United States Patent 7,888,497 (BIOINFORMATICALLY DETECTABLE GROUP OF NOVEL REGULATORY OLIGONUCLEOTIDES AND USES THEREOF) - sequence listing, part 115

SEQ ID NO: 4868956 - DNA, 17 bp, Homo sapiens
ccagatagtgtagctga

SEQ ID NO: 4868957 - DNA, 16 bp, Homo sapiens
ccagatctttcagaaa

SEQ ID NO: 4868958 - DNA, 17 bp, Homo sapiens
ccagcacaaagcactgg

SEQ ID NO: 4868959 - DNA, 21 bp, Homo sapiens
ccagcacaaagcactggcctt

SEQ ID NO: 4868960 - DNA, 17 bp, Homo sapiens
ccagcagctgatgctgt

SEQ ID NO: 4868961 - DNA, 23 bp, Homo sapiens
ccagccagaacgtggctctgctg

SEQ ID NO: 4868962 - DNA, 13 bp, Homo sapiens
ccagcccaaacct

SEQ ID NO: 4868963 - DNA, 21 bp, Homo sapiens
ccagcctgactagaactcctg

SEQ ID NO: 4868964 - DNA, 14 bp, Homo sapiens
ccagcctgcttccc

SEQ ID NO: 4868965 - DNA, 21 bp, Homo sapiens
ccagccttgtacagtctgctc

SEQ ID NO: 4868966 - DNA, 14 bp, Homo sapiens
ccagctccttcgct

SEQ ID NO: 4868967 - DNA, 21 bp, Homo sapiens
ccagcttcggagggcccctgc

SEQ ID NO: 4868968 - DNA, 20 bp, Homo sapiens
ccaggacatgcaataaaatt

SEQ ID NO: 4868969 - DNA, 19 bp, Homo sapiens
ccaggacgtctggggtgtg

SEQ ID NO: 4868970 - DNA, 16 bp, Homo sapiens
ccaggcaagaaagctt

SEQ ID NO: 4868971 - DNA, 18 bp, Homo sapiens
ccaggcagacaaccttgt

SEQ ID NO: 4868972 - DNA, 16 bp, Homo sapiens
ccaggcagggagagag

SEQ ID NO: 4868973 - DNA, 23 bp, Homo sapiens
ccaggcatctgttagcagagtct

SEQ ID NO: 4868974 - DNA, 24 bp, Homo sapiens
ccaggcatctgttagcagagtctg

SEQ ID NO: 4868975 - DNA, 23 bp, Homo sapiens
ccaggccttatctgaaaggccag

SEQ ID NO: 4868976 - DNA, 13 bp, Homo sapiens
ccaggctcaggag

SEQ ID NO: 4868977 - DNA, 13 bp, Homo sapiens
ccagggcagcagg

SEQ ID NO: 4868978 - DNA, 17 bp, Homo sapiens
ccagggcagcaggccag

SEQ ID NO: 4868979 - DNA, 23 bp, Homo sapiens
ccagggcagcaggccagagaaag

SEQ ID NO: 4868980 - DNA, 15 bp, Homo sapiens
ccaggggagccagct

SEQ ID NO: 4868981 - DNA, 21 bp, Homo sapiens
ccaggggagccagctgcttga

SEQ ID NO: 4868982 - DNA, 20 bp, Homo sapiens
ccaggggccaacctcaggct

SEQ ID NO: 4868983 - DNA, 16 bp, Homo sapiens
ccagggtgacaaggcc

SEQ ID NO: 4868984 - DNA, 22 bp, Homo sapiens
ccagggtgacaaggcctgcttg

SEQ ID NO: 4868985 - DNA, 15 bp, Homo sapiens
ccaggtctgactcca

SEQ ID NO: 4868986 - DNA, 18 bp, Homo sapiens
ccaggtctgactccaaag

SEQ ID NO: 4868987 - DNA, 19 bp, Homo sapiens
ccaggtctgactccaaagc

SEQ ID NO: 4868988 - DNA, 16 bp, Homo sapiens
ccaggttgactaagaa

SEQ ID NO: 4868989 - DNA, 17 bp, Homo sapiens
ccaggtttgcaggagcc

SEQ ID NO: 4868990 - DNA, 12 bp, Homo sapiens
ccagtcactgct

SEQ ID NO: 4868991 - DNA, 13 bp, Homo sapiens
ccagtcactgctg

SEQ ID NO: 4868992 - DNA, 17 bp, Homo sapiens
ccagtcagatgaggcaa

SEQ ID NO: 4868993 - DNA, 17 bp, Homo sapiens
ccagtcaggctgcagag

SEQ ID NO: 4868994 - DNA, 14 bp, Homo sapiens
ccagtcccattcct

SEQ ID NO: 4868995 - DNA, 12 bp, Homo sapiens
ccagtctgaccc

SEQ ID NO: 4868996 - DNA, 21 bp, Homo sapiens
ccagtctttcttcactctggc

SEQ ID NO: 4868997 - DNA, 14 bp, Homo sapiens
ccagtgactccagg

SEQ ID NO: 4868998 - DNA, 23 bp, Homo sapiens
ccagtgcctgtgagcatggggcc

SEQ ID NO: 4868999 - DNA, 20 bp, Homo sapiens
ccagtggtggaggtgggtgt

SEQ ID NO: 4869000 - DNA, 23 bp, Homo sapiens
ccagtgttatttattccccagtg

SEQ ID NO: 4869001 - DNA, 16 bp, Homo sapiens
ccagttacttgggctt

SEQ ID NO: 4869002 - DNA, 15 bp, Homo sapiens
ccagttcctcttttg

SEQ ID NO: 4869003 - DNA, 22 bp, Homo sapiens
ccagtttaagccgcagacctgg

SEQ ID NO: 4869004 - DNA, 19 bp, Homo sapiens
ccagttttcggaaacactg

SEQ ID NO: 4869005 - DNA, 15 bp, Homo sapiens
ccataagagaaacct

SEQ ID NO: 4869006 - DNA, 19 bp, Homo sapiens
ccatcatgtgtagagcccc

SEQ ID NO: 4869007 - DNA, 14 bp, Homo sapiens
ccatccctgggggc

SEQ ID NO: 4869008 - DNA, 23 bp, Homo sapiens
ccatcgtattaaaaaacaattaa

SEQ ID NO: 4869009 - DNA, 13 bp, Homo sapiens
ccatctgaagagt

SEQ ID NO: 4869010 - DNA, 14 bp, Homo sapiens
ccatcttctttctt

SEQ ID NO: 4869011 - DNA, 17 bp, Homo sapiens
ccatcttctttcttcca

SEQ ID NO: 4869012 - DNA, 15 bp, Homo sapiens
ccatctttccatcca

SEQ ID NO: 4869013 - DNA, 13 bp, Homo sapiens
ccatgccaataaa

SEQ ID NO: 4869014 - DNA, 11 bp, Homo sapiens
ccatggagcct

SEQ ID NO: 4869015 - DNA, 16 bp, Homo sapiens
ccatggagcctacctc

SEQ ID NO: 4869016 - DNA, 17 bp, Homo sapiens
ccatggctgaagctgga

SEQ ID NO: 4869017 - DNA, 19 bp, Homo sapiens
ccatggctgaagctggagc

SEQ ID NO: 4869018 - DNA, 20 bp, Homo sapiens
ccatggctgaagctggagca

SEQ ID NO: 4869019 - DNA, 21 bp, Homo sapiens
ccatggctgaagctggagcag

SEQ ID NO: 4869020 - DNA, 14 bp, Homo sapiens
ccatgttcccagaa

SEQ ID NO: 4869021 - DNA, 14 bp, Homo sapiens
ccattaaagtcaga

SEQ ID NO: 4869022 - DNA, 23 bp, Homo sapiens
ccattacagaggtattaaaacta

SEQ ID NO: 4869023 - DNA, 16 bp, Homo sapiens
ccattcatccttccat

SEQ ID NO: 4869024 - DNA, 15 bp, Homo sapiens
ccattcccagcctga

SEQ ID NO: 4869025 - DNA, 11 bp, Homo sapiens
ccattcctgat

SEQ ID NO: 4869026 - DNA, 16 bp, Homo sapiens
ccattctattctccag

SEQ ID NO: 4869027 - DNA, 19 bp, Homo sapiens
ccattctattctccagaca

SEQ ID NO: 4869028 - DNA, 14 bp, Homo sapiens
ccatttcaggactc

SEQ ID NO: 4869029 - DNA, 21 bp, Homo sapiens
ccatttcaggactctctccag

SEQ ID NO: 4869030 - DNA, 14 bp, Homo sapiens
ccattttaatttta

SEQ ID NO: 4869031 - DNA, 18 bp, Homo sapiens
ccattttgttattgacta

SEQ ID NO: 4869032 - DNA, 23 bp, Homo sapiens
ccattttgttattgactaacagg

SEQ ID NO: 4869033 - DNA, 14 bp, Homo sapiens
cccaaagagaaaga

SEQ ID NO: 4869034 - DNA, 20 bp, Homo sapiens
cccaacccattcactacagg

SEQ ID NO: 4869035 - DNA, 12 bp, Homo sapiens
cccaacctacat

SEQ ID NO: 4869036 - DNA, 12 bp, Homo sapiens
cccaagcttccc

SEQ ID NO: 4869037 - DNA, 15 bp, Homo sapiens
cccaagcttcccaac

SEQ ID NO: 4869038 - DNA, 18 bp, Homo sapiens
cccaagcttcccaacaga

SEQ ID NO: 4869039 - DNA, 17 bp, Homo sapiens
cccaaggcattctccca

SEQ ID NO: 4869040 - DNA, 16 bp, Homo sapiens
cccaagggggctgctg

SEQ ID NO: 4869041 - DNA, 22 bp, Homo sapiens
cccaagggggctgctgctcctc

SEQ ID NO: 4869042 - DNA, 23 bp, Homo sapiens
cccaaggtgaggtgaactccagg

SEQ ID NO: 4869043 - DNA, 17 bp, Homo sapiens
cccaagttggaagggac

SEQ ID NO: 4869044 - DNA, 21 bp, Homo sapiens
cccaagttggaagggacccca

SEQ ID NO: 4869045 - DNA, 12 bp, Homo sapiens
cccaatgctgct

SEQ ID NO: 4869046 - DNA, 17 bp, Homo sapiens
cccaatgctgcttttgg

SEQ ID NO: 4869047 - DNA, 15 bp, Homo sapiens
cccacaaactccagg

SEQ ID NO: 4869048 - DNA, 16 bp, Homo sapiens
cccacaaactccaggc

SEQ ID NO: 4869049 - DNA, 18 bp, Homo sapiens
cccacaaactccaggctg

SEQ ID NO: 4869050 - DNA, 23 bp, Homo sapiens
cccacatggccatcttctttctt

SEQ ID NO: 4869051 - DNA, 17 bp, Homo sapiens
cccacgcctcaccagcc

SEQ ID NO: 4869052 - DNA, 11 bp, Homo sapiens
cccactccagc

SEQ ID NO: 4869053 - DNA, 13 bp, Homo sapiens
cccactccagctg

SEQ ID NO: 4869054 - DNA, 13 bp, Homo sapiens
cccactcctggga

SEQ ID NO: 4869055 - DNA, 23 bp, Homo sapiens
cccactttcaagaatcagacagc

SEQ ID NO: 4869056 - DNA, 21 bp, Homo sapiens
cccagaaccttgatggggtga

SEQ ID NO: 4869057 - DNA, 20 bp, Homo sapiens
cccagacgtggtgcttctca

SEQ ID NO: 4869058 - DNA, 12 bp, Homo sapiens
cccagagaggga

SEQ ID NO: 4869059 - DNA, 16 bp, Homo sapiens
cccagagatgcctgat

SEQ ID NO: 4869060 - DNA, 15 bp, Homo sapiens
cccagagcagggtct

SEQ ID NO: 4869061 - DNA, 16 bp, Homo sapiens
cccagatacctgtgag

SEQ ID NO: 4869062 - DNA, 17 bp, Homo sapiens
cccagatacctgtgagg

SEQ ID NO: 4869063 - DNA, 18 bp, Homo sapiens
cccagatacctgtgagga

SEQ ID NO: 4869064 - DNA, 22 bp, Homo sapiens
cccagatacctgtgaggactgg

SEQ ID NO: 4869065 - DNA, 17 bp, Homo sapiens
cccagcacaaagcactg

SEQ ID NO: 4869066 - DNA, 18 bp, Homo sapiens
cccagcacaaagcactgg

SEQ ID NO: 4869067 - DNA, 17 bp, Homo sapiens
cccagcccctggtggtg

SEQ ID NO: 4869068 - DNA, 12 bp, Homo sapiens
cccagcttcccg

SEQ ID NO: 4869069 - DNA, 22 bp, Homo sapiens
cccaggcatctgttagcagagt

SEQ ID NO: 4869070 - DNA, 15 bp, Homo sapiens
cccaggggagccagc

SEQ ID NO: 4869071 - DNA, 16 bp, Homo sapiens
cccaggggagccagct

SEQ ID NO: 4869072 - DNA, 19 bp, Homo sapiens
cccaggggagccagctgct

SEQ ID NO: 4869073 - DNA, 22 bp, Homo sapiens
cccagtctttcttcactctggc

SEQ ID NO: 4869074 - DNA, 14 bp, Homo sapiens
cccagtgactccag

SEQ ID NO: 4869075 - DNA, 17 bp, Homo sapiens
cccatcctaggaaccag

SEQ ID NO: 4869076 - DNA, 21 bp, Homo sapiens
cccatcctaggaaccagccaa

SEQ ID NO: 4869077 - DNA, 14 bp, Homo sapiens
cccatgatttgggg

SEQ ID NO: 4869078 - DNA, 15 bp, Homo sapiens
cccatggctgaagct

SEQ ID NO: 4869079 - DNA, 22 bp, Homo sapiens
cccatggctgaagctggagcag

SEQ ID NO: 4869080 - DNA, 15 bp, Homo sapiens
cccattttgcctctg

SEQ ID NO: 4869081 - DNA, 13 bp, Homo sapiens
ccccaagcttccc

SEQ ID NO: 4869082 - DNA, 15 bp, Homo sapiens
ccccaagcttcccaa

SEQ ID NO: 4869083 - DNA, 21 bp, Homo sapiens
ccccacaggcacattaactgt

SEQ ID NO: 4869084 - DNA, 22 bp, Homo sapiens
ccccacaggcacattaactgtt

SEQ ID NO: 4869085 - DNA, 17 bp, Homo sapiens
ccccaccctccatgctc

SEQ ID NO: 4869086 - DNA, 14 bp, Homo sapiens
ccccaccctcccct

SEQ ID NO: 4869087 - DNA, 13 bp, Homo sapiens
ccccactccagct

SEQ ID NO: 4869088 - DNA, 13 bp, Homo sapiens
ccccagaggtgga

SEQ ID NO: 4869089 - DNA, 22 bp, Homo sapiens
ccccagggtttacatgaagcag

SEQ ID NO: 4869090 - DNA, 23 bp, Homo sapiens
ccccagggtttacatgaagcaga

SEQ ID NO: 4869091 - DNA, 19 bp, Homo sapiens
ccccagtgactccagggtg

SEQ ID NO: 4869092 - DNA, 20 bp, Homo sapiens
ccccattcctgatcccatgg

SEQ ID NO: 4869093 - DNA, 14 bp, Homo sapiens
cccccactccagct

SEQ ID NO: 4869094 - DNA, 19 bp, Homo sapiens
cccccagcacaaagcactg

SEQ ID NO: 4869095 - DNA, 13 bp, Homo sapiens
cccccattcccag

SEQ ID NO: 4869096 - DNA, 17 bp, Homo sapiens
cccccattcccagcctg

SEQ ID NO: 4869097 - DNA, 12 bp, Homo sapiens
ccccctcccacc

SEQ ID NO: 4869098 - DNA, 14 bp, Homo sapiens
ccccgagtctccgg

SEQ ID NO: 4869099 - DNA, 14 bp, Homo sapiens
ccccgtcacagcct

SEQ ID NO: 4869100 - DNA, 16 bp, Homo sapiens
ccccgtcacagcctca

SEQ ID NO: 4869101 - DNA, 15 bp, Homo sapiens
cccctaaaccccaag

SEQ ID NO: 4869102 - DNA, 22 bp, Homo sapiens
cccctaaaccccaagcttccca

SEQ ID NO: 4869103 - DNA, 21 bp, Homo sapiens
cccctaaagagcatcctgata

SEQ ID NO: 4869104 - DNA, 13 bp, Homo sapiens
cccctaaagccag

SEQ ID NO: 4869105 - DNA, 16 bp, Homo sapiens
cccctatcctctgagt

SEQ ID NO: 4869106 - DNA, 19 bp, Homo sapiens
cccctcccaggggagccag

SEQ ID NO: 4869107 - DNA, 21 bp, Homo sapiens
cccctcccaggggagccagct

SEQ ID NO: 4869108 - DNA, 21 bp, Homo sapiens
cccctgcgtgggggccagtca

SEQ ID NO: 4869109 - DNA, 21 bp, Homo sapiens
ccccttaccccaaagagaaag

SEQ ID NO: 4869110 - DNA, 13 bp, Homo sapiens
ccccttcaggagc

SEQ ID NO: 4869111 - DNA, 14 bp, Homo sapiens
ccccttcaggagcc

SEQ ID NO: 4869112 - DNA, 16 bp, Homo sapiens
ccccttcaggagcctg

SEQ ID NO: 4869113 - DNA, 20 bp, Homo sapiens
ccccttcaggagcctggcca

SEQ ID NO: 4869114 - DNA, 18 bp, Homo sapiens
ccccttcatccatcctga

SEQ ID NO: 4869115 - DNA, 23 bp, Homo sapiens
cccgcctcgacctccccacccgc

SEQ ID NO: 4869116 - DNA, 15 bp, Homo sapiens
cccgctcccacaccc

SEQ ID NO: 4869117 - DNA, 18 bp, Homo sapiens
cccggttcagacccctgc

SEQ ID NO: 4869118 - DNA, 15 bp, Homo sapiens
cccgtcacagcctca

SEQ ID NO: 4869119 - DNA, 22 bp, Homo sapiens
ccctaaaccccaagcttcccaa

SEQ ID NO: 4869120 - DNA, 18 bp, Homo sapiens
ccctaaagagcatcctga

SEQ ID NO: 4869121 - DNA, 12 bp, Homo sapiens
ccctaaagccag

SEQ ID NO: 4869122 - DNA, 13 bp, Homo sapiens
ccctacagacagc

SEQ ID NO: 4869123 - DNA, 11 bp, Homo sapiens
ccctactgtgg

SEQ ID NO: 4869124 - DNA, 19 bp, Homo sapiens
ccctagggctctccaagca

SEQ ID NO: 4869125 - DNA, 21 bp, Homo sapiens
ccctcacctgtagcagccagt

SEQ ID NO: 4869126 - DNA, 15 bp, Homo sapiens
ccctcatggctctgg

SEQ ID NO: 4869127 - DNA, 21 bp, Homo sapiens
ccctccaaaggaactctagag

SEQ ID NO: 4869128 - DNA, 14 bp, Homo sapiens
ccctccagagaaag

SEQ ID NO: 4869129 - DNA, 13 bp, Homo sapiens
ccctcccacgcct

SEQ ID NO: 4869130 - DNA, 13 bp, Homo sapiens
ccctcctgagggc

SEQ ID NO: 4869131 - DNA, 17 bp, Homo sapiens
ccctctgctctgcctgg

SEQ ID NO: 4869132 - DNA, 20 bp, Homo sapiens
ccctctgctctgcctggagt

SEQ ID NO: 4869133 - DNA, 20 bp, Homo sapiens
ccctctgtccttcccccagc

SEQ ID NO: 4869134 - DNA, 19 bp, Homo sapiens
ccctctttgcacagcatga

SEQ ID NO: 4869135 - DNA, 20 bp, Homo sapiens
ccctgaaatggcctgtccct

SEQ ID NO: 4869136 - DNA, 16 bp, Homo sapiens
ccctgaatccgtactt

SEQ ID NO: 4869137 - DNA, 23 bp, Homo sapiens
ccctgacaggccttcctcctctc

SEQ ID NO: 4869138 - DNA, 17 bp, Homo sapiens
ccctgcaaaactccagg

SEQ ID NO: 4869139 - DNA, 12 bp, Homo sapiens
ccctgcctggag

SEQ ID NO: 4869140 - DNA, 21 bp, Homo sapiens
ccctgctccacgtctgcgccg

SEQ ID NO: 4869141 - DNA, 17 bp, Homo sapiens
ccctgctcccattcctc

SEQ ID NO: 4869142 - DNA, 19 bp, Homo sapiens
ccctggaggtaaacaaaga

SEQ ID NO: 4869143 - DNA, 19 bp, Homo sapiens
ccctgggtttgggagccag

SEQ ID NO: 4869144 - DNA, 21 bp, Homo sapiens
ccctgggtttgggagccagga

SEQ ID NO: 4869145 - DNA, 22 bp, Homo sapiens
ccctgggtttgggagccaggac

SEQ ID NO: 4869146 - DNA, 23 bp, Homo sapiens
ccctgggtttgggagccaggact

SEQ ID NO: 4869147 - DNA, 18 bp, Homo sapiens
ccctgtctcccggctccc

SEQ ID NO: 4869148 - DNA, 18 bp, Homo sapiens
cccttacagcctctgact

SEQ ID NO: 4869149 - DNA, 21 bp, Homo sapiens
cccttactggcttacctcctc

SEQ ID NO: 4869150 - DNA, 12 bp, Homo sapiens
cccttcaggagc

SEQ ID NO: 4869151 - DNA, 14 bp, Homo sapiens
cccttcaggagcct

SEQ ID NO: 4869152 - DNA, 15 bp, Homo sapiens
cccttcaggagcctg

SEQ ID NO: 4869153 - DNA, 22 bp, Homo sapiens
cccttcaggagcctggccaggc

SEQ ID NO: 4869154 - DNA, 23 bp, Homo sapiens
cccttcaggagcctggccaggca

SEQ ID NO: 4869155 - DNA, 19 bp, Homo sapiens
cccttcatccatcctgagc

SEQ ID NO: 4869156 - DNA, 12 bp, Homo sapiens
cccttccctggg

SEQ ID NO: 4869157 - DNA, 13 bp, Homo sapiens
cccttctgggtcc

SEQ ID NO: 4869158 - DNA, 15 bp, Homo sapiens
cccttgcacgtaaac

SEQ ID NO: 4869159 - DNA, 17 bp, Homo sapiens
cccttgtgagagcccat

SEQ ID NO: 4869160 - DNA, 20 bp, Homo sapiens
ccgaagcccaccactggcca

SEQ ID NO: 4869161 - DNA, 14 bp, Homo sapiens
ccgagtctccggga

SEQ ID NO: 4869162 - DNA, 17 bp, Homo sapiens
ccgcagacctggagctt

SEQ ID NO: 4869163 - DNA, 18 bp, Homo sapiens
ccgcagaggtggggtgct

SEQ ID NO: 4869164 - DNA, 21 bp, Homo sapiens
ccgcagaggtggggtgctggg

SEQ ID NO: 4869165 - DNA, 14 bp, Homo sapiens
ccgcccactcctgg

SEQ ID NO: 4869166 - DNA, 15 bp, Homo sapiens
ccgccccgcccctcc

SEQ ID NO: 4869167 - DNA, 15 bp, Homo sapiens
ccgcccctcccacgc

SEQ ID NO: 4869168 - DNA, 15 bp, Homo sapiens
ccgcctccccaagtc

SEQ ID NO: 4869169 - DNA, 17 bp, Homo sapiens
ccggagcaaactctgct

SEQ ID NO: 4869170 - DNA, 17 bp, Homo sapiens
ccggatgaaacttctca

SEQ ID NO: 4869171 - DNA, 19 bp, Homo sapiens
ccggatgaaacttctcagt

SEQ ID NO: 4869172 - DNA, 16 bp, Homo sapiens
ccggccatactgcctt

SEQ ID NO: 4869173 - DNA, 22 bp, Homo sapiens
ccggcgggtgacagctccggga

SEQ ID NO: 4869174 - DNA, 12 bp, Homo sapiens
ccgggactccag

SEQ ID NO: 4869175 - DNA, 18 bp, Homo sapiens
ccggggagaaacccagag

SEQ ID NO: 4869176 - DNA, 22 bp, Homo sapiens
ccgggggcagctctggaggggg

SEQ ID NO: 4869177 - DNA, 16 bp, Homo sapiens
ccgtattcctctccca

SEQ ID NO: 4869178 - DNA, 14 bp, Homo sapiens
ccgtctcctccctc

SEQ ID NO: 4869179 - DNA, 16 bp, Homo sapiens
ccgtgccccttccctg

SEQ ID NO: 4869180 - DNA, 15 bp, Homo sapiens
ccgtggcagcttgct

SEQ ID NO: 4869181 - DNA, 23 bp, Homo sapiens
ccgtttcatttagtcatgtgacc

SEQ ID NO: 4869182 - DNA, 16 bp, Homo sapiens
cctaaagccaggctca

SEQ ID NO: 4869183 - DNA, 15 bp, Homo sapiens
cctaaattatttact

SEQ ID NO: 4869184 - DNA, 21 bp, Homo sapiens
cctaacatctgacctggcatc

SEQ ID NO: 4869185 - DNA, 21 bp, Homo sapiens
cctaactcctataaagtgcct

SEQ ID NO: 4869186 - DNA, 21 bp, Homo sapiens
cctaagaagaaggccagagag

SEQ ID NO: 4869187 - DNA, 20 bp, Homo sapiens
cctaagagatgggactagga

SEQ ID NO: 4869188 - DNA, 19 bp, Homo sapiens
cctaagatgtgttcttatt

SEQ ID NO: 4869189 - DNA, 19 bp, Homo sapiens
cctaatcaaattctgtctg

SEQ ID NO: 4869190 - DNA, 12 bp, Homo sapiens
cctaatgtgttt

SEQ ID NO: 4869191 - DNA, 18 bp, Homo sapiens
cctacactcacctgcact

SEQ ID NO: 4869192 - DNA, 12 bp, Homo sapiens
cctacagacagc

SEQ ID NO: 4869193 - DNA, 15 bp, Homo sapiens
cctacagttttaact

SEQ ID NO: 4869194 - DNA, 17 bp, Homo sapiens
cctacagttttaactgt

SEQ ID NO: 4869195 - DNA, 21 bp, Homo sapiens
cctacattccaccctgttact

SEQ ID NO: 4869196 - DNA, 14 bp, Homo sapiens
cctacctctgtctg

SEQ ID NO: 4869197 - DNA, 15 bp, Homo sapiens
cctacctctgtctga

SEQ ID NO: 4869198 - DNA, 19 bp, Homo sapiens
cctactaggagaggggggc

SEQ ID NO: 4869199 - DNA, 16 bp, Homo sapiens
cctactggtgtaatct

SEQ ID NO: 4869200 - DNA, 17 bp, Homo sapiens
cctactgtgggcaaagt

SEQ ID NO: 4869201 - DNA, 13 bp, Homo sapiens
cctactttctatt

SEQ ID NO: 4869202 - DNA, 18 bp, Homo sapiens
cctagactgctcctgggc

SEQ ID NO: 4869203 - DNA, 20 bp, Homo sapiens
cctagcctatgtctggcaga

SEQ ID NO: 4869204 - DNA, 24 bp, Homo sapiens
cctagctctttgggcctctcctgc

SEQ ID NO: 4869205 - DNA, 22 bp, Homo sapiens
cctagctgtgtgaatacctgct

SEQ ID NO: 4869206 - DNA, 19 bp, Homo sapiens
cctaggatcccgtcttcca

SEQ ID NO: 4869207 - DNA, 21 bp, Homo sapiens
cctagggtcttgggggtcagg

SEQ ID NO: 4869208 - DNA, 14 bp, Homo sapiens
cctagtaagaagac

SEQ ID NO: 4869209 - DNA, 15 bp, Homo sapiens
cctagttaaagaaag

SEQ ID NO: 4869210 - DNA, 16 bp, Homo sapiens
cctagttcaggtccaa

SEQ ID NO: 4869211 - DNA, 14 bp, Homo sapiens
cctataaagtgcct

SEQ ID NO: 4869212 - DNA, 19 bp, Homo sapiens
cctataaagtgcctcggac

SEQ ID NO: 4869213 - DNA, 17 bp, Homo sapiens
cctatatcctccttctc

SEQ ID NO: 4869214 - DNA, 14 bp, Homo sapiens
cctatctcttcctg

SEQ ID NO: 4869215 - DNA, 16 bp, Homo sapiens
cctatctcttcctgtc

SEQ ID NO: 4869216 - DNA, 15 bp, Homo sapiens
cctatgtctggcaga

SEQ ID NO: 4869217 - DNA, 21 bp, Homo sapiens
cctcaccgagcatgcttccct

SEQ ID NO: 4869218 - DNA, 15 bp, Homo sapiens
cctcacctgtagcag

SEQ ID NO: 4869219 - DNA, 14 bp, Homo sapiens
cctcagctctctgg

SEQ ID NO: 4869220 - DNA, 18 bp, Homo sapiens
cctcaggacccatccctg

SEQ ID NO: 4869221 - DNA, 18 bp, Homo sapiens
cctcaggccaagggacca

SEQ ID NO: 4869222 - DNA, 12 bp, Homo sapiens
cctcaggctccg

SEQ ID NO: 4869223 - DNA, 21 bp, Homo sapiens
cctcaggctccgggcaccagg

SEQ ID NO: 4869224 - DNA, 19 bp, Homo sapiens
cctcagggtggggggtgac

SEQ ID NO: 4869225 - DNA, 15 bp, Homo sapiens
cctcatcactggact

SEQ ID NO: 4869226 - DNA, 17 bp, Homo sapiens
cctcatcactggactgc

SEQ ID NO: 4869227 - DNA, 15 bp, Homo sapiens
cctcattttgcttcc

SEQ ID NO: 4869228 - DNA, 17 bp, Homo sapiens
cctcattttgcttccca

SEQ ID NO: 4869229 - DNA, 20 bp, Homo sapiens
cctccaaaggaactctagag

SEQ ID NO: 4869230 - DNA, 14 bp, Homo sapiens
cctccaagggatct

SEQ ID NO: 4869231 - DNA, 17 bp, Homo sapiens
cctccagccctgggcac

SEQ ID NO: 4869232 - DNA, 14 bp, Homo sapiens
cctccagctgggat

SEQ ID NO: 4869233 - DNA, 19 bp, Homo sapiens
cctccaggaccttgcttcc

SEQ ID NO: 4869234 - DNA, 23 bp, Homo sapiens
cctccatgctcctcacctgtcta

SEQ ID NO: 4869235 - DNA, 22 bp, Homo sapiens
cctccattcatccttccatcca

SEQ ID NO: 4869236 - DNA, 23 bp, Homo sapiens
cctccattcatccttccatccat

SEQ ID NO: 4869237 - DNA, 20 bp, Homo sapiens
cctcccaaggcattctccca

SEQ ID NO: 4869238 - DNA, 19 bp, Homo sapiens
cctcccaaggtcctctcag

SEQ ID NO: 4869239 - DNA, 19 bp, Homo sapiens
cctcccacgcctcaccagc

SEQ ID NO: 4869240 - DNA, 21 bp, Homo sapiens
cctcccaggggagccagctgc

SEQ ID NO: 4869241 - DNA, 22 bp, Homo sapiens
cctcccaggggagccagctgct

SEQ ID NO: 4869242 - DNA, 23 bp, Homo sapiens
cctcccaggggagccagctgctt

SEQ ID NO: 4869243 - DNA, 12 bp, Homo sapiens
cctccccagctc

SEQ ID NO: 4869244 - DNA, 14 bp, Homo sapiens
cctcccctgggcag

SEQ ID NO: 4869245 - DNA, 23 bp, Homo sapiens
cctccctccggccatactgcctt

SEQ ID NO: 4869246 - DNA, 22 bp, Homo sapiens
cctccggcgggtgacagctccg

SEQ ID NO: 4869247 - DNA, 19 bp, Homo sapiens
cctcctattctataaaact

SEQ ID NO: 4869248 - DNA, 18 bp, Homo sapiens
cctccttctgcagtcaga

SEQ ID NO: 4869249 - DNA, 13 bp, Homo sapiens
cctcgagagcctt

SEQ ID NO: 4869250 - DNA, 21 bp, Homo sapiens
cctcggggagcgttctaaata

SEQ ID NO: 4869251 - DNA, 16 bp, Homo sapiens
cctctaagtgctgctg

SEQ ID NO: 4869252 - DNA, 17 bp, Homo sapiens
cctctaagtgctgctgt

SEQ ID NO: 4869253 - DNA, 18 bp, Homo sapiens
cctctaagtgctgctgtg

SEQ ID NO: 4869254 - DNA, 19 bp, Homo sapiens
cctctaagtgctgctgtgg

SEQ ID NO: 4869255 - DNA, 17 bp, Homo sapiens
cctctaggccctgtgag

SEQ ID NO: 4869256 - DNA, 22 bp, Homo sapiens
cctctcagttctctcccttcct

SEQ ID NO: 4869257 - DNA, 22 bp, Homo sapiens
cctctcctgccctctgctctgc

SEQ ID NO: 4869258 - DNA, 23 bp, Homo sapiens
cctctccttcatgacagcctcca

SEQ ID NO: 4869259 - DNA, 16 bp, Homo sapiens
cctctcggctgccagg

SEQ ID NO: 4869260 - DNA, 21 bp, Homo sapiens
cctctcggctgccaggggctc

SEQ ID NO: 4869261 - DNA, 23 bp, Homo sapiens
cctctctccttatagacacttgc

SEQ ID NO: 4869262 - DNA, 22 bp, Homo sapiens
cctctgacttaagctgcctcaa

SEQ ID NO: 4869263 - DNA, 19 bp, Homo sapiens
cctctgccaaaggatgtga

SEQ ID NO: 4869264 - DNA, 11 bp, Homo sapiens
cctctgcctgg

SEQ ID NO: 4869265 - DNA, 17 bp, Homo sapiens
cctctgctctgcctgga

SEQ ID NO: 4869266 - DNA, 18 bp, Homo sapiens
cctctgctctgcctggag

SEQ ID NO: 4869267 - DNA, 11 bp, Homo sapiens
cctctgggacc

SEQ ID NO: 4869268 - DNA, 16 bp, Homo sapiens
cctctgggacccacag

SEQ ID NO: 4869269 - DNA, 20 bp, Homo sapiens
cctctgggacccacagaact

SEQ ID NO: 4869270 - DNA, 18 bp, Homo sapiens
cctctgtccttcccccag

SEQ ID NO: 4869271 - DNA, 20 bp, Homo sapiens
cctctgtccttcccccagca

SEQ ID NO: 4869272 - DNA, 17 bp, Homo sapiens
cctcttgttcctgaaat

SEQ ID NO: 4869273 - DNA, 15 bp, Homo sapiens
cctgaaatggcctgt

SEQ ID NO: 4869274 - DNA, 20 bp, Homo sapiens
cctgaaatggcctgtcccta

SEQ ID NO: 4869275 - DNA, 22 bp, Homo sapiens
cctgaaatggcctgtccctagg

SEQ ID NO: 4869276 - DNA, 18 bp, Homo sapiens
cctgaccccattcctgat

SEQ ID NO: 4869277 - DNA, 17 bp, Homo sapiens
cctgactagaactcctg

SEQ ID NO: 4869278 - DNA, 17 bp, Homo sapiens
cctgactaggttctgta

SEQ ID NO: 4869279 - DNA, 19 bp, Homo sapiens
cctgactaggttctgtaga

SEQ ID NO: 4869280 - DNA, 15 bp, Homo sapiens
cctgactcagtgacc

SEQ ID NO: 4869281 - DNA, 18 bp, Homo sapiens
cctgactcagtgaccagt

SEQ ID NO: 4869282 - DNA, 14 bp, Homo sapiens
cctgagaaacacta

SEQ ID NO: 4869283 - DNA, 13 bp, Homo sapiens
cctgagaattgag

SEQ ID NO: 4869284 - DNA, 16 bp, Homo sapiens
cctgatggagtgtgca

SEQ ID NO: 4869285 - DNA, 15 bp, Homo sapiens
cctgcagcagtcgcc

SEQ ID NO: 4869286 - DNA, 15 bp, Homo sapiens
cctgcatagccggtg

SEQ ID NO: 4869287 - DNA, 14 bp, Homo sapiens
cctgccaaggagca

SEQ ID NO: 4869288 - DNA, 22 bp, Homo sapiens
cctgccaaggagcatccttggc

SEQ ID NO: 4869289 - DNA, 15 bp, Homo sapiens
cctgccagctgcagc

SEQ ID NO: 4869290 - DNA, 23 bp, Homo sapiens
cctgccctctgctctgcctggag

SEQ ID NO: 4869291 - DNA, 17 bp, Homo sapiens
cctgcccttcctcctga

SEQ ID NO: 4869292 - DNA, 14 bp, Homo sapiens
cctgcctggaggct

SEQ ID NO: 4869293 - DNA, 20 bp, Homo sapiens
cctgcctggaggctcctcta

SEQ ID NO: 4869294 - DNA, 22 bp, Homo sapiens
cctgcctggaggctcctctagg

SEQ ID NO: 4869295 - DNA, 23 bp, Homo sapiens
cctgcctggaggctcctctaggc

SEQ ID NO: 4869296 - DNA, 17 bp, Homo sapiens
cctgctcaactctaccc

SEQ ID NO: 4869297 - DNA, 21 bp, Homo sapiens
cctgctcaactctacccctgc

SEQ ID NO: 4869298 - DNA, 15 bp, Homo sapiens
cctgctgctgctact

SEQ ID NO: 4869299 - DNA, 22 bp, Homo sapiens
cctgcttaatcttcaaagcctt

SEQ ID NO: 4869300 - DNA, 16 bp, Homo sapiens
cctgcttcccacaact

SEQ ID NO: 4869301 - DNA, 17 bp, Homo sapiens
cctgcttgactttccag

SEQ ID NO: 4869302 - DNA, 19 bp, Homo sapiens
cctgcttgactttccagaa

SEQ ID NO: 4869303 - DNA, 20 bp, Homo sapiens
cctgcttgactttccagaat

SEQ ID NO: 4869304 - DNA, 15 bp, Homo sapiens
cctgctttttggaaa

SEQ ID NO: 4869305 - DNA, 20 bp, Homo sapiens
cctgctttttggaaagtcag

SEQ ID NO: 4869306 - DNA, 21 bp, Homo sapiens
cctggacctgccctgggccac

SEQ ID NO: 4869307 - DNA, 23 bp, Homo sapiens
cctggagcaggcccaatgctgct

SEQ ID NO: 4869308 - DNA, 12 bp, Homo sapiens
cctggagctcag

SEQ ID NO: 4869309 - DNA, 23 bp, Homo sapiens
cctggagcttcagccaggtctga

SEQ ID NO: 4869310 - DNA, 13 bp, Homo sapiens
cctggaggctcct

SEQ ID NO: 4869311 - DNA, 23 bp, Homo sapiens
cctggaggctcctctaggccctg

SEQ ID NO: 4869312 - DNA, 17 bp, Homo sapiens
cctggcagatgggggcc

SEQ ID NO: 4869313 - DNA, 13 bp, Homo sapiens
cctggccaggcag

SEQ ID NO: 4869314 - DNA, 21 bp, Homo sapiens
cctggcctagaaagggcaagg

SEQ ID NO: 4869315 - DNA, 12 bp, Homo sapiens
cctgggaagctg

SEQ ID NO: 4869316 - DNA, 14 bp, Homo sapiens
cctgggaaggccag

SEQ ID NO: 4869317 - DNA, 23 bp, Homo sapiens
cctgggcatgcccagcccctggt

SEQ ID NO: 4869318 - DNA, 18 bp, Homo sapiens
cctgggcattagcaaggc

SEQ ID NO: 4869319 - DNA, 19 bp, Homo sapiens
cctgggcattagcaaggca

SEQ ID NO: 4869320 - DNA, 21 bp, Homo sapiens
cctggggcctccagaagctgc

SEQ ID NO: 4869321 - DNA, 14 bp, Homo sapiens
cctgggtgacattt

SEQ ID NO: 4869322 - DNA, 17 bp, Homo sapiens
cctgggtttgggagcca

SEQ ID NO: 4869323 - DNA, 13 bp, Homo sapiens
cctggtttctggg

SEQ ID NO: 4869324 - DNA, 24 bp, Homo sapiens
cctgtccctagggctctccaagca

SEQ ID NO: 4869325 - DNA, 21 bp, Homo sapiens
cctgtctcccggctcccctcc

SEQ ID NO: 4869326 - DNA, 13 bp, Homo sapiens
cctgtcttctttc

SEQ ID NO: 4869327 - DNA, 21 bp, Homo sapiens
cctgtcttctttctccatgga

SEQ ID NO: 4869328 - DNA, 18 bp, Homo sapiens
cctgtgagcacaaagaag

SEQ ID NO: 4869329 - DNA, 19 bp, Homo sapiens
cctgtgagcatggggccag

SEQ ID NO: 4869330 - DNA, 13 bp, Homo sapiens
cctgtgaggactg

SEQ ID NO: 4869331 - DNA, 11 bp, Homo sapiens
cctgtgaggat

SEQ ID NO: 4869332 - DNA, 13 bp, Homo sapiens
cctgtgagtaggc

SEQ ID NO: 4869333 - DNA, 19 bp, Homo sapiens
cctgtggcactcagggagc

SEQ ID NO: 4869334 - DNA, 13 bp, Homo sapiens
cctgtggcaggag

SEQ ID NO: 4869335 - DNA, 23 bp, Homo sapiens
cctgtggtcatgtgagtctggga

SEQ ID NO: 4869336 - DNA, 15 bp, Homo sapiens
cctgtgtgaccctgg

SEQ ID NO: 4869337 - DNA, 20 bp, Homo sapiens
cctgtgtgaccctgggcagt

SEQ ID NO: 4869338 - DNA, 20 bp, Homo sapiens
cctgttcatgtttttgtttt

SEQ ID NO: 4869339 - DNA, 14 bp, Homo sapiens
ccttaatttaactt

SEQ ID NO: 4869340 - DNA, 23 bp, Homo sapiens
ccttacttcaaagtgcctgggct

SEQ ID NO: 4869341 - DNA, 16 bp, Homo sapiens
ccttagagctcttgtg

SEQ ID NO: 4869342 - DNA, 20 bp, Homo sapiens
ccttaggtttttttccttct

SEQ ID NO: 4869343 - DNA, 18 bp, Homo sapiens
ccttcaagggtcagggtg

SEQ ID NO: 4869344 - DNA, 22 bp, Homo sapiens
ccttcaggagcctggccaggca

SEQ ID NO: 4869345 - DNA, 15 bp, Homo sapiens
ccttcaggcagctga

SEQ ID NO: 4869346 - DNA, 15 bp, Homo sapiens
ccttcatccatcctg

SEQ ID NO: 4869347 - DNA, 17 bp, Homo sapiens
ccttcatgacagcctcc

SEQ ID NO: 4869348 - DNA, 18 bp, Homo sapiens
ccttcatgacagcctcca

SEQ ID NO: 4869349 - DNA, 23 bp, Homo sapiens
ccttccatccatctttccatcca

SEQ ID NO: 4869350 - DNA, 21 bp, Homo sapiens
ccttcccctaaaccccaagct

SEQ ID NO: 4869351 - DNA, 19 bp, Homo sapiens
ccttccctttacagctctc

SEQ ID NO: 4869352 - DNA, 23 bp, Homo sapiens
ccttccctttctaagcaaccaca

SEQ ID NO: 4869353 - DNA, 14 bp, Homo sapiens
ccttcctcctctca

SEQ ID NO: 4869354 - DNA, 21 bp, Homo sapiens
ccttcctcttgtctgatttct

SEQ ID NO: 4869355 - DNA, 14 bp, Homo sapiens
ccttcctgctgctg

SEQ ID NO: 4869356 - DNA, 14 bp, Homo sapiens
ccttcgtttatatt

SEQ ID NO: 4869357 - DNA, 16 bp, Homo sapiens
ccttctaaattcccaa

SEQ ID NO: 4869358 - DNA, 17 bp, Homo sapiens
ccttctagttgccccca

SEQ ID NO: 4869359 - DNA, 22 bp, Homo sapiens
ccttctccctagctcctcccct

SEQ ID NO: 4869360 - DNA, 14 bp, Homo sapiens
ccttctctttgggg

SEQ ID NO: 4869361 - DNA, 14 bp, Homo sapiens
ccttctgggtccag

SEQ ID NO: 4869362 - DNA, 18 bp, Homo sapiens
ccttgaaactttgggaaa

SEQ ID NO: 4869363 - DNA, 19 bp, Homo sapiens
ccttgaaactttgggaaaa

SEQ ID NO: 4869364 - DNA, 22 bp, Homo sapiens
ccttgaccaaaatcagctttgt

SEQ ID NO: 4869365 - DNA, 16 bp, Homo sapiens
ccttgagagttccggg

SEQ ID NO: 4869366 - DNA, 18 bp, Homo sapiens
ccttgagagttccgggga

SEQ ID NO: 4869367 - DNA, 14 bp, Homo sapiens
ccttgagtctctga

SEQ ID NO: 4869368 - DNA, 13 bp, Homo sapiens
ccttgatggggtg

SEQ ID NO: 4869369 - DNA, 14 bp, Homo sapiens
ccttgattcattct

SEQ ID NO: 4869370 - DNA, 14 bp, Homo sapiens
ccttgcaacccaag

SEQ ID NO: 4869371 - DNA, 21 bp, Homo sapiens
ccttgcagatatctgcatgtg

SEQ ID NO: 4869372 - DNA, 18 bp, Homo sapiens
ccttgcaggggtcccccc

SEQ ID NO: 4869373 - DNA, 13 bp, Homo sapiens
ccttgcttcctga

SEQ ID NO: 4869374 - DNA, 16 bp, Homo sapiens
ccttgcttccttctca

SEQ ID NO: 4869375 - DNA, 17 bp, Homo sapiens
ccttgcttccttctcat

SEQ ID NO: 4869376 - DNA, 12 bp, Homo sapiens
ccttgcttctgt

SEQ ID NO: 4869377 - DNA, 20 bp, Homo sapiens
ccttgcttctgtatttcctt

SEQ ID NO: 4869378 - DNA, 16 bp, Homo sapiens
ccttggacattttatg

SEQ ID NO: 4869379 - DNA, 15 bp, Homo sapiens
ccttggattttcctg

SEQ ID NO: 4869380 - DNA, 15 bp, Homo sapiens
ccttgtacagtctgc

SEQ ID NO: 4869381 - DNA, 20 bp, Homo sapiens
ccttgtacagtctgctcctc

SEQ ID NO: 4869382 - DNA, 21 bp, Homo sapiens
ccttgtacagtctgctcctct

SEQ ID NO: 4869383 - DNA, 21 bp, Homo sapiens
ccttgtttctgccctgccagc

SEQ ID NO: 4869384 - DNA, 22 bp, Homo sapiens
ccttgtttctgccctgccagct

SEQ ID NO: 4869385 - DNA, 22 bp, Homo sapiens
cctttacagctctcctccagcc

SEQ ID NO: 4869386 - DNA, 20 bp, Homo sapiens
cctttcctgatgcccctgac

SEQ ID NO: 4869387 - DNA, 18 bp, Homo sapiens
ccttttaagcatgtgatg

SEQ ID NO: 4869388 - DNA, 13 bp, Homo sapiens
ccttttcaggaga

SEQ ID NO: 4869389 - DNA, 15 bp, Homo sapiens
cgaacagccttagag

SEQ ID NO: 4869390 - DNA, 16 bp, Homo sapiens
cgaagactgagccaga

SEQ ID NO: 4869391 - DNA, 19 bp, Homo sapiens
cgaagtctttgccttctct

SEQ ID NO: 4869392 - DNA, 15 bp, Homo sapiens
cgaatctcaaaatta

SEQ ID NO: 4869393 - DNA, 16 bp, Homo sapiens
cgacctccccacccgc

SEQ ID NO: 4869394 - DNA, 18 bp, Homo sapiens
cgactactgctcctgtgg

SEQ ID NO: 4869395 - DNA, 13 bp, Homo sapiens
cgactcagcctca

SEQ ID NO: 4869396 - DNA, 19 bp, Homo sapiens
cgactgtcagtggggcagc

SEQ ID NO: 4869397 - DNA, 16 bp, Homo sapiens
cgagagatcaaagatg

SEQ ID NO: 4869398 - DNA, 17 bp, Homo sapiens
cgagggatgatgaggga

SEQ ID NO: 4869399 - DNA, 17 bp, Homo sapiens
cgatgcatttaataaag

SEQ ID NO: 4869400 - DNA, 14 bp, Homo sapiens
cgcagacctggagc

SEQ ID NO: 4869401 - DNA, 15 bp, Homo sapiens
cgcagacctggagct

SEQ ID NO: 4869402 - DNA, 18 bp, Homo sapiens
cgcagagaaatgccccag

SEQ ID NO: 4869403 - DNA, 12 bp, Homo sapiens
cgcagaggtggg

SEQ ID NO: 4869404 - DNA, 19 bp, Homo sapiens
cgcaggtgctcatgctgct

SEQ ID NO: 4869405 - DNA, 16 bp, Homo sapiens
cgccagcgtgtggagc

SEQ ID NO: 4869406 - DNA, 22 bp, Homo sapiens
cgccagcgtgtggagcagagct

SEQ ID NO: 4869407 - DNA, 15 bp, Homo sapiens
cgccagtcactgctg

SEQ ID NO: 4869408 - DNA, 17 bp, Homo sapiens
cgccagtcactgctgca

SEQ ID NO: 4869409 - DNA, 14 bp, Homo sapiens
cgcccccacctcca

SEQ ID NO: 4869410 - DNA, 16 bp, Homo sapiens
cgcccctcccacgcct

SEQ ID NO: 4869411 - DNA, 13 bp, Homo sapiens
cgccgccgccgct

SEQ ID NO: 4869412 - DNA, 15 bp, Homo sapiens
cgccgccgctgccct

SEQ ID NO: 4869413 - DNA, 22 bp, Homo sapiens
cgccgctgcccttgggtccccc

SEQ ID NO: 4869414 - DNA, 13 bp, Homo sapiens
cgcctcaccagcc

SEQ ID NO: 4869415 - DNA, 21 bp, Homo sapiens
cgcgcgcccaccctccggcgg

SEQ ID NO: 4869416 - DNA, 20 bp, Homo sapiens
cgctccccttaccccagtca

SEQ ID NO: 4869417 - DNA, 20 bp, Homo sapiens
cgctgcccttgggtcccccc

SEQ ID NO: 4869418 - DNA, 18 bp, Homo sapiens
cggaaagaagagcgagag

SEQ ID NO: 4869419 - DNA, 17 bp, Homo sapiens
cggacccttctgggtcc

SEQ ID NO: 4869420 - DNA, 23 bp, Homo sapiens
cggacccttctgggtccagggag

SEQ ID NO: 4869421 - DNA, 17 bp, Homo sapiens
cggagcaaactctgctg

SEQ ID NO: 4869422 - DNA, 13 bp, Homo sapiens
cggaggctgctcg

SEQ ID NO: 4869423 - DNA, 16 bp, Homo sapiens
cggagtccactcccag

SEQ ID NO: 4869424 - DNA, 20 bp, Homo sapiens
cggagtccactcccagtgct

SEQ ID NO: 4869425 - DNA, 13 bp, Homo sapiens
cggcaaaaggaaa

SEQ ID NO: 4869426 - DNA, 21 bp, Homo sapiens
cggcccttacctttcctgatg

SEQ ID NO: 4869427 - DNA, 15 bp, Homo sapiens
cggcctgagaaacac

SEQ ID NO: 4869428 - DNA, 20 bp, Homo sapiens
cggctgccaggggctctgtg

SEQ ID NO: 4869429 - DNA, 20 bp, Homo sapiens
cggggcagggggtatgcaga

SEQ ID NO: 4869430 - DNA, 22 bp, Homo sapiens
cggggcagggggtatgcagagc

SEQ ID NO: 4869431 - DNA, 16 bp, Homo sapiens
cgggggcagtgtgagg

SEQ ID NO: 4869432 - DNA, 15 bp, Homo sapiens
cggggtcccctctgt

SEQ ID NO: 4869433 - DNA, 18 bp, Homo sapiens
cggggtcccctctgtgct

SEQ ID NO: 4869434 - DNA, 18 bp, Homo sapiens
cggggtgtgtcatttcta

SEQ ID NO: 4869435 - DNA, 20 bp, Homo sapiens
cgggtgggcggcacagcctt

SEQ ID NO: 4869436 - DNA, 15 bp, Homo sapiens
cgggttctcccatga

SEQ ID NO: 4869437 - DNA, 15 bp, Homo sapiens
cggtggaggcagagg

SEQ ID NO: 4869438 - DNA, 15 bp, Homo sapiens
cggttctaaggctca

SEQ ID NO: 4869439 - DNA, 16 bp, Homo sapiens
cggtttcccggccctt

SEQ ID NO: 4869440 - DNA, 12 bp, Homo sapiens
cgtaatttaact

SEQ ID NO: 4869441 - DNA, 15 bp, Homo sapiens
cgtattaaaaaacaa

SEQ ID NO: 4869442 - DNA, 13 bp, Homo sapiens
cgtccatctccct

SEQ ID NO: 4869443 - DNA, 13 bp, Homo sapiens
cgtcctctcggct

SEQ ID NO: 4869444 - DNA, 18 bp, Homo sapiens
cgtcctctcggctgccag

SEQ ID NO: 4869445 - DNA, 13 bp, Homo sapiens
cgtctcctccctc

SEQ ID NO: 4869446 - DNA, 17 bp, Homo sapiens
cgtcttctccctattcc

SEQ ID NO: 4869447 - DNA, 15 bp, Homo sapiens
cgtgatgggctaggc

SEQ ID NO: 4869448 - DNA, 15 bp, Homo sapiens
cgtggatcgagtgta

SEQ ID NO: 4869449 - DNA, 14 bp, Homo sapiens
cgtggctctgctgg

SEQ ID NO: 4869450 - DNA, 15 bp, Homo sapiens
cgtggctctgctggc

SEQ ID NO: 4869451 - DNA, 20 bp, Homo sapiens
cgtggggaacggaggaggac

SEQ ID NO: 4869452 - DNA, 17 bp, Homo sapiens
cgtgtgtgacactgatg

SEQ ID NO: 4869453 - DNA, 14 bp, Homo sapiens
cgttctaaatatga

SEQ ID NO: 4869454 - DNA, 15 bp, Homo sapiens
cgttgtctggttgct

SEQ ID NO: 4869455 - DNA, 21 bp, Homo sapiens
cgtttaaggtgagcataaatc

SEQ ID NO: 4869456 - DNA, 21 bp, Homo sapiens
cgtttatatttttttaactgt

SEQ ID NO: 4869457 - DNA, 23 bp, Homo sapiens
cgtttcctttttgttgatgagga

SEQ ID NO: 4869458 - DNA, 14 bp, Homo sapiens
cgtttgtgtttcta

SEQ ID NO: 4869459 - DNA, 23 bp, Homo sapiens
ctaaaaaggcccttagagggaat

SEQ ID NO: 4869460 - DNA, 15 bp, Homo sapiens
ctaaaaagtataaaa

SEQ ID NO: 4869461 - DNA, 17 bp, Homo sapiens
ctaaaaagtataaaata

SEQ ID NO: 4869462 - DNA, 18 bp, Homo sapiens
ctaaaagttctcaatgta

SEQ ID NO: 4869463 - DNA, 15 bp, Homo sapiens
ctaaagccaggctca

SEQ ID NO: 4869464 - DNA, 22 bp, Homo sapiens
ctaaagccaggctcaggagaag

SEQ ID NO: 4869465 - DNA, 16 bp, Homo sapiens
ctaaaggaaaaaactt

SEQ ID NO: 4869466 - DNA, 21 bp, Homo sapiens
ctaaatgtgcaatagaaggtg

SEQ ID NO: 4869467 - DNA, 23 bp, Homo sapiens
ctaaatgtgtaataatgtaacat

SEQ ID NO: 4869468 - DNA, 14 bp, Homo sapiens
ctaaattatttact

SEQ ID NO: 4869469 - DNA, 13 bp, Homo sapiens
ctaacccagtctt

SEQ ID NO: 4869470 - DNA, 17 bp, Homo sapiens
ctaacccagtctttctt

SEQ ID NO: 4869471 - DNA, 15 bp, Homo sapiens
ctaacctgggacctg

SEQ ID NO: 4869472 - DNA, 18 bp, Homo sapiens
ctaacctgggacctgtgg

SEQ ID NO: 4869473 - DNA, 14 bp, Homo sapiens
ctaactcaaataca

SEQ ID NO: 4869474 - DNA, 24 bp, Homo sapiens
ctaactcctataaagtgcctcgga

SEQ ID NO: 4869475 - DNA, 18 bp, Homo sapiens
ctaacttggggaaggggc

SEQ ID NO: 4869476 - DNA, 20 bp, Homo sapiens
ctaagaaatgccagtggtgg

SEQ ID NO: 4869477 - DNA, 16 bp, Homo sapiens
ctaagaagaaggccag

SEQ ID NO: 4869478 - DNA, 17 bp, Homo sapiens
ctaagaagaaggccaga

SEQ ID NO: 4869479 - DNA, 13 bp, Homo sapiens
ctaagactatata

SEQ ID NO: 4869480 - DNA, 15 bp, Homo sapiens
ctaagcaaccacact

SEQ ID NO: 4869481 - DNA, 20 bp, Homo sapiens
ctaagcaaccacactgcttg

SEQ ID NO: 4869482 - DNA, 13 bp, Homo sapiens
ctaaggagaaatg

SEQ ID NO: 4869483 - DNA, 23 bp, Homo sapiens
ctaaggccatggcatcccttttt

SEQ ID NO: 4869484 - DNA, 16 bp, Homo sapiens
ctaaggctcctgtttt

SEQ ID NO: 4869485 - DNA, 13 bp, Homo sapiens
ctaagtgatataa

SEQ ID NO: 4869486 - DNA, 16 bp, Homo sapiens
ctaagtgatataaatc

SEQ ID NO: 4869487 - DNA, 17 bp, Homo sapiens
ctaagtgctaagtgctt

SEQ ID NO: 4869488 - DNA, 17 bp, Homo sapiens
ctaagtgctgctgtgga

SEQ ID NO: 4869489 - DNA, 21 bp, Homo sapiens
ctaattaatatattaaaattc

SEQ ID NO: 4869490 - DNA, 14 bp, Homo sapiens
ctaattatttaatt

SEQ ID NO: 4869491 - DNA, 15 bp, Homo sapiens
ctaattgtgccccta

SEQ ID NO: 4869492 - DNA, 13 bp, Homo sapiens
ctacaatctcttt

SEQ ID NO: 4869493 - DNA, 13 bp, Homo sapiens
ctacacaaagcag

SEQ ID NO: 4869494 - DNA, 15 bp, Homo sapiens
ctacagacagcttac

SEQ ID NO: 4869495 - DNA, 15 bp, Homo sapiens
ctacagttttaactg

SEQ ID NO: 4869496 - DNA, 17 bp, Homo sapiens
ctacagttttaactgtg

SEQ ID NO: 4869497 - DNA, 18 bp, Homo sapiens
ctacatgtattgcacatt

SEQ ID NO: 4869498 - DNA, 13 bp, Homo sapiens
ctacatgtgagtg

SEQ ID NO: 4869499 - DNA, 11 bp, Homo sapiens
ctacattccac

SEQ ID NO: 4869500 - DNA, 17 bp, Homo sapiens
ctaccagggtctctcag

SEQ ID NO: 4869501 - DNA, 21 bp, Homo sapiens
ctaccagggtctctcagggat

SEQ ID NO: 4869502 - DNA, 23 bp, Homo sapiens
ctacccctgctcccattcctccc

SEQ ID NO: 4869503 - DNA, 16 bp, Homo sapiens
ctactagtgtgactcc

SEQ ID NO: 4869504 - DNA, 17 bp, Homo sapiens
ctactagtgtgactcct

SEQ ID NO: 4869505 - DNA, 19 bp, Homo sapiens
ctactatttaaatccttgg

SEQ ID NO: 4869506 - DNA, 18 bp, Homo sapiens
ctactgaacacatgtgta

SEQ ID NO: 4869507 - DNA, 14 bp, Homo sapiens
ctactgctcctgtg

SEQ ID NO: 4869508 - DNA, 21 bp, Homo sapiens
ctactgctcctgtggcaggag

SEQ ID NO: 4869509 - DNA, 23 bp, Homo sapiens
ctactgctgctgctgctgccgcc

SEQ ID NO: 4869510 - DNA, 23 bp, Homo sapiens
ctactggtgtaatctcaatgcaa

SEQ ID NO: 4869511 - DNA, 15 bp, Homo sapiens
ctactggttacctgg

SEQ ID NO: 4869512 - DNA, 20 bp, Homo sapiens
ctactggttacctggagaag

SEQ ID NO: 4869513 - DNA, 22 bp, Homo sapiens
ctactgtaatgctgcctcagga

SEQ ID NO: 4869514 - DNA, 20 bp, Homo sapiens
ctactgttatcagtaatgct

SEQ ID NO: 4869515 - DNA, 17 bp, Homo sapiens
ctacttctgtaattgtg

SEQ ID NO: 4869516 - DNA, 13 bp, Homo sapiens
ctagaactcctgt

SEQ ID NO: 4869517 - DNA, 13 bp, Homo sapiens
ctagaatcacagc

SEQ ID NO: 4869518 - DNA, 15 bp, Homo sapiens
ctagactgctcctgg

SEQ ID NO: 4869519 - DNA, 17 bp, Homo sapiens
ctagagggcgagggatg

SEQ ID NO: 4869520 - DNA, 21 bp, Homo sapiens
ctagattgctaaggagctgat

SEQ ID NO: 4869521 - DNA, 20 bp, Homo sapiens
ctagccccaaaccagcccag

SEQ ID NO: 4869522 - DNA, 13 bp, Homo sapiens
ctagcctctggac

SEQ ID NO: 4869523 - DNA, 20 bp, Homo sapiens
ctagcctctggactggaaag

SEQ ID NO: 4869524 - DNA, 21 bp, Homo sapiens
ctagcctctggactggaaagc

SEQ ID NO: 4869525 - DNA, 14 bp, Homo sapiens
ctagccttcccagc

SEQ ID NO: 4869526 - DNA, 15 bp, Homo sapiens
ctagccttcccagct

SEQ ID NO: 4869527 - DNA, 14 bp, Homo sapiens
ctagctaattattt

SEQ ID NO: 4869528 - DNA, 15 bp, Homo sapiens
ctagctaattattta

SEQ ID NO: 4869529 - DNA, 16 bp, Homo sapiens
ctaggcactgagcagg

SEQ ID NO: 4869530 - DNA, 16 bp, Homo sapiens
ctaggccctgtgagca

SEQ ID NO: 4869531 - DNA, 22 bp, Homo sapiens
ctaggccctgtgagcacaaaga

SEQ ID NO: 4869532 - DNA, 18 bp, Homo sapiens
ctagggctctccaagcac

SEQ ID NO: 4869533 - DNA, 19 bp, Homo sapiens
ctagggctctccaagcact

SEQ ID NO: 4869534 - DNA, 19 bp, Homo sapiens
ctaggtacgatgacagtgt

SEQ ID NO: 4869535 - DNA, 21 bp, Homo sapiens
ctaggttctgtagagccaatt

SEQ ID NO: 4869536 - DNA, 13 bp, Homo sapiens
ctagtaagaagac

SEQ ID NO: 4869537 - DNA, 20 bp, Homo sapiens
ctagtgggccctctctctgg

SEQ ID NO: 4869538 - DNA, 22 bp, Homo sapiens
ctagtggtatggggctgagccc

SEQ ID NO: 4869539 - DNA, 13 bp, Homo sapiens
ctagtgtgactcc

SEQ ID NO: 4869540 - DNA, 18 bp, Homo sapiens
ctagttaaagaaaggaaa

SEQ ID NO: 4869541 - DNA, 16 bp, Homo sapiens
ctagttatacttattt

SEQ ID NO: 4869542 - DNA, 14 bp, Homo sapiens
ctataatctgtttt

SEQ ID NO: 4869543 - DNA, 13 bp, Homo sapiens
ctatactgtggcc

SEQ ID NO: 4869544 - DNA, 15 bp, Homo sapiens
ctatactgtggcctg

SEQ ID NO: 4869545 - DNA, 21 bp, Homo sapiens
ctatactgtggcctgcaggag

SEQ ID NO: 4869546 - DNA, 10 bp, Homo sapiens
ctatagcacc

SEQ ID NO: 4869547 - DNA, 14 bp, Homo sapiens
ctatatatataaat

SEQ ID NO: 4869548 - DNA, 17 bp, Homo sapiens
ctatattcctccagctg

SEQ ID NO: 4869549 - DNA, 21 bp, Homo sapiens
ctatccacactgtcaaacagg

SEQ ID NO: 4869550 - DNA, 15 bp, Homo sapiens
ctatctcttcctgtc

SEQ ID NO: 4869551 - DNA, 16 bp, Homo sapiens
ctatctcttcctgtct

SEQ ID NO: 4869552 - DNA, 22 bp, Homo sapiens
ctatcttctttggacttctgaa

SEQ ID NO: 4869553 - DNA, 21 bp, Homo sapiens
ctatggtgctgccttgcttct

SEQ ID NO: 4869554 - DNA, 13 bp, Homo sapiens
ctatgtctggcag

SEQ ID NO: 4869555 - DNA, 17 bp, Homo sapiens
ctatgttaatattttag

SEQ ID NO: 4869556 - DNA, 12 bp, Homo sapiens
ctatgttcccca

SEQ ID NO: 4869557 - DNA, 16 bp, Homo sapiens
ctattatttttataat

SEQ ID NO: 4869558 - DNA, 22 bp, Homo sapiens
ctattctataaaactctgcatg

SEQ ID NO: 4869559 - DNA, 12 bp, Homo sapiens
ctattctccaga

SEQ ID NO: 4869560 - DNA, 15 bp, Homo sapiens
ctattctccagacat

SEQ ID NO: 4869561 - DNA, 21 bp, Homo sapiens
ctatttataatacagaatctt

SEQ ID NO: 4869562 - DNA, 13 bp, Homo sapiens
ctatttttgtgaa

SEQ ID NO: 4869563 - DNA, 15 bp, Homo sapiens
ctatttttgtgaaga

SEQ ID NO: 4869564 - DNA, 14 bp, Homo sapiens
ctcaaaaagaaatc

SEQ ID NO: 4869565 - DNA, 14 bp, Homo sapiens
ctcaaagcagcagg

SEQ ID NO: 4869566 - DNA, 15 bp, Homo sapiens
ctcaaagcagcagga

SEQ ID NO: 4869567 - DNA, 21 bp, Homo sapiens
ctcaaataggctattaaaaaa

SEQ ID NO: 4869568 - DNA, 19 bp, Homo sapiens
ctcaagtcactcccaagcc

SEQ ID NO: 4869569 - DNA, 15 bp, Homo sapiens
ctcaatccctgagga

SEQ ID NO: 4869570 - DNA, 21 bp, Homo sapiens
ctcaatgcaagccccaacttt

SEQ ID NO: 4869571 - DNA, 17 bp, Homo sapiens
ctcacctgcactaacag

SEQ ID NO: 4869572 - DNA, 14 bp, Homo sapiens
ctcacgtcaaatgc

SEQ ID NO: 4869573 - DNA, 21 bp, Homo sapiens
ctcacgtgtcagaagcctcca

SEQ ID NO: 4869574 - DNA, 13 bp, Homo sapiens
ctcactactgaac

SEQ ID NO: 4869575 - DNA, 21 bp, Homo sapiens
ctcactactgaacacatgtgt

SEQ ID NO: 4869576 - DNA, 18 bp, Homo sapiens
ctcactcccaagggacag

SEQ ID NO: 4869577 - DNA, 15 bp, Homo sapiens
ctcacttagtccttt

SEQ ID NO: 4869578 - DNA, 21 bp, Homo sapiens
ctcagacccagacgtggtgct

SEQ ID NO: 4869579 - DNA, 13 bp, Homo sapiens
ctcagcagagtga

SEQ ID NO: 4869580 - DNA, 21 bp, Homo sapiens
ctcagcctgctttcctgcagc

SEQ ID NO: 4869581 - DNA, 20 bp, Homo sapiens
ctcagcctggtttctgggtg

SEQ ID NO: 4869582 - DNA, 21 bp, Homo sapiens
ctcagctctctgggacctcct

SEQ ID NO: 4869583 - DNA, 17 bp, Homo sapiens
ctcaggacccatccctg

SEQ ID NO: 4869584 - DNA, 12 bp, Homo sapiens
ctcaggagaagc

SEQ ID NO: 4869585 - DNA, 14 bp, Homo sapiens
ctcaggagaagcca

SEQ ID NO: 4869586 - DNA, 20 bp, Homo sapiens
ctcaggctcctaaagagaca

SEQ ID NO: 4869587 - DNA, 15 bp, Homo sapiens
ctcagggatggaggg

SEQ ID NO: 4869588 - DNA, 22 bp, Homo sapiens
ctcagggatggagggaagacct

SEQ ID NO: 4869589 - DNA, 18 bp, Homo sapiens
ctcagggattctgggctt

SEQ ID NO: 4869590 - DNA, 18 bp, Homo sapiens
ctcagggctcgggagcca

SEQ ID NO: 4869591 - DNA, 14 bp, Homo sapiens
ctcagggtgggggg

SEQ ID NO: 4869592 - DNA, 17 bp, Homo sapiens
ctcagggtggggggtga

SEQ ID NO: 4869593 - DNA, 17 bp, Homo sapiens
ctcaggtcaactgacct

SEQ ID NO: 4869594 - DNA, 19 bp, Homo sapiens
ctcagtgttggtatatttt

SEQ ID NO: 4869595 - DNA, 21 bp, Homo sapiens
ctcagtgttggtatattttat

SEQ ID NO: 4869596 - DNA, 12 bp, Homo sapiens
ctcagttctcaa

SEQ ID NO: 4869597 - DNA, 15 bp, Homo sapiens
ctcataggttaaaaa

SEQ ID NO: 4869598 - DNA, 13 bp, Homo sapiens
ctcatataagaca

SEQ ID NO: 4869599 - DNA, 18 bp, Homo sapiens
ctcattctgaattaatta

SEQ ID NO: 4869600 - DNA, 21 bp, Homo sapiens
ctcattgacttttataaagca

SEQ ID NO: 4869601 - DNA, 19 bp, Homo sapiens
ctcattgcttacaagccta

SEQ ID NO: 4869602 - DNA, 20 bp, Homo sapiens
ctccaagcactagccttccc

SEQ ID NO: 4869603 - DNA, 19 bp, Homo sapiens
ctccaagccctggggcagg

SEQ ID NO: 4869604 - DNA, 13 bp, Homo sapiens
ctccacactcaga

SEQ ID NO: 4869605 - DNA, 21 bp, Homo sapiens
ctccacccataataagagaat

SEQ ID NO: 4869606 - DNA, 23 bp, Homo sapiens
ctccactggccggagtcagtgcc

SEQ ID NO: 4869607 - DNA, 12 bp, Homo sapiens
ctccagaagctg

SEQ ID NO: 4869608 - DNA, 14 bp, Homo sapiens
ctccagaagctgct

SEQ ID NO: 4869609 - DNA, 18 bp, Homo sapiens
ctccagacatggagggga

SEQ ID NO: 4869610 - DNA, 20 bp, Homo sapiens
ctccagacatggaggggatg

SEQ ID NO: 4869611 - DNA, 21 bp, Homo sapiens
ctccagactcagcagagtgag

SEQ ID NO: 4869612 - DNA, 22 bp, Homo sapiens
ctccagactcagcagagtgagg

SEQ ID NO: 4869613 - DNA, 23 bp, Homo sapiens
ctccagagaaagcacaatttaaa

SEQ ID NO: 4869614 - DNA, 13 bp, Homo sapiens
ctccagccctggg

SEQ ID NO: 4869615 - DNA, 11 bp, Homo sapiens
ctccagctcct

SEQ ID NO: 4869616 - DNA, 18 bp, Homo sapiens
ctccagctgacagccaca

SEQ ID NO: 4869617 - DNA, 21 bp, Homo sapiens
ctccagctgacagccacaccg

SEQ ID NO: 4869618 - DNA, 13 bp, Homo sapiens
ctccagctgggat

SEQ ID NO: 4869619 - DNA, 18 bp, Homo sapiens
ctccagcttcggagggcc

SEQ ID NO: 4869620 - DNA, 15 bp, Homo sapiens
ctccaggagggctcg

SEQ ID NO: 4869621 - DNA, 14 bp, Homo sapiens
ctccaggcaggact

SEQ ID NO: 4869622 - DNA, 22 bp, Homo sapiens
ctccaggcatgtgtctggccct

SEQ ID NO: 4869623 - DNA, 23 bp, Homo sapiens
ctccaggcatgtgtctggcccta

SEQ ID NO: 4869624 - DNA, 19 bp, Homo sapiens
ctccagggtgacaaggcct

SEQ ID NO: 4869625 - DNA, 22 bp, Homo sapiens
ctccagggtgacaaggcctgct

SEQ ID NO: 4869626 - DNA, 22 bp, Homo sapiens
ctccagtcattatgttaatatt

SEQ ID NO: 4869627 - DNA, 13 bp, Homo sapiens
ctccatccatcct

SEQ ID NO: 4869628 - DNA, 14 bp, Homo sapiens
ctccatgctcctca

SEQ ID NO: 4869629 - DNA, 13 bp, Homo sapiens
ctccattcatcct

SEQ ID NO: 4869630 - DNA, 21 bp, Homo sapiens
ctccattcatccttccatcca

SEQ ID NO: 4869631 - DNA, 14 bp, Homo sapiens
ctcccaagctgatg

SEQ ID NO: 4869632 - DNA, 19 bp, Homo sapiens
ctcccaaggtcctctcagt

SEQ ID NO: 4869633 - DNA, 15 bp, Homo sapiens
ctcccacagcagccc

SEQ ID NO: 4869634 - DNA, 17 bp, Homo sapiens
ctcccacccaccgccac

SEQ ID NO: 4869635 - DNA, 12 bp, Homo sapiens
ctcccagaacct

SEQ ID NO: 4869636 - DNA, 24 bp, Homo sapiens
ctcccagaacctctaagtgctgct

SEQ ID NO: 4869637 - DNA, 17 bp, Homo sapiens
ctcccagctctagcctc

SEQ ID NO: 4869638 - DNA, 20 bp, Homo sapiens
ctcccaggggagccagctgc

SEQ ID NO: 4869639 - DNA, 22 bp, Homo sapiens
ctcccatgggggcacttgagtt

SEQ ID NO: 4869640 - DNA, 15 bp, Homo sapiens
ctcccattcctccct

SEQ ID NO: 4869641 - DNA, 11 bp, Homo sapiens
ctcccccagag

SEQ ID NO: 4869642 - DNA, 14 bp, Homo sapiens
ctcccccagaggtg

SEQ ID NO: 4869643 - DNA, 21 bp, Homo sapiens
ctcccctaaagccaggctcag

SEQ ID NO: 4869644 - DNA, 16 bp, Homo sapiens
ctcccctcctgctggg

SEQ ID NO: 4869645 - DNA, 17 bp, Homo sapiens
ctcccctcgctgctggg

SEQ ID NO: 4869646 - DNA, 15 bp, Homo sapiens
ctcccctgcccttcc

SEQ ID NO: 4869647 - DNA, 21 bp, Homo sapiens
ctcccctgcccttcctcctga

SEQ ID NO: 4869648 - DNA, 13 bp, Homo sapiens
ctcccctgggcag

SEQ ID NO: 4869649 - DNA, 20 bp, Homo sapiens
ctcccctgggcagggttctc

SEQ ID NO: 4869650 - DNA, 13 bp, Homo sapiens
ctcccgccccgcc

SEQ ID NO: 4869651 - DNA, 18 bp, Homo sapiens
ctcccgccccgcccctcc

SEQ ID NO: 4869652 - DNA, 18 bp, Homo sapiens
ctccctcagctctctggg

SEQ ID NO: 4869653 - DNA, 17 bp, Homo sapiens
ctcccttcctctctcct

SEQ ID NO: 4869654 - DNA, 18 bp, Homo sapiens
ctccgactctgcacccgc

SEQ ID NO: 4869655 - DNA, 19 bp, Homo sapiens
ctccgactctgcacccgcc

SEQ ID NO: 4869656 - DNA, 21 bp, Homo sapiens
ctccggcgggtgacagctccg

SEQ ID NO: 4869657 - DNA, 17 bp, Homo sapiens
ctccgggcaccaggggc

SEQ ID NO: 4869658 - DNA, 19 bp, Homo sapiens
ctccgggcaccaggggcca

SEQ ID NO: 4869659 - DNA, 20 bp, Homo sapiens
ctcctaactgccagccccct

SEQ ID NO: 4869660 - DNA, 16 bp, Homo sapiens
ctcctataaagtgcct

SEQ ID NO: 4869661 - DNA, 20 bp, Homo sapiens
ctcctattctataaaactct

SEQ ID NO: 4869662 - DNA, 17 bp, Homo sapiens
ctcctccagccctgggc

SEQ ID NO: 4869663 - DNA, 10 bp, Homo sapiens
ctcctccctc

SEQ ID NO: 4869664 - DNA, 18 bp, Homo sapiens
ctcctccttgcccagact

SEQ ID NO: 4869665 - DNA, 16 bp, Homo sapiens
ctcctctaggccctgt

SEQ ID NO: 4869666 - DNA, 19 bp, Homo sapiens
ctcctctaggccctgtgag

SEQ ID NO: 4869667 - DNA, 19 bp, Homo sapiens
ctcctctcaaacctggcag

SEQ ID NO: 4869668 - DNA, 21 bp, Homo sapiens
ctcctctcaaacctggcagat

SEQ ID NO: 4869669 - DNA, 15 bp, Homo sapiens
ctcctctccctccca

SEQ ID NO: 4869670 - DNA, 16 bp, Homo sapiens
ctcctcttgttcctga

SEQ ID NO: 4869671 - DNA, 20 bp, Homo sapiens
ctcctgatggagtgtgcaga

SEQ ID NO: 4869672 - DNA, 13 bp, Homo sapiens
ctcctgccctctg

SEQ ID NO: 4869673 - DNA, 15 bp, Homo sapiens
ctcctgccctctgct

SEQ ID NO: 4869674 - DNA, 19 bp, Homo sapiens
ctcctgcttaatcttcaaa

SEQ ID NO: 4869675 - DNA, 22 bp, Homo sapiens
ctcctgggcattagcaaggcag

SEQ ID NO: 4869676 - DNA, 17 bp, Homo sapiens
ctcctgtcttctttctc

SEQ ID NO: 4869677 - DNA, 15 bp, Homo sapiens
ctcctgtggcaggag

SEQ ID NO: 4869678 - DNA, 19 bp, Homo sapiens
ctcctgttttgcacagcca

SEQ ID NO: 4869679 - DNA, 16 bp, Homo sapiens
ctccttcatgtttgga

SEQ ID NO: 4869680 - DNA, 18 bp, Homo sapiens
ctccttctcctgttccat

SEQ ID NO: 4869681 - DNA, 13 bp, Homo sapiens
ctccttctgcagt

SEQ ID NO: 4869682 - DNA, 21 bp, Homo sapiens
ctccttctgcagtcagactga

SEQ ID NO: 4869683 - DNA, 16 bp, Homo sapiens
ctcctttcccctctca

SEQ ID NO: 4869684 - DNA, 20 bp, Homo sapiens
ctcctttgaagaaggcaagg

SEQ ID NO: 4869685 - DNA, 15 bp, Homo sapiens
ctcgacctccccacc

SEQ ID NO: 4869686 - DNA, 22 bp, Homo sapiens
ctcgacctccccacccgctccc

SEQ ID NO: 4869687 - DNA, 12 bp, Homo sapiens
ctcgagagcctt

SEQ ID NO: 4869688 - DNA, 20 bp, Homo sapiens
ctcggctactggttacctgg

SEQ ID NO: 4869689 - DNA, 13 bp, Homo sapiens
ctcggctgccagg

SEQ ID NO: 4869690 - DNA, 19 bp, Homo sapiens
ctcggctgccaggggctct

SEQ ID NO: 4869691 - DNA, 21 bp, Homo sapiens
ctcggctgccaggggctctgt

SEQ ID NO: 4869692 - DNA, 19 bp, Homo sapiens
ctcggggtgtgtcatttct

SEQ ID NO: 4869693 - DNA, 15 bp, Homo sapiens
ctctaagtgctgctg

SEQ ID NO: 4869694 - DNA, 15 bp, Homo sapiens
ctctagatttattag

SEQ ID NO: 4869695 - DNA, 14 bp, Homo sapiens
ctctagcctctgga

SEQ ID NO: 4869696 - DNA, 16 bp, Homo sapiens
ctctagcctctggact

SEQ ID NO: 4869697 - DNA, 20 bp, Homo sapiens
ctctagggcctcagtctgga

SEQ ID NO: 4869698 - DNA, 23 bp, Homo sapiens
ctctaggtacgatgacagtgttc

SEQ ID NO: 4869699 - DNA, 17 bp, Homo sapiens
ctctagtgcggtttact

SEQ ID NO: 4869700 - DNA, 22 bp, Homo sapiens
ctctataagcaaattgcttttt

SEQ ID NO: 4869701 - DNA, 15 bp, Homo sapiens
ctctcaaacctggca

SEQ ID NO: 4869702 - DNA, 20 bp, Homo sapiens
ctctccatatcccttcctct

SEQ ID NO: 4869703 - DNA, 18 bp, Homo sapiens
ctctcccctcctgctggg

SEQ ID NO: 4869704 - DNA, 17 bp, Homo sapiens
ctctccgactctgcacc

SEQ ID NO: 4869705 - DNA, 20 bp, Homo sapiens
ctctccgactctgcacccgc

SEQ ID NO: 4869706 - DNA, 23 bp, Homo sapiens
ctctccgactctgcacccgcctc

SEQ ID NO: 4869707 - DNA, 22 bp, Homo sapiens
ctctcctaactgccagccccct

SEQ ID NO: 4869708 - DNA, 14 bp, Homo sapiens
ctctcctcccctac

SEQ ID NO: 4869709 - DNA, 14 bp, Homo sapiens
ctctcctgccctct

SEQ ID NO: 4869710 - DNA, 15 bp, Homo sapiens
ctctcctgccctctg

SEQ ID NO: 4869711 - DNA, 16 bp, Homo sapiens
ctctcctgccctctgc

SEQ ID NO: 4869712 - DNA, 16 bp, Homo sapiens
ctctctatagcaccag

SEQ ID NO: 4869713 - DNA, 19 bp, Homo sapiens
ctctctggaagagggaggg

SEQ ID NO: 4869714 - DNA, 16 bp, Homo sapiens
ctctctgggacctcct

SEQ ID NO: 4869715 - DNA, 17 bp, Homo sapiens
ctctgaaataatgggat

SEQ ID NO: 4869716 - DNA, 15 bp, Homo sapiens
ctctgaaatcttccc

SEQ ID NO: 4869717 - DNA, 23 bp, Homo sapiens
ctctgaaatcttcccatgcattc

SEQ ID NO: 4869718 - DNA, 20 bp, Homo sapiens
ctctgaatttgtcgggttct

SEQ ID NO: 4869719 - DNA, 22 bp, Homo sapiens
ctctgcaagcttcttgctgatc

SEQ ID NO: 4869720 - DNA, 22 bp, Homo sapiens
ctctgccagttacttgggcttc

SEQ ID NO: 4869721 - DNA, 11 bp, Homo sapiens
ctctgcctggg

SEQ ID NO: 4869722 - DNA, 14 bp, Homo sapiens
ctctgctctgcctg

SEQ ID NO: 4869723 - DNA, 23 bp, Homo sapiens
ctctggactggaaagcacaagac

SEQ ID NO: 4869724 - DNA, 13 bp, Homo sapiens
ctctggagcagcc

SEQ ID NO: 4869725 - DNA, 18 bp, Homo sapiens
ctctggagcagccaaggc

SEQ ID NO: 4869726 - DNA, 22 bp, Homo sapiens
ctctggcttcaaaaagccacag

SEQ ID NO: 4869727 - DNA, 12 bp, Homo sapiens
ctctgggaccca

SEQ ID NO: 4869728 - DNA, 16 bp, Homo sapiens
ctctgggacccacaga

SEQ ID NO: 4869729 - DNA, 17 bp, Homo sapiens
ctctgggacccacagaa

SEQ ID NO: 4869730 - DNA, 15 bp, Homo sapiens
ctctgtccttccccc

SEQ ID NO: 4869731 - DNA, 22 bp, Homo sapiens
ctctgtccttcccccagcacaa

SEQ ID NO: 4869732 - DNA, 15 bp, Homo sapiens
ctctgtcttgtgttt

SEQ ID NO: 4869733 - DNA, 11 bp, Homo sapiens
ctctgtgcttc

SEQ ID NO: 4869734 - DNA, 12 bp, Homo sapiens
ctctgtgcttcg

SEQ ID NO: 4869735 - DNA, 13 bp, Homo sapiens
ctctgttccccca

SEQ ID NO: 4869736 - DNA, 20 bp, Homo sapiens
ctcttaaagaaaacccaccc

SEQ ID NO: 4869737 - DNA, 21 bp, Homo sapiens
ctcttaagtcctaaaagttct

SEQ ID NO: 4869738 - DNA, 16 bp, Homo sapiens
ctcttatgtgtgcctt

SEQ ID NO: 4869739 - DNA, 23 bp, Homo sapiens
ctcttcaaccccgaggtccctgt

SEQ ID NO: 4869740 - DNA, 11 bp, Homo sapiens
ctcttcccact

SEQ ID NO: 4869741 - DNA, 17 bp, Homo sapiens
ctcttcccactccagct

SEQ ID NO: 4869742 - DNA, 15 bp, Homo sapiens
ctcttcctcctccca

SEQ ID NO: 4869743 - DNA, 18 bp, Homo sapiens
ctcttcctcctcccaagg

SEQ ID NO: 4869744 - DNA, 11 bp, Homo sapiens
ctcttcctgtc

SEQ ID NO: 4869745 - DNA, 15 bp, Homo sapiens
ctcttcttcctcacc

SEQ ID NO: 4869746 - DNA, 16 bp, Homo sapiens
ctcttgaaacctgatg

SEQ ID NO: 4869747 - DNA, 13 bp, Homo sapiens
ctcttgcagggtc

SEQ ID NO: 4869748 - DNA, 14 bp, Homo sapiens
ctcttgcagggtct

SEQ ID NO: 4869749 - DNA, 15 bp, Homo sapiens
ctcttggtcccatgg

SEQ ID NO: 4869750 - DNA, 21 bp, Homo sapiens
ctcttgtattatctcctttga

SEQ ID NO: 4869751 - DNA, 14 bp, Homo sapiens
ctcttgtgttcaga

SEQ ID NO: 4869752 - DNA, 17 bp, Homo sapiens
ctcttgtgttcagaaga

SEQ ID NO: 4869753 - DNA, 19 bp, Homo sapiens
ctcttgtgttcagaagaat

SEQ ID NO: 4869754 - DNA, 17 bp, Homo sapiens
ctcttgttcctgaaatg

SEQ ID NO: 4869755 - DNA, 24 bp, Homo sapiens
ctcttgtttacgatttcactagga

SEQ ID NO: 4869756 - DNA, 13 bp, Homo sapiens
ctctttccaccat

SEQ ID NO: 4869757 - DNA, 22 bp, Homo sapiens
ctgaaaagtgtgtatatatttt

SEQ ID NO: 4869758 - DNA, 14 bp, Homo sapiens
ctgaaagagaggac

SEQ ID NO: 4869759 - DNA, 14 bp, Homo sapiens
ctgaaataatggga

SEQ ID NO: 4869760 - DNA, 13 bp, Homo sapiens
ctgaaattttaga

SEQ ID NO: 4869761 - DNA, 18 bp, Homo sapiens
ctgaaattttagaaatat

SEQ ID NO: 4869762 - DNA, 14 bp, Homo sapiens
ctgaacacatgtgt

SEQ ID NO: 4869763 - DNA, 16 bp, Homo sapiens
ctgaagctggagcagc

SEQ ID NO: 4869764 - DNA, 17 bp, Homo sapiens
ctgaagctggagcagcg

SEQ ID NO: 4869765 - DNA, 14 bp, Homo sapiens
ctgaagtatgaagt

SEQ ID NO: 4869766 - DNA, 17 bp, Homo sapiens
ctgaattatctatttca

SEQ ID NO: 4869767 - DNA, 18 bp, Homo sapiens
ctgaattatctatttcat

SEQ ID NO: 4869768 - DNA, 12 bp, Homo sapiens
ctgaatttggag

SEQ ID NO: 4869769 - DNA, 23 bp, Homo sapiens
ctgaatttgtcgggttctcccat

SEQ ID NO: 4869770 - DNA, 17 bp, Homo sapiens
ctgacagagctctgggt

SEQ ID NO: 4869771 - DNA, 13 bp, Homo sapiens
ctgacagccacac

SEQ ID NO: 4869772 - DNA, 14 bp, Homo sapiens
ctgaccaagtttct

SEQ ID NO: 4869773 - DNA, 13 bp, Homo sapiens
ctgaccccaaggg

SEQ ID NO: 4869774 - DNA, 20 bp, Homo sapiens
ctgaccccaagggggctgct

SEQ ID NO: 4869775 - DNA, 21 bp, Homo sapiens
ctgaccccaagggggctgctg

SEQ ID NO: 4869776 - DNA, 23 bp, Homo sapiens
ctgacctggcatctaattctgat

SEQ ID NO: 4869777 - DNA, 15 bp, Homo sapiens
ctgactccaaagctg

SEQ ID NO: 4869778 - DNA, 18 bp, Homo sapiens
ctgactccaaagctgttc

SEQ ID NO: 4869779 - DNA, 16 bp, Homo sapiens
ctgactgccctccgaa

SEQ ID NO: 4869780 - DNA, 22 bp, Homo sapiens
ctgacttatggcatgactcttc

SEQ ID NO: 4869781 - DNA, 16 bp, Homo sapiens
ctgagacagtgaattt

SEQ ID NO: 4869782 - DNA, 16 bp, Homo sapiens
ctgagcagggatctgc

SEQ ID NO: 4869783 - DNA, 20 bp, Homo sapiens
ctgagcagggatctgccccc

SEQ ID NO: 4869784 - DNA, 18 bp, Homo sapiens
ctgagccctcctgagggc

SEQ ID NO: 4869785 - DNA, 14 bp, Homo sapiens
ctgaggactgattt

SEQ ID NO: 4869786 - DNA, 13 bp, Homo sapiens
ctgaggaggtgct

SEQ ID NO: 4869787 - DNA, 21 bp, Homo sapiens
ctgaggccaggacgtctgggg

SEQ ID NO: 4869788 - DNA, 18 bp, Homo sapiens
ctgaggcccagagaggga

SEQ ID NO: 4869789 - DNA, 17 bp, Homo sapiens
ctgaggctgagaaagct

SEQ ID NO: 4869790 - DNA, 17 bp, Homo sapiens
ctgataccatatgaatg

SEQ ID NO: 4869791 - DNA, 19 bp, Homo sapiens
ctgataccatatgaatgaa

SEQ ID NO: 4869792 - DNA, 20 bp, Homo sapiens
ctgataccatatgaatgaaa

SEQ ID NO: 4869793 - DNA, 21 bp, Homo sapiens
ctgataccattctattctcca

SEQ ID NO: 4869794 - DNA, 23 bp, Homo sapiens
ctgataccattctattctccaga

SEQ ID NO: 4869795 - DNA, 17 bp, Homo sapiens
ctgatcccatggccagg

SEQ ID NO: 4869796 - DNA, 15 bp, Homo sapiens
ctgatgagagaatgt

SEQ ID NO: 4869797 - DNA, 19 bp, Homo sapiens
ctgatgagagaatgtggaa

SEQ ID NO: 4869798 - DNA, 23 bp, Homo sapiens
ctgatgagtttcactgtactgca

SEQ ID NO: 4869799 - DNA, 15 bp, Homo sapiens
ctgatggagtgtgca

SEQ ID NO: 4869800 - DNA, 16 bp, Homo sapiens
ctgatgggtgcccttt

SEQ ID NO: 4869801 - DNA, 21 bp, Homo sapiens
ctgatgtcagctgctgttgaa

SEQ ID NO: 4869802 - DNA, 14 bp, Homo sapiens
ctgcaaaaagaaaa

SEQ ID NO: 4869803 - DNA, 15 bp, Homo sapiens
ctgcaaaaattatat

SEQ ID NO: 4869804 - DNA, 16 bp, Homo sapiens
ctgcaaagtcgccagt

SEQ ID NO: 4869805 - DNA, 19 bp, Homo sapiens
ctgcaaatactgtatattc

SEQ ID NO: 4869806 - DNA, 13 bp, Homo sapiens
ctgcacaggcaga

SEQ ID NO: 4869807 - DNA, 21 bp, Homo sapiens
ctgcagcagtcgcccaagcag

SEQ ID NO: 4869808 - DNA, 22 bp, Homo sapiens
ctgcagccttcatcagaactct

SEQ ID NO: 4869809 - DNA, 23 bp, Homo sapiens
ctgcagccttcatcagaactctt

SEQ ID NO: 4869810 - DNA, 23 bp, Homo sapiens
ctgcaggagggttggagtgctct

SEQ ID NO: 4869811 - DNA, 22 bp, Homo sapiens
ctgcataatgtttctggatttc

SEQ ID NO: 4869812 - DNA, 13 bp, Homo sapiens
ctgcatagccggt

SEQ ID NO: 4869813 - DNA, 21 bp, Homo sapiens
ctgcatgatttttgccctgcg

SEQ ID NO: 4869814 - DNA, 12 bp, Homo sapiens
ctgcatggggag

SEQ ID NO: 4869815 - DNA, 18 bp, Homo sapiens
ctgcatggggaggcagca

SEQ ID NO: 4869816 - DNA, 22 bp, Homo sapiens
ctgcatgtgacttctcccctgc

SEQ ID NO: 4869817 - DNA, 22 bp, Homo sapiens
ctgcatgtgtcatgaagaatgt

SEQ ID NO: 4869818 - DNA, 19 bp, Homo sapiens
ctgccaaaggatgtgatat

SEQ ID NO: 4869819 - DNA, 13 bp, Homo sapiens
ctgccaaggagca

SEQ ID NO: 4869820 - DNA, 21 bp, Homo sapiens
ctgccaaggagcatccttggc

SEQ ID NO: 4869821 - DNA, 18 bp, Homo sapiens
ctgccaatctgtacaaaa

SEQ ID NO: 4869822 - DNA, 12 bp, Homo sapiens
ctgccaccttca

SEQ ID NO: 4869823 - DNA, 19 bp, Homo sapiens
ctgccagctctcaggaccg

SEQ ID NO: 4869824 - DNA, 15 bp, Homo sapiens
ctgccaggggctctg

SEQ ID NO: 4869825 - DNA, 17 bp, Homo sapiens
ctgccaggggctctgtg

SEQ ID NO: 4869826 - DNA, 18 bp, Homo sapiens
ctgccaggggctctgtgg

SEQ ID NO: 4869827 - DNA, 23 bp, Homo sapiens
ctgccatggctaggtagaagtga

SEQ ID NO: 4869828 - DNA, 23 bp, Homo sapiens
ctgccattacagaggtattaaaa

SEQ ID NO: 4869829 - DNA, 23 bp, Homo sapiens
ctgcccacaactcccttgcacgt

SEQ ID NO: 4869830 - DNA, 21 bp, Homo sapiens
ctgccccaagtggtgagcaag

SEQ ID NO: 4869831 - DNA, 19 bp, Homo sapiens
ctgcccgcctaagaccctg

SEQ ID NO: 4869832 - DNA, 21 bp, Homo sapiens
ctgccctccgaagagagttct

SEQ ID NO: 4869833 - DNA, 11 bp, Homo sapiens
ctgccctctgc

SEQ ID NO: 4869834 - DNA, 19 bp, Homo sapiens
ctgccctctgctctgcctg

SEQ ID NO: 4869835 - DNA, 15 bp, Homo sapiens
ctgccgtaatttaac

SEQ ID NO: 4869836 - DNA, 19 bp, Homo sapiens
ctgccgtagcttcagccag

SEQ ID NO: 4869837 - DNA, 20 bp, Homo sapiens
ctgccgtagcttcagccagg

SEQ ID NO: 4869838 - DNA, 19 bp, Homo sapiens
ctgccgttttctgggctga

SEQ ID NO: 4869839 - DNA, 14 bp, Homo sapiens
ctgcctggaggctc

SEQ ID NO: 4869840 - DNA, 16 bp, Homo sapiens
ctgcctggaggctcct

SEQ ID NO: 4869841 - DNA, 20 bp, Homo sapiens
ctgcctttgcagttggactc

SEQ ID NO: 4869842 - DNA, 19 bp, Homo sapiens
ctgctaaggctcctccttg

SEQ ID NO: 4869843 - DNA, 23 bp, Homo sapiens
ctgctatttttaatttcctgtga

SEQ ID NO: 4869844 - DNA, 22 bp, Homo sapiens
ctgctcaactctacccctgctc

SEQ ID NO: 4869845 - DNA, 21 bp, Homo sapiens
ctgctccatcggggcaggggg

SEQ ID NO: 4869846 - DNA, 17 bp, Homo sapiens
ctgctcccacaggggcc

SEQ ID NO: 4869847 - DNA, 14 bp, Homo sapiens
ctgctcccattcct

SEQ ID NO: 4869848 - DNA, 17 bp, Homo sapiens
ctgctcccattcctccc

SEQ ID NO: 4869849 - DNA, 18 bp, Homo sapiens
ctgctcccctaaagccag

SEQ ID NO: 4869850 - DNA, 22 bp, Homo sapiens
ctgctcccctaaagccaggctc

SEQ ID NO: 4869851 - DNA, 11 bp, Homo sapiens
ctgctcctctt

SEQ ID NO: 4869852 - DNA, 12 bp, Homo sapiens
ctgctcctcttg

SEQ ID NO: 4869853 - DNA, 13 bp, Homo sapiens
ctgctcctcttgt

SEQ ID NO: 4869854 - DNA, 15 bp, Homo sapiens
ctgctcctgtggcag

SEQ ID NO: 4869855 - DNA, 16 bp, Homo sapiens
ctgctcctgtggcagg

SEQ ID NO: 4869856 - DNA, 18 bp, Homo sapiens
ctgctcctgtggcaggag

SEQ ID NO: 4869857 - DNA, 16 bp, Homo sapiens
ctgctcctttaccctc

SEQ ID NO: 4869858 - DNA, 18 bp, Homo sapiens
ctgctcctttaccctctt

SEQ ID NO: 4869859 - DNA, 19 bp, Homo sapiens
ctgctcctttaccctcttg

SEQ ID NO: 4869860 - DNA, 15 bp, Homo sapiens
ctgctcggctactgg

SEQ ID NO: 4869861 - DNA, 16 bp, Homo sapiens
ctgctcggctactggt

SEQ ID NO: 4869862 - DNA, 14 bp, Homo sapiens
ctgctctgcctgga

SEQ ID NO: 4869863 - DNA, 15 bp, Homo sapiens
ctgctctgcctggag

SEQ ID NO: 4869864 - DNA, 21 bp, Homo sapiens
ctgctgcaaggtggcctctgc

SEQ ID NO: 4869865 - DNA, 22 bp, Homo sapiens
ctgctgcaaggtggcctctgcc

SEQ ID NO: 4869866 - DNA, 16 bp, Homo sapiens
ctgctgctgctgccgc

SEQ ID NO: 4869867 - DNA, 16 bp, Homo sapiens
ctgctggccggagcaa

SEQ ID NO: 4869868 - DNA, 21 bp, Homo sapiens
ctgctgggccccatctccaca

SEQ ID NO: 4869869 - DNA, 19 bp, Homo sapiens
ctgctgggcgtgtgtgaca

SEQ ID NO: 4869870 - DNA, 16 bp, Homo sapiens
ctgctgttgaactttt

SEQ ID NO: 4869871 - DNA, 13 bp, Homo sapiens
ctgcttaattgct

SEQ ID NO: 4869872 - DNA, 23 bp, Homo sapiens
ctgcttcccacaactactagtgt

SEQ ID NO: 4869873 - DNA, 17 bp, Homo sapiens
ctgcttgactttccaga

SEQ ID NO: 4869874 - DNA, 22 bp, Homo sapiens
ctgcttgactttccagaatgac

SEQ ID NO: 4869875 - DNA, 17 bp, Homo sapiens
ctggaaccacattgaag

SEQ ID NO: 4869876 - DNA, 20 bp, Homo sapiens
ctggaaccacattgaagaat

SEQ ID NO: 4869877 - DNA, 12 bp, Homo sapiens
ctggaagaggga

SEQ ID NO: 4869878 - DNA, 23 bp, Homo sapiens
ctggacccttgattcattctgaa

SEQ ID NO: 4869879 - DNA, 14 bp, Homo sapiens
ctggactgcatggg

SEQ ID NO: 4869880 - DNA, 21 bp, Homo sapiens
ctggactgcatggggaggcag

SEQ ID NO: 4869881 - DNA, 23 bp, Homo sapiens
ctggactgcatggggaggcagca

SEQ ID NO: 4869882 - DNA, 20 bp, Homo sapiens
ctggactggaaagcacaaga

SEQ ID NO: 4869883 - DNA, 18 bp, Homo sapiens
ctggagcagccaaggccg

SEQ ID NO: 4869884 - DNA, 20 bp, Homo sapiens
ctggagcagccaaggccgcc

SEQ ID NO: 4869885 - DNA, 23 bp, Homo sapiens
ctggagcagcggattgctctgga

SEQ ID NO: 4869886 - DNA, 19 bp, Homo sapiens
ctggagcaggcccaatgct

SEQ ID NO: 4869887 - DNA, 21 bp, Homo sapiens
ctggagcaggcccaatgctgc

SEQ ID NO: 4869888 - DNA, 17 bp, Homo sapiens
ctggagcttcagccagg

SEQ ID NO: 4869889 - DNA, 20 bp, Homo sapiens
ctggagcttcagccaggtct

SEQ ID NO: 4869890 - DNA, 14 bp, Homo sapiens
ctggaggagcacac

SEQ ID NO: 4869891 - DNA, 18 bp, Homo sapiens
ctggaggtaaacaaagac

SEQ ID NO: 4869892 - DNA, 23 bp, Homo sapiens
ctggagtgtcggatcctgtgagt

SEQ ID NO: 4869893 - DNA, 17 bp, Homo sapiens
ctggatggaaagacaaa

SEQ ID NO: 4869894 - DNA, 21 bp, Homo sapiens
ctggatggaaagacaaactgc

SEQ ID NO: 4869895 - DNA, 15 bp, Homo sapiens
ctggatttgcagaag

SEQ ID NO: 4869896 - DNA, 21 bp, Homo sapiens
ctggcacaatgttggagcagc

SEQ ID NO: 4869897 - DNA, 19 bp, Homo sapiens
ctggcagatgagggctggc

SEQ ID NO: 4869898 - DNA, 12 bp, Homo sapiens
ctggccaggcag

SEQ ID NO: 4869899 - DNA, 14 bp, Homo sapiens
ctggccaggcaggg

SEQ ID NO: 4869900 - DNA, 18 bp, Homo sapiens
ctggccaggcagggagag

SEQ ID NO: 4869901 - DNA, 14 bp, Homo sapiens
ctggcccagtgcca

SEQ ID NO: 4869902 - DNA, 16 bp, Homo sapiens
ctggccctctagcttc

SEQ ID NO: 4869903 - DNA, 21 bp, Homo sapiens
ctggccggagcaaactctgct

SEQ ID NO: 4869904 - DNA, 18 bp, Homo sapiens
ctggccggagtcagtgcc

SEQ ID NO: 4869905 - DNA, 22 bp, Homo sapiens
ctggcctgagaattgaggggag

SEQ ID NO: 4869906 - DNA, 14 bp, Homo sapiens
ctggccttgcctcc

SEQ ID NO: 4869907 - DNA, 14 bp, Homo sapiens
ctggcggaggctgc

SEQ ID NO: 4869908 - DNA, 15 bp, Homo sapiens
ctggcggaggctgct

SEQ ID NO: 4869909 - DNA, 19 bp, Homo sapiens
ctggctgccgttttctggg

SEQ ID NO: 4869910 - DNA, 21 bp, Homo sapiens
ctggctgccgttttctgggct

SEQ ID NO: 4869911 - DNA, 19 bp, Homo sapiens
ctggcttcaaaaagccaca

SEQ ID NO: 4869912 - DNA, 20 bp, Homo sapiens
ctggcttcaaaaagccacag

SEQ ID NO: 4869913 - DNA, 22 bp, Homo sapiens
ctggcttcaaaaagccacagca

SEQ ID NO: 4869914 - DNA, 16 bp, Homo sapiens
ctggctttaagccttc

SEQ ID NO: 4869915 - DNA, 13 bp, Homo sapiens
ctgggaaggccag

SEQ ID NO: 4869916 - DNA, 23 bp, Homo sapiens
ctgggaaggccagccttgtacag

SEQ ID NO: 4869917 - DNA, 22 bp, Homo sapiens
ctgggacaccattaccaaaata

SEQ ID NO: 4869918 - DNA, 14 bp, Homo sapiens
ctgggacctgtggt

SEQ ID NO: 4869919 - DNA, 16 bp, Homo sapiens
ctgggacctgtggtca

SEQ ID NO: 4869920 - DNA, 21 bp, Homo sapiens
ctgggcaatgaggcagatagc

SEQ ID NO: 4869921 - DNA, 17 bp, Homo sapiens
ctgggcattagcaaggc

SEQ ID NO: 4869922 - DNA, 15 bp, Homo sapiens
ctgggcctcccctgg

SEQ ID NO: 4869923 - DNA, 23 bp, Homo sapiens
ctgggctcagcctggtttctggg

SEQ ID NO: 4869924 - DNA, 14 bp, Homo sapiens
ctgggctgtgagga

SEQ ID NO: 4869925 - DNA, 23 bp, Homo sapiens
ctgggcttggggtgtggggtggg

SEQ ID NO: 4869926 - DNA, 14 bp, Homo sapiens
ctgggctttgggaa

SEQ ID NO: 4869927 - DNA, 23 bp, Homo sapiens
ctggggacacaggatcctggcct

SEQ ID NO: 4869928 - DNA, 12 bp, Homo sapiens
ctggggcagggt

SEQ ID NO: 4869929 - DNA, 21 bp, Homo sapiens
ctggggcagggtggggggcca

SEQ ID NO: 4869930 - DNA, 15 bp, Homo sapiens
ctggggggcaggcct

SEQ ID NO: 4869931 - DNA, 22 bp, Homo sapiens
ctggggtcaccttctagttgcc

SEQ ID NO: 4869932 - DNA, 13 bp, Homo sapiens
ctggggtggagtg

SEQ ID NO: 4869933 - DNA, 15 bp, Homo sapiens
ctggggtggagtggg

SEQ ID NO: 4869934 - DNA, 15 bp, Homo sapiens
ctgggtttgggagcc

SEQ ID NO: 4869935 - DNA, 22 bp, Homo sapiens
ctgggtttgggagccaggactc

SEQ ID NO: 4869936 - DNA, 19 bp, Homo sapiens
ctggtaatattgacttgta

SEQ ID NO: 4869937 - DNA, 18 bp, Homo sapiens
ctggtgaacactgtgacc

SEQ ID NO: 4869938 - DNA, 14 bp, Homo sapiens
ctggttacctggag

SEQ ID NO: 4869939 - DNA, 22 bp, Homo sapiens
ctggttcggctctagggcctca

SEQ ID NO: 4869940 - DNA, 20 bp, Homo sapiens
ctggttctgaggccagaaag

SEQ ID NO: 4869941 - DNA, 21 bp, Homo sapiens
ctgtaaagatgtttatttcag

SEQ ID NO: 4869942 - DNA, 19 bp, Homo sapiens
ctgtaacttccaaataaat

SEQ ID NO: 4869943 - DNA, 18 bp, Homo sapiens
ctgtaatgctgcctcagg

SEQ ID NO: 4869944 - DNA, 23 bp, Homo sapiens
ctgtaatgctgcctcaggaccca

SEQ ID NO: 4869945 - DNA, 13 bp, Homo sapiens
ctgtacaaaatgg

SEQ ID NO: 4869946 - DNA, 14 bp, Homo sapiens
ctgtacaaaatggt

SEQ ID NO: 4869947 - DNA, 19 bp, Homo sapiens
ctgtactaaggagaaatga

SEQ ID NO: 4869948 - DNA, 12 bp, Homo sapiens
ctgtactgcatg

SEQ ID NO: 4869949 - DNA, 15 bp, Homo sapiens
ctgtactgcatgtga

SEQ ID NO: 4869950 - DNA, 18 bp, Homo sapiens
ctgtactgcatgtgactt

SEQ ID NO: 4869951 - DNA, 16 bp, Homo sapiens
ctgtagagccaattag

SEQ ID NO: 4869952 - DNA, 22 bp, Homo sapiens
ctgtatgggggagattgaactt

SEQ ID NO: 4869953 - DNA, 16 bp, Homo sapiens
ctgtcaatgagagcat

SEQ ID NO: 4869954 - DNA, 17 bp, Homo sapiens
ctgtcactgtccagagt

SEQ ID NO: 4869955 - DNA, 18 bp, Homo sapiens
ctgtcagtggggcagcct

SEQ ID NO: 4869956 - DNA, 15 bp, Homo sapiens
ctgtccagagtctct

SEQ ID NO: 4869957 - DNA, 23 bp, Homo sapiens
ctgtccctagggctctccaagca

SEQ ID NO: 4869958 - DNA, 20 bp, Homo sapiens
ctgtccgtgccccttccctg

SEQ ID NO: 4869959 - DNA, 21 bp, Homo sapiens
ctgtcctattatattcattct

SEQ ID NO: 4869960 - DNA, 18 bp, Homo sapiens
ctgtccttcccccagcac

SEQ ID NO: 4869961 - DNA, 16 bp, Homo sapiens
ctgtctcttggctttg

SEQ ID NO: 4869962 - DNA, 13 bp, Homo sapiens
ctgtcttctttct

SEQ ID NO: 4869963 - DNA, 22 bp, Homo sapiens
ctgtcttctttctccatggagc

SEQ ID NO: 4869964 - DNA, 23 bp, Homo sapiens
ctgtcttctttctccatggagcc

SEQ ID NO: 4869965 - DNA, 23 bp, Homo sapiens
ctgtgactcttagccctcaccac

SEQ ID NO: 4869966 - DNA, 23 bp, Homo sapiens
ctgtgagcacaaagaagaaagct

SEQ ID NO: 4869967 - DNA, 19 bp, Homo sapiens
ctgtgagcatggggccagg

SEQ ID NO: 4869968 - DNA, 17 bp, Homo sapiens
ctgtgagccttgcatga

SEQ ID NO: 4869969 - DNA, 17 bp, Homo sapiens
ctgtgaggacagggccc

SEQ ID NO: 4869970 - DNA, 14 bp, Homo sapiens
ctgtgagtaggctg

SEQ ID NO: 4869971 - DNA, 16 bp, Homo sapiens
ctgtgattactgcaat

SEQ ID NO: 4869972 - DNA, 18 bp, Homo sapiens
ctgtgattactgcaatca

SEQ ID NO: 4869973 - DNA, 23 bp, Homo sapiens
ctgtgctatcggcagatgatgct

SEQ ID NO: 4869974 - DNA, 20 bp, Homo sapiens
ctgtgctccacactcagaaa

SEQ ID NO: 4869975 - DNA, 11 bp, Homo sapiens
ctgtgctgaac

SEQ ID NO: 4869976 - DNA, 11 bp, Homo sapiens
ctgtgctttgg

SEQ ID NO: 4869977 - DNA, 14 bp, Homo sapiens
ctgtgctttggaac

SEQ ID NO: 4869978 - DNA, 18 bp, Homo sapiens
ctgtggaaggcagagaaa

SEQ ID NO: 4869979 - DNA, 13 bp, Homo sapiens
ctgtggcaaaaag

SEQ ID NO: 4869980 - DNA, 22 bp, Homo sapiens
ctgtggcaaaaagagtcagaca

SEQ ID NO: 4869981 - DNA, 12 bp, Homo sapiens
ctgtggcaggag

SEQ ID NO: 4869982 - DNA, 14 bp, Homo sapiens
ctgtggcataaatt

SEQ ID NO: 4869983 - DNA, 15 bp, Homo sapiens
ctgtggcataaattg

SEQ ID NO: 4869984 - DNA, 15 bp, Homo sapiens
ctgtggccgtctcct

SEQ ID NO: 4869985 - DNA, 15 bp, Homo sapiens
ctgtggcctgcagga

SEQ ID NO: 4869986 - DNA, 19 bp, Homo sapiens
ctgtggctttcagcctctg

SEQ ID NO: 4869987 - DNA, 14 bp, Homo sapiens
ctgtggtcatgtga

SEQ ID NO: 4869988 - DNA, 18 bp, Homo sapiens
ctgtgtgaatacctgctc

SEQ ID NO: 4869989 - DNA, 17 bp, Homo sapiens
ctgtgtgaccctgggca

SEQ ID NO: 4869990 - DNA, 18 bp, Homo sapiens
ctgtgtgaccctgggcag

SEQ ID NO: 4869991 - DNA, 23 bp, Homo sapiens
ctgtgttactaaaaaaaagatga

SEQ ID NO: 4869992 - DNA, 16 bp, Homo sapiens
ctgtgtttatatggaa

SEQ ID NO: 4869993 - DNA, 16 bp, Homo sapiens
ctgtgttttgaaagaa

SEQ ID NO: 4869994 - DNA, 22 bp, Homo sapiens
ctgttaaggacccttttaagca

SEQ ID NO: 4869995 - DNA, 21 bp, Homo sapiens
ctgttacttatgtagaaactg

SEQ ID NO: 4869996 - DNA, 14 bp, Homo sapiens
ctgttagcagagtc

SEQ ID NO: 4869997 - DNA, 15 bp, Homo sapiens
ctgttagcagagtct

SEQ ID NO: 4869998 - DNA, 19 bp, Homo sapiens
ctgttagcagagtctgtct

SEQ ID NO: 4869999 - DNA, 20 bp, Homo sapiens
ctgttagcagagtctgtctc

SEQ ID NO: 4870000 - DNA, 23 bp, Homo sapiens
ctgttagcagagtctgtctcttg

SEQ ID NO: 4870001 - DNA, 17 bp, Homo sapiens
ctgttatcagtaatgct

SEQ ID NO: 4870002 - DNA, 20 bp, Homo sapiens
ctgttatcagtaatgctaaa

SEQ ID NO: 4870003 - DNA, 13 bp, Homo sapiens
ctgttatgggctt

SEQ ID NO: 4870004 - DNA, 22 bp, Homo sapiens
ctgttcagctactcccactccc

SEQ ID NO: 4870005 - DNA, 13 bp, Homo sapiens
ctgttccattaca

SEQ ID NO: 4870006 - DNA, 21 bp, Homo sapiens
ctgttccattacaccacagca

SEQ ID NO: 4870007 - DNA, 14 bp, Homo sapiens
ctgttcccccaccc

SEQ ID NO: 4870008 - DNA, 13 bp, Homo sapiens
ctgttcccttgca

SEQ ID NO: 4870009 - DNA, 15 bp, Homo sapiens
ctgttgataaaaact

SEQ ID NO: 4870010 - DNA, 16 bp, Homo sapiens
ctgttgcacttttgaa

SEQ ID NO: 4870011 - DNA, 19 bp, Homo sapiens
ctgttgtaagaattctgat

SEQ ID NO: 4870012 - DNA, 19 bp, Homo sapiens
cttaaacgaagagttccct

SEQ ID NO: 4870013 - DNA, 14 bp, Homo sapiens
cttaaactaaatgt

SEQ ID NO: 4870014 - DNA, 12 bp, Homo sapiens
cttaaatttaat

SEQ ID NO: 4870015 - DNA, 23 bp, Homo sapiens
cttaagtcctaaaagttctcaat

SEQ ID NO: 4870016 - DNA, 21 bp, Homo sapiens
cttacaacccagggtgtgaac

SEQ ID NO: 4870017 - DNA, 18 bp, Homo sapiens
cttacaagcctaagaatc

SEQ ID NO: 4870018 - DNA, 16 bp, Homo sapiens
cttacagcctctgact

SEQ ID NO: 4870019 - DNA, 12 bp, Homo sapiens
cttacaggagcc

SEQ ID NO: 4870020 - DNA, 15 bp, Homo sapiens
cttacaggagccagc

SEQ ID NO: 4870021 - DNA, 19 bp, Homo sapiens
cttacaggagccagcctgc

SEQ ID NO: 4870022 - DNA, 19 bp, Homo sapiens
cttaccccaaagagaaaga

SEQ ID NO: 4870023 - DNA, 18 bp, Homo sapiens
cttacctgggcacaaaca

SEQ ID NO: 4870024 - DNA, 22 bp, Homo sapiens
cttacctgggcacaaacagaat

SEQ ID NO: 4870025 - DNA, 23 bp, Homo sapiens
cttacttcaaagtgcctgggctc

SEQ ID NO: 4870026 - DNA, 21 bp, Homo sapiens
cttacttttaaggataaatca

SEQ ID NO: 4870027 - DNA, 20 bp, Homo sapiens
cttagagattgcatttttat

SEQ ID NO: 4870028 - DNA, 14 bp, Homo sapiens
cttagcatggtacc

SEQ ID NO: 4870029 - DNA, 15 bp, Homo sapiens
cttagctgaggctga

SEQ ID NO: 4870030 - DNA, 18 bp, Homo sapiens
cttagctgaggctgagaa

SEQ ID NO: 4870031 - DNA, 21 bp, Homo sapiens
cttagctgaggctgagaaagc

SEQ ID NO: 4870032 - DNA, 21 bp, Homo sapiens
cttaggctactgtaatgctgc

SEQ ID NO: 4870033 - DNA, 23 bp, Homo sapiens
cttagggactacccatagacatg

SEQ ID NO: 4870034 - DNA, 19 bp, Homo sapiens
cttataacctagttaaaga

SEQ ID NO: 4870035 - DNA, 21 bp, Homo sapiens
cttatagtctaagactatata

SEQ ID NO: 4870036 - DNA, 14 bp, Homo sapiens
cttatctctttcca

SEQ ID NO: 4870037 - DNA, 24 bp, Homo sapiens
cttatctgaaaggccagcagctga

SEQ ID NO: 4870038 - DNA, 15 bp, Homo sapiens
cttatgtagaaactg

SEQ ID NO: 4870039 - DNA, 22 bp, Homo sapiens
cttatgtagaaactgaggccca

SEQ ID NO: 4870040 - DNA, 13 bp, Homo sapiens
cttattgaatata

SEQ ID NO: 4870041 - DNA, 17 bp, Homo sapiens
cttattttctcaatctc

SEQ ID NO: 4870042 - DNA, 22 bp, Homo sapiens
cttattttgttggtgctttgca

SEQ ID NO: 4870043 - DNA, 21 bp, Homo sapiens
cttcaaaaagccacagcagag

SEQ ID NO: 4870044 - DNA, 22 bp, Homo sapiens
cttcaaaaagccacagcagagc

SEQ ID NO: 4870045 - DNA, 15 bp, Homo sapiens
cttcaaagccttctc

SEQ ID NO: 4870046 - DNA, 13 bp, Homo sapiens
cttcaaagtgcct

SEQ ID NO: 4870047 - DNA, 14 bp, Homo sapiens
cttcaaagtgcctg

SEQ ID NO: 4870048 - DNA, 16 bp, Homo sapiens
cttcaaagtgcctggg

SEQ ID NO: 4870049 - DNA, 18 bp, Homo sapiens
cttcaaagtgcctgggct

SEQ ID NO: 4870050 - DNA, 14 bp, Homo sapiens
cttcaacagccaag

SEQ ID NO: 4870051 - DNA, 21 bp, Homo sapiens
cttcaacagccaagctggcac

SEQ ID NO: 4870052 - DNA, 19 bp, Homo sapiens
cttcaaccccgaggtccct

SEQ ID NO: 4870053 - DNA, 16 bp, Homo sapiens
cttcaaggctcttctt

SEQ ID NO: 4870054 - DNA, 22 bp, Homo sapiens
cttcaatttctagtacctgtga

SEQ ID NO: 4870055 - DNA, 14 bp, Homo sapiens
cttcacctccttct

SEQ ID NO: 4870056 - DNA, 16 bp, Homo sapiens
cttcacctccttctgc

SEQ ID NO: 4870057 - DNA, 17 bp, Homo sapiens
cttcactcaaattttgg

SEQ ID NO: 4870058 - DNA, 15 bp, Homo sapiens
cttcagcattgtaat

SEQ ID NO: 4870059 - DNA, 16 bp, Homo sapiens
cttcagcattgtaatt

SEQ ID NO: 4870060 - DNA, 23 bp, Homo sapiens
cttcagcattgtaattatgtaaa

SEQ ID NO: 4870061 - DNA, 15 bp, Homo sapiens
cttcagccaggcaag

SEQ ID NO: 4870062 - DNA, 22 bp, Homo sapiens
cttcagccaggtctgactccaa

SEQ ID NO: 4870063 - DNA, 18 bp, Homo sapiens
cttcaggagcctggccag

SEQ ID NO: 4870064 - DNA, 22 bp, Homo sapiens
cttcaggagcctggccaggcag

SEQ ID NO: 4870065 - DNA, 18 bp, Homo sapiens
cttcaggcagctgaaatt

SEQ ID NO: 4870066 - DNA, 23 bp, Homo sapiens
cttcagttgcttgtcttctggta

SEQ ID NO: 4870067 - DNA, 14 bp, Homo sapiens
cttcatcagaactc

SEQ ID NO: 4870068 - DNA, 22 bp, Homo sapiens
cttcatcagaactcttcctcct

SEQ ID NO: 4870069 - DNA, 13 bp, Homo sapiens
cttcatccatcct

SEQ ID NO: 4870070 - DNA, 15 bp, Homo sapiens
cttcatccatcctga

SEQ ID NO: 4870071 - DNA, 16 bp, Homo sapiens
cttcatccatcctgag

SEQ ID NO: 4870072 - DNA, 22 bp, Homo sapiens
cttcatccatcctgagccaaat

SEQ ID NO: 4870073 - DNA, 20 bp, Homo sapiens
cttcatgcctgatgaaagct

SEQ ID NO: 4870074 - DNA, 21 bp, Homo sapiens
cttcatgtaattttattttaa

SEQ ID NO: 4870075 - DNA, 11 bp, Homo sapiens
cttcatttgta

SEQ ID NO: 4870076 - DNA, 13 bp, Homo sapiens
cttccacccacaa

SEQ ID NO: 4870077 - DNA, 17 bp, Homo sapiens
cttccacccacaaactc

SEQ ID NO: 4870078 - DNA, 22 bp, Homo sapiens
cttccagagaacctgtgggctg

SEQ ID NO: 4870079 - DNA, 15 bp, Homo sapiens
cttcccaacagatca

SEQ ID NO: 4870080 - DNA, 14 bp, Homo sapiens
cttcccactccagc

SEQ ID NO: 4870081 - DNA, 15 bp, Homo sapiens
cttcccatctgaaga

SEQ ID NO: 4870082 - DNA, 13 bp, Homo sapiens
cttcccatgcatt

SEQ ID NO: 4870083 - DNA, 23 bp, Homo sapiens
cttcccccagcacaaagcactgg

SEQ ID NO: 4870084 - DNA, 19 bp, Homo sapiens
cttccctgggtttgggagc

SEQ ID NO: 4870085 - DNA, 15 bp, Homo sapiens
cttcctcctcccaag

SEQ ID NO: 4870086 - DNA, 13 bp, Homo sapiens
cttcctctcaggc

SEQ ID NO: 4870087 - DNA, 16 bp, Homo sapiens
cttcctcttgtctgat

SEQ ID NO: 4870088 - DNA, 18 bp, Homo sapiens
cttcctcttgtctgattt

SEQ ID NO: 4870089 - DNA, 23 bp, Homo sapiens
cttcctggcacaatgttggagca

SEQ ID NO: 4870090 - DNA, 19 bp, Homo sapiens
cttccttctcatcttgcct

SEQ ID NO: 4870091 - DNA, 18 bp, Homo sapiens
cttcgactactgctcctg

SEQ ID NO: 4870092 - DNA, 15 bp, Homo sapiens
cttctaaattcccaa

SEQ ID NO: 4870093 - DNA, 17 bp, Homo sapiens
cttctaccctttgtccc

SEQ ID NO: 4870094 - DNA, 22 bp, Homo sapiens
cttctatttatttatttattca

SEQ ID NO: 4870095 - DNA, 14 bp, Homo sapiens
cttctcatgtatat

SEQ ID NO: 4870096 - DNA, 16 bp, Homo sapiens
cttctcccctgccctt

SEQ ID NO: 4870097 - DNA, 16 bp, Homo sapiens
cttctctgctgagaag

SEQ ID NO: 4870098 - DNA, 17 bp, Homo sapiens
cttctctttggggctcc

SEQ ID NO: 4870099 - DNA, 18 bp, Homo sapiens
cttctctttggggctcct

SEQ ID NO: 4870100 - DNA, 18 bp, Homo sapiens
cttctgcaacaagcatgc

SEQ ID NO: 4870101 - DNA, 17 bp, Homo sapiens
cttctgcagtcagactg

SEQ ID NO: 4870102 - DNA, 18 bp, Homo sapiens
cttctgcagtcagactga

SEQ ID NO: 4870103 - DNA, 19 bp, Homo sapiens
cttctgcctcccactccat

SEQ ID NO: 4870104 - DNA, 17 bp, Homo sapiens
cttctgggtccagggag

SEQ ID NO: 4870105 - DNA, 20 bp, Homo sapiens
cttctgtaattgtgtggatt

SEQ ID NO: 4870106 - DNA, 14 bp, Homo sapiens
cttctgtatttcct

SEQ ID NO: 4870107 - DNA, 16 bp, Homo sapiens
cttcttgaatataaaa

SEQ ID NO: 4870108 - DNA, 19 bp, Homo sapiens
cttcttgaatataaaaaat

SEQ ID NO: 4870109 - DNA, 19 bp, Homo sapiens
cttctttggacttctgaag

SEQ ID NO: 4870110 - DNA, 16 bp, Homo sapiens
cttctttggttccatg

SEQ ID NO: 4870111 - DNA, 14 bp, Homo sapiens
cttgaaaaaaaaca

SEQ ID NO: 4870112 - DNA, 14 bp, Homo sapiens
cttgaaacctgatg

SEQ ID NO: 4870113 - DNA, 16 bp, Homo sapiens
cttgaatataaaaaat

SEQ ID NO: 4870114 - DNA, 20 bp, Homo sapiens
cttgaatataaaaaatcatg

SEQ ID NO: 4870115 - DNA, 13 bp, Homo sapiens
cttgacacctgct

SEQ ID NO: 4870116 - DNA, 15 bp, Homo sapiens
cttgacacctgctga

SEQ ID NO: 4870117 - DNA, 19 bp, Homo sapiens
cttgactacctactggtgt

SEQ ID NO: 4870118 - DNA, 14 bp, Homo sapiens
cttgactttccaga

SEQ ID NO: 4870119 - DNA, 13 bp, Homo sapiens
cttgagtctctga

SEQ ID NO: 4870120 - DNA, 17 bp, Homo sapiens
cttgatggggtgagaag

SEQ ID NO: 4870121 - DNA, 15 bp, Homo sapiens
cttgattcattctga

SEQ ID NO: 4870122 - DNA, 15 bp, Homo sapiens
cttgcaacccaaggt

SEQ ID NO: 4870123 - DNA, 20 bp, Homo sapiens
cttgcaacccaaggtgaggt

SEQ ID NO: 4870124 - DNA, 14 bp, Homo sapiens
cttgcagaactgta

SEQ ID NO: 4870125 - DNA, 19 bp, Homo sapiens
cttgcagatatctgcatgt

SEQ ID NO: 4870126 - DNA, 15 bp, Homo sapiens
cttgcagcggctcct

SEQ ID NO: 4870127 - DNA, 17 bp, Homo sapiens
cttgcagcggctcctgc

SEQ ID NO: 4870128 - DNA, 18 bp, Homo sapiens
cttgcagcggctcctgca

SEQ ID NO: 4870129 - DNA, 19 bp, Homo sapiens
cttgcaggggtcccccctc

SEQ ID NO: 4870130 - DNA, 22 bp, Homo sapiens
cttgcagttagactcaaagaag

SEQ ID NO: 4870131 - DNA, 13 bp, Homo sapiens
cttgcatggagaa

SEQ ID NO: 4870132 - DNA, 19 bp, Homo sapiens
cttgcccagactacagggc

SEQ ID NO: 4870133 - DNA, 12 bp, Homo sapiens
cttgctcccaac

SEQ ID NO: 4870134 - DNA, 22 bp, Homo sapiens
cttgctgatcagagttcctcct

SEQ ID NO: 4870135 - DNA, 18 bp, Homo sapiens
cttgctgggctttgggaa

SEQ ID NO: 4870136 - DNA, 12 bp, Homo sapiens
cttgcttcctga

SEQ ID NO: 4870137 - DNA, 14 bp, Homo sapiens
cttgcttccttctc

SEQ ID NO: 4870138 - DNA, 15 bp, Homo sapiens
cttgcttccttctca

SEQ ID NO: 4870139 - DNA, 20 bp, Homo sapiens
cttggaaattcctgtactgt

SEQ ID NO: 4870140 - DNA, 16 bp, Homo sapiens
cttggaagctgtttgg

SEQ ID NO: 4870141 - DNA, 17 bp, Homo sapiens
cttggcccccttcagga

SEQ ID NO: 4870142 - DNA, 20 bp, Homo sapiens
cttgggcttcaacagccaag

SEQ ID NO: 4870143 - DNA, 15 bp, Homo sapiens
cttggggaaggggcc

SEQ ID NO: 4870144 - DNA, 11 bp, Homo sapiens
cttggggaggc

SEQ ID NO: 4870145 - DNA, 23 bp, Homo sapiens
cttgggtagggtagtggctgggg

SEQ ID NO: 4870146 - DNA, 16 bp, Homo sapiens
cttggttctgtgaaca

SEQ ID NO: 4870147 - DNA, 22 bp, Homo sapiens
cttggtttgttatatcagggaa

SEQ ID NO: 4870148 - DNA, 21 bp, Homo sapiens
cttgtatagcatgaaataaaa

SEQ ID NO: 4870149 - DNA, 18 bp, Homo sapiens
cttgtattatctcctttg

SEQ ID NO: 4870150 - DNA, 19 bp, Homo sapiens
cttgtgagagcccattccc

SEQ ID NO: 4870151 - DNA, 14 bp, Homo sapiens
cttgtgggagacag

SEQ ID NO: 4870152 - DNA, 16 bp, Homo sapiens
cttgtgggagacagca

SEQ ID NO: 4870153 - DNA, 16 bp, Homo sapiens
cttgtgttcagaagaa

SEQ ID NO: 4870154 - DNA, 19 bp, Homo sapiens
cttgtttacctttctctct

SEQ ID NO: 4870155 - DNA, 12 bp, Homo sapiens
ctttaaattatg

SEQ ID NO: 4870156 - DNA, 18 bp, Homo sapiens
ctttaagccttcaaaact

SEQ ID NO: 4870157 - DNA, 16 bp, Homo sapiens
ctttagcttacctggg

SEQ ID NO: 4870158 - DNA, 20 bp, Homo sapiens
ctttagcttacctgggcaca

SEQ ID NO: 4870159 - DNA, 13 bp, Homo sapiens
ctttagtttttgg

SEQ ID NO: 4870160 - DNA, 11 bp, Homo sapiens
ctttatatttc

SEQ ID NO: 4870161 - DNA, 16 bp, Homo sapiens
ctttatatttcaataa

SEQ ID NO: 4870162 - DNA, 19 bp, Homo sapiens
ctttattaatgttttcaaa

SEQ ID NO: 4870163 - DNA, 14 bp, Homo sapiens
ctttattgcaatgc

SEQ ID NO: 4870164 - DNA, 15 bp, Homo sapiens
ctttcagaaatataa

SEQ ID NO: 4870165 - DNA, 24 bp, Homo sapiens
ctttcattaccctacagacagctt

SEQ ID NO: 4870166 - DNA, 17 bp, Homo sapiens
ctttccagaatgacctt

SEQ ID NO: 4870167 - DNA, 19 bp, Homo sapiens
ctttccagaatgaccttga

SEQ ID NO: 4870168 - DNA, 21 bp, Homo sapiens
ctttccagaatgaccttgagt

SEQ ID NO: 4870169 - DNA, 22 bp, Homo sapiens
ctttcccctctcatacataaaa

SEQ ID NO: 4870170 - DNA, 15 bp, Homo sapiens
ctttcctactttcta

SEQ ID NO: 4870171 - DNA, 12 bp, Homo sapiens
ctttcctccacc

SEQ ID NO: 4870172 - DNA, 13 bp, Homo sapiens
ctttcctccaccc

SEQ ID NO: 4870173 - DNA, 15 bp, Homo sapiens
ctttcctccacccat

SEQ ID NO: 4870174 - DNA, 22 bp, Homo sapiens
ctttcttcactctggcttcaaa

SEQ ID NO: 4870175 - DNA, 14 bp, Homo sapiens
ctttcttttaatga

SEQ ID NO: 4870176 - DNA, 19 bp, Homo sapiens
ctttcttttaatgatgcca

SEQ ID NO: 4870177 - DNA, 18 bp, Homo sapiens
ctttgaagaaggcaaggc

SEQ ID NO: 4870178 - DNA, 20 bp, Homo sapiens
ctttgactctataagcaaat

SEQ ID NO: 4870179 - DNA, 19 bp, Homo sapiens
ctttgatactaccagggtc

SEQ ID NO: 4870180 - DNA, 21 bp, Homo sapiens
ctttgcagttggactctcagg

SEQ ID NO: 4870181 - DNA, 23 bp, Homo sapiens
ctttgcagttggactctcaggga

SEQ ID NO: 4870182 - DNA, 16 bp, Homo sapiens
ctttgcattttgatat

SEQ ID NO: 4870183 - DNA, 17 bp, Homo sapiens
ctttggaagatgcagaa

SEQ ID NO: 4870184 - DNA, 19 bp, Homo sapiens
ctttggaagatgcagaagc

SEQ ID NO: 4870185 - DNA, 14 bp, Homo sapiens
ctttggacttctga

SEQ ID NO: 4870186 - DNA, 14 bp, Homo sapiens
ctttggattctaaa

SEQ ID NO: 4870187 - DNA, 18 bp, Homo sapiens
ctttggattctaaataca

SEQ ID NO: 4870188 - DNA, 22 bp, Homo sapiens
ctttgggaagtttgctgtgctt

SEQ ID NO: 4870189 - DNA, 17 bp, Homo sapiens
ctttgggaggctgaggc

SEQ ID NO: 4870190 - DNA, 14 bp, Homo sapiens
ctttggttccatgt

SEQ ID NO: 4870191 - DNA, 13 bp, Homo sapiens
ctttgtcagtgtt

SEQ ID NO: 4870192 - DNA, 22 bp, Homo sapiens
ctttgtctaagtagggccaggg

SEQ ID NO: 4870193 - DNA, 22 bp, Homo sapiens
ctttgtttgtcacaagtggtgt

SEQ ID NO: 4870194 - DNA, 23 bp, Homo sapiens
cttttaaggataaatcataaagt

SEQ ID NO: 4870195 - DNA, 16 bp, Homo sapiens
cttttaatccatttca

SEQ ID NO: 4870196 - DNA, 19 bp, Homo sapiens
cttttaatccatttcagga

SEQ ID NO: 4870197 - DNA, 20 bp, Homo sapiens
cttttaggagaaagtgtatt

SEQ ID NO: 4870198 - DNA, 13 bp, Homo sapiens
cttttataaagca

SEQ ID NO: 4870199 - DNA, 16 bp, Homo sapiens
cttttataaagcatgt

SEQ ID NO: 4870200 - DNA, 17 bp, Homo sapiens
cttttctctggtaatat

SEQ ID NO: 4870201 - DNA, 21 bp, Homo sapiens
cttttgaagcatagataatat

SEQ ID NO: 4870202 - DNA, 15 bp, Homo sapiens
cttttgtagatggcg

SEQ ID NO: 4870203 - DNA, 15 bp, Homo sapiens
cttttgtttggtaaa

SEQ ID NO: 4870204 - DNA, 18 bp, Homo sapiens
cttttgtttggtaaatgt

SEQ ID NO: 4870205 - DNA, 18 bp, Homo sapiens
ctttttaaaaattgttat

SEQ ID NO: 4870206 - DNA, 21 bp, Homo sapiens
ctttttaaaaattgttattta

SEQ ID NO: 4870207 - DNA, 21 bp, Homo sapiens
ctttttaaagaagtgcatgaa

SEQ ID NO: 4870208 - DNA, 22 bp, Homo sapiens
ctttttaaagaagtgcatgaaa

SEQ ID NO: 4870209 - DNA, 22 bp, Homo sapiens
ctttttacacttcacctccttc

SEQ ID NO: 4870210 - DNA, 13 bp, Homo sapiens
ctttttattaaaa

SEQ ID NO: 4870211 - DNA, 14 bp, Homo sapiens
ctttttcatagtaa

SEQ ID NO: 4870212 - DNA, 16 bp, Homo sapiens
gaaaaaaaacagtgga

SEQ ID NO: 4870213 - DNA, 18 bp, Homo sapiens
gaaaaaaagctgcaaaaa

SEQ ID NO: 4870214 - DNA, 12 bp, Homo sapiens
gaaaaatataaa

SEQ ID NO: 4870215 - DNA, 17 bp, Homo sapiens
gaaaaatataaaattat

SEQ ID NO: 4870216 - DNA, 14 bp, Homo sapiens
gaaaaccactttat

SEQ ID NO: 4870217 - DNA, 15 bp, Homo sapiens
gaaaagaaaacaaaa

SEQ ID NO: 4870218 - DNA, 19 bp, Homo sapiens
gaaaagataaagaccagaa

SEQ ID NO: 4870219 - DNA, 22 bp, Homo sapiens
gaaaagataaagaccagaaatt

SEQ ID NO: 4870220 - DNA, 13 bp, Homo sapiens
gaaaaggttgaat

SEQ ID NO: 4870221 - DNA, 20 bp, Homo sapiens
gaaaagtatattgataacct

SEQ ID NO: 4870222 - DNA, 13 bp, Homo sapiens
gaaaataactgaa

SEQ ID NO: 4870223 - DNA, 16 bp, Homo sapiens
gaaaatataatgatca

SEQ ID NO: 4870224 - DNA, 15 bp, Homo sapiens
gaaacaaataatttg

SEQ ID NO: 4870225 - DNA, 18 bp, Homo sapiens
gaaacaaataatttgaac

SEQ ID NO: 4870226 - DNA, 18 bp, Homo sapiens
gaaacaacatttatatgt

SEQ ID NO: 4870227 - DNA, 23 bp, Homo sapiens
gaaacactatttgtgacttttta

SEQ ID NO: 4870228 - DNA, 17 bp, Homo sapiens
gaaaccaacaagaacca

SEQ ID NO: 4870229 - DNA, 22 bp, Homo sapiens
gaaagagctaggaaccctggag

SEQ ID NO: 4870230 - DNA, 20 bp, Homo sapiens
gaaagcaaaggtgcactcca

SEQ ID NO: 4870231 - DNA, 22 bp, Homo sapiens
gaaagcaaaggtgcactccaga

SEQ ID NO: 4870232 - DNA, 15 bp, Homo sapiens
gaaagcttccttcaa

SEQ ID NO: 4870233 - DNA, 12 bp, Homo sapiens
gaaaggcagggc

SEQ ID NO: 4870234 - DNA, 21 bp, Homo sapiens
gaaaggccagcagctgatgct

SEQ ID NO: 4870235 - DNA, 17 bp, Homo sapiens
gaaaggtgtgaggagag

SEQ ID NO: 4870236 - DNA, 11 bp, Homo sapiens
gaaagtttttt

SEQ ID NO: 4870237 - DNA, 13 bp, Homo sapiens
gaaataataaaaa

SEQ ID NO: 4870238 - DNA, 23 bp, Homo sapiens
gaaataatgctacaattttaaga

SEQ ID NO: 4870239 - DNA, 15 bp, Homo sapiens
gaaatactcatgtgc

SEQ ID NO: 4870240 - DNA, 16 bp, Homo sapiens
gaaatagaattataac

SEQ ID NO: 4870241 - DNA, 13 bp, Homo sapiens
gaaatagacaaaa

SEQ ID NO: 4870242 - DNA, 19 bp, Homo sapiens
gaaatagacaaaaagtata

SEQ ID NO: 4870243 - DNA, 19 bp, Homo sapiens
gaaataggatctccactgg

SEQ ID NO: 4870244 - DNA, 18 bp, Homo sapiens
gaaatataacacattttt

SEQ ID NO: 4870245 - DNA, 20 bp, Homo sapiens
gaaatatattacttaactgt

SEQ ID NO: 4870246 - DNA, 20 bp, Homo sapiens
gaaatcagtaatatttatat

SEQ ID NO: 4870247 - DNA, 15 bp, Homo sapiens
gaaatggaaagcaga

SEQ ID NO: 4870248 - DNA, 21 bp, Homo sapiens
gaaatggaggatctctaaaga

SEQ ID NO: 4870249 - DNA, 23 bp, Homo sapiens
gaaatggcctgtccctagggctc

SEQ ID NO: 4870250 - DNA, 13 bp, Homo sapiens
gaaattgcatact

SEQ ID NO: 4870251 - DNA, 20 bp, Homo sapiens
gaacactgtgaccaggcttt

SEQ ID NO: 4870252 - DNA, 19 bp, Homo sapiens
gaacagagtgcaacccagt

SEQ ID NO: 4870253 - DNA, 18 bp, Homo sapiens
gaacagccttagagctct

SEQ ID NO: 4870254 - DNA, 12 bp, Homo sapiens
gaacaggaaaga

SEQ ID NO: 4870255 - DNA, 17 bp, Homo sapiens
gaacaggaaagagctag

SEQ ID NO: 4870256 - DNA, 16 bp, Homo sapiens
gaacataacttctcat

SEQ ID NO: 4870257 - DNA, 22 bp, Homo sapiens
gaacataacttctcatgtatat

SEQ ID NO: 4870258 - DNA, 13 bp, Homo sapiens
gaaccataaattc

SEQ ID NO: 4870259 - DNA, 15 bp, Homo sapiens
gaaccataaattcaa

SEQ ID NO: 4870260 - DNA, 21 bp, Homo sapiens
gaacccccctcccacccaccg

SEQ ID NO: 4870261 - DNA, 13 bp, Homo sapiens
gaaccctccaaag

SEQ ID NO: 4870262 - DNA, 16 bp, Homo sapiens
gaaccctggaggtaaa

SEQ ID NO: 4870263 - DNA, 21 bp, Homo sapiens
gaaccgcagaagcctccccag

SEQ ID NO: 4870264 - DNA, 16 bp, Homo sapiens
gaacctctaagtgctg

SEQ ID NO: 4870265 - DNA, 14 bp, Homo sapiens
gaactcccccagag

SEQ ID NO: 4870266 - DNA, 24 bp, Homo sapiens
gaactcctgtcttctttctccatg

SEQ ID NO: 4870267 - DNA, 11 bp, Homo sapiens
gaactgaaatc

SEQ ID NO: 4870268 - DNA, 19 bp, Homo sapiens
gaactgaaatccttgagag

SEQ ID NO: 4870269 - DNA, 20 bp, Homo sapiens
gaactgtagctgccatggct

SEQ ID NO: 4870270 - DNA, 21 bp, Homo sapiens
gaagaaaatttgccaatcttt

SEQ ID NO: 4870271 - DNA, 12 bp, Homo sapiens
gaagaaagatgt

SEQ ID NO: 4870272 - DNA, 10 bp, Homo sapiens
gaagaaggca

SEQ ID NO: 4870273 - DNA, 16 bp, Homo sapiens
gaagaaggccagagag

SEQ ID NO: 4870274 - DNA, 17 bp, Homo sapiens
gaagaaggccagagagg

SEQ ID NO: 4870275 - DNA, 20 bp, Homo sapiens
gaagaaggccagagagggaa

SEQ ID NO: 4870276 - DNA, 19 bp, Homo sapiens
gaagaagtgagcagtgttg

SEQ ID NO: 4870277 - DNA, 20 bp, Homo sapiens
gaagaatcttcctggcacaa

SEQ ID NO: 4870278 - DNA, 12 bp, Homo sapiens
gaagaatgaaag

SEQ ID NO: 4870279 - DNA, 16 bp, Homo sapiens
gaagaatgaaagctgt

SEQ ID NO: 4870280 - DNA, 22 bp, Homo sapiens
gaagaattgaaaagtttttgtt

SEQ ID NO: 4870281 - DNA, 13 bp, Homo sapiens
gaagacctgaaag

SEQ ID NO: 4870282 - DNA, 15 bp, Homo sapiens
gaagacctgaaagag

SEQ ID NO: 4870283 - DNA, 20 bp, Homo sapiens
gaagagttcccttgaaactt

SEQ ID NO: 4870284 - DNA, 21 bp, Homo sapiens
gaagagttcccttgaaacttt

SEQ ID NO: 4870285 - DNA, 21 bp, Homo sapiens
gaagatagtcttggaagctgt

SEQ ID NO: 4870286 - DNA, 17 bp, Homo sapiens
gaagatctttatatttc

SEQ ID NO: 4870287 - DNA, 20 bp, Homo sapiens
gaagattctatgttaatatt

SEQ ID NO: 4870288 - DNA, 23 bp, Homo sapiens
gaagcaagaggcaagctgaaatt

SEQ ID NO: 4870289 - DNA, 16 bp, Homo sapiens
gaagcaataggtagct

SEQ ID NO: 4870290 - DNA, 13 bp, Homo sapiens
gaagcagtatttt

SEQ ID NO: 4870291 - DNA, 16 bp, Homo sapiens
gaagccaccgggagat

SEQ ID NO: 4870292 - DNA, 18 bp, Homo sapiens
gaagccagtgtctaggca

SEQ ID NO: 4870293 - DNA, 13 bp, Homo sapiens
gaagctggagcag

SEQ ID NO: 4870294 - DNA, 12 bp, Homo sapiens
gaaggagaatgg

SEQ ID NO: 4870295 - DNA, 19 bp, Homo sapiens
gaaggagaatggcatggca

SEQ ID NO: 4870296 - DNA, 13 bp, Homo sapiens
gaaggccagagag

SEQ ID NO: 4870297 - DNA, 17 bp, Homo sapiens
gaaggctctcaccccca

SEQ ID NO: 4870298 - DNA, 14 bp, Homo sapiens
gaagggaaagtttt

SEQ ID NO: 4870299 - DNA, 19 bp, Homo sapiens
gaagggagcattgcagcct

SEQ ID NO: 4870300 - DNA, 16 bp, Homo sapiens
gaaggggcctgggctg

SEQ ID NO: 4870301 - DNA, 19 bp, Homo sapiens
gaaggggctggtggagatg

SEQ ID NO: 4870302 - DNA, 15 bp, Homo sapiens
gaaggtagaatgttt

SEQ ID NO: 4870303 - DNA, 20 bp, Homo sapiens
gaaggtagaatgttttcaaa

SEQ ID NO: 4870304 - DNA, 17 bp, Homo sapiens
gaaggtgataagggaaa

SEQ ID NO: 4870305 - DNA, 20 bp, Homo sapiens
gaagtcagaatttttaactg

SEQ ID NO: 4870306 - DNA, 22 bp, Homo sapiens
gaagtcagaatttttaactgta

SEQ ID NO: 4870307 - DNA, 15 bp, Homo sapiens
gaagtttcaagtttt

SEQ ID NO: 4870308 - DNA, 21 bp, Homo sapiens
gaagtttcaagttttaaagtt

SEQ ID NO: 4870309 - DNA, 18 bp, Homo sapiens
gaataatttccttcaggc

SEQ ID NO: 4870310 - DNA, 22 bp, Homo sapiens
gaataatttccttcaggcagct

SEQ ID NO: 4870311 - DNA, 16 bp, Homo sapiens
gaatagatatgaaagc

SEQ ID NO: 4870312 - DNA, 19 bp, Homo sapiens
gaatagatatgaaagctga

SEQ ID NO: 4870313 - DNA, 13 bp, Homo sapiens
gaatattaaaaaa

SEQ ID NO: 4870314 - DNA, 15 bp, Homo sapiens
gaatcagacagcagg

SEQ ID NO: 4870315 - DNA, 16 bp, Homo sapiens
gaatcttgttttgaaa

SEQ ID NO: 4870316 - DNA, 20 bp, Homo sapiens
gaatgaaaataactgaattt

SEQ ID NO: 4870317 - DNA, 23 bp, Homo sapiens
gaatgaaaataactgaatttgga

SEQ ID NO: 4870318 - DNA, 16 bp, Homo sapiens
gaatgaagcagtattt

SEQ ID NO: 4870319 - DNA, 22 bp, Homo sapiens
gaatgaatgggatattttgaaa

SEQ ID NO: 4870320 - DNA, 16 bp, Homo sapiens
gaatgaggaaaattct

SEQ ID NO: 4870321 - DNA, 21 bp, Homo sapiens
gaatgcttttagtgtgtgcat

SEQ ID NO: 4870322 - DNA, 17 bp, Homo sapiens
gaatggcatggcaggag

SEQ ID NO: 4870323 - DNA, 19 bp, Homo sapiens
gaatggcatggcaggagtc

SEQ ID NO: 4870324 - DNA, 17 bp, Homo sapiens
gaatggccacaaacctg

SEQ ID NO: 4870325 - DNA, 20 bp, Homo sapiens
gaatggccacaaacctgccc

SEQ ID NO: 4870326 - DNA, 13 bp, Homo sapiens
gaatggcctggag

SEQ ID NO: 4870327 - DNA, 16 bp, Homo sapiens
gaatggcctggagcag

SEQ ID NO: 4870328 - DNA, 19 bp, Homo sapiens
gaatggcctggagcaggcc

SEQ ID NO: 4870329 - DNA, 21 bp, Homo sapiens
gaatgtcagttgttatttatt

SEQ ID NO: 4870330 - DNA, 19 bp, Homo sapiens
gaatgtgctggtgaacact

SEQ ID NO: 4870331 - DNA, 13 bp, Homo sapiens
gaatgttaaaggg

SEQ ID NO: 4870332 - DNA, 21 bp, Homo sapiens
gaattaatatccctacatgta

SEQ ID NO: 4870333 - DNA, 21 bp, Homo sapiens
gaattataactgtaaagatgt

SEQ ID NO: 4870334 - DNA, 15 bp, Homo sapiens
gaattctgattgatt

SEQ ID NO: 4870335 - DNA, 19 bp, Homo sapiens
gaattgaggggaggtggcc

SEQ ID NO: 4870336 - DNA, 20 bp, Homo sapiens
gaattgaggggaggtggcca

SEQ ID NO: 4870337 - DNA, 21 bp, Homo sapiens
gaattgaggggaggtggccag

SEQ ID NO: 4870338 - DNA, 15 bp, Homo sapiens
gaatttaatatatat

SEQ ID NO: 4870339 - DNA, 20 bp, Homo sapiens
gaatttgaggtctagagaga

SEQ ID NO: 4870340 - DNA, 18 bp, Homo sapiens
gacaaccattaaagtcag

SEQ ID NO: 4870341 - DNA, 19 bp, Homo sapiens
gacaaccattaaagtcaga

SEQ ID NO: 4870342 - DNA, 13 bp, Homo sapiens
gacaaccttgtcc

SEQ ID NO: 4870343 - DNA, 22 bp, Homo sapiens
gacaagagttggggacagaact

SEQ ID NO: 4870344 - DNA, 15 bp, Homo sapiens
gacaaggcctgcttg

SEQ ID NO: 4870345 - DNA, 14 bp, Homo sapiens
gacaagtgctgttg

SEQ ID NO: 4870346 - DNA, 23 bp, Homo sapiens
gacaccattaccaaaataataaa

SEQ ID NO: 4870347 - DNA, 18 bp, Homo sapiens
gacactgttgataaaaac

SEQ ID NO: 4870348 - DNA, 13 bp, Homo sapiens
gacagagctctgg

SEQ ID NO: 4870349 - DNA, 20 bp, Homo sapiens
gacagaggtttgaaggagaa

SEQ ID NO: 4870350 - DNA, 22 bp, Homo sapiens
gacagaggtttgaaggagaatg

SEQ ID NO: 4870351 - DNA, 16 bp, Homo sapiens
gacagcaagtgagcag

SEQ ID NO: 4870352 - DNA, 11 bp, Homo sapiens
gacagccacac

SEQ ID NO: 4870353 - DNA, 15 bp, Homo sapiens
gacagccatgcgtgg

SEQ ID NO: 4870354 - DNA, 15 bp, Homo sapiens
gacagctccgggatc

SEQ ID NO: 4870355 - DNA, 22 bp, Homo sapiens
gacagctggcggaggctgctcg

SEQ ID NO: 4870356 - DNA, 16 bp, Homo sapiens
gacagcttacaggagc

SEQ ID NO: 4870357 - DNA, 18 bp, Homo sapiens
gacagcttacaggagcca

SEQ ID NO: 4870358 - DNA, 16 bp, Homo sapiens
gacaggaaagagagga

SEQ ID NO: 4870359 - DNA, 20 bp, Homo sapiens
gacagggcccccacagggga

SEQ ID NO: 4870360 - DNA, 21 bp, Homo sapiens
gacaggtgcctaacctgggac

SEQ ID NO: 4870361 - DNA, 20 bp, Homo sapiens
gacagttgatggagccccag

SEQ ID NO: 4870362 - DNA, 21 bp, Homo sapiens
gacagttgatggagccccagg

SEQ ID NO: 4870363 - DNA, 14 bp, Homo sapiens
gacagtttttgaca

SEQ ID NO: 4870364 - DNA, 21 bp, Homo sapiens
gacatcatcattcttgtggga

SEQ ID NO: 4870365 - DNA, 14 bp, Homo sapiens
gacatctgacccca

SEQ ID NO: 4870366 - DNA, 15 bp, Homo sapiens
gacatctgaccccaa

SEQ ID NO: 4870367 - DNA, 17 bp, Homo sapiens
gacatgcaataaaattt

SEQ ID NO: 4870368 - DNA, 20 bp, Homo sapiens
gacatgcaataaaatttaaa

SEQ ID NO: 4870369 - DNA, 18 bp, Homo sapiens
gacatttatattaaataa

SEQ ID NO: 4870370 - DNA, 13 bp, Homo sapiens
gacatttctttgg

SEQ ID NO: 4870371 - DNA, 21 bp, Homo sapiens
gacatttgtgggcaagcagat

SEQ ID NO: 4870372 - DNA, 16 bp, Homo sapiens
gacattttatgtcttt

SEQ ID NO: 4870373 - DNA, 14 bp, Homo sapiens
gaccaaaatcagct

SEQ ID NO: 4870374 - DNA, 15 bp, Homo sapiens
gaccaatgcttgcat

SEQ ID NO: 4870375 - DNA, 15 bp, Homo sapiens
gaccagagctgtctg

SEQ ID NO: 4870376 - DNA, 22 bp, Homo sapiens
gaccagtttaagccgcagacct

SEQ ID NO: 4870377 - DNA, 17 bp, Homo sapiens
gacccatccctgcctgg

SEQ ID NO: 4870378 - DNA, 21 bp, Homo sapiens
gacccatccctgcctggaggc

SEQ ID NO: 4870379 - DNA, 18 bp, Homo sapiens
gaccccaagggggctgct

SEQ ID NO: 4870380 - DNA, 22 bp, Homo sapiens
gaccccaagggggctgctgctc

SEQ ID NO: 4870381 - DNA, 20 bp, Homo sapiens
gaccccagatacctgtgagg

SEQ ID NO: 4870382 - DNA, 22 bp, Homo sapiens
gaccccattcctgatcccatgg

SEQ ID NO: 4870383 - DNA, 20 bp, Homo sapiens
gacccttacagcctctgact

SEQ ID NO: 4870384 - DNA, 13 bp, Homo sapiens
gacccttttaagc

SEQ ID NO: 4870385 - DNA, 21 bp, Homo sapiens
gacctactaggagaggggggc

SEQ ID NO: 4870386 - DNA, 19 bp, Homo sapiens
gacctagctctttgggcct

SEQ ID NO: 4870387 - DNA, 15 bp, Homo sapiens
gacctccccacccgc

SEQ ID NO: 4870388 - DNA, 19 bp, Homo sapiens
gacctccccacccgctccc

SEQ ID NO: 4870389 - DNA, 14 bp, Homo sapiens
gacctccctgtctc

SEQ ID NO: 4870390 - DNA, 20 bp, Homo sapiens
gacctccttagccctgtctg

SEQ ID NO: 4870391 - DNA, 18 bp, Homo sapiens
gacctgaccccattcctg

SEQ ID NO: 4870392 - DNA, 12 bp, Homo sapiens
gacctgccccaa

SEQ ID NO: 4870393 - DNA, 17 bp, Homo sapiens
gacgctccctgctccac

SEQ ID NO: 4870394 - DNA, 14 bp, Homo sapiens
gacgggatgacctc

SEQ ID NO: 4870395 - DNA, 19 bp, Homo sapiens
gacgtctggggtgtgggga

SEQ ID NO: 4870396 - DNA, 20 bp, Homo sapiens
gacgtctggggtgtggggat

SEQ ID NO: 4870397 - DNA, 17 bp, Homo sapiens
gacgttaggccaggcct

SEQ ID NO: 4870398 - DNA, 19 bp, Homo sapiens
gactacttggaactaggct

SEQ ID NO: 4870399 - DNA, 23 bp, Homo sapiens
gactagaactcctgtcttctttc

SEQ ID NO: 4870400 - DNA, 24 bp, Homo sapiens
gactaggacctgagcctggtcctg

SEQ ID NO: 4870401 - DNA, 22 bp, Homo sapiens
gactaggttctgtagagccaat

SEQ ID NO: 4870402 - DNA, 18 bp, Homo sapiens
gactatatatataaatgt

SEQ ID NO: 4870403 - DNA, 19 bp, Homo sapiens
gactatatatataaatgta

SEQ ID NO: 4870404 - DNA, 15 bp, Homo sapiens
gactcagcagagtga

SEQ ID NO: 4870405 - DNA, 18 bp, Homo sapiens
gactcagtgaccagtgcc

SEQ ID NO: 4870406 - DNA, 13 bp, Homo sapiens
gactccaaagctg

SEQ ID NO: 4870407 - DNA, 22 bp, Homo sapiens
gactccaagccctggggcaggg

SEQ ID NO: 4870408 - DNA, 12 bp, Homo sapiens
gactctcaggga

SEQ ID NO: 4870409 - DNA, 14 bp, Homo sapiens
gactctctccagga

SEQ ID NO: 4870410 - DNA, 21 bp, Homo sapiens
gactctgcacccgcctcgacc

SEQ ID NO: 4870411 - DNA, 19 bp, Homo sapiens
gactcttatttatagaatt

SEQ ID NO: 4870412 - DNA, 23 bp, Homo sapiens
gactgacttatggcatgactctt

SEQ ID NO: 4870413 - DNA, 13 bp, Homo sapiens
gactgagccagat

SEQ ID NO: 4870414 - DNA, 17 bp, Homo sapiens
gactgcatggggaggca

SEQ ID NO: 4870415 - DNA, 22 bp, Homo sapiens
gactgctcctgggcattagcaa

SEQ ID NO: 4870416 - DNA, 15 bp, Homo sapiens
gactggaaagcacaa

SEQ ID NO: 4870417 - DNA, 16 bp, Homo sapiens
gactggaaagcacaag

SEQ ID NO: 4870418 - DNA, 24 bp, Homo sapiens
gactggcccagtgccagcaagtcc

SEQ ID NO: 4870419 - DNA, 18 bp, Homo sapiens
gactggttctgaggccag

SEQ ID NO: 4870420 - DNA, 15 bp, Homo sapiens
gactggttgtctctc

SEQ ID NO: 4870421 - DNA, 14 bp, Homo sapiens
gactgtcagtgggg

SEQ ID NO: 4870422 - DNA, 13 bp, Homo sapiens
gactgttgagtta

SEQ ID NO: 4870423 - DNA, 14 bp, Homo sapiens
gacttatggcatga

SEQ ID NO: 4870424 - DNA, 20 bp, Homo sapiens
gacttatggcatgactcttc

SEQ ID NO: 4870425 - DNA, 15 bp, Homo sapiens
gacttctcccctgcc

SEQ ID NO: 4870426 - DNA, 22 bp, Homo sapiens
gacttctcccctgcccttcctc

SEQ ID NO: 4870427 - DNA, 13 bp, Homo sapiens
gacttgaaagaaa

SEQ ID NO: 4870428 - DNA, 15 bp, Homo sapiens
gacttgcagttagac

SEQ ID NO: 4870429 - DNA, 14 bp, Homo sapiens
gactttccagaatg

SEQ ID NO: 4870430 - DNA, 14 bp, Homo sapiens
gagaaacccagaga

SEQ ID NO: 4870431 - DNA, 13 bp, Homo sapiens
gagaaatgcccca

SEQ ID NO: 4870432 - DNA, 20 bp, Homo sapiens
gagaaggggctttgtgacca

SEQ ID NO: 4870433 - DNA, 16 bp, Homo sapiens
gagaagtatacataag

SEQ ID NO: 4870434 - DNA, 20 bp, Homo sapiens
gagaagtcttctatttattt

SEQ ID NO: 4870435 - DNA, 16 bp, Homo sapiens
gagaatactgccaaaa

SEQ ID NO: 4870436 - DNA, 20 bp, Homo sapiens
gagaatggcctggagcaggc

SEQ ID NO: 4870437 - DNA, 21 bp, Homo sapiens
gagaatggcctggagcaggcc

SEQ ID NO: 4870438 - DNA, 22 bp, Homo sapiens
gagaatggcctggagcaggccc

SEQ ID NO: 4870439 - DNA, 20 bp, Homo sapiens
gagaatgggacgaggacatt

SEQ ID NO: 4870440 - DNA, 21 bp, Homo sapiens
gagaatgtattttcatagatg

SEQ ID NO: 4870441 - DNA, 16 bp, Homo sapiens
gagacactgttgataa

SEQ ID NO: 4870442 - DNA, 12 bp, Homo sapiens
gagacagcagcc

SEQ ID NO: 4870443 - DNA, 22 bp, Homo sapiens
gagacaggtgcctaacctggga

SEQ ID NO: 4870444 - DNA, 13 bp, Homo sapiens
gagacatgtgaca

SEQ ID NO: 4870445 - DNA, 20 bp, Homo sapiens
gagacgtttataaacagaaa

SEQ ID NO: 4870446 - DNA, 22 bp, Homo sapiens
gagactgataacttggggaggc

SEQ ID NO: 4870447 - DNA, 22 bp, Homo sapiens
gagactttgatactaccagggt

SEQ ID NO: 4870448 - DNA, 21 bp, Homo sapiens
gagagagttgttttaataact

SEQ ID NO: 4870449 - DNA, 15 bp, Homo sapiens
gagagatcaaagatg

SEQ ID NO: 4870450 - DNA, 23 bp, Homo sapiens
gagagccttacttcaaagtgcct

SEQ ID NO: 4870451 - DNA, 15 bp, Homo sapiens
gagagggaagatgac

SEQ ID NO: 4870452 - DNA, 20 bp, Homo sapiens
gagaggtagcactctcagag

SEQ ID NO: 4870453 - DNA, 23 bp, Homo sapiens
gagagtagctgcagccttcatca

SEQ ID NO: 4870454 - DNA, 15 bp, Homo sapiens
gagagttccggggag

SEQ ID NO: 4870455 - DNA, 19 bp, Homo sapiens
gagatactcttctgcctcc

SEQ ID NO: 4870456 - DNA, 17 bp, Homo sapiens
gagatcgggaagcagaa

SEQ ID NO: 4870457 - DNA, 17 bp, Homo sapiens
gagattcccaccttcca

SEQ ID NO: 4870458 - DNA, 20 bp, Homo sapiens
gagatttctggatggtggtg

SEQ ID NO: 4870459 - DNA, 21 bp, Homo sapiens
gagcacaaaattcaaagcatg

SEQ ID NO: 4870460 - DNA, 12 bp, Homo sapiens
gagcacaaagaa

SEQ ID NO: 4870461 - DNA, 13 bp, Homo sapiens
gagcagagctctc

SEQ ID NO: 4870462 - DNA, 22 bp, Homo sapiens
gagcagagctctcccctcctgc

SEQ ID NO: 4870463 - DNA, 17 bp, Homo sapiens
gagcagcaggcctctgg

SEQ ID NO: 4870464 - DNA, 20 bp, Homo sapiens
gagcagcaggcctctgggac

SEQ ID NO: 4870465 - DNA, 23 bp, Homo sapiens
gagcagcggattgctctggagca

SEQ ID NO: 4870466 - DNA, 22 bp, Homo sapiens
gagcaggcccaatgctgctttt

SEQ ID NO: 4870467 - DNA, 18 bp, Homo sapiens
gagcagggatctgccccc

SEQ ID NO: 4870468 - DNA, 15 bp, Homo sapiens
gagcagggtctctct

SEQ ID NO: 4870469 - DNA, 17 bp, Homo sapiens
gagcataatttaaaaat

SEQ ID NO: 4870470 - DNA, 12 bp, Homo sapiens
gagcatcctgat

SEQ ID NO: 4870471 - DNA, 24 bp, Homo sapiens
gagcattgcagcctaagaagaagg

SEQ ID NO: 4870472 - DNA, 22 bp, Homo sapiens
gagcatttaatggcagctagtg

SEQ ID NO: 4870473 - DNA, 22 bp, Homo sapiens
gagccaaaatggttaatttttc

SEQ ID NO: 4870474 - DNA, 16 bp, Homo sapiens
gagccaattagacttg

SEQ ID NO: 4870475 - DNA, 19 bp, Homo sapiens
gagccaattagacttgaaa

SEQ ID NO: 4870476 - DNA, 20 bp, Homo sapiens
gagccaattagacttgaaat

SEQ ID NO: 4870477 - DNA, 14 bp, Homo sapiens
gagccacttctccc

SEQ ID NO: 4870478 - DNA, 17 bp, Homo sapiens
gagccagcctgcttccc

SEQ ID NO: 4870479 - DNA, 18 bp, Homo sapiens
gagccagcctgcttccca

SEQ ID NO: 4870480 - DNA, 13 bp, Homo sapiens
gagccagctgctt

SEQ ID NO: 4870481 - DNA, 23 bp, Homo sapiens
gagccagctgcttgacctagctc

SEQ ID NO: 4870482 - DNA, 14 bp, Homo sapiens
gagccatacataaa

SEQ ID NO: 4870483 - DNA, 13 bp, Homo sapiens
gagcccattccca

SEQ ID NO: 4870484 - DNA, 14 bp, Homo sapiens
gagcccctactgtg

SEQ ID NO: 4870485 - DNA, 17 bp, Homo sapiens
gagccctattgctgcta

SEQ ID NO: 4870486 - DNA, 21 bp, Homo sapiens
gagcctacctctgtctgagac

SEQ ID NO: 4870487 - DNA, 16 bp, Homo sapiens
gagcctggccaggcag

SEQ ID NO: 4870488 - DNA, 19 bp, Homo sapiens
gagcctggccaggcaggga

SEQ ID NO: 4870489 - DNA, 20 bp, Homo sapiens
gagcctggccaggcagggag

SEQ ID NO: 4870490 - DNA, 20 bp, Homo sapiens
gagcctttttacctggccta

SEQ ID NO: 4870491 - DNA, 17 bp, Homo sapiens
gagcgagagatcaaaga

SEQ ID NO: 4870492 - DNA, 20 bp, Homo sapiens
gagcgagagatcaaagatga

SEQ ID NO: 4870493 - DNA, 16 bp, Homo sapiens
gagctactcccacagc

SEQ ID NO: 4870494 - DNA, 19 bp, Homo sapiens
gagctaggaaccctggagg

SEQ ID NO: 4870495 - DNA, 16 bp, Homo sapiens
gagctctcccctcctg

SEQ ID NO: 4870496 - DNA, 20 bp, Homo sapiens
gagctctcccctcctgctgg

SEQ ID NO: 4870497 - DNA, 22 bp, Homo sapiens
gagctctcccctcctgctgggc

SEQ ID NO: 4870498 - DNA, 21 bp, Homo sapiens
gagctcttcctatccctctcc

SEQ ID NO: 4870499 - DNA, 20 bp, Homo sapiens
gagctcttgtgttcagaaga

SEQ ID NO: 4870500 - DNA, 15 bp, Homo sapiens
gagcttgattaaatc

SEQ ID NO: 4870501 - DNA, 16 bp, Homo sapiens
gaggaaaagtcttcct

SEQ ID NO: 4870502 - DNA, 13 bp, Homo sapiens
gaggaaaattctt

SEQ ID NO: 4870503 - DNA, 18 bp, Homo sapiens
gaggaaccagaggcactt

SEQ ID NO: 4870504 - DNA, 20 bp, Homo sapiens
gaggacatttgtgggcaagc

SEQ ID NO: 4870505 - DNA, 23 bp, Homo sapiens
gaggacatttgtgggcaagcaga

SEQ ID NO: 4870506 - DNA, 24 bp, Homo sapiens
gaggaccaatgcttgcatggagaa

SEQ ID NO: 4870507 - DNA, 18 bp, Homo sapiens
gaggactcacttgcccac

SEQ ID NO: 4870508 - DNA, 21 bp, Homo sapiens
gaggacttggttgatgtttaa

SEQ ID NO: 4870509 - DNA, 20 bp, Homo sapiens
gaggatccagggcagcaggc

SEQ ID NO: 4870510 - DNA, 21 bp, Homo sapiens
gaggatccagggcagcaggcc

SEQ ID NO: 4870511 - DNA, 23 bp, Homo sapiens
gaggatccagggcagcaggccag

SEQ ID NO: 4870512 - DNA, 14 bp, Homo sapiens
gaggcaaaaatgtc

SEQ ID NO: 4870513 - DNA, 14 bp, Homo sapiens
gaggcaagagactg

SEQ ID NO: 4870514 - DNA, 13 bp, Homo sapiens
gaggcagcagagc

SEQ ID NO: 4870515 - DNA, 14 bp, Homo sapiens
gaggccagaaaggt

SEQ ID NO: 4870516 - DNA, 12 bp, Homo sapiens
gaggcccagaga

SEQ ID NO: 4870517 - DNA, 13 bp, Homo sapiens
gaggcccagagag

SEQ ID NO: 4870518 - DNA, 17 bp, Homo sapiens
gaggcccagagagggaa

SEQ ID NO: 4870519 - DNA, 18 bp, Homo sapiens
gaggcctcaccccaggga

SEQ ID NO: 4870520 - DNA, 16 bp, Homo sapiens
gaggctcagagaggta

SEQ ID NO: 4870521 - DNA, 21 bp, Homo sapiens
gaggctcctctaggccctgtg

SEQ ID NO: 4870522 - DNA, 19 bp, Homo sapiens
gagggaaaaggcaggtgct

SEQ ID NO: 4870523 - DNA, 20 bp, Homo sapiens
gagggaagacctgaaagaga

SEQ ID NO: 4870524 - DNA, 15 bp, Homo sapiens
gagggaatctagccc

SEQ ID NO: 4870525 - DNA, 16 bp, Homo sapiens
gagggaatctagccca

SEQ ID NO: 4870526 - DNA, 14 bp, Homo sapiens
gagggactccaagc

SEQ ID NO: 4870527 - DNA, 18 bp, Homo sapiens
gagggactccaagccctg

SEQ ID NO: 4870528 - DNA, 18 bp, Homo sapiens
gagggatgatgagggaag

SEQ ID NO: 4870529 - DNA, 22 bp, Homo sapiens
gagggatgatgagggaagcaat

SEQ ID NO: 4870530 - DNA, 13 bp, Homo sapiens
gagggcccctgcg

SEQ ID NO: 4870531 - DNA, 19 bp, Homo sapiens
gagggcccctgcgtggggg

SEQ ID NO: 4870532 - DNA, 20 bp, Homo sapiens
gagggcccctgcgtgggggc

SEQ ID NO: 4870533 - DNA, 20 bp, Homo sapiens
gagggccggttctaaggctc

SEQ ID NO: 4870534 - DNA, 16 bp, Homo sapiens
gaggggcgcgggaggg

SEQ ID NO: 4870535 - DNA, 20 bp, Homo sapiens
gagggtggttcaacaaagaa

SEQ ID NO: 4870536 - DNA, 15 bp, Homo sapiens
gagggttctaagtgg

SEQ ID NO: 4870537 - DNA, 17 bp, Homo sapiens
gaggtagcactctcaga

SEQ ID NO: 4870538 - DNA, 19 bp, Homo sapiens
gaggtgaactccaggcatg

SEQ ID NO: 4870539 - DNA, 18 bp, Homo sapiens
gaggtggatactgggggg

SEQ ID NO: 4870540 - DNA, 23 bp, Homo sapiens
gaggtggatactggggggcaggc

SEQ ID NO: 4870541 - DNA, 19 bp, Homo sapiens
gaggtttgaaggagaatgg

SEQ ID NO: 4870542 - DNA, 20 bp, Homo sapiens
gaggtttgaaggagaatggc

SEQ ID NO: 4870543 - DNA, 13 bp, Homo sapiens
gagtagggccctg

SEQ ID NO: 4870544 - DNA, 14 bp, Homo sapiens
gagtctctgccagt

SEQ ID NO: 4870545 - DNA, 11 bp, Homo sapiens
gagtctgggat

SEQ ID NO: 4870546 - DNA, 16 bp, Homo sapiens
gagtgactacacacag

SEQ ID NO: 4870547 - DNA, 15 bp, Homo sapiens
gagtgctcttcccac

SEQ ID NO: 4870548 - DNA, 21 bp, Homo sapiens
gagtgctcttcccactccagc

SEQ ID NO: 4870549 - DNA, 19 bp, Homo sapiens
gagtgtcggatcctgtgag

SEQ ID NO: 4870550 - DNA, 13 bp, Homo sapiens
gagtgtgcagaca

SEQ ID NO: 4870551 - DNA, 16 bp, Homo sapiens
gagtgtgcagacagcc

SEQ ID NO: 4870552 - DNA, 16 bp, Homo sapiens
gagttaacaggacagt

SEQ ID NO: 4870553 - DNA, 18 bp, Homo sapiens
gagttatcatgaatttta

SEQ ID NO: 4870554 - DNA, 22 bp, Homo sapiens
gagttatgataacaccagtggg

SEQ ID NO: 4870555 - DNA, 17 bp, Homo sapiens
gagttccggggagaaac

SEQ ID NO: 4870556 - DNA, 17 bp, Homo sapiens
gagttctggatgtctgg

SEQ ID NO: 4870557 - DNA, 19 bp, Homo sapiens
gagttctggatgtctggct

SEQ ID NO: 4870558 - DNA, 16 bp, Homo sapiens
gagttgattgtctagt

SEQ ID NO: 4870559 - DNA, 16 bp, Homo sapiens
gataaccttgaaaaaa

SEQ ID NO: 4870560 - DNA, 14 bp, Homo sapiens
gataagggaaaaga

SEQ ID NO: 4870561 - DNA, 16 bp, Homo sapiens
gataagggaaaagata

SEQ ID NO: 4870562 - DNA, 23 bp, Homo sapiens
gataccattctattctccagaca

SEQ ID NO: 4870563 - DNA, 12 bp, Homo sapiens
gatacctgtgag

SEQ ID NO: 4870564 - DNA, 14 bp, Homo sapiens
gatacctgtgagga

SEQ ID NO: 4870565 - DNA, 17 bp, Homo sapiens
gatactggggggcaggc

SEQ ID NO: 4870566 - DNA, 13 bp, Homo sapiens
gatagtaagcata

SEQ ID NO: 4870567 - DNA, 19 bp, Homo sapiens
gatagtgggatttccagaa

SEQ ID NO: 4870568 - DNA, 16 bp, Homo sapiens
gatataccaaattaaa

SEQ ID NO: 4870569 - DNA, 15 bp, Homo sapiens
gatatataagtgtac

SEQ ID NO: 4870570 - DNA, 20 bp, Homo sapiens
gatatatcatgagtgaataa

SEQ ID NO: 4870571 - DNA, 21 bp, Homo sapiens
gatatatcatgagtgaataaa

SEQ ID NO: 4870572 - DNA, 15 bp, Homo sapiens
gatatgaaagctgat

SEQ ID NO: 4870573 - DNA, 17 bp, Homo sapiens
gatattcagatgtatgt

SEQ ID NO: 4870574 - DNA, 13 bp, Homo sapiens
gatattgaatgtt

SEQ ID NO: 4870575 - DNA, 17 bp, Homo sapiens
gatccagggcagcaggc

SEQ ID NO: 4870576 - DNA, 17 bp, Homo sapiens
gatccagtataagacta

SEQ ID NO: 4870577 - DNA, 14 bp, Homo sapiens
gatccggaaagaag

SEQ ID NO: 4870578 - DNA, 22 bp, Homo sapiens
gatcggccatcaagggaagaac

SEQ ID NO: 4870579 - DNA, 20 bp, Homo sapiens
gatctacttctgtaattgtg

SEQ ID NO: 4870580 - DNA, 18 bp, Homo sapiens
gatctattgtttgttgca

SEQ ID NO: 4870581 - DNA, 20 bp, Homo sapiens
gatctgcttgatatcccaag

SEQ ID NO: 4870582 - DNA, 21 bp, Homo sapiens
gatgaaaagtatattgataac

SEQ ID NO: 4870583 - DNA, 14 bp, Homo sapiens
gatgaaacttctca

SEQ ID NO: 4870584 - DNA, 23 bp, Homo sapiens
gatgacagaggtttgaaggagaa

SEQ ID NO: 4870585 - DNA, 14 bp, Homo sapiens
gatgacctccagaa

SEQ ID NO: 4870586 - DNA, 15 bp, Homo sapiens
gatgacctccagaag

SEQ ID NO: 4870587 - DNA, 14 bp, Homo sapiens
gatgacctgcccca

SEQ ID NO: 4870588 - DNA, 13 bp, Homo sapiens
gatgagagaatgt

SEQ ID NO: 4870589 - DNA, 12 bp, Homo sapiens
gatgaggaccca

SEQ ID NO: 4870590 - DNA, 20 bp, Homo sapiens
gatgaggacccagagctgct

SEQ ID NO: 4870591 - DNA, 23 bp, Homo sapiens
gatgaggctcagagaggtagcac

SEQ ID NO: 4870592 - DNA, 19 bp, Homo sapiens
gatgaggtcagttgtgttt

SEQ ID NO: 4870593 - DNA, 24 bp, Homo sapiens
gatgagtttcactgtactgcatgt

SEQ ID NO: 4870594 - DNA, 13 bp, Homo sapiens
gatgataaaggaa

SEQ ID NO: 4870595 - DNA, 21 bp, Homo sapiens
gatgcaaatagattcagagaa

SEQ ID NO: 4870596 - DNA, 18 bp, Homo sapiens
gatgcatcatctcttcct

SEQ ID NO: 4870597 - DNA, 19 bp, Homo sapiens
gatgcatcatctcttcctc

SEQ ID NO: 4870598 - DNA, 22 bp, Homo sapiens
gatgcatttaataaagatgagt

SEQ ID NO: 4870599 - DNA, 17 bp, Homo sapiens
gatgctgggcaatgagg

SEQ ID NO: 4870600 - DNA, 18 bp, Homo sapiens
gatgctttggaagatgca

SEQ ID NO: 4870601 - DNA, 12 bp, Homo sapiens
gatggagcccat

SEQ ID NO: 4870602 - DNA, 13 bp, Homo sapiens
gatggagggaaga

SEQ ID NO: 4870603 - DNA, 22 bp, Homo sapiens
gatggagggaagacctgaaaga

SEQ ID NO: 4870604 - DNA, 13 bp, Homo sapiens
gatggcttgtcta

SEQ ID NO: 4870605 - DNA, 21 bp, Homo sapiens
gatggggtgagaagtacaggg

SEQ ID NO: 4870606 - DNA, 23 bp, Homo sapiens
gatggggtgagaagtacagggca

SEQ ID NO: 4870607 - DNA, 22 bp, Homo sapiens
gatgggtgccctttcctggcag

SEQ ID NO: 4870608 - DNA, 21 bp, Homo sapiens
gatgtaagtttgtgtaaatta

SEQ ID NO: 4870609 - DNA, 19 bp, Homo sapiens
gatgtgctataatctgttt

SEQ ID NO: 4870610 - DNA, 23 bp, Homo sapiens
gatgttgtcttagcatggtacct

SEQ ID NO: 4870611 - DNA, 22 bp, Homo sapiens
gattaaaaggtatactttagta

SEQ ID NO: 4870612 - DNA, 14 bp, Homo sapiens
gattactgcaatca

SEQ ID NO: 4870613 - DNA, 20 bp, Homo sapiens
gattagaaacaaacaaaact

SEQ ID NO: 4870614 - DNA, 19 bp, Homo sapiens
gattaggtttcagcagagc

SEQ ID NO: 4870615 - DNA, 17 bp, Homo sapiens
gattattttttttttct

SEQ ID NO: 4870616 - DNA, 13 bp, Homo sapiens
gattcagagaaat

SEQ ID NO: 4870617 - DNA, 14 bp, Homo sapiens
gattcagagaaatt

SEQ ID NO: 4870618 - DNA, 20 bp, Homo sapiens
gattctatgttaatatttta

SEQ ID NO: 4870619 - DNA, 20 bp, Homo sapiens
gattctttcagttctttgga

SEQ ID NO: 4870620 - DNA, 11 bp, Homo sapiens
gattgaacttt

SEQ ID NO: 4870621 - DNA, 13 bp, Homo sapiens
gattgctctggag

SEQ ID NO: 4870622 - DNA, 20 bp, Homo sapiens
gattgctctggagcagccaa

SEQ ID NO: 4870623 - DNA, 21 bp, Homo sapiens
gattggggggtgggctttgtt

SEQ ID NO: 4870624 - DNA, 18 bp, Homo sapiens
gatttaaaagcctgctca

SEQ ID NO: 4870625 - DNA, 19 bp, Homo sapiens
gatttccctccagagaaag

SEQ ID NO: 4870626 - DNA, 16 bp, Homo sapiens
gatttggggtgatttc

SEQ ID NO: 4870627 - DNA, 13 bp, Homo sapiens
gatttttctttaa

SEQ ID NO: 4870628 - DNA, 17 bp, Homo sapiens
gatttttgccctgcgtc

SEQ ID NO: 4870629 - DNA, 20 bp, Homo sapiens
gcaaaaagagtcagacattt

SEQ ID NO: 4870630 - DNA, 22 bp, Homo sapiens
gcaaaaatgtccagccaccccc

SEQ ID NO: 4870631 - DNA, 17 bp, Homo sapiens
gcaaactgaggcagcat

SEQ ID NO: 4870632 - DNA, 20 bp, Homo sapiens
gcaaaggtgcactccagact

SEQ ID NO: 4870633 - DNA, 22 bp, Homo sapiens
gcaaaggtgcactccagactct

SEQ ID NO: 4870634 - DNA, 23 bp, Homo sapiens
gcaaaggtgcactccagactctg

SEQ ID NO: 4870635 - DNA, 14 bp, Homo sapiens
gcaaagtcctcctt

SEQ ID NO: 4870636 - DNA, 15 bp, Homo sapiens
gcaaagtgacaaagc

SEQ ID NO: 4870637 - DNA, 20 bp, Homo sapiens
gcaaataaaacgctttcccc

SEQ ID NO: 4870638 - DNA, 16 bp, Homo sapiens
gcaaatgagctctgaa

SEQ ID NO: 4870639 - DNA, 17 bp, Homo sapiens
gcaaattccagatttgt

SEQ ID NO: 4870640 - DNA, 20 bp, Homo sapiens
gcaacccttcctgctgctgc

SEQ ID NO: 4870641 - DNA, 16 bp, Homo sapiens
gcaagaaagcttcctt

SEQ ID NO: 4870642 - DNA, 20 bp, Homo sapiens
gcaagagtaagcagtgttac

SEQ ID NO: 4870643 - DNA, 15 bp, Homo sapiens
gcaagcaccaacctc

SEQ ID NO: 4870644 - DNA, 18 bp, Homo sapiens
gcaagcaccaacctccag

SEQ ID NO: 4870645 - DNA, 18 bp, Homo sapiens
gcaagcagatgacagagg

SEQ ID NO: 4870646 - DNA, 14 bp, Homo sapiens
gcaagctgaaattt

SEQ ID NO: 4870647 - DNA, 13 bp, Homo sapiens
gcaaggcagagcc

SEQ ID NO: 4870648 - DNA, 17 bp, Homo sapiens
gcaaggtggcctctgcc

SEQ ID NO: 4870649 - DNA, 18 bp, Homo sapiens
gcaaggtggcctctgcct

SEQ ID NO: 4870650 - DNA, 22 bp, Homo sapiens
gcaaggtggcctctgcctgggg

SEQ ID NO: 4870651 - DNA, 12 bp, Homo sapiens
gcaataaaattt

SEQ ID NO: 4870652 - DNA, 21 bp, Homo sapiens
gcaataaaatttaaaaaataa

SEQ ID NO: 4870653 - DNA, 16 bp, Homo sapiens
gcaataataaagtact

SEQ ID NO: 4870654 - DNA, 19 bp, Homo sapiens
gcaataggtgagagaatgt

SEQ ID NO: 4870655 - DNA, 21 bp, Homo sapiens
gcaattaaacttccaaagaaa

SEQ ID NO: 4870656 - DNA, 22 bp, Homo sapiens
gcaattaaacttccaaagaaag

SEQ ID NO: 4870657 - DNA, 22 bp, Homo sapiens
gcaatttactgatgagagaatg

SEQ ID NO: 4870658 - DNA, 13 bp, Homo sapiens
gcacaaaagacag

SEQ ID NO: 4870659 - DNA, 14 bp, Homo sapiens
gcacaaacagaatt

SEQ ID NO: 4870660 - DNA, 18 bp, Homo sapiens
gcacaaagcactggcctt

SEQ ID NO: 4870661 - DNA, 19 bp, Homo sapiens
gcacaaagcactggccttg

SEQ ID NO: 4870662 - DNA, 22 bp, Homo sapiens
gcacaatgttggagcagcaggc

SEQ ID NO: 4870663 - DNA, 15 bp, Homo sapiens
gcacaatttaaaaca

SEQ ID NO: 4870664 - DNA, 17 bp, Homo sapiens
gcacacatccaagaggg

SEQ ID NO: 4870665 - DNA, 17 bp, Homo sapiens
gcacagccaaatttaaa

SEQ ID NO: 4870666 - DNA, 23 bp, Homo sapiens
gcacagcctagggtcttgggggt

SEQ ID NO: 4870667 - DNA, 18 bp, Homo sapiens
gcacagtgtaatccaggg

SEQ ID NO: 4870668 - DNA, 19 bp, Homo sapiens
gcacatagcataggctggg

SEQ ID NO: 4870669 - DNA, 17 bp, Homo sapiens
gcaccaacctccagact

SEQ ID NO: 4870670 - DNA, 22 bp, Homo sapiens
gcaccaggggccaacctcaggc

SEQ ID NO: 4870671 - DNA, 13 bp, Homo sapiens
gcaccgtattcct

SEQ ID NO: 4870672 - DNA, 16 bp, Homo sapiens
gcactaaaatgaggat

SEQ ID NO: 4870673 - DNA, 23 bp, Homo sapiens
gcactaaaatgaggatccagggc

SEQ ID NO: 4870674 - DNA, 16 bp, Homo sapiens
gcactagccttcccag

SEQ ID NO: 4870675 - DNA, 17 bp, Homo sapiens
gcactccagactctggg

SEQ ID NO: 4870676 - DNA, 15 bp, Homo sapiens
gcactgagcagggat

SEQ ID NO: 4870677 - DNA, 17 bp, Homo sapiens
gcactgagcagggatct

SEQ ID NO: 4870678 - DNA, 21 bp, Homo sapiens
gcactgagcagggatctgccc

SEQ ID NO: 4870679 - DNA, 15 bp, Homo sapiens
gcactggccttgcct

SEQ ID NO: 4870680 - DNA, 19 bp, Homo sapiens
gcactggccttgcctccag

SEQ ID NO: 4870681 - DNA, 17 bp, Homo sapiens
gcacttattgaatatat

SEQ ID NO: 4870682 - DNA, 13 bp, Homo sapiens
gcacttttgaatg

SEQ ID NO: 4870683 - DNA, 20 bp, Homo sapiens
gcagaaaccaacaagaacca

SEQ ID NO: 4870684 - DNA, 16 bp, Homo sapiens
gcagaaatagacaaaa

SEQ ID NO: 4870685 - DNA, 20 bp, Homo sapiens
gcagaaccaagaacataaac

SEQ ID NO: 4870686 - DNA, 15 bp, Homo sapiens
gcagaagcaataata

SEQ ID NO: 4870687 - DNA, 14 bp, Homo sapiens
gcagacagccatgc

SEQ ID NO: 4870688 - DNA, 16 bp, Homo sapiens
gcagacagccctggca

SEQ ID NO: 4870689 - DNA, 13 bp, Homo sapiens
gcagacctggagc

SEQ ID NO: 4870690 - DNA, 16 bp, Homo sapiens
gcagacctggagcttc

SEQ ID NO: 4870691 - DNA, 19 bp, Homo sapiens
gcagagaccataagagaaa

SEQ ID NO: 4870692 - DNA, 22 bp, Homo sapiens
gcagagatgtactgcaaagtcg

SEQ ID NO: 4870693 - DNA, 16 bp, Homo sapiens
gcagagatttctcatt

SEQ ID NO: 4870694 - DNA, 14 bp, Homo sapiens
gcagaggtggggtg

SEQ ID NO: 4870695 - DNA, 18 bp, Homo sapiens
gcagaggtggggtgctgg

SEQ ID NO: 4870696 - DNA, 23 bp, Homo sapiens
gcagaggtggggtgctggggctg

SEQ ID NO: 4870697 - DNA, 14 bp, Homo sapiens
gcagagtcctggag

SEQ ID NO: 4870698 - DNA, 13 bp, Homo sapiens
gcagagtctgtct

SEQ ID NO: 4870699 - DNA, 16 bp, Homo sapiens
gcagagtctgtctctt

SEQ ID NO: 4870700 - DNA, 22 bp, Homo sapiens
gcagagtgagggggtaaagcag

SEQ ID NO: 4870701 - DNA, 21 bp, Homo sapiens
gcagagttaaatctcaaatag

SEQ ID NO: 4870702 - DNA, 13 bp, Homo sapiens
gcagatgacagag

SEQ ID NO: 4870703 - DNA, 16 bp, Homo sapiens
gcagcaggactgtggg

SEQ ID NO: 4870704 - DNA, 17 bp, Homo sapiens
gcagcaggactgtggga

SEQ ID NO: 4870705 - DNA, 11 bp, Homo sapiens
gcagcaggcca

SEQ ID NO: 4870706 - DNA, 19 bp, Homo sapiens
gcagcaggccagagaaagc

SEQ ID NO: 4870707 - DNA, 21 bp, Homo sapiens
gcagcaggccagagaaagcaa

SEQ ID NO: 4870708 - DNA, 16 bp, Homo sapiens
gcagcaggcctctggg

SEQ ID NO: 4870709 - DNA, 17 bp, Homo sapiens
gcagcagtcgcccaagc

SEQ ID NO: 4870710 - DNA, 17 bp, Homo sapiens
gcagcatctgctccatc

SEQ ID NO: 4870711 - DNA, 15 bp, Homo sapiens
gcagccgcagagaaa

SEQ ID NO: 4870712 - DNA, 16 bp, Homo sapiens
gcagccgcagagaaat

SEQ ID NO: 4870713 - DNA, 22 bp, Homo sapiens
gcagccgcagagaaatgcccca

SEQ ID NO: 4870714 - DNA, 15 bp, Homo sapiens
gcagcctaagaagaa

SEQ ID NO: 4870715 - DNA, 21 bp, Homo sapiens
gcagcctaagaagaaggccag

SEQ ID NO: 4870716 - DNA, 22 bp, Homo sapiens
gcagcctaagaagaaggccaga

SEQ ID NO: 4870717 - DNA, 19 bp, Homo sapiens
gcagccttcatcagaactc

SEQ ID NO: 4870718 - DNA, 12 bp, Homo sapiens
gcagcggctcct

SEQ ID NO: 4870719 - DNA, 15 bp, Homo sapiens
gcagcggctcctgca

SEQ ID NO: 4870720 - DNA, 12 bp, Homo sapiens
gcagctagtgcc

SEQ ID NO: 4870721 - DNA, 13 bp, Homo sapiens
gcagcttgctggg

SEQ ID NO: 4870722 - DNA, 14 bp, Homo sapiens
gcagcttgctgggc

SEQ ID NO: 4870723 - DNA, 17 bp, Homo sapiens
gcagcttgctgggcttt

SEQ ID NO: 4870724 - DNA, 20 bp, Homo sapiens
gcaggacctactaggagagg

SEQ ID NO: 4870725 - DNA, 18 bp, Homo sapiens
gcaggacctgggacagga

SEQ ID NO: 4870726 - DNA, 15 bp, Homo sapiens
gcaggccagagaaag

SEQ ID NO: 4870727 - DNA, 16 bp, Homo sapiens
gcaggccagagaaagc

SEQ ID NO: 4870728 - DNA, 14 bp, Homo sapiens
gcaggcccaatgct

SEQ ID NO: 4870729 - DNA, 16 bp, Homo sapiens
gcaggcccaatgctgc

SEQ ID NO: 4870730 - DNA, 17 bp, Homo sapiens
gcaggcccaatgctgct

SEQ ID NO: 4870731 - DNA, 19 bp, Homo sapiens
gcaggcccaatgctgcttt

SEQ ID NO: 4870732 - DNA, 15 bp, Homo sapiens
gcaggcctctgggac

SEQ ID NO: 4870733 - DNA, 16 bp, Homo sapiens
gcaggcctctgggacc

SEQ ID NO: 4870734 - DNA, 13 bp, Homo sapiens
gcagggagagagt

SEQ ID NO: 4870735 - DNA, 20 bp, Homo sapiens
gcagggaggggaggcagatg

SEQ ID NO: 4870736 - DNA, 20 bp, Homo sapiens
gcagggggtatgcagagctt

SEQ ID NO: 4870737 - DNA, 17 bp, Homo sapiens
gcaggtgctcatgctgc

SEQ ID NO: 4870738 - DNA, 15 bp, Homo sapiens
gcaggtgcttttggc

SEQ ID NO: 4870739 - DNA, 21 bp, Homo sapiens
gcaggtgcttttggcagagac

SEQ ID NO: 4870740 - DNA, 18 bp, Homo sapiens
gcagtaggggagagagca

SEQ ID NO: 4870741 - DNA, 11 bp, Homo sapiens
gcagtcagact

SEQ ID NO: 4870742 - DNA, 23 bp, Homo sapiens
gcagtcgtggggaacggaggagg

SEQ ID NO: 4870743 - DNA, 21 bp, Homo sapiens
gcagtgggaatgttctttctg

SEQ ID NO: 4870744 - DNA, 18 bp, Homo sapiens
gcagtgttggagtgagga

SEQ ID NO: 4870745 - DNA, 17 bp, Homo sapiens
gcagttagctgaagaat

SEQ ID NO: 4870746 - DNA, 16 bp, Homo sapiens
gcagttgtagcagaaa

SEQ ID NO: 4870747 - DNA, 19 bp, Homo sapiens
gcataaagctcaaatgaaa

SEQ ID NO: 4870748 - DNA, 21 bp, Homo sapiens
gcataaagctcaaatgaaatg

SEQ ID NO: 4870749 - DNA, 18 bp, Homo sapiens
gcatactttgtattttga

SEQ ID NO: 4870750 - DNA, 12 bp, Homo sapiens
gcataggctggg

SEQ ID NO: 4870751 - DNA, 18 bp, Homo sapiens
gcatagttgtagacaaag

SEQ ID NO: 4870752 - DNA, 17 bp, Homo sapiens
gcatataatgaataaat

SEQ ID NO: 4870753 - DNA, 18 bp, Homo sapiens
gcatataatgaataaatc

SEQ ID NO: 4870754 - DNA, 19 bp, Homo sapiens
gcatataatgaataaatca

SEQ ID NO: 4870755 - DNA, 13 bp, Homo sapiens
gcatccactagct

SEQ ID NO: 4870756 - DNA, 22 bp, Homo sapiens
gcatccctttttcataaattat

SEQ ID NO: 4870757 - DNA, 16 bp, Homo sapiens
gcatctgttagcagag

SEQ ID NO: 4870758 - DNA, 17 bp, Homo sapiens
gcatctgttagcagagt

SEQ ID NO: 4870759 - DNA, 18 bp, Homo sapiens
gcatctgttagcagagtc

SEQ ID NO: 4870760 - DNA, 19 bp, Homo sapiens
gcatctgttagcagagtct

SEQ ID NO: 4870761 - DNA, 22 bp, Homo sapiens
gcatgaaaaaccatttttgaac

SEQ ID NO: 4870762 - DNA, 14 bp, Homo sapiens
gcatgaaataaaat

SEQ ID NO: 4870763 - DNA, 15 bp, Homo sapiens
gcatgaaataaaata

SEQ ID NO: 4870764 - DNA, 17 bp, Homo sapiens
gcatgaggcaaaaatgt

SEQ ID NO: 4870765 - DNA, 18 bp, Homo sapiens
gcatgaggcaaaaatgtc

SEQ ID NO: 4870766 - DNA, 18 bp, Homo sapiens
gcatgcttaaattttaac

SEQ ID NO: 4870767 - DNA, 16 bp, Homo sapiens
gcatggtggctcatgc

SEQ ID NO: 4870768 - DNA, 18 bp, Homo sapiens
gcatggtggctcatgcct

SEQ ID NO: 4870769 - DNA, 21 bp, Homo sapiens
gcatggtggctcatgcctgta

SEQ ID NO: 4870770 - DNA, 18 bp, Homo sapiens
gcatgtagaggcttgttt

SEQ ID NO: 4870771 - DNA, 20 bp, Homo sapiens
gcatgtagaggcttgtttac

SEQ ID NO: 4870772 - DNA, 16 bp, Homo sapiens
gcattctttgcaatac

SEQ ID NO: 4870773 - DNA, 20 bp, Homo sapiens
gcattctttgcaatactgct

SEQ ID NO: 4870774 - DNA, 12 bp, Homo sapiens
gcattgcagcct

SEQ ID NO: 4870775 - DNA, 18 bp, Homo sapiens
gcattggatattttttac

SEQ ID NO: 4870776 - DNA, 21 bp, Homo sapiens
gcattgtaattatgtaaataa

SEQ ID NO: 4870777 - DNA, 13 bp, Homo sapiens
gcatttaaaaaaa

SEQ ID NO: 4870778 - DNA, 12 bp, Homo sapiens
gcatttaataaa

SEQ ID NO: 4870779 - DNA, 15 bp, Homo sapiens
gcatttaataaagat

SEQ ID NO: 4870780 - DNA, 23 bp, Homo sapiens
gcatttgtgtgtgtgtgtgtgtt

SEQ ID NO: 4870781 - DNA, 23 bp, Homo sapiens
gccaaaatggttaatttttcctg

SEQ ID NO: 4870782 - DNA, 15 bp, Homo sapiens
gccaaagtacagaat

SEQ ID NO: 4870783 - DNA, 21 bp, Homo sapiens
gccaaatgcagggaggggagg

SEQ ID NO: 4870784 - DNA, 21 bp, Homo sapiens
gccaaatttaaaactgttgga

SEQ ID NO: 4870785 - DNA, 15 bp, Homo sapiens
gccaagctggcacaa

SEQ ID NO: 4870786 - DNA, 12 bp, Homo sapiens
gccaaggagcat

SEQ ID NO: 4870787 - DNA, 17 bp, Homo sapiens
gccaatctgtacaaaat

SEQ ID NO: 4870788 - DNA, 19 bp, Homo sapiens
gccaattaaaaacgaaaac

SEQ ID NO: 4870789 - DNA, 15 bp, Homo sapiens
gccacagaaggtgaa

SEQ ID NO: 4870790 - DNA, 19 bp, Homo sapiens
gccacagaaggtgaacttt

SEQ ID NO: 4870791 - DNA, 16 bp, Homo sapiens
gccagagagggaaaag

SEQ ID NO: 4870792 - DNA, 19 bp, Homo sapiens
gccagattggccaattaaa

SEQ ID NO: 4870793 - DNA, 21 bp, Homo sapiens
gccagattggccaattaaaaa

SEQ ID NO: 4870794 - DNA, 14 bp, Homo sapiens
gccagcaagtcctt

SEQ ID NO: 4870795 - DNA, 18 bp, Homo sapiens
gccagcaagtccttaggc

SEQ ID NO: 4870796 - DNA, 20 bp, Homo sapiens
gccagcagctgatgctgtac

SEQ ID NO: 4870797 - DNA, 22 bp, Homo sapiens
gccagcagctgatgctgtacta

SEQ ID NO: 4870798 - DNA, 22 bp, Homo sapiens
gccagccaagctttaaattatg

SEQ ID NO: 4870799 - DNA, 19 bp, Homo sapiens
gccagcccgcagaggtggg

SEQ ID NO: 4870800 - DNA, 18 bp, Homo sapiens
gccagcctgcttcccaca

SEQ ID NO: 4870801 - DNA, 19 bp, Homo sapiens
gccagcctgcttcccacaa

SEQ ID NO: 4870802 - DNA, 15 bp, Homo sapiens
gccagcgtgtggagc

SEQ ID NO: 4870803 - DNA, 17 bp, Homo sapiens
gccagctgcagcctggt

SEQ ID NO: 4870804 - DNA, 17 bp, Homo sapiens
gccaggactcccagaac

SEQ ID NO: 4870805 - DNA, 16 bp, Homo sapiens
gccaggatccccctct

SEQ ID NO: 4870806 - DNA, 17 bp, Homo sapiens
gccaggatccccctctt

SEQ ID NO: 4870807 - DNA, 20 bp, Homo sapiens
gccaggatccccctctttgc

SEQ ID NO: 4870808 - DNA, 21 bp, Homo sapiens
gccaggatccccctctttgca

SEQ ID NO: 4870809 - DNA, 14 bp, Homo sapiens
gccaggcagggaga

SEQ ID NO: 4870810 - DNA, 23 bp, Homo sapiens
gccaggcagggagagagtagctg

SEQ ID NO: 4870811 - DNA, 17 bp, Homo sapiens
gccaggccttatctgaa

SEQ ID NO: 4870812 - DNA, 15 bp, Homo sapiens
gccaggctcaggaga

SEQ ID NO: 4870813 - DNA, 16 bp, Homo sapiens
gccaggggctctgtgg

SEQ ID NO: 4870814 - DNA, 17 bp, Homo sapiens
gccaggtctgactccaa

SEQ ID NO: 4870815 - DNA, 20 bp, Homo sapiens
gccaggtctgactccaaagc

SEQ ID NO: 4870816 - DNA, 21 bp, Homo sapiens
gccaggtctgactccaaagct

SEQ ID NO: 4870817 - DNA, 20 bp, Homo sapiens
gccaggtggttgtcttattg

SEQ ID NO: 4870818 - DNA, 22 bp, Homo sapiens
gccaggtggttgtcttattgca

SEQ ID NO: 4870819 - DNA, 15 bp, Homo sapiens
gccagtcactgctgc

SEQ ID NO: 4870820 - DNA, 17 bp, Homo sapiens
gccagtcactgctgcaa

SEQ ID NO: 4870821 - DNA, 17 bp, Homo sapiens
gccagtggtggaggtgg

SEQ ID NO: 4870822 - DNA, 16 bp, Homo sapiens
gccagtgtctaggcac

SEQ ID NO: 4870823 - DNA, 18 bp, Homo sapiens
gccagttacttgggcttc

SEQ ID NO: 4870824 - DNA, 19 bp, Homo sapiens
gccatcgccgggactccag

SEQ ID NO: 4870825 - DNA, 23 bp, Homo sapiens
gccatcgccgggactccagaacc

SEQ ID NO: 4870826 - DNA, 13 bp, Homo sapiens
gccatcttctttc

SEQ ID NO: 4870827 - DNA, 16 bp, Homo sapiens
gccattccaaaatatt

SEQ ID NO: 4870828 - DNA, 15 bp, Homo sapiens
gcccaaacctgggaa

SEQ ID NO: 4870829 - DNA, 13 bp, Homo sapiens
gcccaatgctgct

SEQ ID NO: 4870830 - DNA, 13 bp, Homo sapiens
gcccactcctggg

SEQ ID NO: 4870831 - DNA, 15 bp, Homo sapiens
gcccagagagggaag

SEQ ID NO: 4870832 - DNA, 14 bp, Homo sapiens
gcccagtacattta

SEQ ID NO: 4870833 - DNA, 19 bp, Homo sapiens
gcccagtacatttaaattt

SEQ ID NO: 4870834 - DNA, 15 bp, Homo sapiens
gcccagtgccagcaa

SEQ ID NO: 4870835 - DNA, 16 bp, Homo sapiens
gccccactttcaagaa

SEQ ID NO: 4870836 - DNA, 13 bp, Homo sapiens
gccccaggagaag

SEQ ID NO: 4870837 - DNA, 24 bp, Homo sapiens
gccccagtgttatttattccccag

SEQ ID NO: 4870838 - DNA, 13 bp, Homo sapiens
gcccccacctcca

SEQ ID NO: 4870839 - DNA, 15 bp, Homo sapiens
gcccccacctccacc

SEQ ID NO: 4870840 - DNA, 16 bp, Homo sapiens
gcccccacctccaccc

SEQ ID NO: 4870841 - DNA, 20 bp, Homo sapiens
gccccccgcgcgcccaccct

SEQ ID NO: 4870842 - DNA, 21 bp, Homo sapiens
gccccccgcgcgcccaccctc

SEQ ID NO: 4870843 - DNA, 16 bp, Homo sapiens
gcccccttcaggagcc

SEQ ID NO: 4870844 - DNA, 18 bp, Homo sapiens
gcccccttcaggagcctg

SEQ ID NO: 4870845 - DNA, 16 bp, Homo sapiens
gccccgcccctcccac

SEQ ID NO: 4870846 - DNA, 23 bp, Homo sapiens
gccccgcccctcccacgcctcac

SEQ ID NO: 4870847 - DNA, 19 bp, Homo sapiens
gcccctaaagagcatcctg

SEQ ID NO: 4870848 - DNA, 20 bp, Homo sapiens
gcccctaaagagcatcctga

SEQ ID NO: 4870849 - DNA, 19 bp, Homo sapiens
gcccctcccacgcctcacc

SEQ ID NO: 4870850 - DNA, 13 bp, Homo sapiens
gccccttccctgg

SEQ ID NO: 4870851 - DNA, 15 bp, Homo sapiens
gccccttccctgggt

SEQ ID NO: 4870852 - DNA, 16 bp, Homo sapiens
gccccttccctgggtt

SEQ ID NO: 4870853 - DNA, 22 bp, Homo sapiens
gccccttccctgggtttgggag

SEQ ID NO: 4870854 - DNA, 15 bp, Homo sapiens
gcccgcagaggtggg

SEQ ID NO: 4870855 - DNA, 15 bp, Homo sapiens
gccctattgctgcta

SEQ ID NO: 4870856 - DNA, 14 bp, Homo sapiens
gccctcaccacagc

SEQ ID NO: 4870857 - DNA, 14 bp, Homo sapiens
gccctctctctggg

SEQ ID NO: 4870858 - DNA, 23 bp, Homo sapiens
gccctctgctctgcctggagtgt

SEQ ID NO: 4870859 - DNA, 17 bp, Homo sapiens
gccctgccagctgcagc

SEQ ID NO: 4870860 - DNA, 15 bp, Homo sapiens
gccctgcggccccgt

SEQ ID NO: 4870861 - DNA, 14 bp, Homo sapiens
gccctggggcaggg

SEQ ID NO: 4870862 - DNA, 15 bp, Homo sapiens
gccctggggcagggt

SEQ ID NO: 4870863 - DNA, 18 bp, Homo sapiens
gccctggggcagggtggg

SEQ ID NO: 4870864 - DNA, 11 bp, Homo sapiens
gccctgtcact

SEQ ID NO: 4870865 - DNA, 17 bp, Homo sapiens
gcccttcctcctgatgg

SEQ ID NO: 4870866 - DNA, 22 bp, Homo sapiens
gcccttcctcctgatggagtgt

SEQ ID NO: 4870867 - DNA, 19 bp, Homo sapiens
gcccttgggtccccccgag

SEQ ID NO: 4870868 - DNA, 14 bp, Homo sapiens
gccctttcctggca

SEQ ID NO: 4870869 - DNA, 17 bp, Homo sapiens
gccgcagacctggagct

SEQ ID NO: 4870870 - DNA, 13 bp, Homo sapiens
gccgcagagaaat

SEQ ID NO: 4870871 - DNA, 14 bp, Homo sapiens
gccgcagagaaatg

SEQ ID NO: 4870872 - DNA, 19 bp, Homo sapiens
gccgcagagaaatgcccca

SEQ ID NO: 4870873 - DNA, 17 bp, Homo sapiens
gccgccagcgtgtggag

SEQ ID NO: 4870874 - DNA, 19 bp, Homo sapiens
gccgccagcgtgtggagca

SEQ ID NO: 4870875 - DNA, 21 bp, Homo sapiens
gccggagtccactcccagtgc

SEQ ID NO: 4870876 - DNA, 18 bp, Homo sapiens
gccggatgaaacttctca

SEQ ID NO: 4870877 - DNA, 20 bp, Homo sapiens
gccggatgaaacttctcagt

SEQ ID NO: 4870878 - DNA, 13 bp, Homo sapiens
gccgggggagggg

SEQ ID NO: 4870879 - DNA, 23 bp, Homo sapiens
gccgtcctaacctcgggcctgct

SEQ ID NO: 4870880 - DNA, 13 bp, Homo sapiens
gccgttttctggg

SEQ ID NO: 4870881 - DNA, 15 bp, Homo sapiens
gcctaacctgggacc

SEQ ID NO: 4870882 - DNA, 18 bp, Homo sapiens
gcctaagaagaaggccag

SEQ ID NO: 4870883 - DNA, 22 bp, Homo sapiens
gcctagaaagggcaaggggtga

SEQ ID NO: 4870884 - DNA, 22 bp, Homo sapiens
gcctagcctatgtctggcagat

SEQ ID NO: 4870885 - DNA, 15 bp, Homo sapiens
gcctattgatacttg

SEQ ID NO: 4870886 - DNA, 14 bp, Homo sapiens
gcctcagcctgctt

SEQ ID NO: 4870887 - DNA, 19 bp, Homo sapiens
gcctcagcctgctttcctg

SEQ ID NO: 4870888 - DNA, 22 bp, Homo sapiens
gcctcagcctgctttcctgcag

SEQ ID NO: 4870889 - DNA, 14 bp, Homo sapiens
gcctcaggacccat

SEQ ID NO: 4870890 - DNA, 17 bp, Homo sapiens
gcctcaggacccatccc

SEQ ID NO: 4870891 - DNA, 21 bp, Homo sapiens
gcctcattttgcttcccatct

SEQ ID NO: 4870892 - DNA, 20 bp, Homo sapiens
gcctcccaaggtcctctcag

SEQ ID NO: 4870893 - DNA, 21 bp, Homo sapiens
gcctcccaaggtcctctcagt

SEQ ID NO: 4870894 - DNA, 17 bp, Homo sapiens
gcctccccagctcaccc

SEQ ID NO: 4870895 - DNA, 14 bp, Homo sapiens
gcctcggacagtcc

SEQ ID NO: 4870896 - DNA, 23 bp, Homo sapiens
gcctctccgactctgcacccgcc

SEQ ID NO: 4870897 - DNA, 14 bp, Homo sapiens
gcctctcctgccct

SEQ ID NO: 4870898 - DNA, 19 bp, Homo sapiens
gcctctcctgccctctgct

SEQ ID NO: 4870899 - DNA, 18 bp, Homo sapiens
gcctctctggaagaggga

SEQ ID NO: 4870900 - DNA, 23 bp, Homo sapiens
gcctctgccaaaggatgtgatat

SEQ ID NO: 4870901 - DNA, 17 bp, Homo sapiens
gcctctgggacccacag

SEQ ID NO: 4870902 - DNA, 18 bp, Homo sapiens
gcctctgggacccacaga

SEQ ID NO: 4870903 - DNA, 16 bp, Homo sapiens
gcctcttgcagggtct

SEQ ID NO: 4870904 - DNA, 22 bp, Homo sapiens
gcctgactagaactcctgtctt

SEQ ID NO: 4870905 - DNA, 15 bp, Homo sapiens
gcctgagaaacacta

SEQ ID NO: 4870906 - DNA, 22 bp, Homo sapiens
gcctgagaaacactatttgtga

SEQ ID NO: 4870907 - DNA, 19 bp, Homo sapiens
gcctgagaattgaggggag

SEQ ID NO: 4870908 - DNA, 16 bp, Homo sapiens
gcctgatttcattcct

SEQ ID NO: 4870909 - DNA, 13 bp, Homo sapiens
gcctgccaccttc

SEQ ID NO: 4870910 - DNA, 15 bp, Homo sapiens
gcctgcttcccacaa

SEQ ID NO: 4870911 - DNA, 22 bp, Homo sapiens
gcctgcttgactttccagaatg

SEQ ID NO: 4870912 - DNA, 16 bp, Homo sapiens
gcctgctttttggaaa

SEQ ID NO: 4870913 - DNA, 12 bp, Homo sapiens
gcctggagcagg

SEQ ID NO: 4870914 - DNA, 13 bp, Homo sapiens
gcctggagcaggc

SEQ ID NO: 4870915 - DNA, 17 bp, Homo sapiens
gcctggagcaggcccaa

SEQ ID NO: 4870916 - DNA, 17 bp, Homo sapiens
gcctggaggctcctcta

SEQ ID NO: 4870917 - DNA, 12 bp, Homo sapiens
gcctggccaggc

SEQ ID NO: 4870918 - DNA, 15 bp, Homo sapiens
gcctggccaggcagg

SEQ ID NO: 4870919 - DNA, 21 bp, Homo sapiens
gcctgggctgtgaggacaggg

SEQ ID NO: 4870920 - DNA, 19 bp, Homo sapiens
gcctgtatgtggtgtgggg

SEQ ID NO: 4870921 - DNA, 17 bp, Homo sapiens
gcctgtccctagggctc

SEQ ID NO: 4870922 - DNA, 22 bp, Homo sapiens
gcctgtccctagggctctccaa

SEQ ID NO: 4870923 - DNA, 23 bp, Homo sapiens
gcctgtccctagggctctccaag

SEQ ID NO: 4870924 - DNA, 16 bp, Homo sapiens
gccttacttcaaagtg

SEQ ID NO: 4870925 - DNA, 14 bp, Homo sapiens
gccttatctgaaag

SEQ ID NO: 4870926 - DNA, 24 bp, Homo sapiens
gccttatctgaaaggccagcagct

SEQ ID NO: 4870927 - DNA, 20 bp, Homo sapiens
gccttccctttacagctctc

SEQ ID NO: 4870928 - DNA, 17 bp, Homo sapiens
gccttcctcctctcaaa

SEQ ID NO: 4870929 - DNA, 15 bp, Homo sapiens
gccttcgtttatatt

SEQ ID NO: 4870930 - DNA, 16 bp, Homo sapiens
gccttctaaattccca

SEQ ID NO: 4870931 - DNA, 14 bp, Homo sapiens
gccttgagtctctg

SEQ ID NO: 4870932 - DNA, 16 bp, Homo sapiens
gccttgcaacccaagg

SEQ ID NO: 4870933 - DNA, 19 bp, Homo sapiens
gccttgcagatatctgcat

SEQ ID NO: 4870934 - DNA, 21 bp, Homo sapiens
gccttgcagatatctgcatgt

SEQ ID NO: 4870935 - DNA, 13 bp, Homo sapiens
gccttgcctccag

SEQ ID NO: 4870936 - DNA, 22 bp, Homo sapiens
gccttgtataatattgaaaatt

SEQ ID NO: 4870937 - DNA, 15 bp, Homo sapiens
gccttgtttaatggt

SEQ ID NO: 4870938 - DNA, 22 bp, Homo sapiens
gcctttgcagttggactctcag

SEQ ID NO: 4870939 - DNA, 23 bp, Homo sapiens
gcctttttacctggcctagaaag

SEQ ID NO: 4870940 - DNA, 16 bp, Homo sapiens
gcgaacagccttagag

SEQ ID NO: 4870941 - DNA, 21 bp, Homo sapiens
gcgaacagccttagagctctt

SEQ ID NO: 4870942 - DNA, 15 bp, Homo sapiens
gcggattgctctgga

SEQ ID NO: 4870943 - DNA, 22 bp, Homo sapiens
gcggattgctctggagcagcca

SEQ ID NO: 4870944 - DNA, 14 bp, Homo sapiens
gcggcaaaaggaaa

SEQ ID NO: 4870945 - DNA, 15 bp, Homo sapiens
gcggccgaagcccac

SEQ ID NO: 4870946 - DNA, 17 bp, Homo sapiens
gcggccgaagcccacca

SEQ ID NO: 4870947 - DNA, 19 bp, Homo sapiens
gcggggtcccctctgtgct

SEQ ID NO: 4870948 - DNA, 23 bp, Homo sapiens
gcgggtacttatttctcagctgt

SEQ ID NO: 4870949 - DNA, 16 bp, Homo sapiens
gcgtagcagagttaaa

SEQ ID NO: 4870950 - DNA, 22 bp, Homo sapiens
gcgtcccttctctttggggctc

SEQ ID NO: 4870951 - DNA, 12 bp, Homo sapiens
gcgtggctgact

SEQ ID NO: 4870952 - DNA, 13 bp, Homo sapiens
gcgtgtgtgacac

SEQ ID NO: 4870953 - DNA, 17 bp, Homo sapiens
gcgtgtgtgacactgat

SEQ ID NO: 4870954 - DNA, 18 bp, Homo sapiens
gctaaaaatgagcttgat

SEQ ID NO: 4870955 - DNA, 22 bp, Homo sapiens
gctaaaaatgagcttgattaaa

SEQ ID NO: 4870956 - DNA, 19 bp, Homo sapiens
gctaaggtttccagtcaga

SEQ ID NO: 4870957 - DNA, 14 bp, Homo sapiens
gctaccaaaacagt

SEQ ID NO: 4870958 - DNA, 21 bp, Homo sapiens
gctaccaacttgtatccaggc

SEQ ID NO: 4870959 - DNA, 17 bp, Homo sapiens
gctactggttacctgga

SEQ ID NO: 4870960 - DNA, 19 bp, Homo sapiens
gctactggttacctggaga

SEQ ID NO: 4870961 - DNA, 16 bp, Homo sapiens
gctactgtaatgctgc

SEQ ID NO: 4870962 - DNA, 22 bp, Homo sapiens
gctactgtaatgctgcctcagg

SEQ ID NO: 4870963 - DNA, 23 bp, Homo sapiens
gctactgtaatgctgcctcagga

SEQ ID NO: 4870964 - DNA, 21 bp, Homo sapiens
gctaggcctccgttgtctggt

SEQ ID NO: 4870965 - DNA, 15 bp, Homo sapiens
gctatgtcagtacta

SEQ ID NO: 4870966 - DNA, 22 bp, Homo sapiens
gctattttctaaagacttgtat

SEQ ID NO: 4870967 - DNA, 22 bp, Homo sapiens
gctatttttaatttcctgtgag

SEQ ID NO: 4870968 - DNA, 15 bp, Homo sapiens
gctcaaagcagcagg

SEQ ID NO: 4870969 - DNA, 15 bp, Homo sapiens
gctcaaatgaaatgt

SEQ ID NO: 4870970 - DNA, 17 bp, Homo sapiens
gctcaagcattctgttt

SEQ ID NO: 4870971 - DNA, 19 bp, Homo sapiens
gctcaagcattctgtttat

SEQ ID NO: 4870972 - DNA, 20 bp, Homo sapiens
gctcaagcattctgtttatc

SEQ ID NO: 4870973 - DNA, 16 bp, Homo sapiens
gctcaatccctgagga

SEQ ID NO: 4870974 - DNA, 14 bp, Homo sapiens
gctcagactgggca

SEQ ID NO: 4870975 - DNA, 22 bp, Homo sapiens
gctcagactgggcactggggcc

SEQ ID NO: 4870976 - DNA, 23 bp, Homo sapiens
gctcagagaggtagcactctcag

SEQ ID NO: 4870977 - DNA, 17 bp, Homo sapiens
gctcagcctggtttctg

SEQ ID NO: 4870978 - DNA, 18 bp, Homo sapiens
gctcagcctggtttctgg

SEQ ID NO: 4870979 - DNA, 13 bp, Homo sapiens
gctcatgctgctc

SEQ ID NO: 4870980 - DNA, 22 bp, Homo sapiens
gctccacactcagaaaattccc

SEQ ID NO: 4870981 - DNA, 18 bp, Homo sapiens
gctcccctaaagccaggc

SEQ ID NO: 4870982 - DNA, 19 bp, Homo sapiens
gctcccctaaagccaggct

SEQ ID NO: 4870983 - DNA, 20 bp, Homo sapiens
gctcccctaaagccaggctc

SEQ ID NO: 4870984 - DNA, 21 bp, Homo sapiens
gctcccctaaagccaggctca

SEQ ID NO: 4870985 - DNA, 21 bp, Homo sapiens
gctcccctcccaggggagcca

SEQ ID NO: 4870986 - DNA, 15 bp, Homo sapiens
gctcctcacctgtct

SEQ ID NO: 4870987 - DNA, 19 bp, Homo sapiens
gctcctccttgcccagact

SEQ ID NO: 4870988 - DNA, 17 bp, Homo sapiens
gctcctcttgttcctga

SEQ ID NO: 4870989 - DNA, 18 bp, Homo sapiens
gctcctcttgttcctgaa

SEQ ID NO: 4870990 - DNA, 22 bp, Homo sapiens
gctcctcttgttcctgaaatgt

SEQ ID NO: 4870991 - DNA, 20 bp, Homo sapiens
gctcctgcaaaaggaggtga

SEQ ID NO: 4870992 - DNA, 21 bp, Homo sapiens
gctcctgcaaaaggaggtgaa

SEQ ID NO: 4870993 - DNA, 18 bp, Homo sapiens
gctcctgtggcaggaggc

SEQ ID NO: 4870994 - DNA, 17 bp, Homo sapiens
gctcctttcccctctca

SEQ ID NO: 4870995 - DNA, 13 bp, Homo sapiens
gctcggctactgg

SEQ ID NO: 4870996 - DNA, 15 bp, Homo sapiens
gctcggggtgtgtca

SEQ ID NO: 4870997 - DNA, 20 bp, Homo sapiens
gctcggggtgtgtcatttct

SEQ ID NO: 4870998 - DNA, 15 bp, Homo sapiens
gctctagcctctgga

SEQ ID NO: 4870999 - DNA, 21 bp, Homo sapiens
gctctatactgtggcctgcag

SEQ ID NO: 4871000 - DNA, 16 bp, Homo sapiens
gctctcccctcctgct

SEQ ID NO: 4871001 - DNA, 20 bp, Homo sapiens
gctctcctcccgccccgccc

SEQ ID NO: 4871002 - DNA, 17 bp, Homo sapiens
gctctctgggacctcct

SEQ ID NO: 4871003 - DNA, 18 bp, Homo sapiens
gctctctgtactaaggag

SEQ ID NO: 4871004 - DNA, 15 bp, Homo sapiens
gctctgcctggagtg

SEQ ID NO: 4871005 - DNA, 12 bp, Homo sapiens
gctctggagcag

SEQ ID NO: 4871006 - DNA, 13 bp, Homo sapiens
gctctggagcagc

SEQ ID NO: 4871007 - DNA, 22 bp, Homo sapiens
gctctgtggcaaaaagagtcag

SEQ ID NO: 4871008 - DNA, 23 bp, Homo sapiens
gctctgtggcaaaaagagtcaga

SEQ ID NO: 4871009 - DNA, 17 bp, Homo sapiens
gctcttatgtgtgcctt

SEQ ID NO: 4871010 - DNA, 19 bp, Homo sapiens
gctcttatgtgtgcctttg

SEQ ID NO: 4871011 - DNA, 16 bp, Homo sapiens
gctcttcccactccag

SEQ ID NO: 4871012 - DNA, 20 bp, Homo sapiens
gctcttcccactccagctga

SEQ ID NO: 4871013 - DNA, 12 bp, Homo sapiens
gctcttcttcct

SEQ ID NO: 4871014 - DNA, 18 bp, Homo sapiens
gctcttgtgttcagaaga

SEQ ID NO: 4871015 - DNA, 19 bp, Homo sapiens
gctgaaagctggtggcaga

SEQ ID NO: 4871016 - DNA, 19 bp, Homo sapiens
gctgaaattcaccaagaac

SEQ ID NO: 4871017 - DNA, 20 bp, Homo sapiens
gctgaaattcaccaagaaca

SEQ ID NO: 4871018 - DNA, 17 bp, Homo sapiens
gctgaaattttagaaat

SEQ ID NO: 4871019 - DNA, 19 bp, Homo sapiens
gctgaaattttagaaatat

SEQ ID NO: 4871020 - DNA, 16 bp, Homo sapiens
gctgaagctggagcag

SEQ ID NO: 4871021 - DNA, 17 bp, Homo sapiens
gctgacagagctctggg

SEQ ID NO: 4871022 - DNA, 19 bp, Homo sapiens
gctgagccctcctgagggc

SEQ ID NO: 4871023 - DNA, 20 bp, Homo sapiens
gctgataccatatgaatgaa

SEQ ID NO: 4871024 - DNA, 20 bp, Homo sapiens
gctgatcagagttcctccta

SEQ ID NO: 4871025 - DNA, 18 bp, Homo sapiens
gctgatgggtgccctttc

SEQ ID NO: 4871026 - DNA, 23 bp, Homo sapiens
gctgcaaggtggcctctgcctgg

SEQ ID NO: 4871027 - DNA, 18 bp, Homo sapiens
gctgcagaggcacctcaa

SEQ ID NO: 4871028 - DNA, 22 bp, Homo sapiens
gctgcagccttcatcagaactc

SEQ ID NO: 4871029 - DNA, 19 bp, Homo sapiens
gctgccagctctcaggacc

SEQ ID NO: 4871030 - DNA, 13 bp, Homo sapiens
gctgccaggggct

SEQ ID NO: 4871031 - DNA, 22 bp, Homo sapiens
gctgccaggggctctgtggcaa

SEQ ID NO: 4871032 - DNA, 19 bp, Homo sapiens
gctgccccacaggtgtgtt

SEQ ID NO: 4871033 - DNA, 20 bp, Homo sapiens
gctgccgtagcttcagccag

SEQ ID NO: 4871034 - DNA, 12 bp, Homo sapiens
gctgcctcagga

SEQ ID NO: 4871035 - DNA, 20 bp, Homo sapiens
gctgcctcaggacccatccc

SEQ ID NO: 4871036 - DNA, 21 bp, Homo sapiens
gctgcctcaggacccatccct

SEQ ID NO: 4871037 - DNA, 22 bp, Homo sapiens
gctgcctcaggacccatccctg

SEQ ID NO: 4871038 - DNA, 21 bp, Homo sapiens
gctgctcccctaaagccaggc

SEQ ID NO: 4871039 - DNA, 17 bp, Homo sapiens
gctgctcctctcttggg

SEQ ID NO: 4871040 - DNA, 14 bp, Homo sapiens
gctgctgctgctgc

SEQ ID NO: 4871041 - DNA, 14 bp, Homo sapiens
gctggcacaaaaga

SEQ ID NO: 4871042 - DNA, 15 bp, Homo sapiens
gctggcacaaaagac

SEQ ID NO: 4871043 - DNA, 19 bp, Homo sapiens
gctggcacaaaagacagct

SEQ ID NO: 4871044 - DNA, 22 bp, Homo sapiens
gctggcggaggctgctcggcta

SEQ ID NO: 4871045 - DNA, 21 bp, Homo sapiens
gctggctctataaggcagcct

SEQ ID NO: 4871046 - DNA, 15 bp, Homo sapiens
gctgggcgtgtgtga

SEQ ID NO: 4871047 - DNA, 16 bp, Homo sapiens
gctgggcgtgtgtgac

SEQ ID NO: 4871048 - DNA, 11 bp, Homo sapiens
gctggggctgc

SEQ ID NO: 4871049 - DNA, 18 bp, Homo sapiens
gctggtgaacactgtgac

SEQ ID NO: 4871050 - DNA, 21 bp, Homo sapiens
gctggtgaacactgtgaccag

SEQ ID NO: 4871051 - DNA, 22 bp, Homo sapiens
gctggtgaacactgtgaccagg

SEQ ID NO: 4871052 - DNA, 24 bp, Homo sapiens
gctggtgaacactgtgaccaggct

SEQ ID NO: 4871053 - DNA, 20 bp, Homo sapiens
gctgtactaacccagtcttt

SEQ ID NO: 4871054 - DNA, 21 bp, Homo sapiens
gctgtcattgcacataagctt

SEQ ID NO: 4871055 - DNA, 18 bp, Homo sapiens
gctgtgaggacagggccc

SEQ ID NO: 4871056 - DNA, 22 bp, Homo sapiens
gctgtgctccacactcagaaaa

SEQ ID NO: 4871057 - DNA, 15 bp, Homo sapiens
gctgtgctttggaac

SEQ ID NO: 4871058 - DNA, 22 bp, Homo sapiens
gctgtgtttatatggaagaaag

SEQ ID NO: 4871059 - DNA, 21 bp, Homo sapiens
gctgttccattacaccacagc

SEQ ID NO: 4871060 - DNA, 16 bp, Homo sapiens
gcttaatgctacatgt

SEQ ID NO: 4871061 - DNA, 14 bp, Homo sapiens
gcttacaggagcca

SEQ ID NO: 4871062 - DNA, 22 bp, Homo sapiens
gcttacaggagccagcctgctt

SEQ ID NO: 4871063 - DNA, 13 bp, Homo sapiens
gcttacctgggca

SEQ ID NO: 4871064 - DNA, 22 bp, Homo sapiens
gcttataacctagttaaagaaa

SEQ ID NO: 4871065 - DNA, 18 bp, Homo sapiens
gcttcaaaaagccacagc

SEQ ID NO: 4871066 - DNA, 14 bp, Homo sapiens
gcttcaacagccaa

SEQ ID NO: 4871067 - DNA, 16 bp, Homo sapiens
gcttcaacagccaagc

SEQ ID NO: 4871068 - DNA, 17 bp, Homo sapiens
gcttcaacagccaagct

SEQ ID NO: 4871069 - DNA, 16 bp, Homo sapiens
gcttcagccaggtctg

SEQ ID NO: 4871070 - DNA, 22 bp, Homo sapiens
gcttcagccaggtctgactcca

SEQ ID NO: 4871071 - DNA, 19 bp, Homo sapiens
gcttccattttaattttaa

SEQ ID NO: 4871072 - DNA, 13 bp, Homo sapiens
gcttcccaacaga

SEQ ID NO: 4871073 - DNA, 17 bp, Homo sapiens
gcttcccatctgaagag

SEQ ID NO: 4871074 - DNA, 15 bp, Homo sapiens
gcttcccttactttg

SEQ ID NO: 4871075 - DNA, 21 bp, Homo sapiens
gcttccttctcatcttgcctc

SEQ ID NO: 4871076 - DNA, 17 bp, Homo sapiens
gcttcgactactgctcc

SEQ ID NO: 4871077 - DNA, 18 bp, Homo sapiens
gcttcttcacaggcactc

SEQ ID NO: 4871078 - DNA, 15 bp, Homo sapiens
gcttgactttccaga

SEQ ID NO: 4871079 - DNA, 16 bp, Homo sapiens
gcttgactttccagaa

SEQ ID NO: 4871080 - DNA, 15 bp, Homo sapiens
gcttgatatcccaag

SEQ ID NO: 4871081 - DNA, 16 bp, Homo sapiens
gcttgcatggagaatg

SEQ ID NO: 4871082 - DNA, 18 bp, Homo sapiens
gcttgcatggagaatggg

SEQ ID NO: 4871083 - DNA, 21 bp, Homo sapiens
gcttgccaaagtacagaattt

SEQ ID NO: 4871084 - DNA, 18 bp, Homo sapiens
gcttgcggcaaaaggaaa

SEQ ID NO: 4871085 - DNA, 20 bp, Homo sapiens
gcttggggtgtggggtgggg

SEQ ID NO: 4871086 - DNA, 15 bp, Homo sapiens
gcttggttctgtgaa

SEQ ID NO: 4871087 - DNA, 13 bp, Homo sapiens
gctttaatcagaa

SEQ ID NO: 4871088 - DNA, 14 bp, Homo sapiens
gctttcctgcagca

SEQ ID NO: 4871089 - DNA, 17 bp, Homo sapiens
gctttctttgacctctt

SEQ ID NO: 4871090 - DNA, 19 bp, Homo sapiens
gctttgggaagtttgctgt

SEQ ID NO: 4871091 - DNA, 17 bp, Homo sapiens
gctttggtggccaggga

SEQ ID NO: 4871092 - DNA, 21 bp, Homo sapiens
gctttggtggccagggaggca

SEQ ID NO: 4871093 - DNA, 16 bp, Homo sapiens
gctttgtaggtgtctc

SEQ ID NO: 4871094 - DNA, 20 bp, Homo sapiens
gctttgtgaccagaaagctt

SEQ ID NO: 4871095 - DNA, 19 bp, Homo sapiens
gctttgttgtgagaatggc

SEQ ID NO: 4871096 - DNA, 14 bp, Homo sapiens
gcttttggcagaga

SEQ ID NO: 4871097 - DNA, 12 bp, Homo sapiens
ggaaaacatttg

SEQ ID NO: 4871098 - DNA, 13 bp, Homo sapiens
ggaaaacatttgc

SEQ ID NO: 4871099 - DNA, 17 bp, Homo sapiens
ggaaaaggcaggtgctt

SEQ ID NO: 4871100 - DNA, 18 bp, Homo sapiens
ggaaagagctaggaaccc

SEQ ID NO: 4871101 - DNA, 21 bp, Homo sapiens
ggaaagcacaagactggccca

SEQ ID NO: 4871102 - DNA, 18 bp, Homo sapiens
ggaaaggcagggccctga

SEQ ID NO: 4871103 - DNA, 11 bp, Homo sapiens
ggaaagtcaga

SEQ ID NO: 4871104 - DNA, 18 bp, Homo sapiens
ggaaatagatgtgcagtt

SEQ ID NO: 4871105 - DNA, 13 bp, Homo sapiens
ggaaatcttaaac

SEQ ID NO: 4871106 - DNA, 15 bp, Homo sapiens
ggaaatgaagcaggg

SEQ ID NO: 4871107 - DNA, 21 bp, Homo sapiens
ggaacccccctcccacccacc

SEQ ID NO: 4871108 - DNA, 18 bp, Homo sapiens
ggaacggtggaggcagag

SEQ ID NO: 4871109 - DNA, 15 bp, Homo sapiens
ggaactcccccagag

SEQ ID NO: 4871110 - DNA, 17 bp, Homo sapiens
ggaagaagtgagcagtg

SEQ ID NO: 4871111 - DNA, 16 bp, Homo sapiens
ggaagaatgaaagctg

SEQ ID NO: 4871112 - DNA, 12 bp, Homo sapiens
ggaagacctgaa

SEQ ID NO: 4871113 - DNA, 16 bp, Homo sapiens
ggaagagggaggggcc

SEQ ID NO: 4871114 - DNA, 18 bp, Homo sapiens
ggaagatgacctgcccca

SEQ ID NO: 4871115 - DNA, 16 bp, Homo sapiens
ggaaggagaagtaaga

SEQ ID NO: 4871116 - DNA, 15 bp, Homo sapiens
ggaagggaaagtttt

SEQ ID NO: 4871117 - DNA, 16 bp, Homo sapiens
ggaagggaccccagat

SEQ ID NO: 4871118 - DNA, 17 bp, Homo sapiens
ggaaggggcctgggctg

SEQ ID NO: 4871119 - DNA, 20 bp, Homo sapiens
ggaaggggcctgggctgtga

SEQ ID NO: 4871120 - DNA, 18 bp, Homo sapiens
ggaagtatgtatattaaa

SEQ ID NO: 4871121 - DNA, 22 bp, Homo sapiens
ggaagtcagaatttttaactgt

SEQ ID NO: 4871122 - DNA, 17 bp, Homo sapiens
ggaagtttgctgtgctt

SEQ ID NO: 4871123 - DNA, 21 bp, Homo sapiens
ggaatctttgtaccaaaattt

SEQ ID NO: 4871124 - DNA, 17 bp, Homo sapiens
ggaatgaggaaaattct

SEQ ID NO: 4871125 - DNA, 20 bp, Homo sapiens
ggaatggatttttctttaac

SEQ ID NO: 4871126 - DNA, 15 bp, Homo sapiens
ggaatggccacaaac

SEQ ID NO: 4871127 - DNA, 18 bp, Homo sapiens
ggaatggccacaaacctg

SEQ ID NO: 4871128 - DNA, 15 bp, Homo sapiens
ggaatgttctttctg

SEQ ID NO: 4871129 - DNA, 20 bp, Homo sapiens
ggaatgttctttctgctcta

SEQ ID NO: 4871130 - DNA, 11 bp, Homo sapiens
ggacagggccc

SEQ ID NO: 4871131 - DNA, 18 bp, Homo sapiens
ggacagggccctggagct

SEQ ID NO: 4871132 - DNA, 11 bp, Homo sapiens
ggacagtggtg

SEQ ID NO: 4871133 - DNA, 18 bp, Homo sapiens
ggacagttgatggagccc

SEQ ID NO: 4871134 - DNA, 19 bp, Homo sapiens
ggacatgcaataaaattta

SEQ ID NO: 4871135 - DNA, 22 bp, Homo sapiens
ggacatgcaataaaatttaaaa

SEQ ID NO: 4871136 - DNA, 19 bp, Homo sapiens
ggacatttgtgggcaagca

SEQ ID NO: 4871137 - DNA, 21 bp, Homo sapiens
ggacccatccctgcctggagg

SEQ ID NO: 4871138 - DNA, 22 bp, Homo sapiens
ggaccccagatacctgtgagga

SEQ ID NO: 4871139 - DNA, 22 bp, Homo sapiens
ggacccttctgggtccagggag

SEQ ID NO: 4871140 - DNA, 15 bp, Homo sapiens
ggacctccctgtctc

SEQ ID NO: 4871141 - DNA, 11 bp, Homo sapiens
ggacctcctta

SEQ ID NO: 4871142 - DNA, 14 bp, Homo sapiens
ggacgactctgacc

SEQ ID NO: 4871143 - DNA, 19 bp, Homo sapiens
ggacgggatgacctccaga

SEQ ID NO: 4871144 - DNA, 18 bp, Homo sapiens
ggacgttaggccaggcct

SEQ ID NO: 4871145 - DNA, 15 bp, Homo sapiens
ggactccaagccctg

SEQ ID NO: 4871146 - DNA, 23 bp, Homo sapiens
ggactccaagccctggggcaggg

SEQ ID NO: 4871147 - DNA, 22 bp, Homo sapiens
ggactccatccacctcatcact

SEQ ID NO: 4871148 - DNA, 14 bp, Homo sapiens
ggactcccagaacc

SEQ ID NO: 4871149 - DNA, 15 bp, Homo sapiens
ggactcccagaacct

SEQ ID NO: 4871150 - DNA, 14 bp, Homo sapiens
ggactctctccagg

SEQ ID NO: 4871151 - DNA, 21 bp, Homo sapiens
ggactggaaagcacaagactg

SEQ ID NO: 4871152 - DNA, 18 bp, Homo sapiens
ggacttctgaagagacca

SEQ ID NO: 4871153 - DNA, 13 bp, Homo sapiens
ggagaaacccaga

SEQ ID NO: 4871154 - DNA, 15 bp, Homo sapiens
ggagaaacccagaga

SEQ ID NO: 4871155 - DNA, 24 bp, Homo sapiens
ggagaaagcttggttctgtgaaca

SEQ ID NO: 4871156 - DNA, 12 bp, Homo sapiens
ggagaatactgc

SEQ ID NO: 4871157 - DNA, 16 bp, Homo sapiens
ggagaatggcatggca

SEQ ID NO: 4871158 - DNA, 22 bp, Homo sapiens
ggagaatggcatggcaggagtc

SEQ ID NO: 4871159 - DNA, 23 bp, Homo sapiens
ggagaatggcatggcaggagtct

SEQ ID NO: 4871160 - DNA, 11 bp, Homo sapiens
ggagacagcag

SEQ ID NO: 4871161 - DNA, 16 bp, Homo sapiens
ggagacagcagcctgt

SEQ ID NO: 4871162 - DNA, 15 bp, Homo sapiens
ggagacatgtgacat

SEQ ID NO: 4871163 - DNA, 22 bp, Homo sapiens
ggagacgtttataaacagaaat

SEQ ID NO: 4871164 - DNA, 17 bp, Homo sapiens
ggagagaggaggaaaag

SEQ ID NO: 4871165 - DNA, 19 bp, Homo sapiens
ggagagagtagctgcagcc

SEQ ID NO: 4871166 - DNA, 21 bp, Homo sapiens
ggagagccatacataaaagaa

SEQ ID NO: 4871167 - DNA, 12 bp, Homo sapiens
ggagaggggggc

SEQ ID NO: 4871168 - DNA, 20 bp, Homo sapiens
ggagatggggaataatttcc

SEQ ID NO: 4871169 - DNA, 17 bp, Homo sapiens
ggagattgaactttccc

SEQ ID NO: 4871170 - DNA, 22 bp, Homo sapiens
ggagcacacatccaagagggac

SEQ ID NO: 4871171 - DNA, 16 bp, Homo sapiens
ggagcagcaggcctct

SEQ ID NO: 4871172 - DNA, 22 bp, Homo sapiens
ggagcagcaggcctctgggacc

SEQ ID NO: 4871173 - DNA, 21 bp, Homo sapiens
ggagcagccaaggccgccagc

SEQ ID NO: 4871174 - DNA, 12 bp, Homo sapiens
ggagcaggccca

SEQ ID NO: 4871175 - DNA, 16 bp, Homo sapiens
ggagccagcctgcttc

SEQ ID NO: 4871176 - DNA, 21 bp, Homo sapiens
ggagccagcctgcttcccaca

SEQ ID NO: 4871177 - DNA, 11 bp, Homo sapiens
ggagccagctg

SEQ ID NO: 4871178 - DNA, 12 bp, Homo sapiens
ggagccaggact

SEQ ID NO: 4871179 - DNA, 21 bp, Homo sapiens
ggagccaggactcccagaacc

SEQ ID NO: 4871180 - DNA, 22 bp, Homo sapiens
ggagccaggactcccagaacct

SEQ ID NO: 4871181 - DNA, 21 bp, Homo sapiens
ggagcccataggccaccccct

SEQ ID NO: 4871182 - DNA, 22 bp, Homo sapiens
ggagcctacctctgtctgagac

SEQ ID NO: 4871183 - DNA, 16 bp, Homo sapiens
ggagcctggccaggca

SEQ ID NO: 4871184 - DNA, 17 bp, Homo sapiens
ggagcctggccaggcag

SEQ ID NO: 4871185 - DNA, 18 bp, Homo sapiens
ggaggaaaagtcttccta

SEQ ID NO: 4871186 - DNA, 23 bp, Homo sapiens
ggaggacttggttgatgtttaaa

SEQ ID NO: 4871187 - DNA, 14 bp, Homo sapiens
ggaggcagcagagc

SEQ ID NO: 4871188 - DNA, 22 bp, Homo sapiens
ggaggcctcaccccagggacag

SEQ ID NO: 4871189 - DNA, 21 bp, Homo sapiens
ggaggctttgggtggctcact

SEQ ID NO: 4871190 - DNA, 22 bp, Homo sapiens
ggagggaagacctgaaagagag

SEQ ID NO: 4871191 - DNA, 14 bp, Homo sapiens
ggagggcccctgcg

SEQ ID NO: 4871192 - DNA, 15 bp, Homo sapiens
ggaggggccctgtca

SEQ ID NO: 4871193 - DNA, 23 bp, Homo sapiens
ggagggggtttgctggggaactg

SEQ ID NO: 4871194 - DNA, 15 bp, Homo sapiens
ggagtcagtgccagg

SEQ ID NO: 4871195 - DNA, 15 bp, Homo sapiens
ggagtccactcccag

SEQ ID NO: 4871196 - DNA, 22 bp, Homo sapiens
ggagtctctgccagttacttgg

SEQ ID NO: 4871197 - DNA, 14 bp, Homo sapiens
ggagtgctcttccc

SEQ ID NO: 4871198 - DNA, 12 bp, Homo sapiens
ggagtgtgcaga

SEQ ID NO: 4871199 - DNA, 14 bp, Homo sapiens
ggagtgtgcagaca

SEQ ID NO: 4871200 - DNA, 16 bp, Homo sapiens
ggatactggggggcag

SEQ ID NO: 4871201 - DNA, 16 bp, Homo sapiens
ggatcccgtcttccag

SEQ ID NO: 4871202 - DNA, 17 bp, Homo sapiens
ggatcctccctcatggc

SEQ ID NO: 4871203 - DNA, 18 bp, Homo sapiens
ggatcgagtgtagctgtg

SEQ ID NO: 4871204 - DNA, 19 bp, Homo sapiens
ggatctccactggaccctt

SEQ ID NO: 4871205 - DNA, 15 bp, Homo sapiens
ggatgataaaggaaa

SEQ ID NO: 4871206 - DNA, 21 bp, Homo sapiens
ggatgcaaatagattcagaga

SEQ ID NO: 4871207 - DNA, 23 bp, Homo sapiens
ggatgcaaatagattcagagaaa

SEQ ID NO: 4871208 - DNA, 14 bp, Homo sapiens
ggatggtggtgcat

SEQ ID NO: 4871209 - DNA, 17 bp, Homo sapiens
ggatgtgtgggccagga

SEQ ID NO: 4871210 - DNA, 17 bp, Homo sapiens
ggatttaaaagcctgct

SEQ ID NO: 4871211 - DNA, 23 bp, Homo sapiens
ggcaaaaatgtccagccaccccc

SEQ ID NO: 4871212 - DNA, 14 bp, Homo sapiens
ggcaaggggtgagg

SEQ ID NO: 4871213 - DNA, 13 bp, Homo sapiens
ggcacaaacagaa

SEQ ID NO: 4871214 - DNA, 15 bp, Homo sapiens
ggcacagcctagggt

SEQ ID NO: 4871215 - DNA, 16 bp, Homo sapiens
ggcacatagcataggc

SEQ ID NO: 4871216 - DNA, 21 bp, Homo sapiens
ggcacccaccagttgctgctg

SEQ ID NO: 4871217 - DNA, 12 bp, Homo sapiens
ggcagatgaggg

SEQ ID NO: 4871218 - DNA, 16 bp, Homo sapiens
ggcagatggagcccat

SEQ ID NO: 4871219 - DNA, 23 bp, Homo sapiens
ggcagatgggggcctctctggaa

SEQ ID NO: 4871220 - DNA, 17 bp, Homo sapiens
ggcagatgtttgcctca

SEQ ID NO: 4871221 - DNA, 12 bp, Homo sapiens
ggcagcagagcg

SEQ ID NO: 4871222 - DNA, 20 bp, Homo sapiens
ggcagcaggccagagaaagc

SEQ ID NO: 4871223 - DNA, 15 bp, Homo sapiens
ggcagctagtgcctt

SEQ ID NO: 4871224 - DNA, 17 bp, Homo sapiens
ggcagctagtgccttta

SEQ ID NO: 4871225 - DNA, 13 bp, Homo sapiens
ggcagctgaaatt

SEQ ID NO: 4871226 - DNA, 21 bp, Homo sapiens
ggcaggacttctcaccagcag

SEQ ID NO: 4871227 - DNA, 19 bp, Homo sapiens
ggcaggagtctctgccagt

SEQ ID NO: 4871228 - DNA, 13 bp, Homo sapiens
ggcagggagagag

SEQ ID NO: 4871229 - DNA, 22 bp, Homo sapiens
ggcagggggtatgcagagcttg

SEQ ID NO: 4871230 - DNA, 21 bp, Homo sapiens
ggcaggtgcttttggcagaga

SEQ ID NO: 4871231 - DNA, 20 bp, Homo sapiens
ggcagttccttacctccctg

SEQ ID NO: 4871232 - DNA, 22 bp, Homo sapiens
ggcatccctttttcataaatta

SEQ ID NO: 4871233 - DNA, 17 bp, Homo sapiens
ggcattagcaaggcaga

SEQ ID NO: 4871234 - DNA, 14 bp, Homo sapiens
ggcattctcccagc

SEQ ID NO: 4871235 - DNA, 11 bp, Homo sapiens
ggcattgagta

SEQ ID NO: 4871236 - DNA, 19 bp, Homo sapiens
ggccaagctgaggaggtgc

SEQ ID NO: 4871237 - DNA, 13 bp, Homo sapiens
ggccacaaacctg

SEQ ID NO: 4871238 - DNA, 19 bp, Homo sapiens
ggccacagaaggtgaactt

SEQ ID NO: 4871239 - DNA, 18 bp, Homo sapiens
ggccacgggggcagtgtg

SEQ ID NO: 4871240 - DNA, 15 bp, Homo sapiens
ggccagagaaagcaa

SEQ ID NO: 4871241 - DNA, 20 bp, Homo sapiens
ggccagcagctgatgctgta

SEQ ID NO: 4871242 - DNA, 14 bp, Homo sapiens
ggccatcttctttc

SEQ ID NO: 4871243 - DNA, 23 bp, Homo sapiens
ggccatcttctttcttccaccca

SEQ ID NO: 4871244 - DNA, 16 bp, Homo sapiens
ggccatgtcctctctt

SEQ ID NO: 4871245 - DNA, 17 bp, Homo sapiens
ggccatgttcccagaac

SEQ ID NO: 4871246 - DNA, 17 bp, Homo sapiens
ggcccaatgctgctttt

SEQ ID NO: 4871247 - DNA, 21 bp, Homo sapiens
ggcccaggcagacaaccttgt

SEQ ID NO: 4871248 - DNA, 21 bp, Homo sapiens
ggcccattcagagctatggtg

SEQ ID NO: 4871249 - DNA, 13 bp, Homo sapiens
ggcccccttcagg

SEQ ID NO: 4871250 - DNA, 23 bp, Homo sapiens
ggcccccttcaggagcctggcca

SEQ ID NO: 4871251 - DNA, 14 bp, Homo sapiens
ggccctctctctgg

SEQ ID NO: 4871252 - DNA, 16 bp, Homo sapiens
ggccctctctctgggc

SEQ ID NO: 4871253 - DNA, 12 bp, Homo sapiens
ggccctgacagg

SEQ ID NO: 4871254 - DNA, 21 bp, Homo sapiens
ggccctgtcactgtccagagt

SEQ ID NO: 4871255 - DNA, 22 bp, Homo sapiens
ggccctgtgagcacaaagaaga

SEQ ID NO: 4871256 - DNA, 20 bp, Homo sapiens
ggccggagtcagtgccaggt

SEQ ID NO: 4871257 - DNA, 13 bp, Homo sapiens
ggcctcaggctcc

SEQ ID NO: 4871258 - DNA, 14 bp, Homo sapiens
ggcctcaggctccg

SEQ ID NO: 4871259 - DNA, 16 bp, Homo sapiens
ggcctccagaagctgc

SEQ ID NO: 4871260 - DNA, 17 bp, Homo sapiens
ggcctccagaagctgct

SEQ ID NO: 4871261 - DNA, 14 bp, Homo sapiens
ggcctcccctgggc

SEQ ID NO: 4871262 - DNA, 17 bp, Homo sapiens
ggcctcccctgggcagg

SEQ ID NO: 4871263 - DNA, 21 bp, Homo sapiens
ggcctcccctgggcagggttc

SEQ ID NO: 4871264 - DNA, 19 bp, Homo sapiens
ggcctctcctgccctctgc

SEQ ID NO: 4871265 - DNA, 12 bp, Homo sapiens
ggcctctgggac

SEQ ID NO: 4871266 - DNA, 20 bp, Homo sapiens
ggcctgctaaggctcctcct

SEQ ID NO: 4871267 - DNA, 19 bp, Homo sapiens
ggcctgcttgactttccag

SEQ ID NO: 4871268 - DNA, 16 bp, Homo sapiens
ggcctggagcaggccc

SEQ ID NO: 4871269 - DNA, 18 bp, Homo sapiens
ggcctgggctgtgaggac

SEQ ID NO: 4871270 - DNA, 21 bp, Homo sapiens
ggccttatctgaaaggccagc

SEQ ID NO: 4871271 - DNA, 23 bp, Homo sapiens
ggccttccctttacagctctcct

SEQ ID NO: 4871272 - DNA, 15 bp, Homo sapiens
ggccttgcctccagg

SEQ ID NO: 4871273 - DNA, 15 bp, Homo sapiens
ggcggcacagccttc

SEQ ID NO: 4871274 - DNA, 10 bp, Homo sapiens
ggcgggtgac

SEQ ID NO: 4871275 - DNA, 12 bp, Homo sapiens
ggctaggcctcc

SEQ ID NO: 4871276 - DNA, 18 bp, Homo sapiens
ggctattttctaaagact

SEQ ID NO: 4871277 - DNA, 20 bp, Homo sapiens
ggctattttctaaagacttg

SEQ ID NO: 4871278 - DNA, 16 bp, Homo sapiens
ggctcactactgaaca

SEQ ID NO: 4871279 - DNA, 18 bp, Homo sapiens
ggctcactactgaacaca

SEQ ID NO: 4871280 - DNA, 18 bp, Homo sapiens
ggctcagagaggtagcac

SEQ ID NO: 4871281 - DNA, 13 bp, Homo sapiens
ggctcagcctggt

SEQ ID NO: 4871282 - DNA, 23 bp, Homo sapiens
ggctcagcctggtttctgggtgc

SEQ ID NO: 4871283 - DNA, 18 bp, Homo sapiens
ggctcaggagaagccagt

SEQ ID NO: 4871284 - DNA, 21 bp, Homo sapiens
ggctcatgcctgtaatctcag

SEQ ID NO: 4871285 - DNA, 16 bp, Homo sapiens
ggctcctccttgccca

SEQ ID NO: 4871286 - DNA, 23 bp, Homo sapiens
ggctcctgcaaaaggaggtgaaa

SEQ ID NO: 4871287 - DNA, 22 bp, Homo sapiens
ggctctctatagcaccagggct

SEQ ID NO: 4871288 - DNA, 13 bp, Homo sapiens
ggctgaagctgga

SEQ ID NO: 4871289 - DNA, 15 bp, Homo sapiens
ggctgaagctggagc

SEQ ID NO: 4871290 - DNA, 20 bp, Homo sapiens
ggctgaagctggagcagcgg

SEQ ID NO: 4871291 - DNA, 17 bp, Homo sapiens
ggctgagccctcctgag

SEQ ID NO: 4871292 - DNA, 20 bp, Homo sapiens
ggctgccaggggctctgtgg

SEQ ID NO: 4871293 - DNA, 11 bp, Homo sapiens
ggctgctgctc

SEQ ID NO: 4871294 - DNA, 16 bp, Homo sapiens
ggctgctgctcctctc

SEQ ID NO: 4871295 - DNA, 20 bp, Homo sapiens
ggctgctgctcctctcttgg

SEQ ID NO: 4871296 - DNA, 23 bp, Homo sapiens
ggctggggtggagtgggaaggga

SEQ ID NO: 4871297 - DNA, 21 bp, Homo sapiens
ggctgtggccgtctcctccct

SEQ ID NO: 4871298 - DNA, 17 bp, Homo sapiens
ggcttcaacagccaagc

SEQ ID NO: 4871299 - DNA, 21 bp, Homo sapiens
ggctttgggtggctcactact

SEQ ID NO: 4871300 - DNA, 13 bp, Homo sapiens
gggaaaaggcagg

SEQ ID NO: 4871301 - DNA, 14 bp, Homo sapiens
gggaactcccccag

SEQ ID NO: 4871302 - DNA, 16 bp, Homo sapiens
gggaactcccccagag

SEQ ID NO: 4871303 - DNA, 20 bp, Homo sapiens
gggaagacctgaaagagagg

SEQ ID NO: 4871304 - DNA, 19 bp, Homo sapiens
gggaagatgacctgcccca

SEQ ID NO: 4871305 - DNA, 16 bp, Homo sapiens
gggaagggcctgccca

SEQ ID NO: 4871306 - DNA, 18 bp, Homo sapiens
gggaagtttgctgtgctt

SEQ ID NO: 4871307 - DNA, 22 bp, Homo sapiens
gggaagtttgctgtgctttgga

SEQ ID NO: 4871308 - DNA, 22 bp, Homo sapiens
gggaataatttccttcaggcag

SEQ ID NO: 4871309 - DNA, 16 bp, Homo sapiens
gggacaggaaagagag

SEQ ID NO: 4871310 - DNA, 19 bp, Homo sapiens
gggaccaggtttgcaggag

SEQ ID NO: 4871311 - DNA, 20 bp, Homo sapiens
gggaccaggtttgcaggagc

SEQ ID NO: 4871312 - DNA, 13 bp, Homo sapiens
gggactccaagcc

SEQ ID NO: 4871313 - DNA, 16 bp, Homo sapiens
gggactccaagccctg

SEQ ID NO: 4871314 - DNA, 17 bp, Homo sapiens
gggactccaagccctgg

SEQ ID NO: 4871315 - DNA, 13 bp, Homo sapiens
gggagacagcagc

SEQ ID NO: 4871316 - DNA, 15 bp, Homo sapiens
gggagacagcagcct

SEQ ID NO: 4871317 - DNA, 18 bp, Homo sapiens
gggagacagcagcctgta

SEQ ID NO: 4871318 - DNA, 14 bp, Homo sapiens
gggagattgaactt

SEQ ID NO: 4871319 - DNA, 22 bp, Homo sapiens
gggagcatttaatggcagctag

SEQ ID NO: 4871320 - DNA, 19 bp, Homo sapiens
gggagccacttctccccag

SEQ ID NO: 4871321 - DNA, 13 bp, Homo sapiens
gggagccagctgc

SEQ ID NO: 4871322 - DNA, 14 bp, Homo sapiens
gggagccagctgct

SEQ ID NO: 4871323 - DNA, 17 bp, Homo sapiens
gggagccagctgcttga

SEQ ID NO: 4871324 - DNA, 12 bp, Homo sapiens
gggagccaggac

SEQ ID NO: 4871325 - DNA, 14 bp, Homo sapiens
gggagccaggactc

SEQ ID NO: 4871326 - DNA, 19 bp, Homo sapiens
gggaggcagatggagccca

SEQ ID NO: 4871327 - DNA, 13 bp, Homo sapiens
gggaggtggccag

SEQ ID NO: 4871328 - DNA, 19 bp, Homo sapiens
gggatacagatctcagggc

SEQ ID NO: 4871329 - DNA, 19 bp, Homo sapiens
gggatggtaagagaaaaga

SEQ ID NO: 4871330 - DNA, 14 bp, Homo sapiens
gggcacagcctagg

SEQ ID NO: 4871331 - DNA, 20 bp, Homo sapiens
gggcacatagcataggctgg

SEQ ID NO: 4871332 - DNA, 19 bp, Homo sapiens
gggcacccaccagttgctg

SEQ ID NO: 4871333 - DNA, 19 bp, Homo sapiens
gggcaccgtattcctctcc

SEQ ID NO: 4871334 - DNA, 13 bp, Homo sapiens
gggcactggggcc

SEQ ID NO: 4871335 - DNA, 14 bp, Homo sapiens
gggcagcaggccag

SEQ ID NO: 4871336 - DNA, 15 bp, Homo sapiens
gggcagcaggccaga

SEQ ID NO: 4871337 - DNA, 22 bp, Homo sapiens
gggcagggggtatgcagagctt

SEQ ID NO: 4871338 - DNA, 18 bp, Homo sapiens
gggcagggtggggggcca

SEQ ID NO: 4871339 - DNA, 16 bp, Homo sapiens
gggcagtgtgaggacc

SEQ ID NO: 4871340 - DNA, 14 bp, Homo sapiens
gggcataaagtaaa

SEQ ID NO: 4871341 - DNA, 14 bp, Homo sapiens
gggcatgcccagcc

SEQ ID NO: 4871342 - DNA, 21 bp, Homo sapiens
gggcatggtggctcatgcctg

SEQ ID NO: 4871343 - DNA, 15 bp, Homo sapiens
gggcattagcaaggc

SEQ ID NO: 4871344 - DNA, 18 bp, Homo sapiens
gggccaacctcaggctcc

SEQ ID NO: 4871345 - DNA, 20 bp, Homo sapiens
gggccaacctcaggctccta

SEQ ID NO: 4871346 - DNA, 15 bp, Homo sapiens
gggccaaggtcctgc

SEQ ID NO: 4871347 - DNA, 18 bp, Homo sapiens
gggccatgttcccagaac

SEQ ID NO: 4871348 - DNA, 21 bp, Homo sapiens
gggccctctctctgggcccag

SEQ ID NO: 4871349 - DNA, 23 bp, Homo sapiens
gggccctgaaatggcctgtccct

SEQ ID NO: 4871350 - DNA, 17 bp, Homo sapiens
gggcctccagaagctgc

SEQ ID NO: 4871351 - DNA, 19 bp, Homo sapiens
gggcctccagaagctgctc

SEQ ID NO: 4871352 - DNA, 17 bp, Homo sapiens
gggcctcccctgggcag

SEQ ID NO: 4871353 - DNA, 18 bp, Homo sapiens
gggcctctcctgccctct

SEQ ID NO: 4871354 - DNA, 17 bp, Homo sapiens
gggcctgggctgtgagg

SEQ ID NO: 4871355 - DNA, 21 bp, Homo sapiens
gggcgtgtgtgacactgatga

SEQ ID NO: 4871356 - DNA, 15 bp, Homo sapiens
gggctctgtggcaaa

SEQ ID NO: 4871357 - DNA, 22 bp, Homo sapiens
gggctgcatgatttttgccctg

SEQ ID NO: 4871358 - DNA, 12 bp, Homo sapiens
gggctgctgctc

SEQ ID NO: 4871359 - DNA, 17 bp, Homo sapiens
gggctgctgctcctctc

SEQ ID NO: 4871360 - DNA, 16 bp, Homo sapiens
gggctggaaggacctg

SEQ ID NO: 4871361 - DNA, 15 bp, Homo sapiens
gggctggtgggacag

SEQ ID NO: 4871362 - DNA, 20 bp, Homo sapiens
gggcttaatggagttcttgt

SEQ ID NO: 4871363 - DNA, 22 bp, Homo sapiens
gggctttgtgaccagaaagctt

SEQ ID NO: 4871364 - DNA, 18 bp, Homo sapiens
ggggaactcccccagagg

SEQ ID NO: 4871365 - DNA, 12 bp, Homo sapiens
ggggaaggggcc

SEQ ID NO: 4871366 - DNA, 16 bp, Homo sapiens
ggggagaaacccagag

SEQ ID NO: 4871367 - DNA, 15 bp, Homo sapiens
ggggagattgaactt

SEQ ID NO: 4871368 - DNA, 13 bp, Homo sapiens
ggggaggtggcca

SEQ ID NO: 4871369 - DNA, 17 bp, Homo sapiens
ggggaggttgtggggcc

SEQ ID NO: 4871370 - DNA, 12 bp, Homo sapiens
ggggcaggcctc

SEQ ID NO: 4871371 - DNA, 13 bp, Homo sapiens
ggggcaggcctcc

SEQ ID NO: 4871372 - DNA, 23 bp, Homo sapiens
ggggcaggcctcccaagctgatg

SEQ ID NO: 4871373 - DNA, 19 bp, Homo sapiens
ggggccaacctcaggctcc

SEQ ID NO: 4871374 - DNA, 20 bp, Homo sapiens
ggggccaacctcaggctcct

SEQ ID NO: 4871375 - DNA, 12 bp, Homo sapiens
ggggccaggaaa

SEQ ID NO: 4871376 - DNA, 15 bp, Homo sapiens
ggggcctccagaagc

SEQ ID NO: 4871377 - DNA, 17 bp, Homo sapiens
ggggcctccagaagctg

SEQ ID NO: 4871378 - DNA, 12 bp, Homo sapiens
ggggcctgggct

SEQ ID NO: 4871379 - DNA, 14 bp, Homo sapiens
ggggcctgggctgt

SEQ ID NO: 4871380 - DNA, 22 bp, Homo sapiens
ggggctaaggtttccagtcaga

SEQ ID NO: 4871381 - DNA, 14 bp, Homo sapiens
ggggctaatttaac

SEQ ID NO: 4871382 - DNA, 20 bp, Homo sapiens
ggggtcaggggagacgaggc

SEQ ID NO: 4871383 - DNA, 13 bp, Homo sapiens
ggggtcccctctg

SEQ ID NO: 4871384 - DNA, 12 bp, Homo sapiens
ggggtccctgca

SEQ ID NO: 4871385 - DNA, 21 bp, Homo sapiens
ggggtgagaagtacagggcag

SEQ ID NO: 4871386 - DNA, 20 bp, Homo sapiens
ggggttccttccacttctgg

SEQ ID NO: 4871387 - DNA, 12 bp, Homo sapiens
gggtaaagcagt

SEQ ID NO: 4871388 - DNA, 12 bp, Homo sapiens
gggtcagggggg

SEQ ID NO: 4871389 - DNA, 23 bp, Homo sapiens
gggtcttgctttctttgacctct

SEQ ID NO: 4871390 - DNA, 22 bp, Homo sapiens
gggtgagaagtacagggcagaa

SEQ ID NO: 4871391 - DNA, 16 bp, Homo sapiens
gggtgtggggtggggt

SEQ ID NO: 4871392 - DNA, 15 bp, Homo sapiens
gggtttattcactga

SEQ ID NO: 4871393 - DNA, 21 bp, Homo sapiens
ggtaaagcagttcctgtccca

SEQ ID NO: 4871394 - DNA, 12 bp, Homo sapiens
ggtaaatgtttc

SEQ ID NO: 4871395 - DNA, 20 bp, Homo sapiens
ggtacttatttctcagctgt

SEQ ID NO: 4871396 - DNA, 17 bp, Homo sapiens
ggtagctggggagccct

SEQ ID NO: 4871397 - DNA, 21 bp, Homo sapiens
ggtaggaccctcgagagcctt

SEQ ID NO: 4871398 - DNA, 15 bp, Homo sapiens
ggtagtggctggggt

SEQ ID NO: 4871399 - DNA, 16 bp, Homo sapiens
ggtagtggctggggtg

SEQ ID NO: 4871400 - DNA, 16 bp, Homo sapiens
ggtatgtagccagctg

SEQ ID NO: 4871401 - DNA, 18 bp, Homo sapiens
ggtatgtagccagctgtg

SEQ ID NO: 4871402 - DNA, 14 bp, Homo sapiens
ggtcacatccatcc

SEQ ID NO: 4871403 - DNA, 20 bp, Homo sapiens
ggtcagcatccagtgtgaga

SEQ ID NO: 4871404 - DNA, 11 bp, Homo sapiens
ggtccagggag

SEQ ID NO: 4871405 - DNA, 12 bp, Homo sapiens
ggtcccctctgt

SEQ ID NO: 4871406 - DNA, 16 bp, Homo sapiens
ggtccctgttgtcaga

SEQ ID NO: 4871407 - DNA, 15 bp, Homo sapiens
ggtcctagtaagaag

SEQ ID NO: 4871408 - DNA, 23 bp, Homo sapiens
ggtccttgtttctgccctgccag

SEQ ID NO: 4871409 - DNA, 14 bp, Homo sapiens
ggtctagagagaac

SEQ ID NO: 4871410 - DNA, 18 bp, Homo sapiens
ggtctcctcagggtgggg

SEQ ID NO: 4871411 - DNA, 15 bp, Homo sapiens
ggtctctcagggatg

SEQ ID NO: 4871412 - DNA, 11 bp, Homo sapiens
ggtctgccaat

SEQ ID NO: 4871413 - DNA, 23 bp, Homo sapiens
ggtctggcttgggtgaatttcag

SEQ ID NO: 4871414 - DNA, 14 bp, Homo sapiens
ggtgaaggggctgg

SEQ ID NO: 4871415 - DNA, 16 bp, Homo sapiens
ggtgaaggggctggtg

SEQ ID NO: 4871416 - DNA, 19 bp, Homo sapiens
ggtgaggtgaactccaggc

SEQ ID NO: 4871417 - DNA, 21 bp, Homo sapiens
ggtgaggtgaactccaggcat

SEQ ID NO: 4871418 - DNA, 20 bp, Homo sapiens
ggtgcactccagactctggg

SEQ ID NO: 4871419 - DNA, 21 bp, Homo sapiens
ggtgcactccagactctgggg

SEQ ID NO: 4871420 - DNA, 14 bp, Homo sapiens
ggtgccctttcctg

SEQ ID NO: 4871421 - DNA, 15 bp, Homo sapiens
ggtgctcatgctgct

SEQ ID NO: 4871422 - DNA, 17 bp, Homo sapiens
ggtgctttgcattttga

SEQ ID NO: 4871423 - DNA, 22 bp, Homo sapiens
ggtggaagtgtgtgccaagagc

SEQ ID NO: 4871424 - DNA, 18 bp, Homo sapiens
ggtggacatctgacccca

SEQ ID NO: 4871425 - DNA, 21 bp, Homo sapiens
ggtggatactggggggcaggc

SEQ ID NO: 4871426 - DNA, 17 bp, Homo sapiens
ggtggccttgagtctct

SEQ ID NO: 4871427 - DNA, 14 bp, Homo sapiens
ggtggctcactact

SEQ ID NO: 4871428 - DNA, 17 bp, Homo sapiens
ggtggtgaaggggctgg

SEQ ID NO: 4871429 - DNA, 19 bp, Homo sapiens
ggtggtgaaggggctggtg

SEQ ID NO: 4871430 - DNA, 15 bp, Homo sapiens
ggtgtctccttaagc

SEQ ID NO: 4871431 - DNA, 15 bp, Homo sapiens
ggtgtgaacatgttc

SEQ ID NO: 4871432 - DNA, 16 bp, Homo sapiens
ggtgtgaacatgttct

SEQ ID NO: 4871433 - DNA, 14 bp, Homo sapiens
ggtgtgaggagaga

SEQ ID NO: 4871434 - DNA, 15 bp, Homo sapiens
ggtgtggggtggggt

SEQ ID NO: 4871435 - DNA, 19 bp, Homo sapiens
ggtgttgcagccgcagaga

SEQ ID NO: 4871436 - DNA, 23 bp, Homo sapiens
ggtgttgcagccgcagagaaatg

SEQ ID NO: 4871437 - DNA, 15 bp, Homo sapiens
ggtgtttttaataaa

SEQ ID NO: 4871438 - DNA, 23 bp, Homo sapiens
ggttcaacaaagaaacaaagatg

SEQ ID NO: 4871439 - DNA, 16 bp, Homo sapiens
ggttcagacccctgcc

SEQ ID NO: 4871440 - DNA, 17 bp, Homo sapiens
ggttcagacccctgcct

SEQ ID NO: 4871441 - DNA, 18 bp, Homo sapiens
ggttcagacccctgcctg

SEQ ID NO: 4871442 - DNA, 16 bp, Homo sapiens
ggttccatgttgactg

SEQ ID NO: 4871443 - DNA, 14 bp, Homo sapiens
ggttgtctctcttc

SEQ ID NO: 4871444 - DNA, 23 bp, Homo sapiens
ggttgtctctcttcggtggcctt

SEQ ID NO: 4871445 - DNA, 16 bp, Homo sapiens
ggttgtgcacatttct

SEQ ID NO: 4871446 - DNA, 20 bp, Homo sapiens
ggttgtggggcctcaggctc

SEQ ID NO: 4871447 - DNA, 13 bp, Homo sapiens
ggtttattctttg

SEQ ID NO: 4871448 - DNA, 18 bp, Homo sapiens
ggtttgaaggagaatggc

SEQ ID NO: 4871449 - DNA, 14 bp, Homo sapiens
ggtttgggagccag

SEQ ID NO: 4871450 - DNA, 15 bp, Homo sapiens
ggtttgggagccagg

SEQ ID NO: 4871451 - DNA, 16 bp, Homo sapiens
ggtttgggagccagga

SEQ ID NO: 4871452 - DNA, 17 bp, Homo sapiens
gtaaaatactattgcct

SEQ ID NO: 4871453 - DNA, 21 bp, Homo sapiens
gtaaagatgtttatttcaggc

SEQ ID NO: 4871454 - DNA, 16 bp, Homo sapiens
gtaaatgaagatcttt

SEQ ID NO: 4871455 - DNA, 21 bp, Homo sapiens
gtaaatgaagatctttatatt

SEQ ID NO: 4871456 - DNA, 16 bp, Homo sapiens
gtaaccagctcagtgt

SEQ ID NO: 4871457 - DNA, 19 bp, Homo sapiens
gtaacgtattggacctgcc

SEQ ID NO: 4871458 - DNA, 22 bp, Homo sapiens
gtaactgtttagatgaatgtca

SEQ ID NO: 4871459 - DNA, 19 bp, Homo sapiens
gtaagagaaaagagagaaa

SEQ ID NO: 4871460 - DNA, 17 bp, Homo sapiens
gtaaggtgcttggagtt

SEQ ID NO: 4871461 - DNA, 17 bp, Homo sapiens
gtaagtggagtcctgga

SEQ ID NO: 4871462 - DNA, 21 bp, Homo sapiens
gtaataagcactgtaaacttc

SEQ ID NO: 4871463 - DNA, 16 bp, Homo sapiens
gtaataatagactgta

SEQ ID NO: 4871464 - DNA, 17 bp, Homo sapiens
gtaatacttccagaagt

SEQ ID NO: 4871465 - DNA, 18 bp, Homo sapiens
gtaatatttatatattta

SEQ ID NO: 4871466 - DNA, 15 bp, Homo sapiens
gtaatccaggggtgt

SEQ ID NO: 4871467 - DNA, 20 bp, Homo sapiens
gtaatcccctaaaataacag

SEQ ID NO: 4871468 - DNA, 20 bp, Homo sapiens
gtaatctatgtttataatac

SEQ ID NO: 4871469 - DNA, 15 bp, Homo sapiens
gtaatctcaatgcaa

SEQ ID NO: 4871470 - DNA, 21 bp, Homo sapiens
gtaatgctgcctcaggaccca

SEQ ID NO: 4871471 - DNA, 14 bp, Homo sapiens
gtaattgggaactg

SEQ ID NO: 4871472 - DNA, 19 bp, Homo sapiens
gtaatttaaatgaaagaaa

SEQ ID NO: 4871473 - DNA, 21 bp, Homo sapiens
gtaatttaaatgaaagaaaat

SEQ ID NO: 4871474 - DNA, 16 bp, Homo sapiens
gtacaaaatggtccta

SEQ ID NO: 4871475 - DNA, 12 bp, Homo sapiens
gtacaaaattaa

SEQ ID NO: 4871476 - DNA, 17 bp, Homo sapiens
gtacagaatttgaatta

SEQ ID NO: 4871477 - DNA, 18 bp, Homo sapiens
gtacaggtcatctgctgg

SEQ ID NO: 4871478 - DNA, 19 bp, Homo sapiens
gtaccaaaattttaaaaaa

SEQ ID NO: 4871479 - DNA, 23 bp, Homo sapiens
gtacgaacctacagttttaactg

SEQ ID NO: 4871480 - DNA, 14 bp, Homo sapiens
gtactgatttcagt

SEQ ID NO: 4871481 - DNA, 20 bp, Homo sapiens
gtactgatttcagtaagtct

SEQ ID NO: 4871482 - DNA, 12 bp, Homo sapiens
gtactgcatgtg

SEQ ID NO: 4871483 - DNA, 16 bp, Homo sapiens
gtactgtactttccca

SEQ ID NO: 4871484 - DNA, 23 bp, Homo sapiens
gtactgtactttcccaggttgac

SEQ ID NO: 4871485 - DNA, 18 bp, Homo sapiens
gtacttatttctcagctg

SEQ ID NO: 4871486 - DNA, 19 bp, Homo sapiens
gtacttatttctcagctgt

SEQ ID NO: 4871487 - DNA, 18 bp, Homo sapiens
gtacttcttgaatataaa

SEQ ID NO: 4871488 - DNA, 23 bp, Homo sapiens
gtacttggcccccttcaggagcc

SEQ ID NO: 4871489 - DNA, 20 bp, Homo sapiens
gtactttcccaggttgacta

SEQ ID NO: 4871490 - DNA, 20 bp, Homo sapiens
gtagagccaattagacttga

SEQ ID NO: 4871491 - DNA, 21 bp, Homo sapiens
gtagagcccctactgtgggca

SEQ ID NO: 4871492 - DNA, 16 bp, Homo sapiens
gtagctggggagccct

SEQ ID NO: 4871493 - DNA, 16 bp, Homo sapiens
gtaggaccctcgagag

SEQ ID NO: 4871494 - DNA, 17 bp, Homo sapiens
gtagggccctgacaggc

SEQ ID NO: 4871495 - DNA, 21 bp, Homo sapiens
gtagggccctgacaggccttc

SEQ ID NO: 4871496 - DNA, 21 bp, Homo sapiens
gtaggggagagagcagagaag

SEQ ID NO: 4871497 - DNA, 13 bp, Homo sapiens
gtagtggctgggg

SEQ ID NO: 4871498 - DNA, 21 bp, Homo sapiens
gtatacttccttacttttaag

SEQ ID NO: 4871499 - DNA, 17 bp, Homo sapiens
gtatataaactgggatg

SEQ ID NO: 4871500 - DNA, 22 bp, Homo sapiens
gtatatattttgtgtgaaattg

SEQ ID NO: 4871501 - DNA, 16 bp, Homo sapiens
gtatatgactgcattt

SEQ ID NO: 4871502 - DNA, 20 bp, Homo sapiens
gtatatgactgcatttgtgt

SEQ ID NO: 4871503 - DNA, 22 bp, Homo sapiens
gtatctagagcttaatgctaca

SEQ ID NO: 4871504 - DNA, 15 bp, Homo sapiens
gtatgatactaaaga

SEQ ID NO: 4871505 - DNA, 13 bp, Homo sapiens
gtatgcagagctt

SEQ ID NO: 4871506 - DNA, 20 bp, Homo sapiens
gtatgtgctatacacacaca

SEQ ID NO: 4871507 - DNA, 20 bp, Homo sapiens
gtattatacatgtgatacat

SEQ ID NO: 4871508 - DNA, 22 bp, Homo sapiens
gtattatacatgtgatacattt

SEQ ID NO: 4871509 - DNA, 15 bp, Homo sapiens
gtattatctcctttg

SEQ ID NO: 4871510 - DNA, 11 bp, Homo sapiens
gtattcctctc

SEQ ID NO: 4871511 - DNA, 16 bp, Homo sapiens
gtattgcacattgtaa

SEQ ID NO: 4871512 - DNA, 22 bp, Homo sapiens
gtattggtgttgcagccgcaga

SEQ ID NO: 4871513 - DNA, 22 bp, Homo sapiens
gtatttatgggtggatttatcc

SEQ ID NO: 4871514 - DNA, 22 bp, Homo sapiens
gtattttatcttattttctcaa

SEQ ID NO: 4871515 - DNA, 16 bp, Homo sapiens
gtcacactgtggccag

SEQ ID NO: 4871516 - DNA, 22 bp, Homo sapiens
gtcaccaaatagtgtgaaatat

SEQ ID NO: 4871517 - DNA, 14 bp, Homo sapiens
gtcactcccaagcc

SEQ ID NO: 4871518 - DNA, 14 bp, Homo sapiens
gtcacttttccttt

SEQ ID NO: 4871519 - DNA, 18 bp, Homo sapiens
gtcagaatttttaactgt

SEQ ID NO: 4871520 - DNA, 13 bp, Homo sapiens
gtcagacatttct

SEQ ID NO: 4871521 - DNA, 12 bp, Homo sapiens
gtcagatgaggc

SEQ ID NO: 4871522 - DNA, 15 bp, Homo sapiens
gtcagcagtcctagc

SEQ ID NO: 4871523 - DNA, 17 bp, Homo sapiens
gtcagcagtcctagccc

SEQ ID NO: 4871524 - DNA, 17 bp, Homo sapiens
gtcagttgttatttatt

SEQ ID NO: 4871525 - DNA, 18 bp, Homo sapiens
gtcagttgttatttattg

SEQ ID NO: 4871526 - DNA, 16 bp, Homo sapiens
gtcatgtgagtctggg

SEQ ID NO: 4871527 - DNA, 16 bp, Homo sapiens
gtccactcccagtgct

SEQ ID NO: 4871528 - DNA, 13 bp, Homo sapiens
gtccagagtctct

SEQ ID NO: 4871529 - DNA, 18 bp, Homo sapiens
gtccagccacccccaggc

SEQ ID NO: 4871530 - DNA, 20 bp, Homo sapiens
gtcccaaggaatcagcagga

SEQ ID NO: 4871531 - DNA, 14 bp, Homo sapiens
gtcccacatggcca

SEQ ID NO: 4871532 - DNA, 20 bp, Homo sapiens
gtcccatggctgaagctgga

SEQ ID NO: 4871533 - DNA, 14 bp, Homo sapiens
gtcccctctgtgct

SEQ ID NO: 4871534 - DNA, 16 bp, Homo sapiens
gtcccctctgtgcttc

SEQ ID NO: 4871535 - DNA, 20 bp, Homo sapiens
gtcccctctgtgcttcgact

SEQ ID NO: 4871536 - DNA, 21 bp, Homo sapiens
gtcccggttcagacccctgcc

SEQ ID NO: 4871537 - DNA, 20 bp, Homo sapiens
gtccctgcaaaactccaggc

SEQ ID NO: 4871538 - DNA, 22 bp, Homo sapiens
gtccctgcaaaactccaggcag

SEQ ID NO: 4871539 - DNA, 20 bp, Homo sapiens
gtccgcagttgtagcagaaa

SEQ ID NO: 4871540 - DNA, 19 bp, Homo sapiens
gtccgtgccccttccctgg

SEQ ID NO: 4871541 - DNA, 22 bp, Homo sapiens
gtcctaacctcgggcctgctgc

SEQ ID NO: 4871542 - DNA, 23 bp, Homo sapiens
gtcctctcagttctctcccttcc

SEQ ID NO: 4871543 - DNA, 17 bp, Homo sapiens
gtcctctcggctgccag

SEQ ID NO: 4871544 - DNA, 19 bp, Homo sapiens
gtccttgatttcaaagttt

SEQ ID NO: 4871545 - DNA, 17 bp, Homo sapiens
gtcgtcatcagatgctt

SEQ ID NO: 4871546 - DNA, 23 bp, Homo sapiens
gtctaacttggggaaggggcctg

SEQ ID NO: 4871547 - DNA, 15 bp, Homo sapiens
gtctaccaatacaaa

SEQ ID NO: 4871548 - DNA, 20 bp, Homo sapiens
gtctaggcactgagcaggga

SEQ ID NO: 4871549 - DNA, 18 bp, Homo sapiens
gtctaggtctcctcaggg

SEQ ID NO: 4871550 - DNA, 22 bp, Homo sapiens
gtctcaggtttgttttgtgaat

SEQ ID NO: 4871551 - DNA, 17 bp, Homo sapiens
gtctccgggactgccct

SEQ ID NO: 4871552 - DNA, 12 bp, Homo sapiens
gtctcctccctc

SEQ ID NO: 4871553 - DNA, 19 bp, Homo sapiens
gtctcctccctcagctctc

SEQ ID NO: 4871554 - DNA, 21 bp, Homo sapiens
gtctctgccagttacttgggc

SEQ ID NO: 4871555 - DNA, 12 bp, Homo sapiens
gtctgagacagg

SEQ ID NO: 4871556 - DNA, 21 bp, Homo sapiens
gtctgagtcatggccgggtgg

SEQ ID NO: 4871557 - DNA, 22 bp, Homo sapiens
gtctgccaatctgtacaaaatg

SEQ ID NO: 4871558 - DNA, 13 bp, Homo sapiens
gtctgctcctctt

SEQ ID NO: 4871559 - DNA, 15 bp, Homo sapiens
gtctggggtgtgggg

SEQ ID NO: 4871560 - DNA, 23 bp, Homo sapiens
gtctggttcctgtgtgaccctgg

SEQ ID NO: 4871561 - DNA, 20 bp, Homo sapiens
gtctgtggctttcagcctct

SEQ ID NO: 4871562 - DNA, 21 bp, Homo sapiens
gtctgtggctttcagcctctg

SEQ ID NO: 4871563 - DNA, 17 bp, Homo sapiens
gtctgtgttttgaaaga

SEQ ID NO: 4871564 - DNA, 22 bp, Homo sapiens
gtcttaaactaaatgtgcaata

SEQ ID NO: 4871565 - DNA, 21 bp, Homo sapiens
gtcttcctaattgtgccccta

SEQ ID NO: 4871566 - DNA, 14 bp, Homo sapiens
gtcttctatttatt

SEQ ID NO: 4871567 - DNA, 17 bp, Homo sapiens
gtcttctatttatttat

SEQ ID NO: 4871568 - DNA, 20 bp, Homo sapiens
gtcttctcacaagccagcca

SEQ ID NO: 4871569 - DNA, 21 bp, Homo sapiens
gtcttctttctccatggagcc

SEQ ID NO: 4871570 - DNA, 23 bp, Homo sapiens
gtcttctttctccatggagccta

SEQ ID NO: 4871571 - DNA, 22 bp, Homo sapiens
gtcttggaagctgtttggaaaa

SEQ ID NO: 4871572 - DNA, 15 bp, Homo sapiens
gtcttggatatatag

SEQ ID NO: 4871573 - DNA, 23 bp, Homo sapiens
gtcttgtgtttccacagcctgca

SEQ ID NO: 4871574 - DNA, 22 bp, Homo sapiens
gtctttcttcactctggcttca

SEQ ID NO: 4871575 - DNA, 13 bp, Homo sapiens
gtgaacactgtga

SEQ ID NO: 4871576 - DNA, 14 bp, Homo sapiens
gtgaactccaggca

SEQ ID NO: 4871577 - DNA, 14 bp, Homo sapiens
gtgaagtttggaga

SEQ ID NO: 4871578 - DNA, 16 bp, Homo sapiens
gtgaataaatgtcttg

SEQ ID NO: 4871579 - DNA, 15 bp, Homo sapiens
gtgaatacctgctca

SEQ ID NO: 4871580 - DNA, 18 bp, Homo sapiens
gtgaatgtgtgagaaaaa

SEQ ID NO: 4871581 - DNA, 13 bp, Homo sapiens
gtgacaaagcaat

SEQ ID NO: 4871582 - DNA, 13 bp, Homo sapiens
gtgaccaggcttt

SEQ ID NO: 4871583 - DNA, 20 bp, Homo sapiens
gtgactcagcatcacccacc

SEQ ID NO: 4871584 - DNA, 20 bp, Homo sapiens
gtgactccagggtgacaagg

SEQ ID NO: 4871585 - DNA, 17 bp, Homo sapiens
gtgactccttatctctt

SEQ ID NO: 4871586 - DNA, 20 bp, Homo sapiens
gtgactccttatctctttcc

SEQ ID NO: 4871587 - DNA, 19 bp, Homo sapiens
gtgacttctcccctgccct

SEQ ID NO: 4871588 - DNA, 11 bp, Homo sapiens
gtgagaatggc

SEQ ID NO: 4871589 - DNA, 23 bp, Homo sapiens
gtgagacgtgatgggctaggcct

SEQ ID NO: 4871590 - DNA, 15 bp, Homo sapiens
gtgagatactgtgta

SEQ ID NO: 4871591 - DNA, 16 bp, Homo sapiens
gtgagcatggggccag

SEQ ID NO: 4871592 - DNA, 14 bp, Homo sapiens
gtgaggacagggcc

SEQ ID NO: 4871593 - DNA, 20 bp, Homo sapiens
gtgaggtgaactccaggcat

SEQ ID NO: 4871594 - DNA, 18 bp, Homo sapiens
gtgagtgacgatgatgta

SEQ ID NO: 4871595 - DNA, 15 bp, Homo sapiens
gtgagtggcctgcta

SEQ ID NO: 4871596 - DNA, 21 bp, Homo sapiens
gtgatatataagtgtacatat

SEQ ID NO: 4871597 - DNA, 23 bp, Homo sapiens
gtgatttgaaaaatataaaatta

SEQ ID NO: 4871598 - DNA, 12 bp, Homo sapiens
gtgcaatagaag

SEQ ID NO: 4871599 - DNA, 21 bp, Homo sapiens
gtgcaataggtgagagaatgt

SEQ ID NO: 4871600 - DNA, 11 bp, Homo sapiens
gtgcactccag

SEQ ID NO: 4871601 - DNA, 12 bp, Homo sapiens
gtgcactccaga

SEQ ID NO: 4871602 - DNA, 14 bp, Homo sapiens
gtgcactccagact

SEQ ID NO: 4871603 - DNA, 15 bp, Homo sapiens
gtgcactccagactc

SEQ ID NO: 4871604 - DNA, 14 bp, Homo sapiens
gtgcagacagccat

SEQ ID NO: 4871605 - DNA, 14 bp, Homo sapiens
gtgcagtttggaat

SEQ ID NO: 4871606 - DNA, 13 bp, Homo sapiens
gtgccaagagcta

SEQ ID NO: 4871607 - DNA, 17 bp, Homo sapiens
gtgccaagagctactcc

SEQ ID NO: 4871608 - DNA, 20 bp, Homo sapiens
gtgccagcaagtccttaggc

SEQ ID NO: 4871609 - DNA, 17 bp, Homo sapiens
gtgcccctaaagagcat

SEQ ID NO: 4871610 - DNA, 19 bp, Homo sapiens
gtgcctaacctgggacctg

SEQ ID NO: 4871611 - DNA, 15 bp, Homo sapiens
gtgcctaatgtgttt

SEQ ID NO: 4871612 - DNA, 18 bp, Homo sapiens
gtgcctttctacaactga

SEQ ID NO: 4871613 - DNA, 14 bp, Homo sapiens
gtgcgaagactgag

SEQ ID NO: 4871614 - DNA, 12 bp, Homo sapiens
gtgctgctgtgg

SEQ ID NO: 4871615 - DNA, 13 bp, Homo sapiens
gtgctgctgtgga

SEQ ID NO: 4871616 - DNA, 14 bp, Homo sapiens
gtgctgctgtggag

SEQ ID NO: 4871617 - DNA, 23 bp, Homo sapiens
gtgcttgctggtgcctgccacct

SEQ ID NO: 4871618 - DNA, 20 bp, Homo sapiens
gtggacgttaggccaggcct

SEQ ID NO: 4871619 - DNA, 14 bp, Homo sapiens
gtggagcagagctc

SEQ ID NO: 4871620 - DNA, 19 bp, Homo sapiens
gtggatactggggggcagg

SEQ ID NO: 4871621 - DNA, 23 bp, Homo sapiens
gtggatcgagtgtagctgtgaaa

SEQ ID NO: 4871622 - DNA, 17 bp, Homo sapiens
gtggattgcctctgaaa

SEQ ID NO: 4871623 - DNA, 18 bp, Homo sapiens
gtggcaaaaagagtcaga

SEQ ID NO: 4871624 - DNA, 18 bp, Homo sapiens
gtggcagcttgctgggct

SEQ ID NO: 4871625 - DNA, 20 bp, Homo sapiens
gtggcagcttgctgggcttt

SEQ ID NO: 4871626 - DNA, 20 bp, Homo sapiens
gtggccacgggggcagtgtg

SEQ ID NO: 4871627 - DNA, 21 bp, Homo sapiens
gtggccacgggggcagtgtga

SEQ ID NO: 4871628 - DNA, 13 bp, Homo sapiens
gtggccagcccgc

SEQ ID NO: 4871629 - DNA, 18 bp, Homo sapiens
gtggccagcccgcagagg

SEQ ID NO: 4871630 - DNA, 18 bp, Homo sapiens
gtggccgtctcctccctc

SEQ ID NO: 4871631 - DNA, 16 bp, Homo sapiens
gtggcctctgcctggg

SEQ ID NO: 4871632 - DNA, 14 bp, Homo sapiens
gtggcctgcaggag

SEQ ID NO: 4871633 - DNA, 22 bp, Homo sapiens
gtggctggaaccacattgaaga

SEQ ID NO: 4871634 - DNA, 16 bp, Homo sapiens
gtgggagacagcagcc

SEQ ID NO: 4871635 - DNA, 16 bp, Homo sapiens
gtgggatcctccctca

SEQ ID NO: 4871636 - DNA, 20 bp, Homo sapiens
gtgggatttccagaaccaca

SEQ ID NO: 4871637 - DNA, 14 bp, Homo sapiens
gtgggccaggatcc

SEQ ID NO: 4871638 - DNA, 23 bp, Homo sapiens
gtggggggccatgttcccagaac

SEQ ID NO: 4871639 - DNA, 12 bp, Homo sapiens
gtggggggtgac

SEQ ID NO: 4871640 - DNA, 16 bp, Homo sapiens
gtggggtgctggggct

SEQ ID NO: 4871641 - DNA, 21 bp, Homo sapiens
gtggggtgctggggctgcatg

SEQ ID NO: 4871642 - DNA, 18 bp, Homo sapiens
gtggtgaaggggctggtg

SEQ ID NO: 4871643 - DNA, 18 bp, Homo sapiens
gtggtgatttgaaaaata

SEQ ID NO: 4871644 - DNA, 21 bp, Homo sapiens
gtggtgatttgaaaaatataa

SEQ ID NO: 4871645 - DNA, 15 bp, Homo sapiens
gtggtggtgaagggg

SEQ ID NO: 4871646 - DNA, 15 bp, Homo sapiens
gtggtggtggtgaag

SEQ ID NO: 4871647 - DNA, 15 bp, Homo sapiens
gtgtacatatgtgct

SEQ ID NO: 4871648 - DNA, 14 bp, Homo sapiens
gtgtagctgtgaaa

SEQ ID NO: 4871649 - DNA, 20 bp, Homo sapiens
gtgtagtcccggaggccttc

SEQ ID NO: 4871650 - DNA, 16 bp, Homo sapiens
gtgtattggtgttgca

SEQ ID NO: 4871651 - DNA, 14 bp, Homo sapiens
gtgtccctaatgtg

SEQ ID NO: 4871652 - DNA, 16 bp, Homo sapiens
gtgtcggatcctgtga

SEQ ID NO: 4871653 - DNA, 19 bp, Homo sapiens
gtgtctaggcactgagcag

SEQ ID NO: 4871654 - DNA, 20 bp, Homo sapiens
gtgtctggccctaactccta

SEQ ID NO: 4871655 - DNA, 23 bp, Homo sapiens
gtgtctggccctaactcctataa

SEQ ID NO: 4871656 - DNA, 16 bp, Homo sapiens
gtgtgaagtttggaga

SEQ ID NO: 4871657 - DNA, 17 bp, Homo sapiens
gtgtgaagtttggagat

SEQ ID NO: 4871658 - DNA, 18 bp, Homo sapiens
gtgtgaagtttggagata

SEQ ID NO: 4871659 - DNA, 22 bp, Homo sapiens
gtgtgaatttgccagaggacca

SEQ ID NO: 4871660 - DNA, 15 bp, Homo sapiens
gtgtggagcagagct

SEQ ID NO: 4871661 - DNA, 19 bp, Homo sapiens
gtgtggattgcctctgaaa

SEQ ID NO: 4871662 - DNA, 21 bp, Homo sapiens
gtgtgtggcagccaggatgac

SEQ ID NO: 4871663 - DNA, 21 bp, Homo sapiens
gtgttcagaagaatcttcctg

SEQ ID NO: 4871664 - DNA, 15 bp, Homo sapiens
gtgttgcctcttgca

SEQ ID NO: 4871665 - DNA, 20 bp, Homo sapiens
gtgtttccttttcaggagat

SEQ ID NO: 4871666 - DNA, 20 bp, Homo sapiens
gtgttttgaaagaatagaac

SEQ ID NO: 4871667 - DNA, 15 bp, Homo sapiens
gttaaagaaaggaaa

SEQ ID NO: 4871668 - DNA, 15 bp, Homo sapiens
gttaaagagaatgag

SEQ ID NO: 4871669 - DNA, 21 bp, Homo sapiens
gttaaagggatatttttttct

SEQ ID NO: 4871670 - DNA, 19 bp, Homo sapiens
gttaaggacccttttaagc

SEQ ID NO: 4871671 - DNA, 15 bp, Homo sapiens
gttaatatttaagac

SEQ ID NO: 4871672 - DNA, 18 bp, Homo sapiens
gttaattttattaaaatg

SEQ ID NO: 4871673 - DNA, 20 bp, Homo sapiens
gttaatttttcctgcatgtt

SEQ ID NO: 4871674 - DNA, 13 bp, Homo sapiens
gttagcagagtct

SEQ ID NO: 4871675 - DNA, 17 bp, Homo sapiens
gttagcagagtctgtct

SEQ ID NO: 4871676 - DNA, 18 bp, Homo sapiens
gttagcagagtctgtctc

SEQ ID NO: 4871677 - DNA, 21 bp, Homo sapiens
gttagcagagtctgtctcttg

SEQ ID NO: 4871678 - DNA, 12 bp, Homo sapiens
gttaggccaggc

SEQ ID NO: 4871679 - DNA, 13 bp, Homo sapiens
gttataagaagaa

SEQ ID NO: 4871680 - DNA, 18 bp, Homo sapiens
gttatcagtaatgctaaa

SEQ ID NO: 4871681 - DNA, 13 bp, Homo sapiens
gttatcatgaatt

SEQ ID NO: 4871682 - DNA, 18 bp, Homo sapiens
gttatcatgaattttaaa

SEQ ID NO: 4871683 - DNA, 15 bp, Homo sapiens
gttattacttcctca

SEQ ID NO: 4871684 - DNA, 19 bp, Homo sapiens
gttatttattttttaagaa

SEQ ID NO: 4871685 - DNA, 19 bp, Homo sapiens
gttcactccccgcctcccc

SEQ ID NO: 4871686 - DNA, 15 bp, Homo sapiens
gttcagacccctgcc

SEQ ID NO: 4871687 - DNA, 17 bp, Homo sapiens
gttcagacccctgcctg

SEQ ID NO: 4871688 - DNA, 18 bp, Homo sapiens
gttcatgtttttgtttta

SEQ ID NO: 4871689 - DNA, 22 bp, Homo sapiens
gttcattggcattctttgcaat

SEQ ID NO: 4871690 - DNA, 20 bp, Homo sapiens
gttccatgagttatcatgaa

SEQ ID NO: 4871691 - DNA, 21 bp, Homo sapiens
gttcccttgaaactttgggaa

SEQ ID NO: 4871692 - DNA, 15 bp, Homo sapiens
gttcctgtcccacat

SEQ ID NO: 4871693 - DNA, 16 bp, Homo sapiens
gttcctgtcccacatg

SEQ ID NO: 4871694 - DNA, 22 bp, Homo sapiens
gttcctgtgtgaccctgggcag

SEQ ID NO: 4871695 - DNA, 18 bp, Homo sapiens
gttctaaatatgaatgaa

SEQ ID NO: 4871696 - DNA, 22 bp, Homo sapiens
gttctaacagtgaagttttact

SEQ ID NO: 4871697 - DNA, 19 bp, Homo sapiens
gttctcctatatcctcctt

SEQ ID NO: 4871698 - DNA, 15 bp, Homo sapiens
gttctgaggccagaa

SEQ ID NO: 4871699 - DNA, 16 bp, Homo sapiens
gttctgaggccagaaa

SEQ ID NO: 4871700 - DNA, 18 bp, Homo sapiens
gttctgtagagccaatta

SEQ ID NO: 4871701 - DNA, 19 bp, Homo sapiens
gttcttctttctctgtatt

SEQ ID NO: 4871702 - DNA, 20 bp, Homo sapiens
gttgaagagacagagacaag

SEQ ID NO: 4871703 - DNA, 18 bp, Homo sapiens
gttgagaggaggacttgg

SEQ ID NO: 4871704 - DNA, 16 bp, Homo sapiens
gttgatgtttaaagag

SEQ ID NO: 4871705 - DNA, 18 bp, Homo sapiens
gttgcagccgcagagaaa

SEQ ID NO: 4871706 - DNA, 20 bp, Homo sapiens
gttgcagccgcagagaaatg

SEQ ID NO: 4871707 - DNA, 23 bp, Homo sapiens
gttgcattttaaccctattttac

SEQ ID NO: 4871708 - DNA, 18 bp, Homo sapiens
gttgcccccattcccagc

SEQ ID NO: 4871709 - DNA, 18 bp, Homo sapiens
gttgcctcttgcaatgcc

SEQ ID NO: 4871710 - DNA, 15 bp, Homo sapiens
gttgctaatgacagc

SEQ ID NO: 4871711 - DNA, 22 bp, Homo sapiens
gttgctaatgacagccttgcaa

SEQ ID NO: 4871712 - DNA, 13 bp, Homo sapiens
gttgcttgtcttc

SEQ ID NO: 4871713 - DNA, 18 bp, Homo sapiens
gttggaagggaccccaga

SEQ ID NO: 4871714 - DNA, 15 bp, Homo sapiens
gttggaatggatttt

SEQ ID NO: 4871715 - DNA, 17 bp, Homo sapiens
gttggaatggatttttc

SEQ ID NO: 4871716 - DNA, 21 bp, Homo sapiens
gttggacgggatgacctccag

SEQ ID NO: 4871717 - DNA, 22 bp, Homo sapiens
gttggacgggatgacctccaga

SEQ ID NO: 4871718 - DNA, 18 bp, Homo sapiens
gttggagcagcaggcctc

SEQ ID NO: 4871719 - DNA, 21 bp, Homo sapiens
gttgggtgtctccttaagctg

SEQ ID NO: 4871720 - DNA, 18 bp, Homo sapiens
gttggtatattttatatt

SEQ ID NO: 4871721 - DNA, 14 bp, Homo sapiens
gttgtagcagaaac

SEQ ID NO: 4871722 - DNA, 14 bp, Homo sapiens
gttgtccaggaagt

SEQ ID NO: 4871723 - DNA, 23 bp, Homo sapiens
gttgtctctcttcggtggccttg

SEQ ID NO: 4871724 - DNA, 15 bp, Homo sapiens
gttgtcttattgcac

SEQ ID NO: 4871725 - DNA, 20 bp, Homo sapiens
gttgtgagaatggcctggag

SEQ ID NO: 4871726 - DNA, 20 bp, Homo sapiens
gttgtgagtttaccttgtat

SEQ ID NO: 4871727 - DNA, 15 bp, Homo sapiens
gttgtttataataaa

SEQ ID NO: 4871728 - DNA, 13 bp, Homo sapiens
gtttaaaatgtaa

SEQ ID NO: 4871729 - DNA, 22 bp, Homo sapiens
gtttaagccgcagacctggagc

SEQ ID NO: 4871730 - DNA, 23 bp, Homo sapiens
gtttaagccgcagacctggagct

SEQ ID NO: 4871731 - DNA, 12 bp, Homo sapiens
gtttaatggtag

SEQ ID NO: 4871732 - DNA, 13 bp, Homo sapiens
gtttacctttctc

SEQ ID NO: 4871733 - DNA, 17 bp, Homo sapiens
gtttagatgaatgtcag

SEQ ID NO: 4871734 - DNA, 18 bp, Homo sapiens
gtttagatgaatgtcagt

SEQ ID NO: 4871735 - DNA, 21 bp, Homo sapiens
gtttagatgaggctcagagag

SEQ ID NO: 4871736 - DNA, 14 bp, Homo sapiens
gtttataaacagaa

SEQ ID NO: 4871737 - DNA, 19 bp, Homo sapiens
gtttatatggaagaaagta

SEQ ID NO: 4871738 - DNA, 15 bp, Homo sapiens
gtttattaaatgctt

SEQ ID NO: 4871739 - DNA, 15 bp, Homo sapiens
gtttattctttgcaa

SEQ ID NO: 4871740 - DNA, 17 bp, Homo sapiens
gtttcaagttttaaagt

SEQ ID NO: 4871741 - DNA, 18 bp, Homo sapiens
gtttcactgtactgcatg

SEQ ID NO: 4871742 - DNA, 21 bp, Homo sapiens
gtttcagtttgttggaaagta

SEQ ID NO: 4871743 - DNA, 16 bp, Homo sapiens
gtttccacagcctgca

SEQ ID NO: 4871744 - DNA, 21 bp, Homo sapiens
gtttcccatcccactgctccc

SEQ ID NO: 4871745 - DNA, 18 bp, Homo sapiens
gtttccttttcaggagat

SEQ ID NO: 4871746 - DNA, 23 bp, Homo sapiens
gtttctaccggagagagaatgta

SEQ ID NO: 4871747 - DNA, 14 bp, Homo sapiens
gtttctggatttca

SEQ ID NO: 4871748 - DNA, 20 bp, Homo sapiens
gtttgcaacctctttgctca

SEQ ID NO: 4871749 - DNA, 19 bp, Homo sapiens
gtttgggaaaggcagggcc

SEQ ID NO: 4871750 - DNA, 15 bp, Homo sapiens
gtttgtcacaagtgg

SEQ ID NO: 4871751 - DNA, 17 bp, Homo sapiens
gtttgtggggctggaag

SEQ ID NO: 4871752 - DNA, 20 bp, Homo sapiens
gttttaaagttcattgcaat

SEQ ID NO: 4871753 - DNA, 16 bp, Homo sapiens
gttttaactgtggata

SEQ ID NO: 4871754 - DNA, 22 bp, Homo sapiens
gttttaactgtggatattgtta

SEQ ID NO: 4871755 - DNA, 14 bp, Homo sapiens
gttttacagtgttt

SEQ ID NO: 4871756 - DNA, 15 bp, Homo sapiens
gttttactgtctatt

SEQ ID NO: 4871757 - DNA, 17 bp, Homo sapiens
gttttgtggtttggaat

SEQ ID NO: 4871758 - DNA, 19 bp, Homo sapiens
gtttttaaataaagaacaa

SEQ ID NO: 4871759 - DNA, 15 bp, Homo sapiens
gtttttgacatttat

SEQ ID NO: 4871760 - DNA, 20 bp, Homo sapiens
taaaaactcaggcaaagaaa

SEQ ID NO: 4871761 - DNA, 12 bp, Homo sapiens
taaaaagaaaga

SEQ ID NO: 4871762 - DNA, 20 bp, Homo sapiens
taaaaagttttagttttgat

SEQ ID NO: 4871763 - DNA, 11 bp, Homo sapiens
taaaaatcttt

SEQ ID NO: 4871764 - DNA, 23 bp, Homo sapiens
taaaaatggaaaaataaacacta

SEQ ID NO: 4871765 - DNA, 23 bp, Homo sapiens
taaaaatggcagggggtggaatt

SEQ ID NO: 4871766 - DNA, 21 bp, Homo sapiens
taaaacaattctgtgacatac

SEQ ID NO: 4871767 - DNA, 20 bp, Homo sapiens
taaaagatgtctctgcaaac

SEQ ID NO: 4871768 - DNA, 12 bp, Homo sapiens
taaaagcctgct

SEQ ID NO: 4871769 - DNA, 14 bp, Homo sapiens
taaaagttctcaat

SEQ ID NO: 4871770 - DNA, 19 bp, Homo sapiens
taaaagttttatatgcttt

SEQ ID NO: 4871771 - DNA, 15 bp, Homo sapiens
taaaataatgggatt

SEQ ID NO: 4871772 - DNA, 16 bp, Homo sapiens
taaaatagtatgaaaa

SEQ ID NO: 4871773 - DNA, 21 bp, Homo sapiens
taaaatgaggatccagggcag

SEQ ID NO: 4871774 - DNA, 16 bp, Homo sapiens
taaaatgatgttatac

SEQ ID NO: 4871775 - DNA, 21 bp, Homo sapiens
taaaatgtaatttaaatgaaa

SEQ ID NO: 4871776 - DNA, 22 bp, Homo sapiens
taaaattatgagattggttttc

SEQ ID NO: 4871777 - DNA, 15 bp, Homo sapiens
taaaattatttcatg

SEQ ID NO: 4871778 - DNA, 14 bp, Homo sapiens
taaaattcagtttt

SEQ ID NO: 4871779 - DNA, 16 bp, Homo sapiens
taaaattgttatcaaa

SEQ ID NO: 4871780 - DNA, 12 bp, Homo sapiens
taaacaaacaag

SEQ ID NO: 4871781 - DNA, 14 bp, Homo sapiens
taaacaaacaagcc

SEQ ID NO: 4871782 - DNA, 23 bp, Homo sapiens
taaacaaagtttcagagtatatt

SEQ ID NO: 4871783 - DNA, 14 bp, Homo sapiens
taaacagaaatgga

SEQ ID NO: 4871784 - DNA, 11 bp, Homo sapiens
taaacattttc

SEQ ID NO: 4871785 - DNA, 13 bp, Homo sapiens
taaaccctccaag

SEQ ID NO: 4871786 - DNA, 14 bp, Homo sapiens
taaaccctccaagg

SEQ ID NO: 4871787 - DNA, 23 bp, Homo sapiens
taaacttctgcaacaagcatgca

SEQ ID NO: 4871788 - DNA, 16 bp, Homo sapiens
taaagaaaggaaaaga

SEQ ID NO: 4871789 - DNA, 22 bp, Homo sapiens
taaagaaaggaaaagaaaacaa

SEQ ID NO: 4871790 - DNA, 16 bp, Homo sapiens
taaagaaggatgatgt

SEQ ID NO: 4871791 - DNA, 19 bp, Homo sapiens
taaagaccctcctattcta

SEQ ID NO: 4871792 - DNA, 12 bp, Homo sapiens
taaagagaatga

SEQ ID NO: 4871793 - DNA, 11 bp, Homo sapiens
taaagagcatc

SEQ ID NO: 4871794 - DNA, 13 bp, Homo sapiens
taaagagcatcct

SEQ ID NO: 4871795 - DNA, 16 bp, Homo sapiens
taaagagcatcctgat

SEQ ID NO: 4871796 - DNA, 16 bp, Homo sapiens
taaagatattctttag

SEQ ID NO: 4871797 - DNA, 13 bp, Homo sapiens
taaagatgagttg

SEQ ID NO: 4871798 - DNA, 18 bp, Homo sapiens
taaagctcaaatgaaatg

SEQ ID NO: 4871799 - DNA, 19 bp, Homo sapiens
taaagctcaaatgaaatgt

SEQ ID NO: 4871800 - DNA, 20 bp, Homo sapiens
taaagctcaaatgaaatgta

SEQ ID NO: 4871801 - DNA, 20 bp, Homo sapiens
taaagggcccaatgaattat

SEQ ID NO: 4871802 - DNA, 15 bp, Homo sapiens
taaagtcagaagttt

SEQ ID NO: 4871803 - DNA, 15 bp, Homo sapiens
taaagtgatctgtgt

SEQ ID NO: 4871804 - DNA, 17 bp, Homo sapiens
taaagttcattgcaatt

SEQ ID NO: 4871805 - DNA, 18 bp, Homo sapiens
taaagtttggttttgaca

SEQ ID NO: 4871806 - DNA, 20 bp, Homo sapiens
taaatacatgcatataatga

SEQ ID NO: 4871807 - DNA, 21 bp, Homo sapiens
taaatacatgcatataatgaa

SEQ ID NO: 4871808 - DNA, 20 bp, Homo sapiens
taaatacatgccacatcaaa

SEQ ID NO: 4871809 - DNA, 23 bp, Homo sapiens
taaataggaatcattcagaaatg

SEQ ID NO: 4871810 - DNA, 16 bp, Homo sapiens
taaatcataaagtcag

SEQ ID NO: 4871811 - DNA, 17 bp, Homo sapiens
taaatcattcttactaa

SEQ ID NO: 4871812 - DNA, 22 bp, Homo sapiens
taaatgaaagaaaattgagttg

SEQ ID NO: 4871813 - DNA, 15 bp, Homo sapiens
taaattaatggttta

SEQ ID NO: 4871814 - DNA, 24 bp, Homo sapiens
taaattaatggtttattctttgca

SEQ ID NO: 4871815 - DNA, 22 bp, Homo sapiens
taaattatgtgaccataatgta

SEQ ID NO: 4871816 - DNA, 21 bp, Homo sapiens
taaattcccaaatcctagact

SEQ ID NO: 4871817 - DNA, 16 bp, Homo sapiens
taaattgcatcactgt

SEQ ID NO: 4871818 - DNA, 19 bp, Homo sapiens
taaattgcatcactgtatc

SEQ ID NO: 4871819 - DNA, 18 bp, Homo sapiens
taaatttaaacttacaaa

SEQ ID NO: 4871820 - DNA, 14 bp, Homo sapiens
taaatttaatacca

SEQ ID NO: 4871821 - DNA, 17 bp, Homo sapiens
taaatttaataccagat

SEQ ID NO: 4871822 - DNA, 21 bp, Homo sapiens
taaatttcactactagattga

SEQ ID NO: 4871823 - DNA, 18 bp, Homo sapiens
taaattttcatgaatgtg

SEQ ID NO: 4871824 - DNA, 15 bp, Homo sapiens
taacaggccaaagag

SEQ ID NO: 4871825 - DNA, 20 bp, Homo sapiens
taacatctttattgaaattc

SEQ ID NO: 4871826 - DNA, 13 bp, Homo sapiens
taacatgtttctc

SEQ ID NO: 4871827 - DNA, 17 bp, Homo sapiens
taacatgtttctctata

SEQ ID NO: 4871828 - DNA, 21 bp, Homo sapiens
taacattcaggaattcttgga

SEQ ID NO: 4871829 - DNA, 17 bp, Homo sapiens
taacctagttaaagaaa

SEQ ID NO: 4871830 - DNA, 20 bp, Homo sapiens
taacctagttaaagaaagga

SEQ ID NO: 4871831 - DNA, 14 bp, Homo sapiens
taactaaattttaa

SEQ ID NO: 4871832 - DNA, 20 bp, Homo sapiens
taactcaaatacacatttgc

SEQ ID NO: 4871833 - DNA, 20 bp, Homo sapiens
taactctaaccaaggctgtg

SEQ ID NO: 4871834 - DNA, 17 bp, Homo sapiens
taactgccgtaatttaa

SEQ ID NO: 4871835 - DNA, 15 bp, Homo sapiens
taacttccaaataaa

SEQ ID NO: 4871836 - DNA, 19 bp, Homo sapiens
taacttccaaataaataat

SEQ ID NO: 4871837 - DNA, 16 bp, Homo sapiens
taacttctcatgtata

SEQ ID NO: 4871838 - DNA, 20 bp, Homo sapiens
taacttggggaaggggcctg

SEQ ID NO: 4871839 - DNA, 13 bp, Homo sapiens
taacttggggagg

SEQ ID NO: 4871840 - DNA, 14 bp, Homo sapiens
taagaagaaggcca

SEQ ID NO: 4871841 - DNA, 17 bp, Homo sapiens
taagaagaagttcatgt

SEQ ID NO: 4871842 - DNA, 18 bp, Homo sapiens
taagaataccacatcaaa

SEQ ID NO: 4871843 - DNA, 18 bp, Homo sapiens
taagaatagtagatgtgg

SEQ ID NO: 4871844 - DNA, 20 bp, Homo sapiens
taagaattctgattgatttg

SEQ ID NO: 4871845 - DNA, 23 bp, Homo sapiens
taagacactgaaaaatctaagtg

SEQ ID NO: 4871846 - DNA, 18 bp, Homo sapiens
taagactatatatataaa

SEQ ID NO: 4871847 - DNA, 20 bp, Homo sapiens
taagagaaaagagagaaaca

SEQ ID NO: 4871848 - DNA, 17 bp, Homo sapiens
taagagaaacctgccaa

SEQ ID NO: 4871849 - DNA, 15 bp, Homo sapiens
taagagatgggacta

SEQ ID NO: 4871850 - DNA, 17 bp, Homo sapiens
taagataaaatgatgtt

SEQ ID NO: 4871851 - DNA, 14 bp, Homo sapiens
taagcaaatgttaa

SEQ ID NO: 4871852 - DNA, 18 bp, Homo sapiens
taagccgcagacctggag

SEQ ID NO: 4871853 - DNA, 23 bp, Homo sapiens
taagccgcagacctggagcttca

SEQ ID NO: 4871854 - DNA, 21 bp, Homo sapiens
taagcgaagtctttgccttct

SEQ ID NO: 4871855 - DNA, 23 bp, Homo sapiens
taagcgaagtctttgccttctct

SEQ ID NO: 4871856 - DNA, 22 bp, Homo sapiens
taagctgtgtctgcccaatgaa

SEQ ID NO: 4871857 - DNA, 13 bp, Homo sapiens
taaggagaaatga

SEQ ID NO: 4871858 - DNA, 15 bp, Homo sapiens
taaggggaagaatga

SEQ ID NO: 4871859 - DNA, 21 bp, Homo sapiens
taaggtttccagtcagatgag

SEQ ID NO: 4871860 - DNA, 17 bp, Homo sapiens
taagtcattggcaaagt

SEQ ID NO: 4871861 - DNA, 23 bp, Homo sapiens
taagtgcgaagactgagccagat

SEQ ID NO: 4871862 - DNA, 14 bp, Homo sapiens
taagtgctgctgtg

SEQ ID NO: 4871863 - DNA, 18 bp, Homo sapiens
taagtgtacatatgtgct

SEQ ID NO: 4871864 - DNA, 22 bp, Homo sapiens
taagttcatattccatatttat

SEQ ID NO: 4871865 - DNA, 14 bp, Homo sapiens
taataaaaagaaag

SEQ ID NO: 4871866 - DNA, 12 bp, Homo sapiens
taataaagtact

SEQ ID NO: 4871867 - DNA, 13 bp, Homo sapiens
taataaagtactt

SEQ ID NO: 4871868 - DNA, 19 bp, Homo sapiens
taataagagaatgttccta

SEQ ID NO: 4871869 - DNA, 22 bp, Homo sapiens
taatagactgtaacttccaaat

SEQ ID NO: 4871870 - DNA, 19 bp, Homo sapiens
taatagctttagtgaatta

SEQ ID NO: 4871871 - DNA, 12 bp, Homo sapiens
taatatattaaa

SEQ ID NO: 4871872 - DNA, 21 bp, Homo sapiens
taatattcagggtaaatagga

SEQ ID NO: 4871873 - DNA, 17 bp, Homo sapiens
taatattgaaaattgaa

SEQ ID NO: 4871874 - DNA, 21 bp, Homo sapiens
taatattgtttggtaaatgtt

SEQ ID NO: 4871875 - DNA, 22 bp, Homo sapiens
taatcaaattctgtctggggac

SEQ ID NO: 4871876 - DNA, 12 bp, Homo sapiens
taatccatttca

SEQ ID NO: 4871877 - DNA, 15 bp, Homo sapiens
taatctatgtttata

SEQ ID NO: 4871878 - DNA, 17 bp, Homo sapiens
taatcttcaaagccttc

SEQ ID NO: 4871879 - DNA, 17 bp, Homo sapiens
taatgacagccttgcaa

SEQ ID NO: 4871880 - DNA, 15 bp, Homo sapiens
taatgcctgcttttt

SEQ ID NO: 4871881 - DNA, 18 bp, Homo sapiens
taatgctaaatgtgtaat

SEQ ID NO: 4871882 - DNA, 15 bp, Homo sapiens
taatgctacaatttt

SEQ ID NO: 4871883 - DNA, 15 bp, Homo sapiens
taatgggattttctt

SEQ ID NO: 4871884 - DNA, 15 bp, Homo sapiens
taattaatttggagc

SEQ ID NO: 4871885 - DNA, 18 bp, Homo sapiens
taattatgtaaataactc

SEQ ID NO: 4871886 - DNA, 18 bp, Homo sapiens
taattcaatcctactttt

SEQ ID NO: 4871887 - DNA, 17 bp, Homo sapiens
taattgtacaaaattaa

SEQ ID NO: 4871888 - DNA, 12 bp, Homo sapiens
taattgtgcccc

SEQ ID NO: 4871889 - DNA, 14 bp, Homo sapiens
taattgtgtggatt

SEQ ID NO: 4871890 - DNA, 16 bp, Homo sapiens
taatttaaatgaaaga

SEQ ID NO: 4871891 - DNA, 19 bp, Homo sapiens
taatttaactttctgggtt

SEQ ID NO: 4871892 - DNA, 11 bp, Homo sapiens
taatttcagtg

SEQ ID NO: 4871893 - DNA, 16 bp, Homo sapiens
taatttcagtgtaaag

SEQ ID NO: 4871894 - DNA, 17 bp, Homo sapiens
taatttcctgtgaggat

SEQ ID NO: 4871895 - DNA, 18 bp, Homo sapiens
taatttgaactttggaac

SEQ ID NO: 4871896 - DNA, 15 bp, Homo sapiens
taatttgtgtgtttt

SEQ ID NO: 4871897 - DNA, 14 bp, Homo sapiens
taattttaaagtgc

SEQ ID NO: 4871898 - DNA, 19 bp, Homo sapiens
taattttattttaaaattt

SEQ ID NO: 4871899 - DNA, 15 bp, Homo sapiens
taatttttcctgcat

SEQ ID NO: 4871900 - DNA, 20 bp, Homo sapiens
tacaaaaattatgcaattca

SEQ ID NO: 4871901 - DNA, 14 bp, Homo sapiens
tacaaaattaagca

SEQ ID NO: 4871902 - DNA, 23 bp, Homo sapiens
tacaaaattaagcaaatgttaaa

SEQ ID NO: 4871903 - DNA, 14 bp, Homo sapiens
tacaaagtgtacca

SEQ ID NO: 4871904 - DNA, 19 bp, Homo sapiens
tacaagggcataaagtaaa

SEQ ID NO: 4871905 - DNA, 15 bp, Homo sapiens
tacaatattgattgg

SEQ ID NO: 4871906 - DNA, 23 bp, Homo sapiens
tacaatattgattgggaaaacat

SEQ ID NO: 4871907 - DNA, 17 bp, Homo sapiens
tacacttcacctccttc

SEQ ID NO: 4871908 - DNA, 20 bp, Homo sapiens
tacacttcacctccttctgc

SEQ ID NO: 4871909 - DNA, 16 bp, Homo sapiens
tacagaggtattaaaa

SEQ ID NO: 4871910 - DNA, 14 bp, Homo sapiens
tacagctgtgctcc

SEQ ID NO: 4871911 - DNA, 17 bp, Homo sapiens
tacaggagccagcctgc

SEQ ID NO: 4871912 - DNA, 19 bp, Homo sapiens
tacaggtcatctgctggga

SEQ ID NO: 4871913 - DNA, 14 bp, Homo sapiens
tacagttttaactg

SEQ ID NO: 4871914 - DNA, 17 bp, Homo sapiens
tacagttttaactgtgg

SEQ ID NO: 4871915 - DNA, 15 bp, Homo sapiens
tacatactgcatctt

SEQ ID NO: 4871916 - DNA, 16 bp, Homo sapiens
tacatcaatatgtata

SEQ ID NO: 4871917 - DNA, 14 bp, Homo sapiens
tacatgaagcagaa

SEQ ID NO: 4871918 - DNA, 20 bp, Homo sapiens
tacatgcatataatgaataa

SEQ ID NO: 4871919 - DNA, 15 bp, Homo sapiens
tacatgtattgcaca

SEQ ID NO: 4871920 - DNA, 19 bp, Homo sapiens
tacatgtattgcacattgt

SEQ ID NO: 4871921 - DNA, 22 bp, Homo sapiens
tacatgtattgcacattgtaaa

SEQ ID NO: 4871922 - DNA, 16 bp, Homo sapiens
tacatgtgatacattt

SEQ ID NO: 4871923 - DNA, 17 bp, Homo sapiens
tacatgtgatacatttt

SEQ ID NO: 4871924 - DNA, 18 bp, Homo sapiens
tacatgtgatacattttt

SEQ ID NO: 4871925 - DNA, 15 bp, Homo sapiens
tacattccaccctgt

SEQ ID NO: 4871926 - DNA, 14 bp, Homo sapiens
taccaaaattttaa

SEQ ID NO: 4871927 - DNA, 14 bp, Homo sapiens
taccaatacaaaat

SEQ ID NO: 4871928 - DNA, 16 bp, Homo sapiens
taccagcaaagcaaat

SEQ ID NO: 4871929 - DNA, 20 bp, Homo sapiens
taccagggtctctcagggat

SEQ ID NO: 4871930 - DNA, 14 bp, Homo sapiens
taccatatgaatga

SEQ ID NO: 4871931 - DNA, 15 bp, Homo sapiens
taccatatgaatgaa

SEQ ID NO: 4871932 - DNA, 19 bp, Homo sapiens
taccatatgaatgaaacat

SEQ ID NO: 4871933 - DNA, 18 bp, Homo sapiens
taccatgcttcacaatgt

SEQ ID NO: 4871934 - DNA, 19 bp, Homo sapiens
taccattctattctccaga

SEQ ID NO: 4871935 - DNA, 18 bp, Homo sapiens
taccatttagtaagaata

SEQ ID NO: 4871936 - DNA, 14 bp, Homo sapiens
tacccctgctccca

SEQ ID NO: 4871937 - DNA, 16 bp, Homo sapiens
tacctactggtgtaat

SEQ ID NO: 4871938 - DNA, 19 bp, Homo sapiens
tacctctgtctgagacagg

SEQ ID NO: 4871939 - DNA, 12 bp, Homo sapiens
tacctcttttgc

SEQ ID NO: 4871940 - DNA, 15 bp, Homo sapiens
tacctggatgttctt

SEQ ID NO: 4871941 - DNA, 14 bp, Homo sapiens
tacctgtgaggact

SEQ ID NO: 4871942 - DNA, 13 bp, Homo sapiens
tacgatttcacta

SEQ ID NO: 4871943 - DNA, 21 bp, Homo sapiens
tacgtagcctaaggctcctgt

SEQ ID NO: 4871944 - DNA, 16 bp, Homo sapiens
tactaaaaagtataaa

SEQ ID NO: 4871945 - DNA, 21 bp, Homo sapiens
tactaaaaagtataaaatagt

SEQ ID NO: 4871946 - DNA, 24 bp, Homo sapiens
tactaacccagtctttcttcactc

SEQ ID NO: 4871947 - DNA, 20 bp, Homo sapiens
tactaccagggtctctcagg

SEQ ID NO: 4871948 - DNA, 15 bp, Homo sapiens
tactactactgttat

SEQ ID NO: 4871949 - DNA, 14 bp, Homo sapiens
tactagtgtgactc

SEQ ID NO: 4871950 - DNA, 22 bp, Homo sapiens
tactcccactcccggcctgtca

SEQ ID NO: 4871951 - DNA, 14 bp, Homo sapiens
tactgacatttctt

SEQ ID NO: 4871952 - DNA, 16 bp, Homo sapiens
tactgacatttcttct

SEQ ID NO: 4871953 - DNA, 11 bp, Homo sapiens
tactgatgaga

SEQ ID NO: 4871954 - DNA, 21 bp, Homo sapiens
tactgatgagagaatgtggaa

SEQ ID NO: 4871955 - DNA, 19 bp, Homo sapiens
tactgatttcagtaagtct

SEQ ID NO: 4871956 - DNA, 14 bp, Homo sapiens
tactgcaatcactg

SEQ ID NO: 4871957 - DNA, 17 bp, Homo sapiens
tactgcatgtgacttct

SEQ ID NO: 4871958 - DNA, 20 bp, Homo sapiens
tactgccaaaacatttatga

SEQ ID NO: 4871959 - DNA, 15 bp, Homo sapiens
tactgctcctgtggc

SEQ ID NO: 4871960 - DNA, 19 bp, Homo sapiens
tactgctcctgtggcagga

SEQ ID NO: 4871961 - DNA, 14 bp, Homo sapiens
tactggggggcagg

SEQ ID NO: 4871962 - DNA, 18 bp, Homo sapiens
tactggggggcaggcctc

SEQ ID NO: 4871963 - DNA, 20 bp, Homo sapiens
tactggtgtaatctcaatgc

SEQ ID NO: 4871964 - DNA, 15 bp, Homo sapiens
tactggttacctgga

SEQ ID NO: 4871965 - DNA, 21 bp, Homo sapiens
tactgtaatgctgcctcagga

SEQ ID NO: 4871966 - DNA, 17 bp, Homo sapiens
tactgtctattaatatt

SEQ ID NO: 4871967 - DNA, 16 bp, Homo sapiens
tactgtggcctgcagg

SEQ ID NO: 4871968 - DNA, 13 bp, Homo sapiens
tactgtgtgccag

SEQ ID NO: 4871969 - DNA, 22 bp, Homo sapiens
tacttatttctcagctgtgcct

SEQ ID NO: 4871970 - DNA, 23 bp, Homo sapiens
tacttatttctcagctgtgcctt

SEQ ID NO: 4871971 - DNA, 21 bp, Homo sapiens
tacttcaaagtgcctgggctc

SEQ ID NO: 4871972 - DNA, 22 bp, Homo sapiens
tactttatcatgaatgctttta

SEQ ID NO: 4871973 - DNA, 15 bp, Homo sapiens
tactttgacagtgtt

SEQ ID NO: 4871974 - DNA, 17 bp, Homo sapiens
tactttggaattcttag

SEQ ID NO: 4871975 - DNA, 20 bp, Homo sapiens
tactttggggctaatttaac

SEQ ID NO: 4871976 - DNA, 19 bp, Homo sapiens
tagaaactgaggcccagag

SEQ ID NO: 4871977 - DNA, 20 bp, Homo sapiens
tagaaactgaggcccagaga

SEQ ID NO: 4871978 - DNA, 12 bp, Homo sapiens
tagaactcctgt

SEQ ID NO: 4871979 - DNA, 21 bp, Homo sapiens
tagaagcctgacaactcattt

SEQ ID NO: 4871980 - DNA, 20 bp, Homo sapiens
tagaagtgagcaaaaaagag

SEQ ID NO: 4871981 - DNA, 17 bp, Homo sapiens
tagaatttaatatatat

SEQ ID NO: 4871982 - DNA, 16 bp, Homo sapiens
tagacaaaaagtatat

SEQ ID NO: 4871983 - DNA, 11 bp, Homo sapiens
tagacatgaaa

SEQ ID NO: 4871984 - DNA, 22 bp, Homo sapiens
tagacttggagaatactgccaa

SEQ ID NO: 4871985 - DNA, 23 bp, Homo sapiens
tagacttggagaatactgccaaa

SEQ ID NO: 4871986 - DNA, 22 bp, Homo sapiens
tagagaacaaagtaaaagtagt

SEQ ID NO: 4871987 - DNA, 23 bp, Homo sapiens
tagagagaaccaataaaagtggt

SEQ ID NO: 4871988 - DNA, 20 bp, Homo sapiens
tagagattgcatttttatta

SEQ ID NO: 4871989 - DNA, 23 bp, Homo sapiens
tagagggcgagggatgatgaggg

SEQ ID NO: 4871990 - DNA, 15 bp, Homo sapiens
tagagtaatgaaatg

SEQ ID NO: 4871991 - DNA, 18 bp, Homo sapiens
tagagtcaactacacaaa

SEQ ID NO: 4871992 - DNA, 22 bp, Homo sapiens
tagatatgtattcttttctcag

SEQ ID NO: 4871993 - DNA, 19 bp, Homo sapiens
tagatccagcccaaacctg

SEQ ID NO: 4871994 - DNA, 18 bp, Homo sapiens
tagatccatttccattgc

SEQ ID NO: 4871995 - DNA, 14 bp, Homo sapiens
tagatgaggctcag

SEQ ID NO: 4871996 - DNA, 18 bp, Homo sapiens
tagatgattttttgaaag

SEQ ID NO: 4871997 - DNA, 19 bp, Homo sapiens
tagatgattttttgaaagt

SEQ ID NO: 4871998 - DNA, 15 bp, Homo sapiens
tagattcagagaaat

SEQ ID NO: 4871999 - DNA, 16 bp, Homo sapiens
tagattgtattaacta

SEQ ID NO: 4872000 - DNA, 11 bp, Homo sapiens
tagatttatgg

SEQ ID NO: 4872001 - DNA, 18 bp, Homo sapiens
tagcaaggcagagccttt

SEQ ID NO: 4872002 - DNA, 15 bp, Homo sapiens
tagcagagtctgtct

SEQ ID NO: 4872003 - DNA, 18 bp, Homo sapiens
tagcagccagttcaaaaa

SEQ ID NO: 4872004 - DNA, 13 bp, Homo sapiens
tagcataggctgg

SEQ ID NO: 4872005 - DNA, 12 bp, Homo sapiens
tagcccaaccta

SEQ ID NO: 4872006 - DNA, 18 bp, Homo sapiens
tagcctatgtctggcaga

SEQ ID NO: 4872007 - DNA, 13 bp, Homo sapiens
tagccttcccagc

SEQ ID NO: 4872008 - DNA, 15 bp, Homo sapiens
tagctggggagccct

SEQ ID NO: 4872009 - DNA, 17 bp, Homo sapiens
tagctgtacttcttgaa

SEQ ID NO: 4872010 - DNA, 11 bp, Homo sapiens
tagctgtgaaa

SEQ ID NO: 4872011 - DNA, 22 bp, Homo sapiens
tagctgtgtgaatacctgctca

SEQ ID NO: 4872012 - DNA, 17 bp, Homo sapiens
tagcttgcagaactgta

SEQ ID NO: 4872013 - DNA, 9 bp, Homo sapiens
taggacaga

SEQ ID NO: 4872014 - DNA, 18 bp, Homo sapiens
taggcactgagcagggat

SEQ ID NO: 4872015 - DNA, 22 bp, Homo sapiens
taggccacagaaggtgaacttt

SEQ ID NO: 4872016 - DNA, 22 bp, Homo sapiens
taggccaggccttatctgaaag

SEQ ID NO: 4872017 - DNA, 20 bp, Homo sapiens
taggctattttctaaagact

SEQ ID NO: 4872018 - DNA, 19 bp, Homo sapiens
tagggactacccatagaca

SEQ ID NO: 4872019 - DNA, 20 bp, Homo sapiens
tagggactacccatagacat

SEQ ID NO: 4872020 - DNA, 22 bp, Homo sapiens
tagggagttcatctggagggtt

SEQ ID NO: 4872021 - DNA, 17 bp, Homo sapiens
tagggccctgacaggcc

SEQ ID NO: 4872022 - DNA, 20 bp, Homo sapiens
taggggagagagcagagaag

SEQ ID NO: 4872023 - DNA, 19 bp, Homo sapiens
taggttctgtagagccaat

SEQ ID NO: 4872024 - DNA, 15 bp, Homo sapiens
taggtttcaggaagt

SEQ ID NO: 4872025 - DNA, 20 bp, Homo sapiens
taggtttttttccttctgaa

SEQ ID NO: 4872026 - DNA, 18 bp, Homo sapiens
tagtaagaagacaaactg

SEQ ID NO: 4872027 - DNA, 16 bp, Homo sapiens
tagtaagcatagaaac

SEQ ID NO: 4872028 - DNA, 17 bp, Homo sapiens
tagtacctgtgactctt

SEQ ID NO: 4872029 - DNA, 19 bp, Homo sapiens
tagtgacatttaatgccat

SEQ ID NO: 4872030 - DNA, 19 bp, Homo sapiens
tagtgatgatggttcacgt

SEQ ID NO: 4872031 - DNA, 18 bp, Homo sapiens
tagtgcaacatctctgaa

SEQ ID NO: 4872032 - DNA, 18 bp, Homo sapiens
tagtgcaatagtgcaaca

SEQ ID NO: 4872033 - DNA, 20 bp, Homo sapiens
tagtgggccctctctctggg

SEQ ID NO: 4872034 - DNA, 22 bp, Homo sapiens
tagtgggggatgggtcctctag

SEQ ID NO: 4872035 - DNA, 17 bp, Homo sapiens
tagtgtgaaatatatta

SEQ ID NO: 4872036 - DNA, 12 bp, Homo sapiens
tagtgtgactcc

SEQ ID NO: 4872037 - DNA, 14 bp, Homo sapiens
tagtgttgtccagg

SEQ ID NO: 4872038 - DNA, 16 bp, Homo sapiens
tagtgttgtccaggaa

SEQ ID NO: 4872039 - DNA, 13 bp, Homo sapiens
tagttaaagaaag

SEQ ID NO: 4872040 - DNA, 18 bp, Homo sapiens
tagttaaagaaaggaaaa

SEQ ID NO: 4872041 - DNA, 20 bp, Homo sapiens
tagttgcatagcagtatatg

SEQ ID NO: 4872042 - DNA, 19 bp, Homo sapiens
tagttgcccccattcccag

SEQ ID NO: 4872043 - DNA, 22 bp, Homo sapiens
tagttgcccccattcccagcct

SEQ ID NO: 4872044 - DNA, 16 bp, Homo sapiens
tataaacagaaatgga

SEQ ID NO: 4872045 - DNA, 18 bp, Homo sapiens
tataaacagaaatggaaa

SEQ ID NO: 4872046 - DNA, 16 bp, Homo sapiens
tataaaggataaagaa

SEQ ID NO: 4872047 - DNA, 14 bp, Homo sapiens
tataaatgtataaa

SEQ ID NO: 4872048 - DNA, 22 bp, Homo sapiens
tataacacatttttttgcatgc

SEQ ID NO: 4872049 - DNA, 16 bp, Homo sapiens
tataacagtgtttaaa

SEQ ID NO: 4872050 - DNA, 17 bp, Homo sapiens
tataacctagttaaaga

SEQ ID NO: 4872051 - DNA, 12 bp, Homo sapiens
tataataaaaat

SEQ ID NO: 4872052 - DNA, 18 bp, Homo sapiens
tataataaaaatatattt

SEQ ID NO: 4872053 - DNA, 13 bp, Homo sapiens
tataatactacta

SEQ ID NO: 4872054 - DNA, 18 bp, Homo sapiens
tataatgtttattaaatg

SEQ ID NO: 4872055 - DNA, 16 bp, Homo sapiens
tataattgtacaaaat

SEQ ID NO: 4872056 - DNA, 14 bp, Homo sapiens
tatacacacacaca

SEQ ID NO: 4872057 - DNA, 20 bp, Homo sapiens
tatacatgtgatacattttt

SEQ ID NO: 4872058 - DNA, 18 bp, Homo sapiens
tatactgtggcctgcagg

SEQ ID NO: 4872059 - DNA, 21 bp, Homo sapiens
tatacttccttacttttaagg

SEQ ID NO: 4872060 - DNA, 19 bp, Homo sapiens
tatactttagtagacattt

SEQ ID NO: 4872061 - DNA, 20 bp, Homo sapiens
tatagacggtgctcactccc

SEQ ID NO: 4872062 - DNA, 23 bp, Homo sapiens
tatagacttggagaatactgcca

SEQ ID NO: 4872063 - DNA, 16 bp, Homo sapiens
tatagcatgaaataaa

SEQ ID NO: 4872064 - DNA, 19 bp, Homo sapiens
tatagtctaagactatata

SEQ ID NO: 4872065 - DNA, 16 bp, Homo sapiens
tatataaactgggatg

SEQ ID NO: 4872066 - DNA, 14 bp, Homo sapiens
tatataatgtatat

SEQ ID NO: 4872067 - DNA, 14 bp, Homo sapiens
tatatatataaatg

SEQ ID NO: 4872068 - DNA, 16 bp, Homo sapiens
tatatatataaatgta

SEQ ID NO: 4872069 - DNA, 16 bp, Homo sapiens
tatatatgtatttcta

SEQ ID NO: 4872070 - DNA, 16 bp, Homo sapiens
tatatattttgtgtga

SEQ ID NO: 4872071 - DNA, 12 bp, Homo sapiens
tatatgactgca

SEQ ID NO: 4872072 - DNA, 18 bp, Homo sapiens
tatatgctttattaatgt

SEQ ID NO: 4872073 - DNA, 21 bp, Homo sapiens
tatatgtattttttgaatcta

SEQ ID NO: 4872074 - DNA, 13 bp, Homo sapiens
tatattaaaattc

SEQ ID NO: 4872075 - DNA, 13 bp, Homo sapiens
tatattaaacaaa

SEQ ID NO: 4872076 - DNA, 17 bp, Homo sapiens
tatattacccaatggaa

SEQ ID NO: 4872077 - DNA, 16 bp, Homo sapiens
tatattactgacattt

SEQ ID NO: 4872078 - DNA, 19 bp, Homo sapiens
tatattcattctttttgaa

SEQ ID NO: 4872079 - DNA, 12 bp, Homo sapiens
tatatttattga

SEQ ID NO: 4872080 - DNA, 13 bp, Homo sapiens
tatattttaagaa

SEQ ID NO: 4872081 - DNA, 18 bp, Homo sapiens
tatattttgtgtgaaatt

SEQ ID NO: 4872082 - DNA, 17 bp, Homo sapiens
tatatttttttaactgt

SEQ ID NO: 4872083 - DNA, 18 bp, Homo sapiens
tatatttttttaactgtg

SEQ ID NO: 4872084 - DNA, 20 bp, Homo sapiens
tatatttttttaactgtgat

SEQ ID NO: 4872085 - DNA, 21 bp, Homo sapiens
tatatttttttaactgtgata

SEQ ID NO: 4872086 - DNA, 12 bp, Homo sapiens
tatcaaagtcat

SEQ ID NO: 4872087 - DNA, 14 bp, Homo sapiens
tatcagcaaagaaa

SEQ ID NO: 4872088 - DNA, 23 bp, Homo sapiens
tatcagtaatgctaaatgtgtaa

SEQ ID NO: 4872089 - DNA, 15 bp, Homo sapiens
tatccacactgtcaa

SEQ ID NO: 4872090 - DNA, 18 bp, Homo sapiens
tatcccttggacatttta

SEQ ID NO: 4872091 - DNA, 18 bp, Homo sapiens
tatcgtttttgtattttc

SEQ ID NO: 4872092 - DNA, 20 bp, Homo sapiens
tatcgtttttgtattttcat

SEQ ID NO: 4872093 - DNA, 17 bp, Homo sapiens
tatctgaaaggccagca

SEQ ID NO: 4872094 - DNA, 18 bp, Homo sapiens
tatctgaaaggccagcag

SEQ ID NO: 4872095 - DNA, 20 bp, Homo sapiens
tatctgaaaggccagcagct

SEQ ID NO: 4872096 - DNA, 15 bp, Homo sapiens
tatctttgaatatgt

SEQ ID NO: 4872097 - DNA, 14 bp, Homo sapiens
tatgaaaatggaaa

SEQ ID NO: 4872098 - DNA, 20 bp, Homo sapiens
tatgagattggttttcctgt

SEQ ID NO: 4872099 - DNA, 10 bp, Homo sapiens
tatgatgaca

SEQ ID NO: 4872100 - DNA, 16 bp, Homo sapiens
tatgcaattcagtgtt

SEQ ID NO: 4872101 - DNA, 17 bp, Homo sapiens
tatgcattattaaattg

SEQ ID NO: 4872102 - DNA, 19 bp, Homo sapiens
tatgccccaccaaggctga

SEQ ID NO: 4872103 - DNA, 13 bp, Homo sapiens
tatggaagaaagt

SEQ ID NO: 4872104 - DNA, 14 bp, Homo sapiens
tatggaagaaagta

SEQ ID NO: 4872105 - DNA, 17 bp, Homo sapiens
tatggcatgactcttca

SEQ ID NO: 4872106 - DNA, 15 bp, Homo sapiens
tatgtaaataactct

SEQ ID NO: 4872107 - DNA, 19 bp, Homo sapiens
tatgtagtatctatatgac

SEQ ID NO: 4872108 - DNA, 18 bp, Homo sapiens
tatgtatattaaaaaaga

SEQ ID NO: 4872109 - DNA, 21 bp, Homo sapiens
tatgtgggatattgaatgtta

SEQ ID NO: 4872110 - DNA, 13 bp, Homo sapiens
tatgttaatattt

SEQ ID NO: 4872111 - DNA, 16 bp, Homo sapiens
tatgttggtgtgaatt

SEQ ID NO: 4872112 - DNA, 20 bp, Homo sapiens
tatgttgtttataataaaaa

SEQ ID NO: 4872113 - DNA, 15 bp, Homo sapiens
tattaaaaaacttca

SEQ ID NO: 4872114 - DNA, 15 bp, Homo sapiens
tattaaaaaagtcta

SEQ ID NO: 4872115 - DNA, 14 bp, Homo sapiens
tattaaaactaaat

SEQ ID NO: 4872116 - DNA, 14 bp, Homo sapiens
tattaaaattccaa

SEQ ID NO: 4872117 - DNA, 18 bp, Homo sapiens
tattaaacaaagtttcag

SEQ ID NO: 4872118 - DNA, 22 bp, Homo sapiens
tattaatattcagggtaaatag

SEQ ID NO: 4872119 - DNA, 16 bp, Homo sapiens
tattactgacatttct

SEQ ID NO: 4872120 - DNA, 19 bp, Homo sapiens
tattaggaagtgtttatgt

SEQ ID NO: 4872121 - DNA, 18 bp, Homo sapiens
tattataaaggataaaga

SEQ ID NO: 4872122 - DNA, 19 bp, Homo sapiens
tattatacatgtgatacat

SEQ ID NO: 4872123 - DNA, 13 bp, Homo sapiens
tattatatacata

SEQ ID NO: 4872124 - DNA, 21 bp, Homo sapiens
tattatcttgttcaggaaaag

SEQ ID NO: 4872125 - DNA, 18 bp, Homo sapiens
tattatgtaggtaagact

SEQ ID NO: 4872126 - DNA, 20 bp, Homo sapiens
tattatttttttaaaatttt

SEQ ID NO: 4872127 - DNA, 16 bp, Homo sapiens
tattcatctaatgtat

SEQ ID NO: 4872128 - DNA, 23 bp, Homo sapiens
tattcattctttttgaaatgtca

SEQ ID NO: 4872129 - DNA, 15 bp, Homo sapiens
tattccccagtgact

SEQ ID NO: 4872130 - DNA, 17 bp, Homo sapiens
tattccccagtgactcc

SEQ ID NO: 4872131 - DNA, 20 bp, Homo sapiens
tattccccagtgactccagg

SEQ ID NO: 4872132 - DNA, 19 bp, Homo sapiens
tattccgatacaaagtgtt

SEQ ID NO: 4872133 - DNA, 12 bp, Homo sapiens
tattctccagac

SEQ ID NO: 4872134 - DNA, 13 bp, Homo sapiens
tattcttttctca

SEQ ID NO: 4872135 - DNA, 14 bp, Homo sapiens
tattgaatgttaaa

SEQ ID NO: 4872136 - DNA, 15 bp, Homo sapiens
tattgacttgtatat

SEQ ID NO: 4872137 - DNA, 18 bp, Homo sapiens
tattgattgggaaaacat

SEQ ID NO: 4872138 - DNA, 22 bp, Homo sapiens
tattgattgggaaaacatttgc

SEQ ID NO: 4872139 - DNA, 17 bp, Homo sapiens
tattgcacattgtaaaa

SEQ ID NO: 4872140 - DNA, 19 bp, Homo sapiens
tattgctgtgagccttgca

SEQ ID NO: 4872141 - DNA, 16 bp, Homo sapiens
tattggtgttgcagcc

SEQ ID NO: 4872142 - DNA, 22 bp, Homo sapiens
tattgtgtggtctggttcctgt

SEQ ID NO: 4872143 - DNA, 13 bp, Homo sapiens
tatttaatttgaa

SEQ ID NO: 4872144 - DNA, 17 bp, Homo sapiens
tatttacagctgtgctc

SEQ ID NO: 4872145 - DNA, 22 bp, Homo sapiens
tatttacagctgtgctccacac

SEQ ID NO: 4872146 - DNA, 19 bp, Homo sapiens
tatttatgcactgtgggat

SEQ ID NO: 4872147 - DNA, 16 bp, Homo sapiens
tatttattgaaatgat

SEQ ID NO: 4872148 - DNA, 20 bp, Homo sapiens
tatttattgaaatgatttca

SEQ ID NO: 4872149 - DNA, 23 bp, Homo sapiens
tatttattgagtacctactgtgt

SEQ ID NO: 4872150 - DNA, 14 bp, Homo sapiens
tatttgattattta

SEQ ID NO: 4872151 - DNA, 18 bp, Homo sapiens
tatttgtataaaagtgtg

SEQ ID NO: 4872152 - DNA, 22 bp, Homo sapiens
tatttgtataaaagtgtgaaat

SEQ ID NO: 4872153 - DNA, 15 bp, Homo sapiens
tattttaaaatttca

SEQ ID NO: 4872154 - DNA, 12 bp, Homo sapiens
tattttagaaat

SEQ ID NO: 4872155 - DNA, 22 bp, Homo sapiens
tattttaggtgtaaaataatta

SEQ ID NO: 4872156 - DNA, 15 bp, Homo sapiens
tattttctaaagact

SEQ ID NO: 4872157 - DNA, 18 bp, Homo sapiens
tattttctcaatctcctc

SEQ ID NO: 4872158 - DNA, 19 bp, Homo sapiens
tattttgggcctgttcctt

SEQ ID NO: 4872159 - DNA, 17 bp, Homo sapiens
tattttgtgtgaaattg

SEQ ID NO: 4872160 - DNA, 13 bp, Homo sapiens
tattttttaagaa

SEQ ID NO: 4872161 - DNA, 19 bp, Homo sapiens
tattttttcttttctttac

SEQ ID NO: 4872162 - DNA, 19 bp, Homo sapiens
tattttttgaatctatgaa

SEQ ID NO: 4872163 - DNA, 16 bp, Homo sapiens
tatttttttaaaattt

SEQ ID NO: 4872164 - DNA, 17 bp, Homo sapiens
tatttttttaactgtga

SEQ ID NO: 4872165 - DNA, 19 bp, Homo sapiens
tatttttttaactgtgata

SEQ ID NO: 4872166 - DNA, 14 bp, Homo sapiens
tcaaaaagaaatca

SEQ ID NO: 4872167 - DNA, 14 bp, Homo sapiens
tcaaaaagccacag

SEQ ID NO: 4872168 - DNA, 13 bp, Homo sapiens
tcaaagcagcagg

SEQ ID NO: 4872169 - DNA, 18 bp, Homo sapiens
tcaaagtcattaaagaca

SEQ ID NO: 4872170 - DNA, 21 bp, Homo sapiens
tcaaagtctgctctcatataa

SEQ ID NO: 4872171 - DNA, 13 bp, Homo sapiens
tcaaagtgcctgg

SEQ ID NO: 4872172 - DNA, 13 bp, Homo sapiens
tcaaagttttgtt

SEQ ID NO: 4872173 - DNA, 13 bp, Homo sapiens
tcaaataagaaat

SEQ ID NO: 4872174 - DNA, 20 bp, Homo sapiens
tcaaataggctattaaaaaa

SEQ ID NO: 4872175 - DNA, 13 bp, Homo sapiens
tcaaatgaaatgt

SEQ ID NO: 4872176 - DNA, 14 bp, Homo sapiens
tcaaatgaaatgta

SEQ ID NO: 4872177 - DNA, 20 bp, Homo sapiens
tcaaatgaaatgtatgcatt

SEQ ID NO: 4872178 - DNA, 12 bp, Homo sapiens
tcaaattctgtc

SEQ ID NO: 4872179 - DNA, 20 bp, Homo sapiens
tcaacaaagaaacaaagatg

SEQ ID NO: 4872180 - DNA, 20 bp, Homo sapiens
tcaacagaacatatgttgca

SEQ ID NO: 4872181 - DNA, 12 bp, Homo sapiens
tcaacagccaag

SEQ ID NO: 4872182 - DNA, 16 bp, Homo sapiens
tcaacagccaagctgg

SEQ ID NO: 4872183 - DNA, 14 bp, Homo sapiens
tcaactctacccct

SEQ ID NO: 4872184 - DNA, 23 bp, Homo sapiens
tcaactctacccctgctcccatt

SEQ ID NO: 4872185 - DNA, 13 bp, Homo sapiens
tcaactttgtaaa

SEQ ID NO: 4872186 - DNA, 15 bp, Homo sapiens
tcaagcattctgttt

SEQ ID NO: 4872187 - DNA, 16 bp, Homo sapiens
tcaagcattctgttta

SEQ ID NO: 4872188 - DNA, 17 bp, Homo sapiens
tcaaggctcttcttcct

SEQ ID NO: 4872189 - DNA, 15 bp, Homo sapiens
tcaagggctgtcatt

SEQ ID NO: 4872190 - DNA, 15 bp, Homo sapiens
tcaagtcactcccaa

SEQ ID NO: 4872191 - DNA, 15 bp, Homo sapiens
tcaagttttaaagtt

SEQ ID NO: 4872192 - DNA, 17 bp, Homo sapiens
tcaagttttaaagttca

SEQ ID NO: 4872193 - DNA, 19 bp, Homo sapiens
tcaatctggattcatattt

SEQ ID NO: 4872194 - DNA, 16 bp, Homo sapiens
tcaatgaaccataaat

SEQ ID NO: 4872195 - DNA, 14 bp, Homo sapiens
tcaatgagagcata

SEQ ID NO: 4872196 - DNA, 22 bp, Homo sapiens
tcaatttctagtacctgtgact

SEQ ID NO: 4872197 - DNA, 14 bp, Homo sapiens
tcacacccctgccc

SEQ ID NO: 4872198 - DNA, 19 bp, Homo sapiens
tcacacgaggggccccgtg

SEQ ID NO: 4872199 - DNA, 16 bp, Homo sapiens
tcacagggaatggcca

SEQ ID NO: 4872200 - DNA, 20 bp, Homo sapiens
tcacatctatccacactgtc

SEQ ID NO: 4872201 - DNA, 19 bp, Homo sapiens
tcacatttagaaaagtgaa

SEQ ID NO: 4872202 - DNA, 20 bp, Homo sapiens
tcaccagccccccgcgcgcc

SEQ ID NO: 4872203 - DNA, 18 bp, Homo sapiens
tcaccatgtgagctcttc

SEQ ID NO: 4872204 - DNA, 14 bp, Homo sapiens
tcacccatcctagg

SEQ ID NO: 4872205 - DNA, 17 bp, Homo sapiens
tcacccatcctaggaac

SEQ ID NO: 4872206 - DNA, 23 bp, Homo sapiens
tcacccattccgggttcactccc

SEQ ID NO: 4872207 - DNA, 17 bp, Homo sapiens
tcaccgagcatgcttcc

SEQ ID NO: 4872208 - DNA, 12 bp, Homo sapiens
tcacctccttct

SEQ ID NO: 4872209 - DNA, 13 bp, Homo sapiens
tcacctccttctg

SEQ ID NO: 4872210 - DNA, 15 bp, Homo sapiens
tcacctccttctgca

SEQ ID NO: 4872211 - DNA, 17 bp, Homo sapiens
tcaccttttcaggaaaa

SEQ ID NO: 4872212 - DNA, 20 bp, Homo sapiens
tcactactgaacacatgtgt

SEQ ID NO: 4872213 - DNA, 19 bp, Homo sapiens
tcactcccaagggacagca

SEQ ID NO: 4872214 - DNA, 14 bp, Homo sapiens
tcactgccccctcc

SEQ ID NO: 4872215 - DNA, 16 bp, Homo sapiens
tcactgcctctttgca

SEQ ID NO: 4872216 - DNA, 15 bp, Homo sapiens
tcactgtactgcatg

SEQ ID NO: 4872217 - DNA, 21 bp, Homo sapiens
tcactgtactgcatgtgactt

SEQ ID NO: 4872218 - DNA, 12 bp, Homo sapiens
tcactttcataa

SEQ ID NO: 4872219 - DNA, 15 bp, Homo sapiens
tcacttttccttttc

SEQ ID NO: 4872220 - DNA, 16 bp, Homo sapiens
tcacttttccttttct

SEQ ID NO: 4872221 - DNA, 16 bp, Homo sapiens
tcagaaaattccctgg

SEQ ID NO: 4872222 - DNA, 22 bp, Homo sapiens
tcagaaacgagatcgggaagca

SEQ ID NO: 4872223 - DNA, 13 bp, Homo sapiens
tcagaaatataac

SEQ ID NO: 4872224 - DNA, 20 bp, Homo sapiens
tcagaaatataacacatttt

SEQ ID NO: 4872225 - DNA, 17 bp, Homo sapiens
tcagaagaatcttcctg

SEQ ID NO: 4872226 - DNA, 15 bp, Homo sapiens
tcagaagcctccaag

SEQ ID NO: 4872227 - DNA, 23 bp, Homo sapiens
tcagaagcctccaagcctgcctc

SEQ ID NO: 4872228 - DNA, 17 bp, Homo sapiens
tcagaaggatgcccaga

SEQ ID NO: 4872229 - DNA, 13 bp, Homo sapiens
tcagacagcagga

SEQ ID NO: 4872230 - DNA, 13 bp, Homo sapiens
tcagacccctgcc

SEQ ID NO: 4872231 - DNA, 16 bp, Homo sapiens
tcagacccctgcctgg

SEQ ID NO: 4872232 - DNA, 15 bp, Homo sapiens
tcagcaaagaaaaaa

SEQ ID NO: 4872233 - DNA, 23 bp, Homo sapiens
tcagcaacccttcctgctgctgc

SEQ ID NO: 4872234 - DNA, 20 bp, Homo sapiens
tcagcacttaactatgagcc

SEQ ID NO: 4872235 - DNA, 14 bp, Homo sapiens
tcagcatccagtgt

SEQ ID NO: 4872236 - DNA, 16 bp, Homo sapiens
tcagccaaatgcaggg

SEQ ID NO: 4872237 - DNA, 22 bp, Homo sapiens
tcagccaggtctgactccaaag

SEQ ID NO: 4872238 - DNA, 14 bp, Homo sapiens
tcagctctctggga

SEQ ID NO: 4872239 - DNA, 18 bp, Homo sapiens
tcagctgctgttgaactt

SEQ ID NO: 4872240 - DNA, 22 bp, Homo sapiens
tcagctgctgttgaacttttta

SEQ ID NO: 4872241 - DNA, 22 bp, Homo sapiens
tcaggacccatccctgcctgga

SEQ ID NO: 4872242 - DNA, 16 bp, Homo sapiens
tcaggactctctccag

SEQ ID NO: 4872243 - DNA, 16 bp, Homo sapiens
tcaggacttgaaagaa

SEQ ID NO: 4872244 - DNA, 13 bp, Homo sapiens
tcaggagaagcca

SEQ ID NO: 4872245 - DNA, 17 bp, Homo sapiens
tcaggagaagccagtgt

SEQ ID NO: 4872246 - DNA, 10 bp, Homo sapiens
tcaggagatg

SEQ ID NO: 4872247 - DNA, 14 bp, Homo sapiens
tcaggagatgggga

SEQ ID NO: 4872248 - DNA, 13 bp, Homo sapiens
tcaggagcctggc

SEQ ID NO: 4872249 - DNA, 18 bp, Homo sapiens
tcaggagcctggccaggc

SEQ ID NO: 4872250 - DNA, 20 bp, Homo sapiens
tcaggagcctggccaggcag

SEQ ID NO: 4872251 - DNA, 16 bp, Homo sapiens
tcaggcaaagaaaatg

SEQ ID NO: 4872252 - DNA, 16 bp, Homo sapiens
tcaggcagctgaaatt

SEQ ID NO: 4872253 - DNA, 20 bp, Homo sapiens
tcaggcattggatatttttt

SEQ ID NO: 4872254 - DNA, 11 bp, Homo sapiens
tcaggctccta

SEQ ID NO: 4872255 - DNA, 16 bp, Homo sapiens
tcagggatggagggaa

SEQ ID NO: 4872256 - DNA, 22 bp, Homo sapiens
tcagggatggagggaagacctg

SEQ ID NO: 4872257 - DNA, 13 bp, Homo sapiens
tcaggggggagaa

SEQ ID NO: 4872258 - DNA, 17 bp, Homo sapiens
tcagggtaaataggaat

SEQ ID NO: 4872259 - DNA, 17 bp, Homo sapiens
tcagtagcatctcagtg

SEQ ID NO: 4872260 - DNA, 15 bp, Homo sapiens
tcagtggggcagcct

SEQ ID NO: 4872261 - DNA, 17 bp, Homo sapiens
tcagttctcaaatgtgt

SEQ ID NO: 4872262 - DNA, 15 bp, Homo sapiens
tcagttgcttgtctt

SEQ ID NO: 4872263 - DNA, 13 bp, Homo sapiens
tcagttgtgtttt

SEQ ID NO: 4872264 - DNA, 14 bp, Homo sapiens
tcagttgtgttttt

SEQ ID NO: 4872265 - DNA, 19 bp, Homo sapiens
tcagtttgttggaaagtaa

SEQ ID NO: 4872266 - DNA, 20 bp, Homo sapiens
tcataggttaaaaaaaaaag

SEQ ID NO: 4872267 - DNA, 19 bp, Homo sapiens
tcatatttgggggctaagg

SEQ ID NO: 4872268 - DNA, 15 bp, Homo sapiens
tcatcactggactgc

SEQ ID NO: 4872269 - DNA, 16 bp, Homo sapiens
tcatcactggactgca

SEQ ID NO: 4872270 - DNA, 18 bp, Homo sapiens
tcatcactggactgcatg

SEQ ID NO: 4872271 - DNA, 21 bp, Homo sapiens
tcatcactttgacctaaatta

SEQ ID NO: 4872272 - DNA, 19 bp, Homo sapiens
tcatcattcttgtgggaga

SEQ ID NO: 4872273 - DNA, 15 bp, Homo sapiens
tcatccatcctgagc

SEQ ID NO: 4872274 - DNA, 15 bp, Homo sapiens
tcatccttccatcca

SEQ ID NO: 4872275 - DNA, 22 bp, Homo sapiens
tcatctaatgtattatgagcca

SEQ ID NO: 4872276 - DNA, 12 bp, Homo sapiens
tcatgaaaatac

SEQ ID NO: 4872277 - DNA, 14 bp, Homo sapiens
tcatgaatgtgctg

SEQ ID NO: 4872278 - DNA, 20 bp, Homo sapiens
tcatgaatgtgctggtgaac

SEQ ID NO: 4872279 - DNA, 12 bp, Homo sapiens
tcatgaatttta

SEQ ID NO: 4872280 - DNA, 16 bp, Homo sapiens
tcatgaattttaaagt

SEQ ID NO: 4872281 - DNA, 18 bp, Homo sapiens
tcatgaattttaaagtat

SEQ ID NO: 4872282 - DNA, 23 bp, Homo sapiens
tcatgattagaaattacctgtgg

SEQ ID NO: 4872283 - DNA, 14 bp, Homo sapiens
tcatgctgctcccc

SEQ ID NO: 4872284 - DNA, 16 bp, Homo sapiens
tcatggctgctgttgc

SEQ ID NO: 4872285 - DNA, 21 bp, Homo sapiens
tcatgtccaaacgtcctcttt

SEQ ID NO: 4872286 - DNA, 17 bp, Homo sapiens
tcatgtgaccactctgt

SEQ ID NO: 4872287 - DNA, 16 bp, Homo sapiens
tcatgtgagtctggga

SEQ ID NO: 4872288 - DNA, 17 bp, Homo sapiens
tcatgtttttgttttaa

SEQ ID NO: 4872289 - DNA, 16 bp, Homo sapiens
tcattaccctacagac

SEQ ID NO: 4872290 - DNA, 23 bp, Homo sapiens
tcattagttttgaagattctatg

SEQ ID NO: 4872291 - DNA, 13 bp, Homo sapiens
tcattcagaaatg

SEQ ID NO: 4872292 - DNA, 20 bp, Homo sapiens
tcattcttactaaaaagtat

SEQ ID NO: 4872293 - DNA, 12 bp, Homo sapiens
tcattgactttt

SEQ ID NO: 4872294 - DNA, 16 bp, Homo sapiens
tcattgacttttataa

SEQ ID NO: 4872295 - DNA, 17 bp, Homo sapiens
tcattgcacataagctt

SEQ ID NO: 4872296 - DNA, 13 bp, Homo sapiens
tcattgcttacaa

SEQ ID NO: 4872297 - DNA, 16 bp, Homo sapiens
tcatttgtatgtcaaa

SEQ ID NO: 4872298 - DNA, 17 bp, Homo sapiens
tcattttatttacagct

SEQ ID NO: 4872299 - DNA, 23 bp, Homo sapiens
tcattttatttacagctgtgctc

SEQ ID NO: 4872300 - DNA, 17 bp, Homo sapiens
tccaaaggaactctaga

SEQ ID NO: 4872301 - DNA, 18 bp, Homo sapiens
tccaaaggaactctagag

SEQ ID NO: 4872302 - DNA, 19 bp, Homo sapiens
tccaaattcaccttcccct

SEQ ID NO: 4872303 - DNA, 19 bp, Homo sapiens
tccaacatatatttattga

SEQ ID NO: 4872304 - DNA, 19 bp, Homo sapiens
tccaagcctgcctcccaag

SEQ ID NO: 4872305 - DNA, 17 bp, Homo sapiens
tccaagtctctgtgtaa

SEQ ID NO: 4872306 - DNA, 12 bp, Homo sapiens
tccacactcaga

SEQ ID NO: 4872307 - DNA, 16 bp, Homo sapiens
tccaccataccttaga

SEQ ID NO: 4872308 - DNA, 10 bp, Homo sapiens
tccacccaca

SEQ ID NO: 4872309 - DNA, 11 bp, Homo sapiens
tccacccacaa

SEQ ID NO: 4872310 - DNA, 20 bp, Homo sapiens
tccacccacaaactccaggc

SEQ ID NO: 4872311 - DNA, 21 bp, Homo sapiens
tccacccacaaactccaggct

SEQ ID NO: 4872312 - DNA, 16 bp, Homo sapiens
tccacctcatcactgg

SEQ ID NO: 4872313 - DNA, 17 bp, Homo sapiens
tccacctcatcactgga

SEQ ID NO: 4872314 - DNA, 23 bp, Homo sapiens
tccaccttggctgggaagactat

SEQ ID NO: 4872315 - DNA, 14 bp, Homo sapiens
tccactggaccctt

SEQ ID NO: 4872316 - DNA, 13 bp, Homo sapiens
tccagaagctgct

SEQ ID NO: 4872317 - DNA, 14 bp, Homo sapiens
tccagaagctgctc

SEQ ID NO: 4872318 - DNA, 15 bp, Homo sapiens
tccagatagtgtagc

SEQ ID NO: 4872319 - DNA, 22 bp, Homo sapiens
tccagatagtgtagctgaggag

SEQ ID NO: 4872320 - DNA, 17 bp, Homo sapiens
tccagatctttcagaaa

SEQ ID NO: 4872321 - DNA, 12 bp, Homo sapiens
tccagccacccc

SEQ ID NO: 4872322 - DNA, 18 bp, Homo sapiens
tccagccacccccaggca

SEQ ID NO: 4872323 - DNA, 16 bp, Homo sapiens
tccagcccaaacctgg

SEQ ID NO: 4872324 - DNA, 17 bp, Homo sapiens
tccagcccaaacctggg

SEQ ID NO: 4872325 - DNA, 18 bp, Homo sapiens
tccagcccaaacctggga

SEQ ID NO: 4872326 - DNA, 23 bp, Homo sapiens
tccagcttcggagggcccctgcg

SEQ ID NO: 4872327 - DNA, 10 bp, Homo sapiens
tccaggaagt

SEQ ID NO: 4872328 - DNA, 23 bp, Homo sapiens
tccaggaccttgcttccttctca

SEQ ID NO: 4872329 - DNA, 14 bp, Homo sapiens
tccaggctggaagt

SEQ ID NO: 4872330 - DNA, 18 bp, Homo sapiens
tccagggcagcaggccag

SEQ ID NO: 4872331 - DNA, 23 bp, Homo sapiens
tccagggcagcaggccagagaaa

SEQ ID NO: 4872332 - DNA, 19 bp, Homo sapiens
tccagggtgacaaggcctg

SEQ ID NO: 4872333 - DNA, 14 bp, Homo sapiens
tccagtcagatgag

SEQ ID NO: 4872334 - DNA, 15 bp, Homo sapiens
tccagtcttagctga

SEQ ID NO: 4872335 - DNA, 20 bp, Homo sapiens
tccagtgtgagatactgtgt

SEQ ID NO: 4872336 - DNA, 21 bp, Homo sapiens
tccagttagagtcttcatctg

SEQ ID NO: 4872337 - DNA, 21 bp, Homo sapiens
tccagttgaagttagtggaaa

SEQ ID NO: 4872338 - DNA, 20 bp, Homo sapiens
tccataccccgccaaggaaa

SEQ ID NO: 4872339 - DNA, 14 bp, Homo sapiens
tccatatttattca

SEQ ID NO: 4872340 - DNA, 12 bp, Homo sapiens
tccatccatcct

SEQ ID NO: 4872341 - DNA, 13 bp, Homo sapiens
tccatccatcctt

SEQ ID NO: 4872342 - DNA, 17 bp, Homo sapiens
tccatccatccttccaa

SEQ ID NO: 4872343 - DNA, 12 bp, Homo sapiens
tccatccatctt

SEQ ID NO: 4872344 - DNA, 16 bp, Homo sapiens
tccatccctccattca

SEQ ID NO: 4872345 - DNA, 12 bp, Homo sapiens
tccatcctgagc

SEQ ID NO: 4872346 - DNA, 16 bp, Homo sapiens
tccatcctgagccaaa

SEQ ID NO: 4872347 - DNA, 15 bp, Homo sapiens
tccatcggggcaggg

SEQ ID NO: 4872348 - DNA, 16 bp, Homo sapiens
tccatcgtattaaaaa

SEQ ID NO: 4872349 - DNA, 21 bp, Homo sapiens
tccatgctcctcacctgtcta

SEQ ID NO: 4872350 - DNA, 19 bp, Homo sapiens
tccatggagcctacctctg

SEQ ID NO: 4872351 - DNA, 12 bp, Homo sapiens
tccatgttgact

SEQ ID NO: 4872352 - DNA, 13 bp, Homo sapiens
tccatgttgactg

SEQ ID NO: 4872353 - DNA, 14 bp, Homo sapiens
tccattacctccat

SEQ ID NO: 4872354 - DNA, 16 bp, Homo sapiens
tccattacctccatcc

SEQ ID NO: 4872355 - DNA, 20 bp, Homo sapiens
tccattcctaatcaaattct

SEQ ID NO: 4872356 - DNA, 14 bp, Homo sapiens
tccatttcaggact

SEQ ID NO: 4872357 - DNA, 22 bp, Homo sapiens
tccatttcaggactctctccag

SEQ ID NO: 4872358 - DNA, 22 bp, Homo sapiens
tcccaagctgatggacatgaga

SEQ ID NO: 4872359 - DNA, 20 bp, Homo sapiens
tcccaaggcattctcccagc

SEQ ID NO: 4872360 - DNA, 13 bp, Homo sapiens
tcccaagggacag

SEQ ID NO: 4872361 - DNA, 16 bp, Homo sapiens
tcccaagggacagcaa

SEQ ID NO: 4872362 - DNA, 21 bp, Homo sapiens
tcccaagggacagcaagtgag

SEQ ID NO: 4872363 - DNA, 22 bp, Homo sapiens
tcccaagggacagcaagtgagc

SEQ ID NO: 4872364 - DNA, 16 bp, Homo sapiens
tcccaaggtcctctca

SEQ ID NO: 4872365 - DNA, 17 bp, Homo sapiens
tcccaaggtcctctcag

SEQ ID NO: 4872366 - DNA, 18 bp, Homo sapiens
tcccacagcagccccagg

SEQ ID NO: 4872367 - DNA, 21 bp, Homo sapiens
tcccacagcagccccaggaga

SEQ ID NO: 4872368 - DNA, 22 bp, Homo sapiens
tcccacagcagccccaggagaa

SEQ ID NO: 4872369 - DNA, 22 bp, Homo sapiens
tcccacatggccatcttctttc

SEQ ID NO: 4872370 - DNA, 12 bp, Homo sapiens
tcccacccaccg

SEQ ID NO: 4872371 - DNA, 19 bp, Homo sapiens
tcccacccaccgccacaat

SEQ ID NO: 4872372 - DNA, 17 bp, Homo sapiens
tcccaccccctccttct

SEQ ID NO: 4872373 - DNA, 16 bp, Homo sapiens
tcccactccagctgac

SEQ ID NO: 4872374 - DNA, 21 bp, Homo sapiens
tcccagaacctctaagtgctg

SEQ ID NO: 4872375 - DNA, 22 bp, Homo sapiens
tcccagaacctctaagtgctgc

SEQ ID NO: 4872376 - DNA, 23 bp, Homo sapiens
tcccagaacctctaagtgctgct

SEQ ID NO: 4872377 - DNA, 21 bp, Homo sapiens
tcccagaggtgggatcctccc

SEQ ID NO: 4872378 - DNA, 18 bp, Homo sapiens
tcccagctctagcctctg

SEQ ID NO: 4872379 - DNA, 17 bp, Homo sapiens
tcccaggggagccagct

SEQ ID NO: 4872380 - DNA, 18 bp, Homo sapiens
tcccaggggagccagctg

SEQ ID NO: 4872381 - DNA, 21 bp, Homo sapiens
tcccaggggagccagctgctt

SEQ ID NO: 4872382 - DNA, 17 bp, Homo sapiens
tcccatctgaagagtgg

SEQ ID NO: 4872383 - DNA, 18 bp, Homo sapiens
tcccatgatttggggtga

SEQ ID NO: 4872384 - DNA, 12 bp, Homo sapiens
tcccatggctga

SEQ ID NO: 4872385 - DNA, 22 bp, Homo sapiens
tcccatggctgaagctggagca

SEQ ID NO: 4872386 - DNA, 16 bp, Homo sapiens
tccccagtgactccag

SEQ ID NO: 4872387 - DNA, 19 bp, Homo sapiens
tccccagtgactccagggt

SEQ ID NO: 4872388 - DNA, 17 bp, Homo sapiens
tcccccaccctccatgc

SEQ ID NO: 4872389 - DNA, 15 bp, Homo sapiens
tcccccttcatccat

SEQ ID NO: 4872390 - DNA, 22 bp, Homo sapiens
tcccccttcatccatcctgagc

SEQ ID NO: 4872391 - DNA, 22 bp, Homo sapiens
tcccctaaagccaggctcagga

SEQ ID NO: 4872392 - DNA, 15 bp, Homo sapiens
tcccctcccagggga

SEQ ID NO: 4872393 - DNA, 16 bp, Homo sapiens
tcccctcccaggggag

SEQ ID NO: 4872394 - DNA, 14 bp, Homo sapiens
tcccctcctgctgg

SEQ ID NO: 4872395 - DNA, 15 bp, Homo sapiens
tcccctcctgctggg

SEQ ID NO: 4872396 - DNA, 16 bp, Homo sapiens
tcccctcctgctgggc

SEQ ID NO: 4872397 - DNA, 18 bp, Homo sapiens
tcccctctcatacataaa

SEQ ID NO: 4872398 - DNA, 14 bp, Homo sapiens
tcccctctgtgctt

SEQ ID NO: 4872399 - DNA, 23 bp, Homo sapiens
tcccctctgtgcttcgactactg

SEQ ID NO: 4872400 - DNA, 20 bp, Homo sapiens
tcccctgcccttcctcctga

SEQ ID NO: 4872401 - DNA, 16 bp, Homo sapiens
tcccgccccgcccctc

SEQ ID NO: 4872402 - DNA, 15 bp, Homo sapiens
tcccgccgccccccc

SEQ ID NO: 4872403 - DNA, 16 bp, Homo sapiens
tcccggctcccctccc

SEQ ID NO: 4872404 - DNA, 16 bp, Homo sapiens
tcccgtcttccagaga

SEQ ID NO: 4872405 - DNA, 14 bp, Homo sapiens
tccctaatgtgttt

SEQ ID NO: 4872406 - DNA, 24 bp, Homo sapiens
tccctacatgtattgcacattgta

SEQ ID NO: 4872407 - DNA, 20 bp, Homo sapiens
tccctagggctctccaagca

SEQ ID NO: 4872408 - DNA, 12 bp, Homo sapiens
tccctcacctgt

SEQ ID NO: 4872409 - DNA, 17 bp, Homo sapiens
tccctcagctctctggg

SEQ ID NO: 4872410 - DNA, 18 bp, Homo sapiens
tccctcagctctctggga

SEQ ID NO: 4872411 - DNA, 15 bp, Homo sapiens
tccctgaggactgat

SEQ ID NO: 4872412 - DNA, 21 bp, Homo sapiens
tccctgaggactgatttcaga

SEQ ID NO: 4872413 - DNA, 15 bp, Homo sapiens
tccctgcaaaactcc

SEQ ID NO: 4872414 - DNA, 20 bp, Homo sapiens
tccctgcaaaactccaggca

SEQ ID NO: 4872415 - DNA, 12 bp, Homo sapiens
tccctgcctgga

SEQ ID NO: 4872416 - DNA, 16 bp, Homo sapiens
tccctgcctggaggct

SEQ ID NO: 4872417 - DNA, 17 bp, Homo sapiens
tccctgctccacgtctg

SEQ ID NO: 4872418 - DNA, 21 bp, Homo sapiens
tccctgggggccttgggtgag

SEQ ID NO: 4872419 - DNA, 15 bp, Homo sapiens
tccctgtctcccggc

SEQ ID NO: 4872420 - DNA, 20 bp, Homo sapiens
tcccttaaggggtatcatgt

SEQ ID NO: 4872421 - DNA, 15 bp, Homo sapiens
tcccttgcaggggtc

SEQ ID NO: 4872422 - DNA, 16 bp, Homo sapiens
tcccttggacatttta

SEQ ID NO: 4872423 - DNA, 19 bp, Homo sapiens
tcccttggacattttatgt

SEQ ID NO: 4872424 - DNA, 20 bp, Homo sapiens
tccctttttcataaattatt

SEQ ID NO: 4872425 - DNA, 22 bp, Homo sapiens
tccgcagttgtagcagaaacca

SEQ ID NO: 4872426 - DNA, 19 bp, Homo sapiens
tccgggcaccaggggccaa

SEQ ID NO: 4872427 - DNA, 14 bp, Homo sapiens
tccggggagaaacc

SEQ ID NO: 4872428 - DNA, 17 bp, Homo sapiens
tccgtacttgggtcaca

SEQ ID NO: 4872429 - DNA, 17 bp, Homo sapiens
tcctaaaagttctcaat

SEQ ID NO: 4872430 - DNA, 20 bp, Homo sapiens
tcctaagatgtgttcttatt

SEQ ID NO: 4872431 - DNA, 17 bp, Homo sapiens
tcctagactgctcctgg

SEQ ID NO: 4872432 - DNA, 20 bp, Homo sapiens
tcctagactgctcctgggca

SEQ ID NO: 4872433 - DNA, 18 bp, Homo sapiens
tcctaggaaccagccaac

SEQ ID NO: 4872434 - DNA, 19 bp, Homo sapiens
tcctataaagtgcctcgga

SEQ ID NO: 4872435 - DNA, 21 bp, Homo sapiens
tcctataaagtgcctcggaca

SEQ ID NO: 4872436 - DNA, 18 bp, Homo sapiens
tcctatatcctccttctc

SEQ ID NO: 4872437 - DNA, 17 bp, Homo sapiens
tcctatttttgtgaaga

SEQ ID NO: 4872438 - DNA, 17 bp, Homo sapiens
tcctcacctgtctaggt

SEQ ID NO: 4872439 - DNA, 20 bp, Homo sapiens
tcctcatgtcttctcacaag

SEQ ID NO: 4872440 - DNA, 17 bp, Homo sapiens
tcctccacccataataa

SEQ ID NO: 4872441 - DNA, 13 bp, Homo sapiens
tcctccagccctg

SEQ ID NO: 4872442 - DNA, 16 bp, Homo sapiens
tcctcccgccccgccc

SEQ ID NO: 4872443 - DNA, 19 bp, Homo sapiens
tcctcccgccccgcccctc

SEQ ID NO: 4872444 - DNA, 20 bp, Homo sapiens
tcctccctcatggctctggc

SEQ ID NO: 4872445 - DNA, 14 bp, Homo sapiens
tcctcctacttaca

SEQ ID NO: 4872446 - DNA, 18 bp, Homo sapiens
tcctcctgatggagtgtg

SEQ ID NO: 4872447 - DNA, 18 bp, Homo sapiens
tcctctcggctgccaggg

SEQ ID NO: 4872448 - DNA, 19 bp, Homo sapiens
tcctctctctttcctccac

SEQ ID NO: 4872449 - DNA, 16 bp, Homo sapiens
tcctctcttgggtagg

SEQ ID NO: 4872450 - DNA, 13 bp, Homo sapiens
tcctctgcaagct

SEQ ID NO: 4872451 - DNA, 16 bp, Homo sapiens
tcctcttgttcctgaa

SEQ ID NO: 4872452 - DNA, 18 bp, Homo sapiens
tcctcttgttcctgaaat

SEQ ID NO: 4872453 - DNA, 19 bp, Homo sapiens
tcctcttgttcctgaaatg

SEQ ID NO: 4872454 - DNA, 15 bp, Homo sapiens
tcctgaaatgtgttt

SEQ ID NO: 4872455 - DNA, 16 bp, Homo sapiens
tcctgataccattcta

SEQ ID NO: 4872456 - DNA, 21 bp, Homo sapiens
tcctgatggagtgtgcagaca

SEQ ID NO: 4872457 - DNA, 20 bp, Homo sapiens
tcctgcaaaaggaggtgaaa

SEQ ID NO: 4872458 - DNA, 11 bp, Homo sapiens
tcctgcatgtt

SEQ ID NO: 4872459 - DNA, 18 bp, Homo sapiens
tcctgccctctgctctgc

SEQ ID NO: 4872460 - DNA, 22 bp, Homo sapiens
tcctgctcaactctacccctgc

SEQ ID NO: 4872461 - DNA, 18 bp, Homo sapiens
tcctgggcattagcaagg

SEQ ID NO: 4872462 - DNA, 19 bp, Homo sapiens
tcctgtctaacttggggaa

SEQ ID NO: 4872463 - DNA, 18 bp, Homo sapiens
tcctgtcttctttctcca

SEQ ID NO: 4872464 - DNA, 23 bp, Homo sapiens
tcctgtcttctttctccatggag

SEQ ID NO: 4872465 - DNA, 22 bp, Homo sapiens
tcctgtggaaggcagagaaatc

SEQ ID NO: 4872466 - DNA, 14 bp, Homo sapiens
tcctgtggcaggag

SEQ ID NO: 4872467 - DNA, 20 bp, Homo sapiens
tcctgtgtgaccctgggcag

SEQ ID NO: 4872468 - DNA, 17 bp, Homo sapiens
tccttaagctgcagaga

SEQ ID NO: 4872469 - DNA, 20 bp, Homo sapiens
tccttaagctgcagagattt

SEQ ID NO: 4872470 - DNA, 15 bp, Homo sapiens
tccttagccctgtct

SEQ ID NO: 4872471 - DNA, 22 bp, Homo sapiens
tccttaggtttttttccttctg

SEQ ID NO: 4872472 - DNA, 18 bp, Homo sapiens
tccttatagacacttgct

SEQ ID NO: 4872473 - DNA, 16 bp, Homo sapiens
tccttcaggcagctga

SEQ ID NO: 4872474 - DNA, 13 bp, Homo sapiens
tccttccatccat

SEQ ID NO: 4872475 - DNA, 16 bp, Homo sapiens
tccttgagtgtatgag

SEQ ID NO: 4872476 - DNA, 19 bp, Homo sapiens
tcgactactgctcctgtgg

SEQ ID NO: 4872477 - DNA, 16 bp, Homo sapiens
tcgagtgtagctgtga

SEQ ID NO: 4872478 - DNA, 17 bp, Homo sapiens
tcgagtgtagctgtgaa

SEQ ID NO: 4872479 - DNA, 14 bp, Homo sapiens
tcgcagaccagagc

SEQ ID NO: 4872480 - DNA, 19 bp, Homo sapiens
tcgcagaccagagctgtct

SEQ ID NO: 4872481 - DNA, 21 bp, Homo sapiens
tcgcagaccagagctgtctga

SEQ ID NO: 4872482 - DNA, 21 bp, Homo sapiens
tcgccagtcactgctgcaagg

SEQ ID NO: 4872483 - DNA, 22 bp, Homo sapiens
tcgccagtcactgctgcaaggt

SEQ ID NO: 4872484 - DNA, 23 bp, Homo sapiens
tcgccagtcactgctgcaaggtg

SEQ ID NO: 4872485 - DNA, 12 bp, Homo sapiens
tcggaaacactg

SEQ ID NO: 4872486 - DNA, 23 bp, Homo sapiens
tcggctgccaggggctctgtggc

SEQ ID NO: 4872487 - DNA, 11 bp, Homo sapiens
tcgtttttgta

SEQ ID NO: 4872488 - DNA, 20 bp, Homo sapiens
tcgtttttgtattttcatga

SEQ ID NO: 4872489 - DNA, 17 bp, Homo sapiens
tctaaaaggtaatgtgt

SEQ ID NO: 4872490 - DNA, 18 bp, Homo sapiens
tctaaaattataaatgac

SEQ ID NO: 4872491 - DNA, 23 bp, Homo sapiens
tctaagactatatatataaatgt

SEQ ID NO: 4872492 - DNA, 19 bp, Homo sapiens
tctaagtgctgctgtggag

SEQ ID NO: 4872493 - DNA, 14 bp, Homo sapiens
tctaattctgattc

SEQ ID NO: 4872494 - DNA, 14 bp, Homo sapiens
tctacaatctcttt

SEQ ID NO: 4872495 - DNA, 14 bp, Homo sapiens
tctaccaatacaaa

SEQ ID NO: 4872496 - DNA, 18 bp, Homo sapiens
tctaccggagagagaatg

SEQ ID NO: 4872497 - DNA, 16 bp, Homo sapiens
tctacctgaggccagg

SEQ ID NO: 4872498 - DNA, 22 bp, Homo sapiens
tctagaatcacagctcaagcat

SEQ ID NO: 4872499 - DNA, 14 bp, Homo sapiens
tctagatgattttt

SEQ ID NO: 4872500 - DNA, 21 bp, Homo sapiens
tctagcccaacctacattcca

SEQ ID NO: 4872501 - DNA, 13 bp, Homo sapiens
tctagcctctgga

SEQ ID NO: 4872502 - DNA, 22 bp, Homo sapiens
tctagcctctggactggaaagc

SEQ ID NO: 4872503 - DNA, 16 bp, Homo sapiens
tctaggcactgagcag

SEQ ID NO: 4872504 - DNA, 19 bp, Homo sapiens
tctaggccctgtgagcaca

SEQ ID NO: 4872505 - DNA, 20 bp, Homo sapiens
tctaggccctgtgagcacaa

SEQ ID NO: 4872506 - DNA, 21 bp, Homo sapiens
tctaggtacgatgacagtgtt

SEQ ID NO: 4872507 - DNA, 15 bp, Homo sapiens
tctagtacctgtgac

SEQ ID NO: 4872508 - DNA, 22 bp, Homo sapiens
tctagtgaggaagacaagcatt

SEQ ID NO: 4872509 - DNA, 12 bp, Homo sapiens
tctagtgatgat

SEQ ID NO: 4872510 - DNA, 20 bp, Homo sapiens
tctagttgcccccattccca

SEQ ID NO: 4872511 - DNA, 21 bp, Homo sapiens
tctataaactataacctctcc

SEQ ID NO: 4872512 - DNA, 12 bp, Homo sapiens
tctataaagtat

SEQ ID NO: 4872513 - DNA, 14 bp, Homo sapiens
tctatactgtggcc

SEQ ID NO: 4872514 - DNA, 20 bp, Homo sapiens
tctatactgtggcctgcagg

SEQ ID NO: 4872515 - DNA, 21 bp, Homo sapiens
tctatactgtggcctgcagga

SEQ ID NO: 4872516 - DNA, 14 bp, Homo sapiens
tctatatagacttg

SEQ ID NO: 4872517 - DNA, 20 bp, Homo sapiens
tctatatagacttggagaat

SEQ ID NO: 4872518 - DNA, 16 bp, Homo sapiens
tctattaatattcagg

SEQ ID NO: 4872519 - DNA, 13 bp, Homo sapiens
tctattctccaga

SEQ ID NO: 4872520 - DNA, 14 bp, Homo sapiens
tctattctccagac

SEQ ID NO: 4872521 - DNA, 14 bp, Homo sapiens
tctatttataatac

SEQ ID NO: 4872522 - DNA, 12 bp, Homo sapiens
tctatttttatg

SEQ ID NO: 4872523 - DNA, 18 bp, Homo sapiens
tctatttttatgatgaca

SEQ ID NO: 4872524 - DNA, 22 bp, Homo sapiens
tctcaaatgtgtgtggcagcca

SEQ ID NO: 4872525 - DNA, 19 bp, Homo sapiens
tctcaatgaaccataaatt

SEQ ID NO: 4872526 - DNA, 21 bp, Homo sapiens
tctcaatgaaccataaattca

SEQ ID NO: 4872527 - DNA, 20 bp, Homo sapiens
tctcaccagcagtcgtgggg

SEQ ID NO: 4872528 - DNA, 16 bp, Homo sapiens
tctcagctgtgccttc

SEQ ID NO: 4872529 - DNA, 14 bp, Homo sapiens
tctcagggctcggg

SEQ ID NO: 4872530 - DNA, 16 bp, Homo sapiens
tctcagtggtgtgtga

SEQ ID NO: 4872531 - DNA, 19 bp, Homo sapiens
tctccaagcactagccttc

SEQ ID NO: 4872532 - DNA, 22 bp, Homo sapiens
tctccaagcactagccttccca

SEQ ID NO: 4872533 - DNA, 15 bp, Homo sapiens
tctccactggaccct

SEQ ID NO: 4872534 - DNA, 14 bp, Homo sapiens
tctccatggagcct

SEQ ID NO: 4872535 - DNA, 19 bp, Homo sapiens
tctcccttcctctctcctt

SEQ ID NO: 4872536 - DNA, 16 bp, Homo sapiens
tctccgggactgccct

SEQ ID NO: 4872537 - DNA, 19 bp, Homo sapiens
tctccgggactgccctctc

SEQ ID NO: 4872538 - DNA, 18 bp, Homo sapiens
tctcctcagggtgggggg

SEQ ID NO: 4872539 - DNA, 18 bp, Homo sapiens
tctcctccagccctgggc

SEQ ID NO: 4872540 - DNA, 19 bp, Homo sapiens
tctcctccagccctgggca

SEQ ID NO: 4872541 - DNA, 19 bp, Homo sapiens
tctcctcccgccccgcccc

SEQ ID NO: 4872542 - DNA, 11 bp, Homo sapiens
tctcctccctc

SEQ ID NO: 4872543 - DNA, 14 bp, Homo sapiens
tctcctccctcagc

SEQ ID NO: 4872544 - DNA, 19 bp, Homo sapiens
tctcctctctctttcctcc

SEQ ID NO: 4872545 - DNA, 15 bp, Homo sapiens
tctcctgccctctgc

SEQ ID NO: 4872546 - DNA, 22 bp, Homo sapiens
tctccttaagctgcagagattt

SEQ ID NO: 4872547 - DNA, 22 bp, Homo sapiens
tctcctttgaagaaggcaaggc

SEQ ID NO: 4872548 - DNA, 22 bp, Homo sapiens
tctctatagcaccagggctcac

SEQ ID NO: 4872549 - DNA, 13 bp, Homo sapiens
tctctccaggagg

SEQ ID NO: 4872550 - DNA, 20 bp, Homo sapiens
tctctccaggagggctcggg

SEQ ID NO: 4872551 - DNA, 14 bp, Homo sapiens
tctctcccttcctc

SEQ ID NO: 4872552 - DNA, 11 bp, Homo sapiens
tctctctgggc

SEQ ID NO: 4872553 - DNA, 21 bp, Homo sapiens
tctctgccagttacttgggct

SEQ ID NO: 4872554 - DNA, 17 bp, Homo sapiens
tctcttcggtggccttg

SEQ ID NO: 4872555 - DNA, 18 bp, Homo sapiens
tctcttcggtggccttga

SEQ ID NO: 4872556 - DNA, 15 bp, Homo sapiens
tctctttcctccacc

SEQ ID NO: 4872557 - DNA, 20 bp, Homo sapiens
tctgaaaggccagcagctga

SEQ ID NO: 4872558 - DNA, 15 bp, Homo sapiens
tctgaaccctccaaa

SEQ ID NO: 4872559 - DNA, 21 bp, Homo sapiens
tctgaattaattaatttggag

SEQ ID NO: 4872560 - DNA, 23 bp, Homo sapiens
tctgacctggcatctaattctga

SEQ ID NO: 4872561 - DNA, 15 bp, Homo sapiens
tctgagacaggtgcc

SEQ ID NO: 4872562 - DNA, 16 bp, Homo sapiens
tctgatcggccagttt

SEQ ID NO: 4872563 - DNA, 16 bp, Homo sapiens
tctgcaacaagcatgc

SEQ ID NO: 4872564 - DNA, 18 bp, Homo sapiens
tctgcaagcttcttgctg

SEQ ID NO: 4872565 - DNA, 15 bp, Homo sapiens
tctgcacccgcctcg

SEQ ID NO: 4872566 - DNA, 15 bp, Homo sapiens
tctgcatttaaaaaa

SEQ ID NO: 4872567 - DNA, 20 bp, Homo sapiens
tctgccaatctgtacaaaat

SEQ ID NO: 4872568 - DNA, 19 bp, Homo sapiens
tctgccagttacttgggct

SEQ ID NO: 4872569 - DNA, 10 bp, Homo sapiens
tctgcctgga

SEQ ID NO: 4872570 - DNA, 14 bp, Homo sapiens
tctgctaggcgctg

SEQ ID NO: 4872571 - DNA, 21 bp, Homo sapiens
tctgctaggcgctggggagac

SEQ ID NO: 4872572 - DNA, 14 bp, Homo sapiens
tctgctctgcctgg

SEQ ID NO: 4872573 - DNA, 14 bp, Homo sapiens
tctggaagagggag

SEQ ID NO: 4872574 - DNA, 13 bp, Homo sapiens
tctggactggaaa

SEQ ID NO: 4872575 - DNA, 14 bp, Homo sapiens
tctggactggaaag

SEQ ID NO: 4872576 - DNA, 13 bp, Homo sapiens
tctggatgtctgg

SEQ ID NO: 4872577 - DNA, 20 bp, Homo sapiens
tctggctcaaagcagcagga

SEQ ID NO: 4872578 - DNA, 17 bp, Homo sapiens
tctggctttaagccttc

SEQ ID NO: 4872579 - DNA, 15 bp, Homo sapiens
tctgggacccacaga

SEQ ID NO: 4872580 - DNA, 17 bp, Homo sapiens
tctgggacccacagaac

SEQ ID NO: 4872581 - DNA, 19 bp, Homo sapiens
tctgggtgctagatccagc

SEQ ID NO: 4872582 - DNA, 22 bp, Homo sapiens
tctggtaatattgacttgtata

SEQ ID NO: 4872583 - DNA, 15 bp, Homo sapiens
tctggtactttctgt

SEQ ID NO: 4872584 - DNA, 16 bp, Homo sapiens
tctgtaataatagact

SEQ ID NO: 4872585 - DNA, 22 bp, Homo sapiens
tctgtacaaaatggtcctattt

SEQ ID NO: 4872586 - DNA, 16 bp, Homo sapiens
tctgtccttcccccag

SEQ ID NO: 4872587 - DNA, 16 bp, Homo sapiens
tctgttagcagagtct

SEQ ID NO: 4872588 - DNA, 21 bp, Homo sapiens
tctgttatgggcttttgggga

SEQ ID NO: 4872589 - DNA, 20 bp, Homo sapiens
tctgttttgtggtttggaat

SEQ ID NO: 4872590 - DNA, 20 bp, Homo sapiens
tcttaaagaaaacccacccc

SEQ ID NO: 4872591 - DNA, 16 bp, Homo sapiens
tcttactaaaaagtat

SEQ ID NO: 4872592 - DNA, 18 bp, Homo sapiens
tcttagccctcaccacag

SEQ ID NO: 4872593 - DNA, 24 bp, Homo sapiens
tcttatccaactttttcatagtaa

SEQ ID NO: 4872594 - DNA, 14 bp, Homo sapiens
tcttatttatagaa

SEQ ID NO: 4872595 - DNA, 15 bp, Homo sapiens
tcttcacaggcactc

SEQ ID NO: 4872596 - DNA, 16 bp, Homo sapiens
tcttcactctggcttc

SEQ ID NO: 4872597 - DNA, 17 bp, Homo sapiens
tcttcactctggcttca

SEQ ID NO: 4872598 - DNA, 18 bp, Homo sapiens
tcttccacccacaaactc

SEQ ID NO: 4872599 - DNA, 18 bp, Homo sapiens
tcttcccactccagctga

SEQ ID NO: 4872600 - DNA, 13 bp, Homo sapiens
tcttcccatgcat

SEQ ID NO: 4872601 - DNA, 17 bp, Homo sapiens
tcttcctatccctctcc

SEQ ID NO: 4872602 - DNA, 19 bp, Homo sapiens
tcttcctatccctctccta

SEQ ID NO: 4872603 - DNA, 22 bp, Homo sapiens
tcttcctatccctctcctaact

SEQ ID NO: 4872604 - DNA, 18 bp, Homo sapiens
tcttcggtggccttgagt

SEQ ID NO: 4872605 - DNA, 20 bp, Homo sapiens
tcttcggtggccttgagtct

SEQ ID NO: 4872606 - DNA, 13 bp, Homo sapiens
tcttctttctcca

SEQ ID NO: 4872607 - DNA, 20 bp, Homo sapiens
tcttgctttctttgacctct

SEQ ID NO: 4872608 - DNA, 20 bp, Homo sapiens
tcttgtattatctcctttga

SEQ ID NO: 4872609 - DNA, 15 bp, Homo sapiens
tcttgtgggagacag

SEQ ID NO: 4872610 - DNA, 20 bp, Homo sapiens
tcttgtgggagacagcagcc

SEQ ID NO: 4872611 - DNA, 22 bp, Homo sapiens
tcttgtgggagacagcagcctg

SEQ ID NO: 4872612 - DNA, 16 bp, Homo sapiens
tcttgttttgaaaata

SEQ ID NO: 4872613 - DNA, 21 bp, Homo sapiens
tctttaactgccgtaatttaa

SEQ ID NO: 4872614 - DNA, 18 bp, Homo sapiens
tctttagcttacctgggc

SEQ ID NO: 4872615 - DNA, 14 bp, Homo sapiens
tctttattgaaatt

SEQ ID NO: 4872616 - DNA, 19 bp, Homo sapiens
tctttcacccatcctagga

SEQ ID NO: 4872617 - DNA, 23 bp, Homo sapiens
tctttcacccatcctaggaacca

SEQ ID NO: 4872618 - DNA, 23 bp, Homo sapiens
tctttcagaaatataacacattt

SEQ ID NO: 4872619 - DNA, 12 bp, Homo sapiens
tctttgcaaata

SEQ ID NO: 4872620 - DNA, 20 bp, Homo sapiens
tctttggagttaaaatgcac

SEQ ID NO: 4872621 - DNA, 22 bp, Homo sapiens
tctttggggctcctttcccctc

SEQ ID NO: 4872622 - DNA, 19 bp, Homo sapiens
tctttgtaccaaaatttta

SEQ ID NO: 4872623 - DNA, 21 bp, Homo sapiens
tctttgtaccaaaattttaaa

SEQ ID NO: 4872624 - DNA, 13 bp, Homo sapiens
tcttttaaagacc

SEQ ID NO: 4872625 - DNA, 14 bp, Homo sapiens
tcttttgaagcata

SEQ ID NO: 4872626 - DNA, 21 bp, Homo sapiens
tcttttttaaccggtaagagt

SEQ ID NO: 4872627 - DNA, 23 bp, Homo sapiens
tcttttttaaccggtaagagttt

SEQ ID NO: 4872628 - DNA, 13 bp, Homo sapiens
tgaaaaatataaa

SEQ ID NO: 4872629 - DNA, 20 bp, Homo sapiens
tgaaaaatataaaattatga

SEQ ID NO: 4872630 - DNA, 21 bp, Homo sapiens
tgaaaataactgaatttggag

SEQ ID NO: 4872631 - DNA, 13 bp, Homo sapiens
tgaaaataccatt

SEQ ID NO: 4872632 - DNA, 16 bp, Homo sapiens
tgaaaattgaaaagta

SEQ ID NO: 4872633 - DNA, 13 bp, Homo sapiens
tgaaacctgatgt

SEQ ID NO: 4872634 - DNA, 15 bp, Homo sapiens
tgaaacctgatgtca

SEQ ID NO: 4872635 - DNA, 17 bp, Homo sapiens
tgaaacctttttttatc

SEQ ID NO: 4872636 - DNA, 23 bp, Homo sapiens
tgaaacttctcagtccagcagtt

SEQ ID NO: 4872637 - DNA, 15 bp, Homo sapiens
tgaaactttgggaaa

SEQ ID NO: 4872638 - DNA, 21 bp, Homo sapiens
tgaaactttgggaaaacatgt

SEQ ID NO: 4872639 - DNA, 14 bp, Homo sapiens
tgaaagaaaattga

SEQ ID NO: 4872640 - DNA, 15 bp, Homo sapiens
tgaaagctactcata

SEQ ID NO: 4872641 - DNA, 14 bp, Homo sapiens
tgaaaggccagcag

SEQ ID NO: 4872642 - DNA, 16 bp, Homo sapiens
tgaaaggccagcagct

SEQ ID NO: 4872643 - DNA, 22 bp, Homo sapiens
tgaaatcttcccatgcattctg

SEQ ID NO: 4872644 - DNA, 14 bp, Homo sapiens
tgaaattttagaaa

SEQ ID NO: 4872645 - DNA, 16 bp, Homo sapiens
tgaaattttagaaata

SEQ ID NO: 4872646 - DNA, 17 bp, Homo sapiens
tgaacataacttctcat

SEQ ID NO: 4872647 - DNA, 20 bp, Homo sapiens
tgaacataacttctcatgta

SEQ ID NO: 4872648 - DNA, 23 bp, Homo sapiens
tgaacataacttctcatgtatat

SEQ ID NO: 4872649 - DNA, 15 bp, Homo sapiens
tgaaccaatctggat

SEQ ID NO: 4872650 - DNA, 21 bp, Homo sapiens
tgaaccataaattcaactttg

SEQ ID NO: 4872651 - DNA, 19 bp, Homo sapiens
tgaaccttaaaaggtactg

SEQ ID NO: 4872652 - DNA, 12 bp, Homo sapiens
tgaactccaggc

SEQ ID NO: 4872653 - DNA, 13 bp, Homo sapiens
tgaactccaggca

SEQ ID NO: 4872654 - DNA, 17 bp, Homo sapiens
tgaactctgttccccca

SEQ ID NO: 4872655 - DNA, 12 bp, Homo sapiens
tgaactttggaa

SEQ ID NO: 4872656 - DNA, 13 bp, Homo sapiens
tgaagaaggcaag

SEQ ID NO: 4872657 - DNA, 12 bp, Homo sapiens
tgaagagacaga

SEQ ID NO: 4872658 - DNA, 16 bp, Homo sapiens
tgaagagggacataag

SEQ ID NO: 4872659 - DNA, 20 bp, Homo sapiens
tgaagagggacataagataa

SEQ ID NO: 4872660 - DNA, 21 bp, Homo sapiens
tgaagagtggaaatggggaac

SEQ ID NO: 4872661 - DNA, 16 bp, Homo sapiens
tgaagatctttatatt

SEQ ID NO: 4872662 - DNA, 17 bp, Homo sapiens
tgaagcagggtttcttt

SEQ ID NO: 4872663 - DNA, 21 bp, Homo sapiens
tgaagcagggtttcttttctt

SEQ ID NO: 4872664 - DNA, 14 bp, Homo sapiens
tgaagcagtatttt

SEQ ID NO: 4872665 - DNA, 15 bp, Homo sapiens
tgaagcagtattttg

SEQ ID NO: 4872666 - DNA, 14 bp, Homo sapiens
tgaagctggagcag

SEQ ID NO: 4872667 - DNA, 13 bp, Homo sapiens
tgaaggagaatgg

SEQ ID NO: 4872668 - DNA, 23 bp, Homo sapiens
tgaaggctctcacccccatccct

SEQ ID NO: 4872669 - DNA, 23 bp, Homo sapiens
tgaaggtagcattctttggagtt

SEQ ID NO: 4872670 - DNA, 16 bp, Homo sapiens
tgaagtatgaagtctg

SEQ ID NO: 4872671 - DNA, 17 bp, Homo sapiens
tgaagtatgaagtctga

SEQ ID NO: 4872672 - DNA, 21 bp, Homo sapiens
tgaagtttcaagttttaaagt

SEQ ID NO: 4872673 - DNA, 23 bp, Homo sapiens
tgaagtttcaagttttaaagttc

SEQ ID NO: 4872674 - DNA, 13 bp, Homo sapiens
tgaagtttggaga

SEQ ID NO: 4872675 - DNA, 14 bp, Homo sapiens
tgaataaatgtctt

SEQ ID NO: 4872676 - DNA, 14 bp, Homo sapiens
tgaatacctgctca

SEQ ID NO: 4872677 - DNA, 13 bp, Homo sapiens
tgaataggttccc

SEQ ID NO: 4872678 - DNA, 13 bp, Homo sapiens
tgaatataaaaaa

SEQ ID NO: 4872679 - DNA, 17 bp, Homo sapiens
tgaatccgtacttgggt

SEQ ID NO: 4872680 - DNA, 20 bp, Homo sapiens
tgaatccttttaatctagag

SEQ ID NO: 4872681 - DNA, 13 bp, Homo sapiens
tgaatgaaacatg

SEQ ID NO: 4872682 - DNA, 19 bp, Homo sapiens
tgaatgcctatggtggatc

SEQ ID NO: 4872683 - DNA, 12 bp, Homo sapiens
tgaatgtgtgag

SEQ ID NO: 4872684 - DNA, 15 bp, Homo sapiens
tgaatgtgtgagaaa

SEQ ID NO: 4872685 - DNA, 19 bp, Homo sapiens
tgaattaatatccctacat

SEQ ID NO: 4872686 - DNA, 22 bp, Homo sapiens
tgaattaatatccctacatgta

SEQ ID NO: 4872687 - DNA, 15 bp, Homo sapiens
tgaattatcagcaaa

SEQ ID NO: 4872688 - DNA, 19 bp, Homo sapiens
tgaattatcagcaaagaaa

SEQ ID NO: 4872689 - DNA, 18 bp, Homo sapiens
tgaattattatatacata

SEQ ID NO: 4872690 - DNA, 12 bp, Homo sapiens
tgaattgaagtt

SEQ ID NO: 4872691 - DNA, 19 bp, Homo sapiens
tgaattgaagtttcaagtt

SEQ ID NO: 4872692 - DNA, 21 bp, Homo sapiens
tgaatttgccagaggaccaat

SEQ ID NO: 4872693 - DNA, 14 bp, Homo sapiens
tgaatttgtatatg

SEQ ID NO: 4872694 - DNA, 19 bp, Homo sapiens
tgaatttgtatatgactgc

SEQ ID NO: 4872695 - DNA, 11 bp, Homo sapiens
tgaattttcta

SEQ ID NO: 4872696 - DNA, 16 bp, Homo sapiens
tgacaaccattaaagt

SEQ ID NO: 4872697 - DNA, 20 bp, Homo sapiens
tgacaactcattttcatatt

SEQ ID NO: 4872698 - DNA, 17 bp, Homo sapiens
tgacaaggcctgcttga

SEQ ID NO: 4872699 - DNA, 19 bp, Homo sapiens
tgacaaggcctgcttgact

SEQ ID NO: 4872700 - DNA, 16 bp, Homo sapiens
tgacaatattccagat

SEQ ID NO: 4872701 - DNA, 16 bp, Homo sapiens
tgacacaactgtgtga

SEQ ID NO: 4872702 - DNA, 15 bp, Homo sapiens
tgacacctgctgaga

SEQ ID NO: 4872703 - DNA, 23 bp, Homo sapiens
tgacaggccttcctcctctcaaa

SEQ ID NO: 4872704 - DNA, 16 bp, Homo sapiens
tgacaggttttccaaa

SEQ ID NO: 4872705 - DNA, 20 bp, Homo sapiens
tgacaggttttccaaaagta

SEQ ID NO: 4872706 - DNA, 14 bp, Homo sapiens
tgacagtgccttct

SEQ ID NO: 4872707 - DNA, 14 bp, Homo sapiens
tgacagttcccaga

SEQ ID NO: 4872708 - DNA, 17 bp, Homo sapiens
tgacagtttttgacatt

SEQ ID NO: 4872709 - DNA, 15 bp, Homo sapiens
tgacatggaaatgaa

SEQ ID NO: 4872710 - DNA, 16 bp, Homo sapiens
tgacatttaatgccat

SEQ ID NO: 4872711 - DNA, 17 bp, Homo sapiens
tgacatttaatgccatc

SEQ ID NO: 4872712 - DNA, 15 bp, Homo sapiens
tgacatttatatatt

SEQ ID NO: 4872713 - DNA, 19 bp, Homo sapiens
tgacatttatatattgaat

SEQ ID NO: 4872714 - DNA, 20 bp, Homo sapiens
tgacatttatatattgaatt

SEQ ID NO: 4872715 - DNA, 23 bp, Homo sapiens
tgacatttgggagacatgtgaca

SEQ ID NO: 4872716 - DNA, 18 bp, Homo sapiens
tgaccagtgcctgtgagc

SEQ ID NO: 4872717 - DNA, 19 bp, Homo sapiens
tgaccagtttaagccgcag

SEQ ID NO: 4872718 - DNA, 22 bp, Homo sapiens
tgaccattttttaatttacttg

SEQ ID NO: 4872719 - DNA, 11 bp, Homo sapiens
tgaccctgggc

SEQ ID NO: 4872720 - DNA, 17 bp, Homo sapiens
tgacctaaattatttac

SEQ ID NO: 4872721 - DNA, 23 bp, Homo sapiens
tgacctagctctttgggcctctc

SEQ ID NO: 4872722 - DNA, 22 bp, Homo sapiens
tgacctccagaagtcccttcaa

SEQ ID NO: 4872723 - DNA, 22 bp, Homo sapiens
tgaccttgagttaacaggacag

SEQ ID NO: 4872724 - DNA, 21 bp, Homo sapiens
tgacgatgatgtacagattct

SEQ ID NO: 4872725 - DNA, 17 bp, Homo sapiens
tgactaacaggccaaag

SEQ ID NO: 4872726 - DNA, 15 bp, Homo sapiens
tgactaactcaaata

SEQ ID NO: 4872727 - DNA, 21 bp, Homo sapiens
tgactaactcaaatacacatt

SEQ ID NO: 4872728 - DNA, 23 bp, Homo sapiens
tgactaactcaaatacacatttg

SEQ ID NO: 4872729 - DNA, 13 bp, Homo sapiens
tgactacctactg

SEQ ID NO: 4872730 - DNA, 22 bp, Homo sapiens
tgactacctactggtgtaatct

SEQ ID NO: 4872731 - DNA, 16 bp, Homo sapiens
tgactagaactcctgt

SEQ ID NO: 4872732 - DNA, 18 bp, Homo sapiens
tgactaggttctgtagag

SEQ ID NO: 4872733 - DNA, 20 bp, Homo sapiens
tgactatgcgtggctggaac

SEQ ID NO: 4872734 - DNA, 13 bp, Homo sapiens
tgactccagggtg

SEQ ID NO: 4872735 - DNA, 19 bp, Homo sapiens
tgactccagggtgacaagg

SEQ ID NO: 4872736 - DNA, 22 bp, Homo sapiens
tgactccagggtgacaaggcct

SEQ ID NO: 4872737 - DNA, 19 bp, Homo sapiens
tgactccttatctctttcc

SEQ ID NO: 4872738 - DNA, 20 bp, Homo sapiens
tgactccttatctctttcca

SEQ ID NO: 4872739 - DNA, 16 bp, Homo sapiens
tgactctataagcaaa

SEQ ID NO: 4872740 - DNA, 20 bp, Homo sapiens
tgactgaagaagatgagcct

SEQ ID NO: 4872741 - DNA, 15 bp, Homo sapiens
tgactgccctccgaa

SEQ ID NO: 4872742 - DNA, 16 bp, Homo sapiens
tgactttccagaatga

SEQ ID NO: 4872743 - DNA, 14 bp, Homo sapiens
tgactttgcccagg

SEQ ID NO: 4872744 - DNA, 23 bp, Homo sapiens
tgactttttaaacgattagtgat

SEQ ID NO: 4872745 - DNA, 15 bp, Homo sapiens
tgagaaacactattt

SEQ ID NO: 4872746 - DNA, 14 bp, Homo sapiens
tgagaatggcctgg

SEQ ID NO: 4872747 - DNA, 16 bp, Homo sapiens
tgagaatggcctggag

SEQ ID NO: 4872748 - DNA, 22 bp, Homo sapiens
tgagaattgaggggaggtggcc

SEQ ID NO: 4872749 - DNA, 20 bp, Homo sapiens
tgagacaggtgcctaacctg

SEQ ID NO: 4872750 - DNA, 15 bp, Homo sapiens
tgagacagtgaattt

SEQ ID NO: 4872751 - DNA, 20 bp, Homo sapiens
tgagagtccaacagacacaa

SEQ ID NO: 4872752 - DNA, 17 bp, Homo sapiens
tgagattctgaagtatg

SEQ ID NO: 4872753 - DNA, 18 bp, Homo sapiens
tgagattctgaagtatga

SEQ ID NO: 4872754 - DNA, 19 bp, Homo sapiens
tgagattggttttcctgtg

SEQ ID NO: 4872755 - DNA, 17 bp, Homo sapiens
tgagcaagcaccaacct

SEQ ID NO: 4872756 - DNA, 22 bp, Homo sapiens
tgagcaagcaccaacctccaga

SEQ ID NO: 4872757 - DNA, 14 bp, Homo sapiens
tgagcacaaagaag

SEQ ID NO: 4872758 - DNA, 19 bp, Homo sapiens
tgagcacaaagaagaaagc

SEQ ID NO: 4872759 - DNA, 21 bp, Homo sapiens
tgagcagcatccaccccaccc

SEQ ID NO: 4872760 - DNA, 15 bp, Homo sapiens
tgagcagggatctgc

SEQ ID NO: 4872761 - DNA, 16 bp, Homo sapiens
tgagcatagagaacaa

SEQ ID NO: 4872762 - DNA, 17 bp, Homo sapiens
tgagcatagagaacaaa

SEQ ID NO: 4872763 - DNA, 23 bp, Homo sapiens
tgagcatcgcttaggagaagtct

SEQ ID NO: 4872764 - DNA, 18 bp, Homo sapiens
tgagcatggggccaggaa

SEQ ID NO: 4872765 - DNA, 15 bp, Homo sapiens
tgagcctggtcctgg

SEQ ID NO: 4872766 - DNA, 18 bp, Homo sapiens
tgagctacagaacacttt

SEQ ID NO: 4872767 - DNA, 17 bp, Homo sapiens
tgagctctgaaatcttc

SEQ ID NO: 4872768 - DNA, 15 bp, Homo sapiens
tgaggacctccctgt

SEQ ID NO: 4872769 - DNA, 18 bp, Homo sapiens
tgaggagagaggaggaaa

SEQ ID NO: 4872770 - DNA, 14 bp, Homo sapiens
tgaggagattccca

SEQ ID NO: 4872771 - DNA, 16 bp, Homo sapiens
tgaggaggtgctgcag

SEQ ID NO: 4872772 - DNA, 23 bp, Homo sapiens
tgagggccggttctaaggctcag

SEQ ID NO: 4872773 - DNA, 16 bp, Homo sapiens
tgaggggaggtggcca

SEQ ID NO: 4872774 - DNA, 21 bp, Homo sapiens
tgaggggaggtggccagcccg

SEQ ID NO: 4872775 - DNA, 14 bp, Homo sapiens
tgagggggtaaagc

SEQ ID NO: 4872776 - DNA, 16 bp, Homo sapiens
tgagggggtaaagcag

SEQ ID NO: 4872777 - DNA, 16 bp, Homo sapiens
tgaggtctagagagaa

SEQ ID NO: 4872778 - DNA, 19 bp, Homo sapiens
tgaggtctagagagaacca

SEQ ID NO: 4872779 - DNA, 17 bp, Homo sapiens
tgaggtgaactccaggc

SEQ ID NO: 4872780 - DNA, 19 bp, Homo sapiens
tgaggtgaactccaggcat

SEQ ID NO: 4872781 - DNA, 20 bp, Homo sapiens
tgaggtgaactccaggcatg

SEQ ID NO: 4872782 - DNA, 21 bp, Homo sapiens
tgaggtgtattggtgttgcag

SEQ ID NO: 4872783 - DNA, 23 bp, Homo sapiens
tgaggtgtattggtgttgcagcc

SEQ ID NO: 4872784 - DNA, 15 bp, Homo sapiens
tgagtaggctgggcc

SEQ ID NO: 4872785 - DNA, 19 bp, Homo sapiens
tgagtattgtttaaaatgt

SEQ ID NO: 4872786 - DNA, 23 bp, Homo sapiens
tgagtctgggatattctttagct

SEQ ID NO: 4872787 - DNA, 18 bp, Homo sapiens
tgagtgtatgagtagcca

SEQ ID NO: 4872788 - DNA, 14 bp, Homo sapiens
tgagttaacaggac

SEQ ID NO: 4872789 - DNA, 17 bp, Homo sapiens
tgagttaacaggacagt

SEQ ID NO: 4872790 - DNA, 12 bp, Homo sapiens
tgagttatcatg

SEQ ID NO: 4872791 - DNA, 23 bp, Homo sapiens
tgagttatcatgaattttaaagt

SEQ ID NO: 4872792 - DNA, 17 bp, Homo sapiens
tgagttccagttgaagt

SEQ ID NO: 4872793 - DNA, 16 bp, Homo sapiens
tgagtttaccttgtat

SEQ ID NO: 4872794 - DNA, 18 bp, Homo sapiens
tgataagggaaaagataa

SEQ ID NO: 4872795 - DNA, 14 bp, Homo sapiens
tgatacatttttgt

SEQ ID NO: 4872796 - DNA, 18 bp, Homo sapiens
tgatacattttttaagct

SEQ ID NO: 4872797 - DNA, 18 bp, Homo sapiens
tgataccatatgaatgaa

SEQ ID NO: 4872798 - DNA, 14 bp, Homo sapiens
tgatagaaaagtgt

SEQ ID NO: 4872799 - DNA, 23 bp, Homo sapiens
tgatagggtctaccaatacaaaa

SEQ ID NO: 4872800 - DNA, 14 bp, Homo sapiens
tgatagttgtgtgt

SEQ ID NO: 4872801 - DNA, 15 bp, Homo sapiens
tgatataccaaatta

SEQ ID NO: 4872802 - DNA, 18 bp, Homo sapiens
tgatatataagtgtacat

SEQ ID NO: 4872803 - DNA, 19 bp, Homo sapiens
tgatatataagtgtacata

SEQ ID NO: 4872804 - DNA, 13 bp, Homo sapiens
tgatatcccaagt

SEQ ID NO: 4872805 - DNA, 15 bp, Homo sapiens
tgatattgctgtgag

SEQ ID NO: 4872806 - DNA, 21 bp, Homo sapiens
tgatcggccagttttcggaaa

SEQ ID NO: 4872807 - DNA, 16 bp, Homo sapiens
tgatgagagaatgtgg

SEQ ID NO: 4872808 - DNA, 17 bp, Homo sapiens
tgatgagagaatgtgga

SEQ ID NO: 4872809 - DNA, 12 bp, Homo sapiens
tgatgagggaag

SEQ ID NO: 4872810 - DNA, 13 bp, Homo sapiens
tgatgagttgtga

SEQ ID NO: 4872811 - DNA, 18 bp, Homo sapiens
tgatgagtttgacagttt

SEQ ID NO: 4872812 - DNA, 15 bp, Homo sapiens
tgatgctgggcaatg

SEQ ID NO: 4872813 - DNA, 17 bp, Homo sapiens
tgatggagccccagggt

SEQ ID NO: 4872814 - DNA, 21 bp, Homo sapiens
tgatggagtgtgcagacagcc

SEQ ID NO: 4872815 - DNA, 18 bp, Homo sapiens
tgatgtccttaaaatgtg

SEQ ID NO: 4872816 - DNA, 17 bp, Homo sapiens
tgatgtctttttattaa

SEQ ID NO: 4872817 - DNA, 18 bp, Homo sapiens
tgattactgcaatcactg

SEQ ID NO: 4872818 - DNA, 23 bp, Homo sapiens
tgattagaaattacctgtggata

SEQ ID NO: 4872819 - DNA, 22 bp, Homo sapiens
tgattatttaagactaaaagtt

SEQ ID NO: 4872820 - DNA, 18 bp, Homo sapiens
tgattattttttttttct

SEQ ID NO: 4872821 - DNA, 14 bp, Homo sapiens
tgattctggcttta

SEQ ID NO: 4872822 - DNA, 18 bp, Homo sapiens
tgattctggctttaagcc

SEQ ID NO: 4872823 - DNA, 21 bp, Homo sapiens
tgattctggctttaagccttc

SEQ ID NO: 4872824 - DNA, 18 bp, Homo sapiens
tgattgggaaaacatttg

SEQ ID NO: 4872825 - DNA, 21 bp, Homo sapiens
tgatttcaaagttttgttgta

SEQ ID NO: 4872826 - DNA, 16 bp, Homo sapiens
tgatttcacagtgtgt

SEQ ID NO: 4872827 - DNA, 14 bp, Homo sapiens
tgatttcagtaagt

SEQ ID NO: 4872828 - DNA, 16 bp, Homo sapiens
tgatttcagtaagtct

SEQ ID NO: 4872829 - DNA, 19 bp, Homo sapiens
tgatttccctccagagaaa

SEQ ID NO: 4872830 - DNA, 20 bp, Homo sapiens
tgatttccctccagagaaag

SEQ ID NO: 4872831 - DNA, 21 bp, Homo sapiens
tgatttccctccagagaaagc

SEQ ID NO: 4872832 - DNA, 22 bp, Homo sapiens
tgatttccctccagagaaagca

SEQ ID NO: 4872833 - DNA, 17 bp, Homo sapiens
tgcaaaaataatcatga

SEQ ID NO: 4872834 - DNA, 19 bp, Homo sapiens
tgcaaaactccaggcagga

SEQ ID NO: 4872835 - DNA, 15 bp, Homo sapiens
tgcaaaaggaggtga

SEQ ID NO: 4872836 - DNA, 15 bp, Homo sapiens
tgcaaagtcgccagt

SEQ ID NO: 4872837 - DNA, 19 bp, Homo sapiens
tgcaaagtctccagaagaa

SEQ ID NO: 4872838 - DNA, 22 bp, Homo sapiens
tgcaaagtctccagaagaaaat

SEQ ID NO: 4872839 - DNA, 21 bp, Homo sapiens
tgcaaataaaacgctttcccc

SEQ ID NO: 4872840 - DNA, 23 bp, Homo sapiens
tgcaaatactgtatattcaggac

SEQ ID NO: 4872841 - DNA, 21 bp, Homo sapiens
tgcaaatagattcagagaaat

SEQ ID NO: 4872842 - DNA, 21 bp, Homo sapiens
tgcaaatgagctctgaaatct

SEQ ID NO: 4872843 - DNA, 18 bp, Homo sapiens
tgcaaggtggcctctgcc

SEQ ID NO: 4872844 - DNA, 14 bp, Homo sapiens
tgcaataaaattta

SEQ ID NO: 4872845 - DNA, 15 bp, Homo sapiens
tgcaataaaatttaa

SEQ ID NO: 4872846 - DNA, 16 bp, Homo sapiens
tgcaataaaatttaaa

SEQ ID NO: 4872847 - DNA, 17 bp, Homo sapiens
tgcaataaaatttaaaa

SEQ ID NO: 4872848 - DNA, 23 bp, Homo sapiens
tgcaatactgcttaattgctgat

SEQ ID NO: 4872849 - DNA, 21 bp, Homo sapiens
tgcaataggtgagagaatgta

SEQ ID NO: 4872850 - DNA, 20 bp, Homo sapiens
tgcaattaaacttccaaaga

SEQ ID NO: 4872851 - DNA, 13 bp, Homo sapiens
tgcacatctgttt

SEQ ID NO: 4872852 - DNA, 17 bp, Homo sapiens
tgcacatttctttgcat

SEQ ID NO: 4872853 - DNA, 15 bp, Homo sapiens
tgcacgtaaacttca

SEQ ID NO: 4872854 - DNA, 17 bp, Homo sapiens
tgcactaacagagtggc

SEQ ID NO: 4872855 - DNA, 11 bp, Homo sapiens
tgcactccaga

SEQ ID NO: 4872856 - DNA, 13 bp, Homo sapiens
tgcactccagact

SEQ ID NO: 4872857 - DNA, 22 bp, Homo sapiens
tgcactgatatatcatgagtga

SEQ ID NO: 4872858 - DNA, 19 bp, Homo sapiens
tgcacttattgaccatttt

SEQ ID NO: 4872859 - DNA, 23 bp, Homo sapiens
tgcacttattgaccattttttaa

SEQ ID NO: 4872860 - DNA, 14 bp, Homo sapiens
tgcacttttgaatg

SEQ ID NO: 4872861 - DNA, 17 bp, Homo sapiens
tgcagaaatagacaaaa

SEQ ID NO: 4872862 - DNA, 18 bp, Homo sapiens
tgcagaagcaataataaa

SEQ ID NO: 4872863 - DNA, 21 bp, Homo sapiens
tgcagaagcaataataaagta

SEQ ID NO: 4872864 - DNA, 14 bp, Homo sapiens
tgcagacagccatg

SEQ ID NO: 4872865 - DNA, 15 bp, Homo sapiens
tgcagacagccatgc

SEQ ID NO: 4872866 - DNA, 15 bp, Homo sapiens
tgcagagatttctca

SEQ ID NO: 4872867 - DNA, 20 bp, Homo sapiens
tgcagagatttctcattgac

SEQ ID NO: 4872868 - DNA, 10 bp, Homo sapiens
tgcagagctt

SEQ ID NO: 4872869 - DNA, 13 bp, Homo sapiens
tgcagagcttgtg

SEQ ID NO: 4872870 - DNA, 17 bp, Homo sapiens
tgcagaggttgagagga

SEQ ID NO: 4872871 - DNA, 19 bp, Homo sapiens
tgcagatatctgcatgtgt

SEQ ID NO: 4872872 - DNA, 17 bp, Homo sapiens
tgcagccgcagagaaat

SEQ ID NO: 4872873 - DNA, 17 bp, Homo sapiens
tgcagcctaagaagaag

SEQ ID NO: 4872874 - DNA, 17 bp, Homo sapiens
tgcagccttcatcagaa

SEQ ID NO: 4872875 - DNA, 14 bp, Homo sapiens
tgcagctttgcaaa

SEQ ID NO: 4872876 - DNA, 15 bp, Homo sapiens
tgcagctttgcaaac

SEQ ID NO: 4872877 - DNA, 15 bp, Homo sapiens
tgcaggagcccccct

SEQ ID NO: 4872878 - DNA, 13 bp, Homo sapiens
tgcagggagggga

SEQ ID NO: 4872879 - DNA, 18 bp, Homo sapiens
tgcagggaggggaggcag

SEQ ID NO: 4872880 - DNA, 18 bp, Homo sapiens
tgcataatgtttctggat

SEQ ID NO: 4872881 - DNA, 13 bp, Homo sapiens
tgcatactttgta

SEQ ID NO: 4872882 - DNA, 20 bp, Homo sapiens
tgcatataatgaataaatca

SEQ ID NO: 4872883 - DNA, 20 bp, Homo sapiens
tgcatattataaaggataaa

SEQ ID NO: 4872884 - DNA, 23 bp, Homo sapiens
tgcatattataaaggataaagaa

SEQ ID NO: 4872885 - DNA, 17 bp, Homo sapiens
tgcatcatctcttcctc

SEQ ID NO: 4872886 - DNA, 19 bp, Homo sapiens
tgcatgatttttgccctgc

SEQ ID NO: 4872887 - DNA, 15 bp, Homo sapiens
tgcatgcaaatgagc

SEQ ID NO: 4872888 - DNA, 13 bp, Homo sapiens
tgcatggagaatg

SEQ ID NO: 4872889 - DNA, 16 bp, Homo sapiens
tgcatggggaggcagc

SEQ ID NO: 4872890 - DNA, 17 bp, Homo sapiens
tgcatggggaggcagca

SEQ ID NO: 4872891 - DNA, 18 bp, Homo sapiens
tgcatggggaggcagcag

SEQ ID NO: 4872892 - DNA, 18 bp, Homo sapiens
tgcatgtagaggcttgtt

SEQ ID NO: 4872893 - DNA, 21 bp, Homo sapiens
tgcatgtagaggcttgtttac

SEQ ID NO: 4872894 - DNA, 22 bp, Homo sapiens
tgcattagcctggatcctcagt

SEQ ID NO: 4872895 - DNA, 14 bp, Homo sapiens
tgcattattaaatt

SEQ ID NO: 4872896 - DNA, 18 bp, Homo sapiens
tgcattattaaattgtaa

SEQ ID NO: 4872897 - DNA, 23 bp, Homo sapiens
tgcattcacatttagaaaagtga

SEQ ID NO: 4872898 - DNA, 13 bp, Homo sapiens
tgcatttaataaa

SEQ ID NO: 4872899 - DNA, 18 bp, Homo sapiens
tgcatttaataaagatga

SEQ ID NO: 4872900 - DNA, 20 bp, Homo sapiens
tgcatttaataaagatgagt

SEQ ID NO: 4872901 - DNA, 19 bp, Homo sapiens
tgcattttaaccctatttt

SEQ ID NO: 4872902 - DNA, 14 bp, Homo sapiens
tgcattttgatatt

SEQ ID NO: 4872903 - DNA, 21 bp, Homo sapiens
tgcatttttattaaagcattt

SEQ ID NO: 4872904 - DNA, 19 bp, Homo sapiens
tgccaaagtacagaatttg

SEQ ID NO: 4872905 - DNA, 21 bp, Homo sapiens
tgccaagagctactcccacag

SEQ ID NO: 4872906 - DNA, 23 bp, Homo sapiens
tgccaagagctactcccacagca

SEQ ID NO: 4872907 - DNA, 16 bp, Homo sapiens
tgccaataaagtgatc

SEQ ID NO: 4872908 - DNA, 21 bp, Homo sapiens
tgccaataaagtgatctgtgt

SEQ ID NO: 4872909 - DNA, 17 bp, Homo sapiens
tgccagccactgtgata

SEQ ID NO: 4872910 - DNA, 21 bp, Homo sapiens
tgccagctgcagcctggttgg

SEQ ID NO: 4872911 - DNA, 23 bp, Homo sapiens
tgccaggacatgcaataaaattt

SEQ ID NO: 4872912 - DNA, 20 bp, Homo sapiens
tgccaggtccttgccctttg

SEQ ID NO: 4872913 - DNA, 15 bp, Homo sapiens
tgccagtggtggagg

SEQ ID NO: 4872914 - DNA, 16 bp, Homo sapiens
tgccagtggtggaggt

SEQ ID NO: 4872915 - DNA, 19 bp, Homo sapiens
tgccagtggtggaggtggg

SEQ ID NO: 4872916 - DNA, 20 bp, Homo sapiens
tgccattccaaaatattatg

SEQ ID NO: 4872917 - DNA, 22 bp, Homo sapiens
tgcccaggcatgaaattcttcc

SEQ ID NO: 4872918 - DNA, 19 bp, Homo sapiens
tgcccagtacatttaaatt

SEQ ID NO: 4872919 - DNA, 20 bp, Homo sapiens
tgccccaagtggtgagcaag

SEQ ID NO: 4872920 - DNA, 12 bp, Homo sapiens
tgccccagtgtt

SEQ ID NO: 4872921 - DNA, 23 bp, Homo sapiens
tgcccccaccccatgcccccacc

SEQ ID NO: 4872922 - DNA, 16 bp, Homo sapiens
tgcccctgttcatgtt

SEQ ID NO: 4872923 - DNA, 15 bp, Homo sapiens
tgccccttccctggg

SEQ ID NO: 4872924 - DNA, 21 bp, Homo sapiens
tgccctcctctccctcccact

SEQ ID NO: 4872925 - DNA, 14 bp, Homo sapiens
tgccctctgctctg

SEQ ID NO: 4872926 - DNA, 13 bp, Homo sapiens
tgccctgcgtccc

SEQ ID NO: 4872927 - DNA, 17 bp, Homo sapiens
tgccctgcgtcccttct

SEQ ID NO: 4872928 - DNA, 16 bp, Homo sapiens
tgccctttcctggcag

SEQ ID NO: 4872929 - DNA, 14 bp, Homo sapiens
tgccgttttctggg

SEQ ID NO: 4872930 - DNA, 17 bp, Homo sapiens
tgcctcaggacccatcc

SEQ ID NO: 4872931 - DNA, 18 bp, Homo sapiens
tgcctcatattgtcctct

SEQ ID NO: 4872932 - DNA, 16 bp, Homo sapiens
tgcctcattttgcttc

SEQ ID NO: 4872933 - DNA, 19 bp, Homo sapiens
tgcctcccaaggtcctctc

SEQ ID NO: 4872934 - DNA, 22 bp, Homo sapiens
tgcctctgccaaaggatgtgat

SEQ ID NO: 4872935 - DNA, 20 bp, Homo sapiens
tgcctgatttcattcctcga

SEQ ID NO: 4872936 - DNA, 16 bp, Homo sapiens
tgcctgctttttggaa

SEQ ID NO: 4872937 - DNA, 15 bp, Homo sapiens
tgcctggaggctcct

SEQ ID NO: 4872938 - DNA, 18 bp, Homo sapiens
tgcctggaggctcctcta

SEQ ID NO: 4872939 - DNA, 22 bp, Homo sapiens
tgcctggagtgtcggatcctgt

SEQ ID NO: 4872940 - DNA, 23 bp, Homo sapiens
tgcctggggcctccagaagctgc

SEQ ID NO: 4872941 - DNA, 19 bp, Homo sapiens
tgcctgtgagcatggggcc

SEQ ID NO: 4872942 - DNA, 21 bp, Homo sapiens
tgccttgcttctgtatttcct

SEQ ID NO: 4872943 - DNA, 16 bp, Homo sapiens
tgccttgtataatatt

SEQ ID NO: 4872944 - DNA, 14 bp, Homo sapiens
tgctacaattttaa

SEQ ID NO: 4872945 - DNA, 13 bp, Homo sapiens
tgctactgttgta

SEQ ID NO: 4872946 - DNA, 23 bp, Homo sapiens
tgctactgttgtaagaattctga

SEQ ID NO: 4872947 - DNA, 13 bp, Homo sapiens
tgctataatctgt

SEQ ID NO: 4872948 - DNA, 17 bp, Homo sapiens
tgctataatctgttttt

SEQ ID NO: 4872949 - DNA, 21 bp, Homo sapiens
tgctataatctgtttttacgt

SEQ ID NO: 4872950 - DNA, 14 bp, Homo sapiens
tgctcatgctgctc

SEQ ID NO: 4872951 - DNA, 20 bp, Homo sapiens
tgctcccattcctccctccg

SEQ ID NO: 4872952 - DNA, 16 bp, Homo sapiens
tgctcccctaaagcca

SEQ ID NO: 4872953 - DNA, 23 bp, Homo sapiens
tgctcccctaaagccaggctcag

SEQ ID NO: 4872954 - DNA, 14 bp, Homo sapiens
tgctcctcacctgt

SEQ ID NO: 4872955 - DNA, 15 bp, Homo sapiens
tgctcctctcttggg

SEQ ID NO: 4872956 - DNA, 21 bp, Homo sapiens
tgctcctcttgttcctgaaat

SEQ ID NO: 4872957 - DNA, 22 bp, Homo sapiens
tgctcctcttgttcctgaaatg

SEQ ID NO: 4872958 - DNA, 15 bp, Homo sapiens
tgctcctgtggcagg

SEQ ID NO: 4872959 - DNA, 13 bp, Homo sapiens
tgctcggctactg

SEQ ID NO: 4872960 - DNA, 15 bp, Homo sapiens
tgctcggctactggt

SEQ ID NO: 4872961 - DNA, 23 bp, Homo sapiens
tgctcggctactggttacctgga

SEQ ID NO: 4872962 - DNA, 12 bp, Homo sapiens
tgctctgcctgg

SEQ ID NO: 4872963 - DNA, 15 bp, Homo sapiens
tgctctgcctggagt

SEQ ID NO: 4872964 - DNA, 15 bp, Homo sapiens
tgctctggagcagcc

SEQ ID NO: 4872965 - DNA, 18 bp, Homo sapiens
tgctctggagcagccaag

SEQ ID NO: 4872966 - DNA, 11 bp, Homo sapiens
tgctcttccca

SEQ ID NO: 4872967 - DNA, 12 bp, Homo sapiens
tgctcttcccac

SEQ ID NO: 4872968 - DNA, 18 bp, Homo sapiens
tgctcttcccactccagc

SEQ ID NO: 4872969 - DNA, 22 bp, Homo sapiens
tgctgaacaggaaagagctagg

SEQ ID NO: 4872970 - DNA, 15 bp, Homo sapiens
tgctgagaaaacatg

SEQ ID NO: 4872971 - DNA, 16 bp, Homo sapiens
tgctgcaaggtggcct

SEQ ID NO: 4872972 - DNA, 21 bp, Homo sapiens
tgctgcacacactcacctcta

SEQ ID NO: 4872973 - DNA, 13 bp, Homo sapiens
tgctgcctcagga

SEQ ID NO: 4872974 - DNA, 18 bp, Homo sapiens
tgctgctcccctaaagcc

SEQ ID NO: 4872975 - DNA, 23 bp, Homo sapiens
tgctgctcccctaaagccaggct

SEQ ID NO: 4872976 - DNA, 19 bp, Homo sapiens
tgctgctcctctcttgggt

SEQ ID NO: 4872977 - DNA, 13 bp, Homo sapiens
tgctgctgctgcc

SEQ ID NO: 4872978 - DNA, 18 bp, Homo sapiens
tgctgctgtggagtgagg

SEQ ID NO: 4872979 - DNA, 13 bp, Homo sapiens
tgctgggcaatga

SEQ ID NO: 4872980 - DNA, 17 bp, Homo sapiens
tgctgggcagagggagg

SEQ ID NO: 4872981 - DNA, 14 bp, Homo sapiens
tgctggtgaacact

SEQ ID NO: 4872982 - DNA, 17 bp, Homo sapiens
tgctgtagcctattttt

SEQ ID NO: 4872983 - DNA, 11 bp, Homo sapiens
tgctgtgcttt

SEQ ID NO: 4872984 - DNA, 13 bp, Homo sapiens
tgctgtgctttgg

SEQ ID NO: 4872985 - DNA, 14 bp, Homo sapiens
tgctgtgctttgga

SEQ ID NO: 4872986 - DNA, 16 bp, Homo sapiens
tgctgtggagtgaggt

SEQ ID NO: 4872987 - DNA, 21 bp, Homo sapiens
tgcttaatcttcaaagccttc

SEQ ID NO: 4872988 - DNA, 19 bp, Homo sapiens
tgcttataacctagttaaa

SEQ ID NO: 4872989 - DNA, 17 bp, Homo sapiens
tgcttattatgtaggta

SEQ ID NO: 4872990 - DNA, 16 bp, Homo sapiens
tgcttcactgccccct

SEQ ID NO: 4872991 - DNA, 14 bp, Homo sapiens
tgcttcccatctga

SEQ ID NO: 4872992 - DNA, 13 bp, Homo sapiens
tgcttccctagga

SEQ ID NO: 4872993 - DNA, 15 bp, Homo sapiens
tgcttcccttacttt

SEQ ID NO: 4872994 - DNA, 11 bp, Homo sapiens
tgcttcctgat

SEQ ID NO: 4872995 - DNA, 14 bp, Homo sapiens
tgcttcgactactg

SEQ ID NO: 4872996 - DNA, 22 bp, Homo sapiens
tgcttctcacactggaggagca

SEQ ID NO: 4872997 - DNA, 17 bp, Homo sapiens
tgcttgactttccagaa

SEQ ID NO: 4872998 - DNA, 14 bp, Homo sapiens
tgcttgcatggaga

SEQ ID NO: 4872999 - DNA, 17 bp, Homo sapiens
tgcttgcggcaaaagga

SEQ ID NO: 4873000 - DNA, 21 bp, Homo sapiens
tgcttgcggcaaaaggaaagc

SEQ ID NO: 4873001 - DNA, 15 bp, Homo sapiens
tgcttggcccttcaa

SEQ ID NO: 4873002 - DNA, 15 bp, Homo sapiens
tgcttgtcttctggt

SEQ ID NO: 4873003 - DNA, 20 bp, Homo sapiens
tgcttgtcttctggtacttt

SEQ ID NO: 4873004 - DNA, 20 bp, Homo sapiens
tgctttattaatgttttcaa

SEQ ID NO: 4873005 - DNA, 16 bp, Homo sapiens
tgctttgcattttgat

SEQ ID NO: 4873006 - DNA, 21 bp, Homo sapiens
tgctttggaagatgcagaagc

SEQ ID NO: 4873007 - DNA, 13 bp, Homo sapiens
tgctttttggaaa

SEQ ID NO: 4873008 - DNA, 20 bp, Homo sapiens
tgcttttttccaaaacaaaa

SEQ ID NO: 4873009 - DNA, 12 bp, Homo sapiens
tggaaaagacag

SEQ ID NO: 4873010 - DNA, 21 bp, Homo sapiens
tggaaagcacaagactggccc

SEQ ID NO: 4873011 - DNA, 19 bp, Homo sapiens
tggaaagcagagttttcat

SEQ ID NO: 4873012 - DNA, 19 bp, Homo sapiens
tggaaattcctgtactgtg

SEQ ID NO: 4873013 - DNA, 19 bp, Homo sapiens
tggaacaatcacagggaat

SEQ ID NO: 4873014 - DNA, 16 bp, Homo sapiens
tggaagagggaggggc

SEQ ID NO: 4873015 - DNA, 17 bp, Homo sapiens
tggaagagggaggggcc

SEQ ID NO: 4873016 - DNA, 17 bp, Homo sapiens
tggaagatgcagaagca

SEQ ID NO: 4873017 - DNA, 21 bp, Homo sapiens
tggaagatgcagaagcaataa

SEQ ID NO: 4873018 - DNA, 14 bp, Homo sapiens
tggaaggcagagaa

SEQ ID NO: 4873019 - DNA, 17 bp, Homo sapiens
tggaaggcagagaaatc

SEQ ID NO: 4873020 - DNA, 20 bp, Homo sapiens
tggaaggcagagaaatctaa

SEQ ID NO: 4873021 - DNA, 17 bp, Homo sapiens
tggaagggaccccagat

SEQ ID NO: 4873022 - DNA, 16 bp, Homo sapiens
tggaagtacttggccc

SEQ ID NO: 4873023 - DNA, 16 bp, Homo sapiens
tggacatctgacccca

SEQ ID NO: 4873024 - DNA, 18 bp, Homo sapiens
tggacatgagagtagggc

SEQ ID NO: 4873025 - DNA, 23 bp, Homo sapiens
tggacatgagagtagggccctga

SEQ ID NO: 4873026 - DNA, 19 bp, Homo sapiens
tggacatttagaagaaaga

SEQ ID NO: 4873027 - DNA, 17 bp, Homo sapiens
tggacgggatgacctcc

SEQ ID NO: 4873028 - DNA, 20 bp, Homo sapiens
tggacgggatgacctccaga

SEQ ID NO: 4873029 - DNA, 22 bp, Homo sapiens
tggacgggatgacctccagaag

SEQ ID NO: 4873030 - DNA, 16 bp, Homo sapiens
tggacgttaggccagg

SEQ ID NO: 4873031 - DNA, 20 bp, Homo sapiens
tggactgcatggggaggcag

SEQ ID NO: 4873032 - DNA, 17 bp, Homo sapiens
tggactggaaagcacaa

SEQ ID NO: 4873033 - DNA, 11 bp, Homo sapiens
tggacttctga

SEQ ID NO: 4873034 - DNA, 22 bp, Homo sapiens
tggagaaaatgggtttattcac

SEQ ID NO: 4873035 - DNA, 18 bp, Homo sapiens
tggagaatactgccaaaa

SEQ ID NO: 4873036 - DNA, 20 bp, Homo sapiens
tggagaatgggacgaggaca

SEQ ID NO: 4873037 - DNA, 22 bp, Homo sapiens
tggagacgtttataaacagaaa

SEQ ID NO: 4873038 - DNA, 15 bp, Homo sapiens
tggagcagagctctc

SEQ ID NO: 4873039 - DNA, 15 bp, Homo sapiens
tggagcagcaggcct

SEQ ID NO: 4873040 - DNA, 17 bp, Homo sapiens
tggagcagcaggcctct

SEQ ID NO: 4873041 - DNA, 18 bp, Homo sapiens
tggagcagcaggcctctg

SEQ ID NO: 4873042 - DNA, 19 bp, Homo sapiens
tggagcaggcccaatgctg

SEQ ID NO: 4873043 - DNA, 12 bp, Homo sapiens
tggagccccagg

SEQ ID NO: 4873044 - DNA, 22 bp, Homo sapiens
tggagcctacctctgtctgaga

SEQ ID NO: 4873045 - DNA, 17 bp, Homo sapiens
tggagctcagggtcctt

SEQ ID NO: 4873046 - DNA, 20 bp, Homo sapiens
tggagcttcagccaggtctg

SEQ ID NO: 4873047 - DNA, 11 bp, Homo sapiens
tggaggagcac

SEQ ID NO: 4873048 - DNA, 14 bp, Homo sapiens
tggaggctcctcta

SEQ ID NO: 4873049 - DNA, 15 bp, Homo sapiens
tggaggctcctctag

SEQ ID NO: 4873050 - DNA, 19 bp, Homo sapiens
tggagtgggaagggagcat

SEQ ID NO: 4873051 - DNA, 17 bp, Homo sapiens
tggagtgtcggatcctg

SEQ ID NO: 4873052 - DNA, 19 bp, Homo sapiens
tggagtgtcggatcctgtg

SEQ ID NO: 4873053 - DNA, 16 bp, Homo sapiens
tggagtgtgcagacag

SEQ ID NO: 4873054 - DNA, 21 bp, Homo sapiens
tggagtgtgcagacagccatg

SEQ ID NO: 4873055 - DNA, 22 bp, Homo sapiens
tggagtgtgcagacagccatgc

SEQ ID NO: 4873056 - DNA, 16 bp, Homo sapiens
tggatactggggggca

SEQ ID NO: 4873057 - DNA, 18 bp, Homo sapiens
tggatactggggggcagg

SEQ ID NO: 4873058 - DNA, 14 bp, Homo sapiens
tggatattgttacg

SEQ ID NO: 4873059 - DNA, 14 bp, Homo sapiens
tggatcacaaagtg

SEQ ID NO: 4873060 - DNA, 15 bp, Homo sapiens
tggatcacaaagtgg

SEQ ID NO: 4873061 - DNA, 18 bp, Homo sapiens
tggatcgagtgtagctgt

SEQ ID NO: 4873062 - DNA, 21 bp, Homo sapiens
tggatgcaaatagattcagag

SEQ ID NO: 4873063 - DNA, 20 bp, Homo sapiens
tggatgcctcattatgtcaa

SEQ ID NO: 4873064 - DNA, 11 bp, Homo sapiens
tggatgtctgg

SEQ ID NO: 4873065 - DNA, 18 bp, Homo sapiens
tggatttggcactagcca

SEQ ID NO: 4873066 - DNA, 17 bp, Homo sapiens
tggcacaaaagacagct

SEQ ID NO: 4873067 - DNA, 18 bp, Homo sapiens
tggcacaatgttggagca

SEQ ID NO: 4873068 - DNA, 19 bp, Homo sapiens
tggcacaatgttggagcag

SEQ ID NO: 4873069 - DNA, 20 bp, Homo sapiens
tggcacaatgttggagcagc

SEQ ID NO: 4873070 - DNA, 19 bp, Homo sapiens
tggcagagaccataagaga

SEQ ID NO: 4873071 - DNA, 20 bp, Homo sapiens
tggcagagaccataagagaa

SEQ ID NO: 4873072 - DNA, 21 bp, Homo sapiens
tggcagagaccataagagaaa

SEQ ID NO: 4873073 - DNA, 18 bp, Homo sapiens
tggcagatgggggcctct

SEQ ID NO: 4873074 - DNA, 14 bp, Homo sapiens
tggcagctagtgcc

SEQ ID NO: 4873075 - DNA, 17 bp, Homo sapiens
tggcagcttgctgggct

SEQ ID NO: 4873076 - DNA, 20 bp, Homo sapiens
tggcagcttgctgggctttg

SEQ ID NO: 4873077 - DNA, 19 bp, Homo sapiens
tggcaggagtctctgccag

SEQ ID NO: 4873078 - DNA, 15 bp, Homo sapiens
tggcataaattgcat

SEQ ID NO: 4873079 - DNA, 14 bp, Homo sapiens
tggcatggcaggag

SEQ ID NO: 4873080 - DNA, 15 bp, Homo sapiens
tggcatggcaggagt

SEQ ID NO: 4873081 - DNA, 22 bp, Homo sapiens
tggcattctttgcaatactgct

SEQ ID NO: 4873082 - DNA, 17 bp, Homo sapiens
tggccacaaacctgccc

SEQ ID NO: 4873083 - DNA, 18 bp, Homo sapiens
tggccagcccgcagaggt

SEQ ID NO: 4873084 - DNA, 20 bp, Homo sapiens
tggccagcccgcagaggtgg

SEQ ID NO: 4873085 - DNA, 12 bp, Homo sapiens
tggccaggcagg

SEQ ID NO: 4873086 - DNA, 19 bp, Homo sapiens
tggcccccttcaggagcct

SEQ ID NO: 4873087 - DNA, 20 bp, Homo sapiens
tggcccccttcaggagcctg

SEQ ID NO: 4873088 - DNA, 22 bp, Homo sapiens
tggcccccttcaggagcctggc

SEQ ID NO: 4873089 - DNA, 16 bp, Homo sapiens
tggcctctgcctgggg

SEQ ID NO: 4873090 - DNA, 20 bp, Homo sapiens
tggcctgagaattgagggga

SEQ ID NO: 4873091 - DNA, 13 bp, Homo sapiens
tggcctgcaggag

SEQ ID NO: 4873092 - DNA, 14 bp, Homo sapiens
tggcctgcaggagg

SEQ ID NO: 4873093 - DNA, 11 bp, Homo sapiens
tggcctggagc

SEQ ID NO: 4873094 - DNA, 14 bp, Homo sapiens
tggcctggagcagg

SEQ ID NO: 4873095 - DNA, 15 bp, Homo sapiens
tggcctggagcaggc

SEQ ID NO: 4873096 - DNA, 16 bp, Homo sapiens
tggcctggagcaggcc

SEQ ID NO: 4873097 - DNA, 18 bp, Homo sapiens
tggcctttatgttctttc

SEQ ID NO: 4873098 - DNA, 19 bp, Homo sapiens
tggcctttatgttctttca

SEQ ID NO: 4873099 - DNA, 13 bp, Homo sapiens
tggcgatgtgtta

SEQ ID NO: 4873100 - DNA, 22 bp, Homo sapiens
tggcgtagcagagttaaatctc

SEQ ID NO: 4873101 - DNA, 17 bp, Homo sapiens
tggctcaaagcagcagg

SEQ ID NO: 4873102 - DNA, 13 bp, Homo sapiens
tggctcactactg

SEQ ID NO: 4873103 - DNA, 17 bp, Homo sapiens
tggctcactactgaaca

SEQ ID NO: 4873104 - DNA, 17 bp, Homo sapiens
tggctgaagctggagca

SEQ ID NO: 4873105 - DNA, 19 bp, Homo sapiens
tggctgaagctggagcagc

SEQ ID NO: 4873106 - DNA, 20 bp, Homo sapiens
tggctgacttacatcatgtg

SEQ ID NO: 4873107 - DNA, 20 bp, Homo sapiens
tggctgggaagactatggtg

SEQ ID NO: 4873108 - DNA, 13 bp, Homo sapiens
tggcttcaaaaag

SEQ ID NO: 4873109 - DNA, 15 bp, Homo sapiens
tggcttcaaaaagcc

SEQ ID NO: 4873110 - DNA, 15 bp, Homo sapiens
tggctttaagccttc

SEQ ID NO: 4873111 - DNA, 14 bp, Homo sapiens
tggctttgtcactt

SEQ ID NO: 4873112 - DNA, 21 bp, Homo sapiens
tgggaaaacatgttaatgaca

SEQ ID NO: 4873113 - DNA, 15 bp, Homo sapiens
tgggaaaggcagggc

SEQ ID NO: 4873114 - DNA, 16 bp, Homo sapiens
tgggaaaggcagggcc

SEQ ID NO: 4873115 - DNA, 17 bp, Homo sapiens
tgggaaaggcagggccc

SEQ ID NO: 4873116 - DNA, 15 bp, Homo sapiens
tgggaagtttgctgt

SEQ ID NO: 4873117 - DNA, 18 bp, Homo sapiens
tgggaagtttgctgtgct

SEQ ID NO: 4873118 - DNA, 22 bp, Homo sapiens
tgggaagtttgctgtgctttgg

SEQ ID NO: 4873119 - DNA, 23 bp, Homo sapiens
tgggaagtttgctgtgctttgga

SEQ ID NO: 4873120 - DNA, 21 bp, Homo sapiens
tgggacagtggtgacatagtc

SEQ ID NO: 4873121 - DNA, 16 bp, Homo sapiens
tgggacccacagaact

SEQ ID NO: 4873122 - DNA, 20 bp, Homo sapiens
tgggacctgtggtcatgtga

SEQ ID NO: 4873123 - DNA, 12 bp, Homo sapiens
tgggagacagca

SEQ ID NO: 4873124 - DNA, 17 bp, Homo sapiens
tgggagacagcagcctg

SEQ ID NO: 4873125 - DNA, 20 bp, Homo sapiens
tgggagccacttctccccag

SEQ ID NO: 4873126 - DNA, 12 bp, Homo sapiens
tgggagccagga

SEQ ID NO: 4873127 - DNA, 14 bp, Homo sapiens
tgggatattcttta

SEQ ID NO: 4873128 - DNA, 16 bp, Homo sapiens
tgggatattttgaaat

SEQ ID NO: 4873129 - DNA, 18 bp, Homo sapiens
tgggatattttgaaatga

SEQ ID NO: 4873130 - DNA, 22 bp, Homo sapiens
tgggatattttgaaatgaactt

SEQ ID NO: 4873131 - DNA, 15 bp, Homo sapiens
tgggattagaaacaa

SEQ ID NO: 4873132 - DNA, 12 bp, Homo sapiens
tgggcaagcaga

SEQ ID NO: 4873133 - DNA, 17 bp, Homo sapiens
tgggcacaaacagaatt

SEQ ID NO: 4873134 - DNA, 21 bp, Homo sapiens
tgggcacatagcataggctgg

SEQ ID NO: 4873135 - DNA, 20 bp, Homo sapiens
tgggcactgcggctgtctcc

SEQ ID NO: 4873136 - DNA, 20 bp, Homo sapiens
tgggcattagcaaggcagag

SEQ ID NO: 4873137 - DNA, 17 bp, Homo sapiens
tgggcctctcctgccct

SEQ ID NO: 4873138 - DNA, 14 bp, Homo sapiens
tgggcctgttcctt

SEQ ID NO: 4873139 - DNA, 14 bp, Homo sapiens
tgggcgtgtgtgac

SEQ ID NO: 4873140 - DNA, 18 bp, Homo sapiens
tgggcgtgtgtgacactg

SEQ ID NO: 4873141 - DNA, 14 bp, Homo sapiens
tgggctcagcctgg

SEQ ID NO: 4873142 - DNA, 14 bp, Homo sapiens
tgggctgtgaggac

SEQ ID NO: 4873143 - DNA, 17 bp, Homo sapiens
tgggctgtgaggacagg

SEQ ID NO: 4873144 - DNA, 19 bp, Homo sapiens
tgggctgtgaggacagggc

SEQ ID NO: 4873145 - DNA, 21 bp, Homo sapiens
tgggctgtgaggacagggccc

SEQ ID NO: 4873146 - DNA, 22 bp, Homo sapiens
tgggcttttggggagccagaag

SEQ ID NO: 4873147 - DNA, 24 bp, Homo sapiens
tggggaataatttccttcaggcag

SEQ ID NO: 4873148 - DNA, 20 bp, Homo sapiens
tggggagccctattgctgct

SEQ ID NO: 4873149 - DNA, 16 bp, Homo sapiens
tggggattggtgggtc

SEQ ID NO: 4873150 - DNA, 21 bp, Homo sapiens
tggggcctcaggctccgggca

SEQ ID NO: 4873151 - DNA, 24 bp, Homo sapiens
tggggctgagccctcctgagggcc

SEQ ID NO: 4873152 - DNA, 17 bp, Homo sapiens
tgggggagattgaactt

SEQ ID NO: 4873153 - DNA, 23 bp, Homo sapiens
tgggggcttctctgctgagaagg

SEQ ID NO: 4873154 - DNA, 12 bp, Homo sapiens
tggggggcaggc

SEQ ID NO: 4873155 - DNA, 15 bp, Homo sapiens
tggggggtgggcttt

SEQ ID NO: 4873156 - DNA, 17 bp, Homo sapiens
tggggtgctggggctgc

SEQ ID NO: 4873157 - DNA, 17 bp, Homo sapiens
tgggtcatttagaagcc

SEQ ID NO: 4873158 - DNA, 13 bp, Homo sapiens
tgggtccagggag

SEQ ID NO: 4873159 - DNA, 23 bp, Homo sapiens
tgggtccccccgagtctccggga

SEQ ID NO: 4873160 - DNA, 12 bp, Homo sapiens
tgggtgacattt

SEQ ID NO: 4873161 - DNA, 18 bp, Homo sapiens
tgggtgtttgggaaaggc

SEQ ID NO: 4873162 - DNA, 16 bp, Homo sapiens
tgggtttgggagccag

SEQ ID NO: 4873163 - DNA, 18 bp, Homo sapiens
tgggtttgggagccagga

SEQ ID NO: 4873164 - DNA, 13 bp, Homo sapiens
tggtaaatgtttc

SEQ ID NO: 4873165 - DNA, 23 bp, Homo sapiens
tggtaatcccctaaaataacagt

SEQ ID NO: 4873166 - DNA, 14 bp, Homo sapiens
tggtaattgggaac

SEQ ID NO: 4873167 - DNA, 20 bp, Homo sapiens
tggtagctgggaaagcataa

SEQ ID NO: 4873168 - DNA, 20 bp, Homo sapiens
tggtcatgtgagtctgggat

SEQ ID NO: 4873169 - DNA, 17 bp, Homo sapiens
tggtcctagtaagaaga

SEQ ID NO: 4873170 - DNA, 20 bp, Homo sapiens
tggtcctatttttgtgaaga

SEQ ID NO: 4873171 - DNA, 23 bp, Homo sapiens
tggtctcccatatgcagaaatag

SEQ ID NO: 4873172 - DNA, 12 bp, Homo sapiens
tggtctgccaat

SEQ ID NO: 4873173 - DNA, 19 bp, Homo sapiens
tggtctgccaatctgtaca

SEQ ID NO: 4873174 - DNA, 20 bp, Homo sapiens
tggtctgccaatctgtacaa

SEQ ID NO: 4873175 - DNA, 16 bp, Homo sapiens
tggtgaacactgtgac

SEQ ID NO: 4873176 - DNA, 19 bp, Homo sapiens
tggtgaatgtgtgagaaaa

SEQ ID NO: 4873177 - DNA, 12 bp, Homo sapiens
tggtgagcaagc

SEQ ID NO: 4873178 - DNA, 19 bp, Homo sapiens
tggtgagcaagcaccaacc

SEQ ID NO: 4873179 - DNA, 14 bp, Homo sapiens
tggtgatttgaaaa

SEQ ID NO: 4873180 - DNA, 20 bp, Homo sapiens
tggtgatttgaaaaatataa

SEQ ID NO: 4873181 - DNA, 13 bp, Homo sapiens
tggtggaggtggg

SEQ ID NO: 4873182 - DNA, 14 bp, Homo sapiens
tggtggctcatgcc

SEQ ID NO: 4873183 - DNA, 13 bp, Homo sapiens
tggtggtgaaggg

SEQ ID NO: 4873184 - DNA, 16 bp, Homo sapiens
tggtggtgaaggggct

SEQ ID NO: 4873185 - DNA, 17 bp, Homo sapiens
tggtgtggggcgtggat

SEQ ID NO: 4873186 - DNA, 12 bp, Homo sapiens
tggttaattttt

SEQ ID NO: 4873187 - DNA, 20 bp, Homo sapiens
tggttaatttttcctgcatg

SEQ ID NO: 4873188 - DNA, 19 bp, Homo sapiens
tggttacctggagaagtag

SEQ ID NO: 4873189 - DNA, 15 bp, Homo sapiens
tggttccatgttgac

SEQ ID NO: 4873190 - DNA, 22 bp, Homo sapiens
tggttcggctctagggcctcag

SEQ ID NO: 4873191 - DNA, 14 bp, Homo sapiens
tggttctgaggcca

SEQ ID NO: 4873192 - DNA, 16 bp, Homo sapiens
tggttctgaggccaga

SEQ ID NO: 4873193 - DNA, 16 bp, Homo sapiens
tggttgggaatgagga

SEQ ID NO: 4873194 - DNA, 23 bp, Homo sapiens
tggttgggaatgaggaaaattct

SEQ ID NO: 4873195 - DNA, 18 bp, Homo sapiens
tggtttattctttgcaaa

SEQ ID NO: 4873196 - DNA, 22 bp, Homo sapiens
tggtttgcaacctctttgctca

SEQ ID NO: 4873197 - DNA, 12 bp, Homo sapiens
tgtaaaaatctt

SEQ ID NO: 4873198 - DNA, 11 bp, Homo sapiens
tgtaaagatgt

SEQ ID NO: 4873199 - DNA, 20 bp, Homo sapiens
tgtaaagtgtgtgattgaag

SEQ ID NO: 4873200 - DNA, 17 bp, Homo sapiens
tgtaaatgaagatcttt

SEQ ID NO: 4873201 - DNA, 22 bp, Homo sapiens
tgtaaatgaagatctttatatt

SEQ ID NO: 4873202 - DNA, 16 bp, Homo sapiens
tgtaaccagctcagtg

SEQ ID NO: 4873203 - DNA, 19 bp, Homo sapiens
tgtaacttccaaataaata

SEQ ID NO: 4873204 - DNA, 17 bp, Homo sapiens
tgtaagtttgtgtaaat

SEQ ID NO: 4873205 - DNA, 14 bp, Homo sapiens
tgtaataatagact

SEQ ID NO: 4873206 - DNA, 17 bp, Homo sapiens
tgtaataatgtaacatg

SEQ ID NO: 4873207 - DNA, 22 bp, Homo sapiens
tgtaataatgtaacatgatttc

SEQ ID NO: 4873208 - DNA, 13 bp, Homo sapiens
tgtaatctatgtt

SEQ ID NO: 4873209 - DNA, 17 bp, Homo sapiens
tgtaatctatgtttata

SEQ ID NO: 4873210 - DNA, 19 bp, Homo sapiens
tgtaatctcaatgcaagcc

SEQ ID NO: 4873211 - DNA, 16 bp, Homo sapiens
tgtaatgctgcctcag

SEQ ID NO: 4873212 - DNA, 16 bp, Homo sapiens
tgtaattgtgtggatt

SEQ ID NO: 4873213 - DNA, 21 bp, Homo sapiens
tgtaattgtgtggattcttta

SEQ ID NO: 4873214 - DNA, 23 bp, Homo sapiens
tgtaattttattttaaaatttca

SEQ ID NO: 4873215 - DNA, 11 bp, Homo sapiens
tgtacaaaagc

SEQ ID NO: 4873216 - DNA, 14 bp, Homo sapiens
tgtacaaaatggtc

SEQ ID NO: 4873217 - DNA, 24 bp, Homo sapiens
tgtacaaaattaagcaaatgttaa

SEQ ID NO: 4873218 - DNA, 14 bp, Homo sapiens
tgtacagattcttt

SEQ ID NO: 4873219 - DNA, 16 bp, Homo sapiens
tgtacagtctgctcct

SEQ ID NO: 4873220 - DNA, 19 bp, Homo sapiens
tgtacagtctgctcctctt

SEQ ID NO: 4873221 - DNA, 15 bp, Homo sapiens
tgtacatatgtgctg

SEQ ID NO: 4873222 - DNA, 13 bp, Homo sapiens
tgtaccaaaattt

SEQ ID NO: 4873223 - DNA, 14 bp, Homo sapiens
tgtactaaacagta

SEQ ID NO: 4873224 - DNA, 17 bp, Homo sapiens
tgtactgatttcagtaa

SEQ ID NO: 4873225 - DNA, 22 bp, Homo sapiens
tgtactgcaaagtcgccagtca

SEQ ID NO: 4873226 - DNA, 19 bp, Homo sapiens
tgtactttatcatgaatgc

SEQ ID NO: 4873227 - DNA, 18 bp, Homo sapiens
tgtagaaactgaggccca

SEQ ID NO: 4873228 - DNA, 16 bp, Homo sapiens
tgtagacaaagtacat

SEQ ID NO: 4873229 - DNA, 17 bp, Homo sapiens
tgtagaggcataaacct

SEQ ID NO: 4873230 - DNA, 16 bp, Homo sapiens
tgtagatggcgatgtg

SEQ ID NO: 4873231 - DNA, 17 bp, Homo sapiens
tgtagatggcgatgtgt

SEQ ID NO: 4873232 - DNA, 20 bp, Homo sapiens
tgtagatgggggaactgtga

SEQ ID NO: 4873233 - DNA, 21 bp, Homo sapiens
tgtagatgggggaactgtgaa

SEQ ID NO: 4873234 - DNA, 13 bp, Homo sapiens
tgtagcagaaacc

SEQ ID NO: 4873235 - DNA, 17 bp, Homo sapiens
tgtagtcccggaggcct

SEQ ID NO: 4873236 - DNA, 19 bp, Homo sapiens
tgtagtcccggaggccttc

SEQ ID NO: 4873237 - DNA, 22 bp, Homo sapiens
tgtagtcccggaggccttccct

SEQ ID NO: 4873238 - DNA, 13 bp, Homo sapiens
tgtataaaagtgt

SEQ ID NO: 4873239 - DNA, 13 bp, Homo sapiens
tgtataaatatac

SEQ ID NO: 4873240 - DNA, 22 bp, Homo sapiens
tgtataatattgaaaattgaaa

SEQ ID NO: 4873241 - DNA, 18 bp, Homo sapiens
tgtatataaactgggatg

SEQ ID NO: 4873242 - DNA, 17 bp, Homo sapiens
tgtatatatgtatttct

SEQ ID NO: 4873243 - DNA, 19 bp, Homo sapiens
tgtatatatgtatttctat

SEQ ID NO: 4873244 - DNA, 22 bp, Homo sapiens
tgtatatattttgtgtgaaatt

SEQ ID NO: 4873245 - DNA, 17 bp, Homo sapiens
tgtatatgactgcattt

SEQ ID NO: 4873246 - DNA, 22 bp, Homo sapiens
tgtatattttaagaaataacag

SEQ ID NO: 4873247 - DNA, 15 bp, Homo sapiens
tgtatccaggcctgg

SEQ ID NO: 4873248 - DNA, 14 bp, Homo sapiens
tgtatgatactaaa

SEQ ID NO: 4873249 - DNA, 22 bp, Homo sapiens
tgtatgggggagattgaacttt

SEQ ID NO: 4873250 - DNA, 17 bp, Homo sapiens
tgtatgtcaaagctttg

SEQ ID NO: 4873251 - DNA, 18 bp, Homo sapiens
tgtattggtgttgcagcc

SEQ ID NO: 4873252 - DNA, 11 bp, Homo sapiens
tgtatttcctt

SEQ ID NO: 4873253 - DNA, 17 bp, Homo sapiens
tgtattttatcttattt

SEQ ID NO: 4873254 - DNA, 23 bp, Homo sapiens
tgtattttatcttattttctcaa

SEQ ID NO: 4873255 - DNA, 12 bp, Homo sapiens
tgtattttcatg

SEQ ID NO: 4873256 - DNA, 13 bp, Homo sapiens
tgtcaaagctttg

SEQ ID NO: 4873257 - DNA, 17 bp, Homo sapiens
tgtcacttttccttttc

SEQ ID NO: 4873258 - DNA, 21 bp, Homo sapiens
tgtcagaacagagtgcaaccc

SEQ ID NO: 4873259 - DNA, 18 bp, Homo sapiens
tgtcagaagcctccaagc

SEQ ID NO: 4873260 - DNA, 20 bp, Homo sapiens
tgtcagctgctgttgaactt

SEQ ID NO: 4873261 - DNA, 17 bp, Homo sapiens
tgtcagtactattcagg

SEQ ID NO: 4873262 - DNA, 19 bp, Homo sapiens
tgtcagtggggcagcctct

SEQ ID NO: 4873263 - DNA, 11 bp, Homo sapiens
tgtcagtgttg

SEQ ID NO: 4873264 - DNA, 21 bp, Homo sapiens
tgtcagttccaaacagacaaa

SEQ ID NO: 4873265 - DNA, 16 bp, Homo sapiens
tgtcattagtcctttg

SEQ ID NO: 4873266 - DNA, 17 bp, Homo sapiens
tgtcattgcacataagc

SEQ ID NO: 4873267 - DNA, 18 bp, Homo sapiens
tgtccaaaatttatattt

SEQ ID NO: 4873268 - DNA, 17 bp, Homo sapiens
tgtccaaacgtcctctt

SEQ ID NO: 4873269 - DNA, 15 bp, Homo sapiens
tgtccagagtctctt

SEQ ID NO: 4873270 - DNA, 15 bp, Homo sapiens
tgtcccacatggcca

SEQ ID NO: 4873271 - DNA, 19 bp, Homo sapiens
tgtcctgcctgtctgaagc

SEQ ID NO: 4873272 - DNA, 14 bp, Homo sapiens
tgtccttcccccag

SEQ ID NO: 4873273 - DNA, 17 bp, Homo sapiens
tgtcggatcctgtgagt

SEQ ID NO: 4873274 - DNA, 18 bp, Homo sapiens
tgtctaggcactgagcag

SEQ ID NO: 4873275 - DNA, 20 bp, Homo sapiens
tgtctaggcactgagcaggg

SEQ ID NO: 4873276 - DNA, 17 bp, Homo sapiens
tgtctgagacaggtgcc

SEQ ID NO: 4873277 - DNA, 19 bp, Homo sapiens
tgtctgcccaatgaataat

SEQ ID NO: 4873278 - DNA, 23 bp, Homo sapiens
tgtctgctaggcgctggggagac

SEQ ID NO: 4873279 - DNA, 17 bp, Homo sapiens
tgtctggcagatgaggg

SEQ ID NO: 4873280 - DNA, 12 bp, Homo sapiens
tgtcttctttct

SEQ ID NO: 4873281 - DNA, 16 bp, Homo sapiens
tgtcttctttctccat

SEQ ID NO: 4873282 - DNA, 19 bp, Homo sapiens
tgtcttctttctccatgga

SEQ ID NO: 4873283 - DNA, 23 bp, Homo sapiens
tgtgaacaagcttcagtaagtta

SEQ ID NO: 4873284 - DNA, 23 bp, Homo sapiens
tgtgaaggcaggggaatgtatgt

SEQ ID NO: 4873285 - DNA, 16 bp, Homo sapiens
tgtgaagtttggagat

SEQ ID NO: 4873286 - DNA, 16 bp, Homo sapiens
tgtgaatttgccagag

SEQ ID NO: 4873287 - DNA, 18 bp, Homo sapiens
tgtgaatttgccagagga

SEQ ID NO: 4873288 - DNA, 14 bp, Homo sapiens
tgtgacactgatga

SEQ ID NO: 4873289 - DNA, 17 bp, Homo sapiens
tgtgacatttatatatt

SEQ ID NO: 4873290 - DNA, 18 bp, Homo sapiens
tgtgacatttatatattg

SEQ ID NO: 4873291 - DNA, 15 bp, Homo sapiens
tgtgactccttatct

SEQ ID NO: 4873292 - DNA, 21 bp, Homo sapiens
tgtgactccttatctctttcc

SEQ ID NO: 4873293 - DNA, 20 bp, Homo sapiens
tgtgactgaagaagatgagc

SEQ ID NO: 4873294 - DNA, 19 bp, Homo sapiens
tgtgacttctcccctgccc

SEQ ID NO: 4873295 - DNA, 12 bp, Homo sapiens
tgtgagaatggc

SEQ ID NO: 4873296 - DNA, 18 bp, Homo sapiens
tgtgagaatggcctggag

SEQ ID NO: 4873297 - DNA, 22 bp, Homo sapiens
tgtgagaatggcctggagcagg

SEQ ID NO: 4873298 - DNA, 15 bp, Homo sapiens
tgtgagatactgtgt

SEQ ID NO: 4873299 - DNA, 20 bp, Homo sapiens
tgtgagcacaaagaagaaag

SEQ ID NO: 4873300 - DNA, 17 bp, Homo sapiens
tgtgagcatggggccag

SEQ ID NO: 4873301 - DNA, 20 bp, Homo sapiens
tgtgagcatggggccaggaa

SEQ ID NO: 4873302 - DNA, 17 bp, Homo sapiens
tgtgaggatagagactt

SEQ ID NO: 4873303 - DNA, 23 bp, Homo sapiens
tgtgaggatagagacttgcagtt

SEQ ID NO: 4873304 - DNA, 15 bp, Homo sapiens
tgtgagtctgggata

SEQ ID NO: 4873305 - DNA, 19 bp, Homo sapiens
tgtgagtttaccttgtata

SEQ ID NO: 4873306 - DNA, 21 bp, Homo sapiens
tgtgatacattttttaagctt

SEQ ID NO: 4873307 - DNA, 22 bp, Homo sapiens
tgtgatacattttttaagcttc

SEQ ID NO: 4873308 - DNA, 21 bp, Homo sapiens
tgtgattactgcaatcactgt

SEQ ID NO: 4873309 - DNA, 16 bp, Homo sapiens
tgtgcaatagaaggtg

SEQ ID NO: 4873310 - DNA, 14 bp, Homo sapiens
tgtgcaataggtga

SEQ ID NO: 4873311 - DNA, 22 bp, Homo sapiens
tgtgcaataggtgagagaatgt

SEQ ID NO: 4873312 - DNA, 14 bp, Homo sapiens
tgtgcacatttctt

SEQ ID NO: 4873313 - DNA, 22 bp, Homo sapiens
tgtgcccctaaagagcatcctg

SEQ ID NO: 4873314 - DNA, 16 bp, Homo sapiens
tgtgctccacactcag

SEQ ID NO: 4873315 - DNA, 21 bp, Homo sapiens
tgtgctgaacataacttctca

SEQ ID NO: 4873316 - DNA, 13 bp, Homo sapiens
tgtgctgcttctc

SEQ ID NO: 4873317 - DNA, 18 bp, Homo sapiens
tgtgctggaattctaaca

SEQ ID NO: 4873318 - DNA, 18 bp, Homo sapiens
tgtgctggtgaacactgt

SEQ ID NO: 4873319 - DNA, 20 bp, Homo sapiens
tgtgctggtgaacactgtga

SEQ ID NO: 4873320 - DNA, 21 bp, Homo sapiens
tgtgctggtgaacactgtgac

SEQ ID NO: 4873321 - DNA, 16 bp, Homo sapiens
tgtgcttcgactactg

SEQ ID NO: 4873322 - DNA, 17 bp, Homo sapiens
tgtgcttcgactactgc

SEQ ID NO: 4873323 - DNA, 15 bp, Homo sapiens
tgtggcaaaaagagt

SEQ ID NO: 4873324 - DNA, 17 bp, Homo sapiens
tgtggcaggaggctttg

SEQ ID NO: 4873325 - DNA, 19 bp, Homo sapiens
tgtggccgtctcctccctc

SEQ ID NO: 4873326 - DNA, 19 bp, Homo sapiens
tgtggctttcagcctctgg

SEQ ID NO: 4873327 - DNA, 13 bp, Homo sapiens
tgtgggaaagagc

SEQ ID NO: 4873328 - DNA, 14 bp, Homo sapiens
tgtgggagacagca

SEQ ID NO: 4873329 - DNA, 15 bp, Homo sapiens
tgtgggagacagcag

SEQ ID NO: 4873330 - DNA, 13 bp, Homo sapiens
tgtggggcgtgga

SEQ ID NO: 4873331 - DNA, 15 bp, Homo sapiens
tgtggtcatgtgagt

SEQ ID NO: 4873332 - DNA, 21 bp, Homo sapiens
tgtggtcatgtgagtctggga

SEQ ID NO: 4873333 - DNA, 23 bp, Homo sapiens
tgtggtctgccaatctgtacaaa

SEQ ID NO: 4873334 - DNA, 20 bp, Homo sapiens
tgtgtaataatgtaacatga

SEQ ID NO: 4873335 - DNA, 21 bp, Homo sapiens
tgtgtcatgaagaatgtttct

SEQ ID NO: 4873336 - DNA, 12 bp, Homo sapiens
tgtgtcatttct

SEQ ID NO: 4873337 - DNA, 23 bp, Homo sapiens
tgtgtggattgcctctgaaaagt

SEQ ID NO: 4873338 - DNA, 14 bp, Homo sapiens
tgtgtggtcaacat

SEQ ID NO: 4873339 - DNA, 23 bp, Homo sapiens
tgtgttactaaaaaaaagatgaa

SEQ ID NO: 4873340 - DNA, 13 bp, Homo sapiens
tgtgttcagaaga

SEQ ID NO: 4873341 - DNA, 23 bp, Homo sapiens
tgtgttcagaagaatcttcctgg

SEQ ID NO: 4873342 - DNA, 15 bp, Homo sapiens
tgtgtttatatggaa

SEQ ID NO: 4873343 - DNA, 12 bp, Homo sapiens
tgtgtttccaca

SEQ ID NO: 4873344 - DNA, 15 bp, Homo sapiens
tgtgtttccttttca

SEQ ID NO: 4873345 - DNA, 19 bp, Homo sapiens
tgtgtttccttttcaggag

SEQ ID NO: 4873346 - DNA, 14 bp, Homo sapiens
tgtgttttttaaga

SEQ ID NO: 4873347 - DNA, 14 bp, Homo sapiens
tgttaaaaatgtca

SEQ ID NO: 4873348 - DNA, 15 bp, Homo sapiens
tgttaaaagttttat

SEQ ID NO: 4873349 - DNA, 17 bp, Homo sapiens
tgttaaagagataaaga

SEQ ID NO: 4873350 - DNA, 20 bp, Homo sapiens
tgttaatttgtgtgttttta

SEQ ID NO: 4873351 - DNA, 20 bp, Homo sapiens
tgttactaaaaaaaagatga

SEQ ID NO: 4873352 - DNA, 21 bp, Homo sapiens
tgttagcagagtctgtctctt

SEQ ID NO: 4873353 - DNA, 22 bp, Homo sapiens
tgttcaagtttgctgcaaccca

SEQ ID NO: 4873354 - DNA, 20 bp, Homo sapiens
tgttccaagtctctgtgtaa

SEQ ID NO: 4873355 - DNA, 18 bp, Homo sapiens
tgttccattacaccacag

SEQ ID NO: 4873356 - DNA, 20 bp, Homo sapiens
tgttccattacaccacagca

SEQ ID NO: 4873357 - DNA, 18 bp, Homo sapiens
tgttcccagaaccttgat

SEQ ID NO: 4873358 - DNA, 19 bp, Homo sapiens
tgttcctgaaatgtgtttc

SEQ ID NO: 4873359 - DNA, 22 bp, Homo sapiens
tgttctaaatatcccttggaca

SEQ ID NO: 4873360 - DNA, 18 bp, Homo sapiens
tgttctgatcggccagtt

SEQ ID NO: 4873361 - DNA, 13 bp, Homo sapiens
tgttctttctgct

SEQ ID NO: 4873362 - DNA, 15 bp, Homo sapiens
tgttctttctgctct

SEQ ID NO: 4873363 - DNA, 20 bp, Homo sapiens
tgttgaactttttaaagaag

SEQ ID NO: 4873364 - DNA, 16 bp, Homo sapiens
tgttgactgtgtcatt

SEQ ID NO: 4873365 - DNA, 13 bp, Homo sapiens
tgttgcactaaaa

SEQ ID NO: 4873366 - DNA, 19 bp, Homo sapiens
tgttgcactaaaatgagga

SEQ ID NO: 4873367 - DNA, 22 bp, Homo sapiens
tgttgcacttttgaatgtccaa

SEQ ID NO: 4873368 - DNA, 13 bp, Homo sapiens
tgttgcagccgca

SEQ ID NO: 4873369 - DNA, 18 bp, Homo sapiens
tgttgcctcttgcaatgc

SEQ ID NO: 4873370 - DNA, 13 bp, Homo sapiens
tgttggagcagca

SEQ ID NO: 4873371 - DNA, 13 bp, Homo sapiens
tgttggagtgagg

SEQ ID NO: 4873372 - DNA, 14 bp, Homo sapiens
tgttgggaaagtat

SEQ ID NO: 4873373 - DNA, 15 bp, Homo sapiens
tgttgtaagaattct

SEQ ID NO: 4873374 - DNA, 15 bp, Homo sapiens
tgttgtacttaaatg

SEQ ID NO: 4873375 - DNA, 20 bp, Homo sapiens
tgttgtgagaatggcctgga

SEQ ID NO: 4873376 - DNA, 21 bp, Homo sapiens
tgttgtgagaatggcctggag

SEQ ID NO: 4873377 - DNA, 20 bp, Homo sapiens
tgttgtttataataaaaata

SEQ ID NO: 4873378 - DNA, 21 bp, Homo sapiens
tgttgtttataataaaaatat

SEQ ID NO: 4873379 - DNA, 22 bp, Homo sapiens
tgtttaaaatgtaatttaaatg

SEQ ID NO: 4873380 - DNA, 20 bp, Homo sapiens
tgtttaatgggtatgctcag

SEQ ID NO: 4873381 - DNA, 16 bp, Homo sapiens
tgtttacctttctctc

SEQ ID NO: 4873382 - DNA, 23 bp, Homo sapiens
tgtttacctttctctctctaagg

SEQ ID NO: 4873383 - DNA, 15 bp, Homo sapiens
tgtttagatgaatgt

SEQ ID NO: 4873384 - DNA, 21 bp, Homo sapiens
tgtttagatgaggctcagaga

SEQ ID NO: 4873385 - DNA, 18 bp, Homo sapiens
tgtttatgttgtttataa

SEQ ID NO: 4873386 - DNA, 22 bp, Homo sapiens
tgtttatgttgtttataataaa

SEQ ID NO: 4873387 - DNA, 13 bp, Homo sapiens
tgtttatttcagg

SEQ ID NO: 4873388 - DNA, 16 bp, Homo sapiens
tgtttcctagctgtgt

SEQ ID NO: 4873389 - DNA, 20 bp, Homo sapiens
tgtttccttttcaggagatg

SEQ ID NO: 4873390 - DNA, 22 bp, Homo sapiens
tgtttgagcatcgcttaggaga

SEQ ID NO: 4873391 - DNA, 21 bp, Homo sapiens
tgtttgatataccaaattaaa

SEQ ID NO: 4873392 - DNA, 16 bp, Homo sapiens
tgtttgccaggacatg

SEQ ID NO: 4873393 - DNA, 22 bp, Homo sapiens
tgtttggcgtagcagagttaaa

SEQ ID NO: 4873394 - DNA, 14 bp, Homo sapiens
tgtttggtaaatgt

SEQ ID NO: 4873395 - DNA, 14 bp, Homo sapiens
tgttttcaaatgtt

SEQ ID NO: 4873396 - DNA, 18 bp, Homo sapiens
tgttttgaccagtttaag

SEQ ID NO: 4873397 - DNA, 17 bp, Homo sapiens
tgttttggatggcttgt

SEQ ID NO: 4873398 - DNA, 20 bp, Homo sapiens
tgttttggtggaaaaaacat

SEQ ID NO: 4873399 - DNA, 17 bp, Homo sapiens
tgttttgtgaattttct

SEQ ID NO: 4873400 - DNA, 19 bp, Homo sapiens
tgttttgtggtttggaata

SEQ ID NO: 4873401 - DNA, 19 bp, Homo sapiens
tgtttttcatccattccta

SEQ ID NO: 4873402 - DNA, 16 bp, Homo sapiens
ttaaaaaaaaattgta

SEQ ID NO: 4873403 - DNA, 14 bp, Homo sapiens
ttaaaaaataaata

SEQ ID NO: 4873404 - DNA, 21 bp, Homo sapiens
ttaaaaacgaaaacctgacta

SEQ ID NO: 4873405 - DNA, 13 bp, Homo sapiens
ttaaaactaaatt

SEQ ID NO: 4873406 - DNA, 13 bp, Homo sapiens
ttaaaagcctgct

SEQ ID NO: 4873407 - DNA, 11 bp, Homo sapiens
ttaaaatgtaa

SEQ ID NO: 4873408 - DNA, 13 bp, Homo sapiens
ttaaaatgtaatt

SEQ ID NO: 4873409 - DNA, 21 bp, Homo sapiens
ttaaaatgtaatttaaatgaa

SEQ ID NO: 4873410 - DNA, 16 bp, Homo sapiens
ttaaaattttgtatgt

SEQ ID NO: 4873411 - DNA, 23 bp, Homo sapiens
ttaaacgctctaggtacgatgac

SEQ ID NO: 4873412 - DNA, 18 bp, Homo sapiens
ttaaacttccaaagaaag

SEQ ID NO: 4873413 - DNA, 15 bp, Homo sapiens
ttaaagaaaacccac

SEQ ID NO: 4873414 - DNA, 14 bp, Homo sapiens
ttaaagaaaggaaa

SEQ ID NO: 4873415 - DNA, 17 bp, Homo sapiens
ttaaagaaaggaaaaga

SEQ ID NO: 4873416 - DNA, 14 bp, Homo sapiens
ttaaagagataaag

SEQ ID NO: 4873417 - DNA, 16 bp, Homo sapiens
ttaaatgaaagaaaat

SEQ ID NO: 4873418 - DNA, 22 bp, Homo sapiens
ttaaatggtaataagcactgta

SEQ ID NO: 4873419 - DNA, 13 bp, Homo sapiens
ttaacaggacagt

SEQ ID NO: 4873420 - DNA, 22 bp, Homo sapiens
ttaactgtccgtaagcagtata

SEQ ID NO: 4873421 - DNA, 12 bp, Homo sapiens
ttaactgtggat

SEQ ID NO: 4873422 - DNA, 15 bp, Homo sapiens
ttaactgtggatatt

SEQ ID NO: 4873423 - DNA, 21 bp, Homo sapiens
ttaactgttgcacttttgaat

SEQ ID NO: 4873424 - DNA, 13 bp, Homo sapiens
ttaagatggcaat

SEQ ID NO: 4873425 - DNA, 21 bp, Homo sapiens
ttaagatggcaattactttgg

SEQ ID NO: 4873426 - DNA, 17 bp, Homo sapiens
ttaaggacccttttaag

SEQ ID NO: 4873427 - DNA, 22 bp, Homo sapiens
ttaaggataaatcataaagtca

SEQ ID NO: 4873428 - DNA, 18 bp, Homo sapiens
ttaaggggtatcatgtat

SEQ ID NO: 4873429 - DNA, 19 bp, Homo sapiens
ttaaggtgagcataaatca

SEQ ID NO: 4873430 - DNA, 20 bp, Homo sapiens
ttaaggtgagcataaatcaa

SEQ ID NO: 4873431 - DNA, 23 bp, Homo sapiens
ttaataccagataccttatctta

SEQ ID NO: 4873432 - DNA, 19 bp, Homo sapiens
ttaatatccctacatgtat

SEQ ID NO: 4873433 - DNA, 18 bp, Homo sapiens
ttaatcttcaaagccttc

SEQ ID NO: 4873434 - DNA, 20 bp, Homo sapiens
ttaatcttttcttatttttg

SEQ ID NO: 4873435 - DNA, 14 bp, Homo sapiens
ttaatgctacatgt

SEQ ID NO: 4873436 - DNA, 19 bp, Homo sapiens
ttaatggtttattctttgc

SEQ ID NO: 4873437 - DNA, 15 bp, Homo sapiens
ttaatgttttcaaaa

SEQ ID NO: 4873438 - DNA, 12 bp, Homo sapiens
ttaatttaactt

SEQ ID NO: 4873439 - DNA, 21 bp, Homo sapiens
ttaatttaactttccagtctt

SEQ ID NO: 4873440 - DNA, 16 bp, Homo sapiens
ttaatttcctgtgagg

SEQ ID NO: 4873441 - DNA, 18 bp, Homo sapiens
ttaattttaaagtgcaaa

SEQ ID NO: 4873442 - DNA, 12 bp, Homo sapiens
ttaattttcact

SEQ ID NO: 4873443 - DNA, 21 bp, Homo sapiens
ttacaaagttaaaattgttat

SEQ ID NO: 4873444 - DNA, 19 bp, Homo sapiens
ttacaactgaccaagtttc

SEQ ID NO: 4873445 - DNA, 18 bp, Homo sapiens
ttacagctctcctccagc

SEQ ID NO: 4873446 - DNA, 17 bp, Homo sapiens
ttacaggagccagcctg

SEQ ID NO: 4873447 - DNA, 13 bp, Homo sapiens
ttaccctacagac

SEQ ID NO: 4873448 - DNA, 20 bp, Homo sapiens
ttacctgtggatatttgtat

SEQ ID NO: 4873449 - DNA, 12 bp, Homo sapiens
ttacctttcctg

SEQ ID NO: 4873450 - DNA, 18 bp, Homo sapiens
ttactaaaaaaaagatga

SEQ ID NO: 4873451 - DNA, 17 bp, Homo sapiens
ttactaaaaagtataaa

SEQ ID NO: 4873452 - DNA, 16 bp, Homo sapiens
ttactagataaaatgt

SEQ ID NO: 4873453 - DNA, 14 bp, Homo sapiens
ttactgacatttct

SEQ ID NO: 4873454 - DNA, 15 bp, Homo sapiens
ttactgcaatcactg

SEQ ID NO: 4873455 - DNA, 19 bp, Homo sapiens
ttactgctttaatcagaaa

SEQ ID NO: 4873456 - DNA, 19 bp, Homo sapiens
ttactgtctattaatattc

SEQ ID NO: 4873457 - DNA, 23 bp, Homo sapiens
ttacttatgtagaaactgaggcc

SEQ ID NO: 4873458 - DNA, 19 bp, Homo sapiens
ttacttcaaagtgcctggg

SEQ ID NO: 4873459 - DNA, 20 bp, Homo sapiens
ttacttcaaagtgcctgggc

SEQ ID NO: 4873460 - DNA, 22 bp, Homo sapiens
ttacttcaaagtgcctgggctc

SEQ ID NO: 4873461 - DNA, 15 bp, Homo sapiens
ttacttgttttggat

SEQ ID NO: 4873462 - DNA, 21 bp, Homo sapiens
ttactttggggctaatttaac

SEQ ID NO: 4873463 - DNA, 11 bp, Homo sapiens
ttagaaatatt

SEQ ID NO: 4873464 - DNA, 13 bp, Homo sapiens
ttagaagcctgca

SEQ ID NO: 4873465 - DNA, 16 bp, Homo sapiens
ttagacctgtgttact

SEQ ID NO: 4873466 - DNA, 20 bp, Homo sapiens
ttagatgggaggatgaattg

SEQ ID NO: 4873467 - DNA, 19 bp, Homo sapiens
ttagattgagaaatgtgta

SEQ ID NO: 4873468 - DNA, 17 bp, Homo sapiens
ttagcagagtctgtctc

SEQ ID NO: 4873469 - DNA, 18 bp, Homo sapiens
ttagcagagtctgtctct

SEQ ID NO: 4873470 - DNA, 11 bp, Homo sapiens
ttagcatggta

SEQ ID NO: 4873471 - DNA, 20 bp, Homo sapiens
ttaggaagtgtttatgttgt

SEQ ID NO: 4873472 - DNA, 13 bp, Homo sapiens
ttagtcatgtgac

SEQ ID NO: 4873473 - DNA, 14 bp, Homo sapiens
ttagtcatgtgacc

SEQ ID NO: 4873474 - DNA, 15 bp, Homo sapiens
ttagtgacatttaat

SEQ ID NO: 4873475 - DNA, 16 bp, Homo sapiens
ttagttttgatgagtt

SEQ ID NO: 4873476 - DNA, 12 bp, Homo sapiens
ttataaaagtgt

SEQ ID NO: 4873477 - DNA, 13 bp, Homo sapiens
ttataaacagaaa

SEQ ID NO: 4873478 - DNA, 23 bp, Homo sapiens
ttataacctagttaaagaaagga

SEQ ID NO: 4873479 - DNA, 18 bp, Homo sapiens
ttataagaagaagttcat

SEQ ID NO: 4873480 - DNA, 21 bp, Homo sapiens
ttataagaagaagttcatgtc

SEQ ID NO: 4873481 - DNA, 24 bp, Homo sapiens
ttatactgggacaccattaccaaa

SEQ ID NO: 4873482 - DNA, 20 bp, Homo sapiens
ttatagtctaagactatata

SEQ ID NO: 4873483 - DNA, 13 bp, Homo sapiens
ttatatttttaaa

SEQ ID NO: 4873484 - DNA, 19 bp, Homo sapiens
ttatatttttttaactgtg

SEQ ID NO: 4873485 - DNA, 21 bp, Homo sapiens
ttatcagtaatgctaaatgtg

SEQ ID NO: 4873486 - DNA, 15 bp, Homo sapiens
ttatccctcacctgt

SEQ ID NO: 4873487 - DNA, 15 bp, Homo sapiens
ttatcgtttttgtat

SEQ ID NO: 4873488 - DNA, 22 bp, Homo sapiens
ttatcgtttttgtattttcatg

SEQ ID NO: 4873489 - DNA, 13 bp, Homo sapiens
ttatctctttcca

SEQ ID NO: 4873490 - DNA, 23 bp, Homo sapiens
ttatctgaaaggccagcagctga

SEQ ID NO: 4873491 - DNA, 14 bp, Homo sapiens
ttatctttgaatat

SEQ ID NO: 4873492 - DNA, 22 bp, Homo sapiens
ttatgacaagctgtatcactgc

SEQ ID NO: 4873493 - DNA, 20 bp, Homo sapiens
ttatgagattggttttcctg

SEQ ID NO: 4873494 - DNA, 15 bp, Homo sapiens
ttatgtagaaactga

SEQ ID NO: 4873495 - DNA, 13 bp, Homo sapiens
ttatgttaatatt

SEQ ID NO: 4873496 - DNA, 15 bp, Homo sapiens
ttattaagctttttg

SEQ ID NO: 4873497 - DNA, 22 bp, Homo sapiens
ttattgaccattttttaattta

SEQ ID NO: 4873498 - DNA, 19 bp, Homo sapiens
ttattgagttccagttgaa

SEQ ID NO: 4873499 - DNA, 18 bp, Homo sapiens
ttatttacagctgtgctc

SEQ ID NO: 4873500 - DNA, 19 bp, Homo sapiens
ttatttcatgattagaaat

SEQ ID NO: 4873501 - DNA, 14 bp, Homo sapiens
ttatttttataatt

SEQ ID NO: 4873502 - DNA, 18 bp, Homo sapiens
ttatttttataattgtac

SEQ ID NO: 4873503 - DNA, 21 bp, Homo sapiens
ttatttttataattgtacaaa

SEQ ID NO: 4873504 - DNA, 17 bp, Homo sapiens
ttatttttttaaaattt

SEQ ID NO: 4873505 - DNA, 12 bp, Homo sapiens
ttcaaagccttc

SEQ ID NO: 4873506 - DNA, 14 bp, Homo sapiens
ttcaaagtgcctgg

SEQ ID NO: 4873507 - DNA, 15 bp, Homo sapiens
ttcaaagtgcctggg

SEQ ID NO: 4873508 - DNA, 20 bp, Homo sapiens
ttcaaagttttgttgtactt

SEQ ID NO: 4873509 - DNA, 16 bp, Homo sapiens
ttcaacagccaagctg

SEQ ID NO: 4873510 - DNA, 17 bp, Homo sapiens
ttcaagaatcagacagc

SEQ ID NO: 4873511 - DNA, 19 bp, Homo sapiens
ttcaaggctcttcttcctc

SEQ ID NO: 4873512 - DNA, 22 bp, Homo sapiens
ttcaagtttgctgcaacccaag

SEQ ID NO: 4873513 - DNA, 15 bp, Homo sapiens
ttcaagttttaaagt

SEQ ID NO: 4873514 - DNA, 19 bp, Homo sapiens
ttcaatctggattcatatt

SEQ ID NO: 4873515 - DNA, 20 bp, Homo sapiens
ttcaatctggattcatattt

SEQ ID NO: 4873516 - DNA, 13 bp, Homo sapiens
ttcacaatgttaa

SEQ ID NO: 4873517 - DNA, 19 bp, Homo sapiens
ttcacagtacccaaactgc

SEQ ID NO: 4873518 - DNA, 23 bp, Homo sapiens
ttcacagtacccaaactgctttt

SEQ ID NO: 4873519 - DNA, 11 bp, Homo sapiens
ttcacccatcc

SEQ ID NO: 4873520 - DNA, 13 bp, Homo sapiens
ttcaccttcccct

SEQ ID NO: 4873521 - DNA, 16 bp, Homo sapiens
ttcaccttcccctaaa

SEQ ID NO: 4873522 - DNA, 20 bp, Homo sapiens
ttcagaaatataacacattt

SEQ ID NO: 4873523 - DNA, 21 bp, Homo sapiens
ttcagaaatataacacatttt

SEQ ID NO: 4873524 - DNA, 12 bp, Homo sapiens
ttcagaaatgtt

SEQ ID NO: 4873525 - DNA, 18 bp, Homo sapiens
ttcagaagaatcttcctg

SEQ ID NO: 4873526 - DNA, 20 bp, Homo sapiens
ttcagaagaatcttcctggc

SEQ ID NO: 4873527 - DNA, 15 bp, Homo sapiens
ttcagacccctgcct

SEQ ID NO: 4873528 - DNA, 16 bp, Homo sapiens
ttcagacccctgcctg

SEQ ID NO: 4873529 - DNA, 13 bp, Homo sapiens
ttcagctgcccca

SEQ ID NO: 4873530 - DNA, 19 bp, Homo sapiens
ttcaggactctctccagga

SEQ ID NO: 4873531 - DNA, 20 bp, Homo sapiens
ttcaggactctctccaggag

SEQ ID NO: 4873532 - DNA, 17 bp, Homo sapiens
ttcaggcagctgaaatt

SEQ ID NO: 4873533 - DNA, 23 bp, Homo sapiens
ttcagtaagtctcataggttaaa

SEQ ID NO: 4873534 - DNA, 14 bp, Homo sapiens
ttcataaattattt

SEQ ID NO: 4873535 - DNA, 20 bp, Homo sapiens
ttcataaattatttgattat

SEQ ID NO: 4873536 - DNA, 15 bp, Homo sapiens
ttcatagctgtactt

SEQ ID NO: 4873537 - DNA, 19 bp, Homo sapiens
ttcatagtaagtgcgaaga

SEQ ID NO: 4873538 - DNA, 20 bp, Homo sapiens
ttcatatttaatttgaaggt

SEQ ID NO: 4873539 - DNA, 13 bp, Homo sapiens
ttcatcagaactc

SEQ ID NO: 4873540 - DNA, 23 bp, Homo sapiens
ttcatctaatgtattatgagcca

SEQ ID NO: 4873541 - DNA, 17 bp, Homo sapiens
ttcatgcctgatgaaag

SEQ ID NO: 4873542 - DNA, 21 bp, Homo sapiens
ttcatggcatgcttaaatttt

SEQ ID NO: 4873543 - DNA, 18 bp, Homo sapiens
ttcatggctgctgttgct

SEQ ID NO: 4873544 - DNA, 21 bp, Homo sapiens
ttcatgtaattttattttaaa

SEQ ID NO: 4873545 - DNA, 15 bp, Homo sapiens
ttcattaccctacag

SEQ ID NO: 4873546 - DNA, 19 bp, Homo sapiens
ttcattaccctacagacag

SEQ ID NO: 4873547 - DNA, 14 bp, Homo sapiens
ttcattagttttga

SEQ ID NO: 4873548 - DNA, 19 bp, Homo sapiens
ttcattctttttgaaatgt

SEQ ID NO: 4873549 - DNA, 16 bp, Homo sapiens
ttcattgcaattaaac

SEQ ID NO: 4873550 - DNA, 19 bp, Homo sapiens
ttcattggcattctttgca

SEQ ID NO: 4873551 - DNA, 19 bp, Homo sapiens
ttcatttagtcatgtgacc

SEQ ID NO: 4873552 - DNA, 17 bp, Homo sapiens
ttcatttgtatgtcaaa

SEQ ID NO: 4873553 - DNA, 18 bp, Homo sapiens
ttcatttgtatgtcaaag

SEQ ID NO: 4873554 - DNA, 22 bp, Homo sapiens
ttcattttgcactgaggatatt

SEQ ID NO: 4873555 - DNA, 14 bp, Homo sapiens
ttccaaagaaagtt

SEQ ID NO: 4873556 - DNA, 21 bp, Homo sapiens
ttccacagcctgcaagtcagt

SEQ ID NO: 4873557 - DNA, 19 bp, Homo sapiens
ttccacccacaaactccag

SEQ ID NO: 4873558 - DNA, 21 bp, Homo sapiens
ttccagaaccacacttgaaac

SEQ ID NO: 4873559 - DNA, 19 bp, Homo sapiens
ttccagagaacctgtgggc

SEQ ID NO: 4873560 - DNA, 20 bp, Homo sapiens
ttccagatctttcagaaata

SEQ ID NO: 4873561 - DNA, 20 bp, Homo sapiens
ttccagtcctaacaaatgct

SEQ ID NO: 4873562 - DNA, 21 bp, Homo sapiens
ttccatccatctttccatcca

SEQ ID NO: 4873563 - DNA, 16 bp, Homo sapiens
ttccattacaccacag

SEQ ID NO: 4873564 - DNA, 16 bp, Homo sapiens
ttccatttattaagca

SEQ ID NO: 4873565 - DNA, 13 bp, Homo sapiens
ttccattttaatt

SEQ ID NO: 4873566 - DNA, 20 bp, Homo sapiens
ttcccagcctgactagaact

SEQ ID NO: 4873567 - DNA, 15 bp, Homo sapiens
ttccccagtgactcc

SEQ ID NO: 4873568 - DNA, 16 bp, Homo sapiens
ttccccagtgactcca

SEQ ID NO: 4873569 - DNA, 17 bp, Homo sapiens
ttccccagtgactccag

SEQ ID NO: 4873570 - DNA, 19 bp, Homo sapiens
ttccccagtgactccaggg

SEQ ID NO: 4873571 - DNA, 20 bp, Homo sapiens
ttccccagtgactccagggt

SEQ ID NO: 4873572 - DNA, 19 bp, Homo sapiens
ttcccccttcatccatcct

SEQ ID NO: 4873573 - DNA, 22 bp, Homo sapiens
ttcccgccgccccccctatctc

SEQ ID NO: 4873574 - DNA, 22 bp, Homo sapiens
ttcccggcccttacctttcctg

SEQ ID NO: 4873575 - DNA, 22 bp, Homo sapiens
ttccctgggtttgggagccagg

SEQ ID NO: 4873576 - DNA, 22 bp, Homo sapiens
ttcccttgaaactttgggaaaa

SEQ ID NO: 4873577 - DNA, 19 bp, Homo sapiens
ttccctttacagctctcct

SEQ ID NO: 4873578 - DNA, 15 bp, Homo sapiens
ttccggggagaaacc

SEQ ID NO: 4873579 - DNA, 21 bp, Homo sapiens
ttccggggagaaacccagaga

SEQ ID NO: 4873580 - DNA, 14 bp, Homo sapiens
ttcctactttctat

SEQ ID NO: 4873581 - DNA, 13 bp, Homo sapiens
ttcctccacccat

SEQ ID NO: 4873582 - DNA, 10 bp, Homo sapiens
ttcctccctc

SEQ ID NO: 4873583 - DNA, 19 bp, Homo sapiens
ttcctcctcccaaggcatt

SEQ ID NO: 4873584 - DNA, 11 bp, Homo sapiens
ttcctgaaatg

SEQ ID NO: 4873585 - DNA, 16 bp, Homo sapiens
ttcctgctgctgctac

SEQ ID NO: 4873586 - DNA, 12 bp, Homo sapiens
ttcctgtactgt

SEQ ID NO: 4873587 - DNA, 22 bp, Homo sapiens
ttccttaggtttttttccttct

SEQ ID NO: 4873588 - DNA, 20 bp, Homo sapiens
ttccttcaggcagctgaaat

SEQ ID NO: 4873589 - DNA, 13 bp, Homo sapiens
ttccttctgaagt

SEQ ID NO: 4873590 - DNA, 23 bp, Homo sapiens
ttccttggtcctagtaagaagac

SEQ ID NO: 4873591 - DNA, 18 bp, Homo sapiens
ttccttttcaggagatgg

SEQ ID NO: 4873592 - DNA, 17 bp, Homo sapiens
ttccttttggcctcctg

SEQ ID NO: 4873593 - DNA, 13 bp, Homo sapiens
ttcggaaacactg

SEQ ID NO: 4873594 - DNA, 16 bp, Homo sapiens
ttcggtggccttgagt

SEQ ID NO: 4873595 - DNA, 13 bp, Homo sapiens
ttcgtaacacagc

SEQ ID NO: 4873596 - DNA, 17 bp, Homo sapiens
ttctaaatatgaatgaa

SEQ ID NO: 4873597 - DNA, 14 bp, Homo sapiens
ttctaacaagtcat

SEQ ID NO: 4873598 - DNA, 18 bp, Homo sapiens
ttctaccggagagagaat

SEQ ID NO: 4873599 - DNA, 23 bp, Homo sapiens
ttctaccggagagagaatgtatt

SEQ ID NO: 4873600 - DNA, 20 bp, Homo sapiens
ttctaggatagcgctcccct

SEQ ID NO: 4873601 - DNA, 21 bp, Homo sapiens
ttctaggatagcgctcccctt

SEQ ID NO: 4873602 - DNA, 23 bp, Homo sapiens
ttctagtgatgatggttcacgtt

SEQ ID NO: 4873603 - DNA, 13 bp, Homo sapiens
ttctatattcctc

SEQ ID NO: 4873604 - DNA, 19 bp, Homo sapiens
ttctattatttttataatt

SEQ ID NO: 4873605 - DNA, 16 bp, Homo sapiens
ttctattctccagaca

SEQ ID NO: 4873606 - DNA, 14 bp, Homo sapiens
ttctcatcttgcct

SEQ ID NO: 4873607 - DNA, 19 bp, Homo sapiens
ttctccagtcattatgtta

SEQ ID NO: 4873608 - DNA, 22 bp, Homo sapiens
ttctccatggagcctacctctg

SEQ ID NO: 4873609 - DNA, 21 bp, Homo sapiens
ttctcccagctctagcctctg

SEQ ID NO: 4873610 - DNA, 23 bp, Homo sapiens
ttctcccctgcccttcctcctga

SEQ ID NO: 4873611 - DNA, 21 bp, Homo sapiens
ttctctcccttcctctctcct

SEQ ID NO: 4873612 - DNA, 15 bp, Homo sapiens
ttctctcctccccta

SEQ ID NO: 4873613 - DNA, 13 bp, Homo sapiens
ttctctctctaag

SEQ ID NO: 4873614 - DNA, 15 bp, Homo sapiens
ttctctgttcccttg

SEQ ID NO: 4873615 - DNA, 22 bp, Homo sapiens
ttctgaaccctccaaaggaact

SEQ ID NO: 4873616 - DNA, 16 bp, Homo sapiens
ttctgagataagtgtt

SEQ ID NO: 4873617 - DNA, 15 bp, Homo sapiens
ttctgcagtcagact

SEQ ID NO: 4873618 - DNA, 18 bp, Homo sapiens
ttctgctctatactgtgg

SEQ ID NO: 4873619 - DNA, 18 bp, Homo sapiens
ttctggacctgggcatga

SEQ ID NO: 4873620 - DNA, 18 bp, Homo sapiens
ttctgggtgctagatcca

SEQ ID NO: 4873621 - DNA, 22 bp, Homo sapiens
ttctggtcaagggctgtcattg

SEQ ID NO: 4873622 - DNA, 19 bp, Homo sapiens
ttctgtttaattttcactt

SEQ ID NO: 4873623 - DNA, 18 bp, Homo sapiens
ttcttactaaaaagtata

SEQ ID NO: 4873624 - DNA, 18 bp, Homo sapiens
ttcttaggggaaggagaa

SEQ ID NO: 4873625 - DNA, 21 bp, Homo sapiens
ttcttatttaatcttttctta

SEQ ID NO: 4873626 - DNA, 18 bp, Homo sapiens
ttcttcactctggcttca

SEQ ID NO: 4873627 - DNA, 12 bp, Homo sapiens
ttctttaactgc

SEQ ID NO: 4873628 - DNA, 18 bp, Homo sapiens
ttctttagcttacctggg

SEQ ID NO: 4873629 - DNA, 16 bp, Homo sapiens
ttctttcacccatcct

SEQ ID NO: 4873630 - DNA, 17 bp, Homo sapiens
ttctttctccatggagc

SEQ ID NO: 4873631 - DNA, 12 bp, Homo sapiens
ttctttgcaata

SEQ ID NO: 4873632 - DNA, 20 bp, Homo sapiens
ttctttggttccatgttgac

SEQ ID NO: 4873633 - DNA, 20 bp, Homo sapiens
ttcttttcttcactcaaatt

SEQ ID NO: 4873634 - DNA, 15 bp, Homo sapiens
ttcttttgtttggta

SEQ ID NO: 4873635 - DNA, 13 bp, Homo sapiens
ttgaaaaatataa

SEQ ID NO: 4873636 - DNA, 22 bp, Homo sapiens
ttgaaaataacctaattaatat

SEQ ID NO: 4873637 - DNA, 19 bp, Homo sapiens
ttgaaaattaaggaaatgt

SEQ ID NO: 4873638 - DNA, 14 bp, Homo sapiens
ttgaaactttaaga

SEQ ID NO: 4873639 - DNA, 13 bp, Homo sapiens
ttgaaattctatt

SEQ ID NO: 4873640 - DNA, 17 bp, Homo sapiens
ttgaaccttaaaaggta

SEQ ID NO: 4873641 - DNA, 23 bp, Homo sapiens
ttgaagattctatgttaatattt

SEQ ID NO: 4873642 - DNA, 14 bp, Homo sapiens
ttgaaggagaatgg

SEQ ID NO: 4873643 - DNA, 15 bp, Homo sapiens
ttgaaggagaatggc

SEQ ID NO: 4873644 - DNA, 22 bp, Homo sapiens
ttgaaggtgataagggaaaaga

SEQ ID NO: 4873645 - DNA, 13 bp, Homo sapiens
ttgaatataaaaa

SEQ ID NO: 4873646 - DNA, 17 bp, Homo sapiens
ttgaatgtccaaaattt

SEQ ID NO: 4873647 - DNA, 22 bp, Homo sapiens
ttgaatgtccaaaatttatatt

SEQ ID NO: 4873648 - DNA, 12 bp, Homo sapiens
ttgaattatcag

SEQ ID NO: 4873649 - DNA, 17 bp, Homo sapiens
ttgacaggttttccaaa

SEQ ID NO: 4873650 - DNA, 20 bp, Homo sapiens
ttgacaggttttccaaaagt

SEQ ID NO: 4873651 - DNA, 19 bp, Homo sapiens
ttgacagtttttgacattt

SEQ ID NO: 4873652 - DNA, 13 bp, Homo sapiens
ttgacatggaaat

SEQ ID NO: 4873653 - DNA, 14 bp, Homo sapiens
ttgacatttatatt

SEQ ID NO: 4873654 - DNA, 17 bp, Homo sapiens
ttgacatttatattaaa

SEQ ID NO: 4873655 - DNA, 14 bp, Homo sapiens
ttgactaagaaatg

SEQ ID NO: 4873656 - DNA, 21 bp, Homo sapiens
ttgactttccagaatgacctt

SEQ ID NO: 4873657 - DNA, 15 bp, Homo sapiens
ttgaggggaggtggc

SEQ ID NO: 4873658 - DNA, 17 bp, Homo sapiens
ttgaggtctagagagaa

SEQ ID NO: 4873659 - DNA, 16 bp, Homo sapiens
ttgagtaatgtgacta

SEQ ID NO: 4873660 - DNA, 14 bp, Homo sapiens
ttgagtattgttta

SEQ ID NO: 4873661 - DNA, 17 bp, Homo sapiens
ttgagtctctgaatttg

SEQ ID NO: 4873662 - DNA, 17 bp, Homo sapiens
ttgagtctgtactaaac

SEQ ID NO: 4873663 - DNA, 18 bp, Homo sapiens
ttgataaccttgaaaaaa

SEQ ID NO: 4873664 - DNA, 16 bp, Homo sapiens
ttgatggagccccagg

SEQ ID NO: 4873665 - DNA, 20 bp, Homo sapiens
ttgatttcaaagttttgttg

SEQ ID NO: 4873666 - DNA, 21 bp, Homo sapiens
ttgcaaataaaacgctttccc

SEQ ID NO: 4873667 - DNA, 21 bp, Homo sapiens
ttgcaacagactgttgagtta

SEQ ID NO: 4873668 - DNA, 20 bp, Homo sapiens
ttgcaatgcagaggttgaga

SEQ ID NO: 4873669 - DNA, 18 bp, Homo sapiens
ttgcacagccaaatttaa

SEQ ID NO: 4873670 - DNA, 23 bp, Homo sapiens
ttgcaccatactccttgcttcct

SEQ ID NO: 4873671 - DNA, 22 bp, Homo sapiens
ttgcacttttgaatgtccaaaa

SEQ ID NO: 4873672 - DNA, 18 bp, Homo sapiens
ttgcagcctaagaagaag

SEQ ID NO: 4873673 - DNA, 23 bp, Homo sapiens
ttgcagttagactcaaagaagta

SEQ ID NO: 4873674 - DNA, 19 bp, Homo sapiens
ttgcagttggactctcagg

SEQ ID NO: 4873675 - DNA, 21 bp, Homo sapiens
ttgcagttggactctcaggga

SEQ ID NO: 4873676 - DNA, 11 bp, Homo sapiens
ttgcatgcatg

SEQ ID NO: 4873677 - DNA, 12 bp, Homo sapiens
ttgcattttgat

SEQ ID NO: 4873678 - DNA, 16 bp, Homo sapiens
ttgccaggacatgcaa

SEQ ID NO: 4873679 - DNA, 18 bp, Homo sapiens
ttgcccacaccgagggcg

SEQ ID NO: 4873680 - DNA, 15 bp, Homo sapiens
ttgcccccattccca

SEQ ID NO: 4873681 - DNA, 17 bp, Homo sapiens
ttgcccccattcccagc

SEQ ID NO: 4873682 - DNA, 13 bp, Homo sapiens
ttgccctgcgtcc

SEQ ID NO: 4873683 - DNA, 11 bp, Homo sapiens
ttgcctccagg

SEQ ID NO: 4873684 - DNA, 16 bp, Homo sapiens
ttgcggcaaaaggaaa

SEQ ID NO: 4873685 - DNA, 17 bp, Homo sapiens
ttgcggcaaaaggaaag

SEQ ID NO: 4873686 - DNA, 21 bp, Homo sapiens
ttgctgatcagagttcctcct

SEQ ID NO: 4873687 - DNA, 20 bp, Homo sapiens
ttgctgccattacagaggta

SEQ ID NO: 4873688 - DNA, 11 bp, Homo sapiens
ttgctgggctt

SEQ ID NO: 4873689 - DNA, 17 bp, Homo sapiens
ttgctgtgctttggaac

SEQ ID NO: 4873690 - DNA, 23 bp, Homo sapiens
ttgcttccttctcatcttgcctc

SEQ ID NO: 4873691 - DNA, 17 bp, Homo sapiens
ttgcttctgtatttcct

SEQ ID NO: 4873692 - DNA, 18 bp, Homo sapiens
ttgcttctgtatttcctt

SEQ ID NO: 4873693 - DNA, 15 bp, Homo sapiens
ttgcttttttccaaa

SEQ ID NO: 4873694 - DNA, 16 bp, Homo sapiens
ttggaagatgcagaag

SEQ ID NO: 4873695 - DNA, 23 bp, Homo sapiens
ttggaagatgcagaagcaataat

SEQ ID NO: 4873696 - DNA, 17 bp, Homo sapiens
ttggacattttatgtct

SEQ ID NO: 4873697 - DNA, 18 bp, Homo sapiens
ttggacattttatgtctt

SEQ ID NO: 4873698 - DNA, 15 bp, Homo sapiens
ttggactctcaggga

SEQ ID NO: 4873699 - DNA, 14 bp, Homo sapiens
ttggagaatactgc

SEQ ID NO: 4873700 - DNA, 15 bp, Homo sapiens
ttggagcacaaaatt

SEQ ID NO: 4873701 - DNA, 20 bp, Homo sapiens
ttggagcagcaggcctctgg

SEQ ID NO: 4873702 - DNA, 13 bp, Homo sapiens
ttggagtgctctt

SEQ ID NO: 4873703 - DNA, 17 bp, Homo sapiens
ttggagtgctcttccca

SEQ ID NO: 4873704 - DNA, 17 bp, Homo sapiens
ttggattctaaatacat

SEQ ID NO: 4873705 - DNA, 21 bp, Homo sapiens
ttggcaatgactcaaagtctg

SEQ ID NO: 4873706 - DNA, 23 bp, Homo sapiens
ttggcattcaaccacgcaggaag

SEQ ID NO: 4873707 - DNA, 19 bp, Homo sapiens
ttggcccccttcaggagcc

SEQ ID NO: 4873708 - DNA, 22 bp, Homo sapiens
ttggcccccttcaggagcctgg

SEQ ID NO: 4873709 - DNA, 13 bp, Homo sapiens
ttgggaaaacatg

SEQ ID NO: 4873710 - DNA, 17 bp, Homo sapiens
ttgggaaaacatttgct

SEQ ID NO: 4873711 - DNA, 18 bp, Homo sapiens
ttgggaaaggcagggccc

SEQ ID NO: 4873712 - DNA, 20 bp, Homo sapiens
ttgggaagtttgctgtgctt

SEQ ID NO: 4873713 - DNA, 17 bp, Homo sapiens
ttgggagacatgtgaca

SEQ ID NO: 4873714 - DNA, 11 bp, Homo sapiens
ttgggagccag

SEQ ID NO: 4873715 - DNA, 21 bp, Homo sapiens
ttgggagccaggactcccaga

SEQ ID NO: 4873716 - DNA, 16 bp, Homo sapiens
ttgggcctctcctgcc

SEQ ID NO: 4873717 - DNA, 20 bp, Homo sapiens
ttgggcttcaacagccaagc

SEQ ID NO: 4873718 - DNA, 19 bp, Homo sapiens
ttggggaaggggcctgggc

SEQ ID NO: 4873719 - DNA, 22 bp, Homo sapiens
ttggggaaggggcctgggctgt

SEQ ID NO: 4873720 - DNA, 18 bp, Homo sapiens
ttgggtcacatgactctc

SEQ ID NO: 4873721 - DNA, 21 bp, Homo sapiens
ttgggtcatttagaagcctga

SEQ ID NO: 4873722 - DNA, 14 bp, Homo sapiens
ttggtaaatgtttc

SEQ ID NO: 4873723 - DNA, 20 bp, Homo sapiens
ttggtaatcccctaaaataa

SEQ ID NO: 4873724 - DNA, 13 bp, Homo sapiens
ttggtgctttgca

SEQ ID NO: 4873725 - DNA, 16 bp, Homo sapiens
ttggtgctttgcattt

SEQ ID NO: 4873726 - DNA, 14 bp, Homo sapiens
ttggttctgtgaac

SEQ ID NO: 4873727 - DNA, 22 bp, Homo sapiens
ttgtaactgtttagatgaatgt

SEQ ID NO: 4873728 - DNA, 15 bp, Homo sapiens
ttgtaattatgtaaa

SEQ ID NO: 4873729 - DNA, 15 bp, Homo sapiens
ttgtaccaaaatttt

SEQ ID NO: 4873730 - DNA, 18 bp, Homo sapiens
ttgtaccaaaattttaaa

SEQ ID NO: 4873731 - DNA, 15 bp, Homo sapiens
ttgtataatattgaa

SEQ ID NO: 4873732 - DNA, 20 bp, Homo sapiens
ttgtatagcatgaaataaaa

SEQ ID NO: 4873733 - DNA, 22 bp, Homo sapiens
ttgtatagcatgaaataaaata

SEQ ID NO: 4873734 - DNA, 16 bp, Homo sapiens
ttgtatgtcaaagctt

SEQ ID NO: 4873735 - DNA, 17 bp, Homo sapiens
ttgtattttcatgaaaa

SEQ ID NO: 4873736 - DNA, 18 bp, Homo sapiens
ttgtattttcatgaaaat

SEQ ID NO: 4873737 - DNA, 16 bp, Homo sapiens
ttgtcacttttccttt

SEQ ID NO: 4873738 - DNA, 19 bp, Homo sapiens
ttgtctgtgcatccggggg

SEQ ID NO: 4873739 - DNA, 14 bp, Homo sapiens
ttgtgactttttaa

SEQ ID NO: 4873740 - DNA, 9 bp, Homo sapiens
ttgtgagaa

SEQ ID NO: 4873741 - DNA, 13 bp, Homo sapiens
ttgtgagaatggc

SEQ ID NO: 4873742 - DNA, 19 bp, Homo sapiens
ttgtgagaatggcctggag

SEQ ID NO: 4873743 - DNA, 14 bp, Homo sapiens
ttgtgcacatttct

SEQ ID NO: 4873744 - DNA, 15 bp, Homo sapiens
ttgtgcctaatgtgt

SEQ ID NO: 4873745 - DNA, 13 bp, Homo sapiens
ttgtgctgcttct

SEQ ID NO: 4873746 - DNA, 15 bp, Homo sapiens
ttgtgggagacagca

SEQ ID NO: 4873747 - DNA, 14 bp, Homo sapiens
ttgtggtttggaat

SEQ ID NO: 4873748 - DNA, 11 bp, Homo sapiens
ttgtgtggaat

SEQ ID NO: 4873749 - DNA, 13 bp, Homo sapiens
ttgtgtggattct

SEQ ID NO: 4873750 - DNA, 16 bp, Homo sapiens
ttgtgttcagaagaat

SEQ ID NO: 4873751 - DNA, 15 bp, Homo sapiens
ttgttatttattgaa

SEQ ID NO: 4873752 - DNA, 20 bp, Homo sapiens
ttgttatttattgaaatgat

SEQ ID NO: 4873753 - DNA, 23 bp, Homo sapiens
ttgttcaggaaaaggttgaataa

SEQ ID NO: 4873754 - DNA, 14 bp, Homo sapiens
ttgttcctgaaatg

SEQ ID NO: 4873755 - DNA, 23 bp, Homo sapiens
ttgtttaatggtagttttacagt

SEQ ID NO: 4873756 - DNA, 15 bp, Homo sapiens
ttgtttataataaaa

SEQ ID NO: 4873757 - DNA, 23 bp, Homo sapiens
ttgtttcctcccctatctgtatt

SEQ ID NO: 4873758 - DNA, 15 bp, Homo sapiens
ttgttttgaaaataa

SEQ ID NO: 4873759 - DNA, 12 bp, Homo sapiens
tttaaaaaataa

SEQ ID NO: 4873760 - DNA, 17 bp, Homo sapiens
tttaaaacgtgtaaatg

SEQ ID NO: 4873761 - DNA, 13 bp, Homo sapiens
tttaaaatttcat

SEQ ID NO: 4873762 - DNA, 17 bp, Homo sapiens
tttaaagaccctcctat

SEQ ID NO: 4873763 - DNA, 14 bp, Homo sapiens
tttaaagtgcaaaa

SEQ ID NO: 4873764 - DNA, 12 bp, Homo sapiens
tttaaattgtgt

SEQ ID NO: 4873765 - DNA, 17 bp, Homo sapiens
tttaactaaattttaaa

SEQ ID NO: 4873766 - DNA, 12 bp, Homo sapiens
tttaagaaaaaa

SEQ ID NO: 4873767 - DNA, 14 bp, Homo sapiens
tttaagaaatagaa

SEQ ID NO: 4873768 - DNA, 15 bp, Homo sapiens
tttaataaagatgag

SEQ ID NO: 4873769 - DNA, 17 bp, Homo sapiens
tttaatccatttcagga

SEQ ID NO: 4873770 - DNA, 20 bp, Homo sapiens
tttaattgtccagtttgtct

SEQ ID NO: 4873771 - DNA, 17 bp, Homo sapiens
tttacagtgtttctggc

SEQ ID NO: 4873772 - DNA, 19 bp, Homo sapiens
tttactgatgagagaatgt

SEQ ID NO: 4873773 - DNA, 18 bp, Homo sapiens
tttactttagaagcctgc

SEQ ID NO: 4873774 - DNA, 15 bp, Homo sapiens
tttagaaataataaa

SEQ ID NO: 4873775 - DNA, 14 bp, Homo sapiens
tttagaagcctgca

SEQ ID NO: 4873776 - DNA, 17 bp, Homo sapiens
tttagatgaatgtcagt

SEQ ID NO: 4873777 - DNA, 18 bp, Homo sapiens
tttagatgaatgtcagtt

SEQ ID NO: 4873778 - DNA, 22 bp, Homo sapiens
tttagcttacctgggcacaaac

SEQ ID NO: 4873779 - DNA, 12 bp, Homo sapiens
tttataaagcat

SEQ ID NO: 4873780 - DNA, 20 bp, Homo sapiens
tttataacatctttattgaa

SEQ ID NO: 4873781 - DNA, 21 bp, Homo sapiens
tttataatacagaatcttgtt

SEQ ID NO: 4873782 - DNA, 12 bp, Homo sapiens
tttatatgcttt

SEQ ID NO: 4873783 - DNA, 18 bp, Homo sapiens
tttatattactgacattt

SEQ ID NO: 4873784 - DNA, 16 bp, Homo sapiens
tttatccctcacctgt

SEQ ID NO: 4873785 - DNA, 14 bp, Homo sapiens
tttatcgtttttgt

SEQ ID NO: 4873786 - DNA, 18 bp, Homo sapiens
tttattaaaatatttcag

SEQ ID NO: 4873787 - DNA, 20 bp, Homo sapiens
tttattccccagtgactcca

SEQ ID NO: 4873788 - DNA, 22 bp, Homo sapiens
tttattccccagtgactccagg

SEQ ID NO: 4873789 - DNA, 21 bp, Homo sapiens
tttcaaagtgatagaaaagtg

SEQ ID NO: 4873790 - DNA, 12 bp, Homo sapiens
tttcaaagtttt

SEQ ID NO: 4873791 - DNA, 14 bp, Homo sapiens
tttcaaatgttctc

SEQ ID NO: 4873792 - DNA, 21 bp, Homo sapiens
tttcaccttttcaggaaaata

SEQ ID NO: 4873793 - DNA, 12 bp, Homo sapiens
tttcactgtact

SEQ ID NO: 4873794 - DNA, 13 bp, Homo sapiens
tttcagaaatata

SEQ ID NO: 4873795 - DNA, 12 bp, Homo sapiens
tttcaggaaaat

SEQ ID NO: 4873796 - DNA, 18 bp, Homo sapiens
tttcaggactctctccag

SEQ ID NO: 4873797 - DNA, 19 bp, Homo sapiens
tttcataaattatttgatt

SEQ ID NO: 4873798 - DNA, 15 bp, Homo sapiens
tttcatattgtaatc

SEQ ID NO: 4873799 - DNA, 14 bp, Homo sapiens
tttcatgaaaatac

SEQ ID NO: 4873800 - DNA, 17 bp, Homo sapiens
tttcattaccctacaga

SEQ ID NO: 4873801 - DNA, 22 bp, Homo sapiens
tttccaaaacaaaaagatgtct

SEQ ID NO: 4873802 - DNA, 19 bp, Homo sapiens
tttccagaatgaccttgag

SEQ ID NO: 4873803 - DNA, 17 bp, Homo sapiens
tttccagttcctctttt

SEQ ID NO: 4873804 - DNA, 17 bp, Homo sapiens
tttcccccttcatccat

SEQ ID NO: 4873805 - DNA, 17 bp, Homo sapiens
tttccctccagagaaag

SEQ ID NO: 4873806 - DNA, 19 bp, Homo sapiens
tttccgcccactcctggga

SEQ ID NO: 4873807 - DNA, 13 bp, Homo sapiens
tttcctgtgagga

SEQ ID NO: 4873808 - DNA, 14 bp, Homo sapiens
tttcctgtgaggat

SEQ ID NO: 4873809 - DNA, 12 bp, Homo sapiens
tttccttcaggc

SEQ ID NO: 4873810 - DNA, 15 bp, Homo sapiens
tttccttcaggcagc

SEQ ID NO: 4873811 - DNA, 18 bp, Homo sapiens
tttccttttcttaaaaca

SEQ ID NO: 4873812 - DNA, 22 bp, Homo sapiens
tttccttttggcctcctgcaaa

SEQ ID NO: 4873813 - DNA, 15 bp, Homo sapiens
tttcggaaacactga

SEQ ID NO: 4873814 - DNA, 16 bp, Homo sapiens
tttctaaaagctttca

SEQ ID NO: 4873815 - DNA, 19 bp, Homo sapiens
tttctaaaagctttcatgt

SEQ ID NO: 4873816 - DNA, 23 bp, Homo sapiens
tttctagtacctgtgactcttag

SEQ ID NO: 4873817 - DNA, 15 bp, Homo sapiens
tttctcaccctctgt

SEQ ID NO: 4873818 - DNA, 13 bp, Homo sapiens
tttctcagctgtg

SEQ ID NO: 4873819 - DNA, 12 bp, Homo sapiens
tttctctctcta

SEQ ID NO: 4873820 - DNA, 18 bp, Homo sapiens
tttctgggctgatgggtg

SEQ ID NO: 4873821 - DNA, 15 bp, Homo sapiens
tttcttcactctggc

SEQ ID NO: 4873822 - DNA, 20 bp, Homo sapiens
tttcttcatgcctgatgaaa

SEQ ID NO: 4873823 - DNA, 19 bp, Homo sapiens
tttcttccacccacaaact

SEQ ID NO: 4873824 - DNA, 12 bp, Homo sapiens
tttctttaactg

SEQ ID NO: 4873825 - DNA, 16 bp, Homo sapiens
tttcttttctctggta

SEQ ID NO: 4873826 - DNA, 13 bp, Homo sapiens
tttgaaaaatata

SEQ ID NO: 4873827 - DNA, 18 bp, Homo sapiens
tttgaagaaggcaaggct

SEQ ID NO: 4873828 - DNA, 14 bp, Homo sapiens
tttgaaggagaatg

SEQ ID NO: 4873829 - DNA, 16 bp, Homo sapiens
tttgacatggaaatga

SEQ ID NO: 4873830 - DNA, 20 bp, Homo sapiens
tttgaccagtttaagccgca

SEQ ID NO: 4873831 - DNA, 15 bp, Homo sapiens
tttgatgagttgtga

SEQ ID NO: 4873832 - DNA, 17 bp, Homo sapiens
tttgattatttaagact

SEQ ID NO: 4873833 - DNA, 18 bp, Homo sapiens
tttgcactgaggatattc

SEQ ID NO: 4873834 - DNA, 21 bp, Homo sapiens
tttgctactgttgtaagaatt

SEQ ID NO: 4873835 - DNA, 18 bp, Homo sapiens
tttgctgtgctttggaac

SEQ ID NO: 4873836 - DNA, 16 bp, Homo sapiens
tttgcttcccatctga

SEQ ID NO: 4873837 - DNA, 20 bp, Homo sapiens
tttggagcacaaaattcaaa

SEQ ID NO: 4873838 - DNA, 18 bp, Homo sapiens
tttggattctaaatacat

SEQ ID NO: 4873839 - DNA, 19 bp, Homo sapiens
tttggattctaaatacatg

SEQ ID NO: 4873840 - DNA, 19 bp, Homo sapiens
tttgggaaaggcagggccc

SEQ ID NO: 4873841 - DNA, 16 bp, Homo sapiens
tttgggagacatgtga

SEQ ID NO: 4873842 - DNA, 21 bp, Homo sapiens
tttgggagccaggactcccag

SEQ ID NO: 4873843 - DNA, 20 bp, Homo sapiens
tttgggggtcagcatccagt

SEQ ID NO: 4873844 - DNA, 14 bp, Homo sapiens
tttgtaaaaatctt

SEQ ID NO: 4873845 - DNA, 22 bp, Homo sapiens
tttgtaaaaatcttttgaagca

SEQ ID NO: 4873846 - DNA, 23 bp, Homo sapiens
tttgtaaaaatcttttgaagcat

SEQ ID NO: 4873847 - DNA, 14 bp, Homo sapiens
tttgtataaaagtg

SEQ ID NO: 4873848 - DNA, 12 bp, Homo sapiens
tttgtcagtgtt

SEQ ID NO: 4873849 - DNA, 21 bp, Homo sapiens
tttgtcttttaatccatttca

SEQ ID NO: 4873850 - DNA, 20 bp, Homo sapiens
ttttaaaacgtgtaaatgaa

SEQ ID NO: 4873851 - DNA, 13 bp, Homo sapiens
ttttaaagtgcaa

SEQ ID NO: 4873852 - DNA, 18 bp, Homo sapiens
ttttaatttacttgtttt

SEQ ID NO: 4873853 - DNA, 15 bp, Homo sapiens
ttttaatttcctgtg

SEQ ID NO: 4873854 - DNA, 22 bp, Homo sapiens
ttttactccaggttattgcaat

SEQ ID NO: 4873855 - DNA, 19 bp, Homo sapiens
ttttagaaataataaaaag

SEQ ID NO: 4873856 - DNA, 19 bp, Homo sapiens
ttttagtgtgtgcataata

SEQ ID NO: 4873857 - DNA, 15 bp, Homo sapiens
ttttataaagcatgt

SEQ ID NO: 4873858 - DNA, 13 bp, Homo sapiens
ttttatatgcttt

SEQ ID NO: 4873859 - DNA, 19 bp, Homo sapiens
ttttatattactgacattt

SEQ ID NO: 4873860 - DNA, 23 bp, Homo sapiens
ttttatcgtttttgtattttcat

SEQ ID NO: 4873861 - DNA, 19 bp, Homo sapiens
ttttattaaaatatttcag

SEQ ID NO: 4873862 - DNA, 22 bp, Homo sapiens
ttttattaagctttttggaatc

SEQ ID NO: 4873863 - DNA, 11 bp, Homo sapiens
ttttcatccat

SEQ ID NO: 4873864 - DNA, 19 bp, Homo sapiens
ttttccaaaacaaaaagat

SEQ ID NO: 4873865 - DNA, 13 bp, Homo sapiens
ttttcctgcatgt

SEQ ID NO: 4873866 - DNA, 14 bp, Homo sapiens
ttttcctgcatgtt

SEQ ID NO: 4873867 - DNA, 13 bp, Homo sapiens
ttttctaaaagct

SEQ ID NO: 4873868 - DNA, 14 bp, Homo sapiens
ttttctaaagactt

SEQ ID NO: 4873869 - DNA, 21 bp, Homo sapiens
ttttctctggtaatattgact

SEQ ID NO: 4873870 - DNA, 20 bp, Homo sapiens
ttttcttcatgcctgatgaa

SEQ ID NO: 4873871 - DNA, 14 bp, Homo sapiens
ttttctttaactgc

SEQ ID NO: 4873872 - DNA, 17 bp, Homo sapiens
ttttgaaatgaactttg

SEQ ID NO: 4873873 - DNA, 13 bp, Homo sapiens
ttttgaagcatag

SEQ ID NO: 4873874 - DNA, 15 bp, Homo sapiens
ttttgatagttgtgt

SEQ ID NO: 4873875 - DNA, 23 bp, Homo sapiens
ttttggcaatgactcaaagtctg

SEQ ID NO: 4873876 - DNA, 17 bp, Homo sapiens
ttttgtcttttaatcca

SEQ ID NO: 4873877 - DNA, 16 bp, Homo sapiens
ttttgtttggtaaatg

SEQ ID NO: 4873878 - DNA, 13 bp, Homo sapiens
tttttaagaaaaa

SEQ ID NO: 4873879 - DNA, 16 bp, Homo sapiens
tttttaagcttcagtt

SEQ ID NO: 4873880 - DNA, 13 bp, Homo sapiens
tttttataattgt

SEQ ID NO: 4873881 - DNA, 11 bp, Homo sapiens
tttttcctgca

SEQ ID NO: 4873882 - DNA, 21 bp, Homo sapiens
tttttcttttcggaaatctta

SEQ ID NO: 4873883 - DNA, 20 bp, Homo sapiens
tttttggcgtggctgactta

SEQ ID NO: 4873884 - DNA, 15 bp, Homo sapiens
ttttttaagcttcag

SEQ ID NO: 4873885 - DNA, 12 bp, Homo sapiens
tttttttctatt

SEQ ID NO: 4873886 - DNA, 13 bp, Homo sapiens
gtgcacagctgtc

SEQ ID NO: 4873887 - DNA, 14 bp, Homo sapiens
gtgcacagctgtcc

SEQ ID NO: 4873888 - DNA, 18 bp, Homo sapiens
gtgcacgcagattagcag

SEQ ID NO: 4873889 - DNA, 15 bp, Homo sapiens
gtgcacgtggagagc

SEQ ID NO: 4873890 - DNA, 18 bp, Homo sapiens
gtgcacgttgcttcaggc

SEQ ID NO: 4873891 - DNA, 16 bp, Homo sapiens
gtgcagacagaagtct

SEQ ID NO: 4873892 - DNA, 23 bp, Homo sapiens
gtgcagaggaagtggaaggcatc

SEQ ID NO: 4873893 - DNA, 18 bp, Homo sapiens
gtgcaggtgctattgtta

SEQ ID NO: 4873894 - DNA, 15 bp, Homo sapiens
gtgcatctcagccca

SEQ ID NO: 4873895 - DNA, 14 bp, Homo sapiens
gtgcatgtgtgtat

SEQ ID NO: 4873896 - DNA, 21 bp, Homo sapiens
gtgcattagcacagattttaa

SEQ ID NO: 4873897 - DNA, 22 bp, Homo sapiens
gtgcattagcacagattttaat

SEQ ID NO: 4873898 - DNA, 14 bp, Homo sapiens
gtgcatttctgaat

SEQ ID NO: 4873899 - DNA, 15 bp, Homo sapiens
gtgccaactcctcac

SEQ ID NO: 4873900 - DNA, 20 bp, Homo sapiens
gtgccaaggacctcctcttc

SEQ ID NO: 4873901 - DNA, 20 bp, Homo sapiens
gtgccaatatgtattgtaaa

SEQ ID NO: 4873902 - DNA, 23 bp, Homo sapiens
gtgccactttacccacctagaac

SEQ ID NO: 4873903 - DNA, 20 bp, Homo sapiens
gtgccagaggaatcctggca

SEQ ID NO: 4873904 - DNA, 22 bp, Homo sapiens
gtgccagaggaatcctggcagc

SEQ ID NO: 4873905 - DNA, 15 bp, Homo sapiens
gtgccagcctgaggc

SEQ ID NO: 4873906 - DNA, 22 bp, Homo sapiens
gtgccaggtttttggtctgacc

SEQ ID NO: 4873907 - DNA, 14 bp, Homo sapiens
gtgccatgtgccag

SEQ ID NO: 4873908 - DNA, 20 bp, Homo sapiens
gtgcccagaacttccctgat

SEQ ID NO: 4873909 - DNA, 21 bp, Homo sapiens
gtgccccatgcctgtccagcc

SEQ ID NO: 4873910 - DNA, 23 bp, Homo sapiens
gtgccctcctgagggaggacctg

SEQ ID NO: 4873911 - DNA, 21 bp, Homo sapiens
gtgccgcctgcactcctcagg

SEQ ID NO: 4873912 - DNA, 13 bp, Homo sapiens
gtgccgtgtgagt

SEQ ID NO: 4873913 - DNA, 18 bp, Homo sapiens
gtgccgtgtgagtgtgac

SEQ ID NO: 4873914 - DNA, 23 bp, Homo sapiens
gtgcctccagaggggctcaggtc

SEQ ID NO: 4873915 - DNA, 12 bp, Homo sapiens
gtgcctctgcct

SEQ ID NO: 4873916 - DNA, 12 bp, Homo sapiens
gtgcctggcctg

SEQ ID NO: 4873917 - DNA, 19 bp, Homo sapiens
gtgcctggcctggcacaca

SEQ ID NO: 4873918 - DNA, 15 bp, Homo sapiens
gtgcctgtcccaccc

SEQ ID NO: 4873919 - DNA, 20 bp, Homo sapiens
gtgcctgtcccacccccacc

SEQ ID NO: 4873920 - DNA, 15 bp, Homo sapiens
gtgccttcagctcta

SEQ ID NO: 4873921 - DNA, 14 bp, Homo sapiens
gtgccttttatagc

SEQ ID NO: 4873922 - DNA, 14 bp, Homo sapiens
gtgcgaatggactt

SEQ ID NO: 4873923 - DNA, 21 bp, Homo sapiens
gtgcgatctgggttcactgca

SEQ ID NO: 4873924 - DNA, 13 bp, Homo sapiens
gtgcgtgaatgta

SEQ ID NO: 4873925 - DNA, 15 bp, Homo sapiens
gtgcgtgtgtagagt

SEQ ID NO: 4873926 - DNA, 22 bp, Homo sapiens
gtgctaaatggtcgcccaggag

SEQ ID NO: 4873927 - DNA, 23 bp, Homo sapiens
gtgctaaccacgtctgtcttcac

SEQ ID NO: 4873928 - DNA, 14 bp, Homo sapiens
gtgctaaggttcta

SEQ ID NO: 4873929 - DNA, 19 bp, Homo sapiens
gtgctagaatactttttaa

SEQ ID NO: 4873930 - DNA, 13 bp, Homo sapiens
gtgctatatatat

SEQ ID NO: 4873931 - DNA, 20 bp, Homo sapiens
gtgctatatatataaatatt

SEQ ID NO: 4873932 - DNA, 19 bp, Homo sapiens
gtgctcaccatgcttccag

SEQ ID NO: 4873933 - DNA, 14 bp, Homo sapiens
gtgctcctccttgg

SEQ ID NO: 4873934 - DNA, 15 bp, Homo sapiens
gtgctctcaccagct

SEQ ID NO: 4873935 - DNA, 15 bp, Homo sapiens
gtgctctggacaggc

SEQ ID NO: 4873936 - DNA, 12 bp, Homo sapiens
gtgctgccacac

SEQ ID NO: 4873937 - DNA, 18 bp, Homo sapiens
gtgctggatggagcccag

SEQ ID NO: 4873938 - DNA, 15 bp, Homo sapiens
gtgctggcaaccact

SEQ ID NO: 4873939 - DNA, 19 bp, Homo sapiens
gtgctggctcacagtacag

SEQ ID NO: 4873940 - DNA, 22 bp, Homo sapiens
gtgctgggattacaagcgtgag

SEQ ID NO: 4873941 - DNA, 20 bp, Homo sapiens
gtgctgggattacaggcgtg

SEQ ID NO: 4873942 - DNA, 18 bp, Homo sapiens
gtgctgtccatgcttctc

SEQ ID NO: 4873943 - DNA, 12 bp, Homo sapiens
gtgctgtgtgcc

SEQ ID NO: 4873944 - DNA, 22 bp, Homo sapiens
gtgcttcacagtagagccagct

SEQ ID NO: 4873945 - DNA, 20 bp, Homo sapiens
gtgcttgttccctctccctg

SEQ ID NO: 4873946 - DNA, 17 bp, Homo sapiens
gtgcttttcctatttgt

SEQ ID NO: 4873947 - DNA, 19 bp, Homo sapiens
gtgcttttcctatttgttt

SEQ ID NO: 4873948 - DNA, 20 bp, Homo sapiens
gtggaacataaaaaggacat

SEQ ID NO: 4873949 - DNA, 13 bp, Homo sapiens
gtggaacccagca

SEQ ID NO: 4873950 - DNA, 15 bp, Homo sapiens
gtggaacctctgtct

SEQ ID NO: 4873951 - DNA, 15 bp, Homo sapiens
gtggaagagtgtgtg

SEQ ID NO: 4873952 - DNA, 20 bp, Homo sapiens
gtggaaggcatcagtcccta

SEQ ID NO: 4873953 - DNA, 18 bp, Homo sapiens
gtggaagttccaagtcca

SEQ ID NO: 4873954 - DNA, 14 bp, Homo sapiens
gtggaatgagtgtg

SEQ ID NO: 4873955 - DNA, 15 bp, Homo sapiens
gtggaatttcttgtt

SEQ ID NO: 4873956 - DNA, 17 bp, Homo sapiens
gtggacaaactggagtc

SEQ ID NO: 4873957 - DNA, 15 bp, Homo sapiens
gtggacacagctctt

SEQ ID NO: 4873958 - DNA, 17 bp, Homo sapiens
gtggacacagctcttct

SEQ ID NO: 4873959 - DNA, 24 bp, Homo sapiens
gtggacacagctcttctccaggct

SEQ ID NO: 4873960 - DNA, 21 bp, Homo sapiens
gtggaccttaggccttcctct

SEQ ID NO: 4873961 - DNA, 21 bp, Homo sapiens
gtggaccttttaaagtgtttc

SEQ ID NO: 4873962 - DNA, 14 bp, Homo sapiens
gtggactctgcaca

SEQ ID NO: 4873963 - DNA, 17 bp, Homo sapiens
gtggactctgcacatgt

SEQ ID NO: 4873964 - DNA, 12 bp, Homo sapiens
gtggactctggt

SEQ ID NO: 4873965 - DNA, 15 bp, Homo sapiens
gtggactggcccctg

SEQ ID NO: 4873966 - DNA, 14 bp, Homo sapiens
gtggactgtggcac

SEQ ID NO: 4873967 - DNA, 22 bp, Homo sapiens
gtggactgtggcacttgcctgg

SEQ ID NO: 4873968 - DNA, 20 bp, Homo sapiens
gtggagactggggggcttga

SEQ ID NO: 4873969 - DNA, 17 bp, Homo sapiens
gtggagagctggtgccc

SEQ ID NO: 4873970 - DNA, 17 bp, Homo sapiens
gtggagcatgggcctgg

SEQ ID NO: 4873971 - DNA, 19 bp, Homo sapiens
gtggagcggggtatgaaga

SEQ ID NO: 4873972 - DNA, 14 bp, Homo sapiens
gtggaggaaggatt

SEQ ID NO: 4873973 - DNA, 15 bp, Homo sapiens
gtggaggaaggattg

SEQ ID NO: 4873974 - DNA, 19 bp, Homo sapiens
gtggaggaaggattgtaaa

SEQ ID NO: 4873975 - DNA, 20 bp, Homo sapiens
gtggatgcctggtggcagct

SEQ ID NO: 4873976 - DNA, 21 bp, Homo sapiens
gtggcaagctgtgacttctcc

SEQ ID NO: 4873977 - DNA, 17 bp, Homo sapiens
gtggcacttgcctgggt

SEQ ID NO: 4873978 - DNA, 18 bp, Homo sapiens
gtggcagtggaggtgggg

SEQ ID NO: 4873979 - DNA, 19 bp, Homo sapiens
gtggcagtgggagctgcct

SEQ ID NO: 4873980 - DNA, 21 bp, Homo sapiens
gtggcagtgggagctgcctgt

SEQ ID NO: 4873981 - DNA, 14 bp, Homo sapiens
gtggcattgaaatg

SEQ ID NO: 4873982 - DNA, 13 bp, Homo sapiens
gtggccactcagc

SEQ ID NO: 4873983 - DNA, 18 bp, Homo sapiens
gtggcccgacagcctggc

SEQ ID NO: 4873984 - DNA, 11 bp, Homo sapiens
gtggccctggc

SEQ ID NO: 4873985 - DNA, 18 bp, Homo sapiens
gtggcctcagctgaatgc

SEQ ID NO: 4873986 - DNA, 18 bp, Homo sapiens
gtggcctggccaggagct

SEQ ID NO: 4873987 - DNA, 20 bp, Homo sapiens
gtggcctggccaggagctct

SEQ ID NO: 4873988 - DNA, 22 bp, Homo sapiens
gtggctaaatgcctaataaaca

SEQ ID NO: 4873989 - DNA, 17 bp, Homo sapiens
gtggctgggggcaggag

SEQ ID NO: 4873990 - DNA, 20 bp, Homo sapiens
gtggctttccttgtggcaga

SEQ ID NO: 4873991 - DNA, 23 bp, Homo sapiens
gtggctttccttgtggcagagga

SEQ ID NO: 4873992 - DNA, 12 bp, Homo sapiens
gtgggaaaacac

SEQ ID NO: 4873993 - DNA, 15 bp, Homo sapiens
gtgggagcaggagat

SEQ ID NO: 4873994 - DNA, 19 bp, Homo sapiens
gtgggagggagcagacagg

SEQ ID NO: 4873995 - DNA, 16 bp, Homo sapiens
gtgggcactggcccag

SEQ ID NO: 4873996 - DNA, 13 bp, Homo sapiens
gtttccacatgct

SEQ ID NO: 4873997 - DNA, 14 bp, Homo sapiens
gtttccacatgctc

SEQ ID NO: 4873998 - DNA, 17 bp, Homo sapiens
gtttccagcagaagaca

SEQ ID NO: 4873999 - DNA, 21 bp, Homo sapiens
gtttccatagcaacaggaaaa

SEQ ID NO: 4874000 - DNA, 15 bp, Homo sapiens
gtttcgtttctgtat

SEQ ID NO: 4874001 - DNA, 17 bp, Homo sapiens
gtttctaagattctaaa

SEQ ID NO: 4874002 - DNA, 20 bp, Homo sapiens
gtttctaagattctaaaggt

SEQ ID NO: 4874003 - DNA, 22 bp, Homo sapiens
gtttctaaggtccggtgttcta

SEQ ID NO: 4874004 - DNA, 13 bp, Homo sapiens
gtttctcattctt

SEQ ID NO: 4874005 - DNA, 15 bp, Homo sapiens
gtttctcatttgttt

SEQ ID NO: 4874006 - DNA, 18 bp, Homo sapiens
gtttctcttgagctggcc

SEQ ID NO: 4874007 - DNA, 14 bp, Homo sapiens
gtttctgagaaaag

SEQ ID NO: 4874008 - DNA, 19 bp, Homo sapiens
gtttctgggtcctgaagaa

SEQ ID NO: 4874009 - DNA, 22 bp, Homo sapiens
gtttctgggtcctgaagaatta

SEQ ID NO: 4874010 - DNA, 20 bp, Homo sapiens
gtttcttcctgttaatgtat

SEQ ID NO: 4874011 - DNA, 20 bp, Homo sapiens
gtttcttctaactgcccctc

SEQ ID NO: 4874012 - DNA, 19 bp, Homo sapiens
gtttcttgcttgtacctct

SEQ ID NO: 4874013 - DNA, 20 bp, Homo sapiens
gtttgaaatgaggtctgttt

SEQ ID NO: 4874014 - DNA, 21 bp, Homo sapiens
gtttgaacacgaaagaaatgt

SEQ ID NO: 4874015 - DNA, 16 bp, Homo sapiens
gtttgaaggaaacagt

SEQ ID NO: 4874016 - DNA, 18 bp, Homo sapiens
gtttgaatatggacaaga

SEQ ID NO: 4874017 - DNA, 13 bp, Homo sapiens
gtttgacctcaca

SEQ ID NO: 4874018 - DNA, 18 bp, Homo sapiens
gtttgactagatgatgga

SEQ ID NO: 4874019 - DNA, 19 bp, Homo sapiens
gtttgactagatgatggat

SEQ ID NO: 4874020 - DNA, 22 bp, Homo sapiens
gtttgaggagcatgttttgtat

SEQ ID NO: 4874021 - DNA, 22 bp, Homo sapiens
gtttgatgcaggcacttattgt

SEQ ID NO: 4874022 - DNA, 20 bp, Homo sapiens
gtttgatgtcattaatgtgt

SEQ ID NO: 4874023 - DNA, 13 bp, Homo sapiens
gtttgcctctgcc

SEQ ID NO: 4874024 - DNA, 16 bp, Homo sapiens
gtttgcttcataaatg

SEQ ID NO: 4874025 - DNA, 23 bp, Homo sapiens
gtttggactttgtatactttaaa

SEQ ID NO: 4874026 - DNA, 19 bp, Homo sapiens
gtttggcaatagtttgcat

SEQ ID NO: 4874027 - DNA, 17 bp, Homo sapiens
gtttgggtgattcctaa

SEQ ID NO: 4874028 - DNA, 17 bp, Homo sapiens
gtttggtctggactgac

SEQ ID NO: 4874029 - DNA, 15 bp, Homo sapiens
gtttggtttacattt

SEQ ID NO: 4874030 - DNA, 20 bp, Homo sapiens
gtttgtaaatgttatttctg

SEQ ID NO: 4874031 - DNA, 16 bp, Homo sapiens
gtttgtataacttctt

SEQ ID NO: 4874032 - DNA, 14 bp, Homo sapiens
gtttgtctatttta

SEQ ID NO: 4874033 - DNA, 16 bp, Homo sapiens
gtttgtctattttaaa

SEQ ID NO: 4874034 - DNA, 15 bp, Homo sapiens
gtttgtctctccttt

SEQ ID NO: 4874035 - DNA, 18 bp, Homo sapiens
gtttgtctctccttttct

SEQ ID NO: 4874036 - DNA, 13 bp, Homo sapiens
gtttgtggcctca

SEQ ID NO: 4874037 - DNA, 15 bp, Homo sapiens
gtttgtggcctcaga

SEQ ID NO: 4874038 - DNA, 13 bp, Homo sapiens
gtttgtggctggg

SEQ ID NO: 4874039 - DNA, 22 bp, Homo sapiens
gtttgtgtatttacgctttgat

SEQ ID NO: 4874040 - DNA, 12 bp, Homo sapiens
gtttgttttttt

SEQ ID NO: 4874041 - DNA, 15 bp, Homo sapiens
gtttgtttttttgcc

SEQ ID NO: 4874042 - DNA, 17 bp, Homo sapiens
gtttgtttttttgccac

SEQ ID NO: 4874043 - DNA, 14 bp, Homo sapiens
gttttaaattctga

SEQ ID NO: 4874044 - DNA, 16 bp, Homo sapiens
gttttaaattctgaga

SEQ ID NO: 4874045 - DNA, 15 bp, Homo sapiens
gttttaagaaatgta

SEQ ID NO: 4874046 - DNA, 16 bp, Homo sapiens
gttttaagaggcaggg

SEQ ID NO: 4874047 - DNA, 14 bp, Homo sapiens
gttttaatttaaac

SEQ ID NO: 4874048 - DNA, 23 bp, Homo sapiens
gttttacaataaaatcttgaaaa

SEQ ID NO: 4874049 - DNA, 17 bp, Homo sapiens
gttttaggtagaaaaac

SEQ ID NO: 4874050 - DNA, 15 bp, Homo sapiens
gttttaggttctaaa

SEQ ID NO: 4874051 - DNA, 21 bp, Homo sapiens
gttttaggttctaaagttcta

SEQ ID NO: 4874052 - DNA, 14 bp, Homo sapiens
gttttataaaatag

SEQ ID NO: 4874053 - DNA, 16 bp, Homo sapiens
gttttataatgaaccc

SEQ ID NO: 4874054 - DNA, 21 bp, Homo sapiens
gttttattatttctattaaat

SEQ ID NO: 4874055 - DNA, 14 bp, Homo sapiens
gttttattcctgta

SEQ ID NO: 4874056 - DNA, 21 bp, Homo sapiens
gttttattttttattgttttc

SEQ ID NO: 4874057 - DNA, 11 bp, Homo sapiens
gttttcactct

SEQ ID NO: 4874058 - DNA, 19 bp, Homo sapiens
gttttcagaacctcttccc

SEQ ID NO: 4874059 - DNA, 21 bp, Homo sapiens
gttttcagaacctcttcccca

SEQ ID NO: 4874060 - DNA, 23 bp, Homo sapiens
gttttcgcacctaccatcaggga

SEQ ID NO: 4874061 - DNA, 18 bp, Homo sapiens
gttttctatttatgcctt

SEQ ID NO: 4874062 - DNA, 18 bp, Homo sapiens
gttttctcctcccaggaa

SEQ ID NO: 4874063 - DNA, 17 bp, Homo sapiens
gttttctctttgtgggg

SEQ ID NO: 4874064 - DNA, 15 bp, Homo sapiens
gttttctgtagtcat

SEQ ID NO: 4874065 - DNA, 12 bp, Homo sapiens
gttttcttcctt

SEQ ID NO: 4874066 - DNA, 13 bp, Homo sapiens
gttttgaaaagct

SEQ ID NO: 4874067 - DNA, 16 bp, Homo sapiens
gttttgagagtaatgc

SEQ ID NO: 4874068 - DNA, 22 bp, Homo sapiens
gttttgagtagatattacttta

SEQ ID NO: 4874069 - DNA, 21 bp, Homo sapiens
gttttgatgtttgtggcctca

SEQ ID NO: 4874070 - DNA, 19 bp, Homo sapiens
gttttgatttgtactgaaa

SEQ ID NO: 4874071 - DNA, 16 bp, Homo sapiens
gttttgccatgttggc

SEQ ID NO: 4874072 - DNA, 22 bp, Homo sapiens
gttttgccatgttggccaggct

SEQ ID NO: 4874073 - DNA, 16 bp, Homo sapiens
gttttggaagctctga

SEQ ID NO: 4874074 - DNA, 15 bp, Homo sapiens
gttttgggtatgttt

SEQ ID NO: 4874075 - DNA, 17 bp, Homo sapiens
gttttggtagattaaat

SEQ ID NO: 4874076 - DNA, 14 bp, Homo sapiens
gttttggttttttt

SEQ ID NO: 4874077 - DNA, 14 bp, Homo sapiens
gttttgtacataga

SEQ ID NO: 4874078 - DNA, 17 bp, Homo sapiens
gttttgtaggagacttg

SEQ ID NO: 4874079 - DNA, 21 bp, Homo sapiens
gttttgtatacaaatatattg

SEQ ID NO: 4874080 - DNA, 14 bp, Homo sapiens
gttttgtcttgaat

SEQ ID NO: 4874081 - DNA, 13 bp, Homo sapiens
gttttgtttgtct

SEQ ID NO: 4874082 - DNA, 11 bp, Homo sapiens
gtttttacagc

SEQ ID NO: 4874083 - DNA, 17 bp, Homo sapiens
gtttttagtaatctgta

SEQ ID NO: 4874084 - DNA, 17 bp, Homo sapiens
gtttttatattaatgta

SEQ ID NO: 4874085 - DNA, 12 bp, Homo sapiens
gtttttcattca

SEQ ID NO: 4874086 - DNA, 15 bp, Homo sapiens
gtttttcctttaaaa

SEQ ID NO: 4874087 - DNA, 11 bp, Homo sapiens
gtttttctcac

SEQ ID NO: 4874088 - DNA, 17 bp, Homo sapiens
gtttttgtttggagagc

SEQ ID NO: 4874089 - DNA, 16 bp, Homo sapiens
gttttttatgaagtgc

SEQ ID NO: 4874090 - DNA, 16 bp, Homo sapiens
gttttttattattgtg

SEQ ID NO: 4874091 - DNA, 22 bp, Homo sapiens
gtttttttttttaaaaaaagaa

SEQ ID NO: 4874092 - DNA, 18 bp, Homo sapiens
taaaaaaaaaaaaaagct

SEQ ID NO: 4874093 - DNA, 15 bp, Homo sapiens
taaaaaaaaatgcct

SEQ ID NO: 4874094 - DNA, 17 bp, Homo sapiens
taaaaaaaaatgccttt

SEQ ID NO: 4874095 - DNA, 18 bp, Homo sapiens
taaaaaaaaatgcctttg

SEQ ID NO: 4874096 - DNA, 21 bp, Homo sapiens
taaaaaaacaatcatttgctt

SEQ ID NO: 4874097 - DNA, 11 bp, Homo sapiens
taaaaaaagaa

SEQ ID NO: 4874098 - DNA, 12 bp, Homo sapiens
taaaaaaattta

SEQ ID NO: 4874099 - DNA, 12 bp, Homo sapiens
taaaaagaaaaa

SEQ ID NO: 4874100 - DNA, 16 bp, Homo sapiens
taaaaagaaatctggt

SEQ ID NO: 4874101 - DNA, 19 bp, Homo sapiens
taaaaagattctttttctg

SEQ ID NO: 4874102 - DNA, 22 bp, Homo sapiens
taaaaagcctgcaatttcatat

SEQ ID NO: 4874103 - DNA, 11 bp, Homo sapiens
taaaaaggaca

SEQ ID NO: 4874104 - DNA, 19 bp, Homo sapiens
taaaaaggacatcagcaaa

SEQ ID NO: 4874105 - DNA, 21 bp, Homo sapiens
taaaaaggacatcagcaaaca

SEQ ID NO: 4874106 - DNA, 18 bp, Homo sapiens
taaaaagtgacacagcag

SEQ ID NO: 4874107 - DNA, 15 bp, Homo sapiens
taactactagttttt

SEQ ID NO: 4874108 - DNA, 18 bp, Homo sapiens
taactagacaccaaagtt

SEQ ID NO: 4874109 - DNA, 21 bp, Homo sapiens
taactagacaccaaagttcta

SEQ ID NO: 4874110 - DNA, 19 bp, Homo sapiens
taactaggctcagagatgt

SEQ ID NO: 4874111 - DNA, 17 bp, Homo sapiens
taactataaatatgtac

SEQ ID NO: 4874112 - DNA, 23 bp, Homo sapiens
taactattgcatttatatgtacc

SEQ ID NO: 4874113 - DNA, 14 bp, Homo sapiens
taactcagaattat

SEQ ID NO: 4874114 - DNA, 16 bp, Homo sapiens
taactcatagtttgtt

SEQ ID NO: 4874115 - DNA, 20 bp, Homo sapiens
taactcatttgttaaaatta

SEQ ID NO: 4874116 - DNA, 17 bp, Homo sapiens
taactcctgagaaatgt

SEQ ID NO: 4874117 - DNA, 18 bp, Homo sapiens
taactctgtaaaaacact

SEQ ID NO: 4874118 - DNA, 16 bp, Homo sapiens
taactcttgtctattt

SEQ ID NO: 4874119 - DNA, 13 bp, Homo sapiens
taactggtataga

SEQ ID NO: 4874120 - DNA, 17 bp, Homo sapiens
taactgtgctgaatgct

SEQ ID NO: 4874121 - DNA, 19 bp, Homo sapiens
taacttaaaaatgtaaata

SEQ ID NO: 4874122 - DNA, 23 bp, Homo sapiens
taacttaaaaatgtaaatattct

SEQ ID NO: 4874123 - DNA, 16 bp, Homo sapiens
taacttatattgaaga

SEQ ID NO: 4874124 - DNA, 15 bp, Homo sapiens
taacttatgtagata

SEQ ID NO: 4874125 - DNA, 22 bp, Homo sapiens
taacttatgtagatatttggct

SEQ ID NO: 4874126 - DNA, 18 bp, Homo sapiens
taacttcacattaaaaaa

SEQ ID NO: 4874127 - DNA, 12 bp, Homo sapiens
taacttgatgca

SEQ ID NO: 4874128 - DNA, 13 bp, Homo sapiens
taacttgatgcat

SEQ ID NO: 4874129 - DNA, 15 bp, Homo sapiens
taacttgcgcagaaa

SEQ ID NO: 4874130 - DNA, 13 bp, Homo sapiens
taacttttgtaag

SEQ ID NO: 4874131 - DNA, 20 bp, Homo sapiens
taagaaaaaataacacacat

SEQ ID NO: 4874132 - DNA, 20 bp, Homo sapiens
taagaaaagtattttgaagt

SEQ ID NO: 4874133 - DNA, 15 bp, Homo sapiens
taagaaacttttgta

SEQ ID NO: 4874134 - DNA, 18 bp, Homo sapiens
taagaaacttttgtaaag

SEQ ID NO: 4874135 - DNA, 24 bp, Homo sapiens
taagaaatctagtatttcatgctg

SEQ ID NO: 4874136 - DNA, 13 bp, Homo sapiens
taagaagctgttg

SEQ ID NO: 4874137 - DNA, 15 bp, Homo sapiens
taagaagctgttgta

SEQ ID NO: 4874138 - DNA, 18 bp, Homo sapiens
taagaagctgttgtacat

SEQ ID NO: 4874139 - DNA, 22 bp, Homo sapiens
taagaagctgttgtacatttat

SEQ ID NO: 4874140 - DNA, 14 bp, Homo sapiens
taagaagcttctaa

SEQ ID NO: 4874141 - DNA, 16 bp, Homo sapiens
taagaagcttctaata

SEQ ID NO: 4874142 - DNA, 17 bp, Homo sapiens
taagaaggcaaaaatgt

SEQ ID NO: 4874143 - DNA, 18 bp, Homo sapiens
taagaatcagagtagaaa

SEQ ID NO: 4874144 - DNA, 19 bp, Homo sapiens
taagaatcagagtagaaat

SEQ ID NO: 4874145 - DNA, 17 bp, Homo sapiens
taagaatggttgcctta

SEQ ID NO: 4874146 - DNA, 14 bp, Homo sapiens
taagaattcaaact

SEQ ID NO: 4874147 - DNA, 22 bp, Homo sapiens
taagaattcaaactggggcctc

SEQ ID NO: 4874148 - DNA, 19 bp, Homo sapiens
taagaattgaccatctgct

SEQ ID NO: 4874149 - DNA, 23 bp, Homo sapiens
taagacacaaatgcatgaacaag

SEQ ID NO: 4874150 - DNA, 20 bp, Homo sapiens
taagacataacgtttttcct

SEQ ID NO: 4874151 - DNA, 22 bp, Homo sapiens
taagacataacgtttttccttt

SEQ ID NO: 4874152 - DNA, 21 bp, Homo sapiens
taagacatgatttccttgaat

SEQ ID NO: 4874153 - DNA, 21 bp, Homo sapiens
taagacatgcactatgaggaa

SEQ ID NO: 4874154 - DNA, 21 bp, Homo sapiens
taagacctactgttctaaagc

SEQ ID NO: 4874155 - DNA, 20 bp, Homo sapiens
taagacggttaaatactgtg

SEQ ID NO: 4874156 - DNA, 15 bp, Homo sapiens
taagactcaaatgtt

SEQ ID NO: 4874157 - DNA, 19 bp, Homo sapiens
taagactcaaatgttctaa

SEQ ID NO: 4874158 - DNA, 21 bp, Homo sapiens
taagactcaaatgttctaagt

SEQ ID NO: 4874159 - DNA, 15 bp, Homo sapiens
taagagaaactttat

SEQ ID NO: 4874160 - DNA, 16 bp, Homo sapiens
taagagaaactttata

SEQ ID NO: 4874161 - DNA, 13 bp, Homo sapiens
taagagaaagaaa

SEQ ID NO: 4874162 - DNA, 23 bp, Homo sapiens
taagagacagaatgtatctgtga

SEQ ID NO: 4874163 - DNA, 15 bp, Homo sapiens
taagaggcagggtct

SEQ ID NO: 4874164 - DNA, 14 bp, Homo sapiens
taagagtgctgggc

SEQ ID NO: 4874165 - DNA, 13 bp, Homo sapiens
taagagtgtagaa

SEQ ID NO: 4874166 - DNA, 14 bp, Homo sapiens
taagatacaaatta

SEQ ID NO: 4874167 - DNA, 23 bp, Homo sapiens
taagatcctagatcctaagggtc

SEQ ID NO: 4874168 - DNA, 14 bp, Homo sapiens
taagatgtgatatt

SEQ ID NO: 4874169 - DNA, 20 bp, Homo sapiens
taagatgtgatattctaaga

SEQ ID NO: 4874170 - DNA, 11 bp, Homo sapiens
taagattctaa

SEQ ID NO: 4874171 - DNA, 14 bp, Homo sapiens
taagattctaaagg

SEQ ID NO: 4874172 - DNA, 14 bp, Homo sapiens
taagattctaatga

SEQ ID NO: 4874173 - DNA, 15 bp, Homo sapiens
taagattctaatgat

SEQ ID NO: 4874174 - DNA, 14 bp, Homo sapiens
taagattctagatc

SEQ ID NO: 4874175 - DNA, 14 bp, Homo sapiens
taagattttacaaa

SEQ ID NO: 4874176 - DNA, 23 bp, Homo sapiens
taagcaaaaacaaaaagaaaaga

SEQ ID NO: 4874177 - DNA, 15 bp, Homo sapiens
taagcaaaagaaaaa

SEQ ID NO: 4874178 - DNA, 12 bp, Homo sapiens
taagcaaatact

SEQ ID NO: 4874179 - DNA, 13 bp, Homo sapiens
taagcaaatttca

SEQ ID NO: 4874180 - DNA, 20 bp, Homo sapiens
taagcaaatttcaaaagaca

SEQ ID NO: 4874181 - DNA, 13 bp, Homo sapiens
taagcactcttaa

SEQ ID NO: 4874182 - DNA, 14 bp, Homo sapiens
taagcatctaagtt

SEQ ID NO: 4874183 - DNA, 18 bp, Homo sapiens
taagcattaccactcagg

SEQ ID NO: 4874184 - DNA, 19 bp, Homo sapiens
taagcattaccactcaggc

SEQ ID NO: 4874185 - DNA, 15 bp, Homo sapiens
taagcattgcctggc

SEQ ID NO: 4874186 - DNA, 16 bp, Homo sapiens
taagccaaagaaatga

SEQ ID NO: 4874187 - DNA, 23 bp, Homo sapiens
taagccaaagaaatgaacattcc

SEQ ID NO: 4874188 - DNA, 22 bp, Homo sapiens
taagccacaagaaatttgattt

SEQ ID NO: 4874189 - DNA, 19 bp, Homo sapiens
taagccagtgttgcctaag

SEQ ID NO: 4874190 - DNA, 15 bp, Homo sapiens
taagcctacctgctc

SEQ ID NO: 4874191 - DNA, 16 bp, Homo sapiens
taagcctcatatttaa

SEQ ID NO: 4874192 - DNA, 16 bp, Homo sapiens
taagctaacccccttc

SEQ ID NO: 4874193 - DNA, 22 bp, Homo sapiens
taagctaacccccttctactga

SEQ ID NO: 4874194 - DNA, 16 bp, Homo sapiens
taagctgcagcttcct

SEQ ID NO: 4874195 - DNA, 17 bp, Homo sapiens
taaggaaactcttatct

SEQ ID NO: 4874196 - DNA, 19 bp, Homo sapiens
taaggaaactcttatctca

SEQ ID NO: 4874197 - DNA, 19 bp, Homo sapiens
taaggaaccttccttcctg

SEQ ID NO: 4874198 - DNA, 23 bp, Homo sapiens
taaggaccgtggccctgccctct

SEQ ID NO: 4874199 - DNA, 22 bp, Homo sapiens
taaggacctgaaattccaaagt

SEQ ID NO: 4874200 - DNA, 14 bp, Homo sapiens
taaggagaatggcc

SEQ ID NO: 4874201 - DNA, 19 bp, Homo sapiens
taaggatgtcacagggcca

SEQ ID NO: 4874202 - DNA, 20 bp, Homo sapiens
taaggcctaggattctaaaa

SEQ ID NO: 4874203 - DNA, 21 bp, Homo sapiens
taaggcctaggattctaaaat

SEQ ID NO: 4874204 - DNA, 14 bp, Homo sapiens
taaggctctagatc

SEQ ID NO: 4874205 - DNA, 22 bp, Homo sapiens
taaggctctgagagtctagatt

SEQ ID NO: 4874206 - DNA, 15 bp, Homo sapiens
taagggaagacattt

SEQ ID NO: 4874207 - DNA, 16 bp, Homo sapiens
taagggaagacatttc

SEQ ID NO: 4874208 - DNA, 18 bp, Homo sapiens
taaggtagaacctcacct

SEQ ID NO: 4874209 - DNA, 20 bp, Homo sapiens
taaggtccggtgttctaaga

SEQ ID NO: 4874210 - DNA, 15 bp, Homo sapiens
taaggttctaaggcc

SEQ ID NO: 4874211 - DNA, 13 bp, Homo sapiens
taagtaaatgcta

SEQ ID NO: 4874212 - DNA, 16 bp, Homo sapiens
taagtaattcaagaaa

SEQ ID NO: 4874213 - DNA, 15 bp, Homo sapiens
taagtatatcatgta

SEQ ID NO: 4874214 - DNA, 17 bp, Homo sapiens
taagtatatcatgtaaa

SEQ ID NO: 4874215 - DNA, 20 bp, Homo sapiens
taagtatgtgtaaaatgtga

SEQ ID NO: 4874216 - DNA, 14 bp, Homo sapiens
taagtattaaaaca

SEQ ID NO: 4874217 - DNA, 20 bp, Homo sapiens
agttcagagtccttaaaatg

SEQ ID NO: 4874218 - DNA, 20 bp, Homo sapiens
agttcaggtaacaggcagat

SEQ ID NO: 4874219 - DNA, 14 bp, Homo sapiens
agttcataccctgt

SEQ ID NO: 4874220 - DNA, 21 bp, Homo sapiens
agttcatacctaagtactgta

SEQ ID NO: 4874221 - DNA, 20 bp, Homo sapiens
agttcatattccatatttat

SEQ ID NO: 4874222 - DNA, 21 bp, Homo sapiens
agttccctgtctcttgaaaaa

SEQ ID NO: 4874223 - DNA, 16 bp, Homo sapiens
agttcctaagaagctt

SEQ ID NO: 4874224 - DNA, 22 bp, Homo sapiens
agttcctaagaagcttctaata

SEQ ID NO: 4874225 - DNA, 16 bp, Homo sapiens
agttcctgtatgaaag

SEQ ID NO: 4874226 - DNA, 16 bp, Homo sapiens
agttcctttgtgtgta

SEQ ID NO: 4874227 - DNA, 18 bp, Homo sapiens
agttcctttgtgtgtact

SEQ ID NO: 4874228 - DNA, 13 bp, Homo sapiens
agttctaagattc

SEQ ID NO: 4874229 - DNA, 17 bp, Homo sapiens
agttctaagattctaat

SEQ ID NO: 4874230 - DNA, 15 bp, Homo sapiens
agttctaagattctg

SEQ ID NO: 4874231 - DNA, 17 bp, Homo sapiens
agttctaagattctgat

SEQ ID NO: 4874232 - DNA, 10 bp, Homo sapiens
agttctaggc

SEQ ID NO: 4874233 - DNA, 19 bp, Homo sapiens
agttctggaaaagaactgt

SEQ ID NO: 4874234 - DNA, 13 bp, Homo sapiens
agttctgtgttta

SEQ ID NO: 4874235 - DNA, 15 bp, Homo sapiens
agttctgtgtttaat

SEQ ID NO: 4874236 - DNA, 16 bp, Homo sapiens
agttcttagccctcta

SEQ ID NO: 4874237 - DNA, 22 bp, Homo sapiens
agttgacaaaaagctcttacac

SEQ ID NO: 4874238 - DNA, 16 bp, Homo sapiens
agttgaggaactgtac

SEQ ID NO: 4874239 - DNA, 15 bp, Homo sapiens
agttgatgttgcatt

SEQ ID NO: 4874240 - DNA, 19 bp, Homo sapiens
agttgccaagacaaatcaa

SEQ ID NO: 4874241 - DNA, 20 bp, Homo sapiens
agttgccaccacctctgtgg

SEQ ID NO: 4874242 - DNA, 22 bp, Homo sapiens
agttgccaccacctctgtggca

SEQ ID NO: 4874243 - DNA, 13 bp, Homo sapiens
agttggactaaat

SEQ ID NO: 4874244 - DNA, 14 bp, Homo sapiens
agttggactaaatg

SEQ ID NO: 4874245 - DNA, 18 bp, Homo sapiens
agttggctggatgaaatt

SEQ ID NO: 4874246 - DNA, 23 bp, Homo sapiens
agttgggaacttcagatggacct

SEQ ID NO: 4874247 - DNA, 19 bp, Homo sapiens
agttgggcttcctcatagt

SEQ ID NO: 4874248 - DNA, 16 bp, Homo sapiens
agttgtcacatcagat

SEQ ID NO: 4874249 - DNA, 17 bp, Homo sapiens
agttgtgaaagttttga

SEQ ID NO: 4874250 - DNA, 15 bp, Homo sapiens
agttgtgccttttat

SEQ ID NO: 4874251 - DNA, 22 bp, Homo sapiens
agttgtgccttttatagctatt

SEQ ID NO: 4874252 - DNA, 20 bp, Homo sapiens
agttgttcaataataaatat

SEQ ID NO: 4874253 - DNA, 16 bp, Homo sapiens
agttgtttgtttttgc

SEQ ID NO: 4874254 - DNA, 17 bp, Homo sapiens
agttgtttgtttttgct

SEQ ID NO: 4874255 - DNA, 20 bp, Homo sapiens
agtttaaaacagtatttatt

SEQ ID NO: 4874256 - DNA, 21 bp, Homo sapiens
agtttacaagtgtatatcaga

SEQ ID NO: 4874257 - DNA, 13 bp, Homo sapiens
agtttacattgta

SEQ ID NO: 4874258 - DNA, 12 bp, Homo sapiens
agtttacatttt

SEQ ID NO: 4874259 - DNA, 21 bp, Homo sapiens
agtttacccatgaagattggt

SEQ ID NO: 4874260 - DNA, 20 bp, Homo sapiens
agtttactagcttttcaaac

SEQ ID NO: 4874261 - DNA, 14 bp, Homo sapiens
agtttatcatgaag

SEQ ID NO: 4874262 - DNA, 22 bp, Homo sapiens
agtttatttccaaataaaatga

SEQ ID NO: 4874263 - DNA, 12 bp, Homo sapiens
agtttcaatgtg

SEQ ID NO: 4874264 - DNA, 22 bp, Homo sapiens
agtttcaatgtgattctaatgt

SEQ ID NO: 4874265 - DNA, 17 bp, Homo sapiens
agtttcagatatatatc

SEQ ID NO: 4874266 - DNA, 20 bp, Homo sapiens
agtttcaggtgacatgtgaa

SEQ ID NO: 4874267 - DNA, 21 bp, Homo sapiens
agtttcaggtgacatgtgaaa

SEQ ID NO: 4874268 - DNA, 20 bp, Homo sapiens
agtttcattctcctgcctgt

SEQ ID NO: 4874269 - DNA, 17 bp, Homo sapiens
agtttccagtctcaaaa

SEQ ID NO: 4874270 - DNA, 17 bp, Homo sapiens
agtttccatagcaacag

SEQ ID NO: 4874271 - DNA, 15 bp, Homo sapiens
agtttctaagattct

SEQ ID NO: 4874272 - DNA, 20 bp, Homo sapiens
agtttctaagattctaaagg

SEQ ID NO: 4874273 - DNA, 11 bp, Homo sapiens
agtttctaagg

SEQ ID NO: 4874274 - DNA, 16 bp, Homo sapiens
agtttctcagctccca

SEQ ID NO: 4874275 - DNA, 14 bp, Homo sapiens
agtttctgtttgat

SEQ ID NO: 4874276 - DNA, 17 bp, Homo sapiens
agtttctgtttgattct

SEQ ID NO: 4874277 - DNA, 15 bp, Homo sapiens
agtttcttagctttt

SEQ ID NO: 4874278 - DNA, 15 bp, Homo sapiens
agtttgaacttcata

SEQ ID NO: 4874279 - DNA, 16 bp, Homo sapiens
agtttgaaggaaacag

SEQ ID NO: 4874280 - DNA, 20 bp, Homo sapiens
agtttgatcacactatttta

SEQ ID NO: 4874281 - DNA, 18 bp, Homo sapiens
agtttggattcttatgta

SEQ ID NO: 4874282 - DNA, 17 bp, Homo sapiens
agtttggcaatagtttg

SEQ ID NO: 4874283 - DNA, 15 bp, Homo sapiens
agtttggtatttgcg

SEQ ID NO: 4874284 - DNA, 15 bp, Homo sapiens
agtttgtaaatgtta

SEQ ID NO: 4874285 - DNA, 20 bp, Homo sapiens
agtttgtaaatgttatttct

SEQ ID NO: 4874286 - DNA, 23 bp, Homo sapiens
agtttgtaaatgttatttctgca

SEQ ID NO: 4874287 - DNA, 17 bp, Homo sapiens
agtttgtaggtaaaatg

SEQ ID NO: 4874288 - DNA, 17 bp, Homo sapiens
agtttgtagttgtttta

SEQ ID NO: 4874289 - DNA, 14 bp, Homo sapiens
agtttgtataactt

SEQ ID NO: 4874290 - DNA, 18 bp, Homo sapiens
agtttgtgtgttgtcttg

SEQ ID NO: 4874291 - DNA, 15 bp, Homo sapiens
agttttaaactcatt

SEQ ID NO: 4874292 - DNA, 23 bp, Homo sapiens
agttttaaactcatttttgccat

SEQ ID NO: 4874293 - DNA, 15 bp, Homo sapiens
agttttatgctcttt

SEQ ID NO: 4874294 - DNA, 23 bp, Homo sapiens
agttttatgctcttttttactca

SEQ ID NO: 4874295 - DNA, 16 bp, Homo sapiens
agttttattttatgtt

SEQ ID NO: 4874296 - DNA, 19 bp, Homo sapiens
agttttattttatgtttag

SEQ ID NO: 4874297 - DNA, 17 bp, Homo sapiens
agttttcagaacctctt

SEQ ID NO: 4874298 - DNA, 18 bp, Homo sapiens
agttttcagaacctcttc

SEQ ID NO: 4874299 - DNA, 21 bp, Homo sapiens
agttttcagaacctcttcccc

SEQ ID NO: 4874300 - DNA, 11 bp, Homo sapiens
agttttcctga

SEQ ID NO: 4874301 - DNA, 21 bp, Homo sapiens
gtcatggtttcttggagggcc

SEQ ID NO: 4874302 - DNA, 12 bp, Homo sapiens
gtcatgtggcta

SEQ ID NO: 4874303 - DNA, 20 bp, Homo sapiens
gtcatgtgggtcttccaggg

SEQ ID NO: 4874304 - DNA, 16 bp, Homo sapiens
gtcatgtgttcccttt

SEQ ID NO: 4874305 - DNA, 15 bp, Homo sapiens
gtcatttaaatgtgt

SEQ ID NO: 4874306 - DNA, 17 bp, Homo sapiens
gtcatttactaaacata

SEQ ID NO: 4874307 - DNA, 16 bp, Homo sapiens
gtcatttcattccatt

SEQ ID NO: 4874308 - DNA, 18 bp, Homo sapiens
gtctatcaagtcaatcat

SEQ ID NO: 4874309 - DNA, 14 bp, Homo sapiens
gtctatgggactca

SEQ ID NO: 4874310 - DNA, 15 bp, Homo sapiens
gtctatgggactcaa

SEQ ID NO: 4874311 - DNA, 22 bp, Homo sapiens
gtctcaagagggcactggtggc

SEQ ID NO: 4874312 - DNA, 19 bp, Homo sapiens
gtctcaagggctagcatcc

SEQ ID NO: 4874313 - DNA, 19 bp, Homo sapiens
gtctcacagtgttgcccag

SEQ ID NO: 4874314 - DNA, 18 bp, Homo sapiens
gtctcactctgtcgccca

SEQ ID NO: 4874315 - DNA, 21 bp, Homo sapiens
gtctcactgaaacatttaaat

SEQ ID NO: 4874316 - DNA, 17 bp, Homo sapiens
gtctcactgttgcccag

SEQ ID NO: 4874317 - DNA, 20 bp, Homo sapiens
gtctcagacttttgtacatc

SEQ ID NO: 4874318 - DNA, 22 bp, Homo sapiens
gtctcagtggcttcatctgtca

SEQ ID NO: 4874319 - DNA, 15 bp, Homo sapiens
gtctcattttaatgt

SEQ ID NO: 4874320 - DNA, 20 bp, Homo sapiens
gtctcattttaatgtaaaga

SEQ ID NO: 4874321 - DNA, 17 bp, Homo sapiens
gtctcccacgtgggaga

SEQ ID NO: 4874322 - DNA, 20 bp, Homo sapiens
gtctcccagttatgaatcag

SEQ ID NO: 4874323 - DNA, 17 bp, Homo sapiens
gtctcctactcctgact

SEQ ID NO: 4874324 - DNA, 13 bp, Homo sapiens
gtctcctctttaa

SEQ ID NO: 4874325 - DNA, 18 bp, Homo sapiens
gtctcctctttaaaacaa

SEQ ID NO: 4874326 - DNA, 13 bp, Homo sapiens
gtctctaaagcac

SEQ ID NO: 4874327 - DNA, 21 bp, Homo sapiens
gtctctaattctattaaagtg

SEQ ID NO: 4874328 - DNA, 16 bp, Homo sapiens
gtctctcacagatgtg

SEQ ID NO: 4874329 - DNA, 21 bp, Homo sapiens
gtctctcctgtaagccaaaga

SEQ ID NO: 4874330 - DNA, 19 bp, Homo sapiens
gtctctccttttcttttgt

SEQ ID NO: 4874331 - DNA, 20 bp, Homo sapiens
gtctctccttttcttttgtt

SEQ ID NO: 4874332 - DNA, 22 bp, Homo sapiens
gtctctccttttcttttgttac

SEQ ID NO: 4874333 - DNA, 23 bp, Homo sapiens
gtctctccttttcttttgttact

SEQ ID NO: 4874334 - DNA, 21 bp, Homo sapiens
gtctctcttcagactctcagc

SEQ ID NO: 4874335 - DNA, 15 bp, Homo sapiens
gtctctgctcgccct

SEQ ID NO: 4874336 - DNA, 23 bp, Homo sapiens
gtctctgctcgccctcctttctg

SEQ ID NO: 4874337 - DNA, 21 bp, Homo sapiens
gtctctggggcaggctgcttc

SEQ ID NO: 4874338 - DNA, 23 bp, Homo sapiens
gtctctttaatgtcacaggcagg

SEQ ID NO: 4874339 - DNA, 12 bp, Homo sapiens
gtctcttttgta

SEQ ID NO: 4874340 - DNA, 18 bp, Homo sapiens
gtctcttttgtaaattaa

SEQ ID NO: 4874341 - DNA, 19 bp, Homo sapiens
gtctcttttgtaaattaaa

SEQ ID NO: 4874342 - DNA, 18 bp, Homo sapiens
gtctgacaggcaatgctg

SEQ ID NO: 4874343 - DNA, 23 bp, Homo sapiens
gtctgacaggcaatgctggctgt

SEQ ID NO: 4874344 - DNA, 14 bp, Homo sapiens
gtctgacccactgc

SEQ ID NO: 4874345 - DNA, 20 bp, Homo sapiens
gtctgagccacagcagcatt

SEQ ID NO: 4874346 - DNA, 13 bp, Homo sapiens
gtctgattggctt

SEQ ID NO: 4874347 - DNA, 18 bp, Homo sapiens
gtctgattggcttgtaga

SEQ ID NO: 4874348 - DNA, 10 bp, Homo sapiens
gtctgccctt

SEQ ID NO: 4874349 - DNA, 15 bp, Homo sapiens
gtctgcgtgggtcag

SEQ ID NO: 4874350 - DNA, 23 bp, Homo sapiens
gtctgctcagacagaacccctac

SEQ ID NO: 4874351 - DNA, 22 bp, Homo sapiens
gtctgctttaaagggcctgcct

SEQ ID NO: 4874352 - DNA, 23 bp, Homo sapiens
gtctgctttaaagggcctgcctg

SEQ ID NO: 4874353 - DNA, 15 bp, Homo sapiens
gtctggaatgcagtg

SEQ ID NO: 4874354 - DNA, 18 bp, Homo sapiens
gtctggaatgcagtggta

SEQ ID NO: 4874355 - DNA, 14 bp, Homo sapiens
gtctggactgacag

SEQ ID NO: 4874356 - DNA, 17 bp, Homo sapiens
gtctggactgacagcat

SEQ ID NO: 4874357 - DNA, 19 bp, Homo sapiens
gtctggagtgggcagagcc

SEQ ID NO: 4874358 - DNA, 14 bp, Homo sapiens
gtctgggacacaaa

SEQ ID NO: 4874359 - DNA, 20 bp, Homo sapiens
gtctgtacacgtgtcctgta

SEQ ID NO: 4874360 - DNA, 15 bp, Homo sapiens
gtctgtcttcacagc

SEQ ID NO: 4874361 - DNA, 18 bp, Homo sapiens
gtctgttgtgtgtcatgc

SEQ ID NO: 4874362 - DNA, 13 bp, Homo sapiens
gtctgtttaaagt

SEQ ID NO: 4874363 - DNA, 18 bp, Homo sapiens
gtcttaattattatttgt

SEQ ID NO: 4874364 - DNA, 18 bp, Homo sapiens
gtcttcagcattccctcc

SEQ ID NO: 4874365 - DNA, 11 bp, Homo sapiens
gtcttcataaa

SEQ ID NO: 4874366 - DNA, 16 bp, Homo sapiens
gtcttcatttcattgt

SEQ ID NO: 4874367 - DNA, 17 bp, Homo sapiens
gtcttcatttcattgta

SEQ ID NO: 4874368 - DNA, 21 bp, Homo sapiens
gtcttccctacctcaggcagg

SEQ ID NO: 4874369 - DNA, 23 bp, Homo sapiens
gtcttctaatttcaaaaatataa

SEQ ID NO: 4874370 - DNA, 18 bp, Homo sapiens
gtcttctgacaaactgtg

SEQ ID NO: 4874371 - DNA, 19 bp, Homo sapiens
gtcttgcaatggcagcctt

SEQ ID NO: 4874372 - DNA, 21 bp, Homo sapiens
gtcttgcaatggcagccttgg

SEQ ID NO: 4874373 - DNA, 23 bp, Homo sapiens
gtcttgcaatggcagccttggca

SEQ ID NO: 4874374 - DNA, 18 bp, Homo sapiens
gtcttggacactgtacaa

SEQ ID NO: 4874375 - DNA, 15 bp, Homo sapiens
gtcttggtattctta

SEQ ID NO: 4874376 - DNA, 18 bp, Homo sapiens
gtcttggtttctctctac

SEQ ID NO: 4874377 - DNA, 15 bp, Homo sapiens
gtcttgtacatgtgt

SEQ ID NO: 4874378 - DNA, 15 bp, Homo sapiens
gtctttaaaagagag

SEQ ID NO: 4874379 - DNA, 22 bp, Homo sapiens
gtctttaaaggcccagccccta

SEQ ID NO: 4874380 - DNA, 15 bp, Homo sapiens
gtctttcacagctcc

SEQ ID NO: 4874381 - DNA, 14 bp, Homo sapiens
gtctttctccaaag

SEQ ID NO: 4874382 - DNA, 13 bp, Homo sapiens
gtctttgtaagag

SEQ ID NO: 4874383 - DNA, 22 bp, Homo sapiens
gtctttgtaagagtgtagaagc

SEQ ID NO: 4874384 - DNA, 21 bp, Homo sapiens
gtctttgtaagtcagtgttga

SEQ ID NO: 4874385 - DNA, 23 bp, Homo sapiens
gtctttgtaagtcagtgttgaga

SEQ ID NO: 4874386 - DNA, 17 bp, Homo sapiens
gtcttttaatgcttcat

SEQ ID NO: 4874387 - DNA, 22 bp, Homo sapiens
gtcttttatagtggaaaaacac

SEQ ID NO: 4874388 - DNA, 14 bp, Homo sapiens
gtcttttgaatatt

SEQ ID NO: 4874389 - DNA, 19 bp, Homo sapiens
gtcttttgaatattcccaa

SEQ ID NO: 4874390 - DNA, 17 bp, Homo sapiens
gtctttttctgttgtaa

SEQ ID NO: 4874391 - DNA, 16 bp, Homo sapiens
gtcttttttcactaca

SEQ ID NO: 4874392 - DNA, 15 bp, Homo sapiens
gtgaaaacggagctg

SEQ ID NO: 4874393 - DNA, 12 bp, Homo sapiens
gtgaaaatcttg

SEQ ID NO: 4874394 - DNA, 14 bp, Homo sapiens
gtgaaacacagctg

SEQ ID NO: 4874395 - DNA, 16 bp, Homo sapiens
gtgaaacacagctgtt

SEQ ID NO: 4874396 - DNA, 17 bp, Homo sapiens
gtgaaaccttttttaag

SEQ ID NO: 4874397 - DNA, 17 bp, Homo sapiens
gtgaaagcatatgggtt

SEQ ID NO: 4874398 - DNA, 20 bp, Homo sapiens
gtgaaagctgagaactcctg

SEQ ID NO: 4874399 - DNA, 17 bp, Homo sapiens
gtgaaagtacatttgga

SEQ ID NO: 4874400 - DNA, 16 bp, Homo sapiens
gtgaaatggccaggat

SEQ ID NO: 4874401 - DNA, 18 bp, Homo sapiens
gtgaaatttctagcctgc

SEQ ID NO: 4874402 - DNA, 22 bp, Homo sapiens
gtgaaattttcttgatttgagt

SEQ ID NO: 4874403 - DNA, 18 bp, Homo sapiens
gtgaacaaaagatgctct

SEQ ID NO: 4874404 - DNA, 21 bp, Homo sapiens
gtgaaccaccacacccagccc

SEQ ID NO: 4874405 - DNA, 22 bp, Homo sapiens
gtgaaccaccacacccagccca

SEQ ID NO: 4874406 - DNA, 18 bp, Homo sapiens
gtgaacttgtagctgtaa

SEQ ID NO: 4874407 - DNA, 12 bp, Homo sapiens
gtgaataataat

SEQ ID NO: 4874408 - DNA, 14 bp, Homo sapiens
gtgaatcagagcac

SEQ ID NO: 4874409 - DNA, 19 bp, Homo sapiens
gtgaatgaaagattaaaca

SEQ ID NO: 4874410 - DNA, 15 bp, Homo sapiens
gtgaatggattggat

SEQ ID NO: 4874411 - DNA, 16 bp, Homo sapiens
gtgacagaggcagccc

SEQ ID NO: 4874412 - DNA, 18 bp, Homo sapiens
gtgacagaggcagcccca

SEQ ID NO: 4874413 - DNA, 14 bp, Homo sapiens
gtgacagggccagt

SEQ ID NO: 4874414 - DNA, 21 bp, Homo sapiens
gtgacagggccagtggggcct

SEQ ID NO: 4874415 - DNA, 22 bp, Homo sapiens
gtgacatgtgaaacctttttta

SEQ ID NO: 4874416 - DNA, 22 bp, Homo sapiens
atatcatgctttaaagtgtaat

SEQ ID NO: 4874417 - DNA, 13 bp, Homo sapiens
atatcatgtaaag

SEQ ID NO: 4874418 - DNA, 14 bp, Homo sapiens
atatccaccacctc

SEQ ID NO: 4874419 - DNA, 14 bp, Homo sapiens
atatcctgtgactg

SEQ ID NO: 4874420 - DNA, 20 bp, Homo sapiens
atatcctgtgactgtctcac

SEQ ID NO: 4874421 - DNA, 16 bp, Homo sapiens
atatcctttctaacaa

SEQ ID NO: 4874422 - DNA, 19 bp, Homo sapiens
atatcggctcacaaagaga

SEQ ID NO: 4874423 - DNA, 14 bp, Homo sapiens
atatctaatatata

SEQ ID NO: 4874424 - DNA, 22 bp, Homo sapiens
atatctatagtagacacactat

SEQ ID NO: 4874425 - DNA, 15 bp, Homo sapiens
atatctattaatata

SEQ ID NO: 4874426 - DNA, 18 bp, Homo sapiens
atatcttgcgaatccaag

SEQ ID NO: 4874427 - DNA, 21 bp, Homo sapiens
atatctttgtgataatttaag

SEQ ID NO: 4874428 - DNA, 22 bp, Homo sapiens
atatctttgtgataatttaaga

SEQ ID NO: 4874429 - DNA, 12 bp, Homo sapiens
atatcttttatg

SEQ ID NO: 4874430 - DNA, 18 bp, Homo sapiens
atatcttttatgtttgaa

SEQ ID NO: 4874431 - DNA, 22 bp, Homo sapiens
atatcttttatgtttgaatatg

SEQ ID NO: 4874432 - DNA, 21 bp, Homo sapiens
atatgagcttccttctgtgaa

SEQ ID NO: 4874433 - DNA, 16 bp, Homo sapiens
atatgagtatacaata

SEQ ID NO: 4874434 - DNA, 17 bp, Homo sapiens
atatgagtatacaatat

SEQ ID NO: 4874435 - DNA, 22 bp, Homo sapiens
atatgagtatacaatatataaa

SEQ ID NO: 4874436 - DNA, 13 bp, Homo sapiens
atatgattgtttc

SEQ ID NO: 4874437 - DNA, 23 bp, Homo sapiens
atatgatttcactagaaaagctg

SEQ ID NO: 4874438 - DNA, 17 bp, Homo sapiens
atatgctaatttgggga

SEQ ID NO: 4874439 - DNA, 16 bp, Homo sapiens
atatggacaagaggta

SEQ ID NO: 4874440 - DNA, 15 bp, Homo sapiens
atatggacacttaat

SEQ ID NO: 4874441 - DNA, 13 bp, Homo sapiens
atatggcaagaaa

SEQ ID NO: 4874442 - DNA, 23 bp, Homo sapiens
atatggccacagtagtcttgatg

SEQ ID NO: 4874443 - DNA, 22 bp, Homo sapiens
atatggtctaccagtttgctga

SEQ ID NO: 4874444 - DNA, 16 bp, Homo sapiens
atatgtaacaagccac

SEQ ID NO: 4874445 - DNA, 17 bp, Homo sapiens
atatgtacaattgtggg

SEQ ID NO: 4874446 - DNA, 21 bp, Homo sapiens
atatgtagactatatacatgt

SEQ ID NO: 4874447 - DNA, 19 bp, Homo sapiens
atatgtagtataaagaaaa

SEQ ID NO: 4874448 - DNA, 23 bp, Homo sapiens
atatgtatatttttttaatttaa

SEQ ID NO: 4874449 - DNA, 18 bp, Homo sapiens
atatgtattatttataat

SEQ ID NO: 4874450 - DNA, 21 bp, Homo sapiens
atatgtattgtaaacatgtgt

SEQ ID NO: 4874451 - DNA, 20 bp, Homo sapiens
atatgtctcgctagtgatgt

SEQ ID NO: 4874452 - DNA, 21 bp, Homo sapiens
atatgtgaatcctcttcttta

SEQ ID NO: 4874453 - DNA, 20 bp, Homo sapiens
atatgtgatctgtcttgtaa

SEQ ID NO: 4874454 - DNA, 15 bp, Homo sapiens
atatgtgtatatata

SEQ ID NO: 4874455 - DNA, 18 bp, Homo sapiens
atatgtgtatatatacat

SEQ ID NO: 4874456 - DNA, 20 bp, Homo sapiens
atatgtgtatatatacatac

SEQ ID NO: 4874457 - DNA, 21 bp, Homo sapiens
atatgtgtatatatacataca

SEQ ID NO: 4874458 - DNA, 18 bp, Homo sapiens
atatgtgttgaaaaccaa

SEQ ID NO: 4874459 - DNA, 20 bp, Homo sapiens
atatgtgttgaaaaccaaaa

SEQ ID NO: 4874460 - DNA, 14 bp, Homo sapiens
atatgttgaatact

SEQ ID NO: 4874461 - DNA, 18 bp, Homo sapiens
atatgttgaatacttttt

SEQ ID NO: 4874462 - DNA, 13 bp, Homo sapiens
atatgtttccttg

SEQ ID NO: 4874463 - DNA, 18 bp, Homo sapiens
atatgtttccttgtttat

SEQ ID NO: 4874464 - DNA, 14 bp, Homo sapiens
atattaacatgctt

SEQ ID NO: 4874465 - DNA, 18 bp, Homo sapiens
atattactgtttatttct

SEQ ID NO: 4874466 - DNA, 11 bp, Homo sapiens
atattacttta

SEQ ID NO: 4874467 - DNA, 14 bp, Homo sapiens
atattactttatca

SEQ ID NO: 4874468 - DNA, 18 bp, Homo sapiens
atattactttatcacttt

SEQ ID NO: 4874469 - DNA, 15 bp, Homo sapiens
atattataaatatat

SEQ ID NO: 4874470 - DNA, 17 bp, Homo sapiens
atattatgtgtttccat

SEQ ID NO: 4874471 - DNA, 23 bp, Homo sapiens
atattatttgctaattaaaaagt

SEQ ID NO: 4874472 - DNA, 14 bp, Homo sapiens
atattatttggcag

SEQ ID NO: 4874473 - DNA, 23 bp, Homo sapiens
atattcaaccatggactttataa

SEQ ID NO: 4874474 - DNA, 15 bp, Homo sapiens
atattcactgggcca

SEQ ID NO: 4874475 - DNA, 14 bp, Homo sapiens
atattcagagaata

SEQ ID NO: 4874476 - DNA, 17 bp, Homo sapiens
atattcattcatggacc

SEQ ID NO: 4874477 - DNA, 13 bp, Homo sapiens
atattctaagact

SEQ ID NO: 4874478 - DNA, 14 bp, Homo sapiens
atattctaagactt

SEQ ID NO: 4874479 - DNA, 20 bp, Homo sapiens
atattctatatgaatttaaa

SEQ ID NO: 4874480 - DNA, 24 bp, Homo sapiens
atattctgaagcaacattttagct

SEQ ID NO: 4874481 - DNA, 13 bp, Homo sapiens
atattcttataaa

SEQ ID NO: 4874482 - DNA, 21 bp, Homo sapiens
atattcttttctgcaaaatag

SEQ ID NO: 4874483 - DNA, 16 bp, Homo sapiens
atattgaagacaattt

SEQ ID NO: 4874484 - DNA, 20 bp, Homo sapiens
atattgaagacaatttgata

SEQ ID NO: 4874485 - DNA, 20 bp, Homo sapiens
atattgacatttgtagttga

SEQ ID NO: 4874486 - DNA, 16 bp, Homo sapiens
atattgaggctttgtg

SEQ ID NO: 4874487 - DNA, 13 bp, Homo sapiens
atattggtattca

SEQ ID NO: 4874488 - DNA, 14 bp, Homo sapiens
atattgtacataaa

SEQ ID NO: 4874489 - DNA, 17 bp, Homo sapiens
atattgtacataaaaga

SEQ ID NO: 4874490 - DNA, 21 bp, Homo sapiens
atattgtacataaaagaattt

SEQ ID NO: 4874491 - DNA, 20 bp, Homo sapiens
ataaaatcaatttttaggaa

SEQ ID NO: 4874492 - DNA, 20 bp, Homo sapiens
ataaaatcctaagacacaaa

SEQ ID NO: 4874493 - DNA, 15 bp, Homo sapiens
ataaaatgtgttgaa

SEQ ID NO: 4874494 - DNA, 14 bp, Homo sapiens
ataaacaatgatgc

SEQ ID NO: 4874495 - DNA, 16 bp, Homo sapiens
ataaacatcacacaca

SEQ ID NO: 4874496 - DNA, 17 bp, Homo sapiens
ataaacatcacacacac

SEQ ID NO: 4874497 - DNA, 15 bp, Homo sapiens
ataaaccaaaggaca

SEQ ID NO: 4874498 - DNA, 21 bp, Homo sapiens
ataaaccaaaggacattatgt

SEQ ID NO: 4874499 - DNA, 15 bp, Homo sapiens
ataaacgcaagctga

SEQ ID NO: 4874500 - DNA, 16 bp, Homo sapiens
ataaactactctttga

SEQ ID NO: 4874501 - DNA, 17 bp, Homo sapiens
ataaactactctttgat

SEQ ID NO: 4874502 - DNA, 15 bp, Homo sapiens
ataaactctaaacat

SEQ ID NO: 4874503 - DNA, 11 bp, Homo sapiens
ataaacttcag

SEQ ID NO: 4874504 - DNA, 15 bp, Homo sapiens
ataaacttcagcacc

SEQ ID NO: 4874505 - DNA, 17 bp, Homo sapiens
ataaagaaattgcaata

SEQ ID NO: 4874506 - DNA, 12 bp, Homo sapiens
ataaagaatata

SEQ ID NO: 4874507 - DNA, 21 bp, Homo sapiens
ataaagcctcaaggttttagg

SEQ ID NO: 4874508 - DNA, 20 bp, Homo sapiens
ataaagcctgttttgtcttt

SEQ ID NO: 4874509 - DNA, 22 bp, Homo sapiens
ataaagcgatatacagatgaaa

SEQ ID NO: 4874510 - DNA, 22 bp, Homo sapiens
ataaaggatgtgattgtggaat

SEQ ID NO: 4874511 - DNA, 17 bp, Homo sapiens
ataaagggggagggaaa

SEQ ID NO: 4874512 - DNA, 17 bp, Homo sapiens
ataaagttagaatctat

SEQ ID NO: 4874513 - DNA, 12 bp, Homo sapiens
ataaagtttgct

SEQ ID NO: 4874514 - DNA, 12 bp, Homo sapiens
ataaatacatac

SEQ ID NO: 4874515 - DNA, 22 bp, Homo sapiens
ataaatacatacggtcaggttt

SEQ ID NO: 4874516 - DNA, 15 bp, Homo sapiens
ataaatagaaaagta

SEQ ID NO: 4874517 - DNA, 18 bp, Homo sapiens
ataaatagaaaagtagac

SEQ ID NO: 4874518 - DNA, 15 bp, Homo sapiens
ataaatataagcctt

SEQ ID NO: 4874519 - DNA, 17 bp, Homo sapiens
ataaatatatataaaga

SEQ ID NO: 4874520 - DNA, 13 bp, Homo sapiens
ataaatatgcagt

SEQ ID NO: 4874521 - DNA, 18 bp, Homo sapiens
ataaatcatattgatgaa

SEQ ID NO: 4874522 - DNA, 15 bp, Homo sapiens
ataaatccagttcta

SEQ ID NO: 4874523 - DNA, 18 bp, Homo sapiens
ataaatccagttctacta

SEQ ID NO: 4874524 - DNA, 16 bp, Homo sapiens
ataaatgattcttagt

SEQ ID NO: 4874525 - DNA, 13 bp, Homo sapiens
ataaatggaaatc

SEQ ID NO: 4874526 - DNA, 13 bp, Homo sapiens
ataaatgtatata

SEQ ID NO: 4874527 - DNA, 18 bp, Homo sapiens
ataaatgtatatacacat

SEQ ID NO: 4874528 - DNA, 19 bp, Homo sapiens
ataaatgtatatacacata

SEQ ID NO: 4874529 - DNA, 17 bp, Homo sapiens
ataaatgtatcatagaa

SEQ ID NO: 4874530 - DNA, 15 bp, Homo sapiens
ataaatgtctgttga

SEQ ID NO: 4874531 - DNA, 13 bp, Homo sapiens
ataaattgaaatt

SEQ ID NO: 4874532 - DNA, 18 bp, Homo sapiens
ataaattgcataaagcat

SEQ ID NO: 4874533 - DNA, 16 bp, Homo sapiens
ataaatttactttaca

SEQ ID NO: 4874534 - DNA, 13 bp, Homo sapiens
ataacaaaatgga

SEQ ID NO: 4874535 - DNA, 12 bp, Homo sapiens
ataacaagaaaa

SEQ ID NO: 4874536 - DNA, 13 bp, Homo sapiens
ataacaagaaaat

SEQ ID NO: 4874537 - DNA, 13 bp, Homo sapiens
ataacaatgttaa

SEQ ID NO: 4874538 - DNA, 22 bp, Homo sapiens
ataacaatgttaaggaaactct

SEQ ID NO: 4874539 - DNA, 16 bp, Homo sapiens
ataacacactttttat

SEQ ID NO: 4874540 - DNA, 18 bp, Homo sapiens
ataacaggcatttgttca

SEQ ID NO: 4874541 - DNA, 18 bp, Homo sapiens
ataacagtgcagggcaaa

SEQ ID NO: 4874542 - DNA, 20 bp, Homo sapiens
ataacattaccttactgtgg

SEQ ID NO: 4874543 - DNA, 20 bp, Homo sapiens
ataaccccagctccctagga

SEQ ID NO: 4874544 - DNA, 15 bp, Homo sapiens
ataaccctaacacac

SEQ ID NO: 4874545 - DNA, 13 bp, Homo sapiens
ataacgtttttcc

SEQ ID NO: 4874546 - DNA, 15 bp, Homo sapiens
ataacgtttttcctt

SEQ ID NO: 4874547 - DNA, 18 bp, Homo sapiens
ataacgtttttcctttaa

SEQ ID NO: 4874548 - DNA, 14 bp, Homo sapiens
ataactaaatttga

SEQ ID NO: 4874549 - DNA, 18 bp, Homo sapiens
ataactaaatttgatact

SEQ ID NO: 4874550 - DNA, 19 bp, Homo sapiens
ataactaaatttgatactt

SEQ ID NO: 4874551 - DNA, 12 bp, Homo sapiens
ataactctgtaa

SEQ ID NO: 4874552 - DNA, 22 bp, Homo sapiens
ataactctgtggcattattgca

SEQ ID NO: 4874553 - DNA, 17 bp, Homo sapiens
ataactgccttgaacct

SEQ ID NO: 4874554 - DNA, 23 bp, Homo sapiens
ataactgccttgaacctgtgagt

SEQ ID NO: 4874555 - DNA, 13 bp, Homo sapiens
ataactgtgaagt

SEQ ID NO: 4874556 - DNA, 19 bp, Homo sapiens
ataacttaaaaatgtaaat

SEQ ID NO: 4874557 - DNA, 18 bp, Homo sapiens
ataacttattgctgattt

SEQ ID NO: 4874558 - DNA, 13 bp, Homo sapiens
ataacttcagtcc

SEQ ID NO: 4874559 - DNA, 14 bp, Homo sapiens
ataacttcagtcct

SEQ ID NO: 4874560 - DNA, 20 bp, Homo sapiens
ataacttcagtcctgctcca

SEQ ID NO: 4874561 - DNA, 11 bp, Homo sapiens
ataacttgatg

SEQ ID NO: 4874562 - DNA, 17 bp, Homo sapiens
ataagaaatgcatatgt

SEQ ID NO: 4874563 - DNA, 18 bp, Homo sapiens
ataagaatggagcagtac

SEQ ID NO: 4874564 - DNA, 18 bp, Homo sapiens
ataagagaaagaaaatga

SEQ ID NO: 4874565 - DNA, 14 bp, Homo sapiens
ataagagcatgaaa

SEQ ID NO: 4874566 - DNA, 19 bp, Homo sapiens
ataagatcctagatcctaa

SEQ ID NO: 4874567 - DNA, 12 bp, Homo sapiens
ataagattctaa

SEQ ID NO: 4874568 - DNA, 14 bp, Homo sapiens
ataagcaaatttca

SEQ ID NO: 4874569 - DNA, 15 bp, Homo sapiens
ataagcattgaaatt

SEQ ID NO: 4874570 - DNA, 18 bp, Homo sapiens
ataagcggcgtaagttta

SEQ ID NO: 4874571 - DNA, 17 bp, Homo sapiens
ataaggggtttgccatt

SEQ ID NO: 4874572 - DNA, 20 bp, Homo sapiens
ataaggtttcgtttctgtat

SEQ ID NO: 4874573 - DNA, 16 bp, Homo sapiens
caggccagagggagtg

SEQ ID NO: 4874574 - DNA, 19 bp, Homo sapiens
caggccagagggagtgaca

SEQ ID NO: 4874575 - DNA, 21 bp, Homo sapiens
caggccagagggagtgacaga

SEQ ID NO: 4874576 - DNA, 19 bp, Homo sapiens
caggcccctgccaccctgg

SEQ ID NO: 4874577 - DNA, 20 bp, Homo sapiens
caggcccctgccaccctggg

SEQ ID NO: 4874578 - DNA, 13 bp, Homo sapiens
caggcccggctcc

SEQ ID NO: 4874579 - DNA, 20 bp, Homo sapiens
caggcccggctccaggctcc

SEQ ID NO: 4874580 - DNA, 21 bp, Homo sapiens
caggcccggctccaggctcct

SEQ ID NO: 4874581 - DNA, 20 bp, Homo sapiens
caggccctgctcctgcagca

SEQ ID NO: 4874582 - DNA, 10 bp, Homo sapiens
caggccctgg

SEQ ID NO: 4874583 - DNA, 11 bp, Homo sapiens
caggccctggc

SEQ ID NO: 4874584 - DNA, 21 bp, Homo sapiens
caggcccttattttcaagaaa

SEQ ID NO: 4874585 - DNA, 19 bp, Homo sapiens
caggcccttcctctccact

SEQ ID NO: 4874586 - DNA, 23 bp, Homo sapiens
caggcccttcctctccactgcct

SEQ ID NO: 4874587 - DNA, 13 bp, Homo sapiens
caggccggccagc

SEQ ID NO: 4874588 - DNA, 19 bp, Homo sapiens
caggccggggtggagcatg

SEQ ID NO: 4874589 - DNA, 20 bp, Homo sapiens
caggccggggtggagcatgg

SEQ ID NO: 4874590 - DNA, 17 bp, Homo sapiens
caggcctcacctctacc

SEQ ID NO: 4874591 - DNA, 12 bp, Homo sapiens
caggcctctgtg

SEQ ID NO: 4874592 - DNA, 17 bp, Homo sapiens
caggcctctgtgtcctt

SEQ ID NO: 4874593 - DNA, 16 bp, Homo sapiens
caggcgggaggaggtg

SEQ ID NO: 4874594 - DNA, 12 bp, Homo sapiens
caggctccgccc

SEQ ID NO: 4874595 - DNA, 17 bp, Homo sapiens
caggctccgcccttagt

SEQ ID NO: 4874596 - DNA, 18 bp, Homo sapiens
caggctccgcccttagtc

SEQ ID NO: 4874597 - DNA, 22 bp, Homo sapiens
caggctccgcccttagtccccc

SEQ ID NO: 4874598 - DNA, 19 bp, Homo sapiens
caggctgcagctggacaga

SEQ ID NO: 4874599 - DNA, 20 bp, Homo sapiens
caggctgcagctggacagag

SEQ ID NO: 4874600 - DNA, 22 bp, Homo sapiens
caggctgcttcaatcccagcct

SEQ ID NO: 4874601 - DNA, 18 bp, Homo sapiens
caggctggcgtgcagtgg

SEQ ID NO: 4874602 - DNA, 17 bp, Homo sapiens
caggctgggccatgtcc

SEQ ID NO: 4874603 - DNA, 18 bp, Homo sapiens
caggctgggccatgtcca

SEQ ID NO: 4874604 - DNA, 22 bp, Homo sapiens
caggctgggccatgtccaaaga

SEQ ID NO: 4874605 - DNA, 15 bp, Homo sapiens
caggctgggcttcag

SEQ ID NO: 4874606 - DNA, 21 bp, Homo sapiens
caggctgggcttcagtggcag

SEQ ID NO: 4874607 - DNA, 22 bp, Homo sapiens
caggctgggcttcagtggcagc

SEQ ID NO: 4874608 - DNA, 16 bp, Homo sapiens
caggctggtctaaaac

SEQ ID NO: 4874609 - DNA, 12 bp, Homo sapiens
caggctggtctc

SEQ ID NO: 4874610 - DNA, 19 bp, Homo sapiens
caggctggtctcaaactct

SEQ ID NO: 4874611 - DNA, 20 bp, Homo sapiens
caggctgtatcccatgagcc

SEQ ID NO: 4874612 - DNA, 21 bp, Homo sapiens
caggctgtatcccatgagcct

SEQ ID NO: 4874613 - DNA, 17 bp, Homo sapiens
caggctgttctgcactg

SEQ ID NO: 4874614 - DNA, 22 bp, Homo sapiens
cagggaagagcagaacggagcc

SEQ ID NO: 4874615 - DNA, 14 bp, Homo sapiens
cagggaagctggcc

SEQ ID NO: 4874616 - DNA, 17 bp, Homo sapiens
cagggaagctggccgag

SEQ ID NO: 4874617 - DNA, 14 bp, Homo sapiens
cagggaatttctat

SEQ ID NO: 4874618 - DNA, 21 bp, Homo sapiens
cagggagcagggaaggcctga

SEQ ID NO: 4874619 - DNA, 19 bp, Homo sapiens
cagggagcctagaagctgg

SEQ ID NO: 4874620 - DNA, 16 bp, Homo sapiens
gtgctctggacaggca

SEQ ID NO: 4874621 - DNA, 22 bp, Homo sapiens
gtgctgaacaaaaaataaaaat

SEQ ID NO: 4874622 - DNA, 21 bp, Homo sapiens
gtgctgccatttgatttttct

SEQ ID NO: 4874623 - DNA, 17 bp, Homo sapiens
gtgctggaggtgggagc

SEQ ID NO: 4874624 - DNA, 21 bp, Homo sapiens
gtgctggatattttactacca

SEQ ID NO: 4874625 - DNA, 16 bp, Homo sapiens
ttttcattacaatgga

SEQ ID NO: 4874626 - DNA, 14 bp, Homo sapiens
ttttcattctcatt

SEQ ID NO: 4874627 - DNA, 14 bp, Homo sapiens
ttttcattttccaa

SEQ ID NO: 4874628 - DNA, 18 bp, Homo sapiens
ttttccccccactctccc

SEQ ID NO: 4874629 - DNA, 18 bp, Homo sapiens
ttttcctcttctattttg

SEQ ID NO: 4874630 - DNA, 14 bp, Homo sapiens
ttttcctgttcata

SEQ ID NO: 4874631 - DNA, 12 bp, Homo sapiens
ttttcctttaaa

SEQ ID NO: 4874632 - DNA, 21 bp, Homo sapiens
ttttcctttaaaaaaatttaa

SEQ ID NO: 4874633 - DNA, 13 bp, Homo sapiens
ttttctaaccttg

SEQ ID NO: 4874634 - DNA, 13 bp, Homo sapiens
ttttctacaaata

SEQ ID NO: 4874635 - DNA, 16 bp, Homo sapiens
ttttctacattattgc

SEQ ID NO: 4874636 - DNA, 13 bp, Homo sapiens
ttttctagacttt

SEQ ID NO: 4874637 - DNA, 14 bp, Homo sapiens
ttttctagactttc

SEQ ID NO: 4874638 - DNA, 18 bp, Homo sapiens
ttttctagactttctgtt

SEQ ID NO: 4874639 - DNA, 17 bp, Homo sapiens
ttttctagtttgctcat

SEQ ID NO: 4874640 - DNA, 20 bp, Homo sapiens
ttttctattccttctggcct

SEQ ID NO: 4874641 - DNA, 15 bp, Homo sapiens
ttttctcaaaagcat

SEQ ID NO: 4874642 - DNA, 12 bp, Homo sapiens
ttttctccagct

SEQ ID NO: 4874643 - DNA, 13 bp, Homo sapiens
ttttctcctccca

SEQ ID NO: 4874644 - DNA, 19 bp, Homo sapiens
ttttctcctcccaggaact

SEQ ID NO: 4874645 - DNA, 9 bp, Homo sapiens
ttttctgaa

SEQ ID NO: 4874646 - DNA, 21 bp, Homo sapiens
ttttctggaatacatgaaata

SEQ ID NO: 4874647 - DNA, 16 bp, Homo sapiens
ttttctgtagtcattt

SEQ ID NO: 4874648 - DNA, 15 bp, Homo sapiens
ttttctgttgtaact

SEQ ID NO: 4874649 - DNA, 14 bp, Homo sapiens
ttttcttgatttga

SEQ ID NO: 4874650 - DNA, 18 bp, Homo sapiens
ttttctttaaagaagttg

SEQ ID NO: 4874651 - DNA, 16 bp, Homo sapiens
ttttcttttgttactg

SEQ ID NO: 4874652 - DNA, 18 bp, Homo sapiens
ttttcttttgttactgtt

SEQ ID NO: 4874653 - DNA, 23 bp, Homo sapiens
ttttctttttacataactgcctt

SEQ ID NO: 4874654 - DNA, 14 bp, Homo sapiens
ttttgaaaaaagct

SEQ ID NO: 4874655 - DNA, 23 bp, Homo sapiens
ttttgaaaaaagctcatttcatg

SEQ ID NO: 4874656 - DNA, 23 bp, Homo sapiens
ttttgaaatcaatgcaagagtga

SEQ ID NO: 4874657 - DNA, 11 bp, Homo sapiens
ttttgaaatga

SEQ ID NO: 4874658 - DNA, 21 bp, Homo sapiens
ttttgaaatgaaatttaaaca

SEQ ID NO: 4874659 - DNA, 14 bp, Homo sapiens
ttttgaaggcaaaa

SEQ ID NO: 4874660 - DNA, 13 bp, Homo sapiens
ttttgaagggagg

SEQ ID NO: 4874661 - DNA, 13 bp, Homo sapiens
ttttgaagtcttg

SEQ ID NO: 4874662 - DNA, 16 bp, Homo sapiens
ttttgaagtcttgtat

SEQ ID NO: 4874663 - DNA, 15 bp, Homo sapiens
ttttgaagtttacat

SEQ ID NO: 4874664 - DNA, 13 bp, Homo sapiens
ttttgaatgttat

SEQ ID NO: 4874665 - DNA, 14 bp, Homo sapiens
ttttgaatttagtg

SEQ ID NO: 4874666 - DNA, 22 bp, Homo sapiens
ttttgactagggattcaggctg

SEQ ID NO: 4874667 - DNA, 14 bp, Homo sapiens
ttttgacttaatgt

SEQ ID NO: 4874668 - DNA, 17 bp, Homo sapiens
ttttgacttaatgtgat

SEQ ID NO: 4874669 - DNA, 18 bp, Homo sapiens
ttttgacttaatgtgatt

SEQ ID NO: 4874670 - DNA, 16 bp, Homo sapiens
ttttgagtagatatta

SEQ ID NO: 4874671 - DNA, 22 bp, Homo sapiens
ttttgagtagatattactttat

SEQ ID NO: 4874672 - DNA, 14 bp, Homo sapiens
ttttgataactgtt

SEQ ID NO: 4874673 - DNA, 18 bp, Homo sapiens
ttttgataataatattgt

SEQ ID NO: 4874674 - DNA, 20 bp, Homo sapiens
ttttgatgcagcatttgata

SEQ ID NO: 4874675 - DNA, 15 bp, Homo sapiens
ttttgatgtttgtgg

SEQ ID NO: 4874676 - DNA, 20 bp, Homo sapiens
ttttgatgtttgtggcctca

SEQ ID NO: 4874677 - DNA, 23 bp, Homo sapiens
ttttgccatgttggccaggctgg

SEQ ID NO: 4874678 - DNA, 19 bp, Homo sapiens
ttttgcttttaattaaata

SEQ ID NO: 4874679 - DNA, 16 bp, Homo sapiens
ttttggattgtatatt

SEQ ID NO: 4874680 - DNA, 19 bp, Homo sapiens
ttttggcgctattacaaat

SEQ ID NO: 4874681 - DNA, 18 bp, Homo sapiens
ttttgggggtgtgagtgt

SEQ ID NO: 4874682 - DNA, 13 bp, Homo sapiens
ttttgggtagctg

SEQ ID NO: 4874683 - DNA, 14 bp, Homo sapiens
ttttgggtagctgc

SEQ ID NO: 4874684 - DNA, 17 bp, Homo sapiens
ttttggtattacactgt

SEQ ID NO: 4874685 - DNA, 23 bp, Homo sapiens
ttttgtaggggtcaaagaaatgc

SEQ ID NO: 4874686 - DNA, 11 bp, Homo sapiens
ttttgtataca

SEQ ID NO: 4874687 - DNA, 13 bp, Homo sapiens
ttttgtatacaaa

SEQ ID NO: 4874688 - DNA, 15 bp, Homo sapiens
ttttgtatacaaata

SEQ ID NO: 4874689 - DNA, 13 bp, Homo sapiens
ttttgtatatatc

SEQ ID NO: 4874690 - DNA, 16 bp, Homo sapiens
ttttgtcccccaactt

SEQ ID NO: 4874691 - DNA, 13 bp, Homo sapiens
ttttgtcttatat

SEQ ID NO: 4874692 - DNA, 17 bp, Homo sapiens
ttttgtctttaaataga

SEQ ID NO: 4874693 - DNA, 18 bp, Homo sapiens
ttttgtgtgaccaactgt

SEQ ID NO: 4874694 - DNA, 15 bp, Homo sapiens
ttttgttactgttct

SEQ ID NO: 4874695 - DNA, 16 bp, Homo sapiens
ttttgttactgttctt

SEQ ID NO: 4874696 - DNA, 20 bp, Homo sapiens
ttttgttactgttcttgctg

SEQ ID NO: 4874697 - DNA, 23 bp, Homo sapiens
ttttgttcgcatggtcacacact

SEQ ID NO: 4874698 - DNA, 14 bp, Homo sapiens
ttttgttgattaaa

SEQ ID NO: 4874699 - DNA, 16 bp, Homo sapiens
ttttgtttgtttcttt

SEQ ID NO: 4874700 - DNA, 14 bp, Homo sapiens
tttttaaaaaaaga

SEQ ID NO: 4874701 - DNA, 14 bp, Homo sapiens
tttttaaaacacat

SEQ ID NO: 4874702 - DNA, 18 bp, Homo sapiens
tttttaaaacacatgttt

SEQ ID NO: 4874703 - DNA, 23 bp, Homo sapiens
tttttaaaacacatgtttttata

SEQ ID NO: 4874704 - DNA, 12 bp, Homo sapiens
tttttaaagatc

SEQ ID NO: 4874705 - DNA, 13 bp, Homo sapiens
tttttaaagctta

SEQ ID NO: 4874706 - DNA, 15 bp, Homo sapiens
tttttaaataaactt

SEQ ID NO: 4874707 - DNA, 16 bp, Homo sapiens
tttttaaataaacttt

SEQ ID NO: 4874708 - DNA, 17 bp, Homo sapiens
tttttaaataaactttt

SEQ ID NO: 4874709 - DNA, 13 bp, Homo sapiens
tttttaaattgtt

SEQ ID NO: 4874710 - DNA, 12 bp, Homo sapiens
tttttaataaac

SEQ ID NO: 4874711 - DNA, 23 bp, Homo sapiens
tttttaatagtcattccaaatat

SEQ ID NO: 4874712 - DNA, 20 bp, Homo sapiens
tttttaattgttgtttcttt

SEQ ID NO: 4874713 - DNA, 13 bp, Homo sapiens
tttttacagctgt

SEQ ID NO: 4874714 - DNA, 17 bp, Homo sapiens
tttttacctgtcacatt

SEQ ID NO: 4874715 - DNA, 18 bp, Homo sapiens
tttttactcattgaaatg

SEQ ID NO: 4874716 - DNA, 22 bp, Homo sapiens
tttttagacagagtctcactgt

SEQ ID NO: 4874717 - DNA, 21 bp, Homo sapiens
tttttagtgcatccagttaac

SEQ ID NO: 4874718 - DNA, 20 bp, Homo sapiens
tttttataaaaataaataga

SEQ ID NO: 4874719 - DNA, 13 bp, Homo sapiens
tttttatacaaaa

SEQ ID NO: 4874720 - DNA, 17 bp, Homo sapiens
tttttataccattcaga

SEQ ID NO: 4874721 - DNA, 12 bp, Homo sapiens
tttttatataca

SEQ ID NO: 4874722 - DNA, 14 bp, Homo sapiens
tttttatatataca

SEQ ID NO: 4874723 - DNA, 13 bp, Homo sapiens
tttttatgaggca

SEQ ID NO: 4874724 - DNA, 16 bp, Homo sapiens
tttttatgtgatcaat

SEQ ID NO: 4874725 - DNA, 13 bp, Homo sapiens
tttttatttatat

SEQ ID NO: 4874726 - DNA, 21 bp, Homo sapiens
tttttcaaaatccaaaaagaa

SEQ ID NO: 4874727 - DNA, 19 bp, Homo sapiens
tttttcaaagatgtgttgc

SEQ ID NO: 4874728 - DNA, 9 bp, Homo sapiens
tttttcaac

SEQ ID NO: 4874729 - DNA, 13 bp, Homo sapiens
tttttcaaggaag

SEQ ID NO: 4874730 - DNA, 20 bp, Homo sapiens
tttttcaggagcgcaagata

SEQ ID NO: 4874731 - DNA, 21 bp, Homo sapiens
tttttcagttccaagaaagat

SEQ ID NO: 4874732 - DNA, 19 bp, Homo sapiens
tttttcatattttctaaag

SEQ ID NO: 4874733 - DNA, 18 bp, Homo sapiens
tttttcctagccctctca

SEQ ID NO: 4874734 - DNA, 11 bp, Homo sapiens
tttttccttta

SEQ ID NO: 4874735 - DNA, 14 bp, Homo sapiens
tttttctagtacac

SEQ ID NO: 4874736 - DNA, 16 bp, Homo sapiens
tttttctcaaagtttt

SEQ ID NO: 4874737 - DNA, 10 bp, Homo sapiens
tttttgaaaa

SEQ ID NO: 4874738 - DNA, 17 bp, Homo sapiens
tttcttttgttactgtt

SEQ ID NO: 4874739 - DNA, 24 bp, Homo sapiens
tttcttttgttactgttcttgctg

SEQ ID NO: 4874740 - DNA, 20 bp, Homo sapiens
tttctttttaagtaatgtgg

SEQ ID NO: 4874741 - DNA, 16 bp, Homo sapiens
tttgaaaaaaacttca

SEQ ID NO: 4874742 - DNA, 14 bp, Homo sapiens
tttgaaaaaagctc

SEQ ID NO: 4874743 - DNA, 19 bp, Homo sapiens
tttgaaaagctattagcca

SEQ ID NO: 4874744 - DNA, 13 bp, Homo sapiens
tttgaaaagcttc

SEQ ID NO: 4874745 - DNA, 19 bp, Homo sapiens
tttgaaagtgaataaactt

SEQ ID NO: 4874746 - DNA, 18 bp, Homo sapiens
tttgaaatacctcatgtt

SEQ ID NO: 4874747 - DNA, 19 bp, Homo sapiens
tttgaaatacctcatgttt

SEQ ID NO: 4874748 - DNA, 20 bp, Homo sapiens
tttgaaatagtctgtgtgaa

SEQ ID NO: 4874749 - DNA, 17 bp, Homo sapiens
tttgaaatgaaatttaa

SEQ ID NO: 4874750 - DNA, 20 bp, Homo sapiens
tttgaacacgaaagaaatgt

SEQ ID NO: 4874751 - DNA, 12 bp, Homo sapiens
tttgaacactgg

SEQ ID NO: 4874752 - DNA, 19 bp, Homo sapiens
tttgaactaagaaactttt

SEQ ID NO: 4874753 - DNA, 15 bp, Homo sapiens
tttgaactcagatct

SEQ ID NO: 4874754 - DNA, 16 bp, Homo sapiens
tttgaactcagatctg

SEQ ID NO: 4874755 - DNA, 21 bp, Homo sapiens
tttgaagaaggtggacctttt

SEQ ID NO: 4874756 - DNA, 18 bp, Homo sapiens
tttgaagcagttgtgtca

SEQ ID NO: 4874757 - DNA, 12 bp, Homo sapiens
tttgaaggcaaa

SEQ ID NO: 4874758 - DNA, 23 bp, Homo sapiens
tttgaagtagtttgtataacttc

SEQ ID NO: 4874759 - DNA, 20 bp, Homo sapiens
tttgaagtgtacctgtgtac

SEQ ID NO: 4874760 - DNA, 13 bp, Homo sapiens
tttgaagtttaca

SEQ ID NO: 4874761 - DNA, 15 bp, Homo sapiens
tttgaagtttacatt

SEQ ID NO: 4874762 - DNA, 17 bp, Homo sapiens
tttgaagtttacatttt

SEQ ID NO: 4874763 - DNA, 16 bp, Homo sapiens
tttgaataccattaaa

SEQ ID NO: 4874764 - DNA, 23 bp, Homo sapiens
tttgaataccattaaaactgctt

SEQ ID NO: 4874765 - DNA, 14 bp, Homo sapiens
tttgaatatggaca

SEQ ID NO: 4874766 - DNA, 20 bp, Homo sapiens
tttgaatgttatttgttatt

SEQ ID NO: 4874767 - DNA, 19 bp, Homo sapiens
tttgaattaaaacttctta

SEQ ID NO: 4874768 - DNA, 18 bp, Homo sapiens
tttgacactctgcagact

SEQ ID NO: 4874769 - DNA, 18 bp, Homo sapiens
tttgacagtgttgaaaat

SEQ ID NO: 4874770 - DNA, 14 bp, Homo sapiens
tttgacatttaatt

SEQ ID NO: 4874771 - DNA, 13 bp, Homo sapiens
tttgaccttttat

SEQ ID NO: 4874772 - DNA, 13 bp, Homo sapiens
tttgagacagagt

SEQ ID NO: 4874773 - DNA, 19 bp, Homo sapiens
tttgagacagtttcttagc

SEQ ID NO: 4874774 - DNA, 20 bp, Homo sapiens
tttgagacagtttcttagct

SEQ ID NO: 4874775 - DNA, 22 bp, Homo sapiens
tttgagacagtttcttagcttt

SEQ ID NO: 4874776 - DNA, 16 bp, Homo sapiens
tttgagagttctaaat

SEQ ID NO: 4874777 - DNA, 16 bp, Homo sapiens
tttcacaaccttctgt

SEQ ID NO: 4874778 - DNA, 16 bp, Homo sapiens
tttcacctagattttt

SEQ ID NO: 4874779 - DNA, 17 bp, Homo sapiens
tttcactgctggctgcc

SEQ ID NO: 4874780 - DNA, 22 bp, Homo sapiens
tttcagaaaatattatgtgttt

SEQ ID NO: 4874781 - DNA, 19 bp, Homo sapiens
tttcagaacctcttcccca

SEQ ID NO: 4874782 - DNA, 20 bp, Homo sapiens
tttcagattcccagagcaaa

SEQ ID NO: 4874783 - DNA, 20 bp, Homo sapiens
tttcagattttttatttgaa

SEQ ID NO: 4874784 - DNA, 21 bp, Homo sapiens
tttcagctaagggaagacatt

SEQ ID NO: 4874785 - DNA, 22 bp, Homo sapiens
tttcagctaagggaagacattt

SEQ ID NO: 4874786 - DNA, 22 bp, Homo sapiens
tttcagggttttctgagggaaa

SEQ ID NO: 4874787 - DNA, 20 bp, Homo sapiens
tttcaggtgacatgtgaaac

SEQ ID NO: 4874788 - DNA, 21 bp, Homo sapiens
tttcaggttcagtattatgta

SEQ ID NO: 4874789 - DNA, 14 bp, Homo sapiens
tttcaggtttgtca

SEQ ID NO: 4874790 - DNA, 21 bp, Homo sapiens
tttcagtattttggagaaatt

SEQ ID NO: 4874791 - DNA, 22 bp, Homo sapiens
tttcataacttattgctgattt

SEQ ID NO: 4874792 - DNA, 15 bp, Homo sapiens
tttcatatgctgtat

SEQ ID NO: 4874793 - DNA, 14 bp, Homo sapiens
tttcatattgtgcc

SEQ ID NO: 4874794 - DNA, 19 bp, Homo sapiens
tttcatgctatctctgtgt

SEQ ID NO: 4874795 - DNA, 19 bp, Homo sapiens
tttcatgctctgcaaaagg

SEQ ID NO: 4874796 - DNA, 12 bp, Homo sapiens
tttcatgtacaa

SEQ ID NO: 4874797 - DNA, 18 bp, Homo sapiens
tttcatgtacaagatgaa

SEQ ID NO: 4874798 - DNA, 14 bp, Homo sapiens
tttcattacaatgg

SEQ ID NO: 4874799 - DNA, 21 bp, Homo sapiens
tttcattacaatggaaacaat

SEQ ID NO: 4874800 - DNA, 21 bp, Homo sapiens
tttcattattagtactgctct

SEQ ID NO: 4874801 - DNA, 15 bp, Homo sapiens
tttcattcatcccat

SEQ ID NO: 4874802 - DNA, 13 bp, Homo sapiens
tttcattctcatt

SEQ ID NO: 4874803 - DNA, 15 bp, Homo sapiens
tttcattctcctgcc

SEQ ID NO: 4874804 - DNA, 15 bp, Homo sapiens
tttcattgtatgatg

SEQ ID NO: 4874805 - DNA, 23 bp, Homo sapiens
tttcattgtatgatgtgttgtga

SEQ ID NO: 4874806 - DNA, 14 bp, Homo sapiens
tttccaaaataatt

SEQ ID NO: 4874807 - DNA, 15 bp, Homo sapiens
tttccaaataaaatg

SEQ ID NO: 4874808 - DNA, 20 bp, Homo sapiens
tttccaacaccacagacaca

SEQ ID NO: 4874809 - DNA, 14 bp, Homo sapiens
tttccaagtaatat

SEQ ID NO: 4874810 - DNA, 18 bp, Homo sapiens
tttccaagtaatataatg

SEQ ID NO: 4874811 - DNA, 15 bp, Homo sapiens
tttccacttcttcct

SEQ ID NO: 4874812 - DNA, 16 bp, Homo sapiens
tttccacttgttctca

SEQ ID NO: 4874813 - DNA, 21 bp, Homo sapiens
tttccagcagaagacaaaaag

SEQ ID NO: 4874814 - DNA, 16 bp, Homo sapiens
tttccagttaaggacc

SEQ ID NO: 4874815 - DNA, 17 bp, Homo sapiens
tttccatgaagtttgaa

SEQ ID NO: 4874816 - DNA, 17 bp, Homo sapiens
tttccccccactctccc

SEQ ID NO: 4874817 - DNA, 23 bp, Homo sapiens
tttccccccactctccccacact

SEQ ID NO: 4874818 - DNA, 16 bp, Homo sapiens
tttcccccttctacat

SEQ ID NO: 4874819 - DNA, 12 bp, Homo sapiens
tttccctctttt

SEQ ID NO: 4874820 - DNA, 22 bp, Homo sapiens
tttccctcttttcttactcctc

SEQ ID NO: 4874821 - DNA, 16 bp, Homo sapiens
tttcccttcagtaccc

SEQ ID NO: 4874822 - DNA, 12 bp, Homo sapiens
tttcccttcctc

SEQ ID NO: 4874823 - DNA, 13 bp, Homo sapiens
tttcccttcctct

SEQ ID NO: 4874824 - DNA, 15 bp, Homo sapiens
tttcccttcctcttc

SEQ ID NO: 4874825 - DNA, 16 bp, Homo sapiens
tttcccttcttgcatc

SEQ ID NO: 4874826 - DNA, 21 bp, Homo sapiens
tttcctacaggcagtctctct

SEQ ID NO: 4874827 - DNA, 15 bp, Homo sapiens
tttcctagcctgttt

SEQ ID NO: 4874828 - DNA, 21 bp, Homo sapiens
tttcctcctgaggctttggat

SEQ ID NO: 4874829 - DNA, 23 bp, Homo sapiens
tttcctttaaaaaaatttaagtg

SEQ ID NO: 4874830 - DNA, 20 bp, Homo sapiens
tttcctttccccagcccagg

SEQ ID NO: 4874831 - DNA, 13 bp, Homo sapiens
tttcctttgctct

SEQ ID NO: 4874832 - DNA, 21 bp, Homo sapiens
tttcctttgtggttttatgga

SEQ ID NO: 4874833 - DNA, 21 bp, Homo sapiens
tttccttttctattccttctg

SEQ ID NO: 4874834 - DNA, 14 bp, Homo sapiens
tttctaaaaaacag

SEQ ID NO: 4874835 - DNA, 15 bp, Homo sapiens
tttctaaaaagatta

SEQ ID NO: 4874836 - DNA, 21 bp, Homo sapiens
tttctaaaatcttatagttct

SEQ ID NO: 4874837 - DNA, 13 bp, Homo sapiens
tttctaaatgttt

SEQ ID NO: 4874838 - DNA, 13 bp, Homo sapiens
tttctaaccttga

SEQ ID NO: 4874839 - DNA, 14 bp, Homo sapiens
tttctaagagagct

SEQ ID NO: 4874840 - DNA, 18 bp, Homo sapiens
tttctaagattctaaagg

SEQ ID NO: 4874841 - DNA, 13 bp, Homo sapiens
tttctaatcaaaa

SEQ ID NO: 4874842 - DNA, 14 bp, Homo sapiens
tttctaatgtttct

SEQ ID NO: 4874843 - DNA, 16 bp, Homo sapiens
tttctaccatttcaga

SEQ ID NO: 4874844 - DNA, 20 bp, Homo sapiens
tttctagaagtttcccttcc

SEQ ID NO: 4874845 - DNA, 21 bp, Homo sapiens
tttctagaatttatcacactt

SEQ ID NO: 4874846 - DNA, 15 bp, Homo sapiens
tttctagtccaaaat

SEQ ID NO: 4874847 - DNA, 18 bp, Homo sapiens
tttctagtggtctttgta

SEQ ID NO: 4874848 - DNA, 23 bp, Homo sapiens
tttctagtggtctttgtaagagt

SEQ ID NO: 4874849 - DNA, 13 bp, Homo sapiens
tttctattccaaa

SEQ ID NO: 4874850 - DNA, 14 bp, Homo sapiens
tttctcaaagtttt

SEQ ID NO: 4874851 - DNA, 15 bp, Homo sapiens
tttctcaaagttttg

SEQ ID NO: 4874852 - DNA, 15 bp, Homo sapiens
tttctcctcccagga

SEQ ID NO: 4874853 - DNA, 23 bp, Homo sapiens
tttctccttgaatatctttcgat

SEQ ID NO: 4874854 - DNA, 16 bp, Homo sapiens
tttctctctacagtgc

SEQ ID NO: 4874855 - DNA, 16 bp, Homo sapiens
tttctcttcatacttt

SEQ ID NO: 4874856 - DNA, 12 bp, Homo sapiens
tttctctttctt

SEQ ID NO: 4874857 - DNA, 15 bp, Homo sapiens
tttctcttttctagt

SEQ ID NO: 4874858 - DNA, 17 bp, Homo sapiens
tttctcttttctagttt

SEQ ID NO: 4874859 - DNA, 14 bp, Homo sapiens
tttctgcaaacaaa

SEQ ID NO: 4874860 - DNA, 20 bp, Homo sapiens
tttctgcaaacaaacacctt

SEQ ID NO: 4874861 - DNA, 15 bp, Homo sapiens
tttctgtaaatacca

SEQ ID NO: 4874862 - DNA, 13 bp, Homo sapiens
tttctgtaccatt

SEQ ID NO: 4874863 - DNA, 16 bp, Homo sapiens
tttctgtcagaatgct

SEQ ID NO: 4874864 - DNA, 20 bp, Homo sapiens
tttctgtcagatgagaacaa

SEQ ID NO: 4874865 - DNA, 14 bp, Homo sapiens
tttctgtcttctct

SEQ ID NO: 4874866 - DNA, 13 bp, Homo sapiens
tttctgtgcccta

SEQ ID NO: 4874867 - DNA, 15 bp, Homo sapiens
tttctgttggtgtat

SEQ ID NO: 4874868 - DNA, 16 bp, Homo sapiens
tttctgttgtaactta

SEQ ID NO: 4874869 - DNA, 12 bp, Homo sapiens
tttcttaaataa

SEQ ID NO: 4874870 - DNA, 23 bp, Homo sapiens
tttcttaaataatgcttcagata

SEQ ID NO: 4874871 - DNA, 17 bp, Homo sapiens
tttcttacataattttt

SEQ ID NO: 4874872 - DNA, 18 bp, Homo sapiens
tttcttacccaatttccc

SEQ ID NO: 4874873 - DNA, 20 bp, Homo sapiens
tttcttagctttttaattgt

SEQ ID NO: 4874874 - DNA, 19 bp, Homo sapiens
tttcttataatactctgtt

SEQ ID NO: 4874875 - DNA, 21 bp, Homo sapiens
tttcttataatactctgttgt

SEQ ID NO: 4874876 - DNA, 13 bp, Homo sapiens
tttcttattgcgc

SEQ ID NO: 4874877 - DNA, 15 bp, Homo sapiens
tttcttcatccaact

SEQ ID NO: 4874878 - DNA, 11 bp, Homo sapiens
tttcttcctct

SEQ ID NO: 4874879 - DNA, 13 bp, Homo sapiens
tttcttcctctgc

SEQ ID NO: 4874880 - DNA, 11 bp, Homo sapiens
tttcttccttt

SEQ ID NO: 4874881 - DNA, 18 bp, Homo sapiens
tttcttgatttgagttga

SEQ ID NO: 4874882 - DNA, 13 bp, Homo sapiens
tttcttgctccct

SEQ ID NO: 4874883 - DNA, 12 bp, Homo sapiens
tttcttgcttgt

SEQ ID NO: 4874884 - DNA, 22 bp, Homo sapiens
tttcttgcttgtacctctggct

SEQ ID NO: 4874885 - DNA, 13 bp, Homo sapiens
tttcttgtttatt

SEQ ID NO: 4874886 - DNA, 15 bp, Homo sapiens
tttctttcagatttt

SEQ ID NO: 4874887 - DNA, 14 bp, Homo sapiens
tttcttttcacata

SEQ ID NO: 4874888 - DNA, 14 bp, Homo sapiens
tttcttttgttact

SEQ ID NO: 4874889 - DNA, 16 bp, Homo sapiens
tttaccctaatgtctt

SEQ ID NO: 4874890 - DNA, 13 bp, Homo sapiens
tttacctagaaga

SEQ ID NO: 4874891 - DNA, 19 bp, Homo sapiens
tttactaattttctagatt

SEQ ID NO: 4874892 - DNA, 13 bp, Homo sapiens
tttactcattgaa

SEQ ID NO: 4874893 - DNA, 14 bp, Homo sapiens
tttactcattgaaa

SEQ ID NO: 4874894 - DNA, 18 bp, Homo sapiens
tttactcattgaaatgtc

SEQ ID NO: 4874895 - DNA, 17 bp, Homo sapiens
tttactgtgaaactggc

SEQ ID NO: 4874896 - DNA, 12 bp, Homo sapiens
tttactgtgttt

SEQ ID NO: 4874897 - DNA, 18 bp, Homo sapiens
tttactttaaacttgtct

SEQ ID NO: 4874898 - DNA, 16 bp, Homo sapiens
tttactttcccttgct

SEQ ID NO: 4874899 - DNA, 18 bp, Homo sapiens
tttacttttaaacagtga

SEQ ID NO: 4874900 - DNA, 23 bp, Homo sapiens
tttagaataaattcccaacttct

SEQ ID NO: 4874901 - DNA, 18 bp, Homo sapiens
tttagagaactgtggccg

SEQ ID NO: 4874902 - DNA, 12 bp, Homo sapiens
tttagatttcaa

SEQ ID NO: 4874903 - DNA, 16 bp, Homo sapiens
tttagatttcaagaaa

SEQ ID NO: 4874904 - DNA, 20 bp, Homo sapiens
tttagatttcaagaaaaaat

SEQ ID NO: 4874905 - DNA, 19 bp, Homo sapiens
tttagattttctggttcta

SEQ ID NO: 4874906 - DNA, 22 bp, Homo sapiens
tttaggaaaatcactttgtcta

SEQ ID NO: 4874907 - DNA, 23 bp, Homo sapiens
tttaggagctaaggctctatgag

SEQ ID NO: 4874908 - DNA, 14 bp, Homo sapiens
tttagggtactaaa

SEQ ID NO: 4874909 - DNA, 22 bp, Homo sapiens
tttagggtactaaatttaaatt

SEQ ID NO: 4874910 - DNA, 16 bp, Homo sapiens
tttaggttctaaagtt

SEQ ID NO: 4874911 - DNA, 19 bp, Homo sapiens
tttagtaatctgtacattt

SEQ ID NO: 4874912 - DNA, 15 bp, Homo sapiens
tttagtagagacagg

SEQ ID NO: 4874913 - DNA, 13 bp, Homo sapiens
tttagtattcatt

SEQ ID NO: 4874914 - DNA, 15 bp, Homo sapiens
tttagtattcattct

SEQ ID NO: 4874915 - DNA, 13 bp, Homo sapiens
tttagtgctgcat

SEQ ID NO: 4874916 - DNA, 15 bp, Homo sapiens
tttagttttctctta

SEQ ID NO: 4874917 - DNA, 22 bp, Homo sapiens
tttataaaaataaatagaaaag

SEQ ID NO: 4874918 - DNA, 21 bp, Homo sapiens
tttataaaatagagtgtagtt

SEQ ID NO: 4874919 - DNA, 15 bp, Homo sapiens
tttataaatgagcaa

SEQ ID NO: 4874920 - DNA, 16 bp, Homo sapiens
tttataattttctgaa

SEQ ID NO: 4874921 - DNA, 17 bp, Homo sapiens
tttatacattagtaaat

SEQ ID NO: 4874922 - DNA, 17 bp, Homo sapiens
tttatagctattactgt

SEQ ID NO: 4874923 - DNA, 18 bp, Homo sapiens
tttatagtgcacaaaatg

SEQ ID NO: 4874924 - DNA, 13 bp, Homo sapiens
tttatagtggaaa

SEQ ID NO: 4874925 - DNA, 19 bp, Homo sapiens
tttatagtttgtacatgca

SEQ ID NO: 4874926 - DNA, 21 bp, Homo sapiens
tttatatatacagtaacttta

SEQ ID NO: 4874927 - DNA, 17 bp, Homo sapiens
tttatatcccattttta

SEQ ID NO: 4874928 - DNA, 23 bp, Homo sapiens
tttatatggatgattcagaaatt

SEQ ID NO: 4874929 - DNA, 18 bp, Homo sapiens
tttatatggggaatatat

SEQ ID NO: 4874930 - DNA, 14 bp, Homo sapiens
tttatatgtactgt

SEQ ID NO: 4874931 - DNA, 16 bp, Homo sapiens
tttatattaatgtact

SEQ ID NO: 4874932 - DNA, 14 bp, Homo sapiens
tttatatttatcca

SEQ ID NO: 4874933 - DNA, 16 bp, Homo sapiens
tttatatttatccact

SEQ ID NO: 4874934 - DNA, 14 bp, Homo sapiens
tttatcaaagcata

SEQ ID NO: 4874935 - DNA, 18 bp, Homo sapiens
tttatcacacttctgtga

SEQ ID NO: 4874936 - DNA, 14 bp, Homo sapiens
tttatcatgacatg

SEQ ID NO: 4874937 - DNA, 20 bp, Homo sapiens
tttatccacaggaaagtgtt

SEQ ID NO: 4874938 - DNA, 15 bp, Homo sapiens
tttatccatttgtaa

SEQ ID NO: 4874939 - DNA, 18 bp, Homo sapiens
tttatcctgaaatttcag

SEQ ID NO: 4874940 - DNA, 19 bp, Homo sapiens
tttatcctgaaatttcaga

SEQ ID NO: 4874941 - DNA, 12 bp, Homo sapiens
tttatctaaatt

SEQ ID NO: 4874942 - DNA, 11 bp, Homo sapiens
tttatgaaaat

SEQ ID NO: 4874943 - DNA, 19 bp, Homo sapiens
tttatgaaaataaatagct

SEQ ID NO: 4874944 - DNA, 19 bp, Homo sapiens
tttatgaaaggtttacatt

SEQ ID NO: 4874945 - DNA, 21 bp, Homo sapiens
tttatgagtaactattattat

SEQ ID NO: 4874946 - DNA, 16 bp, Homo sapiens
tttatgatatccctga

SEQ ID NO: 4874947 - DNA, 14 bp, Homo sapiens
tttatgatgatgaa

SEQ ID NO: 4874948 - DNA, 17 bp, Homo sapiens
tttatgatgatgaaaat

SEQ ID NO: 4874949 - DNA, 18 bp, Homo sapiens
tttatgatttaataaaat

SEQ ID NO: 4874950 - DNA, 17 bp, Homo sapiens
tttatgattttcataac

SEQ ID NO: 4874951 - DNA, 15 bp, Homo sapiens
tttatgcaaggaagg

SEQ ID NO: 4874952 - DNA, 14 bp, Homo sapiens
tttatgcagataga

SEQ ID NO: 4874953 - DNA, 14 bp, Homo sapiens
tttatgctcttttt

SEQ ID NO: 4874954 - DNA, 22 bp, Homo sapiens
tttatggccacatttaatatct

SEQ ID NO: 4874955 - DNA, 18 bp, Homo sapiens
tttatggtcctaaaagca

SEQ ID NO: 4874956 - DNA, 17 bp, Homo sapiens
tttatgtgtagttgtct

SEQ ID NO: 4874957 - DNA, 14 bp, Homo sapiens
tttatgtttgtctt

SEQ ID NO: 4874958 - DNA, 22 bp, Homo sapiens
tttatgtttgtcttttaatgct

SEQ ID NO: 4874959 - DNA, 14 bp, Homo sapiens
tttattaaaatgat

SEQ ID NO: 4874960 - DNA, 23 bp, Homo sapiens
tttattaaaatgattgtaaaata

SEQ ID NO: 4874961 - DNA, 20 bp, Homo sapiens
tttattaaatttgttgacaa

SEQ ID NO: 4874962 - DNA, 12 bp, Homo sapiens
tttattaccagt

SEQ ID NO: 4874963 - DNA, 14 bp, Homo sapiens
tttattaccagtgg

SEQ ID NO: 4874964 - DNA, 17 bp, Homo sapiens
tttattcaagttattgt

SEQ ID NO: 4874965 - DNA, 17 bp, Homo sapiens
tttattcagcttcattt

SEQ ID NO: 4874966 - DNA, 22 bp, Homo sapiens
tttattcagcttcatttgtgtc

SEQ ID NO: 4874967 - DNA, 16 bp, Homo sapiens
tttattcattagctgt

SEQ ID NO: 4874968 - DNA, 18 bp, Homo sapiens
tttattcattagctgtga

SEQ ID NO: 4874969 - DNA, 22 bp, Homo sapiens
tttattccagaatgctgtacat

SEQ ID NO: 4874970 - DNA, 18 bp, Homo sapiens
tttattcttctagagttc

SEQ ID NO: 4874971 - DNA, 14 bp, Homo sapiens
tttattgacacaga

SEQ ID NO: 4874972 - DNA, 19 bp, Homo sapiens
tttattgctagtatttgaa

SEQ ID NO: 4874973 - DNA, 20 bp, Homo sapiens
tttattgttaactcttgtct

SEQ ID NO: 4874974 - DNA, 11 bp, Homo sapiens
tttatttacta

SEQ ID NO: 4874975 - DNA, 14 bp, Homo sapiens
tttatttatgtact

SEQ ID NO: 4874976 - DNA, 14 bp, Homo sapiens
tttatttatttaca

SEQ ID NO: 4874977 - DNA, 15 bp, Homo sapiens
tttatttcagatttt

SEQ ID NO: 4874978 - DNA, 16 bp, Homo sapiens
tttatttgcaacattt

SEQ ID NO: 4874979 - DNA, 21 bp, Homo sapiens
tttattttacacagaaacact

SEQ ID NO: 4874980 - DNA, 16 bp, Homo sapiens
tttattttatgtttag

SEQ ID NO: 4874981 - DNA, 19 bp, Homo sapiens
tttattttgaaaagcttct

SEQ ID NO: 4874982 - DNA, 15 bp, Homo sapiens
tttattttttacatt

SEQ ID NO: 4874983 - DNA, 16 bp, Homo sapiens
tttattttttagtgca

SEQ ID NO: 4874984 - DNA, 23 bp, Homo sapiens
tttcaaaacacatctttcctgtc

SEQ ID NO: 4874985 - DNA, 22 bp, Homo sapiens
tttcaaactccaaggttccctt

SEQ ID NO: 4874986 - DNA, 19 bp, Homo sapiens
tttcaaacttactattttg

SEQ ID NO: 4874987 - DNA, 22 bp, Homo sapiens
tttcaaacttactattttgaca

SEQ ID NO: 4874988 - DNA, 14 bp, Homo sapiens
tttcaaatgtgctg

SEQ ID NO: 4874989 - DNA, 15 bp, Homo sapiens
tttcaacgcagccct

SEQ ID NO: 4874990 - DNA, 22 bp, Homo sapiens
tttcaagaaaaaataaatggaa

SEQ ID NO: 4874991 - DNA, 14 bp, Homo sapiens
tttcaagaacctgg

SEQ ID NO: 4874992 - DNA, 15 bp, Homo sapiens
tttcaagaacctgga

SEQ ID NO: 4874993 - DNA, 16 bp, Homo sapiens
tttcaagaacctggaa

SEQ ID NO: 4874994 - DNA, 17 bp, Homo sapiens
tttcaagaacctggaaa

SEQ ID NO: 4874995 - DNA, 15 bp, Homo sapiens
tttcaaggcactcta

SEQ ID NO: 4874996 - DNA, 18 bp, Homo sapiens
tttcaaggcactctagat

SEQ ID NO: 4874997 - DNA, 16 bp, Homo sapiens
tttcaaggttctaacc

SEQ ID NO: 4874998 - DNA, 14 bp, Homo sapiens
tttcaatgtgattc

SEQ ID NO: 4874999 - DNA, 22 bp, Homo sapiens
tttcaatgtgattctaatgtct

SEQ ID NO: 4875000 - DNA, 15 bp, Homo sapiens
tttcaattctcaaaa

SEQ ID NO: 4875001 - DNA, 13 bp, Homo sapiens
ttgttattttcag

SEQ ID NO: 4875002 - DNA, 13 bp, Homo sapiens
ttgttcaagtttt

SEQ ID NO: 4875003 - DNA, 12 bp, Homo sapiens
ttgttcatgttt

SEQ ID NO: 4875004 - DNA, 19 bp, Homo sapiens
ttgttcatgtttggtgcat

SEQ ID NO: 4875005 - DNA, 14 bp, Homo sapiens
ttgttcttacacat

SEQ ID NO: 4875006 - DNA, 15 bp, Homo sapiens
ttgttcttacacata

SEQ ID NO: 4875007 - DNA, 21 bp, Homo sapiens
ttgttgacagttctgaagaat

SEQ ID NO: 4875008 - DNA, 23 bp, Homo sapiens
ttgttgatgggcacttgagaact

SEQ ID NO: 4875009 - DNA, 15 bp, Homo sapiens
ttgttgtaaaaagaa

SEQ ID NO: 4875010 - DNA, 16 bp, Homo sapiens
ttgttgtgatgtcttt

SEQ ID NO: 4875011 - DNA, 14 bp, Homo sapiens
ttgttgtttgccat

SEQ ID NO: 4875012 - DNA, 23 bp, Homo sapiens
ttgttgtttgccatactttgtct

SEQ ID NO: 4875013 - DNA, 23 bp, Homo sapiens
ttgtttaatgtgaacttgtagct

SEQ ID NO: 4875014 - DNA, 15 bp, Homo sapiens
ttgtttattgagttt

SEQ ID NO: 4875015 - DNA, 19 bp, Homo sapiens
ttgtttattgagtttgtag

SEQ ID NO: 4875016 - DNA, 24 bp, Homo sapiens
ttgtttattgagtttgtaggtaaa

SEQ ID NO: 4875017 - DNA, 23 bp, Homo sapiens
ttgtttctcaaatcttggcaata

SEQ ID NO: 4875018 - DNA, 18 bp, Homo sapiens
ttgtttcttgtttattga

SEQ ID NO: 4875019 - DNA, 15 bp, Homo sapiens
ttgtttctttctagt

SEQ ID NO: 4875020 - DNA, 13 bp, Homo sapiens
ttgtttctttgtg

SEQ ID NO: 4875021 - DNA, 12 bp, Homo sapiens
ttgtttgctgct

SEQ ID NO: 4875022 - DNA, 20 bp, Homo sapiens
ttgtttggggatgagaaagg

SEQ ID NO: 4875023 - DNA, 18 bp, Homo sapiens
ttgtttgtctctcctttt

SEQ ID NO: 4875024 - DNA, 20 bp, Homo sapiens
ttgtttgtctctccttttct

SEQ ID NO: 4875025 - DNA, 13 bp, Homo sapiens
ttgttttaatctg

SEQ ID NO: 4875026 - DNA, 19 bp, Homo sapiens
ttgttttatcatgacatgt

SEQ ID NO: 4875027 - DNA, 16 bp, Homo sapiens
ttgttttctgactaat

SEQ ID NO: 4875028 - DNA, 18 bp, Homo sapiens
ttgttttctgactaatta

SEQ ID NO: 4875029 - DNA, 22 bp, Homo sapiens
ttgttttctttctttaaatgtt

SEQ ID NO: 4875030 - DNA, 23 bp, Homo sapiens
ttgttttgatgtttgtggcctca

SEQ ID NO: 4875031 - DNA, 13 bp, Homo sapiens
ttgttttgtttta

SEQ ID NO: 4875032 - DNA, 17 bp, Homo sapiens
ttgtttttagaatcatt

SEQ ID NO: 4875033 - DNA, 12 bp, Homo sapiens
ttgtttttcatt

SEQ ID NO: 4875034 - DNA, 14 bp, Homo sapiens
ttgtttttctttct

SEQ ID NO: 4875035 - DNA, 14 bp, Homo sapiens
ttgtttttttgcca

SEQ ID NO: 4875036 - DNA, 18 bp, Homo sapiens
tttaaaaaaatttaagtg

SEQ ID NO: 4875037 - DNA, 20 bp, Homo sapiens
tttaaaaaataactaccaag

SEQ ID NO: 4875038 - DNA, 22 bp, Homo sapiens
tttaaaaaatatttattaaata

SEQ ID NO: 4875039 - DNA, 18 bp, Homo sapiens
tttaaaaacatagaaaaa

SEQ ID NO: 4875040 - DNA, 23 bp, Homo sapiens
tttaaaaagttgtagcagattgt

SEQ ID NO: 4875041 - DNA, 17 bp, Homo sapiens
tttaaaaatagacactc

SEQ ID NO: 4875042 - DNA, 18 bp, Homo sapiens
tttaaaattgctatgtta

SEQ ID NO: 4875043 - DNA, 23 bp, Homo sapiens
tttaaaattgctatgttactatt

SEQ ID NO: 4875044 - DNA, 23 bp, Homo sapiens
tttaaacacacagatacacacac

SEQ ID NO: 4875045 - DNA, 17 bp, Homo sapiens
tttaaacagtatttcat

SEQ ID NO: 4875046 - DNA, 23 bp, Homo sapiens
tttaaacattaaaaatggaactg

SEQ ID NO: 4875047 - DNA, 14 bp, Homo sapiens
tttaaacttataaa

SEQ ID NO: 4875048 - DNA, 13 bp, Homo sapiens
tttaaagagtcta

SEQ ID NO: 4875049 - DNA, 21 bp, Homo sapiens
tttaaagagtctagattcaaa

SEQ ID NO: 4875050 - DNA, 23 bp, Homo sapiens
tttaaagagtctagattcaaagg

SEQ ID NO: 4875051 - DNA, 14 bp, Homo sapiens
tttaaagtgtttca

SEQ ID NO: 4875052 - DNA, 15 bp, Homo sapiens
tttaaataaactttt

SEQ ID NO: 4875053 - DNA, 21 bp, Homo sapiens
tttaaataaactttttttcaa

SEQ ID NO: 4875054 - DNA, 20 bp, Homo sapiens
tttaaatacgcactacatgt

SEQ ID NO: 4875055 - DNA, 19 bp, Homo sapiens
tttaaatcaagtattttgt

SEQ ID NO: 4875056 - DNA, 14 bp, Homo sapiens
tttaaatgtgtaca

SEQ ID NO: 4875057 - DNA, 18 bp, Homo sapiens
tttaaattttacccttta

SEQ ID NO: 4875058 - DNA, 22 bp, Homo sapiens
tttaaattttaccctttagact

SEQ ID NO: 4875059 - DNA, 22 bp, Homo sapiens
tttaacatttgccttgcagaac

SEQ ID NO: 4875060 - DNA, 16 bp, Homo sapiens
tttaagaaaagtattt

SEQ ID NO: 4875061 - DNA, 14 bp, Homo sapiens
tttaagagagaaat

SEQ ID NO: 4875062 - DNA, 14 bp, Homo sapiens
tttaagagtgaagt

SEQ ID NO: 4875063 - DNA, 14 bp, Homo sapiens
tttaagatttttct

SEQ ID NO: 4875064 - DNA, 16 bp, Homo sapiens
tttaagatttttctca

SEQ ID NO: 4875065 - DNA, 17 bp, Homo sapiens
tttaagatttttctcaa

SEQ ID NO: 4875066 - DNA, 16 bp, Homo sapiens
tttaagcaaatactta

SEQ ID NO: 4875067 - DNA, 16 bp, Homo sapiens
tttaaggtttttactg

SEQ ID NO: 4875068 - DNA, 17 bp, Homo sapiens
tttaataaaataattct

SEQ ID NO: 4875069 - DNA, 15 bp, Homo sapiens
tttaataacattacc

SEQ ID NO: 4875070 - DNA, 18 bp, Homo sapiens
tttaataacattacctta

SEQ ID NO: 4875071 - DNA, 20 bp, Homo sapiens
tttaataacattaccttact

SEQ ID NO: 4875072 - DNA, 23 bp, Homo sapiens
tttaataacattaccttactgtg

SEQ ID NO: 4875073 - DNA, 15 bp, Homo sapiens
tttaataataatcta

SEQ ID NO: 4875074 - DNA, 20 bp, Homo sapiens
tttaatagtcattccaaata

SEQ ID NO: 4875075 - DNA, 17 bp, Homo sapiens
tttaatctgaaattcta

SEQ ID NO: 4875076 - DNA, 18 bp, Homo sapiens
tttaatgcattaaacctg

SEQ ID NO: 4875077 - DNA, 20 bp, Homo sapiens
tttaatgcattaaacctgtc

SEQ ID NO: 4875078 - DNA, 23 bp, Homo sapiens
tttaatgccgatatactctagat

SEQ ID NO: 4875079 - DNA, 13 bp, Homo sapiens
tttaatgctgcct

SEQ ID NO: 4875080 - DNA, 20 bp, Homo sapiens
tttaatggattgttaatttc

SEQ ID NO: 4875081 - DNA, 17 bp, Homo sapiens
tttaatggcagcagaaa

SEQ ID NO: 4875082 - DNA, 14 bp, Homo sapiens
tttaatgtaaagat

SEQ ID NO: 4875083 - DNA, 20 bp, Homo sapiens
tttaatgtgaacttgtagct

SEQ ID NO: 4875084 - DNA, 21 bp, Homo sapiens
tttaatgtgaacttgtagctg

SEQ ID NO: 4875085 - DNA, 21 bp, Homo sapiens
tttaatgtgatgatgtaattg

SEQ ID NO: 4875086 - DNA, 22 bp, Homo sapiens
tttaatgtgatgatgtaattga

SEQ ID NO: 4875087 - DNA, 18 bp, Homo sapiens
tttaattattaactacat

SEQ ID NO: 4875088 - DNA, 19 bp, Homo sapiens
tttaattattaactacatt

SEQ ID NO: 4875089 - DNA, 16 bp, Homo sapiens
tttaattccaatatga

SEQ ID NO: 4875090 - DNA, 21 bp, Homo sapiens
tttaattccaatatgatgact

SEQ ID NO: 4875091 - DNA, 19 bp, Homo sapiens
tttaatttttttgagacag

SEQ ID NO: 4875092 - DNA, 18 bp, Homo sapiens
tttaattttttttagtat

SEQ ID NO: 4875093 - DNA, 19 bp, Homo sapiens
tttacaaaactacatgaga

SEQ ID NO: 4875094 - DNA, 15 bp, Homo sapiens
tttacaatgtcatat

SEQ ID NO: 4875095 - DNA, 15 bp, Homo sapiens
tttacacaattctta

SEQ ID NO: 4875096 - DNA, 19 bp, Homo sapiens
tttacacagaaacactgcc

SEQ ID NO: 4875097 - DNA, 16 bp, Homo sapiens
tttacagctgcctgca

SEQ ID NO: 4875098 - DNA, 15 bp, Homo sapiens
tttacagctgtgtta

SEQ ID NO: 4875099 - DNA, 13 bp, Homo sapiens
tttacaggccctg

SEQ ID NO: 4875100 - DNA, 19 bp, Homo sapiens
tttacaggccctgctcctg

SEQ ID NO: 4875101 - DNA, 15 bp, Homo sapiens
tttacagtccttcaa

SEQ ID NO: 4875102 - DNA, 15 bp, Homo sapiens
tttacataactgcct

SEQ ID NO: 4875103 - DNA, 19 bp, Homo sapiens
tttacataactgccttgaa

SEQ ID NO: 4875104 - DNA, 20 bp, Homo sapiens
tttacatgtgtagcctatgt

SEQ ID NO: 4875105 - DNA, 21 bp, Homo sapiens
tttacatgtgtagcctatgtt

SEQ ID NO: 4875106 - DNA, 15 bp, Homo sapiens
tttacattgtaaata

SEQ ID NO: 4875107 - DNA, 20 bp, Homo sapiens
tttacattgtaaatagtatt

SEQ ID NO: 4875108 - DNA, 20 bp, Homo sapiens
tttacatttttatttatgaa

SEQ ID NO: 4875109 - DNA, 14 bp, Homo sapiens
tttaccagctttta

SEQ ID NO: 4875110 - DNA, 19 bp, Homo sapiens
tttaccagcttttaaccat

SEQ ID NO: 4875111 - DNA, 18 bp, Homo sapiens
ttgtaacttatgtagata

SEQ ID NO: 4875112 - DNA, 17 bp, Homo sapiens
ttgtaagagtgtagaag

SEQ ID NO: 4875113 - DNA, 22 bp, Homo sapiens
ttgtaagagtgtagaagcattc

SEQ ID NO: 4875114 - DNA, 15 bp, Homo sapiens
ttgtaagtcagtgtt

SEQ ID NO: 4875115 - DNA, 13 bp, Homo sapiens
ttgtaagtttcag

SEQ ID NO: 4875116 - DNA, 17 bp, Homo sapiens
ttgtaagtttcaggtga

SEQ ID NO: 4875117 - DNA, 18 bp, Homo sapiens
ttgtaagtttcaggtgac

SEQ ID NO: 4875118 - DNA, 19 bp, Homo sapiens
ttgtaagtttcaggtgaca

SEQ ID NO: 4875119 - DNA, 13 bp, Homo sapiens
ttgtaatattttg

SEQ ID NO: 4875120 - DNA, 15 bp, Homo sapiens
ttgtaatattttgta

SEQ ID NO: 4875121 - DNA, 16 bp, Homo sapiens
ttgtaatgctgcactt

SEQ ID NO: 4875122 - DNA, 14 bp, Homo sapiens
ttgtaattatgatt

SEQ ID NO: 4875123 - DNA, 15 bp, Homo sapiens
ttgtaattatgattt

SEQ ID NO: 4875124 - DNA, 22 bp, Homo sapiens
ttgtaattgcttttttaaatat

SEQ ID NO: 4875125 - DNA, 14 bp, Homo sapiens
ttgtacaaaataaa

SEQ ID NO: 4875126 - DNA, 21 bp, Homo sapiens
ttgtacagcgttttaaaagaa

SEQ ID NO: 4875127 - DNA, 15 bp, Homo sapiens
ttgtacatatttgtg

SEQ ID NO: 4875128 - DNA, 21 bp, Homo sapiens
ttgtacatatttgtggaataa

SEQ ID NO: 4875129 - DNA, 16 bp, Homo sapiens
ttgtacatctggctta

SEQ ID NO: 4875130 - DNA, 17 bp, Homo sapiens
ttgtacatctggcttat

SEQ ID NO: 4875131 - DNA, 20 bp, Homo sapiens
ttgtacatgtgtagcctgtg

SEQ ID NO: 4875132 - DNA, 15 bp, Homo sapiens
ttgtagagccagggt

SEQ ID NO: 4875133 - DNA, 21 bp, Homo sapiens
ttgtaggaaggtctcattctt

SEQ ID NO: 4875134 - DNA, 17 bp, Homo sapiens
ttgtaggataagtgaaa

SEQ ID NO: 4875135 - DNA, 19 bp, Homo sapiens
ttgtaggtgcaagatggaa

SEQ ID NO: 4875136 - DNA, 21 bp, Homo sapiens
ttgtagtagcgttttttaaat

SEQ ID NO: 4875137 - DNA, 22 bp, Homo sapiens
ttgtagtagcgttttttaaatg

SEQ ID NO: 4875138 - DNA, 17 bp, Homo sapiens
ttgtagtttacctcttt

SEQ ID NO: 4875139 - DNA, 13 bp, Homo sapiens
ttgtataaatgta

SEQ ID NO: 4875140 - DNA, 17 bp, Homo sapiens
ttgtataaatgtatata

SEQ ID NO: 4875141 - DNA, 22 bp, Homo sapiens
ttgtataaatgtatatacacat

SEQ ID NO: 4875142 - DNA, 14 bp, Homo sapiens
ttgtatacaaatat

SEQ ID NO: 4875143 - DNA, 20 bp, Homo sapiens
ttgtatacaccatatactgt

SEQ ID NO: 4875144 - DNA, 20 bp, Homo sapiens
ttgtatactttaaataattt

SEQ ID NO: 4875145 - DNA, 22 bp, Homo sapiens
ttgtatactttaaataatttaa

SEQ ID NO: 4875146 - DNA, 15 bp, Homo sapiens
ttgtatagtgtaaaa

SEQ ID NO: 4875147 - DNA, 20 bp, Homo sapiens
ttgtatgatgtgttgtgata

SEQ ID NO: 4875148 - DNA, 14 bp, Homo sapiens
ttgtattaacaaaa

SEQ ID NO: 4875149 - DNA, 22 bp, Homo sapiens
ttgtattcaaaaattatctata

SEQ ID NO: 4875150 - DNA, 20 bp, Homo sapiens
ttgtcaagtctctgctggcc

SEQ ID NO: 4875151 - DNA, 22 bp, Homo sapiens
ttgtcactgacacaaaggaagt

SEQ ID NO: 4875152 - DNA, 15 bp, Homo sapiens
ttgtcagacataaag

SEQ ID NO: 4875153 - DNA, 18 bp, Homo sapiens
ttgtcagacataaagcca

SEQ ID NO: 4875154 - DNA, 14 bp, Homo sapiens
ttgtccatttgtaa

SEQ ID NO: 4875155 - DNA, 14 bp, Homo sapiens
ttgtcccccaactt

SEQ ID NO: 4875156 - DNA, 18 bp, Homo sapiens
ttgtcccccaacttgaga

SEQ ID NO: 4875157 - DNA, 20 bp, Homo sapiens
ttgtcctgcctgcaatattt

SEQ ID NO: 4875158 - DNA, 15 bp, Homo sapiens
ttgtcctttcccttc

SEQ ID NO: 4875159 - DNA, 17 bp, Homo sapiens
ttgtcctttcccttcag

SEQ ID NO: 4875160 - DNA, 17 bp, Homo sapiens
ttgtccttttgtcttct

SEQ ID NO: 4875161 - DNA, 20 bp, Homo sapiens
ttgtcgggcaccagccagcg

SEQ ID NO: 4875162 - DNA, 19 bp, Homo sapiens
ttgtctaactcagaattat

SEQ ID NO: 4875163 - DNA, 20 bp, Homo sapiens
ttgtctatgggactcaatgc

SEQ ID NO: 4875164 - DNA, 16 bp, Homo sapiens
ttgtctatttttgtct

SEQ ID NO: 4875165 - DNA, 18 bp, Homo sapiens
ttgtctatttttgtctta

SEQ ID NO: 4875166 - DNA, 18 bp, Homo sapiens
ttgtctcctactcctgac

SEQ ID NO: 4875167 - DNA, 14 bp, Homo sapiens
ttgtctctcctttt

SEQ ID NO: 4875168 - DNA, 21 bp, Homo sapiens
ttgtctctccttttcttttgt

SEQ ID NO: 4875169 - DNA, 15 bp, Homo sapiens
ttgtctctcttcaga

SEQ ID NO: 4875170 - DNA, 18 bp, Homo sapiens
ttgtctgaagtcactgca

SEQ ID NO: 4875171 - DNA, 20 bp, Homo sapiens
ttgtctgaagtcactgcaca

SEQ ID NO: 4875172 - DNA, 16 bp, Homo sapiens
ttgtctgtttgtttca

SEQ ID NO: 4875173 - DNA, 13 bp, Homo sapiens
ttgtcttatatat

SEQ ID NO: 4875174 - DNA, 15 bp, Homo sapiens
ttgtcttatatatat

SEQ ID NO: 4875175 - DNA, 13 bp, Homo sapiens
ttgtctttcagga

SEQ ID NO: 4875176 - DNA, 16 bp, Homo sapiens
ttgtgaaacacagctg

SEQ ID NO: 4875177 - DNA, 17 bp, Homo sapiens
ttgtgaaacacagctgt

SEQ ID NO: 4875178 - DNA, 19 bp, Homo sapiens
ttgtgaagaaaaataaagt

SEQ ID NO: 4875179 - DNA, 13 bp, Homo sapiens
ttgtgaatggatt

SEQ ID NO: 4875180 - DNA, 21 bp, Homo sapiens
ttgtgaatggattggattatt

SEQ ID NO: 4875181 - DNA, 14 bp, Homo sapiens
ttgtgataatttaa

SEQ ID NO: 4875182 - DNA, 20 bp, Homo sapiens
ttgtgatagctaacatttta

SEQ ID NO: 4875183 - DNA, 16 bp, Homo sapiens
ttgtgcagtcatcaga

SEQ ID NO: 4875184 - DNA, 15 bp, Homo sapiens
ttgtgcatttgtaaa

SEQ ID NO: 4875185 - DNA, 17 bp, Homo sapiens
ttgtgccaatatgtatt

SEQ ID NO: 4875186 - DNA, 22 bp, Homo sapiens
ttgtgccaatatgtattgtaaa

SEQ ID NO: 4875187 - DNA, 16 bp, Homo sapiens
ttgtgccttttatagc

SEQ ID NO: 4875188 - DNA, 11 bp, Homo sapiens
ttgtgctgcca

SEQ ID NO: 4875189 - DNA, 19 bp, Homo sapiens
ttgtgctttgctcttgtcc

SEQ ID NO: 4875190 - DNA, 16 bp, Homo sapiens
ttgtggacacagctct

SEQ ID NO: 4875191 - DNA, 11 bp, Homo sapiens
ttgtggcctca

SEQ ID NO: 4875192 - DNA, 12 bp, Homo sapiens
ttgtggcctcag

SEQ ID NO: 4875193 - DNA, 16 bp, Homo sapiens
ttgtgggcataaactg

SEQ ID NO: 4875194 - DNA, 15 bp, Homo sapiens
ttgtggttttatgga

SEQ ID NO: 4875195 - DNA, 19 bp, Homo sapiens
ttgtgtaatagaaaactga

SEQ ID NO: 4875196 - DNA, 21 bp, Homo sapiens
ttgtgtaatagaaaactgaaa

SEQ ID NO: 4875197 - DNA, 23 bp, Homo sapiens
ttgtgtaatgaaaatgaatatct

SEQ ID NO: 4875198 - DNA, 24 bp, Homo sapiens
ttgtgtaatgaaaatgaatatcta

SEQ ID NO: 4875199 - DNA, 20 bp, Homo sapiens
ttgtgtatcgtaaccagcca

SEQ ID NO: 4875200 - DNA, 14 bp, Homo sapiens
ttgtgtctgtacac

SEQ ID NO: 4875201 - DNA, 13 bp, Homo sapiens
ttgtgtgtcttaa

SEQ ID NO: 4875202 - DNA, 22 bp, Homo sapiens
ttgtgtgttccaagtttccaaa

SEQ ID NO: 4875203 - DNA, 13 bp, Homo sapiens
ttgtgtgttgtct

SEQ ID NO: 4875204 - DNA, 18 bp, Homo sapiens
ttgtgtgtttatttcact

SEQ ID NO: 4875205 - DNA, 12 bp, Homo sapiens
ttgtgttgtaat

SEQ ID NO: 4875206 - DNA, 14 bp, Homo sapiens
ttgtgttgtaattc

SEQ ID NO: 4875207 - DNA, 21 bp, Homo sapiens
ttgtgttgtaattcttcagtt

SEQ ID NO: 4875208 - DNA, 17 bp, Homo sapiens
ttgtgtttggtttacat

SEQ ID NO: 4875209 - DNA, 17 bp, Homo sapiens
ttgtgtttgtgtattta

SEQ ID NO: 4875210 - DNA, 16 bp, Homo sapiens
ttgttaaaattatgaa

SEQ ID NO: 4875211 - DNA, 22 bp, Homo sapiens
ttgttaaaattatgaatctgat

SEQ ID NO: 4875212 - DNA, 22 bp, Homo sapiens
ttgttacacattaagtaatcaa

SEQ ID NO: 4875213 - DNA, 21 bp, Homo sapiens
ttgttacctccaacagaacta

SEQ ID NO: 4875214 - DNA, 19 bp, Homo sapiens
ttgttactcttacgaatat

SEQ ID NO: 4875215 - DNA, 12 bp, Homo sapiens
ttgttactgttc

SEQ ID NO: 4875216 - DNA, 13 bp, Homo sapiens
ttgttactgttct

SEQ ID NO: 4875217 - DNA, 16 bp, Homo sapiens
ttgttactgttcttgc

SEQ ID NO: 4875218 - DNA, 20 bp, Homo sapiens
ttgttactgttcttgctgct

SEQ ID NO: 4875219 - DNA, 21 bp, Homo sapiens
ttgttactgttcttgctgcta

SEQ ID NO: 4875220 - DNA, 23 bp, Homo sapiens
ttgttactgttcttgctgctaga

SEQ ID NO: 4875221 - DNA, 16 bp, Homo sapiens
ttgttatcagtcaata

SEQ ID NO: 4875222 - DNA, 12 bp, Homo sapiens
ttgcctggcctt

SEQ ID NO: 4875223 - DNA, 22 bp, Homo sapiens
ttgccttcctttctccaggacc

SEQ ID NO: 4875224 - DNA, 23 bp, Homo sapiens
ttgccttcctttctccaggacca

SEQ ID NO: 4875225 - DNA, 14 bp, Homo sapiens
ttgccttctttgaa

SEQ ID NO: 4875226 - DNA, 16 bp, Homo sapiens
ttgccttctttgaaga

SEQ ID NO: 4875227 - DNA, 19 bp, Homo sapiens
ttgcgaatccaagctccct

SEQ ID NO: 4875228 - DNA, 20 bp, Homo sapiens
ttgcgaatccaagctccctg

SEQ ID NO: 4875229 - DNA, 21 bp, Homo sapiens
ttgcggccagtattagactgg

SEQ ID NO: 4875230 - DNA, 16 bp, Homo sapiens
ttgctaatcaaagcca

SEQ ID NO: 4875231 - DNA, 18 bp, Homo sapiens
ttgctagcagtaaaagat

SEQ ID NO: 4875232 - DNA, 16 bp, Homo sapiens
ttgctagctatgtgac

SEQ ID NO: 4875233 - DNA, 19 bp, Homo sapiens
ttgctagctatgtgacctt

SEQ ID NO: 4875234 - DNA, 13 bp, Homo sapiens
ttgctagtatttg

SEQ ID NO: 4875235 - DNA, 15 bp, Homo sapiens
ttgctagtatttgaa

SEQ ID NO: 4875236 - DNA, 16 bp, Homo sapiens
ttgctagtatttgaat

SEQ ID NO: 4875237 - DNA, 18 bp, Homo sapiens
ttgctagtatttgaatta

SEQ ID NO: 4875238 - DNA, 16 bp, Homo sapiens
ttgctatgttactatt

SEQ ID NO: 4875239 - DNA, 17 bp, Homo sapiens
ttgctattagagcattg

SEQ ID NO: 4875240 - DNA, 21 bp, Homo sapiens
ttgctcaagttcattgatgac

SEQ ID NO: 4875241 - DNA, 22 bp, Homo sapiens
ttgctcaagttcattgatgacc

SEQ ID NO: 4875242 - DNA, 12 bp, Homo sapiens
ttgctccttgac

SEQ ID NO: 4875243 - DNA, 19 bp, Homo sapiens
ttgctcttgtcccacgtgt

SEQ ID NO: 4875244 - DNA, 19 bp, Homo sapiens
ttgctgaagggcattcttt

SEQ ID NO: 4875245 - DNA, 22 bp, Homo sapiens
ttgctgagcctctgctccccag

SEQ ID NO: 4875246 - DNA, 13 bp, Homo sapiens
ttgctgctagaac

SEQ ID NO: 4875247 - DNA, 17 bp, Homo sapiens
ttgctgctagaactttt

SEQ ID NO: 4875248 - DNA, 23 bp, Homo sapiens
ttgctggacggggactggggatg

SEQ ID NO: 4875249 - DNA, 11 bp, Homo sapiens
ttgctgtctct

SEQ ID NO: 4875250 - DNA, 17 bp, Homo sapiens
ttgctgtgtttaatttg

SEQ ID NO: 4875251 - DNA, 13 bp, Homo sapiens
ttgcttatgacat

SEQ ID NO: 4875252 - DNA, 17 bp, Homo sapiens
ttgcttcctcctcccca

SEQ ID NO: 4875253 - DNA, 19 bp, Homo sapiens
ttgcttgttatattaagca

SEQ ID NO: 4875254 - DNA, 22 bp, Homo sapiens
ttgctttgaagcagttgtgtca

SEQ ID NO: 4875255 - DNA, 14 bp, Homo sapiens
ttgcttttaattaa

SEQ ID NO: 4875256 - DNA, 15 bp, Homo sapiens
ttgcttttattttga

SEQ ID NO: 4875257 - DNA, 15 bp, Homo sapiens
ttgcttttccctctt

SEQ ID NO: 4875258 - DNA, 18 bp, Homo sapiens
ttggaaagaagaaagact

SEQ ID NO: 4875259 - DNA, 21 bp, Homo sapiens
ttggaaatggatgcaaagtac

SEQ ID NO: 4875260 - DNA, 16 bp, Homo sapiens
ttggaacaaagtgaag

SEQ ID NO: 4875261 - DNA, 15 bp, Homo sapiens
ttggaagagaatcac

SEQ ID NO: 4875262 - DNA, 19 bp, Homo sapiens
ttggaagattttcagtcta

SEQ ID NO: 4875263 - DNA, 19 bp, Homo sapiens
ttggacacctttaggttct

SEQ ID NO: 4875264 - DNA, 20 bp, Homo sapiens
ttggagcgagcatcccccaa

SEQ ID NO: 4875265 - DNA, 15 bp, Homo sapiens
ttggagcttacatag

SEQ ID NO: 4875266 - DNA, 20 bp, Homo sapiens
ttggagcttacatagtttta

SEQ ID NO: 4875267 - DNA, 17 bp, Homo sapiens
ttggattatttaataac

SEQ ID NO: 4875268 - DNA, 18 bp, Homo sapiens
ttggattatttaataaca

SEQ ID NO: 4875269 - DNA, 14 bp, Homo sapiens
ttggatttgacatt

SEQ ID NO: 4875270 - DNA, 14 bp, Homo sapiens
ttggcaacagaagc

SEQ ID NO: 4875271 - DNA, 20 bp, Homo sapiens
ttggcaatagtttgcataga

SEQ ID NO: 4875272 - DNA, 11 bp, Homo sapiens
ttggcaccaaa

SEQ ID NO: 4875273 - DNA, 18 bp, Homo sapiens
ttggcaccaaagatgcag

SEQ ID NO: 4875274 - DNA, 23 bp, Homo sapiens
ttggcaccaaagatgcagccgcc

SEQ ID NO: 4875275 - DNA, 15 bp, Homo sapiens
ttggcagtttggtat

SEQ ID NO: 4875276 - DNA, 24 bp, Homo sapiens
ttggccaaagccaaagctaggcct

SEQ ID NO: 4875277 - DNA, 18 bp, Homo sapiens
ttggcccctgcccggctg

SEQ ID NO: 4875278 - DNA, 21 bp, Homo sapiens
ttggccggctgtgctcagaga

SEQ ID NO: 4875279 - DNA, 15 bp, Homo sapiens
ttgattaagatttta

SEQ ID NO: 4875280 - DNA, 16 bp, Homo sapiens
ttgattaagattttac

SEQ ID NO: 4875281 - DNA, 23 bp, Homo sapiens
ttgattctccttttatgtgtagt

SEQ ID NO: 4875282 - DNA, 20 bp, Homo sapiens
ttgattctgcagtaaatctt

SEQ ID NO: 4875283 - DNA, 14 bp, Homo sapiens
ttgattgatttgaa

SEQ ID NO: 4875284 - DNA, 11 bp, Homo sapiens
ttgatttacag

SEQ ID NO: 4875285 - DNA, 19 bp, Homo sapiens
ttgatttatgcatggaaac

SEQ ID NO: 4875286 - DNA, 17 bp, Homo sapiens
ttgcaaaagactaattt

SEQ ID NO: 4875287 - DNA, 17 bp, Homo sapiens
ttgcaaatataaacatc

SEQ ID NO: 4875288 - DNA, 17 bp, Homo sapiens
ttgcaaatcttgaaatt

SEQ ID NO: 4875289 - DNA, 19 bp, Homo sapiens
ttgcaagcatgcttgtgaa

SEQ ID NO: 4875290 - DNA, 15 bp, Homo sapiens
ttgcaatatctgaag

SEQ ID NO: 4875291 - DNA, 14 bp, Homo sapiens
ttgcaatggcagcc

SEQ ID NO: 4875292 - DNA, 18 bp, Homo sapiens
ttgcacaggatgctggcc

SEQ ID NO: 4875293 - DNA, 17 bp, Homo sapiens
ttgcacttgtgattatt

SEQ ID NO: 4875294 - DNA, 16 bp, Homo sapiens
ttgcagaactgccatt

SEQ ID NO: 4875295 - DNA, 23 bp, Homo sapiens
ttgcagacaggcaagcacctcct

SEQ ID NO: 4875296 - DNA, 20 bp, Homo sapiens
ttgcaggtggaactcagtca

SEQ ID NO: 4875297 - DNA, 18 bp, Homo sapiens
ttgcatccaactccagga

SEQ ID NO: 4875298 - DNA, 15 bp, Homo sapiens
ttgcatccttcctat

SEQ ID NO: 4875299 - DNA, 18 bp, Homo sapiens
ttgcatccttcctataac

SEQ ID NO: 4875300 - DNA, 18 bp, Homo sapiens
ttgcatctaggtaatttt

SEQ ID NO: 4875301 - DNA, 21 bp, Homo sapiens
ttgcatgaagagaagcaattt

SEQ ID NO: 4875302 - DNA, 21 bp, Homo sapiens
ttgcattaaattcacaaactt

SEQ ID NO: 4875303 - DNA, 19 bp, Homo sapiens
ttgcattctattgccttct

SEQ ID NO: 4875304 - DNA, 23 bp, Homo sapiens
ttgcattgaacacaaactgtaaa

SEQ ID NO: 4875305 - DNA, 20 bp, Homo sapiens
ttgcatttatatgtaccgta

SEQ ID NO: 4875306 - DNA, 15 bp, Homo sapiens
ttgccaaatctggct

SEQ ID NO: 4875307 - DNA, 17 bp, Homo sapiens
ttgccaagacaaatcaa

SEQ ID NO: 4875308 - DNA, 24 bp, Homo sapiens
ttgccaagacaaatcaacagaagc

SEQ ID NO: 4875309 - DNA, 17 bp, Homo sapiens
ttgccaccacctctgtg

SEQ ID NO: 4875310 - DNA, 14 bp, Homo sapiens
ttgccaccaggaga

SEQ ID NO: 4875311 - DNA, 23 bp, Homo sapiens
ttgccaccccaccctccctggag

SEQ ID NO: 4875312 - DNA, 12 bp, Homo sapiens
ttgccactaatt

SEQ ID NO: 4875313 - DNA, 14 bp, Homo sapiens
ttgccactgcctct

SEQ ID NO: 4875314 - DNA, 16 bp, Homo sapiens
ttgccactttgcacga

SEQ ID NO: 4875315 - DNA, 18 bp, Homo sapiens
ttgccatactttgtctga

SEQ ID NO: 4875316 - DNA, 20 bp, Homo sapiens
ttgccatgggcttcactgta

SEQ ID NO: 4875317 - DNA, 14 bp, Homo sapiens
ttgccatgttgcca

SEQ ID NO: 4875318 - DNA, 16 bp, Homo sapiens
ttgccatgttggccag

SEQ ID NO: 4875319 - DNA, 17 bp, Homo sapiens
ttgccatgttggccagg

SEQ ID NO: 4875320 - DNA, 21 bp, Homo sapiens
ttgccatgttggccaggctgg

SEQ ID NO: 4875321 - DNA, 13 bp, Homo sapiens
ttgcccaggcagg

SEQ ID NO: 4875322 - DNA, 14 bp, Homo sapiens
ttgcccaggctggc

SEQ ID NO: 4875323 - DNA, 18 bp, Homo sapiens
ttgcccaggctggtctca

SEQ ID NO: 4875324 - DNA, 18 bp, Homo sapiens
ttgccctttctgtaccat

SEQ ID NO: 4875325 - DNA, 18 bp, Homo sapiens
ttgcctaaatttaatgct

SEQ ID NO: 4875326 - DNA, 23 bp, Homo sapiens
ttgcctaagtattaaaacattgg

SEQ ID NO: 4875327 - DNA, 14 bp, Homo sapiens
ttgcctctgcctct

SEQ ID NO: 4875328 - DNA, 16 bp, Homo sapiens
ttgcctctgcctctga

SEQ ID NO: 4875329 - DNA, 18 bp, Homo sapiens
ttgcctctgcctctgaca

SEQ ID NO: 4875330 - DNA, 16 bp, Homo sapiens
ttcaaactggggcctc

SEQ ID NO: 4875331 - DNA, 12 bp, Homo sapiens
ttcaaactgtga

SEQ ID NO: 4875332 - DNA, 17 bp, Homo sapiens
ttcaaacttactatttt

SEQ ID NO: 4875333 - DNA, 21 bp, Homo sapiens
ttcaaaggttctaggtttcaa

SEQ ID NO: 4875334 - DNA, 16 bp, Homo sapiens
ttcaaatccttccaaa

SEQ ID NO: 4875335 - DNA, 23 bp, Homo sapiens
ttcaaatccttccaaaaattatt

SEQ ID NO: 4875336 - DNA, 16 bp, Homo sapiens
ttcaaattgtcttttg

SEQ ID NO: 4875337 - DNA, 20 bp, Homo sapiens
ttcaaccattccccatggga

SEQ ID NO: 4875338 - DNA, 13 bp, Homo sapiens
ttcaacgcagccc

SEQ ID NO: 4875339 - DNA, 16 bp, Homo sapiens
ttcaacgcagccctgc

SEQ ID NO: 4875340 - DNA, 21 bp, Homo sapiens
ttcaagaaaaaataaatggaa

SEQ ID NO: 4875341 - DNA, 11 bp, Homo sapiens
ttcaaggaagg

SEQ ID NO: 4875342 - DNA, 17 bp, Homo sapiens
ttcaaggcactctagat

SEQ ID NO: 4875343 - DNA, 18 bp, Homo sapiens
ttcaaggcactctagatt

SEQ ID NO: 4875344 - DNA, 21 bp, Homo sapiens
ttcaaggcactctagattcca

SEQ ID NO: 4875345 - DNA, 22 bp, Homo sapiens
ttcaaggcactctagattccat

SEQ ID NO: 4875346 - DNA, 17 bp, Homo sapiens
ttcaaggtggccaaatt

SEQ ID NO: 4875347 - DNA, 22 bp, Homo sapiens
ttcaaggtggccaaattatttg

SEQ ID NO: 4875348 - DNA, 15 bp, Homo sapiens
ttcaaggttctaacc

SEQ ID NO: 4875349 - DNA, 13 bp, Homo sapiens
ttcaagtgccttt

SEQ ID NO: 4875350 - DNA, 19 bp, Homo sapiens
ttgaaatgaggtctgttta

SEQ ID NO: 4875351 - DNA, 20 bp, Homo sapiens
ttgaaatgaggtctgtttaa

SEQ ID NO: 4875352 - DNA, 18 bp, Homo sapiens
ttgaaattttgcaaatat

SEQ ID NO: 4875353 - DNA, 19 bp, Homo sapiens
ttgaaattttgcaaatata

SEQ ID NO: 4875354 - DNA, 22 bp, Homo sapiens
ttgaaattttgcaaatataaac

SEQ ID NO: 4875355 - DNA, 15 bp, Homo sapiens
ttgaacacaaactgt

SEQ ID NO: 4875356 - DNA, 15 bp, Homo sapiens
ttgaaccaaacctcc

SEQ ID NO: 4875357 - DNA, 16 bp, Homo sapiens
ttgaactaagaaactt

SEQ ID NO: 4875358 - DNA, 15 bp, Homo sapiens
ttgaactcctggcct

SEQ ID NO: 4875359 - DNA, 16 bp, Homo sapiens
ttgaactcctggcctc

SEQ ID NO: 4875360 - DNA, 23 bp, Homo sapiens
ttgaactggcaattgtctattta

SEQ ID NO: 4875361 - DNA, 14 bp, Homo sapiens
ttgaagaaacagat

SEQ ID NO: 4875362 - DNA, 19 bp, Homo sapiens
ttgaagaaacagataccat

SEQ ID NO: 4875363 - DNA, 14 bp, Homo sapiens
ttgaagaaggtgga

SEQ ID NO: 4875364 - DNA, 18 bp, Homo sapiens
ttgaagaaggtggacctt

SEQ ID NO: 4875365 - DNA, 13 bp, Homo sapiens
ttgaagacaattt

SEQ ID NO: 4875366 - DNA, 15 bp, Homo sapiens
ttgaagacaatttga

SEQ ID NO: 4875367 - DNA, 22 bp, Homo sapiens
ttgaagacaatttgatacataa

SEQ ID NO: 4875368 - DNA, 18 bp, Homo sapiens
ttgaagagagatatatct

SEQ ID NO: 4875369 - DNA, 14 bp, Homo sapiens
ttgaaggaaacagt

SEQ ID NO: 4875370 - DNA, 19 bp, Homo sapiens
ttgaaggaagccaaattta

SEQ ID NO: 4875371 - DNA, 11 bp, Homo sapiens
ttgaagtcttg

SEQ ID NO: 4875372 - DNA, 13 bp, Homo sapiens
ttgaagtttacat

SEQ ID NO: 4875373 - DNA, 12 bp, Homo sapiens
ttgaatactttt

SEQ ID NO: 4875374 - DNA, 17 bp, Homo sapiens
ttgaatatggacaagag

SEQ ID NO: 4875375 - DNA, 21 bp, Homo sapiens
ttgaatattactcctattttt

SEQ ID NO: 4875376 - DNA, 14 bp, Homo sapiens
ttgaatcctttgcc

SEQ ID NO: 4875377 - DNA, 17 bp, Homo sapiens
ttgaatgacaacagaag

SEQ ID NO: 4875378 - DNA, 14 bp, Homo sapiens
ttgaatgctgccag

SEQ ID NO: 4875379 - DNA, 20 bp, Homo sapiens
ttgaatgctttttgaatgtt

SEQ ID NO: 4875380 - DNA, 17 bp, Homo sapiens
ttgaatgttaagcagat

SEQ ID NO: 4875381 - DNA, 18 bp, Homo sapiens
ttgaatttactggacata

SEQ ID NO: 4875382 - DNA, 17 bp, Homo sapiens
ttgacaaaattttctca

SEQ ID NO: 4875383 - DNA, 14 bp, Homo sapiens
ttgacaaatctgtg

SEQ ID NO: 4875384 - DNA, 23 bp, Homo sapiens
ttgacaaatctgtgtatattatt

SEQ ID NO: 4875385 - DNA, 17 bp, Homo sapiens
ttgacacaagtggacct

SEQ ID NO: 4875386 - DNA, 16 bp, Homo sapiens
ttgacacagaaaatgt

SEQ ID NO: 4875387 - DNA, 20 bp, Homo sapiens
ttgacacatccgccttttgt

SEQ ID NO: 4875388 - DNA, 17 bp, Homo sapiens
ttgacactctgcagact

SEQ ID NO: 4875389 - DNA, 19 bp, Homo sapiens
ttgacagtgttgaaaatgt

SEQ ID NO: 4875390 - DNA, 15 bp, Homo sapiens
ttgacagttctgaag

SEQ ID NO: 4875391 - DNA, 11 bp, Homo sapiens
ttgacatttaa

SEQ ID NO: 4875392 - DNA, 13 bp, Homo sapiens
ttgacatttaatt

SEQ ID NO: 4875393 - DNA, 15 bp, Homo sapiens
ttgacatttgtagtt

SEQ ID NO: 4875394 - DNA, 20 bp, Homo sapiens
ttgaccgcgactaatttcaa

SEQ ID NO: 4875395 - DNA, 22 bp, Homo sapiens
ttgacctcacagtgacccttcc

SEQ ID NO: 4875396 - DNA, 23 bp, Homo sapiens
ttgacctcacagtgacccttccc

SEQ ID NO: 4875397 - DNA, 23 bp, Homo sapiens
ttgactagatgatggatgccaat

SEQ ID NO: 4875398 - DNA, 18 bp, Homo sapiens
ttcattctcataattcct

SEQ ID NO: 4875399 - DNA, 15 bp, Homo sapiens
ttcattctccttgtt

SEQ ID NO: 4875400 - DNA, 21 bp, Homo sapiens
ttcattctcgtgagtcattta

SEQ ID NO: 4875401 - DNA, 15 bp, Homo sapiens
ttcattctgcagggt

SEQ ID NO: 4875402 - DNA, 12 bp, Homo sapiens
ttcattctgcat

SEQ ID NO: 4875403 - DNA, 19 bp, Homo sapiens
ttcattgcactttgattag

SEQ ID NO: 4875404 - DNA, 18 bp, Homo sapiens
ttcattgcctgtgtatgg

SEQ ID NO: 4875405 - DNA, 22 bp, Homo sapiens
ttcattggtctaatttattcaa

SEQ ID NO: 4875406 - DNA, 14 bp, Homo sapiens
ttcattgtatgatg

SEQ ID NO: 4875407 - DNA, 21 bp, Homo sapiens
ttcattgtttttaactttgct

SEQ ID NO: 4875408 - DNA, 18 bp, Homo sapiens
ttcatttagtgagttatt

SEQ ID NO: 4875409 - DNA, 15 bp, Homo sapiens
ttcatttcctgtgtc

SEQ ID NO: 4875410 - DNA, 15 bp, Homo sapiens
ttcatttgtgtcaat

SEQ ID NO: 4875411 - DNA, 22 bp, Homo sapiens
ttcatttgtttgtttgtttgtc

SEQ ID NO: 4875412 - DNA, 11 bp, Homo sapiens
ttcattttcca

SEQ ID NO: 4875413 - DNA, 14 bp, Homo sapiens
ttcattttccaata

SEQ ID NO: 4875414 - DNA, 21 bp, Homo sapiens
ttccaaaaagattttcagaaa

SEQ ID NO: 4875415 - DNA, 18 bp, Homo sapiens
ttccaaaaaggttgctgt

SEQ ID NO: 4875416 - DNA, 12 bp, Homo sapiens
ttccaaaataat

SEQ ID NO: 4875417 - DNA, 14 bp, Homo sapiens
ttccaaaattctta

SEQ ID NO: 4875418 - DNA, 16 bp, Homo sapiens
ttccaaaattcttatt

SEQ ID NO: 4875419 - DNA, 15 bp, Homo sapiens
ttccaaagaattctt

SEQ ID NO: 4875420 - DNA, 16 bp, Homo sapiens
ttccaaagctttatta

SEQ ID NO: 4875421 - DNA, 22 bp, Homo sapiens
ttccaaagctttattaccagtg

SEQ ID NO: 4875422 - DNA, 17 bp, Homo sapiens
ttccaaagtctctaatt

SEQ ID NO: 4875423 - DNA, 14 bp, Homo sapiens
ttccaaagttaaca

SEQ ID NO: 4875424 - DNA, 17 bp, Homo sapiens
ttccaacaccacagaca

SEQ ID NO: 4875425 - DNA, 19 bp, Homo sapiens
ttccaacaccacagacaca

SEQ ID NO: 4875426 - DNA, 14 bp, Homo sapiens
ttccaacagtgagt

SEQ ID NO: 4875427 - DNA, 13 bp, Homo sapiens
ttccaagaaagat

SEQ ID NO: 4875428 - DNA, 15 bp, Homo sapiens
ttccaagactctaga

SEQ ID NO: 4875429 - DNA, 22 bp, Homo sapiens
ttccaagactctagagtccaag

SEQ ID NO: 4875430 - DNA, 13 bp, Homo sapiens
ttccaagagtcta

SEQ ID NO: 4875431 - DNA, 14 bp, Homo sapiens
ttccaagagtctaa

SEQ ID NO: 4875432 - DNA, 17 bp, Homo sapiens
ttccaagagtctaaaga

SEQ ID NO: 4875433 - DNA, 18 bp, Homo sapiens
ttccaaggggcaaatttt

SEQ ID NO: 4875434 - DNA, 13 bp, Homo sapiens
ttccaatatttct

SEQ ID NO: 4875435 - DNA, 21 bp, Homo sapiens
ttccaattttctggaatacat

SEQ ID NO: 4875436 - DNA, 17 bp, Homo sapiens
ttccacagttgccacca

SEQ ID NO: 4875437 - DNA, 16 bp, Homo sapiens
ttccacatgctctgag

SEQ ID NO: 4875438 - DNA, 13 bp, Homo sapiens
ttccactgcctct

SEQ ID NO: 4875439 - DNA, 15 bp, Homo sapiens
ttccactgcctctgc

SEQ ID NO: 4875440 - DNA, 15 bp, Homo sapiens
ttccacttcttcctt

SEQ ID NO: 4875441 - DNA, 18 bp, Homo sapiens
ttccacttcttcctttct

SEQ ID NO: 4875442 - DNA, 19 bp, Homo sapiens
ttccacttcttcctttctc

SEQ ID NO: 4875443 - DNA, 20 bp, Homo sapiens
ttccacttcttcctttctct

SEQ ID NO: 4875444 - DNA, 21 bp, Homo sapiens
ttccacttcttcctttctctt

SEQ ID NO: 4875445 - DNA, 23 bp, Homo sapiens
ttccagaagaagagaagctgctg

SEQ ID NO: 4875446 - DNA, 14 bp, Homo sapiens
ttccagaatgctgt

SEQ ID NO: 4875447 - DNA, 15 bp, Homo sapiens
ttccagaatgctgta

SEQ ID NO: 4875448 - DNA, 23 bp, Homo sapiens
ttccagactgcttccaattttct

SEQ ID NO: 4875449 - DNA, 20 bp, Homo sapiens
ttccagacttccttgagaca

SEQ ID NO: 4875450 - DNA, 17 bp, Homo sapiens
ttccagagagtggctcc

SEQ ID NO: 4875451 - DNA, 18 bp, Homo sapiens
ttccagagagtggctcct

SEQ ID NO: 4875452 - DNA, 19 bp, Homo sapiens
ttccagagagtggctcctc

SEQ ID NO: 4875453 - DNA, 20 bp, Homo sapiens
ttccagagagtggctcctcc

SEQ ID NO: 4875454 - DNA, 16 bp, Homo sapiens
ttccagcagaagacaa

SEQ ID NO: 4875455 - DNA, 14 bp, Homo sapiens
ttccagctcctgta

SEQ ID NO: 4875456 - DNA, 21 bp, Homo sapiens
ttccaggctagtccggaccca

SEQ ID NO: 4875457 - DNA, 15 bp, Homo sapiens
ttccaggggaacctg

SEQ ID NO: 4875458 - DNA, 22 bp, Homo sapiens
ttccataatctggactcctctg

SEQ ID NO: 4875459 - DNA, 21 bp, Homo sapiens
ttccatatcttgcgaatccaa

SEQ ID NO: 4875460 - DNA, 20 bp, Homo sapiens
ttccatcccaaccagtgcca

SEQ ID NO: 4875461 - DNA, 23 bp, Homo sapiens
ttccatcccaaccagtgccaagg

SEQ ID NO: 4875462 - DNA, 15 bp, Homo sapiens
ttccatccctacccc

SEQ ID NO: 4875463 - DNA, 18 bp, Homo sapiens
ttccatcctttacgtgtt

SEQ ID NO: 4875464 - DNA, 13 bp, Homo sapiens
ttccatctttaca

SEQ ID NO: 4875465 - DNA, 17 bp, Homo sapiens
ttccatgattctattta

SEQ ID NO: 4875466 - DNA, 18 bp, Homo sapiens
ttccatgattctatttat

SEQ ID NO: 4875467 - DNA, 16 bp, Homo sapiens
ttccatgctaagcaag

SEQ ID NO: 4875468 - DNA, 17 bp, Homo sapiens
ttccatgtcgcctctgc

SEQ ID NO: 4875469 - DNA, 21 bp, Homo sapiens
ttccatgtcgcctctgcattc

SEQ ID NO: 4875470 - DNA, 13 bp, Homo sapiens
ttcccaagctctg

SEQ ID NO: 4875471 - DNA, 20 bp, Homo sapiens
ttcccaatagcaacgtagct

SEQ ID NO: 4875472 - DNA, 18 bp, Homo sapiens
ttcccaatcagcactgaa

SEQ ID NO: 4875473 - DNA, 20 bp, Homo sapiens
ttcccaatcagcactgaaaa

SEQ ID NO: 4875474 - DNA, 17 bp, Homo sapiens
ttcccaccgccctccct

SEQ ID NO: 4875475 - DNA, 22 bp, Homo sapiens
ttcccaccgccctccctcccca

SEQ ID NO: 4875476 - DNA, 16 bp, Homo sapiens
ttcccacctccctgcc

SEQ ID NO: 4875477 - DNA, 15 bp, Homo sapiens
ttcccactcaccccg

SEQ ID NO: 4875478 - DNA, 20 bp, Homo sapiens
ttcccattgcatcacctctg

SEQ ID NO: 4875479 - DNA, 21 bp, Homo sapiens
ttccccactgacagcctccca

SEQ ID NO: 4875480 - DNA, 20 bp, Homo sapiens
ttccccagcatcactcccca

SEQ ID NO: 4875481 - DNA, 12 bp, Homo sapiens
ttccccagccca

SEQ ID NO: 4875482 - DNA, 13 bp, Homo sapiens
ttccccagcccag

SEQ ID NO: 4875483 - DNA, 14 bp, Homo sapiens
ttccccagcccagg

SEQ ID NO: 4875484 - DNA, 17 bp, Homo sapiens
ttccccatcttctaaac

SEQ ID NO: 4875485 - DNA, 14 bp, Homo sapiens
ttcccccatagcca

SEQ ID NO: 4875486 - DNA, 17 bp, Homo sapiens
ttcccccatagccaccc

SEQ ID NO: 4875487 - DNA, 18 bp, Homo sapiens
ttccccccactctcccca

SEQ ID NO: 4875488 - DNA, 21 bp, Homo sapiens
ttcccccttccaaataataaa

SEQ ID NO: 4875489 - DNA, 15 bp, Homo sapiens
ttcccctatcattta

SEQ ID NO: 4875490 - DNA, 16 bp, Homo sapiens
ttcccctccctggctc

SEQ ID NO: 4875491 - DNA, 12 bp, Homo sapiens
ttcccgctcagc

SEQ ID NO: 4875492 - DNA, 14 bp, Homo sapiens
ttcccgctcagccc

SEQ ID NO: 4875493 - DNA, 15 bp, Homo sapiens
ttcccgctcagccct

SEQ ID NO: 4875494 - DNA, 16 bp, Homo sapiens
ttcccgctcagccctc

SEQ ID NO: 4875495 - DNA, 22 bp, Homo sapiens
ttcccgctcagccctccctgcc

SEQ ID NO: 4875496 - DNA, 22 bp, Homo sapiens
ttccctaaaatacatttaaaac

SEQ ID NO: 4875497 - DNA, 14 bp, Homo sapiens
ttccctcttttctt

SEQ ID NO: 4875498 - DNA, 19 bp, Homo sapiens
ttccctcttttcttactcc

SEQ ID NO: 4875499 - DNA, 19 bp, Homo sapiens
ttccctgattgacctgctc

SEQ ID NO: 4875500 - DNA, 12 bp, Homo sapiens
ttccctgcacta

SEQ ID NO: 4875501 - DNA, 19 bp, Homo sapiens
ttcccttccactgcctctg

SEQ ID NO: 4875502 - DNA, 18 bp, Homo sapiens
ttcccttccctaaagtga

SEQ ID NO: 4875503 - DNA, 13 bp, Homo sapiens
ttcccttcctctt

SEQ ID NO: 4875504 - DNA, 17 bp, Homo sapiens
ttcccttgcttttccct

SEQ ID NO: 4875505 - DNA, 11 bp, Homo sapiens
ttcccttggcc

SEQ ID NO: 4875506 - DNA, 14 bp, Homo sapiens
ttccctttgtcttt

SEQ ID NO: 4875507 - DNA, 22 bp, Homo sapiens
ttccgaagaagatgctccagca

SEQ ID NO: 4875508 - DNA, 18 bp, Homo sapiens
ttccgaccctctgggaac

SEQ ID NO: 4875509 - DNA, 21 bp, Homo sapiens
ttccgcacttcagaattccat

SEQ ID NO: 4875510 - DNA, 18 bp, Homo sapiens
ttcatacctaagtactgt

SEQ ID NO: 4875511 - DNA, 20 bp, Homo sapiens
ttcatacctaagtactgtaa

SEQ ID NO: 4875512 - DNA, 15 bp, Homo sapiens
ttcatacctcagaat

SEQ ID NO: 4875513 - DNA, 19 bp, Homo sapiens
ttcatagagatttgtctaa

SEQ ID NO: 4875514 - DNA, 21 bp, Homo sapiens
ttcatccaggcccaactgtga

SEQ ID NO: 4875515 - DNA, 13 bp, Homo sapiens
ttcatcccagccc

SEQ ID NO: 4875516 - DNA, 16 bp, Homo sapiens
ttcatcccagccccaa

SEQ ID NO: 4875517 - DNA, 18 bp, Homo sapiens
ttcatcctgactctgccc

SEQ ID NO: 4875518 - DNA, 20 bp, Homo sapiens
ttcatcgaatctactaattc

SEQ ID NO: 4875519 - DNA, 21 bp, Homo sapiens
ttcatcttttgaggcttctgt

SEQ ID NO: 4875520 - DNA, 14 bp, Homo sapiens
ttcatgatgcagtc

SEQ ID NO: 4875521 - DNA, 21 bp, Homo sapiens
ttcatgccagctacttcctcc

SEQ ID NO: 4875522 - DNA, 18 bp, Homo sapiens
ttcatgctatctctgtgt

SEQ ID NO: 4875523 - DNA, 20 bp, Homo sapiens
ttcatggaatggacatcctg

SEQ ID NO: 4875524 - DNA, 22 bp, Homo sapiens
ttcatggaatggacatcctgta

SEQ ID NO: 4875525 - DNA, 17 bp, Homo sapiens
ttcatgtacaagatgaa

SEQ ID NO: 4875526 - DNA, 15 bp, Homo sapiens
ttcatgtttggtgca

SEQ ID NO: 4875527 - DNA, 22 bp, Homo sapiens
ttcatgtttggtgcatagaact

SEQ ID NO: 4875528 - DNA, 14 bp, Homo sapiens
ttcattaaatgttt

SEQ ID NO: 4875529 - DNA, 15 bp, Homo sapiens
ttcattaaatgtttg

SEQ ID NO: 4875530 - DNA, 21 bp, Homo sapiens
ttcattacttgattaagattt

SEQ ID NO: 4875531 - DNA, 19 bp, Homo sapiens
ttcattcaatattgacatt

SEQ ID NO: 4875532 - DNA, 23 bp, Homo sapiens
ttcattcatggaccactgtttct

SEQ ID NO: 4875533 - DNA, 14 bp, Homo sapiens
ttcattcattcact

SEQ ID NO: 4875534 - DNA, 15 bp, Homo sapiens
ttcattccattgcct

SEQ ID NO: 4875535 - DNA, 13 bp, Homo sapiens
tatacatatgtag

SEQ ID NO: 4875536 - DNA, 16 bp, Homo sapiens
tatacatcctgggtaa

SEQ ID NO: 4875537 - DNA, 15 bp, Homo sapiens
tatacatgaaaattt

SEQ ID NO: 4875538 - DNA, 12 bp, Homo sapiens
tatacatgtgtg

SEQ ID NO: 4875539 - DNA, 14 bp, Homo sapiens
tatacatgtgtgta

SEQ ID NO: 4875540 - DNA, 17 bp, Homo sapiens
tatacatgtgtgtatat

SEQ ID NO: 4875541 - DNA, 23 bp, Homo sapiens
tatacattagtaaatgtctttgt

SEQ ID NO: 4875542 - DNA, 18 bp, Homo sapiens
tatacctataatgtgtgt

SEQ ID NO: 4875543 - DNA, 21 bp, Homo sapiens
tatacctataatgtgtgtatg

SEQ ID NO: 4875544 - DNA, 17 bp, Homo sapiens
tatacgaacaaaacaca

SEQ ID NO: 4875545 - DNA, 14 bp, Homo sapiens
tatactgtaattta

SEQ ID NO: 4875546 - DNA, 13 bp, Homo sapiens
tatactgttcttc

SEQ ID NO: 4875547 - DNA, 15 bp, Homo sapiens
tatacttgaacaaaa

SEQ ID NO: 4875548 - DNA, 16 bp, Homo sapiens
tatacttgaacaaaag

SEQ ID NO: 4875549 - DNA, 22 bp, Homo sapiens
tatacttgtggttttcaaattg

SEQ ID NO: 4875550 - DNA, 15 bp, Homo sapiens
tatactttagtatga

SEQ ID NO: 4875551 - DNA, 11 bp, Homo sapiens
tatactttttt

SEQ ID NO: 4875552 - DNA, 16 bp, Homo sapiens
tatagaagtttgtcca

SEQ ID NO: 4875553 - DNA, 17 bp, Homo sapiens
tatagattagaaaaatt

SEQ ID NO: 4875554 - DNA, 20 bp, Homo sapiens
tatagcactttgaaatacct

SEQ ID NO: 4875555 - DNA, 19 bp, Homo sapiens
tatagcctatggcagaaaa

SEQ ID NO: 4875556 - DNA, 20 bp, Homo sapiens
tatagcctatggcagaaaaa

SEQ ID NO: 4875557 - DNA, 14 bp, Homo sapiens
tatagctaagtaca

SEQ ID NO: 4875558 - DNA, 17 bp, Homo sapiens
tataggtgatgtttgct

SEQ ID NO: 4875559 - DNA, 14 bp, Homo sapiens
tatagtacatgata

SEQ ID NO: 4875560 - DNA, 13 bp, Homo sapiens
tatagtcatttat

SEQ ID NO: 4875561 - DNA, 15 bp, Homo sapiens
tatagtggaaaaaca

SEQ ID NO: 4875562 - DNA, 18 bp, Homo sapiens
tatagtggaaaaacacat

SEQ ID NO: 4875563 - DNA, 13 bp, Homo sapiens
tatagtgtaaaat

SEQ ID NO: 4875564 - DNA, 12 bp, Homo sapiens
tatagttctagg

SEQ ID NO: 4875565 - DNA, 14 bp, Homo sapiens
tatagtttaaaaca

SEQ ID NO: 4875566 - DNA, 23 bp, Homo sapiens
tatagttttgaatcctttgcctg

SEQ ID NO: 4875567 - DNA, 15 bp, Homo sapiens
tatataaagaatata

SEQ ID NO: 4875568 - DNA, 18 bp, Homo sapiens
tatataaatgtaaaaata

SEQ ID NO: 4875569 - DNA, 22 bp, Homo sapiens
tatataaatgtaaaaataataa

SEQ ID NO: 4875570 - DNA, 23 bp, Homo sapiens
tatatacagaggaaatctgtaac

SEQ ID NO: 4875571 - DNA, 23 bp, Homo sapiens
tatatacatacacttgtataaat

SEQ ID NO: 4875572 - DNA, 13 bp, Homo sapiens
tatatacatatgt

SEQ ID NO: 4875573 - DNA, 15 bp, Homo sapiens
tatatacatatgtag

SEQ ID NO: 4875574 - DNA, 15 bp, Homo sapiens
tatatacatgtgtgt

SEQ ID NO: 4875575 - DNA, 16 bp, Homo sapiens
tatatacatgtgtgta

SEQ ID NO: 4875576 - DNA, 14 bp, Homo sapiens
tatatagagatgtt

SEQ ID NO: 4875577 - DNA, 18 bp, Homo sapiens
tatatagcagcaaaaata

SEQ ID NO: 4875578 - DNA, 12 bp, Homo sapiens
tatatataaaga

SEQ ID NO: 4875579 - DNA, 14 bp, Homo sapiens
tatatataaagaat

SEQ ID NO: 4875580 - DNA, 14 bp, Homo sapiens
tatatatacataca

SEQ ID NO: 4875581 - DNA, 13 bp, Homo sapiens
tatatatacatat

SEQ ID NO: 4875582 - DNA, 16 bp, Homo sapiens
tatatatacatatgta

SEQ ID NO: 4875583 - DNA, 13 bp, Homo sapiens
tatatatatataa

SEQ ID NO: 4875584 - DNA, 13 bp, Homo sapiens
tatatatatcagt

SEQ ID NO: 4875585 - DNA, 15 bp, Homo sapiens
tatatatcagtttga

SEQ ID NO: 4875586 - DNA, 21 bp, Homo sapiens
tatatatctgcttcagtggag

SEQ ID NO: 4875587 - DNA, 21 bp, Homo sapiens
tatatatgcctttttcctagc

SEQ ID NO: 4875588 - DNA, 13 bp, Homo sapiens
tatatatggacat

SEQ ID NO: 4875589 - DNA, 21 bp, Homo sapiens
tatatatgtgtatatatacat

SEQ ID NO: 4875590 - DNA, 14 bp, Homo sapiens
tatatcagtttgat

SEQ ID NO: 4875591 - DNA, 20 bp, Homo sapiens
tatatcatgctttaaagtgt

SEQ ID NO: 4875592 - DNA, 19 bp, Homo sapiens
tatatcatgtaaagaaatg

SEQ ID NO: 4875593 - DNA, 14 bp, Homo sapiens
tatatcccagaaat

SEQ ID NO: 4875594 - DNA, 20 bp, Homo sapiens
tatatcctttctaacaaaaa

SEQ ID NO: 4875595 - DNA, 17 bp, Homo sapiens
tatatctgaaaactgga

SEQ ID NO: 4875596 - DNA, 20 bp, Homo sapiens
tatatctgggctggccagtt

SEQ ID NO: 4875597 - DNA, 16 bp, Homo sapiens
tatatgatttatagtt

SEQ ID NO: 4875598 - DNA, 16 bp, Homo sapiens
tatatggatgattcag

SEQ ID NO: 4875599 - DNA, 19 bp, Homo sapiens
tatatgtaccgtaggcttt

SEQ ID NO: 4875600 - DNA, 17 bp, Homo sapiens
tatatgtgtatatatac

SEQ ID NO: 4875601 - DNA, 19 bp, Homo sapiens
tatatgtgtatatatacat

SEQ ID NO: 4875602 - DNA, 15 bp, Homo sapiens
tatattaatgtactt

SEQ ID NO: 4875603 - DNA, 18 bp, Homo sapiens
tatattaccagcaagaat

SEQ ID NO: 4875604 - DNA, 21 bp, Homo sapiens
tatattataaatatatataaa

SEQ ID NO: 4875605 - DNA, 14 bp, Homo sapiens
tatattatttggca

SEQ ID NO: 4875606 - DNA, 13 bp, Homo sapiens
tatattcaaccat

SEQ ID NO: 4875607 - DNA, 14 bp, Homo sapiens
tatattcaaccatg

SEQ ID NO: 4875608 - DNA, 18 bp, Homo sapiens
tatattcccaatagcaac

SEQ ID NO: 4875609 - DNA, 18 bp, Homo sapiens
tatattgaaatttattta

SEQ ID NO: 4875610 - DNA, 18 bp, Homo sapiens
tatattgaagacaatttg

SEQ ID NO: 4875611 - DNA, 15 bp, Homo sapiens
tatatttaatgataa

SEQ ID NO: 4875612 - DNA, 16 bp, Homo sapiens
tatatttaatgcatta

SEQ ID NO: 4875613 - DNA, 22 bp, Homo sapiens
tatatttaatgcattaaacctg

SEQ ID NO: 4875614 - DNA, 18 bp, Homo sapiens
tatatttagttatagttt

SEQ ID NO: 4875615 - DNA, 20 bp, Homo sapiens
tatatttccctaaaatacat

SEQ ID NO: 4875616 - DNA, 20 bp, Homo sapiens
tatattttcgtatgaaaatg

SEQ ID NO: 4875617 - DNA, 18 bp, Homo sapiens
tatatttttaaaaaatga

SEQ ID NO: 4875618 - DNA, 21 bp, Homo sapiens
tatatttttaaaaaatgaaat

SEQ ID NO: 4875619 - DNA, 17 bp, Homo sapiens
tatcaagtcaatcattt

SEQ ID NO: 4875620 - DNA, 22 bp, Homo sapiens
tatcaatatctaatatatatga

SEQ ID NO: 4875621 - DNA, 15 bp, Homo sapiens
tatcactttttgaac

SEQ ID NO: 4875622 - DNA, 16 bp, Homo sapiens
tatcactttttgaact

SEQ ID NO: 4875623 - DNA, 13 bp, Homo sapiens
tatcagatacatc

SEQ ID NO: 4875624 - DNA, 22 bp, Homo sapiens
tactattgttgctgaaacttgc

SEQ ID NO: 4875625 - DNA, 11 bp, Homo sapiens
tactatttaaa

SEQ ID NO: 4875626 - DNA, 22 bp, Homo sapiens
tactatttaaagcctcctcatc

SEQ ID NO: 4875627 - DNA, 23 bp, Homo sapiens
tactcaatggagtatgtctgatg

SEQ ID NO: 4875628 - DNA, 13 bp, Homo sapiens
tactcagcctgct

SEQ ID NO: 4875629 - DNA, 13 bp, Homo sapiens
tactcattgaaat

SEQ ID NO: 4875630 - DNA, 15 bp, Homo sapiens
tactcattgaaatgt

SEQ ID NO: 4875631 - DNA, 13 bp, Homo sapiens
tactccctgcaga

SEQ ID NO: 4875632 - DNA, 14 bp, Homo sapiens
tactcctatttttg

SEQ ID NO: 4875633 - DNA, 21 bp, Homo sapiens
tactcctatttttgtaaactg

SEQ ID NO: 4875634 - DNA, 11 bp, Homo sapiens
tactcctcctc

SEQ ID NO: 4875635 - DNA, 16 bp, Homo sapiens
tactcctcctctttct

SEQ ID NO: 4875636 - DNA, 20 bp, Homo sapiens
tactctaagatcttagattc

SEQ ID NO: 4875637 - DNA, 20 bp, Homo sapiens
tactctgaaacacactgaaa

SEQ ID NO: 4875638 - DNA, 17 bp, Homo sapiens
tactctggggtgctgcc

SEQ ID NO: 4875639 - DNA, 12 bp, Homo sapiens
tactctgtgtca

SEQ ID NO: 4875640 - DNA, 15 bp, Homo sapiens
tactctttctgtata

SEQ ID NO: 4875641 - DNA, 14 bp, Homo sapiens
tactgaaacagatt

SEQ ID NO: 4875642 - DNA, 17 bp, Homo sapiens
tactgatttttgtgatt

SEQ ID NO: 4875643 - DNA, 22 bp, Homo sapiens
tactgcagcctttgcctccccg

SEQ ID NO: 4875644 - DNA, 12 bp, Homo sapiens
tactgcagggcc

SEQ ID NO: 4875645 - DNA, 19 bp, Homo sapiens
tactgcagggccaggactg

SEQ ID NO: 4875646 - DNA, 11 bp, Homo sapiens
tactgccaaag

SEQ ID NO: 4875647 - DNA, 19 bp, Homo sapiens
tactgcccaggcctgcctg

SEQ ID NO: 4875648 - DNA, 14 bp, Homo sapiens
tactgggtgtcatt

SEQ ID NO: 4875649 - DNA, 23 bp, Homo sapiens
tactgggtgtcatttcattccat

SEQ ID NO: 4875650 - DNA, 19 bp, Homo sapiens
tactgtaacctgttgctgt

SEQ ID NO: 4875651 - DNA, 15 bp, Homo sapiens
tactgtaattcctca

SEQ ID NO: 4875652 - DNA, 19 bp, Homo sapiens
tactgtacataaacaatga

SEQ ID NO: 4875653 - DNA, 21 bp, Homo sapiens
tactgtacataaacaatgatg

SEQ ID NO: 4875654 - DNA, 20 bp, Homo sapiens
tactgtatagacagtttgta

SEQ ID NO: 4875655 - DNA, 22 bp, Homo sapiens
tactgtatagacagtttgtaaa

SEQ ID NO: 4875656 - DNA, 21 bp, Homo sapiens
tactgtctggttttaacaatt

SEQ ID NO: 4875657 - DNA, 22 bp, Homo sapiens
tactgtctggttttaacaattt

SEQ ID NO: 4875658 - DNA, 22 bp, Homo sapiens
tactgtggaggaaggattgtaa

SEQ ID NO: 4875659 - DNA, 15 bp, Homo sapiens
tactgtgtactgtat

SEQ ID NO: 4875660 - DNA, 18 bp, Homo sapiens
tactgtgtactgtataga

SEQ ID NO: 4875661 - DNA, 16 bp, Homo sapiens
tactgtgtcataaaca

SEQ ID NO: 4875662 - DNA, 21 bp, Homo sapiens
tactgtgtgcttgttttataa

SEQ ID NO: 4875663 - DNA, 13 bp, Homo sapiens
tactgtgtggaac

SEQ ID NO: 4875664 - DNA, 19 bp, Homo sapiens
tactgtgtgtgtgaatgaa

SEQ ID NO: 4875665 - DNA, 21 bp, Homo sapiens
tactgtgtgtgtgaatgaaca

SEQ ID NO: 4875666 - DNA, 23 bp, Homo sapiens
tactgtgtgtgtgaatgaacact

SEQ ID NO: 4875667 - DNA, 18 bp, Homo sapiens
tactgtgttttataaaat

SEQ ID NO: 4875668 - DNA, 19 bp, Homo sapiens
tactgttaaccatttaagt

SEQ ID NO: 4875669 - DNA, 14 bp, Homo sapiens
tactgttctgtgtc

SEQ ID NO: 4875670 - DNA, 14 bp, Homo sapiens
tactgttcttgctg

SEQ ID NO: 4875671 - DNA, 22 bp, Homo sapiens
taatttgaggacaaccattcca

SEQ ID NO: 4875672 - DNA, 12 bp, Homo sapiens
taatttgatctt

SEQ ID NO: 4875673 - DNA, 15 bp, Homo sapiens
taatttgattaacaa

SEQ ID NO: 4875674 - DNA, 16 bp, Homo sapiens
taatttgcattaaatt

SEQ ID NO: 4875675 - DNA, 14 bp, Homo sapiens
taattttaaacaaa

SEQ ID NO: 4875676 - DNA, 13 bp, Homo sapiens
taattttaagaaa

SEQ ID NO: 4875677 - DNA, 23 bp, Homo sapiens
taattttagtattcattctgcat

SEQ ID NO: 4875678 - DNA, 14 bp, Homo sapiens
taatttttacccta

SEQ ID NO: 4875679 - DNA, 18 bp, Homo sapiens
taatttttaccctaatgt

SEQ ID NO: 4875680 - DNA, 22 bp, Homo sapiens
taatttttcagctctctgtata

SEQ ID NO: 4875681 - DNA, 14 bp, Homo sapiens
taatttttgtaatt

SEQ ID NO: 4875682 - DNA, 18 bp, Homo sapiens
taatttttttttcataga

SEQ ID NO: 4875683 - DNA, 13 bp, Homo sapiens
tacaaaataaaaa

SEQ ID NO: 4875684 - DNA, 15 bp, Homo sapiens
tacaaaataaaaaca

SEQ ID NO: 4875685 - DNA, 20 bp, Homo sapiens
tacaaaataaacaaataaca

SEQ ID NO: 4875686 - DNA, 14 bp, Homo sapiens
tacaaacaatctct

SEQ ID NO: 4875687 - DNA, 13 bp, Homo sapiens
tacaaacctacca

SEQ ID NO: 4875688 - DNA, 15 bp, Homo sapiens
tacaaatatattgtt

SEQ ID NO: 4875689 - DNA, 13 bp, Homo sapiens
tacaaatgcctta

SEQ ID NO: 4875690 - DNA, 20 bp, Homo sapiens
tacaaatgccttaaaatgga

SEQ ID NO: 4875691 - DNA, 15 bp, Homo sapiens
tacaaattataaaaa

SEQ ID NO: 4875692 - DNA, 21 bp, Homo sapiens
tacaaattataaaaagccact

SEQ ID NO: 4875693 - DNA, 23 bp, Homo sapiens
tacaacaaaggcaagttaagaga

SEQ ID NO: 4875694 - DNA, 21 bp, Homo sapiens
tacaacctccctcttgttttg

SEQ ID NO: 4875695 - DNA, 22 bp, Homo sapiens
tacaacctccctcttgttttgt

SEQ ID NO: 4875696 - DNA, 16 bp, Homo sapiens
tacaagagcagcctgt

SEQ ID NO: 4875697 - DNA, 23 bp, Homo sapiens
tacaagagcagcctgtggcatct

SEQ ID NO: 4875698 - DNA, 20 bp, Homo sapiens
tacaagattgaaaatcttgt

SEQ ID NO: 4875699 - DNA, 22 bp, Homo sapiens
tacaagccaaagtggcatgttt

SEQ ID NO: 4875700 - DNA, 16 bp, Homo sapiens
tacaagcgtgagccac

SEQ ID NO: 4875701 - DNA, 13 bp, Homo sapiens
tacaagtgtatat

SEQ ID NO: 4875702 - DNA, 20 bp, Homo sapiens
tacaataaaatcttgaaaat

SEQ ID NO: 4875703 - DNA, 18 bp, Homo sapiens
tacaatatataaaaatat

SEQ ID NO: 4875704 - DNA, 14 bp, Homo sapiens
tacaatggaaacaa

SEQ ID NO: 4875705 - DNA, 21 bp, Homo sapiens
tacaatgtgtttttctccagt

SEQ ID NO: 4875706 - DNA, 22 bp, Homo sapiens
tacaattaaaaaaaaagatctg

SEQ ID NO: 4875707 - DNA, 13 bp, Homo sapiens
tacaattgtgggc

SEQ ID NO: 4875708 - DNA, 13 bp, Homo sapiens
tacacagaaacac

SEQ ID NO: 4875709 - DNA, 16 bp, Homo sapiens
tacacatacagtttta

SEQ ID NO: 4875710 - DNA, 18 bp, Homo sapiens
tacacatatacctataat

SEQ ID NO: 4875711 - DNA, 18 bp, Homo sapiens
tacacattaagtaatcaa

SEQ ID NO: 4875712 - DNA, 13 bp, Homo sapiens
tacacattagatt

SEQ ID NO: 4875713 - DNA, 23 bp, Homo sapiens
tacacattagattttattttact

SEQ ID NO: 4875714 - DNA, 18 bp, Homo sapiens
tacacatttgtacagaat

SEQ ID NO: 4875715 - DNA, 17 bp, Homo sapiens
tacacatttttaaattg

SEQ ID NO: 4875716 - DNA, 14 bp, Homo sapiens
tacacccagacccc

SEQ ID NO: 4875717 - DNA, 19 bp, Homo sapiens
tacacccagaccccaggct

SEQ ID NO: 4875718 - DNA, 20 bp, Homo sapiens
tacacccagaccccaggctg

SEQ ID NO: 4875719 - DNA, 13 bp, Homo sapiens
tacactgcctgta

SEQ ID NO: 4875720 - DNA, 17 bp, Homo sapiens
tacactgcctgtatact

SEQ ID NO: 4875721 - DNA, 20 bp, Homo sapiens
tacactgcctgtatacttta

SEQ ID NO: 4875722 - DNA, 23 bp, Homo sapiens
tacactgcctgtatactttagta

SEQ ID NO: 4875723 - DNA, 16 bp, Homo sapiens
tacactgtatttgtat

SEQ ID NO: 4875724 - DNA, 18 bp, Homo sapiens
tacacttgtataaatgta

SEQ ID NO: 4875725 - DNA, 22 bp, Homo sapiens
tacacttgtataaatgtatata

SEQ ID NO: 4875726 - DNA, 15 bp, Homo sapiens
tacagaaaaagactt

SEQ ID NO: 4875727 - DNA, 14 bp, Homo sapiens
tacagaaaaatctt

SEQ ID NO: 4875728 - DNA, 18 bp, Homo sapiens
ggaagttgacttatagta

SEQ ID NO: 4875729 - DNA, 14 bp, Homo sapiens
ggaagttttctgta

SEQ ID NO: 4875730 - DNA, 15 bp, Homo sapiens
ggaataaaaggcttg

SEQ ID NO: 4875731 - DNA, 18 bp, Homo sapiens
ggaataaaaggcttgaag

SEQ ID NO: 4875732 - DNA, 22 bp, Homo sapiens
ggaataaaaggcttgaagctgt

SEQ ID NO: 4875733 - DNA, 14 bp, Homo sapiens
ggaataaccttcca

SEQ ID NO: 4875734 - DNA, 17 bp, Homo sapiens
ggaataagaagcaaata

SEQ ID NO: 4875735 - DNA, 14 bp, Homo sapiens
ggaataattgcttt

SEQ ID NO: 4875736 - DNA, 15 bp, Homo sapiens
ggaatatttataaat

SEQ ID NO: 4875737 - DNA, 14 bp, Homo sapiens
ggaatcaaaaattg

SEQ ID NO: 4875738 - DNA, 15 bp, Homo sapiens
ggaatcatgtcaggc

SEQ ID NO: 4875739 - DNA, 18 bp, Homo sapiens
ggaatcatgtcaggcctg

SEQ ID NO: 4875740 - DNA, 23 bp, Homo sapiens
ggaatcctatatagaatgctgca

SEQ ID NO: 4875741 - DNA, 12 bp, Homo sapiens
ggaatcctggca

SEQ ID NO: 4875742 - DNA, 15 bp, Homo sapiens
ggaatgagtgtgcat

SEQ ID NO: 4875743 - DNA, 15 bp, Homo sapiens
ggaatgtgtggcctg

SEQ ID NO: 4875744 - DNA, 19 bp, Homo sapiens
ggaattacatgtaaaacat

SEQ ID NO: 4875745 - DNA, 21 bp, Homo sapiens
ggacaaaacttcttgtcagac

SEQ ID NO: 4875746 - DNA, 15 bp, Homo sapiens
ggacaaagtatttga

SEQ ID NO: 4875747 - DNA, 20 bp, Homo sapiens
ggacaagcagaggtggccag

SEQ ID NO: 4875748 - DNA, 12 bp, Homo sapiens
ggacaataaacc

SEQ ID NO: 4875749 - DNA, 19 bp, Homo sapiens
ggacaatcatgaaatatgc

SEQ ID NO: 4875750 - DNA, 15 bp, Homo sapiens
ggacaattgttttaa

SEQ ID NO: 4875751 - DNA, 14 bp, Homo sapiens
ggacacagctcttc

SEQ ID NO: 4875752 - DNA, 16 bp, Homo sapiens
ggacacctgccctgcc

SEQ ID NO: 4875753 - DNA, 14 bp, Homo sapiens
ggacactccagtgc

SEQ ID NO: 4875754 - DNA, 15 bp, Homo sapiens
ggacactccagtgcc

SEQ ID NO: 4875755 - DNA, 16 bp, Homo sapiens
ggacactccagtgcca

SEQ ID NO: 4875756 - DNA, 18 bp, Homo sapiens
ggacactccagtgccagc

SEQ ID NO: 4875757 - DNA, 21 bp, Homo sapiens
ggacactccagtgccagcaat

SEQ ID NO: 4875758 - DNA, 14 bp, Homo sapiens
ggacagaggcctgc

SEQ ID NO: 4875759 - DNA, 16 bp, Homo sapiens
ggacagaggcctgccc

SEQ ID NO: 4875760 - DNA, 16 bp, Homo sapiens
ggacagaggggactct

SEQ ID NO: 4875761 - DNA, 18 bp, Homo sapiens
ggacagaggggactctgg

SEQ ID NO: 4875762 - DNA, 21 bp, Homo sapiens
ggacagccacggccaggccag

SEQ ID NO: 4875763 - DNA, 11 bp, Homo sapiens
ggacagctcct

SEQ ID NO: 4875764 - DNA, 19 bp, Homo sapiens
ggacagctccttctgtcct

SEQ ID NO: 4875765 - DNA, 23 bp, Homo sapiens
ggacaggcatgttctctgaggac

SEQ ID NO: 4875766 - DNA, 11 bp, Homo sapiens
ggacaggcctc

SEQ ID NO: 4875767 - DNA, 13 bp, Homo sapiens
ggacaggctctgc

SEQ ID NO: 4875768 - DNA, 14 bp, Homo sapiens
ggacaggctctgct

SEQ ID NO: 4875769 - DNA, 22 bp, Homo sapiens
ggacagggcatggccaggtggc

SEQ ID NO: 4875770 - DNA, 18 bp, Homo sapiens
ggacagttcacaccctgc

SEQ ID NO: 4875771 - DNA, 20 bp, Homo sapiens
ggacagtttatcatgaagcc

SEQ ID NO: 4875772 - DNA, 18 bp, Homo sapiens
ggacatcctgtataagca

SEQ ID NO: 4875773 - DNA, 13 bp, Homo sapiens
ggaccactcagcc

SEQ ID NO: 4875774 - DNA, 21 bp, Homo sapiens
ggaccactcagcccctaggag

SEQ ID NO: 4875775 - DNA, 18 bp, Homo sapiens
ggaccactgtttcttgct

SEQ ID NO: 4875776 - DNA, 17 bp, Homo sapiens
ggaccaggactccctcc

SEQ ID NO: 4875777 - DNA, 21 bp, Homo sapiens
ggaccatgtgtcacttgtgct

SEQ ID NO: 4875778 - DNA, 18 bp, Homo sapiens
ggacccagcgggcaggtt

SEQ ID NO: 4875779 - DNA, 12 bp, Homo sapiens
ggacccaggctc

SEQ ID NO: 4875780 - DNA, 12 bp, Homo sapiens
ggaccccagaga

SEQ ID NO: 4875781 - DNA, 23 bp, Homo sapiens
ggacccttgagagtatcaggtct

SEQ ID NO: 4875782 - DNA, 16 bp, Homo sapiens
ggacctcctcttcccc

SEQ ID NO: 4875783 - DNA, 23 bp, Homo sapiens
ggacctcctcttcccccttccaa

SEQ ID NO: 4875784 - DNA, 16 bp, Homo sapiens
gctgttgtacatttat

SEQ ID NO: 4875785 - DNA, 22 bp, Homo sapiens
gcttaaatatagttcctaagaa

SEQ ID NO: 4875786 - DNA, 23 bp, Homo sapiens
gcttaaatatagttcctaagaag

SEQ ID NO: 4875787 - DNA, 12 bp, Homo sapiens
gcttaatttcta

SEQ ID NO: 4875788 - DNA, 18 bp, Homo sapiens
gcttaatttctaaagata

SEQ ID NO: 4875789 - DNA, 15 bp, Homo sapiens
gcttacatagtttta

SEQ ID NO: 4875790 - DNA, 16 bp, Homo sapiens
gcttacctgacacaag

SEQ ID NO: 4875791 - DNA, 15 bp, Homo sapiens
gcttagacataacaa

SEQ ID NO: 4875792 - DNA, 16 bp, Homo sapiens
gcttagagaatgttct

SEQ ID NO: 4875793 - DNA, 16 bp, Homo sapiens
gcttagtaaaatttat

SEQ ID NO: 4875794 - DNA, 22 bp, Homo sapiens
gcttagtatctcatcaacaaag

SEQ ID NO: 4875795 - DNA, 13 bp, Homo sapiens
gcttatattcaac

SEQ ID NO: 4875796 - DNA, 22 bp, Homo sapiens
gcttatattcaaccatggactt

SEQ ID NO: 4875797 - DNA, 14 bp, Homo sapiens
gcttattattgaag

SEQ ID NO: 4875798 - DNA, 20 bp, Homo sapiens
gcttattcatctgtttttct

SEQ ID NO: 4875799 - DNA, 14 bp, Homo sapiens
gcttatttaataaa

SEQ ID NO: 4875800 - DNA, 12 bp, Homo sapiens
gcttattttaat

SEQ ID NO: 4875801 - DNA, 18 bp, Homo sapiens
gcttcacagtagagccag

SEQ ID NO: 4875802 - DNA, 19 bp, Homo sapiens
gcttcacagtagagccagc

SEQ ID NO: 4875803 - DNA, 20 bp, Homo sapiens
gcttcacagtagagccagct

SEQ ID NO: 4875804 - DNA, 15 bp, Homo sapiens
gcttcactgtataaa

SEQ ID NO: 4875805 - DNA, 20 bp, Homo sapiens
gcttcaggttatcgaaataa

SEQ ID NO: 4875806 - DNA, 14 bp, Homo sapiens
gcttcagtggagaa

SEQ ID NO: 4875807 - DNA, 17 bp, Homo sapiens
gcttcagtggcagctgc

SEQ ID NO: 4875808 - DNA, 20 bp, Homo sapiens
gcttcagtggcagctgcttt

SEQ ID NO: 4875809 - DNA, 18 bp, Homo sapiens
gcttcataaatgaagcag

SEQ ID NO: 4875810 - DNA, 18 bp, Homo sapiens
gcttcatctgtcaagtgg

SEQ ID NO: 4875811 - DNA, 17 bp, Homo sapiens
gcttcattcaatattga

SEQ ID NO: 4875812 - DNA, 10 bp, Homo sapiens
gcttcattgt

SEQ ID NO: 4875813 - DNA, 11 bp, Homo sapiens
gcttcattgta

SEQ ID NO: 4875814 - DNA, 13 bp, Homo sapiens
gcttcatttcctg

SEQ ID NO: 4875815 - DNA, 22 bp, Homo sapiens
gcttccaaggggcaaattttta

SEQ ID NO: 4875816 - DNA, 15 bp, Homo sapiens
gcttccatgattcta

SEQ ID NO: 4875817 - DNA, 13 bp, Homo sapiens
gcttcccacctcc

SEQ ID NO: 4875818 - DNA, 15 bp, Homo sapiens
gcttcccacctccct

SEQ ID NO: 4875819 - DNA, 22 bp, Homo sapiens
gcttcccacctccctgcccagg

SEQ ID NO: 4875820 - DNA, 18 bp, Homo sapiens
gcttcccccatagccacc

SEQ ID NO: 4875821 - DNA, 16 bp, Homo sapiens
gcttccctcctgcccg

SEQ ID NO: 4875822 - DNA, 21 bp, Homo sapiens
gcttccggtagggaggcagcc

SEQ ID NO: 4875823 - DNA, 22 bp, Homo sapiens
gcttcctcatagtatggtggct

SEQ ID NO: 4875824 - DNA, 22 bp, Homo sapiens
gcttccttctgtgaaagtacat

SEQ ID NO: 4875825 - DNA, 16 bp, Homo sapiens
gcttcctttcccaagc

SEQ ID NO: 4875826 - DNA, 14 bp, Homo sapiens
gcttcgacttttct

SEQ ID NO: 4875827 - DNA, 12 bp, Homo sapiens
gcttctaataaa

SEQ ID NO: 4875828 - DNA, 17 bp, Homo sapiens
gcttctaccatgaacag

SEQ ID NO: 4875829 - DNA, 19 bp, Homo sapiens
gcttctaccatgaacagaa

SEQ ID NO: 4875830 - DNA, 17 bp, Homo sapiens
gctacattataaacgct

SEQ ID NO: 4875831 - DNA, 20 bp, Homo sapiens
gctaccaaagcaccttagct

SEQ ID NO: 4875832 - DNA, 14 bp, Homo sapiens
gctacccttttcct

SEQ ID NO: 4875833 - DNA, 22 bp, Homo sapiens
gctactaagttcacattagaat

SEQ ID NO: 4875834 - DNA, 19 bp, Homo sapiens
gctactgtcctacccaccc

SEQ ID NO: 4875835 - DNA, 16 bp, Homo sapiens
gctactgtctcactga

SEQ ID NO: 4875836 - DNA, 15 bp, Homo sapiens
gctactgtgtgtgtg

SEQ ID NO: 4875837 - DNA, 18 bp, Homo sapiens
gctactgtgtgtgtgaat

SEQ ID NO: 4875838 - DNA, 19 bp, Homo sapiens
gctactgtgtgtgtgaatg

SEQ ID NO: 4875839 - DNA, 16 bp, Homo sapiens
gctacttaagagaaat

SEQ ID NO: 4875840 - DNA, 18 bp, Homo sapiens
gctacttcctcctcccca

SEQ ID NO: 4875841 - DNA, 19 bp, Homo sapiens
gctacttcctcctccccac

SEQ ID NO: 4875842 - DNA, 22 bp, Homo sapiens
gctactttggtttctgtctgta

SEQ ID NO: 4875843 - DNA, 13 bp, Homo sapiens
gctagaacttttt

SEQ ID NO: 4875844 - DNA, 23 bp, Homo sapiens
gctagaacttttttaaataaact

SEQ ID NO: 4875845 - DNA, 13 bp, Homo sapiens
gctagaatacttt

SEQ ID NO: 4875846 - DNA, 15 bp, Homo sapiens
gctagaatacttttt

SEQ ID NO: 4875847 - DNA, 20 bp, Homo sapiens
gctagaggccagccccaccc

SEQ ID NO: 4875848 - DNA, 18 bp, Homo sapiens
gctagagtcctcactccc

SEQ ID NO: 4875849 - DNA, 13 bp, Homo sapiens
gctagataaaagc

SEQ ID NO: 4875850 - DNA, 12 bp, Homo sapiens
gctaggaatgaa

SEQ ID NO: 4875851 - DNA, 18 bp, Homo sapiens
gctaggaatgaaatcctg

SEQ ID NO: 4875852 - DNA, 17 bp, Homo sapiens
gctaggcctggccagat

SEQ ID NO: 4875853 - DNA, 23 bp, Homo sapiens
gctaggcctggccagatgcacca

SEQ ID NO: 4875854 - DNA, 14 bp, Homo sapiens
gctagggtggccct

SEQ ID NO: 4875855 - DNA, 20 bp, Homo sapiens
gctaggtagaaaaagggtca

SEQ ID NO: 4875856 - DNA, 22 bp, Homo sapiens
gctagtccggacccacctcacc

SEQ ID NO: 4875857 - DNA, 15 bp, Homo sapiens
gctagtgagctgggc

SEQ ID NO: 4875858 - DNA, 14 bp, Homo sapiens
gctagttgggcttc

SEQ ID NO: 4875859 - DNA, 16 bp, Homo sapiens
gctatagctacaggaa

SEQ ID NO: 4875860 - DNA, 14 bp, Homo sapiens
gctatctaaagttt

SEQ ID NO: 4875861 - DNA, 16 bp, Homo sapiens
gctatggacacagggt

SEQ ID NO: 4875862 - DNA, 15 bp, Homo sapiens
gctattaaaactcag

SEQ ID NO: 4875863 - DNA, 16 bp, Homo sapiens
gctattaaaactcagc

SEQ ID NO: 4875864 - DNA, 17 bp, Homo sapiens
gctattattttcactgt

SEQ ID NO: 4875865 - DNA, 18 bp, Homo sapiens
gctattattttcactgta

SEQ ID NO: 4875866 - DNA, 17 bp, Homo sapiens
gctattcctttcccttc

SEQ ID NO: 4875867 - DNA, 16 bp, Homo sapiens
gctattggaggatcag

SEQ ID NO: 4875868 - DNA, 19 bp, Homo sapiens
gctattggaggatcagttt

SEQ ID NO: 4875869 - DNA, 16 bp, Homo sapiens
gctatttattttccta

SEQ ID NO: 4875870 - DNA, 22 bp, Homo sapiens
gctatttattttcctaaagaga

SEQ ID NO: 4875871 - DNA, 14 bp, Homo sapiens
gctcaaataaaaat

SEQ ID NO: 4875872 - DNA, 19 bp, Homo sapiens
gctcaagcaggaagttcaa

SEQ ID NO: 4875873 - DNA, 14 bp, Homo sapiens
gctcacaaaccatg

SEQ ID NO: 4875874 - DNA, 15 bp, Homo sapiens
gctcacagtacagca

SEQ ID NO: 4875875 - DNA, 13 bp, Homo sapiens
gctcaccagcccc

SEQ ID NO: 4875876 - DNA, 13 bp, Homo sapiens
gctcacctagagc

SEQ ID NO: 4875877 - DNA, 14 bp, Homo sapiens
gctcacctagagcc

SEQ ID NO: 4875878 - DNA, 17 bp, Homo sapiens
gctcacctagagccaga

SEQ ID NO: 4875879 - DNA, 15 bp, Homo sapiens
gctcactgcagcctc

SEQ ID NO: 4875880 - DNA, 17 bp, Homo sapiens
gctcactgcagcctcaa

SEQ ID NO: 4875881 - DNA, 16 bp, Homo sapiens
gctcagaacccagggc

SEQ ID NO: 4875882 - DNA, 22 bp, Homo sapiens
gctcagaacccagggctctgcc

SEQ ID NO: 4875883 - DNA, 15 bp, Homo sapiens
gctcagaataaggca

SEQ ID NO: 4875884 - DNA, 19 bp, Homo sapiens
gctcagccccgagctgtcc

SEQ ID NO: 4875885 - DNA, 12 bp, Homo sapiens
gctcagccctcc

SEQ ID NO: 4875886 - DNA, 16 bp, Homo sapiens
gctcagccctccctgc

SEQ ID NO: 4875887 - DNA, 16 bp, Homo sapiens
gctcagcggggacagc

SEQ ID NO: 4875888 - DNA, 18 bp, Homo sapiens
gctcagcggggacagctc

SEQ ID NO: 4875889 - DNA, 20 bp, Homo sapiens
gctcagcggggacagctcct

SEQ ID NO: 4875890 - DNA, 20 bp, Homo sapiens
gctcagctactgatttttgt

SEQ ID NO: 4875891 - DNA, 15 bp, Homo sapiens
gctcaggaggcgccc

SEQ ID NO: 4875892 - DNA, 24 bp, Homo sapiens
gctcaggcgatccacctgtctcag

SEQ ID NO: 4875893 - DNA, 14 bp, Homo sapiens
gctcaggctgcagc

SEQ ID NO: 4875894 - DNA, 21 bp, Homo sapiens
gctcaggctgcagctggacag

SEQ ID NO: 4875895 - DNA, 16 bp, Homo sapiens
gctcaggtgtccctgc

SEQ ID NO: 4875896 - DNA, 18 bp, Homo sapiens
gctcaggtgtccctgcac

SEQ ID NO: 4875897 - DNA, 19 bp, Homo sapiens
gctcatatggggctgggag

SEQ ID NO: 4875898 - DNA, 12 bp, Homo sapiens
gctcatttcatg

SEQ ID NO: 4875899 - DNA, 14 bp, Homo sapiens
gctccaagacctag

SEQ ID NO: 4875900 - DNA, 14 bp, Homo sapiens
gctccaagattcta

SEQ ID NO: 4875901 - DNA, 18 bp, Homo sapiens
gctccaagattctagatg

SEQ ID NO: 4875902 - DNA, 13 bp, Homo sapiens
gctccacccttgg

SEQ ID NO: 4875903 - DNA, 17 bp, Homo sapiens
gctccacccttggcctg

SEQ ID NO: 4875904 - DNA, 22 bp, Homo sapiens
gctccaggcctgcagcaggagt

SEQ ID NO: 4875905 - DNA, 13 bp, Homo sapiens
gctgcccctctca

SEQ ID NO: 4875906 - DNA, 21 bp, Homo sapiens
gctgccctgagaagctgctcc

SEQ ID NO: 4875907 - DNA, 22 bp, Homo sapiens
gctgccctgagaagctgctcca

SEQ ID NO: 4875908 - DNA, 22 bp, Homo sapiens
gctgccctgagcgcctggattt

SEQ ID NO: 4875909 - DNA, 12 bp, Homo sapiens
gctgccctggtg

SEQ ID NO: 4875910 - DNA, 14 bp, Homo sapiens
gctgccctggtgct

SEQ ID NO: 4875911 - DNA, 20 bp, Homo sapiens
gctgccctggtgctgccaca

SEQ ID NO: 4875912 - DNA, 22 bp, Homo sapiens
gctgccctggtgctgccacact

SEQ ID NO: 4875913 - DNA, 16 bp, Homo sapiens
gctgccgcctcccagc

SEQ ID NO: 4875914 - DNA, 22 bp, Homo sapiens
gctgcctagcaagctggcctct

SEQ ID NO: 4875915 - DNA, 12 bp, Homo sapiens
gctgcctgtagt

SEQ ID NO: 4875916 - DNA, 13 bp, Homo sapiens
gctgcctgtagtt

SEQ ID NO: 4875917 - DNA, 13 bp, Homo sapiens
gctgcctgttcag

SEQ ID NO: 4875918 - DNA, 20 bp, Homo sapiens
gctgcctgttcagctccagc

SEQ ID NO: 4875919 - DNA, 22 bp, Homo sapiens
gctgcctgttcagctccagctc

SEQ ID NO: 4875920 - DNA, 21 bp, Homo sapiens
gctgccttctgacggccctgc

SEQ ID NO: 4875921 - DNA, 23 bp, Homo sapiens
gctgccttctgacggccctgcaa

SEQ ID NO: 4875922 - DNA, 21 bp, Homo sapiens
gctgcggtccacccaggagcc

SEQ ID NO: 4875923 - DNA, 14 bp, Homo sapiens
gctgctacccagaa

SEQ ID NO: 4875924 - DNA, 16 bp, Homo sapiens
gctgctagaacttttt

SEQ ID NO: 4875925 - DNA, 21 bp, Homo sapiens
gctgctagaacttttttaaat

SEQ ID NO: 4875926 - DNA, 22 bp, Homo sapiens
gctgctccaggcctgcagcagg

SEQ ID NO: 4875927 - DNA, 23 bp, Homo sapiens
gctgctccaggcctgcagcagga

SEQ ID NO: 4875928 - DNA, 23 bp, Homo sapiens
gctgctgaccaattgtgctgcca

SEQ ID NO: 4875929 - DNA, 12 bp, Homo sapiens
gctgctgcgccc

SEQ ID NO: 4875930 - DNA, 20 bp, Homo sapiens
gctgctggggcctcagacga

SEQ ID NO: 4875931 - DNA, 18 bp, Homo sapiens
gctgctgtccctccccct

SEQ ID NO: 4875932 - DNA, 22 bp, Homo sapiens
gctggacagaggggactctggg

SEQ ID NO: 4875933 - DNA, 16 bp, Homo sapiens
gctggacatgctgact

SEQ ID NO: 4875934 - DNA, 20 bp, Homo sapiens
gctggaccagtggtgccttg

SEQ ID NO: 4875935 - DNA, 15 bp, Homo sapiens
gctggaccttgaact

SEQ ID NO: 4875936 - DNA, 14 bp, Homo sapiens
gctggagaagagag

SEQ ID NO: 4875937 - DNA, 15 bp, Homo sapiens
gctggagaagagagg

SEQ ID NO: 4875938 - DNA, 21 bp, Homo sapiens
gctggagaagagaggagagga

SEQ ID NO: 4875939 - DNA, 19 bp, Homo sapiens
gctggaggtgggagcagga

SEQ ID NO: 4875940 - DNA, 15 bp, Homo sapiens
gctggagtgcagtga

SEQ ID NO: 4875941 - DNA, 20 bp, Homo sapiens
gctggagtgcagtggtgtga

SEQ ID NO: 4875942 - DNA, 16 bp, Homo sapiens
gctggatattttacta

SEQ ID NO: 4875943 - DNA, 16 bp, Homo sapiens
gctggatggagcccag

SEQ ID NO: 4875944 - DNA, 23 bp, Homo sapiens
gctggccagcctggggcctggca

SEQ ID NO: 4875945 - DNA, 17 bp, Homo sapiens
gcctcggcctcccaaag

SEQ ID NO: 4875946 - DNA, 22 bp, Homo sapiens
gcctcgggacacctgccctgcc

SEQ ID NO: 4875947 - DNA, 13 bp, Homo sapiens
gcctcgggacctc

SEQ ID NO: 4875948 - DNA, 13 bp, Homo sapiens
gcctctcacacac

SEQ ID NO: 4875949 - DNA, 15 bp, Homo sapiens
gcctctcacacacat

SEQ ID NO: 4875950 - DNA, 21 bp, Homo sapiens
gcctctccctaggagaagagt

SEQ ID NO: 4875951 - DNA, 16 bp, Homo sapiens
gcctctgacacacagc

SEQ ID NO: 4875952 - DNA, 19 bp, Homo sapiens
gcctctgacacacagctct

SEQ ID NO: 4875953 - DNA, 13 bp, Homo sapiens
gcctctgacccct

SEQ ID NO: 4875954 - DNA, 16 bp, Homo sapiens
gcctctgacccctcct

SEQ ID NO: 4875955 - DNA, 17 bp, Homo sapiens
gcctctgacccctcctc

SEQ ID NO: 4875956 - DNA, 16 bp, Homo sapiens
gccctggtccagggaa

SEQ ID NO: 4875957 - DNA, 17 bp, Homo sapiens
gccctggtccagggaag

SEQ ID NO: 4875958 - DNA, 20 bp, Homo sapiens
gccctggtccagggaagctg

SEQ ID NO: 4875959 - DNA, 17 bp, Homo sapiens
gccctggtgctgccaca

SEQ ID NO: 4875960 - DNA, 14 bp, Homo sapiens
gccctggtggcagt

SEQ ID NO: 4875961 - DNA, 23 bp, Homo sapiens
gccctggtggcagtgggagctgc

SEQ ID NO: 4875962 - DNA, 22 bp, Homo sapiens
gcctctgacccctcctcactgg

SEQ ID NO: 4875963 - DNA, 13 bp, Homo sapiens
gcctctgatatgg

SEQ ID NO: 4875964 - DNA, 15 bp, Homo sapiens
gcctctgcattcagg

SEQ ID NO: 4875965 - DNA, 13 bp, Homo sapiens
gcctctgcctctg

SEQ ID NO: 4875966 - DNA, 12 bp, Homo sapiens
gcctctgcctgt

SEQ ID NO: 4875967 - DNA, 13 bp, Homo sapiens
gcctctgcctgtc

SEQ ID NO: 4875968 - DNA, 12 bp, Homo sapiens
gcctctggctag

SEQ ID NO: 4875969 - DNA, 13 bp, Homo sapiens
gcctctggctaga

SEQ ID NO: 4875970 - DNA, 18 bp, Homo sapiens
gcctctggctagaggcca

SEQ ID NO: 4875971 - DNA, 19 bp, Homo sapiens
gcctctggctagaggccag

SEQ ID NO: 4875972 - DNA, 22 bp, Homo sapiens
gcctctggctagaggccagccc

SEQ ID NO: 4875973 - DNA, 15 bp, Homo sapiens
gcctctgtcctcgct

SEQ ID NO: 4875974 - DNA, 12 bp, Homo sapiens
gcctctgtgcct

SEQ ID NO: 4875975 - DNA, 15 bp, Homo sapiens
gcctctgtgtccttc

SEQ ID NO: 4875976 - DNA, 18 bp, Homo sapiens
gcctctgtgtccttccct

SEQ ID NO: 4875977 - DNA, 21 bp, Homo sapiens
gcctctgtgtccttccctgca

SEQ ID NO: 4875978 - DNA, 18 bp, Homo sapiens
gcctcttaaagctgcctg

SEQ ID NO: 4875979 - DNA, 19 bp, Homo sapiens
gcctcttaaagctgcctgt

SEQ ID NO: 4875980 - DNA, 12 bp, Homo sapiens
gcctcttcctcc

SEQ ID NO: 4875981 - DNA, 22 bp, Homo sapiens
gcctcttcctccctcattccac

SEQ ID NO: 4875982 - DNA, 20 bp, Homo sapiens
gcctcttggagaccttaccc

SEQ ID NO: 4875983 - DNA, 18 bp, Homo sapiens
gcctgaaatttcaccatt

SEQ ID NO: 4875984 - DNA, 22 bp, Homo sapiens
gcctgaagtcacacagtgagtc

SEQ ID NO: 4875985 - DNA, 15 bp, Homo sapiens
gcctgacagaaacca

SEQ ID NO: 4875986 - DNA, 23 bp, Homo sapiens
gcctgaccctacttcttttgctc

SEQ ID NO: 4875987 - DNA, 15 bp, Homo sapiens
gcctgaccttccttc

SEQ ID NO: 4875988 - DNA, 16 bp, Homo sapiens
gcctgacttctgctgg

SEQ ID NO: 4875989 - DNA, 19 bp, Homo sapiens
gcctgacttctgctggcat

SEQ ID NO: 4875990 - DNA, 19 bp, Homo sapiens
gcctgagtcagggcccaga

SEQ ID NO: 4875991 - DNA, 14 bp, Homo sapiens
gcctgatctcttcc

SEQ ID NO: 4875992 - DNA, 15 bp, Homo sapiens
gcctgatctcttcct

SEQ ID NO: 4875993 - DNA, 14 bp, Homo sapiens
gcctgatgctccct

SEQ ID NO: 4875994 - DNA, 16 bp, Homo sapiens
gcctgatgctccctcc

SEQ ID NO: 4875995 - DNA, 17 bp, Homo sapiens
gcctgatgctccctccc

SEQ ID NO: 4875996 - DNA, 18 bp, Homo sapiens
gcctgcaatctgagccag

SEQ ID NO: 4875997 - DNA, 13 bp, Homo sapiens
gcctgcacacaag

SEQ ID NO: 4875998 - DNA, 17 bp, Homo sapiens
gcctgcactcctcaggg

SEQ ID NO: 4875999 - DNA, 17 bp, Homo sapiens
gcctgcagtcctggaag

SEQ ID NO: 4876000 - DNA, 15 bp, Homo sapiens
gcctgccatgtacct

SEQ ID NO: 4876001 - DNA, 18 bp, Homo sapiens
gcctgcccaggcccctgc

SEQ ID NO: 4876002 - DNA, 20 bp, Homo sapiens
gcctgcccaggcccctgcca

SEQ ID NO: 4876003 - DNA, 22 bp, Homo sapiens
gcctgcccaggcccctgccacc

SEQ ID NO: 4876004 - DNA, 23 bp, Homo sapiens
gcctgccccaaacaaatatgcaa

SEQ ID NO: 4876005 - DNA, 14 bp, Homo sapiens
gcctgcccgcacag

SEQ ID NO: 4876006 - DNA, 15 bp, Homo sapiens
gcctgcccgcacagc

SEQ ID NO: 4876007 - DNA, 21 bp, Homo sapiens
gcctgcccgcacagcagcctg

SEQ ID NO: 4876008 - DNA, 22 bp, Homo sapiens
gcctgccctcatggcccctctg

SEQ ID NO: 4876009 - DNA, 13 bp, Homo sapiens
gcctgcctggagc

SEQ ID NO: 4876010 - DNA, 14 bp, Homo sapiens
gcctgcctggagcg

SEQ ID NO: 4876011 - DNA, 15 bp, Homo sapiens
gcctgcctggcccct

SEQ ID NO: 4876012 - DNA, 16 bp, Homo sapiens
gcctgcctggcccctc

SEQ ID NO: 4876013 - DNA, 18 bp, Homo sapiens
gcctgcgttggtccagag

SEQ ID NO: 4876014 - DNA, 10 bp, Homo sapiens
gcctgctgca

SEQ ID NO: 4876015 - DNA, 13 bp, Homo sapiens
gcctgcttcccac

SEQ ID NO: 4876016 - DNA, 21 bp, Homo sapiens
gcctgcttcccacctccctgc

SEQ ID NO: 4876017 - DNA, 23 bp, Homo sapiens
gcctgcttcccacctccctgccc

SEQ ID NO: 4876018 - DNA, 20 bp, Homo sapiens
gcctggacatttgccttgct

SEQ ID NO: 4876019 - DNA, 18 bp, Homo sapiens
gcctggcacagggcagtg

SEQ ID NO: 4876020 - DNA, 22 bp, Homo sapiens
gcctggcagccgtgccttcagc

SEQ ID NO: 4876021 - DNA, 14 bp, Homo sapiens
gcctggccacctct

SEQ ID NO: 4876022 - DNA, 17 bp, Homo sapiens
gcctggccacctctctc

SEQ ID NO: 4876023 - DNA, 19 bp, Homo sapiens
gcctggccacctctctcct

SEQ ID NO: 4876024 - DNA, 20 bp, Homo sapiens
gcctggccagatgcaccagc

SEQ ID NO: 4876025 - DNA, 21 bp, Homo sapiens
gcctggccagatgcaccagcc

SEQ ID NO: 4876026 - DNA, 22 bp, Homo sapiens
gcctggccagatgcaccagccc

SEQ ID NO: 4876027 - DNA, 19 bp, Homo sapiens
gcctggccaggagctcttc

SEQ ID NO: 4876028 - DNA, 14 bp, Homo sapiens
gcctggccaggcag

SEQ ID NO: 4876029 - DNA, 17 bp, Homo sapiens
gcctggccaggcagatc

SEQ ID NO: 4876030 - DNA, 19 bp, Homo sapiens
gcctggcccatagaaacat

SEQ ID NO: 4876031 - DNA, 17 bp, Homo sapiens
gcctggccctgccctga

SEQ ID NO: 4876032 - DNA, 13 bp, Homo sapiens
gcctggcctggca

SEQ ID NO: 4876033 - DNA, 15 bp, Homo sapiens
gcctggcctggccct

SEQ ID NO: 4876034 - DNA, 19 bp, Homo sapiens
gcctggcctggccctgccc

SEQ ID NO: 4876035 - DNA, 19 bp, Homo sapiens
gcctggctcttgtgctgga

SEQ ID NO: 4876036 - DNA, 21 bp, Homo sapiens
gcctggctcttgtgctggatg

SEQ ID NO: 4876037 - DNA, 20 bp, Homo sapiens
gcctgggcaacagagcaaga

SEQ ID NO: 4876038 - DNA, 17 bp, Homo sapiens
gcctgggcagccaggct

SEQ ID NO: 4876039 - DNA, 15 bp, Homo sapiens
gcctgggccccagct

SEQ ID NO: 4876040 - DNA, 20 bp, Homo sapiens
gcctgggccccagctcgcgg

SEQ ID NO: 4876041 - DNA, 13 bp, Homo sapiens
gcctggggcctga

SEQ ID NO: 4876042 - DNA, 17 bp, Homo sapiens
gcctggtcacagggcat

SEQ ID NO: 4876043 - DNA, 20 bp, Homo sapiens
gcctggtccatgcagggggc

SEQ ID NO: 4876044 - DNA, 16 bp, Homo sapiens
gcctggtggcagctgc

SEQ ID NO: 4876045 - DNA, 19 bp, Homo sapiens
gcctggtggcagctgcggt

SEQ ID NO: 4876046 - DNA, 18 bp, Homo sapiens
gcctgtatactttagtat

SEQ ID NO: 4876047 - DNA, 14 bp, Homo sapiens
gcctgtccagcctg

SEQ ID NO: 4876048 - DNA, 17 bp, Homo sapiens
gcctgtccagcctgggc

SEQ ID NO: 4876049 - DNA, 20 bp, Homo sapiens
gcctgtcccacccccacccc

SEQ ID NO: 4876050 - DNA, 21 bp, Homo sapiens
gcctgtcccatggacactcca

SEQ ID NO: 4876051 - DNA, 22 bp, Homo sapiens
gcctgtcccatggacactccag

SEQ ID NO: 4876052 - DNA, 18 bp, Homo sapiens
gcctgtctcatccccagg

SEQ ID NO: 4876053 - DNA, 22 bp, Homo sapiens
gcctgtctcatccccaggggtc

SEQ ID NO: 4876054 - DNA, 19 bp, Homo sapiens
gcctgtctctttaagggca

SEQ ID NO: 4876055 - DNA, 13 bp, Homo sapiens
gcctgtgctgtga

SEQ ID NO: 4876056 - DNA, 19 bp, Homo sapiens
gcctgtggaatgagtgtgc

SEQ ID NO: 4876057 - DNA, 17 bp, Homo sapiens
gcctgtggagctcagcc

SEQ ID NO: 4876058 - DNA, 19 bp, Homo sapiens
gcctgttcccattcttgca

SEQ ID NO: 4876059 - DNA, 16 bp, Homo sapiens
gcctgtttcttcctgt

SEQ ID NO: 4876060 - DNA, 22 bp, Homo sapiens
gcctgtttggcgtttcccagag

SEQ ID NO: 4876061 - DNA, 22 bp, Homo sapiens
gccttaaaatggaattgaaaaa

SEQ ID NO: 4876062 - DNA, 15 bp, Homo sapiens
gccttaatacttttt

SEQ ID NO: 4876063 - DNA, 22 bp, Homo sapiens
gccttagaaatgtaaactgcca

SEQ ID NO: 4876064 - DNA, 23 bp, Homo sapiens
gccttagaaatgtaaactgccat

SEQ ID NO: 4876065 - DNA, 18 bp, Homo sapiens
gccttagaagtcacacag

SEQ ID NO: 4876066 - DNA, 19 bp, Homo sapiens
gccttagaagtcacacagt

SEQ ID NO: 4876067 - DNA, 21 bp, Homo sapiens
gccttagccgcccatgcactg

SEQ ID NO: 4876068 - DNA, 18 bp, Homo sapiens
gccttagtctcagtttgt

SEQ ID NO: 4876069 - DNA, 12 bp, Homo sapiens
gccttagtgggc

SEQ ID NO: 4876070 - DNA, 14 bp, Homo sapiens
gccttcagctccag

SEQ ID NO: 4876071 - DNA, 18 bp, Homo sapiens
gccttcccctcagccaca

SEQ ID NO: 4876072 - DNA, 13 bp, Homo sapiens
gccttcctctctc

SEQ ID NO: 4876073 - DNA, 15 bp, Homo sapiens
gttggattccatgct

SEQ ID NO: 4876074 - DNA, 16 bp, Homo sapiens
gttggattccatgcta

SEQ ID NO: 4876075 - DNA, 22 bp, Homo sapiens
gttggcagtgagtgagcctggc

SEQ ID NO: 4876076 - DNA, 14 bp, Homo sapiens
gttggccaggctgg

SEQ ID NO: 4876077 - DNA, 14 bp, Homo sapiens
gttggccagtgtga

SEQ ID NO: 4876078 - DNA, 22 bp, Homo sapiens
gttgggcagggtgaccctgaag

SEQ ID NO: 4876079 - DNA, 17 bp, Homo sapiens
gttgggctggtgtcacc

SEQ ID NO: 4876080 - DNA, 13 bp, Homo sapiens
gttggggtgacag

SEQ ID NO: 4876081 - DNA, 19 bp, Homo sapiens
gttgggtggcaattccaat

SEQ ID NO: 4876082 - DNA, 16 bp, Homo sapiens
gttggtcggtgggttg

SEQ ID NO: 4876083 - DNA, 15 bp, Homo sapiens
gttggttgtgtcttt

SEQ ID NO: 4876084 - DNA, 16 bp, Homo sapiens
gttggttgtgtctttt

SEQ ID NO: 4876085 - DNA, 13 bp, Homo sapiens
gttgtaactaggc

SEQ ID NO: 4876086 - DNA, 12 bp, Homo sapiens
gttgtaacttat

SEQ ID NO: 4876087 - DNA, 14 bp, Homo sapiens
gttgtaatgctgca

SEQ ID NO: 4876088 - DNA, 23 bp, Homo sapiens
gttgtacatttatgatttaataa

SEQ ID NO: 4876089 - DNA, 12 bp, Homo sapiens
gttgtataattt

SEQ ID NO: 4876090 - DNA, 22 bp, Homo sapiens
gttgtccaattgttgacagttc

SEQ ID NO: 4876091 - DNA, 19 bp, Homo sapiens
gttgtctgaagtcactgca

SEQ ID NO: 4876092 - DNA, 14 bp, Homo sapiens
gttgtgaatgttgt

SEQ ID NO: 4876093 - DNA, 21 bp, Homo sapiens
gttgtgatcatcccatctaag

SEQ ID NO: 4876094 - DNA, 13 bp, Homo sapiens
gttgttatgctat

SEQ ID NO: 4876095 - DNA, 14 bp, Homo sapiens
gttgttgcatgttt

SEQ ID NO: 4876096 - DNA, 14 bp, Homo sapiens
gttgtttctttcta

SEQ ID NO: 4876097 - DNA, 17 bp, Homo sapiens
gtttaaaacagtattta

SEQ ID NO: 4876098 - DNA, 17 bp, Homo sapiens
gtttaaagagtctagat

SEQ ID NO: 4876099 - DNA, 20 bp, Homo sapiens
gtttaagaaaagtattttga

SEQ ID NO: 4876100 - DNA, 21 bp, Homo sapiens
gtttaagaaaagtattttgaa

SEQ ID NO: 4876101 - DNA, 15 bp, Homo sapiens
gtttaatatttaaac

SEQ ID NO: 4876102 - DNA, 17 bp, Homo sapiens
gtttaatatttaaacag

SEQ ID NO: 4876103 - DNA, 15 bp, Homo sapiens
gtttaatgtgaactt

SEQ ID NO: 4876104 - DNA, 14 bp, Homo sapiens
gtttaatttcttca

SEQ ID NO: 4876105 - DNA, 14 bp, Homo sapiens
gtttacagaaaaat

SEQ ID NO: 4876106 - DNA, 17 bp, Homo sapiens
gtttacaggtggacaca

SEQ ID NO: 4876107 - DNA, 13 bp, Homo sapiens
gtttacatgtgta

SEQ ID NO: 4876108 - DNA, 21 bp, Homo sapiens
gtttacatttaaagcattgct

SEQ ID NO: 4876109 - DNA, 23 bp, Homo sapiens
gtttacatttaaagcattgctgt

SEQ ID NO: 4876110 - DNA, 21 bp, Homo sapiens
gtttacatttttatttatgaa

SEQ ID NO: 4876111 - DNA, 23 bp, Homo sapiens
gtttacatttttatttatgaagt

SEQ ID NO: 4876112 - DNA, 16 bp, Homo sapiens
gtttacccatgaagat

SEQ ID NO: 4876113 - DNA, 14 bp, Homo sapiens
gtttactttcaaat

SEQ ID NO: 4876114 - DNA, 22 bp, Homo sapiens
gtttagaagctgagacacaaag

SEQ ID NO: 4876115 - DNA, 14 bp, Homo sapiens
gtttagatttcaag

SEQ ID NO: 4876116 - DNA, 15 bp, Homo sapiens
gtttaggtgaattaa

SEQ ID NO: 4876117 - DNA, 23 bp, Homo sapiens
gtttatagagaatgatgataaca

SEQ ID NO: 4876118 - DNA, 14 bp, Homo sapiens
gtttatatgtgttg

SEQ ID NO: 4876119 - DNA, 14 bp, Homo sapiens
gtttatcatgaagc

SEQ ID NO: 4876120 - DNA, 15 bp, Homo sapiens
gtttatcatgaagcc

SEQ ID NO: 4876121 - DNA, 12 bp, Homo sapiens
gtttatgaaaat

SEQ ID NO: 4876122 - DNA, 21 bp, Homo sapiens
gtttatgataataaaggcacc

SEQ ID NO: 4876123 - DNA, 15 bp, Homo sapiens
gtttatggcctcagc

SEQ ID NO: 4876124 - DNA, 19 bp, Homo sapiens
gtttattcttctagagttc

SEQ ID NO: 4876125 - DNA, 21 bp, Homo sapiens
gtttattgagtttgtaggtaa

SEQ ID NO: 4876126 - DNA, 22 bp, Homo sapiens
gtttattgagtttgtaggtaaa

SEQ ID NO: 4876127 - DNA, 16 bp, Homo sapiens
gtttatttcacttgat

SEQ ID NO: 4876128 - DNA, 17 bp, Homo sapiens
gtttatttttcatattg

SEQ ID NO: 4876129 - DNA, 13 bp, Homo sapiens
gtttcaatgtgat

SEQ ID NO: 4876130 - DNA, 16 bp, Homo sapiens
gtttcacccttaaccc

SEQ ID NO: 4876131 - DNA, 16 bp, Homo sapiens
gtttcagatatatatc

SEQ ID NO: 4876132 - DNA, 14 bp, Homo sapiens
gtttcaggtgacat

SEQ ID NO: 4876133 - DNA, 15 bp, Homo sapiens
gtttcaggtgacatg

SEQ ID NO: 4876134 - DNA, 19 bp, Homo sapiens
gtttcatgttttgtgacta

SEQ ID NO: 4876135 - DNA, 15 bp, Homo sapiens
gtttcattctcctgc

SEQ ID NO: 4876136 - DNA, 19 bp, Homo sapiens
gtttcattctcctgcctgt

SEQ ID NO: 4876137 - DNA, 23 bp, Homo sapiens
gtttccttgtttatcagatacat

SEQ ID NO: 4876138 - DNA, 14 bp, Homo sapiens
gtttcgtttctgta

SEQ ID NO: 4876139 - DNA, 19 bp, Homo sapiens
gtttctatgtgtagggcgg

SEQ ID NO: 4876140 - DNA, 20 bp, Homo sapiens
gtttctcttgagctggcctc

SEQ ID NO: 4876141 - DNA, 17 bp, Homo sapiens
gtttctgagaaaagaac

SEQ ID NO: 4876142 - DNA, 16 bp, Homo sapiens
gtttctgggtcctgaa

SEQ ID NO: 4876143 - DNA, 14 bp, Homo sapiens
gtttctgttattaa

SEQ ID NO: 4876144 - DNA, 11 bp, Homo sapiens
gtttcttcctg

SEQ ID NO: 4876145 - DNA, 14 bp, Homo sapiens
gtttcttcctgtta

SEQ ID NO: 4876146 - DNA, 17 bp, Homo sapiens
gtttcttgcaagcatgc

SEQ ID NO: 4876147 - DNA, 14 bp, Homo sapiens
gtttcttgcttgta

SEQ ID NO: 4876148 - DNA, 17 bp, Homo sapiens
gtttcttgcttgtacct

SEQ ID NO: 4876149 - DNA, 19 bp, Homo sapiens
gtttgaaagtgaataaact

SEQ ID NO: 4876150 - DNA, 22 bp, Homo sapiens
gtttgaaatgaggtctgtttaa

SEQ ID NO: 4876151 - DNA, 15 bp, Homo sapiens
gtttgaaggaaacag

SEQ ID NO: 4876152 - DNA, 16 bp, Homo sapiens
gtttgcaggggtgacg

SEQ ID NO: 4876153 - DNA, 12 bp, Homo sapiens
gtttgctgctat

SEQ ID NO: 4876154 - DNA, 13 bp, Homo sapiens
gtttgctgtgaac

SEQ ID NO: 4876155 - DNA, 20 bp, Homo sapiens
gtttgctttgtatgcacttt

SEQ ID NO: 4876156 - DNA, 18 bp, Homo sapiens
gtttggattcttatgtag

SEQ ID NO: 4876157 - DNA, 20 bp, Homo sapiens
gtttggattcttatgtagca

SEQ ID NO: 4876158 - DNA, 18 bp, Homo sapiens
gtttggggatgagaaagg

SEQ ID NO: 4876159 - DNA, 15 bp, Homo sapiens
gtttggtctggactg

SEQ ID NO: 4876160 - DNA, 14 bp, Homo sapiens
gtttggttcctctc

SEQ ID NO: 4876161 - DNA, 16 bp, Homo sapiens
gtttggtttacattta

SEQ ID NO: 4876162 - DNA, 14 bp, Homo sapiens
gtttgtaaatgtta

SEQ ID NO: 4876163 - DNA, 13 bp, Homo sapiens
gtttgtctatttt

SEQ ID NO: 4876164 - DNA, 16 bp, Homo sapiens
gtttgtctgtttgttt

SEQ ID NO: 4876165 - DNA, 18 bp, Homo sapiens
gtttgtctgtttgtttca

SEQ ID NO: 4876166 - DNA, 19 bp, Homo sapiens
gtttgtggaaaatgaaaat

SEQ ID NO: 4876167 - DNA, 12 bp, Homo sapiens
gtttgtggcctc

SEQ ID NO: 4876168 - DNA, 14 bp, Homo sapiens
gtttgtggcctcag

SEQ ID NO: 4876169 - DNA, 16 bp, Homo sapiens
gtttgtggcctcagaa

SEQ ID NO: 4876170 - DNA, 22 bp, Homo sapiens
gtttgtggctgggggcaggagg

SEQ ID NO: 4876171 - DNA, 14 bp, Homo sapiens
gtttgtgtgtctta

SEQ ID NO: 4876172 - DNA, 21 bp, Homo sapiens
gtttgtgtgttgtcttgaaag

SEQ ID NO: 4876173 - DNA, 11 bp, Homo sapiens
gtttgtttgtc

SEQ ID NO: 4876174 - DNA, 14 bp, Homo sapiens
gttttaaactcatt

SEQ ID NO: 4876175 - DNA, 12 bp, Homo sapiens
gttttaaattct

SEQ ID NO: 4876176 - DNA, 22 bp, Homo sapiens
gttttaacaatttcctttatat

SEQ ID NO: 4876177 - DNA, 20 bp, Homo sapiens
gttttaaccgcacatgcaca

SEQ ID NO: 4876178 - DNA, 14 bp, Homo sapiens
gttttaagaaatgt

SEQ ID NO: 4876179 - DNA, 16 bp, Homo sapiens
gttttaagaaatgtag

SEQ ID NO: 4876180 - DNA, 19 bp, Homo sapiens
gttttaatctgaaattcta

SEQ ID NO: 4876181 - DNA, 21 bp, Homo sapiens
gttttaatctgaaattctaaa

SEQ ID NO: 4876182 - DNA, 23 bp, Homo sapiens
gttttaattccaatatgatgact

SEQ ID NO: 4876183 - DNA, 21 bp, Homo sapiens
gttttaatttaaacacctcct

SEQ ID NO: 4876184 - DNA, 12 bp, Homo sapiens
gttttacattgt

SEQ ID NO: 4876185 - DNA, 20 bp, Homo sapiens
gtatattgtgtttgtgtatt

SEQ ID NO: 4876186 - DNA, 16 bp, Homo sapiens
gtatatttccgcactt

SEQ ID NO: 4876187 - DNA, 15 bp, Homo sapiens
gtatcaaacccacga

SEQ ID NO: 4876188 - DNA, 15 bp, Homo sapiens
gtatcaggtctccca

SEQ ID NO: 4876189 - DNA, 18 bp, Homo sapiens
gtatcaggtgctgccatc

SEQ ID NO: 4876190 - DNA, 12 bp, Homo sapiens
gtatcatagaaa

SEQ ID NO: 4876191 - DNA, 14 bp, Homo sapiens
gtatcatctggata

SEQ ID NO: 4876192 - DNA, 19 bp, Homo sapiens
gtatccactttgcacagct

SEQ ID NO: 4876193 - DNA, 19 bp, Homo sapiens
gtatcccatgagcctcagc

SEQ ID NO: 4876194 - DNA, 17 bp, Homo sapiens
gtatcccttctcacagc

SEQ ID NO: 4876195 - DNA, 22 bp, Homo sapiens
gtatctctttcacattgtttgc

SEQ ID NO: 4876196 - DNA, 15 bp, Homo sapiens
gtatctgagttgcca

SEQ ID NO: 4876197 - DNA, 17 bp, Homo sapiens
gtatcttccatatttgg

SEQ ID NO: 4876198 - DNA, 20 bp, Homo sapiens
gtatcttccatatttggaag

SEQ ID NO: 4876199 - DNA, 18 bp, Homo sapiens
gtatctttgcactccaat

SEQ ID NO: 4876200 - DNA, 14 bp, Homo sapiens
gtatgaaaatgagt

SEQ ID NO: 4876201 - DNA, 20 bp, Homo sapiens
gtatgaaaatgagttgtgaa

SEQ ID NO: 4876202 - DNA, 18 bp, Homo sapiens
gtatgaataaagacacct

SEQ ID NO: 4876203 - DNA, 21 bp, Homo sapiens
gtatgatcacggctcactgca

SEQ ID NO: 4876204 - DNA, 22 bp, Homo sapiens
gtatgatcacggctcactgcag

SEQ ID NO: 4876205 - DNA, 13 bp, Homo sapiens
gtatgatgtgttg

SEQ ID NO: 4876206 - DNA, 17 bp, Homo sapiens
gtatgatgtgttgtgat

SEQ ID NO: 4876207 - DNA, 16 bp, Homo sapiens
gtatggtggctgggtt

SEQ ID NO: 4876208 - DNA, 13 bp, Homo sapiens
gtatgtatctatt

SEQ ID NO: 4876209 - DNA, 14 bp, Homo sapiens
gtatgtgccattta

SEQ ID NO: 4876210 - DNA, 13 bp, Homo sapiens
gtattacactgta

SEQ ID NO: 4876211 - DNA, 22 bp, Homo sapiens
gtattacactgtatttgtatct

SEQ ID NO: 4876212 - DNA, 23 bp, Homo sapiens
gtattacccaagaagtaaagatg

SEQ ID NO: 4876213 - DNA, 13 bp, Homo sapiens
gtattacttctgc

SEQ ID NO: 4876214 - DNA, 15 bp, Homo sapiens
gtattacttctgcta

SEQ ID NO: 4876215 - DNA, 14 bp, Homo sapiens
gtattattctacta

SEQ ID NO: 4876216 - DNA, 17 bp, Homo sapiens
gtattattgctgttgct

SEQ ID NO: 4876217 - DNA, 12 bp, Homo sapiens
gtattatttata

SEQ ID NO: 4876218 - DNA, 19 bp, Homo sapiens
gtattcaaaaattatctat

SEQ ID NO: 4876219 - DNA, 16 bp, Homo sapiens
gtattgagatttctta

SEQ ID NO: 4876220 - DNA, 22 bp, Homo sapiens
gtatttaaactatcttgtgtga

SEQ ID NO: 4876221 - DNA, 17 bp, Homo sapiens
gtatttacgctttgatt

SEQ ID NO: 4876222 - DNA, 18 bp, Homo sapiens
gtatttattgaagaaaca

SEQ ID NO: 4876223 - DNA, 12 bp, Homo sapiens
gtatttattttg

SEQ ID NO: 4876224 - DNA, 13 bp, Homo sapiens
gtatttattttgt

SEQ ID NO: 4876225 - DNA, 15 bp, Homo sapiens
gtatttcatgtggct

SEQ ID NO: 4876226 - DNA, 14 bp, Homo sapiens
gtatttgaaactga

SEQ ID NO: 4876227 - DNA, 14 bp, Homo sapiens
gtatttgaattaaa

SEQ ID NO: 4876228 - DNA, 18 bp, Homo sapiens
gtatttgaattaaaactt

SEQ ID NO: 4876229 - DNA, 23 bp, Homo sapiens
gtatttgaattaaaacttcttaa

SEQ ID NO: 4876230 - DNA, 19 bp, Homo sapiens
gtatttgagagttctaaat

SEQ ID NO: 4876231 - DNA, 15 bp, Homo sapiens
gtatttgttcatgtt

SEQ ID NO: 4876232 - DNA, 18 bp, Homo sapiens
gtatttgttcatgtttgg

SEQ ID NO: 4876233 - DNA, 17 bp, Homo sapiens
gtatttttcagagattt

SEQ ID NO: 4876234 - DNA, 12 bp, Homo sapiens
gtcaaaacactg

SEQ ID NO: 4876235 - DNA, 21 bp, Homo sapiens
gtcaaaacactgtggaactaa

SEQ ID NO: 4876236 - DNA, 14 bp, Homo sapiens
gtcaagtctctgct

SEQ ID NO: 4876237 - DNA, 17 bp, Homo sapiens
gtcaatcccaaaagtca

SEQ ID NO: 4876238 - DNA, 17 bp, Homo sapiens
gtcacaaagaatttaaa

SEQ ID NO: 4876239 - DNA, 21 bp, Homo sapiens
gtcacaaatcctaaaagaagc

SEQ ID NO: 4876240 - DNA, 16 bp, Homo sapiens
gtcacacactttggct

SEQ ID NO: 4876241 - DNA, 21 bp, Homo sapiens
gtcacacagtattacttctgc

SEQ ID NO: 4876242 - DNA, 22 bp, Homo sapiens
gtcacacagtattacttctgct

SEQ ID NO: 4876243 - DNA, 14 bp, Homo sapiens
gtcacagcctcctc

SEQ ID NO: 4876244 - DNA, 23 bp, Homo sapiens
gtcacagcctcctctgtctgccc

SEQ ID NO: 4876245 - DNA, 13 bp, Homo sapiens
gtcacaggcaggt

SEQ ID NO: 4876246 - DNA, 15 bp, Homo sapiens
gtcacagggccaact

SEQ ID NO: 4876247 - DNA, 17 bp, Homo sapiens
gtcacatcagataagac

SEQ ID NO: 4876248 - DNA, 18 bp, Homo sapiens
gtcacattgcattctatt

SEQ ID NO: 4876249 - DNA, 21 bp, Homo sapiens
gtcacattgcattctattgcc

SEQ ID NO: 4876250 - DNA, 16 bp, Homo sapiens
gtcaccccaagtagtc

SEQ ID NO: 4876251 - DNA, 20 bp, Homo sapiens
gtcacccctccaggaatgat

SEQ ID NO: 4876252 - DNA, 17 bp, Homo sapiens
gtcaccttcccttgcca

SEQ ID NO: 4876253 - DNA, 16 bp, Homo sapiens
gtcacgtactgtctga

SEQ ID NO: 4876254 - DNA, 12 bp, Homo sapiens
gtcactagaatg

SEQ ID NO: 4876255 - DNA, 23 bp, Homo sapiens
gtcactgcacagtgcatctcagc

SEQ ID NO: 4876256 - DNA, 18 bp, Homo sapiens
gtcacttgtgctttgctc

SEQ ID NO: 4876257 - DNA, 24 bp, Homo sapiens
gtcacttgtgctttgctcttgtcc

SEQ ID NO: 4876258 - DNA, 14 bp, Homo sapiens
gtcagatgagaaca

SEQ ID NO: 4876259 - DNA, 18 bp, Homo sapiens
gtcagatgagaacaaagc

SEQ ID NO: 4876260 - DNA, 22 bp, Homo sapiens
gtcagatgagaacaaagctgtt

SEQ ID NO: 4876261 - DNA, 21 bp, Homo sapiens
gtcagcgcaggtttagtttac

SEQ ID NO: 4876262 - DNA, 17 bp, Homo sapiens
gtcaggaacagaaggat

SEQ ID NO: 4876263 - DNA, 15 bp, Homo sapiens
gtcaggccctggaac

SEQ ID NO: 4876264 - DNA, 21 bp, Homo sapiens
gtcaggcccttattttcaaga

SEQ ID NO: 4876265 - DNA, 14 bp, Homo sapiens
gtcagggcccagag

SEQ ID NO: 4876266 - DNA, 19 bp, Homo sapiens
gtcagggcccagaggctga

SEQ ID NO: 4876267 - DNA, 17 bp, Homo sapiens
gtcagggttggtgtgct

SEQ ID NO: 4876268 - DNA, 18 bp, Homo sapiens
gtcagggttggtgtgctg

SEQ ID NO: 4876269 - DNA, 14 bp, Homo sapiens
gtcaggtgaccctg

SEQ ID NO: 4876270 - DNA, 22 bp, Homo sapiens
gtcagtcatgatggcaccactg

SEQ ID NO: 4876271 - DNA, 17 bp, Homo sapiens
gtcagtctttttctgtt

SEQ ID NO: 4876272 - DNA, 17 bp, Homo sapiens
gtcatatactgccatgt

SEQ ID NO: 4876273 - DNA, 22 bp, Homo sapiens
gtcatatactgccatgtactag

SEQ ID NO: 4876274 - DNA, 17 bp, Homo sapiens
gtcatcaatgtatttgt

SEQ ID NO: 4876275 - DNA, 15 bp, Homo sapiens
gtcatcacttttcag

SEQ ID NO: 4876276 - DNA, 16 bp, Homo sapiens
gtcatcacttttcagt

SEQ ID NO: 4876277 - DNA, 16 bp, Homo sapiens
gtcatcatcagggcct

SEQ ID NO: 4876278 - DNA, 18 bp, Homo sapiens
gtcatcatcagggcctgg

SEQ ID NO: 4876279 - DNA, 21 bp, Homo sapiens
gtcatcatcagggcctggggc

SEQ ID NO: 4876280 - DNA, 17 bp, Homo sapiens
gtcatctgattggacag

SEQ ID NO: 4876281 - DNA, 14 bp, Homo sapiens
gtcatgcataaata

SEQ ID NO: 4876282 - DNA, 18 bp, Homo sapiens
gtcatgcataaatatgca

SEQ ID NO: 4876283 - DNA, 19 bp, Homo sapiens
gtcatgcataaatatgcag

SEQ ID NO: 4876284 - DNA, 14 bp, Homo sapiens
ggcactagcctttg

SEQ ID NO: 4876285 - DNA, 21 bp, Homo sapiens
ggcactagcctttggctctgg

SEQ ID NO: 4876286 - DNA, 13 bp, Homo sapiens
ggcactctagatt

SEQ ID NO: 4876287 - DNA, 22 bp, Homo sapiens
ggcactgattgttttagagact

SEQ ID NO: 4876288 - DNA, 16 bp, Homo sapiens
ggcacttgcctgggtc

SEQ ID NO: 4876289 - DNA, 22 bp, Homo sapiens
ggcactttgaaggggcctcacc

SEQ ID NO: 4876290 - DNA, 22 bp, Homo sapiens
ggcagaaaggttctgcccggga

SEQ ID NO: 4876291 - DNA, 12 bp, Homo sapiens
ggcagaagacac

SEQ ID NO: 4876292 - DNA, 16 bp, Homo sapiens
ggcagaagacaccaga

SEQ ID NO: 4876293 - DNA, 17 bp, Homo sapiens
ggcagaagacaccagag

SEQ ID NO: 4876294 - DNA, 23 bp, Homo sapiens
ggcagacagcaggcagcgccaag

SEQ ID NO: 4876295 - DNA, 15 bp, Homo sapiens
ggcagactacacagg

SEQ ID NO: 4876296 - DNA, 17 bp, Homo sapiens
ggcagactacacaggat

SEQ ID NO: 4876297 - DNA, 14 bp, Homo sapiens
ggcagagaatcata

SEQ ID NO: 4876298 - DNA, 16 bp, Homo sapiens
ggcagagagagagaaa

SEQ ID NO: 4876299 - DNA, 19 bp, Homo sapiens
ggcagagagcggtctcagg

SEQ ID NO: 4876300 - DNA, 18 bp, Homo sapiens
ggcagaggatgtctcaaa

SEQ ID NO: 4876301 - DNA, 19 bp, Homo sapiens
ggcagataatcagcctctt

SEQ ID NO: 4876302 - DNA, 14 bp, Homo sapiens
ggcagcagaaaact

SEQ ID NO: 4876303 - DNA, 17 bp, Homo sapiens
ggcagcatagcaagaca

SEQ ID NO: 4876304 - DNA, 12 bp, Homo sapiens
ggcagccaggct

SEQ ID NO: 4876305 - DNA, 19 bp, Homo sapiens
ggcagccaggctgccaagg

SEQ ID NO: 4876306 - DNA, 13 bp, Homo sapiens
ggcagccagggct

SEQ ID NO: 4876307 - DNA, 14 bp, Homo sapiens
ggcagccagtgaga

SEQ ID NO: 4876308 - DNA, 21 bp, Homo sapiens
ggcagcccagagactttgtag

SEQ ID NO: 4876309 - DNA, 16 bp, Homo sapiens
ggcagccccattctgc

SEQ ID NO: 4876310 - DNA, 19 bp, Homo sapiens
ggcagctgcggtccaccca

SEQ ID NO: 4876311 - DNA, 23 bp, Homo sapiens
ggcagctgcggtccacccaggag

SEQ ID NO: 4876312 - DNA, 24 bp, Homo sapiens
ggcagctgcggtccacccaggagc

SEQ ID NO: 4876313 - DNA, 22 bp, Homo sapiens
ggcagctgcttttgtctatggg

SEQ ID NO: 4876314 - DNA, 21 bp, Homo sapiens
ggcagcttgagggttgggctg

SEQ ID NO: 4876315 - DNA, 14 bp, Homo sapiens
ggcagctttctaga

SEQ ID NO: 4876316 - DNA, 15 bp, Homo sapiens
ggcaggaaggagagc

SEQ ID NO: 4876317 - DNA, 23 bp, Homo sapiens
ggcaggaaggagagcctgctgca

SEQ ID NO: 4876318 - DNA, 13 bp, Homo sapiens
ggcaggcattgag

SEQ ID NO: 4876319 - DNA, 15 bp, Homo sapiens
ggcaggctgggccat

SEQ ID NO: 4876320 - DNA, 14 bp, Homo sapiens
ggcagggaccacac

SEQ ID NO: 4876321 - DNA, 23 bp, Homo sapiens
ggcagggcaaatgacatgcactg

SEQ ID NO: 4876322 - DNA, 17 bp, Homo sapiens
ggcagggtctcactctg

SEQ ID NO: 4876323 - DNA, 15 bp, Homo sapiens
ggcaggtagccaggg

SEQ ID NO: 4876324 - DNA, 23 bp, Homo sapiens
ggcaggtcttgaactcctggcct

SEQ ID NO: 4876325 - DNA, 16 bp, Homo sapiens
ggcagtgagtgagcct

SEQ ID NO: 4876326 - DNA, 21 bp, Homo sapiens
ggcagtgggacagggcatggc

SEQ ID NO: 4876327 - DNA, 19 bp, Homo sapiens
ggcagtgggagctgcctgt

SEQ ID NO: 4876328 - DNA, 21 bp, Homo sapiens
ggcatcaagaggtgggagggc

SEQ ID NO: 4876329 - DNA, 13 bp, Homo sapiens
ggcatcatgcatg

SEQ ID NO: 4876330 - DNA, 16 bp, Homo sapiens
gtacatggcagagttt

SEQ ID NO: 4876331 - DNA, 12 bp, Homo sapiens
gtacatttataa

SEQ ID NO: 4876332 - DNA, 14 bp, Homo sapiens
gtacatttatgatt

SEQ ID NO: 4876333 - DNA, 22 bp, Homo sapiens
gtacatttatgatttaataaaa

SEQ ID NO: 4876334 - DNA, 17 bp, Homo sapiens
gtacattttgttgtaaa

SEQ ID NO: 4876335 - DNA, 18 bp, Homo sapiens
gtacattttgttgtaaaa

SEQ ID NO: 4876336 - DNA, 21 bp, Homo sapiens
gtacattttgttgtaaaaaga

SEQ ID NO: 4876337 - DNA, 14 bp, Homo sapiens
gtacccactgctct

SEQ ID NO: 4876338 - DNA, 15 bp, Homo sapiens
gtacccactgctctg

SEQ ID NO: 4876339 - DNA, 17 bp, Homo sapiens
gtaccctctcagctcca

SEQ ID NO: 4876340 - DNA, 17 bp, Homo sapiens
gtacctcccctgccttg

SEQ ID NO: 4876341 - DNA, 18 bp, Homo sapiens
gtacctcccctgccttgc

SEQ ID NO: 4876342 - DNA, 23 bp, Homo sapiens
gtacctgaaaagtaacttggctt

SEQ ID NO: 4876343 - DNA, 13 bp, Homo sapiens
gtactagtactgt

SEQ ID NO: 4876344 - DNA, 15 bp, Homo sapiens
gtactagtgttctgt

SEQ ID NO: 4876345 - DNA, 16 bp, Homo sapiens
gtactcactgaagcct

SEQ ID NO: 4876346 - DNA, 22 bp, Homo sapiens
gtactgaaagccttagggaagc

SEQ ID NO: 4876347 - DNA, 23 bp, Homo sapiens
gtactgaaagccttagggaagct

SEQ ID NO: 4876348 - DNA, 22 bp, Homo sapiens
gtactgccccccatgaggaagg

SEQ ID NO: 4876349 - DNA, 20 bp, Homo sapiens
gtactgctcaggctgcagct

SEQ ID NO: 4876350 - DNA, 22 bp, Homo sapiens
gtactgctcaggctgcagctgg

SEQ ID NO: 4876351 - DNA, 23 bp, Homo sapiens
gtactgctcaggctgcagctgga

SEQ ID NO: 4876352 - DNA, 13 bp, Homo sapiens
gtactgtaataat

SEQ ID NO: 4876353 - DNA, 17 bp, Homo sapiens
gtactgtaataatacct

SEQ ID NO: 4876354 - DNA, 14 bp, Homo sapiens
gtactgttctgtgt

SEQ ID NO: 4876355 - DNA, 15 bp, Homo sapiens
gtactgttctgtgtc

SEQ ID NO: 4876356 - DNA, 18 bp, Homo sapiens
gtactgttctgtgtcttt

SEQ ID NO: 4876357 - DNA, 17 bp, Homo sapiens
gtacttagagtttctgt

SEQ ID NO: 4876358 - DNA, 19 bp, Homo sapiens
gtacttagagtttctgttt

SEQ ID NO: 4876359 - DNA, 21 bp, Homo sapiens
gtacttcctgagtggccaggg

SEQ ID NO: 4876360 - DNA, 16 bp, Homo sapiens
gtacttctccaccctg

SEQ ID NO: 4876361 - DNA, 19 bp, Homo sapiens
gtacttctccaccctgctc

SEQ ID NO: 4876362 - DNA, 21 bp, Homo sapiens
gtacttctccaccctgctctc

SEQ ID NO: 4876363 - DNA, 20 bp, Homo sapiens
gtacttgtgaaacacagctg

SEQ ID NO: 4876364 - DNA, 16 bp, Homo sapiens
gtacttgtggacacag

SEQ ID NO: 4876365 - DNA, 18 bp, Homo sapiens
gtacttttgagtgtgtgt

SEQ ID NO: 4876366 - DNA, 22 bp, Homo sapiens
gtacttttgagtgtgtgtgtgc

SEQ ID NO: 4876367 - DNA, 17 bp, Homo sapiens
gtagaaataatatgcat

SEQ ID NO: 4876368 - DNA, 18 bp, Homo sapiens
gtagaacgtaaccacgga

SEQ ID NO: 4876369 - DNA, 15 bp, Homo sapiens
gtagaattgcattga

SEQ ID NO: 4876370 - DNA, 16 bp, Homo sapiens
gtagaattgttataga

SEQ ID NO: 4876371 - DNA, 14 bp, Homo sapiens
gtagaccaaaataa

SEQ ID NO: 4876372 - DNA, 15 bp, Homo sapiens
gtagaccaaaataaa

SEQ ID NO: 4876373 - DNA, 16 bp, Homo sapiens
gtagaccaaaataaaa

SEQ ID NO: 4876374 - DNA, 15 bp, Homo sapiens
gtagactatatacat

SEQ ID NO: 4876375 - DNA, 17 bp, Homo sapiens
gtagactatatacatgt

SEQ ID NO: 4876376 - DNA, 11 bp, Homo sapiens
gtagagacagg

SEQ ID NO: 4876377 - DNA, 13 bp, Homo sapiens
gtagagacagggt

SEQ ID NO: 4876378 - DNA, 12 bp, Homo sapiens
gtagagccagct

SEQ ID NO: 4876379 - DNA, 18 bp, Homo sapiens
gtagagccagggtctcac

SEQ ID NO: 4876380 - DNA, 12 bp, Homo sapiens
gtagagttaaga

SEQ ID NO: 4876381 - DNA, 17 bp, Homo sapiens
gtagagttaagaagctg

SEQ ID NO: 4876382 - DNA, 15 bp, Homo sapiens
gtagatattacttta

SEQ ID NO: 4876383 - DNA, 18 bp, Homo sapiens
gtagatattactttatca

SEQ ID NO: 4876384 - DNA, 13 bp, Homo sapiens
gtagattctgtgg

SEQ ID NO: 4876385 - DNA, 19 bp, Homo sapiens
gtagattctgtggaacaag

SEQ ID NO: 4876386 - DNA, 23 bp, Homo sapiens
gtagcagtgtgaagtacaataat

SEQ ID NO: 4876387 - DNA, 14 bp, Homo sapiens
gtagccagcacctg

SEQ ID NO: 4876388 - DNA, 19 bp, Homo sapiens
gtagccagggggactagcc

SEQ ID NO: 4876389 - DNA, 16 bp, Homo sapiens
gtagccccctggcctc

SEQ ID NO: 4876390 - DNA, 17 bp, Homo sapiens
gtagccccctggcctct

SEQ ID NO: 4876391 - DNA, 19 bp, Homo sapiens
gtagccccctggcctctgt

SEQ ID NO: 4876392 - DNA, 14 bp, Homo sapiens
gtagccctttctgt

SEQ ID NO: 4876393 - DNA, 12 bp, Homo sapiens
gtagcctgtgca

SEQ ID NO: 4876394 - DNA, 13 bp, Homo sapiens
gtagcgtttttta

SEQ ID NO: 4876395 - DNA, 14 bp, Homo sapiens
gtagctgccacttg

SEQ ID NO: 4876396 - DNA, 20 bp, Homo sapiens
gtaggccttttaacattttg

SEQ ID NO: 4876397 - DNA, 13 bp, Homo sapiens
gtagggaggcagc

SEQ ID NO: 4876398 - DNA, 16 bp, Homo sapiens
gtagggaggcagcctc

SEQ ID NO: 4876399 - DNA, 22 bp, Homo sapiens
gtaggggcttataataaaggac

SEQ ID NO: 4876400 - DNA, 14 bp, Homo sapiens
gtaggtaaaatgta

SEQ ID NO: 4876401 - DNA, 20 bp, Homo sapiens
gtaggtaaaatgtatttttc

SEQ ID NO: 4876402 - DNA, 16 bp, Homo sapiens
gtagtataaagaaaag

SEQ ID NO: 4876403 - DNA, 21 bp, Homo sapiens
gtagtccttggcatagacatg

SEQ ID NO: 4876404 - DNA, 14 bp, Homo sapiens
gtagttaggaaata

SEQ ID NO: 4876405 - DNA, 20 bp, Homo sapiens
gtagttaggaaataaaacct

SEQ ID NO: 4876406 - DNA, 13 bp, Homo sapiens
gtataaacattaa

SEQ ID NO: 4876407 - DNA, 14 bp, Homo sapiens
gtataaacattaaa

SEQ ID NO: 4876408 - DNA, 19 bp, Homo sapiens
gtataaacattaaatgtct

SEQ ID NO: 4876409 - DNA, 18 bp, Homo sapiens
gtataaataggagaggat

SEQ ID NO: 4876410 - DNA, 13 bp, Homo sapiens
gtataaatgtata

SEQ ID NO: 4876411 - DNA, 16 bp, Homo sapiens
gtataaatgtatatac

SEQ ID NO: 4876412 - DNA, 18 bp, Homo sapiens
gtataaatgtatatacac

SEQ ID NO: 4876413 - DNA, 21 bp, Homo sapiens
gtataaatgtatatacacata

SEQ ID NO: 4876414 - DNA, 20 bp, Homo sapiens
gtataacttcttaaaagttg

SEQ ID NO: 4876415 - DNA, 14 bp, Homo sapiens
gtataagatcctag

SEQ ID NO: 4876416 - DNA, 22 bp, Homo sapiens
gtataagcactgaaaaacaaca

SEQ ID NO: 4876417 - DNA, 17 bp, Homo sapiens
gtataatttcgagattt

SEQ ID NO: 4876418 - DNA, 18 bp, Homo sapiens
gtataatttcgagatttg

SEQ ID NO: 4876419 - DNA, 19 bp, Homo sapiens
gtatacaaatatattgtta

SEQ ID NO: 4876420 - DNA, 19 bp, Homo sapiens
gtatacaaccctggcatta

SEQ ID NO: 4876421 - DNA, 17 bp, Homo sapiens
gtatacatcctgggtaa

SEQ ID NO: 4876422 - DNA, 20 bp, Homo sapiens
gtatacatcctgggtaatga

SEQ ID NO: 4876423 - DNA, 15 bp, Homo sapiens
gtatactatagtacc

SEQ ID NO: 4876424 - DNA, 12 bp, Homo sapiens
gtatactttaaa

SEQ ID NO: 4876425 - DNA, 19 bp, Homo sapiens
taagggtgggtgctcagaa

SEQ ID NO: 4876426 - DNA, 20 bp, Homo sapiens
taagggtgggtgctcagaat

SEQ ID NO: 4876427 - DNA, 21 bp, Homo sapiens
taaggtccggtgttctaagat

SEQ ID NO: 4876428 - DNA, 15 bp, Homo sapiens
taaggtgtgctctga

SEQ ID NO: 4876429 - DNA, 20 bp, Homo sapiens
taaggtttcgtttctgtata

SEQ ID NO: 4876430 - DNA, 22 bp, Homo sapiens
taagtaatgtggaagaaaatgg

SEQ ID NO: 4876431 - DNA, 18 bp, Homo sapiens
taagtacacaataagcaa

SEQ ID NO: 4876432 - DNA, 23 bp, Homo sapiens
taagtactgtaataatacctcaa

SEQ ID NO: 4876433 - DNA, 22 bp, Homo sapiens
taagtatatcatgtaaagaaat

SEQ ID NO: 4876434 - DNA, 20 bp, Homo sapiens
taagtatttaggtttttgtt

SEQ ID NO: 4876435 - DNA, 17 bp, Homo sapiens
taagtatttgaaactga

SEQ ID NO: 4876436 - DNA, 12 bp, Homo sapiens
taagtcagtgtt

SEQ ID NO: 4876437 - DNA, 14 bp, Homo sapiens
taagtcagtgttga

SEQ ID NO: 4876438 - DNA, 16 bp, Homo sapiens
taagtcagtgttgaga

SEQ ID NO: 4876439 - DNA, 17 bp, Homo sapiens
taagtcctttatgtgga

SEQ ID NO: 4876440 - DNA, 12 bp, Homo sapiens
taagtctctgtg

SEQ ID NO: 4876441 - DNA, 14 bp, Homo sapiens
taagtgaataataa

SEQ ID NO: 4876442 - DNA, 15 bp, Homo sapiens
taagtgcacacagaa

SEQ ID NO: 4876443 - DNA, 19 bp, Homo sapiens
taagtgcgtgtgtagagtt

SEQ ID NO: 4876444 - DNA, 19 bp, Homo sapiens
taagtggggcaaaaccttg

SEQ ID NO: 4876445 - DNA, 17 bp, Homo sapiens
taagtggtttgatcatt

SEQ ID NO: 4876446 - DNA, 14 bp, Homo sapiens
taagttataagact

SEQ ID NO: 4876447 - DNA, 16 bp, Homo sapiens
taagttcacattagaa

SEQ ID NO: 4876448 - DNA, 17 bp, Homo sapiens
taagttcacattagaat

SEQ ID NO: 4876449 - DNA, 22 bp, Homo sapiens
taagtttcaggtgacatgtgaa

SEQ ID NO: 4876450 - DNA, 20 bp, Homo sapiens
taagtttctaagattctaaa

SEQ ID NO: 4876451 - DNA, 21 bp, Homo sapiens
taagtttctaagattctaaag

SEQ ID NO: 4876452 - DNA, 12 bp, Homo sapiens
taagtttgaagg

SEQ ID NO: 4876453 - DNA, 19 bp, Homo sapiens
taataaaaaatggaaagaa

SEQ ID NO: 4876454 - DNA, 21 bp, Homo sapiens
taataaaaaatggaaagaatc

SEQ ID NO: 4876455 - DNA, 23 bp, Homo sapiens
taataaaaagctttttcctcctg

SEQ ID NO: 4876456 - DNA, 18 bp, Homo sapiens
taataaaataattctaaa

SEQ ID NO: 4876457 - DNA, 19 bp, Homo sapiens
taataaacataatgaaaat

SEQ ID NO: 4876458 - DNA, 14 bp, Homo sapiens
taataaactgtgtt

SEQ ID NO: 4876459 - DNA, 15 bp, Homo sapiens
taataaactgtgttt

SEQ ID NO: 4876460 - DNA, 13 bp, Homo sapiens
taataaaggactg

SEQ ID NO: 4876461 - DNA, 16 bp, Homo sapiens
taataaatacatacgg

SEQ ID NO: 4876462 - DNA, 21 bp, Homo sapiens
taataaattgtttggcttcct

SEQ ID NO: 4876463 - DNA, 20 bp, Homo sapiens
taataacattaccttactgt

SEQ ID NO: 4876464 - DNA, 21 bp, Homo sapiens
taataacattaccttactgtg

SEQ ID NO: 4876465 - DNA, 15 bp, Homo sapiens
taataactgtgaagt

SEQ ID NO: 4876466 - DNA, 22 bp, Homo sapiens
taataagacataacgtttttcc

SEQ ID NO: 4876467 - DNA, 13 bp, Homo sapiens
taataatgggttt

SEQ ID NO: 4876468 - DNA, 20 bp, Homo sapiens
taataattgctcataagcaa

SEQ ID NO: 4876469 - DNA, 19 bp, Homo sapiens
taaaatcttatagttctag

SEQ ID NO: 4876470 - DNA, 17 bp, Homo sapiens
taaaatcttggaagtac

SEQ ID NO: 4876471 - DNA, 16 bp, Homo sapiens
taaaatgactacttag

SEQ ID NO: 4876472 - DNA, 15 bp, Homo sapiens
taaaatgattgtaaa

SEQ ID NO: 4876473 - DNA, 17 bp, Homo sapiens
taaaatgattgtaaaat

SEQ ID NO: 4876474 - DNA, 22 bp, Homo sapiens
taaaatgattgtaaaatagctt

SEQ ID NO: 4876475 - DNA, 17 bp, Homo sapiens
taaaatgatttgtagtg

SEQ ID NO: 4876476 - DNA, 23 bp, Homo sapiens
taaaatgatttgtagtggaaaca

SEQ ID NO: 4876477 - DNA, 14 bp, Homo sapiens
taaaatgtattttt

SEQ ID NO: 4876478 - DNA, 17 bp, Homo sapiens
taaaatgtgatgttcta

SEQ ID NO: 4876479 - DNA, 20 bp, Homo sapiens
taaaatgtgatgttctaagg

SEQ ID NO: 4876480 - DNA, 22 bp, Homo sapiens
taaaatgtgatgttctaaggct

SEQ ID NO: 4876481 - DNA, 14 bp, Homo sapiens
taaaatgttgaata

SEQ ID NO: 4876482 - DNA, 22 bp, Homo sapiens
taaaattatcaatatctaatat

SEQ ID NO: 4876483 - DNA, 18 bp, Homo sapiens
taaacaaaatagaagctg

SEQ ID NO: 4876484 - DNA, 23 bp, Homo sapiens
taaacaaaatagaagctgtagta

SEQ ID NO: 4876485 - DNA, 13 bp, Homo sapiens
taaacaaacattg

SEQ ID NO: 4876486 - DNA, 13 bp, Homo sapiens
taaacaaactctt

SEQ ID NO: 4876487 - DNA, 17 bp, Homo sapiens
taaacaaattcatattc

SEQ ID NO: 4876488 - DNA, 21 bp, Homo sapiens
taaacaaattcatattctgtc

SEQ ID NO: 4876489 - DNA, 22 bp, Homo sapiens
taaacaaattcatattctgtct

SEQ ID NO: 4876490 - DNA, 24 bp, Homo sapiens
taaacaacattgagattatgatga

SEQ ID NO: 4876491 - DNA, 23 bp, Homo sapiens
taaacaatgatgccctgctccag

SEQ ID NO: 4876492 - DNA, 14 bp, Homo sapiens
taaacacacagata

SEQ ID NO: 4876493 - DNA, 21 bp, Homo sapiens
taaacacacagatacacacac

SEQ ID NO: 4876494 - DNA, 21 bp, Homo sapiens
taaacacagtcaaaataattc

SEQ ID NO: 4876495 - DNA, 16 bp, Homo sapiens
taaacagatgaataaa

SEQ ID NO: 4876496 - DNA, 17 bp, Homo sapiens
taaacagatgatgagaa

SEQ ID NO: 4876497 - DNA, 19 bp, Homo sapiens
taaacagatgatgagaatt

SEQ ID NO: 4876498 - DNA, 20 bp, Homo sapiens
taaacagatgatgagaattt

SEQ ID NO: 4876499 - DNA, 16 bp, Homo sapiens
tagagtccaaggttta

SEQ ID NO: 4876500 - DNA, 13 bp, Homo sapiens
tagagtcctcact

SEQ ID NO: 4876501 - DNA, 20 bp, Homo sapiens
tagagtgtagtttacagaaa

SEQ ID NO: 4876502 - DNA, 14 bp, Homo sapiens
tagagttcatccca

SEQ ID NO: 4876503 - DNA, 15 bp, Homo sapiens
tagagtttctgtttg

SEQ ID NO: 4876504 - DNA, 23 bp, Homo sapiens
tagagtttctgtttgattctttt

SEQ ID NO: 4876505 - DNA, 17 bp, Homo sapiens
tagagtttgctattaga

SEQ ID NO: 4876506 - DNA, 23 bp, Homo sapiens
tagatagggctgggcaaggaaaa

SEQ ID NO: 4876507 - DNA, 15 bp, Homo sapiens
tagatattactttat

SEQ ID NO: 4876508 - DNA, 12 bp, Homo sapiens
tagatatttggc

SEQ ID NO: 4876509 - DNA, 20 bp, Homo sapiens
tagatattttcacaatgtca

SEQ ID NO: 4876510 - DNA, 15 bp, Homo sapiens
tagatcataaggctt

SEQ ID NO: 4876511 - DNA, 21 bp, Homo sapiens
tagatcataaggcttcaaaat

SEQ ID NO: 4876512 - DNA, 13 bp, Homo sapiens
tagatcttctgaa

SEQ ID NO: 4876513 - DNA, 16 bp, Homo sapiens
tagatcttctgaaatg

SEQ ID NO: 4876514 - DNA, 21 bp, Homo sapiens
tagatgagattgttttatcat

SEQ ID NO: 4876515 - DNA, 23 bp, Homo sapiens
tagatgagcccagccctgttctg

SEQ ID NO: 4876516 - DNA, 19 bp, Homo sapiens
tagatgattaaataagatt

SEQ ID NO: 4876517 - DNA, 14 bp, Homo sapiens
tagatggtgaaatt

SEQ ID NO: 4876518 - DNA, 21 bp, Homo sapiens
tagatgtctaggtacttcagg

SEQ ID NO: 4876519 - DNA, 21 bp, Homo sapiens
tagatgttttggtagattaaa

SEQ ID NO: 4876520 - DNA, 15 bp, Homo sapiens
tagattaaatataga

SEQ ID NO: 4876521 - DNA, 22 bp, Homo sapiens
tagattaaatatagattagaaa

SEQ ID NO: 4876522 - DNA, 16 bp, Homo sapiens
tagattaatggcactg

SEQ ID NO: 4876523 - DNA, 13 bp, Homo sapiens
tagattcaaaggt

SEQ ID NO: 4876524 - DNA, 15 bp, Homo sapiens
tagattcaaaggttc

SEQ ID NO: 4876525 - DNA, 18 bp, Homo sapiens
tagattcaaaggttctag

SEQ ID NO: 4876526 - DNA, 21 bp, Homo sapiens
tagattccattggtccaagat

SEQ ID NO: 4876527 - DNA, 22 bp, Homo sapiens
tagattctctggctgtaaggct

SEQ ID NO: 4876528 - DNA, 23 bp, Homo sapiens
tagattctctggctgtaaggctc

SEQ ID NO: 4876529 - DNA, 22 bp, Homo sapiens
tagattctctgtgtctaagatt

SEQ ID NO: 4876530 - DNA, 23 bp, Homo sapiens
tagattctctgtgtctaagattc

SEQ ID NO: 4876531 - DNA, 23 bp, Homo sapiens
tagattctcttgtataagatcct

SEQ ID NO: 4876532 - DNA, 17 bp, Homo sapiens
tagattttattttacta

SEQ ID NO: 4876533 - DNA, 12 bp, Homo sapiens
tagcaacaggaa

SEQ ID NO: 4876534 - DNA, 17 bp, Homo sapiens
tagcaacttttgtgtaa

SEQ ID NO: 4876535 - DNA, 15 bp, Homo sapiens
tagcaagctggcctc

SEQ ID NO: 4876536 - DNA, 17 bp, Homo sapiens
tagcaaggtcatttctt

SEQ ID NO: 4876537 - DNA, 14 bp, Homo sapiens
tagcacagatttta

SEQ ID NO: 4876538 - DNA, 22 bp, Homo sapiens
tagcacagattttaattgtcat

SEQ ID NO: 4876539 - DNA, 16 bp, Homo sapiens
tagcactaggcaccca

SEQ ID NO: 4876540 - DNA, 19 bp, Homo sapiens
tagcactcattttctataa

SEQ ID NO: 4876541 - DNA, 11 bp, Homo sapiens
tagcactgttg

SEQ ID NO: 4876542 - DNA, 17 bp, Homo sapiens
tagcactgttgatgtat

SEQ ID NO: 4876543 - DNA, 20 bp, Homo sapiens
tagcactgttgatgtatctg

SEQ ID NO: 4876544 - DNA, 23 bp, Homo sapiens
tagcactgttgatgtatctgagt

SEQ ID NO: 4876545 - DNA, 15 bp, Homo sapiens
tagcactttgaaata

SEQ ID NO: 4876546 - DNA, 19 bp, Homo sapiens
tagcagagaatgaaagggc

SEQ ID NO: 4876547 - DNA, 23 bp, Homo sapiens
tagcagattgtttcctcttccaa

SEQ ID NO: 4876548 - DNA, 17 bp, Homo sapiens
tagcagcaaaaatataa

SEQ ID NO: 4876549 - DNA, 16 bp, Homo sapiens
tagcatcctaagaaat

SEQ ID NO: 4876550 - DNA, 22 bp, Homo sapiens
tagcattacccccaacctcatt

SEQ ID NO: 4876551 - DNA, 14 bp, Homo sapiens
tagcatttttgatt

SEQ ID NO: 4876552 - DNA, 20 bp, Homo sapiens
tagcatttttgatttatgca

SEQ ID NO: 4876553 - DNA, 22 bp, Homo sapiens
tagccactagtaagtaattatg

SEQ ID NO: 4876554 - DNA, 15 bp, Homo sapiens
tagccaggatcatgg

SEQ ID NO: 4876555 - DNA, 22 bp, Homo sapiens
tagccaggatcatggtgtaata

SEQ ID NO: 4876556 - DNA, 15 bp, Homo sapiens
tagcccaggagagag

SEQ ID NO: 4876557 - DNA, 17 bp, Homo sapiens
tagcccaggagagagaa

SEQ ID NO: 4876558 - DNA, 14 bp, Homo sapiens
tagcccatccctgc

SEQ ID NO: 4876559 - DNA, 16 bp, Homo sapiens
tagccccctggcctct

SEQ ID NO: 4876560 - DNA, 17 bp, Homo sapiens
tagccccctggcctctg

SEQ ID NO: 4876561 - DNA, 18 bp, Homo sapiens
tagccccctggcctctgt

SEQ ID NO: 4876562 - DNA, 16 bp, Homo sapiens
tagcctaggtgacaga

SEQ ID NO: 4876563 - DNA, 13 bp, Homo sapiens
tagcctccctgaa

SEQ ID NO: 4876564 - DNA, 16 bp, Homo sapiens
tagcctttggctctgg

SEQ ID NO: 4876565 - DNA, 14 bp, Homo sapiens
tagcgcccagttgg

SEQ ID NO: 4876566 - DNA, 13 bp, Homo sapiens
tagcgctgttttt

SEQ ID NO: 4876567 - DNA, 16 bp, Homo sapiens
tagcgttttttaaatg

SEQ ID NO: 4876568 - DNA, 18 bp, Homo sapiens
tagctaaacggattccaa

SEQ ID NO: 4876569 - DNA, 19 bp, Homo sapiens
tagctaaacggattccaaa

SEQ ID NO: 4876570 - DNA, 24 bp, Homo sapiens
tagctaataatgagctattaaaac

SEQ ID NO: 4876571 - DNA, 15 bp, Homo sapiens
tagctaataatgtta

SEQ ID NO: 4876572 - DNA, 20 bp, Homo sapiens
tagctacccaaaagagaaaa

SEQ ID NO: 4876573 - DNA, 21 bp, Homo sapiens
tagctacccaaaagagaaaaa

SEQ ID NO: 4876574 - DNA, 21 bp, Homo sapiens
tagctatcagaagaccacaaa

SEQ ID NO: 4876575 - DNA, 13 bp, Homo sapiens
tagctattactgt

SEQ ID NO: 4876576 - DNA, 16 bp, Homo sapiens
tagctcaggtgtccct

SEQ ID NO: 4876577 - DNA, 20 bp, Homo sapiens
gccaaagccaaagctaggcc

SEQ ID NO: 4876578 - DNA, 20 bp, Homo sapiens
gccaaagctagggtggccct

SEQ ID NO: 4876579 - DNA, 17 bp, Homo sapiens
gccaaatccgctctctt

SEQ ID NO: 4876580 - DNA, 23 bp, Homo sapiens
gccaaatccgctctcttcctgcc

SEQ ID NO: 4876581 - DNA, 15 bp, Homo sapiens
gccaaattatttgtg

SEQ ID NO: 4876582 - DNA, 13 bp, Homo sapiens
gccaaatttatca

SEQ ID NO: 4876583 - DNA, 12 bp, Homo sapiens
gccaactgttgt

SEQ ID NO: 4876584 - DNA, 15 bp, Homo sapiens
gccaacttgagggcc

SEQ ID NO: 4876585 - DNA, 20 bp, Homo sapiens
gccaacttgagggcccagag

SEQ ID NO: 4876586 - DNA, 23 bp, Homo sapiens
gccaacttgagggcccagagcag

SEQ ID NO: 4876587 - DNA, 13 bp, Homo sapiens
gccaagacaaatc

SEQ ID NO: 4876588 - DNA, 22 bp, Homo sapiens
gccaagacaaatcaacagaagc

SEQ ID NO: 4876589 - DNA, 12 bp, Homo sapiens
gccaagacttgg

SEQ ID NO: 4876590 - DNA, 18 bp, Homo sapiens
gccaagacttggcaacag

SEQ ID NO: 4876591 - DNA, 22 bp, Homo sapiens
gccaagacttggcaacagaagc

SEQ ID NO: 4876592 - DNA, 22 bp, Homo sapiens
gccaagagaaaggcctgcacac

SEQ ID NO: 4876593 - DNA, 22 bp, Homo sapiens
gccaagcacctagcctcgctct

SEQ ID NO: 4876594 - DNA, 18 bp, Homo sapiens
gccaaggccttctcctcc

SEQ ID NO: 4876595 - DNA, 21 bp, Homo sapiens
gccaaggggagtcaccttccc

SEQ ID NO: 4876596 - DNA, 22 bp, Homo sapiens
gccaaggtctgagccacagcag

SEQ ID NO: 4876597 - DNA, 21 bp, Homo sapiens
gccaagtccgcagaagccctg

SEQ ID NO: 4876598 - DNA, 18 bp, Homo sapiens
gccaagtgccaaatgctc

SEQ ID NO: 4876599 - DNA, 23 bp, Homo sapiens
gccaagtgcgtgccgtgtgagtg

SEQ ID NO: 4876600 - DNA, 21 bp, Homo sapiens
gccaatccctcaccttctgag

SEQ ID NO: 4876601 - DNA, 16 bp, Homo sapiens
gccaatgcacggcctc

SEQ ID NO: 4876602 - DNA, 14 bp, Homo sapiens
gccacaagaaattt

SEQ ID NO: 4876603 - DNA, 16 bp, Homo sapiens
gccacaagaaatttga

SEQ ID NO: 4876604 - DNA, 23 bp, Homo sapiens
gccacaagaaatttgatttctat

SEQ ID NO: 4876605 - DNA, 16 bp, Homo sapiens
gccacaagtcttccag

SEQ ID NO: 4876606 - DNA, 13 bp, Homo sapiens
gccacaccctccc

SEQ ID NO: 4876607 - DNA, 22 bp, Homo sapiens
gccacaccctcccccgccactc

SEQ ID NO: 4876608 - DNA, 17 bp, Homo sapiens
gccacactctccatcac

SEQ ID NO: 4876609 - DNA, 18 bp, Homo sapiens
gccacactctccatcacc

SEQ ID NO: 4876610 - DNA, 20 bp, Homo sapiens
gccacacttcaggctcttct

SEQ ID NO: 4876611 - DNA, 15 bp, Homo sapiens
gccacagcagcattt

SEQ ID NO: 4876612 - DNA, 12 bp, Homo sapiens
gccacatttaat

SEQ ID NO: 4876613 - DNA, 19 bp, Homo sapiens
gccacatttggaatacttt

SEQ ID NO: 4876614 - DNA, 19 bp, Homo sapiens
gccaccaaagctgcccact

SEQ ID NO: 4876615 - DNA, 20 bp, Homo sapiens
gccaccaaagctgcccactg

SEQ ID NO: 4876616 - DNA, 14 bp, Homo sapiens
gccaccacgtccag

SEQ ID NO: 4876617 - DNA, 22 bp, Homo sapiens
gccaccagagaccgtcctcacc

SEQ ID NO: 4876618 - DNA, 23 bp, Homo sapiens
gccaccagagaccgtcctcaccc

SEQ ID NO: 4876619 - DNA, 18 bp, Homo sapiens
gccaccatggccagccaa

SEQ ID NO: 4876620 - DNA, 22 bp, Homo sapiens
gccaccccaccctccctggagt

SEQ ID NO: 4876621 - DNA, 18 bp, Homo sapiens
gccaccccgggctctctg

SEQ ID NO: 4876622 - DNA, 21 bp, Homo sapiens
gccaccccgggctctctgctg

SEQ ID NO: 4876623 - DNA, 13 bp, Homo sapiens
gccaccctgggga

SEQ ID NO: 4876624 - DNA, 19 bp, Homo sapiens
gccaccctggggagaaagt

SEQ ID NO: 4876625 - DNA, 20 bp, Homo sapiens
gccacctccctgacccgtct

SEQ ID NO: 4876626 - DNA, 13 bp, Homo sapiens
gccacctctctcc

SEQ ID NO: 4876627 - DNA, 14 bp, Homo sapiens
gccacctctgcgga

SEQ ID NO: 4876628 - DNA, 10 bp, Homo sapiens
gccacctgcc

SEQ ID NO: 4876629 - DNA, 14 bp, Homo sapiens
gccacctgcctgcg

SEQ ID NO: 4876630 - DNA, 22 bp, Homo sapiens
gccacctgcctgcgtcttccgc

SEQ ID NO: 4876631 - DNA, 18 bp, Homo sapiens
gccactaattttagtatt

SEQ ID NO: 4876632 - DNA, 15 bp, Homo sapiens
gccactcagcttcct

SEQ ID NO: 4876633 - DNA, 18 bp, Homo sapiens
gccactctcttccctttc

SEQ ID NO: 4876634 - DNA, 20 bp, Homo sapiens
gccactgcaccgggccacag

SEQ ID NO: 4876635 - DNA, 21 bp, Homo sapiens
gccactgcaccgggccacaga

SEQ ID NO: 4876636 - DNA, 16 bp, Homo sapiens
gccactgcctcttcct

SEQ ID NO: 4876637 - DNA, 17 bp, Homo sapiens
gccactgcctcttcctc

SEQ ID NO: 4876638 - DNA, 17 bp, Homo sapiens
gccactttaagagagaa

SEQ ID NO: 4876639 - DNA, 19 bp, Homo sapiens
gccactttaagagagaaat

SEQ ID NO: 4876640 - DNA, 20 bp, Homo sapiens
gccactttacccacctagaa

SEQ ID NO: 4876641 - DNA, 23 bp, Homo sapiens
gccactttacccacctagaacac

SEQ ID NO: 4876642 - DNA, 18 bp, Homo sapiens
gccagaagatcccctcag

SEQ ID NO: 4876643 - DNA, 15 bp, Homo sapiens
gccagaatcagcaca

SEQ ID NO: 4876644 - DNA, 22 bp, Homo sapiens
gccagaatcagcacagataaaa

SEQ ID NO: 4876645 - DNA, 21 bp, Homo sapiens
gccagaggaactgtccagaga

SEQ ID NO: 4876646 - DNA, 18 bp, Homo sapiens
gccagaggaatcctggca

SEQ ID NO: 4876647 - DNA, 21 bp, Homo sapiens
gccagaggaatcctggcagcc

SEQ ID NO: 4876648 - DNA, 23 bp, Homo sapiens
gccagagggagtgacagaggcag

SEQ ID NO: 4876649 - DNA, 15 bp, Homo sapiens
gccagagggcttgtg

SEQ ID NO: 4876650 - DNA, 19 bp, Homo sapiens
gccagagggcttgtgaaca

SEQ ID NO: 4876651 - DNA, 17 bp, Homo sapiens
gccagagtcctttccaa

SEQ ID NO: 4876652 - DNA, 14 bp, Homo sapiens
gccagagtggcctg

SEQ ID NO: 4876653 - DNA, 22 bp, Homo sapiens
gccagagtggcctggccaggag

SEQ ID NO: 4876654 - DNA, 23 bp, Homo sapiens
gccagagtggcctggccaggagc

SEQ ID NO: 4876655 - DNA, 16 bp, Homo sapiens
gccagatcctcttggt

SEQ ID NO: 4876656 - DNA, 14 bp, Homo sapiens
gccagatcttaggt

SEQ ID NO: 4876657 - DNA, 16 bp, Homo sapiens
gccagcaacacagagc

SEQ ID NO: 4876658 - DNA, 17 bp, Homo sapiens
gccagcaacacagagca

SEQ ID NO: 4876659 - DNA, 16 bp, Homo sapiens
gccagcacttgtatat

SEQ ID NO: 4876660 - DNA, 13 bp, Homo sapiens
gccagcagcagca

SEQ ID NO: 4876661 - DNA, 15 bp, Homo sapiens
gccagcagcagcagg

SEQ ID NO: 4876662 - DNA, 17 bp, Homo sapiens
gccagccccacccagga

SEQ ID NO: 4876663 - DNA, 18 bp, Homo sapiens
gccagccccacccaggag

SEQ ID NO: 4876664 - DNA, 21 bp, Homo sapiens
gccagcccggccgctccacca

SEQ ID NO: 4876665 - DNA, 16 bp, Homo sapiens
gccagcctggggcctg

SEQ ID NO: 4876666 - DNA, 13 bp, Homo sapiens
gaggatgtccctg

SEQ ID NO: 4876667 - DNA, 18 bp, Homo sapiens
gaggatgtccctgggcca

SEQ ID NO: 4876668 - DNA, 20 bp, Homo sapiens
gaggatgtccctgggccagg

SEQ ID NO: 4876669 - DNA, 17 bp, Homo sapiens
gaggatgttctgggaca

SEQ ID NO: 4876670 - DNA, 23 bp, Homo sapiens
gaggcaatgtcaggaacagaagg

SEQ ID NO: 4876671 - DNA, 23 bp, Homo sapiens
gaggcagccccattctgcctgcc

SEQ ID NO: 4876672 - DNA, 19 bp, Homo sapiens
gaggcagggtctcactctg

SEQ ID NO: 4876673 - DNA, 16 bp, Homo sapiens
gaggccagccccaccc

SEQ ID NO: 4876674 - DNA, 22 bp, Homo sapiens
gaggccaggagtttgagaccag

SEQ ID NO: 4876675 - DNA, 21 bp, Homo sapiens
gaggccatgggcctcctgtgt

SEQ ID NO: 4876676 - DNA, 15 bp, Homo sapiens
gaggccccactgatg

SEQ ID NO: 4876677 - DNA, 18 bp, Homo sapiens
gaggccccactgatgctg

SEQ ID NO: 4876678 - DNA, 13 bp, Homo sapiens
gaggcccctggac

SEQ ID NO: 4876679 - DNA, 17 bp, Homo sapiens
gaggccccttctctccc

SEQ ID NO: 4876680 - DNA, 14 bp, Homo sapiens
gaggccctcctgtg

SEQ ID NO: 4876681 - DNA, 21 bp, Homo sapiens
gaggccctcctgtgctggggg

SEQ ID NO: 4876682 - DNA, 12 bp, Homo sapiens
gaggcctgcccg

SEQ ID NO: 4876683 - DNA, 13 bp, Homo sapiens
gaggcctgcccgg

SEQ ID NO: 4876684 - DNA, 14 bp, Homo sapiens
gaggccttccagct

SEQ ID NO: 4876685 - DNA, 22 bp, Homo sapiens
gaggcgcccttggcttctgtga

SEQ ID NO: 4876686 - DNA, 20 bp, Homo sapiens
gaggctattattttcactgt

SEQ ID NO: 4876687 - DNA, 14 bp, Homo sapiens
gaggctgcagtcag

SEQ ID NO: 4876688 - DNA, 22 bp, Homo sapiens
gaggctgcccccggccccctgg

SEQ ID NO: 4876689 - DNA, 20 bp, Homo sapiens
gaggctgtgtgcctggggga

SEQ ID NO: 4876690 - DNA, 11 bp, Homo sapiens
gaggctttgtg

SEQ ID NO: 4876691 - DNA, 15 bp, Homo sapiens
gagggaaaagggaag

SEQ ID NO: 4876692 - DNA, 21 bp, Homo sapiens
gagggaatccccgaaggtgct

SEQ ID NO: 4876693 - DNA, 19 bp, Homo sapiens
gagggactctgaagcctct

SEQ ID NO: 4876694 - DNA, 21 bp, Homo sapiens
gagggactctgaagcctctgg

SEQ ID NO: 4876695 - DNA, 22 bp, Homo sapiens
gagggactctgaagcctctggg

SEQ ID NO: 4876696 - DNA, 23 bp, Homo sapiens
gagggactctgaagcctctggga

SEQ ID NO: 4876697 - DNA, 15 bp, Homo sapiens
gagggactgcctctg

SEQ ID NO: 4876698 - DNA, 16 bp, Homo sapiens
gagggactgcctctgc

SEQ ID NO: 4876699 - DNA, 15 bp, Homo sapiens
gagggaggacctggg

SEQ ID NO: 4876700 - DNA, 13 bp, Homo sapiens
gagggagggggct

SEQ ID NO: 4876701 - DNA, 13 bp, Homo sapiens
gagggagtgacag

SEQ ID NO: 4876702 - DNA, 14 bp, Homo sapiens
gagggatgggcctg

SEQ ID NO: 4876703 - DNA, 15 bp, Homo sapiens
gagggatgggcctgg

SEQ ID NO: 4876704 - DNA, 18 bp, Homo sapiens
gagggcactggtggcccg

SEQ ID NO: 4876705 - DNA, 23 bp, Homo sapiens
gagggcagaaaggttctgcccgg

SEQ ID NO: 4876706 - DNA, 13 bp, Homo sapiens
gagggcccagagc

SEQ ID NO: 4876707 - DNA, 22 bp, Homo sapiens
gagggcccagagcaggaagcat

SEQ ID NO: 4876708 - DNA, 22 bp, Homo sapiens
gagggcctcaaaggcccgctct

SEQ ID NO: 4876709 - DNA, 16 bp, Homo sapiens
gagggcggagccggcc

SEQ ID NO: 4876710 - DNA, 14 bp, Homo sapiens
gaggggaagtccct

SEQ ID NO: 4876711 - DNA, 12 bp, Homo sapiens
gaggggactctg

SEQ ID NO: 4876712 - DNA, 12 bp, Homo sapiens
gaggggagaagc

SEQ ID NO: 4876713 - DNA, 17 bp, Homo sapiens
gaggggcatctgcccct

SEQ ID NO: 4876714 - DNA, 18 bp, Homo sapiens
gaggggcctggcagccgt

SEQ ID NO: 4876715 - DNA, 19 bp, Homo sapiens
gaggggctctcagctcagc

SEQ ID NO: 4876716 - DNA, 14 bp, Homo sapiens
gagggggagaaaag

SEQ ID NO: 4876717 - DNA, 19 bp, Homo sapiens
gagggtcaggactgtgact

SEQ ID NO: 4876718 - DNA, 13 bp, Homo sapiens
gagggtctgagga

SEQ ID NO: 4876719 - DNA, 19 bp, Homo sapiens
gagggtgggggccacctgc

SEQ ID NO: 4876720 - DNA, 22 bp, Homo sapiens
gagggtgggggccacctgcctg

SEQ ID NO: 4876721 - DNA, 14 bp, Homo sapiens
gagggtggtgacct

SEQ ID NO: 4876722 - DNA, 21 bp, Homo sapiens
gagggtggtgacctctgcctg

SEQ ID NO: 4876723 - DNA, 21 bp, Homo sapiens
gcacccccctgttctaagggg

SEQ ID NO: 4876724 - DNA, 14 bp, Homo sapiens
gcaccccgctgcgg

SEQ ID NO: 4876725 - DNA, 15 bp, Homo sapiens
gcacccggcccctgc

SEQ ID NO: 4876726 - DNA, 19 bp, Homo sapiens
gcacccggcccctgctggt

SEQ ID NO: 4876727 - DNA, 15 bp, Homo sapiens
gcaccctggggcctg

SEQ ID NO: 4876728 - DNA, 20 bp, Homo sapiens
gcaccctggggcctggacct

SEQ ID NO: 4876729 - DNA, 17 bp, Homo sapiens
gcaccctgtggccctgg

SEQ ID NO: 4876730 - DNA, 22 bp, Homo sapiens
gcaccgcttttgttctcgcaaa

SEQ ID NO: 4876731 - DNA, 14 bp, Homo sapiens
gcaccgggccacag

SEQ ID NO: 4876732 - DNA, 19 bp, Homo sapiens
gcacctaaaccaccagtgc

SEQ ID NO: 4876733 - DNA, 21 bp, Homo sapiens
gcacctaaaccaccagtgccc

SEQ ID NO: 4876734 - DNA, 15 bp, Homo sapiens
gcacctaccatcagg

SEQ ID NO: 4876735 - DNA, 23 bp, Homo sapiens
gcacctaccatcagggacaggat

SEQ ID NO: 4876736 - DNA, 13 bp, Homo sapiens
gcacctcagcctg

SEQ ID NO: 4876737 - DNA, 14 bp, Homo sapiens
gcacctcctgcctc

SEQ ID NO: 4876738 - DNA, 15 bp, Homo sapiens
gcacctcctgcctcg

SEQ ID NO: 4876739 - DNA, 20 bp, Homo sapiens
gcaccttgtgtctgtacacg

SEQ ID NO: 4876740 - DNA, 14 bp, Homo sapiens
gcacgacgccctct

SEQ ID NO: 4876741 - DNA, 16 bp, Homo sapiens
gcacgacgccctctcc

SEQ ID NO: 4876742 - DNA, 21 bp, Homo sapiens
gcacgacgccctctccccacc

SEQ ID NO: 4876743 - DNA, 12 bp, Homo sapiens
gcacgcacacac

SEQ ID NO: 4876744 - DNA, 13 bp, Homo sapiens
gcacgcacacaca

SEQ ID NO: 4876745 - DNA, 16 bp, Homo sapiens
gcacgcacacacacaa

SEQ ID NO: 4876746 - DNA, 18 bp, Homo sapiens
gcacggcctcgcgtctgt

SEQ ID NO: 4876747 - DNA, 15 bp, Homo sapiens
gcacgtggagagctg

SEQ ID NO: 4876748 - DNA, 16 bp, Homo sapiens
gcacgtggagagctgg

SEQ ID NO: 4876749 - DNA, 18 bp, Homo sapiens
gcacgtggagagctggtg

SEQ ID NO: 4876750 - DNA, 21 bp, Homo sapiens
gcactaaagccagcctgacct

SEQ ID NO: 4876751 - DNA, 23 bp, Homo sapiens
gcactaaagccagcctgaccttc

SEQ ID NO: 4876752 - DNA, 20 bp, Homo sapiens
gcactaacgttgagcccctg

SEQ ID NO: 4876753 - DNA, 19 bp, Homo sapiens
gcactaatttgatgtttac

SEQ ID NO: 4876754 - DNA, 12 bp, Homo sapiens
gcactactgggt

SEQ ID NO: 4876755 - DNA, 23 bp, Homo sapiens
gcagtccctgagaccatttaaca

SEQ ID NO: 4876756 - DNA, 18 bp, Homo sapiens
gcagtcctgcctcagcct

SEQ ID NO: 4876757 - DNA, 22 bp, Homo sapiens
gcagtcctttgtaaacagtgtt

SEQ ID NO: 4876758 - DNA, 18 bp, Homo sapiens
gcagtctcctctttaaaa

SEQ ID NO: 4876759 - DNA, 21 bp, Homo sapiens
gcagtctcctctttaaaacaa

SEQ ID NO: 4876760 - DNA, 23 bp, Homo sapiens
gcagtctcctctttaaaacaaaa

SEQ ID NO: 4876761 - DNA, 22 bp, Homo sapiens
gcagtgagaaaaagctcctgtc

SEQ ID NO: 4876762 - DNA, 20 bp, Homo sapiens
gcagtgagtgagcctggctc

SEQ ID NO: 4876763 - DNA, 19 bp, Homo sapiens
gcagtgctagtgagctggg

SEQ ID NO: 4876764 - DNA, 15 bp, Homo sapiens
gcagtgggagctgcc

SEQ ID NO: 4876765 - DNA, 18 bp, Homo sapiens
gcagtgggctcctggcag

SEQ ID NO: 4876766 - DNA, 18 bp, Homo sapiens
gcagtggtgcgatctggg

SEQ ID NO: 4876767 - DNA, 19 bp, Homo sapiens
gcagtggtgcgatctgggt

SEQ ID NO: 4876768 - DNA, 19 bp, Homo sapiens
gcagtgtgaagtacaataa

SEQ ID NO: 4876769 - DNA, 22 bp, Homo sapiens
gcagtgttcgcttggctccatg

SEQ ID NO: 4876770 - DNA, 13 bp, Homo sapiens
gcagttgtgtcag

SEQ ID NO: 4876771 - DNA, 12 bp, Homo sapiens
gcataaactgtt

SEQ ID NO: 4876772 - DNA, 13 bp, Homo sapiens
gcataaatatgca

SEQ ID NO: 4876773 - DNA, 21 bp, Homo sapiens
gcatacagaaatataataaaa

SEQ ID NO: 4876774 - DNA, 22 bp, Homo sapiens
gcatactgagccaagtataatt

SEQ ID NO: 4876775 - DNA, 19 bp, Homo sapiens
gcatataggtgatgtttgc

SEQ ID NO: 4876776 - DNA, 18 bp, Homo sapiens
gcatatgttgaatacttt

SEQ ID NO: 4876777 - DNA, 20 bp, Homo sapiens
gcatatgttgaatacttttt

SEQ ID NO: 4876778 - DNA, 21 bp, Homo sapiens
gcatatgttgaatacttttta

SEQ ID NO: 4876779 - DNA, 22 bp, Homo sapiens
gcatattcttttctgcaaaata

SEQ ID NO: 4876780 - DNA, 15 bp, Homo sapiens
gcatcacctctgtaa

SEQ ID NO: 4876781 - DNA, 16 bp, Homo sapiens
gcatcacctgcctgtt

SEQ ID NO: 4876782 - DNA, 21 bp, Homo sapiens
gcatcactccccaaggaagag

SEQ ID NO: 4876783 - DNA, 24 bp, Homo sapiens
gcatcagggggaagaagcagagag

SEQ ID NO: 4876784 - DNA, 15 bp, Homo sapiens
gcatccaatctcaag

SEQ ID NO: 4876785 - DNA, 15 bp, Homo sapiens
gcatccagttaacca

SEQ ID NO: 4876786 - DNA, 15 bp, Homo sapiens
gcatcccagcacctg

SEQ ID NO: 4876787 - DNA, 20 bp, Homo sapiens
gcatcccagcacctgcctcc

SEQ ID NO: 4876788 - DNA, 13 bp, Homo sapiens
gcatcccggagga

SEQ ID NO: 4876789 - DNA, 16 bp, Homo sapiens
gcatcccggaggaaat

SEQ ID NO: 4876790 - DNA, 18 bp, Homo sapiens
gcatccctgaggagccag

SEQ ID NO: 4876791 - DNA, 13 bp, Homo sapiens
gcatcctaagaaa

SEQ ID NO: 4876792 - DNA, 24 bp, Homo sapiens
gcatcctaagaaatatgtgagatt

SEQ ID NO: 4876793 - DNA, 21 bp, Homo sapiens
gcatcctgagccccgccctct

SEQ ID NO: 4876794 - DNA, 13 bp, Homo sapiens
gcatcctggcacc

SEQ ID NO: 4876795 - DNA, 14 bp, Homo sapiens
gcatcctggcaccc

SEQ ID NO: 4876796 - DNA, 23 bp, Homo sapiens
gcatcctggcacccggcccctgc

SEQ ID NO: 4876797 - DNA, 13 bp, Homo sapiens
gcatccttcctat

SEQ ID NO: 4876798 - DNA, 12 bp, Homo sapiens
gcatctcagccc

SEQ ID NO: 4876799 - DNA, 21 bp, Homo sapiens
gcatctcttgaggccaggagt

SEQ ID NO: 4876800 - DNA, 15 bp, Homo sapiens
gcatctgcccctccc

SEQ ID NO: 4876801 - DNA, 17 bp, Homo sapiens
gcatctgcccctccccc

SEQ ID NO: 4876802 - DNA, 15 bp, Homo sapiens
gcatctgtgatggga

SEQ ID NO: 4876803 - DNA, 13 bp, Homo sapiens
gcatctttgcctt

SEQ ID NO: 4876804 - DNA, 18 bp, Homo sapiens
gcatctttgccttgggct

SEQ ID NO: 4876805 - DNA, 15 bp, Homo sapiens
gcatgaagagcaaaa

SEQ ID NO: 4876806 - DNA, 13 bp, Homo sapiens
gcatgacagcctc

SEQ ID NO: 4876807 - DNA, 20 bp, Homo sapiens
gcatgacataacagtgcagg

SEQ ID NO: 4876808 - DNA, 18 bp, Homo sapiens
gcatgccccggccacctc

SEQ ID NO: 4876809 - DNA, 21 bp, Homo sapiens
gcatgccccggccacctctgc

SEQ ID NO: 4876810 - DNA, 22 bp, Homo sapiens
gcatgccccggccacctctgcg

SEQ ID NO: 4876811 - DNA, 11 bp, Homo sapiens
gcatgcctctg

SEQ ID NO: 4876812 - DNA, 13 bp, Homo sapiens
gcatgcctgagag

SEQ ID NO: 4876813 - DNA, 14 bp, Homo sapiens
gcatggatttctgt

SEQ ID NO: 4876814 - DNA, 13 bp, Homo sapiens
gcatggccaggtg

SEQ ID NO: 4876815 - DNA, 18 bp, Homo sapiens
gcatggctccagaaatgt

SEQ ID NO: 4876816 - DNA, 17 bp, Homo sapiens
gcatggctttatttgtt

SEQ ID NO: 4876817 - DNA, 22 bp, Homo sapiens
gcatgggcctggccacctctct

SEQ ID NO: 4876818 - DNA, 18 bp, Homo sapiens
gcatggggggtgggggga

SEQ ID NO: 4876819 - DNA, 18 bp, Homo sapiens
gcatggtaccagccctgg

SEQ ID NO: 4876820 - DNA, 14 bp, Homo sapiens
gcatgtatgtcttg

SEQ ID NO: 4876821 - DNA, 15 bp, Homo sapiens
gcatgtatgtcttgg

SEQ ID NO: 4876822 - DNA, 14 bp, Homo sapiens
gcatgtcaaacatg

SEQ ID NO: 4876823 - DNA, 21 bp, Homo sapiens
gcatgtcagacagaacttgaa

SEQ ID NO: 4876824 - DNA, 20 bp, Homo sapiens
gcatgtgatcacgcctggct

SEQ ID NO: 4876825 - DNA, 14 bp, Homo sapiens
gcatgtgccctcct

SEQ ID NO: 4876826 - DNA, 19 bp, Homo sapiens
gcatgtgccctcctgaggg

SEQ ID NO: 4876827 - DNA, 14 bp, Homo sapiens
gcatgtgtgtgtgt

SEQ ID NO: 4876828 - DNA, 22 bp, Homo sapiens
gcatgttctctgaggacactaa

SEQ ID NO: 4876829 - DNA, 14 bp, Homo sapiens
gcatgtttgaaatg

SEQ ID NO: 4876830 - DNA, 18 bp, Homo sapiens
gcatgttttgtatacaaa

SEQ ID NO: 4876831 - DNA, 20 bp, Homo sapiens
gcatgttttgtatacaaata

SEQ ID NO: 4876832 - DNA, 18 bp, Homo sapiens
gcatgttttgtgcatttg

SEQ ID NO: 4876833 - DNA, 12 bp, Homo sapiens
gcattaaacctg

SEQ ID NO: 4876834 - DNA, 13 bp, Homo sapiens
gcattaaacctgt

SEQ ID NO: 4876835 - DNA, 22 bp, Homo sapiens
gcattaaacctgtctccactgt

SEQ ID NO: 4876836 - DNA, 21 bp, Homo sapiens
gcattacccccaacctcattt

SEQ ID NO: 4876837 - DNA, 14 bp, Homo sapiens
gcattagcacagat

SEQ ID NO: 4876838 - DNA, 13 bp, Homo sapiens
gcattattcattt

SEQ ID NO: 4876839 - DNA, 12 bp, Homo sapiens
gattttgataac

SEQ ID NO: 4876840 - DNA, 19 bp, Homo sapiens
gattttgatccaagctggt

SEQ ID NO: 4876841 - DNA, 18 bp, Homo sapiens
gatttttctcaaagtttt

SEQ ID NO: 4876842 - DNA, 13 bp, Homo sapiens
gcaaaaatataaa

SEQ ID NO: 4876843 - DNA, 12 bp, Homo sapiens
gcaaaaggagag

SEQ ID NO: 4876844 - DNA, 20 bp, Homo sapiens
gcaaaaggttcactaaagca

SEQ ID NO: 4876845 - DNA, 21 bp, Homo sapiens
gcaaaaggttcactaaagcag

SEQ ID NO: 4876846 - DNA, 15 bp, Homo sapiens
gcaaaataaaaacta

SEQ ID NO: 4876847 - DNA, 16 bp, Homo sapiens
gcaaaataaaaactat

SEQ ID NO: 4876848 - DNA, 13 bp, Homo sapiens
gcaaaatagcatt

SEQ ID NO: 4876849 - DNA, 13 bp, Homo sapiens
gcaaacagaacag

SEQ ID NO: 4876850 - DNA, 18 bp, Homo sapiens
gcaaacttaatgttctta

SEQ ID NO: 4876851 - DNA, 16 bp, Homo sapiens
gcaaagaggactcgct

SEQ ID NO: 4876852 - DNA, 15 bp, Homo sapiens
gcaaagatcaaaata

SEQ ID NO: 4876853 - DNA, 21 bp, Homo sapiens
gcaaagctgatgacaacttcc

SEQ ID NO: 4876854 - DNA, 19 bp, Homo sapiens
gcaaaggttccaactgtat

SEQ ID NO: 4876855 - DNA, 22 bp, Homo sapiens
gcaaatacttagcaaaaagtgg

SEQ ID NO: 4876856 - DNA, 15 bp, Homo sapiens
gcaacacagaggaat

SEQ ID NO: 4876857 - DNA, 16 bp, Homo sapiens
gcaacacagaggaatt

SEQ ID NO: 4876858 - DNA, 16 bp, Homo sapiens
gcaacacgcatggtca

SEQ ID NO: 4876859 - DNA, 13 bp, Homo sapiens
gcaacaggctggg

SEQ ID NO: 4876860 - DNA, 14 bp, Homo sapiens
gcaaccactaagaa

SEQ ID NO: 4876861 - DNA, 15 bp, Homo sapiens
gcaacccccagcctg

SEQ ID NO: 4876862 - DNA, 17 bp, Homo sapiens
gcaacccccagcctgct

SEQ ID NO: 4876863 - DNA, 21 bp, Homo sapiens
gcaacccttaccccttagcct

SEQ ID NO: 4876864 - DNA, 18 bp, Homo sapiens
gcaaccgcctcaaaatgt

SEQ ID NO: 4876865 - DNA, 14 bp, Homo sapiens
gcaaccgcttccct

SEQ ID NO: 4876866 - DNA, 17 bp, Homo sapiens
gcaacctcccaacccag

SEQ ID NO: 4876867 - DNA, 22 bp, Homo sapiens
gcaacgaccagggccgaggagg

SEQ ID NO: 4876868 - DNA, 22 bp, Homo sapiens
gcaacgccgtgggctgcgtcct

SEQ ID NO: 4876869 - DNA, 11 bp, Homo sapiens
gcaactgggac

SEQ ID NO: 4876870 - DNA, 13 bp, Homo sapiens
gcaagaagtagca

SEQ ID NO: 4876871 - DNA, 18 bp, Homo sapiens
gcaagagtgattgcagct

SEQ ID NO: 4876872 - DNA, 19 bp, Homo sapiens
gcaagatagatttggaata

SEQ ID NO: 4876873 - DNA, 21 bp, Homo sapiens
gcaagcaacttgcaggctcca

SEQ ID NO: 4876874 - DNA, 16 bp, Homo sapiens
gcaagcacctcctgcc

SEQ ID NO: 4876875 - DNA, 14 bp, Homo sapiens
gcaagctctcttgc

SEQ ID NO: 4876876 - DNA, 16 bp, Homo sapiens
gcaaggaaaaacaggt

SEQ ID NO: 4876877 - DNA, 16 bp, Homo sapiens
gcaaggaaaaagaaaa

SEQ ID NO: 4876878 - DNA, 13 bp, Homo sapiens
gcaaggaaggaaa

SEQ ID NO: 4876879 - DNA, 14 bp, Homo sapiens
gcaaggaaggaaag

SEQ ID NO: 4876880 - DNA, 14 bp, Homo sapiens
gcaaggaccaggac

SEQ ID NO: 4876881 - DNA, 20 bp, Homo sapiens
gcaaggaccaggactccctc

SEQ ID NO: 4876882 - DNA, 16 bp, Homo sapiens
gcaaggccctgctgcc

SEQ ID NO: 4876883 - DNA, 18 bp, Homo sapiens
gcaagtctgagggtctgg

SEQ ID NO: 4876884 - DNA, 13 bp, Homo sapiens
gcaagtgagagct

SEQ ID NO: 4876885 - DNA, 20 bp, Homo sapiens
gcaagttaagagaaacttta

SEQ ID NO: 4876886 - DNA, 16 bp, Homo sapiens
gcaagttcaatttgtt

SEQ ID NO: 4876887 - DNA, 12 bp, Homo sapiens
gcaataacttct

SEQ ID NO: 4876888 - DNA, 17 bp, Homo sapiens
gcaataacttctgacct

SEQ ID NO: 4876889 - DNA, 21 bp, Homo sapiens
gcaatatttatggatgcaaca

SEQ ID NO: 4876890 - DNA, 18 bp, Homo sapiens
gcaatatttgaattttaa

SEQ ID NO: 4876891 - DNA, 16 bp, Homo sapiens
gcaatgaaaggtacta

SEQ ID NO: 4876892 - DNA, 14 bp, Homo sapiens
gcaatgctggctgt

SEQ ID NO: 4876893 - DNA, 16 bp, Homo sapiens
gcaatgggcactggga

SEQ ID NO: 4876894 - DNA, 22 bp, Homo sapiens
gcaatggtgtcagtatccaggc

SEQ ID NO: 4876895 - DNA, 15 bp, Homo sapiens
gcaatgtatcccttc

SEQ ID NO: 4876896 - DNA, 20 bp, Homo sapiens
gcaatgtcaggaacagaagg

SEQ ID NO: 4876897 - DNA, 22 bp, Homo sapiens
gcaatgtcaggaacagaaggat

SEQ ID NO: 4876898 - DNA, 19 bp, Homo sapiens
gcaattaggtttttcctta

SEQ ID NO: 4876899 - DNA, 21 bp, Homo sapiens
gcaattcccctctgctgctgt

SEQ ID NO: 4876900 - DNA, 17 bp, Homo sapiens
gcaattccgcatttaat

SEQ ID NO: 4876901 - DNA, 13 bp, Homo sapiens
gcaattgtctatt

SEQ ID NO: 4876902 - DNA, 19 bp, Homo sapiens
gcaatttaactagacacag

SEQ ID NO: 4876903 - DNA, 13 bp, Homo sapiens
gcaatttcaaggt

SEQ ID NO: 4876904 - DNA, 18 bp, Homo sapiens
gcaatttccttttttgtt

SEQ ID NO: 4876905 - DNA, 23 bp, Homo sapiens
gcaatttttccatgaagtttgaa

SEQ ID NO: 4876906 - DNA, 11 bp, Homo sapiens
gcacaaaatga

SEQ ID NO: 4876907 - DNA, 16 bp, Homo sapiens
gcacaaacatttttca

SEQ ID NO: 4876908 - DNA, 13 bp, Homo sapiens
gcacaaatattta

SEQ ID NO: 4876909 - DNA, 17 bp, Homo sapiens
gcacaacctgcatcttt

SEQ ID NO: 4876910 - DNA, 21 bp, Homo sapiens
gcacaagcagagtgcacagct

SEQ ID NO: 4876911 - DNA, 14 bp, Homo sapiens
gcacaatttgcact

SEQ ID NO: 4876912 - DNA, 10 bp, Homo sapiens
gcacacacac

SEQ ID NO: 4876913 - DNA, 12 bp, Homo sapiens
gcacacacacaa

SEQ ID NO: 4876914 - DNA, 21 bp, Homo sapiens
gcacacacacacacatgcaca

SEQ ID NO: 4876915 - DNA, 14 bp, Homo sapiens
gcacacacacacat

SEQ ID NO: 4876916 - DNA, 14 bp, Homo sapiens
gcacacaccagagc

SEQ ID NO: 4876917 - DNA, 13 bp, Homo sapiens
gcacacagaaata

SEQ ID NO: 4876918 - DNA, 13 bp, Homo sapiens
gcacactctgcca

SEQ ID NO: 4876919 - DNA, 14 bp, Homo sapiens
gcacagagaagctg

SEQ ID NO: 4876920 - DNA, 20 bp, Homo sapiens
gcacagataaaaagtggaat

SEQ ID NO: 4876921 - DNA, 13 bp, Homo sapiens
gcacagattttaa

SEQ ID NO: 4876922 - DNA, 21 bp, Homo sapiens
gcacagattttaattgtcatg

SEQ ID NO: 4876923 - DNA, 14 bp, Homo sapiens
gcacagcagcctgc

SEQ ID NO: 4876924 - DNA, 23 bp, Homo sapiens
gcacagctgtagtggggttctag

SEQ ID NO: 4876925 - DNA, 23 bp, Homo sapiens
gcacagcttcatttcctgtgtct

SEQ ID NO: 4876926 - DNA, 21 bp, Homo sapiens
gcacaggactgattctgggat

SEQ ID NO: 4876927 - DNA, 17 bp, Homo sapiens
gcacaggatgctggcct

SEQ ID NO: 4876928 - DNA, 16 bp, Homo sapiens
gcacagggcagtggga

SEQ ID NO: 4876929 - DNA, 13 bp, Homo sapiens
gcacaggtcccac

SEQ ID NO: 4876930 - DNA, 14 bp, Homo sapiens
gcacaggtcccacc

SEQ ID NO: 4876931 - DNA, 20 bp, Homo sapiens
gcacaggtcgggcgcaggat

SEQ ID NO: 4876932 - DNA, 16 bp, Homo sapiens
gcacagtccaggaaca

SEQ ID NO: 4876933 - DNA, 16 bp, Homo sapiens
gcacagtgaagtgctg

SEQ ID NO: 4876934 - DNA, 15 bp, Homo sapiens
gcacagtgcatctca

SEQ ID NO: 4876935 - DNA, 21 bp, Homo sapiens
gcacagtgcatctcagcccac

SEQ ID NO: 4876936 - DNA, 16 bp, Homo sapiens
gcacagtgtcccccag

SEQ ID NO: 4876937 - DNA, 15 bp, Homo sapiens
gcacagtttgaacaa

SEQ ID NO: 4876938 - DNA, 23 bp, Homo sapiens
gcacatccattcccaagaaatgc

SEQ ID NO: 4876939 - DNA, 21 bp, Homo sapiens
gcacatctgcattttcacccc

SEQ ID NO: 4876940 - DNA, 15 bp, Homo sapiens
gcacatgctggccag

SEQ ID NO: 4876941 - DNA, 18 bp, Homo sapiens
gcacatgctggccagcct

SEQ ID NO: 4876942 - DNA, 23 bp, Homo sapiens
gcaccaccctagtcccttcccct

SEQ ID NO: 4876943 - DNA, 18 bp, Homo sapiens
gcaccagagcaacctctc

SEQ ID NO: 4876944 - DNA, 13 bp, Homo sapiens
gcaccagccagcg

SEQ ID NO: 4876945 - DNA, 19 bp, Homo sapiens
gcaccagccagcgtagcag

SEQ ID NO: 4876946 - DNA, 20 bp, Homo sapiens
gcaccatcacaatacagata

SEQ ID NO: 4876947 - DNA, 22 bp, Homo sapiens
gcacccaccatcatgtctggct

SEQ ID NO: 4876948 - DNA, 14 bp, Homo sapiens
gcaccccccaagct

SEQ ID NO: 4876949 - DNA, 18 bp, Homo sapiens
gcacccccctgttctaag

SEQ ID NO: 4876950 - DNA, 20 bp, Homo sapiens
gcacccccctgttctaaggg

SEQ ID NO: 4876951 - DNA, 22 bp, Homo sapiens
gatggggataaaatgactactt

SEQ ID NO: 4876952 - DNA, 23 bp, Homo sapiens
gatggggataaaatgactactta

SEQ ID NO: 4876953 - DNA, 23 bp, Homo sapiens
gatggttattttcttttctttca

SEQ ID NO: 4876954 - DNA, 18 bp, Homo sapiens
gatggttcccctgttcac

SEQ ID NO: 4876955 - DNA, 22 bp, Homo sapiens
gatgtaatctctctgcagctgc

SEQ ID NO: 4876956 - DNA, 12 bp, Homo sapiens
gatgtaatttag

SEQ ID NO: 4876957 - DNA, 22 bp, Homo sapiens
gatgtaatttagggtactaaat

SEQ ID NO: 4876958 - DNA, 15 bp, Homo sapiens
gatgtagcattatgc

SEQ ID NO: 4876959 - DNA, 19 bp, Homo sapiens
gatgtatctgagttgccaa

SEQ ID NO: 4876960 - DNA, 13 bp, Homo sapiens
gatgtcacagggc

SEQ ID NO: 4876961 - DNA, 14 bp, Homo sapiens
gatgtcatgtgttc

SEQ ID NO: 4876962 - DNA, 16 bp, Homo sapiens
gatgtccctgggccag

SEQ ID NO: 4876963 - DNA, 19 bp, Homo sapiens
gatgtccctgggccagggt

SEQ ID NO: 4876964 - DNA, 21 bp, Homo sapiens
gatgtccctgggccagggtct

SEQ ID NO: 4876965 - DNA, 19 bp, Homo sapiens
gatgtcccttgatgcacag

SEQ ID NO: 4876966 - DNA, 21 bp, Homo sapiens
gatgtcccttgatgcacagag

SEQ ID NO: 4876967 - DNA, 13 bp, Homo sapiens
gatgtcttttata

SEQ ID NO: 4876968 - DNA, 14 bp, Homo sapiens
gatgtcttttcttg

SEQ ID NO: 4876969 - DNA, 14 bp, Homo sapiens
gatgtgactgtata

SEQ ID NO: 4876970 - DNA, 15 bp, Homo sapiens
gatgtgattgtggaa

SEQ ID NO: 4876971 - DNA, 16 bp, Homo sapiens
gatgtgattgtggaat

SEQ ID NO: 4876972 - DNA, 22 bp, Homo sapiens
gatgtgggagggagcagacagg

SEQ ID NO: 4876973 - DNA, 13 bp, Homo sapiens
gatgtgtctgtat

SEQ ID NO: 4876974 - DNA, 14 bp, Homo sapiens
gatgtgttgtgata

SEQ ID NO: 4876975 - DNA, 18 bp, Homo sapiens
gatgttagtgttttaaga

SEQ ID NO: 4876976 - DNA, 13 bp, Homo sapiens
gatgttctaaggc

SEQ ID NO: 4876977 - DNA, 18 bp, Homo sapiens
gatgttgaagaatacagt

SEQ ID NO: 4876978 - DNA, 13 bp, Homo sapiens
gatgtttgtggcc

SEQ ID NO: 4876979 - DNA, 15 bp, Homo sapiens
gatgtttgtggcctc

SEQ ID NO: 4876980 - DNA, 20 bp, Homo sapiens
gatgtttttaaaagtttcaa

SEQ ID NO: 4876981 - DNA, 18 bp, Homo sapiens
gattaaataagattctaa

SEQ ID NO: 4876982 - DNA, 23 bp, Homo sapiens
gattaaatatagattagaaaaat

SEQ ID NO: 4876983 - DNA, 13 bp, Homo sapiens
gattaacaaatat

SEQ ID NO: 4876984 - DNA, 16 bp, Homo sapiens
gattaacaaatatgct

SEQ ID NO: 4876985 - DNA, 17 bp, Homo sapiens
gattaacttatttagag

SEQ ID NO: 4876986 - DNA, 18 bp, Homo sapiens
gattaagattttacaaaa

SEQ ID NO: 4876987 - DNA, 16 bp, Homo sapiens
gattaatggcactgat

SEQ ID NO: 4876988 - DNA, 13 bp, Homo sapiens
gattacaagcgtg

SEQ ID NO: 4876989 - DNA, 22 bp, Homo sapiens
gattacaagcgtgagccactgc

SEQ ID NO: 4876990 - DNA, 20 bp, Homo sapiens
gattacaggtgtgaaccacc

SEQ ID NO: 4876991 - DNA, 17 bp, Homo sapiens
gattagaagctgaaaac

SEQ ID NO: 4876992 - DNA, 10 bp, Homo sapiens
gattagcttt

SEQ ID NO: 4876993 - DNA, 14 bp, Homo sapiens
gagtctttggttct

SEQ ID NO: 4876994 - DNA, 22 bp, Homo sapiens
gagtctttggttctaaggacct

SEQ ID NO: 4876995 - DNA, 14 bp, Homo sapiens
gagtgacagaggca

SEQ ID NO: 4876996 - DNA, 15 bp, Homo sapiens
gagtgacagaggcag

SEQ ID NO: 4876997 - DNA, 16 bp, Homo sapiens
gagtgacagaggcagc

SEQ ID NO: 4876998 - DNA, 18 bp, Homo sapiens
gagtgacagaggcagccc

SEQ ID NO: 4876999 - DNA, 17 bp, Homo sapiens
gagtgactccaagaaca

SEQ ID NO: 4877000 - DNA, 13 bp, Homo sapiens
gagtgagcctggc

SEQ ID NO: 4877001 - DNA, 12 bp, Homo sapiens
gagtgagctggt

SEQ ID NO: 4877002 - DNA, 10 bp, Homo sapiens
gagtgatctt

SEQ ID NO: 4877003 - DNA, 12 bp, Homo sapiens
gagtgattgcag

SEQ ID NO: 4877004 - DNA, 16 bp, Homo sapiens
gagtgcacagctgtcc

SEQ ID NO: 4877005 - DNA, 18 bp, Homo sapiens
gagtgctggctcacagta

SEQ ID NO: 4877006 - DNA, 13 bp, Homo sapiens
gagtggcctggcc

SEQ ID NO: 4877007 - DNA, 15 bp, Homo sapiens
gagtggcctggccag

SEQ ID NO: 4877008 - DNA, 20 bp, Homo sapiens
gagtggcctggccaggagct

SEQ ID NO: 4877009 - DNA, 15 bp, Homo sapiens
gagtggctcctcccg

SEQ ID NO: 4877010 - DNA, 21 bp, Homo sapiens
gagtggggttatctctgtgtt

SEQ ID NO: 4877011 - DNA, 19 bp, Homo sapiens
gagtgggtgacaagagcct

SEQ ID NO: 4877012 - DNA, 20 bp, Homo sapiens
gagtgggtgacaagagcctg

SEQ ID NO: 4877013 - DNA, 21 bp, Homo sapiens
gagtgggtgacaagagcctga

SEQ ID NO: 4877014 - DNA, 15 bp, Homo sapiens
gagtgggtggaggca

SEQ ID NO: 4877015 - DNA, 15 bp, Homo sapiens
gagtggtgcagacag

SEQ ID NO: 4877016 - DNA, 15 bp, Homo sapiens
gagtgtagaagcatt

SEQ ID NO: 4877017 - DNA, 20 bp, Homo sapiens
gagtgtagaagcattccttc

SEQ ID NO: 4877018 - DNA, 15 bp, Homo sapiens
gagtgtgacagggcc

SEQ ID NO: 4877019 - DNA, 20 bp, Homo sapiens
gagtgtgcatggaggccctc

SEQ ID NO: 4877020 - DNA, 15 bp, Homo sapiens
gagtgtggactctgg

SEQ ID NO: 4877021 - DNA, 16 bp, Homo sapiens
gagtgtggctgaggag

SEQ ID NO: 4877022 - DNA, 10 bp, Homo sapiens
gagtgtgtgt

SEQ ID NO: 4877023 - DNA, 22 bp, Homo sapiens
gagtgttgggcatgtgatcacg

SEQ ID NO: 4877024 - DNA, 17 bp, Homo sapiens
gagtgtttgggggacgt

SEQ ID NO: 4877025 - DNA, 22 bp, Homo sapiens
gagttaaatagagtatatgcac

SEQ ID NO: 4877026 - DNA, 21 bp, Homo sapiens
gagttaagaagctgttgtaca

SEQ ID NO: 4877027 - DNA, 22 bp, Homo sapiens
gagttatgatgtaatctctctg

SEQ ID NO: 4877028 - DNA, 13 bp, Homo sapiens
gagttctggaaaa

SEQ ID NO: 4877029 - DNA, 15 bp, Homo sapiens
gagttgaggaactgt

SEQ ID NO: 4877030 - DNA, 16 bp, Homo sapiens
gagttgaggaactgta

SEQ ID NO: 4877031 - DNA, 16 bp, Homo sapiens
gagttgccaagacaaa

SEQ ID NO: 4877032 - DNA, 17 bp, Homo sapiens
gagttgccaagacaaat

SEQ ID NO: 4877033 - DNA, 18 bp, Homo sapiens
gagtttcatgtacaagat

SEQ ID NO: 4877034 - DNA, 19 bp, Homo sapiens
gagtttcattctcctgcct

SEQ ID NO: 4877035 - DNA, 20 bp, Homo sapiens
gagtttcattctcctgcctg

SEQ ID NO: 4877036 - DNA, 12 bp, Homo sapiens
gagtttctgttt

SEQ ID NO: 4877037 - DNA, 13 bp, Homo sapiens
gagtttctgtttg

SEQ ID NO: 4877038 - DNA, 13 bp, Homo sapiens
gagtttgccctgg

SEQ ID NO: 4877039 - DNA, 14 bp, Homo sapiens
gagtttgccttcct

SEQ ID NO: 4877040 - DNA, 18 bp, Homo sapiens
gagtttgctattagagca

SEQ ID NO: 4877041 - DNA, 17 bp, Homo sapiens
gagtttggtctggactg

SEQ ID NO: 4877042 - DNA, 19 bp, Homo sapiens
gataaaagggcaaatctgc

SEQ ID NO: 4877043 - DNA, 16 bp, Homo sapiens
gataaatatttgactt

SEQ ID NO: 4877044 - DNA, 20 bp, Homo sapiens
gataacaatgcagcaaggcc

SEQ ID NO: 4877045 - DNA, 23 bp, Homo sapiens
gataacctatatgatttatagtt

SEQ ID NO: 4877046 - DNA, 23 bp, Homo sapiens
gataagccactctgtcccttcct

SEQ ID NO: 4877047 - DNA, 17 bp, Homo sapiens
gataataatattgtttt

SEQ ID NO: 4877048 - DNA, 12 bp, Homo sapiens
gataataatggg

SEQ ID NO: 4877049 - DNA, 14 bp, Homo sapiens
gataatcagcctct

SEQ ID NO: 4877050 - DNA, 15 bp, Homo sapiens
gataatcagcctctt

SEQ ID NO: 4877051 - DNA, 15 bp, Homo sapiens
gataatgataaaaca

SEQ ID NO: 4877052 - DNA, 14 bp, Homo sapiens
gataattgctattt

SEQ ID NO: 4877053 - DNA, 14 bp, Homo sapiens
gataattgttgaaa

SEQ ID NO: 4877054 - DNA, 16 bp, Homo sapiens
gataattgttgaaatt

SEQ ID NO: 4877055 - DNA, 12 bp, Homo sapiens
gataatttaaga

SEQ ID NO: 4877056 - DNA, 14 bp, Homo sapiens
gatacaacctccct

SEQ ID NO: 4877057 - DNA, 13 bp, Homo sapiens
gatacacacacac

SEQ ID NO: 4877058 - DNA, 21 bp, Homo sapiens
gatacaggaaaagctgctgac

SEQ ID NO: 4877059 - DNA, 23 bp, Homo sapiens
gatacataactaaatttgatact

SEQ ID NO: 4877060 - DNA, 16 bp, Homo sapiens
gatacatcactgcttg

SEQ ID NO: 4877061 - DNA, 19 bp, Homo sapiens
gataccaagatgccatctg

SEQ ID NO: 4877062 - DNA, 20 bp, Homo sapiens
gatactaaaagttcttctcc

SEQ ID NO: 4877063 - DNA, 13 bp, Homo sapiens
gatactacatctt

SEQ ID NO: 4877064 - DNA, 20 bp, Homo sapiens
gatactctttctaatgctga

SEQ ID NO: 4877065 - DNA, 21 bp, Homo sapiens
gatactgcagggccaggactg

SEQ ID NO: 4877066 - DNA, 22 bp, Homo sapiens
gatacttatattttcgtatgaa

SEQ ID NO: 4877067 - DNA, 13 bp, Homo sapiens
gatactttacatg

SEQ ID NO: 4877068 - DNA, 20 bp, Homo sapiens
gatactttttcttttgtaag

SEQ ID NO: 4877069 - DNA, 13 bp, Homo sapiens
gatagagttccat

SEQ ID NO: 4877070 - DNA, 22 bp, Homo sapiens
gatagctaacattttaaataaa

SEQ ID NO: 4877071 - DNA, 13 bp, Homo sapiens
gatagctgcatgt

SEQ ID NO: 4877072 - DNA, 17 bp, Homo sapiens
gataggagcctgctggt

SEQ ID NO: 4877073 - DNA, 21 bp, Homo sapiens
gatagggctgggcaaggaaaa

SEQ ID NO: 4877074 - DNA, 22 bp, Homo sapiens
gatagggctgggcaaggaaaaa

SEQ ID NO: 4877075 - DNA, 15 bp, Homo sapiens
gatagtaacaatgaa

SEQ ID NO: 4877076 - DNA, 14 bp, Homo sapiens
gatagttttctcct

SEQ ID NO: 4877077 - DNA, 14 bp, Homo sapiens
gatatacagatgaa

SEQ ID NO: 4877078 - DNA, 17 bp, Homo sapiens
gatatacagatgaaaat

SEQ ID NO: 4877079 - DNA, 13 bp, Homo sapiens
gatatatatcata

SEQ ID NO: 4877080 - DNA, 23 bp, Homo sapiens
gatatatattataaatatatata

SEQ ID NO: 4877081 - DNA, 16 bp, Homo sapiens
gatatatctgaaaact

SEQ ID NO: 4877082 - DNA, 18 bp, Homo sapiens
gatatatctgaaaactgg

SEQ ID NO: 4877083 - DNA, 21 bp, Homo sapiens
gatatccctgatcctaactga

SEQ ID NO: 4877084 - DNA, 20 bp, Homo sapiens
gatatctagctagtaatata

SEQ ID NO: 4877085 - DNA, 21 bp, Homo sapiens
gatatctagctagtaatatat

SEQ ID NO: 4877086 - DNA, 22 bp, Homo sapiens
gatatgagtatacaatatataa

SEQ ID NO: 4877087 - DNA, 14 bp, Homo sapiens
gatatgattggcaa

SEQ ID NO: 4877088 - DNA, 13 bp, Homo sapiens
gatatggagaatt

SEQ ID NO: 4877089 - DNA, 14 bp, Homo sapiens
gatatggcagaaga

SEQ ID NO: 4877090 - DNA, 17 bp, Homo sapiens
gatatggcagaagacac

SEQ ID NO: 4877091 - DNA, 15 bp, Homo sapiens
gatattactttatca

SEQ ID NO: 4877092 - DNA, 16 bp, Homo sapiens
gatattactttatcac

SEQ ID NO: 4877093 - DNA, 19 bp, Homo sapiens
gatattactttatcacttt

SEQ ID NO: 4877094 - DNA, 13 bp, Homo sapiens
gatattctaagac

SEQ ID NO: 4877095 - DNA, 16 bp, Homo sapiens
gatattgtacataaaa

SEQ ID NO: 4877096 - DNA, 18 bp, Homo sapiens
gatattgtacataaaaga

SEQ ID NO: 4877097 - DNA, 13 bp, Homo sapiens
gatattgttcaaa

SEQ ID NO: 4877098 - DNA, 14 bp, Homo sapiens
gatatttggcttaa

SEQ ID NO: 4877099 - DNA, 18 bp, Homo sapiens
gatatttggcttaaatat

SEQ ID NO: 4877100 - DNA, 19 bp, Homo sapiens
gatattttcaacgcagccc

SEQ ID NO: 4877101 - DNA, 22 bp, Homo sapiens
gatattttcaacgcagccctgc

SEQ ID NO: 4877102 - DNA, 23 bp, Homo sapiens
gatattttcaacgcagccctgct

SEQ ID NO: 4877103 - DNA, 22 bp, Homo sapiens
gatatttttaaagatctgtaag

SEQ ID NO: 4877104 - DNA, 22 bp, Homo sapiens
gatcaaaataaaaagtgacaca

SEQ ID NO: 4877105 - DNA, 19 bp, Homo sapiens
gagcatcccccaaagttca

SEQ ID NO: 4877106 - DNA, 14 bp, Homo sapiens
gagcatcctgagcc

SEQ ID NO: 4877107 - DNA, 18 bp, Homo sapiens
gagcatcctgagccccgc

SEQ ID NO: 4877108 - DNA, 23 bp, Homo sapiens
gagcatctcttgaggccaggagt

SEQ ID NO: 4877109 - DNA, 17 bp, Homo sapiens
gagcatgaaatttttaa

SEQ ID NO: 4877110 - DNA, 15 bp, Homo sapiens
gagcatgggcctggc

SEQ ID NO: 4877111 - DNA, 17 bp, Homo sapiens
gagcatgggcctggcca

SEQ ID NO: 4877112 - DNA, 17 bp, Homo sapiens
gagcatgttttgtatac

SEQ ID NO: 4877113 - DNA, 23 bp, Homo sapiens
gagcatttccaacaccacagaca

SEQ ID NO: 4877114 - DNA, 13 bp, Homo sapiens
gagccacaaaaga

SEQ ID NO: 4877115 - DNA, 13 bp, Homo sapiens
gagccagctccct

SEQ ID NO: 4877116 - DNA, 20 bp, Homo sapiens
gagccagcttggggccacca

SEQ ID NO: 4877117 - DNA, 19 bp, Homo sapiens
gagccagggtctcactatg

SEQ ID NO: 4877118 - DNA, 19 bp, Homo sapiens
gagccatataagtttgaag

SEQ ID NO: 4877119 - DNA, 16 bp, Homo sapiens
gagccattttgtgaat

SEQ ID NO: 4877120 - DNA, 17 bp, Homo sapiens
gagcccaccttggctca

SEQ ID NO: 4877121 - DNA, 18 bp, Homo sapiens
gagcccacggctaagagg

SEQ ID NO: 4877122 - DNA, 22 bp, Homo sapiens
gagcccacggctaagaggctgc

SEQ ID NO: 4877123 - DNA, 23 bp, Homo sapiens
gagcccacggctaagaggctgct

SEQ ID NO: 4877124 - DNA, 11 bp, Homo sapiens
gagcccaggag

SEQ ID NO: 4877125 - DNA, 12 bp, Homo sapiens
gagcccaggagt

SEQ ID NO: 4877126 - DNA, 17 bp, Homo sapiens
gagcccatactcagcct

SEQ ID NO: 4877127 - DNA, 22 bp, Homo sapiens
gagcccatgttctgcccccagc

SEQ ID NO: 4877128 - DNA, 12 bp, Homo sapiens
gagccccagggt

SEQ ID NO: 4877129 - DNA, 19 bp, Homo sapiens
gagccccagggtgcccaga

SEQ ID NO: 4877130 - DNA, 17 bp, Homo sapiens
gagccccgaggccttct

SEQ ID NO: 4877131 - DNA, 13 bp, Homo sapiens
gagccccgccctc

SEQ ID NO: 4877132 - DNA, 16 bp, Homo sapiens
gagccccgccctcttc

SEQ ID NO: 4877133 - DNA, 20 bp, Homo sapiens
gagccccgccctcttcctga

SEQ ID NO: 4877134 - DNA, 21 bp, Homo sapiens
gagccccgccctcttcctgac

SEQ ID NO: 4877135 - DNA, 12 bp, Homo sapiens
gagcccctggtc

SEQ ID NO: 4877136 - DNA, 13 bp, Homo sapiens
gagcccctggtcc

SEQ ID NO: 4877137 - DNA, 17 bp, Homo sapiens
gagcccggcgcccctgc

SEQ ID NO: 4877138 - DNA, 18 bp, Homo sapiens
gagccctaaccccttcca

SEQ ID NO: 4877139 - DNA, 20 bp, Homo sapiens
gagccctaaccccttccaga

SEQ ID NO: 4877140 - DNA, 21 bp, Homo sapiens
gagccctaaccccttccagat

SEQ ID NO: 4877141 - DNA, 13 bp, Homo sapiens
gagccctggtggc

SEQ ID NO: 4877142 - DNA, 15 bp, Homo sapiens
gagccctggtggcag

SEQ ID NO: 4877143 - DNA, 16 bp, Homo sapiens
gagccctggtggcagt

SEQ ID NO: 4877144 - DNA, 17 bp, Homo sapiens
gagccctggtggcagtg

SEQ ID NO: 4877145 - DNA, 18 bp, Homo sapiens
gagccctggtggcagtgg

SEQ ID NO: 4877146 - DNA, 20 bp, Homo sapiens
gagccgagatcacgccactg

SEQ ID NO: 4877147 - DNA, 20 bp, Homo sapiens
gagccgctgtgagcccctgg

SEQ ID NO: 4877148 - DNA, 18 bp, Homo sapiens
gagccgtgaactgtgcat

SEQ ID NO: 4877149 - DNA, 19 bp, Homo sapiens
gagcctaggaccactcagc

SEQ ID NO: 4877150 - DNA, 19 bp, Homo sapiens
gagcctcagcatcctggca

SEQ ID NO: 4877151 - DNA, 20 bp, Homo sapiens
gagcctcccaaggagaacaa

SEQ ID NO: 4877152 - DNA, 22 bp, Homo sapiens
gagcctcccaaggagaacaaat

SEQ ID NO: 4877153 - DNA, 16 bp, Homo sapiens
gagcctctgctcccca

SEQ ID NO: 4877154 - DNA, 17 bp, Homo sapiens
gagcctctgctccccag

SEQ ID NO: 4877155 - DNA, 12 bp, Homo sapiens
gagcctctgggg

SEQ ID NO: 4877156 - DNA, 19 bp, Homo sapiens
gagcctgaattttgttgct

SEQ ID NO: 4877157 - DNA, 17 bp, Homo sapiens
gagcctgagtcagggcc

SEQ ID NO: 4877158 - DNA, 22 bp, Homo sapiens
gagcctgagtcagggcccagag

SEQ ID NO: 4877159 - DNA, 18 bp, Homo sapiens
gagcctgatctcttcctg

SEQ ID NO: 4877160 - DNA, 19 bp, Homo sapiens
gagcctgatctcttcctgt

SEQ ID NO: 4877161 - DNA, 13 bp, Homo sapiens
gagcctgcctgga

SEQ ID NO: 4877162 - DNA, 14 bp, Homo sapiens
gagcctgcctggag

SEQ ID NO: 4877163 - DNA, 21 bp, Homo sapiens
gagcctgctggtcacagcctc

SEQ ID NO: 4877164 - DNA, 20 bp, Homo sapiens
gagcctttttaaaacacatg

SEQ ID NO: 4877165 - DNA, 16 bp, Homo sapiens
gagcggggtatgaaga

SEQ ID NO: 4877166 - DNA, 13 bp, Homo sapiens
gagcggtggggga

SEQ ID NO: 4877167 - DNA, 14 bp, Homo sapiens
gagaggcagagagc

SEQ ID NO: 4877168 - DNA, 15 bp, Homo sapiens
gagagtagaacagat

SEQ ID NO: 4877169 - DNA, 17 bp, Homo sapiens
gagagtgagctacagag

SEQ ID NO: 4877170 - DNA, 16 bp, Homo sapiens
gagagtggctcctccc

SEQ ID NO: 4877171 - DNA, 15 bp, Homo sapiens
gagagttttgtcttg

SEQ ID NO: 4877172 - DNA, 17 bp, Homo sapiens
gagagttttgtcttgaa

SEQ ID NO: 4877173 - DNA, 22 bp, Homo sapiens
gagagttttgtcttgaatgtct

SEQ ID NO: 4877174 - DNA, 21 bp, Homo sapiens
gagatgagggatgggcctggc

SEQ ID NO: 4877175 - DNA, 14 bp, Homo sapiens
gagatgcggccaag

SEQ ID NO: 4877176 - DNA, 21 bp, Homo sapiens
gagatgcgttgttacaggaag

SEQ ID NO: 4877177 - DNA, 16 bp, Homo sapiens
gagatgctggagaaga

SEQ ID NO: 4877178 - DNA, 19 bp, Homo sapiens
gagatgctggagaagagag

SEQ ID NO: 4877179 - DNA, 18 bp, Homo sapiens
gagatggagttcttgtgc

SEQ ID NO: 4877180 - DNA, 23 bp, Homo sapiens
gagatgggagctcctctcctgga

SEQ ID NO: 4877181 - DNA, 18 bp, Homo sapiens
gagatggggataaaatga

SEQ ID NO: 4877182 - DNA, 16 bp, Homo sapiens
gagatgtatgaaggct

SEQ ID NO: 4877183 - DNA, 14 bp, Homo sapiens
gagatgtgcaccca

SEQ ID NO: 4877184 - DNA, 13 bp, Homo sapiens
gagattgagaagg

SEQ ID NO: 4877185 - DNA, 18 bp, Homo sapiens
gagattgagaaggagaga

SEQ ID NO: 4877186 - DNA, 16 bp, Homo sapiens
gagatttatataaatg

SEQ ID NO: 4877187 - DNA, 18 bp, Homo sapiens
gagcaaagatcaaaataa

SEQ ID NO: 4877188 - DNA, 16 bp, Homo sapiens
gagcaacctctcactc

SEQ ID NO: 4877189 - DNA, 20 bp, Homo sapiens
gagcaacgaccagggccgag

SEQ ID NO: 4877190 - DNA, 16 bp, Homo sapiens
gagcaatatttatgga

SEQ ID NO: 4877191 - DNA, 23 bp, Homo sapiens
gagcaatatttatggatgcaaca

SEQ ID NO: 4877192 - DNA, 14 bp, Homo sapiens
gagcacaaacattt

SEQ ID NO: 4877193 - DNA, 16 bp, Homo sapiens
gagcacaggtcccacc

SEQ ID NO: 4877194 - DNA, 15 bp, Homo sapiens
gagcacttactgtaa

SEQ ID NO: 4877195 - DNA, 22 bp, Homo sapiens
gagcagaaatttatctttcaaa

SEQ ID NO: 4877196 - DNA, 23 bp, Homo sapiens
gagcagaacggagccccaggcct

SEQ ID NO: 4877197 - DNA, 15 bp, Homo sapiens
gagcagagcaggcaa

SEQ ID NO: 4877198 - DNA, 16 bp, Homo sapiens
gagcagatgcagagag

SEQ ID NO: 4877199 - DNA, 11 bp, Homo sapiens
gagcagcctgt

SEQ ID NO: 4877200 - DNA, 13 bp, Homo sapiens
gagcagcctgtgg

SEQ ID NO: 4877201 - DNA, 22 bp, Homo sapiens
gagcagctttaaactcagggac

SEQ ID NO: 4877202 - DNA, 23 bp, Homo sapiens
gagcaggaagcattcagagagca

SEQ ID NO: 4877203 - DNA, 14 bp, Homo sapiens
gagcaggaaggcct

SEQ ID NO: 4877204 - DNA, 17 bp, Homo sapiens
gagcaggaaggcctggg

SEQ ID NO: 4877205 - DNA, 13 bp, Homo sapiens
gagcaggacctcc

SEQ ID NO: 4877206 - DNA, 22 bp, Homo sapiens
gagcaggagattgagaaggaga

SEQ ID NO: 4877207 - DNA, 14 bp, Homo sapiens
gagcagggaaggcc

SEQ ID NO: 4877208 - DNA, 14 bp, Homo sapiens
gagcagggctcagc

SEQ ID NO: 4877209 - DNA, 21 bp, Homo sapiens
gagcagggctcagcggggaca

SEQ ID NO: 4877210 - DNA, 16 bp, Homo sapiens
gagcagtccatgcatg

SEQ ID NO: 4877211 - DNA, 14 bp, Homo sapiens
ctttcgggccatgt

SEQ ID NO: 4877212 - DNA, 20 bp, Homo sapiens
ctttcgggccatgttgcccc

SEQ ID NO: 4877213 - DNA, 15 bp, Homo sapiens
ctttcgtacattggc

SEQ ID NO: 4877214 - DNA, 12 bp, Homo sapiens
cttttatagtgg

SEQ ID NO: 4877215 - DNA, 15 bp, Homo sapiens
cttttatagtggaaa

SEQ ID NO: 4877216 - DNA, 13 bp, Homo sapiens
cttttatatttgt

SEQ ID NO: 4877217 - DNA, 23 bp, Homo sapiens
cttttatctattctgagaaaaca

SEQ ID NO: 4877218 - DNA, 23 bp, Homo sapiens
cttttatgtagtaattgacatgt

SEQ ID NO: 4877219 - DNA, 14 bp, Homo sapiens
cttttatgtttgaa

SEQ ID NO: 4877220 - DNA, 21 bp, Homo sapiens
gaaaatataaaacaaataaaa

SEQ ID NO: 4877221 - DNA, 16 bp, Homo sapiens
gaaaatatatgatggc

SEQ ID NO: 4877222 - DNA, 18 bp, Homo sapiens
gaaaatcactttgtctaa

SEQ ID NO: 4877223 - DNA, 14 bp, Homo sapiens
gaaaatctaatatt

SEQ ID NO: 4877224 - DNA, 14 bp, Homo sapiens
gaaaatgaaaaaca

SEQ ID NO: 4877225 - DNA, 21 bp, Homo sapiens
gaaaatgagttgtgaaagttt

SEQ ID NO: 4877226 - DNA, 20 bp, Homo sapiens
gaaaatggtttattttgtat

SEQ ID NO: 4877227 - DNA, 19 bp, Homo sapiens
gaaaatgtgtcctatctat

SEQ ID NO: 4877228 - DNA, 20 bp, Homo sapiens
gaaaatgtttttctgccagg

SEQ ID NO: 4877229 - DNA, 18 bp, Homo sapiens
gaaaattaggatttcatg

SEQ ID NO: 4877230 - DNA, 17 bp, Homo sapiens
gaaaattattttaaaca

SEQ ID NO: 4877231 - DNA, 19 bp, Homo sapiens
gaaaattcaaaaagtgttt

SEQ ID NO: 4877232 - DNA, 19 bp, Homo sapiens
gaaaattttaaaaatacat

SEQ ID NO: 4877233 - DNA, 20 bp, Homo sapiens
gaaaattttaaaaatacata

SEQ ID NO: 4877234 - DNA, 19 bp, Homo sapiens
gaaaattttaccagcagaa

SEQ ID NO: 4877235 - DNA, 13 bp, Homo sapiens
gaaaatttttgta

SEQ ID NO: 4877236 - DNA, 14 bp, Homo sapiens
gaaacaaaaacact

SEQ ID NO: 4877237 - DNA, 12 bp, Homo sapiens
gaaacacagctg

SEQ ID NO: 4877238 - DNA, 14 bp, Homo sapiens
gaaacacagctgtt

SEQ ID NO: 4877239 - DNA, 23 bp, Homo sapiens
gaaacacagctgttcttctgttc

SEQ ID NO: 4877240 - DNA, 22 bp, Homo sapiens
gaaacacagcttacaatcgcaa

SEQ ID NO: 4877241 - DNA, 16 bp, Homo sapiens
gaaacacgaaacttgt

SEQ ID NO: 4877242 - DNA, 15 bp, Homo sapiens
gaaacagataccata

SEQ ID NO: 4877243 - DNA, 20 bp, Homo sapiens
gaaacatgactcgtatatgt

SEQ ID NO: 4877244 - DNA, 13 bp, Homo sapiens
gaaacccaagctc

SEQ ID NO: 4877245 - DNA, 17 bp, Homo sapiens
gaaacccaagctcctcc

SEQ ID NO: 4877246 - DNA, 21 bp, Homo sapiens
gaaaccgcctagtttactgtt

SEQ ID NO: 4877247 - DNA, 17 bp, Homo sapiens
gaaacctagtactgccc

SEQ ID NO: 4877248 - DNA, 14 bp, Homo sapiens
gaaaccttttttaa

SEQ ID NO: 4877249 - DNA, 20 bp, Homo sapiens
gaaaccttttttaagatttt

SEQ ID NO: 4877250 - DNA, 14 bp, Homo sapiens
gaaactagaaatgt

SEQ ID NO: 4877251 - DNA, 14 bp, Homo sapiens
gaaactcttatctc

SEQ ID NO: 4877252 - DNA, 16 bp, Homo sapiens
gaaactcttatctcag

SEQ ID NO: 4877253 - DNA, 23 bp, Homo sapiens
gaaactcttatctcagtcatgca

SEQ ID NO: 4877254 - DNA, 18 bp, Homo sapiens
gaaactgaggaattttct

SEQ ID NO: 4877255 - DNA, 15 bp, Homo sapiens
gaaactggccccgga

SEQ ID NO: 4877256 - DNA, 16 bp, Homo sapiens
gaaactggccccggat

SEQ ID NO: 4877257 - DNA, 15 bp, Homo sapiens
gaaactttatacatt

SEQ ID NO: 4877258 - DNA, 16 bp, Homo sapiens
gaaactttatacatta

SEQ ID NO: 4877259 - DNA, 19 bp, Homo sapiens
gaaacttttaactgagaaa

SEQ ID NO: 4877260 - DNA, 12 bp, Homo sapiens
gaaacttttatc

SEQ ID NO: 4877261 - DNA, 19 bp, Homo sapiens
gaaagacactgcctgggct

SEQ ID NO: 4877262 - DNA, 16 bp, Homo sapiens
gaaagcacaggagaca

SEQ ID NO: 4877263 - DNA, 22 bp, Homo sapiens
gaaagcagatacctcaccctgc

SEQ ID NO: 4877264 - DNA, 23 bp, Homo sapiens
gaaagcaggggctacaagaggga

SEQ ID NO: 4877265 - DNA, 14 bp, Homo sapiens
gaaagccaggcagg

SEQ ID NO: 4877266 - DNA, 18 bp, Homo sapiens
gaaagccccagcactaac

SEQ ID NO: 4877267 - DNA, 22 bp, Homo sapiens
gaaagcctgtaagcctgcaagc

SEQ ID NO: 4877268 - DNA, 21 bp, Homo sapiens
gaaagctgagaactcctgact

SEQ ID NO: 4877269 - DNA, 17 bp, Homo sapiens
gaaagcttcaaactgca

SEQ ID NO: 4877270 - DNA, 18 bp, Homo sapiens
gaaaggaagctccactgt

SEQ ID NO: 4877271 - DNA, 13 bp, Homo sapiens
gaaaggagactag

SEQ ID NO: 4877272 - DNA, 17 bp, Homo sapiens
gaaaggaggcatgcctc

SEQ ID NO: 4877273 - DNA, 22 bp, Homo sapiens
gaaagggagctatcaggaacag

SEQ ID NO: 4877274 - DNA, 14 bp, Homo sapiens
gaaagggatcatca

SEQ ID NO: 4877275 - DNA, 15 bp, Homo sapiens
gaaagggcccagaga

SEQ ID NO: 4877276 - DNA, 20 bp, Homo sapiens
gaaagggccttgacatcagt

SEQ ID NO: 4877277 - DNA, 16 bp, Homo sapiens
gaaaggggttggggtg

SEQ ID NO: 4877278 - DNA, 22 bp, Homo sapiens
gaaagtacttctccaccctgct

SEQ ID NO: 4877279 - DNA, 22 bp, Homo sapiens
gaaagtcgaattaatagctttt

SEQ ID NO: 4877280 - DNA, 20 bp, Homo sapiens
gaaagtgaataaacttcagc

SEQ ID NO: 4877281 - DNA, 21 bp, Homo sapiens
gaaagtgggtgagatgctgga

SEQ ID NO: 4877282 - DNA, 14 bp, Homo sapiens
gaaataaaaccttt

SEQ ID NO: 4877283 - DNA, 19 bp, Homo sapiens
gaaataaaagtgaatgaaa

SEQ ID NO: 4877284 - DNA, 16 bp, Homo sapiens
gaaataacaaaatgga

SEQ ID NO: 4877285 - DNA, 19 bp, Homo sapiens
gaaataacaaaatggacat

SEQ ID NO: 4877286 - DNA, 16 bp, Homo sapiens
gaaataacaatgttaa

SEQ ID NO: 4877287 - DNA, 20 bp, Homo sapiens
gaaataacaatgttaaggaa

SEQ ID NO: 4877288 - DNA, 14 bp, Homo sapiens
gaaatacccttctt

SEQ ID NO: 4877289 - DNA, 11 bp, Homo sapiens
gaaatacctca

SEQ ID NO: 4877290 - DNA, 18 bp, Homo sapiens
gaaataggaaacaagtga

SEQ ID NO: 4877291 - DNA, 20 bp, Homo sapiens
gaaatataataaaatgtgtt

SEQ ID NO: 4877292 - DNA, 20 bp, Homo sapiens
gaaatatatacgaacaaaac

SEQ ID NO: 4877293 - DNA, 23 bp, Homo sapiens
gaaatatattttaccatacattt

SEQ ID NO: 4877294 - DNA, 12 bp, Homo sapiens
gaaatatcattt

SEQ ID NO: 4877295 - DNA, 13 bp, Homo sapiens
gaaatatcattta

SEQ ID NO: 4877296 - DNA, 14 bp, Homo sapiens
gaaatatgtgagat

SEQ ID NO: 4877297 - DNA, 21 bp, Homo sapiens
gaaatatgtgagattttttat

SEQ ID NO: 4877298 - DNA, 13 bp, Homo sapiens
gaaatattttgat

SEQ ID NO: 4877299 - DNA, 19 bp, Homo sapiens
gaaatattttgataataaa

SEQ ID NO: 4877300 - DNA, 19 bp, Homo sapiens
gaaatcaaagagagaaaat

SEQ ID NO: 4877301 - DNA, 20 bp, Homo sapiens
gaaatcagtaatatttatat

SEQ ID NO: 4877302 - DNA, 19 bp, Homo sapiens
gaaatccctgtttaatatt

SEQ ID NO: 4877303 - DNA, 21 bp, Homo sapiens
gaaatccctgtttaatattta

SEQ ID NO: 4877304 - DNA, 23 bp, Homo sapiens
gaaatcctagtttcctctccttc

SEQ ID NO: 4877305 - DNA, 20 bp, Homo sapiens
gaaatctcctttagccatca

SEQ ID NO: 4877306 - DNA, 13 bp, Homo sapiens
gaaatgaaattta

SEQ ID NO: 4877307 - DNA, 12 bp, Homo sapiens
gaaatgaacatt

SEQ ID NO: 4877308 - DNA, 17 bp, Homo sapiens
gaaatgagaaggcagcc

SEQ ID NO: 4877309 - DNA, 17 bp, Homo sapiens
gaaatgaggtctgttta

SEQ ID NO: 4877310 - DNA, 20 bp, Homo sapiens
gaaatggactggtttgagat

SEQ ID NO: 4877311 - DNA, 16 bp, Homo sapiens
gaaatggatactacat

SEQ ID NO: 4877312 - DNA, 14 bp, Homo sapiens
gaaatgtaaactgc

SEQ ID NO: 4877313 - DNA, 14 bp, Homo sapiens
gaaatgtagttgat

SEQ ID NO: 4877314 - DNA, 21 bp, Homo sapiens
gaaatgtcacgtactgtctga

SEQ ID NO: 4877315 - DNA, 17 bp, Homo sapiens
gaaattatttaataaaa

SEQ ID NO: 4877316 - DNA, 18 bp, Homo sapiens
gaagcaaggaagatatac

SEQ ID NO: 4877317 - DNA, 20 bp, Homo sapiens
gaagcaaggaagatatacat

SEQ ID NO: 4877318 - DNA, 16 bp, Homo sapiens
gaagcaccccatgcca

SEQ ID NO: 4877319 - DNA, 12 bp, Homo sapiens
gaagcatgtttc

SEQ ID NO: 4877320 - DNA, 16 bp, Homo sapiens
gaagcatgtttcatgt

SEQ ID NO: 4877321 - DNA, 22 bp, Homo sapiens
gaagcattccttctttgataat

SEQ ID NO: 4877322 - DNA, 17 bp, Homo sapiens
gaagcattctccccagt

SEQ ID NO: 4877323 - DNA, 18 bp, Homo sapiens
gaagcatttactttgtgt

SEQ ID NO: 4877324 - DNA, 14 bp, Homo sapiens
gaagcatttgtatt

SEQ ID NO: 4877325 - DNA, 15 bp, Homo sapiens
gaagcccaagtgaaa

SEQ ID NO: 4877326 - DNA, 15 bp, Homo sapiens
gaagccctcccaggt

SEQ ID NO: 4877327 - DNA, 13 bp, Homo sapiens
gaagccctggaga

SEQ ID NO: 4877328 - DNA, 20 bp, Homo sapiens
gaagcctgtggatgatcaat

SEQ ID NO: 4877329 - DNA, 16 bp, Homo sapiens
gaagccttcagctcca

SEQ ID NO: 4877330 - DNA, 15 bp, Homo sapiens
gaagctaatttgcat

SEQ ID NO: 4877331 - DNA, 17 bp, Homo sapiens
gaagctaatttgcatta

SEQ ID NO: 4877332 - DNA, 15 bp, Homo sapiens
gaagctacttctcca

SEQ ID NO: 4877333 - DNA, 14 bp, Homo sapiens
gaagctccactgtc

SEQ ID NO: 4877334 - DNA, 22 bp, Homo sapiens
gaagctccgctttctacccagc

SEQ ID NO: 4877335 - DNA, 15 bp, Homo sapiens
gaagctctgaagtca

SEQ ID NO: 4877336 - DNA, 15 bp, Homo sapiens
cttccaaataataaa

SEQ ID NO: 4877337 - DNA, 20 bp, Homo sapiens
cttccaaataataaagtcta

SEQ ID NO: 4877338 - DNA, 19 bp, Homo sapiens
cttccaaatgcaatttgat

SEQ ID NO: 4877339 - DNA, 14 bp, Homo sapiens
cttccactgcctct

SEQ ID NO: 4877340 - DNA, 17 bp, Homo sapiens
cttccagatcactgcca

SEQ ID NO: 4877341 - DNA, 12 bp, Homo sapiens
cttccagatcct

SEQ ID NO: 4877342 - DNA, 12 bp, Homo sapiens
cttccagctcct

SEQ ID NO: 4877343 - DNA, 14 bp, Homo sapiens
cttccagctcctgt

SEQ ID NO: 4877344 - DNA, 16 bp, Homo sapiens
cttccagctgctgtct

SEQ ID NO: 4877345 - DNA, 15 bp, Homo sapiens
cttccaggacccctg

SEQ ID NO: 4877346 - DNA, 17 bp, Homo sapiens
cttccaggacccctggg

SEQ ID NO: 4877347 - DNA, 15 bp, Homo sapiens
cttccaggggaacct

SEQ ID NO: 4877348 - DNA, 19 bp, Homo sapiens
cttccaggggaacctgcca

SEQ ID NO: 4877349 - DNA, 13 bp, Homo sapiens
cttccagggggaa

SEQ ID NO: 4877350 - DNA, 22 bp, Homo sapiens
cttccaggtgttactgtaattc

SEQ ID NO: 4877351 - DNA, 18 bp, Homo sapiens
cttccataatgctactgt

SEQ ID NO: 4877352 - DNA, 19 bp, Homo sapiens
cttccatcccaaccagtgc

SEQ ID NO: 4877353 - DNA, 21 bp, Homo sapiens
cttccatcccaaccagtgcca

SEQ ID NO: 4877354 - DNA, 14 bp, Homo sapiens
cttccatccctacc

SEQ ID NO: 4877355 - DNA, 20 bp, Homo sapiens
cttccatgtcgcctctgcat

SEQ ID NO: 4877356 - DNA, 12 bp, Homo sapiens
cttccatttata

SEQ ID NO: 4877357 - DNA, 15 bp, Homo sapiens
cttcccaatcagcac

SEQ ID NO: 4877358 - DNA, 21 bp, Homo sapiens
cttcccaatcagcactgaaaa

SEQ ID NO: 4877359 - DNA, 22 bp, Homo sapiens
cttcccaatcagcactgaaaat

SEQ ID NO: 4877360 - DNA, 15 bp, Homo sapiens
cttcccacctccctg

SEQ ID NO: 4877361 - DNA, 15 bp, Homo sapiens
cttcccactcacccc

SEQ ID NO: 4877362 - DNA, 23 bp, Homo sapiens
cttcccagttcaggagtcccaag

SEQ ID NO: 4877363 - DNA, 19 bp, Homo sapiens
cttccccagaaaggagact

SEQ ID NO: 4877364 - DNA, 15 bp, Homo sapiens
cttcccccatagcca

SEQ ID NO: 4877365 - DNA, 16 bp, Homo sapiens
cttcccccatagccac

SEQ ID NO: 4877366 - DNA, 18 bp, Homo sapiens
cttcccccatagccaccc

SEQ ID NO: 4877367 - DNA, 12 bp, Homo sapiens
cttccccctcca

SEQ ID NO: 4877368 - DNA, 20 bp, Homo sapiens
cttcccctccctggctccca

SEQ ID NO: 4877369 - DNA, 15 bp, Homo sapiens
cttcccgctcagccc

SEQ ID NO: 4877370 - DNA, 13 bp, Homo sapiens
cttccctacctca

SEQ ID NO: 4877371 - DNA, 16 bp, Homo sapiens
cttccctacctcaggc

SEQ ID NO: 4877372 - DNA, 17 bp, Homo sapiens
cttccctacctcaggca

SEQ ID NO: 4877373 - DNA, 19 bp, Homo sapiens
cttccctgattgacctgct

SEQ ID NO: 4877374 - DNA, 18 bp, Homo sapiens
cttccctgcgcctgtgat

SEQ ID NO: 4877375 - DNA, 15 bp, Homo sapiens
cttcccttccactgc

SEQ ID NO: 4877376 - DNA, 16 bp, Homo sapiens
cttcccttccactgcc

SEQ ID NO: 4877377 - DNA, 12 bp, Homo sapiens
cttcccttgcca

SEQ ID NO: 4877378 - DNA, 15 bp, Homo sapiens
cttcccttgccactt

SEQ ID NO: 4877379 - DNA, 20 bp, Homo sapiens
cttcccttgccactttgcac

SEQ ID NO: 4877380 - DNA, 23 bp, Homo sapiens
cttccgaccctctgggaacctcc

SEQ ID NO: 4877381 - DNA, 20 bp, Homo sapiens
cttccgcccctgcctgccat

SEQ ID NO: 4877382 - DNA, 19 bp, Homo sapiens
cttccgccccttcccttcc

SEQ ID NO: 4877383 - DNA, 22 bp, Homo sapiens
cttccggtagggaggcagcctc

SEQ ID NO: 4877384 - DNA, 24 bp, Homo sapiens
cttcctacaagagcagcctgtggc

SEQ ID NO: 4877385 - DNA, 23 bp, Homo sapiens
cttcctagttttctcctcccagg

SEQ ID NO: 4877386 - DNA, 19 bp, Homo sapiens
cttcctataacttgatgca

SEQ ID NO: 4877387 - DNA, 22 bp, Homo sapiens
cttcctataacttgatgcatgt

SEQ ID NO: 4877388 - DNA, 21 bp, Homo sapiens
cttcctcacagtcccactgtg

SEQ ID NO: 4877389 - DNA, 23 bp, Homo sapiens
cttcctcatccaccccatccctc

SEQ ID NO: 4877390 - DNA, 13 bp, Homo sapiens
cttcctccagctg

SEQ ID NO: 4877391 - DNA, 18 bp, Homo sapiens
cttcctccagctgcacca

SEQ ID NO: 4877392 - DNA, 22 bp, Homo sapiens
cttcctccagctgcaccagagc

SEQ ID NO: 4877393 - DNA, 15 bp, Homo sapiens
cttcctccctcattc

SEQ ID NO: 4877394 - DNA, 16 bp, Homo sapiens
cttcctcctccccact

SEQ ID NO: 4877395 - DNA, 11 bp, Homo sapiens
cttcctcctga

SEQ ID NO: 4877396 - DNA, 11 bp, Homo sapiens
cttcctctgct

SEQ ID NO: 4877397 - DNA, 15 bp, Homo sapiens
cttcctcttcggccc

SEQ ID NO: 4877398 - DNA, 20 bp, Homo sapiens
cttcctggggcatctggcga

SEQ ID NO: 4877399 - DNA, 22 bp, Homo sapiens
cttcctgggtcttcagcattcc

SEQ ID NO: 4877400 - DNA, 20 bp, Homo sapiens
cttcctgtctagtctctcct

SEQ ID NO: 4877401 - DNA, 13 bp, Homo sapiens
cttcctgtgactt

SEQ ID NO: 4877402 - DNA, 16 bp, Homo sapiens
cttcctgtgggagcag

SEQ ID NO: 4877403 - DNA, 14 bp, Homo sapiens
cttccttcctgctt

SEQ ID NO: 4877404 - DNA, 17 bp, Homo sapiens
cttccttgaccttcctc

SEQ ID NO: 4877405 - DNA, 18 bp, Homo sapiens
cttccttgaccttcctct

SEQ ID NO: 4877406 - DNA, 18 bp, Homo sapiens
cttccttgagacacggag

SEQ ID NO: 4877407 - DNA, 22 bp, Homo sapiens
cttcctttactttcccttgctt

SEQ ID NO: 4877408 - DNA, 19 bp, Homo sapiens
cttcctttcccaagccttc

SEQ ID NO: 4877409 - DNA, 16 bp, Homo sapiens
cttcctttctccagga

SEQ ID NO: 4877410 - DNA, 18 bp, Homo sapiens
cttcgacttttcttaaca

SEQ ID NO: 4877411 - DNA, 22 bp, Homo sapiens
cttcgcgcccgcccctgcagca

SEQ ID NO: 4877412 - DNA, 17 bp, Homo sapiens
cttcgtgcccccccttc

SEQ ID NO: 4877413 - DNA, 13 bp, Homo sapiens
cttctaataaatt

SEQ ID NO: 4877414 - DNA, 14 bp, Homo sapiens
cttctagagttcag

SEQ ID NO: 4877415 - DNA, 16 bp, Homo sapiens
cttctattttgtaaac

SEQ ID NO: 4877416 - DNA, 16 bp, Homo sapiens
cttctcaagttctaag

SEQ ID NO: 4877417 - DNA, 21 bp, Homo sapiens
cttctcaagttctaagattct

SEQ ID NO: 4877418 - DNA, 18 bp, Homo sapiens
cttctcacagcacatgct

SEQ ID NO: 4877419 - DNA, 13 bp, Homo sapiens
cttctcacttttt

SEQ ID NO: 4877420 - DNA, 19 bp, Homo sapiens
cttctccaattctgcccaa

SEQ ID NO: 4877421 - DNA, 15 bp, Homo sapiens
cttctccaccctgct

SEQ ID NO: 4877422 - DNA, 17 bp, Homo sapiens
cttctccaccctgctct

SEQ ID NO: 4877423 - DNA, 21 bp, Homo sapiens
cttctccaccctgctctccga

SEQ ID NO: 4877424 - DNA, 15 bp, Homo sapiens
cttctccactggatg

SEQ ID NO: 4877425 - DNA, 17 bp, Homo sapiens
cttctccaggctgtatc

SEQ ID NO: 4877426 - DNA, 16 bp, Homo sapiens
cttctcccagaatccc

SEQ ID NO: 4877427 - DNA, 20 bp, Homo sapiens
cttctcccagaatcccagcc

SEQ ID NO: 4877428 - DNA, 18 bp, Homo sapiens
cttctcctccccacccgc

SEQ ID NO: 4877429 - DNA, 20 bp, Homo sapiens
cttctctcagacttacttta

SEQ ID NO: 4877430 - DNA, 13 bp, Homo sapiens
cttctctccctgc

SEQ ID NO: 4877431 - DNA, 11 bp, Homo sapiens
cttctctgctc

SEQ ID NO: 4877432 - DNA, 15 bp, Homo sapiens
cttctctgctccacc

SEQ ID NO: 4877433 - DNA, 19 bp, Homo sapiens
cttctcttaaacttgtgaa

SEQ ID NO: 4877434 - DNA, 15 bp, Homo sapiens
cttctcttgctttct

SEQ ID NO: 4877435 - DNA, 16 bp, Homo sapiens
cttctcttgctttcta

SEQ ID NO: 4877436 - DNA, 16 bp, Homo sapiens
cttctcttgttaggta

SEQ ID NO: 4877437 - DNA, 15 bp, Homo sapiens
cttctgaaatgaaac

SEQ ID NO: 4877438 - DNA, 22 bp, Homo sapiens
cttctgcaaaaatggatattat

SEQ ID NO: 4877439 - DNA, 15 bp, Homo sapiens
cttctgccatattct

SEQ ID NO: 4877440 - DNA, 21 bp, Homo sapiens
cttctgccatattctgttggc

SEQ ID NO: 4877441 - DNA, 18 bp, Homo sapiens
cttctgccttagtctcag

SEQ ID NO: 4877442 - DNA, 20 bp, Homo sapiens
cttctgccttagtctcagtt

SEQ ID NO: 4877443 - DNA, 15 bp, Homo sapiens
cttctgctccaccct

SEQ ID NO: 4877444 - DNA, 18 bp, Homo sapiens
cttctggaatttgttcaa

SEQ ID NO: 4877445 - DNA, 18 bp, Homo sapiens
cttctggacaggctctgc

SEQ ID NO: 4877446 - DNA, 21 bp, Homo sapiens
cttctggacaggctctgcttc

SEQ ID NO: 4877447 - DNA, 15 bp, Homo sapiens
cctgcctcagcctcc

SEQ ID NO: 4877448 - DNA, 17 bp, Homo sapiens
cctgcctctcacacaca

SEQ ID NO: 4877449 - DNA, 13 bp, Homo sapiens
cctgcctgccatg

SEQ ID NO: 4877450 - DNA, 14 bp, Homo sapiens
cctgcctgccatgt

SEQ ID NO: 4877451 - DNA, 17 bp, Homo sapiens
cctgcgtcttccgcccc

SEQ ID NO: 4877452 - DNA, 17 bp, Homo sapiens
cctgcgttggtccagag

SEQ ID NO: 4877453 - DNA, 18 bp, Homo sapiens
cctgcgttggtccagagc

SEQ ID NO: 4877454 - DNA, 17 bp, Homo sapiens
cctgctaattccccaga

SEQ ID NO: 4877455 - DNA, 21 bp, Homo sapiens
cctgctccgctgctccttggc

SEQ ID NO: 4877456 - DNA, 23 bp, Homo sapiens
cctgctctccaagtctcagtggc

SEQ ID NO: 4877457 - DNA, 21 bp, Homo sapiens
cctgctctccgaccagacacc

SEQ ID NO: 4877458 - DNA, 22 bp, Homo sapiens
cctgctctccgaccagacacct

SEQ ID NO: 4877459 - DNA, 19 bp, Homo sapiens
cctgctctcctcttgccac

SEQ ID NO: 4877460 - DNA, 22 bp, Homo sapiens
cctgctctcctcttgccactgc

SEQ ID NO: 4877461 - DNA, 12 bp, Homo sapiens
cctgctgcaggg

SEQ ID NO: 4877462 - DNA, 13 bp, Homo sapiens
cctgctgcagggg

SEQ ID NO: 4877463 - DNA, 14 bp, Homo sapiens
cctgctgcaggggc

SEQ ID NO: 4877464 - DNA, 10 bp, Homo sapiens
cctgctgcat

SEQ ID NO: 4877465 - DNA, 22 bp, Homo sapiens
cctgctgcccaatctccatctg

SEQ ID NO: 4877466 - DNA, 21 bp, Homo sapiens
cctgctgccgcctcccagcct

SEQ ID NO: 4877467 - DNA, 13 bp, Homo sapiens
cctgctggctctt

SEQ ID NO: 4877468 - DNA, 21 bp, Homo sapiens
cctgcttcccacctccctgcc

SEQ ID NO: 4877469 - DNA, 23 bp, Homo sapiens
cctgcttcccacctccctgccca

SEQ ID NO: 4877470 - DNA, 17 bp, Homo sapiens
cctgctttgggctgccc

SEQ ID NO: 4877471 - DNA, 18 bp, Homo sapiens
cctgctttgggctgccct

SEQ ID NO: 4877472 - DNA, 20 bp, Homo sapiens
cctgctttgggctgccctgg

SEQ ID NO: 4877473 - DNA, 23 bp, Homo sapiens
cctgctttgggctgccctggtgc

SEQ ID NO: 4877474 - DNA, 19 bp, Homo sapiens
cctggacagtatcccacat

SEQ ID NO: 4877475 - DNA, 20 bp, Homo sapiens
cctggacatttgccttgctg

SEQ ID NO: 4877476 - DNA, 21 bp, Homo sapiens
cctggacctgccctgggccac

SEQ ID NO: 4877477 - DNA, 16 bp, Homo sapiens
cctggacctgcctcct

SEQ ID NO: 4877478 - DNA, 20 bp, Homo sapiens
cctggacctgcctcctgcct

SEQ ID NO: 4877479 - DNA, 14 bp, Homo sapiens
cctggactgggagg

SEQ ID NO: 4877480 - DNA, 22 bp, Homo sapiens
cctggagacgtggaacctctgt

SEQ ID NO: 4877481 - DNA, 18 bp, Homo sapiens
cctggaggattgcaggtg

SEQ ID NO: 4877482 - DNA, 19 bp, Homo sapiens
cctggagtgcccaccctgg

SEQ ID NO: 4877483 - DNA, 21 bp, Homo sapiens
cctggagtgtggctgaggagg

SEQ ID NO: 4877484 - DNA, 21 bp, Homo sapiens
cctggatttctggttctgatg

SEQ ID NO: 4877485 - DNA, 13 bp, Homo sapiens
cctggcacacatc

SEQ ID NO: 4877486 - DNA, 15 bp, Homo sapiens
cctggcacacatcag

SEQ ID NO: 4877487 - DNA, 15 bp, Homo sapiens
cctggcacaggactg

SEQ ID NO: 4877488 - DNA, 21 bp, Homo sapiens
cctggcacccggcccctgctg

SEQ ID NO: 4877489 - DNA, 22 bp, Homo sapiens
cctggcacccggcccctgctgg

SEQ ID NO: 4877490 - DNA, 22 bp, Homo sapiens
cctggcacggtggctcaggcct

SEQ ID NO: 4877491 - DNA, 17 bp, Homo sapiens
cctggcagcccagagac

SEQ ID NO: 4877492 - DNA, 20 bp, Homo sapiens
cctggcagggaggtcaggcc

SEQ ID NO: 4877493 - DNA, 21 bp, Homo sapiens
cctggcagggaggtcaggccc

SEQ ID NO: 4877494 - DNA, 23 bp, Homo sapiens
cctggcagggaggtcaggccctg

SEQ ID NO: 4877495 - DNA, 17 bp, Homo sapiens
cctggcattcttgtaca

SEQ ID NO: 4877496 - DNA, 20 bp, Homo sapiens
cctggcattcttgtacagtg

SEQ ID NO: 4877497 - DNA, 14 bp, Homo sapiens
cctggccacctctc

SEQ ID NO: 4877498 - DNA, 13 bp, Homo sapiens
cctggccactgct

SEQ ID NO: 4877499 - DNA, 15 bp, Homo sapiens
cctggccaggagctc

SEQ ID NO: 4877500 - DNA, 14 bp, Homo sapiens
cctggccaggcaga

SEQ ID NO: 4877501 - DNA, 14 bp, Homo sapiens
cctggcccctcgcc

SEQ ID NO: 4877502 - DNA, 15 bp, Homo sapiens
cctggcccctcgcct

SEQ ID NO: 4877503 - DNA, 15 bp, Homo sapiens
cctggccgccccctg

SEQ ID NO: 4877504 - DNA, 22 bp, Homo sapiens
cctggccgccccctgcccccca

SEQ ID NO: 4877505 - DNA, 15 bp, Homo sapiens
ctgtcctgcttctga

SEQ ID NO: 4877506 - DNA, 21 bp, Homo sapiens
ctgtcctgggagtgagctggt

SEQ ID NO: 4877507 - DNA, 22 bp, Homo sapiens
ctgtcgagttcggctctgggtg

SEQ ID NO: 4877508 - DNA, 13 bp, Homo sapiens
ctgtcgcccagtc

SEQ ID NO: 4877509 - DNA, 15 bp, Homo sapiens
ctgtcgcccagtctg

SEQ ID NO: 4877510 - DNA, 16 bp, Homo sapiens
ctgtcgcccagtctgg

SEQ ID NO: 4877511 - DNA, 13 bp, Homo sapiens
ctgtctaaaaaac

SEQ ID NO: 4877512 - DNA, 16 bp, Homo sapiens
ctgtctaaaaaccaga

SEQ ID NO: 4877513 - DNA, 23 bp, Homo sapiens
ctgtctcaaaaaaacacaaaagt

SEQ ID NO: 4877514 - DNA, 21 bp, Homo sapiens
ctgtctcagacttttgtacat

SEQ ID NO: 4877515 - DNA, 12 bp, Homo sapiens
ctgtctcagcct

SEQ ID NO: 4877516 - DNA, 15 bp, Homo sapiens
ctgtctcagcctccc

SEQ ID NO: 4877517 - DNA, 20 bp, Homo sapiens
ctgtctcatccccaggggtc

SEQ ID NO: 4877518 - DNA, 16 bp, Homo sapiens
ctgtctcatcctcctg

SEQ ID NO: 4877519 - DNA, 22 bp, Homo sapiens
ctgtctcatcctcctggaacct

SEQ ID NO: 4877520 - DNA, 14 bp, Homo sapiens
ctgtctccactgtg

SEQ ID NO: 4877521 - DNA, 20 bp, Homo sapiens
ctgtctctaacttattttat

SEQ ID NO: 4877522 - DNA, 19 bp, Homo sapiens
ctgtctctgaagtactaac

SEQ ID NO: 4877523 - DNA, 12 bp, Homo sapiens
ctgtctctgctc

SEQ ID NO: 4877524 - DNA, 17 bp, Homo sapiens
ctgtctctgctcgccct

SEQ ID NO: 4877525 - DNA, 20 bp, Homo sapiens
ctgtctgacaacctcttggt

SEQ ID NO: 4877526 - DNA, 15 bp, Homo sapiens
ctgtctgctcagaca

SEQ ID NO: 4877527 - DNA, 14 bp, Homo sapiens
ctgtcttgtaatat

SEQ ID NO: 4877528 - DNA, 16 bp, Homo sapiens
ctgtctttaaaagaga

SEQ ID NO: 4877529 - DNA, 23 bp, Homo sapiens
ctgtctttctgagcacactttag

SEQ ID NO: 4877530 - DNA, 13 bp, Homo sapiens
ctgtgaaacctgt

SEQ ID NO: 4877531 - DNA, 19 bp, Homo sapiens
ctgtgaaacctgtgaagct

SEQ ID NO: 4877532 - DNA, 15 bp, Homo sapiens
ctgtgaacaggctgg

SEQ ID NO: 4877533 - DNA, 14 bp, Homo sapiens
ctgtgacctcaggc

SEQ ID NO: 4877534 - DNA, 17 bp, Homo sapiens
ctgtgacctcaggcact

SEQ ID NO: 4877535 - DNA, 22 bp, Homo sapiens
ctgtgacctcaggcactagcct

SEQ ID NO: 4877536 - DNA, 18 bp, Homo sapiens
ctgtgagacccccacacc

SEQ ID NO: 4877537 - DNA, 17 bp, Homo sapiens
ctgtgagccttggctgt

SEQ ID NO: 4877538 - DNA, 17 bp, Homo sapiens
ctgtgaggaaagcacac

SEQ ID NO: 4877539 - DNA, 17 bp, Homo sapiens
ctgtgaggcccctggac

SEQ ID NO: 4877540 - DNA, 22 bp, Homo sapiens
ctgtgagtctttggttctaagg

SEQ ID NO: 4877541 - DNA, 17 bp, Homo sapiens
ctgtgagtttaaagcaa

SEQ ID NO: 4877542 - DNA, 13 bp, Homo sapiens
ctgtgatcattta

SEQ ID NO: 4877543 - DNA, 18 bp, Homo sapiens
ctgtgatcttttaaagtg

SEQ ID NO: 4877544 - DNA, 22 bp, Homo sapiens
ctgtgatgagctgatctgcgga

SEQ ID NO: 4877545 - DNA, 14 bp, Homo sapiens
ctgtgatgctgggc

SEQ ID NO: 4877546 - DNA, 21 bp, Homo sapiens
ctgtgcaacgccgtgggctgc

SEQ ID NO: 4877547 - DNA, 15 bp, Homo sapiens
ctgtgcacacacaca

SEQ ID NO: 4877548 - DNA, 21 bp, Homo sapiens
ctgtgcacacacacacacatg

SEQ ID NO: 4877549 - DNA, 17 bp, Homo sapiens
ctgtgcagcgcagctgg

SEQ ID NO: 4877550 - DNA, 15 bp, Homo sapiens
ctgtgccatgtgcca

SEQ ID NO: 4877551 - DNA, 16 bp, Homo sapiens
ctgtgcctcctcaccc

SEQ ID NO: 4877552 - DNA, 12 bp, Homo sapiens
ctgtgcctctgc

SEQ ID NO: 4877553 - DNA, 13 bp, Homo sapiens
ctgtgcctctgcc

SEQ ID NO: 4877554 - DNA, 17 bp, Homo sapiens
ctgtgcgttactaattg

SEQ ID NO: 4877555 - DNA, 22 bp, Homo sapiens
ctgtgctactgtctttggaaaa

SEQ ID NO: 4877556 - DNA, 14 bp, Homo sapiens
ctgtgctctggaca

SEQ ID NO: 4877557 - DNA, 15 bp, Homo sapiens
ctgtgctctggacag

SEQ ID NO: 4877558 - DNA, 17 bp, Homo sapiens
ctgtgctctggacaggc

SEQ ID NO: 4877559 - DNA, 14 bp, Homo sapiens
ctgtgctgaatgct

SEQ ID NO: 4877560 - DNA, 13 bp, Homo sapiens
ctgtgctggggga

SEQ ID NO: 4877561 - DNA, 21 bp, Homo sapiens
ctgtgctgtggaagcaacagg

SEQ ID NO: 4877562 - DNA, 22 bp, Homo sapiens
ctgtggaacccagcagttctgt

SEQ ID NO: 4877563 - DNA, 15 bp, Homo sapiens
ctgtggagctcagcc

SEQ ID NO: 4877564 - DNA, 17 bp, Homo sapiens
ctgtggagctcagcccc

SEQ ID NO: 4877565 - DNA, 15 bp, Homo sapiens
ctgtggaggaaggat

SEQ ID NO: 4877566 - DNA, 19 bp, Homo sapiens
ctgtggaggaaggattgta

SEQ ID NO: 4877567 - DNA, 23 bp, Homo sapiens
ctgtggaggaaggattgtaaaaa

SEQ ID NO: 4877568 - DNA, 20 bp, Homo sapiens
ctgtggatacccttaccctt

SEQ ID NO: 4877569 - DNA, 15 bp, Homo sapiens
ctgtggcacttgcct

SEQ ID NO: 4877570 - DNA, 19 bp, Homo sapiens
ctgtggcacttgcctgggt

SEQ ID NO: 4877571 - DNA, 13 bp, Homo sapiens
ctgtggccctggc

SEQ ID NO: 4877572 - DNA, 19 bp, Homo sapiens
ctgtggccctggctctgct

SEQ ID NO: 4877573 - DNA, 14 bp, Homo sapiens
ctgtggggaaaggg

SEQ ID NO: 4877574 - DNA, 23 bp, Homo sapiens
ctgtgggggtgagggtcccatgt

SEQ ID NO: 4877575 - DNA, 18 bp, Homo sapiens
ctgtgtactgtatagaca

SEQ ID NO: 4877576 - DNA, 13 bp, Homo sapiens
ctgtgtactgtgt

SEQ ID NO: 4877577 - DNA, 15 bp, Homo sapiens
ctgtgtatattattt

SEQ ID NO: 4877578 - DNA, 17 bp, Homo sapiens
ctgtgtatattatttgg

SEQ ID NO: 4877579 - DNA, 19 bp, Homo sapiens
ctgtgtatattatttggca

SEQ ID NO: 4877580 - DNA, 15 bp, Homo sapiens
ctgtgtatggaaaaa

SEQ ID NO: 4877581 - DNA, 23 bp, Homo sapiens
ctgtgtcataaacagatgaataa

SEQ ID NO: 4877582 - DNA, 13 bp, Homo sapiens
ctgtgtctaagat

SEQ ID NO: 4877583 - DNA, 16 bp, Homo sapiens
ctgtgtctaagattct

SEQ ID NO: 4877584 - DNA, 21 bp, Homo sapiens
ctgtgtctaagattctagatc

SEQ ID NO: 4877585 - DNA, 21 bp, Homo sapiens
ctgtgtcttgcaatggcagcc

SEQ ID NO: 4877586 - DNA, 19 bp, Homo sapiens
ctgtgtgatgaactttctc

SEQ ID NO: 4877587 - DNA, 16 bp, Homo sapiens
ctgtgtgcacaaatat

SEQ ID NO: 4877588 - DNA, 18 bp, Homo sapiens
ctgtgtgctcctccttgg

SEQ ID NO: 4877589 - DNA, 12 bp, Homo sapiens
ctgtgtggaact

SEQ ID NO: 4877590 - DNA, 18 bp, Homo sapiens
ctgtgtgtgcgcctacag

SEQ ID NO: 4877591 - DNA, 20 bp, Homo sapiens
ctgtgtgtgcgcctacagga

SEQ ID NO: 4877592 - DNA, 12 bp, Homo sapiens
ctgtgtgtgtga

SEQ ID NO: 4877593 - DNA, 14 bp, Homo sapiens
ctgtgtgtgtgaat

SEQ ID NO: 4877594 - DNA, 13 bp, Homo sapiens
ctgtgttgtatta

SEQ ID NO: 4877595 - DNA, 19 bp, Homo sapiens
ctgtgttgtattaacaaaa

SEQ ID NO: 4877596 - DNA, 22 bp, Homo sapiens
ctgtgttgtattaacaaaagtt

SEQ ID NO: 4877597 - DNA, 17 bp, Homo sapiens
ctgtgtttataaaatat

SEQ ID NO: 4877598 - DNA, 19 bp, Homo sapiens
ctgtgtttataaaatataa

SEQ ID NO: 4877599 - DNA, 11 bp, Homo sapiens
ctgttaaactg

SEQ ID NO: 4877600 - DNA, 15 bp, Homo sapiens
ctgttaaactgttag

SEQ ID NO: 4877601 - DNA, 19 bp, Homo sapiens
ctgttaaactgttagcact

SEQ ID NO: 4877602 - DNA, 18 bp, Homo sapiens
ctgttaatgtatttgttc

SEQ ID NO: 4877603 - DNA, 19 bp, Homo sapiens
actcagtccatagcagaga

SEQ ID NO: 4877604 - DNA, 23 bp, Homo sapiens
actcagtttatgttgtacaatgt

SEQ ID NO: 4877605 - DNA, 20 bp, Homo sapiens
actcatcaatcaaataagta

SEQ ID NO: 4877606 - DNA, 19 bp, Homo sapiens
actcattgaaatgtcacgt

SEQ ID NO: 4877607 - DNA, 17 bp, Homo sapiens
actcatttctaaaagaa

SEQ ID NO: 4877608 - DNA, 21 bp, Homo sapiens
actcatttctaaaagaatatt

SEQ ID NO: 4877609 - DNA, 15 bp, Homo sapiens
actcattttctataa

SEQ ID NO: 4877610 - DNA, 16 bp, Homo sapiens
actcattttctataac

SEQ ID NO: 4877611 - DNA, 21 bp, Homo sapiens
actcattttctataacagata

SEQ ID NO: 4877612 - DNA, 15 bp, Homo sapiens
actcatttttgccat

SEQ ID NO: 4877613 - DNA, 16 bp, Homo sapiens
actcatttttttaatt

SEQ ID NO: 4877614 - DNA, 19 bp, Homo sapiens
actcatttttttaatttat

SEQ ID NO: 4877615 - DNA, 17 bp, Homo sapiens
actccaagaacaattgt

SEQ ID NO: 4877616 - DNA, 17 bp, Homo sapiens
actccaaggttcccttg

SEQ ID NO: 4877617 - DNA, 13 bp, Homo sapiens
actccaccttccc

SEQ ID NO: 4877618 - DNA, 13 bp, Homo sapiens
actccagacccct

SEQ ID NO: 4877619 - DNA, 15 bp, Homo sapiens
actccagacccctgg

SEQ ID NO: 4877620 - DNA, 19 bp, Homo sapiens
actccagacccctggcttt

SEQ ID NO: 4877621 - DNA, 14 bp, Homo sapiens
actccagcctgggc

SEQ ID NO: 4877622 - DNA, 18 bp, Homo sapiens
actccagcctgggcaaca

SEQ ID NO: 4877623 - DNA, 14 bp, Homo sapiens
actccagtgccagc

SEQ ID NO: 4877624 - DNA, 14 bp, Homo sapiens
actccagtgtacat

SEQ ID NO: 4877625 - DNA, 14 bp, Homo sapiens
actccattcccaac

SEQ ID NO: 4877626 - DNA, 22 bp, Homo sapiens
actcccagtccaaatgtcctcc

SEQ ID NO: 4877627 - DNA, 16 bp, Homo sapiens
actcccatcacctcta

SEQ ID NO: 4877628 - DNA, 14 bp, Homo sapiens
actccccaaggaag

SEQ ID NO: 4877629 - DNA, 22 bp, Homo sapiens
actccccctaaacccctgtccc

SEQ ID NO: 4877630 - DNA, 19 bp, Homo sapiens
actcccttggtggcaagag

SEQ ID NO: 4877631 - DNA, 21 bp, Homo sapiens
actcccttggtggcaagagcc

SEQ ID NO: 4877632 - DNA, 13 bp, Homo sapiens
actccgcccccag

SEQ ID NO: 4877633 - DNA, 15 bp, Homo sapiens
actccgcccccagcc

SEQ ID NO: 4877634 - DNA, 16 bp, Homo sapiens
actccgcccccagcct

SEQ ID NO: 4877635 - DNA, 21 bp, Homo sapiens
actccgcccccagcctatgag

SEQ ID NO: 4877636 - DNA, 22 bp, Homo sapiens
actcctacaagatttagaaaaa

SEQ ID NO: 4877637 - DNA, 20 bp, Homo sapiens
actcctagagaacgcagccc

SEQ ID NO: 4877638 - DNA, 14 bp, Homo sapiens
actcctatttttgt

SEQ ID NO: 4877639 - DNA, 12 bp, Homo sapiens
actcctcccagg

SEQ ID NO: 4877640 - DNA, 21 bp, Homo sapiens
actcctcctccaaaggccccc

SEQ ID NO: 4877641 - DNA, 23 bp, Homo sapiens
actcctcctccaaaggcccccta

SEQ ID NO: 4877642 - DNA, 16 bp, Homo sapiens
actcctcctctttctc

SEQ ID NO: 4877643 - DNA, 18 bp, Homo sapiens
actcctcctctttctctc

SEQ ID NO: 4877644 - DNA, 19 bp, Homo sapiens
actcctcctctttctctcc

SEQ ID NO: 4877645 - DNA, 21 bp, Homo sapiens
actcctcctctttctctcccc

SEQ ID NO: 4877646 - DNA, 22 bp, Homo sapiens
actcctcctctttctctcccca

SEQ ID NO: 4877647 - DNA, 13 bp, Homo sapiens
actcctctgtcca

SEQ ID NO: 4877648 - DNA, 19 bp, Homo sapiens
actcctgacagtcttgtgc

SEQ ID NO: 4877649 - DNA, 21 bp, Homo sapiens
actcctgacagtcttgtgctt

SEQ ID NO: 4877650 - DNA, 13 bp, Homo sapiens
actcctggcctca

SEQ ID NO: 4877651 - DNA, 21 bp, Homo sapiens
actcctggtctgaaaatgttg

SEQ ID NO: 4877652 - DNA, 12 bp, Homo sapiens
actcgcttcccc

SEQ ID NO: 4877653 - DNA, 17 bp, Homo sapiens
actctaaattctttatt

SEQ ID NO: 4877654 - DNA, 23 bp, Homo sapiens
actctaaattctttatttctgtc

SEQ ID NO: 4877655 - DNA, 12 bp, Homo sapiens
actctaagatct

SEQ ID NO: 4877656 - DNA, 21 bp, Homo sapiens
actctacttagcatgtcccta

SEQ ID NO: 4877657 - DNA, 17 bp, Homo sapiens
actctagacaagatatt

SEQ ID NO: 4877658 - DNA, 20 bp, Homo sapiens
actctagacaagatattgta

SEQ ID NO: 4877659 - DNA, 21 bp, Homo sapiens
actctagacaagatattgtac

SEQ ID NO: 4877660 - DNA, 14 bp, Homo sapiens
actctagagtccaa

SEQ ID NO: 4877661 - DNA, 16 bp, Homo sapiens
actctatgccccaaat

SEQ ID NO: 4877662 - DNA, 17 bp, Homo sapiens
actctatgccccaaata

SEQ ID NO: 4877663 - DNA, 21 bp, Homo sapiens
actctatgccccaaatatagc

SEQ ID NO: 4877664 - DNA, 22 bp, Homo sapiens
actctcagcccagaagaaaatt

SEQ ID NO: 4877665 - DNA, 10 bp, Homo sapiens
actctcccca

SEQ ID NO: 4877666 - DNA, 14 bp, Homo sapiens
actctccccacact

SEQ ID NO: 4877667 - DNA, 20 bp, Homo sapiens
actctctccaccctatatgt

SEQ ID NO: 4877668 - DNA, 20 bp, Homo sapiens
actctcttccctttccccag

SEQ ID NO: 4877669 - DNA, 21 bp, Homo sapiens
actctcttccctttccccagc

SEQ ID NO: 4877670 - DNA, 18 bp, Homo sapiens
actctgaagcctctggga

SEQ ID NO: 4877671 - DNA, 18 bp, Homo sapiens
actctgacaagggctgac

SEQ ID NO: 4877672 - DNA, 24 bp, Homo sapiens
actctgcagactgctagtgttctg

SEQ ID NO: 4877673 - DNA, 18 bp, Homo sapiens
actctgcatcccagcacc

SEQ ID NO: 4877674 - DNA, 21 bp, Homo sapiens
actctgcatcccagcacctgc

SEQ ID NO: 4877675 - DNA, 13 bp, Homo sapiens
actctgccccctg

SEQ ID NO: 4877676 - DNA, 18 bp, Homo sapiens
actctgccccctgctggc

SEQ ID NO: 4877677 - DNA, 12 bp, Homo sapiens
actctgcctcct

SEQ ID NO: 4877678 - DNA, 20 bp, Homo sapiens
actctgggcacactctgcca

SEQ ID NO: 4877679 - DNA, 18 bp, Homo sapiens
actctgggctatggacac

SEQ ID NO: 4877680 - DNA, 20 bp, Homo sapiens
actctgggctatggacacag

SEQ ID NO: 4877681 - DNA, 14 bp, Homo sapiens
actctggtgcctcc

SEQ ID NO: 4877682 - DNA, 16 bp, Homo sapiens
actctggtgcctccag

SEQ ID NO: 4877683 - DNA, 17 bp, Homo sapiens
actctggtgcctccaga

SEQ ID NO: 4877684 - DNA, 16 bp, Homo sapiens
actctgttatttagac

SEQ ID NO: 4877685 - DNA, 12 bp, Homo sapiens
actcttatctca

SEQ ID NO: 4877686 - DNA, 22 bp, Homo sapiens
actcttatctcagtcatgcata

SEQ ID NO: 4877687 - DNA, 23 bp, Homo sapiens
actcttatctcagtcatgcataa

SEQ ID NO: 4877688 - DNA, 18 bp, Homo sapiens
actctttatagtgcacaa

SEQ ID NO: 4877689 - DNA, 12 bp, Homo sapiens
actcttttgctt

SEQ ID NO: 4877690 - DNA, 19 bp, Homo sapiens
actgaaaataccatcaggc

SEQ ID NO: 4877691 - DNA, 23 bp, Homo sapiens
actgaaaatctaatattaaaaat

SEQ ID NO: 4877692 - DNA, 18 bp, Homo sapiens
actgaaacagatttcata

SEQ ID NO: 4877693 - DNA, 13 bp, Homo sapiens
actgaaacttccc

SEQ ID NO: 4877694 - DNA, 21 bp, Homo sapiens
actgaaagacaccatttatct

SEQ ID NO: 4877695 - DNA, 13 bp, Homo sapiens
actgaagtgctta

SEQ ID NO: 4877696 - DNA, 21 bp, Homo sapiens
actgaattaatcatctataaa

SEQ ID NO: 4877697 - DNA, 15 bp, Homo sapiens
actgaatttgtactt

SEQ ID NO: 4877698 - DNA, 18 bp, Homo sapiens
actgacagcctcccaccc

SEQ ID NO: 4877699 - DNA, 15 bp, Homo sapiens
actgacccttccaga

SEQ ID NO: 4877700 - DNA, 21 bp, Homo sapiens
actgaccttggagagacacag

SEQ ID NO: 4877701 - DNA, 18 bp, Homo sapiens
actgagccccgcagacct

SEQ ID NO: 4877702 - DNA, 21 bp, Homo sapiens
actgagccccgcagacctccc

SEQ ID NO: 4877703 - DNA, 16 bp, Homo sapiens
actgaggaattttctt

SEQ ID NO: 4877704 - DNA, 20 bp, Homo sapiens
actgaggaattttctttgtg

SEQ ID NO: 4877705 - DNA, 19 bp, Homo sapiens
actgaggacaaagtggagg

SEQ ID NO: 4877706 - DNA, 21 bp, Homo sapiens
actgagggaccaactgggccc

SEQ ID NO: 4877707 - DNA, 17 bp, Homo sapiens
actgagggactctgaag

SEQ ID NO: 4877708 - DNA, 16 bp, Homo sapiens
actgatagtgtccaaa

SEQ ID NO: 4877709 - DNA, 14 bp, Homo sapiens
actgatatattttc

SEQ ID NO: 4877710 - DNA, 15 bp, Homo sapiens
actgatgctgttctc

SEQ ID NO: 4877711 - DNA, 22 bp, Homo sapiens
actgatgggcaacccccagcct

SEQ ID NO: 4877712 - DNA, 20 bp, Homo sapiens
actgattgttttagagacta

SEQ ID NO: 4877713 - DNA, 13 bp, Homo sapiens
actgcaacctccg

SEQ ID NO: 4877714 - DNA, 17 bp, Homo sapiens
actgcaagaggctcctg

SEQ ID NO: 4877715 - DNA, 18 bp, Homo sapiens
actgcaataacttctgac

SEQ ID NO: 4877716 - DNA, 20 bp, Homo sapiens
actgcaataacttctgacct

SEQ ID NO: 4877717 - DNA, 20 bp, Homo sapiens
actgcacagcggcccctgca

SEQ ID NO: 4877718 - DNA, 22 bp, Homo sapiens
actgcacagcggcccctgcatc

SEQ ID NO: 4877719 - DNA, 20 bp, Homo sapiens
actgcactatagcctaggtg

SEQ ID NO: 4877720 - DNA, 21 bp, Homo sapiens
actgcactatagcctaggtga

SEQ ID NO: 4877721 - DNA, 15 bp, Homo sapiens
actgcagctttacat

SEQ ID NO: 4877722 - DNA, 16 bp, Homo sapiens
actgcagggactgcca

SEQ ID NO: 4877723 - DNA, 17 bp, Homo sapiens
actgcagggactgccag

SEQ ID NO: 4877724 - DNA, 20 bp, Homo sapiens
actgcagggccaggactgag

SEQ ID NO: 4877725 - DNA, 22 bp, Homo sapiens
actgcagggccaggactgagcc

SEQ ID NO: 4877726 - DNA, 21 bp, Homo sapiens
actgcatgtaccatttgcatg

SEQ ID NO: 4877727 - DNA, 15 bp, Homo sapiens
actgcattattctct

SEQ ID NO: 4877728 - DNA, 21 bp, Homo sapiens
actgcattgactttcagtaaa

SEQ ID NO: 4877729 - DNA, 18 bp, Homo sapiens
actgccacactctccatc

SEQ ID NO: 4877730 - DNA, 16 bp, Homo sapiens
actgccactttgcaca

SEQ ID NO: 4877731 - DNA, 16 bp, Homo sapiens
actgccagcagcagca

SEQ ID NO: 4877732 - DNA, 19 bp, Homo sapiens
actgccagtccccctgccc

SEQ ID NO: 4877733 - DNA, 18 bp, Homo sapiens
actgccattattttctgt

SEQ ID NO: 4877734 - DNA, 16 bp, Homo sapiens
actgcccgcacaccct

SEQ ID NO: 4877735 - DNA, 20 bp, Homo sapiens
actgccgtgcattagcacag

SEQ ID NO: 4877736 - DNA, 17 bp, Homo sapiens
actgcctcgaaacacag

SEQ ID NO: 4877737 - DNA, 19 bp, Homo sapiens
actgcctcgaaacacagaa

SEQ ID NO: 4877738 - DNA, 15 bp, Homo sapiens
actgcctctgcctta

SEQ ID NO: 4877739 - DNA, 22 bp, Homo sapiens
actgcctctgccttagaggagc

SEQ ID NO: 4877740 - DNA, 14 bp, Homo sapiens
actgcctcttcctc

SEQ ID NO: 4877741 - DNA, 11 bp, Homo sapiens
actgcctgggc

SEQ ID NO: 4877742 - DNA, 13 bp, Homo sapiens
actgcctgtatac

SEQ ID NO: 4877743 - DNA, 14 bp, Homo sapiens
actgcctgtatact

SEQ ID NO: 4877744 - DNA, 16 bp, Homo sapiens
actgcctgtatacttt

SEQ ID NO: 4877745 - DNA, 20 bp, Homo sapiens
actgcctgtatactttagta

SEQ ID NO: 4877746 - DNA, 14 bp, Homo sapiens
actgcgttctgcaa

SEQ ID NO: 4877747 - DNA, 17 bp, Homo sapiens
actgctagtgttctgtc

SEQ ID NO: 4877748 - DNA, 18 bp, Homo sapiens
actgctcaggctgcagct

SEQ ID NO: 4877749 - DNA, 20 bp, Homo sapiens
actgctccccagccctggct

SEQ ID NO: 4877750 - DNA, 15 bp, Homo sapiens
actgctccctgaagc

SEQ ID NO: 4877751 - DNA, 18 bp, Homo sapiens
actgctccctgaagccag

SEQ ID NO: 4877752 - DNA, 13 bp, Homo sapiens
actgctgctgcct

SEQ ID NO: 4877753 - DNA, 15 bp, Homo sapiens
actgctgctgcctgg

SEQ ID NO: 4877754 - DNA, 18 bp, Homo sapiens
actgctgctgcctggcca

SEQ ID NO: 4877755 - DNA, 23 bp, Homo sapiens
actgctttgggatttaatttcca

SEQ ID NO: 4877756 - DNA, 14 bp, Homo sapiens
actgcttttggtct

SEQ ID NO: 4877757 - DNA, 15 bp, Homo sapiens
actgcttttggtctg

SEQ ID NO: 4877758 - DNA, 18 bp, Homo sapiens
actgcttttttttttcca

SEQ ID NO: 4877759 - DNA, 18 bp, Homo sapiens
actggaacggtgaaggtg

SEQ ID NO: 4877760 - DNA, 19 bp, Homo sapiens
actggaagctaatttgcat

SEQ ID NO: 4877761 - DNA, 20 bp, Homo sapiens
actggaagctaatttgcatt

SEQ ID NO: 4877762 - DNA, 18 bp, Homo sapiens
actggaaggggaagggac

SEQ ID NO: 4877763 - DNA, 23 bp, Homo sapiens
actggaataagaagcaaataaat

SEQ ID NO: 4877764 - DNA, 13 bp, Homo sapiens
actggaattaaaa

SEQ ID NO: 4877765 - DNA, 21 bp, Homo sapiens
actggaccactgggcaatgat

SEQ ID NO: 4877766 - DNA, 14 bp, Homo sapiens
actggcccctgggt

SEQ ID NO: 4877767 - DNA, 18 bp, Homo sapiens
actggctagagtcctcac

SEQ ID NO: 4877768 - DNA, 22 bp, Homo sapiens
actggctgcaaagggtatcagg

SEQ ID NO: 4877769 - DNA, 18 bp, Homo sapiens
actgggcaatgatggcaa

SEQ ID NO: 4877770 - DNA, 20 bp, Homo sapiens
actgggccttagtgggccag

SEQ ID NO: 4877771 - DNA, 21 bp, Homo sapiens
actgggccttagtgggccagg

SEQ ID NO: 4877772 - DNA, 13 bp, Homo sapiens
actggggagcccg

SEQ ID NO: 4877773 - DNA, 21 bp, Homo sapiens
actggggagcccgtctcagtg

SEQ ID NO: 4877774 - DNA, 15 bp, Homo sapiens
actggggagtctttg

SEQ ID NO: 4877775 - DNA, 17 bp, Homo sapiens
actggggcctccagaac

SEQ ID NO: 4877776 - DNA, 13 bp, Homo sapiens
actggggggcttg

SEQ ID NO: 4877777 - DNA, 23 bp, Homo sapiens
actgggtacttgtggacacagct

SEQ ID NO: 4877778 - DNA, 17 bp, Homo sapiens
actgggtgtcatttcat

SEQ ID NO: 4877779 - DNA, 22 bp, Homo sapiens
actgggtgtcatttcattccat

SEQ ID NO: 4877780 - DNA, 14 bp, Homo sapiens
actggtcctgtgtg

SEQ ID NO: 4877781 - DNA, 20 bp, Homo sapiens
actggtcctgtgtgcagtga

SEQ ID NO: 4877782 - DNA, 20 bp, Homo sapiens
actggtggcccgacagcctg

SEQ ID NO: 4877783 - DNA, 22 bp, Homo sapiens
actggtggcccgacagcctggc

SEQ ID NO: 4877784 - DNA, 19 bp, Homo sapiens
actggtgtttgaaagtagg

SEQ ID NO: 4877785 - DNA, 18 bp, Homo sapiens
actggtttacaggccctg

SEQ ID NO: 4877786 - DNA, 16 bp, Homo sapiens
actgtaataatacctc

SEQ ID NO: 4877787 - DNA, 23 bp, Homo sapiens
actgtaataatacctcaatgttt

SEQ ID NO: 4877788 - DNA, 15 bp, Homo sapiens
actgtacataaacaa

SEQ ID NO: 4877789 - DNA, 16 bp, Homo sapiens
actgtacatttaaaat

SEQ ID NO: 4877790 - DNA, 22 bp, Homo sapiens
actgtacatttaaaattgctat

SEQ ID NO: 4877791 - DNA, 16 bp, Homo sapiens
actgtacccaaatgga

SEQ ID NO: 4877792 - DNA, 12 bp, Homo sapiens
actgtactaatt

SEQ ID NO: 4877793 - DNA, 18 bp, Homo sapiens
actgtactaattcttaca

SEQ ID NO: 4877794 - DNA, 22 bp, Homo sapiens
actgtactaattcttacactgc

SEQ ID NO: 4877795 - DNA, 20 bp, Homo sapiens
actgtactcctcccaggcgc

SEQ ID NO: 4877796 - DNA, 17 bp, Homo sapiens
actgtactgacttgagg

SEQ ID NO: 4877797 - DNA, 19 bp, Homo sapiens
actgtagaatgatttcatg

SEQ ID NO: 4877798 - DNA, 17 bp, Homo sapiens
actgtagcctggatatt

SEQ ID NO: 4877799 - DNA, 18 bp, Homo sapiens
actgtagctttgtgaaat

SEQ ID NO: 4877800 - DNA, 13 bp, Homo sapiens
actgtagttctaa

SEQ ID NO: 4877801 - DNA, 17 bp, Homo sapiens
actgtagttctaagact

SEQ ID NO: 4877802 - DNA, 12 bp, Homo sapiens
actgtataaata

SEQ ID NO: 4877803 - DNA, 13 bp, Homo sapiens
actgtataaatag

SEQ ID NO: 4877804 - DNA, 14 bp, Homo sapiens
actgtataaatagg

SEQ ID NO: 4877805 - DNA, 17 bp, Homo sapiens
actgtataaataggaga

SEQ ID NO: 4877806 - DNA, 21 bp, Homo sapiens
actgtataaataggagaggat

SEQ ID NO: 4877807 - DNA, 22 bp, Homo sapiens
actgtataaataggagaggatg

SEQ ID NO: 4877808 - DNA, 23 bp, Homo sapiens
actgtataaataggagaggatga

SEQ ID NO: 4877809 - DNA, 17 bp, Homo sapiens
actgtatagacagtttg

SEQ ID NO: 4877810 - DNA, 21 bp, Homo sapiens
actgtatagacagtttgtaaa

SEQ ID NO: 4877811 - DNA, 15 bp, Homo sapiens
actgtatctgtgtag

SEQ ID NO: 4877812 - DNA, 15 bp, Homo sapiens
actgtcaccctccac

SEQ ID NO: 4877813 - DNA, 14 bp, Homo sapiens
actgtcactcattg

SEQ ID NO: 4877814 - DNA, 15 bp, Homo sapiens
actgtcactcattgc

SEQ ID NO: 4877815 - DNA, 23 bp, Homo sapiens
actgtcactcattgctgagcctc

SEQ ID NO: 4877816 - DNA, 15 bp, Homo sapiens
actgtccagagagca

SEQ ID NO: 4877817 - DNA, 19 bp, Homo sapiens
actgtcctctcccctccag

SEQ ID NO: 4877818 - DNA, 16 bp, Homo sapiens
actgtctaactttaga

SEQ ID NO: 4877819 - DNA, 20 bp, Homo sapiens
actgtctcaagagggcactg

SEQ ID NO: 4877820 - DNA, 18 bp, Homo sapiens
actgtctggttttaacaa

SEQ ID NO: 4877821 - DNA, 19 bp, Homo sapiens
actgtctggttttaacaat

SEQ ID NO: 4877822 - DNA, 23 bp, Homo sapiens
actgtgactctttttagggccag

SEQ ID NO: 4877823 - DNA, 22 bp, Homo sapiens
actgtgcaggtgctattgttac

SEQ ID NO: 4877824 - DNA, 17 bp, Homo sapiens
actgtgccatgtgccag

SEQ ID NO: 4877825 - DNA, 14 bp, Homo sapiens
actgtgcctttgca

SEQ ID NO: 4877826 - DNA, 23 bp, Homo sapiens
actgtgcctttgcaaatcagtgt

SEQ ID NO: 4877827 - DNA, 23 bp, Homo sapiens
actgtgctactgtctttggaaaa

SEQ ID NO: 4877828 - DNA, 13 bp, Homo sapiens
actgtgctgaatg

SEQ ID NO: 4877829 - DNA, 16 bp, Homo sapiens
actgtggaggaaggat

SEQ ID NO: 4877830 - DNA, 22 bp, Homo sapiens
actgtggaggaaggattgtaaa

SEQ ID NO: 4877831 - DNA, 21 bp, Homo sapiens
actgtggatacccttaccctt

SEQ ID NO: 4877832 - DNA, 17 bp, Homo sapiens
actgtggccgttatctg

SEQ ID NO: 4877833 - DNA, 14 bp, Homo sapiens
actgtgtacataat

SEQ ID NO: 4877834 - DNA, 15 bp, Homo sapiens
actgtgtgtgtgaat

SEQ ID NO: 4877835 - DNA, 22 bp, Homo sapiens
actgtgtgtgtgaatgaacact

SEQ ID NO: 4877836 - DNA, 15 bp, Homo sapiens
actgtgttgtattaa

SEQ ID NO: 4877837 - DNA, 19 bp, Homo sapiens
actgtgttttataaaatag

SEQ ID NO: 4877838 - DNA, 14 bp, Homo sapiens
actgttaagaagca

SEQ ID NO: 4877839 - DNA, 21 bp, Homo sapiens
actgttaatagttcaggtaac

SEQ ID NO: 4877840 - DNA, 20 bp, Homo sapiens
actgttagctttttaaaaca

SEQ ID NO: 4877841 - DNA, 16 bp, Homo sapiens
actgttctaaagctct

SEQ ID NO: 4877842 - DNA, 17 bp, Homo sapiens
actgttctaaagctctg

SEQ ID NO: 4877843 - DNA, 21 bp, Homo sapiens
actgttctaaagctctgacat

SEQ ID NO: 4877844 - DNA, 12 bp, Homo sapiens
actgttcttgct

SEQ ID NO: 4877845 - DNA, 18 bp, Homo sapiens
actgttcttgctgctaga

SEQ ID NO: 4877846 - DNA, 22 bp, Homo sapiens
actgttcttgctgctagaactt

SEQ ID NO: 4877847 - DNA, 13 bp, Homo sapiens
actgttgaaaatt

SEQ ID NO: 4877848 - DNA, 12 bp, Homo sapiens
actgttgcccag

SEQ ID NO: 4877849 - DNA, 21 bp, Homo sapiens
actgtttatatgtgttgaaaa

SEQ ID NO: 4877850 - DNA, 15 bp, Homo sapiens
actgtttatttctgt

SEQ ID NO: 4877851 - DNA, 22 bp, Homo sapiens
actgtttatttctgtttctcat

SEQ ID NO: 4877852 - DNA, 20 bp, Homo sapiens
actgtttctcttgagctggc

SEQ ID NO: 4877853 - DNA, 23 bp, Homo sapiens
actgtttctcttgagctggcctc

SEQ ID NO: 4877854 - DNA, 14 bp, Homo sapiens
actgttttatctgg

SEQ ID NO: 4877855 - DNA, 13 bp, Homo sapiens
actgttttcaaat

SEQ ID NO: 4877856 - DNA, 23 bp, Homo sapiens
actgttttctctcggctccccat

SEQ ID NO: 4877857 - DNA, 18 bp, Homo sapiens
actgttttgggtagctgc

SEQ ID NO: 4877858 - DNA, 19 bp, Homo sapiens
actgttttgggtagctgcc

SEQ ID NO: 4877859 - DNA, 22 bp, Homo sapiens
acttaaagcccgcctgacagaa

SEQ ID NO: 4877860 - DNA, 23 bp, Homo sapiens
acttaactattcaggagagtaga

SEQ ID NO: 4877861 - DNA, 17 bp, Homo sapiens
acttaatactaccttga

SEQ ID NO: 4877862 - DNA, 21 bp, Homo sapiens
acttacctaagtgacatttgt

SEQ ID NO: 4877863 - DNA, 13 bp, Homo sapiens
acttagcaaaaag

SEQ ID NO: 4877864 - DNA, 17 bp, Homo sapiens
acttagcaaaaagtggg

SEQ ID NO: 4877865 - DNA, 13 bp, Homo sapiens
acttatattgaag

SEQ ID NO: 4877866 - DNA, 20 bp, Homo sapiens
acttatattgaagacaattt

SEQ ID NO: 4877867 - DNA, 22 bp, Homo sapiens
acttatattttcgtatgaaaat

SEQ ID NO: 4877868 - DNA, 20 bp, Homo sapiens
acttatcagctacttaagag

SEQ ID NO: 4877869 - DNA, 18 bp, Homo sapiens
acttatcctaaaacaaat

SEQ ID NO: 4877870 - DNA, 17 bp, Homo sapiens
acttatctctctgtgct

SEQ ID NO: 4877871 - DNA, 22 bp, Homo sapiens
acttatctctctgtgctgtgga

SEQ ID NO: 4877872 - DNA, 15 bp, Homo sapiens
acttatgtagatatt

SEQ ID NO: 4877873 - DNA, 14 bp, Homo sapiens
acttatgtttttaa

SEQ ID NO: 4877874 - DNA, 16 bp, Homo sapiens
acttatgtttttaaat

SEQ ID NO: 4877875 - DNA, 18 bp, Homo sapiens
acttattgctgattttaa

SEQ ID NO: 4877876 - DNA, 15 bp, Homo sapiens
acttatttcttcaaa

SEQ ID NO: 4877877 - DNA, 17 bp, Homo sapiens
acttattttatttccat

SEQ ID NO: 4877878 - DNA, 10 bp, Homo sapiens
acttcagcac

SEQ ID NO: 4877879 - DNA, 16 bp, Homo sapiens
acttcaggctcttctc

SEQ ID NO: 4877880 - DNA, 15 bp, Homo sapiens
acttcagtcctgctc

SEQ ID NO: 4877881 - DNA, 15 bp, Homo sapiens
acttcagtcctggga

SEQ ID NO: 4877882 - DNA, 19 bp, Homo sapiens
acttcatgacaagcatttt

SEQ ID NO: 4877883 - DNA, 21 bp, Homo sapiens
acttcattgagagttttgtct

SEQ ID NO: 4877884 - DNA, 16 bp, Homo sapiens
acttccaggggaacct

SEQ ID NO: 4877885 - DNA, 21 bp, Homo sapiens
acttccaggggaacctgccat

SEQ ID NO: 4877886 - DNA, 20 bp, Homo sapiens
acttccaggtgttactgtaa

SEQ ID NO: 4877887 - DNA, 17 bp, Homo sapiens
acttcccagtgaattct

SEQ ID NO: 4877888 - DNA, 23 bp, Homo sapiens
acttcccagttcaggagtcccaa

SEQ ID NO: 4877889 - DNA, 14 bp, Homo sapiens
acttccctttctgc

SEQ ID NO: 4877890 - DNA, 15 bp, Homo sapiens
acttcctcctcccca

SEQ ID NO: 4877891 - DNA, 22 bp, Homo sapiens
acttccttactaagcatagcaa

SEQ ID NO: 4877892 - DNA, 20 bp, Homo sapiens
acttcctttaaagatgaact

SEQ ID NO: 4877893 - DNA, 16 bp, Homo sapiens
acttcgggctgtgtaa

SEQ ID NO: 4877894 - DNA, 17 bp, Homo sapiens
acttcgggctgtgtaaa

SEQ ID NO: 4877895 - DNA, 19 bp, Homo sapiens
acttcgtcttctaatttca

SEQ ID NO: 4877896 - DNA, 11 bp, Homo sapiens
acttctaatat

SEQ ID NO: 4877897 - DNA, 15 bp, Homo sapiens
acttctccaccctgc

SEQ ID NO: 4877898 - DNA, 14 bp, Homo sapiens
acttctcttgcttt

SEQ ID NO: 4877899 - DNA, 19 bp, Homo sapiens
acttctgccatattctgtt

SEQ ID NO: 4877900 - DNA, 20 bp, Homo sapiens
acttctgccatattctgttg

SEQ ID NO: 4877901 - DNA, 16 bp, Homo sapiens
acttcttaaaagttgt

SEQ ID NO: 4877902 - DNA, 19 bp, Homo sapiens
acttcttaaatatctttta

SEQ ID NO: 4877903 - DNA, 17 bp, Homo sapiens
acttcttgtcagacata

SEQ ID NO: 4877904 - DNA, 12 bp, Homo sapiens
acttctttctat

SEQ ID NO: 4877905 - DNA, 14 bp, Homo sapiens
acttgaaatgttag

SEQ ID NO: 4877906 - DNA, 23 bp, Homo sapiens
acttgaaatgttagtcattgtta

SEQ ID NO: 4877907 - DNA, 23 bp, Homo sapiens
acttgaaattatatctgtggtct

SEQ ID NO: 4877908 - DNA, 17 bp, Homo sapiens
acttgtaatatttttat

SEQ ID NO: 4877909 - DNA, 14 bp, Homo sapiens
acttgtataaatgt

SEQ ID NO: 4877910 - DNA, 18 bp, Homo sapiens
acttgtcactgacacaaa

SEQ ID NO: 4877911 - DNA, 22 bp, Homo sapiens
acttgtcactgacacaaaggaa

SEQ ID NO: 4877912 - DNA, 12 bp, Homo sapiens
acttgtgaatgc

SEQ ID NO: 4877913 - DNA, 13 bp, Homo sapiens
acttgtgaatgct

SEQ ID NO: 4877914 - DNA, 17 bp, Homo sapiens
acttgtgattatttatt

SEQ ID NO: 4877915 - DNA, 17 bp, Homo sapiens
acttgtggacacagctc

SEQ ID NO: 4877916 - DNA, 16 bp, Homo sapiens
acttgtggttttcaaa

SEQ ID NO: 4877917 - DNA, 15 bp, Homo sapiens
acttgttattgtgaa

SEQ ID NO: 4877918 - DNA, 20 bp, Homo sapiens
acttgttattgtgaatgatt

SEQ ID NO: 4877919 - DNA, 17 bp, Homo sapiens
acttgtttgtcttccat

SEQ ID NO: 4877920 - DNA, 14 bp, Homo sapiens
actttaaaaaatat

SEQ ID NO: 4877921 - DNA, 21 bp, Homo sapiens
actttaaaaaatatttattaa

SEQ ID NO: 4877922 - DNA, 12 bp, Homo sapiens
actttaaaagtg

SEQ ID NO: 4877923 - DNA, 14 bp, Homo sapiens
actttaagagagaa

SEQ ID NO: 4877924 - DNA, 15 bp, Homo sapiens
actttaagagagaaa

SEQ ID NO: 4877925 - DNA, 17 bp, Homo sapiens
actttacccaaaaacta

SEQ ID NO: 4877926 - DNA, 17 bp, Homo sapiens
actttacccacctagaa

SEQ ID NO: 4877927 - DNA, 18 bp, Homo sapiens
actttacccacctagaac

SEQ ID NO: 4877928 - DNA, 19 bp, Homo sapiens
actttagggtaaaaattgc

SEQ ID NO: 4877929 - DNA, 22 bp, Homo sapiens
actttataagtcattgtatgtt

SEQ ID NO: 4877930 - DNA, 13 bp, Homo sapiens
actttatcacttt

SEQ ID NO: 4877931 - DNA, 23 bp, Homo sapiens
actttatctaatacctctgtgtg

SEQ ID NO: 4877932 - DNA, 18 bp, Homo sapiens
actttatgtttgtctttt

SEQ ID NO: 4877933 - DNA, 16 bp, Homo sapiens
actttcagtaaacata

SEQ ID NO: 4877934 - DNA, 17 bp, Homo sapiens
actttcagtaaacataa

SEQ ID NO: 4877935 - DNA, 23 bp, Homo sapiens
actttcatcctgactctgccccc

SEQ ID NO: 4877936 - DNA, 21 bp, Homo sapiens
actttcccaggttctgtttat

SEQ ID NO: 4877937 - DNA, 23 bp, Homo sapiens
actttcccttgcttttccctctt

SEQ ID NO: 4877938 - DNA, 17 bp, Homo sapiens
actttcctttccccagc

SEQ ID NO: 4877939 - DNA, 18 bp, Homo sapiens
actttcctttccccagcc

SEQ ID NO: 4877940 - DNA, 19 bp, Homo sapiens
actttcctttccccagccc

SEQ ID NO: 4877941 - DNA, 22 bp, Homo sapiens
actttcctttccccagcccagg

SEQ ID NO: 4877942 - DNA, 19 bp, Homo sapiens
actttctcttcatactttt

SEQ ID NO: 4877943 - DNA, 19 bp, Homo sapiens
actttctgtaaactcaaaa

SEQ ID NO: 4877944 - DNA, 14 bp, Homo sapiens
actttgaaatacct

SEQ ID NO: 4877945 - DNA, 22 bp, Homo sapiens
actttgaaatacctcatgttta

SEQ ID NO: 4877946 - DNA, 22 bp, Homo sapiens
actttgacgagtcaccttccag

SEQ ID NO: 4877947 - DNA, 19 bp, Homo sapiens
actttgatgtcatgtgttc

SEQ ID NO: 4877948 - DNA, 20 bp, Homo sapiens
actttgcacgacgccctctc

SEQ ID NO: 4877949 - DNA, 16 bp, Homo sapiens
actttgcctcctgtgt

SEQ ID NO: 4877950 - DNA, 15 bp, Homo sapiens
actttgctttcatga

SEQ ID NO: 4877951 - DNA, 22 bp, Homo sapiens
actttggagtcccctcacctcc

SEQ ID NO: 4877952 - DNA, 17 bp, Homo sapiens
actttgtctgaaaaatt

SEQ ID NO: 4877953 - DNA, 21 bp, Homo sapiens
actttgtggaccaattattga

SEQ ID NO: 4877954 - DNA, 16 bp, Homo sapiens
actttgtgttcacctt

SEQ ID NO: 4877955 - DNA, 18 bp, Homo sapiens
actttgtgttcaccttgt

SEQ ID NO: 4877956 - DNA, 15 bp, Homo sapiens
acttttatgagcttc

SEQ ID NO: 4877957 - DNA, 22 bp, Homo sapiens
acttttatttgcaacatttaca

SEQ ID NO: 4877958 - DNA, 22 bp, Homo sapiens
acttttcaaggcttatattcaa

SEQ ID NO: 4877959 - DNA, 14 bp, Homo sapiens
acttttctttgtgg

SEQ ID NO: 4877960 - DNA, 21 bp, Homo sapiens
acttttgagtgtgtgtgtgca

SEQ ID NO: 4877961 - DNA, 13 bp, Homo sapiens
acttttgtacatc

SEQ ID NO: 4877962 - DNA, 14 bp, Homo sapiens
acttttgtacatct

SEQ ID NO: 4877963 - DNA, 20 bp, Homo sapiens
acttttgtacatctggctta

SEQ ID NO: 4877964 - DNA, 20 bp, Homo sapiens
actttttgaactaagaaact

SEQ ID NO: 4877965 - DNA, 13 bp, Homo sapiens
acttttttaaata

SEQ ID NO: 4877966 - DNA, 15 bp, Homo sapiens
acttttttaaataaa

SEQ ID NO: 4877967 - DNA, 21 bp, Homo sapiens
acttttttaaataaacttttt

SEQ ID NO: 4877968 - DNA, 15 bp, Homo sapiens
actttttttcaatgt

SEQ ID NO: 4877969 - DNA, 17 bp, Homo sapiens
agaaaaaaaaaagaaga

SEQ ID NO: 4877970 - DNA, 19 bp, Homo sapiens
agaaaaaaaaaagaagaag

SEQ ID NO: 4877971 - DNA, 20 bp, Homo sapiens
agaaaaaaaaaagaagaaga

SEQ ID NO: 4877972 - DNA, 12 bp, Homo sapiens
agaaaaaaacga

SEQ ID NO: 4877973 - DNA, 16 bp, Homo sapiens
agaaaaaaatcttctc

SEQ ID NO: 4877974 - DNA, 13 bp, Homo sapiens
agaaaaaataaat

SEQ ID NO: 4877975 - DNA, 14 bp, Homo sapiens
agaaaaaataaatg

SEQ ID NO: 4877976 - DNA, 20 bp, Homo sapiens
agaaaaagctcctgtcctcc

SEQ ID NO: 4877977 - DNA, 13 bp, Homo sapiens
agaaaaagggtca

SEQ ID NO: 4877978 - DNA, 12 bp, Homo sapiens
agaaaaatcttg

SEQ ID NO: 4877979 - DNA, 23 bp, Homo sapiens
agaaaaatcttgtgctagaatac

SEQ ID NO: 4877980 - DNA, 22 bp, Homo sapiens
agaaaacaagatgagattggca

SEQ ID NO: 4877981 - DNA, 9 bp, Homo sapiens
agaaaagag

SEQ ID NO: 4877982 - DNA, 20 bp, Homo sapiens
agaaaagagaagaagaaaaa

SEQ ID NO: 4877983 - DNA, 15 bp, Homo sapiens
agaaaaggaaaagaa

SEQ ID NO: 4877984 - DNA, 17 bp, Homo sapiens
agaaaaggaaaagaaaa

SEQ ID NO: 4877985 - DNA, 15 bp, Homo sapiens
agaaaagtagacaat

SEQ ID NO: 4877986 - DNA, 17 bp, Homo sapiens
agaaaatgttgagaatc

SEQ ID NO: 4877987 - DNA, 22 bp, Homo sapiens
agaaaatttttgtagtagcgtt

SEQ ID NO: 4877988 - DNA, 12 bp, Homo sapiens
agaaacaaactt

SEQ ID NO: 4877989 - DNA, 16 bp, Homo sapiens
agaaacaataaagaga

SEQ ID NO: 4877990 - DNA, 17 bp, Homo sapiens
agaaacaataaagagat

SEQ ID NO: 4877991 - DNA, 12 bp, Homo sapiens
agaaacactgcc

SEQ ID NO: 4877992 - DNA, 15 bp, Homo sapiens
agaaacagataccat

SEQ ID NO: 4877993 - DNA, 16 bp, Homo sapiens
agaaacagctttcaag

SEQ ID NO: 4877994 - DNA, 20 bp, Homo sapiens
agaaacagctttcaagtgcc

SEQ ID NO: 4877995 - DNA, 12 bp, Homo sapiens
agaaacatgaca

SEQ ID NO: 4877996 - DNA, 14 bp, Homo sapiens
agaaacatgacact

SEQ ID NO: 4877997 - DNA, 18 bp, Homo sapiens
agaaacatgacactgacc

SEQ ID NO: 4877998 - DNA, 16 bp, Homo sapiens
agaaacccaagctcct

SEQ ID NO: 4877999 - DNA, 17 bp, Homo sapiens
agaaacccaagctcctc

SEQ ID NO: 4878000 - DNA, 20 bp, Homo sapiens
agaaacccaagctcctcctc

SEQ ID NO: 4878001 - DNA, 21 bp, Homo sapiens
agaaacgagttggtgtctttc

SEQ ID NO: 4878002 - DNA, 18 bp, Homo sapiens
agaaacgcatccagcaag

SEQ ID NO: 4878003 - DNA, 21 bp, Homo sapiens
agaaacgtcttctaaacttcc

SEQ ID NO: 4878004 - DNA, 13 bp, Homo sapiens
agaaactgaggaa

SEQ ID NO: 4878005 - DNA, 16 bp, Homo sapiens
agaaactgaggaattt

SEQ ID NO: 4878006 - DNA, 18 bp, Homo sapiens
agaaactttatacattag

SEQ ID NO: 4878007 - DNA, 22 bp, Homo sapiens
agaaacttttatctattctgag

SEQ ID NO: 4878008 - DNA, 12 bp, Homo sapiens
agaaacttttgt

SEQ ID NO: 4878009 - DNA, 16 bp, Homo sapiens
agaaacttttgtaaag

SEQ ID NO: 4878010 - DNA, 12 bp, Homo sapiens
agaaagaaagtt

SEQ ID NO: 4878011 - DNA, 13 bp, Homo sapiens
agaaagaaggaag

SEQ ID NO: 4878012 - DNA, 14 bp, Homo sapiens
agaaagcaacttat

SEQ ID NO: 4878013 - DNA, 16 bp, Homo sapiens
agaaagctggtaaact

SEQ ID NO: 4878014 - DNA, 16 bp, Homo sapiens
agaaagctgtgaacag

SEQ ID NO: 4878015 - DNA, 23 bp, Homo sapiens
agaaaggaggggatagagagaga

SEQ ID NO: 4878016 - DNA, 16 bp, Homo sapiens
agaaagtgggaggtca

SEQ ID NO: 4878017 - DNA, 18 bp, Homo sapiens
agaaagtgggaggtcagg

SEQ ID NO: 4878018 - DNA, 18 bp, Homo sapiens
agactctagacaagatat

SEQ ID NO: 4878019 - DNA, 19 bp, Homo sapiens
agactctagagtccaaggt

SEQ ID NO: 4878020 - DNA, 11 bp, Homo sapiens
agactctcagc

SEQ ID NO: 4878021 - DNA, 17 bp, Homo sapiens
agactctgtaacatcac

SEQ ID NO: 4878022 - DNA, 18 bp, Homo sapiens
agactctgtctcaaaaaa

SEQ ID NO: 4878023 - DNA, 23 bp, Homo sapiens
agactgaaaatatataagctcag

SEQ ID NO: 4878024 - DNA, 19 bp, Homo sapiens
agactgacaacctcatcca

SEQ ID NO: 4878025 - DNA, 21 bp, Homo sapiens
agactgcaagaggctcctgtc

SEQ ID NO: 4878026 - DNA, 21 bp, Homo sapiens
agactgcaggttggaccccag

SEQ ID NO: 4878027 - DNA, 17 bp, Homo sapiens
agactgcgttctgcaag

SEQ ID NO: 4878028 - DNA, 16 bp, Homo sapiens
agactggaagcacagc

SEQ ID NO: 4878029 - DNA, 17 bp, Homo sapiens
agactggaagcacagct

SEQ ID NO: 4878030 - DNA, 21 bp, Homo sapiens
agactggaagctaatttgcat

SEQ ID NO: 4878031 - DNA, 14 bp, Homo sapiens
agactggaagttca

SEQ ID NO: 4878032 - DNA, 18 bp, Homo sapiens
agactgtagcctggatat

SEQ ID NO: 4878033 - DNA, 22 bp, Homo sapiens
agactgtgtctctctgatacct

SEQ ID NO: 4878034 - DNA, 14 bp, Homo sapiens
agacttactctaag

SEQ ID NO: 4878035 - DNA, 16 bp, Homo sapiens
agacttactctaagat

SEQ ID NO: 4878036 - DNA, 12 bp, Homo sapiens
agacttgccaac

SEQ ID NO: 4878037 - DNA, 23 bp, Homo sapiens
agacttgccaacaccacagaaat

SEQ ID NO: 4878038 - DNA, 15 bp, Homo sapiens
agagaaacaaacttt

SEQ ID NO: 4878039 - DNA, 13 bp, Homo sapiens
agagaaactttat

SEQ ID NO: 4878040 - DNA, 21 bp, Homo sapiens
agagaaactttatacattagt

SEQ ID NO: 4878041 - DNA, 16 bp, Homo sapiens
agagaaagaaaatgaa

SEQ ID NO: 4878042 - DNA, 14 bp, Homo sapiens
agagaaagagagag

SEQ ID NO: 4878043 - DNA, 13 bp, Homo sapiens
agagaaagccagg

SEQ ID NO: 4878044 - DNA, 14 bp, Homo sapiens
agagaaatctgaaa

SEQ ID NO: 4878045 - DNA, 18 bp, Homo sapiens
agagaaattctgttaaaa

SEQ ID NO: 4878046 - DNA, 21 bp, Homo sapiens
agagaaccgagcaaagatcaa

SEQ ID NO: 4878047 - DNA, 14 bp, Homo sapiens
agagaacgcagccc

SEQ ID NO: 4878048 - DNA, 16 bp, Homo sapiens
agagaagaagaaaaaa

SEQ ID NO: 4878049 - DNA, 13 bp, Homo sapiens
agagaagataatt

SEQ ID NO: 4878050 - DNA, 15 bp, Homo sapiens
agagaagataattgt

SEQ ID NO: 4878051 - DNA, 21 bp, Homo sapiens
agagaagataattgttgaaat

SEQ ID NO: 4878052 - DNA, 13 bp, Homo sapiens
agagaagcaattt

SEQ ID NO: 4878053 - DNA, 12 bp, Homo sapiens
agagaagctgct

SEQ ID NO: 4878054 - DNA, 12 bp, Homo sapiens
agagaagctggg

SEQ ID NO: 4878055 - DNA, 18 bp, Homo sapiens
agagaaggcctccctagc

SEQ ID NO: 4878056 - DNA, 22 bp, Homo sapiens
agagaaggggaagcactcgtgt

SEQ ID NO: 4878057 - DNA, 14 bp, Homo sapiens
agagaattggctca

SEQ ID NO: 4878058 - DNA, 15 bp, Homo sapiens
agagaattggctcaa

SEQ ID NO: 4878059 - DNA, 22 bp, Homo sapiens
agagaatttctaccatttcaga

SEQ ID NO: 4878060 - DNA, 19 bp, Homo sapiens
agagacaaacacctcccag

SEQ ID NO: 4878061 - DNA, 21 bp, Homo sapiens
agagacaaacacctcccagga

SEQ ID NO: 4878062 - DNA, 15 bp, Homo sapiens
agagaccgtcctcac

SEQ ID NO: 4878063 - DNA, 22 bp, Homo sapiens
agagaccgtcctcacccctgtc

SEQ ID NO: 4878064 - DNA, 23 bp, Homo sapiens
agagaccgtcctcacccctgtcc

SEQ ID NO: 4878065 - DNA, 19 bp, Homo sapiens
agagactcccatgaagcct

SEQ ID NO: 4878066 - DNA, 17 bp, Homo sapiens
agagacttttaatcaga

SEQ ID NO: 4878067 - DNA, 16 bp, Homo sapiens
agagagaaagccaggc

SEQ ID NO: 4878068 - DNA, 12 bp, Homo sapiens
agagagagaaaa

SEQ ID NO: 4878069 - DNA, 14 bp, Homo sapiens
agagagagaaagag

SEQ ID NO: 4878070 - DNA, 12 bp, Homo sapiens
agagagagagaa

SEQ ID NO: 4878071 - DNA, 14 bp, Homo sapiens
agagagagagaaaa

SEQ ID NO: 4878072 - DNA, 15 bp, Homo sapiens
agagagagagagaaa

SEQ ID NO: 4878073 - DNA, 18 bp, Homo sapiens
agagagccattttgtgaa

SEQ ID NO: 4878074 - DNA, 21 bp, Homo sapiens
agagagcggtctcaggctggt

SEQ ID NO: 4878075 - DNA, 17 bp, Homo sapiens
agagagcttagcctgga

SEQ ID NO: 4878076 - DNA, 13 bp, Homo sapiens
agagaggcagaga

SEQ ID NO: 4878077 - DNA, 14 bp, Homo sapiens
agagaggcagagag

SEQ ID NO: 4878078 - DNA, 16 bp, Homo sapiens
agagaggcagagagcg

SEQ ID NO: 4878079 - DNA, 20 bp, Homo sapiens
agagagggccatgcaattca

SEQ ID NO: 4878080 - DNA, 21 bp, Homo sapiens
agagagggtggtgacctctgc

SEQ ID NO: 4878081 - DNA, 22 bp, Homo sapiens
agagagggtggtgacctctgcc

SEQ ID NO: 4878082 - DNA, 17 bp, Homo sapiens
agagagtggctcctccc

SEQ ID NO: 4878083 - DNA, 19 bp, Homo sapiens
agagataccaagatgccat

SEQ ID NO: 4878084 - DNA, 14 bp, Homo sapiens
agagatatatctga

SEQ ID NO: 4878085 - DNA, 15 bp, Homo sapiens
agagatatatctgaa

SEQ ID NO: 4878086 - DNA, 21 bp, Homo sapiens
agagatgctgtaacttaaaat

SEQ ID NO: 4878087 - DNA, 17 bp, Homo sapiens
agagatgggagctcctc

SEQ ID NO: 4878088 - DNA, 14 bp, Homo sapiens
agagatgtgcaccc

SEQ ID NO: 4878089 - DNA, 17 bp, Homo sapiens
agagatgtgcacccatg

SEQ ID NO: 4878090 - DNA, 20 bp, Homo sapiens
agagatgtttttaaaagttt

SEQ ID NO: 4878091 - DNA, 22 bp, Homo sapiens
agagatgtttttaaaagtttca

SEQ ID NO: 4878092 - DNA, 23 bp, Homo sapiens
agagatttatataaatgtaaaaa

SEQ ID NO: 4878093 - DNA, 17 bp, Homo sapiens
agagatttgtctaattg

SEQ ID NO: 4878094 - DNA, 16 bp, Homo sapiens
agagcacaaacatttt

SEQ ID NO: 4878095 - DNA, 19 bp, Homo sapiens
agagcacctagtccagtga

SEQ ID NO: 4878096 - DNA, 18 bp, Homo sapiens
agagcagatgcagagagc

SEQ ID NO: 4878097 - DNA, 16 bp, Homo sapiens
agagcagcctgtggca

SEQ ID NO: 4878098 - DNA, 23 bp, Homo sapiens
agagcaggaagcattcagagagc

SEQ ID NO: 4878099 - DNA, 19 bp, Homo sapiens
agagcattgaattggagag

SEQ ID NO: 4878100 - DNA, 20 bp, Homo sapiens
agagcatttccaacaccaca

SEQ ID NO: 4878101 - DNA, 13 bp, Homo sapiens
agagccagggtct

SEQ ID NO: 4878102 - DNA, 17 bp, Homo sapiens
agagccattttgtgaat

SEQ ID NO: 4878103 - DNA, 20 bp, Homo sapiens
agagcccagaggtaacagaa

SEQ ID NO: 4878104 - DNA, 24 bp, Homo sapiens
agagcccagaggtaacagaacagc

SEQ ID NO: 4878105 - DNA, 23 bp, Homo sapiens
agagcctcccaaggagaacaaat

SEQ ID NO: 4878106 - DNA, 16 bp, Homo sapiens
agagcctgatctcttc

SEQ ID NO: 4878107 - DNA, 20 bp, Homo sapiens
agagcctgatctcttcctgt

SEQ ID NO: 4878108 - DNA, 21 bp, Homo sapiens
agagccttctgatgtctctaa

SEQ ID NO: 4878109 - DNA, 19 bp, Homo sapiens
agagcggaggctgtgtgcc

SEQ ID NO: 4878110 - DNA, 23 bp, Homo sapiens
agagcggtctcaggctggtggga

SEQ ID NO: 4878111 - DNA, 17 bp, Homo sapiens
agagctaagggtgggtg

SEQ ID NO: 4878112 - DNA, 12 bp, Homo sapiens
agagctgggagg

SEQ ID NO: 4878113 - DNA, 22 bp, Homo sapiens
agagctgggaggcatggccctg

SEQ ID NO: 4878114 - DNA, 19 bp, Homo sapiens
agagctgggtgtcaagagg

SEQ ID NO: 4878115 - DNA, 13 bp, Homo sapiens
agagctggtgccc

SEQ ID NO: 4878116 - DNA, 13 bp, Homo sapiens
agaggaactgggc

SEQ ID NO: 4878117 - DNA, 15 bp, Homo sapiens
agaggagccctcatc

SEQ ID NO: 4878118 - DNA, 22 bp, Homo sapiens
agaggatgagagcccagaggta

SEQ ID NO: 4878119 - DNA, 19 bp, Homo sapiens
agaggatgtctcaaacttc

SEQ ID NO: 4878120 - DNA, 22 bp, Homo sapiens
agaggattaggttccatccttt

SEQ ID NO: 4878121 - DNA, 12 bp, Homo sapiens
agaggcagagag

SEQ ID NO: 4878122 - DNA, 18 bp, Homo sapiens
agaggccagccccaccca

SEQ ID NO: 4878123 - DNA, 20 bp, Homo sapiens
agaggccatggcagaataat

SEQ ID NO: 4878124 - DNA, 12 bp, Homo sapiens
agaggcctgccc

SEQ ID NO: 4878125 - DNA, 16 bp, Homo sapiens
agaggctgcccctctc

SEQ ID NO: 4878126 - DNA, 14 bp, Homo sapiens
agagggaccatgtg

SEQ ID NO: 4878127 - DNA, 17 bp, Homo sapiens
agagggaccatgtgtca

SEQ ID NO: 4878128 - DNA, 15 bp, Homo sapiens
agagggagtgacaga

SEQ ID NO: 4878129 - DNA, 19 bp, Homo sapiens
agagggctctgtgctgaca

SEQ ID NO: 4878130 - DNA, 18 bp, Homo sapiens
agagggcttgtgaacaga

SEQ ID NO: 4878131 - DNA, 20 bp, Homo sapiens
agagggtctgaggaatccag

SEQ ID NO: 4878132 - DNA, 17 bp, Homo sapiens
agaggtaacagaacagc

SEQ ID NO: 4878133 - DNA, 22 bp, Homo sapiens
agaggtaacagaacagcttcag

SEQ ID NO: 4878134 - DNA, 19 bp, Homo sapiens
agaggtacagggtttttac

SEQ ID NO: 4878135 - DNA, 14 bp, Homo sapiens
agaggtccagccca

SEQ ID NO: 4878136 - DNA, 12 bp, Homo sapiens
agaggttttgtt

SEQ ID NO: 4878137 - DNA, 15 bp, Homo sapiens
agagtagaaataaaa

SEQ ID NO: 4878138 - DNA, 17 bp, Homo sapiens
agagtagaattgcattg

SEQ ID NO: 4878139 - DNA, 13 bp, Homo sapiens
agagtatatgcac

SEQ ID NO: 4878140 - DNA, 14 bp, Homo sapiens
agagtcagatcttt

SEQ ID NO: 4878141 - DNA, 22 bp, Homo sapiens
agagtcccccctcccacctcca

SEQ ID NO: 4878142 - DNA, 14 bp, Homo sapiens
agagtctagattct

SEQ ID NO: 4878143 - DNA, 22 bp, Homo sapiens
agagtctcactgttgcccaggc

SEQ ID NO: 4878144 - DNA, 16 bp, Homo sapiens
agagtgagctacagag

SEQ ID NO: 4878145 - DNA, 16 bp, Homo sapiens
agagtgattgcagctt

SEQ ID NO: 4878146 - DNA, 15 bp, Homo sapiens
agagtgcacagctgt

SEQ ID NO: 4878147 - DNA, 11 bp, Homo sapiens
agagtggcctg

SEQ ID NO: 4878148 - DNA, 12 bp, Homo sapiens
agagtggcctgg

SEQ ID NO: 4878149 - DNA, 15 bp, Homo sapiens
agagtggcctggcca

SEQ ID NO: 4878150 - DNA, 19 bp, Homo sapiens
agagtggcctggccaggag

SEQ ID NO: 4878151 - DNA, 12 bp, Homo sapiens
agagtggctcct

SEQ ID NO: 4878152 - DNA, 14 bp, Homo sapiens
agagtggctcctcc

SEQ ID NO: 4878153 - DNA, 19 bp, Homo sapiens
agagtggctcctcccggtg

SEQ ID NO: 4878154 - DNA, 16 bp, Homo sapiens
agagtgtagaagcatt

SEQ ID NO: 4878155 - DNA, 17 bp, Homo sapiens
agagtgtagaagcattc

SEQ ID NO: 4878156 - DNA, 22 bp, Homo sapiens
agagtgtagaagcattccttct

SEQ ID NO: 4878157 - DNA, 15 bp, Homo sapiens
agagtgtggaggctg

SEQ ID NO: 4878158 - DNA, 13 bp, Homo sapiens
agagttaagaagc

SEQ ID NO: 4878159 - DNA, 15 bp, Homo sapiens
agagttaagaagctg

SEQ ID NO: 4878160 - DNA, 17 bp, Homo sapiens
agagttaagaagctgtt

SEQ ID NO: 4878161 - DNA, 21 bp, Homo sapiens
agagttaagaagctgttgtac

SEQ ID NO: 4878162 - DNA, 19 bp, Homo sapiens
agagttagtttctttggga

SEQ ID NO: 4878163 - DNA, 18 bp, Homo sapiens
agagtttctgtttgattc

SEQ ID NO: 4878164 - DNA, 13 bp, Homo sapiens
agagtttgtgtgt

SEQ ID NO: 4878165 - DNA, 22 bp, Homo sapiens
agagtttgtgtgttgtcttgaa

SEQ ID NO: 4878166 - DNA, 16 bp, Homo sapiens
agagttttgtcttgaa

SEQ ID NO: 4878167 - DNA, 16 bp, Homo sapiens
agataaaaagtggaat

SEQ ID NO: 4878168 - DNA, 18 bp, Homo sapiens
agataaaagctgaagtta

SEQ ID NO: 4878169 - DNA, 13 bp, Homo sapiens
agataaagtggtt

SEQ ID NO: 4878170 - DNA, 16 bp, Homo sapiens
agataatattactgtt

SEQ ID NO: 4878171 - DNA, 14 bp, Homo sapiens
agataatcagcctc

SEQ ID NO: 4878172 - DNA, 17 bp, Homo sapiens
agataatcagcctctta

SEQ ID NO: 4878173 - DNA, 14 bp, Homo sapiens
agatacaaattaat

SEQ ID NO: 4878174 - DNA, 17 bp, Homo sapiens
agatacctcaccctgct

SEQ ID NO: 4878175 - DNA, 14 bp, Homo sapiens
agatactggtggaa

SEQ ID NO: 4878176 - DNA, 19 bp, Homo sapiens
agatactttttcttttgta

SEQ ID NO: 4878177 - DNA, 20 bp, Homo sapiens
agatactttttcttttgtaa

SEQ ID NO: 4878178 - DNA, 21 bp, Homo sapiens
agatactttttcttttgtaag

SEQ ID NO: 4878179 - DNA, 13 bp, Homo sapiens
agatagaatttcc

SEQ ID NO: 4878180 - DNA, 16 bp, Homo sapiens
agatagaatttccaat

SEQ ID NO: 4878181 - DNA, 21 bp, Homo sapiens
agatagctgcatgtggctttt

SEQ ID NO: 4878182 - DNA, 12 bp, Homo sapiens
agataggacctt

SEQ ID NO: 4878183 - DNA, 17 bp, Homo sapiens
agataggaccttgggcc

SEQ ID NO: 4878184 - DNA, 18 bp, Homo sapiens
agataggaccttgggcca

SEQ ID NO: 4878185 - DNA, 15 bp, Homo sapiens
agatatactttgtgg

SEQ ID NO: 4878186 - DNA, 13 bp, Homo sapiens
agatatatatcat

SEQ ID NO: 4878187 - DNA, 21 bp, Homo sapiens
agatatatctgaaaactggaa

SEQ ID NO: 4878188 - DNA, 21 bp, Homo sapiens
agatattactacttaccattt

SEQ ID NO: 4878189 - DNA, 13 bp, Homo sapiens
agatattacttta

SEQ ID NO: 4878190 - DNA, 14 bp, Homo sapiens
agatattattgctt

SEQ ID NO: 4878191 - DNA, 14 bp, Homo sapiens
agatattgtacata

SEQ ID NO: 4878192 - DNA, 19 bp, Homo sapiens
agatattgttcaaacaata

SEQ ID NO: 4878193 - DNA, 16 bp, Homo sapiens
agatatttggcttaaa

SEQ ID NO: 4878194 - DNA, 19 bp, Homo sapiens
agatatttggcttaaatat

SEQ ID NO: 4878195 - DNA, 20 bp, Homo sapiens
agatatttggcttaaatata

SEQ ID NO: 4878196 - DNA, 17 bp, Homo sapiens
agatcaaaataaaaagt

SEQ ID NO: 4878197 - DNA, 14 bp, Homo sapiens
agatcaaccccttc

SEQ ID NO: 4878198 - DNA, 19 bp, Homo sapiens
agatcaaccccttcgctcc

SEQ ID NO: 4878199 - DNA, 14 bp, Homo sapiens
agatcacgccactg

SEQ ID NO: 4878200 - DNA, 14 bp, Homo sapiens
agatcactgccaca

SEQ ID NO: 4878201 - DNA, 18 bp, Homo sapiens
agatcagatgctccaaga

SEQ ID NO: 4878202 - DNA, 17 bp, Homo sapiens
agatccccgttcctgac

SEQ ID NO: 4878203 - DNA, 16 bp, Homo sapiens
agatcctagatcctaa

SEQ ID NO: 4878204 - DNA, 23 bp, Homo sapiens
agatcgtgtattgagatttctta

SEQ ID NO: 4878205 - DNA, 14 bp, Homo sapiens
agatctataaagcg

SEQ ID NO: 4878206 - DNA, 16 bp, Homo sapiens
agatctataaagcgat

SEQ ID NO: 4878207 - DNA, 14 bp, Homo sapiens
agatctgtgcccca

SEQ ID NO: 4878208 - DNA, 16 bp, Homo sapiens
agatctgtgccccatg

SEQ ID NO: 4878209 - DNA, 19 bp, Homo sapiens
agatctgtgccccatgcct

SEQ ID NO: 4878210 - DNA, 13 bp, Homo sapiens
agatcttaggtat

SEQ ID NO: 4878211 - DNA, 23 bp, Homo sapiens
agatcttaggtatagaggaccct

SEQ ID NO: 4878212 - DNA, 15 bp, Homo sapiens
agatcttctgaaatg

SEQ ID NO: 4878213 - DNA, 17 bp, Homo sapiens
agatcttctgaaatgaa

SEQ ID NO: 4878214 - DNA, 23 bp, Homo sapiens
agatgaaagcagggaatttctat

SEQ ID NO: 4878215 - DNA, 19 bp, Homo sapiens
agatgaactcttagaaatg

SEQ ID NO: 4878216 - DNA, 19 bp, Homo sapiens
agatgaagttttacattgt

SEQ ID NO: 4878217 - DNA, 13 bp, Homo sapiens
agatgagaacaaa

SEQ ID NO: 4878218 - DNA, 18 bp, Homo sapiens
agatgagaacaaagctgt

SEQ ID NO: 4878219 - DNA, 15 bp, Homo sapiens
agatgagattggcat

SEQ ID NO: 4878220 - DNA, 19 bp, Homo sapiens
agccacaagaaatttgatt

SEQ ID NO: 4878221 - DNA, 15 bp, Homo sapiens
agccacaagtcttcc

SEQ ID NO: 4878222 - DNA, 15 bp, Homo sapiens
agccacacccaggca

SEQ ID NO: 4878223 - DNA, 18 bp, Homo sapiens
agccacagcagcattttt

SEQ ID NO: 4878224 - DNA, 14 bp, Homo sapiens
agccacattatttc

SEQ ID NO: 4878225 - DNA, 20 bp, Homo sapiens
agccacatttggaatacttt

SEQ ID NO: 4878226 - DNA, 21 bp, Homo sapiens
agccacatttggaatactttt

SEQ ID NO: 4878227 - DNA, 18 bp, Homo sapiens
agccaccccagaaatggt

SEQ ID NO: 4878228 - DNA, 19 bp, Homo sapiens
agccaccccgggctctctg

SEQ ID NO: 4878229 - DNA, 21 bp, Homo sapiens
agccacctaaacggttcagtt

SEQ ID NO: 4878230 - DNA, 14 bp, Homo sapiens
agccacggccaggc

SEQ ID NO: 4878231 - DNA, 15 bp, Homo sapiens
agccactcaggaggc

SEQ ID NO: 4878232 - DNA, 21 bp, Homo sapiens
agccactgcaccgggccacag

SEQ ID NO: 4878233 - DNA, 12 bp, Homo sapiens
agccagacagac

SEQ ID NO: 4878234 - DNA, 13 bp, Homo sapiens
agccagacagacc

SEQ ID NO: 4878235 - DNA, 12 bp, Homo sapiens
agccagatcctc

SEQ ID NO: 4878236 - DNA, 16 bp, Homo sapiens
agccagatcctcttgg

SEQ ID NO: 4878237 - DNA, 18 bp, Homo sapiens
agccagcacctgtaagaa

SEQ ID NO: 4878238 - DNA, 14 bp, Homo sapiens
agccagcctgacct

SEQ ID NO: 4878239 - DNA, 15 bp, Homo sapiens
agccagcctgacctt

SEQ ID NO: 4878240 - DNA, 18 bp, Homo sapiens
agccagcctgaccttcct

SEQ ID NO: 4878241 - DNA, 23 bp, Homo sapiens
agccagcctgaccttccttcctg

SEQ ID NO: 4878242 - DNA, 12 bp, Homo sapiens
agccagcctggt

SEQ ID NO: 4878243 - DNA, 21 bp, Homo sapiens
agccagccttcttccatccca

SEQ ID NO: 4878244 - DNA, 23 bp, Homo sapiens
agccagccttcttccatcccagg

SEQ ID NO: 4878245 - DNA, 15 bp, Homo sapiens
agccagctcacagtg

SEQ ID NO: 4878246 - DNA, 20 bp, Homo sapiens
agccagctgcagctgggctg

SEQ ID NO: 4878247 - DNA, 18 bp, Homo sapiens
agccagctgcaggaatca

SEQ ID NO: 4878248 - DNA, 15 bp, Homo sapiens
agccaggacagtcag

SEQ ID NO: 4878249 - DNA, 18 bp, Homo sapiens
agccaggatcatggtgta

SEQ ID NO: 4878250 - DNA, 21 bp, Homo sapiens
agccaggctgccaaggccaga

SEQ ID NO: 4878251 - DNA, 18 bp, Homo sapiens
agccagggggactagccc

SEQ ID NO: 4878252 - DNA, 17 bp, Homo sapiens
agccaggtatggctctg

SEQ ID NO: 4878253 - DNA, 19 bp, Homo sapiens
agccaggtatggctctgca

SEQ ID NO: 4878254 - DNA, 21 bp, Homo sapiens
agccatataagtttgaaggaa

SEQ ID NO: 4878255 - DNA, 15 bp, Homo sapiens
agccatgcccgcatt

SEQ ID NO: 4878256 - DNA, 18 bp, Homo sapiens
agccattaaatgaatatt

SEQ ID NO: 4878257 - DNA, 21 bp, Homo sapiens
agcccaaaggggacaggcctc

SEQ ID NO: 4878258 - DNA, 21 bp, Homo sapiens
agcccaacgggaagcaacctc

SEQ ID NO: 4878259 - DNA, 12 bp, Homo sapiens
agcccacagcac

SEQ ID NO: 4878260 - DNA, 13 bp, Homo sapiens
agcccaccctgct

SEQ ID NO: 4878261 - DNA, 13 bp, Homo sapiens
agcccaccttggc

SEQ ID NO: 4878262 - DNA, 20 bp, Homo sapiens
agcccacggctaagaggctg

SEQ ID NO: 4878263 - DNA, 22 bp, Homo sapiens
agcccacggctaagaggctgct

SEQ ID NO: 4878264 - DNA, 14 bp, Homo sapiens
agcccacttctgcc

SEQ ID NO: 4878265 - DNA, 22 bp, Homo sapiens
agcccacttctgccatattctg

SEQ ID NO: 4878266 - DNA, 12 bp, Homo sapiens
agcccagagact

SEQ ID NO: 4878267 - DNA, 20 bp, Homo sapiens
agcccagagactttgtagat

SEQ ID NO: 4878268 - DNA, 21 bp, Homo sapiens
agcccagaggtaacagaacag

SEQ ID NO: 4878269 - DNA, 15 bp, Homo sapiens
agcccagccctgttc

SEQ ID NO: 4878270 - DNA, 17 bp, Homo sapiens
agcccagcgctctgcct

SEQ ID NO: 4878271 - DNA, 21 bp, Homo sapiens
agcccagcttggccctttcct

SEQ ID NO: 4878272 - DNA, 16 bp, Homo sapiens
agcccaggagagagaa

SEQ ID NO: 4878273 - DNA, 17 bp, Homo sapiens
agcccaggagagagaaa

SEQ ID NO: 4878274 - DNA, 18 bp, Homo sapiens
agcccaggagagagaaag

SEQ ID NO: 4878275 - DNA, 22 bp, Homo sapiens
agcccaggagagagaaagccag

SEQ ID NO: 4878276 - DNA, 12 bp, Homo sapiens
agcccaggccac

SEQ ID NO: 4878277 - DNA, 21 bp, Homo sapiens
agcccaggcgggagcggtggc

SEQ ID NO: 4878278 - DNA, 20 bp, Homo sapiens
agcccatccctgcctggtca

SEQ ID NO: 4878279 - DNA, 16 bp, Homo sapiens
agcccatggccctgtg

SEQ ID NO: 4878280 - DNA, 19 bp, Homo sapiens
agcccatgttctgccccca

SEQ ID NO: 4878281 - DNA, 23 bp, Homo sapiens
agcccatgttctgcccccagccc

SEQ ID NO: 4878282 - DNA, 12 bp, Homo sapiens
agccccacacag

SEQ ID NO: 4878283 - DNA, 13 bp, Homo sapiens
agccccacccagg

SEQ ID NO: 4878284 - DNA, 14 bp, Homo sapiens
agccccactgccag

SEQ ID NO: 4878285 - DNA, 17 bp, Homo sapiens
agccccactgccagcag

SEQ ID NO: 4878286 - DNA, 18 bp, Homo sapiens
agccccactgccagcagc

SEQ ID NO: 4878287 - DNA, 12 bp, Homo sapiens
agccccagcact

SEQ ID NO: 4878288 - DNA, 18 bp, Homo sapiens
agccccagggtcttccct

SEQ ID NO: 4878289 - DNA, 13 bp, Homo sapiens
agccccagtgccc

SEQ ID NO: 4878290 - DNA, 16 bp, Homo sapiens
agccccagtgcccaca

SEQ ID NO: 4878291 - DNA, 23 bp, Homo sapiens
agccccataattttttttttcct

SEQ ID NO: 4878292 - DNA, 19 bp, Homo sapiens
agccccattctgcctgccc

SEQ ID NO: 4878293 - DNA, 15 bp, Homo sapiens
agcccccagcccctc

SEQ ID NO: 4878294 - DNA, 18 bp, Homo sapiens
agcccccagcccctcccc

SEQ ID NO: 4878295 - DNA, 14 bp, Homo sapiens
agccccgaggcctt

SEQ ID NO: 4878296 - DNA, 22 bp, Homo sapiens
agccccgaggccttctctgaag

SEQ ID NO: 4878297 - DNA, 16 bp, Homo sapiens
agccccgcagacctcc

SEQ ID NO: 4878298 - DNA, 22 bp, Homo sapiens
agccccgcagacctccccagcc

SEQ ID NO: 4878299 - DNA, 22 bp, Homo sapiens
agccccgccctcttcctgacga

SEQ ID NO: 4878300 - DNA, 14 bp, Homo sapiens
agccccggccctgg

SEQ ID NO: 4878301 - DNA, 21 bp, Homo sapiens
agccccggccctgggctcgga

SEQ ID NO: 4878302 - DNA, 23 bp, Homo sapiens
agcccctagaaacccaagctcct

SEQ ID NO: 4878303 - DNA, 16 bp, Homo sapiens
agcccctagcccagga

SEQ ID NO: 4878304 - DNA, 19 bp, Homo sapiens
agcccctagcccaggagag

SEQ ID NO: 4878305 - DNA, 21 bp, Homo sapiens
agcccctagcccaggagagag

SEQ ID NO: 4878306 - DNA, 23 bp, Homo sapiens
agcccctagcccaggagagagaa

SEQ ID NO: 4878307 - DNA, 21 bp, Homo sapiens
agcccctcccccatctcccac

SEQ ID NO: 4878308 - DNA, 22 bp, Homo sapiens
agcccctggggcctagactctg

SEQ ID NO: 4878309 - DNA, 23 bp, Homo sapiens
agccccttgctctcccctgccct

SEQ ID NO: 4878310 - DNA, 16 bp, Homo sapiens
agcccggcgcccctgc

SEQ ID NO: 4878311 - DNA, 22 bp, Homo sapiens
agcccggcgcccctgccacctc

SEQ ID NO: 4878312 - DNA, 14 bp, Homo sapiens
agcccgggagccta

SEQ ID NO: 4878313 - DNA, 16 bp, Homo sapiens
agcccgggagcctagg

SEQ ID NO: 4878314 - DNA, 18 bp, Homo sapiens
agcccgggagcctaggac

SEQ ID NO: 4878315 - DNA, 19 bp, Homo sapiens
agccctaaaaatccagact

SEQ ID NO: 4878316 - DNA, 17 bp, Homo sapiens
agccctaaccccttcca

SEQ ID NO: 4878317 - DNA, 21 bp, Homo sapiens
agccctaaccccttccagatc

SEQ ID NO: 4878318 - DNA, 15 bp, Homo sapiens
agccctactccctgc

SEQ ID NO: 4878319 - DNA, 12 bp, Homo sapiens
agccctccctgc

SEQ ID NO: 4878320 - DNA, 22 bp, Homo sapiens
agccctccctgcccctcccttc

SEQ ID NO: 4878321 - DNA, 22 bp, Homo sapiens
agccctgctttgggctgccctg

SEQ ID NO: 4878322 - DNA, 23 bp, Homo sapiens
agccctgctttgggctgccctgg

SEQ ID NO: 4878323 - DNA, 16 bp, Homo sapiens
agccctggtggcagtg

SEQ ID NO: 4878324 - DNA, 22 bp, Homo sapiens
agcccttccatgtcgcctctgc

SEQ ID NO: 4878325 - DNA, 18 bp, Homo sapiens
agccctttctgtgtgcac

SEQ ID NO: 4878326 - DNA, 17 bp, Homo sapiens
agccgccatcagcccaa

SEQ ID NO: 4878327 - DNA, 21 bp, Homo sapiens
agccgccattgccaccaggag

SEQ ID NO: 4878328 - DNA, 19 bp, Homo sapiens
agatgccatcctctttctc

SEQ ID NO: 4878329 - DNA, 15 bp, Homo sapiens
agatgccattcatag

SEQ ID NO: 4878330 - DNA, 22 bp, Homo sapiens
agatgccttttttgtagttttt

SEQ ID NO: 4878331 - DNA, 19 bp, Homo sapiens
agatgctccaagattctag

SEQ ID NO: 4878332 - DNA, 20 bp, Homo sapiens
agatgctgactgtactcctc

SEQ ID NO: 4878333 - DNA, 21 bp, Homo sapiens
agatgctggagaagagaggag

SEQ ID NO: 4878334 - DNA, 22 bp, Homo sapiens
agatgctgtaacttaaaatagg

SEQ ID NO: 4878335 - DNA, 16 bp, Homo sapiens
agatgctgtgagtctt

SEQ ID NO: 4878336 - DNA, 15 bp, Homo sapiens
agatggaatgctgtg

SEQ ID NO: 4878337 - DNA, 19 bp, Homo sapiens
agatggagttcttgtgcca

SEQ ID NO: 4878338 - DNA, 14 bp, Homo sapiens
agatggctgtgcct

SEQ ID NO: 4878339 - DNA, 15 bp, Homo sapiens
agatggtgaaattta

SEQ ID NO: 4878340 - DNA, 15 bp, Homo sapiens
agatgtcatcagagc

SEQ ID NO: 4878341 - DNA, 22 bp, Homo sapiens
agatgtcatcagagctcctctg

SEQ ID NO: 4878342 - DNA, 23 bp, Homo sapiens
agatgtcccttgatgcacagaga

SEQ ID NO: 4878343 - DNA, 13 bp, Homo sapiens
agatgtcttttat

SEQ ID NO: 4878344 - DNA, 17 bp, Homo sapiens
agatgtcttttatagtg

SEQ ID NO: 4878345 - DNA, 18 bp, Homo sapiens
agatgtgatattctaaga

SEQ ID NO: 4878346 - DNA, 21 bp, Homo sapiens
agatgtgcacccatgggctct

SEQ ID NO: 4878347 - DNA, 21 bp, Homo sapiens
agatgtggccttccatttata

SEQ ID NO: 4878348 - DNA, 16 bp, Homo sapiens
agatgtgtctatggct

SEQ ID NO: 4878349 - DNA, 23 bp, Homo sapiens
agatgttgatttttactgtgttt

SEQ ID NO: 4878350 - DNA, 23 bp, Homo sapiens
agatgtttcacaccggaaggttt

SEQ ID NO: 4878351 - DNA, 21 bp, Homo sapiens
agatgtttccagacttccttg

SEQ ID NO: 4878352 - DNA, 22 bp, Homo sapiens
agatgttttaccgtaataatta

SEQ ID NO: 4878353 - DNA, 13 bp, Homo sapiens
agatgtttttaaa

SEQ ID NO: 4878354 - DNA, 14 bp, Homo sapiens
agattaaacagatg

SEQ ID NO: 4878355 - DNA, 17 bp, Homo sapiens
agattaaatatagatta

SEQ ID NO: 4878356 - DNA, 19 bp, Homo sapiens
agattagaaaaattcctaa

SEQ ID NO: 4878357 - DNA, 23 bp, Homo sapiens
agattatagattctaaagattct

SEQ ID NO: 4878358 - DNA, 15 bp, Homo sapiens
agattcaaaggttct

SEQ ID NO: 4878359 - DNA, 17 bp, Homo sapiens
agattcaaaggttctag

SEQ ID NO: 4878360 - DNA, 18 bp, Homo sapiens
agattcaaaggttctagg

SEQ ID NO: 4878361 - DNA, 19 bp, Homo sapiens
agattcaaaggttctaggt

SEQ ID NO: 4878362 - DNA, 19 bp, Homo sapiens
agattcaggtatgttgcct

SEQ ID NO: 4878363 - DNA, 20 bp, Homo sapiens
agattcaggtatgttgcctt

SEQ ID NO: 4878364 - DNA, 13 bp, Homo sapiens
agattcagtcttg

SEQ ID NO: 4878365 - DNA, 21 bp, Homo sapiens
agattccagagagtggctcct

SEQ ID NO: 4878366 - DNA, 20 bp, Homo sapiens
agattccattggtccaagat

SEQ ID NO: 4878367 - DNA, 16 bp, Homo sapiens
agattcccagagcaaa

SEQ ID NO: 4878368 - DNA, 18 bp, Homo sapiens
agattccggatcctaagc

SEQ ID NO: 4878369 - DNA, 23 bp, Homo sapiens
agattctaaaggtccacaggtct

SEQ ID NO: 4878370 - DNA, 13 bp, Homo sapiens
agattctaatgat

SEQ ID NO: 4878371 - DNA, 20 bp, Homo sapiens
agattctctgtgtctaagat

SEQ ID NO: 4878372 - DNA, 22 bp, Homo sapiens
agattctctgtgtctaagattc

SEQ ID NO: 4878373 - DNA, 21 bp, Homo sapiens
agattctgtgatcttttaaag

SEQ ID NO: 4878374 - DNA, 22 bp, Homo sapiens
agattgaatatttatctagaga

SEQ ID NO: 4878375 - DNA, 17 bp, Homo sapiens
agattgagaaggagaga

SEQ ID NO: 4878376 - DNA, 18 bp, Homo sapiens
agattgagaaggagagaa

SEQ ID NO: 4878377 - DNA, 19 bp, Homo sapiens
agattgagaaggagagaaa

SEQ ID NO: 4878378 - DNA, 19 bp, Homo sapiens
agattgagagaagagacaa

SEQ ID NO: 4878379 - DNA, 23 bp, Homo sapiens
agattgagtataaaaacttgaaa

SEQ ID NO: 4878380 - DNA, 23 bp, Homo sapiens
agattgttgtttgccatactttg

SEQ ID NO: 4878381 - DNA, 19 bp, Homo sapiens
agattgtttcctcttccaa

SEQ ID NO: 4878382 - DNA, 22 bp, Homo sapiens
agattgttttatcatgacatgt

SEQ ID NO: 4878383 - DNA, 11 bp, Homo sapiens
agatttaagca

SEQ ID NO: 4878384 - DNA, 19 bp, Homo sapiens
agatttaagcacaaacttt

SEQ ID NO: 4878385 - DNA, 12 bp, Homo sapiens
agatttcaagat

SEQ ID NO: 4878386 - DNA, 15 bp, Homo sapiens
agatttgtctaattg

SEQ ID NO: 4878387 - DNA, 14 bp, Homo sapiens
agattttaattgtc

SEQ ID NO: 4878388 - DNA, 17 bp, Homo sapiens
agattttctggttctaa

SEQ ID NO: 4878389 - DNA, 19 bp, Homo sapiens
agattttgaggtaaagata

SEQ ID NO: 4878390 - DNA, 22 bp, Homo sapiens
agatttttctcaaagttttgaa

SEQ ID NO: 4878391 - DNA, 22 bp, Homo sapiens
agattttttattgctagtattt

SEQ ID NO: 4878392 - DNA, 13 bp, Homo sapiens
agcaaaaaatgaa

SEQ ID NO: 4878393 - DNA, 12 bp, Homo sapiens
agcaaaaagtgg

SEQ ID NO: 4878394 - DNA, 17 bp, Homo sapiens
agcaaaaagtggggcag

SEQ ID NO: 4878395 - DNA, 22 bp, Homo sapiens
agcaaaaagtggggcagagcct

SEQ ID NO: 4878396 - DNA, 18 bp, Homo sapiens
agcaaagaggactcgctt

SEQ ID NO: 4878397 - DNA, 12 bp, Homo sapiens
agcaaagatcaa

SEQ ID NO: 4878398 - DNA, 13 bp, Homo sapiens
agcaaagatcaaa

SEQ ID NO: 4878399 - DNA, 14 bp, Homo sapiens
agcaaagatcaaaa

SEQ ID NO: 4878400 - DNA, 12 bp, Homo sapiens
agcaaatactta

SEQ ID NO: 4878401 - DNA, 15 bp, Homo sapiens
agcaaatacttagca

SEQ ID NO: 4878402 - DNA, 21 bp, Homo sapiens
agcaaatacttagcaaaaagt

SEQ ID NO: 4878403 - DNA, 18 bp, Homo sapiens
agcaaatttcaaaagaca

SEQ ID NO: 4878404 - DNA, 22 bp, Homo sapiens
agcaacacagaggaatttatac

SEQ ID NO: 4878405 - DNA, 14 bp, Homo sapiens
agcaacaggaaaaa

SEQ ID NO: 4878406 - DNA, 21 bp, Homo sapiens
agcaacaggaatcaagagctg

SEQ ID NO: 4878407 - DNA, 21 bp, Homo sapiens
agcaaccgcctcaaaatgtgt

SEQ ID NO: 4878408 - DNA, 13 bp, Homo sapiens
agcaacctcccaa

SEQ ID NO: 4878409 - DNA, 19 bp, Homo sapiens
agcaacctttcacctttgt

SEQ ID NO: 4878410 - DNA, 16 bp, Homo sapiens
agcaactcttgattat

SEQ ID NO: 4878411 - DNA, 18 bp, Homo sapiens
agcaactgttatgaaata

SEQ ID NO: 4878412 - DNA, 20 bp, Homo sapiens
agcaactgttatgaaataaa

SEQ ID NO: 4878413 - DNA, 21 bp, Homo sapiens
agcaactgttatgaaataaag

SEQ ID NO: 4878414 - DNA, 21 bp, Homo sapiens
agcaagaataaaaaagaaatc

SEQ ID NO: 4878415 - DNA, 21 bp, Homo sapiens
agcaagatcctgtctttaagg

SEQ ID NO: 4878416 - DNA, 13 bp, Homo sapiens
agcaagctggcct

SEQ ID NO: 4878417 - DNA, 16 bp, Homo sapiens
agcaagctggcctcta

SEQ ID NO: 4878418 - DNA, 15 bp, Homo sapiens
agcaaggccctgctg

SEQ ID NO: 4878419 - DNA, 20 bp, Homo sapiens
agcaaggtgggtggaaacta

SEQ ID NO: 4878420 - DNA, 15 bp, Homo sapiens
agcaagtgagagctg

SEQ ID NO: 4878421 - DNA, 17 bp, Homo sapiens
agcaagtgagagctggg

SEQ ID NO: 4878422 - DNA, 23 bp, Homo sapiens
agcaatatattaccagcaagaat

SEQ ID NO: 4878423 - DNA, 24 bp, Homo sapiens
agcaatatattaccagcaagaata

SEQ ID NO: 4878424 - DNA, 15 bp, Homo sapiens
agcaatatgtaaata

SEQ ID NO: 4878425 - DNA, 16 bp, Homo sapiens
agcaatatttatggat

SEQ ID NO: 4878426 - DNA, 19 bp, Homo sapiens
agcaatgacatctcagggg

SEQ ID NO: 4878427 - DNA, 23 bp, Homo sapiens
agcaatggtgtcagtatccaggc

SEQ ID NO: 4878428 - DNA, 13 bp, Homo sapiens
agcaatttaaatg

SEQ ID NO: 4878429 - DNA, 22 bp, Homo sapiens
agcaatttaactagacacagat

SEQ ID NO: 4878430 - DNA, 20 bp, Homo sapiens
agcaatttatacaatatcat

SEQ ID NO: 4878431 - DNA, 21 bp, Homo sapiens
agcaatttcgccgttgaagag

SEQ ID NO: 4878432 - DNA, 22 bp, Homo sapiens
agcaatttcgccgttgaagagg

SEQ ID NO: 4878433 - DNA, 14 bp, Homo sapiens
agcacaaacatttt

SEQ ID NO: 4878434 - DNA, 19 bp, Homo sapiens
agcacaatttgcactaaat

SEQ ID NO: 4878435 - DNA, 17 bp, Homo sapiens
agcacagataaaaagtg

SEQ ID NO: 4878436 - DNA, 20 bp, Homo sapiens
agcacagataaaaagtggaa

SEQ ID NO: 4878437 - DNA, 15 bp, Homo sapiens
agcacagattttaat

SEQ ID NO: 4878438 - DNA, 22 bp, Homo sapiens
agcacagattttaattgtcatg

SEQ ID NO: 4878439 - DNA, 21 bp, Homo sapiens
agcacagcagcccctgcacaa

SEQ ID NO: 4878440 - DNA, 16 bp, Homo sapiens
agcacaggtcccacct

SEQ ID NO: 4878441 - DNA, 21 bp, Homo sapiens
agcacaggtcccacctccagc

SEQ ID NO: 4878442 - DNA, 15 bp, Homo sapiens
agcacatctgcattt

SEQ ID NO: 4878443 - DNA, 15 bp, Homo sapiens
agcacatgctggcca

SEQ ID NO: 4878444 - DNA, 19 bp, Homo sapiens
agcacatgctggccagcct

SEQ ID NO: 4878445 - DNA, 23 bp, Homo sapiens
agcaccaccctagtcccttcccc

SEQ ID NO: 4878446 - DNA, 19 bp, Homo sapiens
agcaccccatgccaaagct

SEQ ID NO: 4878447 - DNA, 17 bp, Homo sapiens
agcacctagcctcgctc

SEQ ID NO: 4878448 - DNA, 18 bp, Homo sapiens
agcacctagtccagtgac

SEQ ID NO: 4878449 - DNA, 21 bp, Homo sapiens
agcacctgcctcctcgttcct

SEQ ID NO: 4878450 - DNA, 17 bp, Homo sapiens
agcacggactcttactg

SEQ ID NO: 4878451 - DNA, 18 bp, Homo sapiens
agcacgggacggaagtgc

SEQ ID NO: 4878452 - DNA, 19 bp, Homo sapiens
agcactaaggtgtgctctg

SEQ ID NO: 4878453 - DNA, 20 bp, Homo sapiens
agcactaaggtgtgctctga

SEQ ID NO: 4878454 - DNA, 13 bp, Homo sapiens
agcactagagaat

SEQ ID NO: 4878455 - DNA, 15 bp, Homo sapiens
agcactagagaatgc

SEQ ID NO: 4878456 - DNA, 23 bp, Homo sapiens
agcactaggttcaattccctgaa

SEQ ID NO: 4878457 - DNA, 18 bp, Homo sapiens
agcactcacgccctaagc

SEQ ID NO: 4878458 - DNA, 18 bp, Homo sapiens
agcactcattttctataa

SEQ ID NO: 4878459 - DNA, 22 bp, Homo sapiens
agcactgaaaataccatcaggc

SEQ ID NO: 4878460 - DNA, 21 bp, Homo sapiens
agcactgttgatgtatctgag

SEQ ID NO: 4878461 - DNA, 13 bp, Homo sapiens
agcacttgtatat

SEQ ID NO: 4878462 - DNA, 22 bp, Homo sapiens
agcacttgtctcattttaatgt

SEQ ID NO: 4878463 - DNA, 17 bp, Homo sapiens
agcactttgaaatacct

SEQ ID NO: 4878464 - DNA, 18 bp, Homo sapiens
agcagaaagctgtgaaca

SEQ ID NO: 4878465 - DNA, 13 bp, Homo sapiens
agcagaagacaaa

SEQ ID NO: 4878466 - DNA, 16 bp, Homo sapiens
agcagaagtggagctg

SEQ ID NO: 4878467 - DNA, 21 bp, Homo sapiens
agcagaatggtgatcactcca

SEQ ID NO: 4878468 - DNA, 22 bp, Homo sapiens
agcagagaatgaaagggcccag

SEQ ID NO: 4878469 - DNA, 15 bp, Homo sapiens
agcagagagatgcgg

SEQ ID NO: 4878470 - DNA, 18 bp, Homo sapiens
agcagagtgcacagctgt

SEQ ID NO: 4878471 - DNA, 18 bp, Homo sapiens
agcagatacctcaccctg

SEQ ID NO: 4878472 - DNA, 15 bp, Homo sapiens
agcagcatcttctgg

SEQ ID NO: 4878473 - DNA, 13 bp, Homo sapiens
agcagcattttta

SEQ ID NO: 4878474 - DNA, 14 bp, Homo sapiens
agcagcatttttat

SEQ ID NO: 4878475 - DNA, 21 bp, Homo sapiens
agcagccgccttaagctgatc

SEQ ID NO: 4878476 - DNA, 19 bp, Homo sapiens
agcagcctgagcaactctt

SEQ ID NO: 4878477 - DNA, 16 bp, Homo sapiens
agcagcctgcttccca

SEQ ID NO: 4878478 - DNA, 15 bp, Homo sapiens
agcagcttcaccaga

SEQ ID NO: 4878479 - DNA, 16 bp, Homo sapiens
agcaggacctcccttc

SEQ ID NO: 4878480 - DNA, 18 bp, Homo sapiens
agcaggacctcccttccg

SEQ ID NO: 4878481 - DNA, 22 bp, Homo sapiens
agcaggagacgacaggcgagag

SEQ ID NO: 4878482 - DNA, 20 bp, Homo sapiens
agcaggagattgagaaggag

SEQ ID NO: 4878483 - DNA, 18 bp, Homo sapiens
agcaggagtggtgcagac

SEQ ID NO: 4878484 - DNA, 21 bp, Homo sapiens
agcaggagtggtgcagacaga

SEQ ID NO: 4878485 - DNA, 16 bp, Homo sapiens
agcaggcagcgccaag

SEQ ID NO: 4878486 - DNA, 22 bp, Homo sapiens
agcaggccaaggtctgagccac

SEQ ID NO: 4878487 - DNA, 21 bp, Homo sapiens
agcaggcggtggggagagatg

SEQ ID NO: 4878488 - DNA, 13 bp, Homo sapiens
agcagggaaacag

SEQ ID NO: 4878489 - DNA, 14 bp, Homo sapiens
agcagggaaacagc

SEQ ID NO: 4878490 - DNA, 14 bp, Homo sapiens
agcagggctcagcg

SEQ ID NO: 4878491 - DNA, 16 bp, Homo sapiens
agcaggggctacaaga

SEQ ID NO: 4878492 - DNA, 19 bp, Homo sapiens
agcaggggctacaagaggg

SEQ ID NO: 4878493 - DNA, 17 bp, Homo sapiens
agcagggtgttgggata

SEQ ID NO: 4878494 - DNA, 22 bp, Homo sapiens
agcaggtgattggaccaggcca

SEQ ID NO: 4878495 - DNA, 20 bp, Homo sapiens
agcagtaaatttgctagcag

SEQ ID NO: 4878496 - DNA, 21 bp, Homo sapiens
agcagttctgttatatcccct

SEQ ID NO: 4878497 - DNA, 14 bp, Homo sapiens
agcagtttgctttg

SEQ ID NO: 4878498 - DNA, 21 bp, Homo sapiens
agcataaaaacattttaaaaa

SEQ ID NO: 4878499 - DNA, 18 bp, Homo sapiens
agcataagtatacagttc

SEQ ID NO: 4878500 - DNA, 16 bp, Homo sapiens
agcatagcttattatt

SEQ ID NO: 4878501 - DNA, 20 bp, Homo sapiens
agcatcactccccaaggaag

SEQ ID NO: 4878502 - DNA, 17 bp, Homo sapiens
agcatcagggggaagaa

SEQ ID NO: 4878503 - DNA, 20 bp, Homo sapiens
agcatcagggggaagaagca

SEQ ID NO: 4878504 - DNA, 12 bp, Homo sapiens
agcatcccccaa

SEQ ID NO: 4878505 - DNA, 16 bp, Homo sapiens
agcatcccccaaagtt

SEQ ID NO: 4878506 - DNA, 20 bp, Homo sapiens
agcatcccggaggaaatctg

SEQ ID NO: 4878507 - DNA, 15 bp, Homo sapiens
agcatcctaagaaat

SEQ ID NO: 4878508 - DNA, 19 bp, Homo sapiens
agcatcctaagaaatatgt

SEQ ID NO: 4878509 - DNA, 17 bp, Homo sapiens
agcatcctgagccccgc

SEQ ID NO: 4878510 - DNA, 23 bp, Homo sapiens
agcatcctgagccccgccctctt

SEQ ID NO: 4878511 - DNA, 13 bp, Homo sapiens
agcatcctggcac

SEQ ID NO: 4878512 - DNA, 20 bp, Homo sapiens
agcatctaagttataagact

SEQ ID NO: 4878513 - DNA, 23 bp, Homo sapiens
agcatctaagttataagactctc

SEQ ID NO: 4878514 - DNA, 12 bp, Homo sapiens
agcatcttctgg

SEQ ID NO: 4878515 - DNA, 16 bp, Homo sapiens
agcatggtccctgcct

SEQ ID NO: 4878516 - DNA, 15 bp, Homo sapiens
agcatgtgccctcct

SEQ ID NO: 4878517 - DNA, 16 bp, Homo sapiens
agcatgtgccttaatg

SEQ ID NO: 4878518 - DNA, 18 bp, Homo sapiens
agcatgtgccttaatgct

SEQ ID NO: 4878519 - DNA, 15 bp, Homo sapiens
agcatgttttgtata

SEQ ID NO: 4878520 - DNA, 15 bp, Homo sapiens
agcattatgcaatta

SEQ ID NO: 4878521 - DNA, 14 bp, Homo sapiens
agcattcagagagc

SEQ ID NO: 4878522 - DNA, 14 bp, Homo sapiens
agcattccctccca

SEQ ID NO: 4878523 - DNA, 23 bp, Homo sapiens
agcattccttctttgataatgtt

SEQ ID NO: 4878524 - DNA, 17 bp, Homo sapiens
agcattgctgttatgtc

SEQ ID NO: 4878525 - DNA, 20 bp, Homo sapiens
agcattgctgttatgtctgt

SEQ ID NO: 4878526 - DNA, 21 bp, Homo sapiens
agcattgcttttattttgaaa

SEQ ID NO: 4878527 - DNA, 15 bp, Homo sapiens
agcatttatcattct

SEQ ID NO: 4878528 - DNA, 17 bp, Homo sapiens
agcatttccaacaccac

SEQ ID NO: 4878529 - DNA, 19 bp, Homo sapiens
agcatttccaacaccacag

SEQ ID NO: 4878530 - DNA, 20 bp, Homo sapiens
agcatttcttttctggccaa

SEQ ID NO: 4878531 - DNA, 14 bp, Homo sapiens
agcatttgataatg

SEQ ID NO: 4878532 - DNA, 15 bp, Homo sapiens
agcatttgataatga

SEQ ID NO: 4878533 - DNA, 23 bp, Homo sapiens
agcatttggaccaatagcccaca

SEQ ID NO: 4878534 - DNA, 23 bp, Homo sapiens
agcattttagcaatttatacaat

SEQ ID NO: 4878535 - DNA, 18 bp, Homo sapiens
agccaaacccatgaggca

SEQ ID NO: 4878536 - DNA, 19 bp, Homo sapiens
agccaaagaaatgaacatt

SEQ ID NO: 4878537 - DNA, 20 bp, Homo sapiens
agccaaagctaggcctggcc

SEQ ID NO: 4878538 - DNA, 16 bp, Homo sapiens
agccaaatttatcaaa

SEQ ID NO: 4878539 - DNA, 17 bp, Homo sapiens
agccaagcttgttatca

SEQ ID NO: 4878540 - DNA, 18 bp, Homo sapiens
agccaagtgccaaatgct

SEQ ID NO: 4878541 - DNA, 21 bp, Homo sapiens
aggtaacagaacagcttcagg

SEQ ID NO: 4878542 - DNA, 22 bp, Homo sapiens
aggtaacagaacagcttcaggt

SEQ ID NO: 4878543 - DNA, 13 bp, Homo sapiens
aggtaacaggcag

SEQ ID NO: 4878544 - DNA, 16 bp, Homo sapiens
aggtaacaggcagata

SEQ ID NO: 4878545 - DNA, 18 bp, Homo sapiens
aggtaatataaaaagctt

SEQ ID NO: 4878546 - DNA, 19 bp, Homo sapiens
aggtacagggtttttacct

SEQ ID NO: 4878547 - DNA, 16 bp, Homo sapiens
aggtactagaatgctt

SEQ ID NO: 4878548 - DNA, 17 bp, Homo sapiens
aggtactagaatgctta

SEQ ID NO: 4878549 - DNA, 15 bp, Homo sapiens
aggtactatatttgc

SEQ ID NO: 4878550 - DNA, 20 bp, Homo sapiens
aggtatgttgcctttatggt

SEQ ID NO: 4878551 - DNA, 15 bp, Homo sapiens
aggtattattatctt

SEQ ID NO: 4878552 - DNA, 16 bp, Homo sapiens
aggtattattatcttt

SEQ ID NO: 4878553 - DNA, 14 bp, Homo sapiens
aggtatttatcttt

SEQ ID NO: 4878554 - DNA, 14 bp, Homo sapiens
aggtattttgaata

SEQ ID NO: 4878555 - DNA, 17 bp, Homo sapiens
aggtattttgtttcttt

SEQ ID NO: 4878556 - DNA, 19 bp, Homo sapiens
aggtattttgtttctttta

SEQ ID NO: 4878557 - DNA, 20 bp, Homo sapiens
aggtcaagggcttactattt

SEQ ID NO: 4878558 - DNA, 23 bp, Homo sapiens
aggtcacacgaccggggccagca

SEQ ID NO: 4878559 - DNA, 12 bp, Homo sapiens
aggtcagagcct

SEQ ID NO: 4878560 - DNA, 16 bp, Homo sapiens
aggtcaggccctggaa

SEQ ID NO: 4878561 - DNA, 20 bp, Homo sapiens
aggtcagggagtgctggctc

SEQ ID NO: 4878562 - DNA, 19 bp, Homo sapiens
aggtccacaggtctagact

SEQ ID NO: 4878563 - DNA, 12 bp, Homo sapiens
aggtccagccca

SEQ ID NO: 4878564 - DNA, 16 bp, Homo sapiens
aggtccagcccatctc

SEQ ID NO: 4878565 - DNA, 11 bp, Homo sapiens
aggtcccaggc

SEQ ID NO: 4878566 - DNA, 12 bp, Homo sapiens
aggtcccaggca

SEQ ID NO: 4878567 - DNA, 14 bp, Homo sapiens
aggtcccaggcaga

SEQ ID NO: 4878568 - DNA, 15 bp, Homo sapiens
aggtcctcagagaat

SEQ ID NO: 4878569 - DNA, 15 bp, Homo sapiens
aggtcctctggagcc

SEQ ID NO: 4878570 - DNA, 20 bp, Homo sapiens
aggtcctctggagccctaac

SEQ ID NO: 4878571 - DNA, 17 bp, Homo sapiens
aggtctcccacgtggga

SEQ ID NO: 4878572 - DNA, 16 bp, Homo sapiens
aggtctcttctcccag

SEQ ID NO: 4878573 - DNA, 22 bp, Homo sapiens
aggtctcttctcccagaatccc

SEQ ID NO: 4878574 - DNA, 23 bp, Homo sapiens
aggtctcttctcccagaatccca

SEQ ID NO: 4878575 - DNA, 12 bp, Homo sapiens
aggtctgtttaa

SEQ ID NO: 4878576 - DNA, 23 bp, Homo sapiens
aggtcttgaactcctggcctcaa

SEQ ID NO: 4878577 - DNA, 18 bp, Homo sapiens
aggtctttggttcagcta

SEQ ID NO: 4878578 - DNA, 14 bp, Homo sapiens
aggtgaaagggagc

SEQ ID NO: 4878579 - DNA, 21 bp, Homo sapiens
aggtgaaagggagctatcagg

SEQ ID NO: 4878580 - DNA, 15 bp, Homo sapiens
aggtgacactatagt

SEQ ID NO: 4878581 - DNA, 22 bp, Homo sapiens
aggtgacagagtgagactctgt

SEQ ID NO: 4878582 - DNA, 20 bp, Homo sapiens
aggtgacatgtgaaaccttt

SEQ ID NO: 4878583 - DNA, 13 bp, Homo sapiens
aggtgaccccagg

SEQ ID NO: 4878584 - DNA, 18 bp, Homo sapiens
aggtgaccctgatgaaaa

SEQ ID NO: 4878585 - DNA, 13 bp, Homo sapiens
aggtgagaaaaaa

SEQ ID NO: 4878586 - DNA, 14 bp, Homo sapiens
aggtgagaaaaaaa

SEQ ID NO: 4878587 - DNA, 18 bp, Homo sapiens
aggtgaggagcagagcag

SEQ ID NO: 4878588 - DNA, 16 bp, Homo sapiens
aggtgatagcattgct

SEQ ID NO: 4878589 - DNA, 21 bp, Homo sapiens
aggtgatccacccacctcagc

SEQ ID NO: 4878590 - DNA, 20 bp, Homo sapiens
aggtgcaatttcaaggttct

SEQ ID NO: 4878591 - DNA, 23 bp, Homo sapiens
aggtgccactttacccacctaga

SEQ ID NO: 4878592 - DNA, 21 bp, Homo sapiens
aggtgccagcctgaggcagcc

SEQ ID NO: 4878593 - DNA, 17 bp, Homo sapiens
aggtgcctgtcccaccc

SEQ ID NO: 4878594 - DNA, 23 bp, Homo sapiens
aggtgctaaatggtcgcccagga

SEQ ID NO: 4878595 - DNA, 17 bp, Homo sapiens
aggtgctgccatccagg

SEQ ID NO: 4878596 - DNA, 16 bp, Homo sapiens
aggtggaaggcagaca

SEQ ID NO: 4878597 - DNA, 14 bp, Homo sapiens
aggtggacctttta

SEQ ID NO: 4878598 - DNA, 15 bp, Homo sapiens
aggtggaccttttaa

SEQ ID NO: 4878599 - DNA, 23 bp, Homo sapiens
aggtggattttgtttaaaaaatc

SEQ ID NO: 4878600 - DNA, 16 bp, Homo sapiens
aggtgggagcaggaga

SEQ ID NO: 4878601 - DNA, 17 bp, Homo sapiens
aggtgggagcaggagat

SEQ ID NO: 4878602 - DNA, 14 bp, Homo sapiens
aggtggggcagctt

SEQ ID NO: 4878603 - DNA, 17 bp, Homo sapiens
aggtggggcgaggcagg

SEQ ID NO: 4878604 - DNA, 15 bp, Homo sapiens
aggtggtgcttacat

SEQ ID NO: 4878605 - DNA, 15 bp, Homo sapiens
aggtggttttaaagg

SEQ ID NO: 4878606 - DNA, 16 bp, Homo sapiens
aggtgtccctgcactt

SEQ ID NO: 4878607 - DNA, 20 bp, Homo sapiens
aggtgtccctgcacttgcag

SEQ ID NO: 4878608 - DNA, 17 bp, Homo sapiens
aggtgtgaaccaccaca

SEQ ID NO: 4878609 - DNA, 22 bp, Homo sapiens
aggtgtgaaccaccacacccag

SEQ ID NO: 4878610 - DNA, 14 bp, Homo sapiens
aggtgtgagtcacc

SEQ ID NO: 4878611 - DNA, 21 bp, Homo sapiens
aggtgtggtgtaatttataaa

SEQ ID NO: 4878612 - DNA, 18 bp, Homo sapiens
aggtgttaacattccaag

SEQ ID NO: 4878613 - DNA, 15 bp, Homo sapiens
aggtgttactgtaat

SEQ ID NO: 4878614 - DNA, 19 bp, Homo sapiens
aggtgttttttatgaagtg

SEQ ID NO: 4878615 - DNA, 17 bp, Homo sapiens
aggttatcgaaataaca

SEQ ID NO: 4878616 - DNA, 18 bp, Homo sapiens
aggttatcgaaataacaa

SEQ ID NO: 4878617 - DNA, 19 bp, Homo sapiens
aggttatcgaaataacaat

SEQ ID NO: 4878618 - DNA, 21 bp, Homo sapiens
aggttcatgccaccatggcca

SEQ ID NO: 4878619 - DNA, 17 bp, Homo sapiens
aggttccaactgtatat

SEQ ID NO: 4878620 - DNA, 20 bp, Homo sapiens
aggttccctgttcttcctcc

SEQ ID NO: 4878621 - DNA, 11 bp, Homo sapiens
aggttctaaag

SEQ ID NO: 4878622 - DNA, 12 bp, Homo sapiens
aggttctaaagt

SEQ ID NO: 4878623 - DNA, 14 bp, Homo sapiens
aggttctaaagttc

SEQ ID NO: 4878624 - DNA, 16 bp, Homo sapiens
aggttctaaagttcta

SEQ ID NO: 4878625 - DNA, 17 bp, Homo sapiens
aggttctaaagttctaa

SEQ ID NO: 4878626 - DNA, 19 bp, Homo sapiens
aggttctaaagttctaaga

SEQ ID NO: 4878627 - DNA, 14 bp, Homo sapiens
aggttctaacccta

SEQ ID NO: 4878628 - DNA, 12 bp, Homo sapiens
aggttctaaggc

SEQ ID NO: 4878629 - DNA, 13 bp, Homo sapiens
aggttctaaggcc

SEQ ID NO: 4878630 - DNA, 22 bp, Homo sapiens
aggttctaaggcctaggattct

SEQ ID NO: 4878631 - DNA, 17 bp, Homo sapiens
aggttctaggtttcaaa

SEQ ID NO: 4878632 - DNA, 19 bp, Homo sapiens
aggttctaggtttcaaaga

SEQ ID NO: 4878633 - DNA, 22 bp, Homo sapiens
aggttctgtttatggccacatt

SEQ ID NO: 4878634 - DNA, 14 bp, Homo sapiens
aggttgaagcacca

SEQ ID NO: 4878635 - DNA, 14 bp, Homo sapiens
aggttggaagagaa

SEQ ID NO: 4878636 - DNA, 17 bp, Homo sapiens
aggttggaagagaatca

SEQ ID NO: 4878637 - DNA, 16 bp, Homo sapiens
aggttggaccccagag

SEQ ID NO: 4878638 - DNA, 16 bp, Homo sapiens
aggttgtctgaagtca

SEQ ID NO: 4878639 - DNA, 20 bp, Homo sapiens
aggttgtctgaagtcactgc

SEQ ID NO: 4878640 - DNA, 13 bp, Homo sapiens
aggtttaaagagt

SEQ ID NO: 4878641 - DNA, 16 bp, Homo sapiens
aggtttaaagagtcta

SEQ ID NO: 4878642 - DNA, 16 bp, Homo sapiens
aggtttaacatttgcc

SEQ ID NO: 4878643 - DNA, 14 bp, Homo sapiens
aggtttcaaagatg

SEQ ID NO: 4878644 - DNA, 17 bp, Homo sapiens
aggtttcgtttctgtat

SEQ ID NO: 4878645 - DNA, 23 bp, Homo sapiens
aggtttgtcgggcaccagccagc

SEQ ID NO: 4878646 - DNA, 15 bp, Homo sapiens
aggttttaggttcta

SEQ ID NO: 4878647 - DNA, 17 bp, Homo sapiens
aggttttaggttctaaa

SEQ ID NO: 4878648 - DNA, 23 bp, Homo sapiens
aggttttaggttctaaagttcta

SEQ ID NO: 4878649 - DNA, 23 bp, Homo sapiens
aggtttttaaacactaaaatata

SEQ ID NO: 4878650 - DNA, 13 bp, Homo sapiens
agtaaaatttatt

SEQ ID NO: 4878651 - DNA, 15 bp, Homo sapiens
agtaaaatttatttc

SEQ ID NO: 4878652 - DNA, 15 bp, Homo sapiens
agtaaatcttttaca

SEQ ID NO: 4878653 - DNA, 12 bp, Homo sapiens
aggactccctcc

SEQ ID NO: 4878654 - DNA, 18 bp, Homo sapiens
aggactccctcctcacct

SEQ ID NO: 4878655 - DNA, 17 bp, Homo sapiens
aggactcgcttgtaaat

SEQ ID NO: 4878656 - DNA, 21 bp, Homo sapiens
aggactcgcttgtaaatacca

SEQ ID NO: 4878657 - DNA, 12 bp, Homo sapiens
aggactctgcct

SEQ ID NO: 4878658 - DNA, 14 bp, Homo sapiens
aggactctgcctcc

SEQ ID NO: 4878659 - DNA, 17 bp, Homo sapiens
aggactctgcctcctct

SEQ ID NO: 4878660 - DNA, 24 bp, Homo sapiens
aggactgagccccgcagacctccc

SEQ ID NO: 4878661 - DNA, 13 bp, Homo sapiens
aggacttgtgtct

SEQ ID NO: 4878662 - DNA, 23 bp, Homo sapiens
aggacttttctttgtggcttcct

SEQ ID NO: 4878663 - DNA, 12 bp, Homo sapiens
aggagaacaaat

SEQ ID NO: 4878664 - DNA, 18 bp, Homo sapiens
aggagacagttcaagaaa

SEQ ID NO: 4878665 - DNA, 14 bp, Homo sapiens
aggagaccaaggcg

SEQ ID NO: 4878666 - DNA, 17 bp, Homo sapiens
aggagaccaaggcggga

SEQ ID NO: 4878667 - DNA, 11 bp, Homo sapiens
aggagagagaa

SEQ ID NO: 4878668 - DNA, 14 bp, Homo sapiens
aggagagagaaagc

SEQ ID NO: 4878669 - DNA, 10 bp, Homo sapiens
aggagagagg

SEQ ID NO: 4878670 - DNA, 12 bp, Homo sapiens
aggagagcctgc

SEQ ID NO: 4878671 - DNA, 15 bp, Homo sapiens
aggagagcctgctgc

SEQ ID NO: 4878672 - DNA, 15 bp, Homo sapiens
aggagaggagagagg

SEQ ID NO: 4878673 - DNA, 16 bp, Homo sapiens
aggagaggagagaggc

SEQ ID NO: 4878674 - DNA, 21 bp, Homo sapiens
aggagaggatgagagcccaga

SEQ ID NO: 4878675 - DNA, 23 bp, Homo sapiens
aggagaggatgagagcccagagg

SEQ ID NO: 4878676 - DNA, 20 bp, Homo sapiens
aggagaggcaacatccaaaa

SEQ ID NO: 4878677 - DNA, 15 bp, Homo sapiens
aggagattgagaagg

SEQ ID NO: 4878678 - DNA, 19 bp, Homo sapiens
aggagattgagaaggagag

SEQ ID NO: 4878679 - DNA, 14 bp, Homo sapiens
aggagccagacaga

SEQ ID NO: 4878680 - DNA, 14 bp, Homo sapiens
aggagccccagcta

SEQ ID NO: 4878681 - DNA, 12 bp, Homo sapiens
aggagctaaggc

SEQ ID NO: 4878682 - DNA, 17 bp, Homo sapiens
aggagctaaggctctat

SEQ ID NO: 4878683 - DNA, 20 bp, Homo sapiens
aggagctaaggctctatgag

SEQ ID NO: 4878684 - DNA, 21 bp, Homo sapiens
aggagctgaggtttcaccctt

SEQ ID NO: 4878685 - DNA, 18 bp, Homo sapiens
aggagctgccttggctca

SEQ ID NO: 4878686 - DNA, 19 bp, Homo sapiens
aggagctgccttggctcag

SEQ ID NO: 4878687 - DNA, 21 bp, Homo sapiens
aggagctgccttggctcagac

SEQ ID NO: 4878688 - DNA, 22 bp, Homo sapiens
aggagctgccttggctcagaca

SEQ ID NO: 4878689 - DNA, 12 bp, Homo sapiens
aggagctgctgg

SEQ ID NO: 4878690 - DNA, 21 bp, Homo sapiens
aggaggatgtccctgggccag

SEQ ID NO: 4878691 - DNA, 20 bp, Homo sapiens
aggaggattgcttgagccca

SEQ ID NO: 4878692 - DNA, 22 bp, Homo sapiens
aggaggcagaataagaaaacaa

SEQ ID NO: 4878693 - DNA, 20 bp, Homo sapiens
aggaggctcaacaataaaac

SEQ ID NO: 4878694 - DNA, 19 bp, Homo sapiens
aggaggctgaggcaggagg

SEQ ID NO: 4878695 - DNA, 16 bp, Homo sapiens
aggaggctggcaggta

SEQ ID NO: 4878696 - DNA, 20 bp, Homo sapiens
aggagggccctacctgattg

SEQ ID NO: 4878697 - DNA, 17 bp, Homo sapiens
aggaggggatagagaga

SEQ ID NO: 4878698 - DNA, 20 bp, Homo sapiens
aggaggtgtgaggaggaggc

SEQ ID NO: 4878699 - DNA, 21 bp, Homo sapiens
aggagtgggaaaacactgcca

SEQ ID NO: 4878700 - DNA, 20 bp, Homo sapiens
aggagtgtgtgacattccag

SEQ ID NO: 4878701 - DNA, 16 bp, Homo sapiens
aggagttcgaggctgc

SEQ ID NO: 4878702 - DNA, 17 bp, Homo sapiens
aggagttcgaggctgca

SEQ ID NO: 4878703 - DNA, 13 bp, Homo sapiens
aggataagtgaaa

SEQ ID NO: 4878704 - DNA, 20 bp, Homo sapiens
aggatcatttgttggaatga

SEQ ID NO: 4878705 - DNA, 22 bp, Homo sapiens
aggatgaatgaggtcccaggca

SEQ ID NO: 4878706 - DNA, 13 bp, Homo sapiens
aggatgagagccc

SEQ ID NO: 4878707 - DNA, 19 bp, Homo sapiens
aggatgagagcccagaggt

SEQ ID NO: 4878708 - DNA, 20 bp, Homo sapiens
aggatgagagcccagaggta

SEQ ID NO: 4878709 - DNA, 13 bp, Homo sapiens
aggatgctgggtg

SEQ ID NO: 4878710 - DNA, 18 bp, Homo sapiens
aggatgctgtgttgtcaa

SEQ ID NO: 4878711 - DNA, 15 bp, Homo sapiens
aggatgtcacagggc

SEQ ID NO: 4878712 - DNA, 22 bp, Homo sapiens
aggatgtccctgggccagggtc

SEQ ID NO: 4878713 - DNA, 15 bp, Homo sapiens
aggatgttctgggac

SEQ ID NO: 4878714 - DNA, 14 bp, Homo sapiens
aggattcagccgga

SEQ ID NO: 4878715 - DNA, 16 bp, Homo sapiens
aggattcagccggagg

SEQ ID NO: 4878716 - DNA, 14 bp, Homo sapiens
aggattctaaaatg

SEQ ID NO: 4878717 - DNA, 19 bp, Homo sapiens
aggattgcttgagcccagg

SEQ ID NO: 4878718 - DNA, 13 bp, Homo sapiens
aggattgtaaaaa

SEQ ID NO: 4878719 - DNA, 19 bp, Homo sapiens
aggattgtaaaaaaaaatg

SEQ ID NO: 4878720 - DNA, 15 bp, Homo sapiens
aggatttaaaaactg

SEQ ID NO: 4878721 - DNA, 16 bp, Homo sapiens
aggatttaaaaactgg

SEQ ID NO: 4878722 - DNA, 18 bp, Homo sapiens
aggatttaaaaactggaa

SEQ ID NO: 4878723 - DNA, 18 bp, Homo sapiens
aggatttctaatcaaaag

SEQ ID NO: 4878724 - DNA, 21 bp, Homo sapiens
aggatttttttttttttttga

SEQ ID NO: 4878725 - DNA, 15 bp, Homo sapiens
aggcaaaaatgtaaa

SEQ ID NO: 4878726 - DNA, 20 bp, Homo sapiens
aggcaaaattgcaaatcttg

SEQ ID NO: 4878727 - DNA, 15 bp, Homo sapiens
aggcaacctgattgt

SEQ ID NO: 4878728 - DNA, 14 bp, Homo sapiens
aggcaagcacctcc

SEQ ID NO: 4878729 - DNA, 17 bp, Homo sapiens
aggcaagcacctcctgc

SEQ ID NO: 4878730 - DNA, 20 bp, Homo sapiens
aggcaagcacctcctgcctc

SEQ ID NO: 4878731 - DNA, 18 bp, Homo sapiens
aggcaaggctatgtgatt

SEQ ID NO: 4878732 - DNA, 20 bp, Homo sapiens
aggcaaggctatgtgattac

SEQ ID NO: 4878733 - DNA, 18 bp, Homo sapiens
aggcaagttaagagaaac

SEQ ID NO: 4878734 - DNA, 20 bp, Homo sapiens
aggcaagttaagagaaactt

SEQ ID NO: 4878735 - DNA, 17 bp, Homo sapiens
aggcaatgtcaggaaca

SEQ ID NO: 4878736 - DNA, 19 bp, Homo sapiens
aggcaatgtcaggaacaga

SEQ ID NO: 4878737 - DNA, 14 bp, Homo sapiens
aggcacaatatggg

SEQ ID NO: 4878738 - DNA, 13 bp, Homo sapiens
aggcacagctgag

SEQ ID NO: 4878739 - DNA, 15 bp, Homo sapiens
aggcacagggagaag

SEQ ID NO: 4878740 - DNA, 14 bp, Homo sapiens
aggcaccagaagaa

SEQ ID NO: 4878741 - DNA, 14 bp, Homo sapiens
aggcaccatctccc

SEQ ID NO: 4878742 - DNA, 15 bp, Homo sapiens
aggcacccaccatca

SEQ ID NO: 4878743 - DNA, 17 bp, Homo sapiens
aggcacctagcaattcc

SEQ ID NO: 4878744 - DNA, 14 bp, Homo sapiens
aggcactgctgccc

SEQ ID NO: 4878745 - DNA, 16 bp, Homo sapiens
aggcactgtactaggc

SEQ ID NO: 4878746 - DNA, 16 bp, Homo sapiens
aggcactgtagttcta

SEQ ID NO: 4878747 - DNA, 18 bp, Homo sapiens
aggcacttattgtaaatt

SEQ ID NO: 4878748 - DNA, 13 bp, Homo sapiens
aggcagacagcag

SEQ ID NO: 4878749 - DNA, 19 bp, Homo sapiens
aggcagacagcaggcagcg

SEQ ID NO: 4878750 - DNA, 14 bp, Homo sapiens
aggcagagaatcat

SEQ ID NO: 4878751 - DNA, 13 bp, Homo sapiens
aggcagagagcgg

SEQ ID NO: 4878752 - DNA, 20 bp, Homo sapiens
aggcagagagcggtctcagg

SEQ ID NO: 4878753 - DNA, 13 bp, Homo sapiens
aggcagatacagg

SEQ ID NO: 4878754 - DNA, 16 bp, Homo sapiens
aggcagatctgtgccc

SEQ ID NO: 4878755 - DNA, 22 bp, Homo sapiens
aggcagatctgtgccccatgcc

SEQ ID NO: 4878756 - DNA, 16 bp, Homo sapiens
agccgctgtgagcccc

SEQ ID NO: 4878757 - DNA, 17 bp, Homo sapiens
agccgtgaactgtgcat

SEQ ID NO: 4878758 - DNA, 13 bp, Homo sapiens
agccgtggcttcc

SEQ ID NO: 4878759 - DNA, 14 bp, Homo sapiens
agccgtggcttccc

SEQ ID NO: 4878760 - DNA, 21 bp, Homo sapiens
agccgtggcttcccgctcagc

SEQ ID NO: 4878761 - DNA, 23 bp, Homo sapiens
agccgtggcttcccgctcagccc

SEQ ID NO: 4878762 - DNA, 17 bp, Homo sapiens
agcctacctgctctcca

SEQ ID NO: 4878763 - DNA, 14 bp, Homo sapiens
agcctagaagctgg

SEQ ID NO: 4878764 - DNA, 18 bp, Homo sapiens
agcctaggaccactcagc

SEQ ID NO: 4878765 - DNA, 20 bp, Homo sapiens
agcctaggaccactcagccc

SEQ ID NO: 4878766 - DNA, 22 bp, Homo sapiens
agcctaggaccactcagcccct

SEQ ID NO: 4878767 - DNA, 23 bp, Homo sapiens
agcctaggaccactcagccccta

SEQ ID NO: 4878768 - DNA, 16 bp, Homo sapiens
agcctatgagcatcct

SEQ ID NO: 4878769 - DNA, 23 bp, Homo sapiens
agcctatgagcatcctgagcccc

SEQ ID NO: 4878770 - DNA, 19 bp, Homo sapiens
agcctatggcagaaaaaat

SEQ ID NO: 4878771 - DNA, 13 bp, Homo sapiens
agcctatgttgtg

SEQ ID NO: 4878772 - DNA, 16 bp, Homo sapiens
agcctatttacctgca

SEQ ID NO: 4878773 - DNA, 20 bp, Homo sapiens
agcctatttacctgcaggct

SEQ ID NO: 4878774 - DNA, 21 bp, Homo sapiens
agcctcaaggttttaggttct

SEQ ID NO: 4878775 - DNA, 13 bp, Homo sapiens
agcctcactgata

SEQ ID NO: 4878776 - DNA, 22 bp, Homo sapiens
agcctcagcatcctggcacccg

SEQ ID NO: 4878777 - DNA, 15 bp, Homo sapiens
agcctcagtcctccc

SEQ ID NO: 4878778 - DNA, 17 bp, Homo sapiens
agcctcagtcctcccct

SEQ ID NO: 4878779 - DNA, 18 bp, Homo sapiens
agcctcagtcctcccctc

SEQ ID NO: 4878780 - DNA, 19 bp, Homo sapiens
agcctcatatttaaagaca

SEQ ID NO: 4878781 - DNA, 20 bp, Homo sapiens
agcctccatgctgcctccag

SEQ ID NO: 4878782 - DNA, 17 bp, Homo sapiens
agcctcccaaagtgctg

SEQ ID NO: 4878783 - DNA, 19 bp, Homo sapiens
agcctcccaaagtgctggg

SEQ ID NO: 4878784 - DNA, 21 bp, Homo sapiens
agcctcccaaggagaacaaat

SEQ ID NO: 4878785 - DNA, 18 bp, Homo sapiens
agcctcccgaatagctgg

SEQ ID NO: 4878786 - DNA, 22 bp, Homo sapiens
agcctcccgaatagctgggact

SEQ ID NO: 4878787 - DNA, 20 bp, Homo sapiens
agcctcccgagtagctggga

SEQ ID NO: 4878788 - DNA, 17 bp, Homo sapiens
agcctcgttttgatgcc

SEQ ID NO: 4878789 - DNA, 21 bp, Homo sapiens
agcctctgacccctcctcact

SEQ ID NO: 4878790 - DNA, 22 bp, Homo sapiens
agcctctgacccctcctcactg

SEQ ID NO: 4878791 - DNA, 13 bp, Homo sapiens
agcctctgctccc

SEQ ID NO: 4878792 - DNA, 23 bp, Homo sapiens
agcctctggcattagaattattt

SEQ ID NO: 4878793 - DNA, 22 bp, Homo sapiens
agcctcttaaagctgcctgtag

SEQ ID NO: 4878794 - DNA, 14 bp, Homo sapiens
agcctcttctgcca

SEQ ID NO: 4878795 - DNA, 21 bp, Homo sapiens
agcctgaccttccttcctgtt

SEQ ID NO: 4878796 - DNA, 19 bp, Homo sapiens
agcctgagtcagggcccag

SEQ ID NO: 4878797 - DNA, 13 bp, Homo sapiens
agcctgatctctt

SEQ ID NO: 4878798 - DNA, 17 bp, Homo sapiens
agcctgatctcttcctg

SEQ ID NO: 4878799 - DNA, 19 bp, Homo sapiens
agcctgcaatttcatatgc

SEQ ID NO: 4878800 - DNA, 23 bp, Homo sapiens
agcctgcagttattaacactaac

SEQ ID NO: 4878801 - DNA, 11 bp, Homo sapiens
agcctgctgca

SEQ ID NO: 4878802 - DNA, 20 bp, Homo sapiens
agcctgctgcccaggctgtg

SEQ ID NO: 4878803 - DNA, 23 bp, Homo sapiens
agcctgctggtcacagcctcctc

SEQ ID NO: 4878804 - DNA, 24 bp, Homo sapiens
agcctggagacccaccccacctgc

SEQ ID NO: 4878805 - DNA, 18 bp, Homo sapiens
agcctggcacagggcagt

SEQ ID NO: 4878806 - DNA, 19 bp, Homo sapiens
agcctggcccatagaaaca

SEQ ID NO: 4878807 - DNA, 16 bp, Homo sapiens
agcctgtaagcctgca

SEQ ID NO: 4878808 - DNA, 18 bp, Homo sapiens
agcctgtaagcctgcaag

SEQ ID NO: 4878809 - DNA, 16 bp, Homo sapiens
agcctgtcatccttgg

SEQ ID NO: 4878810 - DNA, 12 bp, Homo sapiens
agcctgtgcctc

SEQ ID NO: 4878811 - DNA, 15 bp, Homo sapiens
agcctgtggatgatc

SEQ ID NO: 4878812 - DNA, 20 bp, Homo sapiens
agcctgtggatgatcaatcc

SEQ ID NO: 4878813 - DNA, 23 bp, Homo sapiens
agcctgtggatgatcaatccttt

SEQ ID NO: 4878814 - DNA, 11 bp, Homo sapiens
agcctgtggca

SEQ ID NO: 4878815 - DNA, 14 bp, Homo sapiens
agcctgtggcatct

SEQ ID NO: 4878816 - DNA, 14 bp, Homo sapiens
agcctgtttcttcc

SEQ ID NO: 4878817 - DNA, 12 bp, Homo sapiens
agccttaatttt

SEQ ID NO: 4878818 - DNA, 20 bp, Homo sapiens
agccttagaagtcacacagt

SEQ ID NO: 4878819 - DNA, 22 bp, Homo sapiens
agccttagaagtcacacagtat

SEQ ID NO: 4878820 - DNA, 18 bp, Homo sapiens
agccttcttccatcccag

SEQ ID NO: 4878821 - DNA, 19 bp, Homo sapiens
agcctttagtatcagtgtt

SEQ ID NO: 4878822 - DNA, 21 bp, Homo sapiens
agcctttggctctggagacag

SEQ ID NO: 4878823 - DNA, 18 bp, Homo sapiens
agcctttggttctggcca

SEQ ID NO: 4878824 - DNA, 17 bp, Homo sapiens
agcctttttaaaacaca

SEQ ID NO: 4878825 - DNA, 21 bp, Homo sapiens
agcctttttaaaacacatgtt

SEQ ID NO: 4878826 - DNA, 22 bp, Homo sapiens
agcctttttaaaacacatgttt

SEQ ID NO: 4878827 - DNA, 13 bp, Homo sapiens
agcgaagtagctt

SEQ ID NO: 4878828 - DNA, 17 bp, Homo sapiens
agcgaagtagcttgctc

SEQ ID NO: 4878829 - DNA, 17 bp, Homo sapiens
agcgaccgccccctcct

SEQ ID NO: 4878830 - DNA, 19 bp, Homo sapiens
agcgagccctggtggcagt

SEQ ID NO: 4878831 - DNA, 17 bp, Homo sapiens
agcgatatacagatgaa

SEQ ID NO: 4878832 - DNA, 15 bp, Homo sapiens
agcgattcttctgct

SEQ ID NO: 4878833 - DNA, 19 bp, Homo sapiens
agcgcagcagccctccccg

SEQ ID NO: 4878834 - DNA, 21 bp, Homo sapiens
agcgcagctggactctgcatc

SEQ ID NO: 4878835 - DNA, 22 bp, Homo sapiens
agcgccagtgtaatcccccagg

SEQ ID NO: 4878836 - DNA, 12 bp, Homo sapiens
agcgcgccactc

SEQ ID NO: 4878837 - DNA, 17 bp, Homo sapiens
agcgctatcttcacata

SEQ ID NO: 4878838 - DNA, 18 bp, Homo sapiens
agcggagacggagtccca

SEQ ID NO: 4878839 - DNA, 15 bp, Homo sapiens
agcggcgaccgccct

SEQ ID NO: 4878840 - DNA, 21 bp, Homo sapiens
agcgggaggcagagtttgcct

SEQ ID NO: 4878841 - DNA, 23 bp, Homo sapiens
agcgggcaggttctgcctgcttt

SEQ ID NO: 4878842 - DNA, 15 bp, Homo sapiens
agcggggacagctcc

SEQ ID NO: 4878843 - DNA, 17 bp, Homo sapiens
agcggggacagctcctt

SEQ ID NO: 4878844 - DNA, 19 bp, Homo sapiens
agcggggacagctccttct

SEQ ID NO: 4878845 - DNA, 22 bp, Homo sapiens
agcggggacagctccttctgtc

SEQ ID NO: 4878846 - DNA, 21 bp, Homo sapiens
agcggggccccagggctaccc

SEQ ID NO: 4878847 - DNA, 16 bp, Homo sapiens
agcggggtatgaagag

SEQ ID NO: 4878848 - DNA, 13 bp, Homo sapiens
agcgtaaaatggt

SEQ ID NO: 4878849 - DNA, 17 bp, Homo sapiens
agcgtccctagcagtga

SEQ ID NO: 4878850 - DNA, 15 bp, Homo sapiens
agcgtgagccactgc

SEQ ID NO: 4878851 - DNA, 18 bp, Homo sapiens
agcgtgtttacatgtgta

SEQ ID NO: 4878852 - DNA, 14 bp, Homo sapiens
agcgttttttaaat

SEQ ID NO: 4878853 - DNA, 18 bp, Homo sapiens
agcgttttttaaatgtat

SEQ ID NO: 4878854 - DNA, 17 bp, Homo sapiens
agctaaacggattccaa

SEQ ID NO: 4878855 - DNA, 22 bp, Homo sapiens
agctaacattttaaataaaaga

SEQ ID NO: 4878856 - DNA, 23 bp, Homo sapiens
agctaacattttaaataaaagaa

SEQ ID NO: 4878857 - DNA, 23 bp, Homo sapiens
agctaacccccttctactgagcc

SEQ ID NO: 4878858 - DNA, 10 bp, Homo sapiens
agctaaggct

SEQ ID NO: 4878859 - DNA, 21 bp, Homo sapiens
agctaagggtgggtgctcaga

SEQ ID NO: 4878860 - DNA, 23 bp, Homo sapiens
agctaagggtgggtgctcagaat

SEQ ID NO: 4878861 - DNA, 15 bp, Homo sapiens
agctaataatgttaa

SEQ ID NO: 4878862 - DNA, 22 bp, Homo sapiens
agctaataattcttcacctaag

SEQ ID NO: 4878863 - DNA, 16 bp, Homo sapiens
agctaatcagcattct

SEQ ID NO: 4878864 - DNA, 21 bp, Homo sapiens
agctaatcagcattctcactc

SEQ ID NO: 4878865 - DNA, 12 bp, Homo sapiens
agggaaggcctg

SEQ ID NO: 4878866 - DNA, 14 bp, Homo sapiens
agggaaggcctgac

SEQ ID NO: 4878867 - DNA, 16 bp, Homo sapiens
agggaaggcctgactt

SEQ ID NO: 4878868 - DNA, 23 bp, Homo sapiens
agggaataaaatcctaagacaca

SEQ ID NO: 4878869 - DNA, 18 bp, Homo sapiens
agggaatccccgaaggtg

SEQ ID NO: 4878870 - DNA, 22 bp, Homo sapiens
agggaatctaatatccccaaat

SEQ ID NO: 4878871 - DNA, 16 bp, Homo sapiens
agggaatttctatcta

SEQ ID NO: 4878872 - DNA, 22 bp, Homo sapiens
agggaatttctatctaaatgat

SEQ ID NO: 4878873 - DNA, 16 bp, Homo sapiens
agggaccaactgggcc

SEQ ID NO: 4878874 - DNA, 17 bp, Homo sapiens
agggaccaactgggccc

SEQ ID NO: 4878875 - DNA, 18 bp, Homo sapiens
agggaccacaccctgtac

SEQ ID NO: 4878876 - DNA, 14 bp, Homo sapiens
agggacgctttgtc

SEQ ID NO: 4878877 - DNA, 17 bp, Homo sapiens
agggacgctttgtctgt

SEQ ID NO: 4878878 - DNA, 21 bp, Homo sapiens
agggactctgaagcctctggg

SEQ ID NO: 4878879 - DNA, 23 bp, Homo sapiens
agggactgccagtccccctgccc

SEQ ID NO: 4878880 - DNA, 19 bp, Homo sapiens
agggacttggaagctccgc

SEQ ID NO: 4878881 - DNA, 16 bp, Homo sapiens
agggagcagggaaggc

SEQ ID NO: 4878882 - DNA, 18 bp, Homo sapiens
agggagcctttggttctg

SEQ ID NO: 4878883 - DNA, 13 bp, Homo sapiens
agggaggcagcct

SEQ ID NO: 4878884 - DNA, 17 bp, Homo sapiens
agggaggcagcctccag

SEQ ID NO: 4878885 - DNA, 17 bp, Homo sapiens
agggaggtcaggccctg

SEQ ID NO: 4878886 - DNA, 22 bp, Homo sapiens
agggaggtcaggccctggaact

SEQ ID NO: 4878887 - DNA, 17 bp, Homo sapiens
agggagtgctggctcac

SEQ ID NO: 4878888 - DNA, 15 bp, Homo sapiens
agggatgggcctggc

SEQ ID NO: 4878889 - DNA, 15 bp, Homo sapiens
agggattcaggctgc

SEQ ID NO: 4878890 - DNA, 20 bp, Homo sapiens
agggcacaagtcctggatgt

SEQ ID NO: 4878891 - DNA, 19 bp, Homo sapiens
agggcaggaaggagagcct

SEQ ID NO: 4878892 - DNA, 15 bp, Homo sapiens
agggcataaaacagc

SEQ ID NO: 4878893 - DNA, 14 bp, Homo sapiens
agggcatccatacc

SEQ ID NO: 4878894 - DNA, 22 bp, Homo sapiens
agggcatgccacgtgggctcat

SEQ ID NO: 4878895 - DNA, 20 bp, Homo sapiens
agggcatgccccggccacct

SEQ ID NO: 4878896 - DNA, 16 bp, Homo sapiens
agggcatgccttgtgc

SEQ ID NO: 4878897 - DNA, 12 bp, Homo sapiens
agggccaggcag

SEQ ID NO: 4878898 - DNA, 14 bp, Homo sapiens
agggccaggcaggt

SEQ ID NO: 4878899 - DNA, 13 bp, Homo sapiens
agggccagtcctg

SEQ ID NO: 4878900 - DNA, 23 bp, Homo sapiens
agggccagtcctgcctggccagg

SEQ ID NO: 4878901 - DNA, 17 bp, Homo sapiens
agggccagtggggcctg

SEQ ID NO: 4878902 - DNA, 23 bp, Homo sapiens
agggcccacttgtatcctctggt

SEQ ID NO: 4878903 - DNA, 12 bp, Homo sapiens
agggcccagaga

SEQ ID NO: 4878904 - DNA, 13 bp, Homo sapiens
agggcccagagag

SEQ ID NO: 4878905 - DNA, 18 bp, Homo sapiens
agggcccagagagggtgg

SEQ ID NO: 4878906 - DNA, 17 bp, Homo sapiens
agggcccagagcaggaa

SEQ ID NO: 4878907 - DNA, 18 bp, Homo sapiens
agggcccagagcaggaag

SEQ ID NO: 4878908 - DNA, 17 bp, Homo sapiens
agggcctgcctggcccc

SEQ ID NO: 4878909 - DNA, 17 bp, Homo sapiens
agggcctggggcctgag

SEQ ID NO: 4878910 - DNA, 21 bp, Homo sapiens
agggcctggggcctgagagaa

SEQ ID NO: 4878911 - DNA, 19 bp, Homo sapiens
agggctaccctcccccagg

SEQ ID NO: 4878912 - DNA, 20 bp, Homo sapiens
agggctcagcggggacagct

SEQ ID NO: 4878913 - DNA, 17 bp, Homo sapiens
agggctcctcccagctt

SEQ ID NO: 4878914 - DNA, 14 bp, Homo sapiens
agggctctgcccca

SEQ ID NO: 4878915 - DNA, 18 bp, Homo sapiens
agggctctgtgctgacat

SEQ ID NO: 4878916 - DNA, 23 bp, Homo sapiens
agggctgacctgcctctcacaca

SEQ ID NO: 4878917 - DNA, 16 bp, Homo sapiens
agggctgccctgagaa

SEQ ID NO: 4878918 - DNA, 18 bp, Homo sapiens
agggctggccccagggca

SEQ ID NO: 4878919 - DNA, 19 bp, Homo sapiens
agggctggccccagggcac

SEQ ID NO: 4878920 - DNA, 21 bp, Homo sapiens
agggctgggcaaggaaaaaga

SEQ ID NO: 4878921 - DNA, 22 bp, Homo sapiens
agggctgggcaaggaaaaagaa

SEQ ID NO: 4878922 - DNA, 18 bp, Homo sapiens
agggcttacctgtacact

SEQ ID NO: 4878923 - DNA, 15 bp, Homo sapiens
agggcttactatttc

SEQ ID NO: 4878924 - DNA, 13 bp, Homo sapiens
aggggaacctgcc

SEQ ID NO: 4878925 - DNA, 22 bp, Homo sapiens
aggggaagaaacactttctctt

SEQ ID NO: 4878926 - DNA, 20 bp, Homo sapiens
aggggaatgtttgcctctgc

SEQ ID NO: 4878927 - DNA, 21 bp, Homo sapiens
aggggaatgtttgcctctgcc

SEQ ID NO: 4878928 - DNA, 23 bp, Homo sapiens
aggggactctgggctatggacac

SEQ ID NO: 4878929 - DNA, 16 bp, Homo sapiens
aggggagtcaccttcc

SEQ ID NO: 4878930 - DNA, 16 bp, Homo sapiens
aggggagttgtgtctg

SEQ ID NO: 4878931 - DNA, 21 bp, Homo sapiens
aggggatatttaaggtagctt

SEQ ID NO: 4878932 - DNA, 19 bp, Homo sapiens
aggggatcataaagttaga

SEQ ID NO: 4878933 - DNA, 20 bp, Homo sapiens
aggggatcataaagttagaa

SEQ ID NO: 4878934 - DNA, 14 bp, Homo sapiens
aggggcatctgccc

SEQ ID NO: 4878935 - DNA, 19 bp, Homo sapiens
aggggcatctgcccctccc

SEQ ID NO: 4878936 - DNA, 21 bp, Homo sapiens
aggggcatctgcccctccccc

SEQ ID NO: 4878937 - DNA, 22 bp, Homo sapiens
aggggcccaaggcggcccctcc

SEQ ID NO: 4878938 - DNA, 18 bp, Homo sapiens
aggggcctggcagccgtg

SEQ ID NO: 4878939 - DNA, 18 bp, Homo sapiens
aggggctacaagagggaa

SEQ ID NO: 4878940 - DNA, 18 bp, Homo sapiens
agggggaagaagcagaga

SEQ ID NO: 4878941 - DNA, 19 bp, Homo sapiens
agggggaagaagcagagag

SEQ ID NO: 4878942 - DNA, 16 bp, Homo sapiens
agggggaggggaagtc

SEQ ID NO: 4878943 - DNA, 18 bp, Homo sapiens
agggggggctacattata

SEQ ID NO: 4878944 - DNA, 21 bp, Homo sapiens
aggggttggggtgacagtcat

SEQ ID NO: 4878945 - DNA, 19 bp, Homo sapiens
aggggtttgccatttgata

SEQ ID NO: 4878946 - DNA, 15 bp, Homo sapiens
agggtacagctgggc

SEQ ID NO: 4878947 - DNA, 14 bp, Homo sapiens
agggtcaatgctat

SEQ ID NO: 4878948 - DNA, 17 bp, Homo sapiens
agggtcctggctcctga

SEQ ID NO: 4878949 - DNA, 20 bp, Homo sapiens
agggtcctggctcctgaggg

SEQ ID NO: 4878950 - DNA, 20 bp, Homo sapiens
agggtcctttagtacctgaa

SEQ ID NO: 4878951 - DNA, 14 bp, Homo sapiens
agggtcgaaagctc

SEQ ID NO: 4878952 - DNA, 22 bp, Homo sapiens
agggtcgaaagctctagaatct

SEQ ID NO: 4878953 - DNA, 17 bp, Homo sapiens
agggtcggaacccaagc

SEQ ID NO: 4878954 - DNA, 21 bp, Homo sapiens
agggtctcactatgttgccca

SEQ ID NO: 4878955 - DNA, 22 bp, Homo sapiens
agggtctcactatgttgcccag

SEQ ID NO: 4878956 - DNA, 14 bp, Homo sapiens
agggtctcactctg

SEQ ID NO: 4878957 - DNA, 15 bp, Homo sapiens
agggtctcactctgt

SEQ ID NO: 4878958 - DNA, 16 bp, Homo sapiens
agggtctcactctgtc

SEQ ID NO: 4878959 - DNA, 15 bp, Homo sapiens
agggtctgtgtgaat

SEQ ID NO: 4878960 - DNA, 18 bp, Homo sapiens
agggtctgtgtgaatgtg

SEQ ID NO: 4878961 - DNA, 20 bp, Homo sapiens
agggtggacttagaaagcag

SEQ ID NO: 4878962 - DNA, 21 bp, Homo sapiens
agggtggacttagaaagcagg

SEQ ID NO: 4878963 - DNA, 19 bp, Homo sapiens
agggtgggggccacctgcc

SEQ ID NO: 4878964 - DNA, 18 bp, Homo sapiens
agggtgggtgctcagaat

SEQ ID NO: 4878965 - DNA, 17 bp, Homo sapiens
agggtggtgacctctgc

SEQ ID NO: 4878966 - DNA, 21 bp, Homo sapiens
agggtgttgggatactgcagg

SEQ ID NO: 4878967 - DNA, 16 bp, Homo sapiens
agggttgctggagcct

SEQ ID NO: 4878968 - DNA, 23 bp, Homo sapiens
agggttggcccctgcccggctgc

SEQ ID NO: 4878969 - DNA, 13 bp, Homo sapiens
agggttgggctgg

SEQ ID NO: 4878970 - DNA, 15 bp, Homo sapiens
agggttgggctggtg

SEQ ID NO: 4878971 - DNA, 17 bp, Homo sapiens
agggttgggctggtgtc

SEQ ID NO: 4878972 - DNA, 14 bp, Homo sapiens
agggtttgtggctg

SEQ ID NO: 4878973 - DNA, 23 bp, Homo sapiens
agggttttgccatgttggccagg

SEQ ID NO: 4878974 - DNA, 13 bp, Homo sapiens
aggtaacagaaca

SEQ ID NO: 4878975 - DNA, 13 bp, Homo sapiens
atgaagcagcttt

SEQ ID NO: 4878976 - DNA, 15 bp, Homo sapiens
atgaagcagctttaa

SEQ ID NO: 4878977 - DNA, 15 bp, Homo sapiens
atgaagcccaagtga

SEQ ID NO: 4878978 - DNA, 17 bp, Homo sapiens
atgaagcccaagtgaaa

SEQ ID NO: 4878979 - DNA, 17 bp, Homo sapiens
atgaaggcttttggtct

SEQ ID NO: 4878980 - DNA, 21 bp, Homo sapiens
atgaagtttaaaacagtattt

SEQ ID NO: 4878981 - DNA, 18 bp, Homo sapiens
atgaagtttgaacttcat

SEQ ID NO: 4878982 - DNA, 13 bp, Homo sapiens
atgaatacaaatt

SEQ ID NO: 4878983 - DNA, 14 bp, Homo sapiens
atgaatacaaattt

SEQ ID NO: 4878984 - DNA, 17 bp, Homo sapiens
atgaatatctattaata

SEQ ID NO: 4878985 - DNA, 19 bp, Homo sapiens
atgaatatctattaatata

SEQ ID NO: 4878986 - DNA, 12 bp, Homo sapiens
atgaatattttg

SEQ ID NO: 4878987 - DNA, 13 bp, Homo sapiens
atgaatattttga

SEQ ID NO: 4878988 - DNA, 21 bp, Homo sapiens
atgaatcccacccacatgtga

SEQ ID NO: 4878989 - DNA, 19 bp, Homo sapiens
atgaatgaggtcccaggca

SEQ ID NO: 4878990 - DNA, 15 bp, Homo sapiens
atgaatgaggtctgg

SEQ ID NO: 4878991 - DNA, 15 bp, Homo sapiens
atgaatgtatttatt

SEQ ID NO: 4878992 - DNA, 20 bp, Homo sapiens
atgaatgtatttatttggga

SEQ ID NO: 4878993 - DNA, 14 bp, Homo sapiens
atgaattaaataaa

SEQ ID NO: 4878994 - DNA, 16 bp, Homo sapiens
atgaattaaataaacc

SEQ ID NO: 4878995 - DNA, 17 bp, Homo sapiens
atgaattcttatgctta

SEQ ID NO: 4878996 - DNA, 13 bp, Homo sapiens
atgaatttaaata

SEQ ID NO: 4878997 - DNA, 16 bp, Homo sapiens
atgaatttaaatataa

SEQ ID NO: 4878998 - DNA, 13 bp, Homo sapiens
atgaattttacat

SEQ ID NO: 4878999 - DNA, 13 bp, Homo sapiens
atgacaagcattt

SEQ ID NO: 4879000 - DNA, 18 bp, Homo sapiens
atgacagcctctatccta

SEQ ID NO: 4879001 - DNA, 19 bp, Homo sapiens
atgacaggcctgaagatat

SEQ ID NO: 4879002 - DNA, 19 bp, Homo sapiens
atgacatctttttaaagct

SEQ ID NO: 4879003 - DNA, 16 bp, Homo sapiens
atgacatgcactgacc

SEQ ID NO: 4879004 - DNA, 15 bp, Homo sapiens
atgacatgttatata

SEQ ID NO: 4879005 - DNA, 16 bp, Homo sapiens
atgactatgtaaacta

SEQ ID NO: 4879006 - DNA, 23 bp, Homo sapiens
atgactgctccccagccctggct

SEQ ID NO: 4879007 - DNA, 23 bp, Homo sapiens
atgactttatatggatgattcag

SEQ ID NO: 4879008 - DNA, 13 bp, Homo sapiens
atgagaacaaagc

SEQ ID NO: 4879009 - DNA, 15 bp, Homo sapiens
atgagaacaaagctg

SEQ ID NO: 4879010 - DNA, 20 bp, Homo sapiens
atgagaacaaagctgttaaa

SEQ ID NO: 4879011 - DNA, 23 bp, Homo sapiens
atgagaacaaagctgttaaactg

SEQ ID NO: 4879012 - DNA, 16 bp, Homo sapiens
atgagaaggaacttcc

SEQ ID NO: 4879013 - DNA, 14 bp, Homo sapiens
atgagaatttctaa

SEQ ID NO: 4879014 - DNA, 22 bp, Homo sapiens
atgagacataggccatgaaaaa

SEQ ID NO: 4879015 - DNA, 13 bp, Homo sapiens
atgagagcccaga

SEQ ID NO: 4879016 - DNA, 20 bp, Homo sapiens
atgagagcccagaggtaaca

SEQ ID NO: 4879017 - DNA, 17 bp, Homo sapiens
atgagatctgaatgtgg

SEQ ID NO: 4879018 - DNA, 22 bp, Homo sapiens
atgagatgtgtggactgtggca

SEQ ID NO: 4879019 - DNA, 18 bp, Homo sapiens
atgagattgttttatcat

SEQ ID NO: 4879020 - DNA, 11 bp, Homo sapiens
atgagcccaga

SEQ ID NO: 4879021 - DNA, 18 bp, Homo sapiens
atgagcccagagaacagc

SEQ ID NO: 4879022 - DNA, 20 bp, Homo sapiens
atgagccgctgtgagcccct

SEQ ID NO: 4879023 - DNA, 14 bp, Homo sapiens
atgaggaataatta

SEQ ID NO: 4879024 - DNA, 13 bp, Homo sapiens
atgaggacatgtt

SEQ ID NO: 4879025 - DNA, 18 bp, Homo sapiens
atgaggcaacctgattgt

SEQ ID NO: 4879026 - DNA, 19 bp, Homo sapiens
atgaggcaacctgattgta

SEQ ID NO: 4879027 - DNA, 16 bp, Homo sapiens
atgagggatgggcctg

SEQ ID NO: 4879028 - DNA, 18 bp, Homo sapiens
atgagggatgggcctggc

SEQ ID NO: 4879029 - DNA, 15 bp, Homo sapiens
atgaggtcagagcct

SEQ ID NO: 4879030 - DNA, 16 bp, Homo sapiens
atgaggtcagagcctg

SEQ ID NO: 4879031 - DNA, 20 bp, Homo sapiens
atgaggtcagagcctgcagt

SEQ ID NO: 4879032 - DNA, 22 bp, Homo sapiens
atgaggtcagagcctgcagtta

SEQ ID NO: 4879033 - DNA, 17 bp, Homo sapiens
atgaggtcccaggcaga

SEQ ID NO: 4879034 - DNA, 13 bp, Homo sapiens
atgaggtctgttt

SEQ ID NO: 4879035 - DNA, 14 bp, Homo sapiens
atgaggtctgttta

SEQ ID NO: 4879036 - DNA, 21 bp, Homo sapiens
atgagtaaaaaaaaaaacaat

SEQ ID NO: 4879037 - DNA, 16 bp, Homo sapiens
atgagtacaaatgcct

SEQ ID NO: 4879038 - DNA, 14 bp, Homo sapiens
atgagtatacaata

SEQ ID NO: 4879039 - DNA, 16 bp, Homo sapiens
atgagtccttgaaaat

SEQ ID NO: 4879040 - DNA, 18 bp, Homo sapiens
atgagtccttgaaaatat

SEQ ID NO: 4879041 - DNA, 12 bp, Homo sapiens
atgagtctagat

SEQ ID NO: 4879042 - DNA, 13 bp, Homo sapiens
atgagtctagatg

SEQ ID NO: 4879043 - DNA, 12 bp, Homo sapiens
atgagtgtgcat

SEQ ID NO: 4879044 - DNA, 13 bp, Homo sapiens
atgagtgtgcatg

SEQ ID NO: 4879045 - DNA, 15 bp, Homo sapiens
atgagttgtgaaagt

SEQ ID NO: 4879046 - DNA, 14 bp, Homo sapiens
atcatcagggcctg

SEQ ID NO: 4879047 - DNA, 19 bp, Homo sapiens
atcatcatagtaaaagaaa

SEQ ID NO: 4879048 - DNA, 18 bp, Homo sapiens
atcatcatgcagctcaac

SEQ ID NO: 4879049 - DNA, 14 bp, Homo sapiens
atcatccagaagtt

SEQ ID NO: 4879050 - DNA, 23 bp, Homo sapiens
atcatcccatctaagctgcagct

SEQ ID NO: 4879051 - DNA, 18 bp, Homo sapiens
atcatctataaagaagaa

SEQ ID NO: 4879052 - DNA, 14 bp, Homo sapiens
atcatgaaatatgc

SEQ ID NO: 4879053 - DNA, 15 bp, Homo sapiens
atcatgaaatatgca

SEQ ID NO: 4879054 - DNA, 16 bp, Homo sapiens
atcatgaaatatgcat

SEQ ID NO: 4879055 - DNA, 16 bp, Homo sapiens
atcatgacatgttata

SEQ ID NO: 4879056 - DNA, 21 bp, Homo sapiens
atcatgcccggtcccacccct

SEQ ID NO: 4879057 - DNA, 14 bp, Homo sapiens
atcatgctttaaag

SEQ ID NO: 4879058 - DNA, 17 bp, Homo sapiens
atcatgctttaaagtgt

SEQ ID NO: 4879059 - DNA, 22 bp, Homo sapiens
atcatgctttaaagtgtaataa

SEQ ID NO: 4879060 - DNA, 20 bp, Homo sapiens
atcatggtgtaataagacat

SEQ ID NO: 4879061 - DNA, 23 bp, Homo sapiens
atcatggtgtaataagacataac

SEQ ID NO: 4879062 - DNA, 14 bp, Homo sapiens
atcatgtaaagaaa

SEQ ID NO: 4879063 - DNA, 17 bp, Homo sapiens
atcatgtaaagaaatgt

SEQ ID NO: 4879064 - DNA, 18 bp, Homo sapiens
atcatgtaaagaaatgtc

SEQ ID NO: 4879065 - DNA, 22 bp, Homo sapiens
atcattacccttccctgcacta

SEQ ID NO: 4879066 - DNA, 11 bp, Homo sapiens
atcattagaac

SEQ ID NO: 4879067 - DNA, 23 bp, Homo sapiens
atcattcacggagatatgaagag

SEQ ID NO: 4879068 - DNA, 20 bp, Homo sapiens
atcattggaacaactgatac

SEQ ID NO: 4879069 - DNA, 14 bp, Homo sapiens
atcattgttgcctc

SEQ ID NO: 4879070 - DNA, 15 bp, Homo sapiens
atcattgttttgaat

SEQ ID NO: 4879071 - DNA, 17 bp, Homo sapiens
atcatttattttaagca

SEQ ID NO: 4879072 - DNA, 19 bp, Homo sapiens
atcatttattttttacatt

SEQ ID NO: 4879073 - DNA, 20 bp, Homo sapiens
atccaaacatgtatttatgt

SEQ ID NO: 4879074 - DNA, 14 bp, Homo sapiens
atccaagctccctg

SEQ ID NO: 4879075 - DNA, 19 bp, Homo sapiens
atccaagctccctgcccca

SEQ ID NO: 4879076 - DNA, 16 bp, Homo sapiens
atccaatctcaaggaa

SEQ ID NO: 4879077 - DNA, 21 bp, Homo sapiens
atccaatgttagagacttttt

SEQ ID NO: 4879078 - DNA, 17 bp, Homo sapiens
atccaccacctccctca

SEQ ID NO: 4879079 - DNA, 13 bp, Homo sapiens
atccacccacctc

SEQ ID NO: 4879080 - DNA, 15 bp, Homo sapiens
atccacccacctcag

SEQ ID NO: 4879081 - DNA, 16 bp, Homo sapiens
atccacccacctcagc

SEQ ID NO: 4879082 - DNA, 20 bp, Homo sapiens
atccacccacctcagcctcc

SEQ ID NO: 4879083 - DNA, 16 bp, Homo sapiens
atctcatcaacaaaga

SEQ ID NO: 4879084 - DNA, 19 bp, Homo sapiens
atctccacagtcaaagaag

SEQ ID NO: 4879085 - DNA, 23 bp, Homo sapiens
atctccccttgcactaaagtatg

SEQ ID NO: 4879086 - DNA, 15 bp, Homo sapiens
atctcctgacagaag

SEQ ID NO: 4879087 - DNA, 19 bp, Homo sapiens
atctcctgtcttttcaggt

SEQ ID NO: 4879088 - DNA, 15 bp, Homo sapiens
atctctaatatggca

SEQ ID NO: 4879089 - DNA, 14 bp, Homo sapiens
atctctatttaata

SEQ ID NO: 4879090 - DNA, 17 bp, Homo sapiens
atctctatttaatattt

SEQ ID NO: 4879091 - DNA, 14 bp, Homo sapiens
atctctcaaatctg

SEQ ID NO: 4879092 - DNA, 16 bp, Homo sapiens
atctctcaaatctgtt

SEQ ID NO: 4879093 - DNA, 17 bp, Homo sapiens
atctctcaaatctgtta

SEQ ID NO: 4879094 - DNA, 19 bp, Homo sapiens
atctctctgcagctgccgg

SEQ ID NO: 4879095 - DNA, 11 bp, Homo sapiens
atctctgaaag

SEQ ID NO: 4879096 - DNA, 17 bp, Homo sapiens
atctctgaagcatgttt

SEQ ID NO: 4879097 - DNA, 19 bp, Homo sapiens
atctctgtgtgcacaaata

SEQ ID NO: 4879098 - DNA, 19 bp, Homo sapiens
atctctttcacattgtttg

SEQ ID NO: 4879099 - DNA, 15 bp, Homo sapiens
atctgagccagtgct

SEQ ID NO: 4879100 - DNA, 13 bp, Homo sapiens
atctgagttgcca

SEQ ID NO: 4879101 - DNA, 16 bp, Homo sapiens
atctgagttgccaaga

SEQ ID NO: 4879102 - DNA, 21 bp, Homo sapiens
atctgatttgcatattcattc

SEQ ID NO: 4879103 - DNA, 12 bp, Homo sapiens
atctgcaccctt

SEQ ID NO: 4879104 - DNA, 17 bp, Homo sapiens
atctgcacccttctttt

SEQ ID NO: 4879105 - DNA, 20 bp, Homo sapiens
atctgcagggggtgtgtctg

SEQ ID NO: 4879106 - DNA, 19 bp, Homo sapiens
atctgcattttcaccccac

SEQ ID NO: 4879107 - DNA, 23 bp, Homo sapiens
atctgcccacctcagcctcccaa

SEQ ID NO: 4879108 - DNA, 13 bp, Homo sapiens
atctgctcctccc

SEQ ID NO: 4879109 - DNA, 18 bp, Homo sapiens
atctgctggagtttcatg

SEQ ID NO: 4879110 - DNA, 23 bp, Homo sapiens
atctggaaacctctacatattta

SEQ ID NO: 4879111 - DNA, 21 bp, Homo sapiens
atctggaatctggagaccagg

SEQ ID NO: 4879112 - DNA, 15 bp, Homo sapiens
atctggactcctctg

SEQ ID NO: 4879113 - DNA, 20 bp, Homo sapiens
atctggccctcgacactcac

SEQ ID NO: 4879114 - DNA, 20 bp, Homo sapiens
atctggcctaaaatcttgga

SEQ ID NO: 4879115 - DNA, 15 bp, Homo sapiens
atctggcctggcctg

SEQ ID NO: 4879116 - DNA, 22 bp, Homo sapiens
atctggcctggcctggccctgc

SEQ ID NO: 4879117 - DNA, 19 bp, Homo sapiens
atctggctcctttacaaaa

SEQ ID NO: 4879118 - DNA, 16 bp, Homo sapiens
atctgggcctgggcta

SEQ ID NO: 4879119 - DNA, 21 bp, Homo sapiens
atctggtcttgttagaaaaca

SEQ ID NO: 4879120 - DNA, 14 bp, Homo sapiens
atctggtgatctcc

SEQ ID NO: 4879121 - DNA, 20 bp, Homo sapiens
atctgtacattttgttgtaa

SEQ ID NO: 4879122 - DNA, 21 bp, Homo sapiens
atctgtacattttgttgtaaa

SEQ ID NO: 4879123 - DNA, 22 bp, Homo sapiens
atctgtacattttgttgtaaaa

SEQ ID NO: 4879124 - DNA, 17 bp, Homo sapiens
atctgtcacaccagcca

SEQ ID NO: 4879125 - DNA, 21 bp, Homo sapiens
atctgtccaaaggaggctggc

SEQ ID NO: 4879126 - DNA, 14 bp, Homo sapiens
atctgtgatgggag

SEQ ID NO: 4879127 - DNA, 13 bp, Homo sapiens
atctgtgccccat

SEQ ID NO: 4879128 - DNA, 15 bp, Homo sapiens
atctgtgccccatgc

SEQ ID NO: 4879129 - DNA, 23 bp, Homo sapiens
atctgtgccccatgcctgtccag

SEQ ID NO: 4879130 - DNA, 20 bp, Homo sapiens
atctgtgtatattatttggc

SEQ ID NO: 4879131 - DNA, 15 bp, Homo sapiens
atctgtgtgaaaatg

SEQ ID NO: 4879132 - DNA, 21 bp, Homo sapiens
atctgtttaaagcatatagag

SEQ ID NO: 4879133 - DNA, 22 bp, Homo sapiens
atctgtttaaagcatatagaga

SEQ ID NO: 4879134 - DNA, 16 bp, Homo sapiens
atcttaatatatttga

SEQ ID NO: 4879135 - DNA, 13 bp, Homo sapiens
atcttagattctc

SEQ ID NO: 4879136 - DNA, 22 bp, Homo sapiens
atcttagattctctgtgtctaa

SEQ ID NO: 4879137 - DNA, 19 bp, Homo sapiens
atcttagcatagcttatta

SEQ ID NO: 4879138 - DNA, 17 bp, Homo sapiens
atcttatagcactttga

SEQ ID NO: 4879139 - DNA, 23 bp, Homo sapiens
atcttattttcatgtatatgtgt

SEQ ID NO: 4879140 - DNA, 19 bp, Homo sapiens
atcttcacatagttctcca

SEQ ID NO: 4879141 - DNA, 16 bp, Homo sapiens
atcttctcaagttcta

SEQ ID NO: 4879142 - DNA, 19 bp, Homo sapiens
atcttctcaagttctaaga

SEQ ID NO: 4879143 - DNA, 19 bp, Homo sapiens
atcttctgaaatgaaacaa

SEQ ID NO: 4879144 - DNA, 21 bp, Homo sapiens
atcttctgccttagtctcagt

SEQ ID NO: 4879145 - DNA, 17 bp, Homo sapiens
atcttcttatgcaattt

SEQ ID NO: 4879146 - DNA, 15 bp, Homo sapiens
atcttgaagggccca

SEQ ID NO: 4879147 - DNA, 13 bp, Homo sapiens
atcttgaatgtgg

SEQ ID NO: 4879148 - DNA, 14 bp, Homo sapiens
atcttgaatgtggt

SEQ ID NO: 4879149 - DNA, 19 bp, Homo sapiens
atcttgagtataagaaatg

SEQ ID NO: 4879150 - DNA, 17 bp, Homo sapiens
atcttgctctgctgaca

SEQ ID NO: 4879151 - DNA, 19 bp, Homo sapiens
atcttgctctgctgacaga

SEQ ID NO: 4879152 - DNA, 17 bp, Homo sapiens
atcttggagaccctgca

SEQ ID NO: 4879153 - DNA, 21 bp, Homo sapiens
atcttggatagctaataatga

SEQ ID NO: 4879154 - DNA, 17 bp, Homo sapiens
agtgttttaaattctga

SEQ ID NO: 4879155 - DNA, 17 bp, Homo sapiens
agtgttttaagaaatgt

SEQ ID NO: 4879156 - DNA, 19 bp, Homo sapiens
agtgttttaagaaatgtag

SEQ ID NO: 4879157 - DNA, 15 bp, Homo sapiens
agttaagagaaactt

SEQ ID NO: 4879158 - DNA, 20 bp, Homo sapiens
agttaatatatcccagaaat

SEQ ID NO: 4879159 - DNA, 21 bp, Homo sapiens
agttaatatatcccagaaatt

SEQ ID NO: 4879160 - DNA, 15 bp, Homo sapiens
agttaatttatctaa

SEQ ID NO: 4879161 - DNA, 17 bp, Homo sapiens
agttaccacacatctat

SEQ ID NO: 4879162 - DNA, 18 bp, Homo sapiens
agttagaatctattttct

SEQ ID NO: 4879163 - DNA, 13 bp, Homo sapiens
agttaggaaataa

SEQ ID NO: 4879164 - DNA, 17 bp, Homo sapiens
agttaggaaataaaacc

SEQ ID NO: 4879165 - DNA, 20 bp, Homo sapiens
agttaggaaataaaaccttt

SEQ ID NO: 4879166 - DNA, 22 bp, Homo sapiens
agttaggaaataaaacctttca

SEQ ID NO: 4879167 - DNA, 21 bp, Homo sapiens
agttataagtagcaggccaag

SEQ ID NO: 4879168 - DNA, 15 bp, Homo sapiens
agttatagatgtcta

SEQ ID NO: 4879169 - DNA, 20 bp, Homo sapiens
agttatataattcactcaag

SEQ ID NO: 4879170 - DNA, 19 bp, Homo sapiens
agttattcatattctgttg

SEQ ID NO: 4879171 - DNA, 22 bp, Homo sapiens
agttattcattctgtgatcatt

SEQ ID NO: 4879172 - DNA, 13 bp, Homo sapiens
agttattgtacag

SEQ ID NO: 4879173 - DNA, 18 bp, Homo sapiens
agttattgtacagctgtt

SEQ ID NO: 4879174 - DNA, 21 bp, Homo sapiens
agttattgtacagctgtttaa

SEQ ID NO: 4879175 - DNA, 23 bp, Homo sapiens
agttcaataaacttaactttaac

SEQ ID NO: 4879176 - DNA, 22 bp, Homo sapiens
agttcaatctcccgctgctgct

SEQ ID NO: 4879177 - DNA, 22 bp, Homo sapiens
agttcacaccctgcaaggccca

SEQ ID NO: 4879178 - DNA, 18 bp, Homo sapiens
agttcacattagaattag

SEQ ID NO: 4879179 - DNA, 21 bp, Homo sapiens
aggcaggtcttgaactcctgg

SEQ ID NO: 4879180 - DNA, 15 bp, Homo sapiens
aggcaggtgcctgga

SEQ ID NO: 4879181 - DNA, 11 bp, Homo sapiens
aggcagtctct

SEQ ID NO: 4879182 - DNA, 19 bp, Homo sapiens
aggcatcagtccctatgta

SEQ ID NO: 4879183 - DNA, 20 bp, Homo sapiens
aggcatcagtccctatgtat

SEQ ID NO: 4879184 - DNA, 21 bp, Homo sapiens
aggcatctctgtactttgctt

SEQ ID NO: 4879185 - DNA, 14 bp, Homo sapiens
aggcatgcctctga

SEQ ID NO: 4879186 - DNA, 15 bp, Homo sapiens
aggcatgcctctgat

SEQ ID NO: 4879187 - DNA, 12 bp, Homo sapiens
aggcatggccct

SEQ ID NO: 4879188 - DNA, 14 bp, Homo sapiens
aggcatggccctgg

SEQ ID NO: 4879189 - DNA, 19 bp, Homo sapiens
aggcatgggtgcaaggaaa

SEQ ID NO: 4879190 - DNA, 19 bp, Homo sapiens
aggcatgtaggaccctgca

SEQ ID NO: 4879191 - DNA, 12 bp, Homo sapiens
aggcatgttctc

SEQ ID NO: 4879192 - DNA, 19 bp, Homo sapiens
aggcattaacacaaaggag

SEQ ID NO: 4879193 - DNA, 13 bp, Homo sapiens
aggcattaatgtt

SEQ ID NO: 4879194 - DNA, 12 bp, Homo sapiens
aggccaaactgc

SEQ ID NO: 4879195 - DNA, 17 bp, Homo sapiens
aggccaaactgctggac

SEQ ID NO: 4879196 - DNA, 22 bp, Homo sapiens
aggccaaggggagtcaccttcc

SEQ ID NO: 4879197 - DNA, 23 bp, Homo sapiens
aggccaagtccgcagaagccctg

SEQ ID NO: 4879198 - DNA, 21 bp, Homo sapiens
aggccacatgggagcagtcca

SEQ ID NO: 4879199 - DNA, 14 bp, Homo sapiens
aggccagagggagt

SEQ ID NO: 4879200 - DNA, 20 bp, Homo sapiens
aggccagagggagtgacaga

SEQ ID NO: 4879201 - DNA, 19 bp, Homo sapiens
aggccagagtggcctggcc

SEQ ID NO: 4879202 - DNA, 20 bp, Homo sapiens
aggccagagtggcctggcca

SEQ ID NO: 4879203 - DNA, 16 bp, Homo sapiens
aggccataaaacaggt

SEQ ID NO: 4879204 - DNA, 13 bp, Homo sapiens
aggccatgaaaaa

SEQ ID NO: 4879205 - DNA, 12 bp, Homo sapiens
aggccatggctc

SEQ ID NO: 4879206 - DNA, 19 bp, Homo sapiens
aggcccacaggaggcaagc

SEQ ID NO: 4879207 - DNA, 16 bp, Homo sapiens
aggcccagcccctaga

SEQ ID NO: 4879208 - DNA, 17 bp, Homo sapiens
aggcccagcccctagaa

SEQ ID NO: 4879209 - DNA, 19 bp, Homo sapiens
aggcccagcccctagaaac

SEQ ID NO: 4879210 - DNA, 12 bp, Homo sapiens
aggcccctgcca

SEQ ID NO: 4879211 - DNA, 13 bp, Homo sapiens
aggcccctgccac

SEQ ID NO: 4879212 - DNA, 17 bp, Homo sapiens
aggcccctgccaccctg

SEQ ID NO: 4879213 - DNA, 18 bp, Homo sapiens
aggcccctgccaccctgg

SEQ ID NO: 4879214 - DNA, 21 bp, Homo sapiens
aggcccctgccaccctgggga

SEQ ID NO: 4879215 - DNA, 14 bp, Homo sapiens
aggcccggctccag

SEQ ID NO: 4879216 - DNA, 16 bp, Homo sapiens
aggcccggctccaggc

SEQ ID NO: 4879217 - DNA, 20 bp, Homo sapiens
aggcccggctccaggctcct

SEQ ID NO: 4879218 - DNA, 21 bp, Homo sapiens
aggcccggctccaggctcctt

SEQ ID NO: 4879219 - DNA, 13 bp, Homo sapiens
aggccctgcagtg

SEQ ID NO: 4879220 - DNA, 12 bp, Homo sapiens
aggccctgctcc

SEQ ID NO: 4879221 - DNA, 16 bp, Homo sapiens
aggccctgctcctgca

SEQ ID NO: 4879222 - DNA, 17 bp, Homo sapiens
aggccctgctcctgcag

SEQ ID NO: 4879223 - DNA, 19 bp, Homo sapiens
aggccctgctcctgcagca

SEQ ID NO: 4879224 - DNA, 10 bp, Homo sapiens
aggccctggc

SEQ ID NO: 4879225 - DNA, 14 bp, Homo sapiens
aggccctgtctgta

SEQ ID NO: 4879226 - DNA, 16 bp, Homo sapiens
aggcccttattttcaa

SEQ ID NO: 4879227 - DNA, 22 bp, Homo sapiens
aggcccttattttcaagaaact

SEQ ID NO: 4879228 - DNA, 18 bp, Homo sapiens
aggcccttcctctccact

SEQ ID NO: 4879229 - DNA, 24 bp, Homo sapiens
aggccctttgaagcctcagctacc

SEQ ID NO: 4879230 - DNA, 16 bp, Homo sapiens
aggccgcgccctttcc

SEQ ID NO: 4879231 - DNA, 16 bp, Homo sapiens
aggccggccagcctca

SEQ ID NO: 4879232 - DNA, 21 bp, Homo sapiens
aggccgggccgaatcccctcc

SEQ ID NO: 4879233 - DNA, 15 bp, Homo sapiens
aggcctaggattcta

SEQ ID NO: 4879234 - DNA, 16 bp, Homo sapiens
aggcctaggattctaa

SEQ ID NO: 4879235 - DNA, 17 bp, Homo sapiens
aggcctaggattctaaa

SEQ ID NO: 4879236 - DNA, 19 bp, Homo sapiens
aggcctcacctctacccaa

SEQ ID NO: 4879237 - DNA, 14 bp, Homo sapiens
aggcctctgtgtcc

SEQ ID NO: 4879238 - DNA, 15 bp, Homo sapiens
aggcctctgtgtcct

SEQ ID NO: 4879239 - DNA, 15 bp, Homo sapiens
aggcctcttggagac

SEQ ID NO: 4879240 - DNA, 16 bp, Homo sapiens
aggcctgacttctgct

SEQ ID NO: 4879241 - DNA, 17 bp, Homo sapiens
aggcctgacttctgctg

SEQ ID NO: 4879242 - DNA, 13 bp, Homo sapiens
aggcctgcacaca

SEQ ID NO: 4879243 - DNA, 15 bp, Homo sapiens
aggcctggccagatg

SEQ ID NO: 4879244 - DNA, 21 bp, Homo sapiens
aggcctggccagatgcaccag

SEQ ID NO: 4879245 - DNA, 19 bp, Homo sapiens
aggccttcctctctccaga

SEQ ID NO: 4879246 - DNA, 16 bp, Homo sapiens
aggccttttaacattt

SEQ ID NO: 4879247 - DNA, 23 bp, Homo sapiens
aggcgagagaggagccagacaga

SEQ ID NO: 4879248 - DNA, 23 bp, Homo sapiens
aggcgatccacctgtctcagcct

SEQ ID NO: 4879249 - DNA, 12 bp, Homo sapiens
aggcggcccctc

SEQ ID NO: 4879250 - DNA, 14 bp, Homo sapiens
aggcggcccctccc

SEQ ID NO: 4879251 - DNA, 14 bp, Homo sapiens
aggcgggaggaggt

SEQ ID NO: 4879252 - DNA, 20 bp, Homo sapiens
aggcgggaggaggtgtgagg

SEQ ID NO: 4879253 - DNA, 22 bp, Homo sapiens
aggctagtccggacccacctca

SEQ ID NO: 4879254 - DNA, 18 bp, Homo sapiens
aggctattattttcactg

SEQ ID NO: 4879255 - DNA, 13 bp, Homo sapiens
aggctcagagatg

SEQ ID NO: 4879256 - DNA, 14 bp, Homo sapiens
aggctcagagatgt

SEQ ID NO: 4879257 - DNA, 21 bp, Homo sapiens
aggctcagagatgtgcaccca

SEQ ID NO: 4879258 - DNA, 24 bp, Homo sapiens
aggctcagagatgtgcacccatgg

SEQ ID NO: 4879259 - DNA, 13 bp, Homo sapiens
aggctcaggccat

SEQ ID NO: 4879260 - DNA, 19 bp, Homo sapiens
aggctcctttagcgcccag

SEQ ID NO: 4879261 - DNA, 16 bp, Homo sapiens
aggctctgagagtcta

SEQ ID NO: 4879262 - DNA, 22 bp, Homo sapiens
aggctctgagagtctagattct

SEQ ID NO: 4879263 - DNA, 11 bp, Homo sapiens
aggctgagcca

SEQ ID NO: 4879264 - DNA, 11 bp, Homo sapiens
aggctgaggac

SEQ ID NO: 4879265 - DNA, 13 bp, Homo sapiens
aggctgaggactt

SEQ ID NO: 4879266 - DNA, 14 bp, Homo sapiens
aggctgaggcagga

SEQ ID NO: 4879267 - DNA, 17 bp, Homo sapiens
aggctgagttttctctt

SEQ ID NO: 4879268 - DNA, 17 bp, Homo sapiens
aggctgcagctggacag

SEQ ID NO: 4879269 - DNA, 21 bp, Homo sapiens
aggctgcagctggacagaggg

SEQ ID NO: 4879270 - DNA, 12 bp, Homo sapiens
aggctgcccccg

SEQ ID NO: 4879271 - DNA, 17 bp, Homo sapiens
aggctggacatgctgac

SEQ ID NO: 4879272 - DNA, 18 bp, Homo sapiens
aggctggacatgctgact

SEQ ID NO: 4879273 - DNA, 21 bp, Homo sapiens
aggctgggcttcagtggcagc

SEQ ID NO: 4879274 - DNA, 22 bp, Homo sapiens
aggctgggcttcagtggcagct

SEQ ID NO: 4879275 - DNA, 23 bp, Homo sapiens
aggctgtatcccatgagcctcag

SEQ ID NO: 4879276 - DNA, 18 bp, Homo sapiens
aggctgtgcagcgcagct

SEQ ID NO: 4879277 - DNA, 16 bp, Homo sapiens
aggctgttctgcactg

SEQ ID NO: 4879278 - DNA, 20 bp, Homo sapiens
aggctgttctgcactgaaaa

SEQ ID NO: 4879279 - DNA, 21 bp, Homo sapiens
aggctgttctgcactgaaaag

SEQ ID NO: 4879280 - DNA, 21 bp, Homo sapiens
aggcttatattcaaccatgga

SEQ ID NO: 4879281 - DNA, 21 bp, Homo sapiens
aggcttcctgcaattttctaa

SEQ ID NO: 4879282 - DNA, 22 bp, Homo sapiens
aggcttcctgcaattttctaag

SEQ ID NO: 4879283 - DNA, 22 bp, Homo sapiens
aggcttctccaattctgcccaa

SEQ ID NO: 4879284 - DNA, 16 bp, Homo sapiens
aggcttctctgttcta

SEQ ID NO: 4879285 - DNA, 13 bp, Homo sapiens
aggcttgaagctg

SEQ ID NO: 4879286 - DNA, 23 bp, Homo sapiens
aggctttatgataatagattctc

SEQ ID NO: 4879287 - DNA, 16 bp, Homo sapiens
aggctttgtgttgtaa

SEQ ID NO: 4879288 - DNA, 18 bp, Homo sapiens
aggctttgtgttgtaatt

SEQ ID NO: 4879289 - DNA, 23 bp, Homo sapiens
agggaaatagctaataatgttaa

SEQ ID NO: 4879290 - DNA, 22 bp, Homo sapiens
agtcatttattttaaaaaatga

SEQ ID NO: 4879291 - DNA, 21 bp, Homo sapiens
agtccaaaaagctcctggggc

SEQ ID NO: 4879292 - DNA, 19 bp, Homo sapiens
agtccaaatgtcctccaga

SEQ ID NO: 4879293 - DNA, 14 bp, Homo sapiens
agtccaagaatcca

SEQ ID NO: 4879294 - DNA, 16 bp, Homo sapiens
agtccaaggtttaaag

SEQ ID NO: 4879295 - DNA, 13 bp, Homo sapiens
agtccaggcacag

SEQ ID NO: 4879296 - DNA, 17 bp, Homo sapiens
agtccagtgacctgctg

SEQ ID NO: 4879297 - DNA, 21 bp, Homo sapiens
agtccatgcatgacagcctct

SEQ ID NO: 4879298 - DNA, 22 bp, Homo sapiens
agtccatgcatgacagcctcta

SEQ ID NO: 4879299 - DNA, 12 bp, Homo sapiens
agtccatttata

SEQ ID NO: 4879300 - DNA, 20 bp, Homo sapiens
agtccatttatatatgaaaa

SEQ ID NO: 4879301 - DNA, 22 bp, Homo sapiens
agtccatttatatatgaaaact

SEQ ID NO: 4879302 - DNA, 14 bp, Homo sapiens
agtcccaaggaaag

SEQ ID NO: 4879303 - DNA, 20 bp, Homo sapiens
agtcccaaggaaagccccag

SEQ ID NO: 4879304 - DNA, 18 bp, Homo sapiens
agtcccaccttggctgca

SEQ ID NO: 4879305 - DNA, 18 bp, Homo sapiens
agtcccccagagatgtca

SEQ ID NO: 4879306 - DNA, 18 bp, Homo sapiens
agtccccctatccttggc

SEQ ID NO: 4879307 - DNA, 16 bp, Homo sapiens
agtcccctcacctcct

SEQ ID NO: 4879308 - DNA, 23 bp, Homo sapiens
agtccgaaagggacttggaagct

SEQ ID NO: 4879309 - DNA, 17 bp, Homo sapiens
agtccgcagaagccctg

SEQ ID NO: 4879310 - DNA, 22 bp, Homo sapiens
agtccggacccacctcaccccg

SEQ ID NO: 4879311 - DNA, 16 bp, Homo sapiens
agtcctcactcccagt

SEQ ID NO: 4879312 - DNA, 18 bp, Homo sapiens
agtcctcactcccagtcc

SEQ ID NO: 4879313 - DNA, 13 bp, Homo sapiens
agtcctcccctca

SEQ ID NO: 4879314 - DNA, 14 bp, Homo sapiens
agtcctcccctcac

SEQ ID NO: 4879315 - DNA, 20 bp, Homo sapiens
agtcctcccctcacagcctc

SEQ ID NO: 4879316 - DNA, 23 bp, Homo sapiens
agtcctcccctcacagcctctga

SEQ ID NO: 4879317 - DNA, 22 bp, Homo sapiens
agtcctcttttctgagaggact

SEQ ID NO: 4879318 - DNA, 14 bp, Homo sapiens
agtcctgcctggcc

SEQ ID NO: 4879319 - DNA, 15 bp, Homo sapiens
agtcctgcctggcca

SEQ ID NO: 4879320 - DNA, 13 bp, Homo sapiens
agtcctgtgaatt

SEQ ID NO: 4879321 - DNA, 16 bp, Homo sapiens
agtcctgtgaatttct

SEQ ID NO: 4879322 - DNA, 15 bp, Homo sapiens
agtcctgtgctgaat

SEQ ID NO: 4879323 - DNA, 16 bp, Homo sapiens
agtccttgaaaatatt

SEQ ID NO: 4879324 - DNA, 17 bp, Homo sapiens
agtcctttatgtggaaa

SEQ ID NO: 4879325 - DNA, 16 bp, Homo sapiens
agtcctttttttccat

SEQ ID NO: 4879326 - DNA, 21 bp, Homo sapiens
agtcctttttttccatcttta

SEQ ID NO: 4879327 - DNA, 21 bp, Homo sapiens
agtctaaagatggagtttcta

SEQ ID NO: 4879328 - DNA, 18 bp, Homo sapiens
agtctagattcaaaggtt

SEQ ID NO: 4879329 - DNA, 21 bp, Homo sapiens
agtctagattcaaaggttcta

SEQ ID NO: 4879330 - DNA, 20 bp, Homo sapiens
agtctagattctctggctgt

SEQ ID NO: 4879331 - DNA, 16 bp, Homo sapiens
agtctagcactcattt

SEQ ID NO: 4879332 - DNA, 20 bp, Homo sapiens
agtctagcactcattttcta

SEQ ID NO: 4879333 - DNA, 19 bp, Homo sapiens
agtctcactttgtcgccca

SEQ ID NO: 4879334 - DNA, 10 bp, Homo sapiens
agtctcagtt

SEQ ID NO: 4879335 - DNA, 20 bp, Homo sapiens
agtctcagtttgtgtgtctt

SEQ ID NO: 4879336 - DNA, 21 bp, Homo sapiens
agtctcagtttgtgtgtctta

SEQ ID NO: 4879337 - DNA, 12 bp, Homo sapiens
agtctcccttct

SEQ ID NO: 4879338 - DNA, 13 bp, Homo sapiens
agtctcctcttta

SEQ ID NO: 4879339 - DNA, 14 bp, Homo sapiens
agtctcctctttaa

SEQ ID NO: 4879340 - DNA, 11 bp, Homo sapiens
agtctctcctg

SEQ ID NO: 4879341 - DNA, 13 bp, Homo sapiens
agtctctcctgta

SEQ ID NO: 4879342 - DNA, 17 bp, Homo sapiens
agtctctcttaaagttg

SEQ ID NO: 4879343 - DNA, 23 bp, Homo sapiens
agtctctcttaaagttggaattt

SEQ ID NO: 4879344 - DNA, 13 bp, Homo sapiens
agtctcttctcca

SEQ ID NO: 4879345 - DNA, 14 bp, Homo sapiens
agtctcttctccac

SEQ ID NO: 4879346 - DNA, 16 bp, Homo sapiens
agtctcttctccactg

SEQ ID NO: 4879347 - DNA, 21 bp, Homo sapiens
agtctcttctccactggatgg

SEQ ID NO: 4879348 - DNA, 20 bp, Homo sapiens
agtctgattcccaagctctg

SEQ ID NO: 4879349 - DNA, 21 bp, Homo sapiens
agtctgggacacaaaactccg

SEQ ID NO: 4879350 - DNA, 15 bp, Homo sapiens
agtctgtcctgtgac

SEQ ID NO: 4879351 - DNA, 22 bp, Homo sapiens
agtctgtgtgatgaactttctc

SEQ ID NO: 4879352 - DNA, 13 bp, Homo sapiens
agtctgttgtgtg

SEQ ID NO: 4879353 - DNA, 17 bp, Homo sapiens
agtcttctgacaaactg

SEQ ID NO: 4879354 - DNA, 19 bp, Homo sapiens
agtcttctgacaaactgtg

SEQ ID NO: 4879355 - DNA, 17 bp, Homo sapiens
agtcttggtttctctct

SEQ ID NO: 4879356 - DNA, 12 bp, Homo sapiens
agtcttgtgctt

SEQ ID NO: 4879357 - DNA, 20 bp, Homo sapiens
agtctttcttagtgcctgtg

SEQ ID NO: 4879358 - DNA, 14 bp, Homo sapiens
agtctttttctgtt

SEQ ID NO: 4879359 - DNA, 19 bp, Homo sapiens
agtctttttctgttgtaac

SEQ ID NO: 4879360 - DNA, 21 bp, Homo sapiens
agtctttttctgttgtaactt

SEQ ID NO: 4879361 - DNA, 19 bp, Homo sapiens
agtgaaataacaaaatgga

SEQ ID NO: 4879362 - DNA, 14 bp, Homo sapiens
agtgaaataataga

SEQ ID NO: 4879363 - DNA, 19 bp, Homo sapiens
agtgaactatttctacaca

SEQ ID NO: 4879364 - DNA, 22 bp, Homo sapiens
agtgaagccagctgcaggaatc

SEQ ID NO: 4879365 - DNA, 16 bp, Homo sapiens
agtgaataaacttcag

SEQ ID NO: 4879366 - DNA, 17 bp, Homo sapiens
agtgaataaacttcagc

SEQ ID NO: 4879367 - DNA, 13 bp, Homo sapiens
agtgacaaaccat

SEQ ID NO: 4879368 - DNA, 14 bp, Homo sapiens
agtgacagaggcag

SEQ ID NO: 4879369 - DNA, 20 bp, Homo sapiens
agtgacagtggattgcattt

SEQ ID NO: 4879370 - DNA, 14 bp, Homo sapiens
agtgacccctgcct

SEQ ID NO: 4879371 - DNA, 13 bp, Homo sapiens
agtgacccttccc

SEQ ID NO: 4879372 - DNA, 16 bp, Homo sapiens
agtgactgtatctgtg

SEQ ID NO: 4879373 - DNA, 14 bp, Homo sapiens
agtgagaaaaagct

SEQ ID NO: 4879374 - DNA, 19 bp, Homo sapiens
agtgagaaaaagctcctgt

SEQ ID NO: 4879375 - DNA, 16 bp, Homo sapiens
agtgagactctgtctc

SEQ ID NO: 4879376 - DNA, 17 bp, Homo sapiens
agtgagactctgtctca

SEQ ID NO: 4879377 - DNA, 22 bp, Homo sapiens
agtgagagagatgggagctcct

SEQ ID NO: 4879378 - DNA, 14 bp, Homo sapiens
agtgagcactaagg

SEQ ID NO: 4879379 - DNA, 21 bp, Homo sapiens
cactggtggcccgacagcctg

SEQ ID NO: 4879380 - DNA, 23 bp, Homo sapiens
cactggtggcccgacagcctggc

SEQ ID NO: 4879381 - DNA, 14 bp, Homo sapiens
cactgtagttctaa

SEQ ID NO: 4879382 - DNA, 17 bp, Homo sapiens
cactgtagttctaagac

SEQ ID NO: 4879383 - DNA, 18 bp, Homo sapiens
cactgtagttctaagact

SEQ ID NO: 4879384 - DNA, 19 bp, Homo sapiens
cactgtataaataggagag

SEQ ID NO: 4879385 - DNA, 21 bp, Homo sapiens
cactgtataaataggagagga

SEQ ID NO: 4879386 - DNA, 23 bp, Homo sapiens
cactgtataaataggagaggatg

SEQ ID NO: 4879387 - DNA, 17 bp, Homo sapiens
cactgtatttgtatctc

SEQ ID NO: 4879388 - DNA, 22 bp, Homo sapiens
cactgtgcccagcccggacctt

SEQ ID NO: 4879389 - DNA, 20 bp, Homo sapiens
cactgtggaactaataaata

SEQ ID NO: 4879390 - DNA, 14 bp, Homo sapiens
cactgttgaaaatt

SEQ ID NO: 4879391 - DNA, 21 bp, Homo sapiens
cactgttgaaaattattttaa

SEQ ID NO: 4879392 - DNA, 16 bp, Homo sapiens
cactgttgcccaggct

SEQ ID NO: 4879393 - DNA, 21 bp, Homo sapiens
cactgtttaagtactgtttac

SEQ ID NO: 4879394 - DNA, 19 bp, Homo sapiens
cactgtttctcttgagctg

SEQ ID NO: 4879395 - DNA, 21 bp, Homo sapiens
cactgtttctcttgagctggc

SEQ ID NO: 4879396 - DNA, 19 bp, Homo sapiens
cactgtttcttgcttgtac

SEQ ID NO: 4879397 - DNA, 19 bp, Homo sapiens
cacttagaaattgcatttc

SEQ ID NO: 4879398 - DNA, 20 bp, Homo sapiens
cacttagaaattgcatttcc

SEQ ID NO: 4879399 - DNA, 15 bp, Homo sapiens
cacttcaatgcacat

SEQ ID NO: 4879400 - DNA, 16 bp, Homo sapiens
cacttcattgagagtt

SEQ ID NO: 4879401 - DNA, 19 bp, Homo sapiens
cacttccaaaattcttatt

SEQ ID NO: 4879402 - DNA, 20 bp, Homo sapiens
cacttccaggggaacctgcc

SEQ ID NO: 4879403 - DNA, 21 bp, Homo sapiens
cacttcggccaggtcacacga

SEQ ID NO: 4879404 - DNA, 23 bp, Homo sapiens
cacttcggccaggtcacacgacc

SEQ ID NO: 4879405 - DNA, 21 bp, Homo sapiens
cacttctcttaaacttgtgaa

SEQ ID NO: 4879406 - DNA, 20 bp, Homo sapiens
cacttctgtgagacccccac

SEQ ID NO: 4879407 - DNA, 13 bp, Homo sapiens
cacttcttccttt

SEQ ID NO: 4879408 - DNA, 19 bp, Homo sapiens
cacttcttcctttctcttt

SEQ ID NO: 4879409 - DNA, 19 bp, Homo sapiens
cagagaaagtacttctcca

SEQ ID NO: 4879410 - DNA, 23 bp, Homo sapiens
cagagaaagtacttctccaccct

SEQ ID NO: 4879411 - DNA, 19 bp, Homo sapiens
cagagaagcggatttccag

SEQ ID NO: 4879412 - DNA, 22 bp, Homo sapiens
cagagaagggcataaaacagct

SEQ ID NO: 4879413 - DNA, 21 bp, Homo sapiens
cagagaagggctcctgcaggc

SEQ ID NO: 4879414 - DNA, 18 bp, Homo sapiens
cagagaatatcaagatga

SEQ ID NO: 4879415 - DNA, 15 bp, Homo sapiens
cagagaccctctgcc

SEQ ID NO: 4879416 - DNA, 19 bp, Homo sapiens
cagagaccctctgccacca

SEQ ID NO: 4879417 - DNA, 20 bp, Homo sapiens
cagagaccctctgccaccag

SEQ ID NO: 4879418 - DNA, 17 bp, Homo sapiens
cagagaccgtcctcacc

SEQ ID NO: 4879419 - DNA, 14 bp, Homo sapiens
cagagactttgtag

SEQ ID NO: 4879420 - DNA, 13 bp, Homo sapiens
cagagagagagaa

SEQ ID NO: 4879421 - DNA, 20 bp, Homo sapiens
cagagagcaactctgagatc

SEQ ID NO: 4879422 - DNA, 15 bp, Homo sapiens
cagagagccattttg

SEQ ID NO: 4879423 - DNA, 20 bp, Homo sapiens
cagagagccattttgtgaat

SEQ ID NO: 4879424 - DNA, 21 bp, Homo sapiens
cagagagccattttgtgaatg

SEQ ID NO: 4879425 - DNA, 21 bp, Homo sapiens
cagagagggagagcagagaaa

SEQ ID NO: 4879426 - DNA, 12 bp, Homo sapiens
cagagagggtgg

SEQ ID NO: 4879427 - DNA, 20 bp, Homo sapiens
cagagagggtggtgacctct

SEQ ID NO: 4879428 - DNA, 14 bp, Homo sapiens
cagagagtggctcc

SEQ ID NO: 4879429 - DNA, 18 bp, Homo sapiens
cagagagtggctcctccc

SEQ ID NO: 4879430 - DNA, 23 bp, Homo sapiens
cagagatgtcatcagagctcctc

SEQ ID NO: 4879431 - DNA, 14 bp, Homo sapiens
cagagatgtgcacc

SEQ ID NO: 4879432 - DNA, 16 bp, Homo sapiens
cagagatgtgcaccca

SEQ ID NO: 4879433 - DNA, 17 bp, Homo sapiens
cagagattgaactccaa

SEQ ID NO: 4879434 - DNA, 19 bp, Homo sapiens
cagagattgaactccaaga

SEQ ID NO: 4879435 - DNA, 15 bp, Homo sapiens
cagagattgcttctc

SEQ ID NO: 4879436 - DNA, 22 bp, Homo sapiens
cagagcaacgaccagggccgag

SEQ ID NO: 4879437 - DNA, 20 bp, Homo sapiens
cagagcacctttgcacagga

SEQ ID NO: 4879438 - DNA, 23 bp, Homo sapiens
cagagcacctttgcacaggatgc

SEQ ID NO: 4879439 - DNA, 15 bp, Homo sapiens
cagagcagatgcaga

SEQ ID NO: 4879440 - DNA, 21 bp, Homo sapiens
cagagcagatgcagagagcca

SEQ ID NO: 4879441 - DNA, 14 bp, Homo sapiens
cagagcaggacctc

SEQ ID NO: 4879442 - DNA, 15 bp, Homo sapiens
cagagcaggacctcc

SEQ ID NO: 4879443 - DNA, 22 bp, Homo sapiens
cagagcaggacctcccttccga

SEQ ID NO: 4879444 - DNA, 20 bp, Homo sapiens
cagagcccaccttggctcaa

SEQ ID NO: 4879445 - DNA, 16 bp, Homo sapiens
cagagcccctacagca

SEQ ID NO: 4879446 - DNA, 12 bp, Homo sapiens
cagagcctgcag

SEQ ID NO: 4879447 - DNA, 13 bp, Homo sapiens
cagagcctgcagt

SEQ ID NO: 4879448 - DNA, 13 bp, Homo sapiens
cagagctcctctg

SEQ ID NO: 4879449 - DNA, 23 bp, Homo sapiens
cagagctgggaggcatggccctg

SEQ ID NO: 4879450 - DNA, 18 bp, Homo sapiens
cagaggaaatctgtaaca

SEQ ID NO: 4879451 - DNA, 20 bp, Homo sapiens
cagaggaactgtccagagag

SEQ ID NO: 4879452 - DNA, 19 bp, Homo sapiens
cagaggaatcctggcagcc

SEQ ID NO: 4879453 - DNA, 22 bp, Homo sapiens
cagaggaatcctggcagcccag

SEQ ID NO: 4879454 - DNA, 17 bp, Homo sapiens
cagaggaatttatacct

SEQ ID NO: 4879455 - DNA, 14 bp, Homo sapiens
cagaggacctgtat

SEQ ID NO: 4879456 - DNA, 22 bp, Homo sapiens
cagaggacctgtatttaagcaa

SEQ ID NO: 4879457 - DNA, 13 bp, Homo sapiens
cagaggcagcccc

SEQ ID NO: 4879458 - DNA, 14 bp, Homo sapiens
cagaggcagcccca

SEQ ID NO: 4879459 - DNA, 15 bp, Homo sapiens
cagaggcagccccat

SEQ ID NO: 4879460 - DNA, 19 bp, Homo sapiens
cagaggcagccccattctg

SEQ ID NO: 4879461 - DNA, 14 bp, Homo sapiens
cagaggccatggca

SEQ ID NO: 4879462 - DNA, 16 bp, Homo sapiens
cagaggccatgggcct

SEQ ID NO: 4879463 - DNA, 19 bp, Homo sapiens
cagaggccatgggcctcct

SEQ ID NO: 4879464 - DNA, 13 bp, Homo sapiens
cagaggcctgccc

SEQ ID NO: 4879465 - DNA, 22 bp, Homo sapiens
cagagggagtgacagaggcagc

SEQ ID NO: 4879466 - DNA, 23 bp, Homo sapiens
cagagggagtgacagaggcagcc

SEQ ID NO: 4879467 - DNA, 14 bp, Homo sapiens
cagaggtaacagaa

SEQ ID NO: 4879468 - DNA, 19 bp, Homo sapiens
cagaggtaacagaacagct

SEQ ID NO: 4879469 - DNA, 18 bp, Homo sapiens
cagaggtagggctgccac

SEQ ID NO: 4879470 - DNA, 19 bp, Homo sapiens
cagaggtcagactaagaaa

SEQ ID NO: 4879471 - DNA, 17 bp, Homo sapiens
cagaggtccagcccatc

SEQ ID NO: 4879472 - DNA, 21 bp, Homo sapiens
cagaggtggccagagctggga

SEQ ID NO: 4879473 - DNA, 13 bp, Homo sapiens
cagagtctcactg

SEQ ID NO: 4879474 - DNA, 19 bp, Homo sapiens
cagagtctcactgttgccc

SEQ ID NO: 4879475 - DNA, 22 bp, Homo sapiens
cagagtctcactgttgcccagg

SEQ ID NO: 4879476 - DNA, 23 bp, Homo sapiens
cagagtctcactgttgcccaggc

SEQ ID NO: 4879477 - DNA, 19 bp, Homo sapiens
cagagtgagactctgtctc

SEQ ID NO: 4879478 - DNA, 17 bp, Homo sapiens
cagagtgcacagctgtc

SEQ ID NO: 4879479 - DNA, 17 bp, Homo sapiens
cagagtggcctggccag

SEQ ID NO: 4879480 - DNA, 18 bp, Homo sapiens
cagagtggcctggccagg

SEQ ID NO: 4879481 - DNA, 17 bp, Homo sapiens
cagagtttgccttcctt

SEQ ID NO: 4879482 - DNA, 20 bp, Homo sapiens
cagagtttgccttcctttct

SEQ ID NO: 4879483 - DNA, 19 bp, Homo sapiens
cagagtttgtgtgttgtct

SEQ ID NO: 4879484 - DNA, 20 bp, Homo sapiens
cagataacaatgcagcaagg

SEQ ID NO: 4879485 - DNA, 15 bp, Homo sapiens
cagataatcagcctc

SEQ ID NO: 4879486 - DNA, 16 bp, Homo sapiens
cagataatcagcctct

SEQ ID NO: 4879487 - DNA, 17 bp, Homo sapiens
cagataatcagcctctt

SEQ ID NO: 4879488 - DNA, 18 bp, Homo sapiens
cagataatcagcctctta

SEQ ID NO: 4879489 - DNA, 20 bp, Homo sapiens
cagatacaggaaaagctgct

SEQ ID NO: 4879490 - DNA, 23 bp, Homo sapiens
cagatacaggaaaagctgctgac

SEQ ID NO: 4879491 - DNA, 12 bp, Homo sapiens
cacacacataca

SEQ ID NO: 4879492 - DNA, 16 bp, Homo sapiens
cacacaccagagccca

SEQ ID NO: 4879493 - DNA, 15 bp, Homo sapiens
cacacaccctgaggt

SEQ ID NO: 4879494 - DNA, 18 bp, Homo sapiens
cacacaccctgaggtcag

SEQ ID NO: 4879495 - DNA, 14 bp, Homo sapiens
cacacacgcacgca

SEQ ID NO: 4879496 - DNA, 15 bp, Homo sapiens
cacacacgcacgcac

SEQ ID NO: 4879497 - DNA, 19 bp, Homo sapiens
cacacacgcacgcacacac

SEQ ID NO: 4879498 - DNA, 19 bp, Homo sapiens
cacacacgctttcttatgc

SEQ ID NO: 4879499 - DNA, 14 bp, Homo sapiens
cacacactgatgct

SEQ ID NO: 4879500 - DNA, 14 bp, Homo sapiens
cacacagaaatata

SEQ ID NO: 4879501 - DNA, 16 bp, Homo sapiens
cacacagaaatatata

SEQ ID NO: 4879502 - DNA, 21 bp, Homo sapiens
cacacagaaatatatatacat

SEQ ID NO: 4879503 - DNA, 16 bp, Homo sapiens
cacacagatacacaca

SEQ ID NO: 4879504 - DNA, 18 bp, Homo sapiens
cacacagatacacacaca

SEQ ID NO: 4879505 - DNA, 23 bp, Homo sapiens
cacacatataaacatcacacaca

SEQ ID NO: 4879506 - DNA, 14 bp, Homo sapiens
cacacatgcacaca

SEQ ID NO: 4879507 - DNA, 15 bp, Homo sapiens
cacaccagagcccac

SEQ ID NO: 4879508 - DNA, 13 bp, Homo sapiens
cacacccagccca

SEQ ID NO: 4879509 - DNA, 14 bp, Homo sapiens
cacacccagcccac

SEQ ID NO: 4879510 - DNA, 20 bp, Homo sapiens
cacacccagcccacttctgc

SEQ ID NO: 4879511 - DNA, 13 bp, Homo sapiens
cacacccagcctc

SEQ ID NO: 4879512 - DNA, 16 bp, Homo sapiens
cacacccagcctcagt

SEQ ID NO: 4879513 - DNA, 19 bp, Homo sapiens
cacacccagcctcagtcct

SEQ ID NO: 4879514 - DNA, 23 bp, Homo sapiens
cacacccaggcacttaagcacaa

SEQ ID NO: 4879515 - DNA, 18 bp, Homo sapiens
cacaccctcactctgcca

SEQ ID NO: 4879516 - DNA, 20 bp, Homo sapiens
cacaccctcactctgccagg

SEQ ID NO: 4879517 - DNA, 13 bp, Homo sapiens
cacaccctgaggt

SEQ ID NO: 4879518 - DNA, 22 bp, Homo sapiens
cacaccctgaggtcagggagtg

SEQ ID NO: 4879519 - DNA, 11 bp, Homo sapiens
cacaccctgca

SEQ ID NO: 4879520 - DNA, 12 bp, Homo sapiens
cacaccctgcaa

SEQ ID NO: 4879521 - DNA, 13 bp, Homo sapiens
cacaccctgcaag

SEQ ID NO: 4879522 - DNA, 14 bp, Homo sapiens
cacaccctgtttta

SEQ ID NO: 4879523 - DNA, 18 bp, Homo sapiens
cacacctcactctttata

SEQ ID NO: 4879524 - DNA, 18 bp, Homo sapiens
cacacctcagttcccttg

SEQ ID NO: 4879525 - DNA, 12 bp, Homo sapiens
cacacctctgcc

SEQ ID NO: 4879526 - DNA, 13 bp, Homo sapiens
cacacctctgcca

SEQ ID NO: 4879527 - DNA, 13 bp, Homo sapiens
cacacgcacgcac

SEQ ID NO: 4879528 - DNA, 19 bp, Homo sapiens
cacacgcgcgcgcacacac

SEQ ID NO: 4879529 - DNA, 18 bp, Homo sapiens
cacactatcatagttaac

SEQ ID NO: 4879530 - DNA, 12 bp, Homo sapiens
cacactatttta

SEQ ID NO: 4879531 - DNA, 14 bp, Homo sapiens
cacactattttaga

SEQ ID NO: 4879532 - DNA, 12 bp, Homo sapiens
cacactctgacg

SEQ ID NO: 4879533 - DNA, 16 bp, Homo sapiens
cacactggtacttaga

SEQ ID NO: 4879534 - DNA, 18 bp, Homo sapiens
cacactggtacttagagt

SEQ ID NO: 4879535 - DNA, 22 bp, Homo sapiens
cacactggtacttagagtttct

SEQ ID NO: 4879536 - DNA, 14 bp, Homo sapiens
cacacttcaggctc

SEQ ID NO: 4879537 - DNA, 20 bp, Homo sapiens
cacacttcaggctcttctcc

SEQ ID NO: 4879538 - DNA, 14 bp, Homo sapiens
cacacttccagaca

SEQ ID NO: 4879539 - DNA, 15 bp, Homo sapiens
cacacttctgtgaga

SEQ ID NO: 4879540 - DNA, 14 bp, Homo sapiens
cacagaaaagcata

SEQ ID NO: 4879541 - DNA, 17 bp, Homo sapiens
cacagaaacactgcctt

SEQ ID NO: 4879542 - DNA, 19 bp, Homo sapiens
cacagaaacactgcctttt

SEQ ID NO: 4879543 - DNA, 20 bp, Homo sapiens
cacagaaacactgccttttt

SEQ ID NO: 4879544 - DNA, 18 bp, Homo sapiens
cacagaaatatatataca

SEQ ID NO: 4879545 - DNA, 20 bp, Homo sapiens
cacagaaatatatatacata

SEQ ID NO: 4879546 - DNA, 18 bp, Homo sapiens
cacagacacacacacgca

SEQ ID NO: 4879547 - DNA, 15 bp, Homo sapiens
cacagataaaaagtg

SEQ ID NO: 4879548 - DNA, 23 bp, Homo sapiens
cacagatatactttgtggaccaa

SEQ ID NO: 4879549 - DNA, 11 bp, Homo sapiens
cacagatcatg

SEQ ID NO: 4879550 - DNA, 13 bp, Homo sapiens
cacagattttaat

SEQ ID NO: 4879551 - DNA, 14 bp, Homo sapiens
cacagattttaatt

SEQ ID NO: 4879552 - DNA, 19 bp, Homo sapiens
cacagattttaattgtcat

SEQ ID NO: 4879553 - DNA, 21 bp, Homo sapiens
cacagattttaattgtcatgg

SEQ ID NO: 4879554 - DNA, 14 bp, Homo sapiens
cacagcacatgctg

SEQ ID NO: 4879555 - DNA, 20 bp, Homo sapiens
cacagcacatgctggccagc

SEQ ID NO: 4879556 - DNA, 12 bp, Homo sapiens
cacagcagcatt

SEQ ID NO: 4879557 - DNA, 19 bp, Homo sapiens
cacagcagcctgcttccca

SEQ ID NO: 4879558 - DNA, 21 bp, Homo sapiens
cacagcagcttcaccagagca

SEQ ID NO: 4879559 - DNA, 14 bp, Homo sapiens
cacagcctcctctg

SEQ ID NO: 4879560 - DNA, 19 bp, Homo sapiens
cacagcctcctctgtctgc

SEQ ID NO: 4879561 - DNA, 10 bp, Homo sapiens
cacagcctct

SEQ ID NO: 4879562 - DNA, 11 bp, Homo sapiens
cacagcctctg

SEQ ID NO: 4879563 - DNA, 15 bp, Homo sapiens
cacagcctctgaccc

SEQ ID NO: 4879564 - DNA, 20 bp, Homo sapiens
cacagcctctgacccctcct

SEQ ID NO: 4879565 - DNA, 22 bp, Homo sapiens
cacagcctctgacccctcctca

SEQ ID NO: 4879566 - DNA, 21 bp, Homo sapiens
cacagcctgggccccagctcg

SEQ ID NO: 4879567 - DNA, 15 bp, Homo sapiens
cacagcgagggcagc

SEQ ID NO: 4879568 - DNA, 17 bp, Homo sapiens
cacagcgagggcagctg

SEQ ID NO: 4879569 - DNA, 15 bp, Homo sapiens
cacagctcaggaggc

SEQ ID NO: 4879570 - DNA, 20 bp, Homo sapiens
cacagctctccggtctctct

SEQ ID NO: 4879571 - DNA, 19 bp, Homo sapiens
cacagctctgtcctgggag

SEQ ID NO: 4879572 - DNA, 23 bp, Homo sapiens
cacagctctgtcctgggagtgag

SEQ ID NO: 4879573 - DNA, 17 bp, Homo sapiens
cacagctcttctccagg

SEQ ID NO: 4879574 - DNA, 18 bp, Homo sapiens
cacagctcttctccaggc

SEQ ID NO: 4879575 - DNA, 21 bp, Homo sapiens
cacagctcttctccaggctgt

SEQ ID NO: 4879576 - DNA, 19 bp, Homo sapiens
cacagctgagagactttta

SEQ ID NO: 4879577 - DNA, 22 bp, Homo sapiens
cacagctgttcttctgttctgc

SEQ ID NO: 4879578 - DNA, 15 bp, Homo sapiens
cacaggactctgcct

SEQ ID NO: 4879579 - DNA, 15 bp, Homo sapiens
cacaggaggcaagca

SEQ ID NO: 4879580 - DNA, 15 bp, Homo sapiens
cacaggatcagtctg

SEQ ID NO: 4879581 - DNA, 23 bp, Homo sapiens
cacaggatgaggtggtggagtgg

SEQ ID NO: 4879582 - DNA, 19 bp, Homo sapiens
cacaggcagctttctagaa

SEQ ID NO: 4879583 - DNA, 15 bp, Homo sapiens
cacaggcaggtccag

SEQ ID NO: 4879584 - DNA, 19 bp, Homo sapiens
cacaggcaggtccagggtt

SEQ ID NO: 4879585 - DNA, 12 bp, Homo sapiens
cacaggccccct

SEQ ID NO: 4879586 - DNA, 13 bp, Homo sapiens
cacaggccccctt

SEQ ID NO: 4879587 - DNA, 21 bp, Homo sapiens
cacaggcccccttgagtgggg

SEQ ID NO: 4879588 - DNA, 14 bp, Homo sapiens
cacaggcccggctc

SEQ ID NO: 4879589 - DNA, 19 bp, Homo sapiens
cacaggcccggctccaggc

SEQ ID NO: 4879590 - DNA, 23 bp, Homo sapiens
cacaggcccttcctctccactgc

SEQ ID NO: 4879591 - DNA, 23 bp, Homo sapiens
cacagggcatgccccggccacct

SEQ ID NO: 4879592 - DNA, 19 bp, Homo sapiens
cacaggtcccacctccagc

SEQ ID NO: 4879593 - DNA, 21 bp, Homo sapiens
cacaggtcccacctccagccc

SEQ ID NO: 4879594 - DNA, 21 bp, Homo sapiens
cacaggttggaagagaatcac

SEQ ID NO: 4879595 - DNA, 17 bp, Homo sapiens
cacagtagagccagctt

SEQ ID NO: 4879596 - DNA, 16 bp, Homo sapiens
cacagtattacttctg

SEQ ID NO: 4879597 - DNA, 19 bp, Homo sapiens
cacagtattacttctgcta

SEQ ID NO: 4879598 - DNA, 17 bp, Homo sapiens
cacagtcaaaataattc

SEQ ID NO: 4879599 - DNA, 16 bp, Homo sapiens
cacagtcactgatgta

SEQ ID NO: 4879600 - DNA, 19 bp, Homo sapiens
cacagtcactgatgtacaa

SEQ ID NO: 4879601 - DNA, 13 bp, Homo sapiens
cacagtccaggaa

SEQ ID NO: 4879602 - DNA, 18 bp, Homo sapiens
cacagtccaggaacaagc

SEQ ID NO: 4879603 - DNA, 14 bp, Homo sapiens
atgcagcatttgat

SEQ ID NO: 4879604 - DNA, 16 bp, Homo sapiens
atgcagcatttgataa

SEQ ID NO: 4879605 - DNA, 13 bp, Homo sapiens
atgcagctcaact

SEQ ID NO: 4879606 - DNA, 17 bp, Homo sapiens
atgcagggggctcctgg

SEQ ID NO: 4879607 - DNA, 17 bp, Homo sapiens
atgcagtctcctcttta

SEQ ID NO: 4879608 - DNA, 23 bp, Homo sapiens
atgcagtctcctctttaaaacaa

SEQ ID NO: 4879609 - DNA, 23 bp, Homo sapiens
atgcagtgatatggcagaagaca

SEQ ID NO: 4879610 - DNA, 23 bp, Homo sapiens
atgcagtggtatgatcacggctc

SEQ ID NO: 4879611 - DNA, 16 bp, Homo sapiens
atgcataaatatgcag

SEQ ID NO: 4879612 - DNA, 17 bp, Homo sapiens
atgcataaatatgcagt

SEQ ID NO: 4879613 - DNA, 23 bp, Homo sapiens
atgcatatgtcactagaatggat

SEQ ID NO: 4879614 - DNA, 20 bp, Homo sapiens
atgcatggaaacctgaaaaa

SEQ ID NO: 4879615 - DNA, 22 bp, Homo sapiens
atgcatgtcaaacatgagatgt

SEQ ID NO: 4879616 - DNA, 20 bp, Homo sapiens
atgcattaaacctgtctcca

SEQ ID NO: 4879617 - DNA, 23 bp, Homo sapiens
atgccaatactagtcaccccaag

SEQ ID NO: 4879618 - DNA, 21 bp, Homo sapiens
atgccacgttccacagttgcc

SEQ ID NO: 4879619 - DNA, 16 bp, Homo sapiens
atgccagctacttcct

SEQ ID NO: 4879620 - DNA, 23 bp, Homo sapiens
atgccatcctctttctcttttct

SEQ ID NO: 4879621 - DNA, 19 bp, Homo sapiens
atgccatctgtgtcctggt

SEQ ID NO: 4879622 - DNA, 16 bp, Homo sapiens
atgcccacctgcccat

SEQ ID NO: 4879623 - DNA, 15 bp, Homo sapiens
atgccccaaatatag

SEQ ID NO: 4879624 - DNA, 15 bp, Homo sapiens
atgccccggccacct

SEQ ID NO: 4879625 - DNA, 18 bp, Homo sapiens
atgccccggccacctctg

SEQ ID NO: 4879626 - DNA, 19 bp, Homo sapiens
atgccccggccacctctgc

SEQ ID NO: 4879627 - DNA, 13 bp, Homo sapiens
atgcctaataaac

SEQ ID NO: 4879628 - DNA, 18 bp, Homo sapiens
atgcctagtttttagtaa

SEQ ID NO: 4879629 - DNA, 22 bp, Homo sapiens
atgcctccctatccctcacaca

SEQ ID NO: 4879630 - DNA, 21 bp, Homo sapiens
atgcctctgatatgggactga

SEQ ID NO: 4879631 - DNA, 21 bp, Homo sapiens
atgcctgagagacatggcttt

SEQ ID NO: 4879632 - DNA, 16 bp, Homo sapiens
atgcctggtctttcct

SEQ ID NO: 4879633 - DNA, 19 bp, Homo sapiens
atgcctggtggcagctgcg

SEQ ID NO: 4879634 - DNA, 13 bp, Homo sapiens
atgccttaaaatg

SEQ ID NO: 4879635 - DNA, 15 bp, Homo sapiens
atgcctttgagacag

SEQ ID NO: 4879636 - DNA, 15 bp, Homo sapiens
atgcgttcactccaa

SEQ ID NO: 4879637 - DNA, 18 bp, Homo sapiens
atgctaatttaaagagac

SEQ ID NO: 4879638 - DNA, 14 bp, Homo sapiens
atgctactgtctca

SEQ ID NO: 4879639 - DNA, 18 bp, Homo sapiens
atgctaggttaattccaa

SEQ ID NO: 4879640 - DNA, 16 bp, Homo sapiens
atgctccaagattcta

SEQ ID NO: 4879641 - DNA, 20 bp, Homo sapiens
atgctccaagattctagatg

SEQ ID NO: 4879642 - DNA, 22 bp, Homo sapiens
atgctccctcccctgccctggt

SEQ ID NO: 4879643 - DNA, 18 bp, Homo sapiens
atgctctctcaaattgtc

SEQ ID NO: 4879644 - DNA, 18 bp, Homo sapiens
atgctcttttttactcat

SEQ ID NO: 4879645 - DNA, 21 bp, Homo sapiens
atgctcttttttactcattga

SEQ ID NO: 4879646 - DNA, 17 bp, Homo sapiens
atgctgaaaaaacacct

SEQ ID NO: 4879647 - DNA, 17 bp, Homo sapiens
atgctgacttcacttat

SEQ ID NO: 4879648 - DNA, 18 bp, Homo sapiens
atgctgcaggacttgaga

SEQ ID NO: 4879649 - DNA, 15 bp, Homo sapiens
atgctggagaagaga

SEQ ID NO: 4879650 - DNA, 16 bp, Homo sapiens
atgctggagaagagag

SEQ ID NO: 4879651 - DNA, 18 bp, Homo sapiens
atgctggagaagagagga

SEQ ID NO: 4879652 - DNA, 14 bp, Homo sapiens
atgctggccagcct

SEQ ID NO: 4879653 - DNA, 17 bp, Homo sapiens
atgctggccagcctggg

SEQ ID NO: 4879654 - DNA, 19 bp, Homo sapiens
atgctggctgttggctggg

SEQ ID NO: 4879655 - DNA, 22 bp, Homo sapiens
atgctgtacatctattttggat

SEQ ID NO: 4879656 - DNA, 23 bp, Homo sapiens
atgctgtacatctattttggatt

SEQ ID NO: 4879657 - DNA, 21 bp, Homo sapiens
atgctgtgagtctttggttct

SEQ ID NO: 4879658 - DNA, 19 bp, Homo sapiens
atgctgttctcttcttcat

SEQ ID NO: 4879659 - DNA, 15 bp, Homo sapiens
atgcttaaaaggttg

SEQ ID NO: 4879660 - DNA, 15 bp, Homo sapiens
atgcttaatttctaa

SEQ ID NO: 4879661 - DNA, 20 bp, Homo sapiens
atgcttcattcaatattgac

SEQ ID NO: 4879662 - DNA, 21 bp, Homo sapiens
atgcttcattcaatattgaca

SEQ ID NO: 4879663 - DNA, 16 bp, Homo sapiens
atgcttctcatcttgt

SEQ ID NO: 4879664 - DNA, 22 bp, Homo sapiens
atgctttttattattattattt

SEQ ID NO: 4879665 - DNA, 22 bp, Homo sapiens
atgctttttgaatgttatttgt

SEQ ID NO: 4879666 - DNA, 17 bp, Homo sapiens
atggaaaatcagctgct

SEQ ID NO: 4879667 - DNA, 23 bp, Homo sapiens
atggaactcagctgtctgtggct

SEQ ID NO: 4879668 - DNA, 15 bp, Homo sapiens
atggaagagaaatct

SEQ ID NO: 4879669 - DNA, 13 bp, Homo sapiens
caatgattatttt

SEQ ID NO: 4879670 - DNA, 13 bp, Homo sapiens
caatgcagcaagg

SEQ ID NO: 4879671 - DNA, 21 bp, Homo sapiens
caatgctgatttggtgaccaa

SEQ ID NO: 4879672 - DNA, 20 bp, Homo sapiens
caatgctggctgttggctgg

SEQ ID NO: 4879673 - DNA, 22 bp, Homo sapiens
caatgctggctgttggctgggg

SEQ ID NO: 4879674 - DNA, 23 bp, Homo sapiens
caatgctggctgttggctggggg

SEQ ID NO: 4879675 - DNA, 16 bp, Homo sapiens
caatggaaacctcacg

SEQ ID NO: 4879676 - DNA, 17 bp, Homo sapiens
caatggaaacctcacgc

SEQ ID NO: 4879677 - DNA, 20 bp, Homo sapiens
caatggagactgtctcaaga

SEQ ID NO: 4879678 - DNA, 13 bp, Homo sapiens
caatggatttgat

SEQ ID NO: 4879679 - DNA, 17 bp, Homo sapiens
caatggatttgatgctg

SEQ ID NO: 4879680 - DNA, 15 bp, Homo sapiens
caatgggcaatgaca

SEQ ID NO: 4879681 - DNA, 19 bp, Homo sapiens
caatgggcactgggatgag

SEQ ID NO: 4879682 - DNA, 21 bp, Homo sapiens
caatgtcaggaacagaaggat

SEQ ID NO: 4879683 - DNA, 14 bp, Homo sapiens
caatgtcagtattt

SEQ ID NO: 4879684 - DNA, 21 bp, Homo sapiens
caatgtcagtatttcagtgta

SEQ ID NO: 4879685 - DNA, 14 bp, Homo sapiens
caatgtgtttttct

SEQ ID NO: 4879686 - DNA, 16 bp, Homo sapiens
caatgtgtttttctcc

SEQ ID NO: 4879687 - DNA, 14 bp, Homo sapiens
caatgttaaggaaa

SEQ ID NO: 4879688 - DNA, 16 bp, Homo sapiens
caatgttaaggaaact

SEQ ID NO: 4879689 - DNA, 18 bp, Homo sapiens
caatgttaaggaaactct

SEQ ID NO: 4879690 - DNA, 20 bp, Homo sapiens
caatgttaaggaaactctta

SEQ ID NO: 4879691 - DNA, 16 bp, Homo sapiens
caattagggcctagcc

SEQ ID NO: 4879692 - DNA, 14 bp, Homo sapiens
caattatagtttct

SEQ ID NO: 4879693 - DNA, 22 bp, Homo sapiens
caattatagtttctgaggcttt

SEQ ID NO: 4879694 - DNA, 18 bp, Homo sapiens
caattattgatatatatt

SEQ ID NO: 4879695 - DNA, 22 bp, Homo sapiens
caattattgttacacattaagt

SEQ ID NO: 4879696 - DNA, 17 bp, Homo sapiens
caattcaaaagttccaa

SEQ ID NO: 4879697 - DNA, 14 bp, Homo sapiens
caattgagaaaaat

SEQ ID NO: 4879698 - DNA, 23 bp, Homo sapiens
caattgagaaaaatatatactaa

SEQ ID NO: 4879699 - DNA, 21 bp, Homo sapiens
caattgtcgaaaagagtcttc

SEQ ID NO: 4879700 - DNA, 21 bp, Homo sapiens
caattgtgagccaccacgtcc

SEQ ID NO: 4879701 - DNA, 16 bp, Homo sapiens
caattgtgctgccatt

SEQ ID NO: 4879702 - DNA, 14 bp, Homo sapiens
caattgttgacagt

SEQ ID NO: 4879703 - DNA, 23 bp, Homo sapiens
caattgttgacagttctgaagaa

SEQ ID NO: 4879704 - DNA, 22 bp, Homo sapiens
caattgtttgggtgattcctaa

SEQ ID NO: 4879705 - DNA, 11 bp, Homo sapiens
caatttaaatg

SEQ ID NO: 4879706 - DNA, 23 bp, Homo sapiens
caatttattaaaatgattgtaaa

SEQ ID NO: 4879707 - DNA, 19 bp, Homo sapiens
caatttcaaggttctaacc

SEQ ID NO: 4879708 - DNA, 21 bp, Homo sapiens
caatttcctttatatttagtg

SEQ ID NO: 4879709 - DNA, 15 bp, Homo sapiens
caatttgatacataa

SEQ ID NO: 4879710 - DNA, 23 bp, Homo sapiens
caatttgcacatcttggctatgt

SEQ ID NO: 4879711 - DNA, 20 bp, Homo sapiens
caatttgcactaaatcagag

SEQ ID NO: 4879712 - DNA, 22 bp, Homo sapiens
caattttctaagcaatttcttg

SEQ ID NO: 4879713 - DNA, 19 bp, Homo sapiens
caattttctggaatacatg

SEQ ID NO: 4879714 - DNA, 11 bp, Homo sapiens
caatttttcca

SEQ ID NO: 4879715 - DNA, 19 bp, Homo sapiens
caatttttgtctcagaagt

SEQ ID NO: 4879716 - DNA, 16 bp, Homo sapiens
cacaaaaatgttgaac

SEQ ID NO: 4879717 - DNA, 19 bp, Homo sapiens
cacaaaaatgttgaaccaa

SEQ ID NO: 4879718 - DNA, 12 bp, Homo sapiens
cacaaacatttt

SEQ ID NO: 4879719 - DNA, 13 bp, Homo sapiens
cacaaactgtaaa

SEQ ID NO: 4879720 - DNA, 18 bp, Homo sapiens
cacaaagcacagtttgaa

SEQ ID NO: 4879721 - DNA, 22 bp, Homo sapiens
cacaaagcacagtttgaacaaa

SEQ ID NO: 4879722 - DNA, 20 bp, Homo sapiens
cacaaatttcacttatacct

SEQ ID NO: 4879723 - DNA, 15 bp, Homo sapiens
cacaacatttgcaga

SEQ ID NO: 4879724 - DNA, 17 bp, Homo sapiens
cacaaccttctgtggct

SEQ ID NO: 4879725 - DNA, 19 bp, Homo sapiens
cacaaccttctgtggctca

SEQ ID NO: 4879726 - DNA, 12 bp, Homo sapiens
cacaactgacac

SEQ ID NO: 4879727 - DNA, 12 bp, Homo sapiens
cacaagaaattt

SEQ ID NO: 4879728 - DNA, 20 bp, Homo sapiens
cacaagaaatttgatttcta

SEQ ID NO: 4879729 - DNA, 15 bp, Homo sapiens
cacaagcccacagca

SEQ ID NO: 4879730 - DNA, 21 bp, Homo sapiens
cacaagtcctggatgttgtgt

SEQ ID NO: 4879731 - DNA, 16 bp, Homo sapiens
cacacaagcccacagc

SEQ ID NO: 4879732 - DNA, 13 bp, Homo sapiens
cacacacaaacct

SEQ ID NO: 4879733 - DNA, 12 bp, Homo sapiens
cacacacacaca

SEQ ID NO: 4879734 - DNA, 14 bp, Homo sapiens
cacacacacacaaa

SEQ ID NO: 4879735 - DNA, 14 bp, Homo sapiens
cacacacacacata

SEQ ID NO: 4879736 - DNA, 12 bp, Homo sapiens
cacacacacata

SEQ ID NO: 4879737 - DNA, 13 bp, Homo sapiens
cacacacacgcac

SEQ ID NO: 4879738 - DNA, 16 bp, Homo sapiens
cagctgtctgtggctt

SEQ ID NO: 4879739 - DNA, 13 bp, Homo sapiens
cagctgtgagcct

SEQ ID NO: 4879740 - DNA, 19 bp, Homo sapiens
cagctgtgctctggacagg

SEQ ID NO: 4879741 - DNA, 24 bp, Homo sapiens
cagctgtgctctggacaggcatgt

SEQ ID NO: 4879742 - DNA, 14 bp, Homo sapiens
cagcttcaccagag

SEQ ID NO: 4879743 - DNA, 18 bp, Homo sapiens
cagcttcatttcctgtgt

SEQ ID NO: 4879744 - DNA, 13 bp, Homo sapiens
cagcttcatttgt

SEQ ID NO: 4879745 - DNA, 15 bp, Homo sapiens
cagcttcatttgtgt

SEQ ID NO: 4879746 - DNA, 17 bp, Homo sapiens
cagcttcatttgtgtca

SEQ ID NO: 4879747 - DNA, 19 bp, Homo sapiens
cagcttcctacccacacct

SEQ ID NO: 4879748 - DNA, 12 bp, Homo sapiens
cagcttcctgtc

SEQ ID NO: 4879749 - DNA, 20 bp, Homo sapiens
cagcttgagggttgggctgg

SEQ ID NO: 4879750 - DNA, 22 bp, Homo sapiens
cagcttggggccaccaaagctg

SEQ ID NO: 4879751 - DNA, 20 bp, Homo sapiens
cagcttgtaaatagctcagg

SEQ ID NO: 4879752 - DNA, 21 bp, Homo sapiens
cagcttgtaaatagctcaggt

SEQ ID NO: 4879753 - DNA, 23 bp, Homo sapiens
cagcttgtatgcaatggattttc

SEQ ID NO: 4879754 - DNA, 20 bp, Homo sapiens
cagctttaaactcagggaca

SEQ ID NO: 4879755 - DNA, 21 bp, Homo sapiens
cagctttaaactcagggacag

SEQ ID NO: 4879756 - DNA, 18 bp, Homo sapiens
cagctttacacacacaga

SEQ ID NO: 4879757 - DNA, 23 bp, Homo sapiens
cagctttctccccgctaaggaag

SEQ ID NO: 4879758 - DNA, 21 bp, Homo sapiens
cagctttcttgctcccttcag

SEQ ID NO: 4879759 - DNA, 19 bp, Homo sapiens
cagctttgagaagccttca

SEQ ID NO: 4879760 - DNA, 20 bp, Homo sapiens
cagctttgagaagccttcag

SEQ ID NO: 4879761 - DNA, 20 bp, Homo sapiens
cagctttgatccctgacatc

SEQ ID NO: 4879762 - DNA, 11 bp, Homo sapiens
cagctttgcta

SEQ ID NO: 4879763 - DNA, 20 bp, Homo sapiens
caggaaaagctgctgacagt

SEQ ID NO: 4879764 - DNA, 22 bp, Homo sapiens
caggaaaaggtagcttacctga

SEQ ID NO: 4879765 - DNA, 18 bp, Homo sapiens
caggaacagaaggatgaa

SEQ ID NO: 4879766 - DNA, 20 bp, Homo sapiens
caggaacagctatgggagcc

SEQ ID NO: 4879767 - DNA, 12 bp, Homo sapiens
caggaactgggc

SEQ ID NO: 4879768 - DNA, 20 bp, Homo sapiens
caggaagcattcagagagca

SEQ ID NO: 4879769 - DNA, 22 bp, Homo sapiens
caggaagcattcagagagcagc

SEQ ID NO: 4879770 - DNA, 13 bp, Homo sapiens
caggaaggagagc

SEQ ID NO: 4879771 - DNA, 13 bp, Homo sapiens
caggaaggcctgg

SEQ ID NO: 4879772 - DNA, 15 bp, Homo sapiens
caggaagtacttcca

SEQ ID NO: 4879773 - DNA, 19 bp, Homo sapiens
caggaagtacttccacctc

SEQ ID NO: 4879774 - DNA, 21 bp, Homo sapiens
caggaagtcccttgccatcct

SEQ ID NO: 4879775 - DNA, 17 bp, Homo sapiens
caggaatcaagagctgc

SEQ ID NO: 4879776 - DNA, 18 bp, Homo sapiens
caggaatcaagagctgcc

SEQ ID NO: 4879777 - DNA, 23 bp, Homo sapiens
caggaatcaagagctgccctcct

SEQ ID NO: 4879778 - DNA, 19 bp, Homo sapiens
caggaatgtgtggcctgca

SEQ ID NO: 4879779 - DNA, 14 bp, Homo sapiens
caggacaccacacc

SEQ ID NO: 4879780 - DNA, 13 bp, Homo sapiens
caggaccaagcca

SEQ ID NO: 4879781 - DNA, 14 bp, Homo sapiens
caggactccctcct

SEQ ID NO: 4879782 - DNA, 16 bp, Homo sapiens
caggactccctcctca

SEQ ID NO: 4879783 - DNA, 21 bp, Homo sapiens
caggactccctcctcacctct

SEQ ID NO: 4879784 - DNA, 13 bp, Homo sapiens
caggactctgcct

SEQ ID NO: 4879785 - DNA, 19 bp, Homo sapiens
caggactttgaggcaagtg

SEQ ID NO: 4879786 - DNA, 11 bp, Homo sapiens
caggagaacca

SEQ ID NO: 4879787 - DNA, 23 bp, Homo sapiens
caggagacactgtgctataaatc

SEQ ID NO: 4879788 - DNA, 14 bp, Homo sapiens
caggagacaggaag

SEQ ID NO: 4879789 - DNA, 18 bp, Homo sapiens
caggagagagaaagccag

SEQ ID NO: 4879790 - DNA, 23 bp, Homo sapiens
caggagagagaaagccaggcagg

SEQ ID NO: 4879791 - DNA, 17 bp, Homo sapiens
caggagattgagaagga

SEQ ID NO: 4879792 - DNA, 22 bp, Homo sapiens
caggagattgagaaggagagaa

SEQ ID NO: 4879793 - DNA, 15 bp, Homo sapiens
caggagccccgaggc

SEQ ID NO: 4879794 - DNA, 15 bp, Homo sapiens
caggagcctgtgcct

SEQ ID NO: 4879795 - DNA, 15 bp, Homo sapiens
caggagcgcaagata

SEQ ID NO: 4879796 - DNA, 22 bp, Homo sapiens
caggagctcttcaggcctccct

SEQ ID NO: 4879797 - DNA, 23 bp, Homo sapiens
caggagctcttcaggcctccctc

SEQ ID NO: 4879798 - DNA, 12 bp, Homo sapiens
caggaggctgag

SEQ ID NO: 4879799 - DNA, 17 bp, Homo sapiens
caggaggctgaggcagg

SEQ ID NO: 4879800 - DNA, 12 bp, Homo sapiens
caggagggccct

SEQ ID NO: 4879801 - DNA, 20 bp, Homo sapiens
caggagggtctatggggaga

SEQ ID NO: 4879802 - DNA, 16 bp, Homo sapiens
caggagtcccaaggaa

SEQ ID NO: 4879803 - DNA, 18 bp, Homo sapiens
caggagtcccaaggaaag

SEQ ID NO: 4879804 - DNA, 19 bp, Homo sapiens
caggagtcccaaggaaagc

SEQ ID NO: 4879805 - DNA, 23 bp, Homo sapiens
caggagttcaataaatgtctgtt

SEQ ID NO: 4879806 - DNA, 18 bp, Homo sapiens
caggagttcgaggctgca

SEQ ID NO: 4879807 - DNA, 18 bp, Homo sapiens
caggataaactgaaaact

SEQ ID NO: 4879808 - DNA, 20 bp, Homo sapiens
caggatatccttatcagagc

SEQ ID NO: 4879809 - DNA, 21 bp, Homo sapiens
caggatatccttatcagagct

SEQ ID NO: 4879810 - DNA, 16 bp, Homo sapiens
caggatcatggtgtaa

SEQ ID NO: 4879811 - DNA, 16 bp, Homo sapiens
caggatgctgggtggc

SEQ ID NO: 4879812 - DNA, 15 bp, Homo sapiens
caggattcagccgga

SEQ ID NO: 4879813 - DNA, 15 bp, Homo sapiens
caggatttaaaaact

SEQ ID NO: 4879814 - DNA, 21 bp, Homo sapiens
caggatttgaactcagatctg

SEQ ID NO: 4879815 - DNA, 17 bp, Homo sapiens
caggcaacttcagtcct

SEQ ID NO: 4879816 - DNA, 21 bp, Homo sapiens
caggcaagcacctcctgcctc

SEQ ID NO: 4879817 - DNA, 13 bp, Homo sapiens
caggcacagctga

SEQ ID NO: 4879818 - DNA, 13 bp, Homo sapiens
caggcacaggatg

SEQ ID NO: 4879819 - DNA, 18 bp, Homo sapiens
caggcacccaccatcatg

SEQ ID NO: 4879820 - DNA, 22 bp, Homo sapiens
caggcacccaccatcatgtctg

SEQ ID NO: 4879821 - DNA, 14 bp, Homo sapiens
caggcacggtttgg

SEQ ID NO: 4879822 - DNA, 22 bp, Homo sapiens
caggcactagcctttggctctg

SEQ ID NO: 4879823 - DNA, 21 bp, Homo sapiens
caggcacttaagcacaagcag

SEQ ID NO: 4879824 - DNA, 16 bp, Homo sapiens
caggcagactacacag

SEQ ID NO: 4879825 - DNA, 21 bp, Homo sapiens
caggcagactacacaggatga

SEQ ID NO: 4879826 - DNA, 15 bp, Homo sapiens
caggcagagaatcat

SEQ ID NO: 4879827 - DNA, 22 bp, Homo sapiens
caggcagatctgtgccccatgc

SEQ ID NO: 4879828 - DNA, 18 bp, Homo sapiens
caggcagcgatggtctca

SEQ ID NO: 4879829 - DNA, 20 bp, Homo sapiens
caggcagcgccaagtgcgtg

SEQ ID NO: 4879830 - DNA, 23 bp, Homo sapiens
caggcatgggtgcaaggaaaatt

SEQ ID NO: 4879831 - DNA, 20 bp, Homo sapiens
caggcatgttctctgaggac

SEQ ID NO: 4879832 - DNA, 23 bp, Homo sapiens
caggcatttgactgaagatgcag

SEQ ID NO: 4879833 - DNA, 17 bp, Homo sapiens
caggccaagaaacgtct

SEQ ID NO: 4879834 - DNA, 15 bp, Homo sapiens
caggccaaggtctga

SEQ ID NO: 4879835 - DNA, 20 bp, Homo sapiens
caggccaaggtctgagccac

SEQ ID NO: 4879836 - DNA, 15 bp, Homo sapiens
caggcccaactgtga

SEQ ID NO: 4879837 - DNA, 13 bp, Homo sapiens
caggcccctgcca

SEQ ID NO: 4879838 - DNA, 15 bp, Homo sapiens
caggcccctgccacc

SEQ ID NO: 4879839 - DNA, 17 bp, Homo sapiens
caggcccctgccaccct

SEQ ID NO: 4879840 - DNA, 16 bp, Homo sapiens
caggcccggctccagg

SEQ ID NO: 4879841 - DNA, 18 bp, Homo sapiens
caggcccggctccaggct

SEQ ID NO: 4879842 - DNA, 12 bp, Homo sapiens
caggccctgcag

SEQ ID NO: 4879843 - DNA, 16 bp, Homo sapiens
caggccctgcagtgtt

SEQ ID NO: 4879844 - DNA, 13 bp, Homo sapiens
caggccctgctcc

SEQ ID NO: 4879845 - DNA, 14 bp, Homo sapiens
caggccctgctcct

SEQ ID NO: 4879846 - DNA, 19 bp, Homo sapiens
caggccctgctcctgcagc

SEQ ID NO: 4879847 - DNA, 15 bp, Homo sapiens
caggccctggaactc

SEQ ID NO: 4879848 - DNA, 20 bp, Homo sapiens
caggcccttcctctccactg

SEQ ID NO: 4879849 - DNA, 19 bp, Homo sapiens
caggccctttgaagcctca

SEQ ID NO: 4879850 - DNA, 18 bp, Homo sapiens
caggccgcgccctttccc

SEQ ID NO: 4879851 - DNA, 14 bp, Homo sapiens
caggccggccagcc

SEQ ID NO: 4879852 - DNA, 15 bp, Homo sapiens
caggccggccagcct

SEQ ID NO: 4879853 - DNA, 21 bp, Homo sapiens
caggccggccagcctcaccct

SEQ ID NO: 4879854 - DNA, 13 bp, Homo sapiens
caggcctcacctc

SEQ ID NO: 4879855 - DNA, 14 bp, Homo sapiens
caggcctccctctc

SEQ ID NO: 4879856 - DNA, 23 bp, Homo sapiens
caggcctccctctctcttctgct

SEQ ID NO: 4879857 - DNA, 13 bp, Homo sapiens
caggcctctgtgt

SEQ ID NO: 4879858 - DNA, 15 bp, Homo sapiens
caggcctctgtgtcc

SEQ ID NO: 4879859 - DNA, 22 bp, Homo sapiens
caggcctctgtgtccttccctg

SEQ ID NO: 4879860 - DNA, 22 bp, Homo sapiens
caggcctgcagcaggagtggtg

SEQ ID NO: 4879861 - DNA, 16 bp, Homo sapiens
caggcgatccacctgt

SEQ ID NO: 4879862 - DNA, 20 bp, Homo sapiens
caggcgatccacctgtctca

SEQ ID NO: 4879863 - DNA, 17 bp, Homo sapiens
caggcgccccttccccc

SEQ ID NO: 4879864 - DNA, 18 bp, Homo sapiens
caggctagtccggaccca

SEQ ID NO: 4879865 - DNA, 23 bp, Homo sapiens
caggctagtccggacccacctca

SEQ ID NO: 4879866 - DNA, 14 bp, Homo sapiens
caggctcttctcct

SEQ ID NO: 4879867 - DNA, 15 bp, Homo sapiens
caggctcttctcctt

SEQ ID NO: 4879868 - DNA, 20 bp, Homo sapiens
caggctgagccactctcttc

SEQ ID NO: 4879869 - DNA, 17 bp, Homo sapiens
caggctgcagctggaca

SEQ ID NO: 4879870 - DNA, 21 bp, Homo sapiens
caggctgccaaggccagagtg

SEQ ID NO: 4879871 - DNA, 22 bp, Homo sapiens
caggctgccaaggccagagtgg

SEQ ID NO: 4879872 - DNA, 21 bp, Homo sapiens
caggctgctggggcctcagac

SEQ ID NO: 4879873 - DNA, 23 bp, Homo sapiens
caggctgctggggcctcagacga

SEQ ID NO: 4879874 - DNA, 12 bp, Homo sapiens
caggctgcttgg

SEQ ID NO: 4879875 - DNA, 15 bp, Homo sapiens
caggctgcttgggat

SEQ ID NO: 4879876 - DNA, 17 bp, Homo sapiens
caggctggcgtgcagtg

SEQ ID NO: 4879877 - DNA, 19 bp, Homo sapiens
caggctggcgtgcagtggt

SEQ ID NO: 4879878 - DNA, 10 bp, Homo sapiens
caggctgggc

SEQ ID NO: 4879879 - DNA, 20 bp, Homo sapiens
caggctgggccatgtccaaa

SEQ ID NO: 4879880 - DNA, 15 bp, Homo sapiens
caggctggtgggagg

SEQ ID NO: 4879881 - DNA, 18 bp, Homo sapiens
caggctgttctgcactga

SEQ ID NO: 4879882 - DNA, 20 bp, Homo sapiens
caggctgttctgcactgaaa

SEQ ID NO: 4879883 - DNA, 21 bp, Homo sapiens
caggctgttctgcactgaaaa

SEQ ID NO: 4879884 - DNA, 22 bp, Homo sapiens
caggctgttctgcactgaaaag

SEQ ID NO: 4879885 - DNA, 13 bp, Homo sapiens
cagggaagctggc

SEQ ID NO: 4879886 - DNA, 16 bp, Homo sapiens
cagggaaggcctgact

SEQ ID NO: 4879887 - DNA, 23 bp, Homo sapiens
cagggaaggcctgacttctgctg

SEQ ID NO: 4879888 - DNA, 18 bp, Homo sapiens
cagggaatccaagcctcc

SEQ ID NO: 4879889 - DNA, 16 bp, Homo sapiens
cagggaatttctatct

SEQ ID NO: 4879890 - DNA, 16 bp, Homo sapiens
cagggacagagccatg

SEQ ID NO: 4879891 - DNA, 16 bp, Homo sapiens
cagggaccacaccctg

SEQ ID NO: 4879892 - DNA, 22 bp, Homo sapiens
cagggaccacaccctgtactgt

SEQ ID NO: 4879893 - DNA, 18 bp, Homo sapiens
cagggagcagggaaggcc

SEQ ID NO: 4879894 - DNA, 20 bp, Homo sapiens
cagggagcagggaaggcctg

SEQ ID NO: 4879895 - DNA, 14 bp, Homo sapiens
cagggaggtcaggc

SEQ ID NO: 4879896 - DNA, 17 bp, Homo sapiens
cagggagtgctggctca

SEQ ID NO: 4879897 - DNA, 22 bp, Homo sapiens
cagggagtgctggctcacagta

SEQ ID NO: 4879898 - DNA, 15 bp, Homo sapiens
cagggcaaaatattc

SEQ ID NO: 4879899 - DNA, 22 bp, Homo sapiens
cagggcaaatgacatgcactga

SEQ ID NO: 4879900 - DNA, 18 bp, Homo sapiens
cagggcaatgatgaatga

SEQ ID NO: 4879901 - DNA, 19 bp, Homo sapiens
cagggcacaccgggcactc

SEQ ID NO: 4879902 - DNA, 22 bp, Homo sapiens
cagggcacaccgggcactcaga

SEQ ID NO: 4879903 - DNA, 21 bp, Homo sapiens
cagggcaccctgtggccctgg

SEQ ID NO: 4879904 - DNA, 15 bp, Homo sapiens
cagggcatgccacgt

SEQ ID NO: 4879905 - DNA, 21 bp, Homo sapiens
cagggcatgccccggccacct

SEQ ID NO: 4879906 - DNA, 22 bp, Homo sapiens
cagggcatgccccggccacctc

SEQ ID NO: 4879907 - DNA, 20 bp, Homo sapiens
cagggcatggccaggtggcc

SEQ ID NO: 4879908 - DNA, 14 bp, Homo sapiens
cagggccaggactg

SEQ ID NO: 4879909 - DNA, 20 bp, Homo sapiens
cagggccaggactgagcccc

SEQ ID NO: 4879910 - DNA, 16 bp, Homo sapiens
cagggccagtggggcc

SEQ ID NO: 4879911 - DNA, 16 bp, Homo sapiens
cagggccatgcctgcc

SEQ ID NO: 4879912 - DNA, 17 bp, Homo sapiens
cagggccatgcctgccc

SEQ ID NO: 4879913 - DNA, 12 bp, Homo sapiens
cagggcccagag

SEQ ID NO: 4879914 - DNA, 14 bp, Homo sapiens
cagggccgaccaga

SEQ ID NO: 4879915 - DNA, 23 bp, Homo sapiens
cagggccgaccagaggagccttt

SEQ ID NO: 4879916 - DNA, 13 bp, Homo sapiens
cagggcctggggc

SEQ ID NO: 4879917 - DNA, 15 bp, Homo sapiens
cagggcctggggcct

SEQ ID NO: 4879918 - DNA, 17 bp, Homo sapiens
cagggcctggggcctga

SEQ ID NO: 4879919 - DNA, 19 bp, Homo sapiens
cagggcctggggcctgaga

SEQ ID NO: 4879920 - DNA, 23 bp, Homo sapiens
cagggcctggggcctgagagaat

SEQ ID NO: 4879921 - DNA, 14 bp, Homo sapiens
cagggctcctccca

SEQ ID NO: 4879922 - DNA, 17 bp, Homo sapiens
cagggctcctcccagct

SEQ ID NO: 4879923 - DNA, 18 bp, Homo sapiens
cagggctcctcccagctt

SEQ ID NO: 4879924 - DNA, 15 bp, Homo sapiens
cagggctctgcccca

SEQ ID NO: 4879925 - DNA, 19 bp, Homo sapiens
cagggctctgccccagtcg

SEQ ID NO: 4879926 - DNA, 15 bp, Homo sapiens
cagggctgccctgag

SEQ ID NO: 4879927 - DNA, 14 bp, Homo sapiens
caggggaacctgcc

SEQ ID NO: 4879928 - DNA, 15 bp, Homo sapiens
caggggaacctgcca

SEQ ID NO: 4879929 - DNA, 16 bp, Homo sapiens
caggggaacctgccat

SEQ ID NO: 4879930 - DNA, 21 bp, Homo sapiens
caggggactcagccctgaggt

SEQ ID NO: 4879931 - DNA, 14 bp, Homo sapiens
caggggccagagga

SEQ ID NO: 4879932 - DNA, 20 bp, Homo sapiens
caggggcccaaggcggcccc

SEQ ID NO: 4879933 - DNA, 18 bp, Homo sapiens
caggggctacaagaggga

SEQ ID NO: 4879934 - DNA, 13 bp, Homo sapiens
caggggctctgga

SEQ ID NO: 4879935 - DNA, 18 bp, Homo sapiens
caggggctctggagagaa

SEQ ID NO: 4879936 - DNA, 20 bp, Homo sapiens
caggggctctggagagaaac

SEQ ID NO: 4879937 - DNA, 11 bp, Homo sapiens
cagggggaagg

SEQ ID NO: 4879938 - DNA, 23 bp, Homo sapiens
cagggggaaggccaaggggagtc

SEQ ID NO: 4879939 - DNA, 18 bp, Homo sapiens
cagggggactagcccctg

SEQ ID NO: 4879940 - DNA, 16 bp, Homo sapiens
cagggggagaatgggt

SEQ ID NO: 4879941 - DNA, 20 bp, Homo sapiens
caggggtcccagccaccccg

SEQ ID NO: 4879942 - DNA, 22 bp, Homo sapiens
cagggtctcactatgttgccca

SEQ ID NO: 4879943 - DNA, 15 bp, Homo sapiens
cagggtctgtgtgaa

SEQ ID NO: 4879944 - DNA, 19 bp, Homo sapiens
cagggtgacggtgacaaag

SEQ ID NO: 4879945 - DNA, 22 bp, Homo sapiens
cagggtggacttagaaagcagg

SEQ ID NO: 4879946 - DNA, 23 bp, Homo sapiens
cagggtgttgggatactgcaggg

SEQ ID NO: 4879947 - DNA, 12 bp, Homo sapiens
cagggttggccc

SEQ ID NO: 4879948 - DNA, 17 bp, Homo sapiens
cagggttggcccctgcc

SEQ ID NO: 4879949 - DNA, 19 bp, Homo sapiens
cagggtttcaccatgttgc

SEQ ID NO: 4879950 - DNA, 17 bp, Homo sapiens
caggtaaattaagacat

SEQ ID NO: 4879951 - DNA, 14 bp, Homo sapiens
caggtaacaggcag

SEQ ID NO: 4879952 - DNA, 23 bp, Homo sapiens
caggtatggaagggtttgtggct

SEQ ID NO: 4879953 - DNA, 14 bp, Homo sapiens
caggtatggctctg

SEQ ID NO: 4879954 - DNA, 16 bp, Homo sapiens
caggtatggctctgca

SEQ ID NO: 4879955 - DNA, 18 bp, Homo sapiens
caggtcccacctccagcc

SEQ ID NO: 4879956 - DNA, 16 bp, Homo sapiens
caggtccctccccttc

SEQ ID NO: 4879957 - DNA, 20 bp, Homo sapiens
caggtctcccacgtgggaga

SEQ ID NO: 4879958 - DNA, 21 bp, Homo sapiens
caggtcttgaactcctggcct

SEQ ID NO: 4879959 - DNA, 15 bp, Homo sapiens
cagtgttcgcttggc

SEQ ID NO: 4879960 - DNA, 23 bp, Homo sapiens
cagtgttcgcttggctccatgct

SEQ ID NO: 4879961 - DNA, 18 bp, Homo sapiens
cagtgttctatgaacaac

SEQ ID NO: 4879962 - DNA, 14 bp, Homo sapiens
cagtgttgcctaag

SEQ ID NO: 4879963 - DNA, 14 bp, Homo sapiens
cagtgttttaaatt

SEQ ID NO: 4879964 - DNA, 24 bp, Homo sapiens
cagttaactattgcatttatatgt

SEQ ID NO: 4879965 - DNA, 22 bp, Homo sapiens
cagttaccacacatctatgata

SEQ ID NO: 4879966 - DNA, 13 bp, Homo sapiens
cagttagactagt

SEQ ID NO: 4879967 - DNA, 21 bp, Homo sapiens
cagttattcattctgtgatca

SEQ ID NO: 4879968 - DNA, 22 bp, Homo sapiens
cagttcaataaacttaacttta

SEQ ID NO: 4879969 - DNA, 19 bp, Homo sapiens
cagttcacaccctgcaagg

SEQ ID NO: 4879970 - DNA, 16 bp, Homo sapiens
cagttcacctgcactt

SEQ ID NO: 4879971 - DNA, 20 bp, Homo sapiens
cagttcaggagtcccaagga

SEQ ID NO: 4879972 - DNA, 13 bp, Homo sapiens
catctgcccctcc

SEQ ID NO: 4879973 - DNA, 16 bp, Homo sapiens
catctgcccctccccc

SEQ ID NO: 4879974 - DNA, 17 bp, Homo sapiens
catctgcccctccccca

SEQ ID NO: 4879975 - DNA, 16 bp, Homo sapiens
catctgcttttattaa

SEQ ID NO: 4879976 - DNA, 18 bp, Homo sapiens
catctggataggagcctg

SEQ ID NO: 4879977 - DNA, 20 bp, Homo sapiens
catctggataggagcctgct

SEQ ID NO: 4879978 - DNA, 23 bp, Homo sapiens
catctggataggagcctgctggt

SEQ ID NO: 4879979 - DNA, 11 bp, Homo sapiens
catctggcctg

SEQ ID NO: 4879980 - DNA, 12 bp, Homo sapiens
catctggcctgg

SEQ ID NO: 4879981 - DNA, 13 bp, Homo sapiens
catctggcctggc

SEQ ID NO: 4879982 - DNA, 20 bp, Homo sapiens
catctggcctggcctggccc

SEQ ID NO: 4879983 - DNA, 17 bp, Homo sapiens
catctggcttattttaa

SEQ ID NO: 4879984 - DNA, 18 bp, Homo sapiens
catctggcttattttaat

SEQ ID NO: 4879985 - DNA, 19 bp, Homo sapiens
catctggcttattttaatg

SEQ ID NO: 4879986 - DNA, 14 bp, Homo sapiens
catctgtcaacagg

SEQ ID NO: 4879987 - DNA, 20 bp, Homo sapiens
catctgtcaccaattggtta

SEQ ID NO: 4879988 - DNA, 22 bp, Homo sapiens
catcttactgtacctgttcctt

SEQ ID NO: 4879989 - DNA, 18 bp, Homo sapiens
catcttatagcactttga

SEQ ID NO: 4879990 - DNA, 21 bp, Homo sapiens
catcttatagcactttgaaat

SEQ ID NO: 4879991 - DNA, 18 bp, Homo sapiens
catcttatcaaggactct

SEQ ID NO: 4879992 - DNA, 21 bp, Homo sapiens
catcttatgctaactgtagat

SEQ ID NO: 4879993 - DNA, 21 bp, Homo sapiens
catcttctaaacccaatccaa

SEQ ID NO: 4879994 - DNA, 17 bp, Homo sapiens
catcttgctctgctgac

SEQ ID NO: 4879995 - DNA, 19 bp, Homo sapiens
catctttgacactctgcag

SEQ ID NO: 4879996 - DNA, 17 bp, Homo sapiens
catctttgccttgggct

SEQ ID NO: 4879997 - DNA, 13 bp, Homo sapiens
catcttttacatt

SEQ ID NO: 4879998 - DNA, 21 bp, Homo sapiens
catcttttgaggcttctgttc

SEQ ID NO: 4879999 - DNA, 11 bp, Homo sapiens
catctttttaa

SEQ ID NO: 4880000 - DNA, 19 bp, Homo sapiens
catgaaaattttaaaaata

SEQ ID NO: 4880001 - DNA, 13 bp, Homo sapiens
catgaaatatgca

SEQ ID NO: 4880002 - DNA, 14 bp, Homo sapiens
catgaaatttttaa

SEQ ID NO: 4880003 - DNA, 21 bp, Homo sapiens
catgaagagaagcaattttgg

SEQ ID NO: 4880004 - DNA, 15 bp, Homo sapiens
catgaagagcaaaaa

SEQ ID NO: 4880005 - DNA, 11 bp, Homo sapiens
catgaagcctg

SEQ ID NO: 4880006 - DNA, 16 bp, Homo sapiens
catgaagccttttgaa

SEQ ID NO: 4880007 - DNA, 17 bp, Homo sapiens
catgaatctttgtttca

SEQ ID NO: 4880008 - DNA, 13 bp, Homo sapiens
catgaattttaca

SEQ ID NO: 4880009 - DNA, 21 bp, Homo sapiens
catgacacccgtgagcgcctg

SEQ ID NO: 4880010 - DNA, 15 bp, Homo sapiens
catgacactgacctt

SEQ ID NO: 4880011 - DNA, 20 bp, Homo sapiens
catgacagcgctaaacgttg

SEQ ID NO: 4880012 - DNA, 12 bp, Homo sapiens
catgacatgtta

SEQ ID NO: 4880013 - DNA, 19 bp, Homo sapiens
catgacatgttatatattt

SEQ ID NO: 4880014 - DNA, 14 bp, Homo sapiens
catgacctccaggg

SEQ ID NO: 4880015 - DNA, 22 bp, Homo sapiens
catgacctgatcactagcctgt

SEQ ID NO: 4880016 - DNA, 23 bp, Homo sapiens
catgacctgatcactagcctgtc

SEQ ID NO: 4880017 - DNA, 20 bp, Homo sapiens
catgactcgtatatgtctca

SEQ ID NO: 4880018 - DNA, 12 bp, Homo sapiens
catgagaatcta

SEQ ID NO: 4880019 - DNA, 19 bp, Homo sapiens
catgagaatctatatttaa

SEQ ID NO: 4880020 - DNA, 17 bp, Homo sapiens
catgagcctcagcatcc

SEQ ID NO: 4880021 - DNA, 19 bp, Homo sapiens
catgagcctcagcatcctg

SEQ ID NO: 4880022 - DNA, 23 bp, Homo sapiens
catgagcctcagcatcctggcac

SEQ ID NO: 4880023 - DNA, 14 bp, Homo sapiens
catgagcttttata

SEQ ID NO: 4880024 - DNA, 22 bp, Homo sapiens
catgaggaactgtagatgatgt

SEQ ID NO: 4880025 - DNA, 13 bp, Homo sapiens
catgataaatgat

SEQ ID NO: 4880026 - DNA, 22 bp, Homo sapiens
catgatggttattttcttttct

SEQ ID NO: 4880027 - DNA, 21 bp, Homo sapiens
catgattcatgccaattagca

SEQ ID NO: 4880028 - DNA, 18 bp, Homo sapiens
catgatttccttgaatgt

SEQ ID NO: 4880029 - DNA, 17 bp, Homo sapiens
catgcaaaaagaaatga

SEQ ID NO: 4880030 - DNA, 12 bp, Homo sapiens
catgcactgacc

SEQ ID NO: 4880031 - DNA, 18 bp, Homo sapiens
catgcataaatatgcagt

SEQ ID NO: 4880032 - DNA, 19 bp, Homo sapiens
catgcatgacagcctctat

SEQ ID NO: 4880033 - DNA, 19 bp, Homo sapiens
catgccaggaacctgtcct

SEQ ID NO: 4880034 - DNA, 14 bp, Homo sapiens
catgcccacctgcc

SEQ ID NO: 4880035 - DNA, 21 bp, Homo sapiens
catgcccggctaatttttgta

SEQ ID NO: 4880036 - DNA, 14 bp, Homo sapiens
catgcctgagagac

SEQ ID NO: 4880037 - DNA, 21 bp, Homo sapiens
catgcctgagagacatggctt

SEQ ID NO: 4880038 - DNA, 20 bp, Homo sapiens
catgcctgcccccctcatct

SEQ ID NO: 4880039 - DNA, 23 bp, Homo sapiens
catgcctgtccagcctgggcagc

SEQ ID NO: 4880040 - DNA, 14 bp, Homo sapiens
catgctaggatgcg

SEQ ID NO: 4880041 - DNA, 21 bp, Homo sapiens
catgctctgagaagaggagcc

SEQ ID NO: 4880042 - DNA, 13 bp, Homo sapiens
catgctggccagc

SEQ ID NO: 4880043 - DNA, 16 bp, Homo sapiens
catgctggccagcctg

SEQ ID NO: 4880044 - DNA, 20 bp, Homo sapiens
catgcttctcatcttgtgaa

SEQ ID NO: 4880045 - DNA, 21 bp, Homo sapiens
catgcttctcatcttgtgaaa

SEQ ID NO: 4880046 - DNA, 16 bp, Homo sapiens
catgcttcttccttac

SEQ ID NO: 4880047 - DNA, 14 bp, Homo sapiens
catgctttaaagtg

SEQ ID NO: 4880048 - DNA, 17 bp, Homo sapiens
catggaaacctgaaaaa

SEQ ID NO: 4880049 - DNA, 18 bp, Homo sapiens
catggaatggacatcctg

SEQ ID NO: 4880050 - DNA, 19 bp, Homo sapiens
catggaatggacatcctgt

SEQ ID NO: 4880051 - DNA, 21 bp, Homo sapiens
catggaccactgtttcttgct

SEQ ID NO: 4880052 - DNA, 22 bp, Homo sapiens
catggaccactgtttcttgctt

SEQ ID NO: 4880053 - DNA, 23 bp, Homo sapiens
catggaccactgtttcttgcttg

SEQ ID NO: 4880054 - DNA, 13 bp, Homo sapiens
catggactttata

SEQ ID NO: 4880055 - DNA, 17 bp, Homo sapiens
catggagccagctccct

SEQ ID NO: 4880056 - DNA, 13 bp, Homo sapiens
catggaggccctc

SEQ ID NO: 4880057 - DNA, 18 bp, Homo sapiens
catggaggccctcctgtg

SEQ ID NO: 4880058 - DNA, 20 bp, Homo sapiens
catggaggccctcctgtgct

SEQ ID NO: 4880059 - DNA, 17 bp, Homo sapiens
catggaggttctaaggc

SEQ ID NO: 4880060 - DNA, 21 bp, Homo sapiens
catggcagaataatctttggg

SEQ ID NO: 4880061 - DNA, 22 bp, Homo sapiens
catggcagaataatctttgggt

SEQ ID NO: 4880062 - DNA, 14 bp, Homo sapiens
catggccaggtggc

SEQ ID NO: 4880063 - DNA, 13 bp, Homo sapiens
catggcccctctg

SEQ ID NO: 4880064 - DNA, 16 bp, Homo sapiens
catggcccctctgacc

SEQ ID NO: 4880065 - DNA, 12 bp, Homo sapiens
catggccctggg

SEQ ID NO: 4880066 - DNA, 17 bp, Homo sapiens
catggcctatgcacata

SEQ ID NO: 4880067 - DNA, 16 bp, Homo sapiens
catggctaactggcga

SEQ ID NO: 4880068 - DNA, 18 bp, Homo sapiens
catggctttcagaaaacg

SEQ ID NO: 4880069 - DNA, 21 bp, Homo sapiens
catgggagctggttagaaatg

SEQ ID NO: 4880070 - DNA, 21 bp, Homo sapiens
catgggaggtgaaaggggcac

SEQ ID NO: 4880071 - DNA, 16 bp, Homo sapiens
catgggcctcctgtgt

SEQ ID NO: 4880072 - DNA, 17 bp, Homo sapiens
catgggcctcctgtgtg

SEQ ID NO: 4880073 - DNA, 10 bp, Homo sapiens
cattgaaatg

SEQ ID NO: 4880074 - DNA, 11 bp, Homo sapiens
cattgaaatgt

SEQ ID NO: 4880075 - DNA, 15 bp, Homo sapiens
cattgaacacaaact

SEQ ID NO: 4880076 - DNA, 13 bp, Homo sapiens
cattgacaaatct

SEQ ID NO: 4880077 - DNA, 16 bp, Homo sapiens
cattgacaagaactga

SEQ ID NO: 4880078 - DNA, 18 bp, Homo sapiens
cattgacgattccttctc

SEQ ID NO: 4880079 - DNA, 15 bp, Homo sapiens
cacccttcttttctc

SEQ ID NO: 4880080 - DNA, 16 bp, Homo sapiens
cacccttcttttctca

SEQ ID NO: 4880081 - DNA, 20 bp, Homo sapiens
cacccttcttttctcatgtg

SEQ ID NO: 4880082 - DNA, 15 bp, Homo sapiens
cacccttggcctgtc

SEQ ID NO: 4880083 - DNA, 18 bp, Homo sapiens
cacccttggcctgtctca

SEQ ID NO: 4880084 - DNA, 21 bp, Homo sapiens
cacccttggcctgtctcatcc

SEQ ID NO: 4880085 - DNA, 17 bp, Homo sapiens
caccgacgcgtctcctg

SEQ ID NO: 4880086 - DNA, 18 bp, Homo sapiens
caccgacgcgtctcctgt

SEQ ID NO: 4880087 - DNA, 23 bp, Homo sapiens
caccgccctccctccccagctcc

SEQ ID NO: 4880088 - DNA, 18 bp, Homo sapiens
caccgcttctgccttttc

SEQ ID NO: 4880089 - DNA, 14 bp, Homo sapiens
caccgggcactcag

SEQ ID NO: 4880090 - DNA, 13 bp, Homo sapiens
caccgggcctgga

SEQ ID NO: 4880091 - DNA, 21 bp, Homo sapiens
cacctaaaggtgtatttaaac

SEQ ID NO: 4880092 - DNA, 15 bp, Homo sapiens
cacctaagtctctgt

SEQ ID NO: 4880093 - DNA, 16 bp, Homo sapiens
cacctaagtctctgtg

SEQ ID NO: 4880094 - DNA, 21 bp, Homo sapiens
cacctaattcgatgaaggctg

SEQ ID NO: 4880095 - DNA, 22 bp, Homo sapiens
cacctaccatcagggacaggat

SEQ ID NO: 4880096 - DNA, 23 bp, Homo sapiens
cacctagaacactaactcaccag

SEQ ID NO: 4880097 - DNA, 16 bp, Homo sapiens
cacctagagccagacc

SEQ ID NO: 4880098 - DNA, 12 bp, Homo sapiens
cacctatgtgcc

SEQ ID NO: 4880099 - DNA, 13 bp, Homo sapiens
cacctcagcctcc

SEQ ID NO: 4880100 - DNA, 16 bp, Homo sapiens
cacctcagcctcccaa

SEQ ID NO: 4880101 - DNA, 23 bp, Homo sapiens
cacctcagttcccttggcctcag

SEQ ID NO: 4880102 - DNA, 17 bp, Homo sapiens
cacctccagcccgggag

SEQ ID NO: 4880103 - DNA, 18 bp, Homo sapiens
cacctccagcccgggagc

SEQ ID NO: 4880104 - DNA, 21 bp, Homo sapiens
cacctccattaaagtctgaat

SEQ ID NO: 4880105 - DNA, 10 bp, Homo sapiens
cacctcccag

SEQ ID NO: 4880106 - DNA, 19 bp, Homo sapiens
cacctccccacgccctccc

SEQ ID NO: 4880107 - DNA, 14 bp, Homo sapiens
cacctcctcatgta

SEQ ID NO: 4880108 - DNA, 14 bp, Homo sapiens
cacctcctgcctcg

SEQ ID NO: 4880109 - DNA, 12 bp, Homo sapiens
cacctctgccag

SEQ ID NO: 4880110 - DNA, 13 bp, Homo sapiens
cacctctgccaga

SEQ ID NO: 4880111 - DNA, 18 bp, Homo sapiens
cacctctgcggaccccag

SEQ ID NO: 4880112 - DNA, 20 bp, Homo sapiens
cacctctgcggaccccagct

SEQ ID NO: 4880113 - DNA, 22 bp, Homo sapiens
cacctctgcggaccccagctgt

SEQ ID NO: 4880114 - DNA, 17 bp, Homo sapiens
cacctctggactggcta

SEQ ID NO: 4880115 - DNA, 14 bp, Homo sapiens
cacctctgtgacct

SEQ ID NO: 4880116 - DNA, 19 bp, Homo sapiens
cacctctgtgacctcaggc

SEQ ID NO: 4880117 - DNA, 22 bp, Homo sapiens
cacctctgtgacctcaggcact

SEQ ID NO: 4880118 - DNA, 23 bp, Homo sapiens
cacctgcacttaaggcactctgt

SEQ ID NO: 4880119 - DNA, 15 bp, Homo sapiens
cacctgcagggctgc

SEQ ID NO: 4880120 - DNA, 16 bp, Homo sapiens
cacctgcctgcgtctt

SEQ ID NO: 4880121 - DNA, 14 bp, Homo sapiens
cacctgtaagaaac

SEQ ID NO: 4880122 - DNA, 19 bp, Homo sapiens
cacctgtgagtttaaagca

SEQ ID NO: 4880123 - DNA, 17 bp, Homo sapiens
caccttaccaactttct

SEQ ID NO: 4880124 - DNA, 18 bp, Homo sapiens
caccttaccaactttctg

SEQ ID NO: 4880125 - DNA, 13 bp, Homo sapiens
caccttagctggc

SEQ ID NO: 4880126 - DNA, 16 bp, Homo sapiens
caccttccagctcctg

SEQ ID NO: 4880127 - DNA, 15 bp, Homo sapiens
caccttcccttgcca

SEQ ID NO: 4880128 - DNA, 15 bp, Homo sapiens
caccttgacagggca

SEQ ID NO: 4880129 - DNA, 19 bp, Homo sapiens
caccttgacagggcacacc

SEQ ID NO: 4880130 - DNA, 15 bp, Homo sapiens
caccttggctcaagt

SEQ ID NO: 4880131 - DNA, 18 bp, Homo sapiens
caccttggctgcagggag

SEQ ID NO: 4880132 - DNA, 21 bp, Homo sapiens
caccttgtgtctgtacacgtg

SEQ ID NO: 4880133 - DNA, 22 bp, Homo sapiens
caccttgtgtgttccaagtttc

SEQ ID NO: 4880134 - DNA, 21 bp, Homo sapiens
cacgaaacttgttattgtgaa

SEQ ID NO: 4880135 - DNA, 22 bp, Homo sapiens
cacgaaagagagagaaacaaac

SEQ ID NO: 4880136 - DNA, 18 bp, Homo sapiens
cacgaatttgctggggaa

SEQ ID NO: 4880137 - DNA, 18 bp, Homo sapiens
cacgaccggggccagcac

SEQ ID NO: 4880138 - DNA, 14 bp, Homo sapiens
cacgatcctgccac

SEQ ID NO: 4880139 - DNA, 23 bp, Homo sapiens
cacgattttctccagctcagaac

SEQ ID NO: 4880140 - DNA, 15 bp, Homo sapiens
cacgcaacttgaaat

SEQ ID NO: 4880141 - DNA, 13 bp, Homo sapiens
cacgcacacacac

SEQ ID NO: 4880142 - DNA, 14 bp, Homo sapiens
cacgcacgcacaca

SEQ ID NO: 4880143 - DNA, 15 bp, Homo sapiens
cacgcacgcacacac

SEQ ID NO: 4880144 - DNA, 15 bp, Homo sapiens
cacgccactgcacta

SEQ ID NO: 4880145 - DNA, 20 bp, Homo sapiens
cacgccctcccctcccctgc

SEQ ID NO: 4880146 - DNA, 21 bp, Homo sapiens
cacgccctcccctcccctgct

SEQ ID NO: 4880147 - DNA, 21 bp, Homo sapiens
cacgcctctccctaggagaag

SEQ ID NO: 4880148 - DNA, 23 bp, Homo sapiens
cacgcgcgcacacacacacatac

SEQ ID NO: 4880149 - DNA, 16 bp, Homo sapiens
cacgcgtgcacacacc

SEQ ID NO: 4880150 - DNA, 16 bp, Homo sapiens
cacgctggagtgcagt

SEQ ID NO: 4880151 - DNA, 18 bp, Homo sapiens
cacgctggagtgcagtga

SEQ ID NO: 4880152 - DNA, 18 bp, Homo sapiens
cacgctgggtcctaatta

SEQ ID NO: 4880153 - DNA, 14 bp, Homo sapiens
cacggccaggccag

SEQ ID NO: 4880154 - DNA, 15 bp, Homo sapiens
cacggcgttgtacct

SEQ ID NO: 4880155 - DNA, 16 bp, Homo sapiens
cacggctaagaggctg

SEQ ID NO: 4880156 - DNA, 17 bp, Homo sapiens
cacggctcactgcagcc

SEQ ID NO: 4880157 - DNA, 13 bp, Homo sapiens
caggtgaaaatgt

SEQ ID NO: 4880158 - DNA, 18 bp, Homo sapiens
caggtgacatgtgaaacc

SEQ ID NO: 4880159 - DNA, 17 bp, Homo sapiens
caggtgatccacccacc

SEQ ID NO: 4880160 - DNA, 22 bp, Homo sapiens
caggtgatccacccacctcagc

SEQ ID NO: 4880161 - DNA, 21 bp, Homo sapiens
caggtgattggaccaggccat

SEQ ID NO: 4880162 - DNA, 18 bp, Homo sapiens
caggtgccagcctgaggc

SEQ ID NO: 4880163 - DNA, 15 bp, Homo sapiens
caggtgctattgtta

SEQ ID NO: 4880164 - DNA, 23 bp, Homo sapiens
caggtgctcccctgacagtccct

SEQ ID NO: 4880165 - DNA, 14 bp, Homo sapiens
caggtgctgccatc

SEQ ID NO: 4880166 - DNA, 18 bp, Homo sapiens
caggtggaaggcagacag

SEQ ID NO: 4880167 - DNA, 21 bp, Homo sapiens
caggtggccactccagacccc

SEQ ID NO: 4880168 - DNA, 22 bp, Homo sapiens
caggtggctctgaggtgcctgt

SEQ ID NO: 4880169 - DNA, 21 bp, Homo sapiens
caggtggtgagaaatttctgt

SEQ ID NO: 4880170 - DNA, 14 bp, Homo sapiens
caggtgtccctgca

SEQ ID NO: 4880171 - DNA, 15 bp, Homo sapiens
caggtgtccctgcac

SEQ ID NO: 4880172 - DNA, 16 bp, Homo sapiens
caggtgtgaaccacca

SEQ ID NO: 4880173 - DNA, 22 bp, Homo sapiens
cccagctaccctttttctccag

SEQ ID NO: 4880174 - DNA, 11 bp, Homo sapiens
cccagctcaat

SEQ ID NO: 4880175 - DNA, 13 bp, Homo sapiens
cccagctcagggg

SEQ ID NO: 4880176 - DNA, 20 bp, Homo sapiens
cccagctcaggggcagctca

SEQ ID NO: 4880177 - DNA, 18 bp, Homo sapiens
cccagctgtgagccttgg

SEQ ID NO: 4880178 - DNA, 19 bp, Homo sapiens
cccagctgtgagccttggc

SEQ ID NO: 4880179 - DNA, 21 bp, Homo sapiens
cccagctgtgctctggacagg

SEQ ID NO: 4880180 - DNA, 20 bp, Homo sapiens
cccaggaccatcttcccgag

SEQ ID NO: 4880181 - DNA, 18 bp, Homo sapiens
cccaggagggcatccata

SEQ ID NO: 4880182 - DNA, 11 bp, Homo sapiens
cccaggcaggt

SEQ ID NO: 4880183 - DNA, 11 bp, Homo sapiens
cccaggcccct

SEQ ID NO: 4880184 - DNA, 18 bp, Homo sapiens
cccaggcccctgccaccc

SEQ ID NO: 4880185 - DNA, 21 bp, Homo sapiens
cccaggcccctgccaccctgg

SEQ ID NO: 4880186 - DNA, 17 bp, Homo sapiens
cccaggccggccagcct

SEQ ID NO: 4880187 - DNA, 21 bp, Homo sapiens
cccaggccggggtggagcatg

SEQ ID NO: 4880188 - DNA, 21 bp, Homo sapiens
cccaggctccgcccttagtcc

SEQ ID NO: 4880189 - DNA, 21 bp, Homo sapiens
cccaggctggacatgctgact

SEQ ID NO: 4880190 - DNA, 19 bp, Homo sapiens
cccaggctggcgtgcagtg

SEQ ID NO: 4880191 - DNA, 20 bp, Homo sapiens
cccaggctggcgtgcagtgg

SEQ ID NO: 4880192 - DNA, 23 bp, Homo sapiens
cccaggctgtgcagcgcagctgg

SEQ ID NO: 4880193 - DNA, 12 bp, Homo sapiens
cccagggcaccc

SEQ ID NO: 4880194 - DNA, 17 bp, Homo sapiens
cccagggctctgcccca

SEQ ID NO: 4880195 - DNA, 23 bp, Homo sapiens
cccagggtcttccctacctcagg

SEQ ID NO: 4880196 - DNA, 21 bp, Homo sapiens
cccaggtggaaggcagacagc

SEQ ID NO: 4880197 - DNA, 23 bp, Homo sapiens
cccaggtggaaggcagacagcag

SEQ ID NO: 4880198 - DNA, 21 bp, Homo sapiens
cccaggtgttaacattccaag

SEQ ID NO: 4880199 - DNA, 19 bp, Homo sapiens
cccagtccaaatgtcctcc

SEQ ID NO: 4880200 - DNA, 23 bp, Homo sapiens
cccagtccaaatgtcctccagaa

SEQ ID NO: 4880201 - DNA, 15 bp, Homo sapiens
cccagtctctggcag

SEQ ID NO: 4880202 - DNA, 23 bp, Homo sapiens
cccagtgagtctctggggcaggc

SEQ ID NO: 4880203 - DNA, 21 bp, Homo sapiens
cccagtgcccacaggatcagt

SEQ ID NO: 4880204 - DNA, 19 bp, Homo sapiens
cccagtgtatgtcttgtat

SEQ ID NO: 4880205 - DNA, 19 bp, Homo sapiens
cccagttcaggagtcccaa

SEQ ID NO: 4880206 - DNA, 14 bp, Homo sapiens
cccagttgggtgga

SEQ ID NO: 4880207 - DNA, 15 bp, Homo sapiens
cccatagaaacatga

SEQ ID NO: 4880208 - DNA, 23 bp, Homo sapiens
cccatattggcatggatttctgt

SEQ ID NO: 4880209 - DNA, 22 bp, Homo sapiens
cccatcatgcccggtcccaccc

SEQ ID NO: 4880210 - DNA, 14 bp, Homo sapiens
cccatccagttcat

SEQ ID NO: 4880211 - DNA, 21 bp, Homo sapiens
cccatccagttcatgagaatc

SEQ ID NO: 4880212 - DNA, 15 bp, Homo sapiens
cccatccctccccag

SEQ ID NO: 4880213 - DNA, 17 bp, Homo sapiens
cccatccctgcctggtc

SEQ ID NO: 4880214 - DNA, 18 bp, Homo sapiens
cccatctcggagcatccc

SEQ ID NO: 4880215 - DNA, 13 bp, Homo sapiens
cccatctctccct

SEQ ID NO: 4880216 - DNA, 16 bp, Homo sapiens
cccatgagcctcagca

SEQ ID NO: 4880217 - DNA, 22 bp, Homo sapiens
cccatgagcctcagcatcctgg

SEQ ID NO: 4880218 - DNA, 19 bp, Homo sapiens
cccatgcaggccctttgaa

SEQ ID NO: 4880219 - DNA, 18 bp, Homo sapiens
cccatgccacgttccaca

SEQ ID NO: 4880220 - DNA, 19 bp, Homo sapiens
cccatgcctgtccagcctg

SEQ ID NO: 4880221 - DNA, 20 bp, Homo sapiens
cccatgcctgtccagcctgg

SEQ ID NO: 4880222 - DNA, 16 bp, Homo sapiens
cccatggacactccag

SEQ ID NO: 4880223 - DNA, 22 bp, Homo sapiens
cccatggacactccagtgccag

SEQ ID NO: 4880224 - DNA, 15 bp, Homo sapiens
cccatggccctgtgc

SEQ ID NO: 4880225 - DNA, 22 bp, Homo sapiens
cccatgggttgtgtgtttattt

SEQ ID NO: 4880226 - DNA, 15 bp, Homo sapiens
cccatgtagccccct

SEQ ID NO: 4880227 - DNA, 23 bp, Homo sapiens
cccatgtatttatctctatttaa

SEQ ID NO: 4880228 - DNA, 20 bp, Homo sapiens
cccattctgcctgcccaggc

SEQ ID NO: 4880229 - DNA, 22 bp, Homo sapiens
cccattctgcctgcccaggccc

SEQ ID NO: 4880230 - DNA, 12 bp, Homo sapiens
cccattcttcct

SEQ ID NO: 4880231 - DNA, 17 bp, Homo sapiens
cccattggtgttgtcat

SEQ ID NO: 4880232 - DNA, 16 bp, Homo sapiens
cccatttgtgccagag

SEQ ID NO: 4880233 - DNA, 20 bp, Homo sapiens
cccatttttatatcgatctc

SEQ ID NO: 4880234 - DNA, 13 bp, Homo sapiens
ccccaacccccac

SEQ ID NO: 4880235 - DNA, 18 bp, Homo sapiens
ccccaactctgagcccat

SEQ ID NO: 4880236 - DNA, 12 bp, Homo sapiens
ccccacacagct

SEQ ID NO: 4880237 - DNA, 14 bp, Homo sapiens
ccccacacctcagt

SEQ ID NO: 4880238 - DNA, 16 bp, Homo sapiens
ccccacacctcagttc

SEQ ID NO: 4880239 - DNA, 20 bp, Homo sapiens
ccccacccccagctcaatgg

SEQ ID NO: 4880240 - DNA, 13 bp, Homo sapiens
ccccacccctacc

SEQ ID NO: 4880241 - DNA, 13 bp, Homo sapiens
ccccacctgcagg

SEQ ID NO: 4880242 - DNA, 17 bp, Homo sapiens
ccccacgagggtcagga

SEQ ID NO: 4880243 - DNA, 22 bp, Homo sapiens
ccccacggggcctcgggacctc

SEQ ID NO: 4880244 - DNA, 18 bp, Homo sapiens
ccccactcaccagtgtcc

SEQ ID NO: 4880245 - DNA, 15 bp, Homo sapiens
ccccactgacagcct

SEQ ID NO: 4880246 - DNA, 11 bp, Homo sapiens
ccccactgatg

SEQ ID NO: 4880247 - DNA, 14 bp, Homo sapiens
ccccactgatgctg

SEQ ID NO: 4880248 - DNA, 19 bp, Homo sapiens
ccccactgccagcagcagc

SEQ ID NO: 4880249 - DNA, 11 bp, Homo sapiens
ccccagagctg

SEQ ID NO: 4880250 - DNA, 12 bp, Homo sapiens
ccccagagctgt

SEQ ID NO: 4880251 - DNA, 22 bp, Homo sapiens
ccccagattgcaacaggctggg

SEQ ID NO: 4880252 - DNA, 19 bp, Homo sapiens
ccccagcaagtgagagctg

SEQ ID NO: 4880253 - DNA, 23 bp, Homo sapiens
ccccagcagttgaatgacaacag

SEQ ID NO: 4880254 - DNA, 14 bp, Homo sapiens
ccccagcccaaagg

SEQ ID NO: 4880255 - DNA, 11 bp, Homo sapiens
ccccagcccag

SEQ ID NO: 4880256 - DNA, 12 bp, Homo sapiens
ccccagcccagg

SEQ ID NO: 4880257 - DNA, 22 bp, Homo sapiens
ccccagcccctagcccaggaga

SEQ ID NO: 4880258 - DNA, 20 bp, Homo sapiens
ccccagcccctcccccatct

SEQ ID NO: 4880259 - DNA, 23 bp, Homo sapiens
ccccagcccctcccccatctccc

SEQ ID NO: 4880260 - DNA, 19 bp, Homo sapiens
ccccagccctggctctgca

SEQ ID NO: 4880261 - DNA, 14 bp, Homo sapiens
ccccagcctctggc

SEQ ID NO: 4880262 - DNA, 11 bp, Homo sapiens
ccccagctacc

SEQ ID NO: 4880263 - DNA, 16 bp, Homo sapiens
cccggcaccctctggc

SEQ ID NO: 4880264 - DNA, 13 bp, Homo sapiens
cccggcaggccct

SEQ ID NO: 4880265 - DNA, 16 bp, Homo sapiens
cccggcaggccctgca

SEQ ID NO: 4880266 - DNA, 21 bp, Homo sapiens
cccggccccctggtctctggt

SEQ ID NO: 4880267 - DNA, 16 bp, Homo sapiens
cccggcccctgctggt

SEQ ID NO: 4880268 - DNA, 11 bp, Homo sapiens
cccggctccag

SEQ ID NO: 4880269 - DNA, 12 bp, Homo sapiens
cccggctccagg

SEQ ID NO: 4880270 - DNA, 13 bp, Homo sapiens
cccggctccaggc

SEQ ID NO: 4880271 - DNA, 16 bp, Homo sapiens
cccggctccaggctcc

SEQ ID NO: 4880272 - DNA, 15 bp, Homo sapiens
cccgggagggcggca

SEQ ID NO: 4880273 - DNA, 19 bp, Homo sapiens
cccgggcgcggccagcccc

SEQ ID NO: 4880274 - DNA, 16 bp, Homo sapiens
cccgggctctctgctg

SEQ ID NO: 4880275 - DNA, 19 bp, Homo sapiens
cccggtggcggccccagca

SEQ ID NO: 4880276 - DNA, 18 bp, Homo sapiens
cccgtggccatccctgtg

SEQ ID NO: 4880277 - DNA, 21 bp, Homo sapiens
ccctaaccccttccagatcac

SEQ ID NO: 4880278 - DNA, 15 bp, Homo sapiens
ccctaagccagcctg

SEQ ID NO: 4880279 - DNA, 18 bp, Homo sapiens
ccctacacccagacccca

SEQ ID NO: 4880280 - DNA, 23 bp, Homo sapiens
ccctacccctggctgtactgctc

SEQ ID NO: 4880281 - DNA, 23 bp, Homo sapiens
ccctactattcagtggcgagaaa

SEQ ID NO: 4880282 - DNA, 22 bp, Homo sapiens
ccctactcattggggttccgca

SEQ ID NO: 4880283 - DNA, 15 bp, Homo sapiens
ccctactccctgcag

SEQ ID NO: 4880284 - DNA, 19 bp, Homo sapiens
ccctactccctgcagatgc

SEQ ID NO: 4880285 - DNA, 19 bp, Homo sapiens
ccctacttcttttgctctt

SEQ ID NO: 4880286 - DNA, 16 bp, Homo sapiens
cccagcccctagaaac

SEQ ID NO: 4880287 - DNA, 21 bp, Homo sapiens
cccagcccctagaaacccaag

SEQ ID NO: 4880288 - DNA, 19 bp, Homo sapiens
cccagcccctagcccagga

SEQ ID NO: 4880289 - DNA, 20 bp, Homo sapiens
cccagcccggaccttggcag

SEQ ID NO: 4880290 - DNA, 12 bp, Homo sapiens
cccagccctggc

SEQ ID NO: 4880291 - DNA, 12 bp, Homo sapiens
cccagcctcagt

SEQ ID NO: 4880292 - DNA, 16 bp, Homo sapiens
cccagcctcagtcctc

SEQ ID NO: 4880293 - DNA, 20 bp, Homo sapiens
cccagcctccaagctccatc

SEQ ID NO: 4880294 - DNA, 19 bp, Homo sapiens
cctcccctcccctgctgca

SEQ ID NO: 4880295 - DNA, 15 bp, Homo sapiens
cctcccctgccctgg

SEQ ID NO: 4880296 - DNA, 13 bp, Homo sapiens
cctcccctgcctt

SEQ ID NO: 4880297 - DNA, 14 bp, Homo sapiens
cctcccctgccttg

SEQ ID NO: 4880298 - DNA, 15 bp, Homo sapiens
cctcccctgccttgc

SEQ ID NO: 4880299 - DNA, 13 bp, Homo sapiens
cctcccctgctgc

SEQ ID NO: 4880300 - DNA, 14 bp, Homo sapiens
cctcccctgctgca

SEQ ID NO: 4880301 - DNA, 16 bp, Homo sapiens
cctcccctgctgcagg

SEQ ID NO: 4880302 - DNA, 20 bp, Homo sapiens
cctcccctgctgcaggggct

SEQ ID NO: 4880303 - DNA, 17 bp, Homo sapiens
cctcccgaatagctggg

SEQ ID NO: 4880304 - DNA, 19 bp, Homo sapiens
cctcccgaatagctgggac

SEQ ID NO: 4880305 - DNA, 18 bp, Homo sapiens
cctcccgagtagctggga

SEQ ID NO: 4880306 - DNA, 19 bp, Homo sapiens
cctcccgagtagctgggac

SEQ ID NO: 4880307 - DNA, 18 bp, Homo sapiens
cctcccgccccttcccac

SEQ ID NO: 4880308 - DNA, 13 bp, Homo sapiens
cctcccggtgccc

SEQ ID NO: 4880309 - DNA, 20 bp, Homo sapiens
cctccctctctcttctgctc

SEQ ID NO: 4880310 - DNA, 15 bp, Homo sapiens
cctccctcttgtttt

SEQ ID NO: 4880311 - DNA, 13 bp, Homo sapiens
cctccctgcccag

SEQ ID NO: 4880312 - DNA, 13 bp, Homo sapiens
cctccctgcccct

SEQ ID NO: 4880313 - DNA, 21 bp, Homo sapiens
cctccctgcccctcccttcaa

SEQ ID NO: 4880314 - DNA, 23 bp, Homo sapiens
cctccctggagtgtggctgagga

SEQ ID NO: 4880315 - DNA, 12 bp, Homo sapiens
cctccctggctc

SEQ ID NO: 4880316 - DNA, 16 bp, Homo sapiens
cctccctggctcccat

SEQ ID NO: 4880317 - DNA, 20 bp, Homo sapiens
cctccctggctcccatgacc

SEQ ID NO: 4880318 - DNA, 20 bp, Homo sapiens
cctcccttccgaccctctgg

SEQ ID NO: 4880319 - DNA, 20 bp, Homo sapiens
cctccgccaatgcacggcct

SEQ ID NO: 4880320 - DNA, 21 bp, Homo sapiens
cctccgccaatgcacggcctc

SEQ ID NO: 4880321 - DNA, 19 bp, Homo sapiens
cctccggttgcatactgga

SEQ ID NO: 4880322 - DNA, 19 bp, Homo sapiens
cctcctatcagaagtttct

SEQ ID NO: 4880323 - DNA, 15 bp, Homo sapiens
cctcctcacctctgg

SEQ ID NO: 4880324 - DNA, 19 bp, Homo sapiens
cctcctccaaaggccccct

SEQ ID NO: 4880325 - DNA, 21 bp, Homo sapiens
cctcctccccaactgtggggg

SEQ ID NO: 4880326 - DNA, 19 bp, Homo sapiens
cctcctctaaggttgggca

SEQ ID NO: 4880327 - DNA, 14 bp, Homo sapiens
cctcctctgtctgc

SEQ ID NO: 4880328 - DNA, 17 bp, Homo sapiens
cctcctctgtctgccct

SEQ ID NO: 4880329 - DNA, 14 bp, Homo sapiens
cctcctcttcaccc

SEQ ID NO: 4880330 - DNA, 16 bp, Homo sapiens
cctcctcttcaccccg

SEQ ID NO: 4880331 - DNA, 19 bp, Homo sapiens
cctcctcttcaccccggca

SEQ ID NO: 4880332 - DNA, 14 bp, Homo sapiens
cctcctctttctct

SEQ ID NO: 4880333 - DNA, 15 bp, Homo sapiens
cctcctctttctctc

SEQ ID NO: 4880334 - DNA, 18 bp, Homo sapiens
cctcctggaaccttgctg

SEQ ID NO: 4880335 - DNA, 22 bp, Homo sapiens
cctcctggaaccttgctgtcct

SEQ ID NO: 4880336 - DNA, 13 bp, Homo sapiens
cctcctgtgtgtg

SEQ ID NO: 4880337 - DNA, 22 bp, Homo sapiens
cctcctgtgtgtgcgcctacag

SEQ ID NO: 4880338 - DNA, 17 bp, Homo sapiens
cctccttggtgcctggc

SEQ ID NO: 4880339 - DNA, 12 bp, Homo sapiens
cctcctttctcc

SEQ ID NO: 4880340 - DNA, 13 bp, Homo sapiens
cctcctttctgtg

SEQ ID NO: 4880341 - DNA, 16 bp, Homo sapiens
cctcctttctgtgccc

SEQ ID NO: 4880342 - DNA, 18 bp, Homo sapiens
cctcgaagcgcgccactc

SEQ ID NO: 4880343 - DNA, 15 bp, Homo sapiens
cctcgccctttctta

SEQ ID NO: 4880344 - DNA, 15 bp, Homo sapiens
cctcgcctgtggagc

SEQ ID NO: 4880345 - DNA, 21 bp, Homo sapiens
cctcgcctgtggagctcagcc

SEQ ID NO: 4880346 - DNA, 16 bp, Homo sapiens
cctctacccaaaccct

SEQ ID NO: 4880347 - DNA, 19 bp, Homo sapiens
cctctacccaaaccctagg

SEQ ID NO: 4880348 - DNA, 16 bp, Homo sapiens
cctctactttccaggc

SEQ ID NO: 4880349 - DNA, 22 bp, Homo sapiens
cctctagctgtgggggtgaggg

SEQ ID NO: 4880350 - DNA, 18 bp, Homo sapiens
cctctatacatctctccc

SEQ ID NO: 4880351 - DNA, 13 bp, Homo sapiens
cctctcacacaca

SEQ ID NO: 4880352 - DNA, 16 bp, Homo sapiens
cctctcagctccaggt

SEQ ID NO: 4880353 - DNA, 13 bp, Homo sapiens
cctctccactgcc

SEQ ID NO: 4880354 - DNA, 16 bp, Homo sapiens
cctctccactgccttc

SEQ ID NO: 4880355 - DNA, 15 bp, Homo sapiens
cctctccatcctgct

SEQ ID NO: 4880356 - DNA, 14 bp, Homo sapiens
cctctccccacccc

SEQ ID NO: 4880357 - DNA, 15 bp, Homo sapiens
cctctccccagcaag

SEQ ID NO: 4880358 - DNA, 12 bp, Homo sapiens
cctctcccctcc

SEQ ID NO: 4880359 - DNA, 17 bp, Homo sapiens
cctctcccttaccctgg

SEQ ID NO: 4880360 - DNA, 21 bp, Homo sapiens
cctctccttcgtatcccgagt

SEQ ID NO: 4880361 - DNA, 14 bp, Homo sapiens
cctctcctttgaaa

SEQ ID NO: 4880362 - DNA, 16 bp, Homo sapiens
cctctctccctctccc

SEQ ID NO: 4880363 - DNA, 16 bp, Homo sapiens
cctctctcttctgctc

SEQ ID NO: 4880364 - DNA, 18 bp, Homo sapiens
cctctgaccaacaggctg

SEQ ID NO: 4880365 - DNA, 20 bp, Homo sapiens
cctctgacccctcctcactg

SEQ ID NO: 4880366 - DNA, 17 bp, Homo sapiens
cctctgacctgcactgg

SEQ ID NO: 4880367 - DNA, 18 bp, Homo sapiens
cctctgatatgggactga

SEQ ID NO: 4880368 - DNA, 13 bp, Homo sapiens
cctctgccacact

SEQ ID NO: 4880369 - DNA, 13 bp, Homo sapiens
cctctgccaccag

SEQ ID NO: 4880370 - DNA, 24 bp, Homo sapiens
cctctgccaccagagaccgtcctc

SEQ ID NO: 4880371 - DNA, 13 bp, Homo sapiens
cctcttccccaga

SEQ ID NO: 4880372 - DNA, 17 bp, Homo sapiens
cctcttctattttgtaa

SEQ ID NO: 4880373 - DNA, 18 bp, Homo sapiens
cctcttctattttgtaaa

SEQ ID NO: 4880374 - DNA, 15 bp, Homo sapiens
cctcttctggctcaa

SEQ ID NO: 4880375 - DNA, 15 bp, Homo sapiens
cctcttgctgtctct

SEQ ID NO: 4880376 - DNA, 16 bp, Homo sapiens
cctcttgctgtctctg

SEQ ID NO: 4880377 - DNA, 18 bp, Homo sapiens
cctcttgctgtctctgct

SEQ ID NO: 4880378 - DNA, 12 bp, Homo sapiens
cctcttggagac

SEQ ID NO: 4880379 - DNA, 12 bp, Homo sapiens
cctctttctctc

SEQ ID NO: 4880380 - DNA, 13 bp, Homo sapiens
cctctttctctcc

SEQ ID NO: 4880381 - DNA, 15 bp, Homo sapiens
cctctttctctcccc

SEQ ID NO: 4880382 - DNA, 18 bp, Homo sapiens
cctctttctctccccaac

SEQ ID NO: 4880383 - DNA, 13 bp, Homo sapiens
cctctttctcttt

SEQ ID NO: 4880384 - DNA, 20 bp, Homo sapiens
cctctttctctttcttcctt

SEQ ID NO: 4880385 - DNA, 15 bp, Homo sapiens
cctctttcttataat

SEQ ID NO: 4880386 - DNA, 18 bp, Homo sapiens
cctctttggctcccctgt

SEQ ID NO: 4880387 - DNA, 21 bp, Homo sapiens
cctcttttcttactcctcctc

SEQ ID NO: 4880388 - DNA, 23 bp, Homo sapiens
cctgaaaatgtttttctgccagg

SEQ ID NO: 4880389 - DNA, 19 bp, Homo sapiens
cctgaaacacgaaacttgt

SEQ ID NO: 4880390 - DNA, 20 bp, Homo sapiens
cctgaaacctagtactgccc

SEQ ID NO: 4880391 - DNA, 15 bp, Homo sapiens
cctgaaattccaaag

SEQ ID NO: 4880392 - DNA, 18 bp, Homo sapiens
cctgaaattccaaagtct

SEQ ID NO: 4880393 - DNA, 14 bp, Homo sapiens
cctgaaatttcaga

SEQ ID NO: 4880394 - DNA, 21 bp, Homo sapiens
cctgaacaagaattggaagct

SEQ ID NO: 4880395 - DNA, 16 bp, Homo sapiens
cctgaaccgcacagct

SEQ ID NO: 4880396 - DNA, 18 bp, Homo sapiens
cctgaaccgcacagctca

SEQ ID NO: 4880397 - DNA, 20 bp, Homo sapiens
cctgaaccgcacagctcagg

SEQ ID NO: 4880398 - DNA, 14 bp, Homo sapiens
cctgaagactgagg

SEQ ID NO: 4880399 - DNA, 17 bp, Homo sapiens
cctgaagccagccttct

SEQ ID NO: 4880400 - DNA, 16 bp, Homo sapiens
cctgaagtcacacagt

SEQ ID NO: 4880401 - DNA, 20 bp, Homo sapiens
cctgaagtcacacagtgagt

SEQ ID NO: 4880402 - DNA, 21 bp, Homo sapiens
cctgaatgtttaaagatcatg

SEQ ID NO: 4880403 - DNA, 18 bp, Homo sapiens
cctgacatcacagcagcc

SEQ ID NO: 4880404 - DNA, 19 bp, Homo sapiens
cctgacatcacagcagcct

SEQ ID NO: 4880405 - DNA, 20 bp, Homo sapiens
cctgacatcacagcagcctc

SEQ ID NO: 4880406 - DNA, 12 bp, Homo sapiens
cctgacccgtct

SEQ ID NO: 4880407 - DNA, 12 bp, Homo sapiens
cctgacctcttg

SEQ ID NO: 4880408 - DNA, 13 bp, Homo sapiens
cctgacctcttgc

SEQ ID NO: 4880409 - DNA, 19 bp, Homo sapiens
cctgacctcttgctgtctc

SEQ ID NO: 4880410 - DNA, 24 bp, Homo sapiens
cctgacctcttgctgtctctgctc

SEQ ID NO: 4880411 - DNA, 17 bp, Homo sapiens
cctgaccttccttcctg

SEQ ID NO: 4880412 - DNA, 16 bp, Homo sapiens
cctgacgaaactggcc

SEQ ID NO: 4880413 - DNA, 12 bp, Homo sapiens
cctgactctgcc

SEQ ID NO: 4880414 - DNA, 13 bp, Homo sapiens
cctgactctgccc

SEQ ID NO: 4880415 - DNA, 15 bp, Homo sapiens
cctgactctgccccc

SEQ ID NO: 4880416 - DNA, 16 bp, Homo sapiens
cctgactctgccccct

SEQ ID NO: 4880417 - DNA, 17 bp, Homo sapiens
cctgagaagctgctcca

SEQ ID NO: 4880418 - DNA, 19 bp, Homo sapiens
cctgagaagctgctccagg

SEQ ID NO: 4880419 - DNA, 12 bp, Homo sapiens
cctgagaccaca

SEQ ID NO: 4880420 - DNA, 15 bp, Homo sapiens
cctgagagaattggc

SEQ ID NO: 4880421 - DNA, 15 bp, Homo sapiens
cctgagaggggaagc

SEQ ID NO: 4880422 - DNA, 20 bp, Homo sapiens
cctgagaggggaagcggccc

SEQ ID NO: 4880423 - DNA, 18 bp, Homo sapiens
cctgagcaactcttgatt

SEQ ID NO: 4880424 - DNA, 13 bp, Homo sapiens
cctgagccaagga

SEQ ID NO: 4880425 - DNA, 22 bp, Homo sapiens
cctgagccccgccctcttcctg

SEQ ID NO: 4880426 - DNA, 22 bp, Homo sapiens
cctgagccctactccctgcaga

SEQ ID NO: 4880427 - DNA, 13 bp, Homo sapiens
cctgagctcactc

SEQ ID NO: 4880428 - DNA, 20 bp, Homo sapiens
cctgaggctttggatttgac

SEQ ID NO: 4880429 - DNA, 22 bp, Homo sapiens
cctgaggctttggatttgacat

SEQ ID NO: 4880430 - DNA, 23 bp, Homo sapiens
cctgagggaggacctggggcaca

SEQ ID NO: 4880431 - DNA, 18 bp, Homo sapiens
cctgaggggcatctgccc

SEQ ID NO: 4880432 - DNA, 22 bp, Homo sapiens
cctgaggggcatctgcccctcc

SEQ ID NO: 4880433 - DNA, 20 bp, Homo sapiens
cctgaggtgaaagggagcta

SEQ ID NO: 4880434 - DNA, 14 bp, Homo sapiens
cctgagttcatcca

SEQ ID NO: 4880435 - DNA, 14 bp, Homo sapiens
cctgatctcttcct

SEQ ID NO: 4880436 - DNA, 16 bp, Homo sapiens
cctgatgctccctccc

SEQ ID NO: 4880437 - DNA, 22 bp, Homo sapiens
cctgcaaaatttgatgccagga

SEQ ID NO: 4880438 - DNA, 20 bp, Homo sapiens
cctgcaaacagaacagggtc

SEQ ID NO: 4880439 - DNA, 21 bp, Homo sapiens
cctgcaagcctgtctgagact

SEQ ID NO: 4880440 - DNA, 15 bp, Homo sapiens
cctgcaaggcccaca

SEQ ID NO: 4880441 - DNA, 19 bp, Homo sapiens
cctgcaaggcccacaggag

SEQ ID NO: 4880442 - DNA, 22 bp, Homo sapiens
cctgcacaaagcccttccatgt

SEQ ID NO: 4880443 - DNA, 10 bp, Homo sapiens
cctgcacaca

SEQ ID NO: 4880444 - DNA, 11 bp, Homo sapiens
cctgcacacaa

SEQ ID NO: 4880445 - DNA, 19 bp, Homo sapiens
cctgcacagtgtcccccag

SEQ ID NO: 4880446 - DNA, 14 bp, Homo sapiens
cctgcactaaagcc

SEQ ID NO: 4880447 - DNA, 19 bp, Homo sapiens
cctgcactaaagccagcct

SEQ ID NO: 4880448 - DNA, 19 bp, Homo sapiens
cctgcactttgatgtcatg

SEQ ID NO: 4880449 - DNA, 14 bp, Homo sapiens
cctgcagatgccac

SEQ ID NO: 4880450 - DNA, 21 bp, Homo sapiens
cctgcagcacggacaataaac

SEQ ID NO: 4880451 - DNA, 23 bp, Homo sapiens
cctgcagcacggacaataaacct

SEQ ID NO: 4880452 - DNA, 18 bp, Homo sapiens
cctgcagcatggtccctg

SEQ ID NO: 4880453 - DNA, 13 bp, Homo sapiens
cctgcagccagct

SEQ ID NO: 4880454 - DNA, 15 bp, Homo sapiens
cctgcagggccaagc

SEQ ID NO: 4880455 - DNA, 13 bp, Homo sapiens
cctgcagggctgc

SEQ ID NO: 4880456 - DNA, 20 bp, Homo sapiens
cctgcagtactttacctcct

SEQ ID NO: 4880457 - DNA, 19 bp, Homo sapiens
cctgcagtgttcgcttggc

SEQ ID NO: 4880458 - DNA, 23 bp, Homo sapiens
cctgcatccccttggctgtgagg

SEQ ID NO: 4880459 - DNA, 24 bp, Homo sapiens
cctgcatccccttggctgtgaggc

SEQ ID NO: 4880460 - DNA, 13 bp, Homo sapiens
cctgccaccctgg

SEQ ID NO: 4880461 - DNA, 16 bp, Homo sapiens
cctgccaccctgggga

SEQ ID NO: 4880462 - DNA, 13 bp, Homo sapiens
cctgccaccctgt

SEQ ID NO: 4880463 - DNA, 14 bp, Homo sapiens
cctgccaccctgta

SEQ ID NO: 4880464 - DNA, 14 bp, Homo sapiens
cctgccacctccct

SEQ ID NO: 4880465 - DNA, 14 bp, Homo sapiens
cctgccagagggga

SEQ ID NO: 4880466 - DNA, 18 bp, Homo sapiens
cctgccagaggggaagga

SEQ ID NO: 4880467 - DNA, 12 bp, Homo sapiens
cctgccagcccc

SEQ ID NO: 4880468 - DNA, 19 bp, Homo sapiens
cctgccatgccaggaacct

SEQ ID NO: 4880469 - DNA, 16 bp, Homo sapiens
cctgcccaagcccagg

SEQ ID NO: 4880470 - DNA, 23 bp, Homo sapiens
cctgcccaatgagactctagggt

SEQ ID NO: 4880471 - DNA, 17 bp, Homo sapiens
cctgcccactgctgcag

SEQ ID NO: 4880472 - DNA, 21 bp, Homo sapiens
cctgcccaggcccctgccacc

SEQ ID NO: 4880473 - DNA, 22 bp, Homo sapiens
cctgcccaggcccctgccaccc

SEQ ID NO: 4880474 - DNA, 15 bp, Homo sapiens
cctgcccaggccggc

SEQ ID NO: 4880475 - DNA, 18 bp, Homo sapiens
cctgcccaggccggccag

SEQ ID NO: 4880476 - DNA, 20 bp, Homo sapiens
cctgccccaatccctttatt

SEQ ID NO: 4880477 - DNA, 15 bp, Homo sapiens
cctgcccctctcccg

SEQ ID NO: 4880478 - DNA, 17 bp, Homo sapiens
cctgcccctctttctct

SEQ ID NO: 4880479 - DNA, 20 bp, Homo sapiens
cctgcccctctttctctttc

SEQ ID NO: 4880480 - DNA, 13 bp, Homo sapiens
cctgcccgcacag

SEQ ID NO: 4880481 - DNA, 15 bp, Homo sapiens
cctgcccgcacagca

SEQ ID NO: 4880482 - DNA, 12 bp, Homo sapiens
cctgccctggtc

SEQ ID NO: 4880483 - DNA, 17 bp, Homo sapiens
gtgtcatttcattccat

SEQ ID NO: 4880484 - DNA, 17 bp, Homo sapiens
gtgtccacctgtgggtg

SEQ ID NO: 4880485 - DNA, 20 bp, Homo sapiens
gtgtcccaaaaagaaaggag

SEQ ID NO: 4880486 - DNA, 23 bp, Homo sapiens
gtgtccctgcacttgcagactct

SEQ ID NO: 4880487 - DNA, 15 bp, Homo sapiens
gtgtccttccctgca

SEQ ID NO: 4880488 - DNA, 14 bp, Homo sapiens
gtgtctaaaaacac

SEQ ID NO: 4880489 - DNA, 17 bp, Homo sapiens
gtgtctaaaaacaccaa

SEQ ID NO: 4880490 - DNA, 20 bp, Homo sapiens
gtgtctaagattctagatca

SEQ ID NO: 4880491 - DNA, 23 bp, Homo sapiens
gtgtctcaatctgatctgagtga

SEQ ID NO: 4880492 - DNA, 12 bp, Homo sapiens
gtgtctgtacac

SEQ ID NO: 4880493 - DNA, 21 bp, Homo sapiens
gtgtctgtacacgtgtcctgt

SEQ ID NO: 4880494 - DNA, 11 bp, Homo sapiens
tttttacattt

SEQ ID NO: 4880495 - DNA, 17 bp, Homo sapiens
tttttactcattgaaat

SEQ ID NO: 4880496 - DNA, 21 bp, Homo sapiens
tttttactcattgaaatgtca

SEQ ID NO: 4880497 - DNA, 13 bp, Homo sapiens
tttttagtaatct

SEQ ID NO: 4880498 - DNA, 16 bp, Homo sapiens
tttttagtaatctgta

SEQ ID NO: 4880499 - DNA, 15 bp, Homo sapiens
tttttataccattca

SEQ ID NO: 4880500 - DNA, 12 bp, Homo sapiens
tttttatgtgat

SEQ ID NO: 4880501 - DNA, 22 bp, Homo sapiens
tttttattgctagtatttgaat

SEQ ID NO: 4880502 - DNA, 18 bp, Homo sapiens
tttttatttatatgtact

SEQ ID NO: 4880503 - DNA, 23 bp, Homo sapiens
tttcaacaaatatcttgtgttgt

SEQ ID NO: 4880504 - DNA, 16 bp, Homo sapiens
tttcaacgcagccctg

SEQ ID NO: 4880505 - DNA, 21 bp, Homo sapiens
tttcaagaaaaaataaatgga

SEQ ID NO: 4880506 - DNA, 20 bp, Homo sapiens
tttcaagcagcatcttctgg

SEQ ID NO: 4880507 - DNA, 17 bp, Homo sapiens
tttcaaggaaggttcat

SEQ ID NO: 4880508 - DNA, 22 bp, Homo sapiens
tttcaaggcactctagattcca

SEQ ID NO: 4880509 - DNA, 10 bp, Homo sapiens
tttcaatgtg

SEQ ID NO: 4880510 - DNA, 13 bp, Homo sapiens
tttcacaacattt

SEQ ID NO: 4880511 - DNA, 20 bp, Homo sapiens
tttcacaggtgtggtgtaat

SEQ ID NO: 4880512 - DNA, 15 bp, Homo sapiens
tttcacattgtttgc

SEQ ID NO: 4880513 - DNA, 22 bp, Homo sapiens
tttcaccccacccttcccctcc

SEQ ID NO: 4880514 - DNA, 22 bp, Homo sapiens
tttcacccttaacccaaggagc

SEQ ID NO: 4880515 - DNA, 15 bp, Homo sapiens
tttcactagaaaagc

SEQ ID NO: 4880516 - DNA, 24 bp, Homo sapiens
tttcactcttattgcccacgctgg

SEQ ID NO: 4880517 - DNA, 14 bp, Homo sapiens
tttcactgctggct

SEQ ID NO: 4880518 - DNA, 15 bp, Homo sapiens
tttcacttatacctg

SEQ ID NO: 4880519 - DNA, 20 bp, Homo sapiens
tttcacttcgggctgtgtaa

SEQ ID NO: 4880520 - DNA, 13 bp, Homo sapiens
tttgtaattatga

SEQ ID NO: 4880521 - DNA, 12 bp, Homo sapiens
tttgtacagaat

SEQ ID NO: 4880522 - DNA, 14 bp, Homo sapiens
tttgtacagagtgc

SEQ ID NO: 4880523 - DNA, 13 bp, Homo sapiens
tttgtagagccag

SEQ ID NO: 4880524 - DNA, 21 bp, Homo sapiens
tttgtaggggtcaaagaaatg

SEQ ID NO: 4880525 - DNA, 23 bp, Homo sapiens
tttgtaggggtcaaagaaatgct

SEQ ID NO: 4880526 - DNA, 14 bp, Homo sapiens
tttgtaggtaaaat

SEQ ID NO: 4880527 - DNA, 17 bp, Homo sapiens
tttgtaggtaaaatgta

SEQ ID NO: 4880528 - DNA, 17 bp, Homo sapiens
tttgtagtagcgttttt

SEQ ID NO: 4880529 - DNA, 19 bp, Homo sapiens
tttgtagtagcgtttttta

SEQ ID NO: 4880530 - DNA, 18 bp, Homo sapiens
tttgtagtgaaataatag

SEQ ID NO: 4880531 - DNA, 18 bp, Homo sapiens
tttgtataacttcttaaa

SEQ ID NO: 4880532 - DNA, 22 bp, Homo sapiens
tttgtatacaaatatattgtta

SEQ ID NO: 4880533 - DNA, 17 bp, Homo sapiens
tttgtatacatcctggg

SEQ ID NO: 4880534 - DNA, 19 bp, Homo sapiens
tttgtatacatcctgggta

SEQ ID NO: 4880535 - DNA, 20 bp, Homo sapiens
tttgtattattgctgttgct

SEQ ID NO: 4880536 - DNA, 23 bp, Homo sapiens
tttgtattattgctgttgcttga

SEQ ID NO: 4880537 - DNA, 13 bp, Homo sapiens
tttgtccatttgt

SEQ ID NO: 4880538 - DNA, 14 bp, Homo sapiens
tttgtcccccaact

SEQ ID NO: 4880539 - DNA, 15 bp, Homo sapiens
tttgtcccccaactt

SEQ ID NO: 4880540 - DNA, 13 bp, Homo sapiens
tttgtctctcctt

SEQ ID NO: 4880541 - DNA, 16 bp, Homo sapiens
tttgtctctccttttc

SEQ ID NO: 4880542 - DNA, 17 bp, Homo sapiens
tttgtcttttaatgctt

SEQ ID NO: 4880543 - DNA, 22 bp, Homo sapiens
tttgtgactatatagagatgtt

SEQ ID NO: 4880544 - DNA, 13 bp, Homo sapiens
tttgtgataattt

SEQ ID NO: 4880545 - DNA, 11 bp, Homo sapiens
tttgtggaaaa

SEQ ID NO: 4880546 - DNA, 12 bp, Homo sapiens
tttgtggcctca

SEQ ID NO: 4880547 - DNA, 15 bp, Homo sapiens
tttgtggcctcagaa

SEQ ID NO: 4880548 - DNA, 12 bp, Homo sapiens
tttgtggctggg

SEQ ID NO: 4880549 - DNA, 20 bp, Homo sapiens
tttgtggggcttggcgtgga

SEQ ID NO: 4880550 - DNA, 18 bp, Homo sapiens
tttgtgtgttgtcttgaa

SEQ ID NO: 4880551 - DNA, 17 bp, Homo sapiens
tttgtgttgtaattctt

SEQ ID NO: 4880552 - DNA, 18 bp, Homo sapiens
tttgtgtttggtttacat

SEQ ID NO: 4880553 - DNA, 13 bp, Homo sapiens
tttgttactgttc

SEQ ID NO: 4880554 - DNA, 14 bp, Homo sapiens
tttgttactgttct

SEQ ID NO: 4880555 - DNA, 21 bp, Homo sapiens
tttgttactgttcttgctgct

SEQ ID NO: 4880556 - DNA, 23 bp, Homo sapiens
tttgttactgttcttgctgctag

SEQ ID NO: 4880557 - DNA, 15 bp, Homo sapiens
tttgttcatgtttgg

SEQ ID NO: 4880558 - DNA, 19 bp, Homo sapiens
tttgttcttacacatacag

SEQ ID NO: 4880559 - DNA, 15 bp, Homo sapiens
tttgttcttcaagaa

SEQ ID NO: 4880560 - DNA, 17 bp, Homo sapiens
tttgtttaatgtgaact

SEQ ID NO: 4880561 - DNA, 15 bp, Homo sapiens
tttgtttcctttgtt

SEQ ID NO: 4880562 - DNA, 13 bp, Homo sapiens
tttgttttctttg

SEQ ID NO: 4880563 - DNA, 23 bp, Homo sapiens
ttttaaaaaagcaacagaaacct

SEQ ID NO: 4880564 - DNA, 13 bp, Homo sapiens
ttttaaaaaatga

SEQ ID NO: 4880565 - DNA, 14 bp, Homo sapiens
ttttaaaaaatgaa

SEQ ID NO: 4880566 - DNA, 19 bp, Homo sapiens
ttttaaaaacatagaaaaa

SEQ ID NO: 4880567 - DNA, 16 bp, Homo sapiens
ttttaaaaatacatat

SEQ ID NO: 4880568 - DNA, 21 bp, Homo sapiens
ttttaaaaatacatatcgctg

SEQ ID NO: 4880569 - DNA, 17 bp, Homo sapiens
ttttaaaaatagacact

SEQ ID NO: 4880570 - DNA, 11 bp, Homo sapiens
ttttaaaacac

SEQ ID NO: 4880571 - DNA, 12 bp, Homo sapiens
ttttaaaagttt

SEQ ID NO: 4880572 - DNA, 21 bp, Homo sapiens
ttttaaaagtttcaatgtgat

SEQ ID NO: 4880573 - DNA, 22 bp, Homo sapiens
ttttaaaagtttcaatgtgatt

SEQ ID NO: 4880574 - DNA, 16 bp, Homo sapiens
ttttaaacaaaataga

SEQ ID NO: 4880575 - DNA, 20 bp, Homo sapiens
ttttaaacaaaatagaagct

SEQ ID NO: 4880576 - DNA, 23 bp, Homo sapiens
ttttaaacaaaatagaagctgta

SEQ ID NO: 4880577 - DNA, 12 bp, Homo sapiens
ttttaaactcat

SEQ ID NO: 4880578 - DNA, 11 bp, Homo sapiens
ttttaaataaa

SEQ ID NO: 4880579 - DNA, 16 bp, Homo sapiens
ttttaaataaactttt

SEQ ID NO: 4880580 - DNA, 21 bp, Homo sapiens
ttttaaataaactttttttca

SEQ ID NO: 4880581 - DNA, 23 bp, Homo sapiens
ttttaaataaactttttttcaat

SEQ ID NO: 4880582 - DNA, 18 bp, Homo sapiens
ttttaaatctaaatctat

SEQ ID NO: 4880583 - DNA, 21 bp, Homo sapiens
ttttaaatctaaatctattta

SEQ ID NO: 4880584 - DNA, 12 bp, Homo sapiens
ttttaaatgtat

SEQ ID NO: 4880585 - DNA, 16 bp, Homo sapiens
ttttaaatgtatacta

SEQ ID NO: 4880586 - DNA, 13 bp, Homo sapiens
ttttaacttcttt

SEQ ID NO: 4880587 - DNA, 15 bp, Homo sapiens
ttttaacttctttct

SEQ ID NO: 4880588 - DNA, 16 bp, Homo sapiens
ttttaagaggcagggt

SEQ ID NO: 4880589 - DNA, 12 bp, Homo sapiens
ttttaagatttt

SEQ ID NO: 4880590 - DNA, 18 bp, Homo sapiens
ttttaagatttttctcaa

SEQ ID NO: 4880591 - DNA, 15 bp, Homo sapiens
ttttaagcaaaatat

SEQ ID NO: 4880592 - DNA, 12 bp, Homo sapiens
ttttaataaact

SEQ ID NO: 4880593 - DNA, 13 bp, Homo sapiens
ttttaataaacta

SEQ ID NO: 4880594 - DNA, 18 bp, Homo sapiens
ttttaatagaataaaata

SEQ ID NO: 4880595 - DNA, 22 bp, Homo sapiens
ttttaatcagacaaagtaattc

SEQ ID NO: 4880596 - DNA, 18 bp, Homo sapiens
ttttaatggattgttaat

SEQ ID NO: 4880597 - DNA, 21 bp, Homo sapiens
ttttaatggcagcagaaaact

SEQ ID NO: 4880598 - DNA, 18 bp, Homo sapiens
ttttaattccaatatgat

SEQ ID NO: 4880599 - DNA, 13 bp, Homo sapiens
ttttaattgtcat

SEQ ID NO: 4880600 - DNA, 23 bp, Homo sapiens
ttttaattgtcatggttacaaac

SEQ ID NO: 4880601 - DNA, 16 bp, Homo sapiens
ttttaatttaaagctt

SEQ ID NO: 4880602 - DNA, 17 bp, Homo sapiens
ttttaatttaaagctta

SEQ ID NO: 4880603 - DNA, 12 bp, Homo sapiens
ttttaatttaac

SEQ ID NO: 4880604 - DNA, 21 bp, Homo sapiens
ttttacacagaaacactgcct

SEQ ID NO: 4880605 - DNA, 13 bp, Homo sapiens
ttttacataactg

SEQ ID NO: 4880606 - DNA, 13 bp, Homo sapiens
ttttacattaaat

SEQ ID NO: 4880607 - DNA, 13 bp, Homo sapiens
ttttaccagcttt

SEQ ID NO: 4880608 - DNA, 16 bp, Homo sapiens
ttttactcattgaaat

SEQ ID NO: 4880609 - DNA, 22 bp, Homo sapiens
ttttactctatgccccaaatat

SEQ ID NO: 4880610 - DNA, 15 bp, Homo sapiens
ttttactgtgtttta

SEQ ID NO: 4880611 - DNA, 20 bp, Homo sapiens
ttttagatgagattgtttta

SEQ ID NO: 4880612 - DNA, 20 bp, Homo sapiens
ttttagctgatgaacttatt

SEQ ID NO: 4880613 - DNA, 16 bp, Homo sapiens
ttttagtaatctgtac

SEQ ID NO: 4880614 - DNA, 18 bp, Homo sapiens
ttttagtaatctgtacat

SEQ ID NO: 4880615 - DNA, 15 bp, Homo sapiens
ttttagtattcattc

SEQ ID NO: 4880616 - DNA, 14 bp, Homo sapiens
ttttagtgcttttg

SEQ ID NO: 4880617 - DNA, 16 bp, Homo sapiens
ttttataaaaataaat

SEQ ID NO: 4880618 - DNA, 14 bp, Homo sapiens
ttttataagcaaat

SEQ ID NO: 4880619 - DNA, 19 bp, Homo sapiens
ttttataagttcacaaaat

SEQ ID NO: 4880620 - DNA, 14 bp, Homo sapiens
ttttatacaaaata

SEQ ID NO: 4880621 - DNA, 13 bp, Homo sapiens
ttttatactcttt

SEQ ID NO: 4880622 - DNA, 13 bp, Homo sapiens
ttttatagtggaa

SEQ ID NO: 4880623 - DNA, 23 bp, Homo sapiens
ttttatatttagttatagtttca

SEQ ID NO: 4880624 - DNA, 17 bp, Homo sapiens
ttttatcatgacatgtt

SEQ ID NO: 4880625 - DNA, 21 bp, Homo sapiens
ttttatgaagtgcgtgaatgt

SEQ ID NO: 4880626 - DNA, 13 bp, Homo sapiens
ttttatgcagata

SEQ ID NO: 4880627 - DNA, 12 bp, Homo sapiens
ttttatgtttga

SEQ ID NO: 4880628 - DNA, 12 bp, Homo sapiens
ttttattattgt

SEQ ID NO: 4880629 - DNA, 13 bp, Homo sapiens
ttttattattgtg

SEQ ID NO: 4880630 - DNA, 14 bp, Homo sapiens
ttttattcaagtta

SEQ ID NO: 4880631 - DNA, 15 bp, Homo sapiens
ttgccactgcctctt

SEQ ID NO: 4880632 - DNA, 22 bp, Homo sapiens
ttgccatactttgtctgaaaaa

SEQ ID NO: 4880633 - DNA, 18 bp, Homo sapiens
ttgccatgttggccaggc

SEQ ID NO: 4880634 - DNA, 18 bp, Homo sapiens
ttgccattggacagttgt

SEQ ID NO: 4880635 - DNA, 13 bp, Homo sapiens
ttgccatttgata

SEQ ID NO: 4880636 - DNA, 23 bp, Homo sapiens
ttgcccacgctggagtgcagtga

SEQ ID NO: 4880637 - DNA, 18 bp, Homo sapiens
ttgcccaggcaggtcttg

SEQ ID NO: 4880638 - DNA, 23 bp, Homo sapiens
ttgcccctggggcttccatccca

SEQ ID NO: 4880639 - DNA, 23 bp, Homo sapiens
ttgccctggtttcactggcccaa

SEQ ID NO: 4880640 - DNA, 22 bp, Homo sapiens
ttgcctaaatttaatgctgcct

SEQ ID NO: 4880641 - DNA, 16 bp, Homo sapiens
ttgcctaagtattaaa

SEQ ID NO: 4880642 - DNA, 19 bp, Homo sapiens
ttgcctaataaacatcctt

SEQ ID NO: 4880643 - DNA, 22 bp, Homo sapiens
ttgcctgcgttttggaagctct

SEQ ID NO: 4880644 - DNA, 16 bp, Homo sapiens
ttgcctggttttgtct

SEQ ID NO: 4880645 - DNA, 18 bp, Homo sapiens
ttgccttctttgaagaag

SEQ ID NO: 4880646 - DNA, 17 bp, Homo sapiens
ttgccttgcagaactgc

SEQ ID NO: 4880647 - DNA, 19 bp, Homo sapiens
ttgccttgcagaactgcca

SEQ ID NO: 4880648 - DNA, 20 bp, Homo sapiens
ttgccttgcagaactgccat

SEQ ID NO: 4880649 - DNA, 17 bp, Homo sapiens
ttgcctttgttttgatg

SEQ ID NO: 4880650 - DNA, 17 bp, Homo sapiens
ttgcctttttcattttc

SEQ ID NO: 4880651 - DNA, 20 bp, Homo sapiens
ttgcctttttcattttccaa

SEQ ID NO: 4880652 - DNA, 19 bp, Homo sapiens
ttgcgatagagtctcactg

SEQ ID NO: 4880653 - DNA, 23 bp, Homo sapiens
ttgcggcgtcagtctttttctgt

SEQ ID NO: 4880654 - DNA, 15 bp, Homo sapiens
ttgcgtggactctgc

SEQ ID NO: 4880655 - DNA, 16 bp, Homo sapiens
ttgcgttacacccttt

SEQ ID NO: 4880656 - DNA, 18 bp, Homo sapiens
ttgctaatcaaagccagg

SEQ ID NO: 4880657 - DNA, 15 bp, Homo sapiens
ttgctaattttctca

SEQ ID NO: 4880658 - DNA, 18 bp, Homo sapiens
ttgctagactctagacaa

SEQ ID NO: 4880659 - DNA, 23 bp, Homo sapiens
ttgctagataaaagctgaagtta

SEQ ID NO: 4880660 - DNA, 17 bp, Homo sapiens
ttgctagtatttgaatt

SEQ ID NO: 4880661 - DNA, 15 bp, Homo sapiens
ttgctatgttactat

SEQ ID NO: 4880662 - DNA, 19 bp, Homo sapiens
ttgctatgttactattttc

SEQ ID NO: 4880663 - DNA, 19 bp, Homo sapiens
ttgctcccttcagccccca

SEQ ID NO: 4880664 - DNA, 21 bp, Homo sapiens
ttgctgaagggcattctttcc

SEQ ID NO: 4880665 - DNA, 17 bp, Homo sapiens
ttgctgagctgtttata

SEQ ID NO: 4880666 - DNA, 14 bp, Homo sapiens
ttgctgattttaat

SEQ ID NO: 4880667 - DNA, 16 bp, Homo sapiens
ttgctgattttaatgg

SEQ ID NO: 4880668 - DNA, 18 bp, Homo sapiens
ttgctgattttaatggat

SEQ ID NO: 4880669 - DNA, 15 bp, Homo sapiens
ttgctgctagaactt

SEQ ID NO: 4880670 - DNA, 18 bp, Homo sapiens
ttgctgtgtttaatttga

SEQ ID NO: 4880671 - DNA, 15 bp, Homo sapiens
ttgctgttgcttgaa

SEQ ID NO: 4880672 - DNA, 14 bp, Homo sapiens
ttgcttagtaaaat

SEQ ID NO: 4880673 - DNA, 15 bp, Homo sapiens
ttgcttagtaaaatt

SEQ ID NO: 4880674 - DNA, 20 bp, Homo sapiens
ttgcttcataaatgaagcag

SEQ ID NO: 4880675 - DNA, 16 bp, Homo sapiens
ttgcttgagcccagga

SEQ ID NO: 4880676 - DNA, 13 bp, Homo sapiens
ttgctttgtatgc

SEQ ID NO: 4880677 - DNA, 16 bp, Homo sapiens
ttgctttgtatgcact

SEQ ID NO: 4880678 - DNA, 13 bp, Homo sapiens
ttgcttttttgta

SEQ ID NO: 4880679 - DNA, 19 bp, Homo sapiens
ttgcttttttgtattggtt

SEQ ID NO: 4880680 - DNA, 14 bp, Homo sapiens
ttggaaaaatgttt

SEQ ID NO: 4880681 - DNA, 13 bp, Homo sapiens
ttggaaatattca

SEQ ID NO: 4880682 - DNA, 22 bp, Homo sapiens
ttggaaatcctagtttcctctc

SEQ ID NO: 4880683 - DNA, 13 bp, Homo sapiens
ttggaacagaatg

SEQ ID NO: 4880684 - DNA, 14 bp, Homo sapiens
ttggaagaggaaaa

SEQ ID NO: 4880685 - DNA, 15 bp, Homo sapiens
ttggaataggaataa

SEQ ID NO: 4880686 - DNA, 23 bp, Homo sapiens
ttggacaatcatgaaatatgcat

SEQ ID NO: 4880687 - DNA, 15 bp, Homo sapiens
ttggacactgtacaa

SEQ ID NO: 4880688 - DNA, 21 bp, Homo sapiens
ttggacggcctgatgctccct

SEQ ID NO: 4880689 - DNA, 17 bp, Homo sapiens
ttggactaaatgcctag

SEQ ID NO: 4880690 - DNA, 14 bp, Homo sapiens
ttggactttcaaaa

SEQ ID NO: 4880691 - DNA, 23 bp, Homo sapiens
ttggactttcaaaattaaatctg

SEQ ID NO: 4880692 - DNA, 23 bp, Homo sapiens
ttggagaccctgcaaacagaaca

SEQ ID NO: 4880693 - DNA, 15 bp, Homo sapiens
ttggagaccttaccc

SEQ ID NO: 4880694 - DNA, 20 bp, Homo sapiens
ttggagataatctagaacac

SEQ ID NO: 4880695 - DNA, 16 bp, Homo sapiens
ttggataaacaacatt

SEQ ID NO: 4880696 - DNA, 16 bp, Homo sapiens
ttggatcttgaatgtg

SEQ ID NO: 4880697 - DNA, 15 bp, Homo sapiens
ttggattatttaata

SEQ ID NO: 4880698 - DNA, 20 bp, Homo sapiens
ttggattatttaataacatt

SEQ ID NO: 4880699 - DNA, 23 bp, Homo sapiens
ttggattccatgctaagcaagct

SEQ ID NO: 4880700 - DNA, 22 bp, Homo sapiens
ttggattcccttaaacaaaagt

SEQ ID NO: 4880701 - DNA, 22 bp, Homo sapiens
ttggatttgacattgcgtttga

SEQ ID NO: 4880702 - DNA, 20 bp, Homo sapiens
ttggcaggtcctggccagat

SEQ ID NO: 4880703 - DNA, 20 bp, Homo sapiens
ttggcagtgagtgagcctgg

SEQ ID NO: 4880704 - DNA, 19 bp, Homo sapiens
ttggcatggatttctgtct

SEQ ID NO: 4880705 - DNA, 19 bp, Homo sapiens
ttggccctttccttccaga

SEQ ID NO: 4880706 - DNA, 23 bp, Homo sapiens
ttggcctagcccaccctgctgcc

SEQ ID NO: 4880707 - DNA, 22 bp, Homo sapiens
ttggccttcagaaccatccata

SEQ ID NO: 4880708 - DNA, 23 bp, Homo sapiens
ttggctattagagatcaacccct

SEQ ID NO: 4880709 - DNA, 19 bp, Homo sapiens
ttggctctggagacagccc

SEQ ID NO: 4880710 - DNA, 23 bp, Homo sapiens
ttggctctggagacagccccaga

SEQ ID NO: 4880711 - DNA, 18 bp, Homo sapiens
ttggctgggggcctcagt

SEQ ID NO: 4880712 - DNA, 21 bp, Homo sapiens
ttggctgggggcctcagtgcc

SEQ ID NO: 4880713 - DNA, 22 bp, Homo sapiens
ttggctgggggcctcagtgcca

SEQ ID NO: 4880714 - DNA, 17 bp, Homo sapiens
ttggctgtgaggcccct

SEQ ID NO: 4880715 - DNA, 11 bp, Homo sapiens
ttggcttctgt

SEQ ID NO: 4880716 - DNA, 18 bp, Homo sapiens
ttggcttgtagaattgtt

SEQ ID NO: 4880717 - DNA, 16 bp, Homo sapiens
ttggctttgtttggat

SEQ ID NO: 4880718 - DNA, 18 bp, Homo sapiens
ttgggaactgaactcact

SEQ ID NO: 4880719 - DNA, 14 bp, Homo sapiens
ttgggagcctctgg

SEQ ID NO: 4880720 - DNA, 14 bp, Homo sapiens
ttgggagtccaggc

SEQ ID NO: 4880721 - DNA, 17 bp, Homo sapiens
ttgggagtccaggcaca

SEQ ID NO: 4880722 - DNA, 15 bp, Homo sapiens
ttggggcaaaaatcc

SEQ ID NO: 4880723 - DNA, 17 bp, Homo sapiens
ttggggtacccactgct

SEQ ID NO: 4880724 - DNA, 22 bp, Homo sapiens
ttggggtctcttttgtaaatta

SEQ ID NO: 4880725 - DNA, 13 bp, Homo sapiens
ttggggtgacagt

SEQ ID NO: 4880726 - DNA, 22 bp, Homo sapiens
ttggggtgcccctctccttctt

SEQ ID NO: 4880727 - DNA, 22 bp, Homo sapiens
ttgggttcaagcgattcttctg

SEQ ID NO: 4880728 - DNA, 22 bp, Homo sapiens
ttgggttcatgatgcagtctcc

SEQ ID NO: 4880729 - DNA, 12 bp, Homo sapiens
ttggtccagagc

SEQ ID NO: 4880730 - DNA, 17 bp, Homo sapiens
ttggtcctgtccccgca

SEQ ID NO: 4880731 - DNA, 17 bp, Homo sapiens
ttggtctaatttattca

SEQ ID NO: 4880732 - DNA, 17 bp, Homo sapiens
ttggtctggactgacag

SEQ ID NO: 4880733 - DNA, 15 bp, Homo sapiens
ttggtgattcaaatg

SEQ ID NO: 4880734 - DNA, 21 bp, Homo sapiens
ttggtgcatagaactgggtaa

SEQ ID NO: 4880735 - DNA, 22 bp, Homo sapiens
ttggtgcatagaactgggtaaa

SEQ ID NO: 4880736 - DNA, 20 bp, Homo sapiens
ttggtgtaaagccaacaccc

SEQ ID NO: 4880737 - DNA, 13 bp, Homo sapiens
ttggtgtgtccca

SEQ ID NO: 4880738 - DNA, 22 bp, Homo sapiens
ttggttaaaactgtacatttaa

SEQ ID NO: 4880739 - DNA, 14 bp, Homo sapiens
ttggttcattaatt

SEQ ID NO: 4880740 - DNA, 14 bp, Homo sapiens
ttggttcctctctg

SEQ ID NO: 4880741 - DNA, 15 bp, Homo sapiens
ttggttgtgtctttt

SEQ ID NO: 4880742 - DNA, 12 bp, Homo sapiens
ttggtttaaaaa

SEQ ID NO: 4880743 - DNA, 21 bp, Homo sapiens
ttgtaaaacctgtcaatgata

SEQ ID NO: 4880744 - DNA, 23 bp, Homo sapiens
ttgtaaaacctgtcaatgataca

SEQ ID NO: 4880745 - DNA, 14 bp, Homo sapiens
ttgtaaaactacac

SEQ ID NO: 4880746 - DNA, 15 bp, Homo sapiens
ttgtaaataccagga

SEQ ID NO: 4880747 - DNA, 17 bp, Homo sapiens
ttgtaaatagctcaggt

SEQ ID NO: 4880748 - DNA, 17 bp, Homo sapiens
ttgtaaatagtatttga

SEQ ID NO: 4880749 - DNA, 19 bp, Homo sapiens
ttgtaaatgttatttctgc

SEQ ID NO: 4880750 - DNA, 22 bp, Homo sapiens
ttgtaaattaaacataaaacaa

SEQ ID NO: 4880751 - DNA, 20 bp, Homo sapiens
ttgtaaattaggaggctcaa

SEQ ID NO: 4880752 - DNA, 20 bp, Homo sapiens
ttgtaactaggctcagagat

SEQ ID NO: 4880753 - DNA, 17 bp, Homo sapiens
ttgtaacttatattgaa

SEQ ID NO: 4880754 - DNA, 21 bp, Homo sapiens
ttgtaagacaaaggttttcct

SEQ ID NO: 4880755 - DNA, 15 bp, Homo sapiens
ttgtaagagtgtaga

SEQ ID NO: 4880756 - DNA, 19 bp, Homo sapiens
ttgtaagtcagtgttgaga

SEQ ID NO: 4880757 - DNA, 20 bp, Homo sapiens
ttgtaagtcagtgttgagat

SEQ ID NO: 4880758 - DNA, 21 bp, Homo sapiens
ttgtaagtcagtgttgagatg

SEQ ID NO: 4880759 - DNA, 14 bp, Homo sapiens
ttgtaatattttgt

SEQ ID NO: 4880760 - DNA, 13 bp, Homo sapiens
ttgtaatgctgca

SEQ ID NO: 4880761 - DNA, 21 bp, Homo sapiens
ttgtaatgctgcacttcctgt

SEQ ID NO: 4880762 - DNA, 21 bp, Homo sapiens
ttgtaatgtgtgaaaaagatg

SEQ ID NO: 4880763 - DNA, 12 bp, Homo sapiens
ttgtacaaaata

SEQ ID NO: 4880764 - DNA, 18 bp, Homo sapiens
ttgtacagaattttggaa

SEQ ID NO: 4880765 - DNA, 16 bp, Homo sapiens
ttgtacagctgtttaa

SEQ ID NO: 4880766 - DNA, 22 bp, Homo sapiens
tttaaaaaaagaaaatgaaaaa

SEQ ID NO: 4880767 - DNA, 17 bp, Homo sapiens
tttaaaaaaatcacaaa

SEQ ID NO: 4880768 - DNA, 18 bp, Homo sapiens
tttaaaaaatatttatta

SEQ ID NO: 4880769 - DNA, 19 bp, Homo sapiens
tttaaaaaatgaaaataag

SEQ ID NO: 4880770 - DNA, 20 bp, Homo sapiens
tttaaaaaatgaaatccttt

SEQ ID NO: 4880771 - DNA, 13 bp, Homo sapiens
tttaaaaactgga

SEQ ID NO: 4880772 - DNA, 15 bp, Homo sapiens
tttaaaacagtattt

SEQ ID NO: 4880773 - DNA, 12 bp, Homo sapiens
tttaaaagaaat

SEQ ID NO: 4880774 - DNA, 22 bp, Homo sapiens
tttaaaaggtattttgaatacc

SEQ ID NO: 4880775 - DNA, 20 bp, Homo sapiens
tttaaaagtttcaatgtgat

SEQ ID NO: 4880776 - DNA, 16 bp, Homo sapiens
tttaaaatatttatct

SEQ ID NO: 4880777 - DNA, 15 bp, Homo sapiens
tttaaaatcaactta

SEQ ID NO: 4880778 - DNA, 17 bp, Homo sapiens
tttaaacaaacattgtg

SEQ ID NO: 4880779 - DNA, 14 bp, Homo sapiens
tttaaacaaattca

SEQ ID NO: 4880780 - DNA, 13 bp, Homo sapiens
tttaaacacacag

SEQ ID NO: 4880781 - DNA, 14 bp, Homo sapiens
tttaaacattaaaa

SEQ ID NO: 4880782 - DNA, 16 bp, Homo sapiens
tttaaacattaaaaat

SEQ ID NO: 4880783 - DNA, 19 bp, Homo sapiens
tttaaacattaaaaatgga

SEQ ID NO: 4880784 - DNA, 16 bp, Homo sapiens
tttaaagagtctagat

SEQ ID NO: 4880785 - DNA, 18 bp, Homo sapiens
tttaaagagtctagattc

SEQ ID NO: 4880786 - DNA, 15 bp, Homo sapiens
tttaaagcattgctg

SEQ ID NO: 4880787 - DNA, 14 bp, Homo sapiens
tttaaataaacttt

SEQ ID NO: 4880788 - DNA, 23 bp, Homo sapiens
tttaaataaactttttttcaatg

SEQ ID NO: 4880789 - DNA, 12 bp, Homo sapiens
tttaaatataat

SEQ ID NO: 4880790 - DNA, 13 bp, Homo sapiens
tttaaatataatt

SEQ ID NO: 4880791 - DNA, 16 bp, Homo sapiens
tttaaatataattctg

SEQ ID NO: 4880792 - DNA, 19 bp, Homo sapiens
tttaaatctaaatctattt

SEQ ID NO: 4880793 - DNA, 17 bp, Homo sapiens
tttaaatgtgtacaatg

SEQ ID NO: 4880794 - DNA, 18 bp, Homo sapiens
tttaaatgtgtacaatgt

SEQ ID NO: 4880795 - DNA, 19 bp, Homo sapiens
tttaaatgtgtacaatgta

SEQ ID NO: 4880796 - DNA, 17 bp, Homo sapiens
tttaaattctgagacat

SEQ ID NO: 4880797 - DNA, 21 bp, Homo sapiens
tttaacatttgccttgcagaa

SEQ ID NO: 4880798 - DNA, 16 bp, Homo sapiens
tttaacattttgttct

SEQ ID NO: 4880799 - DNA, 22 bp, Homo sapiens
tttaacattttgttcttacaca

SEQ ID NO: 4880800 - DNA, 18 bp, Homo sapiens
tttaagaaaaaataacac

SEQ ID NO: 4880801 - DNA, 17 bp, Homo sapiens
tttaagaaaagtatttt

SEQ ID NO: 4880802 - DNA, 20 bp, Homo sapiens
tttaagaaaagtattttgaa

SEQ ID NO: 4880803 - DNA, 21 bp, Homo sapiens
tttaagaaaagtattttgaag

SEQ ID NO: 4880804 - DNA, 12 bp, Homo sapiens
tttaagcaaata

SEQ ID NO: 4880805 - DNA, 22 bp, Homo sapiens
tttaagggtttgtggaaaatga

SEQ ID NO: 4880806 - DNA, 14 bp, Homo sapiens
tttaagtaatgtgg

SEQ ID NO: 4880807 - DNA, 22 bp, Homo sapiens
tttaagtaatgtggaagaaaat

SEQ ID NO: 4880808 - DNA, 21 bp, Homo sapiens
tttaagtactacacattttta

SEQ ID NO: 4880809 - DNA, 16 bp, Homo sapiens
tttaataaaataattc

SEQ ID NO: 4880810 - DNA, 14 bp, Homo sapiens
tttaataaactact

SEQ ID NO: 4880811 - DNA, 19 bp, Homo sapiens
tttaataaactactctttg

SEQ ID NO: 4880812 - DNA, 14 bp, Homo sapiens
tttaataacaattg

SEQ ID NO: 4880813 - DNA, 22 bp, Homo sapiens
tttaataacattaccttactgt

SEQ ID NO: 4880814 - DNA, 16 bp, Homo sapiens
tttaataataatctag

SEQ ID NO: 4880815 - DNA, 13 bp, Homo sapiens
tttaatatcttca

SEQ ID NO: 4880816 - DNA, 15 bp, Homo sapiens
tttaatatcttcagc

SEQ ID NO: 4880817 - DNA, 18 bp, Homo sapiens
tttaatatttaaacagca

SEQ ID NO: 4880818 - DNA, 19 bp, Homo sapiens
tttaatcaagttgtaactt

SEQ ID NO: 4880819 - DNA, 19 bp, Homo sapiens
tttaatgcattaaacctgt

SEQ ID NO: 4880820 - DNA, 12 bp, Homo sapiens
tttaatgctgcc

SEQ ID NO: 4880821 - DNA, 14 bp, Homo sapiens
tttaatgctgcctt

SEQ ID NO: 4880822 - DNA, 19 bp, Homo sapiens
tttaatggcagcagaaaac

SEQ ID NO: 4880823 - DNA, 13 bp, Homo sapiens
tttaatgtgaact

SEQ ID NO: 4880824 - DNA, 15 bp, Homo sapiens
tttaatgtgaacttg

SEQ ID NO: 4880825 - DNA, 17 bp, Homo sapiens
tttaatgtgaacttgta

SEQ ID NO: 4880826 - DNA, 19 bp, Homo sapiens
tttaatgtgaacttgtagc

SEQ ID NO: 4880827 - DNA, 13 bp, Homo sapiens
tttaatgtgatga

SEQ ID NO: 4880828 - DNA, 21 bp, Homo sapiens
tttaattgtcatggttacaaa

SEQ ID NO: 4880829 - DNA, 18 bp, Homo sapiens
tttaattgttgtttcttt

SEQ ID NO: 4880830 - DNA, 22 bp, Homo sapiens
tttaattgttgtttctttctag

SEQ ID NO: 4880831 - DNA, 24 bp, Homo sapiens
tttaattgttgtttctttctagtg

SEQ ID NO: 4880832 - DNA, 20 bp, Homo sapiens
tttacaaaagaggagcactt

SEQ ID NO: 4880833 - DNA, 20 bp, Homo sapiens
tttacaacataatctagttt

SEQ ID NO: 4880834 - DNA, 16 bp, Homo sapiens
tttacaagaagtttat

SEQ ID NO: 4880835 - DNA, 14 bp, Homo sapiens
tttacacaattctt

SEQ ID NO: 4880836 - DNA, 20 bp, Homo sapiens
tttacaccgactagccagga

SEQ ID NO: 4880837 - DNA, 11 bp, Homo sapiens
tttacagaaaa

SEQ ID NO: 4880838 - DNA, 12 bp, Homo sapiens
tttacagaaaaa

SEQ ID NO: 4880839 - DNA, 13 bp, Homo sapiens
tttacagaaaaag

SEQ ID NO: 4880840 - DNA, 21 bp, Homo sapiens
tttacatgtgatgttttagtg

SEQ ID NO: 4880841 - DNA, 19 bp, Homo sapiens
tttacatgtgtagcctatg

SEQ ID NO: 4880842 - DNA, 12 bp, Homo sapiens
tttacatttaaa

SEQ ID NO: 4880843 - DNA, 17 bp, Homo sapiens
tttacatttaaagcatt

SEQ ID NO: 4880844 - DNA, 20 bp, Homo sapiens
tttacatttaaagcattgct

SEQ ID NO: 4880845 - DNA, 22 bp, Homo sapiens
tttacatttttatttatgaagt

SEQ ID NO: 4880846 - DNA, 18 bp, Homo sapiens
tttaccagggatgtagat

SEQ ID NO: 4880847 - DNA, 22 bp, Homo sapiens
tttaccctaatgtcttcataaa

SEQ ID NO: 4880848 - DNA, 13 bp, Homo sapiens
tttacccttggct

SEQ ID NO: 4880849 - DNA, 21 bp, Homo sapiens
tttacctgtgcgttactaatt

SEQ ID NO: 4880850 - DNA, 13 bp, Homo sapiens
tttactaaacata

SEQ ID NO: 4880851 - DNA, 20 bp, Homo sapiens
tttactaagccacaagaaat

SEQ ID NO: 4880852 - DNA, 22 bp, Homo sapiens
tttactaagccacaagaaattt

SEQ ID NO: 4880853 - DNA, 21 bp, Homo sapiens
ttctattgccttctttgaaga

SEQ ID NO: 4880854 - DNA, 23 bp, Homo sapiens
ttctattgccttctttgaagaag

SEQ ID NO: 4880855 - DNA, 16 bp, Homo sapiens
ttctattttgtaaact

SEQ ID NO: 4880856 - DNA, 15 bp, Homo sapiens
ttctcaaaagcattt

SEQ ID NO: 4880857 - DNA, 16 bp, Homo sapiens
ttctcaaaagcattta

SEQ ID NO: 4880858 - DNA, 15 bp, Homo sapiens
ttctcaaagttttga

SEQ ID NO: 4880859 - DNA, 18 bp, Homo sapiens
ttctcaaagttttgaaaa

SEQ ID NO: 4880860 - DNA, 22 bp, Homo sapiens
ttctcaaagttttgaaaagcta

SEQ ID NO: 4880861 - DNA, 22 bp, Homo sapiens
ttctcaacaaagcacagtgtta

SEQ ID NO: 4880862 - DNA, 20 bp, Homo sapiens
ttctcaagttctaagattct

SEQ ID NO: 4880863 - DNA, 22 bp, Homo sapiens
ttctcaagttctaagattctaa

SEQ ID NO: 4880864 - DNA, 21 bp, Homo sapiens
ttctcacagcacatgctggcc

SEQ ID NO: 4880865 - DNA, 19 bp, Homo sapiens
ttctcactccttttggtgt

SEQ ID NO: 4880866 - DNA, 18 bp, Homo sapiens
ttctcataattcctacag

SEQ ID NO: 4880867 - DNA, 13 bp, Homo sapiens
ttctcatgtgttt

SEQ ID NO: 4880868 - DNA, 20 bp, Homo sapiens
ttctcattccaacagtgagt

SEQ ID NO: 4880869 - DNA, 17 bp, Homo sapiens
ttctccagatttttaat

SEQ ID NO: 4880870 - DNA, 14 bp, Homo sapiens
ttctccagctcaga

SEQ ID NO: 4880871 - DNA, 20 bp, Homo sapiens
ttctccagctgggctctgca

SEQ ID NO: 4880872 - DNA, 12 bp, Homo sapiens
ttctccatccct

SEQ ID NO: 4880873 - DNA, 19 bp, Homo sapiens
ttctccccgctaaggaaga

SEQ ID NO: 4880874 - DNA, 21 bp, Homo sapiens
ttctcccgttcacgttgccta

SEQ ID NO: 4880875 - DNA, 11 bp, Homo sapiens
ttctcctcccc

SEQ ID NO: 4880876 - DNA, 15 bp, Homo sapiens
ttctcctgcctgtgc

SEQ ID NO: 4880877 - DNA, 22 bp, Homo sapiens
ttctcctttcacaaccttctgt

SEQ ID NO: 4880878 - DNA, 14 bp, Homo sapiens
ttctctccccaacc

SEQ ID NO: 4880879 - DNA, 22 bp, Homo sapiens
ttctctccccaacccccattct

SEQ ID NO: 4880880 - DNA, 23 bp, Homo sapiens
ttctctccccaacccccattctc

SEQ ID NO: 4880881 - DNA, 17 bp, Homo sapiens
ttctctcggctccccat

SEQ ID NO: 4880882 - DNA, 20 bp, Homo sapiens
ttctctggctgtaaggctct

SEQ ID NO: 4880883 - DNA, 20 bp, Homo sapiens
ttctctgtgtctaagattct

SEQ ID NO: 4880884 - DNA, 23 bp, Homo sapiens
ttctcttccctgcgcctgtgatg

SEQ ID NO: 4880885 - DNA, 14 bp, Homo sapiens
ttctcttgagctgg

SEQ ID NO: 4880886 - DNA, 16 bp, Homo sapiens
ttctcttgagctggcc

SEQ ID NO: 4880887 - DNA, 22 bp, Homo sapiens
ttctcttgagctggcctctcta

SEQ ID NO: 4880888 - DNA, 16 bp, Homo sapiens
ttctcttttcaaaaca

SEQ ID NO: 4880889 - DNA, 22 bp, Homo sapiens
ttctgacaaaaagtttccatat

SEQ ID NO: 4880890 - DNA, 15 bp, Homo sapiens
ttctgacaaactgtg

SEQ ID NO: 4880891 - DNA, 15 bp, Homo sapiens
ttctgacggccctgc

SEQ ID NO: 4880892 - DNA, 13 bp, Homo sapiens
ttctgagaaaaca

SEQ ID NO: 4880893 - DNA, 14 bp, Homo sapiens
ttctgagaaaacaa

SEQ ID NO: 4880894 - DNA, 21 bp, Homo sapiens
ttctgagaaaacaagcaagtt

SEQ ID NO: 4880895 - DNA, 16 bp, Homo sapiens
ttctgagtttcattct

SEQ ID NO: 4880896 - DNA, 14 bp, Homo sapiens
ttctgatgagcaac

SEQ ID NO: 4880897 - DNA, 16 bp, Homo sapiens
ttctgatgtctctaaa

SEQ ID NO: 4880898 - DNA, 15 bp, Homo sapiens
ttctgattagctttg

SEQ ID NO: 4880899 - DNA, 20 bp, Homo sapiens
ttctgcagacacgccttccc

SEQ ID NO: 4880900 - DNA, 22 bp, Homo sapiens
ttctgcatatgttgaatacttt

SEQ ID NO: 4880901 - DNA, 23 bp, Homo sapiens
ttctgcatatgttgaatactttt

SEQ ID NO: 4880902 - DNA, 16 bp, Homo sapiens
ttctgcattgctagat

SEQ ID NO: 4880903 - DNA, 15 bp, Homo sapiens
ttctgccagggagct

SEQ ID NO: 4880904 - DNA, 19 bp, Homo sapiens
ttctgcccaaaaatatggt

SEQ ID NO: 4880905 - DNA, 19 bp, Homo sapiens
ttctgcccaattggaggaa

SEQ ID NO: 4880906 - DNA, 15 bp, Homo sapiens
ttctgccgccccctc

SEQ ID NO: 4880907 - DNA, 18 bp, Homo sapiens
ttctgcctctctaggacc

SEQ ID NO: 4880908 - DNA, 15 bp, Homo sapiens
ttctgcctttgatgt

SEQ ID NO: 4880909 - DNA, 16 bp, Homo sapiens
ttctgcctttgatgtt

SEQ ID NO: 4880910 - DNA, 13 bp, Homo sapiens
ttctgctccaccc

SEQ ID NO: 4880911 - DNA, 17 bp, Homo sapiens
ttctgctggcatcaaga

SEQ ID NO: 4880912 - DNA, 17 bp, Homo sapiens
ttctggaatttgttcaa

SEQ ID NO: 4880913 - DNA, 16 bp, Homo sapiens
ttctggctctcccatt

SEQ ID NO: 4880914 - DNA, 22 bp, Homo sapiens
ttctggctctcccatttcctga

SEQ ID NO: 4880915 - DNA, 15 bp, Homo sapiens
ttctggctgaaaaag

SEQ ID NO: 4880916 - DNA, 20 bp, Homo sapiens
ttctggctgccccaacctgc

SEQ ID NO: 4880917 - DNA, 20 bp, Homo sapiens
ttctggcttccttctctcaa

SEQ ID NO: 4880918 - DNA, 10 bp, Homo sapiens
ttctgggaca

SEQ ID NO: 4880919 - DNA, 22 bp, Homo sapiens
ttctgggacacagttcaattct

SEQ ID NO: 4880920 - DNA, 16 bp, Homo sapiens
ttctgggctctttcct

SEQ ID NO: 4880921 - DNA, 21 bp, Homo sapiens
ttctggggaaagacactgcct

SEQ ID NO: 4880922 - DNA, 20 bp, Homo sapiens
ttctggggcaggctgggcca

SEQ ID NO: 4880923 - DNA, 17 bp, Homo sapiens
ttctgggtcttttgcta

SEQ ID NO: 4880924 - DNA, 18 bp, Homo sapiens
ttctgggtggcctcggga

SEQ ID NO: 4880925 - DNA, 20 bp, Homo sapiens
ttctgtaaactcaaaactta

SEQ ID NO: 4880926 - DNA, 23 bp, Homo sapiens
ttctgtaaataccattgacacat

SEQ ID NO: 4880927 - DNA, 15 bp, Homo sapiens
ttctgtacttcctga

SEQ ID NO: 4880928 - DNA, 20 bp, Homo sapiens
ttctgtagagccttctgatg

SEQ ID NO: 4880929 - DNA, 13 bp, Homo sapiens
ttctgtagattct

SEQ ID NO: 4880930 - DNA, 24 bp, Homo sapiens
ttctgtatacaaccctggcattat

SEQ ID NO: 4880931 - DNA, 16 bp, Homo sapiens
ttctgtcagatgagaa

SEQ ID NO: 4880932 - DNA, 18 bp, Homo sapiens
ttctgtcagatgagaaca

SEQ ID NO: 4880933 - DNA, 19 bp, Homo sapiens
ttctgtcagatgagaacaa

SEQ ID NO: 4880934 - DNA, 23 bp, Homo sapiens
ttctgtcagatgagaacaaagct

SEQ ID NO: 4880935 - DNA, 17 bp, Homo sapiens
ttctgtcctactctgtg

SEQ ID NO: 4880936 - DNA, 12 bp, Homo sapiens
ttctgtggctca

SEQ ID NO: 4880937 - DNA, 22 bp, Homo sapiens
ttctgtgggtccgataatatct

SEQ ID NO: 4880938 - DNA, 20 bp, Homo sapiens
ttctgtgtttaatttcttca

SEQ ID NO: 4880939 - DNA, 15 bp, Homo sapiens
ttctgttaaaatcta

SEQ ID NO: 4880940 - DNA, 21 bp, Homo sapiens
ttctgttaaaatctattctgt

SEQ ID NO: 4880941 - DNA, 11 bp, Homo sapiens
ttctgttgtaa

SEQ ID NO: 4880942 - DNA, 13 bp, Homo sapiens
ttctgttgtaact

SEQ ID NO: 4880943 - DNA, 14 bp, Homo sapiens
ttctgttgtaactt

SEQ ID NO: 4880944 - DNA, 22 bp, Homo sapiens
ttctgttgtaacttatgtagat

SEQ ID NO: 4880945 - DNA, 18 bp, Homo sapiens
ttctgtttatggccacat

SEQ ID NO: 4880946 - DNA, 23 bp, Homo sapiens
ttctgtttcaaggcactctagat

SEQ ID NO: 4880947 - DNA, 12 bp, Homo sapiens
ttctgtttctca

SEQ ID NO: 4880948 - DNA, 12 bp, Homo sapiens
ttcttaaatatc

SEQ ID NO: 4880949 - DNA, 14 bp, Homo sapiens
ttcttaaatatctt

SEQ ID NO: 4880950 - DNA, 16 bp, Homo sapiens
ttcttaaatatctttt

SEQ ID NO: 4880951 - DNA, 19 bp, Homo sapiens
ttcttaaatatcttttatg

SEQ ID NO: 4880952 - DNA, 16 bp, Homo sapiens
ttcttaacaacctggc

SEQ ID NO: 4880953 - DNA, 18 bp, Homo sapiens
ttcttaagacatgtatca

SEQ ID NO: 4880954 - DNA, 14 bp, Homo sapiens
ttcttaattaattt

SEQ ID NO: 4880955 - DNA, 16 bp, Homo sapiens
ttcttaattaatttga

SEQ ID NO: 4880956 - DNA, 16 bp, Homo sapiens
ttcttacataattttt

SEQ ID NO: 4880957 - DNA, 17 bp, Homo sapiens
ttcttacccaatttccc

SEQ ID NO: 4880958 - DNA, 15 bp, Homo sapiens
ttcttacctgtatgt

SEQ ID NO: 4880959 - DNA, 15 bp, Homo sapiens
ttcttactcctcctc

SEQ ID NO: 4880960 - DNA, 17 bp, Homo sapiens
ttcttactcctcctctt

SEQ ID NO: 4880961 - DNA, 19 bp, Homo sapiens
ttcttactcctcctctttc

SEQ ID NO: 4880962 - DNA, 21 bp, Homo sapiens
ttcttagactacatttagaga

SEQ ID NO: 4880963 - DNA, 20 bp, Homo sapiens
ttcttagctttttaattgtt

SEQ ID NO: 4880964 - DNA, 12 bp, Homo sapiens
ttcttataatac

SEQ ID NO: 4880965 - DNA, 14 bp, Homo sapiens
ttcttatacacatt

SEQ ID NO: 4880966 - DNA, 16 bp, Homo sapiens
ttcttatgcaaaatgg

SEQ ID NO: 4880967 - DNA, 15 bp, Homo sapiens
ttcttatggaattga

SEQ ID NO: 4880968 - DNA, 18 bp, Homo sapiens
ttcttatggaattgattt

SEQ ID NO: 4880969 - DNA, 19 bp, Homo sapiens
ttcttattgcgctgctacc

SEQ ID NO: 4880970 - DNA, 20 bp, Homo sapiens
ttcttcaaaatgtatatatt

SEQ ID NO: 4880971 - DNA, 21 bp, Homo sapiens
ttcttcaaaatgtatatattt

SEQ ID NO: 4880972 - DNA, 23 bp, Homo sapiens
ttcttcaaaatgtatatatttag

SEQ ID NO: 4880973 - DNA, 21 bp, Homo sapiens
ttcttcacctaagtctctgtg

SEQ ID NO: 4880974 - DNA, 20 bp, Homo sapiens
ttcttcatattctaaaacca

SEQ ID NO: 4880975 - DNA, 22 bp, Homo sapiens
ttcttcattctatcaagcccag

SEQ ID NO: 4880976 - DNA, 13 bp, Homo sapiens
ttcttccatccca

SEQ ID NO: 4880977 - DNA, 14 bp, Homo sapiens
ttcttccatcccag

SEQ ID NO: 4880978 - DNA, 17 bp, Homo sapiens
ttcttccatcccaggac

SEQ ID NO: 4880979 - DNA, 18 bp, Homo sapiens
ttcttcctgttaatgtat

SEQ ID NO: 4880980 - DNA, 11 bp, Homo sapiens
ttcttctagag

SEQ ID NO: 4880981 - DNA, 13 bp, Homo sapiens
ttcttctgcttca

SEQ ID NO: 4880982 - DNA, 15 bp, Homo sapiens
ttcttctgcttcagc

SEQ ID NO: 4880983 - DNA, 20 bp, Homo sapiens
ttcttgacaaaacctaactt

SEQ ID NO: 4880984 - DNA, 19 bp, Homo sapiens
ttcttgcagtcatcagaag

SEQ ID NO: 4880985 - DNA, 22 bp, Homo sapiens
ttcttgctcgggtcccttcacc

SEQ ID NO: 4880986 - DNA, 15 bp, Homo sapiens
ttcttgctgctagaa

SEQ ID NO: 4880987 - DNA, 17 bp, Homo sapiens
ttcttgctgctagaact

SEQ ID NO: 4880988 - DNA, 21 bp, Homo sapiens
ttcttgctgctagaacttttt

SEQ ID NO: 4880989 - DNA, 13 bp, Homo sapiens
ttcttgcttgtac

SEQ ID NO: 4880990 - DNA, 22 bp, Homo sapiens
ttcttgcttgtacctctggctg

SEQ ID NO: 4880991 - DNA, 22 bp, Homo sapiens
ttcttggcaaaagccttgtgta

SEQ ID NO: 4880992 - DNA, 23 bp, Homo sapiens
ttcttggcaaaagccttgtgtat

SEQ ID NO: 4880993 - DNA, 14 bp, Homo sapiens
ttcttgtcaaaaaa

SEQ ID NO: 4880994 - DNA, 15 bp, Homo sapiens
ttcttgtcagacata

SEQ ID NO: 4880995 - DNA, 21 bp, Homo sapiens
ttcttgtcagacataaagcca

SEQ ID NO: 4880996 - DNA, 14 bp, Homo sapiens
ttcttgtctatagt

SEQ ID NO: 4880997 - DNA, 22 bp, Homo sapiens
ttcttgtgccatagtcacatgg

SEQ ID NO: 4880998 - DNA, 21 bp, Homo sapiens
ttctttctagtggtctttgta

SEQ ID NO: 4880999 - DNA, 22 bp, Homo sapiens
ttctttctagtggtctttgtaa

SEQ ID NO: 4881000 - DNA, 13 bp, Homo sapiens
ttctttctctcag

SEQ ID NO: 4881001 - DNA, 13 bp, Homo sapiens
ttctttcttcctc

SEQ ID NO: 4881002 - DNA, 11 bp, Homo sapiens
ttctttgaatg

SEQ ID NO: 4881003 - DNA, 13 bp, Homo sapiens
ttctttgaattta

SEQ ID NO: 4881004 - DNA, 17 bp, Homo sapiens
ttctttgagactgggtc

SEQ ID NO: 4881005 - DNA, 22 bp, Homo sapiens
ttctttgagggactgcctctgc

SEQ ID NO: 4881006 - DNA, 23 bp, Homo sapiens
ttctttgattctccttttatgtg

SEQ ID NO: 4881007 - DNA, 11 bp, Homo sapiens
ttctttgtgtt

SEQ ID NO: 4881008 - DNA, 20 bp, Homo sapiens
ttcttttaacttctttctat

SEQ ID NO: 4881009 - DNA, 21 bp, Homo sapiens
ttcttttaacttctttctatt

SEQ ID NO: 4881010 - DNA, 22 bp, Homo sapiens
ttcttttctcatgtgtttgcat

SEQ ID NO: 4881011 - DNA, 12 bp, Homo sapiens
ttcttttgtaag

SEQ ID NO: 4881012 - DNA, 12 bp, Homo sapiens
ttcttttgttac

SEQ ID NO: 4881013 - DNA, 18 bp, Homo sapiens
ttctttttacataactgc

SEQ ID NO: 4881014 - DNA, 18 bp, Homo sapiens
ttgaaaaaagctcatttc

SEQ ID NO: 4881015 - DNA, 14 bp, Homo sapiens
ttgaaaaactcttt

SEQ ID NO: 4881016 - DNA, 21 bp, Homo sapiens
ttgaaaaactctttattttcc

SEQ ID NO: 4881017 - DNA, 18 bp, Homo sapiens
ttgaaaaccaaaatgaca

SEQ ID NO: 4881018 - DNA, 22 bp, Homo sapiens
ttgaaaagcttcttaattaatt

SEQ ID NO: 4881019 - DNA, 21 bp, Homo sapiens
ttgaaaataagaatagaaata

SEQ ID NO: 4881020 - DNA, 15 bp, Homo sapiens
ttgaaaatcttgtgt

SEQ ID NO: 4881021 - DNA, 19 bp, Homo sapiens
ttgaaaattattttaaaca

SEQ ID NO: 4881022 - DNA, 18 bp, Homo sapiens
ttgaaaattcaaaaagtg

SEQ ID NO: 4881023 - DNA, 17 bp, Homo sapiens
ttgaaagttttcagaac

SEQ ID NO: 4881024 - DNA, 20 bp, Homo sapiens
ttgaaatacctcatgtttat

SEQ ID NO: 4881025 - DNA, 18 bp, Homo sapiens
ttgaaatgaggtctgttt

SEQ ID NO: 4881026 - DNA, 21 bp, Homo sapiens
ttgaaatgaggtctgtttaaa

SEQ ID NO: 4881027 - DNA, 16 bp, Homo sapiens
ttgaaattatatctgt

SEQ ID NO: 4881028 - DNA, 19 bp, Homo sapiens
ttgaaattatatctgtggt

SEQ ID NO: 4881029 - DNA, 13 bp, Homo sapiens
ttgaaattgtgaa

SEQ ID NO: 4881030 - DNA, 17 bp, Homo sapiens
ttgaaattttgcaaata

SEQ ID NO: 4881031 - DNA, 14 bp, Homo sapiens
ttgaacacaaactg

SEQ ID NO: 4881032 - DNA, 11 bp, Homo sapiens
ttgaacactgg

SEQ ID NO: 4881033 - DNA, 20 bp, Homo sapiens
ttgaacactggctaaagata

SEQ ID NO: 4881034 - DNA, 15 bp, Homo sapiens
ttgaaccatccactt

SEQ ID NO: 4881035 - DNA, 21 bp, Homo sapiens
ttgaacctgtgagtaaatatt

SEQ ID NO: 4881036 - DNA, 23 bp, Homo sapiens
ttgaacctgtgagtaaatattga

SEQ ID NO: 4881037 - DNA, 18 bp, Homo sapiens
ttgaactaagaaactttt

SEQ ID NO: 4881038 - DNA, 20 bp, Homo sapiens
ttgaactcagatctgtctga

SEQ ID NO: 4881039 - DNA, 13 bp, Homo sapiens
ttgaactccaaga

SEQ ID NO: 4881040 - DNA, 20 bp, Homo sapiens
ttgaactggcaattgtctat

SEQ ID NO: 4881041 - DNA, 22 bp, Homo sapiens
ttgaagaaggtggaccttttaa

SEQ ID NO: 4881042 - DNA, 16 bp, Homo sapiens
ttgaagacaatttgat

SEQ ID NO: 4881043 - DNA, 20 bp, Homo sapiens
ttgaagagagatatatctga

SEQ ID NO: 4881044 - DNA, 15 bp, Homo sapiens
ttgaagcagttgtgt

SEQ ID NO: 4881045 - DNA, 18 bp, Homo sapiens
ttgaagctgaaaatataa

SEQ ID NO: 4881046 - DNA, 15 bp, Homo sapiens
ttgaaggcaaaattg

SEQ ID NO: 4881047 - DNA, 14 bp, Homo sapiens
ttgaagtcttgtat

SEQ ID NO: 4881048 - DNA, 14 bp, Homo sapiens
ttgaagtttacatt

SEQ ID NO: 4881049 - DNA, 20 bp, Homo sapiens
ttgaataaaaatatgtacaa

SEQ ID NO: 4881050 - DNA, 22 bp, Homo sapiens
ttgaataccattaaaactgctt

SEQ ID NO: 4881051 - DNA, 22 bp, Homo sapiens
ttgaatatctttcgataaacaa

SEQ ID NO: 4881052 - DNA, 14 bp, Homo sapiens
ttgaatctatttca

SEQ ID NO: 4881053 - DNA, 18 bp, Homo sapiens
ttgaatctatttcactta

SEQ ID NO: 4881054 - DNA, 17 bp, Homo sapiens
ttgaatgctttttgaat

SEQ ID NO: 4881055 - DNA, 22 bp, Homo sapiens
ttgaatgtggcttgagaaatat

SEQ ID NO: 4881056 - DNA, 17 bp, Homo sapiens
ttgaatgttaagaattg

SEQ ID NO: 4881057 - DNA, 16 bp, Homo sapiens
ttgaattaaaacttct

SEQ ID NO: 4881058 - DNA, 12 bp, Homo sapiens
ttgacaaaattt

SEQ ID NO: 4881059 - DNA, 13 bp, Homo sapiens
ttgacaaatctgt

SEQ ID NO: 4881060 - DNA, 14 bp, Homo sapiens
ttgacaactgtgac

SEQ ID NO: 4881061 - DNA, 14 bp, Homo sapiens
ttgacacaagtgga

SEQ ID NO: 4881062 - DNA, 21 bp, Homo sapiens
ttgacacatccgccttttgta

SEQ ID NO: 4881063 - DNA, 12 bp, Homo sapiens
ttgacagggcac

SEQ ID NO: 4881064 - DNA, 17 bp, Homo sapiens
ttgacagttctgaagaa

SEQ ID NO: 4881065 - DNA, 18 bp, Homo sapiens
ttgacatcagttcctttg

SEQ ID NO: 4881066 - DNA, 21 bp, Homo sapiens
ttgacattgtatgtatctatt

SEQ ID NO: 4881067 - DNA, 22 bp, Homo sapiens
ttgacattgtatgtatctattt

SEQ ID NO: 4881068 - DNA, 21 bp, Homo sapiens
ttgacctgctccgctgctcct

SEQ ID NO: 4881069 - DNA, 15 bp, Homo sapiens
ttgacgattccttct

SEQ ID NO: 4881070 - DNA, 19 bp, Homo sapiens
ttgactagggattcaggct

SEQ ID NO: 4881071 - DNA, 21 bp, Homo sapiens
ttgactagggattcaggctgc

SEQ ID NO: 4881072 - DNA, 23 bp, Homo sapiens
ttgactcaggatttaaaaactgg

SEQ ID NO: 4881073 - DNA, 19 bp, Homo sapiens
ttgactcccaagtttccat

SEQ ID NO: 4881074 - DNA, 20 bp, Homo sapiens
ttgactgaagatgcagctca

SEQ ID NO: 4881075 - DNA, 16 bp, Homo sapiens
ttgacttgcatgaaga

SEQ ID NO: 4881076 - DNA, 19 bp, Homo sapiens
ttgagaaaaatatatacta

SEQ ID NO: 4881077 - DNA, 21 bp, Homo sapiens
ttgagaaatatggacacttaa

SEQ ID NO: 4881078 - DNA, 19 bp, Homo sapiens
ttgagaagccttcagctcc

SEQ ID NO: 4881079 - DNA, 23 bp, Homo sapiens
ttgagaatcccaaatttgattga

SEQ ID NO: 4881080 - DNA, 12 bp, Homo sapiens
ttgagacagagt

SEQ ID NO: 4881081 - DNA, 12 bp, Homo sapiens
ttgagacagttt

SEQ ID NO: 4881082 - DNA, 23 bp, Homo sapiens
ttgagactatttaaacttataaa

SEQ ID NO: 4881083 - DNA, 20 bp, Homo sapiens
ttgagatactttttcttttg

SEQ ID NO: 4881084 - DNA, 13 bp, Homo sapiens
ttgagatggggat

SEQ ID NO: 4881085 - DNA, 22 bp, Homo sapiens
ttgagatggggataaaatgact

SEQ ID NO: 4881086 - DNA, 23 bp, Homo sapiens
ttgagatggggataaaatgacta

SEQ ID NO: 4881087 - DNA, 13 bp, Homo sapiens
ttgagctggcctc

SEQ ID NO: 4881088 - DNA, 18 bp, Homo sapiens
ttgaggagcatgttttgt

SEQ ID NO: 4881089 - DNA, 12 bp, Homo sapiens
ttgaggagcccc

SEQ ID NO: 4881090 - DNA, 18 bp, Homo sapiens
ttgaggcaagtgtgggcc

SEQ ID NO: 4881091 - DNA, 14 bp, Homo sapiens
ttgaggctttgtgt

SEQ ID NO: 4881092 - DNA, 20 bp, Homo sapiens
ttgagggacgctttgtctgt

SEQ ID NO: 4881093 - DNA, 18 bp, Homo sapiens
ttgagggactgcctctgc

SEQ ID NO: 4881094 - DNA, 20 bp, Homo sapiens
ttgagggactgcctctgcca

SEQ ID NO: 4881095 - DNA, 19 bp, Homo sapiens
ttgagggcccagagcagga

SEQ ID NO: 4881096 - DNA, 20 bp, Homo sapiens
ttgagtagacacatttaagg

SEQ ID NO: 4881097 - DNA, 19 bp, Homo sapiens
ttgagtataagaaatgcat

SEQ ID NO: 4881098 - DNA, 15 bp, Homo sapiens
ttgagtgtgtgtgtg

SEQ ID NO: 4881099 - DNA, 22 bp, Homo sapiens
ttgataacaatgacactagaaa

SEQ ID NO: 4881100 - DNA, 18 bp, Homo sapiens
ttgataataatattgttt

SEQ ID NO: 4881101 - DNA, 23 bp, Homo sapiens
ttgataatgctttcacaacattt

SEQ ID NO: 4881102 - DNA, 22 bp, Homo sapiens
ttgataatgttaaatttgtaag

SEQ ID NO: 4881103 - DNA, 13 bp, Homo sapiens
ttgatacccccct

SEQ ID NO: 4881104 - DNA, 23 bp, Homo sapiens
ttgatatatattataaatatata

SEQ ID NO: 4881105 - DNA, 14 bp, Homo sapiens
ttgatcatttcttg

SEQ ID NO: 4881106 - DNA, 22 bp, Homo sapiens
ttgatcattttccccccactct

SEQ ID NO: 4881107 - DNA, 16 bp, Homo sapiens
ttgatgaagcaaggaa

SEQ ID NO: 4881108 - DNA, 17 bp, Homo sapiens
ttgatgacccccaacca

SEQ ID NO: 4881109 - DNA, 18 bp, Homo sapiens
ttgatgcacagagaagct

SEQ ID NO: 4881110 - DNA, 14 bp, Homo sapiens
ttgatgcagcattt

SEQ ID NO: 4881111 - DNA, 15 bp, Homo sapiens
ttgatgcagcatttg

SEQ ID NO: 4881112 - DNA, 18 bp, Homo sapiens
ttgatgcagcatttgata

SEQ ID NO: 4881113 - DNA, 22 bp, Homo sapiens
ttgatgtatccaacaagccaga

SEQ ID NO: 4881114 - DNA, 22 bp, Homo sapiens
ttgatgtttgtggcctcagaat

SEQ ID NO: 4881115 - DNA, 17 bp, Homo sapiens
ttgattaagattttaca

SEQ ID NO: 4881116 - DNA, 21 bp, Homo sapiens
ttgattatccatattgagtca

SEQ ID NO: 4881117 - DNA, 20 bp, Homo sapiens
ttgattctccttttatgtgt

SEQ ID NO: 4881118 - DNA, 13 bp, Homo sapiens
ttgattgatttga

SEQ ID NO: 4881119 - DNA, 12 bp, Homo sapiens
ttgatttatgca

SEQ ID NO: 4881120 - DNA, 14 bp, Homo sapiens
ttgatttgcattga

SEQ ID NO: 4881121 - DNA, 17 bp, Homo sapiens
ttgatttgcattgaaca

SEQ ID NO: 4881122 - DNA, 17 bp, Homo sapiens
ttgatttttactgtgtt

SEQ ID NO: 4881123 - DNA, 19 bp, Homo sapiens
ttgcaaaatagcatttgtt

SEQ ID NO: 4881124 - DNA, 16 bp, Homo sapiens
ttgcaaatcagtgttt

SEQ ID NO: 4881125 - DNA, 14 bp, Homo sapiens
ttgcaacaggctgg

SEQ ID NO: 4881126 - DNA, 19 bp, Homo sapiens
ttgcaatggctatatggca

SEQ ID NO: 4881127 - DNA, 15 bp, Homo sapiens
ttgcacatcttggct

SEQ ID NO: 4881128 - DNA, 23 bp, Homo sapiens
ttgcacattgttgtttttttaat

SEQ ID NO: 4881129 - DNA, 14 bp, Homo sapiens
ttgcacattttgat

SEQ ID NO: 4881130 - DNA, 13 bp, Homo sapiens
ttgcacccctcac

SEQ ID NO: 4881131 - DNA, 22 bp, Homo sapiens
ttgcacccctcactctggcctc

SEQ ID NO: 4881132 - DNA, 24 bp, Homo sapiens
ttgcacccctcactctggcctcag

SEQ ID NO: 4881133 - DNA, 21 bp, Homo sapiens
ttgcacgacgccctctcccca

SEQ ID NO: 4881134 - DNA, 19 bp, Homo sapiens
ttgcactaaagtatgtaaa

SEQ ID NO: 4881135 - DNA, 17 bp, Homo sapiens
ttgcactggagttctat

SEQ ID NO: 4881136 - DNA, 20 bp, Homo sapiens
ttgcacttgtgattatttat

SEQ ID NO: 4881137 - DNA, 22 bp, Homo sapiens
ttgcagacaggcaagcacctcc

SEQ ID NO: 4881138 - DNA, 14 bp, Homo sapiens
ttgcagctttatgt

SEQ ID NO: 4881139 - DNA, 18 bp, Homo sapiens
ttgcagctttatgttcat

SEQ ID NO: 4881140 - DNA, 14 bp, Homo sapiens
ttgcagggcagccc

SEQ ID NO: 4881141 - DNA, 18 bp, Homo sapiens
ttgcaggtggaactcagt

SEQ ID NO: 4881142 - DNA, 20 bp, Homo sapiens
ttgcatcacctctgtaattt

SEQ ID NO: 4881143 - DNA, 15 bp, Homo sapiens
ttgcattctattgcc

SEQ ID NO: 4881144 - DNA, 16 bp, Homo sapiens
ttgcattctattgcct

SEQ ID NO: 4881145 - DNA, 17 bp, Homo sapiens
ttgcattctattgcctt

SEQ ID NO: 4881146 - DNA, 20 bp, Homo sapiens
ttgcattctattgccttctt

SEQ ID NO: 4881147 - DNA, 22 bp, Homo sapiens
ttgcattctattgccttctttg

SEQ ID NO: 4881148 - DNA, 21 bp, Homo sapiens
ttgcattgaccgcgactaatt

SEQ ID NO: 4881149 - DNA, 13 bp, Homo sapiens
ttgccaagacaaa

SEQ ID NO: 4881150 - DNA, 16 bp, Homo sapiens
ttgccactaattttag

SEQ ID NO: 4881151 - DNA, 21 bp, Homo sapiens
ttgccactaattttagtattc

SEQ ID NO: 4881152 - DNA, 22 bp, Homo sapiens
tgcccactgctgcagtagggga

SEQ ID NO: 4881153 - DNA, 12 bp, Homo sapiens
tgcccactgttt

SEQ ID NO: 4881154 - DNA, 16 bp, Homo sapiens
tgcccagaacttccct

SEQ ID NO: 4881155 - DNA, 17 bp, Homo sapiens
tgcccagaacttccctg

SEQ ID NO: 4881156 - DNA, 20 bp, Homo sapiens
tgcccagcccggaccttggc

SEQ ID NO: 4881157 - DNA, 17 bp, Homo sapiens
tgcccaggcaggtcttg

SEQ ID NO: 4881158 - DNA, 12 bp, Homo sapiens
tgcccaggcccc

SEQ ID NO: 4881159 - DNA, 14 bp, Homo sapiens
tgcccaggcccctg

SEQ ID NO: 4881160 - DNA, 17 bp, Homo sapiens
tgcccaggcccctgcca

SEQ ID NO: 4881161 - DNA, 20 bp, Homo sapiens
tgcccaggcccctgccaccc

SEQ ID NO: 4881162 - DNA, 21 bp, Homo sapiens
tgcccaggccggccagcctca

SEQ ID NO: 4881163 - DNA, 13 bp, Homo sapiens
tgcccaggctggc

SEQ ID NO: 4881164 - DNA, 14 bp, Homo sapiens
tgcccaggctgtgc

SEQ ID NO: 4881165 - DNA, 20 bp, Homo sapiens
tgcccatcacagggttgggc

SEQ ID NO: 4881166 - DNA, 18 bp, Homo sapiens
tgcccattcaccaaaatt

SEQ ID NO: 4881167 - DNA, 13 bp, Homo sapiens
tgccccagagctg

SEQ ID NO: 4881168 - DNA, 17 bp, Homo sapiens
tgccccagagctgttta

SEQ ID NO: 4881169 - DNA, 12 bp, Homo sapiens
tgccccatgcct

SEQ ID NO: 4881170 - DNA, 17 bp, Homo sapiens
tgcccccagcccaaagg

SEQ ID NO: 4881171 - DNA, 18 bp, Homo sapiens
tgcccccggccccctggt

SEQ ID NO: 4881172 - DNA, 21 bp, Homo sapiens
tgcccccggccccctggtctc

SEQ ID NO: 4881173 - DNA, 22 bp, Homo sapiens
tgccccctgctggctcttctgc

SEQ ID NO: 4881174 - DNA, 15 bp, Homo sapiens
tgcatccttcctata

SEQ ID NO: 4881175 - DNA, 18 bp, Homo sapiens
tgcatccttcctataact

SEQ ID NO: 4881176 - DNA, 19 bp, Homo sapiens
tgcatctcaaaattattct

SEQ ID NO: 4881177 - DNA, 21 bp, Homo sapiens
tgcatctcactggatgcaaag

SEQ ID NO: 4881178 - DNA, 15 bp, Homo sapiens
tgcatctcagcccac

SEQ ID NO: 4881179 - DNA, 16 bp, Homo sapiens
tgcatgaagagaagca

SEQ ID NO: 4881180 - DNA, 19 bp, Homo sapiens
tgcatggaaacctgaaaaa

SEQ ID NO: 4881181 - DNA, 22 bp, Homo sapiens
tgcatggctccagaaatgtcta

SEQ ID NO: 4881182 - DNA, 23 bp, Homo sapiens
tgcatgtcctttgcgcctgtgac

SEQ ID NO: 4881183 - DNA, 21 bp, Homo sapiens
tgcatgtggtttggttcctct

SEQ ID NO: 4881184 - DNA, 14 bp, Homo sapiens
tgcattaaacctgt

SEQ ID NO: 4881185 - DNA, 15 bp, Homo sapiens
tgcattaaacctgtc

SEQ ID NO: 4881186 - DNA, 16 bp, Homo sapiens
tgcattaaacctgtct

SEQ ID NO: 4881187 - DNA, 21 bp, Homo sapiens
tgcattaaacctgtctccact

SEQ ID NO: 4881188 - DNA, 14 bp, Homo sapiens
tgcattaaattcac

SEQ ID NO: 4881189 - DNA, 15 bp, Homo sapiens
tgcattaaattcaca

SEQ ID NO: 4881190 - DNA, 23 bp, Homo sapiens
tgcattagcacagattttaattg

SEQ ID NO: 4881191 - DNA, 19 bp, Homo sapiens
tgcattagggatgcctcct

SEQ ID NO: 4881192 - DNA, 21 bp, Homo sapiens
tgaggctctgacccagtgaga

SEQ ID NO: 4881193 - DNA, 23 bp, Homo sapiens
tgaggctttggatttgacattgc

SEQ ID NO: 4881194 - DNA, 18 bp, Homo sapiens
tgaggctttgtgttgtaa

SEQ ID NO: 4881195 - DNA, 13 bp, Homo sapiens
tgagggactctga

SEQ ID NO: 4881196 - DNA, 23 bp, Homo sapiens
tgagggaggacaggcgggaggag

SEQ ID NO: 4881197 - DNA, 12 bp, Homo sapiens
tgagggcaaatc

SEQ ID NO: 4881198 - DNA, 14 bp, Homo sapiens
tgagggcccagagc

SEQ ID NO: 4881199 - DNA, 15 bp, Homo sapiens
tgagggcccagagca

SEQ ID NO: 4881200 - DNA, 16 bp, Homo sapiens
tgagggcccagagcag

SEQ ID NO: 4881201 - DNA, 18 bp, Homo sapiens
tgagggcccagagcagga

SEQ ID NO: 4881202 - DNA, 19 bp, Homo sapiens
tgagggcccagagcaggaa

SEQ ID NO: 4881203 - DNA, 17 bp, Homo sapiens
tgaggggcatctgcccc

SEQ ID NO: 4881204 - DNA, 19 bp, Homo sapiens
tgagggtccccacctggga

SEQ ID NO: 4881205 - DNA, 14 bp, Homo sapiens
tgaggtaaagatat

SEQ ID NO: 4881206 - DNA, 15 bp, Homo sapiens
tgaggtaagtttttt

SEQ ID NO: 4881207 - DNA, 22 bp, Homo sapiens
tgaggtagaccaggatttctaa

SEQ ID NO: 4881208 - DNA, 13 bp, Homo sapiens
tgaggtcagagcc

SEQ ID NO: 4881209 - DNA, 14 bp, Homo sapiens
tgaggtcagggagt

SEQ ID NO: 4881210 - DNA, 16 bp, Homo sapiens
tgaggtcagggagtgc

SEQ ID NO: 4881211 - DNA, 17 bp, Homo sapiens
tgaggtcccaggcagag

SEQ ID NO: 4881212 - DNA, 19 bp, Homo sapiens
tgaggtcccaggcagagaa

SEQ ID NO: 4881213 - DNA, 18 bp, Homo sapiens
tgaggtgaaagggagcta

SEQ ID NO: 4881214 - DNA, 19 bp, Homo sapiens
tgagtagatattactttat

SEQ ID NO: 4881215 - DNA, 18 bp, Homo sapiens
tgagtatacaatatataa

SEQ ID NO: 4881216 - DNA, 17 bp, Homo sapiens
tgagtatgtggaaggca

SEQ ID NO: 4881217 - DNA, 16 bp, Homo sapiens
tgagtcaccaagccca

SEQ ID NO: 4881218 - DNA, 17 bp, Homo sapiens
tgagtcaccaagcccag

SEQ ID NO: 4881219 - DNA, 18 bp, Homo sapiens
tgagtcaccaagcccagt

SEQ ID NO: 4881220 - DNA, 17 bp, Homo sapiens
tgagtcagggcccagag

SEQ ID NO: 4881221 - DNA, 22 bp, Homo sapiens
tgagtcagggcccagaggctga

SEQ ID NO: 4881222 - DNA, 23 bp, Homo sapiens
tgagtcatttaaatgtgtacaat

SEQ ID NO: 4881223 - DNA, 18 bp, Homo sapiens
tgagtcccccagagatgt

SEQ ID NO: 4881224 - DNA, 18 bp, Homo sapiens
tgagtcgtcatcactttt

SEQ ID NO: 4881225 - DNA, 21 bp, Homo sapiens
tgagtctttggttctaaggac

SEQ ID NO: 4881226 - DNA, 23 bp, Homo sapiens
tgagtgagaggcgacaggagtat

SEQ ID NO: 4881227 - DNA, 16 bp, Homo sapiens
tgagtgagcctggctc

SEQ ID NO: 4881228 - DNA, 17 bp, Homo sapiens
tgagtgagcctggctct

SEQ ID NO: 4881229 - DNA, 13 bp, Homo sapiens
tgagtgtgacagg

SEQ ID NO: 4881230 - DNA, 16 bp, Homo sapiens
tgagtgtgacagggcc

SEQ ID NO: 4881231 - DNA, 17 bp, Homo sapiens
tgagtgtgacagggcca

SEQ ID NO: 4881232 - DNA, 16 bp, Homo sapiens
tgagtgtgcatggagg

SEQ ID NO: 4881233 - DNA, 23 bp, Homo sapiens
tgagttattccttgatcattttg

SEQ ID NO: 4881234 - DNA, 18 bp, Homo sapiens
tgagttcataccctgtta

SEQ ID NO: 4881235 - DNA, 15 bp, Homo sapiens
tgagttctacataag

SEQ ID NO: 4881236 - DNA, 23 bp, Homo sapiens
tgagttgccaagacaaatcaaca

SEQ ID NO: 4881237 - DNA, 18 bp, Homo sapiens
tgagttgtgaaagttttg

SEQ ID NO: 4881238 - DNA, 19 bp, Homo sapiens
tgagtttcattctcctgcc

SEQ ID NO: 4881239 - DNA, 22 bp, Homo sapiens
tgagtttgccctggtttcactg

SEQ ID NO: 4881240 - DNA, 16 bp, Homo sapiens
tgagtttgtaggtaaa

SEQ ID NO: 4881241 - DNA, 21 bp, Homo sapiens
tgagtttgtaggtaaaatgta

SEQ ID NO: 4881242 - DNA, 20 bp, Homo sapiens
tgataaaagggcaaatctgc

SEQ ID NO: 4881243 - DNA, 20 bp, Homo sapiens
tgataaagcctcaaggtttt

SEQ ID NO: 4881244 - DNA, 22 bp, Homo sapiens
tgataactgtttatatgtgttg

SEQ ID NO: 4881245 - DNA, 12 bp, Homo sapiens
tgataagtaaat

SEQ ID NO: 4881246 - DNA, 14 bp, Homo sapiens
tgataataaattga

SEQ ID NO: 4881247 - DNA, 17 bp, Homo sapiens
tgataataatattgttt

SEQ ID NO: 4881248 - DNA, 21 bp, Homo sapiens
tgataatgataaaacacctca

SEQ ID NO: 4881249 - DNA, 22 bp, Homo sapiens
tgatacttatattttcgtatga

SEQ ID NO: 4881250 - DNA, 17 bp, Homo sapiens
tgatagacaattgaggt

SEQ ID NO: 4881251 - DNA, 13 bp, Homo sapiens
tgatagcattgct

SEQ ID NO: 4881252 - DNA, 16 bp, Homo sapiens
tgatagctaacatttt

SEQ ID NO: 4881253 - DNA, 21 bp, Homo sapiens
tgataggaatgtgaaagcacg

SEQ ID NO: 4881254 - DNA, 16 bp, Homo sapiens
tgataggaattcatct

SEQ ID NO: 4881255 - DNA, 18 bp, Homo sapiens
tgatatccctgatcctaa

SEQ ID NO: 4881256 - DNA, 18 bp, Homo sapiens
tgatatctatagtagaca

SEQ ID NO: 4881257 - DNA, 15 bp, Homo sapiens
tgatatgagtataca

SEQ ID NO: 4881258 - DNA, 19 bp, Homo sapiens
tgatatgagtatacaatat

SEQ ID NO: 4881259 - DNA, 19 bp, Homo sapiens
tgatatggcagaagacacc

SEQ ID NO: 4881260 - DNA, 14 bp, Homo sapiens
tgatatgggactga

SEQ ID NO: 4881261 - DNA, 15 bp, Homo sapiens
tgatattctaagact

SEQ ID NO: 4881262 - DNA, 22 bp, Homo sapiens
tgatattttcaacgcagccctg

SEQ ID NO: 4881263 - DNA, 23 bp, Homo sapiens
tgatattttcaacgcagccctgc

SEQ ID NO: 4881264 - DNA, 21 bp, Homo sapiens
tgatcaattatagtttctgag

SEQ ID NO: 4881265 - DNA, 16 bp, Homo sapiens
tgatcacactatttta

SEQ ID NO: 4881266 - DNA, 14 bp, Homo sapiens
tgatcacgcctggc

SEQ ID NO: 4881267 - DNA, 14 bp, Homo sapiens
tgatcacggctcac

SEQ ID NO: 4881268 - DNA, 15 bp, Homo sapiens
tgatcacggctcact

SEQ ID NO: 4881269 - DNA, 20 bp, Homo sapiens
tgatcacggctcactgcagc

SEQ ID NO: 4881270 - DNA, 22 bp, Homo sapiens
tgatcacggctcactgcagcct

SEQ ID NO: 4881271 - DNA, 22 bp, Homo sapiens
tgatcactccaggtagtttggg

SEQ ID NO: 4881272 - DNA, 17 bp, Homo sapiens
tgatcataagtgaattt

SEQ ID NO: 4881273 - DNA, 18 bp, Homo sapiens
tgatcataagtgaattta

SEQ ID NO: 4881274 - DNA, 13 bp, Homo sapiens
tgatcatccactg

SEQ ID NO: 4881275 - DNA, 21 bp, Homo sapiens
tgatcattttccccccactct

SEQ ID NO: 4881276 - DNA, 12 bp, Homo sapiens
tgatctcttcct

SEQ ID NO: 4881277 - DNA, 13 bp, Homo sapiens
tgatctcttcctg

SEQ ID NO: 4881278 - DNA, 23 bp, Homo sapiens
tgatctcttcttttggcttccat

SEQ ID NO: 4881279 - DNA, 16 bp, Homo sapiens
tgatctgtcttgtaat

SEQ ID NO: 4881280 - DNA, 17 bp, Homo sapiens
tgatctgtcttgtaata

SEQ ID NO: 4881281 - DNA, 21 bp, Homo sapiens
tgatctgtgatagttcacccc

SEQ ID NO: 4881282 - DNA, 15 bp, Homo sapiens
tgatctgtttttcac

SEQ ID NO: 4881283 - DNA, 18 bp, Homo sapiens
tgatcttaatatatttga

SEQ ID NO: 4881284 - DNA, 19 bp, Homo sapiens
tgatcttctgggagcagga

SEQ ID NO: 4881285 - DNA, 16 bp, Homo sapiens
tgatctttgcagacag

SEQ ID NO: 4881286 - DNA, 20 bp, Homo sapiens
tgatctttgcagacaggcaa

SEQ ID NO: 4881287 - DNA, 14 bp, Homo sapiens
tgatgaaaagattt

SEQ ID NO: 4881288 - DNA, 23 bp, Homo sapiens
tgatgaaatgaggtcagagcctg

SEQ ID NO: 4881289 - DNA, 18 bp, Homo sapiens
tgcaataacttctgacct

SEQ ID NO: 4881290 - DNA, 15 bp, Homo sapiens
tgcaatatctgaagc

SEQ ID NO: 4881291 - DNA, 14 bp, Homo sapiens
tgcaatattccttt

SEQ ID NO: 4881292 - DNA, 17 bp, Homo sapiens
tgcaatcatatgtgatc

SEQ ID NO: 4881293 - DNA, 21 bp, Homo sapiens
tgcaatgaaaggtactatatt

SEQ ID NO: 4881294 - DNA, 22 bp, Homo sapiens
tgcaatgaaaggtactatattt

SEQ ID NO: 4881295 - DNA, 13 bp, Homo sapiens
tgcaatggcagcc

SEQ ID NO: 4881296 - DNA, 14 bp, Homo sapiens
tgcaatggcagcct

SEQ ID NO: 4881297 - DNA, 19 bp, Homo sapiens
tgcaattagcctcatagtt

SEQ ID NO: 4881298 - DNA, 20 bp, Homo sapiens
tgcaattaggtttttcctta

SEQ ID NO: 4881299 - DNA, 14 bp, Homo sapiens
tgcaattcaaaagt

SEQ ID NO: 4881300 - DNA, 16 bp, Homo sapiens
tgcaattcaaaagttc

SEQ ID NO: 4881301 - DNA, 18 bp, Homo sapiens
tgcaattcaaaagttcca

SEQ ID NO: 4881302 - DNA, 18 bp, Homo sapiens
tgcaatttattaaaatga

SEQ ID NO: 4881303 - DNA, 22 bp, Homo sapiens
tgcaatttattaaaatgattgt

SEQ ID NO: 4881304 - DNA, 16 bp, Homo sapiens
tctggcttattttaat

SEQ ID NO: 4881305 - DNA, 19 bp, Homo sapiens
tctgggaacctcccagagg

SEQ ID NO: 4881306 - DNA, 22 bp, Homo sapiens
tctgggaacctcccagaggtcc

SEQ ID NO: 4881307 - DNA, 20 bp, Homo sapiens
tctgggcacactctgccagc

SEQ ID NO: 4881308 - DNA, 17 bp, Homo sapiens
tctgggcctgggctagg

SEQ ID NO: 4881309 - DNA, 18 bp, Homo sapiens
tctgggcctgggctaggg

SEQ ID NO: 4881310 - DNA, 20 bp, Homo sapiens
tctgggctaggtagaaaaag

SEQ ID NO: 4881311 - DNA, 16 bp, Homo sapiens
tctgggctatggacac

SEQ ID NO: 4881312 - DNA, 21 bp, Homo sapiens
tctgggctatggacacagggt

SEQ ID NO: 4881313 - DNA, 14 bp, Homo sapiens
tctgggctctttcc

SEQ ID NO: 4881314 - DNA, 22 bp, Homo sapiens
tctggggtctttttatgcattt

SEQ ID NO: 4881315 - DNA, 14 bp, Homo sapiens
tctgggttcactgc

SEQ ID NO: 4881316 - DNA, 15 bp, Homo sapiens
tctggtgcctccaga

SEQ ID NO: 4881317 - DNA, 11 bp, Homo sapiens
tctggttctaa

SEQ ID NO: 4881318 - DNA, 14 bp, Homo sapiens
tctggtttctcatt

SEQ ID NO: 4881319 - DNA, 13 bp, Homo sapiens
tctggttttaaca

SEQ ID NO: 4881320 - DNA, 16 bp, Homo sapiens
tctgtaaaaacactga

SEQ ID NO: 4881321 - DNA, 18 bp, Homo sapiens
tctgtaaactcaaaactt

SEQ ID NO: 4881322 - DNA, 13 bp, Homo sapiens
tctgtaaatacca

SEQ ID NO: 4881323 - DNA, 16 bp, Homo sapiens
tctgtaaatatgtttt

SEQ ID NO: 4881324 - DNA, 23 bp, Homo sapiens
tctgtaacatcactatccatgca

SEQ ID NO: 4881325 - DNA, 15 bp, Homo sapiens
tctgtaatttttcag

SEQ ID NO: 4881326 - DNA, 13 bp, Homo sapiens
tctgtacattttg

SEQ ID NO: 4881327 - DNA, 19 bp, Homo sapiens
tctgtacattttgttgtaa

SEQ ID NO: 4881328 - DNA, 17 bp, Homo sapiens
tctgtacgtctgacagg

SEQ ID NO: 4881329 - DNA, 18 bp, Homo sapiens
tctgtacgtctgacaggc

SEQ ID NO: 4881330 - DNA, 23 bp, Homo sapiens
tctgtataaacattaaatgtctt

SEQ ID NO: 4881331 - DNA, 15 bp, Homo sapiens
tctgtatacaaccct

SEQ ID NO: 4881332 - DNA, 17 bp, Homo sapiens
tctgtattgtgctgatt

SEQ ID NO: 4881333 - DNA, 18 bp, Homo sapiens
tctgtatttcatgtggct

SEQ ID NO: 4881334 - DNA, 19 bp, Homo sapiens
tctgtcaaaacactgtgga

SEQ ID NO: 4881335 - DNA, 15 bp, Homo sapiens
tctgtcacaccagcc

SEQ ID NO: 4881336 - DNA, 15 bp, Homo sapiens
tctgtcagatgagaa

SEQ ID NO: 4881337 - DNA, 21 bp, Homo sapiens
tctgtcagcgcaggtttagtt

SEQ ID NO: 4881338 - DNA, 20 bp, Homo sapiens
tctgtcatttgagcagggct

SEQ ID NO: 4881339 - DNA, 17 bp, Homo sapiens
tctgtccaaaggaggct

SEQ ID NO: 4881340 - DNA, 23 bp, Homo sapiens
tctgtccaaaggaggctggcagg

SEQ ID NO: 4881341 - DNA, 14 bp, Homo sapiens
tctgtcctactctg

SEQ ID NO: 4881342 - DNA, 14 bp, Homo sapiens
tctgtcgcccagtc

SEQ ID NO: 4881343 - DNA, 22 bp, Homo sapiens
tctgtctacaaatataagattt

SEQ ID NO: 4881344 - DNA, 19 bp, Homo sapiens
tctgtctcagacttttgta

SEQ ID NO: 4881345 - DNA, 22 bp, Homo sapiens
tctgtctcagacttttgtacat

SEQ ID NO: 4881346 - DNA, 17 bp, Homo sapiens
tctgtctcatcctcctg

SEQ ID NO: 4881347 - DNA, 19 bp, Homo sapiens
tctgtctcatcctcctgga

SEQ ID NO: 4881348 - DNA, 22 bp, Homo sapiens
tctgtctcccagttatgaatca

SEQ ID NO: 4881349 - DNA, 15 bp, Homo sapiens
tctgtcttcacagct

SEQ ID NO: 4881350 - DNA, 12 bp, Homo sapiens
tctgtcttgtaa

SEQ ID NO: 4881351 - DNA, 14 bp, Homo sapiens
tctgtcttgtaata

SEQ ID NO: 4881352 - DNA, 13 bp, Homo sapiens
tctgtgaaacctg

SEQ ID NO: 4881353 - DNA, 17 bp, Homo sapiens
tctgtgaaatgctggca

SEQ ID NO: 4881354 - DNA, 16 bp, Homo sapiens
tctgtgacctcaggca

SEQ ID NO: 4881355 - DNA, 20 bp, Homo sapiens
tctgtgaggaaagcacacag

SEQ ID NO: 4881356 - DNA, 14 bp, Homo sapiens
tctgtgatgagctg

SEQ ID NO: 4881357 - DNA, 15 bp, Homo sapiens
tctgtgccccatgcc

SEQ ID NO: 4881358 - DNA, 22 bp, Homo sapiens
tctgtgccttcttttgattatg

SEQ ID NO: 4881359 - DNA, 14 bp, Homo sapiens
tctgtgctgacatg

SEQ ID NO: 4881360 - DNA, 21 bp, Homo sapiens
tctgtggcttcccatgtcttt

SEQ ID NO: 4881361 - DNA, 17 bp, Homo sapiens
tctgtgtcaggtggggc

SEQ ID NO: 4881362 - DNA, 17 bp, Homo sapiens
tctgtgtctaagattct

SEQ ID NO: 4881363 - DNA, 18 bp, Homo sapiens
tctgtgtctaagattcta

SEQ ID NO: 4881364 - DNA, 14 bp, Homo sapiens
tctgtgtgcacaaa

SEQ ID NO: 4881365 - DNA, 21 bp, Homo sapiens
tctgtgtgcacaaatatttat

SEQ ID NO: 4881366 - DNA, 18 bp, Homo sapiens
tctgtgtgcaccttacca

SEQ ID NO: 4881367 - DNA, 23 bp, Homo sapiens
tctgtgtttaatttcttcaaaat

SEQ ID NO: 4881368 - DNA, 13 bp, Homo sapiens
tctgtgtttataa

SEQ ID NO: 4881369 - DNA, 19 bp, Homo sapiens
tctgttatatcccctgcta

SEQ ID NO: 4881370 - DNA, 18 bp, Homo sapiens
tctgttatgtactgtact

SEQ ID NO: 4881371 - DNA, 19 bp, Homo sapiens
tctgttatgtactgtacta

SEQ ID NO: 4881372 - DNA, 21 bp, Homo sapiens
tctgttctacccgttccaaaa

SEQ ID NO: 4881373 - DNA, 16 bp, Homo sapiens
tctgttggattccatg

SEQ ID NO: 4881374 - DNA, 19 bp, Homo sapiens
tctgttggccagtgtgaca

SEQ ID NO: 4881375 - DNA, 11 bp, Homo sapiens
tctgttgtaac

SEQ ID NO: 4881376 - DNA, 13 bp, Homo sapiens
tctgttgtaactt

SEQ ID NO: 4881377 - DNA, 18 bp, Homo sapiens
tctgttgtgtgtcatgcc

SEQ ID NO: 4881378 - DNA, 22 bp, Homo sapiens
tctgtttaaagcatatagagat

SEQ ID NO: 4881379 - DNA, 14 bp, Homo sapiens
tctgtttgattctt

SEQ ID NO: 4881380 - DNA, 13 bp, Homo sapiens
tctgtttgtttca

SEQ ID NO: 4881381 - DNA, 18 bp, Homo sapiens
tctgttttgtatcttaaa

SEQ ID NO: 4881382 - DNA, 14 bp, Homo sapiens
tcttaaacttgtga

SEQ ID NO: 4881383 - DNA, 17 bp, Homo sapiens
tcttaaagaaacagctt

SEQ ID NO: 4881384 - DNA, 19 bp, Homo sapiens
tcttaaagctgcctgtagt

SEQ ID NO: 4881385 - DNA, 18 bp, Homo sapiens
tcttaaagtgcagttctt

SEQ ID NO: 4881386 - DNA, 19 bp, Homo sapiens
tcttaaataatgcttcaga

SEQ ID NO: 4881387 - DNA, 14 bp, Homo sapiens
tcttaaatatcttt

SEQ ID NO: 4881388 - DNA, 15 bp, Homo sapiens
tcttaagacttttgg

SEQ ID NO: 4881389 - DNA, 20 bp, Homo sapiens
tcttaattattatttgtgtt

SEQ ID NO: 4881390 - DNA, 14 bp, Homo sapiens
tcttacacatacag

SEQ ID NO: 4881391 - DNA, 16 bp, Homo sapiens
tcttacacatacagtt

SEQ ID NO: 4881392 - DNA, 15 bp, Homo sapiens
tcttacgaatatttt

SEQ ID NO: 4881393 - DNA, 15 bp, Homo sapiens
tcttactaatgtaaa

SEQ ID NO: 4881394 - DNA, 20 bp, Homo sapiens
tcttactaatgtaaaatgat

SEQ ID NO: 4881395 - DNA, 16 bp, Homo sapiens
tcttactcctcctctt

SEQ ID NO: 4881396 - DNA, 17 bp, Homo sapiens
tcttactcctcctcttt

SEQ ID NO: 4881397 - DNA, 18 bp, Homo sapiens
tcttactcctcctctttc

SEQ ID NO: 4881398 - DNA, 16 bp, Homo sapiens
tcttacttgagccttt

SEQ ID NO: 4881399 - DNA, 21 bp, Homo sapiens
tcttagattctctgtgtctaa

SEQ ID NO: 4881400 - DNA, 21 bp, Homo sapiens
tcttagctatcattgcttcct

SEQ ID NO: 4881401 - DNA, 14 bp, Homo sapiens
tcttagctttttaa

SEQ ID NO: 4881402 - DNA, 22 bp, Homo sapiens
tcttagctttttaattgttgtt

SEQ ID NO: 4881403 - DNA, 23 bp, Homo sapiens
tcttagtttggattcttatgtag

SEQ ID NO: 4881404 - DNA, 17 bp, Homo sapiens
tcttataatactctgtt

SEQ ID NO: 4881405 - DNA, 13 bp, Homo sapiens
tcttatagttcta

SEQ ID NO: 4881406 - DNA, 22 bp, Homo sapiens
tcttatatagcagcaaaaatat

SEQ ID NO: 4881407 - DNA, 12 bp, Homo sapiens
tcttatctcagt

SEQ ID NO: 4881408 - DNA, 14 bp, Homo sapiens
tcttatctcagtca

SEQ ID NO: 4881409 - DNA, 22 bp, Homo sapiens
tcttatctcagtcatgcataaa

SEQ ID NO: 4881410 - DNA, 16 bp, Homo sapiens
tcttatgcaaaatgga

SEQ ID NO: 4881411 - DNA, 22 bp, Homo sapiens
tcttatggaattgatttgcatt

SEQ ID NO: 4881412 - DNA, 23 bp, Homo sapiens
tcttattatatatataatatata

SEQ ID NO: 4881413 - DNA, 14 bp, Homo sapiens
tcttattgcccacg

SEQ ID NO: 4881414 - DNA, 21 bp, Homo sapiens
tgaaatacctcatgtttatga

SEQ ID NO: 4881415 - DNA, 15 bp, Homo sapiens
tgaaataggaaacaa

SEQ ID NO: 4881416 - DNA, 12 bp, Homo sapiens
tgaaatatgcat

SEQ ID NO: 4881417 - DNA, 11 bp, Homo sapiens
tgaaatatttt

SEQ ID NO: 4881418 - DNA, 22 bp, Homo sapiens
tcagcatttcttttctggccaa

SEQ ID NO: 4881419 - DNA, 17 bp, Homo sapiens
tcagccacacccaggca

SEQ ID NO: 4881420 - DNA, 13 bp, Homo sapiens
tcagcccagaaga

SEQ ID NO: 4881421 - DNA, 15 bp, Homo sapiens
tcagcccagaagaaa

SEQ ID NO: 4881422 - DNA, 16 bp, Homo sapiens
tcagcccccagcccct

SEQ ID NO: 4881423 - DNA, 18 bp, Homo sapiens
tcagcccccagcccctcc

SEQ ID NO: 4881424 - DNA, 20 bp, Homo sapiens
tcagcccccagcccctcccc

SEQ ID NO: 4881425 - DNA, 14 bp, Homo sapiens
tcagccctccctgc

SEQ ID NO: 4881426 - DNA, 13 bp, Homo sapiens
tcagccctgaggt

SEQ ID NO: 4881427 - DNA, 21 bp, Homo sapiens
tcagccggcgtggcaaatata

SEQ ID NO: 4881428 - DNA, 12 bp, Homo sapiens
tcagcctcccga

SEQ ID NO: 4881429 - DNA, 21 bp, Homo sapiens
tcagcctcccgaatagctggg

SEQ ID NO: 4881430 - DNA, 18 bp, Homo sapiens
tcagcctcccgagtagct

SEQ ID NO: 4881431 - DNA, 20 bp, Homo sapiens
tcagcctcccgagtagctgg

SEQ ID NO: 4881432 - DNA, 12 bp, Homo sapiens
tcagcctcttaa

SEQ ID NO: 4881433 - DNA, 16 bp, Homo sapiens
tcagcctgctgcccag

SEQ ID NO: 4881434 - DNA, 21 bp, Homo sapiens
tcagcctgctgcccaggctgt

SEQ ID NO: 4881435 - DNA, 22 bp, Homo sapiens
tcagcctgctgcccaggctgtg

SEQ ID NO: 4881436 - DNA, 19 bp, Homo sapiens
tcagcctgggacagtttat

SEQ ID NO: 4881437 - DNA, 14 bp, Homo sapiens
tcagcggggacagc

SEQ ID NO: 4881438 - DNA, 16 bp, Homo sapiens
tcagcggggacagctc

SEQ ID NO: 4881439 - DNA, 18 bp, Homo sapiens
tcagcggggacagctcct

SEQ ID NO: 4881440 - DNA, 23 bp, Homo sapiens
tcagctaagggaagacatttctt

SEQ ID NO: 4881441 - DNA, 20 bp, Homo sapiens
tcagctatcagtaggctaat

SEQ ID NO: 4881442 - DNA, 20 bp, Homo sapiens
tcagctatttactgccaaag

SEQ ID NO: 4881443 - DNA, 14 bp, Homo sapiens
tcagctccagctca

SEQ ID NO: 4881444 - DNA, 18 bp, Homo sapiens
tcagctccagctcaccag

SEQ ID NO: 4881445 - DNA, 24 bp, Homo sapiens
tcagctccagctcaccagccccag

SEQ ID NO: 4881446 - DNA, 17 bp, Homo sapiens
tcagctcggggagcctt

SEQ ID NO: 4881447 - DNA, 15 bp, Homo sapiens
tcagctctctgtata

SEQ ID NO: 4881448 - DNA, 21 bp, Homo sapiens
tcagctgaatgcctcctgtgg

SEQ ID NO: 4881449 - DNA, 12 bp, Homo sapiens
tcagctgcctca

SEQ ID NO: 4881450 - DNA, 14 bp, Homo sapiens
tcagctgcctcact

SEQ ID NO: 4881451 - DNA, 15 bp, Homo sapiens
tcagctgcctcactt

SEQ ID NO: 4881452 - DNA, 23 bp, Homo sapiens
tcagcttcagaatggcattgtac

SEQ ID NO: 4881453 - DNA, 21 bp, Homo sapiens
tcagcttgtaaatagctcagg

SEQ ID NO: 4881454 - DNA, 22 bp, Homo sapiens
tcagctttgagaagccttcagc

SEQ ID NO: 4881455 - DNA, 13 bp, Homo sapiens
tcaggaacagaag

SEQ ID NO: 4881456 - DNA, 14 bp, Homo sapiens
tcaggaacagaagg

SEQ ID NO: 4881457 - DNA, 22 bp, Homo sapiens
tcaggagagtagaacagataat

SEQ ID NO: 4881458 - DNA, 14 bp, Homo sapiens
tcaggaggcgccct

SEQ ID NO: 4881459 - DNA, 20 bp, Homo sapiens
tcaggagtcccaaggaaagc

SEQ ID NO: 4881460 - DNA, 20 bp, Homo sapiens
tcaggatcaaaccccgacca

SEQ ID NO: 4881461 - DNA, 20 bp, Homo sapiens
tcaggatccaagctaagcac

SEQ ID NO: 4881462 - DNA, 22 bp, Homo sapiens
tcaggatccaagctaagcactg

SEQ ID NO: 4881463 - DNA, 21 bp, Homo sapiens
tcaggatttaaaaactggaac

SEQ ID NO: 4881464 - DNA, 13 bp, Homo sapiens
tcaggcagccagt

SEQ ID NO: 4881465 - DNA, 20 bp, Homo sapiens
tcaggcagccagtgagatga

SEQ ID NO: 4881466 - DNA, 13 bp, Homo sapiens
tcaggccctggaa

SEQ ID NO: 4881467 - DNA, 18 bp, Homo sapiens
tcaggcctataaccccag

SEQ ID NO: 4881468 - DNA, 21 bp, Homo sapiens
tcaggcgatccacctgtctca

SEQ ID NO: 4881469 - DNA, 15 bp, Homo sapiens
tcaggctactagaat

SEQ ID NO: 4881470 - DNA, 19 bp, Homo sapiens
tcaggctgcagctggacag

SEQ ID NO: 4881471 - DNA, 20 bp, Homo sapiens
tcaggctgcagctggacaga

SEQ ID NO: 4881472 - DNA, 17 bp, Homo sapiens
tcaggctggtgggaggg

SEQ ID NO: 4881473 - DNA, 17 bp, Homo sapiens
tcagggccatgcctgcc

SEQ ID NO: 4881474 - DNA, 12 bp, Homo sapiens
tcagggcccaga

SEQ ID NO: 4881475 - DNA, 13 bp, Homo sapiens
tcagggcccagag

SEQ ID NO: 4881476 - DNA, 19 bp, Homo sapiens
tcagggcccagaggctgag

SEQ ID NO: 4881477 - DNA, 23 bp, Homo sapiens
tcagggcctggggcctgagagaa

SEQ ID NO: 4881478 - DNA, 22 bp, Homo sapiens
tcagggggaagaagcagagaga

SEQ ID NO: 4881479 - DNA, 16 bp, Homo sapiens
tcagggttggcccctg

SEQ ID NO: 4881480 - DNA, 19 bp, Homo sapiens
tcagggttggcccctgccc

SEQ ID NO: 4881481 - DNA, 18 bp, Homo sapiens
tcagggttggtgtgctga

SEQ ID NO: 4881482 - DNA, 13 bp, Homo sapiens
tcaggtaacaggc

SEQ ID NO: 4881483 - DNA, 15 bp, Homo sapiens
tcaggtatgttgcct

SEQ ID NO: 4881484 - DNA, 15 bp, Homo sapiens
tcaggtgacatgtga

SEQ ID NO: 4881485 - DNA, 20 bp, Homo sapiens
tcaggtgctgccatccaggt

SEQ ID NO: 4881486 - DNA, 18 bp, Homo sapiens
tcaggtggggcagcttga

SEQ ID NO: 4881487 - DNA, 21 bp, Homo sapiens
tcaggtggggcagcttgaggg

SEQ ID NO: 4881488 - DNA, 18 bp, Homo sapiens
tcaggtgtccctgcactt

SEQ ID NO: 4881489 - DNA, 18 bp, Homo sapiens
tcaggttcagtattatgt

SEQ ID NO: 4881490 - DNA, 15 bp, Homo sapiens
tcaggtttaacattt

SEQ ID NO: 4881491 - DNA, 17 bp, Homo sapiens
tcaggtttaacatttgc

SEQ ID NO: 4881492 - DNA, 22 bp, Homo sapiens
tcagtaaataacaggcatttgt

SEQ ID NO: 4881493 - DNA, 15 bp, Homo sapiens
tcagtaatttgagga

SEQ ID NO: 4881494 - DNA, 19 bp, Homo sapiens
tcagtaccctctcagctcc

SEQ ID NO: 4881495 - DNA, 23 bp, Homo sapiens
tcagtacttgtgaaacacagctg

SEQ ID NO: 4881496 - DNA, 17 bp, Homo sapiens
tcagtatccaggctttg

SEQ ID NO: 4881497 - DNA, 15 bp, Homo sapiens
tcagtatgtattctt

SEQ ID NO: 4881498 - DNA, 20 bp, Homo sapiens
tcagtattttggagaaatta

SEQ ID NO: 4881499 - DNA, 22 bp, Homo sapiens
tcagtattttggagaaattatt

SEQ ID NO: 4881500 - DNA, 15 bp, Homo sapiens
tcccatgaagccttt

SEQ ID NO: 4881501 - DNA, 16 bp, Homo sapiens
tcccatgaagcctttt

SEQ ID NO: 4881502 - DNA, 12 bp, Homo sapiens
tcccatgccctg

SEQ ID NO: 4881503 - DNA, 14 bp, Homo sapiens
tcccatggacactc

SEQ ID NO: 4881504 - DNA, 15 bp, Homo sapiens
tcccatgtagccccc

SEQ ID NO: 4881505 - DNA, 22 bp, Homo sapiens
tcccatgtatttatctctattt

SEQ ID NO: 4881506 - DNA, 16 bp, Homo sapiens
tcccatttgtgccaga

SEQ ID NO: 4881507 - DNA, 14 bp, Homo sapiens
tccccaaaacaaag

SEQ ID NO: 4881508 - DNA, 23 bp, Homo sapiens
tccccaacccccattctcatctg

SEQ ID NO: 4881509 - DNA, 22 bp, Homo sapiens
tccccaaccctaggttccctgt

SEQ ID NO: 4881510 - DNA, 10 bp, Homo sapiens
tccccacact

SEQ ID NO: 4881511 - DNA, 23 bp, Homo sapiens
tccccacccctacccctggctgt

SEQ ID NO: 4881512 - DNA, 22 bp, Homo sapiens
tccccacggggcctcgggacct

SEQ ID NO: 4881513 - DNA, 20 bp, Homo sapiens
tccccagattgcaacaggct

SEQ ID NO: 4881514 - DNA, 20 bp, Homo sapiens
tccccagcaagtgagagctg

SEQ ID NO: 4881515 - DNA, 21 bp, Homo sapiens
tccccagcaagtgagagctgg

SEQ ID NO: 4881516 - DNA, 19 bp, Homo sapiens
tccccagcatcactcccca

SEQ ID NO: 4881517 - DNA, 15 bp, Homo sapiens
tccccagccctggct

SEQ ID NO: 4881518 - DNA, 22 bp, Homo sapiens
tccccagcgtcccagtctctgg

SEQ ID NO: 4881519 - DNA, 17 bp, Homo sapiens
tccccataactcaatgg

SEQ ID NO: 4881520 - DNA, 14 bp, Homo sapiens
tccccatcttctaa

SEQ ID NO: 4881521 - DNA, 22 bp, Homo sapiens
tccccatgccacgttccacagt

SEQ ID NO: 4881522 - DNA, 14 bp, Homo sapiens
tccccattcttcct

SEQ ID NO: 4881523 - DNA, 17 bp, Homo sapiens
tcccccaaagttcacaa

SEQ ID NO: 4881524 - DNA, 16 bp, Homo sapiens
tcccccaacccccacc

SEQ ID NO: 4881525 - DNA, 19 bp, Homo sapiens
tcccccaacccccacccca

SEQ ID NO: 4881526 - DNA, 22 bp, Homo sapiens
tcccccaacccccaccccacac

SEQ ID NO: 4881527 - DNA, 12 bp, Homo sapiens
tcccccaactct

SEQ ID NO: 4881528 - DNA, 17 bp, Homo sapiens
tcccccatctcccaccc

SEQ ID NO: 4881529 - DNA, 12 bp, Homo sapiens
tccccccactct

SEQ ID NO: 4881530 - DNA, 21 bp, Homo sapiens
tccccccactctccccacact

SEQ ID NO: 4881531 - DNA, 20 bp, Homo sapiens
tcccccctttttttcctttt

SEQ ID NO: 4881532 - DNA, 14 bp, Homo sapiens
tcccccgccactcc

SEQ ID NO: 4881533 - DNA, 16 bp, Homo sapiens
tcccccttgccacccc

SEQ ID NO: 4881534 - DNA, 19 bp, Homo sapiens
tccccgaaggtgctggagg

SEQ ID NO: 4881535 - DNA, 22 bp, Homo sapiens
tccccgccttccgccccttccc

SEQ ID NO: 4881536 - DNA, 13 bp, Homo sapiens
tccccgtggtctc

SEQ ID NO: 4881537 - DNA, 18 bp, Homo sapiens
tcccctcacagcctctga

SEQ ID NO: 4881538 - DNA, 20 bp, Homo sapiens
tcccctcacagcctctgacc

SEQ ID NO: 4881539 - DNA, 16 bp, Homo sapiens
tcccctcaggactgca

SEQ ID NO: 4881540 - DNA, 14 bp, Homo sapiens
tcccctcccctgct

SEQ ID NO: 4881541 - DNA, 15 bp, Homo sapiens
tcccctcccctgctg

SEQ ID NO: 4881542 - DNA, 16 bp, Homo sapiens
tcccctcccctgctgc

SEQ ID NO: 4881543 - DNA, 14 bp, Homo sapiens
tcccctccctgtca

SEQ ID NO: 4881544 - DNA, 17 bp, Homo sapiens
tcccctctgctgctgtc

SEQ ID NO: 4881545 - DNA, 20 bp, Homo sapiens
tcccctctgctgctgtccct

SEQ ID NO: 4881546 - DNA, 13 bp, Homo sapiens
tcccctgccattt

SEQ ID NO: 4881547 - DNA, 23 bp, Homo sapiens
tcccctgccctgctgccgcctcc

SEQ ID NO: 4881548 - DNA, 13 bp, Homo sapiens
tcccctgctaccc

SEQ ID NO: 4881549 - DNA, 14 bp, Homo sapiens
tcccctgctaccct

SEQ ID NO: 4881550 - DNA, 23 bp, Homo sapiens
tcccctgctgcaggggctctgga

SEQ ID NO: 4881551 - DNA, 20 bp, Homo sapiens
tcccgaagaatggagaggaa

SEQ ID NO: 4881552 - DNA, 16 bp, Homo sapiens
tcccgagtagctggga

SEQ ID NO: 4881553 - DNA, 17 bp, Homo sapiens
tcccgagtagctgggac

SEQ ID NO: 4881554 - DNA, 20 bp, Homo sapiens
tcccgagtagctgggactac

SEQ ID NO: 4881555 - DNA, 15 bp, Homo sapiens
tcccgagtctgggac

SEQ ID NO: 4881556 - DNA, 23 bp, Homo sapiens
tcccgcatcaaggtcagcatgag

SEQ ID NO: 4881557 - DNA, 18 bp, Homo sapiens
tcccgccagactgttaga

SEQ ID NO: 4881558 - DNA, 16 bp, Homo sapiens
tcccgctcagccctcc

SEQ ID NO: 4881559 - DNA, 14 bp, Homo sapiens
tcccggaggaaatc

SEQ ID NO: 4881560 - DNA, 18 bp, Homo sapiens
tcccggaggttgggtggg

SEQ ID NO: 4881561 - DNA, 14 bp, Homo sapiens
tcccggggctccac

SEQ ID NO: 4881562 - DNA, 16 bp, Homo sapiens
tccctaaaatacattt

SEQ ID NO: 4881563 - DNA, 17 bp, Homo sapiens
tccctaagccagcctgg

SEQ ID NO: 4881564 - DNA, 19 bp, Homo sapiens
tccctaccccctaagagcc

SEQ ID NO: 4881565 - DNA, 13 bp, Homo sapiens
tccctacctcagg

SEQ ID NO: 4881566 - DNA, 15 bp, Homo sapiens
tccctacctcaggca

SEQ ID NO: 4881567 - DNA, 23 bp, Homo sapiens
tccctagatctttctattccaaa

SEQ ID NO: 4881568 - DNA, 20 bp, Homo sapiens
tccctagccagcacttgtat

SEQ ID NO: 4881569 - DNA, 22 bp, Homo sapiens
tccctagccagcacttgtatat

SEQ ID NO: 4881570 - DNA, 13 bp, Homo sapiens
tccctatgtattt

SEQ ID NO: 4881571 - DNA, 14 bp, Homo sapiens
tccctcaccttctg

SEQ ID NO: 4881572 - DNA, 16 bp, Homo sapiens
tccctcagtgccctca

SEQ ID NO: 4881573 - DNA, 14 bp, Homo sapiens
tccctccacctacc

SEQ ID NO: 4881574 - DNA, 16 bp, Homo sapiens
tccctcccacctctgt

SEQ ID NO: 4881575 - DNA, 14 bp, Homo sapiens
tccctccccttctc

SEQ ID NO: 4881576 - DNA, 18 bp, Homo sapiens
tccctcctcacctctgga

SEQ ID NO: 4881577 - DNA, 16 bp, Homo sapiens
tccctctaatgagact

SEQ ID NO: 4881578 - DNA, 16 bp, Homo sapiens
tccctctcaggatcca

SEQ ID NO: 4881579 - DNA, 13 bp, Homo sapiens
tccctctgctcag

SEQ ID NO: 4881580 - DNA, 14 bp, Homo sapiens
tccctctgctcagc

SEQ ID NO: 4881581 - DNA, 15 bp, Homo sapiens
tccctctgctcagcc

SEQ ID NO: 4881582 - DNA, 18 bp, Homo sapiens
tccctctgctcagccaag

SEQ ID NO: 4881583 - DNA, 12 bp, Homo sapiens
tccctcttcact

SEQ ID NO: 4881584 - DNA, 15 bp, Homo sapiens
tccctcttcactccc

SEQ ID NO: 4881585 - DNA, 16 bp, Homo sapiens
tccctcttcactcccc

SEQ ID NO: 4881586 - DNA, 12 bp, Homo sapiens
tccctcttgttt

SEQ ID NO: 4881587 - DNA, 17 bp, Homo sapiens
tccctcttgttttgttt

SEQ ID NO: 4881588 - DNA, 22 bp, Homo sapiens
tccctcttttcttactcctcct

SEQ ID NO: 4881589 - DNA, 18 bp, Homo sapiens
tccctgaagccagccttc

SEQ ID NO: 4881590 - DNA, 16 bp, Homo sapiens
tccctgagcaggaaag

SEQ ID NO: 4881591 - DNA, 17 bp, Homo sapiens
tccctgattgacctgct

SEQ ID NO: 4881592 - DNA, 18 bp, Homo sapiens
tccctgattgacctgctc

SEQ ID NO: 4881593 - DNA, 20 bp, Homo sapiens
tccctgattgacctgctccg

SEQ ID NO: 4881594 - DNA, 22 bp, Homo sapiens
tccctgcactaaagccagcctg

SEQ ID NO: 4881595 - DNA, 20 bp, Homo sapiens
tccctgcacttgcagactct

SEQ ID NO: 4881596 - DNA, 14 bp, Homo sapiens
tccctgcatttctg

SEQ ID NO: 4881597 - DNA, 19 bp, Homo sapiens
tccctgcccctcccttcaa

SEQ ID NO: 4881598 - DNA, 11 bp, Homo sapiens
tccctgcctgg

SEQ ID NO: 4881599 - DNA, 20 bp, Homo sapiens
tccctgccttaggcctacct

SEQ ID NO: 4881600 - DNA, 15 bp, Homo sapiens
tccctgctaatctcc

SEQ ID NO: 4881601 - DNA, 21 bp, Homo sapiens
tccctggagcctccactgcct

SEQ ID NO: 4881602 - DNA, 10 bp, Homo sapiens
tccctggagt

SEQ ID NO: 4881603 - DNA, 14 bp, Homo sapiens
tccctgggaggccc

SEQ ID NO: 4881604 - DNA, 16 bp, Homo sapiens
tccctgggccagggtc

SEQ ID NO: 4881605 - DNA, 24 bp, Homo sapiens
tccctgggccagggtctgtgtgaa

SEQ ID NO: 4881606 - DNA, 20 bp, Homo sapiens
tccctgtgtccacctgtggg

SEQ ID NO: 4881607 - DNA, 15 bp, Homo sapiens
tccctgttcttcctc

SEQ ID NO: 4881608 - DNA, 11 bp, Homo sapiens
tccctgtttaa

SEQ ID NO: 4881609 - DNA, 18 bp, Homo sapiens
tccctgtttaatatttaa

SEQ ID NO: 4881610 - DNA, 18 bp, Homo sapiens
tctacggatcatcaacaa

SEQ ID NO: 4881611 - DNA, 21 bp, Homo sapiens
tctacggatcatcaacaagat

SEQ ID NO: 4881612 - DNA, 18 bp, Homo sapiens
tctactaattccacacct

SEQ ID NO: 4881613 - DNA, 20 bp, Homo sapiens
tctactggtcttgtggaatt

SEQ ID NO: 4881614 - DNA, 13 bp, Homo sapiens
tctagaacacagg

SEQ ID NO: 4881615 - DNA, 20 bp, Homo sapiens
tctagaagtttcccttcctc

SEQ ID NO: 4881616 - DNA, 17 bp, Homo sapiens
tctagaattataagtca

SEQ ID NO: 4881617 - DNA, 17 bp, Homo sapiens
tctagacaagatattgt

SEQ ID NO: 4881618 - DNA, 18 bp, Homo sapiens
tctagacatggaggttct

SEQ ID NO: 4881619 - DNA, 20 bp, Homo sapiens
tctagacatggaggttctaa

SEQ ID NO: 4881620 - DNA, 14 bp, Homo sapiens
tctagactttctgt

SEQ ID NO: 4881621 - DNA, 13 bp, Homo sapiens
tctagagtccaag

SEQ ID NO: 4881622 - DNA, 18 bp, Homo sapiens
tctagagttcagagtcct

SEQ ID NO: 4881623 - DNA, 19 bp, Homo sapiens
tctagatgaagttttacat

SEQ ID NO: 4881624 - DNA, 23 bp, Homo sapiens
tctagatgaagttttacattgtt

SEQ ID NO: 4881625 - DNA, 21 bp, Homo sapiens
tctagatgtttattcttctag

SEQ ID NO: 4881626 - DNA, 23 bp, Homo sapiens
tctagatgtttattcttctagag

SEQ ID NO: 4881627 - DNA, 13 bp, Homo sapiens
tctagattcaaag

SEQ ID NO: 4881628 - DNA, 19 bp, Homo sapiens
tctagattcaaaggttcta

SEQ ID NO: 4881629 - DNA, 23 bp, Homo sapiens
tctagattcaaaggttctaggtt

SEQ ID NO: 4881630 - DNA, 21 bp, Homo sapiens
tctagattccattggtccaag

SEQ ID NO: 4881631 - DNA, 11 bp, Homo sapiens
tctagattctc

SEQ ID NO: 4881632 - DNA, 22 bp, Homo sapiens
tctagcacaatttgcactaaat

SEQ ID NO: 4881633 - DNA, 18 bp, Homo sapiens
tctagcactcattttcta

SEQ ID NO: 4881634 - DNA, 14 bp, Homo sapiens
tctagcctgcactt

SEQ ID NO: 4881635 - DNA, 16 bp, Homo sapiens
tctagcctgcactttg

SEQ ID NO: 4881636 - DNA, 20 bp, Homo sapiens
tctagcctgcactttgatgt

SEQ ID NO: 4881637 - DNA, 22 bp, Homo sapiens
tctaggcactgtagttctaaga

SEQ ID NO: 4881638 - DNA, 18 bp, Homo sapiens
tctagggttgctggagcc

SEQ ID NO: 4881639 - DNA, 21 bp, Homo sapiens
tctagggttgctggagcctga

SEQ ID NO: 4881640 - DNA, 16 bp, Homo sapiens
tctagtacacttttat

SEQ ID NO: 4881641 - DNA, 17 bp, Homo sapiens
tctagtacttgaaaaag

SEQ ID NO: 4881642 - DNA, 14 bp, Homo sapiens
tctagtttacagaa

SEQ ID NO: 4881643 - DNA, 15 bp, Homo sapiens
tctagtttacagaaa

SEQ ID NO: 4881644 - DNA, 22 bp, Homo sapiens
tctataaagcgatatacagatg

SEQ ID NO: 4881645 - DNA, 22 bp, Homo sapiens
tctataaggccataaaacaggt

SEQ ID NO: 4881646 - DNA, 20 bp, Homo sapiens
tctataatcccagcactttg

SEQ ID NO: 4881647 - DNA, 21 bp, Homo sapiens
tctataatcccagcactttgg

SEQ ID NO: 4881648 - DNA, 15 bp, Homo sapiens
tctatacatctctcc

SEQ ID NO: 4881649 - DNA, 18 bp, Homo sapiens
tctatagtagacacacta

SEQ ID NO: 4881650 - DNA, 12 bp, Homo sapiens
tctatagttcta

SEQ ID NO: 4881651 - DNA, 14 bp, Homo sapiens
tctatatatgtgta

SEQ ID NO: 4881652 - DNA, 18 bp, Homo sapiens
tctatcaagtcaatcatt

SEQ ID NO: 4881653 - DNA, 12 bp, Homo sapiens
tctatctctcaa

SEQ ID NO: 4881654 - DNA, 14 bp, Homo sapiens
tctatgagtctaga

SEQ ID NO: 4881655 - DNA, 23 bp, Homo sapiens
tctatgggactcaatgcactgac

SEQ ID NO: 4881656 - DNA, 16 bp, Homo sapiens
tctatggttatgaaag

SEQ ID NO: 4881657 - DNA, 20 bp, Homo sapiens
tctatggttatgaaagaata

SEQ ID NO: 4881658 - DNA, 22 bp, Homo sapiens
tctattaatatatgtattattt

SEQ ID NO: 4881659 - DNA, 19 bp, Homo sapiens
tctattctgagaaaacaag

SEQ ID NO: 4881660 - DNA, 22 bp, Homo sapiens
tctattgacttcaatgatagta

SEQ ID NO: 4881661 - DNA, 20 bp, Homo sapiens
tctattgccttctttgaaga

SEQ ID NO: 4881662 - DNA, 18 bp, Homo sapiens
tctattgtgggacttatt

SEQ ID NO: 4881663 - DNA, 13 bp, Homo sapiens
tctatttatatgt

SEQ ID NO: 4881664 - DNA, 18 bp, Homo sapiens
tctatttatatgtacatg

SEQ ID NO: 4881665 - DNA, 13 bp, Homo sapiens
tctatttatgttt

SEQ ID NO: 4881666 - DNA, 14 bp, Homo sapiens
tctatttattaagt

SEQ ID NO: 4881667 - DNA, 11 bp, Homo sapiens
tctattttcta

SEQ ID NO: 4881668 - DNA, 15 bp, Homo sapiens
tctattttctatgta

SEQ ID NO: 4881669 - DNA, 15 bp, Homo sapiens
tctattttgatgcag

SEQ ID NO: 4881670 - DNA, 18 bp, Homo sapiens
tctattttggattgtata

SEQ ID NO: 4881671 - DNA, 17 bp, Homo sapiens
tctattttgtaaactca

SEQ ID NO: 4881672 - DNA, 14 bp, Homo sapiens
tctcaaaaatacaa

SEQ ID NO: 4881673 - DNA, 18 bp, Homo sapiens
tctcaaaagcatttatca

SEQ ID NO: 4881674 - DNA, 23 bp, Homo sapiens
tctcaaaagcatttatcattctt

SEQ ID NO: 4881675 - DNA, 13 bp, Homo sapiens
tctcaaactcttg

SEQ ID NO: 4881676 - DNA, 22 bp, Homo sapiens
tctcaaactcttgacctcaggt

SEQ ID NO: 4881677 - DNA, 22 bp, Homo sapiens
tctcaaagtttcctaatcagaa

SEQ ID NO: 4881678 - DNA, 16 bp, Homo sapiens
tctcaaagttttgaaa

SEQ ID NO: 4881679 - DNA, 17 bp, Homo sapiens
tctcaaagttttgaaaa

SEQ ID NO: 4881680 - DNA, 20 bp, Homo sapiens
tctcaaagttttgaaaagct

SEQ ID NO: 4881681 - DNA, 21 bp, Homo sapiens
tctcaaatttggattgctaat

SEQ ID NO: 4881682 - DNA, 23 bp, Homo sapiens
tctcaagggctagcatccctgag

SEQ ID NO: 4881683 - DNA, 15 bp, Homo sapiens
tctcaagttctaaga

SEQ ID NO: 4881684 - DNA, 17 bp, Homo sapiens
tctcaagttctaagatt

SEQ ID NO: 4881685 - DNA, 21 bp, Homo sapiens
tctcaagttctaagattctaa

SEQ ID NO: 4881686 - DNA, 16 bp, Homo sapiens
tctcacagcacatgct

SEQ ID NO: 4881687 - DNA, 23 bp, Homo sapiens
tctcacagcacatgctggccagc

SEQ ID NO: 4881688 - DNA, 19 bp, Homo sapiens
tctcaccccatcccacacc

SEQ ID NO: 4881689 - DNA, 21 bp, Homo sapiens
tctcaccccatcccacaccct

SEQ ID NO: 4881690 - DNA, 23 bp, Homo sapiens
tctcacgggcatgggcactccct

SEQ ID NO: 4881691 - DNA, 17 bp, Homo sapiens
tctcactatgttgccca

SEQ ID NO: 4881692 - DNA, 22 bp, Homo sapiens
tctcactatgttgcccaggcag

SEQ ID NO: 4881693 - DNA, 20 bp, Homo sapiens
tctcactctaggagttcagt

SEQ ID NO: 4881694 - DNA, 18 bp, Homo sapiens
tctcactctgtcgcccag

SEQ ID NO: 4881695 - DNA, 18 bp, Homo sapiens
tctcactgttgcccaggc

SEQ ID NO: 4881696 - DNA, 19 bp, Homo sapiens
tctcactgttgcccaggct

SEQ ID NO: 4881697 - DNA, 18 bp, Homo sapiens
tctcagacttttgtacat

SEQ ID NO: 4881698 - DNA, 15 bp, Homo sapiens
tctcagatgcagttt

SEQ ID NO: 4881699 - DNA, 18 bp, Homo sapiens
tctcagcccagaagaaaa

SEQ ID NO: 4881700 - DNA, 11 bp, Homo sapiens
tctcagcctcc

SEQ ID NO: 4881701 - DNA, 12 bp, Homo sapiens
tctcagcctccc

SEQ ID NO: 4881702 - DNA, 15 bp, Homo sapiens
tctcagccttacatt

SEQ ID NO: 4881703 - DNA, 16 bp, Homo sapiens
tctcagctccaggtgg

SEQ ID NO: 4881704 - DNA, 15 bp, Homo sapiens
tctcaggatccaagc

SEQ ID NO: 4881705 - DNA, 19 bp, Homo sapiens
tctcaggctggtgggaggg

SEQ ID NO: 4881706 - DNA, 15 bp, Homo sapiens
tctcaggtccctgca

SEQ ID NO: 4881707 - DNA, 20 bp, Homo sapiens
tctcagtcatgcataaatat

SEQ ID NO: 4881708 - DNA, 18 bp, Homo sapiens
tctcagtttgtgtgtctt

SEQ ID NO: 4881709 - DNA, 19 bp, Homo sapiens
tctcatacctctgaccaac

SEQ ID NO: 4881710 - DNA, 21 bp, Homo sapiens
tctcatactcccccacagttt

SEQ ID NO: 4881711 - DNA, 15 bp, Homo sapiens
tcattaaatgtttga

SEQ ID NO: 4881712 - DNA, 14 bp, Homo sapiens
tcattaatgtgttg

SEQ ID NO: 4881713 - DNA, 21 bp, Homo sapiens
tcattacccttccctgcacta

SEQ ID NO: 4881714 - DNA, 13 bp, Homo sapiens
tcattacttgatt

SEQ ID NO: 4881715 - DNA, 15 bp, Homo sapiens
tcattacttgattaa

SEQ ID NO: 4881716 - DNA, 18 bp, Homo sapiens
tcattagactcctcctcc

SEQ ID NO: 4881717 - DNA, 15 bp, Homo sapiens
tcattcaatattgac

SEQ ID NO: 4881718 - DNA, 19 bp, Homo sapiens
tcattcatggaccactgtt

SEQ ID NO: 4881719 - DNA, 14 bp, Homo sapiens
tcattccattgcct

SEQ ID NO: 4881720 - DNA, 21 bp, Homo sapiens
tcattctcataattcctacag

SEQ ID NO: 4881721 - DNA, 21 bp, Homo sapiens
tcattcttccaagctgagagt

SEQ ID NO: 4881722 - DNA, 18 bp, Homo sapiens
tcattgagagttttgtct

SEQ ID NO: 4881723 - DNA, 19 bp, Homo sapiens
tcattgagagttttgtctt

SEQ ID NO: 4881724 - DNA, 16 bp, Homo sapiens
tcattgcctgtgtatg

SEQ ID NO: 4881725 - DNA, 22 bp, Homo sapiens
tcattgcctgtgtatggaaaaa

SEQ ID NO: 4881726 - DNA, 16 bp, Homo sapiens
tcattgctgagcctct

SEQ ID NO: 4881727 - DNA, 17 bp, Homo sapiens
tcattgctgagcctctg

SEQ ID NO: 4881728 - DNA, 22 bp, Homo sapiens
tcattgctgagcctctgctccc

SEQ ID NO: 4881729 - DNA, 21 bp, Homo sapiens
tcattgctttgaagcagttgt

SEQ ID NO: 4881730 - DNA, 16 bp, Homo sapiens
tcattgtaaacaaact

SEQ ID NO: 4881731 - DNA, 19 bp, Homo sapiens
tcattgtaaacaaactctt

SEQ ID NO: 4881732 - DNA, 18 bp, Homo sapiens
tcattgtatgatgtgttg

SEQ ID NO: 4881733 - DNA, 17 bp, Homo sapiens
tccagctggcctggaca

SEQ ID NO: 4881734 - DNA, 18 bp, Homo sapiens
tccagctggcctggacag

SEQ ID NO: 4881735 - DNA, 14 bp, Homo sapiens
tccaggagcctggc

SEQ ID NO: 4881736 - DNA, 18 bp, Homo sapiens
tccaggagcctgtgcctc

SEQ ID NO: 4881737 - DNA, 18 bp, Homo sapiens
tccaggcacaggatgctg

SEQ ID NO: 4881738 - DNA, 15 bp, Homo sapiens
tccaggcaccatctc

SEQ ID NO: 4881739 - DNA, 13 bp, Homo sapiens
tccaggctagtcc

SEQ ID NO: 4881740 - DNA, 12 bp, Homo sapiens
tccagggaagct

SEQ ID NO: 4881741 - DNA, 18 bp, Homo sapiens
tccagggaatccaagcct

SEQ ID NO: 4881742 - DNA, 20 bp, Homo sapiens
tccagggaatccaagcctcc

SEQ ID NO: 4881743 - DNA, 15 bp, Homo sapiens
tccaggttcagcttg

SEQ ID NO: 4881744 - DNA, 21 bp, Homo sapiens
tccagtccccctatccttggc

SEQ ID NO: 4881745 - DNA, 22 bp, Homo sapiens
tccagtccccctatccttggca

SEQ ID NO: 4881746 - DNA, 23 bp, Homo sapiens
tccagtccccctatccttggcac

SEQ ID NO: 4881747 - DNA, 20 bp, Homo sapiens
tccagtgacaaaccatccag

SEQ ID NO: 4881748 - DNA, 20 bp, Homo sapiens
tccagtgtacatagtgtaat

SEQ ID NO: 4881749 - DNA, 17 bp, Homo sapiens
tccagtgttctatgaac

SEQ ID NO: 4881750 - DNA, 16 bp, Homo sapiens
tccagttcatgagaat

SEQ ID NO: 4881751 - DNA, 15 bp, Homo sapiens
tccataaaaaaaaat

SEQ ID NO: 4881752 - DNA, 19 bp, Homo sapiens
tccataaaaaaaaatagat

SEQ ID NO: 4881753 - DNA, 21 bp, Homo sapiens
tccataatctggactcctctg

SEQ ID NO: 4881754 - DNA, 15 bp, Homo sapiens
tccatatttggaaga

SEQ ID NO: 4881755 - DNA, 13 bp, Homo sapiens
tccatattttcac

SEQ ID NO: 4881756 - DNA, 17 bp, Homo sapiens
tccatcaccctcttcct

SEQ ID NO: 4881757 - DNA, 19 bp, Homo sapiens
tccatcccaaccagtgcca

SEQ ID NO: 4881758 - DNA, 21 bp, Homo sapiens
tccatcccaaccagtgccaag

SEQ ID NO: 4881759 - DNA, 22 bp, Homo sapiens
tccatccctaccccctaagagc

SEQ ID NO: 4881760 - DNA, 20 bp, Homo sapiens
tccatctcctataatctgtc

SEQ ID NO: 4881761 - DNA, 22 bp, Homo sapiens
tccatctcctataatctgtcaa

SEQ ID NO: 4881762 - DNA, 18 bp, Homo sapiens
tccatgagtttgccctgg

SEQ ID NO: 4881763 - DNA, 19 bp, Homo sapiens
tccatgagtttgccctggt

SEQ ID NO: 4881764 - DNA, 22 bp, Homo sapiens
tccatgctcctcactgcccgca

SEQ ID NO: 4881765 - DNA, 14 bp, Homo sapiens
tccatgctgcctcc

SEQ ID NO: 4881766 - DNA, 15 bp, Homo sapiens
tccatgctgcctcca

SEQ ID NO: 4881767 - DNA, 17 bp, Homo sapiens
tccatgggatacaacct

SEQ ID NO: 4881768 - DNA, 17 bp, Homo sapiens
tccatgtacttgtttgc

SEQ ID NO: 4881769 - DNA, 16 bp, Homo sapiens
tccatgtcgcctctgc

SEQ ID NO: 4881770 - DNA, 18 bp, Homo sapiens
tccatgtcgcctctgcat

SEQ ID NO: 4881771 - DNA, 19 bp, Homo sapiens
tccattggtccaagattcc

SEQ ID NO: 4881772 - DNA, 22 bp, Homo sapiens
tccattggtccaagattccgga

SEQ ID NO: 4881773 - DNA, 15 bp, Homo sapiens
tccatttatatatga

SEQ ID NO: 4881774 - DNA, 13 bp, Homo sapiens
tccatttgtaaaa

SEQ ID NO: 4881775 - DNA, 18 bp, Homo sapiens
tccattttcctacaggca

SEQ ID NO: 4881776 - DNA, 22 bp, Homo sapiens
tccattttcttattgcgctgct

SEQ ID NO: 4881777 - DNA, 22 bp, Homo sapiens
tccattttggcgctattacaaa

SEQ ID NO: 4881778 - DNA, 13 bp, Homo sapiens
tcccaaagtgctg

SEQ ID NO: 4881779 - DNA, 23 bp, Homo sapiens
tcccaaagtgctgagattacagg

SEQ ID NO: 4881780 - DNA, 15 bp, Homo sapiens
tcccaaagtgctggg

SEQ ID NO: 4881781 - DNA, 17 bp, Homo sapiens
tcccaacagccatgccc

SEQ ID NO: 4881782 - DNA, 19 bp, Homo sapiens
tcccaaccagtgccaagga

SEQ ID NO: 4881783 - DNA, 20 bp, Homo sapiens
tcccaaccagtgccaaggac

SEQ ID NO: 4881784 - DNA, 22 bp, Homo sapiens
tcccaagagaaggggaagcact

SEQ ID NO: 4881785 - DNA, 13 bp, Homo sapiens
tcccaagctctgc

SEQ ID NO: 4881786 - DNA, 14 bp, Homo sapiens
tcccaagctctgct

SEQ ID NO: 4881787 - DNA, 17 bp, Homo sapiens
tcccaagctctgctcct

SEQ ID NO: 4881788 - DNA, 12 bp, Homo sapiens
tcccaaggaaag

SEQ ID NO: 4881789 - DNA, 16 bp, Homo sapiens
tcccaaggagaacaaa

SEQ ID NO: 4881790 - DNA, 21 bp, Homo sapiens
tcccaagtagctgggattaca

SEQ ID NO: 4881791 - DNA, 19 bp, Homo sapiens
tcccaagtttccatagcaa

SEQ ID NO: 4881792 - DNA, 21 bp, Homo sapiens
tcccaagtttccatagcaaca

SEQ ID NO: 4881793 - DNA, 16 bp, Homo sapiens
tcccaatcagcactga

SEQ ID NO: 4881794 - DNA, 17 bp, Homo sapiens
tcccaatcagcactgaa

SEQ ID NO: 4881795 - DNA, 18 bp, Homo sapiens
tcccaatcagcactgaaa

SEQ ID NO: 4881796 - DNA, 19 bp, Homo sapiens
tcccaatcagcactgaaaa

SEQ ID NO: 4881797 - DNA, 13 bp, Homo sapiens
tcccacaccctgg

SEQ ID NO: 4881798 - DNA, 22 bp, Homo sapiens
tcccacaggcccttcctctcca

SEQ ID NO: 4881799 - DNA, 23 bp, Homo sapiens
tcccacatccaactccagcaact

SEQ ID NO: 4881800 - DNA, 19 bp, Homo sapiens
tcccaccaaccctcagagc

SEQ ID NO: 4881801 - DNA, 20 bp, Homo sapiens
tcccacccccacccccagct

SEQ ID NO: 4881802 - DNA, 23 bp, Homo sapiens
tcccacccccacccccagctcaa

SEQ ID NO: 4881803 - DNA, 17 bp, Homo sapiens
tcccacccccttctctg

SEQ ID NO: 4881804 - DNA, 19 bp, Homo sapiens
tcccacccctccctctgtc

SEQ ID NO: 4881805 - DNA, 12 bp, Homo sapiens
tcccaccctgta

SEQ ID NO: 4881806 - DNA, 13 bp, Homo sapiens
tcccacctcagcc

SEQ ID NO: 4881807 - DNA, 13 bp, Homo sapiens
tcccacctccagc

SEQ ID NO: 4881808 - DNA, 22 bp, Homo sapiens
tcccacctccagcccgggagcc

SEQ ID NO: 4881809 - DNA, 17 bp, Homo sapiens
tcccacctccagtcccc

SEQ ID NO: 4881810 - DNA, 16 bp, Homo sapiens
tcccacctccctgccc

SEQ ID NO: 4881811 - DNA, 17 bp, Homo sapiens
tcccacctccctgccca

SEQ ID NO: 4881812 - DNA, 11 bp, Homo sapiens
tcccacctctg

SEQ ID NO: 4881813 - DNA, 13 bp, Homo sapiens
tcccacctctgtg

SEQ ID NO: 4881814 - DNA, 13 bp, Homo sapiens
tcccaccttggct

SEQ ID NO: 4881815 - DNA, 15 bp, Homo sapiens
tcccacgaatttgct

SEQ ID NO: 4881816 - DNA, 15 bp, Homo sapiens
tcccactcaccccgg

SEQ ID NO: 4881817 - DNA, 12 bp, Homo sapiens
tcccacttgtca

SEQ ID NO: 4881818 - DNA, 16 bp, Homo sapiens
tcccagagcaaaataa

SEQ ID NO: 4881819 - DNA, 13 bp, Homo sapiens
tcccagaggtcca

SEQ ID NO: 4881820 - DNA, 16 bp, Homo sapiens
tcccagaggtccagcc

SEQ ID NO: 4881821 - DNA, 22 bp, Homo sapiens
tcccagaggtccagcccatctc

SEQ ID NO: 4881822 - DNA, 13 bp, Homo sapiens
tcccagccacccc

SEQ ID NO: 4881823 - DNA, 13 bp, Homo sapiens
tcccagccggcca

SEQ ID NO: 4881824 - DNA, 23 bp, Homo sapiens
tcccagctgtgctctggacaggc

SEQ ID NO: 4881825 - DNA, 18 bp, Homo sapiens
tcccagcttgtaggagct

SEQ ID NO: 4881826 - DNA, 17 bp, Homo sapiens
tatattgaagacaattt

SEQ ID NO: 4881827 - DNA, 18 bp, Homo sapiens
tatattgtgtttgtgtat

SEQ ID NO: 4881828 - DNA, 13 bp, Homo sapiens
tatatttaaactc

SEQ ID NO: 4881829 - DNA, 16 bp, Homo sapiens
tatatttagttatagt

SEQ ID NO: 4881830 - DNA, 12 bp, Homo sapiens
tatatttattta

SEQ ID NO: 4881831 - DNA, 12 bp, Homo sapiens
tatattttcgta

SEQ ID NO: 4881832 - DNA, 16 bp, Homo sapiens
tatattttcgtatgaa

SEQ ID NO: 4881833 - DNA, 18 bp, Homo sapiens
tatatttttatatttagt

SEQ ID NO: 4881834 - DNA, 21 bp, Homo sapiens
tatcaaacttcagctgtactt

SEQ ID NO: 4881835 - DNA, 22 bp, Homo sapiens
tatcaaggactctggtttctca

SEQ ID NO: 4881836 - DNA, 20 bp, Homo sapiens
tatcaagtcaatcatttctc

SEQ ID NO: 4881837 - DNA, 14 bp, Homo sapiens
tatcaatatctaat

SEQ ID NO: 4881838 - DNA, 21 bp, Homo sapiens
tatcaatatctaatatatatg

SEQ ID NO: 4881839 - DNA, 14 bp, Homo sapiens
tatcagaagaccac

SEQ ID NO: 4881840 - DNA, 21 bp, Homo sapiens
tatcagaagaccacaaaaatt

SEQ ID NO: 4881841 - DNA, 15 bp, Homo sapiens
tatcagaagagaggg

SEQ ID NO: 4881842 - DNA, 16 bp, Homo sapiens
tatcagaagagagggg

SEQ ID NO: 4881843 - DNA, 18 bp, Homo sapiens
tatcagatacatcactgc

SEQ ID NO: 4881844 - DNA, 14 bp, Homo sapiens
tatcagcttcagaa

SEQ ID NO: 4881845 - DNA, 19 bp, Homo sapiens
tatcaggtgctgccatcca

SEQ ID NO: 4881846 - DNA, 21 bp, Homo sapiens
tatcagtgttttaaattctga

SEQ ID NO: 4881847 - DNA, 13 bp, Homo sapiens
tatcagtttgatc

SEQ ID NO: 4881848 - DNA, 20 bp, Homo sapiens
tatcagtttgtcctgtagag

SEQ ID NO: 4881849 - DNA, 16 bp, Homo sapiens
tatcatacaaatcagt

SEQ ID NO: 4881850 - DNA, 14 bp, Homo sapiens
tatcatagaaatgt

SEQ ID NO: 4881851 - DNA, 13 bp, Homo sapiens
tatcatgaagcct

SEQ ID NO: 4881852 - DNA, 21 bp, Homo sapiens
tatcatgctttaaagtgtaat

SEQ ID NO: 4881853 - DNA, 21 bp, Homo sapiens
tatcatgtaaagaaatgtctt

SEQ ID NO: 4881854 - DNA, 19 bp, Homo sapiens
tatccaaaccaaataaaaa

SEQ ID NO: 4881855 - DNA, 13 bp, Homo sapiens
tatccaccacctc

SEQ ID NO: 4881856 - DNA, 15 bp, Homo sapiens
tatccaccacctccc

SEQ ID NO: 4881857 - DNA, 15 bp, Homo sapiens
tatccactttgcaca

SEQ ID NO: 4881858 - DNA, 16 bp, Homo sapiens
tatccatgcaccaaac

SEQ ID NO: 4881859 - DNA, 20 bp, Homo sapiens
tatccatgtacttgtttgca

SEQ ID NO: 4881860 - DNA, 20 bp, Homo sapiens
tatcccacctccatcccaga

SEQ ID NO: 4881861 - DNA, 14 bp, Homo sapiens
tatcccgagtctgg

SEQ ID NO: 4881862 - DNA, 16 bp, Homo sapiens
tatcctgaaatttcag

SEQ ID NO: 4881863 - DNA, 18 bp, Homo sapiens
tatcctgccaaaatcatt

SEQ ID NO: 4881864 - DNA, 22 bp, Homo sapiens
tatcctgggggacccaatgtag

SEQ ID NO: 4881865 - DNA, 13 bp, Homo sapiens
tatcctgtgactg

SEQ ID NO: 4881866 - DNA, 14 bp, Homo sapiens
tatcctgtgactgt

SEQ ID NO: 4881867 - DNA, 20 bp, Homo sapiens
tatcgaaataacaatgttaa

SEQ ID NO: 4881868 - DNA, 19 bp, Homo sapiens
tcaaccctcaggggaaaac

SEQ ID NO: 4881869 - DNA, 18 bp, Homo sapiens
tcaactgaccagcctcca

SEQ ID NO: 4881870 - DNA, 24 bp, Homo sapiens
tcaactgaccagcctccatgctgc

SEQ ID NO: 4881871 - DNA, 13 bp, Homo sapiens
tcaacttaacatg

SEQ ID NO: 4881872 - DNA, 23 bp, Homo sapiens
tcaagaaaaaataaatggaaatc

SEQ ID NO: 4881873 - DNA, 18 bp, Homo sapiens
tcaagaaactgaggaatt

SEQ ID NO: 4881874 - DNA, 21 bp, Homo sapiens
tcaagaaagcttcaaactgca

SEQ ID NO: 4881875 - DNA, 12 bp, Homo sapiens
tcaagcactgat

SEQ ID NO: 4881876 - DNA, 21 bp, Homo sapiens
tcaagcagcgaccgccccctc

SEQ ID NO: 4881877 - DNA, 22 bp, Homo sapiens
tcaagcagcgaccgccccctcc

SEQ ID NO: 4881878 - DNA, 15 bp, Homo sapiens
tcaaggcactctaga

SEQ ID NO: 4881879 - DNA, 16 bp, Homo sapiens
tcaaggcactctagat

SEQ ID NO: 4881880 - DNA, 17 bp, Homo sapiens
tcaaggcactctagatt

SEQ ID NO: 4881881 - DNA, 14 bp, Homo sapiens
tcaaggcttccact

SEQ ID NO: 4881882 - DNA, 18 bp, Homo sapiens
tcaagggcttactatttc

SEQ ID NO: 4881883 - DNA, 13 bp, Homo sapiens
tcaaggttttagg

SEQ ID NO: 4881884 - DNA, 18 bp, Homo sapiens
tcaaggttttaggttcta

SEQ ID NO: 4881885 - DNA, 18 bp, Homo sapiens
tcaagtcaatcatttctc

SEQ ID NO: 4881886 - DNA, 21 bp, Homo sapiens
tcaagtcatggcaggtacagt

SEQ ID NO: 4881887 - DNA, 22 bp, Homo sapiens
tcaagtcctcttttctgagagg

SEQ ID NO: 4881888 - DNA, 16 bp, Homo sapiens
tcaagtctctgctggc

SEQ ID NO: 4881889 - DNA, 22 bp, Homo sapiens
tcaagtgattctcctgcctcag

SEQ ID NO: 4881890 - DNA, 13 bp, Homo sapiens
tcaagttctaaga

SEQ ID NO: 4881891 - DNA, 20 bp, Homo sapiens
tcaagtttgggtctgtgctg

SEQ ID NO: 4881892 - DNA, 21 bp, Homo sapiens
tcaagttttgggtatgtttaa

SEQ ID NO: 4881893 - DNA, 21 bp, Homo sapiens
tcaataaagaaaacttccata

SEQ ID NO: 4881894 - DNA, 15 bp, Homo sapiens
tcaatatctaatata

SEQ ID NO: 4881895 - DNA, 13 bp, Homo sapiens
tcaatattgacat

SEQ ID NO: 4881896 - DNA, 17 bp, Homo sapiens
tcaatattgacatttgt

SEQ ID NO: 4881897 - DNA, 19 bp, Homo sapiens
tcaatattgacatttgtag

SEQ ID NO: 4881898 - DNA, 16 bp, Homo sapiens
tcaatatttttagata

SEQ ID NO: 4881899 - DNA, 21 bp, Homo sapiens
tcaatcaaataagtatttata

SEQ ID NO: 4881900 - DNA, 17 bp, Homo sapiens
tcaatcaagccatgtat

SEQ ID NO: 4881901 - DNA, 20 bp, Homo sapiens
tcaatcatctgtgtgaaaat

SEQ ID NO: 4881902 - DNA, 15 bp, Homo sapiens
tcaatcatttctcac

SEQ ID NO: 4881903 - DNA, 16 bp, Homo sapiens
tcaatcccaaaagtca

SEQ ID NO: 4881904 - DNA, 20 bp, Homo sapiens
tcaatctcccgctgctgctg

SEQ ID NO: 4881905 - DNA, 12 bp, Homo sapiens
tcaatgctattt

SEQ ID NO: 4881906 - DNA, 21 bp, Homo sapiens
tcaatggcctaaaactggcct

SEQ ID NO: 4881907 - DNA, 17 bp, Homo sapiens
tcaatgggctcttccaa

SEQ ID NO: 4881908 - DNA, 17 bp, Homo sapiens
tcaatgtgattctaatg

SEQ ID NO: 4881909 - DNA, 18 bp, Homo sapiens
tcaatgtgattctaatgt

SEQ ID NO: 4881910 - DNA, 21 bp, Homo sapiens
tcaatgtgattctaatgtctt

SEQ ID NO: 4881911 - DNA, 20 bp, Homo sapiens
tcaatgttcacgcaacttga

SEQ ID NO: 4881912 - DNA, 22 bp, Homo sapiens
tcaatgtttatgcaaggaagga

SEQ ID NO: 4881913 - DNA, 23 bp, Homo sapiens
tcaatgtttatgcaaggaaggaa

SEQ ID NO: 4881914 - DNA, 23 bp, Homo sapiens
tcaatgtttgaggagcatgtttt

SEQ ID NO: 4881915 - DNA, 15 bp, Homo sapiens
tcaattatagtttct

SEQ ID NO: 4881916 - DNA, 17 bp, Homo sapiens
tcaattatagtttctga

SEQ ID NO: 4881917 - DNA, 16 bp, Homo sapiens
tcaattcccattgcat

SEQ ID NO: 4881918 - DNA, 14 bp, Homo sapiens
tcaatttttaggaa

SEQ ID NO: 4881919 - DNA, 20 bp, Homo sapiens
tcacaaatcctaaaagaagc

SEQ ID NO: 4881920 - DNA, 20 bp, Homo sapiens
tcacaatacagataacatta

SEQ ID NO: 4881921 - DNA, 16 bp, Homo sapiens
tcacacaccctgaggt

SEQ ID NO: 4881922 - DNA, 13 bp, Homo sapiens
tcacacagtgagt

SEQ ID NO: 4881923 - DNA, 12 bp, Homo sapiens
tcacaccagcca

SEQ ID NO: 4881924 - DNA, 15 bp, Homo sapiens
tcacaccctgcaagg

SEQ ID NO: 4881925 - DNA, 13 bp, Homo sapiens
tcacactatttta

SEQ ID NO: 4881926 - DNA, 13 bp, Homo sapiens
tcacagcagcctc

SEQ ID NO: 4881927 - DNA, 17 bp, Homo sapiens
tcacagcagcctccaac

SEQ ID NO: 4881928 - DNA, 13 bp, Homo sapiens
tcacagcctcctc

SEQ ID NO: 4881929 - DNA, 17 bp, Homo sapiens
tcacagcctcctctgtc

SEQ ID NO: 4881930 - DNA, 20 bp, Homo sapiens
tcacagcctctgacccctcc

SEQ ID NO: 4881931 - DNA, 22 bp, Homo sapiens
tcacagcctctgacccctcctc

SEQ ID NO: 4881932 - DNA, 17 bp, Homo sapiens
tcacaggactctgcctc

SEQ ID NO: 4881933 - DNA, 12 bp, Homo sapiens
tcacaggcaggt

SEQ ID NO: 4881934 - DNA, 16 bp, Homo sapiens
tcacaggcaggtccag

SEQ ID NO: 4881935 - DNA, 17 bp, Homo sapiens
tcacaggcaggtccagg

SEQ ID NO: 4881936 - DNA, 18 bp, Homo sapiens
tcacaggcaggtccaggg

SEQ ID NO: 4881937 - DNA, 14 bp, Homo sapiens
tcacagggccaact

SEQ ID NO: 4881938 - DNA, 22 bp, Homo sapiens
tcacagggccaacttgagggcc

SEQ ID NO: 4881939 - DNA, 24 bp, Homo sapiens
tcacagggttgggcccagatctgg

SEQ ID NO: 4881940 - DNA, 17 bp, Homo sapiens
tcacagtacagcatgtg

SEQ ID NO: 4881941 - DNA, 15 bp, Homo sapiens
tcacagtcccactgt

SEQ ID NO: 4881942 - DNA, 14 bp, Homo sapiens
tcacagtgctgtgt

SEQ ID NO: 4881943 - DNA, 17 bp, Homo sapiens
tcacagtgctgtgtgcc

SEQ ID NO: 4881944 - DNA, 15 bp, Homo sapiens
tactcccttgcccta

SEQ ID NO: 4881945 - DNA, 13 bp, Homo sapiens
tactcctattttt

SEQ ID NO: 4881946 - DNA, 18 bp, Homo sapiens
tactcctatttttgtaaa

SEQ ID NO: 4881947 - DNA, 12 bp, Homo sapiens
tactcctcccag

SEQ ID NO: 4881948 - DNA, 19 bp, Homo sapiens
tactcctcctctttctctc

SEQ ID NO: 4881949 - DNA, 22 bp, Homo sapiens
tactcctcctctttctctcccc

SEQ ID NO: 4881950 - DNA, 15 bp, Homo sapiens
tactctaagatctta

SEQ ID NO: 4881951 - DNA, 21 bp, Homo sapiens
tactctaagatcttagattct

SEQ ID NO: 4881952 - DNA, 13 bp, Homo sapiens
tactctgaaacac

SEQ ID NO: 4881953 - DNA, 21 bp, Homo sapiens
tactctgtgtcaggtggggca

SEQ ID NO: 4881954 - DNA, 16 bp, Homo sapiens
tactcttggtttttat

SEQ ID NO: 4881955 - DNA, 13 bp, Homo sapiens
tactgaaagcctt

SEQ ID NO: 4881956 - DNA, 22 bp, Homo sapiens
tactgattattttcttcatcca

SEQ ID NO: 4881957 - DNA, 13 bp, Homo sapiens
tactgatttttgt

SEQ ID NO: 4881958 - DNA, 22 bp, Homo sapiens
tactgcagctttacatgcaatt

SEQ ID NO: 4881959 - DNA, 23 bp, Homo sapiens
tactgcagctttacatgcaattt

SEQ ID NO: 4881960 - DNA, 10 bp, Homo sapiens
tactgcaggg

SEQ ID NO: 4881961 - DNA, 14 bp, Homo sapiens
tactgcagggccag

SEQ ID NO: 4881962 - DNA, 18 bp, Homo sapiens
tactgcagggccaggact

SEQ ID NO: 4881963 - DNA, 21 bp, Homo sapiens
tactgccatgtactagtttta

SEQ ID NO: 4881964 - DNA, 21 bp, Homo sapiens
tactgcccaggcctgcctgtt

SEQ ID NO: 4881965 - DNA, 14 bp, Homo sapiens
tactgctcaggctg

SEQ ID NO: 4881966 - DNA, 22 bp, Homo sapiens
tactgggccttagtgggccagg

SEQ ID NO: 4881967 - DNA, 18 bp, Homo sapiens
tactgtaataatacctca

SEQ ID NO: 4881968 - DNA, 19 bp, Homo sapiens
tactgtaataatacctcaa

SEQ ID NO: 4881969 - DNA, 23 bp, Homo sapiens
tactgtaataatacctcaatgtt

SEQ ID NO: 4881970 - DNA, 14 bp, Homo sapiens
tactgtagtattct

SEQ ID NO: 4881971 - DNA, 16 bp, Homo sapiens
tactgtcctacccacc

SEQ ID NO: 4881972 - DNA, 17 bp, Homo sapiens
tactgtctgattggctt

SEQ ID NO: 4881973 - DNA, 14 bp, Homo sapiens
tactgtggaggaag

SEQ ID NO: 4881974 - DNA, 23 bp, Homo sapiens
tactgtggaggaaggattgtaaa

SEQ ID NO: 4881975 - DNA, 17 bp, Homo sapiens
tactgtgtgtgtgaatg

SEQ ID NO: 4881976 - DNA, 23 bp, Homo sapiens
tactgttcaatggttctgaaata

SEQ ID NO: 4881977 - DNA, 19 bp, Homo sapiens
tactgttctaaagctctga

SEQ ID NO: 4881978 - DNA, 21 bp, Homo sapiens
tactgttctaaagctctgaca

SEQ ID NO: 4881979 - DNA, 16 bp, Homo sapiens
tactgttctgtgtctt

SEQ ID NO: 4881980 - DNA, 17 bp, Homo sapiens
tactgttcttgctgcta

SEQ ID NO: 4881981 - DNA, 19 bp, Homo sapiens
tactgttcttgctgctaga

SEQ ID NO: 4881982 - DNA, 23 bp, Homo sapiens
tactgttcttgctgctagaactt

SEQ ID NO: 4881983 - DNA, 21 bp, Homo sapiens
tactgtttaccatttttcatt

SEQ ID NO: 4881984 - DNA, 12 bp, Homo sapiens
tacttaagagaa

SEQ ID NO: 4881985 - DNA, 15 bp, Homo sapiens
tacttaagagaaatg

SEQ ID NO: 4881986 - DNA, 18 bp, Homo sapiens
tacttaagagaaatggca

SEQ ID NO: 4881987 - DNA, 19 bp, Homo sapiens
tacttagcatcctaagaaa

SEQ ID NO: 4881988 - DNA, 20 bp, Homo sapiens
tacttatattttcgtatgaa

SEQ ID NO: 4881989 - DNA, 17 bp, Homo sapiens
tacttatttttgacagt

SEQ ID NO: 4881990 - DNA, 19 bp, Homo sapiens
tacttatttttgacagtgt

SEQ ID NO: 4881991 - DNA, 22 bp, Homo sapiens
tacttcctgagtggccagggaa

SEQ ID NO: 4881992 - DNA, 17 bp, Homo sapiens
tacttcgtcttctaatt

SEQ ID NO: 4881993 - DNA, 13 bp, Homo sapiens
tacttctccaccc

SEQ ID NO: 4881994 - DNA, 15 bp, Homo sapiens
tacttgaaaaagtaa

SEQ ID NO: 4881995 - DNA, 13 bp, Homo sapiens
tacttgaacaaaa

SEQ ID NO: 4881996 - DNA, 14 bp, Homo sapiens
tacttgaacaaaag

SEQ ID NO: 4881997 - DNA, 15 bp, Homo sapiens
tacttgaacaaaagg

SEQ ID NO: 4881998 - DNA, 19 bp, Homo sapiens
tacttgaacaaaagggtca

SEQ ID NO: 4881999 - DNA, 18 bp, Homo sapiens
tacttgtgaaacacagct

SEQ ID NO: 4882000 - DNA, 19 bp, Homo sapiens
tacttgtgaaacacagctg

SEQ ID NO: 4882001 - DNA, 21 bp, Homo sapiens
tacttgtgaaacacagctgtt

SEQ ID NO: 4882002 - DNA, 17 bp, Homo sapiens
taaaaataaatagaaaa

SEQ ID NO: 4882003 - DNA, 14 bp, Homo sapiens
taaaaatacatatc

SEQ ID NO: 4882004 - DNA, 22 bp, Homo sapiens
taaaaatattgtgttgtgaatg

SEQ ID NO: 4882005 - DNA, 13 bp, Homo sapiens
taaaaatgtaaat

SEQ ID NO: 4882006 - DNA, 20 bp, Homo sapiens
taaaaatgtaaatattctat

SEQ ID NO: 4882007 - DNA, 22 bp, Homo sapiens
taaaaattgccattggacagtt

SEQ ID NO: 4882008 - DNA, 15 bp, Homo sapiens
taaaacaacactcac

SEQ ID NO: 4882009 - DNA, 17 bp, Homo sapiens
taaaacagtatttattt

SEQ ID NO: 4882010 - DNA, 16 bp, Homo sapiens
taaaacattggattat

SEQ ID NO: 4882011 - DNA, 22 bp, Homo sapiens
taaaacattggattatcctgag

SEQ ID NO: 4882012 - DNA, 15 bp, Homo sapiens
taaaacctgtcaatg

SEQ ID NO: 4882013 - DNA, 13 bp, Homo sapiens
taaaacctttcaa

SEQ ID NO: 4882014 - DNA, 20 bp, Homo sapiens
taaaacctttcaaatttcac

SEQ ID NO: 4882015 - DNA, 21 bp, Homo sapiens
taaaactgcttttttttttcc

SEQ ID NO: 4882016 - DNA, 20 bp, Homo sapiens
taaaacttacctaagtgaca

SEQ ID NO: 4882017 - DNA, 20 bp, Homo sapiens
taaaacttcttaaatatctt

SEQ ID NO: 4882018 - DNA, 22 bp, Homo sapiens
taaaacttcttaaatatctttt

SEQ ID NO: 4882019 - DNA, 16 bp, Homo sapiens
taaaacttttctgctg

SEQ ID NO: 4882020 - DNA, 19 bp, Homo sapiens
taaaagaacttactgatta

SEQ ID NO: 4882021 - DNA, 13 bp, Homo sapiens
taaaagaattttt

SEQ ID NO: 4882022 - DNA, 19 bp, Homo sapiens
taaaagagagagagagaaa

SEQ ID NO: 4882023 - DNA, 13 bp, Homo sapiens
taaaagattcacc

SEQ ID NO: 4882024 - DNA, 13 bp, Homo sapiens
taaaagccacata

SEQ ID NO: 4882025 - DNA, 15 bp, Homo sapiens
taaaagccacataga

SEQ ID NO: 4882026 - DNA, 12 bp, Homo sapiens
taaaaggagcca

SEQ ID NO: 4882027 - DNA, 18 bp, Homo sapiens
taaaaggcaaatgtgtac

SEQ ID NO: 4882028 - DNA, 18 bp, Homo sapiens
taaaaggcttgaagctgt

SEQ ID NO: 4882029 - DNA, 15 bp, Homo sapiens
taaaagtgatctaca

SEQ ID NO: 4882030 - DNA, 19 bp, Homo sapiens
taaaagtgggcttgattct

SEQ ID NO: 4882031 - DNA, 14 bp, Homo sapiens
taaaagttgtgatt

SEQ ID NO: 4882032 - DNA, 21 bp, Homo sapiens
taaaagttgtgattccagata

SEQ ID NO: 4882033 - DNA, 19 bp, Homo sapiens
taaaagtttcaatgtgatt

SEQ ID NO: 4882034 - DNA, 17 bp, Homo sapiens
taaaataattctaaagg

SEQ ID NO: 4882035 - DNA, 13 bp, Homo sapiens
taaaatacattta

SEQ ID NO: 4882036 - DNA, 14 bp, Homo sapiens
taaaatacatttaa

SEQ ID NO: 4882037 - DNA, 21 bp, Homo sapiens
taaaatagagtgtagtttaca

SEQ ID NO: 4882038 - DNA, 17 bp, Homo sapiens
taaaatagttgtccata

SEQ ID NO: 4882039 - DNA, 23 bp, Homo sapiens
taaaatagttgtccatattttca

SEQ ID NO: 4882040 - DNA, 12 bp, Homo sapiens
taaaatatttat

SEQ ID NO: 4882041 - DNA, 17 bp, Homo sapiens
taaaatatttttgaaag

SEQ ID NO: 4882042 - DNA, 18 bp, Homo sapiens
taaaatcaacttaacatg

SEQ ID NO: 4882043 - DNA, 16 bp, Homo sapiens
taactcaccagcccca

SEQ ID NO: 4882044 - DNA, 21 bp, Homo sapiens
taactcaccagccccactgcc

SEQ ID NO: 4882045 - DNA, 12 bp, Homo sapiens
taactcatttgt

SEQ ID NO: 4882046 - DNA, 14 bp, Homo sapiens
taactcttgtctat

SEQ ID NO: 4882047 - DNA, 14 bp, Homo sapiens
taactgaagagaca

SEQ ID NO: 4882048 - DNA, 22 bp, Homo sapiens
taactgccttgaacctgtgagt

SEQ ID NO: 4882049 - DNA, 14 bp, Homo sapiens
taactgtacatttc

SEQ ID NO: 4882050 - DNA, 13 bp, Homo sapiens
taactgtgaagtt

SEQ ID NO: 4882051 - DNA, 17 bp, Homo sapiens
taactgtgaagtttaca

SEQ ID NO: 4882052 - DNA, 18 bp, Homo sapiens
taactgtgaagtttacat

SEQ ID NO: 4882053 - DNA, 15 bp, Homo sapiens
taactgtgctgaatg

SEQ ID NO: 4882054 - DNA, 19 bp, Homo sapiens
taactgtttatatgtgttg

SEQ ID NO: 4882055 - DNA, 22 bp, Homo sapiens
taactgtttatatgtgttgaaa

SEQ ID NO: 4882056 - DNA, 17 bp, Homo sapiens
taacttaaaaatgtaaa

SEQ ID NO: 4882057 - DNA, 20 bp, Homo sapiens
taacttaaaaatgtaaatat

SEQ ID NO: 4882058 - DNA, 14 bp, Homo sapiens
taacttatattgaa

SEQ ID NO: 4882059 - DNA, 19 bp, Homo sapiens
taacttatgtagatatttg

SEQ ID NO: 4882060 - DNA, 21 bp, Homo sapiens
taacttatgtagatatttggc

SEQ ID NO: 4882061 - DNA, 19 bp, Homo sapiens
taacttattgctgatttta

SEQ ID NO: 4882062 - DNA, 15 bp, Homo sapiens
taacttatttagaga

SEQ ID NO: 4882063 - DNA, 23 bp, Homo sapiens
taacttatttatgttaaaagatt

SEQ ID NO: 4882064 - DNA, 22 bp, Homo sapiens
taacttcacattaaaaaatgaa

SEQ ID NO: 4882065 - DNA, 13 bp, Homo sapiens
taacttctttcta

SEQ ID NO: 4882066 - DNA, 23 bp, Homo sapiens
taacttctttctatttgacttgt

SEQ ID NO: 4882067 - DNA, 15 bp, Homo sapiens
taacttggctttcat

SEQ ID NO: 4882068 - DNA, 22 bp, Homo sapiens
taactttaattctctttcaaag

SEQ ID NO: 4882069 - DNA, 18 bp, Homo sapiens
taactttatgtgtaaata

SEQ ID NO: 4882070 - DNA, 20 bp, Homo sapiens
taagaaaacaatcacactca

SEQ ID NO: 4882071 - DNA, 15 bp, Homo sapiens
taagaaaagtatttt

SEQ ID NO: 4882072 - DNA, 21 bp, Homo sapiens
taagaaaagtattttgaagtt

SEQ ID NO: 4882073 - DNA, 16 bp, Homo sapiens
taagaaacagagcagt

SEQ ID NO: 4882074 - DNA, 14 bp, Homo sapiens
taagaaacttttgt

SEQ ID NO: 4882075 - DNA, 19 bp, Homo sapiens
taagaaacttttgtaaaga

SEQ ID NO: 4882076 - DNA, 15 bp, Homo sapiens
taagaacgaggattt

SEQ ID NO: 4882077 - DNA, 22 bp, Homo sapiens
taagaagcttctaataaattat

SEQ ID NO: 4882078 - DNA, 17 bp, Homo sapiens
taagaatcagagtagaa

SEQ ID NO: 4882079 - DNA, 18 bp, Homo sapiens
taagaattcaaactgggg

SEQ ID NO: 4882080 - DNA, 13 bp, Homo sapiens
taagaattgacca

SEQ ID NO: 4882081 - DNA, 22 bp, Homo sapiens
taagaattgaccatctgctttt

SEQ ID NO: 4882082 - DNA, 14 bp, Homo sapiens
taagacacaaatgc

SEQ ID NO: 4882083 - DNA, 16 bp, Homo sapiens
taagacatatctctaa

SEQ ID NO: 4882084 - DNA, 16 bp, Homo sapiens
taagactctcacactc

SEQ ID NO: 4882085 - DNA, 12 bp, Homo sapiens
taagagaaatgg

SEQ ID NO: 4882086 - DNA, 18 bp, Homo sapiens
taagagagaaatctgaaa

SEQ ID NO: 4882087 - DNA, 22 bp, Homo sapiens
taagagccatataagtttgaag

SEQ ID NO: 4882088 - DNA, 12 bp, Homo sapiens
taagaggcaggg

SEQ ID NO: 4882089 - DNA, 22 bp, Homo sapiens
taagaggcagggtctcactctg

SEQ ID NO: 4882090 - DNA, 12 bp, Homo sapiens
taagagtgtaga

SEQ ID NO: 4882091 - DNA, 21 bp, Homo sapiens
taagagttagtttctttggga

SEQ ID NO: 4882092 - DNA, 22 bp, Homo sapiens
taagatacaaattaattttact

SEQ ID NO: 4882093 - DNA, 17 bp, Homo sapiens
taagatcttagattctc

SEQ ID NO: 4882094 - DNA, 18 bp, Homo sapiens
taagatgggcagctagtt

SEQ ID NO: 4882095 - DNA, 19 bp, Homo sapiens
taagatgtgatattctaag

SEQ ID NO: 4882096 - DNA, 21 bp, Homo sapiens
taagatgtgatattctaagac

SEQ ID NO: 4882097 - DNA, 23 bp, Homo sapiens
taagatgtgatattctaagactt

SEQ ID NO: 4882098 - DNA, 15 bp, Homo sapiens
taagattatagattc

SEQ ID NO: 4882099 - DNA, 16 bp, Homo sapiens
taagattatagattct

SEQ ID NO: 4882100 - DNA, 19 bp, Homo sapiens
taagattatagattctaaa

SEQ ID NO: 4882101 - DNA, 20 bp, Homo sapiens
taagattatagattctaaag

SEQ ID NO: 4882102 - DNA, 21 bp, Homo sapiens
taagattatagattctaaaga

SEQ ID NO: 4882103 - DNA, 13 bp, Homo sapiens
taagattctaaag

SEQ ID NO: 4882104 - DNA, 16 bp, Homo sapiens
taagattctaaaggtc

SEQ ID NO: 4882105 - DNA, 14 bp, Homo sapiens
taatctagacaata

SEQ ID NO: 4882106 - DNA, 20 bp, Homo sapiens
taatctcatacctctgacca

SEQ ID NO: 4882107 - DNA, 12 bp, Homo sapiens
taatctctgtta

SEQ ID NO: 4882108 - DNA, 18 bp, Homo sapiens
taatctctgttatgtact

SEQ ID NO: 4882109 - DNA, 22 bp, Homo sapiens
taatctctgttatgtactgtac

SEQ ID NO: 4882110 - DNA, 15 bp, Homo sapiens
taatctgaaattcta

SEQ ID NO: 4882111 - DNA, 15 bp, Homo sapiens
taatctggactcctc

SEQ ID NO: 4882112 - DNA, 20 bp, Homo sapiens
taatctggactcctctgtcc

SEQ ID NO: 4882113 - DNA, 18 bp, Homo sapiens
taatctgtcaaaacactg

SEQ ID NO: 4882114 - DNA, 20 bp, Homo sapiens
taatctgtcaaaacactgtg

SEQ ID NO: 4882115 - DNA, 22 bp, Homo sapiens
taatctgtcaaaacactgtgga

SEQ ID NO: 4882116 - DNA, 16 bp, Homo sapiens
taatgaagtaaagcca

SEQ ID NO: 4882117 - DNA, 17 bp, Homo sapiens
taatgcagttgcttact

SEQ ID NO: 4882118 - DNA, 16 bp, Homo sapiens
taatgcattaaacctg

SEQ ID NO: 4882119 - DNA, 17 bp, Homo sapiens
taatgcattaaacctgt

SEQ ID NO: 4882120 - DNA, 18 bp, Homo sapiens
taatgcattaaacctgtc

SEQ ID NO: 4882121 - DNA, 15 bp, Homo sapiens
taatgctactgtctc

SEQ ID NO: 4882122 - DNA, 12 bp, Homo sapiens
taatgctgcctt

SEQ ID NO: 4882123 - DNA, 16 bp, Homo sapiens
taatgcttaatttcta

SEQ ID NO: 4882124 - DNA, 19 bp, Homo sapiens
taatgcttagagaatgttc

SEQ ID NO: 4882125 - DNA, 14 bp, Homo sapiens
taatgcttcattca

SEQ ID NO: 4882126 - DNA, 13 bp, Homo sapiens
taatggcactgat

SEQ ID NO: 4882127 - DNA, 14 bp, Homo sapiens
taatggcagcagaa

SEQ ID NO: 4882128 - DNA, 16 bp, Homo sapiens
taatggcatgtcagac

SEQ ID NO: 4882129 - DNA, 13 bp, Homo sapiens
taatggtctaaaa

SEQ ID NO: 4882130 - DNA, 12 bp, Homo sapiens
taatgtaaagat

SEQ ID NO: 4882131 - DNA, 17 bp, Homo sapiens
taatgtaataactgtga

SEQ ID NO: 4882132 - DNA, 18 bp, Homo sapiens
taatgtaataactgtgaa

SEQ ID NO: 4882133 - DNA, 20 bp, Homo sapiens
taatgtatttgttcatgttt

SEQ ID NO: 4882134 - DNA, 21 bp, Homo sapiens
taatgtatttgttcatgtttg

SEQ ID NO: 4882135 - DNA, 16 bp, Homo sapiens
taatgtcacaggcagg

SEQ ID NO: 4882136 - DNA, 14 bp, Homo sapiens
taatgtcttcataa

SEQ ID NO: 4882137 - DNA, 15 bp, Homo sapiens
taatgtcttcataaa

SEQ ID NO: 4882138 - DNA, 13 bp, Homo sapiens
taatgtcttcatt

SEQ ID NO: 4882139 - DNA, 17 bp, Homo sapiens
taatgtcttcatttcat

SEQ ID NO: 4882140 - DNA, 12 bp, Homo sapiens
taatgtgtgtat

SEQ ID NO: 4882141 - DNA, 15 bp, Homo sapiens
taatgtgtgtatgtg

SEQ ID NO: 4882142 - DNA, 16 bp, Homo sapiens
taatgtgtgtatgtgt

SEQ ID NO: 4882143 - DNA, 17 bp, Homo sapiens
taatgtgtgtatgtgta

SEQ ID NO: 4882144 - DNA, 16 bp, Homo sapiens
taatgttaaatttgta

SEQ ID NO: 4882145 - DNA, 22 bp, Homo sapiens
taatgttaaatttgtaagtttc

SEQ ID NO: 4882146 - DNA, 17 bp, Homo sapiens
taatgttaaccaaggaa

SEQ ID NO: 4882147 - DNA, 21 bp, Homo sapiens
taatgttggacacctttaggt

SEQ ID NO: 4882148 - DNA, 18 bp, Homo sapiens
taatgtttgttacctcca

SEQ ID NO: 4882149 - DNA, 21 bp, Homo sapiens
taattaaacattgtgatcatt

SEQ ID NO: 4882150 - DNA, 18 bp, Homo sapiens
taattaagactgaaaata

SEQ ID NO: 4882151 - DNA, 16 bp, Homo sapiens
taattaatttgattaa

SEQ ID NO: 4882152 - DNA, 21 bp, Homo sapiens
taattaatttgattaacaaat

SEQ ID NO: 4882153 - DNA, 20 bp, Homo sapiens
taattagggtacatttataa

SEQ ID NO: 4882154 - DNA, 22 bp, Homo sapiens
taattagggtacatttataatt

SEQ ID NO: 4882155 - DNA, 16 bp, Homo sapiens
taattaggttaacatt

SEQ ID NO: 4882156 - DNA, 14 bp, Homo sapiens
taattatgatttgg

SEQ ID NO: 4882157 - DNA, 12 bp, Homo sapiens
taaagataatat

SEQ ID NO: 4882158 - DNA, 17 bp, Homo sapiens
taaagatattgttcaaa

SEQ ID NO: 4882159 - DNA, 17 bp, Homo sapiens
taaagatgaactctgaa

SEQ ID NO: 4882160 - DNA, 22 bp, Homo sapiens
taaagatgcaaggaccaggact

SEQ ID NO: 4882161 - DNA, 19 bp, Homo sapiens
taaagatggagtttctaag

SEQ ID NO: 4882162 - DNA, 22 bp, Homo sapiens
taaagatggagtttctaaggtc

SEQ ID NO: 4882163 - DNA, 24 bp, Homo sapiens
taaagattctatagttctagacat

SEQ ID NO: 4882164 - DNA, 21 bp, Homo sapiens
taaagcaaaaaatgaatgtct

SEQ ID NO: 4882165 - DNA, 16 bp, Homo sapiens
taaagcataagtatac

SEQ ID NO: 4882166 - DNA, 12 bp, Homo sapiens
taaagcatatag

SEQ ID NO: 4882167 - DNA, 22 bp, Homo sapiens
taaagcatgaatggtatggaac

SEQ ID NO: 4882168 - DNA, 15 bp, Homo sapiens
taaagcattgctgtt

SEQ ID NO: 4882169 - DNA, 19 bp, Homo sapiens
taaagcattgctgttatgt

SEQ ID NO: 4882170 - DNA, 21 bp, Homo sapiens
taaagcattgcttttattttg

SEQ ID NO: 4882171 - DNA, 12 bp, Homo sapiens
taaagcctcctc

SEQ ID NO: 4882172 - DNA, 23 bp, Homo sapiens
taaagcgatatacagatgaaaat

SEQ ID NO: 4882173 - DNA, 14 bp, Homo sapiens
taaagctctgacat

SEQ ID NO: 4882174 - DNA, 17 bp, Homo sapiens
taaagctgcctgtagtt

SEQ ID NO: 4882175 - DNA, 21 bp, Homo sapiens
taaagctgcctgtagttagga

SEQ ID NO: 4882176 - DNA, 14 bp, Homo sapiens
taaaggactgtaat

SEQ ID NO: 4882177 - DNA, 15 bp, Homo sapiens
taaaggcccagcccc

SEQ ID NO: 4882178 - DNA, 16 bp, Homo sapiens
taaaggctaactatga

SEQ ID NO: 4882179 - DNA, 19 bp, Homo sapiens
taaaggtccacaggtctag

SEQ ID NO: 4882180 - DNA, 20 bp, Homo sapiens
taaaggtccacaggtctaga

SEQ ID NO: 4882181 - DNA, 21 bp, Homo sapiens
taaaggtccacaggtctagac

SEQ ID NO: 4882182 - DNA, 15 bp, Homo sapiens
taaagtacttgagtg

SEQ ID NO: 4882183 - DNA, 18 bp, Homo sapiens
taaagtagaagagggttt

SEQ ID NO: 4882184 - DNA, 18 bp, Homo sapiens
taaagtatagagagaagt

SEQ ID NO: 4882185 - DNA, 16 bp, Homo sapiens
taaagtatgtaaacag

SEQ ID NO: 4882186 - DNA, 22 bp, Homo sapiens
taaagtatgtaaacaggagaca

SEQ ID NO: 4882187 - DNA, 21 bp, Homo sapiens
taaagtatgtaaagtatgtaa

SEQ ID NO: 4882188 - DNA, 21 bp, Homo sapiens
taaagtatttttataaatata

SEQ ID NO: 4882189 - DNA, 16 bp, Homo sapiens
taaagtctatggacag

SEQ ID NO: 4882190 - DNA, 14 bp, Homo sapiens
taaagtctgaatca

SEQ ID NO: 4882191 - DNA, 18 bp, Homo sapiens
taaagtgctaaggttcta

SEQ ID NO: 4882192 - DNA, 19 bp, Homo sapiens
taaagtgctaaggttctaa

SEQ ID NO: 4882193 - DNA, 21 bp, Homo sapiens
taaagtgctaaggttctaagg

SEQ ID NO: 4882194 - DNA, 18 bp, Homo sapiens
taaagtgtaataatatga

SEQ ID NO: 4882195 - DNA, 12 bp, Homo sapiens
taaagtgtttca

SEQ ID NO: 4882196 - DNA, 13 bp, Homo sapiens
taaagttctaaga

SEQ ID NO: 4882197 - DNA, 18 bp, Homo sapiens
taaagttctaagattctg

SEQ ID NO: 4882198 - DNA, 17 bp, Homo sapiens
taaagtttgcttagaaa

SEQ ID NO: 4882199 - DNA, 12 bp, Homo sapiens
taaataaaatca

SEQ ID NO: 4882200 - DNA, 14 bp, Homo sapiens
taaataaaatcaat

SEQ ID NO: 4882201 - DNA, 15 bp, Homo sapiens
taaataaaatcaatt

SEQ ID NO: 4882202 - DNA, 13 bp, Homo sapiens
taaataaactttt

SEQ ID NO: 4882203 - DNA, 18 bp, Homo sapiens
taaataaactttttttca

SEQ ID NO: 4882204 - DNA, 19 bp, Homo sapiens
taaataaactttttttcaa

SEQ ID NO: 4882205 - DNA, 21 bp, Homo sapiens
taaataaactttttttcaatg

SEQ ID NO: 4882206 - DNA, 22 bp, Homo sapiens
taaataacaggcatttgttcac

SEQ ID NO: 4882207 - DNA, 18 bp, Homo sapiens
taaataagattctaacgg

SEQ ID NO: 4882208 - DNA, 18 bp, Homo sapiens
taaataatgcttcagata

SEQ ID NO: 4882209 - DNA, 16 bp, Homo sapiens
taaataatttaactac

SEQ ID NO: 4882210 - DNA, 14 bp, Homo sapiens
taaataccaggatt

SEQ ID NO: 4882211 - DNA, 16 bp, Homo sapiens
taaatactgtgtggaa

SEQ ID NO: 4882212 - DNA, 18 bp, Homo sapiens
taaatagtatttgagagt

SEQ ID NO: 4882213 - DNA, 22 bp, Homo sapiens
taaatataagccttttatactg

SEQ ID NO: 4882214 - DNA, 16 bp, Homo sapiens
taaatatagttcctaa

SEQ ID NO: 4882215 - DNA, 19 bp, Homo sapiens
taaatatagttcctaagaa

SEQ ID NO: 4882216 - DNA, 15 bp, Homo sapiens
taaatatatataaag

SEQ ID NO: 4882217 - DNA, 20 bp, Homo sapiens
taaatatatataaagaatat

SEQ ID NO: 4882218 - DNA, 14 bp, Homo sapiens
taaatatgcagtga

SEQ ID NO: 4882219 - DNA, 17 bp, Homo sapiens
taaatatgcagtgatat

SEQ ID NO: 4882220 - DNA, 21 bp, Homo sapiens
taaatattagttaatggatta

SEQ ID NO: 4882221 - DNA, 13 bp, Homo sapiens
taaatattctata

SEQ ID NO: 4882222 - DNA, 18 bp, Homo sapiens
taaatattgaggctttgt

SEQ ID NO: 4882223 - DNA, 19 bp, Homo sapiens
taaatatttggtctctatt

SEQ ID NO: 4882224 - DNA, 14 bp, Homo sapiens
taaatcatattgat

SEQ ID NO: 4882225 - DNA, 14 bp, Homo sapiens
taaatccagttcta

SEQ ID NO: 4882226 - DNA, 19 bp, Homo sapiens
taaatctaaatctatttat

SEQ ID NO: 4882227 - DNA, 18 bp, Homo sapiens
taaatctatttattaata

SEQ ID NO: 4882228 - DNA, 15 bp, Homo sapiens
taaatctctaatatg

SEQ ID NO: 4882229 - DNA, 23 bp, Homo sapiens
taaatgaagcagctttaaacaaa

SEQ ID NO: 4882230 - DNA, 16 bp, Homo sapiens
taaatgaatattttga

SEQ ID NO: 4882231 - DNA, 22 bp, Homo sapiens
taaatgagcaaatatcatactg

SEQ ID NO: 4882232 - DNA, 16 bp, Homo sapiens
taaatgcataaatgca

SEQ ID NO: 4882233 - DNA, 17 bp, Homo sapiens
taaatggggctcacaaa

SEQ ID NO: 4882234 - DNA, 17 bp, Homo sapiens
taaatggtcgcccagga

SEQ ID NO: 4882235 - DNA, 13 bp, Homo sapiens
taaatgtcttata

SEQ ID NO: 4882236 - DNA, 17 bp, Homo sapiens
taaatgtctttgtaagt

SEQ ID NO: 4882237 - DNA, 14 bp, Homo sapiens
taaatgtgtacaat

SEQ ID NO: 4882238 - DNA, 22 bp, Homo sapiens
taaatgttatgactatgtaaac

SEQ ID NO: 4882239 - DNA, 15 bp, Homo sapiens
taaatgttatttctg

SEQ ID NO: 4882240 - DNA, 10 bp, Homo sapiens
taaatgtttg

SEQ ID NO: 4882241 - DNA, 22 bp, Homo sapiens
taaatgttttataagttcacaa

SEQ ID NO: 4882242 - DNA, 18 bp, Homo sapiens
taaattaaagcctttagt

SEQ ID NO: 4882243 - DNA, 22 bp, Homo sapiens
taaattatacaaattaaaaaga

SEQ ID NO: 4882244 - DNA, 17 bp, Homo sapiens
taaattatgtaatgcaa

SEQ ID NO: 4882245 - DNA, 19 bp, Homo sapiens
taaattatgtaatgcaaaa

SEQ ID NO: 4882246 - DNA, 19 bp, Homo sapiens
taaattcgtgattttcaag

SEQ ID NO: 4882247 - DNA, 22 bp, Homo sapiens
taaattctgagacatgtgtcaa

SEQ ID NO: 4882248 - DNA, 16 bp, Homo sapiens
taaattgatgttgctg

SEQ ID NO: 4882249 - DNA, 16 bp, Homo sapiens
taaattgcataaagca

SEQ ID NO: 4882250 - DNA, 17 bp, Homo sapiens
taaattgcataaagcat

SEQ ID NO: 4882251 - DNA, 21 bp, Homo sapiens
taaattggcctggtatggctg

SEQ ID NO: 4882252 - DNA, 16 bp, Homo sapiens
taaattgggttcatga

SEQ ID NO: 4882253 - DNA, 23 bp, Homo sapiens
taaattgtccgtgttcatacatt

SEQ ID NO: 4882254 - DNA, 13 bp, Homo sapiens
taaatttaaattt

SEQ ID NO: 4882255 - DNA, 17 bp, Homo sapiens
taaatttactttacaca

SEQ ID NO: 4882256 - DNA, 14 bp, Homo sapiens
taaatttgaatgtt

SEQ ID NO: 4882257 - DNA, 18 bp, Homo sapiens
taaatttgatacttatat

SEQ ID NO: 4882258 - DNA, 13 bp, Homo sapiens
taaatttgattta

SEQ ID NO: 4882259 - DNA, 13 bp, Homo sapiens
taaatttgctagc

SEQ ID NO: 4882260 - DNA, 20 bp, Homo sapiens
taaatttggggacagattca

SEQ ID NO: 4882261 - DNA, 13 bp, Homo sapiens
taaatttgtaagt

SEQ ID NO: 4882262 - DNA, 16 bp, Homo sapiens
taaatttgtaagtttc

SEQ ID NO: 4882263 - DNA, 16 bp, Homo sapiens
taaattttacccttta

SEQ ID NO: 4882264 - DNA, 17 bp, Homo sapiens
taaattttgagttctac

SEQ ID NO: 4882265 - DNA, 18 bp, Homo sapiens
taaattttgagttctaca

SEQ ID NO: 4882266 - DNA, 14 bp, Homo sapiens
taacaaaagatgaa

SEQ ID NO: 4882267 - DNA, 23 bp, Homo sapiens
gtttctgggtcctgaagaattaa

SEQ ID NO: 4882268 - DNA, 17 bp, Homo sapiens
gtttctgtttgattctt

SEQ ID NO: 4882269 - DNA, 18 bp, Homo sapiens
gtttctgtttgattcttt

SEQ ID NO: 4882270 - DNA, 14 bp, Homo sapiens
gtttctttgtgttg

SEQ ID NO: 4882271 - DNA, 19 bp, Homo sapiens
gtttctttttaagtaatgt

SEQ ID NO: 4882272 - DNA, 18 bp, Homo sapiens
gtttgaaagtgaataaac

SEQ ID NO: 4882273 - DNA, 14 bp, Homo sapiens
gtttgaaatctttt

SEQ ID NO: 4882274 - DNA, 12 bp, Homo sapiens
gtttgaacttca

SEQ ID NO: 4882275 - DNA, 15 bp, Homo sapiens
gtttgacattgtatg

SEQ ID NO: 4882276 - DNA, 16 bp, Homo sapiens
gtttgactagatgatg

SEQ ID NO: 4882277 - DNA, 20 bp, Homo sapiens
gtttgatcacactattttag

SEQ ID NO: 4882278 - DNA, 19 bp, Homo sapiens
gtttgcataaacattcttt

SEQ ID NO: 4882279 - DNA, 17 bp, Homo sapiens
gtttgcctctgcctctg

SEQ ID NO: 4882280 - DNA, 17 bp, Homo sapiens
gtttgctattagagcat

SEQ ID NO: 4882281 - DNA, 17 bp, Homo sapiens
gtttgcttcataaatga

SEQ ID NO: 4882282 - DNA, 15 bp, Homo sapiens
gtttggcaatagttt

SEQ ID NO: 4882283 - DNA, 17 bp, Homo sapiens
gtttggcaatagtttgc

SEQ ID NO: 4882284 - DNA, 20 bp, Homo sapiens
gtttgggggacgtttctcat

SEQ ID NO: 4882285 - DNA, 15 bp, Homo sapiens
gtttggtgtgtccca

SEQ ID NO: 4882286 - DNA, 18 bp, Homo sapiens
gtttggttcctctctggt

SEQ ID NO: 4882287 - DNA, 19 bp, Homo sapiens
gtttgtaaatgttatttct

SEQ ID NO: 4882288 - DNA, 14 bp, Homo sapiens
gtttgtaggtaaaa

SEQ ID NO: 4882289 - DNA, 15 bp, Homo sapiens
gtttgtataacttct

SEQ ID NO: 4882290 - DNA, 20 bp, Homo sapiens
gtttgtcatcagatggaaat

SEQ ID NO: 4882291 - DNA, 19 bp, Homo sapiens
gtttgtctattttaaaata

SEQ ID NO: 4882292 - DNA, 18 bp, Homo sapiens
gtttgtctcagttggaaa

SEQ ID NO: 4882293 - DNA, 19 bp, Homo sapiens
gtttgtctcagttggaaat

SEQ ID NO: 4882294 - DNA, 17 bp, Homo sapiens
gtttgtctctccttttc

SEQ ID NO: 4882295 - DNA, 21 bp, Homo sapiens
gtttgtctctccttttctttt

SEQ ID NO: 4882296 - DNA, 11 bp, Homo sapiens
gtttgtctgtt

SEQ ID NO: 4882297 - DNA, 21 bp, Homo sapiens
gtttgtcttccattccattgt

SEQ ID NO: 4882298 - DNA, 20 bp, Homo sapiens
gtttgtggctgggggcagga

SEQ ID NO: 4882299 - DNA, 13 bp, Homo sapiens
gtttgtgtgtctt

SEQ ID NO: 4882300 - DNA, 14 bp, Homo sapiens
gtttgttatatcct

SEQ ID NO: 4882301 - DNA, 23 bp, Homo sapiens
gtttgtttcatatatacaggcat

SEQ ID NO: 4882302 - DNA, 12 bp, Homo sapiens
gtttgtttcttt

SEQ ID NO: 4882303 - DNA, 15 bp, Homo sapiens
gtttgtttctttgtg

SEQ ID NO: 4882304 - DNA, 15 bp, Homo sapiens
gtttgtttgtctgtt

SEQ ID NO: 4882305 - DNA, 12 bp, Homo sapiens
gtcctgctccag

SEQ ID NO: 4882306 - DNA, 22 bp, Homo sapiens
gtcctgctccagaatttggaaa

SEQ ID NO: 4882307 - DNA, 13 bp, Homo sapiens
gtcctgcttctga

SEQ ID NO: 4882308 - DNA, 20 bp, Homo sapiens
gtcctggacaccgggccagt

SEQ ID NO: 4882309 - DNA, 21 bp, Homo sapiens
gtcctggccagatggcccgga

SEQ ID NO: 4882310 - DNA, 17 bp, Homo sapiens
gtcctggctcctgaggg

SEQ ID NO: 4882311 - DNA, 20 bp, Homo sapiens
gtcctgtagttttattttat

SEQ ID NO: 4882312 - DNA, 22 bp, Homo sapiens
gtcctgtagttttattttatgt

SEQ ID NO: 4882313 - DNA, 13 bp, Homo sapiens
gtcctttatgtgg

SEQ ID NO: 4882314 - DNA, 18 bp, Homo sapiens
gtcctttgcgcctgtgac

SEQ ID NO: 4882315 - DNA, 21 bp, Homo sapiens
gtcctttggggcatagatcag

SEQ ID NO: 4882316 - DNA, 13 bp, Homo sapiens
gtccttttgtctt

SEQ ID NO: 4882317 - DNA, 22 bp, Homo sapiens
gtccttttgtcttctctgtctc

SEQ ID NO: 4882318 - DNA, 16 bp, Homo sapiens
gtcctttttttccatc

SEQ ID NO: 4882319 - DNA, 14 bp, Homo sapiens
gtcgaggggctctc

SEQ ID NO: 4882320 - DNA, 13 bp, Homo sapiens
gtcgcccaggaga

SEQ ID NO: 4882321 - DNA, 20 bp, Homo sapiens
gtcgcccaggctggagtgca

SEQ ID NO: 4882322 - DNA, 14 bp, Homo sapiens
gtcgcccagtctgg

SEQ ID NO: 4882323 - DNA, 23 bp, Homo sapiens
gtcgcccagtctggaatgcagtg

SEQ ID NO: 4882324 - DNA, 18 bp, Homo sapiens
gtcgggcaccagccagcg

SEQ ID NO: 4882325 - DNA, 12 bp, Homo sapiens
gtcgttttccaa

SEQ ID NO: 4882326 - DNA, 16 bp, Homo sapiens
gtctaaacaatgctga

SEQ ID NO: 4882327 - DNA, 21 bp, Homo sapiens
gtctaaacaatgctgatttgg

SEQ ID NO: 4882328 - DNA, 20 bp, Homo sapiens
gtctaaagatggagtttcta

SEQ ID NO: 4882329 - DNA, 15 bp, Homo sapiens
gtctaaatgctgaaa

SEQ ID NO: 4882330 - DNA, 15 bp, Homo sapiens
gtgcctctgcctgtc

SEQ ID NO: 4882331 - DNA, 22 bp, Homo sapiens
gtgcgctctgtggatgccaggg

SEQ ID NO: 4882332 - DNA, 16 bp, Homo sapiens
gtgcgtgccgtgtgag

SEQ ID NO: 4882333 - DNA, 13 bp, Homo sapiens
gtgctaaggttct

SEQ ID NO: 4882334 - DNA, 15 bp, Homo sapiens
gtgctaaggttctaa

SEQ ID NO: 4882335 - DNA, 20 bp, Homo sapiens
gtgctactgtctttggaaaa

SEQ ID NO: 4882336 - DNA, 21 bp, Homo sapiens
gtgctattttgtttgttttgt

SEQ ID NO: 4882337 - DNA, 21 bp, Homo sapiens
gtgctgccacacttcaggctc

SEQ ID NO: 4882338 - DNA, 15 bp, Homo sapiens
gtgctgccatccagg

SEQ ID NO: 4882339 - DNA, 22 bp, Homo sapiens
gtgctgccatccaggttcagct

SEQ ID NO: 4882340 - DNA, 19 bp, Homo sapiens
gtgctggaggtgggagcag

SEQ ID NO: 4882341 - DNA, 21 bp, Homo sapiens
gtgctggaggtgggagcagga

SEQ ID NO: 4882342 - DNA, 24 bp, Homo sapiens
gtgctggaggtgggagcaggagat

SEQ ID NO: 4882343 - DNA, 20 bp, Homo sapiens
gtgctggctcacagtacagc

SEQ ID NO: 4882344 - DNA, 21 bp, Homo sapiens
gtgctggctcacagtacagca

SEQ ID NO: 4882345 - DNA, 22 bp, Homo sapiens
gtgctggctcacagtacagcat

SEQ ID NO: 4882346 - DNA, 14 bp, Homo sapiens
gtgctgtggaagca

SEQ ID NO: 4882347 - DNA, 14 bp, Homo sapiens
gtgcttaagttcca

SEQ ID NO: 4882348 - DNA, 15 bp, Homo sapiens
gtgcttcaattaata

SEQ ID NO: 4882349 - DNA, 21 bp, Homo sapiens
gtgcttctccccagaattcac

SEQ ID NO: 4882350 - DNA, 14 bp, Homo sapiens
gtgctttaaagata

SEQ ID NO: 4882351 - DNA, 12 bp, Homo sapiens
gtggaaaaacac

SEQ ID NO: 4882352 - DNA, 14 bp, Homo sapiens
gtggaacctctgtc

SEQ ID NO: 4882353 - DNA, 20 bp, Homo sapiens
gtggaacctctgtctcatcc

SEQ ID NO: 4882354 - DNA, 20 bp, Homo sapiens
gtggaagaaaatggtttatt

SEQ ID NO: 4882355 - DNA, 19 bp, Homo sapiens
gtggacccagcgggcaggt

SEQ ID NO: 4882356 - DNA, 19 bp, Homo sapiens
gtggacctctactttccag

SEQ ID NO: 4882357 - DNA, 17 bp, Homo sapiens
gtggaccttaggccttc

SEQ ID NO: 4882358 - DNA, 18 bp, Homo sapiens
gtggaccttttaaagtgt

SEQ ID NO: 4882359 - DNA, 19 bp, Homo sapiens
gtggagactggggggcttg

SEQ ID NO: 4882360 - DNA, 14 bp, Homo sapiens
gtggagagctggtg

SEQ ID NO: 4882361 - DNA, 14 bp, Homo sapiens
gtggagctcagccc

SEQ ID NO: 4882362 - DNA, 16 bp, Homo sapiens
gtggagctcagccccg

SEQ ID NO: 4882363 - DNA, 20 bp, Homo sapiens
gtggaggaaggattgtaaaa

SEQ ID NO: 4882364 - DNA, 13 bp, Homo sapiens
gtggaggcagcca

SEQ ID NO: 4882365 - DNA, 20 bp, Homo sapiens
gtggagtttgacattgtatg

SEQ ID NO: 4882366 - DNA, 12 bp, Homo sapiens
gtggatgatcaa

SEQ ID NO: 4882367 - DNA, 18 bp, Homo sapiens
gtggatgcctggtggcag

SEQ ID NO: 4882368 - DNA, 16 bp, Homo sapiens
gtggcaaatataaaac

SEQ ID NO: 4882369 - DNA, 12 bp, Homo sapiens
gtggcacaggcc

SEQ ID NO: 4882370 - DNA, 19 bp, Homo sapiens
gtggcacttgcctgggtca

SEQ ID NO: 4882371 - DNA, 13 bp, Homo sapiens
gtggcagagagag

SEQ ID NO: 4882372 - DNA, 17 bp, Homo sapiens
gtggcagagagagagaa

SEQ ID NO: 4882373 - DNA, 20 bp, Homo sapiens
gtggcagataatcagcctct

SEQ ID NO: 4882374 - DNA, 21 bp, Homo sapiens
gtggcagataatcagcctctt

SEQ ID NO: 4882375 - DNA, 14 bp, Homo sapiens
gtggcagctgcggt

SEQ ID NO: 4882376 - DNA, 22 bp, Homo sapiens
gtggcagctgcggtccacccag

SEQ ID NO: 4882377 - DNA, 18 bp, Homo sapiens
gtggcatctttgccttgg

SEQ ID NO: 4882378 - DNA, 20 bp, Homo sapiens
gtggcatctttgccttgggc

SEQ ID NO: 4882379 - DNA, 17 bp, Homo sapiens
gtggccagagctgggag

SEQ ID NO: 4882380 - DNA, 18 bp, Homo sapiens
gtggccatccctgtgagg

SEQ ID NO: 4882381 - DNA, 17 bp, Homo sapiens
gtggcccgacagcctgg

SEQ ID NO: 4882382 - DNA, 19 bp, Homo sapiens
gtggcccgacagcctggca

SEQ ID NO: 4882383 - DNA, 17 bp, Homo sapiens
gtggccctgccctctcc

SEQ ID NO: 4882384 - DNA, 18 bp, Homo sapiens
gtggccctgccctctcct

SEQ ID NO: 4882385 - DNA, 17 bp, Homo sapiens
gtggccctgtccctccc

SEQ ID NO: 4882386 - DNA, 23 bp, Homo sapiens
gtggccctgtccctcccacctct

SEQ ID NO: 4882387 - DNA, 11 bp, Homo sapiens
gtggcccttgc

SEQ ID NO: 4882388 - DNA, 11 bp, Homo sapiens
gtggcctcaga

SEQ ID NO: 4882389 - DNA, 22 bp, Homo sapiens
gtggcctcgggacacctgccct

SEQ ID NO: 4882390 - DNA, 13 bp, Homo sapiens
gtggcctggccag

SEQ ID NO: 4882391 - DNA, 16 bp, Homo sapiens
gtggcctggccaggag

SEQ ID NO: 4882392 - DNA, 21 bp, Homo sapiens
gtggcctggccaggagctctt

SEQ ID NO: 4882393 - DNA, 19 bp, Homo sapiens
gtggccttggccggctgtg

SEQ ID NO: 4882394 - DNA, 21 bp, Homo sapiens
gtggccttggccggctgtgct

SEQ ID NO: 4882395 - DNA, 21 bp, Homo sapiens
gtggctctgaggtgcctgtcc

SEQ ID NO: 4882396 - DNA, 18 bp, Homo sapiens
gtggctgaggaggcctcc

SEQ ID NO: 4882397 - DNA, 22 bp, Homo sapiens
gtggctgggggcaggagggccc

SEQ ID NO: 4882398 - DNA, 19 bp, Homo sapiens
gtggctgggttggagggtg

SEQ ID NO: 4882399 - DNA, 21 bp, Homo sapiens
gtggcttcccgctcagccctc

SEQ ID NO: 4882400 - DNA, 13 bp, Homo sapiens
gtgggagcaggag

SEQ ID NO: 4882401 - DNA, 14 bp, Homo sapiens
gtgggagcaggaga

SEQ ID NO: 4882402 - DNA, 15 bp, Homo sapiens
gtgggagctgcctgt

SEQ ID NO: 4882403 - DNA, 14 bp, Homo sapiens
gtgggagggagcag

SEQ ID NO: 4882404 - DNA, 16 bp, Homo sapiens
gtgggaggtcttgcta

SEQ ID NO: 4882405 - DNA, 20 bp, Homo sapiens
gtgggcatttcttgcgagcc

SEQ ID NO: 4882406 - DNA, 13 bp, Homo sapiens
gtgggccagggct

SEQ ID NO: 4882407 - DNA, 21 bp, Homo sapiens
gtgggccagggctgccctgag

SEQ ID NO: 4882408 - DNA, 13 bp, Homo sapiens
gtgggctcctggc

SEQ ID NO: 4882409 - DNA, 17 bp, Homo sapiens
gtggggcagcttgaggg

SEQ ID NO: 4882410 - DNA, 12 bp, Homo sapiens
gtggggcttggc

SEQ ID NO: 4882411 - DNA, 15 bp, Homo sapiens
gtggggcttggcgtg

SEQ ID NO: 4882412 - DNA, 15 bp, Homo sapiens
gtgggggaaaaataa

SEQ ID NO: 4882413 - DNA, 13 bp, Homo sapiens
gtggggggtcctt

SEQ ID NO: 4882414 - DNA, 14 bp, Homo sapiens
gtgggtgtagccag

SEQ ID NO: 4882415 - DNA, 14 bp, Homo sapiens
gtggtaccctctgg

SEQ ID NO: 4882416 - DNA, 13 bp, Homo sapiens
gtggtctcaggat

SEQ ID NO: 4882417 - DNA, 23 bp, Homo sapiens
gtggtcttcaaattgtcttttgt

SEQ ID NO: 4882418 - DNA, 15 bp, Homo sapiens
gtggtctttgtaaga

SEQ ID NO: 4882419 - DNA, 16 bp, Homo sapiens
gtggtggcacaggccc

SEQ ID NO: 4882420 - DNA, 15 bp, Homo sapiens
gtgtaaaatgtgaag

SEQ ID NO: 4882421 - DNA, 13 bp, Homo sapiens
gtgtaataagaca

SEQ ID NO: 4882422 - DNA, 14 bp, Homo sapiens
gtgtacaatgtaca

SEQ ID NO: 4882423 - DNA, 17 bp, Homo sapiens
gtgtaccatttgcctcc

SEQ ID NO: 4882424 - DNA, 19 bp, Homo sapiens
gtgtactgtatagacagtt

SEQ ID NO: 4882425 - DNA, 13 bp, Homo sapiens
gtgtactgtgtca

SEQ ID NO: 4882426 - DNA, 14 bp, Homo sapiens
gtgtagaagcattc

SEQ ID NO: 4882427 - DNA, 19 bp, Homo sapiens
gtgtagaagcattccttct

SEQ ID NO: 4882428 - DNA, 15 bp, Homo sapiens
gtgtagagttaagaa

SEQ ID NO: 4882429 - DNA, 20 bp, Homo sapiens
gtgtagagttaagaagctgt

SEQ ID NO: 4882430 - DNA, 21 bp, Homo sapiens
gtgtagccaggtatggctctg

SEQ ID NO: 4882431 - DNA, 16 bp, Homo sapiens
gtgtatattatttggc

SEQ ID NO: 4882432 - DNA, 17 bp, Homo sapiens
gtgtatattatttggca

SEQ ID NO: 4882433 - DNA, 21 bp, Homo sapiens
gtgtatcccccccctgtatag

SEQ ID NO: 4882434 - DNA, 21 bp, Homo sapiens
gtgtatggaaaaaccatttga

SEQ ID NO: 4882435 - DNA, 17 bp, Homo sapiens
gtgtatttacgctttga

SEQ ID NO: 4882436 - DNA, 13 bp, Homo sapiens
gtgtcacaaagaa

SEQ ID NO: 4882437 - DNA, 14 bp, Homo sapiens
gtgtcaggtggggc

SEQ ID NO: 4882438 - DNA, 18 bp, Homo sapiens
gtgtcaggtggggcagct

SEQ ID NO: 4882439 - DNA, 19 bp, Homo sapiens
gtgtcaggtggggcagctt

SEQ ID NO: 4882440 - DNA, 20 bp, Homo sapiens
gtgtcaggtggggcagcttg

SEQ ID NO: 4882441 - DNA, 16 bp, Homo sapiens
gtgtcatttcattcca

SEQ ID NO: 4882442 - DNA, 15 bp, Homo sapiens
gtgtccacctgtggg

SEQ ID NO: 4882443 - DNA, 16 bp, Homo sapiens
gtgtccacctgtgggt

SEQ ID NO: 4882444 - DNA, 19 bp, Homo sapiens
gtgtcccattggtgttgtc

SEQ ID NO: 4882445 - DNA, 12 bp, Homo sapiens
gtgtccttccct

SEQ ID NO: 4882446 - DNA, 16 bp, Homo sapiens
gtgtctaagattctag

SEQ ID NO: 4882447 - DNA, 18 bp, Homo sapiens
gtgtctaagattctagat

SEQ ID NO: 4882448 - DNA, 19 bp, Homo sapiens
gtgtctaagattctagatc

SEQ ID NO: 4882449 - DNA, 21 bp, Homo sapiens
gtgtctgctttaaagggcctg

SEQ ID NO: 4882450 - DNA, 18 bp, Homo sapiens
gtgtctgtaaaagagcct

SEQ ID NO: 4882451 - DNA, 16 bp, Homo sapiens
gtgtctgtacacgtgt

SEQ ID NO: 4882452 - DNA, 13 bp, Homo sapiens
gtgtctgtattta

SEQ ID NO: 4882453 - DNA, 14 bp, Homo sapiens
gtgtctgtatttat

SEQ ID NO: 4882454 - DNA, 17 bp, Homo sapiens
gtgtcttccactttgca

SEQ ID NO: 4882455 - DNA, 17 bp, Homo sapiens
gtgtcttgcaatggcag

SEQ ID NO: 4882456 - DNA, 18 bp, Homo sapiens
gtgtctttcacagctcct

SEQ ID NO: 4882457 - DNA, 23 bp, Homo sapiens
gtgtgaaccaccacacccagccc

SEQ ID NO: 4882458 - DNA, 19 bp, Homo sapiens
gtgtgaatgtgggcactgg

SEQ ID NO: 4882459 - DNA, 21 bp, Homo sapiens
gtgtgaatgtgggcactggcc

SEQ ID NO: 4882460 - DNA, 23 bp, Homo sapiens
gtgtgaatgtgggcactggccca

SEQ ID NO: 4882461 - DNA, 14 bp, Homo sapiens
gtgtgacagggcca

SEQ ID NO: 4882462 - DNA, 18 bp, Homo sapiens
gtgtgacagggccagtgg

SEQ ID NO: 4882463 - DNA, 14 bp, Homo sapiens
gtgtgacattccag

SEQ ID NO: 4882464 - DNA, 14 bp, Homo sapiens
gtgtgaccaactgt

SEQ ID NO: 4882465 - DNA, 19 bp, Homo sapiens
gtgtgaggagctgctggct

SEQ ID NO: 4882466 - DNA, 18 bp, Homo sapiens
gtgtgagtgtgacagggc

SEQ ID NO: 4882467 - DNA, 22 bp, Homo sapiens
gtgtgatgaactttctcttcat

SEQ ID NO: 4882468 - DNA, 15 bp, Homo sapiens
gtgtgcaacagacaa

SEQ ID NO: 4882469 - DNA, 22 bp, Homo sapiens
gtgtgcaccttaccaactttct

SEQ ID NO: 4882470 - DNA, 22 bp, Homo sapiens
gtgtgcatggaggccctcctgt

SEQ ID NO: 4882471 - DNA, 16 bp, Homo sapiens
gtgtgcatgtgtgtat

SEQ ID NO: 4882472 - DNA, 17 bp, Homo sapiens
gtgtgcatgtgtgtata

SEQ ID NO: 4882473 - DNA, 16 bp, Homo sapiens
gtgtgcctgggggagt

SEQ ID NO: 4882474 - DNA, 16 bp, Homo sapiens
gtgtgcgctctgtgga

SEQ ID NO: 4882475 - DNA, 12 bp, Homo sapiens
gtgtgctctgat

SEQ ID NO: 4882476 - DNA, 22 bp, Homo sapiens
gtgtgctctgatcatccactgt

SEQ ID NO: 4882477 - DNA, 15 bp, Homo sapiens
gtgtggcagagagag

SEQ ID NO: 4882478 - DNA, 20 bp, Homo sapiens
gtgtggctgaggaggcctcc

SEQ ID NO: 4882479 - DNA, 15 bp, Homo sapiens
gtgtggtggcctcag

SEQ ID NO: 4882480 - DNA, 23 bp, Homo sapiens
gtgtggtggcctcagctgaatgc

SEQ ID NO: 4882481 - DNA, 16 bp, Homo sapiens
gtgtgtagagttaaga

SEQ ID NO: 4882482 - DNA, 23 bp, Homo sapiens
gtgtgtatatatgtgtatatata

SEQ ID NO: 4882483 - DNA, 15 bp, Homo sapiens
gtgtgtatgtgtatt

SEQ ID NO: 4882484 - DNA, 14 bp, Homo sapiens
gtgtgtcttaatta

SEQ ID NO: 4882485 - DNA, 17 bp, Homo sapiens
gtgtgtgaatgaacact

SEQ ID NO: 4882486 - DNA, 17 bp, Homo sapiens
gtgtgtggcagagagag

SEQ ID NO: 4882487 - DNA, 12 bp, Homo sapiens
gtgtgtgtgtgt

SEQ ID NO: 4882488 - DNA, 15 bp, Homo sapiens
gtgtgtgtgtgtgtg

SEQ ID NO: 4882489 - DNA, 16 bp, Homo sapiens
gtgttctccttttcct

SEQ ID NO: 4882490 - DNA, 14 bp, Homo sapiens
gtgttctctcttat

SEQ ID NO: 4882491 - DNA, 15 bp, Homo sapiens
gtgttgaaaaccaaa

SEQ ID NO: 4882492 - DNA, 16 bp, Homo sapiens
gtgttgaaaatgttca

SEQ ID NO: 4882493 - DNA, 11 bp, Homo sapiens
gtgttgacatt

SEQ ID NO: 4882494 - DNA, 14 bp, Homo sapiens
gtgttgggagggat

SEQ ID NO: 4882495 - DNA, 14 bp, Homo sapiens
gtgttgggatactg

SEQ ID NO: 4882496 - DNA, 14 bp, Homo sapiens
gtgttgtattaaca

SEQ ID NO: 4882497 - DNA, 18 bp, Homo sapiens
gtgttgtattaacaaaag

SEQ ID NO: 4882498 - DNA, 18 bp, Homo sapiens
gtgttgtccttttgtctt

SEQ ID NO: 4882499 - DNA, 18 bp, Homo sapiens
gtgttgtcttgaaagatt

SEQ ID NO: 4882500 - DNA, 12 bp, Homo sapiens
gtgtttaaaaaa

SEQ ID NO: 4882501 - DNA, 16 bp, Homo sapiens
gtgtttaatttcttca

SEQ ID NO: 4882502 - DNA, 14 bp, Homo sapiens
gtgtttataaaata

SEQ ID NO: 4882503 - DNA, 22 bp, Homo sapiens
gtgtttataaaatataaacaaa

SEQ ID NO: 4882504 - DNA, 16 bp, Homo sapiens
gtgtttatttttcata

SEQ ID NO: 4882505 - DNA, 20 bp, Homo sapiens
gtgtttatttttcatattgt

SEQ ID NO: 4882506 - DNA, 15 bp, Homo sapiens
gtgttttaatttaaa

SEQ ID NO: 4882507 - DNA, 13 bp, Homo sapiens
gtgtttttctcca

SEQ ID NO: 4882508 - DNA, 15 bp, Homo sapiens
gtgtttttctccagt

SEQ ID NO: 4882509 - DNA, 20 bp, Homo sapiens
gttaaaactgtacatttaaa

SEQ ID NO: 4882510 - DNA, 13 bp, Homo sapiens
gttaaactgttag

SEQ ID NO: 4882511 - DNA, 22 bp, Homo sapiens
gttaaactgttagcactgttga

SEQ ID NO: 4882512 - DNA, 20 bp, Homo sapiens
gttaaatagagtatatgcac

SEQ ID NO: 4882513 - DNA, 21 bp, Homo sapiens
gttaaatagagtatatgcact

SEQ ID NO: 4882514 - DNA, 14 bp, Homo sapiens
gttaaatttgtaag

SEQ ID NO: 4882515 - DNA, 19 bp, Homo sapiens
gttaacatagtaagttcag

SEQ ID NO: 4882516 - DNA, 24 bp, Homo sapiens
gttaacattccaagactctagagt

SEQ ID NO: 4882517 - DNA, 13 bp, Homo sapiens
gttaacattgttg

SEQ ID NO: 4882518 - DNA, 22 bp, Homo sapiens
gttaacattgttgctccctgtg

SEQ ID NO: 4882519 - DNA, 17 bp, Homo sapiens
gttaactgatttgcaat

SEQ ID NO: 4882520 - DNA, 22 bp, Homo sapiens
gttaagacatgatttccttgaa

SEQ ID NO: 4882521 - DNA, 17 bp, Homo sapiens
gttaagagaaactttat

SEQ ID NO: 4882522 - DNA, 19 bp, Homo sapiens
gttaagagaaactttatac

SEQ ID NO: 4882523 - DNA, 14 bp, Homo sapiens
gttaagtatgtgta

SEQ ID NO: 4882524 - DNA, 14 bp, Homo sapiens
gttaatcttcatgg

SEQ ID NO: 4882525 - DNA, 21 bp, Homo sapiens
gttacacactttttaagaaat

SEQ ID NO: 4882526 - DNA, 16 bp, Homo sapiens
gttacagccaagtgcc

SEQ ID NO: 4882527 - DNA, 23 bp, Homo sapiens
gttacagccaagtgccaaatgct

SEQ ID NO: 4882528 - DNA, 13 bp, Homo sapiens
gttacagctcccc

SEQ ID NO: 4882529 - DNA, 20 bp, Homo sapiens
gttacctaaagtatttttat

SEQ ID NO: 4882530 - DNA, 13 bp, Homo sapiens
gttactgtaattc

SEQ ID NO: 4882531 - DNA, 12 bp, Homo sapiens
gttactgttctt

SEQ ID NO: 4882532 - DNA, 14 bp, Homo sapiens
gttactgttcttgc

SEQ ID NO: 4882533 - DNA, 18 bp, Homo sapiens
gttactgttcttgctgct

SEQ ID NO: 4882534 - DNA, 22 bp, Homo sapiens
gttactgttcttgctgctagaa

SEQ ID NO: 4882535 - DNA, 23 bp, Homo sapiens
gttactgttcttgctgctagaac

SEQ ID NO: 4882536 - DNA, 24 bp, Homo sapiens
gttactgttcttgctgctagaact

SEQ ID NO: 4882537 - DNA, 19 bp, Homo sapiens
gttagaaatgcagaatcct

SEQ ID NO: 4882538 - DNA, 18 bp, Homo sapiens
gttagaatctattttcta

SEQ ID NO: 4882539 - DNA, 20 bp, Homo sapiens
gttagagagggaccatgtgt

SEQ ID NO: 4882540 - DNA, 21 bp, Homo sapiens
gttagcactgttgatgtatct

SEQ ID NO: 4882541 - DNA, 11 bp, Homo sapiens
gttagctggag

SEQ ID NO: 4882542 - DNA, 17 bp, Homo sapiens
gttaggaaataaaacct

SEQ ID NO: 4882543 - DNA, 19 bp, Homo sapiens
gttaggaaataaaaccttt

SEQ ID NO: 4882544 - DNA, 21 bp, Homo sapiens
gttaggaaataaaacctttca

SEQ ID NO: 4882545 - DNA, 18 bp, Homo sapiens
gttaggtagagggagttg

SEQ ID NO: 4882546 - DNA, 21 bp, Homo sapiens
gttagtgttttaagaaatgta

SEQ ID NO: 4882547 - DNA, 18 bp, Homo sapiens
gttatcccaatcattgtt

SEQ ID NO: 4882548 - DNA, 14 bp, Homo sapiens
gttatcgaaataac

SEQ ID NO: 4882549 - DNA, 20 bp, Homo sapiens
gttatgaaattcaccccctt

SEQ ID NO: 4882550 - DNA, 13 bp, Homo sapiens
gttatgaatcagt

SEQ ID NO: 4882551 - DNA, 17 bp, Homo sapiens
gttatgactatgtaaac

SEQ ID NO: 4882552 - DNA, 17 bp, Homo sapiens
gtctttgtatcttccat

SEQ ID NO: 4882553 - DNA, 23 bp, Homo sapiens
gtcttttcttggcaaaagccttg

SEQ ID NO: 4882554 - DNA, 20 bp, Homo sapiens
gtctttttctgttgtaactt

SEQ ID NO: 4882555 - DNA, 22 bp, Homo sapiens
gtctttttctgttgtaacttat

SEQ ID NO: 4882556 - DNA, 18 bp, Homo sapiens
gtgaaaccttttttaaga

SEQ ID NO: 4882557 - DNA, 19 bp, Homo sapiens
gtgaaaccttttttaagat

SEQ ID NO: 4882558 - DNA, 21 bp, Homo sapiens
gtgaaaccttttttaagattt

SEQ ID NO: 4882559 - DNA, 21 bp, Homo sapiens
gtgaaagctgagaactcctga

SEQ ID NO: 4882560 - DNA, 17 bp, Homo sapiens
gtgaaataacaaaatgg

SEQ ID NO: 4882561 - DNA, 17 bp, Homo sapiens
gtgaaatcaaaggtgct

SEQ ID NO: 4882562 - DNA, 15 bp, Homo sapiens
gtgaaatggatacta

SEQ ID NO: 4882563 - DNA, 22 bp, Homo sapiens
gtgaaatttctagcctgcactt

SEQ ID NO: 4882564 - DNA, 19 bp, Homo sapiens
gtgaaccaccacacccagc

SEQ ID NO: 4882565 - DNA, 17 bp, Homo sapiens
gtgaactagggaagctc

SEQ ID NO: 4882566 - DNA, 21 bp, Homo sapiens
gtgaagagtgactagtacaaa

SEQ ID NO: 4882567 - DNA, 23 bp, Homo sapiens
gtgaagtacaataattcatattc

SEQ ID NO: 4882568 - DNA, 20 bp, Homo sapiens
gtgaataaacttcagcacca

SEQ ID NO: 4882569 - DNA, 12 bp, Homo sapiens
gtgaatgaaaga

SEQ ID NO: 4882570 - DNA, 17 bp, Homo sapiens
gtgaatgaaagattaaa

SEQ ID NO: 4882571 - DNA, 23 bp, Homo sapiens
gtgaatgattcatgttatattta

SEQ ID NO: 4882572 - DNA, 14 bp, Homo sapiens
gtgaatgcttctca

SEQ ID NO: 4882573 - DNA, 20 bp, Homo sapiens
gtgaatggattggattattt

SEQ ID NO: 4882574 - DNA, 14 bp, Homo sapiens
gtgaatgtgggcac

SEQ ID NO: 4882575 - DNA, 23 bp, Homo sapiens
gtgaatgtgggcactggcccagg

SEQ ID NO: 4882576 - DNA, 22 bp, Homo sapiens
gtgaattcttgaaggaaaatga

SEQ ID NO: 4882577 - DNA, 16 bp, Homo sapiens
gtgacaacacttgtgt

SEQ ID NO: 4882578 - DNA, 20 bp, Homo sapiens
gtgacaaggattgctactgt

SEQ ID NO: 4882579 - DNA, 14 bp, Homo sapiens
gtgacagaggcagc

SEQ ID NO: 4882580 - DNA, 15 bp, Homo sapiens
gtgacagaggcagcc

SEQ ID NO: 4882581 - DNA, 19 bp, Homo sapiens
gtgacagaggcagccccat

SEQ ID NO: 4882582 - DNA, 23 bp, Homo sapiens
gtgacagaggcagccccattctg

SEQ ID NO: 4882583 - DNA, 12 bp, Homo sapiens
gtgacagggcca

SEQ ID NO: 4882584 - DNA, 23 bp, Homo sapiens
gtgacagggccagtggggcctgt

SEQ ID NO: 4882585 - DNA, 11 bp, Homo sapiens
gtgacagtcat

SEQ ID NO: 4882586 - DNA, 23 bp, Homo sapiens
gtgacagtcatcatcagggcctg

SEQ ID NO: 4882587 - DNA, 18 bp, Homo sapiens
gtgacagtggattgcatt

SEQ ID NO: 4882588 - DNA, 23 bp, Homo sapiens
gtgacataatatattctattttt

SEQ ID NO: 4882589 - DNA, 15 bp, Homo sapiens
gtgacatgtgaaacc

SEQ ID NO: 4882590 - DNA, 17 bp, Homo sapiens
gtgacattttacattaa

SEQ ID NO: 4882591 - DNA, 13 bp, Homo sapiens
gtgaccaactgtg

SEQ ID NO: 4882592 - DNA, 20 bp, Homo sapiens
gtgaccaactgtgttgtatt

SEQ ID NO: 4882593 - DNA, 19 bp, Homo sapiens
gtgacctcaggcactagcc

SEQ ID NO: 4882594 - DNA, 20 bp, Homo sapiens
gtgactctttttagggccag

SEQ ID NO: 4882595 - DNA, 15 bp, Homo sapiens
gtgactgtatctgtg

SEQ ID NO: 4882596 - DNA, 15 bp, Homo sapiens
gtgacttctccaggt

SEQ ID NO: 4882597 - DNA, 17 bp, Homo sapiens
gtgagacccccacacct

SEQ ID NO: 4882598 - DNA, 14 bp, Homo sapiens
gtgagactctgtct

SEQ ID NO: 4882599 - DNA, 16 bp, Homo sapiens
gtgagactctgtctca

SEQ ID NO: 4882600 - DNA, 14 bp, Homo sapiens
gtgagagattctgt

SEQ ID NO: 4882601 - DNA, 13 bp, Homo sapiens
gtgagagctgggt

SEQ ID NO: 4882602 - DNA, 19 bp, Homo sapiens
gtgagatgctggagaagag

SEQ ID NO: 4882603 - DNA, 20 bp, Homo sapiens
gtgagatgctggagaagaga

SEQ ID NO: 4882604 - DNA, 19 bp, Homo sapiens
gtgagcagaagtggagctg

SEQ ID NO: 4882605 - DNA, 15 bp, Homo sapiens
gtgagccactgcacc

SEQ ID NO: 4882606 - DNA, 17 bp, Homo sapiens
gtgagcccctggtcctg

SEQ ID NO: 4882607 - DNA, 13 bp, Homo sapiens
gtgagcctggctc

SEQ ID NO: 4882608 - DNA, 14 bp, Homo sapiens
gtgagcctggctct

SEQ ID NO: 4882609 - DNA, 19 bp, Homo sapiens
gtgagcgcctgtgcacaca

SEQ ID NO: 4882610 - DNA, 20 bp, Homo sapiens
gtgagcgcctgtgcacacac

SEQ ID NO: 4882611 - DNA, 15 bp, Homo sapiens
gtgaggagctgctgg

SEQ ID NO: 4882612 - DNA, 17 bp, Homo sapiens
gtgaggagctgctggct

SEQ ID NO: 4882613 - DNA, 21 bp, Homo sapiens
gtgaggggtatatctgggctg

SEQ ID NO: 4882614 - DNA, 17 bp, Homo sapiens
gtgagtcaccaagccca

SEQ ID NO: 4882615 - DNA, 19 bp, Homo sapiens
gtgagtcaccaagcccagt

SEQ ID NO: 4882616 - DNA, 15 bp, Homo sapiens
gtgagtcgaggacag

SEQ ID NO: 4882617 - DNA, 22 bp, Homo sapiens
gtgagtcgaggacagggaggtg

SEQ ID NO: 4882618 - DNA, 17 bp, Homo sapiens
gtgagtctttggttcta

SEQ ID NO: 4882619 - DNA, 18 bp, Homo sapiens
gtgagtgagcctggctct

SEQ ID NO: 4882620 - DNA, 18 bp, Homo sapiens
gtgagtgtgacagggcca

SEQ ID NO: 4882621 - DNA, 19 bp, Homo sapiens
gtgagtgtgacagggccag

SEQ ID NO: 4882622 - DNA, 15 bp, Homo sapiens
gtgataatttaagag

SEQ ID NO: 4882623 - DNA, 19 bp, Homo sapiens
gtgatatggcagaagacac

SEQ ID NO: 4882624 - DNA, 23 bp, Homo sapiens
gtgatccacccacctcagcctcc

SEQ ID NO: 4882625 - DNA, 15 bp, Homo sapiens
gtgatcctcccacct

SEQ ID NO: 4882626 - DNA, 23 bp, Homo sapiens
gtgatcctcccacctcagcctcc

SEQ ID NO: 4882627 - DNA, 15 bp, Homo sapiens
gtgatctcagatcag

SEQ ID NO: 4882628 - DNA, 19 bp, Homo sapiens
gtgatgttctaaggctctg

SEQ ID NO: 4882629 - DNA, 14 bp, Homo sapiens
gtgatgtttgctct

SEQ ID NO: 4882630 - DNA, 21 bp, Homo sapiens
gtgattcctaagccacttgaa

SEQ ID NO: 4882631 - DNA, 18 bp, Homo sapiens
gtgattgcagctttatgt

SEQ ID NO: 4882632 - DNA, 18 bp, Homo sapiens
ggggctgcccttgggcca

SEQ ID NO: 4882633 - DNA, 16 bp, Homo sapiens
gggggccacctgcctg

SEQ ID NO: 4882634 - DNA, 15 bp, Homo sapiens
gggggcctcagtgcc

SEQ ID NO: 4882635 - DNA, 17 bp, Homo sapiens
gggggcctcagtgccac

SEQ ID NO: 4882636 - DNA, 22 bp, Homo sapiens
gggggctatagctacaggaagc

SEQ ID NO: 4882637 - DNA, 19 bp, Homo sapiens
ggggtcctggagcagacca

SEQ ID NO: 4882638 - DNA, 19 bp, Homo sapiens
ggggtgtggctccttccca

SEQ ID NO: 4882639 - DNA, 20 bp, Homo sapiens
ggggttctttcttcctctgc

SEQ ID NO: 4882640 - DNA, 13 bp, Homo sapiens
gggtacagctggg

SEQ ID NO: 4882641 - DNA, 15 bp, Homo sapiens
gggtacagctgggct

SEQ ID NO: 4882642 - DNA, 19 bp, Homo sapiens
gggtacttgtggacacagc

SEQ ID NO: 4882643 - DNA, 20 bp, Homo sapiens
gggtagctgccacttgaaca

SEQ ID NO: 4882644 - DNA, 15 bp, Homo sapiens
gggtagggaataaaa

SEQ ID NO: 4882645 - DNA, 20 bp, Homo sapiens
gggtatcaggtgctgccatc

SEQ ID NO: 4882646 - DNA, 21 bp, Homo sapiens
gggtatgaagagcttgctttg

SEQ ID NO: 4882647 - DNA, 12 bp, Homo sapiens
gggtattggaaa

SEQ ID NO: 4882648 - DNA, 19 bp, Homo sapiens
gggtccagtggatgccaca

SEQ ID NO: 4882649 - DNA, 18 bp, Homo sapiens
gggtcctggctcctgagg

SEQ ID NO: 4882650 - DNA, 17 bp, Homo sapiens
gggtctcttttgtaaat

SEQ ID NO: 4882651 - DNA, 17 bp, Homo sapiens
gggtctgtgtgaatgtg

SEQ ID NO: 4882652 - DNA, 20 bp, Homo sapiens
gggtcttcagcattccctcc

SEQ ID NO: 4882653 - DNA, 20 bp, Homo sapiens
gggtgacagtcatcatcagg

SEQ ID NO: 4882654 - DNA, 17 bp, Homo sapiens
gggtgagggtcccatgt

SEQ ID NO: 4882655 - DNA, 13 bp, Homo sapiens
gggtgattcctaa

SEQ ID NO: 4882656 - DNA, 18 bp, Homo sapiens
gggtgctcagaataaggc

SEQ ID NO: 4882657 - DNA, 21 bp, Homo sapiens
gggtgctcagaataaggcagg

SEQ ID NO: 4882658 - DNA, 12 bp, Homo sapiens
gggtggtgacct

SEQ ID NO: 4882659 - DNA, 18 bp, Homo sapiens
gggtgtcatttcattcca

SEQ ID NO: 4882660 - DNA, 20 bp, Homo sapiens
gggttatgtgtatgtgccat

SEQ ID NO: 4882661 - DNA, 23 bp, Homo sapiens
gggttcaagcgattcttctgctt

SEQ ID NO: 4882662 - DNA, 14 bp, Homo sapiens
gggttcatgatgca

SEQ ID NO: 4882663 - DNA, 15 bp, Homo sapiens
gggttcatgatgcag

SEQ ID NO: 4882664 - DNA, 21 bp, Homo sapiens
gggttccctttccttccatcc

SEQ ID NO: 4882665 - DNA, 16 bp, Homo sapiens
gggttccgcactttcc

SEQ ID NO: 4882666 - DNA, 22 bp, Homo sapiens
gggttctaggcatctctgtact

SEQ ID NO: 4882667 - DNA, 19 bp, Homo sapiens
gggttctttcttcctctgc

SEQ ID NO: 4882668 - DNA, 16 bp, Homo sapiens
gggttggcccctgccc

SEQ ID NO: 4882669 - DNA, 19 bp, Homo sapiens
gggttggcccctgcccggc

SEQ ID NO: 4882670 - DNA, 14 bp, Homo sapiens
gggttgggcccaga

SEQ ID NO: 4882671 - DNA, 22 bp, Homo sapiens
gggttgggcccagatctggtcc

SEQ ID NO: 4882672 - DNA, 14 bp, Homo sapiens
gggttggtgtgctg

SEQ ID NO: 4882673 - DNA, 15 bp, Homo sapiens
gggttggtgtgctga

SEQ ID NO: 4882674 - DNA, 14 bp, Homo sapiens
gggtttgaattgtt

SEQ ID NO: 4882675 - DNA, 20 bp, Homo sapiens
gggttttgccatgttggcca

SEQ ID NO: 4882676 - DNA, 23 bp, Homo sapiens
gggttttgccatgttggccaggc

SEQ ID NO: 4882677 - DNA, 20 bp, Homo sapiens
ggtaaataccaagtatttat

SEQ ID NO: 4882678 - DNA, 14 bp, Homo sapiens
ggtaacaggcagat

SEQ ID NO: 4882679 - DNA, 21 bp, Homo sapiens
ggtaacagttcatgtttgctt

SEQ ID NO: 4882680 - DNA, 23 bp, Homo sapiens
ggtaagagacagaatgtatctgt

SEQ ID NO: 4882681 - DNA, 18 bp, Homo sapiens
ggtaagttttttgaaatt

SEQ ID NO: 4882682 - DNA, 13 bp, Homo sapiens
ggtacccactgct

SEQ ID NO: 4882683 - DNA, 16 bp, Homo sapiens
ggtacccactgctctg

SEQ ID NO: 4882684 - DNA, 14 bp, Homo sapiens
ggtaccctcctggc

SEQ ID NO: 4882685 - DNA, 13 bp, Homo sapiens
ggtaccctctgga

SEQ ID NO: 4882686 - DNA, 14 bp, Homo sapiens
ggtactatatttgc

SEQ ID NO: 4882687 - DNA, 13 bp, Homo sapiens
ggtacttagagtt

SEQ ID NO: 4882688 - DNA, 12 bp, Homo sapiens
ggtagctgccac

SEQ ID NO: 4882689 - DNA, 18 bp, Homo sapiens
ggtagcttacctgacaca

SEQ ID NO: 4882690 - DNA, 15 bp, Homo sapiens
ggtatggaactctct

SEQ ID NO: 4882691 - DNA, 15 bp, Homo sapiens
ggtattttgtttctt

SEQ ID NO: 4882692 - DNA, 18 bp, Homo sapiens
ggtatttttgccctgagt

SEQ ID NO: 4882693 - DNA, 18 bp, Homo sapiens
ggtcaacagctatgctgg

SEQ ID NO: 4882694 - DNA, 12 bp, Homo sapiens
ggtcaatgctat

SEQ ID NO: 4882695 - DNA, 23 bp, Homo sapiens
ggtcaatgctatttttgttttta

SEQ ID NO: 4882696 - DNA, 13 bp, Homo sapiens
ggtcacagcctcc

SEQ ID NO: 4882697 - DNA, 16 bp, Homo sapiens
ggtcacaggactctgc

SEQ ID NO: 4882698 - DNA, 13 bp, Homo sapiens
ggtcagagcctgc

SEQ ID NO: 4882699 - DNA, 19 bp, Homo sapiens
ggtcagaggacctgtattt

SEQ ID NO: 4882700 - DNA, 17 bp, Homo sapiens
ggtcaggcagccagtga

SEQ ID NO: 4882701 - DNA, 14 bp, Homo sapiens
ggtcaggccctgga

SEQ ID NO: 4882702 - DNA, 16 bp, Homo sapiens
ggtcaggccctggaac

SEQ ID NO: 4882703 - DNA, 18 bp, Homo sapiens
ggtcaggccctggaactc

SEQ ID NO: 4882704 - DNA, 14 bp, Homo sapiens
ggtcatcctgcccc

SEQ ID NO: 4882705 - DNA, 14 bp, Homo sapiens
ggtcatttcttcag

SEQ ID NO: 4882706 - DNA, 18 bp, Homo sapiens
ggtccacaggtctagact

SEQ ID NO: 4882707 - DNA, 16 bp, Homo sapiens
ggtccacccaggagcc

SEQ ID NO: 4882708 - DNA, 20 bp, Homo sapiens
ggtccacccaggagccccga

SEQ ID NO: 4882709 - DNA, 20 bp, Homo sapiens
ggtccagctggcctggacag

SEQ ID NO: 4882710 - DNA, 22 bp, Homo sapiens
ggtcccacgaatttgctgggga

SEQ ID NO: 4882711 - DNA, 14 bp, Homo sapiens
ggtcccagccaccc

SEQ ID NO: 4882712 - DNA, 16 bp, Homo sapiens
ggtccccacctgggac

SEQ ID NO: 4882713 - DNA, 20 bp, Homo sapiens
ggtccccctcagcaagccct

SEQ ID NO: 4882714 - DNA, 20 bp, Homo sapiens
ggtccctccagaaccacccc

SEQ ID NO: 4882715 - DNA, 17 bp, Homo sapiens
ggtccggacactcctag

SEQ ID NO: 4882716 - DNA, 20 bp, Homo sapiens
ggtccggacactcctagaga

SEQ ID NO: 4882717 - DNA, 17 bp, Homo sapiens
ggtccggtgttctaaga

SEQ ID NO: 4882718 - DNA, 21 bp, Homo sapiens
ggtcctcagagaatttctacc

SEQ ID NO: 4882719 - DNA, 16 bp, Homo sapiens
ggtcctggctcctgag

SEQ ID NO: 4882720 - DNA, 13 bp, Homo sapiens
ggtcgcccaggag

SEQ ID NO: 4882721 - DNA, 20 bp, Homo sapiens
ggtctcacagtgttgcccag

SEQ ID NO: 4882722 - DNA, 12 bp, Homo sapiens
ggtctcactctg

SEQ ID NO: 4882723 - DNA, 23 bp, Homo sapiens
ggtctcactctgtcgcccagtct

SEQ ID NO: 4882724 - DNA, 16 bp, Homo sapiens
ggtctcccacgtggga

SEQ ID NO: 4882725 - DNA, 20 bp, Homo sapiens
ggtctcgctttgttgcccag

SEQ ID NO: 4882726 - DNA, 21 bp, Homo sapiens
ggtctcgctttgttgcccagg

SEQ ID NO: 4882727 - DNA, 14 bp, Homo sapiens
ggtctcttctccca

SEQ ID NO: 4882728 - DNA, 19 bp, Homo sapiens
gtaaattaaacataaaaca

SEQ ID NO: 4882729 - DNA, 14 bp, Homo sapiens
gtaaattaggaggc

SEQ ID NO: 4882730 - DNA, 14 bp, Homo sapiens
gtaacagaacagct

SEQ ID NO: 4882731 - DNA, 21 bp, Homo sapiens
gtaacagaacagcttcaggtt

SEQ ID NO: 4882732 - DNA, 12 bp, Homo sapiens
gtaacaggcaga

SEQ ID NO: 4882733 - DNA, 11 bp, Homo sapiens
gtaaccagcca

SEQ ID NO: 4882734 - DNA, 19 bp, Homo sapiens
gtaacttatattgaagaca

SEQ ID NO: 4882735 - DNA, 22 bp, Homo sapiens
gtaacttatgtagatatttggc

SEQ ID NO: 4882736 - DNA, 20 bp, Homo sapiens
gtaacttcttatggaattga

SEQ ID NO: 4882737 - DNA, 14 bp, Homo sapiens
gtaagagacagaat

SEQ ID NO: 4882738 - DNA, 18 bp, Homo sapiens
gtaagagtgtagaagcat

SEQ ID NO: 4882739 - DNA, 20 bp, Homo sapiens
gtaagattatagattctaaa

SEQ ID NO: 4882740 - DNA, 13 bp, Homo sapiens
gtaagccaaagaa

SEQ ID NO: 4882741 - DNA, 18 bp, Homo sapiens
gtaagtaattatgcacta

SEQ ID NO: 4882742 - DNA, 16 bp, Homo sapiens
gtaagtttcaggtgac

SEQ ID NO: 4882743 - DNA, 15 bp, Homo sapiens
gtaataactgtgaag

SEQ ID NO: 4882744 - DNA, 16 bp, Homo sapiens
gtaataactgtgaagt

SEQ ID NO: 4882745 - DNA, 22 bp, Homo sapiens
gtaataactgtgaagtttacat

SEQ ID NO: 4882746 - DNA, 15 bp, Homo sapiens
gtaataatacctcaa

SEQ ID NO: 4882747 - DNA, 22 bp, Homo sapiens
gtaatatattctgaagcaacat

SEQ ID NO: 4882748 - DNA, 13 bp, Homo sapiens
gtaatatttttat

SEQ ID NO: 4882749 - DNA, 18 bp, Homo sapiens
gtaatccaggcacagctg

SEQ ID NO: 4882750 - DNA, 20 bp, Homo sapiens
gtaatccaggcacagctgag

SEQ ID NO: 4882751 - DNA, 22 bp, Homo sapiens
gtaatctccacagtcaaagaag

SEQ ID NO: 4882752 - DNA, 22 bp, Homo sapiens
gtaatctctctgcagctgccgg

SEQ ID NO: 4882753 - DNA, 23 bp, Homo sapiens
gtaatctgtacattttgttgtaa

SEQ ID NO: 4882754 - DNA, 21 bp, Homo sapiens
gtaatgtagcgtgtttacatg

SEQ ID NO: 4882755 - DNA, 18 bp, Homo sapiens
gtaatgtgtggtggcctc

SEQ ID NO: 4882756 - DNA, 20 bp, Homo sapiens
gtaatgtgtggtggcctcag

SEQ ID NO: 4882757 - DNA, 15 bp, Homo sapiens
gtaatgttattttct

SEQ ID NO: 4882758 - DNA, 14 bp, Homo sapiens
gtaattatgatttg

SEQ ID NO: 4882759 - DNA, 13 bp, Homo sapiens
gtaattcaagaaa

SEQ ID NO: 4882760 - DNA, 14 bp, Homo sapiens
gtaattcaagaaaa

SEQ ID NO: 4882761 - DNA, 15 bp, Homo sapiens
gtaattgacatgtgc

SEQ ID NO: 4882762 - DNA, 19 bp, Homo sapiens
gtaatttagggtactaaat

SEQ ID NO: 4882763 - DNA, 22 bp, Homo sapiens
gtaatttttaccctaatgtctt

SEQ ID NO: 4882764 - DNA, 12 bp, Homo sapiens
gtacaaaataaa

SEQ ID NO: 4882765 - DNA, 22 bp, Homo sapiens
gtacaaatgccttaaaatggaa

SEQ ID NO: 4882766 - DNA, 16 bp, Homo sapiens
gtacaatgtacacact

SEQ ID NO: 4882767 - DNA, 21 bp, Homo sapiens
gtacaattgtgggcataaact

SEQ ID NO: 4882768 - DNA, 15 bp, Homo sapiens
gtacagaattttgga

SEQ ID NO: 4882769 - DNA, 13 bp, Homo sapiens
gtacagctgggct

SEQ ID NO: 4882770 - DNA, 12 bp, Homo sapiens
gtacataaaaga

SEQ ID NO: 4882771 - DNA, 15 bp, Homo sapiens
gtacataaacaatga

SEQ ID NO: 4882772 - DNA, 22 bp, Homo sapiens
gtacataatgcttaatttctaa

SEQ ID NO: 4882773 - DNA, 22 bp, Homo sapiens
gtacataccctggccgccccct

SEQ ID NO: 4882774 - DNA, 17 bp, Homo sapiens
gtacatatttgtggaat

SEQ ID NO: 4882775 - DNA, 20 bp, Homo sapiens
gtacatctattttggattgt

SEQ ID NO: 4882776 - DNA, 19 bp, Homo sapiens
gtacatctggcttatttta

SEQ ID NO: 4882777 - DNA, 22 bp, Homo sapiens
gtacatctggcttattttaatg

SEQ ID NO: 4882778 - DNA, 19 bp, Homo sapiens
gtacatgtgtagcctgtgc

SEQ ID NO: 4882779 - DNA, 17 bp, Homo sapiens
gtacattcaatgtttat

SEQ ID NO: 4882780 - DNA, 18 bp, Homo sapiens
gtacattcaatgtttatg

SEQ ID NO: 4882781 - DNA, 14 bp, Homo sapiens
gtacatttaaaatt

SEQ ID NO: 4882782 - DNA, 13 bp, Homo sapiens
gtacatttataat

SEQ ID NO: 4882783 - DNA, 18 bp, Homo sapiens
gtacatttatgatttaat

SEQ ID NO: 4882784 - DNA, 20 bp, Homo sapiens
gtacatttatgatttaataa

SEQ ID NO: 4882785 - DNA, 15 bp, Homo sapiens
gtacatttggagaca

SEQ ID NO: 4882786 - DNA, 21 bp, Homo sapiens
gtaccaaagttttatcaagtt

SEQ ID NO: 4882787 - DNA, 16 bp, Homo sapiens
gtaccagcaatatgta

SEQ ID NO: 4882788 - DNA, 22 bp, Homo sapiens
gtaccagcgctctaaaagcacc

SEQ ID NO: 4882789 - DNA, 20 bp, Homo sapiens
gtaccatgaaacaaagctgc

SEQ ID NO: 4882790 - DNA, 17 bp, Homo sapiens
gtaccctcctggctctt

SEQ ID NO: 4882791 - DNA, 18 bp, Homo sapiens
gtaccctctcagctccag

SEQ ID NO: 4882792 - DNA, 15 bp, Homo sapiens
gtacctcccctgcct

SEQ ID NO: 4882793 - DNA, 20 bp, Homo sapiens
gtacctcccctgccttgctg

SEQ ID NO: 4882794 - DNA, 18 bp, Homo sapiens
gtacctgaaaagtaactt

SEQ ID NO: 4882795 - DNA, 12 bp, Homo sapiens
gtacctggtgga

SEQ ID NO: 4882796 - DNA, 19 bp, Homo sapiens
gtacctgttccttagacct

SEQ ID NO: 4882797 - DNA, 21 bp, Homo sapiens
gtaccttttgaggagccccag

SEQ ID NO: 4882798 - DNA, 14 bp, Homo sapiens
gtacgtctgacagg

SEQ ID NO: 4882799 - DNA, 15 bp, Homo sapiens
gtacgtctgacaggc

SEQ ID NO: 4882800 - DNA, 14 bp, Homo sapiens
gtacgtttgtatgt

SEQ ID NO: 4882801 - DNA, 17 bp, Homo sapiens
gtacgtttgtatgtgtg

SEQ ID NO: 4882802 - DNA, 16 bp, Homo sapiens
gtactagtactgtgta

SEQ ID NO: 4882803 - DNA, 19 bp, Homo sapiens
gtactagtactgtgtactg

SEQ ID NO: 4882804 - DNA, 13 bp, Homo sapiens
gtactagttttag

SEQ ID NO: 4882805 - DNA, 21 bp, Homo sapiens
gtactataatgaaaacatcct

SEQ ID NO: 4882806 - DNA, 21 bp, Homo sapiens
gtactatttagatataacact

SEQ ID NO: 4882807 - DNA, 15 bp, Homo sapiens
gtactccctctcagg

SEQ ID NO: 4882808 - DNA, 21 bp, Homo sapiens
gtactctgaaacacactgaaa

SEQ ID NO: 4882809 - DNA, 12 bp, Homo sapiens
gtactgagattt

SEQ ID NO: 4882810 - DNA, 21 bp, Homo sapiens
gtactgccccccatgaggaag

SEQ ID NO: 4882811 - DNA, 17 bp, Homo sapiens
gtactgctcaggctgca

SEQ ID NO: 4882812 - DNA, 18 bp, Homo sapiens
gtactgtaataatacctc

SEQ ID NO: 4882813 - DNA, 14 bp, Homo sapiens
gtactgtactaatt

SEQ ID NO: 4882814 - DNA, 18 bp, Homo sapiens
gtactgtatagacagttt

SEQ ID NO: 4882815 - DNA, 17 bp, Homo sapiens
gtactgtctgattggct

SEQ ID NO: 4882816 - DNA, 18 bp, Homo sapiens
gtactgtctgattggctt

SEQ ID NO: 4882817 - DNA, 14 bp, Homo sapiens
gtactgtgtactgt

SEQ ID NO: 4882818 - DNA, 17 bp, Homo sapiens
gtactgttctgtgtctt

SEQ ID NO: 4882819 - DNA, 13 bp, Homo sapiens
gtactgtttacca

SEQ ID NO: 4882820 - DNA, 15 bp, Homo sapiens
gtacttctccaccct

SEQ ID NO: 4882821 - DNA, 18 bp, Homo sapiens
gtacttctccaccctgct

SEQ ID NO: 4882822 - DNA, 20 bp, Homo sapiens
gtacttctccaccctgctct

SEQ ID NO: 4882823 - DNA, 21 bp, Homo sapiens
gtacttgtggacacagctctt

SEQ ID NO: 4882824 - DNA, 12 bp, Homo sapiens
gtacttgtttgc

SEQ ID NO: 4882825 - DNA, 24 bp, Homo sapiens
gtacttttgagtgtgtgtgtgcat

SEQ ID NO: 4882826 - DNA, 16 bp, Homo sapiens
gtagaaataatatgca

SEQ ID NO: 4882827 - DNA, 14 bp, Homo sapiens
gtagaacctcacct

SEQ ID NO: 4882828 - DNA, 21 bp, Homo sapiens
gtagaagcattccttctttga

SEQ ID NO: 4882829 - DNA, 21 bp, Homo sapiens
gtagacacactatcatagtta

SEQ ID NO: 4882830 - DNA, 16 bp, Homo sapiens
gtagactatatacatg

SEQ ID NO: 4882831 - DNA, 10 bp, Homo sapiens
gtagagccag

SEQ ID NO: 4882832 - DNA, 14 bp, Homo sapiens
gtagaggttttgtt

SEQ ID NO: 4882833 - DNA, 15 bp, Homo sapiens
gtagagttaagaagc

SEQ ID NO: 4882834 - DNA, 13 bp, Homo sapiens
gtagatatttggc

SEQ ID NO: 4882835 - DNA, 19 bp, Homo sapiens
gtagcagggtcgggaaagg

SEQ ID NO: 4882836 - DNA, 19 bp, Homo sapiens
gtagctgggactacaggca

SEQ ID NO: 4882837 - DNA, 22 bp, Homo sapiens
gtagcttacctgacacaagagg

SEQ ID NO: 4882838 - DNA, 15 bp, Homo sapiens
gtcagacataaagcc

SEQ ID NO: 4882839 - DNA, 16 bp, Homo sapiens
gtcagacataaagcca

SEQ ID NO: 4882840 - DNA, 20 bp, Homo sapiens
gtcagacataaagccatgtt

SEQ ID NO: 4882841 - DNA, 20 bp, Homo sapiens
gtcagacatccatgtttgta

SEQ ID NO: 4882842 - DNA, 15 bp, Homo sapiens
gtcagactaagaaat

SEQ ID NO: 4882843 - DNA, 15 bp, Homo sapiens
gtcagagcctgcagt

SEQ ID NO: 4882844 - DNA, 16 bp, Homo sapiens
gtcagagcctgcagtt

SEQ ID NO: 4882845 - DNA, 15 bp, Homo sapiens
gtcagaggacctgta

SEQ ID NO: 4882846 - DNA, 15 bp, Homo sapiens
gtcaggcctgtgtgt

SEQ ID NO: 4882847 - DNA, 14 bp, Homo sapiens
gtcagggagtgctg

SEQ ID NO: 4882848 - DNA, 19 bp, Homo sapiens
gtcagggagtgctggctca

SEQ ID NO: 4882849 - DNA, 15 bp, Homo sapiens
gtcagggcccagagg

SEQ ID NO: 4882850 - DNA, 16 bp, Homo sapiens
gtcagggcccagaggc

SEQ ID NO: 4882851 - DNA, 20 bp, Homo sapiens
gtcagggcccagaggctgag

SEQ ID NO: 4882852 - DNA, 22 bp, Homo sapiens
gtcagggttggtgtgctgaggt

SEQ ID NO: 4882853 - DNA, 17 bp, Homo sapiens
gtcaggtggggcagctt

SEQ ID NO: 4882854 - DNA, 15 bp, Homo sapiens
gtcaggtttaacatt

SEQ ID NO: 4882855 - DNA, 16 bp, Homo sapiens
gtcagtctttttctgt

SEQ ID NO: 4882856 - DNA, 21 bp, Homo sapiens
gtcagtctttttctgttgtaa

SEQ ID NO: 4882857 - DNA, 13 bp, Homo sapiens
gtcatagaaatta

SEQ ID NO: 4882858 - DNA, 17 bp, Homo sapiens
gtcatcacttttcagtg

SEQ ID NO: 4882859 - DNA, 15 bp, Homo sapiens
gggagagcccctggg

SEQ ID NO: 4882860 - DNA, 13 bp, Homo sapiens
gggagaggaaaga

SEQ ID NO: 4882861 - DNA, 18 bp, Homo sapiens
gggagcaggagattgaga

SEQ ID NO: 4882862 - DNA, 18 bp, Homo sapiens
gggagccttagccgccca

SEQ ID NO: 4882863 - DNA, 21 bp, Homo sapiens
gggagcctttggttctggcca

SEQ ID NO: 4882864 - DNA, 18 bp, Homo sapiens
gggagctcctctcctgga

SEQ ID NO: 4882865 - DNA, 19 bp, Homo sapiens
gggagctggttagaaatgc

SEQ ID NO: 4882866 - DNA, 20 bp, Homo sapiens
gggaggacctgaccctactc

SEQ ID NO: 4882867 - DNA, 12 bp, Homo sapiens
gggaggacctgg

SEQ ID NO: 4882868 - DNA, 17 bp, Homo sapiens
gggaggacctggggcac

SEQ ID NO: 4882869 - DNA, 14 bp, Homo sapiens
gggaggagaatgag

SEQ ID NO: 4882870 - DNA, 18 bp, Homo sapiens
gggaggcaagtgtggggg

SEQ ID NO: 4882871 - DNA, 11 bp, Homo sapiens
gggaggcagcc

SEQ ID NO: 4882872 - DNA, 15 bp, Homo sapiens
gggaggccccttctc

SEQ ID NO: 4882873 - DNA, 13 bp, Homo sapiens
gggagggaaaagg

SEQ ID NO: 4882874 - DNA, 18 bp, Homo sapiens
gggaggggcgcccacctc

SEQ ID NO: 4882875 - DNA, 17 bp, Homo sapiens
gggaggtcaggccctgg

SEQ ID NO: 4882876 - DNA, 22 bp, Homo sapiens
gggaggtcaggccctggaactc

SEQ ID NO: 4882877 - DNA, 16 bp, Homo sapiens
gggaggtgaccccagg

SEQ ID NO: 4882878 - DNA, 18 bp, Homo sapiens
gggagtgacagaggcagc

SEQ ID NO: 4882879 - DNA, 13 bp, Homo sapiens
gggatactgcagg

SEQ ID NO: 4882880 - DNA, 20 bp, Homo sapiens
gggatgactaaaatatttat

SEQ ID NO: 4882881 - DNA, 14 bp, Homo sapiens
gggatgtgggaggg

SEQ ID NO: 4882882 - DNA, 20 bp, Homo sapiens
gggattacaggcgtgagcca

SEQ ID NO: 4882883 - DNA, 15 bp, Homo sapiens
gggattacaggtgtg

SEQ ID NO: 4882884 - DNA, 20 bp, Homo sapiens
gggatttaatttccagggtt

SEQ ID NO: 4882885 - DNA, 22 bp, Homo sapiens
gggcaaatgacatgcactgacc

SEQ ID NO: 4882886 - DNA, 14 bp, Homo sapiens
gggcaaggaaaaag

SEQ ID NO: 4882887 - DNA, 16 bp, Homo sapiens
gggcacagtccaggaa

SEQ ID NO: 4882888 - DNA, 15 bp, Homo sapiens
gggcaccagccagcg

SEQ ID NO: 4882889 - DNA, 20 bp, Homo sapiens
gggcactcagaagacactga

SEQ ID NO: 4882890 - DNA, 15 bp, Homo sapiens
gggcactggcccagg

SEQ ID NO: 4882891 - DNA, 16 bp, Homo sapiens
gggcactggtggcccg

SEQ ID NO: 4882892 - DNA, 20 bp, Homo sapiens
gggcactttaaatgaagcta

SEQ ID NO: 4882893 - DNA, 20 bp, Homo sapiens
gggcagcatagcaagacaca

SEQ ID NO: 4882894 - DNA, 16 bp, Homo sapiens
gggcaggaaggagagc

SEQ ID NO: 4882895 - DNA, 19 bp, Homo sapiens
gggcaggaaggagagcctg

SEQ ID NO: 4882896 - DNA, 18 bp, Homo sapiens
gggcaggagggccctacc

SEQ ID NO: 4882897 - DNA, 16 bp, Homo sapiens
gggcaggctgggccat

SEQ ID NO: 4882898 - DNA, 20 bp, Homo sapiens
gggcatccataccagctcgc

SEQ ID NO: 4882899 - DNA, 20 bp, Homo sapiens
gggcatgccccggccacctc

SEQ ID NO: 4882900 - DNA, 22 bp, Homo sapiens
gggcatgccccggccacctctg

SEQ ID NO: 4882901 - DNA, 13 bp, Homo sapiens
gggcattgacaaa

SEQ ID NO: 4882902 - DNA, 21 bp, Homo sapiens
gggccaaatccgctctcttcc

SEQ ID NO: 4882903 - DNA, 23 bp, Homo sapiens
gggccaacttgagggcccagagc

SEQ ID NO: 4882904 - DNA, 21 bp, Homo sapiens
gggccaattcaatacaaacaa

SEQ ID NO: 4882905 - DNA, 16 bp, Homo sapiens
gggccacagagaaagt

SEQ ID NO: 4882906 - DNA, 14 bp, Homo sapiens
gggccacctgcctg

SEQ ID NO: 4882907 - DNA, 17 bp, Homo sapiens
gggccaggactgagccc

SEQ ID NO: 4882908 - DNA, 12 bp, Homo sapiens
gggccaggcagg

SEQ ID NO: 4882909 - DNA, 20 bp, Homo sapiens
gggccaggcaggtgcctgga

SEQ ID NO: 4882910 - DNA, 18 bp, Homo sapiens
gggccagggtctgtgtga

SEQ ID NO: 4882911 - DNA, 18 bp, Homo sapiens
gggccagtcctgcctggc

SEQ ID NO: 4882912 - DNA, 20 bp, Homo sapiens
gggccagtcctgcctggcca

SEQ ID NO: 4882913 - DNA, 18 bp, Homo sapiens
gggccagtggggcctgtg

SEQ ID NO: 4882914 - DNA, 19 bp, Homo sapiens
gggccagtggggcctgtgg

SEQ ID NO: 4882915 - DNA, 17 bp, Homo sapiens
gggccatgtccaaagag

SEQ ID NO: 4882916 - DNA, 23 bp, Homo sapiens
gggccatgtccaaagaggctgcc

SEQ ID NO: 4882917 - DNA, 19 bp, Homo sapiens
gggcccaaggcggcccctc

SEQ ID NO: 4882918 - DNA, 15 bp, Homo sapiens
gggccccccagctca

SEQ ID NO: 4882919 - DNA, 20 bp, Homo sapiens
gggccgaccagaggagcctt

SEQ ID NO: 4882920 - DNA, 12 bp, Homo sapiens
gggccgaggagg

SEQ ID NO: 4882921 - DNA, 13 bp, Homo sapiens
gggcctcctgtgt

SEQ ID NO: 4882922 - DNA, 14 bp, Homo sapiens
gggcctgagagaat

SEQ ID NO: 4882923 - DNA, 14 bp, Homo sapiens
gggcctgcctggcc

SEQ ID NO: 4882924 - DNA, 22 bp, Homo sapiens
gggcctggcattcttgtacagt

SEQ ID NO: 4882925 - DNA, 16 bp, Homo sapiens
gggcctggggcctgag

SEQ ID NO: 4882926 - DNA, 18 bp, Homo sapiens
gggcctggggcctgagag

SEQ ID NO: 4882927 - DNA, 23 bp, Homo sapiens
gggcgcggccagccccggccctg

SEQ ID NO: 4882928 - DNA, 13 bp, Homo sapiens
gggctacaagagg

SEQ ID NO: 4882929 - DNA, 17 bp, Homo sapiens
gggctaggtagaaaaag

SEQ ID NO: 4882930 - DNA, 13 bp, Homo sapiens
gggctatggacac

SEQ ID NO: 4882931 - DNA, 14 bp, Homo sapiens
gggctcggaggctg

SEQ ID NO: 4882932 - DNA, 13 bp, Homo sapiens
gggctctcagctc

SEQ ID NO: 4882933 - DNA, 14 bp, Homo sapiens
gggctctggagaga

SEQ ID NO: 4882934 - DNA, 16 bp, Homo sapiens
gggctctggagagaaa

SEQ ID NO: 4882935 - DNA, 13 bp, Homo sapiens
gggctgccctggt

SEQ ID NO: 4882936 - DNA, 14 bp, Homo sapiens
gggctgccctggtg

SEQ ID NO: 4882937 - DNA, 15 bp, Homo sapiens
gggctgccctggtgc

SEQ ID NO: 4882938 - DNA, 21 bp, Homo sapiens
gggctgggcaaggaaaaagaa

SEQ ID NO: 4882939 - DNA, 12 bp, Homo sapiens
gggctggggagg

SEQ ID NO: 4882940 - DNA, 21 bp, Homo sapiens
gggctgttgaagtcaccttgt

SEQ ID NO: 4882941 - DNA, 16 bp, Homo sapiens
gggcttcagtggcagc

SEQ ID NO: 4882942 - DNA, 18 bp, Homo sapiens
gggcttcagtggcagctg

SEQ ID NO: 4882943 - DNA, 22 bp, Homo sapiens
ggggaacctgccatgccaggaa

SEQ ID NO: 4882944 - DNA, 13 bp, Homo sapiens
ggggacagattca

SEQ ID NO: 4882945 - DNA, 14 bp, Homo sapiens
ggggacagctcctt

SEQ ID NO: 4882946 - DNA, 19 bp, Homo sapiens
ggggacaggcctcacctct

SEQ ID NO: 4882947 - DNA, 21 bp, Homo sapiens
ggggacccaatgtaggagctg

SEQ ID NO: 4882948 - DNA, 21 bp, Homo sapiens
ggggactagcccctgtggaga

SEQ ID NO: 4882949 - DNA, 13 bp, Homo sapiens
ggggactcagccc

SEQ ID NO: 4882950 - DNA, 15 bp, Homo sapiens
ggggactcagccctg

SEQ ID NO: 4882951 - DNA, 23 bp, Homo sapiens
ggggactctgagcgggaggcaga

SEQ ID NO: 4882952 - DNA, 12 bp, Homo sapiens
ggggactgctgc

SEQ ID NO: 4882953 - DNA, 18 bp, Homo sapiens
ggggactgctgctgcctg

SEQ ID NO: 4882954 - DNA, 13 bp, Homo sapiens
ggggaggggaagt

SEQ ID NO: 4882955 - DNA, 15 bp, Homo sapiens
ggggagtcaccttcc

SEQ ID NO: 4882956 - DNA, 17 bp, Homo sapiens
ggggcacagtccaggaa

SEQ ID NO: 4882957 - DNA, 14 bp, Homo sapiens
ggggcagagcctcc

SEQ ID NO: 4882958 - DNA, 13 bp, Homo sapiens
ggggcagtggcaa

SEQ ID NO: 4882959 - DNA, 16 bp, Homo sapiens
ggggccaaaaggaaaa

SEQ ID NO: 4882960 - DNA, 18 bp, Homo sapiens
ggggccaccaaagctgcc

SEQ ID NO: 4882961 - DNA, 16 bp, Homo sapiens
ggggccacctgcctgc

SEQ ID NO: 4882962 - DNA, 14 bp, Homo sapiens
ggggccctgccctg

SEQ ID NO: 4882963 - DNA, 13 bp, Homo sapiens
ggggcctcagacg

SEQ ID NO: 4882964 - DNA, 12 bp, Homo sapiens
ggggcctgagag

SEQ ID NO: 4882965 - DNA, 13 bp, Homo sapiens
ggggcgaggcagg

SEQ ID NO: 4882966 - DNA, 14 bp, Homo sapiens
ggggcgcccacctc

SEQ ID NO: 4882967 - DNA, 16 bp, Homo sapiens
ggggctacaagaggga

SEQ ID NO: 4882968 - DNA, 22 bp, Homo sapiens
ggggctctagggttgctggagc

SEQ ID NO: 4882969 - DNA, 16 bp, Homo sapiens
ggggctctggagagaa

SEQ ID NO: 4882970 - DNA, 18 bp, Homo sapiens
ggggctctggagagaaac

SEQ ID NO: 4882971 - DNA, 24 bp, Homo sapiens
gccagaggaactgtccagagagca

SEQ ID NO: 4882972 - DNA, 19 bp, Homo sapiens
gccagagggagtgacagag

SEQ ID NO: 4882973 - DNA, 22 bp, Homo sapiens
gccagagggagtgacagaggca

SEQ ID NO: 4882974 - DNA, 13 bp, Homo sapiens
gccagagtggcct

SEQ ID NO: 4882975 - DNA, 19 bp, Homo sapiens
gccagagtggcctggccag

SEQ ID NO: 4882976 - DNA, 15 bp, Homo sapiens
gccagatcctcttgg

SEQ ID NO: 4882977 - DNA, 14 bp, Homo sapiens
gccagatgcaccag

SEQ ID NO: 4882978 - DNA, 16 bp, Homo sapiens
gccagatgcaccagcc

SEQ ID NO: 4882979 - DNA, 15 bp, Homo sapiens
gccagatggcccgga

SEQ ID NO: 4882980 - DNA, 20 bp, Homo sapiens
gccagcaatgacatctcagg

SEQ ID NO: 4882981 - DNA, 18 bp, Homo sapiens
gccagcaccacttccttt

SEQ ID NO: 4882982 - DNA, 17 bp, Homo sapiens
gccagccccacacagct

SEQ ID NO: 4882983 - DNA, 22 bp, Homo sapiens
gccagcctgaccttccttcctg

SEQ ID NO: 4882984 - DNA, 18 bp, Homo sapiens
gccagcctggggcctggc

SEQ ID NO: 4882985 - DNA, 14 bp, Homo sapiens
gccagcctggtcca

SEQ ID NO: 4882986 - DNA, 16 bp, Homo sapiens
gccaggacagtcagct

SEQ ID NO: 4882987 - DNA, 19 bp, Homo sapiens
gccaggactgagccccgca

SEQ ID NO: 4882988 - DNA, 22 bp, Homo sapiens
gccaggagctcttcaggcctcc

SEQ ID NO: 4882989 - DNA, 17 bp, Homo sapiens
gccaggatcatggtgta

SEQ ID NO: 4882990 - DNA, 19 bp, Homo sapiens
gccaggatcatggtgtaat

SEQ ID NO: 4882991 - DNA, 22 bp, Homo sapiens
gccaggatcatggtgtaataag

SEQ ID NO: 4882992 - DNA, 24 bp, Homo sapiens
gccaggatcatggtgtaataagac

SEQ ID NO: 4882993 - DNA, 22 bp, Homo sapiens
gccaggcaacttcagtcctggg

SEQ ID NO: 4882994 - DNA, 14 bp, Homo sapiens
gccaggcagatctg

SEQ ID NO: 4882995 - DNA, 15 bp, Homo sapiens
gccaggcagatctgt

SEQ ID NO: 4882996 - DNA, 18 bp, Homo sapiens
gccaggcaggtgcctgga

SEQ ID NO: 4882997 - DNA, 12 bp, Homo sapiens
gccaggccagag

SEQ ID NO: 4882998 - DNA, 13 bp, Homo sapiens
gccaggccgggcc

SEQ ID NO: 4882999 - DNA, 18 bp, Homo sapiens
gccaggctcaggccatgg

SEQ ID NO: 4883000 - DNA, 13 bp, Homo sapiens
gccaggctggtct

SEQ ID NO: 4883001 - DNA, 11 bp, Homo sapiens
gccagggagct

SEQ ID NO: 4883002 - DNA, 18 bp, Homo sapiens
gccagggcagtgctagtg

SEQ ID NO: 4883003 - DNA, 19 bp, Homo sapiens
gccagggggactagcccct

SEQ ID NO: 4883004 - DNA, 21 bp, Homo sapiens
gccagggggactagcccctgt

SEQ ID NO: 4883005 - DNA, 22 bp, Homo sapiens
gccagggtctctccctcaggtg

SEQ ID NO: 4883006 - DNA, 19 bp, Homo sapiens
gccagggtctgtgtgaatg

SEQ ID NO: 4883007 - DNA, 20 bp, Homo sapiens
gccagggtggtcttgatctc

SEQ ID NO: 4883008 - DNA, 22 bp, Homo sapiens
gccagtatctatatatgtgtat

SEQ ID NO: 4883009 - DNA, 23 bp, Homo sapiens
gccagtatctatatatgtgtatg

SEQ ID NO: 4883010 - DNA, 17 bp, Homo sapiens
gccagtcaagaagaaaa

SEQ ID NO: 4883011 - DNA, 16 bp, Homo sapiens
gccagtcctgcctggc

SEQ ID NO: 4883012 - DNA, 15 bp, Homo sapiens
gccagtggggcctgt

SEQ ID NO: 4883013 - DNA, 19 bp, Homo sapiens
gccagtggggcctgtggaa

SEQ ID NO: 4883014 - DNA, 20 bp, Homo sapiens
gccagtgtaatcccccagga

SEQ ID NO: 4883015 - DNA, 16 bp, Homo sapiens
gccagtgttgcctaag

SEQ ID NO: 4883016 - DNA, 14 bp, Homo sapiens
gccagttggaacca

SEQ ID NO: 4883017 - DNA, 23 bp, Homo sapiens
gccatataagtttgaaggaaaca

SEQ ID NO: 4883018 - DNA, 19 bp, Homo sapiens
gccatatataacagataca

SEQ ID NO: 4883019 - DNA, 21 bp, Homo sapiens
gccatatataacagatacatt

SEQ ID NO: 4883020 - DNA, 20 bp, Homo sapiens
gccatattctgttggccagt

SEQ ID NO: 4883021 - DNA, 14 bp, Homo sapiens
gccatatttactac

SEQ ID NO: 4883022 - DNA, 14 bp, Homo sapiens
gccatcaaaatgct

SEQ ID NO: 4883023 - DNA, 13 bp, Homo sapiens
gccatccctgtga

SEQ ID NO: 4883024 - DNA, 14 bp, Homo sapiens
gccatccctgtgag

SEQ ID NO: 4883025 - DNA, 19 bp, Homo sapiens
gccatcctaaaagccaccc

SEQ ID NO: 4883026 - DNA, 15 bp, Homo sapiens
gccatgccaggaacc

SEQ ID NO: 4883027 - DNA, 14 bp, Homo sapiens
gccatgtccaaaga

SEQ ID NO: 4883028 - DNA, 14 bp, Homo sapiens
gccatgttggccag

SEQ ID NO: 4883029 - DNA, 15 bp, Homo sapiens
gccatgttggccagg

SEQ ID NO: 4883030 - DNA, 17 bp, Homo sapiens
gccatgttggccaggct

SEQ ID NO: 4883031 - DNA, 19 bp, Homo sapiens
gccatgttggccaggctgg

SEQ ID NO: 4883032 - DNA, 24 bp, Homo sapiens
gccatgttggccaggctggtctca

SEQ ID NO: 4883033 - DNA, 15 bp, Homo sapiens
gccattaaatgaata

SEQ ID NO: 4883034 - DNA, 22 bp, Homo sapiens
gccattatccctgaatccccct

SEQ ID NO: 4883035 - DNA, 22 bp, Homo sapiens
gccattctgccgccccctcctg

SEQ ID NO: 4883036 - DNA, 17 bp, Homo sapiens
gccattgccaccaggag

SEQ ID NO: 4883037 - DNA, 21 bp, Homo sapiens
gccatttatgtgagtgtgtgt

SEQ ID NO: 4883038 - DNA, 13 bp, Homo sapiens
gccatttgatacc

SEQ ID NO: 4883039 - DNA, 19 bp, Homo sapiens
gccattttgtgaatggatt

SEQ ID NO: 4883040 - DNA, 21 bp, Homo sapiens
gcccaaagagcacaaacattt

SEQ ID NO: 4883041 - DNA, 22 bp, Homo sapiens
gcccaaagagcacaaacatttt

SEQ ID NO: 4883042 - DNA, 19 bp, Homo sapiens
gcccaaaggggacaggcct

SEQ ID NO: 4883043 - DNA, 17 bp, Homo sapiens
gcccaaagtctgtgtga

SEQ ID NO: 4883044 - DNA, 22 bp, Homo sapiens
gcccaagaatagatgctgactg

SEQ ID NO: 4883045 - DNA, 14 bp, Homo sapiens
gcccaagcccaggc

SEQ ID NO: 4883046 - DNA, 17 bp, Homo sapiens
gcccaagcccaggccac

SEQ ID NO: 4883047 - DNA, 16 bp, Homo sapiens
gcccaaggcggcccct

SEQ ID NO: 4883048 - DNA, 17 bp, Homo sapiens
gcccaaggcggcccctc

SEQ ID NO: 4883049 - DNA, 20 bp, Homo sapiens
gcccaatgagactctagggt

SEQ ID NO: 4883050 - DNA, 20 bp, Homo sapiens
gcccacagcacagctccctg

SEQ ID NO: 4883051 - DNA, 18 bp, Homo sapiens
gcccacaggatcagtctg

SEQ ID NO: 4883052 - DNA, 10 bp, Homo sapiens
gcccacctcc

SEQ ID NO: 4883053 - DNA, 12 bp, Homo sapiens
gcccacctcccc

SEQ ID NO: 4883054 - DNA, 18 bp, Homo sapiens
gcccacctccccacgccc

SEQ ID NO: 4883055 - DNA, 15 bp, Homo sapiens
gcccacctgcccatc

SEQ ID NO: 4883056 - DNA, 13 bp, Homo sapiens
gcccaccttggct

SEQ ID NO: 4883057 - DNA, 18 bp, Homo sapiens
gcccaccttggctcaagt

SEQ ID NO: 4883058 - DNA, 16 bp, Homo sapiens
gcccacgctggagtgc

SEQ ID NO: 4883059 - DNA, 19 bp, Homo sapiens
gcccacgctggagtgcagt

SEQ ID NO: 4883060 - DNA, 15 bp, Homo sapiens
gcccacggctaagag

SEQ ID NO: 4883061 - DNA, 23 bp, Homo sapiens
gcccacggctaagaggctgctga

SEQ ID NO: 4883062 - DNA, 21 bp, Homo sapiens
gcccactgctgcagtagggga

SEQ ID NO: 4883063 - DNA, 17 bp, Homo sapiens
gcccagaacttccctga

SEQ ID NO: 4883064 - DNA, 15 bp, Homo sapiens
gcccagagcaggaag

SEQ ID NO: 4883065 - DNA, 13 bp, Homo sapiens
gcccagaggctga

SEQ ID NO: 4883066 - DNA, 11 bp, Homo sapiens
gcccaggagac

SEQ ID NO: 4883067 - DNA, 12 bp, Homo sapiens
gcccaggagaga

SEQ ID NO: 4883068 - DNA, 14 bp, Homo sapiens
gcccaggagagaga

SEQ ID NO: 4883069 - DNA, 16 bp, Homo sapiens
gcccaggagagagaaa

SEQ ID NO: 4883070 - DNA, 17 bp, Homo sapiens
gcccaggagagagaaag

SEQ ID NO: 4883071 - DNA, 22 bp, Homo sapiens
gcccaggagagagaaagccagg

SEQ ID NO: 4883072 - DNA, 20 bp, Homo sapiens
gcccaggagggcatccatac

SEQ ID NO: 4883073 - DNA, 11 bp, Homo sapiens
gcccaggcagg

SEQ ID NO: 4883074 - DNA, 13 bp, Homo sapiens
gcccaggcccctg

SEQ ID NO: 4883075 - DNA, 20 bp, Homo sapiens
gcccaggcccctgccaccct

SEQ ID NO: 4883076 - DNA, 13 bp, Homo sapiens
gcccaggccggcc

SEQ ID NO: 4883077 - DNA, 15 bp, Homo sapiens
gcccaggccggccag

SEQ ID NO: 4883078 - DNA, 16 bp, Homo sapiens
gcccaggccggccagc

SEQ ID NO: 4883079 - DNA, 17 bp, Homo sapiens
gcccaggccggccagcc

SEQ ID NO: 4883080 - DNA, 19 bp, Homo sapiens
gcccaggccggccagcctc

SEQ ID NO: 4883081 - DNA, 19 bp, Homo sapiens
gctcctgccagtgtggaac

SEQ ID NO: 4883082 - DNA, 23 bp, Homo sapiens
gctcctgggggttctttcttcct

SEQ ID NO: 4883083 - DNA, 22 bp, Homo sapiens
gctcctgtcctcccatcccctg

SEQ ID NO: 4883084 - DNA, 12 bp, Homo sapiens
gctcctgtgtct

SEQ ID NO: 4883085 - DNA, 15 bp, Homo sapiens
gctccttctgtccta

SEQ ID NO: 4883086 - DNA, 22 bp, Homo sapiens
gcttattttaatgtgatgatgt

SEQ ID NO: 4883087 - DNA, 14 bp, Homo sapiens
gcttcaccagagca

SEQ ID NO: 4883088 - DNA, 14 bp, Homo sapiens
gcttcactgtataa

SEQ ID NO: 4883089 - DNA, 12 bp, Homo sapiens
gcttcaggttat

SEQ ID NO: 4883090 - DNA, 17 bp, Homo sapiens
gcttcaggttatcgaaa

SEQ ID NO: 4883091 - DNA, 19 bp, Homo sapiens
gcttcaggttatcgaaata

SEQ ID NO: 4883092 - DNA, 14 bp, Homo sapiens
gcttcagtggcagc

SEQ ID NO: 4883093 - DNA, 15 bp, Homo sapiens
gcttcagtggcagct

SEQ ID NO: 4883094 - DNA, 19 bp, Homo sapiens
gcttcagtggcagctgctt

SEQ ID NO: 4883095 - DNA, 14 bp, Homo sapiens
gcttcatgccagct

SEQ ID NO: 4883096 - DNA, 15 bp, Homo sapiens
gcttcattctccttg

SEQ ID NO: 4883097 - DNA, 17 bp, Homo sapiens
gcttcatttcctgtgtc

SEQ ID NO: 4883098 - DNA, 12 bp, Homo sapiens
gcttccaatttt

SEQ ID NO: 4883099 - DNA, 23 bp, Homo sapiens
gcttccatcccaaccagtgccaa

SEQ ID NO: 4883100 - DNA, 14 bp, Homo sapiens
gcttccatgattct

SEQ ID NO: 4883101 - DNA, 14 bp, Homo sapiens
gcttcccacctccc

SEQ ID NO: 4883102 - DNA, 18 bp, Homo sapiens
gcttcccacctccctgcc

SEQ ID NO: 4883103 - DNA, 17 bp, Homo sapiens
gcttcccatgtctttct

SEQ ID NO: 4883104 - DNA, 16 bp, Homo sapiens
gcttcccccatagcca

SEQ ID NO: 4883105 - DNA, 16 bp, Homo sapiens
gcttcccgctcagccc

SEQ ID NO: 4883106 - DNA, 23 bp, Homo sapiens
gcttcccgctcagccctccctgc

SEQ ID NO: 4883107 - DNA, 13 bp, Homo sapiens
gcttccctcctgc

SEQ ID NO: 4883108 - DNA, 22 bp, Homo sapiens
gcttccggtagggaggcagcct

SEQ ID NO: 4883109 - DNA, 24 bp, Homo sapiens
gcttcctttcccaagccttcgggc

SEQ ID NO: 4883110 - DNA, 15 bp, Homo sapiens
gcttctccccagaat

SEQ ID NO: 4883111 - DNA, 17 bp, Homo sapiens
gcttctgtgatgagctg

SEQ ID NO: 4883112 - DNA, 19 bp, Homo sapiens
gcttctgtgatgagctgat

SEQ ID NO: 4883113 - DNA, 17 bp, Homo sapiens
gcttgactcccaagttt

SEQ ID NO: 4883114 - DNA, 19 bp, Homo sapiens
gcttgatgaagcaaggaag

SEQ ID NO: 4883115 - DNA, 16 bp, Homo sapiens
gcttgctagctatgtg

SEQ ID NO: 4883116 - DNA, 22 bp, Homo sapiens
gcttgctagctatgtgaccttg

SEQ ID NO: 4883117 - DNA, 14 bp, Homo sapiens
gcttgctcattttt

SEQ ID NO: 4883118 - DNA, 21 bp, Homo sapiens
gcttgggagagcccctggggc

SEQ ID NO: 4883119 - DNA, 19 bp, Homo sapiens
gcttggggccaccaaagct

SEQ ID NO: 4883120 - DNA, 23 bp, Homo sapiens
gcttggggccaccaaagctgccc

SEQ ID NO: 4883121 - DNA, 13 bp, Homo sapiens
gcttgtaaatacc

SEQ ID NO: 4883122 - DNA, 20 bp, Homo sapiens
gcttgtaaatagctcaggtg

SEQ ID NO: 4883123 - DNA, 18 bp, Homo sapiens
gcttgtacctctggctga

SEQ ID NO: 4883124 - DNA, 17 bp, Homo sapiens
gcttgtagaattgttat

SEQ ID NO: 4883125 - DNA, 22 bp, Homo sapiens
gcttgtaggagctgaggtttca

SEQ ID NO: 4883126 - DNA, 14 bp, Homo sapiens
gcttgtatagtgta

SEQ ID NO: 4883127 - DNA, 18 bp, Homo sapiens
gcttgtatgcaatggatt

SEQ ID NO: 4883128 - DNA, 20 bp, Homo sapiens
gcttgtgaatgtatttttct

SEQ ID NO: 4883129 - DNA, 15 bp, Homo sapiens
gcttgtgcaacaata

SEQ ID NO: 4883130 - DNA, 17 bp, Homo sapiens
gcttgtggggacccagg

SEQ ID NO: 4883131 - DNA, 18 bp, Homo sapiens
gcttgtggggacccaggc

SEQ ID NO: 4883132 - DNA, 21 bp, Homo sapiens
gcttgtggggacccaggctcc

SEQ ID NO: 4883133 - DNA, 12 bp, Homo sapiens
gcttgtgttaag

SEQ ID NO: 4883134 - DNA, 17 bp, Homo sapiens
gcttgttatattaagca

SEQ ID NO: 4883135 - DNA, 18 bp, Homo sapiens
gcttgttccctctccctg

SEQ ID NO: 4883136 - DNA, 14 bp, Homo sapiens
gcttgttttccagt

SEQ ID NO: 4883137 - DNA, 16 bp, Homo sapiens
gctttaaagtgtaata

SEQ ID NO: 4883138 - DNA, 12 bp, Homo sapiens
gctttacacaca

SEQ ID NO: 4883139 - DNA, 11 bp, Homo sapiens
gctttatgatt

SEQ ID NO: 4883140 - DNA, 12 bp, Homo sapiens
gctttatgattt

SEQ ID NO: 4883141 - DNA, 22 bp, Homo sapiens
gctttatggtcctaaaagcaaa

SEQ ID NO: 4883142 - DNA, 19 bp, Homo sapiens
gctttcagaaaacgggaag

SEQ ID NO: 4883143 - DNA, 22 bp, Homo sapiens
gctttcatcacaaatccaaagg

SEQ ID NO: 4883144 - DNA, 18 bp, Homo sapiens
gctttccttgtggcagag

SEQ ID NO: 4883145 - DNA, 23 bp, Homo sapiens
gctttctacccagcgagccctgg

SEQ ID NO: 4883146 - DNA, 16 bp, Homo sapiens
gctttgctaccaaagc

SEQ ID NO: 4883147 - DNA, 15 bp, Homo sapiens
gctttgggctgccct

SEQ ID NO: 4883148 - DNA, 15 bp, Homo sapiens
gctttggtttatatt

SEQ ID NO: 4883149 - DNA, 14 bp, Homo sapiens
gctttgtctgtcgt

SEQ ID NO: 4883150 - DNA, 22 bp, Homo sapiens
gctttgtgttgtaattcttcag

SEQ ID NO: 4883151 - DNA, 22 bp, Homo sapiens
gctttgttttgggggtcaggca

SEQ ID NO: 4883152 - DNA, 12 bp, Homo sapiens
gcttttcactgc

SEQ ID NO: 4883153 - DNA, 22 bp, Homo sapiens
gcttttcctatttgttttcatg

SEQ ID NO: 4883154 - DNA, 18 bp, Homo sapiens
gcttttgtctatgggact

SEQ ID NO: 4883155 - DNA, 13 bp, Homo sapiens
gctttttaattgt

SEQ ID NO: 4883156 - DNA, 21 bp, Homo sapiens
gctttttaattgttgtttctt

SEQ ID NO: 4883157 - DNA, 15 bp, Homo sapiens
gctttttatttctgc

SEQ ID NO: 4883158 - DNA, 16 bp, Homo sapiens
gctttttgaaatgaaa

SEQ ID NO: 4883159 - DNA, 17 bp, Homo sapiens
gctttttgaaatgaaat

SEQ ID NO: 4883160 - DNA, 14 bp, Homo sapiens
ggaaaaatgtttgt

SEQ ID NO: 4883161 - DNA, 21 bp, Homo sapiens
ggaaaaccaagccgtggcttc

SEQ ID NO: 4883162 - DNA, 22 bp, Homo sapiens
ggaaaagaaaaaaaaaagaaga

SEQ ID NO: 4883163 - DNA, 12 bp, Homo sapiens
ggaaacaatata

SEQ ID NO: 4883164 - DNA, 20 bp, Homo sapiens
ggaaacagctaatgggacac

SEQ ID NO: 4883165 - DNA, 22 bp, Homo sapiens
ggaaaggggttggggtgacagt

SEQ ID NO: 4883166 - DNA, 15 bp, Homo sapiens
ggaaataaaaccttt

SEQ ID NO: 4883167 - DNA, 14 bp, Homo sapiens
ggaaatagctaata

SEQ ID NO: 4883168 - DNA, 18 bp, Homo sapiens
ggaacaaggagtcagaca

SEQ ID NO: 4883169 - DNA, 12 bp, Homo sapiens
ggaacagaagga

SEQ ID NO: 4883170 - DNA, 19 bp, Homo sapiens
ggaacagaaggatgaatga

SEQ ID NO: 4883171 - DNA, 12 bp, Homo sapiens
ggaacagaatgt

SEQ ID NO: 4883172 - DNA, 19 bp, Homo sapiens
ggaacagaatgttttactg

SEQ ID NO: 4883173 - DNA, 18 bp, Homo sapiens
ggaacagacaacagaagt

SEQ ID NO: 4883174 - DNA, 17 bp, Homo sapiens
ggaacagactggaagca

SEQ ID NO: 4883175 - DNA, 17 bp, Homo sapiens
ggaacagcactggggag

SEQ ID NO: 4883176 - DNA, 21 bp, Homo sapiens
ggaacagcactggggagtctt

SEQ ID NO: 4883177 - DNA, 11 bp, Homo sapiens
ggaacagcaga

SEQ ID NO: 4883178 - DNA, 23 bp, Homo sapiens
ggaacagctatgggagccccagg

SEQ ID NO: 4883179 - DNA, 13 bp, Homo sapiens
ggaacataaaaag

SEQ ID NO: 4883180 - DNA, 18 bp, Homo sapiens
ggaacataaaaaggacat

SEQ ID NO: 4883181 - DNA, 21 bp, Homo sapiens
ggaacatcctttgcagggcag

SEQ ID NO: 4883182 - DNA, 23 bp, Homo sapiens
ggaacatcctttgcagggcagcc

SEQ ID NO: 4883183 - DNA, 21 bp, Homo sapiens
ggaacatttctgtaaatacca

SEQ ID NO: 4883184 - DNA, 19 bp, Homo sapiens
ggaaccgctcacctagagc

SEQ ID NO: 4883185 - DNA, 21 bp, Homo sapiens
ggaaccgctcacctagagcca

SEQ ID NO: 4883186 - DNA, 16 bp, Homo sapiens
ggaacctcccagaggt

SEQ ID NO: 4883187 - DNA, 22 bp, Homo sapiens
ggaacctcccagaggtccagcc

SEQ ID NO: 4883188 - DNA, 23 bp, Homo sapiens
ggaacctcccagaggtccagccc

SEQ ID NO: 4883189 - DNA, 14 bp, Homo sapiens
ggaacctctgtctc

SEQ ID NO: 4883190 - DNA, 13 bp, Homo sapiens
ggaacctgccatg

SEQ ID NO: 4883191 - DNA, 16 bp, Homo sapiens
ggaaccttccttcctg

SEQ ID NO: 4883192 - DNA, 21 bp, Homo sapiens
ggaaccttccttcctgcttga

SEQ ID NO: 4883193 - DNA, 17 bp, Homo sapiens
ggaaccttgctgtcctg

SEQ ID NO: 4883194 - DNA, 20 bp, Homo sapiens
ggaactagactgcctgggtt

SEQ ID NO: 4883195 - DNA, 21 bp, Homo sapiens
ggaactcctaaacctttgccc

SEQ ID NO: 4883196 - DNA, 12 bp, Homo sapiens
ggatcagttttt

SEQ ID NO: 4883197 - DNA, 15 bp, Homo sapiens
ggatctcagctttga

SEQ ID NO: 4883198 - DNA, 17 bp, Homo sapiens
ggatctcagctttgaga

SEQ ID NO: 4883199 - DNA, 13 bp, Homo sapiens
gcacgcctgcccc

SEQ ID NO: 4883200 - DNA, 23 bp, Homo sapiens
gcacgcggattaatttgcatctg

SEQ ID NO: 4883201 - DNA, 15 bp, Homo sapiens
gcacggacaataaac

SEQ ID NO: 4883202 - DNA, 12 bp, Homo sapiens
gcacggactctt

SEQ ID NO: 4883203 - DNA, 20 bp, Homo sapiens
gcacgtggagagctggtgcc

SEQ ID NO: 4883204 - DNA, 15 bp, Homo sapiens
gcacgttgcttcagg

SEQ ID NO: 4883205 - DNA, 17 bp, Homo sapiens
gcactaaagccagcctg

SEQ ID NO: 4883206 - DNA, 19 bp, Homo sapiens
gcactaaagtatgtaaagt

SEQ ID NO: 4883207 - DNA, 22 bp, Homo sapiens
gcactaaagtatgtaaagtatg

SEQ ID NO: 4883208 - DNA, 14 bp, Homo sapiens
gcactaaatatgaa

SEQ ID NO: 4883209 - DNA, 17 bp, Homo sapiens
gcactaaatcagagaca

SEQ ID NO: 4883210 - DNA, 19 bp, Homo sapiens
gcactaacgttgagcccct

SEQ ID NO: 4883211 - DNA, 17 bp, Homo sapiens
gcactaaggtgtgctct

SEQ ID NO: 4883212 - DNA, 18 bp, Homo sapiens
gcactaaggtgtgctctg

SEQ ID NO: 4883213 - DNA, 20 bp, Homo sapiens
gcactaaggtgtgctctgat

SEQ ID NO: 4883214 - DNA, 17 bp, Homo sapiens
gcactactgggtgtcat

SEQ ID NO: 4883215 - DNA, 16 bp, Homo sapiens
gcactagagaatgcac

SEQ ID NO: 4883216 - DNA, 13 bp, Homo sapiens
gcactagcctttg

SEQ ID NO: 4883217 - DNA, 21 bp, Homo sapiens
gcactagcctttggctctgga

SEQ ID NO: 4883218 - DNA, 21 bp, Homo sapiens
gcactaggcacccagctgcca

SEQ ID NO: 4883219 - DNA, 19 bp, Homo sapiens
gcactaggttcaattccct

SEQ ID NO: 4883220 - DNA, 17 bp, Homo sapiens
gcactcattttctataa

SEQ ID NO: 4883221 - DNA, 20 bp, Homo sapiens
gcactcattttctataacag

SEQ ID NO: 4883222 - DNA, 16 bp, Homo sapiens
gcactccagcctgggc

SEQ ID NO: 4883223 - DNA, 23 bp, Homo sapiens
gcactcccttggtggcaagagcc

SEQ ID NO: 4883224 - DNA, 21 bp, Homo sapiens
gcactcgtgtgcaacagacaa

SEQ ID NO: 4883225 - DNA, 12 bp, Homo sapiens
gcactctagatt

SEQ ID NO: 4883226 - DNA, 19 bp, Homo sapiens
gcattatataccatttatc

SEQ ID NO: 4883227 - DNA, 14 bp, Homo sapiens
gcattatgcaatta

SEQ ID NO: 4883228 - DNA, 19 bp, Homo sapiens
gcattatgtccactgtgta

SEQ ID NO: 4883229 - DNA, 21 bp, Homo sapiens
gcattatgtccactgtgtata

SEQ ID NO: 4883230 - DNA, 23 bp, Homo sapiens
gcattatgtccactgtgtataga

SEQ ID NO: 4883231 - DNA, 14 bp, Homo sapiens
gcattattgcatta

SEQ ID NO: 4883232 - DNA, 15 bp, Homo sapiens
gcattattgcattat

SEQ ID NO: 4883233 - DNA, 14 bp, Homo sapiens
gcattctattgcct

SEQ ID NO: 4883234 - DNA, 18 bp, Homo sapiens
gcattctattgccttctt

SEQ ID NO: 4883235 - DNA, 20 bp, Homo sapiens
gcattctattgccttctttg

SEQ ID NO: 4883236 - DNA, 18 bp, Homo sapiens
gcattctcactcctacct

SEQ ID NO: 4883237 - DNA, 15 bp, Homo sapiens
gcattcttgtacagt

SEQ ID NO: 4883238 - DNA, 11 bp, Homo sapiens
gcattctttcc

SEQ ID NO: 4883239 - DNA, 13 bp, Homo sapiens
gcattctttccca

SEQ ID NO: 4883240 - DNA, 17 bp, Homo sapiens
gcattgaaatgagcacc

SEQ ID NO: 4883241 - DNA, 22 bp, Homo sapiens
gcattgaacacaaactgtaaat

SEQ ID NO: 4883242 - DNA, 23 bp, Homo sapiens
gcattgaacacaaactgtaaata

SEQ ID NO: 4883243 - DNA, 19 bp, Homo sapiens
gcattgacaaatctgtgta

SEQ ID NO: 4883244 - DNA, 20 bp, Homo sapiens
gcattgacaaatctgtgtat

SEQ ID NO: 4883245 - DNA, 23 bp, Homo sapiens
gcattgaccgcgactaatttcaa

SEQ ID NO: 4883246 - DNA, 12 bp, Homo sapiens
gcattgcctggc

SEQ ID NO: 4883247 - DNA, 15 bp, Homo sapiens
gcattgctagataaa

SEQ ID NO: 4883248 - DNA, 17 bp, Homo sapiens
gcattgctagataaaag

SEQ ID NO: 4883249 - DNA, 18 bp, Homo sapiens
gcattgctagataaaagc

SEQ ID NO: 4883250 - DNA, 12 bp, Homo sapiens
gcattgctgtta

SEQ ID NO: 4883251 - DNA, 21 bp, Homo sapiens
gcatttccaacaccacagaca

SEQ ID NO: 4883252 - DNA, 21 bp, Homo sapiens
gcatttgataatgataaaaca

SEQ ID NO: 4883253 - DNA, 12 bp, Homo sapiens
gcatttgtgaaa

SEQ ID NO: 4883254 - DNA, 23 bp, Homo sapiens
gcatttttatttcagattttgat

SEQ ID NO: 4883255 - DNA, 21 bp, Homo sapiens
gcatttttgatttatgcatgg

SEQ ID NO: 4883256 - DNA, 20 bp, Homo sapiens
gccaaaaaccttagctccct

SEQ ID NO: 4883257 - DNA, 13 bp, Homo sapiens
gccaaaaggaaaa

SEQ ID NO: 4883258 - DNA, 14 bp, Homo sapiens
gccaaaaggaaaaa

SEQ ID NO: 4883259 - DNA, 17 bp, Homo sapiens
gccaaaaggaaaaagct

SEQ ID NO: 4883260 - DNA, 23 bp, Homo sapiens
gccaaaaggaaaaagctccatgt

SEQ ID NO: 4883261 - DNA, 12 bp, Homo sapiens
gccaaactgctg

SEQ ID NO: 4883262 - DNA, 13 bp, Homo sapiens
gccaaactgctgg

SEQ ID NO: 4883263 - DNA, 23 bp, Homo sapiens
gccaaactgctggacgtctttct

SEQ ID NO: 4883264 - DNA, 17 bp, Homo sapiens
gccaaagaaatgaacat

SEQ ID NO: 4883265 - DNA, 18 bp, Homo sapiens
gccaaagaaatgaacatt

SEQ ID NO: 4883266 - DNA, 16 bp, Homo sapiens
gccaaagctaggcctg

SEQ ID NO: 4883267 - DNA, 20 bp, Homo sapiens
gccaaaggctggtggcaagt

SEQ ID NO: 4883268 - DNA, 18 bp, Homo sapiens
gccaaatccgctctcttc

SEQ ID NO: 4883269 - DNA, 19 bp, Homo sapiens
gccaaatccgctctcttcc

SEQ ID NO: 4883270 - DNA, 23 bp, Homo sapiens
gccaaattatttgtgtaatagaa

SEQ ID NO: 4883271 - DNA, 19 bp, Homo sapiens
gccaaatttatcaaagcat

SEQ ID NO: 4883272 - DNA, 13 bp, Homo sapiens
gccaactcctcac

SEQ ID NO: 4883273 - DNA, 22 bp, Homo sapiens
gccaagaaacgtcttctaaact

SEQ ID NO: 4883274 - DNA, 15 bp, Homo sapiens
gccaagacaaatcaa

SEQ ID NO: 4883275 - DNA, 17 bp, Homo sapiens
gccaagacaaatcaaca

SEQ ID NO: 4883276 - DNA, 19 bp, Homo sapiens
gccaagacaaatcaacaga

SEQ ID NO: 4883277 - DNA, 18 bp, Homo sapiens
gccaagataggaccttgg

SEQ ID NO: 4883278 - DNA, 20 bp, Homo sapiens
gccaagataggaccttgggc

SEQ ID NO: 4883279 - DNA, 22 bp, Homo sapiens
gccaagataggaccttgggcca

SEQ ID NO: 4883280 - DNA, 22 bp, Homo sapiens
gccaagccctccccatcccatg

SEQ ID NO: 4883281 - DNA, 20 bp, Homo sapiens
gccaaggaggtgaggagcag

SEQ ID NO: 4883282 - DNA, 15 bp, Homo sapiens
gccaaggccttctcc

SEQ ID NO: 4883283 - DNA, 17 bp, Homo sapiens
gccaagtgccaaatgct

SEQ ID NO: 4883284 - DNA, 18 bp, Homo sapiens
gccaagtgcgtgccgtgt

SEQ ID NO: 4883285 - DNA, 13 bp, Homo sapiens
gccaatatgtatt

SEQ ID NO: 4883286 - DNA, 17 bp, Homo sapiens
gccaatatgtattgtaa

SEQ ID NO: 4883287 - DNA, 18 bp, Homo sapiens
gccaatattaaatctgct

SEQ ID NO: 4883288 - DNA, 16 bp, Homo sapiens
gccaatgtctcctccc

SEQ ID NO: 4883289 - DNA, 19 bp, Homo sapiens
gccaatgttttccacccat

SEQ ID NO: 4883290 - DNA, 20 bp, Homo sapiens
gccacaactcctacatgatg

SEQ ID NO: 4883291 - DNA, 16 bp, Homo sapiens
gccacaccctcccccg

SEQ ID NO: 4883292 - DNA, 23 bp, Homo sapiens
gccacacttcaggctcttctcct

SEQ ID NO: 4883293 - DNA, 18 bp, Homo sapiens
gccacacttgaacctaat

SEQ ID NO: 4883294 - DNA, 23 bp, Homo sapiens
gccacagagaaagtacttctcca

SEQ ID NO: 4883295 - DNA, 14 bp, Homo sapiens
gccacatttggaat

SEQ ID NO: 4883296 - DNA, 16 bp, Homo sapiens
gccaccaaagctgccc

SEQ ID NO: 4883297 - DNA, 12 bp, Homo sapiens
gccaccacctct

SEQ ID NO: 4883298 - DNA, 15 bp, Homo sapiens
gccaccacgtccagc

SEQ ID NO: 4883299 - DNA, 21 bp, Homo sapiens
gccaccagagaccgtcctcac

SEQ ID NO: 4883300 - DNA, 15 bp, Homo sapiens
gccaccccaccctcc

SEQ ID NO: 4883301 - DNA, 18 bp, Homo sapiens
gccaccccaccctccctg

SEQ ID NO: 4883302 - DNA, 12 bp, Homo sapiens
gccaccccactt

SEQ ID NO: 4883303 - DNA, 19 bp, Homo sapiens
gccaccccgggctctctgc

SEQ ID NO: 4883304 - DNA, 12 bp, Homo sapiens
gccaccctagcc

SEQ ID NO: 4883305 - DNA, 17 bp, Homo sapiens
gccaccgcgcctggccg

SEQ ID NO: 4883306 - DNA, 16 bp, Homo sapiens
gccacctctctccttt

SEQ ID NO: 4883307 - DNA, 20 bp, Homo sapiens
gccacctctgcggaccccag

SEQ ID NO: 4883308 - DNA, 21 bp, Homo sapiens
gccacctctgcggaccccagc

SEQ ID NO: 4883309 - DNA, 16 bp, Homo sapiens
gccacctctgtcattt

SEQ ID NO: 4883310 - DNA, 23 bp, Homo sapiens
gccacctgcctgcgtcttccgcc

SEQ ID NO: 4883311 - DNA, 15 bp, Homo sapiens
gccacggccaggcca

SEQ ID NO: 4883312 - DNA, 18 bp, Homo sapiens
gagatgtttttaaaagtt

SEQ ID NO: 4883313 - DNA, 21 bp, Homo sapiens
gagatgtttttaaaagtttca

SEQ ID NO: 4883314 - DNA, 15 bp, Homo sapiens
gagattatgttcttt

SEQ ID NO: 4883315 - DNA, 15 bp, Homo sapiens
gagattctgtgatct

SEQ ID NO: 4883316 - DNA, 16 bp, Homo sapiens
gagattgaactccaag

SEQ ID NO: 4883317 - DNA, 20 bp, Homo sapiens
gagattgagaaggagagaaa

SEQ ID NO: 4883318 - DNA, 16 bp, Homo sapiens
gagattggcatggctt

SEQ ID NO: 4883319 - DNA, 23 bp, Homo sapiens
gagattgttgtttgccatacttt

SEQ ID NO: 4883320 - DNA, 22 bp, Homo sapiens
gagatttaccagggatgtagat

SEQ ID NO: 4883321 - DNA, 17 bp, Homo sapiens
gagattttttattgcta

SEQ ID NO: 4883322 - DNA, 20 bp, Homo sapiens
gagcaaaaatatcccttccg

SEQ ID NO: 4883323 - DNA, 12 bp, Homo sapiens
gagcaaaataat

SEQ ID NO: 4883324 - DNA, 22 bp, Homo sapiens
gagcaaagatcaaaataaaaag

SEQ ID NO: 4883325 - DNA, 13 bp, Homo sapiens
gagcaaagctgat

SEQ ID NO: 4883326 - DNA, 15 bp, Homo sapiens
gagcaacctctcact

SEQ ID NO: 4883327 - DNA, 19 bp, Homo sapiens
gagcaacctctcactcccc

SEQ ID NO: 4883328 - DNA, 20 bp, Homo sapiens
gagcaacctctcactcccca

SEQ ID NO: 4883329 - DNA, 21 bp, Homo sapiens
gagcaacctctcactccccat

SEQ ID NO: 4883330 - DNA, 15 bp, Homo sapiens
gagcacaaacatttt

SEQ ID NO: 4883331 - DNA, 14 bp, Homo sapiens
gagcacaggtccca

SEQ ID NO: 4883332 - DNA, 15 bp, Homo sapiens
gagcactaaggtgtg

SEQ ID NO: 4883333 - DNA, 21 bp, Homo sapiens
gagcagacaggaggaatcatg

SEQ ID NO: 4883334 - DNA, 14 bp, Homo sapiens
gagcagatgcagag

SEQ ID NO: 4883335 - DNA, 18 bp, Homo sapiens
gagcagatgcagagagcc

SEQ ID NO: 4883336 - DNA, 15 bp, Homo sapiens
gagcagcctgtggca

SEQ ID NO: 4883337 - DNA, 18 bp, Homo sapiens
gagcagctttaaactcag

SEQ ID NO: 4883338 - DNA, 21 bp, Homo sapiens
gagcagctttaaactcaggga

SEQ ID NO: 4883339 - DNA, 22 bp, Homo sapiens
gagcaggaagcattcagagagc

SEQ ID NO: 4883340 - DNA, 15 bp, Homo sapiens
gagcaggaaggcctg

SEQ ID NO: 4883341 - DNA, 18 bp, Homo sapiens
gagcaggaaggcctgggt

SEQ ID NO: 4883342 - DNA, 12 bp, Homo sapiens
gagcaggacctc

SEQ ID NO: 4883343 - DNA, 20 bp, Homo sapiens
gagcaggacctcccttccga

SEQ ID NO: 4883344 - DNA, 18 bp, Homo sapiens
gagcagggaaggcctgac

SEQ ID NO: 4883345 - DNA, 16 bp, Homo sapiens
gagcagggtgttggga

SEQ ID NO: 4883346 - DNA, 20 bp, Homo sapiens
gagcagtcctgcctcagcct

SEQ ID NO: 4883347 - DNA, 20 bp, Homo sapiens
gagcatcccggaggaaatct

SEQ ID NO: 4883348 - DNA, 16 bp, Homo sapiens
gagcatcctgagcccc

SEQ ID NO: 4883349 - DNA, 22 bp, Homo sapiens
gagcatcctgagccccgccctc

SEQ ID NO: 4883350 - DNA, 20 bp, Homo sapiens
gacacaggcccggctccagg

SEQ ID NO: 4883351 - DNA, 21 bp, Homo sapiens
gacacaggcccggctccaggc

SEQ ID NO: 4883352 - DNA, 15 bp, Homo sapiens
gacaccaaagccacc

SEQ ID NO: 4883353 - DNA, 17 bp, Homo sapiens
gacaccacacccagcct

SEQ ID NO: 4883354 - DNA, 18 bp, Homo sapiens
gacaccacacccagcctc

SEQ ID NO: 4883355 - DNA, 20 bp, Homo sapiens
gacaccacacccagcctcag

SEQ ID NO: 4883356 - DNA, 12 bp, Homo sapiens
gacaccagagca

SEQ ID NO: 4883357 - DNA, 22 bp, Homo sapiens
gacaccagagcagatgcagaga

SEQ ID NO: 4883358 - DNA, 15 bp, Homo sapiens
gacacccattttcac

SEQ ID NO: 4883359 - DNA, 22 bp, Homo sapiens
gacaccgggccagtatctatat

SEQ ID NO: 4883360 - DNA, 15 bp, Homo sapiens
gacacctgccctgcc

SEQ ID NO: 4883361 - DNA, 14 bp, Homo sapiens
gacacctttaggtt

SEQ ID NO: 4883362 - DNA, 17 bp, Homo sapiens
gacacgccttcccctca

SEQ ID NO: 4883363 - DNA, 21 bp, Homo sapiens
gacacgccttcccctcagcca

SEQ ID NO: 4883364 - DNA, 23 bp, Homo sapiens
gacactatagtttaaaacacatt

SEQ ID NO: 4883365 - DNA, 16 bp, Homo sapiens
gacactccagtgccag

SEQ ID NO: 4883366 - DNA, 19 bp, Homo sapiens
gacactccagtgccagcaa

SEQ ID NO: 4883367 - DNA, 13 bp, Homo sapiens
gacactgatgggc

SEQ ID NO: 4883368 - DNA, 14 bp, Homo sapiens
gacactgcctgggc

SEQ ID NO: 4883369 - DNA, 14 bp, Homo sapiens
gacactggcccctc

SEQ ID NO: 4883370 - DNA, 16 bp, Homo sapiens
gacactgtgcccagcc

SEQ ID NO: 4883371 - DNA, 20 bp, Homo sapiens
gacactgtgcccagcccgga

SEQ ID NO: 4883372 - DNA, 20 bp, Homo sapiens
gacacttaatactaccttga

SEQ ID NO: 4883373 - DNA, 12 bp, Homo sapiens
gacagaaagcag

SEQ ID NO: 4883374 - DNA, 20 bp, Homo sapiens
gacagaacccctacatgaaa

SEQ ID NO: 4883375 - DNA, 14 bp, Homo sapiens
gacagaaggtgcca

SEQ ID NO: 4883376 - DNA, 16 bp, Homo sapiens
gacagaagtctcctca

SEQ ID NO: 4883377 - DNA, 20 bp, Homo sapiens
gacagaatgtatctgtgaag

SEQ ID NO: 4883378 - DNA, 15 bp, Homo sapiens
gacagacacacacac

SEQ ID NO: 4883379 - DNA, 12 bp, Homo sapiens
gacagacacagg

SEQ ID NO: 4883380 - DNA, 16 bp, Homo sapiens
gacagacacaggcccg

SEQ ID NO: 4883381 - DNA, 18 bp, Homo sapiens
gacagacatctctgcacc

SEQ ID NO: 4883382 - DNA, 18 bp, Homo sapiens
gacagaccacatctttat

SEQ ID NO: 4883383 - DNA, 13 bp, Homo sapiens
gacagagccatgc

SEQ ID NO: 4883384 - DNA, 14 bp, Homo sapiens
gacagaggcagccc

SEQ ID NO: 4883385 - DNA, 15 bp, Homo sapiens
gacagaggggactct

SEQ ID NO: 4883386 - DNA, 17 bp, Homo sapiens
gacagaggggactctgg

SEQ ID NO: 4883387 - DNA, 21 bp, Homo sapiens
gacagaggggactctgggcta

SEQ ID NO: 4883388 - DNA, 16 bp, Homo sapiens
gacagagtgagactct

SEQ ID NO: 4883389 - DNA, 19 bp, Homo sapiens
gacagagtgagactctgtc

SEQ ID NO: 4883390 - DNA, 22 bp, Homo sapiens
gacagagtgagactctgtctca

SEQ ID NO: 4883391 - DNA, 14 bp, Homo sapiens
gacagatgccccag

SEQ ID NO: 4883392 - DNA, 18 bp, Homo sapiens
gacagatgccccagagct

SEQ ID NO: 4883393 - DNA, 20 bp, Homo sapiens
gacagattcagtcttgcctt

SEQ ID NO: 4883394 - DNA, 12 bp, Homo sapiens
gacagcaggcag

SEQ ID NO: 4883395 - DNA, 14 bp, Homo sapiens
gacagcaggcagcg

SEQ ID NO: 4883396 - DNA, 20 bp, Homo sapiens
gacagcatgtgccctcctga

SEQ ID NO: 4883397 - DNA, 19 bp, Homo sapiens
gacagccacggccaggcca

SEQ ID NO: 4883398 - DNA, 17 bp, Homo sapiens
gacagccccagagcagg

SEQ ID NO: 4883399 - DNA, 16 bp, Homo sapiens
gacagcctcccacccc

SEQ ID NO: 4883400 - DNA, 19 bp, Homo sapiens
gacagctccttctgtccta

SEQ ID NO: 4883401 - DNA, 20 bp, Homo sapiens
gacagctttcccctcatttt

SEQ ID NO: 4883402 - DNA, 23 bp, Homo sapiens
gacaggatgggggctggcctctg

SEQ ID NO: 4883403 - DNA, 18 bp, Homo sapiens
gacaggcatgttctctga

SEQ ID NO: 4883404 - DNA, 19 bp, Homo sapiens
gacaggcatgttctctgag

SEQ ID NO: 4883405 - DNA, 11 bp, Homo sapiens
gacaggcctca

SEQ ID NO: 4883406 - DNA, 19 bp, Homo sapiens
gacaggcctcacctctacc

SEQ ID NO: 4883407 - DNA, 19 bp, Homo sapiens
gacaggcctgaagatatta

SEQ ID NO: 4883408 - DNA, 15 bp, Homo sapiens
gacagggaagagcag

SEQ ID NO: 4883409 - DNA, 24 bp, Homo sapiens
gacagggcacaccgggcactcaga

SEQ ID NO: 4883410 - DNA, 14 bp, Homo sapiens
gacagggccagtgg

SEQ ID NO: 4883411 - DNA, 21 bp, Homo sapiens
gacagggccagtggggcctgt

SEQ ID NO: 4883412 - DNA, 22 bp, Homo sapiens
gacagggccagtggggcctgtg

SEQ ID NO: 4883413 - DNA, 20 bp, Homo sapiens
gacattttctttcatgggca

SEQ ID NO: 4883414 - DNA, 21 bp, Homo sapiens
gaccaacgttactcagggctc

SEQ ID NO: 4883415 - DNA, 13 bp, Homo sapiens
gaccaactgggcc

SEQ ID NO: 4883416 - DNA, 12 bp, Homo sapiens
gaccaactgtgt

SEQ ID NO: 4883417 - DNA, 11 bp, Homo sapiens
gaccaaggaac

SEQ ID NO: 4883418 - DNA, 18 bp, Homo sapiens
gaccaattattgatatat

SEQ ID NO: 4883419 - DNA, 13 bp, Homo sapiens
gaccaattgtgct

SEQ ID NO: 4883420 - DNA, 16 bp, Homo sapiens
gaccacaccctgtact

SEQ ID NO: 4883421 - DNA, 18 bp, Homo sapiens
gaccaccccgcctgccct

SEQ ID NO: 4883422 - DNA, 14 bp, Homo sapiens
gaccactcagcccc

SEQ ID NO: 4883423 - DNA, 17 bp, Homo sapiens
gaccactcagcccctag

SEQ ID NO: 4883424 - DNA, 21 bp, Homo sapiens
gaccactgcatgagcttttat

SEQ ID NO: 4883425 - DNA, 15 bp, Homo sapiens
gaccacttccagggg

SEQ ID NO: 4883426 - DNA, 22 bp, Homo sapiens
gaccacttccaggggaacctgc

SEQ ID NO: 4883427 - DNA, 22 bp, Homo sapiens
gaccagacaccttgacagggca

SEQ ID NO: 4883428 - DNA, 23 bp, Homo sapiens
gaccagacaccttgacagggcac

SEQ ID NO: 4883429 - DNA, 18 bp, Homo sapiens
gaccagaggagccttttt

SEQ ID NO: 4883430 - DNA, 12 bp, Homo sapiens
gaccagcctggg

SEQ ID NO: 4883431 - DNA, 17 bp, Homo sapiens
gaccagcctgggcagca

SEQ ID NO: 4883432 - DNA, 14 bp, Homo sapiens
gaccaggactccct

SEQ ID NO: 4883433 - DNA, 16 bp, Homo sapiens
gaccaggactccctcc

SEQ ID NO: 4883434 - DNA, 15 bp, Homo sapiens
gaccaggatttctaa

SEQ ID NO: 4883435 - DNA, 15 bp, Homo sapiens
gaccaggctgtgtcc

SEQ ID NO: 4883436 - DNA, 15 bp, Homo sapiens
gaccagggagccttt

SEQ ID NO: 4883437 - DNA, 22 bp, Homo sapiens
gaccagggagcctttggttctg

SEQ ID NO: 4883438 - DNA, 13 bp, Homo sapiens
gaccagggccgag

SEQ ID NO: 4883439 - DNA, 15 bp, Homo sapiens
gaccagggccgagga

SEQ ID NO: 4883440 - DNA, 22 bp, Homo sapiens
gaccagttgaataaaagtgcac

SEQ ID NO: 4883441 - DNA, 19 bp, Homo sapiens
gaccatccactctaccctc

SEQ ID NO: 4883442 - DNA, 21 bp, Homo sapiens
gaccatccactctaccctccc

SEQ ID NO: 4883443 - DNA, 15 bp, Homo sapiens
gaccatctgctttta

SEQ ID NO: 4883444 - DNA, 17 bp, Homo sapiens
gaccatctgcttttatt

SEQ ID NO: 4883445 - DNA, 22 bp, Homo sapiens
gaccatggttaagagtccaaga

SEQ ID NO: 4883446 - DNA, 20 bp, Homo sapiens
gaccatgtgtcacttgtgct

SEQ ID NO: 4883447 - DNA, 21 bp, Homo sapiens
gaccatgtgtcacttgtgctt

SEQ ID NO: 4883448 - DNA, 13 bp, Homo sapiens
gaccatttaacat

SEQ ID NO: 4883449 - DNA, 18 bp, Homo sapiens
gacccaatgtaggagctg

SEQ ID NO: 4883450 - DNA, 23 bp, Homo sapiens
gacccacagactggttttgcaac

SEQ ID NO: 4883451 - DNA, 15 bp, Homo sapiens
gacccaccccacctg

SEQ ID NO: 4883452 - DNA, 18 bp, Homo sapiens
gacccaccccacctgcag

SEQ ID NO: 4883453 - DNA, 12 bp, Homo sapiens
gacccactgctt

SEQ ID NO: 4883454 - DNA, 18 bp, Homo sapiens
gacccaggctccgccctt

SEQ ID NO: 4883455 - DNA, 13 bp, Homo sapiens
gacccagggggag

SEQ ID NO: 4883456 - DNA, 23 bp, Homo sapiens
gacccagtgagattacagaggaa

SEQ ID NO: 4883457 - DNA, 18 bp, Homo sapiens
gacccatagatcttctga

SEQ ID NO: 4883458 - DNA, 23 bp, Homo sapiens
gaccccaaacaccttccagctcc

SEQ ID NO: 4883459 - DNA, 22 bp, Homo sapiens
gaccccagctgtgagccttggc

SEQ ID NO: 4883460 - DNA, 14 bp, Homo sapiens
gacccctagttccc

SEQ ID NO: 4883461 - DNA, 17 bp, Homo sapiens
gacccctagttccctct

SEQ ID NO: 4883462 - DNA, 18 bp, Homo sapiens
gacccctagttccctctg

SEQ ID NO: 4883463 - DNA, 21 bp, Homo sapiens
gacccctagttccctctgctc

SEQ ID NO: 4883464 - DNA, 18 bp, Homo sapiens
gacccctccatgtgggct

SEQ ID NO: 4883465 - DNA, 21 bp, Homo sapiens
gacccctccatgtgggctagt

SEQ ID NO: 4883466 - DNA, 12 bp, Homo sapiens
gacccctcctca

SEQ ID NO: 4883467 - DNA, 14 bp, Homo sapiens
gacccctcctcact

SEQ ID NO: 4883468 - DNA, 17 bp, Homo sapiens
gacccctcctcactggc

SEQ ID NO: 4883469 - DNA, 15 bp, Homo sapiens
gaccctctgccacca

SEQ ID NO: 4883470 - DNA, 20 bp, Homo sapiens
gaccctctgccaccagagac

SEQ ID NO: 4883471 - DNA, 18 bp, Homo sapiens
gaccctgcaaacagaaca

SEQ ID NO: 4883472 - DNA, 15 bp, Homo sapiens
gacccttccagacat

SEQ ID NO: 4883473 - DNA, 23 bp, Homo sapiens
gacccttcccaatcagcactgaa

SEQ ID NO: 4883474 - DNA, 22 bp, Homo sapiens
gaccgccctccgcgaaaatagt

SEQ ID NO: 4883475 - DNA, 13 bp, Homo sapiens
gaccgtcctcacc

SEQ ID NO: 4883476 - DNA, 15 bp, Homo sapiens
gacctactgttctaa

SEQ ID NO: 4883477 - DNA, 17 bp, Homo sapiens
gacctactgttctaaag

SEQ ID NO: 4883478 - DNA, 16 bp, Homo sapiens
gacctcactgtgacct

SEQ ID NO: 4883479 - DNA, 18 bp, Homo sapiens
gacctcaggcactagcct

SEQ ID NO: 4883480 - DNA, 20 bp, Homo sapiens
gacctcccttccgaccctct

SEQ ID NO: 4883481 - DNA, 22 bp, Homo sapiens
gacctcccttccgaccctctgg

SEQ ID NO: 4883482 - DNA, 12 bp, Homo sapiens
gacctcttgctg

SEQ ID NO: 4883483 - DNA, 18 bp, Homo sapiens
gacctcttgctgtctctg

SEQ ID NO: 4883484 - DNA, 15 bp, Homo sapiens
gacctgaaattccaa

SEQ ID NO: 4883485 - DNA, 23 bp, Homo sapiens
gacctgaaattccaaagtctcta

SEQ ID NO: 4883486 - DNA, 13 bp, Homo sapiens
gacctgcctcctg

SEQ ID NO: 4883487 - DNA, 14 bp, Homo sapiens
gacctgcctcctgc

SEQ ID NO: 4883488 - DNA, 16 bp, Homo sapiens
gacctgcctcctgcct

SEQ ID NO: 4883489 - DNA, 15 bp, Homo sapiens
gacctgctccgctgc

SEQ ID NO: 4883490 - DNA, 13 bp, Homo sapiens
gacctgctttttg

SEQ ID NO: 4883491 - DNA, 14 bp, Homo sapiens
gacctgctttttga

SEQ ID NO: 4883492 - DNA, 18 bp, Homo sapiens
gacctgctttttgaaatg

SEQ ID NO: 4883493 - DNA, 13 bp, Homo sapiens
gacctggggcaca

SEQ ID NO: 4883494 - DNA, 17 bp, Homo sapiens
gacctggtaccctcctg

SEQ ID NO: 4883495 - DNA, 13 bp, Homo sapiens
gacctgtatttaa

SEQ ID NO: 4883496 - DNA, 19 bp, Homo sapiens
gacctgtatttaagcaaat

SEQ ID NO: 4883497 - DNA, 13 bp, Homo sapiens
gaccttaggcctt

SEQ ID NO: 4883498 - DNA, 18 bp, Homo sapiens
gaccttaggccttcctct

SEQ ID NO: 4883499 - DNA, 21 bp, Homo sapiens
gaccttaggccttcctctctc

SEQ ID NO: 4883500 - DNA, 19 bp, Homo sapiens
gaccttctagaattataag

SEQ ID NO: 4883501 - DNA, 13 bp, Homo sapiens
gaccttttaaagt

SEQ ID NO: 4883502 - DNA, 22 bp, Homo sapiens
gacgagacccaagggcagagca

SEQ ID NO: 4883503 - DNA, 18 bp, Homo sapiens
gacgattccttctctgaa

SEQ ID NO: 4883504 - DNA, 17 bp, Homo sapiens
gacgcctgagctcactc

SEQ ID NO: 4883505 - DNA, 19 bp, Homo sapiens
gacgctgatacataactaa

SEQ ID NO: 4883506 - DNA, 18 bp, Homo sapiens
gacggagtcccaccttgg

SEQ ID NO: 4883507 - DNA, 20 bp, Homo sapiens
gacggcctgatgctccctcc

SEQ ID NO: 4883508 - DNA, 22 bp, Homo sapiens
gacggcctgatgctccctcccc

SEQ ID NO: 4883509 - DNA, 14 bp, Homo sapiens
gacggttttttatt

SEQ ID NO: 4883510 - DNA, 19 bp, Homo sapiens
gacggttttttattattgt

SEQ ID NO: 4883511 - DNA, 20 bp, Homo sapiens
gacgtggagcggggtatgaa

SEQ ID NO: 4883512 - DNA, 12 bp, Homo sapiens
gacgtttctcat

SEQ ID NO: 4883513 - DNA, 22 bp, Homo sapiens
gactaaccccaacgcacaggaa

SEQ ID NO: 4883514 - DNA, 22 bp, Homo sapiens
gactaatttcaaaatgcttttt

SEQ ID NO: 4883515 - DNA, 16 bp, Homo sapiens
gactagacgttcattt

SEQ ID NO: 4883516 - DNA, 16 bp, Homo sapiens
gactagatgatggatg

SEQ ID NO: 4883517 - DNA, 21 bp, Homo sapiens
gactagatgatggatgccaat

SEQ ID NO: 4883518 - DNA, 19 bp, Homo sapiens
gactagggattcaggctgc

SEQ ID NO: 4883519 - DNA, 13 bp, Homo sapiens
gactagtacaaat

SEQ ID NO: 4883520 - DNA, 16 bp, Homo sapiens
gactatatacatgtgt

SEQ ID NO: 4883521 - DNA, 21 bp, Homo sapiens
gactatatacatgtgtgtata

SEQ ID NO: 4883522 - DNA, 20 bp, Homo sapiens
gactatgaacttctctcaga

SEQ ID NO: 4883523 - DNA, 12 bp, Homo sapiens
gactatggagcc

SEQ ID NO: 4883524 - DNA, 16 bp, Homo sapiens
gactatggagcctggc

SEQ ID NO: 4883525 - DNA, 23 bp, Homo sapiens
gactatttaaacttataaatcat

SEQ ID NO: 4883526 - DNA, 17 bp, Homo sapiens
gactcaaatgttctaag

SEQ ID NO: 4883527 - DNA, 19 bp, Homo sapiens
gactcacaggttggaagag

SEQ ID NO: 4883528 - DNA, 13 bp, Homo sapiens
gactcagccctga

SEQ ID NO: 4883529 - DNA, 22 bp, Homo sapiens
gactcaggatttaaaaactgga

SEQ ID NO: 4883530 - DNA, 17 bp, Homo sapiens
gactcccatgaagcctt

SEQ ID NO: 4883531 - DNA, 18 bp, Homo sapiens
gactcctacctgccctgg

SEQ ID NO: 4883532 - DNA, 11 bp, Homo sapiens
gactcctctgt

SEQ ID NO: 4883533 - DNA, 15 bp, Homo sapiens
gactcgcttgtaaat

SEQ ID NO: 4883534 - DNA, 19 bp, Homo sapiens
gactcgcttgtaaatacca

SEQ ID NO: 4883535 - DNA, 14 bp, Homo sapiens
gactctaaagacca

SEQ ID NO: 4883536 - DNA, 17 bp, Homo sapiens
gactctaaagaccaaac

SEQ ID NO: 4883537 - DNA, 23 bp, Homo sapiens
gactctaaattctttatttctgt

SEQ ID NO: 4883538 - DNA, 15 bp, Homo sapiens
gactctacagaggcc

SEQ ID NO: 4883539 - DNA, 19 bp, Homo sapiens
gactctagagtccaaggtt

SEQ ID NO: 4883540 - DNA, 19 bp, Homo sapiens
gactctcagcccagaagaa

SEQ ID NO: 4883541 - DNA, 17 bp, Homo sapiens
gactctgaagcctctgg

SEQ ID NO: 4883542 - DNA, 20 bp, Homo sapiens
gactctgcacatgtcttgta

SEQ ID NO: 4883543 - DNA, 21 bp, Homo sapiens
gactctgcatcccagcacctg

SEQ ID NO: 4883544 - DNA, 10 bp, Homo sapiens
gactctgccc

SEQ ID NO: 4883545 - DNA, 12 bp, Homo sapiens
gactctgccccc

SEQ ID NO: 4883546 - DNA, 14 bp, Homo sapiens
gactctgccccctg

SEQ ID NO: 4883547 - DNA, 18 bp, Homo sapiens
gactctgccccctgctgg

SEQ ID NO: 4883548 - DNA, 22 bp, Homo sapiens
gactctgccccctgctggctct

SEQ ID NO: 4883549 - DNA, 19 bp, Homo sapiens
gactctgggctatggacac

SEQ ID NO: 4883550 - DNA, 12 bp, Homo sapiens
gactctgtctca

SEQ ID NO: 4883551 - DNA, 20 bp, Homo sapiens
gactctttttagggccaggc

SEQ ID NO: 4883552 - DNA, 18 bp, Homo sapiens
gactgaagatgcagctca

SEQ ID NO: 4883553 - DNA, 21 bp, Homo sapiens
gactgacagcatgtgccctcc

SEQ ID NO: 4883554 - DNA, 16 bp, Homo sapiens
gactgattctgggatg

SEQ ID NO: 4883555 - DNA, 15 bp, Homo sapiens
gactgcacagcggcc

SEQ ID NO: 4883556 - DNA, 18 bp, Homo sapiens
gactgcacagcggcccct

SEQ ID NO: 4883557 - DNA, 23 bp, Homo sapiens
gactgcatgtaccatttgcatgg

SEQ ID NO: 4883558 - DNA, 12 bp, Homo sapiens
gactgcctctgc

SEQ ID NO: 4883559 - DNA, 13 bp, Homo sapiens
gactgcctctgcc

SEQ ID NO: 4883560 - DNA, 15 bp, Homo sapiens
gactgcctctgccac

SEQ ID NO: 4883561 - DNA, 21 bp, Homo sapiens
gactgcctctgccacactctg

SEQ ID NO: 4883562 - DNA, 14 bp, Homo sapiens
gactgcgttctgca

SEQ ID NO: 4883563 - DNA, 15 bp, Homo sapiens
gactgcgttctgcaa

SEQ ID NO: 4883564 - DNA, 20 bp, Homo sapiens
gactgctccccagccctggc

SEQ ID NO: 4883565 - DNA, 16 bp, Homo sapiens
gactgctgctgcctgg

SEQ ID NO: 4883566 - DNA, 21 bp, Homo sapiens
gactggaagctaatttgcatt

SEQ ID NO: 4883567 - DNA, 21 bp, Homo sapiens
gactggaagttcatacctaag

SEQ ID NO: 4883568 - DNA, 22 bp, Homo sapiens
gactggcccctgggtcagtctg

SEQ ID NO: 4883569 - DNA, 17 bp, Homo sapiens
gactggggatgtgggag

SEQ ID NO: 4883570 - DNA, 14 bp, Homo sapiens
gactgggggccaga

SEQ ID NO: 4883571 - DNA, 15 bp, Homo sapiens
gactggggtgggagg

SEQ ID NO: 4883572 - DNA, 23 bp, Homo sapiens
gactgggtctcgctttgttgccc

SEQ ID NO: 4883573 - DNA, 15 bp, Homo sapiens
gactggtcctgtgtg

SEQ ID NO: 4883574 - DNA, 15 bp, Homo sapiens
gactgtatctgtgta

SEQ ID NO: 4883575 - DNA, 22 bp, Homo sapiens
gactgtctcaagagggcactgg

SEQ ID NO: 4883576 - DNA, 23 bp, Homo sapiens
gactgtctcaagagggcactggt

SEQ ID NO: 4883577 - DNA, 19 bp, Homo sapiens
gactgttttctctcggctc

SEQ ID NO: 4883578 - DNA, 21 bp, Homo sapiens
gactgttttctctcggctccc

SEQ ID NO: 4883579 - DNA, 20 bp, Homo sapiens
gacttaagcaaaagaaaaag

SEQ ID NO: 4883580 - DNA, 23 bp, Homo sapiens
gacttaatgtgattactgctcta

SEQ ID NO: 4883581 - DNA, 12 bp, Homo sapiens
gacttactctaa

SEQ ID NO: 4883582 - DNA, 18 bp, Homo sapiens
gacttagaaagcaggggc

SEQ ID NO: 4883583 - DNA, 18 bp, Homo sapiens
gacttatagtacatgata

SEQ ID NO: 4883584 - DNA, 15 bp, Homo sapiens
gacttattacaattt

SEQ ID NO: 4883585 - DNA, 14 bp, Homo sapiens
gacttcacttatta

SEQ ID NO: 4883586 - DNA, 14 bp, Homo sapiens
gacttcagctctgt

SEQ ID NO: 4883587 - DNA, 19 bp, Homo sapiens
gacttctaatatcattcac

SEQ ID NO: 4883588 - DNA, 21 bp, Homo sapiens
gacttgccagagccgggcaca

SEQ ID NO: 4883589 - DNA, 19 bp, Homo sapiens
gacttggcaacagaagcag

SEQ ID NO: 4883590 - DNA, 20 bp, Homo sapiens
gacttgggtctcatttagaa

SEQ ID NO: 4883591 - DNA, 18 bp, Homo sapiens
gacttgtagcatattctt

SEQ ID NO: 4883592 - DNA, 16 bp, Homo sapiens
gacttgtgtctctgtg

SEQ ID NO: 4883593 - DNA, 22 bp, Homo sapiens
gacttgtttgtcttccattcca

SEQ ID NO: 4883594 - DNA, 17 bp, Homo sapiens
gactttcagtaaacata

SEQ ID NO: 4883595 - DNA, 11 bp, Homo sapiens
gactttctgtt

SEQ ID NO: 4883596 - DNA, 13 bp, Homo sapiens
gactttctgttgg

SEQ ID NO: 4883597 - DNA, 21 bp, Homo sapiens
gactttgctgatttcccctct

SEQ ID NO: 4883598 - DNA, 20 bp, Homo sapiens
gacttttgtacatctggctt

SEQ ID NO: 4883599 - DNA, 18 bp, Homo sapiens
gacttttttctagtacac

SEQ ID NO: 4883600 - DNA, 16 bp, Homo sapiens
gagaaaaaaaaaatag

SEQ ID NO: 4883601 - DNA, 13 bp, Homo sapiens
gagaaaaaaacaa

SEQ ID NO: 4883602 - DNA, 17 bp, Homo sapiens
gagaaaaagctcctgtc

SEQ ID NO: 4883603 - DNA, 19 bp, Homo sapiens
gagaaaaagctcctgtcct

SEQ ID NO: 4883604 - DNA, 18 bp, Homo sapiens
gagaaaagcacacttgta

SEQ ID NO: 4883605 - DNA, 13 bp, Homo sapiens
gagaaacaaactt

SEQ ID NO: 4883606 - DNA, 15 bp, Homo sapiens
gagaaacaaactttt

SEQ ID NO: 4883607 - DNA, 17 bp, Homo sapiens
gagaaacaataaagaga

SEQ ID NO: 4883608 - DNA, 15 bp, Homo sapiens
gagaaagccaggcag

SEQ ID NO: 4883609 - DNA, 20 bp, Homo sapiens
gagaaatatggacacttaat

SEQ ID NO: 4883610 - DNA, 16 bp, Homo sapiens
gagaaattctgttaaa

SEQ ID NO: 4883611 - DNA, 17 bp, Homo sapiens
gagaaattctgttaaaa

SEQ ID NO: 4883612 - DNA, 22 bp, Homo sapiens
gagaaattctgttaaaatctat

SEQ ID NO: 4883613 - DNA, 23 bp, Homo sapiens
gagaaatttctgtgaaacctgtg

SEQ ID NO: 4883614 - DNA, 12 bp, Homo sapiens
gagaacaaagct

SEQ ID NO: 4883615 - DNA, 14 bp, Homo sapiens
gagaacaaagctgt

SEQ ID NO: 4883616 - DNA, 15 bp, Homo sapiens
gagaacaaagctgtt

SEQ ID NO: 4883617 - DNA, 20 bp, Homo sapiens
gagaaccgagcaaagatcaa

SEQ ID NO: 4883618 - DNA, 13 bp, Homo sapiens
gagaacgcagccc

SEQ ID NO: 4883619 - DNA, 14 bp, Homo sapiens
gagaacgcagccct

SEQ ID NO: 4883620 - DNA, 15 bp, Homo sapiens
gagaacgcagcccta

SEQ ID NO: 4883621 - DNA, 13 bp, Homo sapiens
gagaactcctgac

SEQ ID NO: 4883622 - DNA, 11 bp, Homo sapiens
gagaagaagaa

SEQ ID NO: 4883623 - DNA, 12 bp, Homo sapiens
gagaagagagga

SEQ ID NO: 4883624 - DNA, 18 bp, Homo sapiens
gagaagccttcagctcca

SEQ ID NO: 4883625 - DNA, 17 bp, Homo sapiens
gagaagctgctgaccaa

SEQ ID NO: 4883626 - DNA, 18 bp, Homo sapiens
gagaagctgctgaccaat

SEQ ID NO: 4883627 - DNA, 23 bp, Homo sapiens
gagaaggacccggaggggcctgg

SEQ ID NO: 4883628 - DNA, 12 bp, Homo sapiens
gagaaggagaga

SEQ ID NO: 4883629 - DNA, 15 bp, Homo sapiens
gagaaggagagaaag

SEQ ID NO: 4883630 - DNA, 20 bp, Homo sapiens
gagaagggataaccctacac

SEQ ID NO: 4883631 - DNA, 15 bp, Homo sapiens
gagaatctatattta

SEQ ID NO: 4883632 - DNA, 22 bp, Homo sapiens
gagaatctatatttaacaagat

SEQ ID NO: 4883633 - DNA, 14 bp, Homo sapiens
cttctcctttcaca

SEQ ID NO: 4883634 - DNA, 15 bp, Homo sapiens
cttctctgaacacag

SEQ ID NO: 4883635 - DNA, 19 bp, Homo sapiens
cttctctgaacacaggcag

SEQ ID NO: 4883636 - DNA, 22 bp, Homo sapiens
cttctctgaacacaggcagctt

SEQ ID NO: 4883637 - DNA, 23 bp, Homo sapiens
cttctctgaacacaggcagcttt

SEQ ID NO: 4883638 - DNA, 19 bp, Homo sapiens
cttctctgcctttgacatt

SEQ ID NO: 4883639 - DNA, 13 bp, Homo sapiens
cttctctgctcca

SEQ ID NO: 4883640 - DNA, 16 bp, Homo sapiens
cttctctgctccacca

SEQ ID NO: 4883641 - DNA, 22 bp, Homo sapiens
cttctctgctccaccacatcct

SEQ ID NO: 4883642 - DNA, 13 bp, Homo sapiens
cttctcttgcttt

SEQ ID NO: 4883643 - DNA, 23 bp, Homo sapiens
cttctgaaatgaaacaaataatc

SEQ ID NO: 4883644 - DNA, 16 bp, Homo sapiens
cttctgacaaactgtg

SEQ ID NO: 4883645 - DNA, 22 bp, Homo sapiens
cttctgaccttttggtgaaagc

SEQ ID NO: 4883646 - DNA, 16 bp, Homo sapiens
cttctgacggccctgc

SEQ ID NO: 4883647 - DNA, 19 bp, Homo sapiens
cttctgacggccctgcaat

SEQ ID NO: 4883648 - DNA, 13 bp, Homo sapiens
cttctgactgctg

SEQ ID NO: 4883649 - DNA, 12 bp, Homo sapiens
cttctgctccac

SEQ ID NO: 4883650 - DNA, 14 bp, Homo sapiens
cttctgctccaccc

SEQ ID NO: 4883651 - DNA, 21 bp, Homo sapiens
cttctgctccacccttggcct

SEQ ID NO: 4883652 - DNA, 13 bp, Homo sapiens
cttctgcttcagc

SEQ ID NO: 4883653 - DNA, 17 bp, Homo sapiens
cttctgcttcagcctcc

SEQ ID NO: 4883654 - DNA, 16 bp, Homo sapiens
cttctggaatttgttc

SEQ ID NO: 4883655 - DNA, 15 bp, Homo sapiens
cttctggacaggctc

SEQ ID NO: 4883656 - DNA, 12 bp, Homo sapiens
cttctggctcaa

SEQ ID NO: 4883657 - DNA, 14 bp, Homo sapiens
cttctggcttcctt

SEQ ID NO: 4883658 - DNA, 17 bp, Homo sapiens
cttctgggagcaggaac

SEQ ID NO: 4883659 - DNA, 19 bp, Homo sapiens
cttctggggcaggctgggc

SEQ ID NO: 4883660 - DNA, 19 bp, Homo sapiens
cttctggtttaaacttgtt

SEQ ID NO: 4883661 - DNA, 15 bp, Homo sapiens
cttctgtacgtctga

SEQ ID NO: 4883662 - DNA, 21 bp, Homo sapiens
cttctgtacgtctgacaggca

SEQ ID NO: 4883663 - DNA, 16 bp, Homo sapiens
cttctgtcctactctg

SEQ ID NO: 4883664 - DNA, 18 bp, Homo sapiens
cttctgtcctactctgtg

SEQ ID NO: 4883665 - DNA, 19 bp, Homo sapiens
cttctgtcctactctgtgt

SEQ ID NO: 4883666 - DNA, 19 bp, Homo sapiens
cttctgtgagacccccaca

SEQ ID NO: 4883667 - DNA, 15 bp, Homo sapiens
cttctgtgatgagct

SEQ ID NO: 4883668 - DNA, 16 bp, Homo sapiens
cttctgtgatgagctg

SEQ ID NO: 4883669 - DNA, 14 bp, Homo sapiens
cttctgttctgcag

SEQ ID NO: 4883670 - DNA, 22 bp, Homo sapiens
cttcttaaatatcttttatgtt

SEQ ID NO: 4883671 - DNA, 14 bp, Homo sapiens
cttcttccatccca

SEQ ID NO: 4883672 - DNA, 21 bp, Homo sapiens
cttcttgggggtaagctgatt

SEQ ID NO: 4883673 - DNA, 16 bp, Homo sapiens
cttcttgtcagacata

SEQ ID NO: 4883674 - DNA, 19 bp, Homo sapiens
cttcttgtcagacataaag

SEQ ID NO: 4883675 - DNA, 23 bp, Homo sapiens
cttctttctctcagccttacatt

SEQ ID NO: 4883676 - DNA, 14 bp, Homo sapiens
cttctttgaagaag

SEQ ID NO: 4883677 - DNA, 13 bp, Homo sapiens
cttcttttgatta

SEQ ID NO: 4883678 - DNA, 14 bp, Homo sapiens
cttcttttgattat

SEQ ID NO: 4883679 - DNA, 17 bp, Homo sapiens
cttctttttttgtgatg

SEQ ID NO: 4883680 - DNA, 16 bp, Homo sapiens
cttgaaaataagaata

SEQ ID NO: 4883681 - DNA, 22 bp, Homo sapiens
cttgaaaataagaatagaaata

SEQ ID NO: 4883682 - DNA, 17 bp, Homo sapiens
cttgaaagaattttcct

SEQ ID NO: 4883683 - DNA, 21 bp, Homo sapiens
cttgaaattatatctgtggtc

SEQ ID NO: 4883684 - DNA, 24 bp, Homo sapiens
cttgaaattatatctgtggtcttc

SEQ ID NO: 4883685 - DNA, 19 bp, Homo sapiens
cttgaaattttaaactata

SEQ ID NO: 4883686 - DNA, 14 bp, Homo sapiens
cttgaacaaaaggg

SEQ ID NO: 4883687 - DNA, 18 bp, Homo sapiens
cttgaacaaaatctgttg

SEQ ID NO: 4883688 - DNA, 15 bp, Homo sapiens
cttgaactcctggcc

SEQ ID NO: 4883689 - DNA, 18 bp, Homo sapiens
cttgaactgggtacttgt

SEQ ID NO: 4883690 - DNA, 20 bp, Homo sapiens
cttgaactgggtacttgtgg

SEQ ID NO: 4883691 - DNA, 11 bp, Homo sapiens
cttgaagctgt

SEQ ID NO: 4883692 - DNA, 14 bp, Homo sapiens
cttgaatgctgcca

SEQ ID NO: 4883693 - DNA, 20 bp, Homo sapiens
cttgaatgtggcttgagaaa

SEQ ID NO: 4883694 - DNA, 20 bp, Homo sapiens
cttgaatttctaaaaaacag

SEQ ID NO: 4883695 - DNA, 19 bp, Homo sapiens
cttgacaaaacctaacttg

SEQ ID NO: 4883696 - DNA, 14 bp, Homo sapiens
cttgacagggcaca

SEQ ID NO: 4883697 - DNA, 20 bp, Homo sapiens
cttgacagggcacaccgggc

SEQ ID NO: 4883698 - DNA, 13 bp, Homo sapiens
cttgacctcaggt

SEQ ID NO: 4883699 - DNA, 17 bp, Homo sapiens
cttgaccttcctctggg

SEQ ID NO: 4883700 - DNA, 21 bp, Homo sapiens
cttgaccttcctctggggctc

SEQ ID NO: 4883701 - DNA, 17 bp, Homo sapiens
cttgacttgattagtgc

SEQ ID NO: 4883702 - DNA, 22 bp, Homo sapiens
cttgagaaatatggacacttaa

SEQ ID NO: 4883703 - DNA, 17 bp, Homo sapiens
cttgagacacggagccc

SEQ ID NO: 4883704 - DNA, 22 bp, Homo sapiens
cttgagacacggagcccagccc

SEQ ID NO: 4883705 - DNA, 22 bp, Homo sapiens
cttgagagtatcaggtctccca

SEQ ID NO: 4883706 - DNA, 21 bp, Homo sapiens
cttgagatgtatgaaggcttt

SEQ ID NO: 4883707 - DNA, 22 bp, Homo sapiens
cttgagatgtatgaaggctttt

SEQ ID NO: 4883708 - DNA, 14 bp, Homo sapiens
cttgagctggcctc

SEQ ID NO: 4883709 - DNA, 17 bp, Homo sapiens
cttgagggcccagagca

SEQ ID NO: 4883710 - DNA, 20 bp, Homo sapiens
cttgagggttgggctggtgt

SEQ ID NO: 4883711 - DNA, 23 bp, Homo sapiens
cttgagtggggttatctctgtgt

SEQ ID NO: 4883712 - DNA, 19 bp, Homo sapiens
cttgatacccccctctgtc

SEQ ID NO: 4883713 - DNA, 20 bp, Homo sapiens
cttgatacccccctctgtct

SEQ ID NO: 4883714 - DNA, 23 bp, Homo sapiens
cttgatactaaaagttcttctcc

SEQ ID NO: 4883715 - DNA, 23 bp, Homo sapiens
cttgatgccatatgccttgggga

SEQ ID NO: 4883716 - DNA, 15 bp, Homo sapiens
cttgattaagatttt

SEQ ID NO: 4883717 - DNA, 18 bp, Homo sapiens
cttgattaagattttaca

SEQ ID NO: 4883718 - DNA, 17 bp, Homo sapiens
cttgattctgcagtaaa

SEQ ID NO: 4883719 - DNA, 20 bp, Homo sapiens
cttgattctgcagtaaatct

SEQ ID NO: 4883720 - DNA, 18 bp, Homo sapiens
cttgatttaaacacacag

SEQ ID NO: 4883721 - DNA, 19 bp, Homo sapiens
cttgatttaaacacacaga

SEQ ID NO: 4883722 - DNA, 14 bp, Homo sapiens
cttgcaatggcagc

SEQ ID NO: 4883723 - DNA, 18 bp, Homo sapiens
cttgcacccctcactctg

SEQ ID NO: 4883724 - DNA, 21 bp, Homo sapiens
cttgcactaaagtatgtaaag

SEQ ID NO: 4883725 - DNA, 18 bp, Homo sapiens
cttgcagaactgccatta

SEQ ID NO: 4883726 - DNA, 20 bp, Homo sapiens
cttgcagactctacagaggc

SEQ ID NO: 4883727 - DNA, 15 bp, Homo sapiens
cttgcagtcatcaga

SEQ ID NO: 4883728 - DNA, 15 bp, Homo sapiens
cttgcatccttccta

SEQ ID NO: 4883729 - DNA, 17 bp, Homo sapiens
cttgcatccttcctata

SEQ ID NO: 4883730 - DNA, 20 bp, Homo sapiens
cttgcatccttcctataact

SEQ ID NO: 4883731 - DNA, 21 bp, Homo sapiens
cttgccaccccaccctccctg

SEQ ID NO: 4883732 - DNA, 15 bp, Homo sapiens
cttgccactgcctct

SEQ ID NO: 4883733 - DNA, 15 bp, Homo sapiens
cttgccactttgcac

SEQ ID NO: 4883734 - DNA, 13 bp, Homo sapiens
cttgccgaggagc

SEQ ID NO: 4883735 - DNA, 22 bp, Homo sapiens
cttgcctaaatttaatgctgcc

SEQ ID NO: 4883736 - DNA, 14 bp, Homo sapiens
cttgcgaataacag

SEQ ID NO: 4883737 - DNA, 16 bp, Homo sapiens
cttgcgaatccaagct

SEQ ID NO: 4883738 - DNA, 20 bp, Homo sapiens
cttgctagctatgtgacctt

SEQ ID NO: 4883739 - DNA, 15 bp, Homo sapiens
cttgctccctgtgtc

SEQ ID NO: 4883740 - DNA, 20 bp, Homo sapiens
cttgctccctgtgtccacct

SEQ ID NO: 4883741 - DNA, 17 bp, Homo sapiens
cttgctcccttcagccc

SEQ ID NO: 4883742 - DNA, 22 bp, Homo sapiens
ctttatgaatgaaaaaacagtc

SEQ ID NO: 4883743 - DNA, 21 bp, Homo sapiens
ctttatgattttcataactta

SEQ ID NO: 4883744 - DNA, 22 bp, Homo sapiens
ctttatggtcctaaaagcaaaa

SEQ ID NO: 4883745 - DNA, 20 bp, Homo sapiens
ctttatgttcatttgtttgt

SEQ ID NO: 4883746 - DNA, 12 bp, Homo sapiens
ctttattattat

SEQ ID NO: 4883747 - DNA, 18 bp, Homo sapiens
ctttattgcttttttgta

SEQ ID NO: 4883748 - DNA, 13 bp, Homo sapiens
ctttcaaatcggt

SEQ ID NO: 4883749 - DNA, 20 bp, Homo sapiens
ctttcacaacatttgcagat

SEQ ID NO: 4883750 - DNA, 13 bp, Homo sapiens
ctttcacagctcc

SEQ ID NO: 4883751 - DNA, 15 bp, Homo sapiens
ctttcacagctcctc

SEQ ID NO: 4883752 - DNA, 18 bp, Homo sapiens
ctttcacagctcctccca

SEQ ID NO: 4883753 - DNA, 22 bp, Homo sapiens
ctttcacattgtttgctgctat

SEQ ID NO: 4883754 - DNA, 17 bp, Homo sapiens
ctttcatcctgactctg

SEQ ID NO: 4883755 - DNA, 20 bp, Homo sapiens
ctttcatcctgactctgccc

SEQ ID NO: 4883756 - DNA, 16 bp, Homo sapiens
ctttcatccttgacta

SEQ ID NO: 4883757 - DNA, 11 bp, Homo sapiens
ctttcccaagc

SEQ ID NO: 4883758 - DNA, 22 bp, Homo sapiens
ctttcccaccccacgccttatc

SEQ ID NO: 4883759 - DNA, 20 bp, Homo sapiens
ctttcccagtgagtctctgg

SEQ ID NO: 4883760 - DNA, 14 bp, Homo sapiens
ctttccccagccca

SEQ ID NO: 4883761 - DNA, 17 bp, Homo sapiens
ctttccccagcccaggg

SEQ ID NO: 4883762 - DNA, 22 bp, Homo sapiens
ctttcccttgcttttccctctt

SEQ ID NO: 4883763 - DNA, 15 bp, Homo sapiens
ctttccttccatccc

SEQ ID NO: 4883764 - DNA, 17 bp, Homo sapiens
ctttccttgtggcagag

SEQ ID NO: 4883765 - DNA, 19 bp, Homo sapiens
ctttccttgtggcagagga

SEQ ID NO: 4883766 - DNA, 16 bp, Homo sapiens
ctttcctttccccagc

SEQ ID NO: 4883767 - DNA, 19 bp, Homo sapiens
ctttcgatacccaggacca

SEQ ID NO: 4883768 - DNA, 15 bp, Homo sapiens
ctttctattccaaag

SEQ ID NO: 4883769 - DNA, 17 bp, Homo sapiens
ctttctatttgacttgt

SEQ ID NO: 4883770 - DNA, 15 bp, Homo sapiens
ctttctccaaagtta

SEQ ID NO: 4883771 - DNA, 20 bp, Homo sapiens
ctttctccaaagttatccag

SEQ ID NO: 4883772 - DNA, 15 bp, Homo sapiens
ctttctccttgaata

SEQ ID NO: 4883773 - DNA, 21 bp, Homo sapiens
ctttctctcagccttacattt

SEQ ID NO: 4883774 - DNA, 22 bp, Homo sapiens
ctttctctcagccttacatttg

SEQ ID NO: 4883775 - DNA, 13 bp, Homo sapiens
ctttctctcttcc

SEQ ID NO: 4883776 - DNA, 15 bp, Homo sapiens
ctttctctcttccct

SEQ ID NO: 4883777 - DNA, 19 bp, Homo sapiens
ctttctcttttctcttttt

SEQ ID NO: 4883778 - DNA, 20 bp, Homo sapiens
ctttctgagcacactttagt

SEQ ID NO: 4883779 - DNA, 21 bp, Homo sapiens
ctttctgagcacactttagtg

SEQ ID NO: 4883780 - DNA, 20 bp, Homo sapiens
ctttctgtatatactttttt

SEQ ID NO: 4883781 - DNA, 12 bp, Homo sapiens
ctttctgtgtgc

SEQ ID NO: 4883782 - DNA, 21 bp, Homo sapiens
ctttctgtgtgcaccttacca

SEQ ID NO: 4883783 - DNA, 12 bp, Homo sapiens
ctttcttcctct

SEQ ID NO: 4883784 - DNA, 14 bp, Homo sapiens
ctttcttcctctgc

SEQ ID NO: 4883785 - DNA, 12 bp, Homo sapiens
ctttcttccttt

SEQ ID NO: 4883786 - DNA, 20 bp, Homo sapiens
ctttcttgctcccttcagcc

SEQ ID NO: 4883787 - DNA, 18 bp, Homo sapiens
ctttcttttgattcttcc

SEQ ID NO: 4883788 - DNA, 16 bp, Homo sapiens
ctttctttttttcccc

SEQ ID NO: 4883789 - DNA, 19 bp, Homo sapiens
ctttgaaacctgctctgta

SEQ ID NO: 4883790 - DNA, 13 bp, Homo sapiens
ctttgaaatacct

SEQ ID NO: 4883791 - DNA, 17 bp, Homo sapiens
ctttgaagctgaaaata

SEQ ID NO: 4883792 - DNA, 18 bp, Homo sapiens
ctttgaaggggcctcacc

SEQ ID NO: 4883793 - DNA, 13 bp, Homo sapiens
ctttgaatgcttt

SEQ ID NO: 4883794 - DNA, 14 bp, Homo sapiens
ctttgacactctgc

SEQ ID NO: 4883795 - DNA, 15 bp, Homo sapiens
ctttgagaagccttc

SEQ ID NO: 4883796 - DNA, 15 bp, Homo sapiens
ctttgagacagtttc

SEQ ID NO: 4883797 - DNA, 18 bp, Homo sapiens
ctttgagacagtttctta

SEQ ID NO: 4883798 - DNA, 13 bp, Homo sapiens
ctttgagggactg

SEQ ID NO: 4883799 - DNA, 18 bp, Homo sapiens
ctttgagggactgcctct

SEQ ID NO: 4883800 - DNA, 19 bp, Homo sapiens
ctttgagggactgcctctg

SEQ ID NO: 4883801 - DNA, 20 bp, Homo sapiens
ctttgagtcccccagagatg

SEQ ID NO: 4883802 - DNA, 22 bp, Homo sapiens
ctttgataatgttaaatttgta

SEQ ID NO: 4883803 - DNA, 19 bp, Homo sapiens
ctttgattcatagtaactt

SEQ ID NO: 4883804 - DNA, 21 bp, Homo sapiens
ctttgattcatagtaacttct

SEQ ID NO: 4883805 - DNA, 12 bp, Homo sapiens
ctttgatttcca

SEQ ID NO: 4883806 - DNA, 20 bp, Homo sapiens
ctttgatttccaagtaatat

SEQ ID NO: 4883807 - DNA, 23 bp, Homo sapiens
ctttgcacgacgccctctcccca

SEQ ID NO: 4883808 - DNA, 14 bp, Homo sapiens
ctttgcagggcagc

SEQ ID NO: 4883809 - DNA, 17 bp, Homo sapiens
ctttgcagggcagcccc

SEQ ID NO: 4883810 - DNA, 18 bp, Homo sapiens
ctttgcagggcagcccca

SEQ ID NO: 4883811 - DNA, 19 bp, Homo sapiens
ctttgccttgggctgctcc

SEQ ID NO: 4883812 - DNA, 19 bp, Homo sapiens
ctttgctgatttcccctct

SEQ ID NO: 4883813 - DNA, 19 bp, Homo sapiens
ctttggctattagagatca

SEQ ID NO: 4883814 - DNA, 15 bp, Homo sapiens
ctttggctcccctgt

SEQ ID NO: 4883815 - DNA, 13 bp, Homo sapiens
ctttggctctgga

SEQ ID NO: 4883816 - DNA, 15 bp, Homo sapiens
ctttggctctggaga

SEQ ID NO: 4883817 - DNA, 19 bp, Homo sapiens
ctttgggctgccctggtgc

SEQ ID NO: 4883818 - DNA, 17 bp, Homo sapiens
ctttggggtctacactg

SEQ ID NO: 4883819 - DNA, 22 bp, Homo sapiens
ctttgggttaagcattaccact

SEQ ID NO: 4883820 - DNA, 23 bp, Homo sapiens
ctttggtgccaactggtgtttga

SEQ ID NO: 4883821 - DNA, 14 bp, Homo sapiens
ctttggttctaagg

SEQ ID NO: 4883822 - DNA, 16 bp, Homo sapiens
ctttggttctaaggac

SEQ ID NO: 4883823 - DNA, 18 bp, Homo sapiens
ctttgtaagagtgtagaa

SEQ ID NO: 4883824 - DNA, 19 bp, Homo sapiens
ctttgtaagagtgtagaag

SEQ ID NO: 4883825 - DNA, 20 bp, Homo sapiens
ctttgtaagagtgtagaagc

SEQ ID NO: 4883826 - DNA, 21 bp, Homo sapiens
ctttgtaagagtgtagaagca

SEQ ID NO: 4883827 - DNA, 15 bp, Homo sapiens
ctttgtctgaaaaat

SEQ ID NO: 4883828 - DNA, 18 bp, Homo sapiens
ctttgtgataatttaaga

SEQ ID NO: 4883829 - DNA, 16 bp, Homo sapiens
ctttgtggggcttggc

SEQ ID NO: 4883830 - DNA, 15 bp, Homo sapiens
ctttgtgttgtaatt

SEQ ID NO: 4883831 - DNA, 17 bp, Homo sapiens
ctttgtgttgtaattct

SEQ ID NO: 4883832 - DNA, 22 bp, Homo sapiens
ctttgtgttgtaattcttcagt

SEQ ID NO: 4883833 - DNA, 23 bp, Homo sapiens
ctttgtgtttctattgacttcaa

SEQ ID NO: 4883834 - DNA, 18 bp, Homo sapiens
ctttgtgtttggtttaca

SEQ ID NO: 4883835 - DNA, 20 bp, Homo sapiens
ctttgtgtttggtttacatt

SEQ ID NO: 4883836 - DNA, 21 bp, Homo sapiens
ctttgtgtttggtttacattt

SEQ ID NO: 4883837 - DNA, 17 bp, Homo sapiens
ctttgtttcaaccaagt

SEQ ID NO: 4883838 - DNA, 15 bp, Homo sapiens
ctttgtttcttgttt

SEQ ID NO: 4883839 - DNA, 17 bp, Homo sapiens
ctttgtttcttgtttat

SEQ ID NO: 4883840 - DNA, 20 bp, Homo sapiens
ctttgtttggatgtaattta

SEQ ID NO: 4883841 - DNA, 23 bp, Homo sapiens
ctttgttttgatgtttgtggcct

SEQ ID NO: 4883842 - DNA, 24 bp, Homo sapiens
ctttgttttgatgtttgtggcctc

SEQ ID NO: 4883843 - DNA, 20 bp, Homo sapiens
cttttaaagtgttacttttt

SEQ ID NO: 4883844 - DNA, 19 bp, Homo sapiens
cttttaaagtgtttcagct

SEQ ID NO: 4883845 - DNA, 17 bp, Homo sapiens
cttttaaccatctgata

SEQ ID NO: 4883846 - DNA, 18 bp, Homo sapiens
cttttaaccatctgatat

SEQ ID NO: 4883847 - DNA, 14 bp, Homo sapiens
cttttaacttcttt

SEQ ID NO: 4883848 - DNA, 15 bp, Homo sapiens
cttttaacttctttc

SEQ ID NO: 4883849 - DNA, 15 bp, Homo sapiens
cttttaatgcttcat

SEQ ID NO: 4883850 - DNA, 17 bp, Homo sapiens
cttttaatgcttcattc

SEQ ID NO: 4883851 - DNA, 23 bp, Homo sapiens
gaagaaggtggaccttttaaagt

SEQ ID NO: 4883852 - DNA, 16 bp, Homo sapiens
gaagaatggagaggaa

SEQ ID NO: 4883853 - DNA, 20 bp, Homo sapiens
gaagacaaaaagacaaacat

SEQ ID NO: 4883854 - DNA, 20 bp, Homo sapiens
gaagacaatttgatacataa

SEQ ID NO: 4883855 - DNA, 21 bp, Homo sapiens
gaagacacagactgcgatttg

SEQ ID NO: 4883856 - DNA, 17 bp, Homo sapiens
gaagacaccagagcaga

SEQ ID NO: 4883857 - DNA, 22 bp, Homo sapiens
gaagacaccagagcagatgcag

SEQ ID NO: 4883858 - DNA, 22 bp, Homo sapiens
gaagaccgtttacctagaagaa

SEQ ID NO: 4883859 - DNA, 20 bp, Homo sapiens
gaagacctcacctagaaatt

SEQ ID NO: 4883860 - DNA, 15 bp, Homo sapiens
gaagacgcctgagct

SEQ ID NO: 4883861 - DNA, 17 bp, Homo sapiens
gaagactcattcttctg

SEQ ID NO: 4883862 - DNA, 17 bp, Homo sapiens
gaagactggaagctaat

SEQ ID NO: 4883863 - DNA, 17 bp, Homo sapiens
gaagagaagctgctgac

SEQ ID NO: 4883864 - DNA, 21 bp, Homo sapiens
gaagagaggagaggagagagg

SEQ ID NO: 4883865 - DNA, 17 bp, Homo sapiens
gaagagcaaaaatatcc

SEQ ID NO: 4883866 - DNA, 22 bp, Homo sapiens
gaagagcaaaaatatcccttcc

SEQ ID NO: 4883867 - DNA, 20 bp, Homo sapiens
gaagagcttgctttgattta

SEQ ID NO: 4883868 - DNA, 13 bp, Homo sapiens
gaagagtgtgtgt

SEQ ID NO: 4883869 - DNA, 14 bp, Homo sapiens
gaagagttgaggaa

SEQ ID NO: 4883870 - DNA, 21 bp, Homo sapiens
gaagagttgtgcacgcagatt

SEQ ID NO: 4883871 - DNA, 13 bp, Homo sapiens
gaagataattgtt

SEQ ID NO: 4883872 - DNA, 13 bp, Homo sapiens
gaagatgatcaga

SEQ ID NO: 4883873 - DNA, 16 bp, Homo sapiens
gaagatgatcagacct

SEQ ID NO: 4883874 - DNA, 24 bp, Homo sapiens
gaagatgcgagcgctatcttcaca

SEQ ID NO: 4883875 - DNA, 23 bp, Homo sapiens
gaagatgttgaagaatacagtta

SEQ ID NO: 4883876 - DNA, 16 bp, Homo sapiens
gaagattttcagtcta

SEQ ID NO: 4883877 - DNA, 22 bp, Homo sapiens
gaagcaacattttagctctatt

SEQ ID NO: 4883878 - DNA, 23 bp, Homo sapiens
gaagcaaggaagatatacatgaa

SEQ ID NO: 4883879 - DNA, 13 bp, Homo sapiens
gaagcagttgtgt

SEQ ID NO: 4883880 - DNA, 13 bp, Homo sapiens
gaagcatgtttca

SEQ ID NO: 4883881 - DNA, 16 bp, Homo sapiens
gaagcattcagagagc

SEQ ID NO: 4883882 - DNA, 17 bp, Homo sapiens
gaagcattcagagagca

SEQ ID NO: 4883883 - DNA, 15 bp, Homo sapiens
gaagcattccttctt

SEQ ID NO: 4883884 - DNA, 18 bp, Homo sapiens
gaagcattccttctttga

SEQ ID NO: 4883885 - DNA, 15 bp, Homo sapiens
gaagcattctcccca

SEQ ID NO: 4883886 - DNA, 15 bp, Homo sapiens
gaagcatttgtattt

SEQ ID NO: 4883887 - DNA, 16 bp, Homo sapiens
gaagcatttgtatttt

SEQ ID NO: 4883888 - DNA, 18 bp, Homo sapiens
gaagcatttgtattttgt

SEQ ID NO: 4883889 - DNA, 13 bp, Homo sapiens
gaagccctcccag

SEQ ID NO: 4883890 - DNA, 17 bp, Homo sapiens
gaagcctcagctaccca

SEQ ID NO: 4883891 - DNA, 12 bp, Homo sapiens
gaagcctctggc

SEQ ID NO: 4883892 - DNA, 13 bp, Homo sapiens
gaagcctctggga

SEQ ID NO: 4883893 - DNA, 15 bp, Homo sapiens
gaagccttcagctcc

SEQ ID NO: 4883894 - DNA, 17 bp, Homo sapiens
gaagccttcagctccag

SEQ ID NO: 4883895 - DNA, 13 bp, Homo sapiens
gaagctccactgt

SEQ ID NO: 4883896 - DNA, 16 bp, Homo sapiens
gaagctccactgtcac

SEQ ID NO: 4883897 - DNA, 19 bp, Homo sapiens
gaagctccgctttctaccc

SEQ ID NO: 4883898 - DNA, 13 bp, Homo sapiens
gaagctgcatcca

SEQ ID NO: 4883899 - DNA, 17 bp, Homo sapiens
gaagctggccgagggtc

SEQ ID NO: 4883900 - DNA, 15 bp, Homo sapiens
gaagctggcctgaga

SEQ ID NO: 4883901 - DNA, 19 bp, Homo sapiens
gaagctggcctgagagggg

SEQ ID NO: 4883902 - DNA, 16 bp, Homo sapiens
gaagctgttgtacatt

SEQ ID NO: 4883903 - DNA, 19 bp, Homo sapiens
gaagctgttgtacatttat

SEQ ID NO: 4883904 - DNA, 15 bp, Homo sapiens
gaagcttctaataaa

SEQ ID NO: 4883905 - DNA, 19 bp, Homo sapiens
gaagcttctaataaattat

SEQ ID NO: 4883906 - DNA, 14 bp, Homo sapiens
gaaggaaaatgata

SEQ ID NO: 4883907 - DNA, 22 bp, Homo sapiens
gaaggaagccaaatttatcaaa

SEQ ID NO: 4883908 - DNA, 16 bp, Homo sapiens
gaaggaagtgaagagg

SEQ ID NO: 4883909 - DNA, 22 bp, Homo sapiens
gaaggaataaattgctccttga

SEQ ID NO: 4883910 - DNA, 20 bp, Homo sapiens
gaaggacattgcggacagcc

SEQ ID NO: 4883911 - DNA, 16 bp, Homo sapiens
cccagctcgcgggacc

SEQ ID NO: 4883912 - DNA, 17 bp, Homo sapiens
cccagcttgtaggagct

SEQ ID NO: 4883913 - DNA, 15 bp, Homo sapiens
cccaggaactgggcc

SEQ ID NO: 4883914 - DNA, 21 bp, Homo sapiens
cccaggaagcccaggagggca

SEQ ID NO: 4883915 - DNA, 19 bp, Homo sapiens
cccaggacaccacacccag

SEQ ID NO: 4883916 - DNA, 23 bp, Homo sapiens
cccaggacaccacacccagcctc

SEQ ID NO: 4883917 - DNA, 20 bp, Homo sapiens
cccaggaccaagccacagca

SEQ ID NO: 4883918 - DNA, 13 bp, Homo sapiens
cccaggcaggtct

SEQ ID NO: 4883919 - DNA, 23 bp, Homo sapiens
cccaggccggccagcctcaccct

SEQ ID NO: 4883920 - DNA, 15 bp, Homo sapiens
cccaggcctgcctgt

SEQ ID NO: 4883921 - DNA, 13 bp, Homo sapiens
cccaggcgggagc

SEQ ID NO: 4883922 - DNA, 14 bp, Homo sapiens
cccaggctccgccc

SEQ ID NO: 4883923 - DNA, 19 bp, Homo sapiens
cccaggctggacatgctga

SEQ ID NO: 4883924 - DNA, 13 bp, Homo sapiens
cccaggctggcgt

SEQ ID NO: 4883925 - DNA, 21 bp, Homo sapiens
cccaggctggcgtgcagtggt

SEQ ID NO: 4883926 - DNA, 16 bp, Homo sapiens
cccaggctggtctcaa

SEQ ID NO: 4883927 - DNA, 13 bp, Homo sapiens
cccagggcaccct

SEQ ID NO: 4883928 - DNA, 18 bp, Homo sapiens
cccagggctctgccccag

SEQ ID NO: 4883929 - DNA, 15 bp, Homo sapiens
cccagggtcttccct

SEQ ID NO: 4883930 - DNA, 20 bp, Homo sapiens
cccccattctcatctgcacc

SEQ ID NO: 4883931 - DNA, 13 bp, Homo sapiens
cccccccatgcag

SEQ ID NO: 4883932 - DNA, 14 bp, Homo sapiens
cccccggccccctg

SEQ ID NO: 4883933 - DNA, 15 bp, Homo sapiens
cccccggccccctgg

SEQ ID NO: 4883934 - DNA, 19 bp, Homo sapiens
ccccctaaacccctgtccc

SEQ ID NO: 4883935 - DNA, 16 bp, Homo sapiens
ccccctctgtcttgtg

SEQ ID NO: 4883936 - DNA, 16 bp, Homo sapiens
ccccctgccccccagc

SEQ ID NO: 4883937 - DNA, 12 bp, Homo sapiens
ccccctgctggc

SEQ ID NO: 4883938 - DNA, 16 bp, Homo sapiens
ccccctggtctctggt

SEQ ID NO: 4883939 - DNA, 20 bp, Homo sapiens
ccccctttcctggacactca

SEQ ID NO: 4883940 - DNA, 13 bp, Homo sapiens
ccccgcagccctg

SEQ ID NO: 4883941 - DNA, 13 bp, Homo sapiens
ccccggccacctc

SEQ ID NO: 4883942 - DNA, 17 bp, Homo sapiens
ccccggccacctctgcg

SEQ ID NO: 4883943 - DNA, 12 bp, Homo sapiens
ccccggccccct

SEQ ID NO: 4883944 - DNA, 13 bp, Homo sapiens
ccccggccctggg

SEQ ID NO: 4883945 - DNA, 17 bp, Homo sapiens
ccccggcttcctttccc

SEQ ID NO: 4883946 - DNA, 20 bp, Homo sapiens
ccccggtcacctagcaagct

SEQ ID NO: 4883947 - DNA, 18 bp, Homo sapiens
ccccggtggcggccccag

SEQ ID NO: 4883948 - DNA, 20 bp, Homo sapiens
ccccgtggccatccctgtga

SEQ ID NO: 4883949 - DNA, 18 bp, Homo sapiens
cccctacgcgccttgtct

SEQ ID NO: 4883950 - DNA, 13 bp, Homo sapiens
cccctagaaaccc

SEQ ID NO: 4883951 - DNA, 18 bp, Homo sapiens
cccctagaaacccaagct

SEQ ID NO: 4883952 - DNA, 12 bp, Homo sapiens
cccctagcccag

SEQ ID NO: 4883953 - DNA, 13 bp, Homo sapiens
cccctagttccct

SEQ ID NO: 4883954 - DNA, 18 bp, Homo sapiens
cccctcacagcctctgac

SEQ ID NO: 4883955 - DNA, 13 bp, Homo sapiens
cccctcacctcct

SEQ ID NO: 4883956 - DNA, 23 bp, Homo sapiens
cccctccaatcccaccaaccctc

SEQ ID NO: 4883957 - DNA, 14 bp, Homo sapiens
cccctccactgtca

SEQ ID NO: 4883958 - DNA, 15 bp, Homo sapiens
cccctcccccaaccc

SEQ ID NO: 4883959 - DNA, 13 bp, Homo sapiens
cccctcccctgct

SEQ ID NO: 4883960 - DNA, 14 bp, Homo sapiens
cccctccctctgtc

SEQ ID NO: 4883961 - DNA, 12 bp, Homo sapiens
cccctccctggc

SEQ ID NO: 4883962 - DNA, 15 bp, Homo sapiens
cccctccctggctcc

SEQ ID NO: 4883963 - DNA, 22 bp, Homo sapiens
cccctccctggctcccatgacc

SEQ ID NO: 4883964 - DNA, 15 bp, Homo sapiens
cccctcccttcaacc

SEQ ID NO: 4883965 - DNA, 23 bp, Homo sapiens
cccctcctcactggccatccctc

SEQ ID NO: 4883966 - DNA, 17 bp, Homo sapiens
cccctcctctagctgtg

SEQ ID NO: 4883967 - DNA, 19 bp, Homo sapiens
cccctcctctagctgtggg

SEQ ID NO: 4883968 - DNA, 18 bp, Homo sapiens
cccctctgacctgcactg

SEQ ID NO: 4883969 - DNA, 16 bp, Homo sapiens
cccctctgctgctgtc

SEQ ID NO: 4883970 - DNA, 18 bp, Homo sapiens
cccctctgtctacaaata

SEQ ID NO: 4883971 - DNA, 13 bp, Homo sapiens
cccctgcagcacg

SEQ ID NO: 4883972 - DNA, 14 bp, Homo sapiens
cccctgcagcacgg

SEQ ID NO: 4883973 - DNA, 14 bp, Homo sapiens
cccctgccaccctg

SEQ ID NO: 4883974 - DNA, 17 bp, Homo sapiens
cccctgccccccagcct

SEQ ID NO: 4883975 - DNA, 19 bp, Homo sapiens
cccctgcccggctgcggaa

SEQ ID NO: 4883976 - DNA, 13 bp, Homo sapiens
cccctgccctggt

SEQ ID NO: 4883977 - DNA, 17 bp, Homo sapiens
cccctgccctggtccag

SEQ ID NO: 4883978 - DNA, 23 bp, Homo sapiens
cccctgctgcaggggctctggag

SEQ ID NO: 4883979 - DNA, 21 bp, Homo sapiens
cccctgctggctcttctgccc

SEQ ID NO: 4883980 - DNA, 11 bp, Homo sapiens
cccctgctggt

SEQ ID NO: 4883981 - DNA, 13 bp, Homo sapiens
cccctgctggttc

SEQ ID NO: 4883982 - DNA, 15 bp, Homo sapiens
cccctgctggttcag

SEQ ID NO: 4883983 - DNA, 20 bp, Homo sapiens
cccctggaggcactgaagtg

SEQ ID NO: 4883984 - DNA, 23 bp, Homo sapiens
cccctggctgtactgctcaggct

SEQ ID NO: 4883985 - DNA, 22 bp, Homo sapiens
cccctggcttttcactgctggc

SEQ ID NO: 4883986 - DNA, 12 bp, Homo sapiens
cccctggggcct

SEQ ID NO: 4883987 - DNA, 23 bp, Homo sapiens
cccctggggcctagactctgtaa

SEQ ID NO: 4883988 - DNA, 15 bp, Homo sapiens
cccctggtctctggt

SEQ ID NO: 4883989 - DNA, 18 bp, Homo sapiens
cccctgtcccatgcaggc

SEQ ID NO: 4883990 - DNA, 22 bp, Homo sapiens
cccctgtcccatgcaggccctt

SEQ ID NO: 4883991 - DNA, 15 bp, Homo sapiens
cccctgtcctcactg

SEQ ID NO: 4883992 - DNA, 15 bp, Homo sapiens
cccctgttcactcta

SEQ ID NO: 4883993 - DNA, 13 bp, Homo sapiens
ccccttccctgtc

SEQ ID NO: 4883994 - DNA, 14 bp, Homo sapiens
ccccttcgctcctg

SEQ ID NO: 4883995 - DNA, 17 bp, Homo sapiens
ccccttcgctcctgtgt

SEQ ID NO: 4883996 - DNA, 12 bp, Homo sapiens
ccccttctctgc

SEQ ID NO: 4883997 - DNA, 21 bp, Homo sapiens
ccccttgatttaaacacacag

SEQ ID NO: 4883998 - DNA, 20 bp, Homo sapiens
ccccttgccaccccaccctc

SEQ ID NO: 4883999 - DNA, 17 bp, Homo sapiens
cccctttttcttcctca

SEQ ID NO: 4884000 - DNA, 23 bp, Homo sapiens
cccgaaggttatggtcaatccca

SEQ ID NO: 4884001 - DNA, 22 bp, Homo sapiens
cccgaatagctgggactacagg

SEQ ID NO: 4884002 - DNA, 14 bp, Homo sapiens
cccgagctgtttat

SEQ ID NO: 4884003 - DNA, 19 bp, Homo sapiens
cccgaggccgcgtgcgtga

SEQ ID NO: 4884004 - DNA, 21 bp, Homo sapiens
cccgagtagctgggactacag

SEQ ID NO: 4884005 - DNA, 21 bp, Homo sapiens
cccgcacaccctcactctgcc

SEQ ID NO: 4884006 - DNA, 11 bp, Homo sapiens
cccgcacagca

SEQ ID NO: 4884007 - DNA, 14 bp, Homo sapiens
cccgcacagcagcc

SEQ ID NO: 4884008 - DNA, 14 bp, Homo sapiens
cccgccacacagac

SEQ ID NO: 4884009 - DNA, 15 bp, Homo sapiens
cccgcccctgcagca

SEQ ID NO: 4884010 - DNA, 12 bp, Homo sapiens
cccgcctgccct

SEQ ID NO: 4884011 - DNA, 14 bp, Homo sapiens
cccgctcagccctc

SEQ ID NO: 4884012 - DNA, 15 bp, Homo sapiens
cccgctcagccctcc

SEQ ID NO: 4884013 - DNA, 19 bp, Homo sapiens
cccgctcagccctccctgc

SEQ ID NO: 4884014 - DNA, 12 bp, Homo sapiens
cccgctgctgct

SEQ ID NO: 4884015 - DNA, 15 bp, Homo sapiens
cccggaggaaatctg

SEQ ID NO: 4884016 - DNA, 18 bp, Homo sapiens
cccggaggttgggtgggc

SEQ ID NO: 4884017 - DNA, 14 bp, Homo sapiens
cccggatcagagca

SEQ ID NO: 4884018 - DNA, 17 bp, Homo sapiens
cccggatcagagcagga

SEQ ID NO: 4884019 - DNA, 22 bp, Homo sapiens
cccggatcagagcaggacctcc

SEQ ID NO: 4884020 - DNA, 13 bp, Homo sapiens
cccggatgctgct

SEQ ID NO: 4884021 - DNA, 15 bp, Homo sapiens
cccggcaggccctgc

SEQ ID NO: 4884022 - DNA, 17 bp, Homo sapiens
cccggcaggccctgcag

SEQ ID NO: 4884023 - DNA, 12 bp, Homo sapiens
cccggccacctc

SEQ ID NO: 4884024 - DNA, 20 bp, Homo sapiens
cccggccacctctgcggacc

SEQ ID NO: 4884025 - DNA, 17 bp, Homo sapiens
cccggccgctccaccag

SEQ ID NO: 4884026 - DNA, 12 bp, Homo sapiens
cccggctgcgga

SEQ ID NO: 4884027 - DNA, 16 bp, Homo sapiens
cccgggagcctaggac

SEQ ID NO: 4884028 - DNA, 21 bp, Homo sapiens
cccgggcgcggccagccccgg

SEQ ID NO: 4884029 - DNA, 20 bp, Homo sapiens
cccggtcccacccctccctc

SEQ ID NO: 4884030 - DNA, 18 bp, Homo sapiens
cccggtgcccaagaatag

SEQ ID NO: 4884031 - DNA, 20 bp, Homo sapiens
cccgtcgaggggctctcagc

SEQ ID NO: 4884032 - DNA, 13 bp, Homo sapiens
cccgtctcagtgt

SEQ ID NO: 4884033 - DNA, 16 bp, Homo sapiens
cccgtttctccaccta

SEQ ID NO: 4884034 - DNA, 18 bp, Homo sapiens
ccctaaacccctgtccca

SEQ ID NO: 4884035 - DNA, 17 bp, Homo sapiens
ccctaaccccttccaga

SEQ ID NO: 4884036 - DNA, 16 bp, Homo sapiens
ccctaagccagcctgg

SEQ ID NO: 4884037 - DNA, 16 bp, Homo sapiens
ccctacccctggctgt

SEQ ID NO: 4884038 - DNA, 22 bp, Homo sapiens
ccctacctgattggtgcaaccc

SEQ ID NO: 4884039 - DNA, 23 bp, Homo sapiens
ccctacctgattggtgcaaccct

SEQ ID NO: 4884040 - DNA, 16 bp, Homo sapiens
ccctactccctgcaga

SEQ ID NO: 4884041 - DNA, 12 bp, Homo sapiens
ccctgctcctgc

SEQ ID NO: 4884042 - DNA, 16 bp, Homo sapiens
ccctgctcctgcagca

SEQ ID NO: 4884043 - DNA, 18 bp, Homo sapiens
ccctgctcctgcagcatg

SEQ ID NO: 4884044 - DNA, 22 bp, Homo sapiens
ccctgctctccgaccagacacc

SEQ ID NO: 4884045 - DNA, 13 bp, Homo sapiens
ccctgctgcaggg

SEQ ID NO: 4884046 - DNA, 14 bp, Homo sapiens
ccctgctggctctt

SEQ ID NO: 4884047 - DNA, 19 bp, Homo sapiens
ccctgctggttcagggttg

SEQ ID NO: 4884048 - DNA, 19 bp, Homo sapiens
ccctgctttgggctgccct

SEQ ID NO: 4884049 - DNA, 20 bp, Homo sapiens
ccctgctttgggctgccctg

SEQ ID NO: 4884050 - DNA, 23 bp, Homo sapiens
ccctggaactctatctgggcctg

SEQ ID NO: 4884051 - DNA, 22 bp, Homo sapiens
ccctggatcacgacgctgcaga

SEQ ID NO: 4884052 - DNA, 23 bp, Homo sapiens
ccctggatcacgacgctgcagag

SEQ ID NO: 4884053 - DNA, 19 bp, Homo sapiens
ccctggatccatcaggcca

SEQ ID NO: 4884054 - DNA, 13 bp, Homo sapiens
ccctggcctctgt

SEQ ID NO: 4884055 - DNA, 15 bp, Homo sapiens
ccctggcctctgtgc

SEQ ID NO: 4884056 - DNA, 21 bp, Homo sapiens
ccctggcctctgtgccttctt

SEQ ID NO: 4884057 - DNA, 14 bp, Homo sapiens
ccctggctcccatg

SEQ ID NO: 4884058 - DNA, 13 bp, Homo sapiens
ccctggctctgca

SEQ ID NO: 4884059 - DNA, 21 bp, Homo sapiens
ccctggctgtactgctcaggc

SEQ ID NO: 4884060 - DNA, 17 bp, Homo sapiens
ccctggcttttcactgc

SEQ ID NO: 4884061 - DNA, 19 bp, Homo sapiens
ccctggcttttcactgctg

SEQ ID NO: 4884062 - DNA, 16 bp, Homo sapiens
ccctgggaggcccctt

SEQ ID NO: 4884063 - DNA, 13 bp, Homo sapiens
ccctgggccaggg

SEQ ID NO: 4884064 - DNA, 18 bp, Homo sapiens
ccctggggcctggacctg

SEQ ID NO: 4884065 - DNA, 23 bp, Homo sapiens
ccctggggcctggacctgcctcc

SEQ ID NO: 4884066 - DNA, 16 bp, Homo sapiens
ccctggtccagggaag

SEQ ID NO: 4884067 - DNA, 13 bp, Homo sapiens
ccctggtctctgg

SEQ ID NO: 4884068 - DNA, 13 bp, Homo sapiens
ccctggtgctgcc

SEQ ID NO: 4884069 - DNA, 21 bp, Homo sapiens
ccctggtggcagtgggagctg

SEQ ID NO: 4884070 - DNA, 14 bp, Homo sapiens
ccctgtccctccca

SEQ ID NO: 4884071 - DNA, 20 bp, Homo sapiens
ccctgtccctcccacctctg

SEQ ID NO: 4884072 - DNA, 24 bp, Homo sapiens
ccctgtccctcccacctctgtgac

SEQ ID NO: 4884073 - DNA, 13 bp, Homo sapiens
ccctgtcttgtcc

SEQ ID NO: 4884074 - DNA, 14 bp, Homo sapiens
ccctgtgacaaaat

SEQ ID NO: 4884075 - DNA, 14 bp, Homo sapiens
ccctgtggccctgg

SEQ ID NO: 4884076 - DNA, 21 bp, Homo sapiens
ccctgtgtccacctgtgggtg

SEQ ID NO: 4884077 - DNA, 12 bp, Homo sapiens
ccctgttcttcc

SEQ ID NO: 4884078 - DNA, 11 bp, Homo sapiens
ccctgtttaat

SEQ ID NO: 4884079 - DNA, 16 bp, Homo sapiens
ccctgtttaatattta

SEQ ID NO: 4884080 - DNA, 17 bp, Homo sapiens
ccctgtttaatatttaa

SEQ ID NO: 4884081 - DNA, 16 bp, Homo sapiens
cccttaacccaaggag

SEQ ID NO: 4884082 - DNA, 17 bp, Homo sapiens
cccttaacccaaggagc

SEQ ID NO: 4884083 - DNA, 22 bp, Homo sapiens
cccttaacccaaggagcacagg

SEQ ID NO: 4884084 - DNA, 17 bp, Homo sapiens
cccttaccccttagcct

SEQ ID NO: 4884085 - DNA, 13 bp, Homo sapiens
cccttaccttccc

SEQ ID NO: 4884086 - DNA, 23 bp, Homo sapiens
cccttagcagggaaacagctaat

SEQ ID NO: 4884087 - DNA, 23 bp, Homo sapiens
cccttagtcccccaactctgagc

SEQ ID NO: 4884088 - DNA, 19 bp, Homo sapiens
cccttcagtaccctctcag

SEQ ID NO: 4884089 - DNA, 21 bp, Homo sapiens
cccttcagtaccctctcagct

SEQ ID NO: 4884090 - DNA, 20 bp, Homo sapiens
cccttccaaataataaagtc

SEQ ID NO: 4884091 - DNA, 16 bp, Homo sapiens
cccttccactgcctct

SEQ ID NO: 4884092 - DNA, 20 bp, Homo sapiens
cccttccactgcctctgcct

SEQ ID NO: 4884093 - DNA, 12 bp, Homo sapiens
cccttccagaca

SEQ ID NO: 4884094 - DNA, 20 bp, Homo sapiens
cccttccatgtcgcctctgc

SEQ ID NO: 4884095 - DNA, 18 bp, Homo sapiens
cccttcccaatcagcact

SEQ ID NO: 4884096 - DNA, 20 bp, Homo sapiens
cccttcccaatcagcactga

SEQ ID NO: 4884097 - DNA, 21 bp, Homo sapiens
cccttcccaatcagcactgaa

SEQ ID NO: 4884098 - DNA, 12 bp, Homo sapiens
cccttcccctcc

SEQ ID NO: 4884099 - DNA, 15 bp, Homo sapiens
cccttcccctccctg

SEQ ID NO: 4884100 - DNA, 17 bp, Homo sapiens
cccttcccctccctggc

SEQ ID NO: 4884101 - DNA, 22 bp, Homo sapiens
cccttcccctccctggctccca

SEQ ID NO: 4884102 - DNA, 14 bp, Homo sapiens
cccttccgaccctc

SEQ ID NO: 4884103 - DNA, 17 bp, Homo sapiens
cccttccgaccctctgg

SEQ ID NO: 4884104 - DNA, 19 bp, Homo sapiens
cccttccgaccctctggga

SEQ ID NO: 4884105 - DNA, 10 bp, Homo sapiens
cccttcctct

SEQ ID NO: 4884106 - DNA, 21 bp, Homo sapiens
cccttcctctccactgccttc

SEQ ID NO: 4884107 - DNA, 12 bp, Homo sapiens
cccttcctcttc

SEQ ID NO: 4884108 - DNA, 14 bp, Homo sapiens
cccttcgctcctgt

SEQ ID NO: 4884109 - DNA, 15 bp, Homo sapiens
cccttcgctcctgtg

SEQ ID NO: 4884110 - DNA, 17 bp, Homo sapiens
cccttgaaattttaaac

SEQ ID NO: 4884111 - DNA, 20 bp, Homo sapiens
cccttgatttaaacacacag

SEQ ID NO: 4884112 - DNA, 21 bp, Homo sapiens
cccttgcagttcagcaccacc

SEQ ID NO: 4884113 - DNA, 18 bp, Homo sapiens
cccttgccaccccaccct

SEQ ID NO: 4884114 - DNA, 17 bp, Homo sapiens
cccttgcttttccctct

SEQ ID NO: 4884115 - DNA, 12 bp, Homo sapiens
cccttggaagag

SEQ ID NO: 4884116 - DNA, 12 bp, Homo sapiens
cccttggcctgt

SEQ ID NO: 4884117 - DNA, 15 bp, Homo sapiens
cccttggctcaatcc

SEQ ID NO: 4884118 - DNA, 18 bp, Homo sapiens
cccttggcttctgtgatg

SEQ ID NO: 4884119 - DNA, 17 bp, Homo sapiens
cccttggtggcaagagc

SEQ ID NO: 4884120 - DNA, 18 bp, Homo sapiens
ccctttccttccatccct

SEQ ID NO: 4884121 - DNA, 17 bp, Homo sapiens
ccctttgaagcctcagc

SEQ ID NO: 4884122 - DNA, 19 bp, Homo sapiens
ccctttgtttcttgtttat

SEQ ID NO: 4884123 - DNA, 20 bp, Homo sapiens
cccttttgttgagccaggcc

SEQ ID NO: 4884124 - DNA, 16 bp, Homo sapiens
ccctttttctccagct

SEQ ID NO: 4884125 - DNA, 20 bp, Homo sapiens
ccgaatagctgggactacag

SEQ ID NO: 4884126 - DNA, 19 bp, Homo sapiens
ccgaatcccctccctgtca

SEQ ID NO: 4884127 - DNA, 14 bp, Homo sapiens
ccgacagcctggca

SEQ ID NO: 4884128 - DNA, 22 bp, Homo sapiens
ccgacagcctggcacagggcag

SEQ ID NO: 4884129 - DNA, 15 bp, Homo sapiens
ccgacaggccctggc

SEQ ID NO: 4884130 - DNA, 15 bp, Homo sapiens
ccgaccacctgccca

SEQ ID NO: 4884131 - DNA, 21 bp, Homo sapiens
ccgagcaaagatcaaaataaa

SEQ ID NO: 4884132 - DNA, 22 bp, Homo sapiens
ccgagcaatatttatggatgca

SEQ ID NO: 4884133 - DNA, 15 bp, Homo sapiens
ccgaggaggtgcctg

SEQ ID NO: 4884134 - DNA, 16 bp, Homo sapiens
ccgagggtcctggctc

SEQ ID NO: 4884135 - DNA, 17 bp, Homo sapiens
ccgaggtggttttaaag

SEQ ID NO: 4884136 - DNA, 13 bp, Homo sapiens
ccgagtacagtct

SEQ ID NO: 4884137 - DNA, 14 bp, Homo sapiens
ccgagtctcttctc

SEQ ID NO: 4884138 - DNA, 18 bp, Homo sapiens
ccgagtctcttctccact

SEQ ID NO: 4884139 - DNA, 19 bp, Homo sapiens
ccgagtctcttctccactg

SEQ ID NO: 4884140 - DNA, 13 bp, Homo sapiens
ccgcacagcagcc

SEQ ID NO: 4884141 - DNA, 22 bp, Homo sapiens
ccgcacagcagcctgcttccca

SEQ ID NO: 4884142 - DNA, 12 bp, Homo sapiens
ccgcacagctca

SEQ ID NO: 4884143 - DNA, 21 bp, Homo sapiens
ccgcactttccacttcttcct

SEQ ID NO: 4884144 - DNA, 22 bp, Homo sapiens
ccgcactttccacttcttcctt

SEQ ID NO: 4884145 - DNA, 16 bp, Homo sapiens
ccgcagacctccccag

SEQ ID NO: 4884146 - DNA, 14 bp, Homo sapiens
ccgcagccctggca

SEQ ID NO: 4884147 - DNA, 22 bp, Homo sapiens
ccgcaggcagactacacaggat

SEQ ID NO: 4884148 - DNA, 15 bp, Homo sapiens
ccgccagagggcttg

SEQ ID NO: 4884149 - DNA, 14 bp, Homo sapiens
ccgccattgccacc

SEQ ID NO: 4884150 - DNA, 15 bp, Homo sapiens
ccgccattgccacca

SEQ ID NO: 4884151 - DNA, 12 bp, Homo sapiens
cctcccaccccc

SEQ ID NO: 4884152 - DNA, 14 bp, Homo sapiens
cctcccacctctgt

SEQ ID NO: 4884153 - DNA, 22 bp, Homo sapiens
cctcccagaggtccagcccatc

SEQ ID NO: 4884154 - DNA, 14 bp, Homo sapiens
cctcccatcccctg

SEQ ID NO: 4884155 - DNA, 22 bp, Homo sapiens
cctccccagcccctagcccagg

SEQ ID NO: 4884156 - DNA, 18 bp, Homo sapiens
cctcccccaacccccacc

SEQ ID NO: 4884157 - DNA, 22 bp, Homo sapiens
cctcccccaacccccaccccac

SEQ ID NO: 4884158 - DNA, 19 bp, Homo sapiens
cctcccccatctcccaccc

SEQ ID NO: 4884159 - DNA, 14 bp, Homo sapiens
cctcccctcccctg

SEQ ID NO: 4884160 - DNA, 15 bp, Homo sapiens
cctcccctcccctgc

SEQ ID NO: 4884161 - DNA, 14 bp, Homo sapiens
cctcccctgccatt

SEQ ID NO: 4884162 - DNA, 20 bp, Homo sapiens
cctcccgagtagctgggact

SEQ ID NO: 4884163 - DNA, 21 bp, Homo sapiens
cctcccgagtagctgggacta

SEQ ID NO: 4884164 - DNA, 15 bp, Homo sapiens
cctcccgcaccccga

SEQ ID NO: 4884165 - DNA, 13 bp, Homo sapiens
cctccctctctct

SEQ ID NO: 4884166 - DNA, 22 bp, Homo sapiens
cctccctctctcttctgctcca

SEQ ID NO: 4884167 - DNA, 14 bp, Homo sapiens
cctccctgcccagg

SEQ ID NO: 4884168 - DNA, 15 bp, Homo sapiens
cctccctgcccaggc

SEQ ID NO: 4884169 - DNA, 20 bp, Homo sapiens
cctccctggagcctccactg

SEQ ID NO: 4884170 - DNA, 15 bp, Homo sapiens
cctccctggctccca

SEQ ID NO: 4884171 - DNA, 15 bp, Homo sapiens
cctcccttccgaccc

SEQ ID NO: 4884172 - DNA, 21 bp, Homo sapiens
cctcccttccgaccctctggg

SEQ ID NO: 4884173 - DNA, 23 bp, Homo sapiens
cctcccttccgaccctctgggaa

SEQ ID NO: 4884174 - DNA, 13 bp, Homo sapiens
cctccgcctcttg

SEQ ID NO: 4884175 - DNA, 18 bp, Homo sapiens
cctccgtccaggagcctg

SEQ ID NO: 4884176 - DNA, 13 bp, Homo sapiens
cctcctcacctct

SEQ ID NO: 4884177 - DNA, 21 bp, Homo sapiens
cctcctcacctctggactggc

SEQ ID NO: 4884178 - DNA, 22 bp, Homo sapiens
cctcctcacctctggactggct

SEQ ID NO: 4884179 - DNA, 17 bp, Homo sapiens
cctcctcactggccatc

SEQ ID NO: 4884180 - DNA, 19 bp, Homo sapiens
cctcctcactggccatccc

SEQ ID NO: 4884181 - DNA, 20 bp, Homo sapiens
cctcctcactggccatccct

SEQ ID NO: 4884182 - DNA, 20 bp, Homo sapiens
cctcctcatgtacataccct

SEQ ID NO: 4884183 - DNA, 14 bp, Homo sapiens
cctcctccccactt

SEQ ID NO: 4884184 - DNA, 23 bp, Homo sapiens
cctcctcggaaccgctcacctag

SEQ ID NO: 4884185 - DNA, 24 bp, Homo sapiens
cctcctcggaaccgctcacctaga

SEQ ID NO: 4884186 - DNA, 16 bp, Homo sapiens
cctcctctgtctgccc

SEQ ID NO: 4884187 - DNA, 21 bp, Homo sapiens
cctcctctttctctccccaac

SEQ ID NO: 4884188 - DNA, 20 bp, Homo sapiens
cctcctgaaccgcacagctc

SEQ ID NO: 4884189 - DNA, 16 bp, Homo sapiens
cctcctgagggaggac

SEQ ID NO: 4884190 - DNA, 23 bp, Homo sapiens
cctcctgcctcgaactggctgca

SEQ ID NO: 4884191 - DNA, 19 bp, Homo sapiens
cctcctggaaccttgctgt

SEQ ID NO: 4884192 - DNA, 12 bp, Homo sapiens
cctcctgtgggg

SEQ ID NO: 4884193 - DNA, 17 bp, Homo sapiens
cctcctgtgtactgtgt

SEQ ID NO: 4884194 - DNA, 18 bp, Homo sapiens
cctcctgtgtactgtgtc

SEQ ID NO: 4884195 - DNA, 14 bp, Homo sapiens
cctccttcagacac

SEQ ID NO: 4884196 - DNA, 15 bp, Homo sapiens
cctccttctcccttt

SEQ ID NO: 4884197 - DNA, 17 bp, Homo sapiens
cctccttctcccttttt

SEQ ID NO: 4884198 - DNA, 15 bp, Homo sapiens
cctccttggtgcctg

SEQ ID NO: 4884199 - DNA, 15 bp, Homo sapiens
cctccttgtccaccc

SEQ ID NO: 4884200 - DNA, 13 bp, Homo sapiens
cctcctttatcac

SEQ ID NO: 4884201 - DNA, 14 bp, Homo sapiens
cctcctttctcctc

SEQ ID NO: 4884202 - DNA, 18 bp, Homo sapiens
cctcctttctgtgcccta

SEQ ID NO: 4884203 - DNA, 20 bp, Homo sapiens
cctcgaaacacagaaacctt

SEQ ID NO: 4884204 - DNA, 16 bp, Homo sapiens
cctcgaactggctgca

SEQ ID NO: 4884205 - DNA, 19 bp, Homo sapiens
cctcgaagcgcgccactcg

SEQ ID NO: 4884206 - DNA, 12 bp, Homo sapiens
cctcgcctgtgg

SEQ ID NO: 4884207 - DNA, 13 bp, Homo sapiens
cctcgcctgtgga

SEQ ID NO: 4884208 - DNA, 13 bp, Homo sapiens
cctcgctgcttct

SEQ ID NO: 4884209 - DNA, 19 bp, Homo sapiens
cctcgtggtccccaacagc

SEQ ID NO: 4884210 - DNA, 14 bp, Homo sapiens
cctctacccaaacc

SEQ ID NO: 4884211 - DNA, 15 bp, Homo sapiens
cctctatacatctct

SEQ ID NO: 4884212 - DNA, 21 bp, Homo sapiens
cctctatacatctctccccaa

SEQ ID NO: 4884213 - DNA, 21 bp, Homo sapiens
cctctatttatgtttgcactt

SEQ ID NO: 4884214 - DNA, 19 bp, Homo sapiens
cctctccactgccttcgat

SEQ ID NO: 4884215 - DNA, 15 bp, Homo sapiens
cctctcccaagtcca

SEQ ID NO: 4884216 - DNA, 20 bp, Homo sapiens
cctctccccagcaagtgaga

SEQ ID NO: 4884217 - DNA, 13 bp, Homo sapiens
cctctcccctcca

SEQ ID NO: 4884218 - DNA, 17 bp, Homo sapiens
cctctcccctccagcct

SEQ ID NO: 4884219 - DNA, 22 bp, Homo sapiens
cctctcccgccagactgttaga

SEQ ID NO: 4884220 - DNA, 13 bp, Homo sapiens
cctctccctgttg

SEQ ID NO: 4884221 - DNA, 14 bp, Homo sapiens
cctctccgtttatt

SEQ ID NO: 4884222 - DNA, 23 bp, Homo sapiens
cctctccgtttattataaactgt

SEQ ID NO: 4884223 - DNA, 12 bp, Homo sapiens
cctctcctggag

SEQ ID NO: 4884224 - DNA, 13 bp, Homo sapiens
cctctccttccta

SEQ ID NO: 4884225 - DNA, 16 bp, Homo sapiens
cctctcgagggcaggg

SEQ ID NO: 4884226 - DNA, 12 bp, Homo sapiens
cctctctccctc

SEQ ID NO: 4884227 - DNA, 20 bp, Homo sapiens
cctctctcttctgctccacc

SEQ ID NO: 4884228 - DNA, 14 bp, Homo sapiens
cctctgacacacag

SEQ ID NO: 4884229 - DNA, 15 bp, Homo sapiens
cctctgacacacagc

SEQ ID NO: 4884230 - DNA, 16 bp, Homo sapiens
cctctgacacacagct

SEQ ID NO: 4884231 - DNA, 19 bp, Homo sapiens
cctctgacacacagctctg

SEQ ID NO: 4884232 - DNA, 21 bp, Homo sapiens
cctctgacacacagctctgtc

SEQ ID NO: 4884233 - DNA, 13 bp, Homo sapiens
cctctgaccaaca

SEQ ID NO: 4884234 - DNA, 13 bp, Homo sapiens
cctctgacccctc

SEQ ID NO: 4884235 - DNA, 18 bp, Homo sapiens
cctctgacccctcctcac

SEQ ID NO: 4884236 - DNA, 22 bp, Homo sapiens
cctctgacccctcctcactggc

SEQ ID NO: 4884237 - DNA, 11 bp, Homo sapiens
cctctgccacc

SEQ ID NO: 4884238 - DNA, 17 bp, Homo sapiens
cctctgccaccagagac

SEQ ID NO: 4884239 - DNA, 19 bp, Homo sapiens
cctctgccaccagagaccg

SEQ ID NO: 4884240 - DNA, 23 bp, Homo sapiens
cctctgcctctgacacacagctc

SEQ ID NO: 4884241 - DNA, 18 bp, Homo sapiens
cctctgccttagaggagc

SEQ ID NO: 4884242 - DNA, 13 bp, Homo sapiens
cctctgcggaccc

SEQ ID NO: 4884243 - DNA, 13 bp, Homo sapiens
cctctgctcccca

SEQ ID NO: 4884244 - DNA, 14 bp, Homo sapiens
cctctgctgctgtc

SEQ ID NO: 4884245 - DNA, 14 bp, Homo sapiens
cctctggactggct

SEQ ID NO: 4884246 - DNA, 15 bp, Homo sapiens
cctctggactggcta

SEQ ID NO: 4884247 - DNA, 22 bp, Homo sapiens
cctctggaggggtgtggctcct

SEQ ID NO: 4884248 - DNA, 21 bp, Homo sapiens
cctctggcattagaattattt

SEQ ID NO: 4884249 - DNA, 13 bp, Homo sapiens
cctctgggaacct

SEQ ID NO: 4884250 - DNA, 17 bp, Homo sapiens
cctctgggaacctccca

SEQ ID NO: 4884251 - DNA, 15 bp, Homo sapiens
cctctgtcatttgtt

SEQ ID NO: 4884252 - DNA, 16 bp, Homo sapiens
cctctgtcatttgttg

SEQ ID NO: 4884253 - DNA, 17 bp, Homo sapiens
cctctgtcctgcttctg

SEQ ID NO: 4884254 - DNA, 12 bp, Homo sapiens
cctctgtctcat

SEQ ID NO: 4884255 - DNA, 18 bp, Homo sapiens
cctctgtctcatcctcct

SEQ ID NO: 4884256 - DNA, 16 bp, Homo sapiens
cctctgtgacctcagg

SEQ ID NO: 4884257 - DNA, 23 bp, Homo sapiens
cctctgtggcattgaaatgagca

SEQ ID NO: 4884258 - DNA, 17 bp, Homo sapiens
cctcttaaagctgcctg

SEQ ID NO: 4884259 - DNA, 13 bp, Homo sapiens
cctcttcaccccc

SEQ ID NO: 4884260 - DNA, 23 bp, Homo sapiens
cctcttcaccccggcaggccctg

SEQ ID NO: 4884261 - DNA, 14 bp, Homo sapiens
cctgcctggccagg

SEQ ID NO: 4884262 - DNA, 23 bp, Homo sapiens
cctgcctggccaggcagatctgt

SEQ ID NO: 4884263 - DNA, 13 bp, Homo sapiens
cctgcctggcccc

SEQ ID NO: 4884264 - DNA, 14 bp, Homo sapiens
cctgcctggcccct

SEQ ID NO: 4884265 - DNA, 15 bp, Homo sapiens
cctgcctggcccctc

SEQ ID NO: 4884266 - DNA, 18 bp, Homo sapiens
cctgcgattttgcctgtg

SEQ ID NO: 4884267 - DNA, 14 bp, Homo sapiens
cctgcgcctgtgat

SEQ ID NO: 4884268 - DNA, 15 bp, Homo sapiens
cctgcgcctgtgatg

SEQ ID NO: 4884269 - DNA, 14 bp, Homo sapiens
cctgcgtcttccgc

SEQ ID NO: 4884270 - DNA, 18 bp, Homo sapiens
cctgcgtcttccgcccct

SEQ ID NO: 4884271 - DNA, 19 bp, Homo sapiens
cctgcgttggtccagagcg

SEQ ID NO: 4884272 - DNA, 21 bp, Homo sapiens
cctgctaattccccagattgc

SEQ ID NO: 4884273 - DNA, 21 bp, Homo sapiens
cctgctccagaatttggaaat

SEQ ID NO: 4884274 - DNA, 22 bp, Homo sapiens
cctgctccagaatttggaaatc

SEQ ID NO: 4884275 - DNA, 14 bp, Homo sapiens
cctgctccgctgct

SEQ ID NO: 4884276 - DNA, 22 bp, Homo sapiens
cctgctccgctgctccttggct

SEQ ID NO: 4884277 - DNA, 15 bp, Homo sapiens
cctgctcctgcagca

SEQ ID NO: 4884278 - DNA, 22 bp, Homo sapiens
cctgctctccaagtctcagtgg

SEQ ID NO: 4884279 - DNA, 18 bp, Homo sapiens
cctgctctcctcttgcca

SEQ ID NO: 4884280 - DNA, 15 bp, Homo sapiens
cctgctgcccaggct

SEQ ID NO: 4884281 - DNA, 17 bp, Homo sapiens
cctgctgcccaggctgt

SEQ ID NO: 4884282 - DNA, 22 bp, Homo sapiens
cctgctgccgcctcccagcctg

SEQ ID NO: 4884283 - DNA, 23 bp, Homo sapiens
cctgctgccgcctcccagcctgg

SEQ ID NO: 4884284 - DNA, 17 bp, Homo sapiens
cctgctggtcacagcct

SEQ ID NO: 4884285 - DNA, 18 bp, Homo sapiens
cctgctggtcacagcctc

SEQ ID NO: 4884286 - DNA, 13 bp, Homo sapiens
cctgctggttcag

SEQ ID NO: 4884287 - DNA, 21 bp, Homo sapiens
cctgctttgggctgccctggt

SEQ ID NO: 4884288 - DNA, 23 bp, Homo sapiens
cctgctttttgaaatgaaattta

SEQ ID NO: 4884289 - DNA, 24 bp, Homo sapiens
cctggaacatcctttgcagggcag

SEQ ID NO: 4884290 - DNA, 18 bp, Homo sapiens
cctggaaccttgctgtcc

SEQ ID NO: 4884291 - DNA, 20 bp, Homo sapiens
cctggaaccttgctgtcctg

SEQ ID NO: 4884292 - DNA, 21 bp, Homo sapiens
cctggaaccttgctgtcctga

SEQ ID NO: 4884293 - DNA, 16 bp, Homo sapiens
cctggacactcagacc

SEQ ID NO: 4884294 - DNA, 23 bp, Homo sapiens
cctggacagtatcccacatccaa

SEQ ID NO: 4884295 - DNA, 22 bp, Homo sapiens
cctggacctgcctcctgcctgc

SEQ ID NO: 4884296 - DNA, 17 bp, Homo sapiens
cctggactgggaggtag

SEQ ID NO: 4884297 - DNA, 21 bp, Homo sapiens
cctggagacccaccccacctg

SEQ ID NO: 4884298 - DNA, 17 bp, Homo sapiens
cctggagacgtggaacc

SEQ ID NO: 4884299 - DNA, 22 bp, Homo sapiens
cctggagcgtttctagcaagtg

SEQ ID NO: 4884300 - DNA, 16 bp, Homo sapiens
cctggaggatttcatc

SEQ ID NO: 4884301 - DNA, 15 bp, Homo sapiens
cctggagtataatat

SEQ ID NO: 4884302 - DNA, 19 bp, Homo sapiens
cctggagtgtggctgagga

SEQ ID NO: 4884303 - DNA, 18 bp, Homo sapiens
cctggatattattcttgt

SEQ ID NO: 4884304 - DNA, 19 bp, Homo sapiens
cctggatcacgacgctgca

SEQ ID NO: 4884305 - DNA, 18 bp, Homo sapiens
cctggatcccctctgtct

SEQ ID NO: 4884306 - DNA, 12 bp, Homo sapiens
cctggcacacat

SEQ ID NO: 4884307 - DNA, 21 bp, Homo sapiens
cctggcacacatcaggagttc

SEQ ID NO: 4884308 - DNA, 24 bp, Homo sapiens
cctggcacaggactgattctggga

SEQ ID NO: 4884309 - DNA, 23 bp, Homo sapiens
cctggcacccggcccctgctggt

SEQ ID NO: 4884310 - DNA, 18 bp, Homo sapiens
cctggcacggtggctcag

SEQ ID NO: 4884311 - DNA, 13 bp, Homo sapiens
cctggcagcccag

SEQ ID NO: 4884312 - DNA, 19 bp, Homo sapiens
cctggcagccgtgccttca

SEQ ID NO: 4884313 - DNA, 22 bp, Homo sapiens
cctggcagccgtgccttcagct

SEQ ID NO: 4884314 - DNA, 15 bp, Homo sapiens
cctggccacctctct

SEQ ID NO: 4884315 - DNA, 21 bp, Homo sapiens
cctggccagatgcaccagccc

SEQ ID NO: 4884316 - DNA, 23 bp, Homo sapiens
cctggccagatgcaccagccctt

SEQ ID NO: 4884317 - DNA, 19 bp, Homo sapiens
cctggccagatggcccgga

SEQ ID NO: 4884318 - DNA, 16 bp, Homo sapiens
cctggccaggagctct

SEQ ID NO: 4884319 - DNA, 21 bp, Homo sapiens
cctggccaggagctcttcagg

SEQ ID NO: 4884320 - DNA, 22 bp, Homo sapiens
cctggccaggagctcttcaggc

SEQ ID NO: 4884321 - DNA, 22 bp, Homo sapiens
cctggccaggcagatctgtgcc

SEQ ID NO: 4884322 - DNA, 24 bp, Homo sapiens
cctggcccatagaaacatgacact

SEQ ID NO: 4884323 - DNA, 17 bp, Homo sapiens
cctggcccctcgcctgt

SEQ ID NO: 4884324 - DNA, 17 bp, Homo sapiens
cctggccctgccctgag

SEQ ID NO: 4884325 - DNA, 12 bp, Homo sapiens
cctggccgcccc

SEQ ID NO: 4884326 - DNA, 14 bp, Homo sapiens
cctggccgccccct

SEQ ID NO: 4884327 - DNA, 21 bp, Homo sapiens
cctggccgccccctgcccccc

SEQ ID NO: 4884328 - DNA, 13 bp, Homo sapiens
cctggcctggcac

SEQ ID NO: 4884329 - DNA, 15 bp, Homo sapiens
cctggcctggccctg

SEQ ID NO: 4884330 - DNA, 20 bp, Homo sapiens
cctggcgactgcccctgcct

SEQ ID NO: 4884331 - DNA, 23 bp, Homo sapiens
cctggctcccacaggcccttcct

SEQ ID NO: 4884332 - DNA, 22 bp, Homo sapiens
cctggctcccatgaccatactg

SEQ ID NO: 4884333 - DNA, 22 bp, Homo sapiens
cctggctctgcaatgggcactg

SEQ ID NO: 4884334 - DNA, 13 bp, Homo sapiens
cctggctgtactg

SEQ ID NO: 4884335 - DNA, 22 bp, Homo sapiens
cctggcttctttctctcagcct

SEQ ID NO: 4884336 - DNA, 17 bp, Homo sapiens
cctggcttttcactgct

SEQ ID NO: 4884337 - DNA, 22 bp, Homo sapiens
cctggcttttcactgctggctg

SEQ ID NO: 4884338 - DNA, 24 bp, Homo sapiens
cctggcttttcactgctggctgcc

SEQ ID NO: 4884339 - DNA, 14 bp, Homo sapiens
cctgggagacagac

SEQ ID NO: 4884340 - DNA, 15 bp, Homo sapiens
cctgggagacagacc

SEQ ID NO: 4884341 - DNA, 12 bp, Homo sapiens
cctgggaggccc

SEQ ID NO: 4884342 - DNA, 19 bp, Homo sapiens
cctgggctcggaggctgcc

SEQ ID NO: 4884343 - DNA, 15 bp, Homo sapiens
cctggggagaaagta

SEQ ID NO: 4884344 - DNA, 13 bp, Homo sapiens
cctggggcacagt

SEQ ID NO: 4884345 - DNA, 17 bp, Homo sapiens
cctggggcctggacctg

SEQ ID NO: 4884346 - DNA, 18 bp, Homo sapiens
cctggggcctggacctgc

SEQ ID NO: 4884347 - DNA, 19 bp, Homo sapiens
cctggggcctggacctgcc

SEQ ID NO: 4884348 - DNA, 13 bp, Homo sapiens
cctggggctgggc

SEQ ID NO: 4884349 - DNA, 17 bp, Homo sapiens
cctggggctgggccccc

SEQ ID NO: 4884350 - DNA, 12 bp, Homo sapiens
cctgggggtggg

SEQ ID NO: 4884351 - DNA, 21 bp, Homo sapiens
cctgggggttctttcttcctc

SEQ ID NO: 4884352 - DNA, 22 bp, Homo sapiens
cctgggggttctttcttcctct

SEQ ID NO: 4884353 - DNA, 18 bp, Homo sapiens
cctggggtctctgctgca

SEQ ID NO: 4884354 - DNA, 18 bp, Homo sapiens
cctgggtactgaaagcct

SEQ ID NO: 4884355 - DNA, 14 bp, Homo sapiens
cctgggtcagtctg

SEQ ID NO: 4884356 - DNA, 19 bp, Homo sapiens
cctgggtcagtctggtggg

SEQ ID NO: 4884357 - DNA, 22 bp, Homo sapiens
cctgggtggatcggcctcctct

SEQ ID NO: 4884358 - DNA, 16 bp, Homo sapiens
cctggtatggctgcag

SEQ ID NO: 4884359 - DNA, 22 bp, Homo sapiens
cctggtcacaggactctgcctc

SEQ ID NO: 4884360 - DNA, 23 bp, Homo sapiens
cctggtcacaggactctgcctcc

SEQ ID NO: 4884361 - DNA, 22 bp, Homo sapiens
cctggtccagggaagctggccg

SEQ ID NO: 4884362 - DNA, 16 bp, Homo sapiens
cctggtccatgcaggg

SEQ ID NO: 4884363 - DNA, 15 bp, Homo sapiens
cctggtgctgccaca

SEQ ID NO: 4884364 - DNA, 15 bp, Homo sapiens
cctggtgcttccaaa

SEQ ID NO: 4884365 - DNA, 13 bp, Homo sapiens
cctggtggcagct

SEQ ID NO: 4884366 - DNA, 16 bp, Homo sapiens
cctggtggcagctgcg

SEQ ID NO: 4884367 - DNA, 17 bp, Homo sapiens
cctggtggcagctgcgg

SEQ ID NO: 4884368 - DNA, 18 bp, Homo sapiens
ctctttggctcccctgta

SEQ ID NO: 4884369 - DNA, 18 bp, Homo sapiens
ctctttgtggggcttggc

SEQ ID NO: 4884370 - DNA, 20 bp, Homo sapiens
ctctttgtggggcttggcgt

SEQ ID NO: 4884371 - DNA, 20 bp, Homo sapiens
ctcttttcttactcctcctc

SEQ ID NO: 4884372 - DNA, 22 bp, Homo sapiens
ctctttttagggccaggcaggt

SEQ ID NO: 4884373 - DNA, 18 bp, Homo sapiens
ctgaaaaaaagtttacaa

SEQ ID NO: 4884374 - DNA, 15 bp, Homo sapiens
ctgaaaaagtagatt

SEQ ID NO: 4884375 - DNA, 19 bp, Homo sapiens
ctgaaaactggaataagaa

SEQ ID NO: 4884376 - DNA, 18 bp, Homo sapiens
ctgaaacacgaaacttgt

SEQ ID NO: 4884377 - DNA, 19 bp, Homo sapiens
ctgaaacacgaaacttgtt

SEQ ID NO: 4884378 - DNA, 20 bp, Homo sapiens
ctgaaacctagtactgcccc

SEQ ID NO: 4884379 - DNA, 16 bp, Homo sapiens
ctgaaagcacaggaga

SEQ ID NO: 4884380 - DNA, 20 bp, Homo sapiens
ctgaaagccttagggaagct

SEQ ID NO: 4884381 - DNA, 15 bp, Homo sapiens
ctgaaagttacccac

SEQ ID NO: 4884382 - DNA, 18 bp, Homo sapiens
ctgaaatgaaacaaataa

SEQ ID NO: 4884383 - DNA, 19 bp, Homo sapiens
ctgaaatgaaacaaataat

SEQ ID NO: 4884384 - DNA, 15 bp, Homo sapiens
ctgaaattccaaagt

SEQ ID NO: 4884385 - DNA, 14 bp, Homo sapiens
ctgaaattctaaag

SEQ ID NO: 4884386 - DNA, 13 bp, Homo sapiens
ctgaaatttcaga

SEQ ID NO: 4884387 - DNA, 14 bp, Homo sapiens
ctgaaatttcagat

SEQ ID NO: 4884388 - DNA, 21 bp, Homo sapiens
ctgaacaaactaaaggtgcac

SEQ ID NO: 4884389 - DNA, 14 bp, Homo sapiens
ctgaacaagaattg

SEQ ID NO: 4884390 - DNA, 16 bp, Homo sapiens
ctgaacacaggcagct

SEQ ID NO: 4884391 - DNA, 18 bp, Homo sapiens
ctgaacacaggcagcttt

SEQ ID NO: 4884392 - DNA, 19 bp, Homo sapiens
ctgaacacaggcagctttc

SEQ ID NO: 4884393 - DNA, 21 bp, Homo sapiens
ctgaaccccgtcgaggggctc

SEQ ID NO: 4884394 - DNA, 15 bp, Homo sapiens
ctgaaccgcacagct

SEQ ID NO: 4884395 - DNA, 21 bp, Homo sapiens
ctgaaccgcacagctcaggag

SEQ ID NO: 4884396 - DNA, 23 bp, Homo sapiens
ctgaaccgcacagctcaggaggc

SEQ ID NO: 4884397 - DNA, 13 bp, Homo sapiens
ctgaactttggag

SEQ ID NO: 4884398 - DNA, 15 bp, Homo sapiens
ctgaagaattaagat

SEQ ID NO: 4884399 - DNA, 20 bp, Homo sapiens
ctgaagaattaagatacaaa

SEQ ID NO: 4884400 - DNA, 19 bp, Homo sapiens
ctgaagactcattcttctg

SEQ ID NO: 4884401 - DNA, 19 bp, Homo sapiens
ctgaagaggaactgggcct

SEQ ID NO: 4884402 - DNA, 22 bp, Homo sapiens
ctgaagatgcagctcactaccc

SEQ ID NO: 4884403 - DNA, 15 bp, Homo sapiens
ctgaagcatgtttca

SEQ ID NO: 4884404 - DNA, 23 bp, Homo sapiens
ctgaagcatgtttcatgttttgt

SEQ ID NO: 4884405 - DNA, 14 bp, Homo sapiens
ctgaagccagcctt

SEQ ID NO: 4884406 - DNA, 14 bp, Homo sapiens
ctgaagcctctggg

SEQ ID NO: 4884407 - DNA, 21 bp, Homo sapiens
ctgaagcttcactcactgtca

SEQ ID NO: 4884408 - DNA, 19 bp, Homo sapiens
ctgaaggacattgcggaca

SEQ ID NO: 4884409 - DNA, 20 bp, Homo sapiens
ctgaagggcattctttccca

SEQ ID NO: 4884410 - DNA, 22 bp, Homo sapiens
ctgaaggtggccactttaagag

SEQ ID NO: 4884411 - DNA, 17 bp, Homo sapiens
ctgaagtactaacacaa

SEQ ID NO: 4884412 - DNA, 15 bp, Homo sapiens
ctgaagtcacacagt

SEQ ID NO: 4884413 - DNA, 19 bp, Homo sapiens
ctgaagtcacatcacagga

SEQ ID NO: 4884414 - DNA, 16 bp, Homo sapiens
ctgaagtgcttagtgt

SEQ ID NO: 4884415 - DNA, 14 bp, Homo sapiens
ctgaataaatggta

SEQ ID NO: 4884416 - DNA, 16 bp, Homo sapiens
ctgaatagaaatggga

SEQ ID NO: 4884417 - DNA, 21 bp, Homo sapiens
ctgaatcccccttgccacccc

SEQ ID NO: 4884418 - DNA, 15 bp, Homo sapiens
ctgaatgcctcctgt

SEQ ID NO: 4884419 - DNA, 17 bp, Homo sapiens
ctgaatgcctcctgtgg

SEQ ID NO: 4884420 - DNA, 17 bp, Homo sapiens
ctgaatgtgctgatcat

SEQ ID NO: 4884421 - DNA, 16 bp, Homo sapiens
ctgaatgtttattcct

SEQ ID NO: 4884422 - DNA, 12 bp, Homo sapiens
ctgacaagggct

SEQ ID NO: 4884423 - DNA, 19 bp, Homo sapiens
ctgacaagggctgacctgc

SEQ ID NO: 4884424 - DNA, 20 bp, Homo sapiens
ctgacaagggctgacctgcc

SEQ ID NO: 4884425 - DNA, 15 bp, Homo sapiens
ctgacacacagctct

SEQ ID NO: 4884426 - DNA, 20 bp, Homo sapiens
ctgacacacagctctgtcct

SEQ ID NO: 4884427 - DNA, 10 bp, Homo sapiens
ctgacacagg

SEQ ID NO: 4884428 - DNA, 12 bp, Homo sapiens
ctgacagacaca

SEQ ID NO: 4884429 - DNA, 19 bp, Homo sapiens
ctgacagacacaggcccgg

SEQ ID NO: 4884430 - DNA, 22 bp, Homo sapiens
ctgacagcatgtgccctcctga

SEQ ID NO: 4884431 - DNA, 17 bp, Homo sapiens
ctgacaggcaatgctgg

SEQ ID NO: 4884432 - DNA, 18 bp, Homo sapiens
ctgacaggcaatgctggc

SEQ ID NO: 4884433 - DNA, 21 bp, Homo sapiens
ctgacaggcaatgctggctgt

SEQ ID NO: 4884434 - DNA, 17 bp, Homo sapiens
ctgacatcacagcagcc

SEQ ID NO: 4884435 - DNA, 18 bp, Homo sapiens
ctgacatcacagcagcct

SEQ ID NO: 4884436 - DNA, 16 bp, Homo sapiens
ctgacatctggaatct

SEQ ID NO: 4884437 - DNA, 13 bp, Homo sapiens
ctgacatggctct

SEQ ID NO: 4884438 - DNA, 22 bp, Homo sapiens
ctgacattgttggccaaagcca

SEQ ID NO: 4884439 - DNA, 21 bp, Homo sapiens
ctgacattttctttcatgggc

SEQ ID NO: 4884440 - DNA, 13 bp, Homo sapiens
ctgaccaacaggc

SEQ ID NO: 4884441 - DNA, 20 bp, Homo sapiens
ctgaccaattgtgctgccat

SEQ ID NO: 4884442 - DNA, 21 bp, Homo sapiens
ctgaccagcctccatgctgcc

SEQ ID NO: 4884443 - DNA, 20 bp, Homo sapiens
ctgaccccaaacaccttcca

SEQ ID NO: 4884444 - DNA, 22 bp, Homo sapiens
ctgaccccaaacaccttccagc

SEQ ID NO: 4884445 - DNA, 20 bp, Homo sapiens
ctgaccctactcccttgccc

SEQ ID NO: 4884446 - DNA, 14 bp, Homo sapiens
ctgacccttccaga

SEQ ID NO: 4884447 - DNA, 16 bp, Homo sapiens
ctgacccttccagaca

SEQ ID NO: 4884448 - DNA, 17 bp, Homo sapiens
ctgacccttccagacat

SEQ ID NO: 4884449 - DNA, 15 bp, Homo sapiens
ctgaccttccttcct

SEQ ID NO: 4884450 - DNA, 15 bp, Homo sapiens
ctgcccgcacagcag

SEQ ID NO: 4884451 - DNA, 11 bp, Homo sapiens
ctgcccggctg

SEQ ID NO: 4884452 - DNA, 15 bp, Homo sapiens
ctgcccggctgcgga

SEQ ID NO: 4884453 - DNA, 19 bp, Homo sapiens
ctgcccgggcgcggccagc

SEQ ID NO: 4884454 - DNA, 17 bp, Homo sapiens
ctgccctccttaatttg

SEQ ID NO: 4884455 - DNA, 12 bp, Homo sapiens
ctgccctgagaa

SEQ ID NO: 4884456 - DNA, 21 bp, Homo sapiens
ctgccctgagaagctgctcca

SEQ ID NO: 4884457 - DNA, 15 bp, Homo sapiens
ctgccctggtccagg

SEQ ID NO: 4884458 - DNA, 14 bp, Homo sapiens
ctgccctggtgctg

SEQ ID NO: 4884459 - DNA, 15 bp, Homo sapiens
ctgccctggtgctgc

SEQ ID NO: 4884460 - DNA, 17 bp, Homo sapiens
ctgccctggtgctgcca

SEQ ID NO: 4884461 - DNA, 23 bp, Homo sapiens
ctgccctggtgctgccacacttc

SEQ ID NO: 4884462 - DNA, 21 bp, Homo sapiens
ctgccctgtaccccagcactt

SEQ ID NO: 4884463 - DNA, 16 bp, Homo sapiens
ctgcccttcaccccag

SEQ ID NO: 4884464 - DNA, 19 bp, Homo sapiens
ctgccgccccctcctgaac

SEQ ID NO: 4884465 - DNA, 15 bp, Homo sapiens
ctgccgcctcccagc

SEQ ID NO: 4884466 - DNA, 16 bp, Homo sapiens
ctgccgcctcccagcc

SEQ ID NO: 4884467 - DNA, 19 bp, Homo sapiens
ctgccgtgccgcctgcact

SEQ ID NO: 4884468 - DNA, 18 bp, Homo sapiens
ctgcctcaccgcttccct

SEQ ID NO: 4884469 - DNA, 19 bp, Homo sapiens
ctgcctcagcctcccaaag

SEQ ID NO: 4884470 - DNA, 14 bp, Homo sapiens
ctgcctccagaatg

SEQ ID NO: 4884471 - DNA, 15 bp, Homo sapiens
ctgcctcctcgttcc

SEQ ID NO: 4884472 - DNA, 17 bp, Homo sapiens
ctgcctcctcgttcctt

SEQ ID NO: 4884473 - DNA, 13 bp, Homo sapiens
ctgcctcctcttc

SEQ ID NO: 4884474 - DNA, 14 bp, Homo sapiens
ctgcctcctcttca

SEQ ID NO: 4884475 - DNA, 15 bp, Homo sapiens
ctgcctcctcttcaa

SEQ ID NO: 4884476 - DNA, 15 bp, Homo sapiens
ctgcctcgaactggc

SEQ ID NO: 4884477 - DNA, 17 bp, Homo sapiens
ctgcctcgaactggctg

SEQ ID NO: 4884478 - DNA, 19 bp, Homo sapiens
ctgcctcgaactggctgca

SEQ ID NO: 4884479 - DNA, 20 bp, Homo sapiens
ctgcctcgaactggctgcaa

SEQ ID NO: 4884480 - DNA, 16 bp, Homo sapiens
ctgcctctcacacaca

SEQ ID NO: 4884481 - DNA, 23 bp, Homo sapiens
ctctgcctttgacatttaattta

SEQ ID NO: 4884482 - DNA, 16 bp, Homo sapiens
ctctgcggaccccagc

SEQ ID NO: 4884483 - DNA, 17 bp, Homo sapiens
ctctgcggaccccagct

SEQ ID NO: 4884484 - DNA, 19 bp, Homo sapiens
ctctgcggaccccagctgt

SEQ ID NO: 4884485 - DNA, 18 bp, Homo sapiens
ctctgctccaccacatcc

SEQ ID NO: 4884486 - DNA, 20 bp, Homo sapiens
ctctgctcctctccccagca

SEQ ID NO: 4884487 - DNA, 16 bp, Homo sapiens
ctctgctgacagacac

SEQ ID NO: 4884488 - DNA, 22 bp, Homo sapiens
ctctgctgcctgcccgcacagc

SEQ ID NO: 4884489 - DNA, 16 bp, Homo sapiens
ctctgctgctgtccct

SEQ ID NO: 4884490 - DNA, 15 bp, Homo sapiens
ctctggacaggcatg

SEQ ID NO: 4884491 - DNA, 16 bp, Homo sapiens
ctctggacaggcatgt

SEQ ID NO: 4884492 - DNA, 13 bp, Homo sapiens
ctctggactggct

SEQ ID NO: 4884493 - DNA, 16 bp, Homo sapiens
ctctggactggctaga

SEQ ID NO: 4884494 - DNA, 16 bp, Homo sapiens
ctctggagacagcccc

SEQ ID NO: 4884495 - DNA, 18 bp, Homo sapiens
ctctggagacagccccag

SEQ ID NO: 4884496 - DNA, 24 bp, Homo sapiens
ctctggagacagccccagagcagg

SEQ ID NO: 4884497 - DNA, 21 bp, Homo sapiens
ctctggaggggtgtggctcct

SEQ ID NO: 4884498 - DNA, 20 bp, Homo sapiens
ctctggcattagaattattt

SEQ ID NO: 4884499 - DNA, 14 bp, Homo sapiens
ctctggctagaggc

SEQ ID NO: 4884500 - DNA, 20 bp, Homo sapiens
ctctggctagaggccagccc

SEQ ID NO: 4884501 - DNA, 21 bp, Homo sapiens
ctctggctagaggccagcccc

SEQ ID NO: 4884502 - DNA, 19 bp, Homo sapiens
ctctggctgactaaatttg

SEQ ID NO: 4884503 - DNA, 19 bp, Homo sapiens
ctctggctgtaaggctcta

SEQ ID NO: 4884504 - DNA, 22 bp, Homo sapiens
ctctggctgtaaggctctagat

SEQ ID NO: 4884505 - DNA, 20 bp, Homo sapiens
ctctgggaaatgagaaggca

SEQ ID NO: 4884506 - DNA, 22 bp, Homo sapiens
ctctgggaaatgagaaggcagc

SEQ ID NO: 4884507 - DNA, 19 bp, Homo sapiens
ctctgggcacactctgcca

SEQ ID NO: 4884508 - DNA, 22 bp, Homo sapiens
ctctggggctctagggttgctg

SEQ ID NO: 4884509 - DNA, 18 bp, Homo sapiens
ctctggggtgctgcctga

SEQ ID NO: 4884510 - DNA, 22 bp, Homo sapiens
ctctggtccggacactcctaga

SEQ ID NO: 4884511 - DNA, 13 bp, Homo sapiens
ctctggtgcctcc

SEQ ID NO: 4884512 - DNA, 16 bp, Homo sapiens
ctctggtgcctccaga

SEQ ID NO: 4884513 - DNA, 18 bp, Homo sapiens
ctctgtataaacattaaa

SEQ ID NO: 4884514 - DNA, 14 bp, Homo sapiens
ctctgtcctgcttc

SEQ ID NO: 4884515 - DNA, 15 bp, Homo sapiens
ctctgtcctgcttct

SEQ ID NO: 4884516 - DNA, 14 bp, Homo sapiens
ctctgtcctgggag

SEQ ID NO: 4884517 - DNA, 17 bp, Homo sapiens
ctctgtcgcccagtctg

SEQ ID NO: 4884518 - DNA, 14 bp, Homo sapiens
ctctgtctcatcct

SEQ ID NO: 4884519 - DNA, 17 bp, Homo sapiens
ctctgtctcatcctcct

SEQ ID NO: 4884520 - DNA, 19 bp, Homo sapiens
ctctgtctcatcctcctgg

SEQ ID NO: 4884521 - DNA, 21 bp, Homo sapiens
ctctgtctcatcctcctggaa

SEQ ID NO: 4884522 - DNA, 22 bp, Homo sapiens
ctctgtctgagtaagaaacaga

SEQ ID NO: 4884523 - DNA, 17 bp, Homo sapiens
ctctgtctgcccttcac

SEQ ID NO: 4884524 - DNA, 19 bp, Homo sapiens
ctctgtgacctcaggcact

SEQ ID NO: 4884525 - DNA, 24 bp, Homo sapiens
ctctgtgacctcaggcactagcct

SEQ ID NO: 4884526 - DNA, 22 bp, Homo sapiens
ctctgtgtctaagattctagat

SEQ ID NO: 4884527 - DNA, 17 bp, Homo sapiens
ctctgtgtgcacaaata

SEQ ID NO: 4884528 - DNA, 13 bp, Homo sapiens
ctctgtgtgctcc

SEQ ID NO: 4884529 - DNA, 12 bp, Homo sapiens
ctcttaaagttg

SEQ ID NO: 4884530 - DNA, 14 bp, Homo sapiens
ctcttactgctaac

SEQ ID NO: 4884531 - DNA, 15 bp, Homo sapiens
ctcttagaacattgt

SEQ ID NO: 4884532 - DNA, 11 bp, Homo sapiens
ctcttatctca

SEQ ID NO: 4884533 - DNA, 14 bp, Homo sapiens
ctcttattgcccac

SEQ ID NO: 4884534 - DNA, 15 bp, Homo sapiens
ctcttattgcccacg

SEQ ID NO: 4884535 - DNA, 19 bp, Homo sapiens
ctcttcaccccggcaggcc

SEQ ID NO: 4884536 - DNA, 21 bp, Homo sapiens
ctcttcaccccggcaggccct

SEQ ID NO: 4884537 - DNA, 23 bp, Homo sapiens
ctcttcaccccggcaggccctgc

SEQ ID NO: 4884538 - DNA, 15 bp, Homo sapiens
ctcttcagactctca

SEQ ID NO: 4884539 - DNA, 15 bp, Homo sapiens
ctcttcaggcctccc

SEQ ID NO: 4884540 - DNA, 21 bp, Homo sapiens
ctcttccccagaaaggagact

SEQ ID NO: 4884541 - DNA, 15 bp, Homo sapiens
ctcttcccccttcca

SEQ ID NO: 4884542 - DNA, 16 bp, Homo sapiens
ctcttcctatttttgt

SEQ ID NO: 4884543 - DNA, 14 bp, Homo sapiens
ctcttcctgcccct

SEQ ID NO: 4884544 - DNA, 18 bp, Homo sapiens
ctcttcctgcccctcttt

SEQ ID NO: 4884545 - DNA, 19 bp, Homo sapiens
ctcttcctgcccctctttc

SEQ ID NO: 4884546 - DNA, 18 bp, Homo sapiens
ctcttcgaagccttgcct

SEQ ID NO: 4884547 - DNA, 21 bp, Homo sapiens
ctcttcgcgcccgcccctgca

SEQ ID NO: 4884548 - DNA, 13 bp, Homo sapiens
ctcttcggccctc

SEQ ID NO: 4884549 - DNA, 14 bp, Homo sapiens
ctcttcggccctca

SEQ ID NO: 4884550 - DNA, 17 bp, Homo sapiens
ctcttctattttgtaaa

SEQ ID NO: 4884551 - DNA, 12 bp, Homo sapiens
ctcttctccact

SEQ ID NO: 4884552 - DNA, 14 bp, Homo sapiens
ctcttctccactgg

SEQ ID NO: 4884553 - DNA, 15 bp, Homo sapiens
ctcttctccactgga

SEQ ID NO: 4884554 - DNA, 17 bp, Homo sapiens
ctcttctcccagaatcc

SEQ ID NO: 4884555 - DNA, 22 bp, Homo sapiens
ctcttctcccagaatcccagcc

SEQ ID NO: 4884556 - DNA, 12 bp, Homo sapiens
ctcttctgctcc

SEQ ID NO: 4884557 - DNA, 16 bp, Homo sapiens
ctcttctgctccaccc

SEQ ID NO: 4884558 - DNA, 19 bp, Homo sapiens
ctcttctgctccacccttg

SEQ ID NO: 4884559 - DNA, 19 bp, Homo sapiens
ctcttctggggcaggctgg

SEQ ID NO: 4884560 - DNA, 23 bp, Homo sapiens
ctcttctggggcaggctgggcca

SEQ ID NO: 4884561 - DNA, 24 bp, Homo sapiens
ctcttctttatactgtaatttagt

SEQ ID NO: 4884562 - DNA, 22 bp, Homo sapiens
ctcttgaaaaatgcccatttgc

SEQ ID NO: 4884563 - DNA, 13 bp, Homo sapiens
ctcttgagctggc

SEQ ID NO: 4884564 - DNA, 15 bp, Homo sapiens
ctcttgagctggcct

SEQ ID NO: 4884565 - DNA, 16 bp, Homo sapiens
ctcttgagctggcctc

SEQ ID NO: 4884566 - DNA, 14 bp, Homo sapiens
ctcttgaggccagg

SEQ ID NO: 4884567 - DNA, 13 bp, Homo sapiens
cgctcctgtgtct

SEQ ID NO: 4884568 - DNA, 12 bp, Homo sapiens
cgctctcttcct

SEQ ID NO: 4884569 - DNA, 19 bp, Homo sapiens
cgctctcttttctgtactt

SEQ ID NO: 4884570 - DNA, 18 bp, Homo sapiens
cgctgatacataactaaa

SEQ ID NO: 4884571 - DNA, 21 bp, Homo sapiens
cgctgctccacgcgcttcgac

SEQ ID NO: 4884572 - DNA, 15 bp, Homo sapiens
cgctgctgctgctgc

SEQ ID NO: 4884573 - DNA, 20 bp, Homo sapiens
cgctgctgctgctgcgccct

SEQ ID NO: 4884574 - DNA, 19 bp, Homo sapiens
cgctgggtggtaccctctg

SEQ ID NO: 4884575 - DNA, 22 bp, Homo sapiens
cgctgggtggtaccctctggag

SEQ ID NO: 4884576 - DNA, 16 bp, Homo sapiens
cgctgtgagcccctgg

SEQ ID NO: 4884577 - DNA, 19 bp, Homo sapiens
cgctgtgagcccctggtcc

SEQ ID NO: 4884578 - DNA, 18 bp, Homo sapiens
cgcttccctcctgcccgc

SEQ ID NO: 4884579 - DNA, 12 bp, Homo sapiens
cgcttggctcca

SEQ ID NO: 4884580 - DNA, 21 bp, Homo sapiens
cgcttggctccatgctcctca

SEQ ID NO: 4884581 - DNA, 18 bp, Homo sapiens
cgcttgtggggacccagg

SEQ ID NO: 4884582 - DNA, 22 bp, Homo sapiens
cgcttgtggggacccaggctcc

SEQ ID NO: 4884583 - DNA, 14 bp, Homo sapiens
cgctttctacccag

SEQ ID NO: 4884584 - DNA, 13 bp, Homo sapiens
cggaacagcagat

SEQ ID NO: 4884585 - DNA, 17 bp, Homo sapiens
cggaaggtttttaaaca

SEQ ID NO: 4884586 - DNA, 22 bp, Homo sapiens
cggacaataaacctccgccaat

SEQ ID NO: 4884587 - DNA, 16 bp, Homo sapiens
cggacagccacggcca

SEQ ID NO: 4884588 - DNA, 21 bp, Homo sapiens
cggacagccacggccaggcca

SEQ ID NO: 4884589 - DNA, 13 bp, Homo sapiens
cggaccccagctg

SEQ ID NO: 4884590 - DNA, 14 bp, Homo sapiens
cggaccccagctgt

SEQ ID NO: 4884591 - DNA, 21 bp, Homo sapiens
cggaccttggcagcccaggcc

SEQ ID NO: 4884592 - DNA, 15 bp, Homo sapiens
cggagcatcccggag

SEQ ID NO: 4884593 - DNA, 18 bp, Homo sapiens
cggaggatagtatgagcc

SEQ ID NO: 4884594 - DNA, 19 bp, Homo sapiens
cggaggcaaagctggctca

SEQ ID NO: 4884595 - DNA, 18 bp, Homo sapiens
cggaggccccactgatgc

SEQ ID NO: 4884596 - DNA, 15 bp, Homo sapiens
cggaggggcctggca

SEQ ID NO: 4884597 - DNA, 18 bp, Homo sapiens
cggaggggcctggcagcc

SEQ ID NO: 4884598 - DNA, 22 bp, Homo sapiens
cggaggttgggtgggccggctt

SEQ ID NO: 4884599 - DNA, 18 bp, Homo sapiens
cggatcagagcaggacct

SEQ ID NO: 4884600 - DNA, 19 bp, Homo sapiens
cggatcatcaacaagattt

SEQ ID NO: 4884601 - DNA, 16 bp, Homo sapiens
cggattccagcccaca

SEQ ID NO: 4884602 - DNA, 22 bp, Homo sapiens
cggcaactaagcagtccctgag

SEQ ID NO: 4884603 - DNA, 18 bp, Homo sapiens
cggccaagataggacctt

SEQ ID NO: 4884604 - DNA, 15 bp, Homo sapiens
cggccaatggaaacc

SEQ ID NO: 4884605 - DNA, 12 bp, Homo sapiens
cggccacctctg

SEQ ID NO: 4884606 - DNA, 13 bp, Homo sapiens
cggccacctctgc

SEQ ID NO: 4884607 - DNA, 14 bp, Homo sapiens
cggccacctctgcg

SEQ ID NO: 4884608 - DNA, 12 bp, Homo sapiens
cggccaggccag

SEQ ID NO: 4884609 - DNA, 13 bp, Homo sapiens
cggcccctgctgg

SEQ ID NO: 4884610 - DNA, 12 bp, Homo sapiens
cggccctaaggg

SEQ ID NO: 4884611 - DNA, 12 bp, Homo sapiens
cggccctgcaat

SEQ ID NO: 4884612 - DNA, 22 bp, Homo sapiens
cggccctgggctcggaggctgc

SEQ ID NO: 4884613 - DNA, 21 bp, Homo sapiens
cggcctccgtccaggagcctg

SEQ ID NO: 4884614 - DNA, 22 bp, Homo sapiens
cggcctccgtccaggagcctgg

SEQ ID NO: 4884615 - DNA, 15 bp, Homo sapiens
cggcctgatgctccc

SEQ ID NO: 4884616 - DNA, 19 bp, Homo sapiens
cggcctgatgctccctccc

SEQ ID NO: 4884617 - DNA, 20 bp, Homo sapiens
cggcgaccgccctccgcgaa

SEQ ID NO: 4884618 - DNA, 18 bp, Homo sapiens
cggcgcccctgccacctc

SEQ ID NO: 4884619 - DNA, 22 bp, Homo sapiens
cggcgcgctcttcgcgcccgcc

SEQ ID NO: 4884620 - DNA, 15 bp, Homo sapiens
cggcggaaagcctgt

SEQ ID NO: 4884621 - DNA, 15 bp, Homo sapiens
cggctaagaggctgc

SEQ ID NO: 4884622 - DNA, 12 bp, Homo sapiens
cggctccaggct

SEQ ID NO: 4884623 - DNA, 15 bp, Homo sapiens
cggctccaggctcct

SEQ ID NO: 4884624 - DNA, 20 bp, Homo sapiens
cggctccccatgtgtcctgg

SEQ ID NO: 4884625 - DNA, 16 bp, Homo sapiens
cggctgtgctcagaga

SEQ ID NO: 4884626 - DNA, 15 bp, Homo sapiens
cggcttcatgccagc

SEQ ID NO: 4884627 - DNA, 14 bp, Homo sapiens
cggcttcctttccc

SEQ ID NO: 4884628 - DNA, 15 bp, Homo sapiens
cggcttcctttccca

SEQ ID NO: 4884629 - DNA, 19 bp, Homo sapiens
cggcttcctttcccaagcc

SEQ ID NO: 4884630 - DNA, 20 bp, Homo sapiens
cggcttcgttagaccgctct

SEQ ID NO: 4884631 - DNA, 16 bp, Homo sapiens
cgggaaccaagcagga

SEQ ID NO: 4884632 - DNA, 17 bp, Homo sapiens
cgggaaggtcaccagca

SEQ ID NO: 4884633 - DNA, 17 bp, Homo sapiens
cgggaataaccttccat

SEQ ID NO: 4884634 - DNA, 17 bp, Homo sapiens
cgggagcctaggaccac

SEQ ID NO: 4884635 - DNA, 20 bp, Homo sapiens
cgggaggatgttctgggaca

SEQ ID NO: 4884636 - DNA, 16 bp, Homo sapiens
cgggcctggagaacta

SEQ ID NO: 4884637 - DNA, 14 bp, Homo sapiens
cgggctctctgctg

SEQ ID NO: 4884638 - DNA, 18 bp, Homo sapiens
cggggtggtgggaaccat

SEQ ID NO: 4884639 - DNA, 17 bp, Homo sapiens
cgggtcccttcacctcc

SEQ ID NO: 4884640 - DNA, 17 bp, Homo sapiens
cggtagggaggcagcct

SEQ ID NO: 4884641 - DNA, 18 bp, Homo sapiens
cggtcaggtttaacattt

SEQ ID NO: 4884642 - DNA, 14 bp, Homo sapiens
cggtccacccagga

SEQ ID NO: 4884643 - DNA, 15 bp, Homo sapiens
cggtccacccaggag

SEQ ID NO: 4884644 - DNA, 13 bp, Homo sapiens
cggtccagctggc

SEQ ID NO: 4884645 - DNA, 15 bp, Homo sapiens
cggtccagctggcct

SEQ ID NO: 4884646 - DNA, 16 bp, Homo sapiens
cggtccagctggcctg

SEQ ID NO: 4884647 - DNA, 16 bp, Homo sapiens
cggtcccacccctccc

SEQ ID NO: 4884648 - DNA, 11 bp, Homo sapiens
cggtctcaggc

SEQ ID NO: 4884649 - DNA, 20 bp, Homo sapiens
cggtggctcaggcctataac

SEQ ID NO: 4884650 - DNA, 13 bp, Homo sapiens
cggtgttctaaga

SEQ ID NO: 4884651 - DNA, 16 bp, Homo sapiens
cggtttctttttaagt

SEQ ID NO: 4884652 - DNA, 17 bp, Homo sapiens
cgtacattcaatgttta

SEQ ID NO: 4884653 - DNA, 11 bp, Homo sapiens
cgtatgaaaat

SEQ ID NO: 4884654 - DNA, 22 bp, Homo sapiens
cgtattttaaaagccacataga

SEQ ID NO: 4884655 - DNA, 16 bp, Homo sapiens
cgtcagggttggtgtg

SEQ ID NO: 4884656 - DNA, 21 bp, Homo sapiens
cgtccagccgccattgccacc

SEQ ID NO: 4884657 - DNA, 21 bp, Homo sapiens
cgtccaggccgcgccctttcc

SEQ ID NO: 4884658 - DNA, 18 bp, Homo sapiens
cgtctgaagcttgactcc

SEQ ID NO: 4884659 - DNA, 22 bp, Homo sapiens
cgtctgacaggcaatgctggct

SEQ ID NO: 4884660 - DNA, 21 bp, Homo sapiens
cgtcttccgcccctgcctgcc

SEQ ID NO: 4884661 - DNA, 15 bp, Homo sapiens
cgtgaaaacggagct

SEQ ID NO: 4884662 - DNA, 12 bp, Homo sapiens
cgtgagaagcat

SEQ ID NO: 4884663 - DNA, 20 bp, Homo sapiens
cgtgagcaggaaggcctggg

SEQ ID NO: 4884664 - DNA, 21 bp, Homo sapiens
cgtgagcaggaaggcctgggt

SEQ ID NO: 4884665 - DNA, 22 bp, Homo sapiens
cgtgagccactgcaccgggcca

SEQ ID NO: 4884666 - DNA, 21 bp, Homo sapiens
cgtgagcgcctgtgcacacac

SEQ ID NO: 4884667 - DNA, 19 bp, Homo sapiens
cgtgcattagcacagattt

SEQ ID NO: 4884668 - DNA, 20 bp, Homo sapiens
cgtgccaaagtctcccttct

SEQ ID NO: 4884669 - DNA, 15 bp, Homo sapiens
cgtgccgcctgcact

SEQ ID NO: 4884670 - DNA, 19 bp, Homo sapiens
ctagaatctgcaattcaaa

SEQ ID NO: 4884671 - DNA, 21 bp, Homo sapiens
ctagaatttatcacacttctg

SEQ ID NO: 4884672 - DNA, 15 bp, Homo sapiens
ctagacaagatattg

SEQ ID NO: 4884673 - DNA, 18 bp, Homo sapiens
ctagacaagatattgtac

SEQ ID NO: 4884674 - DNA, 17 bp, Homo sapiens
ctagacaccaaagttct

SEQ ID NO: 4884675 - DNA, 18 bp, Homo sapiens
ctagacatggaggttcta

SEQ ID NO: 4884676 - DNA, 14 bp, Homo sapiens
ctagagaagataat

SEQ ID NO: 4884677 - DNA, 15 bp, Homo sapiens
ctagagaagataatt

SEQ ID NO: 4884678 - DNA, 17 bp, Homo sapiens
ctagagaagataattgt

SEQ ID NO: 4884679 - DNA, 21 bp, Homo sapiens
ctagagaagataattgttgaa

SEQ ID NO: 4884680 - DNA, 13 bp, Homo sapiens
ctagagcctgcct

SEQ ID NO: 4884681 - DNA, 15 bp, Homo sapiens
ctagagcctgcctgg

SEQ ID NO: 4884682 - DNA, 19 bp, Homo sapiens
ctagagcctgcctggagcg

SEQ ID NO: 4884683 - DNA, 23 bp, Homo sapiens
ccttcctataacttgatgcatgt

SEQ ID NO: 4884684 - DNA, 18 bp, Homo sapiens
ccttcctcatccacccca

SEQ ID NO: 4884685 - DNA, 20 bp, Homo sapiens
ccttcctcatccaccccatc

SEQ ID NO: 4884686 - DNA, 14 bp, Homo sapiens
ccttcctctccact

SEQ ID NO: 4884687 - DNA, 17 bp, Homo sapiens
ccttcctctccactgcc

SEQ ID NO: 4884688 - DNA, 20 bp, Homo sapiens
ccttcctctccactgccttc

SEQ ID NO: 4884689 - DNA, 21 bp, Homo sapiens
ccttcctctccactgccttcg

SEQ ID NO: 4884690 - DNA, 17 bp, Homo sapiens
ccttcctctctccagat

SEQ ID NO: 4884691 - DNA, 22 bp, Homo sapiens
ccttcgatacaccgggcctgga

SEQ ID NO: 4884692 - DNA, 14 bp, Homo sapiens
ccttcgctcctgtg

SEQ ID NO: 4884693 - DNA, 17 bp, Homo sapiens
ccttcgtgaacatcccc

SEQ ID NO: 4884694 - DNA, 15 bp, Homo sapiens
ccttctactgagcct

SEQ ID NO: 4884695 - DNA, 16 bp, Homo sapiens
ccttctctatatcatg

SEQ ID NO: 4884696 - DNA, 17 bp, Homo sapiens
ccttctctgaacacagg

SEQ ID NO: 4884697 - DNA, 19 bp, Homo sapiens
ccttctctgaacacaggca

SEQ ID NO: 4884698 - DNA, 14 bp, Homo sapiens
ccttctctgctcca

SEQ ID NO: 4884699 - DNA, 16 bp, Homo sapiens
ccttctctgctccacc

SEQ ID NO: 4884700 - DNA, 20 bp, Homo sapiens
ccttctctgctccaccacat

SEQ ID NO: 4884701 - DNA, 16 bp, Homo sapiens
ccttctgacggccctg

SEQ ID NO: 4884702 - DNA, 12 bp, Homo sapiens
ccttctggcctt

SEQ ID NO: 4884703 - DNA, 13 bp, Homo sapiens
ccttctggccttt

SEQ ID NO: 4884704 - DNA, 19 bp, Homo sapiens
ccttcttccatcccaggac

SEQ ID NO: 4884705 - DNA, 23 bp, Homo sapiens
ccttctttcactctgtcatcttt

SEQ ID NO: 4884706 - DNA, 14 bp, Homo sapiens
ccttctttgaagaa

SEQ ID NO: 4884707 - DNA, 15 bp, Homo sapiens
ccttctttgaagaag

SEQ ID NO: 4884708 - DNA, 13 bp, Homo sapiens
ccttctttgataa

SEQ ID NO: 4884709 - DNA, 19 bp, Homo sapiens
ccttctttgataatgttaa

SEQ ID NO: 4884710 - DNA, 22 bp, Homo sapiens
ccttcttttatgagcagaagga

SEQ ID NO: 4884711 - DNA, 16 bp, Homo sapiens
ccttgaactgggtact

SEQ ID NO: 4884712 - DNA, 12 bp, Homo sapiens
ccttgaatgctg

SEQ ID NO: 4884713 - DNA, 20 bp, Homo sapiens
ccttgaatgctgccagtgtg

SEQ ID NO: 4884714 - DNA, 22 bp, Homo sapiens
ccttgaatgctgccagtgtgga

SEQ ID NO: 4884715 - DNA, 15 bp, Homo sapiens
ccttgacagggcaca

SEQ ID NO: 4884716 - DNA, 18 bp, Homo sapiens
ccttgacagggcacaccg

SEQ ID NO: 4884717 - DNA, 21 bp, Homo sapiens
ccttgacagggcacaccgggc

SEQ ID NO: 4884718 - DNA, 21 bp, Homo sapiens
ccttgactggacctggtggct

SEQ ID NO: 4884719 - DNA, 22 bp, Homo sapiens
ccttgagtggggttatctctgt

SEQ ID NO: 4884720 - DNA, 17 bp, Homo sapiens
ccttgcacccctcactc

SEQ ID NO: 4884721 - DNA, 13 bp, Homo sapiens
ccttgcagaactg

SEQ ID NO: 4884722 - DNA, 14 bp, Homo sapiens
ccttgcagaactgc

SEQ ID NO: 4884723 - DNA, 17 bp, Homo sapiens
ccttgcagaactgccat

SEQ ID NO: 4884724 - DNA, 17 bp, Homo sapiens
ccttgcagttcagcacc

SEQ ID NO: 4884725 - DNA, 19 bp, Homo sapiens
ccttgcagttcagcaccac

SEQ ID NO: 4884726 - DNA, 17 bp, Homo sapiens
ccttgccaccccaccct

SEQ ID NO: 4884727 - DNA, 23 bp, Homo sapiens
ccttgccaccccaccctccctgg

SEQ ID NO: 4884728 - DNA, 20 bp, Homo sapiens
ccttgctctcccctgccctg

SEQ ID NO: 4884729 - DNA, 16 bp, Homo sapiens
ccttgctgtcctgatc

SEQ ID NO: 4884730 - DNA, 17 bp, Homo sapiens
ccttgcttttccctctt

SEQ ID NO: 4884731 - DNA, 18 bp, Homo sapiens
ccttgcttttccctcttt

SEQ ID NO: 4884732 - DNA, 19 bp, Homo sapiens
ccttgcttttccctctttt

SEQ ID NO: 4884733 - DNA, 16 bp, Homo sapiens
ccttggcatagacatg

SEQ ID NO: 4884734 - DNA, 20 bp, Homo sapiens
ccttggcctagcccaccctg

SEQ ID NO: 4884735 - DNA, 13 bp, Homo sapiens
ccttggcctcaga

SEQ ID NO: 4884736 - DNA, 15 bp, Homo sapiens
ccttggctcagacat

SEQ ID NO: 4884737 - DNA, 13 bp, Homo sapiens
ccttggctgcagg

SEQ ID NO: 4884738 - DNA, 21 bp, Homo sapiens
ccttggctgtgaggcccctgg

SEQ ID NO: 4884739 - DNA, 17 bp, Homo sapiens
ccttggcttctgtgatg

SEQ ID NO: 4884740 - DNA, 19 bp, Homo sapiens
ccttggggaggacaaaact

SEQ ID NO: 4884741 - DNA, 17 bp, Homo sapiens
ccttggtctttgtatct

SEQ ID NO: 4884742 - DNA, 20 bp, Homo sapiens
ccttgtctcctactcctgac

SEQ ID NO: 4884743 - DNA, 17 bp, Homo sapiens
ccttgtgaccttctcta

SEQ ID NO: 4884744 - DNA, 12 bp, Homo sapiens
ccttgtggcaga

SEQ ID NO: 4884745 - DNA, 16 bp, Homo sapiens
ccttgtggcagaggat

SEQ ID NO: 4884746 - DNA, 20 bp, Homo sapiens
ccttgtttatcagatacatc

SEQ ID NO: 4884747 - DNA, 20 bp, Homo sapiens
cctttaaaaaaatttaagtg

SEQ ID NO: 4884748 - DNA, 19 bp, Homo sapiens
cctttaattaagactgaaa

SEQ ID NO: 4884749 - DNA, 13 bp, Homo sapiens
cctttactttccc

SEQ ID NO: 4884750 - DNA, 14 bp, Homo sapiens
cctttactttccct

SEQ ID NO: 4884751 - DNA, 14 bp, Homo sapiens
cctttagcgcccag

SEQ ID NO: 4884752 - DNA, 13 bp, Homo sapiens
cctttaggttctt

SEQ ID NO: 4884753 - DNA, 18 bp, Homo sapiens
cctttagtacctgaaaag

SEQ ID NO: 4884754 - DNA, 19 bp, Homo sapiens
cctttatgtggaaaacaga

SEQ ID NO: 4884755 - DNA, 23 bp, Homo sapiens
cctttatgtggaaaacagaacat

SEQ ID NO: 4884756 - DNA, 23 bp, Homo sapiens
cctttattaccccctccttcaga

SEQ ID NO: 4884757 - DNA, 17 bp, Homo sapiens
cctttccccagcatcac

SEQ ID NO: 4884758 - DNA, 14 bp, Homo sapiens
cctttccccagccc

SEQ ID NO: 4884759 - DNA, 12 bp, Homo sapiens
cctttcccttcc

SEQ ID NO: 4884760 - DNA, 17 bp, Homo sapiens
cctttcctcctttatca

SEQ ID NO: 4884761 - DNA, 15 bp, Homo sapiens
cctttccttcctaat

SEQ ID NO: 4884762 - DNA, 12 bp, Homo sapiens
cctttctccagg

SEQ ID NO: 4884763 - DNA, 18 bp, Homo sapiens
cctttctctttctctctt

SEQ ID NO: 4884764 - DNA, 14 bp, Homo sapiens
cctttctgtgccct

SEQ ID NO: 4884765 - DNA, 13 bp, Homo sapiens
cctttctgtgtgc

SEQ ID NO: 4884766 - DNA, 17 bp, Homo sapiens
cctttgaaacctgctct

SEQ ID NO: 4884767 - DNA, 14 bp, Homo sapiens
cctttgaagcctca

SEQ ID NO: 4884768 - DNA, 14 bp, Homo sapiens
cctttgacatttaa

SEQ ID NO: 4884769 - DNA, 15 bp, Homo sapiens
cctttgagacagttt

SEQ ID NO: 4884770 - DNA, 14 bp, Homo sapiens
cctttgcacaggat

SEQ ID NO: 4884771 - DNA, 17 bp, Homo sapiens
cctttgcagggcagccc

SEQ ID NO: 4884772 - DNA, 11 bp, Homo sapiens
cctttgcccct

SEQ ID NO: 4884773 - DNA, 14 bp, Homo sapiens
cctttggctctgga

SEQ ID NO: 4884774 - DNA, 16 bp, Homo sapiens
cctttggctctggaga

SEQ ID NO: 4884775 - DNA, 17 bp, Homo sapiens
cctttggtcctgtcccc

SEQ ID NO: 4884776 - DNA, 12 bp, Homo sapiens
cctttgtctttc

SEQ ID NO: 4884777 - DNA, 15 bp, Homo sapiens
cctttgtctttcaaa

SEQ ID NO: 4884778 - DNA, 19 bp, Homo sapiens
ccttttaaagtgtttcagc

SEQ ID NO: 4884779 - DNA, 22 bp, Homo sapiens
ccttttataggtgagaaaaaaa

SEQ ID NO: 4884780 - DNA, 14 bp, Homo sapiens
ccttttcttttgtt

SEQ ID NO: 4884781 - DNA, 19 bp, Homo sapiens
ccttttcttttgttactgt

SEQ ID NO: 4884782 - DNA, 19 bp, Homo sapiens
ccttttgtatacatcctgg

SEQ ID NO: 4884783 - DNA, 23 bp, Homo sapiens
ccttttgtatacatcctgggtaa

SEQ ID NO: 4884784 - DNA, 19 bp, Homo sapiens
cctttttcctagcctgttt

SEQ ID NO: 4884785 - DNA, 13 bp, Homo sapiens
cctttttctgatt

SEQ ID NO: 4884786 - DNA, 18 bp, Homo sapiens
ccttttttaagatttttc

SEQ ID NO: 4884787 - DNA, 21 bp, Homo sapiens
ccttttttaagatttttctca

SEQ ID NO: 4884788 - DNA, 15 bp, Homo sapiens
cgaaaagagtcttcc

SEQ ID NO: 4884789 - DNA, 17 bp, Homo sapiens
cgaaacttgttattgtg

SEQ ID NO: 4884790 - DNA, 21 bp, Homo sapiens
cgaaacttgttattgtgaatg

SEQ ID NO: 4884791 - DNA, 23 bp, Homo sapiens
cgaaagagagagaaacaaacttt

SEQ ID NO: 4884792 - DNA, 20 bp, Homo sapiens
cgaaataacaatgttaagga

SEQ ID NO: 4884793 - DNA, 14 bp, Homo sapiens
ccatagtagtatga

SEQ ID NO: 4884794 - DNA, 15 bp, Homo sapiens
ccatagtcacatggc

SEQ ID NO: 4884795 - DNA, 23 bp, Homo sapiens
ccatataagtttgaaggaaacag

SEQ ID NO: 4884796 - DNA, 16 bp, Homo sapiens
ccatatataacagata

SEQ ID NO: 4884797 - DNA, 23 bp, Homo sapiens
ccatattctgttggccagtgtga

SEQ ID NO: 4884798 - DNA, 21 bp, Homo sapiens
ccatattgtgcttcacagtag

SEQ ID NO: 4884799 - DNA, 14 bp, Homo sapiens
ccatatttagcagt

SEQ ID NO: 4884800 - DNA, 21 bp, Homo sapiens
ccatatttatccatttgtaat

SEQ ID NO: 4884801 - DNA, 12 bp, Homo sapiens
ccatatttattc

SEQ ID NO: 4884802 - DNA, 14 bp, Homo sapiens
ccatatttggaaga

SEQ ID NO: 4884803 - DNA, 19 bp, Homo sapiens
ccatcaaaatgctttttat

SEQ ID NO: 4884804 - DNA, 18 bp, Homo sapiens
ccatcaccctcttcctgt

SEQ ID NO: 4884805 - DNA, 12 bp, Homo sapiens
ccatcatgtctg

SEQ ID NO: 4884806 - DNA, 13 bp, Homo sapiens
ccatcatgtctgg

SEQ ID NO: 4884807 - DNA, 19 bp, Homo sapiens
ccatccaggttcagcttgt

SEQ ID NO: 4884808 - DNA, 16 bp, Homo sapiens
ccatcccacaccctgg

SEQ ID NO: 4884809 - DNA, 15 bp, Homo sapiens
ccatccctgcctggt

SEQ ID NO: 4884810 - DNA, 16 bp, Homo sapiens
ccatccctgcctggtc

SEQ ID NO: 4884811 - DNA, 19 bp, Homo sapiens
ccatcctatccactgggca

SEQ ID NO: 4884812 - DNA, 13 bp, Homo sapiens
ccatcctggctgc

SEQ ID NO: 4884813 - DNA, 16 bp, Homo sapiens
ccatctcccaccctgt

SEQ ID NO: 4884814 - DNA, 21 bp, Homo sapiens
ccatctcctataatctgtcaa

SEQ ID NO: 4884815 - DNA, 14 bp, Homo sapiens
ccatctctccctcc

SEQ ID NO: 4884816 - DNA, 23 bp, Homo sapiens
ccatctctgattttcaaagcttt

SEQ ID NO: 4884817 - DNA, 23 bp, Homo sapiens
ccatctgcttttattaaatttgt

SEQ ID NO: 4884818 - DNA, 15 bp, Homo sapiens
ccatctggcctggcc

SEQ ID NO: 4884819 - DNA, 18 bp, Homo sapiens
ccatctgggtccttgcac

SEQ ID NO: 4884820 - DNA, 23 bp, Homo sapiens
ccatctgggtccttgcacccctc

SEQ ID NO: 4884821 - DNA, 13 bp, Homo sapiens
ccatgaaacaaag

SEQ ID NO: 4884822 - DNA, 12 bp, Homo sapiens
ccatgaagacag

SEQ ID NO: 4884823 - DNA, 14 bp, Homo sapiens
ccatgaagacagga

SEQ ID NO: 4884824 - DNA, 12 bp, Homo sapiens
ccatgaagcctt

SEQ ID NO: 4884825 - DNA, 21 bp, Homo sapiens
ccatgacaggcctgaagatat

SEQ ID NO: 4884826 - DNA, 22 bp, Homo sapiens
ccatgagaataagagaaagaaa

SEQ ID NO: 4884827 - DNA, 13 bp, Homo sapiens
ccatgagcctcag

SEQ ID NO: 4884828 - DNA, 18 bp, Homo sapiens
ccatgagcctcagcatcc

SEQ ID NO: 4884829 - DNA, 18 bp, Homo sapiens
ccatgagtttgccctggt

SEQ ID NO: 4884830 - DNA, 12 bp, Homo sapiens
ccatgcaccaaa

SEQ ID NO: 4884831 - DNA, 13 bp, Homo sapiens
ccatgcaggccct

SEQ ID NO: 4884832 - DNA, 18 bp, Homo sapiens
ccatgcatgacagcctct

SEQ ID NO: 4884833 - DNA, 20 bp, Homo sapiens
ccatgcatttcataaactaa

SEQ ID NO: 4884834 - DNA, 20 bp, Homo sapiens
ccatgccaaagctagggtgg

SEQ ID NO: 4884835 - DNA, 13 bp, Homo sapiens
ccatgccacgttc

SEQ ID NO: 4884836 - DNA, 18 bp, Homo sapiens
ccatgcccacctgcccat

SEQ ID NO: 4884837 - DNA, 22 bp, Homo sapiens
ccatgcctgcccccctcatctc

SEQ ID NO: 4884838 - DNA, 16 bp, Homo sapiens
ccatgctcctcactgc

SEQ ID NO: 4884839 - DNA, 21 bp, Homo sapiens
ccatgctcctcactgcccgca

SEQ ID NO: 4884840 - DNA, 22 bp, Homo sapiens
ccatgctcctcactgcccgcac

SEQ ID NO: 4884841 - DNA, 21 bp, Homo sapiens
ccatgctgggaagacgcctga

SEQ ID NO: 4884842 - DNA, 22 bp, Homo sapiens
ccatgcttctcatcttgtgaaa

SEQ ID NO: 4884843 - DNA, 14 bp, Homo sapiens
ccatggacactcca

SEQ ID NO: 4884844 - DNA, 14 bp, Homo sapiens
ccatggactttata

SEQ ID NO: 4884845 - DNA, 18 bp, Homo sapiens
ccatggagccagctccct

SEQ ID NO: 4884846 - DNA, 22 bp, Homo sapiens
ccatggagccagctccctctat

SEQ ID NO: 4884847 - DNA, 22 bp, Homo sapiens
ccatgggagctggttagaaatg

SEQ ID NO: 4884848 - DNA, 16 bp, Homo sapiens
ccatgggatacaacct

SEQ ID NO: 4884849 - DNA, 14 bp, Homo sapiens
ccatgggcctcctg

SEQ ID NO: 4884850 - DNA, 20 bp, Homo sapiens
ccatgggcttcactgtataa

SEQ ID NO: 4884851 - DNA, 23 bp, Homo sapiens
ccatggggacgccctcagtctag

SEQ ID NO: 4884852 - DNA, 23 bp, Homo sapiens
ccatgtaaataccagactgcagg

SEQ ID NO: 4884853 - DNA, 17 bp, Homo sapiens
ccatgtacctcccctgc

SEQ ID NO: 4884854 - DNA, 22 bp, Homo sapiens
ccatgtatttatctctatttaa

SEQ ID NO: 4884855 - DNA, 20 bp, Homo sapiens
ccatgtccaaagaggctgcc

SEQ ID NO: 4884856 - DNA, 12 bp, Homo sapiens
ccatgtcgcctc

SEQ ID NO: 4884857 - DNA, 17 bp, Homo sapiens
ccatgtcgcctctgcat

SEQ ID NO: 4884858 - DNA, 15 bp, Homo sapiens
ccatgtctttctcca

SEQ ID NO: 4884859 - DNA, 13 bp, Homo sapiens
ccatgtgccaggt

SEQ ID NO: 4884860 - DNA, 19 bp, Homo sapiens
ccatgtgtcacttgtgctt

SEQ ID NO: 4884861 - DNA, 17 bp, Homo sapiens
ccatgtgtcctggttcc

SEQ ID NO: 4884862 - DNA, 22 bp, Homo sapiens
ccatgttcacaccgctgcactc

SEQ ID NO: 4884863 - DNA, 16 bp, Homo sapiens
ccatgttctgccccca

SEQ ID NO: 4884864 - DNA, 15 bp, Homo sapiens
ccatgttggccaggc

SEQ ID NO: 4884865 - DNA, 21 bp, Homo sapiens
ccatgttggccaggctggtct

SEQ ID NO: 4884866 - DNA, 20 bp, Homo sapiens
ccatgttgtaatgctgcact

SEQ ID NO: 4884867 - DNA, 15 bp, Homo sapiens
ccattaaaactgctt

SEQ ID NO: 4884868 - DNA, 13 bp, Homo sapiens
ccattaaagtctg

SEQ ID NO: 4884869 - DNA, 18 bp, Homo sapiens
ccattaatcatttcccca

SEQ ID NO: 4884870 - DNA, 19 bp, Homo sapiens
ccattcacaataaaagctt

SEQ ID NO: 4884871 - DNA, 14 bp, Homo sapiens
ccattccaaagctt

SEQ ID NO: 4884872 - DNA, 22 bp, Homo sapiens
ccattccaaagctttattacca

SEQ ID NO: 4884873 - DNA, 18 bp, Homo sapiens
ccattctcatctgcaccc

SEQ ID NO: 4884874 - DNA, 16 bp, Homo sapiens
ccattctgcctgccca

SEQ ID NO: 4884875 - DNA, 20 bp, Homo sapiens
ccattctgcctgcccaggcc

SEQ ID NO: 4884876 - DNA, 21 bp, Homo sapiens
ccattctgcctgcccaggccc

SEQ ID NO: 4884877 - DNA, 23 bp, Homo sapiens
ccattcttacttactaaaatata

SEQ ID NO: 4884878 - DNA, 19 bp, Homo sapiens
ccattcttcctagttttct

SEQ ID NO: 4884879 - DNA, 15 bp, Homo sapiens
ccattgccaccagga

SEQ ID NO: 4884880 - DNA, 16 bp, Homo sapiens
ccattgccaccaggag

SEQ ID NO: 4884881 - DNA, 17 bp, Homo sapiens
ccattgccaccaggaga

SEQ ID NO: 4884882 - DNA, 14 bp, Homo sapiens
ccatttaaaaagtt

SEQ ID NO: 4884883 - DNA, 18 bp, Homo sapiens
ccatttatatatgaaaac

SEQ ID NO: 4884884 - DNA, 17 bp, Homo sapiens
ccatttcaattctcaaa

SEQ ID NO: 4884885 - DNA, 13 bp, Homo sapiens
ccatttcagagag

SEQ ID NO: 4884886 - DNA, 13 bp, Homo sapiens
ccatttctccgtt

SEQ ID NO: 4884887 - DNA, 18 bp, Homo sapiens
ccatttgctactgtacat

SEQ ID NO: 4884888 - DNA, 20 bp, Homo sapiens
ccatttgctactgtacataa

SEQ ID NO: 4884889 - DNA, 12 bp, Homo sapiens
ccatttgtaaaa

SEQ ID NO: 4884890 - DNA, 13 bp, Homo sapiens
ccatttgtaaaac

SEQ ID NO: 4884891 - DNA, 16 bp, Homo sapiens
ccatttgtgccagagg

SEQ ID NO: 4884892 - DNA, 18 bp, Homo sapiens
ccattttcctacaggcag

SEQ ID NO: 4884893 - DNA, 22 bp, Homo sapiens
ccattttggggtacccactgct

SEQ ID NO: 4884894 - DNA, 14 bp, Homo sapiens
cccaaaacaaagtc

SEQ ID NO: 4884895 - DNA, 19 bp, Homo sapiens
cccaaacaccttccagctc

SEQ ID NO: 4884896 - DNA, 16 bp, Homo sapiens
cccaaagtgctgggat

SEQ ID NO: 4884897 - DNA, 18 bp, Homo sapiens
cccaaataacttcagtcc

SEQ ID NO: 4884898 - DNA, 21 bp, Homo sapiens
cccaaataacttcagtcctgc

SEQ ID NO: 4884899 - DNA, 23 bp, Homo sapiens
cccaaattagggcaattggaaca

SEQ ID NO: 4884900 - DNA, 12 bp, Homo sapiens
cccaacccccac

SEQ ID NO: 4884901 - DNA, 23 bp, Homo sapiens
cccaacctgctctcctcttgcca

SEQ ID NO: 4884902 - DNA, 15 bp, Homo sapiens
cccaacgcacaggaa

SEQ ID NO: 4884903 - DNA, 11 bp, Homo sapiens
aaaaaaaagct

SEQ ID NO: 4884904 - DNA, 13 bp, Homo sapiens
aaaaaaacacaaa

SEQ ID NO: 4884905 - DNA, 10 bp, Homo sapiens
aaaaaaagaa

SEQ ID NO: 4884906 - DNA, 13 bp, Homo sapiens
aaaaaaagacaag

SEQ ID NO: 4884907 - DNA, 11 bp, Homo sapiens
aaaaaaagctt

SEQ ID NO: 4884908 - DNA, 10 bp, Homo sapiens
aaaaaagaaa

SEQ ID NO: 4884909 - DNA, 20 bp, Homo sapiens
aaaaaagtttacaagtgtat

SEQ ID NO: 4884910 - DNA, 9 bp, Homo sapiens
aaaaaatag

SEQ ID NO: 4884911 - DNA, 21 bp, Homo sapiens
aaaaaatagatgtcttttata

SEQ ID NO: 4884912 - DNA, 14 bp, Homo sapiens
aaaaaatcatctat

SEQ ID NO: 4884913 - DNA, 11 bp, Homo sapiens
aaaaaatcttc

SEQ ID NO: 4884914 - DNA, 11 bp, Homo sapiens
aaaaaattaag

SEQ ID NO: 4884915 - DNA, 12 bp, Homo sapiens
aaaaaatttaag

SEQ ID NO: 4884916 - DNA, 18 bp, Homo sapiens
aaaaacacctagctttat

SEQ ID NO: 4884917 - DNA, 16 bp, Homo sapiens
aaaaacatagaaaaat

SEQ ID NO: 4884918 - DNA, 15 bp, Homo sapiens
aaaaacatattcttg

SEQ ID NO: 4884919 - DNA, 20 bp, Homo sapiens
aaaaactaaatctctaatat

SEQ ID NO: 4884920 - DNA, 15 bp, Homo sapiens
aaaaactctttattt

SEQ ID NO: 4884921 - DNA, 15 bp, Homo sapiens
aaaaagaaatgacta

SEQ ID NO: 4884922 - DNA, 11 bp, Homo sapiens
aaaaagaagaa

SEQ ID NO: 4884923 - DNA, 13 bp, Homo sapiens
aaaaagattcttt

SEQ ID NO: 4884924 - DNA, 20 bp, Homo sapiens
aaaaagcctgcaatttcata

SEQ ID NO: 4884925 - DNA, 18 bp, Homo sapiens
aaaaagctcatattttgt

SEQ ID NO: 4884926 - DNA, 21 bp, Homo sapiens
aaaaagctcatttcatgctct

SEQ ID NO: 4884927 - DNA, 14 bp, Homo sapiens
aaaaagctttttcc

SEQ ID NO: 4884928 - DNA, 21 bp, Homo sapiens
aaaaaggccagtggaaattca

SEQ ID NO: 4884929 - DNA, 16 bp, Homo sapiens
aaaaagtgacacagca

SEQ ID NO: 4884930 - DNA, 17 bp, Homo sapiens
aaaaagtgacacagcag

SEQ ID NO: 4884931 - DNA, 19 bp, Homo sapiens
aaaaagtgacacagcagct

SEQ ID NO: 4884932 - DNA, 15 bp, Homo sapiens
aaaaagtggggcaga

SEQ ID NO: 4884933 - DNA, 13 bp, Homo sapiens
aaaaagtgtttat

SEQ ID NO: 4884934 - DNA, 13 bp, Homo sapiens
aaaaagttccttc

SEQ ID NO: 4884935 - DNA, 14 bp, Homo sapiens
aaaaagtttccata

SEQ ID NO: 4884936 - DNA, 13 bp, Homo sapiens
aaaaatacaaaat

SEQ ID NO: 4884937 - DNA, 14 bp, Homo sapiens
aaaaatacatgcat

SEQ ID NO: 4884938 - DNA, 14 bp, Homo sapiens
aaaaatacatgttc

SEQ ID NO: 4884939 - DNA, 18 bp, Homo sapiens
aaaaatagatgtctttta

SEQ ID NO: 4884940 - DNA, 15 bp, Homo sapiens
aaaaatatatactaa

SEQ ID NO: 4884941 - DNA, 15 bp, Homo sapiens
aaaaatatatttaat

SEQ ID NO: 4884942 - DNA, 20 bp, Homo sapiens
aaaaatatggaacttctaat

SEQ ID NO: 4884943 - DNA, 17 bp, Homo sapiens
aaaaatcacaaaaattt

SEQ ID NO: 4884944 - DNA, 12 bp, Homo sapiens
aaaaatcatcta

SEQ ID NO: 4884945 - DNA, 17 bp, Homo sapiens
aaaaatcatctattttg

SEQ ID NO: 4884946 - DNA, 20 bp, Homo sapiens
aaaaatcttgtgctagaata

SEQ ID NO: 4884947 - DNA, 15 bp, Homo sapiens
aaaaatgaatgtcta

SEQ ID NO: 4884948 - DNA, 18 bp, Homo sapiens
aaaaatgcccttaaatca

SEQ ID NO: 4884949 - DNA, 12 bp, Homo sapiens
aaaaatgccttt

SEQ ID NO: 4884950 - DNA, 22 bp, Homo sapiens
aaaaatgcctttgagacagttt

SEQ ID NO: 4884951 - DNA, 23 bp, Homo sapiens
aaaaatggatattattagaaatt

SEQ ID NO: 4884952 - DNA, 18 bp, Homo sapiens
aaaaatgtcctgcctttt

SEQ ID NO: 4884953 - DNA, 18 bp, Homo sapiens
aaaaattactaattttac

SEQ ID NO: 4884954 - DNA, 19 bp, Homo sapiens
aaaaattatctatagctaa

SEQ ID NO: 4884955 - DNA, 13 bp, Homo sapiens
aaaaatttaagtg

SEQ ID NO: 4884956 - DNA, 14 bp, Homo sapiens
aaaacaaaactata

SEQ ID NO: 4884957 - DNA, 15 bp, Homo sapiens
aaaacaagaatgaaa

SEQ ID NO: 4884958 - DNA, 22 bp, Homo sapiens
aaaacacacgcgcgcacacaca

SEQ ID NO: 4884959 - DNA, 16 bp, Homo sapiens
aaaacacatgttttta

SEQ ID NO: 4884960 - DNA, 22 bp, Homo sapiens
aaaacaccgcttctgccttttc

SEQ ID NO: 4884961 - DNA, 23 bp, Homo sapiens
aaaacactgtggaactaataaat

SEQ ID NO: 4884962 - DNA, 13 bp, Homo sapiens
aaaacagtattta

SEQ ID NO: 4884963 - DNA, 23 bp, Homo sapiens
aaaacagtatttattttgtaatt

SEQ ID NO: 4884964 - DNA, 16 bp, Homo sapiens
aaaacatagcatctca

SEQ ID NO: 4884965 - DNA, 12 bp, Homo sapiens
aaaaccaaattc

SEQ ID NO: 4884966 - DNA, 15 bp, Homo sapiens
aaaaccacacaaaga

SEQ ID NO: 4884967 - DNA, 18 bp, Homo sapiens
aaaaccatctggcctggc

SEQ ID NO: 4884968 - DNA, 14 bp, Homo sapiens
aaaacctgtcaatg

SEQ ID NO: 4884969 - DNA, 17 bp, Homo sapiens
aaaacctgtcaatgata

SEQ ID NO: 4884970 - DNA, 13 bp, Homo sapiens
aaaacctttcaaa

SEQ ID NO: 4884971 - DNA, 19 bp, Homo sapiens
aaaacgctgtcaaaagttg

SEQ ID NO: 4884972 - DNA, 13 bp, Homo sapiens
aaaactatacaac

SEQ ID NO: 4884973 - DNA, 20 bp, Homo sapiens
aaaactatacttgaacaaaa

SEQ ID NO: 4884974 - DNA, 16 bp, Homo sapiens
aaaactccaccttccc

SEQ ID NO: 4884975 - DNA, 19 bp, Homo sapiens
aaaactgaaaatctaatat

SEQ ID NO: 4884976 - DNA, 23 bp, Homo sapiens
aaaactgcttttttttttccagc

SEQ ID NO: 4884977 - DNA, 17 bp, Homo sapiens
aaaactgtacatttaaa

SEQ ID NO: 4884978 - DNA, 20 bp, Homo sapiens
aaaacttgaaaatatatgat

SEQ ID NO: 4884979 - DNA, 22 bp, Homo sapiens
aaaacttgtgtgaaattttctt

SEQ ID NO: 4884980 - DNA, 11 bp, Homo sapiens
aaaactttgga

SEQ ID NO: 4884981 - DNA, 17 bp, Homo sapiens
aaaagaaaaaaaaaaga

SEQ ID NO: 4884982 - DNA, 21 bp, Homo sapiens
aaaagaaaaaccactcccagt

SEQ ID NO: 4884983 - DNA, 15 bp, Homo sapiens
aaaagaaaaataata

SEQ ID NO: 4884984 - DNA, 11 bp, Homo sapiens
aaaagaaaatg

SEQ ID NO: 4884985 - DNA, 13 bp, Homo sapiens
aaaagaaatgatg

SEQ ID NO: 4884986 - DNA, 17 bp, Homo sapiens
aaaagaacactagagtc

SEQ ID NO: 4884987 - DNA, 18 bp, Homo sapiens
aaaagacatgttgtaaat

SEQ ID NO: 4884988 - DNA, 13 bp, Homo sapiens
aaaagagaagaag

SEQ ID NO: 4884989 - DNA, 18 bp, Homo sapiens
aaaagagaattagattat

SEQ ID NO: 4884990 - DNA, 17 bp, Homo sapiens
aaaagagtcttccaatt

SEQ ID NO: 4884991 - DNA, 12 bp, Homo sapiens
aaaagattcttc

SEQ ID NO: 4884992 - DNA, 21 bp, Homo sapiens
aaaagattttcagaaaatatt

SEQ ID NO: 4884993 - DNA, 21 bp, Homo sapiens
aaaagcaaaataaaaactatt

SEQ ID NO: 4884994 - DNA, 19 bp, Homo sapiens
aaaagcagtaaatttgcta

SEQ ID NO: 4884995 - DNA, 21 bp, Homo sapiens
aaaagcctcaactagtcattt

SEQ ID NO: 4884996 - DNA, 20 bp, Homo sapiens
aaaagccttgtgtatatttg

SEQ ID NO: 4884997 - DNA, 23 bp, Homo sapiens
aaaagccttgtgtatatttgtat

SEQ ID NO: 4884998 - DNA, 20 bp, Homo sapiens
aaaagcgacccattcagaga

SEQ ID NO: 4884999 - DNA, 20 bp, Homo sapiens
aaaagctattagccaggatc

SEQ ID NO: 4885000 - DNA, 13 bp, Homo sapiens
aaaagctcctgtc

SEQ ID NO: 4885001 - DNA, 14 bp, Homo sapiens
aaaagcttccatga

SEQ ID NO: 4885002 - DNA, 16 bp, Homo sapiens
aaaagcttcttaatta

SEQ ID NO: 4885003 - DNA, 22 bp, Homo sapiens
aaaagcttcttaattaatttga

SEQ ID NO: 4885004 - DNA, 17 bp, Homo sapiens
aaaagctttatgatttt

SEQ ID NO: 4885005 - DNA, 22 bp, Homo sapiens
aaaagctttatgattttcataa

SEQ ID NO: 4885006 - DNA, 11 bp, Homo sapiens
aaaaggaaaaa

SEQ ID NO: 4885007 - DNA, 16 bp, Homo sapiens
aaaaggaaaagaaaaa

SEQ ID NO: 4885008 - DNA, 22 bp, Homo sapiens
aaaaggagccaatttaaagaaa

SEQ ID NO: 4885009 - DNA, 12 bp, Homo sapiens
aaaagggaagta

SEQ ID NO: 4885010 - DNA, 19 bp, Homo sapiens
aaaagggaagttgtgcctt

SEQ ID NO: 4885011 - DNA, 18 bp, Homo sapiens
aaaaggtattttgaatac

SEQ ID NO: 4885012 - DNA, 11 bp, Homo sapiens
aaaagtatttt

SEQ ID NO: 4885013 - DNA, 12 bp, Homo sapiens
aaaagtattttg

SEQ ID NO: 4885014 - DNA, 19 bp, Homo sapiens
aaaagtattttgaagttta

SEQ ID NO: 4885015 - DNA, 22 bp, Homo sapiens
aaaagtattttgaagtttacat

SEQ ID NO: 4885016 - DNA, 23 bp, Homo sapiens
aaaagtattttgaagtttacatt

SEQ ID NO: 4885017 - DNA, 22 bp, Homo sapiens
aaaagtcgttttccaaactgac

SEQ ID NO: 4885018 - DNA, 17 bp, Homo sapiens
aaaagtgacacagcagc

SEQ ID NO: 4885019 - DNA, 23 bp, Homo sapiens
aaaagtggaatttcttgtttctc

SEQ ID NO: 4885020 - DNA, 15 bp, Homo sapiens
aaaagtggggcagag

SEQ ID NO: 4885021 - DNA, 20 bp, Homo sapiens
aaaagttggactaaatgcct

SEQ ID NO: 4885022 - DNA, 17 bp, Homo sapiens
aaaagtttacaacataa

SEQ ID NO: 4885023 - DNA, 23 bp, Homo sapiens
aaaagtttacaacataatctagt

SEQ ID NO: 4885024 - DNA, 16 bp, Homo sapiens
aaaagtttacaagtgt

SEQ ID NO: 4885025 - DNA, 21 bp, Homo sapiens
aaaataaaaacccacaaaaat

SEQ ID NO: 4885026 - DNA, 18 bp, Homo sapiens
aaaataaaaactattcga

SEQ ID NO: 4885027 - DNA, 22 bp, Homo sapiens
aaaataaagacaaccatattta

SEQ ID NO: 4885028 - DNA, 15 bp, Homo sapiens
aaaataaatagaaaa

SEQ ID NO: 4885029 - DNA, 21 bp, Homo sapiens
aaaataagtgaataataatta

SEQ ID NO: 4885030 - DNA, 14 bp, Homo sapiens
aaaataatgctgca

SEQ ID NO: 4885031 - DNA, 19 bp, Homo sapiens
aaaataattttaaacaaag

SEQ ID NO: 4885032 - DNA, 12 bp, Homo sapiens
aaaatacattta

SEQ ID NO: 4885033 - DNA, 21 bp, Homo sapiens
aaaatagagcttttaaaaatg

SEQ ID NO: 4885034 - DNA, 14 bp, Homo sapiens
aaaatagatgtctt

SEQ ID NO: 4885035 - DNA, 12 bp, Homo sapiens
aaaatagcttgt

SEQ ID NO: 4885036 - DNA, 21 bp, Homo sapiens
aaaatagcttgtatagtgtaa

SEQ ID NO: 4885037 - DNA, 18 bp, Homo sapiens
aaaataggggatatttaa

SEQ ID NO: 4885038 - DNA, 18 bp, Homo sapiens
aaaatatataccccccca

SEQ ID NO: 4885039 - DNA, 16 bp, Homo sapiens
aagaggtgggagggcc

SEQ ID NO: 4885040 - DNA, 17 bp, Homo sapiens
aagaggtgggagggccc

SEQ ID NO: 4885041 - DNA, 15 bp, Homo sapiens
aagagtagaattgca

SEQ ID NO: 4885042 - DNA, 19 bp, Homo sapiens
aagagtagttgatgttgca

SEQ ID NO: 4885043 - DNA, 23 bp, Homo sapiens
aagagtagttgatgttgcatttt

SEQ ID NO: 4885044 - DNA, 24 bp, Homo sapiens
aagagtctaaagatggagtttcta

SEQ ID NO: 4885045 - DNA, 14 bp, Homo sapiens
aagagtctagattc

SEQ ID NO: 4885046 - DNA, 20 bp, Homo sapiens
aagagtctagattcaaaggt

SEQ ID NO: 4885047 - DNA, 13 bp, Homo sapiens
aagagtgattgca

SEQ ID NO: 4885048 - DNA, 20 bp, Homo sapiens
aagagtgattgcagctttat

SEQ ID NO: 4885049 - DNA, 21 bp, Homo sapiens
aagagtgattgcagctttatg

SEQ ID NO: 4885050 - DNA, 12 bp, Homo sapiens
aagagtgtagaa

SEQ ID NO: 4885051 - DNA, 13 bp, Homo sapiens
aagagtgtagaag

SEQ ID NO: 4885052 - DNA, 12 bp, Homo sapiens
aagagtgtgtgt

SEQ ID NO: 4885053 - DNA, 17 bp, Homo sapiens
aagagttgtgcacgcag

SEQ ID NO: 4885054 - DNA, 22 bp, Homo sapiens
aagatcctagatcctaagggtc

SEQ ID NO: 4885055 - DNA, 20 bp, Homo sapiens
aagatctgttttgaaggcaa

SEQ ID NO: 4885056 - DNA, 23 bp, Homo sapiens
aagatcttagattctctgtgtct

SEQ ID NO: 4885057 - DNA, 14 bp, Homo sapiens
aagatgaagtttta

SEQ ID NO: 4885058 - DNA, 18 bp, Homo sapiens
aagatgccaattattgtt

SEQ ID NO: 4885059 - DNA, 17 bp, Homo sapiens
aagatgctcttctgtgg

SEQ ID NO: 4885060 - DNA, 15 bp, Homo sapiens
aagatggagtttcta

SEQ ID NO: 4885061 - DNA, 18 bp, Homo sapiens
aagatggagtttctaagg

SEQ ID NO: 4885062 - DNA, 19 bp, Homo sapiens
aagatggctcagaggggga

SEQ ID NO: 4885063 - DNA, 18 bp, Homo sapiens
aagatgggcagctagttc

SEQ ID NO: 4885064 - DNA, 16 bp, Homo sapiens
aagatgtgatattcta

SEQ ID NO: 4885065 - DNA, 17 bp, Homo sapiens
aagatgtgatattctaa

SEQ ID NO: 4885066 - DNA, 18 bp, Homo sapiens
aagatgtgatattctaag

SEQ ID NO: 4885067 - DNA, 21 bp, Homo sapiens
aagatgttgaagaatacagtt

SEQ ID NO: 4885068 - DNA, 22 bp, Homo sapiens
aagattagcaaggtcatttctt

SEQ ID NO: 4885069 - DNA, 24 bp, Homo sapiens
aagattagcaaggtcatttcttca

SEQ ID NO: 4885070 - DNA, 14 bp, Homo sapiens
aagattatagattc

SEQ ID NO: 4885071 - DNA, 15 bp, Homo sapiens
aagattatagattct

SEQ ID NO: 4885072 - DNA, 16 bp, Homo sapiens
aagattatagattcta

SEQ ID NO: 4885073 - DNA, 24 bp, Homo sapiens
aagattccggatcctaagcatcta

SEQ ID NO: 4885074 - DNA, 11 bp, Homo sapiens
aagattctaaa

SEQ ID NO: 4885075 - DNA, 20 bp, Homo sapiens
aagattctatagttctagac

SEQ ID NO: 4885076 - DNA, 21 bp, Homo sapiens
aagatttaagcacaaacttta

SEQ ID NO: 4885077 - DNA, 21 bp, Homo sapiens
aagatttagaaaaaagtttac

SEQ ID NO: 4885078 - DNA, 13 bp, Homo sapiens
aagattttcagaa

SEQ ID NO: 4885079 - DNA, 15 bp, Homo sapiens
aagatttttctcaaa

SEQ ID NO: 4885080 - DNA, 20 bp, Homo sapiens
aagatttttctcaaagtttt

SEQ ID NO: 4885081 - DNA, 13 bp, Homo sapiens
aagcaaataaata

SEQ ID NO: 4885082 - DNA, 14 bp, Homo sapiens
aagcaaataaatat

SEQ ID NO: 4885083 - DNA, 18 bp, Homo sapiens
aagcaaatacttagcaaa

SEQ ID NO: 4885084 - DNA, 22 bp, Homo sapiens
aagcaaatttcaaaagacatgt

SEQ ID NO: 4885085 - DNA, 16 bp, Homo sapiens
aagcaagctctcttgc

SEQ ID NO: 4885086 - DNA, 23 bp, Homo sapiens
aagcacaagcagagtgcacagct

SEQ ID NO: 4885087 - DNA, 11 bp, Homo sapiens
aagcacagctg

SEQ ID NO: 4885088 - DNA, 13 bp, Homo sapiens
aagcacagtgtta

SEQ ID NO: 4885089 - DNA, 18 bp, Homo sapiens
aagcacagtgttaaatga

SEQ ID NO: 4885090 - DNA, 16 bp, Homo sapiens
aagcacatctgcattt

SEQ ID NO: 4885091 - DNA, 14 bp, Homo sapiens
aagcaccccatgcc

SEQ ID NO: 4885092 - DNA, 17 bp, Homo sapiens
aagcacctcctgcctcg

SEQ ID NO: 4885093 - DNA, 16 bp, Homo sapiens
aagcaccttagctggc

SEQ ID NO: 4885094 - DNA, 13 bp, Homo sapiens
aagcactagagaa

SEQ ID NO: 4885095 - DNA, 22 bp, Homo sapiens
aagcagaaatcctgcaatgaaa

SEQ ID NO: 4885096 - DNA, 19 bp, Homo sapiens
aagcagatggaatgctgtg

SEQ ID NO: 4885097 - DNA, 20 bp, Homo sapiens
aagcagatggaatgctgtgt

SEQ ID NO: 4885098 - DNA, 16 bp, Homo sapiens
aagcagctttaaacaa

SEQ ID NO: 4885099 - DNA, 21 bp, Homo sapiens
aagcagctttaaacaaattca

SEQ ID NO: 4885100 - DNA, 16 bp, Homo sapiens
aagcaggtttttctcc

SEQ ID NO: 4885101 - DNA, 15 bp, Homo sapiens
aagcagttgtgtcag

SEQ ID NO: 4885102 - DNA, 22 bp, Homo sapiens
aagcataaaaacattttaaaaa

SEQ ID NO: 4885103 - DNA, 16 bp, Homo sapiens
aagcatagatgttttg

SEQ ID NO: 4885104 - DNA, 15 bp, Homo sapiens
aagcatatagagatg

SEQ ID NO: 4885105 - DNA, 12 bp, Homo sapiens
aagcatgtttca

SEQ ID NO: 4885106 - DNA, 18 bp, Homo sapiens
aagcattaccactcaggc

SEQ ID NO: 4885107 - DNA, 16 bp, Homo sapiens
aagcattccttctttg

SEQ ID NO: 4885108 - DNA, 17 bp, Homo sapiens
aagcattccttctttga

SEQ ID NO: 4885109 - DNA, 18 bp, Homo sapiens
aagcattctccccagtgt

SEQ ID NO: 4885110 - DNA, 17 bp, Homo sapiens
aagcattgaaattatag

SEQ ID NO: 4885111 - DNA, 14 bp, Homo sapiens
aagcattgcctggc

SEQ ID NO: 4885112 - DNA, 20 bp, Homo sapiens
aagcattgcttttattttga

SEQ ID NO: 4885113 - DNA, 22 bp, Homo sapiens
aagcattgcttttattttgaaa

SEQ ID NO: 4885114 - DNA, 18 bp, Homo sapiens
aagcatttgtattttgtg

SEQ ID NO: 4885115 - DNA, 19 bp, Homo sapiens
aagcatttgtattttgtgt

SEQ ID NO: 4885116 - DNA, 21 bp, Homo sapiens
aagccaaaaaccttagctccc

SEQ ID NO: 4885117 - DNA, 12 bp, Homo sapiens
aagccaaagaaa

SEQ ID NO: 4885118 - DNA, 17 bp, Homo sapiens
aagccaaagctaggcct

SEQ ID NO: 4885119 - DNA, 20 bp, Homo sapiens
aagccaaagctaggcctggc

SEQ ID NO: 4885120 - DNA, 22 bp, Homo sapiens
aagccaaagctaggcctggcca

SEQ ID NO: 4885121 - DNA, 14 bp, Homo sapiens
aagccaaatttatc

SEQ ID NO: 4885122 - DNA, 16 bp, Homo sapiens
aagccaaatttatcaa

SEQ ID NO: 4885123 - DNA, 16 bp, Homo sapiens
aagccaacaccctgtc

SEQ ID NO: 4885124 - DNA, 16 bp, Homo sapiens
aagccacaagaaattt

SEQ ID NO: 4885125 - DNA, 18 bp, Homo sapiens
aagccacaagaaatttga

SEQ ID NO: 4885126 - DNA, 13 bp, Homo sapiens
aagccacatagag

SEQ ID NO: 4885127 - DNA, 19 bp, Homo sapiens
aagccagcctgaccttcct

SEQ ID NO: 4885128 - DNA, 11 bp, Homo sapiens
aagccagcctt

SEQ ID NO: 4885129 - DNA, 21 bp, Homo sapiens
aagccaggcaggtagccaggg

SEQ ID NO: 4885130 - DNA, 20 bp, Homo sapiens
aagccagggtctctccctca

SEQ ID NO: 4885131 - DNA, 21 bp, Homo sapiens
aagccagggtctctccctcag

SEQ ID NO: 4885132 - DNA, 18 bp, Homo sapiens
aagccagtgttgcctaag

SEQ ID NO: 4885133 - DNA, 19 bp, Homo sapiens
aagcccatgagtccttgaa

SEQ ID NO: 4885134 - DNA, 22 bp, Homo sapiens
aagcccatgagtccttgaaaat

SEQ ID NO: 4885135 - DNA, 21 bp, Homo sapiens
aagccccttgctctcccctgc

SEQ ID NO: 4885136 - DNA, 23 bp, Homo sapiens
aagccctgattgtgtatattcat

SEQ ID NO: 4885137 - DNA, 13 bp, Homo sapiens
aagccctggagac

SEQ ID NO: 4885138 - DNA, 14 bp, Homo sapiens
aagccgggaacaga

SEQ ID NO: 4885139 - DNA, 23 bp, Homo sapiens
aagcctaaaagtgggcttgattc

SEQ ID NO: 4885140 - DNA, 23 bp, Homo sapiens
aagcctaaatgccttagaaatgt

SEQ ID NO: 4885141 - DNA, 14 bp, Homo sapiens
aagcctacctgctc

SEQ ID NO: 4885142 - DNA, 19 bp, Homo sapiens
aagcctacctgctctccaa

SEQ ID NO: 4885143 - DNA, 22 bp, Homo sapiens
aagcctcaactagtcatttttt

SEQ ID NO: 4885144 - DNA, 15 bp, Homo sapiens
aagcctccacagcga

SEQ ID NO: 4885145 - DNA, 12 bp, Homo sapiens
aagcctctggga

SEQ ID NO: 4885146 - DNA, 22 bp, Homo sapiens
aagcctgtggatgatcaatcct

SEQ ID NO: 4885147 - DNA, 15 bp, Homo sapiens
aagccttcagctcca

SEQ ID NO: 4885148 - DNA, 17 bp, Homo sapiens
aagccttcagctccagg

SEQ ID NO: 4885149 - DNA, 22 bp, Homo sapiens
aagccttcgggcgtctgtgtgc

SEQ ID NO: 4885150 - DNA, 11 bp, Homo sapiens
aagccttgtgt

SEQ ID NO: 4885151 - DNA, 22 bp, Homo sapiens
aagccttgtgtatatttgtata

SEQ ID NO: 4885152 - DNA, 16 bp, Homo sapiens
aagcgatatacagatg

SEQ ID NO: 4885153 - DNA, 14 bp, Homo sapiens
aagcgattcttctg

SEQ ID NO: 4885154 - DNA, 15 bp, Homo sapiens
aagcgattcttctgc

SEQ ID NO: 4885155 - DNA, 23 bp, Homo sapiens
aagcgcatccaatctcaaggaat

SEQ ID NO: 4885156 - DNA, 17 bp, Homo sapiens
aagcgtgagccactgca

SEQ ID NO: 4885157 - DNA, 20 bp, Homo sapiens
aagctaattgggagtccagg

SEQ ID NO: 4885158 - DNA, 22 bp, Homo sapiens
aagctaatttgcattaaattca

SEQ ID NO: 4885159 - DNA, 15 bp, Homo sapiens
aagctagacagatcc

SEQ ID NO: 4885160 - DNA, 21 bp, Homo sapiens
aagctagacagatccccgttc

SEQ ID NO: 4885161 - DNA, 14 bp, Homo sapiens
aagctaggaatgaa

SEQ ID NO: 4885162 - DNA, 17 bp, Homo sapiens
aagctaggcctggccag

SEQ ID NO: 4885163 - DNA, 15 bp, Homo sapiens
aagctagggtggccc

SEQ ID NO: 4885164 - DNA, 19 bp, Homo sapiens
aagctagggtggcccttgc

SEQ ID NO: 4885165 - DNA, 22 bp, Homo sapiens
aagctagggtggcccttgcagt

SEQ ID NO: 4885166 - DNA, 14 bp, Homo sapiens
aagctatctaaagt

SEQ ID NO: 4885167 - DNA, 16 bp, Homo sapiens
aagctattagccagga

SEQ ID NO: 4885168 - DNA, 20 bp, Homo sapiens
aagctattcctttcccttcc

SEQ ID NO: 4885169 - DNA, 16 bp, Homo sapiens
aagctcagattattta

SEQ ID NO: 4885170 - DNA, 17 bp, Homo sapiens
aagctcagctactgatt

SEQ ID NO: 4885171 - DNA, 20 bp, Homo sapiens
aagctcatattttgtatata

SEQ ID NO: 4885172 - DNA, 22 bp, Homo sapiens
aagctcatattttgtatatatc

SEQ ID NO: 4885173 - DNA, 15 bp, Homo sapiens
aagctccctgcccca

SEQ ID NO: 4885174 - DNA, 13 bp, Homo sapiens
aagctcctgtcct

SEQ ID NO: 4885175 - DNA, 15 bp, Homo sapiens
aagctcctgtcctcc

SEQ ID NO: 4885176 - DNA, 15 bp, Homo sapiens
aagctctagaatctg

SEQ ID NO: 4885177 - DNA, 20 bp, Homo sapiens
aagctctagttcttaacaac

SEQ ID NO: 4885178 - DNA, 16 bp, Homo sapiens
aagctctgaagtcaca

SEQ ID NO: 4885179 - DNA, 22 bp, Homo sapiens
aagctctgaagtcacatcacag

SEQ ID NO: 4885180 - DNA, 12 bp, Homo sapiens
aagctctgacat

SEQ ID NO: 4885181 - DNA, 22 bp, Homo sapiens
aagctgatcataagtgaattta

SEQ ID NO: 4885182 - DNA, 17 bp, Homo sapiens
aagctgcagcttcctgt

SEQ ID NO: 4885183 - DNA, 13 bp, Homo sapiens
aagctgcagcttg

SEQ ID NO: 4885184 - DNA, 18 bp, Homo sapiens
aagctgcccactgtttct

SEQ ID NO: 4885185 - DNA, 21 bp, Homo sapiens
aagctgccgaaccaaaagaat

SEQ ID NO: 4885186 - DNA, 15 bp, Homo sapiens
aagctgcctgtagtt

SEQ ID NO: 4885187 - DNA, 16 bp, Homo sapiens
aagctgcctgtagtta

SEQ ID NO: 4885188 - DNA, 16 bp, Homo sapiens
aagctgctgacagtgt

SEQ ID NO: 4885189 - DNA, 13 bp, Homo sapiens
aagctgctgacca

SEQ ID NO: 4885190 - DNA, 22 bp, Homo sapiens
aagctgctgaccaattgtgctg

SEQ ID NO: 4885191 - DNA, 14 bp, Homo sapiens
aagctggcctgaga

SEQ ID NO: 4885192 - DNA, 22 bp, Homo sapiens
aagctgtagtagccctttctgt

SEQ ID NO: 4885193 - DNA, 14 bp, Homo sapiens
aagctgttaaactg

SEQ ID NO: 4885194 - DNA, 15 bp, Homo sapiens
aagctgttaaactgt

SEQ ID NO: 4885195 - DNA, 20 bp, Homo sapiens
aagctgttgtacatttatga

SEQ ID NO: 4885196 - DNA, 15 bp, Homo sapiens
aagcttccatgattc

SEQ ID NO: 4885197 - DNA, 20 bp, Homo sapiens
aagcttccatgattctattt

SEQ ID NO: 4885198 - DNA, 21 bp, Homo sapiens
aagcttccatgattctattta

SEQ ID NO: 4885199 - DNA, 12 bp, Homo sapiens
aagcttcttaat

SEQ ID NO: 4885200 - DNA, 12 bp, Homo sapiens
aagcttgactcc

SEQ ID NO: 4885201 - DNA, 18 bp, Homo sapiens
aagcttgactcccaagtt

SEQ ID NO: 4885202 - DNA, 15 bp, Homo sapiens
aagcttgttttccag

SEQ ID NO: 4885203 - DNA, 12 bp, Homo sapiens
aagctttatgat

SEQ ID NO: 4885204 - DNA, 21 bp, Homo sapiens
aagctttatgattttcataac

SEQ ID NO: 4885205 - DNA, 10 bp, Homo sapiens
aaggaaaaag

SEQ ID NO: 4885206 - DNA, 18 bp, Homo sapiens
aaggaaaaagaaaataaa

SEQ ID NO: 4885207 - DNA, 13 bp, Homo sapiens
aaggaaaaagctc

SEQ ID NO: 4885208 - DNA, 15 bp, Homo sapiens
aaggaaaaagctcca

SEQ ID NO: 4885209 - DNA, 23 bp, Homo sapiens
aaggaaatacccttcttttatga

SEQ ID NO: 4885210 - DNA, 23 bp, Homo sapiens
aaggaacaaaaaaaccacaaagg

SEQ ID NO: 4885211 - DNA, 17 bp, Homo sapiens
aaggaacagcaatggtg

SEQ ID NO: 4885212 - DNA, 23 bp, Homo sapiens
aaggaaccttccttcctgcttga

SEQ ID NO: 4885213 - DNA, 18 bp, Homo sapiens
aaggaagatatacatgaa

SEQ ID NO: 4885214 - DNA, 12 bp, Homo sapiens
aaggaaggaaag

SEQ ID NO: 4885215 - DNA, 21 bp, Homo sapiens
aaggaataaattgctccttga

SEQ ID NO: 4885216 - DNA, 17 bp, Homo sapiens
aaggaatagaagcaaat

SEQ ID NO: 4885217 - DNA, 14 bp, Homo sapiens
aaggaatctttaag

SEQ ID NO: 4885218 - DNA, 17 bp, Homo sapiens
aaggacagagtatgaac

SEQ ID NO: 4885219 - DNA, 17 bp, Homo sapiens
aaggacattatgtgtgc

SEQ ID NO: 4885220 - DNA, 12 bp, Homo sapiens
aaggaccaggac

SEQ ID NO: 4885221 - DNA, 13 bp, Homo sapiens
aaggaccaggact

SEQ ID NO: 4885222 - DNA, 19 bp, Homo sapiens
aaggacctgaaattccaaa

SEQ ID NO: 4885223 - DNA, 17 bp, Homo sapiens
aaggacgggttggggcc

SEQ ID NO: 4885224 - DNA, 17 bp, Homo sapiens
aaggactgagggactct

SEQ ID NO: 4885225 - DNA, 21 bp, Homo sapiens
aaggagagactcccatgaagc

SEQ ID NO: 4885226 - DNA, 23 bp, Homo sapiens
aaggagagactcccatgaagcct

SEQ ID NO: 4885227 - DNA, 14 bp, Homo sapiens
aaggagagcctgct

SEQ ID NO: 4885228 - DNA, 14 bp, Homo sapiens
aaggaggctggcag

SEQ ID NO: 4885229 - DNA, 15 bp, Homo sapiens
aaggaggggaagctg

SEQ ID NO: 4885230 - DNA, 17 bp, Homo sapiens
aaggagtcaaaactaca

SEQ ID NO: 4885231 - DNA, 16 bp, Homo sapiens
aaggagttggaagtga

SEQ ID NO: 4885232 - DNA, 17 bp, Homo sapiens
aaggatgtgattgtgga

SEQ ID NO: 4885233 - DNA, 21 bp, Homo sapiens
aaggattgtaaaaaaaaatgc

SEQ ID NO: 4885234 - DNA, 15 bp, Homo sapiens
aaggattttttaaag

SEQ ID NO: 4885235 - DNA, 14 bp, Homo sapiens
aaggcaaaaatgta

SEQ ID NO: 4885236 - DNA, 12 bp, Homo sapiens
aaggcaaaattg

SEQ ID NO: 4885237 - DNA, 14 bp, Homo sapiens
aaggcaaaattgca

SEQ ID NO: 4885238 - DNA, 15 bp, Homo sapiens
aaggcaaaattgcaa

SEQ ID NO: 4885239 - DNA, 15 bp, Homo sapiens
aaggcacaatatggg

SEQ ID NO: 4885240 - DNA, 21 bp, Homo sapiens
aaggcactctgttatttagac

SEQ ID NO: 4885241 - DNA, 17 bp, Homo sapiens
aaggccagagtggcctg

SEQ ID NO: 4885242 - DNA, 20 bp, Homo sapiens
aaggccagagtggcctggcc

SEQ ID NO: 4885243 - DNA, 23 bp, Homo sapiens
aaggccagagtggcctggccagg

SEQ ID NO: 4885244 - DNA, 21 bp, Homo sapiens
aaggccagtggaaattcaggt

SEQ ID NO: 4885245 - DNA, 14 bp, Homo sapiens
aaggccataaaaca

SEQ ID NO: 4885246 - DNA, 18 bp, Homo sapiens
aaggccataaaacaggta

SEQ ID NO: 4885247 - DNA, 24 bp, Homo sapiens
aaggccataaaacaggtaatataa

SEQ ID NO: 4885248 - DNA, 14 bp, Homo sapiens
aaggccccctacgc

SEQ ID NO: 4885249 - DNA, 12 bp, Homo sapiens
aaggcctcttgg

SEQ ID NO: 4885250 - DNA, 12 bp, Homo sapiens
aaggctctagat

SEQ ID NO: 4885251 - DNA, 13 bp, Homo sapiens
aaggctctagatc

SEQ ID NO: 4885252 - DNA, 21 bp, Homo sapiens
aaggctctatgagtctagatg

SEQ ID NO: 4885253 - DNA, 13 bp, Homo sapiens
aaggctctgagag

SEQ ID NO: 4885254 - DNA, 17 bp, Homo sapiens
aaggctctgagagtcta

SEQ ID NO: 4885255 - DNA, 22 bp, Homo sapiens
aaggctctgagagtctagattc

SEQ ID NO: 4885256 - DNA, 23 bp, Homo sapiens
aaggcttatattcaaccatggac

SEQ ID NO: 4885257 - DNA, 15 bp, Homo sapiens
aaggctttatctcag

SEQ ID NO: 4885258 - DNA, 22 bp, Homo sapiens
aaggcttttggtctccctggga

SEQ ID NO: 4885259 - DNA, 22 bp, Homo sapiens
aagggaaagcttcattctcctt

SEQ ID NO: 4885260 - DNA, 15 bp, Homo sapiens
aagggaaatatcatt

SEQ ID NO: 4885261 - DNA, 16 bp, Homo sapiens
aagggaaatatcattt

SEQ ID NO: 4885262 - DNA, 15 bp, Homo sapiens
aagggaagacatttc

SEQ ID NO: 4885263 - DNA, 17 bp, Homo sapiens
aagggaagttgtgcctt

SEQ ID NO: 4885264 - DNA, 18 bp, Homo sapiens
aagggaggacgggagctg

SEQ ID NO: 4885265 - DNA, 24 bp, Homo sapiens
aagggatggaggtcacactggtag

SEQ ID NO: 4885266 - DNA, 13 bp, Homo sapiens
aagggcatgcctt

SEQ ID NO: 4885267 - DNA, 19 bp, Homo sapiens
aagggcatgccttgtgctg

SEQ ID NO: 4885268 - DNA, 13 bp, Homo sapiens
aagggcccagaga

SEQ ID NO: 4885269 - DNA, 11 bp, Homo sapiens
aagggcccagg

SEQ ID NO: 4885270 - DNA, 19 bp, Homo sapiens
aagggcctgcctggcccct

SEQ ID NO: 4885271 - DNA, 22 bp, Homo sapiens
aaggggaatgtttgcctctgcc

SEQ ID NO: 4885272 - DNA, 15 bp, Homo sapiens
aaggggacaggcctc

SEQ ID NO: 4885273 - DNA, 16 bp, Homo sapiens
aaggggacaggcctca

SEQ ID NO: 4885274 - DNA, 21 bp, Homo sapiens
aaggggagtcaccttcccttg

SEQ ID NO: 4885275 - DNA, 23 bp, Homo sapiens
aaggggcctcaccgagtgggggc

SEQ ID NO: 4885276 - DNA, 16 bp, Homo sapiens
aaggggtttgccattt

SEQ ID NO: 4885277 - DNA, 20 bp, Homo sapiens
aaggggtttgccatttgata

SEQ ID NO: 4885278 - DNA, 16 bp, Homo sapiens
aagggtatcaggtgct

SEQ ID NO: 4885279 - DNA, 16 bp, Homo sapiens
aagggtcatagaaagg

SEQ ID NO: 4885280 - DNA, 17 bp, Homo sapiens
aagggtcatagaaaggg

SEQ ID NO: 4885281 - DNA, 17 bp, Homo sapiens
aagggtgggtgctcaga

SEQ ID NO: 4885282 - DNA, 18 bp, Homo sapiens
aagggtgggtgctcagaa

SEQ ID NO: 4885283 - DNA, 18 bp, Homo sapiens
aaggtagcttacctgaca

SEQ ID NO: 4885284 - DNA, 18 bp, Homo sapiens
aaggtattaaattgatgt

SEQ ID NO: 4885285 - DNA, 15 bp, Homo sapiens
aaggtattttgaata

SEQ ID NO: 4885286 - DNA, 19 bp, Homo sapiens
aaggtccggtgttctaaga

SEQ ID NO: 4885287 - DNA, 21 bp, Homo sapiens
aaggtccggtgttctaagatg

SEQ ID NO: 4885288 - DNA, 15 bp, Homo sapiens
aaggtctcattcttc

SEQ ID NO: 4885289 - DNA, 19 bp, Homo sapiens
aaggtctgagccacagcag

SEQ ID NO: 4885290 - DNA, 18 bp, Homo sapiens
aaggttccaactgtatat

SEQ ID NO: 4885291 - DNA, 22 bp, Homo sapiens
aaggttccaatcagatctttat

SEQ ID NO: 4885292 - DNA, 15 bp, Homo sapiens
aaggttcccttgtgg

SEQ ID NO: 4885293 - DNA, 13 bp, Homo sapiens
aaggttctaaggc

SEQ ID NO: 4885294 - DNA, 21 bp, Homo sapiens
aaggttgcatactgagccaag

SEQ ID NO: 4885295 - DNA, 16 bp, Homo sapiens
aaggtttcgtttctgt

SEQ ID NO: 4885296 - DNA, 19 bp, Homo sapiens
aaggttttaggttctaaag

SEQ ID NO: 4885297 - DNA, 13 bp, Homo sapiens
aagtaaaattgct

SEQ ID NO: 4885298 - DNA, 17 bp, Homo sapiens
aagtaaagccattaaat

SEQ ID NO: 4885299 - DNA, 15 bp, Homo sapiens
aagtaacataactag

SEQ ID NO: 4885300 - DNA, 14 bp, Homo sapiens
aagtaactcatttg

SEQ ID NO: 4885301 - DNA, 13 bp, Homo sapiens
aagtaatataatg

SEQ ID NO: 4885302 - DNA, 13 bp, Homo sapiens
aagtaatgtggaa

SEQ ID NO: 4885303 - DNA, 13 bp, Homo sapiens
aagtaattatgca

SEQ ID NO: 4885304 - DNA, 19 bp, Homo sapiens
aagtaattatgcactaaat

SEQ ID NO: 4885305 - DNA, 16 bp, Homo sapiens
aagtacacaataagca

SEQ ID NO: 4885306 - DNA, 13 bp, Homo sapiens
aagtacatattta

SEQ ID NO: 4885307 - DNA, 21 bp, Homo sapiens
aagtacatatttattttcttt

SEQ ID NO: 4885308 - DNA, 16 bp, Homo sapiens
aagtaccaaagtttta

SEQ ID NO: 4885309 - DNA, 19 bp, Homo sapiens
aagtactgtaataatacct

SEQ ID NO: 4885310 - DNA, 20 bp, Homo sapiens
aagtactgtaataatacctc

SEQ ID NO: 4885311 - DNA, 18 bp, Homo sapiens
aagtacttctccaccctg

SEQ ID NO: 4885312 - DNA, 23 bp, Homo sapiens
aagtacttctccaccctgctctc

SEQ ID NO: 4885313 - DNA, 11 bp, Homo sapiens
aagtacttctt

SEQ ID NO: 4885314 - DNA, 17 bp, Homo sapiens
aagtagacaatcattgt

SEQ ID NO: 4885315 - DNA, 21 bp, Homo sapiens
aagtagacaatcattgttttg

SEQ ID NO: 4885316 - DNA, 13 bp, Homo sapiens
aagtatagagaga

SEQ ID NO: 4885317 - DNA, 18 bp, Homo sapiens
aagtatataaattggctt

SEQ ID NO: 4885318 - DNA, 23 bp, Homo sapiens
aagtatatcatgtaaagaaatgt

SEQ ID NO: 4885319 - DNA, 18 bp, Homo sapiens
aagtatcttttttcaaaa

SEQ ID NO: 4885320 - DNA, 17 bp, Homo sapiens
aagtatgagggaaaatg

SEQ ID NO: 4885321 - DNA, 13 bp, Homo sapiens
aagtatgtaaaca

SEQ ID NO: 4885322 - DNA, 22 bp, Homo sapiens
aagtatgtaaagtatgtaaaca

SEQ ID NO: 4885323 - DNA, 19 bp, Homo sapiens
aagtatgtgtaaaatgtga

SEQ ID NO: 4885324 - DNA, 14 bp, Homo sapiens
aagtattaaaacat

SEQ ID NO: 4885325 - DNA, 12 bp, Homo sapiens
aagtatttataa

SEQ ID NO: 4885326 - DNA, 15 bp, Homo sapiens
aagtattttgaagtt

SEQ ID NO: 4885327 - DNA, 16 bp, Homo sapiens
aagtattttgaagttt

SEQ ID NO: 4885328 - DNA, 19 bp, Homo sapiens
aagtattttgaagtttaca

SEQ ID NO: 4885329 - DNA, 23 bp, Homo sapiens
aagtattttgaagtttacatttt

SEQ ID NO: 4885330 - DNA, 17 bp, Homo sapiens
aagtcaatcatttctca

SEQ ID NO: 4885331 - DNA, 22 bp, Homo sapiens
aagtcaatcatttctcactgtg

SEQ ID NO: 4885332 - DNA, 20 bp, Homo sapiens
aagtcaccactccattccca

SEQ ID NO: 4885333 - DNA, 20 bp, Homo sapiens
aagtcacttactattgttgc

SEQ ID NO: 4885334 - DNA, 14 bp, Homo sapiens
aagtcatgtgcatt

SEQ ID NO: 4885335 - DNA, 19 bp, Homo sapiens
aagtccgcagaagccctga

SEQ ID NO: 4885336 - DNA, 18 bp, Homo sapiens
aagtcctcttttctgaga

SEQ ID NO: 4885337 - DNA, 22 bp, Homo sapiens
aagtcctcttttctgagaggac

SEQ ID NO: 4885338 - DNA, 21 bp, Homo sapiens
aagtcctttttttccatcttt

SEQ ID NO: 4885339 - DNA, 15 bp, Homo sapiens
aagtcgttttccaaa

SEQ ID NO: 4885340 - DNA, 18 bp, Homo sapiens
aagtctctaattctatta

SEQ ID NO: 4885341 - DNA, 15 bp, Homo sapiens
aagtctctgctggcc

SEQ ID NO: 4885342 - DNA, 14 bp, Homo sapiens
aagtctctgtgaat

SEQ ID NO: 4885343 - DNA, 18 bp, Homo sapiens
aagtgaaataacaaaatg

SEQ ID NO: 4885344 - DNA, 16 bp, Homo sapiens
aagtgaagactggaag

SEQ ID NO: 4885345 - DNA, 12 bp, Homo sapiens
aagtgaataaac

SEQ ID NO: 4885346 - DNA, 18 bp, Homo sapiens
aagtgaataaacttcagc

SEQ ID NO: 4885347 - DNA, 16 bp, Homo sapiens
aagtgaatgaaagatt

SEQ ID NO: 4885348 - DNA, 18 bp, Homo sapiens
aagtgactgtatctgtgt

SEQ ID NO: 4885349 - DNA, 22 bp, Homo sapiens
aagtgatctacatgaggaactg

SEQ ID NO: 4885350 - DNA, 18 bp, Homo sapiens
aagtgatgggctttctct

SEQ ID NO: 4885351 - DNA, 17 bp, Homo sapiens
aagtgcacacagaaata

SEQ ID NO: 4885352 - DNA, 22 bp, Homo sapiens
aagtgcagttcttagccctcta

SEQ ID NO: 4885353 - DNA, 15 bp, Homo sapiens
aagtgccaaatgctc

SEQ ID NO: 4885354 - DNA, 12 bp, Homo sapiens
aagtgccccctc

SEQ ID NO: 4885355 - DNA, 18 bp, Homo sapiens
aagtgcctttctgcagtt

SEQ ID NO: 4885356 - DNA, 20 bp, Homo sapiens
aagtgcgtgccgtgtgagtg

SEQ ID NO: 4885357 - DNA, 17 bp, Homo sapiens
aagtgcgtgtgtagagt

SEQ ID NO: 4885358 - DNA, 19 bp, Homo sapiens
aagtgcgtgtgtagagtta

SEQ ID NO: 4885359 - DNA, 16 bp, Homo sapiens
aagtgctaaggttcta

SEQ ID NO: 4885360 - DNA, 17 bp, Homo sapiens
aagtgctaaggttctaa

SEQ ID NO: 4885361 - DNA, 18 bp, Homo sapiens
aagtgctaaggttctaag

SEQ ID NO: 4885362 - DNA, 21 bp, Homo sapiens
aagtggaatttcttgtttctc

SEQ ID NO: 4885363 - DNA, 22 bp, Homo sapiens
aagtggaccttaggccttcctc

SEQ ID NO: 4885364 - DNA, 22 bp, Homo sapiens
aagtggcatgttttgtgcattt

SEQ ID NO: 4885365 - DNA, 12 bp, Homo sapiens
aagtgggcttga

SEQ ID NO: 4885366 - DNA, 22 bp, Homo sapiens
aagtgggcttgattctgcagta

SEQ ID NO: 4885367 - DNA, 14 bp, Homo sapiens
aagtgggtgagatg

SEQ ID NO: 4885368 - DNA, 21 bp, Homo sapiens
aagtgttatttttcaaggaag

SEQ ID NO: 4885369 - DNA, 21 bp, Homo sapiens
aagtgtttatttttcatattg

SEQ ID NO: 4885370 - DNA, 23 bp, Homo sapiens
aagtgttttgttctttctggagt

SEQ ID NO: 4885371 - DNA, 18 bp, Homo sapiens
aagttaagagaaacttta

SEQ ID NO: 4885372 - DNA, 14 bp, Homo sapiens
aagttagaatctat

SEQ ID NO: 4885373 - DNA, 15 bp, Homo sapiens
aagttagaatctatt

SEQ ID NO: 4885374 - DNA, 17 bp, Homo sapiens
aagttagaatctatttt

SEQ ID NO: 4885375 - DNA, 17 bp, Homo sapiens
aagttcacaaaatggtg

SEQ ID NO: 4885376 - DNA, 22 bp, Homo sapiens
aagttcatacctaagtactgta

SEQ ID NO: 4885377 - DNA, 23 bp, Homo sapiens
aagttcatattccatatttattc

SEQ ID NO: 4885378 - DNA, 16 bp, Homo sapiens
aagttccaagagtcta

SEQ ID NO: 4885379 - DNA, 20 bp, Homo sapiens
aagttccaagagtctaaaga

SEQ ID NO: 4885380 - DNA, 21 bp, Homo sapiens
aagttccaagagtctaaagat

SEQ ID NO: 4885381 - DNA, 12 bp, Homo sapiens
aagttctaagat

SEQ ID NO: 4885382 - DNA, 19 bp, Homo sapiens
aagttgacttatagtacat

SEQ ID NO: 4885383 - DNA, 19 bp, Homo sapiens
aagttgtaacttatattga

SEQ ID NO: 4885384 - DNA, 16 bp, Homo sapiens
aagttgtagcagattg

SEQ ID NO: 4885385 - DNA, 20 bp, Homo sapiens
aagttgtgccttttatagct

SEQ ID NO: 4885386 - DNA, 19 bp, Homo sapiens
aagtttaaaacagtattta

SEQ ID NO: 4885387 - DNA, 13 bp, Homo sapiens
aagtttacatttt

SEQ ID NO: 4885388 - DNA, 12 bp, Homo sapiens
aagtttattctc

SEQ ID NO: 4885389 - DNA, 22 bp, Homo sapiens
aagtttcaaacttactattttg

SEQ ID NO: 4885390 - DNA, 16 bp, Homo sapiens
aagtttcaatgtgatt

SEQ ID NO: 4885391 - DNA, 16 bp, Homo sapiens
aagtttcaggtgacat

SEQ ID NO: 4885392 - DNA, 18 bp, Homo sapiens
aagtttccatatgttata

SEQ ID NO: 4885393 - DNA, 12 bp, Homo sapiens
aagtttctaaga

SEQ ID NO: 4885394 - DNA, 20 bp, Homo sapiens
aagtttctaagattctaaag

SEQ ID NO: 4885395 - DNA, 15 bp, Homo sapiens
aagtttgcttagaaa

SEQ ID NO: 4885396 - DNA, 13 bp, Homo sapiens
aagttttctgtag

SEQ ID NO: 4885397 - DNA, 23 bp, Homo sapiens
aagttttgagtagatattacttt

SEQ ID NO: 4885398 - DNA, 21 bp, Homo sapiens
aataaaaacccacaaaaatgt

SEQ ID NO: 4885399 - DNA, 13 bp, Homo sapiens
aataaaaatgata

SEQ ID NO: 4885400 - DNA, 21 bp, Homo sapiens
aataaaacagctgtctctaac

SEQ ID NO: 4885401 - DNA, 22 bp, Homo sapiens
aataaaacctttcaaatttcac

SEQ ID NO: 4885402 - DNA, 19 bp, Homo sapiens
aataaaatgaggacatgtt

SEQ ID NO: 4885403 - DNA, 17 bp, Homo sapiens
aataaactactctttga

SEQ ID NO: 4885404 - DNA, 15 bp, Homo sapiens
aataaactttttttc

SEQ ID NO: 4885405 - DNA, 17 bp, Homo sapiens
aataaactttttttcaa

SEQ ID NO: 4885406 - DNA, 20 bp, Homo sapiens
aataaactttttttcaatgt

SEQ ID NO: 4885407 - DNA, 21 bp, Homo sapiens
aataaactttttttcaatgtg

SEQ ID NO: 4885408 - DNA, 13 bp, Homo sapiens
aataaagaaattg

SEQ ID NO: 4885409 - DNA, 14 bp, Homo sapiens
aataaattgaaatt

SEQ ID NO: 4885410 - DNA, 14 bp, Homo sapiens
aataacaatgttaa

SEQ ID NO: 4885411 - DNA, 12 bp, Homo sapiens
aataacacacat

SEQ ID NO: 4885412 - DNA, 19 bp, Homo sapiens
aataacactaaaattttag

SEQ ID NO: 4885413 - DNA, 14 bp, Homo sapiens
aataactgtgaagt

SEQ ID NO: 4885414 - DNA, 13 bp, Homo sapiens
aataacttcagtc

SEQ ID NO: 4885415 - DNA, 14 bp, Homo sapiens
aataagagaaagaa

SEQ ID NO: 4885416 - DNA, 15 bp, Homo sapiens
aataagagaaagaaa

SEQ ID NO: 4885417 - DNA, 12 bp, Homo sapiens
aataagattcta

SEQ ID NO: 4885418 - DNA, 20 bp, Homo sapiens
aataatacctcaatgtttga

SEQ ID NO: 4885419 - DNA, 12 bp, Homo sapiens
aataatatgcat

SEQ ID NO: 4885420 - DNA, 14 bp, Homo sapiens
aataatattgttgt

SEQ ID NO: 4885421 - DNA, 20 bp, Homo sapiens
aataatattgttgtataatt

SEQ ID NO: 4885422 - DNA, 17 bp, Homo sapiens
aataatattgtttttct

SEQ ID NO: 4885423 - DNA, 15 bp, Homo sapiens
aataatcacattgac

SEQ ID NO: 4885424 - DNA, 14 bp, Homo sapiens
aataatctttgggt

SEQ ID NO: 4885425 - DNA, 16 bp, Homo sapiens
aataatgagctattaa

SEQ ID NO: 4885426 - DNA, 22 bp, Homo sapiens
aataatgagctattaaaactca

SEQ ID NO: 4885427 - DNA, 17 bp, Homo sapiens
aataattcatattcttc

SEQ ID NO: 4885428 - DNA, 13 bp, Homo sapiens
aatacatgcatct

SEQ ID NO: 4885429 - DNA, 17 bp, Homo sapiens
aatacatttaaaactta

SEQ ID NO: 4885430 - DNA, 20 bp, Homo sapiens
aataccattttttaaggaaa

SEQ ID NO: 4885431 - DNA, 21 bp, Homo sapiens
aatacctcatgtttatgaaaa

SEQ ID NO: 4885432 - DNA, 15 bp, Homo sapiens
aatactaaaatatgt

SEQ ID NO: 4885433 - DNA, 14 bp, Homo sapiens
aatactaccttgaa

SEQ ID NO: 4885434 - DNA, 21 bp, Homo sapiens
aatactaccttgaaaataaga

SEQ ID NO: 4885435 - DNA, 16 bp, Homo sapiens
aatactagtcacccca

SEQ ID NO: 4885436 - DNA, 14 bp, Homo sapiens
aatactctgttgta

SEQ ID NO: 4885437 - DNA, 22 bp, Homo sapiens
aatactctgttgtactatggaa

SEQ ID NO: 4885438 - DNA, 15 bp, Homo sapiens
aatactgtgtggaac

SEQ ID NO: 4885439 - DNA, 16 bp, Homo sapiens
aatactgtgtggaact

SEQ ID NO: 4885440 - DNA, 13 bp, Homo sapiens
aatagaaaagtag

SEQ ID NO: 4885441 - DNA, 16 bp, Homo sapiens
aatagagtatatgcac

SEQ ID NO: 4885442 - DNA, 17 bp, Homo sapiens
aatagagtatatgcact

SEQ ID NO: 4885443 - DNA, 11 bp, Homo sapiens
aatagattctc

SEQ ID NO: 4885444 - DNA, 15 bp, Homo sapiens
aatagcaacttttgt

SEQ ID NO: 4885445 - DNA, 17 bp, Homo sapiens
aatagcaacttttgtgt

SEQ ID NO: 4885446 - DNA, 20 bp, Homo sapiens
aatagccacatttggaatac

SEQ ID NO: 4885447 - DNA, 14 bp, Homo sapiens
aatagctgggacta

SEQ ID NO: 4885448 - DNA, 19 bp, Homo sapiens
aatagcttgtatagtgtaa

SEQ ID NO: 4885449 - DNA, 11 bp, Homo sapiens
aataggaataa

SEQ ID NO: 4885450 - DNA, 13 bp, Homo sapiens
aataggagaggat

SEQ ID NO: 4885451 - DNA, 15 bp, Homo sapiens
aataggagaggatga

SEQ ID NO: 4885452 - DNA, 15 bp, Homo sapiens
aataggggatattta

SEQ ID NO: 4885453 - DNA, 23 bp, Homo sapiens
aatagtatttgagagttctaaat

SEQ ID NO: 4885454 - DNA, 13 bp, Homo sapiens
aatagtctgtgtg

SEQ ID NO: 4885455 - DNA, 14 bp, Homo sapiens
aatagtctgtgtga

SEQ ID NO: 4885456 - DNA, 15 bp, Homo sapiens
aatagtctgtgtgaa

SEQ ID NO: 4885457 - DNA, 19 bp, Homo sapiens
aatagtgcagaatctcata

SEQ ID NO: 4885458 - DNA, 23 bp, Homo sapiens
aatagttaagacatgatttcctt

SEQ ID NO: 4885459 - DNA, 18 bp, Homo sapiens
aatagttgtccatatttt

SEQ ID NO: 4885460 - DNA, 19 bp, Homo sapiens
aatagtttgtctattttaa

SEQ ID NO: 4885461 - DNA, 23 bp, Homo sapiens
aatagtttgtctattttaaaata

SEQ ID NO: 4885462 - DNA, 15 bp, Homo sapiens
aatagtttgtttaat

SEQ ID NO: 4885463 - DNA, 23 bp, Homo sapiens
aatataaaaggcaaatgtgtaca

SEQ ID NO: 4885464 - DNA, 21 bp, Homo sapiens
aatataaacaaagattcatga

SEQ ID NO: 4885465 - DNA, 23 bp, Homo sapiens
aatataaacaaagattcatgatt

SEQ ID NO: 4885466 - DNA, 12 bp, Homo sapiens
aatataaacatc

SEQ ID NO: 4885467 - DNA, 13 bp, Homo sapiens
aatataggtctct

SEQ ID NO: 4885468 - DNA, 23 bp, Homo sapiens
aatataggtctcttctcccagaa

SEQ ID NO: 4885469 - DNA, 12 bp, Homo sapiens
aatatataaaaa

SEQ ID NO: 4885470 - DNA, 16 bp, Homo sapiens
aatatataaaaatata

SEQ ID NO: 4885471 - DNA, 14 bp, Homo sapiens
aatatataatttat

SEQ ID NO: 4885472 - DNA, 19 bp, Homo sapiens
aatatatacgaacaaaaca

SEQ ID NO: 4885473 - DNA, 12 bp, Homo sapiens
aatatatataaa

SEQ ID NO: 4885474 - DNA, 13 bp, Homo sapiens
aatatatataaag

SEQ ID NO: 4885475 - DNA, 12 bp, Homo sapiens
aatatatataca

SEQ ID NO: 4885476 - DNA, 16 bp, Homo sapiens
aatatatatacatatg

SEQ ID NO: 4885477 - DNA, 23 bp, Homo sapiens
aatatatatatatatcagtttga

SEQ ID NO: 4885478 - DNA, 12 bp, Homo sapiens
aatatatgtatt

SEQ ID NO: 4885479 - DNA, 19 bp, Homo sapiens
aatatatttatttaaagca

SEQ ID NO: 4885480 - DNA, 20 bp, Homo sapiens
aatatctaatatatatgaat

SEQ ID NO: 4885481 - DNA, 14 bp, Homo sapiens
aatatctattaata

SEQ ID NO: 4885482 - DNA, 15 bp, Homo sapiens
aatatctattaatat

SEQ ID NO: 4885483 - DNA, 14 bp, Homo sapiens
aatatcttttatgt

SEQ ID NO: 4885484 - DNA, 15 bp, Homo sapiens
aatatcttttatgtt

SEQ ID NO: 4885485 - DNA, 18 bp, Homo sapiens
aatatcttttatgtttga

SEQ ID NO: 4885486 - DNA, 23 bp, Homo sapiens
aatatcttttatgtttgaatatg

SEQ ID NO: 4885487 - DNA, 20 bp, Homo sapiens
aatatgaaccctttgtttct

SEQ ID NO: 4885488 - DNA, 21 bp, Homo sapiens
aatatgaaccctttgtttctt

SEQ ID NO: 4885489 - DNA, 16 bp, Homo sapiens
aatatgagtacaaatg

SEQ ID NO: 4885490 - DNA, 11 bp, Homo sapiens
aatatgatgac

SEQ ID NO: 4885491 - DNA, 15 bp, Homo sapiens
aatatgctaatttgg

SEQ ID NO: 4885492 - DNA, 20 bp, Homo sapiens
aatatggaacttctaatata

SEQ ID NO: 4885493 - DNA, 14 bp, Homo sapiens
aatatggacaagag

SEQ ID NO: 4885494 - DNA, 15 bp, Homo sapiens
aatatggacaagagg

SEQ ID NO: 4885495 - DNA, 17 bp, Homo sapiens
aatatggacacttaata

SEQ ID NO: 4885496 - DNA, 16 bp, Homo sapiens
aatatggttgatagtt

SEQ ID NO: 4885497 - DNA, 20 bp, Homo sapiens
aatatgtattgtaaacatgt

SEQ ID NO: 4885498 - DNA, 13 bp, Homo sapiens
aatattaaatctg

SEQ ID NO: 4885499 - DNA, 13 bp, Homo sapiens
aatattcccaagc

SEQ ID NO: 4885500 - DNA, 16 bp, Homo sapiens
aatattgtgttccttt

SEQ ID NO: 4885501 - DNA, 17 bp, Homo sapiens
aatattgtgttgtgaat

SEQ ID NO: 4885502 - DNA, 18 bp, Homo sapiens
aatattgtgttgtgaatg

SEQ ID NO: 4885503 - DNA, 20 bp, Homo sapiens
aatattgttgacaactgtga

SEQ ID NO: 4885504 - DNA, 18 bp, Homo sapiens
aatattgttgtataattt

SEQ ID NO: 4885505 - DNA, 18 bp, Homo sapiens
aatattgtttttctttct

SEQ ID NO: 4885506 - DNA, 19 bp, Homo sapiens
aatatttaaacagcagtgt

SEQ ID NO: 4885507 - DNA, 21 bp, Homo sapiens
aatatttaacattatttatat

SEQ ID NO: 4885508 - DNA, 17 bp, Homo sapiens
aatatttatatatttat

SEQ ID NO: 4885509 - DNA, 17 bp, Homo sapiens
aatatttattaaataaa

SEQ ID NO: 4885510 - DNA, 13 bp, Homo sapiens
aatatttatttat

SEQ ID NO: 4885511 - DNA, 18 bp, Homo sapiens
aatatttgactattctgt

SEQ ID NO: 4885512 - DNA, 16 bp, Homo sapiens
aatattttcagcctac

SEQ ID NO: 4885513 - DNA, 13 bp, Homo sapiens
aatattttcagta

SEQ ID NO: 4885514 - DNA, 20 bp, Homo sapiens
aatattttgataataaattg

SEQ ID NO: 4885515 - DNA, 22 bp, Homo sapiens
aatattttgataataatattgt

SEQ ID NO: 4885516 - DNA, 16 bp, Homo sapiens
aatatttttatataca

SEQ ID NO: 4885517 - DNA, 13 bp, Homo sapiens
aatcaagagctgc

SEQ ID NO: 4885518 - DNA, 17 bp, Homo sapiens
aatcaagagctgccctc

SEQ ID NO: 4885519 - DNA, 14 bp, Homo sapiens
aatcaagtattttg

SEQ ID NO: 4885520 - DNA, 15 bp, Homo sapiens
aatcaagtattttgt

SEQ ID NO: 4885521 - DNA, 15 bp, Homo sapiens
aatcaataaagaaaa

SEQ ID NO: 4885522 - DNA, 19 bp, Homo sapiens
aatcaatgaatattgaagt

SEQ ID NO: 4885523 - DNA, 16 bp, Homo sapiens
aatcaatttttaggaa

SEQ ID NO: 4885524 - DNA, 14 bp, Homo sapiens
aatcacaaaaattt

SEQ ID NO: 4885525 - DNA, 15 bp, Homo sapiens
aatcaccaaaggctc

SEQ ID NO: 4885526 - DNA, 13 bp, Homo sapiens
aatcactttgtct

SEQ ID NO: 4885527 - DNA, 14 bp, Homo sapiens
aatcagaaattttt

SEQ ID NO: 4885528 - DNA, 15 bp, Homo sapiens
aatcagagtagaaat

SEQ ID NO: 4885529 - DNA, 12 bp, Homo sapiens
aatcagcattct

SEQ ID NO: 4885530 - DNA, 23 bp, Homo sapiens
aatcagctatttactgccaaagg

SEQ ID NO: 4885531 - DNA, 18 bp, Homo sapiens
aatcagtgggcaggataa

SEQ ID NO: 4885532 - DNA, 18 bp, Homo sapiens
aatcagtgtgtctaaatt

SEQ ID NO: 4885533 - DNA, 22 bp, Homo sapiens
aatcagtgtgtctaaatttgaa

SEQ ID NO: 4885534 - DNA, 16 bp, Homo sapiens
aatcatattgatgaaa

SEQ ID NO: 4885535 - DNA, 14 bp, Homo sapiens
aatcatcgaaaatt

SEQ ID NO: 4885536 - DNA, 16 bp, Homo sapiens
aatcatcgaaaattca

SEQ ID NO: 4885537 - DNA, 21 bp, Homo sapiens
aatcatcgaaaattcatttca

SEQ ID NO: 4885538 - DNA, 23 bp, Homo sapiens
aatcatcgaaaattcatttcaca

SEQ ID NO: 4885539 - DNA, 18 bp, Homo sapiens
aatcatctataaagaaga

SEQ ID NO: 4885540 - DNA, 13 bp, Homo sapiens
aatcatctatttt

SEQ ID NO: 4885541 - DNA, 15 bp, Homo sapiens
aatcatctgtgtgaa

SEQ ID NO: 4885542 - DNA, 18 bp, Homo sapiens
aatcatctgtgtgaaaat

SEQ ID NO: 4885543 - DNA, 17 bp, Homo sapiens
aatcatgaaatatgcat

SEQ ID NO: 4885544 - DNA, 16 bp, Homo sapiens
aatcattgttttgaat

SEQ ID NO: 4885545 - DNA, 18 bp, Homo sapiens
aatcattgttttgaatat

SEQ ID NO: 4885546 - DNA, 22 bp, Homo sapiens
aatcattgttttgaatattact

SEQ ID NO: 4885547 - DNA, 14 bp, Homo sapiens
aatcatttgctttt

SEQ ID NO: 4885548 - DNA, 20 bp, Homo sapiens
aatcattttacccttggctc

SEQ ID NO: 4885549 - DNA, 13 bp, Homo sapiens
aatccaaatggcg

SEQ ID NO: 4885550 - DNA, 17 bp, Homo sapiens
aatccaagctccctgcc

SEQ ID NO: 4885551 - DNA, 13 bp, Homo sapiens
aatccatatctta

SEQ ID NO: 4885552 - DNA, 16 bp, Homo sapiens
aatcccaaatttgatt

SEQ ID NO: 4885553 - DNA, 21 bp, Homo sapiens
aatcccaaatttgattgattt

SEQ ID NO: 4885554 - DNA, 21 bp, Homo sapiens
aatcccctccctgtcaaagct

SEQ ID NO: 4885555 - DNA, 17 bp, Homo sapiens
aatccccttatgacttg

SEQ ID NO: 4885556 - DNA, 19 bp, Homo sapiens
aatccctcaccttctgagt

SEQ ID NO: 4885557 - DNA, 14 bp, Homo sapiens
aatccgctctcttc

SEQ ID NO: 4885558 - DNA, 17 bp, Homo sapiens
aatccgctctcttcctg

SEQ ID NO: 4885559 - DNA, 19 bp, Homo sapiens
aatccgctctcttcctgcc

SEQ ID NO: 4885560 - DNA, 20 bp, Homo sapiens
aatccgctctcttcctgccc

SEQ ID NO: 4885561 - DNA, 23 bp, Homo sapiens
aatccgctctcttcctgcccctc

SEQ ID NO: 4885562 - DNA, 15 bp, Homo sapiens
aatcctaaaagaagc

SEQ ID NO: 4885563 - DNA, 18 bp, Homo sapiens
aatccttgcttatgacat

SEQ ID NO: 4885564 - DNA, 14 bp, Homo sapiens
aatcctttgcctgc

SEQ ID NO: 4885565 - DNA, 23 bp, Homo sapiens
aatcctttgttttctgactaatt

SEQ ID NO: 4885566 - DNA, 18 bp, Homo sapiens
aatccttttcctgttcat

SEQ ID NO: 4885567 - DNA, 19 bp, Homo sapiens
aatcgagtgagacaaaatt

SEQ ID NO: 4885568 - DNA, 16 bp, Homo sapiens
aatctaatattaaaaa

SEQ ID NO: 4885569 - DNA, 17 bp, Homo sapiens
aatctaatattaaaaat

SEQ ID NO: 4885570 - DNA, 13 bp, Homo sapiens
aatctagacaata

SEQ ID NO: 4885571 - DNA, 13 bp, Homo sapiens
aatctattctgtg

SEQ ID NO: 4885572 - DNA, 21 bp, Homo sapiens
aatctatttattaatatttaa

SEQ ID NO: 4885573 - DNA, 16 bp, Homo sapiens
aatctcaaggaatctt

SEQ ID NO: 4885574 - DNA, 21 bp, Homo sapiens
aatctcaaggaatctttaagc

SEQ ID NO: 4885575 - DNA, 22 bp, Homo sapiens
aatctcagaggtagggctgcca

SEQ ID NO: 4885576 - DNA, 22 bp, Homo sapiens
aatctcatacctctgaccaaca

SEQ ID NO: 4885577 - DNA, 15 bp, Homo sapiens
aatctccagtattct

SEQ ID NO: 4885578 - DNA, 17 bp, Homo sapiens
aatctcccgctgctgct

SEQ ID NO: 4885579 - DNA, 19 bp, Homo sapiens
aatctctcaaatctgttat

SEQ ID NO: 4885580 - DNA, 18 bp, Homo sapiens
aatctctccctcctcagt

SEQ ID NO: 4885581 - DNA, 17 bp, Homo sapiens
aatctctctgcagctgc

SEQ ID NO: 4885582 - DNA, 19 bp, Homo sapiens
aatctctctgcagctgccg

SEQ ID NO: 4885583 - DNA, 19 bp, Homo sapiens
aatctctgttatgtactgt

SEQ ID NO: 4885584 - DNA, 20 bp, Homo sapiens
aatctctgttatgtactgta

SEQ ID NO: 4885585 - DNA, 15 bp, Homo sapiens
aatctgaaattctaa

SEQ ID NO: 4885586 - DNA, 18 bp, Homo sapiens
aatctgaagcttcactca

SEQ ID NO: 4885587 - DNA, 15 bp, Homo sapiens
aatctgatctgagtg

SEQ ID NO: 4885588 - DNA, 20 bp, Homo sapiens
aatctggactcctctgtcca

SEQ ID NO: 4885589 - DNA, 14 bp, Homo sapiens
aatctggtcttgtt

SEQ ID NO: 4885590 - DNA, 21 bp, Homo sapiens
aatctgtaacaggtattttgt

SEQ ID NO: 4885591 - DNA, 14 bp, Homo sapiens
aatctgtacatttt

SEQ ID NO: 4885592 - DNA, 18 bp, Homo sapiens
aatctgtcaaaacactgt

SEQ ID NO: 4885593 - DNA, 19 bp, Homo sapiens
aatctgtcaaaacactgtg

SEQ ID NO: 4885594 - DNA, 21 bp, Homo sapiens
aatctgtccaaaggaggctgg

SEQ ID NO: 4885595 - DNA, 20 bp, Homo sapiens
aatctgtgtatattatttgg

SEQ ID NO: 4885596 - DNA, 19 bp, Homo sapiens
aatctgttctgggctcttt

SEQ ID NO: 4885597 - DNA, 14 bp, Homo sapiens
aatcttatagttct

SEQ ID NO: 4885598 - DNA, 19 bp, Homo sapiens
aatcttatagttctaggca

SEQ ID NO: 4885599 - DNA, 13 bp, Homo sapiens
aatcttgaaaatg

SEQ ID NO: 4885600 - DNA, 16 bp, Homo sapiens
aatcttgtgctagaat

SEQ ID NO: 4885601 - DNA, 20 bp, Homo sapiens
aatcttgtgctagaatactt

SEQ ID NO: 4885602 - DNA, 21 bp, Homo sapiens
aatcttttaaaaattcaaatg

SEQ ID NO: 4885603 - DNA, 19 bp, Homo sapiens
aatgaaaagtcgttttcca

SEQ ID NO: 4885604 - DNA, 11 bp, Homo sapiens
aatgaaaataa

SEQ ID NO: 4885605 - DNA, 15 bp, Homo sapiens
aatgaaaataagtga

SEQ ID NO: 4885606 - DNA, 13 bp, Homo sapiens
aatgaaaatgaat

SEQ ID NO: 4885607 - DNA, 13 bp, Homo sapiens
aatgaaagattaa

SEQ ID NO: 4885608 - DNA, 16 bp, Homo sapiens
aatgaaagattaaaca

SEQ ID NO: 4885609 - DNA, 20 bp, Homo sapiens
aatgaaaggtactatatttg

SEQ ID NO: 4885610 - DNA, 14 bp, Homo sapiens
aatgaaattgtaaa

SEQ ID NO: 4885611 - DNA, 13 bp, Homo sapiens
aatgaaatttaaa

SEQ ID NO: 4885612 - DNA, 15 bp, Homo sapiens
aatgaagcagcttta

SEQ ID NO: 4885613 - DNA, 19 bp, Homo sapiens
aatgaagcagctttaaaca

SEQ ID NO: 4885614 - DNA, 14 bp, Homo sapiens
aatgaatatctatt

SEQ ID NO: 4885615 - DNA, 20 bp, Homo sapiens
aatgaatatctattaatata

SEQ ID NO: 4885616 - DNA, 16 bp, Homo sapiens
aatgacaacagaagct

SEQ ID NO: 4885617 - DNA, 22 bp, Homo sapiens
aatgacatctcaggggccagag

SEQ ID NO: 4885618 - DNA, 16 bp, Homo sapiens
aatgacatctttttaa

SEQ ID NO: 4885619 - DNA, 21 bp, Homo sapiens
aatgacatctttttaaagctt

SEQ ID NO: 4885620 - DNA, 22 bp, Homo sapiens
aatgacatgcactgacccttcc

SEQ ID NO: 4885621 - DNA, 14 bp, Homo sapiens
aatgactacttagc

SEQ ID NO: 4885622 - DNA, 20 bp, Homo sapiens
aatgactcagaatattgctt

SEQ ID NO: 4885623 - DNA, 17 bp, Homo sapiens
aatgagaaggcagccac

SEQ ID NO: 4885624 - DNA, 23 bp, Homo sapiens
aatgagctattaaaactcagcct

SEQ ID NO: 4885625 - DNA, 17 bp, Homo sapiens
aatgaggattattgata

SEQ ID NO: 4885626 - DNA, 18 bp, Homo sapiens
aatgaggtcagagcctgc

SEQ ID NO: 4885627 - DNA, 15 bp, Homo sapiens
aatgaggtcccaggc

SEQ ID NO: 4885628 - DNA, 16 bp, Homo sapiens
aatgaggtctgtttaa

SEQ ID NO: 4885629 - DNA, 14 bp, Homo sapiens
aatgagtctgttgt

SEQ ID NO: 4885630 - DNA, 20 bp, Homo sapiens
aatgatccccaagtgtgaac

SEQ ID NO: 4885631 - DNA, 16 bp, Homo sapiens
aatgatctcttctttt

SEQ ID NO: 4885632 - DNA, 18 bp, Homo sapiens
aatgatgccctgctccag

SEQ ID NO: 4885633 - DNA, 17 bp, Homo sapiens
aatgatggcaattttgt

SEQ ID NO: 4885634 - DNA, 14 bp, Homo sapiens
aatgatttttagat

SEQ ID NO: 4885635 - DNA, 22 bp, Homo sapiens
aatgcaagagtgattgcagctt

SEQ ID NO: 4885636 - DNA, 16 bp, Homo sapiens
aatgcacagatatact

SEQ ID NO: 4885637 - DNA, 16 bp, Homo sapiens
aatgcacatccattcc

SEQ ID NO: 4885638 - DNA, 13 bp, Homo sapiens
aatgcacggcctc

SEQ ID NO: 4885639 - DNA, 16 bp, Homo sapiens
aatgcagcttgtgtgc

SEQ ID NO: 4885640 - DNA, 14 bp, Homo sapiens
aatgcataaatgca

SEQ ID NO: 4885641 - DNA, 13 bp, Homo sapiens
aatgcatgagtaa

SEQ ID NO: 4885642 - DNA, 18 bp, Homo sapiens
aatgcatgagtaaaaaaa

SEQ ID NO: 4885643 - DNA, 16 bp, Homo sapiens
aatgccattatccctg

SEQ ID NO: 4885644 - DNA, 13 bp, Homo sapiens
aatgcctttgaga

SEQ ID NO: 4885645 - DNA, 14 bp, Homo sapiens
aatgcctttgagac

SEQ ID NO: 4885646 - DNA, 14 bp, Homo sapiens
aatgctattgaaaa

SEQ ID NO: 4885647 - DNA, 20 bp, Homo sapiens
aatgctatttttgtttttag

SEQ ID NO: 4885648 - DNA, 19 bp, Homo sapiens
aatgctctctcaaattgtc

SEQ ID NO: 4885649 - DNA, 20 bp, Homo sapiens
aatgctctggggtcttttta

SEQ ID NO: 4885650 - DNA, 17 bp, Homo sapiens
aatgctgcaaacttaat

SEQ ID NO: 4885651 - DNA, 12 bp, Homo sapiens
aatgctgcactt

SEQ ID NO: 4885652 - DNA, 12 bp, Homo sapiens
aatgctgtgtta

SEQ ID NO: 4885653 - DNA, 15 bp, Homo sapiens
aatgcttaatttcta

SEQ ID NO: 4885654 - DNA, 20 bp, Homo sapiens
aatgcttaatttctaaagat

SEQ ID NO: 4885655 - DNA, 14 bp, Homo sapiens
aatggaaacctcac

SEQ ID NO: 4885656 - DNA, 14 bp, Homo sapiens
aatggaagagaaat

SEQ ID NO: 4885657 - DNA, 23 bp, Homo sapiens
aatggactggaaggggaagggac

SEQ ID NO: 4885658 - DNA, 17 bp, Homo sapiens
aatggactttggaagca

SEQ ID NO: 4885659 - DNA, 12 bp, Homo sapiens
aatggattgtta

SEQ ID NO: 4885660 - DNA, 18 bp, Homo sapiens
aatggattgttaatttca

SEQ ID NO: 4885661 - DNA, 14 bp, Homo sapiens
aatggccttccttc

SEQ ID NO: 4885662 - DNA, 23 bp, Homo sapiens
aatgggcactgggatgagccgct

SEQ ID NO: 4885663 - DNA, 19 bp, Homo sapiens
aatggtacatgtcttccat

SEQ ID NO: 4885664 - DNA, 23 bp, Homo sapiens
aatggtagtaatcacagttggcc

SEQ ID NO: 4885665 - DNA, 16 bp, Homo sapiens
aatggtataaatttca

SEQ ID NO: 4885666 - DNA, 16 bp, Homo sapiens
aatggtcgcccaggag

SEQ ID NO: 4885667 - DNA, 22 bp, Homo sapiens
aatggtctttctaatgtgtgaa

SEQ ID NO: 4885668 - DNA, 22 bp, Homo sapiens
aatggtggggaactataaagaa

SEQ ID NO: 4885669 - DNA, 15 bp, Homo sapiens
aatggttgccttaaa

SEQ ID NO: 4885670 - DNA, 18 bp, Homo sapiens
aatggttgccttaaagaa

SEQ ID NO: 4885671 - DNA, 22 bp, Homo sapiens
aatggtttattttgtattgtgg

SEQ ID NO: 4885672 - DNA, 12 bp, Homo sapiens
aatgtaaaaaag

SEQ ID NO: 4885673 - DNA, 17 bp, Homo sapiens
aatgtaaaatgttgaat

SEQ ID NO: 4885674 - DNA, 21 bp, Homo sapiens
aatgtaaaggagtcaaaacta

SEQ ID NO: 4885675 - DNA, 18 bp, Homo sapiens
aatgtaaatattctatat

SEQ ID NO: 4885676 - DNA, 15 bp, Homo sapiens
aatgtaacttagaga

SEQ ID NO: 4885677 - DNA, 21 bp, Homo sapiens
aatgtagcgtgtttacatgtg

SEQ ID NO: 4885678 - DNA, 14 bp, Homo sapiens
aatgtatatacaca

SEQ ID NO: 4885679 - DNA, 17 bp, Homo sapiens
aatgtatatacacatat

SEQ ID NO: 4885680 - DNA, 18 bp, Homo sapiens
aatgtatcatagaaatgt

SEQ ID NO: 4885681 - DNA, 21 bp, Homo sapiens
aatgtatcccttctcacagca

SEQ ID NO: 4885682 - DNA, 13 bp, Homo sapiens
aatgtatctgtga

SEQ ID NO: 4885683 - DNA, 14 bp, Homo sapiens
aatgtatctgtgaa

SEQ ID NO: 4885684 - DNA, 17 bp, Homo sapiens
aatgtatttgttcatgt

SEQ ID NO: 4885685 - DNA, 20 bp, Homo sapiens
aatgtatttgttcatgtttg

SEQ ID NO: 4885686 - DNA, 21 bp, Homo sapiens
aatgtatttgttcatgtttgg

SEQ ID NO: 4885687 - DNA, 19 bp, Homo sapiens
aatgtcacaggcaggtcca

SEQ ID NO: 4885688 - DNA, 13 bp, Homo sapiens
aatgtcagtattt

SEQ ID NO: 4885689 - DNA, 18 bp, Homo sapiens
aatgtcctccagaagcct

SEQ ID NO: 4885690 - DNA, 23 bp, Homo sapiens
aatgtcctccagaagcctctggc

SEQ ID NO: 4885691 - DNA, 16 bp, Homo sapiens
aatgtcctgcctttta

SEQ ID NO: 4885692 - DNA, 15 bp, Homo sapiens
aatgtctaaaattgt

SEQ ID NO: 4885693 - DNA, 18 bp, Homo sapiens
aatgtctaaatgctgaaa

SEQ ID NO: 4885694 - DNA, 20 bp, Homo sapiens
aatgtctctttaatgtcaca

SEQ ID NO: 4885695 - DNA, 14 bp, Homo sapiens
aatgtctgtaaata

SEQ ID NO: 4885696 - DNA, 12 bp, Homo sapiens
aatgtcttcata

SEQ ID NO: 4885697 - DNA, 17 bp, Homo sapiens
aatgtcttcatttcatt

SEQ ID NO: 4885698 - DNA, 21 bp, Homo sapiens
aatgtcttcatttcattgtat

SEQ ID NO: 4885699 - DNA, 16 bp, Homo sapiens
aatgtctttgtaagtc

SEQ ID NO: 4885700 - DNA, 13 bp, Homo sapiens
aatgtcttttgaa

SEQ ID NO: 4885701 - DNA, 17 bp, Homo sapiens
aatgtgaacttgtagct

SEQ ID NO: 4885702 - DNA, 17 bp, Homo sapiens
aatgtgatgatgtaatt

SEQ ID NO: 4885703 - DNA, 14 bp, Homo sapiens
aatgtgatgttcta

SEQ ID NO: 4885704 - DNA, 17 bp, Homo sapiens
aatgtgatgttctaagg

SEQ ID NO: 4885705 - DNA, 19 bp, Homo sapiens
aatgtgattctaatgtctt

SEQ ID NO: 4885706 - DNA, 20 bp, Homo sapiens
aatgtgcagatgcaattgtt

SEQ ID NO: 4885707 - DNA, 16 bp, Homo sapiens
aatgtggtctcaggat

SEQ ID NO: 4885708 - DNA, 19 bp, Homo sapiens
aatgtgtcctatctatctt

SEQ ID NO: 4885709 - DNA, 19 bp, Homo sapiens
aatgtgtgccatagagttt

SEQ ID NO: 4885710 - DNA, 13 bp, Homo sapiens
aatgtgtgtatgt

SEQ ID NO: 4885711 - DNA, 15 bp, Homo sapiens
aatgtgttgaaactg

SEQ ID NO: 4885712 - DNA, 16 bp, Homo sapiens
aatgtgtttttctcca

SEQ ID NO: 4885713 - DNA, 16 bp, Homo sapiens
aatgttaaatttgtaa

SEQ ID NO: 4885714 - DNA, 17 bp, Homo sapiens
aatgttaaatttgtaag

SEQ ID NO: 4885715 - DNA, 18 bp, Homo sapiens
aatgttaaggaaactctt

SEQ ID NO: 4885716 - DNA, 15 bp, Homo sapiens
aatgttagagacttt

SEQ ID NO: 4885717 - DNA, 16 bp, Homo sapiens
aatgttatcttctcaa

SEQ ID NO: 4885718 - DNA, 22 bp, Homo sapiens
aatgttatgactatgtaaacta

SEQ ID NO: 4885719 - DNA, 17 bp, Homo sapiens
aatgttatttctgcaaa

SEQ ID NO: 4885720 - DNA, 22 bp, Homo sapiens
aatgttatttgttattttcagt

SEQ ID NO: 4885721 - DNA, 18 bp, Homo sapiens
aatgttattttcttctaa

SEQ ID NO: 4885722 - DNA, 19 bp, Homo sapiens
aatgttcacgcaacttgaa

SEQ ID NO: 4885723 - DNA, 20 bp, Homo sapiens
aatgttctatggttatgaaa

SEQ ID NO: 4885724 - DNA, 21 bp, Homo sapiens
aatgttcttatgcaaaatgga

SEQ ID NO: 4885725 - DNA, 20 bp, Homo sapiens
aatgttggacacctttaggt

SEQ ID NO: 4885726 - DNA, 15 bp, Homo sapiens
aatgttggtttactt

SEQ ID NO: 4885727 - DNA, 18 bp, Homo sapiens
aatgttggtttactttca

SEQ ID NO: 4885728 - DNA, 21 bp, Homo sapiens
aatgtttatgcaaggaaggaa

SEQ ID NO: 4885729 - DNA, 22 bp, Homo sapiens
aatgtttatgcaaggaaggaaa

SEQ ID NO: 4885730 - DNA, 23 bp, Homo sapiens
aatgtttatgcaaggaaggaaag

SEQ ID NO: 4885731 - DNA, 15 bp, Homo sapiens
aatgtttattccttg

SEQ ID NO: 4885732 - DNA, 12 bp, Homo sapiens
aatgtttctatc

SEQ ID NO: 4885733 - DNA, 20 bp, Homo sapiens
aatgtttgaggagcatgttt

SEQ ID NO: 4885734 - DNA, 21 bp, Homo sapiens
aatgtttgaggagcatgtttt

SEQ ID NO: 4885735 - DNA, 16 bp, Homo sapiens
aatgtttgcctctgcc

SEQ ID NO: 4885736 - DNA, 19 bp, Homo sapiens
aatgtttgtctcagttgga

SEQ ID NO: 4885737 - DNA, 16 bp, Homo sapiens
aattaaaaagattctt

SEQ ID NO: 4885738 - DNA, 16 bp, Homo sapiens
aattaaaacagctgca

SEQ ID NO: 4885739 - DNA, 20 bp, Homo sapiens
aattaaaacttcttaaatat

SEQ ID NO: 4885740 - DNA, 12 bp, Homo sapiens
aattaaatctgt

SEQ ID NO: 4885741 - DNA, 23 bp, Homo sapiens
aattaagaaggcaaaaatgtaaa

SEQ ID NO: 4885742 - DNA, 12 bp, Homo sapiens
aattaagacaag

SEQ ID NO: 4885743 - DNA, 23 bp, Homo sapiens
aattaataaaaaatggaaagaat

SEQ ID NO: 4885744 - DNA, 14 bp, Homo sapiens
aattaatagctttt

SEQ ID NO: 4885745 - DNA, 15 bp, Homo sapiens
aattaatttgattaa

SEQ ID NO: 4885746 - DNA, 13 bp, Homo sapiens
aattaattttact

SEQ ID NO: 4885747 - DNA, 17 bp, Homo sapiens
aattacatgtaaaacat

SEQ ID NO: 4885748 - DNA, 12 bp, Homo sapiens
aattacttaaaa

SEQ ID NO: 4885749 - DNA, 19 bp, Homo sapiens
aattaggaggctcaacaat

SEQ ID NO: 4885750 - DNA, 17 bp, Homo sapiens
aattagggtacatttat

SEQ ID NO: 4885751 - DNA, 14 bp, Homo sapiens
aattaggttaacat

SEQ ID NO: 4885752 - DNA, 18 bp, Homo sapiens
aattaggtttttccttat

SEQ ID NO: 4885753 - DNA, 13 bp, Homo sapiens
aattatacaaatt

SEQ ID NO: 4885754 - DNA, 13 bp, Homo sapiens
aattatagtttca

SEQ ID NO: 4885755 - DNA, 13 bp, Homo sapiens
aattatagtttct

SEQ ID NO: 4885756 - DNA, 20 bp, Homo sapiens
aattatcaatatctaatata

SEQ ID NO: 4885757 - DNA, 23 bp, Homo sapiens
aattatctatagctaagtacaca

SEQ ID NO: 4885758 - DNA, 18 bp, Homo sapiens
aattatgcactaaatatg

SEQ ID NO: 4885759 - DNA, 19 bp, Homo sapiens
aattatgcactaaatatga

SEQ ID NO: 4885760 - DNA, 22 bp, Homo sapiens
aattatgtgacattttacatta

SEQ ID NO: 4885761 - DNA, 18 bp, Homo sapiens
aattattataagcattga

SEQ ID NO: 4885762 - DNA, 12 bp, Homo sapiens
aattattatttg

SEQ ID NO: 4885763 - DNA, 16 bp, Homo sapiens
aattattatttgtgtt

SEQ ID NO: 4885764 - DNA, 18 bp, Homo sapiens
aattattatttgtgtttt

SEQ ID NO: 4885765 - DNA, 13 bp, Homo sapiens
aattattgatata

SEQ ID NO: 4885766 - DNA, 15 bp, Homo sapiens
aattattgatatata

SEQ ID NO: 4885767 - DNA, 17 bp, Homo sapiens
aattattgatatatatt

SEQ ID NO: 4885768 - DNA, 18 bp, Homo sapiens
aattattgatatatatta

SEQ ID NO: 4885769 - DNA, 15 bp, Homo sapiens
aattatttgtgtaat

SEQ ID NO: 4885770 - DNA, 18 bp, Homo sapiens
aattatttgtgtaataga

SEQ ID NO: 4885771 - DNA, 16 bp, Homo sapiens
aattcaaaaagtgttt

SEQ ID NO: 4885772 - DNA, 16 bp, Homo sapiens
aattcaaaagttccaa

SEQ ID NO: 4885773 - DNA, 20 bp, Homo sapiens
aattcaagaaaacaacttca

SEQ ID NO: 4885774 - DNA, 21 bp, Homo sapiens
aattcaccccctttcctggac

SEQ ID NO: 4885775 - DNA, 13 bp, Homo sapiens
aattcatattctt

SEQ ID NO: 4885776 - DNA, 20 bp, Homo sapiens
aattccacaccttttattga

SEQ ID NO: 4885777 - DNA, 14 bp, Homo sapiens
aattccactgtcaa

SEQ ID NO: 4885778 - DNA, 13 bp, Homo sapiens
aattcctacagca

SEQ ID NO: 4885779 - DNA, 14 bp, Homo sapiens
aattcctacagcac

SEQ ID NO: 4885780 - DNA, 21 bp, Homo sapiens
aattcctctcactaaacttta

SEQ ID NO: 4885781 - DNA, 21 bp, Homo sapiens
aattcgcccgagctgtttatg

SEQ ID NO: 4885782 - DNA, 15 bp, Homo sapiens
aattcttatgcttat

SEQ ID NO: 4885783 - DNA, 23 bp, Homo sapiens
aattcttcacctaagtctctgtg

SEQ ID NO: 4885784 - DNA, 15 bp, Homo sapiens
aattcttgaaggaaa

SEQ ID NO: 4885785 - DNA, 18 bp, Homo sapiens
aattcttgtaatttttat

SEQ ID NO: 4885786 - DNA, 15 bp, Homo sapiens
aattgactcaaatct

SEQ ID NO: 4885787 - DNA, 23 bp, Homo sapiens
aattgagaaaaatatatactaaa

SEQ ID NO: 4885788 - DNA, 21 bp, Homo sapiens
aattgatcataggtatttcaa

SEQ ID NO: 4885789 - DNA, 23 bp, Homo sapiens
aattgatttgcattgaacacaaa

SEQ ID NO: 4885790 - DNA, 15 bp, Homo sapiens
aattgcataaagcat

SEQ ID NO: 4885791 - DNA, 16 bp, Homo sapiens
aattgcataaagcata

SEQ ID NO: 4885792 - DNA, 11 bp, Homo sapiens
aattgcattga

SEQ ID NO: 4885793 - DNA, 19 bp, Homo sapiens
aattgctatgttactattt

SEQ ID NO: 4885794 - DNA, 12 bp, Homo sapiens
aattgctccttg

SEQ ID NO: 4885795 - DNA, 16 bp, Homo sapiens
aattggaacaaagtga

SEQ ID NO: 4885796 - DNA, 20 bp, Homo sapiens
aattggaagctgccctgccc

SEQ ID NO: 4885797 - DNA, 21 bp, Homo sapiens
aattgggagcttgggaatgga

SEQ ID NO: 4885798 - DNA, 14 bp, Homo sapiens
aattgggagtccag

SEQ ID NO: 4885799 - DNA, 21 bp, Homo sapiens
aattgggagtccaggcacagg

SEQ ID NO: 4885800 - DNA, 16 bp, Homo sapiens
aattgggttcatgatg

SEQ ID NO: 4885801 - DNA, 19 bp, Homo sapiens
aattgggttcatgatgcag

SEQ ID NO: 4885802 - DNA, 20 bp, Homo sapiens
aattgggttcatgatgcagt

SEQ ID NO: 4885803 - DNA, 15 bp, Homo sapiens
aattgtacatatttg

SEQ ID NO: 4885804 - DNA, 17 bp, Homo sapiens
aattgtccgtgttcata

SEQ ID NO: 4885805 - DNA, 12 bp, Homo sapiens
aattgtctattt

SEQ ID NO: 4885806 - DNA, 18 bp, Homo sapiens
aattgtctatttatcttt

SEQ ID NO: 4885807 - DNA, 20 bp, Homo sapiens
aattgtcttttgtcatgtgg

SEQ ID NO: 4885808 - DNA, 13 bp, Homo sapiens
aattgtgctgcca

SEQ ID NO: 4885809 - DNA, 12 bp, Homo sapiens
aattgtgcttct

SEQ ID NO: 4885810 - DNA, 21 bp, Homo sapiens
aattgtgcttctccccagaat

SEQ ID NO: 4885811 - DNA, 23 bp, Homo sapiens
aattgtgggcataaactgtttca

SEQ ID NO: 4885812 - DNA, 12 bp, Homo sapiens
aattgttgtttc

SEQ ID NO: 4885813 - DNA, 17 bp, Homo sapiens
aattgtttggcttcctc

SEQ ID NO: 4885814 - DNA, 18 bp, Homo sapiens
aattgttttaatctgaaa

SEQ ID NO: 4885815 - DNA, 19 bp, Homo sapiens
aattgttttaatctgaaat

SEQ ID NO: 4885816 - DNA, 20 bp, Homo sapiens
aattgttttgcactttttta

SEQ ID NO: 4885817 - DNA, 15 bp, Homo sapiens
aatttaaacacctcc

SEQ ID NO: 4885818 - DNA, 13 bp, Homo sapiens
aatttaaacatta

SEQ ID NO: 4885819 - DNA, 22 bp, Homo sapiens
aatttaaacattaaaaatggaa

SEQ ID NO: 4885820 - DNA, 16 bp, Homo sapiens
aatttaaatataattc

SEQ ID NO: 4885821 - DNA, 19 bp, Homo sapiens
aatttaaatataattctgt

SEQ ID NO: 4885822 - DNA, 20 bp, Homo sapiens
aatttaaatataattctgta

SEQ ID NO: 4885823 - DNA, 15 bp, Homo sapiens
aatttaaatttaaag

SEQ ID NO: 4885824 - DNA, 17 bp, Homo sapiens
aatttaaatttaaagat

SEQ ID NO: 4885825 - DNA, 18 bp, Homo sapiens
aatttaaatttaaagata

SEQ ID NO: 4885826 - DNA, 21 bp, Homo sapiens
aatttaactagacacagataa

SEQ ID NO: 4885827 - DNA, 15 bp, Homo sapiens
aatttactatatata

SEQ ID NO: 4885828 - DNA, 15 bp, Homo sapiens
aatttactttacaca

SEQ ID NO: 4885829 - DNA, 21 bp, Homo sapiens
aatttagggtactaaatttaa

SEQ ID NO: 4885830 - DNA, 22 bp, Homo sapiens
aatttagggtactaaatttaaa

SEQ ID NO: 4885831 - DNA, 21 bp, Homo sapiens
aatttagtgatcttagcatag

SEQ ID NO: 4885832 - DNA, 16 bp, Homo sapiens
aatttataaaattaga

SEQ ID NO: 4885833 - DNA, 18 bp, Homo sapiens
aatttataaaattagaaa

SEQ ID NO: 4885834 - DNA, 15 bp, Homo sapiens
aatttataaagtacc

SEQ ID NO: 4885835 - DNA, 18 bp, Homo sapiens
aatttattagttaatata

SEQ ID NO: 4885836 - DNA, 17 bp, Homo sapiens
aatttattattgaaatt

SEQ ID NO: 4885837 - DNA, 14 bp, Homo sapiens
aatttcaaggttct

SEQ ID NO: 4885838 - DNA, 18 bp, Homo sapiens
aatttcaaggttctaacc

SEQ ID NO: 4885839 - DNA, 18 bp, Homo sapiens
aatttcatatgctgtata

SEQ ID NO: 4885840 - DNA, 21 bp, Homo sapiens
aatttcctttatatttagtga

SEQ ID NO: 4885841 - DNA, 22 bp, Homo sapiens
aatttctaaaaaacagaggcca

SEQ ID NO: 4885842 - DNA, 18 bp, Homo sapiens
aatttctaccatttcaga

SEQ ID NO: 4885843 - DNA, 14 bp, Homo sapiens
aatttctgtgaaac

SEQ ID NO: 4885844 - DNA, 24 bp, Homo sapiens
aatttcttgctctatctctcaaaa

SEQ ID NO: 4885845 - DNA, 14 bp, Homo sapiens
aatttgaggacaac

SEQ ID NO: 4885846 - DNA, 15 bp, Homo sapiens
aatttgatacataat

SEQ ID NO: 4885847 - DNA, 16 bp, Homo sapiens
aatttgatacttatat

SEQ ID NO: 4885848 - DNA, 20 bp, Homo sapiens
aatttgatacttatattttc

SEQ ID NO: 4885849 - DNA, 18 bp, Homo sapiens
aatttgattaacaaatat

SEQ ID NO: 4885850 - DNA, 15 bp, Homo sapiens
aatttgattgatttg

SEQ ID NO: 4885851 - DNA, 17 bp, Homo sapiens
aatttgattgatttgaa

SEQ ID NO: 4885852 - DNA, 20 bp, Homo sapiens
aatttgattgatttgaagaa

SEQ ID NO: 4885853 - DNA, 18 bp, Homo sapiens
aatttgcattaaattcac

SEQ ID NO: 4885854 - DNA, 23 bp, Homo sapiens
aatttgcattaaattcacaaact

SEQ ID NO: 4885855 - DNA, 22 bp, Homo sapiens
aatttgggaaggtttgtgtttt

SEQ ID NO: 4885856 - DNA, 20 bp, Homo sapiens
aatttggggacagattcagt

SEQ ID NO: 4885857 - DNA, 22 bp, Homo sapiens
aatttggggacagattcagtct

SEQ ID NO: 4885858 - DNA, 19 bp, Homo sapiens
aatttggtttaaaaataca

SEQ ID NO: 4885859 - DNA, 14 bp, Homo sapiens
aatttgtaagtttc

SEQ ID NO: 4885860 - DNA, 17 bp, Homo sapiens
aatttgtttgaaatctt

SEQ ID NO: 4885861 - DNA, 18 bp, Homo sapiens
aattttaaaaatacatat

SEQ ID NO: 4885862 - DNA, 14 bp, Homo sapiens
aattttagtattca

SEQ ID NO: 4885863 - DNA, 20 bp, Homo sapiens
aattttattttgtgctcatt

SEQ ID NO: 4885864 - DNA, 23 bp, Homo sapiens
aattttattttgtgctcatttaa

SEQ ID NO: 4885865 - DNA, 11 bp, Homo sapiens
aattttctaag

SEQ ID NO: 4885866 - DNA, 18 bp, Homo sapiens
aattttctagactttctg

SEQ ID NO: 4885867 - DNA, 20 bp, Homo sapiens
aattttctagactttctgtt

SEQ ID NO: 4885868 - DNA, 15 bp, Homo sapiens
aattttgcaaatata

SEQ ID NO: 4885869 - DNA, 19 bp, Homo sapiens
aattttgcaaatataaaca

SEQ ID NO: 4885870 - DNA, 20 bp, Homo sapiens
aattttgcaaatataaacat

SEQ ID NO: 4885871 - DNA, 17 bp, Homo sapiens
aattttgcttttaatta

SEQ ID NO: 4885872 - DNA, 13 bp, Homo sapiens
aattttgttgctg

SEQ ID NO: 4885873 - DNA, 13 bp, Homo sapiens
aatttttaagcaa

SEQ ID NO: 4885874 - DNA, 22 bp, Homo sapiens
aatttttaccctaatgtcttca

SEQ ID NO: 4885875 - DNA, 22 bp, Homo sapiens
aatttttaggaagttttctgta

SEQ ID NO: 4885876 - DNA, 20 bp, Homo sapiens
aatttttcagctctctgtat

SEQ ID NO: 4885877 - DNA, 13 bp, Homo sapiens
aatttttgtagta

SEQ ID NO: 4885878 - DNA, 16 bp, Homo sapiens
aatttttttgtcttta

SEQ ID NO: 4885879 - DNA, 23 bp, Homo sapiens
aattttttttagtatttatttat

SEQ ID NO: 4885880 - DNA, 23 bp, Homo sapiens
acaaaaaaaaaaaaagaagaccg

SEQ ID NO: 4885881 - DNA, 13 bp, Homo sapiens
acaaaaaaatata

SEQ ID NO: 4885882 - DNA, 17 bp, Homo sapiens
acaaaaaaatatattta

SEQ ID NO: 4885883 - DNA, 18 bp, Homo sapiens
acaaaaagaaaagaaaat

SEQ ID NO: 4885884 - DNA, 15 bp, Homo sapiens
acaaaaagacaaaca

SEQ ID NO: 4885885 - DNA, 13 bp, Homo sapiens
acaaaaatttgaa

SEQ ID NO: 4885886 - DNA, 17 bp, Homo sapiens
acaaaactatacttgaa

SEQ ID NO: 4885887 - DNA, 20 bp, Homo sapiens
acaaaagaaaagacttgtaa

SEQ ID NO: 4885888 - DNA, 15 bp, Homo sapiens
acaaaatagaagctg

SEQ ID NO: 4885889 - DNA, 22 bp, Homo sapiens
acaaaattttattttgtgctca

SEQ ID NO: 4885890 - DNA, 16 bp, Homo sapiens
acaaacaatctcttaa

SEQ ID NO: 4885891 - DNA, 19 bp, Homo sapiens
acaaacattgtgttgacat

SEQ ID NO: 4885892 - DNA, 14 bp, Homo sapiens
acaaacatttttca

SEQ ID NO: 4885893 - DNA, 16 bp, Homo sapiens
acaaacatttttcaac

SEQ ID NO: 4885894 - DNA, 16 bp, Homo sapiens
acaaaccacaactgac

SEQ ID NO: 4885895 - DNA, 21 bp, Homo sapiens
acaaaccacaactgacacagg

SEQ ID NO: 4885896 - DNA, 23 bp, Homo sapiens
acaaaccacaactgacacaggaa

SEQ ID NO: 4885897 - DNA, 14 bp, Homo sapiens
acaaaccatgcaaa

SEQ ID NO: 4885898 - DNA, 13 bp, Homo sapiens
acaaactcttgaa

SEQ ID NO: 4885899 - DNA, 18 bp, Homo sapiens
acaaacttttcaaggctt

SEQ ID NO: 4885900 - DNA, 20 bp, Homo sapiens
acaaagatggctcagagggg

SEQ ID NO: 4885901 - DNA, 16 bp, Homo sapiens
acaaagcacagtttga

SEQ ID NO: 4885902 - DNA, 17 bp, Homo sapiens
acaaagcacagtttgaa

SEQ ID NO: 4885903 - DNA, 18 bp, Homo sapiens
acaaagcccttccatgtc

SEQ ID NO: 4885904 - DNA, 13 bp, Homo sapiens
acaaagctgttaa

SEQ ID NO: 4885905 - DNA, 17 bp, Homo sapiens
acaaagctgttaaactg

SEQ ID NO: 4885906 - DNA, 18 bp, Homo sapiens
acaaagctgttaaactgt

SEQ ID NO: 4885907 - DNA, 19 bp, Homo sapiens
acaaagctgttaaactgtt

SEQ ID NO: 4885908 - DNA, 20 bp, Homo sapiens
acaaagctgttaaactgtta

SEQ ID NO: 4885909 - DNA, 17 bp, Homo sapiens
acaaaggccaaactgct

SEQ ID NO: 4885910 - DNA, 24 bp, Homo sapiens
acaaaggttgagatgtaaaaggta

SEQ ID NO: 4885911 - DNA, 13 bp, Homo sapiens
acaaataatcaca

SEQ ID NO: 4885912 - DNA, 15 bp, Homo sapiens
acaaataattttagt

SEQ ID NO: 4885913 - DNA, 11 bp, Homo sapiens
acaaatatgca

SEQ ID NO: 4885914 - DNA, 17 bp, Homo sapiens
acaaatatgctaatttg

SEQ ID NO: 4885915 - DNA, 18 bp, Homo sapiens
acaaatatgctaatttgg

SEQ ID NO: 4885916 - DNA, 13 bp, Homo sapiens
acaaatattcaga

SEQ ID NO: 4885917 - DNA, 18 bp, Homo sapiens
acaaatatttattttctt

SEQ ID NO: 4885918 - DNA, 16 bp, Homo sapiens
acaaatcaacagaagc

SEQ ID NO: 4885919 - DNA, 17 bp, Homo sapiens
acaaatcagttagtttt

SEQ ID NO: 4885920 - DNA, 20 bp, Homo sapiens
acaaatgccttaaaatggaa

SEQ ID NO: 4885921 - DNA, 21 bp, Homo sapiens
acaaattaaaaagattctttt

SEQ ID NO: 4885922 - DNA, 17 bp, Homo sapiens
acaaattcatattctgt

SEQ ID NO: 4885923 - DNA, 13 bp, Homo sapiens
acaacagaagctt

SEQ ID NO: 4885924 - DNA, 13 bp, Homo sapiens
acaacagaagtca

SEQ ID NO: 4885925 - DNA, 17 bp, Homo sapiens
acaacatccatgtccta

SEQ ID NO: 4885926 - DNA, 21 bp, Homo sapiens
acaaccaagcgcatccaatct

SEQ ID NO: 4885927 - DNA, 17 bp, Homo sapiens
acaacctccctcttgtt

SEQ ID NO: 4885928 - DNA, 18 bp, Homo sapiens
acaacctccctcttgttt

SEQ ID NO: 4885929 - DNA, 18 bp, Homo sapiens
acaactatcctgacttct

SEQ ID NO: 4885930 - DNA, 12 bp, Homo sapiens
acaactgacaca

SEQ ID NO: 4885931 - DNA, 21 bp, Homo sapiens
acaactgcaataacttctgac

SEQ ID NO: 4885932 - DNA, 14 bp, Homo sapiens
acaactgtgactgt

SEQ ID NO: 4885933 - DNA, 18 bp, Homo sapiens
acaacttcccagtgaatt

SEQ ID NO: 4885934 - DNA, 13 bp, Homo sapiens
acaagaaaatcag

SEQ ID NO: 4885935 - DNA, 16 bp, Homo sapiens
acaagaaatccctgtt

SEQ ID NO: 4885936 - DNA, 21 bp, Homo sapiens
acaagaaatccctgtttaata

SEQ ID NO: 4885937 - DNA, 15 bp, Homo sapiens
acaagaactgaaacc

SEQ ID NO: 4885938 - DNA, 14 bp, Homo sapiens
acaagagcagcctg

SEQ ID NO: 4885939 - DNA, 15 bp, Homo sapiens
acaagagcagcctgt

SEQ ID NO: 4885940 - DNA, 16 bp, Homo sapiens
acaagaggtacagggt

SEQ ID NO: 4885941 - DNA, 21 bp, Homo sapiens
acaagcagagtgcacagctgt

SEQ ID NO: 4885942 - DNA, 20 bp, Homo sapiens
acaagccacaagtcttccag

SEQ ID NO: 4885943 - DNA, 16 bp, Homo sapiens
acaagcccacagcaca

SEQ ID NO: 4885944 - DNA, 17 bp, Homo sapiens
acaagcgtgagccactg

SEQ ID NO: 4885945 - DNA, 15 bp, Homo sapiens
acaaggattgaaaat

SEQ ID NO: 4885946 - DNA, 18 bp, Homo sapiens
acaaggggctgttacata

SEQ ID NO: 4885947 - DNA, 22 bp, Homo sapiens
acaagtaccaaagttttatcaa

SEQ ID NO: 4885948 - DNA, 19 bp, Homo sapiens
acaagtatacttatatttc

SEQ ID NO: 4885949 - DNA, 20 bp, Homo sapiens
acaagtcctggatgttgtgt

SEQ ID NO: 4885950 - DNA, 19 bp, Homo sapiens
acaagtcctgtgaatttct

SEQ ID NO: 4885951 - DNA, 18 bp, Homo sapiens
acaataatattgttgtat

SEQ ID NO: 4885952 - DNA, 21 bp, Homo sapiens
acaataattctggagatactg

SEQ ID NO: 4885953 - DNA, 12 bp, Homo sapiens
acaatacagata

SEQ ID NO: 4885954 - DNA, 15 bp, Homo sapiens
acaatatataaaaat

SEQ ID NO: 4885955 - DNA, 12 bp, Homo sapiens
acaatatcatat

SEQ ID NO: 4885956 - DNA, 15 bp, Homo sapiens
acaatatcatatcat

SEQ ID NO: 4885957 - DNA, 18 bp, Homo sapiens
acaatcatgaaatatgca

SEQ ID NO: 4885958 - DNA, 18 bp, Homo sapiens
acaatcatttgctttttg

SEQ ID NO: 4885959 - DNA, 22 bp, Homo sapiens
acaatgcagcaaggccctgctg

SEQ ID NO: 4885960 - DNA, 18 bp, Homo sapiens
acaatgtcagtatttcag

SEQ ID NO: 4885961 - DNA, 22 bp, Homo sapiens
acaatgtcagtatttcagtgta

SEQ ID NO: 4885962 - DNA, 15 bp, Homo sapiens
acaatgtgtttttct

SEQ ID NO: 4885963 - DNA, 11 bp, Homo sapiens
acaatgttaag

SEQ ID NO: 4885964 - DNA, 21 bp, Homo sapiens
acaattaaaaacctgatggaa

SEQ ID NO: 4885965 - DNA, 21 bp, Homo sapiens
acaattgtcgaaaagagtctt

SEQ ID NO: 4885966 - DNA, 20 bp, Homo sapiens
acaattgttttaatctgaaa

SEQ ID NO: 4885967 - DNA, 22 bp, Homo sapiens
acaattgttttaatctgaaatt

SEQ ID NO: 4885968 - DNA, 16 bp, Homo sapiens
acaatttcctttatat

SEQ ID NO: 4885969 - DNA, 20 bp, Homo sapiens
acaatttcctttatatttag

SEQ ID NO: 4885970 - DNA, 14 bp, Homo sapiens
acaatttttaatgg

SEQ ID NO: 4885971 - DNA, 15 bp, Homo sapiens
acaatttttaatggc

SEQ ID NO: 4885972 - DNA, 20 bp, Homo sapiens
acacaaaccacaactgacac

SEQ ID NO: 4885973 - DNA, 15 bp, Homo sapiens
acacaaactgtaaat

SEQ ID NO: 4885974 - DNA, 21 bp, Homo sapiens
acacaaaggaagtgccccctc

SEQ ID NO: 4885975 - DNA, 13 bp, Homo sapiens
acacaaaggggat

SEQ ID NO: 4885976 - DNA, 13 bp, Homo sapiens
acacaacacacac

SEQ ID NO: 4885977 - DNA, 16 bp, Homo sapiens
acacaagtcctgtgaa

SEQ ID NO: 4885978 - DNA, 14 bp, Homo sapiens
acacaataagcaaa

SEQ ID NO: 4885979 - DNA, 14 bp, Homo sapiens
acacacaacaatta

SEQ ID NO: 4885980 - DNA, 13 bp, Homo sapiens
acacacacaaacc

SEQ ID NO: 4885981 - DNA, 13 bp, Homo sapiens
acacacacacaca

SEQ ID NO: 4885982 - DNA, 14 bp, Homo sapiens
acacacacacacac

SEQ ID NO: 4885983 - DNA, 13 bp, Homo sapiens
acacacacacata

SEQ ID NO: 4885984 - DNA, 15 bp, Homo sapiens
acacacacacataca

SEQ ID NO: 4885985 - DNA, 13 bp, Homo sapiens
acacacacacatc

SEQ ID NO: 4885986 - DNA, 13 bp, Homo sapiens
acacacacacgca

SEQ ID NO: 4885987 - DNA, 13 bp, Homo sapiens
acacacacagaaa

SEQ ID NO: 4885988 - DNA, 14 bp, Homo sapiens
acacacacatacac

SEQ ID NO: 4885989 - DNA, 14 bp, Homo sapiens
acacacacatccac

SEQ ID NO: 4885990 - DNA, 14 bp, Homo sapiens
acacacagctctgt

SEQ ID NO: 4885991 - DNA, 13 bp, Homo sapiens
acacacatgcaca

SEQ ID NO: 4885992 - DNA, 14 bp, Homo sapiens
acacaccagagccc

SEQ ID NO: 4885993 - DNA, 20 bp, Homo sapiens
acacaccagagcccaccttg

SEQ ID NO: 4885994 - DNA, 13 bp, Homo sapiens
acacacgcacgca

SEQ ID NO: 4885995 - DNA, 15 bp, Homo sapiens
acacacgcgcgcaca

SEQ ID NO: 4885996 - DNA, 16 bp, Homo sapiens
acacacgcgcgcacac

SEQ ID NO: 4885997 - DNA, 13 bp, Homo sapiens
acacactcagtgc

SEQ ID NO: 4885998 - DNA, 14 bp, Homo sapiens
acacactgaaagct

SEQ ID NO: 4885999 - DNA, 13 bp, Homo sapiens
acacactgatgct

SEQ ID NO: 4886000 - DNA, 15 bp, Homo sapiens
acacactgatgctta

SEQ ID NO: 4886001 - DNA, 19 bp, Homo sapiens
acacactttttaagaaata

SEQ ID NO: 4886002 - DNA, 17 bp, Homo sapiens
acacactttttattaga

SEQ ID NO: 4886003 - DNA, 18 bp, Homo sapiens
acacagaaaatgttgaga

SEQ ID NO: 4886004 - DNA, 12 bp, Homo sapiens
acacagaaacac

SEQ ID NO: 4886005 - DNA, 13 bp, Homo sapiens
acacagaaacctt

SEQ ID NO: 4886006 - DNA, 19 bp, Homo sapiens
acacagaaacctttttaaa

SEQ ID NO: 4886007 - DNA, 21 bp, Homo sapiens
acacagaaacctttttaaaaa

SEQ ID NO: 4886008 - DNA, 21 bp, Homo sapiens
acacagaaatatatatacata

SEQ ID NO: 4886009 - DNA, 22 bp, Homo sapiens
acacagcagcttcaccagagca

SEQ ID NO: 4886010 - DNA, 13 bp, Homo sapiens
acacagcctgggc

SEQ ID NO: 4886011 - DNA, 20 bp, Homo sapiens
acacagcctgggccccagct

SEQ ID NO: 4886012 - DNA, 15 bp, Homo sapiens
acacagctacagctt

SEQ ID NO: 4886013 - DNA, 11 bp, Homo sapiens
acacagctctg

SEQ ID NO: 4886014 - DNA, 12 bp, Homo sapiens
acacagctctgt

SEQ ID NO: 4886015 - DNA, 14 bp, Homo sapiens
acacagctctgtcc

SEQ ID NO: 4886016 - DNA, 11 bp, Homo sapiens
acacagctctt

SEQ ID NO: 4886017 - DNA, 18 bp, Homo sapiens
acacagctcttctccagg

SEQ ID NO: 4886018 - DNA, 11 bp, Homo sapiens
acacaggcagc

SEQ ID NO: 4886019 - DNA, 17 bp, Homo sapiens
acacaggcccggctcca

SEQ ID NO: 4886020 - DNA, 19 bp, Homo sapiens
acacaggcccggctccagg

SEQ ID NO: 4886021 - DNA, 22 bp, Homo sapiens
acacaggcccggctccaggctc

SEQ ID NO: 4886022 - DNA, 12 bp, Homo sapiens
acacaggctggc

SEQ ID NO: 4886023 - DNA, 20 bp, Homo sapiens
acacagggtgacggtgacaa

SEQ ID NO: 4886024 - DNA, 15 bp, Homo sapiens
acacagtcaaaataa

SEQ ID NO: 4886025 - DNA, 18 bp, Homo sapiens
acacagtcaaaataattc

SEQ ID NO: 4886026 - DNA, 11 bp, Homo sapiens
acacagtgagt

SEQ ID NO: 4886027 - DNA, 20 bp, Homo sapiens
acacagtgggaactctgaca

SEQ ID NO: 4886028 - DNA, 21 bp, Homo sapiens
acacatagattaatggcactg

SEQ ID NO: 4886029 - DNA, 22 bp, Homo sapiens
acacatagattaatggcactga

SEQ ID NO: 4886030 - DNA, 23 bp, Homo sapiens
acacatagattaatggcactgat

SEQ ID NO: 4886031 - DNA, 20 bp, Homo sapiens
acacatccagacatcatgaa

SEQ ID NO: 4886032 - DNA, 19 bp, Homo sapiens
acacatccctaatgtgtgc

SEQ ID NO: 4886033 - DNA, 21 bp, Homo sapiens
acacatccgccttttgtatac

SEQ ID NO: 4886034 - DNA, 22 bp, Homo sapiens
acacatccgccttttgtataca

SEQ ID NO: 4886035 - DNA, 13 bp, Homo sapiens
acacatctttcct

SEQ ID NO: 4886036 - DNA, 14 bp, Homo sapiens
acaccaaagttcta

SEQ ID NO: 4886037 - DNA, 16 bp, Homo sapiens
acaccacacccagcct

SEQ ID NO: 4886038 - DNA, 12 bp, Homo sapiens
acaccacagaca

SEQ ID NO: 4886039 - DNA, 15 bp, Homo sapiens
acaccacagacacac

SEQ ID NO: 4886040 - DNA, 17 bp, Homo sapiens
acaccacagacacacac

SEQ ID NO: 4886041 - DNA, 18 bp, Homo sapiens
acaccacagacacacaca

SEQ ID NO: 4886042 - DNA, 22 bp, Homo sapiens
acaccacagacacacacacgca

SEQ ID NO: 4886043 - DNA, 13 bp, Homo sapiens
acaccagagcaga

SEQ ID NO: 4886044 - DNA, 17 bp, Homo sapiens
acaccagagcagatgca

SEQ ID NO: 4886045 - DNA, 20 bp, Homo sapiens
acaccagagcagatgcagag

SEQ ID NO: 4886046 - DNA, 18 bp, Homo sapiens
acaccagagcccaccttg

SEQ ID NO: 4886047 - DNA, 19 bp, Homo sapiens
acacccagcccacttctgc

SEQ ID NO: 4886048 - DNA, 21 bp, Homo sapiens
acacccagcccacttctgcca

SEQ ID NO: 4886049 - DNA, 16 bp, Homo sapiens
acacccagcctcagtc

SEQ ID NO: 4886050 - DNA, 19 bp, Homo sapiens
acaccctcccccgccactc

SEQ ID NO: 4886051 - DNA, 22 bp, Homo sapiens
acaccctcgaagcgcgccactc

SEQ ID NO: 4886052 - DNA, 20 bp, Homo sapiens
acaccctgcaaggcccacag

SEQ ID NO: 4886053 - DNA, 16 bp, Homo sapiens
acaccgggcactcaga

SEQ ID NO: 4886054 - DNA, 14 bp, Homo sapiens
acaccgggcctgga

SEQ ID NO: 4886055 - DNA, 19 bp, Homo sapiens
acaccggggtggtgggaac

SEQ ID NO: 4886056 - DNA, 17 bp, Homo sapiens
acacctcacacctcact

SEQ ID NO: 4886057 - DNA, 19 bp, Homo sapiens
acacctcacacctcactct

SEQ ID NO: 4886058 - DNA, 13 bp, Homo sapiens
acacctcccagga

SEQ ID NO: 4886059 - DNA, 19 bp, Homo sapiens
acacctcccaggagacagt

SEQ ID NO: 4886060 - DNA, 14 bp, Homo sapiens
acacctgccctgcc

SEQ ID NO: 4886061 - DNA, 19 bp, Homo sapiens
acaccttcttattatatat

SEQ ID NO: 4886062 - DNA, 21 bp, Homo sapiens
acaccttcttattatatatat

SEQ ID NO: 4886063 - DNA, 23 bp, Homo sapiens
acaccttgtgaccttctctatat

SEQ ID NO: 4886064 - DNA, 15 bp, Homo sapiens
acacctttaggttct

SEQ ID NO: 4886065 - DNA, 14 bp, Homo sapiens
acacgaaagaaatg

SEQ ID NO: 4886066 - DNA, 15 bp, Homo sapiens
acacgaaagagagag

SEQ ID NO: 4886067 - DNA, 22 bp, Homo sapiens
acacgaccggggccagcaccac

SEQ ID NO: 4886068 - DNA, 16 bp, Homo sapiens
acacgccttcccctca

SEQ ID NO: 4886069 - DNA, 22 bp, Homo sapiens
acacgcgcgcacacacacacat

SEQ ID NO: 4886070 - DNA, 17 bp, Homo sapiens
acacgcgtgcacacacc

SEQ ID NO: 4886071 - DNA, 15 bp, Homo sapiens
acacgctgttctaat

SEQ ID NO: 4886072 - DNA, 18 bp, Homo sapiens
acactaaaattttaggca

SEQ ID NO: 4886073 - DNA, 16 bp, Homo sapiens
acactaaccacgctgg

SEQ ID NO: 4886074 - DNA, 20 bp, Homo sapiens
acactaactcaccagcccca

SEQ ID NO: 4886075 - DNA, 23 bp, Homo sapiens
acactaattcctttctatcctac

SEQ ID NO: 4886076 - DNA, 11 bp, Homo sapiens
acactatttta

SEQ ID NO: 4886077 - DNA, 20 bp, Homo sapiens
acactcacatttattctgct

SEQ ID NO: 4886078 - DNA, 22 bp, Homo sapiens
acactcacatttattctgctca

SEQ ID NO: 4886079 - DNA, 20 bp, Homo sapiens
acactcaccatgaagcgaaa

SEQ ID NO: 4886080 - DNA, 16 bp, Homo sapiens
acactcagttgttcaa

SEQ ID NO: 4886081 - DNA, 19 bp, Homo sapiens
acactccagtgccagcaat

SEQ ID NO: 4886082 - DNA, 15 bp, Homo sapiens
acactccccgaagtc

SEQ ID NO: 4886083 - DNA, 16 bp, Homo sapiens
acactctgcagactgc

SEQ ID NO: 4886084 - DNA, 21 bp, Homo sapiens
acactcttttgctttattcca

SEQ ID NO: 4886085 - DNA, 13 bp, Homo sapiens
acactgaaaaatt

SEQ ID NO: 4886086 - DNA, 19 bp, Homo sapiens
acactgcaatcatatgtga

SEQ ID NO: 4886087 - DNA, 22 bp, Homo sapiens
acactgccatcttagtttggat

SEQ ID NO: 4886088 - DNA, 15 bp, Homo sapiens
acactgcctgggctg

SEQ ID NO: 4886089 - DNA, 20 bp, Homo sapiens
acactgcctgtatactttag

SEQ ID NO: 4886090 - DNA, 22 bp, Homo sapiens
acactgcctgtatactttagta

SEQ ID NO: 4886091 - DNA, 22 bp, Homo sapiens
acactgtgcccagcccggacct

SEQ ID NO: 4886092 - DNA, 13 bp, Homo sapiens
acactgtgctata

SEQ ID NO: 4886093 - DNA, 23 bp, Homo sapiens
acactgtggaactaataaataca

SEQ ID NO: 4886094 - DNA, 20 bp, Homo sapiens
acacttctgtgagaccccca

SEQ ID NO: 4886095 - DNA, 20 bp, Homo sapiens
acacttgttccagctctttg

SEQ ID NO: 4886096 - DNA, 12 bp, Homo sapiens
acactttctctt

SEQ ID NO: 4886097 - DNA, 19 bp, Homo sapiens
acactttgcctcctgtgta

SEQ ID NO: 4886098 - DNA, 22 bp, Homo sapiens
acagaaaacattctgatttgga

SEQ ID NO: 4886099 - DNA, 13 bp, Homo sapiens
acagaaaagcata

SEQ ID NO: 4886100 - DNA, 15 bp, Homo sapiens
acagaaacactgcct

SEQ ID NO: 4886101 - DNA, 13 bp, Homo sapiens
acagaaatactat

SEQ ID NO: 4886102 - DNA, 12 bp, Homo sapiens
acagaacagctt

SEQ ID NO: 4886103 - DNA, 14 bp, Homo sapiens
acagaacagcttca

SEQ ID NO: 4886104 - DNA, 17 bp, Homo sapiens
acagaacatcattagaa

SEQ ID NO: 4886105 - DNA, 16 bp, Homo sapiens
acagaactaaatgttc

SEQ ID NO: 4886106 - DNA, 14 bp, Homo sapiens
acagaagcatttgt

SEQ ID NO: 4886107 - DNA, 15 bp, Homo sapiens
acagaagcatttgta

SEQ ID NO: 4886108 - DNA, 16 bp, Homo sapiens
acagaagcatttgtat

SEQ ID NO: 4886109 - DNA, 17 bp, Homo sapiens
acagaagcatttgtatt

SEQ ID NO: 4886110 - DNA, 14 bp, Homo sapiens
acagaagcttcaga

SEQ ID NO: 4886111 - DNA, 18 bp, Homo sapiens
acagaagtcatgaagccc

SEQ ID NO: 4886112 - DNA, 18 bp, Homo sapiens
acagaatgtatctgtgaa

SEQ ID NO: 4886113 - DNA, 21 bp, Homo sapiens
acagaatgttttactgtgaaa

SEQ ID NO: 4886114 - DNA, 14 bp, Homo sapiens
acagacaacagaag

SEQ ID NO: 4886115 - DNA, 11 bp, Homo sapiens
acagacacaca

SEQ ID NO: 4886116 - DNA, 22 bp, Homo sapiens
acagacacacacacgcacgcac

SEQ ID NO: 4886117 - DNA, 23 bp, Homo sapiens
acagacacaggcccggctccagg

SEQ ID NO: 4886118 - DNA, 15 bp, Homo sapiens
acagacatctctgca

SEQ ID NO: 4886119 - DNA, 11 bp, Homo sapiens
acagactgcaa

SEQ ID NO: 4886120 - DNA, 23 bp, Homo sapiens
acagactgcgatttgtcccaggt

SEQ ID NO: 4886121 - DNA, 24 bp, Homo sapiens
acagagagggagagcagagaaaga

SEQ ID NO: 4886122 - DNA, 17 bp, Homo sapiens
acagagattgaactcca

SEQ ID NO: 4886123 - DNA, 18 bp, Homo sapiens
acagagccgagcaatatt

SEQ ID NO: 4886124 - DNA, 22 bp, Homo sapiens
acagagcgtggctgtgctctca

SEQ ID NO: 4886125 - DNA, 12 bp, Homo sapiens
acagagctgtgg

SEQ ID NO: 4886126 - DNA, 17 bp, Homo sapiens
acagaggccatggcaga

SEQ ID NO: 4886127 - DNA, 12 bp, Homo sapiens
acagaggcctgc

SEQ ID NO: 4886128 - DNA, 13 bp, Homo sapiens
acagaggcctgcc

SEQ ID NO: 4886129 - DNA, 23 bp, Homo sapiens
acagagtatgaacacctgggctt

SEQ ID NO: 4886130 - DNA, 19 bp, Homo sapiens
acagagtctcactgttgcc

SEQ ID NO: 4886131 - DNA, 22 bp, Homo sapiens
acagataataatgggtttcttt

SEQ ID NO: 4886132 - DNA, 13 bp, Homo sapiens
acagatagttgtg

SEQ ID NO: 4886133 - DNA, 16 bp, Homo sapiens
acagatgaaaatttga

SEQ ID NO: 4886134 - DNA, 18 bp, Homo sapiens
acagatgccccagagctg

SEQ ID NO: 4886135 - DNA, 19 bp, Homo sapiens
acagatgccccagagctgt

SEQ ID NO: 4886136 - DNA, 18 bp, Homo sapiens
acagatgccttttttgta

SEQ ID NO: 4886137 - DNA, 20 bp, Homo sapiens
acagatttaatacagtttat

SEQ ID NO: 4886138 - DNA, 16 bp, Homo sapiens
acagatttcatacctc

SEQ ID NO: 4886139 - DNA, 22 bp, Homo sapiens
acagattttggggttgtgttgt

SEQ ID NO: 4886140 - DNA, 15 bp, Homo sapiens
acagcaagtagataa

SEQ ID NO: 4886141 - DNA, 16 bp, Homo sapiens
acagcacagctccctg

SEQ ID NO: 4886142 - DNA, 20 bp, Homo sapiens
acagcacagctccctgccaa

SEQ ID NO: 4886143 - DNA, 15 bp, Homo sapiens
acagcacatgctggc

SEQ ID NO: 4886144 - DNA, 17 bp, Homo sapiens
acagcacatgctggcca

SEQ ID NO: 4886145 - DNA, 21 bp, Homo sapiens
acagcacatgctggccagcct

SEQ ID NO: 4886146 - DNA, 19 bp, Homo sapiens
acagcactactgggtgtca

SEQ ID NO: 4886147 - DNA, 11 bp, Homo sapiens
acagcagcctg

SEQ ID NO: 4886148 - DNA, 18 bp, Homo sapiens
acagcagcctgcttccca

SEQ ID NO: 4886149 - DNA, 19 bp, Homo sapiens
acagcagcctgcttcccac

SEQ ID NO: 4886150 - DNA, 22 bp, Homo sapiens
acagcagcttcaccagagcatt

SEQ ID NO: 4886151 - DNA, 18 bp, Homo sapiens
acagcaggtcctccatcc

SEQ ID NO: 4886152 - DNA, 21 bp, Homo sapiens
acagcatccccaaaacaaagt

SEQ ID NO: 4886153 - DNA, 22 bp, Homo sapiens
acagcatccccaaaacaaagtc

SEQ ID NO: 4886154 - DNA, 20 bp, Homo sapiens
acagcatgtgccctcctgag

SEQ ID NO: 4886155 - DNA, 13 bp, Homo sapiens
acagccaagtgcc

SEQ ID NO: 4886156 - DNA, 19 bp, Homo sapiens
acagccacggccaggccag

SEQ ID NO: 4886157 - DNA, 16 bp, Homo sapiens
acagccccagagcagg

SEQ ID NO: 4886158 - DNA, 17 bp, Homo sapiens
acagccccagagcaggg

SEQ ID NO: 4886159 - DNA, 20 bp, Homo sapiens
acagcctcctctgtctgccc

SEQ ID NO: 4886160 - DNA, 22 bp, Homo sapiens
acagcctcctctgtctgccctt

SEQ ID NO: 4886161 - DNA, 12 bp, Homo sapiens
acagcctctatc

SEQ ID NO: 4886162 - DNA, 20 bp, Homo sapiens
acagcctctgacccctcctc

SEQ ID NO: 4886163 - DNA, 21 bp, Homo sapiens
acagcctctgacccctcctca

SEQ ID NO: 4886164 - DNA, 18 bp, Homo sapiens
acagcctgggccccagct

SEQ ID NO: 4886165 - DNA, 16 bp, Homo sapiens
acagcgagggcagctg

SEQ ID NO: 4886166 - DNA, 18 bp, Homo sapiens
acagcggagtctgtcctg

SEQ ID NO: 4886167 - DNA, 19 bp, Homo sapiens
acagcggcccctgcatccc

SEQ ID NO: 4886168 - DNA, 15 bp, Homo sapiens
acagctaatgggaca

SEQ ID NO: 4886169 - DNA, 19 bp, Homo sapiens
acagctaatgggacactaa

SEQ ID NO: 4886170 - DNA, 14 bp, Homo sapiens
acagctcaggaggc

SEQ ID NO: 4886171 - DNA, 15 bp, Homo sapiens
acagctcgatccaaa

SEQ ID NO: 4886172 - DNA, 17 bp, Homo sapiens
acagctctgtcctggga

SEQ ID NO: 4886173 - DNA, 12 bp, Homo sapiens
acagctgcctgc

SEQ ID NO: 4886174 - DNA, 16 bp, Homo sapiens
acagctgttcttctgt

SEQ ID NO: 4886175 - DNA, 21 bp, Homo sapiens
acagctgttcttctgttctgc

SEQ ID NO: 4886176 - DNA, 17 bp, Homo sapiens
acagctgtttaagatgg

SEQ ID NO: 4886177 - DNA, 13 bp, Homo sapiens
acagcttcaggtt

SEQ ID NO: 4886178 - DNA, 15 bp, Homo sapiens
acagcttcaggttat

SEQ ID NO: 4886179 - DNA, 20 bp, Homo sapiens
acagcttcaggttatcgaaa

SEQ ID NO: 4886180 - DNA, 22 bp, Homo sapiens
acagcttcaggttatcgaaata

SEQ ID NO: 4886181 - DNA, 20 bp, Homo sapiens
acagctttcccctcattttt

SEQ ID NO: 4886182 - DNA, 21 bp, Homo sapiens
acagctttcttgctcccttca

SEQ ID NO: 4886183 - DNA, 22 bp, Homo sapiens
acagctttcttgctcccttcag

SEQ ID NO: 4886184 - DNA, 22 bp, Homo sapiens
acagctttggggtgtctttttt

SEQ ID NO: 4886185 - DNA, 21 bp, Homo sapiens
acaggaaaagctgctgacagt

SEQ ID NO: 4886186 - DNA, 19 bp, Homo sapiens
acaggaatcaagagctgcc

SEQ ID NO: 4886187 - DNA, 14 bp, Homo sapiens
acaggactctgcct

SEQ ID NO: 4886188 - DNA, 23 bp, Homo sapiens
acaggactgattctgggatgctc

SEQ ID NO: 4886189 - DNA, 19 bp, Homo sapiens
acaggaggcaagcaagctc

SEQ ID NO: 4886190 - DNA, 16 bp, Homo sapiens
acaggagtgagcacta

SEQ ID NO: 4886191 - DNA, 14 bp, Homo sapiens
acaggatcagtctg

SEQ ID NO: 4886192 - DNA, 15 bp, Homo sapiens
acaggatcagtctga

SEQ ID NO: 4886193 - DNA, 19 bp, Homo sapiens
acaggatcagttaactatt

SEQ ID NO: 4886194 - DNA, 14 bp, Homo sapiens
acaggatgctgtgt

SEQ ID NO: 4886195 - DNA, 12 bp, Homo sapiens
acaggcaagcac

SEQ ID NO: 4886196 - DNA, 15 bp, Homo sapiens
acaggcaagcacctc

SEQ ID NO: 4886197 - DNA, 20 bp, Homo sapiens
acaggcaagcacctcctgcc

SEQ ID NO: 4886198 - DNA, 14 bp, Homo sapiens
acaggcaatgctgg

SEQ ID NO: 4886199 - DNA, 15 bp, Homo sapiens
acaggcaatgctggc

SEQ ID NO: 4886200 - DNA, 18 bp, Homo sapiens
acaggcaatgctggctgt

SEQ ID NO: 4886201 - DNA, 15 bp, Homo sapiens
acaggcagctttcta

SEQ ID NO: 4886202 - DNA, 20 bp, Homo sapiens
acaggcccggctccaggctc

SEQ ID NO: 4886203 - DNA, 14 bp, Homo sapiens
acaggccctgctcc

SEQ ID NO: 4886204 - DNA, 12 bp, Homo sapiens
acaggccctggc

SEQ ID NO: 4886205 - DNA, 13 bp, Homo sapiens
acaggcccttcct

SEQ ID NO: 4886206 - DNA, 21 bp, Homo sapiens
acaggcctcacctctacccaa

SEQ ID NO: 4886207 - DNA, 14 bp, Homo sapiens
acaggcctgaagat

SEQ ID NO: 4886208 - DNA, 13 bp, Homo sapiens
acaggcgagagag

SEQ ID NO: 4886209 - DNA, 14 bp, Homo sapiens
acaggcgagagagg

SEQ ID NO: 4886210 - DNA, 17 bp, Homo sapiens
acaggcgggaggaggtg

SEQ ID NO: 4886211 - DNA, 17 bp, Homo sapiens
acaggctgggcttcagt

SEQ ID NO: 4886212 - DNA, 21 bp, Homo sapiens
acaggctgggcttcagtggca

SEQ ID NO: 4886213 - DNA, 20 bp, Homo sapiens
acaggctgttctgcactgaa

SEQ ID NO: 4886214 - DNA, 22 bp, Homo sapiens
acaggctgttctgcactgaaaa

SEQ ID NO: 4886215 - DNA, 15 bp, Homo sapiens
acagggaagagcaga

SEQ ID NO: 4886216 - DNA, 22 bp, Homo sapiens
acagggcacaccgggcactcag

SEQ ID NO: 4886217 - DNA, 24 bp, Homo sapiens
acagggcatgccccggccacctct

SEQ ID NO: 4886218 - DNA, 23 bp, Homo sapiens
acagggccagtggggcctgtgga

SEQ ID NO: 4886219 - DNA, 23 bp, Homo sapiens
acaggggaggtgatagcattgct

SEQ ID NO: 4886220 - DNA, 23 bp, Homo sapiens
acagggtaactgtgctgaatgct

SEQ ID NO: 4886221 - DNA, 14 bp, Homo sapiens
acagggttgggccc

SEQ ID NO: 4886222 - DNA, 12 bp, Homo sapiens
acaggtattttg

SEQ ID NO: 4886223 - DNA, 21 bp, Homo sapiens
acaggtattttgtttctttta

SEQ ID NO: 4886224 - DNA, 16 bp, Homo sapiens
acaggtggacacacaa

SEQ ID NO: 4886225 - DNA, 20 bp, Homo sapiens
acaggtgtgaaccaccacac

SEQ ID NO: 4886226 - DNA, 15 bp, Homo sapiens
acaggttggaagaga

SEQ ID NO: 4886227 - DNA, 16 bp, Homo sapiens
acaggttggaagagaa

SEQ ID NO: 4886228 - DNA, 15 bp, Homo sapiens
acagtaactttatgt

SEQ ID NO: 4886229 - DNA, 18 bp, Homo sapiens
acagtaactttatgtgta

SEQ ID NO: 4886230 - DNA, 19 bp, Homo sapiens
acagtacagcatgtgcctt

SEQ ID NO: 4886231 - DNA, 14 bp, Homo sapiens
acagtagtcttgat

SEQ ID NO: 4886232 - DNA, 12 bp, Homo sapiens
acagtatttcca

SEQ ID NO: 4886233 - DNA, 13 bp, Homo sapiens
acagtcaaaataa

SEQ ID NO: 4886234 - DNA, 17 bp, Homo sapiens
acagtcaaccaacccca

SEQ ID NO: 4886235 - DNA, 18 bp, Homo sapiens
acagtcactgatgtacaa

SEQ ID NO: 4886236 - DNA, 23 bp, Homo sapiens
acagtcactgccactttgcacat

SEQ ID NO: 4886237 - DNA, 21 bp, Homo sapiens
acagtcatcatcagggcctgg

SEQ ID NO: 4886238 - DNA, 18 bp, Homo sapiens
acagtccaggaacaagct

SEQ ID NO: 4886239 - DNA, 15 bp, Homo sapiens
acagtcccactgtgc

SEQ ID NO: 4886240 - DNA, 19 bp, Homo sapiens
acagtcctaactggtatag

SEQ ID NO: 4886241 - DNA, 17 bp, Homo sapiens
acagtgagcctgaattt

SEQ ID NO: 4886242 - DNA, 13 bp, Homo sapiens
acagtgctgtgtg

SEQ ID NO: 4886243 - DNA, 17 bp, Homo sapiens
acagtggattgcatttc

SEQ ID NO: 4886244 - DNA, 19 bp, Homo sapiens
acagtggattgtttatact

SEQ ID NO: 4886245 - DNA, 19 bp, Homo sapiens
acagtgttgaaaatgttca

SEQ ID NO: 4886246 - DNA, 21 bp, Homo sapiens
acagtgttgaaaatgttcaga

SEQ ID NO: 4886247 - DNA, 18 bp, Homo sapiens
acagttatttatagtcat

SEQ ID NO: 4886248 - DNA, 15 bp, Homo sapiens
acagttattttgata

SEQ ID NO: 4886249 - DNA, 23 bp, Homo sapiens
acagttcaataaacttaacttta

SEQ ID NO: 4886250 - DNA, 14 bp, Homo sapiens
acagttcacaccct

SEQ ID NO: 4886251 - DNA, 17 bp, Homo sapiens
acagttcacaccctgca

SEQ ID NO: 4886252 - DNA, 20 bp, Homo sapiens
acagttcacaccctgcaagg

SEQ ID NO: 4886253 - DNA, 15 bp, Homo sapiens
acagttctgaagaat

SEQ ID NO: 4886254 - DNA, 20 bp, Homo sapiens
acagttgccaccacctctgt

SEQ ID NO: 4886255 - DNA, 16 bp, Homo sapiens
acagttggccttcaga

SEQ ID NO: 4886256 - DNA, 17 bp, Homo sapiens
acagttgtctagagata

SEQ ID NO: 4886257 - DNA, 22 bp, Homo sapiens
acagtttatcatgaagcctgtg

SEQ ID NO: 4886258 - DNA, 17 bp, Homo sapiens
acagtttcttagctttt

SEQ ID NO: 4886259 - DNA, 15 bp, Homo sapiens
acagtttgaacaaaa

SEQ ID NO: 4886260 - DNA, 16 bp, Homo sapiens
acagtttgatgtcatt

SEQ ID NO: 4886261 - DNA, 13 bp, Homo sapiens
acagtttgtaaat

SEQ ID NO: 4886262 - DNA, 20 bp, Homo sapiens
acataaaaaggacatcagca

SEQ ID NO: 4886263 - DNA, 11 bp, Homo sapiens
acataaaacaa

SEQ ID NO: 4886264 - DNA, 16 bp, Homo sapiens
acataaagccatgttt

SEQ ID NO: 4886265 - DNA, 20 bp, Homo sapiens
acataaattgcataaagcat

SEQ ID NO: 4886266 - DNA, 13 bp, Homo sapiens
acataacaagaaa

SEQ ID NO: 4886267 - DNA, 14 bp, Homo sapiens
acataacgtttttc

SEQ ID NO: 4886268 - DNA, 17 bp, Homo sapiens
acataataaaaaattat

SEQ ID NO: 4886269 - DNA, 15 bp, Homo sapiens
acatacagttttatg

SEQ ID NO: 4886270 - DNA, 14 bp, Homo sapiens
acatacgaaacaca

SEQ ID NO: 4886271 - DNA, 17 bp, Homo sapiens
acatacgaaacacaaac

SEQ ID NO: 4886272 - DNA, 22 bp, Homo sapiens
acatacggtcaggtttaacatt

SEQ ID NO: 4886273 - DNA, 18 bp, Homo sapiens
acatactggcctggactg

SEQ ID NO: 4886274 - DNA, 16 bp, Homo sapiens
acatagaggtatattg

SEQ ID NO: 4886275 - DNA, 14 bp, Homo sapiens
acatagattaatgg

SEQ ID NO: 4886276 - DNA, 14 bp, Homo sapiens
acatagcccatccc

SEQ ID NO: 4886277 - DNA, 16 bp, Homo sapiens
acatagtgatggttcc

SEQ ID NO: 4886278 - DNA, 21 bp, Homo sapiens
acatagtgatggttcccctgt

SEQ ID NO: 4886279 - DNA, 12 bp, Homo sapiens
acatagtgtaat

SEQ ID NO: 4886280 - DNA, 17 bp, Homo sapiens
acatagttctccagttg

SEQ ID NO: 4886281 - DNA, 23 bp, Homo sapiens
acatagttctccagttgtatgga

SEQ ID NO: 4886282 - DNA, 20 bp, Homo sapiens
acatagttttaaactcattt

SEQ ID NO: 4886283 - DNA, 20 bp, Homo sapiens
acatataaacatcacacaca

SEQ ID NO: 4886284 - DNA, 19 bp, Homo sapiens
acatatacctataatgtgt

SEQ ID NO: 4886285 - DNA, 21 bp, Homo sapiens
acatatacctataatgtgtgt

SEQ ID NO: 4886286 - DNA, 21 bp, Homo sapiens
acatatatttttaaaaaatga

SEQ ID NO: 4886287 - DNA, 22 bp, Homo sapiens
acatatatttttaaaaaatgaa

SEQ ID NO: 4886288 - DNA, 17 bp, Homo sapiens
acatatgcaccttgtgt

SEQ ID NO: 4886289 - DNA, 19 bp, Homo sapiens
acatatgcaccttgtgtct

SEQ ID NO: 4886290 - DNA, 23 bp, Homo sapiens
acatatggactctgcacatgaat

SEQ ID NO: 4886291 - DNA, 20 bp, Homo sapiens
acatatgtagactatataca

SEQ ID NO: 4886292 - DNA, 23 bp, Homo sapiens
acatatgtagactatatacatgt

SEQ ID NO: 4886293 - DNA, 16 bp, Homo sapiens
acatatttgtggaata

SEQ ID NO: 4886294 - DNA, 17 bp, Homo sapiens
acatatttgtggaataa

SEQ ID NO: 4886295 - DNA, 13 bp, Homo sapiens
acatattttctgt

SEQ ID NO: 4886296 - DNA, 13 bp, Homo sapiens
acatcacagcagc

SEQ ID NO: 4886297 - DNA, 14 bp, Homo sapiens
acatcacagcagcc

SEQ ID NO: 4886298 - DNA, 23 bp, Homo sapiens
acatcaccgacgcgtctcctgtt

SEQ ID NO: 4886299 - DNA, 19 bp, Homo sapiens
acatcactctgctgcttag

SEQ ID NO: 4886300 - DNA, 14 bp, Homo sapiens
acatcactgcttga

SEQ ID NO: 4886301 - DNA, 21 bp, Homo sapiens
acatcactgcttgatgaagca

SEQ ID NO: 4886302 - DNA, 22 bp, Homo sapiens
acatcactgcttgatgaagcaa

SEQ ID NO: 4886303 - DNA, 15 bp, Homo sapiens
acatcacttgtacaa

SEQ ID NO: 4886304 - DNA, 16 bp, Homo sapiens
acatcacttgtacaaa

SEQ ID NO: 4886305 - DNA, 12 bp, Homo sapiens
acatcagcaaac

SEQ ID NO: 4886306 - DNA, 11 bp, Homo sapiens
acatcagttcc

SEQ ID NO: 4886307 - DNA, 16 bp, Homo sapiens
acatccaactccagca

SEQ ID NO: 4886308 - DNA, 18 bp, Homo sapiens
acatccaactccagcaac

SEQ ID NO: 4886309 - DNA, 13 bp, Homo sapiens
acatccatgtcct

SEQ ID NO: 4886310 - DNA, 18 bp, Homo sapiens
acatccatgtttgtaaaa

SEQ ID NO: 4886311 - DNA, 20 bp, Homo sapiens
acatccatgtttgtaaaact

SEQ ID NO: 4886312 - DNA, 13 bp, Homo sapiens
acatccattccca

SEQ ID NO: 4886313 - DNA, 20 bp, Homo sapiens
acatccattcccaagaaatg

SEQ ID NO: 4886314 - DNA, 16 bp, Homo sapiens
acatccgccttttgta

SEQ ID NO: 4886315 - DNA, 18 bp, Homo sapiens
acatccgccttttgtata

SEQ ID NO: 4886316 - DNA, 16 bp, Homo sapiens
acatcctgtataagca

SEQ ID NO: 4886317 - DNA, 19 bp, Homo sapiens
acatcctgtataagcactg

SEQ ID NO: 4886318 - DNA, 20 bp, Homo sapiens
acatcctttgcagggcagcc

SEQ ID NO: 4886319 - DNA, 14 bp, Homo sapiens
acatctatgatata

SEQ ID NO: 4886320 - DNA, 19 bp, Homo sapiens
acatctattttggattgta

SEQ ID NO: 4886321 - DNA, 17 bp, Homo sapiens
acatctggcttatttta

SEQ ID NO: 4886322 - DNA, 19 bp, Homo sapiens
acatctggcttattttaat

SEQ ID NO: 4886323 - DNA, 20 bp, Homo sapiens
acatctggcttattttaatg

SEQ ID NO: 4886324 - DNA, 17 bp, Homo sapiens
acatcttgctctgctga

SEQ ID NO: 4886325 - DNA, 18 bp, Homo sapiens
acatcttgctctgctgac

SEQ ID NO: 4886326 - DNA, 19 bp, Homo sapiens
acatcttgctctgctgaca

SEQ ID NO: 4886327 - DNA, 22 bp, Homo sapiens
acatcttgctctgctgacagac

SEQ ID NO: 4886328 - DNA, 16 bp, Homo sapiens
acatgaaaattttaaa

SEQ ID NO: 4886329 - DNA, 15 bp, Homo sapiens
acatgaaacagaaac

SEQ ID NO: 4886330 - DNA, 21 bp, Homo sapiens
acatgaatcccacccacatgt

SEQ ID NO: 4886331 - DNA, 20 bp, Homo sapiens
acatgagatgtgtggactgt

SEQ ID NO: 4886332 - DNA, 17 bp, Homo sapiens
acatgaggaactgtaga

SEQ ID NO: 4886333 - DNA, 17 bp, Homo sapiens
acatgatttccttgaat

SEQ ID NO: 4886334 - DNA, 15 bp, Homo sapiens
acatgcaacccgaag

SEQ ID NO: 4886335 - DNA, 12 bp, Homo sapiens
acatgcactgac

SEQ ID NO: 4886336 - DNA, 18 bp, Homo sapiens
acatgcactgacccttcc

SEQ ID NO: 4886337 - DNA, 17 bp, Homo sapiens
acatgcagcccatgccc

SEQ ID NO: 4886338 - DNA, 22 bp, Homo sapiens
acatgcagcccatgcccacctg

SEQ ID NO: 4886339 - DNA, 15 bp, Homo sapiens
acatggaggttctaa

SEQ ID NO: 4886340 - DNA, 16 bp, Homo sapiens
acatggaggttctaag

SEQ ID NO: 4886341 - DNA, 18 bp, Homo sapiens
acatggaggttctaaggc

SEQ ID NO: 4886342 - DNA, 17 bp, Homo sapiens
acatggcctatgcacat

SEQ ID NO: 4886343 - DNA, 18 bp, Homo sapiens
acatggctttcagaaaac

SEQ ID NO: 4886344 - DNA, 20 bp, Homo sapiens
acatgggagcagtccatgca

SEQ ID NO: 4886345 - DNA, 20 bp, Homo sapiens
acatggtactcttgttgagt

SEQ ID NO: 4886346 - DNA, 19 bp, Homo sapiens
acatggtgcccctagcttt

SEQ ID NO: 4886347 - DNA, 14 bp, Homo sapiens
acatgtatttatgt

SEQ ID NO: 4886348 - DNA, 20 bp, Homo sapiens
acatgtcttccatgtatctt

SEQ ID NO: 4886349 - DNA, 14 bp, Homo sapiens
acatgtcttgtaca

SEQ ID NO: 4886350 - DNA, 17 bp, Homo sapiens
acatgtgaaaccttttt

SEQ ID NO: 4886351 - DNA, 20 bp, Homo sapiens
acatgtgaaaccttttttaa

SEQ ID NO: 4886352 - DNA, 14 bp, Homo sapiens
acatgtgacacata

SEQ ID NO: 4886353 - DNA, 15 bp, Homo sapiens
acatgtgacacatat

SEQ ID NO: 4886354 - DNA, 21 bp, Homo sapiens
acatgtgacacatatgcacct

SEQ ID NO: 4886355 - DNA, 16 bp, Homo sapiens
acatgtggtttataga

SEQ ID NO: 4886356 - DNA, 21 bp, Homo sapiens
acatgtgtagcctatgttgtg

SEQ ID NO: 4886357 - DNA, 13 bp, Homo sapiens
acatgtgtgtata

SEQ ID NO: 4886358 - DNA, 22 bp, Homo sapiens
acatgtgtgtatatatgtgtat

SEQ ID NO: 4886359 - DNA, 23 bp, Homo sapiens
acatgtgtgtatatatgtgtata

SEQ ID NO: 4886360 - DNA, 14 bp, Homo sapiens
acatgttatatatt

SEQ ID NO: 4886361 - DNA, 21 bp, Homo sapiens
acatgttgtaaattaggaggc

SEQ ID NO: 4886362 - DNA, 17 bp, Homo sapiens
acatgtttttatacaaa

SEQ ID NO: 4886363 - DNA, 23 bp, Homo sapiens
acatgtttttgttttctttgaat

SEQ ID NO: 4886364 - DNA, 15 bp, Homo sapiens
acattaaaaatggaa

SEQ ID NO: 4886365 - DNA, 18 bp, Homo sapiens
acattagaacactgcatt

SEQ ID NO: 4886366 - DNA, 19 bp, Homo sapiens
acattagattttattttac

SEQ ID NO: 4886367 - DNA, 16 bp, Homo sapiens
acattagtaaatgtct

SEQ ID NO: 4886368 - DNA, 18 bp, Homo sapiens
acattagtaaatgtcttt

SEQ ID NO: 4886369 - DNA, 21 bp, Homo sapiens
acattagtaaatgtctttgta

SEQ ID NO: 4886370 - DNA, 23 bp, Homo sapiens
acattagtaaatgtctttgtaag

SEQ ID NO: 4886371 - DNA, 14 bp, Homo sapiens
acattataaacgct

SEQ ID NO: 4886372 - DNA, 15 bp, Homo sapiens
acattataaacgctt

SEQ ID NO: 4886373 - DNA, 17 bp, Homo sapiens
acattatgctccagaaa

SEQ ID NO: 4886374 - DNA, 19 bp, Homo sapiens
acattatgtggttttagat

SEQ ID NO: 4886375 - DNA, 15 bp, Homo sapiens
acattatgtgtgcat

SEQ ID NO: 4886376 - DNA, 17 bp, Homo sapiens
acattatgtgtgcatgt

SEQ ID NO: 4886377 - DNA, 21 bp, Homo sapiens
acattatgtgtgcatgtgtgt

SEQ ID NO: 4886378 - DNA, 23 bp, Homo sapiens
acattatgtgtgcatgtgtgtat

SEQ ID NO: 4886379 - DNA, 16 bp, Homo sapiens
acattatttattcagc

SEQ ID NO: 4886380 - DNA, 13 bp, Homo sapiens
acattatttctag

SEQ ID NO: 4886381 - DNA, 16 bp, Homo sapiens
acattccaagactcta

SEQ ID NO: 4886382 - DNA, 17 bp, Homo sapiens
acattcccatctgtcac

SEQ ID NO: 4886383 - DNA, 16 bp, Homo sapiens
acattctgatgagcaa

SEQ ID NO: 4886384 - DNA, 16 bp, Homo sapiens
acattctgatttggaa

SEQ ID NO: 4886385 - DNA, 19 bp, Homo sapiens
acattcttccaaaaagatt

SEQ ID NO: 4886386 - DNA, 20 bp, Homo sapiens
acattgacgattccttctct

SEQ ID NO: 4886387 - DNA, 14 bp, Homo sapiens
acattgcattctat

SEQ ID NO: 4886388 - DNA, 15 bp, Homo sapiens
acattgcattctatt

SEQ ID NO: 4886389 - DNA, 21 bp, Homo sapiens
acattgcggacagccacggcc

SEQ ID NO: 4886390 - DNA, 22 bp, Homo sapiens
acattgcggacagccacggcca

SEQ ID NO: 4886391 - DNA, 23 bp, Homo sapiens
acattgcgtttgaccttttatgt

SEQ ID NO: 4886392 - DNA, 17 bp, Homo sapiens
acattgtaaatagtatt

SEQ ID NO: 4886393 - DNA, 20 bp, Homo sapiens
acattgttgtttttttaata

SEQ ID NO: 4886394 - DNA, 12 bp, Homo sapiens
acatttaaaatt

SEQ ID NO: 4886395 - DNA, 20 bp, Homo sapiens
acatttaaagcattgctgtt

SEQ ID NO: 4886396 - DNA, 15 bp, Homo sapiens
acatttaatttagtg

SEQ ID NO: 4886397 - DNA, 21 bp, Homo sapiens
acatttagagaactgtggccg

SEQ ID NO: 4886398 - DNA, 14 bp, Homo sapiens
acatttataattgc

SEQ ID NO: 4886399 - DNA, 20 bp, Homo sapiens
acatttatgatttaataaaa

SEQ ID NO: 4886400 - DNA, 14 bp, Homo sapiens
acatttcttttctt

SEQ ID NO: 4886401 - DNA, 13 bp, Homo sapiens
acatttgccttgc

SEQ ID NO: 4886402 - DNA, 17 bp, Homo sapiens
acatttgccttgcagaa

SEQ ID NO: 4886403 - DNA, 14 bp, Homo sapiens
acatttgtagttga

SEQ ID NO: 4886404 - DNA, 12 bp, Homo sapiens
acatttgtgaga

SEQ ID NO: 4886405 - DNA, 18 bp, Homo sapiens
acattttaaaaacataga

SEQ ID NO: 4886406 - DNA, 14 bp, Homo sapiens
acattttaaataaa

SEQ ID NO: 4886407 - DNA, 19 bp, Homo sapiens
acattttgttcttacacat

SEQ ID NO: 4886408 - DNA, 20 bp, Homo sapiens
acattttgttcttacacata

SEQ ID NO: 4886409 - DNA, 13 bp, Homo sapiens
acatttttattta

SEQ ID NO: 4886410 - DNA, 17 bp, Homo sapiens
acatttttatttatgaa

SEQ ID NO: 4886411 - DNA, 16 bp, Homo sapiens
accaaaatgacatctt

SEQ ID NO: 4886412 - DNA, 22 bp, Homo sapiens
accaaaatgacatctttttaaa

SEQ ID NO: 4886413 - DNA, 13 bp, Homo sapiens
accaaagatgcag

SEQ ID NO: 4886414 - DNA, 19 bp, Homo sapiens
accaaagctgcccactgtt

SEQ ID NO: 4886415 - DNA, 17 bp, Homo sapiens
accaaaggacattatgt

SEQ ID NO: 4886416 - DNA, 20 bp, Homo sapiens
accaaaggacattatgtgtg

SEQ ID NO: 4886417 - DNA, 12 bp, Homo sapiens
accaaagtttta

SEQ ID NO: 4886418 - DNA, 16 bp, Homo sapiens
accaaataaaaatatt

SEQ ID NO: 4886419 - DNA, 22 bp, Homo sapiens
accaacaggctgttctgcactg

SEQ ID NO: 4886420 - DNA, 15 bp, Homo sapiens
accaaccctcagagc

SEQ ID NO: 4886421 - DNA, 17 bp, Homo sapiens
accaacgttactcaggg

SEQ ID NO: 4886422 - DNA, 20 bp, Homo sapiens
accaacgttactcagggctc

SEQ ID NO: 4886423 - DNA, 23 bp, Homo sapiens
accaactgtcactcattgctgag

SEQ ID NO: 4886424 - DNA, 13 bp, Homo sapiens
accaactgtgttg

SEQ ID NO: 4886425 - DNA, 16 bp, Homo sapiens
accaactgtgttgtat

SEQ ID NO: 4886426 - DNA, 22 bp, Homo sapiens
accaactgtgttgtattaacaa

SEQ ID NO: 4886427 - DNA, 12 bp, Homo sapiens
accaactttctg

SEQ ID NO: 4886428 - DNA, 14 bp, Homo sapiens
accaactttctgta

SEQ ID NO: 4886429 - DNA, 19 bp, Homo sapiens
accaactttctgtaaactc

SEQ ID NO: 4886430 - DNA, 16 bp, Homo sapiens
accaagatgccatctg

SEQ ID NO: 4886431 - DNA, 12 bp, Homo sapiens
accaagcccagt

SEQ ID NO: 4886432 - DNA, 17 bp, Homo sapiens
accaagccgtggcttcc

SEQ ID NO: 4886433 - DNA, 19 bp, Homo sapiens
accaagtcggaacagcaga

SEQ ID NO: 4886434 - DNA, 16 bp, Homo sapiens
accaatagcccacagc

SEQ ID NO: 4886435 - DNA, 19 bp, Homo sapiens
accaatgcttttatcaaac

SEQ ID NO: 4886436 - DNA, 16 bp, Homo sapiens
accaattggttaatct

SEQ ID NO: 4886437 - DNA, 20 bp, Homo sapiens
accaattgtgtcctgaaaat

SEQ ID NO: 4886438 - DNA, 14 bp, Homo sapiens
accacaaaaattga

SEQ ID NO: 4886439 - DNA, 21 bp, Homo sapiens
accacaaaggccaaactgctg

SEQ ID NO: 4886440 - DNA, 14 bp, Homo sapiens
accacacaaagaca

SEQ ID NO: 4886441 - DNA, 18 bp, Homo sapiens
accacacacctcaccaga

SEQ ID NO: 4886442 - DNA, 15 bp, Homo sapiens
accacacccagccca

SEQ ID NO: 4886443 - DNA, 20 bp, Homo sapiens
accacacccagcccacttct

SEQ ID NO: 4886444 - DNA, 14 bp, Homo sapiens
accacacccagcct

SEQ ID NO: 4886445 - DNA, 15 bp, Homo sapiens
accacacccagcctc

SEQ ID NO: 4886446 - DNA, 16 bp, Homo sapiens
accacacccagcctca

SEQ ID NO: 4886447 - DNA, 17 bp, Homo sapiens
accacacccagcctcag

SEQ ID NO: 4886448 - DNA, 24 bp, Homo sapiens
accacacccagcctcagtcctccc

SEQ ID NO: 4886449 - DNA, 17 bp, Homo sapiens
accacaccctgtactgt

SEQ ID NO: 4886450 - DNA, 12 bp, Homo sapiens
accacagacaca

SEQ ID NO: 4886451 - DNA, 15 bp, Homo sapiens
accacagacacacac

SEQ ID NO: 4886452 - DNA, 22 bp, Homo sapiens
accacaggttcatgccaccatg

SEQ ID NO: 4886453 - DNA, 21 bp, Homo sapiens
accacatcctccgtccagccg

SEQ ID NO: 4886454 - DNA, 14 bp, Homo sapiens
accacatcttgctc

SEQ ID NO: 4886455 - DNA, 18 bp, Homo sapiens
accacatcttgctctgct

SEQ ID NO: 4886456 - DNA, 20 bp, Homo sapiens
accacatcttgctctgctga

SEQ ID NO: 4886457 - DNA, 17 bp, Homo sapiens
accacatctttatctgt

SEQ ID NO: 4886458 - DNA, 21 bp, Homo sapiens
accaccctagtcccttcccct

SEQ ID NO: 4886459 - DNA, 15 bp, Homo sapiens
accacctctgtggca

SEQ ID NO: 4886460 - DNA, 17 bp, Homo sapiens
accaccttttattacat

SEQ ID NO: 4886461 - DNA, 14 bp, Homo sapiens
accacggaaaagag

SEQ ID NO: 4886462 - DNA, 18 bp, Homo sapiens
accacggaaaagagcgca

SEQ ID NO: 4886463 - DNA, 16 bp, Homo sapiens
accactaactcctgag

SEQ ID NO: 4886464 - DNA, 17 bp, Homo sapiens
accactaactcctgaga

SEQ ID NO: 4886465 - DNA, 13 bp, Homo sapiens
accactcagcccc

SEQ ID NO: 4886466 - DNA, 16 bp, Homo sapiens
accactcagcccctag

SEQ ID NO: 4886467 - DNA, 12 bp, Homo sapiens
accactccattc

SEQ ID NO: 4886468 - DNA, 15 bp, Homo sapiens
accacttcctttaaa

SEQ ID NO: 4886469 - DNA, 22 bp, Homo sapiens
accactttccttttctattcct

SEQ ID NO: 4886470 - DNA, 21 bp, Homo sapiens
accagaattgtgcaaatggaa

SEQ ID NO: 4886471 - DNA, 14 bp, Homo sapiens
accagacaccttga

SEQ ID NO: 4886472 - DNA, 23 bp, Homo sapiens
accagacaccttgacagggcaca

SEQ ID NO: 4886473 - DNA, 16 bp, Homo sapiens
accagagaccgtcctc

SEQ ID NO: 4886474 - DNA, 19 bp, Homo sapiens
accagagcaacctctcact

SEQ ID NO: 4886475 - DNA, 20 bp, Homo sapiens
accagagcaacctctcactc

SEQ ID NO: 4886476 - DNA, 15 bp, Homo sapiens
accagagcagatgca

SEQ ID NO: 4886477 - DNA, 17 bp, Homo sapiens
accagagcagatgcaga

SEQ ID NO: 4886478 - DNA, 22 bp, Homo sapiens
accagagcagatgcagagagcc

SEQ ID NO: 4886479 - DNA, 17 bp, Homo sapiens
accagagcccaccttgg

SEQ ID NO: 4886480 - DNA, 14 bp, Homo sapiens
accagaggagcctt

SEQ ID NO: 4886481 - DNA, 17 bp, Homo sapiens
accagcaatatgtaaat

SEQ ID NO: 4886482 - DNA, 18 bp, Homo sapiens
accagcatcacctgcctg

SEQ ID NO: 4886483 - DNA, 22 bp, Homo sapiens
accagccatacttatctctctg

SEQ ID NO: 4886484 - DNA, 16 bp, Homo sapiens
accagccccactgcca

SEQ ID NO: 4886485 - DNA, 20 bp, Homo sapiens
accagcctccatgctgcctc

SEQ ID NO: 4886486 - DNA, 21 bp, Homo sapiens
accagcctccatgctgcctcc

SEQ ID NO: 4886487 - DNA, 14 bp, Homo sapiens
accagcctgggcag

SEQ ID NO: 4886488 - DNA, 19 bp, Homo sapiens
accagcgctctaaaagcac

SEQ ID NO: 4886489 - DNA, 14 bp, Homo sapiens
accaggactccctc

SEQ ID NO: 4886490 - DNA, 21 bp, Homo sapiens
accaggactccctcctcacct

SEQ ID NO: 4886491 - DNA, 20 bp, Homo sapiens
accaggagaaccactacatg

SEQ ID NO: 4886492 - DNA, 13 bp, Homo sapiens
accaggatttttt

SEQ ID NO: 4886493 - DNA, 22 bp, Homo sapiens
accagtctttaaaggcccagcc

SEQ ID NO: 4886494 - DNA, 23 bp, Homo sapiens
accagtctttaaaggcccagccc

SEQ ID NO: 4886495 - DNA, 17 bp, Homo sapiens
accagtgccaaggacct

SEQ ID NO: 4886496 - DNA, 13 bp, Homo sapiens
accagtgtcccct

SEQ ID NO: 4886497 - DNA, 20 bp, Homo sapiens
accagtgtcccctccactgt

SEQ ID NO: 4886498 - DNA, 13 bp, Homo sapiens
accatatgatact

SEQ ID NO: 4886499 - DNA, 22 bp, Homo sapiens
accatattgtgcttcacagtag

SEQ ID NO: 4886500 - DNA, 20 bp, Homo sapiens
accatatttatccatttgta

SEQ ID NO: 4886501 - DNA, 18 bp, Homo sapiens
accatcacaatacagata

SEQ ID NO: 4886502 - DNA, 15 bp, Homo sapiens
accatcagggacagg

SEQ ID NO: 4886503 - DNA, 17 bp, Homo sapiens
accatctggcctggcct

SEQ ID NO: 4886504 - DNA, 22 bp, Homo sapiens
accatctggcctggcctggccc

SEQ ID NO: 4886505 - DNA, 14 bp, Homo sapiens
accatgaaacaaag

SEQ ID NO: 4886506 - DNA, 23 bp, Homo sapiens
accatgaacagaaaacattctga

SEQ ID NO: 4886507 - DNA, 14 bp, Homo sapiens
accatgaagacagg

SEQ ID NO: 4886508 - DNA, 15 bp, Homo sapiens
accatggactttata

SEQ ID NO: 4886509 - DNA, 19 bp, Homo sapiens
accatggttaagagtccaa

SEQ ID NO: 4886510 - DNA, 16 bp, Homo sapiens
accatgtgtcacttgt

SEQ ID NO: 4886511 - DNA, 21 bp, Homo sapiens
accatgtgtcacttgtgcttt

SEQ ID NO: 4886512 - DNA, 16 bp, Homo sapiens
accattaaaactgctt

SEQ ID NO: 4886513 - DNA, 20 bp, Homo sapiens
accattaaaactgctttttt

SEQ ID NO: 4886514 - DNA, 14 bp, Homo sapiens
accatttaacatgc

SEQ ID NO: 4886515 - DNA, 14 bp, Homo sapiens
accatttcagagag

SEQ ID NO: 4886516 - DNA, 16 bp, Homo sapiens
accatttgctactgta

SEQ ID NO: 4886517 - DNA, 22 bp, Homo sapiens
accattttggggtacccactgc

SEQ ID NO: 4886518 - DNA, 22 bp, Homo sapiens
accatttttaaagtagaagagg

SEQ ID NO: 4886519 - DNA, 20 bp, Homo sapiens
accattttttaaggaaacaa

SEQ ID NO: 4886520 - DNA, 22 bp, Homo sapiens
accattttttaaggaaacaata

SEQ ID NO: 4886521 - DNA, 14 bp, Homo sapiens
acccaaaagagaaa

SEQ ID NO: 4886522 - DNA, 18 bp, Homo sapiens
acccaaagaggtatttat

SEQ ID NO: 4886523 - DNA, 16 bp, Homo sapiens
acccaaagcatggact

SEQ ID NO: 4886524 - DNA, 22 bp, Homo sapiens
acccaaccctatctcctgacag

SEQ ID NO: 4886525 - DNA, 15 bp, Homo sapiens
acccaacggccctgc

SEQ ID NO: 4886526 - DNA, 15 bp, Homo sapiens
acccaagctcctcct

SEQ ID NO: 4886527 - DNA, 13 bp, Homo sapiens
acccaaggactga

SEQ ID NO: 4886528 - DNA, 17 bp, Homo sapiens
acccaaggactgaggga

SEQ ID NO: 4886529 - DNA, 14 bp, Homo sapiens
acccaatccaaatg

SEQ ID NO: 4886530 - DNA, 16 bp, Homo sapiens
acccaccccacctgca

SEQ ID NO: 4886531 - DNA, 15 bp, Homo sapiens
acccaccctcctttc

SEQ ID NO: 4886532 - DNA, 13 bp, Homo sapiens
acccacctagaac

SEQ ID NO: 4886533 - DNA, 14 bp, Homo sapiens
acccacctcagcct

SEQ ID NO: 4886534 - DNA, 18 bp, Homo sapiens
acccacgattttctccag

SEQ ID NO: 4886535 - DNA, 10 bp, Homo sapiens
acccactgct

SEQ ID NO: 4886536 - DNA, 11 bp, Homo sapiens
acccactgctc

SEQ ID NO: 4886537 - DNA, 13 bp, Homo sapiens
acccactgctctg

SEQ ID NO: 4886538 - DNA, 14 bp, Homo sapiens
acccactgctctgg

SEQ ID NO: 4886539 - DNA, 14 bp, Homo sapiens
acccagaggaggca

SEQ ID NO: 4886540 - DNA, 14 bp, Homo sapiens
acccagcagttctg

SEQ ID NO: 4886541 - DNA, 15 bp, Homo sapiens
acccagcagttctgt

SEQ ID NO: 4886542 - DNA, 17 bp, Homo sapiens
acccagcagttctgtta

SEQ ID NO: 4886543 - DNA, 21 bp, Homo sapiens
acccagccgccatcagcccaa

SEQ ID NO: 4886544 - DNA, 13 bp, Homo sapiens
acccagcgagccc

SEQ ID NO: 4886545 - DNA, 17 bp, Homo sapiens
acccagcgagccctggt

SEQ ID NO: 4886546 - DNA, 19 bp, Homo sapiens
acccaggctccgcccttag

SEQ ID NO: 4886547 - DNA, 18 bp, Homo sapiens
acccaggctggagtgcag

SEQ ID NO: 4886548 - DNA, 19 bp, Homo sapiens
acccaggctggagtgcagt

SEQ ID NO: 4886549 - DNA, 15 bp, Homo sapiens
acccagggctctgcc

SEQ ID NO: 4886550 - DNA, 18 bp, Homo sapiens
acccagggctctgcccca

SEQ ID NO: 4886551 - DNA, 20 bp, Homo sapiens
acccagggctctgccccagt

SEQ ID NO: 4886552 - DNA, 21 bp, Homo sapiens
acccagggctctgccccagtc

SEQ ID NO: 4886553 - DNA, 18 bp, Homo sapiens
acccatagatcttctgaa

SEQ ID NO: 4886554 - DNA, 22 bp, Homo sapiens
acccatagatcttctgaaatga

SEQ ID NO: 4886555 - DNA, 23 bp, Homo sapiens
acccatgactttatatggatgat

SEQ ID NO: 4886556 - DNA, 16 bp, Homo sapiens
acccatgggctctgac

SEQ ID NO: 4886557 - DNA, 14 bp, Homo sapiens
acccattttcacat

SEQ ID NO: 4886558 - DNA, 19 bp, Homo sapiens
accccaccctccctggagt

SEQ ID NO: 4886559 - DNA, 19 bp, Homo sapiens
accccacccttcccctcct

SEQ ID NO: 4886560 - DNA, 16 bp, Homo sapiens
accccacgccttatcc

SEQ ID NO: 4886561 - DNA, 23 bp, Homo sapiens
accccagctccctaggagaccaa

SEQ ID NO: 4886562 - DNA, 23 bp, Homo sapiens
accccaggctggacatgctgact

SEQ ID NO: 4886563 - DNA, 13 bp, Homo sapiens
accccaggtttct

SEQ ID NO: 4886564 - DNA, 17 bp, Homo sapiens
accccatccctccccag

SEQ ID NO: 4886565 - DNA, 18 bp, Homo sapiens
accccatttgctttcttt

SEQ ID NO: 4886566 - DNA, 15 bp, Homo sapiens
acccccacacctcag

SEQ ID NO: 4886567 - DNA, 17 bp, Homo sapiens
acccccacacctcagtt

SEQ ID NO: 4886568 - DNA, 15 bp, Homo sapiens
acccccacccccagc

SEQ ID NO: 4886569 - DNA, 15 bp, Homo sapiens
acccccagcctgcta

SEQ ID NO: 4886570 - DNA, 14 bp, Homo sapiens
acccccagctttgc

SEQ ID NO: 4886571 - DNA, 16 bp, Homo sapiens
acccccagctttgcta

SEQ ID NO: 4886572 - DNA, 14 bp, Homo sapiens
accccccaagctgt

SEQ ID NO: 4886573 - DNA, 14 bp, Homo sapiens
accccccgtgggct

SEQ ID NO: 4886574 - DNA, 19 bp, Homo sapiens
accccctccttcagacacc

SEQ ID NO: 4886575 - DNA, 20 bp, Homo sapiens
accccctgagatcccctgag

SEQ ID NO: 4886576 - DNA, 19 bp, Homo sapiens
acccccttctactgagcct

SEQ ID NO: 4886577 - DNA, 17 bp, Homo sapiens
acccccttctctgctcc

SEQ ID NO: 4886578 - DNA, 18 bp, Homo sapiens
accccgaccacctgccca

SEQ ID NO: 4886579 - DNA, 14 bp, Homo sapiens
accccgcctgccct

SEQ ID NO: 4886580 - DNA, 20 bp, Homo sapiens
accccggcaggccctgcagt

SEQ ID NO: 4886581 - DNA, 13 bp, Homo sapiens
accccgggctctc

SEQ ID NO: 4886582 - DNA, 15 bp, Homo sapiens
accccgggctctctg

SEQ ID NO: 4886583 - DNA, 17 bp, Homo sapiens
accccgggctctctgct

SEQ ID NO: 4886584 - DNA, 21 bp, Homo sapiens
accccgggctctctgctgtac

SEQ ID NO: 4886585 - DNA, 20 bp, Homo sapiens
accccgtcgaggggctctca

SEQ ID NO: 4886586 - DNA, 20 bp, Homo sapiens
accccgttacagctccccaa

SEQ ID NO: 4886587 - DNA, 22 bp, Homo sapiens
acccctaaagagatactttgat

SEQ ID NO: 4886588 - DNA, 14 bp, Homo sapiens
acccctaagagact

SEQ ID NO: 4886589 - DNA, 19 bp, Homo sapiens
acccctagttccctctgct

SEQ ID NO: 4886590 - DNA, 18 bp, Homo sapiens
acccctcactctggcctc

SEQ ID NO: 4886591 - DNA, 19 bp, Homo sapiens
acccctccatgtgggctag

SEQ ID NO: 4886592 - DNA, 19 bp, Homo sapiens
acccctcctcactggccat

SEQ ID NO: 4886593 - DNA, 23 bp, Homo sapiens
acccctcctcactggccatccct

SEQ ID NO: 4886594 - DNA, 14 bp, Homo sapiens
acccctgcttctga

SEQ ID NO: 4886595 - DNA, 15 bp, Homo sapiens
acccctggctgtact

SEQ ID NO: 4886596 - DNA, 21 bp, Homo sapiens
acccctgtcccatgcaggccc

SEQ ID NO: 4886597 - DNA, 22 bp, Homo sapiens
acccctgtcccatgcaggccct

SEQ ID NO: 4886598 - DNA, 15 bp, Homo sapiens
acccctgtcctcact

SEQ ID NO: 4886599 - DNA, 13 bp, Homo sapiens
accccttccagat

SEQ ID NO: 4886600 - DNA, 16 bp, Homo sapiens
accccttcgctcctgt

SEQ ID NO: 4886601 - DNA, 23 bp, Homo sapiens
acccgaccccccgtgggctcccg

SEQ ID NO: 4886602 - DNA, 14 bp, Homo sapiens
acccggcccctgct

SEQ ID NO: 4886603 - DNA, 20 bp, Homo sapiens
acccggcccctgctggttca

SEQ ID NO: 4886604 - DNA, 22 bp, Homo sapiens
acccggcccctgctggttcagg

SEQ ID NO: 4886605 - DNA, 19 bp, Homo sapiens
acccgtgagcgcctgtgca

SEQ ID NO: 4886606 - DNA, 13 bp, Homo sapiens
acccgttccaaaa

SEQ ID NO: 4886607 - DNA, 23 bp, Homo sapiens
accctaatgtcttcataaagtac

SEQ ID NO: 4886608 - DNA, 16 bp, Homo sapiens
accctagccaatgtct

SEQ ID NO: 4886609 - DNA, 19 bp, Homo sapiens
accctagccaatgtctcct

SEQ ID NO: 4886610 - DNA, 18 bp, Homo sapiens
accctaggttccctgttc

SEQ ID NO: 4886611 - DNA, 22 bp, Homo sapiens
accctagtcccttcccctccct

SEQ ID NO: 4886612 - DNA, 21 bp, Homo sapiens
accctcaacctcttctggctc

SEQ ID NO: 4886613 - DNA, 11 bp, Homo sapiens
accctcagagc

SEQ ID NO: 4886614 - DNA, 18 bp, Homo sapiens
accctcagagccacccct

SEQ ID NO: 4886615 - DNA, 21 bp, Homo sapiens
accctcaggggaaaactgtta

SEQ ID NO: 4886616 - DNA, 12 bp, Homo sapiens
accctcccaccc

SEQ ID NO: 4886617 - DNA, 23 bp, Homo sapiens
accctccccgcaccccccaagct

SEQ ID NO: 4886618 - DNA, 12 bp, Homo sapiens
accctccctgga

SEQ ID NO: 4886619 - DNA, 11 bp, Homo sapiens
accctcctggc

SEQ ID NO: 4886620 - DNA, 20 bp, Homo sapiens
accctcgaagcgcgccactc

SEQ ID NO: 4886621 - DNA, 20 bp, Homo sapiens
accctctgccaccagagacc

SEQ ID NO: 4886622 - DNA, 11 bp, Homo sapiens
accctctggcc

SEQ ID NO: 4886623 - DNA, 19 bp, Homo sapiens
accctctgggaacctccca

SEQ ID NO: 4886624 - DNA, 19 bp, Homo sapiens
accctcttcctgtgatcca

SEQ ID NO: 4886625 - DNA, 20 bp, Homo sapiens
accctcttcctgtgatccac

SEQ ID NO: 4886626 - DNA, 21 bp, Homo sapiens
accctgaatttggcctgcact

SEQ ID NO: 4886627 - DNA, 14 bp, Homo sapiens
accctgatgaaaac

SEQ ID NO: 4886628 - DNA, 16 bp, Homo sapiens
accctgcaaggcccac

SEQ ID NO: 4886629 - DNA, 14 bp, Homo sapiens
accctgctgccttc

SEQ ID NO: 4886630 - DNA, 16 bp, Homo sapiens
accctgggagacagac

SEQ ID NO: 4886631 - DNA, 19 bp, Homo sapiens
accctggggcctggacctg

SEQ ID NO: 4886632 - DNA, 15 bp, Homo sapiens
accctgtacctcatc

SEQ ID NO: 4886633 - DNA, 20 bp, Homo sapiens
accctgtactgttctgtgtc

SEQ ID NO: 4886634 - DNA, 22 bp, Homo sapiens
accctgtactgttctgtgtctt

SEQ ID NO: 4886635 - DNA, 16 bp, Homo sapiens
accctgtggccctggc

SEQ ID NO: 4886636 - DNA, 17 bp, Homo sapiens
accctgttaccattttg

SEQ ID NO: 4886637 - DNA, 13 bp, Homo sapiens
acccttagaaaat

SEQ ID NO: 4886638 - DNA, 14 bp, Homo sapiens
acccttcttttctc

SEQ ID NO: 4886639 - DNA, 23 bp, Homo sapiens
acccttgaatgtagcagccccgg

SEQ ID NO: 4886640 - DNA, 13 bp, Homo sapiens
acccttggcctgt

SEQ ID NO: 4886641 - DNA, 17 bp, Homo sapiens
acccttggcctgtctca

SEQ ID NO: 4886642 - DNA, 17 bp, Homo sapiens
acccttggctcaatcct

SEQ ID NO: 4886643 - DNA, 21 bp, Homo sapiens
accctttcttgacaaaaccta

SEQ ID NO: 4886644 - DNA, 17 bp, Homo sapiens
accctttgtttcttgtt

SEQ ID NO: 4886645 - DNA, 17 bp, Homo sapiens
acccttttcctttgtgg

SEQ ID NO: 4886646 - DNA, 19 bp, Homo sapiens
acccttttcctttgtggtt

SEQ ID NO: 4886647 - DNA, 17 bp, Homo sapiens
accctttttctccagct

SEQ ID NO: 4886648 - DNA, 15 bp, Homo sapiens
accgacaggccctgg

SEQ ID NO: 4886649 - DNA, 19 bp, Homo sapiens
accgagcaaagatcaaaat

SEQ ID NO: 4886650 - DNA, 24 bp, Homo sapiens
accgagtctcttctccactggatg

SEQ ID NO: 4886651 - DNA, 12 bp, Homo sapiens
accgcacagctc

SEQ ID NO: 4886652 - DNA, 18 bp, Homo sapiens
accgcacagctcaggagg

SEQ ID NO: 4886653 - DNA, 11 bp, Homo sapiens
accgccccctc

SEQ ID NO: 4886654 - DNA, 20 bp, Homo sapiens
accgcgactaatttcaaaat

SEQ ID NO: 4886655 - DNA, 19 bp, Homo sapiens
accgcttccctcctgcccg

SEQ ID NO: 4886656 - DNA, 18 bp, Homo sapiens
accgcttgtggggaccca

SEQ ID NO: 4886657 - DNA, 22 bp, Homo sapiens
accggctggcagggctggcccc

SEQ ID NO: 4886658 - DNA, 20 bp, Homo sapiens
accgggcactcagaagacac

SEQ ID NO: 4886659 - DNA, 15 bp, Homo sapiens
accggtccagctggc

SEQ ID NO: 4886660 - DNA, 18 bp, Homo sapiens
accggtccagctggcctg

SEQ ID NO: 4886661 - DNA, 17 bp, Homo sapiens
accgtaataattattat

SEQ ID NO: 4886662 - DNA, 12 bp, Homo sapiens
accgtcctcacc

SEQ ID NO: 4886663 - DNA, 18 bp, Homo sapiens
accgtcctcacccctgtc

SEQ ID NO: 4886664 - DNA, 22 bp, Homo sapiens
accgtgagcaggaaggcctggg

SEQ ID NO: 4886665 - DNA, 19 bp, Homo sapiens
accgtggccctgccctctc

SEQ ID NO: 4886666 - DNA, 20 bp, Homo sapiens
accgtggccctgccctctcc

SEQ ID NO: 4886667 - DNA, 21 bp, Homo sapiens
acctaaaaggaaatctcaccc

SEQ ID NO: 4886668 - DNA, 19 bp, Homo sapiens
acctaaacggttcagtttc

SEQ ID NO: 4886669 - DNA, 15 bp, Homo sapiens
acctaagtactgtaa

SEQ ID NO: 4886670 - DNA, 14 bp, Homo sapiens
acctaagtctctgt

SEQ ID NO: 4886671 - DNA, 16 bp, Homo sapiens
acctactgttctaaag

SEQ ID NO: 4886672 - DNA, 20 bp, Homo sapiens
acctactgttctaaagctct

SEQ ID NO: 4886673 - DNA, 20 bp, Homo sapiens
acctagaagaagctatgtca

SEQ ID NO: 4886674 - DNA, 12 bp, Homo sapiens
acctagattttt

SEQ ID NO: 4886675 - DNA, 18 bp, Homo sapiens
acctagcaattccatcac

SEQ ID NO: 4886676 - DNA, 14 bp, Homo sapiens
acctagctgtgcaa

SEQ ID NO: 4886677 - DNA, 20 bp, Homo sapiens
acctaggctcatggacgaga

SEQ ID NO: 4886678 - DNA, 15 bp, Homo sapiens
acctataatgtgtgt

SEQ ID NO: 4886679 - DNA, 16 bp, Homo sapiens
acctataatgtgtgta

SEQ ID NO: 4886680 - DNA, 17 bp, Homo sapiens
acctataatgtgtgtat

SEQ ID NO: 4886681 - DNA, 14 bp, Homo sapiens
acctatcccacctc

SEQ ID NO: 4886682 - DNA, 16 bp, Homo sapiens
acctcaaaatgtctaa

SEQ ID NO: 4886683 - DNA, 15 bp, Homo sapiens
acctcacagtgaccc

SEQ ID NO: 4886684 - DNA, 21 bp, Homo sapiens
acctcacagtgacccttccca

SEQ ID NO: 4886685 - DNA, 22 bp, Homo sapiens
acctcaccccgttacagctccc

SEQ ID NO: 4886686 - DNA, 12 bp, Homo sapiens
acctcaccctgc

SEQ ID NO: 4886687 - DNA, 17 bp, Homo sapiens
acctcactctttatagt

SEQ ID NO: 4886688 - DNA, 20 bp, Homo sapiens
acctcagcctgcacagtgtc

SEQ ID NO: 4886689 - DNA, 23 bp, Homo sapiens
acctcagcctgcacagtgtcccc

SEQ ID NO: 4886690 - DNA, 17 bp, Homo sapiens
acctcaggcactagcct

SEQ ID NO: 4886691 - DNA, 17 bp, Homo sapiens
acctcagttcccttggc

SEQ ID NO: 4886692 - DNA, 18 bp, Homo sapiens
acctcatgtttatgaaaa

SEQ ID NO: 4886693 - DNA, 19 bp, Homo sapiens
acctccaacagaactaaat

SEQ ID NO: 4886694 - DNA, 18 bp, Homo sapiens
acctccagtccccctatc

SEQ ID NO: 4886695 - DNA, 16 bp, Homo sapiens
acctccattaaagtct

SEQ ID NO: 4886696 - DNA, 21 bp, Homo sapiens
acctccattctattttagaat

SEQ ID NO: 4886697 - DNA, 20 bp, Homo sapiens
acctcccagaggtccagccc

SEQ ID NO: 4886698 - DNA, 22 bp, Homo sapiens
acctcccagaggtccagcccat

SEQ ID NO: 4886699 - DNA, 11 bp, Homo sapiens
acctccccacg

SEQ ID NO: 4886700 - DNA, 15 bp, Homo sapiens
acctccccagcccct

SEQ ID NO: 4886701 - DNA, 16 bp, Homo sapiens
acctccccagccccta

SEQ ID NO: 4886702 - DNA, 15 bp, Homo sapiens
acctcccctgccttg

SEQ ID NO: 4886703 - DNA, 16 bp, Homo sapiens
acctcccctgccttgc

SEQ ID NO: 4886704 - DNA, 17 bp, Homo sapiens
acctcccctgccttgct

SEQ ID NO: 4886705 - DNA, 17 bp, Homo sapiens
acctccctgacccgtct

SEQ ID NO: 4886706 - DNA, 12 bp, Homo sapiens
acctccctgccc

SEQ ID NO: 4886707 - DNA, 14 bp, Homo sapiens
acctccctgcccag

SEQ ID NO: 4886708 - DNA, 20 bp, Homo sapiens
acctccgcctcttgggttca

SEQ ID NO: 4886709 - DNA, 14 bp, Homo sapiens
acctcctcttcccc

SEQ ID NO: 4886710 - DNA, 19 bp, Homo sapiens
acctccttgtcactttatt

SEQ ID NO: 4886711 - DNA, 20 bp, Homo sapiens
acctctacccaaaccctagg

SEQ ID NO: 4886712 - DNA, 12 bp, Homo sapiens
acctctgcctga

SEQ ID NO: 4886713 - DNA, 20 bp, Homo sapiens
acctctgcctgaagtcacac

SEQ ID NO: 4886714 - DNA, 23 bp, Homo sapiens
acctctgcctgaagtcacacagt

SEQ ID NO: 4886715 - DNA, 14 bp, Homo sapiens
acctctgcggaccc

SEQ ID NO: 4886716 - DNA, 17 bp, Homo sapiens
acctctgcggaccccag

SEQ ID NO: 4886717 - DNA, 15 bp, Homo sapiens
acctctggactggct

SEQ ID NO: 4886718 - DNA, 16 bp, Homo sapiens
acctctggactggcta

SEQ ID NO: 4886719 - DNA, 18 bp, Homo sapiens
acctctggattcattgtc

SEQ ID NO: 4886720 - DNA, 13 bp, Homo sapiens
acctctgtaattt

SEQ ID NO: 4886721 - DNA, 23 bp, Homo sapiens
acctctgtaatttttcagctctc

SEQ ID NO: 4886722 - DNA, 16 bp, Homo sapiens
acctctgtctcatcct

SEQ ID NO: 4886723 - DNA, 17 bp, Homo sapiens
acctctgtgacctcagg

SEQ ID NO: 4886724 - DNA, 13 bp, Homo sapiens
acctcttccccag

SEQ ID NO: 4886725 - DNA, 15 bp, Homo sapiens
acctcttgctgtctc

SEQ ID NO: 4886726 - DNA, 17 bp, Homo sapiens
acctcttgctgtctctg

SEQ ID NO: 4886727 - DNA, 20 bp, Homo sapiens
acctgaaattccaaagtctc

SEQ ID NO: 4886728 - DNA, 15 bp, Homo sapiens
acctgacacaagagg

SEQ ID NO: 4886729 - DNA, 16 bp, Homo sapiens
acctgacacaagagga

SEQ ID NO: 4886730 - DNA, 14 bp, Homo sapiens
acctgacctcttgc

SEQ ID NO: 4886731 - DNA, 19 bp, Homo sapiens
acctgacctcttgctgtct

SEQ ID NO: 4886732 - DNA, 20 bp, Homo sapiens
acctgacctcttgctgtctc

SEQ ID NO: 4886733 - DNA, 15 bp, Homo sapiens
acctgaggcctgaag

SEQ ID NO: 4886734 - DNA, 23 bp, Homo sapiens
acctgagggcagaaaggttctgc

SEQ ID NO: 4886735 - DNA, 22 bp, Homo sapiens
acctgatggaagtaaagcctca

SEQ ID NO: 4886736 - DNA, 19 bp, Homo sapiens
acctgccatgccaggaacc

SEQ ID NO: 4886737 - DNA, 13 bp, Homo sapiens
acctgcccaacct

SEQ ID NO: 4886738 - DNA, 12 bp, Homo sapiens
acctgccctgcc

SEQ ID NO: 4886739 - DNA, 17 bp, Homo sapiens
acctgccctgcccccac

SEQ ID NO: 4886740 - DNA, 13 bp, Homo sapiens
acctgccctggaa

SEQ ID NO: 4886741 - DNA, 18 bp, Homo sapiens
acctgcctcctcgttcct

SEQ ID NO: 4886742 - DNA, 20 bp, Homo sapiens
acctgcctcctcgttccttt

SEQ ID NO: 4886743 - DNA, 21 bp, Homo sapiens
acctgcctcggcctcccaaag

SEQ ID NO: 4886744 - DNA, 22 bp, Homo sapiens
acctgctccgctgctccttggc

SEQ ID NO: 4886745 - DNA, 18 bp, Homo sapiens
acctgctctcctcttgcc

SEQ ID NO: 4886746 - DNA, 17 bp, Homo sapiens
acctgctgggtaaactg

SEQ ID NO: 4886747 - DNA, 15 bp, Homo sapiens
acctgctttgactga

SEQ ID NO: 4886748 - DNA, 17 bp, Homo sapiens
acctgctttttgaaatg

SEQ ID NO: 4886749 - DNA, 17 bp, Homo sapiens
acctggaaaaattccag

SEQ ID NO: 4886750 - DNA, 18 bp, Homo sapiens
acctgggattcaggaatg

SEQ ID NO: 4886751 - DNA, 14 bp, Homo sapiens
acctggggcacagt

SEQ ID NO: 4886752 - DNA, 19 bp, Homo sapiens
acctggggcacagtccagg

SEQ ID NO: 4886753 - DNA, 20 bp, Homo sapiens
acctggggcacagtccagga

SEQ ID NO: 4886754 - DNA, 17 bp, Homo sapiens
acctgggttccctttcc

SEQ ID NO: 4886755 - DNA, 18 bp, Homo sapiens
acctggtaccctcctggc

SEQ ID NO: 4886756 - DNA, 17 bp, Homo sapiens
acctgtatgtctccagt

SEQ ID NO: 4886757 - DNA, 18 bp, Homo sapiens
acctgtatttaagcaaat

SEQ ID NO: 4886758 - DNA, 21 bp, Homo sapiens
acctgtatttaagcaaatact

SEQ ID NO: 4886759 - DNA, 22 bp, Homo sapiens
acctgtcaatgatacagtccct

SEQ ID NO: 4886760 - DNA, 13 bp, Homo sapiens
acctgtcacattg

SEQ ID NO: 4886761 - DNA, 14 bp, Homo sapiens
acctgtctcagcct

SEQ ID NO: 4886762 - DNA, 15 bp, Homo sapiens
acctgtgaagctgaa

SEQ ID NO: 4886763 - DNA, 16 bp, Homo sapiens
acctgtgagtaaatat

SEQ ID NO: 4886764 - DNA, 17 bp, Homo sapiens
acctgtgagtaaatatt

SEQ ID NO: 4886765 - DNA, 20 bp, Homo sapiens
acctgtggaacataaaaagg

SEQ ID NO: 4886766 - DNA, 20 bp, Homo sapiens
acctgtgtggtactctgaaa

SEQ ID NO: 4886767 - DNA, 18 bp, Homo sapiens
acctgttgctgtgtttaa

SEQ ID NO: 4886768 - DNA, 12 bp, Homo sapiens
accttaagacct

SEQ ID NO: 4886769 - DNA, 18 bp, Homo sapiens
accttaccaactttctgt

SEQ ID NO: 4886770 - DNA, 21 bp, Homo sapiens
accttactgtggaggaaggat

SEQ ID NO: 4886771 - DNA, 23 bp, Homo sapiens
accttagctccctcccgcacccc

SEQ ID NO: 4886772 - DNA, 22 bp, Homo sapiens
accttagctggcattacagctg

SEQ ID NO: 4886773 - DNA, 13 bp, Homo sapiens
accttaggccttc

SEQ ID NO: 4886774 - DNA, 15 bp, Homo sapiens
accttaggccttcct

SEQ ID NO: 4886775 - DNA, 18 bp, Homo sapiens
accttaggccttcctctc

SEQ ID NO: 4886776 - DNA, 20 bp, Homo sapiens
accttaggccttcctctctc

SEQ ID NO: 4886777 - DNA, 19 bp, Homo sapiens
accttatcactgcattatt

SEQ ID NO: 4886778 - DNA, 16 bp, Homo sapiens
accttatcctgcattg

SEQ ID NO: 4886779 - DNA, 14 bp, Homo sapiens
accttccaggaccc

SEQ ID NO: 4886780 - DNA, 19 bp, Homo sapiens
accttccatggctcttttt

SEQ ID NO: 4886781 - DNA, 16 bp, Homo sapiens
accttccttcctgctt

SEQ ID NO: 4886782 - DNA, 15 bp, Homo sapiens
accttctagaattat

SEQ ID NO: 4886783 - DNA, 12 bp, Homo sapiens
accttctgtggc

SEQ ID NO: 4886784 - DNA, 16 bp, Homo sapiens
accttctgtggctcac

SEQ ID NO: 4886785 - DNA, 17 bp, Homo sapiens
accttctttcactctgt

SEQ ID NO: 4886786 - DNA, 13 bp, Homo sapiens
accttgctaattt

SEQ ID NO: 4886787 - DNA, 12 bp, Homo sapiens
accttgctgtcc

SEQ ID NO: 4886788 - DNA, 14 bp, Homo sapiens
accttgtgatcatg

SEQ ID NO: 4886789 - DNA, 17 bp, Homo sapiens
acctttcaaatttcaca

SEQ ID NO: 4886790 - DNA, 15 bp, Homo sapiens
acctttgtgtatttt

SEQ ID NO: 4886791 - DNA, 13 bp, Homo sapiens
accttttaaagtg

SEQ ID NO: 4886792 - DNA, 21 bp, Homo sapiens
accttttaaagtgtttcagct

SEQ ID NO: 4886793 - DNA, 15 bp, Homo sapiens
accttttaccagctt

SEQ ID NO: 4886794 - DNA, 15 bp, Homo sapiens
accttttatgtagca

SEQ ID NO: 4886795 - DNA, 21 bp, Homo sapiens
accttttgaggagccccagct

SEQ ID NO: 4886796 - DNA, 19 bp, Homo sapiens
acgaaacttgttattgtga

SEQ ID NO: 4886797 - DNA, 12 bp, Homo sapiens
acgaacaaaaca

SEQ ID NO: 4886798 - DNA, 13 bp, Homo sapiens
acgaacaaaacac

SEQ ID NO: 4886799 - DNA, 14 bp, Homo sapiens
acgacgccctctcc

SEQ ID NO: 4886800 - DNA, 20 bp, Homo sapiens
acgagatgggaaggcacagg

SEQ ID NO: 4886801 - DNA, 16 bp, Homo sapiens
acgagtcaccttccag

SEQ ID NO: 4886802 - DNA, 15 bp, Homo sapiens
acgatgtgtctgtat

SEQ ID NO: 4886803 - DNA, 16 bp, Homo sapiens
acgattccttctctga

SEQ ID NO: 4886804 - DNA, 18 bp, Homo sapiens
acgattttctccagctca

SEQ ID NO: 4886805 - DNA, 13 bp, Homo sapiens
acgcacacacaca

SEQ ID NO: 4886806 - DNA, 13 bp, Homo sapiens
acgcacgcacaca

SEQ ID NO: 4886807 - DNA, 16 bp, Homo sapiens
acgcaggcatctgatt

SEQ ID NO: 4886808 - DNA, 18 bp, Homo sapiens
acgccctcccctcccctg

SEQ ID NO: 4886809 - DNA, 19 bp, Homo sapiens
acgccctcccctcccctgc

SEQ ID NO: 4886810 - DNA, 21 bp, Homo sapiens
acgccctcccctcccctgctg

SEQ ID NO: 4886811 - DNA, 23 bp, Homo sapiens
acgccctcccctcccctgctgca

SEQ ID NO: 4886812 - DNA, 21 bp, Homo sapiens
acgccctctccccacccctac

SEQ ID NO: 4886813 - DNA, 21 bp, Homo sapiens
acgccggggacagaggcctgc

SEQ ID NO: 4886814 - DNA, 23 bp, Homo sapiens
acgcctctccctaggagaagagt

SEQ ID NO: 4886815 - DNA, 11 bp, Homo sapiens
acgcctggcta

SEQ ID NO: 4886816 - DNA, 16 bp, Homo sapiens
acgcctgtagtcctag

SEQ ID NO: 4886817 - DNA, 20 bp, Homo sapiens
acgcgccttgtctcctactc

SEQ ID NO: 4886818 - DNA, 20 bp, Homo sapiens
acgcgtgcacacaccagagc

SEQ ID NO: 4886819 - DNA, 13 bp, Homo sapiens
acgctccgctgcc

SEQ ID NO: 4886820 - DNA, 20 bp, Homo sapiens
acgctccgctgccgtgccgc

SEQ ID NO: 4886821 - DNA, 13 bp, Homo sapiens
acgctggaccttg

SEQ ID NO: 4886822 - DNA, 17 bp, Homo sapiens
acgctggagtgcagtga

SEQ ID NO: 4886823 - DNA, 15 bp, Homo sapiens
acgcttgctcatttt

SEQ ID NO: 4886824 - DNA, 15 bp, Homo sapiens
acggaatagttggct

SEQ ID NO: 4886825 - DNA, 18 bp, Homo sapiens
acggacaataaacctccg

SEQ ID NO: 4886826 - DNA, 19 bp, Homo sapiens
acggacaataaacctccgc

SEQ ID NO: 4886827 - DNA, 18 bp, Homo sapiens
acggagccccaggcctct

SEQ ID NO: 4886828 - DNA, 18 bp, Homo sapiens
acggaggcatcctaccct

SEQ ID NO: 4886829 - DNA, 12 bp, Homo sapiens
acggattccaaa

SEQ ID NO: 4886830 - DNA, 12 bp, Homo sapiens
acggccaggcca

SEQ ID NO: 4886831 - DNA, 13 bp, Homo sapiens
acggccaggccag

SEQ ID NO: 4886832 - DNA, 11 bp, Homo sapiens
acggccctgca

SEQ ID NO: 4886833 - DNA, 13 bp, Homo sapiens
acggccctgcaat

SEQ ID NO: 4886834 - DNA, 18 bp, Homo sapiens
acggccctgcagccagct

SEQ ID NO: 4886835 - DNA, 20 bp, Homo sapiens
acggcctgatgctccctccc

SEQ ID NO: 4886836 - DNA, 15 bp, Homo sapiens
acgggttggggccgg

SEQ ID NO: 4886837 - DNA, 16 bp, Homo sapiens
acggtcaggtttaaca

SEQ ID NO: 4886838 - DNA, 20 bp, Homo sapiens
acggtcaggtttaacatttg

SEQ ID NO: 4886839 - DNA, 14 bp, Homo sapiens
acgtactgtctgat

SEQ ID NO: 4886840 - DNA, 21 bp, Homo sapiens
acgtcactggaccactgggca

SEQ ID NO: 4886841 - DNA, 15 bp, Homo sapiens
acgtctgtcttcaca

SEQ ID NO: 4886842 - DNA, 19 bp, Homo sapiens
acgtctgtcttcacagctc

SEQ ID NO: 4886843 - DNA, 15 bp, Homo sapiens
acgtctttctttttt

SEQ ID NO: 4886844 - DNA, 19 bp, Homo sapiens
acgtggagagctggtgccc

SEQ ID NO: 4886845 - DNA, 16 bp, Homo sapiens
acgtgggagacaagaa

SEQ ID NO: 4886846 - DNA, 13 bp, Homo sapiens
acgtttgtatgtg

SEQ ID NO: 4886847 - DNA, 13 bp, Homo sapiens
acgtttttccttt

SEQ ID NO: 4886848 - DNA, 17 bp, Homo sapiens
actaaaagacatttgtt

SEQ ID NO: 4886849 - DNA, 19 bp, Homo sapiens
actaaacatatgatttcac

SEQ ID NO: 4886850 - DNA, 13 bp, Homo sapiens
actaaactttacc

SEQ ID NO: 4886851 - DNA, 16 bp, Homo sapiens
actaaagatccaagaa

SEQ ID NO: 4886852 - DNA, 15 bp, Homo sapiens
actaaagccagcctg

SEQ ID NO: 4886853 - DNA, 14 bp, Homo sapiens
actaaagtatgtaa

SEQ ID NO: 4886854 - DNA, 17 bp, Homo sapiens
actaaatgcctagtttt

SEQ ID NO: 4886855 - DNA, 20 bp, Homo sapiens
actaaatgcctagtttttag

SEQ ID NO: 4886856 - DNA, 22 bp, Homo sapiens
actaaatttaaatttaaagata

SEQ ID NO: 4886857 - DNA, 13 bp, Homo sapiens
actaaatttgata

SEQ ID NO: 4886858 - DNA, 22 bp, Homo sapiens
actaaatttgatacttatattt

SEQ ID NO: 4886859 - DNA, 19 bp, Homo sapiens
actaaatttggggacagat

SEQ ID NO: 4886860 - DNA, 20 bp, Homo sapiens
actaaatttggggacagatt

SEQ ID NO: 4886861 - DNA, 24 bp, Homo sapiens
actaaatttggggacagattcagt

SEQ ID NO: 4886862 - DNA, 17 bp, Homo sapiens
actaacaggatatttaa

SEQ ID NO: 4886863 - DNA, 18 bp, Homo sapiens
actaacgttgagcccctg

SEQ ID NO: 4886864 - DNA, 17 bp, Homo sapiens
actaagaaacttttgta

SEQ ID NO: 4886865 - DNA, 17 bp, Homo sapiens
actaagaaatattccaa

SEQ ID NO: 4886866 - DNA, 23 bp, Homo sapiens
actaagaaatattccaaatgtct

SEQ ID NO: 4886867 - DNA, 16 bp, Homo sapiens
actaagaattcaaact

SEQ ID NO: 4886868 - DNA, 18 bp, Homo sapiens
actaagaattcaaactgg

SEQ ID NO: 4886869 - DNA, 19 bp, Homo sapiens
actaagcctacctgctctc

SEQ ID NO: 4886870 - DNA, 20 bp, Homo sapiens
actaattagggtacatttat

SEQ ID NO: 4886871 - DNA, 23 bp, Homo sapiens
actaattagggtacatttataat

SEQ ID NO: 4886872 - DNA, 20 bp, Homo sapiens
actaattggcctctttaaga

SEQ ID NO: 4886873 - DNA, 15 bp, Homo sapiens
actaatttaaaaaat

SEQ ID NO: 4886874 - DNA, 17 bp, Homo sapiens
actaatttgatgtttac

SEQ ID NO: 4886875 - DNA, 13 bp, Homo sapiens
actacaaatcaag

SEQ ID NO: 4886876 - DNA, 19 bp, Homo sapiens
actacaaatcaagtatttg

SEQ ID NO: 4886877 - DNA, 20 bp, Homo sapiens
actacacatccctaatgtgt

SEQ ID NO: 4886878 - DNA, 18 bp, Homo sapiens
actacacatttttaaatt

SEQ ID NO: 4886879 - DNA, 20 bp, Homo sapiens
actacacatttttaaattgt

SEQ ID NO: 4886880 - DNA, 16 bp, Homo sapiens
actacagacctgcttt

SEQ ID NO: 4886881 - DNA, 17 bp, Homo sapiens
actacagacctgctttt

SEQ ID NO: 4886882 - DNA, 19 bp, Homo sapiens
actacagacctgctttttg

SEQ ID NO: 4886883 - DNA, 23 bp, Homo sapiens
actacagacctgctttttgaaat

SEQ ID NO: 4886884 - DNA, 11 bp, Homo sapiens
actacaggcac

SEQ ID NO: 4886885 - DNA, 20 bp, Homo sapiens
actacatgagaacaaacaga

SEQ ID NO: 4886886 - DNA, 22 bp, Homo sapiens
actacattgagtagacacattt

SEQ ID NO: 4886887 - DNA, 18 bp, Homo sapiens
actacggaatagttggct

SEQ ID NO: 4886888 - DNA, 14 bp, Homo sapiens
actactctttgatt

SEQ ID NO: 4886889 - DNA, 16 bp, Homo sapiens
actactgggtgtcatt

SEQ ID NO: 4886890 - DNA, 20 bp, Homo sapiens
actactgggtgtcatttcat

SEQ ID NO: 4886891 - DNA, 22 bp, Homo sapiens
actacttagcatcctaagaaat

SEQ ID NO: 4886892 - DNA, 21 bp, Homo sapiens
actactttgccttcttttgta

SEQ ID NO: 4886893 - DNA, 13 bp, Homo sapiens
actagaactctcc

SEQ ID NO: 4886894 - DNA, 14 bp, Homo sapiens
actagaagggccag

SEQ ID NO: 4886895 - DNA, 16 bp, Homo sapiens
actagacacagataat

SEQ ID NO: 4886896 - DNA, 18 bp, Homo sapiens
actagacaccaaagttct

SEQ ID NO: 4886897 - DNA, 20 bp, Homo sapiens
actagacaccaaagttctaa

SEQ ID NO: 4886898 - DNA, 19 bp, Homo sapiens
actagactcttcactgtta

SEQ ID NO: 4886899 - DNA, 21 bp, Homo sapiens
actagcccctgtggagactgg

SEQ ID NO: 4886900 - DNA, 17 bp, Homo sapiens
actagcctttggctctg

SEQ ID NO: 4886901 - DNA, 16 bp, Homo sapiens
actagcttttcaaaca

SEQ ID NO: 4886902 - DNA, 18 bp, Homo sapiens
actagggattcaggctgc

SEQ ID NO: 4886903 - DNA, 21 bp, Homo sapiens
actagggattcaggctgcttg

SEQ ID NO: 4886904 - DNA, 16 bp, Homo sapiens
actagtacaaattata

SEQ ID NO: 4886905 - DNA, 16 bp, Homo sapiens
actagtgacagcttgt

SEQ ID NO: 4886906 - DNA, 19 bp, Homo sapiens
actagtgaccccttccctg

SEQ ID NO: 4886907 - DNA, 17 bp, Homo sapiens
actagttttagttttct

SEQ ID NO: 4886908 - DNA, 12 bp, Homo sapiens
actataaagaga

SEQ ID NO: 4886909 - DNA, 14 bp, Homo sapiens
actataaagagaag

SEQ ID NO: 4886910 - DNA, 15 bp, Homo sapiens
actatacaacaaagg

SEQ ID NO: 4886911 - DNA, 14 bp, Homo sapiens
actatacttgaaca

SEQ ID NO: 4886912 - DNA, 15 bp, Homo sapiens
actatacttgaacaa

SEQ ID NO: 4886913 - DNA, 17 bp, Homo sapiens
actatacttgaacaaaa

SEQ ID NO: 4886914 - DNA, 23 bp, Homo sapiens
actatacttgaacaaaagggtca

SEQ ID NO: 4886915 - DNA, 18 bp, Homo sapiens
actatagcctaggtgaca

SEQ ID NO: 4886916 - DNA, 20 bp, Homo sapiens
actatagcctaggtgacaga

SEQ ID NO: 4886917 - DNA, 14 bp, Homo sapiens
actatatacatgtg

SEQ ID NO: 4886918 - DNA, 13 bp, Homo sapiens
actatatttgcta

SEQ ID NO: 4886919 - DNA, 18 bp, Homo sapiens
actatccatgcaccaaac

SEQ ID NO: 4886920 - DNA, 21 bp, Homo sapiens
actatggaaaatcagctgctc

SEQ ID NO: 4886921 - DNA, 16 bp, Homo sapiens
actatggctgagttct

SEQ ID NO: 4886922 - DNA, 18 bp, Homo sapiens
actatgttgcccaggcag

SEQ ID NO: 4886923 - DNA, 20 bp, Homo sapiens
actattattataggtaatca

SEQ ID NO: 4886924 - DNA, 22 bp, Homo sapiens
actattcaggagagtagaacag

SEQ ID NO: 4886925 - DNA, 19 bp, Homo sapiens
actattcattaaatgtttg

SEQ ID NO: 4886926 - DNA, 15 bp, Homo sapiens
actattgcatttata

SEQ ID NO: 4886927 - DNA, 11 bp, Homo sapiens
actatttaaag

SEQ ID NO: 4886928 - DNA, 22 bp, Homo sapiens
actatttcccttgaaattttaa

SEQ ID NO: 4886929 - DNA, 23 bp, Homo sapiens
actatttgcttatttaataaaga

SEQ ID NO: 4886930 - DNA, 14 bp, Homo sapiens
actattttcttttt

SEQ ID NO: 4886931 - DNA, 20 bp, Homo sapiens
actcaaaatatttgtacata

SEQ ID NO: 4886932 - DNA, 21 bp, Homo sapiens
actcaaatatgagtacaaatg

SEQ ID NO: 4886933 - DNA, 22 bp, Homo sapiens
actcaaatgttctaagtttcta

SEQ ID NO: 4886934 - DNA, 23 bp, Homo sapiens
actcaatctccccttgcactaaa

SEQ ID NO: 4886935 - DNA, 14 bp, Homo sapiens
actcaatgcactga

SEQ ID NO: 4886936 - DNA, 19 bp, Homo sapiens
actcaatggagtatgtctg

SEQ ID NO: 4886937 - DNA, 15 bp, Homo sapiens
actcacaggaaggag

SEQ ID NO: 4886938 - DNA, 19 bp, Homo sapiens
actcaccagtgtcccctcc

SEQ ID NO: 4886939 - DNA, 13 bp, Homo sapiens
actcactgaagcc

SEQ ID NO: 4886940 - DNA, 19 bp, Homo sapiens
actcactgaagcctgcgtt

SEQ ID NO: 4886941 - DNA, 14 bp, Homo sapiens
actcagaagacact

SEQ ID NO: 4886942 - DNA, 14 bp, Homo sapiens
actcagaatattgc

SEQ ID NO: 4886943 - DNA, 15 bp, Homo sapiens
actcagcagaatggt

SEQ ID NO: 4886944 - DNA, 14 bp, Homo sapiens
actcagcccctagg

SEQ ID NO: 4886945 - DNA, 15 bp, Homo sapiens
actcagcccctagga

SEQ ID NO: 4886946 - DNA, 15 bp, Homo sapiens
actcagccctgaggt

SEQ ID NO: 4886947 - DNA, 15 bp, Homo sapiens
actcagcctgctgcc

SEQ ID NO: 4886948 - DNA, 18 bp, Homo sapiens
actcagctgtctgtggct

SEQ ID NO: 4886949 - DNA, 19 bp, Homo sapiens
actcaggaggctgaggcag

SEQ ID NO: 4886950 - DNA, 17 bp, Homo sapiens
actcaggatttaaaaac

SEQ ID NO: 4886951 - DNA, 18 bp, Homo sapiens
actcagggccatgcctgc

SEQ ID NO: 4886952 - DNA, 14 bp, Homo sapiens
actcagggctcctc

SEQ ID NO: 4886953 - DNA, 16 bp, Homo sapiens
actcagggctcctccc

SEQ ID NO: 4886954 - DNA, 17 bp, Homo sapiens
actcagggctcctccca

SEQ ID NO: 4886955 - DNA, 18 bp, Homo sapiens
actcagggctcctcccag

SEQ ID NO: 4886956 - DNA, 16 bp, Homo sapiens
actcagtttatgctgt

SEQ ID NO: 4886957 - DNA, 20 bp, Homo sapiens
actcagtttatgttgtacaa

SEQ ID NO: 4886958 - DNA, 19 bp, Homo sapiens
actcatcttactgtacctg

SEQ ID NO: 4886959 - DNA, 18 bp, Homo sapiens
actcattgctgagcctct

SEQ ID NO: 4886960 - DNA, 21 bp, Homo sapiens
actcattgctgagcctctgct

SEQ ID NO: 4886961 - DNA, 23 bp, Homo sapiens
actcattgctgagcctctgctcc

SEQ ID NO: 4886962 - DNA, 15 bp, Homo sapiens
actcatttctaaaag

SEQ ID NO: 4886963 - DNA, 22 bp, Homo sapiens
actcatttgttaaaattatcaa

SEQ ID NO: 4886964 - DNA, 19 bp, Homo sapiens
actcatttttgccatacat

SEQ ID NO: 4886965 - DNA, 15 bp, Homo sapiens
actccaaggttccct

SEQ ID NO: 4886966 - DNA, 23 bp, Homo sapiens
actccagcctgggcaacagagca

SEQ ID NO: 4886967 - DNA, 12 bp, Homo sapiens
actccattccca

SEQ ID NO: 4886968 - DNA, 18 bp, Homo sapiens
actccattcccaactaga

SEQ ID NO: 4886969 - DNA, 16 bp, Homo sapiens
actcccatgaagcctt

SEQ ID NO: 4886970 - DNA, 18 bp, Homo sapiens
actcccatgaagcctttt

SEQ ID NO: 4886971 - DNA, 22 bp, Homo sapiens
actcccatgaagccttttgaaa

SEQ ID NO: 4886972 - DNA, 19 bp, Homo sapiens
actccccaaggaagagcca

SEQ ID NO: 4886973 - DNA, 20 bp, Homo sapiens
actccctcctcacctctgga

SEQ ID NO: 4886974 - DNA, 22 bp, Homo sapiens
actccctcctcacctctggact

SEQ ID NO: 4886975 - DNA, 17 bp, Homo sapiens
actccgcccccagccta

SEQ ID NO: 4886976 - DNA, 20 bp, Homo sapiens
actccggattgcgttcctcc

SEQ ID NO: 4886977 - DNA, 20 bp, Homo sapiens
actcctacaagatttagaaa

SEQ ID NO: 4886978 - DNA, 21 bp, Homo sapiens
actcctacatgatgttatgta

SEQ ID NO: 4886979 - DNA, 21 bp, Homo sapiens
actcctagagaacgcagccct

SEQ ID NO: 4886980 - DNA, 15 bp, Homo sapiens
actcctcctctttct

SEQ ID NO: 4886981 - DNA, 15 bp, Homo sapiens
actcctcctttctcc

SEQ ID NO: 4886982 - DNA, 14 bp, Homo sapiens
actcctctgtccag

SEQ ID NO: 4886983 - DNA, 15 bp, Homo sapiens
actcctgacagtctt

SEQ ID NO: 4886984 - DNA, 15 bp, Homo sapiens
actcctgacctcaag

SEQ ID NO: 4886985 - DNA, 11 bp, Homo sapiens
actcctggcct

SEQ ID NO: 4886986 - DNA, 11 bp, Homo sapiens
actccttggcc

SEQ ID NO: 4886987 - DNA, 18 bp, Homo sapiens
actcgagtcacactcaag

SEQ ID NO: 4886988 - DNA, 12 bp, Homo sapiens
actcgcttgtaa

SEQ ID NO: 4886989 - DNA, 13 bp, Homo sapiens
actcgcttgtaaa

SEQ ID NO: 4886990 - DNA, 18 bp, Homo sapiens
actcgcttgtaaatacca

SEQ ID NO: 4886991 - DNA, 16 bp, Homo sapiens
actcgtgtgcaacaga

SEQ ID NO: 4886992 - DNA, 14 bp, Homo sapiens
actctaaagaccaa

SEQ ID NO: 4886993 - DNA, 16 bp, Homo sapiens
actctaaagaccaaac

SEQ ID NO: 4886994 - DNA, 18 bp, Homo sapiens
actctaaagaccaaactt

SEQ ID NO: 4886995 - DNA, 13 bp, Homo sapiens
actctaccctccc

SEQ ID NO: 4886996 - DNA, 15 bp, Homo sapiens
actctaccctcccac

SEQ ID NO: 4886997 - DNA, 18 bp, Homo sapiens
actctaccctcccacccc

SEQ ID NO: 4886998 - DNA, 20 bp, Homo sapiens
actctacttagcatgtccct

SEQ ID NO: 4886999 - DNA, 19 bp, Homo sapiens
actctagacaagatattgt

SEQ ID NO: 4887000 - DNA, 20 bp, Homo sapiens
actctagagtccaaggttta

SEQ ID NO: 4887001 - DNA, 22 bp, Homo sapiens
actctagatgaagttttacatt

SEQ ID NO: 4887002 - DNA, 14 bp, Homo sapiens
actctagattccat

SEQ ID NO: 4887003 - DNA, 15 bp, Homo sapiens
actctatctgggcct

SEQ ID NO: 4887004 - DNA, 17 bp, Homo sapiens
actctatctgggcctgg

SEQ ID NO: 4887005 - DNA, 18 bp, Homo sapiens
actctatctgggcctggg

SEQ ID NO: 4887006 - DNA, 19 bp, Homo sapiens
actctatgccccaaatata

SEQ ID NO: 4887007 - DNA, 15 bp, Homo sapiens
actctcagcccagaa

SEQ ID NO: 4887008 - DNA, 16 bp, Homo sapiens
actctcagcccagaag

SEQ ID NO: 4887009 - DNA, 21 bp, Homo sapiens
actctcagcccagaagaaaat

SEQ ID NO: 4887010 - DNA, 15 bp, Homo sapiens
actctccccacacta

SEQ ID NO: 4887011 - DNA, 13 bp, Homo sapiens
actctgaactttg

SEQ ID NO: 4887012 - DNA, 17 bp, Homo sapiens
actctgaactttggaga

SEQ ID NO: 4887013 - DNA, 16 bp, Homo sapiens
actctgaagcctctgg

SEQ ID NO: 4887014 - DNA, 19 bp, Homo sapiens
actctgaagcctctgggaa

SEQ ID NO: 4887015 - DNA, 14 bp, Homo sapiens
actctgagcccatg

SEQ ID NO: 4887016 - DNA, 22 bp, Homo sapiens
actctgagcgggaggcagagtt

SEQ ID NO: 4887017 - DNA, 11 bp, Homo sapiens
actctgcacat

SEQ ID NO: 4887018 - DNA, 13 bp, Homo sapiens
actctgcacatgt

SEQ ID NO: 4887019 - DNA, 17 bp, Homo sapiens
actctgcacatgtcttg

SEQ ID NO: 4887020 - DNA, 22 bp, Homo sapiens
actctgcacatgtcttgtacat

SEQ ID NO: 4887021 - DNA, 14 bp, Homo sapiens
actctgccagcaaa

SEQ ID NO: 4887022 - DNA, 20 bp, Homo sapiens
actctgccagggcagtgcta

SEQ ID NO: 4887023 - DNA, 12 bp, Homo sapiens
actctgccccct

SEQ ID NO: 4887024 - DNA, 15 bp, Homo sapiens
actctgccccctgct

SEQ ID NO: 4887025 - DNA, 21 bp, Homo sapiens
actctgccccctgctggctct

SEQ ID NO: 4887026 - DNA, 16 bp, Homo sapiens
actctgcctcctcttc

SEQ ID NO: 4887027 - DNA, 17 bp, Homo sapiens
actctgggctgctaccc

SEQ ID NO: 4887028 - DNA, 17 bp, Homo sapiens
actctggggtgctgcct

SEQ ID NO: 4887029 - DNA, 16 bp, Homo sapiens
actctgtaacatcact

SEQ ID NO: 4887030 - DNA, 19 bp, Homo sapiens
actctgtcgcccagtctgg

SEQ ID NO: 4887031 - DNA, 21 bp, Homo sapiens
actctgtgtcaggtggggcag

SEQ ID NO: 4887032 - DNA, 13 bp, Homo sapiens
actcttaaagcaa

SEQ ID NO: 4887033 - DNA, 20 bp, Homo sapiens
actcttaaagcaaaaaatga

SEQ ID NO: 4887034 - DNA, 19 bp, Homo sapiens
actcttattgcccacgctg

SEQ ID NO: 4887035 - DNA, 18 bp, Homo sapiens
actcttcaaaaactgttt

SEQ ID NO: 4887036 - DNA, 13 bp, Homo sapiens
actcttcactgtt

SEQ ID NO: 4887037 - DNA, 20 bp, Homo sapiens
actcttcgaagccttgccta

SEQ ID NO: 4887038 - DNA, 16 bp, Homo sapiens
actcttgattatccat

SEQ ID NO: 4887039 - DNA, 16 bp, Homo sapiens
actcttgttgagttct

SEQ ID NO: 4887040 - DNA, 16 bp, Homo sapiens
actctttctaatgctg

SEQ ID NO: 4887041 - DNA, 14 bp, Homo sapiens
actctttctgtata

SEQ ID NO: 4887042 - DNA, 22 bp, Homo sapiens
actctttctgtatatacttttt

SEQ ID NO: 4887043 - DNA, 12 bp, Homo sapiens
actgaagagaca

SEQ ID NO: 4887044 - DNA, 17 bp, Homo sapiens
actgacacaaaggaagt

SEQ ID NO: 4887045 - DNA, 13 bp, Homo sapiens
actgacacaggaa

SEQ ID NO: 4887046 - DNA, 20 bp, Homo sapiens
actgacacaggaaaccaaca

SEQ ID NO: 4887047 - DNA, 21 bp, Homo sapiens
actgacacaggaaaccaacac

SEQ ID NO: 4887048 - DNA, 20 bp, Homo sapiens
actgacagcatgtgccctcc

SEQ ID NO: 4887049 - DNA, 20 bp, Homo sapiens
actgaccagcctccatgctg

SEQ ID NO: 4887050 - DNA, 23 bp, Homo sapiens
actgaccagcctccatgctgcct

SEQ ID NO: 4887051 - DNA, 22 bp, Homo sapiens
actgaccatccactctaccctc

SEQ ID NO: 4887052 - DNA, 12 bp, Homo sapiens
actgacccttcc

SEQ ID NO: 4887053 - DNA, 19 bp, Homo sapiens
actgacccttccagacata

SEQ ID NO: 4887054 - DNA, 20 bp, Homo sapiens
actgacttgtttgtcttcca

SEQ ID NO: 4887055 - DNA, 17 bp, Homo sapiens
actgagattttggtatt

SEQ ID NO: 4887056 - DNA, 20 bp, Homo sapiens
actgagccccgcagacctcc

SEQ ID NO: 4887057 - DNA, 15 bp, Homo sapiens
actgaggaccagcca

SEQ ID NO: 4887058 - DNA, 17 bp, Homo sapiens
actgatagtgtccaaat

SEQ ID NO: 4887059 - DNA, 18 bp, Homo sapiens
actgatgctgagattctt

SEQ ID NO: 4887060 - DNA, 15 bp, Homo sapiens
actgatgcttagatg

SEQ ID NO: 4887061 - DNA, 18 bp, Homo sapiens
actgatgtacaattaaaa

SEQ ID NO: 4887062 - DNA, 20 bp, Homo sapiens
actgattctgggatgctcct

SEQ ID NO: 4887063 - DNA, 21 bp, Homo sapiens
actgattgttttagagactat

SEQ ID NO: 4887064 - DNA, 14 bp, Homo sapiens
actgatttttgtga

SEQ ID NO: 4887065 - DNA, 17 bp, Homo sapiens
actgcaataacttctga

SEQ ID NO: 4887066 - DNA, 17 bp, Homo sapiens
actgcaatcatatgtga

SEQ ID NO: 4887067 - DNA, 18 bp, Homo sapiens
actgcacagtgcatctca

SEQ ID NO: 4887068 - DNA, 23 bp, Homo sapiens
actgcacagtgcatctcagccca

SEQ ID NO: 4887069 - DNA, 14 bp, Homo sapiens
actgcaccgggcca

SEQ ID NO: 4887070 - DNA, 17 bp, Homo sapiens
actgcactccagcctgg

SEQ ID NO: 4887071 - DNA, 19 bp, Homo sapiens
actgcagcctcaacctcct

SEQ ID NO: 4887072 - DNA, 21 bp, Homo sapiens
actgcagcctcaacctcctgg

SEQ ID NO: 4887073 - DNA, 18 bp, Homo sapiens
actgcagggactgccagt

SEQ ID NO: 4887074 - DNA, 19 bp, Homo sapiens
actgcaggttggaccccag

SEQ ID NO: 4887075 - DNA, 20 bp, Homo sapiens
actgcaggttggaccccaga

SEQ ID NO: 4887076 - DNA, 21 bp, Homo sapiens
actgcaggttggaccccagag

SEQ ID NO: 4887077 - DNA, 20 bp, Homo sapiens
actgcattattctcttttat

SEQ ID NO: 4887078 - DNA, 17 bp, Homo sapiens
actgccactttgcacat

SEQ ID NO: 4887079 - DNA, 14 bp, Homo sapiens
actgccagcagcag

SEQ ID NO: 4887080 - DNA, 17 bp, Homo sapiens
actgccattattttctg

SEQ ID NO: 4887081 - DNA, 21 bp, Homo sapiens
actgccattattttctgtcag

SEQ ID NO: 4887082 - DNA, 22 bp, Homo sapiens
actgccccccatgaggaaggaa

SEQ ID NO: 4887083 - DNA, 10 bp, Homo sapiens
actgcctctg

SEQ ID NO: 4887084 - DNA, 12 bp, Homo sapiens
actgcctctgcc

SEQ ID NO: 4887085 - DNA, 18 bp, Homo sapiens
actgcctctgccttagag

SEQ ID NO: 4887086 - DNA, 15 bp, Homo sapiens
actgcctgtatactt

SEQ ID NO: 4887087 - DNA, 20 bp, Homo sapiens
actgcggaaaaggaaggaaa

SEQ ID NO: 4887088 - DNA, 20 bp, Homo sapiens
actgcgttctgcaagcatca

SEQ ID NO: 4887089 - DNA, 15 bp, Homo sapiens
actgctcaggctgca

SEQ ID NO: 4887090 - DNA, 21 bp, Homo sapiens
actgctcaggctgcagctgga

SEQ ID NO: 4887091 - DNA, 18 bp, Homo sapiens
actgctccccagccctgg

SEQ ID NO: 4887092 - DNA, 21 bp, Homo sapiens
actgctccctaagccagcctg

SEQ ID NO: 4887093 - DNA, 23 bp, Homo sapiens
actgctccctaagccagcctggt

SEQ ID NO: 4887094 - DNA, 22 bp, Homo sapiens
actgctccctgaagccagcctt

SEQ ID NO: 4887095 - DNA, 16 bp, Homo sapiens
actgctgcccagcctc

SEQ ID NO: 4887096 - DNA, 18 bp, Homo sapiens
actgctgcccagcctcca

SEQ ID NO: 4887097 - DNA, 21 bp, Homo sapiens
actgctgcccagcctccaagc

SEQ ID NO: 4887098 - DNA, 14 bp, Homo sapiens
actgctgctgcctg

SEQ ID NO: 4887099 - DNA, 19 bp, Homo sapiens
actgctgctgcctggccac

SEQ ID NO: 4887100 - DNA, 22 bp, Homo sapiens
actgctggacgtctttcttttt

SEQ ID NO: 4887101 - DNA, 12 bp, Homo sapiens
actgctggctgc

SEQ ID NO: 4887102 - DNA, 13 bp, Homo sapiens
actgctggctgcc

SEQ ID NO: 4887103 - DNA, 17 bp, Homo sapiens
actgcttacttatgcca

SEQ ID NO: 4887104 - DNA, 18 bp, Homo sapiens
actgcttgatgaagcaag

SEQ ID NO: 4887105 - DNA, 23 bp, Homo sapiens
actgcttgatgaagcaaggaaga

SEQ ID NO: 4887106 - DNA, 20 bp, Homo sapiens
actgcttttggtctgtgtga

SEQ ID NO: 4887107 - DNA, 15 bp, Homo sapiens
actggaagcacagct

SEQ ID NO: 4887108 - DNA, 16 bp, Homo sapiens
actggaagcacagctt

SEQ ID NO: 4887109 - DNA, 19 bp, Homo sapiens
actggaagttcatacctaa

SEQ ID NO: 4887110 - DNA, 20 bp, Homo sapiens
actggaagttcatacctaag

SEQ ID NO: 4887111 - DNA, 22 bp, Homo sapiens
actggaagttcatacctaagta

SEQ ID NO: 4887112 - DNA, 18 bp, Homo sapiens
actggacagtcactgcca

SEQ ID NO: 4887113 - DNA, 18 bp, Homo sapiens
actggacataacattttc

SEQ ID NO: 4887114 - DNA, 13 bp, Homo sapiens
actggagtctgga

SEQ ID NO: 4887115 - DNA, 15 bp, Homo sapiens
actggagtctggagt

SEQ ID NO: 4887116 - DNA, 15 bp, Homo sapiens
actggagttctatgc

SEQ ID NO: 4887117 - DNA, 20 bp, Homo sapiens
actggcactgaattaatcat

SEQ ID NO: 4887118 - DNA, 12 bp, Homo sapiens
actggcccctgg

SEQ ID NO: 4887119 - DNA, 13 bp, Homo sapiens
actggcccctggg

SEQ ID NO: 4887120 - DNA, 13 bp, Homo sapiens
actggcctgactt

SEQ ID NO: 4887121 - DNA, 18 bp, Homo sapiens
actggcctgacttggggg

SEQ ID NO: 4887122 - DNA, 13 bp, Homo sapiens
actgggcaatgat

SEQ ID NO: 4887123 - DNA, 19 bp, Homo sapiens
actggggaaaactccacct

SEQ ID NO: 4887124 - DNA, 16 bp, Homo sapiens
actggggatgtgggag

SEQ ID NO: 4887125 - DNA, 18 bp, Homo sapiens
actggggatgtgggaggg

SEQ ID NO: 4887126 - DNA, 12 bp, Homo sapiens
actggggcctcc

SEQ ID NO: 4887127 - DNA, 15 bp, Homo sapiens
actgggtacttgtgg

SEQ ID NO: 4887128 - DNA, 19 bp, Homo sapiens
actgggtacttgtggacac

SEQ ID NO: 4887129 - DNA, 21 bp, Homo sapiens
actggtggcccgacagcctgg

SEQ ID NO: 4887130 - DNA, 23 bp, Homo sapiens
actggtggcccgacagcctggca

SEQ ID NO: 4887131 - DNA, 18 bp, Homo sapiens
actgtaaataaaaagaaa

SEQ ID NO: 4887132 - DNA, 19 bp, Homo sapiens
actgtaataatacctcaat

SEQ ID NO: 4887133 - DNA, 19 bp, Homo sapiens
actgtaatcttatttagga

SEQ ID NO: 4887134 - DNA, 18 bp, Homo sapiens
actgtagaatgatttcat

SEQ ID NO: 4887135 - DNA, 13 bp, Homo sapiens
actgtagatgatg

SEQ ID NO: 4887136 - DNA, 15 bp, Homo sapiens
actgtagttctaaga

SEQ ID NO: 4887137 - DNA, 16 bp, Homo sapiens
actgtagttctaagac

SEQ ID NO: 4887138 - DNA, 15 bp, Homo sapiens
actgtataaatagga

SEQ ID NO: 4887139 - DNA, 20 bp, Homo sapiens
actgtataaataggagagga

SEQ ID NO: 4887140 - DNA, 16 bp, Homo sapiens
actgtatagacagttt

SEQ ID NO: 4887141 - DNA, 13 bp, Homo sapiens
actgtatctgtgt

SEQ ID NO: 4887142 - DNA, 14 bp, Homo sapiens
actgtatttgtatc

SEQ ID NO: 4887143 - DNA, 13 bp, Homo sapiens
actgtcatagaaa

SEQ ID NO: 4887144 - DNA, 13 bp, Homo sapiens
actgtccagagag

SEQ ID NO: 4887145 - DNA, 17 bp, Homo sapiens
actgtcctacccaccct

SEQ ID NO: 4887146 - DNA, 23 bp, Homo sapiens
actgtcctacccaccctcctttc

SEQ ID NO: 4887147 - DNA, 20 bp, Homo sapiens
actgtcctctcccctccagc

SEQ ID NO: 4887148 - DNA, 21 bp, Homo sapiens
actgtctcaagagggcactgg

SEQ ID NO: 4887149 - DNA, 17 bp, Homo sapiens
actgtctggttttaaca

SEQ ID NO: 4887150 - DNA, 19 bp, Homo sapiens
actgtctttaaaagagaga

SEQ ID NO: 4887151 - DNA, 21 bp, Homo sapiens
actgtctttggaaaaatgttt

SEQ ID NO: 4887152 - DNA, 23 bp, Homo sapiens
actgtctttggaaaaatgtttgt

SEQ ID NO: 4887153 - DNA, 22 bp, Homo sapiens
actgtgaagtttacattgtaaa

SEQ ID NO: 4887154 - DNA, 23 bp, Homo sapiens
actgtgacaactgtctaacttta

SEQ ID NO: 4887155 - DNA, 20 bp, Homo sapiens
actgtgcaggtgctattgtt

SEQ ID NO: 4887156 - DNA, 23 bp, Homo sapiens
actgtgcaggtgctattgttact

SEQ ID NO: 4887157 - DNA, 17 bp, Homo sapiens
actgtgcatagtgctgg

SEQ ID NO: 4887158 - DNA, 18 bp, Homo sapiens
actgtgccatgtgccagg

SEQ ID NO: 4887159 - DNA, 22 bp, Homo sapiens
actgtgcctttgcaaatcagtg

SEQ ID NO: 4887160 - DNA, 23 bp, Homo sapiens
actgtggaggaaggattgtaaaa

SEQ ID NO: 4887161 - DNA, 22 bp, Homo sapiens
actgtggcacttgcctgggtca

SEQ ID NO: 4887162 - DNA, 20 bp, Homo sapiens
actgtggccgttatctggaa

SEQ ID NO: 4887163 - DNA, 23 bp, Homo sapiens
actgtgtacataatgcttaattt

SEQ ID NO: 4887164 - DNA, 14 bp, Homo sapiens
actgtgttgtatta

SEQ ID NO: 4887165 - DNA, 20 bp, Homo sapiens
actgtgttgtattaacaaaa

SEQ ID NO: 4887166 - DNA, 18 bp, Homo sapiens
actgtgttttataaaata

SEQ ID NO: 4887167 - DNA, 21 bp, Homo sapiens
actgttagcactgttgatgta

SEQ ID NO: 4887168 - DNA, 23 bp, Homo sapiens
actgttcaatggttctgaaataa

SEQ ID NO: 4887169 - DNA, 17 bp, Homo sapiens
actgttcagctgtcctc

SEQ ID NO: 4887170 - DNA, 22 bp, Homo sapiens
actgttcagctgtcctccctcc

SEQ ID NO: 4887171 - DNA, 15 bp, Homo sapiens
actgttctgtgtctt

SEQ ID NO: 4887172 - DNA, 17 bp, Homo sapiens
actgttctgtgtctttc

SEQ ID NO: 4887173 - DNA, 18 bp, Homo sapiens
actgttcttcattttatt

SEQ ID NO: 4887174 - DNA, 10 bp, Homo sapiens
actgttcttg

SEQ ID NO: 4887175 - DNA, 13 bp, Homo sapiens
actgttcttgctg

SEQ ID NO: 4887176 - DNA, 15 bp, Homo sapiens
actgttcttgctgct

SEQ ID NO: 4887177 - DNA, 20 bp, Homo sapiens
actgttcttgctgctagaac

SEQ ID NO: 4887178 - DNA, 21 bp, Homo sapiens
actgttcttgctgctagaact

SEQ ID NO: 4887179 - DNA, 21 bp, Homo sapiens
actgttgaaaattattttaaa

SEQ ID NO: 4887180 - DNA, 23 bp, Homo sapiens
actgttgaaaattattttaaaca

SEQ ID NO: 4887181 - DNA, 17 bp, Homo sapiens
actgttgatgtatctga

SEQ ID NO: 4887182 - DNA, 19 bp, Homo sapiens
actgtttatttctgtttct

SEQ ID NO: 4887183 - DNA, 18 bp, Homo sapiens
actgtttctcttgagctg

SEQ ID NO: 4887184 - DNA, 19 bp, Homo sapiens
actgtttctcttgagctgg

SEQ ID NO: 4887185 - DNA, 13 bp, Homo sapiens
actgtttcttgct

SEQ ID NO: 4887186 - DNA, 16 bp, Homo sapiens
actgtttcttgcttgt

SEQ ID NO: 4887187 - DNA, 20 bp, Homo sapiens
actgtttcttgcttgtacct

SEQ ID NO: 4887188 - DNA, 22 bp, Homo sapiens
actgttttctctcggctcccca

SEQ ID NO: 4887189 - DNA, 14 bp, Homo sapiens
acttaaaaatgtaa

SEQ ID NO: 4887190 - DNA, 17 bp, Homo sapiens
acttaaaaatgtaaata

SEQ ID NO: 4887191 - DNA, 18 bp, Homo sapiens
acttaaaaatgtaaatat

SEQ ID NO: 4887192 - DNA, 23 bp, Homo sapiens
acttaaaaatgtaaatattctat

SEQ ID NO: 4887193 - DNA, 22 bp, Homo sapiens
acttaaaataggggatatttaa

SEQ ID NO: 4887194 - DNA, 19 bp, Homo sapiens
acttaactttaactgaaca

SEQ ID NO: 4887195 - DNA, 14 bp, Homo sapiens
acttaagcaaaaga

SEQ ID NO: 4887196 - DNA, 16 bp, Homo sapiens
acttaagcaaaagaaa

SEQ ID NO: 4887197 - DNA, 20 bp, Homo sapiens
acttaagcaaaagaaaaaga

SEQ ID NO: 4887198 - DNA, 22 bp, Homo sapiens
acttacagagcgtggctgtgct

SEQ ID NO: 4887199 - DNA, 17 bp, Homo sapiens
acttacagctctggcca

SEQ ID NO: 4887200 - DNA, 19 bp, Homo sapiens
acttacatatatttttaaa

SEQ ID NO: 4887201 - DNA, 14 bp, Homo sapiens
acttaccatttgct

SEQ ID NO: 4887202 - DNA, 17 bp, Homo sapiens
acttactaaaatatata

SEQ ID NO: 4887203 - DNA, 22 bp, Homo sapiens
acttagaaggattgaacttctt

SEQ ID NO: 4887204 - DNA, 17 bp, Homo sapiens
acttagagtttctgttt

SEQ ID NO: 4887205 - DNA, 18 bp, Homo sapiens
acttagagtttctgtttg

SEQ ID NO: 4887206 - DNA, 20 bp, Homo sapiens
acttagagtttctgtttgat

SEQ ID NO: 4887207 - DNA, 18 bp, Homo sapiens
acttagcatcctaagaaa

SEQ ID NO: 4887208 - DNA, 19 bp, Homo sapiens
acttagcatcctaagaaat

SEQ ID NO: 4887209 - DNA, 21 bp, Homo sapiens
acttagcatcctaagaaatat

SEQ ID NO: 4887210 - DNA, 18 bp, Homo sapiens
acttaggccctagcggca

SEQ ID NO: 4887211 - DNA, 18 bp, Homo sapiens
acttagtgacaaaataga

SEQ ID NO: 4887212 - DNA, 11 bp, Homo sapiens
acttatacctg

SEQ ID NO: 4887213 - DNA, 15 bp, Homo sapiens
acttatagtacatga

SEQ ID NO: 4887214 - DNA, 15 bp, Homo sapiens
acttatatttcccta

SEQ ID NO: 4887215 - DNA, 21 bp, Homo sapiens
acttatattttcgtatgaaaa

SEQ ID NO: 4887216 - DNA, 13 bp, Homo sapiens
acttattacaatt

SEQ ID NO: 4887217 - DNA, 20 bp, Homo sapiens
acttattgctgattttaatg

SEQ ID NO: 4887218 - DNA, 21 bp, Homo sapiens
acttattgctgattttaatgg

SEQ ID NO: 4887219 - DNA, 13 bp, Homo sapiens
acttatttaatgc

SEQ ID NO: 4887220 - DNA, 19 bp, Homo sapiens
acttatttttgacagtgtt

SEQ ID NO: 4887221 - DNA, 19 bp, Homo sapiens
acttcaatgggctcttcca

SEQ ID NO: 4887222 - DNA, 15 bp, Homo sapiens
acttcactgaaagac

SEQ ID NO: 4887223 - DNA, 15 bp, Homo sapiens
acttcagaattccat

SEQ ID NO: 4887224 - DNA, 13 bp, Homo sapiens
acttcagctctgt

SEQ ID NO: 4887225 - DNA, 17 bp, Homo sapiens
acttcaggctcttctcc

SEQ ID NO: 4887226 - DNA, 18 bp, Homo sapiens
acttcaggctcttctcct

SEQ ID NO: 4887227 - DNA, 19 bp, Homo sapiens
acttcagtcctgctccaga

SEQ ID NO: 4887228 - DNA, 20 bp, Homo sapiens
acttcatttaaaaaaatcac

SEQ ID NO: 4887229 - DNA, 16 bp, Homo sapiens
acttccaaaattctta

SEQ ID NO: 4887230 - DNA, 19 bp, Homo sapiens
acttccaaaattcttattt

SEQ ID NO: 4887231 - DNA, 21 bp, Homo sapiens
acttccacctcgggcacattt

SEQ ID NO: 4887232 - DNA, 20 bp, Homo sapiens
acttccaggggaacctgcca

SEQ ID NO: 4887233 - DNA, 21 bp, Homo sapiens
acttccaggtgttactgtaat

SEQ ID NO: 4887234 - DNA, 21 bp, Homo sapiens
acttccctgattgacctgctc

SEQ ID NO: 4887235 - DNA, 22 bp, Homo sapiens
acttccctgattgacctgctcc

SEQ ID NO: 4887236 - DNA, 17 bp, Homo sapiens
acttcctcctccccact

SEQ ID NO: 4887237 - DNA, 17 bp, Homo sapiens
acttcctcgcctctccc

SEQ ID NO: 4887238 - DNA, 18 bp, Homo sapiens
acttcctcgcctctccca

SEQ ID NO: 4887239 - DNA, 22 bp, Homo sapiens
acttccttgagacacggagccc

SEQ ID NO: 4887240 - DNA, 15 bp, Homo sapiens
acttctaatatattt

SEQ ID NO: 4887241 - DNA, 22 bp, Homo sapiens
acttctaatatatttttatatt

SEQ ID NO: 4887242 - DNA, 14 bp, Homo sapiens
acttctccaccctg

SEQ ID NO: 4887243 - DNA, 18 bp, Homo sapiens
acttctccaccctgctct

SEQ ID NO: 4887244 - DNA, 16 bp, Homo sapiens
acttctccaggtctca

SEQ ID NO: 4887245 - DNA, 21 bp, Homo sapiens
acttctcttaaacttgtgaat

SEQ ID NO: 4887246 - DNA, 17 bp, Homo sapiens
acttctcttgctttcta

SEQ ID NO: 4887247 - DNA, 18 bp, Homo sapiens
acttctgccatattctgt

SEQ ID NO: 4887248 - DNA, 14 bp, Homo sapiens
acttctgctggcat

SEQ ID NO: 4887249 - DNA, 18 bp, Homo sapiens
acttcttaaatatctttt

SEQ ID NO: 4887250 - DNA, 17 bp, Homo sapiens
acttcttatggaattga

SEQ ID NO: 4887251 - DNA, 20 bp, Homo sapiens
acttcttatggaattgattt

SEQ ID NO: 4887252 - DNA, 21 bp, Homo sapiens
acttcttatggaattgatttg

SEQ ID NO: 4887253 - DNA, 17 bp, Homo sapiens
acttcttcctttctctt

SEQ ID NO: 4887254 - DNA, 14 bp, Homo sapiens
acttcttctccatc

SEQ ID NO: 4887255 - DNA, 12 bp, Homo sapiens
acttcttgtcag

SEQ ID NO: 4887256 - DNA, 16 bp, Homo sapiens
acttcttgtcagacat

SEQ ID NO: 4887257 - DNA, 19 bp, Homo sapiens
acttcttttgctcttagct

SEQ ID NO: 4887258 - DNA, 16 bp, Homo sapiens
acttgaaattatatct

SEQ ID NO: 4887259 - DNA, 15 bp, Homo sapiens
acttgaacaaaaggg

SEQ ID NO: 4887260 - DNA, 19 bp, Homo sapiens
acttgacccccttgagggt

SEQ ID NO: 4887261 - DNA, 18 bp, Homo sapiens
acttgactccatttcatc

SEQ ID NO: 4887262 - DNA, 21 bp, Homo sapiens
acttgagaactttccattttg

SEQ ID NO: 4887263 - DNA, 21 bp, Homo sapiens
acttgagcgtgaatctgtatc

SEQ ID NO: 4887264 - DNA, 16 bp, Homo sapiens
acttgagtgtaatgtt

SEQ ID NO: 4887265 - DNA, 20 bp, Homo sapiens
acttgatagcaaacactggg

SEQ ID NO: 4887266 - DNA, 13 bp, Homo sapiens
acttgatgcatgt

SEQ ID NO: 4887267 - DNA, 16 bp, Homo sapiens
acttgattaagatttt

SEQ ID NO: 4887268 - DNA, 21 bp, Homo sapiens
acttgattaagattttacaaa

SEQ ID NO: 4887269 - DNA, 23 bp, Homo sapiens
acttgattaagattttacaaaag

SEQ ID NO: 4887270 - DNA, 22 bp, Homo sapiens
acttgcagactctacagaggcc

SEQ ID NO: 4887271 - DNA, 14 bp, Homo sapiens
acttgcatgaagag

SEQ ID NO: 4887272 - DNA, 13 bp, Homo sapiens
acttgcctgggtc

SEQ ID NO: 4887273 - DNA, 22 bp, Homo sapiens
acttgctttatgccttcttatt

SEQ ID NO: 4887274 - DNA, 13 bp, Homo sapiens
acttggctttcat

SEQ ID NO: 4887275 - DNA, 12 bp, Homo sapiens
acttggtttgtg

SEQ ID NO: 4887276 - DNA, 17 bp, Homo sapiens
acttgtagctgtaaaac

SEQ ID NO: 4887277 - DNA, 14 bp, Homo sapiens
acttgtaggataag

SEQ ID NO: 4887278 - DNA, 15 bp, Homo sapiens
acttgtataaatgta

SEQ ID NO: 4887279 - DNA, 20 bp, Homo sapiens
acttgtataaatgtatatac

SEQ ID NO: 4887280 - DNA, 14 bp, Homo sapiens
acttgtatgaaaga

SEQ ID NO: 4887281 - DNA, 20 bp, Homo sapiens
acttgtcactgacacaaagg

SEQ ID NO: 4887282 - DNA, 16 bp, Homo sapiens
acttgtctcattttaa

SEQ ID NO: 4887283 - DNA, 17 bp, Homo sapiens
acttgtctcattttaat

SEQ ID NO: 4887284 - DNA, 20 bp, Homo sapiens
acttgtctcattttaatgta

SEQ ID NO: 4887285 - DNA, 18 bp, Homo sapiens
acttgtgaatgcttctca

SEQ ID NO: 4887286 - DNA, 20 bp, Homo sapiens
acttgtgattatttattatt

SEQ ID NO: 4887287 - DNA, 15 bp, Homo sapiens
acttgtgctttgctc

SEQ ID NO: 4887288 - DNA, 14 bp, Homo sapiens
acttgtggacacag

SEQ ID NO: 4887289 - DNA, 18 bp, Homo sapiens
acttgtggacacagctct

SEQ ID NO: 4887290 - DNA, 16 bp, Homo sapiens
acttgtgtctctgtgc

SEQ ID NO: 4887291 - DNA, 22 bp, Homo sapiens
acttgtgtctctgtgcttttaa

SEQ ID NO: 4887292 - DNA, 13 bp, Homo sapiens
acttgttattgtg

SEQ ID NO: 4887293 - DNA, 17 bp, Homo sapiens
acttgttccagctcttt

SEQ ID NO: 4887294 - DNA, 19 bp, Homo sapiens
acttgtttctctgttgtaa

SEQ ID NO: 4887295 - DNA, 17 bp, Homo sapiens
acttgttttatgctcag

SEQ ID NO: 4887296 - DNA, 12 bp, Homo sapiens
actttaagagag

SEQ ID NO: 4887297 - DNA, 16 bp, Homo sapiens
actttaagagagaaat

SEQ ID NO: 4887298 - DNA, 19 bp, Homo sapiens
actttagaagtgcatttct

SEQ ID NO: 4887299 - DNA, 22 bp, Homo sapiens
actttagggtaaaaattgccat

SEQ ID NO: 4887300 - DNA, 23 bp, Homo sapiens
actttagtatgacgctgatacat

SEQ ID NO: 4887301 - DNA, 19 bp, Homo sapiens
actttatacattagtaaat

SEQ ID NO: 4887302 - DNA, 22 bp, Homo sapiens
actttatacattagtaaatgtc

SEQ ID NO: 4887303 - DNA, 16 bp, Homo sapiens
actttatgtgtaaata

SEQ ID NO: 4887304 - DNA, 21 bp, Homo sapiens
actttcaaatcggtcccctgt

SEQ ID NO: 4887305 - DNA, 22 bp, Homo sapiens
actttccacttcttcctttctc

SEQ ID NO: 4887306 - DNA, 13 bp, Homo sapiens
actttcccttgct

SEQ ID NO: 4887307 - DNA, 14 bp, Homo sapiens
actttcccttgctt

SEQ ID NO: 4887308 - DNA, 17 bp, Homo sapiens
actttcccttgcttttc

SEQ ID NO: 4887309 - DNA, 19 bp, Homo sapiens
actttcctcctgaggcttt

SEQ ID NO: 4887310 - DNA, 15 bp, Homo sapiens
actttcgtacattgg

SEQ ID NO: 4887311 - DNA, 17 bp, Homo sapiens
actttgaaatacctcat

SEQ ID NO: 4887312 - DNA, 20 bp, Homo sapiens
actttgaaatacctcatgtt

SEQ ID NO: 4887313 - DNA, 21 bp, Homo sapiens
actttgaaatacctcatgttt

SEQ ID NO: 4887314 - DNA, 14 bp, Homo sapiens
actttgatgtcatg

SEQ ID NO: 4887315 - DNA, 21 bp, Homo sapiens
actttgatgtcatgtgttccc

SEQ ID NO: 4887316 - DNA, 15 bp, Homo sapiens
actttgcacattttg

SEQ ID NO: 4887317 - DNA, 23 bp, Homo sapiens
actttgcctcctgtgtactgtgt

SEQ ID NO: 4887318 - DNA, 20 bp, Homo sapiens
actttgctgatttcccctct

SEQ ID NO: 4887319 - DNA, 18 bp, Homo sapiens
actttggagtcccctcac

SEQ ID NO: 4887320 - DNA, 17 bp, Homo sapiens
actttgtggaccaatta

SEQ ID NO: 4887321 - DNA, 12 bp, Homo sapiens
acttttaaacag

SEQ ID NO: 4887322 - DNA, 15 bp, Homo sapiens
acttttaaacagtga

SEQ ID NO: 4887323 - DNA, 20 bp, Homo sapiens
acttttatgagcttccaagg

SEQ ID NO: 4887324 - DNA, 14 bp, Homo sapiens
acttttatttgcaa

SEQ ID NO: 4887325 - DNA, 17 bp, Homo sapiens
acttttccattcccaat

SEQ ID NO: 4887326 - DNA, 12 bp, Homo sapiens
acttttgagtgt

SEQ ID NO: 4887327 - DNA, 16 bp, Homo sapiens
acttttgagtgtgtgt

SEQ ID NO: 4887328 - DNA, 17 bp, Homo sapiens
acttttgtaaagaaatt

SEQ ID NO: 4887329 - DNA, 18 bp, Homo sapiens
acttttgtgtaatgaaaa

SEQ ID NO: 4887330 - DNA, 14 bp, Homo sapiens
actttttcttttgt

SEQ ID NO: 4887331 - DNA, 18 bp, Homo sapiens
actttttcttttgtaagt

SEQ ID NO: 4887332 - DNA, 21 bp, Homo sapiens
actttttgaactaagaaactt

SEQ ID NO: 4887333 - DNA, 21 bp, Homo sapiens
acttttttctagtacactttt

SEQ ID NO: 4887334 - DNA, 18 bp, Homo sapiens
actttttttcttctactt

SEQ ID NO: 4887335 - DNA, 14 bp, Homo sapiens
agaaaaaaaaaaga

SEQ ID NO: 4887336 - DNA, 15 bp, Homo sapiens
agaaaaaaaaaagaa

SEQ ID NO: 4887337 - DNA, 16 bp, Homo sapiens
agaaaaaaaaaagaag

SEQ ID NO: 4887338 - DNA, 18 bp, Homo sapiens
agaaaaaaaaaagaagaa

SEQ ID NO: 4887339 - DNA, 17 bp, Homo sapiens
agaaaaaaatcttctcc

SEQ ID NO: 4887340 - DNA, 21 bp, Homo sapiens
agaaaaaaatcttctccagat

SEQ ID NO: 4887341 - DNA, 19 bp, Homo sapiens
agaaaaaaattactaattt

SEQ ID NO: 4887342 - DNA, 17 bp, Homo sapiens
agaaaaatatatactaa

SEQ ID NO: 4887343 - DNA, 20 bp, Homo sapiens
agaaaaattcagcaaaccat

SEQ ID NO: 4887344 - DNA, 13 bp, Homo sapiens
agaaaacaaaatt

SEQ ID NO: 4887345 - DNA, 22 bp, Homo sapiens
agaaaacaagcaagttctgaga

SEQ ID NO: 4887346 - DNA, 15 bp, Homo sapiens
agaaaactgaaaatc

SEQ ID NO: 4887347 - DNA, 16 bp, Homo sapiens
agaaaactgaaaatct

SEQ ID NO: 4887348 - DNA, 13 bp, Homo sapiens
agaaaagagaaga

SEQ ID NO: 4887349 - DNA, 12 bp, Homo sapiens
agaaaagcacac

SEQ ID NO: 4887350 - DNA, 23 bp, Homo sapiens
agaaaagggaagttgtgcctttt

SEQ ID NO: 4887351 - DNA, 14 bp, Homo sapiens
agaaaagtagacaa

SEQ ID NO: 4887352 - DNA, 17 bp, Homo sapiens
agaaaagtattttgaag

SEQ ID NO: 4887353 - DNA, 18 bp, Homo sapiens
agaaaagtattttgaagt

SEQ ID NO: 4887354 - DNA, 23 bp, Homo sapiens
agaaaagtattttgaagtttaca

SEQ ID NO: 4887355 - DNA, 16 bp, Homo sapiens
agaaaatgaaaaacaa

SEQ ID NO: 4887356 - DNA, 20 bp, Homo sapiens
agaaaatggtttattttgta

SEQ ID NO: 4887357 - DNA, 16 bp, Homo sapiens
agaaaatgttgagaat

SEQ ID NO: 4887358 - DNA, 18 bp, Homo sapiens
agaaaattaaacacaaag

SEQ ID NO: 4887359 - DNA, 16 bp, Homo sapiens
agaaaatttttgtagt

SEQ ID NO: 4887360 - DNA, 13 bp, Homo sapiens
agaaacaaacttt

SEQ ID NO: 4887361 - DNA, 22 bp, Homo sapiens
agaaacaaacttttcaaggctt

SEQ ID NO: 4887362 - DNA, 15 bp, Homo sapiens
agaaacactgccttt

SEQ ID NO: 4887363 - DNA, 21 bp, Homo sapiens
agaaacagataccatactcat

SEQ ID NO: 4887364 - DNA, 11 bp, Homo sapiens
agaaacagctt

SEQ ID NO: 4887365 - DNA, 15 bp, Homo sapiens
agaaacagctttcaa

SEQ ID NO: 4887366 - DNA, 19 bp, Homo sapiens
agaaacagctttcaagtgc

SEQ ID NO: 4887367 - DNA, 15 bp, Homo sapiens
agaaacccaagctcc

SEQ ID NO: 4887368 - DNA, 19 bp, Homo sapiens
agaaacccaagctcctcct

SEQ ID NO: 4887369 - DNA, 17 bp, Homo sapiens
agaaaccttaatatgtg

SEQ ID NO: 4887370 - DNA, 18 bp, Homo sapiens
agaaacctttttaaaaat

SEQ ID NO: 4887371 - DNA, 15 bp, Homo sapiens
agaaacgtcttctaa

SEQ ID NO: 4887372 - DNA, 16 bp, Homo sapiens
agaaacgtcttctaaa

SEQ ID NO: 4887373 - DNA, 23 bp, Homo sapiens
agaaacttttatctattctgaga

SEQ ID NO: 4887374 - DNA, 18 bp, Homo sapiens
agaaagaaggaagtgaag

SEQ ID NO: 4887375 - DNA, 20 bp, Homo sapiens
agaaagcaggggctacaaga

SEQ ID NO: 4887376 - DNA, 19 bp, Homo sapiens
agaaagctggtaaactatt

SEQ ID NO: 4887377 - DNA, 16 bp, Homo sapiens
agaaaggaaaacctga

SEQ ID NO: 4887378 - DNA, 17 bp, Homo sapiens
agaaaggcctgcacaca

SEQ ID NO: 4887379 - DNA, 20 bp, Homo sapiens
agaaagtcattccttctttt

SEQ ID NO: 4887380 - DNA, 22 bp, Homo sapiens
agaaagtgggaggtcaggaaac

SEQ ID NO: 4887381 - DNA, 20 bp, Homo sapiens
agaaagtgggtgagatgctg

SEQ ID NO: 4887382 - DNA, 23 bp, Homo sapiens
agaaataaaagtgaatgaaagat

SEQ ID NO: 4887383 - DNA, 16 bp, Homo sapiens
agaaataatatgcatt

SEQ ID NO: 4887384 - DNA, 13 bp, Homo sapiens
agaaatatatata

SEQ ID NO: 4887385 - DNA, 15 bp, Homo sapiens
agaaatatatataca

SEQ ID NO: 4887386 - DNA, 14 bp, Homo sapiens
agaaatatgtgaga

SEQ ID NO: 4887387 - DNA, 18 bp, Homo sapiens
agaaatattccaaatgtc

SEQ ID NO: 4887388 - DNA, 13 bp, Homo sapiens
agaaatctgaaaa

SEQ ID NO: 4887389 - DNA, 16 bp, Homo sapiens
agaaatggggaattct

SEQ ID NO: 4887390 - DNA, 21 bp, Homo sapiens
agaaatggggaattctctaat

SEQ ID NO: 4887391 - DNA, 16 bp, Homo sapiens
agaaatgtaaactgcc

SEQ ID NO: 4887392 - DNA, 18 bp, Homo sapiens
agaaatgtaaactgccat

SEQ ID NO: 4887393 - DNA, 18 bp, Homo sapiens
agaaattctgttaaaatc

SEQ ID NO: 4887394 - DNA, 20 bp, Homo sapiens
agaaattctgttaaaatcta

SEQ ID NO: 4887395 - DNA, 21 bp, Homo sapiens
agaaattctgttaaaatctat

SEQ ID NO: 4887396 - DNA, 22 bp, Homo sapiens
agaaattctgttaaaatctatt

SEQ ID NO: 4887397 - DNA, 17 bp, Homo sapiens
agaaatttactatatat

SEQ ID NO: 4887398 - DNA, 15 bp, Homo sapiens
agaaatttgatttct

SEQ ID NO: 4887399 - DNA, 20 bp, Homo sapiens
agaaatttgatttctattca

SEQ ID NO: 4887400 - DNA, 15 bp, Homo sapiens
agaaatttttatcag

SEQ ID NO: 4887401 - DNA, 16 bp, Homo sapiens
agaaatttttatcagt

SEQ ID NO: 4887402 - DNA, 17 bp, Homo sapiens
agaacaaagctgttaaa

SEQ ID NO: 4887403 - DNA, 18 bp, Homo sapiens
agaacaaagctgttaaac

SEQ ID NO: 4887404 - DNA, 19 bp, Homo sapiens
agaacaaagctgttaaact

SEQ ID NO: 4887405 - DNA, 14 bp, Homo sapiens
agaacaaaggacag

SEQ ID NO: 4887406 - DNA, 22 bp, Homo sapiens
agaacaaaggacagagtatgaa

SEQ ID NO: 4887407 - DNA, 18 bp, Homo sapiens
agaacaaatattcagaat

SEQ ID NO: 4887408 - DNA, 12 bp, Homo sapiens
agaacagcttca

SEQ ID NO: 4887409 - DNA, 21 bp, Homo sapiens
agaacagggtcatgtttgcag

SEQ ID NO: 4887410 - DNA, 18 bp, Homo sapiens
agaacatcattagaacaa

SEQ ID NO: 4887411 - DNA, 13 bp, Homo sapiens
agaacatgtgaga

SEQ ID NO: 4887412 - DNA, 18 bp, Homo sapiens
agaaccaaaagttttcct

SEQ ID NO: 4887413 - DNA, 13 bp, Homo sapiens
agaacccagggct

SEQ ID NO: 4887414 - DNA, 14 bp, Homo sapiens
agaacccagggctc

SEQ ID NO: 4887415 - DNA, 21 bp, Homo sapiens
agaaccgagcaaagatcaaaa

SEQ ID NO: 4887416 - DNA, 15 bp, Homo sapiens
agaacctcttcccca

SEQ ID NO: 4887417 - DNA, 13 bp, Homo sapiens
agaacgcagccct

SEQ ID NO: 4887418 - DNA, 23 bp, Homo sapiens
agaacgcagccctagagcctgcc

SEQ ID NO: 4887419 - DNA, 11 bp, Homo sapiens
agaactaaatg

SEQ ID NO: 4887420 - DNA, 12 bp, Homo sapiens
agaactaaatgt

SEQ ID NO: 4887421 - DNA, 13 bp, Homo sapiens
agaactaaatgtt

SEQ ID NO: 4887422 - DNA, 16 bp, Homo sapiens
agaactatatgtgaat

SEQ ID NO: 4887423 - DNA, 16 bp, Homo sapiens
agaactcactggggcc

SEQ ID NO: 4887424 - DNA, 14 bp, Homo sapiens
agaactcctgactg

SEQ ID NO: 4887425 - DNA, 18 bp, Homo sapiens
agaactgggtaaatgcaa

SEQ ID NO: 4887426 - DNA, 20 bp, Homo sapiens
agaactgggtaaatgcaaag

SEQ ID NO: 4887427 - DNA, 21 bp, Homo sapiens
agaacttccctgattgacctg

SEQ ID NO: 4887428 - DNA, 23 bp, Homo sapiens
agaacttccctgattgacctgct

SEQ ID NO: 4887429 - DNA, 10 bp, Homo sapiens
agaacttttt

SEQ ID NO: 4887430 - DNA, 13 bp, Homo sapiens
agaacttttttaa

SEQ ID NO: 4887431 - DNA, 14 bp, Homo sapiens
agaacttttttaaa

SEQ ID NO: 4887432 - DNA, 15 bp, Homo sapiens
agaacttttttaaat

SEQ ID NO: 4887433 - DNA, 19 bp, Homo sapiens
agaacttttttaaataaac

SEQ ID NO: 4887434 - DNA, 11 bp, Homo sapiens
agaagaaaaaa

SEQ ID NO: 4887435 - DNA, 14 bp, Homo sapiens
agaagaaaaaaacg

SEQ ID NO: 4887436 - DNA, 12 bp, Homo sapiens
agaagaaaagag

SEQ ID NO: 4887437 - DNA, 14 bp, Homo sapiens
agaagaaatgaata

SEQ ID NO: 4887438 - DNA, 16 bp, Homo sapiens
agaagaagagaagctg

SEQ ID NO: 4887439 - DNA, 18 bp, Homo sapiens
agaagaagagaagctgct

SEQ ID NO: 4887440 - DNA, 15 bp, Homo sapiens
agaagacaaaaagac

SEQ ID NO: 4887441 - DNA, 14 bp, Homo sapiens
agaagacaccagag

SEQ ID NO: 4887442 - DNA, 17 bp, Homo sapiens
agaagacaccagagcag

SEQ ID NO: 4887443 - DNA, 23 bp, Homo sapiens
agaagacaccagagcagatgcag

SEQ ID NO: 4887444 - DNA, 21 bp, Homo sapiens
agaagaccacaaaaattgact

SEQ ID NO: 4887445 - DNA, 13 bp, Homo sapiens
agaagagaagctg

SEQ ID NO: 4887446 - DNA, 15 bp, Homo sapiens
agaagagaagctgct

SEQ ID NO: 4887447 - DNA, 16 bp, Homo sapiens
agaagagaggagagga

SEQ ID NO: 4887448 - DNA, 20 bp, Homo sapiens
agaagagaggagaggagaga

SEQ ID NO: 4887449 - DNA, 22 bp, Homo sapiens
agaagagaggagaggagagagg

SEQ ID NO: 4887450 - DNA, 14 bp, Homo sapiens
agaagatcccctca

SEQ ID NO: 4887451 - DNA, 23 bp, Homo sapiens
agaagatgctccagcaacacagc

SEQ ID NO: 4887452 - DNA, 23 bp, Homo sapiens
agaagatgttgaagaatacagtt

SEQ ID NO: 4887453 - DNA, 16 bp, Homo sapiens
agaagcatttgtattt

SEQ ID NO: 4887454 - DNA, 14 bp, Homo sapiens
agaagccgggaaca

SEQ ID NO: 4887455 - DNA, 13 bp, Homo sapiens
agaagccttcagc

SEQ ID NO: 4887456 - DNA, 14 bp, Homo sapiens
agaagccttcagct

SEQ ID NO: 4887457 - DNA, 17 bp, Homo sapiens
agaagccttcagctcca

SEQ ID NO: 4887458 - DNA, 18 bp, Homo sapiens
agaagccttcagctccag

SEQ ID NO: 4887459 - DNA, 19 bp, Homo sapiens
agaagctgcatccagaggc

SEQ ID NO: 4887460 - DNA, 13 bp, Homo sapiens
agaagctgctcca

SEQ ID NO: 4887461 - DNA, 18 bp, Homo sapiens
agaagctgctccaggcct

SEQ ID NO: 4887462 - DNA, 23 bp, Homo sapiens
agaagctgctccaggcctgcagc

SEQ ID NO: 4887463 - DNA, 11 bp, Homo sapiens
agaagctgctg

SEQ ID NO: 4887464 - DNA, 13 bp, Homo sapiens
agaagctgctgac

SEQ ID NO: 4887465 - DNA, 13 bp, Homo sapiens
agaagctgtagta

SEQ ID NO: 4887466 - DNA, 16 bp, Homo sapiens
agaagctgttgtacat

SEQ ID NO: 4887467 - DNA, 18 bp, Homo sapiens
agaagctgttgtacattt

SEQ ID NO: 4887468 - DNA, 22 bp, Homo sapiens
agaagctgttgtacatttatga

SEQ ID NO: 4887469 - DNA, 12 bp, Homo sapiens
agaagcttctaa

SEQ ID NO: 4887470 - DNA, 16 bp, Homo sapiens
agaagcttctaataaa

SEQ ID NO: 4887471 - DNA, 11 bp, Homo sapiens
agaaggcaaaa

SEQ ID NO: 4887472 - DNA, 23 bp, Homo sapiens
agaaggccttcatggccccagca

SEQ ID NO: 4887473 - DNA, 19 bp, Homo sapiens
agaagggcataaaacagct

SEQ ID NO: 4887474 - DNA, 19 bp, Homo sapiens
agaagggccagtcctgcct

SEQ ID NO: 4887475 - DNA, 15 bp, Homo sapiens
agaaggtgccacttt

SEQ ID NO: 4887476 - DNA, 22 bp, Homo sapiens
agaaggtggaccttttaaagtg

SEQ ID NO: 4887477 - DNA, 16 bp, Homo sapiens
agaaggttgctctaga

SEQ ID NO: 4887478 - DNA, 20 bp, Homo sapiens
agaaggttgctctagattga

SEQ ID NO: 4887479 - DNA, 13 bp, Homo sapiens
agaagtagattaa

SEQ ID NO: 4887480 - DNA, 17 bp, Homo sapiens
agaagtcatgaagccca

SEQ ID NO: 4887481 - DNA, 20 bp, Homo sapiens
agaagtcatgaagcccaagt

SEQ ID NO: 4887482 - DNA, 14 bp, Homo sapiens
agaagtgcatttct

SEQ ID NO: 4887483 - DNA, 16 bp, Homo sapiens
agaagtgcatttctga

SEQ ID NO: 4887484 - DNA, 24 bp, Homo sapiens
agaagtgcatttctgaatagaaat

SEQ ID NO: 4887485 - DNA, 17 bp, Homo sapiens
agaagtttattctcatt

SEQ ID NO: 4887486 - DNA, 18 bp, Homo sapiens
agaagtttcccttcctcc

SEQ ID NO: 4887487 - DNA, 21 bp, Homo sapiens
agaagtttgtccatttgtaaa

SEQ ID NO: 4887488 - DNA, 20 bp, Homo sapiens
agaataagaaaacaatcaca

SEQ ID NO: 4887489 - DNA, 16 bp, Homo sapiens
agaataatgttctatt

SEQ ID NO: 4887490 - DNA, 14 bp, Homo sapiens
agaatactttttaa

SEQ ID NO: 4887491 - DNA, 21 bp, Homo sapiens
agaatagccacatttggaata

SEQ ID NO: 4887492 - DNA, 14 bp, Homo sapiens
agaatataggtctc

SEQ ID NO: 4887493 - DNA, 12 bp, Homo sapiens
agaatatatata

SEQ ID NO: 4887494 - DNA, 18 bp, Homo sapiens
agaatatatttatttaaa

SEQ ID NO: 4887495 - DNA, 21 bp, Homo sapiens
agaatatatttatttaaagca

SEQ ID NO: 4887496 - DNA, 16 bp, Homo sapiens
agaatcagagtagaaa

SEQ ID NO: 4887497 - DNA, 18 bp, Homo sapiens
agaatcagagtagaaata

SEQ ID NO: 4887498 - DNA, 19 bp, Homo sapiens
agaatccacatttctaaaa

SEQ ID NO: 4887499 - DNA, 15 bp, Homo sapiens
agaatcccaaatttg

SEQ ID NO: 4887500 - DNA, 17 bp, Homo sapiens
agaatcccaaatttgat

SEQ ID NO: 4887501 - DNA, 12 bp, Homo sapiens
agaatcccagcc

SEQ ID NO: 4887502 - DNA, 18 bp, Homo sapiens
agaatctatatttaacaa

SEQ ID NO: 4887503 - DNA, 16 bp, Homo sapiens
agaatctattttctat

SEQ ID NO: 4887504 - DNA, 22 bp, Homo sapiens
agaatctattttctatgtacta

SEQ ID NO: 4887505 - DNA, 18 bp, Homo sapiens
agaatgcacagatatact

SEQ ID NO: 4887506 - DNA, 20 bp, Homo sapiens
agaatgctgtacatctattt

SEQ ID NO: 4887507 - DNA, 21 bp, Homo sapiens
agaatggttgccttaaagaaa

SEQ ID NO: 4887508 - DNA, 16 bp, Homo sapiens
agaatgtaaaagaact

SEQ ID NO: 4887509 - DNA, 15 bp, Homo sapiens
agaatgtatctgtga

SEQ ID NO: 4887510 - DNA, 19 bp, Homo sapiens
agaatgttggtttactttc

SEQ ID NO: 4887511 - DNA, 20 bp, Homo sapiens
agaatgttggtttactttca

SEQ ID NO: 4887512 - DNA, 18 bp, Homo sapiens
agaatgttttactgtgaa

SEQ ID NO: 4887513 - DNA, 19 bp, Homo sapiens
agaatgttttactgtgaaa

SEQ ID NO: 4887514 - DNA, 17 bp, Homo sapiens
agaattaacagagattg

SEQ ID NO: 4887515 - DNA, 13 bp, Homo sapiens
agaattatatagg

SEQ ID NO: 4887516 - DNA, 21 bp, Homo sapiens
agaattgatcattttcccccc

SEQ ID NO: 4887517 - DNA, 22 bp, Homo sapiens
agaattgatcattttcccccca

SEQ ID NO: 4887518 - DNA, 13 bp, Homo sapiens
agaattggctcaa

SEQ ID NO: 4887519 - DNA, 23 bp, Homo sapiens
agaattgtgcaaatggaagacaa

SEQ ID NO: 4887520 - DNA, 22 bp, Homo sapiens
agaatttctaaaaagattagca

SEQ ID NO: 4887521 - DNA, 23 bp, Homo sapiens
agaatttctaaaaagattagcaa

SEQ ID NO: 4887522 - DNA, 20 bp, Homo sapiens
agaatttctaccatttcaga

SEQ ID NO: 4887523 - DNA, 13 bp, Homo sapiens
agaatttcttggt

SEQ ID NO: 4887524 - DNA, 14 bp, Homo sapiens
agacaaaaagacaa

SEQ ID NO: 4887525 - DNA, 15 bp, Homo sapiens
agacaaaaagacaaa

SEQ ID NO: 4887526 - DNA, 14 bp, Homo sapiens
agacaaaatgtttt

SEQ ID NO: 4887527 - DNA, 12 bp, Homo sapiens
agacaaatattt

SEQ ID NO: 4887528 - DNA, 21 bp, Homo sapiens
agacaaatcaacagaagcatt

SEQ ID NO: 4887529 - DNA, 17 bp, Homo sapiens
agacaagaaatccctgt

SEQ ID NO: 4887530 - DNA, 15 bp, Homo sapiens
agacaagatattgta

SEQ ID NO: 4887531 - DNA, 22 bp, Homo sapiens
agacaagatattgtacataaaa

SEQ ID NO: 4887532 - DNA, 22 bp, Homo sapiens
agacaagtgactgtatctgtgt

SEQ ID NO: 4887533 - DNA, 11 bp, Homo sapiens
agacaatatac

SEQ ID NO: 4887534 - DNA, 13 bp, Homo sapiens
agacaatatacaa

SEQ ID NO: 4887535 - DNA, 14 bp, Homo sapiens
agacaatcattgtt

SEQ ID NO: 4887536 - DNA, 20 bp, Homo sapiens
agacaatgcacctagctgtg

SEQ ID NO: 4887537 - DNA, 18 bp, Homo sapiens
agacaatttgatacataa

SEQ ID NO: 4887538 - DNA, 12 bp, Homo sapiens
agacacaaatgc

SEQ ID NO: 4887539 - DNA, 15 bp, Homo sapiens
agacacacacacgca

SEQ ID NO: 4887540 - DNA, 21 bp, Homo sapiens
agacacacacacgcacgcaca

SEQ ID NO: 4887541 - DNA, 23 bp, Homo sapiens
agacacacacacgcacgcacaca

SEQ ID NO: 4887542 - DNA, 20 bp, Homo sapiens
agacacactatcatagttaa

SEQ ID NO: 4887543 - DNA, 18 bp, Homo sapiens
agacacagcgtccctagc

SEQ ID NO: 4887544 - DNA, 16 bp, Homo sapiens
agacacaggcccggct

SEQ ID NO: 4887545 - DNA, 23 bp, Homo sapiens
agacacaggcccggctccaggct

SEQ ID NO: 4887546 - DNA, 13 bp, Homo sapiens
agacacatttaag

SEQ ID NO: 4887547 - DNA, 20 bp, Homo sapiens
agacaccagagcagatgcag

SEQ ID NO: 4887548 - DNA, 19 bp, Homo sapiens
agacaccctcaacctcttc

SEQ ID NO: 4887549 - DNA, 18 bp, Homo sapiens
agacaccttgacagggca

SEQ ID NO: 4887550 - DNA, 18 bp, Homo sapiens
agacacgccttcccctca

SEQ ID NO: 4887551 - DNA, 21 bp, Homo sapiens
agacacggagcccagccctcc

SEQ ID NO: 4887552 - DNA, 20 bp, Homo sapiens
agacactccccgaagtcttt

SEQ ID NO: 4887553 - DNA, 22 bp, Homo sapiens
agacactccccgaagtcttttg

SEQ ID NO: 4887554 - DNA, 20 bp, Homo sapiens
agacactgccacacagggtc

SEQ ID NO: 4887555 - DNA, 11 bp, Homo sapiens
agacactgcct

SEQ ID NO: 4887556 - DNA, 12 bp, Homo sapiens
agacactgcctg

SEQ ID NO: 4887557 - DNA, 14 bp, Homo sapiens
agacactgcctggg

SEQ ID NO: 4887558 - DNA, 12 bp, Homo sapiens
agacagaatctc

SEQ ID NO: 4887559 - DNA, 14 bp, Homo sapiens
agacagaatgtatc

SEQ ID NO: 4887560 - DNA, 21 bp, Homo sapiens
agacagaatgtatctgtgaag

SEQ ID NO: 4887561 - DNA, 16 bp, Homo sapiens
agacagacacacacac

SEQ ID NO: 4887562 - DNA, 23 bp, Homo sapiens
agacagagtctcactgttgccca

SEQ ID NO: 4887563 - DNA, 15 bp, Homo sapiens
agacagatgccccag

SEQ ID NO: 4887564 - DNA, 19 bp, Homo sapiens
agacagatgccccagagct

SEQ ID NO: 4887565 - DNA, 14 bp, Homo sapiens
agacagcaggcagc

SEQ ID NO: 4887566 - DNA, 15 bp, Homo sapiens
agacagccccagagc

SEQ ID NO: 4887567 - DNA, 13 bp, Homo sapiens
agacagtttctta

SEQ ID NO: 4887568 - DNA, 18 bp, Homo sapiens
agacagtttcttagcttt

SEQ ID NO: 4887569 - DNA, 11 bp, Homo sapiens
agacagtttgt

SEQ ID NO: 4887570 - DNA, 17 bp, Homo sapiens
agacagtttgtaaatgt

SEQ ID NO: 4887571 - DNA, 14 bp, Homo sapiens
agacataacgtttt

SEQ ID NO: 4887572 - DNA, 17 bp, Homo sapiens
agacatggaggttctaa

SEQ ID NO: 4887573 - DNA, 20 bp, Homo sapiens
agacatggaggttctaaggc

SEQ ID NO: 4887574 - DNA, 21 bp, Homo sapiens
agacatggaggttctaaggcc

SEQ ID NO: 4887575 - DNA, 21 bp, Homo sapiens
agacatggctttcagaaaacg

SEQ ID NO: 4887576 - DNA, 18 bp, Homo sapiens
agacatgttttccgtgaa

SEQ ID NO: 4887577 - DNA, 19 bp, Homo sapiens
agacatttcttttcttttt

SEQ ID NO: 4887578 - DNA, 23 bp, Homo sapiens
agacatttcttttctttttacat

SEQ ID NO: 4887579 - DNA, 21 bp, Homo sapiens
agaccaacgttactcagggct

SEQ ID NO: 4887580 - DNA, 22 bp, Homo sapiens
agaccaacgttactcagggctc

SEQ ID NO: 4887581 - DNA, 14 bp, Homo sapiens
agaccaaggaacaa

SEQ ID NO: 4887582 - DNA, 14 bp, Homo sapiens
agaccaaggcggga

SEQ ID NO: 4887583 - DNA, 23 bp, Homo sapiens
agaccaaggcgggagcatctctt

SEQ ID NO: 4887584 - DNA, 14 bp, Homo sapiens
agaccaccccgcct

SEQ ID NO: 4887585 - DNA, 16 bp, Homo sapiens
agaccaccccgcctgc

SEQ ID NO: 4887586 - DNA, 16 bp, Homo sapiens
agaccaggatttctaa

SEQ ID NO: 4887587 - DNA, 16 bp, Homo sapiens
agaccaggctgtgtcc

SEQ ID NO: 4887588 - DNA, 18 bp, Homo sapiens
agaccatttaacatgcaa

SEQ ID NO: 4887589 - DNA, 16 bp, Homo sapiens
agacccaccccacctg

SEQ ID NO: 4887590 - DNA, 21 bp, Homo sapiens
agacccaccccacctgcaggg

SEQ ID NO: 4887591 - DNA, 17 bp, Homo sapiens
agaccccacctccttgg

SEQ ID NO: 4887592 - DNA, 13 bp, Homo sapiens
agaccccaggctg

SEQ ID NO: 4887593 - DNA, 15 bp, Homo sapiens
agacccccacacctc

SEQ ID NO: 4887594 - DNA, 14 bp, Homo sapiens
agacccctggcttt

SEQ ID NO: 4887595 - DNA, 16 bp, Homo sapiens
agaccctctgccacca

SEQ ID NO: 4887596 - DNA, 20 bp, Homo sapiens
agaccctctgccaccagaga

SEQ ID NO: 4887597 - DNA, 20 bp, Homo sapiens
agaccctgcaaacagaacag

SEQ ID NO: 4887598 - DNA, 13 bp, Homo sapiens
agaccgtcctcac

SEQ ID NO: 4887599 - DNA, 15 bp, Homo sapiens
agaccgtcctcaccc

SEQ ID NO: 4887600 - DNA, 18 bp, Homo sapiens
agaccgtttacctagaag

SEQ ID NO: 4887601 - DNA, 16 bp, Homo sapiens
agacctactgttctaa

SEQ ID NO: 4887602 - DNA, 19 bp, Homo sapiens
agacctactgttctaaagc

SEQ ID NO: 4887603 - DNA, 22 bp, Homo sapiens
agacctactgttctaaagctct

SEQ ID NO: 4887604 - DNA, 14 bp, Homo sapiens
agacctccccagcc

SEQ ID NO: 4887605 - DNA, 15 bp, Homo sapiens
agacctccccagccc

SEQ ID NO: 4887606 - DNA, 23 bp, Homo sapiens
agacctctgtgaggaaagcacac

SEQ ID NO: 4887607 - DNA, 23 bp, Homo sapiens
agaccttccataatgctactgtc

SEQ ID NO: 4887608 - DNA, 20 bp, Homo sapiens
agacgccggggacagaggcc

SEQ ID NO: 4887609 - DNA, 18 bp, Homo sapiens
agacggagtcccaccttg

SEQ ID NO: 4887610 - DNA, 14 bp, Homo sapiens
agactaagaaatat

SEQ ID NO: 4887611 - DNA, 19 bp, Homo sapiens
agactactattttcttttt

SEQ ID NO: 4887612 - DNA, 19 bp, Homo sapiens
agactagattgcctttgtt

SEQ ID NO: 4887613 - DNA, 13 bp, Homo sapiens
agactatatacat

SEQ ID NO: 4887614 - DNA, 14 bp, Homo sapiens
agactatatacatg

SEQ ID NO: 4887615 - DNA, 20 bp, Homo sapiens
agactatatacatgtgtgta

SEQ ID NO: 4887616 - DNA, 15 bp, Homo sapiens
agactatggagcctg

SEQ ID NO: 4887617 - DNA, 19 bp, Homo sapiens
agactatttaaacttataa

SEQ ID NO: 4887618 - DNA, 22 bp, Homo sapiens
agactatttaaacttataaatc

SEQ ID NO: 4887619 - DNA, 19 bp, Homo sapiens
agactcaggccaagaaacg

SEQ ID NO: 4887620 - DNA, 16 bp, Homo sapiens
agactcatcttactgt

SEQ ID NO: 4887621 - DNA, 15 bp, Homo sapiens
agactcattcttctg

SEQ ID NO: 4887622 - DNA, 21 bp, Homo sapiens
agactcccatgaagccttttg

SEQ ID NO: 4887623 - DNA, 14 bp, Homo sapiens
agactcctcctcca

SEQ ID NO: 4887624 - DNA, 15 bp, Homo sapiens
agactctagggtcca

SEQ ID NO: 4887625 - DNA, 17 bp, Homo sapiens
agactctcagcccagaa

SEQ ID NO: 4887626 - DNA, 15 bp, Homo sapiens
agactctttgcatat

SEQ ID NO: 4887627 - DNA, 18 bp, Homo sapiens
agactgcaggttggaccc

SEQ ID NO: 4887628 - DNA, 18 bp, Homo sapiens
agactgctagtgttctgt

SEQ ID NO: 4887629 - DNA, 19 bp, Homo sapiens
agactgcttccaattttct

SEQ ID NO: 4887630 - DNA, 19 bp, Homo sapiens
agactggaagctaatttgc

SEQ ID NO: 4887631 - DNA, 20 bp, Homo sapiens
agactggaagctaatttgca

SEQ ID NO: 4887632 - DNA, 18 bp, Homo sapiens
agactggggggcttgaaa

SEQ ID NO: 4887633 - DNA, 15 bp, Homo sapiens
agactggtcctgtgt

SEQ ID NO: 4887634 - DNA, 18 bp, Homo sapiens
agactggtcctgtgtgca

SEQ ID NO: 4887635 - DNA, 15 bp, Homo sapiens
agacttactctaaga

SEQ ID NO: 4887636 - DNA, 17 bp, Homo sapiens
agacttggcaacagaag

SEQ ID NO: 4887637 - DNA, 18 bp, Homo sapiens
agacttggcaacagaagc

SEQ ID NO: 4887638 - DNA, 19 bp, Homo sapiens
agacttggcaacagaagca

SEQ ID NO: 4887639 - DNA, 12 bp, Homo sapiens
agactttctgtt

SEQ ID NO: 4887640 - DNA, 13 bp, Homo sapiens
agacttttgtaca

SEQ ID NO: 4887641 - DNA, 14 bp, Homo sapiens
agacttttgtacat

SEQ ID NO: 4887642 - DNA, 22 bp, Homo sapiens
agacttttgtacatctggctta

SEQ ID NO: 4887643 - DNA, 15 bp, Homo sapiens
agacttttttctagt

SEQ ID NO: 4887644 - DNA, 18 bp, Homo sapiens
agagaaaaaaaaaatagt

SEQ ID NO: 4887645 - DNA, 14 bp, Homo sapiens
agagaaacaaactt

SEQ ID NO: 4887646 - DNA, 12 bp, Homo sapiens
agagaaacttta

SEQ ID NO: 4887647 - DNA, 16 bp, Homo sapiens
agagaaagccaggcag

SEQ ID NO: 4887648 - DNA, 17 bp, Homo sapiens
agagaaagccaggcagg

SEQ ID NO: 4887649 - DNA, 22 bp, Homo sapiens
agagaaagccaggcaggtagcc

SEQ ID NO: 4887650 - DNA, 17 bp, Homo sapiens
agagaaaggcctgcaca

SEQ ID NO: 4887651 - DNA, 18 bp, Homo sapiens
agagaaaggcctgcacac

SEQ ID NO: 4887652 - DNA, 19 bp, Homo sapiens
agagaaaggcctgcacaca

SEQ ID NO: 4887653 - DNA, 18 bp, Homo sapiens
agagaaagtacttctcca

SEQ ID NO: 4887654 - DNA, 17 bp, Homo sapiens
agagaaattctgttaaa

SEQ ID NO: 4887655 - DNA, 10 bp, Homo sapiens
agagaagaag

SEQ ID NO: 4887656 - DNA, 11 bp, Homo sapiens
agagaagaaga

SEQ ID NO: 4887657 - DNA, 12 bp, Homo sapiens
agagaagaagaa

SEQ ID NO: 4887658 - DNA, 13 bp, Homo sapiens
agagaagaagaaa

SEQ ID NO: 4887659 - DNA, 18 bp, Homo sapiens
agagaagcggatttccag

SEQ ID NO: 4887660 - DNA, 21 bp, Homo sapiens
agagaagggcataaaacagct

SEQ ID NO: 4887661 - DNA, 15 bp, Homo sapiens
agagaatcatactta

SEQ ID NO: 4887662 - DNA, 20 bp, Homo sapiens
agagaatgcacagatatact

SEQ ID NO: 4887663 - DNA, 16 bp, Homo sapiens
agagaattagattata

SEQ ID NO: 4887664 - DNA, 12 bp, Homo sapiens
agagaattggct

SEQ ID NO: 4887665 - DNA, 12 bp, Homo sapiens
agagacagaatg

SEQ ID NO: 4887666 - DNA, 22 bp, Homo sapiens
agagacagttatttatagtcat

SEQ ID NO: 4887667 - DNA, 21 bp, Homo sapiens
agagaccctctgccaccagag

SEQ ID NO: 4887668 - DNA, 23 bp, Homo sapiens
agagaccctctgccaccagagac

SEQ ID NO: 4887669 - DNA, 18 bp, Homo sapiens
agagactatggagcctgg

SEQ ID NO: 4887670 - DNA, 22 bp, Homo sapiens
agagactatggagcctggcaca

SEQ ID NO: 4887671 - DNA, 16 bp, Homo sapiens
agagactcccatgaag

SEQ ID NO: 4887672 - DNA, 17 bp, Homo sapiens
agagactcccatgaagc

SEQ ID NO: 4887673 - DNA, 18 bp, Homo sapiens
agagactcccatgaagcc

SEQ ID NO: 4887674 - DNA, 20 bp, Homo sapiens
agagactcccatgaagcctt

SEQ ID NO: 4887675 - DNA, 17 bp, Homo sapiens
agagactgcgttctgca

SEQ ID NO: 4887676 - DNA, 18 bp, Homo sapiens
agagactgcgttctgcaa

SEQ ID NO: 4887677 - DNA, 22 bp, Homo sapiens
agagactgcgttctgcaagcat

SEQ ID NO: 4887678 - DNA, 14 bp, Homo sapiens
agagagaaaataaa

SEQ ID NO: 4887679 - DNA, 14 bp, Homo sapiens
agagagaaagagag

SEQ ID NO: 4887680 - DNA, 22 bp, Homo sapiens
agagagaaagccaggcaggtag

SEQ ID NO: 4887681 - DNA, 19 bp, Homo sapiens
agagagaaattctgttaaa

SEQ ID NO: 4887682 - DNA, 10 bp, Homo sapiens
agagagagaa

SEQ ID NO: 4887683 - DNA, 13 bp, Homo sapiens
agagagagaaaga

SEQ ID NO: 4887684 - DNA, 11 bp, Homo sapiens
agagagagaga

SEQ ID NO: 4887685 - DNA, 14 bp, Homo sapiens
agagagagagaaat

SEQ ID NO: 4887686 - DNA, 12 bp, Homo sapiens
agagagagagag

SEQ ID NO: 4887687 - DNA, 13 bp, Homo sapiens
agagaggagagga

SEQ ID NO: 4887688 - DNA, 17 bp, Homo sapiens
agagaggagaggagaga

SEQ ID NO: 4887689 - DNA, 14 bp, Homo sapiens
agagaggagccaga

SEQ ID NO: 4887690 - DNA, 19 bp, Homo sapiens
agagaggatgtgcaagcga

SEQ ID NO: 4887691 - DNA, 14 bp, Homo sapiens
agagaggccttttg

SEQ ID NO: 4887692 - DNA, 23 bp, Homo sapiens
agagagggtggtgacctctgcct

SEQ ID NO: 4887693 - DNA, 16 bp, Homo sapiens
agagagtggctcctcc

SEQ ID NO: 4887694 - DNA, 22 bp, Homo sapiens
agagataccaagatgccatctg

SEQ ID NO: 4887695 - DNA, 13 bp, Homo sapiens
agagatatatata

SEQ ID NO: 4887696 - DNA, 16 bp, Homo sapiens
agagatatatctgaaa

SEQ ID NO: 4887697 - DNA, 20 bp, Homo sapiens
agagatatgtagaaggcaca

SEQ ID NO: 4887698 - DNA, 17 bp, Homo sapiens
agagatgtcatcagagc

SEQ ID NO: 4887699 - DNA, 12 bp, Homo sapiens
agagatgttttt

SEQ ID NO: 4887700 - DNA, 23 bp, Homo sapiens
agagattctgtgatcttttaaag

SEQ ID NO: 4887701 - DNA, 15 bp, Homo sapiens
agagattgcttctca

SEQ ID NO: 4887702 - DNA, 21 bp, Homo sapiens
agagatttatataaatgtaaa

SEQ ID NO: 4887703 - DNA, 14 bp, Homo sapiens
agagatttgtctaa

SEQ ID NO: 4887704 - DNA, 18 bp, Homo sapiens
agagcaaaataattttaa

SEQ ID NO: 4887705 - DNA, 23 bp, Homo sapiens
agagcaagatcctgtctttaagg

SEQ ID NO: 4887706 - DNA, 21 bp, Homo sapiens
agagcaatgcccgtaatgctt

SEQ ID NO: 4887707 - DNA, 18 bp, Homo sapiens
agagcacctagtccagtg

SEQ ID NO: 4887708 - DNA, 23 bp, Homo sapiens
agagcagaacggagccccaggcc

SEQ ID NO: 4887709 - DNA, 12 bp, Homo sapiens
agagcagcctgt

SEQ ID NO: 4887710 - DNA, 19 bp, Homo sapiens
agagcagcctgtggcatct

SEQ ID NO: 4887711 - DNA, 21 bp, Homo sapiens
agagccacaaaagaaaagact

SEQ ID NO: 4887712 - DNA, 12 bp, Homo sapiens
agagccagcttg

SEQ ID NO: 4887713 - DNA, 19 bp, Homo sapiens
agagccatataagtttgaa

SEQ ID NO: 4887714 - DNA, 16 bp, Homo sapiens
agagccatgctgggaa

SEQ ID NO: 4887715 - DNA, 16 bp, Homo sapiens
agagccattttgtgaa

SEQ ID NO: 4887716 - DNA, 19 bp, Homo sapiens
agagcccaccttggctcaa

SEQ ID NO: 4887717 - DNA, 14 bp, Homo sapiens
agagcccagaggta

SEQ ID NO: 4887718 - DNA, 12 bp, Homo sapiens
agagcccccagg

SEQ ID NO: 4887719 - DNA, 16 bp, Homo sapiens
agagcccctggggcct

SEQ ID NO: 4887720 - DNA, 22 bp, Homo sapiens
agagcctcccaaggagaacaaa

SEQ ID NO: 4887721 - DNA, 18 bp, Homo sapiens
agagcctgatctcttcct

SEQ ID NO: 4887722 - DNA, 16 bp, Homo sapiens
agagcctgcctggagc

SEQ ID NO: 4887723 - DNA, 17 bp, Homo sapiens
agagcctgctgcatggg

SEQ ID NO: 4887724 - DNA, 20 bp, Homo sapiens
agagcgtggctgtgctctca

SEQ ID NO: 4887725 - DNA, 22 bp, Homo sapiens
agagctaagggtgggtgctcag

SEQ ID NO: 4887726 - DNA, 23 bp, Homo sapiens
agagctaagggtgggtgctcaga

SEQ ID NO: 4887727 - DNA, 20 bp, Homo sapiens
agagctgccctccttgtcca

SEQ ID NO: 4887728 - DNA, 21 bp, Homo sapiens
agagctgccctccttgtccac

SEQ ID NO: 4887729 - DNA, 23 bp, Homo sapiens
agagctgggaggcatggccctgg

SEQ ID NO: 4887730 - DNA, 19 bp, Homo sapiens
agagctgtttatggcctca

SEQ ID NO: 4887731 - DNA, 20 bp, Homo sapiens
agagctgtttatggcctcag

SEQ ID NO: 4887732 - DNA, 15 bp, Homo sapiens
agagcttagcctgga

SEQ ID NO: 4887733 - DNA, 16 bp, Homo sapiens
agagcttttaaaaatg

SEQ ID NO: 4887734 - DNA, 14 bp, Homo sapiens
agaggaaatctgta

SEQ ID NO: 4887735 - DNA, 17 bp, Homo sapiens
agaggaactgtccagag

SEQ ID NO: 4887736 - DNA, 19 bp, Homo sapiens
agaggaactgtccagagag

SEQ ID NO: 4887737 - DNA, 21 bp, Homo sapiens
agaggaactgtccagagagca

SEQ ID NO: 4887738 - DNA, 21 bp, Homo sapiens
agaggaatcctggcagcccag

SEQ ID NO: 4887739 - DNA, 17 bp, Homo sapiens
agaggactcgcttgtaa

SEQ ID NO: 4887740 - DNA, 23 bp, Homo sapiens
agaggacttttctttgtggcttc

SEQ ID NO: 4887741 - DNA, 11 bp, Homo sapiens
agaggagagag

SEQ ID NO: 4887742 - DNA, 13 bp, Homo sapiens
agaggagagaggc

SEQ ID NO: 4887743 - DNA, 15 bp, Homo sapiens
agaggagagaggcag

SEQ ID NO: 4887744 - DNA, 17 bp, Homo sapiens
agaggagagaggcagag

SEQ ID NO: 4887745 - DNA, 11 bp, Homo sapiens
agaggagcctt

SEQ ID NO: 4887746 - DNA, 14 bp, Homo sapiens
agaggagccttttt

SEQ ID NO: 4887747 - DNA, 22 bp, Homo sapiens
agaggagcctttttaaaacaca

SEQ ID NO: 4887748 - DNA, 13 bp, Homo sapiens
agaggcagcccca

SEQ ID NO: 4887749 - DNA, 19 bp, Homo sapiens
agaggcagccccattctgc

SEQ ID NO: 4887750 - DNA, 21 bp, Homo sapiens
agaggcagccccattctgcct

SEQ ID NO: 4887751 - DNA, 22 bp, Homo sapiens
agaggcagccccattctgcctg

SEQ ID NO: 4887752 - DNA, 24 bp, Homo sapiens
agaggcagccccattctgcctgcc

SEQ ID NO: 4887753 - DNA, 13 bp, Homo sapiens
agaggcagggtct

SEQ ID NO: 4887754 - DNA, 19 bp, Homo sapiens
agaggccttttggaatgtg

SEQ ID NO: 4887755 - DNA, 14 bp, Homo sapiens
agaggctgcccctc

SEQ ID NO: 4887756 - DNA, 19 bp, Homo sapiens
agaggctgcccctctcacc

SEQ ID NO: 4887757 - DNA, 20 bp, Homo sapiens
agagggagtgacagaggcag

SEQ ID NO: 4887758 - DNA, 18 bp, Homo sapiens
agagggccaagacttggc

SEQ ID NO: 4887759 - DNA, 19 bp, Homo sapiens
agagggccatgcaattcat

SEQ ID NO: 4887760 - DNA, 17 bp, Homo sapiens
agagggctctgtgctga

SEQ ID NO: 4887761 - DNA, 12 bp, Homo sapiens
agaggggaagga

SEQ ID NO: 4887762 - DNA, 19 bp, Homo sapiens
agagggtggtgacctctgc

SEQ ID NO: 4887763 - DNA, 20 bp, Homo sapiens
agagggtggtgacctctgcc

SEQ ID NO: 4887764 - DNA, 23 bp, Homo sapiens
agagggtggtgacctctgcctga

SEQ ID NO: 4887765 - DNA, 20 bp, Homo sapiens
agaggtaacagaacagcttc

SEQ ID NO: 4887766 - DNA, 18 bp, Homo sapiens
agaggtactagaatgctt

SEQ ID NO: 4887767 - DNA, 16 bp, Homo sapiens
agaggtagggctgcca

SEQ ID NO: 4887768 - DNA, 14 bp, Homo sapiens
agaggtcagactaa

SEQ ID NO: 4887769 - DNA, 12 bp, Homo sapiens
agaggtccagcc

SEQ ID NO: 4887770 - DNA, 15 bp, Homo sapiens
agaggtccagcccat

SEQ ID NO: 4887771 - DNA, 16 bp, Homo sapiens
agaggtccagcccatc

SEQ ID NO: 4887772 - DNA, 17 bp, Homo sapiens
agaggtccagcccatct

SEQ ID NO: 4887773 - DNA, 18 bp, Homo sapiens
agaggtcctctggagccc

SEQ ID NO: 4887774 - DNA, 22 bp, Homo sapiens
agaggtttgactagatgatgga

SEQ ID NO: 4887775 - DNA, 16 bp, Homo sapiens
agaggttttgttgttt

SEQ ID NO: 4887776 - DNA, 13 bp, Homo sapiens
agagtagaaataa

SEQ ID NO: 4887777 - DNA, 14 bp, Homo sapiens
agagtagaaataaa

SEQ ID NO: 4887778 - DNA, 16 bp, Homo sapiens
agagtagaattgcatt

SEQ ID NO: 4887779 - DNA, 18 bp, Homo sapiens
agagtagaattgcattga

SEQ ID NO: 4887780 - DNA, 22 bp, Homo sapiens
agagtagatggtgaaatttatt

SEQ ID NO: 4887781 - DNA, 21 bp, Homo sapiens
agagtccaaggtttaaagagt

SEQ ID NO: 4887782 - DNA, 13 bp, Homo sapiens
agagtcctcactc

SEQ ID NO: 4887783 - DNA, 17 bp, Homo sapiens
agagtcctgtgctgaat

SEQ ID NO: 4887784 - DNA, 13 bp, Homo sapiens
agagtctaaagat

SEQ ID NO: 4887785 - DNA, 22 bp, Homo sapiens
agagtctaaagatggagtttct

SEQ ID NO: 4887786 - DNA, 12 bp, Homo sapiens
agagtctagatt

SEQ ID NO: 4887787 - DNA, 19 bp, Homo sapiens
agagtctagattcaaaggt

SEQ ID NO: 4887788 - DNA, 19 bp, Homo sapiens
agagtgactagtacaaatt

SEQ ID NO: 4887789 - DNA, 18 bp, Homo sapiens
agagtgactccaagaaca

SEQ ID NO: 4887790 - DNA, 15 bp, Homo sapiens
agagtgagactctgt

SEQ ID NO: 4887791 - DNA, 16 bp, Homo sapiens
agagtgagactctgtc

SEQ ID NO: 4887792 - DNA, 22 bp, Homo sapiens
agagtgagctacagagccgagc

SEQ ID NO: 4887793 - DNA, 16 bp, Homo sapiens
agagtggcctggccag

SEQ ID NO: 4887794 - DNA, 17 bp, Homo sapiens
agagtggcctggccagg

SEQ ID NO: 4887795 - DNA, 13 bp, Homo sapiens
agagtgtagaagc

SEQ ID NO: 4887796 - DNA, 14 bp, Homo sapiens
agagtgtagaagca

SEQ ID NO: 4887797 - DNA, 20 bp, Homo sapiens
agagtgtagtttacagaaaa

SEQ ID NO: 4887798 - DNA, 12 bp, Homo sapiens
agagttaagaag

SEQ ID NO: 4887799 - DNA, 18 bp, Homo sapiens
agagttaagaagctgttg

SEQ ID NO: 4887800 - DNA, 20 bp, Homo sapiens
agagttaagaagctgttgta

SEQ ID NO: 4887801 - DNA, 14 bp, Homo sapiens
agagttcatcccag

SEQ ID NO: 4887802 - DNA, 13 bp, Homo sapiens
agagttccagagg

SEQ ID NO: 4887803 - DNA, 15 bp, Homo sapiens
agagtttaacacaag

SEQ ID NO: 4887804 - DNA, 22 bp, Homo sapiens
agagtttaacacaagtcctgtg

SEQ ID NO: 4887805 - DNA, 14 bp, Homo sapiens
agagtttctgtttg

SEQ ID NO: 4887806 - DNA, 15 bp, Homo sapiens
agagtttctgtttga

SEQ ID NO: 4887807 - DNA, 22 bp, Homo sapiens
agagtttctgtttgattctttt

SEQ ID NO: 4887808 - DNA, 16 bp, Homo sapiens
agagtttgtgtgttgt

SEQ ID NO: 4887809 - DNA, 19 bp, Homo sapiens
agagttttgtcttgaatgt

SEQ ID NO: 4887810 - DNA, 13 bp, Homo sapiens
agataaaaagtgg

SEQ ID NO: 4887811 - DNA, 21 bp, Homo sapiens
agataaaaagtggaatttctt

SEQ ID NO: 4887812 - DNA, 21 bp, Homo sapiens
agataacaatgcagcaaggcc

SEQ ID NO: 4887813 - DNA, 22 bp, Homo sapiens
agataacgcttaaaggaagtca

SEQ ID NO: 4887814 - DNA, 12 bp, Homo sapiens
agataagacata

SEQ ID NO: 4887815 - DNA, 22 bp, Homo sapiens
agataataatgggtttctttca

SEQ ID NO: 4887816 - DNA, 15 bp, Homo sapiens
agataatattactgt

SEQ ID NO: 4887817 - DNA, 18 bp, Homo sapiens
agataattgttgaaattt

SEQ ID NO: 4887818 - DNA, 22 bp, Homo sapiens
agataattgttgaaattttgca

SEQ ID NO: 4887819 - DNA, 18 bp, Homo sapiens
agatacaaattaatttta

SEQ ID NO: 4887820 - DNA, 19 bp, Homo sapiens
agatacaggaaaagctgct

SEQ ID NO: 4887821 - DNA, 20 bp, Homo sapiens
agatacaggaaaagctgctg

SEQ ID NO: 4887822 - DNA, 16 bp, Homo sapiens
agatacatcactgctt

SEQ ID NO: 4887823 - DNA, 16 bp, Homo sapiens
agataccatactcatt

SEQ ID NO: 4887824 - DNA, 23 bp, Homo sapiens
agatactttttcttttgtaagtg

SEQ ID NO: 4887825 - DNA, 17 bp, Homo sapiens
agatagatttggaatag

SEQ ID NO: 4887826 - DNA, 14 bp, Homo sapiens
agataggaccttgg

SEQ ID NO: 4887827 - DNA, 16 bp, Homo sapiens
agataggaccttgggc

SEQ ID NO: 4887828 - DNA, 15 bp, Homo sapiens
agatagggctgggca

SEQ ID NO: 4887829 - DNA, 23 bp, Homo sapiens
agatatactttgtggaccaatta

SEQ ID NO: 4887830 - DNA, 17 bp, Homo sapiens
agatatatctgaaaact

SEQ ID NO: 4887831 - DNA, 20 bp, Homo sapiens
agatatatctgaaaactgga

SEQ ID NO: 4887832 - DNA, 20 bp, Homo sapiens
agatatggagaattgctgaa

SEQ ID NO: 4887833 - DNA, 14 bp, Homo sapiens
agatattactttat

SEQ ID NO: 4887834 - DNA, 22 bp, Homo sapiens
agatattactttatcacttttt

SEQ ID NO: 4887835 - DNA, 18 bp, Homo sapiens
agatattgtacataaaag

SEQ ID NO: 4887836 - DNA, 19 bp, Homo sapiens
agatattgtacataaaaga

SEQ ID NO: 4887837 - DNA, 23 bp, Homo sapiens
agatattgttcaaacaatatcat

SEQ ID NO: 4887838 - DNA, 12 bp, Homo sapiens
agatatttggct

SEQ ID NO: 4887839 - DNA, 21 bp, Homo sapiens
agatatttggcttaaatatag

SEQ ID NO: 4887840 - DNA, 12 bp, Homo sapiens
agatcaaaataa

SEQ ID NO: 4887841 - DNA, 16 bp, Homo sapiens
agatcaaaataaaaag

SEQ ID NO: 4887842 - DNA, 21 bp, Homo sapiens
agatcaaccccttcgctcctg

SEQ ID NO: 4887843 - DNA, 16 bp, Homo sapiens
agatcacgccactgca

SEQ ID NO: 4887844 - DNA, 17 bp, Homo sapiens
agatcacgccactgcac

SEQ ID NO: 4887845 - DNA, 18 bp, Homo sapiens
agatcactgaatttataa

SEQ ID NO: 4887846 - DNA, 14 bp, Homo sapiens
agatcctaagggtc

SEQ ID NO: 4887847 - DNA, 23 bp, Homo sapiens
agatcctaagggtcgaaagctct

SEQ ID NO: 4887848 - DNA, 21 bp, Homo sapiens
agatctgcagggggtgtgtct

SEQ ID NO: 4887849 - DNA, 13 bp, Homo sapiens
agatctgtgcccc

SEQ ID NO: 4887850 - DNA, 14 bp, Homo sapiens
agatctgttttgaa

SEQ ID NO: 4887851 - DNA, 15 bp, Homo sapiens
agatcttagattctc

SEQ ID NO: 4887852 - DNA, 19 bp, Homo sapiens
agatgaactctgaactttg

SEQ ID NO: 4887853 - DNA, 21 bp, Homo sapiens
agatgaactctgaactttgga

SEQ ID NO: 4887854 - DNA, 16 bp, Homo sapiens
agatgaaggagaggca

SEQ ID NO: 4887855 - DNA, 15 bp, Homo sapiens
agatgaagttttaca

SEQ ID NO: 4887856 - DNA, 14 bp, Homo sapiens
agatgaagttttat

SEQ ID NO: 4887857 - DNA, 12 bp, Homo sapiens
agatgacaacct

SEQ ID NO: 4887858 - DNA, 17 bp, Homo sapiens
agatgacaacctccatt

SEQ ID NO: 4887859 - DNA, 16 bp, Homo sapiens
agatgagaacaaagct

SEQ ID NO: 4887860 - DNA, 19 bp, Homo sapiens
agatgagaacaaagctgtt

SEQ ID NO: 4887861 - DNA, 21 bp, Homo sapiens
agatgagggatgggcctggca

SEQ ID NO: 4887862 - DNA, 19 bp, Homo sapiens
agatgattaaataagattc

SEQ ID NO: 4887863 - DNA, 12 bp, Homo sapiens
agatgattctgg

SEQ ID NO: 4887864 - DNA, 21 bp, Homo sapiens
agatgattctggctgaaaaag

SEQ ID NO: 4887865 - DNA, 15 bp, Homo sapiens
agatgcaaggaccag

SEQ ID NO: 4887866 - DNA, 17 bp, Homo sapiens
agatgcaaggaccagga

SEQ ID NO: 4887867 - DNA, 15 bp, Homo sapiens
agatgcagagagcca

SEQ ID NO: 4887868 - DNA, 20 bp, Homo sapiens
agatgcagagagccattttg

SEQ ID NO: 4887869 - DNA, 15 bp, Homo sapiens
agatgcagtttggag

SEQ ID NO: 4887870 - DNA, 15 bp, Homo sapiens
agatgccaccctagc

SEQ ID NO: 4887871 - DNA, 16 bp, Homo sapiens
agatgccatctgtgtc

SEQ ID NO: 4887872 - DNA, 16 bp, Homo sapiens
agatgccattcataga

SEQ ID NO: 4887873 - DNA, 15 bp, Homo sapiens
agatgcgtcccaaga

SEQ ID NO: 4887874 - DNA, 13 bp, Homo sapiens
agatgctccaaga

SEQ ID NO: 4887875 - DNA, 15 bp, Homo sapiens
agatgctccaagatt

SEQ ID NO: 4887876 - DNA, 13 bp, Homo sapiens
agatgctggagaa

SEQ ID NO: 4887877 - DNA, 19 bp, Homo sapiens
agatgctggagaagagagg

SEQ ID NO: 4887878 - DNA, 18 bp, Homo sapiens
agatggaatgctgtgtta

SEQ ID NO: 4887879 - DNA, 14 bp, Homo sapiens
agatggagtttcta

SEQ ID NO: 4887880 - DNA, 16 bp, Homo sapiens
agatggagtttctaag

SEQ ID NO: 4887881 - DNA, 18 bp, Homo sapiens
agatggagtttctaaggt

SEQ ID NO: 4887882 - DNA, 21 bp, Homo sapiens
agatggcccggatgctgcttc

SEQ ID NO: 4887883 - DNA, 16 bp, Homo sapiens
agatggctcagagggg

SEQ ID NO: 4887884 - DNA, 21 bp, Homo sapiens
agatggctcagagggggactg

SEQ ID NO: 4887885 - DNA, 21 bp, Homo sapiens
agatggctggaaggggtccag

SEQ ID NO: 4887886 - DNA, 21 bp, Homo sapiens
agatggctgtgcctctgcctg

SEQ ID NO: 4887887 - DNA, 22 bp, Homo sapiens
agatggctgtgcctctgcctgt

SEQ ID NO: 4887888 - DNA, 20 bp, Homo sapiens
agatggggataaaatgacta

SEQ ID NO: 4887889 - DNA, 16 bp, Homo sapiens
agatgtgatattctaa

SEQ ID NO: 4887890 - DNA, 13 bp, Homo sapiens
agatgtgcaccca

SEQ ID NO: 4887891 - DNA, 15 bp, Homo sapiens
agatgtgcacccatg

SEQ ID NO: 4887892 - DNA, 21 bp, Homo sapiens
agatgttgaagaatacagtta

SEQ ID NO: 4887893 - DNA, 14 bp, Homo sapiens
agatgtttcacacc

SEQ ID NO: 4887894 - DNA, 19 bp, Homo sapiens
agatgttttggtagattaa

SEQ ID NO: 4887895 - DNA, 18 bp, Homo sapiens
agatgtttttaaaagttt

SEQ ID NO: 4887896 - DNA, 20 bp, Homo sapiens
agatgtttttaaaagtttca

SEQ ID NO: 4887897 - DNA, 12 bp, Homo sapiens
agattaaatata

SEQ ID NO: 4887898 - DNA, 14 bp, Homo sapiens
agattaatggcact

SEQ ID NO: 4887899 - DNA, 15 bp, Homo sapiens
agattaatggcactg

SEQ ID NO: 4887900 - DNA, 17 bp, Homo sapiens
agattaatggcactgat

SEQ ID NO: 4887901 - DNA, 22 bp, Homo sapiens
agattacccaaaaactgtcttt

SEQ ID NO: 4887902 - DNA, 13 bp, Homo sapiens
agattagaaaaat

SEQ ID NO: 4887903 - DNA, 16 bp, Homo sapiens
agattatagattctaa

SEQ ID NO: 4887904 - DNA, 17 bp, Homo sapiens
agattatagattctaaa

SEQ ID NO: 4887905 - DNA, 19 bp, Homo sapiens
agattatagattctaaaga

SEQ ID NO: 4887906 - DNA, 21 bp, Homo sapiens
agattcaaaggttctaggttt

SEQ ID NO: 4887907 - DNA, 18 bp, Homo sapiens
agattcagtcttgcctta

SEQ ID NO: 4887908 - DNA, 18 bp, Homo sapiens
agattccagagagtggct

SEQ ID NO: 4887909 - DNA, 19 bp, Homo sapiens
agattccattggtccaaga

SEQ ID NO: 4887910 - DNA, 15 bp, Homo sapiens
agattcctctgtatt

SEQ ID NO: 4887911 - DNA, 16 bp, Homo sapiens
agattcgctttccatg

SEQ ID NO: 4887912 - DNA, 12 bp, Homo sapiens
agattctaaaga

SEQ ID NO: 4887913 - DNA, 15 bp, Homo sapiens
agattctaaagattc

SEQ ID NO: 4887914 - DNA, 16 bp, Homo sapiens
agattctaaagattct

SEQ ID NO: 4887915 - DNA, 18 bp, Homo sapiens
agattctaaagattctat

SEQ ID NO: 4887916 - DNA, 12 bp, Homo sapiens
agattctaacgg

SEQ ID NO: 4887917 - DNA, 14 bp, Homo sapiens
agattctaatgatg

SEQ ID NO: 4887918 - DNA, 14 bp, Homo sapiens
agattctagatcag

SEQ ID NO: 4887919 - DNA, 15 bp, Homo sapiens
agattctatagttct

SEQ ID NO: 4887920 - DNA, 19 bp, Homo sapiens
agattctatagttctagac

SEQ ID NO: 4887921 - DNA, 20 bp, Homo sapiens
agattctatagttctagaca

SEQ ID NO: 4887922 - DNA, 23 bp, Homo sapiens
agattctctggctgtaaggctct

SEQ ID NO: 4887923 - DNA, 23 bp, Homo sapiens
agattctctgtgtctaagattct

SEQ ID NO: 4887924 - DNA, 19 bp, Homo sapiens
agattctgtgatcttttaa

SEQ ID NO: 4887925 - DNA, 22 bp, Homo sapiens
agattctgtgatcttttaaagt

SEQ ID NO: 4887926 - DNA, 15 bp, Homo sapiens
agattctttttctga

SEQ ID NO: 4887927 - DNA, 15 bp, Homo sapiens
agattgagaaggaga

SEQ ID NO: 4887928 - DNA, 18 bp, Homo sapiens
agattgagagaagagaca

SEQ ID NO: 4887929 - DNA, 21 bp, Homo sapiens
agattgcaacaggctgggctt

SEQ ID NO: 4887930 - DNA, 23 bp, Homo sapiens
agattgcaacaggctgggcttca

SEQ ID NO: 4887931 - DNA, 19 bp, Homo sapiens
agattgctgaaaaagtaga

SEQ ID NO: 4887932 - DNA, 21 bp, Homo sapiens
agattggtgggattttttgtt

SEQ ID NO: 4887933 - DNA, 20 bp, Homo sapiens
agattgtgggggaaaaataa

SEQ ID NO: 4887934 - DNA, 23 bp, Homo sapiens
agattgttttatcatgacatgtt

SEQ ID NO: 4887935 - DNA, 15 bp, Homo sapiens
agatttatataaatg

SEQ ID NO: 4887936 - DNA, 20 bp, Homo sapiens
agatttatttttcagttcca

SEQ ID NO: 4887937 - DNA, 22 bp, Homo sapiens
agatttgtaggaaggtctcatt

SEQ ID NO: 4887938 - DNA, 17 bp, Homo sapiens
agattttaattgtcatg

SEQ ID NO: 4887939 - DNA, 17 bp, Homo sapiens
agattttcagaaaatat

SEQ ID NO: 4887940 - DNA, 18 bp, Homo sapiens
agattttctggttctaac

SEQ ID NO: 4887941 - DNA, 19 bp, Homo sapiens
agattttctggttctaaca

SEQ ID NO: 4887942 - DNA, 17 bp, Homo sapiens
agattttgataactgtt

SEQ ID NO: 4887943 - DNA, 13 bp, Homo sapiens
agatttttgcaat

SEQ ID NO: 4887944 - DNA, 16 bp, Homo sapiens
agattttttattgcta

SEQ ID NO: 4887945 - DNA, 20 bp, Homo sapiens
agcaaaaaatgaatgtctaa

SEQ ID NO: 4887946 - DNA, 13 bp, Homo sapiens
agcaaaagaaaaa

SEQ ID NO: 4887947 - DNA, 17 bp, Homo sapiens
agcaaaataaaaactat

SEQ ID NO: 4887948 - DNA, 21 bp, Homo sapiens
agcaaaataattttaaacaaa

SEQ ID NO: 4887949 - DNA, 23 bp, Homo sapiens
agcaaaattgatgtgtttattta

SEQ ID NO: 4887950 - DNA, 17 bp, Homo sapiens
agcaaaccatttttaaa

SEQ ID NO: 4887951 - DNA, 19 bp, Homo sapiens
agcaaataaactaggaaat

SEQ ID NO: 4887952 - DNA, 14 bp, Homo sapiens
agcaaatacttagc

SEQ ID NO: 4887953 - DNA, 24 bp, Homo sapiens
agcaaatttcaaaagacatgttgt

SEQ ID NO: 4887954 - DNA, 20 bp, Homo sapiens
agcaaccgcctcaaaatgtg

SEQ ID NO: 4887955 - DNA, 20 bp, Homo sapiens
agcaacgtagcttctaccat

SEQ ID NO: 4887956 - DNA, 20 bp, Homo sapiens
agcaactcttgattatccat

SEQ ID NO: 4887957 - DNA, 12 bp, Homo sapiens
agcaactgggac

SEQ ID NO: 4887958 - DNA, 13 bp, Homo sapiens
agcaactgttatg

SEQ ID NO: 4887959 - DNA, 15 bp, Homo sapiens
agcaacttcttctcc

SEQ ID NO: 4887960 - DNA, 15 bp, Homo sapiens
agcaacttttgtgta

SEQ ID NO: 4887961 - DNA, 20 bp, Homo sapiens
agcaacttttgtgtaatgaa

SEQ ID NO: 4887962 - DNA, 19 bp, Homo sapiens
agcaagccctacagagctg

SEQ ID NO: 4887963 - DNA, 12 bp, Homo sapiens
agcaagctggcc

SEQ ID NO: 4887964 - DNA, 12 bp, Homo sapiens
agcaaggccctg

SEQ ID NO: 4887965 - DNA, 18 bp, Homo sapiens
agcaagtgagagagatgg

SEQ ID NO: 4887966 - DNA, 13 bp, Homo sapiens
agcaagtgagagc

SEQ ID NO: 4887967 - DNA, 16 bp, Homo sapiens
agcaagtgagagctgg

SEQ ID NO: 4887968 - DNA, 18 bp, Homo sapiens
agcaagtgagagctgggt

SEQ ID NO: 4887969 - DNA, 15 bp, Homo sapiens
agcaatatttatgga

SEQ ID NO: 4887970 - DNA, 18 bp, Homo sapiens
agcaatgacatctcaggg

SEQ ID NO: 4887971 - DNA, 20 bp, Homo sapiens
agcaatgacatctcaggggc

SEQ ID NO: 4887972 - DNA, 20 bp, Homo sapiens
agcaatgcccgtaatgctta

SEQ ID NO: 4887973 - DNA, 21 bp, Homo sapiens
agcaatgcccgtaatgcttag

SEQ ID NO: 4887974 - DNA, 16 bp, Homo sapiens
agcaatttaaatgtta

SEQ ID NO: 4887975 - DNA, 17 bp, Homo sapiens
agcaatttaactagaca

SEQ ID NO: 4887976 - DNA, 15 bp, Homo sapiens
agcacaaacattttt

SEQ ID NO: 4887977 - DNA, 23 bp, Homo sapiens
agcacaagcagagtgcacagctg

SEQ ID NO: 4887978 - DNA, 21 bp, Homo sapiens
agcacagctcaggaactagac

SEQ ID NO: 4887979 - DNA, 15 bp, Homo sapiens
agcacagctccctgc

SEQ ID NO: 4887980 - DNA, 16 bp, Homo sapiens
agcacagcttcatttc

SEQ ID NO: 4887981 - DNA, 15 bp, Homo sapiens
agcacaggtcccacc

SEQ ID NO: 4887982 - DNA, 20 bp, Homo sapiens
agcacaggtcccacctccag

SEQ ID NO: 4887983 - DNA, 22 bp, Homo sapiens
agcacagtgttaaatgaaattg

SEQ ID NO: 4887984 - DNA, 12 bp, Homo sapiens
agcacagtttgt

SEQ ID NO: 4887985 - DNA, 16 bp, Homo sapiens
agcacatctgcatttt

SEQ ID NO: 4887986 - DNA, 23 bp, Homo sapiens
agcacatctgcattttcacccca

SEQ ID NO: 4887987 - DNA, 16 bp, Homo sapiens
agcacatgctggccag

SEQ ID NO: 4887988 - DNA, 12 bp, Homo sapiens
agcaccacccta

SEQ ID NO: 4887989 - DNA, 16 bp, Homo sapiens
agcacctcagcctgca

SEQ ID NO: 4887990 - DNA, 13 bp, Homo sapiens
agcacctcctgcc

SEQ ID NO: 4887991 - DNA, 18 bp, Homo sapiens
agcacctgcctcctcgtt

SEQ ID NO: 4887992 - DNA, 13 bp, Homo sapiens
agcacggacaata

SEQ ID NO: 4887993 - DNA, 17 bp, Homo sapiens
agcacggacaataaacc

SEQ ID NO: 4887994 - DNA, 14 bp, Homo sapiens
agcactactgggtg

SEQ ID NO: 4887995 - DNA, 15 bp, Homo sapiens
agcactactgggtgt

SEQ ID NO: 4887996 - DNA, 16 bp, Homo sapiens
agcactactgggtgtc

SEQ ID NO: 4887997 - DNA, 18 bp, Homo sapiens
agcactactgggtgtcat

SEQ ID NO: 4887998 - DNA, 16 bp, Homo sapiens
agcactagagaatgca

SEQ ID NO: 4887999 - DNA, 17 bp, Homo sapiens
agcactagagaatgcac

SEQ ID NO: 4888000 - DNA, 20 bp, Homo sapiens
agcactagagaatgcacaga

SEQ ID NO: 4888001 - DNA, 15 bp, Homo sapiens
agcactgttgatgta

SEQ ID NO: 4888002 - DNA, 18 bp, Homo sapiens
agcactgttgatgtatct

SEQ ID NO: 4888003 - DNA, 15 bp, Homo sapiens
agcacttatttaatg

SEQ ID NO: 4888004 - DNA, 18 bp, Homo sapiens
agcacttccaaaattctt

SEQ ID NO: 4888005 - DNA, 18 bp, Homo sapiens
agcactttgaaatacctc

SEQ ID NO: 4888006 - DNA, 23 bp, Homo sapiens
agcagagaatgaaagggcccaga

SEQ ID NO: 4888007 - DNA, 19 bp, Homo sapiens
agcagagtgcacagctgtc

SEQ ID NO: 4888008 - DNA, 23 bp, Homo sapiens
agcagagtgcacagctgtccact

SEQ ID NO: 4888009 - DNA, 13 bp, Homo sapiens
agcagatgcagag

SEQ ID NO: 4888010 - DNA, 18 bp, Homo sapiens
agcagatgcagagagcca

SEQ ID NO: 4888011 - DNA, 17 bp, Homo sapiens
agcagcaaaaatataaa

SEQ ID NO: 4888012 - DNA, 16 bp, Homo sapiens
agcagcagcaggtgat

SEQ ID NO: 4888013 - DNA, 13 bp, Homo sapiens
agcagcaggtgat

SEQ ID NO: 4888014 - DNA, 15 bp, Homo sapiens
agcagccccgggagg

SEQ ID NO: 4888015 - DNA, 22 bp, Homo sapiens
agcagcctgcttcccacctccc

SEQ ID NO: 4888016 - DNA, 16 bp, Homo sapiens
agcagctttaaacaaa

SEQ ID NO: 4888017 - DNA, 17 bp, Homo sapiens
agcagctttaaacaaat

SEQ ID NO: 4888018 - DNA, 19 bp, Homo sapiens
agcagctttaaactcaggg

SEQ ID NO: 4888019 - DNA, 20 bp, Homo sapiens
agcagctttaaactcaggga

SEQ ID NO: 4888020 - DNA, 21 bp, Homo sapiens
agcaggaagcattcagagagc

SEQ ID NO: 4888021 - DNA, 17 bp, Homo sapiens
agcaggaaggcctgggt

SEQ ID NO: 4888022 - DNA, 23 bp, Homo sapiens
agcaggagattgagaaggagaga

SEQ ID NO: 4888023 - DNA, 20 bp, Homo sapiens
agcaggagtggtgcagacag

SEQ ID NO: 4888024 - DNA, 14 bp, Homo sapiens
agcaggcagcgcca

SEQ ID NO: 4888025 - DNA, 16 bp, Homo sapiens
agcaggccaaggtctg

SEQ ID NO: 4888026 - DNA, 17 bp, Homo sapiens
agcaggccaaggtctga

SEQ ID NO: 4888027 - DNA, 14 bp, Homo sapiens
agcagggaaggcct

SEQ ID NO: 4888028 - DNA, 15 bp, Homo sapiens
agcagggaaggcctg

SEQ ID NO: 4888029 - DNA, 16 bp, Homo sapiens
agcagggaaggcctga

SEQ ID NO: 4888030 - DNA, 20 bp, Homo sapiens
agcaggggctacaagaggga

SEQ ID NO: 4888031 - DNA, 23 bp, Homo sapiens
agcaggtgattggaccaggccat

SEQ ID NO: 4888032 - DNA, 21 bp, Homo sapiens
agcagtaaaagatgaagtttt

SEQ ID NO: 4888033 - DNA, 17 bp, Homo sapiens
agcagtaaatttgctag

SEQ ID NO: 4888034 - DNA, 19 bp, Homo sapiens
agcagtaaatttgctagca

SEQ ID NO: 4888035 - DNA, 11 bp, Homo sapiens
agcagtacatg

SEQ ID NO: 4888036 - DNA, 17 bp, Homo sapiens
agcagtaccagcgctct

SEQ ID NO: 4888037 - DNA, 21 bp, Homo sapiens
agcagtagaaataatatgcat

SEQ ID NO: 4888038 - DNA, 22 bp, Homo sapiens
agcagtagaaataatatgcatt

SEQ ID NO: 4888039 - DNA, 22 bp, Homo sapiens
agcagtcctgcctcagcctccg

SEQ ID NO: 4888040 - DNA, 21 bp, Homo sapiens
agcagtgttccccatctgggt

SEQ ID NO: 4888041 - DNA, 13 bp, Homo sapiens
agcagttgtgtca

SEQ ID NO: 4888042 - DNA, 13 bp, Homo sapiens
agcataaaaacat

SEQ ID NO: 4888043 - DNA, 21 bp, Homo sapiens
agcataattgaaagttctgaa

SEQ ID NO: 4888044 - DNA, 13 bp, Homo sapiens
agcatcacctgcc

SEQ ID NO: 4888045 - DNA, 18 bp, Homo sapiens
agcatcagggggaagaag

SEQ ID NO: 4888046 - DNA, 19 bp, Homo sapiens
agcatccccaaaacaaagt

SEQ ID NO: 4888047 - DNA, 20 bp, Homo sapiens
agcatcccccaaagttcaca

SEQ ID NO: 4888048 - DNA, 13 bp, Homo sapiens
agcatcccggagg

SEQ ID NO: 4888049 - DNA, 14 bp, Homo sapiens
agcatcccggagga

SEQ ID NO: 4888050 - DNA, 19 bp, Homo sapiens
agcatcccggaggaaatct

SEQ ID NO: 4888051 - DNA, 17 bp, Homo sapiens
agcatcctaagaaatat

SEQ ID NO: 4888052 - DNA, 22 bp, Homo sapiens
agcatcctaagaaatatgtgag

SEQ ID NO: 4888053 - DNA, 14 bp, Homo sapiens
agcatcctggcacc

SEQ ID NO: 4888054 - DNA, 18 bp, Homo sapiens
agcatcctggcacccggc

SEQ ID NO: 4888055 - DNA, 12 bp, Homo sapiens
agcatctaagtt

SEQ ID NO: 4888056 - DNA, 22 bp, Homo sapiens
agcatctaagttataagactct

SEQ ID NO: 4888057 - DNA, 22 bp, Homo sapiens
agcatgaatggtatggaactct

SEQ ID NO: 4888058 - DNA, 17 bp, Homo sapiens
agcatgcttgtgaaaat

SEQ ID NO: 4888059 - DNA, 18 bp, Homo sapiens
agcatggctcaaagtgca

SEQ ID NO: 4888060 - DNA, 14 bp, Homo sapiens
agcatgggcctggc

SEQ ID NO: 4888061 - DNA, 18 bp, Homo sapiens
agcatgtttcatgttttg

SEQ ID NO: 4888062 - DNA, 14 bp, Homo sapiens
agcatgttttgtat

SEQ ID NO: 4888063 - DNA, 19 bp, Homo sapiens
agcatgttttgtatacaaa

SEQ ID NO: 4888064 - DNA, 16 bp, Homo sapiens
agcattcagagagcag

SEQ ID NO: 4888065 - DNA, 16 bp, Homo sapiens
agcattccttctttga

SEQ ID NO: 4888066 - DNA, 24 bp, Homo sapiens
agcattccttctttgataatgtta

SEQ ID NO: 4888067 - DNA, 22 bp, Homo sapiens
agcattctcactcctacctggt

SEQ ID NO: 4888068 - DNA, 17 bp, Homo sapiens
agcattctccccagtgt

SEQ ID NO: 4888069 - DNA, 16 bp, Homo sapiens
agcattgaaattatag

SEQ ID NO: 4888070 - DNA, 12 bp, Homo sapiens
agcattgcctgg

SEQ ID NO: 4888071 - DNA, 12 bp, Homo sapiens
agcatttatcat

SEQ ID NO: 4888072 - DNA, 21 bp, Homo sapiens
agcatttccaacaccacagac

SEQ ID NO: 4888073 - DNA, 23 bp, Homo sapiens
agcatttccaacaccacagacac

SEQ ID NO: 4888074 - DNA, 16 bp, Homo sapiens
agcatttgataatgat

SEQ ID NO: 4888075 - DNA, 17 bp, Homo sapiens
agcatttttatttcaga

SEQ ID NO: 4888076 - DNA, 18 bp, Homo sapiens
agcatttttgatttatgc

SEQ ID NO: 4888077 - DNA, 19 bp, Homo sapiens
agccaaacccatgaggcaa

SEQ ID NO: 4888078 - DNA, 17 bp, Homo sapiens
agccaaagaaatgaaca

SEQ ID NO: 4888079 - DNA, 23 bp, Homo sapiens
agccaaagctaggcctggccaga

SEQ ID NO: 4888080 - DNA, 16 bp, Homo sapiens
agccaacctaagcaag

SEQ ID NO: 4888081 - DNA, 16 bp, Homo sapiens
agccaatgtctcctcc

SEQ ID NO: 4888082 - DNA, 16 bp, Homo sapiens
agccacaagtcttcca

SEQ ID NO: 4888083 - DNA, 20 bp, Homo sapiens
agccacagcagcatttttat

SEQ ID NO: 4888084 - DNA, 21 bp, Homo sapiens
agccacatagagtgactccaa

SEQ ID NO: 4888085 - DNA, 15 bp, Homo sapiens
agccacatttggaat

SEQ ID NO: 4888086 - DNA, 17 bp, Homo sapiens
agccaccacgtccagct

SEQ ID NO: 4888087 - DNA, 14 bp, Homo sapiens
agccaccccgggct

SEQ ID NO: 4888088 - DNA, 23 bp, Homo sapiens
agccacctctgtcatttgttgtg

SEQ ID NO: 4888089 - DNA, 16 bp, Homo sapiens
agccacggccaggcca

SEQ ID NO: 4888090 - DNA, 17 bp, Homo sapiens
agccacggccaggccag

SEQ ID NO: 4888091 - DNA, 18 bp, Homo sapiens
agccacggccaggccaga

SEQ ID NO: 4888092 - DNA, 19 bp, Homo sapiens
agccactctcttccctttc

SEQ ID NO: 4888093 - DNA, 16 bp, Homo sapiens
agccactgcaccgggc

SEQ ID NO: 4888094 - DNA, 18 bp, Homo sapiens
agccactgcaccgggcca

SEQ ID NO: 4888095 - DNA, 19 bp, Homo sapiens
agccactgcaccgggccac

SEQ ID NO: 4888096 - DNA, 22 bp, Homo sapiens
agccactgcaccgggccacaga

SEQ ID NO: 4888097 - DNA, 22 bp, Homo sapiens
agccacttcggccaggtcacac

SEQ ID NO: 4888098 - DNA, 15 bp, Homo sapiens
agccagcacttgtat

SEQ ID NO: 4888099 - DNA, 21 bp, Homo sapiens
agccagctcacagtgctgtgt

SEQ ID NO: 4888100 - DNA, 19 bp, Homo sapiens
agccagctccctctattta

SEQ ID NO: 4888101 - DNA, 18 bp, Homo sapiens
agccaggctcaggccatg

SEQ ID NO: 4888102 - DNA, 18 bp, Homo sapiens
agccagggtctctccctc

SEQ ID NO: 4888103 - DNA, 20 bp, Homo sapiens
agccagggtctctccctcag

SEQ ID NO: 4888104 - DNA, 21 bp, Homo sapiens
agccagggtctctccctcagg

SEQ ID NO: 4888105 - DNA, 14 bp, Homo sapiens
agccatcaaaatgc

SEQ ID NO: 4888106 - DNA, 19 bp, Homo sapiens
agccatgctgggaagacgc

SEQ ID NO: 4888107 - DNA, 14 bp, Homo sapiens
agccattaaatgaa

SEQ ID NO: 4888108 - DNA, 17 bp, Homo sapiens
agccattaaatgaatat

SEQ ID NO: 4888109 - DNA, 21 bp, Homo sapiens
agccattaaatgaatattttg

SEQ ID NO: 4888110 - DNA, 16 bp, Homo sapiens
agccattttgtgaatg

SEQ ID NO: 4888111 - DNA, 17 bp, Homo sapiens
agccattttgtgaatgg

SEQ ID NO: 4888112 - DNA, 19 bp, Homo sapiens
agccattttgtgaatggat

SEQ ID NO: 4888113 - DNA, 23 bp, Homo sapiens
agcccaaaggggacaggcctcac

SEQ ID NO: 4888114 - DNA, 14 bp, Homo sapiens
agcccaccctgctg

SEQ ID NO: 4888115 - DNA, 16 bp, Homo sapiens
agcccaccctgctgcc

SEQ ID NO: 4888116 - DNA, 21 bp, Homo sapiens
agcccacggctaagaggctgc

SEQ ID NO: 4888117 - DNA, 13 bp, Homo sapiens
agcccacttctgc

SEQ ID NO: 4888118 - DNA, 12 bp, Homo sapiens
agcccagacaaa

SEQ ID NO: 4888119 - DNA, 11 bp, Homo sapiens
agcccagagaa

SEQ ID NO: 4888120 - DNA, 14 bp, Homo sapiens
agcccagagaacag

SEQ ID NO: 4888121 - DNA, 13 bp, Homo sapiens
agcccagaggtaa

SEQ ID NO: 4888122 - DNA, 15 bp, Homo sapiens
agcccaggagagaga

SEQ ID NO: 4888123 - DNA, 22 bp, Homo sapiens
agcccaggagggcatccatacc

SEQ ID NO: 4888124 - DNA, 11 bp, Homo sapiens
agcccaggagt

SEQ ID NO: 4888125 - DNA, 17 bp, Homo sapiens
agcccaggtgccagcct

SEQ ID NO: 4888126 - DNA, 19 bp, Homo sapiens
agcccatactcagcctgct

SEQ ID NO: 4888127 - DNA, 22 bp, Homo sapiens
agcccatgttctgcccccagcc

SEQ ID NO: 4888128 - DNA, 12 bp, Homo sapiens
agccccactgcc

SEQ ID NO: 4888129 - DNA, 19 bp, Homo sapiens
agccccactgccagcagca

SEQ ID NO: 4888130 - DNA, 12 bp, Homo sapiens
agccccagagca

SEQ ID NO: 4888131 - DNA, 16 bp, Homo sapiens
agccccaggcctctgt

SEQ ID NO: 4888132 - DNA, 21 bp, Homo sapiens
agccccaggcctctgtgtcct

SEQ ID NO: 4888133 - DNA, 20 bp, Homo sapiens
agccccagggtcttccctac

SEQ ID NO: 4888134 - DNA, 23 bp, Homo sapiens
agccccagggtcttccctacctc

SEQ ID NO: 4888135 - DNA, 13 bp, Homo sapiens
agccccattctgc

SEQ ID NO: 4888136 - DNA, 16 bp, Homo sapiens
agccccattctgcctg

SEQ ID NO: 4888137 - DNA, 17 bp, Homo sapiens
agccccattctgcctgc

SEQ ID NO: 4888138 - DNA, 18 bp, Homo sapiens
agccccattctgcctgcc

SEQ ID NO: 4888139 - DNA, 21 bp, Homo sapiens
agccccattctgcctgcccag

SEQ ID NO: 4888140 - DNA, 13 bp, Homo sapiens
agcccccaggaag

SEQ ID NO: 4888141 - DNA, 14 bp, Homo sapiens
agccccctggcctc

SEQ ID NO: 4888142 - DNA, 17 bp, Homo sapiens
agccccctggcctctgt

SEQ ID NO: 4888143 - DNA, 16 bp, Homo sapiens
agcccccttgacaccg

SEQ ID NO: 4888144 - DNA, 16 bp, Homo sapiens
agccccgccctcttcc

SEQ ID NO: 4888145 - DNA, 20 bp, Homo sapiens
agccccgccctcttcctgac

SEQ ID NO: 4888146 - DNA, 12 bp, Homo sapiens
agcccctagccc

SEQ ID NO: 4888147 - DNA, 14 bp, Homo sapiens
agcccctagcccag

SEQ ID NO: 4888148 - DNA, 22 bp, Homo sapiens
agcccctagcccaggagagaga

SEQ ID NO: 4888149 - DNA, 13 bp, Homo sapiens
agcccctggggcc

SEQ ID NO: 4888150 - DNA, 20 bp, Homo sapiens
agccccttgctctcccctgc

SEQ ID NO: 4888151 - DNA, 20 bp, Homo sapiens
agcccggaccttggcagccc

SEQ ID NO: 4888152 - DNA, 21 bp, Homo sapiens
agcccggcgcccctgccacct

SEQ ID NO: 4888153 - DNA, 14 bp, Homo sapiens
agcccgtctcagtg

SEQ ID NO: 4888154 - DNA, 15 bp, Homo sapiens
agccctacagagctg

SEQ ID NO: 4888155 - DNA, 18 bp, Homo sapiens
agccctacagagctgtgg

SEQ ID NO: 4888156 - DNA, 18 bp, Homo sapiens
agccctactccctgcaga

SEQ ID NO: 4888157 - DNA, 20 bp, Homo sapiens
agccctactccctgcagatg

SEQ ID NO: 4888158 - DNA, 14 bp, Homo sapiens
agccctagagcctg

SEQ ID NO: 4888159 - DNA, 15 bp, Homo sapiens
agccctagagcctgc

SEQ ID NO: 4888160 - DNA, 23 bp, Homo sapiens
agccctcatcttgaagggcccag

SEQ ID NO: 4888161 - DNA, 20 bp, Homo sapiens
agccctccccatggagccag

SEQ ID NO: 4888162 - DNA, 23 bp, Homo sapiens
agccctgatgtgtcctcagggag

SEQ ID NO: 4888163 - DNA, 13 bp, Homo sapiens
agccctggggctg

SEQ ID NO: 4888164 - DNA, 14 bp, Homo sapiens
agccctggggctgg

SEQ ID NO: 4888165 - DNA, 21 bp, Homo sapiens
agccctggtggcagtgggagc

SEQ ID NO: 4888166 - DNA, 21 bp, Homo sapiens
agcccttagcagggaaacagc

SEQ ID NO: 4888167 - DNA, 14 bp, Homo sapiens
agcccttcatttgg

SEQ ID NO: 4888168 - DNA, 19 bp, Homo sapiens
agcccttccatgtcgcctc

SEQ ID NO: 4888169 - DNA, 23 bp, Homo sapiens
agcccttccatgtcgcctctgca

SEQ ID NO: 4888170 - DNA, 12 bp, Homo sapiens
agccctttctgt

SEQ ID NO: 4888171 - DNA, 13 bp, Homo sapiens
agccctttctgtg

SEQ ID NO: 4888172 - DNA, 16 bp, Homo sapiens
agccctttctgtgtgc

SEQ ID NO: 4888173 - DNA, 23 bp, Homo sapiens
agccgactgcacagcggcccctg

SEQ ID NO: 4888174 - DNA, 18 bp, Homo sapiens
agccgccattgccaccag

SEQ ID NO: 4888175 - DNA, 17 bp, Homo sapiens
agccgccttaagctgat

SEQ ID NO: 4888176 - DNA, 16 bp, Homo sapiens
agccgccttccttgac

SEQ ID NO: 4888177 - DNA, 19 bp, Homo sapiens
agccgctgtgagcccctgg

SEQ ID NO: 4888178 - DNA, 22 bp, Homo sapiens
agccgctgtgagcccctggtcc

SEQ ID NO: 4888179 - DNA, 17 bp, Homo sapiens
agccgtgccttcagctc

SEQ ID NO: 4888180 - DNA, 22 bp, Homo sapiens
agccgtggcttcccgctcagcc

SEQ ID NO: 4888181 - DNA, 15 bp, Homo sapiens
agcctaatacaacat

SEQ ID NO: 4888182 - DNA, 15 bp, Homo sapiens
agcctaggaccactc

SEQ ID NO: 4888183 - DNA, 19 bp, Homo sapiens
agcctaggaccactcagcc

SEQ ID NO: 4888184 - DNA, 17 bp, Homo sapiens
agcctatgagcatcctg

SEQ ID NO: 4888185 - DNA, 21 bp, Homo sapiens
agcctatgagcatcctgagcc

SEQ ID NO: 4888186 - DNA, 21 bp, Homo sapiens
agcctatttacctgcaggctg

SEQ ID NO: 4888187 - DNA, 19 bp, Homo sapiens
agcctcaacctcctgggct

SEQ ID NO: 4888188 - DNA, 23 bp, Homo sapiens
agcctcaaggttttaggttctaa

SEQ ID NO: 4888189 - DNA, 15 bp, Homo sapiens
agcctcagcatcctg

SEQ ID NO: 4888190 - DNA, 16 bp, Homo sapiens
agcctcagcatcctgg

SEQ ID NO: 4888191 - DNA, 20 bp, Homo sapiens
agcctcagcatcctggcacc

SEQ ID NO: 4888192 - DNA, 23 bp, Homo sapiens
agcctcagcatcctggcacccgg

SEQ ID NO: 4888193 - DNA, 11 bp, Homo sapiens
agcctcagtcc

SEQ ID NO: 4888194 - DNA, 16 bp, Homo sapiens
agcctcagtcctcccc

SEQ ID NO: 4888195 - DNA, 14 bp, Homo sapiens
agcctcatatttaa

SEQ ID NO: 4888196 - DNA, 17 bp, Homo sapiens
agcctcatatttaaaga

SEQ ID NO: 4888197 - DNA, 20 bp, Homo sapiens
agcctcatatttaaagacag

SEQ ID NO: 4888198 - DNA, 21 bp, Homo sapiens
agcctccaagctccatctcca

SEQ ID NO: 4888199 - DNA, 18 bp, Homo sapiens
agcctcccaaagtgctgg

SEQ ID NO: 4888200 - DNA, 20 bp, Homo sapiens
agcctcccaaagtgctggga

SEQ ID NO: 4888201 - DNA, 20 bp, Homo sapiens
agcctcccgaatagctggga

SEQ ID NO: 4888202 - DNA, 18 bp, Homo sapiens
agcctcccgagtagctgg

SEQ ID NO: 4888203 - DNA, 11 bp, Homo sapiens
agcctccctga

SEQ ID NO: 4888204 - DNA, 20 bp, Homo sapiens
agcctcctcatcccgtgttc

SEQ ID NO: 4888205 - DNA, 18 bp, Homo sapiens
agcctcctctgtctgccc

SEQ ID NO: 4888206 - DNA, 17 bp, Homo sapiens
agcctctgacccctcct

SEQ ID NO: 4888207 - DNA, 18 bp, Homo sapiens
agcctctgacccctcctc

SEQ ID NO: 4888208 - DNA, 13 bp, Homo sapiens
agcctctggctag

SEQ ID NO: 4888209 - DNA, 15 bp, Homo sapiens
agcctctggctagag

SEQ ID NO: 4888210 - DNA, 20 bp, Homo sapiens
agcctctggctagaggccag

SEQ ID NO: 4888211 - DNA, 20 bp, Homo sapiens
agcctcttctgccaagagag

SEQ ID NO: 4888212 - DNA, 20 bp, Homo sapiens
agcctgaattttgttgctgt

SEQ ID NO: 4888213 - DNA, 16 bp, Homo sapiens
agcctgaccttccttc

SEQ ID NO: 4888214 - DNA, 19 bp, Homo sapiens
agcctgaccttccttcctg

SEQ ID NO: 4888215 - DNA, 18 bp, Homo sapiens
agcctgagtcagggccca

SEQ ID NO: 4888216 - DNA, 16 bp, Homo sapiens
agcctgatctcttcct

SEQ ID NO: 4888217 - DNA, 18 bp, Homo sapiens
agcctgatctcttcctgt

SEQ ID NO: 4888218 - DNA, 21 bp, Homo sapiens
agcctgcaatttcatatgctg

SEQ ID NO: 4888219 - DNA, 21 bp, Homo sapiens
agcctgcatcccaggatgctg

SEQ ID NO: 4888220 - DNA, 21 bp, Homo sapiens
agcctgcccaagcccaggcca

SEQ ID NO: 4888221 - DNA, 13 bp, Homo sapiens
agcctgcctggag

SEQ ID NO: 4888222 - DNA, 14 bp, Homo sapiens
agcctgcctggagc

SEQ ID NO: 4888223 - DNA, 15 bp, Homo sapiens
agcctgcctggagcg

SEQ ID NO: 4888224 - DNA, 21 bp, Homo sapiens
agcctgcgttggtccagagcg

SEQ ID NO: 4888225 - DNA, 20 bp, Homo sapiens
agcctgctggtcacagcctc

SEQ ID NO: 4888226 - DNA, 22 bp, Homo sapiens
agcctgctggtcacagcctcct

SEQ ID NO: 4888227 - DNA, 19 bp, Homo sapiens
agcctgcttcccacctccc

SEQ ID NO: 4888228 - DNA, 23 bp, Homo sapiens
agcctgcttcccacctccctgcc

SEQ ID NO: 4888229 - DNA, 19 bp, Homo sapiens
agcctggagacccacccca

SEQ ID NO: 4888230 - DNA, 13 bp, Homo sapiens
agcctggcacagg

SEQ ID NO: 4888231 - DNA, 16 bp, Homo sapiens
agcctggcacaggact

SEQ ID NO: 4888232 - DNA, 19 bp, Homo sapiens
agcctggcacaggactgat

SEQ ID NO: 4888233 - DNA, 16 bp, Homo sapiens
agcctggcccatagaa

SEQ ID NO: 4888234 - DNA, 17 bp, Homo sapiens
agcctggcccatagaaa

SEQ ID NO: 4888235 - DNA, 21 bp, Homo sapiens
agcctgggacagtttatcatg

SEQ ID NO: 4888236 - DNA, 15 bp, Homo sapiens
agcctgggcaacaga

SEQ ID NO: 4888237 - DNA, 17 bp, Homo sapiens
agcctgggcagccaggc

SEQ ID NO: 4888238 - DNA, 18 bp, Homo sapiens
agcctgggcagccaggct

SEQ ID NO: 4888239 - DNA, 20 bp, Homo sapiens
agcctgggcagccaggctgc

SEQ ID NO: 4888240 - DNA, 13 bp, Homo sapiens
agcctggggcctg

SEQ ID NO: 4888241 - DNA, 15 bp, Homo sapiens
agcctggggcctggc

SEQ ID NO: 4888242 - DNA, 17 bp, Homo sapiens
agcctgtaagcctgcaa

SEQ ID NO: 4888243 - DNA, 22 bp, Homo sapiens
agcctgtcatccttggtctttg

SEQ ID NO: 4888244 - DNA, 21 bp, Homo sapiens
agcctgtgcatgtatgtcttg

SEQ ID NO: 4888245 - DNA, 22 bp, Homo sapiens
agcctgtggcatctttgccttg

SEQ ID NO: 4888246 - DNA, 18 bp, Homo sapiens
agcctgtttcttcctgtt

SEQ ID NO: 4888247 - DNA, 23 bp, Homo sapiens
agcctgtttcttcctgttaatgt

SEQ ID NO: 4888248 - DNA, 20 bp, Homo sapiens
agccttaatttttttttcat

SEQ ID NO: 4888249 - DNA, 15 bp, Homo sapiens
agccttacatttgtg

SEQ ID NO: 4888250 - DNA, 14 bp, Homo sapiens
agccttagggaagc

SEQ ID NO: 4888251 - DNA, 20 bp, Homo sapiens
agccttagggaagctggcct

SEQ ID NO: 4888252 - DNA, 15 bp, Homo sapiens
agccttctgatgtct

SEQ ID NO: 4888253 - DNA, 20 bp, Homo sapiens
agccttcttccatcccagga

SEQ ID NO: 4888254 - DNA, 21 bp, Homo sapiens
agccttgcctaaatttaatgc

SEQ ID NO: 4888255 - DNA, 23 bp, Homo sapiens
agccttgcctaaatttaatgctg

SEQ ID NO: 4888256 - DNA, 23 bp, Homo sapiens
agcctttaatggacttatttctt

SEQ ID NO: 4888257 - DNA, 18 bp, Homo sapiens
agcctttagtatcagtgt

SEQ ID NO: 4888258 - DNA, 20 bp, Homo sapiens
agcctttagtatcagtgttt

SEQ ID NO: 4888259 - DNA, 15 bp, Homo sapiens
agcctttgcctcccc

SEQ ID NO: 4888260 - DNA, 16 bp, Homo sapiens
agcctttgcctccccg

SEQ ID NO: 4888261 - DNA, 16 bp, Homo sapiens
agcctttggctctgga

SEQ ID NO: 4888262 - DNA, 17 bp, Homo sapiens
agcctttggctctggag

SEQ ID NO: 4888263 - DNA, 17 bp, Homo sapiens
agccttttatactgatt

SEQ ID NO: 4888264 - DNA, 13 bp, Homo sapiens
agccttttgaaag

SEQ ID NO: 4888265 - DNA, 19 bp, Homo sapiens
agcctttttaaaacacatg

SEQ ID NO: 4888266 - DNA, 20 bp, Homo sapiens
agcctttttaaaacacatgt

SEQ ID NO: 4888267 - DNA, 17 bp, Homo sapiens
agcgagggcagctgcta

SEQ ID NO: 4888268 - DNA, 15 bp, Homo sapiens
agcgcctgtgcacac

SEQ ID NO: 4888269 - DNA, 22 bp, Homo sapiens
agcgcgccactcgcttccccca

SEQ ID NO: 4888270 - DNA, 18 bp, Homo sapiens
agcgctatcttcacatag

SEQ ID NO: 4888271 - DNA, 20 bp, Homo sapiens
agcggactcctcctttctcc

SEQ ID NO: 4888272 - DNA, 17 bp, Homo sapiens
agcggagtctgtcctgt

SEQ ID NO: 4888273 - DNA, 18 bp, Homo sapiens
agcggcgaccgccctccg

SEQ ID NO: 4888274 - DNA, 15 bp, Homo sapiens
agcgggaggcagagt

SEQ ID NO: 4888275 - DNA, 16 bp, Homo sapiens
agcggggacagctcct

SEQ ID NO: 4888276 - DNA, 13 bp, Homo sapiens
agcggtctcaggc

SEQ ID NO: 4888277 - DNA, 12 bp, Homo sapiens
agcggtggccct

SEQ ID NO: 4888278 - DNA, 15 bp, Homo sapiens
agcggtggccctgtc

SEQ ID NO: 4888279 - DNA, 16 bp, Homo sapiens
agcgtaaaatggtgaa

SEQ ID NO: 4888280 - DNA, 21 bp, Homo sapiens
agcgtcagggttggtgtgctg

SEQ ID NO: 4888281 - DNA, 23 bp, Homo sapiens
agcgtcagggttggtgtgctgag

SEQ ID NO: 4888282 - DNA, 15 bp, Homo sapiens
agcgtccagaaatgg

SEQ ID NO: 4888283 - DNA, 19 bp, Homo sapiens
agcgtcccagtctctggca

SEQ ID NO: 4888284 - DNA, 16 bp, Homo sapiens
agcgtgagccactgca

SEQ ID NO: 4888285 - DNA, 17 bp, Homo sapiens
agcgtggctgtgctctc

SEQ ID NO: 4888286 - DNA, 23 bp, Homo sapiens
agcgttttttaaatgtatactat

SEQ ID NO: 4888287 - DNA, 18 bp, Homo sapiens
agctaacattttaaataa

SEQ ID NO: 4888288 - DNA, 20 bp, Homo sapiens
agctaacattttaaataaaa

SEQ ID NO: 4888289 - DNA, 18 bp, Homo sapiens
agctaagctaggaatgaa

SEQ ID NO: 4888290 - DNA, 13 bp, Homo sapiens
agctaaggctcta

SEQ ID NO: 4888291 - DNA, 15 bp, Homo sapiens
agctaaggctctatg

SEQ ID NO: 4888292 - DNA, 18 bp, Homo sapiens
agctaaggctctatgagt

SEQ ID NO: 4888293 - DNA, 20 bp, Homo sapiens
agctaaggctctatgagtct

SEQ ID NO: 4888294 - DNA, 20 bp, Homo sapiens
agctaagggtgggtgctcag

SEQ ID NO: 4888295 - DNA, 14 bp, Homo sapiens
agctaatgggacac

SEQ ID NO: 4888296 - DNA, 23 bp, Homo sapiens
agctaatgtaataactgtgaagt

SEQ ID NO: 4888297 - DNA, 20 bp, Homo sapiens
agctaatttgcattaaattc

SEQ ID NO: 4888298 - DNA, 15 bp, Homo sapiens
agctaccctgtgtat

SEQ ID NO: 4888299 - DNA, 19 bp, Homo sapiens
agctacccttttcctttgt

SEQ ID NO: 4888300 - DNA, 21 bp, Homo sapiens
agctacccttttcctttgtgg

SEQ ID NO: 4888301 - DNA, 22 bp, Homo sapiens
agctacccttttcctttgtggt

SEQ ID NO: 4888302 - DNA, 20 bp, Homo sapiens
agctaccctttttctccagc

SEQ ID NO: 4888303 - DNA, 21 bp, Homo sapiens
agctaccctttttctccagct

SEQ ID NO: 4888304 - DNA, 16 bp, Homo sapiens
agctactgatttttgt

SEQ ID NO: 4888305 - DNA, 19 bp, Homo sapiens
agctactgtgtgtgtgaat

SEQ ID NO: 4888306 - DNA, 21 bp, Homo sapiens
agctacttaagagaaatggca

SEQ ID NO: 4888307 - DNA, 17 bp, Homo sapiens
agctagaaaacattttt

SEQ ID NO: 4888308 - DNA, 15 bp, Homo sapiens
agctagcttttagga

SEQ ID NO: 4888309 - DNA, 16 bp, Homo sapiens
agctagcttttaggaa

SEQ ID NO: 4888310 - DNA, 20 bp, Homo sapiens
agctagcttttaggaaaatc

SEQ ID NO: 4888311 - DNA, 14 bp, Homo sapiens
agctaggcctggcc

SEQ ID NO: 4888312 - DNA, 14 bp, Homo sapiens
agctatcaggaaca

SEQ ID NO: 4888313 - DNA, 20 bp, Homo sapiens
agctatcattgcttcctcct

SEQ ID NO: 4888314 - DNA, 18 bp, Homo sapiens
agctatctaaagtttgtt

SEQ ID NO: 4888315 - DNA, 18 bp, Homo sapiens
agctatgggagccccagg

SEQ ID NO: 4888316 - DNA, 22 bp, Homo sapiens
agctatgggagccccagggtct

SEQ ID NO: 4888317 - DNA, 18 bp, Homo sapiens
agctatgtcaagaggctg

SEQ ID NO: 4888318 - DNA, 13 bp, Homo sapiens
agctattaaaact

SEQ ID NO: 4888319 - DNA, 15 bp, Homo sapiens
agctattactgtctg

SEQ ID NO: 4888320 - DNA, 20 bp, Homo sapiens
agctattactgtctggtttt

SEQ ID NO: 4888321 - DNA, 14 bp, Homo sapiens
agctattagccagg

SEQ ID NO: 4888322 - DNA, 14 bp, Homo sapiens
agctattcctttcc

SEQ ID NO: 4888323 - DNA, 19 bp, Homo sapiens
agctattcctttcccttcc

SEQ ID NO: 4888324 - DNA, 20 bp, Homo sapiens
agctattcctttcccttcct

SEQ ID NO: 4888325 - DNA, 22 bp, Homo sapiens
agctattcctttcccttcctct

SEQ ID NO: 4888326 - DNA, 20 bp, Homo sapiens
agctcaagcaggaagttcaa

SEQ ID NO: 4888327 - DNA, 14 bp, Homo sapiens
agctcaccagcccc

SEQ ID NO: 4888328 - DNA, 20 bp, Homo sapiens
agctcaccagccccagtgcc

SEQ ID NO: 4888329 - DNA, 13 bp, Homo sapiens
agctcactaccct

SEQ ID NO: 4888330 - DNA, 23 bp, Homo sapiens
agctcagccccgagctgtccccg

SEQ ID NO: 4888331 - DNA, 14 bp, Homo sapiens
agctcaggggcagc

SEQ ID NO: 4888332 - DNA, 21 bp, Homo sapiens
agctcaggtgtccctgcactt

SEQ ID NO: 4888333 - DNA, 22 bp, Homo sapiens
agctcaggtgtccctgcacttg

SEQ ID NO: 4888334 - DNA, 21 bp, Homo sapiens
agctcagtcccatcagagagc

SEQ ID NO: 4888335 - DNA, 14 bp, Homo sapiens
agctcatattttgt

SEQ ID NO: 4888336 - DNA, 18 bp, Homo sapiens
agctcatattttgtatat

SEQ ID NO: 4888337 - DNA, 13 bp, Homo sapiens
agctccatctcca

SEQ ID NO: 4888338 - DNA, 15 bp, Homo sapiens
agctccatctccact

SEQ ID NO: 4888339 - DNA, 13 bp, Homo sapiens
agctccattttct

SEQ ID NO: 4888340 - DNA, 14 bp, Homo sapiens
agctccctcccgca

SEQ ID NO: 4888341 - DNA, 12 bp, Homo sapiens
agctccctgcca

SEQ ID NO: 4888342 - DNA, 23 bp, Homo sapiens
agctccgctttctacccagcgag

SEQ ID NO: 4888343 - DNA, 17 bp, Homo sapiens
agctcctgtcctcccat

SEQ ID NO: 4888344 - DNA, 15 bp, Homo sapiens
agctccttctgtcct

SEQ ID NO: 4888345 - DNA, 14 bp, Homo sapiens
agctcgcacccccc

SEQ ID NO: 4888346 - DNA, 22 bp, Homo sapiens
agctcgcacccccctgttctaa

SEQ ID NO: 4888347 - DNA, 16 bp, Homo sapiens
agctcggggagcctta

SEQ ID NO: 4888348 - DNA, 14 bp, Homo sapiens
agctctagaatctg

SEQ ID NO: 4888349 - DNA, 12 bp, Homo sapiens
agctctctgtat

SEQ ID NO: 4888350 - DNA, 17 bp, Homo sapiens
agctctctgtataaaca

SEQ ID NO: 4888351 - DNA, 21 bp, Homo sapiens
agctctgtcctgggagtgagc

SEQ ID NO: 4888352 - DNA, 15 bp, Homo sapiens
agctctgtgttgcca

SEQ ID NO: 4888353 - DNA, 23 bp, Homo sapiens
agctctgtgttgccatgtgtgct

SEQ ID NO: 4888354 - DNA, 13 bp, Homo sapiens
agctcttcaggcc

SEQ ID NO: 4888355 - DNA, 15 bp, Homo sapiens
agctcttctccaggc

SEQ ID NO: 4888356 - DNA, 18 bp, Homo sapiens
agctgaatgcctcctgtg

SEQ ID NO: 4888357 - DNA, 19 bp, Homo sapiens
agctgagaactcctgactg

SEQ ID NO: 4888358 - DNA, 16 bp, Homo sapiens
agctgaggtttcaccc

SEQ ID NO: 4888359 - DNA, 18 bp, Homo sapiens
agctgaggtttcaccctt

SEQ ID NO: 4888360 - DNA, 14 bp, Homo sapiens
agctgatataaatt

SEQ ID NO: 4888361 - DNA, 20 bp, Homo sapiens
agctgatcataagtgaattt

SEQ ID NO: 4888362 - DNA, 13 bp, Homo sapiens
agctgatgaaact

SEQ ID NO: 4888363 - DNA, 22 bp, Homo sapiens
agctgatgaaactcacaaatga

SEQ ID NO: 4888364 - DNA, 23 bp, Homo sapiens
agctgatgaaactcacaaatgat

SEQ ID NO: 4888365 - DNA, 20 bp, Homo sapiens
agctgatgttggaagagaaa

SEQ ID NO: 4888366 - DNA, 13 bp, Homo sapiens
agctgcagcttcc

SEQ ID NO: 4888367 - DNA, 14 bp, Homo sapiens
agctgcagcttcct

SEQ ID NO: 4888368 - DNA, 16 bp, Homo sapiens
agctgcaggaatcaaa

SEQ ID NO: 4888369 - DNA, 17 bp, Homo sapiens
agctgcaggaatcaaaa

SEQ ID NO: 4888370 - DNA, 20 bp, Homo sapiens
agctgcaggaatcaaaaatt

SEQ ID NO: 4888371 - DNA, 23 bp, Homo sapiens
agctgcaggaatcaaaaattgaa

SEQ ID NO: 4888372 - DNA, 23 bp, Homo sapiens
agctgccacctctccatcctgct

SEQ ID NO: 4888373 - DNA, 24 bp, Homo sapiens
agctgcccactgtttctcttgagc

SEQ ID NO: 4888374 - DNA, 19 bp, Homo sapiens
agctgcctagcaagctggc

SEQ ID NO: 4888375 - DNA, 13 bp, Homo sapiens
agctgcctcactt

SEQ ID NO: 4888376 - DNA, 10 bp, Homo sapiens
agctgcctgt

SEQ ID NO: 4888377 - DNA, 14 bp, Homo sapiens
agctgcctgtagtt

SEQ ID NO: 4888378 - DNA, 20 bp, Homo sapiens
agctgcctgtagttaggaaa

SEQ ID NO: 4888379 - DNA, 22 bp, Homo sapiens
agctgcctgtagttaggaaata

SEQ ID NO: 4888380 - DNA, 18 bp, Homo sapiens
agctgcctgttcagctcc

SEQ ID NO: 4888381 - DNA, 19 bp, Homo sapiens
agctgcctgttcagctcca

SEQ ID NO: 4888382 - DNA, 20 bp, Homo sapiens
agctgcctgttcagctccag

SEQ ID NO: 4888383 - DNA, 13 bp, Homo sapiens
agctgcggtccac

SEQ ID NO: 4888384 - DNA, 19 bp, Homo sapiens
agctgcggtccacccagga

SEQ ID NO: 4888385 - DNA, 17 bp, Homo sapiens
agctgctccaggcctgc

SEQ ID NO: 4888386 - DNA, 19 bp, Homo sapiens
agctgctccaggcctgcag

SEQ ID NO: 4888387 - DNA, 21 bp, Homo sapiens
agctgctctgaaatctccttt

SEQ ID NO: 4888388 - DNA, 12 bp, Homo sapiens
agctgctgacag

SEQ ID NO: 4888389 - DNA, 13 bp, Homo sapiens
agctgctgacagt

SEQ ID NO: 4888390 - DNA, 14 bp, Homo sapiens
agctgctgacagtg

SEQ ID NO: 4888391 - DNA, 13 bp, Homo sapiens
agctgctgctctg

SEQ ID NO: 4888392 - DNA, 12 bp, Homo sapiens
agctggacagag

SEQ ID NO: 4888393 - DNA, 23 bp, Homo sapiens
agctggccgagggtcctggctcc

SEQ ID NO: 4888394 - DNA, 16 bp, Homo sapiens
agctgggactacaggc

SEQ ID NO: 4888395 - DNA, 14 bp, Homo sapiens
agctgggaggcatg

SEQ ID NO: 4888396 - DNA, 14 bp, Homo sapiens
agctggggacctgg

SEQ ID NO: 4888397 - DNA, 15 bp, Homo sapiens
agctggtcccactca

SEQ ID NO: 4888398 - DNA, 18 bp, Homo sapiens
agctgtaaaacgctgtca

SEQ ID NO: 4888399 - DNA, 20 bp, Homo sapiens
agctgtagtagccctttctg

SEQ ID NO: 4888400 - DNA, 21 bp, Homo sapiens
agctgtagtagccctttctgt

SEQ ID NO: 4888401 - DNA, 22 bp, Homo sapiens
agctgtagtagccctttctgtg

SEQ ID NO: 4888402 - DNA, 15 bp, Homo sapiens
agctgtcctccctcc

SEQ ID NO: 4888403 - DNA, 15 bp, Homo sapiens
agctgtgaacaggct

SEQ ID NO: 4888404 - DNA, 16 bp, Homo sapiens
agctgtgagccttggc

SEQ ID NO: 4888405 - DNA, 17 bp, Homo sapiens
agctgtgagccttggct

SEQ ID NO: 4888406 - DNA, 18 bp, Homo sapiens
agctgtgagccttggctg

SEQ ID NO: 4888407 - DNA, 22 bp, Homo sapiens
agctgtggaggattgctatctg

SEQ ID NO: 4888408 - DNA, 12 bp, Homo sapiens
agctgttaaact

SEQ ID NO: 4888409 - DNA, 15 bp, Homo sapiens
agctgttaaactgtt

SEQ ID NO: 4888410 - DNA, 22 bp, Homo sapiens
agctgttaaactgttagcactg

SEQ ID NO: 4888411 - DNA, 15 bp, Homo sapiens
agctgttgtacattt

SEQ ID NO: 4888412 - DNA, 18 bp, Homo sapiens
agctgttgtacatttatg

SEQ ID NO: 4888413 - DNA, 22 bp, Homo sapiens
agctgttgtacatttatgattt

SEQ ID NO: 4888414 - DNA, 20 bp, Homo sapiens
agctgtttatggcctcagct

SEQ ID NO: 4888415 - DNA, 12 bp, Homo sapiens
agctgtttatgt

SEQ ID NO: 4888416 - DNA, 20 bp, Homo sapiens
agcttaaaataaacagttgt

SEQ ID NO: 4888417 - DNA, 23 bp, Homo sapiens
agcttaaaataaacagttgtgaa

SEQ ID NO: 4888418 - DNA, 16 bp, Homo sapiens
agcttacatagtttta

SEQ ID NO: 4888419 - DNA, 17 bp, Homo sapiens
agcttacatagttttaa

SEQ ID NO: 4888420 - DNA, 17 bp, Homo sapiens
agcttacctgacacaag

SEQ ID NO: 4888421 - DNA, 10 bp, Homo sapiens
agcttagaac

SEQ ID NO: 4888422 - DNA, 18 bp, Homo sapiens
agcttatccataaaaaaa

SEQ ID NO: 4888423 - DNA, 19 bp, Homo sapiens
agcttcatttcctgtgtct

SEQ ID NO: 4888424 - DNA, 15 bp, Homo sapiens
agcttcctgtcaaca

SEQ ID NO: 4888425 - DNA, 17 bp, Homo sapiens
agcttctaataaattat

SEQ ID NO: 4888426 - DNA, 13 bp, Homo sapiens
agcttcttaatta

SEQ ID NO: 4888427 - DNA, 22 bp, Homo sapiens
agcttgaaagttttcagaacct

SEQ ID NO: 4888428 - DNA, 15 bp, Homo sapiens
agcttgactcccaag

SEQ ID NO: 4888429 - DNA, 22 bp, Homo sapiens
agcttgagggttgggctggtgt

SEQ ID NO: 4888430 - DNA, 23 bp, Homo sapiens
agcttgcttgctttcttttttaa

SEQ ID NO: 4888431 - DNA, 18 bp, Homo sapiens
agcttgctttgatttaca

SEQ ID NO: 4888432 - DNA, 19 bp, Homo sapiens
agcttgggagagcccctgg

SEQ ID NO: 4888433 - DNA, 21 bp, Homo sapiens
agcttggggccaccaaagctg

SEQ ID NO: 4888434 - DNA, 23 bp, Homo sapiens
agcttggggccaccaaagctgcc

SEQ ID NO: 4888435 - DNA, 21 bp, Homo sapiens
agcttgtaaatagctcaggtg

SEQ ID NO: 4888436 - DNA, 17 bp, Homo sapiens
agcttgtaggagctgag

SEQ ID NO: 4888437 - DNA, 21 bp, Homo sapiens
agcttgtatagtgtaaaataa

SEQ ID NO: 4888438 - DNA, 20 bp, Homo sapiens
agctttaaactcagggacag

SEQ ID NO: 4888439 - DNA, 21 bp, Homo sapiens
agctttaaactcagggacaga

SEQ ID NO: 4888440 - DNA, 19 bp, Homo sapiens
agctttacatgcaatttat

SEQ ID NO: 4888441 - DNA, 18 bp, Homo sapiens
agctttatgattttcata

SEQ ID NO: 4888442 - DNA, 23 bp, Homo sapiens
agctttatgttcatttgtttgtt

SEQ ID NO: 4888443 - DNA, 21 bp, Homo sapiens
agctttcccaaataaactcta

SEQ ID NO: 4888444 - DNA, 16 bp, Homo sapiens
agctttcttgctccct

SEQ ID NO: 4888445 - DNA, 17 bp, Homo sapiens
agctttgagaagccttc

SEQ ID NO: 4888446 - DNA, 10 bp, Homo sapiens
agctttgcta

SEQ ID NO: 4888447 - DNA, 23 bp, Homo sapiens
agctttgctctttggtagaaaag

SEQ ID NO: 4888448 - DNA, 12 bp, Homo sapiens
agctttgtgttt

SEQ ID NO: 4888449 - DNA, 19 bp, Homo sapiens
agcttttattgtataaact

SEQ ID NO: 4888450 - DNA, 12 bp, Homo sapiens
agcttttcaaac

SEQ ID NO: 4888451 - DNA, 13 bp, Homo sapiens
agcttttcccttc

SEQ ID NO: 4888452 - DNA, 16 bp, Homo sapiens
agcttttcccttcttt

SEQ ID NO: 4888453 - DNA, 14 bp, Homo sapiens
agctttttaattgt

SEQ ID NO: 4888454 - DNA, 22 bp, Homo sapiens
agctttttaattgttgtttctt

SEQ ID NO: 4888455 - DNA, 14 bp, Homo sapiens
aggaaaaacaggtc

SEQ ID NO: 4888456 - DNA, 14 bp, Homo sapiens
aggaaacaagtgaa

SEQ ID NO: 4888457 - DNA, 17 bp, Homo sapiens
aggaaacaatatttata

SEQ ID NO: 4888458 - DNA, 12 bp, Homo sapiens
aggaaacagtta

SEQ ID NO: 4888459 - DNA, 16 bp, Homo sapiens
aggaaaccgcctagtt

SEQ ID NO: 4888460 - DNA, 20 bp, Homo sapiens
aggaaagccccagcactaac

SEQ ID NO: 4888461 - DNA, 16 bp, Homo sapiens
aggaaataaaaccttt

SEQ ID NO: 4888462 - DNA, 20 bp, Homo sapiens
aggaaataaaacctttcaaa

SEQ ID NO: 4888463 - DNA, 21 bp, Homo sapiens
aggaaataaaacctttcaaat

SEQ ID NO: 4888464 - DNA, 16 bp, Homo sapiens
aggaacaaaaaaacca

SEQ ID NO: 4888465 - DNA, 18 bp, Homo sapiens
aggaacaaaaaaaccaca

SEQ ID NO: 4888466 - DNA, 22 bp, Homo sapiens
aggaacaaaaaaaccacaaagg

SEQ ID NO: 4888467 - DNA, 13 bp, Homo sapiens
aggaactgtacag

SEQ ID NO: 4888468 - DNA, 15 bp, Homo sapiens
aggaactgtacagaa

SEQ ID NO: 4888469 - DNA, 18 bp, Homo sapiens
aggaactgtagatgatgt

SEQ ID NO: 4888470 - DNA, 17 bp, Homo sapiens
aggaactgtccagagag

SEQ ID NO: 4888471 - DNA, 20 bp, Homo sapiens
aggaactgtccagagagcaa

SEQ ID NO: 4888472 - DNA, 13 bp, Homo sapiens
aggaacttcagag

SEQ ID NO: 4888473 - DNA, 14 bp, Homo sapiens
aggaacttccaggt

SEQ ID NO: 4888474 - DNA, 22 bp, Homo sapiens
aggaagatatacatgaaaattt

SEQ ID NO: 4888475 - DNA, 19 bp, Homo sapiens
aggaagcattcagagagca

SEQ ID NO: 4888476 - DNA, 20 bp, Homo sapiens
aggaagcctgcagtcctgga

SEQ ID NO: 4888477 - DNA, 15 bp, Homo sapiens
aggaagctccactgt

SEQ ID NO: 4888478 - DNA, 15 bp, Homo sapiens
aggaaggattgtaaa

SEQ ID NO: 4888479 - DNA, 16 bp, Homo sapiens
aggaaggattgtaaaa

SEQ ID NO: 4888480 - DNA, 13 bp, Homo sapiens
aggaaggcctggg

SEQ ID NO: 4888481 - DNA, 14 bp, Homo sapiens
aggaaggcctgggt

SEQ ID NO: 4888482 - DNA, 12 bp, Homo sapiens
aggaagggcaaa

SEQ ID NO: 4888483 - DNA, 21 bp, Homo sapiens
aggaagggggtctaaggtcta

SEQ ID NO: 4888484 - DNA, 17 bp, Homo sapiens
aggaaggtctcattctt

SEQ ID NO: 4888485 - DNA, 16 bp, Homo sapiens
aggaatcaagagctgc

SEQ ID NO: 4888486 - DNA, 23 bp, Homo sapiens
aggaatcatgtcaggcctgtgtg

SEQ ID NO: 4888487 - DNA, 23 bp, Homo sapiens
aggaatccagacccggctgcgtg

SEQ ID NO: 4888488 - DNA, 18 bp, Homo sapiens
aggaatcctggcagccca

SEQ ID NO: 4888489 - DNA, 20 bp, Homo sapiens
aggaatcctggcagcccaga

SEQ ID NO: 4888490 - DNA, 16 bp, Homo sapiens
aggaatgtgtggcctg

SEQ ID NO: 4888491 - DNA, 14 bp, Homo sapiens
aggaatttatacct

SEQ ID NO: 4888492 - DNA, 12 bp, Homo sapiens
aggacaaaactt

SEQ ID NO: 4888493 - DNA, 14 bp, Homo sapiens
aggacaaaacttct

SEQ ID NO: 4888494 - DNA, 21 bp, Homo sapiens
aggacaaaacttcttgtcaga

SEQ ID NO: 4888495 - DNA, 23 bp, Homo sapiens
aggacaaaacttcttgtcagaca

SEQ ID NO: 4888496 - DNA, 15 bp, Homo sapiens
aggacaccacaccca

SEQ ID NO: 4888497 - DNA, 18 bp, Homo sapiens
aggacaccacacccagcc

SEQ ID NO: 4888498 - DNA, 19 bp, Homo sapiens
aggacaccacacccagcct

SEQ ID NO: 4888499 - DNA, 22 bp, Homo sapiens
aggacaccacacccagcctcag

SEQ ID NO: 4888500 - DNA, 23 bp, Homo sapiens
aggacaccacacccagcctcagt

SEQ ID NO: 4888501 - DNA, 15 bp, Homo sapiens
aggacatcagcaaac

SEQ ID NO: 4888502 - DNA, 16 bp, Homo sapiens
aggacatcagcaaaca

SEQ ID NO: 4888503 - DNA, 15 bp, Homo sapiens
aggacatgtttttgt

SEQ ID NO: 4888504 - DNA, 23 bp, Homo sapiens
aggacatgtttttgttttctttg

SEQ ID NO: 4888505 - DNA, 15 bp, Homo sapiens
aggaccactcagccc

SEQ ID NO: 4888506 - DNA, 18 bp, Homo sapiens
aggaccaggactccctcc

SEQ ID NO: 4888507 - DNA, 17 bp, Homo sapiens
aggaccgtggccctgcc

SEQ ID NO: 4888508 - DNA, 19 bp, Homo sapiens
aggacctcctcttccccct

SEQ ID NO: 4888509 - DNA, 13 bp, Homo sapiens
aggacctggggca

SEQ ID NO: 4888510 - DNA, 17 bp, Homo sapiens
aggacctggggcacagt

SEQ ID NO: 4888511 - DNA, 13 bp, Homo sapiens
aggactccctcct

SEQ ID NO: 4888512 - DNA, 13 bp, Homo sapiens
aggactgagcccc

SEQ ID NO: 4888513 - DNA, 23 bp, Homo sapiens
aggactttgaggcaagtgtgggc

SEQ ID NO: 4888514 - DNA, 22 bp, Homo sapiens
aggactttgattgcacattgtt

SEQ ID NO: 4888515 - DNA, 17 bp, Homo sapiens
aggacttttctttgtgg

SEQ ID NO: 4888516 - DNA, 13 bp, Homo sapiens
aggagaacaaata

SEQ ID NO: 4888517 - DNA, 14 bp, Homo sapiens
aggagaacaaatat

SEQ ID NO: 4888518 - DNA, 18 bp, Homo sapiens
aggagaagagttgaggaa

SEQ ID NO: 4888519 - DNA, 13 bp, Homo sapiens
aggagaagctgca

SEQ ID NO: 4888520 - DNA, 17 bp, Homo sapiens
aggagaagctgcatcca

SEQ ID NO: 4888521 - DNA, 15 bp, Homo sapiens
aggagaatgagcctc

SEQ ID NO: 4888522 - DNA, 22 bp, Homo sapiens
aggagacactgtgctataaatc

SEQ ID NO: 4888523 - DNA, 18 bp, Homo sapiens
aggagagagaaagccagg

SEQ ID NO: 4888524 - DNA, 14 bp, Homo sapiens
aggagagcctgctg

SEQ ID NO: 4888525 - DNA, 18 bp, Homo sapiens
aggagagcctgctgcatg

SEQ ID NO: 4888526 - DNA, 20 bp, Homo sapiens
aggagagcctgctgcatggg

SEQ ID NO: 4888527 - DNA, 14 bp, Homo sapiens
aggagaggagagag

SEQ ID NO: 4888528 - DNA, 15 bp, Homo sapiens
aggagaggatgagag

SEQ ID NO: 4888529 - DNA, 17 bp, Homo sapiens
aggagaggatgagagcc

SEQ ID NO: 4888530 - DNA, 17 bp, Homo sapiens
aggagagtagaacagat

SEQ ID NO: 4888531 - DNA, 17 bp, Homo sapiens
aggagattgagaaggag

SEQ ID NO: 4888532 - DNA, 21 bp, Homo sapiens
aggagattgagaaggagagaa

SEQ ID NO: 4888533 - DNA, 16 bp, Homo sapiens
aggagcacaagccaca

SEQ ID NO: 4888534 - DNA, 15 bp, Homo sapiens
aggagcacaggtccc

SEQ ID NO: 4888535 - DNA, 16 bp, Homo sapiens
aggagcacaggtccca

SEQ ID NO: 4888536 - DNA, 17 bp, Homo sapiens
aggagcacttccaaaat

SEQ ID NO: 4888537 - DNA, 13 bp, Homo sapiens
aggagcagcattg

SEQ ID NO: 4888538 - DNA, 15 bp, Homo sapiens
aggagccagacagac

SEQ ID NO: 4888539 - DNA, 13 bp, Homo sapiens
aggagccaggcaa

SEQ ID NO: 4888540 - DNA, 19 bp, Homo sapiens
aggagccaggcaacttcag

SEQ ID NO: 4888541 - DNA, 24 bp, Homo sapiens
aggagcccacggctaagaggctgc

SEQ ID NO: 4888542 - DNA, 22 bp, Homo sapiens
aggagccccgaggccttctctg

SEQ ID NO: 4888543 - DNA, 14 bp, Homo sapiens
aggagcctgctggt

SEQ ID NO: 4888544 - DNA, 19 bp, Homo sapiens
aggagcctttttaaaacac

SEQ ID NO: 4888545 - DNA, 13 bp, Homo sapiens
aggagctaaggct

SEQ ID NO: 4888546 - DNA, 15 bp, Homo sapiens
aggagctaaggctct

SEQ ID NO: 4888547 - DNA, 19 bp, Homo sapiens
aggagctaaggctctatga

SEQ ID NO: 4888548 - DNA, 19 bp, Homo sapiens
aggagctcttcaggcctcc

SEQ ID NO: 4888549 - DNA, 21 bp, Homo sapiens
aggagctcttcaggcctccct

SEQ ID NO: 4888550 - DNA, 15 bp, Homo sapiens
aggagctgaggtttc

SEQ ID NO: 4888551 - DNA, 23 bp, Homo sapiens
aggaggaatcatgtcaggcctgt

SEQ ID NO: 4888552 - DNA, 17 bp, Homo sapiens
aggaggatgtccctggg

SEQ ID NO: 4888553 - DNA, 21 bp, Homo sapiens
aggaggattgcttgagcccag

SEQ ID NO: 4888554 - DNA, 16 bp, Homo sapiens
aggagggagacactgg

SEQ ID NO: 4888555 - DNA, 23 bp, Homo sapiens
aggagggagacactggcccctca

SEQ ID NO: 4888556 - DNA, 16 bp, Homo sapiens
aggaggggaagctgca

SEQ ID NO: 4888557 - DNA, 19 bp, Homo sapiens
aggaggggaagctgcagct

SEQ ID NO: 4888558 - DNA, 18 bp, Homo sapiens
aggagggtacagctgggc

SEQ ID NO: 4888559 - DNA, 14 bp, Homo sapiens
aggaggtgcctgga

SEQ ID NO: 4888560 - DNA, 14 bp, Homo sapiens
aggagtcccaagga

SEQ ID NO: 4888561 - DNA, 14 bp, Homo sapiens
aggagtgagcacta

SEQ ID NO: 4888562 - DNA, 21 bp, Homo sapiens
aggagtgggtgacaagagcct

SEQ ID NO: 4888563 - DNA, 14 bp, Homo sapiens
aggagtggtgcaga

SEQ ID NO: 4888564 - DNA, 18 bp, Homo sapiens
aggagtggtgcagacaga

SEQ ID NO: 4888565 - DNA, 19 bp, Homo sapiens
aggagtttgagaccagcct

SEQ ID NO: 4888566 - DNA, 14 bp, Homo sapiens
aggatagtattttt

SEQ ID NO: 4888567 - DNA, 16 bp, Homo sapiens
aggatagtatttttat

SEQ ID NO: 4888568 - DNA, 19 bp, Homo sapiens
aggatatccttatcagagc

SEQ ID NO: 4888569 - DNA, 20 bp, Homo sapiens
aggatatccttatcagagct

SEQ ID NO: 4888570 - DNA, 17 bp, Homo sapiens
aggatcagttaactatt

SEQ ID NO: 4888571 - DNA, 23 bp, Homo sapiens
aggatcagttaactattgcattt

SEQ ID NO: 4888572 - DNA, 22 bp, Homo sapiens
aggatcagttttttgttttaca

SEQ ID NO: 4888573 - DNA, 17 bp, Homo sapiens
aggatcatggtgtaata

SEQ ID NO: 4888574 - DNA, 18 bp, Homo sapiens
aggatcatggtgtaataa

SEQ ID NO: 4888575 - DNA, 22 bp, Homo sapiens
aggatcatggtgtaataagaca

SEQ ID NO: 4888576 - DNA, 21 bp, Homo sapiens
aggatcatttgttggaatgaa

SEQ ID NO: 4888577 - DNA, 20 bp, Homo sapiens
aggatgaatgaggtcccagg

SEQ ID NO: 4888578 - DNA, 21 bp, Homo sapiens
aggatgaatgaggtcccaggc

SEQ ID NO: 4888579 - DNA, 20 bp, Homo sapiens
aggatgacctggataactta

SEQ ID NO: 4888580 - DNA, 14 bp, Homo sapiens
aggatgagagccca

SEQ ID NO: 4888581 - DNA, 16 bp, Homo sapiens
aggatgagagcccaga

SEQ ID NO: 4888582 - DNA, 17 bp, Homo sapiens
aggatgagagcccagag

SEQ ID NO: 4888583 - DNA, 18 bp, Homo sapiens
aggatgagagcccagagg

SEQ ID NO: 4888584 - DNA, 18 bp, Homo sapiens
aggatgataagttccttt

SEQ ID NO: 4888585 - DNA, 16 bp, Homo sapiens
aggatgtcacagggcc

SEQ ID NO: 4888586 - DNA, 17 bp, Homo sapiens
aggatgtccctgggcca

SEQ ID NO: 4888587 - DNA, 20 bp, Homo sapiens
aggatgtccctgggccaggg

SEQ ID NO: 4888588 - DNA, 18 bp, Homo sapiens
aggatgttctgggacaca

SEQ ID NO: 4888589 - DNA, 17 bp, Homo sapiens
aggattgcttgagccca

SEQ ID NO: 4888590 - DNA, 18 bp, Homo sapiens
aggattgcttgagcccag

SEQ ID NO: 4888591 - DNA, 20 bp, Homo sapiens
aggattgcttgagcccagga

SEQ ID NO: 4888592 - DNA, 13 bp, Homo sapiens
aggattttatacc

SEQ ID NO: 4888593 - DNA, 13 bp, Homo sapiens
aggcaaaattgca

SEQ ID NO: 4888594 - DNA, 17 bp, Homo sapiens
aggcaaaattgcaaatc

SEQ ID NO: 4888595 - DNA, 14 bp, Homo sapiens
aggcaaatgtgtac

SEQ ID NO: 4888596 - DNA, 16 bp, Homo sapiens
aggcaacatccaaaat

SEQ ID NO: 4888597 - DNA, 19 bp, Homo sapiens
aggcaagcacctcctgcct

SEQ ID NO: 4888598 - DNA, 15 bp, Homo sapiens
aggcaatgctggctg

SEQ ID NO: 4888599 - DNA, 15 bp, Homo sapiens
aggcacaggatgctg

SEQ ID NO: 4888600 - DNA, 21 bp, Homo sapiens
aggcacccaccatcatgtctg

SEQ ID NO: 4888601 - DNA, 22 bp, Homo sapiens
aggcacccaccatcatgtctgg

SEQ ID NO: 4888602 - DNA, 17 bp, Homo sapiens
aggcaccgctgatgggg

SEQ ID NO: 4888603 - DNA, 16 bp, Homo sapiens
aggcactctgttattt

SEQ ID NO: 4888604 - DNA, 17 bp, Homo sapiens
aggcactgaagtgctta

SEQ ID NO: 4888605 - DNA, 16 bp, Homo sapiens
aggcacttaagcacaa

SEQ ID NO: 4888606 - DNA, 14 bp, Homo sapiens
aggcacttattgta

SEQ ID NO: 4888607 - DNA, 17 bp, Homo sapiens
aggcacttattgtaaat

SEQ ID NO: 4888608 - DNA, 15 bp, Homo sapiens
aggcagacagcaggc

SEQ ID NO: 4888609 - DNA, 11 bp, Homo sapiens
aggcagagagc

SEQ ID NO: 4888610 - DNA, 19 bp, Homo sapiens
aggcagagtttgccttcct

SEQ ID NO: 4888611 - DNA, 20 bp, Homo sapiens
aggcagatctgtgccccatg

SEQ ID NO: 4888612 - DNA, 19 bp, Homo sapiens
aggcagccccattctgcct

SEQ ID NO: 4888613 - DNA, 20 bp, Homo sapiens
aggcagccccattctgcctg

SEQ ID NO: 4888614 - DNA, 21 bp, Homo sapiens
aggcagccccattctgcctgc

SEQ ID NO: 4888615 - DNA, 13 bp, Homo sapiens
aggcagccgccct

SEQ ID NO: 4888616 - DNA, 16 bp, Homo sapiens
aggcagcctccagcct

SEQ ID NO: 4888617 - DNA, 16 bp, Homo sapiens
aggcaggaagggcagg

SEQ ID NO: 4888618 - DNA, 21 bp, Homo sapiens
aggcaggccaaggccttctcc

SEQ ID NO: 4888619 - DNA, 14 bp, Homo sapiens
aggcaggccgactg

SEQ ID NO: 4888620 - DNA, 12 bp, Homo sapiens
aggcagggtctc

SEQ ID NO: 4888621 - DNA, 18 bp, Homo sapiens
aggcagggtctcactctg

SEQ ID NO: 4888622 - DNA, 15 bp, Homo sapiens
aggcaggtagccagg

SEQ ID NO: 4888623 - DNA, 22 bp, Homo sapiens
aggcaggtcttgaactcctggc

SEQ ID NO: 4888624 - DNA, 13 bp, Homo sapiens
aggcaggtgcctg

SEQ ID NO: 4888625 - DNA, 16 bp, Homo sapiens
aggcatctgatttgca

SEQ ID NO: 4888626 - DNA, 13 bp, Homo sapiens
aggcatgcctctg

SEQ ID NO: 4888627 - DNA, 23 bp, Homo sapiens
aggcatgcctctgatatgggact

SEQ ID NO: 4888628 - DNA, 16 bp, Homo sapiens
aggcatggccctgggg

SEQ ID NO: 4888629 - DNA, 19 bp, Homo sapiens
aggcatgttctctgaggac

SEQ ID NO: 4888630 - DNA, 20 bp, Homo sapiens
aggcatgttctctgaggaca

SEQ ID NO: 4888631 - DNA, 22 bp, Homo sapiens
aggcatgttctctgaggacact

SEQ ID NO: 4888632 - DNA, 19 bp, Homo sapiens
aggcattaatgtttctatc

SEQ ID NO: 4888633 - DNA, 11 bp, Homo sapiens
aggcatttgtt

SEQ ID NO: 4888634 - DNA, 14 bp, Homo sapiens
aggccaaactgctg

SEQ ID NO: 4888635 - DNA, 16 bp, Homo sapiens
aggccaaaggctggtg

SEQ ID NO: 4888636 - DNA, 17 bp, Homo sapiens
aggccaaggccttctcc

SEQ ID NO: 4888637 - DNA, 17 bp, Homo sapiens
aggccagagtggcctgg

SEQ ID NO: 4888638 - DNA, 14 bp, Homo sapiens
aggccagccccacc

SEQ ID NO: 4888639 - DNA, 17 bp, Homo sapiens
aggccagccccacccag

SEQ ID NO: 4888640 - DNA, 18 bp, Homo sapiens
aggccagccccacccagg

SEQ ID NO: 4888641 - DNA, 15 bp, Homo sapiens
aggccatggcagaat

SEQ ID NO: 4888642 - DNA, 14 bp, Homo sapiens
aggccatgggcctc

SEQ ID NO: 4888643 - DNA, 16 bp, Homo sapiens
aggccatgggcctcct

SEQ ID NO: 4888644 - DNA, 14 bp, Homo sapiens
aggcccaactgtga

SEQ ID NO: 4888645 - DNA, 13 bp, Homo sapiens
aggccccactgat

SEQ ID NO: 4888646 - DNA, 15 bp, Homo sapiens
aggccccactgatgc

SEQ ID NO: 4888647 - DNA, 20 bp, Homo sapiens
aggccccttctctccctgcc

SEQ ID NO: 4888648 - DNA, 18 bp, Homo sapiens
aggcccggctccaggctc

SEQ ID NO: 4888649 - DNA, 21 bp, Homo sapiens
aggccctcctgtgctggggga

SEQ ID NO: 4888650 - DNA, 21 bp, Homo sapiens
aggccctgctcctgcagcatg

SEQ ID NO: 4888651 - DNA, 22 bp, Homo sapiens
aggccctgctcctgcagcatgg

SEQ ID NO: 4888652 - DNA, 15 bp, Homo sapiens
aggcccttcctctcc

SEQ ID NO: 4888653 - DNA, 13 bp, Homo sapiens
aggccggccagcc

SEQ ID NO: 4888654 - DNA, 15 bp, Homo sapiens
aggccggccagcctc

SEQ ID NO: 4888655 - DNA, 16 bp, Homo sapiens
aggcctataaccccag

SEQ ID NO: 4888656 - DNA, 17 bp, Homo sapiens
aggcctcacctctaccc

SEQ ID NO: 4888657 - DNA, 18 bp, Homo sapiens
aggcctcacctctaccca

SEQ ID NO: 4888658 - DNA, 15 bp, Homo sapiens
aggcctccctctctc

SEQ ID NO: 4888659 - DNA, 22 bp, Homo sapiens
aggcctccctctctcttctgct

SEQ ID NO: 4888660 - DNA, 13 bp, Homo sapiens
aggcctctgtgtc

SEQ ID NO: 4888661 - DNA, 16 bp, Homo sapiens
aggcctctgtgtcctt

SEQ ID NO: 4888662 - DNA, 23 bp, Homo sapiens
aggcctctgtgtccttccctgca

SEQ ID NO: 4888663 - DNA, 14 bp, Homo sapiens
aggcctgcacacaa

SEQ ID NO: 4888664 - DNA, 13 bp, Homo sapiens
aggcctgcctgtt

SEQ ID NO: 4888665 - DNA, 16 bp, Homo sapiens
aggcctggccagatgc

SEQ ID NO: 4888666 - DNA, 23 bp, Homo sapiens
aggcctggccagatgcaccagcc

SEQ ID NO: 4888667 - DNA, 12 bp, Homo sapiens
aggcctgggtgg

SEQ ID NO: 4888668 - DNA, 12 bp, Homo sapiens
aggcctgtgtgt

SEQ ID NO: 4888669 - DNA, 15 bp, Homo sapiens
aggccttccagctgc

SEQ ID NO: 4888670 - DNA, 16 bp, Homo sapiens
aggccttccagctgct

SEQ ID NO: 4888671 - DNA, 18 bp, Homo sapiens
aggccttccagctgctgt

SEQ ID NO: 4888672 - DNA, 16 bp, Homo sapiens
aggccttcctctctcc

SEQ ID NO: 4888673 - DNA, 17 bp, Homo sapiens
aggccttctctgaagga

SEQ ID NO: 4888674 - DNA, 16 bp, Homo sapiens
aggcggcccctcccgc

SEQ ID NO: 4888675 - DNA, 13 bp, Homo sapiens
aggctaatgtcaa

SEQ ID NO: 4888676 - DNA, 17 bp, Homo sapiens
aggctatgtgattacaa

SEQ ID NO: 4888677 - DNA, 19 bp, Homo sapiens
aggctattattttcactgt

SEQ ID NO: 4888678 - DNA, 15 bp, Homo sapiens
aggctcaacaataaa

SEQ ID NO: 4888679 - DNA, 22 bp, Homo sapiens
aggctccaccccatccagttca

SEQ ID NO: 4888680 - DNA, 15 bp, Homo sapiens
aggctccgcccttag

SEQ ID NO: 4888681 - DNA, 17 bp, Homo sapiens
aggctctagatcataag

SEQ ID NO: 4888682 - DNA, 13 bp, Homo sapiens
aggctctgagagt

SEQ ID NO: 4888683 - DNA, 21 bp, Homo sapiens
aggctctgagagtctagattc

SEQ ID NO: 4888684 - DNA, 23 bp, Homo sapiens
aggctctgagagtctagattctc

SEQ ID NO: 4888685 - DNA, 22 bp, Homo sapiens
aggctctgcttctccaaggaaa

SEQ ID NO: 4888686 - DNA, 19 bp, Homo sapiens
aggctgcagctggacagag

SEQ ID NO: 4888687 - DNA, 20 bp, Homo sapiens
aggctgcagctggacagagg

SEQ ID NO: 4888688 - DNA, 22 bp, Homo sapiens
aggctgcccccggccccctggt

SEQ ID NO: 4888689 - DNA, 13 bp, Homo sapiens
aggctggcgtgca

SEQ ID NO: 4888690 - DNA, 18 bp, Homo sapiens
aggctgggccatgtccaa

SEQ ID NO: 4888691 - DNA, 20 bp, Homo sapiens
aggctgggccatgtccaaag

SEQ ID NO: 4888692 - DNA, 21 bp, Homo sapiens
aggctgggccatgtccaaaga

SEQ ID NO: 4888693 - DNA, 22 bp, Homo sapiens
aggctgggccatgtccaaagag

SEQ ID NO: 4888694 - DNA, 14 bp, Homo sapiens
aggctgggcttcag

SEQ ID NO: 4888695 - DNA, 12 bp, Homo sapiens
aggctggtggga

SEQ ID NO: 4888696 - DNA, 18 bp, Homo sapiens
aggctggtgggaggggcg

SEQ ID NO: 4888697 - DNA, 13 bp, Homo sapiens
aggctgtatccca

SEQ ID NO: 4888698 - DNA, 21 bp, Homo sapiens
aggctgtatcccatgagcctc

SEQ ID NO: 4888699 - DNA, 22 bp, Homo sapiens
aggctgtatcccatgagcctca

SEQ ID NO: 4888700 - DNA, 15 bp, Homo sapiens
aggctttgtgttgta

SEQ ID NO: 4888701 - DNA, 16 bp, Homo sapiens
agggaagctggcctga

SEQ ID NO: 4888702 - DNA, 23 bp, Homo sapiens
agggaagctggcctgagagggga

SEQ ID NO: 4888703 - DNA, 15 bp, Homo sapiens
agggaatccaagcct

SEQ ID NO: 4888704 - DNA, 15 bp, Homo sapiens
agggaatcctgacct

SEQ ID NO: 4888705 - DNA, 14 bp, Homo sapiens
agggactctgaagc

SEQ ID NO: 4888706 - DNA, 20 bp, Homo sapiens
agggactctgaagcctctgg

SEQ ID NO: 4888707 - DNA, 20 bp, Homo sapiens
agggagacactggcccctca

SEQ ID NO: 4888708 - DNA, 20 bp, Homo sapiens
agggagcctagaagctggtg

SEQ ID NO: 4888709 - DNA, 12 bp, Homo sapiens
agggaggcagcc

SEQ ID NO: 4888710 - DNA, 16 bp, Homo sapiens
agggaggcagcctcca

SEQ ID NO: 4888711 - DNA, 18 bp, Homo sapiens
agggaggcgggggctgcc

SEQ ID NO: 4888712 - DNA, 17 bp, Homo sapiens
agggaggtgaccccagg

SEQ ID NO: 4888713 - DNA, 20 bp, Homo sapiens
agggagtgacagaggcagcc

SEQ ID NO: 4888714 - DNA, 24 bp, Homo sapiens
agggagtgctggctcacagtacag

SEQ ID NO: 4888715 - DNA, 19 bp, Homo sapiens
agggatcatcatgcagctc

SEQ ID NO: 4888716 - DNA, 18 bp, Homo sapiens
agggattcacatctgcat

SEQ ID NO: 4888717 - DNA, 19 bp, Homo sapiens
agggattcaggctgcttgg

SEQ ID NO: 4888718 - DNA, 20 bp, Homo sapiens
agggcaaatgacatgcactg

SEQ ID NO: 4888719 - DNA, 21 bp, Homo sapiens
agggcacaccgggcactcaga

SEQ ID NO: 4888720 - DNA, 21 bp, Homo sapiens
agggcaccctagttctacctc

SEQ ID NO: 4888721 - DNA, 21 bp, Homo sapiens
agggcaccctgtggccctggc

SEQ ID NO: 4888722 - DNA, 17 bp, Homo sapiens
agggcactggtggcccg

SEQ ID NO: 4888723 - DNA, 19 bp, Homo sapiens
agggcagaaaggttctgcc

SEQ ID NO: 4888724 - DNA, 12 bp, Homo sapiens
agggcagcccca

SEQ ID NO: 4888725 - DNA, 23 bp, Homo sapiens
agggcaggaaggagagcctgctg

SEQ ID NO: 4888726 - DNA, 22 bp, Homo sapiens
agggcagggaccacaccctgta

SEQ ID NO: 4888727 - DNA, 14 bp, Homo sapiens
agggcataaaacag

SEQ ID NO: 4888728 - DNA, 16 bp, Homo sapiens
agggcataaaacagct

SEQ ID NO: 4888729 - DNA, 21 bp, Homo sapiens
agggcatccataccagctcgc

SEQ ID NO: 4888730 - DNA, 15 bp, Homo sapiens
agggcatgccccggc

SEQ ID NO: 4888731 - DNA, 21 bp, Homo sapiens
agggcatgccccggccacctc

SEQ ID NO: 4888732 - DNA, 22 bp, Homo sapiens
agggcatgccccggccacctct

SEQ ID NO: 4888733 - DNA, 13 bp, Homo sapiens
agggcatgccttg

SEQ ID NO: 4888734 - DNA, 15 bp, Homo sapiens
agggcatgccttgtg

SEQ ID NO: 4888735 - DNA, 14 bp, Homo sapiens
agggcattctttcc

SEQ ID NO: 4888736 - DNA, 16 bp, Homo sapiens
agggccaagacttggc

SEQ ID NO: 4888737 - DNA, 17 bp, Homo sapiens
agggccaggactgagcc

SEQ ID NO: 4888738 - DNA, 13 bp, Homo sapiens
agggccaggcagg

SEQ ID NO: 4888739 - DNA, 21 bp, Homo sapiens
agggccaggcaggtgcctgga

SEQ ID NO: 4888740 - DNA, 22 bp, Homo sapiens
agggccaggcaggtgcctggac

SEQ ID NO: 4888741 - DNA, 17 bp, Homo sapiens
agggccagtcctgcctg

SEQ ID NO: 4888742 - DNA, 19 bp, Homo sapiens
agggccagtggggcctgtg

SEQ ID NO: 4888743 - DNA, 20 bp, Homo sapiens
agggccagtggggcctgtgg

SEQ ID NO: 4888744 - DNA, 23 bp, Homo sapiens
agggcccagagagggtggtgacc

SEQ ID NO: 4888745 - DNA, 15 bp, Homo sapiens
agggcccagagcagg

SEQ ID NO: 4888746 - DNA, 12 bp, Homo sapiens
agggcccaggag

SEQ ID NO: 4888747 - DNA, 13 bp, Homo sapiens
agggccctacctg

SEQ ID NO: 4888748 - DNA, 18 bp, Homo sapiens
agggcctggggcctgaga

SEQ ID NO: 4888749 - DNA, 19 bp, Homo sapiens
agggcctggggcctgagag

SEQ ID NO: 4888750 - DNA, 19 bp, Homo sapiens
agggcgggaggatgttctg

SEQ ID NO: 4888751 - DNA, 23 bp, Homo sapiens
agggcggggcacagattggagag

SEQ ID NO: 4888752 - DNA, 22 bp, Homo sapiens
agggctcagcggggacagctcc

SEQ ID NO: 4888753 - DNA, 11 bp, Homo sapiens
agggctcctcc

SEQ ID NO: 4888754 - DNA, 14 bp, Homo sapiens
agggctcctcccag

SEQ ID NO: 4888755 - DNA, 18 bp, Homo sapiens
agggctcctcccagcttg

SEQ ID NO: 4888756 - DNA, 14 bp, Homo sapiens
agggctcctgcagg

SEQ ID NO: 4888757 - DNA, 15 bp, Homo sapiens
agggctctgccccag

SEQ ID NO: 4888758 - DNA, 17 bp, Homo sapiens
agggctgacctgcctct

SEQ ID NO: 4888759 - DNA, 16 bp, Homo sapiens
agggctgagctgggga

SEQ ID NO: 4888760 - DNA, 13 bp, Homo sapiens
agggctgccacca

SEQ ID NO: 4888761 - DNA, 15 bp, Homo sapiens
agggctgccctgaga

SEQ ID NO: 4888762 - DNA, 22 bp, Homo sapiens
agggctggccccagggcaccct

SEQ ID NO: 4888763 - DNA, 14 bp, Homo sapiens
aggggaacagactg

SEQ ID NO: 4888764 - DNA, 17 bp, Homo sapiens
aggggaagcactcgtgt

SEQ ID NO: 4888765 - DNA, 14 bp, Homo sapiens
aggggaagctgcag

SEQ ID NO: 4888766 - DNA, 15 bp, Homo sapiens
aggggaagctgcagc

SEQ ID NO: 4888767 - DNA, 13 bp, Homo sapiens
aggggaatgtttg

SEQ ID NO: 4888768 - DNA, 19 bp, Homo sapiens
aggggaatgtttgcctctg

SEQ ID NO: 4888769 - DNA, 13 bp, Homo sapiens
aggggacaggcct

SEQ ID NO: 4888770 - DNA, 18 bp, Homo sapiens
aggggacaggcctcacct

SEQ ID NO: 4888771 - DNA, 14 bp, Homo sapiens
aggggactcagccc

SEQ ID NO: 4888772 - DNA, 22 bp, Homo sapiens
aggggactcagccctgaggtga

SEQ ID NO: 4888773 - DNA, 18 bp, Homo sapiens
aggggagtcaccttccct

SEQ ID NO: 4888774 - DNA, 22 bp, Homo sapiens
aggggagtcaccttcccttgcc

SEQ ID NO: 4888775 - DNA, 19 bp, Homo sapiens
aggggatggaattcttcct

SEQ ID NO: 4888776 - DNA, 15 bp, Homo sapiens
aggggcatctgcccc

SEQ ID NO: 4888777 - DNA, 17 bp, Homo sapiens
aggggcatctgcccctc

SEQ ID NO: 4888778 - DNA, 22 bp, Homo sapiens
aggggcatctgcccctccccca

SEQ ID NO: 4888779 - DNA, 17 bp, Homo sapiens
aggggcccaaggcggcc

SEQ ID NO: 4888780 - DNA, 20 bp, Homo sapiens
aggggcccaaggcggcccct

SEQ ID NO: 4888781 - DNA, 12 bp, Homo sapiens
aggggcctggca

SEQ ID NO: 4888782 - DNA, 16 bp, Homo sapiens
aggggcgcccacctcc

SEQ ID NO: 4888783 - DNA, 18 bp, Homo sapiens
aggggcggtgcccacacc

SEQ ID NO: 4888784 - DNA, 17 bp, Homo sapiens
aggggctacaagaggga

SEQ ID NO: 4888785 - DNA, 17 bp, Homo sapiens
aggggctctcagctcag

SEQ ID NO: 4888786 - DNA, 22 bp, Homo sapiens
aggggctctcagctcagcgcca

SEQ ID NO: 4888787 - DNA, 15 bp, Homo sapiens
aggggctctggagag

SEQ ID NO: 4888788 - DNA, 17 bp, Homo sapiens
aggggctctggagagaa

SEQ ID NO: 4888789 - DNA, 22 bp, Homo sapiens
agggggaaggtggggtcctgga

SEQ ID NO: 4888790 - DNA, 20 bp, Homo sapiens
agggggactgctgctgcctg

SEQ ID NO: 4888791 - DNA, 15 bp, Homo sapiens
agggggaggggaagt

SEQ ID NO: 4888792 - DNA, 18 bp, Homo sapiens
aggggtcccagccacccc

SEQ ID NO: 4888793 - DNA, 19 bp, Homo sapiens
aggggtcccagccaccccg

SEQ ID NO: 4888794 - DNA, 15 bp, Homo sapiens
aggggtgtggctcct

SEQ ID NO: 4888795 - DNA, 14 bp, Homo sapiens
agggtacagctggg

SEQ ID NO: 4888796 - DNA, 13 bp, Homo sapiens
agggtacatttat

SEQ ID NO: 4888797 - DNA, 18 bp, Homo sapiens
agggtacatttataattg

SEQ ID NO: 4888798 - DNA, 15 bp, Homo sapiens
agggtactaaattta

SEQ ID NO: 4888799 - DNA, 17 bp, Homo sapiens
agggtactaaatttaaa

SEQ ID NO: 4888800 - DNA, 18 bp, Homo sapiens
agggtatcaggtgctgcc

SEQ ID NO: 4888801 - DNA, 15 bp, Homo sapiens
agggtccccacctgg

SEQ ID NO: 4888802 - DNA, 18 bp, Homo sapiens
agggtccccacctgggac

SEQ ID NO: 4888803 - DNA, 16 bp, Homo sapiens
agggtcctggctcctg

SEQ ID NO: 4888804 - DNA, 21 bp, Homo sapiens
agggtcctggctcctgagggg

SEQ ID NO: 4888805 - DNA, 18 bp, Homo sapiens
agggtcctttagtacctg

SEQ ID NO: 4888806 - DNA, 18 bp, Homo sapiens
agggtcgaaagctctaga

SEQ ID NO: 4888807 - DNA, 15 bp, Homo sapiens
agggtctatggggag

SEQ ID NO: 4888808 - DNA, 23 bp, Homo sapiens
agggtctcactatgttgcccagg

SEQ ID NO: 4888809 - DNA, 22 bp, Homo sapiens
agggtctcactctgtcgcccag

SEQ ID NO: 4888810 - DNA, 17 bp, Homo sapiens
agggtctctccctcagg

SEQ ID NO: 4888811 - DNA, 15 bp, Homo sapiens
agggtcttccctacc

SEQ ID NO: 4888812 - DNA, 23 bp, Homo sapiens
agggtggacttagaaagcagggg

SEQ ID NO: 4888813 - DNA, 14 bp, Homo sapiens
agggtggcccttgc

SEQ ID NO: 4888814 - DNA, 22 bp, Homo sapiens
agggtgggggccacctgcctgc

SEQ ID NO: 4888815 - DNA, 15 bp, Homo sapiens
agggtgggtgctcag

SEQ ID NO: 4888816 - DNA, 16 bp, Homo sapiens
agggtggtgacctctg

SEQ ID NO: 4888817 - DNA, 18 bp, Homo sapiens
agggtggtgacctctgcc

SEQ ID NO: 4888818 - DNA, 14 bp, Homo sapiens
agggttctggctgc

SEQ ID NO: 4888819 - DNA, 17 bp, Homo sapiens
agggttgctggagcctg

SEQ ID NO: 4888820 - DNA, 13 bp, Homo sapiens
agggttggcccct

SEQ ID NO: 4888821 - DNA, 18 bp, Homo sapiens
agggttggcccctgcccg

SEQ ID NO: 4888822 - DNA, 15 bp, Homo sapiens
agggttgggcccaga

SEQ ID NO: 4888823 - DNA, 22 bp, Homo sapiens
agggtttgaattgttttcttta

SEQ ID NO: 4888824 - DNA, 22 bp, Homo sapiens
agggtttttacctgtcacattg

SEQ ID NO: 4888825 - DNA, 19 bp, Homo sapiens
aggtaaaatgtatttttct

SEQ ID NO: 4888826 - DNA, 19 bp, Homo sapiens
aggtaacagaacagcttca

SEQ ID NO: 4888827 - DNA, 14 bp, Homo sapiens
aggtaatttttacc

SEQ ID NO: 4888828 - DNA, 21 bp, Homo sapiens
aggtaatttttaccctaatgt

SEQ ID NO: 4888829 - DNA, 16 bp, Homo sapiens
aggtacacagctctag

SEQ ID NO: 4888830 - DNA, 11 bp, Homo sapiens
aggtacagggt

SEQ ID NO: 4888831 - DNA, 22 bp, Homo sapiens
aggtaccagcaatatgtaaata

SEQ ID NO: 4888832 - DNA, 13 bp, Homo sapiens
aggtagaaaaagg

SEQ ID NO: 4888833 - DNA, 14 bp, Homo sapiens
aggtagaaaaaggg

SEQ ID NO: 4888834 - DNA, 16 bp, Homo sapiens
aggtagaaaaagggtc

SEQ ID NO: 4888835 - DNA, 17 bp, Homo sapiens
aggtagaaaaagggtca

SEQ ID NO: 4888836 - DNA, 20 bp, Homo sapiens
aggtagaccaggatttctaa

SEQ ID NO: 4888837 - DNA, 18 bp, Homo sapiens
aggtagcttacctgacac

SEQ ID NO: 4888838 - DNA, 19 bp, Homo sapiens
aggtagcttacctgacaca

SEQ ID NO: 4888839 - DNA, 20 bp, Homo sapiens
aggtattttgtttcttttaa

SEQ ID NO: 4888840 - DNA, 22 bp, Homo sapiens
aggtcacacgaccggggccagc

SEQ ID NO: 4888841 - DNA, 12 bp, Homo sapiens
aggtcaccagca

SEQ ID NO: 4888842 - DNA, 14 bp, Homo sapiens
aggtcagagcctgc

SEQ ID NO: 4888843 - DNA, 12 bp, Homo sapiens
aggtcaggccct

SEQ ID NO: 4888844 - DNA, 16 bp, Homo sapiens
aggtcagggagtgctg

SEQ ID NO: 4888845 - DNA, 11 bp, Homo sapiens
aggtccagccc

SEQ ID NO: 4888846 - DNA, 17 bp, Homo sapiens
aggtcccacctccagcc

SEQ ID NO: 4888847 - DNA, 19 bp, Homo sapiens
aggtcccacctccagcccg

SEQ ID NO: 4888848 - DNA, 17 bp, Homo sapiens
aggtctcttctcccaga

SEQ ID NO: 4888849 - DNA, 18 bp, Homo sapiens
aggtctcttctcccagaa

SEQ ID NO: 4888850 - DNA, 20 bp, Homo sapiens
aggtcttcatcgaatctact

SEQ ID NO: 4888851 - DNA, 22 bp, Homo sapiens
aggtcttgaactcctggcctca

SEQ ID NO: 4888852 - DNA, 16 bp, Homo sapiens
aggtgaaagggagcta

SEQ ID NO: 4888853 - DNA, 14 bp, Homo sapiens
aggtgatccaccca

SEQ ID NO: 4888854 - DNA, 20 bp, Homo sapiens
aggtgatccacccacctcag

SEQ ID NO: 4888855 - DNA, 23 bp, Homo sapiens
aggtgatccacccacctcagcct

SEQ ID NO: 4888856 - DNA, 22 bp, Homo sapiens
aggtgcaatttcaaggttctaa

SEQ ID NO: 4888857 - DNA, 13 bp, Homo sapiens
aggtgcctggagt

SEQ ID NO: 4888858 - DNA, 19 bp, Homo sapiens
aggtgctggaggtgggagc

SEQ ID NO: 4888859 - DNA, 18 bp, Homo sapiens
aggtggaaggcagacagc

SEQ ID NO: 4888860 - DNA, 14 bp, Homo sapiens
aggtggccactcca

SEQ ID NO: 4888861 - DNA, 17 bp, Homo sapiens
aggtggccactccagac

SEQ ID NO: 4888862 - DNA, 18 bp, Homo sapiens
aggtgggcttcagtaagt

SEQ ID NO: 4888863 - DNA, 16 bp, Homo sapiens
aggtggggcagcttga

SEQ ID NO: 4888864 - DNA, 23 bp, Homo sapiens
aggtggggcagcttgagggttgg

SEQ ID NO: 4888865 - DNA, 15 bp, Homo sapiens
aggtggtcagtaaat

SEQ ID NO: 4888866 - DNA, 16 bp, Homo sapiens
aggtggtgtgatctta

SEQ ID NO: 4888867 - DNA, 13 bp, Homo sapiens
aggtgtcacatgg

SEQ ID NO: 4888868 - DNA, 23 bp, Homo sapiens
aggtgtgaaccaccacacccagc

SEQ ID NO: 4888869 - DNA, 13 bp, Homo sapiens
aggtgtgaggagg

SEQ ID NO: 4888870 - DNA, 21 bp, Homo sapiens
aggtgtgagtcaccaagccca

SEQ ID NO: 4888871 - DNA, 22 bp, Homo sapiens
aggtgtgagtcaccaagcccag

SEQ ID NO: 4888872 - DNA, 16 bp, Homo sapiens
aggtgttactgtaatt

SEQ ID NO: 4888873 - DNA, 23 bp, Homo sapiens
aggtgttttttatgaagtgcgtg

SEQ ID NO: 4888874 - DNA, 20 bp, Homo sapiens
aggttatcgaaataacaatg

SEQ ID NO: 4888875 - DNA, 20 bp, Homo sapiens
aggttcagtattatgtagtt

SEQ ID NO: 4888876 - DNA, 16 bp, Homo sapiens
aggttccatcctttac

SEQ ID NO: 4888877 - DNA, 18 bp, Homo sapiens
aggttccctgttcttcct

SEQ ID NO: 4888878 - DNA, 15 bp, Homo sapiens
aggttctaaagttct

SEQ ID NO: 4888879 - DNA, 18 bp, Homo sapiens
aggttctaaagttctaag

SEQ ID NO: 4888880 - DNA, 23 bp, Homo sapiens
aggttctaaagttctaagattct

SEQ ID NO: 4888881 - DNA, 14 bp, Homo sapiens
aggttctgcctgct

SEQ ID NO: 4888882 - DNA, 19 bp, Homo sapiens
aggttcttcatccctttcc

SEQ ID NO: 4888883 - DNA, 15 bp, Homo sapiens
aggttggaagagaat

SEQ ID NO: 4888884 - DNA, 17 bp, Homo sapiens
aggtttcaaagatgctg

SEQ ID NO: 4888885 - DNA, 15 bp, Homo sapiens
aggtttgtgttttct

SEQ ID NO: 4888886 - DNA, 14 bp, Homo sapiens
aggttttaggttct

SEQ ID NO: 4888887 - DNA, 23 bp, Homo sapiens
aggttttggatcttgaatgtggt

SEQ ID NO: 4888888 - DNA, 12 bp, Homo sapiens
aggttttgttgt

SEQ ID NO: 4888889 - DNA, 17 bp, Homo sapiens
aggttttgttgttttat

SEQ ID NO: 4888890 - DNA, 19 bp, Homo sapiens
aggtttttgtttgtttcct

SEQ ID NO: 4888891 - DNA, 16 bp, Homo sapiens
agtaaaatttatttca

SEQ ID NO: 4888892 - DNA, 17 bp, Homo sapiens
agtaaaatttatttcat

SEQ ID NO: 4888893 - DNA, 23 bp, Homo sapiens
agtaaagccattaaatgaatatt

SEQ ID NO: 4888894 - DNA, 21 bp, Homo sapiens
agtaaatattgaggctttgtg

SEQ ID NO: 4888895 - DNA, 14 bp, Homo sapiens
agtaaccatttgca

SEQ ID NO: 4888896 - DNA, 11 bp, Homo sapiens
agtaactccca

SEQ ID NO: 4888897 - DNA, 15 bp, Homo sapiens
agtaacttggctttc

SEQ ID NO: 4888898 - DNA, 14 bp, Homo sapiens
agtaatagagcaaa

SEQ ID NO: 4888899 - DNA, 13 bp, Homo sapiens
agtaatctgtaca

SEQ ID NO: 4888900 - DNA, 15 bp, Homo sapiens
agtaattatgcacta

SEQ ID NO: 4888901 - DNA, 15 bp, Homo sapiens
agtaattcaagaaaa

SEQ ID NO: 4888902 - DNA, 18 bp, Homo sapiens
agtaattgacatgtgcca

SEQ ID NO: 4888903 - DNA, 13 bp, Homo sapiens
agtacaaatgcct

SEQ ID NO: 4888904 - DNA, 16 bp, Homo sapiens
agtacaaatgccttaa

SEQ ID NO: 4888905 - DNA, 22 bp, Homo sapiens
agtacaaatgccttaaaatgga

SEQ ID NO: 4888906 - DNA, 18 bp, Homo sapiens
agtacacaataagcaaaa

SEQ ID NO: 4888907 - DNA, 19 bp, Homo sapiens
agtacacttttatgagctt

SEQ ID NO: 4888908 - DNA, 19 bp, Homo sapiens
agtacatatttattttctt

SEQ ID NO: 4888909 - DNA, 21 bp, Homo sapiens
agtacatatttattttctttt

SEQ ID NO: 4888910 - DNA, 22 bp, Homo sapiens
agtacatatttattttcttttg

SEQ ID NO: 4888911 - DNA, 16 bp, Homo sapiens
agtacatttggagaca

SEQ ID NO: 4888912 - DNA, 17 bp, Homo sapiens
agtactaacacaaggac

SEQ ID NO: 4888913 - DNA, 18 bp, Homo sapiens
agtactaacacaaggaca

SEQ ID NO: 4888914 - DNA, 20 bp, Homo sapiens
agtactgtaataatacctca

SEQ ID NO: 4888915 - DNA, 21 bp, Homo sapiens
agtactgtttaccatttttca

SEQ ID NO: 4888916 - DNA, 12 bp, Homo sapiens
agtacttctttt

SEQ ID NO: 4888917 - DNA, 22 bp, Homo sapiens
agtacttgagtgtaatgtttgt

SEQ ID NO: 4888918 - DNA, 20 bp, Homo sapiens
agtacttgtgaaacacagct

SEQ ID NO: 4888919 - DNA, 21 bp, Homo sapiens
agtacttgtgaaacacagctg

SEQ ID NO: 4888920 - DNA, 22 bp, Homo sapiens
agtacttgtgaaacacagctgt

SEQ ID NO: 4888921 - DNA, 24 bp, Homo sapiens
agtacttgtgaaacacagctgttc

SEQ ID NO: 4888922 - DNA, 15 bp, Homo sapiens
agtagaattgcattg

SEQ ID NO: 4888923 - DNA, 11 bp, Homo sapiens
agtagagacag

SEQ ID NO: 4888924 - DNA, 13 bp, Homo sapiens
agtagagccagct

SEQ ID NO: 4888925 - DNA, 15 bp, Homo sapiens
agtagatattacttt

SEQ ID NO: 4888926 - DNA, 17 bp, Homo sapiens
agtagatattactttat

SEQ ID NO: 4888927 - DNA, 15 bp, Homo sapiens
agtagatggtgaaat

SEQ ID NO: 4888928 - DNA, 20 bp, Homo sapiens
agtagccctttctgtgtgca

SEQ ID NO: 4888929 - DNA, 18 bp, Homo sapiens
agtagcttgctccctgtg

SEQ ID NO: 4888930 - DNA, 23 bp, Homo sapiens
agtaggggaggagcacagtttgt

SEQ ID NO: 4888931 - DNA, 17 bp, Homo sapiens
agtataaccatatgata

SEQ ID NO: 4888932 - DNA, 14 bp, Homo sapiens
agtataagaaatgc

SEQ ID NO: 4888933 - DNA, 14 bp, Homo sapiens
agtatagagagaag

SEQ ID NO: 4888934 - DNA, 16 bp, Homo sapiens
agtatagagagaagtt

SEQ ID NO: 4888935 - DNA, 17 bp, Homo sapiens
agtatatcatgtaaaga

SEQ ID NO: 4888936 - DNA, 21 bp, Homo sapiens
agtatatcatgtaaagaaatg

SEQ ID NO: 4888937 - DNA, 12 bp, Homo sapiens
agtatatgtgag

SEQ ID NO: 4888938 - DNA, 15 bp, Homo sapiens
agtatatttaaactc

SEQ ID NO: 4888939 - DNA, 15 bp, Homo sapiens
agtatcaggtctccc

SEQ ID NO: 4888940 - DNA, 13 bp, Homo sapiens
agtatcagtgttt

SEQ ID NO: 4888941 - DNA, 16 bp, Homo sapiens
agtatcagtgttttaa

SEQ ID NO: 4888942 - DNA, 18 bp, Homo sapiens
agtatcagtgttttaaat

SEQ ID NO: 4888943 - DNA, 20 bp, Homo sapiens
agtatcagtgttttaaattc

SEQ ID NO: 4888944 - DNA, 22 bp, Homo sapiens
agtatcagtgttttaaattctg

SEQ ID NO: 4888945 - DNA, 23 bp, Homo sapiens
agtatccaggctttgtacagagt

SEQ ID NO: 4888946 - DNA, 18 bp, Homo sapiens
agtatcccacatccaact

SEQ ID NO: 4888947 - DNA, 17 bp, Homo sapiens
agtatctatatatgtgt

SEQ ID NO: 4888948 - DNA, 19 bp, Homo sapiens
agtatctatatatgtgtat

SEQ ID NO: 4888949 - DNA, 22 bp, Homo sapiens
agtatctatatatgtgtatgta

SEQ ID NO: 4888950 - DNA, 16 bp, Homo sapiens
agtatgaataaagaca

SEQ ID NO: 4888951 - DNA, 18 bp, Homo sapiens
agtatgacgctgatacat

SEQ ID NO: 4888952 - DNA, 16 bp, Homo sapiens
agtatgtaaagtatgt

SEQ ID NO: 4888953 - DNA, 14 bp, Homo sapiens
agtatgtctgatgg

SEQ ID NO: 4888954 - DNA, 19 bp, Homo sapiens
agtattaaaacattggatt

SEQ ID NO: 4888955 - DNA, 20 bp, Homo sapiens
agtattagactggaagttca

SEQ ID NO: 4888956 - DNA, 15 bp, Homo sapiens
agtattcttgtcaaa

SEQ ID NO: 4888957 - DNA, 18 bp, Homo sapiens
agtattggggtctgaccc

SEQ ID NO: 4888958 - DNA, 16 bp, Homo sapiens
agtatttatttatgta

SEQ ID NO: 4888959 - DNA, 18 bp, Homo sapiens
agtatttatttatgtact

SEQ ID NO: 4888960 - DNA, 15 bp, Homo sapiens
agtatttattttgta

SEQ ID NO: 4888961 - DNA, 17 bp, Homo sapiens
agtatttattttgtaat

SEQ ID NO: 4888962 - DNA, 18 bp, Homo sapiens
agtatttattttgtaatt

SEQ ID NO: 4888963 - DNA, 13 bp, Homo sapiens
agtatttcagtgt

SEQ ID NO: 4888964 - DNA, 12 bp, Homo sapiens
agtatttgaatt

SEQ ID NO: 4888965 - DNA, 17 bp, Homo sapiens
agtatttgggaagtgaa

SEQ ID NO: 4888966 - DNA, 14 bp, Homo sapiens
agtattttgaagtt

SEQ ID NO: 4888967 - DNA, 19 bp, Homo sapiens
agtattttgaagtttacat

SEQ ID NO: 4888968 - DNA, 22 bp, Homo sapiens
agtattttgaagtttacatttt

SEQ ID NO: 4888969 - DNA, 23 bp, Homo sapiens
agtcaaatggtaggcatttccta

SEQ ID NO: 4888970 - DNA, 14 bp, Homo sapiens
agtcaatcatttct

SEQ ID NO: 4888971 - DNA, 15 bp, Homo sapiens
agtcaatcatttctc

SEQ ID NO: 4888972 - DNA, 23 bp, Homo sapiens
agtcacacagtgagtcgaggaca

SEQ ID NO: 4888973 - DNA, 23 bp, Homo sapiens
agtcacatggcctatgcacatat

SEQ ID NO: 4888974 - DNA, 15 bp, Homo sapiens
agtcaccaagcccag

SEQ ID NO: 4888975 - DNA, 18 bp, Homo sapiens
agtcaccactccattccc

SEQ ID NO: 4888976 - DNA, 16 bp, Homo sapiens
agtcaccttcccttgc

SEQ ID NO: 4888977 - DNA, 18 bp, Homo sapiens
agtcaccttcccttgcca

SEQ ID NO: 4888978 - DNA, 13 bp, Homo sapiens
agtcactgcacag

SEQ ID NO: 4888979 - DNA, 22 bp, Homo sapiens
agtcagagcccctacagcattg

SEQ ID NO: 4888980 - DNA, 23 bp, Homo sapiens
agtcagagcccctacagcattgt

SEQ ID NO: 4888981 - DNA, 14 bp, Homo sapiens
agtcagggcccaga

SEQ ID NO: 4888982 - DNA, 15 bp, Homo sapiens
agtcagggcccagag

SEQ ID NO: 4888983 - DNA, 16 bp, Homo sapiens
agtcagggcccagagg

SEQ ID NO: 4888984 - DNA, 20 bp, Homo sapiens
agtcagggcccagaggctga

SEQ ID NO: 4888985 - DNA, 16 bp, Homo sapiens
agtcagttgaaattct

SEQ ID NO: 4888986 - DNA, 15 bp, Homo sapiens
agtcatcatcagggc

SEQ ID NO: 4888987 - DNA, 16 bp, Homo sapiens
agtcatcatcagggcc

SEQ ID NO: 4888988 - DNA, 18 bp, Homo sapiens
agtcatcatcagggcctg

SEQ ID NO: 4888989 - DNA, 21 bp, Homo sapiens
agtcatgaagcccaagtgaaa

SEQ ID NO: 4888990 - DNA, 21 bp, Homo sapiens
agtcatgcataaatatgcagt

SEQ ID NO: 4888991 - DNA, 18 bp, Homo sapiens
agtcattagactcctcct

SEQ ID NO: 4888992 - DNA, 13 bp, Homo sapiens
agtcattgtatgt

SEQ ID NO: 4888993 - DNA, 18 bp, Homo sapiens
agtcattgtatgttatta

SEQ ID NO: 4888994 - DNA, 13 bp, Homo sapiens
agtccaataagac

SEQ ID NO: 4888995 - DNA, 13 bp, Homo sapiens
agtccaggaacaa

SEQ ID NO: 4888996 - DNA, 14 bp, Homo sapiens
agtccaggcacagg

SEQ ID NO: 4888997 - DNA, 16 bp, Homo sapiens
agtccaggcacaggat

SEQ ID NO: 4888998 - DNA, 17 bp, Homo sapiens
agtccatttatatatga

SEQ ID NO: 4888999 - DNA, 19 bp, Homo sapiens
agtccatttatatatgaaa

SEQ ID NO: 4889000 - DNA, 21 bp, Homo sapiens
agtcccaaggaaagccccagc

SEQ ID NO: 4889001 - DNA, 23 bp, Homo sapiens
agtccccagcccttcacattttt

SEQ ID NO: 4889002 - DNA, 18 bp, Homo sapiens
agtcccccaactctgagc

SEQ ID NO: 4889003 - DNA, 16 bp, Homo sapiens
agtccccctgccccag

SEQ ID NO: 4889004 - DNA, 16 bp, Homo sapiens
agtccccgtggccatc

SEQ ID NO: 4889005 - DNA, 20 bp, Homo sapiens
agtcccttcccctccctggc

SEQ ID NO: 4889006 - DNA, 21 bp, Homo sapiens
agtcccttcccctccctggct

SEQ ID NO: 4889007 - DNA, 15 bp, Homo sapiens
agtccgcagaagccc

SEQ ID NO: 4889008 - DNA, 19 bp, Homo sapiens
agtccgtgtggatccaatg

SEQ ID NO: 4889009 - DNA, 16 bp, Homo sapiens
agtcctcccctcacag

SEQ ID NO: 4889010 - DNA, 22 bp, Homo sapiens
agtcctcccctcacagcctctg

SEQ ID NO: 4889011 - DNA, 23 bp, Homo sapiens
agtcctccggttgcatactggac

SEQ ID NO: 4889012 - DNA, 16 bp, Homo sapiens
agtcctgcctcagcct

SEQ ID NO: 4889013 - DNA, 13 bp, Homo sapiens
agtcctgctccag

SEQ ID NO: 4889014 - DNA, 23 bp, Homo sapiens
agtcctgctccagaatttggaaa

SEQ ID NO: 4889015 - DNA, 17 bp, Homo sapiens
agtcctggatgttgtgt

SEQ ID NO: 4889016 - DNA, 16 bp, Homo sapiens
agtcctgggagaccca

SEQ ID NO: 4889017 - DNA, 23 bp, Homo sapiens
agtcctgtgaatttcttcactgt

SEQ ID NO: 4889018 - DNA, 14 bp, Homo sapiens
agtccttgaaaata

SEQ ID NO: 4889019 - DNA, 17 bp, Homo sapiens
agtccttgaaaatattt

SEQ ID NO: 4889020 - DNA, 18 bp, Homo sapiens
agtcgaattaatagcttt

SEQ ID NO: 4889021 - DNA, 13 bp, Homo sapiens
agtcgttttccaa

SEQ ID NO: 4889022 - DNA, 20 bp, Homo sapiens
agtctaaagatggagtttct

SEQ ID NO: 4889023 - DNA, 13 bp, Homo sapiens
agtctagattctc

SEQ ID NO: 4889024 - DNA, 16 bp, Homo sapiens
agtctagattctctgg

SEQ ID NO: 4889025 - DNA, 17 bp, Homo sapiens
agtctcaaaaatacaaa

SEQ ID NO: 4889026 - DNA, 21 bp, Homo sapiens
agtctcaaaaatacaaaataa

SEQ ID NO: 4889027 - DNA, 18 bp, Homo sapiens
agtctcactgttgcccag

SEQ ID NO: 4889028 - DNA, 20 bp, Homo sapiens
agtctcactgttgcccaggc

SEQ ID NO: 4889029 - DNA, 21 bp, Homo sapiens
agtctcactgttgcccaggct

SEQ ID NO: 4889030 - DNA, 19 bp, Homo sapiens
agtctcagtggcttcatct

SEQ ID NO: 4889031 - DNA, 19 bp, Homo sapiens
agtctcctctttaaaacaa

SEQ ID NO: 4889032 - DNA, 20 bp, Homo sapiens
agtctcctctttaaaacaaa

SEQ ID NO: 4889033 - DNA, 12 bp, Homo sapiens
agtctctgtgaa

SEQ ID NO: 4889034 - DNA, 15 bp, Homo sapiens
agtctcttctccact

SEQ ID NO: 4889035 - DNA, 19 bp, Homo sapiens
agtctcttctccactggat

SEQ ID NO: 4889036 - DNA, 21 bp, Homo sapiens
agtctgattcccaagctctgc

SEQ ID NO: 4889037 - DNA, 13 bp, Homo sapiens
agtctggagtggg

SEQ ID NO: 4889038 - DNA, 14 bp, Homo sapiens
agtctgggacacaa

SEQ ID NO: 4889039 - DNA, 22 bp, Homo sapiens
agtctgggacacaaaactccgc

SEQ ID NO: 4889040 - DNA, 11 bp, Homo sapiens
agtctgtgtga

SEQ ID NO: 4889041 - DNA, 12 bp, Homo sapiens
agtctgtgtgaa

SEQ ID NO: 4889042 - DNA, 15 bp, Homo sapiens
agtctgtgtgaaggt

SEQ ID NO: 4889043 - DNA, 18 bp, Homo sapiens
agtctgtgtgatgaactt

SEQ ID NO: 4889044 - DNA, 22 bp, Homo sapiens
agtcttccaattaatgcttttt

SEQ ID NO: 4889045 - DNA, 23 bp, Homo sapiens
agtcttggtttctctctacagtg

SEQ ID NO: 4889046 - DNA, 10 bp, Homo sapiens
agtcttgtat

SEQ ID NO: 4889047 - DNA, 21 bp, Homo sapiens
agtctttaaaggcccagcccc

SEQ ID NO: 4889048 - DNA, 14 bp, Homo sapiens
agtctttgaagctg

SEQ ID NO: 4889049 - DNA, 17 bp, Homo sapiens
agtctttggttctaagg

SEQ ID NO: 4889050 - DNA, 22 bp, Homo sapiens
agtcttttgttcgcatggtcac

SEQ ID NO: 4889051 - DNA, 22 bp, Homo sapiens
agtgaaaatcttggagaccctg

SEQ ID NO: 4889052 - DNA, 14 bp, Homo sapiens
agtgaaataacaaa

SEQ ID NO: 4889053 - DNA, 17 bp, Homo sapiens
agtgaaatttctagcct

SEQ ID NO: 4889054 - DNA, 20 bp, Homo sapiens
agtgaaatttctagcctgca

SEQ ID NO: 4889055 - DNA, 12 bp, Homo sapiens
agtgaataaact

SEQ ID NO: 4889056 - DNA, 13 bp, Homo sapiens
agtgaataaactt

SEQ ID NO: 4889057 - DNA, 20 bp, Homo sapiens
agtgaataaacttcagcacc

SEQ ID NO: 4889058 - DNA, 13 bp, Homo sapiens
agtgaatgaaaca

SEQ ID NO: 4889059 - DNA, 20 bp, Homo sapiens
agtgaattcttgaaggaaaa

SEQ ID NO: 4889060 - DNA, 14 bp, Homo sapiens
agtgacaaaataga

SEQ ID NO: 4889061 - DNA, 17 bp, Homo sapiens
agtgacacagcagcttc

SEQ ID NO: 4889062 - DNA, 18 bp, Homo sapiens
agtgacacagcagcttca

SEQ ID NO: 4889063 - DNA, 23 bp, Homo sapiens
agtgacacagcagcttcaccaga

SEQ ID NO: 4889064 - DNA, 16 bp, Homo sapiens
agtgacagaggcagcc

SEQ ID NO: 4889065 - DNA, 19 bp, Homo sapiens
agtgacagaggcagcccca

SEQ ID NO: 4889066 - DNA, 22 bp, Homo sapiens
agtgacataatatattctattt

SEQ ID NO: 4889067 - DNA, 14 bp, Homo sapiens
agtgacctgtttat

SEQ ID NO: 4889068 - DNA, 16 bp, Homo sapiens
agtgactagtacaaat

SEQ ID NO: 4889069 - DNA, 17 bp, Homo sapiens
agtgactagtacaaatt

SEQ ID NO: 4889070 - DNA, 18 bp, Homo sapiens
agtgactagtacaaatta

SEQ ID NO: 4889071 - DNA, 22 bp, Homo sapiens
agtgactatgaacttctctcag

SEQ ID NO: 4889072 - DNA, 16 bp, Homo sapiens
agtgactccaagaaca

SEQ ID NO: 4889073 - DNA, 18 bp, Homo sapiens
agtgactccaagaacaat

SEQ ID NO: 4889074 - DNA, 17 bp, Homo sapiens
agtgactgtatctgtgt

SEQ ID NO: 4889075 - DNA, 18 bp, Homo sapiens
agtgagaaaaagctcctg

SEQ ID NO: 4889076 - DNA, 22 bp, Homo sapiens
agtgagaaaaagctcctgtcct

SEQ ID NO: 4889077 - DNA, 15 bp, Homo sapiens
agtgagacaaaattt

SEQ ID NO: 4889078 - DNA, 13 bp, Homo sapiens
agtgagactctgt

SEQ ID NO: 4889079 - DNA, 21 bp, Homo sapiens
agtgagcctgaattttgttgc

SEQ ID NO: 4889080 - DNA, 12 bp, Homo sapiens
agtgagctggtt

SEQ ID NO: 4889081 - DNA, 23 bp, Homo sapiens
agtgagctggtttttagcggaga

SEQ ID NO: 4889082 - DNA, 20 bp, Homo sapiens
agtgatactatccagttact

SEQ ID NO: 4889083 - DNA, 17 bp, Homo sapiens
agtgatatggcagaaga

SEQ ID NO: 4889084 - DNA, 21 bp, Homo sapiens
agtgatatggcagaagacacc

SEQ ID NO: 4889085 - DNA, 22 bp, Homo sapiens
agtgatatggcagaagacacca

SEQ ID NO: 4889086 - DNA, 23 bp, Homo sapiens
agtgatcctcccacctcagcctc

SEQ ID NO: 4889087 - DNA, 17 bp, Homo sapiens
agtgatgggctttctct

SEQ ID NO: 4889088 - DNA, 14 bp, Homo sapiens
agtgatgtttttat

SEQ ID NO: 4889089 - DNA, 23 bp, Homo sapiens
agtgatgtttttatgatatccct

SEQ ID NO: 4889090 - DNA, 20 bp, Homo sapiens
agtgattctcctgcctcagc

SEQ ID NO: 4889091 - DNA, 24 bp, Homo sapiens
agtgattctcctgcctcagcctcc

SEQ ID NO: 4889092 - DNA, 16 bp, Homo sapiens
agtgcaaccacacacc

SEQ ID NO: 4889093 - DNA, 12 bp, Homo sapiens
agtgcacagctg

SEQ ID NO: 4889094 - DNA, 18 bp, Homo sapiens
agtgcactttctaatgtt

SEQ ID NO: 4889095 - DNA, 21 bp, Homo sapiens
agtgcactttctaatgtttct

SEQ ID NO: 4889096 - DNA, 16 bp, Homo sapiens
agtgcagggcaaaata

SEQ ID NO: 4889097 - DNA, 17 bp, Homo sapiens
agtgcagtgagccgaga

SEQ ID NO: 4889098 - DNA, 17 bp, Homo sapiens
agtgcatctcagcccac

SEQ ID NO: 4889099 - DNA, 15 bp, Homo sapiens
agtgcatttctgaat

SEQ ID NO: 4889100 - DNA, 21 bp, Homo sapiens
agtgcatttctgaatagaaat

SEQ ID NO: 4889101 - DNA, 14 bp, Homo sapiens
agtgcgtgaatgta

SEQ ID NO: 4889102 - DNA, 16 bp, Homo sapiens
agtgcgtgtgtagagt

SEQ ID NO: 4889103 - DNA, 22 bp, Homo sapiens
agtgcgtgtgtagagttaagaa

SEQ ID NO: 4889104 - DNA, 14 bp, Homo sapiens
agtgctaaggttct

SEQ ID NO: 4889105 - DNA, 14 bp, Homo sapiens
agtgctacataaat

SEQ ID NO: 4889106 - DNA, 23 bp, Homo sapiens
agtgctagtgagctgggcatggt

SEQ ID NO: 4889107 - DNA, 16 bp, Homo sapiens
agtgctatatatataa

SEQ ID NO: 4889108 - DNA, 23 bp, Homo sapiens
agtgctatatatataaatatttg

SEQ ID NO: 4889109 - DNA, 14 bp, Homo sapiens
agtgctcatctgtt

SEQ ID NO: 4889110 - DNA, 19 bp, Homo sapiens
agtgctggctcacagtaca

SEQ ID NO: 4889111 - DNA, 20 bp, Homo sapiens
agtgctgggattacaggcgt

SEQ ID NO: 4889112 - DNA, 19 bp, Homo sapiens
agtgctgggattacaggct

SEQ ID NO: 4889113 - DNA, 19 bp, Homo sapiens
agtgctgggattacaggtg

SEQ ID NO: 4889114 - DNA, 20 bp, Homo sapiens
agtgctgtccatgcttctca

SEQ ID NO: 4889115 - DNA, 13 bp, Homo sapiens
agtgctttaatgg

SEQ ID NO: 4889116 - DNA, 13 bp, Homo sapiens
agtgctttcttgt

SEQ ID NO: 4889117 - DNA, 22 bp, Homo sapiens
agtggaatcctatatagaatgc

SEQ ID NO: 4889118 - DNA, 14 bp, Homo sapiens
agtggaatttcttg

SEQ ID NO: 4889119 - DNA, 17 bp, Homo sapiens
agtggaccttaggcctt

SEQ ID NO: 4889120 - DNA, 15 bp, Homo sapiens
agtggactggcccct

SEQ ID NO: 4889121 - DNA, 18 bp, Homo sapiens
agtggactggcccctggg

SEQ ID NO: 4889122 - DNA, 16 bp, Homo sapiens
agtggagaattatata

SEQ ID NO: 4889123 - DNA, 14 bp, Homo sapiens
agtggattgcattt

SEQ ID NO: 4889124 - DNA, 11 bp, Homo sapiens
agtggcagctg

SEQ ID NO: 4889125 - DNA, 12 bp, Homo sapiens
agtggcagctgc

SEQ ID NO: 4889126 - DNA, 13 bp, Homo sapiens
agtggcagctgct

SEQ ID NO: 4889127 - DNA, 20 bp, Homo sapiens
agtggcagctgcttttgtct

SEQ ID NO: 4889128 - DNA, 15 bp, Homo sapiens
agtggcctggccagg

SEQ ID NO: 4889129 - DNA, 18 bp, Homo sapiens
agtggcctggccaggagc

SEQ ID NO: 4889130 - DNA, 18 bp, Homo sapiens
agtgggacccatagatct

SEQ ID NO: 4889131 - DNA, 21 bp, Homo sapiens
agtgggacccatagatcttct

SEQ ID NO: 4889132 - DNA, 16 bp, Homo sapiens
agtgggagctgcctgt

SEQ ID NO: 4889133 - DNA, 12 bp, Homo sapiens
agtgggaggtca

SEQ ID NO: 4889134 - DNA, 14 bp, Homo sapiens
agtgggccagggct

SEQ ID NO: 4889135 - DNA, 18 bp, Homo sapiens
agtggggttatctctgtg

SEQ ID NO: 4889136 - DNA, 19 bp, Homo sapiens
agtgggtgacaagagcctg

SEQ ID NO: 4889137 - DNA, 21 bp, Homo sapiens
agtgggtgacaagagcctgat

SEQ ID NO: 4889138 - DNA, 14 bp, Homo sapiens
agtggtctttgtaa

SEQ ID NO: 4889139 - DNA, 15 bp, Homo sapiens
agtggtctttgtaag

SEQ ID NO: 4889140 - DNA, 17 bp, Homo sapiens
agtggtctttgtaagag

SEQ ID NO: 4889141 - DNA, 19 bp, Homo sapiens
agtggtctttgtaagagtg

SEQ ID NO: 4889142 - DNA, 16 bp, Homo sapiens
agtggtgcgatctggg

SEQ ID NO: 4889143 - DNA, 15 bp, Homo sapiens
agtggtgtgatctca

SEQ ID NO: 4889144 - DNA, 19 bp, Homo sapiens
agtgtaatcccccaggaga

SEQ ID NO: 4889145 - DNA, 19 bp, Homo sapiens
agtgtaatgtagcgtgttt

SEQ ID NO: 4889146 - DNA, 14 bp, Homo sapiens
agtgtacatagtgt

SEQ ID NO: 4889147 - DNA, 16 bp, Homo sapiens
agtgtaccatttgcct

SEQ ID NO: 4889148 - DNA, 17 bp, Homo sapiens
agtgtacctgtgtacat

SEQ ID NO: 4889149 - DNA, 12 bp, Homo sapiens
agtgtagaagca

SEQ ID NO: 4889150 - DNA, 14 bp, Homo sapiens
agtgtagaagcatt

SEQ ID NO: 4889151 - DNA, 16 bp, Homo sapiens
agtgtagaagcattcc

SEQ ID NO: 4889152 - DNA, 19 bp, Homo sapiens
agtgtagaagcattccttc

SEQ ID NO: 4889153 - DNA, 19 bp, Homo sapiens
agtgtagtttacagaaaaa

SEQ ID NO: 4889154 - DNA, 13 bp, Homo sapiens
agtgtatgtcttg

SEQ ID NO: 4889155 - DNA, 13 bp, Homo sapiens
agtgtcatttcca

SEQ ID NO: 4889156 - DNA, 17 bp, Homo sapiens
agtgtcccctccactgt

SEQ ID NO: 4889157 - DNA, 22 bp, Homo sapiens
agtgtgaacaaaagatgctctt

SEQ ID NO: 4889158 - DNA, 23 bp, Homo sapiens
agtgtgacaaggattgctactgt

SEQ ID NO: 4889159 - DNA, 11 bp, Homo sapiens
agtgtgacagg

SEQ ID NO: 4889160 - DNA, 15 bp, Homo sapiens
agtgtgacagggcca

SEQ ID NO: 4889161 - DNA, 19 bp, Homo sapiens
agtgtgcatggaggccctc

SEQ ID NO: 4889162 - DNA, 12 bp, Homo sapiens
agtgtggagtgg

SEQ ID NO: 4889163 - DNA, 22 bp, Homo sapiens
agtgtggagtgggtaatccagg

SEQ ID NO: 4889164 - DNA, 15 bp, Homo sapiens
agtgtggggggtcct

SEQ ID NO: 4889165 - DNA, 18 bp, Homo sapiens
agtgtgtgtgtgcatgtg

SEQ ID NO: 4889166 - DNA, 22 bp, Homo sapiens
agtgttctgtttgttattgttt

SEQ ID NO: 4889167 - DNA, 13 bp, Homo sapiens
agtgttgcctaag

SEQ ID NO: 4889168 - DNA, 23 bp, Homo sapiens
agtgttgcctaagtattaaaaca

SEQ ID NO: 4889169 - DNA, 15 bp, Homo sapiens
agtgtttatttttca

SEQ ID NO: 4889170 - DNA, 14 bp, Homo sapiens
agtgtttcatgggt

SEQ ID NO: 4889171 - DNA, 23 bp, Homo sapiens
agtgtttgggggacgtttctcat

SEQ ID NO: 4889172 - DNA, 15 bp, Homo sapiens
agtgttttaaattct

SEQ ID NO: 4889173 - DNA, 19 bp, Homo sapiens
agtgttttaaattctgaga

SEQ ID NO: 4889174 - DNA, 21 bp, Homo sapiens
agtgttttaagaaatgtagtt

SEQ ID NO: 4889175 - DNA, 19 bp, Homo sapiens
agttaactattgcatttat

SEQ ID NO: 4889176 - DNA, 20 bp, Homo sapiens
agttaactattgcatttata

SEQ ID NO: 4889177 - DNA, 15 bp, Homo sapiens
agttaagaagctgtt

SEQ ID NO: 4889178 - DNA, 16 bp, Homo sapiens
agttaagaagctgttg

SEQ ID NO: 4889179 - DNA, 18 bp, Homo sapiens
agttaagaagctgttgta

SEQ ID NO: 4889180 - DNA, 20 bp, Homo sapiens
agttaagaagctgttgtaca

SEQ ID NO: 4889181 - DNA, 22 bp, Homo sapiens
agttaagaagctgttgtacatt

SEQ ID NO: 4889182 - DNA, 22 bp, Homo sapiens
agttaagagaaactttatacat

SEQ ID NO: 4889183 - DNA, 23 bp, Homo sapiens
agttaagagaaactttatacatt

SEQ ID NO: 4889184 - DNA, 19 bp, Homo sapiens
agttaaggaccgtggccct

SEQ ID NO: 4889185 - DNA, 15 bp, Homo sapiens
agttaatattgtgaa

SEQ ID NO: 4889186 - DNA, 21 bp, Homo sapiens
agttactgccggtttgaaaat

SEQ ID NO: 4889187 - DNA, 20 bp, Homo sapiens
agttactttatgtttgtctt

SEQ ID NO: 4889188 - DNA, 18 bp, Homo sapiens
agttaggaaataaaacct

SEQ ID NO: 4889189 - DNA, 21 bp, Homo sapiens
agttaggaaataaaacctttc

SEQ ID NO: 4889190 - DNA, 16 bp, Homo sapiens
agttaggatagcattt

SEQ ID NO: 4889191 - DNA, 18 bp, Homo sapiens
agttaggatagcattttt

SEQ ID NO: 4889192 - DNA, 16 bp, Homo sapiens
agttagtttctttggg

SEQ ID NO: 4889193 - DNA, 19 bp, Homo sapiens
agttatagatgtctaggta

SEQ ID NO: 4889194 - DNA, 16 bp, Homo sapiens
agttatagtttcagat

SEQ ID NO: 4889195 - DNA, 12 bp, Homo sapiens
agttattgtaca

SEQ ID NO: 4889196 - DNA, 19 bp, Homo sapiens
agttattgtacagctgttt

SEQ ID NO: 4889197 - DNA, 21 bp, Homo sapiens
agttatttatttattggagat

SEQ ID NO: 4889198 - DNA, 21 bp, Homo sapiens
agttcaataaatgtctgttga

SEQ ID NO: 4889199 - DNA, 16 bp, Homo sapiens
agttcaattctcattt

SEQ ID NO: 4889200 - DNA, 14 bp, Homo sapiens
agttcacaccctgc

SEQ ID NO: 4889201 - DNA, 16 bp, Homo sapiens
agttcacaccctgcaa

SEQ ID NO: 4889202 - DNA, 17 bp, Homo sapiens
agttcacaccctgcaag

SEQ ID NO: 4889203 - DNA, 15 bp, Homo sapiens
agttcagcaccaccc

SEQ ID NO: 4889204 - DNA, 21 bp, Homo sapiens
agttcagcacttgtctcattt

SEQ ID NO: 4889205 - DNA, 18 bp, Homo sapiens
agttcatacctaagtact

SEQ ID NO: 4889206 - DNA, 20 bp, Homo sapiens
agttcatacctaagtactgt

SEQ ID NO: 4889207 - DNA, 19 bp, Homo sapiens
agttccaagagtctaaaga

SEQ ID NO: 4889208 - DNA, 20 bp, Homo sapiens
agttccaagagtctaaagat

SEQ ID NO: 4889209 - DNA, 17 bp, Homo sapiens
agttcccaaaagattgc

SEQ ID NO: 4889210 - DNA, 14 bp, Homo sapiens
agttccctctgctc

SEQ ID NO: 4889211 - DNA, 20 bp, Homo sapiens
agttccctctgctcagccaa

SEQ ID NO: 4889212 - DNA, 22 bp, Homo sapiens
agttccctctgctcagccaagc

SEQ ID NO: 4889213 - DNA, 17 bp, Homo sapiens
agttccctgaaacacga

SEQ ID NO: 4889214 - DNA, 15 bp, Homo sapiens
agttcctaagaagct

SEQ ID NO: 4889215 - DNA, 15 bp, Homo sapiens
agttctaaattttgt

SEQ ID NO: 4889216 - DNA, 16 bp, Homo sapiens
agttctaagattctaa

SEQ ID NO: 4889217 - DNA, 21 bp, Homo sapiens
agttctaataatttctaatgt

SEQ ID NO: 4889218 - DNA, 22 bp, Homo sapiens
agttctacctcaggcagctcaa

SEQ ID NO: 4889219 - DNA, 22 bp, Homo sapiens
agttctactatggctgagttct

SEQ ID NO: 4889220 - DNA, 21 bp, Homo sapiens
agttctagacatggaggttct

SEQ ID NO: 4889221 - DNA, 22 bp, Homo sapiens
agttctagacatggaggttcta

SEQ ID NO: 4889222 - DNA, 16 bp, Homo sapiens
agttctggtcaaagaa

SEQ ID NO: 4889223 - DNA, 21 bp, Homo sapiens
agttctgtagagccttctgat

SEQ ID NO: 4889224 - DNA, 22 bp, Homo sapiens
agttctgttatatcccctgcta

SEQ ID NO: 4889225 - DNA, 12 bp, Homo sapiens
agttcttgtgcc

SEQ ID NO: 4889226 - DNA, 13 bp, Homo sapiens
agttcttgtgcca

SEQ ID NO: 4889227 - DNA, 21 bp, Homo sapiens
agttgaatgacaacagaagct

SEQ ID NO: 4889228 - DNA, 14 bp, Homo sapiens
agttgatgtatcca

SEQ ID NO: 4889229 - DNA, 15 bp, Homo sapiens
agttgcactgatatt

SEQ ID NO: 4889230 - DNA, 13 bp, Homo sapiens
agttgccaagaca

SEQ ID NO: 4889231 - DNA, 16 bp, Homo sapiens
agttgccaagacaaat

SEQ ID NO: 4889232 - DNA, 18 bp, Homo sapiens
agttgccaagacaaatca

SEQ ID NO: 4889233 - DNA, 21 bp, Homo sapiens
agttgcctaagcattgcctgg

SEQ ID NO: 4889234 - DNA, 16 bp, Homo sapiens
agttgcgtggactctg

SEQ ID NO: 4889235 - DNA, 20 bp, Homo sapiens
agttgcgtggactctgcaca

SEQ ID NO: 4889236 - DNA, 15 bp, Homo sapiens
agttggaatttacca

SEQ ID NO: 4889237 - DNA, 16 bp, Homo sapiens
agttggctaggacccc

SEQ ID NO: 4889238 - DNA, 17 bp, Homo sapiens
agttgggtggatgcctg

SEQ ID NO: 4889239 - DNA, 14 bp, Homo sapiens
agttggtgtctttc

SEQ ID NO: 4889240 - DNA, 16 bp, Homo sapiens
agttgtaacttatatt

SEQ ID NO: 4889241 - DNA, 19 bp, Homo sapiens
agttgtaacttatattgaa

SEQ ID NO: 4889242 - DNA, 19 bp, Homo sapiens
agttgtcaagtctctgctg

SEQ ID NO: 4889243 - DNA, 13 bp, Homo sapiens
agttgtctaaaca

SEQ ID NO: 4889244 - DNA, 20 bp, Homo sapiens
agttgtgaaagttttgagta

SEQ ID NO: 4889245 - DNA, 18 bp, Homo sapiens
agttgtgccttttatagc

SEQ ID NO: 4889246 - DNA, 19 bp, Homo sapiens
agttgtgccttttatagct

SEQ ID NO: 4889247 - DNA, 23 bp, Homo sapiens
agttgtgccttttatagctatta

SEQ ID NO: 4889248 - DNA, 13 bp, Homo sapiens
agtttaaaacagt

SEQ ID NO: 4889249 - DNA, 16 bp, Homo sapiens
agtttaaaacagtatt

SEQ ID NO: 4889250 - DNA, 17 bp, Homo sapiens
agtttaaaacagtattt

SEQ ID NO: 4889251 - DNA, 18 bp, Homo sapiens
agtttaaaacagtattta

SEQ ID NO: 4889252 - DNA, 17 bp, Homo sapiens
agtttacaagtgtatat

SEQ ID NO: 4889253 - DNA, 19 bp, Homo sapiens
agtttacagaaaaatcttg

SEQ ID NO: 4889254 - DNA, 13 bp, Homo sapiens
agtttacattttt

SEQ ID NO: 4889255 - DNA, 14 bp, Homo sapiens
agtttacattttta

SEQ ID NO: 4889256 - DNA, 19 bp, Homo sapiens
agtttacatttttatttat

SEQ ID NO: 4889257 - DNA, 17 bp, Homo sapiens
agtttacccatgaagat

SEQ ID NO: 4889258 - DNA, 16 bp, Homo sapiens
agtttacccggtttct

SEQ ID NO: 4889259 - DNA, 16 bp, Homo sapiens
agtttacctctttaaa

SEQ ID NO: 4889260 - DNA, 14 bp, Homo sapiens
agtttagatttcaa

SEQ ID NO: 4889261 - DNA, 16 bp, Homo sapiens
agtttatcatgaagcc

SEQ ID NO: 4889262 - DNA, 17 bp, Homo sapiens
agtttatcatgaagcct

SEQ ID NO: 4889263 - DNA, 16 bp, Homo sapiens
agtttattctcatttg

SEQ ID NO: 4889264 - DNA, 16 bp, Homo sapiens
agtttcaatgtgattc

SEQ ID NO: 4889265 - DNA, 23 bp, Homo sapiens
agtttcagatatatatcatattg

SEQ ID NO: 4889266 - DNA, 15 bp, Homo sapiens
agtttcagcttaaaa

SEQ ID NO: 4889267 - DNA, 11 bp, Homo sapiens
agtttcaggtg

SEQ ID NO: 4889268 - DNA, 14 bp, Homo sapiens
agtttcaggtgaca

SEQ ID NO: 4889269 - DNA, 15 bp, Homo sapiens
agtttcaggtgacat

SEQ ID NO: 4889270 - DNA, 17 bp, Homo sapiens
agtttcaggtgacatgt

SEQ ID NO: 4889271 - DNA, 18 bp, Homo sapiens
agtttcaggtgacatgtg

SEQ ID NO: 4889272 - DNA, 15 bp, Homo sapiens
agtttcatgtacaag

SEQ ID NO: 4889273 - DNA, 16 bp, Homo sapiens
agtttcccttcctcca

SEQ ID NO: 4889274 - DNA, 20 bp, Homo sapiens
agtttcccttcctccatcct

SEQ ID NO: 4889275 - DNA, 16 bp, Homo sapiens
agtttcctaatcagaa

SEQ ID NO: 4889276 - DNA, 16 bp, Homo sapiens
agtttctaagattcta

SEQ ID NO: 4889277 - DNA, 17 bp, Homo sapiens
agtttctaagattctaa

SEQ ID NO: 4889278 - DNA, 18 bp, Homo sapiens
agtttctaagattctaaa

SEQ ID NO: 4889279 - DNA, 18 bp, Homo sapiens
agtttgaaggaaacagtt

SEQ ID NO: 4889280 - DNA, 21 bp, Homo sapiens
agtttgccctggtttcactgg

SEQ ID NO: 4889281 - DNA, 16 bp, Homo sapiens
agtttggcaatagttt

SEQ ID NO: 4889282 - DNA, 14 bp, Homo sapiens
agtttggtctggac

SEQ ID NO: 4889283 - DNA, 15 bp, Homo sapiens
agtttggtctggact

SEQ ID NO: 4889284 - DNA, 21 bp, Homo sapiens
agtttgtaggtaaaatgtatt

SEQ ID NO: 4889285 - DNA, 17 bp, Homo sapiens
agtttgtataacttctt

SEQ ID NO: 4889286 - DNA, 21 bp, Homo sapiens
agtttgtatagagttcatccc

SEQ ID NO: 4889287 - DNA, 23 bp, Homo sapiens
agtttgtattttaattatgggaa

SEQ ID NO: 4889288 - DNA, 16 bp, Homo sapiens
agtttgtccatttgta

SEQ ID NO: 4889289 - DNA, 15 bp, Homo sapiens
agtttgtctatttta

SEQ ID NO: 4889290 - DNA, 19 bp, Homo sapiens
agtttgtctattttaaaat

SEQ ID NO: 4889291 - DNA, 21 bp, Homo sapiens
agtttgtctattttaaaataa

SEQ ID NO: 4889292 - DNA, 14 bp, Homo sapiens
agtttgtgtgtctt

SEQ ID NO: 4889293 - DNA, 19 bp, Homo sapiens
agtttgtgtgttgtcttga

SEQ ID NO: 4889294 - DNA, 16 bp, Homo sapiens
agttttcagaacctct

SEQ ID NO: 4889295 - DNA, 20 bp, Homo sapiens
agttttcagaacctcttccc

SEQ ID NO: 4889296 - DNA, 12 bp, Homo sapiens
agttttgaaaag

SEQ ID NO: 4889297 - DNA, 15 bp, Homo sapiens
agttttgaaaagcta

SEQ ID NO: 4889298 - DNA, 21 bp, Homo sapiens
agttttgaatgttaagaattg

SEQ ID NO: 4889299 - DNA, 23 bp, Homo sapiens
agttttttgaaattatgtgacat

SEQ ID NO: 4889300 - DNA, 14 bp, Homo sapiens
ataaaaaaataaaa

SEQ ID NO: 4889301 - DNA, 18 bp, Homo sapiens
ataaaaacccacaaaaat

SEQ ID NO: 4889302 - DNA, 20 bp, Homo sapiens
ataaaaacttgaaaatatat

SEQ ID NO: 4889303 - DNA, 14 bp, Homo sapiens
ataaaaaggacatc

SEQ ID NO: 4889304 - DNA, 17 bp, Homo sapiens
ataaaaagtgacacagc

SEQ ID NO: 4889305 - DNA, 23 bp, Homo sapiens
ataaaaatatatatagtgctata

SEQ ID NO: 4889306 - DNA, 13 bp, Homo sapiens
ataaaacattatg

SEQ ID NO: 4889307 - DNA, 14 bp, Homo sapiens
ataaaacctttcaa

SEQ ID NO: 4889308 - DNA, 15 bp, Homo sapiens
ataaaacctttcaaa

SEQ ID NO: 4889309 - DNA, 21 bp, Homo sapiens
ataaaacctttcaaatttcac

SEQ ID NO: 4889310 - DNA, 15 bp, Homo sapiens
ataaaagaaaaaata

SEQ ID NO: 4889311 - DNA, 22 bp, Homo sapiens
ataaaagctgaagttactttat

SEQ ID NO: 4889312 - DNA, 20 bp, Homo sapiens
ataaaaggcttgaagctgtg

SEQ ID NO: 4889313 - DNA, 18 bp, Homo sapiens
ataaaagggcaaatctgc

SEQ ID NO: 4889314 - DNA, 19 bp, Homo sapiens
ataaaagtgaatgaaagat

SEQ ID NO: 4889315 - DNA, 21 bp, Homo sapiens
ataaaagtgaatgaaagatta

SEQ ID NO: 4889316 - DNA, 15 bp, Homo sapiens
ataaaatataaacaa

SEQ ID NO: 4889317 - DNA, 21 bp, Homo sapiens
ataaaatcctaagacacaaat

SEQ ID NO: 4889318 - DNA, 18 bp, Homo sapiens
ataaaatgaggacatgtt

SEQ ID NO: 4889319 - DNA, 19 bp, Homo sapiens
ataaaatgaggacatgttt

SEQ ID NO: 4889320 - DNA, 14 bp, Homo sapiens
ataaaattttgctt

SEQ ID NO: 4889321 - DNA, 17 bp, Homo sapiens
ataaacagatgaataaa

SEQ ID NO: 4889322 - DNA, 16 bp, Homo sapiens
ataaacattaaatgtc

SEQ ID NO: 4889323 - DNA, 21 bp, Homo sapiens
ataaacattaaatgtcttata

SEQ ID NO: 4889324 - DNA, 13 bp, Homo sapiens
ataaaccaaagga

SEQ ID NO: 4889325 - DNA, 16 bp, Homo sapiens
ataaaccaaaggacat

SEQ ID NO: 4889326 - DNA, 17 bp, Homo sapiens
ataaacctccgccaatg

SEQ ID NO: 4889327 - DNA, 22 bp, Homo sapiens
ataaactgactatcataaaatc

SEQ ID NO: 4889328 - DNA, 13 bp, Homo sapiens
ataaacttcagca

SEQ ID NO: 4889329 - DNA, 18 bp, Homo sapiens
ataaactttttttcaatg

SEQ ID NO: 4889330 - DNA, 20 bp, Homo sapiens
ataaactttttttcaatgtg

SEQ ID NO: 4889331 - DNA, 15 bp, Homo sapiens
ataaagaatatatat

SEQ ID NO: 4889332 - DNA, 16 bp, Homo sapiens
ataaagacccaggggg

SEQ ID NO: 4889333 - DNA, 22 bp, Homo sapiens
ataaagcaactgttatgaaata

SEQ ID NO: 4889334 - DNA, 21 bp, Homo sapiens
ataaagcataagtatacagtt

SEQ ID NO: 4889335 - DNA, 21 bp, Homo sapiens
ataaagcgatatacagatgaa

SEQ ID NO: 4889336 - DNA, 17 bp, Homo sapiens
ataaaggatgtgattgt

SEQ ID NO: 4889337 - DNA, 22 bp, Homo sapiens
ataaagttagaatctattttct

SEQ ID NO: 4889338 - DNA, 19 bp, Homo sapiens
ataaagtttgcttagaaaa

SEQ ID NO: 4889339 - DNA, 16 bp, Homo sapiens
ataaatataagccttt

SEQ ID NO: 4889340 - DNA, 14 bp, Homo sapiens
ataaatatatataa

SEQ ID NO: 4889341 - DNA, 16 bp, Homo sapiens
ataaatatatataaag

SEQ ID NO: 4889342 - DNA, 19 bp, Homo sapiens
ataaatatatataaagaat

SEQ ID NO: 4889343 - DNA, 15 bp, Homo sapiens
ataaatcatattgat

SEQ ID NO: 4889344 - DNA, 20 bp, Homo sapiens
ataaatcatattgatgaaaa

SEQ ID NO: 4889345 - DNA, 15 bp, Homo sapiens
ataaatctttggaaa

SEQ ID NO: 4889346 - DNA, 17 bp, Homo sapiens
ataaatgaagcagcttt

SEQ ID NO: 4889347 - DNA, 20 bp, Homo sapiens
ataaatgaagcagctttaaa

SEQ ID NO: 4889348 - DNA, 18 bp, Homo sapiens
ataaatgattcttagtga

SEQ ID NO: 4889349 - DNA, 21 bp, Homo sapiens
ataaatgtatatacacatata

SEQ ID NO: 4889350 - DNA, 13 bp, Homo sapiens
ataaatgtatcat

SEQ ID NO: 4889351 - DNA, 15 bp, Homo sapiens
ataaattatacaaat

SEQ ID NO: 4889352 - DNA, 23 bp, Homo sapiens
ataaattcccaacttctcttgct

SEQ ID NO: 4889353 - DNA, 14 bp, Homo sapiens
ataacaatgttaag

SEQ ID NO: 4889354 - DNA, 18 bp, Homo sapiens
ataacaatgttaaggaaa

SEQ ID NO: 4889355 - DNA, 17 bp, Homo sapiens
ataacacccttccttct

SEQ ID NO: 4889356 - DNA, 15 bp, Homo sapiens
ataacactaaaattt

SEQ ID NO: 4889357 - DNA, 12 bp, Homo sapiens
ataacagtgcag

SEQ ID NO: 4889358 - DNA, 19 bp, Homo sapiens
ataacattaccttactgtg

SEQ ID NO: 4889359 - DNA, 23 bp, Homo sapiens
ataaccacaaagcacagtttgaa

SEQ ID NO: 4889360 - DNA, 15 bp, Homo sapiens
ataacccacttgtca

SEQ ID NO: 4889361 - DNA, 15 bp, Homo sapiens
ataactaaatttgat

SEQ ID NO: 4889362 - DNA, 20 bp, Homo sapiens
ataactaaatttgatactta

SEQ ID NO: 4889363 - DNA, 21 bp, Homo sapiens
ataactaaatttgatacttat

SEQ ID NO: 4889364 - DNA, 13 bp, Homo sapiens
ataactctgtaaa

SEQ ID NO: 4889365 - DNA, 19 bp, Homo sapiens
ataactctgtaaaaacact

SEQ ID NO: 4889366 - DNA, 12 bp, Homo sapiens
ataactgtgaag

SEQ ID NO: 4889367 - DNA, 20 bp, Homo sapiens
ataactgtttatatgtgttg

SEQ ID NO: 4889368 - DNA, 21 bp, Homo sapiens
ataacttaaaaatgtaaatat

SEQ ID NO: 4889369 - DNA, 14 bp, Homo sapiens
ataacttattgctg

SEQ ID NO: 4889370 - DNA, 16 bp, Homo sapiens
ataacttcaagcaaac

SEQ ID NO: 4889371 - DNA, 14 bp, Homo sapiens
ataacttctgacct

SEQ ID NO: 4889372 - DNA, 16 bp, Homo sapiens
ataacttcttaaaagt

SEQ ID NO: 4889373 - DNA, 19 bp, Homo sapiens
ataacttcttaaaagttgt

SEQ ID NO: 4889374 - DNA, 17 bp, Homo sapiens
ataacttgatgcatgtg

SEQ ID NO: 4889375 - DNA, 15 bp, Homo sapiens
ataagaaagtttcac

SEQ ID NO: 4889376 - DNA, 17 bp, Homo sapiens
ataagacataacgtttt

SEQ ID NO: 4889377 - DNA, 22 bp, Homo sapiens
ataagacatatctctaattcca

SEQ ID NO: 4889378 - DNA, 22 bp, Homo sapiens
ataagagcatgaaatttttaaa

SEQ ID NO: 4889379 - DNA, 17 bp, Homo sapiens
ataagattctaacggtc

SEQ ID NO: 4889380 - DNA, 20 bp, Homo sapiens
ataagcaaaaacaaaaagaa

SEQ ID NO: 4889381 - DNA, 22 bp, Homo sapiens
ataagcaaatttcaaaagacat

SEQ ID NO: 4889382 - DNA, 20 bp, Homo sapiens
ataagccagtgttgcctaag

SEQ ID NO: 4889383 - DNA, 14 bp, Homo sapiens
ataagctctagttc

SEQ ID NO: 4889384 - DNA, 13 bp, Homo sapiens
ataaggcaggcat

SEQ ID NO: 4889385 - DNA, 11 bp, Homo sapiens
ataaggcttca

SEQ ID NO: 4889386 - DNA, 20 bp, Homo sapiens
ataaggggtttgccatttga

SEQ ID NO: 4889387 - DNA, 19 bp, Homo sapiens
ataaggtttcgtttctgta

SEQ ID NO: 4889388 - DNA, 15 bp, Homo sapiens
ataagtgaatttata

SEQ ID NO: 4889389 - DNA, 21 bp, Homo sapiens
ataagtgtgtggtcccaagtt

SEQ ID NO: 4889390 - DNA, 16 bp, Homo sapiens
ataagttcacaaaatg

SEQ ID NO: 4889391 - DNA, 16 bp, Homo sapiens
ataagttcctttcctt

SEQ ID NO: 4889392 - DNA, 21 bp, Homo sapiens
ataataaacataatgaaaata

SEQ ID NO: 4889393 - DNA, 13 bp, Homo sapiens
ataataaaggact

SEQ ID NO: 4889394 - DNA, 22 bp, Homo sapiens
ataataattaggttaacattgt

SEQ ID NO: 4889395 - DNA, 18 bp, Homo sapiens
ataatacctcaatgtttg

SEQ ID NO: 4889396 - DNA, 21 bp, Homo sapiens
ataatagcaacttttgtgtaa

SEQ ID NO: 4889397 - DNA, 21 bp, Homo sapiens
ataatatatatatatatcagt

SEQ ID NO: 4889398 - DNA, 22 bp, Homo sapiens
ataatatctttgtgataattta

SEQ ID NO: 4889399 - DNA, 13 bp, Homo sapiens
ataatattactgt

SEQ ID NO: 4889400 - DNA, 14 bp, Homo sapiens
ataatattactgtt

SEQ ID NO: 4889401 - DNA, 14 bp, Homo sapiens
ataatattgttgta

SEQ ID NO: 4889402 - DNA, 20 bp, Homo sapiens
ataatcagtgtgtctaaatt

SEQ ID NO: 4889403 - DNA, 18 bp, Homo sapiens
ataatctggactcctctg

SEQ ID NO: 4889404 - DNA, 13 bp, Homo sapiens
ataatctgtcaaa

SEQ ID NO: 4889405 - DNA, 17 bp, Homo sapiens
ataatctgtcaaaacac

SEQ ID NO: 4889406 - DNA, 19 bp, Homo sapiens
ataatctgtcaaaacactg

SEQ ID NO: 4889407 - DNA, 17 bp, Homo sapiens
ataatgaaaatattttt

SEQ ID NO: 4889408 - DNA, 15 bp, Homo sapiens
ataatgagctattaa

SEQ ID NO: 4889409 - DNA, 19 bp, Homo sapiens
ataatgagctattaaaact

SEQ ID NO: 4889410 - DNA, 21 bp, Homo sapiens
ataatgagctattaaaactca

SEQ ID NO: 4889411 - DNA, 17 bp, Homo sapiens
ataatgataaaacacct

SEQ ID NO: 4889412 - DNA, 14 bp, Homo sapiens
ataatgcttcagat

SEQ ID NO: 4889413 - DNA, 18 bp, Homo sapiens
ataatggaagagaaatct

SEQ ID NO: 4889414 - DNA, 18 bp, Homo sapiens
ataatgtgtgtatgtgta

SEQ ID NO: 4889415 - DNA, 10 bp, Homo sapiens
ataatgttaa

SEQ ID NO: 4889416 - DNA, 12 bp, Homo sapiens
ataatgttaaat

SEQ ID NO: 4889417 - DNA, 16 bp, Homo sapiens
ataatgttaaatttgt

SEQ ID NO: 4889418 - DNA, 18 bp, Homo sapiens
ataatgttaaatttgtaa

SEQ ID NO: 4889419 - DNA, 19 bp, Homo sapiens
ataatgttaaatttgtaag

SEQ ID NO: 4889420 - DNA, 22 bp, Homo sapiens
ataatgttaaatttgtaagttt

SEQ ID NO: 4889421 - DNA, 23 bp, Homo sapiens
ataatgttaaatttgtaagtttc

SEQ ID NO: 4889422 - DNA, 16 bp, Homo sapiens
ataattaggttaacat

SEQ ID NO: 4889423 - DNA, 21 bp, Homo sapiens
ataattatttatttaataaca

SEQ ID NO: 4889424 - DNA, 18 bp, Homo sapiens
ataattcaattttaaaga

SEQ ID NO: 4889425 - DNA, 18 bp, Homo sapiens
ataattcactcaagcact

SEQ ID NO: 4889426 - DNA, 19 bp, Homo sapiens
ataattcctacagcactac

SEQ ID NO: 4889427 - DNA, 12 bp, Homo sapiens
ataattctaaat

SEQ ID NO: 4889428 - DNA, 15 bp, Homo sapiens
ataattctggagata

SEQ ID NO: 4889429 - DNA, 12 bp, Homo sapiens
ataattctgtaa

SEQ ID NO: 4889430 - DNA, 13 bp, Homo sapiens
ataattgcatcta

SEQ ID NO: 4889431 - DNA, 19 bp, Homo sapiens
ataattgcatctaggtaat

SEQ ID NO: 4889432 - DNA, 18 bp, Homo sapiens
ataattgttgaaattttg

SEQ ID NO: 4889433 - DNA, 13 bp, Homo sapiens
ataatttcgagat

SEQ ID NO: 4889434 - DNA, 15 bp, Homo sapiens
ataatttcgagattt

SEQ ID NO: 4889435 - DNA, 15 bp, Homo sapiens
ataattttaaacaaa

SEQ ID NO: 4889436 - DNA, 15 bp, Homo sapiens
ataattttctgaaag

SEQ ID NO: 4889437 - DNA, 19 bp, Homo sapiens
ataatttttatatttaatt

SEQ ID NO: 4889438 - DNA, 15 bp, Homo sapiens
ataattttttattca

SEQ ID NO: 4889439 - DNA, 17 bp, Homo sapiens
ataattttttattcaag

SEQ ID NO: 4889440 - DNA, 22 bp, Homo sapiens
ataattttttgtaatgtgtgaa

SEQ ID NO: 4889441 - DNA, 14 bp, Homo sapiens
atacaaatatattg

SEQ ID NO: 4889442 - DNA, 18 bp, Homo sapiens
atacaaattaattttact

SEQ ID NO: 4889443 - DNA, 17 bp, Homo sapiens
atacaacctccctcttg

SEQ ID NO: 4889444 - DNA, 18 bp, Homo sapiens
atacaacctccctcttgt

SEQ ID NO: 4889445 - DNA, 15 bp, Homo sapiens
atacaatatataaaa

SEQ ID NO: 4889446 - DNA, 20 bp, Homo sapiens
atacaatatataaaaatata

SEQ ID NO: 4889447 - DNA, 15 bp, Homo sapiens
atacacgaaagagag

SEQ ID NO: 4889448 - DNA, 22 bp, Homo sapiens
atacactatttgtgagcaaagg

SEQ ID NO: 4889449 - DNA, 15 bp, Homo sapiens
atacacttgtataaa

SEQ ID NO: 4889450 - DNA, 20 bp, Homo sapiens
atacacttgtgattataaaa

SEQ ID NO: 4889451 - DNA, 12 bp, Homo sapiens
atacagaggaaa

SEQ ID NO: 4889452 - DNA, 15 bp, Homo sapiens
atacagataacatta

SEQ ID NO: 4889453 - DNA, 20 bp, Homo sapiens
atacagatgaaaatttgaga

SEQ ID NO: 4889454 - DNA, 19 bp, Homo sapiens
atacagtaactttatgtgt

SEQ ID NO: 4889455 - DNA, 20 bp, Homo sapiens
atacagtaactttatgtgta

SEQ ID NO: 4889456 - DNA, 12 bp, Homo sapiens
atacagttttat

SEQ ID NO: 4889457 - DNA, 13 bp, Homo sapiens
atacagttttatg

SEQ ID NO: 4889458 - DNA, 18 bp, Homo sapiens
atacagttttatgctctt

SEQ ID NO: 4889459 - DNA, 15 bp, Homo sapiens
atacataactaaatt

SEQ ID NO: 4889460 - DNA, 22 bp, Homo sapiens
atacataactaaatttgatact

SEQ ID NO: 4889461 - DNA, 13 bp, Homo sapiens
atacataataaaa

SEQ ID NO: 4889462 - DNA, 14 bp, Homo sapiens
atacatacacttgt

SEQ ID NO: 4889463 - DNA, 21 bp, Homo sapiens
atacatacggtcaggtttaac

SEQ ID NO: 4889464 - DNA, 14 bp, Homo sapiens
atacatcctgggta

SEQ ID NO: 4889465 - DNA, 16 bp, Homo sapiens
atacatcctgggtaat

SEQ ID NO: 4889466 - DNA, 16 bp, Homo sapiens
atacatgcaaaaagaa

SEQ ID NO: 4889467 - DNA, 13 bp, Homo sapiens
atacatgtgtgta

SEQ ID NO: 4889468 - DNA, 21 bp, Homo sapiens
atacatgtgtgtatatatgtg

SEQ ID NO: 4889469 - DNA, 14 bp, Homo sapiens
atacattagtaaat

SEQ ID NO: 4889470 - DNA, 17 bp, Homo sapiens
atacattagtaaatgtc

SEQ ID NO: 4889471 - DNA, 18 bp, Homo sapiens
atacattagtaaatgtct

SEQ ID NO: 4889472 - DNA, 22 bp, Homo sapiens
atacattagtaaatgtctttgt

SEQ ID NO: 4889473 - DNA, 16 bp, Homo sapiens
ataccaggattttttt

SEQ ID NO: 4889474 - DNA, 22 bp, Homo sapiens
ataccattcagatcactgaatt

SEQ ID NO: 4889475 - DNA, 15 bp, Homo sapiens
ataccattgacacat

SEQ ID NO: 4889476 - DNA, 13 bp, Homo sapiens
atacccccctctg

SEQ ID NO: 4889477 - DNA, 21 bp, Homo sapiens
atacctaagtactgtaataat

SEQ ID NO: 4889478 - DNA, 22 bp, Homo sapiens
atacctaagtactgtaataata

SEQ ID NO: 4889479 - DNA, 18 bp, Homo sapiens
atacctataatgtgtgta

SEQ ID NO: 4889480 - DNA, 14 bp, Homo sapiens
atacctcaatgttt

SEQ ID NO: 4889481 - DNA, 21 bp, Homo sapiens
atacctcatgtttatgaaaat

SEQ ID NO: 4889482 - DNA, 22 bp, Homo sapiens
atacctcatgtttatgaaaata

SEQ ID NO: 4889483 - DNA, 13 bp, Homo sapiens
atacctctgacca

SEQ ID NO: 4889484 - DNA, 12 bp, Homo sapiens
atacctctgtgt

SEQ ID NO: 4889485 - DNA, 13 bp, Homo sapiens
atacctctgtgtg

SEQ ID NO: 4889486 - DNA, 14 bp, Homo sapiens
atacgaaacacaaa

SEQ ID NO: 4889487 - DNA, 23 bp, Homo sapiens
atacgcaacataattaaattttg

SEQ ID NO: 4889488 - DNA, 16 bp, Homo sapiens
atacgcactacatgtg

SEQ ID NO: 4889489 - DNA, 20 bp, Homo sapiens
atacgctactataaagagaa

SEQ ID NO: 4889490 - DNA, 18 bp, Homo sapiens
atacggtcaggtttaaca

SEQ ID NO: 4889491 - DNA, 15 bp, Homo sapiens
atactaacttattta

SEQ ID NO: 4889492 - DNA, 14 bp, Homo sapiens
atactatagtacca

SEQ ID NO: 4889493 - DNA, 21 bp, Homo sapiens
atactatttaaagcctcctca

SEQ ID NO: 4889494 - DNA, 17 bp, Homo sapiens
atactcagcctgctgcc

SEQ ID NO: 4889495 - DNA, 13 bp, Homo sapiens
atactccagtgta

SEQ ID NO: 4889496 - DNA, 17 bp, Homo sapiens
atactccagtgtacata

SEQ ID NO: 4889497 - DNA, 17 bp, Homo sapiens
atactctagatgaagtt

SEQ ID NO: 4889498 - DNA, 23 bp, Homo sapiens
atactctagatgaagttttacat

SEQ ID NO: 4889499 - DNA, 22 bp, Homo sapiens
atactcttcctatttttgtagt

SEQ ID NO: 4889500 - DNA, 15 bp, Homo sapiens
atactctttctgtat

SEQ ID NO: 4889501 - DNA, 16 bp, Homo sapiens
atactctttctgtata

SEQ ID NO: 4889502 - DNA, 14 bp, Homo sapiens
atactgagggacca

SEQ ID NO: 4889503 - DNA, 22 bp, Homo sapiens
atactgagggaccaactgggcc

SEQ ID NO: 4889504 - DNA, 17 bp, Homo sapiens
atactgcagggccagga

SEQ ID NO: 4889505 - DNA, 19 bp, Homo sapiens
atactgcagggccaggact

SEQ ID NO: 4889506 - DNA, 15 bp, Homo sapiens
atactggcctggact

SEQ ID NO: 4889507 - DNA, 15 bp, Homo sapiens
atactgtacatgaaa

SEQ ID NO: 4889508 - DNA, 23 bp, Homo sapiens
atacttagcaaaaagtggggcag

SEQ ID NO: 4889509 - DNA, 15 bp, Homo sapiens
atacttatatttccc

SEQ ID NO: 4889510 - DNA, 14 bp, Homo sapiens
atacttatattttc

SEQ ID NO: 4889511 - DNA, 22 bp, Homo sapiens
atacttatattttcgtatgaaa

SEQ ID NO: 4889512 - DNA, 16 bp, Homo sapiens
atacttcactacttta

SEQ ID NO: 4889513 - DNA, 15 bp, Homo sapiens
atacttgaacaaaag

SEQ ID NO: 4889514 - DNA, 19 bp, Homo sapiens
atacttgtggttttcaaat

SEQ ID NO: 4889515 - DNA, 17 bp, Homo sapiens
atactttaaataattta

SEQ ID NO: 4889516 - DNA, 20 bp, Homo sapiens
atactttaaataatttaact

SEQ ID NO: 4889517 - DNA, 12 bp, Homo sapiens
atactttacatg

SEQ ID NO: 4889518 - DNA, 20 bp, Homo sapiens
atactttttacaattaaaaa

SEQ ID NO: 4889519 - DNA, 21 bp, Homo sapiens
atactttttcttttgtaagtg

SEQ ID NO: 4889520 - DNA, 10 bp, Homo sapiens
atagaaaaat

SEQ ID NO: 4889521 - DNA, 23 bp, Homo sapiens
atagaaaaattcagcaaaccatt

SEQ ID NO: 4889522 - DNA, 13 bp, Homo sapiens
atagaaacatgac

SEQ ID NO: 4889523 - DNA, 16 bp, Homo sapiens
atagaaacatgacact

SEQ ID NO: 4889524 - DNA, 16 bp, Homo sapiens
atagaactgggtaaat

SEQ ID NO: 4889525 - DNA, 20 bp, Homo sapiens
atagaactgggtaaatgcaa

SEQ ID NO: 4889526 - DNA, 12 bp, Homo sapiens
atagaatgctgc

SEQ ID NO: 4889527 - DNA, 14 bp, Homo sapiens
atagaatttccaat

SEQ ID NO: 4889528 - DNA, 21 bp, Homo sapiens
atagacaattgaggtaagttt

SEQ ID NO: 4889529 - DNA, 21 bp, Homo sapiens
atagacagtttgtaaatgtta

SEQ ID NO: 4889530 - DNA, 21 bp, Homo sapiens
atagactgccgtgcattagca

SEQ ID NO: 4889531 - DNA, 14 bp, Homo sapiens
atagagagagacca

SEQ ID NO: 4889532 - DNA, 21 bp, Homo sapiens
atagagcaaaattgatgtgtt

SEQ ID NO: 4889533 - DNA, 21 bp, Homo sapiens
atagagcacctagtccagtga

SEQ ID NO: 4889534 - DNA, 12 bp, Homo sapiens
atagagctttta

SEQ ID NO: 4889535 - DNA, 14 bp, Homo sapiens
atagagtatatgca

SEQ ID NO: 4889536 - DNA, 19 bp, Homo sapiens
atagatcaaagtcaaaaat

SEQ ID NO: 4889537 - DNA, 13 bp, Homo sapiens
atagatcttctga

SEQ ID NO: 4889538 - DNA, 14 bp, Homo sapiens
atagatcttctgaa

SEQ ID NO: 4889539 - DNA, 18 bp, Homo sapiens
atagatgtctaggtactt

SEQ ID NO: 4889540 - DNA, 17 bp, Homo sapiens
atagatgtcttttatag

SEQ ID NO: 4889541 - DNA, 21 bp, Homo sapiens
atagatgtcttttatagtgga

SEQ ID NO: 4889542 - DNA, 13 bp, Homo sapiens
atagattctaaag

SEQ ID NO: 4889543 - DNA, 18 bp, Homo sapiens
atagattctaaagattct

SEQ ID NO: 4889544 - DNA, 20 bp, Homo sapiens
atagatttatttttcagttc

SEQ ID NO: 4889545 - DNA, 19 bp, Homo sapiens
atagcaagacacatcccta

SEQ ID NO: 4889546 - DNA, 21 bp, Homo sapiens
atagcactttgaaatacctca

SEQ ID NO: 4889547 - DNA, 19 bp, Homo sapiens
atagcagcaaaaatataaa

SEQ ID NO: 4889548 - DNA, 13 bp, Homo sapiens
atagccacatttg

SEQ ID NO: 4889549 - DNA, 23 bp, Homo sapiens
atagccacatttggaatactttt

SEQ ID NO: 4889550 - DNA, 15 bp, Homo sapiens
atagctaacatttta

SEQ ID NO: 4889551 - DNA, 14 bp, Homo sapiens
atagctattactgt

SEQ ID NO: 4889552 - DNA, 21 bp, Homo sapiens
atagctcaggtgtccctgcac

SEQ ID NO: 4889553 - DNA, 18 bp, Homo sapiens
atagctgcatgtggcttt

SEQ ID NO: 4889554 - DNA, 14 bp, Homo sapiens
atagcttgtatagt

SEQ ID NO: 4889555 - DNA, 17 bp, Homo sapiens
atagcttttattgtata

SEQ ID NO: 4889556 - DNA, 19 bp, Homo sapiens
ataggagaggatgagagcc

SEQ ID NO: 4889557 - DNA, 16 bp, Homo sapiens
ataggagcctgctggt

SEQ ID NO: 4889558 - DNA, 14 bp, Homo sapiens
ataggtaatcaatg

SEQ ID NO: 4889559 - DNA, 16 bp, Homo sapiens
ataggtaatcaatgaa

SEQ ID NO: 4889560 - DNA, 20 bp, Homo sapiens
ataggttgccaataatacac

SEQ ID NO: 4889561 - DNA, 14 bp, Homo sapiens
atagtaaaagaaat

SEQ ID NO: 4889562 - DNA, 16 bp, Homo sapiens
atagtatggtggctgg

SEQ ID NO: 4889563 - DNA, 21 bp, Homo sapiens
atagtatttgagagttctaaa

SEQ ID NO: 4889564 - DNA, 23 bp, Homo sapiens
atagtatttgagagttctaaatt

SEQ ID NO: 4889565 - DNA, 16 bp, Homo sapiens
atagtatttttatcca

SEQ ID NO: 4889566 - DNA, 16 bp, Homo sapiens
atagtcattccaaata

SEQ ID NO: 4889567 - DNA, 13 bp, Homo sapiens
atagtctttcagt

SEQ ID NO: 4889568 - DNA, 15 bp, Homo sapiens
atagtgcacaaaatg

SEQ ID NO: 4889569 - DNA, 15 bp, Homo sapiens
atagtgctatatata

SEQ ID NO: 4889570 - DNA, 22 bp, Homo sapiens
atagtgctgggatggaggggag

SEQ ID NO: 4889571 - DNA, 15 bp, Homo sapiens
atagtggaaaaacac

SEQ ID NO: 4889572 - DNA, 13 bp, Homo sapiens
atagtgtaaaata

SEQ ID NO: 4889573 - DNA, 16 bp, Homo sapiens
atagttggtcatctag

SEQ ID NO: 4889574 - DNA, 14 bp, Homo sapiens
atagtttctgaggc

SEQ ID NO: 4889575 - DNA, 13 bp, Homo sapiens
atagtttgtacat

SEQ ID NO: 4889576 - DNA, 12 bp, Homo sapiens
atagtttgttat

SEQ ID NO: 4889577 - DNA, 17 bp, Homo sapiens
atagttttaaactcatt

SEQ ID NO: 4889578 - DNA, 21 bp, Homo sapiens
atagtttttaccttttatgta

SEQ ID NO: 4889579 - DNA, 20 bp, Homo sapiens
atataaaaggcaaatgtgta

SEQ ID NO: 4889580 - DNA, 20 bp, Homo sapiens
atataaagggggagggaaat

SEQ ID NO: 4889581 - DNA, 16 bp, Homo sapiens
atataacagatacatt

SEQ ID NO: 4889582 - DNA, 14 bp, Homo sapiens
atataagtttgaag

SEQ ID NO: 4889583 - DNA, 21 bp, Homo sapiens
atataagtttgaaggaaacag

SEQ ID NO: 4889584 - DNA, 19 bp, Homo sapiens
atataatggaagagaaatc

SEQ ID NO: 4889585 - DNA, 22 bp, Homo sapiens
atataatggaagagaaatctca

SEQ ID NO: 4889586 - DNA, 17 bp, Homo sapiens
atataattctgtaaatg

SEQ ID NO: 4889587 - DNA, 14 bp, Homo sapiens
atatacagtaactt

SEQ ID NO: 4889588 - DNA, 17 bp, Homo sapiens
atatacagtaactttat

SEQ ID NO: 4889589 - DNA, 23 bp, Homo sapiens
atatacagtaactttatgtgtaa

SEQ ID NO: 4889590 - DNA, 13 bp, Homo sapiens
atatacatacact

SEQ ID NO: 4889591 - DNA, 21 bp, Homo sapiens
atatacatacacttgtataaa

SEQ ID NO: 4889592 - DNA, 22 bp, Homo sapiens
atatacatgtgtgtatatatgt

SEQ ID NO: 4889593 - DNA, 15 bp, Homo sapiens
atatacctataatgt

SEQ ID NO: 4889594 - DNA, 19 bp, Homo sapiens
atatacctataatgtgtgt

SEQ ID NO: 4889595 - DNA, 22 bp, Homo sapiens
atatactctagatgaagtttta

SEQ ID NO: 4889596 - DNA, 21 bp, Homo sapiens
atatactttgtggaccaatta

SEQ ID NO: 4889597 - DNA, 15 bp, Homo sapiens
atatagaatgctgca

SEQ ID NO: 4889598 - DNA, 13 bp, Homo sapiens
atatagagatgtt

SEQ ID NO: 4889599 - DNA, 14 bp, Homo sapiens
atatagagatgttt

SEQ ID NO: 4889600 - DNA, 16 bp, Homo sapiens
atatagagatgttttt

SEQ ID NO: 4889601 - DNA, 14 bp, Homo sapiens
atatagattagaaa

SEQ ID NO: 4889602 - DNA, 20 bp, Homo sapiens
atatagcagcaaaaatataa

SEQ ID NO: 4889603 - DNA, 21 bp, Homo sapiens
atatagcgttcccaacaacat

SEQ ID NO: 4889604 - DNA, 18 bp, Homo sapiens
atataggtgatgtttgct

SEQ ID NO: 4889605 - DNA, 16 bp, Homo sapiens
atataggttgtgcaaa

SEQ ID NO: 4889606 - DNA, 22 bp, Homo sapiens
atataggttgtgcaaattaaca

SEQ ID NO: 4889607 - DNA, 21 bp, Homo sapiens
atatagtttttaccttttatg

SEQ ID NO: 4889608 - DNA, 17 bp, Homo sapiens
atatataaagaatatat

SEQ ID NO: 4889609 - DNA, 13 bp, Homo sapiens
atatataaagtat

SEQ ID NO: 4889610 - DNA, 17 bp, Homo sapiens
atatataacagatacat

SEQ ID NO: 4889611 - DNA, 10 bp, Homo sapiens
atatatacat

SEQ ID NO: 4889612 - DNA, 16 bp, Homo sapiens
atatatacatacactt

SEQ ID NO: 4889613 - DNA, 22 bp, Homo sapiens
atatatacgaacaaaacacacg

SEQ ID NO: 4889614 - DNA, 18 bp, Homo sapiens
atatatacttaagaatat

SEQ ID NO: 4889615 - DNA, 14 bp, Homo sapiens
atatatagtgctat

SEQ ID NO: 4889616 - DNA, 16 bp, Homo sapiens
atatatatacatatgt

SEQ ID NO: 4889617 - DNA, 14 bp, Homo sapiens
atatatatatataa

SEQ ID NO: 4889618 - DNA, 16 bp, Homo sapiens
atatatatatatataa

SEQ ID NO: 4889619 - DNA, 14 bp, Homo sapiens
atatatatatatca

SEQ ID NO: 4889620 - DNA, 15 bp, Homo sapiens
atatatatcagtttg

SEQ ID NO: 4889621 - DNA, 19 bp, Homo sapiens
atatatatgcctttttcct

SEQ ID NO: 4889622 - DNA, 20 bp, Homo sapiens
atatatatgcctttttccta

SEQ ID NO: 4889623 - DNA, 14 bp, Homo sapiens
atatatcagtttga

SEQ ID NO: 4889624 - DNA, 20 bp, Homo sapiens
atatatcatattggtattca

SEQ ID NO: 4889625 - DNA, 17 bp, Homo sapiens
atatatctgcttcagtg

SEQ ID NO: 4889626 - DNA, 14 bp, Homo sapiens
atatatgccttttt

SEQ ID NO: 4889627 - DNA, 15 bp, Homo sapiens
atatatggacatggc

SEQ ID NO: 4889628 - DNA, 19 bp, Homo sapiens
atatatgtgtatatataca

SEQ ID NO: 4889629 - DNA, 13 bp, Homo sapiens
atatatgtgtatg

SEQ ID NO: 4889630 - DNA, 21 bp, Homo sapiens
atatattctgaagcaacattt

SEQ ID NO: 4889631 - DNA, 14 bp, Homo sapiens
atatatttatttaa

SEQ ID NO: 4889632 - DNA, 15 bp, Homo sapiens
atatatttatttaaa

SEQ ID NO: 4889633 - DNA, 14 bp, Homo sapiens
atatatttctttgt

SEQ ID NO: 4889634 - DNA, 14 bp, Homo sapiens
atatatttttatat

SEQ ID NO: 4889635 - DNA, 21 bp, Homo sapiens
atatatttttatatttagtta

SEQ ID NO: 4889636 - DNA, 14 bp, Homo sapiens
atatattttttgta

SEQ ID NO: 4889637 - DNA, 16 bp, Homo sapiens
atatcaagatgattct

SEQ ID NO: 4889638 - DNA, 21 bp, Homo sapiens
atatcaatcaagccatgtata

SEQ ID NO: 4889639 - DNA, 17 bp, Homo sapiens
atatcagaaaagggaag

SEQ ID NO: 4889640 - DNA, 19 bp, Homo sapiens
atatcatattggtattcac

SEQ ID NO: 4889641 - DNA, 22 bp, Homo sapiens
atatcatgtaaagaaatgtctt

SEQ ID NO: 4889642 - DNA, 23 bp, Homo sapiens
atatcatttattttttacattat

SEQ ID NO: 4889643 - DNA, 16 bp, Homo sapiens
atatccaccacctccc

SEQ ID NO: 4889644 - DNA, 13 bp, Homo sapiens
atatcctgtgact

SEQ ID NO: 4889645 - DNA, 15 bp, Homo sapiens
atatcctttctaaca

SEQ ID NO: 4889646 - DNA, 18 bp, Homo sapiens
atatcggctcacaaagag

SEQ ID NO: 4889647 - DNA, 13 bp, Homo sapiens
atatctaatatat

SEQ ID NO: 4889648 - DNA, 17 bp, Homo sapiens
atatctaatatatatga

SEQ ID NO: 4889649 - DNA, 20 bp, Homo sapiens
atatctaattattttgcagt

SEQ ID NO: 4889650 - DNA, 12 bp, Homo sapiens
atatctattaat

SEQ ID NO: 4889651 - DNA, 13 bp, Homo sapiens
atatctattaata

SEQ ID NO: 4889652 - DNA, 16 bp, Homo sapiens
atatctgaaaactgga

SEQ ID NO: 4889653 - DNA, 23 bp, Homo sapiens
atatctgaaaactggaataagaa

SEQ ID NO: 4889654 - DNA, 15 bp, Homo sapiens
atatctgaagccctc

SEQ ID NO: 4889655 - DNA, 13 bp, Homo sapiens
atatctgcttcag

SEQ ID NO: 4889656 - DNA, 16 bp, Homo sapiens
atatctttgtgataat

SEQ ID NO: 4889657 - DNA, 17 bp, Homo sapiens
atatcttttatgtttga

SEQ ID NO: 4889658 - DNA, 19 bp, Homo sapiens
atatcttttatgtttgaat

SEQ ID NO: 4889659 - DNA, 20 bp, Homo sapiens
atatcttttatgtttgaata

SEQ ID NO: 4889660 - DNA, 15 bp, Homo sapiens
atatgaaaactatac

SEQ ID NO: 4889661 - DNA, 17 bp, Homo sapiens
atatgaatttaaatata

SEQ ID NO: 4889662 - DNA, 13 bp, Homo sapiens
atatgactcacat

SEQ ID NO: 4889663 - DNA, 20 bp, Homo sapiens
atatgagtatacaatatata

SEQ ID NO: 4889664 - DNA, 21 bp, Homo sapiens
atatgagtatacaatatataa

SEQ ID NO: 4889665 - DNA, 14 bp, Homo sapiens
atatgatctgtttt

SEQ ID NO: 4889666 - DNA, 14 bp, Homo sapiens
atatgattgtttct

SEQ ID NO: 4889667 - DNA, 22 bp, Homo sapiens
atatgattgtttctcaaatctt

SEQ ID NO: 4889668 - DNA, 12 bp, Homo sapiens
atatgatttata

SEQ ID NO: 4889669 - DNA, 13 bp, Homo sapiens
atatgatttatag

SEQ ID NO: 4889670 - DNA, 17 bp, Homo sapiens
atatgatttcactagaa

SEQ ID NO: 4889671 - DNA, 18 bp, Homo sapiens
atatgattttttaaaaga

SEQ ID NO: 4889672 - DNA, 22 bp, Homo sapiens
atatgattttttaaaagaaatt

SEQ ID NO: 4889673 - DNA, 19 bp, Homo sapiens
atatgcaccttgtgtctgt

SEQ ID NO: 4889674 - DNA, 20 bp, Homo sapiens
atatgcaccttgtgtctgta

SEQ ID NO: 4889675 - DNA, 20 bp, Homo sapiens
atatgcagtgatatggcaga

SEQ ID NO: 4889676 - DNA, 18 bp, Homo sapiens
atatggaacttctaatat

SEQ ID NO: 4889677 - DNA, 15 bp, Homo sapiens
atatggactctgcac

SEQ ID NO: 4889678 - DNA, 21 bp, Homo sapiens
atatggagaattgctgaaggg

SEQ ID NO: 4889679 - DNA, 18 bp, Homo sapiens
atatggatgattcagaaa

SEQ ID NO: 4889680 - DNA, 17 bp, Homo sapiens
atatggcagaagacacc

SEQ ID NO: 4889681 - DNA, 14 bp, Homo sapiens
atatgggactgagc

SEQ ID NO: 4889682 - DNA, 16 bp, Homo sapiens
atatggggaatatatt

SEQ ID NO: 4889683 - DNA, 14 bp, Homo sapiens
atatgtacataaat

SEQ ID NO: 4889684 - DNA, 23 bp, Homo sapiens
atatgtagactatatacatgtgt

SEQ ID NO: 4889685 - DNA, 18 bp, Homo sapiens
atatgtagtataaagaaa

SEQ ID NO: 4889686 - DNA, 22 bp, Homo sapiens
atatgtattatttataattcct

SEQ ID NO: 4889687 - DNA, 14 bp, Homo sapiens
atatgtattgtaaa

SEQ ID NO: 4889688 - DNA, 15 bp, Homo sapiens
atatgtcactagaat

SEQ ID NO: 4889689 - DNA, 17 bp, Homo sapiens
atatgtcactagaatgg

SEQ ID NO: 4889690 - DNA, 16 bp, Homo sapiens
atatgtgatctgtctt

SEQ ID NO: 4889691 - DNA, 21 bp, Homo sapiens
atatgtgatctgtcttgtaat

SEQ ID NO: 4889692 - DNA, 13 bp, Homo sapiens
atatgtgtatata

SEQ ID NO: 4889693 - DNA, 16 bp, Homo sapiens
atatgtgtatatatac

SEQ ID NO: 4889694 - DNA, 19 bp, Homo sapiens
atatgtgtatatatacata

SEQ ID NO: 4889695 - DNA, 22 bp, Homo sapiens
atatgtgtatatatacatacac

SEQ ID NO: 4889696 - DNA, 12 bp, Homo sapiens
atatgtgtatgt

SEQ ID NO: 4889697 - DNA, 12 bp, Homo sapiens
atattaaatctg

SEQ ID NO: 4889698 - DNA, 21 bp, Homo sapiens
atattaattttctacaaataa

SEQ ID NO: 4889699 - DNA, 21 bp, Homo sapiens
atattactacttaccatttgc

SEQ ID NO: 4889700 - DNA, 13 bp, Homo sapiens
atattactttatc

SEQ ID NO: 4889701 - DNA, 13 bp, Homo sapiens
atattatttggca

SEQ ID NO: 4889702 - DNA, 16 bp, Homo sapiens
atattatttggcagtt

SEQ ID NO: 4889703 - DNA, 11 bp, Homo sapiens
atattcaacca

SEQ ID NO: 4889704 - DNA, 21 bp, Homo sapiens
atattcaaccatggactttat

SEQ ID NO: 4889705 - DNA, 17 bp, Homo sapiens
atattcagagaatatca

SEQ ID NO: 4889706 - DNA, 14 bp, Homo sapiens
atattcatattgga

SEQ ID NO: 4889707 - DNA, 17 bp, Homo sapiens
atattcatattggaaaa

SEQ ID NO: 4889708 - DNA, 15 bp, Homo sapiens
atattctatttttat

SEQ ID NO: 4889709 - DNA, 12 bp, Homo sapiens
atattcttgtca

SEQ ID NO: 4889710 - DNA, 15 bp, Homo sapiens
atattcttgtgcttt

SEQ ID NO: 4889711 - DNA, 17 bp, Homo sapiens
atattgaagacaatttg

SEQ ID NO: 4889712 - DNA, 21 bp, Homo sapiens
atattgaagacaatttgatac

SEQ ID NO: 4889713 - DNA, 18 bp, Homo sapiens
atattgaatgtttccaac

SEQ ID NO: 4889714 - DNA, 14 bp, Homo sapiens
atattgacatttgt

SEQ ID NO: 4889715 - DNA, 15 bp, Homo sapiens
atattgacatttgta

SEQ ID NO: 4889716 - DNA, 17 bp, Homo sapiens
atattgaggctttgtgt

SEQ ID NO: 4889717 - DNA, 18 bp, Homo sapiens
atattgaggctttgtgtt

SEQ ID NO: 4889718 - DNA, 16 bp, Homo sapiens
atattgtacataaaag

SEQ ID NO: 4889719 - DNA, 16 bp, Homo sapiens
atattgtcatatcagc

SEQ ID NO: 4889720 - DNA, 12 bp, Homo sapiens
atattgtgccaa

SEQ ID NO: 4889721 - DNA, 18 bp, Homo sapiens
atattgtgccaatatgta

SEQ ID NO: 4889722 - DNA, 21 bp, Homo sapiens
atattgtgccaatatgtattg

SEQ ID NO: 4889723 - DNA, 17 bp, Homo sapiens
atattgtgttgtgaatg

SEQ ID NO: 4889724 - DNA, 13 bp, Homo sapiens
atattgtgtttgt

SEQ ID NO: 4889725 - DNA, 21 bp, Homo sapiens
atattgtgtttgtgtatttac

SEQ ID NO: 4889726 - DNA, 18 bp, Homo sapiens
atattgttcaaacaatat

SEQ ID NO: 4889727 - DNA, 16 bp, Homo sapiens
atattgttgtataatt

SEQ ID NO: 4889728 - DNA, 22 bp, Homo sapiens
atattgttgtataatttcgaga

SEQ ID NO: 4889729 - DNA, 15 bp, Homo sapiens
atatttaaactcaag

SEQ ID NO: 4889730 - DNA, 23 bp, Homo sapiens
atatttaaactcaagacaatgca

SEQ ID NO: 4889731 - DNA, 14 bp, Homo sapiens
atatttaaagacag

SEQ ID NO: 4889732 - DNA, 19 bp, Homo sapiens
atatttaacattatttata

SEQ ID NO: 4889733 - DNA, 12 bp, Homo sapiens
atatttaatgat

SEQ ID NO: 4889734 - DNA, 23 bp, Homo sapiens
atatttactaagccacaagaaat

SEQ ID NO: 4889735 - DNA, 18 bp, Homo sapiens
atatttattaaataaaat

SEQ ID NO: 4889736 - DNA, 22 bp, Homo sapiens
atatttattaaataaaatcaat

SEQ ID NO: 4889737 - DNA, 16 bp, Homo sapiens
atatttatttaaagca

SEQ ID NO: 4889738 - DNA, 17 bp, Homo sapiens
atatttatttatttatt

SEQ ID NO: 4889739 - DNA, 15 bp, Homo sapiens
atatttgaaaaaaac

SEQ ID NO: 4889740 - DNA, 22 bp, Homo sapiens
atatttgacttgcatgaagaga

SEQ ID NO: 4889741 - DNA, 21 bp, Homo sapiens
atatttgctagactctagaca

SEQ ID NO: 4889742 - DNA, 18 bp, Homo sapiens
atatttggcttaaatata

SEQ ID NO: 4889743 - DNA, 12 bp, Homo sapiens
atatttgtatcg

SEQ ID NO: 4889744 - DNA, 14 bp, Homo sapiens
atatttgtggaata

SEQ ID NO: 4889745 - DNA, 17 bp, Homo sapiens
atattttacctcttatt

SEQ ID NO: 4889746 - DNA, 20 bp, Homo sapiens
atattttcaacgcagccctg

SEQ ID NO: 4889747 - DNA, 13 bp, Homo sapiens
atattttcacaat

SEQ ID NO: 4889748 - DNA, 16 bp, Homo sapiens
atattttcgtatgaaa

SEQ ID NO: 4889749 - DNA, 14 bp, Homo sapiens
atattttgataata

SEQ ID NO: 4889750 - DNA, 21 bp, Homo sapiens
atattttgtatatatctgctt

SEQ ID NO: 4889751 - DNA, 16 bp, Homo sapiens
atatttttatatttag

SEQ ID NO: 4889752 - DNA, 18 bp, Homo sapiens
atcaaaataaaaagtgac

SEQ ID NO: 4889753 - DNA, 22 bp, Homo sapiens
atcaaaatgctttttatttctg

SEQ ID NO: 4889754 - DNA, 16 bp, Homo sapiens
atcaaagccagggtct

SEQ ID NO: 4889755 - DNA, 17 bp, Homo sapiens
atcaaataagtatttat

SEQ ID NO: 4889756 - DNA, 20 bp, Homo sapiens
atcaaataagtatttataat

SEQ ID NO: 4889757 - DNA, 19 bp, Homo sapiens
atcaaccccttcgctcctg

SEQ ID NO: 4889758 - DNA, 20 bp, Homo sapiens
atcaaccccttcgctcctgt

SEQ ID NO: 4889759 - DNA, 12 bp, Homo sapiens
atcaacttaaca

SEQ ID NO: 4889760 - DNA, 21 bp, Homo sapiens
atcaagccatgtataaatgtg

SEQ ID NO: 4889761 - DNA, 22 bp, Homo sapiens
atcaaggaagaaatggttcaga

SEQ ID NO: 4889762 - DNA, 21 bp, Homo sapiens
atcaaggactctggtttctca

SEQ ID NO: 4889763 - DNA, 16 bp, Homo sapiens
atcaagtatttgggaa

SEQ ID NO: 4889764 - DNA, 20 bp, Homo sapiens
atcaagtatttgggaagtga

SEQ ID NO: 4889765 - DNA, 21 bp, Homo sapiens
atcaagtatttgggaagtgaa

SEQ ID NO: 4889766 - DNA, 13 bp, Homo sapiens
atcaagtattttg

SEQ ID NO: 4889767 - DNA, 17 bp, Homo sapiens
atcaagtcaatcatttc

SEQ ID NO: 4889768 - DNA, 22 bp, Homo sapiens
atcaagttgtaacttatattga

SEQ ID NO: 4889769 - DNA, 13 bp, Homo sapiens
atcaataagaagg

SEQ ID NO: 4889770 - DNA, 15 bp, Homo sapiens
atcaatatctaatat

SEQ ID NO: 4889771 - DNA, 15 bp, Homo sapiens
atcaatcaaataagt

SEQ ID NO: 4889772 - DNA, 14 bp, Homo sapiens
atcaatcctttatt

SEQ ID NO: 4889773 - DNA, 21 bp, Homo sapiens
atcaatgttcacgcaacttga

SEQ ID NO: 4889774 - DNA, 22 bp, Homo sapiens
atcaattttgacttaatgtgat

SEQ ID NO: 4889775 - DNA, 19 bp, Homo sapiens
atcacaaatccaaaggaaa

SEQ ID NO: 4889776 - DNA, 14 bp, Homo sapiens
atcacaatacagat

SEQ ID NO: 4889777 - DNA, 16 bp, Homo sapiens
atcacaatacagataa

SEQ ID NO: 4889778 - DNA, 15 bp, Homo sapiens
atcacaatttttaat

SEQ ID NO: 4889779 - DNA, 17 bp, Homo sapiens
atcacaatttttaatgg

SEQ ID NO: 4889780 - DNA, 14 bp, Homo sapiens
atcacactatttta

SEQ ID NO: 4889781 - DNA, 16 bp, Homo sapiens
atcacactattttaga

SEQ ID NO: 4889782 - DNA, 14 bp, Homo sapiens
atcacacttctgtg

SEQ ID NO: 4889783 - DNA, 18 bp, Homo sapiens
atcacacttctgtgagac

SEQ ID NO: 4889784 - DNA, 16 bp, Homo sapiens
atcaccctcttcctgt

SEQ ID NO: 4889785 - DNA, 20 bp, Homo sapiens
atcaccgacgcgtctcctgt

SEQ ID NO: 4889786 - DNA, 20 bp, Homo sapiens
atcacctctgtaatttttca

SEQ ID NO: 4889787 - DNA, 14 bp, Homo sapiens
atcacgccactgca

SEQ ID NO: 4889788 - DNA, 17 bp, Homo sapiens
atcacgccactgcacta

SEQ ID NO: 4889789 - DNA, 14 bp, Homo sapiens
atcacgcctggcta

SEQ ID NO: 4889790 - DNA, 15 bp, Homo sapiens
atcacggctcactgc

SEQ ID NO: 4889791 - DNA, 20 bp, Homo sapiens
atcactaatactaattcatt

SEQ ID NO: 4889792 - DNA, 14 bp, Homo sapiens
atcactagcctgtc

SEQ ID NO: 4889793 - DNA, 13 bp, Homo sapiens
atcactctgtcct

SEQ ID NO: 4889794 - DNA, 18 bp, Homo sapiens
atcactgccacactctcc

SEQ ID NO: 4889795 - DNA, 19 bp, Homo sapiens
atcactgccacactctcca

SEQ ID NO: 4889796 - DNA, 22 bp, Homo sapiens
atcactgccacactctccatca

SEQ ID NO: 4889797 - DNA, 19 bp, Homo sapiens
atcactgcttgatgaagca

SEQ ID NO: 4889798 - DNA, 16 bp, Homo sapiens
atcactttgtctaact

SEQ ID NO: 4889799 - DNA, 21 bp, Homo sapiens
atcactttgtctaactcagaa

SEQ ID NO: 4889800 - DNA, 14 bp, Homo sapiens
atcacttttcagtg

SEQ ID NO: 4889801 - DNA, 21 bp, Homo sapiens
atcactttttgaactaagaaa

SEQ ID NO: 4889802 - DNA, 13 bp, Homo sapiens
atcagaaaaggga

SEQ ID NO: 4889803 - DNA, 15 bp, Homo sapiens
atcagaaaagggaag

SEQ ID NO: 4889804 - DNA, 22 bp, Homo sapiens
atcagagacaaaatatttccca

SEQ ID NO: 4889805 - DNA, 22 bp, Homo sapiens
atcagataagacatatctctaa

SEQ ID NO: 4889806 - DNA, 12 bp, Homo sapiens
atcagatacatc

SEQ ID NO: 4889807 - DNA, 13 bp, Homo sapiens
atcagatacatca

SEQ ID NO: 4889808 - DNA, 15 bp, Homo sapiens
atcagatacatcact

SEQ ID NO: 4889809 - DNA, 16 bp, Homo sapiens
atcagatacatcactg

SEQ ID NO: 4889810 - DNA, 22 bp, Homo sapiens
atcagatggaaatattttgata

SEQ ID NO: 4889811 - DNA, 15 bp, Homo sapiens
atcagcactgaaaat

SEQ ID NO: 4889812 - DNA, 20 bp, Homo sapiens
atcagcccaacgggaagcaa

SEQ ID NO: 4889813 - DNA, 11 bp, Homo sapiens
atcagcctctt

SEQ ID NO: 4889814 - DNA, 13 bp, Homo sapiens
atcagcctcttaa

SEQ ID NO: 4889815 - DNA, 15 bp, Homo sapiens
atcagcctcttaaag

SEQ ID NO: 4889816 - DNA, 20 bp, Homo sapiens
atcagctacttaagagaaat

SEQ ID NO: 4889817 - DNA, 14 bp, Homo sapiens
atcagctatttact

SEQ ID NO: 4889818 - DNA, 16 bp, Homo sapiens
atcaggctactagaat

SEQ ID NO: 4889819 - DNA, 21 bp, Homo sapiens
atcagggcaatcccaacacat

SEQ ID NO: 4889820 - DNA, 17 bp, Homo sapiens
atcagggcctggggcct

SEQ ID NO: 4889821 - DNA, 19 bp, Homo sapiens
atcagggcctggggcctga

SEQ ID NO: 4889822 - DNA, 20 bp, Homo sapiens
atcagggcctggggcctgag

SEQ ID NO: 4889823 - DNA, 21 bp, Homo sapiens
atcagggcctggggcctgaga

SEQ ID NO: 4889824 - DNA, 16 bp, Homo sapiens
atcagggggaagaagc

SEQ ID NO: 4889825 - DNA, 18 bp, Homo sapiens
atcagggggaagaagcag

SEQ ID NO: 4889826 - DNA, 16 bp, Homo sapiens
atcaggtcctcagaga

SEQ ID NO: 4889827 - DNA, 19 bp, Homo sapiens
atcaggtgctgccatccag

SEQ ID NO: 4889828 - DNA, 17 bp, Homo sapiens
atcagtattaatactaa

SEQ ID NO: 4889829 - DNA, 22 bp, Homo sapiens
atcagtattaatactaaaatat

SEQ ID NO: 4889830 - DNA, 13 bp, Homo sapiens
atcagtcaatatt

SEQ ID NO: 4889831 - DNA, 19 bp, Homo sapiens
atcagtgtaccatttgcct

SEQ ID NO: 4889832 - DNA, 19 bp, Homo sapiens
atcagtgttttaaattctg

SEQ ID NO: 4889833 - DNA, 13 bp, Homo sapiens
atcataaggcttc

SEQ ID NO: 4889834 - DNA, 16 bp, Homo sapiens
atcataagtgaattta

SEQ ID NO: 4889835 - DNA, 18 bp, Homo sapiens
atcataagtgaatttata

SEQ ID NO: 4889836 - DNA, 12 bp, Homo sapiens
atcatagaaatg

SEQ ID NO: 4889837 - DNA, 13 bp, Homo sapiens
atcatattgatga

SEQ ID NO: 4889838 - DNA, 20 bp, Homo sapiens
atcatcaacaagatttcctt

SEQ ID NO: 4889839 - DNA, 13 bp, Homo sapiens
atcatcagggcct

SEQ ID NO: 4889840 - DNA, 21 bp, Homo sapiens
atcatcccatctaagctgcag

SEQ ID NO: 4889841 - DNA, 14 bp, Homo sapiens
atcatctattttga

SEQ ID NO: 4889842 - DNA, 19 bp, Homo sapiens
atcatctattttgatgcag

SEQ ID NO: 4889843 - DNA, 21 bp, Homo sapiens
atcatctattttgatgcagca

SEQ ID NO: 4889844 - DNA, 18 bp, Homo sapiens
atcatgaaatatgcatct

SEQ ID NO: 4889845 - DNA, 12 bp, Homo sapiens
atcatgaagcct

SEQ ID NO: 4889846 - DNA, 14 bp, Homo sapiens
atcatgaagcctgt

SEQ ID NO: 4889847 - DNA, 15 bp, Homo sapiens
atcatgaagcctgtg

SEQ ID NO: 4889848 - DNA, 18 bp, Homo sapiens
atcatgacatgttatata

SEQ ID NO: 4889849 - DNA, 22 bp, Homo sapiens
atcatgcagctcaactttctgt

SEQ ID NO: 4889850 - DNA, 20 bp, Homo sapiens
atcatgctttaaagtgtaat

SEQ ID NO: 4889851 - DNA, 11 bp, Homo sapiens
atcatgtaaag

SEQ ID NO: 4889852 - DNA, 14 bp, Homo sapiens
atcatgtcagagca

SEQ ID NO: 4889853 - DNA, 18 bp, Homo sapiens
atcatgtcaggcctgtgt

SEQ ID NO: 4889854 - DNA, 14 bp, Homo sapiens
atcatgtctggcta

SEQ ID NO: 4889855 - DNA, 21 bp, Homo sapiens
atcatgttgttaaaattatga

SEQ ID NO: 4889856 - DNA, 11 bp, Homo sapiens
atcattaatac

SEQ ID NO: 4889857 - DNA, 17 bp, Homo sapiens
atcattacccttccctg

SEQ ID NO: 4889858 - DNA, 18 bp, Homo sapiens
atcattgttttgaatatt

SEQ ID NO: 4889859 - DNA, 21 bp, Homo sapiens
atcatttattttaagcactct

SEQ ID NO: 4889860 - DNA, 22 bp, Homo sapiens
atcatttattttttacattatt

SEQ ID NO: 4889861 - DNA, 15 bp, Homo sapiens
atcatttctcactgt

SEQ ID NO: 4889862 - DNA, 18 bp, Homo sapiens
atcatttgttggaatgaa

SEQ ID NO: 4889863 - DNA, 14 bp, Homo sapiens
atcattttcccccc

SEQ ID NO: 4889864 - DNA, 15 bp, Homo sapiens
atccaactccagcaa

SEQ ID NO: 4889865 - DNA, 12 bp, Homo sapiens
atccaagcctcc

SEQ ID NO: 4889866 - DNA, 16 bp, Homo sapiens
atccaagcctccacag

SEQ ID NO: 4889867 - DNA, 17 bp, Homo sapiens
atccaagcctccacagc

SEQ ID NO: 4889868 - DNA, 21 bp, Homo sapiens
atccaagctggtcccactcag

SEQ ID NO: 4889869 - DNA, 22 bp, Homo sapiens
atccaatgttagagactttttt

SEQ ID NO: 4889870 - DNA, 23 bp, Homo sapiens
atccaatgttagagacttttttc

SEQ ID NO: 4889871 - DNA, 20 bp, Homo sapiens
atccacaggaaagtgttatt

SEQ ID NO: 4889872 - DNA, 15 bp, Homo sapiens
atccacatttctaaa

SEQ ID NO: 4889873 - DNA, 18 bp, Homo sapiens
atccacccacctcagcct

SEQ ID NO: 4889874 - DNA, 16 bp, Homo sapiens
atccacccatatgtta

SEQ ID NO: 4889875 - DNA, 18 bp, Homo sapiens
atccacctgtctcagcct

SEQ ID NO: 4889876 - DNA, 21 bp, Homo sapiens
atccacctgtctcagcctccc

SEQ ID NO: 4889877 - DNA, 21 bp, Homo sapiens
atccactgtgccatgtgccag

SEQ ID NO: 4889878 - DNA, 12 bp, Homo sapiens
atccactttgca

SEQ ID NO: 4889879 - DNA, 21 bp, Homo sapiens
atccagacatcatgaatttta

SEQ ID NO: 4889880 - DNA, 22 bp, Homo sapiens
atccagaggcaaacggaggcaa

SEQ ID NO: 4889881 - DNA, 15 bp, Homo sapiens
atccaggcacagctg

SEQ ID NO: 4889882 - DNA, 16 bp, Homo sapiens
atccaggttcagcttg

SEQ ID NO: 4889883 - DNA, 16 bp, Homo sapiens
atccagttcatgagaa

SEQ ID NO: 4889884 - DNA, 20 bp, Homo sapiens
atccatattgagtcaaatgg

SEQ ID NO: 4889885 - DNA, 18 bp, Homo sapiens
atccatgtcctatgtgtg

SEQ ID NO: 4889886 - DNA, 19 bp, Homo sapiens
atccatgtcctatgtgtga

SEQ ID NO: 4889887 - DNA, 21 bp, Homo sapiens
atcccaaccagtgccaaggac

SEQ ID NO: 4889888 - DNA, 16 bp, Homo sapiens
atcccaatcattgttg

SEQ ID NO: 4889889 - DNA, 15 bp, Homo sapiens
atcccaccaaccctc

SEQ ID NO: 4889890 - DNA, 18 bp, Homo sapiens
atcccacccacatgtgac

SEQ ID NO: 4889891 - DNA, 17 bp, Homo sapiens
atcccagaaattagaaa

SEQ ID NO: 4889892 - DNA, 16 bp, Homo sapiens
atcccagcacctgcct

SEQ ID NO: 4889893 - DNA, 21 bp, Homo sapiens
atcccagcacctgcctcctcg

SEQ ID NO: 4889894 - DNA, 21 bp, Homo sapiens
atcccaggacaccacacccag

SEQ ID NO: 4889895 - DNA, 19 bp, Homo sapiens
atcccaggggcccaaggcg

SEQ ID NO: 4889896 - DNA, 18 bp, Homo sapiens
atcccatctaagctgcag

SEQ ID NO: 4889897 - DNA, 20 bp, Homo sapiens
atcccatctaagctgcagct

SEQ ID NO: 4889898 - DNA, 17 bp, Homo sapiens
atcccatgagcctcagc

SEQ ID NO: 4889899 - DNA, 15 bp, Homo sapiens
atcccatgtatttat

SEQ ID NO: 4889900 - DNA, 18 bp, Homo sapiens
atcccattaatcatttcc

SEQ ID NO: 4889901 - DNA, 21 bp, Homo sapiens
atcccattaatcatttcccca

SEQ ID NO: 4889902 - DNA, 20 bp, Homo sapiens
atccccaaaacaaagtcttt

SEQ ID NO: 4889903 - DNA, 14 bp, Homo sapiens
atccccaagtgtga

SEQ ID NO: 4889904 - DNA, 22 bp, Homo sapiens
atccccagggggcatgaccaga

SEQ ID NO: 4889905 - DNA, 14 bp, Homo sapiens
atcccccttgccac

SEQ ID NO: 4889906 - DNA, 18 bp, Homo sapiens
atcccccttgccacccca

SEQ ID NO: 4889907 - DNA, 22 bp, Homo sapiens
atccccgttcctgacatcacag

SEQ ID NO: 4889908 - DNA, 15 bp, Homo sapiens
atcccctccctgtca

SEQ ID NO: 4889909 - DNA, 20 bp, Homo sapiens
atcccctctgtctacaaata

SEQ ID NO: 4889910 - DNA, 12 bp, Homo sapiens
atcccctgctac

SEQ ID NO: 4889911 - DNA, 13 bp, Homo sapiens
atcccgaagaatg

SEQ ID NO: 4889912 - DNA, 21 bp, Homo sapiens
atcccgaagaatggagaggaa

SEQ ID NO: 4889913 - DNA, 15 bp, Homo sapiens
atcccgagtctggga

SEQ ID NO: 4889914 - DNA, 17 bp, Homo sapiens
atcccgagtctgggaca

SEQ ID NO: 4889915 - DNA, 13 bp, Homo sapiens
atcccgtgttctc

SEQ ID NO: 4889916 - DNA, 17 bp, Homo sapiens
atccctcgatattttta

SEQ ID NO: 4889917 - DNA, 24 bp, Homo sapiens
atccctcgatatttttaaagatct

SEQ ID NO: 4889918 - DNA, 23 bp, Homo sapiens
atccctctaatgagactgaccat

SEQ ID NO: 4889919 - DNA, 22 bp, Homo sapiens
atccctgtttaatatttaaaca

SEQ ID NO: 4889920 - DNA, 23 bp, Homo sapiens
atccctgtttaatatttaaacag

SEQ ID NO: 4889921 - DNA, 14 bp, Homo sapiens
atcccttctcacag

SEQ ID NO: 4889922 - DNA, 14 bp, Homo sapiens
atccgctctcttcc

SEQ ID NO: 4889923 - DNA, 16 bp, Homo sapiens
atccgctctcttcctg

SEQ ID NO: 4889924 - DNA, 18 bp, Homo sapiens
atcctaactgaagagaca

SEQ ID NO: 4889925 - DNA, 19 bp, Homo sapiens
atcctaagaaatatgtgag

SEQ ID NO: 4889926 - DNA, 21 bp, Homo sapiens
atcctaagaaatatgtgagat

SEQ ID NO: 4889927 - DNA, 22 bp, Homo sapiens
atcctaagaaatatgtgagatt

SEQ ID NO: 4889928 - DNA, 15 bp, Homo sapiens
atcctaagacacaaa

SEQ ID NO: 4889929 - DNA, 18 bp, Homo sapiens
atcctatccactgggcac

SEQ ID NO: 4889930 - DNA, 16 bp, Homo sapiens
atcctcactgccctcc

SEQ ID NO: 4889931 - DNA, 12 bp, Homo sapiens
atcctcctggaa

SEQ ID NO: 4889932 - DNA, 16 bp, Homo sapiens
atcctcctggaacctt

SEQ ID NO: 4889933 - DNA, 19 bp, Homo sapiens
atcctgaactgcttctcca

SEQ ID NO: 4889934 - DNA, 19 bp, Homo sapiens
atcctgaggtgtaccagga

SEQ ID NO: 4889935 - DNA, 17 bp, Homo sapiens
atcctgcaatgaaaggt

SEQ ID NO: 4889936 - DNA, 16 bp, Homo sapiens
atcctgcattgttagc

SEQ ID NO: 4889937 - DNA, 17 bp, Homo sapiens
atcctgccagccccaca

SEQ ID NO: 4889938 - DNA, 17 bp, Homo sapiens
atcctgccttcatggaa

SEQ ID NO: 4889939 - DNA, 17 bp, Homo sapiens
atcctggcacccggccc

SEQ ID NO: 4889940 - DNA, 20 bp, Homo sapiens
atcctggcacccggcccctg

SEQ ID NO: 4889941 - DNA, 21 bp, Homo sapiens
atcctggcacccggcccctgc

SEQ ID NO: 4889942 - DNA, 11 bp, Homo sapiens
atcctggcagc

SEQ ID NO: 4889943 - DNA, 13 bp, Homo sapiens
atcctggcagccc

SEQ ID NO: 4889944 - DNA, 16 bp, Homo sapiens
atcctggcagcccaga

SEQ ID NO: 4889945 - DNA, 18 bp, Homo sapiens
atcctggctctgtggctt

SEQ ID NO: 4889946 - DNA, 22 bp, Homo sapiens
atcctggctctgtggcttgcta

SEQ ID NO: 4889947 - DNA, 14 bp, Homo sapiens
atcctgtataagca

SEQ ID NO: 4889948 - DNA, 16 bp, Homo sapiens
atcctgtataagcact

SEQ ID NO: 4889949 - DNA, 21 bp, Homo sapiens
atcctgtctttaaggaaaaaa

SEQ ID NO: 4889950 - DNA, 23 bp, Homo sapiens
atcctgtctttaaggaaaaaaag

SEQ ID NO: 4889951 - DNA, 15 bp, Homo sapiens
atcctgtctttctga

SEQ ID NO: 4889952 - DNA, 11 bp, Homo sapiens
atcctgtgact

SEQ ID NO: 4889953 - DNA, 18 bp, Homo sapiens
atccttagaggtcctctg

SEQ ID NO: 4889954 - DNA, 15 bp, Homo sapiens
atccttatcagagct

SEQ ID NO: 4889955 - DNA, 23 bp, Homo sapiens
atccttccaaaaattattataag

SEQ ID NO: 4889956 - DNA, 12 bp, Homo sapiens
atccttcctata

SEQ ID NO: 4889957 - DNA, 15 bp, Homo sapiens
atccttcctataact

SEQ ID NO: 4889958 - DNA, 20 bp, Homo sapiens
atccttcctataacttgatg

SEQ ID NO: 4889959 - DNA, 16 bp, Homo sapiens
atccttgactggacct

SEQ ID NO: 4889960 - DNA, 15 bp, Homo sapiens
atccttggtctttgt

SEQ ID NO: 4889961 - DNA, 18 bp, Homo sapiens
atccttggtctttgtatc

SEQ ID NO: 4889962 - DNA, 19 bp, Homo sapiens
atccttggtctttgtatct

SEQ ID NO: 4889963 - DNA, 23 bp, Homo sapiens
atccttgttttgaaaacctaaaa

SEQ ID NO: 4889964 - DNA, 16 bp, Homo sapiens
atcctttctgccgacc

SEQ ID NO: 4889965 - DNA, 15 bp, Homo sapiens
atcctttgcagggca

SEQ ID NO: 4889966 - DNA, 16 bp, Homo sapiens
atcctttgcagggcag

SEQ ID NO: 4889967 - DNA, 19 bp, Homo sapiens
atcctttgttttctgacta

SEQ ID NO: 4889968 - DNA, 16 bp, Homo sapiens
atcgaaaattcatttc

SEQ ID NO: 4889969 - DNA, 17 bp, Homo sapiens
atcgaaataacaatgtt

SEQ ID NO: 4889970 - DNA, 18 bp, Homo sapiens
atcgaatctactaattcc

SEQ ID NO: 4889971 - DNA, 13 bp, Homo sapiens
atcggcctcctct

SEQ ID NO: 4889972 - DNA, 14 bp, Homo sapiens
atcggcctcctctt

SEQ ID NO: 4889973 - DNA, 21 bp, Homo sapiens
atcggcctcctcttcaccccg

SEQ ID NO: 4889974 - DNA, 15 bp, Homo sapiens
atcgtaaccagccag

SEQ ID NO: 4889975 - DNA, 15 bp, Homo sapiens
atcgtgacaacactt

SEQ ID NO: 4889976 - DNA, 13 bp, Homo sapiens
atctaaatctatt

SEQ ID NO: 4889977 - DNA, 15 bp, Homo sapiens
atctaaatctattta

SEQ ID NO: 4889978 - DNA, 15 bp, Homo sapiens
atctaagctgcagct

SEQ ID NO: 4889979 - DNA, 18 bp, Homo sapiens
atctaagctgcagcttcc

SEQ ID NO: 4889980 - DNA, 13 bp, Homo sapiens
atctaagttataa

SEQ ID NO: 4889981 - DNA, 19 bp, Homo sapiens
atctaagttataagactct

SEQ ID NO: 4889982 - DNA, 17 bp, Homo sapiens
atctaatacctctgtgt

SEQ ID NO: 4889983 - DNA, 22 bp, Homo sapiens
atctaatagcgggttactttca

SEQ ID NO: 4889984 - DNA, 22 bp, Homo sapiens
atctaatatatatgaataaagt

SEQ ID NO: 4889985 - DNA, 14 bp, Homo sapiens
atctaatattaaaa

SEQ ID NO: 4889986 - DNA, 19 bp, Homo sapiens
atctactaattccacacct

SEQ ID NO: 4889987 - DNA, 17 bp, Homo sapiens
atctagacaatatacaa

SEQ ID NO: 4889988 - DNA, 15 bp, Homo sapiens
atctagctagtaata

SEQ ID NO: 4889989 - DNA, 14 bp, Homo sapiens
atctaggcatgaag

SEQ ID NO: 4889990 - DNA, 11 bp, Homo sapiens
atctagtgttg

SEQ ID NO: 4889991 - DNA, 21 bp, Homo sapiens
atctataaagcgatatacaga

SEQ ID NO: 4889992 - DNA, 15 bp, Homo sapiens
atctatatatgtgta

SEQ ID NO: 4889993 - DNA, 19 bp, Homo sapiens
atctatatatgtgtatgta

SEQ ID NO: 4889994 - DNA, 12 bp, Homo sapiens
atctattaatat

SEQ ID NO: 4889995 - DNA, 15 bp, Homo sapiens
atctattaatatatg

SEQ ID NO: 4889996 - DNA, 18 bp, Homo sapiens
atctattaatatatgtat

SEQ ID NO: 4889997 - DNA, 17 bp, Homo sapiens
atctattctgagaaaac

SEQ ID NO: 4889998 - DNA, 22 bp, Homo sapiens
atctattctgagaaaacaagca

SEQ ID NO: 4889999 - DNA, 13 bp, Homo sapiens
atctattctgtgt

SEQ ID NO: 4890000 - DNA, 15 bp, Homo sapiens
atctatttattaata

SEQ ID NO: 4890001 - DNA, 14 bp, Homo sapiens
atctattttctatg

SEQ ID NO: 4890002 - DNA, 16 bp, Homo sapiens
atctattttctatgta

SEQ ID NO: 4890003 - DNA, 20 bp, Homo sapiens
atctattttctatgtactag

SEQ ID NO: 4890004 - DNA, 16 bp, Homo sapiens
atctattttgatgcag

SEQ ID NO: 4890005 - DNA, 17 bp, Homo sapiens
atctattttgatgcagc

SEQ ID NO: 4890006 - DNA, 18 bp, Homo sapiens
atctattttgatgcagca

SEQ ID NO: 4890007 - DNA, 22 bp, Homo sapiens
atctattttggattgtatattg

SEQ ID NO: 4890008 - DNA, 14 bp, Homo sapiens
atctcaccccatcc

SEQ ID NO: 4890009 - DNA, 16 bp, Homo sapiens
atctcaccccatccca

SEQ ID NO: 4890010 - DNA, 22 bp, Homo sapiens
atctcaccccatcccacaccct

SEQ ID NO: 4890011 - DNA, 23 bp, Homo sapiens
atctcagctttgagaagccttca

SEQ ID NO: 4890012 - DNA, 20 bp, Homo sapiens
atctcagtcatgcataaata

SEQ ID NO: 4890013 - DNA, 21 bp, Homo sapiens
atctcagtcatgcataaatat

SEQ ID NO: 4890014 - DNA, 22 bp, Homo sapiens
atctcagtcatgcataaatatg

SEQ ID NO: 4890015 - DNA, 19 bp, Homo sapiens
atctcataggttgccaata

SEQ ID NO: 4890016 - DNA, 18 bp, Homo sapiens
atctcctataatctgtca

SEQ ID NO: 4890017 - DNA, 21 bp, Homo sapiens
atctcctataatctgtcaaaa

SEQ ID NO: 4890018 - DNA, 19 bp, Homo sapiens
atctcggagcatcccggag

SEQ ID NO: 4890019 - DNA, 13 bp, Homo sapiens
atctctaatatgg

SEQ ID NO: 4890020 - DNA, 18 bp, Homo sapiens
atctctatttaatattta

SEQ ID NO: 4890021 - DNA, 14 bp, Homo sapiens
atctctcaaaactt

SEQ ID NO: 4890022 - DNA, 15 bp, Homo sapiens
atctctcaaaacttg

SEQ ID NO: 4890023 - DNA, 14 bp, Homo sapiens
atctctccctcccc

SEQ ID NO: 4890024 - DNA, 15 bp, Homo sapiens
atctctccctcccct

SEQ ID NO: 4890025 - DNA, 23 bp, Homo sapiens
atctctccctcccctgccatttt

SEQ ID NO: 4890026 - DNA, 15 bp, Homo sapiens
atctctctgcagctg

SEQ ID NO: 4890027 - DNA, 16 bp, Homo sapiens
atctctgaagcatgtt

SEQ ID NO: 4890028 - DNA, 20 bp, Homo sapiens
atctctgcaccctggggcct

SEQ ID NO: 4890029 - DNA, 15 bp, Homo sapiens
atctctgtgtgcaca

SEQ ID NO: 4890030 - DNA, 16 bp, Homo sapiens
atctctgttatgtact

SEQ ID NO: 4890031 - DNA, 18 bp, Homo sapiens
atctctgttatgtactgt

SEQ ID NO: 4890032 - DNA, 19 bp, Homo sapiens
atctctgttatgtactgta

SEQ ID NO: 4890033 - DNA, 20 bp, Homo sapiens
atctctgttatgtactgtac

SEQ ID NO: 4890034 - DNA, 20 bp, Homo sapiens
atctcttcttttggcttcca

SEQ ID NO: 4890035 - DNA, 13 bp, Homo sapiens
atctctttcacat

SEQ ID NO: 4890036 - DNA, 21 bp, Homo sapiens
atctgaaataggaaacaagtg

SEQ ID NO: 4890037 - DNA, 15 bp, Homo sapiens
atctgaagccctccc

SEQ ID NO: 4890038 - DNA, 18 bp, Homo sapiens
atctgagttgccaagaca

SEQ ID NO: 4890039 - DNA, 20 bp, Homo sapiens
atctgagttgccaagacaaa

SEQ ID NO: 4890040 - DNA, 23 bp, Homo sapiens
atctgagttgccaagacaaatca

SEQ ID NO: 4890041 - DNA, 13 bp, Homo sapiens
atctgatttgcat

SEQ ID NO: 4890042 - DNA, 21 bp, Homo sapiens
atctgcaattcaaaagttcca

SEQ ID NO: 4890043 - DNA, 22 bp, Homo sapiens
atctgcacccttcttttctcat

SEQ ID NO: 4890044 - DNA, 22 bp, Homo sapiens
atctgcattttcaccccaccct

SEQ ID NO: 4890045 - DNA, 15 bp, Homo sapiens
atctgcccacctcag

SEQ ID NO: 4890046 - DNA, 22 bp, Homo sapiens
atctgcggatctcagctttgag

SEQ ID NO: 4890047 - DNA, 23 bp, Homo sapiens
atctgcggatctcagctttgaga

SEQ ID NO: 4890048 - DNA, 14 bp, Homo sapiens
atctgctggagttt

SEQ ID NO: 4890049 - DNA, 16 bp, Homo sapiens
atctggactcctctgt

SEQ ID NO: 4890050 - DNA, 17 bp, Homo sapiens
atctggactcctctgtc

SEQ ID NO: 4890051 - DNA, 18 bp, Homo sapiens
atctggactcctctgtcc

SEQ ID NO: 4890052 - DNA, 22 bp, Homo sapiens
atctggaggccttccagctgct

SEQ ID NO: 4890053 - DNA, 17 bp, Homo sapiens
atctggataggagcctg

SEQ ID NO: 4890054 - DNA, 22 bp, Homo sapiens
atctggataggagcctgctggt

SEQ ID NO: 4890055 - DNA, 21 bp, Homo sapiens
atctggccccaggtagaaact

SEQ ID NO: 4890056 - DNA, 21 bp, Homo sapiens
atctggccctcgacactcacc

SEQ ID NO: 4890057 - DNA, 17 bp, Homo sapiens
atctggcctaaaatctt

SEQ ID NO: 4890058 - DNA, 22 bp, Homo sapiens
atctggcctaaaatcttggaag

SEQ ID NO: 4890059 - DNA, 23 bp, Homo sapiens
atctggcctaaaatcttggaagt

SEQ ID NO: 4890060 - DNA, 18 bp, Homo sapiens
atctggcctggcctggcc

SEQ ID NO: 4890061 - DNA, 17 bp, Homo sapiens
atctggctcctttacaa

SEQ ID NO: 4890062 - DNA, 21 bp, Homo sapiens
atctggctcctttacaaaaga

SEQ ID NO: 4890063 - DNA, 16 bp, Homo sapiens
atctggcttattttaa

SEQ ID NO: 4890064 - DNA, 19 bp, Homo sapiens
atctggcttattttaatgt

SEQ ID NO: 4890065 - DNA, 21 bp, Homo sapiens
atctggcttattttaatgtga

SEQ ID NO: 4890066 - DNA, 18 bp, Homo sapiens
atctgggtccttgcaccc

SEQ ID NO: 4890067 - DNA, 17 bp, Homo sapiens
atctgggttcactgcaa

SEQ ID NO: 4890068 - DNA, 19 bp, Homo sapiens
atctgggttcactgcaacc

SEQ ID NO: 4890069 - DNA, 19 bp, Homo sapiens
atctggtcttgttagaaaa

SEQ ID NO: 4890070 - DNA, 11 bp, Homo sapiens
atctgtaacag

SEQ ID NO: 4890071 - DNA, 11 bp, Homo sapiens
atctgtacatt

SEQ ID NO: 4890072 - DNA, 15 bp, Homo sapiens
atctgtacattttgt

SEQ ID NO: 4890073 - DNA, 16 bp, Homo sapiens
atctgtcaaaacactg

SEQ ID NO: 4890074 - DNA, 19 bp, Homo sapiens
atctgtcaaaacactgtgg

SEQ ID NO: 4890075 - DNA, 22 bp, Homo sapiens
atctgtcaaaacactgtggaac

SEQ ID NO: 4890076 - DNA, 18 bp, Homo sapiens
atctgtcacaccagccat

SEQ ID NO: 4890077 - DNA, 12 bp, Homo sapiens
atctgtcatttg

SEQ ID NO: 4890078 - DNA, 18 bp, Homo sapiens
atctgtctcccagttatg

SEQ ID NO: 4890079 - DNA, 20 bp, Homo sapiens
atctgtctcccagttatgaa

SEQ ID NO: 4890080 - DNA, 14 bp, Homo sapiens
atctgtcttgtaat

SEQ ID NO: 4890081 - DNA, 15 bp, Homo sapiens
atctgtcttgtaata

SEQ ID NO: 4890082 - DNA, 16 bp, Homo sapiens
atctgtcttgtaatat

SEQ ID NO: 4890083 - DNA, 16 bp, Homo sapiens
atctgtggtcttcaaa

SEQ ID NO: 4890084 - DNA, 14 bp, Homo sapiens
atctgtttaaagca

SEQ ID NO: 4890085 - DNA, 18 bp, Homo sapiens
atctgttttgaaggcaaa

SEQ ID NO: 4890086 - DNA, 19 bp, Homo sapiens
atctgttttgaaggcaaaa

SEQ ID NO: 4890087 - DNA, 21 bp, Homo sapiens
atcttaaagaaacagctttca

SEQ ID NO: 4890088 - DNA, 22 bp, Homo sapiens
atcttaaagaaacagctttcaa

SEQ ID NO: 4890089 - DNA, 23 bp, Homo sapiens
atcttaaagaaacagctttcaag

SEQ ID NO: 4890090 - DNA, 21 bp, Homo sapiens
atcttaatgaatgagtctgtt

SEQ ID NO: 4890091 - DNA, 18 bp, Homo sapiens
atcttagatgtttcacac

SEQ ID NO: 4890092 - DNA, 15 bp, Homo sapiens
atcttagattctctg

SEQ ID NO: 4890093 - DNA, 18 bp, Homo sapiens
atcttagattctctgtgt

SEQ ID NO: 4890094 - DNA, 18 bp, Homo sapiens
atcttagggtgaaccact

SEQ ID NO: 4890095 - DNA, 18 bp, Homo sapiens
atcttatagcactttgaa

SEQ ID NO: 4890096 - DNA, 21 bp, Homo sapiens
atcttatagcactttgaaata

SEQ ID NO: 4890097 - DNA, 17 bp, Homo sapiens
atcttatagttctaggc

SEQ ID NO: 4890098 - DNA, 12 bp, Homo sapiens
atcttcacatag

SEQ ID NO: 4890099 - DNA, 16 bp, Homo sapiens
atcttccatatttgga

SEQ ID NO: 4890100 - DNA, 20 bp, Homo sapiens
atcttctcaagttctaagat

SEQ ID NO: 4890101 - DNA, 13 bp, Homo sapiens
atcttctccagat

SEQ ID NO: 4890102 - DNA, 12 bp, Homo sapiens
atcttgaaatta

SEQ ID NO: 4890103 - DNA, 22 bp, Homo sapiens
atcttgaaattaagaaggcaaa

SEQ ID NO: 4890104 - DNA, 16 bp, Homo sapiens
atcttgaagggcccag

SEQ ID NO: 4890105 - DNA, 17 bp, Homo sapiens
atcttgaagggcccagg

SEQ ID NO: 4890106 - DNA, 23 bp, Homo sapiens
atcttgcgaatccaagctccctg

SEQ ID NO: 4890107 - DNA, 13 bp, Homo sapiens
atcttgctctgct

SEQ ID NO: 4890108 - DNA, 14 bp, Homo sapiens
atcttgctctgctg

SEQ ID NO: 4890109 - DNA, 15 bp, Homo sapiens
atcttgctctgctga

SEQ ID NO: 4890110 - DNA, 22 bp, Homo sapiens
atcttggctatgtaattcttgt

SEQ ID NO: 4890111 - DNA, 20 bp, Homo sapiens
atcttgtgctagaatacttt

SEQ ID NO: 4890112 - DNA, 17 bp, Homo sapiens
atcttgtgttgtccttt

SEQ ID NO: 4890113 - DNA, 21 bp, Homo sapiens
atctttacaaaactacatgag

SEQ ID NO: 4890114 - DNA, 15 bp, Homo sapiens
atctttagtgctttc

SEQ ID NO: 4890115 - DNA, 17 bp, Homo sapiens
atctttcgataaacaac

SEQ ID NO: 4890116 - DNA, 22 bp, Homo sapiens
atctttctccttgaatatcttt

SEQ ID NO: 4890117 - DNA, 21 bp, Homo sapiens
atctttcttttgattcttcct

SEQ ID NO: 4890118 - DNA, 13 bp, Homo sapiens
atctttgccttgg

SEQ ID NO: 4890119 - DNA, 20 bp, Homo sapiens
atctttgccttgggctgctc

SEQ ID NO: 4890120 - DNA, 11 bp, Homo sapiens
atcttttacat

SEQ ID NO: 4890121 - DNA, 16 bp, Homo sapiens
atcttttatgtttgaa

SEQ ID NO: 4890122 - DNA, 18 bp, Homo sapiens
atgaaaagacaagaaaat

SEQ ID NO: 4890123 - DNA, 18 bp, Homo sapiens
atgaaaatgagttgtgaa

SEQ ID NO: 4890124 - DNA, 19 bp, Homo sapiens
atgaaaatgagttgtgaaa

SEQ ID NO: 4890125 - DNA, 13 bp, Homo sapiens
atgaaaatttgag

SEQ ID NO: 4890126 - DNA, 17 bp, Homo sapiens
atgaaaattttaaaaat

SEQ ID NO: 4890127 - DNA, 16 bp, Homo sapiens
atgaaacaaataatca

SEQ ID NO: 4890128 - DNA, 14 bp, Homo sapiens
atgaaagaatatat

SEQ ID NO: 4890129 - DNA, 18 bp, Homo sapiens
atgaaagattaaacagat

SEQ ID NO: 4890130 - DNA, 21 bp, Homo sapiens
atgaaagcagggaatttctat

SEQ ID NO: 4890131 - DNA, 19 bp, Homo sapiens
atgaaagggcccagagagg

SEQ ID NO: 4890132 - DNA, 21 bp, Homo sapiens
atgaaaggtttacattgtcaa

SEQ ID NO: 4890133 - DNA, 20 bp, Homo sapiens
atgaaagtctagaaataaaa

SEQ ID NO: 4890134 - DNA, 22 bp, Homo sapiens
atgaaataaagacccaggggga

SEQ ID NO: 4890135 - DNA, 15 bp, Homo sapiens
atgaaatatgcatct

SEQ ID NO: 4890136 - DNA, 12 bp, Homo sapiens
atgaaatttaaa

SEQ ID NO: 4890137 - DNA, 21 bp, Homo sapiens
atgaaatttaaacattaaaaa

SEQ ID NO: 4890138 - DNA, 13 bp, Homo sapiens
atgaacaagtttt

SEQ ID NO: 4890139 - DNA, 14 bp, Homo sapiens
atgaacaagtttta

SEQ ID NO: 4890140 - DNA, 15 bp, Homo sapiens
atgaacaagttttaa

SEQ ID NO: 4890141 - DNA, 13 bp, Homo sapiens
atgaacacttata

SEQ ID NO: 4890142 - DNA, 12 bp, Homo sapiens
atgaacattcca

SEQ ID NO: 4890143 - DNA, 15 bp, Homo sapiens
atgaagagaagcaat

SEQ ID NO: 4890144 - DNA, 15 bp, Homo sapiens
atgaagagcaaaaat

SEQ ID NO: 4890145 - DNA, 12 bp, Homo sapiens
atgaagccagct

SEQ ID NO: 4890146 - DNA, 12 bp, Homo sapiens
atgaagcccaag

SEQ ID NO: 4890147 - DNA, 16 bp, Homo sapiens
atgaagccttttgaaa

SEQ ID NO: 4890148 - DNA, 20 bp, Homo sapiens
atgaagccttttgaaaggga

SEQ ID NO: 4890149 - DNA, 22 bp, Homo sapiens
atgaaggcagaaaaatgtcatt

SEQ ID NO: 4890150 - DNA, 20 bp, Homo sapiens
atgaagtttaaaacagtatt

SEQ ID NO: 4890151 - DNA, 22 bp, Homo sapiens
atgaagtttgtagttgttttaa

SEQ ID NO: 4890152 - DNA, 16 bp, Homo sapiens
atgaagttttacattg

SEQ ID NO: 4890153 - DNA, 15 bp, Homo sapiens
atgaatacaaatttt

SEQ ID NO: 4890154 - DNA, 18 bp, Homo sapiens
atgaatatctattaatat

SEQ ID NO: 4890155 - DNA, 17 bp, Homo sapiens
atgaatattgaagtttc

SEQ ID NO: 4890156 - DNA, 14 bp, Homo sapiens
atgaatattttgat

SEQ ID NO: 4890157 - DNA, 20 bp, Homo sapiens
atgaatattttgataataat

SEQ ID NO: 4890158 - DNA, 20 bp, Homo sapiens
atgaatctcccactccagcg

SEQ ID NO: 4890159 - DNA, 22 bp, Homo sapiens
atgaatctgatttttatgatga

SEQ ID NO: 4890160 - DNA, 23 bp, Homo sapiens
atgaatctgtctcccagttatga

SEQ ID NO: 4890161 - DNA, 19 bp, Homo sapiens
atgaatgaggtctgggcta

SEQ ID NO: 4890162 - DNA, 23 bp, Homo sapiens
atgaatttaaatataattctgta

SEQ ID NO: 4890163 - DNA, 15 bp, Homo sapiens
atgacaatgactgtg

SEQ ID NO: 4890164 - DNA, 16 bp, Homo sapiens
atgacactagaaaact

SEQ ID NO: 4890165 - DNA, 21 bp, Homo sapiens
atgacactagaaaacttgact

SEQ ID NO: 4890166 - DNA, 18 bp, Homo sapiens
atgacataacagtgcagg

SEQ ID NO: 4890167 - DNA, 18 bp, Homo sapiens
atgacatcacttgtacaa

SEQ ID NO: 4890168 - DNA, 19 bp, Homo sapiens
atgacatcacttgtacaaa

SEQ ID NO: 4890169 - DNA, 13 bp, Homo sapiens
atgacatcttttt

SEQ ID NO: 4890170 - DNA, 21 bp, Homo sapiens
atgacatctttttaaagctta

SEQ ID NO: 4890171 - DNA, 14 bp, Homo sapiens
atgacatgcactga

SEQ ID NO: 4890172 - DNA, 17 bp, Homo sapiens
atgacatgcactgaccc

SEQ ID NO: 4890173 - DNA, 22 bp, Homo sapiens
atgacatgcactgacccttcca

SEQ ID NO: 4890174 - DNA, 23 bp, Homo sapiens
atgacatgcactgacccttccag

SEQ ID NO: 4890175 - DNA, 20 bp, Homo sapiens
atgacctctgtcctccctct

SEQ ID NO: 4890176 - DNA, 23 bp, Homo sapiens
atgactacttagcatcctaagaa

SEQ ID NO: 4890177 - DNA, 14 bp, Homo sapiens
atgactcagaatat

SEQ ID NO: 4890178 - DNA, 22 bp, Homo sapiens
atgactcccttaaaatagaaat

SEQ ID NO: 4890179 - DNA, 22 bp, Homo sapiens
atgactgctccccagccctggc

SEQ ID NO: 4890180 - DNA, 22 bp, Homo sapiens
atgactgtgctactgtctttgg

SEQ ID NO: 4890181 - DNA, 16 bp, Homo sapiens
atgacttgctactttt

SEQ ID NO: 4890182 - DNA, 20 bp, Homo sapiens
atgacttgtagcatattctt

SEQ ID NO: 4890183 - DNA, 13 bp, Homo sapiens
atgagaacaaaca

SEQ ID NO: 4890184 - DNA, 14 bp, Homo sapiens
atgagaacaaagct

SEQ ID NO: 4890185 - DNA, 11 bp, Homo sapiens
atgagaatcta

SEQ ID NO: 4890186 - DNA, 23 bp, Homo sapiens
atgagaatctacccccagatcca

SEQ ID NO: 4890187 - DNA, 22 bp, Homo sapiens
atgagaatttctaaaaagatta

SEQ ID NO: 4890188 - DNA, 17 bp, Homo sapiens
atgagactctagggtcc

SEQ ID NO: 4890189 - DNA, 22 bp, Homo sapiens
atgagattgttttatcatgaca

SEQ ID NO: 4890190 - DNA, 14 bp, Homo sapiens
atgagcacctccat

SEQ ID NO: 4890191 - DNA, 14 bp, Homo sapiens
atgagcagaaggaa

SEQ ID NO: 4890192 - DNA, 17 bp, Homo sapiens
atgagcccagagaacag

SEQ ID NO: 4890193 - DNA, 16 bp, Homo sapiens
atgagcctcagcatcc

SEQ ID NO: 4890194 - DNA, 16 bp, Homo sapiens
atgagctattaaaact

SEQ ID NO: 4890195 - DNA, 22 bp, Homo sapiens
atgagctattaaaactcagcct

SEQ ID NO: 4890196 - DNA, 17 bp, Homo sapiens
atgagctgatctgcgga

SEQ ID NO: 4890197 - DNA, 23 bp, Homo sapiens
atgaggaataattatttatttaa

SEQ ID NO: 4890198 - DNA, 17 bp, Homo sapiens
atgagggatgggcctgg

SEQ ID NO: 4890199 - DNA, 14 bp, Homo sapiens
atgaggtcccaggc

SEQ ID NO: 4890200 - DNA, 18 bp, Homo sapiens
atgaggtcccaggcagag

SEQ ID NO: 4890201 - DNA, 19 bp, Homo sapiens
atgaggtcccaggcagaga

SEQ ID NO: 4890202 - DNA, 20 bp, Homo sapiens
atgaggtcccaggcagagaa

SEQ ID NO: 4890203 - DNA, 14 bp, Homo sapiens
atgagtacaaatgc

SEQ ID NO: 4890204 - DNA, 17 bp, Homo sapiens
atgagtacaaatgcctt

SEQ ID NO: 4890205 - DNA, 17 bp, Homo sapiens
atgagtatacaatatat

SEQ ID NO: 4890206 - DNA, 20 bp, Homo sapiens
atgagtccttgaaaatattt

SEQ ID NO: 4890207 - DNA, 18 bp, Homo sapiens
atgagtctgttgtgtgtc

SEQ ID NO: 4890208 - DNA, 20 bp, Homo sapiens
atgataagttcctttccttt

SEQ ID NO: 4890209 - DNA, 17 bp, Homo sapiens
atgatagtaagaaaagt

SEQ ID NO: 4890210 - DNA, 20 bp, Homo sapiens
atgatcaattatagtttctg

SEQ ID NO: 4890211 - DNA, 18 bp, Homo sapiens
atgatcacggctcactgc

SEQ ID NO: 4890212 - DNA, 23 bp, Homo sapiens
atgatcacggctcactgcagcct

SEQ ID NO: 4890213 - DNA, 22 bp, Homo sapiens
atgatcactaatactaattcat

SEQ ID NO: 4890214 - DNA, 21 bp, Homo sapiens
atgatccatgagtttgccctg

SEQ ID NO: 4890215 - DNA, 17 bp, Homo sapiens
atgatctgcctctaaaa

SEQ ID NO: 4890216 - DNA, 17 bp, Homo sapiens
atgatctttgcagacag

SEQ ID NO: 4890217 - DNA, 18 bp, Homo sapiens
atgatgaaatgaggtcag

SEQ ID NO: 4890218 - DNA, 15 bp, Homo sapiens
atgatgaatgagaat

SEQ ID NO: 4890219 - DNA, 14 bp, Homo sapiens
atgatgcagtctcc

SEQ ID NO: 4890220 - DNA, 15 bp, Homo sapiens
atgatgcagtctcct

SEQ ID NO: 4890221 - DNA, 19 bp, Homo sapiens
atgatggcaattttgtaac

SEQ ID NO: 4890222 - DNA, 18 bp, Homo sapiens
atgatggttgcaaaagac

SEQ ID NO: 4890223 - DNA, 21 bp, Homo sapiens
atgatgtaatctctctgcagc

SEQ ID NO: 4890224 - DNA, 17 bp, Homo sapiens
atgatgtgaaacacttt

SEQ ID NO: 4890225 - DNA, 15 bp, Homo sapiens
atgatgtttcacata

SEQ ID NO: 4890226 - DNA, 17 bp, Homo sapiens
atgattaaataagattc

SEQ ID NO: 4890227 - DNA, 24 bp, Homo sapiens
atgattaaataagattctaacggt

SEQ ID NO: 4890228 - DNA, 17 bp, Homo sapiens
atgattcagaaattgga

SEQ ID NO: 4890229 - DNA, 18 bp, Homo sapiens
atgattgtaaaatagctt

SEQ ID NO: 4890230 - DNA, 13 bp, Homo sapiens
atgatttaataaa

SEQ ID NO: 4890231 - DNA, 13 bp, Homo sapiens
atgatttatagtt

SEQ ID NO: 4890232 - DNA, 21 bp, Homo sapiens
atgatttcactagaaaagctg

SEQ ID NO: 4890233 - DNA, 21 bp, Homo sapiens
atgatttcatgctatctctgt

SEQ ID NO: 4890234 - DNA, 13 bp, Homo sapiens
atgatttccttga

SEQ ID NO: 4890235 - DNA, 16 bp, Homo sapiens
atgatttccttgaatg

SEQ ID NO: 4890236 - DNA, 17 bp, Homo sapiens
atgatttccttgaatgt

SEQ ID NO: 4890237 - DNA, 20 bp, Homo sapiens
atgatttccttgaatgtggc

SEQ ID NO: 4890238 - DNA, 20 bp, Homo sapiens
atgattttcataacttattg

SEQ ID NO: 4890239 - DNA, 13 bp, Homo sapiens
atgatttttagat

SEQ ID NO: 4890240 - DNA, 19 bp, Homo sapiens
atgattttttaaaagaaat

SEQ ID NO: 4890241 - DNA, 22 bp, Homo sapiens
atgattttttaaaagaaattta

SEQ ID NO: 4890242 - DNA, 14 bp, Homo sapiens
atgcaaagtacaat

SEQ ID NO: 4890243 - DNA, 15 bp, Homo sapiens
atgcaaagtacaatg

SEQ ID NO: 4890244 - DNA, 17 bp, Homo sapiens
atgcaaagttctgtgtt

SEQ ID NO: 4890245 - DNA, 21 bp, Homo sapiens
atgcaagagtgattgcagctt

SEQ ID NO: 4890246 - DNA, 18 bp, Homo sapiens
atgcaaggaaggaaagaa

SEQ ID NO: 4890247 - DNA, 19 bp, Homo sapiens
atgcaattagcctcatagt

SEQ ID NO: 4890248 - DNA, 19 bp, Homo sapiens
atgcaatttattaaaatga

SEQ ID NO: 4890249 - DNA, 21 bp, Homo sapiens
atgcacacacacacgctttct

SEQ ID NO: 4890250 - DNA, 11 bp, Homo sapiens
atgcacagaga

SEQ ID NO: 4890251 - DNA, 19 bp, Homo sapiens
atgcacatatggactctgc

SEQ ID NO: 4890252 - DNA, 13 bp, Homo sapiens
atgcaccagccct

SEQ ID NO: 4890253 - DNA, 22 bp, Homo sapiens
atgcaccagcccttagcaggga

SEQ ID NO: 4890254 - DNA, 20 bp, Homo sapiens
atgcacctagctgtgcaaga

SEQ ID NO: 4890255 - DNA, 15 bp, Homo sapiens
atgcaccttgtgtct

SEQ ID NO: 4890256 - DNA, 16 bp, Homo sapiens
atgcaccttgtgtctg

SEQ ID NO: 4890257 - DNA, 18 bp, Homo sapiens
atgcaccttgtgtctgta

SEQ ID NO: 4890258 - DNA, 19 bp, Homo sapiens
atgcaccttgtgtctgtac

SEQ ID NO: 4890259 - DNA, 21 bp, Homo sapiens
atgcaccttgtgtctgtacac

SEQ ID NO: 4890260 - DNA, 18 bp, Homo sapiens
atgcacggcctcgcgtct

SEQ ID NO: 4890261 - DNA, 13 bp, Homo sapiens
atgcactatgagg

SEQ ID NO: 4890262 - DNA, 20 bp, Homo sapiens
atgcagaatgtttttaaaat

SEQ ID NO: 4890263 - DNA, 13 bp, Homo sapiens
atgcagagagcca

SEQ ID NO: 4890264 - DNA, 21 bp, Homo sapiens
atgcagcaaggccctgctgcc

SEQ ID NO: 4890265 - DNA, 12 bp, Homo sapiens
atgcagcatttg

SEQ ID NO: 4890266 - DNA, 23 bp, Homo sapiens
atgcagcccatgcccacctgccc

SEQ ID NO: 4890267 - DNA, 22 bp, Homo sapiens
atgcaggccctttgaagcctca

SEQ ID NO: 4890268 - DNA, 19 bp, Homo sapiens
atgcagtctcctctttaaa

SEQ ID NO: 4890269 - DNA, 20 bp, Homo sapiens
atgcagtctcctctttaaaa

SEQ ID NO: 4890270 - DNA, 21 bp, Homo sapiens
atgcagtctcctctttaaaac

SEQ ID NO: 4890271 - DNA, 18 bp, Homo sapiens
atgcagtgatatggcaga

SEQ ID NO: 4890272 - DNA, 19 bp, Homo sapiens
atgcagtgatatggcagaa

SEQ ID NO: 4890273 - DNA, 22 bp, Homo sapiens
atgcagtgatatggcagaagac

SEQ ID NO: 4890274 - DNA, 15 bp, Homo sapiens
atgcataaatatgca

SEQ ID NO: 4890275 - DNA, 14 bp, Homo sapiens
atgcataaatgcat

SEQ ID NO: 4890276 - DNA, 18 bp, Homo sapiens
atgcatatgtcactagaa

SEQ ID NO: 4890277 - DNA, 20 bp, Homo sapiens
atgcatatgtcactagaatg

SEQ ID NO: 4890278 - DNA, 22 bp, Homo sapiens
atgcatctcactggatgcaaag

SEQ ID NO: 4890279 - DNA, 21 bp, Homo sapiens
atgcatgaacaagttttaatg

SEQ ID NO: 4890280 - DNA, 16 bp, Homo sapiens
atgcatgtcaaacatg

SEQ ID NO: 4890281 - DNA, 14 bp, Homo sapiens
atgcattaaacctg

SEQ ID NO: 4890282 - DNA, 15 bp, Homo sapiens
atgcattaaacctgt

SEQ ID NO: 4890283 - DNA, 17 bp, Homo sapiens
atgcattaaacctgtct

SEQ ID NO: 4890284 - DNA, 21 bp, Homo sapiens
atgcattataggatcatttgt

SEQ ID NO: 4890285 - DNA, 18 bp, Homo sapiens
atgccaaagctagggtgg

SEQ ID NO: 4890286 - DNA, 20 bp, Homo sapiens
atgccaagagtgcacccatg

SEQ ID NO: 4890287 - DNA, 14 bp, Homo sapiens
atgccaccctagcc

SEQ ID NO: 4890288 - DNA, 21 bp, Homo sapiens
atgccagggccgaccagagga

SEQ ID NO: 4890289 - DNA, 15 bp, Homo sapiens
atgcccacctgccca

SEQ ID NO: 4890290 - DNA, 16 bp, Homo sapiens
atgccccggccacctc

SEQ ID NO: 4890291 - DNA, 14 bp, Homo sapiens
atgccctggatcca

SEQ ID NO: 4890292 - DNA, 15 bp, Homo sapiens
atgcccttaaatcat

SEQ ID NO: 4890293 - DNA, 14 bp, Homo sapiens
atgcctcctgtggg

SEQ ID NO: 4890294 - DNA, 15 bp, Homo sapiens
atgcctcctgtgggg

SEQ ID NO: 4890295 - DNA, 19 bp, Homo sapiens
atgcctgccccaaacaaat

SEQ ID NO: 4890296 - DNA, 18 bp, Homo sapiens
atgcctggtggcagctgc

SEQ ID NO: 4890297 - DNA, 21 bp, Homo sapiens
atgcctggtggcagctgcggt

SEQ ID NO: 4890298 - DNA, 15 bp, Homo sapiens
atgccttaaaatgga

SEQ ID NO: 4890299 - DNA, 18 bp, Homo sapiens
atgccttaaaatggaatt

SEQ ID NO: 4890300 - DNA, 19 bp, Homo sapiens
atgccttaaaatggaattg

SEQ ID NO: 4890301 - DNA, 22 bp, Homo sapiens
atgccttggggaggacaaaact

SEQ ID NO: 4890302 - DNA, 16 bp, Homo sapiens
atgcctttgagacagt

SEQ ID NO: 4890303 - DNA, 19 bp, Homo sapiens
atgcctttgagacagtttc

SEQ ID NO: 4890304 - DNA, 20 bp, Homo sapiens
atgcctttgagacagtttct

SEQ ID NO: 4890305 - DNA, 16 bp, Homo sapiens
atgccttttttgtagt

SEQ ID NO: 4890306 - DNA, 21 bp, Homo sapiens
atgcgtacgtttcctgagaag

SEQ ID NO: 4890307 - DNA, 21 bp, Homo sapiens
atgctaagcaagctaacctta

SEQ ID NO: 4890308 - DNA, 20 bp, Homo sapiens
atgctactgtctcactgaaa

SEQ ID NO: 4890309 - DNA, 21 bp, Homo sapiens
atgctaggatgcggaaatccc

SEQ ID NO: 4890310 - DNA, 13 bp, Homo sapiens
atgctatctctgt

SEQ ID NO: 4890311 - DNA, 15 bp, Homo sapiens
atgctattgaaaatg

SEQ ID NO: 4890312 - DNA, 11 bp, Homo sapiens
atgctattttt

SEQ ID NO: 4890313 - DNA, 19 bp, Homo sapiens
atgctccaagattctagat

SEQ ID NO: 4890314 - DNA, 14 bp, Homo sapiens
atgctccctcccct

SEQ ID NO: 4890315 - DNA, 16 bp, Homo sapiens
atgctccctcccctgc

SEQ ID NO: 4890316 - DNA, 23 bp, Homo sapiens
atgctctgagaagaggagccctc

SEQ ID NO: 4890317 - DNA, 17 bp, Homo sapiens
atgctctgcaaaaggag

SEQ ID NO: 4890318 - DNA, 13 bp, Homo sapiens
atgctcttctgtg

SEQ ID NO: 4890319 - DNA, 14 bp, Homo sapiens
atgctcttctgtgg

SEQ ID NO: 4890320 - DNA, 15 bp, Homo sapiens
atgctcttctgtgga

SEQ ID NO: 4890321 - DNA, 19 bp, Homo sapiens
atgctcttttttactcatt

SEQ ID NO: 4890322 - DNA, 22 bp, Homo sapiens
atgctcttttttactcattgaa

SEQ ID NO: 4890323 - DNA, 23 bp, Homo sapiens
atgctcttttttactcattgaaa

SEQ ID NO: 4890324 - DNA, 24 bp, Homo sapiens
atgctcttttttactcattgaaat

SEQ ID NO: 4890325 - DNA, 21 bp, Homo sapiens
atgctgactgtactcctccca

SEQ ID NO: 4890326 - DNA, 14 bp, Homo sapiens
atgctgagattctt

SEQ ID NO: 4890327 - DNA, 13 bp, Homo sapiens
atgctgccagtgt

SEQ ID NO: 4890328 - DNA, 15 bp, Homo sapiens
atgctgcctccagaa

SEQ ID NO: 4890329 - DNA, 14 bp, Homo sapiens
atgctggagaagag

SEQ ID NO: 4890330 - DNA, 19 bp, Homo sapiens
atgctggagaagagaggag

SEQ ID NO: 4890331 - DNA, 22 bp, Homo sapiens
atgctggccagcctggggcctg

SEQ ID NO: 4890332 - DNA, 18 bp, Homo sapiens
atgctggctgttggctgg

SEQ ID NO: 4890333 - DNA, 23 bp, Homo sapiens
atgctgggaagacgcctgagctc

SEQ ID NO: 4890334 - DNA, 20 bp, Homo sapiens
atgctgtaacttaaaatagg

SEQ ID NO: 4890335 - DNA, 16 bp, Homo sapiens
atgctgtacatctatt

SEQ ID NO: 4890336 - DNA, 14 bp, Homo sapiens
atgctgtatatgtt

SEQ ID NO: 4890337 - DNA, 11 bp, Homo sapiens
atgctgtttgt

SEQ ID NO: 4890338 - DNA, 22 bp, Homo sapiens
atgctgtttgtagtgaaataat

SEQ ID NO: 4890339 - DNA, 13 bp, Homo sapiens
atgcttaatttct

SEQ ID NO: 4890340 - DNA, 16 bp, Homo sapiens
atgcttaatttctaaa

SEQ ID NO: 4890341 - DNA, 17 bp, Homo sapiens
atgcttagatgttccag

SEQ ID NO: 4890342 - DNA, 17 bp, Homo sapiens
atgcttcattcaatatt

SEQ ID NO: 4890343 - DNA, 20 bp, Homo sapiens
atgcttctcatcttgtgaaa

SEQ ID NO: 4890344 - DNA, 23 bp, Homo sapiens
atgctttttatttctgcatatgt

SEQ ID NO: 4890345 - DNA, 17 bp, Homo sapiens
atggaaagaatctaata

SEQ ID NO: 4890346 - DNA, 16 bp, Homo sapiens
atggaaagtaactcat

SEQ ID NO: 4890347 - DNA, 19 bp, Homo sapiens
atggaacttctaatatatt

SEQ ID NO: 4890348 - DNA, 19 bp, Homo sapiens
atggaagacaaaatgtttt

SEQ ID NO: 4890349 - DNA, 17 bp, Homo sapiens
atggaagagaaatctca

SEQ ID NO: 4890350 - DNA, 16 bp, Homo sapiens
atggaagggtttgtgg

SEQ ID NO: 4890351 - DNA, 17 bp, Homo sapiens
atggaagtaaagcctca

SEQ ID NO: 4890352 - DNA, 18 bp, Homo sapiens
atggaatggacatcctgt

SEQ ID NO: 4890353 - DNA, 17 bp, Homo sapiens
atggaattgatttgcat

SEQ ID NO: 4890354 - DNA, 19 bp, Homo sapiens
atggacagttcacaccctg

SEQ ID NO: 4890355 - DNA, 23 bp, Homo sapiens
atggacagttcacaccctgcaag

SEQ ID NO: 4890356 - DNA, 13 bp, Homo sapiens
atggacatcctgt

SEQ ID NO: 4890357 - DNA, 22 bp, Homo sapiens
atggacatcctgtataagcact

SEQ ID NO: 4890358 - DNA, 23 bp, Homo sapiens
atggacatcctgtataagcactg

SEQ ID NO: 4890359 - DNA, 16 bp, Homo sapiens
atggaccactgtttct

SEQ ID NO: 4890360 - DNA, 20 bp, Homo sapiens
atggagattcagttttcatt

SEQ ID NO: 4890361 - DNA, 19 bp, Homo sapiens
atggagcagtacatgggaa

SEQ ID NO: 4890362 - DNA, 13 bp, Homo sapiens
atggagcccaggc

SEQ ID NO: 4890363 - DNA, 14 bp, Homo sapiens
atggagcccaggcg

SEQ ID NO: 4890364 - DNA, 23 bp, Homo sapiens
atggagcccaggcgggagcggtg

SEQ ID NO: 4890365 - DNA, 22 bp, Homo sapiens
atggagcctggcacaggactga

SEQ ID NO: 4890366 - DNA, 16 bp, Homo sapiens
atggaggccctcctgt

SEQ ID NO: 4890367 - DNA, 17 bp, Homo sapiens
atggaggggagtgttgg

SEQ ID NO: 4890368 - DNA, 16 bp, Homo sapiens
atggagtttctaaggt

SEQ ID NO: 4890369 - DNA, 20 bp, Homo sapiens
atggataaaataatgctgca

SEQ ID NO: 4890370 - DNA, 13 bp, Homo sapiens
atggatactacat

SEQ ID NO: 4890371 - DNA, 16 bp, Homo sapiens
atggatcctggaggat

SEQ ID NO: 4890372 - DNA, 20 bp, Homo sapiens
atggatgaatctcccactcc

SEQ ID NO: 4890373 - DNA, 20 bp, Homo sapiens
atggattaaatttaattctt

SEQ ID NO: 4890374 - DNA, 16 bp, Homo sapiens
atggattctatttatt

SEQ ID NO: 4890375 - DNA, 20 bp, Homo sapiens
atggatttctgtcttctcta

SEQ ID NO: 4890376 - DNA, 19 bp, Homo sapiens
atggatttgatgctgtttg

SEQ ID NO: 4890377 - DNA, 14 bp, Homo sapiens
atggatttgttaca

SEQ ID NO: 4890378 - DNA, 15 bp, Homo sapiens
atggcaattttgtaa

SEQ ID NO: 4890379 - DNA, 16 bp, Homo sapiens
atggcaattttgtaac

SEQ ID NO: 4890380 - DNA, 21 bp, Homo sapiens
atggcagaagacaccagagca

SEQ ID NO: 4890381 - DNA, 19 bp, Homo sapiens
atggcagagtttgtgtgtt

SEQ ID NO: 4890382 - DNA, 17 bp, Homo sapiens
atggcagcagaaaactt

SEQ ID NO: 4890383 - DNA, 22 bp, Homo sapiens
atggccacagtagtcttgatga

SEQ ID NO: 4890384 - DNA, 16 bp, Homo sapiens
atggccaggtggccac

SEQ ID NO: 4890385 - DNA, 23 bp, Homo sapiens
atggcccctctgacctgcactgg

SEQ ID NO: 4890386 - DNA, 17 bp, Homo sapiens
atggcccggatgctgct

SEQ ID NO: 4890387 - DNA, 18 bp, Homo sapiens
atggcccggatgctgctt

SEQ ID NO: 4890388 - DNA, 19 bp, Homo sapiens
atggcccggatgctgcttc

SEQ ID NO: 4890389 - DNA, 18 bp, Homo sapiens
atggcctatgcacatatg

SEQ ID NO: 4890390 - DNA, 14 bp, Homo sapiens
atggcctcagctgc

SEQ ID NO: 4890391 - DNA, 16 bp, Homo sapiens
atggcctcagctgcct

SEQ ID NO: 4890392 - DNA, 21 bp, Homo sapiens
atggcctcagctgcctcactt

SEQ ID NO: 4890393 - DNA, 14 bp, Homo sapiens
atggctatatggca

SEQ ID NO: 4890394 - DNA, 12 bp, Homo sapiens
atggctcagagg

SEQ ID NO: 4890395 - DNA, 15 bp, Homo sapiens
atggctcagaggggg

SEQ ID NO: 4890396 - DNA, 17 bp, Homo sapiens
atggctctgcacccctc

SEQ ID NO: 4890397 - DNA, 22 bp, Homo sapiens
atggctctggactctaaagacc

SEQ ID NO: 4890398 - DNA, 23 bp, Homo sapiens
atggctttatttgttttttttgt

SEQ ID NO: 4890399 - DNA, 20 bp, Homo sapiens
atgggagcagtccatgcatg

SEQ ID NO: 4890400 - DNA, 14 bp, Homo sapiens
atgggagctcctct

SEQ ID NO: 4890401 - DNA, 22 bp, Homo sapiens
atgggagctggttagaaatgca

SEQ ID NO: 4890402 - DNA, 13 bp, Homo sapiens
atgggaggaaaga

SEQ ID NO: 4890403 - DNA, 21 bp, Homo sapiens
atgggcaacccccagcctgct

SEQ ID NO: 4890404 - DNA, 13 bp, Homo sapiens
atgggcctggcat

SEQ ID NO: 4890405 - DNA, 20 bp, Homo sapiens
atgggcctggccacctctct

SEQ ID NO: 4890406 - DNA, 14 bp, Homo sapiens
atgggctcttcact

SEQ ID NO: 4890407 - DNA, 14 bp, Homo sapiens
atgggctcttccaa

SEQ ID NO: 4890408 - DNA, 20 bp, Homo sapiens
atgggcttcactgtataaat

SEQ ID NO: 4890409 - DNA, 15 bp, Homo sapiens
atgggctttctcttt

SEQ ID NO: 4890410 - DNA, 15 bp, Homo sapiens
atggggaaaaaaatc

SEQ ID NO: 4890411 - DNA, 17 bp, Homo sapiens
atggggaaaaaaatcat

SEQ ID NO: 4890412 - DNA, 20 bp, Homo sapiens
atggggaaaaaaatcatcta

SEQ ID NO: 4890413 - DNA, 21 bp, Homo sapiens
atggggaggcaagtgtggggg

SEQ ID NO: 4890414 - DNA, 17 bp, Homo sapiens
atggggataaaatgact

SEQ ID NO: 4890415 - DNA, 15 bp, Homo sapiens
atgggtgatatcctg

SEQ ID NO: 4890416 - DNA, 14 bp, Homo sapiens
atggtaattgttgc

SEQ ID NO: 4890417 - DNA, 20 bp, Homo sapiens
atggtaccaatcatgaatct

SEQ ID NO: 4890418 - DNA, 15 bp, Homo sapiens
atggtaccagccctg

SEQ ID NO: 4890419 - DNA, 13 bp, Homo sapiens
atggtactattta

SEQ ID NO: 4890420 - DNA, 19 bp, Homo sapiens
atggtaggaagaagctctc

SEQ ID NO: 4890421 - DNA, 16 bp, Homo sapiens
atggtcacacactgat

SEQ ID NO: 4890422 - DNA, 20 bp, Homo sapiens
atggtcctaaaagcaaaata

SEQ ID NO: 4890423 - DNA, 23 bp, Homo sapiens
atggtgacttcctcgcctctccc

SEQ ID NO: 4890424 - DNA, 15 bp, Homo sapiens
atggtgctcaccatg

SEQ ID NO: 4890425 - DNA, 22 bp, Homo sapiens
atggtgctcaccatgcttccag

SEQ ID NO: 4890426 - DNA, 16 bp, Homo sapiens
atggtgcttaagttcc

SEQ ID NO: 4890427 - DNA, 17 bp, Homo sapiens
atggtgcttaagttcca

SEQ ID NO: 4890428 - DNA, 14 bp, Homo sapiens
atggtgtaataaga

SEQ ID NO: 4890429 - DNA, 16 bp, Homo sapiens
atggtgtaataagaca

SEQ ID NO: 4890430 - DNA, 22 bp, Homo sapiens
atggtgtaataagacataacgt

SEQ ID NO: 4890431 - DNA, 14 bp, Homo sapiens
atggttatgaaaga

SEQ ID NO: 4890432 - DNA, 22 bp, Homo sapiens
atggtttattttgtattgtggt

SEQ ID NO: 4890433 - DNA, 15 bp, Homo sapiens
atggtttcttgcaag

SEQ ID NO: 4890434 - DNA, 22 bp, Homo sapiens
atggtttgactcccgaacatca

SEQ ID NO: 4890435 - DNA, 16 bp, Homo sapiens
atgtaaaatgttgaat

SEQ ID NO: 4890436 - DNA, 14 bp, Homo sapiens
atgtaaactgccat

SEQ ID NO: 4890437 - DNA, 12 bp, Homo sapiens
atgtaaatagtg

SEQ ID NO: 4890438 - DNA, 12 bp, Homo sapiens
atgtaaatattc

SEQ ID NO: 4890439 - DNA, 15 bp, Homo sapiens
atgtaagattataga

SEQ ID NO: 4890440 - DNA, 21 bp, Homo sapiens
atgtaagattatagattctaa

SEQ ID NO: 4890441 - DNA, 22 bp, Homo sapiens
atgtaagattatagattctaaa

SEQ ID NO: 4890442 - DNA, 24 bp, Homo sapiens
atgtaagattatagattctaaaga

SEQ ID NO: 4890443 - DNA, 19 bp, Homo sapiens
atgtaatctctctgcagct

SEQ ID NO: 4890444 - DNA, 21 bp, Homo sapiens
atgtaatttagggtactaaat

SEQ ID NO: 4890445 - DNA, 15 bp, Homo sapiens
atgtacatgagaagg

SEQ ID NO: 4890446 - DNA, 19 bp, Homo sapiens
atgtaccatatgatctgtt

SEQ ID NO: 4890447 - DNA, 14 bp, Homo sapiens
atgtacctcccctg

SEQ ID NO: 4890448 - DNA, 16 bp, Homo sapiens
atgtacctcccctgcc

SEQ ID NO: 4890449 - DNA, 22 bp, Homo sapiens
atgtacctcccctgccttgctg

SEQ ID NO: 4890450 - DNA, 14 bp, Homo sapiens
atgtacgtttgtat

SEQ ID NO: 4890451 - DNA, 21 bp, Homo sapiens
atgtactagtactgtgtactg

SEQ ID NO: 4890452 - DNA, 20 bp, Homo sapiens
atgtactagtgttctgtttg

SEQ ID NO: 4890453 - DNA, 17 bp, Homo sapiens
atgtactcctctttaca

SEQ ID NO: 4890454 - DNA, 20 bp, Homo sapiens
atgtactcctctttacactg

SEQ ID NO: 4890455 - DNA, 14 bp, Homo sapiens
atgtactgagattt

SEQ ID NO: 4890456 - DNA, 13 bp, Homo sapiens
atgtactgtacta

SEQ ID NO: 4890457 - DNA, 17 bp, Homo sapiens
atgtactgtactaattc

SEQ ID NO: 4890458 - DNA, 20 bp, Homo sapiens
atgtacttttattttacaca

SEQ ID NO: 4890459 - DNA, 22 bp, Homo sapiens
atgtacttttattttacacaga

SEQ ID NO: 4890460 - DNA, 23 bp, Homo sapiens
atgtagactatatacatgtgtgt

SEQ ID NO: 4890461 - DNA, 13 bp, Homo sapiens
atgtagatatttg

SEQ ID NO: 4890462 - DNA, 21 bp, Homo sapiens
atgtagatatttggcttaaat

SEQ ID NO: 4890463 - DNA, 15 bp, Homo sapiens
atgtagcacataaac

SEQ ID NO: 4890464 - DNA, 13 bp, Homo sapiens
atgtagcgtgttt

SEQ ID NO: 4890465 - DNA, 16 bp, Homo sapiens
atgtagcgtgtttaca

SEQ ID NO: 4890466 - DNA, 21 bp, Homo sapiens
atgtagcgtgtttacatgtgt

SEQ ID NO: 4890467 - DNA, 22 bp, Homo sapiens
atgtagctctgcatctcctgtc

SEQ ID NO: 4890468 - DNA, 13 bp, Homo sapiens
atgtagtaattga

SEQ ID NO: 4890469 - DNA, 16 bp, Homo sapiens
atgtagtataaagaaa

SEQ ID NO: 4890470 - DNA, 15 bp, Homo sapiens
atgtagttgatgtat

SEQ ID NO: 4890471 - DNA, 21 bp, Homo sapiens
atgtataaagcaactgttatg

SEQ ID NO: 4890472 - DNA, 16 bp, Homo sapiens
atgtataaatgtgata

SEQ ID NO: 4890473 - DNA, 16 bp, Homo sapiens
atgtatagttttgaat

SEQ ID NO: 4890474 - DNA, 15 bp, Homo sapiens
atgtatatacacata

SEQ ID NO: 4890475 - DNA, 17 bp, Homo sapiens
atgtatatacacatata

SEQ ID NO: 4890476 - DNA, 12 bp, Homo sapiens
atgtatatattt

SEQ ID NO: 4890477 - DNA, 16 bp, Homo sapiens
atgtatcatagaaatg

SEQ ID NO: 4890478 - DNA, 14 bp, Homo sapiens
atgtatgaaggctt

SEQ ID NO: 4890479 - DNA, 20 bp, Homo sapiens
atgtattgtaaacatgtgtt

SEQ ID NO: 4890480 - DNA, 19 bp, Homo sapiens
atgtatttgttcatgtttg

SEQ ID NO: 4890481 - DNA, 15 bp, Homo sapiens
atgtatttttctaca

SEQ ID NO: 4890482 - DNA, 13 bp, Homo sapiens
atgtcacaggcag

SEQ ID NO: 4890483 - DNA, 16 bp, Homo sapiens
atgtcacaggcaggtc

SEQ ID NO: 4890484 - DNA, 16 bp, Homo sapiens
atgtcacgtactgtct

SEQ ID NO: 4890485 - DNA, 16 bp, Homo sapiens
atgtcactagaatgga

SEQ ID NO: 4890486 - DNA, 15 bp, Homo sapiens
atgtcaggaacagaa

SEQ ID NO: 4890487 - DNA, 17 bp, Homo sapiens
atgtcaggaacagaagg

SEQ ID NO: 4890488 - DNA, 20 bp, Homo sapiens
atgtcaggaacagaaggatg

SEQ ID NO: 4890489 - DNA, 16 bp, Homo sapiens
atgtcaggcctgtgtg

SEQ ID NO: 4890490 - DNA, 21 bp, Homo sapiens
atgtcatcagagctcctctgt

SEQ ID NO: 4890491 - DNA, 16 bp, Homo sapiens
atgtcattaatgtgtt

SEQ ID NO: 4890492 - DNA, 17 bp, Homo sapiens
atgtcattaatgtgttg

SEQ ID NO: 4890493 - DNA, 12 bp, Homo sapiens
atgtccaaagag

SEQ ID NO: 4890494 - DNA, 19 bp, Homo sapiens
atgtccaaagaggctgccc

SEQ ID NO: 4890495 - DNA, 17 bp, Homo sapiens
atgtccactgtgtatag

SEQ ID NO: 4890496 - DNA, 20 bp, Homo sapiens
atgtcccaacttgtaaaaat

SEQ ID NO: 4890497 - DNA, 24 bp, Homo sapiens
atgtccctaccgagtctcttctcc

SEQ ID NO: 4890498 - DNA, 14 bp, Homo sapiens
atgtccctgggcca

SEQ ID NO: 4890499 - DNA, 17 bp, Homo sapiens
atgtccctgggccaggg

SEQ ID NO: 4890500 - DNA, 16 bp, Homo sapiens
atgtcctccagaagcc

SEQ ID NO: 4890501 - DNA, 18 bp, Homo sapiens
atgtcctccagaagcctc

SEQ ID NO: 4890502 - DNA, 19 bp, Homo sapiens
atgtcctccagaagcctct

SEQ ID NO: 4890503 - DNA, 20 bp, Homo sapiens
atgtcctccagaagcctctg

SEQ ID NO: 4890504 - DNA, 13 bp, Homo sapiens
atgtcctgccttt

SEQ ID NO: 4890505 - DNA, 13 bp, Homo sapiens
atgtcgcctctgc

SEQ ID NO: 4890506 - DNA, 13 bp, Homo sapiens
atgtctaaaattg

SEQ ID NO: 4890507 - DNA, 20 bp, Homo sapiens
atgtctatcaactttaatca

SEQ ID NO: 4890508 - DNA, 13 bp, Homo sapiens
atgtctatttaag

SEQ ID NO: 4890509 - DNA, 22 bp, Homo sapiens
atgtctcaggtccctgcagggc

SEQ ID NO: 4890510 - DNA, 13 bp, Homo sapiens
atgtctcctcccc

SEQ ID NO: 4890511 - DNA, 16 bp, Homo sapiens
atgtctcgctagtgat

SEQ ID NO: 4890512 - DNA, 14 bp, Homo sapiens
atgtctctaaagca

SEQ ID NO: 4890513 - DNA, 23 bp, Homo sapiens
atgtctctttaatgtcacaggca

SEQ ID NO: 4890514 - DNA, 17 bp, Homo sapiens
atgtcttcatttcattg

SEQ ID NO: 4890515 - DNA, 19 bp, Homo sapiens
atgtcttcatttcattgta

SEQ ID NO: 4890516 - DNA, 20 bp, Homo sapiens
atgtcttcatttcattgtat

SEQ ID NO: 4890517 - DNA, 14 bp, Homo sapiens
atgtcttgtacatg

SEQ ID NO: 4890518 - DNA, 15 bp, Homo sapiens
atgtcttttcttggc

SEQ ID NO: 4890519 - DNA, 16 bp, Homo sapiens
atgtcttttcttggca

SEQ ID NO: 4890520 - DNA, 15 bp, Homo sapiens
atgtcttttgaatat

SEQ ID NO: 4890521 - DNA, 16 bp, Homo sapiens
atgtcttttgaatatt

SEQ ID NO: 4890522 - DNA, 21 bp, Homo sapiens
atgtgaaaccttttttaagat

SEQ ID NO: 4890523 - DNA, 22 bp, Homo sapiens
atgtgaaaccttttttaagatt

SEQ ID NO: 4890524 - DNA, 12 bp, Homo sapiens
atgtgaaagcac

SEQ ID NO: 4890525 - DNA, 16 bp, Homo sapiens
atgtgaacttgtagct

SEQ ID NO: 4890526 - DNA, 15 bp, Homo sapiens
atgtgacaccaaagc

SEQ ID NO: 4890527 - DNA, 16 bp, Homo sapiens
atgtgacattttacat

SEQ ID NO: 4890528 - DNA, 16 bp, Homo sapiens
atgtgagaggtttgac

SEQ ID NO: 4890529 - DNA, 21 bp, Homo sapiens
atgtgagattttttattgcta

SEQ ID NO: 4890530 - DNA, 21 bp, Homo sapiens
atgtgaggaagaactacagct

SEQ ID NO: 4890531 - DNA, 22 bp, Homo sapiens
atgtgagtttggtctggactga

SEQ ID NO: 4890532 - DNA, 16 bp, Homo sapiens
atgtgatctgtcttgt

SEQ ID NO: 4890533 - DNA, 18 bp, Homo sapiens
atgtgatctgtcttgtaa

SEQ ID NO: 4890534 - DNA, 17 bp, Homo sapiens
atgtgatgatgtaattg

SEQ ID NO: 4890535 - DNA, 15 bp, Homo sapiens
atgtgatgttctaag

SEQ ID NO: 4890536 - DNA, 14 bp, Homo sapiens
atgtgattgtggaa

SEQ ID NO: 4890537 - DNA, 16 bp, Homo sapiens
atgtgcacccatgggc

SEQ ID NO: 4890538 - DNA, 21 bp, Homo sapiens
atgtgccagggcaatgatgaa

SEQ ID NO: 4890539 - DNA, 21 bp, Homo sapiens
atgtgccaggtttttggtctg

SEQ ID NO: 4890540 - DNA, 22 bp, Homo sapiens
atgtgccctcctgagggaggac

SEQ ID NO: 4890541 - DNA, 12 bp, Homo sapiens
atgtgctgatca

SEQ ID NO: 4890542 - DNA, 15 bp, Homo sapiens
atgtggaagaaaatg

SEQ ID NO: 4890543 - DNA, 21 bp, Homo sapiens
atgtggaagaaaatggtttat

SEQ ID NO: 4890544 - DNA, 20 bp, Homo sapiens
atgtggcccctgaacaagaa

SEQ ID NO: 4890545 - DNA, 22 bp, Homo sapiens
atgtggcccctgaacaagaatt

SEQ ID NO: 4890546 - DNA, 17 bp, Homo sapiens
atgtggccgaggacttt

SEQ ID NO: 4890547 - DNA, 18 bp, Homo sapiens
atgtggccgaggactttg

SEQ ID NO: 4890548 - DNA, 22 bp, Homo sapiens
atgtggcttttttaaaaaagca

SEQ ID NO: 4890549 - DNA, 10 bp, Homo sapiens
atgtgggagg

SEQ ID NO: 4890550 - DNA, 11 bp, Homo sapiens
atgtgggaggg

SEQ ID NO: 4890551 - DNA, 15 bp, Homo sapiens
atgtgggtcttccag

SEQ ID NO: 4890552 - DNA, 17 bp, Homo sapiens
atgtgggtcttccaggg

SEQ ID NO: 4890553 - DNA, 13 bp, Homo sapiens
atgtggtttatag

SEQ ID NO: 4890554 - DNA, 21 bp, Homo sapiens
atgtggtttggttcctctctg

SEQ ID NO: 4890555 - DNA, 22 bp, Homo sapiens
atgtggtttggttcctctctgg

SEQ ID NO: 4890556 - DNA, 20 bp, Homo sapiens
atgtgtacaatgtacacact

SEQ ID NO: 4890557 - DNA, 16 bp, Homo sapiens
atgtgtacatggcaga

SEQ ID NO: 4890558 - DNA, 15 bp, Homo sapiens
atgtgtagcctgtgc

SEQ ID NO: 4890559 - DNA, 17 bp, Homo sapiens
atgtgtatatatacata

SEQ ID NO: 4890560 - DNA, 14 bp, Homo sapiens
atgtgtcacttgtg

SEQ ID NO: 4890561 - DNA, 18 bp, Homo sapiens
atgtgtcctatctatctt

SEQ ID NO: 4890562 - DNA, 15 bp, Homo sapiens
atgtgtgaggagctg

SEQ ID NO: 4890563 - DNA, 19 bp, Homo sapiens
atgtgtgaggagctgctgg

SEQ ID NO: 4890564 - DNA, 11 bp, Homo sapiens
atgtgtgccat

SEQ ID NO: 4890565 - DNA, 18 bp, Homo sapiens
atgtgtgccatagagttt

SEQ ID NO: 4890566 - DNA, 19 bp, Homo sapiens
atgtgtgtagacaaatatt

SEQ ID NO: 4890567 - DNA, 20 bp, Homo sapiens
atgtgtgtagacaaatattt

SEQ ID NO: 4890568 - DNA, 13 bp, Homo sapiens
atgtgtgtataag

SEQ ID NO: 4890569 - DNA, 12 bp, Homo sapiens
atgtgtgtatat

SEQ ID NO: 4890570 - DNA, 15 bp, Homo sapiens
atgtgtgtatatatg

SEQ ID NO: 4890571 - DNA, 18 bp, Homo sapiens
atgtgtgtatatatgtgt

SEQ ID NO: 4890572 - DNA, 16 bp, Homo sapiens
atgtgtgtatgtgtat

SEQ ID NO: 4890573 - DNA, 22 bp, Homo sapiens
atgtgttgaaaaccaaaatgac

SEQ ID NO: 4890574 - DNA, 15 bp, Homo sapiens
atgtgttttagatgg

SEQ ID NO: 4890575 - DNA, 17 bp, Homo sapiens
atgttaaatttgtaagt

SEQ ID NO: 4890576 - DNA, 18 bp, Homo sapiens
atgttaaatttgtaagtt

SEQ ID NO: 4890577 - DNA, 22 bp, Homo sapiens
atgttaaatttgtaagtttcag

SEQ ID NO: 4890578 - DNA, 12 bp, Homo sapiens
atgttaagcaga

SEQ ID NO: 4890579 - DNA, 21 bp, Homo sapiens
atgttaccatcttacttgagc

SEQ ID NO: 4890580 - DNA, 23 bp, Homo sapiens
atgttactattttctacaattaa

SEQ ID NO: 4890581 - DNA, 15 bp, Homo sapiens
atgttagtcattgtt

SEQ ID NO: 4890582 - DNA, 16 bp, Homo sapiens
atgttagtcattgtta

SEQ ID NO: 4890583 - DNA, 16 bp, Homo sapiens
atgttatcttctcaag

SEQ ID NO: 4890584 - DNA, 22 bp, Homo sapiens
atgttatcttctcaagttctaa

SEQ ID NO: 4890585 - DNA, 24 bp, Homo sapiens
atgttatgactatgtaaactactt

SEQ ID NO: 4890586 - DNA, 15 bp, Homo sapiens
atgttatttctgcaa

SEQ ID NO: 4890587 - DNA, 18 bp, Homo sapiens
atgttatttctgcaaaca

SEQ ID NO: 4890588 - DNA, 22 bp, Homo sapiens
atgttatttgttattttcagta

SEQ ID NO: 4890589 - DNA, 17 bp, Homo sapiens
atgttcaaagccacatt

SEQ ID NO: 4890590 - DNA, 18 bp, Homo sapiens
atgttcaaagccacatta

SEQ ID NO: 4890591 - DNA, 16 bp, Homo sapiens
atgttcatcaattccc

SEQ ID NO: 4890592 - DNA, 23 bp, Homo sapiens
atgttctaagtttctaagattct

SEQ ID NO: 4890593 - DNA, 20 bp, Homo sapiens
atgttctatggttatgaaag

SEQ ID NO: 4890594 - DNA, 21 bp, Homo sapiens
atgttctatggttatgaaaga

SEQ ID NO: 4890595 - DNA, 12 bp, Homo sapiens
atgttctgcccc

SEQ ID NO: 4890596 - DNA, 18 bp, Homo sapiens
atgttctgcccccagccc

SEQ ID NO: 4890597 - DNA, 20 bp, Homo sapiens
atgttctgcccccagcccaa

SEQ ID NO: 4890598 - DNA, 13 bp, Homo sapiens
atgttctgggaca

SEQ ID NO: 4890599 - DNA, 19 bp, Homo sapiens
atgttgaatactttttaca

SEQ ID NO: 4890600 - DNA, 22 bp, Homo sapiens
atgttgagaatcccaaatttga

SEQ ID NO: 4890601 - DNA, 21 bp, Homo sapiens
atgttgatttttactgtgttt

SEQ ID NO: 4890602 - DNA, 16 bp, Homo sapiens
atgttgccatgtgttt

SEQ ID NO: 4890603 - DNA, 16 bp, Homo sapiens
atgttgcccaggcagg

SEQ ID NO: 4890604 - DNA, 20 bp, Homo sapiens
atgttgcccaggcaggtctt

SEQ ID NO: 4890605 - DNA, 17 bp, Homo sapiens
atgttggaagagaaagc

SEQ ID NO: 4890606 - DNA, 17 bp, Homo sapiens
atgttggacacctttag

SEQ ID NO: 4890607 - DNA, 22 bp, Homo sapiens
atgttggacacctttaggttct

SEQ ID NO: 4890608 - DNA, 17 bp, Homo sapiens
atgttggccaggctggt

SEQ ID NO: 4890609 - DNA, 19 bp, Homo sapiens
atgttggccaggctggtct

SEQ ID NO: 4890610 - DNA, 19 bp, Homo sapiens
atgttggtttactttcaaa

SEQ ID NO: 4890611 - DNA, 14 bp, Homo sapiens
atgttgtaatgctg

SEQ ID NO: 4890612 - DNA, 15 bp, Homo sapiens
atgttgtaatgctgc

SEQ ID NO: 4890613 - DNA, 22 bp, Homo sapiens
atgttgtccaattgttgacagt

SEQ ID NO: 4890614 - DNA, 17 bp, Homo sapiens
atgttgttaaaattatg

SEQ ID NO: 4890615 - DNA, 14 bp, Homo sapiens
atgtttaatctgtt

SEQ ID NO: 4890616 - DNA, 15 bp, Homo sapiens
atgtttatgaaaata

SEQ ID NO: 4890617 - DNA, 22 bp, Homo sapiens
atgtttatgcaaggaaggaaag

SEQ ID NO: 4890618 - DNA, 18 bp, Homo sapiens
atgtttattcttctagag

SEQ ID NO: 4890619 - DNA, 22 bp, Homo sapiens
atgtttcatgttttgtgactat

SEQ ID NO: 4890620 - DNA, 13 bp, Homo sapiens
atgtttccaacct

SEQ ID NO: 4890621 - DNA, 11 bp, Homo sapiens
atgtttgaata

SEQ ID NO: 4890622 - DNA, 13 bp, Homo sapiens
atgtttgaatatg

SEQ ID NO: 4890623 - DNA, 21 bp, Homo sapiens
atgtttgaatatggacaagag

SEQ ID NO: 4890624 - DNA, 16 bp, Homo sapiens
atgtttgcacttgtga

SEQ ID NO: 4890625 - DNA, 20 bp, Homo sapiens
atgtttgcttcataaatgaa

SEQ ID NO: 4890626 - DNA, 20 bp, Homo sapiens
atgttttattatttctatta

SEQ ID NO: 4890627 - DNA, 22 bp, Homo sapiens
atgttttggtagattaaatata

SEQ ID NO: 4890628 - DNA, 14 bp, Homo sapiens
atgttttgtataca

SEQ ID NO: 4890629 - DNA, 22 bp, Homo sapiens
atgttttgtatacaaatatatt

SEQ ID NO: 4890630 - DNA, 15 bp, Homo sapiens
atgttttgtgcattt

SEQ ID NO: 4890631 - DNA, 16 bp, Homo sapiens
atgttttgtgcatttg

SEQ ID NO: 4890632 - DNA, 23 bp, Homo sapiens
atgttttgtgcatttgtaaatgc

SEQ ID NO: 4890633 - DNA, 21 bp, Homo sapiens
atgtttttataaaaataaata

SEQ ID NO: 4890634 - DNA, 16 bp, Homo sapiens
atgtttttatgatatc

SEQ ID NO: 4890635 - DNA, 22 bp, Homo sapiens
atgttttttaaaatatttatct

SEQ ID NO: 4890636 - DNA, 22 bp, Homo sapiens
attaaaaagattctttttctga

SEQ ID NO: 4890637 - DNA, 15 bp, Homo sapiens
attaaaaagttaatc

SEQ ID NO: 4890638 - DNA, 14 bp, Homo sapiens
attaaaacttctta

SEQ ID NO: 4890639 - DNA, 20 bp, Homo sapiens
attaaaacttcttaaatatc

SEQ ID NO: 4890640 - DNA, 16 bp, Homo sapiens
attaaaaggatagtat

SEQ ID NO: 4890641 - DNA, 19 bp, Homo sapiens
attaaaatgattgtaaaat

SEQ ID NO: 4890642 - DNA, 20 bp, Homo sapiens
attaaacctgtctccactgt

SEQ ID NO: 4890643 - DNA, 14 bp, Homo sapiens
attaaagtctgaat

SEQ ID NO: 4890644 - DNA, 13 bp, Homo sapiens
attaaataaaatc

SEQ ID NO: 4890645 - DNA, 14 bp, Homo sapiens
attaaataaaatca

SEQ ID NO: 4890646 - DNA, 19 bp, Homo sapiens
attaaataagattctaacg

SEQ ID NO: 4890647 - DNA, 16 bp, Homo sapiens
attaaattcacaaact

SEQ ID NO: 4890648 - DNA, 18 bp, Homo sapiens
attaaattcacaaacttt

SEQ ID NO: 4890649 - DNA, 13 bp, Homo sapiens
attaaatttaatt

SEQ ID NO: 4890650 - DNA, 21 bp, Homo sapiens
attaaatttgttgacaaaatt

SEQ ID NO: 4890651 - DNA, 17 bp, Homo sapiens
attaaattttttttaca

SEQ ID NO: 4890652 - DNA, 20 bp, Homo sapiens
attaaattttttttacattt

SEQ ID NO: 4890653 - DNA, 12 bp, Homo sapiens
attaacaaaagt

SEQ ID NO: 4890654 - DNA, 12 bp, Homo sapiens
attaacaaatat

SEQ ID NO: 4890655 - DNA, 20 bp, Homo sapiens
attaacaaatatgctaattt

SEQ ID NO: 4890656 - DNA, 21 bp, Homo sapiens
attaacaaatatgctaatttg

SEQ ID NO: 4890657 - DNA, 21 bp, Homo sapiens
attaacatgcttatgacaatg

SEQ ID NO: 4890658 - DNA, 17 bp, Homo sapiens
attaacttatttagaga

SEQ ID NO: 4890659 - DNA, 18 bp, Homo sapiens
attaacttatttagagat

SEQ ID NO: 4890660 - DNA, 20 bp, Homo sapiens
attaagaatatgtttccttg

SEQ ID NO: 4890661 - DNA, 13 bp, Homo sapiens
attaagaatgttg

SEQ ID NO: 4890662 - DNA, 23 bp, Homo sapiens
attaagaatgttggtttactttc

SEQ ID NO: 4890663 - DNA, 14 bp, Homo sapiens
attaagatacaaat

SEQ ID NO: 4890664 - DNA, 15 bp, Homo sapiens
attaagatacaaatt

SEQ ID NO: 4890665 - DNA, 15 bp, Homo sapiens
attaagattttacaa

SEQ ID NO: 4890666 - DNA, 15 bp, Homo sapiens
attaaggtgatgtga

SEQ ID NO: 4890667 - DNA, 13 bp, Homo sapiens
attaagttatctt

SEQ ID NO: 4890668 - DNA, 19 bp, Homo sapiens
attaagttctcaatgtgaa

SEQ ID NO: 4890669 - DNA, 22 bp, Homo sapiens
attaataaaaaatggaaagaat

SEQ ID NO: 4890670 - DNA, 13 bp, Homo sapiens
attaatactaaaa

SEQ ID NO: 4890671 - DNA, 20 bp, Homo sapiens
attaatatatgtattattta

SEQ ID NO: 4890672 - DNA, 22 bp, Homo sapiens
attaatatatgtattatttata

SEQ ID NO: 4890673 - DNA, 23 bp, Homo sapiens
attaatcaatcatctgtgtgaaa

SEQ ID NO: 4890674 - DNA, 19 bp, Homo sapiens
attaatcatctataaagaa

SEQ ID NO: 4890675 - DNA, 15 bp, Homo sapiens
attaatggtctaaaa

SEQ ID NO: 4890676 - DNA, 17 bp, Homo sapiens
attaatggtctaaaaat

SEQ ID NO: 4890677 - DNA, 12 bp, Homo sapiens
attaatgtttct

SEQ ID NO: 4890678 - DNA, 14 bp, Homo sapiens
attaattctataag

SEQ ID NO: 4890679 - DNA, 18 bp, Homo sapiens
attaattgttttgcactt

SEQ ID NO: 4890680 - DNA, 21 bp, Homo sapiens
attaatttgcatctgaaatag

SEQ ID NO: 4890681 - DNA, 22 bp, Homo sapiens
attacaagcgtgagccactgca

SEQ ID NO: 4890682 - DNA, 17 bp, Homo sapiens
attacaatggaaacaat

SEQ ID NO: 4890683 - DNA, 18 bp, Homo sapiens
attacacatttgtacaga

SEQ ID NO: 4890684 - DNA, 21 bp, Homo sapiens
attaccagtggcgttgttgca

SEQ ID NO: 4890685 - DNA, 20 bp, Homo sapiens
attaccccctccttcagaca

SEQ ID NO: 4890686 - DNA, 21 bp, Homo sapiens
attaccccctccttcagacac

SEQ ID NO: 4890687 - DNA, 13 bp, Homo sapiens
attaccttactgt

SEQ ID NO: 4890688 - DNA, 15 bp, Homo sapiens
attactaattttaca

SEQ ID NO: 4890689 - DNA, 20 bp, Homo sapiens
attactcctatttttgtaaa

SEQ ID NO: 4890690 - DNA, 15 bp, Homo sapiens
attactcttaaggaa

SEQ ID NO: 4890691 - DNA, 14 bp, Homo sapiens
attactgggcctta

SEQ ID NO: 4890692 - DNA, 16 bp, Homo sapiens
attactgtttatttct

SEQ ID NO: 4890693 - DNA, 17 bp, Homo sapiens
attactgtttatttctg

SEQ ID NO: 4890694 - DNA, 12 bp, Homo sapiens
attacttaaaaa

SEQ ID NO: 4890695 - DNA, 16 bp, Homo sapiens
attacttatttttgac

SEQ ID NO: 4890696 - DNA, 18 bp, Homo sapiens
attacttatttttgacag

SEQ ID NO: 4890697 - DNA, 13 bp, Homo sapiens
attacttctgcta

SEQ ID NO: 4890698 - DNA, 14 bp, Homo sapiens
attactttatcact

SEQ ID NO: 4890699 - DNA, 17 bp, Homo sapiens
attagaaaaattcctaa

SEQ ID NO: 4890700 - DNA, 15 bp, Homo sapiens
attagaaattagaaa

SEQ ID NO: 4890701 - DNA, 21 bp, Homo sapiens
attagcaaggtcatttcttca

SEQ ID NO: 4890702 - DNA, 22 bp, Homo sapiens
attagcaattgactgtcactgt

SEQ ID NO: 4890703 - DNA, 14 bp, Homo sapiens
attagcacagattt

SEQ ID NO: 4890704 - DNA, 18 bp, Homo sapiens
attagcacagattttaat

SEQ ID NO: 4890705 - DNA, 17 bp, Homo sapiens
attagcagtttgctttg

SEQ ID NO: 4890706 - DNA, 14 bp, Homo sapiens
attagccaggatca

SEQ ID NO: 4890707 - DNA, 15 bp, Homo sapiens
attagctgtgatttt

SEQ ID NO: 4890708 - DNA, 12 bp, Homo sapiens
attagctttgtg

SEQ ID NO: 4890709 - DNA, 17 bp, Homo sapiens
attaggaggctcaacaa

SEQ ID NO: 4890710 - DNA, 14 bp, Homo sapiens
attaggattttgat

SEQ ID NO: 4890711 - DNA, 20 bp, Homo sapiens
attaggcaaggctatgtgat

SEQ ID NO: 4890712 - DNA, 21 bp, Homo sapiens
attaggcaaggctatgtgatt

SEQ ID NO: 4890713 - DNA, 18 bp, Homo sapiens
attaggttaacattgttg

SEQ ID NO: 4890714 - DNA, 13 bp, Homo sapiens
attagtaaatgtc

SEQ ID NO: 4890715 - DNA, 14 bp, Homo sapiens
attagtaaatgtct

SEQ ID NO: 4890716 - DNA, 23 bp, Homo sapiens
attagtaaatgtctttgtaagtc

SEQ ID NO: 4890717 - DNA, 19 bp, Homo sapiens
attagtactgctcttgttt

SEQ ID NO: 4890718 - DNA, 18 bp, Homo sapiens
attagtgccagaatttta

SEQ ID NO: 4890719 - DNA, 21 bp, Homo sapiens
attagtgccagaattttagga

SEQ ID NO: 4890720 - DNA, 14 bp, Homo sapiens
attagttaatatat

SEQ ID NO: 4890721 - DNA, 21 bp, Homo sapiens
attagttccctgtctcttgaa

SEQ ID NO: 4890722 - DNA, 18 bp, Homo sapiens
attataaaattaatcaca

SEQ ID NO: 4890723 - DNA, 13 bp, Homo sapiens
attataaacgctt

SEQ ID NO: 4890724 - DNA, 17 bp, Homo sapiens
attataaatatatataa

SEQ ID NO: 4890725 - DNA, 17 bp, Homo sapiens
attataacaagtgtgtc

SEQ ID NO: 4890726 - DNA, 12 bp, Homo sapiens
attataagcatt

SEQ ID NO: 4890727 - DNA, 15 bp, Homo sapiens
attataagtcacaaa

SEQ ID NO: 4890728 - DNA, 15 bp, Homo sapiens
attatagattctaaa

SEQ ID NO: 4890729 - DNA, 16 bp, Homo sapiens
attatagattctaaag

SEQ ID NO: 4890730 - DNA, 19 bp, Homo sapiens
attataggagccttaattt

SEQ ID NO: 4890731 - DNA, 20 bp, Homo sapiens
attatataggttgtgcaaat

SEQ ID NO: 4890732 - DNA, 17 bp, Homo sapiens
attatatatataatata

SEQ ID NO: 4890733 - DNA, 16 bp, Homo sapiens
attatatctaattatt

SEQ ID NO: 4890734 - DNA, 18 bp, Homo sapiens
attatatctgtggtcttc

SEQ ID NO: 4890735 - DNA, 23 bp, Homo sapiens
attatatggagacgctaagaaat

SEQ ID NO: 4890736 - DNA, 13 bp, Homo sapiens
attatattggtgg

SEQ ID NO: 4890737 - DNA, 20 bp, Homo sapiens
attatattggtggttctcag

SEQ ID NO: 4890738 - DNA, 17 bp, Homo sapiens
attatcaatatctaata

SEQ ID NO: 4890739 - DNA, 12 bp, Homo sapiens
attatccctgaa

SEQ ID NO: 4890740 - DNA, 19 bp, Homo sapiens
attatctatagctaagtac

SEQ ID NO: 4890741 - DNA, 16 bp, Homo sapiens
attatgagtttgctta

SEQ ID NO: 4890742 - DNA, 21 bp, Homo sapiens
attatgatttgggttggggaa

SEQ ID NO: 4890743 - DNA, 13 bp, Homo sapiens
attatgtgacatt

SEQ ID NO: 4890744 - DNA, 19 bp, Homo sapiens
attatgtgacattttacat

SEQ ID NO: 4890745 - DNA, 20 bp, Homo sapiens
attatgtgacattttacatt

SEQ ID NO: 4890746 - DNA, 14 bp, Homo sapiens
attatgtggtttta

SEQ ID NO: 4890747 - DNA, 14 bp, Homo sapiens
attattaactacat

SEQ ID NO: 4890748 - DNA, 15 bp, Homo sapiens
attattaactacatt

SEQ ID NO: 4890749 - DNA, 21 bp, Homo sapiens
attattacttatttttgacag

SEQ ID NO: 4890750 - DNA, 15 bp, Homo sapiens
attattataggtaat

SEQ ID NO: 4890751 - DNA, 13 bp, Homo sapiens
attattcatttag

SEQ ID NO: 4890752 - DNA, 18 bp, Homo sapiens
attattctcttttatctg

SEQ ID NO: 4890753 - DNA, 17 bp, Homo sapiens
attattgatagtactct

SEQ ID NO: 4890754 - DNA, 15 bp, Homo sapiens
attattgatatatat

SEQ ID NO: 4890755 - DNA, 11 bp, Homo sapiens
attattgctta

SEQ ID NO: 4890756 - DNA, 19 bp, Homo sapiens
attattgcttattgcttag

SEQ ID NO: 4890757 - DNA, 18 bp, Homo sapiens
attattgtggtaggcctt

SEQ ID NO: 4890758 - DNA, 13 bp, Homo sapiens
attatttaataaa

SEQ ID NO: 4890759 - DNA, 21 bp, Homo sapiens
attatttaataacattacctt

SEQ ID NO: 4890760 - DNA, 22 bp, Homo sapiens
attatttaataacattacctta

SEQ ID NO: 4890761 - DNA, 13 bp, Homo sapiens
attatttatatgg

SEQ ID NO: 4890762 - DNA, 23 bp, Homo sapiens
attatttggcagtttggtatttg

SEQ ID NO: 4890763 - DNA, 12 bp, Homo sapiens
attatttgtgtt

SEQ ID NO: 4890764 - DNA, 15 bp, Homo sapiens
attattttaaacaaa

SEQ ID NO: 4890765 - DNA, 14 bp, Homo sapiens
attattttcattac

SEQ ID NO: 4890766 - DNA, 19 bp, Homo sapiens
attattttcattacaatgg

SEQ ID NO: 4890767 - DNA, 16 bp, Homo sapiens
attattttctgtcaga

SEQ ID NO: 4890768 - DNA, 21 bp, Homo sapiens
attattttcttcatccaactt

SEQ ID NO: 4890769 - DNA, 19 bp, Homo sapiens
attattttggggtctcttt

SEQ ID NO: 4890770 - DNA, 21 bp, Homo sapiens
attattttttttttttgaaaa

SEQ ID NO: 4890771 - DNA, 14 bp, Homo sapiens
attcaaaaagtgtt

SEQ ID NO: 4890772 - DNA, 16 bp, Homo sapiens
attcaaaaattatcta

SEQ ID NO: 4890773 - DNA, 23 bp, Homo sapiens
attcaaaaattatctatagctaa

SEQ ID NO: 4890774 - DNA, 13 bp, Homo sapiens
attcaaaagttcc

SEQ ID NO: 4890775 - DNA, 14 bp, Homo sapiens
attcaaaagttcca

SEQ ID NO: 4890776 - DNA, 17 bp, Homo sapiens
attcaaactggggcctc

SEQ ID NO: 4890777 - DNA, 14 bp, Homo sapiens
attcaaaggttcta

SEQ ID NO: 4890778 - DNA, 21 bp, Homo sapiens
attcaaatcgtttatttcaca

SEQ ID NO: 4890779 - DNA, 18 bp, Homo sapiens
attcaaccatggacttta

SEQ ID NO: 4890780 - DNA, 20 bp, Homo sapiens
attcaaccatggactttata

SEQ ID NO: 4890781 - DNA, 22 bp, Homo sapiens
attcaagaaaacaacttcaata

SEQ ID NO: 4890782 - DNA, 15 bp, Homo sapiens
attcaaggtggccaa

SEQ ID NO: 4890783 - DNA, 15 bp, Homo sapiens
attcaatattgacat

SEQ ID NO: 4890784 - DNA, 22 bp, Homo sapiens
attcaatgtttatgcaaggaag

SEQ ID NO: 4890785 - DNA, 22 bp, Homo sapiens
attcacaaacttttatactctt

SEQ ID NO: 4890786 - DNA, 22 bp, Homo sapiens
attcaccccctttcctggacac

SEQ ID NO: 4890787 - DNA, 16 bp, Homo sapiens
attcactcaagcactg

SEQ ID NO: 4890788 - DNA, 17 bp, Homo sapiens
attcactcaagcactga

SEQ ID NO: 4890789 - DNA, 18 bp, Homo sapiens
attcactcaagcactgat

SEQ ID NO: 4890790 - DNA, 20 bp, Homo sapiens
attcactgaagttctcctga

SEQ ID NO: 4890791 - DNA, 23 bp, Homo sapiens
attcagatcactgaatttataaa

SEQ ID NO: 4890792 - DNA, 15 bp, Homo sapiens
attcagcaaaccatt

SEQ ID NO: 4890793 - DNA, 14 bp, Homo sapiens
attcagcctgtttg

SEQ ID NO: 4890794 - DNA, 12 bp, Homo sapiens
attcagcttcat

SEQ ID NO: 4890795 - DNA, 21 bp, Homo sapiens
attcaggaatgtgtggcctgc

SEQ ID NO: 4890796 - DNA, 22 bp, Homo sapiens
attcaggagagtagaacagata

SEQ ID NO: 4890797 - DNA, 16 bp, Homo sapiens
attcaggctgcttggg

SEQ ID NO: 4890798 - DNA, 17 bp, Homo sapiens
attcaggtatgttgcct

SEQ ID NO: 4890799 - DNA, 23 bp, Homo sapiens
attcaggtatgttgcctttatgg

SEQ ID NO: 4890800 - DNA, 15 bp, Homo sapiens
attcagttttcattt

SEQ ID NO: 4890801 - DNA, 16 bp, Homo sapiens
attcataaaaactgct

SEQ ID NO: 4890802 - DNA, 19 bp, Homo sapiens
attcatattctgttggaag

SEQ ID NO: 4890803 - DNA, 20 bp, Homo sapiens
attcatattggaaaaatcac

SEQ ID NO: 4890804 - DNA, 22 bp, Homo sapiens
attcatgttatatttaatgcat

SEQ ID NO: 4890805 - DNA, 16 bp, Homo sapiens
attcattaaatgtttg

SEQ ID NO: 4890806 - DNA, 20 bp, Homo sapiens
attcattctcataattccta

SEQ ID NO: 4890807 - DNA, 18 bp, Homo sapiens
attcattctgcattgcta

SEQ ID NO: 4890808 - DNA, 18 bp, Homo sapiens
attcattctgtgatcatt

SEQ ID NO: 4890809 - DNA, 12 bp, Homo sapiens
attcatttcaca

SEQ ID NO: 4890810 - DNA, 13 bp, Homo sapiens
attcatttcacat

SEQ ID NO: 4890811 - DNA, 23 bp, Homo sapiens
attccaaagctttattaccagtg

SEQ ID NO: 4890812 - DNA, 16 bp, Homo sapiens
attccaaagtctctaa

SEQ ID NO: 4890813 - DNA, 16 bp, Homo sapiens
attccaagactctaga

SEQ ID NO: 4890814 - DNA, 21 bp, Homo sapiens
attccagaagaagagaagctg

SEQ ID NO: 4890815 - DNA, 14 bp, Homo sapiens
attccagaatgctg

SEQ ID NO: 4890816 - DNA, 23 bp, Homo sapiens
attccagactgcttccaattttc

SEQ ID NO: 4890817 - DNA, 18 bp, Homo sapiens
attccagagacatcagca

SEQ ID NO: 4890818 - DNA, 21 bp, Homo sapiens
attccagagagtggctcctcc

SEQ ID NO: 4890819 - DNA, 21 bp, Homo sapiens
attccatatcttgcgaatcca

SEQ ID NO: 4890820 - DNA, 13 bp, Homo sapiens
attccatatttat

SEQ ID NO: 4890821 - DNA, 22 bp, Homo sapiens
attccatgctaagcaagctaac

SEQ ID NO: 4890822 - DNA, 20 bp, Homo sapiens
attccattgcctagctcttt

SEQ ID NO: 4890823 - DNA, 15 bp, Homo sapiens
attcccaagaaatgc

SEQ ID NO: 4890824 - DNA, 15 bp, Homo sapiens
attcccatctttact

SEQ ID NO: 4890825 - DNA, 20 bp, Homo sapiens
attccccagattgcaacagg

SEQ ID NO: 4890826 - DNA, 15 bp, Homo sapiens
attcccctctgctgc

SEQ ID NO: 4890827 - DNA, 15 bp, Homo sapiens
attcctacagcacta

SEQ ID NO: 4890828 - DNA, 17 bp, Homo sapiens
attcctacagcactact

SEQ ID NO: 4890829 - DNA, 13 bp, Homo sapiens
attcctctgtatt

SEQ ID NO: 4890830 - DNA, 13 bp, Homo sapiens
attcctgtatgtt

SEQ ID NO: 4890831 - DNA, 18 bp, Homo sapiens
attcctgtatgttgtcca

SEQ ID NO: 4890832 - DNA, 15 bp, Homo sapiens
attccttctctgaac

SEQ ID NO: 4890833 - DNA, 16 bp, Homo sapiens
attccttctggccttt

SEQ ID NO: 4890834 - DNA, 22 bp, Homo sapiens
attccttctggcctttcctctc

SEQ ID NO: 4890835 - DNA, 16 bp, Homo sapiens
attccttctttgataa

SEQ ID NO: 4890836 - DNA, 22 bp, Homo sapiens
attccttctttgataatgttaa

SEQ ID NO: 4890837 - DNA, 23 bp, Homo sapiens
attcctttgtcttcaaactgtga

SEQ ID NO: 4890838 - DNA, 18 bp, Homo sapiens
attcctttgtgtttctat

SEQ ID NO: 4890839 - DNA, 19 bp, Homo sapiens
attcgcccgagctgtttat

SEQ ID NO: 4890840 - DNA, 21 bp, Homo sapiens
attcgtgattttcaagcagca

SEQ ID NO: 4890841 - DNA, 23 bp, Homo sapiens
attctaaagagcacttactgtaa

SEQ ID NO: 4890842 - DNA, 14 bp, Homo sapiens
attctaaagattct

SEQ ID NO: 4890843 - DNA, 17 bp, Homo sapiens
attctaaagattctata

SEQ ID NO: 4890844 - DNA, 22 bp, Homo sapiens
attctaagacttactctaagat

SEQ ID NO: 4890845 - DNA, 14 bp, Homo sapiens
attctaatgtcttc

SEQ ID NO: 4890846 - DNA, 18 bp, Homo sapiens
attctagctaatgtaata

SEQ ID NO: 4890847 - DNA, 15 bp, Homo sapiens
attctatagttctag

SEQ ID NO: 4890848 - DNA, 17 bp, Homo sapiens
attctatagttctagac

SEQ ID NO: 4890849 - DNA, 23 bp, Homo sapiens
attctatatgaatttaaatataa

SEQ ID NO: 4890850 - DNA, 19 bp, Homo sapiens
attctattgccttctttga

SEQ ID NO: 4890851 - DNA, 21 bp, Homo sapiens
attctattgccttctttgaag

SEQ ID NO: 4890852 - DNA, 22 bp, Homo sapiens
attctattgccttctttgaaga

SEQ ID NO: 4890853 - DNA, 18 bp, Homo sapiens
attctattttagaataaa

SEQ ID NO: 4890854 - DNA, 16 bp, Homo sapiens
attctcataattccta

SEQ ID NO: 4890855 - DNA, 16 bp, Homo sapiens
attctcattgcagaat

SEQ ID NO: 4890856 - DNA, 13 bp, Homo sapiens
attctcctgcctc

SEQ ID NO: 4890857 - DNA, 19 bp, Homo sapiens
attctccttttatgtgtag

SEQ ID NO: 4890858 - DNA, 17 bp, Homo sapiens
attctctggctgtaagg

SEQ ID NO: 4890859 - DNA, 21 bp, Homo sapiens
attctctggctgtaaggctct

SEQ ID NO: 4890860 - DNA, 21 bp, Homo sapiens
attctctgtgtctaagattct

SEQ ID NO: 4890861 - DNA, 23 bp, Homo sapiens
attctctgtgtctaagattctag

SEQ ID NO: 4890862 - DNA, 14 bp, Homo sapiens
attctctttcaaag

SEQ ID NO: 4890863 - DNA, 16 bp, Homo sapiens
attctcttttatctgt

SEQ ID NO: 4890864 - DNA, 15 bp, Homo sapiens
attctgagaaaacaa

SEQ ID NO: 4890865 - DNA, 17 bp, Homo sapiens
attctgaggccctgccc

SEQ ID NO: 4890866 - DNA, 19 bp, Homo sapiens
attctgcaagcacatctgc

SEQ ID NO: 4890867 - DNA, 22 bp, Homo sapiens
attctgcaagcacatctgcatt

SEQ ID NO: 4890868 - DNA, 17 bp, Homo sapiens
attctgcagtaaatctt

SEQ ID NO: 4890869 - DNA, 15 bp, Homo sapiens
attctgcctctctag

SEQ ID NO: 4890870 - DNA, 11 bp, Homo sapiens
attctgcctgc

SEQ ID NO: 4890871 - DNA, 14 bp, Homo sapiens
attctgcctgccca

SEQ ID NO: 4890872 - DNA, 19 bp, Homo sapiens
attctgcctgcccaggccc

SEQ ID NO: 4890873 - DNA, 19 bp, Homo sapiens
attctgctcacatatctgt

SEQ ID NO: 4890874 - DNA, 22 bp, Homo sapiens
attctgctcacatatctgtcat

SEQ ID NO: 4890875 - DNA, 15 bp, Homo sapiens
attctgtagattctg

SEQ ID NO: 4890876 - DNA, 17 bp, Homo sapiens
attctgtagattctgtg

SEQ ID NO: 4890877 - DNA, 20 bp, Homo sapiens
attctgtatctttcatcctt

SEQ ID NO: 4890878 - DNA, 20 bp, Homo sapiens
attctgtgatcttttaaagt

SEQ ID NO: 4890879 - DNA, 14 bp, Homo sapiens
attctgtgttgcat

SEQ ID NO: 4890880 - DNA, 15 bp, Homo sapiens
attctgttaaaatct

SEQ ID NO: 4890881 - DNA, 16 bp, Homo sapiens
attctgttaaaatcta

SEQ ID NO: 4890882 - DNA, 22 bp, Homo sapiens
attctgttaaaatctattctgt

SEQ ID NO: 4890883 - DNA, 13 bp, Homo sapiens
attctgttggaag

SEQ ID NO: 4890884 - DNA, 15 bp, Homo sapiens
attcttaaccatgga

SEQ ID NO: 4890885 - DNA, 15 bp, Homo sapiens
attcttacactgcct

SEQ ID NO: 4890886 - DNA, 23 bp, Homo sapiens
attcttaccctgtacatatgtaa

SEQ ID NO: 4890887 - DNA, 15 bp, Homo sapiens
attcttatacacatt

SEQ ID NO: 4890888 - DNA, 16 bp, Homo sapiens
attcttatttttccta

SEQ ID NO: 4890889 - DNA, 21 bp, Homo sapiens
attcttccaagctgagagtct

SEQ ID NO: 4890890 - DNA, 22 bp, Homo sapiens
attcttccaagctgagagtcta

SEQ ID NO: 4890891 - DNA, 14 bp, Homo sapiens
attcttctagagtt

SEQ ID NO: 4890892 - DNA, 19 bp, Homo sapiens
attcttctgtgtttataaa

SEQ ID NO: 4890893 - DNA, 13 bp, Homo sapiens
attcttgtacagt

SEQ ID NO: 4890894 - DNA, 18 bp, Homo sapiens
attcttgtgcttttcctg

SEQ ID NO: 4890895 - DNA, 22 bp, Homo sapiens
attctttggagttgtcacatca

SEQ ID NO: 4890896 - DNA, 15 bp, Homo sapiens
attctttttctgatt

SEQ ID NO: 4890897 - DNA, 19 bp, Homo sapiens
attgaaattatagtttcaa

SEQ ID NO: 4890898 - DNA, 17 bp, Homo sapiens
attgaaattgtacatat

SEQ ID NO: 4890899 - DNA, 14 bp, Homo sapiens
attgaacacaaact

SEQ ID NO: 4890900 - DNA, 15 bp, Homo sapiens
attgaacacaaactg

SEQ ID NO: 4890901 - DNA, 18 bp, Homo sapiens
attgaacacaaactgtaa

SEQ ID NO: 4890902 - DNA, 20 bp, Homo sapiens
attgaacacaaactgtaaat

SEQ ID NO: 4890903 - DNA, 14 bp, Homo sapiens
attgaagaaacaga

SEQ ID NO: 4890904 - DNA, 13 bp, Homo sapiens
attgaagaagaat

SEQ ID NO: 4890905 - DNA, 22 bp, Homo sapiens
attgaagacaatttgatacata

SEQ ID NO: 4890906 - DNA, 21 bp, Homo sapiens
attgaagagagatatatctga

SEQ ID NO: 4890907 - DNA, 19 bp, Homo sapiens
attgaaggaagccaaattt

SEQ ID NO: 4890908 - DNA, 20 bp, Homo sapiens
attgaaggaagccaaattta

SEQ ID NO: 4890909 - DNA, 15 bp, Homo sapiens
attgacaaatctgtg

SEQ ID NO: 4890910 - DNA, 20 bp, Homo sapiens
attgacaaatctgtgtatat

SEQ ID NO: 4890911 - DNA, 22 bp, Homo sapiens
attgacaaatctgtgtatatta

SEQ ID NO: 4890912 - DNA, 12 bp, Homo sapiens
attgacacagaa

SEQ ID NO: 4890913 - DNA, 23 bp, Homo sapiens
attgaccgcgactaatttcaaaa

SEQ ID NO: 4890914 - DNA, 17 bp, Homo sapiens
attgacctgctccgctg

SEQ ID NO: 4890915 - DNA, 21 bp, Homo sapiens
attgacctgctccgctgctcc

SEQ ID NO: 4890916 - DNA, 16 bp, Homo sapiens
attgacgattccttct

SEQ ID NO: 4890917 - DNA, 21 bp, Homo sapiens
attgacggttttttattattg

SEQ ID NO: 4890918 - DNA, 22 bp, Homo sapiens
attgactcaaatctccagtatt

SEQ ID NO: 4890919 - DNA, 21 bp, Homo sapiens
attgactggtttacaggccct

SEQ ID NO: 4890920 - DNA, 15 bp, Homo sapiens
attgagaaggagaga

SEQ ID NO: 4890921 - DNA, 20 bp, Homo sapiens
attgagagttttgtcttgaa

SEQ ID NO: 4890922 - DNA, 22 bp, Homo sapiens
attgagatactttttcttttgt

SEQ ID NO: 4890923 - DNA, 19 bp, Homo sapiens
attgagattatgatgaaaa

SEQ ID NO: 4890924 - DNA, 20 bp, Homo sapiens
attgagctgatataaattct

SEQ ID NO: 4890925 - DNA, 22 bp, Homo sapiens
attgaggctttgtgttgtaatt

SEQ ID NO: 4890926 - DNA, 14 bp, Homo sapiens
attgagtttgtagg

SEQ ID NO: 4890927 - DNA, 16 bp, Homo sapiens
attgagtttgtaggta

SEQ ID NO: 4890928 - DNA, 18 bp, Homo sapiens
attgataatgctttcaca

SEQ ID NO: 4890929 - DNA, 15 bp, Homo sapiens
attgatactctttct

SEQ ID NO: 4890930 - DNA, 18 bp, Homo sapiens
attgatcattttcccccc

SEQ ID NO: 4890931 - DNA, 20 bp, Homo sapiens
attgatcattttccccccac

SEQ ID NO: 4890932 - DNA, 21 bp, Homo sapiens
attgatcattttccccccact

SEQ ID NO: 4890933 - DNA, 22 bp, Homo sapiens
attgatgaaaagatttaagcac

SEQ ID NO: 4890934 - DNA, 14 bp, Homo sapiens
attgatttgaagaa

SEQ ID NO: 4890935 - DNA, 12 bp, Homo sapiens
attgatttgcat

SEQ ID NO: 4890936 - DNA, 16 bp, Homo sapiens
attgcaaatcttgaaa

SEQ ID NO: 4890937 - DNA, 19 bp, Homo sapiens
attgcaaatcttgaaatta

SEQ ID NO: 4890938 - DNA, 15 bp, Homo sapiens
attgcaacaggctgg

SEQ ID NO: 4890939 - DNA, 19 bp, Homo sapiens
attgcaacaggctgggctt

SEQ ID NO: 4890940 - DNA, 14 bp, Homo sapiens
attgcaatatctga

SEQ ID NO: 4890941 - DNA, 16 bp, Homo sapiens
attgcagctttatgtt

SEQ ID NO: 4890942 - DNA, 17 bp, Homo sapiens
attgcagctttatgttc

SEQ ID NO: 4890943 - DNA, 16 bp, Homo sapiens
attgcattctattgcc

SEQ ID NO: 4890944 - DNA, 17 bp, Homo sapiens
attgcattctattgcct

SEQ ID NO: 4890945 - DNA, 17 bp, Homo sapiens
attgcatttcctgacag

SEQ ID NO: 4890946 - DNA, 17 bp, Homo sapiens
attgcccacgctggagt

SEQ ID NO: 4890947 - DNA, 15 bp, Homo sapiens
attgccttctttgaa

SEQ ID NO: 4890948 - DNA, 19 bp, Homo sapiens
attgccttctttgaagaag

SEQ ID NO: 4890949 - DNA, 18 bp, Homo sapiens
attgctagtatttgaatt

SEQ ID NO: 4890950 - DNA, 20 bp, Homo sapiens
attgctagtatttgaattaa

SEQ ID NO: 4890951 - DNA, 20 bp, Homo sapiens
attgctatgttactattttc

SEQ ID NO: 4890952 - DNA, 16 bp, Homo sapiens
attgctgagcctctgc

SEQ ID NO: 4890953 - DNA, 22 bp, Homo sapiens
attgctgagcctctgctcccca

SEQ ID NO: 4890954 - DNA, 13 bp, Homo sapiens
attgctgatttta

SEQ ID NO: 4890955 - DNA, 20 bp, Homo sapiens
attgctgttatgtctgttta

SEQ ID NO: 4890956 - DNA, 23 bp, Homo sapiens
attgctgttatgtctgtttaaga

SEQ ID NO: 4890957 - DNA, 12 bp, Homo sapiens
attgctgttgct

SEQ ID NO: 4890958 - DNA, 17 bp, Homo sapiens
attgctgttgcttgaat

SEQ ID NO: 4890959 - DNA, 22 bp, Homo sapiens
attgcttagtaaaatttatttc

SEQ ID NO: 4890960 - DNA, 23 bp, Homo sapiens
attgcttagtaaaatttatttca

SEQ ID NO: 4890961 - DNA, 18 bp, Homo sapiens
attgctttggtcatatga

SEQ ID NO: 4890962 - DNA, 16 bp, Homo sapiens
attgcttttattttga

SEQ ID NO: 4890963 - DNA, 18 bp, Homo sapiens
attgcttttttgtattgg

SEQ ID NO: 4890964 - DNA, 12 bp, Homo sapiens
attggaaatgga

SEQ ID NO: 4890965 - DNA, 16 bp, Homo sapiens
attggaacagaatgtt

SEQ ID NO: 4890966 - DNA, 23 bp, Homo sapiens
attggaggaaagcaaccggtgga

SEQ ID NO: 4890967 - DNA, 16 bp, Homo sapiens
attggattatttaata

SEQ ID NO: 4890968 - DNA, 17 bp, Homo sapiens
attggattatttaataa

SEQ ID NO: 4890969 - DNA, 20 bp, Homo sapiens
attggattatttaataacat

SEQ ID NO: 4890970 - DNA, 22 bp, Homo sapiens
attggattatttaataacatta

SEQ ID NO: 4890971 - DNA, 21 bp, Homo sapiens
attggcatggatttctgtctt

SEQ ID NO: 4890972 - DNA, 16 bp, Homo sapiens
attggcttgtagaatt

SEQ ID NO: 4890973 - DNA, 22 bp, Homo sapiens
attggcttgtagaattgttata

SEQ ID NO: 4890974 - DNA, 18 bp, Homo sapiens
attgggttcatgatgcag

SEQ ID NO: 4890975 - DNA, 18 bp, Homo sapiens
attggtctaatttattca

SEQ ID NO: 4890976 - DNA, 17 bp, Homo sapiens
attggtggttctcagca

SEQ ID NO: 4890977 - DNA, 17 bp, Homo sapiens
attgtaaaaaaaaatgc

SEQ ID NO: 4890978 - DNA, 21 bp, Homo sapiens
attgtaaaaaaaaatgccttt

SEQ ID NO: 4890979 - DNA, 21 bp, Homo sapiens
attgtaaaacctgtcaatgat

SEQ ID NO: 4890980 - DNA, 15 bp, Homo sapiens
attgtaaaatagctt

SEQ ID NO: 4890981 - DNA, 22 bp, Homo sapiens
attgtaaaatagcttgtatagt

SEQ ID NO: 4890982 - DNA, 17 bp, Homo sapiens
attgtaaacaaactctt

SEQ ID NO: 4890983 - DNA, 14 bp, Homo sapiens
attgtaaatagtat

SEQ ID NO: 4890984 - DNA, 16 bp, Homo sapiens
attgtacagctgttta

SEQ ID NO: 4890985 - DNA, 17 bp, Homo sapiens
attgtacagctgtttaa

SEQ ID NO: 4890986 - DNA, 15 bp, Homo sapiens
attgtaggtgcaaga

SEQ ID NO: 4890987 - DNA, 17 bp, Homo sapiens
attgtataaactatcag

SEQ ID NO: 4890988 - DNA, 17 bp, Homo sapiens
attgtatattgtgtttg

SEQ ID NO: 4890989 - DNA, 12 bp, Homo sapiens
attgtatgatgt

SEQ ID NO: 4890990 - DNA, 21 bp, Homo sapiens
attgtatgatgtgttgtgata

SEQ ID NO: 4890991 - DNA, 12 bp, Homo sapiens
attgtctattta

SEQ ID NO: 4890992 - DNA, 16 bp, Homo sapiens
attgtgccaatatgta

SEQ ID NO: 4890993 - DNA, 13 bp, Homo sapiens
attgtgctgccat

SEQ ID NO: 4890994 - DNA, 15 bp, Homo sapiens
attgtgctgccattt

SEQ ID NO: 4890995 - DNA, 18 bp, Homo sapiens
attgtggtaggcctttta

SEQ ID NO: 4890996 - DNA, 14 bp, Homo sapiens
attgtgttcctttt

SEQ ID NO: 4890997 - DNA, 13 bp, Homo sapiens
attgtgttgacat

SEQ ID NO: 4890998 - DNA, 17 bp, Homo sapiens
attgttaatctctgtta

SEQ ID NO: 4890999 - DNA, 14 bp, Homo sapiens
attgttaatttcag

SEQ ID NO: 4891000 - DNA, 15 bp, Homo sapiens
attgttaatttcagt

SEQ ID NO: 4891001 - DNA, 16 bp, Homo sapiens
attgttaatttcagtc

SEQ ID NO: 4891002 - DNA, 16 bp, Homo sapiens
attgttgaaattttgc

SEQ ID NO: 4891003 - DNA, 19 bp, Homo sapiens
attgttgacaactgtgact

SEQ ID NO: 4891004 - DNA, 20 bp, Homo sapiens
attgttgacaactgtgactg

SEQ ID NO: 4891005 - DNA, 22 bp, Homo sapiens
attgttgacagttctgaagaat

SEQ ID NO: 4891006 - DNA, 19 bp, Homo sapiens
attgttgagctattgctgt

SEQ ID NO: 4891007 - DNA, 21 bp, Homo sapiens
attgttgatgggcacttgaga

SEQ ID NO: 4891008 - DNA, 14 bp, Homo sapiens
attgttgtataatt

SEQ ID NO: 4891009 - DNA, 19 bp, Homo sapiens
attgttgtttctttctagt

SEQ ID NO: 4891010 - DNA, 19 bp, Homo sapiens
attgttgtttgccatactt

SEQ ID NO: 4891011 - DNA, 22 bp, Homo sapiens
attgttgtttgccatactttgt

SEQ ID NO: 4891012 - DNA, 22 bp, Homo sapiens
attgttttgaatattactccta

SEQ ID NO: 4891013 - DNA, 16 bp, Homo sapiens
atttaaaaaaatcaca

SEQ ID NO: 4891014 - DNA, 19 bp, Homo sapiens
atttaaacaataaatgtgc

SEQ ID NO: 4891015 - DNA, 16 bp, Homo sapiens
atttaaacagcagtgt

SEQ ID NO: 4891016 - DNA, 17 bp, Homo sapiens
atttaaacattaaaaat

SEQ ID NO: 4891017 - DNA, 17 bp, Homo sapiens
atttaaactatcttgtg

SEQ ID NO: 4891018 - DNA, 18 bp, Homo sapiens
atttaaagcattgctgtt

SEQ ID NO: 4891019 - DNA, 21 bp, Homo sapiens
atttaaagcattgctgttatg

SEQ ID NO: 4891020 - DNA, 19 bp, Homo sapiens
atttaaatataattctgta

SEQ ID NO: 4891021 - DNA, 23 bp, Homo sapiens
atttaaatataattctgtaaatg

SEQ ID NO: 4891022 - DNA, 15 bp, Homo sapiens
atttaacattattta

SEQ ID NO: 4891023 - DNA, 17 bp, Homo sapiens
atttaacattatttata

SEQ ID NO: 4891024 - DNA, 18 bp, Homo sapiens
atttaactacccttaatt

SEQ ID NO: 4891025 - DNA, 17 bp, Homo sapiens
atttaagcaaatactta

SEQ ID NO: 4891026 - DNA, 19 bp, Homo sapiens
atttaagcctcatatttaa

SEQ ID NO: 4891027 - DNA, 21 bp, Homo sapiens
atttaagcctcatatttaaag

SEQ ID NO: 4891028 - DNA, 16 bp, Homo sapiens
atttaataaaaaaaca

SEQ ID NO: 4891029 - DNA, 19 bp, Homo sapiens
atttaataaaataattcta

SEQ ID NO: 4891030 - DNA, 21 bp, Homo sapiens
atttaataaaataattctaaa

SEQ ID NO: 4891031 - DNA, 16 bp, Homo sapiens
atttaataacaattgt

SEQ ID NO: 4891032 - DNA, 12 bp, Homo sapiens
atttaataacat

SEQ ID NO: 4891033 - DNA, 17 bp, Homo sapiens
atttaatgcattaaacc

SEQ ID NO: 4891034 - DNA, 13 bp, Homo sapiens
atttaatgctgcc

SEQ ID NO: 4891035 - DNA, 15 bp, Homo sapiens
atttaattattaact

SEQ ID NO: 4891036 - DNA, 19 bp, Homo sapiens
atttacagatgaatgtatt

SEQ ID NO: 4891037 - DNA, 18 bp, Homo sapiens
atttaccagggatgtaga

SEQ ID NO: 4891038 - DNA, 19 bp, Homo sapiens
atttacgctttgattcata

SEQ ID NO: 4891039 - DNA, 13 bp, Homo sapiens
atttactaaacat

SEQ ID NO: 4891040 - DNA, 19 bp, Homo sapiens
atttactaaacatatgatt

SEQ ID NO: 4891041 - DNA, 22 bp, Homo sapiens
atttactaaacatatgatttca

SEQ ID NO: 4891042 - DNA, 23 bp, Homo sapiens
atttactaagccacaagaaattt

SEQ ID NO: 4891043 - DNA, 18 bp, Homo sapiens
atttagaaaaaagtttac

SEQ ID NO: 4891044 - DNA, 14 bp, Homo sapiens
atttagaactgtat

SEQ ID NO: 4891045 - DNA, 23 bp, Homo sapiens
atttaggaagttgacttatagta

SEQ ID NO: 4891046 - DNA, 15 bp, Homo sapiens
atttagtgaactacg

SEQ ID NO: 4891047 - DNA, 13 bp, Homo sapiens
atttagttatagt

SEQ ID NO: 4891048 - DNA, 14 bp, Homo sapiens
atttagttatagtt

SEQ ID NO: 4891049 - DNA, 11 bp, Homo sapiens
atttataattg

SEQ ID NO: 4891050 - DNA, 17 bp, Homo sapiens
atttataattgcatcta

SEQ ID NO: 4891051 - DNA, 13 bp, Homo sapiens
atttatacaagat

SEQ ID NO: 4891052 - DNA, 13 bp, Homo sapiens
atttatacctcaa

SEQ ID NO: 4891053 - DNA, 22 bp, Homo sapiens
atttatacctcaaactatctgg

SEQ ID NO: 4891054 - DNA, 14 bp, Homo sapiens
atttatagtttgta

SEQ ID NO: 4891055 - DNA, 16 bp, Homo sapiens
atttatagtttgtaca

SEQ ID NO: 4891056 - DNA, 13 bp, Homo sapiens
atttatatatgaa

SEQ ID NO: 4891057 - DNA, 14 bp, Homo sapiens
atttatatatgaaa

SEQ ID NO: 4891058 - DNA, 16 bp, Homo sapiens
atttatatatgaaaac

SEQ ID NO: 4891059 - DNA, 19 bp, Homo sapiens
atttatatatgaaaactat

SEQ ID NO: 4891060 - DNA, 15 bp, Homo sapiens
atttatatgtacatg

SEQ ID NO: 4891061 - DNA, 16 bp, Homo sapiens
atttatatgtacatga

SEQ ID NO: 4891062 - DNA, 17 bp, Homo sapiens
atttatatgtacatgag

SEQ ID NO: 4891063 - DNA, 13 bp, Homo sapiens
atttatatgtact

SEQ ID NO: 4891064 - DNA, 14 bp, Homo sapiens
atttatcaaagcat

SEQ ID NO: 4891065 - DNA, 18 bp, Homo sapiens
atttatcctgaaatttca

SEQ ID NO: 4891066 - DNA, 15 bp, Homo sapiens
atttatctaaattaa

SEQ ID NO: 4891067 - DNA, 22 bp, Homo sapiens
atttatctttacttttaaacag

SEQ ID NO: 4891068 - DNA, 22 bp, Homo sapiens
atttatgaagtttaaaacagta

SEQ ID NO: 4891069 - DNA, 16 bp, Homo sapiens
atttatgatttaataa

SEQ ID NO: 4891070 - DNA, 19 bp, Homo sapiens
atttatgatttaataaaat

SEQ ID NO: 4891071 - DNA, 13 bp, Homo sapiens
atttatgcacatt

SEQ ID NO: 4891072 - DNA, 19 bp, Homo sapiens
atttatgcatggaaacctg

SEQ ID NO: 4891073 - DNA, 21 bp, Homo sapiens
atttatgtaatgaagtaaagc

SEQ ID NO: 4891074 - DNA, 22 bp, Homo sapiens
atttatgtctatttaagcctca

SEQ ID NO: 4891075 - DNA, 14 bp, Homo sapiens
atttatgttaaaag

SEQ ID NO: 4891076 - DNA, 17 bp, Homo sapiens
atttattaaataaaatc

SEQ ID NO: 4891077 - DNA, 16 bp, Homo sapiens
atttattattgaaatt

SEQ ID NO: 4891078 - DNA, 13 bp, Homo sapiens
atttattatttat

SEQ ID NO: 4891079 - DNA, 13 bp, Homo sapiens
atttattctgctc

SEQ ID NO: 4891080 - DNA, 14 bp, Homo sapiens
atttattctgctca

SEQ ID NO: 4891081 - DNA, 18 bp, Homo sapiens
atttattgaagaaacaga

SEQ ID NO: 4891082 - DNA, 20 bp, Homo sapiens
atttatttaaagcattgctt

SEQ ID NO: 4891083 - DNA, 12 bp, Homo sapiens
atttatttaata

SEQ ID NO: 4891084 - DNA, 21 bp, Homo sapiens
atttatttaatgtgagtttgg

SEQ ID NO: 4891085 - DNA, 18 bp, Homo sapiens
atttatttatgtactttt

SEQ ID NO: 4891086 - DNA, 17 bp, Homo sapiens
atttattttcctaaaga

SEQ ID NO: 4891087 - DNA, 19 bp, Homo sapiens
atttattttcctaaagaga

SEQ ID NO: 4891088 - DNA, 16 bp, Homo sapiens
atttattttcttttga

SEQ ID NO: 4891089 - DNA, 15 bp, Homo sapiens
atttattttgtaatt

SEQ ID NO: 4891090 - DNA, 20 bp, Homo sapiens
atttatttttcagttccaag

SEQ ID NO: 4891091 - DNA, 16 bp, Homo sapiens
atttcaaaagacatgt

SEQ ID NO: 4891092 - DNA, 13 bp, Homo sapiens
atttcaaaatgct

SEQ ID NO: 4891093 - DNA, 15 bp, Homo sapiens
atttcaaaatgcttt

SEQ ID NO: 4891094 - DNA, 16 bp, Homo sapiens
atttcaaaatgctttt

SEQ ID NO: 4891095 - DNA, 21 bp, Homo sapiens
atttcaagaaaaaataaatgg

SEQ ID NO: 4891096 - DNA, 22 bp, Homo sapiens
atttcaagaaaaaataaatgga

SEQ ID NO: 4891097 - DNA, 17 bp, Homo sapiens
atttcaaggttctaacc

SEQ ID NO: 4891098 - DNA, 14 bp, Homo sapiens
atttcaattctcaa

SEQ ID NO: 4891099 - DNA, 19 bp, Homo sapiens
atttcacacgctgttctaa

SEQ ID NO: 4891100 - DNA, 16 bp, Homo sapiens
atttcacattaatggt

SEQ ID NO: 4891101 - DNA, 22 bp, Homo sapiens
atttcacattaatggtctaaaa

SEQ ID NO: 4891102 - DNA, 17 bp, Homo sapiens
atttcagtcctgtagtt

SEQ ID NO: 4891103 - DNA, 21 bp, Homo sapiens
atttcagtgtagttaatttat

SEQ ID NO: 4891104 - DNA, 21 bp, Homo sapiens
atttcatacctcagaatgtaa

SEQ ID NO: 4891105 - DNA, 17 bp, Homo sapiens
atttcattccattgcct

SEQ ID NO: 4891106 - DNA, 14 bp, Homo sapiens
atttcattgtatga

SEQ ID NO: 4891107 - DNA, 20 bp, Homo sapiens
atttcattgtatgatgtgtt

SEQ ID NO: 4891108 - DNA, 16 bp, Homo sapiens
atttcattttttgcat

SEQ ID NO: 4891109 - DNA, 22 bp, Homo sapiens
atttcattttttgcatcagtat

SEQ ID NO: 4891110 - DNA, 20 bp, Homo sapiens
atttccaacaccacagacac

SEQ ID NO: 4891111 - DNA, 23 bp, Homo sapiens
atttccaacaccacagacacaca

SEQ ID NO: 4891112 - DNA, 19 bp, Homo sapiens
atttccaagtaatataatg

SEQ ID NO: 4891113 - DNA, 21 bp, Homo sapiens
atttccagctttctccccgct

SEQ ID NO: 4891114 - DNA, 21 bp, Homo sapiens
atttccagtgttctatgaaca

SEQ ID NO: 4891115 - DNA, 18 bp, Homo sapiens
atttccctaaaatacatt

SEQ ID NO: 4891116 - DNA, 20 bp, Homo sapiens
atttccctaaaatacattta

SEQ ID NO: 4891117 - DNA, 23 bp, Homo sapiens
atttcccttgaaattttaaacta

SEQ ID NO: 4891118 - DNA, 22 bp, Homo sapiens
atttccgcacttcagaattcca

SEQ ID NO: 4891119 - DNA, 14 bp, Homo sapiens
atttcctgtgtctt

SEQ ID NO: 4891120 - DNA, 19 bp, Homo sapiens
atttccttttttgttatta

SEQ ID NO: 4891121 - DNA, 14 bp, Homo sapiens
atttctaaaaagat

SEQ ID NO: 4891122 - DNA, 19 bp, Homo sapiens
atttctacacagtgggaac

SEQ ID NO: 4891123 - DNA, 20 bp, Homo sapiens
atttctagtccaaaattaca

SEQ ID NO: 4891124 - DNA, 21 bp, Homo sapiens
atttctagtccaaaattacaa

SEQ ID NO: 4891125 - DNA, 19 bp, Homo sapiens
atttctcaacaaagcacag

SEQ ID NO: 4891126 - DNA, 13 bp, Homo sapiens
atttctgcaaaca

SEQ ID NO: 4891127 - DNA, 17 bp, Homo sapiens
atttctgctttctttga

SEQ ID NO: 4891128 - DNA, 16 bp, Homo sapiens
atttctgggtcttttg

SEQ ID NO: 4891129 - DNA, 17 bp, Homo sapiens
atttctgtaaataccat

SEQ ID NO: 4891130 - DNA, 15 bp, Homo sapiens
atttctgtttctcat

SEQ ID NO: 4891131 - DNA, 23 bp, Homo sapiens
atttcttaaataatgcttcagat

SEQ ID NO: 4891132 - DNA, 15 bp, Homo sapiens
atttcttcaaaatgt

SEQ ID NO: 4891133 - DNA, 17 bp, Homo sapiens
atttcttcaaaatgtat

SEQ ID NO: 4891134 - DNA, 20 bp, Homo sapiens
atttcttcaaaatgtatata

SEQ ID NO: 4891135 - DNA, 21 bp, Homo sapiens
atttcttcaaatccttccaaa

SEQ ID NO: 4891136 - DNA, 20 bp, Homo sapiens
atttcttcagtcagaaaact

SEQ ID NO: 4891137 - DNA, 14 bp, Homo sapiens
atttcttgcgagcc

SEQ ID NO: 4891138 - DNA, 20 bp, Homo sapiens
atttcttggtaagaagccgg

SEQ ID NO: 4891139 - DNA, 21 bp, Homo sapiens
atttctttatatttatccact

SEQ ID NO: 4891140 - DNA, 22 bp, Homo sapiens
atttctttgttatcaaacttca

SEQ ID NO: 4891141 - DNA, 22 bp, Homo sapiens
atttgaaaacataatctgcaaa

SEQ ID NO: 4891142 - DNA, 22 bp, Homo sapiens
atttgaacactggctaaagata

SEQ ID NO: 4891143 - DNA, 17 bp, Homo sapiens
atttgaattaaaacttc

SEQ ID NO: 4891144 - DNA, 19 bp, Homo sapiens
atttgaattaaaacttctt

SEQ ID NO: 4891145 - DNA, 18 bp, Homo sapiens
atttgaattttaaatcta

SEQ ID NO: 4891146 - DNA, 14 bp, Homo sapiens
atttgactgaagat

SEQ ID NO: 4891147 - DNA, 21 bp, Homo sapiens
atttgacttgcatgaagagaa

SEQ ID NO: 4891148 - DNA, 15 bp, Homo sapiens
atttgacttgtggtt

SEQ ID NO: 4891149 - DNA, 15 bp, Homo sapiens
atttgagcagggctc

SEQ ID NO: 4891150 - DNA, 17 bp, Homo sapiens
atttgaggggaaaacac

SEQ ID NO: 4891151 - DNA, 22 bp, Homo sapiens
atttgaggggaaaacaccataa

SEQ ID NO: 4891152 - DNA, 19 bp, Homo sapiens
atttgataatgataaaaca

SEQ ID NO: 4891153 - DNA, 12 bp, Homo sapiens
atttgatactta

SEQ ID NO: 4891154 - DNA, 23 bp, Homo sapiens
atttgatgctgtttgacaaagtt

SEQ ID NO: 4891155 - DNA, 14 bp, Homo sapiens
atttgattaacaaa

SEQ ID NO: 4891156 - DNA, 13 bp, Homo sapiens
atttgattgattt

SEQ ID NO: 4891157 - DNA, 17 bp, Homo sapiens
atttgatttctattcaa

SEQ ID NO: 4891158 - DNA, 22 bp, Homo sapiens
atttgatttttctaaccttgaa

SEQ ID NO: 4891159 - DNA, 12 bp, Homo sapiens
atttgcaacatt

SEQ ID NO: 4891160 - DNA, 21 bp, Homo sapiens
atttgcatctgaaataggaaa

SEQ ID NO: 4891161 - DNA, 22 bp, Homo sapiens
atttgcatggctccagaaatgt

SEQ ID NO: 4891162 - DNA, 23 bp, Homo sapiens
atttgcattaaattcacaaactt

SEQ ID NO: 4891163 - DNA, 22 bp, Homo sapiens
atttgcattgaacacaaactgt

SEQ ID NO: 4891164 - DNA, 24 bp, Homo sapiens
atttgccatgggcttcactgtata

SEQ ID NO: 4891165 - DNA, 21 bp, Homo sapiens
atttgccttgcagaactgcca

SEQ ID NO: 4891166 - DNA, 23 bp, Homo sapiens
atttgccttgcagaactgccatt

SEQ ID NO: 4891167 - DNA, 14 bp, Homo sapiens
atttgcctttaaaa

SEQ ID NO: 4891168 - DNA, 23 bp, Homo sapiens
atttgctaatcaaagccagggtc

SEQ ID NO: 4891169 - DNA, 16 bp, Homo sapiens
atttgctactgtacat

SEQ ID NO: 4891170 - DNA, 13 bp, Homo sapiens
atttgctggggaa

SEQ ID NO: 4891171 - DNA, 18 bp, Homo sapiens
atttgcttatttaataaa

SEQ ID NO: 4891172 - DNA, 12 bp, Homo sapiens
atttgcttcatt

SEQ ID NO: 4891173 - DNA, 14 bp, Homo sapiens
atttgcttcattgt

SEQ ID NO: 4891174 - DNA, 12 bp, Homo sapiens
atttggaaatcc

SEQ ID NO: 4891175 - DNA, 11 bp, Homo sapiens
atttggaatag

SEQ ID NO: 4891176 - DNA, 20 bp, Homo sapiens
atttggagacacaactattt

SEQ ID NO: 4891177 - DNA, 21 bp, Homo sapiens
atttggagacacaactatttt

SEQ ID NO: 4891178 - DNA, 16 bp, Homo sapiens
atttggcagtttggta

SEQ ID NO: 4891179 - DNA, 16 bp, Homo sapiens
atttggcctgcactaa

SEQ ID NO: 4891180 - DNA, 19 bp, Homo sapiens
atttggcctgcactaattt

SEQ ID NO: 4891181 - DNA, 14 bp, Homo sapiens
atttgggaagtgaa

SEQ ID NO: 4891182 - DNA, 19 bp, Homo sapiens
atttggggacagattcagt

SEQ ID NO: 4891183 - DNA, 22 bp, Homo sapiens
atttggggacagattcagtctt

SEQ ID NO: 4891184 - DNA, 21 bp, Homo sapiens
atttggttcattaattctata

SEQ ID NO: 4891185 - DNA, 14 bp, Homo sapiens
atttgtaagtttca

SEQ ID NO: 4891186 - DNA, 15 bp, Homo sapiens
atttgtaagtttcag

SEQ ID NO: 4891187 - DNA, 17 bp, Homo sapiens
atttgtaagtttcaggt

SEQ ID NO: 4891188 - DNA, 18 bp, Homo sapiens
atttgtaagtttcaggtg

SEQ ID NO: 4891189 - DNA, 22 bp, Homo sapiens
atttgtaggaaggtctcattct

SEQ ID NO: 4891190 - DNA, 22 bp, Homo sapiens
atttgtagtggaaacatttata

SEQ ID NO: 4891191 - DNA, 16 bp, Homo sapiens
atttgtattttgtgtg

SEQ ID NO: 4891192 - DNA, 18 bp, Homo sapiens
atttgtattttgtgtgac

SEQ ID NO: 4891193 - DNA, 12 bp, Homo sapiens
atttgtggaata

SEQ ID NO: 4891194 - DNA, 13 bp, Homo sapiens
atttgtgtaatag

SEQ ID NO: 4891195 - DNA, 17 bp, Homo sapiens
atttgtgtcacaaagaa

SEQ ID NO: 4891196 - DNA, 21 bp, Homo sapiens
atttgttagttcctgtatgaa

SEQ ID NO: 4891197 - DNA, 16 bp, Homo sapiens
atttgttcatgtttgg

SEQ ID NO: 4891198 - DNA, 16 bp, Homo sapiens
atttgttcttcaagaa

SEQ ID NO: 4891199 - DNA, 14 bp, Homo sapiens
atttgttggaatga

SEQ ID NO: 4891200 - DNA, 22 bp, Homo sapiens
atttgtttgtttgttttattca

SEQ ID NO: 4891201 - DNA, 15 bp, Homo sapiens
atttgttttcatggt

SEQ ID NO: 4891202 - DNA, 16 bp, Homo sapiens
atttgtttttcattca

SEQ ID NO: 4891203 - DNA, 15 bp, Homo sapiens
atttgtttttctcac

SEQ ID NO: 4891204 - DNA, 23 bp, Homo sapiens
attttaaaaaatgaaaataagtg

SEQ ID NO: 4891205 - DNA, 22 bp, Homo sapiens
attttaaaaatacatatcgctg

SEQ ID NO: 4891206 - DNA, 13 bp, Homo sapiens
attttaaacaaag

SEQ ID NO: 4891207 - DNA, 13 bp, Homo sapiens
attttaatgtgat

SEQ ID NO: 4891208 - DNA, 18 bp, Homo sapiens
attttaatgtgatgatgt

SEQ ID NO: 4891209 - DNA, 22 bp, Homo sapiens
attttacacagaaacactgcct

SEQ ID NO: 4891210 - DNA, 12 bp, Homo sapiens
attttacattaa

SEQ ID NO: 4891211 - DNA, 15 bp, Homo sapiens
attttacattaaatt

SEQ ID NO: 4891212 - DNA, 15 bp, Homo sapiens
attttacctcttatt

SEQ ID NO: 4891213 - DNA, 18 bp, Homo sapiens
attttacctcttattgca

SEQ ID NO: 4891214 - DNA, 15 bp, Homo sapiens
attttaggaacttca

SEQ ID NO: 4891215 - DNA, 17 bp, Homo sapiens
attttaggaacttcaga

SEQ ID NO: 4891216 - DNA, 18 bp, Homo sapiens
attttaggagctaaggct

SEQ ID NO: 4891217 - DNA, 22 bp, Homo sapiens
attttaggagctaaggctctat

SEQ ID NO: 4891218 - DNA, 22 bp, Homo sapiens
attttaggcactcttaaatgat

SEQ ID NO: 4891219 - DNA, 14 bp, Homo sapiens
attttagtattcat

SEQ ID NO: 4891220 - DNA, 14 bp, Homo sapiens
attttagtccaaat

SEQ ID NO: 4891221 - DNA, 21 bp, Homo sapiens
attttatgaaaggtttacatt

SEQ ID NO: 4891222 - DNA, 16 bp, Homo sapiens
attttatttccatcat

SEQ ID NO: 4891223 - DNA, 14 bp, Homo sapiens
attttcaagaaact

SEQ ID NO: 4891224 - DNA, 16 bp, Homo sapiens
attttcaagaaactga

SEQ ID NO: 4891225 - DNA, 15 bp, Homo sapiens
attttcacaatgtca

SEQ ID NO: 4891226 - DNA, 15 bp, Homo sapiens
attttcataacttat

SEQ ID NO: 4891227 - DNA, 11 bp, Homo sapiens
attttcatgtt

SEQ ID NO: 4891228 - DNA, 15 bp, Homo sapiens
attttcattacaatg

SEQ ID NO: 4891229 - DNA, 17 bp, Homo sapiens
attttccagggcaatca

SEQ ID NO: 4891230 - DNA, 22 bp, Homo sapiens
attttccagggcaatcaatgtt

SEQ ID NO: 4891231 - DNA, 14 bp, Homo sapiens
attttccccccact

SEQ ID NO: 4891232 - DNA, 17 bp, Homo sapiens
attttcccctatcattt

SEQ ID NO: 4891233 - DNA, 18 bp, Homo sapiens
attttcgtatgaaaatga

SEQ ID NO: 4891234 - DNA, 16 bp, Homo sapiens
attttcgttcattact

SEQ ID NO: 4891235 - DNA, 16 bp, Homo sapiens
attttctagactttct

SEQ ID NO: 4891236 - DNA, 19 bp, Homo sapiens
attttctagactttctgtt

SEQ ID NO: 4891237 - DNA, 19 bp, Homo sapiens
attttctatgtactagtac

SEQ ID NO: 4891238 - DNA, 17 bp, Homo sapiens
attttctcaaaagcatt

SEQ ID NO: 4891239 - DNA, 22 bp, Homo sapiens
attttctcaaaagcatttatca

SEQ ID NO: 4891240 - DNA, 22 bp, Homo sapiens
attttctggaatacatgaaata

SEQ ID NO: 4891241 - DNA, 23 bp, Homo sapiens
attttctggggctcctcacatag

SEQ ID NO: 4891242 - DNA, 15 bp, Homo sapiens
attttctggttctaa

SEQ ID NO: 4891243 - DNA, 17 bp, Homo sapiens
attttctggttctaaca

SEQ ID NO: 4891244 - DNA, 13 bp, Homo sapiens
attttctgtcaga

SEQ ID NO: 4891245 - DNA, 21 bp, Homo sapiens
attttcttacccaatttccca

SEQ ID NO: 4891246 - DNA, 13 bp, Homo sapiens
attttcttctaag

SEQ ID NO: 4891247 - DNA, 16 bp, Homo sapiens
attttcttctaagtga

SEQ ID NO: 4891248 - DNA, 16 bp, Homo sapiens
attttctttctgtaac

SEQ ID NO: 4891249 - DNA, 13 bp, Homo sapiens
attttcttttctt

SEQ ID NO: 4891250 - DNA, 17 bp, Homo sapiens
attttgaaaagatgtac

SEQ ID NO: 4891251 - DNA, 14 bp, Homo sapiens
attttgaagtttac

SEQ ID NO: 4891252 - DNA, 16 bp, Homo sapiens
attttgaagtttacat

SEQ ID NO: 4891253 - DNA, 11 bp, Homo sapiens
attttgaatac

SEQ ID NO: 4891254 - DNA, 15 bp, Homo sapiens
attttgaataccatt

SEQ ID NO: 4891255 - DNA, 19 bp, Homo sapiens
attttgacttaatgtgatt

SEQ ID NO: 4891256 - DNA, 15 bp, Homo sapiens
attttgataataaat

SEQ ID NO: 4891257 - DNA, 17 bp, Homo sapiens
attttgataccagaagg

SEQ ID NO: 4891258 - DNA, 24 bp, Homo sapiens
attttgatgcagcatttgataatg

SEQ ID NO: 4891259 - DNA, 13 bp, Homo sapiens
attttgcaaatat

SEQ ID NO: 4891260 - DNA, 13 bp, Homo sapiens
attttgcctgtgt

SEQ ID NO: 4891261 - DNA, 14 bp, Homo sapiens
attttggagaaatt

SEQ ID NO: 4891262 - DNA, 21 bp, Homo sapiens
attttggagaaattatttaat

SEQ ID NO: 4891263 - DNA, 21 bp, Homo sapiens
attttggcgctattacaaata

SEQ ID NO: 4891264 - DNA, 21 bp, Homo sapiens
attttggggtacccactgctc

SEQ ID NO: 4891265 - DNA, 13 bp, Homo sapiens
attttggggtctc

SEQ ID NO: 4891266 - DNA, 17 bp, Homo sapiens
attttggggtctctttt

SEQ ID NO: 4891267 - DNA, 20 bp, Homo sapiens
attttggggttgtgttgtca

SEQ ID NO: 4891268 - DNA, 17 bp, Homo sapiens
attttgtaaactcaaaa

SEQ ID NO: 4891269 - DNA, 18 bp, Homo sapiens
attttgtaacgaagacac

SEQ ID NO: 4891270 - DNA, 15 bp, Homo sapiens
attttgtattgtggt

SEQ ID NO: 4891271 - DNA, 17 bp, Homo sapiens
attttgtattgtggtat

SEQ ID NO: 4891272 - DNA, 12 bp, Homo sapiens
attttgtgaatg

SEQ ID NO: 4891273 - DNA, 13 bp, Homo sapiens
attttgtgtgacc

SEQ ID NO: 4891274 - DNA, 17 bp, Homo sapiens
attttgtgtgaccaact

SEQ ID NO: 4891275 - DNA, 16 bp, Homo sapiens
attttgttcttacaca

SEQ ID NO: 4891276 - DNA, 14 bp, Homo sapiens
atttttaaattgtt

SEQ ID NO: 4891277 - DNA, 19 bp, Homo sapiens
atttttacaagaagtttat

SEQ ID NO: 4891278 - DNA, 14 bp, Homo sapiens
atttttagacagag

SEQ ID NO: 4891279 - DNA, 21 bp, Homo sapiens
atttttaggaagttttctgta

SEQ ID NO: 4891280 - DNA, 16 bp, Homo sapiens
atttttatttcagatt

SEQ ID NO: 4891281 - DNA, 17 bp, Homo sapiens
atttttatttcagattt

SEQ ID NO: 4891282 - DNA, 19 bp, Homo sapiens
atttttatttcagattttg

SEQ ID NO: 4891283 - DNA, 21 bp, Homo sapiens
atttttatttcagattttgat

SEQ ID NO: 4891284 - DNA, 13 bp, Homo sapiens
atttttcatattg

SEQ ID NO: 4891285 - DNA, 19 bp, Homo sapiens
atttttcatattgtgccaa

SEQ ID NO: 4891286 - DNA, 22 bp, Homo sapiens
atttttcggaggccccactgat

SEQ ID NO: 4891287 - DNA, 17 bp, Homo sapiens
atttttctaaccttgaa

SEQ ID NO: 4891288 - DNA, 21 bp, Homo sapiens
atttttctcaaagttttgaaa

SEQ ID NO: 4891289 - DNA, 19 bp, Homo sapiens
atttttgtagagccagggt

SEQ ID NO: 4891290 - DNA, 13 bp, Homo sapiens
attttttatatat

SEQ ID NO: 4891291 - DNA, 13 bp, Homo sapiens
attttttattgct

SEQ ID NO: 4891292 - DNA, 18 bp, Homo sapiens
attttttgcatcagtatt

SEQ ID NO: 4891293 - DNA, 16 bp, Homo sapiens
atttttttgagacaga

SEQ ID NO: 4891294 - DNA, 14 bp, Homo sapiens
attttttttacatt

SEQ ID NO: 4891295 - DNA, 19 bp, Homo sapiens
attttttttttaaattatt

SEQ ID NO: 4891296 - DNA, 18 bp, Homo sapiens
attttttttttttgaaaa

SEQ ID NO: 4891297 - DNA, 22 bp, Homo sapiens
caaaaaaaccacaaaggccaaa

SEQ ID NO: 4891298 - DNA, 20 bp, Homo sapiens
caaaaagaaaagaaaatttt

SEQ ID NO: 4891299 - DNA, 13 bp, Homo sapiens
caaaaaggttgct

SEQ ID NO: 4891300 - DNA, 13 bp, Homo sapiens
caaaaatacaaaa

SEQ ID NO: 4891301 - DNA, 11 bp, Homo sapiens
caaaaatgttg

SEQ ID NO: 4891302 - DNA, 15 bp, Homo sapiens
caaaacaaaacaaaa

SEQ ID NO: 4891303 - DNA, 17 bp, Homo sapiens
caaaacaaaacaaaact

SEQ ID NO: 4891304 - DNA, 16 bp, Homo sapiens
caaaacactgtggaac

SEQ ID NO: 4891305 - DNA, 14 bp, Homo sapiens
caaaacccatgtgg

SEQ ID NO: 4891306 - DNA, 15 bp, Homo sapiens
caaaactatacttga

SEQ ID NO: 4891307 - DNA, 21 bp, Homo sapiens
caaaactatacttgaacaaaa

SEQ ID NO: 4891308 - DNA, 16 bp, Homo sapiens
caaaactcctgtcttt

SEQ ID NO: 4891309 - DNA, 11 bp, Homo sapiens
caaaacttctt

SEQ ID NO: 4891310 - DNA, 19 bp, Homo sapiens
caaaacttcttgtcagaca

SEQ ID NO: 4891311 - DNA, 21 bp, Homo sapiens
caaaacttcttgtcagacata

SEQ ID NO: 4891312 - DNA, 14 bp, Homo sapiens
caaaagagaaaaaa

SEQ ID NO: 4891313 - DNA, 20 bp, Homo sapiens
caaaagatgctcttctgtgg

SEQ ID NO: 4891314 - DNA, 21 bp, Homo sapiens
caaaagcagtgggctcctggc

SEQ ID NO: 4891315 - DNA, 18 bp, Homo sapiens
caaaagccttgtgtatat

SEQ ID NO: 4891316 - DNA, 19 bp, Homo sapiens
caaaagccttgtgtatatt

SEQ ID NO: 4891317 - DNA, 22 bp, Homo sapiens
caaaagccttgtgtatatttgt

SEQ ID NO: 4891318 - DNA, 15 bp, Homo sapiens
caaaaggaaaaagct

SEQ ID NO: 4891319 - DNA, 22 bp, Homo sapiens
caaaaggagagactcccatgaa

SEQ ID NO: 4891320 - DNA, 23 bp, Homo sapiens
caaaagggtcagaggacctgtat

SEQ ID NO: 4891321 - DNA, 18 bp, Homo sapiens
caaaagttccaagagtct

SEQ ID NO: 4891322 - DNA, 21 bp, Homo sapiens
caaaagttccctgaaacacga

SEQ ID NO: 4891323 - DNA, 19 bp, Homo sapiens
caaaagttggactaaatgc

SEQ ID NO: 4891324 - DNA, 21 bp, Homo sapiens
caaaagttggactaaatgcct

SEQ ID NO: 4891325 - DNA, 14 bp, Homo sapiens
caaaagtttctctt

SEQ ID NO: 4891326 - DNA, 17 bp, Homo sapiens
caaaagttttcctgaga

SEQ ID NO: 4891327 - DNA, 21 bp, Homo sapiens
caaaataaaaagtgacacagc

SEQ ID NO: 4891328 - DNA, 14 bp, Homo sapiens
caaaataattctaa

SEQ ID NO: 4891329 - DNA, 16 bp, Homo sapiens
caaaatccaaaaagaa

SEQ ID NO: 4891330 - DNA, 22 bp, Homo sapiens
caaaatccaaaaagaaatgatg

SEQ ID NO: 4891331 - DNA, 21 bp, Homo sapiens
caaaatctgtccaaaggaggc

SEQ ID NO: 4891332 - DNA, 19 bp, Homo sapiens
caaaatgacatctttttaa

SEQ ID NO: 4891333 - DNA, 22 bp, Homo sapiens
caaaatgacatctttttaaagc

SEQ ID NO: 4891334 - DNA, 17 bp, Homo sapiens
caaaatggaataaaagg

SEQ ID NO: 4891335 - DNA, 19 bp, Homo sapiens
caaaatgttatcttctcaa

SEQ ID NO: 4891336 - DNA, 20 bp, Homo sapiens
caaaattcttatttttccta

SEQ ID NO: 4891337 - DNA, 15 bp, Homo sapiens
caaaattgatgtgtt

SEQ ID NO: 4891338 - DNA, 14 bp, Homo sapiens
caaaattttatttt

SEQ ID NO: 4891339 - DNA, 15 bp, Homo sapiens
caaacaaatatgcaa

SEQ ID NO: 4891340 - DNA, 12 bp, Homo sapiens
caaacaccttcc

SEQ ID NO: 4891341 - DNA, 21 bp, Homo sapiens
caaacaccttcttattatata

SEQ ID NO: 4891342 - DNA, 17 bp, Homo sapiens
caaacagaacagggtca

SEQ ID NO: 4891343 - DNA, 23 bp, Homo sapiens
caaacatgagatgtgtggactgt

SEQ ID NO: 4891344 - DNA, 13 bp, Homo sapiens
caaacatgtattt

SEQ ID NO: 4891345 - DNA, 11 bp, Homo sapiens
caaacattgtg

SEQ ID NO: 4891346 - DNA, 17 bp, Homo sapiens
caaacattgtgttgaca

SEQ ID NO: 4891347 - DNA, 22 bp, Homo sapiens
caaaccaagtcggaacagcaga

SEQ ID NO: 4891348 - DNA, 22 bp, Homo sapiens
caaacccacgattttctccagc

SEQ ID NO: 4891349 - DNA, 24 bp, Homo sapiens
caaacccacgattttctccagctc

SEQ ID NO: 4891350 - DNA, 21 bp, Homo sapiens
caaaccctaggttcccggtcc

SEQ ID NO: 4891351 - DNA, 17 bp, Homo sapiens
caaactcttgacctcag

SEQ ID NO: 4891352 - DNA, 17 bp, Homo sapiens
caaactgactcaacagt

SEQ ID NO: 4891353 - DNA, 21 bp, Homo sapiens
caaactggggcctccagaact

SEQ ID NO: 4891354 - DNA, 20 bp, Homo sapiens
caaactgtaaataaaaagaa

SEQ ID NO: 4891355 - DNA, 22 bp, Homo sapiens
caaactgtgaagcatttacaga

SEQ ID NO: 4891356 - DNA, 20 bp, Homo sapiens
caaactgttcaagaaataat

SEQ ID NO: 4891357 - DNA, 21 bp, Homo sapiens
caaacttaatgttcttatgca

SEQ ID NO: 4891358 - DNA, 18 bp, Homo sapiens
caaacttactattttgac

SEQ ID NO: 4891359 - DNA, 13 bp, Homo sapiens
caaacttgcttta

SEQ ID NO: 4891360 - DNA, 17 bp, Homo sapiens
caaacttttcaaggctt

SEQ ID NO: 4891361 - DNA, 20 bp, Homo sapiens
caaacttttcaaggcttata

SEQ ID NO: 4891362 - DNA, 15 bp, Homo sapiens
caaagaaatgaacat

SEQ ID NO: 4891363 - DNA, 16 bp, Homo sapiens
caaagaaatgaacatt

SEQ ID NO: 4891364 - DNA, 15 bp, Homo sapiens
caaagagaaaactta

SEQ ID NO: 4891365 - DNA, 16 bp, Homo sapiens
caaagagagaaaataa

SEQ ID NO: 4891366 - DNA, 19 bp, Homo sapiens
caaagagagaaaataaaga

SEQ ID NO: 4891367 - DNA, 19 bp, Homo sapiens
caaagagcacaaacatttt

SEQ ID NO: 4891368 - DNA, 20 bp, Homo sapiens
caaagagcacaaacattttt

SEQ ID NO: 4891369 - DNA, 22 bp, Homo sapiens
caaagaggactcgcttgtaaat

SEQ ID NO: 4891370 - DNA, 23 bp, Homo sapiens
caaagaggactcgcttgtaaata

SEQ ID NO: 4891371 - DNA, 13 bp, Homo sapiens
caaagaggctgcc

SEQ ID NO: 4891372 - DNA, 15 bp, Homo sapiens
caaagaggctgcccc

SEQ ID NO: 4891373 - DNA, 16 bp, Homo sapiens
caaagatcaaaataaa

SEQ ID NO: 4891374 - DNA, 18 bp, Homo sapiens
caaagatcaaaataaaaa

SEQ ID NO: 4891375 - DNA, 19 bp, Homo sapiens
caaagatggctcagagggg

SEQ ID NO: 4891376 - DNA, 15 bp, Homo sapiens
caaagcacagtgtta

SEQ ID NO: 4891377 - DNA, 13 bp, Homo sapiens
caaagcatagatg

SEQ ID NO: 4891378 - DNA, 14 bp, Homo sapiens
caaagcatggacta

SEQ ID NO: 4891379 - DNA, 20 bp, Homo sapiens
caaagccacctctgtcattt

SEQ ID NO: 4891380 - DNA, 23 bp, Homo sapiens
caaagccacctctgtcatttgtt

SEQ ID NO: 4891381 - DNA, 14 bp, Homo sapiens
caaagccagggtct

SEQ ID NO: 4891382 - DNA, 15 bp, Homo sapiens
caaagccagggtctc

SEQ ID NO: 4891383 - DNA, 14 bp, Homo sapiens
caaagctaggcctg

SEQ ID NO: 4891384 - DNA, 15 bp, Homo sapiens
caaagctaggcctgg

SEQ ID NO: 4891385 - DNA, 16 bp, Homo sapiens
caaagctaggcctggc

SEQ ID NO: 4891386 - DNA, 18 bp, Homo sapiens
caaagctaggcctggcca

SEQ ID NO: 4891387 - DNA, 20 bp, Homo sapiens
caaagctcaaataaaaataa

SEQ ID NO: 4891388 - DNA, 19 bp, Homo sapiens
caaagctgttaaactgtta

SEQ ID NO: 4891389 - DNA, 20 bp, Homo sapiens
caaagctgttaaactgttag

SEQ ID NO: 4891390 - DNA, 22 bp, Homo sapiens
caaagctgttaaactgttagca

SEQ ID NO: 4891391 - DNA, 19 bp, Homo sapiens
caaaggaagtgccccctcc

SEQ ID NO: 4891392 - DNA, 18 bp, Homo sapiens
caaaggacattatgtgtg

SEQ ID NO: 4891393 - DNA, 15 bp, Homo sapiens
caaaggccaaactgc

SEQ ID NO: 4891394 - DNA, 15 bp, Homo sapiens
caaaggggacaggcc

SEQ ID NO: 4891395 - DNA, 19 bp, Homo sapiens
caaaggggatcataaagtt

SEQ ID NO: 4891396 - DNA, 19 bp, Homo sapiens
caaagggtatcaggtgctg

SEQ ID NO: 4891397 - DNA, 21 bp, Homo sapiens
caaagggtatcaggtgctgcc

SEQ ID NO: 4891398 - DNA, 13 bp, Homo sapiens
caaaggtcttttt

SEQ ID NO: 4891399 - DNA, 14 bp, Homo sapiens
caaaggttctaggt

SEQ ID NO: 4891400 - DNA, 21 bp, Homo sapiens
caaaggttctaggtttcaaag

SEQ ID NO: 4891401 - DNA, 14 bp, Homo sapiens
caaagtcctttttt

SEQ ID NO: 4891402 - DNA, 17 bp, Homo sapiens
caaagtcctttttttcc

SEQ ID NO: 4891403 - DNA, 12 bp, Homo sapiens
caaagtctctaa

SEQ ID NO: 4891404 - DNA, 15 bp, Homo sapiens
caaagtctctaattc

SEQ ID NO: 4891405 - DNA, 15 bp, Homo sapiens
caaagtgctgagatt

SEQ ID NO: 4891406 - DNA, 19 bp, Homo sapiens
caaagtgctgggattacaa

SEQ ID NO: 4891407 - DNA, 23 bp, Homo sapiens
caaagtgctgggattacaagcgt

SEQ ID NO: 4891408 - DNA, 23 bp, Homo sapiens
caaagtgctgggattacaggtgt

SEQ ID NO: 4891409 - DNA, 16 bp, Homo sapiens
caaagttaacagattt

SEQ ID NO: 4891410 - DNA, 22 bp, Homo sapiens
caaagttctaataatttctaat

SEQ ID NO: 4891411 - DNA, 23 bp, Homo sapiens
caaagttctaataatttctaatg

SEQ ID NO: 4891412 - DNA, 15 bp, Homo sapiens
caaagttctgtgttt

SEQ ID NO: 4891413 - DNA, 20 bp, Homo sapiens
caaagttctgtgtttaattt

SEQ ID NO: 4891414 - DNA, 14 bp, Homo sapiens
caaagttttgaaaa

SEQ ID NO: 4891415 - DNA, 16 bp, Homo sapiens
caaataaaaatattgt

SEQ ID NO: 4891416 - DNA, 16 bp, Homo sapiens
caaataacttcagtcc

SEQ ID NO: 4891417 - DNA, 13 bp, Homo sapiens
caaataatcacat

SEQ ID NO: 4891418 - DNA, 15 bp, Homo sapiens
caaatacttagcaaa

SEQ ID NO: 4891419 - DNA, 18 bp, Homo sapiens
caaatataagattttctg

SEQ ID NO: 4891420 - DNA, 21 bp, Homo sapiens
caaatatcttgtgttgtcctt

SEQ ID NO: 4891421 - DNA, 21 bp, Homo sapiens
caaatatgagtacaaatgcct

SEQ ID NO: 4891422 - DNA, 23 bp, Homo sapiens
caaatatgagtacaaatgcctta

SEQ ID NO: 4891423 - DNA, 16 bp, Homo sapiens
caaatatttattttct

SEQ ID NO: 4891424 - DNA, 13 bp, Homo sapiens
caaatatttggag

SEQ ID NO: 4891425 - DNA, 16 bp, Homo sapiens
caaatccgctctcttc

SEQ ID NO: 4891426 - DNA, 21 bp, Homo sapiens
caaatccgctctcttcctgcc

SEQ ID NO: 4891427 - DNA, 19 bp, Homo sapiens
caaatccttccaaaaatta

SEQ ID NO: 4891428 - DNA, 16 bp, Homo sapiens
caaatcgtttatttca

SEQ ID NO: 4891429 - DNA, 17 bp, Homo sapiens
caaatctgtgtatatta

SEQ ID NO: 4891430 - DNA, 13 bp, Homo sapiens
caaatcttgaaat

SEQ ID NO: 4891431 - DNA, 10 bp, Homo sapiens
caaatgaatt

SEQ ID NO: 4891432 - DNA, 16 bp, Homo sapiens
caaatgacatgcactg

SEQ ID NO: 4891433 - DNA, 18 bp, Homo sapiens
caaatgacatgcactgac

SEQ ID NO: 4891434 - DNA, 15 bp, Homo sapiens
caaatgcaatttgat

SEQ ID NO: 4891435 - DNA, 18 bp, Homo sapiens
caaatggcgtctggaagt

SEQ ID NO: 4891436 - DNA, 19 bp, Homo sapiens
caaatggcgtctggaagtc

SEQ ID NO: 4891437 - DNA, 18 bp, Homo sapiens
caaatgggtgatatcctg

SEQ ID NO: 4891438 - DNA, 22 bp, Homo sapiens
caaatgggtgatatcctgaaaa

SEQ ID NO: 4891439 - DNA, 13 bp, Homo sapiens
caaatggtaggca

SEQ ID NO: 4891440 - DNA, 20 bp, Homo sapiens
caaatggtaggcatttccta

SEQ ID NO: 4891441 - DNA, 20 bp, Homo sapiens
caaatgtgtacatggcagag

SEQ ID NO: 4891442 - DNA, 23 bp, Homo sapiens
caaatgttctaagtttctaagat

SEQ ID NO: 4891443 - DNA, 15 bp, Homo sapiens
caaattaaaaagatt

SEQ ID NO: 4891444 - DNA, 19 bp, Homo sapiens
caaattaaaaagattcttt

SEQ ID NO: 4891445 - DNA, 15 bp, Homo sapiens
caaattatttgtgta

SEQ ID NO: 4891446 - DNA, 20 bp, Homo sapiens
caaattatttgtgtaataga

SEQ ID NO: 4891447 - DNA, 16 bp, Homo sapiens
caaattcatattctgt

SEQ ID NO: 4891448 - DNA, 22 bp, Homo sapiens
caaattgctcctaagcttcaaa

SEQ ID NO: 4891449 - DNA, 19 bp, Homo sapiens
caaattggactttcaaaat

SEQ ID NO: 4891450 - DNA, 14 bp, Homo sapiens
caaattgtcagcaa

SEQ ID NO: 4891451 - DNA, 14 bp, Homo sapiens
caaattgtgcttct

SEQ ID NO: 4891452 - DNA, 21 bp, Homo sapiens
caaattgtgcttctccccaga

SEQ ID NO: 4891453 - DNA, 16 bp, Homo sapiens
caaatttcaaaagaca

SEQ ID NO: 4891454 - DNA, 17 bp, Homo sapiens
caacaaagcacagtgtt

SEQ ID NO: 4891455 - DNA, 18 bp, Homo sapiens
caacaaaggcaagttaag

SEQ ID NO: 4891456 - DNA, 16 bp, Homo sapiens
caacacagcctgggcc

SEQ ID NO: 4891457 - DNA, 12 bp, Homo sapiens
caacaccacaga

SEQ ID NO: 4891458 - DNA, 14 bp, Homo sapiens
caacaccacagaca

SEQ ID NO: 4891459 - DNA, 16 bp, Homo sapiens
caacaccacagacaca

SEQ ID NO: 4891460 - DNA, 15 bp, Homo sapiens
caacagaactaaatg

SEQ ID NO: 4891461 - DNA, 21 bp, Homo sapiens
caacagcgacatagcccatcc

SEQ ID NO: 4891462 - DNA, 18 bp, Homo sapiens
caacagctcgatccaaat

SEQ ID NO: 4891463 - DNA, 12 bp, Homo sapiens
caacaggctggg

SEQ ID NO: 4891464 - DNA, 23 bp, Homo sapiens
caacaggctgggcttcagtggca

SEQ ID NO: 4891465 - DNA, 22 bp, Homo sapiens
caacaggctgttctgcactgaa

SEQ ID NO: 4891466 - DNA, 18 bp, Homo sapiens
caacatcctgccagcccc

SEQ ID NO: 4891467 - DNA, 23 bp, Homo sapiens
caacatttacagtccttcaaaat

SEQ ID NO: 4891468 - DNA, 15 bp, Homo sapiens
caaccagtgccaagg

SEQ ID NO: 4891469 - DNA, 17 bp, Homo sapiens
caaccagtgccaaggac

SEQ ID NO: 4891470 - DNA, 19 bp, Homo sapiens
caaccagtgccaaggacct

SEQ ID NO: 4891471 - DNA, 18 bp, Homo sapiens
caaccatggactttataa

SEQ ID NO: 4891472 - DNA, 14 bp, Homo sapiens
caaccattccagac

SEQ ID NO: 4891473 - DNA, 14 bp, Homo sapiens
caaccattccccat

SEQ ID NO: 4891474 - DNA, 15 bp, Homo sapiens
caacccaaggactga

SEQ ID NO: 4891475 - DNA, 19 bp, Homo sapiens
caacccaaggactgaggga

SEQ ID NO: 4891476 - DNA, 22 bp, Homo sapiens
caacccaaggactgagggactc

SEQ ID NO: 4891477 - DNA, 17 bp, Homo sapiens
caacccccaccccacac

SEQ ID NO: 4891478 - DNA, 16 bp, Homo sapiens
caacccccagcctgct

SEQ ID NO: 4891479 - DNA, 21 bp, Homo sapiens
caacccccattctcatctgca

SEQ ID NO: 4891480 - DNA, 17 bp, Homo sapiens
caaccccttcgctcctg

SEQ ID NO: 4891481 - DNA, 21 bp, Homo sapiens
caaccccttcgctcctgtgtc

SEQ ID NO: 4891482 - DNA, 22 bp, Homo sapiens
caaccccttcgctcctgtgtct

SEQ ID NO: 4891483 - DNA, 22 bp, Homo sapiens
caaccctaggttccctgttctt

SEQ ID NO: 4891484 - DNA, 16 bp, Homo sapiens
caaccctatctcctga

SEQ ID NO: 4891485 - DNA, 18 bp, Homo sapiens
caaccctcaggggaaaac

SEQ ID NO: 4891486 - DNA, 15 bp, Homo sapiens
caacccttacccctt

SEQ ID NO: 4891487 - DNA, 17 bp, Homo sapiens
caaccgcctcaaaatgt

SEQ ID NO: 4891488 - DNA, 20 bp, Homo sapiens
caacctccctcttgttttgt

SEQ ID NO: 4891489 - DNA, 15 bp, Homo sapiens
caacctcctgggcta

SEQ ID NO: 4891490 - DNA, 13 bp, Homo sapiens
caacctctcactc

SEQ ID NO: 4891491 - DNA, 14 bp, Homo sapiens
caacctctcactcc

SEQ ID NO: 4891492 - DNA, 16 bp, Homo sapiens
caacctcttctggctc

SEQ ID NO: 4891493 - DNA, 14 bp, Homo sapiens
caacgcacaggaaa

SEQ ID NO: 4891494 - DNA, 16 bp, Homo sapiens
caacgttactcagggc

SEQ ID NO: 4891495 - DNA, 17 bp, Homo sapiens
caacgttactcagggct

SEQ ID NO: 4891496 - DNA, 22 bp, Homo sapiens
caacgttactcagggctcctcc

SEQ ID NO: 4891497 - DNA, 19 bp, Homo sapiens
caactatcctgacttctaa

SEQ ID NO: 4891498 - DNA, 17 bp, Homo sapiens
caactatggatcagaat

SEQ ID NO: 4891499 - DNA, 13 bp, Homo sapiens
caactccagcaac

SEQ ID NO: 4891500 - DNA, 22 bp, Homo sapiens
caactccagcaacttcttctcc

SEQ ID NO: 4891501 - DNA, 18 bp, Homo sapiens
caactcttgattatccat

SEQ ID NO: 4891502 - DNA, 19 bp, Homo sapiens
caactgcaaagaaagtggg

SEQ ID NO: 4891503 - DNA, 23 bp, Homo sapiens
caactgcaaagaaagtgggaggt

SEQ ID NO: 4891504 - DNA, 21 bp, Homo sapiens
caactgcctcgaaacacagaa

SEQ ID NO: 4891505 - DNA, 19 bp, Homo sapiens
caactggacattgtctgcg

SEQ ID NO: 4891506 - DNA, 13 bp, Homo sapiens
caactgtatatat

SEQ ID NO: 4891507 - DNA, 12 bp, Homo sapiens
caactgtgactg

SEQ ID NO: 4891508 - DNA, 17 bp, Homo sapiens
caactgtgttgtattaa

SEQ ID NO: 4891509 - DNA, 15 bp, Homo sapiens
caacttaacatgggc

SEQ ID NO: 4891510 - DNA, 14 bp, Homo sapiens
caacttcagtcctg

SEQ ID NO: 4891511 - DNA, 16 bp, Homo sapiens
caactttctgtaaact

SEQ ID NO: 4891512 - DNA, 20 bp, Homo sapiens
caacttttgtgtaatgaaaa

SEQ ID NO: 4891513 - DNA, 21 bp, Homo sapiens
caacttttgtgtaatgaaaat

SEQ ID NO: 4891514 - DNA, 12 bp, Homo sapiens
caagaaaatcag

SEQ ID NO: 4891515 - DNA, 18 bp, Homo sapiens
caagaaactgaggaattt

SEQ ID NO: 4891516 - DNA, 19 bp, Homo sapiens
caagaaactgaggaatttt

SEQ ID NO: 4891517 - DNA, 14 bp, Homo sapiens
caagaaatccctgt

SEQ ID NO: 4891518 - DNA, 13 bp, Homo sapiens
caagaaatttgat

SEQ ID NO: 4891519 - DNA, 10 bp, Homo sapiens
caagaacctg

SEQ ID NO: 4891520 - DNA, 14 bp, Homo sapiens
caagaactctgggc

SEQ ID NO: 4891521 - DNA, 20 bp, Homo sapiens
caagaagtagcagtgtctgt

SEQ ID NO: 4891522 - DNA, 17 bp, Homo sapiens
caagaagtttattctca

SEQ ID NO: 4891523 - DNA, 18 bp, Homo sapiens
caagaatagatgctgact

SEQ ID NO: 4891524 - DNA, 14 bp, Homo sapiens
caagaatccacatt

SEQ ID NO: 4891525 - DNA, 15 bp, Homo sapiens
caagacacatcccta

SEQ ID NO: 4891526 - DNA, 13 bp, Homo sapiens
caagacagatgcc

SEQ ID NO: 4891527 - DNA, 16 bp, Homo sapiens
caagacagatgcccca

SEQ ID NO: 4891528 - DNA, 21 bp, Homo sapiens
caagacagatgccccagagct

SEQ ID NO: 4891529 - DNA, 21 bp, Homo sapiens
caagagaaaggcctgcacaca

SEQ ID NO: 4891530 - DNA, 19 bp, Homo sapiens
caagagaaggggaagcact

SEQ ID NO: 4891531 - DNA, 17 bp, Homo sapiens
caagagcccccttgaca

SEQ ID NO: 4891532 - DNA, 14 bp, Homo sapiens
caagagctgccctc

SEQ ID NO: 4891533 - DNA, 17 bp, Homo sapiens
caagagggcactggtgg

SEQ ID NO: 4891534 - DNA, 16 bp, Homo sapiens
caagagggtctgagga

SEQ ID NO: 4891535 - DNA, 18 bp, Homo sapiens
caagagtgattgcagctt

SEQ ID NO: 4891536 - DNA, 18 bp, Homo sapiens
caagagttttcttccttg

SEQ ID NO: 4891537 - DNA, 18 bp, Homo sapiens
caagataggaccttgggc

SEQ ID NO: 4891538 - DNA, 19 bp, Homo sapiens
caagatgttgatttttact

SEQ ID NO: 4891539 - DNA, 20 bp, Homo sapiens
caagattagaagctgaaaac

SEQ ID NO: 4891540 - DNA, 18 bp, Homo sapiens
caagattccggatcctaa

SEQ ID NO: 4891541 - DNA, 19 bp, Homo sapiens
caagattccggatcctaag

SEQ ID NO: 4891542 - DNA, 12 bp, Homo sapiens
caagattctaga

SEQ ID NO: 4891543 - DNA, 17 bp, Homo sapiens
caagattctagatgatt

SEQ ID NO: 4891544 - DNA, 18 bp, Homo sapiens
caagattctagatgatta

SEQ ID NO: 4891545 - DNA, 14 bp, Homo sapiens
caagatttagaaaa

SEQ ID NO: 4891546 - DNA, 15 bp, Homo sapiens
caagcaagttctgag

SEQ ID NO: 4891547 - DNA, 14 bp, Homo sapiens
caagcacctcctgc

SEQ ID NO: 4891548 - DNA, 20 bp, Homo sapiens
caagcagaggtggccagagc

SEQ ID NO: 4891549 - DNA, 20 bp, Homo sapiens
caagcagagtgcacagctgt

SEQ ID NO: 4891550 - DNA, 17 bp, Homo sapiens
caagcagcatcttctgg

SEQ ID NO: 4891551 - DNA, 21 bp, Homo sapiens
caagcagcctgagcaactctt

SEQ ID NO: 4891552 - DNA, 13 bp, Homo sapiens
caagcaggagacg

SEQ ID NO: 4891553 - DNA, 22 bp, Homo sapiens
caagcatcagggggaagaagca

SEQ ID NO: 4891554 - DNA, 21 bp, Homo sapiens
caagccatgtataaatgtgat

SEQ ID NO: 4891555 - DNA, 14 bp, Homo sapiens
caagcccaggtgcc

SEQ ID NO: 4891556 - DNA, 22 bp, Homo sapiens
caagcccaggtgccagcctgag

SEQ ID NO: 4891557 - DNA, 16 bp, Homo sapiens
caagcctccacagcga

SEQ ID NO: 4891558 - DNA, 17 bp, Homo sapiens
caagcctccacagcgag

SEQ ID NO: 4891559 - DNA, 18 bp, Homo sapiens
caagcgattcttctgctt

SEQ ID NO: 4891560 - DNA, 17 bp, Homo sapiens
caagcgtgagccactgc

SEQ ID NO: 4891561 - DNA, 16 bp, Homo sapiens
caagctaagcactgcc

SEQ ID NO: 4891562 - DNA, 22 bp, Homo sapiens
caagctaagcactgccactggg

SEQ ID NO: 4891563 - DNA, 21 bp, Homo sapiens
caagctaattgggagtccagg

SEQ ID NO: 4891564 - DNA, 15 bp, Homo sapiens
caagctatctaaagt

SEQ ID NO: 4891565 - DNA, 21 bp, Homo sapiens
caagctatctaaagtttgtta

SEQ ID NO: 4891566 - DNA, 16 bp, Homo sapiens
caagctattcctttcc

SEQ ID NO: 4891567 - DNA, 19 bp, Homo sapiens
caagctattcctttccctt

SEQ ID NO: 4891568 - DNA, 20 bp, Homo sapiens
caagctattcctttcccttc

SEQ ID NO: 4891569 - DNA, 19 bp, Homo sapiens
caagctccctgccccaaat

SEQ ID NO: 4891570 - DNA, 12 bp, Homo sapiens
caagctcctcct

SEQ ID NO: 4891571 - DNA, 20 bp, Homo sapiens
caagctcctcctcggaaccg

SEQ ID NO: 4891572 - DNA, 16 bp, Homo sapiens
caagctctgctcctct

SEQ ID NO: 4891573 - DNA, 17 bp, Homo sapiens
caagctggtcccactca

SEQ ID NO: 4891574 - DNA, 19 bp, Homo sapiens
caagctggtcccactcagt

SEQ ID NO: 4891575 - DNA, 17 bp, Homo sapiens
caagctgtccagagaaa

SEQ ID NO: 4891576 - DNA, 18 bp, Homo sapiens
caaggaacaaaaaaacca

SEQ ID NO: 4891577 - DNA, 23 bp, Homo sapiens
caaggaaggaaagaaagaaggaa

SEQ ID NO: 4891578 - DNA, 23 bp, Homo sapiens
caaggaaggttcatgtagagaaa

SEQ ID NO: 4891579 - DNA, 13 bp, Homo sapiens
caaggaccaggac

SEQ ID NO: 4891580 - DNA, 14 bp, Homo sapiens
caaggaccaggact

SEQ ID NO: 4891581 - DNA, 15 bp, Homo sapiens
caaggactgcaggga

SEQ ID NO: 4891582 - DNA, 13 bp, Homo sapiens
caaggagaacaaa

SEQ ID NO: 4891583 - DNA, 15 bp, Homo sapiens
caaggagaacaaata

SEQ ID NO: 4891584 - DNA, 18 bp, Homo sapiens
caaggagaacaaatattc

SEQ ID NO: 4891585 - DNA, 16 bp, Homo sapiens
caaggagcacaagcca

SEQ ID NO: 4891586 - DNA, 20 bp, Homo sapiens
caaggattgctactgtccta

SEQ ID NO: 4891587 - DNA, 14 bp, Homo sapiens
caaggccagagtgg

SEQ ID NO: 4891588 - DNA, 12 bp, Homo sapiens
caaggccctgct

SEQ ID NO: 4891589 - DNA, 14 bp, Homo sapiens
caaggccttctcct

SEQ ID NO: 4891590 - DNA, 14 bp, Homo sapiens
caaggcggcccctc

SEQ ID NO: 4891591 - DNA, 16 bp, Homo sapiens
caaggcggcccctccc

SEQ ID NO: 4891592 - DNA, 18 bp, Homo sapiens
caaggcttatattcaacc

SEQ ID NO: 4891593 - DNA, 20 bp, Homo sapiens
caaggggagtcaccttccct

SEQ ID NO: 4891594 - DNA, 23 bp, Homo sapiens
caagggtcattatgggttaggca

SEQ ID NO: 4891595 - DNA, 16 bp, Homo sapiens
caaggttcccttgtgg

SEQ ID NO: 4891596 - DNA, 17 bp, Homo sapiens
caaggtttaaagagtct

SEQ ID NO: 4891597 - DNA, 20 bp, Homo sapiens
caaggtttaaagagtctaga

SEQ ID NO: 4891598 - DNA, 18 bp, Homo sapiens
caaggttttaggttctaa

SEQ ID NO: 4891599 - DNA, 21 bp, Homo sapiens
caaggttttaggttctaaagt

SEQ ID NO: 4891600 - DNA, 17 bp, Homo sapiens
caagtagataaatattt

SEQ ID NO: 4891601 - DNA, 13 bp, Homo sapiens
caagtagtctgct

SEQ ID NO: 4891602 - DNA, 19 bp, Homo sapiens
caagtatgaataaagacac

SEQ ID NO: 4891603 - DNA, 16 bp, Homo sapiens
caagtcaatcatttct

SEQ ID NO: 4891604 - DNA, 13 bp, Homo sapiens
caagtcatgtgca

SEQ ID NO: 4891605 - DNA, 15 bp, Homo sapiens
caagtccaataagac

SEQ ID NO: 4891606 - DNA, 18 bp, Homo sapiens
caagtcctgtgaatttct

SEQ ID NO: 4891607 - DNA, 16 bp, Homo sapiens
caagtcggaacagcag

SEQ ID NO: 4891608 - DNA, 20 bp, Homo sapiens
caagtgaaataacaaaatgg

SEQ ID NO: 4891609 - DNA, 22 bp, Homo sapiens
caagtgaaataacaaaatggac

SEQ ID NO: 4891610 - DNA, 18 bp, Homo sapiens
caagtgagagctgggtgt

SEQ ID NO: 4891611 - DNA, 17 bp, Homo sapiens
caagtgattctcctgcc

SEQ ID NO: 4891612 - DNA, 19 bp, Homo sapiens
caagtgattctcctgcctc

SEQ ID NO: 4891613 - DNA, 21 bp, Homo sapiens
caagtgattctcctgcctcag

SEQ ID NO: 4891614 - DNA, 20 bp, Homo sapiens
caagtgcacggggcacagcg

SEQ ID NO: 4891615 - DNA, 16 bp, Homo sapiens
caagtgccaaatgctc

SEQ ID NO: 4891616 - DNA, 19 bp, Homo sapiens
caagtggctcccacaccct

SEQ ID NO: 4891617 - DNA, 22 bp, Homo sapiens
caagtgggatctgtcacaccag

SEQ ID NO: 4891618 - DNA, 19 bp, Homo sapiens
caagtggtttccacatgct

SEQ ID NO: 4891619 - DNA, 22 bp, Homo sapiens
caagtggtttccacatgctctg

SEQ ID NO: 4891620 - DNA, 18 bp, Homo sapiens
caagtgtatatcagaaaa

SEQ ID NO: 4891621 - DNA, 21 bp, Homo sapiens
caagtgtgggccactgtggtg

SEQ ID NO: 4891622 - DNA, 17 bp, Homo sapiens
caagttaagagaaactt

SEQ ID NO: 4891623 - DNA, 20 bp, Homo sapiens
caagttattgtacagctgtt

SEQ ID NO: 4891624 - DNA, 22 bp, Homo sapiens
caagttccatgggatacaacct

SEQ ID NO: 4891625 - DNA, 20 bp, Homo sapiens
caagttctaagattctaatg

SEQ ID NO: 4891626 - DNA, 21 bp, Homo sapiens
caagttctaagattctaatga

SEQ ID NO: 4891627 - DNA, 20 bp, Homo sapiens
caagtttccatagcaacagg

SEQ ID NO: 4891628 - DNA, 12 bp, Homo sapiens
caataaaacatt

SEQ ID NO: 4891629 - DNA, 17 bp, Homo sapiens
caataacactaaaattt

SEQ ID NO: 4891630 - DNA, 19 bp, Homo sapiens
caataataaatatttttgc

SEQ ID NO: 4891631 - DNA, 20 bp, Homo sapiens
caatagcatggatagagtat

SEQ ID NO: 4891632 - DNA, 18 bp, Homo sapiens
caatatataaaaatatat

SEQ ID NO: 4891633 - DNA, 18 bp, Homo sapiens
caatatattaccagcaag

SEQ ID NO: 4891634 - DNA, 23 bp, Homo sapiens
caatatcatatcatcacattgag

SEQ ID NO: 4891635 - DNA, 11 bp, Homo sapiens
caatatgctta

SEQ ID NO: 4891636 - DNA, 12 bp, Homo sapiens
caatatgcttac

SEQ ID NO: 4891637 - DNA, 15 bp, Homo sapiens
caatatgtaaatagt

SEQ ID NO: 4891638 - DNA, 15 bp, Homo sapiens
caatatgtattgtaa

SEQ ID NO: 4891639 - DNA, 21 bp, Homo sapiens
caatatgtattgtaaacatgt

SEQ ID NO: 4891640 - DNA, 17 bp, Homo sapiens
caatatgtgtttacttt

SEQ ID NO: 4891641 - DNA, 18 bp, Homo sapiens
caatatgtgtttacttta

SEQ ID NO: 4891642 - DNA, 14 bp, Homo sapiens
caatattccttagt

SEQ ID NO: 4891643 - DNA, 17 bp, Homo sapiens
caatattgacatttgta

SEQ ID NO: 4891644 - DNA, 17 bp, Homo sapiens
caatatttataaagaat

SEQ ID NO: 4891645 - DNA, 19 bp, Homo sapiens
caatatttatggatgcaac

SEQ ID NO: 4891646 - DNA, 21 bp, Homo sapiens
caatatttctgctttctttga

SEQ ID NO: 4891647 - DNA, 17 bp, Homo sapiens
caatcagcactgaaaat

SEQ ID NO: 4891648 - DNA, 19 bp, Homo sapiens
caatcagtatgtattcttt

SEQ ID NO: 4891649 - DNA, 14 bp, Homo sapiens
caatcatatgtgat

SEQ ID NO: 4891650 - DNA, 17 bp, Homo sapiens
caatcatatgtgatctg

SEQ ID NO: 4891651 - DNA, 12 bp, Homo sapiens
caatcattgttt

SEQ ID NO: 4891652 - DNA, 20 bp, Homo sapiens
caatcattgttttgaatatt

SEQ ID NO: 4891653 - DNA, 14 bp, Homo sapiens
caatcatttctcac

SEQ ID NO: 4891654 - DNA, 16 bp, Homo sapiens
caatcccaccaaccct

SEQ ID NO: 4891655 - DNA, 23 bp, Homo sapiens
caatcccaccaaccctcagagcc

SEQ ID NO: 4891656 - DNA, 12 bp, Homo sapiens
caatcctggctc

SEQ ID NO: 4891657 - DNA, 13 bp, Homo sapiens
caatctattattt

SEQ ID NO: 4891658 - DNA, 18 bp, Homo sapiens
caatctcaaggaatcttt

SEQ ID NO: 4891659 - DNA, 17 bp, Homo sapiens
caatctggaagaaaaaa

SEQ ID NO: 4891660 - DNA, 17 bp, Homo sapiens
caatgactgtgctactg

SEQ ID NO: 4891661 - DNA, 16 bp, Homo sapiens
caatgatggcaatttt

SEQ ID NO: 4891662 - DNA, 24 bp, Homo sapiens
caatgatggcaattttgtaacgaa

SEQ ID NO: 4891663 - DNA, 15 bp, Homo sapiens
caatgattattttca

SEQ ID NO: 4891664 - DNA, 21 bp, Homo sapiens
caatgcaagagtgattgcagc

SEQ ID NO: 4891665 - DNA, 13 bp, Homo sapiens
caatgcacatcca

SEQ ID NO: 4891666 - DNA, 16 bp, Homo sapiens
caatgcacatggtgca

SEQ ID NO: 4891667 - DNA, 14 bp, Homo sapiens
caatgcactgacat

SEQ ID NO: 4891668 - DNA, 18 bp, Homo sapiens
caatgcagcaaggccctg

SEQ ID NO: 4891669 - DNA, 22 bp, Homo sapiens
caatgcagcaaggccctgctgc

SEQ ID NO: 4891670 - DNA, 20 bp, Homo sapiens
caatgcccgtaatgcttaga

SEQ ID NO: 4891671 - DNA, 13 bp, Homo sapiens
caatggaaacaat

SEQ ID NO: 4891672 - DNA, 19 bp, Homo sapiens
caatggatttgatgctgtt

SEQ ID NO: 4891673 - DNA, 17 bp, Homo sapiens
caatgggcactgggatg

SEQ ID NO: 4891674 - DNA, 17 bp, Homo sapiens
caatgtatcccttctca

SEQ ID NO: 4891675 - DNA, 23 bp, Homo sapiens
caatgtatcccttctcacagcac

SEQ ID NO: 4891676 - DNA, 11 bp, Homo sapiens
caatgtgaaaa

SEQ ID NO: 4891677 - DNA, 15 bp, Homo sapiens
caatgtgattctaat

SEQ ID NO: 4891678 - DNA, 23 bp, Homo sapiens
caatgtggcaaggaaaaacaggt

SEQ ID NO: 4891679 - DNA, 24 bp, Homo sapiens
caatgttaaggaaactcttatctc

SEQ ID NO: 4891680 - DNA, 16 bp, Homo sapiens
caatgttagagacttt

SEQ ID NO: 4891681 - DNA, 23 bp, Homo sapiens
caattaaaaaaaaagatctgttt

SEQ ID NO: 4891682 - DNA, 15 bp, Homo sapiens
caattaatagtttgt

SEQ ID NO: 4891683 - DNA, 20 bp, Homo sapiens
caattaatattaattttcta

SEQ ID NO: 4891684 - DNA, 13 bp, Homo sapiens
caattaatgcttt

SEQ ID NO: 4891685 - DNA, 21 bp, Homo sapiens
caattagcaattgactgtcac

SEQ ID NO: 4891686 - DNA, 17 bp, Homo sapiens
caattaggtttttcctt

SEQ ID NO: 4891687 - DNA, 14 bp, Homo sapiens
caattattgatata

SEQ ID NO: 4891688 - DNA, 22 bp, Homo sapiens
caattattgatatatattataa

SEQ ID NO: 4891689 - DNA, 17 bp, Homo sapiens
caattattgttacacat

SEQ ID NO: 4891690 - DNA, 13 bp, Homo sapiens
caattcaaaagtt

SEQ ID NO: 4891691 - DNA, 15 bp, Homo sapiens
caattcaaaagttcc

SEQ ID NO: 4891692 - DNA, 17 bp, Homo sapiens
caattccaatatttctg

SEQ ID NO: 4891693 - DNA, 12 bp, Homo sapiens
caattcccctct

SEQ ID NO: 4891694 - DNA, 17 bp, Homo sapiens
caattcccctctgctgc

SEQ ID NO: 4891695 - DNA, 12 bp, Homo sapiens
caattggaggaa

SEQ ID NO: 4891696 - DNA, 15 bp, Homo sapiens
caattgtgctgccat

SEQ ID NO: 4891697 - DNA, 14 bp, Homo sapiens
caatttaaatgtta

SEQ ID NO: 4891698 - DNA, 14 bp, Homo sapiens
caatttattaaaat

SEQ ID NO: 4891699 - DNA, 22 bp, Homo sapiens
caatttattaaaatgattgtaa

SEQ ID NO: 4891700 - DNA, 16 bp, Homo sapiens
caatttgatacataat

SEQ ID NO: 4891701 - DNA, 20 bp, Homo sapiens
caatttgatacataataaaa

SEQ ID NO: 4891702 - DNA, 22 bp, Homo sapiens
caatttgatacataataaaaaa

SEQ ID NO: 4891703 - DNA, 21 bp, Homo sapiens
caatttgcactaaatcagaga

SEQ ID NO: 4891704 - DNA, 22 bp, Homo sapiens
caatttgttcatcctattgttg

SEQ ID NO: 4891705 - DNA, 12 bp, Homo sapiens
caattttaaaga

SEQ ID NO: 4891706 - DNA, 16 bp, Homo sapiens
caattttctaagcaat

SEQ ID NO: 4891707 - DNA, 12 bp, Homo sapiens
caattttgtaac

SEQ ID NO: 4891708 - DNA, 12 bp, Homo sapiens
caatttttaatg

SEQ ID NO: 4891709 - DNA, 16 bp, Homo sapiens
caatttttgtctcaga

SEQ ID NO: 4891710 - DNA, 23 bp, Homo sapiens
cacaaaactccgcccccagccta

SEQ ID NO: 4891711 - DNA, 15 bp, Homo sapiens
cacaaaatctgtcca

SEQ ID NO: 4891712 - DNA, 13 bp, Homo sapiens
cacaaacattttt

SEQ ID NO: 4891713 - DNA, 18 bp, Homo sapiens
cacaaaccacaactgaca

SEQ ID NO: 4891714 - DNA, 19 bp, Homo sapiens
cacaaaccacaactgacac

SEQ ID NO: 4891715 - DNA, 20 bp, Homo sapiens
cacaaaccacaactgacaca

SEQ ID NO: 4891716 - DNA, 15 bp, Homo sapiens
cacaaactgtaaata

SEQ ID NO: 4891717 - DNA, 18 bp, Homo sapiens
cacaaagcccttccatgt

SEQ ID NO: 4891718 - DNA, 17 bp, Homo sapiens
cacaaaggccaaactgc

SEQ ID NO: 4891719 - DNA, 13 bp, Homo sapiens
cacaaatatttat

SEQ ID NO: 4891720 - DNA, 21 bp, Homo sapiens
cacaaatatttattttctttc

SEQ ID NO: 4891721 - DNA, 23 bp, Homo sapiens
cacaaatatttattttctttctg

SEQ ID NO: 4891722 - DNA, 16 bp, Homo sapiens
cacaacacacacactc

SEQ ID NO: 4891723 - DNA, 16 bp, Homo sapiens
cacaaccagccaggca

SEQ ID NO: 4891724 - DNA, 15 bp, Homo sapiens
cacaacctgcatctt

SEQ ID NO: 4891725 - DNA, 13 bp, Homo sapiens
cacaactgacaca

SEQ ID NO: 4891726 - DNA, 17 bp, Homo sapiens
cacaactgacacaggaa

SEQ ID NO: 4891727 - DNA, 19 bp, Homo sapiens
cacaactgcaataacttct

SEQ ID NO: 4891728 - DNA, 23 bp, Homo sapiens
cacaactgcaataacttctgacc

SEQ ID NO: 4891729 - DNA, 14 bp, Homo sapiens
cacaagaaatttga

SEQ ID NO: 4891730 - DNA, 21 bp, Homo sapiens
cacaagcagagtgcacagctg

SEQ ID NO: 4891731 - DNA, 21 bp, Homo sapiens
cacaagccacaagtcttccag

SEQ ID NO: 4891732 - DNA, 18 bp, Homo sapiens
cacaaggctccaagacct

SEQ ID NO: 4891733 - DNA, 19 bp, Homo sapiens
cacaataacactaaaattt

SEQ ID NO: 4891734 - DNA, 16 bp, Homo sapiens
cacacaagaagaaggg

SEQ ID NO: 4891735 - DNA, 15 bp, Homo sapiens
cacacacacaaacct

SEQ ID NO: 4891736 - DNA, 11 bp, Homo sapiens
cacacacacac

SEQ ID NO: 4891737 - DNA, 14 bp, Homo sapiens
cacacacacacaca

SEQ ID NO: 4891738 - DNA, 15 bp, Homo sapiens
cacacacacacacaa

SEQ ID NO: 4891739 - DNA, 14 bp, Homo sapiens
cacacacacacatc

SEQ ID NO: 4891740 - DNA, 12 bp, Homo sapiens
cacacacacatc

SEQ ID NO: 4891741 - DNA, 12 bp, Homo sapiens
cacacacacatg

SEQ ID NO: 4891742 - DNA, 14 bp, Homo sapiens
cacacacacatgct

SEQ ID NO: 4891743 - DNA, 13 bp, Homo sapiens
cacacacatacac

SEQ ID NO: 4891744 - DNA, 13 bp, Homo sapiens
cacacacatagat

SEQ ID NO: 4891745 - DNA, 14 bp, Homo sapiens
cacacaccagagcc

SEQ ID NO: 4891746 - DNA, 16 bp, Homo sapiens
cacacacgcacgcaca

SEQ ID NO: 4891747 - DNA, 17 bp, Homo sapiens
cacacacgcgtgcacac

SEQ ID NO: 4891748 - DNA, 20 bp, Homo sapiens
cacacacggaggcatcctac

SEQ ID NO: 4891749 - DNA, 12 bp, Homo sapiens
cacacagaaata

SEQ ID NO: 4891750 - DNA, 14 bp, Homo sapiens
cacacagaccacca

SEQ ID NO: 4891751 - DNA, 17 bp, Homo sapiens
cacacagatacacacac

SEQ ID NO: 4891752 - DNA, 13 bp, Homo sapiens
cacacagctctgt

SEQ ID NO: 4891753 - DNA, 17 bp, Homo sapiens
cacacagctctgtcctg

SEQ ID NO: 4891754 - DNA, 20 bp, Homo sapiens
cacacagctctgtcctggga

SEQ ID NO: 4891755 - DNA, 20 bp, Homo sapiens
cacacagtattacttctgct

SEQ ID NO: 4891756 - DNA, 23 bp, Homo sapiens
cacacagtattacttctgctaca

SEQ ID NO: 4891757 - DNA, 18 bp, Homo sapiens
cacacagtgagtcgagga

SEQ ID NO: 4891758 - DNA, 21 bp, Homo sapiens
cacacagtgagtcgaggacag

SEQ ID NO: 4891759 - DNA, 22 bp, Homo sapiens
cacacatagattaatggcactg

SEQ ID NO: 4891760 - DNA, 23 bp, Homo sapiens
cacacatagattaatggcactga

SEQ ID NO: 4891761 - DNA, 21 bp, Homo sapiens
cacacatataaacatcacaca

SEQ ID NO: 4891762 - DNA, 13 bp, Homo sapiens
cacacatcaggag

SEQ ID NO: 4891763 - DNA, 13 bp, Homo sapiens
cacacatgcacac

SEQ ID NO: 4891764 - DNA, 12 bp, Homo sapiens
cacaccagagcc

SEQ ID NO: 4891765 - DNA, 21 bp, Homo sapiens
cacaccagagcccaccttggc

SEQ ID NO: 4891766 - DNA, 12 bp, Homo sapiens
cacaccagccat

SEQ ID NO: 4891767 - DNA, 16 bp, Homo sapiens
cacaccagtcacatga

SEQ ID NO: 4891768 - DNA, 19 bp, Homo sapiens
cacaccctcactctgccag

SEQ ID NO: 4891769 - DNA, 12 bp, Homo sapiens
cacaccctgagg

SEQ ID NO: 4891770 - DNA, 16 bp, Homo sapiens
cacaccctgcaaggcc

SEQ ID NO: 4891771 - DNA, 21 bp, Homo sapiens
cacaccctgtactgttctgtg

SEQ ID NO: 4891772 - DNA, 14 bp, Homo sapiens
cacacctcactctt

SEQ ID NO: 4891773 - DNA, 13 bp, Homo sapiens
cacacctcagttc

SEQ ID NO: 4891774 - DNA, 20 bp, Homo sapiens
cacacctcagttcccttggc

SEQ ID NO: 4891775 - DNA, 21 bp, Homo sapiens
cacacctcagttcccttggcc

SEQ ID NO: 4891776 - DNA, 14 bp, Homo sapiens
cacacctctgccag

SEQ ID NO: 4891777 - DNA, 17 bp, Homo sapiens
cacacgcacgcacacac

SEQ ID NO: 4891778 - DNA, 19 bp, Homo sapiens
cacacgcacgcacacacac

SEQ ID NO: 4891779 - DNA, 21 bp, Homo sapiens
cacacgcacgcacacacacaa

SEQ ID NO: 4891780 - DNA, 19 bp, Homo sapiens
cacactatcatagttaaca

SEQ ID NO: 4891781 - DNA, 13 bp, Homo sapiens
cacactcagtgca

SEQ ID NO: 4891782 - DNA, 22 bp, Homo sapiens
cacactctccatcaccctcttc

SEQ ID NO: 4891783 - DNA, 18 bp, Homo sapiens
cacactgatgcttagatg

SEQ ID NO: 4891784 - DNA, 18 bp, Homo sapiens
cacactgcactgttttca

SEQ ID NO: 4891785 - DNA, 17 bp, Homo sapiens
cacacttcaggctcttc

SEQ ID NO: 4891786 - DNA, 21 bp, Homo sapiens
cacacttcaggctcttctcct

SEQ ID NO: 4891787 - DNA, 16 bp, Homo sapiens
cacacttgttccagct

SEQ ID NO: 4891788 - DNA, 17 bp, Homo sapiens
cacactttttaagaaat

SEQ ID NO: 4891789 - DNA, 13 bp, Homo sapiens
cacagaaaagcat

SEQ ID NO: 4891790 - DNA, 16 bp, Homo sapiens
cacagaaacactgcct

SEQ ID NO: 4891791 - DNA, 13 bp, Homo sapiens
cacagaaatatat

SEQ ID NO: 4891792 - DNA, 15 bp, Homo sapiens
cacagaaatatatat

SEQ ID NO: 4891793 - DNA, 23 bp, Homo sapiens
cacagaaatatatatacatatgt

SEQ ID NO: 4891794 - DNA, 14 bp, Homo sapiens
cacagacacacaca

SEQ ID NO: 4891795 - DNA, 17 bp, Homo sapiens
cacagacacacacacgc

SEQ ID NO: 4891796 - DNA, 20 bp, Homo sapiens
cacagacacacacacgcacg

SEQ ID NO: 4891797 - DNA, 22 bp, Homo sapiens
cacagacacacacacgcacgca

SEQ ID NO: 4891798 - DNA, 19 bp, Homo sapiens
cacagactggttttgcaac

SEQ ID NO: 4891799 - DNA, 19 bp, Homo sapiens
cacagagaaagtacttctc

SEQ ID NO: 4891800 - DNA, 20 bp, Homo sapiens
cacagagaaagtacttctcc

SEQ ID NO: 4891801 - DNA, 21 bp, Homo sapiens
cacagagaaagtacttctcca

SEQ ID NO: 4891802 - DNA, 14 bp, Homo sapiens
cacagagaagctgg

SEQ ID NO: 4891803 - DNA, 20 bp, Homo sapiens
cacagagaagctggggagga

SEQ ID NO: 4891804 - DNA, 19 bp, Homo sapiens
cacagagagggagagcaga

SEQ ID NO: 4891805 - DNA, 20 bp, Homo sapiens
cacagatatactttgtggac

SEQ ID NO: 4891806 - DNA, 16 bp, Homo sapiens
cacagattttaattgt

SEQ ID NO: 4891807 - DNA, 13 bp, Homo sapiens
cacagcacagctc

SEQ ID NO: 4891808 - DNA, 19 bp, Homo sapiens
cacagcacatgctggccag

SEQ ID NO: 4891809 - DNA, 21 bp, Homo sapiens
cacagcacatgctggccagcc

SEQ ID NO: 4891810 - DNA, 23 bp, Homo sapiens
cacagcacatgctggccagcctg

SEQ ID NO: 4891811 - DNA, 13 bp, Homo sapiens
cacagcagcattt

SEQ ID NO: 4891812 - DNA, 14 bp, Homo sapiens
cacagcagcatttt

SEQ ID NO: 4891813 - DNA, 15 bp, Homo sapiens
cacagcagcttcacc

SEQ ID NO: 4891814 - DNA, 19 bp, Homo sapiens
cacagcagcttcaccagag

SEQ ID NO: 4891815 - DNA, 15 bp, Homo sapiens
cacagcccagcttgg

SEQ ID NO: 4891816 - DNA, 20 bp, Homo sapiens
cacagcctcctctgtctgcc

SEQ ID NO: 4891817 - DNA, 12 bp, Homo sapiens
cacagcctctga

SEQ ID NO: 4891818 - DNA, 17 bp, Homo sapiens
cacagcctctgacccct

SEQ ID NO: 4891819 - DNA, 23 bp, Homo sapiens
cacagcctctgacccctcctcac

SEQ ID NO: 4891820 - DNA, 19 bp, Homo sapiens
cacagcctgggccccagct

SEQ ID NO: 4891821 - DNA, 14 bp, Homo sapiens
cacagcgagggcag

SEQ ID NO: 4891822 - DNA, 19 bp, Homo sapiens
cacagcgagggcagctgct

SEQ ID NO: 4891823 - DNA, 21 bp, Homo sapiens
cacagcggagtctgtcctgtg

SEQ ID NO: 4891824 - DNA, 15 bp, Homo sapiens
cacagcgtccctagc

SEQ ID NO: 4891825 - DNA, 22 bp, Homo sapiens
cacagcgtccctagcagtgaac

SEQ ID NO: 4891826 - DNA, 16 bp, Homo sapiens
cacagctcaggaacta

SEQ ID NO: 4891827 - DNA, 16 bp, Homo sapiens
cacagctccctgccaa

SEQ ID NO: 4891828 - DNA, 21 bp, Homo sapiens
cacagctctccggtctctctc

SEQ ID NO: 4891829 - DNA, 20 bp, Homo sapiens
cacagctctgtcctgggagt

SEQ ID NO: 4891830 - DNA, 14 bp, Homo sapiens
cacagctcttctcc

SEQ ID NO: 4891831 - DNA, 15 bp, Homo sapiens
cacagctcttctcca

SEQ ID NO: 4891832 - DNA, 20 bp, Homo sapiens
cacagctcttctccaggctg

SEQ ID NO: 4891833 - DNA, 20 bp, Homo sapiens
cacagctgaaagttcttgct

SEQ ID NO: 4891834 - DNA, 21 bp, Homo sapiens
cacagctggagctctcaaact

SEQ ID NO: 4891835 - DNA, 12 bp, Homo sapiens
cacaggaaaagg

SEQ ID NO: 4891836 - DNA, 23 bp, Homo sapiens
cacaggaaaccaacacccaaagc

SEQ ID NO: 4891837 - DNA, 16 bp, Homo sapiens
cacaggcaaaatcctt

SEQ ID NO: 4891838 - DNA, 20 bp, Homo sapiens
cacaggcaaaatccttgctt

SEQ ID NO: 4891839 - DNA, 22 bp, Homo sapiens
cacaggcccccttgagtggggt

SEQ ID NO: 4891840 - DNA, 17 bp, Homo sapiens
cacaggcccggctccag

SEQ ID NO: 4891841 - DNA, 20 bp, Homo sapiens
cacaggcccggctccaggct

SEQ ID NO: 4891842 - DNA, 23 bp, Homo sapiens
cacaggcccggctccaggctcct

SEQ ID NO: 4891843 - DNA, 15 bp, Homo sapiens
cacaggcccttcctc

SEQ ID NO: 4891844 - DNA, 15 bp, Homo sapiens
cacaggtcccacctc

SEQ ID NO: 4891845 - DNA, 22 bp, Homo sapiens
cacaggtcccacctccagcccg

SEQ ID NO: 4891846 - DNA, 19 bp, Homo sapiens
cacaggttcatgccaccat

SEQ ID NO: 4891847 - DNA, 18 bp, Homo sapiens
cacaggttggaagagaat

SEQ ID NO: 4891848 - DNA, 15 bp, Homo sapiens
cacagtagagccagc

SEQ ID NO: 4891849 - DNA, 13 bp, Homo sapiens
cacagtagtcttg

SEQ ID NO: 4891850 - DNA, 16 bp, Homo sapiens
cacagtagtcttgatg

SEQ ID NO: 4891851 - DNA, 16 bp, Homo sapiens
cacagtcaaaataatt

SEQ ID NO: 4891852 - DNA, 22 bp, Homo sapiens
cacagtccaggaacaagctaat

SEQ ID NO: 4891853 - DNA, 17 bp, Homo sapiens
cacagtgacccttccca

SEQ ID NO: 4891854 - DNA, 14 bp, Homo sapiens
cacagtgggaactc

SEQ ID NO: 4891855 - DNA, 19 bp, Homo sapiens
cacagtgggaactctgaca

SEQ ID NO: 4891856 - DNA, 17 bp, Homo sapiens
cacagttcaattctcat

SEQ ID NO: 4891857 - DNA, 17 bp, Homo sapiens
cacagttggctggatga

SEQ ID NO: 4891858 - DNA, 22 bp, Homo sapiens
cacagttggctggatgaaattt

SEQ ID NO: 4891859 - DNA, 12 bp, Homo sapiens
cacataaaactt

SEQ ID NO: 4891860 - DNA, 14 bp, Homo sapiens
cacatacagtttta

SEQ ID NO: 4891861 - DNA, 16 bp, Homo sapiens
cacatacagttttatg

SEQ ID NO: 4891862 - DNA, 18 bp, Homo sapiens
cacatagattaatggcac

SEQ ID NO: 4891863 - DNA, 16 bp, Homo sapiens
cacatagctgtctaga

SEQ ID NO: 4891864 - DNA, 21 bp, Homo sapiens
cacatataaacatcacacaca

SEQ ID NO: 4891865 - DNA, 18 bp, Homo sapiens
cacatatacctataatgt

SEQ ID NO: 4891866 - DNA, 12 bp, Homo sapiens
cacatatctgtc

SEQ ID NO: 4891867 - DNA, 18 bp, Homo sapiens
cacatatgcaccttgtgt

SEQ ID NO: 4891868 - DNA, 22 bp, Homo sapiens
cacatatgcaccttgtgtctgt

SEQ ID NO: 4891869 - DNA, 21 bp, Homo sapiens
cacatccattcccaagaaatg

SEQ ID NO: 4891870 - DNA, 18 bp, Homo sapiens
cacatcctccgtccagcc

SEQ ID NO: 4891871 - DNA, 13 bp, Homo sapiens
cacatctctgaaa

SEQ ID NO: 4891872 - DNA, 13 bp, Homo sapiens
cacatctgcattt

SEQ ID NO: 4891873 - DNA, 15 bp, Homo sapiens
cacatcttgctctgc

SEQ ID NO: 4891874 - DNA, 17 bp, Homo sapiens
cacatcttgctctgctg

SEQ ID NO: 4891875 - DNA, 19 bp, Homo sapiens
cacatcttgctctgctgac

SEQ ID NO: 4891876 - DNA, 21 bp, Homo sapiens
cacatcttggctatgtaattc

SEQ ID NO: 4891877 - DNA, 15 bp, Homo sapiens
cacatctttcctgtc

SEQ ID NO: 4891878 - DNA, 9 bp, Homo sapiens
cacatgcta

SEQ ID NO: 4891879 - DNA, 21 bp, Homo sapiens
cacatgctaggatgcggaaat

SEQ ID NO: 4891880 - DNA, 12 bp, Homo sapiens
cacatgctggcc

SEQ ID NO: 4891881 - DNA, 17 bp, Homo sapiens
cacatgctggccagcct

SEQ ID NO: 4891882 - DNA, 19 bp, Homo sapiens
cacatgctggccagcctgg

SEQ ID NO: 4891883 - DNA, 17 bp, Homo sapiens
cacatgtgcacatgcac

SEQ ID NO: 4891884 - DNA, 13 bp, Homo sapiens
cacatgtttttat

SEQ ID NO: 4891885 - DNA, 13 bp, Homo sapiens
cacattaaaaaat

SEQ ID NO: 4891886 - DNA, 19 bp, Homo sapiens
cacattaaaaaatgaaata

SEQ ID NO: 4891887 - DNA, 20 bp, Homo sapiens
cacattaaaaaatgaaatat

SEQ ID NO: 4891888 - DNA, 17 bp, Homo sapiens
cacattgagctgtgcaa

SEQ ID NO: 4891889 - DNA, 16 bp, Homo sapiens
cacattgcattctatt

SEQ ID NO: 4891890 - DNA, 18 bp, Homo sapiens
cacattgcattctattgc

SEQ ID NO: 4891891 - DNA, 19 bp, Homo sapiens
cacattgcattctattgcc

SEQ ID NO: 4891892 - DNA, 23 bp, Homo sapiens
cacattgcattctattgccttct

SEQ ID NO: 4891893 - DNA, 18 bp, Homo sapiens
cacattgtttgctgctat

SEQ ID NO: 4891894 - DNA, 17 bp, Homo sapiens
cacatttctaaaatctt

SEQ ID NO: 4891895 - DNA, 14 bp, Homo sapiens
caccaaagatgcag

SEQ ID NO: 4891896 - DNA, 12 bp, Homo sapiens
caccaaagttct

SEQ ID NO: 4891897 - DNA, 17 bp, Homo sapiens
caccaaagttctaataa

SEQ ID NO: 4891898 - DNA, 22 bp, Homo sapiens
caccaagacttgttttatgctc

SEQ ID NO: 4891899 - DNA, 13 bp, Homo sapiens
caccacacccagc

SEQ ID NO: 4891900 - DNA, 17 bp, Homo sapiens
caccacacccagcccac

SEQ ID NO: 4891901 - DNA, 16 bp, Homo sapiens
caccacacccagcctc

SEQ ID NO: 4891902 - DNA, 18 bp, Homo sapiens
caccacacccagcctcag

SEQ ID NO: 4891903 - DNA, 13 bp, Homo sapiens
caccacagacaca

SEQ ID NO: 4891904 - DNA, 16 bp, Homo sapiens
caccacagacacacac

SEQ ID NO: 4891905 - DNA, 19 bp, Homo sapiens
caccacagacacacacacg

SEQ ID NO: 4891906 - DNA, 18 bp, Homo sapiens
caccacatgtgcacatgc

SEQ ID NO: 4891907 - DNA, 18 bp, Homo sapiens
caccaccccaacaaacca

SEQ ID NO: 4891908 - DNA, 22 bp, Homo sapiens
caccaccctagtcccttcccct

SEQ ID NO: 4891909 - DNA, 13 bp, Homo sapiens
caccacctccctc

SEQ ID NO: 4891910 - DNA, 13 bp, Homo sapiens
caccactgcactc

SEQ ID NO: 4891911 - DNA, 18 bp, Homo sapiens
caccagaattgtgcaaat

SEQ ID NO: 4891912 - DNA, 22 bp, Homo sapiens
caccagagcaacctctcactcc

SEQ ID NO: 4891913 - DNA, 16 bp, Homo sapiens
caccagagcagatgca

SEQ ID NO: 4891914 - DNA, 18 bp, Homo sapiens
caccagagcagatgcaga

SEQ ID NO: 4891915 - DNA, 19 bp, Homo sapiens
caccagagcagatgcagag

SEQ ID NO: 4891916 - DNA, 21 bp, Homo sapiens
caccagagcatttccaacacc

SEQ ID NO: 4891917 - DNA, 22 bp, Homo sapiens
caccagagcccaccttggctca

SEQ ID NO: 4891918 - DNA, 16 bp, Homo sapiens
caccagatagcagagg

SEQ ID NO: 4891919 - DNA, 12 bp, Homo sapiens
caccagccccac

SEQ ID NO: 4891920 - DNA, 22 bp, Homo sapiens
caccagccccagtgcccacagg

SEQ ID NO: 4891921 - DNA, 17 bp, Homo sapiens
caccaggagaaccacta

SEQ ID NO: 4891922 - DNA, 16 bp, Homo sapiens
caccagtcacatgacc

SEQ ID NO: 4891923 - DNA, 14 bp, Homo sapiens
caccagtgtcccct

SEQ ID NO: 4891924 - DNA, 18 bp, Homo sapiens
caccagtgtcccctccac

SEQ ID NO: 4891925 - DNA, 12 bp, Homo sapiens
caccatggccag

SEQ ID NO: 4891926 - DNA, 18 bp, Homo sapiens
cacccaaagcatggacta

SEQ ID NO: 4891927 - DNA, 22 bp, Homo sapiens
cacccaaccctatctcctgaca

SEQ ID NO: 4891928 - DNA, 12 bp, Homo sapiens
cacccagcctca

SEQ ID NO: 4891929 - DNA, 22 bp, Homo sapiens
cacccagcctcagtcctcccct

SEQ ID NO: 4891930 - DNA, 17 bp, Homo sapiens
cacccataatcctttct

SEQ ID NO: 4891931 - DNA, 13 bp, Homo sapiens
cacccatggtacc

SEQ ID NO: 4891932 - DNA, 15 bp, Homo sapiens
caccccaccctccct

SEQ ID NO: 4891933 - DNA, 21 bp, Homo sapiens
caccccatcccacaccctgga

SEQ ID NO: 4891934 - DNA, 15 bp, Homo sapiens
caccccatgccaaag

SEQ ID NO: 4891935 - DNA, 12 bp, Homo sapiens
cacccccagctt

SEQ ID NO: 4891936 - DNA, 17 bp, Homo sapiens
cacccccatctctccct

SEQ ID NO: 4891937 - DNA, 15 bp, Homo sapiens
caccccccaagctgt

SEQ ID NO: 4891938 - DNA, 18 bp, Homo sapiens
cacccccttctctgctcc

SEQ ID NO: 4891939 - DNA, 19 bp, Homo sapiens
caccccgctgtaagctcct

SEQ ID NO: 4891940 - DNA, 22 bp, Homo sapiens
caccccgctgtaagctcctttg

SEQ ID NO: 4891941 - DNA, 23 bp, Homo sapiens
caccccggccccctgcccgttct

SEQ ID NO: 4891942 - DNA, 20 bp, Homo sapiens
caccccgttacagctcccca

SEQ ID NO: 4891943 - DNA, 18 bp, Homo sapiens
cacccctgtcctcactgc

SEQ ID NO: 4891944 - DNA, 12 bp, Homo sapiens
cacccggcccct

SEQ ID NO: 4891945 - DNA, 17 bp, Homo sapiens
cacccggcccctgctgg

SEQ ID NO: 4891946 - DNA, 18 bp, Homo sapiens
cacccggcccctgctggt

SEQ ID NO: 4891947 - DNA, 17 bp, Homo sapiens
cacccgtgagcgcctgt

SEQ ID NO: 4891948 - DNA, 16 bp, Homo sapiens
caccctacctgtgcct

SEQ ID NO: 4891949 - DNA, 16 bp, Homo sapiens
caccctagtttccctg

SEQ ID NO: 4891950 - DNA, 17 bp, Homo sapiens
caccctagtttccctga

SEQ ID NO: 4891951 - DNA, 18 bp, Homo sapiens
caccctcactctgccagg

SEQ ID NO: 4891952 - DNA, 12 bp, Homo sapiens
caccctcctttc

SEQ ID NO: 4891953 - DNA, 16 bp, Homo sapiens
caccctcgaagcgcgc

SEQ ID NO: 4891954 - DNA, 23 bp, Homo sapiens
caccctcgaagcgcgccactcgc

SEQ ID NO: 4891955 - DNA, 14 bp, Homo sapiens
caccctcttcctgt

SEQ ID NO: 4891956 - DNA, 17 bp, Homo sapiens
caccctgaggtcaggga

SEQ ID NO: 4891957 - DNA, 15 bp, Homo sapiens
caccctgctgccttc

SEQ ID NO: 4891958 - DNA, 17 bp, Homo sapiens
caccctggggagaaagt

SEQ ID NO: 4891959 - DNA, 16 bp, Homo sapiens
caccctgtacctcatc

SEQ ID NO: 4891960 - DNA, 21 bp, Homo sapiens
caccctgtactgttctgtgtc

SEQ ID NO: 4891961 - DNA, 20 bp, Homo sapiens
caccctgtggccctggctct

SEQ ID NO: 4891962 - DNA, 23 bp, Homo sapiens
cacccttaacccaaggagcacag

SEQ ID NO: 4891963 - DNA, 14 bp, Homo sapiens
cacccttagaaaat

SEQ ID NO: 4891964 - DNA, 23 bp, Homo sapiens
cacccttcccctccttctccctt

SEQ ID NO: 4891965 - DNA, 13 bp, Homo sapiens
cacccttccttct

SEQ ID NO: 4891966 - DNA, 13 bp, Homo sapiens
cacccttggcctg

SEQ ID NO: 4891967 - DNA, 23 bp, Homo sapiens
cacccttggcctgtctcatcccc

SEQ ID NO: 4891968 - DNA, 19 bp, Homo sapiens
caccctttcttgacaaaac

SEQ ID NO: 4891969 - DNA, 23 bp, Homo sapiens
caccgaagtggactggcccctgg

SEQ ID NO: 4891970 - DNA, 19 bp, Homo sapiens
caccgacgcgtctcctgtt

SEQ ID NO: 4891971 - DNA, 15 bp, Homo sapiens
caccgactagccagg

SEQ ID NO: 4891972 - DNA, 19 bp, Homo sapiens
caccgctgctccacgcgct

SEQ ID NO: 4891973 - DNA, 19 bp, Homo sapiens
caccgcttttgttctcgca

SEQ ID NO: 4891974 - DNA, 12 bp, Homo sapiens
caccggcgcgct

SEQ ID NO: 4891975 - DNA, 15 bp, Homo sapiens
caccgggccacagag

SEQ ID NO: 4891976 - DNA, 20 bp, Homo sapiens
caccggggacaggccgcagc

SEQ ID NO: 4891977 - DNA, 16 bp, Homo sapiens
caccggtccagctggc

SEQ ID NO: 4891978 - DNA, 12 bp, Homo sapiens
cacctactgagt

SEQ ID NO: 4891979 - DNA, 17 bp, Homo sapiens
cacctagagccagacca

SEQ ID NO: 4891980 - DNA, 21 bp, Homo sapiens
cacctatgtgccaactgttgt

SEQ ID NO: 4891981 - DNA, 13 bp, Homo sapiens
cacctatttccat

SEQ ID NO: 4891982 - DNA, 18 bp, Homo sapiens
cacctcaccccgttacag

SEQ ID NO: 4891983 - DNA, 17 bp, Homo sapiens
cacctcagcctgcacag

SEQ ID NO: 4891984 - DNA, 11 bp, Homo sapiens
cacctcagttc

SEQ ID NO: 4891985 - DNA, 18 bp, Homo sapiens
cacctcagttcccttggc

SEQ ID NO: 4891986 - DNA, 14 bp, Homo sapiens
cacctccagcccgg

SEQ ID NO: 4891987 - DNA, 22 bp, Homo sapiens
cacctccagcccgggagcctag

SEQ ID NO: 4891988 - DNA, 13 bp, Homo sapiens
cacctccagtccc

SEQ ID NO: 4891989 - DNA, 22 bp, Homo sapiens
cacctccagtccccctatcctt

SEQ ID NO: 4891990 - DNA, 11 bp, Homo sapiens
cacctcccagg

SEQ ID NO: 4891991 - DNA, 17 bp, Homo sapiens
cacctccccacgccctc

SEQ ID NO: 4891992 - DNA, 14 bp, Homo sapiens
cacctccctgaccc

SEQ ID NO: 4891993 - DNA, 13 bp, Homo sapiens
cacctccctgccc

SEQ ID NO: 4891994 - DNA, 11 bp, Homo sapiens
cacctcctgcc

SEQ ID NO: 4891995 - DNA, 22 bp, Homo sapiens
cacctccttgtcactttattac

SEQ ID NO: 4891996 - DNA, 18 bp, Homo sapiens
cacctctacccaaaccct

SEQ ID NO: 4891997 - DNA, 21 bp, Homo sapiens
cacctctacccaaaccctagg

SEQ ID NO: 4891998 - DNA, 16 bp, Homo sapiens
cacctctctcctttgc

SEQ ID NO: 4891999 - DNA, 18 bp, Homo sapiens
cacctctggactggctag

SEQ ID NO: 4892000 - DNA, 13 bp, Homo sapiens
cacctctgtaatt

SEQ ID NO: 4892001 - DNA, 20 bp, Homo sapiens
cacctctgtggcattgaaat

SEQ ID NO: 4892002 - DNA, 20 bp, Homo sapiens
cacctcttcaccccccactc

SEQ ID NO: 4892003 - DNA, 13 bp, Homo sapiens
cacctgcccaacc

SEQ ID NO: 4892004 - DNA, 18 bp, Homo sapiens
cacctgcccaacctgctc

SEQ ID NO: 4892005 - DNA, 19 bp, Homo sapiens
cacctgcccaacctgctct

SEQ ID NO: 4892006 - DNA, 22 bp, Homo sapiens
cacctgcccatcacagggttgg

SEQ ID NO: 4892007 - DNA, 12 bp, Homo sapiens
cacctgccctgc

SEQ ID NO: 4892008 - DNA, 14 bp, Homo sapiens
cacctgcctcctcg

SEQ ID NO: 4892009 - DNA, 15 bp, Homo sapiens
cacctgcctgcgtct

SEQ ID NO: 4892010 - DNA, 18 bp, Homo sapiens
cacctgcctgttaggaga

SEQ ID NO: 4892011 - DNA, 23 bp, Homo sapiens
cacctgcctgttaggagaagctg

SEQ ID NO: 4892012 - DNA, 16 bp, Homo sapiens
cacctgggcttaagaa

SEQ ID NO: 4892013 - DNA, 17 bp, Homo sapiens
cacctgtctcagcctcc

SEQ ID NO: 4892014 - DNA, 18 bp, Homo sapiens
cacctgtctcagcctccc

SEQ ID NO: 4892015 - DNA, 20 bp, Homo sapiens
cacctgtgagtttaaagcaa

SEQ ID NO: 4892016 - DNA, 20 bp, Homo sapiens
cacctgtgggtgtagccagg

SEQ ID NO: 4892017 - DNA, 22 bp, Homo sapiens
cacctgtgggtgtagccaggta

SEQ ID NO: 4892018 - DNA, 18 bp, Homo sapiens
caccttcccttgccactt

SEQ ID NO: 4892019 - DNA, 21 bp, Homo sapiens
caccttcccttgccactttgc

SEQ ID NO: 4892020 - DNA, 13 bp, Homo sapiens
caccttgacaggg

SEQ ID NO: 4892021 - DNA, 16 bp, Homo sapiens
caccttggctgcaggg

SEQ ID NO: 4892022 - DNA, 15 bp, Homo sapiens
caccttgtgtctgta

SEQ ID NO: 4892023 - DNA, 17 bp, Homo sapiens
caccttgtgtctgtaca

SEQ ID NO: 4892024 - DNA, 15 bp, Homo sapiens
cacctttaggttctt

SEQ ID NO: 4892025 - DNA, 13 bp, Homo sapiens
cacctttgtgtat

SEQ ID NO: 4892026 - DNA, 17 bp, Homo sapiens
cacctttgtgtattttt

SEQ ID NO: 4892027 - DNA, 22 bp, Homo sapiens
cacgaatttgctggggaatctc

SEQ ID NO: 4892028 - DNA, 16 bp, Homo sapiens
cacgagaccccggctt

SEQ ID NO: 4892029 - DNA, 19 bp, Homo sapiens
cacgatcctgccaccctgt

SEQ ID NO: 4892030 - DNA, 21 bp, Homo sapiens
cacgattttctccagctcaga

SEQ ID NO: 4892031 - DNA, 13 bp, Homo sapiens
cacgcaacttgaa

SEQ ID NO: 4892032 - DNA, 12 bp, Homo sapiens
cacgcacacaca

SEQ ID NO: 4892033 - DNA, 14 bp, Homo sapiens
cacgcacacacaca

SEQ ID NO: 4892034 - DNA, 12 bp, Homo sapiens
cacgcacgcaca

SEQ ID NO: 4892035 - DNA, 16 bp, Homo sapiens
cacgcacgcacacaca

SEQ ID NO: 4892036 - DNA, 21 bp, Homo sapiens
cacgccgggaaccaagcagga

SEQ ID NO: 4892037 - DNA, 17 bp, Homo sapiens
cacgcgcgcgcacacac

SEQ ID NO: 4892038 - DNA, 15 bp, Homo sapiens
cacgcgggggccttg

SEQ ID NO: 4892039 - DNA, 21 bp, Homo sapiens
cacgcgtgcacacaccagagc

SEQ ID NO: 4892040 - DNA, 17 bp, Homo sapiens
cacgctggaccttgaac

SEQ ID NO: 4892041 - DNA, 15 bp, Homo sapiens
cacggacaataaacc

SEQ ID NO: 4892042 - DNA, 19 bp, Homo sapiens
cacggagcccagccctccc

SEQ ID NO: 4892043 - DNA, 12 bp, Homo sapiens
cacggccaggcc

SEQ ID NO: 4892044 - DNA, 13 bp, Homo sapiens
cacggccaggcca

SEQ ID NO: 4892045 - DNA, 20 bp, Homo sapiens
cacggctaagaggctgctga

SEQ ID NO: 4892046 - DNA, 16 bp, Homo sapiens
cacggctcactgcagc

SEQ ID NO: 4892047 - DNA, 17 bp, Homo sapiens
cacggtatttatagaga

SEQ ID NO: 4892048 - DNA, 23 bp, Homo sapiens
cacgtggagagctggtgcccgga

SEQ ID NO: 4892049 - DNA, 22 bp, Homo sapiens
cacgtgttttattcctgtatgt

SEQ ID NO: 4892050 - DNA, 23 bp, Homo sapiens
cacgtgttttattcctgtatgtt

SEQ ID NO: 4892051 - DNA, 22 bp, Homo sapiens
cactaaactttacccaaaaact

SEQ ID NO: 4892052 - DNA, 16 bp, Homo sapiens
cactaaagccagcctg

SEQ ID NO: 4892053 - DNA, 16 bp, Homo sapiens
cactaaagtatgtaaa

SEQ ID NO: 4892054 - DNA, 16 bp, Homo sapiens
cactaaccacgctgga

SEQ ID NO: 4892055 - DNA, 17 bp, Homo sapiens
cactaatttgatgttta

SEQ ID NO: 4892056 - DNA, 21 bp, Homo sapiens
cactaattttagtattcattc

SEQ ID NO: 4892057 - DNA, 23 bp, Homo sapiens
cactacggaatagttggctagga

SEQ ID NO: 4892058 - DNA, 12 bp, Homo sapiens
cactactgggtg

SEQ ID NO: 4892059 - DNA, 15 bp, Homo sapiens
cactactgggtgtca

SEQ ID NO: 4892060 - DNA, 17 bp, Homo sapiens
cactagaactctccatc

SEQ ID NO: 4892061 - DNA, 19 bp, Homo sapiens
cactagaatggataaaata

SEQ ID NO: 4892062 - DNA, 21 bp, Homo sapiens
cactagcctttggctctggag

SEQ ID NO: 4892063 - DNA, 22 bp, Homo sapiens
cactagcctttggctctggaga

SEQ ID NO: 4892064 - DNA, 16 bp, Homo sapiens
cactaggcacccagct

SEQ ID NO: 4892065 - DNA, 17 bp, Homo sapiens
cactaggttcaattccc

SEQ ID NO: 4892066 - DNA, 21 bp, Homo sapiens
cactagtgaccccttccctgt

SEQ ID NO: 4892067 - DNA, 14 bp, Homo sapiens
cactatagcctagg

SEQ ID NO: 4892068 - DNA, 21 bp, Homo sapiens
cactatagcctaggtgacaga

SEQ ID NO: 4892069 - DNA, 17 bp, Homo sapiens
cactatagtttaaaaca

SEQ ID NO: 4892070 - DNA, 19 bp, Homo sapiens
cactatcatagttaacata

SEQ ID NO: 4892071 - DNA, 15 bp, Homo sapiens
cactatgttgcccag

SEQ ID NO: 4892072 - DNA, 19 bp, Homo sapiens
cactatgttgcccaggcag

SEQ ID NO: 4892073 - DNA, 21 bp, Homo sapiens
cactatgttgcccaggcaggt

SEQ ID NO: 4892074 - DNA, 12 bp, Homo sapiens
cactattttaga

SEQ ID NO: 4892075 - DNA, 14 bp, Homo sapiens
cactcaagcactga

SEQ ID NO: 4892076 - DNA, 18 bp, Homo sapiens
cactcaccagtgtcccct

SEQ ID NO: 4892077 - DNA, 14 bp, Homo sapiens
cactcaccatgaag

SEQ ID NO: 4892078 - DNA, 16 bp, Homo sapiens
cactcagcccctagga

SEQ ID NO: 4892079 - DNA, 18 bp, Homo sapiens
cactcagcccctaggagt

SEQ ID NO: 4892080 - DNA, 16 bp, Homo sapiens
cactcagtttatgctg

SEQ ID NO: 4892081 - DNA, 15 bp, Homo sapiens
cactcattcctgtag

SEQ ID NO: 4892082 - DNA, 22 bp, Homo sapiens
cactcattttctataacagata

SEQ ID NO: 4892083 - DNA, 14 bp, Homo sapiens
cactccagacccct

SEQ ID NO: 4892084 - DNA, 15 bp, Homo sapiens
cactccattcccaac

SEQ ID NO: 4892085 - DNA, 13 bp, Homo sapiens
cactccccaagga

SEQ ID NO: 4892086 - DNA, 14 bp, Homo sapiens
cactccccaaggaa

SEQ ID NO: 4892087 - DNA, 21 bp, Homo sapiens
cactcctagagaacgcagccc

SEQ ID NO: 4892088 - DNA, 16 bp, Homo sapiens
cactcgcttcccccat

SEQ ID NO: 4892089 - DNA, 22 bp, Homo sapiens
cactcggcatttcaaatgtgct

SEQ ID NO: 4892090 - DNA, 15 bp, Homo sapiens
cactctaccctccca

SEQ ID NO: 4892091 - DNA, 16 bp, Homo sapiens
cactctaccctcccac

SEQ ID NO: 4892092 - DNA, 15 bp, Homo sapiens
cactctccccacact

SEQ ID NO: 4892093 - DNA, 14 bp, Homo sapiens
cactctctggaagc

SEQ ID NO: 4892094 - DNA, 20 bp, Homo sapiens
cactctgacgcaaaaccact

SEQ ID NO: 4892095 - DNA, 16 bp, Homo sapiens
cactctgccagcaaag

SEQ ID NO: 4892096 - DNA, 17 bp, Homo sapiens
cactctgccagcaaaga

SEQ ID NO: 4892097 - DNA, 13 bp, Homo sapiens
cactctgccaggg

SEQ ID NO: 4892098 - DNA, 15 bp, Homo sapiens
cactctgccagggca

SEQ ID NO: 4892099 - DNA, 13 bp, Homo sapiens
cactctggcctca

SEQ ID NO: 4892100 - DNA, 16 bp, Homo sapiens
cactctgtcgcccagt

SEQ ID NO: 4892101 - DNA, 20 bp, Homo sapiens
cactctgttatttagactca

SEQ ID NO: 4892102 - DNA, 21 bp, Homo sapiens
cactcttattgcccacgctgg

SEQ ID NO: 4892103 - DNA, 22 bp, Homo sapiens
cactcttattgcccacgctgga

SEQ ID NO: 4892104 - DNA, 11 bp, Homo sapiens
cactgaaaaat

SEQ ID NO: 4892105 - DNA, 22 bp, Homo sapiens
cactgaaaataccatcaggcct

SEQ ID NO: 4892106 - DNA, 17 bp, Homo sapiens
cactgaagcctgcgttg

SEQ ID NO: 4892107 - DNA, 15 bp, Homo sapiens
cactgaatttataaa

SEQ ID NO: 4892108 - DNA, 19 bp, Homo sapiens
cactgaatttataaagtac

SEQ ID NO: 4892109 - DNA, 15 bp, Homo sapiens
cactgacagcctccc

SEQ ID NO: 4892110 - DNA, 16 bp, Homo sapiens
cactgacagcctccca

SEQ ID NO: 4892111 - DNA, 14 bp, Homo sapiens
cactgacccttcca

SEQ ID NO: 4892112 - DNA, 20 bp, Homo sapiens
cactgaccttggagagacac

SEQ ID NO: 4892113 - DNA, 22 bp, Homo sapiens
cactgaccttggagagacacag

SEQ ID NO: 4892114 - DNA, 15 bp, Homo sapiens
cactgactactggct

SEQ ID NO: 4892115 - DNA, 19 bp, Homo sapiens
cactgactactggctctca

SEQ ID NO: 4892116 - DNA, 18 bp, Homo sapiens
cactgatatattttccag

SEQ ID NO: 4892117 - DNA, 23 bp, Homo sapiens
cactgatgctgttctcttcttca

SEQ ID NO: 4892118 - DNA, 14 bp, Homo sapiens
cactgcaacctccg

SEQ ID NO: 4892119 - DNA, 23 bp, Homo sapiens
cactgcaacctccgcctcttggg

SEQ ID NO: 4892120 - DNA, 21 bp, Homo sapiens
cactgcactcaaccttaagac

SEQ ID NO: 4892121 - DNA, 14 bp, Homo sapiens
cactgcagcctcaa

SEQ ID NO: 4892122 - DNA, 18 bp, Homo sapiens
cactgcatgagcttttat

SEQ ID NO: 4892123 - DNA, 12 bp, Homo sapiens
cactgccactgg

SEQ ID NO: 4892124 - DNA, 17 bp, Homo sapiens
cactgccatctgatgcc

SEQ ID NO: 4892125 - DNA, 16 bp, Homo sapiens
cactgccatcttagtt

SEQ ID NO: 4892126 - DNA, 15 bp, Homo sapiens
cactgcccgcacacc

SEQ ID NO: 4892127 - DNA, 13 bp, Homo sapiens
cactgcctctgcc

SEQ ID NO: 4892128 - DNA, 15 bp, Homo sapiens
cactgcctctggaat

SEQ ID NO: 4892129 - DNA, 16 bp, Homo sapiens
cactgcctcttcctcc

SEQ ID NO: 4892130 - DNA, 11 bp, Homo sapiens
cactgcctggg

SEQ ID NO: 4892131 - DNA, 15 bp, Homo sapiens
cactgcctgggctga

SEQ ID NO: 4892132 - DNA, 16 bp, Homo sapiens
cactgcctgtatactt

SEQ ID NO: 4892133 - DNA, 17 bp, Homo sapiens
cactgcctgtatacttt

SEQ ID NO: 4892134 - DNA, 23 bp, Homo sapiens
cactgcctgtatactttagtatg

SEQ ID NO: 4892135 - DNA, 22 bp, Homo sapiens
cactgctccctaagccagcctg

SEQ ID NO: 4892136 - DNA, 23 bp, Homo sapiens
cactgctccctaagccagcctgg

SEQ ID NO: 4892137 - DNA, 18 bp, Homo sapiens
cactgctccctgaagcca

SEQ ID NO: 4892138 - DNA, 20 bp, Homo sapiens
cactgctccctgaagccagc

SEQ ID NO: 4892139 - DNA, 22 bp, Homo sapiens
cactgctccctgaagccagcct

SEQ ID NO: 4892140 - DNA, 13 bp, Homo sapiens
cactgctgcagta

SEQ ID NO: 4892141 - DNA, 15 bp, Homo sapiens
cactgctgcccagcc

SEQ ID NO: 4892142 - DNA, 21 bp, Homo sapiens
cactgctggctgccttagaac

SEQ ID NO: 4892143 - DNA, 21 bp, Homo sapiens
cactgcttttggtctgtgtga

SEQ ID NO: 4892144 - DNA, 16 bp, Homo sapiens
cactggaccactgggc

SEQ ID NO: 4892145 - DNA, 13 bp, Homo sapiens
cactggcccctca

SEQ ID NO: 4892146 - DNA, 16 bp, Homo sapiens
cactggctaaagataa

SEQ ID NO: 4892147 - DNA, 22 bp, Homo sapiens
cactgggatgagccgctgtgag

SEQ ID NO: 4892148 - DNA, 20 bp, Homo sapiens
cactgggccaattcaataca

SEQ ID NO: 4892149 - DNA, 22 bp, Homo sapiens
cactggggagcccgtctcagtg

SEQ ID NO: 4892150 - DNA, 16 bp, Homo sapiens
cactggggcctacagc

SEQ ID NO: 4892151 - DNA, 13 bp, Homo sapiens
cactggtggcccg

SEQ ID NO: 4892152 - DNA, 22 bp, Homo sapiens
cactggtggcccgacagcctgg

SEQ ID NO: 4892153 - DNA, 19 bp, Homo sapiens
cactggtgtgacctgaggg

SEQ ID NO: 4892154 - DNA, 20 bp, Homo sapiens
cactggtgtgacctgagggc

SEQ ID NO: 4892155 - DNA, 22 bp, Homo sapiens
cactgtaagactcattccctag

SEQ ID NO: 4892156 - DNA, 15 bp, Homo sapiens
cactgtagttctaag

SEQ ID NO: 4892157 - DNA, 16 bp, Homo sapiens
cactgtagttctaaga

SEQ ID NO: 4892158 - DNA, 13 bp, Homo sapiens
cactgtataaata

SEQ ID NO: 4892159 - DNA, 16 bp, Homo sapiens
cactgtataaatagga

SEQ ID NO: 4892160 - DNA, 20 bp, Homo sapiens
cactgtcaccctccacctct

SEQ ID NO: 4892161 - DNA, 16 bp, Homo sapiens
cactgtgccatgtgcc

SEQ ID NO: 4892162 - DNA, 18 bp, Homo sapiens
cactgtgccatgtgccag

SEQ ID NO: 4892163 - DNA, 21 bp, Homo sapiens
cactgtgcctttgcaaatcag

SEQ ID NO: 4892164 - DNA, 22 bp, Homo sapiens
cactgtgcctttgcaaatcagt

SEQ ID NO: 4892165 - DNA, 14 bp, Homo sapiens
cactgtgctataaa

SEQ ID NO: 4892166 - DNA, 19 bp, Homo sapiens
cactgtggaactaataaat

SEQ ID NO: 4892167 - DNA, 13 bp, Homo sapiens
cactgtggtggca

SEQ ID NO: 4892168 - DNA, 23 bp, Homo sapiens
cactgttactttcgtacattggc

SEQ ID NO: 4892169 - DNA, 22 bp, Homo sapiens
cactgttagctttttaaaacat

SEQ ID NO: 4892170 - DNA, 13 bp, Homo sapiens
cactgttgaattt

SEQ ID NO: 4892171 - DNA, 16 bp, Homo sapiens
cactgttgatgtatct

SEQ ID NO: 4892172 - DNA, 15 bp, Homo sapiens
cactgttgcccaggc

SEQ ID NO: 4892173 - DNA, 19 bp, Homo sapiens
cactgttgcccaggctggc

SEQ ID NO: 4892174 - DNA, 17 bp, Homo sapiens
cactgtttctcttgagc

SEQ ID NO: 4892175 - DNA, 15 bp, Homo sapiens
cactgtttcttgctt

SEQ ID NO: 4892176 - DNA, 18 bp, Homo sapiens
cactgtttcttgcttgta

SEQ ID NO: 4892177 - DNA, 13 bp, Homo sapiens
cacttacatatat

SEQ ID NO: 4892178 - DNA, 17 bp, Homo sapiens
cacttagaaattgcatt

SEQ ID NO: 4892179 - DNA, 24 bp, Homo sapiens
cacttagaaattgcatttcctgac

SEQ ID NO: 4892180 - DNA, 14 bp, Homo sapiens
cacttcaggctctt

SEQ ID NO: 4892181 - DNA, 15 bp, Homo sapiens
cacttcaggctcttc

SEQ ID NO: 4892182 - DNA, 23 bp, Homo sapiens
cacttcaggctcttctcctttca

SEQ ID NO: 4892183 - DNA, 22 bp, Homo sapiens
cacttcattgagagttttgtct

SEQ ID NO: 4892184 - DNA, 17 bp, Homo sapiens
cacttccaggggaacct

SEQ ID NO: 4892185 - DNA, 20 bp, Homo sapiens
cacttccataatctggactc

SEQ ID NO: 4892186 - DNA, 17 bp, Homo sapiens
cacttcctacaagagca

SEQ ID NO: 4892187 - DNA, 17 bp, Homo sapiens
cacttcctgttttataa

SEQ ID NO: 4892188 - DNA, 23 bp, Homo sapiens
cacttcgggctgtgtaaacacag

SEQ ID NO: 4892189 - DNA, 22 bp, Homo sapiens
cacttctgtgagacccccacac

SEQ ID NO: 4892190 - DNA, 16 bp, Homo sapiens
cacttcttcctttctc

SEQ ID NO: 4892191 - DNA, 13 bp, Homo sapiens
cacttgcagactc

SEQ ID NO: 4892192 - DNA, 12 bp, Homo sapiens
cacttgcctggg

SEQ ID NO: 4892193 - DNA, 12 bp, Homo sapiens
cacttgtacaaa

SEQ ID NO: 4892194 - DNA, 23 bp, Homo sapiens
cacttgtaggataagtgaaatgg

SEQ ID NO: 4892195 - DNA, 12 bp, Homo sapiens
cacttgtataaa

SEQ ID NO: 4892196 - DNA, 20 bp, Homo sapiens
cacttgtcactgacacaaag

SEQ ID NO: 4892197 - DNA, 22 bp, Homo sapiens
cacttgtcactgacacaaagga

SEQ ID NO: 4892198 - DNA, 19 bp, Homo sapiens
cacttgtctcattttaatg

SEQ ID NO: 4892199 - DNA, 17 bp, Homo sapiens
cacttgtgattatttat

SEQ ID NO: 4892200 - DNA, 16 bp, Homo sapiens
cacttgtgctttgctc

SEQ ID NO: 4892201 - DNA, 18 bp, Homo sapiens
cactttataagtcattgt

SEQ ID NO: 4892202 - DNA, 12 bp, Homo sapiens
cactttccactt

SEQ ID NO: 4892203 - DNA, 22 bp, Homo sapiens
cactttccacttcttcctttct

SEQ ID NO: 4892204 - DNA, 15 bp, Homo sapiens
cactttgaaatacct

SEQ ID NO: 4892205 - DNA, 18 bp, Homo sapiens
cactttgaaatacctcat

SEQ ID NO: 4892206 - DNA, 21 bp, Homo sapiens
cactttgaaatacctcatgtt

SEQ ID NO: 4892207 - DNA, 22 bp, Homo sapiens
cactttgaaatacctcatgttt

SEQ ID NO: 4892208 - DNA, 13 bp, Homo sapiens
cactttgcacatt

SEQ ID NO: 4892209 - DNA, 14 bp, Homo sapiens
cactttgcacattt

SEQ ID NO: 4892210 - DNA, 20 bp, Homo sapiens
cactttgcacgacgccctct

SEQ ID NO: 4892211 - DNA, 13 bp, Homo sapiens
cactttgcctcct

SEQ ID NO: 4892212 - DNA, 20 bp, Homo sapiens
cactttgtcgcccaggctgg

SEQ ID NO: 4892213 - DNA, 19 bp, Homo sapiens
cactttttattagataacg

SEQ ID NO: 4892214 - DNA, 20 bp, Homo sapiens
cagaaaactttaaaaaatat

SEQ ID NO: 4892215 - DNA, 12 bp, Homo sapiens
cagaaaagcata

SEQ ID NO: 4892216 - DNA, 18 bp, Homo sapiens
cagaaaagggaagttgtg

SEQ ID NO: 4892217 - DNA, 18 bp, Homo sapiens
cagaaaatgttgagaatc

SEQ ID NO: 4892218 - DNA, 12 bp, Homo sapiens
cagaaacactgc

SEQ ID NO: 4892219 - DNA, 18 bp, Homo sapiens
cagaaacactgccttttt

SEQ ID NO: 4892220 - DNA, 15 bp, Homo sapiens
cagaaaggaaaacct

SEQ ID NO: 4892221 - DNA, 12 bp, Homo sapiens
cagaaaggagac

SEQ ID NO: 4892222 - DNA, 16 bp, Homo sapiens
cagaaaggttctgccc

SEQ ID NO: 4892223 - DNA, 21 bp, Homo sapiens
cagaaatataataaaatgtgt

SEQ ID NO: 4892224 - DNA, 16 bp, Homo sapiens
cagaaatatatataca

SEQ ID NO: 4892225 - DNA, 17 bp, Homo sapiens
cagaaatatatatacat

SEQ ID NO: 4892226 - DNA, 18 bp, Homo sapiens
cagaaatatatatacata

SEQ ID NO: 4892227 - DNA, 20 bp, Homo sapiens
cagaaatatatatacatatg

SEQ ID NO: 4892228 - DNA, 11 bp, Homo sapiens
cagaaatgtct

SEQ ID NO: 4892229 - DNA, 15 bp, Homo sapiens
cagaacagcttcagg

SEQ ID NO: 4892230 - DNA, 19 bp, Homo sapiens
cagaacagcttcaggttat

SEQ ID NO: 4892231 - DNA, 17 bp, Homo sapiens
cagaacatcattagaac

SEQ ID NO: 4892232 - DNA, 18 bp, Homo sapiens
cagaacatcattagaaca

SEQ ID NO: 4892233 - DNA, 12 bp, Homo sapiens
cagaacccaggg

SEQ ID NO: 4892234 - DNA, 15 bp, Homo sapiens
cagaacccagggctc

SEQ ID NO: 4892235 - DNA, 18 bp, Homo sapiens
cagaacccagggctctgc

SEQ ID NO: 4892236 - DNA, 14 bp, Homo sapiens
cagaacctcttccc

SEQ ID NO: 4892237 - DNA, 16 bp, Homo sapiens
cagaacctcttcccca

SEQ ID NO: 4892238 - DNA, 17 bp, Homo sapiens
cagaactaaatgttcta

SEQ ID NO: 4892239 - DNA, 18 bp, Homo sapiens
cagaactaaatgttctat

SEQ ID NO: 4892240 - DNA, 11 bp, Homo sapiens
cagaactgcca

SEQ ID NO: 4892241 - DNA, 14 bp, Homo sapiens
cagaactgccatta

SEQ ID NO: 4892242 - DNA, 19 bp, Homo sapiens
cagaactgccattattttc

SEQ ID NO: 4892243 - DNA, 21 bp, Homo sapiens
cagaactgccattattttctg

SEQ ID NO: 4892244 - DNA, 14 bp, Homo sapiens
cagaacttccctga

SEQ ID NO: 4892245 - DNA, 15 bp, Homo sapiens
cagaacttgaatgtg

SEQ ID NO: 4892246 - DNA, 18 bp, Homo sapiens
cagaagaagagaagctgc

SEQ ID NO: 4892247 - DNA, 20 bp, Homo sapiens
cagaagaagagaagctgctg

SEQ ID NO: 4892248 - DNA, 21 bp, Homo sapiens
cagaagaagagaagctgctga

SEQ ID NO: 4892249 - DNA, 17 bp, Homo sapiens
cagaagacaccagagca

SEQ ID NO: 4892250 - DNA, 21 bp, Homo sapiens
cagaagacactgatgggcaac

SEQ ID NO: 4892251 - DNA, 15 bp, Homo sapiens
cagaagatcccctca

SEQ ID NO: 4892252 - DNA, 13 bp, Homo sapiens
cagaagcatttgt

SEQ ID NO: 4892253 - DNA, 16 bp, Homo sapiens
cagaagcttctgccca

SEQ ID NO: 4892254 - DNA, 18 bp, Homo sapiens
cagaaggattttttaaag

SEQ ID NO: 4892255 - DNA, 17 bp, Homo sapiens
cagaagtcatgaagccc

SEQ ID NO: 4892256 - DNA, 13 bp, Homo sapiens
cagaagtgaaaat

SEQ ID NO: 4892257 - DNA, 19 bp, Homo sapiens
cagaagtttctcagctccc

SEQ ID NO: 4892258 - DNA, 20 bp, Homo sapiens
cagaataaggcaggcattga

SEQ ID NO: 4892259 - DNA, 17 bp, Homo sapiens
cagaataatctttgggt

SEQ ID NO: 4892260 - DNA, 18 bp, Homo sapiens
cagaatcagcacagataa

SEQ ID NO: 4892261 - DNA, 18 bp, Homo sapiens
cagaatcccagccggcca

SEQ ID NO: 4892262 - DNA, 12 bp, Homo sapiens
cagaatgtatct

SEQ ID NO: 4892263 - DNA, 17 bp, Homo sapiens
cagaatgtttttaaaat

SEQ ID NO: 4892264 - DNA, 23 bp, Homo sapiens
cagaattttaggaacttcagaga

SEQ ID NO: 4892265 - DNA, 22 bp, Homo sapiens
cagacaaatgtggttacacact

SEQ ID NO: 4892266 - DNA, 17 bp, Homo sapiens
cagacaacagaagtcat

SEQ ID NO: 4892267 - DNA, 17 bp, Homo sapiens
cagacaaggaaataccc

SEQ ID NO: 4892268 - DNA, 11 bp, Homo sapiens
cagacacacac

SEQ ID NO: 4892269 - DNA, 12 bp, Homo sapiens
cagacacacaca

SEQ ID NO: 4892270 - DNA, 15 bp, Homo sapiens
cagacacacacacgc

SEQ ID NO: 4892271 - DNA, 16 bp, Homo sapiens
cagacacacacacgca

SEQ ID NO: 4892272 - DNA, 17 bp, Homo sapiens
cagacacacacacgcac

SEQ ID NO: 4892273 - DNA, 18 bp, Homo sapiens
cagacacaggcccggctc

SEQ ID NO: 4892274 - DNA, 15 bp, Homo sapiens
cagacaccctcaacc

SEQ ID NO: 4892275 - DNA, 23 bp, Homo sapiens
cagacagaacttgaatgtgtcag

SEQ ID NO: 4892276 - DNA, 17 bp, Homo sapiens
cagacagaagtctcctc

SEQ ID NO: 4892277 - DNA, 18 bp, Homo sapiens
cagacagaagtctcctca

SEQ ID NO: 4892278 - DNA, 14 bp, Homo sapiens
cagacagacacaca

SEQ ID NO: 4892279 - DNA, 19 bp, Homo sapiens
cagacagacatctctgcac

SEQ ID NO: 4892280 - DNA, 23 bp, Homo sapiens
cagacaggcaagcacctcctgcc

SEQ ID NO: 4892281 - DNA, 16 bp, Homo sapiens
cagacaggtccctccc

SEQ ID NO: 4892282 - DNA, 22 bp, Homo sapiens
cagacataaagccatgtttcct

SEQ ID NO: 4892283 - DNA, 18 bp, Homo sapiens
cagacatacgaaacacaa

SEQ ID NO: 4892284 - DNA, 13 bp, Homo sapiens
cagacccctggct

SEQ ID NO: 4892285 - DNA, 14 bp, Homo sapiens
cagacccctggctt

SEQ ID NO: 4892286 - DNA, 22 bp, Homo sapiens
cagacccctggcttttcactgc

SEQ ID NO: 4892287 - DNA, 12 bp, Homo sapiens
cagacctcccca

SEQ ID NO: 4892288 - DNA, 18 bp, Homo sapiens
cagacctccccagcccct

SEQ ID NO: 4892289 - DNA, 19 bp, Homo sapiens
cagacctccccagccccta

SEQ ID NO: 4892290 - DNA, 23 bp, Homo sapiens
cagacctccccagcccctagccc

SEQ ID NO: 4892291 - DNA, 20 bp, Homo sapiens
cagacctgctttttgaaatg

SEQ ID NO: 4892292 - DNA, 23 bp, Homo sapiens
cagacgccggggacagaggcctg

SEQ ID NO: 4892293 - DNA, 14 bp, Homo sapiens
cagactacacagga

SEQ ID NO: 4892294 - DNA, 16 bp, Homo sapiens
cagactacacaggatg

SEQ ID NO: 4892295 - DNA, 18 bp, Homo sapiens
cagactgcgatttgtccc

SEQ ID NO: 4892296 - DNA, 13 bp, Homo sapiens
cagactgctagtg

SEQ ID NO: 4892297 - DNA, 13 bp, Homo sapiens
cagactggaagca

SEQ ID NO: 4892298 - DNA, 16 bp, Homo sapiens
cagactggaagcacag

SEQ ID NO: 4892299 - DNA, 18 bp, Homo sapiens
cagactggaagcacagct

SEQ ID NO: 4892300 - DNA, 14 bp, Homo sapiens
cagacttggctcag

SEQ ID NO: 4892301 - DNA, 24 bp, Homo sapiens
cagagaacagcgaagtagcttgct

SEQ ID NO: 4892302 - DNA, 13 bp, Homo sapiens
cagagaagctggg

SEQ ID NO: 4892303 - DNA, 15 bp, Homo sapiens
cagagaagctgggga

SEQ ID NO: 4892304 - DNA, 21 bp, Homo sapiens
cagagaagctggggaggagct

SEQ ID NO: 4892305 - DNA, 18 bp, Homo sapiens
cagagaagggcataaaac

SEQ ID NO: 4892306 - DNA, 20 bp, Homo sapiens
cagagaagggctcctgcagg

SEQ ID NO: 4892307 - DNA, 19 bp, Homo sapiens
cagagaatcatacttagca

SEQ ID NO: 4892308 - DNA, 19 bp, Homo sapiens
cagagaatgaaagggccca

SEQ ID NO: 4892309 - DNA, 15 bp, Homo sapiens
cagagaatttctacc

SEQ ID NO: 4892310 - DNA, 22 bp, Homo sapiens
cagagaatttctaccatttcag

SEQ ID NO: 4892311 - DNA, 14 bp, Homo sapiens
cagagacagctgat

SEQ ID NO: 4892312 - DNA, 21 bp, Homo sapiens
cagagacagctgatacttcat

SEQ ID NO: 4892313 - DNA, 18 bp, Homo sapiens
cagagaccgtcctcaccc

SEQ ID NO: 4892314 - DNA, 19 bp, Homo sapiens
cagagaccgtcctcacccc

SEQ ID NO: 4892315 - DNA, 17 bp, Homo sapiens
cagagagagagaaagag

SEQ ID NO: 4892316 - DNA, 23 bp, Homo sapiens
cagagagccattttgtgaatgga

SEQ ID NO: 4892317 - DNA, 18 bp, Homo sapiens
cagagagcggtctcaggc

SEQ ID NO: 4892318 - DNA, 21 bp, Homo sapiens
cagagagcggtctcaggctgg

SEQ ID NO: 4892319 - DNA, 20 bp, Homo sapiens
cagagagcttagcctggagc

SEQ ID NO: 4892320 - DNA, 17 bp, Homo sapiens
cagagagggtggtgacc

SEQ ID NO: 4892321 - DNA, 16 bp, Homo sapiens
cagagattgcttctca

SEQ ID NO: 4892322 - DNA, 14 bp, Homo sapiens
cagagcaaaataat

SEQ ID NO: 4892323 - DNA, 16 bp, Homo sapiens
cagagcaacgaccagg

SEQ ID NO: 4892324 - DNA, 18 bp, Homo sapiens
cagagcaagatcctgtct

SEQ ID NO: 4892325 - DNA, 21 bp, Homo sapiens
cagagcactaggttcaattcc

SEQ ID NO: 4892326 - DNA, 16 bp, Homo sapiens
cagagcagatgcagag

SEQ ID NO: 4892327 - DNA, 19 bp, Homo sapiens
cagagcagatgcagagagc

SEQ ID NO: 4892328 - DNA, 13 bp, Homo sapiens
cagagcaggcaat

SEQ ID NO: 4892329 - DNA, 15 bp, Homo sapiens
cagagcatttaagag

SEQ ID NO: 4892330 - DNA, 22 bp, Homo sapiens
cagagccacccctaaagagata

SEQ ID NO: 4892331 - DNA, 15 bp, Homo sapiens
cagagcccaccttgg

SEQ ID NO: 4892332 - DNA, 22 bp, Homo sapiens
cagagctaagggtgggtgctca

SEQ ID NO: 4892333 - DNA, 23 bp, Homo sapiens
cagagctggaccagtggtgcctt

SEQ ID NO: 4892334 - DNA, 20 bp, Homo sapiens
cagagctgggaggcatggcc

SEQ ID NO: 4892335 - DNA, 12 bp, Homo sapiens
cagagctgtgga

SEQ ID NO: 4892336 - DNA, 19 bp, Homo sapiens
cagagctgtttatggcctc

SEQ ID NO: 4892337 - DNA, 21 bp, Homo sapiens
cagagctgtttatggcctcag

SEQ ID NO: 4892338 - DNA, 23 bp, Homo sapiens
cagaggaaacaatatttataaag

SEQ ID NO: 4892339 - DNA, 14 bp, Homo sapiens
cagaggaaatctgt

SEQ ID NO: 4892340 - DNA, 17 bp, Homo sapiens
cagaggaactgtccaga

SEQ ID NO: 4892341 - DNA, 19 bp, Homo sapiens
cagaggaactgtccagaga

SEQ ID NO: 4892342 - DNA, 18 bp, Homo sapiens
cagaggaatcctggcagc

SEQ ID NO: 4892343 - DNA, 23 bp, Homo sapiens
cagaggaatcctggcagcccaga

SEQ ID NO: 4892344 - DNA, 20 bp, Homo sapiens
cagaggacctgtatttaagc

SEQ ID NO: 4892345 - DNA, 12 bp, Homo sapiens
cagaggcagccc

SEQ ID NO: 4892346 - DNA, 18 bp, Homo sapiens
cagaggcagccccattct

SEQ ID NO: 4892347 - DNA, 20 bp, Homo sapiens
cagaggctattattttcact

SEQ ID NO: 4892348 - DNA, 14 bp, Homo sapiens
cagagggagtgaca

SEQ ID NO: 4892349 - DNA, 19 bp, Homo sapiens
cagagggagtgacagaggc

SEQ ID NO: 4892350 - DNA, 14 bp, Homo sapiens
cagaggggactctg

SEQ ID NO: 4892351 - DNA, 17 bp, Homo sapiens
cagagggggactgctgc

SEQ ID NO: 4892352 - DNA, 17 bp, Homo sapiens
cagaggtaacagaacag

SEQ ID NO: 4892353 - DNA, 18 bp, Homo sapiens
cagaggtaacagaacagc

SEQ ID NO: 4892354 - DNA, 20 bp, Homo sapiens
cagaggtaacagaacagctt

SEQ ID NO: 4892355 - DNA, 22 bp, Homo sapiens
cagaggtaacagaacagcttca

SEQ ID NO: 4892356 - DNA, 14 bp, Homo sapiens
cagaggtccagccc

SEQ ID NO: 4892357 - DNA, 16 bp, Homo sapiens
cagaggtccagcccat

SEQ ID NO: 4892358 - DNA, 17 bp, Homo sapiens
cagaggtggccagagct

SEQ ID NO: 4892359 - DNA, 19 bp, Homo sapiens
cagaggtggccagagctgg

SEQ ID NO: 4892360 - DNA, 13 bp, Homo sapiens
cagagtagaaata

SEQ ID NO: 4892361 - DNA, 13 bp, Homo sapiens
cagagtatgaaca

SEQ ID NO: 4892362 - DNA, 20 bp, Homo sapiens
cagagtatttgaaaaatgta

SEQ ID NO: 4892363 - DNA, 16 bp, Homo sapiens
cagagtccttaaaatg

SEQ ID NO: 4892364 - DNA, 16 bp, Homo sapiens
cagagtgagactctgt

SEQ ID NO: 4892365 - DNA, 18 bp, Homo sapiens
cagagtgagactctgtct

SEQ ID NO: 4892366 - DNA, 15 bp, Homo sapiens
cagagtgcttttctg

SEQ ID NO: 4892367 - DNA, 13 bp, Homo sapiens
cagagtggcctgg

SEQ ID NO: 4892368 - DNA, 15 bp, Homo sapiens
cagagtggcctggcc

SEQ ID NO: 4892369 - DNA, 21 bp, Homo sapiens
cagagtggcctggccaggagc

SEQ ID NO: 4892370 - DNA, 22 bp, Homo sapiens
cagagtggcctggccaggagct

SEQ ID NO: 4892371 - DNA, 19 bp, Homo sapiens
cagataatcagcctcttaa

SEQ ID NO: 4892372 - DNA, 15 bp, Homo sapiens
cagatacatcactgc

SEQ ID NO: 4892373 - DNA, 15 bp, Homo sapiens
cagatacatttccct

SEQ ID NO: 4892374 - DNA, 21 bp, Homo sapiens
cagataccatactcatttcta

SEQ ID NO: 4892375 - DNA, 15 bp, Homo sapiens
cagatacctcaccct

SEQ ID NO: 4892376 - DNA, 15 bp, Homo sapiens
cagatcactgccaca

SEQ ID NO: 4892377 - DNA, 18 bp, Homo sapiens
cagatctttctccttgaa

SEQ ID NO: 4892378 - DNA, 17 bp, Homo sapiens
cagatgaaaatttgaga

SEQ ID NO: 4892379 - DNA, 12 bp, Homo sapiens
cagatgaataaa

SEQ ID NO: 4892380 - DNA, 15 bp, Homo sapiens
cagatgaatgtattt

SEQ ID NO: 4892381 - DNA, 19 bp, Homo sapiens
cagatgagaacaaagctgt

SEQ ID NO: 4892382 - DNA, 19 bp, Homo sapiens
cagatgatgagaatttcta

SEQ ID NO: 4892383 - DNA, 22 bp, Homo sapiens
cagatgatgagaatttctaaaa

SEQ ID NO: 4892384 - DNA, 20 bp, Homo sapiens
cagatgcagagagccatttt

SEQ ID NO: 4892385 - DNA, 18 bp, Homo sapiens
cagatgccaccctagcca

SEQ ID NO: 4892386 - DNA, 20 bp, Homo sapiens
cagatgccaccctagccaat

SEQ ID NO: 4892387 - DNA, 16 bp, Homo sapiens
cagatgccccagagct

SEQ ID NO: 4892388 - DNA, 18 bp, Homo sapiens
cagatgccccagagctgt

SEQ ID NO: 4892389 - DNA, 15 bp, Homo sapiens
cagatgctccaagat

SEQ ID NO: 4892390 - DNA, 20 bp, Homo sapiens
cagatgctccaagattctag

SEQ ID NO: 4892391 - DNA, 22 bp, Homo sapiens
cagatgctccaagattctagat

SEQ ID NO: 4892392 - DNA, 13 bp, Homo sapiens
cagatggcccgga

SEQ ID NO: 4892393 - DNA, 22 bp, Homo sapiens
cagatgggaggaaagagagcag

SEQ ID NO: 4892394 - DNA, 23 bp, Homo sapiens
cagatgggaggaaagagagcagg

SEQ ID NO: 4892395 - DNA, 22 bp, Homo sapiens
cagatgtcccttgatgcacaga

SEQ ID NO: 4892396 - DNA, 16 bp, Homo sapiens
cagatgtgactgtata

SEQ ID NO: 4892397 - DNA, 14 bp, Homo sapiens
cagatgtttccaga

SEQ ID NO: 4892398 - DNA, 16 bp, Homo sapiens
cagatgtttccagact

SEQ ID NO: 4892399 - DNA, 16 bp, Homo sapiens
cagattcagtcttgcc

SEQ ID NO: 4892400 - DNA, 17 bp, Homo sapiens
cagattcccagagcaaa

SEQ ID NO: 4892401 - DNA, 17 bp, Homo sapiens
cagattgcaacaggctg

SEQ ID NO: 4892402 - DNA, 13 bp, Homo sapiens
cagattgtttcct

SEQ ID NO: 4892403 - DNA, 13 bp, Homo sapiens
cagatttaataca

SEQ ID NO: 4892404 - DNA, 20 bp, Homo sapiens
cagatttgctaatttatcct

SEQ ID NO: 4892405 - DNA, 18 bp, Homo sapiens
cagattttaattgtcatg

SEQ ID NO: 4892406 - DNA, 19 bp, Homo sapiens
cagattttaattgtcatgg

SEQ ID NO: 4892407 - DNA, 12 bp, Homo sapiens
cagattttgata

SEQ ID NO: 4892408 - DNA, 23 bp, Homo sapiens
cagattttggggttgtgttgtca

SEQ ID NO: 4892409 - DNA, 18 bp, Homo sapiens
cagcaaaaatataaaata

SEQ ID NO: 4892410 - DNA, 12 bp, Homo sapiens
cagcaaaccatt

SEQ ID NO: 4892411 - DNA, 16 bp, Homo sapiens
cagcaacacagcctgg

SEQ ID NO: 4892412 - DNA, 16 bp, Homo sapiens
cagcaagaataaaaaa

SEQ ID NO: 4892413 - DNA, 19 bp, Homo sapiens
cagcaagccctacagagct

SEQ ID NO: 4892414 - DNA, 12 bp, Homo sapiens
cagcaaggccct

SEQ ID NO: 4892415 - DNA, 12 bp, Homo sapiens
cagcaagtgaga

SEQ ID NO: 4892416 - DNA, 20 bp, Homo sapiens
cagcaatgacatctcagggg

SEQ ID NO: 4892417 - DNA, 14 bp, Homo sapiens
cagcaatttaaatg

SEQ ID NO: 4892418 - DNA, 16 bp, Homo sapiens
cagcaatttaaatgtt

SEQ ID NO: 4892419 - DNA, 21 bp, Homo sapiens
cagcacagataaaaagtggaa

SEQ ID NO: 4892420 - DNA, 15 bp, Homo sapiens
cagcacagctccctg

SEQ ID NO: 4892421 - DNA, 16 bp, Homo sapiens
cagcacagctccctgc

SEQ ID NO: 4892422 - DNA, 20 bp, Homo sapiens
cagcacatgctggccagcct

SEQ ID NO: 4892423 - DNA, 22 bp, Homo sapiens
cagcacatgctggccagcctgg

SEQ ID NO: 4892424 - DNA, 13 bp, Homo sapiens
cagcaccacccta

SEQ ID NO: 4892425 - DNA, 19 bp, Homo sapiens
cagcacggacaataaacct

SEQ ID NO: 4892426 - DNA, 16 bp, Homo sapiens
cagcactactgggtgt

SEQ ID NO: 4892427 - DNA, 17 bp, Homo sapiens
cagcacttgtctcattt

SEQ ID NO: 4892428 - DNA, 22 bp, Homo sapiens
cagcagaaaacttgtgtgaaat

SEQ ID NO: 4892429 - DNA, 20 bp, Homo sapiens
cagcagataacaatgcagca

SEQ ID NO: 4892430 - DNA, 12 bp, Homo sapiens
cagcagcaggtg

SEQ ID NO: 4892431 - DNA, 23 bp, Homo sapiens
cagcagcccctgcacaaagccct

SEQ ID NO: 4892432 - DNA, 20 bp, Homo sapiens
cagcagcctgcttcccacct

SEQ ID NO: 4892433 - DNA, 21 bp, Homo sapiens
cagcagcctgcttcccacctc

SEQ ID NO: 4892434 - DNA, 18 bp, Homo sapiens
cagcagcttcaccagagc

SEQ ID NO: 4892435 - DNA, 13 bp, Homo sapiens
cagcaggcagcgc

SEQ ID NO: 4892436 - DNA, 16 bp, Homo sapiens
cagcaggcagcgccaa

SEQ ID NO: 4892437 - DNA, 20 bp, Homo sapiens
cagcaggtgattggaccagg

SEQ ID NO: 4892438 - DNA, 19 bp, Homo sapiens
cagcagtcggttggagcga

SEQ ID NO: 4892439 - DNA, 13 bp, Homo sapiens
cagcagtgttccc

SEQ ID NO: 4892440 - DNA, 17 bp, Homo sapiens
cagcagtgttccccatc

SEQ ID NO: 4892441 - DNA, 14 bp, Homo sapiens
cagcatcacctgcc

SEQ ID NO: 4892442 - DNA, 20 bp, Homo sapiens
cagcatcactccccaaggaa

SEQ ID NO: 4892443 - DNA, 16 bp, Homo sapiens
cagcatcctggcaccc

SEQ ID NO: 4892444 - DNA, 21 bp, Homo sapiens
cagcatcctggcacccggccc

SEQ ID NO: 4892445 - DNA, 15 bp, Homo sapiens
cagcatcttctggtt

SEQ ID NO: 4892446 - DNA, 20 bp, Homo sapiens
cagcatgacataacagtgca

SEQ ID NO: 4892447 - DNA, 17 bp, Homo sapiens
cagcatggtccctgcct

SEQ ID NO: 4892448 - DNA, 18 bp, Homo sapiens
cagcatggtccctgcctt

SEQ ID NO: 4892449 - DNA, 20 bp, Homo sapiens
cagcatggtccctgccttag

SEQ ID NO: 4892450 - DNA, 23 bp, Homo sapiens
cagcatggtccctgccttaggcc

SEQ ID NO: 4892451 - DNA, 14 bp, Homo sapiens
cagcattccctccc

SEQ ID NO: 4892452 - DNA, 16 bp, Homo sapiens
cagcatttcttttctg

SEQ ID NO: 4892453 - DNA, 12 bp, Homo sapiens
cagcatttgata

SEQ ID NO: 4892454 - DNA, 15 bp, Homo sapiens
cagcatttgataatg

SEQ ID NO: 4892455 - DNA, 18 bp, Homo sapiens
cagcatttttatttcaga

SEQ ID NO: 4892456 - DNA, 16 bp, Homo sapiens
cagccaaacccatgag

SEQ ID NO: 4892457 - DNA, 11 bp, Homo sapiens
cagccaagctt

SEQ ID NO: 4892458 - DNA, 19 bp, Homo sapiens
cagccacacccaggcactt

SEQ ID NO: 4892459 - DNA, 12 bp, Homo sapiens
cagccaccagcg

SEQ ID NO: 4892460 - DNA, 17 bp, Homo sapiens
cagccaccccgggctct

SEQ ID NO: 4892461 - DNA, 16 bp, Homo sapiens
cagccacctaaacggt

SEQ ID NO: 4892462 - DNA, 22 bp, Homo sapiens
cagccacttcggccaggtcaca

SEQ ID NO: 4892463 - DNA, 17 bp, Homo sapiens
cagccagatcctcttgg

SEQ ID NO: 4892464 - DNA, 16 bp, Homo sapiens
cagccaggctgccaag

SEQ ID NO: 4892465 - DNA, 22 bp, Homo sapiens
cagccaggctgccaaggccaga

SEQ ID NO: 4892466 - DNA, 20 bp, Homo sapiens
cagccatacttatctctctg

SEQ ID NO: 4892467 - DNA, 23 bp, Homo sapiens
cagccatacttatctctctgtgc

SEQ ID NO: 4892468 - DNA, 20 bp, Homo sapiens
cagcccaaaggggacaggcc

SEQ ID NO: 4892469 - DNA, 19 bp, Homo sapiens
cagcccacatagtgatggt

SEQ ID NO: 4892470 - DNA, 15 bp, Homo sapiens
cagcccacttctgcc

SEQ ID NO: 4892471 - DNA, 21 bp, Homo sapiens
cagcccagagactttgtagat

SEQ ID NO: 4892472 - DNA, 16 bp, Homo sapiens
cagcccatgcccacct

SEQ ID NO: 4892473 - DNA, 17 bp, Homo sapiens
cagcccatggccctgtg

SEQ ID NO: 4892474 - DNA, 15 bp, Homo sapiens
cagccccacaacttt

SEQ ID NO: 4892475 - DNA, 16 bp, Homo sapiens
cagccccacacagcta

SEQ ID NO: 4892476 - DNA, 12 bp, Homo sapiens
cagccccaccca

SEQ ID NO: 4892477 - DNA, 15 bp, Homo sapiens
cagccccacccagga

SEQ ID NO: 4892478 - DNA, 22 bp, Homo sapiens
cagccccacccaggagggaggg

SEQ ID NO: 4892479 - DNA, 12 bp, Homo sapiens
cagccccactgc

SEQ ID NO: 4892480 - DNA, 13 bp, Homo sapiens
cagccccactgcc

SEQ ID NO: 4892481 - DNA, 15 bp, Homo sapiens
cagccccactgccag

SEQ ID NO: 4892482 - DNA, 19 bp, Homo sapiens
cagccccactgccagcagc

SEQ ID NO: 4892483 - DNA, 18 bp, Homo sapiens
cagccccattctgcctgc

SEQ ID NO: 4892484 - DNA, 22 bp, Homo sapiens
cagccccattctgcctgcccag

SEQ ID NO: 4892485 - DNA, 24 bp, Homo sapiens
cagccccattctgcctgcccaggc

SEQ ID NO: 4892486 - DNA, 15 bp, Homo sapiens
cagcccccagcccct

SEQ ID NO: 4892487 - DNA, 13 bp, Homo sapiens
cagcccctagaaa

SEQ ID NO: 4892488 - DNA, 16 bp, Homo sapiens
cagcccctagaaaccc

SEQ ID NO: 4892489 - DNA, 20 bp, Homo sapiens
cagcccctagaaacccaagc

SEQ ID NO: 4892490 - DNA, 17 bp, Homo sapiens
cagcccctagcccagga

SEQ ID NO: 4892491 - DNA, 23 bp, Homo sapiens
cagcccctagcccaggagagaga

SEQ ID NO: 4892492 - DNA, 11 bp, Homo sapiens
cagcccctccc

SEQ ID NO: 4892493 - DNA, 22 bp, Homo sapiens
cagcccctcccccatctcccac

SEQ ID NO: 4892494 - DNA, 15 bp, Homo sapiens
cagcccggaccttgg

SEQ ID NO: 4892495 - DNA, 15 bp, Homo sapiens
cagccctagagcctg

SEQ ID NO: 4892496 - DNA, 16 bp, Homo sapiens
cagccctagagcctgc

SEQ ID NO: 4892497 - DNA, 18 bp, Homo sapiens
cagccctagagcctgcct

SEQ ID NO: 4892498 - DNA, 20 bp, Homo sapiens
cagccctagagcctgcctgg

SEQ ID NO: 4892499 - DNA, 23 bp, Homo sapiens
cagccctagagcctgcctggagc

SEQ ID NO: 4892500 - DNA, 20 bp, Homo sapiens
cagccctccccatggagcca

SEQ ID NO: 4892501 - DNA, 21 bp, Homo sapiens
cagccctccccatggagccag

SEQ ID NO: 4892502 - DNA, 17 bp, Homo sapiens
cagccctccctgcccct

SEQ ID NO: 4892503 - DNA, 19 bp, Homo sapiens
cagccctgctttgggctgc

SEQ ID NO: 4892504 - DNA, 20 bp, Homo sapiens
cagccctgctttgggctgcc

SEQ ID NO: 4892505 - DNA, 21 bp, Homo sapiens
cagccctggcagggggcatgc

SEQ ID NO: 4892506 - DNA, 15 bp, Homo sapiens
cagccctggctctgc

SEQ ID NO: 4892507 - DNA, 21 bp, Homo sapiens
cagcccttagcagggaaacag

SEQ ID NO: 4892508 - DNA, 23 bp, Homo sapiens
cagcccttttgttgagccaggcc

SEQ ID NO: 4892509 - DNA, 18 bp, Homo sapiens
cagccgcttctgactgct

SEQ ID NO: 4892510 - DNA, 19 bp, Homo sapiens
cagccggccaatggaaacc

SEQ ID NO: 4892511 - DNA, 9 bp, Homo sapiens
cagccgtgc

SEQ ID NO: 4892512 - DNA, 12 bp, Homo sapiens
cagcctacagtt

SEQ ID NO: 4892513 - DNA, 13 bp, Homo sapiens
cagcctatgagca

SEQ ID NO: 4892514 - DNA, 23 bp, Homo sapiens
cagcctatgagcatcctgagccc

SEQ ID NO: 4892515 - DNA, 18 bp, Homo sapiens
cagcctcaacctcctggg

SEQ ID NO: 4892516 - DNA, 21 bp, Homo sapiens
cagcctcaacctcctgggcta

SEQ ID NO: 4892517 - DNA, 15 bp, Homo sapiens
cagcctcagtcctcc

SEQ ID NO: 4892518 - DNA, 22 bp, Homo sapiens
cagcctccaacacaaggctcca

SEQ ID NO: 4892519 - DNA, 14 bp, Homo sapiens
cagcctccaagctc

SEQ ID NO: 4892520 - DNA, 18 bp, Homo sapiens
cagcctccatgctgcctc

SEQ ID NO: 4892521 - DNA, 20 bp, Homo sapiens
cagcctccatgctgcctcca

SEQ ID NO: 4892522 - DNA, 15 bp, Homo sapiens
cagcctcccaaagtg

SEQ ID NO: 4892523 - DNA, 22 bp, Homo sapiens
cagcctcccaaagtgctgagat

SEQ ID NO: 4892524 - DNA, 20 bp, Homo sapiens
cagcctcccaaagtgctggg

SEQ ID NO: 4892525 - DNA, 21 bp, Homo sapiens
cagcctcccaaagtgctggga

SEQ ID NO: 4892526 - DNA, 23 bp, Homo sapiens
cagcctcccaaagtgctgggatt

SEQ ID NO: 4892527 - DNA, 18 bp, Homo sapiens
cagcctcccacccccatc

SEQ ID NO: 4892528 - DNA, 21 bp, Homo sapiens
cagcctcccgaatagctggga

SEQ ID NO: 4892529 - DNA, 20 bp, Homo sapiens
cagcctcccgagtagctggg

SEQ ID NO: 4892530 - DNA, 23 bp, Homo sapiens
cagcctcccgagtagctgggact

SEQ ID NO: 4892531 - DNA, 17 bp, Homo sapiens
cagcctcctctgtctgc

SEQ ID NO: 4892532 - DNA, 23 bp, Homo sapiens
cagcctcctctgtctgcccttca

SEQ ID NO: 4892533 - DNA, 23 bp, Homo sapiens
cagcctctccaggcaccatctcc

SEQ ID NO: 4892534 - DNA, 20 bp, Homo sapiens
cagcctctgacccctcctca

SEQ ID NO: 4892535 - DNA, 22 bp, Homo sapiens
cagcctgcacagtgtcccccag

SEQ ID NO: 4892536 - DNA, 23 bp, Homo sapiens
cagcctgcttcccacctccctgc

SEQ ID NO: 4892537 - DNA, 19 bp, Homo sapiens
cagcctgggcaacagagca

SEQ ID NO: 4892538 - DNA, 20 bp, Homo sapiens
cagcctggggcctggcaggg

SEQ ID NO: 4892539 - DNA, 21 bp, Homo sapiens
cagcctgtcccatggacactc

SEQ ID NO: 4892540 - DNA, 16 bp, Homo sapiens
cagccttcttccatcc

SEQ ID NO: 4892541 - DNA, 21 bp, Homo sapiens
cagccttcttccatcccagga

SEQ ID NO: 4892542 - DNA, 23 bp, Homo sapiens
cagccttcttccatcccaggaca

SEQ ID NO: 4892543 - DNA, 18 bp, Homo sapiens
cagcgaagtagcttgctc

SEQ ID NO: 4892544 - DNA, 22 bp, Homo sapiens
cagcgaagtagcttgctccctg

SEQ ID NO: 4892545 - DNA, 20 bp, Homo sapiens
cagcgacatagcccatccct

SEQ ID NO: 4892546 - DNA, 19 bp, Homo sapiens
cagcgagccctggtggcag

SEQ ID NO: 4892547 - DNA, 17 bp, Homo sapiens
cagcgagggcagctgct

SEQ ID NO: 4892548 - DNA, 14 bp, Homo sapiens
cagcgccagcctgt

SEQ ID NO: 4892549 - DNA, 20 bp, Homo sapiens
cagcgctctgcctcaccgct

SEQ ID NO: 4892550 - DNA, 17 bp, Homo sapiens
cagcggagtctgtcctg

SEQ ID NO: 4892551 - DNA, 15 bp, Homo sapiens
cagcggcccctgcat

SEQ ID NO: 4892552 - DNA, 20 bp, Homo sapiens
cagcgggcaggttctgcctg

SEQ ID NO: 4892553 - DNA, 18 bp, Homo sapiens
cagcggggacagctcctt

SEQ ID NO: 4892554 - DNA, 18 bp, Homo sapiens
cagcggggccccagggct

SEQ ID NO: 4892555 - DNA, 14 bp, Homo sapiens
cagcgtcccagtct

SEQ ID NO: 4892556 - DNA, 21 bp, Homo sapiens
cagcgtgcccgcttccgctgt

SEQ ID NO: 4892557 - DNA, 15 bp, Homo sapiens
cagctaagctaggaa

SEQ ID NO: 4892558 - DNA, 21 bp, Homo sapiens
cagctaagggaagacatttct

SEQ ID NO: 4892559 - DNA, 21 bp, Homo sapiens
cagctaccctttttctccagc

SEQ ID NO: 4892560 - DNA, 19 bp, Homo sapiens
cagctactgatttttgtga

SEQ ID NO: 4892561 - DNA, 17 bp, Homo sapiens
cagctacttcctcctcc

SEQ ID NO: 4892562 - DNA, 19 bp, Homo sapiens
cagctacttggtttgtgtt

SEQ ID NO: 4892563 - DNA, 18 bp, Homo sapiens
cagctatgggagccccag

SEQ ID NO: 4892564 - DNA, 21 bp, Homo sapiens
cagctatgggagccccagggt

SEQ ID NO: 4892565 - DNA, 23 bp, Homo sapiens
cagctatgggagccccagggtct

SEQ ID NO: 4892566 - DNA, 13 bp, Homo sapiens
cagctcacagtgc

SEQ ID NO: 4892567 - DNA, 14 bp, Homo sapiens
cagctcaccagccc

SEQ ID NO: 4892568 - DNA, 17 bp, Homo sapiens
cagctcaccagccccag

SEQ ID NO: 4892569 - DNA, 20 bp, Homo sapiens
cagctcaccagccccagtgc

SEQ ID NO: 4892570 - DNA, 21 bp, Homo sapiens
cagctcaccagccccagtgcc

SEQ ID NO: 4892571 - DNA, 14 bp, Homo sapiens
cagctcagaaccca

SEQ ID NO: 4892572 - DNA, 19 bp, Homo sapiens
cagctcagaacccagggct

SEQ ID NO: 4892573 - DNA, 20 bp, Homo sapiens
cagctcagaacccagggctc

SEQ ID NO: 4892574 - DNA, 12 bp, Homo sapiens
cagctcagtccc

SEQ ID NO: 4892575 - DNA, 15 bp, Homo sapiens
cagctccagctcacc

SEQ ID NO: 4892576 - DNA, 20 bp, Homo sapiens
cagctccagctcaccagccc

SEQ ID NO: 4892577 - DNA, 21 bp, Homo sapiens
cagctccaggtggctctgagg

SEQ ID NO: 4892578 - DNA, 21 bp, Homo sapiens
cagctcccaaggctctgagca

SEQ ID NO: 4892579 - DNA, 13 bp, Homo sapiens
cagctccctgcca

SEQ ID NO: 4892580 - DNA, 14 bp, Homo sapiens
cagctcctcccaca

SEQ ID NO: 4892581 - DNA, 15 bp, Homo sapiens
cagctcctgtaacat

SEQ ID NO: 4892582 - DNA, 17 bp, Homo sapiens
cagctccttctgtccta

SEQ ID NO: 4892583 - DNA, 23 bp, Homo sapiens
cagctccttctgtcctactctgt

SEQ ID NO: 4892584 - DNA, 19 bp, Homo sapiens
cagctcgaattaagaatat

SEQ ID NO: 4892585 - DNA, 22 bp, Homo sapiens
cagctcgatccaaattgtgctt

SEQ ID NO: 4892586 - DNA, 13 bp, Homo sapiens
cagctcggggagc

SEQ ID NO: 4892587 - DNA, 13 bp, Homo sapiens
cagctctctgtat

SEQ ID NO: 4892588 - DNA, 12 bp, Homo sapiens
cagctctgtcct

SEQ ID NO: 4892589 - DNA, 17 bp, Homo sapiens
cagctctgtcctgggag

SEQ ID NO: 4892590 - DNA, 15 bp, Homo sapiens
cagctcttaaatgta

SEQ ID NO: 4892591 - DNA, 14 bp, Homo sapiens
cagctcttctccag

SEQ ID NO: 4892592 - DNA, 15 bp, Homo sapiens
cagctcttctccagg

SEQ ID NO: 4892593 - DNA, 16 bp, Homo sapiens
cagctcttctccaggc

SEQ ID NO: 4892594 - DNA, 14 bp, Homo sapiens
cagctgcaccagag

SEQ ID NO: 4892595 - DNA, 12 bp, Homo sapiens
cagctgccacct

SEQ ID NO: 4892596 - DNA, 17 bp, Homo sapiens
cagctgcctcacttcct

SEQ ID NO: 4892597 - DNA, 12 bp, Homo sapiens
cagctgcctgca

SEQ ID NO: 4892598 - DNA, 19 bp, Homo sapiens
cagctgcggtccacccagg

SEQ ID NO: 4892599 - DNA, 22 bp, Homo sapiens
cagctgcttttgtctatgggac

SEQ ID NO: 4892600 - DNA, 23 bp, Homo sapiens
cagctgcttttgtctatgggact

SEQ ID NO: 4892601 - DNA, 13 bp, Homo sapiens
cagctggacagag

SEQ ID NO: 4892602 - DNA, 15 bp, Homo sapiens
cagctggacagaggg

SEQ ID NO: 4892603 - DNA, 16 bp, Homo sapiens
cagctggacagagggg

SEQ ID NO: 4892604 - DNA, 23 bp, Homo sapiens
cagctggacagaggggactctgg

SEQ ID NO: 4892605 - DNA, 15 bp, Homo sapiens
cagctggactctgca

SEQ ID NO: 4892606 - DNA, 17 bp, Homo sapiens
cagctggactctgcatc

SEQ ID NO: 4892607 - DNA, 19 bp, Homo sapiens
cagctggactctgcatccc

SEQ ID NO: 4892608 - DNA, 13 bp, Homo sapiens
cagctggcctgga

SEQ ID NO: 4892609 - DNA, 12 bp, Homo sapiens
cagctgtctcta

SEQ ID NO: 4892610 - DNA, 20 bp, Homo sapiens
cagctgtgctctggacaggc

SEQ ID NO: 4892611 - DNA, 14 bp, Homo sapiens
cagctgtttaagat

SEQ ID NO: 4892612 - DNA, 13 bp, Homo sapiens
cagcttcaccaga

SEQ ID NO: 4892613 - DNA, 21 bp, Homo sapiens
cagcttcatttcctgtgtctt

SEQ ID NO: 4892614 - DNA, 14 bp, Homo sapiens
cagcttcctaccca

SEQ ID NO: 4892615 - DNA, 22 bp, Homo sapiens
cagcttcctacccacacctctg

SEQ ID NO: 4892616 - DNA, 18 bp, Homo sapiens
cagcttgagggttgggct

SEQ ID NO: 4892617 - DNA, 21 bp, Homo sapiens
cagcttgagggttgggctggt

SEQ ID NO: 4892618 - DNA, 14 bp, Homo sapiens
cagcttgcgaataa

SEQ ID NO: 4892619 - DNA, 14 bp, Homo sapiens
cagcttgggagagc

SEQ ID NO: 4892620 - DNA, 20 bp, Homo sapiens
cagcttggggccaccaaagc

SEQ ID NO: 4892621 - DNA, 21 bp, Homo sapiens
cagcttggggccaccaaagct

SEQ ID NO: 4892622 - DNA, 18 bp, Homo sapiens
cagcttgtaaatagctca

SEQ ID NO: 4892623 - DNA, 19 bp, Homo sapiens
cagcttgtaaatagctcag

SEQ ID NO: 4892624 - DNA, 22 bp, Homo sapiens
cagcttgtaaatagctcaggtg

SEQ ID NO: 4892625 - DNA, 19 bp, Homo sapiens
cagcttgtatgcaatggat

SEQ ID NO: 4892626 - DNA, 15 bp, Homo sapiens
cagctttaaacaaat

SEQ ID NO: 4892627 - DNA, 17 bp, Homo sapiens
cagctttaaactcaggg

SEQ ID NO: 4892628 - DNA, 19 bp, Homo sapiens
cagctttaaactcagggac

SEQ ID NO: 4892629 - DNA, 13 bp, Homo sapiens
cagctttatgttc

SEQ ID NO: 4892630 - DNA, 17 bp, Homo sapiens
cagctttcaagtgcctt

SEQ ID NO: 4892631 - DNA, 19 bp, Homo sapiens
cagctttcttgctcccttc

SEQ ID NO: 4892632 - DNA, 22 bp, Homo sapiens
cagctttcttgctcccttcagc

SEQ ID NO: 4892633 - DNA, 23 bp, Homo sapiens
cagctttcttgctcccttcagcc

SEQ ID NO: 4892634 - DNA, 11 bp, Homo sapiens
cagcttttaac

SEQ ID NO: 4892635 - DNA, 21 bp, Homo sapiens
cagcttttaaccatctgatat

SEQ ID NO: 4892636 - DNA, 15 bp, Homo sapiens
caggaaaagctgctg

SEQ ID NO: 4892637 - DNA, 16 bp, Homo sapiens
caggaaaagctgctga

SEQ ID NO: 4892638 - DNA, 18 bp, Homo sapiens
caggaaaagctgctgaca

SEQ ID NO: 4892639 - DNA, 18 bp, Homo sapiens
caggaaagtgttattttt

SEQ ID NO: 4892640 - DNA, 12 bp, Homo sapiens
caggaacagaag

SEQ ID NO: 4892641 - DNA, 14 bp, Homo sapiens
caggaacagctatg

SEQ ID NO: 4892642 - DNA, 22 bp, Homo sapiens
caggaacagctatgggagcccc

SEQ ID NO: 4892643 - DNA, 14 bp, Homo sapiens
caggaagcacccca

SEQ ID NO: 4892644 - DNA, 19 bp, Homo sapiens
caggaagcattcagagagc

SEQ ID NO: 4892645 - DNA, 13 bp, Homo sapiens
caggaagcctgca

SEQ ID NO: 4892646 - DNA, 12 bp, Homo sapiens
caggaaggagag

SEQ ID NO: 4892647 - DNA, 14 bp, Homo sapiens
caggaaggagagcc

SEQ ID NO: 4892648 - DNA, 15 bp, Homo sapiens
caggaaggagagcct

SEQ ID NO: 4892649 - DNA, 12 bp, Homo sapiens
caggaaggcctg

SEQ ID NO: 4892650 - DNA, 14 bp, Homo sapiens
caggaatgatctct

SEQ ID NO: 4892651 - DNA, 16 bp, Homo sapiens
caggaatgtgtggcct

SEQ ID NO: 4892652 - DNA, 17 bp, Homo sapiens
caggacaccacacccag

SEQ ID NO: 4892653 - DNA, 19 bp, Homo sapiens
caggacctcccttccgacc

SEQ ID NO: 4892654 - DNA, 20 bp, Homo sapiens
caggacctcccttccgaccc

SEQ ID NO: 4892655 - DNA, 22 bp, Homo sapiens
caggacctcccttccgaccctc

SEQ ID NO: 4892656 - DNA, 23 bp, Homo sapiens
caggacctcccttccgaccctct

SEQ ID NO: 4892657 - DNA, 20 bp, Homo sapiens
caggaccttttgaagtagtt

SEQ ID NO: 4892658 - DNA, 15 bp, Homo sapiens
caggactccctcctc

SEQ ID NO: 4892659 - DNA, 17 bp, Homo sapiens
caggactccctcctcac

SEQ ID NO: 4892660 - DNA, 20 bp, Homo sapiens
caggactccctcctcacctc

SEQ ID NO: 4892661 - DNA, 22 bp, Homo sapiens
caggactccctcctcacctctg

SEQ ID NO: 4892662 - DNA, 12 bp, Homo sapiens
caggactctgcc

SEQ ID NO: 4892663 - DNA, 14 bp, Homo sapiens
caggactgagcccc

SEQ ID NO: 4892664 - DNA, 20 bp, Homo sapiens
caggactgagccccgcagac

SEQ ID NO: 4892665 - DNA, 15 bp, Homo sapiens
caggagacaggaagg

SEQ ID NO: 4892666 - DNA, 13 bp, Homo sapiens
caggagacgacag

SEQ ID NO: 4892667 - DNA, 20 bp, Homo sapiens
caggagagagaaagccaggc

SEQ ID NO: 4892668 - DNA, 19 bp, Homo sapiens
caggagattgagaaggaga

SEQ ID NO: 4892669 - DNA, 22 bp, Homo sapiens
caggagccccgaggccttctct

SEQ ID NO: 4892670 - DNA, 23 bp, Homo sapiens
caggagccccgaggccttctctg

SEQ ID NO: 4892671 - DNA, 11 bp, Homo sapiens
caggagcctgg

SEQ ID NO: 4892672 - DNA, 12 bp, Homo sapiens
caggagcctggc

SEQ ID NO: 4892673 - DNA, 12 bp, Homo sapiens
caggagctcttc

SEQ ID NO: 4892674 - DNA, 22 bp, Homo sapiens
caggaggattgcttgagcccag

SEQ ID NO: 4892675 - DNA, 18 bp, Homo sapiens
caggaggcaagcaagctc

SEQ ID NO: 4892676 - DNA, 22 bp, Homo sapiens
caggaggcgcccttggcttctg

SEQ ID NO: 4892677 - DNA, 21 bp, Homo sapiens
caggaggctgaggcaggagga

SEQ ID NO: 4892678 - DNA, 16 bp, Homo sapiens
caggagggccctacct

SEQ ID NO: 4892679 - DNA, 17 bp, Homo sapiens
caggagtcccaaggaaa

SEQ ID NO: 4892680 - DNA, 21 bp, Homo sapiens
caggagtcccaaggaaagccc

SEQ ID NO: 4892681 - DNA, 12 bp, Homo sapiens
caggagtgagca

SEQ ID NO: 4892682 - DNA, 22 bp, Homo sapiens
caggagtgggaaaacactgcca

SEQ ID NO: 4892683 - DNA, 18 bp, Homo sapiens
caggataataaagtgttt

SEQ ID NO: 4892684 - DNA, 15 bp, Homo sapiens
caggatcagttaact

SEQ ID NO: 4892685 - DNA, 21 bp, Homo sapiens
caggatcatggtgtaataaga

SEQ ID NO: 4892686 - DNA, 17 bp, Homo sapiens
caggatccaagctaagc

SEQ ID NO: 4892687 - DNA, 16 bp, Homo sapiens
caggatcccaggggcc

SEQ ID NO: 4892688 - DNA, 16 bp, Homo sapiens
caggatgacctggata

SEQ ID NO: 4892689 - DNA, 17 bp, Homo sapiens
caggatgacctggataa

SEQ ID NO: 4892690 - DNA, 13 bp, Homo sapiens
caggatgctgggt

SEQ ID NO: 4892691 - DNA, 18 bp, Homo sapiens
caggatgggggctggcct

SEQ ID NO: 4892692 - DNA, 18 bp, Homo sapiens
caggatttaaaaactgga

SEQ ID NO: 4892693 - DNA, 19 bp, Homo sapiens
caggatttaaaaactggaa

SEQ ID NO: 4892694 - DNA, 20 bp, Homo sapiens
caggatttaaaaactggaac

SEQ ID NO: 4892695 - DNA, 22 bp, Homo sapiens
caggatttgaactcagatctgt

SEQ ID NO: 4892696 - DNA, 20 bp, Homo sapiens
caggcaacttcagtcctggg

SEQ ID NO: 4892697 - DNA, 21 bp, Homo sapiens
caggcaacttcagtcctggga

SEQ ID NO: 4892698 - DNA, 14 bp, Homo sapiens
caggcaagcacctc

SEQ ID NO: 4892699 - DNA, 16 bp, Homo sapiens
caggcaagcacctcct

SEQ ID NO: 4892700 - DNA, 17 bp, Homo sapiens
caggcaatgctggctgt

SEQ ID NO: 4892701 - DNA, 19 bp, Homo sapiens
caggcaatgctggctgttg

SEQ ID NO: 4892702 - DNA, 12 bp, Homo sapiens
caggcaattccg

SEQ ID NO: 4892703 - DNA, 15 bp, Homo sapiens
caggcacagctgagt

SEQ ID NO: 4892704 - DNA, 16 bp, Homo sapiens
caggcacagctgagtt

SEQ ID NO: 4892705 - DNA, 12 bp, Homo sapiens
caggcacaggat

SEQ ID NO: 4892706 - DNA, 23 bp, Homo sapiens
caggcactagcctttggctctgg

SEQ ID NO: 4892707 - DNA, 23 bp, Homo sapiens
caggcactgctgcccagcctcca

SEQ ID NO: 4892708 - DNA, 14 bp, Homo sapiens
caggcagagaatca

SEQ ID NO: 4892709 - DNA, 18 bp, Homo sapiens
caggcagatacaggaaaa

SEQ ID NO: 4892710 - DNA, 16 bp, Homo sapiens
caggcagatctgtgcc

SEQ ID NO: 4892711 - DNA, 17 bp, Homo sapiens
caggcagatctgtgccc

SEQ ID NO: 4892712 - DNA, 13 bp, Homo sapiens
caggcagcgccaa

SEQ ID NO: 4892713 - DNA, 17 bp, Homo sapiens
caggcagctttctagaa

SEQ ID NO: 4892714 - DNA, 14 bp, Homo sapiens
caggcaggtccagg

SEQ ID NO: 4892715 - DNA, 15 bp, Homo sapiens
caggcaggtccaggg

SEQ ID NO: 4892716 - DNA, 19 bp, Homo sapiens
caggcaggtccagggtttg

SEQ ID NO: 4892717 - DNA, 13 bp, Homo sapiens
caggcaggtcttg

SEQ ID NO: 4892718 - DNA, 20 bp, Homo sapiens
caggcattgaggaagagtct

SEQ ID NO: 4892719 - DNA, 18 bp, Homo sapiens
caggcatttgactgaaga

SEQ ID NO: 4892720 - DNA, 19 bp, Homo sapiens
caggccaaggccttctcct

SEQ ID NO: 4892721 - DNA, 19 bp, Homo sapiens
caggccaaggtctgagcca

SEQ ID NO: 4892722 - DNA, 13 bp, Homo sapiens
caggccagaggga

SEQ ID NO: 4892723 - DNA, 17 bp, Homo sapiens
caggcccggctccaggc

SEQ ID NO: 4892724 - DNA, 22 bp, Homo sapiens
caggcccggctccaggctcctt

SEQ ID NO: 4892725 - DNA, 15 bp, Homo sapiens
caggccctgcagtgt

SEQ ID NO: 4892726 - DNA, 17 bp, Homo sapiens
caggccctgcagtgttc

SEQ ID NO: 4892727 - DNA, 16 bp, Homo sapiens
caggccctgctcctgc

SEQ ID NO: 4892728 - DNA, 22 bp, Homo sapiens
caggccctggctgagggcagct

SEQ ID NO: 4892729 - DNA, 16 bp, Homo sapiens
caggcccttcctctcc

SEQ ID NO: 4892730 - DNA, 17 bp, Homo sapiens
caggcccttcctctcca

SEQ ID NO: 4892731 - DNA, 21 bp, Homo sapiens
caggcccttcctctccactgc

SEQ ID NO: 4892732 - DNA, 20 bp, Homo sapiens
caggccctttgaagcctcag

SEQ ID NO: 4892733 - DNA, 22 bp, Homo sapiens
caggccctttgaagcctcagct

SEQ ID NO: 4892734 - DNA, 16 bp, Homo sapiens
caggccggccagcctc

SEQ ID NO: 4892735 - DNA, 12 bp, Homo sapiens
caggcctcacct

SEQ ID NO: 4892736 - DNA, 22 bp, Homo sapiens
caggcctcacctctacccaaac

SEQ ID NO: 4892737 - DNA, 16 bp, Homo sapiens
caggcctccctctctc

SEQ ID NO: 4892738 - DNA, 19 bp, Homo sapiens
caggcctccctctctcttc

SEQ ID NO: 4892739 - DNA, 14 bp, Homo sapiens
caggcctctgtgtc

SEQ ID NO: 4892740 - DNA, 12 bp, Homo sapiens
caggcctgtgtg

SEQ ID NO: 4892741 - DNA, 20 bp, Homo sapiens
caggcgagagaggagccaga

SEQ ID NO: 4892742 - DNA, 19 bp, Homo sapiens
caggcgatccacctgtctc

SEQ ID NO: 4892743 - DNA, 14 bp, Homo sapiens
caggctactagaat

SEQ ID NO: 4892744 - DNA, 16 bp, Homo sapiens
caggctccgcccttag

SEQ ID NO: 4892745 - DNA, 19 bp, Homo sapiens
caggctcctttagcgccca

SEQ ID NO: 4892746 - DNA, 20 bp, Homo sapiens
caggctcctttagcgcccag

SEQ ID NO: 4892747 - DNA, 14 bp, Homo sapiens
caggctgcagctgg

SEQ ID NO: 4892748 - DNA, 18 bp, Homo sapiens
caggctgcagctggacag

SEQ ID NO: 4892749 - DNA, 22 bp, Homo sapiens
caggctggacatgctgactgtc

SEQ ID NO: 4892750 - DNA, 16 bp, Homo sapiens
caggctgggcttcagt

SEQ ID NO: 4892751 - DNA, 19 bp, Homo sapiens
caggctgggcttcagtggc

SEQ ID NO: 4892752 - DNA, 20 bp, Homo sapiens
caggctgggcttcagtggca

SEQ ID NO: 4892753 - DNA, 23 bp, Homo sapiens
caggctgggcttcagtggcagct

SEQ ID NO: 4892754 - DNA, 17 bp, Homo sapiens
caggctggtctaaaact

SEQ ID NO: 4892755 - DNA, 18 bp, Homo sapiens
caggctggtctaaaactc

SEQ ID NO: 4892756 - DNA, 22 bp, Homo sapiens
caggctgtatcccatgagcctc

SEQ ID NO: 4892757 - DNA, 19 bp, Homo sapiens
caggctgttctgcactgaa

SEQ ID NO: 4892758 - DNA, 22 bp, Homo sapiens
caggcttcctgcaattttctaa

SEQ ID NO: 4892759 - DNA, 19 bp, Homo sapiens
caggctttgtacagagtgc

SEQ ID NO: 4892760 - DNA, 22 bp, Homo sapiens
cagggaaacagctaatgggaca

SEQ ID NO: 4892761 - DNA, 13 bp, Homo sapiens
cagggaacagtat

SEQ ID NO: 4892762 - DNA, 15 bp, Homo sapiens
cagggaagagcagaa

SEQ ID NO: 4892763 - DNA, 17 bp, Homo sapiens
cagggaagagcagaacg

SEQ ID NO: 4892764 - DNA, 23 bp, Homo sapiens
cagggaatccaagcctccacagc

SEQ ID NO: 4892765 - DNA, 13 bp, Homo sapiens
cagggacagagcc

SEQ ID NO: 4892766 - DNA, 16 bp, Homo sapiens
cagggagcagggaagg

SEQ ID NO: 4892767 - DNA, 22 bp, Homo sapiens
cagggagcctttggttctggcc

SEQ ID NO: 4892768 - DNA, 17 bp, Homo sapiens
cagggaggtcaggccct

SEQ ID NO: 4892769 - DNA, 22 bp, Homo sapiens
cagggagtccgaaagggacttg

SEQ ID NO: 4892770 - DNA, 14 bp, Homo sapiens
cagggagtgctggc

SEQ ID NO: 4892771 - DNA, 16 bp, Homo sapiens
cagggagtgctggctc

SEQ ID NO: 4892772 - DNA, 23 bp, Homo sapiens
cagggcaaaatattcactgggcc

SEQ ID NO: 4892773 - DNA, 17 bp, Homo sapiens
cagggcaatcaatgttc

SEQ ID NO: 4892774 - DNA, 18 bp, Homo sapiens
cagggccaggactgagcc

SEQ ID NO: 4892775 - DNA, 18 bp, Homo sapiens
cagggccagtggggcctg

SEQ ID NO: 4892776 - DNA, 19 bp, Homo sapiens
cagggccagtggggcctgt

SEQ ID NO: 4892777 - DNA, 22 bp, Homo sapiens
cagggccagtggggcctgtgga

SEQ ID NO: 4892778 - DNA, 18 bp, Homo sapiens
cagggcctggggcctgag

SEQ ID NO: 4892779 - DNA, 21 bp, Homo sapiens
cagggcctggggcctgagaga

SEQ ID NO: 4892780 - DNA, 22 bp, Homo sapiens
cagggcctggggcctgagagaa

SEQ ID NO: 4892781 - DNA, 17 bp, Homo sapiens
cagggctaccctccccc

SEQ ID NO: 4892782 - DNA, 12 bp, Homo sapiens
cagggctcagcg

SEQ ID NO: 4892783 - DNA, 16 bp, Homo sapiens
cagggctctgccccag

SEQ ID NO: 4892784 - DNA, 21 bp, Homo sapiens
cagggcttacctgtacactga

SEQ ID NO: 4892785 - DNA, 18 bp, Homo sapiens
caggggactcagccctga

SEQ ID NO: 4892786 - DNA, 20 bp, Homo sapiens
caggggactcagccctgagg

SEQ ID NO: 4892787 - DNA, 22 bp, Homo sapiens
caggggcgtgaggtcccaggaa

SEQ ID NO: 4892788 - DNA, 17 bp, Homo sapiens
caggggctacaagaggg

SEQ ID NO: 4892789 - DNA, 19 bp, Homo sapiens
caggggctacaagagggaa

SEQ ID NO: 4892790 - DNA, 14 bp, Homo sapiens
cagggggaagaagc

SEQ ID NO: 4892791 - DNA, 15 bp, Homo sapiens
cagggggaagaagca

SEQ ID NO: 4892792 - DNA, 18 bp, Homo sapiens
caggggtcccagccaccc

SEQ ID NO: 4892793 - DNA, 18 bp, Homo sapiens
cagggtcatgtttgcagg

SEQ ID NO: 4892794 - DNA, 23 bp, Homo sapiens
cagggtctcactatgttgcccag

SEQ ID NO: 4892795 - DNA, 18 bp, Homo sapiens
cagggtctcactctgtcg

SEQ ID NO: 4892796 - DNA, 22 bp, Homo sapiens
cagggtctcactctgtcgccca

SEQ ID NO: 4892797 - DNA, 18 bp, Homo sapiens
cagggtctctccctcagg

SEQ ID NO: 4892798 - DNA, 19 bp, Homo sapiens
cagggtctgtgtgaatgtg

SEQ ID NO: 4892799 - DNA, 20 bp, Homo sapiens
cagggtctgtgtgaatgtgg

SEQ ID NO: 4892800 - DNA, 22 bp, Homo sapiens
cagggtcttccctacctcaggc

SEQ ID NO: 4892801 - DNA, 17 bp, Homo sapiens
cagggtggacttagaaa

SEQ ID NO: 4892802 - DNA, 16 bp, Homo sapiens
cagggttggcccctgc

SEQ ID NO: 4892803 - DNA, 15 bp, Homo sapiens
cagggttgggcccag

SEQ ID NO: 4892804 - DNA, 16 bp, Homo sapiens
cagggttgggcccaga

SEQ ID NO: 4892805 - DNA, 20 bp, Homo sapiens
cagggttgggcccagatctg

SEQ ID NO: 4892806 - DNA, 13 bp, Homo sapiens
cagggtttttacc

SEQ ID NO: 4892807 - DNA, 17 bp, Homo sapiens
caggtaacaggcagata

SEQ ID NO: 4892808 - DNA, 21 bp, Homo sapiens
caggtaacaggcagatacagg

SEQ ID NO: 4892809 - DNA, 12 bp, Homo sapiens
caggtagccagg

SEQ ID NO: 4892810 - DNA, 20 bp, Homo sapiens
caggtatgttgcctttatgg

SEQ ID NO: 4892811 - DNA, 11 bp, Homo sapiens
caggtattttg

SEQ ID NO: 4892812 - DNA, 20 bp, Homo sapiens
caggtattttgtttctttta

SEQ ID NO: 4892813 - DNA, 20 bp, Homo sapiens
caggtcctcagagaatttct

SEQ ID NO: 4892814 - DNA, 16 bp, Homo sapiens
caggtcgggcgcagga

SEQ ID NO: 4892815 - DNA, 12 bp, Homo sapiens
caggtctagact

SEQ ID NO: 4892816 - DNA, 14 bp, Homo sapiens
caggtctcacgggc

SEQ ID NO: 4892817 - DNA, 19 bp, Homo sapiens
caggtcttgaactcctggc

SEQ ID NO: 4892818 - DNA, 20 bp, Homo sapiens
caggtcttgaactcctggcc

SEQ ID NO: 4892819 - DNA, 17 bp, Homo sapiens
caggtgaaaatgttcat

SEQ ID NO: 4892820 - DNA, 20 bp, Homo sapiens
caggtgatccacccacctca

SEQ ID NO: 4892821 - DNA, 21 bp, Homo sapiens
caggtgatccacccacctcag

SEQ ID NO: 4892822 - DNA, 23 bp, Homo sapiens
caggtgatccacccacctcagcc

SEQ ID NO: 4892823 - DNA, 12 bp, Homo sapiens
caggtgcctgga

SEQ ID NO: 4892824 - DNA, 18 bp, Homo sapiens
caggtgctattgttactc

SEQ ID NO: 4892825 - DNA, 16 bp, Homo sapiens
caggtggccactccag

SEQ ID NO: 4892826 - DNA, 13 bp, Homo sapiens
caggtggggcagc

SEQ ID NO: 4892827 - DNA, 16 bp, Homo sapiens
caggtggggcagcttg

SEQ ID NO: 4892828 - DNA, 13 bp, Homo sapiens
caggtggttttta

SEQ ID NO: 4892829 - DNA, 11 bp, Homo sapiens
caggtgtccct

SEQ ID NO: 4892830 - DNA, 16 bp, Homo sapiens
caggtgtccctgcact

SEQ ID NO: 4892831 - DNA, 18 bp, Homo sapiens
caggtgtccctgcacttg

SEQ ID NO: 4892832 - DNA, 16 bp, Homo sapiens
caggtgtgagtcacca

SEQ ID NO: 4892833 - DNA, 20 bp, Homo sapiens
caggtgtgagtcaccaagcc

SEQ ID NO: 4892834 - DNA, 22 bp, Homo sapiens
caggtgtgagtcaccaagccca

SEQ ID NO: 4892835 - DNA, 20 bp, Homo sapiens
caggtgtggtgtaatttata

SEQ ID NO: 4892836 - DNA, 18 bp, Homo sapiens
caggtgttaacattccaa

SEQ ID NO: 4892837 - DNA, 21 bp, Homo sapiens
caggtgttttttatgaagtgc

SEQ ID NO: 4892838 - DNA, 23 bp, Homo sapiens
caggttatcgaaataacaatgtt

SEQ ID NO: 4892839 - DNA, 15 bp, Homo sapiens
caggttggaagagaa

SEQ ID NO: 4892840 - DNA, 18 bp, Homo sapiens
caggttggaagagaatca

SEQ ID NO: 4892841 - DNA, 13 bp, Homo sapiens
caggttggacccc

SEQ ID NO: 4892842 - DNA, 23 bp, Homo sapiens
caggttgtctgaagtcactgcac

SEQ ID NO: 4892843 - DNA, 12 bp, Homo sapiens
caggtttaacat

SEQ ID NO: 4892844 - DNA, 13 bp, Homo sapiens
cagtaatatttat

SEQ ID NO: 4892845 - DNA, 14 bp, Homo sapiens
cagtaccctctcag

SEQ ID NO: 4892846 - DNA, 19 bp, Homo sapiens
cagtagaaataatatgcat

SEQ ID NO: 4892847 - DNA, 15 bp, Homo sapiens
cagtagagccagctt

SEQ ID NO: 4892848 - DNA, 16 bp, Homo sapiens
cagtagagccagcttg

SEQ ID NO: 4892849 - DNA, 12 bp, Homo sapiens
cagtaggggagg

SEQ ID NO: 4892850 - DNA, 19 bp, Homo sapiens
cagtaggggcttataataa

SEQ ID NO: 4892851 - DNA, 14 bp, Homo sapiens
cagtatatttaaac

SEQ ID NO: 4892852 - DNA, 16 bp, Homo sapiens
cagtatcccacatcca

SEQ ID NO: 4892853 - DNA, 18 bp, Homo sapiens
cagtatctatatatgtgt

SEQ ID NO: 4892854 - DNA, 15 bp, Homo sapiens
cagtatgatttataa

SEQ ID NO: 4892855 - DNA, 16 bp, Homo sapiens
cagtatgctgcccctg

SEQ ID NO: 4892856 - DNA, 17 bp, Homo sapiens
cagtatgtattcttttg

SEQ ID NO: 4892857 - DNA, 12 bp, Homo sapiens
cagtattatgta

SEQ ID NO: 4892858 - DNA, 16 bp, Homo sapiens
cagtattcttgtcaaa

SEQ ID NO: 4892859 - DNA, 16 bp, Homo sapiens
cagtatttattttgta

SEQ ID NO: 4892860 - DNA, 17 bp, Homo sapiens
cagtatttattttgtaa

SEQ ID NO: 4892861 - DNA, 11 bp, Homo sapiens
cagtatttcag

SEQ ID NO: 4892862 - DNA, 15 bp, Homo sapiens
cagtatttcattgcc

SEQ ID NO: 4892863 - DNA, 19 bp, Homo sapiens
cagtatttcattgcctgtg

SEQ ID NO: 4892864 - DNA, 16 bp, Homo sapiens
cagtatttccacttgt

SEQ ID NO: 4892865 - DNA, 17 bp, Homo sapiens
cagtcacatgacctgat

SEQ ID NO: 4892866 - DNA, 14 bp, Homo sapiens
cagtcatcatcagg

SEQ ID NO: 4892867 - DNA, 16 bp, Homo sapiens
cagtcatcatcagggc

SEQ ID NO: 4892868 - DNA, 20 bp, Homo sapiens
cagtcatcatcagggcctgg

SEQ ID NO: 4892869 - DNA, 13 bp, Homo sapiens
cagtcatgcataa

SEQ ID NO: 4892870 - DNA, 16 bp, Homo sapiens
cagtcatgcataaata

SEQ ID NO: 4892871 - DNA, 18 bp, Homo sapiens
cagtcatgcataaatatg

SEQ ID NO: 4892872 - DNA, 20 bp, Homo sapiens
cagtcatgcataaatatgca

SEQ ID NO: 4892873 - DNA, 23 bp, Homo sapiens
cagtcatgcataaatatgcagtg

SEQ ID NO: 4892874 - DNA, 16 bp, Homo sapiens
cagtccatagcagaga

SEQ ID NO: 4892875 - DNA, 12 bp, Homo sapiens
cagtccatgcat

SEQ ID NO: 4892876 - DNA, 18 bp, Homo sapiens
cagtccatttatatatga

SEQ ID NO: 4892877 - DNA, 13 bp, Homo sapiens
cagtcccactgtg

SEQ ID NO: 4892878 - DNA, 23 bp, Homo sapiens
cagtcccactgtgcaggtgctat

SEQ ID NO: 4892879 - DNA, 19 bp, Homo sapiens
cagtccgtgtggatccaat

SEQ ID NO: 4892880 - DNA, 12 bp, Homo sapiens
cagtcctcccct

SEQ ID NO: 4892881 - DNA, 13 bp, Homo sapiens
cagtcctcccctc

SEQ ID NO: 4892882 - DNA, 14 bp, Homo sapiens
cagtcctcccctca

SEQ ID NO: 4892883 - DNA, 19 bp, Homo sapiens
cagtcctcccctcacagcc

SEQ ID NO: 4892884 - DNA, 13 bp, Homo sapiens
cagtcctgcctgg

SEQ ID NO: 4892885 - DNA, 17 bp, Homo sapiens
cagtcctgcctggccag

SEQ ID NO: 4892886 - DNA, 18 bp, Homo sapiens
cagtcctgcctggccagg

SEQ ID NO: 4892887 - DNA, 14 bp, Homo sapiens
cagtcctgtagttt

SEQ ID NO: 4892888 - DNA, 16 bp, Homo sapiens
cagtcctgtagtttta

SEQ ID NO: 4892889 - DNA, 18 bp, Homo sapiens
cagtcctgtagttttatt

SEQ ID NO: 4892890 - DNA, 21 bp, Homo sapiens
cagtcctttgtaaacagtgtt

SEQ ID NO: 4892891 - DNA, 17 bp, Homo sapiens
cagtctcctctttaaaa

SEQ ID NO: 4892892 - DNA, 19 bp, Homo sapiens
cagtctcctctttaaaaca

SEQ ID NO: 4892893 - DNA, 15 bp, Homo sapiens
cagtctctctcttcc

SEQ ID NO: 4892894 - DNA, 14 bp, Homo sapiens
cagtctctcttaaa

SEQ ID NO: 4892895 - DNA, 17 bp, Homo sapiens
cagtctctcttaaagtt

SEQ ID NO: 4892896 - DNA, 21 bp, Homo sapiens
cagtctgattcccaagctctg

SEQ ID NO: 4892897 - DNA, 18 bp, Homo sapiens
cagtctggaatgcagtgg

SEQ ID NO: 4892898 - DNA, 23 bp, Homo sapiens
cagtcttgaatttctaaaaaaca

SEQ ID NO: 4892899 - DNA, 19 bp, Homo sapiens
cagtctttaaaggcccagc

SEQ ID NO: 4892900 - DNA, 20 bp, Homo sapiens
cagtctttaaaggcccagcc

SEQ ID NO: 4892901 - DNA, 19 bp, Homo sapiens
cagtgacctgctgggtaaa

SEQ ID NO: 4892902 - DNA, 20 bp, Homo sapiens
cagtgagaaaaagctcctgt

SEQ ID NO: 4892903 - DNA, 21 bp, Homo sapiens
cagtgagaaaaagctcctgtc

SEQ ID NO: 4892904 - DNA, 19 bp, Homo sapiens
cagtgagattacagaggaa

SEQ ID NO: 4892905 - DNA, 23 bp, Homo sapiens
cagtgaggggtatatctgggctg

SEQ ID NO: 4892906 - DNA, 18 bp, Homo sapiens
cagtgagtcgaggacagg

SEQ ID NO: 4892907 - DNA, 19 bp, Homo sapiens
cagtgagtcgaggacaggg

SEQ ID NO: 4892908 - DNA, 20 bp, Homo sapiens
cagtgagtcgaggacaggga

SEQ ID NO: 4892909 - DNA, 23 bp, Homo sapiens
cagtgagtcgaggacagggaggt

SEQ ID NO: 4892910 - DNA, 17 bp, Homo sapiens
cagtgagtgagcctggc

SEQ ID NO: 4892911 - DNA, 18 bp, Homo sapiens
cagtgatatggcagaaga

SEQ ID NO: 4892912 - DNA, 22 bp, Homo sapiens
cagtgatatggcagaagacacc

SEQ ID NO: 4892913 - DNA, 13 bp, Homo sapiens
cagtgcagcaata

SEQ ID NO: 4892914 - DNA, 12 bp, Homo sapiens
cagtgcatctca

SEQ ID NO: 4892915 - DNA, 17 bp, Homo sapiens
cagtgccaactcctcac

SEQ ID NO: 4892916 - DNA, 14 bp, Homo sapiens
cagtgccagcaatg

SEQ ID NO: 4892917 - DNA, 21 bp, Homo sapiens
cagtgccagcaatgacatctc

SEQ ID NO: 4892918 - DNA, 24 bp, Homo sapiens
cagtgcgcgtgcacgtggagagct

SEQ ID NO: 4892919 - DNA, 16 bp, Homo sapiens
cagtgctagtgagctg

SEQ ID NO: 4892920 - DNA, 19 bp, Homo sapiens
cagtgctgtccatgcttct

SEQ ID NO: 4892921 - DNA, 12 bp, Homo sapiens
cagtgctgtgtg

SEQ ID NO: 4892922 - DNA, 16 bp, Homo sapiens
cagtggattgcatttc

SEQ ID NO: 4892923 - DNA, 13 bp, Homo sapiens
cagtggcagctgc

SEQ ID NO: 4892924 - DNA, 14 bp, Homo sapiens
cagtggccactcag

SEQ ID NO: 4892925 - DNA, 21 bp, Homo sapiens
cagtggcttcatctgtcaagt

SEQ ID NO: 4892926 - DNA, 17 bp, Homo sapiens
cagtgggaactctgaca

SEQ ID NO: 4892927 - DNA, 22 bp, Homo sapiens
cagtgggaactctgacaagggc

SEQ ID NO: 4892928 - DNA, 11 bp, Homo sapiens
cagtgggagct

SEQ ID NO: 4892929 - DNA, 18 bp, Homo sapiens
cagtgggagctgcctgtt

SEQ ID NO: 4892930 - DNA, 23 bp, Homo sapiens
cagtgggagctgcctgttcagct

SEQ ID NO: 4892931 - DNA, 15 bp, Homo sapiens
cagtgggctcctggc

SEQ ID NO: 4892932 - DNA, 13 bp, Homo sapiens
cagtggggcctgt

SEQ ID NO: 4892933 - DNA, 14 bp, Homo sapiens
cagtggggcctgtg

SEQ ID NO: 4892934 - DNA, 19 bp, Homo sapiens
cagtgtacatagtgtaatg

SEQ ID NO: 4892935 - DNA, 15 bp, Homo sapiens
cagtgtagttaattt

SEQ ID NO: 4892936 - DNA, 17 bp, Homo sapiens
cagtgtagttaatttat

SEQ ID NO: 4892937 - DNA, 19 bp, Homo sapiens
cagtgtctgtaaaagagcc

SEQ ID NO: 4892938 - DNA, 11 bp, Homo sapiens
cagtgtggaac

SEQ ID NO: 4892939 - DNA, 13 bp, Homo sapiens
cagtgtggagtgg

SEQ ID NO: 4892940 - DNA, 21 bp, Homo sapiens
cagtgttccccatctgggtcc

SEQ ID NO: 4892941 - DNA, 17 bp, Homo sapiens
cagtgttctatgaacaa

SEQ ID NO: 4892942 - DNA, 20 bp, Homo sapiens
cagtgttttaaactctccta

SEQ ID NO: 4892943 - DNA, 16 bp, Homo sapiens
cagtgttttaaattct

SEQ ID NO: 4892944 - DNA, 17 bp, Homo sapiens
cagtgttttaaattctg

SEQ ID NO: 4892945 - DNA, 21 bp, Homo sapiens
cagttaactattgcatttata

SEQ ID NO: 4892946 - DNA, 21 bp, Homo sapiens
cagttataagtagcaggccaa

SEQ ID NO: 4892947 - DNA, 16 bp, Homo sapiens
cagttatgttcagtca

SEQ ID NO: 4892948 - DNA, 17 bp, Homo sapiens
cagttattcattctgtg

SEQ ID NO: 4892949 - DNA, 17 bp, Homo sapiens
cagttattttgataaca

SEQ ID NO: 4892950 - DNA, 15 bp, Homo sapiens
cagttcacaccctgc

SEQ ID NO: 4892951 - DNA, 18 bp, Homo sapiens
cagttcacaccctgcaag

SEQ ID NO: 4892952 - DNA, 16 bp, Homo sapiens
cagttcagcaccaccc

SEQ ID NO: 4892953 - DNA, 18 bp, Homo sapiens
cagttcattgcactttga

SEQ ID NO: 4892954 - DNA, 12 bp, Homo sapiens
cagttccaagaa

SEQ ID NO: 4892955 - DNA, 16 bp, Homo sapiens
cagttccaagaaagat

SEQ ID NO: 4892956 - DNA, 13 bp, Homo sapiens
cagttcccttggc

SEQ ID NO: 4892957 - DNA, 20 bp, Homo sapiens
cagttcccttggcctcagaa

SEQ ID NO: 4892958 - DNA, 12 bp, Homo sapiens
cagttcttagcc

SEQ ID NO: 4892959 - DNA, 20 bp, Homo sapiens
cagttgaatgacaacagaag

SEQ ID NO: 4892960 - DNA, 21 bp, Homo sapiens
cagttgaatgacaacagaagc

SEQ ID NO: 4892961 - DNA, 20 bp, Homo sapiens
cagttgagtcgtcatcactt

SEQ ID NO: 4892962 - DNA, 15 bp, Homo sapiens
cagttgccaccacct

SEQ ID NO: 4892963 - DNA, 21 bp, Homo sapiens
cagttgccaccacctctgtgg

SEQ ID NO: 4892964 - DNA, 16 bp, Homo sapiens
cagttggccttcagaa

SEQ ID NO: 4892965 - DNA, 16 bp, Homo sapiens
cagttgggtggatgcc

SEQ ID NO: 4892966 - DNA, 18 bp, Homo sapiens
cagttgtttgtttttgct

SEQ ID NO: 4892967 - DNA, 21 bp, Homo sapiens
cagttgtttgtttttgcttgt

SEQ ID NO: 4892968 - DNA, 18 bp, Homo sapiens
cagtttatcatgaagcct

SEQ ID NO: 4892969 - DNA, 15 bp, Homo sapiens
cagtttcttagcttt

SEQ ID NO: 4892970 - DNA, 21 bp, Homo sapiens
cagtttgctttgtatgcactt

SEQ ID NO: 4892971 - DNA, 14 bp, Homo sapiens
cagtttgtaaatgt

SEQ ID NO: 4892972 - DNA, 21 bp, Homo sapiens
cagtttgtaaatgttatttct

SEQ ID NO: 4892973 - DNA, 21 bp, Homo sapiens
cagtttgtgtgtcttaattat

SEQ ID NO: 4892974 - DNA, 15 bp, Homo sapiens
cagttttatgctctt

SEQ ID NO: 4892975 - DNA, 19 bp, Homo sapiens
cagttttggtgtgtaactt

SEQ ID NO: 4892976 - DNA, 15 bp, Homo sapiens
cagtttttcaggagc

SEQ ID NO: 4892977 - DNA, 19 bp, Homo sapiens
cataaaaacattttaaaaa

SEQ ID NO: 4892978 - DNA, 13 bp, Homo sapiens
cataaaaaggaca

SEQ ID NO: 4892979 - DNA, 22 bp, Homo sapiens
cataaaaaggacatcagcaaac

SEQ ID NO: 4892980 - DNA, 12 bp, Homo sapiens
cataaagtactt

SEQ ID NO: 4892981 - DNA, 18 bp, Homo sapiens
cataaagttagaatctat

SEQ ID NO: 4892982 - DNA, 12 bp, Homo sapiens
cataaatatgca

SEQ ID NO: 4892983 - DNA, 15 bp, Homo sapiens
cataaatatgcagtg

SEQ ID NO: 4892984 - DNA, 13 bp, Homo sapiens
cataacagtgcag

SEQ ID NO: 4892985 - DNA, 15 bp, Homo sapiens
cataacagtgcaggg

SEQ ID NO: 4892986 - DNA, 16 bp, Homo sapiens
cataacagtgcagggc

SEQ ID NO: 4892987 - DNA, 21 bp, Homo sapiens
cataacgtttttcctttaaaa

SEQ ID NO: 4892988 - DNA, 22 bp, Homo sapiens
cataactctgtaaaaacactga

SEQ ID NO: 4892989 - DNA, 12 bp, Homo sapiens
cataactgcctt

SEQ ID NO: 4892990 - DNA, 19 bp, Homo sapiens
cataacttattgctgattt

SEQ ID NO: 4892991 - DNA, 22 bp, Homo sapiens
cataacttattgctgattttaa

SEQ ID NO: 4892992 - DNA, 19 bp, Homo sapiens
cataagcggcgtaagttta

SEQ ID NO: 4892993 - DNA, 21 bp, Homo sapiens
cataaggccagtatgatttat

SEQ ID NO: 4892994 - DNA, 15 bp, Homo sapiens
cataaggcttcaaaa

SEQ ID NO: 4892995 - DNA, 15 bp, Homo sapiens
cataaggtttcgttt

SEQ ID NO: 4892996 - DNA, 16 bp, Homo sapiens
cataagtgaatttata

SEQ ID NO: 4892997 - DNA, 20 bp, Homo sapiens
cataatctggactcctctgt

SEQ ID NO: 4892998 - DNA, 21 bp, Homo sapiens
cataatctggactcctctgtc

SEQ ID NO: 4892999 - DNA, 18 bp, Homo sapiens
cataatgctaatttaaag

SEQ ID NO: 4893000 - DNA, 15 bp, Homo sapiens
cataatgctactgtc

SEQ ID NO: 4893001 - DNA, 19 bp, Homo sapiens
cataatgcttaatttctaa

SEQ ID NO: 4893002 - DNA, 16 bp, Homo sapiens
cataattcctacagca

SEQ ID NO: 4893003 - DNA, 18 bp, Homo sapiens
catacaaagcgtgcacaa

SEQ ID NO: 4893004 - DNA, 19 bp, Homo sapiens
catacactaaccaaatctc

SEQ ID NO: 4893005 - DNA, 16 bp, Homo sapiens
catacacttgtataaa

SEQ ID NO: 4893006 - DNA, 21 bp, Homo sapiens
catacatcagttattcattct

SEQ ID NO: 4893007 - DNA, 16 bp, Homo sapiens
catacattaattaata

SEQ ID NO: 4893008 - DNA, 22 bp, Homo sapiens
catacctcagaatgtaaaagaa

SEQ ID NO: 4893009 - DNA, 22 bp, Homo sapiens
catactactgaaacagatttca

SEQ ID NO: 4893010 - DNA, 17 bp, Homo sapiens
catactcagcctgctgc

SEQ ID NO: 4893011 - DNA, 19 bp, Homo sapiens
catactcagcctgctgccc

SEQ ID NO: 4893012 - DNA, 20 bp, Homo sapiens
catactcatttctaaaagaa

SEQ ID NO: 4893013 - DNA, 21 bp, Homo sapiens
catactcatttctaaaagaat

SEQ ID NO: 4893014 - DNA, 22 bp, Homo sapiens
catactgagccaagtataattt

SEQ ID NO: 4893015 - DNA, 15 bp, Homo sapiens
catactgagggacca

SEQ ID NO: 4893016 - DNA, 15 bp, Homo sapiens
catactggcctggac

SEQ ID NO: 4893017 - DNA, 13 bp, Homo sapiens
catactttgtctg

SEQ ID NO: 4893018 - DNA, 18 bp, Homo sapiens
catactttgtctgaaaaa

SEQ ID NO: 4893019 - DNA, 16 bp, Homo sapiens
catagaaacatgacac

SEQ ID NO: 4893020 - DNA, 15 bp, Homo sapiens
catagaactgggtaa

SEQ ID NO: 4893021 - DNA, 20 bp, Homo sapiens
catagaactgggtaaatgca

SEQ ID NO: 4893022 - DNA, 23 bp, Homo sapiens
catagaactgggtaaatgcaaag

SEQ ID NO: 4893023 - DNA, 23 bp, Homo sapiens
catagagtgactccaagaacaat

SEQ ID NO: 4893024 - DNA, 18 bp, Homo sapiens
catagagtttaacacaag

SEQ ID NO: 4893025 - DNA, 14 bp, Homo sapiens
catagatattttca

SEQ ID NO: 4893026 - DNA, 20 bp, Homo sapiens
catagattaatggcactgat

SEQ ID NO: 4893027 - DNA, 16 bp, Homo sapiens
catagatttatttttc

SEQ ID NO: 4893028 - DNA, 21 bp, Homo sapiens
catagatttatttttcagttc

SEQ ID NO: 4893029 - DNA, 23 bp, Homo sapiens
catagcagagaatgaaagggccc

SEQ ID NO: 4893030 - DNA, 16 bp, Homo sapiens
catagcccatccctgc

SEQ ID NO: 4893031 - DNA, 20 bp, Homo sapiens
catagcttattattgaagga

SEQ ID NO: 4893032 - DNA, 18 bp, Homo sapiens
catagtgatggttcccct

SEQ ID NO: 4893033 - DNA, 19 bp, Homo sapiens
catagtgatggttcccctg

SEQ ID NO: 4893034 - DNA, 17 bp, Homo sapiens
catagtgctgggatgga

SEQ ID NO: 4893035 - DNA, 19 bp, Homo sapiens
catagttttaaactcattt

SEQ ID NO: 4893036 - DNA, 19 bp, Homo sapiens
catataaacatcacacaca

SEQ ID NO: 4893037 - DNA, 20 bp, Homo sapiens
catataaacatcacacacac

SEQ ID NO: 4893038 - DNA, 15 bp, Homo sapiens
catataagtttgaag

SEQ ID NO: 4893039 - DNA, 24 bp, Homo sapiens
catataagtttgaaggaaacagtt

SEQ ID NO: 4893040 - DNA, 15 bp, Homo sapiens
catatacctataatg

SEQ ID NO: 4893041 - DNA, 17 bp, Homo sapiens
catatacctataatgtg

SEQ ID NO: 4893042 - DNA, 23 bp, Homo sapiens
catatacctataatgtgtgtatg

SEQ ID NO: 4893043 - DNA, 14 bp, Homo sapiens
catatagagatgaa

SEQ ID NO: 4893044 - DNA, 23 bp, Homo sapiens
catatatatgttttaagaggcag

SEQ ID NO: 4893045 - DNA, 17 bp, Homo sapiens
catatatgaggacttgt

SEQ ID NO: 4893046 - DNA, 17 bp, Homo sapiens
catatcgctgacttcat

SEQ ID NO: 4893047 - DNA, 20 bp, Homo sapiens
catatcttaaagaaacagct

SEQ ID NO: 4893048 - DNA, 20 bp, Homo sapiens
catatcttgcgaatccaagc

SEQ ID NO: 4893049 - DNA, 21 bp, Homo sapiens
catatcttgcgaatccaagct

SEQ ID NO: 4893050 - DNA, 20 bp, Homo sapiens
catatgactcacatgatgca

SEQ ID NO: 4893051 - DNA, 22 bp, Homo sapiens
catatgactcacatgatgcata

SEQ ID NO: 4893052 - DNA, 22 bp, Homo sapiens
catatgagccgtgaactgtgca

SEQ ID NO: 4893053 - DNA, 23 bp, Homo sapiens
catatgctgtatatcctttctaa

SEQ ID NO: 4893054 - DNA, 15 bp, Homo sapiens
catatggactctgca

SEQ ID NO: 4893055 - DNA, 18 bp, Homo sapiens
catatggactctgcacat

SEQ ID NO: 4893056 - DNA, 20 bp, Homo sapiens
catatggactctgcacatga

SEQ ID NO: 4893057 - DNA, 19 bp, Homo sapiens
catatgtagactatataca

SEQ ID NO: 4893058 - DNA, 16 bp, Homo sapiens
catatgtcactagaat

SEQ ID NO: 4893059 - DNA, 20 bp, Homo sapiens
catatgtgatctgtcttgta

SEQ ID NO: 4893060 - DNA, 22 bp, Homo sapiens
catatgtgatctgtcttgtaat

SEQ ID NO: 4893061 - DNA, 17 bp, Homo sapiens
catatgttgaatacttt

SEQ ID NO: 4893062 - DNA, 14 bp, Homo sapiens
catattcattcatg

SEQ ID NO: 4893063 - DNA, 17 bp, Homo sapiens
catattctaaaaccatt

SEQ ID NO: 4893064 - DNA, 15 bp, Homo sapiens
catattctgttggaa

SEQ ID NO: 4893065 - DNA, 22 bp, Homo sapiens
catattctgttggccagtgtga

SEQ ID NO: 4893066 - DNA, 20 bp, Homo sapiens
catattcttttctgcaaaat

SEQ ID NO: 4893067 - DNA, 16 bp, Homo sapiens
catattgaatgtttcc

SEQ ID NO: 4893068 - DNA, 13 bp, Homo sapiens
catattgatgaaa

SEQ ID NO: 4893069 - DNA, 14 bp, Homo sapiens
catattgatgaaaa

SEQ ID NO: 4893070 - DNA, 15 bp, Homo sapiens
catattgatgaaaag

SEQ ID NO: 4893071 - DNA, 13 bp, Homo sapiens
catattgtgccaa

SEQ ID NO: 4893072 - DNA, 20 bp, Homo sapiens
catattgtgccaatatgtat

SEQ ID NO: 4893073 - DNA, 17 bp, Homo sapiens
catatttatccatttgt

SEQ ID NO: 4893074 - DNA, 18 bp, Homo sapiens
catatttattttcttttg

SEQ ID NO: 4893075 - DNA, 14 bp, Homo sapiens
catatttgtggaat

SEQ ID NO: 4893076 - DNA, 13 bp, Homo sapiens
catattttcacag

SEQ ID NO: 4893077 - DNA, 15 bp, Homo sapiens
catcaaaatgctttt

SEQ ID NO: 4893078 - DNA, 14 bp, Homo sapiens
catcaattcccatt

SEQ ID NO: 4893079 - DNA, 12 bp, Homo sapiens
catcacacacac

SEQ ID NO: 4893080 - DNA, 19 bp, Homo sapiens
catcaccgacgcgtctcct

SEQ ID NO: 4893081 - DNA, 16 bp, Homo sapiens
catcactctgctgctt

SEQ ID NO: 4893082 - DNA, 14 bp, Homo sapiens
catcacttgtacaa

SEQ ID NO: 4893083 - DNA, 12 bp, Homo sapiens
catcagggcctg

SEQ ID NO: 4893084 - DNA, 18 bp, Homo sapiens
catcagggggaagaagca

SEQ ID NO: 4893085 - DNA, 19 bp, Homo sapiens
catcagttcctttgtgtgt

SEQ ID NO: 4893086 - DNA, 20 bp, Homo sapiens
catcatagtaaaagaaatga

SEQ ID NO: 4893087 - DNA, 14 bp, Homo sapiens
catcatcagggcct

SEQ ID NO: 4893088 - DNA, 15 bp, Homo sapiens
catcatcagggcctg

SEQ ID NO: 4893089 - DNA, 13 bp, Homo sapiens
catcatgcagctc

SEQ ID NO: 4893090 - DNA, 12 bp, Homo sapiens
catcatgcatgt

SEQ ID NO: 4893091 - DNA, 17 bp, Homo sapiens
catcattacccttccct

SEQ ID NO: 4893092 - DNA, 20 bp, Homo sapiens
catcattacccttccctgca

SEQ ID NO: 4893093 - DNA, 22 bp, Homo sapiens
catcattacccttccctgcact

SEQ ID NO: 4893094 - DNA, 14 bp, Homo sapiens
catcattagaacaa

SEQ ID NO: 4893095 - DNA, 14 bp, Homo sapiens
catccaactccagc

SEQ ID NO: 4893096 - DNA, 16 bp, Homo sapiens
catccaactccagcaa

SEQ ID NO: 4893097 - DNA, 18 bp, Homo sapiens
catccaccgctgctccac

SEQ ID NO: 4893098 - DNA, 14 bp, Homo sapiens
catccactctaccc

SEQ ID NO: 4893099 - DNA, 17 bp, Homo sapiens
catccactctaccctcc

SEQ ID NO: 4893100 - DNA, 14 bp, Homo sapiens
catccactgtgcca

SEQ ID NO: 4893101 - DNA, 12 bp, Homo sapiens
catccagcaaga

SEQ ID NO: 4893102 - DNA, 13 bp, Homo sapiens
catccagcaagaa

SEQ ID NO: 4893103 - DNA, 18 bp, Homo sapiens
catccatagtagtatgat

SEQ ID NO: 4893104 - DNA, 18 bp, Homo sapiens
catccatgtcctatgtgt

SEQ ID NO: 4893105 - DNA, 17 bp, Homo sapiens
catcccaaccagtgcca

SEQ ID NO: 4893106 - DNA, 17 bp, Homo sapiens
catcccagacaggtccc

SEQ ID NO: 4893107 - DNA, 23 bp, Homo sapiens
catcccagacaggtccctcccct

SEQ ID NO: 4893108 - DNA, 13 bp, Homo sapiens
catcccagcccca

SEQ ID NO: 4893109 - DNA, 21 bp, Homo sapiens
catcccaggacaccacaccca

SEQ ID NO: 4893110 - DNA, 23 bp, Homo sapiens
catcccaggacaccacacccagc

SEQ ID NO: 4893111 - DNA, 20 bp, Homo sapiens
catcccatctaagctgcagc

SEQ ID NO: 4893112 - DNA, 21 bp, Homo sapiens
catcccatctaagctgcagct

SEQ ID NO: 4893113 - DNA, 21 bp, Homo sapiens
catccccaaaacaaagtcttt

SEQ ID NO: 4893114 - DNA, 12 bp, Homo sapiens
catccccagggg

SEQ ID NO: 4893115 - DNA, 18 bp, Homo sapiens
catccccaggggtcccag

SEQ ID NO: 4893116 - DNA, 14 bp, Homo sapiens
catcccctggactg

SEQ ID NO: 4893117 - DNA, 17 bp, Homo sapiens
catcccggaggaaatct

SEQ ID NO: 4893118 - DNA, 18 bp, Homo sapiens
catcccggaggaaatctg

SEQ ID NO: 4893119 - DNA, 14 bp, Homo sapiens
catcccgtgttctc

SEQ ID NO: 4893120 - DNA, 16 bp, Homo sapiens
catcccgtgttctcct

SEQ ID NO: 4893121 - DNA, 21 bp, Homo sapiens
catcccgtgttctccttttcc

SEQ ID NO: 4893122 - DNA, 22 bp, Homo sapiens
catccctaccccctaagagcca

SEQ ID NO: 4893123 - DNA, 16 bp, Homo sapiens
catcctaaaagccacc

SEQ ID NO: 4893124 - DNA, 17 bp, Homo sapiens
catcctaagaaatatgt

SEQ ID NO: 4893125 - DNA, 16 bp, Homo sapiens
catcctcctggaacct

SEQ ID NO: 4893126 - DNA, 22 bp, Homo sapiens
catcctcctggaaccttgctgt

SEQ ID NO: 4893127 - DNA, 11 bp, Homo sapiens
catcctctttc

SEQ ID NO: 4893128 - DNA, 20 bp, Homo sapiens
catcctgactctgccccctg

SEQ ID NO: 4893129 - DNA, 22 bp, Homo sapiens
catcctgactctgccccctgct

SEQ ID NO: 4893130 - DNA, 19 bp, Homo sapiens
catcctgagccccgccctc

SEQ ID NO: 4893131 - DNA, 22 bp, Homo sapiens
catcctgagccccgccctcttc

SEQ ID NO: 4893132 - DNA, 14 bp, Homo sapiens
catcctgccagccc

SEQ ID NO: 4893133 - DNA, 17 bp, Homo sapiens
catcctgccagccccac

SEQ ID NO: 4893134 - DNA, 23 bp, Homo sapiens
catcctggcacccggcccctgct

SEQ ID NO: 4893135 - DNA, 12 bp, Homo sapiens
catcctgggtaa

SEQ ID NO: 4893136 - DNA, 11 bp, Homo sapiens
catccttaaag

SEQ ID NO: 4893137 - DNA, 19 bp, Homo sapiens
catccttggtctttgtatc

SEQ ID NO: 4893138 - DNA, 16 bp, Homo sapiens
catcctttgcagggca

SEQ ID NO: 4893139 - DNA, 19 bp, Homo sapiens
catcctttgcagggcagcc

SEQ ID NO: 4893140 - DNA, 20 bp, Homo sapiens
catcgaaaattcatttcaca

SEQ ID NO: 4893141 - DNA, 21 bp, Homo sapiens
catcgccaactaagcgaggca

SEQ ID NO: 4893142 - DNA, 16 bp, Homo sapiens
catctaagctgcagct

SEQ ID NO: 4893143 - DNA, 20 bp, Homo sapiens
catctaagctgcagcttcct

SEQ ID NO: 4893144 - DNA, 17 bp, Homo sapiens
catctaggtaattttta

SEQ ID NO: 4893145 - DNA, 14 bp, Homo sapiens
catctataaagaag

SEQ ID NO: 4893146 - DNA, 14 bp, Homo sapiens
catctataaattgt

SEQ ID NO: 4893147 - DNA, 23 bp, Homo sapiens
catctattttgatgcagcatttg

SEQ ID NO: 4893148 - DNA, 14 bp, Homo sapiens
catctattttggat

SEQ ID NO: 4893149 - DNA, 23 bp, Homo sapiens
catctcatgtatcatctggatag

SEQ ID NO: 4893150 - DNA, 22 bp, Homo sapiens
catctcccttcctgtgggagca

SEQ ID NO: 4893151 - DNA, 15 bp, Homo sapiens
catctcggagcatcc

SEQ ID NO: 4893152 - DNA, 16 bp, Homo sapiens
catctctccctcccct

SEQ ID NO: 4893153 - DNA, 20 bp, Homo sapiens
catctctccctcccctgcca

SEQ ID NO: 4893154 - DNA, 15 bp, Homo sapiens
catctcttgaggcca

SEQ ID NO: 4893155 - DNA, 14 bp, Homo sapiens
catctgaaagtaga

SEQ ID NO: 4893156 - DNA, 15 bp, Homo sapiens
catctgaagagcaga

SEQ ID NO: 4893157 - DNA, 18 bp, Homo sapiens
catctgatgccgtgatcc

SEQ ID NO: 4893158 - DNA, 18 bp, Homo sapiens
catctgcacccttctttt

SEQ ID NO: 4893159 - DNA, 22 bp, Homo sapiens
catctgcacccttcttttctca

SEQ ID NO: 4893160 - DNA, 19 bp, Homo sapiens
catctgcattttcacccca

SEQ ID NO: 4893161 - DNA, 20 bp, Homo sapiens
catctgcattttcaccccac

SEQ ID NO: 4893162 - DNA, 21 bp, Homo sapiens
catctggaatctggagaccag

SEQ ID NO: 4893163 - DNA, 16 bp, Homo sapiens
catctggataggagcc

SEQ ID NO: 4893164 - DNA, 14 bp, Homo sapiens
catctggcctggcc

SEQ ID NO: 4893165 - DNA, 15 bp, Homo sapiens
catctggcctggcct

SEQ ID NO: 4893166 - DNA, 17 bp, Homo sapiens
catctggcctggcctgg

SEQ ID NO: 4893167 - DNA, 21 bp, Homo sapiens
catctggcctggcctggccct

SEQ ID NO: 4893168 - DNA, 22 bp, Homo sapiens
catctggcttattttaatgtga

SEQ ID NO: 4893169 - DNA, 12 bp, Homo sapiens
catctgttgttt

SEQ ID NO: 4893170 - DNA, 19 bp, Homo sapiens
catcttacttgagccttta

SEQ ID NO: 4893171 - DNA, 20 bp, Homo sapiens
catcttattttcatgtatat

SEQ ID NO: 4893172 - DNA, 13 bp, Homo sapiens
catcttgctctgc

SEQ ID NO: 4893173 - DNA, 14 bp, Homo sapiens
catcttgctctgct

SEQ ID NO: 4893174 - DNA, 16 bp, Homo sapiens
catcttgctctgctga

SEQ ID NO: 4893175 - DNA, 16 bp, Homo sapiens
catcttggagggacca

SEQ ID NO: 4893176 - DNA, 23 bp, Homo sapiens
catcttgtaatttccagctttct

SEQ ID NO: 4893177 - DNA, 17 bp, Homo sapiens
catcttgtatacacata

SEQ ID NO: 4893178 - DNA, 13 bp, Homo sapiens
catcttgtgaaat

SEQ ID NO: 4893179 - DNA, 15 bp, Homo sapiens
catctttgccttggg

SEQ ID NO: 4893180 - DNA, 22 bp, Homo sapiens
catctttgccttgggctgctcc

SEQ ID NO: 4893181 - DNA, 23 bp, Homo sapiens
catctttgccttgggctgctcct

SEQ ID NO: 4893182 - DNA, 21 bp, Homo sapiens
catctttttaaagcttatcca

SEQ ID NO: 4893183 - DNA, 22 bp, Homo sapiens
catctttttaaagcttatccat

SEQ ID NO: 4893184 - DNA, 17 bp, Homo sapiens
catgaaaattttaaaaa

SEQ ID NO: 4893185 - DNA, 13 bp, Homo sapiens
catgaaacaaagc

SEQ ID NO: 4893186 - DNA, 19 bp, Homo sapiens
catgaaacagaaacaaaaa

SEQ ID NO: 4893187 - DNA, 22 bp, Homo sapiens
catgaaagtagcagtgtgaagt

SEQ ID NO: 4893188 - DNA, 14 bp, Homo sapiens
catgaagacaggat

SEQ ID NO: 4893189 - DNA, 12 bp, Homo sapiens
catgaagagaag

SEQ ID NO: 4893190 - DNA, 15 bp, Homo sapiens
catgaagagaagcaa

SEQ ID NO: 4893191 - DNA, 16 bp, Homo sapiens
catgaagagaagcaat

SEQ ID NO: 4893192 - DNA, 13 bp, Homo sapiens
catgaagcctgtg

SEQ ID NO: 4893193 - DNA, 16 bp, Homo sapiens
catgaagcctgtggat

SEQ ID NO: 4893194 - DNA, 11 bp, Homo sapiens
catgaagcctt

SEQ ID NO: 4893195 - DNA, 19 bp, Homo sapiens
catgaagccttttgaaagg

SEQ ID NO: 4893196 - DNA, 18 bp, Homo sapiens
catgaattcttatgctta

SEQ ID NO: 4893197 - DNA, 23 bp, Homo sapiens
catgacacccgtgagcgcctgtg

SEQ ID NO: 4893198 - DNA, 12 bp, Homo sapiens
catgacactgac

SEQ ID NO: 4893199 - DNA, 15 bp, Homo sapiens
catgacatgttatat

SEQ ID NO: 4893200 - DNA, 23 bp, Homo sapiens
catgactcgtatatgtctcaggt

SEQ ID NO: 4893201 - DNA, 21 bp, Homo sapiens
catgacttgtagcatattctt

SEQ ID NO: 4893202 - DNA, 20 bp, Homo sapiens
catgagcctcagcatcctgg

SEQ ID NO: 4893203 - DNA, 22 bp, Homo sapiens
catgaggcaatgtcaggaacag

SEQ ID NO: 4893204 - DNA, 11 bp, Homo sapiens
catgatgcagt

SEQ ID NO: 4893205 - DNA, 14 bp, Homo sapiens
catgatgcagtctc

SEQ ID NO: 4893206 - DNA, 14 bp, Homo sapiens
catgatttccttga

SEQ ID NO: 4893207 - DNA, 16 bp, Homo sapiens
catgatttccttgaat

SEQ ID NO: 4893208 - DNA, 18 bp, Homo sapiens
catgcaatttattaaaat

SEQ ID NO: 4893209 - DNA, 11 bp, Homo sapiens
catgcacacac

SEQ ID NO: 4893210 - DNA, 12 bp, Homo sapiens
catgcaccaaac

SEQ ID NO: 4893211 - DNA, 19 bp, Homo sapiens
catgcagcccatgcccacc

SEQ ID NO: 4893212 - DNA, 13 bp, Homo sapiens
catgcaggccctt

SEQ ID NO: 4893213 - DNA, 18 bp, Homo sapiens
catgcagggggctcctgg

SEQ ID NO: 4893214 - DNA, 12 bp, Homo sapiens
catgcataaata

SEQ ID NO: 4893215 - DNA, 13 bp, Homo sapiens
catgcataaatat

SEQ ID NO: 4893216 - DNA, 15 bp, Homo sapiens
catgcataaatatgc

SEQ ID NO: 4893217 - DNA, 15 bp, Homo sapiens
catgcatgacagcct

SEQ ID NO: 4893218 - DNA, 21 bp, Homo sapiens
catgccagctacttcctcctc

SEQ ID NO: 4893219 - DNA, 16 bp, Homo sapiens
catgcccacctgccca

SEQ ID NO: 4893220 - DNA, 19 bp, Homo sapiens
catgcccacgttctttccc

SEQ ID NO: 4893221 - DNA, 17 bp, Homo sapiens
catgcccggtcccaccc

SEQ ID NO: 4893222 - DNA, 18 bp, Homo sapiens
catgcccggtcccacccc

SEQ ID NO: 4893223 - DNA, 22 bp, Homo sapiens
catgcctctgatatgggactga

SEQ ID NO: 4893224 - DNA, 17 bp, Homo sapiens
catgcctgtccagcctg

SEQ ID NO: 4893225 - DNA, 18 bp, Homo sapiens
catgcctgtccagcctgg

SEQ ID NO: 4893226 - DNA, 20 bp, Homo sapiens
catgcctgtccagcctgggc

SEQ ID NO: 4893227 - DNA, 21 bp, Homo sapiens
catgcctgtccagcctgggca

SEQ ID NO: 4893228 - DNA, 12 bp, Homo sapiens
catgccttgtgc

SEQ ID NO: 4893229 - DNA, 16 bp, Homo sapiens
catgctaagcaagcta

SEQ ID NO: 4893230 - DNA, 22 bp, Homo sapiens
catgctaagcaagctaacctta

SEQ ID NO: 4893231 - DNA, 22 bp, Homo sapiens
catgctatttgttcttcaagaa

SEQ ID NO: 4893232 - DNA, 17 bp, Homo sapiens
catgctcctcactgccc

SEQ ID NO: 4893233 - DNA, 19 bp, Homo sapiens
catgctgactgtcctctcc

SEQ ID NO: 4893234 - DNA, 12 bp, Homo sapiens
catgctgcctcc

SEQ ID NO: 4893235 - DNA, 14 bp, Homo sapiens
catgctgcctccag

SEQ ID NO: 4893236 - DNA, 15 bp, Homo sapiens
catgcttatgacaat

SEQ ID NO: 4893237 - DNA, 23 bp, Homo sapiens
catgcttctcatcttgtgaaatg

SEQ ID NO: 4893238 - DNA, 14 bp, Homo sapiens
catgcttcttcctt

SEQ ID NO: 4893239 - DNA, 18 bp, Homo sapiens
catggaaacctgaaaaaa

SEQ ID NO: 4893240 - DNA, 18 bp, Homo sapiens
catggacactccagtgcc

SEQ ID NO: 4893241 - DNA, 19 bp, Homo sapiens
catggacactccagtgcca

SEQ ID NO: 4893242 - DNA, 14 bp, Homo sapiens
catggaccactgtt

SEQ ID NO: 4893243 - DNA, 18 bp, Homo sapiens
catggaccactgtttctt

SEQ ID NO: 4893244 - DNA, 10 bp, Homo sapiens
catggagcca

SEQ ID NO: 4893245 - DNA, 21 bp, Homo sapiens
catggatttctgtcttctcta

SEQ ID NO: 4893246 - DNA, 17 bp, Homo sapiens
catggcagagtttgtgt

SEQ ID NO: 4893247 - DNA, 18 bp, Homo sapiens
catggcccctctgacctg

SEQ ID NO: 4893248 - DNA, 21 bp, Homo sapiens
catggctctggactctaaaga

SEQ ID NO: 4893249 - DNA, 21 bp, Homo sapiens
catgggaaaggaggcatgcct

SEQ ID NO: 4893250 - DNA, 22 bp, Homo sapiens
catgggaaaggaggcatgcctc

SEQ ID NO: 4893251 - DNA, 20 bp, Homo sapiens
catgggaaatgtcaacaagt

SEQ ID NO: 4893252 - DNA, 16 bp, Homo sapiens
catgggatacaacctc

SEQ ID NO: 4893253 - DNA, 21 bp, Homo sapiens
catgggatacaacctccctct

SEQ ID NO: 4893254 - DNA, 15 bp, Homo sapiens
catgggcctcctgtg

SEQ ID NO: 4893255 - DNA, 18 bp, Homo sapiens
catgggcctcctgtgtgt

SEQ ID NO: 4893256 - DNA, 24 bp, Homo sapiens
catgggcctggccacctctctcct

SEQ ID NO: 4893257 - DNA, 13 bp, Homo sapiens
catgggctcttca

SEQ ID NO: 4893258 - DNA, 13 bp, Homo sapiens
catgggcttcact

SEQ ID NO: 4893259 - DNA, 20 bp, Homo sapiens
catgggcttcactgtataaa

SEQ ID NO: 4893260 - DNA, 21 bp, Homo sapiens
catggggaaaaaaatcatcta

SEQ ID NO: 4893261 - DNA, 16 bp, Homo sapiens
catggtaccagccctg

SEQ ID NO: 4893262 - DNA, 17 bp, Homo sapiens
catggtaccagccctgg

SEQ ID NO: 4893263 - DNA, 16 bp, Homo sapiens
catggtcaaccctcag

SEQ ID NO: 4893264 - DNA, 17 bp, Homo sapiens
catggtcaaccctcagg

SEQ ID NO: 4893265 - DNA, 15 bp, Homo sapiens
catggtcacacactg

SEQ ID NO: 4893266 - DNA, 18 bp, Homo sapiens
catggtgcccctagcttt

SEQ ID NO: 4893267 - DNA, 13 bp, Homo sapiens
catggtgtaataa

SEQ ID NO: 4893268 - DNA, 19 bp, Homo sapiens
catggtgtaataagacata

SEQ ID NO: 4893269 - DNA, 13 bp, Homo sapiens
catggttaagagt

SEQ ID NO: 4893270 - DNA, 16 bp, Homo sapiens
catggttaagagtcca

SEQ ID NO: 4893271 - DNA, 19 bp, Homo sapiens
catggttaagagtccaaga

SEQ ID NO: 4893272 - DNA, 18 bp, Homo sapiens
catgtaaccggcatgttt

SEQ ID NO: 4893273 - DNA, 22 bp, Homo sapiens
catgtacctcccctgccttgct

SEQ ID NO: 4893274 - DNA, 21 bp, Homo sapiens
catgtagccccctggcctctg

SEQ ID NO: 4893275 - DNA, 16 bp, Homo sapiens
catgtaggaccctgca

SEQ ID NO: 4893276 - DNA, 15 bp, Homo sapiens
catgtataaatgtga

SEQ ID NO: 4893277 - DNA, 23 bp, Homo sapiens
catgtatttatctctatttaata

SEQ ID NO: 4893278 - DNA, 15 bp, Homo sapiens
catgtatttatgtaa

SEQ ID NO: 4893279 - DNA, 16 bp, Homo sapiens
catgtcaggcctgtgt

SEQ ID NO: 4893280 - DNA, 12 bp, Homo sapiens
catgtccaaaga

SEQ ID NO: 4893281 - DNA, 23 bp, Homo sapiens
catgtccctaccgagtctcttct

SEQ ID NO: 4893282 - DNA, 18 bp, Homo sapiens
catgtcctatgtgtgact

SEQ ID NO: 4893283 - DNA, 21 bp, Homo sapiens
catgtcctttgcgcctgtgac

SEQ ID NO: 4893284 - DNA, 14 bp, Homo sapiens
catgtcttgtacat

SEQ ID NO: 4893285 - DNA, 15 bp, Homo sapiens
catgtgcacatgcac

SEQ ID NO: 4893286 - DNA, 24 bp, Homo sapiens
catgtgccagggcaatgatgaatg

SEQ ID NO: 4893287 - DNA, 21 bp, Homo sapiens
catgtgccaggtttttggtct

SEQ ID NO: 4893288 - DNA, 22 bp, Homo sapiens
catgtggctgtagatcccaaga

SEQ ID NO: 4893289 - DNA, 21 bp, Homo sapiens
catgtggcttttttaaaaaag

SEQ ID NO: 4893290 - DNA, 22 bp, Homo sapiens
catgtgggaaaaaaatgaatga

SEQ ID NO: 4893291 - DNA, 19 bp, Homo sapiens
catgtgggtcttccagggg

SEQ ID NO: 4893292 - DNA, 20 bp, Homo sapiens
catgtggtttatagagggcc

SEQ ID NO: 4893293 - DNA, 22 bp, Homo sapiens
catgtggtttggttcctctctg

SEQ ID NO: 4893294 - DNA, 14 bp, Homo sapiens
catgtgtagcctgt

SEQ ID NO: 4893295 - DNA, 16 bp, Homo sapiens
catgtgtagcctgtgc

SEQ ID NO: 4893296 - DNA, 23 bp, Homo sapiens
catgtgtcaacacccctgtgtgg

SEQ ID NO: 4893297 - DNA, 18 bp, Homo sapiens
catgtgtcacttgtgctt

SEQ ID NO: 4893298 - DNA, 15 bp, Homo sapiens
catgtgtcctggttc

SEQ ID NO: 4893299 - DNA, 21 bp, Homo sapiens
catgtgtcctggttcccgttt

SEQ ID NO: 4893300 - DNA, 12 bp, Homo sapiens
catgtgtgtata

SEQ ID NO: 4893301 - DNA, 13 bp, Homo sapiens
catgtgtgtatat

SEQ ID NO: 4893302 - DNA, 14 bp, Homo sapiens
catgtgtgtatata

SEQ ID NO: 4893303 - DNA, 16 bp, Homo sapiens
catgtgtgtatatatg

SEQ ID NO: 4893304 - DNA, 13 bp, Homo sapiens
catgtgttccctt

SEQ ID NO: 4893305 - DNA, 22 bp, Homo sapiens
catgtgttccctttgtctttca

SEQ ID NO: 4893306 - DNA, 14 bp, Homo sapiens
catgttatatattt

SEQ ID NO: 4893307 - DNA, 20 bp, Homo sapiens
catgttatatttaatgcatt

SEQ ID NO: 4893308 - DNA, 13 bp, Homo sapiens
catgttctgcccc

SEQ ID NO: 4893309 - DNA, 16 bp, Homo sapiens
catgttctgcccccag

SEQ ID NO: 4893310 - DNA, 17 bp, Homo sapiens
catgttctgcccccagc

SEQ ID NO: 4893311 - DNA, 20 bp, Homo sapiens
catgttctgcccccagccca

SEQ ID NO: 4893312 - DNA, 21 bp, Homo sapiens
catgttctgcccccagcccaa

SEQ ID NO: 4893313 - DNA, 14 bp, Homo sapiens
catgttggccaggc

SEQ ID NO: 4893314 - DNA, 15 bp, Homo sapiens
catgttggccaggct

SEQ ID NO: 4893315 - DNA, 17 bp, Homo sapiens
catgttggccaggctgg

SEQ ID NO: 4893316 - DNA, 21 bp, Homo sapiens
catgttggccaggctggtcta

SEQ ID NO: 4893317 - DNA, 12 bp, Homo sapiens
catgttgtaatg

SEQ ID NO: 4893318 - DNA, 19 bp, Homo sapiens
catgttgtaatgctgcact

SEQ ID NO: 4893319 - DNA, 20 bp, Homo sapiens
catgttgtaatgctgcactt

SEQ ID NO: 4893320 - DNA, 15 bp, Homo sapiens
catgtttatgaaaat

SEQ ID NO: 4893321 - DNA, 16 bp, Homo sapiens
catgtttatgaaaata

SEQ ID NO: 4893322 - DNA, 19 bp, Homo sapiens
catgtttatgaaaataaat

SEQ ID NO: 4893323 - DNA, 13 bp, Homo sapiens
catgtttcatgtt

SEQ ID NO: 4893324 - DNA, 17 bp, Homo sapiens
catgtttcatgttttgt

SEQ ID NO: 4893325 - DNA, 22 bp, Homo sapiens
catgtttcatgttttgtgacta

SEQ ID NO: 4893326 - DNA, 14 bp, Homo sapiens
catgtttggaagac

SEQ ID NO: 4893327 - DNA, 17 bp, Homo sapiens
catgtttggtgcataga

SEQ ID NO: 4893328 - DNA, 14 bp, Homo sapiens
catgttttccgtga

SEQ ID NO: 4893329 - DNA, 12 bp, Homo sapiens
catgttttgtat

SEQ ID NO: 4893330 - DNA, 13 bp, Homo sapiens
catgttttgtata

SEQ ID NO: 4893331 - DNA, 19 bp, Homo sapiens
catgttttgtatacaaata

SEQ ID NO: 4893332 - DNA, 22 bp, Homo sapiens
cattaaaaaatgaaatattttt

SEQ ID NO: 4893333 - DNA, 15 bp, Homo sapiens
cattaaaaatggaac

SEQ ID NO: 4893334 - DNA, 14 bp, Homo sapiens
cattaaaactgctt

SEQ ID NO: 4893335 - DNA, 16 bp, Homo sapiens
cattaaaactgctttt

SEQ ID NO: 4893336 - DNA, 18 bp, Homo sapiens
cattaaatgaatattttg

SEQ ID NO: 4893337 - DNA, 22 bp, Homo sapiens
cattaaatgaatattttgataa

SEQ ID NO: 4893338 - DNA, 13 bp, Homo sapiens
cattaacacaaag

SEQ ID NO: 4893339 - DNA, 22 bp, Homo sapiens
cattaagaatgttggtttactt

SEQ ID NO: 4893340 - DNA, 21 bp, Homo sapiens
cattaagtaatcaataaagaa

SEQ ID NO: 4893341 - DNA, 22 bp, Homo sapiens
cattaatcaatcatctgtgtga

SEQ ID NO: 4893342 - DNA, 16 bp, Homo sapiens
cattacccttccctgc

SEQ ID NO: 4893343 - DNA, 13 bp, Homo sapiens
cattaccttactg

SEQ ID NO: 4893344 - DNA, 19 bp, Homo sapiens
cattaccttttaccagctt

SEQ ID NO: 4893345 - DNA, 22 bp, Homo sapiens
cattaccttttaccagctttta

SEQ ID NO: 4893346 - DNA, 13 bp, Homo sapiens
cattactgggcct

SEQ ID NO: 4893347 - DNA, 21 bp, Homo sapiens
cattagattttattttactat

SEQ ID NO: 4893348 - DNA, 16 bp, Homo sapiens
cattagcacagatttt

SEQ ID NO: 4893349 - DNA, 23 bp, Homo sapiens
cattagcacagattttaattgtc

SEQ ID NO: 4893350 - DNA, 17 bp, Homo sapiens
cattagcagtttgcttt

SEQ ID NO: 4893351 - DNA, 17 bp, Homo sapiens
cattagggatgcctcct

SEQ ID NO: 4893352 - DNA, 20 bp, Homo sapiens
cattagggatgcctcctttc

SEQ ID NO: 4893353 - DNA, 18 bp, Homo sapiens
cattaggttgtcctagaa

SEQ ID NO: 4893354 - DNA, 16 bp, Homo sapiens
cattagtaaatgtctt

SEQ ID NO: 4893355 - DNA, 19 bp, Homo sapiens
cattagtaaatgtctttgt

SEQ ID NO: 4893356 - DNA, 21 bp, Homo sapiens
cattagtaaatgtctttgtaa

SEQ ID NO: 4893357 - DNA, 22 bp, Homo sapiens
cattagtaaatgtctttgtaag

SEQ ID NO: 4893358 - DNA, 19 bp, Homo sapiens
cattatagattttcatgtt

SEQ ID NO: 4893359 - DNA, 21 bp, Homo sapiens
cattatgggttaggcattaat

SEQ ID NO: 4893360 - DNA, 17 bp, Homo sapiens
cattatgtccactgtgt

SEQ ID NO: 4893361 - DNA, 21 bp, Homo sapiens
cattatgtccactgtgtatag

SEQ ID NO: 4893362 - DNA, 22 bp, Homo sapiens
cattatgtccactgtgtataga

SEQ ID NO: 4893363 - DNA, 17 bp, Homo sapiens
cattatgtggttttaga

SEQ ID NO: 4893364 - DNA, 11 bp, Homo sapiens
cattatgtgtg

SEQ ID NO: 4893365 - DNA, 13 bp, Homo sapiens
cattatgtgtgca

SEQ ID NO: 4893366 - DNA, 19 bp, Homo sapiens
cattatgtgtgcatgtgtg

SEQ ID NO: 4893367 - DNA, 20 bp, Homo sapiens
cattatgtgtgcatgtgtgt

SEQ ID NO: 4893368 - DNA, 19 bp, Homo sapiens
cattattagtactgctctt

SEQ ID NO: 4893369 - DNA, 14 bp, Homo sapiens
cattattcatttag

SEQ ID NO: 4893370 - DNA, 12 bp, Homo sapiens
cattattctctt

SEQ ID NO: 4893371 - DNA, 15 bp, Homo sapiens
cattattttctgtca

SEQ ID NO: 4893372 - DNA, 22 bp, Homo sapiens
cattcacggagatatgaagagc

SEQ ID NO: 4893373 - DNA, 15 bp, Homo sapiens
cattcacttgcattt

SEQ ID NO: 4893374 - DNA, 18 bp, Homo sapiens
cattcacttgcatttctt

SEQ ID NO: 4893375 - DNA, 15 bp, Homo sapiens
cattcagagagcagc

SEQ ID NO: 4893376 - DNA, 16 bp, Homo sapiens
cattcagatcactgaa

SEQ ID NO: 4893377 - DNA, 21 bp, Homo sapiens
cattcagatcactgaatttat

SEQ ID NO: 4893378 - DNA, 13 bp, Homo sapiens
cattcatctcatt

SEQ ID NO: 4893379 - DNA, 19 bp, Homo sapiens
cattcatggaccactgttt

SEQ ID NO: 4893380 - DNA, 20 bp, Homo sapiens
cattcatttagctaaacgga

SEQ ID NO: 4893381 - DNA, 17 bp, Homo sapiens
cattccaaagctttatt

SEQ ID NO: 4893382 - DNA, 22 bp, Homo sapiens
cattccaccttcccatgccctg

SEQ ID NO: 4893383 - DNA, 14 bp, Homo sapiens
cattccattgccta

SEQ ID NO: 4893384 - DNA, 21 bp, Homo sapiens
cattccattgcctagctcttt

SEQ ID NO: 4893385 - DNA, 13 bp, Homo sapiens
cattccctcccat

SEQ ID NO: 4893386 - DNA, 18 bp, Homo sapiens
cattctatcaagcccagg

SEQ ID NO: 4893387 - DNA, 18 bp, Homo sapiens
cattctattgccttcttt

SEQ ID NO: 4893388 - DNA, 17 bp, Homo sapiens
cattctattttagaata

SEQ ID NO: 4893389 - DNA, 16 bp, Homo sapiens
cattctcactcctacc

SEQ ID NO: 4893390 - DNA, 19 bp, Homo sapiens
cattctcataattcctaca

SEQ ID NO: 4893391 - DNA, 14 bp, Homo sapiens
cattctcatctgca

SEQ ID NO: 4893392 - DNA, 15 bp, Homo sapiens
cattctcatctgcac

SEQ ID NO: 4893393 - DNA, 13 bp, Homo sapiens
cattctcattgca

SEQ ID NO: 4893394 - DNA, 22 bp, Homo sapiens
cattctcctgcctgtagcagtg

SEQ ID NO: 4893395 - DNA, 19 bp, Homo sapiens
cattctcgtgagtcattta

SEQ ID NO: 4893396 - DNA, 15 bp, Homo sapiens
cattctgcattgcta

SEQ ID NO: 4893397 - DNA, 20 bp, Homo sapiens
cattctgcattgctagataa

SEQ ID NO: 4893398 - DNA, 17 bp, Homo sapiens
cattctgcctgcccagg

SEQ ID NO: 4893399 - DNA, 19 bp, Homo sapiens
cattctgcctgcccaggcc

SEQ ID NO: 4893400 - DNA, 22 bp, Homo sapiens
cattcttacttactaaaatata

SEQ ID NO: 4893401 - DNA, 23 bp, Homo sapiens
cattcttacttactaaaatatat

SEQ ID NO: 4893402 - DNA, 13 bp, Homo sapiens
cattcttcctagt

SEQ ID NO: 4893403 - DNA, 18 bp, Homo sapiens
cattcttcctagttttct

SEQ ID NO: 4893404 - DNA, 23 bp, Homo sapiens
cattcttctgtacgtctgacagg

SEQ ID NO: 4893405 - DNA, 20 bp, Homo sapiens
cattgaaatgagcacctcca

SEQ ID NO: 4893406 - DNA, 14 bp, Homo sapiens
cattgaacacaaac

SEQ ID NO: 4893407 - DNA, 16 bp, Homo sapiens
cattgaacacaaactg

SEQ ID NO: 4893408 - DNA, 18 bp, Homo sapiens
cattgaacacaaactgta

SEQ ID NO: 4893409 - DNA, 21 bp, Homo sapiens
cattgacaaatctgtgtatat

SEQ ID NO: 4893410 - DNA, 17 bp, Homo sapiens
cattgacccatagcaca

SEQ ID NO: 4893411 - DNA, 21 bp, Homo sapiens
cattgaccgcgactaatttca

SEQ ID NO: 4893412 - DNA, 23 bp, Homo sapiens
cattgactggtttacaggccctg

SEQ ID NO: 4893413 - DNA, 18 bp, Homo sapiens
cattgagagttttgtctt

SEQ ID NO: 4893414 - DNA, 18 bp, Homo sapiens
cattgagctgatataaat

SEQ ID NO: 4893415 - DNA, 21 bp, Homo sapiens
cattgagctgatataaattct

SEQ ID NO: 4893416 - DNA, 14 bp, Homo sapiens
cattgagctgtgca

SEQ ID NO: 4893417 - DNA, 21 bp, Homo sapiens
cattgagtagacacatttaag

SEQ ID NO: 4893418 - DNA, 19 bp, Homo sapiens
cattgcattctattgcctt

SEQ ID NO: 4893419 - DNA, 16 bp, Homo sapiens
cattgccaccaggaga

SEQ ID NO: 4893420 - DNA, 16 bp, Homo sapiens
cattgcctagctcttt

SEQ ID NO: 4893421 - DNA, 17 bp, Homo sapiens
cattgcctggccttcct

SEQ ID NO: 4893422 - DNA, 15 bp, Homo sapiens
cattgcggacagcca

SEQ ID NO: 4893423 - DNA, 17 bp, Homo sapiens
cattgcggacagccacg

SEQ ID NO: 4893424 - DNA, 21 bp, Homo sapiens
cattgcggacagccacggcca

SEQ ID NO: 4893425 - DNA, 15 bp, Homo sapiens
cattgctagataaaa

SEQ ID NO: 4893426 - DNA, 14 bp, Homo sapiens
cattgctgagcctc

SEQ ID NO: 4893427 - DNA, 15 bp, Homo sapiens
cattgctgagcctct

SEQ ID NO: 4893428 - DNA, 16 bp, Homo sapiens
cattgctgagcctctg

SEQ ID NO: 4893429 - DNA, 19 bp, Homo sapiens
cattgcttttattttgaaa

SEQ ID NO: 4893430 - DNA, 21 bp, Homo sapiens
cattgcttttattttgaaaag

SEQ ID NO: 4893431 - DNA, 17 bp, Homo sapiens
cattggattatcctgag

SEQ ID NO: 4893432 - DNA, 15 bp, Homo sapiens
cattgtactacctgt

SEQ ID NO: 4893433 - DNA, 19 bp, Homo sapiens
cattgtagagcttctggca

SEQ ID NO: 4893434 - DNA, 18 bp, Homo sapiens
cattgtatgatgtgttgt

SEQ ID NO: 4893435 - DNA, 17 bp, Homo sapiens
cattgtatgtatctatt

SEQ ID NO: 4893436 - DNA, 20 bp, Homo sapiens
cattgtccctcttcactccc

SEQ ID NO: 4893437 - DNA, 16 bp, Homo sapiens
cattgtgttgacatta

SEQ ID NO: 4893438 - DNA, 19 bp, Homo sapiens
cattgtgttgacattaaga

SEQ ID NO: 4893439 - DNA, 15 bp, Homo sapiens
cattgttatttatac

SEQ ID NO: 4893440 - DNA, 16 bp, Homo sapiens
cattgttttgaatatt

SEQ ID NO: 4893441 - DNA, 18 bp, Homo sapiens
cattgttttgaatattac

SEQ ID NO: 4893442 - DNA, 19 bp, Homo sapiens
catttaaaattgctatgtt

SEQ ID NO: 4893443 - DNA, 20 bp, Homo sapiens
catttaaaattgctatgtta

SEQ ID NO: 4893444 - DNA, 14 bp, Homo sapiens
catttaaagcattg

SEQ ID NO: 4893445 - DNA, 16 bp, Homo sapiens
catttaaagcattgct

SEQ ID NO: 4893446 - DNA, 18 bp, Homo sapiens
catttaaagcattgctgt

SEQ ID NO: 4893447 - DNA, 16 bp, Homo sapiens
catttaaatgtgtaca

SEQ ID NO: 4893448 - DNA, 20 bp, Homo sapiens
catttaaatgtgtacaatgt

SEQ ID NO: 4893449 - DNA, 21 bp, Homo sapiens
catttaaatgtgtacaatgta

SEQ ID NO: 4893450 - DNA, 23 bp, Homo sapiens
catttaaattttaccctttagac

SEQ ID NO: 4893451 - DNA, 22 bp, Homo sapiens
catttaaggatggggttatgaa

SEQ ID NO: 4893452 - DNA, 19 bp, Homo sapiens
catttaatttagtgatctt

SEQ ID NO: 4893453 - DNA, 21 bp, Homo sapiens
catttactaaacatatgattt

SEQ ID NO: 4893454 - DNA, 15 bp, Homo sapiens
catttagaaaataga

SEQ ID NO: 4893455 - DNA, 14 bp, Homo sapiens
catttattctgctc

SEQ ID NO: 4893456 - DNA, 15 bp, Homo sapiens
catttattctgctca

SEQ ID NO: 4893457 - DNA, 15 bp, Homo sapiens
catttattttaagca

SEQ ID NO: 4893458 - DNA, 21 bp, Homo sapiens
catttattttaagcactctta

SEQ ID NO: 4893459 - DNA, 12 bp, Homo sapiens
catttcacatta

SEQ ID NO: 4893460 - DNA, 15 bp, Homo sapiens
catttcataaactaa

SEQ ID NO: 4893461 - DNA, 18 bp, Homo sapiens
catttcatcattgtttct

SEQ ID NO: 4893462 - DNA, 22 bp, Homo sapiens
catttcatgctctgcaaaagga

SEQ ID NO: 4893463 - DNA, 13 bp, Homo sapiens
catttcattccat

SEQ ID NO: 4893464 - DNA, 18 bp, Homo sapiens
catttcattccattgcct

SEQ ID NO: 4893465 - DNA, 21 bp, Homo sapiens
catttcattccattgcctagc

SEQ ID NO: 4893466 - DNA, 16 bp, Homo sapiens
catttcattgtatgat

SEQ ID NO: 4893467 - DNA, 18 bp, Homo sapiens
catttccaacaccacaga

SEQ ID NO: 4893468 - DNA, 13 bp, Homo sapiens
catttcctgacag

SEQ ID NO: 4893469 - DNA, 19 bp, Homo sapiens
catttcctgagaccacaga

SEQ ID NO: 4893470 - DNA, 12 bp, Homo sapiens
catttcctgtgt

SEQ ID NO: 4893471 - DNA, 14 bp, Homo sapiens
catttctaaaagaa

SEQ ID NO: 4893472 - DNA, 12 bp, Homo sapiens
catttcttagac

SEQ ID NO: 4893473 - DNA, 23 bp, Homo sapiens
catttcttgtgatgttttgagag

SEQ ID NO: 4893474 - DNA, 19 bp, Homo sapiens
catttgaagtgtacctgtg

SEQ ID NO: 4893475 - DNA, 14 bp, Homo sapiens
catttgagcagggc

SEQ ID NO: 4893476 - DNA, 20 bp, Homo sapiens
catttgagcagggctcagcg

SEQ ID NO: 4893477 - DNA, 14 bp, Homo sapiens
catttgataatgat

SEQ ID NO: 4893478 - DNA, 17 bp, Homo sapiens
catttgataatgataaa

SEQ ID NO: 4893479 - DNA, 17 bp, Homo sapiens
catttgatacccctggg

SEQ ID NO: 4893480 - DNA, 16 bp, Homo sapiens
catttgatttttctaa

SEQ ID NO: 4893481 - DNA, 21 bp, Homo sapiens
catttgcactggagttctatg

SEQ ID NO: 4893482 - DNA, 12 bp, Homo sapiens
catttgccttgc

SEQ ID NO: 4893483 - DNA, 13 bp, Homo sapiens
catttgctttttg

SEQ ID NO: 4893484 - DNA, 16 bp, Homo sapiens
catttggttcattaat

SEQ ID NO: 4893485 - DNA, 14 bp, Homo sapiens
catttgtaaatgct

SEQ ID NO: 4893486 - DNA, 14 bp, Homo sapiens
catttgtattttgt

SEQ ID NO: 4893487 - DNA, 15 bp, Homo sapiens
catttgtattttgtg

SEQ ID NO: 4893488 - DNA, 15 bp, Homo sapiens
catttgttaaaatta

SEQ ID NO: 4893489 - DNA, 16 bp, Homo sapiens
catttgtttttctcac

SEQ ID NO: 4893490 - DNA, 13 bp, Homo sapiens
cattttaaaaaca

SEQ ID NO: 4893491 - DNA, 14 bp, Homo sapiens
cattttaatgtaaa

SEQ ID NO: 4893492 - DNA, 22 bp, Homo sapiens
cattttcctacaggcagtctct

SEQ ID NO: 4893493 - DNA, 18 bp, Homo sapiens
cattttctataacagata

SEQ ID NO: 4893494 - DNA, 18 bp, Homo sapiens
cattttcttttcacttcg

SEQ ID NO: 4893495 - DNA, 22 bp, Homo sapiens
cattttggcgctattacaaata

SEQ ID NO: 4893496 - DNA, 22 bp, Homo sapiens
cattttggggtacccactgctc

SEQ ID NO: 4893497 - DNA, 22 bp, Homo sapiens
cattttggtaagagacagaatg

SEQ ID NO: 4893498 - DNA, 13 bp, Homo sapiens
cattttgtgaatg

SEQ ID NO: 4893499 - DNA, 18 bp, Homo sapiens
cattttgtgaatggattg

SEQ ID NO: 4893500 - DNA, 15 bp, Homo sapiens
cattttgttcttaca

SEQ ID NO: 4893501 - DNA, 19 bp, Homo sapiens
cattttgttgtaaaaagaa

SEQ ID NO: 4893502 - DNA, 20 bp, Homo sapiens
cattttgttgtaaaaagaaa

SEQ ID NO: 4893503 - DNA, 16 bp, Homo sapiens
catttttaaattgtta

SEQ ID NO: 4893504 - DNA, 17 bp, Homo sapiens
catttttagtagagaca

SEQ ID NO: 4893505 - DNA, 17 bp, Homo sapiens
catttttatttatgaag

SEQ ID NO: 4893506 - DNA, 13 bp, Homo sapiens
catttttcattca

SEQ ID NO: 4893507 - DNA, 17 bp, Homo sapiens
cattttttaaggaaaca

SEQ ID NO: 4893508 - DNA, 21 bp, Homo sapiens
catttttttttttgtttctga

SEQ ID NO: 4893509 - DNA, 13 bp, Homo sapiens
ccaaaaattatta

SEQ ID NO: 4893510 - DNA, 15 bp, Homo sapiens
ccaaaagcagtaaat

SEQ ID NO: 4893511 - DNA, 20 bp, Homo sapiens
ccaaaagccaatggctgcag

SEQ ID NO: 4893512 - DNA, 15 bp, Homo sapiens
ccaaaagctagacag

SEQ ID NO: 4893513 - DNA, 15 bp, Homo sapiens
ccaaaaggaaaaagc

SEQ ID NO: 4893514 - DNA, 17 bp, Homo sapiens
ccaaaagttttcctgag

SEQ ID NO: 4893515 - DNA, 16 bp, Homo sapiens
ccaaacaaatatgcaa

SEQ ID NO: 4893516 - DNA, 15 bp, Homo sapiens
ccaaacaccttccag

SEQ ID NO: 4893517 - DNA, 19 bp, Homo sapiens
ccaaacaccttccagctcc

SEQ ID NO: 4893518 - DNA, 16 bp, Homo sapiens
ccaaacccatgaggca

SEQ ID NO: 4893519 - DNA, 12 bp, Homo sapiens
ccaaaccctagg

SEQ ID NO: 4893520 - DNA, 15 bp, Homo sapiens
ccaaacttcactctg

SEQ ID NO: 4893521 - DNA, 20 bp, Homo sapiens
ccaaagaaatgaacattcca

SEQ ID NO: 4893522 - DNA, 23 bp, Homo sapiens
ccaaagaaatgaacattccaagg

SEQ ID NO: 4893523 - DNA, 14 bp, Homo sapiens
ccaaagagcacaaa

SEQ ID NO: 4893524 - DNA, 22 bp, Homo sapiens
ccaaagagcacaaacatttttc

SEQ ID NO: 4893525 - DNA, 16 bp, Homo sapiens
ccaaagaggctgcccc

SEQ ID NO: 4893526 - DNA, 13 bp, Homo sapiens
ccaaagatgcagc

SEQ ID NO: 4893527 - DNA, 13 bp, Homo sapiens
ccaaagcatggac

SEQ ID NO: 4893528 - DNA, 23 bp, Homo sapiens
ccaaagccccttgctctcccctg

SEQ ID NO: 4893529 - DNA, 16 bp, Homo sapiens
ccaaagctaggcctgg

SEQ ID NO: 4893530 - DNA, 21 bp, Homo sapiens
ccaaagctaggcctggccaga

SEQ ID NO: 4893531 - DNA, 23 bp, Homo sapiens
ccaaagctagggtggcccttgca

SEQ ID NO: 4893532 - DNA, 20 bp, Homo sapiens
ccaaaggacattatgtgtgc

SEQ ID NO: 4893533 - DNA, 18 bp, Homo sapiens
ccaaaggaggctggcagg

SEQ ID NO: 4893534 - DNA, 12 bp, Homo sapiens
ccaaaggccccc

SEQ ID NO: 4893535 - DNA, 16 bp, Homo sapiens
ccaaaggctctctcct

SEQ ID NO: 4893536 - DNA, 18 bp, Homo sapiens
ccaaaggggacaggcctc

SEQ ID NO: 4893537 - DNA, 15 bp, Homo sapiens
ccaaagtctctaatt

SEQ ID NO: 4893538 - DNA, 16 bp, Homo sapiens
ccaaagtctctaattc

SEQ ID NO: 4893539 - DNA, 18 bp, Homo sapiens
ccaaagtctctaattcta

SEQ ID NO: 4893540 - DNA, 15 bp, Homo sapiens
ccaaagtgctgagat

SEQ ID NO: 4893541 - DNA, 14 bp, Homo sapiens
ccaaagtgctggga

SEQ ID NO: 4893542 - DNA, 12 bp, Homo sapiens
ccaaagttctaa

SEQ ID NO: 4893543 - DNA, 14 bp, Homo sapiens
ccaaagttctaata

SEQ ID NO: 4893544 - DNA, 18 bp, Homo sapiens
ccaaataacttcagtcct

SEQ ID NO: 4893545 - DNA, 16 bp, Homo sapiens
ccaaatcatagtggct

SEQ ID NO: 4893546 - DNA, 20 bp, Homo sapiens
ccaaatccgctctcttcctg

SEQ ID NO: 4893547 - DNA, 22 bp, Homo sapiens
ccaaatccgctctcttcctgcc

SEQ ID NO: 4893548 - DNA, 16 bp, Homo sapiens
ccaaatgcaatttgat

SEQ ID NO: 4893549 - DNA, 12 bp, Homo sapiens
ccaaattatttg

SEQ ID NO: 4893550 - DNA, 14 bp, Homo sapiens
ccaaattatttgtg

SEQ ID NO: 4893551 - DNA, 18 bp, Homo sapiens
ccaaattatttgtgtaat

SEQ ID NO: 4893552 - DNA, 12 bp, Homo sapiens
ccaaatttatca

SEQ ID NO: 4893553 - DNA, 14 bp, Homo sapiens
ccaaatttatcaaa

SEQ ID NO: 4893554 - DNA, 15 bp, Homo sapiens
ccaaatttgattgat

SEQ ID NO: 4893555 - DNA, 17 bp, Homo sapiens
ccaaccagtgccaagga

SEQ ID NO: 4893556 - DNA, 19 bp, Homo sapiens
ccaaccctaggttccctgt

SEQ ID NO: 4893557 - DNA, 19 bp, Homo sapiens
ccaaccctatctcctgaca

SEQ ID NO: 4893558 - DNA, 20 bp, Homo sapiens
ccaaccctatctcctgacag

SEQ ID NO: 4893559 - DNA, 13 bp, Homo sapiens
ccaacgcacagga

SEQ ID NO: 4893560 - DNA, 15 bp, Homo sapiens
ccaacgcacaggaaa

SEQ ID NO: 4893561 - DNA, 20 bp, Homo sapiens
ccaacggccctgcagccagc

SEQ ID NO: 4893562 - DNA, 21 bp, Homo sapiens
ccaacggccctgcagccagct

SEQ ID NO: 4893563 - DNA, 13 bp, Homo sapiens
ccaactccagcaa

SEQ ID NO: 4893564 - DNA, 16 bp, Homo sapiens
ccaactctgagcccat

SEQ ID NO: 4893565 - DNA, 10 bp, Homo sapiens
ccaactgtgt

SEQ ID NO: 4893566 - DNA, 11 bp, Homo sapiens
ccaactgtgtt

SEQ ID NO: 4893567 - DNA, 18 bp, Homo sapiens
ccaactgtgttcattaga

SEQ ID NO: 4893568 - DNA, 20 bp, Homo sapiens
ccaacttctcttgctttcta

SEQ ID NO: 4893569 - DNA, 19 bp, Homo sapiens
ccaacttgagggcccagag

SEQ ID NO: 4893570 - DNA, 19 bp, Homo sapiens
ccaacttggttctgcttca

SEQ ID NO: 4893571 - DNA, 22 bp, Homo sapiens
ccaagaaagatgaatacatttt

SEQ ID NO: 4893572 - DNA, 20 bp, Homo sapiens
ccaagaatagatgctgactg

SEQ ID NO: 4893573 - DNA, 19 bp, Homo sapiens
ccaagaatccacatttcta

SEQ ID NO: 4893574 - DNA, 14 bp, Homo sapiens
ccaagacaaatcaa

SEQ ID NO: 4893575 - DNA, 21 bp, Homo sapiens
ccaagagaaaggcctgcacac

SEQ ID NO: 4893576 - DNA, 19 bp, Homo sapiens
ccaagagggtcctttagta

SEQ ID NO: 4893577 - DNA, 11 bp, Homo sapiens
ccaagagtcta

SEQ ID NO: 4893578 - DNA, 15 bp, Homo sapiens
ccaagagtctaaaga

SEQ ID NO: 4893579 - DNA, 15 bp, Homo sapiens
ccaagataggacctt

SEQ ID NO: 4893580 - DNA, 21 bp, Homo sapiens
ccaagataggaccttgggcca

SEQ ID NO: 4893581 - DNA, 13 bp, Homo sapiens
ccaagatctataa

SEQ ID NO: 4893582 - DNA, 17 bp, Homo sapiens
ccaagatgactggggtg

SEQ ID NO: 4893583 - DNA, 13 bp, Homo sapiens
ccaagattctaga

SEQ ID NO: 4893584 - DNA, 14 bp, Homo sapiens
ccaagattctagat

SEQ ID NO: 4893585 - DNA, 20 bp, Homo sapiens
ccaagcaggagacgacaggc

SEQ ID NO: 4893586 - DNA, 22 bp, Homo sapiens
ccaagcaggagacgacaggcga

SEQ ID NO: 4893587 - DNA, 19 bp, Homo sapiens
ccaagcatcagggggaaga

SEQ ID NO: 4893588 - DNA, 13 bp, Homo sapiens
ccaagccgtggct

SEQ ID NO: 4893589 - DNA, 13 bp, Homo sapiens
ccaagctattcct

SEQ ID NO: 4893590 - DNA, 14 bp, Homo sapiens
ccaagctccatctc

SEQ ID NO: 4893591 - DNA, 13 bp, Homo sapiens
ccaagctccctgc

SEQ ID NO: 4893592 - DNA, 19 bp, Homo sapiens
ccaagctccctgccccaaa

SEQ ID NO: 4893593 - DNA, 21 bp, Homo sapiens
ccaagctccctgccccaaata

SEQ ID NO: 4893594 - DNA, 22 bp, Homo sapiens
ccaagctccctgccccaaataa

SEQ ID NO: 4893595 - DNA, 20 bp, Homo sapiens
ccaagctcctcctcggaacc

SEQ ID NO: 4893596 - DNA, 22 bp, Homo sapiens
ccaagctcctcctcggaaccgc

SEQ ID NO: 4893597 - DNA, 12 bp, Homo sapiens
ccaagctggtcc

SEQ ID NO: 4893598 - DNA, 17 bp, Homo sapiens
ccaagctgttttcttct

SEQ ID NO: 4893599 - DNA, 18 bp, Homo sapiens
ccaagctgttttcttcta

SEQ ID NO: 4893600 - DNA, 12 bp, Homo sapiens
ccaaggagcaca

SEQ ID NO: 4893601 - DNA, 13 bp, Homo sapiens
ccaaggagcacag

SEQ ID NO: 4893602 - DNA, 17 bp, Homo sapiens
ccaaggagcacaggtcc

SEQ ID NO: 4893603 - DNA, 20 bp, Homo sapiens
ccaaggagcacaggtcccac

SEQ ID NO: 4893604 - DNA, 23 bp, Homo sapiens
ccaaggaggtgaggagcagagca

SEQ ID NO: 4893605 - DNA, 15 bp, Homo sapiens
ccaaggccagagtgg

SEQ ID NO: 4893606 - DNA, 14 bp, Homo sapiens
ccaaggccttctcc

SEQ ID NO: 4893607 - DNA, 14 bp, Homo sapiens
ccaaggcggcccct

SEQ ID NO: 4893608 - DNA, 21 bp, Homo sapiens
ccaaggcggcccctcccgccc

SEQ ID NO: 4893609 - DNA, 20 bp, Homo sapiens
ccaaggggagtcaccttccc

SEQ ID NO: 4893610 - DNA, 21 bp, Homo sapiens
ccaaggggagtcaccttccct

SEQ ID NO: 4893611 - DNA, 15 bp, Homo sapiens
ccaaggtctgagcca

SEQ ID NO: 4893612 - DNA, 21 bp, Homo sapiens
ccaaggtctgagccacagcag

SEQ ID NO: 4893613 - DNA, 20 bp, Homo sapiens
ccaaggtttaaagagtctag

SEQ ID NO: 4893614 - DNA, 23 bp, Homo sapiens
ccaaggtttaaagagtctagatt

SEQ ID NO: 4893615 - DNA, 16 bp, Homo sapiens
ccaagtaatataatgg

SEQ ID NO: 4893616 - DNA, 20 bp, Homo sapiens
ccaagtagctgggattacag

SEQ ID NO: 4893617 - DNA, 18 bp, Homo sapiens
ccaagtcggaacagcaga

SEQ ID NO: 4893618 - DNA, 14 bp, Homo sapiens
ccaagtctcagtgg

SEQ ID NO: 4893619 - DNA, 13 bp, Homo sapiens
ccaagtggctccc

SEQ ID NO: 4893620 - DNA, 18 bp, Homo sapiens
ccaatagcaaattcaaag

SEQ ID NO: 4893621 - DNA, 22 bp, Homo sapiens
ccaatatgtattgtaaacatgt

SEQ ID NO: 4893622 - DNA, 15 bp, Homo sapiens
ccaatattaaatctg

SEQ ID NO: 4893623 - DNA, 18 bp, Homo sapiens
ccaatattaaatctgctg

SEQ ID NO: 4893624 - DNA, 22 bp, Homo sapiens
ccaatattggagcatatcaaaa

SEQ ID NO: 4893625 - DNA, 18 bp, Homo sapiens
ccaatatttctgctttct

SEQ ID NO: 4893626 - DNA, 18 bp, Homo sapiens
ccaatgcttttatcaaac

SEQ ID NO: 4893627 - DNA, 21 bp, Homo sapiens
ccaatggagactgtctcaaga

SEQ ID NO: 4893628 - DNA, 15 bp, Homo sapiens
ccaatgtaggagctg

SEQ ID NO: 4893629 - DNA, 22 bp, Homo sapiens
ccaattatatgagacgtttttg

SEQ ID NO: 4893630 - DNA, 21 bp, Homo sapiens
ccaattattgatatatattat

SEQ ID NO: 4893631 - DNA, 22 bp, Homo sapiens
ccaattattgatatatattata

SEQ ID NO: 4893632 - DNA, 18 bp, Homo sapiens
ccaattattgttacacat

SEQ ID NO: 4893633 - DNA, 13 bp, Homo sapiens
ccaattggaggaa

SEQ ID NO: 4893634 - DNA, 16 bp, Homo sapiens
ccaattgtgctgccat

SEQ ID NO: 4893635 - DNA, 12 bp, Homo sapiens
ccacaactgaca

SEQ ID NO: 4893636 - DNA, 14 bp, Homo sapiens
ccacaactgacaca

SEQ ID NO: 4893637 - DNA, 21 bp, Homo sapiens
ccacaagaaatttgatttcta

SEQ ID NO: 4893638 - DNA, 14 bp, Homo sapiens
ccacaagggctctc

SEQ ID NO: 4893639 - DNA, 22 bp, Homo sapiens
ccacaagtcttccagaggatgc

SEQ ID NO: 4893640 - DNA, 19 bp, Homo sapiens
ccacacagctacagctttc

SEQ ID NO: 4893641 - DNA, 12 bp, Homo sapiens
ccacacccagcc

SEQ ID NO: 4893642 - DNA, 15 bp, Homo sapiens
ccacacccagcccac

SEQ ID NO: 4893643 - DNA, 14 bp, Homo sapiens
ccacacccagcctc

SEQ ID NO: 4893644 - DNA, 17 bp, Homo sapiens
ccacacccagcctcagt

SEQ ID NO: 4893645 - DNA, 19 bp, Homo sapiens
ccacacctcagttcccttg

SEQ ID NO: 4893646 - DNA, 15 bp, Homo sapiens
ccacacctctgccag

SEQ ID NO: 4893647 - DNA, 16 bp, Homo sapiens
ccacactaacctgggt

SEQ ID NO: 4893648 - DNA, 20 bp, Homo sapiens
ccacacttgttccagctctt

SEQ ID NO: 4893649 - DNA, 21 bp, Homo sapiens
ccacagacacacacacgcacg

SEQ ID NO: 4893650 - DNA, 21 bp, Homo sapiens
ccacagagagggagagcagag

SEQ ID NO: 4893651 - DNA, 22 bp, Homo sapiens
ccacagcacagctccctgccaa

SEQ ID NO: 4893652 - DNA, 15 bp, Homo sapiens
ccacagcagcatttt

SEQ ID NO: 4893653 - DNA, 19 bp, Homo sapiens
ccacagcgagggcagctgc

SEQ ID NO: 4893654 - DNA, 19 bp, Homo sapiens
ccacaggaagcctgcagtc

SEQ ID NO: 4893655 - DNA, 22 bp, Homo sapiens
ccacaggaagcctgcagtcctg

SEQ ID NO: 4893656 - DNA, 17 bp, Homo sapiens
ccacaggcccttcctct

SEQ ID NO: 4893657 - DNA, 23 bp, Homo sapiens
ccacaggcccttcctctccactg

SEQ ID NO: 4893658 - DNA, 22 bp, Homo sapiens
ccacaggttcatgccaccatgg

SEQ ID NO: 4893659 - DNA, 16 bp, Homo sapiens
ccacagttgccaccac

SEQ ID NO: 4893660 - DNA, 22 bp, Homo sapiens
ccacagttgccaccacctctgt

SEQ ID NO: 4893661 - DNA, 23 bp, Homo sapiens
ccacagttgccaccacctctgtg

SEQ ID NO: 4893662 - DNA, 19 bp, Homo sapiens
ccacatagtgatggttccc

SEQ ID NO: 4893663 - DNA, 22 bp, Homo sapiens
ccacatagtgatggttcccctg

SEQ ID NO: 4893664 - DNA, 14 bp, Homo sapiens
ccacatcttgctct

SEQ ID NO: 4893665 - DNA, 16 bp, Homo sapiens
ccacatcttgctctgc

SEQ ID NO: 4893666 - DNA, 18 bp, Homo sapiens
ccacatcttgctctgctg

SEQ ID NO: 4893667 - DNA, 17 bp, Homo sapiens
ccacatgggagcagtcc

SEQ ID NO: 4893668 - DNA, 14 bp, Homo sapiens
ccacatttctaaaa

SEQ ID NO: 4893669 - DNA, 22 bp, Homo sapiens
ccacatttggaatactttttgt

SEQ ID NO: 4893670 - DNA, 12 bp, Homo sapiens
ccaccaaagctg

SEQ ID NO: 4893671 - DNA, 13 bp, Homo sapiens
ccaccaaagctgc

SEQ ID NO: 4893672 - DNA, 19 bp, Homo sapiens
ccaccaaagctgcccactg

SEQ ID NO: 4893673 - DNA, 15 bp, Homo sapiens
ccaccaaccctcaga

SEQ ID NO: 4893674 - DNA, 17 bp, Homo sapiens
ccaccaagacttgtttt

SEQ ID NO: 4893675 - DNA, 16 bp, Homo sapiens
ccaccacacccagccc

SEQ ID NO: 4893676 - DNA, 15 bp, Homo sapiens
ccaccacctctgtgg

SEQ ID NO: 4893677 - DNA, 17 bp, Homo sapiens
ccaccagagaccgtcct

SEQ ID NO: 4893678 - DNA, 20 bp, Homo sapiens
ccaccagagaccgtcctcac

SEQ ID NO: 4893679 - DNA, 21 bp, Homo sapiens
ccaccagagaccgtcctcacc

SEQ ID NO: 4893680 - DNA, 19 bp, Homo sapiens
ccaccaggagaaccactac

SEQ ID NO: 4893681 - DNA, 19 bp, Homo sapiens
ccaccatcatgtctggcta

SEQ ID NO: 4893682 - DNA, 21 bp, Homo sapiens
ccacccaaccccaagccagcc

SEQ ID NO: 4893683 - DNA, 13 bp, Homo sapiens
ccacccaacccta

SEQ ID NO: 4893684 - DNA, 21 bp, Homo sapiens
ccacccaaccctatctcctga

SEQ ID NO: 4893685 - DNA, 13 bp, Homo sapiens
ccacccacctcag

SEQ ID NO: 4893686 - DNA, 14 bp, Homo sapiens
ccacccacctcagc

SEQ ID NO: 4893687 - DNA, 15 bp, Homo sapiens
ccacccacctcagcc

SEQ ID NO: 4893688 - DNA, 23 bp, Homo sapiens
ccacccaggagccccgaggcctt

SEQ ID NO: 4893689 - DNA, 17 bp, Homo sapiens
ccacccaggagggaggg

SEQ ID NO: 4893690 - DNA, 12 bp, Homo sapiens
ccaccccacact

SEQ ID NO: 4893691 - DNA, 15 bp, Homo sapiens
ccacccccaccccca

SEQ ID NO: 4893692 - DNA, 20 bp, Homo sapiens
ccacccccttctctgctcca

SEQ ID NO: 4893693 - DNA, 23 bp, Homo sapiens
ccacccccttctctgctccacca

SEQ ID NO: 4893694 - DNA, 16 bp, Homo sapiens
ccacccctacccctgg

SEQ ID NO: 4893695 - DNA, 14 bp, Homo sapiens
ccacccctccctct

SEQ ID NO: 4893696 - DNA, 17 bp, Homo sapiens
ccaccctccctggagtg

SEQ ID NO: 4893697 - DNA, 11 bp, Homo sapiens
ccaccctgctc

SEQ ID NO: 4893698 - DNA, 13 bp, Homo sapiens
ccaccctgctctc

SEQ ID NO: 4893699 - DNA, 16 bp, Homo sapiens
ccaccctgctgccttc

SEQ ID NO: 4893700 - DNA, 14 bp, Homo sapiens
ccacccttggcctg

SEQ ID NO: 4893701 - DNA, 15 bp, Homo sapiens
ccacccttggcctgt

SEQ ID NO: 4893702 - DNA, 23 bp, Homo sapiens
ccaccgaagtggactggcccctg

SEQ ID NO: 4893703 - DNA, 15 bp, Homo sapiens
ccaccggtccagctg

SEQ ID NO: 4893704 - DNA, 23 bp, Homo sapiens
ccacctaattcgatgaaggctgc

SEQ ID NO: 4893705 - DNA, 23 bp, Homo sapiens
ccacctacttttctttcctcaga

SEQ ID NO: 4893706 - DNA, 14 bp, Homo sapiens
ccacctagaacact

SEQ ID NO: 4893707 - DNA, 14 bp, Homo sapiens
ccacctcagcctcc

SEQ ID NO: 4893708 - DNA, 12 bp, Homo sapiens
ccacctccagcc

SEQ ID NO: 4893709 - DNA, 14 bp, Homo sapiens
ccacctccagcccg

SEQ ID NO: 4893710 - DNA, 22 bp, Homo sapiens
ccacctccagcccgggagccta

SEQ ID NO: 4893711 - DNA, 14 bp, Homo sapiens
ccacctccagtccc

SEQ ID NO: 4893712 - DNA, 13 bp, Homo sapiens
ccacctccctcac

SEQ ID NO: 4893713 - DNA, 20 bp, Homo sapiens
ccacctctgcggaccccagc

SEQ ID NO: 4893714 - DNA, 15 bp, Homo sapiens
ccacctctgtgacct

SEQ ID NO: 4893715 - DNA, 23 bp, Homo sapiens
ccacctctgtgacctcaggcact

SEQ ID NO: 4893716 - DNA, 17 bp, Homo sapiens
ccacctgcagggctgcc

SEQ ID NO: 4893717 - DNA, 23 bp, Homo sapiens
ccacctgcccatcacagggttgg

SEQ ID NO: 4893718 - DNA, 13 bp, Homo sapiens
ccacctgcctgcg

SEQ ID NO: 4893719 - DNA, 12 bp, Homo sapiens
ccacctgtctca

SEQ ID NO: 4893720 - DNA, 23 bp, Homo sapiens
ccacctgtctcagcctcccagag

SEQ ID NO: 4893721 - DNA, 14 bp, Homo sapiens
ccaccttcccatgc

SEQ ID NO: 4893722 - DNA, 12 bp, Homo sapiens
ccaccttggctg

SEQ ID NO: 4893723 - DNA, 14 bp, Homo sapiens
ccaccttggctgca

SEQ ID NO: 4893724 - DNA, 15 bp, Homo sapiens
ccaccttggctgcag

SEQ ID NO: 4893725 - DNA, 19 bp, Homo sapiens
ccaccttggctgcagggag

SEQ ID NO: 4893726 - DNA, 23 bp, Homo sapiens
ccacgatcctgccaccctgtagc

SEQ ID NO: 4893727 - DNA, 15 bp, Homo sapiens
ccacgccctcccctc

SEQ ID NO: 4893728 - DNA, 20 bp, Homo sapiens
ccacgccctcccctcccctg

SEQ ID NO: 4893729 - DNA, 18 bp, Homo sapiens
ccacgcgggggccttgag

SEQ ID NO: 4893730 - DNA, 13 bp, Homo sapiens
ccacggccaggcc

SEQ ID NO: 4893731 - DNA, 14 bp, Homo sapiens
ccacggccaggcca

SEQ ID NO: 4893732 - DNA, 15 bp, Homo sapiens
ccacggccaggccag

SEQ ID NO: 4893733 - DNA, 13 bp, Homo sapiens
ccacggctaagag

SEQ ID NO: 4893734 - DNA, 21 bp, Homo sapiens
ccacggctaagaggctgctga

SEQ ID NO: 4893735 - DNA, 18 bp, Homo sapiens
ccactaactcctgagaaa

SEQ ID NO: 4893736 - DNA, 23 bp, Homo sapiens
ccactacggaatagttggctagg

SEQ ID NO: 4893737 - DNA, 13 bp, Homo sapiens
ccactcaccccgg

SEQ ID NO: 4893738 - DNA, 14 bp, Homo sapiens
ccactcagccccta

SEQ ID NO: 4893739 - DNA, 20 bp, Homo sapiens
ccactcaggaggctgaggca

SEQ ID NO: 4893740 - DNA, 18 bp, Homo sapiens
ccactcaggcatttgact

SEQ ID NO: 4893741 - DNA, 18 bp, Homo sapiens
ccactcagtccatagcag

SEQ ID NO: 4893742 - DNA, 17 bp, Homo sapiens
ccactccagacccctgg

SEQ ID NO: 4893743 - DNA, 19 bp, Homo sapiens
ccactccagacccctggct

SEQ ID NO: 4893744 - DNA, 14 bp, Homo sapiens
ccactccattccca

SEQ ID NO: 4893745 - DNA, 18 bp, Homo sapiens
ccactcgcttcccccata

SEQ ID NO: 4893746 - DNA, 16 bp, Homo sapiens
ccactctaccctccca

SEQ ID NO: 4893747 - DNA, 21 bp, Homo sapiens
ccactctaccctcccaccccc

SEQ ID NO: 4893748 - DNA, 14 bp, Homo sapiens
ccactctccccaca

SEQ ID NO: 4893749 - DNA, 15 bp, Homo sapiens
ccactctccccacac

SEQ ID NO: 4893750 - DNA, 16 bp, Homo sapiens
ccactctccccacact

SEQ ID NO: 4893751 - DNA, 13 bp, Homo sapiens
ccactctcttccc

SEQ ID NO: 4893752 - DNA, 18 bp, Homo sapiens
ccactgaagcccatttct

SEQ ID NO: 4893753 - DNA, 16 bp, Homo sapiens
ccactgacagcctccc

SEQ ID NO: 4893754 - DNA, 17 bp, Homo sapiens
ccactgatgctgttctc

SEQ ID NO: 4893755 - DNA, 19 bp, Homo sapiens
ccactgatgctgttctctt

SEQ ID NO: 4893756 - DNA, 14 bp, Homo sapiens
ccactgcaccgggc

SEQ ID NO: 4893757 - DNA, 20 bp, Homo sapiens
ccactgcactatagcctagg

SEQ ID NO: 4893758 - DNA, 16 bp, Homo sapiens
ccactgccagcagcag

SEQ ID NO: 4893759 - DNA, 17 bp, Homo sapiens
ccactgccagcagcagc

SEQ ID NO: 4893760 - DNA, 23 bp, Homo sapiens
ccactgccagcagcagcaggtga

SEQ ID NO: 4893761 - DNA, 11 bp, Homo sapiens
ccactgcctct

SEQ ID NO: 4893762 - DNA, 18 bp, Homo sapiens
ccactgcctctgccttag

SEQ ID NO: 4893763 - DNA, 21 bp, Homo sapiens
ccactgccttcgatacaccgg

SEQ ID NO: 4893764 - DNA, 24 bp, Homo sapiens
ccactgctccctaagccagcctgg

SEQ ID NO: 4893765 - DNA, 12 bp, Homo sapiens
ccactgctctgg

SEQ ID NO: 4893766 - DNA, 22 bp, Homo sapiens
ccactgcttttggtctgtgtga

SEQ ID NO: 4893767 - DNA, 20 bp, Homo sapiens
ccactgtgcctttgcaaatc

SEQ ID NO: 4893768 - DNA, 21 bp, Homo sapiens
ccactgtgcctttgcaaatca

SEQ ID NO: 4893769 - DNA, 18 bp, Homo sapiens
ccactgtttctcttgagc

SEQ ID NO: 4893770 - DNA, 20 bp, Homo sapiens
ccactgtttcttgcttgtac

SEQ ID NO: 4893771 - DNA, 20 bp, Homo sapiens
ccacttacatatatttttaa

SEQ ID NO: 4893772 - DNA, 20 bp, Homo sapiens
ccacttcaatgcacatggtg

SEQ ID NO: 4893773 - DNA, 18 bp, Homo sapiens
ccacttccaggggaacct

SEQ ID NO: 4893774 - DNA, 15 bp, Homo sapiens
ccacttcttcctttc

SEQ ID NO: 4893775 - DNA, 22 bp, Homo sapiens
ccacttcttcctttctctttct

SEQ ID NO: 4893776 - DNA, 19 bp, Homo sapiens
ccacttcttgttccccact

SEQ ID NO: 4893777 - DNA, 14 bp, Homo sapiens
ccacttgaaatgtt

SEQ ID NO: 4893778 - DNA, 15 bp, Homo sapiens
ccacttgtccgctgg

SEQ ID NO: 4893779 - DNA, 17 bp, Homo sapiens
ccactttaagagagaaa

SEQ ID NO: 4893780 - DNA, 18 bp, Homo sapiens
ccactttacccacctaga

SEQ ID NO: 4893781 - DNA, 21 bp, Homo sapiens
ccactttgcatatgagccgtg

SEQ ID NO: 4893782 - DNA, 17 bp, Homo sapiens
ccagaacaacaactatc

SEQ ID NO: 4893783 - DNA, 20 bp, Homo sapiens
ccagaacacggctcacgctt

SEQ ID NO: 4893784 - DNA, 19 bp, Homo sapiens
ccagaaccaccccggcccc

SEQ ID NO: 4893785 - DNA, 19 bp, Homo sapiens
ccagaactcactggggcct

SEQ ID NO: 4893786 - DNA, 18 bp, Homo sapiens
ccagaagaaaattctcct

SEQ ID NO: 4893787 - DNA, 21 bp, Homo sapiens
ccagaagaagagaagctgctg

SEQ ID NO: 4893788 - DNA, 22 bp, Homo sapiens
ccagaagaagagaagctgctga

SEQ ID NO: 4893789 - DNA, 18 bp, Homo sapiens
ccagaagatcccctcagg

SEQ ID NO: 4893790 - DNA, 15 bp, Homo sapiens
ccagaagcctctggc

SEQ ID NO: 4893791 - DNA, 16 bp, Homo sapiens
ccagaagcctctggct

SEQ ID NO: 4893792 - DNA, 16 bp, Homo sapiens
ccagaatgctgtacat

SEQ ID NO: 4893793 - DNA, 13 bp, Homo sapiens
ccagaatttggaa

SEQ ID NO: 4893794 - DNA, 17 bp, Homo sapiens
ccagaatttggaaatcc

SEQ ID NO: 4893795 - DNA, 23 bp, Homo sapiens
ccagaatttggaaatcctagttt

SEQ ID NO: 4893796 - DNA, 17 bp, Homo sapiens
ccagacaccttgacagg

SEQ ID NO: 4893797 - DNA, 19 bp, Homo sapiens
ccagacaccttgacagggc

SEQ ID NO: 4893798 - DNA, 21 bp, Homo sapiens
ccagacaccttgacagggcac

SEQ ID NO: 4893799 - DNA, 21 bp, Homo sapiens
ccagaccaacgttactcaggg

SEQ ID NO: 4893800 - DNA, 17 bp, Homo sapiens
ccagaccccaggctgga

SEQ ID NO: 4893801 - DNA, 17 bp, Homo sapiens
ccagacccctggctttt

SEQ ID NO: 4893802 - DNA, 18 bp, Homo sapiens
ccagacccctggcttttc

SEQ ID NO: 4893803 - DNA, 15 bp, Homo sapiens
ccagacccggctgcg

SEQ ID NO: 4893804 - DNA, 17 bp, Homo sapiens
ccagacccggctgcgtg

SEQ ID NO: 4893805 - DNA, 17 bp, Homo sapiens
ccagactactattttct

SEQ ID NO: 4893806 - DNA, 13 bp, Homo sapiens
ccagacttccttg

SEQ ID NO: 4893807 - DNA, 12 bp, Homo sapiens
ccagagaacagc

SEQ ID NO: 4893808 - DNA, 18 bp, Homo sapiens
ccagagaccgtcctcacc

SEQ ID NO: 4893809 - DNA, 13 bp, Homo sapiens
ccagagcaaaata

SEQ ID NO: 4893810 - DNA, 12 bp, Homo sapiens
ccagagcagggt

SEQ ID NO: 4893811 - DNA, 21 bp, Homo sapiens
ccagagcatttccaacaccac

SEQ ID NO: 4893812 - DNA, 23 bp, Homo sapiens
ccagagcatttccaacaccacag

SEQ ID NO: 4893813 - DNA, 16 bp, Homo sapiens
ccagagcccaccttgg

SEQ ID NO: 4893814 - DNA, 22 bp, Homo sapiens
ccagagcccaccttggctcaag

SEQ ID NO: 4893815 - DNA, 22 bp, Homo sapiens
ccagagcggaggctgtgtgcct

SEQ ID NO: 4893816 - DNA, 21 bp, Homo sapiens
ccagagctgggaggcatggcc

SEQ ID NO: 4893817 - DNA, 22 bp, Homo sapiens
ccagagctgtttatggcctcag

SEQ ID NO: 4893818 - DNA, 17 bp, Homo sapiens
ccagaggaacctgaggc

SEQ ID NO: 4893819 - DNA, 17 bp, Homo sapiens
ccagaggaatcctggca

SEQ ID NO: 4893820 - DNA, 23 bp, Homo sapiens
ccagaggaatcctggcagcccag

SEQ ID NO: 4893821 - DNA, 17 bp, Homo sapiens
ccagaggagccttttta

SEQ ID NO: 4893822 - DNA, 17 bp, Homo sapiens
ccagagggagtgacaga

SEQ ID NO: 4893823 - DNA, 13 bp, Homo sapiens
ccagaggggaagg

SEQ ID NO: 4893824 - DNA, 23 bp, Homo sapiens
ccagaggggaaggagggtacagc

SEQ ID NO: 4893825 - DNA, 18 bp, Homo sapiens
ccagaggtaacagaacag

SEQ ID NO: 4893826 - DNA, 21 bp, Homo sapiens
ccagaggtaacagaacagctt

SEQ ID NO: 4893827 - DNA, 22 bp, Homo sapiens
ccagaggtaacagaacagcttc

SEQ ID NO: 4893828 - DNA, 13 bp, Homo sapiens
ccagagtggcctg

SEQ ID NO: 4893829 - DNA, 16 bp, Homo sapiens
ccagagtggcctggcc

SEQ ID NO: 4893830 - DNA, 17 bp, Homo sapiens
ccagagtggcctggcca

SEQ ID NO: 4893831 - DNA, 15 bp, Homo sapiens
ccagatcactgccac

SEQ ID NO: 4893832 - DNA, 16 bp, Homo sapiens
ccagatcactgccaca

SEQ ID NO: 4893833 - DNA, 20 bp, Homo sapiens
ccagatcactgccacactct

SEQ ID NO: 4893834 - DNA, 13 bp, Homo sapiens
ccagatcagtcag

SEQ ID NO: 4893835 - DNA, 15 bp, Homo sapiens
ccagatcctcttggt

SEQ ID NO: 4893836 - DNA, 14 bp, Homo sapiens
ccagattgcaacag

SEQ ID NO: 4893837 - DNA, 18 bp, Homo sapiens
ccagattgcaacaggctg

SEQ ID NO: 4893838 - DNA, 19 bp, Homo sapiens
ccagattgcaacaggctgg

SEQ ID NO: 4893839 - DNA, 20 bp, Homo sapiens
ccagattgcaacaggctggg

SEQ ID NO: 4893840 - DNA, 21 bp, Homo sapiens
ccagatttgctaatttatcct

SEQ ID NO: 4893841 - DNA, 14 bp, Homo sapiens
ccagcaacacagcc

SEQ ID NO: 4893842 - DNA, 19 bp, Homo sapiens
ccagcaacacagcctgggc

SEQ ID NO: 4893843 - DNA, 18 bp, Homo sapiens
ccagcaagtgagagctgg

SEQ ID NO: 4893844 - DNA, 22 bp, Homo sapiens
ccagcaatgacatctcaggggc

SEQ ID NO: 4893845 - DNA, 23 bp, Homo sapiens
ccagcaatgacatctcaggggcc

SEQ ID NO: 4893846 - DNA, 21 bp, Homo sapiens
ccagcaattcataaaaactgc

SEQ ID NO: 4893847 - DNA, 17 bp, Homo sapiens
ccagcacctgcctcctc

SEQ ID NO: 4893848 - DNA, 18 bp, Homo sapiens
ccagcagcagcaggtgat

SEQ ID NO: 4893849 - DNA, 13 bp, Homo sapiens
ccagcagttctgt

SEQ ID NO: 4893850 - DNA, 14 bp, Homo sapiens
ccagcagttctgtt

SEQ ID NO: 4893851 - DNA, 17 bp, Homo sapiens
ccagcatcactccccaa

SEQ ID NO: 4893852 - DNA, 21 bp, Homo sapiens
ccagcatcactccccaaggaa

SEQ ID NO: 4893853 - DNA, 19 bp, Homo sapiens
ccagccaaaccctgtctga

SEQ ID NO: 4893854 - DNA, 21 bp, Homo sapiens
ccagccaggcaggtccacaga

SEQ ID NO: 4893855 - DNA, 21 bp, Homo sapiens
ccagccatacttatctctctg

SEQ ID NO: 4893856 - DNA, 21 bp, Homo sapiens
ccagcccaaaggggacaggcc

SEQ ID NO: 4893857 - DNA, 16 bp, Homo sapiens
ccagcccatctcggag

SEQ ID NO: 4893858 - DNA, 19 bp, Homo sapiens
ccagcccatggccctgtgc

SEQ ID NO: 4893859 - DNA, 16 bp, Homo sapiens
ccagccccacccagga

SEQ ID NO: 4893860 - DNA, 13 bp, Homo sapiens
ccagccccactgc

SEQ ID NO: 4893861 - DNA, 16 bp, Homo sapiens
ccagccccactgccag

SEQ ID NO: 4893862 - DNA, 17 bp, Homo sapiens
ccagccccactgccagc

SEQ ID NO: 4893863 - DNA, 15 bp, Homo sapiens
ccagccccagtgccc

SEQ ID NO: 4893864 - DNA, 21 bp, Homo sapiens
ccagcccctagaaacccaagc

SEQ ID NO: 4893865 - DNA, 23 bp, Homo sapiens
ccagcccctagcccaggagagag

SEQ ID NO: 4893866 - DNA, 16 bp, Homo sapiens
ccagcccctcccccat

SEQ ID NO: 4893867 - DNA, 22 bp, Homo sapiens
ccagcccggccgctccaccagc

SEQ ID NO: 4893868 - DNA, 15 bp, Homo sapiens
ccagcccgggagcct

SEQ ID NO: 4893869 - DNA, 15 bp, Homo sapiens
ccagccctggggctg

SEQ ID NO: 4893870 - DNA, 19 bp, Homo sapiens
ccagccctggggctgggcc

SEQ ID NO: 4893871 - DNA, 16 bp, Homo sapiens
ccagcccttagcaggg

SEQ ID NO: 4893872 - DNA, 22 bp, Homo sapiens
ccagccggccaatggaaacctc

SEQ ID NO: 4893873 - DNA, 22 bp, Homo sapiens
ccagcctatgagcatcctgagc

SEQ ID NO: 4893874 - DNA, 23 bp, Homo sapiens
ccagcctatgagcatcctgagcc

SEQ ID NO: 4893875 - DNA, 15 bp, Homo sapiens
ccagcctccatgctg

SEQ ID NO: 4893876 - DNA, 17 bp, Homo sapiens
ccagcctgaccttcctt

SEQ ID NO: 4893877 - DNA, 23 bp, Homo sapiens
ccagcctgggcagccaggctgcc

SEQ ID NO: 4893878 - DNA, 14 bp, Homo sapiens
ccagcctggggcct

SEQ ID NO: 4893879 - DNA, 19 bp, Homo sapiens
ccagcctggggcctggcag

SEQ ID NO: 4893880 - DNA, 19 bp, Homo sapiens
ccagcctgtcccatggaca

SEQ ID NO: 4893881 - DNA, 22 bp, Homo sapiens
ccagccttcttccatcccagga

SEQ ID NO: 4893882 - DNA, 19 bp, Homo sapiens
ccagcctttggccttggct

SEQ ID NO: 4893883 - DNA, 14 bp, Homo sapiens
ccagcgagccctgg

SEQ ID NO: 4893884 - DNA, 21 bp, Homo sapiens
ccagctaccctttttctccag

SEQ ID NO: 4893885 - DNA, 22 bp, Homo sapiens
ccagctaccctttttctccagc

SEQ ID NO: 4893886 - DNA, 17 bp, Homo sapiens
ccagctacttcctcctc

SEQ ID NO: 4893887 - DNA, 22 bp, Homo sapiens
ccagctcaatggactggaaggg

SEQ ID NO: 4893888 - DNA, 15 bp, Homo sapiens
ccagctcagaaccca

SEQ ID NO: 4893889 - DNA, 21 bp, Homo sapiens
ccagctcagaacccagggctc

SEQ ID NO: 4893890 - DNA, 14 bp, Homo sapiens
ccagctcaggggca

SEQ ID NO: 4893891 - DNA, 14 bp, Homo sapiens
ccagctccctctat

SEQ ID NO: 4893892 - DNA, 16 bp, Homo sapiens
ccagctccctctattt

SEQ ID NO: 4893893 - DNA, 15 bp, Homo sapiens
ccagctggcctggac

SEQ ID NO: 4893894 - DNA, 15 bp, Homo sapiens
ccagctgtgagcctt

SEQ ID NO: 4893895 - DNA, 17 bp, Homo sapiens
ccagctgtgagccttgg

SEQ ID NO: 4893896 - DNA, 20 bp, Homo sapiens
ccagctgtgagccttggctg

SEQ ID NO: 4893897 - DNA, 22 bp, Homo sapiens
ccagctgtgctctggacaggca

SEQ ID NO: 4893898 - DNA, 21 bp, Homo sapiens
ccagcttggggccaccaaagc

SEQ ID NO: 4893899 - DNA, 22 bp, Homo sapiens
ccagcttggggccaccaaagct

SEQ ID NO: 4893900 - DNA, 18 bp, Homo sapiens
ccagctttctccccgcta

SEQ ID NO: 4893901 - DNA, 19 bp, Homo sapiens
ccaggaaaggattttataa

SEQ ID NO: 4893902 - DNA, 23 bp, Homo sapiens
ccaggacaccacacccagcctca

SEQ ID NO: 4893903 - DNA, 16 bp, Homo sapiens
ccaggactccctcctc

SEQ ID NO: 4893904 - DNA, 19 bp, Homo sapiens
ccaggactgagccccgcag

SEQ ID NO: 4893905 - DNA, 23 bp, Homo sapiens
ccaggagaaccactacatgcagc

SEQ ID NO: 4893906 - DNA, 21 bp, Homo sapiens
ccaggagagagaaagccaggc

SEQ ID NO: 4893907 - DNA, 13 bp, Homo sapiens
ccaggagctcttc

SEQ ID NO: 4893908 - DNA, 18 bp, Homo sapiens
ccaggagctcttcaggcc

SEQ ID NO: 4893909 - DNA, 17 bp, Homo sapiens
ccaggagggcatccata

SEQ ID NO: 4893910 - DNA, 18 bp, Homo sapiens
ccaggaggtcgaccccaa

SEQ ID NO: 4893911 - DNA, 20 bp, Homo sapiens
ccaggagttcgaggctgcag

SEQ ID NO: 4893912 - DNA, 23 bp, Homo sapiens
ccaggatagtgggcaccccactg

SEQ ID NO: 4893913 - DNA, 14 bp, Homo sapiens
ccaggatcatggtg

SEQ ID NO: 4893914 - DNA, 21 bp, Homo sapiens
ccaggatgataagttcctttc

SEQ ID NO: 4893915 - DNA, 21 bp, Homo sapiens
ccaggcaacttcagtcctggg

SEQ ID NO: 4893916 - DNA, 15 bp, Homo sapiens
ccaggcacagctgag

SEQ ID NO: 4893917 - DNA, 16 bp, Homo sapiens
ccaggcacagctgagt

SEQ ID NO: 4893918 - DNA, 13 bp, Homo sapiens
ccaggcacaggat

SEQ ID NO: 4893919 - DNA, 18 bp, Homo sapiens
ccaggcactgctgcccag

SEQ ID NO: 4893920 - DNA, 13 bp, Homo sapiens
ccaggcagatctg

SEQ ID NO: 4893921 - DNA, 18 bp, Homo sapiens
ccaggcagatctgtgccc

SEQ ID NO: 4893922 - DNA, 23 bp, Homo sapiens
ccaggcagatctgtgccccatgc

SEQ ID NO: 4893923 - DNA, 21 bp, Homo sapiens
ccaggcccctgccaccctggg

SEQ ID NO: 4893924 - DNA, 23 bp, Homo sapiens
ccaggcccctgccaccctgggga

SEQ ID NO: 4893925 - DNA, 17 bp, Homo sapiens
ccaggcctctgtgtcct

SEQ ID NO: 4893926 - DNA, 18 bp, Homo sapiens
ccaggcctgcagcaggag

SEQ ID NO: 4893927 - DNA, 19 bp, Homo sapiens
ccaggctagtccggaccca

SEQ ID NO: 4893928 - DNA, 23 bp, Homo sapiens
ccaggctagtccggacccacctc

SEQ ID NO: 4893929 - DNA, 14 bp, Homo sapiens
ccaggctccgccct

SEQ ID NO: 4893930 - DNA, 21 bp, Homo sapiens
ccaggctggacatgctgactg

SEQ ID NO: 4893931 - DNA, 16 bp, Homo sapiens
ccaggctggcgtgcag

SEQ ID NO: 4893932 - DNA, 18 bp, Homo sapiens
ccaggctggcgtgcagtg

SEQ ID NO: 4893933 - DNA, 19 bp, Homo sapiens
ccaggctggcgtgcagtgg

SEQ ID NO: 4893934 - DNA, 16 bp, Homo sapiens
ccaggctggtctaaaa

SEQ ID NO: 4893935 - DNA, 20 bp, Homo sapiens
ccaggctgtatcccatgagc

SEQ ID NO: 4893936 - DNA, 24 bp, Homo sapiens
ccaggctgtatcccatgagcctca

SEQ ID NO: 4893937 - DNA, 20 bp, Homo sapiens
ccaggctgtgcagcgcagct

SEQ ID NO: 4893938 - DNA, 21 bp, Homo sapiens
ccagggaatccaagcctccac

SEQ ID NO: 4893939 - DNA, 14 bp, Homo sapiens
ccagggagcctaga

SEQ ID NO: 4893940 - DNA, 16 bp, Homo sapiens
ccagggagcctagaag

SEQ ID NO: 4893941 - DNA, 12 bp, Homo sapiens
ccagggagcctt

SEQ ID NO: 4893942 - DNA, 22 bp, Homo sapiens
ccagggagcctttggttctggc

SEQ ID NO: 4893943 - DNA, 22 bp, Homo sapiens
ccagggcaccctgtggccctgg

SEQ ID NO: 4893944 - DNA, 17 bp, Homo sapiens
ccagggcagtgctagtg

SEQ ID NO: 4893945 - DNA, 22 bp, Homo sapiens
ccagggcagtgctagtgagctg

SEQ ID NO: 4893946 - DNA, 16 bp, Homo sapiens
ccagggccgaggaggt

SEQ ID NO: 4893947 - DNA, 17 bp, Homo sapiens
ccagggctgccctgaga

SEQ ID NO: 4893948 - DNA, 18 bp, Homo sapiens
ccagggctgccctgagaa

SEQ ID NO: 4893949 - DNA, 23 bp, Homo sapiens
ccagggctgccctgagaagctgc

SEQ ID NO: 4893950 - DNA, 20 bp, Homo sapiens
ccagggcttacctgtacact

SEQ ID NO: 4893951 - DNA, 22 bp, Homo sapiens
ccagggcttacctgtacactga

SEQ ID NO: 4893952 - DNA, 12 bp, Homo sapiens
ccaggggaacct

SEQ ID NO: 4893953 - DNA, 17 bp, Homo sapiens
ccaggggaacctgccat

SEQ ID NO: 4893954 - DNA, 24 bp, Homo sapiens
ccaggggaacctgccatgccagga

SEQ ID NO: 4893955 - DNA, 16 bp, Homo sapiens
ccaggggagttgtgtc

SEQ ID NO: 4893956 - DNA, 19 bp, Homo sapiens
ccaggggcccaaggcggcc

SEQ ID NO: 4893957 - DNA, 19 bp, Homo sapiens
ccagggggaaggccaaggg

SEQ ID NO: 4893958 - DNA, 17 bp, Homo sapiens
ccagggggactagcccc

SEQ ID NO: 4893959 - DNA, 18 bp, Homo sapiens
ccagggggactagcccct

SEQ ID NO: 4893960 - DNA, 17 bp, Homo sapiens
ccaggggtcccagccac

SEQ ID NO: 4893961 - DNA, 18 bp, Homo sapiens
ccaggggtcccagccacc

SEQ ID NO: 4893962 - DNA, 16 bp, Homo sapiens
ccaggtctcacgggca

SEQ ID NO: 4893963 - DNA, 23 bp, Homo sapiens
ccaggtctcacgggcatgggcac

SEQ ID NO: 4893964 - DNA, 23 bp, Homo sapiens
ccaggtctgggaagctgagggca

SEQ ID NO: 4893965 - DNA, 17 bp, Homo sapiens
ccaggtgttactgtaat

SEQ ID NO: 4893966 - DNA, 21 bp, Homo sapiens
ccaggtgttactgtaattcct

SEQ ID NO: 4893967 - DNA, 16 bp, Homo sapiens
ccaggtttctatgtgt

SEQ ID NO: 4893968 - DNA, 17 bp, Homo sapiens
ccaggtttttggtctga

SEQ ID NO: 4893969 - DNA, 12 bp, Homo sapiens
ccagtattcttg

SEQ ID NO: 4893970 - DNA, 13 bp, Homo sapiens
ccagtcacatgac

SEQ ID NO: 4893971 - DNA, 21 bp, Homo sapiens
ccagtcacatgacctgatcac

SEQ ID NO: 4893972 - DNA, 18 bp, Homo sapiens
ccagtccaaatgtcctcc

SEQ ID NO: 4893973 - DNA, 21 bp, Homo sapiens
ccagtccaaatgtcctccaga

SEQ ID NO: 4893974 - DNA, 16 bp, Homo sapiens
ccagtcctgcctggcc

SEQ ID NO: 4893975 - DNA, 17 bp, Homo sapiens
ccagtcctgcctggcca

SEQ ID NO: 4893976 - DNA, 20 bp, Homo sapiens
ccagtctggaatgcagtggt

SEQ ID NO: 4893977 - DNA, 18 bp, Homo sapiens
ccagtctttaaaggccca

SEQ ID NO: 4893978 - DNA, 12 bp, Homo sapiens
ccagtgccaagg

SEQ ID NO: 4893979 - DNA, 20 bp, Homo sapiens
ccagtggcgttgttgcatgt

SEQ ID NO: 4893980 - DNA, 22 bp, Homo sapiens
ccagtggggcctgtggaatgag

SEQ ID NO: 4893981 - DNA, 20 bp, Homo sapiens
ccagtgtaatcccccaggag

SEQ ID NO: 4893982 - DNA, 22 bp, Homo sapiens
ccagtgtaatcccccaggagaa

SEQ ID NO: 4893983 - DNA, 17 bp, Homo sapiens
ccagtgttgcctaagta

SEQ ID NO: 4893984 - DNA, 22 bp, Homo sapiens
ccagttaaggaccgtggccctg

SEQ ID NO: 4893985 - DNA, 18 bp, Homo sapiens
ccagttcattgcactttg

SEQ ID NO: 4893986 - DNA, 17 bp, Homo sapiens
ccagttgaataaaagtg

SEQ ID NO: 4893987 - DNA, 19 bp, Homo sapiens
ccagttgggtggatgcctg

SEQ ID NO: 4893988 - DNA, 17 bp, Homo sapiens
ccataaatccagttcta

SEQ ID NO: 4893989 - DNA, 22 bp, Homo sapiens
ccataaggtttcgtttctgtat

SEQ ID NO: 4893990 - DNA, 14 bp, Homo sapiens
ccataatctggact

SEQ ID NO: 4893991 - DNA, 15 bp, Homo sapiens
ccatactcagcctgc

SEQ ID NO: 4893992 - DNA, 21 bp, Homo sapiens
ccatactcagcctgctgccca

SEQ ID NO: 4893993 - DNA, 18 bp, Homo sapiens
ccatagaaacatgacact

SEQ ID NO: 4893994 - DNA, 20 bp, Homo sapiens
ccatagaaacatgacactga

SEQ ID NO: 4893995 - DNA, 16 bp, Homo sapiens
ccatagagtttaacac

SEQ ID NO: 4893996 - DNA, 17 bp, Homo sapiens
ccatagagtttaacaca

SEQ ID NO: 4893997 - DNA, 20 bp, Homo sapiens
ccatagatcttctgaaatga

SEQ ID NO: 4893998 - DNA, 18 bp, Homo sapiens
ccatagccaccccagaaa

SEQ ID NO: 4893999 - DNA, 15 bp, Homo sapiens
ccatataagtttgaa

SEQ ID NO: 4894000 - DNA, 16 bp, Homo sapiens
ccatataagtttgaag

SEQ ID NO: 4894001 - DNA, 22 bp, Homo sapiens
ccatataagtttgaaggaaaca

SEQ ID NO: 4894002 - DNA, 16 bp, Homo sapiens
ccatatcttaaagaaa

SEQ ID NO: 4894003 - DNA, 21 bp, Homo sapiens
ccatatcttaaagaaacagct

SEQ ID NO: 4894004 - DNA, 21 bp, Homo sapiens
ccatatgccttggggaggaca

SEQ ID NO: 4894005 - DNA, 22 bp, Homo sapiens
ccatattggcatggatttctgt

SEQ ID NO: 4894006 - DNA, 17 bp, Homo sapiens
ccatatttagcagtgca

SEQ ID NO: 4894007 - DNA, 16 bp, Homo sapiens
ccatcaaaatgctttt

SEQ ID NO: 4894008 - DNA, 17 bp, Homo sapiens
ccatcacaatacagata

SEQ ID NO: 4894009 - DNA, 13 bp, Homo sapiens
ccatcacagggtt

SEQ ID NO: 4894010 - DNA, 21 bp, Homo sapiens
ccatcagcccaacgggaagca

SEQ ID NO: 4894011 - DNA, 16 bp, Homo sapiens
ccatcatgcccggtcc

SEQ ID NO: 4894012 - DNA, 14 bp, Homo sapiens
ccatcatgtctggc

SEQ ID NO: 4894013 - DNA, 18 bp, Homo sapiens
ccatccacttacatatat

SEQ ID NO: 4894014 - DNA, 18 bp, Homo sapiens
ccatccaggttcagcttg

SEQ ID NO: 4894015 - DNA, 18 bp, Homo sapiens
ccatccagtgacaaacca

SEQ ID NO: 4894016 - DNA, 16 bp, Homo sapiens
ccatcccaaccagtgc

SEQ ID NO: 4894017 - DNA, 17 bp, Homo sapiens
ccatcccaaccagtgcc

SEQ ID NO: 4894018 - DNA, 12 bp, Homo sapiens
ccatcccacacc

SEQ ID NO: 4894019 - DNA, 14 bp, Homo sapiens
ccatcccaggacac

SEQ ID NO: 4894020 - DNA, 24 bp, Homo sapiens
ccatcccaggacaccacacccagc

SEQ ID NO: 4894021 - DNA, 13 bp, Homo sapiens
ccatcccctggac

SEQ ID NO: 4894022 - DNA, 16 bp, Homo sapiens
ccatccctccccagtt

SEQ ID NO: 4894023 - DNA, 12 bp, Homo sapiens
ccatccctgcct

SEQ ID NO: 4894024 - DNA, 13 bp, Homo sapiens
ccatccctgcctg

SEQ ID NO: 4894025 - DNA, 12 bp, Homo sapiens
ccatccctgtga

SEQ ID NO: 4894026 - DNA, 20 bp, Homo sapiens
ccatctcatgtatcatctgg

SEQ ID NO: 4894027 - DNA, 21 bp, Homo sapiens
ccatctcggagcatcccggag

SEQ ID NO: 4894028 - DNA, 22 bp, Homo sapiens
ccatctcggagcatcccggagg

SEQ ID NO: 4894029 - DNA, 20 bp, Homo sapiens
ccatctcgggcacaggccca

SEQ ID NO: 4894030 - DNA, 23 bp, Homo sapiens
ccatctctccctcccctgccatt

SEQ ID NO: 4894031 - DNA, 12 bp, Homo sapiens
ccatctggcctg

SEQ ID NO: 4894032 - DNA, 13 bp, Homo sapiens
ccatctggcctgg

SEQ ID NO: 4894033 - DNA, 14 bp, Homo sapiens
ccatctggcctggc

SEQ ID NO: 4894034 - DNA, 17 bp, Homo sapiens
ccatctggcctggcctg

SEQ ID NO: 4894035 - DNA, 15 bp, Homo sapiens
ccatctttactccca

SEQ ID NO: 4894036 - DNA, 11 bp, Homo sapiens
ccatgaagcct

SEQ ID NO: 4894037 - DNA, 13 bp, Homo sapiens
ccatgaagccttt

SEQ ID NO: 4894038 - DNA, 16 bp, Homo sapiens
ccatgaagccttttga

SEQ ID NO: 4894039 - DNA, 14 bp, Homo sapiens
ccatgagcctcagc

SEQ ID NO: 4894040 - DNA, 19 bp, Homo sapiens
ccatgagcctcagcatcct

SEQ ID NO: 4894041 - DNA, 21 bp, Homo sapiens
ccatgagcctcagcatcctgg

SEQ ID NO: 4894042 - DNA, 17 bp, Homo sapiens
ccatgagtccttgaaaa

SEQ ID NO: 4894043 - DNA, 17 bp, Homo sapiens
ccatgcaggccctttga

SEQ ID NO: 4894044 - DNA, 11 bp, Homo sapiens
ccatgcatttc

SEQ ID NO: 4894045 - DNA, 18 bp, Homo sapiens
ccatgccacgttccacag

SEQ ID NO: 4894046 - DNA, 21 bp, Homo sapiens
ccatgccacgttccacagttg

SEQ ID NO: 4894047 - DNA, 14 bp, Homo sapiens
ccatgccaggaacc

SEQ ID NO: 4894048 - DNA, 15 bp, Homo sapiens
ccatgccaggaacct

SEQ ID NO: 4894049 - DNA, 13 bp, Homo sapiens
ccatgcctgtcca

SEQ ID NO: 4894050 - DNA, 14 bp, Homo sapiens
ccatgcctgtccag

SEQ ID NO: 4894051 - DNA, 14 bp, Homo sapiens
ccatgctgcctcca

SEQ ID NO: 4894052 - DNA, 17 bp, Homo sapiens
ccatggacactccagtg

SEQ ID NO: 4894053 - DNA, 21 bp, Homo sapiens
ccatggacactccagtgccag

SEQ ID NO: 4894054 - DNA, 14 bp, Homo sapiens
ccatggagccagct

SEQ ID NO: 4894055 - DNA, 17 bp, Homo sapiens
ccatggagccagctccc

SEQ ID NO: 4894056 - DNA, 21 bp, Homo sapiens
ccatgggaaatgtcaacaagt

SEQ ID NO: 4894057 - DNA, 13 bp, Homo sapiens
ccatgggcctcct

SEQ ID NO: 4894058 - DNA, 21 bp, Homo sapiens
ccatgggcttcactgtataaa

SEQ ID NO: 4894059 - DNA, 14 bp, Homo sapiens
ccatgtaaatacca

SEQ ID NO: 4894060 - DNA, 13 bp, Homo sapiens
ccatgtacctccc

SEQ ID NO: 4894061 - DNA, 14 bp, Homo sapiens
ccatgtacctcccc

SEQ ID NO: 4894062 - DNA, 20 bp, Homo sapiens
ccatgtacctcccctgcctt

SEQ ID NO: 4894063 - DNA, 17 bp, Homo sapiens
ccatgtactagttttag

SEQ ID NO: 4894064 - DNA, 20 bp, Homo sapiens
ccatgtagccccctggcctc

SEQ ID NO: 4894065 - DNA, 23 bp, Homo sapiens
ccatgtagccccctggcctctgt

SEQ ID NO: 4894066 - DNA, 13 bp, Homo sapiens
ccatgtccaaaga

SEQ ID NO: 4894067 - DNA, 18 bp, Homo sapiens
ccatgtccaaagaggctg

SEQ ID NO: 4894068 - DNA, 16 bp, Homo sapiens
ccatgtcctatgtgtg

SEQ ID NO: 4894069 - DNA, 21 bp, Homo sapiens
ccatgtctttctccaaagtta

SEQ ID NO: 4894070 - DNA, 15 bp, Homo sapiens
ccatgtgcctctttg

SEQ ID NO: 4894071 - DNA, 12 bp, Homo sapiens
ccatgtgtcact

SEQ ID NO: 4894072 - DNA, 20 bp, Homo sapiens
ccatgtgtcacttgtgcttt

SEQ ID NO: 4894073 - DNA, 14 bp, Homo sapiens
ccatgttctgcccc

SEQ ID NO: 4894074 - DNA, 20 bp, Homo sapiens
ccatgttctgcccccagccc

SEQ ID NO: 4894075 - DNA, 13 bp, Homo sapiens
ccatgttggccag

SEQ ID NO: 4894076 - DNA, 16 bp, Homo sapiens
ccatgttggccaggct

SEQ ID NO: 4894077 - DNA, 18 bp, Homo sapiens
ccatgttggccaggctgg

SEQ ID NO: 4894078 - DNA, 19 bp, Homo sapiens
ccatgttggccaggctggt

SEQ ID NO: 4894079 - DNA, 16 bp, Homo sapiens
ccattaaaactgcttt

SEQ ID NO: 4894080 - DNA, 16 bp, Homo sapiens
ccattaaagtctgaat

SEQ ID NO: 4894081 - DNA, 12 bp, Homo sapiens
ccattattttct

SEQ ID NO: 4894082 - DNA, 13 bp, Homo sapiens
ccattattttctg

SEQ ID NO: 4894083 - DNA, 14 bp, Homo sapiens
ccattattttctgt

SEQ ID NO: 4894084 - DNA, 16 bp, Homo sapiens
ccattattttctgtca

SEQ ID NO: 4894085 - DNA, 17 bp, Homo sapiens
ccattattttctgtcag

SEQ ID NO: 4894086 - DNA, 19 bp, Homo sapiens
ccattattttctgtcagat

SEQ ID NO: 4894087 - DNA, 22 bp, Homo sapiens
ccattctcatctgcacccttct

SEQ ID NO: 4894088 - DNA, 17 bp, Homo sapiens
ccattctgcctgcccag

SEQ ID NO: 4894089 - DNA, 18 bp, Homo sapiens
ccattctgcctgcccagg

SEQ ID NO: 4894090 - DNA, 22 bp, Homo sapiens
ccattcttacttactaaaatat

SEQ ID NO: 4894091 - DNA, 18 bp, Homo sapiens
ccattgatcataaactga

SEQ ID NO: 4894092 - DNA, 18 bp, Homo sapiens
ccatttacgtgtctgaat

SEQ ID NO: 4894093 - DNA, 20 bp, Homo sapiens
ccatttatgtgagtgtgtgt

SEQ ID NO: 4894094 - DNA, 12 bp, Homo sapiens
ccatttatttat

SEQ ID NO: 4894095 - DNA, 13 bp, Homo sapiens
ccatttgaagtgt

SEQ ID NO: 4894096 - DNA, 12 bp, Homo sapiens
ccatttgatacc

SEQ ID NO: 4894097 - DNA, 20 bp, Homo sapiens
ccatttgtaaaactccggat

SEQ ID NO: 4894098 - DNA, 18 bp, Homo sapiens
ccatttgtgccagaggaa

SEQ ID NO: 4894099 - DNA, 14 bp, Homo sapiens
ccattttgtgaatg

SEQ ID NO: 4894100 - DNA, 22 bp, Homo sapiens
cccaaactgttcaagaaataat

SEQ ID NO: 4894101 - DNA, 18 bp, Homo sapiens
cccaaaggggacaggcct

SEQ ID NO: 4894102 - DNA, 20 bp, Homo sapiens
cccaaaggggacaggcctca

SEQ ID NO: 4894103 - DNA, 22 bp, Homo sapiens
cccaaaggggacaggcctcacc

SEQ ID NO: 4894104 - DNA, 16 bp, Homo sapiens
cccaaagtctgtgtga

SEQ ID NO: 4894105 - DNA, 15 bp, Homo sapiens
cccaaagtgctgaga

SEQ ID NO: 4894106 - DNA, 20 bp, Homo sapiens
cccaaagtgctgagattaca

SEQ ID NO: 4894107 - DNA, 16 bp, Homo sapiens
cccaaatttgattgat

SEQ ID NO: 4894108 - DNA, 19 bp, Homo sapiens
cccaaatttgattgatttg

SEQ ID NO: 4894109 - DNA, 19 bp, Homo sapiens
cccaacagcgacatagccc

SEQ ID NO: 4894110 - DNA, 12 bp, Homo sapiens
cccaaccagtgc

SEQ ID NO: 4894111 - DNA, 18 bp, Homo sapiens
cccaaccagtgccaagga

SEQ ID NO: 4894112 - DNA, 16 bp, Homo sapiens
cccaacgcacaggaaa

SEQ ID NO: 4894113 - DNA, 16 bp, Homo sapiens
cccaacggccctgcag

SEQ ID NO: 4894114 - DNA, 20 bp, Homo sapiens
cccaactccaccagatagca

SEQ ID NO: 4894115 - DNA, 18 bp, Homo sapiens
cccaactctgagcccatg

SEQ ID NO: 4894116 - DNA, 20 bp, Homo sapiens
cccaacttctcttgctttct

SEQ ID NO: 4894117 - DNA, 21 bp, Homo sapiens
cccaagaatagatgctgactg

SEQ ID NO: 4894118 - DNA, 18 bp, Homo sapiens
cccaagacagatgcccca

SEQ ID NO: 4894119 - DNA, 20 bp, Homo sapiens
cccaagacagatgccccaga

SEQ ID NO: 4894120 - DNA, 21 bp, Homo sapiens
cccaagacagatgccccagag

SEQ ID NO: 4894121 - DNA, 23 bp, Homo sapiens
cccaagaggtcaaggctgcagtg

SEQ ID NO: 4894122 - DNA, 19 bp, Homo sapiens
cccaaggaaagccccagca

SEQ ID NO: 4894123 - DNA, 22 bp, Homo sapiens
cccaaggaaagccccagcacta

SEQ ID NO: 4894124 - DNA, 14 bp, Homo sapiens
cccaaggagcacag

SEQ ID NO: 4894125 - DNA, 17 bp, Homo sapiens
cccaaggctctgagcaa

SEQ ID NO: 4894126 - DNA, 19 bp, Homo sapiens
cccaagtgcactttctaat

SEQ ID NO: 4894127 - DNA, 15 bp, Homo sapiens
cccaatcagcactga

SEQ ID NO: 4894128 - DNA, 20 bp, Homo sapiens
cccaatgcacatccattccc

SEQ ID NO: 4894129 - DNA, 16 bp, Homo sapiens
cccaatgtaggagctg

SEQ ID NO: 4894130 - DNA, 15 bp, Homo sapiens
cccaattgagaaaaa

SEQ ID NO: 4894131 - DNA, 13 bp, Homo sapiens
cccacaaaaatgt

SEQ ID NO: 4894132 - DNA, 22 bp, Homo sapiens
cccacacctcagttcccttggc

SEQ ID NO: 4894133 - DNA, 15 bp, Homo sapiens
cccacacctctgcca

SEQ ID NO: 4894134 - DNA, 17 bp, Homo sapiens
cccacacttgttccagc

SEQ ID NO: 4894135 - DNA, 19 bp, Homo sapiens
cccacagcacagctccctg

SEQ ID NO: 4894136 - DNA, 18 bp, Homo sapiens
cccacatccaactccagc

SEQ ID NO: 4894137 - DNA, 18 bp, Homo sapiens
cccacattctgatgagca

SEQ ID NO: 4894138 - DNA, 13 bp, Homo sapiens
cccaccccacact

SEQ ID NO: 4894139 - DNA, 13 bp, Homo sapiens
cccacccccagct

SEQ ID NO: 4894140 - DNA, 12 bp, Homo sapiens
cccacccccatc

SEQ ID NO: 4894141 - DNA, 16 bp, Homo sapiens
cccaccctccctggag

SEQ ID NO: 4894142 - DNA, 16 bp, Homo sapiens
cccaccggtccagctg

SEQ ID NO: 4894143 - DNA, 14 bp, Homo sapiens
cccacctcagcctc

SEQ ID NO: 4894144 - DNA, 17 bp, Homo sapiens
cccacctcagcctcccg

SEQ ID NO: 4894145 - DNA, 12 bp, Homo sapiens
cccacctccagc

SEQ ID NO: 4894146 - DNA, 15 bp, Homo sapiens
cccacctccccacgc

SEQ ID NO: 4894147 - DNA, 16 bp, Homo sapiens
cccacctccccacgcc

SEQ ID NO: 4894148 - DNA, 14 bp, Homo sapiens
cccacctccctgcc

SEQ ID NO: 4894149 - DNA, 19 bp, Homo sapiens
cccacctccctgcccaggc

SEQ ID NO: 4894150 - DNA, 17 bp, Homo sapiens
cccacctctgtgacctc

SEQ ID NO: 4894151 - DNA, 17 bp, Homo sapiens
cccacgccctcccctcc

SEQ ID NO: 4894152 - DNA, 14 bp, Homo sapiens
cccacgctggagtg

SEQ ID NO: 4894153 - DNA, 20 bp, Homo sapiens
cccacgctggagtgcagtga

SEQ ID NO: 4894154 - DNA, 21 bp, Homo sapiens
cccacgctggagtgcagtgag

SEQ ID NO: 4894155 - DNA, 15 bp, Homo sapiens
cccacggctaagagg

SEQ ID NO: 4894156 - DNA, 18 bp, Homo sapiens
cccacggctaagaggctg

SEQ ID NO: 4894157 - DNA, 18 bp, Homo sapiens
cccacgtgtcttccactt

SEQ ID NO: 4894158 - DNA, 19 bp, Homo sapiens
cccacgtgtcttccacttt

SEQ ID NO: 4894159 - DNA, 13 bp, Homo sapiens
cccacgttctttc

SEQ ID NO: 4894160 - DNA, 12 bp, Homo sapiens
cccactgatgct

SEQ ID NO: 4894161 - DNA, 15 bp, Homo sapiens
cccactgcaatcctg

SEQ ID NO: 4894162 - DNA, 18 bp, Homo sapiens
cccactgcaatcctgtct

SEQ ID NO: 4894163 - DNA, 12 bp, Homo sapiens
cccactgctctg

SEQ ID NO: 4894164 - DNA, 13 bp, Homo sapiens
cccactgctctgg

SEQ ID NO: 4894165 - DNA, 16 bp, Homo sapiens
cccactgtgcaggtgc

SEQ ID NO: 4894166 - DNA, 12 bp, Homo sapiens
cccacttctgcc

SEQ ID NO: 4894167 - DNA, 12 bp, Homo sapiens
cccagaatccca

SEQ ID NO: 4894168 - DNA, 11 bp, Homo sapiens
cccagaattca

SEQ ID NO: 4894169 - DNA, 20 bp, Homo sapiens
cccagagatgtcatcagagc

SEQ ID NO: 4894170 - DNA, 22 bp, Homo sapiens
cccagagattgcttctcatccc

SEQ ID NO: 4894171 - DNA, 15 bp, Homo sapiens
cccagagcagggtgt

SEQ ID NO: 4894172 - DNA, 11 bp, Homo sapiens
cccagagctgt

SEQ ID NO: 4894173 - DNA, 13 bp, Homo sapiens
cccagagctgttt

SEQ ID NO: 4894174 - DNA, 20 bp, Homo sapiens
cccagagctgtttatggcct

SEQ ID NO: 4894175 - DNA, 20 bp, Homo sapiens
cccagaggtaacagaacagc

SEQ ID NO: 4894176 - DNA, 17 bp, Homo sapiens
cccagaggtccagccca

SEQ ID NO: 4894177 - DNA, 19 bp, Homo sapiens
cccagatctggtcccttgc

SEQ ID NO: 4894178 - DNA, 21 bp, Homo sapiens
cccagattgcaacaggctggg

SEQ ID NO: 4894179 - DNA, 22 bp, Homo sapiens
cccagcaagtgagagctgggtg

SEQ ID NO: 4894180 - DNA, 18 bp, Homo sapiens
cccagcacttgtgttgtc

SEQ ID NO: 4894181 - DNA, 12 bp, Homo sapiens
cccagcagttct

SEQ ID NO: 4894182 - DNA, 22 bp, Homo sapiens
cccagcatgacataacagtgca

SEQ ID NO: 4894183 - DNA, 12 bp, Homo sapiens
cccagccacccc

SEQ ID NO: 4894184 - DNA, 19 bp, Homo sapiens
cccagccaccccgggctct

SEQ ID NO: 4894185 - DNA, 11 bp, Homo sapiens
cccagccccta

SEQ ID NO: 4894186 - DNA, 13 bp, Homo sapiens
cccagcccctagc

SEQ ID NO: 4894187 - DNA, 14 bp, Homo sapiens
cccagcccctagcc

SEQ ID NO: 4894188 - DNA, 18 bp, Homo sapiens
cccagcccctcccccatc

SEQ ID NO: 4894189 - DNA, 15 bp, Homo sapiens
cccagccctggctct

SEQ ID NO: 4894190 - DNA, 16 bp, Homo sapiens
cccagccctggctctg

SEQ ID NO: 4894191 - DNA, 11 bp, Homo sapiens
cccagcctcag

SEQ ID NO: 4894192 - DNA, 15 bp, Homo sapiens
cccagcctctggcat

SEQ ID NO: 4894193 - DNA, 12 bp, Homo sapiens
cccagcctgcta

SEQ ID NO: 4894194 - DNA, 15 bp, Homo sapiens
cccagcgagccctgg

SEQ ID NO: 4894195 - DNA, 17 bp, Homo sapiens
cccagcgagccctggtg

SEQ ID NO: 4894196 - DNA, 19 bp, Homo sapiens
cccagcgagccctggtggc

SEQ ID NO: 4894197 - DNA, 23 bp, Homo sapiens
cccagcgagccctggtggcagtg

SEQ ID NO: 4894198 - DNA, 15 bp, Homo sapiens
cccagcgctctgcct

SEQ ID NO: 4894199 - DNA, 22 bp, Homo sapiens
cccagcgggcaggttctgcctg

SEQ ID NO: 4894200 - DNA, 12 bp, Homo sapiens
cccagctcaggg

SEQ ID NO: 4894201 - DNA, 15 bp, Homo sapiens
cccagctccctagga

SEQ ID NO: 4894202 - DNA, 15 bp, Homo sapiens
cccagctgtgagcct

SEQ ID NO: 4894203 - DNA, 16 bp, Homo sapiens
cccagctgtgagcctt

SEQ ID NO: 4894204 - DNA, 17 bp, Homo sapiens
cccagctgtgagccttg

SEQ ID NO: 4894205 - DNA, 18 bp, Homo sapiens
cccagcttgtaggagctg

SEQ ID NO: 4894206 - DNA, 20 bp, Homo sapiens
cccaggacaccacacccagc

SEQ ID NO: 4894207 - DNA, 22 bp, Homo sapiens
cccaggacaccacacccagcct

SEQ ID NO: 4894208 - DNA, 15 bp, Homo sapiens
cccaggagacagttc

SEQ ID NO: 4894209 - DNA, 17 bp, Homo sapiens
cccaggagacagttcaa

SEQ ID NO: 4894210 - DNA, 14 bp, Homo sapiens
cccaggagagagaa

SEQ ID NO: 4894211 - DNA, 20 bp, Homo sapiens
cccaggagagagaaagccag

SEQ ID NO: 4894212 - DNA, 13 bp, Homo sapiens
cccaggagccccg

SEQ ID NO: 4894213 - DNA, 14 bp, Homo sapiens
cccaggagccccga

SEQ ID NO: 4894214 - DNA, 18 bp, Homo sapiens
cccaggagccccgaggcc

SEQ ID NO: 4894215 - DNA, 21 bp, Homo sapiens
cccaggagccccgaggccttc

SEQ ID NO: 4894216 - DNA, 17 bp, Homo sapiens
cccaggcaggtcttgaa

SEQ ID NO: 4894217 - DNA, 23 bp, Homo sapiens
cccaggcaggtcttgaactcctg

SEQ ID NO: 4894218 - DNA, 13 bp, Homo sapiens
cccaggccggcca

SEQ ID NO: 4894219 - DNA, 13 bp, Homo sapiens
cccaggcctctgt

SEQ ID NO: 4894220 - DNA, 16 bp, Homo sapiens
cccaggcctgcctgtt

SEQ ID NO: 4894221 - DNA, 18 bp, Homo sapiens
cccaggctggcgtgcagt

SEQ ID NO: 4894222 - DNA, 21 bp, Homo sapiens
cccaggctgtgcagcgcagct

SEQ ID NO: 4894223 - DNA, 22 bp, Homo sapiens
cccaggctgtgcagcgcagctg

SEQ ID NO: 4894224 - DNA, 19 bp, Homo sapiens
cccagggctctgccccagt

SEQ ID NO: 4894225 - DNA, 15 bp, Homo sapiens
cccaggggtcccagc

SEQ ID NO: 4894226 - DNA, 16 bp, Homo sapiens
cccaggggtcccagcc

SEQ ID NO: 4894227 - DNA, 22 bp, Homo sapiens
cccagggtggacttagaaagca

SEQ ID NO: 4894228 - DNA, 19 bp, Homo sapiens
cccaggtgttaacattcca

SEQ ID NO: 4894229 - DNA, 22 bp, Homo sapiens
cccaggtgttaacattccaaga

SEQ ID NO: 4894230 - DNA, 13 bp, Homo sapiens
cccaggtttctat

SEQ ID NO: 4894231 - DNA, 21 bp, Homo sapiens
cccagtctctcttaaagttgg

SEQ ID NO: 4894232 - DNA, 20 bp, Homo sapiens
cccagtctctggcagttctg

SEQ ID NO: 4894233 - DNA, 19 bp, Homo sapiens
cccagtctggaatgcagtg

SEQ ID NO: 4894234 - DNA, 20 bp, Homo sapiens
cccagtctggaatgcagtgg

SEQ ID NO: 4894235 - DNA, 19 bp, Homo sapiens
cccagtgagattacagagg

SEQ ID NO: 4894236 - DNA, 15 bp, Homo sapiens
cccagtgcccacagg

SEQ ID NO: 4894237 - DNA, 22 bp, Homo sapiens
cccataattttttttttccttt

SEQ ID NO: 4894238 - DNA, 23 bp, Homo sapiens
cccataattttttttttcctttt

SEQ ID NO: 4894239 - DNA, 16 bp, Homo sapiens
cccatactcagcctgc

SEQ ID NO: 4894240 - DNA, 17 bp, Homo sapiens
cccatagaaacatgaca

SEQ ID NO: 4894241 - DNA, 21 bp, Homo sapiens
cccatagaaacatgacactga

SEQ ID NO: 4894242 - DNA, 22 bp, Homo sapiens
cccatagatcttctgaaatgaa

SEQ ID NO: 4894243 - DNA, 13 bp, Homo sapiens
cccatcccacacc

SEQ ID NO: 4894244 - DNA, 16 bp, Homo sapiens
cccatccctccccagt

SEQ ID NO: 4894245 - DNA, 14 bp, Homo sapiens
cccatccctgcctg

SEQ ID NO: 4894246 - DNA, 15 bp, Homo sapiens
cccatccctgcctgg

SEQ ID NO: 4894247 - DNA, 18 bp, Homo sapiens
cccatctaagctgcagct

SEQ ID NO: 4894248 - DNA, 13 bp, Homo sapiens
cccatctcggagc

SEQ ID NO: 4894249 - DNA, 21 bp, Homo sapiens
cccatctctccctcccctgcc

SEQ ID NO: 4894250 - DNA, 11 bp, Homo sapiens
cccatgaagcc

SEQ ID NO: 4894251 - DNA, 19 bp, Homo sapiens
cccatgaccatactgaggg

SEQ ID NO: 4894252 - DNA, 14 bp, Homo sapiens
cccatgagcctcag

SEQ ID NO: 4894253 - DNA, 15 bp, Homo sapiens
cccatgcccacctgc

SEQ ID NO: 4894254 - DNA, 18 bp, Homo sapiens
cccatgcccacctgccca

SEQ ID NO: 4894255 - DNA, 14 bp, Homo sapiens
cccatgcctgtcca

SEQ ID NO: 4894256 - DNA, 20 bp, Homo sapiens
cccatggacactccagtgcc

SEQ ID NO: 4894257 - DNA, 21 bp, Homo sapiens
cccatggacactccagtgcca

SEQ ID NO: 4894258 - DNA, 14 bp, Homo sapiens
cccatgggctctga

SEQ ID NO: 4894259 - DNA, 16 bp, Homo sapiens
cccatgggctctgaca

SEQ ID NO: 4894260 - DNA, 17 bp, Homo sapiens
cccatgggctctgacag

SEQ ID NO: 4894261 - DNA, 23 bp, Homo sapiens
cccatgggttgtgtgtttatttc

SEQ ID NO: 4894262 - DNA, 21 bp, Homo sapiens
cccatgtagccccctggcctc

SEQ ID NO: 4894263 - DNA, 21 bp, Homo sapiens
cccatgtgtcctggttcccgt

SEQ ID NO: 4894264 - DNA, 14 bp, Homo sapiens
cccatgttgtaatg

SEQ ID NO: 4894265 - DNA, 18 bp, Homo sapiens
cccatgttgtaatgctgc

SEQ ID NO: 4894266 - DNA, 19 bp, Homo sapiens
cccatgttgtaatgctgca

SEQ ID NO: 4894267 - DNA, 18 bp, Homo sapiens
cccattccaaagctttat

SEQ ID NO: 4894268 - DNA, 19 bp, Homo sapiens
cccattctgcctgcccagg

SEQ ID NO: 4894269 - DNA, 23 bp, Homo sapiens
cccattctgcctgcccaggcccc

SEQ ID NO: 4894270 - DNA, 21 bp, Homo sapiens
cccattcttcctagttttctc

SEQ ID NO: 4894271 - DNA, 12 bp, Homo sapiens
ccccaaagcccc

SEQ ID NO: 4894272 - DNA, 14 bp, Homo sapiens
ccccaactctgagc

SEQ ID NO: 4894273 - DNA, 17 bp, Homo sapiens
ccccaactctgagccca

SEQ ID NO: 4894274 - DNA, 19 bp, Homo sapiens
ccccaagtagtctgctcac

SEQ ID NO: 4894275 - DNA, 12 bp, Homo sapiens
ccccacaacttt

SEQ ID NO: 4894276 - DNA, 17 bp, Homo sapiens
ccccacacagctacagc

SEQ ID NO: 4894277 - DNA, 22 bp, Homo sapiens
ccccacacttgttccagctctt

SEQ ID NO: 4894278 - DNA, 16 bp, Homo sapiens
ccccaccccacacttg

SEQ ID NO: 4894279 - DNA, 16 bp, Homo sapiens
ccccacccccagctca

SEQ ID NO: 4894280 - DNA, 17 bp, Homo sapiens
ccccacccccagctcaa

SEQ ID NO: 4894281 - DNA, 12 bp, Homo sapiens
ccccacctgcag

SEQ ID NO: 4894282 - DNA, 11 bp, Homo sapiens
ccccacctggg

SEQ ID NO: 4894283 - DNA, 14 bp, Homo sapiens
ccccacgccctccc

SEQ ID NO: 4894284 - DNA, 13 bp, Homo sapiens
ccccactgatgct

SEQ ID NO: 4894285 - DNA, 15 bp, Homo sapiens
ccccactgatgctgt

SEQ ID NO: 4894286 - DNA, 19 bp, Homo sapiens
ccccactgatgctgttctc

SEQ ID NO: 4894287 - DNA, 15 bp, Homo sapiens
ccccactgccagcag

SEQ ID NO: 4894288 - DNA, 17 bp, Homo sapiens
ccccactgccagcagca

SEQ ID NO: 4894289 - DNA, 21 bp, Homo sapiens
ccccagagctgtttatggcct

SEQ ID NO: 4894290 - DNA, 23 bp, Homo sapiens
ccccagattgcaacaggctgggc

SEQ ID NO: 4894291 - DNA, 17 bp, Homo sapiens
ccccagcaagtgagagc

SEQ ID NO: 4894292 - DNA, 21 bp, Homo sapiens
ccccagcaagtgagagctggg

SEQ ID NO: 4894293 - DNA, 22 bp, Homo sapiens
ccccagcaagtgagagctgggt

SEQ ID NO: 4894294 - DNA, 16 bp, Homo sapiens
ccccagcatcactccc

SEQ ID NO: 4894295 - DNA, 13 bp, Homo sapiens
ccccagcccaggg

SEQ ID NO: 4894296 - DNA, 18 bp, Homo sapiens
ccccagcccctcccccat

SEQ ID NO: 4894297 - DNA, 16 bp, Homo sapiens
ccccagccctggctct

SEQ ID NO: 4894298 - DNA, 15 bp, Homo sapiens
ccccagcctctggca

SEQ ID NO: 4894299 - DNA, 13 bp, Homo sapiens
ccccagcctgcta

SEQ ID NO: 4894300 - DNA, 13 bp, Homo sapiens
ccccagctcaggg

SEQ ID NO: 4894301 - DNA, 16 bp, Homo sapiens
ccccagctgtgagcct

SEQ ID NO: 4894302 - DNA, 22 bp, Homo sapiens
ccccaggctggacatgctgact

SEQ ID NO: 4894303 - DNA, 19 bp, Homo sapiens
ccccaggggtcccagccac

SEQ ID NO: 4894304 - DNA, 11 bp, Homo sapiens
ccccagtccca

SEQ ID NO: 4894305 - DNA, 14 bp, Homo sapiens
ccccatagccaccc

SEQ ID NO: 4894306 - DNA, 13 bp, Homo sapiens
ccccatgcctgtc

SEQ ID NO: 4894307 - DNA, 17 bp, Homo sapiens
ccccatgcctgtccagc

SEQ ID NO: 4894308 - DNA, 18 bp, Homo sapiens
ccccatgcctgtccagcc

SEQ ID NO: 4894309 - DNA, 14 bp, Homo sapiens
ccccatgtgtcctg

SEQ ID NO: 4894310 - DNA, 21 bp, Homo sapiens
ccccatgttgtaatgctgcac

SEQ ID NO: 4894311 - DNA, 23 bp, Homo sapiens
ccccatgttgtaatgctgcactt

SEQ ID NO: 4894312 - DNA, 13 bp, Homo sapiens
ccccattctcatc

SEQ ID NO: 4894313 - DNA, 20 bp, Homo sapiens
cccccaactctgagcccatg

SEQ ID NO: 4894314 - DNA, 21 bp, Homo sapiens
cccccaacttgagatgtatga

SEQ ID NO: 4894315 - DNA, 17 bp, Homo sapiens
cccccacacctcagttc

SEQ ID NO: 4894316 - DNA, 14 bp, Homo sapiens
cccccacccccagc

SEQ ID NO: 4894317 - DNA, 13 bp, Homo sapiens
cccccagcctatg

SEQ ID NO: 4894318 - DNA, 15 bp, Homo sapiens
cccccagcctatgag

SEQ ID NO: 4894319 - DNA, 12 bp, Homo sapiens
cccccagcctgc

SEQ ID NO: 4894320 - DNA, 14 bp, Homo sapiens
cccccagctcaggg

SEQ ID NO: 4894321 - DNA, 23 bp, Homo sapiens
cccccagctttgctaccaaagca

SEQ ID NO: 4894322 - DNA, 12 bp, Homo sapiens
ccccccactctc

SEQ ID NO: 4894323 - DNA, 13 bp, Homo sapiens
ccccccagcctct

SEQ ID NO: 4894324 - DNA, 12 bp, Homo sapiens
cccccgccactc

SEQ ID NO: 4894325 - DNA, 13 bp, Homo sapiens
cccccggccccct

SEQ ID NO: 4894326 - DNA, 21 bp, Homo sapiens
ccccctgccccccagcctctg

SEQ ID NO: 4894327 - DNA, 22 bp, Homo sapiens
ccccctgccccccagcctctgg

SEQ ID NO: 4894328 - DNA, 15 bp, Homo sapiens
ccccctgctggctct

SEQ ID NO: 4894329 - DNA, 18 bp, Homo sapiens
ccccctgctggctcttct

SEQ ID NO: 4894330 - DNA, 22 bp, Homo sapiens
ccccctggcctctgtgccttct

SEQ ID NO: 4894331 - DNA, 15 bp, Homo sapiens
cccccttctctgctc

SEQ ID NO: 4894332 - DNA, 17 bp, Homo sapiens
cccccttctctgctcca

SEQ ID NO: 4894333 - DNA, 14 bp, Homo sapiens
cccccttgagtggg

SEQ ID NO: 4894334 - DNA, 12 bp, Homo sapiens
ccccctttcctg

SEQ ID NO: 4894335 - DNA, 23 bp, Homo sapiens
ccccgaggccttctctgaaggac

SEQ ID NO: 4894336 - DNA, 12 bp, Homo sapiens
ccccgcagacct

SEQ ID NO: 4894337 - DNA, 13 bp, Homo sapiens
ccccgcagacctc

SEQ ID NO: 4894338 - DNA, 19 bp, Homo sapiens
ccccgcagacctccccagc

SEQ ID NO: 4894339 - DNA, 21 bp, Homo sapiens
ccccgcagacctccccagccc

SEQ ID NO: 4894340 - DNA, 17 bp, Homo sapiens
ccccgccctcttcctga

SEQ ID NO: 4894341 - DNA, 18 bp, Homo sapiens
ccccgcctgccctcatgg

SEQ ID NO: 4894342 - DNA, 16 bp, Homo sapiens
ccccgctaaggaagat

SEQ ID NO: 4894343 - DNA, 17 bp, Homo sapiens
ccccggcaccctctggc

SEQ ID NO: 4894344 - DNA, 14 bp, Homo sapiens
ccccggcagacgcc

SEQ ID NO: 4894345 - DNA, 13 bp, Homo sapiens
ccccggcaggccc

SEQ ID NO: 4894346 - DNA, 17 bp, Homo sapiens
ccccggcaggccctgca

SEQ ID NO: 4894347 - DNA, 14 bp, Homo sapiens
ccccggccacctct

SEQ ID NO: 4894348 - DNA, 13 bp, Homo sapiens
ccccggccccctg

SEQ ID NO: 4894349 - DNA, 12 bp, Homo sapiens
ccccggccctgg

SEQ ID NO: 4894350 - DNA, 15 bp, Homo sapiens
ccccgggctctctgc

SEQ ID NO: 4894351 - DNA, 17 bp, Homo sapiens
ccccgggctctctgctg

SEQ ID NO: 4894352 - DNA, 17 bp, Homo sapiens
cccctaaacccctgtcc

SEQ ID NO: 4894353 - DNA, 16 bp, Homo sapiens
cccctagaaacccaag

SEQ ID NO: 4894354 - DNA, 17 bp, Homo sapiens
cccctagcccaggagag

SEQ ID NO: 4894355 - DNA, 20 bp, Homo sapiens
cccctatccttggcaccaaa

SEQ ID NO: 4894356 - DNA, 18 bp, Homo sapiens
cccctcaaatcgtccagc

SEQ ID NO: 4894357 - DNA, 19 bp, Homo sapiens
cccctcaacctcctgtgga

SEQ ID NO: 4894358 - DNA, 13 bp, Homo sapiens
cccctcacagcct

SEQ ID NO: 4894359 - DNA, 12 bp, Homo sapiens
cccctcacctcc

SEQ ID NO: 4894360 - DNA, 14 bp, Homo sapiens
cccctcacctcctc

SEQ ID NO: 4894361 - DNA, 11 bp, Homo sapiens
cccctccagga

SEQ ID NO: 4894362 - DNA, 12 bp, Homo sapiens
cccctccatgtg

SEQ ID NO: 4894363 - DNA, 14 bp, Homo sapiens
cccctcccacctcc

SEQ ID NO: 4894364 - DNA, 16 bp, Homo sapiens
cccctcccccaacccc

SEQ ID NO: 4894365 - DNA, 21 bp, Homo sapiens
cccctcccccaacccccaccc

SEQ ID NO: 4894366 - DNA, 18 bp, Homo sapiens
cccctcccctgctgcagg

SEQ ID NO: 4894367 - DNA, 13 bp, Homo sapiens
cccctccctggct

SEQ ID NO: 4894368 - DNA, 14 bp, Homo sapiens
cccctccctggctc

SEQ ID NO: 4894369 - DNA, 13 bp, Homo sapiens
cccctccctgtca

SEQ ID NO: 4894370 - DNA, 13 bp, Homo sapiens
cccctcctcactg

SEQ ID NO: 4894371 - DNA, 13 bp, Homo sapiens
cccctccttcaga

SEQ ID NO: 4894372 - DNA, 15 bp, Homo sapiens
cccctctgacctgca

SEQ ID NO: 4894373 - DNA, 11 bp, Homo sapiens
cccctctgtag

SEQ ID NO: 4894374 - DNA, 12 bp, Homo sapiens
cccctctgtctt

SEQ ID NO: 4894375 - DNA, 12 bp, Homo sapiens
cccctctttctc

SEQ ID NO: 4894376 - DNA, 13 bp, Homo sapiens
cccctctttctct

SEQ ID NO: 4894377 - DNA, 17 bp, Homo sapiens
cccctgagatcccctga

SEQ ID NO: 4894378 - DNA, 20 bp, Homo sapiens
cccctgagatcccctgagcc

SEQ ID NO: 4894379 - DNA, 13 bp, Homo sapiens
cccctgagcccca

SEQ ID NO: 4894380 - DNA, 16 bp, Homo sapiens
cccctgccaccctggg

SEQ ID NO: 4894381 - DNA, 14 bp, Homo sapiens
cccctgccctgctg

SEQ ID NO: 4894382 - DNA, 12 bp, Homo sapiens
cccctgcctgcc

SEQ ID NO: 4894383 - DNA, 14 bp, Homo sapiens
cccctgcctgccat

SEQ ID NO: 4894384 - DNA, 15 bp, Homo sapiens
cccctgcctgccatg

SEQ ID NO: 4894385 - DNA, 16 bp, Homo sapiens
cccctgcctgccatgt

SEQ ID NO: 4894386 - DNA, 14 bp, Homo sapiens
cccctgctggctct

SEQ ID NO: 4894387 - DNA, 22 bp, Homo sapiens
cccctgctggctcttctgccca

SEQ ID NO: 4894388 - DNA, 20 bp, Homo sapiens
cccctgctggttcagggttg

SEQ ID NO: 4894389 - DNA, 11 bp, Homo sapiens
cccctggggcc

SEQ ID NO: 4894390 - DNA, 15 bp, Homo sapiens
cccctggggcctaga

SEQ ID NO: 4894391 - DNA, 14 bp, Homo sapiens
cccctgtcctcact

SEQ ID NO: 4894392 - DNA, 22 bp, Homo sapiens
ccccttccagatcactgccaca

SEQ ID NO: 4894393 - DNA, 15 bp, Homo sapiens
ccccttcgctcctgt

SEQ ID NO: 4894394 - DNA, 19 bp, Homo sapiens
ccccttcgctcctgtgtct

SEQ ID NO: 4894395 - DNA, 18 bp, Homo sapiens
ccccttgtcctttccctt

SEQ ID NO: 4894396 - DNA, 20 bp, Homo sapiens
ccccttttttgtcccccaac

SEQ ID NO: 4894397 - DNA, 18 bp, Homo sapiens
cccctttttttccttttt

SEQ ID NO: 4894398 - DNA, 16 bp, Homo sapiens
cccgaatagctgggac

SEQ ID NO: 4894399 - DNA, 18 bp, Homo sapiens
cccgaatagctgggacta

SEQ ID NO: 4894400 - DNA, 14 bp, Homo sapiens
cccgacagcctggc

SEQ ID NO: 4894401 - DNA, 15 bp, Homo sapiens
cccgacagcctggca

SEQ ID NO: 4894402 - DNA, 14 bp, Homo sapiens
cccgagctgtcccc

SEQ ID NO: 4894403 - DNA, 20 bp, Homo sapiens
cccgaggccttctctgaagg

SEQ ID NO: 4894404 - DNA, 21 bp, Homo sapiens
cccgaggccttctctgaagga

SEQ ID NO: 4894405 - DNA, 15 bp, Homo sapiens
cccgagtacagtctg

SEQ ID NO: 4894406 - DNA, 17 bp, Homo sapiens
cccgagtagctgggact

SEQ ID NO: 4894407 - DNA, 18 bp, Homo sapiens
cccgagtagctgggacta

SEQ ID NO: 4894408 - DNA, 13 bp, Homo sapiens
cccgcacagcagc

SEQ ID NO: 4894409 - DNA, 19 bp, Homo sapiens
cccgcaccccccaagctgt

SEQ ID NO: 4894410 - DNA, 12 bp, Homo sapiens
cccgcagacctc

SEQ ID NO: 4894411 - DNA, 14 bp, Homo sapiens
cccgcagacctccc

SEQ ID NO: 4894412 - DNA, 19 bp, Homo sapiens
cccgcagacctccccagcc

SEQ ID NO: 4894413 - DNA, 21 bp, Homo sapiens
cccgcagacctccccagcccc

SEQ ID NO: 4894414 - DNA, 13 bp, Homo sapiens
cccgcagccctgg

SEQ ID NO: 4894415 - DNA, 16 bp, Homo sapiens
cccgcagccctggcag

SEQ ID NO: 4894416 - DNA, 13 bp, Homo sapiens
cccgcctgccctc

SEQ ID NO: 4894417 - DNA, 23 bp, Homo sapiens
cccgccttccgccccttcccttc

SEQ ID NO: 4894418 - DNA, 13 bp, Homo sapiens
cccgctcagccct

SEQ ID NO: 4894419 - DNA, 23 bp, Homo sapiens
cccgctcagccctccctgcccct

SEQ ID NO: 4894420 - DNA, 16 bp, Homo sapiens
cccggaggaaatctgc

SEQ ID NO: 4894421 - DNA, 22 bp, Homo sapiens
cccggaggaaatctgcagaggg

SEQ ID NO: 4894422 - DNA, 18 bp, Homo sapiens
cccggaggggcctggcag

SEQ ID NO: 4894423 - DNA, 20 bp, Homo sapiens
cccggatcagagcaggacct

SEQ ID NO: 4894424 - DNA, 21 bp, Homo sapiens
cccggatcagagcaggacctc

SEQ ID NO: 4894425 - DNA, 17 bp, Homo sapiens
cccggcaccctctggcc

SEQ ID NO: 4894426 - DNA, 19 bp, Homo sapiens
cccggcaccctctggccgc

SEQ ID NO: 4894427 - DNA, 13 bp, Homo sapiens
cccggcagacgcc

SEQ ID NO: 4894428 - DNA, 12 bp, Homo sapiens
cccggcaggccc

SEQ ID NO: 4894429 - DNA, 14 bp, Homo sapiens
cccggcaggccctg

SEQ ID NO: 4894430 - DNA, 18 bp, Homo sapiens
cccggcaggccctgcagt

SEQ ID NO: 4894431 - DNA, 14 bp, Homo sapiens
cccggccacctctg

SEQ ID NO: 4894432 - DNA, 15 bp, Homo sapiens
cccggccacctctgc

SEQ ID NO: 4894433 - DNA, 22 bp, Homo sapiens
cccggccctgggctcggaggct

SEQ ID NO: 4894434 - DNA, 17 bp, Homo sapiens
cccggctaatttttgta

SEQ ID NO: 4894435 - DNA, 14 bp, Homo sapiens
cccggctccaggct

SEQ ID NO: 4894436 - DNA, 18 bp, Homo sapiens
cccggctctacgggggcc

SEQ ID NO: 4894437 - DNA, 20 bp, Homo sapiens
cccggctctacgggggccgc

SEQ ID NO: 4894438 - DNA, 12 bp, Homo sapiens
cccgggagccta

SEQ ID NO: 4894439 - DNA, 18 bp, Homo sapiens
cccgggagcctaggacca

SEQ ID NO: 4894440 - DNA, 23 bp, Homo sapiens
cccgggagggcggcacaggtcgg

SEQ ID NO: 4894441 - DNA, 17 bp, Homo sapiens
cccgggctctctgctgt

SEQ ID NO: 4894442 - DNA, 14 bp, Homo sapiens
cccgtaatgcttag

SEQ ID NO: 4894443 - DNA, 12 bp, Homo sapiens
cccgtctcagtg

SEQ ID NO: 4894444 - DNA, 19 bp, Homo sapiens
cccgtggccatccctgtga

SEQ ID NO: 4894445 - DNA, 14 bp, Homo sapiens
cccgtgggctcccg

SEQ ID NO: 4894446 - DNA, 17 bp, Homo sapiens
ccctacacccagacccc

SEQ ID NO: 4894447 - DNA, 13 bp, Homo sapiens
ccctacagagctg

SEQ ID NO: 4894448 - DNA, 18 bp, Homo sapiens
ccctaccgagtctcttct

SEQ ID NO: 4894449 - DNA, 13 bp, Homo sapiens
ccctacctcaggc

SEQ ID NO: 4894450 - DNA, 16 bp, Homo sapiens
ccctacctcaggcagg

SEQ ID NO: 4894451 - DNA, 21 bp, Homo sapiens
ccctactccctgcagatgcca

SEQ ID NO: 4894452 - DNA, 18 bp, Homo sapiens
ccctagagcctgcctgga

SEQ ID NO: 4894453 - DNA, 13 bp, Homo sapiens
ccctagcagtgaa

SEQ ID NO: 4894454 - DNA, 20 bp, Homo sapiens
ccctagccaatgtctcctcc

SEQ ID NO: 4894455 - DNA, 17 bp, Homo sapiens
ccctagccagcacttgt

SEQ ID NO: 4894456 - DNA, 17 bp, Homo sapiens
ccctagcccaggagaga

SEQ ID NO: 4894457 - DNA, 21 bp, Homo sapiens
ccctagctttatatatggaca

SEQ ID NO: 4894458 - DNA, 22 bp, Homo sapiens
ccctagctttatatatggacat

SEQ ID NO: 4894459 - DNA, 23 bp, Homo sapiens
ccctagctttatatatggacatg

SEQ ID NO: 4894460 - DNA, 17 bp, Homo sapiens
ccctaggaactcagtcc

SEQ ID NO: 4894461 - DNA, 13 bp, Homo sapiens
ccctatctcctga

SEQ ID NO: 4894462 - DNA, 12 bp, Homo sapiens
ccctcacagcct

SEQ ID NO: 4894463 - DNA, 14 bp, Homo sapiens
ccctcacagcctct

SEQ ID NO: 4894464 - DNA, 16 bp, Homo sapiens
ccctcaccttctgagt

SEQ ID NO: 4894465 - DNA, 13 bp, Homo sapiens
ccctcagagccac

SEQ ID NO: 4894466 - DNA, 13 bp, Homo sapiens
ccctcaggactgc

SEQ ID NO: 4894467 - DNA, 18 bp, Homo sapiens
ccctcatcttgaagggcc

SEQ ID NO: 4894468 - DNA, 22 bp, Homo sapiens
ccctcattccaccttcccatgc

SEQ ID NO: 4894469 - DNA, 11 bp, Homo sapiens
ccctcattttt

SEQ ID NO: 4894470 - DNA, 12 bp, Homo sapiens
ccctccactgtc

SEQ ID NO: 4894471 - DNA, 23 bp, Homo sapiens
ccctccagcctttggccttggct

SEQ ID NO: 4894472 - DNA, 15 bp, Homo sapiens
ccctcccacctccag

SEQ ID NO: 4894473 - DNA, 17 bp, Homo sapiens
ccctcccacctctgtga

SEQ ID NO: 4894474 - DNA, 16 bp, Homo sapiens
ccctcccccaaccccc

SEQ ID NO: 4894475 - DNA, 12 bp, Homo sapiens
ccctcccccttg

SEQ ID NO: 4894476 - DNA, 21 bp, Homo sapiens
ccctccccggcaccctctggc

SEQ ID NO: 4894477 - DNA, 14 bp, Homo sapiens
ccctcccctgccct

SEQ ID NO: 4894478 - DNA, 13 bp, Homo sapiens
ccctcccctgctg

SEQ ID NO: 4894479 - DNA, 14 bp, Homo sapiens
ccctccccttctct

SEQ ID NO: 4894480 - DNA, 23 bp, Homo sapiens
ccctcccgccccttcccactcac

SEQ ID NO: 4894481 - DNA, 12 bp, Homo sapiens
ccctccctggag

SEQ ID NO: 4894482 - DNA, 12 bp, Homo sapiens
ccctcctcacct

SEQ ID NO: 4894483 - DNA, 13 bp, Homo sapiens
ccctcctcacctc

SEQ ID NO: 4894484 - DNA, 12 bp, Homo sapiens
ccctcctcactg

SEQ ID NO: 4894485 - DNA, 15 bp, Homo sapiens
ccctcctcactggcc

SEQ ID NO: 4894486 - DNA, 19 bp, Homo sapiens
ccctcctcactggccatcc

SEQ ID NO: 4894487 - DNA, 21 bp, Homo sapiens
ccctcctgagggaggacctgg

SEQ ID NO: 4894488 - DNA, 13 bp, Homo sapiens
ccctcctggctct

SEQ ID NO: 4894489 - DNA, 14 bp, Homo sapiens
ccctcctttcacca

SEQ ID NO: 4894490 - DNA, 19 bp, Homo sapiens
ccctcgaagcgcgccactc

SEQ ID NO: 4894491 - DNA, 15 bp, Homo sapiens
ccctcgctgcttctg

SEQ ID NO: 4894492 - DNA, 20 bp, Homo sapiens
ccctcgtggtccccaacagc

SEQ ID NO: 4894493 - DNA, 13 bp, Homo sapiens
ccctctcaccaaa

SEQ ID NO: 4894494 - DNA, 14 bp, Homo sapiens
ccctctccttcctt

SEQ ID NO: 4894495 - DNA, 13 bp, Homo sapiens
ccctctctcttct

SEQ ID NO: 4894496 - DNA, 17 bp, Homo sapiens
ccctctctcttctgctc

SEQ ID NO: 4894497 - DNA, 19 bp, Homo sapiens
ccctctctcttctgctcca

SEQ ID NO: 4894498 - DNA, 19 bp, Homo sapiens
ccctctgacctgcactggg

SEQ ID NO: 4894499 - DNA, 9 bp, Homo sapiens
ccctctgcc

SEQ ID NO: 4894500 - DNA, 14 bp, Homo sapiens
ccctctgccaccag

SEQ ID NO: 4894501 - DNA, 15 bp, Homo sapiens
ccctctgctcagcca

SEQ ID NO: 4894502 - DNA, 21 bp, Homo sapiens
ccctctggaggggtgtggctc

SEQ ID NO: 4894503 - DNA, 12 bp, Homo sapiens
ccctctggccgc

SEQ ID NO: 4894504 - DNA, 12 bp, Homo sapiens
ccctctgggaac

SEQ ID NO: 4894505 - DNA, 14 bp, Homo sapiens
ccctctgggaacct

SEQ ID NO: 4894506 - DNA, 15 bp, Homo sapiens
ccctcttcctgtgat

SEQ ID NO: 4894507 - DNA, 16 bp, Homo sapiens
ccctctttctctttct

SEQ ID NO: 4894508 - DNA, 18 bp, Homo sapiens
ccctctttctctttcttc

SEQ ID NO: 4894509 - DNA, 19 bp, Homo sapiens
ccctctttggctcccctgt

SEQ ID NO: 4894510 - DNA, 12 bp, Homo sapiens
ccctcttttctt

SEQ ID NO: 4894511 - DNA, 22 bp, Homo sapiens
ccctcttttcttactcctcctc

SEQ ID NO: 4894512 - DNA, 21 bp, Homo sapiens
ccctcttttgttaaataatat

SEQ ID NO: 4894513 - DNA, 22 bp, Homo sapiens
ccctgaaaatgtttttctgcca

SEQ ID NO: 4894514 - DNA, 13 bp, Homo sapiens
ccctgaaacacga

SEQ ID NO: 4894515 - DNA, 21 bp, Homo sapiens
ccctgaaacctagtactgccc

SEQ ID NO: 4894516 - DNA, 16 bp, Homo sapiens
ccctgaagccagcctt

SEQ ID NO: 4894517 - DNA, 15 bp, Homo sapiens
ccctgaatccccctt

SEQ ID NO: 4894518 - DNA, 21 bp, Homo sapiens
ccctgaatcccccttgccacc

SEQ ID NO: 4894519 - DNA, 20 bp, Homo sapiens
ccctgagaagctgctccagg

SEQ ID NO: 4894520 - DNA, 14 bp, Homo sapiens
ccctgagatcccct

SEQ ID NO: 4894521 - DNA, 12 bp, Homo sapiens
ccctgagcgcct

SEQ ID NO: 4894522 - DNA, 22 bp, Homo sapiens
ccctgaggaaggaggggaagct

SEQ ID NO: 4894523 - DNA, 14 bp, Homo sapiens
ccctgaggagccag

SEQ ID NO: 4894524 - DNA, 20 bp, Homo sapiens
ccctgagttcatccaggccc

SEQ ID NO: 4894525 - DNA, 20 bp, Homo sapiens
ccctgatgtgtcctcaggga

SEQ ID NO: 4894526 - DNA, 23 bp, Homo sapiens
ccctgattgacctgctccgctgc

SEQ ID NO: 4894527 - DNA, 13 bp, Homo sapiens
ccctgcaaacaga

SEQ ID NO: 4894528 - DNA, 23 bp, Homo sapiens
ccctgcacaaagcccttccatgt

SEQ ID NO: 4894529 - DNA, 20 bp, Homo sapiens
ccctgcactaaagccagcct

SEQ ID NO: 4894530 - DNA, 15 bp, Homo sapiens
ccctgcagatgccac

SEQ ID NO: 4894531 - DNA, 21 bp, Homo sapiens
ccctgcagtgttcgcttggct

SEQ ID NO: 4894532 - DNA, 13 bp, Homo sapiens
ccctgcatcccct

SEQ ID NO: 4894533 - DNA, 15 bp, Homo sapiens
ccctgccccccagcc

SEQ ID NO: 4894534 - DNA, 18 bp, Homo sapiens
ccctgcccctcccttcaa

SEQ ID NO: 4894535 - DNA, 23 bp, Homo sapiens
ccctgcccctcccttcaaccatt

SEQ ID NO: 4894536 - DNA, 14 bp, Homo sapiens
ccctgcccggctgc

SEQ ID NO: 4894537 - DNA, 20 bp, Homo sapiens
ccctgcccgttcttgaaatg

SEQ ID NO: 4894538 - DNA, 14 bp, Homo sapiens
ccctgccctggtcc

SEQ ID NO: 4894539 - DNA, 18 bp, Homo sapiens
ccctgccctggtccaggg

SEQ ID NO: 4894540 - DNA, 13 bp, Homo sapiens
ccctgctcctgca

SEQ ID NO: 4894541 - DNA, 21 bp, Homo sapiens
ccctgctctccgaccagacac

SEQ ID NO: 4894542 - DNA, 21 bp, Homo sapiens
ccctgctgcaggggctctgga

SEQ ID NO: 4894543 - DNA, 22 bp, Homo sapiens
ccctgctgcaggggctctggag

SEQ ID NO: 4894544 - DNA, 22 bp, Homo sapiens
ccctgctgccgcctcccagcct

SEQ ID NO: 4894545 - DNA, 17 bp, Homo sapiens
ccctgctttgggctgcc

SEQ ID NO: 4894546 - DNA, 18 bp, Homo sapiens
ccctgctttgggctgccc

SEQ ID NO: 4894547 - DNA, 22 bp, Homo sapiens
ccctgctttgggctgccctggt

SEQ ID NO: 4894548 - DNA, 17 bp, Homo sapiens
ccctggacaagcagagg

SEQ ID NO: 4894549 - DNA, 14 bp, Homo sapiens
ccctggactgggag

SEQ ID NO: 4894550 - DNA, 19 bp, Homo sapiens
ccctggaggcactgaagtg

SEQ ID NO: 4894551 - DNA, 20 bp, Homo sapiens
ccctggagtgtggctgagga

SEQ ID NO: 4894552 - DNA, 23 bp, Homo sapiens
ccctggagtgtggctgaggaggc

SEQ ID NO: 4894553 - DNA, 24 bp, Homo sapiens
ccctggatcacgacgctgcagagc

SEQ ID NO: 4894554 - DNA, 15 bp, Homo sapiens
ccctggccgccccct

SEQ ID NO: 4894555 - DNA, 19 bp, Homo sapiens
ccctggctcccacaggccc

SEQ ID NO: 4894556 - DNA, 20 bp, Homo sapiens
ccctggctcccacaggccct

SEQ ID NO: 4894557 - DNA, 22 bp, Homo sapiens
ccctggctgtactgctcaggct

SEQ ID NO: 4894558 - DNA, 13 bp, Homo sapiens
ccctggcttttca

SEQ ID NO: 4894559 - DNA, 22 bp, Homo sapiens
ccctgggccagggtctgtgtga

SEQ ID NO: 4894560 - DNA, 15 bp, Homo sapiens
ccctggggcctagac

SEQ ID NO: 4894561 - DNA, 13 bp, Homo sapiens
ccctggggcctgg

SEQ ID NO: 4894562 - DNA, 16 bp, Homo sapiens
ccctggggctgggccc

SEQ ID NO: 4894563 - DNA, 22 bp, Homo sapiens
ccctggggctgggccccccagc

SEQ ID NO: 4894564 - DNA, 18 bp, Homo sapiens
ccctggtccagggaagct

SEQ ID NO: 4894565 - DNA, 15 bp, Homo sapiens
ccctggtctctggtc

SEQ ID NO: 4894566 - DNA, 21 bp, Homo sapiens
ccctggtgctgccacacttca

SEQ ID NO: 4894567 - DNA, 15 bp, Homo sapiens
ccctggtttcactgg

SEQ ID NO: 4894568 - DNA, 20 bp, Homo sapiens
ccctggtttcactggcccaa

SEQ ID NO: 4894569 - DNA, 17 bp, Homo sapiens
ccctgtacctcatccca

SEQ ID NO: 4894570 - DNA, 20 bp, Homo sapiens
ccctgtacctcatcccatga

SEQ ID NO: 4894571 - DNA, 19 bp, Homo sapiens
ccctgtaccttttgaggag

SEQ ID NO: 4894572 - DNA, 15 bp, Homo sapiens
ccctgtcccatgcag

SEQ ID NO: 4894573 - DNA, 19 bp, Homo sapiens
ccctgtcccatgcaggccc

SEQ ID NO: 4894574 - DNA, 13 bp, Homo sapiens
ccctgtccctccc

SEQ ID NO: 4894575 - DNA, 15 bp, Homo sapiens
ccctgtccctcccac

SEQ ID NO: 4894576 - DNA, 22 bp, Homo sapiens
ccctgtccctcccacctctgtg

SEQ ID NO: 4894577 - DNA, 14 bp, Homo sapiens
ccctgtcctcactg

SEQ ID NO: 4894578 - DNA, 16 bp, Homo sapiens
ccctgtcctcactgct

SEQ ID NO: 4894579 - DNA, 21 bp, Homo sapiens
ccctgtcgagttcggctctgg

SEQ ID NO: 4894580 - DNA, 15 bp, Homo sapiens
ccctgtggccctggc

SEQ ID NO: 4894581 - DNA, 21 bp, Homo sapiens
ccctgttctaagggggagggg

SEQ ID NO: 4894582 - DNA, 16 bp, Homo sapiens
ccctgttcttcctcca

SEQ ID NO: 4894583 - DNA, 21 bp, Homo sapiens
ccctgttcttcctccagctgc

SEQ ID NO: 4894584 - DNA, 14 bp, Homo sapiens
cccttaacccaagg

SEQ ID NO: 4894585 - DNA, 18 bp, Homo sapiens
cccttaattacttaaaaa

SEQ ID NO: 4894586 - DNA, 20 bp, Homo sapiens
cccttaattacttaaaaaaa

SEQ ID NO: 4894587 - DNA, 14 bp, Homo sapiens
cccttagcagggaa

SEQ ID NO: 4894588 - DNA, 12 bp, Homo sapiens
cccttagtcccc

SEQ ID NO: 4894589 - DNA, 15 bp, Homo sapiens
cccttagtcccccaa

SEQ ID NO: 4894590 - DNA, 14 bp, Homo sapiens
cccttcaaccattc

SEQ ID NO: 4894591 - DNA, 18 bp, Homo sapiens
cccttcaaccattcccca

SEQ ID NO: 4894592 - DNA, 16 bp, Homo sapiens
cccttcacatttttta

SEQ ID NO: 4894593 - DNA, 12 bp, Homo sapiens
cccttcagcccc

SEQ ID NO: 4894594 - DNA, 20 bp, Homo sapiens
cccttcagcccccagcccct

SEQ ID NO: 4894595 - DNA, 17 bp, Homo sapiens
cccttcagtaccctctc

SEQ ID NO: 4894596 - DNA, 13 bp, Homo sapiens
cccttccactgcc

SEQ ID NO: 4894597 - DNA, 18 bp, Homo sapiens
cccttccactgcctctgc

SEQ ID NO: 4894598 - DNA, 13 bp, Homo sapiens
cccttccagatca

SEQ ID NO: 4894599 - DNA, 13 bp, Homo sapiens
cccttcccccacc

SEQ ID NO: 4894600 - DNA, 19 bp, Homo sapiens
cccttcccctccctggctc

SEQ ID NO: 4894601 - DNA, 13 bp, Homo sapiens
cccttccctgcac

SEQ ID NO: 4894602 - DNA, 13 bp, Homo sapiens
cccttcccttccc

SEQ ID NO: 4894603 - DNA, 21 bp, Homo sapiens
cccttccgaccctctgggaac

SEQ ID NO: 4894604 - DNA, 13 bp, Homo sapiens
cccttcctctcca

SEQ ID NO: 4894605 - DNA, 17 bp, Homo sapiens
cccttcctctccactgc

SEQ ID NO: 4894606 - DNA, 13 bp, Homo sapiens
cccttcgctcctg

SEQ ID NO: 4894607 - DNA, 16 bp, Homo sapiens
cccttcgctcctgtgt

SEQ ID NO: 4894608 - DNA, 13 bp, Homo sapiens
cccttctcacagc

SEQ ID NO: 4894609 - DNA, 15 bp, Homo sapiens
cccttctcacagcac

SEQ ID NO: 4894610 - DNA, 23 bp, Homo sapiens
cccttctcattccaacagtgagt

SEQ ID NO: 4894611 - DNA, 14 bp, Homo sapiens
cccttctctgctcc

SEQ ID NO: 4894612 - DNA, 16 bp, Homo sapiens
cccttctctgctccac

SEQ ID NO: 4894613 - DNA, 23 bp, Homo sapiens
cccttctctgctccaccacatcc

SEQ ID NO: 4894614 - DNA, 16 bp, Homo sapiens
cccttgatgcacagag

SEQ ID NO: 4894615 - DNA, 13 bp, Homo sapiens
cccttgccacccc

SEQ ID NO: 4894616 - DNA, 15 bp, Homo sapiens
cccttgccactttgc

SEQ ID NO: 4894617 - DNA, 17 bp, Homo sapiens
cccttgccactttgcac

SEQ ID NO: 4894618 - DNA, 14 bp, Homo sapiens
cccttggcctcaga

SEQ ID NO: 4894619 - DNA, 14 bp, Homo sapiens
cccttggctgtgag

SEQ ID NO: 4894620 - DNA, 15 bp, Homo sapiens
ccctttccctcgcta

SEQ ID NO: 4894621 - DNA, 13 bp, Homo sapiens
ccctttccttcca

SEQ ID NO: 4894622 - DNA, 15 bp, Homo sapiens
ccctttccttccatc

SEQ ID NO: 4894623 - DNA, 15 bp, Homo sapiens
ccctttgaagcctca

SEQ ID NO: 4894624 - DNA, 18 bp, Homo sapiens
ccctttgaagcctcagct

SEQ ID NO: 4894625 - DNA, 21 bp, Homo sapiens
ccctttgaagcctcagctacc

SEQ ID NO: 4894626 - DNA, 15 bp, Homo sapiens
ccctttttctccagc

SEQ ID NO: 4894627 - DNA, 16 bp, Homo sapiens
cccttttttgtccccc

SEQ ID NO: 4894628 - DNA, 17 bp, Homo sapiens
cccttttttgtccccca

SEQ ID NO: 4894629 - DNA, 18 bp, Homo sapiens
cccttttttgtcccccaa

SEQ ID NO: 4894630 - DNA, 21 bp, Homo sapiens
ccctttttttcctttttctga

SEQ ID NO: 4894631 - DNA, 23 bp, Homo sapiens
ccctttttttcctttttctgatt

SEQ ID NO: 4894632 - DNA, 18 bp, Homo sapiens
ccgaagaatggagaggaa

SEQ ID NO: 4894633 - DNA, 15 bp, Homo sapiens
ccgaaggtgctggag

SEQ ID NO: 4894634 - DNA, 21 bp, Homo sapiens
ccgaaggttatggtcaatccc

SEQ ID NO: 4894635 - DNA, 13 bp, Homo sapiens
ccgaagtcttttg

SEQ ID NO: 4894636 - DNA, 21 bp, Homo sapiens
ccgaagtggactggcccctgg

SEQ ID NO: 4894637 - DNA, 16 bp, Homo sapiens
ccgaatagctgggact

SEQ ID NO: 4894638 - DNA, 16 bp, Homo sapiens
ccgaatcccctccctg

SEQ ID NO: 4894639 - DNA, 22 bp, Homo sapiens
ccgaattcgctgttaccgcctg

SEQ ID NO: 4894640 - DNA, 15 bp, Homo sapiens
ccgacagcctggcac

SEQ ID NO: 4894641 - DNA, 17 bp, Homo sapiens
ccgaccacttccagggg

SEQ ID NO: 4894642 - DNA, 13 bp, Homo sapiens
ccgaccagacacc

SEQ ID NO: 4894643 - DNA, 17 bp, Homo sapiens
ccgaccctctgggaacc

SEQ ID NO: 4894644 - DNA, 19 bp, Homo sapiens
ccgaccctctgggaacctc

SEQ ID NO: 4894645 - DNA, 16 bp, Homo sapiens
ccgacgcgtctcctgt

SEQ ID NO: 4894646 - DNA, 15 bp, Homo sapiens
ccgagcaaagatcaa

SEQ ID NO: 4894647 - DNA, 13 bp, Homo sapiens
ccgagctgtcccc

SEQ ID NO: 4894648 - DNA, 14 bp, Homo sapiens
ccgagctgtttatg

SEQ ID NO: 4894649 - DNA, 16 bp, Homo sapiens
ccgaggagccaggcaa

SEQ ID NO: 4894650 - DNA, 19 bp, Homo sapiens
ccgagggtcctggctcctg

SEQ ID NO: 4894651 - DNA, 13 bp, Homo sapiens
ccgagtctgggac

SEQ ID NO: 4894652 - DNA, 14 bp, Homo sapiens
ccgagtctgggaca

SEQ ID NO: 4894653 - DNA, 14 bp, Homo sapiens
ccgcacaccctcac

SEQ ID NO: 4894654 - DNA, 19 bp, Homo sapiens
ccgcacaccctcactctgc

SEQ ID NO: 4894655 - DNA, 21 bp, Homo sapiens
ccgcacaccctcactctgcca

SEQ ID NO: 4894656 - DNA, 23 bp, Homo sapiens
ccgcacaccctcactctgccagg

SEQ ID NO: 4894657 - DNA, 12 bp, Homo sapiens
ccgcacagcagc

SEQ ID NO: 4894658 - DNA, 14 bp, Homo sapiens
ccgcacagcagcct

SEQ ID NO: 4894659 - DNA, 16 bp, Homo sapiens
ccgcacagcagcctgc

SEQ ID NO: 4894660 - DNA, 13 bp, Homo sapiens
ccgcacagctcag

SEQ ID NO: 4894661 - DNA, 16 bp, Homo sapiens
ccgcacagctcaggag

SEQ ID NO: 4894662 - DNA, 17 bp, Homo sapiens
ccgcactttccacttct

SEQ ID NO: 4894663 - DNA, 14 bp, Homo sapiens
ccgcagaagccctg

SEQ ID NO: 4894664 - DNA, 15 bp, Homo sapiens
ccgcagacctcccca

SEQ ID NO: 4894665 - DNA, 17 bp, Homo sapiens
ccgcagacctccccagc

SEQ ID NO: 4894666 - DNA, 21 bp, Homo sapiens
ccgcagacctccccagcccct

SEQ ID NO: 4894667 - DNA, 16 bp, Homo sapiens
ccgccactcctgaacc

SEQ ID NO: 4894668 - DNA, 16 bp, Homo sapiens
ccgccagactgttaga

SEQ ID NO: 4894669 - DNA, 19 bp, Homo sapiens
ccgccattgccaccaggag

SEQ ID NO: 4894670 - DNA, 19 bp, Homo sapiens
ccgcccatgcactggggac

SEQ ID NO: 4894671 - DNA, 17 bp, Homo sapiens
ccgcccctgcctgccat

SEQ ID NO: 4894672 - DNA, 18 bp, Homo sapiens
ccgccccttcccttccct

SEQ ID NO: 4894673 - DNA, 13 bp, Homo sapiens
ccgccctcttcct

SEQ ID NO: 4894674 - DNA, 15 bp, Homo sapiens
ccgcctcaaaatgtg

SEQ ID NO: 4894675 - DNA, 15 bp, Homo sapiens
ccgcctcccagcctg

SEQ ID NO: 4894676 - DNA, 17 bp, Homo sapiens
ccgcctgacagaaacca

SEQ ID NO: 4894677 - DNA, 23 bp, Homo sapiens
ccgccttccgccccttcccttcc

SEQ ID NO: 4894678 - DNA, 23 bp, Homo sapiens
ccgccttccttgaccttcctctg

SEQ ID NO: 4894679 - DNA, 19 bp, Homo sapiens
ccgcgggttccgcaggcag

SEQ ID NO: 4894680 - DNA, 13 bp, Homo sapiens
ccgctaaggaaga

SEQ ID NO: 4894681 - DNA, 19 bp, Homo sapiens
ccgctcacctagagccaga

SEQ ID NO: 4894682 - DNA, 12 bp, Homo sapiens
ccgctcagccct

SEQ ID NO: 4894683 - DNA, 18 bp, Homo sapiens
ccgctctacatcttctgc

SEQ ID NO: 4894684 - DNA, 19 bp, Homo sapiens
ccgctctcttcctgcccct

SEQ ID NO: 4894685 - DNA, 22 bp, Homo sapiens
ccgctctcttcctgcccctctt

SEQ ID NO: 4894686 - DNA, 23 bp, Homo sapiens
ccgctgccgtgccgcctgcactc

SEQ ID NO: 4894687 - DNA, 11 bp, Homo sapiens
ccgctgctgct

SEQ ID NO: 4894688 - DNA, 20 bp, Homo sapiens
ccgctgtaagctcctttgtg

SEQ ID NO: 4894689 - DNA, 20 bp, Homo sapiens
ccgctgtgagcccctggtcc

SEQ ID NO: 4894690 - DNA, 15 bp, Homo sapiens
ccgcttccctattta

SEQ ID NO: 4894691 - DNA, 16 bp, Homo sapiens
ccgcttccctcctgcc

SEQ ID NO: 4894692 - DNA, 21 bp, Homo sapiens
ccgcttgtggggacccaggct

SEQ ID NO: 4894693 - DNA, 23 bp, Homo sapiens
ccgcttgtggggacccaggctcc

SEQ ID NO: 4894694 - DNA, 19 bp, Homo sapiens
ccgctttctacccagcgag

SEQ ID NO: 4894695 - DNA, 16 bp, Homo sapiens
ccggacactcctagag

SEQ ID NO: 4894696 - DNA, 14 bp, Homo sapiens
ccggacccacctca

SEQ ID NO: 4894697 - DNA, 19 bp, Homo sapiens
ccggagattggacggcctg

SEQ ID NO: 4894698 - DNA, 20 bp, Homo sapiens
ccggagattggacggcctga

SEQ ID NO: 4894699 - DNA, 17 bp, Homo sapiens
ccggaggggcctggcag

SEQ ID NO: 4894700 - DNA, 21 bp, Homo sapiens
ccggaggggcctggcagccgt

SEQ ID NO: 4894701 - DNA, 14 bp, Homo sapiens
ccggcaggccctgc

SEQ ID NO: 4894702 - DNA, 16 bp, Homo sapiens
ccggcaggccctgcag

SEQ ID NO: 4894703 - DNA, 21 bp, Homo sapiens
ccggcaggccctgcagtgttc

SEQ ID NO: 4894704 - DNA, 17 bp, Homo sapiens
ccggccaatggaaacct

SEQ ID NO: 4894705 - DNA, 13 bp, Homo sapiens
ccggccacctctg

SEQ ID NO: 4894706 - DNA, 13 bp, Homo sapiens
ccggccccctggt

SEQ ID NO: 4894707 - DNA, 15 bp, Homo sapiens
ccggccccctggtct

SEQ ID NO: 4894708 - DNA, 13 bp, Homo sapiens
ccggcccctgctg

SEQ ID NO: 4894709 - DNA, 19 bp, Homo sapiens
ccggccctgggctcggagg

SEQ ID NO: 4894710 - DNA, 14 bp, Homo sapiens
ccggccgatggaga

SEQ ID NO: 4894711 - DNA, 15 bp, Homo sapiens
ccggccgctccacca

SEQ ID NO: 4894712 - DNA, 12 bp, Homo sapiens
ccggctccaggc

SEQ ID NO: 4894713 - DNA, 14 bp, Homo sapiens
ccggctccaggctc

SEQ ID NO: 4894714 - DNA, 21 bp, Homo sapiens
ccggctccaggctcctttagc

SEQ ID NO: 4894715 - DNA, 15 bp, Homo sapiens
ccggcttcctttccc

SEQ ID NO: 4894716 - DNA, 23 bp, Homo sapiens
ccggcttcctttcccaagccttc

SEQ ID NO: 4894717 - DNA, 17 bp, Homo sapiens
ccgggaaccaagcagga

SEQ ID NO: 4894718 - DNA, 19 bp, Homo sapiens
ccgggagcctaggaccact

SEQ ID NO: 4894719 - DNA, 15 bp, Homo sapiens
ccgggcactcagaag

SEQ ID NO: 4894720 - DNA, 13 bp, Homo sapiens
ccgggccacagag

SEQ ID NO: 4894721 - DNA, 23 bp, Homo sapiens
ccgggccgaatcccctccctgtc

SEQ ID NO: 4894722 - DNA, 17 bp, Homo sapiens
ccgggcgcggccagccc

SEQ ID NO: 4894723 - DNA, 21 bp, Homo sapiens
ccggggtggagcatgggcctg

SEQ ID NO: 4894724 - DNA, 17 bp, Homo sapiens
ccggtagggaggcagcc

SEQ ID NO: 4894725 - DNA, 17 bp, Homo sapiens
ccgtaataattattatt

SEQ ID NO: 4894726 - DNA, 14 bp, Homo sapiens
ccgtcctcacccct

SEQ ID NO: 4894727 - DNA, 18 bp, Homo sapiens
ccgtgaaaacggagctga

SEQ ID NO: 4894728 - DNA, 16 bp, Homo sapiens
ccgtgaactgtgcata

SEQ ID NO: 4894729 - DNA, 21 bp, Homo sapiens
ccgtgccgcctgcactcctca

SEQ ID NO: 4894730 - DNA, 16 bp, Homo sapiens
ccgtgccttcagctct

SEQ ID NO: 4894731 - DNA, 19 bp, Homo sapiens
ccgtggccatccctgtgag

SEQ ID NO: 4894732 - DNA, 21 bp, Homo sapiens
ccgtggcttcccgctcagccc

SEQ ID NO: 4894733 - DNA, 23 bp, Homo sapiens
ccgtggcttcccgctcagccctc

SEQ ID NO: 4894734 - DNA, 23 bp, Homo sapiens
ccgtggtttgaacacgaaagaaa

SEQ ID NO: 4894735 - DNA, 13 bp, Homo sapiens
cctaaaagcaaaa

SEQ ID NO: 4894736 - DNA, 22 bp, Homo sapiens
cctaaaagcaaaataaaaacta

SEQ ID NO: 4894737 - DNA, 23 bp, Homo sapiens
cctaaaagcaaaataaaaactat

SEQ ID NO: 4894738 - DNA, 15 bp, Homo sapiens
cctaaaatacattta

SEQ ID NO: 4894739 - DNA, 12 bp, Homo sapiens
cctaaaatcttg

SEQ ID NO: 4894740 - DNA, 15 bp, Homo sapiens
cctaaaattcagtgg

SEQ ID NO: 4894741 - DNA, 16 bp, Homo sapiens
cctaaaattcagtgga

SEQ ID NO: 4894742 - DNA, 12 bp, Homo sapiens
cctaaagaaaaa

SEQ ID NO: 4894743 - DNA, 13 bp, Homo sapiens
cctaaagagagta

SEQ ID NO: 4894744 - DNA, 18 bp, Homo sapiens
cctaaatttaatgctgcc

SEQ ID NO: 4894745 - DNA, 20 bp, Homo sapiens
cctaaatttaatgctgcctt

SEQ ID NO: 4894746 - DNA, 16 bp, Homo sapiens
cctaactgaagagaca

SEQ ID NO: 4894747 - DNA, 17 bp, Homo sapiens
cctaagcattgcctggc

SEQ ID NO: 4894748 - DNA, 16 bp, Homo sapiens
cctaagccacttgaaa

SEQ ID NO: 4894749 - DNA, 13 bp, Homo sapiens
cctaagccagcct

SEQ ID NO: 4894750 - DNA, 16 bp, Homo sapiens
cctaaggaaccttcct

SEQ ID NO: 4894751 - DNA, 19 bp, Homo sapiens
cctaagggtcgaaagctct

SEQ ID NO: 4894752 - DNA, 12 bp, Homo sapiens
cctaagtactgt

SEQ ID NO: 4894753 - DNA, 17 bp, Homo sapiens
cctaagtattaaaacat

SEQ ID NO: 4894754 - DNA, 21 bp, Homo sapiens
cctaagtattaaaacattgga

SEQ ID NO: 4894755 - DNA, 18 bp, Homo sapiens
cctaagtcctttatgtgg

SEQ ID NO: 4894756 - DNA, 15 bp, Homo sapiens
cctaagtctctgtga

SEQ ID NO: 4894757 - DNA, 18 bp, Homo sapiens
cctaatctcatacctctg

SEQ ID NO: 4894758 - DNA, 21 bp, Homo sapiens
cctaatctcatacctctgacc

SEQ ID NO: 4894759 - DNA, 17 bp, Homo sapiens
cctacaagagcagcctg

SEQ ID NO: 4894760 - DNA, 18 bp, Homo sapiens
cctacaagatttagaaaa

SEQ ID NO: 4894761 - DNA, 20 bp, Homo sapiens
cctacaagatttagaaaaaa

SEQ ID NO: 4894762 - DNA, 22 bp, Homo sapiens
cctacaagatttagaaaaaagt

SEQ ID NO: 4894763 - DNA, 14 bp, Homo sapiens
cctacaaggcctat

SEQ ID NO: 4894764 - DNA, 17 bp, Homo sapiens
cctacacccagacccca

SEQ ID NO: 4894765 - DNA, 15 bp, Homo sapiens
cctacagcactactg

SEQ ID NO: 4894766 - DNA, 20 bp, Homo sapiens
cctacagctttgatccctga

SEQ ID NO: 4894767 - DNA, 21 bp, Homo sapiens
cctacagctttgatccctgac

SEQ ID NO: 4894768 - DNA, 19 bp, Homo sapiens
cctacatgaaacagaaaca

SEQ ID NO: 4894769 - DNA, 17 bp, Homo sapiens
cctacccacacctctgc

SEQ ID NO: 4894770 - DNA, 22 bp, Homo sapiens
cctaccgagtctcttctccact

SEQ ID NO: 4894771 - DNA, 15 bp, Homo sapiens
cctacctcaggcagg

SEQ ID NO: 4894772 - DNA, 16 bp, Homo sapiens
cctacctgctctccaa

SEQ ID NO: 4894773 - DNA, 12 bp, Homo sapiens
cctacctggtaa

SEQ ID NO: 4894774 - DNA, 15 bp, Homo sapiens
cctacctgtgcctga

SEQ ID NO: 4894775 - DNA, 16 bp, Homo sapiens
cctacgcgccttgtct

SEQ ID NO: 4894776 - DNA, 20 bp, Homo sapiens
cctactcctgactcctacct

SEQ ID NO: 4894777 - DNA, 20 bp, Homo sapiens
cctagagaacgcagccctag

SEQ ID NO: 4894778 - DNA, 21 bp, Homo sapiens
cctagagaagataattgttga

SEQ ID NO: 4894779 - DNA, 13 bp, Homo sapiens
cctagagccagac

SEQ ID NO: 4894780 - DNA, 18 bp, Homo sapiens
cctagagcctgcctggag

SEQ ID NO: 4894781 - DNA, 16 bp, Homo sapiens
cctagcaagctggcct

SEQ ID NO: 4894782 - DNA, 13 bp, Homo sapiens
cctagcaattcca

SEQ ID NO: 4894783 - DNA, 12 bp, Homo sapiens
cctagcagtgaa

SEQ ID NO: 4894784 - DNA, 20 bp, Homo sapiens
cctagcccaccctgctgcct

SEQ ID NO: 4894785 - DNA, 13 bp, Homo sapiens
cctagcccagcgc

SEQ ID NO: 4894786 - DNA, 11 bp, Homo sapiens
cctagcccagg

SEQ ID NO: 4894787 - DNA, 13 bp, Homo sapiens
cctagcccaggag

SEQ ID NO: 4894788 - DNA, 13 bp, Homo sapiens
cctagccctctca

SEQ ID NO: 4894789 - DNA, 20 bp, Homo sapiens
cctagctttatatatggaca

SEQ ID NO: 4894790 - DNA, 20 bp, Homo sapiens
cctaggaccactcagcccct

SEQ ID NO: 4894791 - DNA, 17 bp, Homo sapiens
cctaggctccaccccat

SEQ ID NO: 4894792 - DNA, 15 bp, Homo sapiens
cctaggtgacagagt

SEQ ID NO: 4894793 - DNA, 14 bp, Homo sapiens
cctagtcccttccc

SEQ ID NO: 4894794 - DNA, 16 bp, Homo sapiens
cctagtcccttcccct

SEQ ID NO: 4894795 - DNA, 21 bp, Homo sapiens
cctagtcccttcccctccctg

SEQ ID NO: 4894796 - DNA, 16 bp, Homo sapiens
cctagtttcctctcct

SEQ ID NO: 4894797 - DNA, 20 bp, Homo sapiens
cctagtttgggaggagcaga

SEQ ID NO: 4894798 - DNA, 15 bp, Homo sapiens
cctagttttctcctc

SEQ ID NO: 4894799 - DNA, 16 bp, Homo sapiens
cctagttttctcctcc

SEQ ID NO: 4894800 - DNA, 19 bp, Homo sapiens
cctagttttctcctcccag

SEQ ID NO: 4894801 - DNA, 20 bp, Homo sapiens
cctagttttctcctcccagg

SEQ ID NO: 4894802 - DNA, 15 bp, Homo sapiens
cctataatctgtcaa

SEQ ID NO: 4894803 - DNA, 21 bp, Homo sapiens
cctataatgtgtgtatgtgta

SEQ ID NO: 4894804 - DNA, 14 bp, Homo sapiens
cctatatgtagtat

SEQ ID NO: 4894805 - DNA, 16 bp, Homo sapiens
cctatcacctatttcc

SEQ ID NO: 4894806 - DNA, 17 bp, Homo sapiens
cctatcagaagtttctc

SEQ ID NO: 4894807 - DNA, 13 bp, Homo sapiens
cctatcatttatt

SEQ ID NO: 4894808 - DNA, 17 bp, Homo sapiens
cctatccactgggcaca

SEQ ID NO: 4894809 - DNA, 13 bp, Homo sapiens
cctatctcctgac

SEQ ID NO: 4894810 - DNA, 15 bp, Homo sapiens
cctatctcctgacag

SEQ ID NO: 4894811 - DNA, 16 bp, Homo sapiens
cctatgagcatcctga

SEQ ID NO: 4894812 - DNA, 17 bp, Homo sapiens
cctcaacctcttctggc

SEQ ID NO: 4894813 - DNA, 18 bp, Homo sapiens
cctcaacgtattgtttcg

SEQ ID NO: 4894814 - DNA, 23 bp, Homo sapiens
cctcaaggttttaggttctaaag

SEQ ID NO: 4894815 - DNA, 23 bp, Homo sapiens
cctcaagtgattctcctgcctca

SEQ ID NO: 4894816 - DNA, 19 bp, Homo sapiens
cctcaatttttgtctcaga

SEQ ID NO: 4894817 - DNA, 21 bp, Homo sapiens
cctcaatttttgtctcagaag

SEQ ID NO: 4894818 - DNA, 17 bp, Homo sapiens
cctcacacaccctgagg

SEQ ID NO: 4894819 - DNA, 13 bp, Homo sapiens
cctcacagcctct

SEQ ID NO: 4894820 - DNA, 23 bp, Homo sapiens
cctcacagcctctgacccctcct

SEQ ID NO: 4894821 - DNA, 16 bp, Homo sapiens
cctcacagtcccactg

SEQ ID NO: 4894822 - DNA, 18 bp, Homo sapiens
cctcacagtgacccttcc

SEQ ID NO: 4894823 - DNA, 21 bp, Homo sapiens
cctcacatagctacccaaaag

SEQ ID NO: 4894824 - DNA, 19 bp, Homo sapiens
cctcacccccagctttgct

SEQ ID NO: 4894825 - DNA, 13 bp, Homo sapiens
cctcacccttgcg

SEQ ID NO: 4894826 - DNA, 18 bp, Homo sapiens
cctcaccgagtgggggca

SEQ ID NO: 4894827 - DNA, 17 bp, Homo sapiens
cctcaccgcttccctcc

SEQ ID NO: 4894828 - DNA, 20 bp, Homo sapiens
cctcacctctggactggcta

SEQ ID NO: 4894829 - DNA, 15 bp, Homo sapiens
cctcaccttctgagt

SEQ ID NO: 4894830 - DNA, 21 bp, Homo sapiens
cctcactgcccgcacaccctc

SEQ ID NO: 4894831 - DNA, 22 bp, Homo sapiens
cctcactgcccgcacaccctca

SEQ ID NO: 4894832 - DNA, 17 bp, Homo sapiens
cctcactgctccctgaa

SEQ ID NO: 4894833 - DNA, 14 bp, Homo sapiens
cctcagcatcctgg

SEQ ID NO: 4894834 - DNA, 21 bp, Homo sapiens
cctcagcctcccaaagtgctg

SEQ ID NO: 4894835 - DNA, 12 bp, Homo sapiens
cctcagcctgca

SEQ ID NO: 4894836 - DNA, 16 bp, Homo sapiens
cctcagctgcctcact

SEQ ID NO: 4894837 - DNA, 17 bp, Homo sapiens
cctcagctgcctcactt

SEQ ID NO: 4894838 - DNA, 22 bp, Homo sapiens
cctcaggcactagcctttggct

SEQ ID NO: 4894839 - DNA, 14 bp, Homo sapiens
cctcaggcagctca

SEQ ID NO: 4894840 - DNA, 15 bp, Homo sapiens
cctcaggcagctcaa

SEQ ID NO: 4894841 - DNA, 15 bp, Homo sapiens
cctcaggcaggaagg

SEQ ID NO: 4894842 - DNA, 21 bp, Homo sapiens
cctcagggagcagggaaggcc

SEQ ID NO: 4894843 - DNA, 18 bp, Homo sapiens
cctcaggggaaaactgtt

SEQ ID NO: 4894844 - DNA, 17 bp, Homo sapiens
cctcaggtgatccaccc

SEQ ID NO: 4894845 - DNA, 16 bp, Homo sapiens
cctcagtatatttaaa

SEQ ID NO: 4894846 - DNA, 18 bp, Homo sapiens
cctcagtccatttatata

SEQ ID NO: 4894847 - DNA, 20 bp, Homo sapiens
cctcagtccatttatatatg

SEQ ID NO: 4894848 - DNA, 16 bp, Homo sapiens
cctcagtcctcccctc

SEQ ID NO: 4894849 - DNA, 17 bp, Homo sapiens
cctcagtcctcccctca

SEQ ID NO: 4894850 - DNA, 18 bp, Homo sapiens
cctcagtcctcccctcac

SEQ ID NO: 4894851 - DNA, 20 bp, Homo sapiens
cctcagtcctcccctcacag

SEQ ID NO: 4894852 - DNA, 21 bp, Homo sapiens
cctcagtcctcccctcacagc

SEQ ID NO: 4894853 - DNA, 22 bp, Homo sapiens
cctcagtcctcccctcacagcc

SEQ ID NO: 4894854 - DNA, 17 bp, Homo sapiens
cctcagttcccttggcc

SEQ ID NO: 4894855 - DNA, 19 bp, Homo sapiens
cctcagttcccttggcctc

SEQ ID NO: 4894856 - DNA, 22 bp, Homo sapiens
cctcagttcccttggcctcaga

SEQ ID NO: 4894857 - DNA, 21 bp, Homo sapiens
cctcatagtatggtggctggg

SEQ ID NO: 4894858 - DNA, 22 bp, Homo sapiens
cctcatagtatggtggctgggt

SEQ ID NO: 4894859 - DNA, 20 bp, Homo sapiens
cctcatcccgtgttctcctt

SEQ ID NO: 4894860 - DNA, 22 bp, Homo sapiens
cctcatcttgaagggcccagga

SEQ ID NO: 4894861 - DNA, 19 bp, Homo sapiens
cctcattgacaagaactga

SEQ ID NO: 4894862 - DNA, 21 bp, Homo sapiens
cctccaagctccatctccact

SEQ ID NO: 4894863 - DNA, 20 bp, Homo sapiens
cctccacagcgagggcagct

SEQ ID NO: 4894864 - DNA, 23 bp, Homo sapiens
cctccacagcgagggcagctgct

SEQ ID NO: 4894865 - DNA, 13 bp, Homo sapiens
cctccagaagcct

SEQ ID NO: 4894866 - DNA, 16 bp, Homo sapiens
cctccagcccgggagc

SEQ ID NO: 4894867 - DNA, 14 bp, Homo sapiens
cctccagctgcacc

SEQ ID NO: 4894868 - DNA, 22 bp, Homo sapiens
cctccaggaatgatctcttctt

SEQ ID NO: 4894869 - DNA, 24 bp, Homo sapiens
cctccatctcatgtatcatctgga

SEQ ID NO: 4894870 - DNA, 14 bp, Homo sapiens
cctccatgctgcct

SEQ ID NO: 4894871 - DNA, 15 bp, Homo sapiens
cctccatgctgcctc

SEQ ID NO: 4894872 - DNA, 21 bp, Homo sapiens
cctccattaaagtctgaatca

SEQ ID NO: 4894873 - DNA, 17 bp, Homo sapiens
cctcccaaagtgctggg

SEQ ID NO: 4894874 - DNA, 15 bp, Homo sapiens
cctcccacctctgtg

SEQ ID NO: 4894875 - DNA, 12 bp, Homo sapiens
cctcccagaggt

SEQ ID NO: 4894876 - DNA, 23 bp, Homo sapiens
cctcccagaggtccagcccatct

SEQ ID NO: 4894877 - DNA, 13 bp, Homo sapiens
cctccccacgccc

SEQ ID NO: 4894878 - DNA, 16 bp, Homo sapiens
cctccccagcccctag

SEQ ID NO: 4894879 - DNA, 17 bp, Homo sapiens
cctccccagcccctagc

SEQ ID NO: 4894880 - DNA, 16 bp, Homo sapiens
cctccccatggagcca

SEQ ID NO: 4894881 - DNA, 19 bp, Homo sapiens
cctcccccaacccccaccc

SEQ ID NO: 4894882 - DNA, 16 bp, Homo sapiens
cctcccccgccactcc

SEQ ID NO: 4894883 - DNA, 17 bp, Homo sapiens
cctcccccgccactcct

SEQ ID NO: 4894884 - DNA, 18 bp, Homo sapiens
cctcccctcacagcctct

SEQ ID NO: 4894885 - DNA, 16 bp, Homo sapiens
cctcccctcccctgct

SEQ ID NO: 4894886 - DNA, 16 bp, Homo sapiens
cctcccctgccctggt

SEQ ID NO: 4894887 - DNA, 12 bp, Homo sapiens
cctcccctgctg

SEQ ID NO: 4894888 - DNA, 20 bp, Homo sapiens
cctcccgaatagctgggact

SEQ ID NO: 4894889 - DNA, 17 bp, Homo sapiens
cctcccgagtagctggg

SEQ ID NO: 4894890 - DNA, 16 bp, Homo sapiens
cctcccggtgcccaag

SEQ ID NO: 4894891 - DNA, 15 bp, Homo sapiens
cctccctagccagca

SEQ ID NO: 4894892 - DNA, 20 bp, Homo sapiens
cctccctgaaaatgtttttc

SEQ ID NO: 4894893 - DNA, 18 bp, Homo sapiens
cctccctgcccctccctt

SEQ ID NO: 4894894 - DNA, 22 bp, Homo sapiens
cctccctgcccctcccttcaac

SEQ ID NO: 4894895 - DNA, 18 bp, Homo sapiens
cctccctggctcccatga

SEQ ID NO: 4894896 - DNA, 23 bp, Homo sapiens
cctccctgtcaaagctgtcactt

SEQ ID NO: 4894897 - DNA, 22 bp, Homo sapiens
cctcccttccgaccctctggga

SEQ ID NO: 4894898 - DNA, 22 bp, Homo sapiens
cctccgaccacttccaggggaa

SEQ ID NO: 4894899 - DNA, 13 bp, Homo sapiens
cctcctcaccccc

SEQ ID NO: 4894900 - DNA, 14 bp, Homo sapiens
cctcctcaccccca

SEQ ID NO: 4894901 - DNA, 16 bp, Homo sapiens
cctcctcacccccagc

SEQ ID NO: 4894902 - DNA, 12 bp, Homo sapiens
cctcctcacctc

SEQ ID NO: 4894903 - DNA, 14 bp, Homo sapiens
cctcctcacctctg

SEQ ID NO: 4894904 - DNA, 16 bp, Homo sapiens
cctcctcacctctgga

SEQ ID NO: 4894905 - DNA, 13 bp, Homo sapiens
cctcctcatcccg

SEQ ID NO: 4894906 - DNA, 20 bp, Homo sapiens
cctcctcatcccgtgttctc

SEQ ID NO: 4894907 - DNA, 12 bp, Homo sapiens
cctcctcatgta

SEQ ID NO: 4894908 - DNA, 17 bp, Homo sapiens
cctcctccacctcacct

SEQ ID NO: 4894909 - DNA, 13 bp, Homo sapiens
cctcctccccact

SEQ ID NO: 4894910 - DNA, 22 bp, Homo sapiens
cctcctcttcaccccggcaggc

SEQ ID NO: 4894911 - DNA, 18 bp, Homo sapiens
cctcctctttctctcccc

SEQ ID NO: 4894912 - DNA, 22 bp, Homo sapiens
cctcctgaaccgcacagctcag

SEQ ID NO: 4894913 - DNA, 20 bp, Homo sapiens
cctcctggaaccttgctgtc

SEQ ID NO: 4894914 - DNA, 21 bp, Homo sapiens
cctcctggaaccttgctgtcc

SEQ ID NO: 4894915 - DNA, 11 bp, Homo sapiens
cctcctgtgga

SEQ ID NO: 4894916 - DNA, 18 bp, Homo sapiens
cctcctgtggggaaaggg

SEQ ID NO: 4894917 - DNA, 15 bp, Homo sapiens
cctcctgtgtgtgcg

SEQ ID NO: 4894918 - DNA, 23 bp, Homo sapiens
cctcctgtgtgtgcgcctacagg

SEQ ID NO: 4894919 - DNA, 22 bp, Homo sapiens
cctccttcagacaccctcaacc

SEQ ID NO: 4894920 - DNA, 22 bp, Homo sapiens
cctcctttctgtgccctactca

SEQ ID NO: 4894921 - DNA, 16 bp, Homo sapiens
cctcgaaacacagaaa

SEQ ID NO: 4894922 - DNA, 18 bp, Homo sapiens
cctcggaaccgctcacct

SEQ ID NO: 4894923 - DNA, 22 bp, Homo sapiens
cctcggcctcccaaagtgctgg

SEQ ID NO: 4894924 - DNA, 21 bp, Homo sapiens
cctcgttcctttctcctgttt

SEQ ID NO: 4894925 - DNA, 19 bp, Homo sapiens
cctctaaggttgggcaggg

SEQ ID NO: 4894926 - DNA, 15 bp, Homo sapiens
cctctaatgagactg

SEQ ID NO: 4894927 - DNA, 14 bp, Homo sapiens
cctctactttccag

SEQ ID NO: 4894928 - DNA, 13 bp, Homo sapiens
cctctatacatct

SEQ ID NO: 4894929 - DNA, 19 bp, Homo sapiens
cctctatacatctctcccc

SEQ ID NO: 4894930 - DNA, 17 bp, Homo sapiens
cctctatttatgtttgc

SEQ ID NO: 4894931 - DNA, 14 bp, Homo sapiens
cctctcactcccca

SEQ ID NO: 4894932 - DNA, 18 bp, Homo sapiens
cctctcagctccaggtgg

SEQ ID NO: 4894933 - DNA, 15 bp, Homo sapiens
cctctcaggatccaa

SEQ ID NO: 4894934 - DNA, 18 bp, Homo sapiens
cctctcaggatccaagct

SEQ ID NO: 4894935 - DNA, 23 bp, Homo sapiens
cctctcaggatccaagctaagca

SEQ ID NO: 4894936 - DNA, 12 bp, Homo sapiens
cctctccactgc

SEQ ID NO: 4894937 - DNA, 14 bp, Homo sapiens
cctctccactgcct

SEQ ID NO: 4894938 - DNA, 15 bp, Homo sapiens
cctctcctactcact

SEQ ID NO: 4894939 - DNA, 11 bp, Homo sapiens
cctctcctgga

SEQ ID NO: 4894940 - DNA, 13 bp, Homo sapiens
cctctcctggagg

SEQ ID NO: 4894941 - DNA, 14 bp, Homo sapiens
cctctcctggagga

SEQ ID NO: 4894942 - DNA, 15 bp, Homo sapiens
cctctcctggaggat

SEQ ID NO: 4894943 - DNA, 17 bp, Homo sapiens
cctctccttccttaccc

SEQ ID NO: 4894944 - DNA, 22 bp, Homo sapiens
cctctctcttctgctccaccct

SEQ ID NO: 4894945 - DNA, 13 bp, Homo sapiens
cctctgacacaca

SEQ ID NO: 4894946 - DNA, 20 bp, Homo sapiens
cctctgacacacagctctgt

SEQ ID NO: 4894947 - DNA, 17 bp, Homo sapiens
cctctgaccaacaggct

SEQ ID NO: 4894948 - DNA, 20 bp, Homo sapiens
cctctgaccaacaggctgtt

SEQ ID NO: 4894949 - DNA, 14 bp, Homo sapiens
cctctgacccctcc

SEQ ID NO: 4894950 - DNA, 15 bp, Homo sapiens
cctctgacccctcct

SEQ ID NO: 4894951 - DNA, 22 bp, Homo sapiens
cctctgaccctagctctttcct

SEQ ID NO: 4894952 - DNA, 16 bp, Homo sapiens
cctctgacctgcactg

SEQ ID NO: 4894953 - DNA, 18 bp, Homo sapiens
cctctgccacactctgac

SEQ ID NO: 4894954 - DNA, 11 bp, Homo sapiens
cctctgccaga

SEQ ID NO: 4894955 - DNA, 21 bp, Homo sapiens
cctctgcctctgacacacagc

SEQ ID NO: 4894956 - DNA, 20 bp, Homo sapiens
cctctgcctgaagtcacaca

SEQ ID NO: 4894957 - DNA, 21 bp, Homo sapiens
cctctgcctgaagtcacacag

SEQ ID NO: 4894958 - DNA, 22 bp, Homo sapiens
cctctgcctgaagtcacacagt

SEQ ID NO: 4894959 - DNA, 12 bp, Homo sapiens
cctctgcctgtc

SEQ ID NO: 4894960 - DNA, 12 bp, Homo sapiens
cctctgctcagc

SEQ ID NO: 4894961 - DNA, 14 bp, Homo sapiens
cctctgctcagcca

SEQ ID NO: 4894962 - DNA, 14 bp, Homo sapiens
cctctgctccccag

SEQ ID NO: 4894963 - DNA, 19 bp, Homo sapiens
cctctgctgctgtccctcc

SEQ ID NO: 4894964 - DNA, 16 bp, Homo sapiens
cctctggaattgctca

SEQ ID NO: 4894965 - DNA, 17 bp, Homo sapiens
cctctggaggggtgtgg

SEQ ID NO: 4894966 - DNA, 12 bp, Homo sapiens
cctctggctaga

SEQ ID NO: 4894967 - DNA, 12 bp, Homo sapiens
cctctgggaacc

SEQ ID NO: 4894968 - DNA, 18 bp, Homo sapiens
cctctgggaacctcccag

SEQ ID NO: 4894969 - DNA, 19 bp, Homo sapiens
cctctgggaacctcccaga

SEQ ID NO: 4894970 - DNA, 20 bp, Homo sapiens
cctctgggaacctcccagag

SEQ ID NO: 4894971 - DNA, 19 bp, Homo sapiens
cctctggttcttcatttat

SEQ ID NO: 4894972 - DNA, 18 bp, Homo sapiens
cctctgtcctgcttctga

SEQ ID NO: 4894973 - DNA, 14 bp, Homo sapiens
cctctgtctcatcc

SEQ ID NO: 4894974 - DNA, 20 bp, Homo sapiens
cctctgtctcatcctcctgg

SEQ ID NO: 4894975 - DNA, 24 bp, Homo sapiens
cctctgtctcatcctcctggaacc

SEQ ID NO: 4894976 - DNA, 22 bp, Homo sapiens
cctctgtcttgtgaaggcaggg

SEQ ID NO: 4894977 - DNA, 21 bp, Homo sapiens
cctcttaaagctgcctgtagt

SEQ ID NO: 4894978 - DNA, 17 bp, Homo sapiens
cctcttcaccccccact

SEQ ID NO: 4894979 - DNA, 17 bp, Homo sapiens
cctcttcaccccggcag

SEQ ID NO: 4894980 - DNA, 21 bp, Homo sapiens
cctcttcaccccggcaggccc

SEQ ID NO: 4894981 - DNA, 22 bp, Homo sapiens
cctcttcaccccggcaggccct

SEQ ID NO: 4894982 - DNA, 14 bp, Homo sapiens
cctcttccccagaa

SEQ ID NO: 4894983 - DNA, 22 bp, Homo sapiens
cctcttccccagaaaggagact

SEQ ID NO: 4894984 - DNA, 15 bp, Homo sapiens
cctcttcccccttcc

SEQ ID NO: 4894985 - DNA, 20 bp, Homo sapiens
cctcttcctgacgaaactgg

SEQ ID NO: 4894986 - DNA, 13 bp, Homo sapiens
cctcttcctgtga

SEQ ID NO: 4894987 - DNA, 21 bp, Homo sapiens
cctcttcctgtgatccaccca

SEQ ID NO: 4894988 - DNA, 15 bp, Homo sapiens
cctcttcggccctca

SEQ ID NO: 4894989 - DNA, 16 bp, Homo sapiens
cctcttctgccaagag

SEQ ID NO: 4894990 - DNA, 19 bp, Homo sapiens
cctcttgctgtctctgctc

SEQ ID NO: 4894991 - DNA, 13 bp, Homo sapiens
cctcttgggttca

SEQ ID NO: 4894992 - DNA, 11 bp, Homo sapiens
cctctttaaaa

SEQ ID NO: 4894993 - DNA, 13 bp, Homo sapiens
cctctttaaaaca

SEQ ID NO: 4894994 - DNA, 18 bp, Homo sapiens
cctctttaaaacaaaaca

SEQ ID NO: 4894995 - DNA, 19 bp, Homo sapiens
cctctttggctcccctgta

SEQ ID NO: 4894996 - DNA, 22 bp, Homo sapiens
cctctttgtctgcgtgggtcag

SEQ ID NO: 4894997 - DNA, 20 bp, Homo sapiens
cctcttttcttactcctcct

SEQ ID NO: 4894998 - DNA, 21 bp, Homo sapiens
cctgaaaatgtttttctgcca

SEQ ID NO: 4894999 - DNA, 14 bp, Homo sapiens
cctgaaattccaaa

SEQ ID NO: 4895000 - DNA, 15 bp, Homo sapiens
cctgaaatttcagat

SEQ ID NO: 4895001 - DNA, 15 bp, Homo sapiens
cctgaacaagaattg

SEQ ID NO: 4895002 - DNA, 14 bp, Homo sapiens
cctgaagccagcct

SEQ ID NO: 4895003 - DNA, 15 bp, Homo sapiens
cctgaagccagcctt

SEQ ID NO: 4895004 - DNA, 21 bp, Homo sapiens
cctgaaggaacattccttagt

SEQ ID NO: 4895005 - DNA, 15 bp, Homo sapiens
cctgaagtcacacag

SEQ ID NO: 4895006 - DNA, 19 bp, Homo sapiens
cctgaagtcacacagtgag

SEQ ID NO: 4895007 - DNA, 19 bp, Homo sapiens
cctgaatcccccttgccac

SEQ ID NO: 4895008 - DNA, 20 bp, Homo sapiens
cctgaatcccccttgccacc

SEQ ID NO: 4895009 - DNA, 15 bp, Homo sapiens
cctgaattctttttc

SEQ ID NO: 4895010 - DNA, 14 bp, Homo sapiens
cctgacatcacagc

SEQ ID NO: 4895011 - DNA, 21 bp, Homo sapiens
cctgacatcacagcagcctcc

SEQ ID NO: 4895012 - DNA, 15 bp, Homo sapiens
cctgacctcttgctg

SEQ ID NO: 4895013 - DNA, 16 bp, Homo sapiens
cctgacctcttgctgt

SEQ ID NO: 4895014 - DNA, 17 bp, Homo sapiens
cctgacgaaactggccc

SEQ ID NO: 4895015 - DNA, 21 bp, Homo sapiens
cctgacgaaactggccccgga

SEQ ID NO: 4895016 - DNA, 20 bp, Homo sapiens
cctgacgtctgaagcttgac

SEQ ID NO: 4895017 - DNA, 14 bp, Homo sapiens
cctgactctgcccc

SEQ ID NO: 4895018 - DNA, 23 bp, Homo sapiens
cctgacttggggagatggagttc

SEQ ID NO: 4895019 - DNA, 22 bp, Homo sapiens
cctgagaagctgctccaggcct

SEQ ID NO: 4895020 - DNA, 23 bp, Homo sapiens
cctgagaagctgctccaggcctg

SEQ ID NO: 4895021 - DNA, 22 bp, Homo sapiens
cctgagaataagaaagtttcac

SEQ ID NO: 4895022 - DNA, 18 bp, Homo sapiens
cctgagaccacagagaga

SEQ ID NO: 4895023 - DNA, 23 bp, Homo sapiens
cctgagcaactcttgattatcca

SEQ ID NO: 4895024 - DNA, 23 bp, Homo sapiens
cctgagccccagggtgcccagaa

SEQ ID NO: 4895025 - DNA, 14 bp, Homo sapiens
cctgagccccgccc

SEQ ID NO: 4895026 - DNA, 20 bp, Homo sapiens
cctgagccccgccctcttcc

SEQ ID NO: 4895027 - DNA, 23 bp, Homo sapiens
cctgagccccgccctcttcctga

SEQ ID NO: 4895028 - DNA, 21 bp, Homo sapiens
cctgagcgcctggatttctgg

SEQ ID NO: 4895029 - DNA, 18 bp, Homo sapiens
cctgagggaggacctggg

SEQ ID NO: 4895030 - DNA, 22 bp, Homo sapiens
cctgagggaggacctggggcac

SEQ ID NO: 4895031 - DNA, 23 bp, Homo sapiens
cctgaggggcatctgcccctccc

SEQ ID NO: 4895032 - DNA, 20 bp, Homo sapiens
cctgaggtcagggagtgctg

SEQ ID NO: 4895033 - DNA, 14 bp, Homo sapiens
cctgaggtgtacca

SEQ ID NO: 4895034 - DNA, 23 bp, Homo sapiens
cctgagtccaagagggtccttta

SEQ ID NO: 4895035 - DNA, 20 bp, Homo sapiens
cctgagttcatccaggccca

SEQ ID NO: 4895036 - DNA, 18 bp, Homo sapiens
cctgataaagcacagctg

SEQ ID NO: 4895037 - DNA, 17 bp, Homo sapiens
cctgatcactagcctgt

SEQ ID NO: 4895038 - DNA, 16 bp, Homo sapiens
cctgatctcttcctgt

SEQ ID NO: 4895039 - DNA, 19 bp, Homo sapiens
cctgatgctccctcccctg

SEQ ID NO: 4895040 - DNA, 20 bp, Homo sapiens
cctgatgctccctcccctgc

SEQ ID NO: 4895041 - DNA, 21 bp, Homo sapiens
cctgatggaagtaaagcctca

SEQ ID NO: 4895042 - DNA, 21 bp, Homo sapiens
cctgatgtgtcctcagggagc

SEQ ID NO: 4895043 - DNA, 13 bp, Homo sapiens
cctgattgacctg

SEQ ID NO: 4895044 - DNA, 17 bp, Homo sapiens
cctgcaaacagaacagg

SEQ ID NO: 4895045 - DNA, 22 bp, Homo sapiens
cctgcaatgaaaggtactatat

SEQ ID NO: 4895046 - DNA, 19 bp, Homo sapiens
cctgcaatgtatcccttct

SEQ ID NO: 4895047 - DNA, 19 bp, Homo sapiens
cctgcaatttcatatgctg

SEQ ID NO: 4895048 - DNA, 22 bp, Homo sapiens
cctgcacacaagcccacagcac

SEQ ID NO: 4895049 - DNA, 21 bp, Homo sapiens
cctgcactaaagccagcctga

SEQ ID NO: 4895050 - DNA, 21 bp, Homo sapiens
cctgcactaatttgatgttta

SEQ ID NO: 4895051 - DNA, 23 bp, Homo sapiens
cctgcactcctcagggcagcctc

SEQ ID NO: 4895052 - DNA, 16 bp, Homo sapiens
cctgcacttgcagact

SEQ ID NO: 4895053 - DNA, 18 bp, Homo sapiens
cctgcacttgcagactct

SEQ ID NO: 4895054 - DNA, 22 bp, Homo sapiens
cctgcacttgcagactctacag

SEQ ID NO: 4895055 - DNA, 20 bp, Homo sapiens
cctgcagatgccaccctagc

SEQ ID NO: 4895056 - DNA, 16 bp, Homo sapiens
cctgcagcacggacaa

SEQ ID NO: 4895057 - DNA, 16 bp, Homo sapiens
cctgcagcatggtccc

SEQ ID NO: 4895058 - DNA, 19 bp, Homo sapiens
cctgcagcatggtccctgc

SEQ ID NO: 4895059 - DNA, 22 bp, Homo sapiens
cctgcagcatggtccctgcctt

SEQ ID NO: 4895060 - DNA, 20 bp, Homo sapiens
cctgcagtgttcgcttggct

SEQ ID NO: 4895061 - DNA, 23 bp, Homo sapiens
cctgcatcccaggatgctgggtg

SEQ ID NO: 4895062 - DNA, 14 bp, Homo sapiens
cctgccaccctggg

SEQ ID NO: 4895063 - DNA, 13 bp, Homo sapiens
cctgccacctccc

SEQ ID NO: 4895064 - DNA, 16 bp, Homo sapiens
cctgccacctccctga

SEQ ID NO: 4895065 - DNA, 21 bp, Homo sapiens
cctgccatgtacctcccctgc

SEQ ID NO: 4895066 - DNA, 23 bp, Homo sapiens
cctgccatgtacctcccctgcct

SEQ ID NO: 4895067 - DNA, 18 bp, Homo sapiens
cctgccatttaaaaagtt

SEQ ID NO: 4895068 - DNA, 18 bp, Homo sapiens
cctgcccaagcccaggcc

SEQ ID NO: 4895069 - DNA, 15 bp, Homo sapiens
cctgcccaggcccct

SEQ ID NO: 4895070 - DNA, 16 bp, Homo sapiens
cctgcccaggcccctg

SEQ ID NO: 4895071 - DNA, 19 bp, Homo sapiens
cctgcccaggcccctgcca

SEQ ID NO: 4895072 - DNA, 16 bp, Homo sapiens
cctgcccaggccggcc

SEQ ID NO: 4895073 - DNA, 23 bp, Homo sapiens
cctgccccaaataacttcagtcc

SEQ ID NO: 4895074 - DNA, 17 bp, Homo sapiens
cctgccccagggctccc

SEQ ID NO: 4895075 - DNA, 15 bp, Homo sapiens
cctgccccccagcct

SEQ ID NO: 4895076 - DNA, 15 bp, Homo sapiens
cctgcccctcccttc

SEQ ID NO: 4895077 - DNA, 12 bp, Homo sapiens
cctgcccctctt

SEQ ID NO: 4895078 - DNA, 15 bp, Homo sapiens
cctgcccctctttct

SEQ ID NO: 4895079 - DNA, 16 bp, Homo sapiens
cctgccccttccttta

SEQ ID NO: 4895080 - DNA, 14 bp, Homo sapiens
cctgcccggctgcg

SEQ ID NO: 4895081 - DNA, 10 bp, Homo sapiens
cctgcccggg

SEQ ID NO: 4895082 - DNA, 15 bp, Homo sapiens
cctgccctgccccca

SEQ ID NO: 4895083 - DNA, 13 bp, Homo sapiens
cctgcctcagcct

SEQ ID NO: 4895084 - DNA, 16 bp, Homo sapiens
cctgcctcagcctccc

SEQ ID NO: 4895085 - DNA, 13 bp, Homo sapiens
cctgcctcctgcc

SEQ ID NO: 4895086 - DNA, 23 bp, Homo sapiens
cctgcctcgaactggctgcaaag

SEQ ID NO: 4895087 - DNA, 13 bp, Homo sapiens
cctgcctggccag

SEQ ID NO: 4895088 - DNA, 22 bp, Homo sapiens
cctgcctggccaggcagatctg

SEQ ID NO: 4895089 - DNA, 22 bp, Homo sapiens
cctgcctgttcccattcttgca

SEQ ID NO: 4895090 - DNA, 11 bp, Homo sapiens
cctgcctttta

SEQ ID NO: 4895091 - DNA, 17 bp, Homo sapiens
cctgctccgctgctcct

SEQ ID NO: 4895092 - DNA, 16 bp, Homo sapiens
cctgctctcctcttgc

SEQ ID NO: 4895093 - DNA, 17 bp, Homo sapiens
cctgctgcaggggctct

SEQ ID NO: 4895094 - DNA, 20 bp, Homo sapiens
cctgctgcaggggctctgga

SEQ ID NO: 4895095 - DNA, 22 bp, Homo sapiens
cctgctgcaggggctctggaga

SEQ ID NO: 4895096 - DNA, 22 bp, Homo sapiens
cctgctgcccaggctgtgcagc

SEQ ID NO: 4895097 - DNA, 18 bp, Homo sapiens
cctgctgccgcctcccag

SEQ ID NO: 4895098 - DNA, 22 bp, Homo sapiens
cctgctgccttctgacggccct

SEQ ID NO: 4895099 - DNA, 12 bp, Homo sapiens
cctgctggctct

SEQ ID NO: 4895100 - DNA, 17 bp, Homo sapiens
cctgctggctcttctgc

SEQ ID NO: 4895101 - DNA, 15 bp, Homo sapiens
cctgctgggtaaact

SEQ ID NO: 4895102 - DNA, 20 bp, Homo sapiens
cctgctggtcacagcctcct

SEQ ID NO: 4895103 - DNA, 18 bp, Homo sapiens
cctgcttcccacctccct

SEQ ID NO: 4895104 - DNA, 20 bp, Homo sapiens
cctgcttcccacctccctgc

SEQ ID NO: 4895105 - DNA, 15 bp, Homo sapiens
cctgctttggcgggc

SEQ ID NO: 4895106 - DNA, 15 bp, Homo sapiens
cctggaaccttgctg

SEQ ID NO: 4895107 - DNA, 17 bp, Homo sapiens
cctggaaccttgctgtc

SEQ ID NO: 4895108 - DNA, 20 bp, Homo sapiens
cctggaactctatctgggcc

SEQ ID NO: 4895109 - DNA, 21 bp, Homo sapiens
cctggacatttgccttgctgg

SEQ ID NO: 4895110 - DNA, 13 bp, Homo sapiens
cctggacctgcct

SEQ ID NO: 4895111 - DNA, 23 bp, Homo sapiens
cctggacctgcctcctgcctgcc

SEQ ID NO: 4895112 - DNA, 16 bp, Homo sapiens
cctggagacccacccc

SEQ ID NO: 4895113 - DNA, 18 bp, Homo sapiens
cctggagcagaccacccc

SEQ ID NO: 4895114 - DNA, 22 bp, Homo sapiens
cctggaggcactgaagtgctta

SEQ ID NO: 4895115 - DNA, 20 bp, Homo sapiens
cctggagtgtggctgaggag

SEQ ID NO: 4895116 - DNA, 22 bp, Homo sapiens
cctggatattattcttgtagtt

SEQ ID NO: 4895117 - DNA, 22 bp, Homo sapiens
cctggatcacgacgctgcagag

SEQ ID NO: 4895118 - DNA, 23 bp, Homo sapiens
cctggatcacgacgctgcagagc

SEQ ID NO: 4895119 - DNA, 21 bp, Homo sapiens
cctggatccatcaggccactt

SEQ ID NO: 4895120 - DNA, 14 bp, Homo sapiens
cctggcacaggact

SEQ ID NO: 4895121 - DNA, 16 bp, Homo sapiens
cctggcacaggactga

SEQ ID NO: 4895122 - DNA, 18 bp, Homo sapiens
cctggcacaggactgatt

SEQ ID NO: 4895123 - DNA, 18 bp, Homo sapiens
cctggcacagggcagtgg

SEQ ID NO: 4895124 - DNA, 18 bp, Homo sapiens
cctggcacccggcccctg

SEQ ID NO: 4895125 - DNA, 23 bp, Homo sapiens
cctggcactaacgttgagcccct

SEQ ID NO: 4895126 - DNA, 15 bp, Homo sapiens
cctggcagcccagag

SEQ ID NO: 4895127 - DNA, 12 bp, Homo sapiens
cctggcagccgt

SEQ ID NO: 4895128 - DNA, 21 bp, Homo sapiens
cctggcagccgtgccttcagc

SEQ ID NO: 4895129 - DNA, 22 bp, Homo sapiens
cctggcagggaggtcaggccct

SEQ ID NO: 4895130 - DNA, 23 bp, Homo sapiens
cctggcagggtcatcctgtgctc

SEQ ID NO: 4895131 - DNA, 19 bp, Homo sapiens
cctggcattatgtccactg

SEQ ID NO: 4895132 - DNA, 15 bp, Homo sapiens
cctggccagatgcac

SEQ ID NO: 4895133 - DNA, 16 bp, Homo sapiens
cctggccagatggccc

SEQ ID NO: 4895134 - DNA, 13 bp, Homo sapiens
cctggccaggagc

SEQ ID NO: 4895135 - DNA, 14 bp, Homo sapiens
cctggccaggagct

SEQ ID NO: 4895136 - DNA, 20 bp, Homo sapiens
cctggccaggagctcttcag

SEQ ID NO: 4895137 - DNA, 18 bp, Homo sapiens
cctggcccatagaaacat

SEQ ID NO: 4895138 - DNA, 23 bp, Homo sapiens
cctggcccatagaaacatgacac

SEQ ID NO: 4895139 - DNA, 18 bp, Homo sapiens
cctggcccctcaacctcc

SEQ ID NO: 4895140 - DNA, 16 bp, Homo sapiens
cctggccctgccctga

SEQ ID NO: 4895141 - DNA, 20 bp, Homo sapiens
cctggccgccccctgccccc

SEQ ID NO: 4895142 - DNA, 13 bp, Homo sapiens
cctggcctctgtg

SEQ ID NO: 4895143 - DNA, 15 bp, Homo sapiens
cctggcctggcacac

SEQ ID NO: 4895144 - DNA, 16 bp, Homo sapiens
cctggcctggcacaca

SEQ ID NO: 4895145 - DNA, 15 bp, Homo sapiens
cctggccttcctgtc

SEQ ID NO: 4895146 - DNA, 20 bp, Homo sapiens
cctggctcttgtgctggatg

SEQ ID NO: 4895147 - DNA, 14 bp, Homo sapiens
cctggctgtactgc

SEQ ID NO: 4895148 - DNA, 20 bp, Homo sapiens
cctggcttttcactgctggc

SEQ ID NO: 4895149 - DNA, 21 bp, Homo sapiens
cctggcttttcactgctggct

SEQ ID NO: 4895150 - DNA, 16 bp, Homo sapiens
cctgggagtgagctgg

SEQ ID NO: 4895151 - DNA, 18 bp, Homo sapiens
cctgggagtgagctggtt

SEQ ID NO: 4895152 - DNA, 17 bp, Homo sapiens
cctgggcagccaggctg

SEQ ID NO: 4895153 - DNA, 19 bp, Homo sapiens
cctgggcagccaggctgcc

SEQ ID NO: 4895154 - DNA, 23 bp, Homo sapiens
cctgggcagccaggctgccaagg

SEQ ID NO: 4895155 - DNA, 22 bp, Homo sapiens
cctgggcatatccaccacctcc

SEQ ID NO: 4895156 - DNA, 16 bp, Homo sapiens
cctgggccagggtctg

SEQ ID NO: 4895157 - DNA, 14 bp, Homo sapiens
cctgggctcggagg

SEQ ID NO: 4895158 - DNA, 16 bp, Homo sapiens
cctgggctcggaggct

SEQ ID NO: 4895159 - DNA, 22 bp, Homo sapiens
cctgggctcggaggctgccccc

SEQ ID NO: 4895160 - DNA, 14 bp, Homo sapiens
cctggggcacagtc

SEQ ID NO: 4895161 - DNA, 22 bp, Homo sapiens
cctggggcacagtccaggaaca

SEQ ID NO: 4895162 - DNA, 15 bp, Homo sapiens
cctggggcctgagag

SEQ ID NO: 4895163 - DNA, 16 bp, Homo sapiens
cctggggcctgagaga

SEQ ID NO: 4895164 - DNA, 17 bp, Homo sapiens
cctggggcctgagagaa

SEQ ID NO: 4895165 - DNA, 13 bp, Homo sapiens
cctggggcctggc

SEQ ID NO: 4895166 - DNA, 15 bp, Homo sapiens
cctggggcctggcag

SEQ ID NO: 4895167 - DNA, 16 bp, Homo sapiens
cctggggcctggcagg

SEQ ID NO: 4895168 - DNA, 12 bp, Homo sapiens
cctggggctggg

SEQ ID NO: 4895169 - DNA, 15 bp, Homo sapiens
cctggggctgggccc

SEQ ID NO: 4895170 - DNA, 18 bp, Homo sapiens
cctgggggagttttcctc

SEQ ID NO: 4895171 - DNA, 23 bp, Homo sapiens
cctgggggttctttcttcctctg

SEQ ID NO: 4895172 - DNA, 22 bp, Homo sapiens
cctgggtcagtctggtgggagg

SEQ ID NO: 4895173 - DNA, 13 bp, Homo sapiens
cctgggttccctt

SEQ ID NO: 4895174 - DNA, 14 bp, Homo sapiens
cctggtaccctcct

SEQ ID NO: 4895175 - DNA, 15 bp, Homo sapiens
cctggtaccctcctg

SEQ ID NO: 4895176 - DNA, 17 bp, Homo sapiens
cctggtaccctcctggc

SEQ ID NO: 4895177 - DNA, 19 bp, Homo sapiens
cctggtcaggccctggtgc

SEQ ID NO: 4895178 - DNA, 19 bp, Homo sapiens
cctggtccatgcagggggc

SEQ ID NO: 4895179 - DNA, 16 bp, Homo sapiens
cctggtctttcctctg

SEQ ID NO: 4895180 - DNA, 20 bp, Homo sapiens
cctggtgaatggccttcctt

SEQ ID NO: 4895181 - DNA, 15 bp, Homo sapiens
cctggtggcagctgc

SEQ ID NO: 4895182 - DNA, 15 bp, Homo sapiens
cctggtggcagtggg

SEQ ID NO: 4895183 - DNA, 13 bp, Homo sapiens
cctggttcccgtt

SEQ ID NO: 4895184 - DNA, 15 bp, Homo sapiens
cctggttgggtggca

SEQ ID NO: 4895185 - DNA, 17 bp, Homo sapiens
cctggtttcactggccc

SEQ ID NO: 4895186 - DNA, 22 bp, Homo sapiens
cctggtttttaaatagagtttg

SEQ ID NO: 4895187 - DNA, 17 bp, Homo sapiens
cctgtaagccaaagaaa

SEQ ID NO: 4895188 - DNA, 16 bp, Homo sapiens
cctgtaagcctgcaag

SEQ ID NO: 4895189 - DNA, 17 bp, Homo sapiens
cctgtaccccagcactt

SEQ ID NO: 4895190 - DNA, 23 bp, Homo sapiens
cctgtaccttttgaggagcccca

SEQ ID NO: 4895191 - DNA, 17 bp, Homo sapiens
cctgtactgttctgtgt

SEQ ID NO: 4895192 - DNA, 13 bp, Homo sapiens
cctgtagcagtga

SEQ ID NO: 4895193 - DNA, 21 bp, Homo sapiens
cctgtagcagtgagaaaaagc

SEQ ID NO: 4895194 - DNA, 13 bp, Homo sapiens
cctgtagtcctag

SEQ ID NO: 4895195 - DNA, 14 bp, Homo sapiens
cctgtagttaggaa

SEQ ID NO: 4895196 - DNA, 16 bp, Homo sapiens
cctgtagttaggaaat

SEQ ID NO: 4895197 - DNA, 18 bp, Homo sapiens
cctgtagttaggaaataa

SEQ ID NO: 4895198 - DNA, 23 bp, Homo sapiens
cctgtagttgcgtggactctgca

SEQ ID NO: 4895199 - DNA, 12 bp, Homo sapiens
cctgtatagtta

SEQ ID NO: 4895200 - DNA, 22 bp, Homo sapiens
cctgtatagttaggatagcatt

SEQ ID NO: 4895201 - DNA, 16 bp, Homo sapiens
cctgtatgtctccagt

SEQ ID NO: 4895202 - DNA, 17 bp, Homo sapiens
cctgtatgtctccagta

SEQ ID NO: 4895203 - DNA, 14 bp, Homo sapiens
cctgtatttaagca

SEQ ID NO: 4895204 - DNA, 12 bp, Homo sapiens
cctgtccagcct

SEQ ID NO: 4895205 - DNA, 22 bp, Homo sapiens
cctgtccagcctgggcagccag

SEQ ID NO: 4895206 - DNA, 18 bp, Homo sapiens
cctgtccatcagccagga

SEQ ID NO: 4895207 - DNA, 17 bp, Homo sapiens
cctgtcccacccccacc

SEQ ID NO: 4895208 - DNA, 19 bp, Homo sapiens
cctgtcccatggacactcc

SEQ ID NO: 4895209 - DNA, 17 bp, Homo sapiens
cctgtccctcccacctc

SEQ ID NO: 4895210 - DNA, 19 bp, Homo sapiens
cctgtccctcccacctctg

SEQ ID NO: 4895211 - DNA, 17 bp, Homo sapiens
cctgtcctaaggaacct

SEQ ID NO: 4895212 - DNA, 21 bp, Homo sapiens
cctgtcctaaggaaccttcct

SEQ ID NO: 4895213 - DNA, 13 bp, Homo sapiens
cctgtcctcactg

SEQ ID NO: 4895214 - DNA, 15 bp, Homo sapiens
cctgtcctcactgct

SEQ ID NO: 4895215 - DNA, 16 bp, Homo sapiens
cctgtcctcactgctc

SEQ ID NO: 4895216 - DNA, 23 bp, Homo sapiens
cctgtcgagttcggctctgggtg

SEQ ID NO: 4895217 - DNA, 21 bp, Homo sapiens
cctgtctagtctctcctgtaa

SEQ ID NO: 4895218 - DNA, 15 bp, Homo sapiens
cctgtctcagcctcc

SEQ ID NO: 4895219 - DNA, 15 bp, Homo sapiens
cctgtctccactgtg

SEQ ID NO: 4895220 - DNA, 13 bp, Homo sapiens
cctgtctctgccc

SEQ ID NO: 4895221 - DNA, 23 bp, Homo sapiens
cctgtctgagactcacaggaagg

SEQ ID NO: 4895222 - DNA, 14 bp, Homo sapiens
cctgtgacaaaatt

SEQ ID NO: 4895223 - DNA, 17 bp, Homo sapiens
cctgtgagtaaatattg

SEQ ID NO: 4895224 - DNA, 13 bp, Homo sapiens
cctgtgcacacac

SEQ ID NO: 4895225 - DNA, 14 bp, Homo sapiens
cctgtgcacacaca

SEQ ID NO: 4895226 - DNA, 17 bp, Homo sapiens
cctgtgcacacacacac

SEQ ID NO: 4895227 - DNA, 21 bp, Homo sapiens
cctgtgcctcctcacccccag

SEQ ID NO: 4895228 - DNA, 19 bp, Homo sapiens
cctgtggaacataaaaagg

SEQ ID NO: 4895229 - DNA, 23 bp, Homo sapiens
cctgtggaacataaaaaggacat

SEQ ID NO: 4895230 - DNA, 22 bp, Homo sapiens
cctgtggaacccagcagttctg

SEQ ID NO: 4895231 - DNA, 19 bp, Homo sapiens
cctgtggaagagtgtgtgt

SEQ ID NO: 4895232 - DNA, 23 bp, Homo sapiens
cctgtggaatgagtgtgcatgga

SEQ ID NO: 4895233 - DNA, 21 bp, Homo sapiens
cctgtggatgatcaatccttt

SEQ ID NO: 4895234 - DNA, 23 bp, Homo sapiens
cctgtgggtgtagccaggtatgg

SEQ ID NO: 4895235 - DNA, 18 bp, Homo sapiens
cctgtgtccacctgtggg

SEQ ID NO: 4895236 - DNA, 21 bp, Homo sapiens
cctgtgtgtgaaaggaagctc

SEQ ID NO: 4895237 - DNA, 20 bp, Homo sapiens
cctgtgtgtgcgcctacagg

SEQ ID NO: 4895238 - DNA, 13 bp, Homo sapiens
cctgttcagctcc

SEQ ID NO: 4895239 - DNA, 15 bp, Homo sapiens
cctgttcagctccag

SEQ ID NO: 4895240 - DNA, 16 bp, Homo sapiens
cctgttctaaggggga

SEQ ID NO: 4895241 - DNA, 13 bp, Homo sapiens
cctgttcttcctc

SEQ ID NO: 4895242 - DNA, 14 bp, Homo sapiens
cctgtttaatattt

SEQ ID NO: 4895243 - DNA, 16 bp, Homo sapiens
cctgtttaatatttaa

SEQ ID NO: 4895244 - DNA, 13 bp, Homo sapiens
ccttaaaatggaa

SEQ ID NO: 4895245 - DNA, 23 bp, Homo sapiens
ccttaagacctactgttctaaag

SEQ ID NO: 4895246 - DNA, 23 bp, Homo sapiens
ccttaatcaggtcctcagagaat

SEQ ID NO: 4895247 - DNA, 13 bp, Homo sapiens
ccttaattactta

SEQ ID NO: 4895248 - DNA, 15 bp, Homo sapiens
ccttaccaactttct

SEQ ID NO: 4895249 - DNA, 17 bp, Homo sapiens
ccttaccaactttctgt

SEQ ID NO: 4895250 - DNA, 18 bp, Homo sapiens
ccttaccaactttctgta

SEQ ID NO: 4895251 - DNA, 16 bp, Homo sapiens
ccttaccccttagcct

SEQ ID NO: 4895252 - DNA, 18 bp, Homo sapiens
ccttagaaatgtaaactg

SEQ ID NO: 4895253 - DNA, 19 bp, Homo sapiens
ccttagaaatgtaaactgc

SEQ ID NO: 4895254 - DNA, 23 bp, Homo sapiens
ccttagaaatgtaaactgccata

SEQ ID NO: 4895255 - DNA, 14 bp, Homo sapiens
ccttagaacctttc

SEQ ID NO: 4895256 - DNA, 18 bp, Homo sapiens
ccttagaacctttcttac

SEQ ID NO: 4895257 - DNA, 17 bp, Homo sapiens
ccttagaggtcctctgg

SEQ ID NO: 4895258 - DNA, 14 bp, Homo sapiens
ccttagcctccctg

SEQ ID NO: 4895259 - DNA, 16 bp, Homo sapiens
ccttagcctccctgaa

SEQ ID NO: 4895260 - DNA, 19 bp, Homo sapiens
ccttagctccctcccgcac

SEQ ID NO: 4895261 - DNA, 14 bp, Homo sapiens
ccttaggccttcct

SEQ ID NO: 4895262 - DNA, 20 bp, Homo sapiens
ccttagggaagctggcctga

SEQ ID NO: 4895263 - DNA, 22 bp, Homo sapiens
ccttagtcccccaactctgagc

SEQ ID NO: 4895264 - DNA, 14 bp, Homo sapiens
ccttagtctcagtt

SEQ ID NO: 4895265 - DNA, 22 bp, Homo sapiens
ccttagtgggccagggctgccc

SEQ ID NO: 4895266 - DNA, 14 bp, Homo sapiens
ccttatccccactt

SEQ ID NO: 4895267 - DNA, 22 bp, Homo sapiens
ccttatttgctaatcaaagcca

SEQ ID NO: 4895268 - DNA, 14 bp, Homo sapiens
ccttcaaccattcc

SEQ ID NO: 4895269 - DNA, 19 bp, Homo sapiens
ccttcaagaactctgggct

SEQ ID NO: 4895270 - DNA, 23 bp, Homo sapiens
ccttcaagccagcaacacagagc

SEQ ID NO: 4895271 - DNA, 18 bp, Homo sapiens
ccttcacattttttatgg

SEQ ID NO: 4895272 - DNA, 19 bp, Homo sapiens
ccttcagtaccctctcagc

SEQ ID NO: 4895273 - DNA, 13 bp, Homo sapiens
ccttccactgcct

SEQ ID NO: 4895274 - DNA, 20 bp, Homo sapiens
ccttccactgcctctgcctt

SEQ ID NO: 4895275 - DNA, 14 bp, Homo sapiens
ccttccagacatac

SEQ ID NO: 4895276 - DNA, 13 bp, Homo sapiens
ccttccagctcct

SEQ ID NO: 4895277 - DNA, 14 bp, Homo sapiens
ccttccagctgctg

SEQ ID NO: 4895278 - DNA, 21 bp, Homo sapiens
ccttccatgtcgcctctgcat

SEQ ID NO: 4895279 - DNA, 23 bp, Homo sapiens
ccttccatgtcgcctctgcattc

SEQ ID NO: 4895280 - DNA, 18 bp, Homo sapiens
ccttcccactcaccccgg

SEQ ID NO: 4895281 - DNA, 19 bp, Homo sapiens
ccttccccctccaatccca

SEQ ID NO: 4895282 - DNA, 23 bp, Homo sapiens
ccttcccccttttttgtccccca

SEQ ID NO: 4895283 - DNA, 18 bp, Homo sapiens
ccttcccctccctggctc

SEQ ID NO: 4895284 - DNA, 19 bp, Homo sapiens
ccttcccctccctggctcc

SEQ ID NO: 4895285 - DNA, 16 bp, Homo sapiens
ccttccctaaagtgat

SEQ ID NO: 4895286 - DNA, 12 bp, Homo sapiens
ccttccctgcac

SEQ ID NO: 4895287 - DNA, 20 bp, Homo sapiens
ccttcccttccactgcctct

SEQ ID NO: 4895288 - DNA, 18 bp, Homo sapiens
ccttcccttgccactttg

SEQ ID NO: 4895289 - DNA, 16 bp, Homo sapiens
ccttccgaccctctgg

SEQ ID NO: 4895290 - DNA, 17 bp, Homo sapiens
ccttccgaccctctggg

SEQ ID NO: 4895291 - DNA, 21 bp, Homo sapiens
ccttcctataacttgatgcat

SEQ ID NO: 4895292 - DNA, 14 bp, Homo sapiens
ccttcctcactgcc

SEQ ID NO: 4895293 - DNA, 19 bp, Homo sapiens
ccttcctcatccaccccat

SEQ ID NO: 4895294 - DNA, 15 bp, Homo sapiens
ccttcctctccactg

SEQ ID NO: 4895295 - DNA, 15 bp, Homo sapiens
ccttcctctctccag

SEQ ID NO: 4895296 - DNA, 14 bp, Homo sapiens
ccttcctctggggc

SEQ ID NO: 4895297 - DNA, 14 bp, Homo sapiens
ccttcctcttcggc

SEQ ID NO: 4895298 - DNA, 13 bp, Homo sapiens
ccttccttcctgt

SEQ ID NO: 4895299 - DNA, 13 bp, Homo sapiens
ccttccttgacct

SEQ ID NO: 4895300 - DNA, 14 bp, Homo sapiens
ccttccttgacctt

SEQ ID NO: 4895301 - DNA, 12 bp, Homo sapiens
ccttcctttctc

SEQ ID NO: 4895302 - DNA, 17 bp, Homo sapiens
ccttcctttctccagga

SEQ ID NO: 4895303 - DNA, 19 bp, Homo sapiens
ccttcctttctccaggacc

SEQ ID NO: 4895304 - DNA, 23 bp, Homo sapiens
ccttcgatacaccgggcctggag

SEQ ID NO: 4895305 - DNA, 15 bp, Homo sapiens
ccttcgctcctgtgt

SEQ ID NO: 4895306 - DNA, 14 bp, Homo sapiens
ccttcgtatcccga

SEQ ID NO: 4895307 - DNA, 13 bp, Homo sapiens
ccttcgtgccccc

SEQ ID NO: 4895308 - DNA, 14 bp, Homo sapiens
ccttctcacagcac

SEQ ID NO: 4895309 - DNA, 15 bp, Homo sapiens
ccttctctccctgcc

SEQ ID NO: 4895310 - DNA, 15 bp, Homo sapiens
ccttctctgaacaca

SEQ ID NO: 4895311 - DNA, 18 bp, Homo sapiens
ccttctctgaacacaggc

SEQ ID NO: 4895312 - DNA, 20 bp, Homo sapiens
ccttctctgaacacaggcag

SEQ ID NO: 4895313 - DNA, 14 bp, Homo sapiens
ccttctctgaagga

SEQ ID NO: 4895314 - DNA, 16 bp, Homo sapiens
ccttctctgaaggaca

SEQ ID NO: 4895315 - DNA, 13 bp, Homo sapiens
ccttctctgctcc

SEQ ID NO: 4895316 - DNA, 17 bp, Homo sapiens
ccttctctgctccacca

SEQ ID NO: 4895317 - DNA, 17 bp, Homo sapiens
ccttctgacggccctgc

SEQ ID NO: 4895318 - DNA, 22 bp, Homo sapiens
ccttctgatgtctctaaagcac

SEQ ID NO: 4895319 - DNA, 17 bp, Homo sapiens
ccttctgcctttgatgt

SEQ ID NO: 4895320 - DNA, 20 bp, Homo sapiens
ccttctgtcctactctgtgt

SEQ ID NO: 4895321 - DNA, 18 bp, Homo sapiens
ccttcttccatcccagga

SEQ ID NO: 4895322 - DNA, 13 bp, Homo sapiens
ccttctttgaaga

SEQ ID NO: 4895323 - DNA, 21 bp, Homo sapiens
ccttctttgataatgttaaat

SEQ ID NO: 4895324 - DNA, 14 bp, Homo sapiens
ccttcttttatgag

SEQ ID NO: 4895325 - DNA, 14 bp, Homo sapiens
ccttctttttcttc

SEQ ID NO: 4895326 - DNA, 21 bp, Homo sapiens
ccttgaaaataagaatagaaa

SEQ ID NO: 4895327 - DNA, 15 bp, Homo sapiens
ccttgaaaatatttt

SEQ ID NO: 4895328 - DNA, 15 bp, Homo sapiens
ccttgaacctgtgag

SEQ ID NO: 4895329 - DNA, 16 bp, Homo sapiens
ccttgaacctgtgagt

SEQ ID NO: 4895330 - DNA, 14 bp, Homo sapiens
ccttgaactgggta

SEQ ID NO: 4895331 - DNA, 14 bp, Homo sapiens
ccttgaatgctgcc

SEQ ID NO: 4895332 - DNA, 19 bp, Homo sapiens
ccttgaatgctgccagtgt

SEQ ID NO: 4895333 - DNA, 12 bp, Homo sapiens
ccttgaatgtgg

SEQ ID NO: 4895334 - DNA, 13 bp, Homo sapiens
ccttgacagggca

SEQ ID NO: 4895335 - DNA, 14 bp, Homo sapiens
ccttgacagggcac

SEQ ID NO: 4895336 - DNA, 23 bp, Homo sapiens
ccttgacattgtagagcttctgg

SEQ ID NO: 4895337 - DNA, 20 bp, Homo sapiens
ccttgactttgaactaatga

SEQ ID NO: 4895338 - DNA, 21 bp, Homo sapiens
ccttgagagtatcaggtctcc

SEQ ID NO: 4895339 - DNA, 14 bp, Homo sapiens
ccttgagtggggtt

SEQ ID NO: 4895340 - DNA, 14 bp, Homo sapiens
ccttgatgcacaga

SEQ ID NO: 4895341 - DNA, 15 bp, Homo sapiens
ccttgatgcacagag

SEQ ID NO: 4895342 - DNA, 18 bp, Homo sapiens
ccttgatgcacagagaag

SEQ ID NO: 4895343 - DNA, 19 bp, Homo sapiens
ccttgatttaaacacacag

SEQ ID NO: 4895344 - DNA, 14 bp, Homo sapiens
ccttgcacccctca

SEQ ID NO: 4895345 - DNA, 18 bp, Homo sapiens
ccttgcacccctcactct

SEQ ID NO: 4895346 - DNA, 16 bp, Homo sapiens
ccttgcagaactgcca

SEQ ID NO: 4895347 - DNA, 23 bp, Homo sapiens
ccttgcagttcagcaccacccta

SEQ ID NO: 4895348 - DNA, 24 bp, Homo sapiens
ccttgccaccccaccctccctgga

SEQ ID NO: 4895349 - DNA, 19 bp, Homo sapiens
ccttgccactttgcacgac

SEQ ID NO: 4895350 - DNA, 22 bp, Homo sapiens
ccttgcctaaatttaatgctgc

SEQ ID NO: 4895351 - DNA, 14 bp, Homo sapiens
ccttgctaattttc

SEQ ID NO: 4895352 - DNA, 22 bp, Homo sapiens
ccttgctggacggggactgggg

SEQ ID NO: 4895353 - DNA, 20 bp, Homo sapiens
ccttgctgttggtcatgtgg

SEQ ID NO: 4895354 - DNA, 15 bp, Homo sapiens
ccttggaagtttcat

SEQ ID NO: 4895355 - DNA, 16 bp, Homo sapiens
ccttggcaccaaagat

SEQ ID NO: 4895356 - DNA, 20 bp, Homo sapiens
ccttggcaccaaagatgcag

SEQ ID NO: 4895357 - DNA, 23 bp, Homo sapiens
ccttggcaccaaagatgcagccg

SEQ ID NO: 4895358 - DNA, 19 bp, Homo sapiens
ccttggccggctgtgctca

SEQ ID NO: 4895359 - DNA, 23 bp, Homo sapiens
ccttggccggctgtgctcagaga

SEQ ID NO: 4895360 - DNA, 23 bp, Homo sapiens
ccttggcctagcccaccctgctg

SEQ ID NO: 4895361 - DNA, 15 bp, Homo sapiens
ccttggcctgtctca

SEQ ID NO: 4895362 - DNA, 22 bp, Homo sapiens
ccttggcctgtctcatccccag

SEQ ID NO: 4895363 - DNA, 22 bp, Homo sapiens
ccttggctcaatcctctaagct

SEQ ID NO: 4895364 - DNA, 14 bp, Homo sapiens
ccttggctgcaggg

SEQ ID NO: 4895365 - DNA, 18 bp, Homo sapiens
ccttggcttacctgacct

SEQ ID NO: 4895366 - DNA, 15 bp, Homo sapiens
ccttgggctgctcct

SEQ ID NO: 4895367 - DNA, 23 bp, Homo sapiens
ccttggggaggacaaaacttctt

SEQ ID NO: 4895368 - DNA, 19 bp, Homo sapiens
ccttgtctcctactcctga

SEQ ID NO: 4895369 - DNA, 13 bp, Homo sapiens
ccttgtggcagag

SEQ ID NO: 4895370 - DNA, 15 bp, Homo sapiens
ccttgtgtatatttg

SEQ ID NO: 4895371 - DNA, 18 bp, Homo sapiens
ccttgtgtatatttgtat

SEQ ID NO: 4895372 - DNA, 15 bp, Homo sapiens
cctttacgtgtttaa

SEQ ID NO: 4895373 - DNA, 23 bp, Homo sapiens
cctttactttcccttgcttttcc

SEQ ID NO: 4895374 - DNA, 20 bp, Homo sapiens
cctttagcgcccagttgggt

SEQ ID NO: 4895375 - DNA, 19 bp, Homo sapiens
cctttatatttagtgaact

SEQ ID NO: 4895376 - DNA, 16 bp, Homo sapiens
cctttcaaatttcaca

SEQ ID NO: 4895377 - DNA, 15 bp, Homo sapiens
cctttcacaaccttc

SEQ ID NO: 4895378 - DNA, 12 bp, Homo sapiens
cctttccccagc

SEQ ID NO: 4895379 - DNA, 14 bp, Homo sapiens
cctttccccagcat

SEQ ID NO: 4895380 - DNA, 15 bp, Homo sapiens
cctttccccagccca

SEQ ID NO: 4895381 - DNA, 17 bp, Homo sapiens
cctttccccagcccagg

SEQ ID NO: 4895382 - DNA, 15 bp, Homo sapiens
cctttcccttcctct

SEQ ID NO: 4895383 - DNA, 18 bp, Homo sapiens
cctttcctcctttatcac

SEQ ID NO: 4895384 - DNA, 22 bp, Homo sapiens
cctttcctggacactcagacct

SEQ ID NO: 4895385 - DNA, 16 bp, Homo sapiens
cctttctctttctctc

SEQ ID NO: 4895386 - DNA, 15 bp, Homo sapiens
cctttctgccgaccc

SEQ ID NO: 4895387 - DNA, 16 bp, Homo sapiens
cctttctgtaccattt

SEQ ID NO: 4895388 - DNA, 20 bp, Homo sapiens
cctttctgtgccctactcat

SEQ ID NO: 4895389 - DNA, 14 bp, Homo sapiens
cctttcttgacaaa

SEQ ID NO: 4895390 - DNA, 16 bp, Homo sapiens
cctttgacatttaatt

SEQ ID NO: 4895391 - DNA, 17 bp, Homo sapiens
cctttgagacagtttct

SEQ ID NO: 4895392 - DNA, 14 bp, Homo sapiens
cctttgcagggcag

SEQ ID NO: 4895393 - DNA, 16 bp, Homo sapiens
cctttgcagggcagcc

SEQ ID NO: 4895394 - DNA, 12 bp, Homo sapiens
cctttggctctg

SEQ ID NO: 4895395 - DNA, 14 bp, Homo sapiens
cctttggttctggc

SEQ ID NO: 4895396 - DNA, 22 bp, Homo sapiens
cctttgtggttttatggagacc

SEQ ID NO: 4895397 - DNA, 13 bp, Homo sapiens
cctttgtttcttg

SEQ ID NO: 4895398 - DNA, 14 bp, Homo sapiens
ccttttaacatttt

SEQ ID NO: 4895399 - DNA, 15 bp, Homo sapiens
ccttttaacattttg

SEQ ID NO: 4895400 - DNA, 22 bp, Homo sapiens
ccttttctattccttctggcct

SEQ ID NO: 4895401 - DNA, 22 bp, Homo sapiens
ccttttctggggaaagacactg

SEQ ID NO: 4895402 - DNA, 13 bp, Homo sapiens
ccttttcttttgt

SEQ ID NO: 4895403 - DNA, 21 bp, Homo sapiens
ccttttcttttgttactgttc

SEQ ID NO: 4895404 - DNA, 21 bp, Homo sapiens
ccttttgtatacatcctgggt

SEQ ID NO: 4895405 - DNA, 14 bp, Homo sapiens
ccttttttaagatt

SEQ ID NO: 4895406 - DNA, 12 bp, Homo sapiens
ccttttttcaaa

SEQ ID NO: 4895407 - DNA, 18 bp, Homo sapiens
cctttttttccatcttta

SEQ ID NO: 4895408 - DNA, 16 bp, Homo sapiens
cctttttttccttttt

SEQ ID NO: 4895409 - DNA, 18 bp, Homo sapiens
cgaaacctgggattcagg

SEQ ID NO: 4895410 - DNA, 11 bp, Homo sapiens
cgaaagagaga

SEQ ID NO: 4895411 - DNA, 14 bp, Homo sapiens
cgaaagctctagaa

SEQ ID NO: 4895412 - DNA, 22 bp, Homo sapiens
cgaacaccctcgaagcgcgcca

SEQ ID NO: 4895413 - DNA, 13 bp, Homo sapiens
cgaagacacagac

SEQ ID NO: 4895414 - DNA, 16 bp, Homo sapiens
cgaagcgcgccactcg

SEQ ID NO: 4895415 - DNA, 15 bp, Homo sapiens
cgaagtagcttgctc

SEQ ID NO: 4895416 - DNA, 15 bp, Homo sapiens
cgaatagctgggact

SEQ ID NO: 4895417 - DNA, 18 bp, Homo sapiens
cgaatcagctatttactg

SEQ ID NO: 4895418 - DNA, 22 bp, Homo sapiens
cgaatccaagctccctgcccca

SEQ ID NO: 4895419 - DNA, 15 bp, Homo sapiens
cgaatgaaaagacaa

SEQ ID NO: 4895420 - DNA, 16 bp, Homo sapiens
cgacaggagtattttt

SEQ ID NO: 4895421 - DNA, 22 bp, Homo sapiens
cgacaggcgagagaggagccag

SEQ ID NO: 4895422 - DNA, 14 bp, Homo sapiens
cgaccacctgccca

SEQ ID NO: 4895423 - DNA, 23 bp, Homo sapiens
cgaccagacaccttgacagggca

SEQ ID NO: 4895424 - DNA, 17 bp, Homo sapiens
cgaccagaggagccttt

SEQ ID NO: 4895425 - DNA, 16 bp, Homo sapiens
cgaccccccgtgggct

SEQ ID NO: 4895426 - DNA, 19 bp, Homo sapiens
cgacccctagttccctctg

SEQ ID NO: 4895427 - DNA, 14 bp, Homo sapiens
cgaccctctgggaa

SEQ ID NO: 4895428 - DNA, 15 bp, Homo sapiens
cgacgcgtctcctgt

SEQ ID NO: 4895429 - DNA, 20 bp, Homo sapiens
cgactgcacagcggcccctg

SEQ ID NO: 4895430 - DNA, 20 bp, Homo sapiens
cgagagaggagccagacaga

SEQ ID NO: 4895431 - DNA, 21 bp, Homo sapiens
cgagagaggagccagacagac

SEQ ID NO: 4895432 - DNA, 17 bp, Homo sapiens
cgagatcacgccactgc

SEQ ID NO: 4895433 - DNA, 18 bp, Homo sapiens
cgagatcacgccactgca

SEQ ID NO: 4895434 - DNA, 20 bp, Homo sapiens
cgagatcacgccactgcact

SEQ ID NO: 4895435 - DNA, 17 bp, Homo sapiens
cgagcagtcctgcctca

SEQ ID NO: 4895436 - DNA, 21 bp, Homo sapiens
cgagcagtcctgcctcagcct

SEQ ID NO: 4895437 - DNA, 21 bp, Homo sapiens
cgagcatcccccaaagttcac

SEQ ID NO: 4895438 - DNA, 18 bp, Homo sapiens
cgagccctggtggcagtg

SEQ ID NO: 4895439 - DNA, 19 bp, Homo sapiens
cgagccctggtggcagtgg

SEQ ID NO: 4895440 - DNA, 19 bp, Homo sapiens
cgagcgctatcttcacata

SEQ ID NO: 4895441 - DNA, 12 bp, Homo sapiens
cgagctgtcccc

SEQ ID NO: 4895442 - DNA, 14 bp, Homo sapiens
cgaggattttaatt

SEQ ID NO: 4895443 - DNA, 20 bp, Homo sapiens
cgaggggctctcagctcagc

SEQ ID NO: 4895444 - DNA, 16 bp, Homo sapiens
cgagtcaccttccagg

SEQ ID NO: 4895445 - DNA, 15 bp, Homo sapiens
cgagtctgggacaca

SEQ ID NO: 4895446 - DNA, 19 bp, Homo sapiens
cgagttcggctctgggtgg

SEQ ID NO: 4895447 - DNA, 18 bp, Homo sapiens
cgatacaccgggcctgga

SEQ ID NO: 4895448 - DNA, 21 bp, Homo sapiens
cgatacaccgggcctggagaa

SEQ ID NO: 4895449 - DNA, 12 bp, Homo sapiens
cgatagagtctc

SEQ ID NO: 4895450 - DNA, 16 bp, Homo sapiens
cgatatttttaaagat

SEQ ID NO: 4895451 - DNA, 13 bp, Homo sapiens
cgatcctgccacc

SEQ ID NO: 4895452 - DNA, 23 bp, Homo sapiens
cgatgtggacctctactttccag

SEQ ID NO: 4895453 - DNA, 20 bp, Homo sapiens
cgcacaccctcactctgcca

SEQ ID NO: 4895454 - DNA, 22 bp, Homo sapiens
cgcacaccctcactctgccagg

SEQ ID NO: 4895455 - DNA, 15 bp, Homo sapiens
cgcacagcagcctgc

SEQ ID NO: 4895456 - DNA, 14 bp, Homo sapiens
cgcacccccctgtt

SEQ ID NO: 4895457 - DNA, 18 bp, Homo sapiens
cgcacccccctgttctaa

SEQ ID NO: 4895458 - DNA, 22 bp, Homo sapiens
cgcactacatgtggtttataga

SEQ ID NO: 4895459 - DNA, 19 bp, Homo sapiens
cgcactttccacttcttcc

SEQ ID NO: 4895460 - DNA, 17 bp, Homo sapiens
cgcagacctccccagcc

SEQ ID NO: 4895461 - DNA, 14 bp, Homo sapiens
cgcagatgatccat

SEQ ID NO: 4895462 - DNA, 20 bp, Homo sapiens
cgcagccctagagcctgcct

SEQ ID NO: 4895463 - DNA, 14 bp, Homo sapiens
cgcatccagcaaga

SEQ ID NO: 4895464 - DNA, 16 bp, Homo sapiens
cgcatggtcacacact

SEQ ID NO: 4895465 - DNA, 13 bp, Homo sapiens
cgccacccgcagc

SEQ ID NO: 4895466 - DNA, 15 bp, Homo sapiens
cgccactcctgaacc

SEQ ID NO: 4895467 - DNA, 23 bp, Homo sapiens
cgccactcgcttcccccatagcc

SEQ ID NO: 4895468 - DNA, 13 bp, Homo sapiens
cgcccaactccac

SEQ ID NO: 4895469 - DNA, 11 bp, Homo sapiens
cgcccacctcc

SEQ ID NO: 4895470 - DNA, 15 bp, Homo sapiens
cgcccaggagacatc

SEQ ID NO: 4895471 - DNA, 12 bp, Homo sapiens
cgcccagtctgg

SEQ ID NO: 4895472 - DNA, 13 bp, Homo sapiens
cgcccagtctgga

SEQ ID NO: 4895473 - DNA, 19 bp, Homo sapiens
cgcccagtctggaatgcag

SEQ ID NO: 4895474 - DNA, 21 bp, Homo sapiens
cgcccagtctggaatgcagtg

SEQ ID NO: 4895475 - DNA, 14 bp, Homo sapiens
cgcccctgccacct

SEQ ID NO: 4895476 - DNA, 12 bp, Homo sapiens
cgcccctgcctg

SEQ ID NO: 4895477 - DNA, 14 bp, Homo sapiens
cgcccgcccctgca

SEQ ID NO: 4895478 - DNA, 16 bp, Homo sapiens
cgcccgcccctgcagc

SEQ ID NO: 4895479 - DNA, 16 bp, Homo sapiens
cgccctcccctcccct

SEQ ID NO: 4895480 - DNA, 18 bp, Homo sapiens
cgccctcccctcccctgc

SEQ ID NO: 4895481 - DNA, 20 bp, Homo sapiens
cgccctcccctcccctgctg

SEQ ID NO: 4895482 - DNA, 13 bp, Homo sapiens
cgccctcttcctg

SEQ ID NO: 4895483 - DNA, 15 bp, Homo sapiens
cgccctcttcctgac

SEQ ID NO: 4895484 - DNA, 11 bp, Homo sapiens
cgcccttggct

SEQ ID NO: 4895485 - DNA, 20 bp, Homo sapiens
cgccggggacagaggcctgc

SEQ ID NO: 4895486 - DNA, 22 bp, Homo sapiens
cgccggggacagaggcctgccc

SEQ ID NO: 4895487 - DNA, 14 bp, Homo sapiens
cgccgtgggctgcg

SEQ ID NO: 4895488 - DNA, 15 bp, Homo sapiens
cgcctcccagcctgg

SEQ ID NO: 4895489 - DNA, 12 bp, Homo sapiens
cgcctctcccac

SEQ ID NO: 4895490 - DNA, 22 bp, Homo sapiens
cgcctgcactcctcagggcagc

SEQ ID NO: 4895491 - DNA, 20 bp, Homo sapiens
cgcctgtagtcctagccact

SEQ ID NO: 4895492 - DNA, 15 bp, Homo sapiens
cgcctgtgcacacac

SEQ ID NO: 4895493 - DNA, 18 bp, Homo sapiens
cgcctgtggagctcagcc

SEQ ID NO: 4895494 - DNA, 21 bp, Homo sapiens
cgccttgtctcctactcctga

SEQ ID NO: 4895495 - DNA, 16 bp, Homo sapiens
cgccttttgtatacat

SEQ ID NO: 4895496 - DNA, 18 bp, Homo sapiens
cgcgccactcgcttcccc

SEQ ID NO: 4895497 - DNA, 17 bp, Homo sapiens
cgcgcccgcccctgcag

SEQ ID NO: 4895498 - DNA, 13 bp, Homo sapiens
cgcgtctcctgtt

SEQ ID NO: 4895499 - DNA, 21 bp, Homo sapiens
cgcgtctcctgtttttctggg

SEQ ID NO: 4895500 - DNA, 19 bp, Homo sapiens
cgcgtgcacacaccagagc

SEQ ID NO: 4895501 - DNA, 11 bp, Homo sapiens
cgctacccact

SEQ ID NO: 4895502 - DNA, 14 bp, Homo sapiens
cgctatcttcacat

SEQ ID NO: 4895503 - DNA, 12 bp, Homo sapiens
cgctcagccctc

SEQ ID NO: 4895504 - DNA, 23 bp, Homo sapiens
cgctctcttcctgcccctctttc

SEQ ID NO: 4895505 - DNA, 21 bp, Homo sapiens
cgctctgcctcaccgcttccc

SEQ ID NO: 4895506 - DNA, 19 bp, Homo sapiens
cgctgctccacgcgcttcg

SEQ ID NO: 4895507 - DNA, 12 bp, Homo sapiens
cgctgctccttg

SEQ ID NO: 4895508 - DNA, 15 bp, Homo sapiens
cgctgctccttggct

SEQ ID NO: 4895509 - DNA, 18 bp, Homo sapiens
cgctggagtgcagtgagc

SEQ ID NO: 4895510 - DNA, 22 bp, Homo sapiens
cgctgggtcctaattaccagtc

SEQ ID NO: 4895511 - DNA, 13 bp, Homo sapiens
cgctgtcacaggc

SEQ ID NO: 4895512 - DNA, 15 bp, Homo sapiens
cgcttctgccttttc

SEQ ID NO: 4895513 - DNA, 16 bp, Homo sapiens
cgctttgattcatagt

SEQ ID NO: 4895514 - DNA, 17 bp, Homo sapiens
cgcttttgttctcgcaa

SEQ ID NO: 4895515 - DNA, 14 bp, Homo sapiens
cggaatagttggct

SEQ ID NO: 4895516 - DNA, 20 bp, Homo sapiens
cggaatgaaccacatcttgc

SEQ ID NO: 4895517 - DNA, 12 bp, Homo sapiens
cggacaataaac

SEQ ID NO: 4895518 - DNA, 13 bp, Homo sapiens
cggacaataaacc

SEQ ID NO: 4895519 - DNA, 14 bp, Homo sapiens
cggacactcctaga

SEQ ID NO: 4895520 - DNA, 15 bp, Homo sapiens
cggacactcctagag

SEQ ID NO: 4895521 - DNA, 18 bp, Homo sapiens
cggacagccacggccagg

SEQ ID NO: 4895522 - DNA, 12 bp, Homo sapiens
cggaccccagct

SEQ ID NO: 4895523 - DNA, 20 bp, Homo sapiens
cggaccccagctgtgagcct

SEQ ID NO: 4895524 - DNA, 22 bp, Homo sapiens
cggaccccagctgtgagccttg

SEQ ID NO: 4895525 - DNA, 23 bp, Homo sapiens
cggaccgcttgtggggacccagg

SEQ ID NO: 4895526 - DNA, 17 bp, Homo sapiens
cggagacggagtcccac

SEQ ID NO: 4895527 - DNA, 22 bp, Homo sapiens
cggagcatcccggaggaaatct

SEQ ID NO: 4895528 - DNA, 22 bp, Homo sapiens
cggagccccaggcctctgtgtc

SEQ ID NO: 4895529 - DNA, 17 bp, Homo sapiens
cggaggccccactgatg

SEQ ID NO: 4895530 - DNA, 13 bp, Homo sapiens
cggaggctgcccc

SEQ ID NO: 4895531 - DNA, 21 bp, Homo sapiens
cggagggtgggggccacctgc

SEQ ID NO: 4895532 - DNA, 22 bp, Homo sapiens
cggagggtgggggccacctgcc

SEQ ID NO: 4895533 - DNA, 14 bp, Homo sapiens
cggagtcccacctt

SEQ ID NO: 4895534 - DNA, 16 bp, Homo sapiens
cggagtcccaccttgg

SEQ ID NO: 4895535 - DNA, 21 bp, Homo sapiens
cggagtcccaccttggctgca

SEQ ID NO: 4895536 - DNA, 23 bp, Homo sapiens
cggagtcccaccttggctgcagg

SEQ ID NO: 4895537 - DNA, 15 bp, Homo sapiens
cggatcatcaacaag

SEQ ID NO: 4895538 - DNA, 21 bp, Homo sapiens
cggatcatcaacaagatttcc

SEQ ID NO: 4895539 - DNA, 14 bp, Homo sapiens
cggatcctaagcat

SEQ ID NO: 4895540 - DNA, 13 bp, Homo sapiens
cggatgctgcttc

SEQ ID NO: 4895541 - DNA, 14 bp, Homo sapiens
cggatgctgcttcc

SEQ ID NO: 4895542 - DNA, 12 bp, Homo sapiens
cggattccagcc

SEQ ID NO: 4895543 - DNA, 16 bp, Homo sapiens
cggcaccctctggccg

SEQ ID NO: 4895544 - DNA, 11 bp, Homo sapiens
cggcaggccct

SEQ ID NO: 4895545 - DNA, 15 bp, Homo sapiens
cggcaggccctgcag

SEQ ID NO: 4895546 - DNA, 17 bp, Homo sapiens
cggcaggccctgcagtg

SEQ ID NO: 4895547 - DNA, 18 bp, Homo sapiens
cggcatgtttccagcaga

SEQ ID NO: 4895548 - DNA, 22 bp, Homo sapiens
cggccaagataggaccttgggc

SEQ ID NO: 4895549 - DNA, 14 bp, Homo sapiens
cggccaatggaaac

SEQ ID NO: 4895550 - DNA, 11 bp, Homo sapiens
cggccacctct

SEQ ID NO: 4895551 - DNA, 20 bp, Homo sapiens
cggccagccccggccctggg

SEQ ID NO: 4895552 - DNA, 22 bp, Homo sapiens
cggccatctctttgtacaggaa

SEQ ID NO: 4895553 - DNA, 15 bp, Homo sapiens
cggccccctggtctc

SEQ ID NO: 4895554 - DNA, 15 bp, Homo sapiens
cggcccctcccgccc

SEQ ID NO: 4895555 - DNA, 18 bp, Homo sapiens
cggcccctgctggttcag

SEQ ID NO: 4895556 - DNA, 14 bp, Homo sapiens
cggccctagcccag

SEQ ID NO: 4895557 - DNA, 18 bp, Homo sapiens
cggccctcatctatgagg

SEQ ID NO: 4895558 - DNA, 17 bp, Homo sapiens
cggccctgcagccagct

SEQ ID NO: 4895559 - DNA, 13 bp, Homo sapiens
cggccctgggctc

SEQ ID NO: 4895560 - DNA, 16 bp, Homo sapiens
cggcctgatgctccct

SEQ ID NO: 4895561 - DNA, 17 bp, Homo sapiens
cggcctgatgctccctc

SEQ ID NO: 4895562 - DNA, 16 bp, Homo sapiens
cggctaagaggctgct

SEQ ID NO: 4895563 - DNA, 19 bp, Homo sapiens
cggctcactgcagcctcaa

SEQ ID NO: 4895564 - DNA, 13 bp, Homo sapiens
cggctccaggctc

SEQ ID NO: 4895565 - DNA, 16 bp, Homo sapiens
cggctccaggctcctt

SEQ ID NO: 4895566 - DNA, 14 bp, Homo sapiens
cggctgtgctcaga

SEQ ID NO: 4895567 - DNA, 16 bp, Homo sapiens
cggcttcatgccagct

SEQ ID NO: 4895568 - DNA, 14 bp, Homo sapiens
cgggaaccaagcag

SEQ ID NO: 4895569 - DNA, 15 bp, Homo sapiens
cgggacacctgccct

SEQ ID NO: 4895570 - DNA, 17 bp, Homo sapiens
cgggagcggtggccctg

SEQ ID NO: 4895571 - DNA, 13 bp, Homo sapiens
cgggaggaggtgt

SEQ ID NO: 4895572 - DNA, 12 bp, Homo sapiens
cgggccacagag

SEQ ID NO: 4895573 - DNA, 17 bp, Homo sapiens
cgggccacagagaaagt

SEQ ID NO: 4895574 - DNA, 20 bp, Homo sapiens
cgggctgggagctctgcaga

SEQ ID NO: 4895575 - DNA, 14 bp, Homo sapiens
cggggacagaggcc

SEQ ID NO: 4895576 - DNA, 21 bp, Homo sapiens
cggggacagaggcctgcccgg

SEQ ID NO: 4895577 - DNA, 15 bp, Homo sapiens
cggggccccagggct

SEQ ID NO: 4895578 - DNA, 17 bp, Homo sapiens
cggggcctcgggacctc

SEQ ID NO: 4895579 - DNA, 20 bp, Homo sapiens
cgggggctgcccttgggcca

SEQ ID NO: 4895580 - DNA, 19 bp, Homo sapiens
cggggtggtgggaaccatg

SEQ ID NO: 4895581 - DNA, 14 bp, Homo sapiens
cggtcaggtttaac

SEQ ID NO: 4895582 - DNA, 21 bp, Homo sapiens
cggtcaggtttaacatttgcc

SEQ ID NO: 4895583 - DNA, 14 bp, Homo sapiens
cggtccagctggcc

SEQ ID NO: 4895584 - DNA, 13 bp, Homo sapiens
cggtcccacccct

SEQ ID NO: 4895585 - DNA, 21 bp, Homo sapiens
cggtgagaggggaacagactg

SEQ ID NO: 4895586 - DNA, 14 bp, Homo sapiens
cggtggccctgtcc

SEQ ID NO: 4895587 - DNA, 13 bp, Homo sapiens
cggtttcttttta

SEQ ID NO: 4895588 - DNA, 20 bp, Homo sapiens
cggtttgccatgttgccaga

SEQ ID NO: 4895589 - DNA, 20 bp, Homo sapiens
cgtaaatacacaacacacac

SEQ ID NO: 4895590 - DNA, 15 bp, Homo sapiens
cgtaaccacggaaaa

SEQ ID NO: 4895591 - DNA, 23 bp, Homo sapiens
cgtaaccagccagatcctcttgg

SEQ ID NO: 4895592 - DNA, 14 bp, Homo sapiens
cgtaataattatta

SEQ ID NO: 4895593 - DNA, 20 bp, Homo sapiens
cgtagcgtgcccgtgtgcat

SEQ ID NO: 4895594 - DNA, 22 bp, Homo sapiens
cgtagcttctaccatgaacaga

SEQ ID NO: 4895595 - DNA, 22 bp, Homo sapiens
cgtatatgtctcaggtccctgc

SEQ ID NO: 4895596 - DNA, 20 bp, Homo sapiens
cgtattttaaaagccacata

SEQ ID NO: 4895597 - DNA, 18 bp, Homo sapiens
cgtcagggttggtgtgct

SEQ ID NO: 4895598 - DNA, 22 bp, Homo sapiens
cgtcagtctttttctgttgtaa

SEQ ID NO: 4895599 - DNA, 22 bp, Homo sapiens
cgtccaggccgcgccctttccc

SEQ ID NO: 4895600 - DNA, 21 bp, Homo sapiens
cgtccaggttcaacccacagc

SEQ ID NO: 4895601 - DNA, 15 bp, Homo sapiens
cgtcccaagatgttg

SEQ ID NO: 4895602 - DNA, 14 bp, Homo sapiens
cgtcctcacccctg

SEQ ID NO: 4895603 - DNA, 11 bp, Homo sapiens
cgtctcagtgt

SEQ ID NO: 4895604 - DNA, 21 bp, Homo sapiens
cgtctgaagcttgactcccaa

SEQ ID NO: 4895605 - DNA, 15 bp, Homo sapiens
cgtctggaagtccaa

SEQ ID NO: 4895606 - DNA, 11 bp, Homo sapiens
cgtctgtgtgc

SEQ ID NO: 4895607 - DNA, 17 bp, Homo sapiens
cgtcttccgcccctgcc

SEQ ID NO: 4895608 - DNA, 18 bp, Homo sapiens
cgtgaaaacggagctgaa

SEQ ID NO: 4895609 - DNA, 12 bp, Homo sapiens
cgtgacaacact

SEQ ID NO: 4895610 - DNA, 15 bp, Homo sapiens
cgtgagccactgcac

SEQ ID NO: 4895611 - DNA, 13 bp, Homo sapiens
cgtgatacatttg

SEQ ID NO: 4895612 - DNA, 13 bp, Homo sapiens
cgtgatcttggct

SEQ ID NO: 4895613 - DNA, 14 bp, Homo sapiens
cgtgcacacaccag

SEQ ID NO: 4895614 - DNA, 16 bp, Homo sapiens
cgtgcacacaccagag

SEQ ID NO: 4895615 - DNA, 19 bp, Homo sapiens
cgtgcacacaccagagccc

SEQ ID NO: 4895616 - DNA, 21 bp, Homo sapiens
cgtgcacgtggagagctggtg

SEQ ID NO: 4895617 - DNA, 21 bp, Homo sapiens
cgtgcagtggtgcgatctggg

SEQ ID NO: 4895618 - DNA, 22 bp, Homo sapiens
cgtgcattagcacagattttaa

SEQ ID NO: 4895619 - DNA, 18 bp, Homo sapiens
cgtgccaaagtctccctt

SEQ ID NO: 4895620 - DNA, 21 bp, Homo sapiens
cgtgccagtcaagaagaaaaa

SEQ ID NO: 4895621 - DNA, 17 bp, Homo sapiens
cgtggaacctctgtctc

SEQ ID NO: 4895622 - DNA, 17 bp, Homo sapiens
cgtggagagctggtgcc

SEQ ID NO: 4895623 - DNA, 20 bp, Homo sapiens
cgtggagagctggtgcccgg

SEQ ID NO: 4895624 - DNA, 20 bp, Homo sapiens
cgtggagcggggtatgaaga

SEQ ID NO: 4895625 - DNA, 21 bp, Homo sapiens
cgtggagcggggtatgaagag

SEQ ID NO: 4895626 - DNA, 22 bp, Homo sapiens
cgtggagcggggtatgaagagc

SEQ ID NO: 4895627 - DNA, 13 bp, Homo sapiens
cgtggcaaatata

SEQ ID NO: 4895628 - DNA, 18 bp, Homo sapiens
cgtggcaaatataaaact

SEQ ID NO: 4895629 - DNA, 20 bp, Homo sapiens
cgtggcagataatcagcctc

SEQ ID NO: 4895630 - DNA, 17 bp, Homo sapiens
cgtggccatccctgtga

SEQ ID NO: 4895631 - DNA, 19 bp, Homo sapiens
cgtggccatccctgtgagg

SEQ ID NO: 4895632 - DNA, 19 bp, Homo sapiens
cgtggcttcccgctcagcc

SEQ ID NO: 4895633 - DNA, 20 bp, Homo sapiens
cgtggcttcccgctcagccc

SEQ ID NO: 4895634 - DNA, 20 bp, Homo sapiens
cgtgggctcccgtgttttgt

SEQ ID NO: 4895635 - DNA, 11 bp, Homo sapiens
cgtgggtcaga

SEQ ID NO: 4895636 - DNA, 12 bp, Homo sapiens
cgtgggtcagaa

SEQ ID NO: 4895637 - DNA, 13 bp, Homo sapiens
cgtgtcttccact

SEQ ID NO: 4895638 - DNA, 15 bp, Homo sapiens
cgtgtgtagagttaa

SEQ ID NO: 4895639 - DNA, 16 bp, Homo sapiens
cgtgttctccttttcc

SEQ ID NO: 4895640 - DNA, 13 bp, Homo sapiens
cgttcactccaat

SEQ ID NO: 4895641 - DNA, 14 bp, Homo sapiens
cgttccacagttgc

SEQ ID NO: 4895642 - DNA, 18 bp, Homo sapiens
cgttgaagaggaagggca

SEQ ID NO: 4895643 - DNA, 23 bp, Homo sapiens
cgttgggagggggagaaaaggaa

SEQ ID NO: 4895644 - DNA, 15 bp, Homo sapiens
cgtttacctagaaga

SEQ ID NO: 4895645 - DNA, 13 bp, Homo sapiens
cgtttagaccaag

SEQ ID NO: 4895646 - DNA, 16 bp, Homo sapiens
cgtttagaccaaggaa

SEQ ID NO: 4895647 - DNA, 18 bp, Homo sapiens
cgtttagaccaaggaaca

SEQ ID NO: 4895648 - DNA, 11 bp, Homo sapiens
ctaaaaaacag

SEQ ID NO: 4895649 - DNA, 22 bp, Homo sapiens
ctaaaaaacataaatttcttta

SEQ ID NO: 4895650 - DNA, 15 bp, Homo sapiens
ctaaaaagattagca

SEQ ID NO: 4895651 - DNA, 15 bp, Homo sapiens
ctaaaaataaaccaa

SEQ ID NO: 4895652 - DNA, 17 bp, Homo sapiens
ctaaaaccattccattt

SEQ ID NO: 4895653 - DNA, 18 bp, Homo sapiens
ctaaaactggcctgactt

SEQ ID NO: 4895654 - DNA, 13 bp, Homo sapiens
ctaaaagacaggc

SEQ ID NO: 4895655 - DNA, 20 bp, Homo sapiens
ctaaaagcaaaataaaaact

SEQ ID NO: 4895656 - DNA, 20 bp, Homo sapiens
ctaaaagtgggcttgattct

SEQ ID NO: 4895657 - DNA, 11 bp, Homo sapiens
ctaaaatatat

SEQ ID NO: 4895658 - DNA, 23 bp, Homo sapiens
ctaaaatatttattttttttaag

SEQ ID NO: 4895659 - DNA, 19 bp, Homo sapiens
ctaaaatcttatagttcta

SEQ ID NO: 4895660 - DNA, 12 bp, Homo sapiens
ctaaaatgcttc

SEQ ID NO: 4895661 - DNA, 13 bp, Homo sapiens
ctaaaatgcttca

SEQ ID NO: 4895662 - DNA, 23 bp, Homo sapiens
ctaaaatgtgatgttctaaggct

SEQ ID NO: 4895663 - DNA, 15 bp, Homo sapiens
ctaaacggattccaa

SEQ ID NO: 4895664 - DNA, 17 bp, Homo sapiens
ctaaacggattccaaag

SEQ ID NO: 4895665 - DNA, 15 bp, Homo sapiens
ctaaacggttcagtt

SEQ ID NO: 4895666 - DNA, 20 bp, Homo sapiens
ctaaacggttcagtttcttc

SEQ ID NO: 4895667 - DNA, 16 bp, Homo sapiens
ctaaacttccccatct

SEQ ID NO: 4895668 - DNA, 15 bp, Homo sapiens
ctaaagaccaaactt

SEQ ID NO: 4895669 - DNA, 18 bp, Homo sapiens
ctaaagatggagtttcta

SEQ ID NO: 4895670 - DNA, 21 bp, Homo sapiens
ctaaagatggagtttctaagg

SEQ ID NO: 4895671 - DNA, 23 bp, Homo sapiens
ctaaagatggagtttctaaggtc

SEQ ID NO: 4895672 - DNA, 14 bp, Homo sapiens
ctaaagattctata

SEQ ID NO: 4895673 - DNA, 17 bp, Homo sapiens
ctaaagattctatagtt

SEQ ID NO: 4895674 - DNA, 14 bp, Homo sapiens
ctaaagccagcctg

SEQ ID NO: 4895675 - DNA, 14 bp, Homo sapiens
ctaaagctctgaca

SEQ ID NO: 4895676 - DNA, 17 bp, Homo sapiens
ctaaaggatagatcaaa

SEQ ID NO: 4895677 - DNA, 19 bp, Homo sapiens
ctaaaggatagatcaaagt

SEQ ID NO: 4895678 - DNA, 16 bp, Homo sapiens
ctaaagtatgtaaagt

SEQ ID NO: 4895679 - DNA, 19 bp, Homo sapiens
ctaaagtatttttataaat

SEQ ID NO: 4895680 - DNA, 21 bp, Homo sapiens
ctaaagtgatgggctttctct

SEQ ID NO: 4895681 - DNA, 14 bp, Homo sapiens
ctaaatcagagaca

SEQ ID NO: 4895682 - DNA, 15 bp, Homo sapiens
ctaaatcagagacaa

SEQ ID NO: 4895683 - DNA, 19 bp, Homo sapiens
ctaaatcagagacaaaata

SEQ ID NO: 4895684 - DNA, 12 bp, Homo sapiens
ctaaatctattt

SEQ ID NO: 4895685 - DNA, 15 bp, Homo sapiens
ctaaatctctaatat

SEQ ID NO: 4895686 - DNA, 20 bp, Homo sapiens
ctaaatgcctagtttttagt

SEQ ID NO: 4895687 - DNA, 20 bp, Homo sapiens
ctaaatggtcgcccaggaga

SEQ ID NO: 4895688 - DNA, 17 bp, Homo sapiens
ctaaattctttatttct

SEQ ID NO: 4895689 - DNA, 19 bp, Homo sapiens
ctaaatttaaatttaaaga

SEQ ID NO: 4895690 - DNA, 13 bp, Homo sapiens
ctaaatttaatgc

SEQ ID NO: 4895691 - DNA, 16 bp, Homo sapiens
ctaaatttaatgctgc

SEQ ID NO: 4895692 - DNA, 18 bp, Homo sapiens
ctaaatttaatgctgcct

SEQ ID NO: 4895693 - DNA, 23 bp, Homo sapiens
ctaaatttgaatgttaagcagat

SEQ ID NO: 4895694 - DNA, 17 bp, Homo sapiens
ctaaatttgatacttat

SEQ ID NO: 4895695 - DNA, 19 bp, Homo sapiens
ctaaatttgatacttatat

SEQ ID NO: 4895696 - DNA, 20 bp, Homo sapiens
ctaaatttgatacttatatt

SEQ ID NO: 4895697 - DNA, 19 bp, Homo sapiens
ctaacaaaagatgaaagca

SEQ ID NO: 4895698 - DNA, 13 bp, Homo sapiens
ctaacacaaggac

SEQ ID NO: 4895699 - DNA, 17 bp, Homo sapiens
ctaacacacacagaaaa

SEQ ID NO: 4895700 - DNA, 18 bp, Homo sapiens
ctaacattttaaataaaa

SEQ ID NO: 4895701 - DNA, 22 bp, Homo sapiens
ctaaccaaatctctcaaatctg

SEQ ID NO: 4895702 - DNA, 17 bp, Homo sapiens
ctaaccacgctggacct

SEQ ID NO: 4895703 - DNA, 21 bp, Homo sapiens
ctaaccagggaagctgtccct

SEQ ID NO: 4895704 - DNA, 23 bp, Homo sapiens
ctaaccctatactgtagtattct

SEQ ID NO: 4895705 - DNA, 18 bp, Homo sapiens
ctaaccttgaatgctgcc

SEQ ID NO: 4895706 - DNA, 22 bp, Homo sapiens
ctaacggtctgttctgtttcaa

SEQ ID NO: 4895707 - DNA, 22 bp, Homo sapiens
ctaactagacaccaaagttcta

SEQ ID NO: 4895708 - DNA, 14 bp, Homo sapiens
ctaactcaccagcc

SEQ ID NO: 4895709 - DNA, 17 bp, Homo sapiens
ctaactcagaattattt

SEQ ID NO: 4895710 - DNA, 15 bp, Homo sapiens
ctaactgaagagaca

SEQ ID NO: 4895711 - DNA, 15 bp, Homo sapiens
ctaactgtacatttc

SEQ ID NO: 4895712 - DNA, 19 bp, Homo sapiens
ctaacttattttatttcca

SEQ ID NO: 4895713 - DNA, 20 bp, Homo sapiens
ctaactttagaagtgcattt

SEQ ID NO: 4895714 - DNA, 20 bp, Homo sapiens
ctaagaaacttttgtaaaga

SEQ ID NO: 4895715 - DNA, 15 bp, Homo sapiens
ctaagaaatatgtga

SEQ ID NO: 4895716 - DNA, 21 bp, Homo sapiens
ctaagaaatatgtgagatttt

SEQ ID NO: 4895717 - DNA, 16 bp, Homo sapiens
ctaagaagcttctaat

SEQ ID NO: 4895718 - DNA, 17 bp, Homo sapiens
ctaagaagcttctaata

SEQ ID NO: 4895719 - DNA, 23 bp, Homo sapiens
ctaagaagcttctaataaattat

SEQ ID NO: 4895720 - DNA, 23 bp, Homo sapiens
ctaagacacaaatgcatgaacaa

SEQ ID NO: 4895721 - DNA, 13 bp, Homo sapiens
ctaagactcaaat

SEQ ID NO: 4895722 - DNA, 22 bp, Homo sapiens
ctaagactcaaatgttctaagt

SEQ ID NO: 4895723 - DNA, 18 bp, Homo sapiens
ctaagacttactctaaga

SEQ ID NO: 4895724 - DNA, 23 bp, Homo sapiens
ctaagacttactctaagatctta

SEQ ID NO: 4895725 - DNA, 15 bp, Homo sapiens
ctaagagaatgaatt

SEQ ID NO: 4895726 - DNA, 11 bp, Homo sapiens
ctaagagccat

SEQ ID NO: 4895727 - DNA, 11 bp, Homo sapiens
ctaagaggctg

SEQ ID NO: 4895728 - DNA, 14 bp, Homo sapiens
ctaagaggctgctg

SEQ ID NO: 4895729 - DNA, 21 bp, Homo sapiens
ctaagatgtgatattctaaga

SEQ ID NO: 4895730 - DNA, 13 bp, Homo sapiens
ctaagattctaaa

SEQ ID NO: 4895731 - DNA, 12 bp, Homo sapiens
ctaagattctag

SEQ ID NO: 4895732 - DNA, 11 bp, Homo sapiens
ctaagattctg

SEQ ID NO: 4895733 - DNA, 12 bp, Homo sapiens
ctaagcaatttc

SEQ ID NO: 4895734 - DNA, 15 bp, Homo sapiens
ctaagcaatttcttg

SEQ ID NO: 4895735 - DNA, 13 bp, Homo sapiens
ctaagcatctaag

SEQ ID NO: 4895736 - DNA, 15 bp, Homo sapiens
ctaagctaaccccct

SEQ ID NO: 4895737 - DNA, 17 bp, Homo sapiens
ctaagctaggaatgaaa

SEQ ID NO: 4895738 - DNA, 20 bp, Homo sapiens
ctaaggacctgaaattccaa

SEQ ID NO: 4895739 - DNA, 18 bp, Homo sapiens
ctaaggatgtcacagggc

SEQ ID NO: 4895740 - DNA, 14 bp, Homo sapiens
ctaaggcctaggat

SEQ ID NO: 4895741 - DNA, 19 bp, Homo sapiens
ctaaggcctaggattctaa

SEQ ID NO: 4895742 - DNA, 20 bp, Homo sapiens
ctaaggcctaggattctaaa

SEQ ID NO: 4895743 - DNA, 20 bp, Homo sapiens
ctaaggctctatgagtctag

SEQ ID NO: 4895744 - DNA, 20 bp, Homo sapiens
ctaaggctctgagagtctag

SEQ ID NO: 4895745 - DNA, 21 bp, Homo sapiens
ctaaggctctgagagtctaga

SEQ ID NO: 4895746 - DNA, 16 bp, Homo sapiens
ctaagggaagacattt

SEQ ID NO: 4895747 - DNA, 17 bp, Homo sapiens
ctaagggaagacatttc

SEQ ID NO: 4895748 - DNA, 20 bp, Homo sapiens
ctaagggtgggtgctcagaa

SEQ ID NO: 4895749 - DNA, 21 bp, Homo sapiens
ctaagggtgggtgctcagaat

SEQ ID NO: 4895750 - DNA, 15 bp, Homo sapiens
ctaaggttctaaggc

SEQ ID NO: 4895751 - DNA, 13 bp, Homo sapiens
ctaagtattaaaa

SEQ ID NO: 4895752 - DNA, 16 bp, Homo sapiens
ctaagtgacatttgta

SEQ ID NO: 4895753 - DNA, 20 bp, Homo sapiens
ctaagtgatcctcccacctc

SEQ ID NO: 4895754 - DNA, 17 bp, Homo sapiens
ctaagttataagactct

SEQ ID NO: 4895755 - DNA, 21 bp, Homo sapiens
ctaagttataagactctcaca

SEQ ID NO: 4895756 - DNA, 22 bp, Homo sapiens
ctaagtttctaagattctaaag

SEQ ID NO: 4895757 - DNA, 15 bp, Homo sapiens
ctaataaatacatac

SEQ ID NO: 4895758 - DNA, 17 bp, Homo sapiens
ctaataatttctaatgt

SEQ ID NO: 4895759 - DNA, 13 bp, Homo sapiens
ctaatacctctgt

SEQ ID NO: 4895760 - DNA, 13 bp, Homo sapiens
ctaatatatatga

SEQ ID NO: 4895761 - DNA, 12 bp, Homo sapiens
ctaatatatttt

SEQ ID NO: 4895762 - DNA, 21 bp, Homo sapiens
ctaatatatttttatatttag

SEQ ID NO: 4895763 - DNA, 20 bp, Homo sapiens
ctaatcaaagccagggtctc

SEQ ID NO: 4895764 - DNA, 15 bp, Homo sapiens
ctaatctcatacctc

SEQ ID NO: 4895765 - DNA, 13 bp, Homo sapiens
ctaatgggacact

SEQ ID NO: 4895766 - DNA, 19 bp, Homo sapiens
ctaatgtaataactgtgaa

SEQ ID NO: 4895767 - DNA, 17 bp, Homo sapiens
ctaatgtcttcataaag

SEQ ID NO: 4895768 - DNA, 20 bp, Homo sapiens
ctaattagggtacatttata

SEQ ID NO: 4895769 - DNA, 15 bp, Homo sapiens
ctaattccacacctt

SEQ ID NO: 4895770 - DNA, 17 bp, Homo sapiens
ctaattccacacctttt

SEQ ID NO: 4895771 - DNA, 16 bp, Homo sapiens
ctaattcgatgaaggc

SEQ ID NO: 4895772 - DNA, 17 bp, Homo sapiens
ctaattcgatgaaggct

SEQ ID NO: 4895773 - DNA, 23 bp, Homo sapiens
ctaatttatcctgaaatttcaga

SEQ ID NO: 4895774 - DNA, 19 bp, Homo sapiens
ctaatttcaaaaatataac

SEQ ID NO: 4895775 - DNA, 12 bp, Homo sapiens
ctaatttgcatt

SEQ ID NO: 4895776 - DNA, 19 bp, Homo sapiens
ctaatttgcattaaattca

SEQ ID NO: 4895777 - DNA, 22 bp, Homo sapiens
ctaattttctcaaaagcattta

SEQ ID NO: 4895778 - DNA, 17 bp, Homo sapiens
ctaatttttaagcaaaa

SEQ ID NO: 4895779 - DNA, 14 bp, Homo sapiens
ctaatttttgtaat

SEQ ID NO: 4895780 - DNA, 20 bp, Homo sapiens
ctaatttttgtaattttagt

SEQ ID NO: 4895781 - DNA, 20 bp, Homo sapiens
ctacaaagcactagagaatg

SEQ ID NO: 4895782 - DNA, 12 bp, Homo sapiens
ctacaaccaatt

SEQ ID NO: 4895783 - DNA, 17 bp, Homo sapiens
ctacaagagcagcctgt

SEQ ID NO: 4895784 - DNA, 18 bp, Homo sapiens
ctacaagagcagcctgtg

SEQ ID NO: 4895785 - DNA, 21 bp, Homo sapiens
ctacacagtgggaactctgac

SEQ ID NO: 4895786 - DNA, 14 bp, Homo sapiens
ctacactgcaatca

SEQ ID NO: 4895787 - DNA, 23 bp, Homo sapiens
ctacagacctgctttttgaaatg

SEQ ID NO: 4895788 - DNA, 21 bp, Homo sapiens
ctacagaggaaacaatattta

SEQ ID NO: 4895789 - DNA, 22 bp, Homo sapiens
ctacagcactactgggtgtcat

SEQ ID NO: 4895790 - DNA, 18 bp, Homo sapiens
ctacagctaatcagcatt

SEQ ID NO: 4895791 - DNA, 19 bp, Homo sapiens
ctacagctttcttgctccc

SEQ ID NO: 4895792 - DNA, 20 bp, Homo sapiens
ctacagctttcttgctccct

SEQ ID NO: 4895793 - DNA, 23 bp, Homo sapiens
ctacagctttcttgctcccttca

SEQ ID NO: 4895794 - DNA, 20 bp, Homo sapiens
ctacaggaagcaccccatgc

SEQ ID NO: 4895795 - DNA, 16 bp, Homo sapiens
ctacaggagtgagcac

SEQ ID NO: 4895796 - DNA, 15 bp, Homo sapiens
ctacaggcacccacc

SEQ ID NO: 4895797 - DNA, 17 bp, Homo sapiens
ctacaggcacccaccat

SEQ ID NO: 4895798 - DNA, 17 bp, Homo sapiens
ctacaggcagtctctct

SEQ ID NO: 4895799 - DNA, 18 bp, Homo sapiens
ctacaggcagtctctctc

SEQ ID NO: 4895800 - DNA, 13 bp, Homo sapiens
ctacataaattgg

SEQ ID NO: 4895801 - DNA, 22 bp, Homo sapiens
ctacataagtaattcaagaaaa

SEQ ID NO: 4895802 - DNA, 23 bp, Homo sapiens
ctacataagtaattcaagaaaac

SEQ ID NO: 4895803 - DNA, 13 bp, Homo sapiens
ctacatgaaacag

SEQ ID NO: 4895804 - DNA, 13 bp, Homo sapiens
ctacatgagaaca

SEQ ID NO: 4895805 - DNA, 14 bp, Homo sapiens
ctacatgagaacaa

SEQ ID NO: 4895806 - DNA, 17 bp, Homo sapiens
ctacatgagaacaaaca

SEQ ID NO: 4895807 - DNA, 17 bp, Homo sapiens
ctacattataaacgctt

SEQ ID NO: 4895808 - DNA, 22 bp, Homo sapiens
ctacattgagtagacacattta

SEQ ID NO: 4895809 - DNA, 12 bp, Homo sapiens
ctaccaaaatgg

SEQ ID NO: 4895810 - DNA, 19 bp, Homo sapiens
ctaccaatgccaagataat

SEQ ID NO: 4895811 - DNA, 16 bp, Homo sapiens
ctaccatcagggacag

SEQ ID NO: 4895812 - DNA, 19 bp, Homo sapiens
ctaccatgaacagaaaaca

SEQ ID NO: 4895813 - DNA, 19 bp, Homo sapiens
ctacccacacctctgccag

SEQ ID NO: 4895814 - DNA, 17 bp, Homo sapiens
ctaccccctaagagcca

SEQ ID NO: 4895815 - DNA, 12 bp, Homo sapiens
ctaccctcccac

SEQ ID NO: 4895816 - DNA, 17 bp, Homo sapiens
ctaccctcctgcactgt

SEQ ID NO: 4895817 - DNA, 19 bp, Homo sapiens
ctaccctcctgcactgttt

SEQ ID NO: 4895818 - DNA, 14 bp, Homo sapiens
ctaccctgtgtata

SEQ ID NO: 4895819 - DNA, 17 bp, Homo sapiens
ctaccgagtctcttctc

SEQ ID NO: 4895820 - DNA, 23 bp, Homo sapiens
ctaccgagtctcttctccactgg

SEQ ID NO: 4895821 - DNA, 18 bp, Homo sapiens
ctacctcaggcagctcaa

SEQ ID NO: 4895822 - DNA, 18 bp, Homo sapiens
ctacctgccctggaacat

SEQ ID NO: 4895823 - DNA, 12 bp, Homo sapiens
ctacctgctctc

SEQ ID NO: 4895824 - DNA, 19 bp, Homo sapiens
ctacctgctctccaagtct

SEQ ID NO: 4895825 - DNA, 14 bp, Homo sapiens
ctaccttgaaaata

SEQ ID NO: 4895826 - DNA, 13 bp, Homo sapiens
ctacgaatcttcc

SEQ ID NO: 4895827 - DNA, 15 bp, Homo sapiens
ctacgccaatcaagg

SEQ ID NO: 4895828 - DNA, 15 bp, Homo sapiens
ctactaattccacac

SEQ ID NO: 4895829 - DNA, 15 bp, Homo sapiens
ctactataaagagaa

SEQ ID NO: 4895830 - DNA, 18 bp, Homo sapiens
ctactatggctgagttct

SEQ ID NO: 4895831 - DNA, 12 bp, Homo sapiens
ctactattttct

SEQ ID NO: 4895832 - DNA, 13 bp, Homo sapiens
ctactccctgcag

SEQ ID NO: 4895833 - DNA, 14 bp, Homo sapiens
ctactccctgcaga

SEQ ID NO: 4895834 - DNA, 13 bp, Homo sapiens
ctactcctgactc

SEQ ID NO: 4895835 - DNA, 16 bp, Homo sapiens
ctactctgtgtcaggt

SEQ ID NO: 4895836 - DNA, 22 bp, Homo sapiens
ctactgaaacagatttcatacc

SEQ ID NO: 4895837 - DNA, 16 bp, Homo sapiens
ctactgatttttgtga

SEQ ID NO: 4895838 - DNA, 16 bp, Homo sapiens
ctactgggtgtcattt

SEQ ID NO: 4895839 - DNA, 17 bp, Homo sapiens
ctactggtcttgtggaa

SEQ ID NO: 4895840 - DNA, 20 bp, Homo sapiens
ctactgtcctacccaccctc

SEQ ID NO: 4895841 - DNA, 17 bp, Homo sapiens
ctactgtctttggaaaa

SEQ ID NO: 4895842 - DNA, 22 bp, Homo sapiens
ctactgtctttggaaaaatgtt

SEQ ID NO: 4895843 - DNA, 15 bp, Homo sapiens
ctactgtgtgtgtga

SEQ ID NO: 4895844 - DNA, 14 bp, Homo sapiens
ctactgttctaaag

SEQ ID NO: 4895845 - DNA, 18 bp, Homo sapiens
ctactgttctaaagctct

SEQ ID NO: 4895846 - DNA, 20 bp, Homo sapiens
ctacttagcatcctaagaaa

SEQ ID NO: 4895847 - DNA, 17 bp, Homo sapiens
ctacttagcatgtccct

SEQ ID NO: 4895848 - DNA, 22 bp, Homo sapiens
ctacttcttttgctcttagctg

SEQ ID NO: 4895849 - DNA, 13 bp, Homo sapiens
ctacttggtttgt

SEQ ID NO: 4895850 - DNA, 14 bp, Homo sapiens
ctactttccaggct

SEQ ID NO: 4895851 - DNA, 21 bp, Homo sapiens
ctactttggtttctgtctgta

SEQ ID NO: 4895852 - DNA, 18 bp, Homo sapiens
ctagaaaagctgatcata

SEQ ID NO: 4895853 - DNA, 16 bp, Homo sapiens
ctagaaacagatcttg

SEQ ID NO: 4895854 - DNA, 21 bp, Homo sapiens
ctagaaacccaagctcctcct

SEQ ID NO: 4895855 - DNA, 19 bp, Homo sapiens
ctagaacacaggcaaaatc

SEQ ID NO: 4895856 - DNA, 21 bp, Homo sapiens
ctagaacacaggcaaaatcct

SEQ ID NO: 4895857 - DNA, 22 bp, Homo sapiens
ctagaacacaggcaaaatcctt

SEQ ID NO: 4895858 - DNA, 16 bp, Homo sapiens
ctagaacactaactca

SEQ ID NO: 4895859 - DNA, 19 bp, Homo sapiens
ctagaacactaactcacca

SEQ ID NO: 4895860 - DNA, 20 bp, Homo sapiens
ctagaacactaactcaccag

SEQ ID NO: 4895861 - DNA, 11 bp, Homo sapiens
ctagaactttt

SEQ ID NO: 4895862 - DNA, 16 bp, Homo sapiens
ctagaacttttttaaa

SEQ ID NO: 4895863 - DNA, 18 bp, Homo sapiens
ctagaacttttttaaata

SEQ ID NO: 4895864 - DNA, 22 bp, Homo sapiens
ctagaacttttttaaataaact

SEQ ID NO: 4895865 - DNA, 14 bp, Homo sapiens
ctagaatacttttt

SEQ ID NO: 4895866 - DNA, 20 bp, Homo sapiens
ctagaattctgtattggata

SEQ ID NO: 4895867 - DNA, 23 bp, Homo sapiens
ctagacaagatattgtacataaa

SEQ ID NO: 4895868 - DNA, 18 bp, Homo sapiens
ctagacaccaaagttcta

SEQ ID NO: 4895869 - DNA, 13 bp, Homo sapiens
ctagacactgcca

SEQ ID NO: 4895870 - DNA, 18 bp, Homo sapiens
ctagacagatccccgttc

SEQ ID NO: 4895871 - DNA, 20 bp, Homo sapiens
ctagacatggaggttctaag

SEQ ID NO: 4895872 - DNA, 22 bp, Homo sapiens
ctagacatggaggttctaaggc

SEQ ID NO: 4895873 - DNA, 12 bp, Homo sapiens
ctagactttctg

SEQ ID NO: 4895874 - DNA, 15 bp, Homo sapiens
ctagagaacgcagcc

SEQ ID NO: 4895875 - DNA, 16 bp, Homo sapiens
ctagagaacgcagccc

SEQ ID NO: 4895876 - DNA, 17 bp, Homo sapiens
ctagagaacgcagccct

SEQ ID NO: 4895877 - DNA, 18 bp, Homo sapiens
ctagagaacgcagcccta

SEQ ID NO: 4895878 - DNA, 20 bp, Homo sapiens
ctagagaagataattgttga

SEQ ID NO: 4895879 - DNA, 15 bp, Homo sapiens
ctagagaatgcacag

SEQ ID NO: 4895880 - DNA, 16 bp, Homo sapiens
ctagagaatgcacaga

SEQ ID NO: 4895881 - DNA, 21 bp, Homo sapiens
ctagagcagcccaaatttttc

SEQ ID NO: 4895882 - DNA, 14 bp, Homo sapiens
ctagagcctgcctg

SEQ ID NO: 4895883 - DNA, 18 bp, Homo sapiens
ctagagcctgcctggagc

SEQ ID NO: 4895884 - DNA, 17 bp, Homo sapiens
ctagaggccagccccac

SEQ ID NO: 4895885 - DNA, 18 bp, Homo sapiens
ctagaggccagccccacc

SEQ ID NO: 4895886 - DNA, 22 bp, Homo sapiens
ctagaggccagccccacccagg

SEQ ID NO: 4895887 - DNA, 20 bp, Homo sapiens
ctagatcagatgctccaaga

SEQ ID NO: 4895888 - DNA, 17 bp, Homo sapiens
ctagatcataaggcttc

SEQ ID NO: 4895889 - DNA, 22 bp, Homo sapiens
ctagatcataaggcttcaaaat

SEQ ID NO: 4895890 - DNA, 22 bp, Homo sapiens
ctagatgattaaataagattct

SEQ ID NO: 4895891 - DNA, 21 bp, Homo sapiens
ctagattcaaaggttctaggt

SEQ ID NO: 4895892 - DNA, 24 bp, Homo sapiens
ctagattgagagaagagacaaaca

SEQ ID NO: 4895893 - DNA, 21 bp, Homo sapiens
ctagcaaccgcctcaaaatgt

SEQ ID NO: 4895894 - DNA, 21 bp, Homo sapiens
ctagcaagctgccgaaccaaa

SEQ ID NO: 4895895 - DNA, 15 bp, Homo sapiens
ctagcaagctggcct

SEQ ID NO: 4895896 - DNA, 15 bp, Homo sapiens
ctagcaagtgagaga

SEQ ID NO: 4895897 - DNA, 17 bp, Homo sapiens
ctagcagtgaactattt

SEQ ID NO: 4895898 - DNA, 13 bp, Homo sapiens
ctagcatccctga

SEQ ID NO: 4895899 - DNA, 22 bp, Homo sapiens
ctagccaggaagtacttccacc

SEQ ID NO: 4895900 - DNA, 14 bp, Homo sapiens
ctagcccaccctgc

SEQ ID NO: 4895901 - DNA, 20 bp, Homo sapiens
ctagcccaccctgctgcctt

SEQ ID NO: 4895902 - DNA, 13 bp, Homo sapiens
ctagcccaggaga

SEQ ID NO: 4895903 - DNA, 18 bp, Homo sapiens
ctagcccaggagagagaa

SEQ ID NO: 4895904 - DNA, 19 bp, Homo sapiens
ctagcccaggagagagaaa

SEQ ID NO: 4895905 - DNA, 22 bp, Homo sapiens
ctagcccaggagagagaaagcc

SEQ ID NO: 4895906 - DNA, 14 bp, Homo sapiens
ctagcccctgtgga

SEQ ID NO: 4895907 - DNA, 18 bp, Homo sapiens
ctagcctatttacctgca

SEQ ID NO: 4895908 - DNA, 23 bp, Homo sapiens
ctagcctatttacctgcaggctg

SEQ ID NO: 4895909 - DNA, 23 bp, Homo sapiens
ctagccttagaagtcacacagta

SEQ ID NO: 4895910 - DNA, 15 bp, Homo sapiens
ctagcctttggctct

SEQ ID NO: 4895911 - DNA, 21 bp, Homo sapiens
ctagcctttggctctggagac

SEQ ID NO: 4895912 - DNA, 15 bp, Homo sapiens
ctagctatgtgacct

SEQ ID NO: 4895913 - DNA, 14 bp, Homo sapiens
ctagctgtgggggt

SEQ ID NO: 4895914 - DNA, 21 bp, Homo sapiens
ctagctttatatatggacatg

SEQ ID NO: 4895915 - DNA, 23 bp, Homo sapiens
ctagctttatatatggacatggc

SEQ ID NO: 4895916 - DNA, 17 bp, Homo sapiens
ctaggaatgaaatcctg

SEQ ID NO: 4895917 - DNA, 22 bp, Homo sapiens
ctaggaccactcagcccctagg

SEQ ID NO: 4895918 - DNA, 23 bp, Homo sapiens
ctaggaccatggttaagagtcca

SEQ ID NO: 4895919 - DNA, 13 bp, Homo sapiens
ctaggagaagagt

SEQ ID NO: 4895920 - DNA, 18 bp, Homo sapiens
ctaggatgcggaaatccc

SEQ ID NO: 4895921 - DNA, 15 bp, Homo sapiens
ctaggctcagagatg

SEQ ID NO: 4895922 - DNA, 15 bp, Homo sapiens
ctagggattcaggct

SEQ ID NO: 4895923 - DNA, 19 bp, Homo sapiens
ctagggttgctggagcctg

SEQ ID NO: 4895924 - DNA, 15 bp, Homo sapiens
ctaggtaatttttac

SEQ ID NO: 4895925 - DNA, 18 bp, Homo sapiens
ctaggtagaaaaagggtc

SEQ ID NO: 4895926 - DNA, 19 bp, Homo sapiens
ctaggtagaaaaagggtca

SEQ ID NO: 4895927 - DNA, 13 bp, Homo sapiens
ctaggttccctgt

SEQ ID NO: 4895928 - DNA, 21 bp, Homo sapiens
ctaggttccctgttcttcctc

SEQ ID NO: 4895929 - DNA, 17 bp, Homo sapiens
ctagtactgtgtactgt

SEQ ID NO: 4895930 - DNA, 15 bp, Homo sapiens
ctagtatttgaatta

SEQ ID NO: 4895931 - DNA, 15 bp, Homo sapiens
ctagtcccttcccct

SEQ ID NO: 4895932 - DNA, 16 bp, Homo sapiens
ctagtctctcctgtaa

SEQ ID NO: 4895933 - DNA, 17 bp, Homo sapiens
ctagtgagctgggcatg

SEQ ID NO: 4895934 - DNA, 21 bp, Homo sapiens
ctagtggctctcagttaaaat

SEQ ID NO: 4895935 - DNA, 23 bp, Homo sapiens
ctagtgttctgtctaaaaaccag

SEQ ID NO: 4895936 - DNA, 22 bp, Homo sapiens
ctagtttgacctcacagtgacc

SEQ ID NO: 4895937 - DNA, 18 bp, Homo sapiens
ctagtttgggaggagcag

SEQ ID NO: 4895938 - DNA, 20 bp, Homo sapiens
ctagttttagttttctctta

SEQ ID NO: 4895939 - DNA, 17 bp, Homo sapiens
ctagttttctcctccca

SEQ ID NO: 4895940 - DNA, 18 bp, Homo sapiens
ctagttttctcctcccag

SEQ ID NO: 4895941 - DNA, 23 bp, Homo sapiens
ctagtttttagtaatctgtacat

SEQ ID NO: 4895942 - DNA, 19 bp, Homo sapiens
ctataaagagaagacgaaa

SEQ ID NO: 4895943 - DNA, 21 bp, Homo sapiens
ctataacatatgtacataaat

SEQ ID NO: 4895944 - DNA, 16 bp, Homo sapiens
ctataacttgatgcat

SEQ ID NO: 4895945 - DNA, 15 bp, Homo sapiens
ctataatctgtcaaa

SEQ ID NO: 4895946 - DNA, 21 bp, Homo sapiens
ctataatctgtcaaaacactg

SEQ ID NO: 4895947 - DNA, 14 bp, Homo sapiens
ctatacatctctcc

SEQ ID NO: 4895948 - DNA, 17 bp, Homo sapiens
ctatacttgaacaaaag

SEQ ID NO: 4895949 - DNA, 15 bp, Homo sapiens
ctatagctaagtaca

SEQ ID NO: 4895950 - DNA, 14 bp, Homo sapiens
ctatagttctagac

SEQ ID NO: 4895951 - DNA, 19 bp, Homo sapiens
ctatagtttaaaacacatt

SEQ ID NO: 4895952 - DNA, 14 bp, Homo sapiens
ctatatagagatgt

SEQ ID NO: 4895953 - DNA, 14 bp, Homo sapiens
ctatatatatatgc

SEQ ID NO: 4895954 - DNA, 18 bp, Homo sapiens
ctatatatatatgccttt

SEQ ID NO: 4895955 - DNA, 17 bp, Homo sapiens
ctatatatgtgtatgta

SEQ ID NO: 4895956 - DNA, 16 bp, Homo sapiens
ctatatgaatttaaat

SEQ ID NO: 4895957 - DNA, 17 bp, Homo sapiens
ctatatgatttatagtt

SEQ ID NO: 4895958 - DNA, 12 bp, Homo sapiens
ctatatgtgaat

SEQ ID NO: 4895959 - DNA, 22 bp, Homo sapiens
ctatatttgctagactctagac

SEQ ID NO: 4895960 - DNA, 19 bp, Homo sapiens
ctatcaagtcaatcatttc

SEQ ID NO: 4895961 - DNA, 21 bp, Homo sapiens
ctatccactgggcacaactgc

SEQ ID NO: 4895962 - DNA, 15 bp, Homo sapiens
ctatccatgcaccaa

SEQ ID NO: 4895963 - DNA, 18 bp, Homo sapiens
ctatccatgcaccaaact

SEQ ID NO: 4895964 - DNA, 23 bp, Homo sapiens
ctatcctgacttctaatatcatt

SEQ ID NO: 4895965 - DNA, 12 bp, Homo sapiens
ctatccttcgtg

SEQ ID NO: 4895966 - DNA, 13 bp, Homo sapiens
ctatctaaagttt

SEQ ID NO: 4895967 - DNA, 17 bp, Homo sapiens
ctatctgattttgtgca

SEQ ID NO: 4895968 - DNA, 18 bp, Homo sapiens
ctatctgattttgtgcaa

SEQ ID NO: 4895969 - DNA, 14 bp, Homo sapiens
ctatcttccaaatg

SEQ ID NO: 4895970 - DNA, 18 bp, Homo sapiens
ctatgagcatcctgagcc

SEQ ID NO: 4895971 - DNA, 19 bp, Homo sapiens
ctatgagcatcctgagccc

SEQ ID NO: 4895972 - DNA, 22 bp, Homo sapiens
ctatgagcatcctgagccccgc

SEQ ID NO: 4895973 - DNA, 23 bp, Homo sapiens
ctatgaggaataattatttattt

SEQ ID NO: 4895974 - DNA, 19 bp, Homo sapiens
ctatgatgtgaaacacttt

SEQ ID NO: 4895975 - DNA, 17 bp, Homo sapiens
ctatgccccaaatatag

SEQ ID NO: 4895976 - DNA, 13 bp, Homo sapiens
ctatgctgtttgt

SEQ ID NO: 4895977 - DNA, 15 bp, Homo sapiens
ctatggacacagggt

SEQ ID NO: 4895978 - DNA, 19 bp, Homo sapiens
ctatggagcctggcacagg

SEQ ID NO: 4895979 - DNA, 14 bp, Homo sapiens
ctatggcagaaaaa

SEQ ID NO: 4895980 - DNA, 16 bp, Homo sapiens
ctatggcagaaaaaat

SEQ ID NO: 4895981 - DNA, 14 bp, Homo sapiens
ctatgggagcccca

SEQ ID NO: 4895982 - DNA, 19 bp, Homo sapiens
ctatgggggcactgaggac

SEQ ID NO: 4895983 - DNA, 16 bp, Homo sapiens
ctatggttatgaaaga

SEQ ID NO: 4895984 - DNA, 13 bp, Homo sapiens
ctatgtatttgca

SEQ ID NO: 4895985 - DNA, 16 bp, Homo sapiens
ctatgttgcccaggca

SEQ ID NO: 4895986 - DNA, 19 bp, Homo sapiens
ctatgttgcccaggcaggt

SEQ ID NO: 4895987 - DNA, 21 bp, Homo sapiens
ctatgttgcccaggcaggtct

SEQ ID NO: 4895988 - DNA, 22 bp, Homo sapiens
ctatgttgcccaggcaggtctt

SEQ ID NO: 4895989 - DNA, 13 bp, Homo sapiens
ctattaaaactca

SEQ ID NO: 4895990 - DNA, 20 bp, Homo sapiens
ctattaaagtgctaaggttc

SEQ ID NO: 4895991 - DNA, 21 bp, Homo sapiens
ctattaaagtgctaaggttct

SEQ ID NO: 4895992 - DNA, 22 bp, Homo sapiens
ctattaaatagttatataattc

SEQ ID NO: 4895993 - DNA, 22 bp, Homo sapiens
ctattagccaggatcatggtgt

SEQ ID NO: 4895994 - DNA, 22 bp, Homo sapiens
ctattcaaggtggccaaattat

SEQ ID NO: 4895995 - DNA, 23 bp, Homo sapiens
ctattcaaggtggccaaattatt

SEQ ID NO: 4895996 - DNA, 15 bp, Homo sapiens
ctattcctttccctt

SEQ ID NO: 4895997 - DNA, 17 bp, Homo sapiens
ctattcctttcccttcc

SEQ ID NO: 4895998 - DNA, 18 bp, Homo sapiens
ctattcctttcccttcct

SEQ ID NO: 4895999 - DNA, 17 bp, Homo sapiens
ctattcgaatgaaaaga

SEQ ID NO: 4896000 - DNA, 21 bp, Homo sapiens
ctattctcaaagtttcctaat

SEQ ID NO: 4896001 - DNA, 19 bp, Homo sapiens
ctattctgtgttgcattat

SEQ ID NO: 4896002 - DNA, 12 bp, Homo sapiens
ctattgccttct

SEQ ID NO: 4896003 - DNA, 20 bp, Homo sapiens
ctattgccttctttgaagaa

SEQ ID NO: 4896004 - DNA, 21 bp, Homo sapiens
ctattggaggatcagtttttt

SEQ ID NO: 4896005 - DNA, 21 bp, Homo sapiens
ctattgtgggacttattacaa

SEQ ID NO: 4896006 - DNA, 15 bp, Homo sapiens
ctatttaatatttat

SEQ ID NO: 4896007 - DNA, 14 bp, Homo sapiens
ctatttatgccttg

SEQ ID NO: 4896008 - DNA, 20 bp, Homo sapiens
ctatttatgccttgatgatt

SEQ ID NO: 4896009 - DNA, 21 bp, Homo sapiens
ctatttattaatatttaacat

SEQ ID NO: 4896010 - DNA, 19 bp, Homo sapiens
ctatttattttcctaaaga

SEQ ID NO: 4896011 - DNA, 21 bp, Homo sapiens
ctatttattttcctaaagaga

SEQ ID NO: 4896012 - DNA, 21 bp, Homo sapiens
ctatttctgggtcttttgcta

SEQ ID NO: 4896013 - DNA, 23 bp, Homo sapiens
ctatttgccatgggcttcactgt

SEQ ID NO: 4896014 - DNA, 18 bp, Homo sapiens
ctatttgcttatttaata

SEQ ID NO: 4896015 - DNA, 13 bp, Homo sapiens
ctattttaaaata

SEQ ID NO: 4896016 - DNA, 14 bp, Homo sapiens
ctattttctacaat

SEQ ID NO: 4896017 - DNA, 20 bp, Homo sapiens
ctcaaaacttaacatattta

SEQ ID NO: 4896018 - DNA, 22 bp, Homo sapiens
ctcaaaagcatttatcattctt

SEQ ID NO: 4896019 - DNA, 18 bp, Homo sapiens
ctcaaaatatttgtacat

SEQ ID NO: 4896020 - DNA, 16 bp, Homo sapiens
ctcaaacaacactggt

SEQ ID NO: 4896021 - DNA, 20 bp, Homo sapiens
ctcaaactaaaagacatttg

SEQ ID NO: 4896022 - DNA, 20 bp, Homo sapiens
ctcaaactcttgacctcagg

SEQ ID NO: 4896023 - DNA, 17 bp, Homo sapiens
ctcaaagttttgaaaag

SEQ ID NO: 4896024 - DNA, 18 bp, Homo sapiens
ctcaaagttttgaaaagc

SEQ ID NO: 4896025 - DNA, 19 bp, Homo sapiens
ctcaaagttttgaaaagct

SEQ ID NO: 4896026 - DNA, 21 bp, Homo sapiens
ctcaaagttttgaaaagctat

SEQ ID NO: 4896027 - DNA, 23 bp, Homo sapiens
ctcaaagttttgaaaagctatta

SEQ ID NO: 4896028 - DNA, 15 bp, Homo sapiens
ctcaaatgttctaag

SEQ ID NO: 4896029 - DNA, 12 bp, Homo sapiens
ctcaaatttgga

SEQ ID NO: 4896030 - DNA, 14 bp, Homo sapiens
ctcaacaataaaac

SEQ ID NO: 4896031 - DNA, 13 bp, Homo sapiens
ctcaacctcctgg

SEQ ID NO: 4896032 - DNA, 13 bp, Homo sapiens
ctcaacctcttct

SEQ ID NO: 4896033 - DNA, 21 bp, Homo sapiens
ctcaacctcttctggctcaaa

SEQ ID NO: 4896034 - DNA, 19 bp, Homo sapiens
ctcaaggttttaggttcta

SEQ ID NO: 4896035 - DNA, 21 bp, Homo sapiens
ctcaagtcctcttttctgaga

SEQ ID NO: 4896036 - DNA, 17 bp, Homo sapiens
ctcaagtgattctcctg

SEQ ID NO: 4896037 - DNA, 20 bp, Homo sapiens
ctcaagtgattctcctgcct

SEQ ID NO: 4896038 - DNA, 15 bp, Homo sapiens
ctcaagttctaagat

SEQ ID NO: 4896039 - DNA, 18 bp, Homo sapiens
ctcaagttctaagattct

SEQ ID NO: 4896040 - DNA, 19 bp, Homo sapiens
ctcaagttctaagattcta

SEQ ID NO: 4896041 - DNA, 16 bp, Homo sapiens
ctcaatgaagccagct

SEQ ID NO: 4896042 - DNA, 20 bp, Homo sapiens
ctcaatttttgtctcagaag

SEQ ID NO: 4896043 - DNA, 23 bp, Homo sapiens
ctcacaacttagtgtaatatacc

SEQ ID NO: 4896044 - DNA, 13 bp, Homo sapiens
ctcacagcctctg

SEQ ID NO: 4896045 - DNA, 21 bp, Homo sapiens
ctcacagcctctgacccctcc

SEQ ID NO: 4896046 - DNA, 16 bp, Homo sapiens
ctcacagtaacccaaa

SEQ ID NO: 4896047 - DNA, 20 bp, Homo sapiens
ctcacagtaacccaaacctc

SEQ ID NO: 4896048 - DNA, 23 bp, Homo sapiens
ctcacagtaacccaaacctcaag

SEQ ID NO: 4896049 - DNA, 13 bp, Homo sapiens
ctcacagtacagc

SEQ ID NO: 4896050 - DNA, 15 bp, Homo sapiens
ctcacattcctaggg

SEQ ID NO: 4896051 - DNA, 12 bp, Homo sapiens
ctcacatttatg

SEQ ID NO: 4896052 - DNA, 13 bp, Homo sapiens
ctcaccagcccca

SEQ ID NO: 4896053 - DNA, 18 bp, Homo sapiens
ctcaccagccccactgcc

SEQ ID NO: 4896054 - DNA, 23 bp, Homo sapiens
ctcaccagccccactgccagcag

SEQ ID NO: 4896055 - DNA, 14 bp, Homo sapiens
ctcaccagccccag

SEQ ID NO: 4896056 - DNA, 20 bp, Homo sapiens
ctcaccagtgtcccctccac

SEQ ID NO: 4896057 - DNA, 24 bp, Homo sapiens
ctcaccagtgtcccctccactgtc

SEQ ID NO: 4896058 - DNA, 22 bp, Homo sapiens
ctcaccccatcccacaccctgg

SEQ ID NO: 4896059 - DNA, 19 bp, Homo sapiens
ctcacccctgtcctcactg

SEQ ID NO: 4896060 - DNA, 15 bp, Homo sapiens
ctcaccctgctacac

SEQ ID NO: 4896061 - DNA, 18 bp, Homo sapiens
ctcaccgcttccctcctg

SEQ ID NO: 4896062 - DNA, 22 bp, Homo sapiens
ctcacctctggactggctagag

SEQ ID NO: 4896063 - DNA, 19 bp, Homo sapiens
ctcacctgagtcaccctac

SEQ ID NO: 4896064 - DNA, 21 bp, Homo sapiens
ctcacgggcatgggcactccc

SEQ ID NO: 4896065 - DNA, 22 bp, Homo sapiens
ctcactatgttgcccaggcagg

SEQ ID NO: 4896066 - DNA, 19 bp, Homo sapiens
ctcactccccatgccacgt

SEQ ID NO: 4896067 - DNA, 16 bp, Homo sapiens
ctcactcctacctggt

SEQ ID NO: 4896068 - DNA, 17 bp, Homo sapiens
ctcactcctacctggta

SEQ ID NO: 4896069 - DNA, 11 bp, Homo sapiens
ctcactctgcc

SEQ ID NO: 4896070 - DNA, 14 bp, Homo sapiens
ctcactctgccagg

SEQ ID NO: 4896071 - DNA, 14 bp, Homo sapiens
ctcactctggcctc

SEQ ID NO: 4896072 - DNA, 11 bp, Homo sapiens
ctcactctgtc

SEQ ID NO: 4896073 - DNA, 22 bp, Homo sapiens
ctcactctgtcgcccagtctgg

SEQ ID NO: 4896074 - DNA, 15 bp, Homo sapiens
ctcactgaagcctgc

SEQ ID NO: 4896075 - DNA, 16 bp, Homo sapiens
ctcactgaagcctgcg

SEQ ID NO: 4896076 - DNA, 18 bp, Homo sapiens
ctcactgcaaccttcacc

SEQ ID NO: 4896077 - DNA, 13 bp, Homo sapiens
ctcactgcagcct

SEQ ID NO: 4896078 - DNA, 14 bp, Homo sapiens
ctcactgcagcctc

SEQ ID NO: 4896079 - DNA, 15 bp, Homo sapiens
ctcactgcagcctca

SEQ ID NO: 4896080 - DNA, 20 bp, Homo sapiens
ctcactgcccgcacaccctc

SEQ ID NO: 4896081 - DNA, 14 bp, Homo sapiens
ctcactggccatcc

SEQ ID NO: 4896082 - DNA, 16 bp, Homo sapiens
ctcactggccatccct

SEQ ID NO: 4896083 - DNA, 21 bp, Homo sapiens
ctcactgttgaattttctcta

SEQ ID NO: 4896084 - DNA, 21 bp, Homo sapiens
ctcactgttgcccaggctggc

SEQ ID NO: 4896085 - DNA, 22 bp, Homo sapiens
ctcactgttgcccaggctggcg

SEQ ID NO: 4896086 - DNA, 17 bp, Homo sapiens
ctcagaacccagggctc

SEQ ID NO: 4896087 - DNA, 17 bp, Homo sapiens
ctcagaataaggcaggc

SEQ ID NO: 4896088 - DNA, 17 bp, Homo sapiens
ctcagaatgtaaaagaa

SEQ ID NO: 4896089 - DNA, 16 bp, Homo sapiens
ctcagacttttgtaca

SEQ ID NO: 4896090 - DNA, 17 bp, Homo sapiens
ctcagagggggactgct

SEQ ID NO: 4896091 - DNA, 15 bp, Homo sapiens
ctcagattatttaaa

SEQ ID NO: 4896092 - DNA, 15 bp, Homo sapiens
ctcagcatcctggca

SEQ ID NO: 4896093 - DNA, 22 bp, Homo sapiens
ctcagcatcctggcacccggcc

SEQ ID NO: 4896094 - DNA, 13 bp, Homo sapiens
ctcagccaagctt

SEQ ID NO: 4896095 - DNA, 17 bp, Homo sapiens
ctcagccacacccaggc

SEQ ID NO: 4896096 - DNA, 19 bp, Homo sapiens
ctcagcccacatagtgatg

SEQ ID NO: 4896097 - DNA, 21 bp, Homo sapiens
ctcagcccacatagtgatggt

SEQ ID NO: 4896098 - DNA, 16 bp, Homo sapiens
ctcagccccgagctgt

SEQ ID NO: 4896099 - DNA, 11 bp, Homo sapiens
ctcagccccta

SEQ ID NO: 4896100 - DNA, 14 bp, Homo sapiens
ctcagcccctagga

SEQ ID NO: 4896101 - DNA, 14 bp, Homo sapiens
ctcagccctccctg

SEQ ID NO: 4896102 - DNA, 13 bp, Homo sapiens
ctcagcctcccaa

SEQ ID NO: 4896103 - DNA, 14 bp, Homo sapiens
ctcagcctcccaaa

SEQ ID NO: 4896104 - DNA, 16 bp, Homo sapiens
ctcagcctcccaaagt

SEQ ID NO: 4896105 - DNA, 22 bp, Homo sapiens
ctcagcctcccaaagtgctggg

SEQ ID NO: 4896106 - DNA, 20 bp, Homo sapiens
ctcagcctcccagagtgctg

SEQ ID NO: 4896107 - DNA, 13 bp, Homo sapiens
ctcagcctgcaca

SEQ ID NO: 4896108 - DNA, 14 bp, Homo sapiens
ctcagcctgctgcc

SEQ ID NO: 4896109 - DNA, 17 bp, Homo sapiens
ctcagcctgctgcccag

SEQ ID NO: 4896110 - DNA, 20 bp, Homo sapiens
ctcagcggcgaccgccctcc

SEQ ID NO: 4896111 - DNA, 13 bp, Homo sapiens
ctcagcggggaca

SEQ ID NO: 4896112 - DNA, 18 bp, Homo sapiens
ctcagcggggacagctcc

SEQ ID NO: 4896113 - DNA, 19 bp, Homo sapiens
ctcagcggggacagctcct

SEQ ID NO: 4896114 - DNA, 21 bp, Homo sapiens
ctcagcggggacagctccttc

SEQ ID NO: 4896115 - DNA, 21 bp, Homo sapiens
ctcagctacccactatccttc

SEQ ID NO: 4896116 - DNA, 17 bp, Homo sapiens
ctcagctcagcgccagc

SEQ ID NO: 4896117 - DNA, 23 bp, Homo sapiens
ctcagctgaatgcctcctgtggg

SEQ ID NO: 4896118 - DNA, 16 bp, Homo sapiens
ctcagctgtctgtggc

SEQ ID NO: 4896119 - DNA, 18 bp, Homo sapiens
ctcagctgtctgtggctt

SEQ ID NO: 4896120 - DNA, 13 bp, Homo sapiens
ctcagctttgaga

SEQ ID NO: 4896121 - DNA, 16 bp, Homo sapiens
ctcagctttgagaagc

SEQ ID NO: 4896122 - DNA, 15 bp, Homo sapiens
ctcaggaactagact

SEQ ID NO: 4896123 - DNA, 16 bp, Homo sapiens
ctcaggactgcaacag

SEQ ID NO: 4896124 - DNA, 19 bp, Homo sapiens
ctcaggaggcgcccttggc

SEQ ID NO: 4896125 - DNA, 20 bp, Homo sapiens
ctcaggaggcgcccttggct

SEQ ID NO: 4896126 - DNA, 18 bp, Homo sapiens
ctcaggaggctgaggcag

SEQ ID NO: 4896127 - DNA, 23 bp, Homo sapiens
ctcaggaggctgaggcaggagga

SEQ ID NO: 4896128 - DNA, 20 bp, Homo sapiens
ctcaggatatccttatcaga

SEQ ID NO: 4896129 - DNA, 19 bp, Homo sapiens
ctcaggatttaaaaactgg

SEQ ID NO: 4896130 - DNA, 14 bp, Homo sapiens
ctcaggcagctcaa

SEQ ID NO: 4896131 - DNA, 15 bp, Homo sapiens
ctcaggcagctcaag

SEQ ID NO: 4896132 - DNA, 13 bp, Homo sapiens
ctcaggctgcagc

SEQ ID NO: 4896133 - DNA, 17 bp, Homo sapiens
ctcaggctgcagctgga

SEQ ID NO: 4896134 - DNA, 22 bp, Homo sapiens
ctcaggctgcagctggacagag

SEQ ID NO: 4896135 - DNA, 14 bp, Homo sapiens
ctcagggacagagc

SEQ ID NO: 4896136 - DNA, 15 bp, Homo sapiens
ctcagggacagagcc

SEQ ID NO: 4896137 - DNA, 16 bp, Homo sapiens
ctcagggacagagcca

SEQ ID NO: 4896138 - DNA, 22 bp, Homo sapiens
ctcagggagcagggaaggcctg

SEQ ID NO: 4896139 - DNA, 23 bp, Homo sapiens
ctcagggagcagggaaggcctga

SEQ ID NO: 4896140 - DNA, 16 bp, Homo sapiens
ctcagggctcctccca

SEQ ID NO: 4896141 - DNA, 18 bp, Homo sapiens
ctcaggggaaaactgtta

SEQ ID NO: 4896142 - DNA, 18 bp, Homo sapiens
ctcaggggccagaggaac

SEQ ID NO: 4896143 - DNA, 18 bp, Homo sapiens
ctcaggtgatccacccac

SEQ ID NO: 4896144 - DNA, 16 bp, Homo sapiens
ctcaggtgtccctgca

SEQ ID NO: 4896145 - DNA, 18 bp, Homo sapiens
ctcaggtgtccctgcact

SEQ ID NO: 4896146 - DNA, 22 bp, Homo sapiens
ctcaggtgttttttatgaagtg

SEQ ID NO: 4896147 - DNA, 15 bp, Homo sapiens
ctcagtatatttaaa

SEQ ID NO: 4896148 - DNA, 14 bp, Homo sapiens
ctcagtcatgcata

SEQ ID NO: 4896149 - DNA, 16 bp, Homo sapiens
ctcagtcatgcataaa

SEQ ID NO: 4896150 - DNA, 23 bp, Homo sapiens
ctcagtcatgcataaatatgcag

SEQ ID NO: 4896151 - DNA, 20 bp, Homo sapiens
ctcagtcctcccctcacagc

SEQ ID NO: 4896152 - DNA, 21 bp, Homo sapiens
ctcagtcctcccctcacagcc

SEQ ID NO: 4896153 - DNA, 18 bp, Homo sapiens
ctcagtggcttcatctgt

SEQ ID NO: 4896154 - DNA, 16 bp, Homo sapiens
ctcagttaaaatgtga

SEQ ID NO: 4896155 - DNA, 21 bp, Homo sapiens
ctcagttcccttggcctcaga

SEQ ID NO: 4896156 - DNA, 20 bp, Homo sapiens
ctcagttgtgactaactaga

SEQ ID NO: 4896157 - DNA, 16 bp, Homo sapiens
ctcataaatttacttt

SEQ ID NO: 4896158 - DNA, 15 bp, Homo sapiens
ctcatacctctgacc

SEQ ID NO: 4896159 - DNA, 21 bp, Homo sapiens
ctcatacctctgaccaacagg

SEQ ID NO: 4896160 - DNA, 21 bp, Homo sapiens
ctcatactacattgagtagac

SEQ ID NO: 4896161 - DNA, 18 bp, Homo sapiens
ctcatagtatggtggctg

SEQ ID NO: 4896162 - DNA, 19 bp, Homo sapiens
ctcatagtatggtggctgg

SEQ ID NO: 4896163 - DNA, 20 bp, Homo sapiens
ctcatagtatggtggctggg

SEQ ID NO: 4896164 - DNA, 21 bp, Homo sapiens
ctcatagtatggtggctgggt

SEQ ID NO: 4896165 - DNA, 18 bp, Homo sapiens
ctcatcaacaaagaaata

SEQ ID NO: 4896166 - DNA, 16 bp, Homo sapiens
ctcatccaccccatcc

SEQ ID NO: 4896167 - DNA, 21 bp, Homo sapiens
ctcatcccatgagaccctggt

SEQ ID NO: 4896168 - DNA, 22 bp, Homo sapiens
ctcatcccatgagaccctggtg

SEQ ID NO: 4896169 - DNA, 14 bp, Homo sapiens
ctcatccccagggg

SEQ ID NO: 4896170 - DNA, 16 bp, Homo sapiens
ctcatcccgtgttctc

SEQ ID NO: 4896171 - DNA, 13 bp, Homo sapiens
ctcatcctcctgg

SEQ ID NO: 4896172 - DNA, 19 bp, Homo sapiens
ctcatctatgaggaaaggt

SEQ ID NO: 4896173 - DNA, 20 bp, Homo sapiens
ctcatctatgaggaaaggtt

SEQ ID NO: 4896174 - DNA, 21 bp, Homo sapiens
ctcatctgcacccttcttttc

SEQ ID NO: 4896175 - DNA, 19 bp, Homo sapiens
ctcatcttgaagggcccag

SEQ ID NO: 4896176 - DNA, 20 bp, Homo sapiens
ctcatcttgaagggcccagg

SEQ ID NO: 4896177 - DNA, 14 bp, Homo sapiens
ctcatcttgtgaaa

SEQ ID NO: 4896178 - DNA, 20 bp, Homo sapiens
ctcatggcccctctgacctg

SEQ ID NO: 4896179 - DNA, 17 bp, Homo sapiens
ctcatgtatcatctgga

SEQ ID NO: 4896180 - DNA, 19 bp, Homo sapiens
ctcatgtatcatctggata

SEQ ID NO: 4896181 - DNA, 18 bp, Homo sapiens
ctcatgtttatgaaaata

SEQ ID NO: 4896182 - DNA, 18 bp, Homo sapiens
ctcattccaacagtgagt

SEQ ID NO: 4896183 - DNA, 13 bp, Homo sapiens
ctcattcttctgt

SEQ ID NO: 4896184 - DNA, 23 bp, Homo sapiens
ctcattcttctgtacgtctgaca

SEQ ID NO: 4896185 - DNA, 14 bp, Homo sapiens
ctcattcttgtttt

SEQ ID NO: 4896186 - DNA, 14 bp, Homo sapiens
ctcattgaaatgtc

SEQ ID NO: 4896187 - DNA, 16 bp, Homo sapiens
ctcattgaaatgtcac

SEQ ID NO: 4896188 - DNA, 20 bp, Homo sapiens
ctcattgctgagcctctgct

SEQ ID NO: 4896189 - DNA, 12 bp, Homo sapiens
ctcattggggtt

SEQ ID NO: 4896190 - DNA, 15 bp, Homo sapiens
ctcattttaatgtaa

SEQ ID NO: 4896191 - DNA, 21 bp, Homo sapiens
ctcattttaatgtaaagattt

SEQ ID NO: 4896192 - DNA, 16 bp, Homo sapiens
ctcattttagttgcct

SEQ ID NO: 4896193 - DNA, 20 bp, Homo sapiens
ctcatttttttaatttatta

SEQ ID NO: 4896194 - DNA, 23 bp, Homo sapiens
ctccaaatctcaatgaagccagc

SEQ ID NO: 4896195 - DNA, 20 bp, Homo sapiens
ctccaacacaaggctccaag

SEQ ID NO: 4896196 - DNA, 22 bp, Homo sapiens
ctccaacagaactaaatgttct

SEQ ID NO: 4896197 - DNA, 14 bp, Homo sapiens
ctccaagacctagg

SEQ ID NO: 4896198 - DNA, 12 bp, Homo sapiens
ctccaagattct

SEQ ID NO: 4896199 - DNA, 16 bp, Homo sapiens
ctccaagattctagat

SEQ ID NO: 4896200 - DNA, 17 bp, Homo sapiens
ctccaagattctagatg

SEQ ID NO: 4896201 - DNA, 17 bp, Homo sapiens
ctccaagtctcagtggc

SEQ ID NO: 4896202 - DNA, 22 bp, Homo sapiens
ctccaatcccaccaaccctcag

SEQ ID NO: 4896203 - DNA, 13 bp, Homo sapiens
ctccacagcgagg

SEQ ID NO: 4896204 - DNA, 23 bp, Homo sapiens
ctccaccagcatcacctgcctgt

SEQ ID NO: 4896205 - DNA, 11 bp, Homo sapiens
ctccaccctgc

SEQ ID NO: 4896206 - DNA, 15 bp, Homo sapiens
ctccaccctgctctc

SEQ ID NO: 4896207 - DNA, 13 bp, Homo sapiens
ctccacccttggc

SEQ ID NO: 4896208 - DNA, 14 bp, Homo sapiens
ctccacccttggcc

SEQ ID NO: 4896209 - DNA, 17 bp, Homo sapiens
ctccacccttggcctgt

SEQ ID NO: 4896210 - DNA, 11 bp, Homo sapiens
ctccactgcct

SEQ ID NO: 4896211 - DNA, 13 bp, Homo sapiens
ctccactgccttc

SEQ ID NO: 4896212 - DNA, 14 bp, Homo sapiens
ctccactgccttcg

SEQ ID NO: 4896213 - DNA, 13 bp, Homo sapiens
ctccactggatgg

SEQ ID NO: 4896214 - DNA, 14 bp, Homo sapiens
ctccactggatgga

SEQ ID NO: 4896215 - DNA, 16 bp, Homo sapiens
ctccactggatggagg

SEQ ID NO: 4896216 - DNA, 23 bp, Homo sapiens
ctccactgtgcctttgcaaatca

SEQ ID NO: 4896217 - DNA, 22 bp, Homo sapiens
ctccagaaatgtctaaatgctg

SEQ ID NO: 4896218 - DNA, 14 bp, Homo sapiens
ctccagaagcctct

SEQ ID NO: 4896219 - DNA, 17 bp, Homo sapiens
ctccagaagcctctggc

SEQ ID NO: 4896220 - DNA, 19 bp, Homo sapiens
ctccagaagcctctggcta

SEQ ID NO: 4896221 - DNA, 18 bp, Homo sapiens
ctccagaatttggaaatc

SEQ ID NO: 4896222 - DNA, 19 bp, Homo sapiens
ctccagaatttggaaatcc

SEQ ID NO: 4896223 - DNA, 20 bp, Homo sapiens
ctccagaatttggaaatcct

SEQ ID NO: 4896224 - DNA, 22 bp, Homo sapiens
ctccagaatttggaaatcctag

SEQ ID NO: 4896225 - DNA, 14 bp, Homo sapiens
ctccagacccctgg

SEQ ID NO: 4896226 - DNA, 17 bp, Homo sapiens
ctccagacccctggctt

SEQ ID NO: 4896227 - DNA, 18 bp, Homo sapiens
ctccagacccctggcttt

SEQ ID NO: 4896228 - DNA, 19 bp, Homo sapiens
ctccagacccctggctttt

SEQ ID NO: 4896229 - DNA, 19 bp, Homo sapiens
ctccagagcaacgaccagg

SEQ ID NO: 4896230 - DNA, 17 bp, Homo sapiens
ctccagatgtttccaga

SEQ ID NO: 4896231 - DNA, 16 bp, Homo sapiens
ctccagatttttaata

SEQ ID NO: 4896232 - DNA, 17 bp, Homo sapiens
ctccagcaacacagcct

SEQ ID NO: 4896233 - DNA, 21 bp, Homo sapiens
ctccagcaacttcttctccat

SEQ ID NO: 4896234 - DNA, 15 bp, Homo sapiens
ctccagcccgggagc

SEQ ID NO: 4896235 - DNA, 21 bp, Homo sapiens
ctccagcccgggagcctagga

SEQ ID NO: 4896236 - DNA, 21 bp, Homo sapiens
ctccagcctgcccaagcccag

SEQ ID NO: 4896237 - DNA, 16 bp, Homo sapiens
ctccagctcaccagcc

SEQ ID NO: 4896238 - DNA, 19 bp, Homo sapiens
ctccagctcaccagcccca

SEQ ID NO: 4896239 - DNA, 16 bp, Homo sapiens
ctccagctcagaaccc

SEQ ID NO: 4896240 - DNA, 22 bp, Homo sapiens
ctccagctcagaacccagggct

SEQ ID NO: 4896241 - DNA, 14 bp, Homo sapiens
ctccagctgcacca

SEQ ID NO: 4896242 - DNA, 17 bp, Homo sapiens
ctccaggcaccatctcc

SEQ ID NO: 4896243 - DNA, 17 bp, Homo sapiens
ctccaggcctgcagcag

SEQ ID NO: 4896244 - DNA, 11 bp, Homo sapiens
ctccaggctcc

SEQ ID NO: 4896245 - DNA, 23 bp, Homo sapiens
ctccaggctcctttagcgcccag

SEQ ID NO: 4896246 - DNA, 23 bp, Homo sapiens
ctccaggctgtatcccatgagcc

SEQ ID NO: 4896247 - DNA, 19 bp, Homo sapiens
ctccagggaatccaagcct

SEQ ID NO: 4896248 - DNA, 22 bp, Homo sapiens
ctccagggagcctagaagctgg

SEQ ID NO: 4896249 - DNA, 18 bp, Homo sapiens
ctccaggtctcacgggca

SEQ ID NO: 4896250 - DNA, 18 bp, Homo sapiens
ctccagtccccctatcct

SEQ ID NO: 4896251 - DNA, 23 bp, Homo sapiens
ctccagtccccctatccttggca

SEQ ID NO: 4896252 - DNA, 14 bp, Homo sapiens
ctccagtgtacata

SEQ ID NO: 4896253 - DNA, 15 bp, Homo sapiens
ctccatcaccctctt

SEQ ID NO: 4896254 - DNA, 12 bp, Homo sapiens
ctccatccctct

SEQ ID NO: 4896255 - DNA, 23 bp, Homo sapiens
ctccatctcatgtatcatctgga

SEQ ID NO: 4896256 - DNA, 14 bp, Homo sapiens
ctccatctccactc

SEQ ID NO: 4896257 - DNA, 18 bp, Homo sapiens
ctccatgctcctcactgc

SEQ ID NO: 4896258 - DNA, 19 bp, Homo sapiens
ctccatgctcctcactgcc

SEQ ID NO: 4896259 - DNA, 14 bp, Homo sapiens
ctccatgtgggcta

SEQ ID NO: 4896260 - DNA, 14 bp, Homo sapiens
ctccattaaagtct

SEQ ID NO: 4896261 - DNA, 20 bp, Homo sapiens
ctccattaaagtctgaatca

SEQ ID NO: 4896262 - DNA, 17 bp, Homo sapiens
ctcccaaggagaacaaa

SEQ ID NO: 4896263 - DNA, 18 bp, Homo sapiens
ctcccaaggagaacaaat

SEQ ID NO: 4896264 - DNA, 23 bp, Homo sapiens
ctcccacccccttctctgctcca

SEQ ID NO: 4896265 - DNA, 18 bp, Homo sapiens
ctcccaccctgtacctca

SEQ ID NO: 4896266 - DNA, 12 bp, Homo sapiens
ctcccacctcag

SEQ ID NO: 4896267 - DNA, 13 bp, Homo sapiens
ctcccacctcagc

SEQ ID NO: 4896268 - DNA, 15 bp, Homo sapiens
ctcccacctccagtc

SEQ ID NO: 4896269 - DNA, 12 bp, Homo sapiens
ctcccacctctg

SEQ ID NO: 4896270 - DNA, 18 bp, Homo sapiens
ctcccacctctgtgacct

SEQ ID NO: 4896271 - DNA, 20 bp, Homo sapiens
ctcccacctctgtgacctca

SEQ ID NO: 4896272 - DNA, 14 bp, Homo sapiens
ctcccacgtgggag

SEQ ID NO: 4896273 - DNA, 15 bp, Homo sapiens
ctcccacgtgggaga

SEQ ID NO: 4896274 - DNA, 16 bp, Homo sapiens
ctcccagaatcccagc

SEQ ID NO: 4896275 - DNA, 17 bp, Homo sapiens
ctcccagaatcccagcc

SEQ ID NO: 4896276 - DNA, 19 bp, Homo sapiens
ctcccagaatcccagccgg

SEQ ID NO: 4896277 - DNA, 15 bp, Homo sapiens
ctcccagaggtccag

SEQ ID NO: 4896278 - DNA, 16 bp, Homo sapiens
ctcccagaggtccagc

SEQ ID NO: 4896279 - DNA, 17 bp, Homo sapiens
ctcccagaggtccagcc

SEQ ID NO: 4896280 - DNA, 18 bp, Homo sapiens
ctcccagaggtccagccc

SEQ ID NO: 4896281 - DNA, 11 bp, Homo sapiens
ctcccagcctg

SEQ ID NO: 4896282 - DNA, 18 bp, Homo sapiens
ctcccagcttgtaggagc

SEQ ID NO: 4896283 - DNA, 14 bp, Homo sapiens
ctcccaggcgcccc

SEQ ID NO: 4896284 - DNA, 19 bp, Homo sapiens
ctcccaggcgccccttccc

SEQ ID NO: 4896285 - DNA, 21 bp, Homo sapiens
ctcccaggtgttaacattcca

SEQ ID NO: 4896286 - DNA, 22 bp, Homo sapiens
ctcccaggtgttaacattccaa

SEQ ID NO: 4896287 - DNA, 11 bp, Homo sapiens
ctcccagtccc

SEQ ID NO: 4896288 - DNA, 17 bp, Homo sapiens
ctcccagttatgaatca

SEQ ID NO: 4896289 - DNA, 23 bp, Homo sapiens
ctcccatcccctggactgggagg

SEQ ID NO: 4896290 - DNA, 15 bp, Homo sapiens
ctcccatgaagcctt

SEQ ID NO: 4896291 - DNA, 19 bp, Homo sapiens
ctcccatgaagccttttga

SEQ ID NO: 4896292 - DNA, 22 bp, Homo sapiens
ctcccatgaagccttttgaaag

SEQ ID NO: 4896293 - DNA, 14 bp, Homo sapiens
ctcccatttcctga

SEQ ID NO: 4896294 - DNA, 22 bp, Homo sapiens
ctccccaacccccattctcatc

SEQ ID NO: 4896295 - DNA, 12 bp, Homo sapiens
ctccccacgccc

SEQ ID NO: 4896296 - DNA, 23 bp, Homo sapiens
ctccccacggggcctcgggacct

SEQ ID NO: 4896297 - DNA, 14 bp, Homo sapiens
ctccccagaattca

SEQ ID NO: 4896298 - DNA, 20 bp, Homo sapiens
ctccccagcaagtgagagct

SEQ ID NO: 4896299 - DNA, 23 bp, Homo sapiens
ctccccagcaagtgagagctggg

SEQ ID NO: 4896300 - DNA, 15 bp, Homo sapiens
ctccccagcccctag

SEQ ID NO: 4896301 - DNA, 17 bp, Homo sapiens
ctccccagcccctagcc

SEQ ID NO: 4896302 - DNA, 15 bp, Homo sapiens
ctccccagccctggc

SEQ ID NO: 4896303 - DNA, 22 bp, Homo sapiens
ctccccagtctctcttaaagtt

SEQ ID NO: 4896304 - DNA, 23 bp, Homo sapiens
ctcccccaacccccaccccacac

SEQ ID NO: 4896305 - DNA, 16 bp, Homo sapiens
ctcccccatctcccac

SEQ ID NO: 4896306 - DNA, 12 bp, Homo sapiens
ctcccccgccac

SEQ ID NO: 4896307 - DNA, 15 bp, Homo sapiens
ctcccccgccactcc

SEQ ID NO: 4896308 - DNA, 15 bp, Homo sapiens
ctcccccggctctac

SEQ ID NO: 4896309 - DNA, 21 bp, Homo sapiens
ctccccctaaacccctgtccc

SEQ ID NO: 4896310 - DNA, 16 bp, Homo sapiens
ctccccgctaaggaag

SEQ ID NO: 4896311 - DNA, 15 bp, Homo sapiens
ctcccctcccctgct

SEQ ID NO: 4896312 - DNA, 13 bp, Homo sapiens
ctcccctgccctg

SEQ ID NO: 4896313 - DNA, 14 bp, Homo sapiens
ctcccctgccctgg

SEQ ID NO: 4896314 - DNA, 16 bp, Homo sapiens
ctcccgaatagctggg

SEQ ID NO: 4896315 - DNA, 17 bp, Homo sapiens
ctcccgaatagctggga

SEQ ID NO: 4896316 - DNA, 18 bp, Homo sapiens
ctcccgaatagctgggac

SEQ ID NO: 4896317 - DNA, 17 bp, Homo sapiens
ctcccgagtagctggga

SEQ ID NO: 4896318 - DNA, 19 bp, Homo sapiens
ctcccgagtagctgggact

SEQ ID NO: 4896319 - DNA, 21 bp, Homo sapiens
ctcccgccagactgttagaaa

SEQ ID NO: 4896320 - DNA, 16 bp, Homo sapiens
ctcccgctgctgctgc

SEQ ID NO: 4896321 - DNA, 15 bp, Homo sapiens
ctcccggtgcccaag

SEQ ID NO: 4896322 - DNA, 14 bp, Homo sapiens
ctccctaaactgta

SEQ ID NO: 4896323 - DNA, 14 bp, Homo sapiens
ctccctcagtgccc

SEQ ID NO: 4896324 - DNA, 18 bp, Homo sapiens
ctccctcccctgccctgg

SEQ ID NO: 4896325 - DNA, 15 bp, Homo sapiens
ctccctcctcacctc

SEQ ID NO: 4896326 - DNA, 17 bp, Homo sapiens
ctccctcctcacctctg

SEQ ID NO: 4896327 - DNA, 17 bp, Homo sapiens
ctccctctcaggatcca

SEQ ID NO: 4896328 - DNA, 15 bp, Homo sapiens
ctccctctccctgtc

SEQ ID NO: 4896329 - DNA, 17 bp, Homo sapiens
ctccctctctcttctgc

SEQ ID NO: 4896330 - DNA, 22 bp, Homo sapiens
ctccctctctcttctgctccac

SEQ ID NO: 4896331 - DNA, 14 bp, Homo sapiens
ctccctgaagccag

SEQ ID NO: 4896332 - DNA, 16 bp, Homo sapiens
ctccctgaagccagcc

SEQ ID NO: 4896333 - DNA, 18 bp, Homo sapiens
ctccctgaagccagcctt

SEQ ID NO: 4896334 - DNA, 19 bp, Homo sapiens
ctccctgaagccagccttc

SEQ ID NO: 4896335 - DNA, 15 bp, Homo sapiens
ctccctgcagatgcc

SEQ ID NO: 4896336 - DNA, 16 bp, Homo sapiens
ctccctgcagatgcca

SEQ ID NO: 4896337 - DNA, 13 bp, Homo sapiens
ctccctgcccctc

SEQ ID NO: 4896338 - DNA, 14 bp, Homo sapiens
ctccctgcccctcc

SEQ ID NO: 4896339 - DNA, 21 bp, Homo sapiens
ctccctgcccctcccttcaac

SEQ ID NO: 4896340 - DNA, 11 bp, Homo sapiens
ctccctggagt

SEQ ID NO: 4896341 - DNA, 14 bp, Homo sapiens
ctccctggctccca

SEQ ID NO: 4896342 - DNA, 20 bp, Homo sapiens
ctcccttcaaccattcccca

SEQ ID NO: 4896343 - DNA, 22 bp, Homo sapiens
ctcccttccgaccctctgggaa

SEQ ID NO: 4896344 - DNA, 23 bp, Homo sapiens
ctcccttccgaccctctgggaac

SEQ ID NO: 4896345 - DNA, 17 bp, Homo sapiens
ctccgcccccagcctat

SEQ ID NO: 4896346 - DNA, 13 bp, Homo sapiens
ctccgctgctcct

SEQ ID NO: 4896347 - DNA, 16 bp, Homo sapiens
ctccgctgctccttgg

SEQ ID NO: 4896348 - DNA, 20 bp, Homo sapiens
ctccgctttctacccagcga

SEQ ID NO: 4896349 - DNA, 15 bp, Homo sapiens
ctccgtccagccgcc

SEQ ID NO: 4896350 - DNA, 20 bp, Homo sapiens
ctccgtccaggagcctgtgc

SEQ ID NO: 4896351 - DNA, 22 bp, Homo sapiens
ctccgtttattataaactgtat

SEQ ID NO: 4896352 - DNA, 20 bp, Homo sapiens
ctcctacctgccctggaaca

SEQ ID NO: 4896353 - DNA, 14 bp, Homo sapiens
ctcctactcctgac

SEQ ID NO: 4896354 - DNA, 15 bp, Homo sapiens
ctcctagagaacgca

SEQ ID NO: 4896355 - DNA, 20 bp, Homo sapiens
ctcctagagaacgcagccct

SEQ ID NO: 4896356 - DNA, 19 bp, Homo sapiens
ctcctagtttgacctcaca

SEQ ID NO: 4896357 - DNA, 14 bp, Homo sapiens
ctcctataatctgt

SEQ ID NO: 4896358 - DNA, 16 bp, Homo sapiens
ctcctataatctgtca

SEQ ID NO: 4896359 - DNA, 21 bp, Homo sapiens
ctcctataatctgtcaaaaca

SEQ ID NO: 4896360 - DNA, 22 bp, Homo sapiens
ctcctataatctgtcaaaacac

SEQ ID NO: 4896361 - DNA, 23 bp, Homo sapiens
ctcctataatctgtcaaaacact

SEQ ID NO: 4896362 - DNA, 17 bp, Homo sapiens
ctcctcacacaccctga

SEQ ID NO: 4896363 - DNA, 15 bp, Homo sapiens
ctcctcacccccagc

SEQ ID NO: 4896364 - DNA, 13 bp, Homo sapiens
ctcctcacctctg

SEQ ID NO: 4896365 - DNA, 15 bp, Homo sapiens
ctcctcacctctgga

SEQ ID NO: 4896366 - DNA, 16 bp, Homo sapiens
ctcctcacctctggac

SEQ ID NO: 4896367 - DNA, 21 bp, Homo sapiens
ctcctcacctctggactggct

SEQ ID NO: 4896368 - DNA, 18 bp, Homo sapiens
ctcctcagggcagcctcc

SEQ ID NO: 4896369 - DNA, 14 bp, Homo sapiens
ctcctcccagcttg

SEQ ID NO: 4896370 - DNA, 22 bp, Homo sapiens
ctcctcccaggcgccccttccc

SEQ ID NO: 4896371 - DNA, 23 bp, Homo sapiens
ctcctcccaggcgccccttcccc

SEQ ID NO: 4896372 - DNA, 15 bp, Homo sapiens
ctcctcccggtgccc

SEQ ID NO: 4896373 - DNA, 18 bp, Homo sapiens
ctcctccctttccttcct

SEQ ID NO: 4896374 - DNA, 22 bp, Homo sapiens
ctcctccgaggtggttttaaag

SEQ ID NO: 4896375 - DNA, 13 bp, Homo sapiens
ctcctcctcggaa

SEQ ID NO: 4896376 - DNA, 12 bp, Homo sapiens
ctcctcctcttt

SEQ ID NO: 4896377 - DNA, 17 bp, Homo sapiens
ctcctcctctttctctc

SEQ ID NO: 4896378 - DNA, 13 bp, Homo sapiens
ctcctcgttcctt

SEQ ID NO: 4896379 - DNA, 19 bp, Homo sapiens
ctcctctagctgtgggggt

SEQ ID NO: 4896380 - DNA, 16 bp, Homo sapiens
ctcctctcctggagga

SEQ ID NO: 4896381 - DNA, 16 bp, Homo sapiens
ctcctctgtctgccct

SEQ ID NO: 4896382 - DNA, 23 bp, Homo sapiens
ctcctcttcaactgaccagcctc

SEQ ID NO: 4896383 - DNA, 18 bp, Homo sapiens
ctcctcttgccactgcct

SEQ ID NO: 4896384 - DNA, 13 bp, Homo sapiens
ctcctctttaaaa

SEQ ID NO: 4896385 - DNA, 16 bp, Homo sapiens
ctcctctttaaaacaa

SEQ ID NO: 4896386 - DNA, 13 bp, Homo sapiens
ctcctctttctct

SEQ ID NO: 4896387 - DNA, 15 bp, Homo sapiens
ctcctctttctctcc

SEQ ID NO: 4896388 - DNA, 19 bp, Homo sapiens
ctcctgaaccgcacagctc

SEQ ID NO: 4896389 - DNA, 16 bp, Homo sapiens
ctcctgacagaaggtg

SEQ ID NO: 4896390 - DNA, 19 bp, Homo sapiens
ctcctgacagaaggtgcca

SEQ ID NO: 4896391 - DNA, 15 bp, Homo sapiens
ctcctgactgtaaca

SEQ ID NO: 4896392 - DNA, 16 bp, Homo sapiens
ctcctgagaaatgtta

SEQ ID NO: 4896393 - DNA, 19 bp, Homo sapiens
ctcctgagggaggacctgg

SEQ ID NO: 4896394 - DNA, 20 bp, Homo sapiens
ctcctgagggaggacctggg

SEQ ID NO: 4896395 - DNA, 16 bp, Homo sapiens
ctcctgaggggcatct

SEQ ID NO: 4896396 - DNA, 23 bp, Homo sapiens
ctcctgaggggcatctgcccctc

SEQ ID NO: 4896397 - DNA, 23 bp, Homo sapiens
ctcctgataaaacaacagctcga

SEQ ID NO: 4896398 - DNA, 13 bp, Homo sapiens
ctcctgcctcagc

SEQ ID NO: 4896399 - DNA, 16 bp, Homo sapiens
ctcctgcctcagcctc

SEQ ID NO: 4896400 - DNA, 17 bp, Homo sapiens
ctcctgcctgcccctct

SEQ ID NO: 4896401 - DNA, 15 bp, Homo sapiens
ctcctgcctgtagca

SEQ ID NO: 4896402 - DNA, 16 bp, Homo sapiens
ctcctgcctgtagcag

SEQ ID NO: 4896403 - DNA, 22 bp, Homo sapiens
ctcctggaacagaagacagctg

SEQ ID NO: 4896404 - DNA, 17 bp, Homo sapiens
ctcctggaaccttgctg

SEQ ID NO: 4896405 - DNA, 22 bp, Homo sapiens
ctcctggaaccttgctgtcctg

SEQ ID NO: 4896406 - DNA, 18 bp, Homo sapiens
ctcctgggctaagtgatc

SEQ ID NO: 4896407 - DNA, 22 bp, Homo sapiens
ctcctgggggttctttcttcct

SEQ ID NO: 4896408 - DNA, 23 bp, Homo sapiens
ctcctgtaacatactggcctgga

SEQ ID NO: 4896409 - DNA, 16 bp, Homo sapiens
ctcctgtggaacccag

SEQ ID NO: 4896410 - DNA, 18 bp, Homo sapiens
ctcctgtggaacccagca

SEQ ID NO: 4896411 - DNA, 20 bp, Homo sapiens
ctcctgtggaacccagcagt

SEQ ID NO: 4896412 - DNA, 15 bp, Homo sapiens
ctcctgtgtactgtg

SEQ ID NO: 4896413 - DNA, 23 bp, Homo sapiens
ctcctgtgtcttgcaatggcagc

SEQ ID NO: 4896414 - DNA, 20 bp, Homo sapiens
ctcctgtgtgtgcgcctaca

SEQ ID NO: 4896415 - DNA, 21 bp, Homo sapiens
ctcctgtgtgtgcgcctacag

SEQ ID NO: 4896416 - DNA, 23 bp, Homo sapiens
ctcctgtgtgtgcgcctacagga

SEQ ID NO: 4896417 - DNA, 19 bp, Homo sapiens
ctccttcgcaggcatgtcc

SEQ ID NO: 4896418 - DNA, 13 bp, Homo sapiens
ctccttctccctt

SEQ ID NO: 4896419 - DNA, 10 bp, Homo sapiens
ctccttggcc

SEQ ID NO: 4896420 - DNA, 11 bp, Homo sapiens
ctccttggcct

SEQ ID NO: 4896421 - DNA, 16 bp, Homo sapiens
ctccttggcttacctg

SEQ ID NO: 4896422 - DNA, 21 bp, Homo sapiens
ctccttggcttacctgacctc

SEQ ID NO: 4896423 - DNA, 22 bp, Homo sapiens
ctcctttacaaaagaaatacct

SEQ ID NO: 4896424 - DNA, 16 bp, Homo sapiens
ctcctttagcgcccag

SEQ ID NO: 4896425 - DNA, 17 bp, Homo sapiens
ctcctttagcgcccagt

SEQ ID NO: 4896426 - DNA, 22 bp, Homo sapiens
ctcctttagcgcccagttgggt

SEQ ID NO: 4896427 - DNA, 17 bp, Homo sapiens
ctcctttcacaaccttc

SEQ ID NO: 4896428 - DNA, 14 bp, Homo sapiens
ctcctttctcctcc

SEQ ID NO: 4896429 - DNA, 16 bp, Homo sapiens
ctccttttcttttgtt

SEQ ID NO: 4896430 - DNA, 15 bp, Homo sapiens
ctcgaaacacagaaa

SEQ ID NO: 4896431 - DNA, 13 bp, Homo sapiens
ctcgaactggctg

SEQ ID NO: 4896432 - DNA, 14 bp, Homo sapiens
ctcgaactggctgc

SEQ ID NO: 4896433 - DNA, 17 bp, Homo sapiens
ctcgagcagtcctgcct

SEQ ID NO: 4896434 - DNA, 18 bp, Homo sapiens
ctcgagggcagggaccac

SEQ ID NO: 4896435 - DNA, 14 bp, Homo sapiens
ctcgatccaaattg

SEQ ID NO: 4896436 - DNA, 15 bp, Homo sapiens
ctcgccctcctttct

SEQ ID NO: 4896437 - DNA, 18 bp, Homo sapiens
ctcgctgcacaaatactc

SEQ ID NO: 4896438 - DNA, 18 bp, Homo sapiens
ctcgcttcccccatagcc

SEQ ID NO: 4896439 - DNA, 12 bp, Homo sapiens
ctcgcttgtaaa

SEQ ID NO: 4896440 - DNA, 17 bp, Homo sapiens
ctcgctttgttgcccag

SEQ ID NO: 4896441 - DNA, 18 bp, Homo sapiens
ctcggaaccgctcaccta

SEQ ID NO: 4896442 - DNA, 23 bp, Homo sapiens
ctcggaaccgctcacctagagcc

SEQ ID NO: 4896443 - DNA, 18 bp, Homo sapiens
ctcggactaagcctacct

SEQ ID NO: 4896444 - DNA, 18 bp, Homo sapiens
ctcggagcatcccggagg

SEQ ID NO: 4896445 - DNA, 22 bp, Homo sapiens
ctcggagcatcccggaggaaat

SEQ ID NO: 4896446 - DNA, 12 bp, Homo sapiens
ctcggaggctgc

SEQ ID NO: 4896447 - DNA, 21 bp, Homo sapiens
ctcggagtgtgtatgccaaga

SEQ ID NO: 4896448 - DNA, 20 bp, Homo sapiens
ctcggcctcccaaagtgctg

SEQ ID NO: 4896449 - DNA, 20 bp, Homo sapiens
ctcgtgagtcatttaaatgt

SEQ ID NO: 4896450 - DNA, 17 bp, Homo sapiens
ctcgttcctttctcctg

SEQ ID NO: 4896451 - DNA, 18 bp, Homo sapiens
ctcgttggaagaggaaca

SEQ ID NO: 4896452 - DNA, 23 bp, Homo sapiens
ctctaaaagcgttggatgtagca

SEQ ID NO: 4896453 - DNA, 15 bp, Homo sapiens
ctctaaagaccaaac

SEQ ID NO: 4896454 - DNA, 21 bp, Homo sapiens
ctctaacttattttatttcca

SEQ ID NO: 4896455 - DNA, 22 bp, Homo sapiens
ctctaagatcttagattctctg

SEQ ID NO: 4896456 - DNA, 14 bp, Homo sapiens
ctctaaggttgggc

SEQ ID NO: 4896457 - DNA, 14 bp, Homo sapiens
ctctacagaggcca

SEQ ID NO: 4896458 - DNA, 14 bp, Homo sapiens
ctctacccaaaccc

SEQ ID NO: 4896459 - DNA, 18 bp, Homo sapiens
ctctacccaaaccctagg

SEQ ID NO: 4896460 - DNA, 15 bp, Homo sapiens
ctctaccctcccacc

SEQ ID NO: 4896461 - DNA, 16 bp, Homo sapiens
ctctaccctcccaccc

SEQ ID NO: 4896462 - DNA, 20 bp, Homo sapiens
ctctacttagcatgtcccta

SEQ ID NO: 4896463 - DNA, 18 bp, Homo sapiens
ctctactttccaggctag

SEQ ID NO: 4896464 - DNA, 13 bp, Homo sapiens
ctctagagtccaa

SEQ ID NO: 4896465 - DNA, 14 bp, Homo sapiens
ctctagatcataag

SEQ ID NO: 4896466 - DNA, 12 bp, Homo sapiens
ctctagattcca

SEQ ID NO: 4896467 - DNA, 16 bp, Homo sapiens
ctctagctgtgggggt

SEQ ID NO: 4896468 - DNA, 12 bp, Homo sapiens
ctctagggtcca

SEQ ID NO: 4896469 - DNA, 15 bp, Homo sapiens
ctctatacatctctc

SEQ ID NO: 4896470 - DNA, 16 bp, Homo sapiens
ctctatctgggcctgg

SEQ ID NO: 4896471 - DNA, 17 bp, Homo sapiens
ctctatgagtctagatg

SEQ ID NO: 4896472 - DNA, 19 bp, Homo sapiens
ctctatgagtctagatgtt

SEQ ID NO: 4896473 - DNA, 17 bp, Homo sapiens
ctctatgccagctcagt

SEQ ID NO: 4896474 - DNA, 16 bp, Homo sapiens
ctctatgccccaaata

SEQ ID NO: 4896475 - DNA, 19 bp, Homo sapiens
ctctatgccccaaatatag

SEQ ID NO: 4896476 - DNA, 21 bp, Homo sapiens
ctctattctcaaagtttccta

SEQ ID NO: 4896477 - DNA, 13 bp, Homo sapiens
ctctatttaatat

SEQ ID NO: 4896478 - DNA, 16 bp, Homo sapiens
ctctatttaatattta

SEQ ID NO: 4896479 - DNA, 17 bp, Homo sapiens
ctctatttatgtttgca

SEQ ID NO: 4896480 - DNA, 15 bp, Homo sapiens
ctctatttcattttt

SEQ ID NO: 4896481 - DNA, 21 bp, Homo sapiens
ctctcactaaactttacccaa

SEQ ID NO: 4896482 - DNA, 14 bp, Homo sapiens
ctctcactccccat

SEQ ID NO: 4896483 - DNA, 18 bp, Homo sapiens
ctctcagcccagaagaaa

SEQ ID NO: 4896484 - DNA, 17 bp, Homo sapiens
ctctcagccttacattt

SEQ ID NO: 4896485 - DNA, 17 bp, Homo sapiens
ctctcagctcagcgcca

SEQ ID NO: 4896486 - DNA, 20 bp, Homo sapiens
ctctccaagtctcagtggct

SEQ ID NO: 4896487 - DNA, 14 bp, Homo sapiens
ctctccaggcacca

SEQ ID NO: 4896488 - DNA, 13 bp, Homo sapiens
ctctccccacact

SEQ ID NO: 4896489 - DNA, 17 bp, Homo sapiens
ctctccccacccctacc

SEQ ID NO: 4896490 - DNA, 22 bp, Homo sapiens
ctctccccagcaagtgagagct

SEQ ID NO: 4896491 - DNA, 16 bp, Homo sapiens
ctctcccctccagcct

SEQ ID NO: 4896492 - DNA, 17 bp, Homo sapiens
ctctcccctccagcctt

SEQ ID NO: 4896493 - DNA, 16 bp, Homo sapiens
ctctcccctgccctgc

SEQ ID NO: 4896494 - DNA, 23 bp, Homo sapiens
ctctcccggaggttgggtgggcc

SEQ ID NO: 4896495 - DNA, 16 bp, Homo sapiens
ctctccctgccagagg

SEQ ID NO: 4896496 - DNA, 13 bp, Homo sapiens
ctctcccttaccc

SEQ ID NO: 4896497 - DNA, 21 bp, Homo sapiens
ctctccgtttattataaactg

SEQ ID NO: 4896498 - DNA, 21 bp, Homo sapiens
ctctcctgatagtctttcagt

SEQ ID NO: 4896499 - DNA, 12 bp, Homo sapiens
ctctcctggagg

SEQ ID NO: 4896500 - DNA, 13 bp, Homo sapiens
ctctcctggagga

SEQ ID NO: 4896501 - DNA, 19 bp, Homo sapiens
ctctcctgtaagccaaaga

SEQ ID NO: 4896502 - DNA, 17 bp, Homo sapiens
ctctccttccttaccca

SEQ ID NO: 4896503 - DNA, 13 bp, Homo sapiens
ctctcctttgaaa

SEQ ID NO: 4896504 - DNA, 21 bp, Homo sapiens
ctctcctttgaaacctgctct

SEQ ID NO: 4896505 - DNA, 18 bp, Homo sapiens
ctctccttttcttttgtt

SEQ ID NO: 4896506 - DNA, 17 bp, Homo sapiens
ctctcgcacctttccaa

SEQ ID NO: 4896507 - DNA, 19 bp, Homo sapiens
ctctcgcacctttccaaag

SEQ ID NO: 4896508 - DNA, 14 bp, Homo sapiens
ctctcggctcccca

SEQ ID NO: 4896509 - DNA, 17 bp, Homo sapiens
ctctcggctccccatgt

SEQ ID NO: 4896510 - DNA, 19 bp, Homo sapiens
ctctctacaaactcccact

SEQ ID NO: 4896511 - DNA, 13 bp, Homo sapiens
ctctctacagtgc

SEQ ID NO: 4896512 - DNA, 14 bp, Homo sapiens
ctctctcaaaagag

SEQ ID NO: 4896513 - DNA, 17 bp, Homo sapiens
ctctctccagatgtttc

SEQ ID NO: 4896514 - DNA, 16 bp, Homo sapiens
ctctctgcagctgccg

SEQ ID NO: 4896515 - DNA, 16 bp, Homo sapiens
ctctctgtataaacat

SEQ ID NO: 4896516 - DNA, 13 bp, Homo sapiens
ctctcttccctca

SEQ ID NO: 4896517 - DNA, 15 bp, Homo sapiens
ctctcttccctttcc

SEQ ID NO: 4896518 - DNA, 20 bp, Homo sapiens
ctctcttccctttccccagc

SEQ ID NO: 4896519 - DNA, 23 bp, Homo sapiens
ctctcttccctttccccagcatc

SEQ ID NO: 4896520 - DNA, 12 bp, Homo sapiens
ctctcttcctgc

SEQ ID NO: 4896521 - DNA, 13 bp, Homo sapiens
ctctcttcctgcc

SEQ ID NO: 4896522 - DNA, 18 bp, Homo sapiens
ctctcttcctgcccctct

SEQ ID NO: 4896523 - DNA, 19 bp, Homo sapiens
ctctcttcctgcccctctt

SEQ ID NO: 4896524 - DNA, 12 bp, Homo sapiens
ctctcttctgct

SEQ ID NO: 4896525 - DNA, 14 bp, Homo sapiens
ctctcttctgctcc

SEQ ID NO: 4896526 - DNA, 16 bp, Homo sapiens
ctctcttctgctccac

SEQ ID NO: 4896527 - DNA, 22 bp, Homo sapiens
ctctcttttctgtacttcctga

SEQ ID NO: 4896528 - DNA, 22 bp, Homo sapiens
ctctgaacacaggcagctttct

SEQ ID NO: 4896529 - DNA, 20 bp, Homo sapiens
ctctgaagcatgtttcatgt

SEQ ID NO: 4896530 - DNA, 15 bp, Homo sapiens
ctctgaagcctctgg

SEQ ID NO: 4896531 - DNA, 15 bp, Homo sapiens
ctctgaaggacattg

SEQ ID NO: 4896532 - DNA, 16 bp, Homo sapiens
ctctgacaagggctga

SEQ ID NO: 4896533 - DNA, 19 bp, Homo sapiens
ctctgacaagggctgacct

SEQ ID NO: 4896534 - DNA, 18 bp, Homo sapiens
ctctgacccctcctcact

SEQ ID NO: 4896535 - DNA, 12 bp, Homo sapiens
ctctgacctgca

SEQ ID NO: 4896536 - DNA, 15 bp, Homo sapiens
ctctgacctgcactg

SEQ ID NO: 4896537 - DNA, 22 bp, Homo sapiens
ctctgacttaagcaaaagaaaa

SEQ ID NO: 4896538 - DNA, 16 bp, Homo sapiens
ctctgagagtctagat

SEQ ID NO: 4896539 - DNA, 17 bp, Homo sapiens
ctctgagagtctagatt

SEQ ID NO: 4896540 - DNA, 18 bp, Homo sapiens
ctctgagagtctagattc

SEQ ID NO: 4896541 - DNA, 16 bp, Homo sapiens
ctctgagcaaatgtgg

SEQ ID NO: 4896542 - DNA, 12 bp, Homo sapiens
ctctgaggacac

SEQ ID NO: 4896543 - DNA, 16 bp, Homo sapiens
ctctgaggacactaac

SEQ ID NO: 4896544 - DNA, 19 bp, Homo sapiens
ctctgaggtgcctgtccca

SEQ ID NO: 4896545 - DNA, 23 bp, Homo sapiens
ctctgataaaagggcaaatctgc

SEQ ID NO: 4896546 - DNA, 17 bp, Homo sapiens
ctctgatatgggactga

SEQ ID NO: 4896547 - DNA, 21 bp, Homo sapiens
ctctgatatgggactgagcct

SEQ ID NO: 4896548 - DNA, 15 bp, Homo sapiens
ctctgattttcaaag

SEQ ID NO: 4896549 - DNA, 20 bp, Homo sapiens
ctctgattttcaaagctttt

SEQ ID NO: 4896550 - DNA, 22 bp, Homo sapiens
ctctgattttcaaagctttttc

SEQ ID NO: 4896551 - DNA, 18 bp, Homo sapiens
ctctgcaaaaggagagac

SEQ ID NO: 4896552 - DNA, 18 bp, Homo sapiens
ctctgcagactgctagtg

SEQ ID NO: 4896553 - DNA, 13 bp, Homo sapiens
ctctgcagctgcc

SEQ ID NO: 4896554 - DNA, 18 bp, Homo sapiens
ctctgcatcccagcacct

SEQ ID NO: 4896555 - DNA, 19 bp, Homo sapiens
ctctgcatcccagcacctg

SEQ ID NO: 4896556 - DNA, 15 bp, Homo sapiens
ctctgccacactctg

SEQ ID NO: 4896557 - DNA, 22 bp, Homo sapiens
ctctgccagaagatcccctcag

SEQ ID NO: 4896558 - DNA, 15 bp, Homo sapiens
ctctgccagcaaaga

SEQ ID NO: 4896559 - DNA, 16 bp, Homo sapiens
ctctgccagcaaagag

SEQ ID NO: 4896560 - DNA, 13 bp, Homo sapiens
ctctgccagggca

SEQ ID NO: 4896561 - DNA, 22 bp, Homo sapiens
ctctgccagggcagtgctagtg

SEQ ID NO: 4896562 - DNA, 14 bp, Homo sapiens
ctctgcctcctctt

SEQ ID NO: 4896563 - DNA, 14 bp, Homo sapiens
ctctgcctctgaca

SEQ ID NO: 4896564 - DNA, 16 bp, Homo sapiens
ctctgcctctgacaca

SEQ ID NO: 4896565 - DNA, 13 bp, Homo sapiens
ctctgctcctctc

SEQ ID NO: 4896566 - DNA, 21 bp, Homo sapiens
ctctgctcgccctcctttctg

SEQ ID NO: 4896567 - DNA, 18 bp, Homo sapiens
ctctgctgacagacacag

SEQ ID NO: 4896568 - DNA, 21 bp, Homo sapiens
ctctgctgacagacacaggcc

SEQ ID NO: 4896569 - DNA, 23 bp, Homo sapiens
ctctgctgcctgcccgcacagca

SEQ ID NO: 4896570 - DNA, 21 bp, Homo sapiens
ctctgctgctgtccctccccc

SEQ ID NO: 4896571 - DNA, 13 bp, Homo sapiens
ctctgctgcttag

SEQ ID NO: 4896572 - DNA, 18 bp, Homo sapiens
ctctgctggcccagccaa

SEQ ID NO: 4896573 - DNA, 18 bp, Homo sapiens
ctctgcttctccaaggaa

SEQ ID NO: 4896574 - DNA, 18 bp, Homo sapiens
ctctggaagccctggaga

SEQ ID NO: 4896575 - DNA, 19 bp, Homo sapiens
ctctggaagccctggagac

SEQ ID NO: 4896576 - DNA, 22 bp, Homo sapiens
ctctggacaggcatgttctctg

SEQ ID NO: 4896577 - DNA, 14 bp, Homo sapiens
ctctggactctaaa

SEQ ID NO: 4896578 - DNA, 16 bp, Homo sapiens
ctctggactctaaaga

SEQ ID NO: 4896579 - DNA, 21 bp, Homo sapiens
ctctggactctaaagaccaaa

SEQ ID NO: 4896580 - DNA, 15 bp, Homo sapiens
ctctggagagaaaca

SEQ ID NO: 4896581 - DNA, 20 bp, Homo sapiens
ctctggaggggtgtggctcc

SEQ ID NO: 4896582 - DNA, 18 bp, Homo sapiens
ctctggcattagaattat

SEQ ID NO: 4896583 - DNA, 23 bp, Homo sapiens
ctctggcattagaattatttaaa

SEQ ID NO: 4896584 - DNA, 18 bp, Homo sapiens
ctctggcctcagccgact

SEQ ID NO: 4896585 - DNA, 16 bp, Homo sapiens
ctctggctagaggcca

SEQ ID NO: 4896586 - DNA, 22 bp, Homo sapiens
ctctggctagaggccagcccca

SEQ ID NO: 4896587 - DNA, 21 bp, Homo sapiens
ctctggctgtaaggctctaga

SEQ ID NO: 4896588 - DNA, 18 bp, Homo sapiens
ctctgggaacctcccaga

SEQ ID NO: 4896589 - DNA, 20 bp, Homo sapiens
ctctgggaacctcccagagg

SEQ ID NO: 4896590 - DNA, 18 bp, Homo sapiens
ctctgggctatggacaca

SEQ ID NO: 4896591 - DNA, 21 bp, Homo sapiens
ctctgggctatggacacaggg

SEQ ID NO: 4896592 - DNA, 14 bp, Homo sapiens
ctctggggctctag

SEQ ID NO: 4896593 - DNA, 16 bp, Homo sapiens
ctctggggctctaggg

SEQ ID NO: 4896594 - DNA, 21 bp, Homo sapiens
ctctggggctgttgaagtcac

SEQ ID NO: 4896595 - DNA, 22 bp, Homo sapiens
ctctggggctgttgaagtcacc

SEQ ID NO: 4896596 - DNA, 18 bp, Homo sapiens
ctctggtgcctccagagg

SEQ ID NO: 4896597 - DNA, 16 bp, Homo sapiens
ctctggttcttcattt

SEQ ID NO: 4896598 - DNA, 13 bp, Homo sapiens
ctctgtataaaca

SEQ ID NO: 4896599 - DNA, 13 bp, Homo sapiens
ctctgtatatata

SEQ ID NO: 4896600 - DNA, 17 bp, Homo sapiens
ctctgtccatttatcca

SEQ ID NO: 4896601 - DNA, 21 bp, Homo sapiens
ctctgtccatttatccacagg

SEQ ID NO: 4896602 - DNA, 16 bp, Homo sapiens
ctctgtcctgcttctg

SEQ ID NO: 4896603 - DNA, 17 bp, Homo sapiens
ctctgtcctgcttctga

SEQ ID NO: 4896604 - DNA, 19 bp, Homo sapiens
ctctgtcgcccagtctgga

SEQ ID NO: 4896605 - DNA, 22 bp, Homo sapiens
ctctgtctgcccttcaccccag

SEQ ID NO: 4896606 - DNA, 15 bp, Homo sapiens
ctctgtgccttcttt

SEQ ID NO: 4896607 - DNA, 16 bp, Homo sapiens
ctctgtgccttctttt

SEQ ID NO: 4896608 - DNA, 15 bp, Homo sapiens
ctctgtgctgtggaa

SEQ ID NO: 4896609 - DNA, 18 bp, Homo sapiens
ctctgtgctgtggaagca

SEQ ID NO: 4896610 - DNA, 22 bp, Homo sapiens
ctctgtgcttttaaatgcataa

SEQ ID NO: 4896611 - DNA, 11 bp, Homo sapiens
ctctgtggatg

SEQ ID NO: 4896612 - DNA, 15 bp, Homo sapiens
ctctgtgtcaggtgg

SEQ ID NO: 4896613 - DNA, 20 bp, Homo sapiens
ctctgtgtcaggtggggcag

SEQ ID NO: 4896614 - DNA, 23 bp, Homo sapiens
ctctgtgtcaggtggggcagctt

SEQ ID NO: 4896615 - DNA, 16 bp, Homo sapiens
ctctgtgtccttccct

SEQ ID NO: 4896616 - DNA, 17 bp, Homo sapiens
ctctgtgtccttccctg

SEQ ID NO: 4896617 - DNA, 15 bp, Homo sapiens
ctctgtgtctaagat

SEQ ID NO: 4896618 - DNA, 20 bp, Homo sapiens
ctctgttatgtactgtacta

SEQ ID NO: 4896619 - DNA, 14 bp, Homo sapiens
ctctgttgtaagaa

SEQ ID NO: 4896620 - DNA, 20 bp, Homo sapiens
ctcttaaagctgcctgtagt

SEQ ID NO: 4896621 - DNA, 18 bp, Homo sapiens
ctcttaaagttggaattt

SEQ ID NO: 4896622 - DNA, 17 bp, Homo sapiens
ctcttactaatgtaaaa

SEQ ID NO: 4896623 - DNA, 16 bp, Homo sapiens
ctcttagaaatgaagg

SEQ ID NO: 4896624 - DNA, 22 bp, Homo sapiens
ctcttaggcatgtaggaccctg

SEQ ID NO: 4896625 - DNA, 22 bp, Homo sapiens
ctcttatctcagtcatgcataa

SEQ ID NO: 4896626 - DNA, 23 bp, Homo sapiens
ctcttatctcagtcatgcataaa

SEQ ID NO: 4896627 - DNA, 14 bp, Homo sapiens
ctcttattacaaag

SEQ ID NO: 4896628 - DNA, 13 bp, Homo sapiens
ctcttattgccca

SEQ ID NO: 4896629 - DNA, 19 bp, Homo sapiens
ctcttattgcccacgctgg

SEQ ID NO: 4896630 - DNA, 15 bp, Homo sapiens
ctcttattttacaat

SEQ ID NO: 4896631 - DNA, 16 bp, Homo sapiens
ctcttcaactgaccag

SEQ ID NO: 4896632 - DNA, 17 bp, Homo sapiens
ctcttcaactgaccagc

SEQ ID NO: 4896633 - DNA, 20 bp, Homo sapiens
ctcttcaactgaccagcctc

SEQ ID NO: 4896634 - DNA, 22 bp, Homo sapiens
ctcttcaccccggcaggccctg

SEQ ID NO: 4896635 - DNA, 20 bp, Homo sapiens
ctcttcagactctcagccca

SEQ ID NO: 4896636 - DNA, 16 bp, Homo sapiens
ctcttcaggcctccct

SEQ ID NO: 4896637 - DNA, 19 bp, Homo sapiens
ctcttcaggcctccctctc

SEQ ID NO: 4896638 - DNA, 19 bp, Homo sapiens
ctcttcatactttttttca

SEQ ID NO: 4896639 - DNA, 12 bp, Homo sapiens
ctcttccccaga

SEQ ID NO: 4896640 - DNA, 22 bp, Homo sapiens
ctcttccctgcgcctgtgatgc

SEQ ID NO: 4896641 - DNA, 20 bp, Homo sapiens
ctcttcctgcccctctttct

SEQ ID NO: 4896642 - DNA, 22 bp, Homo sapiens
ctcttcctgcccctctttctct

SEQ ID NO: 4896643 - DNA, 23 bp, Homo sapiens
ctcttcctgcccctctttctctt

SEQ ID NO: 4896644 - DNA, 13 bp, Homo sapiens
ctcttctccactg

SEQ ID NO: 4896645 - DNA, 19 bp, Homo sapiens
ctcttctccactggatgga

SEQ ID NO: 4896646 - DNA, 12 bp, Homo sapiens
ctcttctccagg

SEQ ID NO: 4896647 - DNA, 13 bp, Homo sapiens
ctcttctccaggc

SEQ ID NO: 4896648 - DNA, 15 bp, Homo sapiens
ctcttctccaggctg

SEQ ID NO: 4896649 - DNA, 12 bp, Homo sapiens
ctcttctcccag

SEQ ID NO: 4896650 - DNA, 13 bp, Homo sapiens
ctcttctcccaga

SEQ ID NO: 4896651 - DNA, 14 bp, Homo sapiens
ctcttctcccagaa

SEQ ID NO: 4896652 - DNA, 16 bp, Homo sapiens
ctcttctcccagaatc

SEQ ID NO: 4896653 - DNA, 15 bp, Homo sapiens
ctcttctcctttcac

SEQ ID NO: 4896654 - DNA, 16 bp, Homo sapiens
ctcttctcctttcaca

SEQ ID NO: 4896655 - DNA, 15 bp, Homo sapiens
ctcttctgctccacc

SEQ ID NO: 4896656 - DNA, 14 bp, Homo sapiens
ctcttctggctcaa

SEQ ID NO: 4896657 - DNA, 15 bp, Homo sapiens
ctcttgacctcaggt

SEQ ID NO: 4896658 - DNA, 14 bp, Homo sapiens
ctcttgagctggcc

SEQ ID NO: 4896659 - DNA, 17 bp, Homo sapiens
ctcttgaggccaggagt

SEQ ID NO: 4896660 - DNA, 21 bp, Homo sapiens
ctcttgattatccatattgag

SEQ ID NO: 4896661 - DNA, 20 bp, Homo sapiens
ctcttgccactgcctcttcc

SEQ ID NO: 4896662 - DNA, 14 bp, Homo sapiens
ctcttgctgtctct

SEQ ID NO: 4896663 - DNA, 21 bp, Homo sapiens
ctcttgggttcaagcgattct

SEQ ID NO: 4896664 - DNA, 20 bp, Homo sapiens
ctcttgtataagatcctaga

SEQ ID NO: 4896665 - DNA, 16 bp, Homo sapiens
ctcttgtcccacgtgt

SEQ ID NO: 4896666 - DNA, 18 bp, Homo sapiens
ctcttgtcccacgtgtct

SEQ ID NO: 4896667 - DNA, 17 bp, Homo sapiens
ctcttgttgagttctgt

SEQ ID NO: 4896668 - DNA, 15 bp, Homo sapiens
ctcttgttttgtttg

SEQ ID NO: 4896669 - DNA, 17 bp, Homo sapiens
ctcttgttttgtttgtc

SEQ ID NO: 4896670 - DNA, 14 bp, Homo sapiens
ctctttaaaacaaa

SEQ ID NO: 4896671 - DNA, 15 bp, Homo sapiens
ctctttaaaacaaaa

SEQ ID NO: 4896672 - DNA, 17 bp, Homo sapiens
ctctttaaaacaaaaca

SEQ ID NO: 4896673 - DNA, 21 bp, Homo sapiens
ctctttaagagttagtttctt

SEQ ID NO: 4896674 - DNA, 21 bp, Homo sapiens
ctctttaagggcatgccttgt

SEQ ID NO: 4896675 - DNA, 22 bp, Homo sapiens
ctctttaagggcatgccttgtg

SEQ ID NO: 4896676 - DNA, 22 bp, Homo sapiens
ctctttaatgtcacaggcaggt

SEQ ID NO: 4896677 - DNA, 16 bp, Homo sapiens
ctctttcacattgttt

SEQ ID NO: 4896678 - DNA, 13 bp, Homo sapiens
ctctttctctccc

SEQ ID NO: 4896679 - DNA, 14 bp, Homo sapiens
ctctttctctcccc

SEQ ID NO: 4896680 - DNA, 15 bp, Homo sapiens
ctctttctctcccca

SEQ ID NO: 4896681 - DNA, 13 bp, Homo sapiens
ctctttctctttc

SEQ ID NO: 4896682 - DNA, 23 bp, Homo sapiens
ctctttcttataatactctgttg

SEQ ID NO: 4896683 - DNA, 14 bp, Homo sapiens
ctcttttctctgtg

SEQ ID NO: 4896684 - DNA, 21 bp, Homo sapiens
ctcttttcttactcctcctct

SEQ ID NO: 4896685 - DNA, 10 bp, Homo sapiens
ctcttttgta

SEQ ID NO: 4896686 - DNA, 15 bp, Homo sapiens
ctcttttgtaaatta

SEQ ID NO: 4896687 - DNA, 11 bp, Homo sapiens
ctctttttaag

SEQ ID NO: 4896688 - DNA, 20 bp, Homo sapiens
ctctttttagggccaggcag

SEQ ID NO: 4896689 - DNA, 18 bp, Homo sapiens
ctcttttttactcattga

SEQ ID NO: 4896690 - DNA, 22 bp, Homo sapiens
ctcttttttactcattgaaatg

SEQ ID NO: 4896691 - DNA, 19 bp, Homo sapiens
ctcttttttgtttgtttct

SEQ ID NO: 4896692 - DNA, 14 bp, Homo sapiens
ctgaaaaaaagttt

SEQ ID NO: 4896693 - DNA, 15 bp, Homo sapiens
ctgaaaaaaagttta

SEQ ID NO: 4896694 - DNA, 22 bp, Homo sapiens
ctgaaaaaacacctagctttat

SEQ ID NO: 4896695 - DNA, 19 bp, Homo sapiens
ctgaaaaagtagattgagt

SEQ ID NO: 4896696 - DNA, 15 bp, Homo sapiens
ctgaaaaattccttt

SEQ ID NO: 4896697 - DNA, 22 bp, Homo sapiens
ctgaaaaccatctggcctggcc

SEQ ID NO: 4896698 - DNA, 15 bp, Homo sapiens
ctgaaaactggaata

SEQ ID NO: 4896699 - DNA, 21 bp, Homo sapiens
ctgaaaactggaataagaagc

SEQ ID NO: 4896700 - DNA, 22 bp, Homo sapiens
ctgaaaactggaataagaagca

SEQ ID NO: 4896701 - DNA, 18 bp, Homo sapiens
ctgaaaataccatcaggc

SEQ ID NO: 4896702 - DNA, 17 bp, Homo sapiens
ctgaaaatctaatatta

SEQ ID NO: 4896703 - DNA, 22 bp, Homo sapiens
ctgaaaatgtttttctgccagg

SEQ ID NO: 4896704 - DNA, 13 bp, Homo sapiens
ctgaaacagattt

SEQ ID NO: 4896705 - DNA, 18 bp, Homo sapiens
ctgaaagttacccactga

SEQ ID NO: 4896706 - DNA, 18 bp, Homo sapiens
ctgaaataggaaacaagt

SEQ ID NO: 4896707 - DNA, 22 bp, Homo sapiens
ctgaaatgaaacaaataatcac

SEQ ID NO: 4896708 - DNA, 12 bp, Homo sapiens
ctgaaattccaa

SEQ ID NO: 4896709 - DNA, 17 bp, Homo sapiens
ctgaaattccaaagtct

SEQ ID NO: 4896710 - DNA, 14 bp, Homo sapiens
ctgaaatttcacca

SEQ ID NO: 4896711 - DNA, 13 bp, Homo sapiens
ctgaacaagaatt

SEQ ID NO: 4896712 - DNA, 13 bp, Homo sapiens
ctgaacacaggca

SEQ ID NO: 4896713 - DNA, 14 bp, Homo sapiens
ctgaacacaggcag

SEQ ID NO: 4896714 - DNA, 17 bp, Homo sapiens
ctgaacacaggcagctt

SEQ ID NO: 4896715 - DNA, 22 bp, Homo sapiens
ctgaacttcaggataataaagt

SEQ ID NO: 4896716 - DNA, 16 bp, Homo sapiens
ctgaactttggagagt

SEQ ID NO: 4896717 - DNA, 14 bp, Homo sapiens
ctgaagactgagga

SEQ ID NO: 4896718 - DNA, 16 bp, Homo sapiens
ctgaagcaacatttta

SEQ ID NO: 4896719 - DNA, 22 bp, Homo sapiens
ctgaaggaataaattgctcctt

SEQ ID NO: 4896720 - DNA, 23 bp, Homo sapiens
ctgaaggacattgcggacagcca

SEQ ID NO: 4896721 - DNA, 16 bp, Homo sapiens
ctgaagtactaacaca

SEQ ID NO: 4896722 - DNA, 17 bp, Homo sapiens
ctgaagtcacacagtga

SEQ ID NO: 4896723 - DNA, 19 bp, Homo sapiens
ctgaagtcacacagtgagt

SEQ ID NO: 4896724 - DNA, 13 bp, Homo sapiens
ctgaagtcactgc

SEQ ID NO: 4896725 - DNA, 14 bp, Homo sapiens
ctgaagtcactgca

SEQ ID NO: 4896726 - DNA, 15 bp, Homo sapiens
ctgaagtcactgcac

SEQ ID NO: 4896727 - DNA, 16 bp, Homo sapiens
ctgaagtcactgcaca

SEQ ID NO: 4896728 - DNA, 22 bp, Homo sapiens
ctgaagtcactgcacagtgcat

SEQ ID NO: 4896729 - DNA, 19 bp, Homo sapiens
ctgaagtgagcacagccta

SEQ ID NO: 4896730 - DNA, 17 bp, Homo sapiens
ctgaataaatggtagta

SEQ ID NO: 4896731 - DNA, 17 bp, Homo sapiens
ctgaatatacagcaggt

SEQ ID NO: 4896732 - DNA, 20 bp, Homo sapiens
ctgaatccattaaaaatggg

SEQ ID NO: 4896733 - DNA, 19 bp, Homo sapiens
ctgaatgcctcctgtgggg

SEQ ID NO: 4896734 - DNA, 18 bp, Homo sapiens
ctgaatgtttattccttg

SEQ ID NO: 4896735 - DNA, 18 bp, Homo sapiens
ctgacaaaaagtttccat

SEQ ID NO: 4896736 - DNA, 14 bp, Homo sapiens
ctgacacaaaggaa

SEQ ID NO: 4896737 - DNA, 18 bp, Homo sapiens
ctgacacacagctctgtc

SEQ ID NO: 4896738 - DNA, 13 bp, Homo sapiens
ctgacagaaacca

SEQ ID NO: 4896739 - DNA, 14 bp, Homo sapiens
ctgacagaaagcag

SEQ ID NO: 4896740 - DNA, 15 bp, Homo sapiens
ctgacagacacaggc

SEQ ID NO: 4896741 - DNA, 17 bp, Homo sapiens
ctgacagacacaggccc

SEQ ID NO: 4896742 - DNA, 15 bp, Homo sapiens
ctgacagcatgtgcc

SEQ ID NO: 4896743 - DNA, 17 bp, Homo sapiens
ctgacagcctcccaccc

SEQ ID NO: 4896744 - DNA, 19 bp, Homo sapiens
ctgacaggcaatgctggct

SEQ ID NO: 4896745 - DNA, 13 bp, Homo sapiens
ctgacatcacagc

SEQ ID NO: 4896746 - DNA, 14 bp, Homo sapiens
ctgacatcacagca

SEQ ID NO: 4896747 - DNA, 15 bp, Homo sapiens
ctgacatcacagcag

SEQ ID NO: 4896748 - DNA, 16 bp, Homo sapiens
ctgacatcacagcagc

SEQ ID NO: 4896749 - DNA, 23 bp, Homo sapiens
ctgacatcacagcagcctccaac

SEQ ID NO: 4896750 - DNA, 14 bp, Homo sapiens
ctgacatggctctg

SEQ ID NO: 4896751 - DNA, 18 bp, Homo sapiens
ctgaccaacaggctgttc

SEQ ID NO: 4896752 - DNA, 16 bp, Homo sapiens
ctgaccaattgtgctg

SEQ ID NO: 4896753 - DNA, 19 bp, Homo sapiens
ctgaccaattgtgctgcca

SEQ ID NO: 4896754 - DNA, 21 bp, Homo sapiens
ctgaccaattgtgctgccatt

SEQ ID NO: 4896755 - DNA, 15 bp, Homo sapiens
ctgaccatccactct

SEQ ID NO: 4896756 - DNA, 19 bp, Homo sapiens
ctgaccatccactctaccc

SEQ ID NO: 4896757 - DNA, 11 bp, Homo sapiens
ctgacccactg

SEQ ID NO: 4896758 - DNA, 12 bp, Homo sapiens
ctgacccactgc

SEQ ID NO: 4896759 - DNA, 20 bp, Homo sapiens
ctgaccccggtggcggcccc

SEQ ID NO: 4896760 - DNA, 12 bp, Homo sapiens
ctgacccctcct

SEQ ID NO: 4896761 - DNA, 14 bp, Homo sapiens
ctgacccctcctca

SEQ ID NO: 4896762 - DNA, 16 bp, Homo sapiens
ctgacccctcctcact

SEQ ID NO: 4896763 - DNA, 18 bp, Homo sapiens
ctgaccctactcccttgc

SEQ ID NO: 4896764 - DNA, 15 bp, Homo sapiens
ctgacctcttgctgt

SEQ ID NO: 4896765 - DNA, 17 bp, Homo sapiens
ctgacctcttgctgtct

SEQ ID NO: 4896766 - DNA, 18 bp, Homo sapiens
ctgacctcttgctgtctc

SEQ ID NO: 4896767 - DNA, 20 bp, Homo sapiens
ctgacctcttgctgtctctg

SEQ ID NO: 4896768 - DNA, 22 bp, Homo sapiens
ctgacctcttgctgtctctgct

SEQ ID NO: 4896769 - DNA, 13 bp, Homo sapiens
ctgaccttccttc

SEQ ID NO: 4896770 - DNA, 20 bp, Homo sapiens
ctgaccttggagagacacag

SEQ ID NO: 4896771 - DNA, 17 bp, Homo sapiens
ctgacgaaactggcccc

SEQ ID NO: 4896772 - DNA, 17 bp, Homo sapiens
ctgacggccctgcaatg

SEQ ID NO: 4896773 - DNA, 12 bp, Homo sapiens
ctgactaaattt

SEQ ID NO: 4896774 - DNA, 15 bp, Homo sapiens
ctgactactttgcct

SEQ ID NO: 4896775 - DNA, 20 bp, Homo sapiens
ctgactccacgatcctgcca

SEQ ID NO: 4896776 - DNA, 20 bp, Homo sapiens
ctgactcctacctgccctgg

SEQ ID NO: 4896777 - DNA, 19 bp, Homo sapiens
ctgactctgccccctgctg

SEQ ID NO: 4896778 - DNA, 20 bp, Homo sapiens
ctgactctgccccctgctgg

SEQ ID NO: 4896779 - DNA, 21 bp, Homo sapiens
ctgactctgccccctgctggc

SEQ ID NO: 4896780 - DNA, 20 bp, Homo sapiens
ctgactggattcattctcat

SEQ ID NO: 4896781 - DNA, 14 bp, Homo sapiens
ctgactgtcctctc

SEQ ID NO: 4896782 - DNA, 18 bp, Homo sapiens
ctgacttaagcaaaagaa

SEQ ID NO: 4896783 - DNA, 20 bp, Homo sapiens
ctgacttcatggaatggaca

SEQ ID NO: 4896784 - DNA, 15 bp, Homo sapiens
ctgacttgtttgtct

SEQ ID NO: 4896785 - DNA, 17 bp, Homo sapiens
ctgacttgtttgtcttc

SEQ ID NO: 4896786 - DNA, 14 bp, Homo sapiens
ctgagaaaacaagc

SEQ ID NO: 4896787 - DNA, 23 bp, Homo sapiens
ctgagaaaatgagtgactagacg

SEQ ID NO: 4896788 - DNA, 15 bp, Homo sapiens
ctgagaataagaaag

SEQ ID NO: 4896789 - DNA, 16 bp, Homo sapiens
ctgagaccatttaaca

SEQ ID NO: 4896790 - DNA, 18 bp, Homo sapiens
ctgagagacttttaatca

SEQ ID NO: 4896791 - DNA, 12 bp, Homo sapiens
ctgagagccagg

SEQ ID NO: 4896792 - DNA, 14 bp, Homo sapiens
ctgagagtctagat

SEQ ID NO: 4896793 - DNA, 17 bp, Homo sapiens
ctgagatcccctgagcc

SEQ ID NO: 4896794 - DNA, 21 bp, Homo sapiens
ctgagatcccctgagccccag

SEQ ID NO: 4896795 - DNA, 20 bp, Homo sapiens
ctgagcaaatgtggctcctg

SEQ ID NO: 4896796 - DNA, 19 bp, Homo sapiens
ctgagccacagcagcattt

SEQ ID NO: 4896797 - DNA, 20 bp, Homo sapiens
ctgagccacagcagcatttt

SEQ ID NO: 4896798 - DNA, 22 bp, Homo sapiens
ctgagccagtgctttaatggca

SEQ ID NO: 4896799 - DNA, 20 bp, Homo sapiens
ctgagcccatgttctgcccc

SEQ ID NO: 4896800 - DNA, 22 bp, Homo sapiens
ctgagccccgcagacctcccca

SEQ ID NO: 4896801 - DNA, 23 bp, Homo sapiens
ctgagccccgcagacctccccag

SEQ ID NO: 4896802 - DNA, 18 bp, Homo sapiens
ctgagccccgccctcttc

SEQ ID NO: 4896803 - DNA, 23 bp, Homo sapiens
ctgagccccgccctcttcctgac

SEQ ID NO: 4896804 - DNA, 22 bp, Homo sapiens
ctgagccctactccctgcagat

SEQ ID NO: 4896805 - DNA, 23 bp, Homo sapiens
ctgagccctactccctgcagatg

SEQ ID NO: 4896806 - DNA, 12 bp, Homo sapiens
ctgagcctctgc

SEQ ID NO: 4896807 - DNA, 14 bp, Homo sapiens
ctgagcctctgctc

SEQ ID NO: 4896808 - DNA, 16 bp, Homo sapiens
ctgagcctctgctccc

SEQ ID NO: 4896809 - DNA, 12 bp, Homo sapiens
ctgagccttcag

SEQ ID NO: 4896810 - DNA, 13 bp, Homo sapiens
ctgagcgggaggc

SEQ ID NO: 4896811 - DNA, 16 bp, Homo sapiens
ctgagcgggaggcaga

SEQ ID NO: 4896812 - DNA, 18 bp, Homo sapiens
ctgagcgggaggcagagt

SEQ ID NO: 4896813 - DNA, 23 bp, Homo sapiens
ctgaggaaggaggggaagctgca

SEQ ID NO: 4896814 - DNA, 20 bp, Homo sapiens
ctgaggaatccagacccggc

SEQ ID NO: 4896815 - DNA, 14 bp, Homo sapiens
ctgaggacaaagtg

SEQ ID NO: 4896816 - DNA, 13 bp, Homo sapiens
ctgaggaggcctc

SEQ ID NO: 4896817 - DNA, 16 bp, Homo sapiens
ctgaggccctgcccaa

SEQ ID NO: 4896818 - DNA, 14 bp, Homo sapiens
ctgaggctttggat

SEQ ID NO: 4896819 - DNA, 15 bp, Homo sapiens
ctgaggctttggatt

SEQ ID NO: 4896820 - DNA, 17 bp, Homo sapiens
ctgaggctttggatttg

SEQ ID NO: 4896821 - DNA, 20 bp, Homo sapiens
ctgagggaccaactgggccc

SEQ ID NO: 4896822 - DNA, 21 bp, Homo sapiens
ctgagggactctgaagcctct

SEQ ID NO: 4896823 - DNA, 23 bp, Homo sapiens
ctgagggactctgaagcctctgg

SEQ ID NO: 4896824 - DNA, 16 bp, Homo sapiens
ctgagggaggacctgg

SEQ ID NO: 4896825 - DNA, 17 bp, Homo sapiens
ctgagggaggacctggg

SEQ ID NO: 4896826 - DNA, 22 bp, Homo sapiens
ctgagggaggacctggggcaca

SEQ ID NO: 4896827 - DNA, 16 bp, Homo sapiens
ctgaggggcatctgcc

SEQ ID NO: 4896828 - DNA, 19 bp, Homo sapiens
ctgaggggcatctgcccct

SEQ ID NO: 4896829 - DNA, 20 bp, Homo sapiens
ctgaggggcatctgcccctc

SEQ ID NO: 4896830 - DNA, 15 bp, Homo sapiens
ctgagggtccccacc

SEQ ID NO: 4896831 - DNA, 21 bp, Homo sapiens
ctgagggtccccacctgggac

SEQ ID NO: 4896832 - DNA, 19 bp, Homo sapiens
ctgaggtgaaagggagcta

SEQ ID NO: 4896833 - DNA, 19 bp, Homo sapiens
ctgaggtgcctgtcccacc

SEQ ID NO: 4896834 - DNA, 22 bp, Homo sapiens
ctgaggtgcctgtcccaccccc

SEQ ID NO: 4896835 - DNA, 22 bp, Homo sapiens
ctgagtcaccctacctgtgcct

SEQ ID NO: 4896836 - DNA, 17 bp, Homo sapiens
ctgagtcagggcccaga

SEQ ID NO: 4896837 - DNA, 20 bp, Homo sapiens
ctgagtcagggcccagaggc

SEQ ID NO: 4896838 - DNA, 22 bp, Homo sapiens
ctgagtcagggcccagaggctg

SEQ ID NO: 4896839 - DNA, 23 bp, Homo sapiens
ctgagtcagggcccagaggctga

SEQ ID NO: 4896840 - DNA, 15 bp, Homo sapiens
ctgagttatgatgta

SEQ ID NO: 4896841 - DNA, 11 bp, Homo sapiens
ctgagttgcca

SEQ ID NO: 4896842 - DNA, 19 bp, Homo sapiens
ctgagtttcattctcctgc

SEQ ID NO: 4896843 - DNA, 19 bp, Homo sapiens
ctgataaaacaacagctcg

SEQ ID NO: 4896844 - DNA, 16 bp, Homo sapiens
ctgatacataactaaa

SEQ ID NO: 4896845 - DNA, 17 bp, Homo sapiens
ctgatacataactaaat

SEQ ID NO: 4896846 - DNA, 18 bp, Homo sapiens
ctgatacataactaaatt

SEQ ID NO: 4896847 - DNA, 14 bp, Homo sapiens
ctgatataaattct

SEQ ID NO: 4896848 - DNA, 17 bp, Homo sapiens
ctgatataaattctgtg

SEQ ID NO: 4896849 - DNA, 18 bp, Homo sapiens
ctgatataaattctgtgg

SEQ ID NO: 4896850 - DNA, 14 bp, Homo sapiens
ctgatatactgtgt

SEQ ID NO: 4896851 - DNA, 15 bp, Homo sapiens
ctgatatgggactga

SEQ ID NO: 4896852 - DNA, 23 bp, Homo sapiens
ctgatattttacctcttattgca

SEQ ID NO: 4896853 - DNA, 15 bp, Homo sapiens
ctgatctcttcctgt

SEQ ID NO: 4896854 - DNA, 16 bp, Homo sapiens
ctgatctcttcctgtt

SEQ ID NO: 4896855 - DNA, 21 bp, Homo sapiens
ctgatgaaactcacaaatgat

SEQ ID NO: 4896856 - DNA, 11 bp, Homo sapiens
ctgatgagcaa

SEQ ID NO: 4896857 - DNA, 18 bp, Homo sapiens
ctgatgccaatactagtc

SEQ ID NO: 4896858 - DNA, 20 bp, Homo sapiens
ctgatgccgtgatcctgagc

SEQ ID NO: 4896859 - DNA, 17 bp, Homo sapiens
ctgatgctccctcccct

SEQ ID NO: 4896860 - DNA, 21 bp, Homo sapiens
ctgatgctccctcccctgccc

SEQ ID NO: 4896861 - DNA, 16 bp, Homo sapiens
ctgatgctgagattct

SEQ ID NO: 4896862 - DNA, 17 bp, Homo sapiens
ctgatgctgttctcttc

SEQ ID NO: 4896863 - DNA, 20 bp, Homo sapiens
ctgatggaagtaaagcctca

SEQ ID NO: 4896864 - DNA, 21 bp, Homo sapiens
ctgatgggcaacccccagcct

SEQ ID NO: 4896865 - DNA, 23 bp, Homo sapiens
ctgatgggcaacccccagcctgc

SEQ ID NO: 4896866 - DNA, 20 bp, Homo sapiens
ctgatgtgtcctcagggagc

SEQ ID NO: 4896867 - DNA, 16 bp, Homo sapiens
ctgattagctttgtgt

SEQ ID NO: 4896868 - DNA, 17 bp, Homo sapiens
ctgattagctttgtgtt

SEQ ID NO: 4896869 - DNA, 23 bp, Homo sapiens
ctgattatgtcttttatatttgt

SEQ ID NO: 4896870 - DNA, 15 bp, Homo sapiens
ctgattcccaagctc

SEQ ID NO: 4896871 - DNA, 13 bp, Homo sapiens
ctgattctgggat

SEQ ID NO: 4896872 - DNA, 16 bp, Homo sapiens
ctgattctgggatgct

SEQ ID NO: 4896873 - DNA, 15 bp, Homo sapiens
ctgattgacctgctc

SEQ ID NO: 4896874 - DNA, 17 bp, Homo sapiens
ctgattggcttgtagaa

SEQ ID NO: 4896875 - DNA, 22 bp, Homo sapiens
ctgattggcttgtagaattgtt

SEQ ID NO: 4896876 - DNA, 17 bp, Homo sapiens
ctgattggtgcaaccct

SEQ ID NO: 4896877 - DNA, 16 bp, Homo sapiens
ctgattgtaaacttca

SEQ ID NO: 4896878 - DNA, 13 bp, Homo sapiens
ctgatttcttgct

SEQ ID NO: 4896879 - DNA, 14 bp, Homo sapiens
ctgatttggaaaaa

SEQ ID NO: 4896880 - DNA, 14 bp, Homo sapiens
ctgatttggtactt

SEQ ID NO: 4896881 - DNA, 13 bp, Homo sapiens
ctgattttaatgg

SEQ ID NO: 4896882 - DNA, 14 bp, Homo sapiens
ctgattttaatgga

SEQ ID NO: 4896883 - DNA, 22 bp, Homo sapiens
ctgattttaatggattgttaat

SEQ ID NO: 4896884 - DNA, 21 bp, Homo sapiens
ctgattttaggagctaaggct

SEQ ID NO: 4896885 - DNA, 22 bp, Homo sapiens
ctgattttaggagctaaggctc

SEQ ID NO: 4896886 - DNA, 18 bp, Homo sapiens
ctgattttcaaagctttt

SEQ ID NO: 4896887 - DNA, 15 bp, Homo sapiens
ctgcaaacagaacag

SEQ ID NO: 4896888 - DNA, 21 bp, Homo sapiens
ctgcaaacagaacagggtcat

SEQ ID NO: 4896889 - DNA, 21 bp, Homo sapiens
ctgcaaagggtatcaggtgct

SEQ ID NO: 4896890 - DNA, 22 bp, Homo sapiens
ctgcaacctccgcctcttgggt

SEQ ID NO: 4896891 - DNA, 13 bp, Homo sapiens
ctgcaaggcccac

SEQ ID NO: 4896892 - DNA, 20 bp, Homo sapiens
ctgcaaggcccacaggaggc

SEQ ID NO: 4896893 - DNA, 19 bp, Homo sapiens
ctgcaataacttctgacct

SEQ ID NO: 4896894 - DNA, 12 bp, Homo sapiens
ctgcaatatttg

SEQ ID NO: 4896895 - DNA, 19 bp, Homo sapiens
ctgcaatatttgaatttta

SEQ ID NO: 4896896 - DNA, 16 bp, Homo sapiens
ctgcaatcctgtcttt

SEQ ID NO: 4896897 - DNA, 14 bp, Homo sapiens
ctgcaattcaaaag

SEQ ID NO: 4896898 - DNA, 20 bp, Homo sapiens
ctgcacaaagcccttccatg

SEQ ID NO: 4896899 - DNA, 21 bp, Homo sapiens
ctgcacaaagcccttccatgt

SEQ ID NO: 4896900 - DNA, 23 bp, Homo sapiens
ctgcacacaagcccacagcacag

SEQ ID NO: 4896901 - DNA, 19 bp, Homo sapiens
ctgcacagcggcccctgca

SEQ ID NO: 4896902 - DNA, 18 bp, Homo sapiens
ctgcacagtgcatctcag

SEQ ID NO: 4896903 - DNA, 23 bp, Homo sapiens
ctgcacatgaatcccacccacat

SEQ ID NO: 4896904 - DNA, 21 bp, Homo sapiens
ctgcaccctggggcctggacc

SEQ ID NO: 4896905 - DNA, 14 bp, Homo sapiens
ctgcacccttcttt

SEQ ID NO: 4896906 - DNA, 14 bp, Homo sapiens
ctgcaccgggccac

SEQ ID NO: 4896907 - DNA, 18 bp, Homo sapiens
ctgcaccgggccacagag

SEQ ID NO: 4896908 - DNA, 18 bp, Homo sapiens
ctgcactaaagccagcct

SEQ ID NO: 4896909 - DNA, 21 bp, Homo sapiens
ctgcactaaagccagcctgac

SEQ ID NO: 4896910 - DNA, 17 bp, Homo sapiens
ctgcactatagcctagg

SEQ ID NO: 4896911 - DNA, 15 bp, Homo sapiens
ctgcactcctcaggg

SEQ ID NO: 4896912 - DNA, 12 bp, Homo sapiens
ctgcactgaaaa

SEQ ID NO: 4896913 - DNA, 16 bp, Homo sapiens
ctgcactggggagccc

SEQ ID NO: 4896914 - DNA, 16 bp, Homo sapiens
ctgcacttgcagactc

SEQ ID NO: 4896915 - DNA, 14 bp, Homo sapiens
ctgcactttgatgt

SEQ ID NO: 4896916 - DNA, 15 bp, Homo sapiens
ctgcagagcaccttt

SEQ ID NO: 4896917 - DNA, 13 bp, Homo sapiens
ctgcagagggtta

SEQ ID NO: 4896918 - DNA, 22 bp, Homo sapiens
ctgcagagggttaggagtgggt

SEQ ID NO: 4896919 - DNA, 16 bp, Homo sapiens
ctgcagatgccaccct

SEQ ID NO: 4896920 - DNA, 22 bp, Homo sapiens
ctgcagatgccaccctagccaa

SEQ ID NO: 4896921 - DNA, 14 bp, Homo sapiens
ctgcagcacggaca

SEQ ID NO: 4896922 - DNA, 22 bp, Homo sapiens
ctgcagcacggacaataaacct

SEQ ID NO: 4896923 - DNA, 12 bp, Homo sapiens
ctgcagccagct

SEQ ID NO: 4896924 - DNA, 11 bp, Homo sapiens
ctgcagcctca

SEQ ID NO: 4896925 - DNA, 19 bp, Homo sapiens
ctgcagcctcaacctcctg

SEQ ID NO: 4896926 - DNA, 24 bp, Homo sapiens
ctgcagcctcaacctcctgggcta

SEQ ID NO: 4896927 - DNA, 13 bp, Homo sapiens
ctgcagctgccgg

SEQ ID NO: 4896928 - DNA, 14 bp, Homo sapiens
ctgcagctggacag

SEQ ID NO: 4896929 - DNA, 16 bp, Homo sapiens
ctgcagctggacagag

SEQ ID NO: 4896930 - DNA, 18 bp, Homo sapiens
ctgcagctggacagaggg

SEQ ID NO: 4896931 - DNA, 15 bp, Homo sapiens
ctgcagcttcctgtc

SEQ ID NO: 4896932 - DNA, 21 bp, Homo sapiens
ctgcagctttacatgcaattt

SEQ ID NO: 4896933 - DNA, 20 bp, Homo sapiens
ctgcaggaatcaaaaattga

SEQ ID NO: 4896934 - DNA, 14 bp, Homo sapiens
ctgcaggggctctg

SEQ ID NO: 4896935 - DNA, 18 bp, Homo sapiens
ctgcaggggctctggaga

SEQ ID NO: 4896936 - DNA, 22 bp, Homo sapiens
ctgcaggggctctggagagaaa

SEQ ID NO: 4896937 - DNA, 17 bp, Homo sapiens
ctgcagggggtgtgtct

SEQ ID NO: 4896938 - DNA, 20 bp, Homo sapiens
ctgcagggggtgtgtctgct

SEQ ID NO: 4896939 - DNA, 17 bp, Homo sapiens
ctgcaggttggacccca

SEQ ID NO: 4896940 - DNA, 18 bp, Homo sapiens
ctgcaggttggaccccag

SEQ ID NO: 4896941 - DNA, 21 bp, Homo sapiens
ctgcaggttggaccccagaga

SEQ ID NO: 4896942 - DNA, 17 bp, Homo sapiens
ctgcagtaaatctttta

SEQ ID NO: 4896943 - DNA, 18 bp, Homo sapiens
ctgcagtgttcgcttggc

SEQ ID NO: 4896944 - DNA, 20 bp, Homo sapiens
ctgcagtgttcgcttggctc

SEQ ID NO: 4896945 - DNA, 24 bp, Homo sapiens
ctgcagtttttcaggagcgcaaga

SEQ ID NO: 4896946 - DNA, 15 bp, Homo sapiens
ctgcatcccagcacc

SEQ ID NO: 4896947 - DNA, 16 bp, Homo sapiens
ctgcatcccagcacct

SEQ ID NO: 4896948 - DNA, 23 bp, Homo sapiens
ctgcatcccagcacctgcctcct

SEQ ID NO: 4896949 - DNA, 22 bp, Homo sapiens
ctgcatccccttggctgtgagg

SEQ ID NO: 4896950 - DNA, 21 bp, Homo sapiens
ctgcatcttatagcactttga

SEQ ID NO: 4896951 - DNA, 17 bp, Homo sapiens
ctgcatctttagtgctt

SEQ ID NO: 4896952 - DNA, 15 bp, Homo sapiens
ctgcatgaatatcat

SEQ ID NO: 4896953 - DNA, 16 bp, Homo sapiens
ctgcatgaatatcata

SEQ ID NO: 4896954 - DNA, 21 bp, Homo sapiens
ctgcatgtggcttttttaaaa

SEQ ID NO: 4896955 - DNA, 20 bp, Homo sapiens
ctgcattcaggatcaaaccc

SEQ ID NO: 4896956 - DNA, 21 bp, Homo sapiens
ctgcattctgcctctctagga

SEQ ID NO: 4896957 - DNA, 13 bp, Homo sapiens
ctgcatttctgag

SEQ ID NO: 4896958 - DNA, 13 bp, Homo sapiens
ctgccacactctg

SEQ ID NO: 4896959 - DNA, 15 bp, Homo sapiens
ctgccaccagagacc

SEQ ID NO: 4896960 - DNA, 22 bp, Homo sapiens
ctgccaccagagaccgtcctca

SEQ ID NO: 4896961 - DNA, 12 bp, Homo sapiens
ctgccaccctgg

SEQ ID NO: 4896962 - DNA, 15 bp, Homo sapiens
ctgccacctccctga

SEQ ID NO: 4896963 - DNA, 16 bp, Homo sapiens
ctgccacttgaacaaa

SEQ ID NO: 4896964 - DNA, 14 bp, Homo sapiens
ctgccactttgcac

SEQ ID NO: 4896965 - DNA, 17 bp, Homo sapiens
ctgccactttgcacatt

SEQ ID NO: 4896966 - DNA, 22 bp, Homo sapiens
ctgccactttgcacattttgat

SEQ ID NO: 4896967 - DNA, 10 bp, Homo sapiens
ctgccagagg

SEQ ID NO: 4896968 - DNA, 19 bp, Homo sapiens
ctgccagcagcagcaggtg

SEQ ID NO: 4896969 - DNA, 21 bp, Homo sapiens
ctgccagcagcagcaggtgat

SEQ ID NO: 4896970 - DNA, 17 bp, Homo sapiens
ctgccagccccacacag

SEQ ID NO: 4896971 - DNA, 20 bp, Homo sapiens
ctgccagtccccctgcccca

SEQ ID NO: 4896972 - DNA, 17 bp, Homo sapiens
ctgccatatataacaga

SEQ ID NO: 4896973 - DNA, 16 bp, Homo sapiens
ctgccatattctgttg

SEQ ID NO: 4896974 - DNA, 20 bp, Homo sapiens
ctgccatattctgttggcca

SEQ ID NO: 4896975 - DNA, 23 bp, Homo sapiens
ctgccatattctgttggccagtg

SEQ ID NO: 4896976 - DNA, 18 bp, Homo sapiens
ctgccatccaggttcagc

SEQ ID NO: 4896977 - DNA, 19 bp, Homo sapiens
ctgccatcttagtttggat

SEQ ID NO: 4896978 - DNA, 18 bp, Homo sapiens
ctgccatgccaggaacct

SEQ ID NO: 4896979 - DNA, 20 bp, Homo sapiens
ctgccatgtacctcccctgc

SEQ ID NO: 4896980 - DNA, 15 bp, Homo sapiens
ctgccattattttct

SEQ ID NO: 4896981 - DNA, 21 bp, Homo sapiens
ctgccatttgatttttctaac

SEQ ID NO: 4896982 - DNA, 19 bp, Homo sapiens
ctgcccaacctgctctcct

SEQ ID NO: 4896983 - DNA, 22 bp, Homo sapiens
ctgcccactgtttctcttgagc

SEQ ID NO: 4896984 - DNA, 17 bp, Homo sapiens
ctgcccagcctccaagc

SEQ ID NO: 4896985 - DNA, 14 bp, Homo sapiens
ctgcccaggcccct

SEQ ID NO: 4896986 - DNA, 17 bp, Homo sapiens
ctgcccaggcctgcctg

SEQ ID NO: 4896987 - DNA, 15 bp, Homo sapiens
ctgcccatcacaggg

SEQ ID NO: 4896988 - DNA, 23 bp, Homo sapiens
ctgccccaaataacttcagtcct

SEQ ID NO: 4896989 - DNA, 23 bp, Homo sapiens
ctgccccagtcgttagaatatag

SEQ ID NO: 4896990 - DNA, 21 bp, Homo sapiens
ctgcccccacgagggtcagga

SEQ ID NO: 4896991 - DNA, 16 bp, Homo sapiens
ctgccccccagcctct

SEQ ID NO: 4896992 - DNA, 17 bp, Homo sapiens
ctgccccctgctggctc

SEQ ID NO: 4896993 - DNA, 14 bp, Homo sapiens
ctgcccctcccttc

SEQ ID NO: 4896994 - DNA, 13 bp, Homo sapiens
ctgcccctctttc

SEQ ID NO: 4896995 - DNA, 17 bp, Homo sapiens
ctgcccgcacaccctca

SEQ ID NO: 4896996 - DNA, 17 bp, Homo sapiens
ctgcccgcacagcagcc

SEQ ID NO: 4896997 - DNA, 21 bp, Homo sapiens
ctgcccgcacagcagcctgct

SEQ ID NO: 4896998 - DNA, 23 bp, Homo sapiens
ctgccctcattactgggccttag

SEQ ID NO: 4896999 - DNA, 18 bp, Homo sapiens
ctgccctccttgtccacc

SEQ ID NO: 4897000 - DNA, 17 bp, Homo sapiens
ctgccctctccttcctt

SEQ ID NO: 4897001 - DNA, 18 bp, Homo sapiens
ctgccctctccttcctta

SEQ ID NO: 4897002 - DNA, 11 bp, Homo sapiens
ctgccctgaga

SEQ ID NO: 4897003 - DNA, 11 bp, Homo sapiens
ctgccctgctg

SEQ ID NO: 4897004 - DNA, 22 bp, Homo sapiens
ctgccctggaacatcctttgca

SEQ ID NO: 4897005 - DNA, 23 bp, Homo sapiens
ctgccctggtccagggaagctgg

SEQ ID NO: 4897006 - DNA, 19 bp, Homo sapiens
ctgccctggtgctgccaca

SEQ ID NO: 4897007 - DNA, 21 bp, Homo sapiens
ctgccctggtgctgccacact

SEQ ID NO: 4897008 - DNA, 13 bp, Homo sapiens
ctgccctgtaccc

SEQ ID NO: 4897009 - DNA, 15 bp, Homo sapiens
ctgcccttaggccac

SEQ ID NO: 4897010 - DNA, 17 bp, Homo sapiens
ctgcccttcaccccagt

SEQ ID NO: 4897011 - DNA, 12 bp, Homo sapiens
ctgcccttgggc

SEQ ID NO: 4897012 - DNA, 14 bp, Homo sapiens
ctgccggtttgaaa

SEQ ID NO: 4897013 - DNA, 20 bp, Homo sapiens
ctgccgtgcattagcacaga

SEQ ID NO: 4897014 - DNA, 18 bp, Homo sapiens
ctgcctagcaagctggcc

SEQ ID NO: 4897015 - DNA, 21 bp, Homo sapiens
ctgcctagctgcctagcaagc

SEQ ID NO: 4897016 - DNA, 16 bp, Homo sapiens
ctgcctcaccgcttcc

SEQ ID NO: 4897017 - DNA, 12 bp, Homo sapiens
ctgcctcagcct

SEQ ID NO: 4897018 - DNA, 14 bp, Homo sapiens
ctgcctcagcctcc

SEQ ID NO: 4897019 - DNA, 15 bp, Homo sapiens
ctgcctcagcctccc

SEQ ID NO: 4897020 - DNA, 18 bp, Homo sapiens
ctgcctcagcctcccaag

SEQ ID NO: 4897021 - DNA, 22 bp, Homo sapiens
ctgcctccagaatggtctttct

SEQ ID NO: 4897022 - DNA, 16 bp, Homo sapiens
ctgcctcccattctga

SEQ ID NO: 4897023 - DNA, 19 bp, Homo sapiens
ctgcctcctcgttcctttc

SEQ ID NO: 4897024 - DNA, 15 bp, Homo sapiens
ctgcctcctgcctgc

SEQ ID NO: 4897025 - DNA, 16 bp, Homo sapiens
ctgcctcctgcctgcc

SEQ ID NO: 4897026 - DNA, 17 bp, Homo sapiens
ctgcctcctgcctgccc

SEQ ID NO: 4897027 - DNA, 18 bp, Homo sapiens
ctgcctcgaactggctgc

SEQ ID NO: 4897028 - DNA, 17 bp, Homo sapiens
ctgcctctgacacacag

SEQ ID NO: 4897029 - DNA, 22 bp, Homo sapiens
ctgcctctgacacacagctctg

SEQ ID NO: 4897030 - DNA, 13 bp, Homo sapiens
ctgcctctgccac

SEQ ID NO: 4897031 - DNA, 12 bp, Homo sapiens
ctgcctctgcct

SEQ ID NO: 4897032 - DNA, 14 bp, Homo sapiens
ctgcctctgcctta

SEQ ID NO: 4897033 - DNA, 23 bp, Homo sapiens
ctgcctctgccttagaggagccc

SEQ ID NO: 4897034 - DNA, 23 bp, Homo sapiens
ctgcctgaagtcacacagtgagt

SEQ ID NO: 4897035 - DNA, 17 bp, Homo sapiens
ctgcctgcaatatttga

SEQ ID NO: 4897036 - DNA, 18 bp, Homo sapiens
ctgcctgcaatatttgaa

SEQ ID NO: 4897037 - DNA, 19 bp, Homo sapiens
ctgcctgcaatatttgaat

SEQ ID NO: 4897038 - DNA, 20 bp, Homo sapiens
ctgcctgcaatatttgaatt

SEQ ID NO: 4897039 - DNA, 12 bp, Homo sapiens
ctgcctgccatg

SEQ ID NO: 4897040 - DNA, 13 bp, Homo sapiens
ctgcctgctttgg

SEQ ID NO: 4897041 - DNA, 16 bp, Homo sapiens
ctgcctggccactgct

SEQ ID NO: 4897042 - DNA, 15 bp, Homo sapiens
ctgcctggccaggca

SEQ ID NO: 4897043 - DNA, 16 bp, Homo sapiens
ctgcctggccaggcag

SEQ ID NO: 4897044 - DNA, 21 bp, Homo sapiens
ctgcctggccaggcagatctg

SEQ ID NO: 4897045 - DNA, 11 bp, Homo sapiens
ctgcctgggct

SEQ ID NO: 4897046 - DNA, 23 bp, Homo sapiens
ctgcctgggctgaccccggtggc

SEQ ID NO: 4897047 - DNA, 22 bp, Homo sapiens
ctgcctgggttccaatcctggc

SEQ ID NO: 4897048 - DNA, 16 bp, Homo sapiens
ctgcctgtagcagtga

SEQ ID NO: 4897049 - DNA, 13 bp, Homo sapiens
ctgcctgtagtta

SEQ ID NO: 4897050 - DNA, 15 bp, Homo sapiens
ctgcctgtagttagg

SEQ ID NO: 4897051 - DNA, 22 bp, Homo sapiens
ctgcctgtagttaggaaataaa

SEQ ID NO: 4897052 - DNA, 14 bp, Homo sapiens
ctgcctgttcagct

SEQ ID NO: 4897053 - DNA, 15 bp, Homo sapiens
ctgcctgttcagctc

SEQ ID NO: 4897054 - DNA, 23 bp, Homo sapiens
ctgccttagtctcagtttgtgtg

SEQ ID NO: 4897055 - DNA, 18 bp, Homo sapiens
ctgccttctgacggccct

SEQ ID NO: 4897056 - DNA, 22 bp, Homo sapiens
ctgccttggctcagacatgttt

SEQ ID NO: 4897057 - DNA, 21 bp, Homo sapiens
ctgcctttgacatttaattta

SEQ ID NO: 4897058 - DNA, 20 bp, Homo sapiens
ctgcggaatgaaccacatct

SEQ ID NO: 4897059 - DNA, 15 bp, Homo sapiens
ctgcggatctcagct

SEQ ID NO: 4897060 - DNA, 15 bp, Homo sapiens
ctgcggtccacccag

SEQ ID NO: 4897061 - DNA, 16 bp, Homo sapiens
ctgcggtccacccagg

SEQ ID NO: 4897062 - DNA, 17 bp, Homo sapiens
ctgcggtccacccagga

SEQ ID NO: 4897063 - DNA, 23 bp, Homo sapiens
ctgcgtcttccgcccctgcctgc

SEQ ID NO: 4897064 - DNA, 17 bp, Homo sapiens
ctgcgttggtccagagc

SEQ ID NO: 4897065 - DNA, 17 bp, Homo sapiens
ctgctatttattttcct

SEQ ID NO: 4897066 - DNA, 19 bp, Homo sapiens
ctgctcacatatctgtcat

SEQ ID NO: 4897067 - DNA, 15 bp, Homo sapiens
ctgctcagccaagct

SEQ ID NO: 4897068 - DNA, 16 bp, Homo sapiens
ctgctcagccaagctt

SEQ ID NO: 4897069 - DNA, 13 bp, Homo sapiens
ctgctcaggctgc

SEQ ID NO: 4897070 - DNA, 16 bp, Homo sapiens
ctgctcaggctgcagc

SEQ ID NO: 4897071 - DNA, 18 bp, Homo sapiens
ctgctcaggctgcagctg

SEQ ID NO: 4897072 - DNA, 15 bp, Homo sapiens
ctgctccacccttgg

SEQ ID NO: 4897073 - DNA, 16 bp, Homo sapiens
ctgctccacccttggc

SEQ ID NO: 4897074 - DNA, 18 bp, Homo sapiens
ctgctccacccttggcct

SEQ ID NO: 4897075 - DNA, 12 bp, Homo sapiens
ctgctccaggga

SEQ ID NO: 4897076 - DNA, 16 bp, Homo sapiens
ctgctccccaggggag

SEQ ID NO: 4897077 - DNA, 15 bp, Homo sapiens
ctgctccctgaagcc

SEQ ID NO: 4897078 - DNA, 18 bp, Homo sapiens
ctgctccctgaagccagc

SEQ ID NO: 4897079 - DNA, 11 bp, Homo sapiens
ctgctcctcca

SEQ ID NO: 4897080 - DNA, 17 bp, Homo sapiens
ctgctcctctccccagc

SEQ ID NO: 4897081 - DNA, 18 bp, Homo sapiens
ctgctcctctccccagca

SEQ ID NO: 4897082 - DNA, 19 bp, Homo sapiens
ctgctcctctccccagcaa

SEQ ID NO: 4897083 - DNA, 20 bp, Homo sapiens
ctgctcctctccccagcaag

SEQ ID NO: 4897084 - DNA, 16 bp, Homo sapiens
ctgctcctgcagcatg

SEQ ID NO: 4897085 - DNA, 19 bp, Homo sapiens
ctgctccttggcttacctg

SEQ ID NO: 4897086 - DNA, 14 bp, Homo sapiens
ctgctcgccctcct

SEQ ID NO: 4897087 - DNA, 18 bp, Homo sapiens
ctgctcgccctcctttct

SEQ ID NO: 4897088 - DNA, 19 bp, Homo sapiens
ctgctcgccctcctttctg

SEQ ID NO: 4897089 - DNA, 19 bp, Homo sapiens
ctgctctccgaccagacac

SEQ ID NO: 4897090 - DNA, 12 bp, Homo sapiens
ctgctctggtta

SEQ ID NO: 4897091 - DNA, 14 bp, Homo sapiens
ctgctcttgtttct

SEQ ID NO: 4897092 - DNA, 12 bp, Homo sapiens
ctgctgacagtg

SEQ ID NO: 4897093 - DNA, 13 bp, Homo sapiens
ctgctgacagtgt

SEQ ID NO: 4897094 - DNA, 15 bp, Homo sapiens
ctgctgacagtgttg

SEQ ID NO: 4897095 - DNA, 20 bp, Homo sapiens
ctgctgcaggggctctggag

SEQ ID NO: 4897096 - DNA, 15 bp, Homo sapiens
ctgctgcagtagggg

SEQ ID NO: 4897097 - DNA, 16 bp, Homo sapiens
ctgctgcatggggtgg

SEQ ID NO: 4897098 - DNA, 13 bp, Homo sapiens
ctgctgcccaggc

SEQ ID NO: 4897099 - DNA, 17 bp, Homo sapiens
ctgctgccgcctcccag

SEQ ID NO: 4897100 - DNA, 11 bp, Homo sapiens
ctgctgcctgg

SEQ ID NO: 4897101 - DNA, 16 bp, Homo sapiens
ctgctgcctggccact

SEQ ID NO: 4897102 - DNA, 19 bp, Homo sapiens
ctgctgcctggccactgct

SEQ ID NO: 4897103 - DNA, 17 bp, Homo sapiens
ctgctgcgcccttacct

SEQ ID NO: 4897104 - DNA, 20 bp, Homo sapiens
ctgctgcgcccttaccttcc

SEQ ID NO: 4897105 - DNA, 21 bp, Homo sapiens
ctgctggagtttcatgtacaa

SEQ ID NO: 4897106 - DNA, 15 bp, Homo sapiens
ctgctggcatcaaga

SEQ ID NO: 4897107 - DNA, 12 bp, Homo sapiens
ctgctggctctt

SEQ ID NO: 4897108 - DNA, 12 bp, Homo sapiens
ctgctggctgcc

SEQ ID NO: 4897109 - DNA, 15 bp, Homo sapiens
ctgctggctgcctta

SEQ ID NO: 4897110 - DNA, 14 bp, Homo sapiens
ctgctggcttgcag

SEQ ID NO: 4897111 - DNA, 17 bp, Homo sapiens
ctgctggggcctcagac

SEQ ID NO: 4897112 - DNA, 20 bp, Homo sapiens
ctgctggtcacagcctcctc

SEQ ID NO: 4897113 - DNA, 20 bp, Homo sapiens
ctgctgtccctcccccttgt

SEQ ID NO: 4897114 - DNA, 19 bp, Homo sapiens
ctgcttagcttgcaccttg

SEQ ID NO: 4897115 - DNA, 19 bp, Homo sapiens
ctgcttcaaggcttccact

SEQ ID NO: 4897116 - DNA, 16 bp, Homo sapiens
ctgcttcagcctcccg

SEQ ID NO: 4897117 - DNA, 21 bp, Homo sapiens
ctgcttcagtgtatggaaata

SEQ ID NO: 4897118 - DNA, 20 bp, Homo sapiens
ctgcttcccacctccctgcc

SEQ ID NO: 4897119 - DNA, 21 bp, Homo sapiens
ctgcttcccacctccctgccc

SEQ ID NO: 4897120 - DNA, 23 bp, Homo sapiens
ctgcttccggtagggaggcagcc

SEQ ID NO: 4897121 - DNA, 16 bp, Homo sapiens
ctgcttgatgaagcaa

SEQ ID NO: 4897122 - DNA, 18 bp, Homo sapiens
ctgcttgatgaagcaagg

SEQ ID NO: 4897123 - DNA, 20 bp, Homo sapiens
ctgctttaaagggcctgcct

SEQ ID NO: 4897124 - DNA, 21 bp, Homo sapiens
ctgctttaaagggcctgcctg

SEQ ID NO: 4897125 - DNA, 16 bp, Homo sapiens
ctgctttgggctgccc

SEQ ID NO: 4897126 - DNA, 21 bp, Homo sapiens
ctgctttgggctgccctggtg

SEQ ID NO: 4897127 - DNA, 20 bp, Homo sapiens
ctgcttttgtctatgggact

SEQ ID NO: 4897128 - DNA, 15 bp, Homo sapiens
ctgctttttgaaatg

SEQ ID NO: 4897129 - DNA, 18 bp, Homo sapiens
ctgctttttgaaatgaaa

SEQ ID NO: 4897130 - DNA, 22 bp, Homo sapiens
ctgcttttttttttccagcaag

SEQ ID NO: 4897131 - DNA, 19 bp, Homo sapiens
ctggaaccttgctgtcctg

SEQ ID NO: 4897132 - DNA, 16 bp, Homo sapiens
ctggaacggtgaaggt

SEQ ID NO: 4897133 - DNA, 20 bp, Homo sapiens
ctggaactctatctgggcct

SEQ ID NO: 4897134 - DNA, 23 bp, Homo sapiens
ctggaactctatctgggcctggg

SEQ ID NO: 4897135 - DNA, 12 bp, Homo sapiens
ctggaagaaaaa

SEQ ID NO: 4897136 - DNA, 14 bp, Homo sapiens
ctggaagaaaaaaa

SEQ ID NO: 4897137 - DNA, 17 bp, Homo sapiens
ctggaagctaatttgca

SEQ ID NO: 4897138 - DNA, 22 bp, Homo sapiens
ctggaagctaatttgcattaaa

SEQ ID NO: 4897139 - DNA, 16 bp, Homo sapiens
ctggaagtccaatgtg

SEQ ID NO: 4897140 - DNA, 19 bp, Homo sapiens
ctggaagtccaatgtggca

SEQ ID NO: 4897141 - DNA, 17 bp, Homo sapiens
ctggaatctggagacca

SEQ ID NO: 4897142 - DNA, 18 bp, Homo sapiens
ctggaatctggagaccag

SEQ ID NO: 4897143 - DNA, 19 bp, Homo sapiens
ctggaatctggagaccagg

SEQ ID NO: 4897144 - DNA, 24 bp, Homo sapiens
ctggaatctggagaccagggagcc

SEQ ID NO: 4897145 - DNA, 17 bp, Homo sapiens
ctggacaccgggccagt

SEQ ID NO: 4897146 - DNA, 22 bp, Homo sapiens
ctggacaccgggccagtatcta

SEQ ID NO: 4897147 - DNA, 16 bp, Homo sapiens
ctggacactcagacct

SEQ ID NO: 4897148 - DNA, 13 bp, Homo sapiens
ctggacagagggg

SEQ ID NO: 4897149 - DNA, 14 bp, Homo sapiens
ctggacagagggga

SEQ ID NO: 4897150 - DNA, 20 bp, Homo sapiens
ctggacagaggggactctgg

SEQ ID NO: 4897151 - DNA, 22 bp, Homo sapiens
ctggacagaggggactctgggc

SEQ ID NO: 4897152 - DNA, 15 bp, Homo sapiens
ctggacaggctctgc

SEQ ID NO: 4897153 - DNA, 20 bp, Homo sapiens
ctggacagtatcccacatcc

SEQ ID NO: 4897154 - DNA, 18 bp, Homo sapiens
ctggacatttgccttgct

SEQ ID NO: 4897155 - DNA, 15 bp, Homo sapiens
ctggaccactgggca

SEQ ID NO: 4897156 - DNA, 12 bp, Homo sapiens
ctggacctgcct

SEQ ID NO: 4897157 - DNA, 17 bp, Homo sapiens
ctggaccttgaactggg

SEQ ID NO: 4897158 - DNA, 20 bp, Homo sapiens
ctggaccttgaactgggtac

SEQ ID NO: 4897159 - DNA, 17 bp, Homo sapiens
ctggacggaagtggtgg

SEQ ID NO: 4897160 - DNA, 14 bp, Homo sapiens
ctggactcctctgt

SEQ ID NO: 4897161 - DNA, 19 bp, Homo sapiens
ctggactcctctgtccagg

SEQ ID NO: 4897162 - DNA, 20 bp, Homo sapiens
ctggactcctctgtccaggc

SEQ ID NO: 4897163 - DNA, 18 bp, Homo sapiens
ctggactctaaagaccaa

SEQ ID NO: 4897164 - DNA, 23 bp, Homo sapiens
ctggactctgcatcccagcacct

SEQ ID NO: 4897165 - DNA, 12 bp, Homo sapiens
ctggactgacag

SEQ ID NO: 4897166 - DNA, 13 bp, Homo sapiens
ctggactgacagc

SEQ ID NO: 4897167 - DNA, 15 bp, Homo sapiens
ctggactggctagag

SEQ ID NO: 4897168 - DNA, 21 bp, Homo sapiens
ctggactggctagagtcctca

SEQ ID NO: 4897169 - DNA, 14 bp, Homo sapiens
ctggactgggaggt

SEQ ID NO: 4897170 - DNA, 17 bp, Homo sapiens
ctggactgggaggtaga

SEQ ID NO: 4897171 - DNA, 19 bp, Homo sapiens
ctggagaagaccctccccg

SEQ ID NO: 4897172 - DNA, 11 bp, Homo sapiens
ctggagacagc

SEQ ID NO: 4897173 - DNA, 13 bp, Homo sapiens
ctggagacagccc

SEQ ID NO: 4897174 - DNA, 14 bp, Homo sapiens
ctggagacagcccc

SEQ ID NO: 4897175 - DNA, 16 bp, Homo sapiens
ctggagacagccccag

SEQ ID NO: 4897176 - DNA, 20 bp, Homo sapiens
ctggagacagccccagagca

SEQ ID NO: 4897177 - DNA, 21 bp, Homo sapiens
ctggagacagccccagagcag

SEQ ID NO: 4897178 - DNA, 22 bp, Homo sapiens
ctggagacagccccagagcagg

SEQ ID NO: 4897179 - DNA, 23 bp, Homo sapiens
ctggagacagccccagagcaggg

SEQ ID NO: 4897180 - DNA, 19 bp, Homo sapiens
ctggagaccagggagcctt

SEQ ID NO: 4897181 - DNA, 19 bp, Homo sapiens
ctggagacccaccccacct

SEQ ID NO: 4897182 - DNA, 20 bp, Homo sapiens
ctggagacccaccccacctg

SEQ ID NO: 4897183 - DNA, 21 bp, Homo sapiens
ctggagacccaccccacctgc

SEQ ID NO: 4897184 - DNA, 20 bp, Homo sapiens
ctggagacgtggaacctctg

SEQ ID NO: 4897185 - DNA, 21 bp, Homo sapiens
ctggagacgtggaacctctgt

SEQ ID NO: 4897186 - DNA, 14 bp, Homo sapiens
ctggagccctaacc

SEQ ID NO: 4897187 - DNA, 23 bp, Homo sapiens
ctggagcctccactgcctctgga

SEQ ID NO: 4897188 - DNA, 21 bp, Homo sapiens
ctggaggccttccagctgctg

SEQ ID NO: 4897189 - DNA, 22 bp, Homo sapiens
ctggaggccttccagctgctgt

SEQ ID NO: 4897190 - DNA, 16 bp, Homo sapiens
ctggaggtggggcgag

SEQ ID NO: 4897191 - DNA, 12 bp, Homo sapiens
ctggagtctgga

SEQ ID NO: 4897192 - DNA, 13 bp, Homo sapiens
ctggagtctggag

SEQ ID NO: 4897193 - DNA, 17 bp, Homo sapiens
ctggagtgcagtgagcc

SEQ ID NO: 4897194 - DNA, 19 bp, Homo sapiens
ctggagtgcccaccctggg

SEQ ID NO: 4897195 - DNA, 16 bp, Homo sapiens
ctggagtgggcagagc

SEQ ID NO: 4897196 - DNA, 13 bp, Homo sapiens
ctggagtttcatg

SEQ ID NO: 4897197 - DNA, 18 bp, Homo sapiens
ctggagtttcatgtacaa

SEQ ID NO: 4897198 - DNA, 23 bp, Homo sapiens
ctggagtttttgtttggagagca

SEQ ID NO: 4897199 - DNA, 14 bp, Homo sapiens
ctggataacttagg

SEQ ID NO: 4897200 - DNA, 15 bp, Homo sapiens
ctggataggagcctg

SEQ ID NO: 4897201 - DNA, 19 bp, Homo sapiens
ctggataggagcctgctgg

SEQ ID NO: 4897202 - DNA, 16 bp, Homo sapiens
ctggatggagcccagg

SEQ ID NO: 4897203 - DNA, 21 bp, Homo sapiens
ctggatggaggaaaaccaagc

SEQ ID NO: 4897204 - DNA, 16 bp, Homo sapiens
ctggattcattgtctc

SEQ ID NO: 4897205 - DNA, 19 bp, Homo sapiens
ctggcaattgtctatttat

SEQ ID NO: 4897206 - DNA, 15 bp, Homo sapiens
ctggcacaggactga

SEQ ID NO: 4897207 - DNA, 18 bp, Homo sapiens
ctggcacaggactgattc

SEQ ID NO: 4897208 - DNA, 16 bp, Homo sapiens
ctggcacccggcccct

SEQ ID NO: 4897209 - DNA, 17 bp, Homo sapiens
ctggcacccggcccctg

SEQ ID NO: 4897210 - DNA, 18 bp, Homo sapiens
ctggcacccggcccctgc

SEQ ID NO: 4897211 - DNA, 19 bp, Homo sapiens
ctggcactgaattaatcat

SEQ ID NO: 4897212 - DNA, 13 bp, Homo sapiens
ctggcagcccaga

SEQ ID NO: 4897213 - DNA, 13 bp, Homo sapiens
ctggcagccgtgc

SEQ ID NO: 4897214 - DNA, 19 bp, Homo sapiens
ctggcagccgtgccttcag

SEQ ID NO: 4897215 - DNA, 22 bp, Homo sapiens
ctggcagccgtgccttcagctc

SEQ ID NO: 4897216 - DNA, 21 bp, Homo sapiens
ctggcagggaggtcaggccct

SEQ ID NO: 4897217 - DNA, 22 bp, Homo sapiens
ctggcatcaagaggtgggaggg

SEQ ID NO: 4897218 - DNA, 16 bp, Homo sapiens
ctggcattacagctgg

SEQ ID NO: 4897219 - DNA, 19 bp, Homo sapiens
ctggcattagaattattta

SEQ ID NO: 4897220 - DNA, 20 bp, Homo sapiens
ctggcattagaattatttaa

SEQ ID NO: 4897221 - DNA, 18 bp, Homo sapiens
ctggccacctctctcctt

SEQ ID NO: 4897222 - DNA, 14 bp, Homo sapiens
ctggccagatgcac

SEQ ID NO: 4897223 - DNA, 17 bp, Homo sapiens
ctggccagatgcaccag

SEQ ID NO: 4897224 - DNA, 19 bp, Homo sapiens
ctggccagatgcaccagcc

SEQ ID NO: 4897225 - DNA, 22 bp, Homo sapiens
ctggccagatgcaccagccctt

SEQ ID NO: 4897226 - DNA, 21 bp, Homo sapiens
ctggccagcctggggcctggc

SEQ ID NO: 4897227 - DNA, 23 bp, Homo sapiens
ctggccagcctggggcctggcag

SEQ ID NO: 4897228 - DNA, 12 bp, Homo sapiens
ctggccaggagc

SEQ ID NO: 4897229 - DNA, 22 bp, Homo sapiens
ctggccaggagctcttcaggcc

SEQ ID NO: 4897230 - DNA, 22 bp, Homo sapiens
ctggccaggcagatctgtgccc

SEQ ID NO: 4897231 - DNA, 17 bp, Homo sapiens
ctggccatccctcgtgg

SEQ ID NO: 4897232 - DNA, 13 bp, Homo sapiens
ctggcccagccaa

SEQ ID NO: 4897233 - DNA, 18 bp, Homo sapiens
ctggccccggatcagagc

SEQ ID NO: 4897234 - DNA, 24 bp, Homo sapiens
ctggccccggatcagagcaggacc

SEQ ID NO: 4897235 - DNA, 18 bp, Homo sapiens
ctggcccctcaacctcct

SEQ ID NO: 4897236 - DNA, 12 bp, Homo sapiens
ctggcccctggg

SEQ ID NO: 4897237 - DNA, 14 bp, Homo sapiens
ctggcccctgggtc

SEQ ID NO: 4897238 - DNA, 15 bp, Homo sapiens
ctggccctgccctga

SEQ ID NO: 4897239 - DNA, 19 bp, Homo sapiens
ctggccgagggtcctggct

SEQ ID NO: 4897240 - DNA, 22 bp, Homo sapiens
ctggccgcgtttagaccaagga

SEQ ID NO: 4897241 - DNA, 19 bp, Homo sapiens
ctggcctaaaatcttggaa

SEQ ID NO: 4897242 - DNA, 20 bp, Homo sapiens
ctggcctctaccacaagggc

SEQ ID NO: 4897243 - DNA, 16 bp, Homo sapiens
ctggcctctctagcac

SEQ ID NO: 4897244 - DNA, 17 bp, Homo sapiens
ctggcctctggctctca

SEQ ID NO: 4897245 - DNA, 11 bp, Homo sapiens
ctggcctctgt

SEQ ID NO: 4897246 - DNA, 15 bp, Homo sapiens
ctggcctctgtgcct

SEQ ID NO: 4897247 - DNA, 18 bp, Homo sapiens
ctggcctgacttggggga

SEQ ID NO: 4897248 - DNA, 11 bp, Homo sapiens
ctggcctggcc

SEQ ID NO: 4897249 - DNA, 13 bp, Homo sapiens
ctggcctggccct

SEQ ID NO: 4897250 - DNA, 19 bp, Homo sapiens
ctggcctggccctgccctg

SEQ ID NO: 4897251 - DNA, 21 bp, Homo sapiens
ctggcctggccctgccctgag

SEQ ID NO: 4897252 - DNA, 23 bp, Homo sapiens
ctggcctggccctgccctgagga

SEQ ID NO: 4897253 - DNA, 16 bp, Homo sapiens
ctggcctggcctggcc

SEQ ID NO: 4897254 - DNA, 20 bp, Homo sapiens
ctggctaaagataattgcta

SEQ ID NO: 4897255 - DNA, 20 bp, Homo sapiens
ctggctagaggccagcccca

SEQ ID NO: 4897256 - DNA, 15 bp, Homo sapiens
ctggctcacagtaca

SEQ ID NO: 4897257 - DNA, 22 bp, Homo sapiens
ctggctcccacaggcccttcct

SEQ ID NO: 4897258 - DNA, 14 bp, Homo sapiens
ctggctcctgaggg

SEQ ID NO: 4897259 - DNA, 16 bp, Homo sapiens
ctggctcctgaggggc

SEQ ID NO: 4897260 - DNA, 20 bp, Homo sapiens
ctggctctcccatttcctga

SEQ ID NO: 4897261 - DNA, 15 bp, Homo sapiens
ctggctctgctgtcc

SEQ ID NO: 4897262 - DNA, 14 bp, Homo sapiens
ctggctctgtggct

SEQ ID NO: 4897263 - DNA, 18 bp, Homo sapiens
ctggctctgtggcttgct

SEQ ID NO: 4897264 - DNA, 17 bp, Homo sapiens
ctggctcttctgcccaa

SEQ ID NO: 4897265 - DNA, 20 bp, Homo sapiens
ctggctcttgatacccccct

SEQ ID NO: 4897266 - DNA, 20 bp, Homo sapiens
ctggctctttcgtcaccctt

SEQ ID NO: 4897267 - DNA, 21 bp, Homo sapiens
ctggctgccccaacctgctga

SEQ ID NO: 4897268 - DNA, 19 bp, Homo sapiens
ctggctgccttagaacctt

SEQ ID NO: 4897269 - DNA, 15 bp, Homo sapiens
ctggctgtaaggctc

SEQ ID NO: 4897270 - DNA, 16 bp, Homo sapiens
ctggctgtaaggctct

SEQ ID NO: 4897271 - DNA, 20 bp, Homo sapiens
ctggctgtaaggctctagat

SEQ ID NO: 4897272 - DNA, 16 bp, Homo sapiens
ctggctgttggctggg

SEQ ID NO: 4897273 - DNA, 15 bp, Homo sapiens
ctggcttattttaat

SEQ ID NO: 4897274 - DNA, 18 bp, Homo sapiens
ctggcttccttctctcaa

SEQ ID NO: 4897275 - DNA, 16 bp, Homo sapiens
ctggcttttcactgct

SEQ ID NO: 4897276 - DNA, 17 bp, Homo sapiens
ctggcttttcactgctg

SEQ ID NO: 4897277 - DNA, 20 bp, Homo sapiens
ctggcttttcactgctggct

SEQ ID NO: 4897278 - DNA, 19 bp, Homo sapiens
ctgggaaatgagaaggcag

SEQ ID NO: 4897279 - DNA, 23 bp, Homo sapiens
ctgggaaatgagaaggcagccac

SEQ ID NO: 4897280 - DNA, 18 bp, Homo sapiens
ctgggaacctcccagagg

SEQ ID NO: 4897281 - DNA, 13 bp, Homo sapiens
ctgggaagggaag

SEQ ID NO: 4897282 - DNA, 22 bp, Homo sapiens
ctgggacagtttatcatgaagc

SEQ ID NO: 4897283 - DNA, 23 bp, Homo sapiens
ctgggacagtttatcatgaagcc

SEQ ID NO: 4897284 - DNA, 13 bp, Homo sapiens
ctgggactacagg

SEQ ID NO: 4897285 - DNA, 15 bp, Homo sapiens
ctgggagctctgcag

SEQ ID NO: 4897286 - DNA, 23 bp, Homo sapiens
ctgggagtagttgtctttcctgg

SEQ ID NO: 4897287 - DNA, 21 bp, Homo sapiens
ctgggatgagccgctgtgagc

SEQ ID NO: 4897288 - DNA, 15 bp, Homo sapiens
ctgggcaacagagca

SEQ ID NO: 4897289 - DNA, 18 bp, Homo sapiens
ctgggcaacagagcaaga

SEQ ID NO: 4897290 - DNA, 19 bp, Homo sapiens
ctgggcaaggaaaaagaaa

SEQ ID NO: 4897291 - DNA, 21 bp, Homo sapiens
ctgggcacactctgccagcaa

SEQ ID NO: 4897292 - DNA, 22 bp, Homo sapiens
ctgggcacactctgccagcaaa

SEQ ID NO: 4897293 - DNA, 17 bp, Homo sapiens
ctgggcagcatagcaag

SEQ ID NO: 4897294 - DNA, 15 bp, Homo sapiens
ctgggcagccaggct

SEQ ID NO: 4897295 - DNA, 20 bp, Homo sapiens
ctgggcatggtaccagccct

SEQ ID NO: 4897296 - DNA, 21 bp, Homo sapiens
ctgggcatggtaccagccctg

SEQ ID NO: 4897297 - DNA, 14 bp, Homo sapiens
ctgggccagggtct

SEQ ID NO: 4897298 - DNA, 20 bp, Homo sapiens
ctgggccagggtctgtgtga

SEQ ID NO: 4897299 - DNA, 18 bp, Homo sapiens
ctgggccatgtccaaaga

SEQ ID NO: 4897300 - DNA, 19 bp, Homo sapiens
ctgggccatgtccaaagag

SEQ ID NO: 4897301 - DNA, 13 bp, Homo sapiens
ctgggccccagct

SEQ ID NO: 4897302 - DNA, 11 bp, Homo sapiens
ctgggcctggg

SEQ ID NO: 4897303 - DNA, 18 bp, Homo sapiens
ctgggctaggtagaaaaa

SEQ ID NO: 4897304 - DNA, 14 bp, Homo sapiens
ctgggctatggaca

SEQ ID NO: 4897305 - DNA, 16 bp, Homo sapiens
ctgggctatggacaca

SEQ ID NO: 4897306 - DNA, 15 bp, Homo sapiens
ctgggctcggaggct

SEQ ID NO: 4897307 - DNA, 17 bp, Homo sapiens
ctgggctcggaggctgc

SEQ ID NO: 4897308 - DNA, 22 bp, Homo sapiens
ctgggctggccagttggaacca

SEQ ID NO: 4897309 - DNA, 18 bp, Homo sapiens
ctgggctggggaggacct

SEQ ID NO: 4897310 - DNA, 19 bp, Homo sapiens
ctgggcttcagtggcagct

SEQ ID NO: 4897311 - DNA, 24 bp, Homo sapiens
ctgggcttcagtggcagctgcttt

SEQ ID NO: 4897312 - DNA, 21 bp, Homo sapiens
ctggggaaagacactgcctgg

SEQ ID NO: 4897313 - DNA, 19 bp, Homo sapiens
ctggggacgctccgctgcc

SEQ ID NO: 4897314 - DNA, 20 bp, Homo sapiens
ctggggagcccgtctcagtg

SEQ ID NO: 4897315 - DNA, 14 bp, Homo sapiens
ctggggaggacctg

SEQ ID NO: 4897316 - DNA, 16 bp, Homo sapiens
ctggggcacagtccag

SEQ ID NO: 4897317 - DNA, 12 bp, Homo sapiens
ctggggcaggct

SEQ ID NO: 4897318 - DNA, 14 bp, Homo sapiens
ctggggcaggctgg

SEQ ID NO: 4897319 - DNA, 17 bp, Homo sapiens
ctggggcaggctgggcc

SEQ ID NO: 4897320 - DNA, 11 bp, Homo sapiens
ctggggcctcc

SEQ ID NO: 4897321 - DNA, 15 bp, Homo sapiens
ctggggcctccagaa

SEQ ID NO: 4897322 - DNA, 15 bp, Homo sapiens
ctggggcctgagaga

SEQ ID NO: 4897323 - DNA, 17 bp, Homo sapiens
ctggggcctgagagaat

SEQ ID NO: 4897324 - DNA, 14 bp, Homo sapiens
ctggggcctggacc

SEQ ID NO: 4897325 - DNA, 16 bp, Homo sapiens
ctggggcctggacctg

SEQ ID NO: 4897326 - DNA, 19 bp, Homo sapiens
ctggggcctggacctgcct

SEQ ID NO: 4897327 - DNA, 19 bp, Homo sapiens
ctggggcctggcagggagg

SEQ ID NO: 4897328 - DNA, 13 bp, Homo sapiens
ctggggctgggcc

SEQ ID NO: 4897329 - DNA, 14 bp, Homo sapiens
ctggggctgggccc

SEQ ID NO: 4897330 - DNA, 18 bp, Homo sapiens
ctgggggagttttcctct

SEQ ID NO: 4897331 - DNA, 12 bp, Homo sapiens
ctgggggcagga

SEQ ID NO: 4897332 - DNA, 14 bp, Homo sapiens
ctgggggcaggagg

SEQ ID NO: 4897333 - DNA, 19 bp, Homo sapiens
ctgggggcaggagggccct

SEQ ID NO: 4897334 - DNA, 13 bp, Homo sapiens
ctgggggcctcag

SEQ ID NO: 4897335 - DNA, 14 bp, Homo sapiens
ctggggtgggaggt

SEQ ID NO: 4897336 - DNA, 20 bp, Homo sapiens
ctggggtgggaggtcttgct

SEQ ID NO: 4897337 - DNA, 18 bp, Homo sapiens
ctgggtacttgtggacac

SEQ ID NO: 4897338 - DNA, 22 bp, Homo sapiens
ctgggtctcgctttgttgccca

SEQ ID NO: 4897339 - DNA, 20 bp, Homo sapiens
ctgggtggatcggcctcctc

SEQ ID NO: 4897340 - DNA, 19 bp, Homo sapiens
ctgggtggcctcgggacac

SEQ ID NO: 4897341 - DNA, 13 bp, Homo sapiens
ctgggtgtcattt

SEQ ID NO: 4897342 - DNA, 15 bp, Homo sapiens
ctgggttcactgcaa

SEQ ID NO: 4897343 - DNA, 18 bp, Homo sapiens
ctgggttcactgcaacct

SEQ ID NO: 4897344 - DNA, 16 bp, Homo sapiens
ctgggttccctttcct

SEQ ID NO: 4897345 - DNA, 13 bp, Homo sapiens
ctgggttggaggg

SEQ ID NO: 4897346 - DNA, 16 bp, Homo sapiens
ctggtaaactatttgt

SEQ ID NO: 4897347 - DNA, 20 bp, Homo sapiens
ctggtacttagagtttctgt

SEQ ID NO: 4897348 - DNA, 20 bp, Homo sapiens
ctggtattggtggctttcct

SEQ ID NO: 4897349 - DNA, 13 bp, Homo sapiens
ctggtcaaagaaa

SEQ ID NO: 4897350 - DNA, 15 bp, Homo sapiens
ctggtcacagcctcc

SEQ ID NO: 4897351 - DNA, 16 bp, Homo sapiens
ctggtcacagcctcct

SEQ ID NO: 4897352 - DNA, 17 bp, Homo sapiens
ctggtcacagcctcctc

SEQ ID NO: 4897353 - DNA, 20 bp, Homo sapiens
ctggtcacaggactctgcct

SEQ ID NO: 4897354 - DNA, 22 bp, Homo sapiens
ctggtcacaggactctgcctcc

SEQ ID NO: 4897355 - DNA, 23 bp, Homo sapiens
ctggtcacaggactctgcctcct

SEQ ID NO: 4897356 - DNA, 23 bp, Homo sapiens
ctggtcacagggcatgccccggc

SEQ ID NO: 4897357 - DNA, 16 bp, Homo sapiens
ctggtcaggccctggt

SEQ ID NO: 4897358 - DNA, 21 bp, Homo sapiens
ctggtcccttgcagctagttt

SEQ ID NO: 4897359 - DNA, 20 bp, Homo sapiens
ctggtcttgtggaattggga

SEQ ID NO: 4897360 - DNA, 15 bp, Homo sapiens
ctggtctttcctctg

SEQ ID NO: 4897361 - DNA, 20 bp, Homo sapiens
ctggtgaatggccttccttc

SEQ ID NO: 4897362 - DNA, 13 bp, Homo sapiens
ctggtggcagctg

SEQ ID NO: 4897363 - DNA, 19 bp, Homo sapiens
ctggtggcagtgggagctg

SEQ ID NO: 4897364 - DNA, 20 bp, Homo sapiens
ctggtggcccgacagcctgg

SEQ ID NO: 4897365 - DNA, 22 bp, Homo sapiens
ctggtgggaggggcgcccacct

SEQ ID NO: 4897366 - DNA, 17 bp, Homo sapiens
ctggtgtgacctgaggg

SEQ ID NO: 4897367 - DNA, 18 bp, Homo sapiens
ctggtgtgacctgagggc

SEQ ID NO: 4897368 - DNA, 16 bp, Homo sapiens
ctggtttctcattctt

SEQ ID NO: 4897369 - DNA, 19 bp, Homo sapiens
ctgtaaaaacactgaaaaa

SEQ ID NO: 4897370 - DNA, 12 bp, Homo sapiens
ctgtaaaacgct

SEQ ID NO: 4897371 - DNA, 19 bp, Homo sapiens
ctgtaaaagagcctagttt

SEQ ID NO: 4897372 - DNA, 15 bp, Homo sapiens
ctgtaacacagctga

SEQ ID NO: 4897373 - DNA, 14 bp, Homo sapiens
ctgtaagccaaaga

SEQ ID NO: 4897374 - DNA, 21 bp, Homo sapiens
ctgtaagccaaagaaatgaac

SEQ ID NO: 4897375 - DNA, 13 bp, Homo sapiens
ctgtaagcctgca

SEQ ID NO: 4897376 - DNA, 17 bp, Homo sapiens
ctgtaagcctgcaagcc

SEQ ID NO: 4897377 - DNA, 18 bp, Homo sapiens
ctgtaagcctgcaagcct

SEQ ID NO: 4897378 - DNA, 16 bp, Homo sapiens
ctgtaaggctctagat

SEQ ID NO: 4897379 - DNA, 17 bp, Homo sapiens
ctgtaaggctctagatc

SEQ ID NO: 4897380 - DNA, 16 bp, Homo sapiens
ctgtacacgtgtcctg

SEQ ID NO: 4897381 - DNA, 17 bp, Homo sapiens
ctgtacacgtgtcctgt

SEQ ID NO: 4897382 - DNA, 16 bp, Homo sapiens
ctgtacatatgtaaac

SEQ ID NO: 4897383 - DNA, 16 bp, Homo sapiens
ctgtacatttaaaatt

SEQ ID NO: 4897384 - DNA, 20 bp, Homo sapiens
ctgtacattttgttgtaaaa

SEQ ID NO: 4897385 - DNA, 21 bp, Homo sapiens
ctgtacctgttccttagacct

SEQ ID NO: 4897386 - DNA, 18 bp, Homo sapiens
ctgtacgtctgacaggca

SEQ ID NO: 4897387 - DNA, 19 bp, Homo sapiens
ctgtacgtctgacaggcaa

SEQ ID NO: 4897388 - DNA, 18 bp, Homo sapiens
ctgtactctggggtgctg

SEQ ID NO: 4897389 - DNA, 16 bp, Homo sapiens
ctgtactgctcaggct

SEQ ID NO: 4897390 - DNA, 20 bp, Homo sapiens
ctgtactgttctgtgtcttt

SEQ ID NO: 4897391 - DNA, 18 bp, Homo sapiens
ctgtagagccttctgatg

SEQ ID NO: 4897392 - DNA, 13 bp, Homo sapiens
ctgtagattctgt

SEQ ID NO: 4897393 - DNA, 20 bp, Homo sapiens
ctgtagattctgtggaacaa

SEQ ID NO: 4897394 - DNA, 20 bp, Homo sapiens
ctgtagcagtgagaaaaagc

SEQ ID NO: 4897395 - DNA, 18 bp, Homo sapiens
ctgtagcttgttccctgt

SEQ ID NO: 4897396 - DNA, 22 bp, Homo sapiens
ctgtaggagctacccttttcct

SEQ ID NO: 4897397 - DNA, 21 bp, Homo sapiens
ctgtagtagccctttctgtgt

SEQ ID NO: 4897398 - DNA, 17 bp, Homo sapiens
ctgtagtcatttactaa

SEQ ID NO: 4897399 - DNA, 23 bp, Homo sapiens
ctgtagtcctagccactcaggag

SEQ ID NO: 4897400 - DNA, 14 bp, Homo sapiens
ctgtagttaggaaa

SEQ ID NO: 4897401 - DNA, 21 bp, Homo sapiens
ctgtagttaggaaataaaacc

SEQ ID NO: 4897402 - DNA, 17 bp, Homo sapiens
ctgtagttttattttat

SEQ ID NO: 4897403 - DNA, 20 bp, Homo sapiens
ctgtagttttattttatgtt

SEQ ID NO: 4897404 - DNA, 19 bp, Homo sapiens
ctgtataaataggagagga

SEQ ID NO: 4897405 - DNA, 21 bp, Homo sapiens
ctgtataaataggagaggatg

SEQ ID NO: 4897406 - DNA, 16 bp, Homo sapiens
ctgtatagacagtttg

SEQ ID NO: 4897407 - DNA, 16 bp, Homo sapiens
ctgtatagttaggata

SEQ ID NO: 4897408 - DNA, 21 bp, Homo sapiens
ctgtatagttaggatagcatt

SEQ ID NO: 4897409 - DNA, 14 bp, Homo sapiens
ctgtatatactttt

SEQ ID NO: 4897410 - DNA, 17 bp, Homo sapiens
ctgtatcaagtcatggc

SEQ ID NO: 4897411 - DNA, 21 bp, Homo sapiens
ctgtatcccatgagcctcagc

SEQ ID NO: 4897412 - DNA, 13 bp, Homo sapiens
ctgtatctgtgta

SEQ ID NO: 4897413 - DNA, 14 bp, Homo sapiens
ctgtatctgtgtag

SEQ ID NO: 4897414 - DNA, 18 bp, Homo sapiens
ctgtatctgtgtagacta

SEQ ID NO: 4897415 - DNA, 15 bp, Homo sapiens
ctgtatttaagcaaa

SEQ ID NO: 4897416 - DNA, 15 bp, Homo sapiens
ctgtatttcatgtgg

SEQ ID NO: 4897417 - DNA, 21 bp, Homo sapiens
ctgtcaaaacaagtttttctg

SEQ ID NO: 4897418 - DNA, 14 bp, Homo sapiens
ctgtcaaaacactg

SEQ ID NO: 4897419 - DNA, 15 bp, Homo sapiens
ctgtcaaaacactgt

SEQ ID NO: 4897420 - DNA, 16 bp, Homo sapiens
ctgtcaaaacactgtg

SEQ ID NO: 4897421 - DNA, 17 bp, Homo sapiens
ctgtcaaaacactgtgg

SEQ ID NO: 4897422 - DNA, 13 bp, Homo sapiens
ctgtcacattgca

SEQ ID NO: 4897423 - DNA, 18 bp, Homo sapiens
ctgtcacattgcattcta

SEQ ID NO: 4897424 - DNA, 16 bp, Homo sapiens
ctgtcaccctccacct

SEQ ID NO: 4897425 - DNA, 21 bp, Homo sapiens
ctgtcactcattgctgagcct

SEQ ID NO: 4897426 - DNA, 17 bp, Homo sapiens
ctgtcagaatgctattg

SEQ ID NO: 4897427 - DNA, 17 bp, Homo sapiens
ctgtcagatgagaacaa

SEQ ID NO: 4897428 - DNA, 18 bp, Homo sapiens
ctgtcagatgagaacaaa

SEQ ID NO: 4897429 - DNA, 19 bp, Homo sapiens
ctgtcagatgagaacaaag

SEQ ID NO: 4897430 - DNA, 16 bp, Homo sapiens
ctgtcatagaaattac

SEQ ID NO: 4897431 - DNA, 14 bp, Homo sapiens
ctgtcatctttctt

SEQ ID NO: 4897432 - DNA, 19 bp, Homo sapiens
ctgtcattcaaatgggtga

SEQ ID NO: 4897433 - DNA, 20 bp, Homo sapiens
ctgtcatttgagcagggctc

SEQ ID NO: 4897434 - DNA, 17 bp, Homo sapiens
ctgtccaggcactgctg

SEQ ID NO: 4897435 - DNA, 16 bp, Homo sapiens
ctgtccatcagccagg

SEQ ID NO: 4897436 - DNA, 21 bp, Homo sapiens
ctgtccatttatccacaggaa

SEQ ID NO: 4897437 - DNA, 18 bp, Homo sapiens
ctgtcccatgcaggccct

SEQ ID NO: 4897438 - DNA, 17 bp, Homo sapiens
ctgtcccatggacactc

SEQ ID NO: 4897439 - DNA, 15 bp, Homo sapiens
ctgtccccgcagccc

SEQ ID NO: 4897440 - DNA, 18 bp, Homo sapiens
ctgtccccgtgttgcatg

SEQ ID NO: 4897441 - DNA, 15 bp, Homo sapiens
ctgtccccttggcag

SEQ ID NO: 4897442 - DNA, 17 bp, Homo sapiens
ctgtccctcccacctct

SEQ ID NO: 4897443 - DNA, 19 bp, Homo sapiens
ctgtccctcccacctctgt

SEQ ID NO: 4897444 - DNA, 20 bp, Homo sapiens
ctgtcctaaggaaccttcct

SEQ ID NO: 4897445 - DNA, 17 bp, Homo sapiens
ctgtcctactctgtgtc

SEQ ID NO: 4897446 - DNA, 19 bp, Homo sapiens
ctgtcctcactgctccctg

SEQ ID NO: 4897447 - DNA, 14 bp, Homo sapiens
ctgtcctccctcca

SEQ ID NO: 4897448 - DNA, 14 bp, Homo sapiens
ctgtcctctcccct

SEQ ID NO: 4897449 - DNA, 16 bp, Homo sapiens
ctgtcctctcccctcc

SEQ ID NO: 4897450 - DNA, 14 bp, Homo sapiens
ctgtcctgggagtg

SEQ ID NO: 4897451 - DNA, 21 bp, Homo sapiens
ctgtcgtgatggggcaagggc

SEQ ID NO: 4897452 - DNA, 18 bp, Homo sapiens
ctgtctcaagagggcact

SEQ ID NO: 4897453 - DNA, 19 bp, Homo sapiens
ctgtctcaagagggcactg

SEQ ID NO: 4897454 - DNA, 20 bp, Homo sapiens
ctgtctcaagagggcactgg

SEQ ID NO: 4897455 - DNA, 22 bp, Homo sapiens
ctgtctcaagagggcactggtg

SEQ ID NO: 4897456 - DNA, 14 bp, Homo sapiens
ctgtctcagacttt

SEQ ID NO: 4897457 - DNA, 14 bp, Homo sapiens
ctgtctcagcctcc

SEQ ID NO: 4897458 - DNA, 16 bp, Homo sapiens
ctgtctcagcctccca

SEQ ID NO: 4897459 - DNA, 17 bp, Homo sapiens
ctgtctcatcctcctgg

SEQ ID NO: 4897460 - DNA, 18 bp, Homo sapiens
ctgtctcatcctcctgga

SEQ ID NO: 4897461 - DNA, 16 bp, Homo sapiens
ctgtctctaacttatt

SEQ ID NO: 4897462 - DNA, 21 bp, Homo sapiens
ctgtctctgctcgccctcctt

SEQ ID NO: 4897463 - DNA, 18 bp, Homo sapiens
ctgtctcttgaaaaatgc

SEQ ID NO: 4897464 - DNA, 23 bp, Homo sapiens
ctgtctctttaagggcatgcctt

SEQ ID NO: 4897465 - DNA, 14 bp, Homo sapiens
ctgtctgattggct

SEQ ID NO: 4897466 - DNA, 17 bp, Homo sapiens
ctgtctggttttaacaa

SEQ ID NO: 4897467 - DNA, 18 bp, Homo sapiens
ctgtctggttttaacaat

SEQ ID NO: 4897468 - DNA, 12 bp, Homo sapiens
ctgtctgtggct

SEQ ID NO: 4897469 - DNA, 19 bp, Homo sapiens
ctgtcttcacagctctgtg

SEQ ID NO: 4897470 - DNA, 13 bp, Homo sapiens
ctgtcttgtaata

SEQ ID NO: 4897471 - DNA, 20 bp, Homo sapiens
ctgtcttgtaatattttgta

SEQ ID NO: 4897472 - DNA, 16 bp, Homo sapiens
ctgtctttaaggaaaa

SEQ ID NO: 4897473 - DNA, 22 bp, Homo sapiens
ctgtctttggaaaaatgtttgt

SEQ ID NO: 4897474 - DNA, 23 bp, Homo sapiens
ctgtgaaactggcactgaattaa

SEQ ID NO: 4897475 - DNA, 18 bp, Homo sapiens
ctgtgaagtttacattgt

SEQ ID NO: 4897476 - DNA, 23 bp, Homo sapiens
ctgtgaagtttacattgtaaata

SEQ ID NO: 4897477 - DNA, 23 bp, Homo sapiens
ctgtgacctcaggcactagcctt

SEQ ID NO: 4897478 - DNA, 21 bp, Homo sapiens
ctgtgacttctccaggtctca

SEQ ID NO: 4897479 - DNA, 14 bp, Homo sapiens
ctgtgagaccccca

SEQ ID NO: 4897480 - DNA, 23 bp, Homo sapiens
ctgtgagcaaggagcacaagcca

SEQ ID NO: 4897481 - DNA, 15 bp, Homo sapiens
ctgtgagcccctggt

SEQ ID NO: 4897482 - DNA, 16 bp, Homo sapiens
ctgtgagcccctggtc

SEQ ID NO: 4897483 - DNA, 21 bp, Homo sapiens
ctgtgagcccctggtcctgag

SEQ ID NO: 4897484 - DNA, 12 bp, Homo sapiens
ctgtgagccttg

SEQ ID NO: 4897485 - DNA, 20 bp, Homo sapiens
ctgtgaggaaagcacacagt

SEQ ID NO: 4897486 - DNA, 17 bp, Homo sapiens
ctgtgagtaaatattga

SEQ ID NO: 4897487 - DNA, 19 bp, Homo sapiens
ctgtgatagttcaccccct

SEQ ID NO: 4897488 - DNA, 15 bp, Homo sapiens
ctgtgatcatttatt

SEQ ID NO: 4897489 - DNA, 17 bp, Homo sapiens
ctgtgatcttttaaagt

SEQ ID NO: 4897490 - DNA, 14 bp, Homo sapiens
ctgtgatgagctga

SEQ ID NO: 4897491 - DNA, 16 bp, Homo sapiens
ctgtgatgagctgatc

SEQ ID NO: 4897492 - DNA, 18 bp, Homo sapiens
ctgtgatgagctgatctg

SEQ ID NO: 4897493 - DNA, 12 bp, Homo sapiens
ctgtgcacacac

SEQ ID NO: 4897494 - DNA, 21 bp, Homo sapiens
ctgtgcagcgcagctggactc

SEQ ID NO: 4897495 - DNA, 15 bp, Homo sapiens
ctgtgcatgtatgtc

SEQ ID NO: 4897496 - DNA, 17 bp, Homo sapiens
ctgtgcatttctggttg

SEQ ID NO: 4897497 - DNA, 16 bp, Homo sapiens
ctgtgccatgtgccag

SEQ ID NO: 4897498 - DNA, 11 bp, Homo sapiens
ctgtgcctctg

SEQ ID NO: 4897499 - DNA, 14 bp, Homo sapiens
ctgtgcctctgcct

SEQ ID NO: 4897500 - DNA, 19 bp, Homo sapiens
ctgtgccttcttttgatta

SEQ ID NO: 4897501 - DNA, 19 bp, Homo sapiens
ctgtgcctttgcaaatcag

SEQ ID NO: 4897502 - DNA, 13 bp, Homo sapiens
ctgtgctcagaga

SEQ ID NO: 4897503 - DNA, 16 bp, Homo sapiens
ctgtgctctcaccagc

SEQ ID NO: 4897504 - DNA, 19 bp, Homo sapiens
ctgtgctgctgttactgtt

SEQ ID NO: 4897505 - DNA, 20 bp, Homo sapiens
ctgtgctgctgttactgtta

SEQ ID NO: 4897506 - DNA, 23 bp, Homo sapiens
ctgtgctgggggaatgagcccag

SEQ ID NO: 4897507 - DNA, 15 bp, Homo sapiens
ctgtgctgtggaagc

SEQ ID NO: 4897508 - DNA, 23 bp, Homo sapiens
ctgtggaacccagcagttctgtt

SEQ ID NO: 4897509 - DNA, 22 bp, Homo sapiens
ctgtggaactaataaatacata

SEQ ID NO: 4897510 - DNA, 21 bp, Homo sapiens
ctgtggaatgagtgtgcatgg

SEQ ID NO: 4897511 - DNA, 14 bp, Homo sapiens
ctgtggagactggg

SEQ ID NO: 4897512 - DNA, 14 bp, Homo sapiens
ctgtggaggaagga

SEQ ID NO: 4897513 - DNA, 16 bp, Homo sapiens
ctgtggaggaaggatt

SEQ ID NO: 4897514 - DNA, 21 bp, Homo sapiens
ctgtggaggaaggattgtaaa

SEQ ID NO: 4897515 - DNA, 17 bp, Homo sapiens
ctgtggcacttgcctgg

SEQ ID NO: 4897516 - DNA, 21 bp, Homo sapiens
ctgtggcacttgcctgggtca

SEQ ID NO: 4897517 - DNA, 16 bp, Homo sapiens
ctgtggcattgaaatg

SEQ ID NO: 4897518 - DNA, 19 bp, Homo sapiens
ctgtggccgttatctggaa

SEQ ID NO: 4897519 - DNA, 21 bp, Homo sapiens
ctgtggccgttatctggaagt

SEQ ID NO: 4897520 - DNA, 20 bp, Homo sapiens
ctgtgggagggactttgctg

SEQ ID NO: 4897521 - DNA, 20 bp, Homo sapiens
ctgtgggggtgtgccccctt

SEQ ID NO: 4897522 - DNA, 23 bp, Homo sapiens
ctgtgtacataactctgtaaaaa

SEQ ID NO: 4897523 - DNA, 12 bp, Homo sapiens
ctgtgtactgtg

SEQ ID NO: 4897524 - DNA, 13 bp, Homo sapiens
ctgtgtatattat

SEQ ID NO: 4897525 - DNA, 14 bp, Homo sapiens
ctgtgtcacccagg

SEQ ID NO: 4897526 - DNA, 21 bp, Homo sapiens
ctgtgtcaggtggggcagctt

SEQ ID NO: 4897527 - DNA, 22 bp, Homo sapiens
ctgtgtcaggtggggcagcttg

SEQ ID NO: 4897528 - DNA, 15 bp, Homo sapiens
ctgtgtcataaacag

SEQ ID NO: 4897529 - DNA, 15 bp, Homo sapiens
ctgtgtccttccctg

SEQ ID NO: 4897530 - DNA, 18 bp, Homo sapiens
ctgtgtctaagattctag

SEQ ID NO: 4897531 - DNA, 19 bp, Homo sapiens
ctgtgtctaagattctaga

SEQ ID NO: 4897532 - DNA, 22 bp, Homo sapiens
ctgtgtcttgcaatggcagcct

SEQ ID NO: 4897533 - DNA, 23 bp, Homo sapiens
ctgtgtcttgcaatggcagcctt

SEQ ID NO: 4897534 - DNA, 20 bp, Homo sapiens
ctgtgtctttcacagctcct

SEQ ID NO: 4897535 - DNA, 20 bp, Homo sapiens
ctgtgtcttttttcactaca

SEQ ID NO: 4897536 - DNA, 13 bp, Homo sapiens
ctgtgtgaaaatg

SEQ ID NO: 4897537 - DNA, 15 bp, Homo sapiens
ctgtgtgcagtgaag

SEQ ID NO: 4897538 - DNA, 16 bp, Homo sapiens
ctgtgtgtgtgaatga

SEQ ID NO: 4897539 - DNA, 17 bp, Homo sapiens
ctgtgtgtgtgaatgaa

SEQ ID NO: 4897540 - DNA, 21 bp, Homo sapiens
ctgtgtgtgtgaatgaacact

SEQ ID NO: 4897541 - DNA, 21 bp, Homo sapiens
ctgtgttgtattaacaaaagt

SEQ ID NO: 4897542 - DNA, 18 bp, Homo sapiens
ctgtgtttaatttcttca

SEQ ID NO: 4897543 - DNA, 16 bp, Homo sapiens
ctgtgtttaatttgac

SEQ ID NO: 4897544 - DNA, 12 bp, Homo sapiens
ctgttaaaatct

SEQ ID NO: 4897545 - DNA, 19 bp, Homo sapiens
ctgttaaaatctattctgt

SEQ ID NO: 4897546 - DNA, 12 bp, Homo sapiens
ctgttaaactgt

SEQ ID NO: 4897547 - DNA, 14 bp, Homo sapiens
ctgttaaactgtta

SEQ ID NO: 4897548 - DNA, 23 bp, Homo sapiens
ctgttaaactgttagcactgttg

SEQ ID NO: 4897549 - DNA, 19 bp, Homo sapiens
ctgttaatagatcttaggg

SEQ ID NO: 4897550 - DNA, 23 bp, Homo sapiens
ctgttacataacaagaaaatcaa

SEQ ID NO: 4897551 - DNA, 18 bp, Homo sapiens
ctgttaggagaagctgca

SEQ ID NO: 4897552 - DNA, 14 bp, Homo sapiens
ctgttatgtactgt

SEQ ID NO: 4897553 - DNA, 15 bp, Homo sapiens
ctgttatgtactgta

SEQ ID NO: 4897554 - DNA, 12 bp, Homo sapiens
ctgttatgtctg

SEQ ID NO: 4897555 - DNA, 16 bp, Homo sapiens
ctgttatgtctgttta

SEQ ID NO: 4897556 - DNA, 17 bp, Homo sapiens
ctgttatgtctgtttaa

SEQ ID NO: 4897557 - DNA, 20 bp, Homo sapiens
ctgttatgtctgtttaagaa

SEQ ID NO: 4897558 - DNA, 22 bp, Homo sapiens
ctgttatgtctgtttaagaaaa

SEQ ID NO: 4897559 - DNA, 16 bp, Homo sapiens
ctgttatttagactca

SEQ ID NO: 4897560 - DNA, 13 bp, Homo sapiens
ctgttcactctac

SEQ ID NO: 4897561 - DNA, 16 bp, Homo sapiens
ctgttcacttttcctc

SEQ ID NO: 4897562 - DNA, 17 bp, Homo sapiens
ctgttcacttttcctcc

SEQ ID NO: 4897563 - DNA, 14 bp, Homo sapiens
ctgttcagctccag

SEQ ID NO: 4897564 - DNA, 18 bp, Homo sapiens
ctgttcagctccagctca

SEQ ID NO: 4897565 - DNA, 22 bp, Homo sapiens
ctgttcagctccagctcaccag

SEQ ID NO: 4897566 - DNA, 12 bp, Homo sapiens
ctgttctaaagc

SEQ ID NO: 4897567 - DNA, 16 bp, Homo sapiens
ctgttctaaagctctg

SEQ ID NO: 4897568 - DNA, 22 bp, Homo sapiens
ctgttctaagggggaggggaag

SEQ ID NO: 4897569 - DNA, 15 bp, Homo sapiens
ctgttctgcactgaa

SEQ ID NO: 4897570 - DNA, 16 bp, Homo sapiens
ctgttctgcactgaaa

SEQ ID NO: 4897571 - DNA, 14 bp, Homo sapiens
ctgttctgcagaca

SEQ ID NO: 4897572 - DNA, 11 bp, Homo sapiens
ctgttctgtgt

SEQ ID NO: 4897573 - DNA, 13 bp, Homo sapiens
ctgttctgtgtct

SEQ ID NO: 4897574 - DNA, 14 bp, Homo sapiens
ctgttctgtttcaa

SEQ ID NO: 4897575 - DNA, 15 bp, Homo sapiens
ctgttcttgctgcta

SEQ ID NO: 4897576 - DNA, 12 bp, Homo sapiens
ctgttgcccagg

SEQ ID NO: 4897577 - DNA, 13 bp, Homo sapiens
ctgttgcccaggc

SEQ ID NO: 4897578 - DNA, 20 bp, Homo sapiens
ctgttgctgtgtttaatttg

SEQ ID NO: 4897579 - DNA, 15 bp, Homo sapiens
ctgttgcttgaatag

SEQ ID NO: 4897580 - DNA, 19 bp, Homo sapiens
ctgttggattccatgctaa

SEQ ID NO: 4897581 - DNA, 21 bp, Homo sapiens
ctgttggcagtgagtgagcct

SEQ ID NO: 4897582 - DNA, 20 bp, Homo sapiens
ctgttgtaacttatgtagat

SEQ ID NO: 4897583 - DNA, 19 bp, Homo sapiens
ctgttgtacatttatgatt

SEQ ID NO: 4897584 - DNA, 12 bp, Homo sapiens
ctgtttaagaaa

SEQ ID NO: 4897585 - DNA, 17 bp, Homo sapiens
ctgtttaccatttttca

SEQ ID NO: 4897586 - DNA, 20 bp, Homo sapiens
ctgtttatatgtgttgaaaa

SEQ ID NO: 4897587 - DNA, 14 bp, Homo sapiens
ctgtttatggcctc

SEQ ID NO: 4897588 - DNA, 15 bp, Homo sapiens
ctgtttatggcctca

SEQ ID NO: 4897589 - DNA, 17 bp, Homo sapiens
ctgtttcaacacagacc

SEQ ID NO: 4897590 - DNA, 21 bp, Homo sapiens
ctgtttcaaggcactctagat

SEQ ID NO: 4897591 - DNA, 21 bp, Homo sapiens
ctgtttcccttcccttccact

SEQ ID NO: 4897592 - DNA, 15 bp, Homo sapiens
ctgtttctcttgagc

SEQ ID NO: 4897593 - DNA, 21 bp, Homo sapiens
ctgtttctcttgagctggcct

SEQ ID NO: 4897594 - DNA, 12 bp, Homo sapiens
ctgtttcttgct

SEQ ID NO: 4897595 - DNA, 13 bp, Homo sapiens
ctgtttcttgctt

SEQ ID NO: 4897596 - DNA, 12 bp, Homo sapiens
ctgtttgattct

SEQ ID NO: 4897597 - DNA, 16 bp, Homo sapiens
ctgtttggactttgta

SEQ ID NO: 4897598 - DNA, 13 bp, Homo sapiens
ctgtttgttattg

SEQ ID NO: 4897599 - DNA, 17 bp, Homo sapiens
ctgttttgaaggcaaaa

SEQ ID NO: 4897600 - DNA, 14 bp, Homo sapiens
ctgtttttgttgtg

SEQ ID NO: 4897601 - DNA, 21 bp, Homo sapiens
cttaaaaaaaaaaaaaagctt

SEQ ID NO: 4897602 - DNA, 15 bp, Homo sapiens
cttaaaaatgtaaat

SEQ ID NO: 4897603 - DNA, 16 bp, Homo sapiens
cttaaaaatgtaaata

SEQ ID NO: 4897604 - DNA, 18 bp, Homo sapiens
cttaaaaatgtaaatatt

SEQ ID NO: 4897605 - DNA, 17 bp, Homo sapiens
cttaaaataaacagttg

SEQ ID NO: 4897606 - DNA, 13 bp, Homo sapiens
cttaaaatagaaa

SEQ ID NO: 4897607 - DNA, 21 bp, Homo sapiens
cttaaagaaagtcgaattaat

SEQ ID NO: 4897608 - DNA, 18 bp, Homo sapiens
cttaaagctgcctgtagt

SEQ ID NO: 4897609 - DNA, 20 bp, Homo sapiens
cttaaataatgcttcagata

SEQ ID NO: 4897610 - DNA, 21 bp, Homo sapiens
cttaaataatgcttcagatat

SEQ ID NO: 4897611 - DNA, 13 bp, Homo sapiens
cttaaatatagtt

SEQ ID NO: 4897612 - DNA, 21 bp, Homo sapiens
cttaaatttgatttacatata

SEQ ID NO: 4897613 - DNA, 17 bp, Homo sapiens
cttaacaacctggccgc

SEQ ID NO: 4897614 - DNA, 15 bp, Homo sapiens
cttaacatatttact

SEQ ID NO: 4897615 - DNA, 14 bp, Homo sapiens
cttaacccaaggag

SEQ ID NO: 4897616 - DNA, 17 bp, Homo sapiens
cttaacccaaggagcac

SEQ ID NO: 4897617 - DNA, 20 bp, Homo sapiens
cttaagacctactgttctaa

SEQ ID NO: 4897618 - DNA, 14 bp, Homo sapiens
cttaagcaaaagaa

SEQ ID NO: 4897619 - DNA, 11 bp, Homo sapiens
cttaagctgat

SEQ ID NO: 4897620 - DNA, 20 bp, Homo sapiens
cttaagtatatcatgtaaag

SEQ ID NO: 4897621 - DNA, 15 bp, Homo sapiens
cttaattaatttgat

SEQ ID NO: 4897622 - DNA, 17 bp, Homo sapiens
cttaattaatttgatta

SEQ ID NO: 4897623 - DNA, 14 bp, Homo sapiens
cttaattacttaaa

SEQ ID NO: 4897624 - DNA, 18 bp, Homo sapiens
cttacacaaaggggatca

SEQ ID NO: 4897625 - DNA, 13 bp, Homo sapiens
cttacacatacag

SEQ ID NO: 4897626 - DNA, 20 bp, Homo sapiens
cttacacatacagttttatg

SEQ ID NO: 4897627 - DNA, 22 bp, Homo sapiens
cttacataattttttattcaag

SEQ ID NO: 4897628 - DNA, 12 bp, Homo sapiens
cttacatttgtg

SEQ ID NO: 4897629 - DNA, 13 bp, Homo sapiens
cttacatttgtga

SEQ ID NO: 4897630 - DNA, 15 bp, Homo sapiens
cttaccaactttctg

SEQ ID NO: 4897631 - DNA, 19 bp, Homo sapiens
cttaccaactttctgtaaa

SEQ ID NO: 4897632 - DNA, 21 bp, Homo sapiens
cttacctaagtgacatttgta

SEQ ID NO: 4897633 - DNA, 12 bp, Homo sapiens
cttacctgacac

SEQ ID NO: 4897634 - DNA, 13 bp, Homo sapiens
cttacctgacaca

SEQ ID NO: 4897635 - DNA, 17 bp, Homo sapiens
cttacctgacctcttgc

SEQ ID NO: 4897636 - DNA, 18 bp, Homo sapiens
cttacctgacctcttgct

SEQ ID NO: 4897637 - DNA, 19 bp, Homo sapiens
cttacctgacctcttgctg

SEQ ID NO: 4897638 - DNA, 15 bp, Homo sapiens
cttacctgtacactg

SEQ ID NO: 4897639 - DNA, 20 bp, Homo sapiens
cttacgaatattttcagtaa

SEQ ID NO: 4897640 - DNA, 14 bp, Homo sapiens
cttactaaaatata

SEQ ID NO: 4897641 - DNA, 18 bp, Homo sapiens
cttactaatgtaaaatga

SEQ ID NO: 4897642 - DNA, 23 bp, Homo sapiens
cttactattcattaaatgtttga

SEQ ID NO: 4897643 - DNA, 12 bp, Homo sapiens
cttactattttg

SEQ ID NO: 4897644 - DNA, 18 bp, Homo sapiens
cttactcctcctctttct

SEQ ID NO: 4897645 - DNA, 13 bp, Homo sapiens
cttactctaagat

SEQ ID NO: 4897646 - DNA, 15 bp, Homo sapiens
cttactgtacctgtt

SEQ ID NO: 4897647 - DNA, 18 bp, Homo sapiens
cttactgtacctgttcct

SEQ ID NO: 4897648 - DNA, 19 bp, Homo sapiens
cttacttactaaaatatat

SEQ ID NO: 4897649 - DNA, 13 bp, Homo sapiens
cttagaaaatgtg

SEQ ID NO: 4897650 - DNA, 20 bp, Homo sapiens
cttagagaatgttctcctaa

SEQ ID NO: 4897651 - DNA, 14 bp, Homo sapiens
cttagagtttctgt

SEQ ID NO: 4897652 - DNA, 22 bp, Homo sapiens
cttagagtttctgtttgattct

SEQ ID NO: 4897653 - DNA, 23 bp, Homo sapiens
cttagagtttctgtttgattctt

SEQ ID NO: 4897654 - DNA, 20 bp, Homo sapiens
cttagatgttccagtaatct

SEQ ID NO: 4897655 - DNA, 11 bp, Homo sapiens
cttagattctc

SEQ ID NO: 4897656 - DNA, 22 bp, Homo sapiens
cttagattctctgtgtctaaga

SEQ ID NO: 4897657 - DNA, 11 bp, Homo sapiens
cttagcctccc

SEQ ID NO: 4897658 - DNA, 14 bp, Homo sapiens
cttagcctccctga

SEQ ID NO: 4897659 - DNA, 15 bp, Homo sapiens
cttagcctccctgaa

SEQ ID NO: 4897660 - DNA, 17 bp, Homo sapiens
cttagcctggagcacct

SEQ ID NO: 4897661 - DNA, 17 bp, Homo sapiens
cttagctgtctgctcag

SEQ ID NO: 4897662 - DNA, 15 bp, Homo sapiens
cttaggccttcctct

SEQ ID NO: 4897663 - DNA, 16 bp, Homo sapiens
cttagggtgaaccact

SEQ ID NO: 4897664 - DNA, 22 bp, Homo sapiens
cttagggtgaaccacttcattc

SEQ ID NO: 4897665 - DNA, 15 bp, Homo sapiens
cttagtaaaatttat

SEQ ID NO: 4897666 - DNA, 20 bp, Homo sapiens
cttagtaaaatttatttcat

SEQ ID NO: 4897667 - DNA, 22 bp, Homo sapiens
cttagtatctcatcaacaaaga

SEQ ID NO: 4897668 - DNA, 13 bp, Homo sapiens
cttagtctcagtt

SEQ ID NO: 4897669 - DNA, 17 bp, Homo sapiens
cttagtggttccccacc

SEQ ID NO: 4897670 - DNA, 19 bp, Homo sapiens
cttagtttggattcttatg

SEQ ID NO: 4897671 - DNA, 13 bp, Homo sapiens
cttataaatcata

SEQ ID NO: 4897672 - DNA, 19 bp, Homo sapiens
cttataagtgaagtgatac

SEQ ID NO: 4897673 - DNA, 15 bp, Homo sapiens
cttatagcactttga

SEQ ID NO: 4897674 - DNA, 17 bp, Homo sapiens
cttatagcactttgaaa

SEQ ID NO: 4897675 - DNA, 20 bp, Homo sapiens
cttatagcactttgaaatac

SEQ ID NO: 4897676 - DNA, 14 bp, Homo sapiens
cttatagttctagg

SEQ ID NO: 4897677 - DNA, 16 bp, Homo sapiens
cttatagttctaggca

SEQ ID NO: 4897678 - DNA, 22 bp, Homo sapiens
cttatcagctacttaagagaaa

SEQ ID NO: 4897679 - DNA, 22 bp, Homo sapiens
cttatctcagtcatgcataaat

SEQ ID NO: 4897680 - DNA, 12 bp, Homo sapiens
cttatctctctg

SEQ ID NO: 4897681 - DNA, 14 bp, Homo sapiens
cttatctctctgtg

SEQ ID NO: 4897682 - DNA, 18 bp, Homo sapiens
cttatgacttgctacttt

SEQ ID NO: 4897683 - DNA, 14 bp, Homo sapiens
cttatgcaaaatgg

SEQ ID NO: 4897684 - DNA, 17 bp, Homo sapiens
cttatggaattgatttg

SEQ ID NO: 4897685 - DNA, 21 bp, Homo sapiens
cttatgggtccccctcagcaa

SEQ ID NO: 4897686 - DNA, 19 bp, Homo sapiens
cttatgtagcaggaaataa

SEQ ID NO: 4897687 - DNA, 20 bp, Homo sapiens
cttatgtgggttgcctggtg

SEQ ID NO: 4897688 - DNA, 13 bp, Homo sapiens
cttattacaattt

SEQ ID NO: 4897689 - DNA, 15 bp, Homo sapiens
cttattattgaagga

SEQ ID NO: 4897690 - DNA, 17 bp, Homo sapiens
cttattgcgctgctacc

SEQ ID NO: 4897691 - DNA, 18 bp, Homo sapiens
cttattgtaaattttaga

SEQ ID NO: 4897692 - DNA, 19 bp, Homo sapiens
cttatttatgttaaaagat

SEQ ID NO: 4897693 - DNA, 16 bp, Homo sapiens
cttattttaatgtgat

SEQ ID NO: 4897694 - DNA, 17 bp, Homo sapiens
cttattttaatgtgatg

SEQ ID NO: 4897695 - DNA, 15 bp, Homo sapiens
cttattttatttcca

SEQ ID NO: 4897696 - DNA, 14 bp, Homo sapiens
cttattttcaagaa

SEQ ID NO: 4897697 - DNA, 18 bp, Homo sapiens
cttattttcaagaaactg

SEQ ID NO: 4897698 - DNA, 15 bp, Homo sapiens
cttcaaaatgtatat

SEQ ID NO: 4897699 - DNA, 19 bp, Homo sapiens
cttcaaaatgtatatattt

SEQ ID NO: 4897700 - DNA, 18 bp, Homo sapiens
cttcaaatccttccaaaa

SEQ ID NO: 4897701 - DNA, 16 bp, Homo sapiens
cttcaacatcctgcca

SEQ ID NO: 4897702 - DNA, 23 bp, Homo sapiens
cttcaactgaccagcctccatgc

SEQ ID NO: 4897703 - DNA, 15 bp, Homo sapiens
cttcaataaatcttt

SEQ ID NO: 4897704 - DNA, 13 bp, Homo sapiens
cttcaatcccagc

SEQ ID NO: 4897705 - DNA, 18 bp, Homo sapiens
cttcaatgggctcttcca

SEQ ID NO: 4897706 - DNA, 19 bp, Homo sapiens
cttcaatgggctcttccaa

SEQ ID NO: 4897707 - DNA, 15 bp, Homo sapiens
cttcaattaataaaa

SEQ ID NO: 4897708 - DNA, 14 bp, Homo sapiens
cttcaccccggcag

SEQ ID NO: 4897709 - DNA, 19 bp, Homo sapiens
cttcaccccggcaggccct

SEQ ID NO: 4897710 - DNA, 21 bp, Homo sapiens
cttcaccccggcaggccctgc

SEQ ID NO: 4897711 - DNA, 18 bp, Homo sapiens
cttcactactttaataaa

SEQ ID NO: 4897712 - DNA, 20 bp, Homo sapiens
cttcactctgggcacactct

SEQ ID NO: 4897713 - DNA, 13 bp, Homo sapiens
cttcactgtataa

SEQ ID NO: 4897714 - DNA, 20 bp, Homo sapiens
cttcagaattccatatcttg

SEQ ID NO: 4897715 - DNA, 14 bp, Homo sapiens
cttcagactctcag

SEQ ID NO: 4897716 - DNA, 16 bp, Homo sapiens
cttcagcccccagccc

SEQ ID NO: 4897717 - DNA, 20 bp, Homo sapiens
cttcagcccccagcccctcc

SEQ ID NO: 4897718 - DNA, 16 bp, Homo sapiens
cttcagcctcccgagt

SEQ ID NO: 4897719 - DNA, 16 bp, Homo sapiens
cttcagcgtaaaatgg

SEQ ID NO: 4897720 - DNA, 15 bp, Homo sapiens
cttcagctctttttg

SEQ ID NO: 4897721 - DNA, 12 bp, Homo sapiens
cttcaggcctcc

SEQ ID NO: 4897722 - DNA, 14 bp, Homo sapiens
cttcaggctcttct

SEQ ID NO: 4897723 - DNA, 18 bp, Homo sapiens
cttcaggctcttctcctt

SEQ ID NO: 4897724 - DNA, 22 bp, Homo sapiens
cttcaggctcttctcctttcac

SEQ ID NO: 4897725 - DNA, 17 bp, Homo sapiens
cttcaggggcacttcat

SEQ ID NO: 4897726 - DNA, 22 bp, Homo sapiens
cttcagtaccctctcagctcca

SEQ ID NO: 4897727 - DNA, 11 bp, Homo sapiens
cttcagtcctg

SEQ ID NO: 4897728 - DNA, 15 bp, Homo sapiens
cttcagtcctgggag

SEQ ID NO: 4897729 - DNA, 17 bp, Homo sapiens
cttcagtggagaattat

SEQ ID NO: 4897730 - DNA, 13 bp, Homo sapiens
cttcagtggcagc

SEQ ID NO: 4897731 - DNA, 14 bp, Homo sapiens
cttcagtggcagct

SEQ ID NO: 4897732 - DNA, 17 bp, Homo sapiens
cttcagtggcagctgct

SEQ ID NO: 4897733 - DNA, 15 bp, Homo sapiens
cttcagttggttgtg

SEQ ID NO: 4897734 - DNA, 21 bp, Homo sapiens
cttcagttggttgtgtctttt

SEQ ID NO: 4897735 - DNA, 13 bp, Homo sapiens
cttcatccctttc

SEQ ID NO: 4897736 - DNA, 15 bp, Homo sapiens
cttcatgccagctac

SEQ ID NO: 4897737 - DNA, 19 bp, Homo sapiens
cttcatggccatagctttt

SEQ ID NO: 4897738 - DNA, 14 bp, Homo sapiens
cttcattgagagtt

SEQ ID NO: 4897739 - DNA, 21 bp, Homo sapiens
cttcattgagagttttgtctt

SEQ ID NO: 4897740 - DNA, 16 bp, Homo sapiens
cttcatttcattgtat

SEQ ID NO: 4897741 - DNA, 13 bp, Homo sapiens
cttcatttggaga

SEQ ID NO: 4897742 - DNA, 18 bp, Homo sapiens
cttcatttgtgtcaatgg

SEQ ID NO: 4897743 - DNA, 21 bp, Homo sapiens
cttcattttattaatattttt

SEQ ID NO: 4897744 - DNA, 16 bp, Homo sapiens
cttccaaaaattatta

SEQ ID NO: 4897745 - DNA, 19 bp, Homo sapiens
cttccaaaaattattataa

SEQ ID NO: 4897746 - DNA, 17 bp, Homo sapiens
cttccaaagaattctta

SEQ ID NO: 4897747 - DNA, 17 bp, Homo sapiens
cttccaattaatgcttt

SEQ ID NO: 4897748 - DNA, 13 bp, Homo sapiens
cttccagatcact

SEQ ID NO: 4897749 - DNA, 13 bp, Homo sapiens
cttccagctcctg

SEQ ID NO: 4897750 - DNA, 15 bp, Homo sapiens
cttccagctcctgta

SEQ ID NO: 4897751 - DNA, 12 bp, Homo sapiens
cttccagctgct

SEQ ID NO: 4897752 - DNA, 19 bp, Homo sapiens
cttccaggtgttactgtaa

SEQ ID NO: 4897753 - DNA, 20 bp, Homo sapiens
cttccaggtgttactgtaat

SEQ ID NO: 4897754 - DNA, 11 bp, Homo sapiens
cttccataatc

SEQ ID NO: 4897755 - DNA, 17 bp, Homo sapiens
cttccatcccaaccagt

SEQ ID NO: 4897756 - DNA, 22 bp, Homo sapiens
cttccatcccaggacaccacac

SEQ ID NO: 4897757 - DNA, 17 bp, Homo sapiens
cttccatccctaccccc

SEQ ID NO: 4897758 - DNA, 17 bp, Homo sapiens
cttccatgtcgcctctg

SEQ ID NO: 4897759 - DNA, 18 bp, Homo sapiens
cttccatgtcgcctctgc

SEQ ID NO: 4897760 - DNA, 21 bp, Homo sapiens
cttcccacctccctgcccagg

SEQ ID NO: 4897761 - DNA, 22 bp, Homo sapiens
cttcccagttcaggagtcccaa

SEQ ID NO: 4897762 - DNA, 14 bp, Homo sapiens
cttcccccatagcc

SEQ ID NO: 4897763 - DNA, 16 bp, Homo sapiens
cttcccccttttttgt

SEQ ID NO: 4897764 - DNA, 14 bp, Homo sapiens
cttcccctccctgg

SEQ ID NO: 4897765 - DNA, 16 bp, Homo sapiens
cttcccctccctggct

SEQ ID NO: 4897766 - DNA, 19 bp, Homo sapiens
cttcccgccagagggcttg

SEQ ID NO: 4897767 - DNA, 23 bp, Homo sapiens
cttcccgctcagccctccctgcc

SEQ ID NO: 4897768 - DNA, 20 bp, Homo sapiens
cttccctgattgacctgctc

SEQ ID NO: 4897769 - DNA, 21 bp, Homo sapiens
cttccctgattgacctgctcc

SEQ ID NO: 4897770 - DNA, 20 bp, Homo sapiens
cttcccttccactgcctctg

SEQ ID NO: 4897771 - DNA, 22 bp, Homo sapiens
cttcccttccactgcctctgcc

SEQ ID NO: 4897772 - DNA, 14 bp, Homo sapiens
cttcccttgccact

SEQ ID NO: 4897773 - DNA, 18 bp, Homo sapiens
cttcccttgccactttgc

SEQ ID NO: 4897774 - DNA, 16 bp, Homo sapiens
cttccctttccccagc

SEQ ID NO: 4897775 - DNA, 13 bp, Homo sapiens
cttccctttctgc

SEQ ID NO: 4897776 - DNA, 15 bp, Homo sapiens
cttccgaccctctgg

SEQ ID NO: 4897777 - DNA, 21 bp, Homo sapiens
cttccgaccctctgggaacct

SEQ ID NO: 4897778 - DNA, 17 bp, Homo sapiens
cttccgcccctgcctgc

SEQ ID NO: 4897779 - DNA, 18 bp, Homo sapiens
cttccgccccttcccttc

SEQ ID NO: 4897780 - DNA, 22 bp, Homo sapiens
cttcctaatttcccttcttgca

SEQ ID NO: 4897781 - DNA, 18 bp, Homo sapiens
cttcctacaagagcagcc

SEQ ID NO: 4897782 - DNA, 16 bp, Homo sapiens
cttcctacccacacct

SEQ ID NO: 4897783 - DNA, 18 bp, Homo sapiens
cttcctacccacacctct

SEQ ID NO: 4897784 - DNA, 16 bp, Homo sapiens
cttcctaccctcctgc

SEQ ID NO: 4897785 - DNA, 15 bp, Homo sapiens
cttcctagttttctc

SEQ ID NO: 4897786 - DNA, 15 bp, Homo sapiens
cttcctcaccctgat

SEQ ID NO: 4897787 - DNA, 22 bp, Homo sapiens
cttcctcatccaccccatccct

SEQ ID NO: 4897788 - DNA, 17 bp, Homo sapiens
cttcctcctccccactt

SEQ ID NO: 4897789 - DNA, 14 bp, Homo sapiens
cttcctctccactg

SEQ ID NO: 4897790 - DNA, 16 bp, Homo sapiens
cttcctctccactgcc

SEQ ID NO: 4897791 - DNA, 19 bp, Homo sapiens
cttcctctccactgccttc

SEQ ID NO: 4897792 - DNA, 13 bp, Homo sapiens
cttcctctgctga

SEQ ID NO: 4897793 - DNA, 14 bp, Homo sapiens
cttcctctggggct

SEQ ID NO: 4897794 - DNA, 20 bp, Homo sapiens
cttcctctggggctctaggg

SEQ ID NO: 4897795 - DNA, 18 bp, Homo sapiens
cttcctgacgaaactggc

SEQ ID NO: 4897796 - DNA, 14 bp, Homo sapiens
cttcctgagcttta

SEQ ID NO: 4897797 - DNA, 17 bp, Homo sapiens
cttcctgcaattttcta

SEQ ID NO: 4897798 - DNA, 15 bp, Homo sapiens
cttcctgcccctctt

SEQ ID NO: 4897799 - DNA, 20 bp, Homo sapiens
cttcctgcccctctttctct

SEQ ID NO: 4897800 - DNA, 16 bp, Homo sapiens
cttcctgtgatccacc

SEQ ID NO: 4897801 - DNA, 13 bp, Homo sapiens
cttccttcctgtt

SEQ ID NO: 4897802 - DNA, 17 bp, Homo sapiens
cttccttctgtaaatac

SEQ ID NO: 4897803 - DNA, 20 bp, Homo sapiens
cttccttgagacacggagcc

SEQ ID NO: 4897804 - DNA, 23 bp, Homo sapiens
cttccttgagacacggagcccag

SEQ ID NO: 4897805 - DNA, 20 bp, Homo sapiens
cttcctttactttcccttgc

SEQ ID NO: 4897806 - DNA, 19 bp, Homo sapiens
cttcctttctccaggacca

SEQ ID NO: 4897807 - DNA, 15 bp, Homo sapiens
cttcgaaacctggga

SEQ ID NO: 4897808 - DNA, 19 bp, Homo sapiens
cttcgcgtgccctcgctgc

SEQ ID NO: 4897809 - DNA, 14 bp, Homo sapiens
cttcgctcctgtgt

SEQ ID NO: 4897810 - DNA, 17 bp, Homo sapiens
cttcgctcctgtgtctt

SEQ ID NO: 4897811 - DNA, 16 bp, Homo sapiens
cttcggccaggtcaca

SEQ ID NO: 4897812 - DNA, 18 bp, Homo sapiens
cttcgggcgtctgtgtgc

SEQ ID NO: 4897813 - DNA, 19 bp, Homo sapiens
cttcgtatcccgagtctgg

SEQ ID NO: 4897814 - DNA, 23 bp, Homo sapiens
cttcgtatcccgagtctgggaca

SEQ ID NO: 4897815 - DNA, 15 bp, Homo sapiens
cttcgtgccccccct

SEQ ID NO: 4897816 - DNA, 19 bp, Homo sapiens
cttctaaacttccccatct

SEQ ID NO: 4897817 - DNA, 18 bp, Homo sapiens
cttctactgagccttcag

SEQ ID NO: 4897818 - DNA, 15 bp, Homo sapiens
cttctattttgtaaa

SEQ ID NO: 4897819 - DNA, 17 bp, Homo sapiens
cttctcaagttctaaga

SEQ ID NO: 4897820 - DNA, 13 bp, Homo sapiens
cttctcacagcac

SEQ ID NO: 4897821 - DNA, 15 bp, Homo sapiens
cttctcacagcacat

SEQ ID NO: 4897822 - DNA, 19 bp, Homo sapiens
cttctcacagcacatgctg

SEQ ID NO: 4897823 - DNA, 23 bp, Homo sapiens
cttctcacagcacatgctggcca

SEQ ID NO: 4897824 - DNA, 16 bp, Homo sapiens
cttctccaccctgctc

SEQ ID NO: 4897825 - DNA, 13 bp, Homo sapiens
cttctccactgga

SEQ ID NO: 4897826 - DNA, 14 bp, Homo sapiens
cttctccactggat

SEQ ID NO: 4897827 - DNA, 13 bp, Homo sapiens
cttctccccagaa

SEQ ID NO: 4897828 - DNA, 14 bp, Homo sapiens
cttctccccagaat

SEQ ID NO: 4897829 - DNA, 20 bp, Homo sapiens
cttctcctttcacaaccttc

SEQ ID NO: 4897830 - DNA, 22 bp, Homo sapiens
cttctcctttcacaaccttctg

SEQ ID NO: 4897831 - DNA, 13 bp, Homo sapiens
cttctctgaacac

SEQ ID NO: 4897832 - DNA, 17 bp, Homo sapiens
cttctctgaacacaggc

SEQ ID NO: 4897833 - DNA, 18 bp, Homo sapiens
cttctctgaacacaggca

SEQ ID NO: 4897834 - DNA, 21 bp, Homo sapiens
cttctctgaacacaggcagct

SEQ ID NO: 4897835 - DNA, 12 bp, Homo sapiens
cttctctgctcc

SEQ ID NO: 4897836 - DNA, 21 bp, Homo sapiens
cttctctgctccaccacatcc

SEQ ID NO: 4897837 - DNA, 20 bp, Homo sapiens
cttctcttaaacttgtgaat

SEQ ID NO: 4897838 - DNA, 20 bp, Homo sapiens
cttctgaatgtgctgatcat

SEQ ID NO: 4897839 - DNA, 21 bp, Homo sapiens
cttctgaatgtgctgatcatt

SEQ ID NO: 4897840 - DNA, 14 bp, Homo sapiens
cttctgacggccct

SEQ ID NO: 4897841 - DNA, 17 bp, Homo sapiens
cttctgacggccctgca

SEQ ID NO: 4897842 - DNA, 18 bp, Homo sapiens
cttctgacggccctgcaa

SEQ ID NO: 4897843 - DNA, 14 bp, Homo sapiens
cttctgccaagaga

SEQ ID NO: 4897844 - DNA, 17 bp, Homo sapiens
cttctgccatattctgt

SEQ ID NO: 4897845 - DNA, 23 bp, Homo sapiens
cttctgcccaattggaggaaagc

SEQ ID NO: 4897846 - DNA, 21 bp, Homo sapiens
cttctgccttagtctcagttt

SEQ ID NO: 4897847 - DNA, 13 bp, Homo sapiens
cttctgccttttc

SEQ ID NO: 4897848 - DNA, 16 bp, Homo sapiens
cttctgcgcctcaggc

SEQ ID NO: 4897849 - DNA, 17 bp, Homo sapiens
cttctgctccacccttg

SEQ ID NO: 4897850 - DNA, 19 bp, Homo sapiens
cttctgctccacccttggc

SEQ ID NO: 4897851 - DNA, 18 bp, Homo sapiens
cttctggcagattcaaat

SEQ ID NO: 4897852 - DNA, 11 bp, Homo sapiens
cttctggcctt

SEQ ID NO: 4897853 - DNA, 14 bp, Homo sapiens
cttctggggcaggc

SEQ ID NO: 4897854 - DNA, 15 bp, Homo sapiens
cttctggggcaggct

SEQ ID NO: 4897855 - DNA, 16 bp, Homo sapiens
cttctggggcaggctg

SEQ ID NO: 4897856 - DNA, 21 bp, Homo sapiens
cttctgtcctactctgtgtca

SEQ ID NO: 4897857 - DNA, 20 bp, Homo sapiens
cttctgtgagacccccacac

SEQ ID NO: 4897858 - DNA, 21 bp, Homo sapiens
cttctgtgagacccccacacc

SEQ ID NO: 4897859 - DNA, 22 bp, Homo sapiens
cttctgtgagacccccacacct

SEQ ID NO: 4897860 - DNA, 17 bp, Homo sapiens
cttctgtgatgagctga

SEQ ID NO: 4897861 - DNA, 19 bp, Homo sapiens
cttctgtgatgagctgatc

SEQ ID NO: 4897862 - DNA, 15 bp, Homo sapiens
cttctgtggctcaca

SEQ ID NO: 4897863 - DNA, 13 bp, Homo sapiens
cttctgtgtatct

SEQ ID NO: 4897864 - DNA, 22 bp, Homo sapiens
cttctgtgtatctctttcacat

SEQ ID NO: 4897865 - DNA, 12 bp, Homo sapiens
cttcttaattaa

SEQ ID NO: 4897866 - DNA, 14 bp, Homo sapiens
cttcttaattaatt

SEQ ID NO: 4897867 - DNA, 17 bp, Homo sapiens
cttcttaattaatttga

SEQ ID NO: 4897868 - DNA, 16 bp, Homo sapiens
cttcttattatatata

SEQ ID NO: 4897869 - DNA, 16 bp, Homo sapiens
cttcttcatattctaa

SEQ ID NO: 4897870 - DNA, 16 bp, Homo sapiens
cttcttcattctatca

SEQ ID NO: 4897871 - DNA, 19 bp, Homo sapiens
cttcttcctttctctttct

SEQ ID NO: 4897872 - DNA, 12 bp, Homo sapiens
cttcttctccat

SEQ ID NO: 4897873 - DNA, 13 bp, Homo sapiens
cttcttgtcagac

SEQ ID NO: 4897874 - DNA, 18 bp, Homo sapiens
cttcttgtcagacataaa

SEQ ID NO: 4897875 - DNA, 12 bp, Homo sapiens
cttctttgaaga

SEQ ID NO: 4897876 - DNA, 14 bp, Homo sapiens
cttcttttgctctt

SEQ ID NO: 4897877 - DNA, 15 bp, Homo sapiens
cttcttttggcttcc

SEQ ID NO: 4897878 - DNA, 20 bp, Homo sapiens
cttgaaaatatatgatggct

SEQ ID NO: 4897879 - DNA, 23 bp, Homo sapiens
cttgaaaatattttttatatata

SEQ ID NO: 4897880 - DNA, 14 bp, Homo sapiens
cttgaaagaatttt

SEQ ID NO: 4897881 - DNA, 17 bp, Homo sapiens
cttgaaattatatctgt

SEQ ID NO: 4897882 - DNA, 20 bp, Homo sapiens
cttgaaattatatctgtggt

SEQ ID NO: 4897883 - DNA, 17 bp, Homo sapiens
cttgaacaaaagggtca

SEQ ID NO: 4897884 - DNA, 22 bp, Homo sapiens
cttgaacaaaagggtcagagga

SEQ ID NO: 4897885 - DNA, 20 bp, Homo sapiens
cttgaacaaaatctgttgcc

SEQ ID NO: 4897886 - DNA, 16 bp, Homo sapiens
cttgaacctgtgagta

SEQ ID NO: 4897887 - DNA, 21 bp, Homo sapiens
cttgaacctgtgagtaaatat

SEQ ID NO: 4897888 - DNA, 14 bp, Homo sapiens
cttgaactcctggc

SEQ ID NO: 4897889 - DNA, 18 bp, Homo sapiens
cttgaactcctggcctca

SEQ ID NO: 4897890 - DNA, 16 bp, Homo sapiens
cttgaactgggtactt

SEQ ID NO: 4897891 - DNA, 16 bp, Homo sapiens
cttgaagggcccagga

SEQ ID NO: 4897892 - DNA, 13 bp, Homo sapiens
cttgaatgctgcc

SEQ ID NO: 4897893 - DNA, 16 bp, Homo sapiens
cttgaatgctgccagt

SEQ ID NO: 4897894 - DNA, 21 bp, Homo sapiens
cttgaatgtagcagccccggg

SEQ ID NO: 4897895 - DNA, 18 bp, Homo sapiens
cttgaatgtggtctcagg

SEQ ID NO: 4897896 - DNA, 20 bp, Homo sapiens
cttgaatgtggtctcaggat

SEQ ID NO: 4897897 - DNA, 21 bp, Homo sapiens
cttgaatgtggtctcaggata

SEQ ID NO: 4897898 - DNA, 15 bp, Homo sapiens
cttgaatgtgtcagg

SEQ ID NO: 4897899 - DNA, 12 bp, Homo sapiens
cttgacagggca

SEQ ID NO: 4897900 - DNA, 14 bp, Homo sapiens
cttgaccttcctct

SEQ ID NO: 4897901 - DNA, 16 bp, Homo sapiens
cttgactcaggattta

SEQ ID NO: 4897902 - DNA, 21 bp, Homo sapiens
cttgactcccaagtttccata

SEQ ID NO: 4897903 - DNA, 23 bp, Homo sapiens
cttgagaagacctcacctagaaa

SEQ ID NO: 4897904 - DNA, 13 bp, Homo sapiens
cttgagcccagga

SEQ ID NO: 4897905 - DNA, 13 bp, Homo sapiens
cttgagctggcct

SEQ ID NO: 4897906 - DNA, 17 bp, Homo sapiens
cttgagctggcctctct

SEQ ID NO: 4897907 - DNA, 19 bp, Homo sapiens
cttgagggcccagagcagg

SEQ ID NO: 4897908 - DNA, 15 bp, Homo sapiens
cttgagggttgggct

SEQ ID NO: 4897909 - DNA, 19 bp, Homo sapiens
cttgagggttgggctggtg

SEQ ID NO: 4897910 - DNA, 21 bp, Homo sapiens
cttgagtggggttatctctgt

SEQ ID NO: 4897911 - DNA, 16 bp, Homo sapiens
cttgagtgtaatgttt

SEQ ID NO: 4897912 - DNA, 17 bp, Homo sapiens
cttgagttcccagatgg

SEQ ID NO: 4897913 - DNA, 16 bp, Homo sapiens
cttgatacccccctct

SEQ ID NO: 4897914 - DNA, 17 bp, Homo sapiens
cttgatacccccctctg

SEQ ID NO: 4897915 - DNA, 18 bp, Homo sapiens
cttgatacccccctctgt

SEQ ID NO: 4897916 - DNA, 21 bp, Homo sapiens
cttgatacccccctctgtctt

SEQ ID NO: 4897917 - DNA, 16 bp, Homo sapiens
cttgatcattttggga

SEQ ID NO: 4897918 - DNA, 18 bp, Homo sapiens
cttgatgcacagagaagc

SEQ ID NO: 4897919 - DNA, 20 bp, Homo sapiens
cttgattaagattttacaaa

SEQ ID NO: 4897920 - DNA, 21 bp, Homo sapiens
cttgattaagattttacaaaa

SEQ ID NO: 4897921 - DNA, 13 bp, Homo sapiens
cttgattctgcag

SEQ ID NO: 4897922 - DNA, 22 bp, Homo sapiens
cttgattctgcagtaaatcttt

SEQ ID NO: 4897923 - DNA, 24 bp, Homo sapiens
cttgatttgagttgattgagaaga

SEQ ID NO: 4897924 - DNA, 17 bp, Homo sapiens
cttgcaagcatgcttgt

SEQ ID NO: 4897925 - DNA, 18 bp, Homo sapiens
cttgcaatggcagccttg

SEQ ID NO: 4897926 - DNA, 15 bp, Homo sapiens
cttgcagaactgcca

SEQ ID NO: 4897927 - DNA, 18 bp, Homo sapiens
cttgcagactctacagag

SEQ ID NO: 4897928 - DNA, 21 bp, Homo sapiens
cttgcagactctacagaggcc

SEQ ID NO: 4897929 - DNA, 18 bp, Homo sapiens
cttgcagttcagcaccac

SEQ ID NO: 4897930 - DNA, 14 bp, Homo sapiens
cttgcatccttcct

SEQ ID NO: 4897931 - DNA, 20 bp, Homo sapiens
cttgcatgaagagaagcaat

SEQ ID NO: 4897932 - DNA, 18 bp, Homo sapiens
cttgccaccccaccctcc

SEQ ID NO: 4897933 - DNA, 23 bp, Homo sapiens
cttgccaccccaccctccctgga

SEQ ID NO: 4897934 - DNA, 17 bp, Homo sapiens
cttgccactttgcacga

SEQ ID NO: 4897935 - DNA, 13 bp, Homo sapiens
cttgccagagccg

SEQ ID NO: 4897936 - DNA, 19 bp, Homo sapiens
cttgccctagatagtttat

SEQ ID NO: 4897937 - DNA, 17 bp, Homo sapiens
cttgccctttcccccca

SEQ ID NO: 4897938 - DNA, 18 bp, Homo sapiens
cttgccgaggagccaggc

SEQ ID NO: 4897939 - DNA, 20 bp, Homo sapiens
cttgccgaggagccaggcaa

SEQ ID NO: 4897940 - DNA, 17 bp, Homo sapiens
cttgcctaaatttaatg

SEQ ID NO: 4897941 - DNA, 20 bp, Homo sapiens
cttgcctggagacgtggaac

SEQ ID NO: 4897942 - DNA, 16 bp, Homo sapiens
cttgctcattaatttt

SEQ ID NO: 4897943 - DNA, 19 bp, Homo sapiens
cttgctctcccctgccctg

SEQ ID NO: 4897944 - DNA, 20 bp, Homo sapiens
cttgctctcccctgccctgc

SEQ ID NO: 4897945 - DNA, 13 bp, Homo sapiens
cttgctctgctga

SEQ ID NO: 4897946 - DNA, 14 bp, Homo sapiens
cttgctctgctgac

SEQ ID NO: 4897947 - DNA, 16 bp, Homo sapiens
cttgctctgctgacag

SEQ ID NO: 4897948 - DNA, 22 bp, Homo sapiens
cttgctctgctgacagacacag

SEQ ID NO: 4897949 - DNA, 21 bp, Homo sapiens
cttgctggacggggactgggg

SEQ ID NO: 4897950 - DNA, 16 bp, Homo sapiens
cttgctgtctctgctc

SEQ ID NO: 4897951 - DNA, 20 bp, Homo sapiens
cttgctgttggtcatgtggg

SEQ ID NO: 4897952 - DNA, 16 bp, Homo sapiens
cttgcttgtacctctg

SEQ ID NO: 4897953 - DNA, 13 bp, Homo sapiens
cttggaagctccg

SEQ ID NO: 4897954 - DNA, 16 bp, Homo sapiens
cttggaagtacatgaa

SEQ ID NO: 4897955 - DNA, 21 bp, Homo sapiens
cttggaagtttcatatattgt

SEQ ID NO: 4897956 - DNA, 15 bp, Homo sapiens
cttggagaccctgca

SEQ ID NO: 4897957 - DNA, 14 bp, Homo sapiens
cttggagggaccaa

SEQ ID NO: 4897958 - DNA, 18 bp, Homo sapiens
cttggagtattggggtct

SEQ ID NO: 4897959 - DNA, 22 bp, Homo sapiens
cttggagtttttcattgtcgct

SEQ ID NO: 4897960 - DNA, 21 bp, Homo sapiens
cttggatagctaataatgagc

SEQ ID NO: 4897961 - DNA, 18 bp, Homo sapiens
cttggcaaaagccttgtg

SEQ ID NO: 4897962 - DNA, 20 bp, Homo sapiens
cttggcaaaagccttgtgta

SEQ ID NO: 4897963 - DNA, 21 bp, Homo sapiens
cttggcaaaagccttgtgtat

SEQ ID NO: 4897964 - DNA, 15 bp, Homo sapiens
cttggcaacagaagc

SEQ ID NO: 4897965 - DNA, 20 bp, Homo sapiens
cttggcaacagaagcagttg

SEQ ID NO: 4897966 - DNA, 15 bp, Homo sapiens
cttggccctttcctt

SEQ ID NO: 4897967 - DNA, 20 bp, Homo sapiens
cttggccctttccttccaga

SEQ ID NO: 4897968 - DNA, 22 bp, Homo sapiens
cttggccggctgtgctcagaga

SEQ ID NO: 4897969 - DNA, 18 bp, Homo sapiens
cttggcctagcccaccct

SEQ ID NO: 4897970 - DNA, 17 bp, Homo sapiens
cttggcctgtctcatcc

SEQ ID NO: 4897971 - DNA, 15 bp, Homo sapiens
cttggcgtggagcag

SEQ ID NO: 4897972 - DNA, 16 bp, Homo sapiens
cttggcgtggagcagg

SEQ ID NO: 4897973 - DNA, 22 bp, Homo sapiens
cttggctccatgctcctcactg

SEQ ID NO: 4897974 - DNA, 16 bp, Homo sapiens
cttggctgcagggagt

SEQ ID NO: 4897975 - DNA, 17 bp, Homo sapiens
cttggctgcagggagtc

SEQ ID NO: 4897976 - DNA, 21 bp, Homo sapiens
cttggctgtgaggcccctgga

SEQ ID NO: 4897977 - DNA, 20 bp, Homo sapiens
cttggctgttggcagtgagt

SEQ ID NO: 4897978 - DNA, 15 bp, Homo sapiens
cttggcttacctgac

SEQ ID NO: 4897979 - DNA, 21 bp, Homo sapiens
cttggcttctgtgatgagctg

SEQ ID NO: 4897980 - DNA, 18 bp, Homo sapiens
cttgggaatggatcctgg

SEQ ID NO: 4897981 - DNA, 16 bp, Homo sapiens
cttgggagagcccctg

SEQ ID NO: 4897982 - DNA, 18 bp, Homo sapiens
cttgggagagcccctggg

SEQ ID NO: 4897983 - DNA, 13 bp, Homo sapiens
cttgggccacccc

SEQ ID NO: 4897984 - DNA, 17 bp, Homo sapiens
cttgggccacccctcct

SEQ ID NO: 4897985 - DNA, 19 bp, Homo sapiens
cttggggccaccaaagctg

SEQ ID NO: 4897986 - DNA, 22 bp, Homo sapiens
cttggggccaccaaagctgccc

SEQ ID NO: 4897987 - DNA, 21 bp, Homo sapiens
cttgggggaacgatgtgtctg

SEQ ID NO: 4897988 - DNA, 15 bp, Homo sapiens
cttggtaagaagccg

SEQ ID NO: 4897989 - DNA, 16 bp, Homo sapiens
cttggtggcttatggg

SEQ ID NO: 4897990 - DNA, 20 bp, Homo sapiens
cttggtttctctctacagtg

SEQ ID NO: 4897991 - DNA, 19 bp, Homo sapiens
cttgtaaataccaggattt

SEQ ID NO: 4897992 - DNA, 20 bp, Homo sapiens
cttgtaatattttgtattat

SEQ ID NO: 4897993 - DNA, 14 bp, Homo sapiens
cttgtaatttccag

SEQ ID NO: 4897994 - DNA, 13 bp, Homo sapiens
cttgtacatgtgt

SEQ ID NO: 4897995 - DNA, 22 bp, Homo sapiens
cttgtacccccaggtggaaggc

SEQ ID NO: 4897996 - DNA, 14 bp, Homo sapiens
cttgtagaattgtt

SEQ ID NO: 4897997 - DNA, 15 bp, Homo sapiens
cttgtagaattgtta

SEQ ID NO: 4897998 - DNA, 16 bp, Homo sapiens
cttgtagctgtaaaac

SEQ ID NO: 4897999 - DNA, 22 bp, Homo sapiens
cttgtagctgtaaaacgctgtc

SEQ ID NO: 4898000 - DNA, 21 bp, Homo sapiens
cttgtagtttacctctttaaa

SEQ ID NO: 4898001 - DNA, 13 bp, Homo sapiens
cttgtataaatgt

SEQ ID NO: 4898002 - DNA, 21 bp, Homo sapiens
cttgtatgaaagatggctgtg

SEQ ID NO: 4898003 - DNA, 20 bp, Homo sapiens
cttgtcactgacacaaagga

SEQ ID NO: 4898004 - DNA, 20 bp, Homo sapiens
cttgtcagacataaagccat

SEQ ID NO: 4898005 - DNA, 14 bp, Homo sapiens
cttgtcatgtgaca

SEQ ID NO: 4898006 - DNA, 21 bp, Homo sapiens
cttgtcccacgtgtcttccac

SEQ ID NO: 4898007 - DNA, 15 bp, Homo sapiens
cttgtcctttccctt

SEQ ID NO: 4898008 - DNA, 17 bp, Homo sapiens
cttgtctatttttgtct

SEQ ID NO: 4898009 - DNA, 23 bp, Homo sapiens
cttgtctcattttaatgtaaaga

SEQ ID NO: 4898010 - DNA, 20 bp, Homo sapiens
cttgtctcctactcctgact

SEQ ID NO: 4898011 - DNA, 13 bp, Homo sapiens
cttgtgaaaatgt

SEQ ID NO: 4898012 - DNA, 18 bp, Homo sapiens
cttgtgaaaatgtgttct

SEQ ID NO: 4898013 - DNA, 16 bp, Homo sapiens
cttgtgaaacacagct

SEQ ID NO: 4898014 - DNA, 18 bp, Homo sapiens
cttgtgaaacacagctgt

SEQ ID NO: 4898015 - DNA, 12 bp, Homo sapiens
cttgtgaacaga

SEQ ID NO: 4898016 - DNA, 16 bp, Homo sapiens
cttgtgaatgcttctc

SEQ ID NO: 4898017 - DNA, 17 bp, Homo sapiens
cttgtgattatttatta

SEQ ID NO: 4898018 - DNA, 22 bp, Homo sapiens
cttgtgctggatggagcccagg

SEQ ID NO: 4898019 - DNA, 18 bp, Homo sapiens
cttgtggaattgggagct

SEQ ID NO: 4898020 - DNA, 14 bp, Homo sapiens
cttgtggacacagc

SEQ ID NO: 4898021 - DNA, 16 bp, Homo sapiens
cttgtggacacagctc

SEQ ID NO: 4898022 - DNA, 21 bp, Homo sapiens
cttgtggacacagctcttctc

SEQ ID NO: 4898023 - DNA, 13 bp, Homo sapiens
cttgtggcagagg

SEQ ID NO: 4898024 - DNA, 17 bp, Homo sapiens
cttgtggcagaggatgt

SEQ ID NO: 4898025 - DNA, 22 bp, Homo sapiens
cttgtggccctctcccttaccc

SEQ ID NO: 4898026 - DNA, 14 bp, Homo sapiens
cttgtgtctgtaca

SEQ ID NO: 4898027 - DNA, 18 bp, Homo sapiens
cttgtgtctgtacacgtg

SEQ ID NO: 4898028 - DNA, 16 bp, Homo sapiens
cttgttagaaaacaaa

SEQ ID NO: 4898029 - DNA, 14 bp, Homo sapiens
cttgttattgtgaa

SEQ ID NO: 4898030 - DNA, 16 bp, Homo sapiens
cttgttattgtgaatg

SEQ ID NO: 4898031 - DNA, 13 bp, Homo sapiens
cttgttccagctc

SEQ ID NO: 4898032 - DNA, 14 bp, Homo sapiens
cttgttccctctcc

SEQ ID NO: 4898033 - DNA, 20 bp, Homo sapiens
cttgttgttggttgtttttt

SEQ ID NO: 4898034 - DNA, 22 bp, Homo sapiens
cttgtttatcagatacatcact

SEQ ID NO: 4898035 - DNA, 23 bp, Homo sapiens
cttgtttattgagtttgtaggta

SEQ ID NO: 4898036 - DNA, 15 bp, Homo sapiens
cttgtttgtcttcca

SEQ ID NO: 4898037 - DNA, 13 bp, Homo sapiens
cttgttttataaa

SEQ ID NO: 4898038 - DNA, 20 bp, Homo sapiens
cttgttttctttctttaaat

SEQ ID NO: 4898039 - DNA, 18 bp, Homo sapiens
cttgttttgtttgtctct

SEQ ID NO: 4898040 - DNA, 22 bp, Homo sapiens
cttgttttgtttgtctctcctt

SEQ ID NO: 4898041 - DNA, 17 bp, Homo sapiens
ctttaaaaaatatttat

SEQ ID NO: 4898042 - DNA, 14 bp, Homo sapiens
ctttaaaacaaaac

SEQ ID NO: 4898043 - DNA, 15 bp, Homo sapiens
ctttaaaacaaaaca

SEQ ID NO: 4898044 - DNA, 18 bp, Homo sapiens
ctttaaacagtatttcat

SEQ ID NO: 4898045 - DNA, 15 bp, Homo sapiens
ctttaaactcaggga

SEQ ID NO: 4898046 - DNA, 16 bp, Homo sapiens
ctttaaactcagggac

SEQ ID NO: 4898047 - DNA, 22 bp, Homo sapiens
ctttaaactcagggacagagcc

SEQ ID NO: 4898048 - DNA, 21 bp, Homo sapiens
ctttaaagtgtaataatatga

SEQ ID NO: 4898049 - DNA, 13 bp, Homo sapiens
ctttaaatagata

SEQ ID NO: 4898050 - DNA, 18 bp, Homo sapiens
ctttaaatgttttataag

SEQ ID NO: 4898051 - DNA, 22 bp, Homo sapiens
ctttaaatgttttataagttca

SEQ ID NO: 4898052 - DNA, 15 bp, Homo sapiens
ctttaagcagagaag

SEQ ID NO: 4898053 - DNA, 22 bp, Homo sapiens
ctttaagggcatgccttgtgct

SEQ ID NO: 4898054 - DNA, 20 bp, Homo sapiens
ctttacaaaagaaatacctt

SEQ ID NO: 4898055 - DNA, 14 bp, Homo sapiens
ctttacacacacag

SEQ ID NO: 4898056 - DNA, 17 bp, Homo sapiens
ctttacccacctagaac

SEQ ID NO: 4898057 - DNA, 19 bp, Homo sapiens
ctttacccacctagaacac

SEQ ID NO: 4898058 - DNA, 21 bp, Homo sapiens
ctttacgtgtttaaaaaaaag

SEQ ID NO: 4898059 - DNA, 22 bp, Homo sapiens
ctttacgtgtttaaaaaaaagc

SEQ ID NO: 4898060 - DNA, 13 bp, Homo sapiens
ctttactcccaag

SEQ ID NO: 4898061 - DNA, 22 bp, Homo sapiens
ctttactcccaagacttcattg

SEQ ID NO: 4898062 - DNA, 19 bp, Homo sapiens
ctttactttcccttgcttt

SEQ ID NO: 4898063 - DNA, 23 bp, Homo sapiens
ctttactttcccttgcttttccc

SEQ ID NO: 4898064 - DNA, 20 bp, Homo sapiens
ctttagaagtgcatttctga

SEQ ID NO: 4898065 - DNA, 15 bp, Homo sapiens
ctttagcgcccagtt

SEQ ID NO: 4898066 - DNA, 19 bp, Homo sapiens
ctttatacattagtaaatg

SEQ ID NO: 4898067 - DNA, 22 bp, Homo sapiens
ctttatacattagtaaatgtct

SEQ ID NO: 4898068 - DNA, 15 bp, Homo sapiens
ctttatatatggaca

SEQ ID NO: 4898069 - DNA, 16 bp, Homo sapiens
ctttatatatggacat

SEQ ID NO: 4898070 - DNA, 18 bp, Homo sapiens
ctttatatttatccacta

SEQ ID NO: 4898071 - DNA, 13 bp, Homo sapiens
ctttatcactttt

SEQ ID NO: 4898072 - DNA, 17 bp, Homo sapiens
ctttatcactttttgaa

SEQ ID NO: 4898073 - DNA, 22 bp, Homo sapiens
ctttatcactttttgaactaag

SEQ ID NO: 4898074 - DNA, 22 bp, Homo sapiens
ctttatctaatacctctgtgtg

SEQ ID NO: 4898075 - DNA, 16 bp, Homo sapiens
ctttatgattttcata

SEQ ID NO: 4898076 - DNA, 18 bp, Homo sapiens
ctttatgattttcataac

SEQ ID NO: 4898077 - DNA, 20 bp, Homo sapiens
ctttatggtcctaaaagcaa

SEQ ID NO: 4898078 - DNA, 23 bp, Homo sapiens
ctttatgtggaaaacagaacatc

SEQ ID NO: 4898079 - DNA, 12 bp, Homo sapiens
ctttatgtgtaa

SEQ ID NO: 4898080 - DNA, 14 bp, Homo sapiens
ctttattaccccct

SEQ ID NO: 4898081 - DNA, 22 bp, Homo sapiens
ctttattaccccctccttcaga

SEQ ID NO: 4898082 - DNA, 23 bp, Homo sapiens
ctttattccagaatgctgtacat

SEQ ID NO: 4898083 - DNA, 12 bp, Homo sapiens
ctttattggaaa

SEQ ID NO: 4898084 - DNA, 13 bp, Homo sapiens
ctttatttgtttt

SEQ ID NO: 4898085 - DNA, 21 bp, Homo sapiens
ctttattttcccctatcattt

SEQ ID NO: 4898086 - DNA, 15 bp, Homo sapiens
ctttcaaatttcaca

SEQ ID NO: 4898087 - DNA, 14 bp, Homo sapiens
ctttcaagtgcctt

SEQ ID NO: 4898088 - DNA, 16 bp, Homo sapiens
ctttcacctttgtgta

SEQ ID NO: 4898089 - DNA, 17 bp, Homo sapiens
ctttcagggccatggtt

SEQ ID NO: 4898090 - DNA, 18 bp, Homo sapiens
ctttcatcctgactctgc

SEQ ID NO: 4898091 - DNA, 19 bp, Homo sapiens
ctttcatcctgactctgcc

SEQ ID NO: 4898092 - DNA, 21 bp, Homo sapiens
ctttcatcctgactctgcccc

SEQ ID NO: 4898093 - DNA, 22 bp, Homo sapiens
ctttcatcctgactctgccccc

SEQ ID NO: 4898094 - DNA, 17 bp, Homo sapiens
ctttccacttcttcctt

SEQ ID NO: 4898095 - DNA, 22 bp, Homo sapiens
ctttccccagcatcactcccca

SEQ ID NO: 4898096 - DNA, 23 bp, Homo sapiens
ctttcccttgcttttccctcttt

SEQ ID NO: 4898097 - DNA, 14 bp, Homo sapiens
ctttccttcctaat

SEQ ID NO: 4898098 - DNA, 17 bp, Homo sapiens
ctttcctttccccagcc

SEQ ID NO: 4898099 - DNA, 21 bp, Homo sapiens
ctttcctttccccagcccagg

SEQ ID NO: 4898100 - DNA, 15 bp, Homo sapiens
ctttccttttcttta

SEQ ID NO: 4898101 - DNA, 22 bp, Homo sapiens
ctttcggggagaggctgaggac

SEQ ID NO: 4898102 - DNA, 14 bp, Homo sapiens
ctttcgtcaccctt

SEQ ID NO: 4898103 - DNA, 22 bp, Homo sapiens
ctttcgtgtaaattatgtaatg

SEQ ID NO: 4898104 - DNA, 14 bp, Homo sapiens
ctttctaatgctga

SEQ ID NO: 4898105 - DNA, 23 bp, Homo sapiens
ctttctacaaagcactagagaat

SEQ ID NO: 4898106 - DNA, 16 bp, Homo sapiens
ctttctacccagcgag

SEQ ID NO: 4898107 - DNA, 19 bp, Homo sapiens
ctttctagtggtctttgta

SEQ ID NO: 4898108 - DNA, 21 bp, Homo sapiens
ctttctagtggtctttgtaag

SEQ ID NO: 4898109 - DNA, 22 bp, Homo sapiens
ctttctcagccgcttctgactg

SEQ ID NO: 4898110 - DNA, 14 bp, Homo sapiens
ctttctccaaagtt

SEQ ID NO: 4898111 - DNA, 12 bp, Homo sapiens
ctttctcctgtt

SEQ ID NO: 4898112 - DNA, 13 bp, Homo sapiens
ctttctctcccca

SEQ ID NO: 4898113 - DNA, 14 bp, Homo sapiens
ctttctctccccaa

SEQ ID NO: 4898114 - DNA, 18 bp, Homo sapiens
ctttctctccccaacccc

SEQ ID NO: 4898115 - DNA, 14 bp, Homo sapiens
ctttctctttcttc

SEQ ID NO: 4898116 - DNA, 18 bp, Homo sapiens
ctttctctttcttccttt

SEQ ID NO: 4898117 - DNA, 17 bp, Homo sapiens
ctttctgtaccatttat

SEQ ID NO: 4898118 - DNA, 19 bp, Homo sapiens
ctttctgtatatacttttt

SEQ ID NO: 4898119 - DNA, 22 bp, Homo sapiens
ctttctgtgccctactcattgg

SEQ ID NO: 4898120 - DNA, 21 bp, Homo sapiens
ctttctgttggattccatgct

SEQ ID NO: 4898121 - DNA, 15 bp, Homo sapiens
ctttcttcctctgct

SEQ ID NO: 4898122 - DNA, 11 bp, Homo sapiens
ctttcttcctt

SEQ ID NO: 4898123 - DNA, 12 bp, Homo sapiens
ctttcttgacaa

SEQ ID NO: 4898124 - DNA, 14 bp, Homo sapiens
ctttcttgctccct

SEQ ID NO: 4898125 - DNA, 16 bp, Homo sapiens
ctttcttgctcccttc

SEQ ID NO: 4898126 - DNA, 17 bp, Homo sapiens
ctttcttgctcccttca

SEQ ID NO: 4898127 - DNA, 16 bp, Homo sapiens
ctttctttaaatgttt

SEQ ID NO: 4898128 - DNA, 17 bp, Homo sapiens
ctttctttgattctcct

SEQ ID NO: 4898129 - DNA, 11 bp, Homo sapiens
ctttcttttct

SEQ ID NO: 4898130 - DNA, 14 bp, Homo sapiens
ctttgaaatacctc

SEQ ID NO: 4898131 - DNA, 16 bp, Homo sapiens
ctttgaaatacctcat

SEQ ID NO: 4898132 - DNA, 19 bp, Homo sapiens
ctttgaaatagtctgtgtg

SEQ ID NO: 4898133 - DNA, 19 bp, Homo sapiens
ctttgaagcagttgtgtca

SEQ ID NO: 4898134 - DNA, 14 bp, Homo sapiens
ctttgacatttaat

SEQ ID NO: 4898135 - DNA, 20 bp, Homo sapiens
ctttgacgagtcaccttcca

SEQ ID NO: 4898136 - DNA, 21 bp, Homo sapiens
ctttgactgatgctgagattc

SEQ ID NO: 4898137 - DNA, 17 bp, Homo sapiens
ctttgagaagccttcag

SEQ ID NO: 4898138 - DNA, 22 bp, Homo sapiens
ctttgagggactgcctctgcca

SEQ ID NO: 4898139 - DNA, 19 bp, Homo sapiens
ctttgagtcccccagagat

SEQ ID NO: 4898140 - DNA, 21 bp, Homo sapiens
ctttgataatgttaaatttgt

SEQ ID NO: 4898141 - DNA, 16 bp, Homo sapiens
ctttgatgtcatgtgt

SEQ ID NO: 4898142 - DNA, 18 bp, Homo sapiens
ctttgatgtcatgtgttc

SEQ ID NO: 4898143 - DNA, 23 bp, Homo sapiens
ctttgattctccttttatgtgta

SEQ ID NO: 4898144 - DNA, 14 bp, Homo sapiens
ctttgattgcacat

SEQ ID NO: 4898145 - DNA, 18 bp, Homo sapiens
ctttgcacagctctccgg

SEQ ID NO: 4898146 - DNA, 16 bp, Homo sapiens
ctttgcacaggatgct

SEQ ID NO: 4898147 - DNA, 15 bp, Homo sapiens
ctttgcacattttga

SEQ ID NO: 4898148 - DNA, 21 bp, Homo sapiens
ctttgcacgacgccctctccc

SEQ ID NO: 4898149 - DNA, 19 bp, Homo sapiens
ctttgcagggcagccccac

SEQ ID NO: 4898150 - DNA, 21 bp, Homo sapiens
ctttgcatatgagccgtgaac

SEQ ID NO: 4898151 - DNA, 22 bp, Homo sapiens
ctttgccttgggctgctcctca

SEQ ID NO: 4898152 - DNA, 23 bp, Homo sapiens
ctttgccttgggctgctcctcat

SEQ ID NO: 4898153 - DNA, 11 bp, Homo sapiens
ctttgctgcca

SEQ ID NO: 4898154 - DNA, 17 bp, Homo sapiens
ctttggaaaaatgtttg

SEQ ID NO: 4898155 - DNA, 14 bp, Homo sapiens
ctttggagtcccct

SEQ ID NO: 4898156 - DNA, 13 bp, Homo sapiens
ctttggatttgac

SEQ ID NO: 4898157 - DNA, 16 bp, Homo sapiens
ctttggatttgacatt

SEQ ID NO: 4898158 - DNA, 13 bp, Homo sapiens
ctttggctcccct

SEQ ID NO: 4898159 - DNA, 19 bp, Homo sapiens
ctttgggatttaatttcca

SEQ ID NO: 4898160 - DNA, 18 bp, Homo sapiens
ctttgggcctctgcttct

SEQ ID NO: 4898161 - DNA, 15 bp, Homo sapiens
ctttgggctgccctg

SEQ ID NO: 4898162 - DNA, 23 bp, Homo sapiens
ctttggggtctacactgcaatca

SEQ ID NO: 4898163 - DNA, 17 bp, Homo sapiens
ctttgggttaagcatta

SEQ ID NO: 4898164 - DNA, 13 bp, Homo sapiens
ctttggttctaag

SEQ ID NO: 4898165 - DNA, 15 bp, Homo sapiens
ctttggttctaagga

SEQ ID NO: 4898166 - DNA, 17 bp, Homo sapiens
ctttgtaagagtgtaga

SEQ ID NO: 4898167 - DNA, 21 bp, Homo sapiens
ctttgtaagtcagtgttgaga

SEQ ID NO: 4898168 - DNA, 13 bp, Homo sapiens
ctttgtagatcct

SEQ ID NO: 4898169 - DNA, 20 bp, Homo sapiens
ctttgtatactttaaataat

SEQ ID NO: 4898170 - DNA, 15 bp, Homo sapiens
ctttgtatcttccat

SEQ ID NO: 4898171 - DNA, 16 bp, Homo sapiens
ctttgtgataatttaa

SEQ ID NO: 4898172 - DNA, 17 bp, Homo sapiens
ctttgtgataatttaag

SEQ ID NO: 4898173 - DNA, 19 bp, Homo sapiens
ctttgtggaccaattattg

SEQ ID NO: 4898174 - DNA, 18 bp, Homo sapiens
ctttgtgtgtactcactg

SEQ ID NO: 4898175 - DNA, 14 bp, Homo sapiens
ctttgtgttgtaat

SEQ ID NO: 4898176 - DNA, 19 bp, Homo sapiens
ctttgtgtttggtttacat

SEQ ID NO: 4898177 - DNA, 22 bp, Homo sapiens
ctttgtgtttggtttacattta

SEQ ID NO: 4898178 - DNA, 16 bp, Homo sapiens
ctttgttgcccaggct

SEQ ID NO: 4898179 - DNA, 13 bp, Homo sapiens
ctttgtttcttgt

SEQ ID NO: 4898180 - DNA, 21 bp, Homo sapiens
ctttgtttggatgtaatttag

SEQ ID NO: 4898181 - DNA, 19 bp, Homo sapiens
ctttgttttgatgtttgtg

SEQ ID NO: 4898182 - DNA, 11 bp, Homo sapiens
cttttaaagtg

SEQ ID NO: 4898183 - DNA, 13 bp, Homo sapiens
cttttaacatttt

SEQ ID NO: 4898184 - DNA, 20 bp, Homo sapiens
cttttaacattttgttctta

SEQ ID NO: 4898185 - DNA, 15 bp, Homo sapiens
cttttaaccatctga

SEQ ID NO: 4898186 - DNA, 19 bp, Homo sapiens
cttttatactctttctgta

SEQ ID NO: 4898187 - DNA, 19 bp, Homo sapiens
cttttataggtgagaaaaa

SEQ ID NO: 4898188 - DNA, 22 bp, Homo sapiens
cttttataggtgagaaaaaaac

SEQ ID NO: 4898189 - DNA, 20 bp, Homo sapiens
cttttatagtggaaaaacac

SEQ ID NO: 4898190 - DNA, 17 bp, Homo sapiens
cttttatatttgtatcg

SEQ ID NO: 4898191 - DNA, 22 bp, Homo sapiens
cttttatctgtttaaagcatat

SEQ ID NO: 4898192 - DNA, 14 bp, Homo sapiens
cttttatgtagcac

SEQ ID NO: 4898193 - DNA, 16 bp, Homo sapiens
cttttatgtttgaata

SEQ ID NO: 4898194 - DNA, 22 bp, Homo sapiens
cttttatgtttgaatatggaca

SEQ ID NO: 4898195 - DNA, 17 bp, Homo sapiens
cttttattgacacagaa

SEQ ID NO: 4898196 - DNA, 19 bp, Homo sapiens
cttttattgtataaactat

SEQ ID NO: 4898197 - DNA, 14 bp, Homo sapiens
cttttattttgaaa

SEQ ID NO: 4898198 - DNA, 18 bp, Homo sapiens
cttttcactgctggctgc

SEQ ID NO: 4898199 - DNA, 20 bp, Homo sapiens
cttttcataacctagcctta

SEQ ID NO: 4898200 - DNA, 20 bp, Homo sapiens
cttttccctctttggctccc

SEQ ID NO: 4898201 - DNA, 19 bp, Homo sapiens
cttttccctcttttcttac

SEQ ID NO: 4898202 - DNA, 14 bp, Homo sapiens
cttttcccttcttt

SEQ ID NO: 4898203 - DNA, 16 bp, Homo sapiens
cttttcctgttgtatt

SEQ ID NO: 4898204 - DNA, 16 bp, Homo sapiens
cttttcctttgtggtt

SEQ ID NO: 4898205 - DNA, 19 bp, Homo sapiens
cttttctggccaaaagcag

SEQ ID NO: 4898206 - DNA, 13 bp, Homo sapiens
cttttctgtactt

SEQ ID NO: 4898207 - DNA, 19 bp, Homo sapiens
cttttcttaacaacctggc

SEQ ID NO: 4898208 - DNA, 14 bp, Homo sapiens
cttttcttactcct

SEQ ID NO: 4898209 - DNA, 20 bp, Homo sapiens
cttttcttttgttactgttc

SEQ ID NO: 4898210 - DNA, 16 bp, Homo sapiens
cttttctttttacata

SEQ ID NO: 4898211 - DNA, 17 bp, Homo sapiens
cttttgaggcttctgtt

SEQ ID NO: 4898212 - DNA, 20 bp, Homo sapiens
cttttgagtgtgtgtgtgca

SEQ ID NO: 4898213 - DNA, 14 bp, Homo sapiens
cttttggcttccat

SEQ ID NO: 4898214 - DNA, 15 bp, Homo sapiens
cttttggtctgtgtg

SEQ ID NO: 4898215 - DNA, 15 bp, Homo sapiens
cttttgtaaattaaa

SEQ ID NO: 4898216 - DNA, 12 bp, Homo sapiens
cttttgtataca

SEQ ID NO: 4898217 - DNA, 19 bp, Homo sapiens
cttttgtatacatcctggg

SEQ ID NO: 4898218 - DNA, 23 bp, Homo sapiens
cttttgtatacatcctgggtaat

SEQ ID NO: 4898219 - DNA, 18 bp, Homo sapiens
cttttgtctatgggactc

SEQ ID NO: 4898220 - DNA, 16 bp, Homo sapiens
cttttgtgtaatgaaa

SEQ ID NO: 4898221 - DNA, 17 bp, Homo sapiens
cttttgtgtaatgaaaa

SEQ ID NO: 4898222 - DNA, 19 bp, Homo sapiens
cttttgtgtgaattgacta

SEQ ID NO: 4898223 - DNA, 15 bp, Homo sapiens
cttttgttaaataat

SEQ ID NO: 4898224 - DNA, 13 bp, Homo sapiens
cttttgttactgt

SEQ ID NO: 4898225 - DNA, 14 bp, Homo sapiens
cttttgttactgtt

SEQ ID NO: 4898226 - DNA, 21 bp, Homo sapiens
cttttgttactgttcttgctg

SEQ ID NO: 4898227 - DNA, 23 bp, Homo sapiens
cttttgttactgttcttgctgct

SEQ ID NO: 4898228 - DNA, 14 bp, Homo sapiens
ctttttaaagctta

SEQ ID NO: 4898229 - DNA, 15 bp, Homo sapiens
ctttttaaagcttat

SEQ ID NO: 4898230 - DNA, 15 bp, Homo sapiens
ctttttaagtaatgt

SEQ ID NO: 4898231 - DNA, 22 bp, Homo sapiens
ctttttacataactgccttgaa

SEQ ID NO: 4898232 - DNA, 12 bp, Homo sapiens
ctttttagttta

SEQ ID NO: 4898233 - DNA, 13 bp, Homo sapiens
ctttttatttctg

SEQ ID NO: 4898234 - DNA, 16 bp, Homo sapiens
ctttttatttctgcat

SEQ ID NO: 4898235 - DNA, 18 bp, Homo sapiens
ctttttcctagcctgttt

SEQ ID NO: 4898236 - DNA, 23 bp, Homo sapiens
ctttttcctagcctgtttcttcc

SEQ ID NO: 4898237 - DNA, 18 bp, Homo sapiens
ctttttctgattagcttt

SEQ ID NO: 4898238 - DNA, 21 bp, Homo sapiens
ctttttctgattagctttgtg

SEQ ID NO: 4898239 - DNA, 17 bp, Homo sapiens
ctttttctgttgtaact

SEQ ID NO: 4898240 - DNA, 14 bp, Homo sapiens
ctttttcttcctca

SEQ ID NO: 4898241 - DNA, 17 bp, Homo sapiens
ctttttcttttgtaagt

SEQ ID NO: 4898242 - DNA, 18 bp, Homo sapiens
ctttttcttttgtaagtg

SEQ ID NO: 4898243 - DNA, 17 bp, Homo sapiens
ctttttgaaatgaaatt

SEQ ID NO: 4898244 - DNA, 23 bp, Homo sapiens
ctttttggtgtatagaagtttgt

SEQ ID NO: 4898245 - DNA, 13 bp, Homo sapiens
cttttttaaataa

SEQ ID NO: 4898246 - DNA, 18 bp, Homo sapiens
cttttttaaataaacttt

SEQ ID NO: 4898247 - DNA, 16 bp, Homo sapiens
cttttttaataaacta

SEQ ID NO: 4898248 - DNA, 13 bp, Homo sapiens
cttttttcctaat

SEQ ID NO: 4898249 - DNA, 10 bp, Homo sapiens
cttttttgtc

SEQ ID NO: 4898250 - DNA, 22 bp, Homo sapiens
cttttttgtttgtttctttgtg

SEQ ID NO: 4898251 - DNA, 14 bp, Homo sapiens
ctttttttcaatgt

SEQ ID NO: 4898252 - DNA, 11 bp, Homo sapiens
ctttttttccc

SEQ ID NO: 4898253 - DNA, 21 bp, Homo sapiens
ctttttttggtgattcaaatg

SEQ ID NO: 4898254 - DNA, 15 bp, Homo sapiens
cttttttttctttaa

SEQ ID NO: 4898255 - DNA, 18 bp, Homo sapiens
ctttttttttttgtttga

SEQ ID NO: 4898256 - DNA, 23 bp, Homo sapiens
ctttttttttttgtttgatgcag

SEQ ID NO: 4898257 - DNA, 16 bp, Homo sapiens
gaaaaaaaaaagaaga

SEQ ID NO: 4898258 - DNA, 17 bp, Homo sapiens
gaaaaaataacacacat

SEQ ID NO: 4898259 - DNA, 18 bp, Homo sapiens
gaaaaataaatctgttct

SEQ ID NO: 4898260 - DNA, 19 bp, Homo sapiens
gaaaaatatatactaaaca

SEQ ID NO: 4898261 - DNA, 19 bp, Homo sapiens
gaaaaatcacaatttttaa

SEQ ID NO: 4898262 - DNA, 14 bp, Homo sapiens
gaaaaatcttgtgc

SEQ ID NO: 4898263 - DNA, 11 bp, Homo sapiens
gaaaaatgttt

SEQ ID NO: 4898264 - DNA, 21 bp, Homo sapiens
gaaaacagtcaaccaacccca

SEQ ID NO: 4898265 - DNA, 11 bp, Homo sapiens
gaaaaccaaaa

SEQ ID NO: 4898266 - DNA, 17 bp, Homo sapiens
gaaaaccaaaatgacat

SEQ ID NO: 4898267 - DNA, 14 bp, Homo sapiens
gaaaactatacaac

SEQ ID NO: 4898268 - DNA, 20 bp, Homo sapiens
gaaaactgaaaatctaatat

SEQ ID NO: 4898269 - DNA, 19 bp, Homo sapiens
gaaaactttaaaaaatatt

SEQ ID NO: 4898270 - DNA, 11 bp, Homo sapiens
gaaaagaaaaa

SEQ ID NO: 4898271 - DNA, 18 bp, Homo sapiens
gaaaagacttgtaatatt

SEQ ID NO: 4898272 - DNA, 11 bp, Homo sapiens
gaaaagctatt

SEQ ID NO: 4898273 - DNA, 22 bp, Homo sapiens
gaaaagctattagccaggatca

SEQ ID NO: 4898274 - DNA, 13 bp, Homo sapiens
gaaaagctgctga

SEQ ID NO: 4898275 - DNA, 19 bp, Homo sapiens
gaaaagctgctgacagtgt

SEQ ID NO: 4898276 - DNA, 14 bp, Homo sapiens
gaaaagcttcttaa

SEQ ID NO: 4898277 - DNA, 16 bp, Homo sapiens
gaaaaggaaaagaaaa

SEQ ID NO: 4898278 - DNA, 19 bp, Homo sapiens
gaaaagggaagttgtgcct

SEQ ID NO: 4898279 - DNA, 17 bp, Homo sapiens
gaaaagtattttgaagt

SEQ ID NO: 4898280 - DNA, 23 bp, Homo sapiens
gaaaagtattttgaagtttacat

SEQ ID NO: 4898281 - DNA, 16 bp, Homo sapiens
gaaaagtcgttttcca

SEQ ID NO: 4898282 - DNA, 23 bp, Homo sapiens
gaaaataaagacaaccatattta

SEQ ID NO: 4898283 - DNA, 18 bp, Homo sapiens
gaaaataagaatagaaat

SEQ ID NO: 4898284 - DNA, 19 bp, Homo sapiens
gaaaataagtgaataataa

SEQ ID NO: 4898285 - DNA, 13 bp, Homo sapiens
gaaaatagtttgt

SEQ ID NO: 4898286 - DNA, 14 bp, Homo sapiens
gaaaatagtttgtt

SEQ ID NO: 4898287 - DNA, 21 bp, Homo sapiens
gaaaatattatgtgtttccat

SEQ ID NO: 4898288 - DNA, 17 bp, Homo sapiens
gaaaatcactttgtcta

SEQ ID NO: 4898289 - DNA, 18 bp, Homo sapiens
gaaaatgagttgtgaaag

SEQ ID NO: 4898290 - DNA, 20 bp, Homo sapiens
gaaaatgatacgcaacataa

SEQ ID NO: 4898291 - DNA, 17 bp, Homo sapiens
gaaaatgttgagaatcc

SEQ ID NO: 4898292 - DNA, 20 bp, Homo sapiens
gaaaattcaaaaagtgttta

SEQ ID NO: 4898293 - DNA, 21 bp, Homo sapiens
gaaaattttaaaaatacatat

SEQ ID NO: 4898294 - DNA, 20 bp, Homo sapiens
gaaaattttaccagcagaag

SEQ ID NO: 4898295 - DNA, 14 bp, Homo sapiens
gaaacaaataatca

SEQ ID NO: 4898296 - DNA, 19 bp, Homo sapiens
gaaacaaataatcacattg

SEQ ID NO: 4898297 - DNA, 14 bp, Homo sapiens
gaaacacagaaacc

SEQ ID NO: 4898298 - DNA, 15 bp, Homo sapiens
gaaacacgaaacttg

SEQ ID NO: 4898299 - DNA, 17 bp, Homo sapiens
gaaacacgaaacttgtt

SEQ ID NO: 4898300 - DNA, 22 bp, Homo sapiens
gaaacacgaaacttgttattgt

SEQ ID NO: 4898301 - DNA, 12 bp, Homo sapiens
gaaacactgcct

SEQ ID NO: 4898302 - DNA, 17 bp, Homo sapiens
gaaacactgccttttta

SEQ ID NO: 4898303 - DNA, 14 bp, Homo sapiens
gaaacactttctct

SEQ ID NO: 4898304 - DNA, 22 bp, Homo sapiens
gaaacactttgcctcctgtgta

SEQ ID NO: 4898305 - DNA, 22 bp, Homo sapiens
gaaacagaaacaaaaacactaa

SEQ ID NO: 4898306 - DNA, 16 bp, Homo sapiens
gaaacagctttcaagt

SEQ ID NO: 4898307 - DNA, 17 bp, Homo sapiens
gaaacatgacactgacc

SEQ ID NO: 4898308 - DNA, 12 bp, Homo sapiens
gaaacatttata

SEQ ID NO: 4898309 - DNA, 23 bp, Homo sapiens
gaaacccaagctcctcctcggaa

SEQ ID NO: 4898310 - DNA, 18 bp, Homo sapiens
gaaacctagtactgcccc

SEQ ID NO: 4898311 - DNA, 16 bp, Homo sapiens
gaaacctctacatatt

SEQ ID NO: 4898312 - DNA, 18 bp, Homo sapiens
gaaacctgaaaaaaagtt

SEQ ID NO: 4898313 - DNA, 21 bp, Homo sapiens
gaaactcttatctcagtcatg

SEQ ID NO: 4898314 - DNA, 16 bp, Homo sapiens
gaaacttgttattgtg

SEQ ID NO: 4898315 - DNA, 17 bp, Homo sapiens
gaaacttgttattgtga

SEQ ID NO: 4898316 - DNA, 19 bp, Homo sapiens
gaaacttgttattgtgaat

SEQ ID NO: 4898317 - DNA, 20 bp, Homo sapiens
gaaacttgttattgtgaatg

SEQ ID NO: 4898318 - DNA, 20 bp, Homo sapiens
gaaactttatacattagtaa

SEQ ID NO: 4898319 - DNA, 21 bp, Homo sapiens
gaaacttttgtaaagaaattt

SEQ ID NO: 4898320 - DNA, 13 bp, Homo sapiens
gaaagaatatatt

SEQ ID NO: 4898321 - DNA, 16 bp, Homo sapiens
gaaagaatatatttat

SEQ ID NO: 4898322 - DNA, 14 bp, Homo sapiens
gaaagacactgcct

SEQ ID NO: 4898323 - DNA, 22 bp, Homo sapiens
gaaagagagagagagagagaaa

SEQ ID NO: 4898324 - DNA, 13 bp, Homo sapiens
gaaagagagcagg

SEQ ID NO: 4898325 - DNA, 23 bp, Homo sapiens
gaaagatggctgtgcctctgcct

SEQ ID NO: 4898326 - DNA, 13 bp, Homo sapiens
gaaagcaggggct

SEQ ID NO: 4898327 - DNA, 13 bp, Homo sapiens
gaaagctctagaa

SEQ ID NO: 4898328 - DNA, 18 bp, Homo sapiens
gaaagctctgttgcaatt

SEQ ID NO: 4898329 - DNA, 22 bp, Homo sapiens
gaaagctgagaactcctgactg

SEQ ID NO: 4898330 - DNA, 17 bp, Homo sapiens
gaaagctgtgaacaggc

SEQ ID NO: 4898331 - DNA, 24 bp, Homo sapiens
gaaagctgtgaacaggctgggctg

SEQ ID NO: 4898332 - DNA, 22 bp, Homo sapiens
gaaaggaagctccactgtcacc

SEQ ID NO: 4898333 - DNA, 11 bp, Homo sapiens
gaaaggagact

SEQ ID NO: 4898334 - DNA, 18 bp, Homo sapiens
gaaaggaggcatgcctct

SEQ ID NO: 4898335 - DNA, 14 bp, Homo sapiens
gaaaggcctgcaca

SEQ ID NO: 4898336 - DNA, 16 bp, Homo sapiens
gaaaggcctgcacaca

SEQ ID NO: 4898337 - DNA, 13 bp, Homo sapiens
gaaagggcccaga

SEQ ID NO: 4898338 - DNA, 16 bp, Homo sapiens
gaaagggcccagagag

SEQ ID NO: 4898339 - DNA, 21 bp, Homo sapiens
gaaaggggttggggtgacagt

SEQ ID NO: 4898340 - DNA, 18 bp, Homo sapiens
gaaaggtactatatttgc

SEQ ID NO: 4898341 - DNA, 13 bp, Homo sapiens
gaaaggttctgcc

SEQ ID NO: 4898342 - DNA, 15 bp, Homo sapiens
gaaaggttctgcccg

SEQ ID NO: 4898343 - DNA, 13 bp, Homo sapiens
gaaaggttttgga

SEQ ID NO: 4898344 - DNA, 18 bp, Homo sapiens
gaaagtgaataaacttca

SEQ ID NO: 4898345 - DNA, 22 bp, Homo sapiens
gaaagtgaataaacttcagcac

SEQ ID NO: 4898346 - DNA, 23 bp, Homo sapiens
gaaagtgggtgagatgctggaga

SEQ ID NO: 4898347 - DNA, 17 bp, Homo sapiens
gaaagtgttatttttca

SEQ ID NO: 4898348 - DNA, 22 bp, Homo sapiens
gaaagttttcagaacctcttcc

SEQ ID NO: 4898349 - DNA, 17 bp, Homo sapiens
gaaataaaacctttcaa

SEQ ID NO: 4898350 - DNA, 21 bp, Homo sapiens
gaaataaaagtgaatgaaaga

SEQ ID NO: 4898351 - DNA, 23 bp, Homo sapiens
gaaataaaagtgaatgaaagatt

SEQ ID NO: 4898352 - DNA, 20 bp, Homo sapiens
gaaataaaggatgtgattgt

SEQ ID NO: 4898353 - DNA, 21 bp, Homo sapiens
gaaataaatgtatcatagaaa

SEQ ID NO: 4898354 - DNA, 14 bp, Homo sapiens
gaaataatatgcat

SEQ ID NO: 4898355 - DNA, 21 bp, Homo sapiens
gaaatacaattctacattgtc

SEQ ID NO: 4898356 - DNA, 12 bp, Homo sapiens
gaaatacctcat

SEQ ID NO: 4898357 - DNA, 21 bp, Homo sapiens
gaaatacctcatgtttatgaa

SEQ ID NO: 4898358 - DNA, 23 bp, Homo sapiens
gaaatacctcatgtttatgaaaa

SEQ ID NO: 4898359 - DNA, 14 bp, Homo sapiens
gaaatactatttaa

SEQ ID NO: 4898360 - DNA, 15 bp, Homo sapiens
gaaatactatttaaa

SEQ ID NO: 4898361 - DNA, 14 bp, Homo sapiens
gaaataggaaacaa

SEQ ID NO: 4898362 - DNA, 14 bp, Homo sapiens
gaaatataataaaa

SEQ ID NO: 4898363 - DNA, 19 bp, Homo sapiens
gaaatatatacgaacaaaa

SEQ ID NO: 4898364 - DNA, 15 bp, Homo sapiens
gaaatatatatacat

SEQ ID NO: 4898365 - DNA, 21 bp, Homo sapiens
gaaatatatatacatatgtag

SEQ ID NO: 4898366 - DNA, 20 bp, Homo sapiens
gaaatattttgataataaat

SEQ ID NO: 4898367 - DNA, 22 bp, Homo sapiens
gaaatattttgataataaattg

SEQ ID NO: 4898368 - DNA, 21 bp, Homo sapiens
gaaatattttttaatttaaag

SEQ ID NO: 4898369 - DNA, 18 bp, Homo sapiens
gaaatccctgtttaatat

SEQ ID NO: 4898370 - DNA, 20 bp, Homo sapiens
gaaatcctagtttcctctcc

SEQ ID NO: 4898371 - DNA, 12 bp, Homo sapiens
gaaatctcaccc

SEQ ID NO: 4898372 - DNA, 19 bp, Homo sapiens
gaaatgaaatttaaacatt

SEQ ID NO: 4898373 - DNA, 15 bp, Homo sapiens
gaaatgaacattcca

SEQ ID NO: 4898374 - DNA, 13 bp, Homo sapiens
gaaatgactaatt

SEQ ID NO: 4898375 - DNA, 19 bp, Homo sapiens
gaaatgagaaggcagccac

SEQ ID NO: 4898376 - DNA, 22 bp, Homo sapiens
gaaatgaggtctgtttaaagtg

SEQ ID NO: 4898377 - DNA, 18 bp, Homo sapiens
gaaatgctgatggataac

SEQ ID NO: 4898378 - DNA, 21 bp, Homo sapiens
gaaatggatactacatcttta

SEQ ID NO: 4898379 - DNA, 16 bp, Homo sapiens
gaaatgtaaactgcca

SEQ ID NO: 4898380 - DNA, 15 bp, Homo sapiens
gaaattatatctgtg

SEQ ID NO: 4898381 - DNA, 22 bp, Homo sapiens
gaaattatgtgacattttacat

SEQ ID NO: 4898382 - DNA, 15 bp, Homo sapiens
gaaattctgttaaaa

SEQ ID NO: 4898383 - DNA, 18 bp, Homo sapiens
gaaattctgttaaaatct

SEQ ID NO: 4898384 - DNA, 16 bp, Homo sapiens
gaaattctttcagcta

SEQ ID NO: 4898385 - DNA, 21 bp, Homo sapiens
gaaattgacacaagtggacct

SEQ ID NO: 4898386 - DNA, 13 bp, Homo sapiens
gaaattgtgaact

SEQ ID NO: 4898387 - DNA, 21 bp, Homo sapiens
gaaatttattagttaatatat

SEQ ID NO: 4898388 - DNA, 21 bp, Homo sapiens
gaaatttcagattcccagagc

SEQ ID NO: 4898389 - DNA, 23 bp, Homo sapiens
gaaatttcagattcccagagcaa

SEQ ID NO: 4898390 - DNA, 17 bp, Homo sapiens
gaaatttctcatcacag

SEQ ID NO: 4898391 - DNA, 14 bp, Homo sapiens
gaacaaaaaaacca

SEQ ID NO: 4898392 - DNA, 19 bp, Homo sapiens
gaacaaaaaaaccacaaag

SEQ ID NO: 4898393 - DNA, 23 bp, Homo sapiens
gaacaaaacacacgcgcgcacac

SEQ ID NO: 4898394 - DNA, 13 bp, Homo sapiens
gaacaaaagggtc

SEQ ID NO: 4898395 - DNA, 14 bp, Homo sapiens
gaacaaagctgtta

SEQ ID NO: 4898396 - DNA, 20 bp, Homo sapiens
gaacaaagctgttaaactgt

SEQ ID NO: 4898397 - DNA, 17 bp, Homo sapiens
gaacaaagtgaaggaca

SEQ ID NO: 4898398 - DNA, 19 bp, Homo sapiens
gaacaaatattcagaatat

SEQ ID NO: 4898399 - DNA, 17 bp, Homo sapiens
gaacacaaactgtaaat

SEQ ID NO: 4898400 - DNA, 23 bp, Homo sapiens
gaacacccttagaaaatgtgtcc

SEQ ID NO: 4898401 - DNA, 12 bp, Homo sapiens
gaacagaatgtt

SEQ ID NO: 4898402 - DNA, 18 bp, Homo sapiens
gaacagacaacagaagtc

SEQ ID NO: 4898403 - DNA, 17 bp, Homo sapiens
gaacagcttcaggttat

SEQ ID NO: 4898404 - DNA, 16 bp, Homo sapiens
gaacaggtggttttta

SEQ ID NO: 4898405 - DNA, 22 bp, Homo sapiens
gaacataaaaaggacatcagca

SEQ ID NO: 4898406 - DNA, 17 bp, Homo sapiens
gaacatccaaccttccc

SEQ ID NO: 4898407 - DNA, 18 bp, Homo sapiens
gaacatccaaccttccca

SEQ ID NO: 4898408 - DNA, 22 bp, Homo sapiens
gaacatcctttgcagggcagcc

SEQ ID NO: 4898409 - DNA, 21 bp, Homo sapiens
gaacatctttgacactctgca

SEQ ID NO: 4898410 - DNA, 22 bp, Homo sapiens
gaacatctttgacactctgcag

SEQ ID NO: 4898411 - DNA, 10 bp, Homo sapiens
gaacattgta

SEQ ID NO: 4898412 - DNA, 16 bp, Homo sapiens
gaaccaagctattcct

SEQ ID NO: 4898413 - DNA, 16 bp, Homo sapiens
gaaccaccacacccag

SEQ ID NO: 4898414 - DNA, 20 bp, Homo sapiens
gaaccaccacacccagccca

SEQ ID NO: 4898415 - DNA, 14 bp, Homo sapiens
gaacccagggctct

SEQ ID NO: 4898416 - DNA, 20 bp, Homo sapiens
gaaccctttgtttcttgttt

SEQ ID NO: 4898417 - DNA, 23 bp, Homo sapiens
gaaccctttgtttcttgtttatt

SEQ ID NO: 4898418 - DNA, 13 bp, Homo sapiens
gaaccgcacagct

SEQ ID NO: 4898419 - DNA, 17 bp, Homo sapiens
gaaccgctcacctagag

SEQ ID NO: 4898420 - DNA, 18 bp, Homo sapiens
gaaccgctcacctagagc

SEQ ID NO: 4898421 - DNA, 18 bp, Homo sapiens
gaaccgttttgaagctac

SEQ ID NO: 4898422 - DNA, 14 bp, Homo sapiens
gaacctaataccct

SEQ ID NO: 4898423 - DNA, 14 bp, Homo sapiens
gaacctcccagagg

SEQ ID NO: 4898424 - DNA, 21 bp, Homo sapiens
gaacctcccagaggtccagcc

SEQ ID NO: 4898425 - DNA, 22 bp, Homo sapiens
gaacctctgtctcatcctcctg

SEQ ID NO: 4898426 - DNA, 17 bp, Homo sapiens
gaacctgtgagtaaata

SEQ ID NO: 4898427 - DNA, 13 bp, Homo sapiens
gaaccttgctgtc

SEQ ID NO: 4898428 - DNA, 16 bp, Homo sapiens
gaacgatgtgtctgta

SEQ ID NO: 4898429 - DNA, 12 bp, Homo sapiens
gaacgcagccct

SEQ ID NO: 4898430 - DNA, 21 bp, Homo sapiens
gaacgcagccctagagcctgc

SEQ ID NO: 4898431 - DNA, 23 bp, Homo sapiens
gaacggagccccaggcctctgtg

SEQ ID NO: 4898432 - DNA, 12 bp, Homo sapiens
gaactaaatgtt

SEQ ID NO: 4898433 - DNA, 17 bp, Homo sapiens
gaactaataaatacata

SEQ ID NO: 4898434 - DNA, 20 bp, Homo sapiens
gaactcagctgtctgtggct

SEQ ID NO: 4898435 - DNA, 13 bp, Homo sapiens
gaactccttggcc

SEQ ID NO: 4898436 - DNA, 21 bp, Homo sapiens
gaactccttggcctagcccac

SEQ ID NO: 4898437 - DNA, 17 bp, Homo sapiens
gaactctctccacccta

SEQ ID NO: 4898438 - DNA, 17 bp, Homo sapiens
gaactctgaactttgga

SEQ ID NO: 4898439 - DNA, 20 bp, Homo sapiens
gaactctgaactttggagag

SEQ ID NO: 4898440 - DNA, 13 bp, Homo sapiens
gaactctgacaag

SEQ ID NO: 4898441 - DNA, 15 bp, Homo sapiens
gaactctgacaaggg

SEQ ID NO: 4898442 - DNA, 19 bp, Homo sapiens
gaactctgacaagggctga

SEQ ID NO: 4898443 - DNA, 12 bp, Homo sapiens
gaactgaactca

SEQ ID NO: 4898444 - DNA, 19 bp, Homo sapiens
gaactgccattattttctg

SEQ ID NO: 4898445 - DNA, 12 bp, Homo sapiens
gaactgggtaaa

SEQ ID NO: 4898446 - DNA, 16 bp, Homo sapiens
gaactgggtaaatgca

SEQ ID NO: 4898447 - DNA, 19 bp, Homo sapiens
gaactgtgcatagtgctgg

SEQ ID NO: 4898448 - DNA, 15 bp, Homo sapiens
gaacttactattcat

SEQ ID NO: 4898449 - DNA, 15 bp, Homo sapiens
gaacttattctgtag

SEQ ID NO: 4898450 - DNA, 15 bp, Homo sapiens
gaacttctaatatat

SEQ ID NO: 4898451 - DNA, 14 bp, Homo sapiens
gaacttgtagctgt

SEQ ID NO: 4898452 - DNA, 15 bp, Homo sapiens
gaactttccattttg

SEQ ID NO: 4898453 - DNA, 21 bp, Homo sapiens
gaactttctcttcatactttt

SEQ ID NO: 4898454 - DNA, 23 bp, Homo sapiens
gaactttctcttcatactttttt

SEQ ID NO: 4898455 - DNA, 22 bp, Homo sapiens
gaacttttcctctgtatcactg

SEQ ID NO: 4898456 - DNA, 18 bp, Homo sapiens
gaacttttttaaataaac

SEQ ID NO: 4898457 - DNA, 19 bp, Homo sapiens
gaacttttttaaataaact

SEQ ID NO: 4898458 - DNA, 20 bp, Homo sapiens
gaacttttttaaataaactt

SEQ ID NO: 4898459 - DNA, 14 bp, Homo sapiens
gaagaaaaaaatct

SEQ ID NO: 4898460 - DNA, 23 bp, Homo sapiens
gaagaaaaaaatcttctccagat

SEQ ID NO: 4898461 - DNA, 17 bp, Homo sapiens
gaagaaaagagaagaag

SEQ ID NO: 4898462 - DNA, 16 bp, Homo sapiens
gaagaacttgcatgga

SEQ ID NO: 4898463 - DNA, 16 bp, Homo sapiens
gaagaagaaaaaaacg

SEQ ID NO: 4898464 - DNA, 12 bp, Homo sapiens
gaagaagaaaag

SEQ ID NO: 4898465 - DNA, 13 bp, Homo sapiens
gaagaagaagaaa

SEQ ID NO: 4898466 - DNA, 13 bp, Homo sapiens
gaagaagcagaga

SEQ ID NO: 4898467 - DNA, 21 bp, Homo sapiens
gaagaaggtggaccttttaaa

SEQ ID NO: 4898468 - DNA, 17 bp, Homo sapiens
gaagaatggagaggaac

SEQ ID NO: 4898469 - DNA, 18 bp, Homo sapiens
gaagaatggagaggaaca

SEQ ID NO: 4898470 - DNA, 19 bp, Homo sapiens
gaagacaatttgatacata

SEQ ID NO: 4898471 - DNA, 12 bp, Homo sapiens
gaagacacagac

SEQ ID NO: 4898472 - DNA, 15 bp, Homo sapiens
gaagacaccagagca

SEQ ID NO: 4898473 - DNA, 16 bp, Homo sapiens
gaagacaccagagcag

SEQ ID NO: 4898474 - DNA, 16 bp, Homo sapiens
gaagacactgatgggc

SEQ ID NO: 4898475 - DNA, 14 bp, Homo sapiens
gaagacatttcttt

SEQ ID NO: 4898476 - DNA, 23 bp, Homo sapiens
gaagacatttcttttctttttac

SEQ ID NO: 4898477 - DNA, 16 bp, Homo sapiens
gaagacgcctgagctc

SEQ ID NO: 4898478 - DNA, 19 bp, Homo sapiens
gaagactcattcttctgta

SEQ ID NO: 4898479 - DNA, 21 bp, Homo sapiens
gaagactcattcttctgtacg

SEQ ID NO: 4898480 - DNA, 16 bp, Homo sapiens
gaagactggaagctaa

SEQ ID NO: 4898481 - DNA, 18 bp, Homo sapiens
gaagagagatatatctga

SEQ ID NO: 4898482 - DNA, 19 bp, Homo sapiens
gaagagagatatatctgaa

SEQ ID NO: 4898483 - DNA, 14 bp, Homo sapiens
gaagagaggagagg

SEQ ID NO: 4898484 - DNA, 13 bp, Homo sapiens
gaagagcaaaaat

SEQ ID NO: 4898485 - DNA, 16 bp, Homo sapiens
gaagagcttgctttga

SEQ ID NO: 4898486 - DNA, 23 bp, Homo sapiens
gaagagttgaggaactgtacaga

SEQ ID NO: 4898487 - DNA, 14 bp, Homo sapiens
gaagagttgtgcac

SEQ ID NO: 4898488 - DNA, 16 bp, Homo sapiens
gaagataattgttgaa

SEQ ID NO: 4898489 - DNA, 15 bp, Homo sapiens
gaagatcccctcagg

SEQ ID NO: 4898490 - DNA, 16 bp, Homo sapiens
gaagatcccctcagga

SEQ ID NO: 4898491 - DNA, 20 bp, Homo sapiens
gaagatcccctcaggactgc

SEQ ID NO: 4898492 - DNA, 14 bp, Homo sapiens
gaagatgcagctca

SEQ ID NO: 4898493 - DNA, 13 bp, Homo sapiens
gaagcaaggaaga

SEQ ID NO: 4898494 - DNA, 13 bp, Homo sapiens
gaagcacagcttc

SEQ ID NO: 4898495 - DNA, 14 bp, Homo sapiens
gaagcagttgtgtc

SEQ ID NO: 4898496 - DNA, 14 bp, Homo sapiens
gaagcatgtttcat

SEQ ID NO: 4898497 - DNA, 19 bp, Homo sapiens
gaagcatgtttcatgtttt

SEQ ID NO: 4898498 - DNA, 15 bp, Homo sapiens
gaagcattcagagag

SEQ ID NO: 4898499 - DNA, 19 bp, Homo sapiens
gaagcattctccccagtgt

SEQ ID NO: 4898500 - DNA, 20 bp, Homo sapiens
gaagcatttgtattttgtgt

SEQ ID NO: 4898501 - DNA, 22 bp, Homo sapiens
gaagcatttgtattttgtgtga

SEQ ID NO: 4898502 - DNA, 16 bp, Homo sapiens
gaagccaaatttatca

SEQ ID NO: 4898503 - DNA, 12 bp, Homo sapiens
gaagccagcctt

SEQ ID NO: 4898504 - DNA, 10 bp, Homo sapiens
gaagccagct

SEQ ID NO: 4898505 - DNA, 17 bp, Homo sapiens
gaagcctctggctagag

SEQ ID NO: 4898506 - DNA, 22 bp, Homo sapiens
gaagccttgcctaaatttaatg

SEQ ID NO: 4898507 - DNA, 22 bp, Homo sapiens
gaagcgcgccactcgcttcccc

SEQ ID NO: 4898508 - DNA, 20 bp, Homo sapiens
gaagcggccctaagggagtg

SEQ ID NO: 4898509 - DNA, 16 bp, Homo sapiens
gaagctaatttgcatt

SEQ ID NO: 4898510 - DNA, 23 bp, Homo sapiens
gaagctactgtgtgtgtgaatga

SEQ ID NO: 4898511 - DNA, 19 bp, Homo sapiens
gaagctccactgtcaccct

SEQ ID NO: 4898512 - DNA, 13 bp, Homo sapiens
gaagctctgaagt

SEQ ID NO: 4898513 - DNA, 16 bp, Homo sapiens
gaagctctgaagtcac

SEQ ID NO: 4898514 - DNA, 22 bp, Homo sapiens
gaagctgaaaacctaagtcctt

SEQ ID NO: 4898515 - DNA, 16 bp, Homo sapiens
gaagctgccctgccca

SEQ ID NO: 4898516 - DNA, 13 bp, Homo sapiens
gaagctgctccag

SEQ ID NO: 4898517 - DNA, 14 bp, Homo sapiens
gaagctgctccagg

SEQ ID NO: 4898518 - DNA, 20 bp, Homo sapiens
gaagctgctccaggcctgca

SEQ ID NO: 4898519 - DNA, 12 bp, Homo sapiens
gaagctgctgac

SEQ ID NO: 4898520 - DNA, 23 bp, Homo sapiens
gaagctggccgagggtcctggct

SEQ ID NO: 4898521 - DNA, 14 bp, Homo sapiens
gaagctggcctgag

SEQ ID NO: 4898522 - DNA, 23 bp, Homo sapiens
gaagctgtagtagccctttctgt

SEQ ID NO: 4898523 - DNA, 22 bp, Homo sapiens
gaagctgttgtacatttatgat

SEQ ID NO: 4898524 - DNA, 11 bp, Homo sapiens
gaagcttctaa

SEQ ID NO: 4898525 - DNA, 13 bp, Homo sapiens
gaaggacatagag

SEQ ID NO: 4898526 - DNA, 19 bp, Homo sapiens
gaaggacattgcggacagc

SEQ ID NO: 4898527 - DNA, 13 bp, Homo sapiens
gaaggagagaaag

SEQ ID NO: 4898528 - DNA, 16 bp, Homo sapiens
gaaggagagaaagtgg

SEQ ID NO: 4898529 - DNA, 21 bp, Homo sapiens
gaaggagagaaagtgggtgag

SEQ ID NO: 4898530 - DNA, 13 bp, Homo sapiens
gaaggagagcctg

SEQ ID NO: 4898531 - DNA, 15 bp, Homo sapiens
gaaggagagcctgct

SEQ ID NO: 4898532 - DNA, 14 bp, Homo sapiens
gaaggaggggaagc

SEQ ID NO: 4898533 - DNA, 16 bp, Homo sapiens
gaaggaggggaagctg

SEQ ID NO: 4898534 - DNA, 20 bp, Homo sapiens
gaaggaggggaagctgcagc

SEQ ID NO: 4898535 - DNA, 13 bp, Homo sapiens
gaaggattgtaaa

SEQ ID NO: 4898536 - DNA, 14 bp, Homo sapiens
gaaggcagacagca

SEQ ID NO: 4898537 - DNA, 20 bp, Homo sapiens
gaaggcagacagcaggcagc

SEQ ID NO: 4898538 - DNA, 21 bp, Homo sapiens
gaaggcagggggaaggtgggg

SEQ ID NO: 4898539 - DNA, 12 bp, Homo sapiens
gaaggcctcttg

SEQ ID NO: 4898540 - DNA, 17 bp, Homo sapiens
gaaggcttttggtctcc

SEQ ID NO: 4898541 - DNA, 19 bp, Homo sapiens
gaaggcttttggtctccct

SEQ ID NO: 4898542 - DNA, 15 bp, Homo sapiens
gaagggagcagcaca

SEQ ID NO: 4898543 - DNA, 13 bp, Homo sapiens
gaagggaggtggc

SEQ ID NO: 4898544 - DNA, 16 bp, Homo sapiens
gaagggcattctttcc

SEQ ID NO: 4898545 - DNA, 17 bp, Homo sapiens
gaaggggttggattgca

SEQ ID NO: 4898546 - DNA, 14 bp, Homo sapiens
gaaggtcaccagca

SEQ ID NO: 4898547 - DNA, 12 bp, Homo sapiens
gaaggtgctgga

SEQ ID NO: 4898548 - DNA, 16 bp, Homo sapiens
gaaggtgctggaggtg

SEQ ID NO: 4898549 - DNA, 19 bp, Homo sapiens
gaaggtgctggaggtggga

SEQ ID NO: 4898550 - DNA, 20 bp, Homo sapiens
gaaggtgctggaggtgggag

SEQ ID NO: 4898551 - DNA, 15 bp, Homo sapiens
gaagtaaagccatta

SEQ ID NO: 4898552 - DNA, 15 bp, Homo sapiens
gaagtaaagcctcaa

SEQ ID NO: 4898553 - DNA, 19 bp, Homo sapiens
gaagtaaccatttgcactg

SEQ ID NO: 4898554 - DNA, 16 bp, Homo sapiens
gaagtacatgaataca

SEQ ID NO: 4898555 - DNA, 18 bp, Homo sapiens
gaagtagcttgctccctg

SEQ ID NO: 4898556 - DNA, 14 bp, Homo sapiens
gaagtagtccttgg

SEQ ID NO: 4898557 - DNA, 19 bp, Homo sapiens
gaagtagtttgtataactt

SEQ ID NO: 4898558 - DNA, 22 bp, Homo sapiens
gaagtcaccttgtgtgttccaa

SEQ ID NO: 4898559 - DNA, 15 bp, Homo sapiens
gaagtcatgaagccc

SEQ ID NO: 4898560 - DNA, 11 bp, Homo sapiens
gaagtcttgta

SEQ ID NO: 4898561 - DNA, 14 bp, Homo sapiens
gaagtcttgtataa

SEQ ID NO: 4898562 - DNA, 14 bp, Homo sapiens
gaagtcttttgttc

SEQ ID NO: 4898563 - DNA, 14 bp, Homo sapiens
gaagtgcatttctg

SEQ ID NO: 4898564 - DNA, 21 bp, Homo sapiens
gaagtgcgtgaatgtatgtaa

SEQ ID NO: 4898565 - DNA, 17 bp, Homo sapiens
gaagtggactggcccct

SEQ ID NO: 4898566 - DNA, 18 bp, Homo sapiens
gaagtggactggcccctg

SEQ ID NO: 4898567 - DNA, 20 bp, Homo sapiens
gaagtggactggcccctggg

SEQ ID NO: 4898568 - DNA, 18 bp, Homo sapiens
gaagtggtaggaaagcct

SEQ ID NO: 4898569 - DNA, 15 bp, Homo sapiens
gaagttcatacctaa

SEQ ID NO: 4898570 - DNA, 20 bp, Homo sapiens
gaagttcatacctaagtact

SEQ ID NO: 4898571 - DNA, 23 bp, Homo sapiens
gaagttcatacctaagtactgta

SEQ ID NO: 4898572 - DNA, 21 bp, Homo sapiens
gaagttgacttatagtacatg

SEQ ID NO: 4898573 - DNA, 19 bp, Homo sapiens
gaagtttaaaacagtattt

SEQ ID NO: 4898574 - DNA, 21 bp, Homo sapiens
gaagtttgtccatttgtaaaa

SEQ ID NO: 4898575 - DNA, 14 bp, Homo sapiens
gaataaaaaagaaa

SEQ ID NO: 4898576 - DNA, 20 bp, Homo sapiens
gaataaaatcctaagacaca

SEQ ID NO: 4898577 - DNA, 16 bp, Homo sapiens
gaataaacttcagcac

SEQ ID NO: 4898578 - DNA, 15 bp, Homo sapiens
gaataaattgctcct

SEQ ID NO: 4898579 - DNA, 21 bp, Homo sapiens
gaataactctgtggcattatt

SEQ ID NO: 4898580 - DNA, 17 bp, Homo sapiens
gaataagaaagtttcac

SEQ ID NO: 4898581 - DNA, 23 bp, Homo sapiens
gaataagctctagttcttaacaa

SEQ ID NO: 4898582 - DNA, 15 bp, Homo sapiens
gaataatctttgggt

SEQ ID NO: 4898583 - DNA, 13 bp, Homo sapiens
gaataattattta

SEQ ID NO: 4898584 - DNA, 21 bp, Homo sapiens
gaataattgctttttcacagt

SEQ ID NO: 4898585 - DNA, 19 bp, Homo sapiens
gaataccattaaaactgct

SEQ ID NO: 4898586 - DNA, 21 bp, Homo sapiens
gaataccattaaaactgcttt

SEQ ID NO: 4898587 - DNA, 15 bp, Homo sapiens
gaatactttttaaaa

SEQ ID NO: 4898588 - DNA, 23 bp, Homo sapiens
gaatagccacatttggaatactt

SEQ ID NO: 4898589 - DNA, 14 bp, Homo sapiens
gaatataggtctct

SEQ ID NO: 4898590 - DNA, 20 bp, Homo sapiens
gaatataggtctcttctccc

SEQ ID NO: 4898591 - DNA, 16 bp, Homo sapiens
gaatatatttatttaa

SEQ ID NO: 4898592 - DNA, 21 bp, Homo sapiens
gaatatatttatttaaagcat

SEQ ID NO: 4898593 - DNA, 15 bp, Homo sapiens
gaatatgtttccttg

SEQ ID NO: 4898594 - DNA, 20 bp, Homo sapiens
gaatattcagagaatatcaa

SEQ ID NO: 4898595 - DNA, 23 bp, Homo sapiens
gaatattgtgttcctttttatga

SEQ ID NO: 4898596 - DNA, 17 bp, Homo sapiens
gaatcaagagctgccct

SEQ ID NO: 4898597 - DNA, 19 bp, Homo sapiens
gaatcaagagctgccctcc

SEQ ID NO: 4898598 - DNA, 21 bp, Homo sapiens
gaatcatgtcaggcctgtgtg

SEQ ID NO: 4898599 - DNA, 20 bp, Homo sapiens
gaatccaagcctccacagcg

SEQ ID NO: 4898600 - DNA, 16 bp, Homo sapiens
gaatccacatttctaa

SEQ ID NO: 4898601 - DNA, 17 bp, Homo sapiens
gaatcccctccctgtca

SEQ ID NO: 4898602 - DNA, 20 bp, Homo sapiens
gaatcctaggctccacccca

SEQ ID NO: 4898603 - DNA, 15 bp, Homo sapiens
gaatctactaattcc

SEQ ID NO: 4898604 - DNA, 13 bp, Homo sapiens
gaatctatattta

SEQ ID NO: 4898605 - DNA, 17 bp, Homo sapiens
gaatctatatttaacaa

SEQ ID NO: 4898606 - DNA, 16 bp, Homo sapiens
gaatctattttctatg

SEQ ID NO: 4898607 - DNA, 21 bp, Homo sapiens
gaatctattttctatgtacta

SEQ ID NO: 4898608 - DNA, 15 bp, Homo sapiens
gaatctgcaattcaa

SEQ ID NO: 4898609 - DNA, 18 bp, Homo sapiens
gaatctggagaccaggga

SEQ ID NO: 4898610 - DNA, 21 bp, Homo sapiens
gaatgaaagggcccagagagg

SEQ ID NO: 4898611 - DNA, 22 bp, Homo sapiens
gaatgaaccacatcttgctctg

SEQ ID NO: 4898612 - DNA, 23 bp, Homo sapiens
gaatgaaccacatcttgctctgc

SEQ ID NO: 4898613 - DNA, 14 bp, Homo sapiens
gaatgaattaaata

SEQ ID NO: 4898614 - DNA, 16 bp, Homo sapiens
gaatgacaacagaagc

SEQ ID NO: 4898615 - DNA, 13 bp, Homo sapiens
gaatgagcccaga

SEQ ID NO: 4898616 - DNA, 14 bp, Homo sapiens
gaatgagcccagag

SEQ ID NO: 4898617 - DNA, 13 bp, Homo sapiens
gaatgagcctcgg

SEQ ID NO: 4898618 - DNA, 15 bp, Homo sapiens
gaatgaggtcccagg

SEQ ID NO: 4898619 - DNA, 16 bp, Homo sapiens
gaatgaggtcccaggc

SEQ ID NO: 4898620 - DNA, 21 bp, Homo sapiens
gaatgaggtcccaggcagaga

SEQ ID NO: 4898621 - DNA, 18 bp, Homo sapiens
gaatgaggtctgggctag

SEQ ID NO: 4898622 - DNA, 21 bp, Homo sapiens
gaatgagtctgttgtgtgtca

SEQ ID NO: 4898623 - DNA, 17 bp, Homo sapiens
gaatgatctcttctttt

SEQ ID NO: 4898624 - DNA, 19 bp, Homo sapiens
gaatgattcatgttatatt

SEQ ID NO: 4898625 - DNA, 16 bp, Homo sapiens
gaatgatttttagatg

SEQ ID NO: 4898626 - DNA, 15 bp, Homo sapiens
gaatgcacagatata

SEQ ID NO: 4898627 - DNA, 16 bp, Homo sapiens
gaatgcacagatatac

SEQ ID NO: 4898628 - DNA, 17 bp, Homo sapiens
gaatgcctcctgtgggg

SEQ ID NO: 4898629 - DNA, 21 bp, Homo sapiens
gaatgctgcaggacttgagaa

SEQ ID NO: 4898630 - DNA, 13 bp, Homo sapiens
gaatgctgtacat

SEQ ID NO: 4898631 - DNA, 15 bp, Homo sapiens
gaatgctgtatatgt

SEQ ID NO: 4898632 - DNA, 15 bp, Homo sapiens
gaatggacatcctgt

SEQ ID NO: 4898633 - DNA, 11 bp, Homo sapiens
gaatggagcag

SEQ ID NO: 4898634 - DNA, 22 bp, Homo sapiens
gaatggataaaataatgctgca

SEQ ID NO: 4898635 - DNA, 20 bp, Homo sapiens
gaatggattggattatttaa

SEQ ID NO: 4898636 - DNA, 20 bp, Homo sapiens
gaatggtacatgtcttccat

SEQ ID NO: 4898637 - DNA, 23 bp, Homo sapiens
gaatgtagcagccccgggagggc

SEQ ID NO: 4898638 - DNA, 13 bp, Homo sapiens
gaatgtatttatt

SEQ ID NO: 4898639 - DNA, 17 bp, Homo sapiens
gaatgtcccttttccta

SEQ ID NO: 4898640 - DNA, 22 bp, Homo sapiens
gaatgtggcccctgaacaagaa

SEQ ID NO: 4898641 - DNA, 15 bp, Homo sapiens
gaatgtgggcactgg

SEQ ID NO: 4898642 - DNA, 21 bp, Homo sapiens
gaatgtgggcactggcccagg

SEQ ID NO: 4898643 - DNA, 22 bp, Homo sapiens
gaatgttggtttactttcaaat

SEQ ID NO: 4898644 - DNA, 15 bp, Homo sapiens
gaatgtttgcctctg

SEQ ID NO: 4898645 - DNA, 11 bp, Homo sapiens
gaattaaaact

SEQ ID NO: 4898646 - DNA, 12 bp, Homo sapiens
gaattaaaactt

SEQ ID NO: 4898647 - DNA, 18 bp, Homo sapiens
gaattaaaacttcttaaa

SEQ ID NO: 4898648 - DNA, 19 bp, Homo sapiens
gaattaaaacttcttaaat

SEQ ID NO: 4898649 - DNA, 22 bp, Homo sapiens
gaattacatgtaaaacattatc

SEQ ID NO: 4898650 - DNA, 18 bp, Homo sapiens
gaattcttgaaggaaaat

SEQ ID NO: 4898651 - DNA, 23 bp, Homo sapiens
gaattcttgaaggaaaatgatac

SEQ ID NO: 4898652 - DNA, 22 bp, Homo sapiens
gaattgatttgcattgaacaca

SEQ ID NO: 4898653 - DNA, 12 bp, Homo sapiens
gaattgtgcaaa

SEQ ID NO: 4898654 - DNA, 15 bp, Homo sapiens
gaatttaaatataat

SEQ ID NO: 4898655 - DNA, 17 bp, Homo sapiens
gaatttaaatataattc

SEQ ID NO: 4898656 - DNA, 20 bp, Homo sapiens
gaatttaaatataattctgt

SEQ ID NO: 4898657 - DNA, 16 bp, Homo sapiens
gaatttactggacata

SEQ ID NO: 4898658 - DNA, 23 bp, Homo sapiens
gaatttatacctacctgtgtggt

SEQ ID NO: 4898659 - DNA, 20 bp, Homo sapiens
gaatttcttcactgttgaaa

SEQ ID NO: 4898660 - DNA, 12 bp, Homo sapiens
gaatttcttggt

SEQ ID NO: 4898661 - DNA, 21 bp, Homo sapiens
gaatttcttggtaagaagccg

SEQ ID NO: 4898662 - DNA, 14 bp, Homo sapiens
gaatttggaaatcc

SEQ ID NO: 4898663 - DNA, 23 bp, Homo sapiens
gaattttctttgtgtagctttgc

SEQ ID NO: 4898664 - DNA, 15 bp, Homo sapiens
gaattttgttgctgt

SEQ ID NO: 4898665 - DNA, 12 bp, Homo sapiens
gacaaaacttct

SEQ ID NO: 4898666 - DNA, 13 bp, Homo sapiens
gacaaaacttctt

SEQ ID NO: 4898667 - DNA, 21 bp, Homo sapiens
gacaaaacttcttgtcagaca

SEQ ID NO: 4898668 - DNA, 22 bp, Homo sapiens
gacaaaattttagtccaaataa

SEQ ID NO: 4898669 - DNA, 18 bp, Homo sapiens
gacaaaattttataagca

SEQ ID NO: 4898670 - DNA, 13 bp, Homo sapiens
gacaaatcaacag

SEQ ID NO: 4898671 - DNA, 20 bp, Homo sapiens
gacaaatctgtgtatattat

SEQ ID NO: 4898672 - DNA, 12 bp, Homo sapiens
gacaacagaagc

SEQ ID NO: 4898673 - DNA, 13 bp, Homo sapiens
gacaactgtgact

SEQ ID NO: 4898674 - DNA, 15 bp, Homo sapiens
gacaagaaaatcagg

SEQ ID NO: 4898675 - DNA, 19 bp, Homo sapiens
gacaagaggtacagggttt

SEQ ID NO: 4898676 - DNA, 21 bp, Homo sapiens
gacaaggattgctactgtcct

SEQ ID NO: 4898677 - DNA, 12 bp, Homo sapiens
gacaagggctga

SEQ ID NO: 4898678 - DNA, 15 bp, Homo sapiens
gacaagggctgacct

SEQ ID NO: 4898679 - DNA, 19 bp, Homo sapiens
gacaagtgactgtatctgt

SEQ ID NO: 4898680 - DNA, 14 bp, Homo sapiens
gacaagttccatgg

SEQ ID NO: 4898681 - DNA, 21 bp, Homo sapiens
gacaataatattgttgtataa

SEQ ID NO: 4898682 - DNA, 19 bp, Homo sapiens
gacaataattctggagata

SEQ ID NO: 4898683 - DNA, 17 bp, Homo sapiens
gacaatcattgttttga

SEQ ID NO: 4898684 - DNA, 20 bp, Homo sapiens
gacaatcattgttttgaata

SEQ ID NO: 4898685 - DNA, 22 bp, Homo sapiens
gacaattgaggtaagttttttg

SEQ ID NO: 4898686 - DNA, 14 bp, Homo sapiens
gacacaaaggaagt

SEQ ID NO: 4898687 - DNA, 12 bp, Homo sapiens
gacacacacaca

SEQ ID NO: 4898688 - DNA, 15 bp, Homo sapiens
gacacacagctctgt

SEQ ID NO: 4898689 - DNA, 18 bp, Homo sapiens
gacacacagctctgtcct

SEQ ID NO: 4898690 - DNA, 21 bp, Homo sapiens
gacacacagctctgtcctggg

SEQ ID NO: 4898691 - DNA, 21 bp, Homo sapiens
gacacagaaaatgttgagaat

SEQ ID NO: 4898692 - DNA, 11 bp, Homo sapiens
gacacagcagc

SEQ ID NO: 4898693 - DNA, 15 bp, Homo sapiens
gacacagcagcttca

SEQ ID NO: 4898694 - DNA, 23 bp, Homo sapiens
gacacagcagcttcaccagagca

SEQ ID NO: 4898695 - DNA, 13 bp, Homo sapiens
gacacagctcttc

SEQ ID NO: 4898696 - DNA, 22 bp, Homo sapiens
gacacagctcttctccaggctg

SEQ ID NO: 4898697 - DNA, 18 bp, Homo sapiens
gacacaggaaaccaacac

SEQ ID NO: 4898698 - DNA, 15 bp, Homo sapiens
gacacaggcccggct

SEQ ID NO: 4898699 - DNA, 18 bp, Homo sapiens
gacacaggcccggctcca

SEQ ID NO: 4898700 - DNA, 22 bp, Homo sapiens
gacacatatgcaccttgtgtct

SEQ ID NO: 4898701 - DNA, 23 bp, Homo sapiens
gacacatccgccttttgtataca

SEQ ID NO: 4898702 - DNA, 14 bp, Homo sapiens
gacacatttaagga

SEQ ID NO: 4898703 - DNA, 15 bp, Homo sapiens
gacacatttaaggat

SEQ ID NO: 4898704 - DNA, 14 bp, Homo sapiens
gacaccaaagttct

SEQ ID NO: 4898705 - DNA, 16 bp, Homo sapiens
gacaccacacccagcc

SEQ ID NO: 4898706 - DNA, 18 bp, Homo sapiens
gacaccagagcagatgca

SEQ ID NO: 4898707 - DNA, 13 bp, Homo sapiens
gacaccctcaacc

SEQ ID NO: 4898708 - DNA, 19 bp, Homo sapiens
gacaccggctggcagggct

SEQ ID NO: 4898709 - DNA, 13 bp, Homo sapiens
gacacctgccctg

SEQ ID NO: 4898710 - DNA, 18 bp, Homo sapiens
gacaccttgacagggcac

SEQ ID NO: 4898711 - DNA, 20 bp, Homo sapiens
gacaccttgacagggcacac

SEQ ID NO: 4898712 - DNA, 15 bp, Homo sapiens
gacacggagcccagc

SEQ ID NO: 4898713 - DNA, 18 bp, Homo sapiens
gacactaaccacgctgga

SEQ ID NO: 4898714 - DNA, 14 bp, Homo sapiens
gacactagaaaact

SEQ ID NO: 4898715 - DNA, 14 bp, Homo sapiens
gacactccagtgcc

SEQ ID NO: 4898716 - DNA, 21 bp, Homo sapiens
gacactcctagagaacgcagc

SEQ ID NO: 4898717 - DNA, 16 bp, Homo sapiens
gacactgccacacagg

SEQ ID NO: 4898718 - DNA, 12 bp, Homo sapiens
gacactgcctgg

SEQ ID NO: 4898719 - DNA, 12 bp, Homo sapiens
gacactgtacaa

SEQ ID NO: 4898720 - DNA, 23 bp, Homo sapiens
gacactgtgcccagcccggacct

SEQ ID NO: 4898721 - DNA, 23 bp, Homo sapiens
gacagaaggtgccactttaccca

SEQ ID NO: 4898722 - DNA, 13 bp, Homo sapiens
gacagacacacac

SEQ ID NO: 4898723 - DNA, 14 bp, Homo sapiens
gacagacacaggcc

SEQ ID NO: 4898724 - DNA, 17 bp, Homo sapiens
gacagacacaggcccgg

SEQ ID NO: 4898725 - DNA, 22 bp, Homo sapiens
gacagactgcaagaggctcctg

SEQ ID NO: 4898726 - DNA, 23 bp, Homo sapiens
gacagaggcagccccattctgcc

SEQ ID NO: 4898727 - DNA, 15 bp, Homo sapiens
gacagaggcctgccc

SEQ ID NO: 4898728 - DNA, 16 bp, Homo sapiens
gacagagtatgaacac

SEQ ID NO: 4898729 - DNA, 19 bp, Homo sapiens
gacagatgccccagagctg

SEQ ID NO: 4898730 - DNA, 17 bp, Homo sapiens
gacagattcagtcttgc

SEQ ID NO: 4898731 - DNA, 17 bp, Homo sapiens
gacagcaggcagcgcca

SEQ ID NO: 4898732 - DNA, 13 bp, Homo sapiens
gacagcatgtgcc

SEQ ID NO: 4898733 - DNA, 21 bp, Homo sapiens
gacagccacggccaggccaga

SEQ ID NO: 4898734 - DNA, 11 bp, Homo sapiens
gacagcctccc

SEQ ID NO: 4898735 - DNA, 19 bp, Homo sapiens
gacagcctggcacagggca

SEQ ID NO: 4898736 - DNA, 11 bp, Homo sapiens
gacagctcctt

SEQ ID NO: 4898737 - DNA, 14 bp, Homo sapiens
gacagctccttctg

SEQ ID NO: 4898738 - DNA, 16 bp, Homo sapiens
gacagctccttctgtc

SEQ ID NO: 4898739 - DNA, 13 bp, Homo sapiens
gacaggcaagcac

SEQ ID NO: 4898740 - DNA, 16 bp, Homo sapiens
gacaggcaatgctggc

SEQ ID NO: 4898741 - DNA, 18 bp, Homo sapiens
gacaggcaatgctggctg

SEQ ID NO: 4898742 - DNA, 19 bp, Homo sapiens
gacaggcaatgctggctgt

SEQ ID NO: 4898743 - DNA, 24 bp, Homo sapiens
gacaggcaatgctggctgttggct

SEQ ID NO: 4898744 - DNA, 22 bp, Homo sapiens
gacaggcatgttctctgaggac

SEQ ID NO: 4898745 - DNA, 15 bp, Homo sapiens
gacaggcctcacctc

SEQ ID NO: 4898746 - DNA, 20 bp, Homo sapiens
gacaggcctcacctctaccc

SEQ ID NO: 4898747 - DNA, 15 bp, Homo sapiens
gacaggcctgaagat

SEQ ID NO: 4898748 - DNA, 19 bp, Homo sapiens
gacaggcgagagaggagcc

SEQ ID NO: 4898749 - DNA, 21 bp, Homo sapiens
gacaggcgagagaggagccag

SEQ ID NO: 4898750 - DNA, 23 bp, Homo sapiens
gacaggcgagagaggagccagac

SEQ ID NO: 4898751 - DNA, 23 bp, Homo sapiens
gacagggcacaccgggcactcag

SEQ ID NO: 4898752 - DNA, 20 bp, Homo sapiens
gacagggcatggccaggtgg

SEQ ID NO: 4898753 - DNA, 13 bp, Homo sapiens
gacagggccagtg

SEQ ID NO: 4898754 - DNA, 15 bp, Homo sapiens
gacagtatcccacat

SEQ ID NO: 4898755 - DNA, 17 bp, Homo sapiens
gacagtcatcatcaggg

SEQ ID NO: 4898756 - DNA, 22 bp, Homo sapiens
gacagtcatcatcagggcctgg

SEQ ID NO: 4898757 - DNA, 18 bp, Homo sapiens
gacagttcacaccctgca

SEQ ID NO: 4898758 - DNA, 19 bp, Homo sapiens
gacagttcacaccctgcaa

SEQ ID NO: 4898759 - DNA, 14 bp, Homo sapiens
gacagttctgaaga

SEQ ID NO: 4898760 - DNA, 18 bp, Homo sapiens
gacagttgtctagagata

SEQ ID NO: 4898761 - DNA, 19 bp, Homo sapiens
gacagtttatcatgaagcc

SEQ ID NO: 4898762 - DNA, 21 bp, Homo sapiens
gacagtttatcatgaagcctg

SEQ ID NO: 4898763 - DNA, 23 bp, Homo sapiens
gacagtttatcatgaagcctgtg

SEQ ID NO: 4898764 - DNA, 14 bp, Homo sapiens
gacagtttcttagc

SEQ ID NO: 4898765 - DNA, 17 bp, Homo sapiens
gacagtttgtaaatgtt

SEQ ID NO: 4898766 - DNA, 19 bp, Homo sapiens
gacagtttgtaaatgttat

SEQ ID NO: 4898767 - DNA, 20 bp, Homo sapiens
gacagtttgtaaatgttatt

SEQ ID NO: 4898768 - DNA, 16 bp, Homo sapiens
gacataacgtttttcc

SEQ ID NO: 4898769 - DNA, 22 bp, Homo sapiens
gacataacgtttttcctttaaa

SEQ ID NO: 4898770 - DNA, 20 bp, Homo sapiens
gacatagatattttcacaat

SEQ ID NO: 4898771 - DNA, 13 bp, Homo sapiens
gacatcacagcag

SEQ ID NO: 4898772 - DNA, 16 bp, Homo sapiens
gacatcacttgtacaa

SEQ ID NO: 4898773 - DNA, 22 bp, Homo sapiens
gacatccatgtttgtaaaacta

SEQ ID NO: 4898774 - DNA, 23 bp, Homo sapiens
gacatccatgtttgtaaaactac

SEQ ID NO: 4898775 - DNA, 14 bp, Homo sapiens
gacatcctgtataa

SEQ ID NO: 4898776 - DNA, 17 bp, Homo sapiens
gacatctctgcaccctg

SEQ ID NO: 4898777 - DNA, 14 bp, Homo sapiens
gacatctggaatct

SEQ ID NO: 4898778 - DNA, 20 bp, Homo sapiens
gacatctggaatctggagac

SEQ ID NO: 4898779 - DNA, 22 bp, Homo sapiens
gacatctggaatctggagacca

SEQ ID NO: 4898780 - DNA, 14 bp, Homo sapiens
gacatgatttcctt

SEQ ID NO: 4898781 - DNA, 16 bp, Homo sapiens
gacatgatttccttga

SEQ ID NO: 4898782 - DNA, 24 bp, Homo sapiens
gacatgatttccttgaatgtggct

SEQ ID NO: 4898783 - DNA, 15 bp, Homo sapiens
gacatgcactgaccc

SEQ ID NO: 4898784 - DNA, 15 bp, Homo sapiens
gacatgctgactgtc

SEQ ID NO: 4898785 - DNA, 19 bp, Homo sapiens
gacatggaggttctaaggc

SEQ ID NO: 4898786 - DNA, 21 bp, Homo sapiens
gacatggaggttctaaggcct

SEQ ID NO: 4898787 - DNA, 23 bp, Homo sapiens
gacatggctctggactctaaaga

SEQ ID NO: 4898788 - DNA, 18 bp, Homo sapiens
gacatgtgaaaccttttt

SEQ ID NO: 4898789 - DNA, 14 bp, Homo sapiens
gacatgtttttgtt

SEQ ID NO: 4898790 - DNA, 18 bp, Homo sapiens
gacatgtttttgttttct

SEQ ID NO: 4898791 - DNA, 16 bp, Homo sapiens
gacattaagaatgttg

SEQ ID NO: 4898792 - DNA, 19 bp, Homo sapiens
gacattaagaatgttggtt

SEQ ID NO: 4898793 - DNA, 23 bp, Homo sapiens
gacattatgtggttttagatttt

SEQ ID NO: 4898794 - DNA, 13 bp, Homo sapiens
gacattatgtgtg

SEQ ID NO: 4898795 - DNA, 22 bp, Homo sapiens
gacattatgtgtgcatgtgtgt

SEQ ID NO: 4898796 - DNA, 17 bp, Homo sapiens
gacattgcggacagcca

SEQ ID NO: 4898797 - DNA, 14 bp, Homo sapiens
gacattgcgtttga

SEQ ID NO: 4898798 - DNA, 19 bp, Homo sapiens
gacattgttggccaaagcc

SEQ ID NO: 4898799 - DNA, 17 bp, Homo sapiens
gacatttcttttctttt

SEQ ID NO: 4898800 - DNA, 21 bp, Homo sapiens
gacatttcttttctttttaca

SEQ ID NO: 4898801 - DNA, 23 bp, Homo sapiens
gacatttcttttctttttacata

SEQ ID NO: 4898802 - DNA, 13 bp, Homo sapiens
gacattttacatt

SEQ ID NO: 4898803 - DNA, 14 bp, Homo sapiens
gacattttacatta

SEQ ID NO: 4898804 - DNA, 21 bp, Homo sapiens
gacattttacattaaattttt

SEQ ID NO: 4898805 - DNA, 14 bp, Homo sapiens
gaccaactgggccc

SEQ ID NO: 4898806 - DNA, 18 bp, Homo sapiens
gaccaaggggtgggccac

SEQ ID NO: 4898807 - DNA, 20 bp, Homo sapiens
gaccaataaaatttctaaga

SEQ ID NO: 4898808 - DNA, 21 bp, Homo sapiens
gaccaataaaatttctaagag

SEQ ID NO: 4898809 - DNA, 16 bp, Homo sapiens
gaccaatagcccacag

SEQ ID NO: 4898810 - DNA, 15 bp, Homo sapiens
gaccaattgtgctgc

SEQ ID NO: 4898811 - DNA, 17 bp, Homo sapiens
gaccacatctttatctg

SEQ ID NO: 4898812 - DNA, 20 bp, Homo sapiens
gaccaccccgcctgccctca

SEQ ID NO: 4898813 - DNA, 13 bp, Homo sapiens
gaccacctgccca

SEQ ID NO: 4898814 - DNA, 16 bp, Homo sapiens
gaccactcagccccta

SEQ ID NO: 4898815 - DNA, 16 bp, Homo sapiens
gaccactgtttcttgc

SEQ ID NO: 4898816 - DNA, 20 bp, Homo sapiens
gaccactgtttcttgcttgt

SEQ ID NO: 4898817 - DNA, 24 bp, Homo sapiens
gaccagacaccttgacagggcaca

SEQ ID NO: 4898818 - DNA, 21 bp, Homo sapiens
gaccagaggagcctttttaaa

SEQ ID NO: 4898819 - DNA, 23 bp, Homo sapiens
gaccaggactccctcctcacctc

SEQ ID NO: 4898820 - DNA, 14 bp, Homo sapiens
gaccaggctgtgtc

SEQ ID NO: 4898821 - DNA, 22 bp, Homo sapiens
gaccagtggtgccttggaggga

SEQ ID NO: 4898822 - DNA, 23 bp, Homo sapiens
gaccagttgaataaaagtgcaca

SEQ ID NO: 4898823 - DNA, 13 bp, Homo sapiens
gaccatgtgtcac

SEQ ID NO: 4898824 - DNA, 15 bp, Homo sapiens
gaccatgtgtcactt

SEQ ID NO: 4898825 - DNA, 18 bp, Homo sapiens
gacccactggttccttct

SEQ ID NO: 4898826 - DNA, 17 bp, Homo sapiens
gacccaggctccgccct

SEQ ID NO: 4898827 - DNA, 21 bp, Homo sapiens
gaccccagctgtgagccttgg

SEQ ID NO: 4898828 - DNA, 21 bp, Homo sapiens
gacccccaaccaagtggctcc

SEQ ID NO: 4898829 - DNA, 15 bp, Homo sapiens
gacccccacacctca

SEQ ID NO: 4898830 - DNA, 19 bp, Homo sapiens
gaccccggcttcctttccc

SEQ ID NO: 4898831 - DNA, 14 bp, Homo sapiens
gacccctccatgtg

SEQ ID NO: 4898832 - DNA, 13 bp, Homo sapiens
gacccctcctcac

SEQ ID NO: 4898833 - DNA, 19 bp, Homo sapiens
gacccctcctcactggcca

SEQ ID NO: 4898834 - DNA, 17 bp, Homo sapiens
gacccggaggggcctgg

SEQ ID NO: 4898835 - DNA, 19 bp, Homo sapiens
gacccggaggggcctggca

SEQ ID NO: 4898836 - DNA, 22 bp, Homo sapiens
gaccctactcccttgccctaga

SEQ ID NO: 4898837 - DNA, 13 bp, Homo sapiens
gaccctctgggaa

SEQ ID NO: 4898838 - DNA, 14 bp, Homo sapiens
gaccctctgggaac

SEQ ID NO: 4898839 - DNA, 20 bp, Homo sapiens
gaccctctgggaacctccca

SEQ ID NO: 4898840 - DNA, 21 bp, Homo sapiens
gaccctctgggaacctcccag

SEQ ID NO: 4898841 - DNA, 20 bp, Homo sapiens
gaccctgcaaacagaacagg

SEQ ID NO: 4898842 - DNA, 18 bp, Homo sapiens
gaccctggtgcctggctc

SEQ ID NO: 4898843 - DNA, 21 bp, Homo sapiens
gacccttcccaatcagcactg

SEQ ID NO: 4898844 - DNA, 12 bp, Homo sapiens
gaccgccccctc

SEQ ID NO: 4898845 - DNA, 16 bp, Homo sapiens
gaccgccccctcctct

SEQ ID NO: 4898846 - DNA, 20 bp, Homo sapiens
gaccgcttgtggggacccag

SEQ ID NO: 4898847 - DNA, 21 bp, Homo sapiens
gaccgcttgtggggacccagg

SEQ ID NO: 4898848 - DNA, 21 bp, Homo sapiens
gacctcacagtgacccttccc

SEQ ID NO: 4898849 - DNA, 17 bp, Homo sapiens
gacctcaggcactagcc

SEQ ID NO: 4898850 - DNA, 21 bp, Homo sapiens
gacctcccttccgaccctctg

SEQ ID NO: 4898851 - DNA, 13 bp, Homo sapiens
gacctcttgctgt

SEQ ID NO: 4898852 - DNA, 14 bp, Homo sapiens
gacctcttgctgtc

SEQ ID NO: 4898853 - DNA, 15 bp, Homo sapiens
gacctcttgctgtct

SEQ ID NO: 4898854 - DNA, 17 bp, Homo sapiens
gacctcttgctgtctct

SEQ ID NO: 4898855 - DNA, 22 bp, Homo sapiens
gacctcttgctgtctctgctcg

SEQ ID NO: 4898856 - DNA, 14 bp, Homo sapiens
gacctgatcactag

SEQ ID NO: 4898857 - DNA, 19 bp, Homo sapiens
gacctgcctcctgcctgcc

SEQ ID NO: 4898858 - DNA, 23 bp, Homo sapiens
gacctgcctcctgcctgcccctc

SEQ ID NO: 4898859 - DNA, 22 bp, Homo sapiens
gacctgcctctcacacacatag

SEQ ID NO: 4898860 - DNA, 17 bp, Homo sapiens
gacctgctccgctgctc

SEQ ID NO: 4898861 - DNA, 23 bp, Homo sapiens
gacctgctccgctgctccttggc

SEQ ID NO: 4898862 - DNA, 16 bp, Homo sapiens
gacctgctttttgaaa

SEQ ID NO: 4898863 - DNA, 17 bp, Homo sapiens
gacctgctttttgaaat

SEQ ID NO: 4898864 - DNA, 15 bp, Homo sapiens
gacctggataactta

SEQ ID NO: 4898865 - DNA, 17 bp, Homo sapiens
gacctggataacttagg

SEQ ID NO: 4898866 - DNA, 20 bp, Homo sapiens
gacctggggcacagtccagg

SEQ ID NO: 4898867 - DNA, 22 bp, Homo sapiens
gacctggggcacagtccaggaa

SEQ ID NO: 4898868 - DNA, 19 bp, Homo sapiens
gacctggtaccctcctggc

SEQ ID NO: 4898869 - DNA, 21 bp, Homo sapiens
gacctggtaccctcctggctc

SEQ ID NO: 4898870 - DNA, 23 bp, Homo sapiens
gacctggtaccctcctggctctt

SEQ ID NO: 4898871 - DNA, 22 bp, Homo sapiens
gaccttcctcatccaccccatc

SEQ ID NO: 4898872 - DNA, 12 bp, Homo sapiens
gaccttcctctg

SEQ ID NO: 4898873 - DNA, 21 bp, Homo sapiens
gaccttcctctggggctctag

SEQ ID NO: 4898874 - DNA, 16 bp, Homo sapiens
gaccttggagagacac

SEQ ID NO: 4898875 - DNA, 14 bp, Homo sapiens
gaccttttaaagtg

SEQ ID NO: 4898876 - DNA, 15 bp, Homo sapiens
gacgacaggcgagag

SEQ ID NO: 4898877 - DNA, 15 bp, Homo sapiens
gacgattccttctct

SEQ ID NO: 4898878 - DNA, 23 bp, Homo sapiens
gacgccctctccccacccctacc

SEQ ID NO: 4898879 - DNA, 21 bp, Homo sapiens
gacgccggggacagaggcctg

SEQ ID NO: 4898880 - DNA, 22 bp, Homo sapiens
gacgccggggacagaggcctgc

SEQ ID NO: 4898881 - DNA, 15 bp, Homo sapiens
gacgctgatacataa

SEQ ID NO: 4898882 - DNA, 13 bp, Homo sapiens
gacgctgcagagc

SEQ ID NO: 4898883 - DNA, 13 bp, Homo sapiens
gacgctttgtctg

SEQ ID NO: 4898884 - DNA, 21 bp, Homo sapiens
gacggagtcccaccttggctg

SEQ ID NO: 4898885 - DNA, 15 bp, Homo sapiens
gacggcctgatgctc

SEQ ID NO: 4898886 - DNA, 19 bp, Homo sapiens
gacgggttggggccgggca

SEQ ID NO: 4898887 - DNA, 24 bp, Homo sapiens
gacggtgacaaagatggctcagag

SEQ ID NO: 4898888 - DNA, 22 bp, Homo sapiens
gacgtctttctttttttccccc

SEQ ID NO: 4898889 - DNA, 22 bp, Homo sapiens
gacgtggaacctctgtctcatc

SEQ ID NO: 4898890 - DNA, 23 bp, Homo sapiens
gactaaccccaacgcacaggaaa

SEQ ID NO: 4898891 - DNA, 15 bp, Homo sapiens
gactaagcctacctg

SEQ ID NO: 4898892 - DNA, 18 bp, Homo sapiens
gactaagcctacctgctc

SEQ ID NO: 4898893 - DNA, 15 bp, Homo sapiens
gactaattaggcaag

SEQ ID NO: 4898894 - DNA, 18 bp, Homo sapiens
gactaatttaaaaaataa

SEQ ID NO: 4898895 - DNA, 13 bp, Homo sapiens
gactacaggcacc

SEQ ID NO: 4898896 - DNA, 18 bp, Homo sapiens
gactacaggcacccacca

SEQ ID NO: 4898897 - DNA, 14 bp, Homo sapiens
gactacatttagag

SEQ ID NO: 4898898 - DNA, 14 bp, Homo sapiens
gactactattttct

SEQ ID NO: 4898899 - DNA, 15 bp, Homo sapiens
gactagaagggccag

SEQ ID NO: 4898900 - DNA, 20 bp, Homo sapiens
gactagggattcaggctgct

SEQ ID NO: 4898901 - DNA, 14 bp, Homo sapiens
gactagtacaaatt

SEQ ID NO: 4898902 - DNA, 17 bp, Homo sapiens
gactagtacaaattata

SEQ ID NO: 4898903 - DNA, 16 bp, Homo sapiens
gactatatagagatgt

SEQ ID NO: 4898904 - DNA, 20 bp, Homo sapiens
gactatatagagatgttttt

SEQ ID NO: 4898905 - DNA, 23 bp, Homo sapiens
gactatatagagatgtttttaaa

SEQ ID NO: 4898906 - DNA, 22 bp, Homo sapiens
gactattaggtgcaatttcaag

SEQ ID NO: 4898907 - DNA, 19 bp, Homo sapiens
gactattctgtatctttca

SEQ ID NO: 4898908 - DNA, 21 bp, Homo sapiens
gactatttaaacttataaatc

SEQ ID NO: 4898909 - DNA, 16 bp, Homo sapiens
gactcaaatgttctaa

SEQ ID NO: 4898910 - DNA, 19 bp, Homo sapiens
gactcaaatgttctaagtt

SEQ ID NO: 4898911 - DNA, 23 bp, Homo sapiens
gactcaaatgttctaagtttcta

SEQ ID NO: 4898912 - DNA, 15 bp, Homo sapiens
gactcaatccctagg

SEQ ID NO: 4898913 - DNA, 14 bp, Homo sapiens
gactcacaggaagg

SEQ ID NO: 4898914 - DNA, 21 bp, Homo sapiens
gactcagggccatgcctgccc

SEQ ID NO: 4898915 - DNA, 20 bp, Homo sapiens
gactcattccctagatcttt

SEQ ID NO: 4898916 - DNA, 23 bp, Homo sapiens
gactccacgatcctgccaccctg

SEQ ID NO: 4898917 - DNA, 17 bp, Homo sapiens
gactcccaagtttccat

SEQ ID NO: 4898918 - DNA, 15 bp, Homo sapiens
gactcccatgaagcc

SEQ ID NO: 4898919 - DNA, 16 bp, Homo sapiens
gactccctcctcacct

SEQ ID NO: 4898920 - DNA, 17 bp, Homo sapiens
gactcctacctgccctg

SEQ ID NO: 4898921 - DNA, 19 bp, Homo sapiens
gactcctacctgccctgga

SEQ ID NO: 4898922 - DNA, 14 bp, Homo sapiens
gactcctctgtcca

SEQ ID NO: 4898923 - DNA, 16 bp, Homo sapiens
gactctaaagaccaaa

SEQ ID NO: 4898924 - DNA, 21 bp, Homo sapiens
gactctacagaggccatgggc

SEQ ID NO: 4898925 - DNA, 16 bp, Homo sapiens
gactctagagtccaag

SEQ ID NO: 4898926 - DNA, 18 bp, Homo sapiens
gactctagagtccaaggt

SEQ ID NO: 4898927 - DNA, 15 bp, Homo sapiens
gactctcagcccaga

SEQ ID NO: 4898928 - DNA, 17 bp, Homo sapiens
gactctcagcccagaag

SEQ ID NO: 4898929 - DNA, 21 bp, Homo sapiens
gactctcagcccagaagaaaa

SEQ ID NO: 4898930 - DNA, 18 bp, Homo sapiens
gactctgaagcctctggg

SEQ ID NO: 4898931 - DNA, 17 bp, Homo sapiens
gactctgagcgggaggc

SEQ ID NO: 4898932 - DNA, 19 bp, Homo sapiens
gactctgagcgggaggcag

SEQ ID NO: 4898933 - DNA, 21 bp, Homo sapiens
gactctgagcgggaggcagag

SEQ ID NO: 4898934 - DNA, 22 bp, Homo sapiens
gactctgagcgggaggcagagt

SEQ ID NO: 4898935 - DNA, 19 bp, Homo sapiens
gactctgcacatgtcttgt

SEQ ID NO: 4898936 - DNA, 20 bp, Homo sapiens
gactctgcatcccagcacct

SEQ ID NO: 4898937 - DNA, 15 bp, Homo sapiens
gactctgccccctgc

SEQ ID NO: 4898938 - DNA, 16 bp, Homo sapiens
gactctgccccctgct

SEQ ID NO: 4898939 - DNA, 17 bp, Homo sapiens
gactctgccccctgctg

SEQ ID NO: 4898940 - DNA, 16 bp, Homo sapiens
gactctgcctcctctt

SEQ ID NO: 4898941 - DNA, 18 bp, Homo sapiens
gactctgggctatggaca

SEQ ID NO: 4898942 - DNA, 21 bp, Homo sapiens
gactctgggctatggacacag

SEQ ID NO: 4898943 - DNA, 19 bp, Homo sapiens
gactctggtttctcattct

SEQ ID NO: 4898944 - DNA, 19 bp, Homo sapiens
gactctgtctcaaaaaaac

SEQ ID NO: 4898945 - DNA, 19 bp, Homo sapiens
gactctttttagggccagg

SEQ ID NO: 4898946 - DNA, 22 bp, Homo sapiens
gactctttttagggccaggcag

SEQ ID NO: 4898947 - DNA, 20 bp, Homo sapiens
gactgaaaatatataagctc

SEQ ID NO: 4898948 - DNA, 14 bp, Homo sapiens
gactgacagcatgt

SEQ ID NO: 4898949 - DNA, 23 bp, Homo sapiens
gactgacagcatgtgccctcctg

SEQ ID NO: 4898950 - DNA, 22 bp, Homo sapiens
gactgagccccgcagacctccc

SEQ ID NO: 4898951 - DNA, 15 bp, Homo sapiens
gactgagggactctg

SEQ ID NO: 4898952 - DNA, 21 bp, Homo sapiens
gactgagggactctgaagcct

SEQ ID NO: 4898953 - DNA, 14 bp, Homo sapiens
gactgcctctgcca

SEQ ID NO: 4898954 - DNA, 17 bp, Homo sapiens
gactgctagtgttctgt

SEQ ID NO: 4898955 - DNA, 18 bp, Homo sapiens
gactgctagtgttctgtc

SEQ ID NO: 4898956 - DNA, 15 bp, Homo sapiens
gactgctccccagcc

SEQ ID NO: 4898957 - DNA, 14 bp, Homo sapiens
gactgctgctgcct

SEQ ID NO: 4898958 - DNA, 22 bp, Homo sapiens
gactgctgctgcctggccactg

SEQ ID NO: 4898959 - DNA, 14 bp, Homo sapiens
gactggaagcacag

SEQ ID NO: 4898960 - DNA, 13 bp, Homo sapiens
gactggaagttca

SEQ ID NO: 4898961 - DNA, 18 bp, Homo sapiens
gactggacctggtggcta

SEQ ID NO: 4898962 - DNA, 20 bp, Homo sapiens
gactggctagagtcctcact

SEQ ID NO: 4898963 - DNA, 21 bp, Homo sapiens
gactggctagagtcctcactc

SEQ ID NO: 4898964 - DNA, 23 bp, Homo sapiens
gactggctagagtcctcactccc

SEQ ID NO: 4898965 - DNA, 13 bp, Homo sapiens
gactgggaggtag

SEQ ID NO: 4898966 - DNA, 16 bp, Homo sapiens
gactggggatgtggga

SEQ ID NO: 4898967 - DNA, 14 bp, Homo sapiens
gactggggggcttg

SEQ ID NO: 4898968 - DNA, 17 bp, Homo sapiens
gactggtttacaggccc

SEQ ID NO: 4898969 - DNA, 19 bp, Homo sapiens
gactggtttacaggccctg

SEQ ID NO: 4898970 - DNA, 16 bp, Homo sapiens
gactgtatctgtgtag

SEQ ID NO: 4898971 - DNA, 17 bp, Homo sapiens
gactgtatctgtgtaga

SEQ ID NO: 4898972 - DNA, 19 bp, Homo sapiens
gactgtctcacttaatcct

SEQ ID NO: 4898973 - DNA, 21 bp, Homo sapiens
gactgtggcacttgcctgggt

SEQ ID NO: 4898974 - DNA, 19 bp, Homo sapiens
gacttaaaatattcctgca

SEQ ID NO: 4898975 - DNA, 17 bp, Homo sapiens
gacttatttcttcaaat

SEQ ID NO: 4898976 - DNA, 18 bp, Homo sapiens
gacttatttcttcaaatc

SEQ ID NO: 4898977 - DNA, 23 bp, Homo sapiens
gacttcattgtccctcttcactc

SEQ ID NO: 4898978 - DNA, 19 bp, Homo sapiens
gacttcctcgcctctccca

SEQ ID NO: 4898979 - DNA, 14 bp, Homo sapiens
gacttccttactaa

SEQ ID NO: 4898980 - DNA, 15 bp, Homo sapiens
gacttccttgagaca

SEQ ID NO: 4898981 - DNA, 16 bp, Homo sapiens
gacttccttgagacac

SEQ ID NO: 4898982 - DNA, 20 bp, Homo sapiens
gacttccttgagacacggag

SEQ ID NO: 4898983 - DNA, 17 bp, Homo sapiens
gacttcggaccgcttgt

SEQ ID NO: 4898984 - DNA, 14 bp, Homo sapiens
gacttctccaggtc

SEQ ID NO: 4898985 - DNA, 15 bp, Homo sapiens
gacttggaagctccg

SEQ ID NO: 4898986 - DNA, 17 bp, Homo sapiens
gacttggcaacagaagc

SEQ ID NO: 4898987 - DNA, 18 bp, Homo sapiens
gacttgttttatgctcag

SEQ ID NO: 4898988 - DNA, 22 bp, Homo sapiens
gactttatctaatacctctgtg

SEQ ID NO: 4898989 - DNA, 22 bp, Homo sapiens
gacttttcttaacaacctggcc

SEQ ID NO: 4898990 - DNA, 21 bp, Homo sapiens
gacttttctttgtggcttcct

SEQ ID NO: 4898991 - DNA, 16 bp, Homo sapiens
gagaaaaggaaaagaa

SEQ ID NO: 4898992 - DNA, 19 bp, Homo sapiens
gagaaaaggaaaagaaaaa

SEQ ID NO: 4898993 - DNA, 18 bp, Homo sapiens
gagaaaggcctgcacaca

SEQ ID NO: 4898994 - DNA, 19 bp, Homo sapiens
gagaaaggcctgcacacaa

SEQ ID NO: 4898995 - DNA, 11 bp, Homo sapiens
gagaaattatt

SEQ ID NO: 4898996 - DNA, 12 bp, Homo sapiens
gagaaattctgt

SEQ ID NO: 4898997 - DNA, 14 bp, Homo sapiens
gagaaattctgtta

SEQ ID NO: 4898998 - DNA, 15 bp, Homo sapiens
gagaacaaatattca

SEQ ID NO: 4898999 - DNA, 17 bp, Homo sapiens
gagaactttccattttg

SEQ ID NO: 4899000 - DNA, 9 bp, Homo sapiens
gagaagaag

SEQ ID NO: 4899001 - DNA, 14 bp, Homo sapiens
gagaagaagaaaaa

SEQ ID NO: 4899002 - DNA, 16 bp, Homo sapiens
gagaagagaggagagg

SEQ ID NO: 4899003 - DNA, 12 bp, Homo sapiens
gagaagaggagc

SEQ ID NO: 4899004 - DNA, 18 bp, Homo sapiens
gagaagcatatagaggca

SEQ ID NO: 4899005 - DNA, 13 bp, Homo sapiens
gagaagccttcag

SEQ ID NO: 4899006 - DNA, 20 bp, Homo sapiens
gagaagctgctccaggcctg

SEQ ID NO: 4899007 - DNA, 12 bp, Homo sapiens
gagaagctgctg

SEQ ID NO: 4899008 - DNA, 15 bp, Homo sapiens
gagaagctggggagg

SEQ ID NO: 4899009 - DNA, 20 bp, Homo sapiens
gagaaggacccggaggggcc

SEQ ID NO: 4899010 - DNA, 22 bp, Homo sapiens
gagaaggacccggaggggcctg

SEQ ID NO: 4899011 - DNA, 14 bp, Homo sapiens
gagaaggagagaaa

SEQ ID NO: 4899012 - DNA, 12 bp, Homo sapiens
gagaaggcagcc

SEQ ID NO: 4899013 - DNA, 22 bp, Homo sapiens
gagaataagagaaagaaaatga

SEQ ID NO: 4899014 - DNA, 21 bp, Homo sapiens
gagaatctacccccagatcca

SEQ ID NO: 4899015 - DNA, 13 bp, Homo sapiens
gagaatgagcctc

SEQ ID NO: 4899016 - DNA, 13 bp, Homo sapiens
gagaattggctca

SEQ ID NO: 4899017 - DNA, 13 bp, Homo sapiens
gagaatttctaaa

SEQ ID NO: 4899018 - DNA, 19 bp, Homo sapiens
gagacaaacacctcccagg

SEQ ID NO: 4899019 - DNA, 22 bp, Homo sapiens
gagacaaacacctcccaggaga

SEQ ID NO: 4899020 - DNA, 22 bp, Homo sapiens
gagacaagttccatgggataca

SEQ ID NO: 4899021 - DNA, 13 bp, Homo sapiens
gagacagccccag

SEQ ID NO: 4899022 - DNA, 19 bp, Homo sapiens
gagacagccccagagcagg

SEQ ID NO: 4899023 - DNA, 17 bp, Homo sapiens
gagacagttatttatag

SEQ ID NO: 4899024 - DNA, 18 bp, Homo sapiens
gagacagttatttatagt

SEQ ID NO: 4899025 - DNA, 18 bp, Homo sapiens
gagacagttcaagaaagc

SEQ ID NO: 4899026 - DNA, 16 bp, Homo sapiens
gagacagtttcttagc

SEQ ID NO: 4899027 - DNA, 21 bp, Homo sapiens
gagacagtttcttagcttttt

SEQ ID NO: 4899028 - DNA, 18 bp, Homo sapiens
gagaccaaggcgggagca

SEQ ID NO: 4899029 - DNA, 16 bp, Homo sapiens
gagaccagcctgggca

SEQ ID NO: 4899030 - DNA, 23 bp, Homo sapiens
gagaccagttgaataaaagtgca

SEQ ID NO: 4899031 - DNA, 15 bp, Homo sapiens
gagacccaagggcag

SEQ ID NO: 4899032 - DNA, 17 bp, Homo sapiens
gagacccaccccacctg

SEQ ID NO: 4899033 - DNA, 19 bp, Homo sapiens
gagacccaccccacctgca

SEQ ID NO: 4899034 - DNA, 20 bp, Homo sapiens
gagacccaccccacctgcag

SEQ ID NO: 4899035 - DNA, 12 bp, Homo sapiens
gagacccccaca

SEQ ID NO: 4899036 - DNA, 15 bp, Homo sapiens
gagacccccacacct

SEQ ID NO: 4899037 - DNA, 23 bp, Homo sapiens
gagacccccacacctcagttccc

SEQ ID NO: 4899038 - DNA, 23 bp, Homo sapiens
gagaccctcgcccaactccacca

SEQ ID NO: 4899039 - DNA, 21 bp, Homo sapiens
gagaccctctgccaccagaga

SEQ ID NO: 4899040 - DNA, 22 bp, Homo sapiens
gagaccctgcaaacagaacagg

SEQ ID NO: 4899041 - DNA, 22 bp, Homo sapiens
gagaccgtcctcacccctgtcc

SEQ ID NO: 4899042 - DNA, 13 bp, Homo sapiens
gagaccttacccc

SEQ ID NO: 4899043 - DNA, 15 bp, Homo sapiens
gagacgacaggcgag

SEQ ID NO: 4899044 - DNA, 16 bp, Homo sapiens
gagacggagtcccacc

SEQ ID NO: 4899045 - DNA, 21 bp, Homo sapiens
gagactatggagcctggcaca

SEQ ID NO: 4899046 - DNA, 22 bp, Homo sapiens
gagactatttaaacttataaat

SEQ ID NO: 4899047 - DNA, 18 bp, Homo sapiens
gagactcccatgaagcct

SEQ ID NO: 4899048 - DNA, 20 bp, Homo sapiens
gagactcccatgaagccttt

SEQ ID NO: 4899049 - DNA, 16 bp, Homo sapiens
gagactctagggtcca

SEQ ID NO: 4899050 - DNA, 19 bp, Homo sapiens
gagactctagggtccagtg

SEQ ID NO: 4899051 - DNA, 13 bp, Homo sapiens
gagactctgtctc

SEQ ID NO: 4899052 - DNA, 16 bp, Homo sapiens
gagactgcgttctgca

SEQ ID NO: 4899053 - DNA, 19 bp, Homo sapiens
gagactggggggcttgaaa

SEQ ID NO: 4899054 - DNA, 11 bp, Homo sapiens
gagagaaaaaa

SEQ ID NO: 4899055 - DNA, 18 bp, Homo sapiens
gagagaaagccaggcagg

SEQ ID NO: 4899056 - DNA, 19 bp, Homo sapiens
gagagaaagccaggcaggt

SEQ ID NO: 4899057 - DNA, 18 bp, Homo sapiens
gagagaaagtgggtgaga

SEQ ID NO: 4899058 - DNA, 20 bp, Homo sapiens
gagagaaagtgggtgagatg

SEQ ID NO: 4899059 - DNA, 23 bp, Homo sapiens
gagagaaattctgttaaaatcta

SEQ ID NO: 4899060 - DNA, 18 bp, Homo sapiens
gagagacacagcgtccct

SEQ ID NO: 4899061 - DNA, 19 bp, Homo sapiens
gagagactcccatgaagcc

SEQ ID NO: 4899062 - DNA, 19 bp, Homo sapiens
gagagagaaacaaactttt

SEQ ID NO: 4899063 - DNA, 10 bp, Homo sapiens
gagagagaga

SEQ ID NO: 4899064 - DNA, 13 bp, Homo sapiens
gagagagagagaa

SEQ ID NO: 4899065 - DNA, 15 bp, Homo sapiens
gagagaggcagagag

SEQ ID NO: 4899066 - DNA, 16 bp, Homo sapiens
gagagaggcagagagc

SEQ ID NO: 4899067 - DNA, 17 bp, Homo sapiens
gagagaggcagagagcg

SEQ ID NO: 4899068 - DNA, 17 bp, Homo sapiens
gagagcaactctgagat

SEQ ID NO: 4899069 - DNA, 21 bp, Homo sapiens
gagagcagctttaaactcagg

SEQ ID NO: 4899070 - DNA, 23 bp, Homo sapiens
gagagcagctttaaactcaggga

SEQ ID NO: 4899071 - DNA, 21 bp, Homo sapiens
gagagcccagaggtaacagaa

SEQ ID NO: 4899072 - DNA, 23 bp, Homo sapiens
gagagcccagaggtaacagaaca

SEQ ID NO: 4899073 - DNA, 14 bp, Homo sapiens
gagagcctgctgca

SEQ ID NO: 4899074 - DNA, 13 bp, Homo sapiens
gagagctggtgcc

SEQ ID NO: 4899075 - DNA, 12 bp, Homo sapiens
gagaggagagag

SEQ ID NO: 4899076 - DNA, 19 bp, Homo sapiens
gagaggagagaggcagaga

SEQ ID NO: 4899077 - DNA, 18 bp, Homo sapiens
gagaggagaggagagagg

SEQ ID NO: 4899078 - DNA, 19 bp, Homo sapiens
gagaggagccagacagacc

SEQ ID NO: 4899079 - DNA, 21 bp, Homo sapiens
gagaggatgagagcccagagg

SEQ ID NO: 4899080 - DNA, 15 bp, Homo sapiens
gagaggcaatggcca

SEQ ID NO: 4899081 - DNA, 15 bp, Homo sapiens
gagaggccttttgga

SEQ ID NO: 4899082 - DNA, 19 bp, Homo sapiens
gagagggagagcagagaaa

SEQ ID NO: 4899083 - DNA, 18 bp, Homo sapiens
gagaggggaacagactgg

SEQ ID NO: 4899084 - DNA, 23 bp, Homo sapiens
gagagtctagcactcattttcta

SEQ ID NO: 4899085 - DNA, 13 bp, Homo sapiens
gagagtggctcct

SEQ ID NO: 4899086 - DNA, 17 bp, Homo sapiens
gagataccaagatgcca

SEQ ID NO: 4899087 - DNA, 14 bp, Homo sapiens
gagatactggtgga

SEQ ID NO: 4899088 - DNA, 13 bp, Homo sapiens
gagatactttttc

SEQ ID NO: 4899089 - DNA, 23 bp, Homo sapiens
gagatactttttcttttgtaagt

SEQ ID NO: 4899090 - DNA, 20 bp, Homo sapiens
gagatcaaccccttcgctcc

SEQ ID NO: 4899091 - DNA, 22 bp, Homo sapiens
gagatctccttgccctagatga

SEQ ID NO: 4899092 - DNA, 20 bp, Homo sapiens
gagatgctggagaagagagg

SEQ ID NO: 4899093 - DNA, 14 bp, Homo sapiens
gagatgggagctcc

SEQ ID NO: 4899094 - DNA, 15 bp, Homo sapiens
gagatgggagctcct

SEQ ID NO: 4899095 - DNA, 22 bp, Homo sapiens
gagatgggagctcctctcctgg

SEQ ID NO: 4899096 - DNA, 18 bp, Homo sapiens
gagatgtatgaaggcttt

SEQ ID NO: 4899097 - DNA, 23 bp, Homo sapiens
gagatgtatgaaggcttttggtc

SEQ ID NO: 4899098 - DNA, 21 bp, Homo sapiens
gagatgtcatcagagctcctc

SEQ ID NO: 4899099 - DNA, 17 bp, Homo sapiens
gagatgtttttaaaagt

SEQ ID NO: 4899100 - DNA, 19 bp, Homo sapiens
gagatgtttttaaaagttt

SEQ ID NO: 4899101 - DNA, 14 bp, Homo sapiens
gagattacaggcat

SEQ ID NO: 4899102 - DNA, 14 bp, Homo sapiens
gagattcccaagcc

SEQ ID NO: 4899103 - DNA, 16 bp, Homo sapiens
gagattcccgcgggtt

SEQ ID NO: 4899104 - DNA, 23 bp, Homo sapiens
gagattcccgcgggttccgcagg

SEQ ID NO: 4899105 - DNA, 14 bp, Homo sapiens
gagatttatataaa

SEQ ID NO: 4899106 - DNA, 16 bp, Homo sapiens
gagatttcctcctggc

SEQ ID NO: 4899107 - DNA, 16 bp, Homo sapiens
gagattttttattgct

SEQ ID NO: 4899108 - DNA, 16 bp, Homo sapiens
gagcacaaacattttt

SEQ ID NO: 4899109 - DNA, 18 bp, Homo sapiens
gagcacaaacatttttca

SEQ ID NO: 4899110 - DNA, 13 bp, Homo sapiens
gagcacaggtccc

SEQ ID NO: 4899111 - DNA, 22 bp, Homo sapiens
gagcacaggtcccacctccagc

SEQ ID NO: 4899112 - DNA, 19 bp, Homo sapiens
gagcacccattccaaagct

SEQ ID NO: 4899113 - DNA, 22 bp, Homo sapiens
gagcagaccaccccgcctgccc

SEQ ID NO: 4899114 - DNA, 12 bp, Homo sapiens
gagcagagagct

SEQ ID NO: 4899115 - DNA, 21 bp, Homo sapiens
gagcagatgcagagagccatt

SEQ ID NO: 4899116 - DNA, 23 bp, Homo sapiens
gagcagctttaaactcagggaca

SEQ ID NO: 4899117 - DNA, 16 bp, Homo sapiens
gagcaggaagcattca

SEQ ID NO: 4899118 - DNA, 19 bp, Homo sapiens
gagcaggactctattttaa

SEQ ID NO: 4899119 - DNA, 23 bp, Homo sapiens
gagcaggagattgagaaggagag

SEQ ID NO: 4899120 - DNA, 13 bp, Homo sapiens
gagcagggaaggc

SEQ ID NO: 4899121 - DNA, 17 bp, Homo sapiens
gagcagggaaggcctga

SEQ ID NO: 4899122 - DNA, 13 bp, Homo sapiens
gagcatcccggag

SEQ ID NO: 4899123 - DNA, 19 bp, Homo sapiens
gagcatcccggaggaaatc

SEQ ID NO: 4899124 - DNA, 15 bp, Homo sapiens
gagcatcctgagccc

SEQ ID NO: 4899125 - DNA, 18 bp, Homo sapiens
gagcatctcttgaggcca

SEQ ID NO: 4899126 - DNA, 19 bp, Homo sapiens
gagcatctcttgaggccag

SEQ ID NO: 4899127 - DNA, 18 bp, Homo sapiens
gagcatgttttgtataca

SEQ ID NO: 4899128 - DNA, 20 bp, Homo sapiens
gagcattttgataccagaag

SEQ ID NO: 4899129 - DNA, 20 bp, Homo sapiens
gagccaatgttttccaccca

SEQ ID NO: 4899130 - DNA, 14 bp, Homo sapiens
gagccacagcagca

SEQ ID NO: 4899131 - DNA, 20 bp, Homo sapiens
gagccacagcagcattttta

SEQ ID NO: 4899132 - DNA, 13 bp, Homo sapiens
gagccactgcacc

SEQ ID NO: 4899133 - DNA, 20 bp, Homo sapiens
gagccactgcaccgggccac

SEQ ID NO: 4899134 - DNA, 15 bp, Homo sapiens
gagccagccacactt

SEQ ID NO: 4899135 - DNA, 14 bp, Homo sapiens
gagccatgctggga

SEQ ID NO: 4899136 - DNA, 21 bp, Homo sapiens
gagccattttgtgaatggatt

SEQ ID NO: 4899137 - DNA, 16 bp, Homo sapiens
gagcccagagaacagc

SEQ ID NO: 4899138 - DNA, 22 bp, Homo sapiens
gagcccagaggtaacagaacag

SEQ ID NO: 4899139 - DNA, 15 bp, Homo sapiens
gagcccagccctccc

SEQ ID NO: 4899140 - DNA, 18 bp, Homo sapiens
gagcccagccctccccat

SEQ ID NO: 4899141 - DNA, 18 bp, Homo sapiens
gagcccagccctgttctg

SEQ ID NO: 4899142 - DNA, 23 bp, Homo sapiens
gagcccaggagttcgaggctgca

SEQ ID NO: 4899143 - DNA, 19 bp, Homo sapiens
gagcccatactcagcctgc

SEQ ID NO: 4899144 - DNA, 20 bp, Homo sapiens
gagcccatactcagcctgct

SEQ ID NO: 4899145 - DNA, 20 bp, Homo sapiens
gagcccatgttctgccccca

SEQ ID NO: 4899146 - DNA, 21 bp, Homo sapiens
gagcccatgttctgcccccag

SEQ ID NO: 4899147 - DNA, 23 bp, Homo sapiens
gagcccatgttctgcccccagcc

SEQ ID NO: 4899148 - DNA, 16 bp, Homo sapiens
gagccccagctaccct

SEQ ID NO: 4899149 - DNA, 13 bp, Homo sapiens
gagccccaggcct

SEQ ID NO: 4899150 - DNA, 17 bp, Homo sapiens
gagccccaggcctctgt

SEQ ID NO: 4899151 - DNA, 13 bp, Homo sapiens
gagccccagggtc

SEQ ID NO: 4899152 - DNA, 19 bp, Homo sapiens
gagccccagggtcttccct

SEQ ID NO: 4899153 - DNA, 13 bp, Homo sapiens
gagccccgcagac

SEQ ID NO: 4899154 - DNA, 23 bp, Homo sapiens
gagccccgcagacctccccagcc

SEQ ID NO: 4899155 - DNA, 15 bp, Homo sapiens
gagccccgccctctt

SEQ ID NO: 4899156 - DNA, 17 bp, Homo sapiens
gagccccgccctcttcc

SEQ ID NO: 4899157 - DNA, 19 bp, Homo sapiens
gagccctactccctgcaga

SEQ ID NO: 4899158 - DNA, 22 bp, Homo sapiens
gagccctactccctgcagatgc

SEQ ID NO: 4899159 - DNA, 22 bp, Homo sapiens
gagccgagatcacgccactgca

SEQ ID NO: 4899160 - DNA, 17 bp, Homo sapiens
gagccgtgaactgtgca

SEQ ID NO: 4899161 - DNA, 15 bp, Homo sapiens
gagcctagaagctgg

SEQ ID NO: 4899162 - DNA, 20 bp, Homo sapiens
gagcctaggaccactcagcc

SEQ ID NO: 4899163 - DNA, 22 bp, Homo sapiens
gagcctaggaccactcagcccc

SEQ ID NO: 4899164 - DNA, 14 bp, Homo sapiens
gagcctcagcatcc

SEQ ID NO: 4899165 - DNA, 21 bp, Homo sapiens
gagcctcccaaggagaacaaa

SEQ ID NO: 4899166 - DNA, 16 bp, Homo sapiens
gagcctgagtcagggc

SEQ ID NO: 4899167 - DNA, 21 bp, Homo sapiens
gagcctgagtcagggcccaga

SEQ ID NO: 4899168 - DNA, 12 bp, Homo sapiens
gagcctgcagtt

SEQ ID NO: 4899169 - DNA, 17 bp, Homo sapiens
gagcctggcccatagaa

SEQ ID NO: 4899170 - DNA, 18 bp, Homo sapiens
gagcctggcccatagaaa

SEQ ID NO: 4899171 - DNA, 18 bp, Homo sapiens
gagcctttggttctggcc

SEQ ID NO: 4899172 - DNA, 16 bp, Homo sapiens
gagcgagcatccccca

SEQ ID NO: 4899173 - DNA, 12 bp, Homo sapiens
gagcgcaagata

SEQ ID NO: 4899174 - DNA, 15 bp, Homo sapiens
gagcgcatggcaagt

SEQ ID NO: 4899175 - DNA, 13 bp, Homo sapiens
gagcgggaggcag

SEQ ID NO: 4899176 - DNA, 15 bp, Homo sapiens
gagcgggaggcagag

SEQ ID NO: 4899177 - DNA, 23 bp, Homo sapiens
gagcggtggccctgtccctccca

SEQ ID NO: 4899178 - DNA, 14 bp, Homo sapiens
gagctaaggctcta

SEQ ID NO: 4899179 - DNA, 15 bp, Homo sapiens
gagctaagggtgggt

SEQ ID NO: 4899180 - DNA, 22 bp, Homo sapiens
gagctaagggtgggtgctcaga

SEQ ID NO: 4899181 - DNA, 23 bp, Homo sapiens
gagctaagggtgggtgctcagaa

SEQ ID NO: 4899182 - DNA, 14 bp, Homo sapiens
gagctattaaaact

SEQ ID NO: 4899183 - DNA, 16 bp, Homo sapiens
gagctcactcggcacc

SEQ ID NO: 4899184 - DNA, 23 bp, Homo sapiens
gagctcagccccgagctgtcccc

SEQ ID NO: 4899185 - DNA, 11 bp, Homo sapiens
gagctgccctc

SEQ ID NO: 4899186 - DNA, 23 bp, Homo sapiens
gagctgccctccttgtccaccca

SEQ ID NO: 4899187 - DNA, 19 bp, Homo sapiens
gagctgcctgttcagctcc

SEQ ID NO: 4899188 - DNA, 18 bp, Homo sapiens
gagctgccttggctcaga

SEQ ID NO: 4899189 - DNA, 21 bp, Homo sapiens
gagctgccttggctcagacat

SEQ ID NO: 4899190 - DNA, 12 bp, Homo sapiens
gagctgctggct

SEQ ID NO: 4899191 - DNA, 15 bp, Homo sapiens
gagctggaccagtgg

SEQ ID NO: 4899192 - DNA, 14 bp, Homo sapiens
gagctgggcatggt

SEQ ID NO: 4899193 - DNA, 13 bp, Homo sapiens
gagctggggacct

SEQ ID NO: 4899194 - DNA, 18 bp, Homo sapiens
gagctgtttatggcctca

SEQ ID NO: 4899195 - DNA, 19 bp, Homo sapiens
gagctgtttatggcctcag

SEQ ID NO: 4899196 - DNA, 20 bp, Homo sapiens
gagctgtttatggcctcagc

SEQ ID NO: 4899197 - DNA, 13 bp, Homo sapiens
gagcttgggaatg

SEQ ID NO: 4899198 - DNA, 21 bp, Homo sapiens
gaggaaaaccaagccgtggct

SEQ ID NO: 4899199 - DNA, 16 bp, Homo sapiens
gaggaactccttggcc

SEQ ID NO: 4899200 - DNA, 15 bp, Homo sapiens
gaggaactgtccaga

SEQ ID NO: 4899201 - DNA, 14 bp, Homo sapiens
gaggaaggattgta

SEQ ID NO: 4899202 - DNA, 21 bp, Homo sapiens
gaggaataattatttatttaa

SEQ ID NO: 4899203 - DNA, 21 bp, Homo sapiens
gaggaatcatgtcaggcctgt

SEQ ID NO: 4899204 - DNA, 14 bp, Homo sapiens
gaggaatccagacc

SEQ ID NO: 4899205 - DNA, 20 bp, Homo sapiens
gaggaatcctggcagcccag

SEQ ID NO: 4899206 - DNA, 22 bp, Homo sapiens
gaggaattttctttgtgtagct

SEQ ID NO: 4899207 - DNA, 13 bp, Homo sapiens
gaggacaaaactt

SEQ ID NO: 4899208 - DNA, 20 bp, Homo sapiens
gaggaccctggaaatggact

SEQ ID NO: 4899209 - DNA, 20 bp, Homo sapiens
gaggacctgaccctactccc

SEQ ID NO: 4899210 - DNA, 16 bp, Homo sapiens
gaggacctgtatttaa

SEQ ID NO: 4899211 - DNA, 17 bp, Homo sapiens
gaggacctgtatttaag

SEQ ID NO: 4899212 - DNA, 18 bp, Homo sapiens
gaggacctgtatttaagc

SEQ ID NO: 4899213 - DNA, 17 bp, Homo sapiens
gaggacggtgcaaccca

SEQ ID NO: 4899214 - DNA, 22 bp, Homo sapiens
gaggactcgcttgtaaatacca

SEQ ID NO: 4899215 - DNA, 18 bp, Homo sapiens
gaggacttgtgtctctgt

SEQ ID NO: 4899216 - DNA, 23 bp, Homo sapiens
gaggactttgattgcacattgtt

SEQ ID NO: 4899217 - DNA, 16 bp, Homo sapiens
gaggacttttctttgt

SEQ ID NO: 4899218 - DNA, 20 bp, Homo sapiens
gaggacttttctttgtggct

SEQ ID NO: 4899219 - DNA, 14 bp, Homo sapiens
gaggagagaggcag

SEQ ID NO: 4899220 - DNA, 13 bp, Homo sapiens
gaggagccaggca

SEQ ID NO: 4899221 - DNA, 21 bp, Homo sapiens
gaggagcccatactcagcctg

SEQ ID NO: 4899222 - DNA, 15 bp, Homo sapiens
gaggagccccagcta

SEQ ID NO: 4899223 - DNA, 11 bp, Homo sapiens
gaggagccttt

SEQ ID NO: 4899224 - DNA, 22 bp, Homo sapiens
gaggaggatgtccctgggccag

SEQ ID NO: 4899225 - DNA, 15 bp, Homo sapiens
gaggatgagagccca

SEQ ID NO: 4899226 - DNA, 18 bp, Homo sapiens
gaggatgtctcaaacttc

SEQ ID NO: 4899227 - DNA, 20 bp, Homo sapiens
gaggatgttctgggacacag

SEQ ID NO: 4899228 - DNA, 14 bp, Homo sapiens
gaggattattgata

SEQ ID NO: 4899229 - DNA, 15 bp, Homo sapiens
gaggattgctatctg

SEQ ID NO: 4899230 - DNA, 18 bp, Homo sapiens
gaggattgcttgagccca

SEQ ID NO: 4899231 - DNA, 19 bp, Homo sapiens
gaggattgcttgagcccag

SEQ ID NO: 4899232 - DNA, 16 bp, Homo sapiens
gaggcaaagctggctc

SEQ ID NO: 4899233 - DNA, 20 bp, Homo sapiens
gaggcaaagctggctcacct

SEQ ID NO: 4899234 - DNA, 19 bp, Homo sapiens
gaggcaatgtcaggaacag

SEQ ID NO: 4899235 - DNA, 18 bp, Homo sapiens
gaggcactgaagtgctta

SEQ ID NO: 4899236 - DNA, 12 bp, Homo sapiens
gaggcagagagc

SEQ ID NO: 4899237 - DNA, 15 bp, Homo sapiens
gaggcagagagcggt

SEQ ID NO: 4899238 - DNA, 17 bp, Homo sapiens
gaggcagccacttcggc

SEQ ID NO: 4899239 - DNA, 20 bp, Homo sapiens
gaggcagccccattctgcct

SEQ ID NO: 4899240 - DNA, 22 bp, Homo sapiens
gaggcaggccgactgtactaaa

SEQ ID NO: 4899241 - DNA, 23 bp, Homo sapiens
gaggcagggcaaatgacatgcac

SEQ ID NO: 4899242 - DNA, 14 bp, Homo sapiens
gaggcagggtctca

SEQ ID NO: 4899243 - DNA, 15 bp, Homo sapiens
gaggcagggtctcac

SEQ ID NO: 4899244 - DNA, 22 bp, Homo sapiens
gaggcagggtctcactctgtcg

SEQ ID NO: 4899245 - DNA, 13 bp, Homo sapiens
gaggcatggccct

SEQ ID NO: 4899246 - DNA, 15 bp, Homo sapiens
gaggcatggccctgg

SEQ ID NO: 4899247 - DNA, 13 bp, Homo sapiens
gaggccagcccca

SEQ ID NO: 4899248 - DNA, 14 bp, Homo sapiens
gaggccagccccac

SEQ ID NO: 4899249 - DNA, 18 bp, Homo sapiens
gaggccagccccacccag

SEQ ID NO: 4899250 - DNA, 22 bp, Homo sapiens
gaggccagccccacccaggagg

SEQ ID NO: 4899251 - DNA, 12 bp, Homo sapiens
gaggccaggagt

SEQ ID NO: 4899252 - DNA, 14 bp, Homo sapiens
gaggccatgggcct

SEQ ID NO: 4899253 - DNA, 18 bp, Homo sapiens
gaggccatgggcctcctg

SEQ ID NO: 4899254 - DNA, 16 bp, Homo sapiens
gaggccctcctgtgct

SEQ ID NO: 4899255 - DNA, 16 bp, Homo sapiens
gaggccttccagctgc

SEQ ID NO: 4899256 - DNA, 17 bp, Homo sapiens
gaggccttccagctgct

SEQ ID NO: 4899257 - DNA, 19 bp, Homo sapiens
gaggccttccagctgctgt

SEQ ID NO: 4899258 - DNA, 14 bp, Homo sapiens
gaggccttctctga

SEQ ID NO: 4899259 - DNA, 18 bp, Homo sapiens
gaggccttctctgaagga

SEQ ID NO: 4899260 - DNA, 19 bp, Homo sapiens
gaggccttctctgaaggac

SEQ ID NO: 4899261 - DNA, 15 bp, Homo sapiens
gaggctcaacaataa

SEQ ID NO: 4899262 - DNA, 13 bp, Homo sapiens
gaggctcctgtcc

SEQ ID NO: 4899263 - DNA, 20 bp, Homo sapiens
gaggctgcccccggccccct

SEQ ID NO: 4899264 - DNA, 15 bp, Homo sapiens
gaggctgcccctctc

SEQ ID NO: 4899265 - DNA, 12 bp, Homo sapiens
gaggctggcagg

SEQ ID NO: 4899266 - DNA, 13 bp, Homo sapiens
gaggctggcaggt

SEQ ID NO: 4899267 - DNA, 17 bp, Homo sapiens
gaggctgtgtgcctggg

SEQ ID NO: 4899268 - DNA, 21 bp, Homo sapiens
gaggctgtgtgcctgggggag

SEQ ID NO: 4899269 - DNA, 23 bp, Homo sapiens
gaggctttatgataatagattct

SEQ ID NO: 4899270 - DNA, 16 bp, Homo sapiens
gaggctttgtgttgta

SEQ ID NO: 4899271 - DNA, 17 bp, Homo sapiens
gagggaccaactgggcc

SEQ ID NO: 4899272 - DNA, 18 bp, Homo sapiens
gagggaccaactgggccc

SEQ ID NO: 4899273 - DNA, 15 bp, Homo sapiens
gagggaccatgtgtc

SEQ ID NO: 4899274 - DNA, 18 bp, Homo sapiens
gagggactctgaagcctc

SEQ ID NO: 4899275 - DNA, 20 bp, Homo sapiens
gagggactctgaagcctctg

SEQ ID NO: 4899276 - DNA, 21 bp, Homo sapiens
gagggactttgctgatttccc

SEQ ID NO: 4899277 - DNA, 14 bp, Homo sapiens
gagggaggacctgg

SEQ ID NO: 4899278 - DNA, 22 bp, Homo sapiens
gagggagtgacagaggcagccc

SEQ ID NO: 4899279 - DNA, 16 bp, Homo sapiens
gagggatgggcctggc

SEQ ID NO: 4899280 - DNA, 17 bp, Homo sapiens
gagggcagaaaggttct

SEQ ID NO: 4899281 - DNA, 20 bp, Homo sapiens
gagggcagaaaggttctgcc

SEQ ID NO: 4899282 - DNA, 21 bp, Homo sapiens
gagggcagaaaggttctgccc

SEQ ID NO: 4899283 - DNA, 13 bp, Homo sapiens
gagggcagctgct

SEQ ID NO: 4899284 - DNA, 18 bp, Homo sapiens
gagggccaagacttggca

SEQ ID NO: 4899285 - DNA, 15 bp, Homo sapiens
gagggcccagagcag

SEQ ID NO: 4899286 - DNA, 20 bp, Homo sapiens
gagggcccagagcaggaagc

SEQ ID NO: 4899287 - DNA, 13 bp, Homo sapiens
gagggctgccctg

SEQ ID NO: 4899288 - DNA, 16 bp, Homo sapiens
gaggggaagctgcagc

SEQ ID NO: 4899289 - DNA, 16 bp, Homo sapiens
gaggggaaggggcggt

SEQ ID NO: 4899290 - DNA, 22 bp, Homo sapiens
gaggggcatctgcccctccccc

SEQ ID NO: 4899291 - DNA, 14 bp, Homo sapiens
gaggggcctggcag

SEQ ID NO: 4899292 - DNA, 20 bp, Homo sapiens
gagggggactgctgctgcct

SEQ ID NO: 4899293 - DNA, 21 bp, Homo sapiens
gagggggctatagctacagga

SEQ ID NO: 4899294 - DNA, 21 bp, Homo sapiens
gaggggtgtggctccttccca

SEQ ID NO: 4899295 - DNA, 17 bp, Homo sapiens
gagggtacagctgggct

SEQ ID NO: 4899296 - DNA, 21 bp, Homo sapiens
gagggtcctggctcctgaggg

SEQ ID NO: 4899297 - DNA, 22 bp, Homo sapiens
gagggtgtcccaaaaagaaagg

SEQ ID NO: 4899298 - DNA, 15 bp, Homo sapiens
gaggtaaagatatgg

SEQ ID NO: 4899299 - DNA, 15 bp, Homo sapiens
gaggtaacagaacag

SEQ ID NO: 4899300 - DNA, 16 bp, Homo sapiens
gaggtaacagaacagc

SEQ ID NO: 4899301 - DNA, 12 bp, Homo sapiens
gaggtcagagcc

SEQ ID NO: 4899302 - DNA, 17 bp, Homo sapiens
gaggtcagagcctgcag

SEQ ID NO: 4899303 - DNA, 14 bp, Homo sapiens
gaggtcctctggag

SEQ ID NO: 4899304 - DNA, 16 bp, Homo sapiens
gaggtcctctggagcc

SEQ ID NO: 4899305 - DNA, 22 bp, Homo sapiens
gaggtcttgctagaatgggaag

SEQ ID NO: 4899306 - DNA, 15 bp, Homo sapiens
gaggtgaaagggagc

SEQ ID NO: 4899307 - DNA, 16 bp, Homo sapiens
gaggtgaaagggagct

SEQ ID NO: 4899308 - DNA, 23 bp, Homo sapiens
gaggtgaccccaggtttctatgt

SEQ ID NO: 4899309 - DNA, 14 bp, Homo sapiens
gaggtgatagcatt

SEQ ID NO: 4899310 - DNA, 21 bp, Homo sapiens
gaggtggccagagctgggagg

SEQ ID NO: 4899311 - DNA, 14 bp, Homo sapiens
gaggtgggagcagg

SEQ ID NO: 4899312 - DNA, 17 bp, Homo sapiens
gaggtgggagcaggaga

SEQ ID NO: 4899313 - DNA, 20 bp, Homo sapiens
gaggtggtggagtggagtga

SEQ ID NO: 4899314 - DNA, 23 bp, Homo sapiens
gaggtttgtcgggcaccagccag

SEQ ID NO: 4899315 - DNA, 21 bp, Homo sapiens
gagtaaaaaaaaaaacaatta

SEQ ID NO: 4899316 - DNA, 19 bp, Homo sapiens
gagtaaatattgaggcttt

SEQ ID NO: 4899317 - DNA, 13 bp, Homo sapiens
gagtacaaatgcc

SEQ ID NO: 4899318 - DNA, 17 bp, Homo sapiens
gagtagaattgcattga

SEQ ID NO: 4899319 - DNA, 18 bp, Homo sapiens
gagtagacacatttaagg

SEQ ID NO: 4899320 - DNA, 14 bp, Homo sapiens
gagtagctgggact

SEQ ID NO: 4899321 - DNA, 21 bp, Homo sapiens
gagtagttgatgttgcatttt

SEQ ID NO: 4899322 - DNA, 15 bp, Homo sapiens
gagtataagaaatgc

SEQ ID NO: 4899323 - DNA, 17 bp, Homo sapiens
gagtataagaaatgcat

SEQ ID NO: 4899324 - DNA, 18 bp, Homo sapiens
gagtataagaaatgcata

SEQ ID NO: 4899325 - DNA, 12 bp, Homo sapiens
gagtatatgcac

SEQ ID NO: 4899326 - DNA, 18 bp, Homo sapiens
gagtcaccttccaggacc

SEQ ID NO: 4899327 - DNA, 23 bp, Homo sapiens
gagtcaccttccaggacccctgg

SEQ ID NO: 4899328 - DNA, 14 bp, Homo sapiens
gagtcaccttccct

SEQ ID NO: 4899329 - DNA, 16 bp, Homo sapiens
gagtcagggcccagag

SEQ ID NO: 4899330 - DNA, 17 bp, Homo sapiens
gagtcagggcccagagg

SEQ ID NO: 4899331 - DNA, 13 bp, Homo sapiens
gagtcatttaaat

SEQ ID NO: 4899332 - DNA, 16 bp, Homo sapiens
gagtcatttaaatgtg

SEQ ID NO: 4899333 - DNA, 16 bp, Homo sapiens
gagtccaggcacagga

SEQ ID NO: 4899334 - DNA, 15 bp, Homo sapiens
gagtcccaaggaaag

SEQ ID NO: 4899335 - DNA, 20 bp, Homo sapiens
gagtcccaccttggctgcag

SEQ ID NO: 4899336 - DNA, 16 bp, Homo sapiens
gagtcccccagagatg

SEQ ID NO: 4899337 - DNA, 16 bp, Homo sapiens
gagtcccctcacctcc

SEQ ID NO: 4899338 - DNA, 19 bp, Homo sapiens
gagtccgaaagggacttgg

SEQ ID NO: 4899339 - DNA, 11 bp, Homo sapiens
gagtctaaaga

SEQ ID NO: 4899340 - DNA, 13 bp, Homo sapiens
gagtctaaagatg

SEQ ID NO: 4899341 - DNA, 11 bp, Homo sapiens
gagtctagatg

SEQ ID NO: 4899342 - DNA, 21 bp, Homo sapiens
gagtctagattcaaaggttct

SEQ ID NO: 4899343 - DNA, 16 bp, Homo sapiens
gagtctagcactcatt

SEQ ID NO: 4899344 - DNA, 22 bp, Homo sapiens
gagtctagcactcattttctat

SEQ ID NO: 4899345 - DNA, 23 bp, Homo sapiens
gagtctcactgttgcccaggctg

SEQ ID NO: 4899346 - DNA, 16 bp, Homo sapiens
gagtctcttctccact

SEQ ID NO: 4899347 - DNA, 17 bp, Homo sapiens
gagtctcttctccactg

SEQ ID NO: 4899348 - DNA, 22 bp, Homo sapiens
gagtcttggtttctctctacag

SEQ ID NO: 4899349 - DNA, 16 bp, Homo sapiens
gagtctttggttctaa

SEQ ID NO: 4899350 - DNA, 19 bp, Homo sapiens
gagtgagacaaaattttag

SEQ ID NO: 4899351 - DNA, 18 bp, Homo sapiens
gagtgagactctgtctca

SEQ ID NO: 4899352 - DNA, 20 bp, Homo sapiens
gagtgattgcagctttatgt

SEQ ID NO: 4899353 - DNA, 12 bp, Homo sapiens
gagtgcacagct

SEQ ID NO: 4899354 - DNA, 15 bp, Homo sapiens
gagtgcacagctgtc

SEQ ID NO: 4899355 - DNA, 18 bp, Homo sapiens
gagtgcagtgagccgaga

SEQ ID NO: 4899356 - DNA, 21 bp, Homo sapiens
gagtgctggctcacagtacag

SEQ ID NO: 4899357 - DNA, 23 bp, Homo sapiens
gagtgggcagagcccccaggaag

SEQ ID NO: 4899358 - DNA, 16 bp, Homo sapiens
gagtggtgcagacaga

SEQ ID NO: 4899359 - DNA, 11 bp, Homo sapiens
gagtgtagaag

SEQ ID NO: 4899360 - DNA, 14 bp, Homo sapiens
gagtgtagaagcat

SEQ ID NO: 4899361 - DNA, 11 bp, Homo sapiens
gagtgtgacag

SEQ ID NO: 4899362 - DNA, 15 bp, Homo sapiens
gagtgtgcatggagg

SEQ ID NO: 4899363 - DNA, 19 bp, Homo sapiens
gagtgtgtgtttgtgctga

SEQ ID NO: 4899364 - DNA, 13 bp, Homo sapiens
gagttaagaagct

SEQ ID NO: 4899365 - DNA, 16 bp, Homo sapiens
gagttaagaagctgtt

SEQ ID NO: 4899366 - DNA, 17 bp, Homo sapiens
gagttatgatgtaatct

SEQ ID NO: 4899367 - DNA, 19 bp, Homo sapiens
gagttcgaggctgcagtca

SEQ ID NO: 4899368 - DNA, 15 bp, Homo sapiens
gagttcttgtgccat

SEQ ID NO: 4899369 - DNA, 13 bp, Homo sapiens
gagtttaaagcaa

SEQ ID NO: 4899370 - DNA, 18 bp, Homo sapiens
gagtttcattctcctgcc

SEQ ID NO: 4899371 - DNA, 14 bp, Homo sapiens
gagtttctgtttga

SEQ ID NO: 4899372 - DNA, 15 bp, Homo sapiens
gagtttctgtttgat

SEQ ID NO: 4899373 - DNA, 11 bp, Homo sapiens
gagtttgtagg

SEQ ID NO: 4899374 - DNA, 23 bp, Homo sapiens
gagtttgtaggtaaaatgtattt

SEQ ID NO: 4899375 - DNA, 21 bp, Homo sapiens
gagttttctctttgtggggct

SEQ ID NO: 4899376 - DNA, 14 bp, Homo sapiens
gagttttcttcctt

SEQ ID NO: 4899377 - DNA, 18 bp, Homo sapiens
gataaaatgactacttag

SEQ ID NO: 4899378 - DNA, 16 bp, Homo sapiens
gataaacaacaaggtg

SEQ ID NO: 4899379 - DNA, 15 bp, Homo sapiens
gataaagcacagctg

SEQ ID NO: 4899380 - DNA, 13 bp, Homo sapiens
gataaatatttga

SEQ ID NO: 4899381 - DNA, 21 bp, Homo sapiens
gataacttaggtggcaagctg

SEQ ID NO: 4899382 - DNA, 13 bp, Homo sapiens
gataatagattct

SEQ ID NO: 4899383 - DNA, 14 bp, Homo sapiens
gataatagattctc

SEQ ID NO: 4899384 - DNA, 23 bp, Homo sapiens
gataatatctttgtgataattta

SEQ ID NO: 4899385 - DNA, 22 bp, Homo sapiens
gataattgctatttatttttac

SEQ ID NO: 4899386 - DNA, 16 bp, Homo sapiens
gatacaaatgtctatc

SEQ ID NO: 4899387 - DNA, 19 bp, Homo sapiens
gatacaacctccctcttgt

SEQ ID NO: 4899388 - DNA, 19 bp, Homo sapiens
gatacaccgggcctggaga

SEQ ID NO: 4899389 - DNA, 18 bp, Homo sapiens
gatacaggaaaagctgct

SEQ ID NO: 4899390 - DNA, 19 bp, Homo sapiens
gatacaggaaaagctgctg

SEQ ID NO: 4899391 - DNA, 18 bp, Homo sapiens
gatacagtccctaaagaa

SEQ ID NO: 4899392 - DNA, 21 bp, Homo sapiens
gatacataactaaatttgata

SEQ ID NO: 4899393 - DNA, 13 bp, Homo sapiens
gatacataataaa

SEQ ID NO: 4899394 - DNA, 13 bp, Homo sapiens
gatacatcactgc

SEQ ID NO: 4899395 - DNA, 17 bp, Homo sapiens
gatacatcactgcttga

SEQ ID NO: 4899396 - DNA, 14 bp, Homo sapiens
gatacttatatttt

SEQ ID NO: 4899397 - DNA, 18 bp, Homo sapiens
gatactttgatattttca

SEQ ID NO: 4899398 - DNA, 23 bp, Homo sapiens
gatactttttcttttgtaagtgc

SEQ ID NO: 4899399 - DNA, 21 bp, Homo sapiens
gatagatgcacttatgcagta

SEQ ID NO: 4899400 - DNA, 15 bp, Homo sapiens
gatagatttggaata

SEQ ID NO: 4899401 - DNA, 17 bp, Homo sapiens
gatagcatttttgattt

SEQ ID NO: 4899402 - DNA, 22 bp, Homo sapiens
gatagcatttttgatttatgca

SEQ ID NO: 4899403 - DNA, 20 bp, Homo sapiens
gatagctaacattttaaata

SEQ ID NO: 4899404 - DNA, 19 bp, Homo sapiens
gatagctgcatgtggcttt

SEQ ID NO: 4899405 - DNA, 17 bp, Homo sapiens
gataggaccttgggcca

SEQ ID NO: 4899406 - DNA, 18 bp, Homo sapiens
gataggaccttgggccaa

SEQ ID NO: 4899407 - DNA, 23 bp, Homo sapiens
gatagtgggcaccccactgcaat

SEQ ID NO: 4899408 - DNA, 15 bp, Homo sapiens
gatagttcaccccct

SEQ ID NO: 4899409 - DNA, 14 bp, Homo sapiens
gatataaaatgtgc

SEQ ID NO: 4899410 - DNA, 15 bp, Homo sapiens
gatataaaatgtgca

SEQ ID NO: 4899411 - DNA, 13 bp, Homo sapiens
gatataaattctg

SEQ ID NO: 4899412 - DNA, 19 bp, Homo sapiens
gatatacagatgaaaattt

SEQ ID NO: 4899413 - DNA, 14 bp, Homo sapiens
gatatacatgaaaa

SEQ ID NO: 4899414 - DNA, 17 bp, Homo sapiens
gatatacatgaaaattt

SEQ ID NO: 4899415 - DNA, 22 bp, Homo sapiens
gatatactttgtggaccaatta

SEQ ID NO: 4899416 - DNA, 12 bp, Homo sapiens
gatatatctgaa

SEQ ID NO: 4899417 - DNA, 16 bp, Homo sapiens
gatatccttatcagag

SEQ ID NO: 4899418 - DNA, 21 bp, Homo sapiens
gatatctggcctaaaatcttg

SEQ ID NO: 4899419 - DNA, 23 bp, Homo sapiens
gatatgattgtttctcaaatctt

SEQ ID NO: 4899420 - DNA, 19 bp, Homo sapiens
gatatggagaattgctgaa

SEQ ID NO: 4899421 - DNA, 12 bp, Homo sapiens
gatattacttta

SEQ ID NO: 4899422 - DNA, 13 bp, Homo sapiens
gatattactttat

SEQ ID NO: 4899423 - DNA, 22 bp, Homo sapiens
gatattactttatcactttttg

SEQ ID NO: 4899424 - DNA, 15 bp, Homo sapiens
gatattattcttgta

SEQ ID NO: 4899425 - DNA, 12 bp, Homo sapiens
gatattctaaga

SEQ ID NO: 4899426 - DNA, 15 bp, Homo sapiens
gatattgtacataaa

SEQ ID NO: 4899427 - DNA, 13 bp, Homo sapiens
gatatttggctta

SEQ ID NO: 4899428 - DNA, 19 bp, Homo sapiens
gatatttggcttaaatata

SEQ ID NO: 4899429 - DNA, 17 bp, Homo sapiens
gatcaaaataaaaagtg

SEQ ID NO: 4899430 - DNA, 22 bp, Homo sapiens
gatcaaaccccgaccacctgcc

SEQ ID NO: 4899431 - DNA, 14 bp, Homo sapiens
gatcacgccactgc

SEQ ID NO: 4899432 - DNA, 15 bp, Homo sapiens
gatcacggctcactg

SEQ ID NO: 4899433 - DNA, 16 bp, Homo sapiens
gatcacggctcactgc

SEQ ID NO: 4899434 - DNA, 20 bp, Homo sapiens
gatcacggctcactgcagcc

SEQ ID NO: 4899435 - DNA, 17 bp, Homo sapiens
gatcactgaatttataa

SEQ ID NO: 4899436 - DNA, 15 bp, Homo sapiens
gatcagagcaggacc

SEQ ID NO: 4899437 - DNA, 17 bp, Homo sapiens
gatcagagcaggacctc

SEQ ID NO: 4899438 - DNA, 22 bp, Homo sapiens
gatcagatgctccaagattcta

SEQ ID NO: 4899439 - DNA, 20 bp, Homo sapiens
gatcagtgtaccatttgcct

SEQ ID NO: 4899440 - DNA, 18 bp, Homo sapiens
gatcagttataagtagca

SEQ ID NO: 4899441 - DNA, 19 bp, Homo sapiens
gatcataaagttagaatct

SEQ ID NO: 4899442 - DNA, 17 bp, Homo sapiens
gatcataaggcttcaaa

SEQ ID NO: 4899443 - DNA, 13 bp, Homo sapiens
gatcatccactgt

SEQ ID NO: 4899444 - DNA, 14 bp, Homo sapiens
gatcatggtgtaat

SEQ ID NO: 4899445 - DNA, 21 bp, Homo sapiens
gatcatggtgtaataagacat

SEQ ID NO: 4899446 - DNA, 18 bp, Homo sapiens
gatcatttgttggaatga

SEQ ID NO: 4899447 - DNA, 19 bp, Homo sapiens
gatcattttccccccactc

SEQ ID NO: 4899448 - DNA, 15 bp, Homo sapiens
gatccaagctaagca

SEQ ID NO: 4899449 - DNA, 12 bp, Homo sapiens
gatccaagctgg

SEQ ID NO: 4899450 - DNA, 16 bp, Homo sapiens
gatccaatgttagaga

SEQ ID NO: 4899451 - DNA, 17 bp, Homo sapiens
gatccacccaaccctat

SEQ ID NO: 4899452 - DNA, 19 bp, Homo sapiens
gatccacccacctcagcct

SEQ ID NO: 4899453 - DNA, 21 bp, Homo sapiens
gatccacccacctcagcctcc

SEQ ID NO: 4899454 - DNA, 22 bp, Homo sapiens
gatccacccacctcagcctccc

SEQ ID NO: 4899455 - DNA, 23 bp, Homo sapiens
gatcccaggggcccaaggcggcc

SEQ ID NO: 4899456 - DNA, 18 bp, Homo sapiens
gatccccaagtgtgaaca

SEQ ID NO: 4899457 - DNA, 17 bp, Homo sapiens
gatccccgttcctgaca

SEQ ID NO: 4899458 - DNA, 20 bp, Homo sapiens
gatcctaactgaagagacag

SEQ ID NO: 4899459 - DNA, 16 bp, Homo sapiens
gatcctcccacctcag

SEQ ID NO: 4899460 - DNA, 20 bp, Homo sapiens
gatcctcccacctcagcctc

SEQ ID NO: 4899461 - DNA, 21 bp, Homo sapiens
gatcctcccacctcagcctcc

SEQ ID NO: 4899462 - DNA, 15 bp, Homo sapiens
gatcctgccaccctg

SEQ ID NO: 4899463 - DNA, 16 bp, Homo sapiens
gatcctgccaccctgt

SEQ ID NO: 4899464 - DNA, 21 bp, Homo sapiens
gatccttagaggtcctctgga

SEQ ID NO: 4899465 - DNA, 17 bp, Homo sapiens
gatcgaaccgttttgaa

SEQ ID NO: 4899466 - DNA, 16 bp, Homo sapiens
gatctcagctttgaga

SEQ ID NO: 4899467 - DNA, 13 bp, Homo sapiens
gatctcctgacct

SEQ ID NO: 4899468 - DNA, 13 bp, Homo sapiens
gatctcttcctgt

SEQ ID NO: 4899469 - DNA, 14 bp, Homo sapiens
gatctcttcctgtt

SEQ ID NO: 4899470 - DNA, 20 bp, Homo sapiens
gatctgggttcactgcaacc

SEQ ID NO: 4899471 - DNA, 16 bp, Homo sapiens
gatctgtcacaccagc

SEQ ID NO: 4899472 - DNA, 12 bp, Homo sapiens
gatctgtcttgt

SEQ ID NO: 4899473 - DNA, 13 bp, Homo sapiens
gatctgtcttgta

SEQ ID NO: 4899474 - DNA, 14 bp, Homo sapiens
gatctgtcttgtaa

SEQ ID NO: 4899475 - DNA, 21 bp, Homo sapiens
gatctgtgatagttcaccccc

SEQ ID NO: 4899476 - DNA, 13 bp, Homo sapiens
gatctgtgcccca

SEQ ID NO: 4899477 - DNA, 14 bp, Homo sapiens
gatctgtgccccat

SEQ ID NO: 4899478 - DNA, 13 bp, Homo sapiens
gatctgttttgaa

SEQ ID NO: 4899479 - DNA, 14 bp, Homo sapiens
gatcttctgaaatg

SEQ ID NO: 4899480 - DNA, 16 bp, Homo sapiens
gatcttctgaaatgaa

SEQ ID NO: 4899481 - DNA, 14 bp, Homo sapiens
gatcttgaatgtgg

SEQ ID NO: 4899482 - DNA, 22 bp, Homo sapiens
gatcttgaatgtggtctcagga

SEQ ID NO: 4899483 - DNA, 23 bp, Homo sapiens
gatcttgagtataagaaatgcat

SEQ ID NO: 4899484 - DNA, 17 bp, Homo sapiens
gatcttttaaagtgtta

SEQ ID NO: 4899485 - DNA, 21 bp, Homo sapiens
gatgaaaacctacatattcca

SEQ ID NO: 4899486 - DNA, 16 bp, Homo sapiens
gatgaaactcacaaat

SEQ ID NO: 4899487 - DNA, 15 bp, Homo sapiens
gatgaaatgaggtca

SEQ ID NO: 4899488 - DNA, 18 bp, Homo sapiens
gatgaactctgaactttg

SEQ ID NO: 4899489 - DNA, 13 bp, Homo sapiens
gatgaactttctc

SEQ ID NO: 4899490 - DNA, 17 bp, Homo sapiens
gatgacaacttcccagt

SEQ ID NO: 4899491 - DNA, 12 bp, Homo sapiens
gatgactaaaat

SEQ ID NO: 4899492 - DNA, 19 bp, Homo sapiens
gatgactggggtgggaggt

SEQ ID NO: 4899493 - DNA, 17 bp, Homo sapiens
gatgagaacaaagctgt

SEQ ID NO: 4899494 - DNA, 22 bp, Homo sapiens
gatgagaacaaagctgttaaac

SEQ ID NO: 4899495 - DNA, 17 bp, Homo sapiens
gatgagagcccagaggt

SEQ ID NO: 4899496 - DNA, 20 bp, Homo sapiens
gatgagcccagccctgttct

SEQ ID NO: 4899497 - DNA, 18 bp, Homo sapiens
gatgatagaggattttat

SEQ ID NO: 4899498 - DNA, 19 bp, Homo sapiens
gatgatcaatcctttatta

SEQ ID NO: 4899499 - DNA, 13 bp, Homo sapiens
gatgatcaattat

SEQ ID NO: 4899500 - DNA, 22 bp, Homo sapiens
gatgatccatgagtttgccctg

SEQ ID NO: 4899501 - DNA, 20 bp, Homo sapiens
gatgatctttgcagacaggc

SEQ ID NO: 4899502 - DNA, 14 bp, Homo sapiens
gatgatttttgtca

SEQ ID NO: 4899503 - DNA, 14 bp, Homo sapiens
gatgcacagagaag

SEQ ID NO: 4899504 - DNA, 18 bp, Homo sapiens
gatgcacagagaagctgg

SEQ ID NO: 4899505 - DNA, 23 bp, Homo sapiens
gatgcagcatttgataatgataa

SEQ ID NO: 4899506 - DNA, 22 bp, Homo sapiens
gatgcatgtggtttggttcctc

SEQ ID NO: 4899507 - DNA, 19 bp, Homo sapiens
gatgccaatattaaatctg

SEQ ID NO: 4899508 - DNA, 12 bp, Homo sapiens
gatgccacccta

SEQ ID NO: 4899509 - DNA, 11 bp, Homo sapiens
gatgccaggac

SEQ ID NO: 4899510 - DNA, 16 bp, Homo sapiens
gatgccatctgtgtcc

SEQ ID NO: 4899511 - DNA, 20 bp, Homo sapiens
gatgccatctgtgtcctggt

SEQ ID NO: 4899512 - DNA, 22 bp, Homo sapiens
gatgccttttttgtagtttttt

SEQ ID NO: 4899513 - DNA, 18 bp, Homo sapiens
gatgcgttgttacaggaa

SEQ ID NO: 4899514 - DNA, 20 bp, Homo sapiens
gatgctccctcccctgccct

SEQ ID NO: 4899515 - DNA, 21 bp, Homo sapiens
gatgctccctcccctgccctg

SEQ ID NO: 4899516 - DNA, 14 bp, Homo sapiens
gatgctggagaaga

SEQ ID NO: 4899517 - DNA, 20 bp, Homo sapiens
gatgctggagaagagaggag

SEQ ID NO: 4899518 - DNA, 21 bp, Homo sapiens
gatgctgggcacttcatctga

SEQ ID NO: 4899519 - DNA, 23 bp, Homo sapiens
gatggacagttcacaccctgcaa

SEQ ID NO: 4899520 - DNA, 23 bp, Homo sapiens
gatggagactggtcctgtgtgca

SEQ ID NO: 4899521 - DNA, 23 bp, Homo sapiens
gatggaggaaaaccaagccgtgg

SEQ ID NO: 4899522 - DNA, 16 bp, Homo sapiens
gatggaggggagtgtt

SEQ ID NO: 4899523 - DNA, 16 bp, Homo sapiens
gatggagttcttgtgc

SEQ ID NO: 4899524 - DNA, 17 bp, Homo sapiens
gatggagtttctaaggt

SEQ ID NO: 4899525 - DNA, 23 bp, Homo sapiens
gatggatgccaatattaaatctg

SEQ ID NO: 4899526 - DNA, 21 bp, Homo sapiens
gatggcacttagctatcagaa

SEQ ID NO: 4899527 - DNA, 20 bp, Homo sapiens
gatggcccggatgctgcttc

SEQ ID NO: 4899528 - DNA, 20 bp, Homo sapiens
gatgggcaacccccagcctg

SEQ ID NO: 4899529 - DNA, 21 bp, Homo sapiens
gatgggcaacccccagcctgc

SEQ ID NO: 4899530 - DNA, 17 bp, Homo sapiens
gatggttattttctttt

SEQ ID NO: 4899531 - DNA, 21 bp, Homo sapiens
gatggttcccctgttcactct

SEQ ID NO: 4899532 - DNA, 20 bp, Homo sapiens
gatgtaatctctctgcagct

SEQ ID NO: 4899533 - DNA, 23 bp, Homo sapiens
gatgtaatctctctgcagctgcc

SEQ ID NO: 4899534 - DNA, 19 bp, Homo sapiens
gatgtaccatgaaacaaag

SEQ ID NO: 4899535 - DNA, 21 bp, Homo sapiens
gatgtatctgagttgccaaga

SEQ ID NO: 4899536 - DNA, 20 bp, Homo sapiens
gatgtatgaaggcttttggt

SEQ ID NO: 4899537 - DNA, 20 bp, Homo sapiens
gatgtcatcagagctcctct

SEQ ID NO: 4899538 - DNA, 18 bp, Homo sapiens
gatgtcttttatagtgga

SEQ ID NO: 4899539 - DNA, 23 bp, Homo sapiens
gatgtgggagggagcagacagga

SEQ ID NO: 4899540 - DNA, 13 bp, Homo sapiens
gatgtgtcctcag

SEQ ID NO: 4899541 - DNA, 18 bp, Homo sapiens
gatgtgtggactgtggca

SEQ ID NO: 4899542 - DNA, 12 bp, Homo sapiens
gatgtgttgtga

SEQ ID NO: 4899543 - DNA, 12 bp, Homo sapiens
gatgttctaagg

SEQ ID NO: 4899544 - DNA, 14 bp, Homo sapiens
gatgttctaaggct

SEQ ID NO: 4899545 - DNA, 19 bp, Homo sapiens
gatgttctaaggctctgag

SEQ ID NO: 4899546 - DNA, 16 bp, Homo sapiens
gatgttctgggacaca

SEQ ID NO: 4899547 - DNA, 20 bp, Homo sapiens
gatgttgaagaatacagtta

SEQ ID NO: 4899548 - DNA, 13 bp, Homo sapiens
gatgttgccatgt

SEQ ID NO: 4899549 - DNA, 17 bp, Homo sapiens
gatgttgccatgtgttt

SEQ ID NO: 4899550 - DNA, 23 bp, Homo sapiens
gatgtttacaggtggacacacaa

SEQ ID NO: 4899551 - DNA, 14 bp, Homo sapiens
gatgtttattcttc

SEQ ID NO: 4899552 - DNA, 14 bp, Homo sapiens
gatgtttgtggcct

SEQ ID NO: 4899553 - DNA, 14 bp, Homo sapiens
gatgttttattatt

SEQ ID NO: 4899554 - DNA, 21 bp, Homo sapiens
gatgtttttaaaagtttcaat

SEQ ID NO: 4899555 - DNA, 22 bp, Homo sapiens
gatgtttttaaaagtttcaatg

SEQ ID NO: 4899556 - DNA, 16 bp, Homo sapiens
gattaaataagattct

SEQ ID NO: 4899557 - DNA, 19 bp, Homo sapiens
gattaaatatagattagaa

SEQ ID NO: 4899558 - DNA, 20 bp, Homo sapiens
gattaaatatagattagaaa

SEQ ID NO: 4899559 - DNA, 19 bp, Homo sapiens
gattaacttatttagagat

SEQ ID NO: 4899560 - DNA, 12 bp, Homo sapiens
gattaagatttt

SEQ ID NO: 4899561 - DNA, 20 bp, Homo sapiens
gattacaggcatgagccact

SEQ ID NO: 4899562 - DNA, 19 bp, Homo sapiens
gattagaaaaattcctaag

SEQ ID NO: 4899563 - DNA, 16 bp, Homo sapiens
gattagctttgtgttt

SEQ ID NO: 4899564 - DNA, 17 bp, Homo sapiens
gattagctttgtgtttg

SEQ ID NO: 4899565 - DNA, 13 bp, Homo sapiens
gattatagattct

SEQ ID NO: 4899566 - DNA, 15 bp, Homo sapiens
gattatagattctaa

SEQ ID NO: 4899567 - DNA, 18 bp, Homo sapiens
gattatagattctaaaga

SEQ ID NO: 4899568 - DNA, 21 bp, Homo sapiens
gattatttaataacattacct

SEQ ID NO: 4899569 - DNA, 21 bp, Homo sapiens
gattatttgggagggaaaagg

SEQ ID NO: 4899570 - DNA, 13 bp, Homo sapiens
gattcaaaggttc

SEQ ID NO: 4899571 - DNA, 15 bp, Homo sapiens
gattcaaaggttcta

SEQ ID NO: 4899572 - DNA, 18 bp, Homo sapiens
gattcaaaggttctaggt

SEQ ID NO: 4899573 - DNA, 13 bp, Homo sapiens
gattcaggctgct

SEQ ID NO: 4899574 - DNA, 14 bp, Homo sapiens
gattcagtcttgcc

SEQ ID NO: 4899575 - DNA, 15 bp, Homo sapiens
gattcagtcttgcct

SEQ ID NO: 4899576 - DNA, 17 bp, Homo sapiens
gattcagtcttgcctta

SEQ ID NO: 4899577 - DNA, 15 bp, Homo sapiens
gattcagttttcatt

SEQ ID NO: 4899578 - DNA, 16 bp, Homo sapiens
gattcatagtaacttc

SEQ ID NO: 4899579 - DNA, 19 bp, Homo sapiens
gattcatagtaacttctta

SEQ ID NO: 4899580 - DNA, 22 bp, Homo sapiens
gattcatctaccctgctgacct

SEQ ID NO: 4899581 - DNA, 21 bp, Homo sapiens
gattcatgccaattagcaatt

SEQ ID NO: 4899582 - DNA, 15 bp, Homo sapiens
gattcattctcataa

SEQ ID NO: 4899583 - DNA, 23 bp, Homo sapiens
gattccaaagagtagaattgcat

SEQ ID NO: 4899584 - DNA, 19 bp, Homo sapiens
gattccagagagtggctcc

SEQ ID NO: 4899585 - DNA, 15 bp, Homo sapiens
gattccagcccacat

SEQ ID NO: 4899586 - DNA, 18 bp, Homo sapiens
gattccagcccacattgg

SEQ ID NO: 4899587 - DNA, 14 bp, Homo sapiens
gattccatgctaag

SEQ ID NO: 4899588 - DNA, 20 bp, Homo sapiens
gattccatgctaagcaagct

SEQ ID NO: 4899589 - DNA, 18 bp, Homo sapiens
gattccggatcctaagca

SEQ ID NO: 4899590 - DNA, 13 bp, Homo sapiens
gattccttctctg

SEQ ID NO: 4899591 - DNA, 22 bp, Homo sapiens
gattccttctctgaacacaggc

SEQ ID NO: 4899592 - DNA, 16 bp, Homo sapiens
gattccttttttcaaa

SEQ ID NO: 4899593 - DNA, 11 bp, Homo sapiens
gattctaaaat

SEQ ID NO: 4899594 - DNA, 12 bp, Homo sapiens
gattctaaaatg

SEQ ID NO: 4899595 - DNA, 13 bp, Homo sapiens
gattctaaagatt

SEQ ID NO: 4899596 - DNA, 19 bp, Homo sapiens
gattctaatttttaagcaa

SEQ ID NO: 4899597 - DNA, 19 bp, Homo sapiens
gattctagatcagatgctc

SEQ ID NO: 4899598 - DNA, 15 bp, Homo sapiens
gattctatagttcta

SEQ ID NO: 4899599 - DNA, 19 bp, Homo sapiens
gattctatagttctagaca

SEQ ID NO: 4899600 - DNA, 21 bp, Homo sapiens
gattctcctgcctcagcctcc

SEQ ID NO: 4899601 - DNA, 15 bp, Homo sapiens
gattctctgtgtcta

SEQ ID NO: 4899602 - DNA, 23 bp, Homo sapiens
gattctctgtgtctaagattcta

SEQ ID NO: 4899603 - DNA, 15 bp, Homo sapiens
gattctgcagtaaat

SEQ ID NO: 4899604 - DNA, 16 bp, Homo sapiens
gattctgcagtaaatc

SEQ ID NO: 4899605 - DNA, 19 bp, Homo sapiens
gattctgcagtaaatcttt

SEQ ID NO: 4899606 - DNA, 17 bp, Homo sapiens
gattctgggatgctcct

SEQ ID NO: 4899607 - DNA, 16 bp, Homo sapiens
gattcttctgtgttta

SEQ ID NO: 4899608 - DNA, 15 bp, Homo sapiens
gattgaaaattcgcc

SEQ ID NO: 4899609 - DNA, 14 bp, Homo sapiens
gattgacctgctcc

SEQ ID NO: 4899610 - DNA, 18 bp, Homo sapiens
gattgacctgctccgctg

SEQ ID NO: 4899611 - DNA, 17 bp, Homo sapiens
gattgatttgaagaaca

SEQ ID NO: 4899612 - DNA, 17 bp, Homo sapiens
gattgcaacaggctggg

SEQ ID NO: 4899613 - DNA, 18 bp, Homo sapiens
gattgcaacaggctgggc

SEQ ID NO: 4899614 - DNA, 20 bp, Homo sapiens
gattgcaacaggctgggctt

SEQ ID NO: 4899615 - DNA, 21 bp, Homo sapiens
gattgcaatatctgaagccct

SEQ ID NO: 4899616 - DNA, 12 bp, Homo sapiens
gattgcagcttt

SEQ ID NO: 4899617 - DNA, 18 bp, Homo sapiens
gattgcagctttatgttc

SEQ ID NO: 4899618 - DNA, 13 bp, Homo sapiens
gattggattattt

SEQ ID NO: 4899619 - DNA, 22 bp, Homo sapiens
gattggattatttaataacatt

SEQ ID NO: 4899620 - DNA, 20 bp, Homo sapiens
gattggcttgtagaattgtt

SEQ ID NO: 4899621 - DNA, 13 bp, Homo sapiens
gattgtaaaaaaa

SEQ ID NO: 4899622 - DNA, 18 bp, Homo sapiens
gattgtaaaaaaaaatgc

SEQ ID NO: 4899623 - DNA, 23 bp, Homo sapiens
gattgtaaaatagcttgtatagt

SEQ ID NO: 4899624 - DNA, 18 bp, Homo sapiens
gattgtttcctcttccaa

SEQ ID NO: 4899625 - DNA, 15 bp, Homo sapiens
gatttaaacacacag

SEQ ID NO: 4899626 - DNA, 16 bp, Homo sapiens
gatttaagcacaaact

SEQ ID NO: 4899627 - DNA, 13 bp, Homo sapiens
gatttaataaaat

SEQ ID NO: 4899628 - DNA, 14 bp, Homo sapiens
gatttaataaaata

SEQ ID NO: 4899629 - DNA, 14 bp, Homo sapiens
gatttaatttccag

SEQ ID NO: 4899630 - DNA, 21 bp, Homo sapiens
gatttacagcaagtagataaa

SEQ ID NO: 4899631 - DNA, 12 bp, Homo sapiens
gatttagaaaaa

SEQ ID NO: 4899632 - DNA, 19 bp, Homo sapiens
gatttatataaatgtaaaa

SEQ ID NO: 4899633 - DNA, 17 bp, Homo sapiens
gatttatttttcagttc

SEQ ID NO: 4899634 - DNA, 16 bp, Homo sapiens
gatttcatacctcaga

SEQ ID NO: 4899635 - DNA, 16 bp, Homo sapiens
gatttcatgctatctc

SEQ ID NO: 4899636 - DNA, 15 bp, Homo sapiens
gatttccaagtaata

SEQ ID NO: 4899637 - DNA, 18 bp, Homo sapiens
gatttccaagtaatataa

SEQ ID NO: 4899638 - DNA, 20 bp, Homo sapiens
gatttccaagtaatataatg

SEQ ID NO: 4899639 - DNA, 18 bp, Homo sapiens
gatttctggttctgatgc

SEQ ID NO: 4899640 - DNA, 13 bp, Homo sapiens
gatttcttaaata

SEQ ID NO: 4899641 - DNA, 20 bp, Homo sapiens
gatttgaagaacatgtgaga

SEQ ID NO: 4899642 - DNA, 21 bp, Homo sapiens
gatttgcattgaacacaaact

SEQ ID NO: 4899643 - DNA, 14 bp, Homo sapiens
gatttgtactgaaa

SEQ ID NO: 4899644 - DNA, 14 bp, Homo sapiens
gatttgtcccaggt

SEQ ID NO: 4899645 - DNA, 19 bp, Homo sapiens
gatttgttaatgatagcta

SEQ ID NO: 4899646 - DNA, 16 bp, Homo sapiens
gattttaattgtcatg

SEQ ID NO: 4899647 - DNA, 19 bp, Homo sapiens
gattttaggagctaaggct

SEQ ID NO: 4899648 - DNA, 21 bp, Homo sapiens
gattttaggagctaaggctct

SEQ ID NO: 4899649 - DNA, 18 bp, Homo sapiens
gattttcaaagctttttc

SEQ ID NO: 4899650 - DNA, 14 bp, Homo sapiens
gattttcataactt

SEQ ID NO: 4899651 - DNA, 23 bp, Homo sapiens
gattttcataacttattgctgat

SEQ ID NO: 4899652 - DNA, 13 bp, Homo sapiens
gattttctccagc

SEQ ID NO: 4899653 - DNA, 13 bp, Homo sapiens
gattttgcctgtg

SEQ ID NO: 4899654 - DNA, 21 bp, Homo sapiens
gattttggggttgtgttgtca

SEQ ID NO: 4899655 - DNA, 18 bp, Homo sapiens
gatttttactgtgtttta

SEQ ID NO: 4899656 - DNA, 13 bp, Homo sapiens
gatttttctcaaa

SEQ ID NO: 4899657 - DNA, 14 bp, Homo sapiens
gatttttgttgatt

SEQ ID NO: 4899658 - DNA, 17 bp, Homo sapiens
gattttttaaaagaaat

SEQ ID NO: 4899659 - DNA, 14 bp, Homo sapiens
gattttttattgct

SEQ ID NO: 4899660 - DNA, 22 bp, Homo sapiens
gattttttattgctagtatttg

SEQ ID NO: 4899661 - DNA, 18 bp, Homo sapiens
gcaaaaatccgaggtgct

SEQ ID NO: 4899662 - DNA, 14 bp, Homo sapiens
gcaaaagccttgtg

SEQ ID NO: 4899663 - DNA, 13 bp, Homo sapiens
gcaaaataatttt

SEQ ID NO: 4899664 - DNA, 14 bp, Homo sapiens
gcaaacagaacagg

SEQ ID NO: 4899665 - DNA, 15 bp, Homo sapiens
gcaaacagaacaggg

SEQ ID NO: 4899666 - DNA, 21 bp, Homo sapiens
gcaaacaggatcagttaacta

SEQ ID NO: 4899667 - DNA, 16 bp, Homo sapiens
gcaaaccatttttaaa

SEQ ID NO: 4899668 - DNA, 22 bp, Homo sapiens
gcaaagaaagtgggaggtcagg

SEQ ID NO: 4899669 - DNA, 23 bp, Homo sapiens
gcaaagaaagtgggaggtcagga

SEQ ID NO: 4899670 - DNA, 21 bp, Homo sapiens
gcaaagaggactcgcttgtaa

SEQ ID NO: 4899671 - DNA, 14 bp, Homo sapiens
gcaaagatcaaaat

SEQ ID NO: 4899672 - DNA, 18 bp, Homo sapiens
gcaaagatcaaaataaaa

SEQ ID NO: 4899673 - DNA, 16 bp, Homo sapiens
gcaaagtacaatgtgt

SEQ ID NO: 4899674 - DNA, 20 bp, Homo sapiens
gcaaatatcatactgttcaa

SEQ ID NO: 4899675 - DNA, 12 bp, Homo sapiens
gcaaatcaatgc

SEQ ID NO: 4899676 - DNA, 12 bp, Homo sapiens
gcaaatcttgaa

SEQ ID NO: 4899677 - DNA, 19 bp, Homo sapiens
gcaaatgacatgcactgac

SEQ ID NO: 4899678 - DNA, 15 bp, Homo sapiens
gcaaatgtggctcct

SEQ ID NO: 4899679 - DNA, 12 bp, Homo sapiens
gcaaatgtgtac

SEQ ID NO: 4899680 - DNA, 20 bp, Homo sapiens
gcaaatttcaaaagacatgt

SEQ ID NO: 4899681 - DNA, 15 bp, Homo sapiens
gcaacacagcctggg

SEQ ID NO: 4899682 - DNA, 18 bp, Homo sapiens
gcaacacagcctgggccc

SEQ ID NO: 4899683 - DNA, 23 bp, Homo sapiens
gcaacacagcctgggccccagct

SEQ ID NO: 4899684 - DNA, 13 bp, Homo sapiens
gcaacagacaagt

SEQ ID NO: 4899685 - DNA, 14 bp, Homo sapiens
gcaacaggctgggc

SEQ ID NO: 4899686 - DNA, 17 bp, Homo sapiens
gcaacatccaaaatagt

SEQ ID NO: 4899687 - DNA, 23 bp, Homo sapiens
gcaacatttacagtccttcaaaa

SEQ ID NO: 4899688 - DNA, 13 bp, Homo sapiens
gcaaccacacacc

SEQ ID NO: 4899689 - DNA, 16 bp, Homo sapiens
gcaacccccagcctgc

SEQ ID NO: 4899690 - DNA, 18 bp, Homo sapiens
gcaacctgattgtaaact

SEQ ID NO: 4899691 - DNA, 22 bp, Homo sapiens
gcaacctttcacctttgtgtat

SEQ ID NO: 4899692 - DNA, 23 bp, Homo sapiens
gcaacctttcacctttgtgtatt

SEQ ID NO: 4899693 - DNA, 22 bp, Homo sapiens
gcaacgtttacaccgactagcc

SEQ ID NO: 4899694 - DNA, 12 bp, Homo sapiens
gcaactgttatg

SEQ ID NO: 4899695 - DNA, 21 bp, Homo sapiens
gcaactgttatgaaataaaga

SEQ ID NO: 4899696 - DNA, 16 bp, Homo sapiens
gcaacttcagtcctgg

SEQ ID NO: 4899697 - DNA, 17 bp, Homo sapiens
gcaacttcagtcctggg

SEQ ID NO: 4899698 - DNA, 19 bp, Homo sapiens
gcaacttcagtcctgggag

SEQ ID NO: 4899699 - DNA, 15 bp, Homo sapiens
gcaacttgaaattat

SEQ ID NO: 4899700 - DNA, 19 bp, Homo sapiens
gcaacttgaaattatatct

SEQ ID NO: 4899701 - DNA, 20 bp, Homo sapiens
gcaacttttgtgtaatgaaa

SEQ ID NO: 4899702 - DNA, 14 bp, Homo sapiens
gcaagcacatctgc

SEQ ID NO: 4899703 - DNA, 18 bp, Homo sapiens
gcaagcacctcctgcctc

SEQ ID NO: 4899704 - DNA, 15 bp, Homo sapiens
gcaagccctacagag

SEQ ID NO: 4899705 - DNA, 21 bp, Homo sapiens
gcaagccctacagagctgtgg

SEQ ID NO: 4899706 - DNA, 14 bp, Homo sapiens
gcaagctaacctta

SEQ ID NO: 4899707 - DNA, 15 bp, Homo sapiens
gcaagctaaccttat

SEQ ID NO: 4899708 - DNA, 23 bp, Homo sapiens
gcaagctaaccttatcctgcatt

SEQ ID NO: 4899709 - DNA, 14 bp, Homo sapiens
gcaagctggcctct

SEQ ID NO: 4899710 - DNA, 14 bp, Homo sapiens
gcaaggaaaaagaa

SEQ ID NO: 4899711 - DNA, 17 bp, Homo sapiens
gcaaggaaaaagaaaat

SEQ ID NO: 4899712 - DNA, 18 bp, Homo sapiens
gcaaggaaaaagaaaata

SEQ ID NO: 4899713 - DNA, 13 bp, Homo sapiens
gcaaggcccacag

SEQ ID NO: 4899714 - DNA, 14 bp, Homo sapiens
gcaaggcccacagg

SEQ ID NO: 4899715 - DNA, 16 bp, Homo sapiens
gcaaggcccacaggag

SEQ ID NO: 4899716 - DNA, 19 bp, Homo sapiens
gcaaggccctgctgcccaa

SEQ ID NO: 4899717 - DNA, 15 bp, Homo sapiens
gcaaggtcatttctt

SEQ ID NO: 4899718 - DNA, 19 bp, Homo sapiens
gcaaggttaagcaaggtgg

SEQ ID NO: 4899719 - DNA, 18 bp, Homo sapiens
gcaagtagataaatattt

SEQ ID NO: 4899720 - DNA, 19 bp, Homo sapiens
gcaagtagataaatatttg

SEQ ID NO: 4899721 - DNA, 17 bp, Homo sapiens
gcaagtgagagagatgg

SEQ ID NO: 4899722 - DNA, 22 bp, Homo sapiens
gcaagtgagagagatgggagct

SEQ ID NO: 4899723 - DNA, 19 bp, Homo sapiens
gcaagtgagagctgggtgt

SEQ ID NO: 4899724 - DNA, 22 bp, Homo sapiens
gcaagtgtggggggtccttctc

SEQ ID NO: 4899725 - DNA, 16 bp, Homo sapiens
gcaagttaagagaaac

SEQ ID NO: 4899726 - DNA, 14 bp, Homo sapiens
gcaataacttctga

SEQ ID NO: 4899727 - DNA, 21 bp, Homo sapiens
gcaatatattaccagcaagaa

SEQ ID NO: 4899728 - DNA, 22 bp, Homo sapiens
gcaatattccttagtcaaatca

SEQ ID NO: 4899729 - DNA, 14 bp, Homo sapiens
gcaatcctgtcttt

SEQ ID NO: 4899730 - DNA, 23 bp, Homo sapiens
gcaatgaaaggtactatatttgc

SEQ ID NO: 4899731 - DNA, 18 bp, Homo sapiens
gcaatgacaggtaaatta

SEQ ID NO: 4899732 - DNA, 19 bp, Homo sapiens
gcaatgacaggtaaattaa

SEQ ID NO: 4899733 - DNA, 16 bp, Homo sapiens
gcaatgacatctcagg

SEQ ID NO: 4899734 - DNA, 13 bp, Homo sapiens
gcaatgctggctg

SEQ ID NO: 4899735 - DNA, 22 bp, Homo sapiens
gcaatgctggctgttggctggg

SEQ ID NO: 4899736 - DNA, 13 bp, Homo sapiens
gcaatggcagcct

SEQ ID NO: 4899737 - DNA, 14 bp, Homo sapiens
gcaatggcagcctt

SEQ ID NO: 4899738 - DNA, 14 bp, Homo sapiens
gcaattcataaaaa

SEQ ID NO: 4899739 - DNA, 14 bp, Homo sapiens
gcaattcccctctg

SEQ ID NO: 4899740 - DNA, 18 bp, Homo sapiens
gcaattcccctctgctgc

SEQ ID NO: 4899741 - DNA, 22 bp, Homo sapiens
gcaattgtctatttatctttta

SEQ ID NO: 4899742 - DNA, 19 bp, Homo sapiens
gcaatttatacaatatcat

SEQ ID NO: 4899743 - DNA, 23 bp, Homo sapiens
gcacaaaatgaatgaggtctggg

SEQ ID NO: 4899744 - DNA, 15 bp, Homo sapiens
gcacaaatatttatt

SEQ ID NO: 4899745 - DNA, 22 bp, Homo sapiens
gcacaagcagagtgcacagctg

SEQ ID NO: 4899746 - DNA, 19 bp, Homo sapiens
gcacaatttgcactaaatc

SEQ ID NO: 4899747 - DNA, 16 bp, Homo sapiens
gcacacaccagagccc

SEQ ID NO: 4899748 - DNA, 19 bp, Homo sapiens
gcacacaccagagcccacc

SEQ ID NO: 4899749 - DNA, 15 bp, Homo sapiens
gcacacactcagtgc

SEQ ID NO: 4899750 - DNA, 17 bp, Homo sapiens
gcacacagaaatatata

SEQ ID NO: 4899751 - DNA, 23 bp, Homo sapiens
gcacacagaaatatatatacata

SEQ ID NO: 4899752 - DNA, 14 bp, Homo sapiens
gcacacagtcacct

SEQ ID NO: 4899753 - DNA, 20 bp, Homo sapiens
gcacaccctcactctgccag

SEQ ID NO: 4899754 - DNA, 23 bp, Homo sapiens
gcacaccctcactctgccagggc

SEQ ID NO: 4899755 - DNA, 14 bp, Homo sapiens
gcacaccgggcact

SEQ ID NO: 4899756 - DNA, 20 bp, Homo sapiens
gcacaccgggcactcagaag

SEQ ID NO: 4899757 - DNA, 16 bp, Homo sapiens
gcacacgcgttatagt

SEQ ID NO: 4899758 - DNA, 20 bp, Homo sapiens
gcacacgcgttatagtaact

SEQ ID NO: 4899759 - DNA, 19 bp, Homo sapiens
gcacactctgccagcaaag

SEQ ID NO: 4899760 - DNA, 17 bp, Homo sapiens
gcacagatatactttgt

SEQ ID NO: 4899761 - DNA, 19 bp, Homo sapiens
gcacagatatactttgtgg

SEQ ID NO: 4899762 - DNA, 14 bp, Homo sapiens
gcacagattttaat

SEQ ID NO: 4899763 - DNA, 21 bp, Homo sapiens
gcacagcggggccccagggct

SEQ ID NO: 4899764 - DNA, 14 bp, Homo sapiens
gcacagctccctgc

SEQ ID NO: 4899765 - DNA, 16 bp, Homo sapiens
gcacagctgtagtggg

SEQ ID NO: 4899766 - DNA, 15 bp, Homo sapiens
gcacaggaaaaggta

SEQ ID NO: 4899767 - DNA, 18 bp, Homo sapiens
gcacaggaaaaggtagct

SEQ ID NO: 4899768 - DNA, 16 bp, Homo sapiens
gcacaggactgattct

SEQ ID NO: 4899769 - DNA, 15 bp, Homo sapiens
gcacaggatgctggc

SEQ ID NO: 4899770 - DNA, 12 bp, Homo sapiens
gcacagggagaa

SEQ ID NO: 4899771 - DNA, 15 bp, Homo sapiens
gcacaggtcccacct

SEQ ID NO: 4899772 - DNA, 17 bp, Homo sapiens
gcacaggtcccacctcc

SEQ ID NO: 4899773 - DNA, 20 bp, Homo sapiens
gcacagtgcatctcagccca

SEQ ID NO: 4899774 - DNA, 17 bp, Homo sapiens
gcacagtgttaaatgaa

SEQ ID NO: 4899775 - DNA, 20 bp, Homo sapiens
gcacagtgttaaatgaaatt

SEQ ID NO: 4899776 - DNA, 14 bp, Homo sapiens
gcacataaactttg

SEQ ID NO: 4899777 - DNA, 21 bp, Homo sapiens
gcacatccattcccaagaaat

SEQ ID NO: 4899778 - DNA, 14 bp, Homo sapiens
gcacatgctggcca

SEQ ID NO: 4899779 - DNA, 21 bp, Homo sapiens
gcacatgctggccagcctggg

SEQ ID NO: 4899780 - DNA, 23 bp, Homo sapiens
gcacatgctggccagcctggggc

SEQ ID NO: 4899781 - DNA, 21 bp, Homo sapiens
gcacatgtcttgtacatgtgt

SEQ ID NO: 4899782 - DNA, 14 bp, Homo sapiens
gcacattgagctgt

SEQ ID NO: 4899783 - DNA, 18 bp, Homo sapiens
gcacattgagctgtgcaa

SEQ ID NO: 4899784 - DNA, 18 bp, Homo sapiens
gcacattgttgttttttt

SEQ ID NO: 4899785 - DNA, 19 bp, Homo sapiens
gcaccaaagatgcagccgc

SEQ ID NO: 4899786 - DNA, 21 bp, Homo sapiens
gcaccaaagatgcagccgcct

SEQ ID NO: 4899787 - DNA, 22 bp, Homo sapiens
gcaccaccctagtcccttcccc

SEQ ID NO: 4899788 - DNA, 11 bp, Homo sapiens
gcaccagccag

SEQ ID NO: 4899789 - DNA, 18 bp, Homo sapiens
gcaccccgatgtggacct

SEQ ID NO: 4899790 - DNA, 23 bp, Homo sapiens
gcaccccgatgtggacctctact

SEQ ID NO: 4899791 - DNA, 18 bp, Homo sapiens
gcacccggcccctgctgg

SEQ ID NO: 4899792 - DNA, 17 bp, Homo sapiens
gcaccctggggcctgga

SEQ ID NO: 4899793 - DNA, 21 bp, Homo sapiens
gcaccctggggcctggacctg

SEQ ID NO: 4899794 - DNA, 20 bp, Homo sapiens
gcaccgcttttgttctcgca

SEQ ID NO: 4899795 - DNA, 23 bp, Homo sapiens
gcaccgggccacagagaaagtac

SEQ ID NO: 4899796 - DNA, 19 bp, Homo sapiens
gcacctaccatcagggaca

SEQ ID NO: 4899797 - DNA, 16 bp, Homo sapiens
gcacctcagcctgcac

SEQ ID NO: 4899798 - DNA, 12 bp, Homo sapiens
gcacctcctgcc

SEQ ID NO: 4899799 - DNA, 17 bp, Homo sapiens
gcacctccttgtcactt

SEQ ID NO: 4899800 - DNA, 21 bp, Homo sapiens
gcaccttaccaactttctgta

SEQ ID NO: 4899801 - DNA, 22 bp, Homo sapiens
gcaccttgtgtctgtacacgtg

SEQ ID NO: 4899802 - DNA, 18 bp, Homo sapiens
gcacggacaataaacctc

SEQ ID NO: 4899803 - DNA, 15 bp, Homo sapiens
gcactaaagccagcc

SEQ ID NO: 4899804 - DNA, 20 bp, Homo sapiens
gcactaaagtatgtaaagta

SEQ ID NO: 4899805 - DNA, 15 bp, Homo sapiens
gcactaaatatgaac

SEQ ID NO: 4899806 - DNA, 13 bp, Homo sapiens
gcactacatgtgg

SEQ ID NO: 4899807 - DNA, 21 bp, Homo sapiens
gcactacatgtggtttataga

SEQ ID NO: 4899808 - DNA, 12 bp, Homo sapiens
gcactacattca

SEQ ID NO: 4899809 - DNA, 16 bp, Homo sapiens
gcactacattcattta

SEQ ID NO: 4899810 - DNA, 16 bp, Homo sapiens
gcactaccgattcttt

SEQ ID NO: 4899811 - DNA, 18 bp, Homo sapiens
gcactactgggtgtcatt

SEQ ID NO: 4899812 - DNA, 19 bp, Homo sapiens
gcactactgggtgtcattt

SEQ ID NO: 4899813 - DNA, 21 bp, Homo sapiens
gcactactgggtgtcatttca

SEQ ID NO: 4899814 - DNA, 18 bp, Homo sapiens
gcactagcctttggctct

SEQ ID NO: 4899815 - DNA, 17 bp, Homo sapiens
gcactaggcacccagct

SEQ ID NO: 4899816 - DNA, 22 bp, Homo sapiens
gcactatgaggaataattattt

SEQ ID NO: 4899817 - DNA, 13 bp, Homo sapiens
gcactcagaagac

SEQ ID NO: 4899818 - DNA, 20 bp, Homo sapiens
gcactcagaagacactgatg

SEQ ID NO: 4899819 - DNA, 17 bp, Homo sapiens
gcactccagcctgggca

SEQ ID NO: 4899820 - DNA, 11 bp, Homo sapiens
gcactctagat

SEQ ID NO: 4899821 - DNA, 14 bp, Homo sapiens
gcactctgttattt

SEQ ID NO: 4899822 - DNA, 15 bp, Homo sapiens
gcactcttaaagcaa

SEQ ID NO: 4899823 - DNA, 14 bp, Homo sapiens
gcactgacccttcc

SEQ ID NO: 4899824 - DNA, 16 bp, Homo sapiens
gcactgacccttccag

SEQ ID NO: 4899825 - DNA, 20 bp, Homo sapiens
gcactgacccttccagacat

SEQ ID NO: 4899826 - DNA, 21 bp, Homo sapiens
gcactgacccttccagacata

SEQ ID NO: 4899827 - DNA, 14 bp, Homo sapiens
gcactgatatttta

SEQ ID NO: 4899828 - DNA, 12 bp, Homo sapiens
gcactgctgccc

SEQ ID NO: 4899829 - DNA, 18 bp, Homo sapiens
gcactgctgcccagcctc

SEQ ID NO: 4899830 - DNA, 23 bp, Homo sapiens
gcactgggatgagccgctgtgag

SEQ ID NO: 4899831 - DNA, 23 bp, Homo sapiens
gcactggggagcccgtctcagtg

SEQ ID NO: 4899832 - DNA, 22 bp, Homo sapiens
gcactggtggcttgcagtttgc

SEQ ID NO: 4899833 - DNA, 18 bp, Homo sapiens
gcactgtagttctaagac

SEQ ID NO: 4899834 - DNA, 17 bp, Homo sapiens
gcacttagctatcagaa

SEQ ID NO: 4899835 - DNA, 22 bp, Homo sapiens
gcacttcctgttttataatgaa

SEQ ID NO: 4899836 - DNA, 13 bp, Homo sapiens
gcacttgcctggg

SEQ ID NO: 4899837 - DNA, 18 bp, Homo sapiens
gcacttggagacttgtat

SEQ ID NO: 4899838 - DNA, 18 bp, Homo sapiens
gcactttaaatgaagcta

SEQ ID NO: 4899839 - DNA, 19 bp, Homo sapiens
gcactttccacttcttcct

SEQ ID NO: 4899840 - DNA, 13 bp, Homo sapiens
gcactttgaaata

SEQ ID NO: 4899841 - DNA, 18 bp, Homo sapiens
gcactttgaaatacctca

SEQ ID NO: 4899842 - DNA, 21 bp, Homo sapiens
gcactttgatgtcatgtgttc

SEQ ID NO: 4899843 - DNA, 24 bp, Homo sapiens
gcagaacggagccccaggcctctg

SEQ ID NO: 4899844 - DNA, 14 bp, Homo sapiens
gcagaagacaccag

SEQ ID NO: 4899845 - DNA, 16 bp, Homo sapiens
gcagaagacaccagag

SEQ ID NO: 4899846 - DNA, 18 bp, Homo sapiens
gcagaagacaccagagca

SEQ ID NO: 4899847 - DNA, 15 bp, Homo sapiens
gcagacagcaggcag

SEQ ID NO: 4899848 - DNA, 19 bp, Homo sapiens
gcagacaggcaagcacctc

SEQ ID NO: 4899849 - DNA, 17 bp, Homo sapiens
gcagacctccccagccc

SEQ ID NO: 4899850 - DNA, 22 bp, Homo sapiens
gcagacctccccagcccctagc

SEQ ID NO: 4899851 - DNA, 23 bp, Homo sapiens
gcagacctccccagcccctagcc

SEQ ID NO: 4899852 - DNA, 14 bp, Homo sapiens
gcagacgccgggga

SEQ ID NO: 4899853 - DNA, 16 bp, Homo sapiens
gcagactacacaggat

SEQ ID NO: 4899854 - DNA, 15 bp, Homo sapiens
gcagactctacagag

SEQ ID NO: 4899855 - DNA, 22 bp, Homo sapiens
gcagactctacagaggccatgg

SEQ ID NO: 4899856 - DNA, 20 bp, Homo sapiens
gcagagaatgaaagggccca

SEQ ID NO: 4899857 - DNA, 21 bp, Homo sapiens
gcagagaatgaaagggcccag

SEQ ID NO: 4899858 - DNA, 10 bp, Homo sapiens
gcagagagag

SEQ ID NO: 4899859 - DNA, 14 bp, Homo sapiens
gcagaggtcagact

SEQ ID NO: 4899860 - DNA, 16 bp, Homo sapiens
gcagagtgcacagctg

SEQ ID NO: 4899861 - DNA, 18 bp, Homo sapiens
gcagagtgcacagctgtc

SEQ ID NO: 4899862 - DNA, 13 bp, Homo sapiens
gcagagtttgcct

SEQ ID NO: 4899863 - DNA, 22 bp, Homo sapiens
gcagatacaggaaaagctgctg

SEQ ID NO: 4899864 - DNA, 18 bp, Homo sapiens
gcagatacctcaccctgc

SEQ ID NO: 4899865 - DNA, 14 bp, Homo sapiens
gcagatctgtgccc

SEQ ID NO: 4899866 - DNA, 13 bp, Homo sapiens
gcagatgatccat

SEQ ID NO: 4899867 - DNA, 17 bp, Homo sapiens
gcagatgcagagagcca

SEQ ID NO: 4899868 - DNA, 22 bp, Homo sapiens
gcagatggaatgctgtgttaaa

SEQ ID NO: 4899869 - DNA, 14 bp, Homo sapiens
gcagcaaaaatata

SEQ ID NO: 4899870 - DNA, 19 bp, Homo sapiens
gcagcaaaaatataaaata

SEQ ID NO: 4899871 - DNA, 12 bp, Homo sapiens
gcagcaatttaa

SEQ ID NO: 4899872 - DNA, 17 bp, Homo sapiens
gcagcaatttaaatgtt

SEQ ID NO: 4899873 - DNA, 15 bp, Homo sapiens
gcagcacggacaata

SEQ ID NO: 4899874 - DNA, 18 bp, Homo sapiens
gcagcacggacaataaac

SEQ ID NO: 4899875 - DNA, 21 bp, Homo sapiens
gcagcaggtgattggaccagg

SEQ ID NO: 4899876 - DNA, 20 bp, Homo sapiens
gcagcatggtccctgcctta

SEQ ID NO: 4899877 - DNA, 21 bp, Homo sapiens
gcagccaaacccatgaggcaa

SEQ ID NO: 4899878 - DNA, 14 bp, Homo sapiens
gcagccaacctaag

SEQ ID NO: 4899879 - DNA, 12 bp, Homo sapiens
gcagccaggctg

SEQ ID NO: 4899880 - DNA, 23 bp, Homo sapiens
gcagccagggcttacctgtacac

SEQ ID NO: 4899881 - DNA, 13 bp, Homo sapiens
gcagcccagagac

SEQ ID NO: 4899882 - DNA, 15 bp, Homo sapiens
gcagcccatgcccac

SEQ ID NO: 4899883 - DNA, 20 bp, Homo sapiens
gcagcccatgcccacctgcc

SEQ ID NO: 4899884 - DNA, 21 bp, Homo sapiens
gcagccccattctgcctgccc

SEQ ID NO: 4899885 - DNA, 18 bp, Homo sapiens
gcagccctagagcctgcc

SEQ ID NO: 4899886 - DNA, 20 bp, Homo sapiens
gcagccgccttaagctgatc

SEQ ID NO: 4899887 - DNA, 18 bp, Homo sapiens
gcagccgtgccttcagct

SEQ ID NO: 4899888 - DNA, 17 bp, Homo sapiens
gcagcctccaacacaag

SEQ ID NO: 4899889 - DNA, 18 bp, Homo sapiens
gcagcctccaacacaagg

SEQ ID NO: 4899890 - DNA, 20 bp, Homo sapiens
gcagcctggagacccacccc

SEQ ID NO: 4899891 - DNA, 14 bp, Homo sapiens
gcagcctgtggcat

SEQ ID NO: 4899892 - DNA, 22 bp, Homo sapiens
gcagcctgtggcatctttgcct

SEQ ID NO: 4899893 - DNA, 18 bp, Homo sapiens
gcagcgaccgccccctcc

SEQ ID NO: 4899894 - DNA, 17 bp, Homo sapiens
gcagctggacagagggg

SEQ ID NO: 4899895 - DNA, 19 bp, Homo sapiens
gcagcttgagggttgggct

SEQ ID NO: 4899896 - DNA, 21 bp, Homo sapiens
gcagctttaaactcagggaca

SEQ ID NO: 4899897 - DNA, 21 bp, Homo sapiens
gcaggaaagtttacccatgaa

SEQ ID NO: 4899898 - DNA, 20 bp, Homo sapiens
gcaggaagcattcagagagc

SEQ ID NO: 4899899 - DNA, 23 bp, Homo sapiens
gcaggaaggagagcctgctgcat

SEQ ID NO: 4899900 - DNA, 22 bp, Homo sapiens
gcaggacctcccttccgaccct

SEQ ID NO: 4899901 - DNA, 23 bp, Homo sapiens
gcaggactcacaggttggaagag

SEQ ID NO: 4899902 - DNA, 14 bp, Homo sapiens
gcaggagattgaga

SEQ ID NO: 4899903 - DNA, 21 bp, Homo sapiens
gcaggagattgagaaggagag

SEQ ID NO: 4899904 - DNA, 18 bp, Homo sapiens
gcaggagggccctacctg

SEQ ID NO: 4899905 - DNA, 19 bp, Homo sapiens
gcaggagtggtgcagacag

SEQ ID NO: 4899906 - DNA, 20 bp, Homo sapiens
gcaggcacctagcaattcca

SEQ ID NO: 4899907 - DNA, 19 bp, Homo sapiens
gcaggcacttattgtaaat

SEQ ID NO: 4899908 - DNA, 20 bp, Homo sapiens
gcaggcagactacacaggat

SEQ ID NO: 4899909 - DNA, 14 bp, Homo sapiens
gcaggcatctgatt

SEQ ID NO: 4899910 - DNA, 16 bp, Homo sapiens
gcaggcattgaggaag

SEQ ID NO: 4899911 - DNA, 12 bp, Homo sapiens
gcaggccctgca

SEQ ID NO: 4899912 - DNA, 13 bp, Homo sapiens
gcaggccctgcag

SEQ ID NO: 4899913 - DNA, 17 bp, Homo sapiens
gcaggctgagccactct

SEQ ID NO: 4899914 - DNA, 10 bp, Homo sapiens
gcaggctggg

SEQ ID NO: 4899915 - DNA, 12 bp, Homo sapiens
gcagggcagccc

SEQ ID NO: 4899916 - DNA, 13 bp, Homo sapiens
gcagggcagcccc

SEQ ID NO: 4899917 - DNA, 12 bp, Homo sapiens
gcagggctcagc

SEQ ID NO: 4899918 - DNA, 14 bp, Homo sapiens
gcagggctcagcgg

SEQ ID NO: 4899919 - DNA, 21 bp, Homo sapiens
gcagggctggccccagggcac

SEQ ID NO: 4899920 - DNA, 17 bp, Homo sapiens
gcaggggctacaagagg

SEQ ID NO: 4899921 - DNA, 13 bp, Homo sapiens
gcaggggctctgg

SEQ ID NO: 4899922 - DNA, 17 bp, Homo sapiens
gcaggggctctggagag

SEQ ID NO: 4899923 - DNA, 21 bp, Homo sapiens
gcaggggctctggagagaaac

SEQ ID NO: 4899924 - DNA, 21 bp, Homo sapiens
gcagggggtggacaaactgga

SEQ ID NO: 4899925 - DNA, 14 bp, Homo sapiens
gcagggtgttggga

SEQ ID NO: 4899926 - DNA, 21 bp, Homo sapiens
gcaggtgattggaccaggcca

SEQ ID NO: 4899927 - DNA, 19 bp, Homo sapiens
gcaggttctgcctgctttg

SEQ ID NO: 4899928 - DNA, 19 bp, Homo sapiens
gcaggttggaccccagaga

SEQ ID NO: 4899929 - DNA, 20 bp, Homo sapiens
gcagtagaaataatatgcat

SEQ ID NO: 4899930 - DNA, 12 bp, Homo sapiens
gcagtccatgca

SEQ ID NO: 4899931 - DNA, 14 bp, Homo sapiens
gcagtccatgcatg

SEQ ID NO: 4899932 - DNA, 16 bp, Homo sapiens
gcagtccatgcatgac

SEQ ID NO: 4899933 - DNA, 22 bp, Homo sapiens
gcagtctcctctttaaaacaaa

SEQ ID NO: 4899934 - DNA, 23 bp, Homo sapiens
gcagtgagaaaaagctcctgtcc

SEQ ID NO: 4899935 - DNA, 13 bp, Homo sapiens
gcagtgagcagaa

SEQ ID NO: 4899936 - DNA, 18 bp, Homo sapiens
gcagtgagtgagcctggc

SEQ ID NO: 4899937 - DNA, 19 bp, Homo sapiens
gcagtgagtgagcctggct

SEQ ID NO: 4899938 - DNA, 21 bp, Homo sapiens
gcagtgagtgagcctggctct

SEQ ID NO: 4899939 - DNA, 21 bp, Homo sapiens
gcagtgatatggcagaagaca

SEQ ID NO: 4899940 - DNA, 14 bp, Homo sapiens
gcagtggaggtggg

SEQ ID NO: 4899941 - DNA, 21 bp, Homo sapiens
gcagtgggacagggcatggcc

SEQ ID NO: 4899942 - DNA, 22 bp, Homo sapiens
gcagtggtgcgatctgggttca

SEQ ID NO: 4899943 - DNA, 16 bp, Homo sapiens
gcagtgttcgcttggc

SEQ ID NO: 4899944 - DNA, 13 bp, Homo sapiens
gcagttcacctgc

SEQ ID NO: 4899945 - DNA, 12 bp, Homo sapiens
gcagttctgtta

SEQ ID NO: 4899946 - DNA, 14 bp, Homo sapiens
gcagtttttcagga

SEQ ID NO: 4899947 - DNA, 16 bp, Homo sapiens
gcataaaaacatttta

SEQ ID NO: 4899948 - DNA, 14 bp, Homo sapiens
gcataaatatgcag

SEQ ID NO: 4899949 - DNA, 15 bp, Homo sapiens
gcataaatatgcagt

SEQ ID NO: 4899950 - DNA, 23 bp, Homo sapiens
gcatagatgttttggtagattaa

SEQ ID NO: 4899951 - DNA, 16 bp, Homo sapiens
gcatagcaagacacat

SEQ ID NO: 4899952 - DNA, 14 bp, Homo sapiens
gcatatagagatga

SEQ ID NO: 4899953 - DNA, 13 bp, Homo sapiens
gcatcagggggaa

SEQ ID NO: 4899954 - DNA, 20 bp, Homo sapiens
gcatcagggggaagaagcag

SEQ ID NO: 4899955 - DNA, 19 bp, Homo sapiens
gcatcagtccctatgtatt

SEQ ID NO: 4899956 - DNA, 15 bp, Homo sapiens
gcatcagttctacgg

SEQ ID NO: 4899957 - DNA, 12 bp, Homo sapiens
gcatcccccaaa

SEQ ID NO: 4899958 - DNA, 20 bp, Homo sapiens
gcatcccccaaagttcacaa

SEQ ID NO: 4899959 - DNA, 18 bp, Homo sapiens
gcatcccggaggaaatct

SEQ ID NO: 4899960 - DNA, 15 bp, Homo sapiens
gcatcctaagaaata

SEQ ID NO: 4899961 - DNA, 14 bp, Homo sapiens
gcatcctgagcccc

SEQ ID NO: 4899962 - DNA, 21 bp, Homo sapiens
gcatcctggcacccggcccct

SEQ ID NO: 4899963 - DNA, 22 bp, Homo sapiens
gcatcctggcacccggcccctg

SEQ ID NO: 4899964 - DNA, 22 bp, Homo sapiens
gcatctaagttataagactctc

SEQ ID NO: 4899965 - DNA, 18 bp, Homo sapiens
gcatctcttgaggccagg

SEQ ID NO: 4899966 - DNA, 20 bp, Homo sapiens
gcatctcttgaggccaggag

SEQ ID NO: 4899967 - DNA, 15 bp, Homo sapiens
gcatctgatttgcat

SEQ ID NO: 4899968 - DNA, 16 bp, Homo sapiens
gcatctgatttgcata

SEQ ID NO: 4899969 - DNA, 18 bp, Homo sapiens
gcatctgtgatgggagcg

SEQ ID NO: 4899970 - DNA, 16 bp, Homo sapiens
gcatcttatagcactt

SEQ ID NO: 4899971 - DNA, 23 bp, Homo sapiens
gcatctttgccttgggctgctcc

SEQ ID NO: 4899972 - DNA, 18 bp, Homo sapiens
gcatgaagagcaaaaata

SEQ ID NO: 4899973 - DNA, 19 bp, Homo sapiens
gcatgccccggccacctct

SEQ ID NO: 4899974 - DNA, 20 bp, Homo sapiens
gcatgccccggccacctctg

SEQ ID NO: 4899975 - DNA, 23 bp, Homo sapiens
gcatgccccggccacctctgcgg

SEQ ID NO: 4899976 - DNA, 12 bp, Homo sapiens
gcatgccttgtg

SEQ ID NO: 4899977 - DNA, 20 bp, Homo sapiens
gcatggcaaggactgcaggg

SEQ ID NO: 4899978 - DNA, 14 bp, Homo sapiens
gcatggccaggtgg

SEQ ID NO: 4899979 - DNA, 17 bp, Homo sapiens
gcatggccaggtggcca

SEQ ID NO: 4899980 - DNA, 13 bp, Homo sapiens
gcatggccctggg

SEQ ID NO: 4899981 - DNA, 19 bp, Homo sapiens
gcatggtaccagccctggg

SEQ ID NO: 4899982 - DNA, 20 bp, Homo sapiens
gcatggtaccagccctgggg

SEQ ID NO: 4899983 - DNA, 22 bp, Homo sapiens
gcatggtaccagccctggggct

SEQ ID NO: 4899984 - DNA, 14 bp, Homo sapiens
gcatgtaggaccct

SEQ ID NO: 4899985 - DNA, 21 bp, Homo sapiens
gcatgtcaaacatgagatgtg

SEQ ID NO: 4899986 - DNA, 23 bp, Homo sapiens
gcatgtccctaccgagtctcttc

SEQ ID NO: 4899987 - DNA, 17 bp, Homo sapiens
gcatgtggcttttttaa

SEQ ID NO: 4899988 - DNA, 13 bp, Homo sapiens
gcatgtgtgtgtg

SEQ ID NO: 4899989 - DNA, 15 bp, Homo sapiens
gcatgttttgtatac

SEQ ID NO: 4899990 - DNA, 16 bp, Homo sapiens
gcatgttttgtataca

SEQ ID NO: 4899991 - DNA, 22 bp, Homo sapiens
gcattaaattcacaaactttta

SEQ ID NO: 4899992 - DNA, 15 bp, Homo sapiens
gcattagaattattt

SEQ ID NO: 4899993 - DNA, 18 bp, Homo sapiens
gcattagaattatttaaa

SEQ ID NO: 4899994 - DNA, 19 bp, Homo sapiens
gcattagcacagattttaa

SEQ ID NO: 4899995 - DNA, 18 bp, Homo sapiens
gcattattcatttagtga

SEQ ID NO: 4899996 - DNA, 13 bp, Homo sapiens
gcattccttcttt

SEQ ID NO: 4899997 - DNA, 19 bp, Homo sapiens
gcattccttctttgataat

SEQ ID NO: 4899998 - DNA, 23 bp, Homo sapiens
gcattccttctttgataatgtta

SEQ ID NO: 4899999 - DNA, 15 bp, Homo sapiens
gcattctattgcctt

SEQ ID NO: 4900000 - DNA, 22 bp, Homo sapiens
gcattctattgccttctttgaa

SEQ ID NO: 4900001 - DNA, 13 bp, Homo sapiens
gcattctcactcc

SEQ ID NO: 4900002 - DNA, 15 bp, Homo sapiens
gcattctcactccta

SEQ ID NO: 4900003 - DNA, 20 bp, Homo sapiens
gcattctgcctctctaggac

SEQ ID NO: 4900004 - DNA, 16 bp, Homo sapiens
gcattgaacacaaact

SEQ ID NO: 4900005 - DNA, 19 bp, Homo sapiens
gcattgaacacaaactgta

SEQ ID NO: 4900006 - DNA, 15 bp, Homo sapiens
gcattgacaaatctg

SEQ ID NO: 4900007 - DNA, 22 bp, Homo sapiens
gcattgaccgcgactaatttca

SEQ ID NO: 4900008 - DNA, 20 bp, Homo sapiens
gcattgcctggccttcctgt

SEQ ID NO: 4900009 - DNA, 14 bp, Homo sapiens
gcattgctagataa

SEQ ID NO: 4900010 - DNA, 22 bp, Homo sapiens
gcatttccaacaccacagacac

SEQ ID NO: 4900011 - DNA, 23 bp, Homo sapiens
gcatttccaacaccacagacaca

SEQ ID NO: 4900012 - DNA, 21 bp, Homo sapiens
gcatttcctatcacctatttc

SEQ ID NO: 4900013 - DNA, 20 bp, Homo sapiens
gcatttgataatgataaaac

SEQ ID NO: 4900014 - DNA, 23 bp, Homo sapiens
gcatttgctctttcatctctgct

SEQ ID NO: 4900015 - DNA, 12 bp, Homo sapiens
gcatttgtattt

SEQ ID NO: 4900016 - DNA, 16 bp, Homo sapiens
gcatttgtattttgtg

SEQ ID NO: 4900017 - DNA, 21 bp, Homo sapiens
gcatttgtattttgtgtgacc

SEQ ID NO: 4900018 - DNA, 15 bp, Homo sapiens
gccaaaccctgtctg

SEQ ID NO: 4900019 - DNA, 13 bp, Homo sapiens
gccaaagaaatga

SEQ ID NO: 4900020 - DNA, 16 bp, Homo sapiens
gccaaagctagggtgg

SEQ ID NO: 4900021 - DNA, 22 bp, Homo sapiens
gccaaatccgctctcttcctgc

SEQ ID NO: 4900022 - DNA, 22 bp, Homo sapiens
gccaaatgctctctcaaattgt

SEQ ID NO: 4900023 - DNA, 11 bp, Homo sapiens
gccaaattatt

SEQ ID NO: 4900024 - DNA, 19 bp, Homo sapiens
gccaaattatttgtgtaat

SEQ ID NO: 4900025 - DNA, 14 bp, Homo sapiens
gccaactcctcaca

SEQ ID NO: 4900026 - DNA, 17 bp, Homo sapiens
gccaactggtgtttgaa

SEQ ID NO: 4900027 - DNA, 21 bp, Homo sapiens
gccaacttgagggcccagagc

SEQ ID NO: 4900028 - DNA, 21 bp, Homo sapiens
gccaagaaacgtcttctaaac

SEQ ID NO: 4900029 - DNA, 23 bp, Homo sapiens
gccaagacttggcaacagaagca

SEQ ID NO: 4900030 - DNA, 21 bp, Homo sapiens
gccaagagaaaggcctgcaca

SEQ ID NO: 4900031 - DNA, 23 bp, Homo sapiens
gccaagagaaaggcctgcacaca

SEQ ID NO: 4900032 - DNA, 21 bp, Homo sapiens
gccaagccctccccatcccat

SEQ ID NO: 4900033 - DNA, 22 bp, Homo sapiens
gccaagcttgttatcagctttc

SEQ ID NO: 4900034 - DNA, 15 bp, Homo sapiens
gccaaggtctgagcc

SEQ ID NO: 4900035 - DNA, 16 bp, Homo sapiens
gccaaggtctgagcca

SEQ ID NO: 4900036 - DNA, 16 bp, Homo sapiens
gccaagtataattttt

SEQ ID NO: 4900037 - DNA, 22 bp, Homo sapiens
gccaagtataattttttgtaat

SEQ ID NO: 4900038 - DNA, 23 bp, Homo sapiens
gccaatatgtattgtaaacatgt

SEQ ID NO: 4900039 - DNA, 15 bp, Homo sapiens
gccaatcaagggcaa

SEQ ID NO: 4900040 - DNA, 13 bp, Homo sapiens
gccaatggaaacc

SEQ ID NO: 4900041 - DNA, 19 bp, Homo sapiens
gccaatggaaacctcacgc

SEQ ID NO: 4900042 - DNA, 19 bp, Homo sapiens
gccaatggagactgtctca

SEQ ID NO: 4900043 - DNA, 15 bp, Homo sapiens
gccacacagaccacc

SEQ ID NO: 4900044 - DNA, 20 bp, Homo sapiens
gccacacagaccaccatcca

SEQ ID NO: 4900045 - DNA, 12 bp, Homo sapiens
gccacacccagg

SEQ ID NO: 4900046 - DNA, 15 bp, Homo sapiens
gccacacccaggcac

SEQ ID NO: 4900047 - DNA, 13 bp, Homo sapiens
gccacagagaaag

SEQ ID NO: 4900048 - DNA, 14 bp, Homo sapiens
gccacagagaaagt

SEQ ID NO: 4900049 - DNA, 16 bp, Homo sapiens
gccacagcagcatttt

SEQ ID NO: 4900050 - DNA, 19 bp, Homo sapiens
gccacagcagcatttttat

SEQ ID NO: 4900051 - DNA, 18 bp, Homo sapiens
gccacagtagtcttgatg

SEQ ID NO: 4900052 - DNA, 16 bp, Homo sapiens
gccacatttggttcta

SEQ ID NO: 4900053 - DNA, 17 bp, Homo sapiens
gccaccaaagctgccca

SEQ ID NO: 4900054 - DNA, 14 bp, Homo sapiens
gccaccacctctgt

SEQ ID NO: 4900055 - DNA, 12 bp, Homo sapiens
gccaccagagac

SEQ ID NO: 4900056 - DNA, 10 bp, Homo sapiens
gccaccagcg

SEQ ID NO: 4900057 - DNA, 14 bp, Homo sapiens
gccaccatggccag

SEQ ID NO: 4900058 - DNA, 16 bp, Homo sapiens
gccaccatggccagcc

SEQ ID NO: 4900059 - DNA, 17 bp, Homo sapiens
gccaccatggccagcca

SEQ ID NO: 4900060 - DNA, 13 bp, Homo sapiens
gccacccaggtga

SEQ ID NO: 4900061 - DNA, 20 bp, Homo sapiens
gccaccccaccctccctgga

SEQ ID NO: 4900062 - DNA, 21 bp, Homo sapiens
gccaccccaccctccctggag

SEQ ID NO: 4900063 - DNA, 21 bp, Homo sapiens
gccactagactcttcactgtt

SEQ ID NO: 4900064 - DNA, 13 bp, Homo sapiens
gccactcagcttc

SEQ ID NO: 4900065 - DNA, 20 bp, Homo sapiens
gccactcaggaggctgaggc

SEQ ID NO: 4900066 - DNA, 16 bp, Homo sapiens
gccactcattcctgta

SEQ ID NO: 4900067 - DNA, 18 bp, Homo sapiens
gccactccagacccctgg

SEQ ID NO: 4900068 - DNA, 21 bp, Homo sapiens
gccactccagacccctggctt

SEQ ID NO: 4900069 - DNA, 14 bp, Homo sapiens
gccactcgcttccc

SEQ ID NO: 4900070 - DNA, 21 bp, Homo sapiens
gccactgctccctaagccagc

SEQ ID NO: 4900071 - DNA, 23 bp, Homo sapiens
gccactgctccctaagccagcct

SEQ ID NO: 4900072 - DNA, 16 bp, Homo sapiens
gccacttcggccaggt

SEQ ID NO: 4900073 - DNA, 20 bp, Homo sapiens
gccactttaagagagaaatc

SEQ ID NO: 4900074 - DNA, 19 bp, Homo sapiens
gccactttacccacctaga

SEQ ID NO: 4900075 - DNA, 23 bp, Homo sapiens
gccacttttgactagggattcag

SEQ ID NO: 4900076 - DNA, 19 bp, Homo sapiens
gccagaagatcccctcagg

SEQ ID NO: 4900077 - DNA, 14 bp, Homo sapiens
gccagaggaactgt

SEQ ID NO: 4900078 - DNA, 17 bp, Homo sapiens
gccagaggaatcctggc

SEQ ID NO: 4900079 - DNA, 19 bp, Homo sapiens
gccagaggaatcctggcag

SEQ ID NO: 4900080 - DNA, 22 bp, Homo sapiens
gccagaggaatcctggcagccc

SEQ ID NO: 4900081 - DNA, 24 bp, Homo sapiens
gccagaggaatcctggcagcccag

SEQ ID NO: 4900082 - DNA, 17 bp, Homo sapiens
gccagagggagtgacag

SEQ ID NO: 4900083 - DNA, 18 bp, Homo sapiens
gccagagggagtgacaga

SEQ ID NO: 4900084 - DNA, 15 bp, Homo sapiens
gccagagtggcctgg

SEQ ID NO: 4900085 - DNA, 18 bp, Homo sapiens
gccagagtggcctggcca

SEQ ID NO: 4900086 - DNA, 24 bp, Homo sapiens
gccagagtggcctggccaggagct

SEQ ID NO: 4900087 - DNA, 16 bp, Homo sapiens
gccagatgatcaactc

SEQ ID NO: 4900088 - DNA, 18 bp, Homo sapiens
gccagatgcaccagccct

SEQ ID NO: 4900089 - DNA, 23 bp, Homo sapiens
gccagcaatgacatctcaggggc

SEQ ID NO: 4900090 - DNA, 15 bp, Homo sapiens
gccagcacttgtata

SEQ ID NO: 4900091 - DNA, 13 bp, Homo sapiens
gccagccccaccc

SEQ ID NO: 4900092 - DNA, 15 bp, Homo sapiens
gccagccccacccag

SEQ ID NO: 4900093 - DNA, 19 bp, Homo sapiens
gccagccccacccaggagg

SEQ ID NO: 4900094 - DNA, 19 bp, Homo sapiens
gccagccccggccctgggc

SEQ ID NO: 4900095 - DNA, 21 bp, Homo sapiens
gccagccccggccctgggctc

SEQ ID NO: 4900096 - DNA, 13 bp, Homo sapiens
gccagcctgacct

SEQ ID NO: 4900097 - DNA, 13 bp, Homo sapiens
gccagcctgaggc

SEQ ID NO: 4900098 - DNA, 23 bp, Homo sapiens
gccagctacttcctcctccccac

SEQ ID NO: 4900099 - DNA, 17 bp, Homo sapiens
gccagctcacagtgctg

SEQ ID NO: 4900100 - DNA, 19 bp, Homo sapiens
gccagctgcagctgggctg

SEQ ID NO: 4900101 - DNA, 20 bp, Homo sapiens
gccagctgcaggaatcaaaa

SEQ ID NO: 4900102 - DNA, 22 bp, Homo sapiens
gccaggaacctgtcctaaggaa

SEQ ID NO: 4900103 - DNA, 16 bp, Homo sapiens
gccaggactgagcccc

SEQ ID NO: 4900104 - DNA, 20 bp, Homo sapiens
gccaggagctcttcaggcct

SEQ ID NO: 4900105 - DNA, 19 bp, Homo sapiens
gccaggcaacttcagtcct

SEQ ID NO: 4900106 - DNA, 13 bp, Homo sapiens
gccaggccagagg

SEQ ID NO: 4900107 - DNA, 14 bp, Homo sapiens
gccaggctgccaag

SEQ ID NO: 4900108 - DNA, 10 bp, Homo sapiens
gccagggctg

SEQ ID NO: 4900109 - DNA, 20 bp, Homo sapiens
gccagggtctctccctcagg

SEQ ID NO: 4900110 - DNA, 23 bp, Homo sapiens
gccagggtctctccctcaggtgt

SEQ ID NO: 4900111 - DNA, 18 bp, Homo sapiens
gccagggtctgtgtgaat

SEQ ID NO: 4900112 - DNA, 21 bp, Homo sapiens
gccagggtctgtgtgaatgtg

SEQ ID NO: 4900113 - DNA, 18 bp, Homo sapiens
gccaggtggccactccag

SEQ ID NO: 4900114 - DNA, 23 bp, Homo sapiens
gccagtattagactggaagttca

SEQ ID NO: 4900115 - DNA, 18 bp, Homo sapiens
gccagtcaagaagaaaaa

SEQ ID NO: 4900116 - DNA, 17 bp, Homo sapiens
gccagtcctgcctggcc

SEQ ID NO: 4900117 - DNA, 18 bp, Homo sapiens
gccagtggaaattcaggt

SEQ ID NO: 4900118 - DNA, 21 bp, Homo sapiens
gccagtggggcctgtggaatg

SEQ ID NO: 4900119 - DNA, 17 bp, Homo sapiens
gccagtgtaatccccca

SEQ ID NO: 4900120 - DNA, 18 bp, Homo sapiens
gccatacttatctctctg

SEQ ID NO: 4900121 - DNA, 16 bp, Homo sapiens
gccatactttgtctga

SEQ ID NO: 4900122 - DNA, 16 bp, Homo sapiens
gccatagagtttaaca

SEQ ID NO: 4900123 - DNA, 19 bp, Homo sapiens
gccatataagtttgaagga

SEQ ID NO: 4900124 - DNA, 22 bp, Homo sapiens
gccatataagtttgaaggaaac

SEQ ID NO: 4900125 - DNA, 19 bp, Homo sapiens
gccatcaaaatgcttttta

SEQ ID NO: 4900126 - DNA, 14 bp, Homo sapiens
gccatccaggttca

SEQ ID NO: 4900127 - DNA, 19 bp, Homo sapiens
gccatccaggttcagcttg

SEQ ID NO: 4900128 - DNA, 16 bp, Homo sapiens
gccatccccagggggc

SEQ ID NO: 4900129 - DNA, 18 bp, Homo sapiens
gccatccccagggggcat

SEQ ID NO: 4900130 - DNA, 14 bp, Homo sapiens
gccatccctcgtgg

SEQ ID NO: 4900131 - DNA, 19 bp, Homo sapiens
gccatcctctttctctttt

SEQ ID NO: 4900132 - DNA, 14 bp, Homo sapiens
gccatgcaattcat

SEQ ID NO: 4900133 - DNA, 19 bp, Homo sapiens
gccatggagttgtgatcat

SEQ ID NO: 4900134 - DNA, 20 bp, Homo sapiens
gccatgtacctcccctgcct

SEQ ID NO: 4900135 - DNA, 15 bp, Homo sapiens
gccatgtactagttt

SEQ ID NO: 4900136 - DNA, 17 bp, Homo sapiens
gccatgtactagtttta

SEQ ID NO: 4900137 - DNA, 20 bp, Homo sapiens
gccatgttggccaggctggt

SEQ ID NO: 4900138 - DNA, 21 bp, Homo sapiens
gccattaaatgaatattttga

SEQ ID NO: 4900139 - DNA, 23 bp, Homo sapiens
gccattaaatgaatattttgata

SEQ ID NO: 4900140 - DNA, 12 bp, Homo sapiens
gccattattttc

SEQ ID NO: 4900141 - DNA, 18 bp, Homo sapiens
gccattattttctgtcag

SEQ ID NO: 4900142 - DNA, 19 bp, Homo sapiens
gccattattttctgtcaga

SEQ ID NO: 4900143 - DNA, 18 bp, Homo sapiens
gccattgccaccaggaga

SEQ ID NO: 4900144 - DNA, 18 bp, Homo sapiens
gccatttaaaaagttgta

SEQ ID NO: 4900145 - DNA, 16 bp, Homo sapiens
gccatttatttattga

SEQ ID NO: 4900146 - DNA, 20 bp, Homo sapiens
gcccaaaggggacaggcctc

SEQ ID NO: 4900147 - DNA, 14 bp, Homo sapiens
gcccaacctgctct

SEQ ID NO: 4900148 - DNA, 15 bp, Homo sapiens
gcccaagcccaggcc

SEQ ID NO: 4900149 - DNA, 20 bp, Homo sapiens
gcccaattggaggaaagcaa

SEQ ID NO: 4900150 - DNA, 22 bp, Homo sapiens
gcccacaggaggcaagcaagct

SEQ ID NO: 4900151 - DNA, 20 bp, Homo sapiens
gcccacatagtgatggttcc

SEQ ID NO: 4900152 - DNA, 13 bp, Homo sapiens
gcccacctgccca

SEQ ID NO: 4900153 - DNA, 16 bp, Homo sapiens
gcccaccttggctcaa

SEQ ID NO: 4900154 - DNA, 17 bp, Homo sapiens
gcccaccttggctcaag

SEQ ID NO: 4900155 - DNA, 15 bp, Homo sapiens
gcccacgctggagtg

SEQ ID NO: 4900156 - DNA, 19 bp, Homo sapiens
gcccacggctaagaggctg

SEQ ID NO: 4900157 - DNA, 21 bp, Homo sapiens
gcccacggctaagaggctgct

SEQ ID NO: 4900158 - DNA, 15 bp, Homo sapiens
gcccagaacttccct

SEQ ID NO: 4900159 - DNA, 14 bp, Homo sapiens
gcccagagaacagc

SEQ ID NO: 4900160 - DNA, 12 bp, Homo sapiens
gcccagagactt

SEQ ID NO: 4900161 - DNA, 21 bp, Homo sapiens
gcccagagagggtggtgacct

SEQ ID NO: 4900162 - DNA, 17 bp, Homo sapiens
gcccagccaaaccctgt

SEQ ID NO: 4900163 - DNA, 12 bp, Homo sapiens
gcccagccccta

SEQ ID NO: 4900164 - DNA, 15 bp, Homo sapiens
gcccagcccctagaa

SEQ ID NO: 4900165 - DNA, 12 bp, Homo sapiens
gcccagccctcc

SEQ ID NO: 4900166 - DNA, 15 bp, Homo sapiens
gcccagccctgttct

SEQ ID NO: 4900167 - DNA, 22 bp, Homo sapiens
gcccaggaccatcttcccgaga

SEQ ID NO: 4900168 - DNA, 15 bp, Homo sapiens
gcccaggagagagaa

SEQ ID NO: 4900169 - DNA, 12 bp, Homo sapiens
gcccaggcaggt

SEQ ID NO: 4900170 - DNA, 14 bp, Homo sapiens
gcccaggcaggtct

SEQ ID NO: 4900171 - DNA, 15 bp, Homo sapiens
gcccaggcccctgcc

SEQ ID NO: 4900172 - DNA, 17 bp, Homo sapiens
gcccaggcccctgccac

SEQ ID NO: 4900173 - DNA, 21 bp, Homo sapiens
gcccaggcccctgccaccctg

SEQ ID NO: 4900174 - DNA, 22 bp, Homo sapiens
gcccaggccggggtggagcatg

SEQ ID NO: 4900175 - DNA, 23 bp, Homo sapiens
gcccaggccggggtggagcatgg

SEQ ID NO: 4900176 - DNA, 17 bp, Homo sapiens
gcccaggcctgcctgtt

SEQ ID NO: 4900177 - DNA, 12 bp, Homo sapiens
gcccaggcggga

SEQ ID NO: 4900178 - DNA, 22 bp, Homo sapiens
gcccaggcgggagcggtggccc

SEQ ID NO: 4900179 - DNA, 12 bp, Homo sapiens
gcccaggctcca

SEQ ID NO: 4900180 - DNA, 19 bp, Homo sapiens
gcccaggctggagtgcagt

SEQ ID NO: 4900181 - DNA, 23 bp, Homo sapiens
gcccagtcctctcccaagtccac

SEQ ID NO: 4900182 - DNA, 19 bp, Homo sapiens
gcccagtctggaatgcagt

SEQ ID NO: 4900183 - DNA, 20 bp, Homo sapiens
gcccagtctggaatgcagtg

SEQ ID NO: 4900184 - DNA, 19 bp, Homo sapiens
gcccagttgggtggatgcc

SEQ ID NO: 4900185 - DNA, 21 bp, Homo sapiens
gcccagttgggtggatgcctg

SEQ ID NO: 4900186 - DNA, 22 bp, Homo sapiens
gcccagttgggtggatgcctgg

SEQ ID NO: 4900187 - DNA, 20 bp, Homo sapiens
gcccatactcagcctgctgc

SEQ ID NO: 4900188 - DNA, 18 bp, Homo sapiens
gcccatagaaacatgaca

SEQ ID NO: 4900189 - DNA, 21 bp, Homo sapiens
gcccatagaaacatgacactg

SEQ ID NO: 4900190 - DNA, 18 bp, Homo sapiens
gcccatccctgcctggtc

SEQ ID NO: 4900191 - DNA, 13 bp, Homo sapiens
gcccatgcccacc

SEQ ID NO: 4900192 - DNA, 14 bp, Homo sapiens
gcccatgcccacct

SEQ ID NO: 4900193 - DNA, 19 bp, Homo sapiens
gcccatgcccacctgccca

SEQ ID NO: 4900194 - DNA, 14 bp, Homo sapiens
gcccatggccctgt

SEQ ID NO: 4900195 - DNA, 14 bp, Homo sapiens
gcccatgttctgcc

SEQ ID NO: 4900196 - DNA, 16 bp, Homo sapiens
gcccatgttctgcccc

SEQ ID NO: 4900197 - DNA, 20 bp, Homo sapiens
gcccatgttctgcccccagc

SEQ ID NO: 4900198 - DNA, 19 bp, Homo sapiens
gcccatttcaattctcaaa

SEQ ID NO: 4900199 - DNA, 20 bp, Homo sapiens
gccccaaataacttcagtcc

SEQ ID NO: 4900200 - DNA, 12 bp, Homo sapiens
gccccaaatata

SEQ ID NO: 4900201 - DNA, 15 bp, Homo sapiens
gccccaacctgctga

SEQ ID NO: 4900202 - DNA, 16 bp, Homo sapiens
gccccacacagctaca

SEQ ID NO: 4900203 - DNA, 11 bp, Homo sapiens
gccccacccag

SEQ ID NO: 4900204 - DNA, 12 bp, Homo sapiens
gccccactgatg

SEQ ID NO: 4900205 - DNA, 12 bp, Homo sapiens
gccccactgcca

SEQ ID NO: 4900206 - DNA, 12 bp, Homo sapiens
gccccagagctg

SEQ ID NO: 4900207 - DNA, 19 bp, Homo sapiens
gccccagcacctcagcctg

SEQ ID NO: 4900208 - DNA, 21 bp, Homo sapiens
gccccagcacctcagcctgca

SEQ ID NO: 4900209 - DNA, 19 bp, Homo sapiens
gccccagcactaacgtaaa

SEQ ID NO: 4900210 - DNA, 14 bp, Homo sapiens
gccccaggcctctg

SEQ ID NO: 4900211 - DNA, 12 bp, Homo sapiens
gccccagggcac

SEQ ID NO: 4900212 - DNA, 15 bp, Homo sapiens
gccccagggcaccct

SEQ ID NO: 4900213 - DNA, 18 bp, Homo sapiens
gccccagggctaccctcc

SEQ ID NO: 4900214 - DNA, 16 bp, Homo sapiens
gccccagggtcttccc

SEQ ID NO: 4900215 - DNA, 20 bp, Homo sapiens
gccccagggtcttccctacc

SEQ ID NO: 4900216 - DNA, 16 bp, Homo sapiens
gccccaggtagaaact

SEQ ID NO: 4900217 - DNA, 14 bp, Homo sapiens
gccccagtgcccac

SEQ ID NO: 4900218 - DNA, 16 bp, Homo sapiens
gccccagtgcccacag

SEQ ID NO: 4900219 - DNA, 17 bp, Homo sapiens
gccccagtgcccacagg

SEQ ID NO: 4900220 - DNA, 17 bp, Homo sapiens
gccccatgcctgtccag

SEQ ID NO: 4900221 - DNA, 14 bp, Homo sapiens
gccccattctgcct

SEQ ID NO: 4900222 - DNA, 20 bp, Homo sapiens
gccccattctgcctgcccag

SEQ ID NO: 4900223 - DNA, 21 bp, Homo sapiens
gccccattctgcctgcccagg

SEQ ID NO: 4900224 - DNA, 13 bp, Homo sapiens
gcccccagcccaa

SEQ ID NO: 4900225 - DNA, 14 bp, Homo sapiens
gcccccagcccaaa

SEQ ID NO: 4900226 - DNA, 23 bp, Homo sapiens
gcccccccttcccccttttttgt

SEQ ID NO: 4900227 - DNA, 19 bp, Homo sapiens
gccccctcctctagctgtg

SEQ ID NO: 4900228 - DNA, 15 bp, Homo sapiens
gccccctcctgaacc

SEQ ID NO: 4900229 - DNA, 16 bp, Homo sapiens
gccccctggcctctgt

SEQ ID NO: 4900230 - DNA, 17 bp, Homo sapiens
gccccctggtctctggt

SEQ ID NO: 4900231 - DNA, 13 bp, Homo sapiens
gccccgagctgtc

SEQ ID NO: 4900232 - DNA, 23 bp, Homo sapiens
gccccgaggccttctctgaagga

SEQ ID NO: 4900233 - DNA, 15 bp, Homo sapiens
gccccgcagacctcc

SEQ ID NO: 4900234 - DNA, 18 bp, Homo sapiens
gccccgcagacctcccca

SEQ ID NO: 4900235 - DNA, 16 bp, Homo sapiens
gccccgccctcttcct

SEQ ID NO: 4900236 - DNA, 17 bp, Homo sapiens
gccccgccctcttcctg

SEQ ID NO: 4900237 - DNA, 18 bp, Homo sapiens
gccccgccctcttcctga

SEQ ID NO: 4900238 - DNA, 22 bp, Homo sapiens
gccccgccctcttcctgacgaa

SEQ ID NO: 4900239 - DNA, 17 bp, Homo sapiens
gccccggatcagagcag

SEQ ID NO: 4900240 - DNA, 18 bp, Homo sapiens
gccccggatcagagcagg

SEQ ID NO: 4900241 - DNA, 23 bp, Homo sapiens
gccccggatcagagcaggacctc

SEQ ID NO: 4900242 - DNA, 16 bp, Homo sapiens
gccccggccacctctg

SEQ ID NO: 4900243 - DNA, 15 bp, Homo sapiens
gccccggccctgggc

SEQ ID NO: 4900244 - DNA, 21 bp, Homo sapiens
gccccggccctgggctcggag

SEQ ID NO: 4900245 - DNA, 18 bp, Homo sapiens
gccccggtcacctagcaa

SEQ ID NO: 4900246 - DNA, 19 bp, Homo sapiens
gcccctagaaacccaagct

SEQ ID NO: 4900247 - DNA, 18 bp, Homo sapiens
gcccctagcccaggagag

SEQ ID NO: 4900248 - DNA, 12 bp, Homo sapiens
gcccctccccca

SEQ ID NO: 4900249 - DNA, 23 bp, Homo sapiens
gcccctcccccaacccccacccc

SEQ ID NO: 4900250 - DNA, 16 bp, Homo sapiens
gcccctcccgcccctt

SEQ ID NO: 4900251 - DNA, 15 bp, Homo sapiens
gcccctctcaccaaa

SEQ ID NO: 4900252 - DNA, 23 bp, Homo sapiens
gcccctgcagcacggacaataaa

SEQ ID NO: 4900253 - DNA, 14 bp, Homo sapiens
gcccctgccaccct

SEQ ID NO: 4900254 - DNA, 15 bp, Homo sapiens
gcccctgccaccctg

SEQ ID NO: 4900255 - DNA, 15 bp, Homo sapiens
gcccctgcccggctg

SEQ ID NO: 4900256 - DNA, 14 bp, Homo sapiens
gcccctgcctgcca

SEQ ID NO: 4900257 - DNA, 16 bp, Homo sapiens
gcccctggggcctaga

SEQ ID NO: 4900258 - DNA, 12 bp, Homo sapiens
gccccttccccc

SEQ ID NO: 4900259 - DNA, 14 bp, Homo sapiens
gccccttcctttaa

SEQ ID NO: 4900260 - DNA, 12 bp, Homo sapiens
gcccgacagcct

SEQ ID NO: 4900261 - DNA, 15 bp, Homo sapiens
gcccgacagcctggc

SEQ ID NO: 4900262 - DNA, 16 bp, Homo sapiens
gcccgcacagcagcct

SEQ ID NO: 4900263 - DNA, 15 bp, Homo sapiens
gcccgccacacagac

SEQ ID NO: 4900264 - DNA, 14 bp, Homo sapiens
gcccgcccctgcag

SEQ ID NO: 4900265 - DNA, 19 bp, Homo sapiens
gcccggagattggacggcc

SEQ ID NO: 4900266 - DNA, 16 bp, Homo sapiens
gcccggatgctgcttc

SEQ ID NO: 4900267 - DNA, 18 bp, Homo sapiens
gcccggctaatttttgta

SEQ ID NO: 4900268 - DNA, 15 bp, Homo sapiens
gcccggctccaggct

SEQ ID NO: 4900269 - DNA, 18 bp, Homo sapiens
gcccggctccaggctcct

SEQ ID NO: 4900270 - DNA, 17 bp, Homo sapiens
gccctacagagctgtgg

SEQ ID NO: 4900271 - DNA, 17 bp, Homo sapiens
gccctactccctgcaga

SEQ ID NO: 4900272 - DNA, 16 bp, Homo sapiens
gccctagagcctgcct

SEQ ID NO: 4900273 - DNA, 17 bp, Homo sapiens
gccctagagcctgcctg

SEQ ID NO: 4900274 - DNA, 19 bp, Homo sapiens
gccctagcccagcgctctg

SEQ ID NO: 4900275 - DNA, 21 bp, Homo sapiens
gccctagcccagcgctctgcc

SEQ ID NO: 4900276 - DNA, 17 bp, Homo sapiens
gccctcagatgtccctt

SEQ ID NO: 4900277 - DNA, 21 bp, Homo sapiens
gccctccctgcccctcccttc

SEQ ID NO: 4900278 - DNA, 18 bp, Homo sapiens
gccctcctttctgtgccc

SEQ ID NO: 4900279 - DNA, 13 bp, Homo sapiens
gccctcgacactc

SEQ ID NO: 4900280 - DNA, 16 bp, Homo sapiens
gccctcgctgcttctg

SEQ ID NO: 4900281 - DNA, 20 bp, Homo sapiens
gccctctccccacccctacc

SEQ ID NO: 4900282 - DNA, 22 bp, Homo sapiens
gccctctccccacccctacccc

SEQ ID NO: 4900283 - DNA, 21 bp, Homo sapiens
gccctctcccttaccctggga

SEQ ID NO: 4900284 - DNA, 16 bp, Homo sapiens
gccctctccttcctta

SEQ ID NO: 4900285 - DNA, 22 bp, Homo sapiens
gccctgatgtgtcctcagggag

SEQ ID NO: 4900286 - DNA, 20 bp, Homo sapiens
gccctgccctctccttcctt

SEQ ID NO: 4900287 - DNA, 15 bp, Homo sapiens
gccctgccctgagga

SEQ ID NO: 4900288 - DNA, 15 bp, Homo sapiens
gccctgccctggcag

SEQ ID NO: 4900289 - DNA, 17 bp, Homo sapiens
gccctgctcctgcagca

SEQ ID NO: 4900290 - DNA, 23 bp, Homo sapiens
gccctgctgccgcctcccagcct

SEQ ID NO: 4900291 - DNA, 19 bp, Homo sapiens
gccctgctttgggctgccc

SEQ ID NO: 4900292 - DNA, 22 bp, Homo sapiens
gccctgctttgggctgccctgg

SEQ ID NO: 4900293 - DNA, 23 bp, Homo sapiens
gccctgctttgggctgccctggt

SEQ ID NO: 4900294 - DNA, 20 bp, Homo sapiens
gccctggaacatcctttgca

SEQ ID NO: 4900295 - DNA, 17 bp, Homo sapiens
gccctggcagggggcat

SEQ ID NO: 4900296 - DNA, 20 bp, Homo sapiens
gccctggctcccacaggccc

SEQ ID NO: 4900297 - DNA, 12 bp, Homo sapiens
gccctggctctg

SEQ ID NO: 4900298 - DNA, 15 bp, Homo sapiens
gccctggggctgggc

SEQ ID NO: 4900299 - DNA, 16 bp, Homo sapiens
gccctggggctgggcc

SEQ ID NO: 4900300 - DNA, 13 bp, Homo sapiens
gccctggtccagg

SEQ ID NO: 4900301 - DNA, 18 bp, Homo sapiens
gccctggtccagggaagc

SEQ ID NO: 4900302 - DNA, 21 bp, Homo sapiens
gccctggtgcgaatggacttt

SEQ ID NO: 4900303 - DNA, 21 bp, Homo sapiens
gccctggtgctgccacacttc

SEQ ID NO: 4900304 - DNA, 17 bp, Homo sapiens
gccctggtggcagtggg

SEQ ID NO: 4900305 - DNA, 20 bp, Homo sapiens
gccctggtggcagtgggagc

SEQ ID NO: 4900306 - DNA, 22 bp, Homo sapiens
gccctggtggcagtgggagctg

SEQ ID NO: 4900307 - DNA, 13 bp, Homo sapiens
gccctgtccctcc

SEQ ID NO: 4900308 - DNA, 20 bp, Homo sapiens
gccctgtccctcccacctct

SEQ ID NO: 4900309 - DNA, 21 bp, Homo sapiens
gccctgttctgggtgcagctg

SEQ ID NO: 4900310 - DNA, 18 bp, Homo sapiens
gcccttagtcccccaact

SEQ ID NO: 4900311 - DNA, 19 bp, Homo sapiens
gcccttcctctccactgcc

SEQ ID NO: 4900312 - DNA, 15 bp, Homo sapiens
gcccttggcttctgt

SEQ ID NO: 4900313 - DNA, 12 bp, Homo sapiens
gcccttgggcca

SEQ ID NO: 4900314 - DNA, 16 bp, Homo sapiens
gccctttctgtaccat

SEQ ID NO: 4900315 - DNA, 22 bp, Homo sapiens
gccctttctgtaccatttattt

SEQ ID NO: 4900316 - DNA, 12 bp, Homo sapiens
gccctttctgtg

SEQ ID NO: 4900317 - DNA, 18 bp, Homo sapiens
gccctttgaagcctcagc

SEQ ID NO: 4900318 - DNA, 12 bp, Homo sapiens
gccgaccagagg

SEQ ID NO: 4900319 - DNA, 22 bp, Homo sapiens
gccgactgcacagcggcccctg

SEQ ID NO: 4900320 - DNA, 21 bp, Homo sapiens
gccgagatcacgccactgcac

SEQ ID NO: 4900321 - DNA, 22 bp, Homo sapiens
gccgatatactctagatgaagt

SEQ ID NO: 4900322 - DNA, 17 bp, Homo sapiens
gccgccccctgcccccc

SEQ ID NO: 4900323 - DNA, 15 bp, Homo sapiens
gccgcctcccagcct

SEQ ID NO: 4900324 - DNA, 22 bp, Homo sapiens
gccgccttccttgaccttcctc

SEQ ID NO: 4900325 - DNA, 16 bp, Homo sapiens
gccggctgtgctcaga

SEQ ID NO: 4900326 - DNA, 20 bp, Homo sapiens
gccgggaacagacaacagaa

SEQ ID NO: 4900327 - DNA, 22 bp, Homo sapiens
gccgggcacattgagctgtgca

SEQ ID NO: 4900328 - DNA, 16 bp, Homo sapiens
gccggggacagaggcc

SEQ ID NO: 4900329 - DNA, 21 bp, Homo sapiens
gccggggacagaggcctgccc

SEQ ID NO: 4900330 - DNA, 12 bp, Homo sapiens
gccggtcatttt

SEQ ID NO: 4900331 - DNA, 16 bp, Homo sapiens
gccgtgcattagcaca

SEQ ID NO: 4900332 - DNA, 17 bp, Homo sapiens
gccgtgccttcagctct

SEQ ID NO: 4900333 - DNA, 19 bp, Homo sapiens
gccgtggcttcccgctcag

SEQ ID NO: 4900334 - DNA, 18 bp, Homo sapiens
gccgtgggggttgaggca

SEQ ID NO: 4900335 - DNA, 14 bp, Homo sapiens
gcctaagtattaaa

SEQ ID NO: 4900336 - DNA, 15 bp, Homo sapiens
gcctaataaacaatt

SEQ ID NO: 4900337 - DNA, 13 bp, Homo sapiens
gcctacctgctct

SEQ ID NO: 4900338 - DNA, 13 bp, Homo sapiens
gcctagaagctgg

SEQ ID NO: 4900339 - DNA, 17 bp, Homo sapiens
gcctagcaagctggcct

SEQ ID NO: 4900340 - DNA, 16 bp, Homo sapiens
gcctagcccaccctgc

SEQ ID NO: 4900341 - DNA, 23 bp, Homo sapiens
gcctagcccaccctgctgccttc

SEQ ID NO: 4900342 - DNA, 19 bp, Homo sapiens
gcctagctgcctagcaagc

SEQ ID NO: 4900343 - DNA, 15 bp, Homo sapiens
gcctaggaccactca

SEQ ID NO: 4900344 - DNA, 19 bp, Homo sapiens
gcctaggaccactcagccc

SEQ ID NO: 4900345 - DNA, 13 bp, Homo sapiens
gcctaggtgacag

SEQ ID NO: 4900346 - DNA, 23 bp, Homo sapiens
gcctatgcacatatggactctgc

SEQ ID NO: 4900347 - DNA, 16 bp, Homo sapiens
gcctatggcagaaaaa

SEQ ID NO: 4900348 - DNA, 19 bp, Homo sapiens
gcctcaacctcctgggcta

SEQ ID NO: 4900349 - DNA, 20 bp, Homo sapiens
gcctcaaggttttaggttct

SEQ ID NO: 4900350 - DNA, 21 bp, Homo sapiens
gcctcaaggttttaggttcta

SEQ ID NO: 4900351 - DNA, 19 bp, Homo sapiens
gcctcaagtgattctcctg

SEQ ID NO: 4900352 - DNA, 22 bp, Homo sapiens
gcctcaagtgattctcctgcct

SEQ ID NO: 4900353 - DNA, 16 bp, Homo sapiens
gcctcacctctaccca

SEQ ID NO: 4900354 - DNA, 23 bp, Homo sapiens
gcctcagaattgatcattttccc

SEQ ID NO: 4900355 - DNA, 21 bp, Homo sapiens
gcctcagcatcctggcacccg

SEQ ID NO: 4900356 - DNA, 21 bp, Homo sapiens
gcctcagtatatttaaactca

SEQ ID NO: 4900357 - DNA, 16 bp, Homo sapiens
gcctcagtcctcccct

SEQ ID NO: 4900358 - DNA, 18 bp, Homo sapiens
gcctcagtcctcccctca

SEQ ID NO: 4900359 - DNA, 24 bp, Homo sapiens
gcctcagtcctcccctcacagcct

SEQ ID NO: 4900360 - DNA, 12 bp, Homo sapiens
gcctcagtgcca

SEQ ID NO: 4900361 - DNA, 15 bp, Homo sapiens
gcctcagtgccacta

SEQ ID NO: 4900362 - DNA, 13 bp, Homo sapiens
gcctcatatttaa

SEQ ID NO: 4900363 - DNA, 22 bp, Homo sapiens
gcctcatatttaaagacaggga

SEQ ID NO: 4900364 - DNA, 17 bp, Homo sapiens
gcctccaagctccatct

SEQ ID NO: 4900365 - DNA, 22 bp, Homo sapiens
gcctccacagcgagggcagctg

SEQ ID NO: 4900366 - DNA, 17 bp, Homo sapiens
gcctccagaactcactg

SEQ ID NO: 4900367 - DNA, 22 bp, Homo sapiens
gcctccagaggggctcaggtca

SEQ ID NO: 4900368 - DNA, 18 bp, Homo sapiens
gcctccagcctgcccaag

SEQ ID NO: 4900369 - DNA, 11 bp, Homo sapiens
gcctccatctc

SEQ ID NO: 4900370 - DNA, 16 bp, Homo sapiens
gcctcccaaagtgctg

SEQ ID NO: 4900371 - DNA, 17 bp, Homo sapiens
gcctcccaaagtgctgg

SEQ ID NO: 4900372 - DNA, 19 bp, Homo sapiens
gcctcccaaagtgctggga

SEQ ID NO: 4900373 - DNA, 20 bp, Homo sapiens
gcctcccaaggagaacaaat

SEQ ID NO: 4900374 - DNA, 17 bp, Homo sapiens
gcctcccacccccatct

SEQ ID NO: 4900375 - DNA, 10 bp, Homo sapiens
gcctcccagc

SEQ ID NO: 4900376 - DNA, 18 bp, Homo sapiens
gcctcccgaatagctggg

SEQ ID NO: 4900377 - DNA, 21 bp, Homo sapiens
gcctcccgagtagctgggact

SEQ ID NO: 4900378 - DNA, 16 bp, Homo sapiens
gcctccctagccagca

SEQ ID NO: 4900379 - DNA, 22 bp, Homo sapiens
gcctccctctctcttctgctcc

SEQ ID NO: 4900380 - DNA, 18 bp, Homo sapiens
gcctcctcacccccagct

SEQ ID NO: 4900381 - DNA, 15 bp, Homo sapiens
gcctcctcgttcctt

SEQ ID NO: 4900382 - DNA, 17 bp, Homo sapiens
gcctcctcttcaccccg

SEQ ID NO: 4900383 - DNA, 20 bp, Homo sapiens
gcctcctcttcaccccggca

SEQ ID NO: 4900384 - DNA, 13 bp, Homo sapiens
gcctcctgtgggg

SEQ ID NO: 4900385 - DNA, 18 bp, Homo sapiens
gcctcctgtggggaaagg

SEQ ID NO: 4900386 - DNA, 19 bp, Homo sapiens
gcctcctgtgtactgtgtc

SEQ ID NO: 4900387 - DNA, 13 bp, Homo sapiens
gcctcgaactggc

SEQ ID NO: 4900388 - DNA, 16 bp, Homo sapiens
gcctcgaactggctgc

SEQ ID NO: 4900389 - DNA, 20 bp, Homo sapiens
gcctcgaactggctgcaaag

SEQ ID NO: 4900390 - DNA, 16 bp, Homo sapiens
gcctctccaggcacca

SEQ ID NO: 4900391 - DNA, 13 bp, Homo sapiens
gcctctcccaccc

SEQ ID NO: 4900392 - DNA, 13 bp, Homo sapiens
gcctctctagcac

SEQ ID NO: 4900393 - DNA, 13 bp, Homo sapiens
gcctctctccctc

SEQ ID NO: 4900394 - DNA, 14 bp, Homo sapiens
gcctctctccctct

SEQ ID NO: 4900395 - DNA, 15 bp, Homo sapiens
gcctctgacacacag

SEQ ID NO: 4900396 - DNA, 17 bp, Homo sapiens
gcctctgacacacagct

SEQ ID NO: 4900397 - DNA, 18 bp, Homo sapiens
gcctctgacacacagctc

SEQ ID NO: 4900398 - DNA, 14 bp, Homo sapiens
gcctctgacccctc

SEQ ID NO: 4900399 - DNA, 18 bp, Homo sapiens
gcctctgacccctcctca

SEQ ID NO: 4900400 - DNA, 19 bp, Homo sapiens
gcctctgacccctcctcac

SEQ ID NO: 4900401 - DNA, 17 bp, Homo sapiens
gcctctgatatgggact

SEQ ID NO: 4900402 - DNA, 23 bp, Homo sapiens
gcctctgatatgggactgagcct

SEQ ID NO: 4900403 - DNA, 18 bp, Homo sapiens
gcctctgccttagaggag

SEQ ID NO: 4900404 - DNA, 19 bp, Homo sapiens
gcctctgccttagaggagc

SEQ ID NO: 4900405 - DNA, 23 bp, Homo sapiens
gcctctggctagaggccagcccc

SEQ ID NO: 4900406 - DNA, 14 bp, Homo sapiens
gcctcttgggttca

SEQ ID NO: 4900407 - DNA, 15 bp, Homo sapiens
gcctgaagtcacaca

SEQ ID NO: 4900408 - DNA, 16 bp, Homo sapiens
gcctgaagtcacacag

SEQ ID NO: 4900409 - DNA, 20 bp, Homo sapiens
gcctgagagaattggctcaa

SEQ ID NO: 4900410 - DNA, 16 bp, Homo sapiens
gcctgagaggggaagc

SEQ ID NO: 4900411 - DNA, 18 bp, Homo sapiens
gcctgagtcagggcccag

SEQ ID NO: 4900412 - DNA, 17 bp, Homo sapiens
gcctgatctcttcctgt

SEQ ID NO: 4900413 - DNA, 19 bp, Homo sapiens
gcctgatgctccctcccct

SEQ ID NO: 4900414 - DNA, 11 bp, Homo sapiens
gcctgcacaca

SEQ ID NO: 4900415 - DNA, 23 bp, Homo sapiens
gcctgcatcccaggatgctgggt

SEQ ID NO: 4900416 - DNA, 14 bp, Homo sapiens
gcctgccatgtacc

SEQ ID NO: 4900417 - DNA, 17 bp, Homo sapiens
gcctgcccaagcccagg

SEQ ID NO: 4900418 - DNA, 11 bp, Homo sapiens
gcctgcccagg

SEQ ID NO: 4900419 - DNA, 12 bp, Homo sapiens
gcctgcccaggc

SEQ ID NO: 4900420 - DNA, 14 bp, Homo sapiens
gcctgcccaggccc

SEQ ID NO: 4900421 - DNA, 17 bp, Homo sapiens
gcctgcccaggcccctg

SEQ ID NO: 4900422 - DNA, 17 bp, Homo sapiens
gcctgccccaaacaaat

SEQ ID NO: 4900423 - DNA, 16 bp, Homo sapiens
gcctgcccccctcatc

SEQ ID NO: 4900424 - DNA, 17 bp, Homo sapiens
gcctgcccgcacagcag

SEQ ID NO: 4900425 - DNA, 19 bp, Homo sapiens
gcctgcccgcacagcagcc

SEQ ID NO: 4900426 - DNA, 14 bp, Homo sapiens
gcctgcctggcccc

SEQ ID NO: 4900427 - DNA, 17 bp, Homo sapiens
gcctgcctgttcccatt

SEQ ID NO: 4900428 - DNA, 13 bp, Homo sapiens
gcctgcgtcttcc

SEQ ID NO: 4900429 - DNA, 18 bp, Homo sapiens
gcctgctggtcacagcct

SEQ ID NO: 4900430 - DNA, 19 bp, Homo sapiens
gcctgctggtcacagcctc

SEQ ID NO: 4900431 - DNA, 22 bp, Homo sapiens
gcctgctggtcacagcctcctc

SEQ ID NO: 4900432 - DNA, 16 bp, Homo sapiens
gcctggacctgcctcc

SEQ ID NO: 4900433 - DNA, 18 bp, Homo sapiens
gcctggacctgcctcctg

SEQ ID NO: 4900434 - DNA, 23 bp, Homo sapiens
gcctggacctgcctcctgcctgc

SEQ ID NO: 4900435 - DNA, 15 bp, Homo sapiens
gcctggagacccacc

SEQ ID NO: 4900436 - DNA, 16 bp, Homo sapiens
gcctggatttctggtt

SEQ ID NO: 4900437 - DNA, 13 bp, Homo sapiens
gcctggcacacat

SEQ ID NO: 4900438 - DNA, 13 bp, Homo sapiens
gcctggcacagga

SEQ ID NO: 4900439 - DNA, 17 bp, Homo sapiens
gcctggcacaggactga

SEQ ID NO: 4900440 - DNA, 20 bp, Homo sapiens
gcctggcagggaggtcaggc

SEQ ID NO: 4900441 - DNA, 22 bp, Homo sapiens
gcctggcattcttgtacagtgt

SEQ ID NO: 4900442 - DNA, 14 bp, Homo sapiens
gcctggccagatgc

SEQ ID NO: 4900443 - DNA, 15 bp, Homo sapiens
gcctggccagatgca

SEQ ID NO: 4900444 - DNA, 23 bp, Homo sapiens
gcctggccaggcagatctgtgcc

SEQ ID NO: 4900445 - DNA, 12 bp, Homo sapiens
gcctggccctgc

SEQ ID NO: 4900446 - DNA, 19 bp, Homo sapiens
gcctggccctgccctgagg

SEQ ID NO: 4900447 - DNA, 16 bp, Homo sapiens
gcctggcctggcacac

SEQ ID NO: 4900448 - DNA, 17 bp, Homo sapiens
gcctggcctggccctgc

SEQ ID NO: 4900449 - DNA, 16 bp, Homo sapiens
gcctggctccgtccag

SEQ ID NO: 4900450 - DNA, 16 bp, Homo sapiens
gcctgggcaacagagc

SEQ ID NO: 4900451 - DNA, 19 bp, Homo sapiens
gcctgggcaacagagcaag

SEQ ID NO: 4900452 - DNA, 19 bp, Homo sapiens
gcctgggcagcatagcaag

SEQ ID NO: 4900453 - DNA, 20 bp, Homo sapiens
gcctgggcagccaggctgcc

SEQ ID NO: 4900454 - DNA, 18 bp, Homo sapiens
gcctggggcctgagagaa

SEQ ID NO: 4900455 - DNA, 18 bp, Homo sapiens
gcctggtcaggccctggt

SEQ ID NO: 4900456 - DNA, 13 bp, Homo sapiens
gcctggtccatgc

SEQ ID NO: 4900457 - DNA, 13 bp, Homo sapiens
gcctggtggcagc

SEQ ID NO: 4900458 - DNA, 14 bp, Homo sapiens
gcctgtagttagga

SEQ ID NO: 4900459 - DNA, 22 bp, Homo sapiens
gcctgtagttaggaaataaaac

SEQ ID NO: 4900460 - DNA, 15 bp, Homo sapiens
gcctgtatactttag

SEQ ID NO: 4900461 - DNA, 12 bp, Homo sapiens
gcctgtccagcc

SEQ ID NO: 4900462 - DNA, 15 bp, Homo sapiens
gcctgtctgagactc

SEQ ID NO: 4900463 - DNA, 23 bp, Homo sapiens
gcctgtctgagactcacaggaag

SEQ ID NO: 4900464 - DNA, 14 bp, Homo sapiens
gcctgtgctgtgac

SEQ ID NO: 4900465 - DNA, 18 bp, Homo sapiens
gcctgtggagctcagccc

SEQ ID NO: 4900466 - DNA, 22 bp, Homo sapiens
gcctgtggcatctttgccttgg

SEQ ID NO: 4900467 - DNA, 15 bp, Homo sapiens
gcctgttcagctcca

SEQ ID NO: 4900468 - DNA, 17 bp, Homo sapiens
gcctgttcagctccagc

SEQ ID NO: 4900469 - DNA, 19 bp, Homo sapiens
gcctgttcagctccagctc

SEQ ID NO: 4900470 - DNA, 20 bp, Homo sapiens
gcctgttcagctccagctca

SEQ ID NO: 4900471 - DNA, 13 bp, Homo sapiens
gcctgtttcttcc

SEQ ID NO: 4900472 - DNA, 16 bp, Homo sapiens
gccttaagctgatcct

SEQ ID NO: 4900473 - DNA, 18 bp, Homo sapiens
gccttaagctgatcctgc

SEQ ID NO: 4900474 - DNA, 23 bp, Homo sapiens
gccttaatacttttttattttgt

SEQ ID NO: 4900475 - DNA, 20 bp, Homo sapiens
gccttagaagtcacacagta

SEQ ID NO: 4900476 - DNA, 13 bp, Homo sapiens
gccttagaggagc

SEQ ID NO: 4900477 - DNA, 15 bp, Homo sapiens
gccttagtctcagtt

SEQ ID NO: 4900478 - DNA, 17 bp, Homo sapiens
gccttagtgggccaggg

SEQ ID NO: 4900479 - DNA, 17 bp, Homo sapiens
gccttcagaaccatcca

SEQ ID NO: 4900480 - DNA, 13 bp, Homo sapiens
gccttcagctcca

SEQ ID NO: 4900481 - DNA, 13 bp, Homo sapiens
gccttcagctcta

SEQ ID NO: 4900482 - DNA, 16 bp, Homo sapiens
gccttcagctctacag

SEQ ID NO: 4900483 - DNA, 14 bp, Homo sapiens
gccttccagctgct

SEQ ID NO: 4900484 - DNA, 15 bp, Homo sapiens
gccttccagctgctg

SEQ ID NO: 4900485 - DNA, 20 bp, Homo sapiens
gccttccgccccttcccttc

SEQ ID NO: 4900486 - DNA, 16 bp, Homo sapiens
gccttcctctctccag

SEQ ID NO: 4900487 - DNA, 17 bp, Homo sapiens
gccttcctctctccaga

SEQ ID NO: 4900488 - DNA, 18 bp, Homo sapiens
gccttcctctctccagat

SEQ ID NO: 4900489 - DNA, 18 bp, Homo sapiens
gccttccttgaccttcct

SEQ ID NO: 4900490 - DNA, 13 bp, Homo sapiens
gccttcctttctc

SEQ ID NO: 4900491 - DNA, 19 bp, Homo sapiens
gccttcctttctccaggac

SEQ ID NO: 4900492 - DNA, 20 bp, Homo sapiens
gccttcctttctccaggacc

SEQ ID NO: 4900493 - DNA, 18 bp, Homo sapiens
gccttcgatacaccgggc

SEQ ID NO: 4900494 - DNA, 22 bp, Homo sapiens
gccttcgatacaccgggcctgg

SEQ ID NO: 4900495 - DNA, 19 bp, Homo sapiens
gccttcgtgcccccccttc

SEQ ID NO: 4900496 - DNA, 16 bp, Homo sapiens
gccttctctgaaggac

SEQ ID NO: 4900497 - DNA, 18 bp, Homo sapiens
gccttctgacggccctgc

SEQ ID NO: 4900498 - DNA, 20 bp, Homo sapiens
gccttcttccatcccaggac

SEQ ID NO: 4900499 - DNA, 22 bp, Homo sapiens
gccttcttttgattatgttttt

SEQ ID NO: 4900500 - DNA, 16 bp, Homo sapiens
gccttgacatcagttc

SEQ ID NO: 4900501 - DNA, 18 bp, Homo sapiens
gccttgacatcagttcct

SEQ ID NO: 4900502 - DNA, 18 bp, Homo sapiens
gccttgcagaactgccat

SEQ ID NO: 4900503 - DNA, 20 bp, Homo sapiens
gccttgcagaactgccatta

SEQ ID NO: 4900504 - DNA, 15 bp, Homo sapiens
gccttggccggctgt

SEQ ID NO: 4900505 - DNA, 15 bp, Homo sapiens
gccttggctcagaca

SEQ ID NO: 4900506 - DNA, 14 bp, Homo sapiens
gccttgggctgctc

SEQ ID NO: 4900507 - DNA, 23 bp, Homo sapiens
gccttggggaggacaaaacttct

SEQ ID NO: 4900508 - DNA, 14 bp, Homo sapiens
gccttgtctcctac

SEQ ID NO: 4900509 - DNA, 19 bp, Homo sapiens
gcctttgagacagtttctt

SEQ ID NO: 4900510 - DNA, 20 bp, Homo sapiens
gcctttgagacagtttctta

SEQ ID NO: 4900511 - DNA, 15 bp, Homo sapiens
gcctttggctctgga

SEQ ID NO: 4900512 - DNA, 16 bp, Homo sapiens
gcctttggctctggag

SEQ ID NO: 4900513 - DNA, 14 bp, Homo sapiens
gccttttaacattt

SEQ ID NO: 4900514 - DNA, 20 bp, Homo sapiens
gccttttccctctttggctc

SEQ ID NO: 4900515 - DNA, 17 bp, Homo sapiens
gcctttttcattttcca

SEQ ID NO: 4900516 - DNA, 16 bp, Homo sapiens
gcgaagtagcttgctc

SEQ ID NO: 4900517 - DNA, 21 bp, Homo sapiens
gcgaatccaagctccctgccc

SEQ ID NO: 4900518 - DNA, 16 bp, Homo sapiens
gcgacatagcccatcc

SEQ ID NO: 4900519 - DNA, 21 bp, Homo sapiens
gcgacatagcccatccctgcc

SEQ ID NO: 4900520 - DNA, 14 bp, Homo sapiens
gcgaccgccccctc

SEQ ID NO: 4900521 - DNA, 23 bp, Homo sapiens
gcgaccttcctcatccaccccat

SEQ ID NO: 4900522 - DNA, 14 bp, Homo sapiens
gcgagagaggagcc

SEQ ID NO: 4900523 - DNA, 14 bp, Homo sapiens
gcgatatacagatg

SEQ ID NO: 4900524 - DNA, 19 bp, Homo sapiens
gcgcacacacacacataca

SEQ ID NO: 4900525 - DNA, 18 bp, Homo sapiens
gcgccactcgcttccccc

SEQ ID NO: 4900526 - DNA, 12 bp, Homo sapiens
gcgcccacctcc

SEQ ID NO: 4900527 - DNA, 15 bp, Homo sapiens
gcgcctgtgcacaca

SEQ ID NO: 4900528 - DNA, 22 bp, Homo sapiens
gcgccttgtctcctactcctga

SEQ ID NO: 4900529 - DNA, 18 bp, Homo sapiens
gcgcgcacacacacacat

SEQ ID NO: 4900530 - DNA, 15 bp, Homo sapiens
gcgcggccagccccg

SEQ ID NO: 4900531 - DNA, 21 bp, Homo sapiens
gcgcggccagccccggccctg

SEQ ID NO: 4900532 - DNA, 20 bp, Homo sapiens
gcgctctgcctcaccgcttc

SEQ ID NO: 4900533 - DNA, 18 bp, Homo sapiens
gcgctgtttttgttgtgt

SEQ ID NO: 4900534 - DNA, 21 bp, Homo sapiens
gcgctgtttttgttgtgtgtg

SEQ ID NO: 4900535 - DNA, 15 bp, Homo sapiens
gcggacagccacggc

SEQ ID NO: 4900536 - DNA, 17 bp, Homo sapiens
gcggactcctcctttct

SEQ ID NO: 4900537 - DNA, 14 bp, Homo sapiens
gcggaggctgtgtg

SEQ ID NO: 4900538 - DNA, 16 bp, Homo sapiens
gcggaggctgtgtgcc

SEQ ID NO: 4900539 - DNA, 18 bp, Homo sapiens
gcggattaatttgcatct

SEQ ID NO: 4900540 - DNA, 19 bp, Homo sapiens
gcggattaatttgcatctg

SEQ ID NO: 4900541 - DNA, 21 bp, Homo sapiens
gcggccaagataggaccttgg

SEQ ID NO: 4900542 - DNA, 11 bp, Homo sapiens
gcggccagccc

SEQ ID NO: 4900543 - DNA, 19 bp, Homo sapiens
gcggccagccccggccctg

SEQ ID NO: 4900544 - DNA, 16 bp, Homo sapiens
gcggcgaccgccctcc

SEQ ID NO: 4900545 - DNA, 18 bp, Homo sapiens
gcgggagcggtggccctg

SEQ ID NO: 4900546 - DNA, 13 bp, Homo sapiens
gcggggacagctc

SEQ ID NO: 4900547 - DNA, 17 bp, Homo sapiens
gcgggttccgcaggcag

SEQ ID NO: 4900548 - DNA, 19 bp, Homo sapiens
gcggtccacccaggagccc

SEQ ID NO: 4900549 - DNA, 22 bp, Homo sapiens
gcggtctcaggctggtgggagg

SEQ ID NO: 4900550 - DNA, 14 bp, Homo sapiens
gcggtggccctgtc

SEQ ID NO: 4900551 - DNA, 14 bp, Homo sapiens
gcggtgggggagga

SEQ ID NO: 4900552 - DNA, 14 bp, Homo sapiens
gcgtcagtcttttt

SEQ ID NO: 4900553 - DNA, 16 bp, Homo sapiens
gcgtccctagcagtga

SEQ ID NO: 4900554 - DNA, 11 bp, Homo sapiens
gcgtctcctgt

SEQ ID NO: 4900555 - DNA, 20 bp, Homo sapiens
gcgtctcctgtttttctggg

SEQ ID NO: 4900556 - DNA, 21 bp, Homo sapiens
gcgtctggaagtccaatgtgg

SEQ ID NO: 4900557 - DNA, 18 bp, Homo sapiens
gcgtcttccgcccctgcc

SEQ ID NO: 4900558 - DNA, 20 bp, Homo sapiens
gcgtgcacacaccagagccc

SEQ ID NO: 4900559 - DNA, 23 bp, Homo sapiens
gcgtgccagtcaagaagaaaaag

SEQ ID NO: 4900560 - DNA, 14 bp, Homo sapiens
gcgtgccctcgctg

SEQ ID NO: 4900561 - DNA, 17 bp, Homo sapiens
gcgtgccgtgtgagtgt

SEQ ID NO: 4900562 - DNA, 21 bp, Homo sapiens
gcgtgccgtgtgagtgtgaca

SEQ ID NO: 4900563 - DNA, 22 bp, Homo sapiens
gcgtgccgtgtgagtgtgacag

SEQ ID NO: 4900564 - DNA, 13 bp, Homo sapiens
gcgtggactctgc

SEQ ID NO: 4900565 - DNA, 13 bp, Homo sapiens
gcgtggtgccatc

SEQ ID NO: 4900566 - DNA, 17 bp, Homo sapiens
gcgttacaccctttctt

SEQ ID NO: 4900567 - DNA, 22 bp, Homo sapiens
gcgttggtccagagcggaggct

SEQ ID NO: 4900568 - DNA, 19 bp, Homo sapiens
gcgttgttgcatgtttgaa

SEQ ID NO: 4900569 - DNA, 23 bp, Homo sapiens
gcgttgttgcatgtttgaaatga

SEQ ID NO: 4900570 - DNA, 21 bp, Homo sapiens
gctaaagataattgctattta

SEQ ID NO: 4900571 - DNA, 19 bp, Homo sapiens
gctaaatggtcgcccagga

SEQ ID NO: 4900572 - DNA, 22 bp, Homo sapiens
gctaacccccttctactgagcc

SEQ ID NO: 4900573 - DNA, 22 bp, Homo sapiens
gctaaccttatcctgcattgtt

SEQ ID NO: 4900574 - DNA, 13 bp, Homo sapiens
gctaagaggctgc

SEQ ID NO: 4900575 - DNA, 14 bp, Homo sapiens
gctaagaggctgct

SEQ ID NO: 4900576 - DNA, 19 bp, Homo sapiens
gctaagctaggaatgaaat

SEQ ID NO: 4900577 - DNA, 19 bp, Homo sapiens
gctaagggaagacatttct

SEQ ID NO: 4900578 - DNA, 20 bp, Homo sapiens
gctaagggaagacatttctt

SEQ ID NO: 4900579 - DNA, 22 bp, Homo sapiens
gctaagggtgggtgctcagaat

SEQ ID NO: 4900580 - DNA, 15 bp, Homo sapiens
gctaaggttctaagg

SEQ ID NO: 4900581 - DNA, 17 bp, Homo sapiens
gctaaggttctaaggcc

SEQ ID NO: 4900582 - DNA, 21 bp, Homo sapiens
gctaataatgagctattaaaa

SEQ ID NO: 4900583 - DNA, 16 bp, Homo sapiens
gctaatcagcattctc

SEQ ID NO: 4900584 - DNA, 22 bp, Homo sapiens
gctaatcagcattctcactcct

SEQ ID NO: 4900585 - DNA, 15 bp, Homo sapiens
gctaatttaaagaga

SEQ ID NO: 4900586 - DNA, 16 bp, Homo sapiens
gctaatttaaagagac

SEQ ID NO: 4900587 - DNA, 22 bp, Homo sapiens
gctaattttctcaaaagcattt

SEQ ID NO: 4900588 - DNA, 22 bp, Homo sapiens
gctacagagccgagcaatattt

SEQ ID NO: 4900589 - DNA, 20 bp, Homo sapiens
gctacaggaagcaccccatg

SEQ ID NO: 4900590 - DNA, 22 bp, Homo sapiens
gctacaggaagcaccccatgcc

SEQ ID NO: 4900591 - DNA, 13 bp, Homo sapiens
gctacataaattg

SEQ ID NO: 4900592 - DNA, 15 bp, Homo sapiens
gctacccaaaagaga

SEQ ID NO: 4900593 - DNA, 16 bp, Homo sapiens
gctacccaaaagagaa

SEQ ID NO: 4900594 - DNA, 23 bp, Homo sapiens
gctacccaaaagagaaaaaaaat

SEQ ID NO: 4900595 - DNA, 17 bp, Homo sapiens
gctacccacttctaaat

SEQ ID NO: 4900596 - DNA, 19 bp, Homo sapiens
gctaccctttttctccagc

SEQ ID NO: 4900597 - DNA, 22 bp, Homo sapiens
gctaccctttttctccagctgg

SEQ ID NO: 4900598 - DNA, 21 bp, Homo sapiens
gctactaagttcacattagaa

SEQ ID NO: 4900599 - DNA, 16 bp, Homo sapiens
gctactataaagagaa

SEQ ID NO: 4900600 - DNA, 17 bp, Homo sapiens
gctactgatttttgtga

SEQ ID NO: 4900601 - DNA, 21 bp, Homo sapiens
gctactgtctcactgaaacat

SEQ ID NO: 4900602 - DNA, 21 bp, Homo sapiens
gctactgtgtgtgtgaatgaa

SEQ ID NO: 4900603 - DNA, 13 bp, Homo sapiens
gctacttaagaga

SEQ ID NO: 4900604 - DNA, 15 bp, Homo sapiens
gctacttggtttgtg

SEQ ID NO: 4900605 - DNA, 18 bp, Homo sapiens
gctactttggtttctgtc

SEQ ID NO: 4900606 - DNA, 22 bp, Homo sapiens
gctagaacttttttaaataaac

SEQ ID NO: 4900607 - DNA, 15 bp, Homo sapiens
gctagacacccattt

SEQ ID NO: 4900608 - DNA, 23 bp, Homo sapiens
gctagagcagcccaaatttttct

SEQ ID NO: 4900609 - DNA, 18 bp, Homo sapiens
gctagaggccagccccac

SEQ ID NO: 4900610 - DNA, 19 bp, Homo sapiens
gctagcagtaaaagatgaa

SEQ ID NO: 4900611 - DNA, 16 bp, Homo sapiens
gctagcttttaggaaa

SEQ ID NO: 4900612 - DNA, 11 bp, Homo sapiens
gctagtatttg

SEQ ID NO: 4900613 - DNA, 14 bp, Homo sapiens
gctagtatttgaat

SEQ ID NO: 4900614 - DNA, 18 bp, Homo sapiens
gctagtatttgaattaaa

SEQ ID NO: 4900615 - DNA, 20 bp, Homo sapiens
gctagtccggacccacctca

SEQ ID NO: 4900616 - DNA, 17 bp, Homo sapiens
gctagtgatgtttttat

SEQ ID NO: 4900617 - DNA, 15 bp, Homo sapiens
gctagtgttctgtct

SEQ ID NO: 4900618 - DNA, 21 bp, Homo sapiens
gctagttgggcttcctcatag

SEQ ID NO: 4900619 - DNA, 15 bp, Homo sapiens
gctatatatataaat

SEQ ID NO: 4900620 - DNA, 16 bp, Homo sapiens
gctatatatataaata

SEQ ID NO: 4900621 - DNA, 20 bp, Homo sapiens
gctatcctgccaaaatcatt

SEQ ID NO: 4900622 - DNA, 21 bp, Homo sapiens
gctatctggaggccttccagc

SEQ ID NO: 4900623 - DNA, 13 bp, Homo sapiens
gctatggacacag

SEQ ID NO: 4900624 - DNA, 18 bp, Homo sapiens
gctatggacacagggtga

SEQ ID NO: 4900625 - DNA, 14 bp, Homo sapiens
gctatgggagcccc

SEQ ID NO: 4900626 - DNA, 19 bp, Homo sapiens
gctatgggagccccagggt

SEQ ID NO: 4900627 - DNA, 21 bp, Homo sapiens
gctatgggagccccagggtct

SEQ ID NO: 4900628 - DNA, 16 bp, Homo sapiens
gctatgttactatttt

SEQ ID NO: 4900629 - DNA, 17 bp, Homo sapiens
gctatgttactattttc

SEQ ID NO: 4900630 - DNA, 19 bp, Homo sapiens
gctattagccaggatcatg

SEQ ID NO: 4900631 - DNA, 14 bp, Homo sapiens
gctattcctttccc

SEQ ID NO: 4900632 - DNA, 19 bp, Homo sapiens
gctattcctttcccttcct

SEQ ID NO: 4900633 - DNA, 15 bp, Homo sapiens
gctatttattttcct

SEQ ID NO: 4900634 - DNA, 20 bp, Homo sapiens
gctatttattttcctaaaga

SEQ ID NO: 4900635 - DNA, 14 bp, Homo sapiens
gctcaactttctgt

SEQ ID NO: 4900636 - DNA, 18 bp, Homo sapiens
gctcaagtcctcttttct

SEQ ID NO: 4900637 - DNA, 14 bp, Homo sapiens
gctcaataaagatt

SEQ ID NO: 4900638 - DNA, 16 bp, Homo sapiens
gctcaatcaagaaaat

SEQ ID NO: 4900639 - DNA, 17 bp, Homo sapiens
gctcaatggactggaag

SEQ ID NO: 4900640 - DNA, 22 bp, Homo sapiens
gctcacagaacccttggagcca

SEQ ID NO: 4900641 - DNA, 22 bp, Homo sapiens
gctcacagtacagcatgtgcct

SEQ ID NO: 4900642 - DNA, 12 bp, Homo sapiens
gctcaccagccc

SEQ ID NO: 4900643 - DNA, 15 bp, Homo sapiens
gctcaccagccccag

SEQ ID NO: 4900644 - DNA, 19 bp, Homo sapiens
gctcaccagccccagtgcc

SEQ ID NO: 4900645 - DNA, 15 bp, Homo sapiens
gctcacctagagcca

SEQ ID NO: 4900646 - DNA, 16 bp, Homo sapiens
gctcacctagagccag

SEQ ID NO: 4900647 - DNA, 18 bp, Homo sapiens
gctcacctagagccagac

SEQ ID NO: 4900648 - DNA, 19 bp, Homo sapiens
gctcacctagagccagacc

SEQ ID NO: 4900649 - DNA, 20 bp, Homo sapiens
gctcacctagagccagacca

SEQ ID NO: 4900650 - DNA, 17 bp, Homo sapiens
gctcagaacagtatctt

SEQ ID NO: 4900651 - DNA, 15 bp, Homo sapiens
gctcagaacccaggg

SEQ ID NO: 4900652 - DNA, 17 bp, Homo sapiens
gctcagaacccagggct

SEQ ID NO: 4900653 - DNA, 23 bp, Homo sapiens
gctcagaacccagggctctgccc

SEQ ID NO: 4900654 - DNA, 16 bp, Homo sapiens
gctcagacatgttttc

SEQ ID NO: 4900655 - DNA, 21 bp, Homo sapiens
gctcagacatgttttccgtga

SEQ ID NO: 4900656 - DNA, 18 bp, Homo sapiens
gctcagccccgagctgtc

SEQ ID NO: 4900657 - DNA, 18 bp, Homo sapiens
gctcagccctccctgccc

SEQ ID NO: 4900658 - DNA, 15 bp, Homo sapiens
gctcagcgccagcct

SEQ ID NO: 4900659 - DNA, 21 bp, Homo sapiens
gctcagcggggacagctcctt

SEQ ID NO: 4900660 - DNA, 23 bp, Homo sapiens
gctcagcggggacagctccttct

SEQ ID NO: 4900661 - DNA, 19 bp, Homo sapiens
gctcaggcgatccacctgt

SEQ ID NO: 4900662 - DNA, 17 bp, Homo sapiens
gctcaggctgcagctgg

SEQ ID NO: 4900663 - DNA, 22 bp, Homo sapiens
gctcaggctgcagctggacaga

SEQ ID NO: 4900664 - DNA, 23 bp, Homo sapiens
gctcaggctgcagctggacagag

SEQ ID NO: 4900665 - DNA, 16 bp, Homo sapiens
gctcaggggcagctca

SEQ ID NO: 4900666 - DNA, 17 bp, Homo sapiens
gctcaggtgtccctgca

SEQ ID NO: 4900667 - DNA, 19 bp, Homo sapiens
gctcaggtgtccctgcact

SEQ ID NO: 4900668 - DNA, 16 bp, Homo sapiens
gctcagtaatttgagg

SEQ ID NO: 4900669 - DNA, 21 bp, Homo sapiens
gctcagtaatttgaggacaac

SEQ ID NO: 4900670 - DNA, 12 bp, Homo sapiens
gctcagtcccat

SEQ ID NO: 4900671 - DNA, 23 bp, Homo sapiens
gctcagtcccatcagagagcgag

SEQ ID NO: 4900672 - DNA, 14 bp, Homo sapiens
gctcatattttgta

SEQ ID NO: 4900673 - DNA, 11 bp, Homo sapiens
gctcatttaag

SEQ ID NO: 4900674 - DNA, 15 bp, Homo sapiens
gctccaagattctag

SEQ ID NO: 4900675 - DNA, 19 bp, Homo sapiens
gctccaccaagaaagcagg

SEQ ID NO: 4900676 - DNA, 15 bp, Homo sapiens
gctccaccacatcct

SEQ ID NO: 4900677 - DNA, 18 bp, Homo sapiens
gctccaccagcatcacct

SEQ ID NO: 4900678 - DNA, 23 bp, Homo sapiens
gctccacccttggcctgtctcat

SEQ ID NO: 4900679 - DNA, 18 bp, Homo sapiens
gctccactgtcaccctcc

SEQ ID NO: 4900680 - DNA, 20 bp, Homo sapiens
gctccagaaatgtctaaatg

SEQ ID NO: 4900681 - DNA, 19 bp, Homo sapiens
gctccagaatttggaaatc

SEQ ID NO: 4900682 - DNA, 19 bp, Homo sapiens
gctccagcaacacagcctg

SEQ ID NO: 4900683 - DNA, 22 bp, Homo sapiens
gctccagcaacacagcctgggc

SEQ ID NO: 4900684 - DNA, 17 bp, Homo sapiens
gctccagctcaccagcc

SEQ ID NO: 4900685 - DNA, 15 bp, Homo sapiens
gctccaggcacccag

SEQ ID NO: 4900686 - DNA, 19 bp, Homo sapiens
gctccaggcctgcagcagg

SEQ ID NO: 4900687 - DNA, 12 bp, Homo sapiens
gctccaggctcc

SEQ ID NO: 4900688 - DNA, 22 bp, Homo sapiens
gctccagggaatccaagcctcc

SEQ ID NO: 4900689 - DNA, 18 bp, Homo sapiens
gctccaggtggctctgag

SEQ ID NO: 4900690 - DNA, 19 bp, Homo sapiens
gctccatgctcctcactgc

SEQ ID NO: 4900691 - DNA, 16 bp, Homo sapiens
gctccatgtgcctctt

SEQ ID NO: 4900692 - DNA, 14 bp, Homo sapiens
gctccccagccctg

SEQ ID NO: 4900693 - DNA, 19 bp, Homo sapiens
gctccccagccctggctct

SEQ ID NO: 4900694 - DNA, 22 bp, Homo sapiens
gctccccagccctggctctgca

SEQ ID NO: 4900695 - DNA, 14 bp, Homo sapiens
gctccccatgtgtc

SEQ ID NO: 4900696 - DNA, 23 bp, Homo sapiens
gctccctcccctgccctggtcca

SEQ ID NO: 4900697 - DNA, 14 bp, Homo sapiens
gctccctgaagcca

SEQ ID NO: 4900698 - DNA, 15 bp, Homo sapiens
gctccctgccccaaa

SEQ ID NO: 4900699 - DNA, 13 bp, Homo sapiens
gctcccttcagcc

SEQ ID NO: 4900700 - DNA, 22 bp, Homo sapiens
gctccgctgctccttggcttac

SEQ ID NO: 4900701 - DNA, 18 bp, Homo sapiens
gctccgctttctacccag

SEQ ID NO: 4900702 - DNA, 16 bp, Homo sapiens
gctcctcactgcccgc

SEQ ID NO: 4900703 - DNA, 19 bp, Homo sapiens
gctcctcatggtgggttca

SEQ ID NO: 4900704 - DNA, 23 bp, Homo sapiens
gctcctcccagcttgtaggagct

SEQ ID NO: 4900705 - DNA, 19 bp, Homo sapiens
gctcctcccggtgcccaag

SEQ ID NO: 4900706 - DNA, 16 bp, Homo sapiens
gctcctctccccagca

SEQ ID NO: 4900707 - DNA, 22 bp, Homo sapiens
gctcctgaggggcatctgcccc

SEQ ID NO: 4900708 - DNA, 23 bp, Homo sapiens
gctcctgaggggcatctgcccct

SEQ ID NO: 4900709 - DNA, 23 bp, Homo sapiens
gctcctgcaggccacagccacct

SEQ ID NO: 4900710 - DNA, 15 bp, Homo sapiens
gctcctgtcctccca

SEQ ID NO: 4900711 - DNA, 13 bp, Homo sapiens
gctcctgtgtctt

SEQ ID NO: 4900712 - DNA, 13 bp, Homo sapiens
gctccttctgtcc

SEQ ID NO: 4900713 - DNA, 17 bp, Homo sapiens
gctcgagcagtcctgcc

SEQ ID NO: 4900714 - DNA, 20 bp, Homo sapiens
gctcgagcagtcctgcctca

SEQ ID NO: 4900715 - DNA, 16 bp, Homo sapiens
gctcgccctcctttct

SEQ ID NO: 4900716 - DNA, 17 bp, Homo sapiens
gctcggaggctgccccc

SEQ ID NO: 4900717 - DNA, 12 bp, Homo sapiens
gctctaataaaa

SEQ ID NO: 4900718 - DNA, 24 bp, Homo sapiens
gctctagggttgctggagcctgag

SEQ ID NO: 4900719 - DNA, 18 bp, Homo sapiens
gctctcagctcagcgcca

SEQ ID NO: 4900720 - DNA, 16 bp, Homo sapiens
gctctcccctgccctg

SEQ ID NO: 4900721 - DNA, 19 bp, Homo sapiens
gctctcctcttgccactgc

SEQ ID NO: 4900722 - DNA, 11 bp, Homo sapiens
gctctctgtat

SEQ ID NO: 4900723 - DNA, 19 bp, Homo sapiens
gctctcttcctgcccctct

SEQ ID NO: 4900724 - DNA, 23 bp, Homo sapiens
gctctcttcctgcccctctttct

SEQ ID NO: 4900725 - DNA, 18 bp, Homo sapiens
gctctcttttctgtactt

SEQ ID NO: 4900726 - DNA, 19 bp, Homo sapiens
gctctcttttctgtacttc

SEQ ID NO: 4900727 - DNA, 16 bp, Homo sapiens
gctctgacagaaagca

SEQ ID NO: 4900728 - DNA, 15 bp, Homo sapiens
gctctgacccagtga

SEQ ID NO: 4900729 - DNA, 17 bp, Homo sapiens
gctctgacccagtgaga

SEQ ID NO: 4900730 - DNA, 14 bp, Homo sapiens
gctctgagaagagg

SEQ ID NO: 4900731 - DNA, 22 bp, Homo sapiens
gctctgagaagaggagccctca

SEQ ID NO: 4900732 - DNA, 13 bp, Homo sapiens
gctctgagagtct

SEQ ID NO: 4900733 - DNA, 21 bp, Homo sapiens
gctctgatcatccactgtgcc

SEQ ID NO: 4900734 - DNA, 15 bp, Homo sapiens
gctctgcaaaaggag

SEQ ID NO: 4900735 - DNA, 17 bp, Homo sapiens
gctctgcaattcccctc

SEQ ID NO: 4900736 - DNA, 23 bp, Homo sapiens
gctctgcaattcccctctgctgc

SEQ ID NO: 4900737 - DNA, 12 bp, Homo sapiens
gctctgccccag

SEQ ID NO: 4900738 - DNA, 19 bp, Homo sapiens
gctctgctcctctccccag

SEQ ID NO: 4900739 - DNA, 21 bp, Homo sapiens
gctctgctcctctccccagca

SEQ ID NO: 4900740 - DNA, 19 bp, Homo sapiens
gctctgctgacagacacag

SEQ ID NO: 4900741 - DNA, 20 bp, Homo sapiens
gctctgctgacagacacagg

SEQ ID NO: 4900742 - DNA, 21 bp, Homo sapiens
gctctggacaggcatgttctc

SEQ ID NO: 4900743 - DNA, 14 bp, Homo sapiens
gctctggagacagc

SEQ ID NO: 4900744 - DNA, 20 bp, Homo sapiens
gctctggagacagccccaga

SEQ ID NO: 4900745 - DNA, 13 bp, Homo sapiens
gctctggagagaa

SEQ ID NO: 4900746 - DNA, 14 bp, Homo sapiens
gctctggagagaaa

SEQ ID NO: 4900747 - DNA, 24 bp, Homo sapiens
gctctgtggatgccagggccgacc

SEQ ID NO: 4900748 - DNA, 16 bp, Homo sapiens
gctctgtgttgccatg

SEQ ID NO: 4900749 - DNA, 13 bp, Homo sapiens
gctcttaaatgta

SEQ ID NO: 4900750 - DNA, 16 bp, Homo sapiens
gctcttctccaggctg

SEQ ID NO: 4900751 - DNA, 13 bp, Homo sapiens
gctcttctccttt

SEQ ID NO: 4900752 - DNA, 23 bp, Homo sapiens
gctcttctcctttcacaaccttc

SEQ ID NO: 4900753 - DNA, 23 bp, Homo sapiens
gctcttgatacccccctctgtct

SEQ ID NO: 4900754 - DNA, 14 bp, Homo sapiens
gctcttgtcccacg

SEQ ID NO: 4900755 - DNA, 23 bp, Homo sapiens
gctcttgtcctcagtccatttat

SEQ ID NO: 4900756 - DNA, 22 bp, Homo sapiens
gctcttgtgctggatggagccc

SEQ ID NO: 4900757 - DNA, 22 bp, Homo sapiens
gctcttttttactcattgaaat

SEQ ID NO: 4900758 - DNA, 23 bp, Homo sapiens
gctcttttttactcattgaaatg

SEQ ID NO: 4900759 - DNA, 23 bp, Homo sapiens
gctgaaaaccatctggcctggcc

SEQ ID NO: 4900760 - DNA, 20 bp, Homo sapiens
gctgaaaacctaagtccttt

SEQ ID NO: 4900761 - DNA, 13 bp, Homo sapiens
gctgacagacaca

SEQ ID NO: 4900762 - DNA, 18 bp, Homo sapiens
gctgacagacacaggccc

SEQ ID NO: 4900763 - DNA, 16 bp, Homo sapiens
gctgaccaattgtgct

SEQ ID NO: 4900764 - DNA, 21 bp, Homo sapiens
gctgaccaattgtgctgccat

SEQ ID NO: 4900765 - DNA, 15 bp, Homo sapiens
gctgacctgcctctc

SEQ ID NO: 4900766 - DNA, 20 bp, Homo sapiens
gctgactaaatttggggaca

SEQ ID NO: 4900767 - DNA, 15 bp, Homo sapiens
gctgactagaagggc

SEQ ID NO: 4900768 - DNA, 18 bp, Homo sapiens
gctgactgtactcctccc

SEQ ID NO: 4900769 - DNA, 14 bp, Homo sapiens
gctgagaactcctg

SEQ ID NO: 4900770 - DNA, 22 bp, Homo sapiens
gctgagtgggagaaggcagtga

SEQ ID NO: 4900771 - DNA, 20 bp, Homo sapiens
gctgagttttctctttgtgg

SEQ ID NO: 4900772 - DNA, 18 bp, Homo sapiens
gctgatacataactaaat

SEQ ID NO: 4900773 - DNA, 22 bp, Homo sapiens
gctgcaaagggtatcaggtgct

SEQ ID NO: 4900774 - DNA, 23 bp, Homo sapiens
gctgcaaagggtatcaggtgctg

SEQ ID NO: 4900775 - DNA, 13 bp, Homo sapiens
gctgcaccagagc

SEQ ID NO: 4900776 - DNA, 14 bp, Homo sapiens
gctgcaccagagca

SEQ ID NO: 4900777 - DNA, 14 bp, Homo sapiens
gctgcagctggaca

SEQ ID NO: 4900778 - DNA, 15 bp, Homo sapiens
gctgcagctggacag

SEQ ID NO: 4900779 - DNA, 17 bp, Homo sapiens
gctgcagctggacagag

SEQ ID NO: 4900780 - DNA, 10 bp, Homo sapiens
gctgcagctt

SEQ ID NO: 4900781 - DNA, 12 bp, Homo sapiens
gctgcagcttcc

SEQ ID NO: 4900782 - DNA, 13 bp, Homo sapiens
gctgcagcttcct

SEQ ID NO: 4900783 - DNA, 14 bp, Homo sapiens
gctgcagcttcctg

SEQ ID NO: 4900784 - DNA, 13 bp, Homo sapiens
gctgcagcttggg

SEQ ID NO: 4900785 - DNA, 16 bp, Homo sapiens
gctgcaggaatcaaaa

SEQ ID NO: 4900786 - DNA, 11 bp, Homo sapiens
gctgcaggggc

SEQ ID NO: 4900787 - DNA, 12 bp, Homo sapiens
gctgcaggggct

SEQ ID NO: 4900788 - DNA, 21 bp, Homo sapiens
gctgcaggggctctggagaga

SEQ ID NO: 4900789 - DNA, 23 bp, Homo sapiens
gctgcagtccgtgtggatccaat

SEQ ID NO: 4900790 - DNA, 14 bp, Homo sapiens
gctgcatccagagg

SEQ ID NO: 4900791 - DNA, 23 bp, Homo sapiens
gctgcatcttatagcactttgaa

SEQ ID NO: 4900792 - DNA, 15 bp, Homo sapiens
gctgcattagaaaaa

SEQ ID NO: 4900793 - DNA, 17 bp, Homo sapiens
gctgccaaggccagagt

SEQ ID NO: 4900794 - DNA, 18 bp, Homo sapiens
gctgccaaggccagagtg

SEQ ID NO: 4900795 - DNA, 23 bp, Homo sapiens
gctgccaaggccagagtggcctg

SEQ ID NO: 4900796 - DNA, 17 bp, Homo sapiens
gctgccacacttcaggc

SEQ ID NO: 4900797 - DNA, 22 bp, Homo sapiens
gctgccacacttcaggctcttc

SEQ ID NO: 4900798 - DNA, 18 bp, Homo sapiens
gctgccatttgatttttc

SEQ ID NO: 4900799 - DNA, 17 bp, Homo sapiens
gctgccccaacctgctg

SEQ ID NO: 4900800 - DNA, 18 bp, Homo sapiens
gctgcccccggccccctg

SEQ ID NO: 4900801 - DNA, 23 bp, Homo sapiens
gctgcccccggccccctggtctc

SEQ ID NO: 4900802 - DNA, 16 bp, Homo sapiens
gctgcccctctcacca

SEQ ID NO: 4900803 - DNA, 18 bp, Homo sapiens
gctgcccctctcaccaaa

SEQ ID NO: 4900804 - DNA, 21 bp, Homo sapiens
gctgccctccttgtccaccca

SEQ ID NO: 4900805 - DNA, 22 bp, Homo sapiens
gctgccctccttgtccacccac

SEQ ID NO: 4900806 - DNA, 12 bp, Homo sapiens
gctgccctgaga

SEQ ID NO: 4900807 - DNA, 13 bp, Homo sapiens
gctgccctgagaa

SEQ ID NO: 4900808 - DNA, 18 bp, Homo sapiens
gctgccctgtaccccagc

SEQ ID NO: 4900809 - DNA, 18 bp, Homo sapiens
gctgcccttgggccaccc

SEQ ID NO: 4900810 - DNA, 20 bp, Homo sapiens
gctgcccttgggccacccct

SEQ ID NO: 4900811 - DNA, 15 bp, Homo sapiens
gctgccgggcctgat

SEQ ID NO: 4900812 - DNA, 19 bp, Homo sapiens
gctgccgggcctgatttgg

SEQ ID NO: 4900813 - DNA, 22 bp, Homo sapiens
gctgccgtgccgcctgcactcc

SEQ ID NO: 4900814 - DNA, 23 bp, Homo sapiens
gctgcctgcccgcacagcagcct

SEQ ID NO: 4900815 - DNA, 16 bp, Homo sapiens
gctgcctgtagttagg

SEQ ID NO: 4900816 - DNA, 19 bp, Homo sapiens
gctgcctgtagttaggaaa

SEQ ID NO: 4900817 - DNA, 17 bp, Homo sapiens
gctgcctgttcagctcc

SEQ ID NO: 4900818 - DNA, 20 bp, Homo sapiens
gctgccttagaacctttctt

SEQ ID NO: 4900819 - DNA, 22 bp, Homo sapiens
gctgccttctgacggccctgca

SEQ ID NO: 4900820 - DNA, 23 bp, Homo sapiens
gctgccttggctcagacatgttt

SEQ ID NO: 4900821 - DNA, 19 bp, Homo sapiens
gctgcgcccttaccttccc

SEQ ID NO: 4900822 - DNA, 14 bp, Homo sapiens
gctgcggtccaccc

SEQ ID NO: 4900823 - DNA, 16 bp, Homo sapiens
gctgcggtccacccag

SEQ ID NO: 4900824 - DNA, 18 bp, Homo sapiens
gctgcggtccacccagga

SEQ ID NO: 4900825 - DNA, 22 bp, Homo sapiens
gctgctaccgttgacttccagg

SEQ ID NO: 4900826 - DNA, 10 bp, Homo sapiens
gctgctagaa

SEQ ID NO: 4900827 - DNA, 14 bp, Homo sapiens
gctgctagaacttt

SEQ ID NO: 4900828 - DNA, 15 bp, Homo sapiens
gctgctagaactttt

SEQ ID NO: 4900829 - DNA, 17 bp, Homo sapiens
gctgctagaactttttt

SEQ ID NO: 4900830 - DNA, 22 bp, Homo sapiens
gctgctagaacttttttaaata

SEQ ID NO: 4900831 - DNA, 18 bp, Homo sapiens
gctgctatttattttcct

SEQ ID NO: 4900832 - DNA, 14 bp, Homo sapiens
gctgctccaggcct

SEQ ID NO: 4900833 - DNA, 19 bp, Homo sapiens
gctgctccaggcctgcagc

SEQ ID NO: 4900834 - DNA, 13 bp, Homo sapiens
gctgctcctcatg

SEQ ID NO: 4900835 - DNA, 22 bp, Homo sapiens
gctgctgaaaaccatctggcct

SEQ ID NO: 4900836 - DNA, 11 bp, Homo sapiens
gctgctgacca

SEQ ID NO: 4900837 - DNA, 12 bp, Homo sapiens
gctgctgcctgg

SEQ ID NO: 4900838 - DNA, 17 bp, Homo sapiens
gctgctgcctggccact

SEQ ID NO: 4900839 - DNA, 12 bp, Homo sapiens
gctgctgctctg

SEQ ID NO: 4900840 - DNA, 15 bp, Homo sapiens
gctgctgtccctccc

SEQ ID NO: 4900841 - DNA, 22 bp, Homo sapiens
gctgcttttgtctatgggactc

SEQ ID NO: 4900842 - DNA, 16 bp, Homo sapiens
gctggaccttgaactg

SEQ ID NO: 4900843 - DNA, 18 bp, Homo sapiens
gctggaccttgaactggg

SEQ ID NO: 4900844 - DNA, 22 bp, Homo sapiens
gctggaccttgaactgggtact

SEQ ID NO: 4900845 - DNA, 21 bp, Homo sapiens
gctggacggggactggggatg

SEQ ID NO: 4900846 - DNA, 16 bp, Homo sapiens
gctggagaagagagga

SEQ ID NO: 4900847 - DNA, 20 bp, Homo sapiens
gctggagaagagaggagagg

SEQ ID NO: 4900848 - DNA, 13 bp, Homo sapiens
gctggagcctgag

SEQ ID NO: 4900849 - DNA, 23 bp, Homo sapiens
gctggagggaggcgggggctgcc

SEQ ID NO: 4900850 - DNA, 23 bp, Homo sapiens
gctggaggtggggcgaggcaggc

SEQ ID NO: 4900851 - DNA, 18 bp, Homo sapiens
gctggagtgcagtgagcc

SEQ ID NO: 4900852 - DNA, 16 bp, Homo sapiens
gctggagtttcatgta

SEQ ID NO: 4900853 - DNA, 23 bp, Homo sapiens
gctggcagaaagggaacagaaag

SEQ ID NO: 4900854 - DNA, 16 bp, Homo sapiens
gctggcatttgcacct

SEQ ID NO: 4900855 - DNA, 13 bp, Homo sapiens
gctggccagcctg

SEQ ID NO: 4900856 - DNA, 16 bp, Homo sapiens
gctggccagcctgggg

SEQ ID NO: 4900857 - DNA, 21 bp, Homo sapiens
gctggccagcctggggcctgg

SEQ ID NO: 4900858 - DNA, 18 bp, Homo sapiens
gctggccccagggcaccc

SEQ ID NO: 4900859 - DNA, 20 bp, Homo sapiens
gctggccccagggcaccctg

SEQ ID NO: 4900860 - DNA, 19 bp, Homo sapiens
gctggccctggctcccaca

SEQ ID NO: 4900861 - DNA, 16 bp, Homo sapiens
gctggcctctaccaca

SEQ ID NO: 4900862 - DNA, 23 bp, Homo sapiens
gctggcctctggctctcatgggg

SEQ ID NO: 4900863 - DNA, 18 bp, Homo sapiens
gctggctcacagtacagc

SEQ ID NO: 4900864 - DNA, 13 bp, Homo sapiens
gctggctcttctg

SEQ ID NO: 4900865 - DNA, 19 bp, Homo sapiens
gctggctgttggctggggg

SEQ ID NO: 4900866 - DNA, 16 bp, Homo sapiens
gctgggagctctgcag

SEQ ID NO: 4900867 - DNA, 18 bp, Homo sapiens
gctgggattacaggtgtg

SEQ ID NO: 4900868 - DNA, 15 bp, Homo sapiens
gctgggcaaggaaaa

SEQ ID NO: 4900869 - DNA, 16 bp, Homo sapiens
gctgggcaaggaaaaa

SEQ ID NO: 4900870 - DNA, 17 bp, Homo sapiens
gctgggccatgtccaaa

SEQ ID NO: 4900871 - DNA, 21 bp, Homo sapiens
gctgggccccccagctcaggg

SEQ ID NO: 4900872 - DNA, 22 bp, Homo sapiens
gctgggcttcagtggcagctgc

SEQ ID NO: 4900873 - DNA, 16 bp, Homo sapiens
gctggggacctggtac

SEQ ID NO: 4900874 - DNA, 15 bp, Homo sapiens
gctggggcctcagac

SEQ ID NO: 4900875 - DNA, 23 bp, Homo sapiens
gctgggggcaggagggccctacc

SEQ ID NO: 4900876 - DNA, 21 bp, Homo sapiens
gctgggtaaactgtggatgat

SEQ ID NO: 4900877 - DNA, 17 bp, Homo sapiens
gctgggtggtaccctct

SEQ ID NO: 4900878 - DNA, 14 bp, Homo sapiens
gctggtaaactatt

SEQ ID NO: 4900879 - DNA, 15 bp, Homo sapiens
gctggtaaactattt

SEQ ID NO: 4900880 - DNA, 14 bp, Homo sapiens
gctggtcccactca

SEQ ID NO: 4900881 - DNA, 14 bp, Homo sapiens
gctggtgcccggag

SEQ ID NO: 4900882 - DNA, 12 bp, Homo sapiens
gctggtgggagg

SEQ ID NO: 4900883 - DNA, 13 bp, Homo sapiens
gctggtgggaggg

SEQ ID NO: 4900884 - DNA, 15 bp, Homo sapiens
gctggttcagggttg

SEQ ID NO: 4900885 - DNA, 13 bp, Homo sapiens
gctgtaaggctct

SEQ ID NO: 4900886 - DNA, 15 bp, Homo sapiens
gctgtaaggctctag

SEQ ID NO: 4900887 - DNA, 17 bp, Homo sapiens
gctgtaaggctctagat

SEQ ID NO: 4900888 - DNA, 12 bp, Homo sapiens
gctgtacatcta

SEQ ID NO: 4900889 - DNA, 23 bp, Homo sapiens
gctgtacatctattttggattgt

SEQ ID NO: 4900890 - DNA, 20 bp, Homo sapiens
gctgtagtagccctttctgt

SEQ ID NO: 4900891 - DNA, 17 bp, Homo sapiens
gctgtatcccatgagcc

SEQ ID NO: 4900892 - DNA, 23 bp, Homo sapiens
gctgtatcccatgagcctcagca

SEQ ID NO: 4900893 - DNA, 20 bp, Homo sapiens
gctgtcaaaacaagtttttc

SEQ ID NO: 4900894 - DNA, 18 bp, Homo sapiens
gctgtcaagttcctttgg

SEQ ID NO: 4900895 - DNA, 15 bp, Homo sapiens
gctgtccctccccct

SEQ ID NO: 4900896 - DNA, 16 bp, Homo sapiens
gctgtccctccccctt

SEQ ID NO: 4900897 - DNA, 15 bp, Homo sapiens
gctgtcctccctcca

SEQ ID NO: 4900898 - DNA, 13 bp, Homo sapiens
gctgtcttctgga

SEQ ID NO: 4900899 - DNA, 13 bp, Homo sapiens
gctgtgaacaggc

SEQ ID NO: 4900900 - DNA, 16 bp, Homo sapiens
gctgtgacttctccag

SEQ ID NO: 4900901 - DNA, 16 bp, Homo sapiens
gctgtgagcccctggt

SEQ ID NO: 4900902 - DNA, 13 bp, Homo sapiens
gctgtgagccttg

SEQ ID NO: 4900903 - DNA, 18 bp, Homo sapiens
gctgtgaggcccctggac

SEQ ID NO: 4900904 - DNA, 22 bp, Homo sapiens
gctgtgaggcccctggacaagc

SEQ ID NO: 4900905 - DNA, 13 bp, Homo sapiens
gctgtgcaacgcc

SEQ ID NO: 4900906 - DNA, 19 bp, Homo sapiens
gctgtgcaacgccgtgggc

SEQ ID NO: 4900907 - DNA, 15 bp, Homo sapiens
gctgtgcctctgcct

SEQ ID NO: 4900908 - DNA, 12 bp, Homo sapiens
gctgtgctcaga

SEQ ID NO: 4900909 - DNA, 15 bp, Homo sapiens
gctgtgctctggaca

SEQ ID NO: 4900910 - DNA, 15 bp, Homo sapiens
gctgtgtgcctgggg

SEQ ID NO: 4900911 - DNA, 18 bp, Homo sapiens
gctgtgttaaataaacct

SEQ ID NO: 4900912 - DNA, 19 bp, Homo sapiens
gctgtgttgggtagaatag

SEQ ID NO: 4900913 - DNA, 12 bp, Homo sapiens
gctgttaaactg

SEQ ID NO: 4900914 - DNA, 21 bp, Homo sapiens
gctgttaccgcctgtctcttt

SEQ ID NO: 4900915 - DNA, 16 bp, Homo sapiens
gctgttctgcactgaa

SEQ ID NO: 4900916 - DNA, 16 bp, Homo sapiens
gctgttggcagtgagt

SEQ ID NO: 4900917 - DNA, 20 bp, Homo sapiens
gctgttggctgggggcctca

SEQ ID NO: 4900918 - DNA, 22 bp, Homo sapiens
gctgttggctgggggcctcagt

SEQ ID NO: 4900919 - DNA, 12 bp, Homo sapiens
gctgttggtcat

SEQ ID NO: 4900920 - DNA, 12 bp, Homo sapiens
gctgttgtacat

SEQ ID NO: 4900921 - DNA, 14 bp, Homo sapiens
gctgtttatggcct

SEQ ID NO: 4900922 - DNA, 16 bp, Homo sapiens
gctgtttatggcctca

SEQ ID NO: 4900923 - DNA, 17 bp, Homo sapiens
gctgtttatgtttttat

SEQ ID NO: 4900924 - DNA, 22 bp, Homo sapiens
gcttaaaataaacagttgtgaa

SEQ ID NO: 4900925 - DNA, 20 bp, Homo sapiens
gcttaagaaatctagtattt

SEQ ID NO: 4900926 - DNA, 13 bp, Homo sapiens
gcttacctgacct

SEQ ID NO: 4900927 - DNA, 21 bp, Homo sapiens
gcttacctgacctcttgctgt

SEQ ID NO: 4900928 - DNA, 23 bp, Homo sapiens
gcttacctgacctcttgctgtct

SEQ ID NO: 4900929 - DNA, 13 bp, Homo sapiens
gcttactatttct

SEQ ID NO: 4900930 - DNA, 18 bp, Homo sapiens
gcttagagaatgttctcc

SEQ ID NO: 4900931 - DNA, 15 bp, Homo sapiens
gcttagtaaaattta

SEQ ID NO: 4900932 - DNA, 20 bp, Homo sapiens
gcttatattcaaccatggac

SEQ ID NO: 4900933 - DNA, 23 bp, Homo sapiens
gcttatattcaaccatggacttt

SEQ ID NO: 4900934 - DNA, 22 bp, Homo sapiens
gcttatgacatcacttgtacaa

SEQ ID NO: 4900935 - DNA, 15 bp, Homo sapiens
gcttattttaatgtg

SEQ ID NO: 4900936 - DNA, 21 bp, Homo sapiens
gcttcacagtagagccagctt

SEQ ID NO: 4900937 - DNA, 22 bp, Homo sapiens
gcttcacagtagagccagcttg

SEQ ID NO: 4900938 - DNA, 15 bp, Homo sapiens
gcttcaccagagcat

SEQ ID NO: 4900939 - DNA, 17 bp, Homo sapiens
gcttcactgtataaata

SEQ ID NO: 4900940 - DNA, 12 bp, Homo sapiens
gcttcagcctcc

SEQ ID NO: 4900941 - DNA, 21 bp, Homo sapiens
gcttcaggttatcgaaataac

SEQ ID NO: 4900942 - DNA, 22 bp, Homo sapiens
gcttcaggttatcgaaataaca

SEQ ID NO: 4900943 - DNA, 23 bp, Homo sapiens
gcttcaggttatcgaaataacaa

SEQ ID NO: 4900944 - DNA, 23 bp, Homo sapiens
gcttcagtacttgtgaaacacag

SEQ ID NO: 4900945 - DNA, 16 bp, Homo sapiens
gcttcagtggcagctg

SEQ ID NO: 4900946 - DNA, 18 bp, Homo sapiens
gcttcagtggcagctgct

SEQ ID NO: 4900947 - DNA, 13 bp, Homo sapiens
gcttcatctgtca

SEQ ID NO: 4900948 - DNA, 18 bp, Homo sapiens
gcttcattcaatattgac

SEQ ID NO: 4900949 - DNA, 22 bp, Homo sapiens
gcttcattcaatattgacattt

SEQ ID NO: 4900950 - DNA, 18 bp, Homo sapiens
gcttcatttcctgtgtct

SEQ ID NO: 4900951 - DNA, 22 bp, Homo sapiens
gcttccatcccaaccagtgcca

SEQ ID NO: 4900952 - DNA, 19 bp, Homo sapiens
gcttccatgattctattta

SEQ ID NO: 4900953 - DNA, 22 bp, Homo sapiens
gcttccattttcctacaggcag

SEQ ID NO: 4900954 - DNA, 17 bp, Homo sapiens
gcttcccacctccctgc

SEQ ID NO: 4900955 - DNA, 18 bp, Homo sapiens
gcttcccgctcagccctc

SEQ ID NO: 4900956 - DNA, 17 bp, Homo sapiens
gcttccggtagggaggc

SEQ ID NO: 4900957 - DNA, 22 bp, Homo sapiens
gcttcctacccacacctctgcc

SEQ ID NO: 4900958 - DNA, 23 bp, Homo sapiens
gcttcctacccacacctctgcca

SEQ ID NO: 4900959 - DNA, 21 bp, Homo sapiens
gcttcctcctccccaactgtg

SEQ ID NO: 4900960 - DNA, 11 bp, Homo sapiens
gcttcctcctg

SEQ ID NO: 4900961 - DNA, 16 bp, Homo sapiens
gcttctaataaattat

SEQ ID NO: 4900962 - DNA, 16 bp, Homo sapiens
gcttctcatcttgtga

SEQ ID NO: 4900963 - DNA, 17 bp, Homo sapiens
gcttctggaatttgttc

SEQ ID NO: 4900964 - DNA, 23 bp, Homo sapiens
gcttctggaatttgttcaagttt

SEQ ID NO: 4900965 - DNA, 18 bp, Homo sapiens
gcttctgtgatgagctga

SEQ ID NO: 4900966 - DNA, 13 bp, Homo sapiens
gcttcttaattaa

SEQ ID NO: 4900967 - DNA, 16 bp, Homo sapiens
gcttcttaattaattt

SEQ ID NO: 4900968 - DNA, 11 bp, Homo sapiens
gcttgaagctg

SEQ ID NO: 4900969 - DNA, 16 bp, Homo sapiens
gcttgactcaggattt

SEQ ID NO: 4900970 - DNA, 20 bp, Homo sapiens
gcttgagggttgggctggtg

SEQ ID NO: 4900971 - DNA, 13 bp, Homo sapiens
gcttgatgaagca

SEQ ID NO: 4900972 - DNA, 13 bp, Homo sapiens
gcttgctccctgt

SEQ ID NO: 4900973 - DNA, 19 bp, Homo sapiens
gcttggcgtggagcaggcg

SEQ ID NO: 4900974 - DNA, 20 bp, Homo sapiens
gcttggggccaccaaagctg

SEQ ID NO: 4900975 - DNA, 15 bp, Homo sapiens
gcttgtaaataccag

SEQ ID NO: 4900976 - DNA, 17 bp, Homo sapiens
gcttgtaaataccagga

SEQ ID NO: 4900977 - DNA, 19 bp, Homo sapiens
gcttgtaaatagctcaggt

SEQ ID NO: 4900978 - DNA, 17 bp, Homo sapiens
gcttgtacctctggctg

SEQ ID NO: 4900979 - DNA, 22 bp, Homo sapiens
gcttgtacctctggctgactaa

SEQ ID NO: 4900980 - DNA, 14 bp, Homo sapiens
gcttgtaggagctg

SEQ ID NO: 4900981 - DNA, 18 bp, Homo sapiens
gcttgtgaaaatgtgttc

SEQ ID NO: 4900982 - DNA, 13 bp, Homo sapiens
gcttgtgaacaga

SEQ ID NO: 4900983 - DNA, 13 bp, Homo sapiens
gctttaaacaaat

SEQ ID NO: 4900984 - DNA, 22 bp, Homo sapiens
gctttaaactcagggacagagc

SEQ ID NO: 4900985 - DNA, 18 bp, Homo sapiens
gctttaaagggcctgcct

SEQ ID NO: 4900986 - DNA, 16 bp, Homo sapiens
gctttacacacacaga

SEQ ID NO: 4900987 - DNA, 18 bp, Homo sapiens
gctttatatatggacatg

SEQ ID NO: 4900988 - DNA, 20 bp, Homo sapiens
gctttatgataatagattct

SEQ ID NO: 4900989 - DNA, 14 bp, Homo sapiens
gctttatgattttc

SEQ ID NO: 4900990 - DNA, 15 bp, Homo sapiens
gctttatgattttca

SEQ ID NO: 4900991 - DNA, 16 bp, Homo sapiens
gctttatgattttcat

SEQ ID NO: 4900992 - DNA, 12 bp, Homo sapiens
gctttatgttca

SEQ ID NO: 4900993 - DNA, 13 bp, Homo sapiens
gctttattcttca

SEQ ID NO: 4900994 - DNA, 11 bp, Homo sapiens
gctttcaagtg

SEQ ID NO: 4900995 - DNA, 15 bp, Homo sapiens
gctttcaagtgcctt

SEQ ID NO: 4900996 - DNA, 22 bp, Homo sapiens
gctttccttgtggcagaggatg

SEQ ID NO: 4900997 - DNA, 22 bp, Homo sapiens
gctttctacccagcgagccctg

SEQ ID NO: 4900998 - DNA, 14 bp, Homo sapiens
gctttgagaagcct

SEQ ID NO: 4900999 - DNA, 14 bp, Homo sapiens
gctttgatccctga

SEQ ID NO: 4901000 - DNA, 12 bp, Homo sapiens
gctttgattcat

SEQ ID NO: 4901001 - DNA, 15 bp, Homo sapiens
gctttgattcatagt

SEQ ID NO: 4901002 - DNA, 20 bp, Homo sapiens
gctttgattcatagtaactt

SEQ ID NO: 4901003 - DNA, 20 bp, Homo sapiens
gctttgcctggttttgtctt

SEQ ID NO: 4901004 - DNA, 22 bp, Homo sapiens
gctttgggaatgtttttagctg

SEQ ID NO: 4901005 - DNA, 15 bp, Homo sapiens
gctttgtgttgtaat

SEQ ID NO: 4901006 - DNA, 13 bp, Homo sapiens
gctttgtgtttgg

SEQ ID NO: 4901007 - DNA, 21 bp, Homo sapiens
gctttgtgtttggtttacatt

SEQ ID NO: 4901008 - DNA, 22 bp, Homo sapiens
gctttgtgtttggtttacattt

SEQ ID NO: 4901009 - DNA, 23 bp, Homo sapiens
gctttgtgtttggtttacattta

SEQ ID NO: 4901010 - DNA, 20 bp, Homo sapiens
gctttgtttggatgtaattt

SEQ ID NO: 4901011 - DNA, 17 bp, Homo sapiens
gcttttaaccatctgat

SEQ ID NO: 4901012 - DNA, 15 bp, Homo sapiens
gcttttattaaattt

SEQ ID NO: 4901013 - DNA, 17 bp, Homo sapiens
gcttttattaaatttgt

SEQ ID NO: 4901014 - DNA, 15 bp, Homo sapiens
gcttttattgtataa

SEQ ID NO: 4901015 - DNA, 16 bp, Homo sapiens
gcttttattttgaaaa

SEQ ID NO: 4901016 - DNA, 18 bp, Homo sapiens
gcttttcaaacaagaatg

SEQ ID NO: 4901017 - DNA, 22 bp, Homo sapiens
gcttttcactgctggctgcctt

SEQ ID NO: 4901018 - DNA, 14 bp, Homo sapiens
gcttttccctcttt

SEQ ID NO: 4901019 - DNA, 17 bp, Homo sapiens
gctttttatttctgcat

SEQ ID NO: 4901020 - DNA, 16 bp, Homo sapiens
gctttttcctcctgga

SEQ ID NO: 4901021 - DNA, 12 bp, Homo sapiens
gctttttgaaat

SEQ ID NO: 4901022 - DNA, 18 bp, Homo sapiens
gctttttggtgtatagaa

SEQ ID NO: 4901023 - DNA, 15 bp, Homo sapiens
gcttttttttttcca

SEQ ID NO: 4901024 - DNA, 16 bp, Homo sapiens
gcttttttttttccag

SEQ ID NO: 4901025 - DNA, 12 bp, Homo sapiens
ggaaaaatgttt

SEQ ID NO: 4901026 - DNA, 22 bp, Homo sapiens
ggaaaacagaacatcattagaa

SEQ ID NO: 4901027 - DNA, 20 bp, Homo sapiens
ggaaaactccaccttcccac

SEQ ID NO: 4901028 - DNA, 12 bp, Homo sapiens
ggaaaagaaaaa

SEQ ID NO: 4901029 - DNA, 23 bp, Homo sapiens
ggaaaagaaaaaaaaaagaagaa

SEQ ID NO: 4901030 - DNA, 22 bp, Homo sapiens
ggaaaagagcgcatcaggcctg

SEQ ID NO: 4901031 - DNA, 12 bp, Homo sapiens
ggaaaagggaag

SEQ ID NO: 4901032 - DNA, 17 bp, Homo sapiens
ggaaactcttatctcag

SEQ ID NO: 4901033 - DNA, 14 bp, Homo sapiens
ggaaagacactgcc

SEQ ID NO: 4901034 - DNA, 16 bp, Homo sapiens
ggaaagacactgcctg

SEQ ID NO: 4901035 - DNA, 23 bp, Homo sapiens
ggaaagctcagctactgattttt

SEQ ID NO: 4901036 - DNA, 21 bp, Homo sapiens
ggaaagtttacccatgaagat

SEQ ID NO: 4901037 - DNA, 18 bp, Homo sapiens
ggaaataaaacctttcaa

SEQ ID NO: 4901038 - DNA, 19 bp, Homo sapiens
ggaaataaaacctttcaaa

SEQ ID NO: 4901039 - DNA, 23 bp, Homo sapiens
ggaaatacccttcttttatgagc

SEQ ID NO: 4901040 - DNA, 21 bp, Homo sapiens
ggaacaaaaaaaccacaaagg

SEQ ID NO: 4901041 - DNA, 11 bp, Homo sapiens
ggaacagaagg

SEQ ID NO: 4901042 - DNA, 19 bp, Homo sapiens
ggaacagctatgggagccc

SEQ ID NO: 4901043 - DNA, 20 bp, Homo sapiens
ggaacagctatgggagcccc

SEQ ID NO: 4901044 - DNA, 18 bp, Homo sapiens
ggaacatttctgtaaata

SEQ ID NO: 4901045 - DNA, 19 bp, Homo sapiens
ggaacatttctgtaaatac

SEQ ID NO: 4901046 - DNA, 22 bp, Homo sapiens
ggaacatttctgtaaataccat

SEQ ID NO: 4901047 - DNA, 18 bp, Homo sapiens
ggaaccatgaagacagga

SEQ ID NO: 4901048 - DNA, 14 bp, Homo sapiens
ggaaccgctcacct

SEQ ID NO: 4901049 - DNA, 14 bp, Homo sapiens
ggaacctcccagag

SEQ ID NO: 4901050 - DNA, 11 bp, Homo sapiens
ggaacctgcca

SEQ ID NO: 4901051 - DNA, 19 bp, Homo sapiens
ggaaccttccttcctgctt

SEQ ID NO: 4901052 - DNA, 15 bp, Homo sapiens
ggaaccttgctgtcc

SEQ ID NO: 4901053 - DNA, 14 bp, Homo sapiens
ggaacgatgtgtct

SEQ ID NO: 4901054 - DNA, 19 bp, Homo sapiens
ggaactctatctgggcctg

SEQ ID NO: 4901055 - DNA, 23 bp, Homo sapiens
ggaactctatctgggcctgggct

SEQ ID NO: 4901056 - DNA, 11 bp, Homo sapiens
ggaactctgac

SEQ ID NO: 4901057 - DNA, 21 bp, Homo sapiens
ggaacttgagcgtgaatctgt

SEQ ID NO: 4901058 - DNA, 16 bp, Homo sapiens
ggaagaagcagagaga

SEQ ID NO: 4901059 - DNA, 13 bp, Homo sapiens
ggaagacatttct

SEQ ID NO: 4901060 - DNA, 13 bp, Homo sapiens
ggaagagaatcac

SEQ ID NO: 4901061 - DNA, 19 bp, Homo sapiens
ggaagagcagaacggagcc

SEQ ID NO: 4901062 - DNA, 14 bp, Homo sapiens
ggaagagtgtgtgt

SEQ ID NO: 4901063 - DNA, 16 bp, Homo sapiens
ggaagcattcagagag

SEQ ID NO: 4901064 - DNA, 21 bp, Homo sapiens
ggaagcggccctaagggagtg

SEQ ID NO: 4901065 - DNA, 14 bp, Homo sapiens
ggaagctccactgt

SEQ ID NO: 4901066 - DNA, 15 bp, Homo sapiens
ggaagctgcagcttg

SEQ ID NO: 4901067 - DNA, 16 bp, Homo sapiens
ggaagctgcagcttgg

SEQ ID NO: 4901068 - DNA, 15 bp, Homo sapiens
ggaaggagagcctgc

SEQ ID NO: 4901069 - DNA, 16 bp, Homo sapiens
ggaaggagagcctgct

SEQ ID NO: 4901070 - DNA, 20 bp, Homo sapiens
ggaaggagggtacagctggg

SEQ ID NO: 4901071 - DNA, 18 bp, Homo sapiens
ggaaggcagacagcaggc

SEQ ID NO: 4901072 - DNA, 22 bp, Homo sapiens
ggaaggcctcttggagacctta

SEQ ID NO: 4901073 - DNA, 12 bp, Homo sapiens
ggaaggcctgac

SEQ ID NO: 4901074 - DNA, 20 bp, Homo sapiens
ggaaggcctgacttctgctg

SEQ ID NO: 4901075 - DNA, 12 bp, Homo sapiens
ggaaggcctggg

SEQ ID NO: 4901076 - DNA, 13 bp, Homo sapiens
ggaaggcctgggt

SEQ ID NO: 4901077 - DNA, 14 bp, Homo sapiens
ggaaggcctgggtg

SEQ ID NO: 4901078 - DNA, 14 bp, Homo sapiens
ggaagggcaaaacc

SEQ ID NO: 4901079 - DNA, 20 bp, Homo sapiens
ggaagggggggctacattat

SEQ ID NO: 4901080 - DNA, 13 bp, Homo sapiens
ggaaggtctcatt

SEQ ID NO: 4901081 - DNA, 16 bp, Homo sapiens
ggaagtagtccttggc

SEQ ID NO: 4901082 - DNA, 13 bp, Homo sapiens
ggaataattattt

SEQ ID NO: 4901083 - DNA, 21 bp, Homo sapiens
ggaataattatttatttaata

SEQ ID NO: 4901084 - DNA, 12 bp, Homo sapiens
ggaatacttttt

SEQ ID NO: 4901085 - DNA, 16 bp, Homo sapiens
ggaatagaagcaaatt

SEQ ID NO: 4901086 - DNA, 21 bp, Homo sapiens
ggaatcatgtcaggcctgtgt

SEQ ID NO: 4901087 - DNA, 22 bp, Homo sapiens
ggaatctaatatccccaaatta

SEQ ID NO: 4901088 - DNA, 13 bp, Homo sapiens
ggaatgagcccag

SEQ ID NO: 4901089 - DNA, 14 bp, Homo sapiens
ggaatgctgtgtta

SEQ ID NO: 4901090 - DNA, 15 bp, Homo sapiens
ggaattgatttgcat

SEQ ID NO: 4901091 - DNA, 18 bp, Homo sapiens
ggaattgatttgcattga

SEQ ID NO: 4901092 - DNA, 19 bp, Homo sapiens
ggaattgatttgcattgaa

SEQ ID NO: 4901093 - DNA, 21 bp, Homo sapiens
ggaatttgttcaagttttggg

SEQ ID NO: 4901094 - DNA, 15 bp, Homo sapiens
ggacaagaggtacag

SEQ ID NO: 4901095 - DNA, 13 bp, Homo sapiens
ggacaagcagagg

SEQ ID NO: 4901096 - DNA, 19 bp, Homo sapiens
ggacaataaacctccgcca

SEQ ID NO: 4901097 - DNA, 20 bp, Homo sapiens
ggacacaaaactccgccccc

SEQ ID NO: 4901098 - DNA, 21 bp, Homo sapiens
ggacacaaaactccgccccca

SEQ ID NO: 4901099 - DNA, 12 bp, Homo sapiens
ggacacagctct

SEQ ID NO: 4901100 - DNA, 13 bp, Homo sapiens
ggacacagctctt

SEQ ID NO: 4901101 - DNA, 15 bp, Homo sapiens
ggacacagctcttct

SEQ ID NO: 4901102 - DNA, 20 bp, Homo sapiens
ggacaccacacccagcctca

SEQ ID NO: 4901103 - DNA, 21 bp, Homo sapiens
ggacaccacacccagcctcag

SEQ ID NO: 4901104 - DNA, 22 bp, Homo sapiens
ggacaccacacccagcctcagt

SEQ ID NO: 4901105 - DNA, 15 bp, Homo sapiens
ggacacctgccctgc

SEQ ID NO: 4901106 - DNA, 14 bp, Homo sapiens
ggacactcagacct

SEQ ID NO: 4901107 - DNA, 15 bp, Homo sapiens
ggacactcctagaga

SEQ ID NO: 4901108 - DNA, 16 bp, Homo sapiens
ggacacttaatactac

SEQ ID NO: 4901109 - DNA, 19 bp, Homo sapiens
ggacagaggggactctggg

SEQ ID NO: 4901110 - DNA, 16 bp, Homo sapiens
ggacagattcagtctt

SEQ ID NO: 4901111 - DNA, 18 bp, Homo sapiens
ggacagattcagtcttgc

SEQ ID NO: 4901112 - DNA, 20 bp, Homo sapiens
ggacagattcagtcttgcct

SEQ ID NO: 4901113 - DNA, 15 bp, Homo sapiens
ggacagctccttctg

SEQ ID NO: 4901114 - DNA, 16 bp, Homo sapiens
ggacagctccttctgt

SEQ ID NO: 4901115 - DNA, 17 bp, Homo sapiens
ggacagctccttctgtc

SEQ ID NO: 4901116 - DNA, 20 bp, Homo sapiens
ggacagctccttctgtccta

SEQ ID NO: 4901117 - DNA, 16 bp, Homo sapiens
ggacaggccgcagctc

SEQ ID NO: 4901118 - DNA, 16 bp, Homo sapiens
ggacaggcctcacctc

SEQ ID NO: 4901119 - DNA, 23 bp, Homo sapiens
ggacaggcctcacctctacccaa

SEQ ID NO: 4901120 - DNA, 12 bp, Homo sapiens
ggacagtcactg

SEQ ID NO: 4901121 - DNA, 16 bp, Homo sapiens
ggacagttcacaccct

SEQ ID NO: 4901122 - DNA, 17 bp, Homo sapiens
ggacagttcacaccctg

SEQ ID NO: 4901123 - DNA, 20 bp, Homo sapiens
ggacagttcacaccctgcaa

SEQ ID NO: 4901124 - DNA, 22 bp, Homo sapiens
ggacagtttatcatgaagcctg

SEQ ID NO: 4901125 - DNA, 12 bp, Homo sapiens
ggacatcagcaa

SEQ ID NO: 4901126 - DNA, 15 bp, Homo sapiens
ggacattatgtgtgc

SEQ ID NO: 4901127 - DNA, 16 bp, Homo sapiens
ggaccactcagcccct

SEQ ID NO: 4901128 - DNA, 21 bp, Homo sapiens
ggaccactgcatgagctttta

SEQ ID NO: 4901129 - DNA, 15 bp, Homo sapiens
ggaccaggactccct

SEQ ID NO: 4901130 - DNA, 19 bp, Homo sapiens
ggacccaatgtaggagctg

SEQ ID NO: 4901131 - DNA, 13 bp, Homo sapiens
ggacccaggctcc

SEQ ID NO: 4901132 - DNA, 17 bp, Homo sapiens
ggacccaggctccgccc

SEQ ID NO: 4901133 - DNA, 20 bp, Homo sapiens
ggaccgtggccctgccctct

SEQ ID NO: 4901134 - DNA, 13 bp, Homo sapiens
ggacctcccttcc

SEQ ID NO: 4901135 - DNA, 20 bp, Homo sapiens
ggacctcccttccgaccctc

SEQ ID NO: 4901136 - DNA, 20 bp, Homo sapiens
ggacctctactttccaggct

SEQ ID NO: 4901137 - DNA, 19 bp, Homo sapiens
ggacctgcctcctgcctgc

SEQ ID NO: 4901138 - DNA, 15 bp, Homo sapiens
ggacctggggcacag

SEQ ID NO: 4901139 - DNA, 16 bp, Homo sapiens
ggacctggggcacagt

SEQ ID NO: 4901140 - DNA, 22 bp, Homo sapiens
ggacctgtatttaagcaaatac

SEQ ID NO: 4901141 - DNA, 18 bp, Homo sapiens
ggaccttaggccttcctc

SEQ ID NO: 4901142 - DNA, 21 bp, Homo sapiens
ggaccttaggccttcctctct

SEQ ID NO: 4901143 - DNA, 15 bp, Homo sapiens
ggaccttgaactggg

SEQ ID NO: 4901144 - DNA, 13 bp, Homo sapiens
ggaccttttaaag

SEQ ID NO: 4901145 - DNA, 19 bp, Homo sapiens
ggacgctccgctgccgtgc

SEQ ID NO: 4901146 - DNA, 21 bp, Homo sapiens
ggacggcctgatgctccctcc

SEQ ID NO: 4901147 - DNA, 22 bp, Homo sapiens
ggacggcctgatgctccctccc

SEQ ID NO: 4901148 - DNA, 17 bp, Homo sapiens
ggacgtcagacttggct

SEQ ID NO: 4901149 - DNA, 21 bp, Homo sapiens
ggactaaatgcctagttttta

SEQ ID NO: 4901150 - DNA, 19 bp, Homo sapiens
ggactaagcctacctgctc

SEQ ID NO: 4901151 - DNA, 14 bp, Homo sapiens
ggactagcccctgt

SEQ ID NO: 4901152 - DNA, 18 bp, Homo sapiens
ggactcaatgcactgaca

SEQ ID NO: 4901153 - DNA, 13 bp, Homo sapiens
ggactcagccctg

SEQ ID NO: 4901154 - DNA, 15 bp, Homo sapiens
ggactcagccctgag

SEQ ID NO: 4901155 - DNA, 17 bp, Homo sapiens
ggactcagccctgaggt

SEQ ID NO: 4901156 - DNA, 20 bp, Homo sapiens
ggactccctcctcacctctg

SEQ ID NO: 4901157 - DNA, 15 bp, Homo sapiens
ggactcctcctttct

SEQ ID NO: 4901158 - DNA, 14 bp, Homo sapiens
ggactcgcttgtaa

SEQ ID NO: 4901159 - DNA, 20 bp, Homo sapiens
ggactctgcacatgtcttgt

SEQ ID NO: 4901160 - DNA, 21 bp, Homo sapiens
ggactctgcacatgtcttgta

SEQ ID NO: 4901161 - DNA, 12 bp, Homo sapiens
ggactgagcccc

SEQ ID NO: 4901162 - DNA, 21 bp, Homo sapiens
ggactgagggactctgaagcc

SEQ ID NO: 4901163 - DNA, 13 bp, Homo sapiens
ggactgcctctgc

SEQ ID NO: 4901164 - DNA, 15 bp, Homo sapiens
ggactgcctctgcca

SEQ ID NO: 4901165 - DNA, 22 bp, Homo sapiens
ggactggctagagtcctcactc

SEQ ID NO: 4901166 - DNA, 15 bp, Homo sapiens
ggacttagaaagcag

SEQ ID NO: 4901167 - DNA, 19 bp, Homo sapiens
ggacttattacaatttgtt

SEQ ID NO: 4901168 - DNA, 23 bp, Homo sapiens
ggacttcggaccgcttgtgggga

SEQ ID NO: 4901169 - DNA, 17 bp, Homo sapiens
ggacttggaagctccgc

SEQ ID NO: 4901170 - DNA, 22 bp, Homo sapiens
ggactttcaaaattaaatctgt

SEQ ID NO: 4901171 - DNA, 13 bp, Homo sapiens
ggagaagagagga

SEQ ID NO: 4901172 - DNA, 14 bp, Homo sapiens
ggagaagagaggag

SEQ ID NO: 4901173 - DNA, 17 bp, Homo sapiens
ggagaagggaagttgaa

SEQ ID NO: 4901174 - DNA, 15 bp, Homo sapiens
ggagacaagaaatcc

SEQ ID NO: 4901175 - DNA, 18 bp, Homo sapiens
ggagacaagaaatccctg

SEQ ID NO: 4901176 - DNA, 15 bp, Homo sapiens
ggagacagccccaga

SEQ ID NO: 4901177 - DNA, 22 bp, Homo sapiens
ggagacagccccagagcagggt

SEQ ID NO: 4901178 - DNA, 20 bp, Homo sapiens
ggagacccaccccacctgca

SEQ ID NO: 4901179 - DNA, 10 bp, Homo sapiens
ggagactaga

SEQ ID NO: 4901180 - DNA, 19 bp, Homo sapiens
ggagactagattgcctttg

SEQ ID NO: 4901181 - DNA, 18 bp, Homo sapiens
ggagactggggggcttga

SEQ ID NO: 4901182 - DNA, 18 bp, Homo sapiens
ggagagaaacaataaaga

SEQ ID NO: 4901183 - DNA, 18 bp, Homo sapiens
ggagagctggtgcccgga

SEQ ID NO: 4901184 - DNA, 14 bp, Homo sapiens
ggagaggagagagg

SEQ ID NO: 4901185 - DNA, 13 bp, Homo sapiens
ggagatggagttc

SEQ ID NO: 4901186 - DNA, 17 bp, Homo sapiens
ggagattggacggcctg

SEQ ID NO: 4901187 - DNA, 17 bp, Homo sapiens
ggagcacaggtcccacc

SEQ ID NO: 4901188 - DNA, 18 bp, Homo sapiens
ggagcacaggtcccacct

SEQ ID NO: 4901189 - DNA, 13 bp, Homo sapiens
ggagcaggaacaa

SEQ ID NO: 4901190 - DNA, 16 bp, Homo sapiens
ggagcaggagattgag

SEQ ID NO: 4901191 - DNA, 22 bp, Homo sapiens
ggagcaggagattgagaaggag

SEQ ID NO: 4901192 - DNA, 18 bp, Homo sapiens
ggagcaggcggtggggag

SEQ ID NO: 4901193 - DNA, 21 bp, Homo sapiens
ggagcaggcggtggggagaga

SEQ ID NO: 4901194 - DNA, 13 bp, Homo sapiens
ggagcagggaagg

SEQ ID NO: 4901195 - DNA, 16 bp, Homo sapiens
ggagcagtccatgcat

SEQ ID NO: 4901196 - DNA, 20 bp, Homo sapiens
ggagcatctcttgaggccag

SEQ ID NO: 4901197 - DNA, 21 bp, Homo sapiens
ggagcatctcttgaggccagg

SEQ ID NO: 4901198 - DNA, 16 bp, Homo sapiens
ggagcatgggcctggc

SEQ ID NO: 4901199 - DNA, 16 bp, Homo sapiens
ggagcccagccctccc

SEQ ID NO: 4901200 - DNA, 19 bp, Homo sapiens
ggagcccagccctccccat

SEQ ID NO: 4901201 - DNA, 20 bp, Homo sapiens
ggagcccatactcagcctgc

SEQ ID NO: 4901202 - DNA, 20 bp, Homo sapiens
ggagccccagggtcttccct

SEQ ID NO: 4901203 - DNA, 14 bp, Homo sapiens
ggagcctaggacca

SEQ ID NO: 4901204 - DNA, 20 bp, Homo sapiens
ggagcctgagtcagggccca

SEQ ID NO: 4901205 - DNA, 21 bp, Homo sapiens
ggagcctgagtcagggcccag

SEQ ID NO: 4901206 - DNA, 14 bp, Homo sapiens
ggagcctggcacag

SEQ ID NO: 4901207 - DNA, 19 bp, Homo sapiens
ggagcctttttaaaacaca

SEQ ID NO: 4901208 - DNA, 22 bp, Homo sapiens
ggagcggtggccctgtccctcc

SEQ ID NO: 4901209 - DNA, 16 bp, Homo sapiens
ggagcgtcagggttgg

SEQ ID NO: 4901210 - DNA, 15 bp, Homo sapiens
ggagctaaggctcta

SEQ ID NO: 4901211 - DNA, 20 bp, Homo sapiens
ggagctaaggctctatgagt

SEQ ID NO: 4901212 - DNA, 22 bp, Homo sapiens
ggagctatcaggaacagctatg

SEQ ID NO: 4901213 - DNA, 17 bp, Homo sapiens
ggagctcctctcctgga

SEQ ID NO: 4901214 - DNA, 15 bp, Homo sapiens
ggagctgctggcttg

SEQ ID NO: 4901215 - DNA, 23 bp, Homo sapiens
ggagctttgttttgggggtcagg

SEQ ID NO: 4901216 - DNA, 18 bp, Homo sapiens
ggaggacctggggcacag

SEQ ID NO: 4901217 - DNA, 19 bp, Homo sapiens
ggaggacctggggcacagt

SEQ ID NO: 4901218 - DNA, 13 bp, Homo sapiens
ggaggagaatgag

SEQ ID NO: 4901219 - DNA, 15 bp, Homo sapiens
ggaggagcacagttt

SEQ ID NO: 4901220 - DNA, 22 bp, Homo sapiens
ggaggagctttgttttgggggt

SEQ ID NO: 4901221 - DNA, 15 bp, Homo sapiens
ggaggagggttgtgc

SEQ ID NO: 4901222 - DNA, 17 bp, Homo sapiens
ggaggcaaagctggctc

SEQ ID NO: 4901223 - DNA, 15 bp, Homo sapiens
ggaggcatggccctg

SEQ ID NO: 4901224 - DNA, 14 bp, Homo sapiens
ggaggccccactga

SEQ ID NO: 4901225 - DNA, 16 bp, Homo sapiens
ggaggccctcctgtgc

SEQ ID NO: 4901226 - DNA, 23 bp, Homo sapiens
ggaggccctcctgtgctggggga

SEQ ID NO: 4901227 - DNA, 17 bp, Homo sapiens
ggaggccttccagctgc

SEQ ID NO: 4901228 - DNA, 18 bp, Homo sapiens
ggaggccttccagctgct

SEQ ID NO: 4901229 - DNA, 13 bp, Homo sapiens
ggaggcgcccttg

SEQ ID NO: 4901230 - DNA, 23 bp, Homo sapiens
ggaggcgcccttggcttctgtga

SEQ ID NO: 4901231 - DNA, 18 bp, Homo sapiens
ggaggcgtctcgggagag

SEQ ID NO: 4901232 - DNA, 20 bp, Homo sapiens
ggaggctcccgaggggaagg

SEQ ID NO: 4901233 - DNA, 14 bp, Homo sapiens
ggaggctgaggcag

SEQ ID NO: 4901234 - DNA, 17 bp, Homo sapiens
ggaggctgaggcaggag

SEQ ID NO: 4901235 - DNA, 12 bp, Homo sapiens
ggaggctgcccc

SEQ ID NO: 4901236 - DNA, 16 bp, Homo sapiens
ggagggccctacctga

SEQ ID NO: 4901237 - DNA, 13 bp, Homo sapiens
ggaggggaagctg

SEQ ID NO: 4901238 - DNA, 17 bp, Homo sapiens
ggaggggaagctgcagc

SEQ ID NO: 4901239 - DNA, 13 bp, Homo sapiens
ggaggggcctggc

SEQ ID NO: 4901240 - DNA, 21 bp, Homo sapiens
ggaggggcctggcagccgtgc

SEQ ID NO: 4901241 - DNA, 17 bp, Homo sapiens
ggaggggcgcccacctc

SEQ ID NO: 4901242 - DNA, 15 bp, Homo sapiens
ggaggggtgtggctc

SEQ ID NO: 4901243 - DNA, 16 bp, Homo sapiens
ggagggtacagctggg

SEQ ID NO: 4901244 - DNA, 18 bp, Homo sapiens
ggagggtacagctgggct

SEQ ID NO: 4901245 - DNA, 19 bp, Homo sapiens
ggaggtgggagcaggagat

SEQ ID NO: 4901246 - DNA, 12 bp, Homo sapiens
ggaggtgtgagg

SEQ ID NO: 4901247 - DNA, 23 bp, Homo sapiens
ggaggttctaaggcctaggattc

SEQ ID NO: 4901248 - DNA, 15 bp, Homo sapiens
ggaggttgggtgggc

SEQ ID NO: 4901249 - DNA, 14 bp, Homo sapiens
ggaggtttgtcggg

SEQ ID NO: 4901250 - DNA, 16 bp, Homo sapiens
ggagtccaggcacagg

SEQ ID NO: 4901251 - DNA, 17 bp, Homo sapiens
ggagtcccaaggaaagc

SEQ ID NO: 4901252 - DNA, 21 bp, Homo sapiens
ggagtcccaccttggctgcag

SEQ ID NO: 4901253 - DNA, 18 bp, Homo sapiens
ggagtctggagtgggcag

SEQ ID NO: 4901254 - DNA, 11 bp, Homo sapiens
ggagtgacaga

SEQ ID NO: 4901255 - DNA, 17 bp, Homo sapiens
ggagtgacagaggcagc

SEQ ID NO: 4901256 - DNA, 12 bp, Homo sapiens
ggagtgcagtgg

SEQ ID NO: 4901257 - DNA, 15 bp, Homo sapiens
ggagtggtgcagaca

SEQ ID NO: 4901258 - DNA, 20 bp, Homo sapiens
ggagttcgaggctgcagtca

SEQ ID NO: 4901259 - DNA, 19 bp, Homo sapiens
ggataaaataatgctgcaa

SEQ ID NO: 4901260 - DNA, 18 bp, Homo sapiens
ggataaaatgactactta

SEQ ID NO: 4901261 - DNA, 18 bp, Homo sapiens
ggatacaacctccctctt

SEQ ID NO: 4901262 - DNA, 16 bp, Homo sapiens
ggatactgcagggcca

SEQ ID NO: 4901263 - DNA, 18 bp, Homo sapiens
ggatagtatttttatcca

SEQ ID NO: 4901264 - DNA, 12 bp, Homo sapiens
ggatatttaagg

SEQ ID NO: 4901265 - DNA, 22 bp, Homo sapiens
ggatcaaaccccgaccacctgc

SEQ ID NO: 4901266 - DNA, 12 bp, Homo sapiens
ggatcagaatag

SEQ ID NO: 4901267 - DNA, 16 bp, Homo sapiens
ggatcagagcaggacc

SEQ ID NO: 4901268 - DNA, 18 bp, Homo sapiens
ggatcagagcaggacctc

SEQ ID NO: 4901269 - DNA, 22 bp, Homo sapiens
ggatcagagcaggacctccctt

SEQ ID NO: 4901270 - DNA, 19 bp, Homo sapiens
ggatcatggtgtaataaga

SEQ ID NO: 4901271 - DNA, 21 bp, Homo sapiens
ggatcatggtgtaataagaca

SEQ ID NO: 4901272 - DNA, 22 bp, Homo sapiens
ggatcccctctgtctacaaata

SEQ ID NO: 4901273 - DNA, 15 bp, Homo sapiens
ggatcggcctcctct

SEQ ID NO: 4901274 - DNA, 22 bp, Homo sapiens
ggatcttgaatgtggtctcagg

SEQ ID NO: 4901275 - DNA, 17 bp, Homo sapiens
ggatgaaattttctaga

SEQ ID NO: 4901276 - DNA, 13 bp, Homo sapiens
ggatgaatctccc

SEQ ID NO: 4901277 - DNA, 14 bp, Homo sapiens
ggatgaatgaggtc

SEQ ID NO: 4901278 - DNA, 18 bp, Homo sapiens
ggatgagagcccagaggt

SEQ ID NO: 4901279 - DNA, 23 bp, Homo sapiens
ggatgagagcccagaggtaacag

SEQ ID NO: 4901280 - DNA, 22 bp, Homo sapiens
ggatgccaatattaaatctgct

SEQ ID NO: 4901281 - DNA, 17 bp, Homo sapiens
ggatgcctggtggcagc

SEQ ID NO: 4901282 - DNA, 20 bp, Homo sapiens
ggatgcctggtggcagctgc

SEQ ID NO: 4901283 - DNA, 21 bp, Homo sapiens
ggatgcctggtggcagctgcg

SEQ ID NO: 4901284 - DNA, 13 bp, Homo sapiens
ggatgggcctggc

SEQ ID NO: 4901285 - DNA, 22 bp, Homo sapiens
ggatgggggctggcctctggct

SEQ ID NO: 4901286 - DNA, 16 bp, Homo sapiens
ggatgtcacagggcca

SEQ ID NO: 4901287 - DNA, 14 bp, Homo sapiens
ggatgtccctgggc

SEQ ID NO: 4901288 - DNA, 18 bp, Homo sapiens
ggatgtccctgggccagg

SEQ ID NO: 4901289 - DNA, 19 bp, Homo sapiens
ggatgtccctgggccaggg

SEQ ID NO: 4901290 - DNA, 23 bp, Homo sapiens
ggatgtccctgggccagggtctg

SEQ ID NO: 4901291 - DNA, 23 bp, Homo sapiens
ggatgtgggagggagcagacagg

SEQ ID NO: 4901292 - DNA, 13 bp, Homo sapiens
ggattatcctgag

SEQ ID NO: 4901293 - DNA, 17 bp, Homo sapiens
ggattatttaataacat

SEQ ID NO: 4901294 - DNA, 14 bp, Homo sapiens
ggattcaggctgct

SEQ ID NO: 4901295 - DNA, 21 bp, Homo sapiens
ggattttgatccaagctggtc

SEQ ID NO: 4901296 - DNA, 16 bp, Homo sapiens
ggcaaaagccttgtgt

SEQ ID NO: 4901297 - DNA, 19 bp, Homo sapiens
ggcaaatgacatgcactga

SEQ ID NO: 4901298 - DNA, 20 bp, Homo sapiens
ggcaaatgacatgcactgac

SEQ ID NO: 4901299 - DNA, 18 bp, Homo sapiens
ggcaaatttttatttttt

SEQ ID NO: 4901300 - DNA, 19 bp, Homo sapiens
ggcaacagagcaagatcct

SEQ ID NO: 4901301 - DNA, 17 bp, Homo sapiens
ggcaacccccagcctgc

SEQ ID NO: 4901302 - DNA, 19 bp, Homo sapiens
ggcaactaagcagtccctg

SEQ ID NO: 4901303 - DNA, 23 bp, Homo sapiens
ggcaacttcagtcctgggagacc

SEQ ID NO: 4901304 - DNA, 14 bp, Homo sapiens
ggcaaggaaaaaga

SEQ ID NO: 4901305 - DNA, 19 bp, Homo sapiens
ggcaaggaaaaagaaaata

SEQ ID NO: 4901306 - DNA, 18 bp, Homo sapiens
ggcaatgtcaggaacaga

SEQ ID NO: 4901307 - DNA, 12 bp, Homo sapiens
ggcaattggaac

SEQ ID NO: 4901308 - DNA, 13 bp, Homo sapiens
ggcaattggaaca

SEQ ID NO: 4901309 - DNA, 14 bp, Homo sapiens
ggcaattttgtaac

SEQ ID NO: 4901310 - DNA, 11 bp, Homo sapiens
ggcacagattg

SEQ ID NO: 4901311 - DNA, 18 bp, Homo sapiens
ggcaccaaagatgcagcc

SEQ ID NO: 4901312 - DNA, 23 bp, Homo sapiens
ggcacccaccatcatgtctggct

SEQ ID NO: 4901313 - DNA, 16 bp, Homo sapiens
ggcacccggcccctgc

SEQ ID NO: 4901314 - DNA, 15 bp, Homo sapiens
ggcaccctctggccg

SEQ ID NO: 4901315 - DNA, 18 bp, Homo sapiens
ggcactcagaagacactg

SEQ ID NO: 4901316 - DNA, 22 bp, Homo sapiens
ggcactctgttatttagactca

SEQ ID NO: 4901317 - DNA, 19 bp, Homo sapiens
ggcactgggatgagccgct

SEQ ID NO: 4901318 - DNA, 24 bp, Homo sapiens
ggcactgtactaggcgtgagaagc

SEQ ID NO: 4901319 - DNA, 22 bp, Homo sapiens
ggcacttattgtaaattttaga

SEQ ID NO: 4901320 - DNA, 15 bp, Homo sapiens
ggcacttgcctgggt

SEQ ID NO: 4901321 - DNA, 20 bp, Homo sapiens
ggcagaaaggttctgcccgg

SEQ ID NO: 4901322 - DNA, 18 bp, Homo sapiens
ggcagaagacaccagagc

SEQ ID NO: 4901323 - DNA, 20 bp, Homo sapiens
ggcagaagacaccagagcag

SEQ ID NO: 4901324 - DNA, 10 bp, Homo sapiens
ggcagagagc

SEQ ID NO: 4901325 - DNA, 12 bp, Homo sapiens
ggcagagcattt

SEQ ID NO: 4901326 - DNA, 15 bp, Homo sapiens
ggcagataatcagcc

SEQ ID NO: 4901327 - DNA, 15 bp, Homo sapiens
ggcagatctgtgccc

SEQ ID NO: 4901328 - DNA, 17 bp, Homo sapiens
ggcagatctgtgcccca

SEQ ID NO: 4901329 - DNA, 18 bp, Homo sapiens
ggcagatctgtgccccat

SEQ ID NO: 4901330 - DNA, 20 bp, Homo sapiens
ggcagatctgtgccccatgc

SEQ ID NO: 4901331 - DNA, 13 bp, Homo sapiens
ggcagcagaaaac

SEQ ID NO: 4901332 - DNA, 16 bp, Homo sapiens
ggcagccaaacccatg

SEQ ID NO: 4901333 - DNA, 18 bp, Homo sapiens
ggcagccaaacccatgag

SEQ ID NO: 4901334 - DNA, 19 bp, Homo sapiens
ggcagccaaacccatgagg

SEQ ID NO: 4901335 - DNA, 23 bp, Homo sapiens
ggcagccacttcggccaggtcac

SEQ ID NO: 4901336 - DNA, 22 bp, Homo sapiens
ggcagccagtgagatgagggat

SEQ ID NO: 4901337 - DNA, 20 bp, Homo sapiens
ggcagccccattctgcctgc

SEQ ID NO: 4901338 - DNA, 22 bp, Homo sapiens
ggcagccccattctgcctgccc

SEQ ID NO: 4901339 - DNA, 19 bp, Homo sapiens
ggcagccgtgccttcagct

SEQ ID NO: 4901340 - DNA, 21 bp, Homo sapiens
ggcagccgtgccttcagctct

SEQ ID NO: 4901341 - DNA, 18 bp, Homo sapiens
ggcagcgccaagtgcgtg

SEQ ID NO: 4901342 - DNA, 20 bp, Homo sapiens
ggcagcgccaagtgcgtgcc

SEQ ID NO: 4901343 - DNA, 23 bp, Homo sapiens
ggcagctcatagagtcccccctc

SEQ ID NO: 4901344 - DNA, 11 bp, Homo sapiens
ggcagctgcta

SEQ ID NO: 4901345 - DNA, 22 bp, Homo sapiens
ggcagctgctatttattttcct

SEQ ID NO: 4901346 - DNA, 17 bp, Homo sapiens
ggcagcttgagggttgg

SEQ ID NO: 4901347 - DNA, 24 bp, Homo sapiens
ggcaggaggattgcttgagcccag

SEQ ID NO: 4901348 - DNA, 14 bp, Homo sapiens
ggcaggagggccct

SEQ ID NO: 4901349 - DNA, 10 bp, Homo sapiens
ggcaggccct

SEQ ID NO: 4901350 - DNA, 11 bp, Homo sapiens
ggcaggccctg

SEQ ID NO: 4901351 - DNA, 10 bp, Homo sapiens
ggcaggctgg

SEQ ID NO: 4901352 - DNA, 12 bp, Homo sapiens
ggcaggctgggc

SEQ ID NO: 4901353 - DNA, 13 bp, Homo sapiens
ggcaggctgggcc

SEQ ID NO: 4901354 - DNA, 14 bp, Homo sapiens
ggcaggctgggcca

SEQ ID NO: 4901355 - DNA, 16 bp, Homo sapiens
ggcaggctgggccatg

SEQ ID NO: 4901356 - DNA, 22 bp, Homo sapiens
ggcaggctgggccatgtccaaa

SEQ ID NO: 4901357 - DNA, 22 bp, Homo sapiens
ggcagggaggtcaggccctgga

SEQ ID NO: 4901358 - DNA, 19 bp, Homo sapiens
ggcagggtctcactctgtc

SEQ ID NO: 4901359 - DNA, 15 bp, Homo sapiens
ggcagtgagtgagcc

SEQ ID NO: 4901360 - DNA, 17 bp, Homo sapiens
ggcagtgggagctgcct

SEQ ID NO: 4901361 - DNA, 13 bp, Homo sapiens
ggcataaaacagc

SEQ ID NO: 4901362 - DNA, 14 bp, Homo sapiens
ggcataaactgttt

SEQ ID NO: 4901363 - DNA, 14 bp, Homo sapiens
ggcatctgcccctc

SEQ ID NO: 4901364 - DNA, 16 bp, Homo sapiens
ggcatctttgccttgg

SEQ ID NO: 4901365 - DNA, 17 bp, Homo sapiens
ggcatctttgccttggg

SEQ ID NO: 4901366 - DNA, 23 bp, Homo sapiens
ggcatctttgccttgggctgctc

SEQ ID NO: 4901367 - DNA, 14 bp, Homo sapiens
ggcatgccttgtgc

SEQ ID NO: 4901368 - DNA, 18 bp, Homo sapiens
ggcatggccaggtggcca

SEQ ID NO: 4901369 - DNA, 12 bp, Homo sapiens
ggcatggccctg

SEQ ID NO: 4901370 - DNA, 16 bp, Homo sapiens
ggcatggtaccagccc

SEQ ID NO: 4901371 - DNA, 16 bp, Homo sapiens
ggcatgtaggaccctg

SEQ ID NO: 4901372 - DNA, 14 bp, Homo sapiens
ggcatgttcctctg

SEQ ID NO: 4901373 - DNA, 20 bp, Homo sapiens
ggcatgttctctgaggacac

SEQ ID NO: 4901374 - DNA, 23 bp, Homo sapiens
ggcatgttctctgaggacactaa

SEQ ID NO: 4901375 - DNA, 16 bp, Homo sapiens
ggcattaatgtttcta

SEQ ID NO: 4901376 - DNA, 11 bp, Homo sapiens
ggcatttccta

SEQ ID NO: 4901377 - DNA, 12 bp, Homo sapiens
ggcatttgttca

SEQ ID NO: 4901378 - DNA, 11 bp, Homo sapiens
ggccaaactgc

SEQ ID NO: 4901379 - DNA, 15 bp, Homo sapiens
ggccaaagccaaagc

SEQ ID NO: 4901380 - DNA, 21 bp, Homo sapiens
ggccaaattatttgtgtaata

SEQ ID NO: 4901381 - DNA, 22 bp, Homo sapiens
ggccaacttgagggcccagagc

SEQ ID NO: 4901382 - DNA, 19 bp, Homo sapiens
ggccaagataggaccttgg

SEQ ID NO: 4901383 - DNA, 16 bp, Homo sapiens
ggccaagtccgcagaa

SEQ ID NO: 4901384 - DNA, 16 bp, Homo sapiens
ggccaccaaagctgcc

SEQ ID NO: 4901385 - DNA, 17 bp, Homo sapiens
ggccactccagacccct

SEQ ID NO: 4901386 - DNA, 15 bp, Homo sapiens
ggccacttttgacta

SEQ ID NO: 4901387 - DNA, 21 bp, Homo sapiens
ggccagaggaactgtccagag

SEQ ID NO: 4901388 - DNA, 22 bp, Homo sapiens
ggccagaggaactgtccagaga

SEQ ID NO: 4901389 - DNA, 23 bp, Homo sapiens
ggccagagggagtgacagaggca

SEQ ID NO: 4901390 - DNA, 16 bp, Homo sapiens
ggccagagtggcctgg

SEQ ID NO: 4901391 - DNA, 18 bp, Homo sapiens
ggccagagtggcctggcc

SEQ ID NO: 4901392 - DNA, 19 bp, Homo sapiens
ggccagagtggcctggcca

SEQ ID NO: 4901393 - DNA, 16 bp, Homo sapiens
ggccagatgcaccagc

SEQ ID NO: 4901394 - DNA, 23 bp, Homo sapiens
ggccagatggcccggatgctgct

SEQ ID NO: 4901395 - DNA, 20 bp, Homo sapiens
ggccagccccacccaggagg

SEQ ID NO: 4901396 - DNA, 17 bp, Homo sapiens
ggccagccccggccctg

SEQ ID NO: 4901397 - DNA, 15 bp, Homo sapiens
ggccagcctcaccct

SEQ ID NO: 4901398 - DNA, 16 bp, Homo sapiens
ggccagcctcaccctt

SEQ ID NO: 4901399 - DNA, 17 bp, Homo sapiens
ggccagcctcacccttg

SEQ ID NO: 4901400 - DNA, 18 bp, Homo sapiens
ggccagcctggggcctgg

SEQ ID NO: 4901401 - DNA, 19 bp, Homo sapiens
ggccagcctggggcctggc

SEQ ID NO: 4901402 - DNA, 13 bp, Homo sapiens
ggccaggagctct

SEQ ID NO: 4901403 - DNA, 16 bp, Homo sapiens
ggccaggccagaggga

SEQ ID NO: 4901404 - DNA, 19 bp, Homo sapiens
ggccaggctggtctaaaac

SEQ ID NO: 4901405 - DNA, 17 bp, Homo sapiens
ggccagggctgccctga

SEQ ID NO: 4901406 - DNA, 17 bp, Homo sapiens
ggccagggtctgtgtga

SEQ ID NO: 4901407 - DNA, 21 bp, Homo sapiens
ggccagtatctatatatgtgt

SEQ ID NO: 4901408 - DNA, 16 bp, Homo sapiens
ggccagtcctgcctgg

SEQ ID NO: 4901409 - DNA, 18 bp, Homo sapiens
ggccagtcctgcctggcc

SEQ ID NO: 4901410 - DNA, 21 bp, Homo sapiens
ggccagtcctgcctggccagg

SEQ ID NO: 4901411 - DNA, 17 bp, Homo sapiens
ggccagtggggcctgtg

SEQ ID NO: 4901412 - DNA, 18 bp, Homo sapiens
ggccagtggggcctgtgg

SEQ ID NO: 4901413 - DNA, 19 bp, Homo sapiens
ggccagtggggcctgtgga

SEQ ID NO: 4901414 - DNA, 16 bp, Homo sapiens
ggccagtgtgacaagg

SEQ ID NO: 4901415 - DNA, 13 bp, Homo sapiens
ggccatgcctgcc

SEQ ID NO: 4901416 - DNA, 14 bp, Homo sapiens
ggccatgcctgccc

SEQ ID NO: 4901417 - DNA, 16 bp, Homo sapiens
ggccatgggcctcctg

SEQ ID NO: 4901418 - DNA, 13 bp, Homo sapiens
ggcccaaggcggc

SEQ ID NO: 4901419 - DNA, 14 bp, Homo sapiens
ggcccagagcagga

SEQ ID NO: 4901420 - DNA, 14 bp, Homo sapiens
ggcccagaggctga

SEQ ID NO: 4901421 - DNA, 17 bp, Homo sapiens
ggccccagcacctcagc

SEQ ID NO: 4901422 - DNA, 17 bp, Homo sapiens
ggccccccagctcaggg

SEQ ID NO: 4901423 - DNA, 23 bp, Homo sapiens
ggccccccagctcaggggcagct

SEQ ID NO: 4901424 - DNA, 17 bp, Homo sapiens
ggccccctggtctctgg

SEQ ID NO: 4901425 - DNA, 17 bp, Homo sapiens
ggcccctgcatcccctt

SEQ ID NO: 4901426 - DNA, 18 bp, Homo sapiens
ggcccctgccaccctggg

SEQ ID NO: 4901427 - DNA, 23 bp, Homo sapiens
ggcccctgctggttcagggttgg

SEQ ID NO: 4901428 - DNA, 23 bp, Homo sapiens
ggccccttctctccctgccagag

SEQ ID NO: 4901429 - DNA, 13 bp, Homo sapiens
ggcccggctccag

SEQ ID NO: 4901430 - DNA, 23 bp, Homo sapiens
ggccctagcccagcgctctgcct

SEQ ID NO: 4901431 - DNA, 22 bp, Homo sapiens
ggccctccgaccacttccaggg

SEQ ID NO: 4901432 - DNA, 14 bp, Homo sapiens
ggccctcctgtgct

SEQ ID NO: 4901433 - DNA, 15 bp, Homo sapiens
ggccctcgacactca

SEQ ID NO: 4901434 - DNA, 22 bp, Homo sapiens
ggccctgcaatgtatcccttct

SEQ ID NO: 4901435 - DNA, 17 bp, Homo sapiens
ggccctgcagccagctc

SEQ ID NO: 4901436 - DNA, 11 bp, Homo sapiens
ggccctgccct

SEQ ID NO: 4901437 - DNA, 14 bp, Homo sapiens
ggccctgccctgag

SEQ ID NO: 4901438 - DNA, 18 bp, Homo sapiens
ggccctgccctgaggaag

SEQ ID NO: 4901439 - DNA, 19 bp, Homo sapiens
ggccctgccctgaggaagg

SEQ ID NO: 4901440 - DNA, 14 bp, Homo sapiens
ggccctgctgccca

SEQ ID NO: 4901441 - DNA, 15 bp, Homo sapiens
ggccctggaactcta

SEQ ID NO: 4901442 - DNA, 22 bp, Homo sapiens
ggccctggctcccacaggccct

SEQ ID NO: 4901443 - DNA, 18 bp, Homo sapiens
ggccctgtccctcccacc

SEQ ID NO: 4901444 - DNA, 21 bp, Homo sapiens
ggccctgtccctcccacctct

SEQ ID NO: 4901445 - DNA, 15 bp, Homo sapiens
ggcccttcctctcca

SEQ ID NO: 4901446 - DNA, 18 bp, Homo sapiens
ggcccttcctctccactg

SEQ ID NO: 4901447 - DNA, 22 bp, Homo sapiens
ggcccttcctctccactgcctt

SEQ ID NO: 4901448 - DNA, 19 bp, Homo sapiens
ggccctttccttccagatc

SEQ ID NO: 4901449 - DNA, 19 bp, Homo sapiens
ggccctttgaagcctcagc

SEQ ID NO: 4901450 - DNA, 13 bp, Homo sapiens
ggccgaggacttt

SEQ ID NO: 4901451 - DNA, 12 bp, Homo sapiens
ggccgccccctg

SEQ ID NO: 4901452 - DNA, 16 bp, Homo sapiens
ggccgccccctgcccc

SEQ ID NO: 4901453 - DNA, 18 bp, Homo sapiens
ggccgccccctgcccccc

SEQ ID NO: 4901454 - DNA, 22 bp, Homo sapiens
ggccgccccctgccccccagcc

SEQ ID NO: 4901455 - DNA, 16 bp, Homo sapiens
ggccgcgccctttccc

SEQ ID NO: 4901456 - DNA, 19 bp, Homo sapiens
ggccgctccaccagcatca

SEQ ID NO: 4901457 - DNA, 22 bp, Homo sapiens
ggccggcttcatgccagctact

SEQ ID NO: 4901458 - DNA, 23 bp, Homo sapiens
ggcctaatctcatacctctgacc

SEQ ID NO: 4901459 - DNA, 17 bp, Homo sapiens
ggcctagcccaccctgc

SEQ ID NO: 4901460 - DNA, 15 bp, Homo sapiens
ggcctaggattctaa

SEQ ID NO: 4901461 - DNA, 21 bp, Homo sapiens
ggcctatgcacatatggactc

SEQ ID NO: 4901462 - DNA, 14 bp, Homo sapiens
ggcctcaagtgatt

SEQ ID NO: 4901463 - DNA, 19 bp, Homo sapiens
ggcctcaccgagtgggggc

SEQ ID NO: 4901464 - DNA, 13 bp, Homo sapiens
ggcctcagctgcc

SEQ ID NO: 4901465 - DNA, 15 bp, Homo sapiens
ggcctcagctgcctc

SEQ ID NO: 4901466 - DNA, 16 bp, Homo sapiens
ggcctcagctgcctca

SEQ ID NO: 4901467 - DNA, 15 bp, Homo sapiens
ggcctccagaactca

SEQ ID NO: 4901468 - DNA, 20 bp, Homo sapiens
ggcctccagaactcactggg

SEQ ID NO: 4901469 - DNA, 15 bp, Homo sapiens
ggcctccctctctct

SEQ ID NO: 4901470 - DNA, 14 bp, Homo sapiens
ggcctcctcttcac

SEQ ID NO: 4901471 - DNA, 23 bp, Homo sapiens
ggcctcctcttcaccccggcagg

SEQ ID NO: 4901472 - DNA, 14 bp, Homo sapiens
ggcctcctgtgtgt

SEQ ID NO: 4901473 - DNA, 16 bp, Homo sapiens
ggcctctgtgccttct

SEQ ID NO: 4901474 - DNA, 14 bp, Homo sapiens
ggcctctgtgtcct

SEQ ID NO: 4901475 - DNA, 19 bp, Homo sapiens
ggcctcttccgtgacgtca

SEQ ID NO: 4901476 - DNA, 18 bp, Homo sapiens
ggcctgagaggggaagcg

SEQ ID NO: 4901477 - DNA, 14 bp, Homo sapiens
ggcctgatgctccc

SEQ ID NO: 4901478 - DNA, 15 bp, Homo sapiens
ggcctgatgctccct

SEQ ID NO: 4901479 - DNA, 22 bp, Homo sapiens
ggcctgatgctccctcccctgc

SEQ ID NO: 4901480 - DNA, 12 bp, Homo sapiens
ggcctgcacaca

SEQ ID NO: 4901481 - DNA, 14 bp, Homo sapiens
ggcctgcacagtga

SEQ ID NO: 4901482 - DNA, 15 bp, Homo sapiens
ggcctggacctgcct

SEQ ID NO: 4901483 - DNA, 14 bp, Homo sapiens
ggcctggcagccgt

SEQ ID NO: 4901484 - DNA, 15 bp, Homo sapiens
ggcctggcagggagg

SEQ ID NO: 4901485 - DNA, 15 bp, Homo sapiens
ggcctggcattcttg

SEQ ID NO: 4901486 - DNA, 19 bp, Homo sapiens
ggcctggcattcttgtaca

SEQ ID NO: 4901487 - DNA, 15 bp, Homo sapiens
ggcctggccaggagc

SEQ ID NO: 4901488 - DNA, 23 bp, Homo sapiens
ggcctggccaggagctcttcagg

SEQ ID NO: 4901489 - DNA, 19 bp, Homo sapiens
ggcctggccctgccctgag

SEQ ID NO: 4901490 - DNA, 16 bp, Homo sapiens
ggcctggcctggccct

SEQ ID NO: 4901491 - DNA, 17 bp, Homo sapiens
ggcctggcctggccctg

SEQ ID NO: 4901492 - DNA, 14 bp, Homo sapiens
ggcctggggcctga

SEQ ID NO: 4901493 - DNA, 23 bp, Homo sapiens
ggcctgggtggatcggcctcctc

SEQ ID NO: 4901494 - DNA, 18 bp, Homo sapiens
ggcctgtctcatccccag

SEQ ID NO: 4901495 - DNA, 18 bp, Homo sapiens
ggcctgtggaatgagtgt

SEQ ID NO: 4901496 - DNA, 11 bp, Homo sapiens
ggcctgttgcc

SEQ ID NO: 4901497 - DNA, 21 bp, Homo sapiens
ggccttagtgggccagggctg

SEQ ID NO: 4901498 - DNA, 22 bp, Homo sapiens
ggccttagtgggccagggctgc

SEQ ID NO: 4901499 - DNA, 14 bp, Homo sapiens
ggccttccagctgc

SEQ ID NO: 4901500 - DNA, 17 bp, Homo sapiens
ggccttccagctgctgt

SEQ ID NO: 4901501 - DNA, 12 bp, Homo sapiens
ggccttctctga

SEQ ID NO: 4901502 - DNA, 20 bp, Homo sapiens
ggccttggcttttctagcct

SEQ ID NO: 4901503 - DNA, 20 bp, Homo sapiens
ggcggcacaggtcgggcgca

SEQ ID NO: 4901504 - DNA, 17 bp, Homo sapiens
ggcggcccctcccgccc

SEQ ID NO: 4901505 - DNA, 16 bp, Homo sapiens
ggcgggagcatctctt

SEQ ID NO: 4901506 - DNA, 17 bp, Homo sapiens
ggcggtgcccacaccgg

SEQ ID NO: 4901507 - DNA, 15 bp, Homo sapiens
ggcgtcagtcttttt

SEQ ID NO: 4901508 - DNA, 12 bp, Homo sapiens
ggcgtgatctcg

SEQ ID NO: 4901509 - DNA, 23 bp, Homo sapiens
ggcgttgggagggggagaaaagg

SEQ ID NO: 4901510 - DNA, 17 bp, Homo sapiens
ggctaactatatttgct

SEQ ID NO: 4901511 - DNA, 16 bp, Homo sapiens
ggctaagaggctgctg

SEQ ID NO: 4901512 - DNA, 13 bp, Homo sapiens
ggctaatttttgt

SEQ ID NO: 4901513 - DNA, 14 bp, Homo sapiens
ggctacattataaa

SEQ ID NO: 4901514 - DNA, 18 bp, Homo sapiens
ggctactgcagctttaca

SEQ ID NO: 4901515 - DNA, 13 bp, Homo sapiens
ggctagagtcctc

SEQ ID NO: 4901516 - DNA, 20 bp, Homo sapiens
ggctagagtcctcactccca

SEQ ID NO: 4901517 - DNA, 22 bp, Homo sapiens
ggctaggacccctccatgtggg

SEQ ID NO: 4901518 - DNA, 15 bp, Homo sapiens
ggctaggtagaaaaa

SEQ ID NO: 4901519 - DNA, 20 bp, Homo sapiens
ggctaggtagaaaaagggtc

SEQ ID NO: 4901520 - DNA, 20 bp, Homo sapiens
ggctatagctacaggaagca

SEQ ID NO: 4901521 - DNA, 23 bp, Homo sapiens
ggctcacagtacagcatgtgcct

SEQ ID NO: 4901522 - DNA, 14 bp, Homo sapiens
ggctcactgcagcc

SEQ ID NO: 4901523 - DNA, 18 bp, Homo sapiens
ggctcagagatgtgcacc

SEQ ID NO: 4901524 - DNA, 18 bp, Homo sapiens
ggctcagcggggacagct

SEQ ID NO: 4901525 - DNA, 21 bp, Homo sapiens
ggctcagcggggacagctcct

SEQ ID NO: 4901526 - DNA, 23 bp, Homo sapiens
ggctcagcggggacagctccttc

SEQ ID NO: 4901527 - DNA, 21 bp, Homo sapiens
ggctcagctcggggagcctta

SEQ ID NO: 4901528 - DNA, 11 bp, Homo sapiens
ggctccaggct

SEQ ID NO: 4901529 - DNA, 12 bp, Homo sapiens
ggctccaggctc

SEQ ID NO: 4901530 - DNA, 18 bp, Homo sapiens
ggctccatgctcctcact

SEQ ID NO: 4901531 - DNA, 19 bp, Homo sapiens
ggctcccacaggcccttcc

SEQ ID NO: 4901532 - DNA, 21 bp, Homo sapiens
ggctcccacaggcccttcctc

SEQ ID NO: 4901533 - DNA, 12 bp, Homo sapiens
ggctcctcccag

SEQ ID NO: 4901534 - DNA, 20 bp, Homo sapiens
ggctccttcccatcgctgtc

SEQ ID NO: 4901535 - DNA, 11 bp, Homo sapiens
ggctctagatc

SEQ ID NO: 4901536 - DNA, 12 bp, Homo sapiens
ggctctcagctc

SEQ ID NO: 4901537 - DNA, 15 bp, Homo sapiens
ggctctgagagtcta

SEQ ID NO: 4901538 - DNA, 20 bp, Homo sapiens
ggctctgagagtctagattc

SEQ ID NO: 4901539 - DNA, 19 bp, Homo sapiens
ggctctgcaattcccctct

SEQ ID NO: 4901540 - DNA, 13 bp, Homo sapiens
ggctctgccccag

SEQ ID NO: 4901541 - DNA, 21 bp, Homo sapiens
ggctctgccccagtcgttaga

SEQ ID NO: 4901542 - DNA, 17 bp, Homo sapiens
ggctctggagacagccc

SEQ ID NO: 4901543 - DNA, 19 bp, Homo sapiens
ggctctggagacagcccca

SEQ ID NO: 4901544 - DNA, 16 bp, Homo sapiens
ggctcttctcctttca

SEQ ID NO: 4901545 - DNA, 19 bp, Homo sapiens
ggctcttgatacccccctc

SEQ ID NO: 4901546 - DNA, 21 bp, Homo sapiens
ggctcttgatacccccctctg

SEQ ID NO: 4901547 - DNA, 19 bp, Homo sapiens
ggctgactagaagggccag

SEQ ID NO: 4901548 - DNA, 22 bp, Homo sapiens
ggctgactagaagggccagtcc

SEQ ID NO: 4901549 - DNA, 24 bp, Homo sapiens
ggctgactagaagggccagtcctg

SEQ ID NO: 4901550 - DNA, 19 bp, Homo sapiens
ggctgaggaggcctccatc

SEQ ID NO: 4901551 - DNA, 20 bp, Homo sapiens
ggctgaggaggcctccatct

SEQ ID NO: 4901552 - DNA, 23 bp, Homo sapiens
ggctgcaaagggtatcaggtgct

SEQ ID NO: 4901553 - DNA, 17 bp, Homo sapiens
ggctgcagctggacaga

SEQ ID NO: 4901554 - DNA, 18 bp, Homo sapiens
ggctgcagctggacagag

SEQ ID NO: 4901555 - DNA, 24 bp, Homo sapiens
ggctgcagctggacagaggggact

SEQ ID NO: 4901556 - DNA, 13 bp, Homo sapiens
ggctgcagtcctc

SEQ ID NO: 4901557 - DNA, 15 bp, Homo sapiens
ggctgcagtgagcca

SEQ ID NO: 4901558 - DNA, 15 bp, Homo sapiens
ggctgccaaggccag

SEQ ID NO: 4901559 - DNA, 17 bp, Homo sapiens
ggctgccaaggccagag

SEQ ID NO: 4901560 - DNA, 20 bp, Homo sapiens
ggctgcccccggccccctgg

SEQ ID NO: 4901561 - DNA, 21 bp, Homo sapiens
ggctgccctgagaagctgctc

SEQ ID NO: 4901562 - DNA, 14 bp, Homo sapiens
ggctgccctggtgc

SEQ ID NO: 4901563 - DNA, 16 bp, Homo sapiens
ggctgcccttgggcca

SEQ ID NO: 4901564 - DNA, 19 bp, Homo sapiens
ggctgctgaaaaccatctg

SEQ ID NO: 4901565 - DNA, 20 bp, Homo sapiens
ggctggagtgcagtggtgtg

SEQ ID NO: 4901566 - DNA, 19 bp, Homo sapiens
ggctggagtggagtggcgt

SEQ ID NO: 4901567 - DNA, 13 bp, Homo sapiens
ggctggcagggct

SEQ ID NO: 4901568 - DNA, 17 bp, Homo sapiens
ggctggccccagggcac

SEQ ID NO: 4901569 - DNA, 11 bp, Homo sapiens
ggctgggccat

SEQ ID NO: 4901570 - DNA, 21 bp, Homo sapiens
ggctgggccatgtccaaagag

SEQ ID NO: 4901571 - DNA, 21 bp, Homo sapiens
ggctgggccccccagctcagg

SEQ ID NO: 4901572 - DNA, 12 bp, Homo sapiens
ggctgggcttca

SEQ ID NO: 4901573 - DNA, 18 bp, Homo sapiens
ggctgggcttcagtggca

SEQ ID NO: 4901574 - DNA, 18 bp, Homo sapiens
ggctgggggcaggagggc

SEQ ID NO: 4901575 - DNA, 14 bp, Homo sapiens
ggctgggttggagg

SEQ ID NO: 4901576 - DNA, 19 bp, Homo sapiens
ggctggtattggtggcttt

SEQ ID NO: 4901577 - DNA, 14 bp, Homo sapiens
ggctggtggcaagt

SEQ ID NO: 4901578 - DNA, 17 bp, Homo sapiens
ggctggtgggaggggcg

SEQ ID NO: 4901579 - DNA, 20 bp, Homo sapiens
ggctgtactgctcaggctgc

SEQ ID NO: 4901580 - DNA, 21 bp, Homo sapiens
ggctgtactgctcaggctgca

SEQ ID NO: 4901581 - DNA, 20 bp, Homo sapiens
ggctgtatcccatgagcctc

SEQ ID NO: 4901582 - DNA, 22 bp, Homo sapiens
ggctgtatcccatgagcctcag

SEQ ID NO: 4901583 - DNA, 17 bp, Homo sapiens
ggctgttctgcactgaa

SEQ ID NO: 4901584 - DNA, 18 bp, Homo sapiens
ggctgttctgcactgaaa

SEQ ID NO: 4901585 - DNA, 21 bp, Homo sapiens
ggctgttctgcactgaaaagg

SEQ ID NO: 4901586 - DNA, 15 bp, Homo sapiens
ggctgttggcagtga

SEQ ID NO: 4901587 - DNA, 15 bp, Homo sapiens
ggctgttggctgggg

SEQ ID NO: 4901588 - DNA, 15 bp, Homo sapiens
ggcttaaaacaacac

SEQ ID NO: 4901589 - DNA, 19 bp, Homo sapiens
ggcttacctgacctcttgc

SEQ ID NO: 4901590 - DNA, 23 bp, Homo sapiens
ggcttacctgacctcttgctgtc

SEQ ID NO: 4901591 - DNA, 18 bp, Homo sapiens
ggcttcactgtataaata

SEQ ID NO: 4901592 - DNA, 19 bp, Homo sapiens
ggcttcactgtataaatag

SEQ ID NO: 4901593 - DNA, 15 bp, Homo sapiens
ggcttcatgccagct

SEQ ID NO: 4901594 - DNA, 16 bp, Homo sapiens
ggcttcatgccagcta

SEQ ID NO: 4901595 - DNA, 14 bp, Homo sapiens
ggcttcccgctcag

SEQ ID NO: 4901596 - DNA, 17 bp, Homo sapiens
ggcttcccgctcagccc

SEQ ID NO: 4901597 - DNA, 13 bp, Homo sapiens
ggcttgaagctgt

SEQ ID NO: 4901598 - DNA, 14 bp, Homo sapiens
ggcttgaagctgtg

SEQ ID NO: 4901599 - DNA, 17 bp, Homo sapiens
ggcttgactcaggattt

SEQ ID NO: 4901600 - DNA, 13 bp, Homo sapiens
ggctttccttgtg

SEQ ID NO: 4901601 - DNA, 13 bp, Homo sapiens
ggctttgtgttgt

SEQ ID NO: 4901602 - DNA, 13 bp, Homo sapiens
ggcttttcactgc

SEQ ID NO: 4901603 - DNA, 15 bp, Homo sapiens
ggcttttcactgctg

SEQ ID NO: 4901604 - DNA, 17 bp, Homo sapiens
ggcttttcactgctggc

SEQ ID NO: 4901605 - DNA, 22 bp, Homo sapiens
ggcttttcactgctggctgcct

SEQ ID NO: 4901606 - DNA, 19 bp, Homo sapiens
ggcttttttaaaaaagcaa

SEQ ID NO: 4901607 - DNA, 20 bp, Homo sapiens
gggaaacctagagaagataa

SEQ ID NO: 4901608 - DNA, 17 bp, Homo sapiens
gggaaagacactgcctg

SEQ ID NO: 4901609 - DNA, 20 bp, Homo sapiens
gggaaagtgcatatgaaatc

SEQ ID NO: 4901610 - DNA, 19 bp, Homo sapiens
gggaacatttctgtaaata

SEQ ID NO: 4901611 - DNA, 16 bp, Homo sapiens
gggaagaagcagagag

SEQ ID NO: 4901612 - DNA, 17 bp, Homo sapiens
gggaagacgcctgagct

SEQ ID NO: 4901613 - DNA, 13 bp, Homo sapiens
gggaagctgcagc

SEQ ID NO: 4901614 - DNA, 22 bp, Homo sapiens
gggaagctgcagcttgggagag

SEQ ID NO: 4901615 - DNA, 16 bp, Homo sapiens
gggaagctggcctgag

SEQ ID NO: 4901616 - DNA, 18 bp, Homo sapiens
gggaaggcacagggagaa

SEQ ID NO: 4901617 - DNA, 14 bp, Homo sapiens
gggaagggacacac

SEQ ID NO: 4901618 - DNA, 17 bp, Homo sapiens
gggaagggtcatagaaa

SEQ ID NO: 4901619 - DNA, 21 bp, Homo sapiens
gggaaggtggggtcctggagc

SEQ ID NO: 4901620 - DNA, 16 bp, Homo sapiens
gggaagtagtccttgg

SEQ ID NO: 4901621 - DNA, 15 bp, Homo sapiens
gggaatccaagcctc

SEQ ID NO: 4901622 - DNA, 16 bp, Homo sapiens
gggacacctgccctgc

SEQ ID NO: 4901623 - DNA, 17 bp, Homo sapiens
gggacagaggcctgccc

SEQ ID NO: 4901624 - DNA, 15 bp, Homo sapiens
gggacagctccttct

SEQ ID NO: 4901625 - DNA, 16 bp, Homo sapiens
gggacagctccttctg

SEQ ID NO: 4901626 - DNA, 17 bp, Homo sapiens
gggacaggcctcacctc

SEQ ID NO: 4901627 - DNA, 21 bp, Homo sapiens
gggacagtttatcatgaagcc

SEQ ID NO: 4901628 - DNA, 22 bp, Homo sapiens
gggacagtttatcatgaagcct

SEQ ID NO: 4901629 - DNA, 13 bp, Homo sapiens
gggaccatgtgtc

SEQ ID NO: 4901630 - DNA, 22 bp, Homo sapiens
gggacccaggctccgcccttag

SEQ ID NO: 4901631 - DNA, 20 bp, Homo sapiens
gggacccatagatcttctga

SEQ ID NO: 4901632 - DNA, 17 bp, Homo sapiens
gggactacaggcaccca

SEQ ID NO: 4901633 - DNA, 16 bp, Homo sapiens
gggactcagccctgag

SEQ ID NO: 4901634 - DNA, 17 bp, Homo sapiens
gggactcagccctgagg

SEQ ID NO: 4901635 - DNA, 21 bp, Homo sapiens
gggactctgagcgggaggcag

SEQ ID NO: 4901636 - DNA, 22 bp, Homo sapiens
gggactctgagcgggaggcaga

SEQ ID NO: 4901637 - DNA, 23 bp, Homo sapiens
gggactctgagcgggaggcagag

SEQ ID NO: 4901638 - DNA, 23 bp, Homo sapiens
gggactgccagtccccctgcccc

SEQ ID NO: 4901639 - DNA, 19 bp, Homo sapiens
gggactgctgctgcctggc

SEQ ID NO: 4901640 - DNA, 22 bp, Homo sapiens
gggactgctgctgcctggccac

SEQ ID NO: 4901641 - DNA, 18 bp, Homo sapiens
gggacttggaagctccgc

SEQ ID NO: 4901642 - DNA, 23 bp, Homo sapiens
gggactttgctgatttcccctct

SEQ ID NO: 4901643 - DNA, 14 bp, Homo sapiens
gggagacactggcc

SEQ ID NO: 4901644 - DNA, 13 bp, Homo sapiens
gggagaggaactc

SEQ ID NO: 4901645 - DNA, 16 bp, Homo sapiens
gggagagttccagagg

SEQ ID NO: 4901646 - DNA, 21 bp, Homo sapiens
gggagcaggagattgagaagg

SEQ ID NO: 4901647 - DNA, 12 bp, Homo sapiens
gggagccccagg

SEQ ID NO: 4901648 - DNA, 14 bp, Homo sapiens
gggagccccagggt

SEQ ID NO: 4901649 - DNA, 20 bp, Homo sapiens
gggagcctaggaccactcag

SEQ ID NO: 4901650 - DNA, 22 bp, Homo sapiens
gggagctcctctcctggaggat

SEQ ID NO: 4901651 - DNA, 12 bp, Homo sapiens
gggagctctgca

SEQ ID NO: 4901652 - DNA, 22 bp, Homo sapiens
gggagctgcctgttcagctcca

SEQ ID NO: 4901653 - DNA, 16 bp, Homo sapiens
gggaggaaagagagca

SEQ ID NO: 4901654 - DNA, 19 bp, Homo sapiens
gggaggacctgaccctact

SEQ ID NO: 4901655 - DNA, 12 bp, Homo sapiens
gggaggcagcct

SEQ ID NO: 4901656 - DNA, 20 bp, Homo sapiens
gggagggaaaagggaagtag

SEQ ID NO: 4901657 - DNA, 11 bp, Homo sapiens
gggagggatta

SEQ ID NO: 4901658 - DNA, 15 bp, Homo sapiens
gggaggtcaggccct

SEQ ID NO: 4901659 - DNA, 15 bp, Homo sapiens
gggagtccaggcaca

SEQ ID NO: 4901660 - DNA, 17 bp, Homo sapiens
gggagtccaggcacagg

SEQ ID NO: 4901661 - DNA, 17 bp, Homo sapiens
gggagtgacagaggcag

SEQ ID NO: 4901662 - DNA, 15 bp, Homo sapiens
gggagtgctggctca

SEQ ID NO: 4901663 - DNA, 23 bp, Homo sapiens
gggagtgctggctcacagtacag

SEQ ID NO: 4901664 - DNA, 20 bp, Homo sapiens
gggataaccctacacccaga

SEQ ID NO: 4901665 - DNA, 22 bp, Homo sapiens
gggatacaacctccctcttgtt

SEQ ID NO: 4901666 - DNA, 19 bp, Homo sapiens
gggatgactaaaatattta

SEQ ID NO: 4901667 - DNA, 13 bp, Homo sapiens
gggatgagaaagg

SEQ ID NO: 4901668 - DNA, 15 bp, Homo sapiens
gggatgagccgctgt

SEQ ID NO: 4901669 - DNA, 15 bp, Homo sapiens
gggatggaggggagt

SEQ ID NO: 4901670 - DNA, 15 bp, Homo sapiens
gggattcaggctgct

SEQ ID NO: 4901671 - DNA, 16 bp, Homo sapiens
gggattcaggctgctt

SEQ ID NO: 4901672 - DNA, 16 bp, Homo sapiens
gggcaacccccagcct

SEQ ID NO: 4901673 - DNA, 18 bp, Homo sapiens
gggcaacccccagcctgc

SEQ ID NO: 4901674 - DNA, 17 bp, Homo sapiens
gggcaattggaacaaag

SEQ ID NO: 4901675 - DNA, 22 bp, Homo sapiens
gggcacactctgccagcaaaga

SEQ ID NO: 4901676 - DNA, 20 bp, Homo sapiens
gggcaccctgtggccctggc

SEQ ID NO: 4901677 - DNA, 19 bp, Homo sapiens
gggcactcagaagacactg

SEQ ID NO: 4901678 - DNA, 13 bp, Homo sapiens
gggcactggccca

SEQ ID NO: 4901679 - DNA, 13 bp, Homo sapiens
gggcactggtggc

SEQ ID NO: 4901680 - DNA, 17 bp, Homo sapiens
gggcagccaaacccatg

SEQ ID NO: 4901681 - DNA, 14 bp, Homo sapiens
gggcagccaggctg

SEQ ID NO: 4901682 - DNA, 15 bp, Homo sapiens
gggcagcctcccccg

SEQ ID NO: 4901683 - DNA, 12 bp, Homo sapiens
gggcagctgcta

SEQ ID NO: 4901684 - DNA, 15 bp, Homo sapiens
gggcaggctgggcca

SEQ ID NO: 4901685 - DNA, 13 bp, Homo sapiens
gggcaggggctgg

SEQ ID NO: 4901686 - DNA, 19 bp, Homo sapiens
gggcagtgctagtgagctg

SEQ ID NO: 4901687 - DNA, 21 bp, Homo sapiens
gggcagtgggacccatagatc

SEQ ID NO: 4901688 - DNA, 17 bp, Homo sapiens
gggcatatccaccacct

SEQ ID NO: 4901689 - DNA, 14 bp, Homo sapiens
gggcatctgcccct

SEQ ID NO: 4901690 - DNA, 17 bp, Homo sapiens
gggcatctgcccctccc

SEQ ID NO: 4901691 - DNA, 19 bp, Homo sapiens
gggcatctgcccctccccc

SEQ ID NO: 4901692 - DNA, 17 bp, Homo sapiens
gggcatggccaggtggc

SEQ ID NO: 4901693 - DNA, 18 bp, Homo sapiens
gggcatggtaccagccct

SEQ ID NO: 4901694 - DNA, 19 bp, Homo sapiens
gggcatggtaccagccctg

SEQ ID NO: 4901695 - DNA, 21 bp, Homo sapiens
gggcatttcttgcgagcctcg

SEQ ID NO: 4901696 - DNA, 22 bp, Homo sapiens
gggccaacttgagggcccagag

SEQ ID NO: 4901697 - DNA, 14 bp, Homo sapiens
gggccaccaaagct

SEQ ID NO: 4901698 - DNA, 13 bp, Homo sapiens
gggccacccctcc

SEQ ID NO: 4901699 - DNA, 11 bp, Homo sapiens
gggccaggcag

SEQ ID NO: 4901700 - DNA, 12 bp, Homo sapiens
gggccagggctg

SEQ ID NO: 4901701 - DNA, 13 bp, Homo sapiens
gggccagggctgc

SEQ ID NO: 4901702 - DNA, 21 bp, Homo sapiens
gggccagtcctgcctggccag

SEQ ID NO: 4901703 - DNA, 15 bp, Homo sapiens
gggccagtggggcct

SEQ ID NO: 4901704 - DNA, 20 bp, Homo sapiens
gggccagtggggcctgtgga

SEQ ID NO: 4901705 - DNA, 15 bp, Homo sapiens
gggccatgtccaaag

SEQ ID NO: 4901706 - DNA, 22 bp, Homo sapiens
gggccatgtccaaagaggctgc

SEQ ID NO: 4901707 - DNA, 18 bp, Homo sapiens
gggcccaagacagatgcc

SEQ ID NO: 4901708 - DNA, 23 bp, Homo sapiens
gggcccaagacagatgccccaga

SEQ ID NO: 4901709 - DNA, 18 bp, Homo sapiens
gggcccaaggcggcccct

SEQ ID NO: 4901710 - DNA, 19 bp, Homo sapiens
gggcccacgtggttggggc

SEQ ID NO: 4901711 - DNA, 17 bp, Homo sapiens
gggcccagagagggtgg

SEQ ID NO: 4901712 - DNA, 14 bp, Homo sapiens
gggcccagagcagg

SEQ ID NO: 4901713 - DNA, 13 bp, Homo sapiens
gggcccaggaggg

SEQ ID NO: 4901714 - DNA, 23 bp, Homo sapiens
gggccccccagctcaggggcagc

SEQ ID NO: 4901715 - DNA, 18 bp, Homo sapiens
gggccgaatcccctccct

SEQ ID NO: 4901716 - DNA, 20 bp, Homo sapiens
gggccgaggaggtgcctgga

SEQ ID NO: 4901717 - DNA, 20 bp, Homo sapiens
gggccgcgtggtgccatccc

SEQ ID NO: 4901718 - DNA, 23 bp, Homo sapiens
gggccgcgtggtgccatccccag

SEQ ID NO: 4901719 - DNA, 19 bp, Homo sapiens
gggcctcaaaggcccgctc

SEQ ID NO: 4901720 - DNA, 20 bp, Homo sapiens
gggcctcaaaggcccgctct

SEQ ID NO: 4901721 - DNA, 13 bp, Homo sapiens
gggcctcagtgcc

SEQ ID NO: 4901722 - DNA, 15 bp, Homo sapiens
gggcctcctgtgtgt

SEQ ID NO: 4901723 - DNA, 16 bp, Homo sapiens
gggcctcgggacctca

SEQ ID NO: 4901724 - DNA, 13 bp, Homo sapiens
gggcctgcctggc

SEQ ID NO: 4901725 - DNA, 14 bp, Homo sapiens
gggcctggacctgc

SEQ ID NO: 4901726 - DNA, 16 bp, Homo sapiens
gggcctggacctgcct

SEQ ID NO: 4901727 - DNA, 13 bp, Homo sapiens
gggcctggcaggg

SEQ ID NO: 4901728 - DNA, 14 bp, Homo sapiens
gggcctggggcctg

SEQ ID NO: 4901729 - DNA, 12 bp, Homo sapiens
gggcctgttgcc

SEQ ID NO: 4901730 - DNA, 14 bp, Homo sapiens
gggcctgttgccct

SEQ ID NO: 4901731 - DNA, 22 bp, Homo sapiens
gggccttagtgggccagggctg

SEQ ID NO: 4901732 - DNA, 12 bp, Homo sapiens
gggcggctgggt

SEQ ID NO: 4901733 - DNA, 21 bp, Homo sapiens
gggcggtgagaggggaacaga

SEQ ID NO: 4901734 - DNA, 14 bp, Homo sapiens
gggcgtgaggtccc

SEQ ID NO: 4901735 - DNA, 16 bp, Homo sapiens
gggcgtgaggtcccag

SEQ ID NO: 4901736 - DNA, 20 bp, Homo sapiens
gggctactgcagctttacat

SEQ ID NO: 4901737 - DNA, 19 bp, Homo sapiens
gggctcagcggggacagct

SEQ ID NO: 4901738 - DNA, 21 bp, Homo sapiens
gggctcctgggggtggggagg

SEQ ID NO: 4901739 - DNA, 15 bp, Homo sapiens
gggctcggaggctgc

SEQ ID NO: 4901740 - DNA, 13 bp, Homo sapiens
gggctctgcccca

SEQ ID NO: 4901741 - DNA, 16 bp, Homo sapiens
gggctgccctgagaag

SEQ ID NO: 4901742 - DNA, 18 bp, Homo sapiens
gggctggccccagggcac

SEQ ID NO: 4901743 - DNA, 19 bp, Homo sapiens
gggctggcctctggctctc

SEQ ID NO: 4901744 - DNA, 16 bp, Homo sapiens
gggctgggagctctgc

SEQ ID NO: 4901745 - DNA, 18 bp, Homo sapiens
gggctgggagctctgcag

SEQ ID NO: 4901746 - DNA, 22 bp, Homo sapiens
gggcttacctgtacactgactt

SEQ ID NO: 4901747 - DNA, 15 bp, Homo sapiens
gggcttcagtggcag

SEQ ID NO: 4901748 - DNA, 20 bp, Homo sapiens
gggcttcagtggcagctgct

SEQ ID NO: 4901749 - DNA, 23 bp, Homo sapiens
ggggaaagacactgcctgggctg

SEQ ID NO: 4901750 - DNA, 14 bp, Homo sapiens
ggggaaggggcggt

SEQ ID NO: 4901751 - DNA, 20 bp, Homo sapiens
ggggacagctccttctgtcc

SEQ ID NO: 4901752 - DNA, 13 bp, Homo sapiens
ggggacaggcctc

SEQ ID NO: 4901753 - DNA, 17 bp, Homo sapiens
ggggacaggcctcacct

SEQ ID NO: 4901754 - DNA, 16 bp, Homo sapiens
ggggacgctccgctgc

SEQ ID NO: 4901755 - DNA, 14 bp, Homo sapiens
ggggactcagccct

SEQ ID NO: 4901756 - DNA, 16 bp, Homo sapiens
ggggactcagccctga

SEQ ID NO: 4901757 - DNA, 14 bp, Homo sapiens
ggggatgtgggagg

SEQ ID NO: 4901758 - DNA, 21 bp, Homo sapiens
ggggcagccaaacccatgagg

SEQ ID NO: 4901759 - DNA, 13 bp, Homo sapiens
ggggcaggctggg

SEQ ID NO: 4901760 - DNA, 19 bp, Homo sapiens
ggggccacttttgactagg

SEQ ID NO: 4901761 - DNA, 19 bp, Homo sapiens
ggggcccaaggcggcccct

SEQ ID NO: 4901762 - DNA, 22 bp, Homo sapiens
ggggcccaaggcggcccctccc

SEQ ID NO: 4901763 - DNA, 15 bp, Homo sapiens
ggggcctcagtgcca

SEQ ID NO: 4901764 - DNA, 13 bp, Homo sapiens
ggggcctggcagg

SEQ ID NO: 4901765 - DNA, 13 bp, Homo sapiens
ggggcgtccaggc

SEQ ID NO: 4901766 - DNA, 14 bp, Homo sapiens
ggggctacaagagg

SEQ ID NO: 4901767 - DNA, 17 bp, Homo sapiens
ggggctacaagagggaa

SEQ ID NO: 4901768 - DNA, 20 bp, Homo sapiens
ggggctctcagctcagcgcc

SEQ ID NO: 4901769 - DNA, 13 bp, Homo sapiens
ggggctctggaga

SEQ ID NO: 4901770 - DNA, 14 bp, Homo sapiens
ggggctctggagag

SEQ ID NO: 4901771 - DNA, 11 bp, Homo sapiens
ggggctgggcc

SEQ ID NO: 4901772 - DNA, 17 bp, Homo sapiens
gggggaacgatgtgtct

SEQ ID NO: 4901773 - DNA, 16 bp, Homo sapiens
gggggaatgagcccag

SEQ ID NO: 4901774 - DNA, 16 bp, Homo sapiens
gggggactagcccctg

SEQ ID NO: 4901775 - DNA, 14 bp, Homo sapiens
gggggccaaaagga

SEQ ID NO: 4901776 - DNA, 12 bp, Homo sapiens
gggggccacctg

SEQ ID NO: 4901777 - DNA, 14 bp, Homo sapiens
gggggccacctgcc

SEQ ID NO: 4901778 - DNA, 14 bp, Homo sapiens
ggggtatgaagagc

SEQ ID NO: 4901779 - DNA, 21 bp, Homo sapiens
ggggtgacagtcatcatcagg

SEQ ID NO: 4901780 - DNA, 15 bp, Homo sapiens
ggggtgcagcagtga

SEQ ID NO: 4901781 - DNA, 11 bp, Homo sapiens
ggggtgctgcc

SEQ ID NO: 4901782 - DNA, 13 bp, Homo sapiens
ggggtgtcttttt

SEQ ID NO: 4901783 - DNA, 15 bp, Homo sapiens
ggggttatctctgtg

SEQ ID NO: 4901784 - DNA, 17 bp, Homo sapiens
ggggttggggtgacagt

SEQ ID NO: 4901785 - DNA, 15 bp, Homo sapiens
ggggttgtgttgtca

SEQ ID NO: 4901786 - DNA, 13 bp, Homo sapiens
gggtaagagagga

SEQ ID NO: 4901787 - DNA, 15 bp, Homo sapiens
gggtacatttataat

SEQ ID NO: 4901788 - DNA, 18 bp, Homo sapiens
gggtacccactgctctgg

SEQ ID NO: 4901789 - DNA, 22 bp, Homo sapiens
gggtacttgtggacacagctct

SEQ ID NO: 4901790 - DNA, 16 bp, Homo sapiens
gggtatatctgggctg

SEQ ID NO: 4901791 - DNA, 22 bp, Homo sapiens
gggtatgtttaatctgttatgt

SEQ ID NO: 4901792 - DNA, 10 bp, Homo sapiens
gggtattttt

SEQ ID NO: 4901793 - DNA, 17 bp, Homo sapiens
gggtcaccctctccagc

SEQ ID NO: 4901794 - DNA, 21 bp, Homo sapiens
gggtcagtctggtgggaggac

SEQ ID NO: 4901795 - DNA, 20 bp, Homo sapiens
gggtcatgtttgcaggggtg

SEQ ID NO: 4901796 - DNA, 20 bp, Homo sapiens
gggtcctaattaccagtctt

SEQ ID NO: 4901797 - DNA, 15 bp, Homo sapiens
gggtccttctccaca

SEQ ID NO: 4901798 - DNA, 16 bp, Homo sapiens
gggtcgaaagctctag

SEQ ID NO: 4901799 - DNA, 23 bp, Homo sapiens
gggtcggaacccaagcttagaac

SEQ ID NO: 4901800 - DNA, 23 bp, Homo sapiens
gggtctcactatgttgcccaggc

SEQ ID NO: 4901801 - DNA, 17 bp, Homo sapiens
gggtctctccctcaggt

SEQ ID NO: 4901802 - DNA, 12 bp, Homo sapiens
gggtctgaggaa

SEQ ID NO: 4901803 - DNA, 23 bp, Homo sapiens
gggtctgggcggcgggcggctgg

SEQ ID NO: 4901804 - DNA, 15 bp, Homo sapiens
gggtctgtgtgaatg

SEQ ID NO: 4901805 - DNA, 19 bp, Homo sapiens
gggtgaagagaaccgagca

SEQ ID NO: 4901806 - DNA, 18 bp, Homo sapiens
gggtgacagtcatcatca

SEQ ID NO: 4901807 - DNA, 18 bp, Homo sapiens
gggtgacggccctcatct

SEQ ID NO: 4901808 - DNA, 15 bp, Homo sapiens
gggtgagatgctgga

SEQ ID NO: 4901809 - DNA, 14 bp, Homo sapiens
gggtgcagcagtga

SEQ ID NO: 4901810 - DNA, 13 bp, Homo sapiens
gggtggatgcctg

SEQ ID NO: 4901811 - DNA, 15 bp, Homo sapiens
gggtgggtgctcaga

SEQ ID NO: 4901812 - DNA, 18 bp, Homo sapiens
gggtgttgtatggggagg

SEQ ID NO: 4901813 - DNA, 18 bp, Homo sapiens
gggttagatgttgccatg

SEQ ID NO: 4901814 - DNA, 18 bp, Homo sapiens
gggttatgtatcagaaga

SEQ ID NO: 4901815 - DNA, 16 bp, Homo sapiens
gggttctttcttcctc

SEQ ID NO: 4901816 - DNA, 17 bp, Homo sapiens
gggttctttcttcctct

SEQ ID NO: 4901817 - DNA, 23 bp, Homo sapiens
gggttgaaaattcaaaaagtgtt

SEQ ID NO: 4901818 - DNA, 14 bp, Homo sapiens
gggttgctggagcc

SEQ ID NO: 4901819 - DNA, 12 bp, Homo sapiens
gggttgggccca

SEQ ID NO: 4901820 - DNA, 15 bp, Homo sapiens
gggttggggccgggc

SEQ ID NO: 4901821 - DNA, 20 bp, Homo sapiens
gggtttcactgtgttagcca

SEQ ID NO: 4901822 - DNA, 15 bp, Homo sapiens
ggtaaaatgtatttt

SEQ ID NO: 4901823 - DNA, 14 bp, Homo sapiens
ggtaacagaacagc

SEQ ID NO: 4901824 - DNA, 15 bp, Homo sapiens
ggtaacagaacagct

SEQ ID NO: 4901825 - DNA, 20 bp, Homo sapiens
ggtaacaggcagatacagga

SEQ ID NO: 4901826 - DNA, 20 bp, Homo sapiens
ggtaatccaggcacagctga

SEQ ID NO: 4901827 - DNA, 19 bp, Homo sapiens
ggtacatttataattgcat

SEQ ID NO: 4901828 - DNA, 17 bp, Homo sapiens
ggtacccactgctctgg

SEQ ID NO: 4901829 - DNA, 15 bp, Homo sapiens
ggtactcttgttgag

SEQ ID NO: 4901830 - DNA, 20 bp, Homo sapiens
ggtacttcaggggcacttca

SEQ ID NO: 4901831 - DNA, 16 bp, Homo sapiens
ggtacttgtggacaca

SEQ ID NO: 4901832 - DNA, 20 bp, Homo sapiens
ggtacttgtggacacagctc

SEQ ID NO: 4901833 - DNA, 20 bp, Homo sapiens
ggtacttttgagtgtgtgtg

SEQ ID NO: 4901834 - DNA, 13 bp, Homo sapiens
ggtagaaaaacat

SEQ ID NO: 4901835 - DNA, 16 bp, Homo sapiens
ggtagaaaaagggtca

SEQ ID NO: 4901836 - DNA, 14 bp, Homo sapiens
ggtagccaggggga

SEQ ID NO: 4901837 - DNA, 20 bp, Homo sapiens
ggtaggccttttaacatttt

SEQ ID NO: 4901838 - DNA, 14 bp, Homo sapiens
ggtagggaggcagc

SEQ ID NO: 4901839 - DNA, 14 bp, Homo sapiens
ggtatcaggtgctg

SEQ ID NO: 4901840 - DNA, 22 bp, Homo sapiens
ggtatgatcacggctcactgca

SEQ ID NO: 4901841 - DNA, 20 bp, Homo sapiens
ggtattacactgtatttgta

SEQ ID NO: 4901842 - DNA, 18 bp, Homo sapiens
ggtattggtggctttcct

SEQ ID NO: 4901843 - DNA, 19 bp, Homo sapiens
ggtatttttcagagattta

SEQ ID NO: 4901844 - DNA, 21 bp, Homo sapiens
ggtcaagggcttactatttct

SEQ ID NO: 4901845 - DNA, 22 bp, Homo sapiens
ggtcacaaatcctaaaagaagc

SEQ ID NO: 4901846 - DNA, 11 bp, Homo sapiens
ggtcagagcct

SEQ ID NO: 4901847 - DNA, 20 bp, Homo sapiens
ggtcagaggacctgtattta

SEQ ID NO: 4901848 - DNA, 16 bp, Homo sapiens
ggtcagtctggtggga

SEQ ID NO: 4901849 - DNA, 20 bp, Homo sapiens
ggtcatttcttcagtcagaa

SEQ ID NO: 4901850 - DNA, 19 bp, Homo sapiens
ggtccacccaggagccccg

SEQ ID NO: 4901851 - DNA, 11 bp, Homo sapiens
ggtccagggaa

SEQ ID NO: 4901852 - DNA, 18 bp, Homo sapiens
ggtccagtggatgccaca

SEQ ID NO: 4901853 - DNA, 12 bp, Homo sapiens
ggtcccacccct

SEQ ID NO: 4901854 - DNA, 17 bp, Homo sapiens
ggtcccacctccagccc

SEQ ID NO: 4901855 - DNA, 12 bp, Homo sapiens
ggtcccactcag

SEQ ID NO: 4901856 - DNA, 15 bp, Homo sapiens
ggtcccagccacccc

SEQ ID NO: 4901857 - DNA, 13 bp, Homo sapiens
ggtccccctcagc

SEQ ID NO: 4901858 - DNA, 16 bp, Homo sapiens
ggtccggtgttctaag

SEQ ID NO: 4901859 - DNA, 21 bp, Homo sapiens
ggtccggtgttctaagatgtg

SEQ ID NO: 4901860 - DNA, 18 bp, Homo sapiens
ggtcctaaaagcaaaata

SEQ ID NO: 4901861 - DNA, 22 bp, Homo sapiens
ggtcctaattaccagtctttaa

SEQ ID NO: 4901862 - DNA, 18 bp, Homo sapiens
ggtcctgaagaattaaga

SEQ ID NO: 4901863 - DNA, 17 bp, Homo sapiens
ggtcctgagggtcccca

SEQ ID NO: 4901864 - DNA, 17 bp, Homo sapiens
ggtcctggagcagacca

SEQ ID NO: 4901865 - DNA, 12 bp, Homo sapiens
ggtcctggctcc

SEQ ID NO: 4901866 - DNA, 15 bp, Homo sapiens
ggtcctgtccccgca

SEQ ID NO: 4901867 - DNA, 14 bp, Homo sapiens
ggtccttctccaca

SEQ ID NO: 4901868 - DNA, 12 bp, Homo sapiens
ggtcgcccagga

SEQ ID NO: 4901869 - DNA, 14 bp, Homo sapiens
ggtcgcccaggaga

SEQ ID NO: 4901870 - DNA, 21 bp, Homo sapiens
ggtctcaaactcctgggctca

SEQ ID NO: 4901871 - DNA, 23 bp, Homo sapiens
ggtctcaaactcctgggctcagg

SEQ ID NO: 4901872 - DNA, 18 bp, Homo sapiens
ggtctcacagtgttgccc

SEQ ID NO: 4901873 - DNA, 22 bp, Homo sapiens
ggtctcactatgttgcccaggc

SEQ ID NO: 4901874 - DNA, 22 bp, Homo sapiens
ggtctcaggatatccttatcag

SEQ ID NO: 4901875 - DNA, 18 bp, Homo sapiens
ggtctcaggctggtggga

SEQ ID NO: 4901876 - DNA, 16 bp, Homo sapiens
ggtctctccctcaggt

SEQ ID NO: 4901877 - DNA, 10 bp, Homo sapiens
ggtctctggt

SEQ ID NO: 4901878 - DNA, 16 bp, Homo sapiens
ggtctgacccactgct

SEQ ID NO: 4901879 - DNA, 23 bp, Homo sapiens
ggtctgagccacagcagcatttt

SEQ ID NO: 4901880 - DNA, 19 bp, Homo sapiens
ggtctggactgacagcatg

SEQ ID NO: 4901881 - DNA, 24 bp, Homo sapiens
ggtctgtgtgaatgtgggcactgg

SEQ ID NO: 4901882 - DNA, 17 bp, Homo sapiens
ggtctgttctgtttcaa

SEQ ID NO: 4901883 - DNA, 12 bp, Homo sapiens
ggtcttccaggg

SEQ ID NO: 4901884 - DNA, 15 bp, Homo sapiens
ggtctttgtaagagt

SEQ ID NO: 4901885 - DNA, 19 bp, Homo sapiens
ggtctttgtaagagtgtag

SEQ ID NO: 4901886 - DNA, 14 bp, Homo sapiens
ggtctttgtatctt

SEQ ID NO: 4901887 - DNA, 15 bp, Homo sapiens
ggtctttttaaacca

SEQ ID NO: 4901888 - DNA, 14 bp, Homo sapiens
ggtgaaagggagct

SEQ ID NO: 4901889 - DNA, 21 bp, Homo sapiens
ggtgacaaagatggctcagag

SEQ ID NO: 4901890 - DNA, 14 bp, Homo sapiens
ggtgacaagagcct

SEQ ID NO: 4901891 - DNA, 20 bp, Homo sapiens
ggtgacagtcatcatcaggg

SEQ ID NO: 4901892 - DNA, 21 bp, Homo sapiens
ggtgacagtcatcatcagggc

SEQ ID NO: 4901893 - DNA, 14 bp, Homo sapiens
ggtgacatgtgaaa

SEQ ID NO: 4901894 - DNA, 18 bp, Homo sapiens
ggtgacatgtgaaacctt

SEQ ID NO: 4901895 - DNA, 16 bp, Homo sapiens
ggtgacctctgcctga

SEQ ID NO: 4901896 - DNA, 12 bp, Homo sapiens
ggtgacggccct

SEQ ID NO: 4901897 - DNA, 16 bp, Homo sapiens
ggtgagaggggaacag

SEQ ID NO: 4901898 - DNA, 21 bp, Homo sapiens
ggtgagatgctggagaagaga

SEQ ID NO: 4901899 - DNA, 16 bp, Homo sapiens
ggtgatagcattgctt

SEQ ID NO: 4901900 - DNA, 18 bp, Homo sapiens
ggtgcaaagttccctact

SEQ ID NO: 4901901 - DNA, 16 bp, Homo sapiens
ggtgcaacccttaccc

SEQ ID NO: 4901902 - DNA, 15 bp, Homo sapiens
ggtgcagacagaagt

SEQ ID NO: 4901903 - DNA, 19 bp, Homo sapiens
ggtgcccagaacttccctg

SEQ ID NO: 4901904 - DNA, 15 bp, Homo sapiens
ggtgcgatctgggtt

SEQ ID NO: 4901905 - DNA, 23 bp, Homo sapiens
ggtgctaaatggtcgcccaggag

SEQ ID NO: 4901906 - DNA, 15 bp, Homo sapiens
ggtggaaggcagaca

SEQ ID NO: 4901907 - DNA, 22 bp, Homo sapiens
ggtggaccttttaaagtgtttc

SEQ ID NO: 4901908 - DNA, 20 bp, Homo sapiens
ggtggagggtggggggcgct

SEQ ID NO: 4901909 - DNA, 14 bp, Homo sapiens
ggtggatgcctggt

SEQ ID NO: 4901910 - DNA, 21 bp, Homo sapiens
ggtggatgcctggtggcagct

SEQ ID NO: 4901911 - DNA, 13 bp, Homo sapiens
ggtggcaagagcc

SEQ ID NO: 4901912 - DNA, 12 bp, Homo sapiens
ggtggcagctgc

SEQ ID NO: 4901913 - DNA, 13 bp, Homo sapiens
ggtggcagctgcg

SEQ ID NO: 4901914 - DNA, 15 bp, Homo sapiens
ggtggcagctgcggt

SEQ ID NO: 4901915 - DNA, 15 bp, Homo sapiens
ggtggcagtggaggt

SEQ ID NO: 4901916 - DNA, 18 bp, Homo sapiens
ggtggcagtggaggtggg

SEQ ID NO: 4901917 - DNA, 20 bp, Homo sapiens
ggtggccactccagacccct

SEQ ID NO: 4901918 - DNA, 16 bp, Homo sapiens
ggtggcccgacagcct

SEQ ID NO: 4901919 - DNA, 17 bp, Homo sapiens
ggtggcccgacagcctg

SEQ ID NO: 4901920 - DNA, 18 bp, Homo sapiens
ggtggcccgacagcctgg

SEQ ID NO: 4901921 - DNA, 19 bp, Homo sapiens
ggtggcccgacagcctggc

SEQ ID NO: 4901922 - DNA, 22 bp, Homo sapiens
ggtggcctcgggacacctgccc

SEQ ID NO: 4901923 - DNA, 21 bp, Homo sapiens
ggtggctttccttgtggcaga

SEQ ID NO: 4901924 - DNA, 20 bp, Homo sapiens
ggtgggggccacctgcctgc

SEQ ID NO: 4901925 - DNA, 23 bp, Homo sapiens
ggtggggtcctggagcagaccac

SEQ ID NO: 4901926 - DNA, 12 bp, Homo sapiens
ggtgggtgctca

SEQ ID NO: 4901927 - DNA, 17 bp, Homo sapiens
ggtgtcaagagggtctg

SEQ ID NO: 4901928 - DNA, 19 bp, Homo sapiens
ggtgtcaagagggtctgag

SEQ ID NO: 4901929 - DNA, 17 bp, Homo sapiens
ggtgtcatttcattcca

SEQ ID NO: 4901930 - DNA, 13 bp, Homo sapiens
ggtgtgctctgat

SEQ ID NO: 4901931 - DNA, 21 bp, Homo sapiens
ggtgtgttggacagagaaggg

SEQ ID NO: 4901932 - DNA, 19 bp, Homo sapiens
ggtgttttttatgaagtgc

SEQ ID NO: 4901933 - DNA, 21 bp, Homo sapiens
ggttaaaactgtacatttaaa

SEQ ID NO: 4901934 - DNA, 13 bp, Homo sapiens
ggttagatgttgc

SEQ ID NO: 4901935 - DNA, 18 bp, Homo sapiens
ggttagatgttgccatgt

SEQ ID NO: 4901936 - DNA, 17 bp, Homo sapiens
ggttagcagagctggac

SEQ ID NO: 4901937 - DNA, 14 bp, Homo sapiens
ggttatctctgtgt

SEQ ID NO: 4901938 - DNA, 21 bp, Homo sapiens
ggttatgaaagaatatattta

SEQ ID NO: 4901939 - DNA, 22 bp, Homo sapiens
ggttatgtgtatgtgccattta

SEQ ID NO: 4901940 - DNA, 20 bp, Homo sapiens
ggttattgaaaatatgatgt

SEQ ID NO: 4901941 - DNA, 24 bp, Homo sapiens
ggttatttctcaacaaagcacagt

SEQ ID NO: 4901942 - DNA, 22 bp, Homo sapiens
ggttcaagcgattcttctgctt

SEQ ID NO: 4901943 - DNA, 15 bp, Homo sapiens
ggttcactaaagcag

SEQ ID NO: 4901944 - DNA, 13 bp, Homo sapiens
ggttcatgatgca

SEQ ID NO: 4901945 - DNA, 14 bp, Homo sapiens
ggttcatgatgcag

SEQ ID NO: 4901946 - DNA, 15 bp, Homo sapiens
ggttcccctgttcac

SEQ ID NO: 4901947 - DNA, 21 bp, Homo sapiens
ggttccgcactttccacttct

SEQ ID NO: 4901948 - DNA, 11 bp, Homo sapiens
ggttcctctct

SEQ ID NO: 4901949 - DNA, 14 bp, Homo sapiens
ggttcctctctggt

SEQ ID NO: 4901950 - DNA, 11 bp, Homo sapiens
ggttctaaagt

SEQ ID NO: 4901951 - DNA, 12 bp, Homo sapiens
ggttctaaagtt

SEQ ID NO: 4901952 - DNA, 18 bp, Homo sapiens
ggttctaggcatctctgt

SEQ ID NO: 4901953 - DNA, 15 bp, Homo sapiens
ggttctaggtttcaa

SEQ ID NO: 4901954 - DNA, 17 bp, Homo sapiens
ggttctttcttcctctg

SEQ ID NO: 4901955 - DNA, 23 bp, Homo sapiens
ggttctttgagggactgcctctg

SEQ ID NO: 4901956 - DNA, 14 bp, Homo sapiens
ggttgaagcaccaa

SEQ ID NO: 4901957 - DNA, 14 bp, Homo sapiens
ggttggaccccaga

SEQ ID NO: 4901958 - DNA, 15 bp, Homo sapiens
ggttggggtgacagt

SEQ ID NO: 4901959 - DNA, 20 bp, Homo sapiens
ggtttaaacttgtttgctgt

SEQ ID NO: 4901960 - DNA, 19 bp, Homo sapiens
ggtttacattcatctcatt

SEQ ID NO: 4901961 - DNA, 16 bp, Homo sapiens
ggtttcaaagatgctg

SEQ ID NO: 4901962 - DNA, 20 bp, Homo sapiens
ggtttcaaagatgctgtgag

SEQ ID NO: 4901963 - DNA, 18 bp, Homo sapiens
ggtttctctctacagtgc

SEQ ID NO: 4901964 - DNA, 20 bp, Homo sapiens
ggtttctctctacagtgcca

SEQ ID NO: 4901965 - DNA, 23 bp, Homo sapiens
ggtttgtcgggcaccagccagcg

SEQ ID NO: 4901966 - DNA, 13 bp, Homo sapiens
ggtttttacctgt

SEQ ID NO: 4901967 - DNA, 23 bp, Homo sapiens
ggtttttgtttgtttcctttgtt

SEQ ID NO: 4901968 - DNA, 9 bp, Homo sapiens
ggttttttt

SEQ ID NO: 4901969 - DNA, 23 bp, Homo sapiens
ggtttttttttttaaaaaaagaa

SEQ ID NO: 4901970 - DNA, 20 bp, Homo sapiens
gtaaaaaaaaatgcctttga

SEQ ID NO: 4901971 - DNA, 21 bp, Homo sapiens
gtaaaactacacatccctaat

SEQ ID NO: 4901972 - DNA, 17 bp, Homo sapiens
gtaaaatgtatttttct

SEQ ID NO: 4901973 - DNA, 18 bp, Homo sapiens
gtaaaatgtatttttcta

SEQ ID NO: 4901974 - DNA, 20 bp, Homo sapiens
gtaaaatgtgaagtgaatga

SEQ ID NO: 4901975 - DNA, 16 bp, Homo sapiens
gtaaaatgttgaataa

SEQ ID NO: 4901976 - DNA, 13 bp, Homo sapiens
gtaaaatttattt

SEQ ID NO: 4901977 - DNA, 22 bp, Homo sapiens
gtaaacatgtgttttaattcca

SEQ ID NO: 4901978 - DNA, 16 bp, Homo sapiens
gtaaactcaaaatatt

SEQ ID NO: 4901979 - DNA, 14 bp, Homo sapiens
gtaaagaaatttac

SEQ ID NO: 4901980 - DNA, 15 bp, Homo sapiens
gtaaagaaatttact

SEQ ID NO: 4901981 - DNA, 16 bp, Homo sapiens
gtaaagtatgtaaaca

SEQ ID NO: 4901982 - DNA, 13 bp, Homo sapiens
gtaaataccagga

SEQ ID NO: 4901983 - DNA, 16 bp, Homo sapiens
gtaaataccattgaca

SEQ ID NO: 4901984 - DNA, 15 bp, Homo sapiens
gtaaatagtatttga

SEQ ID NO: 4901985 - DNA, 20 bp, Homo sapiens
gtaaatcctgccatttaaaa

SEQ ID NO: 4901986 - DNA, 13 bp, Homo sapiens
gtaaatgttattt

SEQ ID NO: 4901987 - DNA, 15 bp, Homo sapiens
gtaaatgttatttct

SEQ ID NO: 4901988 - DNA, 16 bp, Homo sapiens
gtaacaagccacccca

SEQ ID NO: 4901989 - DNA, 22 bp, Homo sapiens
gtaacaggtattttgtttcttt

SEQ ID NO: 4901990 - DNA, 18 bp, Homo sapiens
gtaacagttcatgtttgc

SEQ ID NO: 4901991 - DNA, 20 bp, Homo sapiens
gtaacagttcatgtttgctt

SEQ ID NO: 4901992 - DNA, 20 bp, Homo sapiens
gtaacatcactatccatgca

SEQ ID NO: 4901993 - DNA, 17 bp, Homo sapiens
gtaactaggctcagaga

SEQ ID NO: 4901994 - DNA, 22 bp, Homo sapiens
gtaactatagactggaaaaaat

SEQ ID NO: 4901995 - DNA, 15 bp, Homo sapiens
gtaacttatgtagat

SEQ ID NO: 4901996 - DNA, 20 bp, Homo sapiens
gtaacttcacattaaaaaat

SEQ ID NO: 4901997 - DNA, 16 bp, Homo sapiens
gtaactttatgtgtaa

SEQ ID NO: 4901998 - DNA, 15 bp, Homo sapiens
gtaacttttgtaaga

SEQ ID NO: 4901999 - DNA, 17 bp, Homo sapiens
gtaacttttgtaagaca

SEQ ID NO: 4902000 - DNA, 17 bp, Homo sapiens
gtaagaaaagtggttgt

SEQ ID NO: 4902001 - DNA, 11 bp, Homo sapiens
gtaagaagccg

SEQ ID NO: 4902002 - DNA, 15 bp, Homo sapiens
gtaagagtgtagaag

SEQ ID NO: 4902003 - DNA, 18 bp, Homo sapiens
gtaagattatagattcta

SEQ ID NO: 4902004 - DNA, 21 bp, Homo sapiens
gtaagattatagattctaaag

SEQ ID NO: 4902005 - DNA, 22 bp, Homo sapiens
gtaagattatagattctaaaga

SEQ ID NO: 4902006 - DNA, 22 bp, Homo sapiens
gtaagccaaagaaatgaacatt

SEQ ID NO: 4902007 - DNA, 14 bp, Homo sapiens
gtaagtcagtgttg

SEQ ID NO: 4902008 - DNA, 16 bp, Homo sapiens
gtaagtgctacataaa

SEQ ID NO: 4902009 - DNA, 22 bp, Homo sapiens
gtaagtttcaggtgacatgtga

SEQ ID NO: 4902010 - DNA, 13 bp, Homo sapiens
gtaataagacata

SEQ ID NO: 4902011 - DNA, 14 bp, Homo sapiens
gtaataagacataa

SEQ ID NO: 4902012 - DNA, 23 bp, Homo sapiens
gtaataagacataacgtttttcc

SEQ ID NO: 4902013 - DNA, 21 bp, Homo sapiens
gtaataatacctcaatgtttg

SEQ ID NO: 4902014 - DNA, 22 bp, Homo sapiens
gtaataatacctcaatgtttga

SEQ ID NO: 4902015 - DNA, 20 bp, Homo sapiens
gtaatataatggaagagaaa

SEQ ID NO: 4902016 - DNA, 18 bp, Homo sapiens
gtaatatttatatattta

SEQ ID NO: 4902017 - DNA, 13 bp, Homo sapiens
gtaatattttgta

SEQ ID NO: 4902018 - DNA, 19 bp, Homo sapiens
gtaatcaatgaatattgaa

SEQ ID NO: 4902019 - DNA, 17 bp, Homo sapiens
gtaatctctctgcagct

SEQ ID NO: 4902020 - DNA, 20 bp, Homo sapiens
gtaatctctctgcagctgcc

SEQ ID NO: 4902021 - DNA, 21 bp, Homo sapiens
gtaatctctctgcagctgccg

SEQ ID NO: 4902022 - DNA, 17 bp, Homo sapiens
gtaatgaaaatgaatat

SEQ ID NO: 4902023 - DNA, 14 bp, Homo sapiens
gtaatgctgcactt

SEQ ID NO: 4902024 - DNA, 17 bp, Homo sapiens
gtaatgtaaaatccatc

SEQ ID NO: 4902025 - DNA, 14 bp, Homo sapiens
gtaattaaattatg

SEQ ID NO: 4902026 - DNA, 15 bp, Homo sapiens
gtaattcttcagttg

SEQ ID NO: 4902027 - DNA, 18 bp, Homo sapiens
gtaattgacggtttttta

SEQ ID NO: 4902028 - DNA, 17 bp, Homo sapiens
gtaatttagttattgat

SEQ ID NO: 4902029 - DNA, 15 bp, Homo sapiens
gtaatttttttcacc

SEQ ID NO: 4902030 - DNA, 14 bp, Homo sapiens
gtacaaaataaaca

SEQ ID NO: 4902031 - DNA, 16 bp, Homo sapiens
gtacaataattcatat

SEQ ID NO: 4902032 - DNA, 19 bp, Homo sapiens
gtacaataattcatattct

SEQ ID NO: 4902033 - DNA, 13 bp, Homo sapiens
gtacaatgtgttt

SEQ ID NO: 4902034 - DNA, 16 bp, Homo sapiens
gtacacacacatacac

SEQ ID NO: 4902035 - DNA, 17 bp, Homo sapiens
gtacacgtgtcctgtag

SEQ ID NO: 4902036 - DNA, 15 bp, Homo sapiens
gtacagcatgtgcct

SEQ ID NO: 4902037 - DNA, 18 bp, Homo sapiens
gtacagctgtttaagatg

SEQ ID NO: 4902038 - DNA, 17 bp, Homo sapiens
gtacagtaggataagcc

SEQ ID NO: 4902039 - DNA, 21 bp, Homo sapiens
gtacataaattgcataaagca

SEQ ID NO: 4902040 - DNA, 22 bp, Homo sapiens
gtacataaattgcataaagcat

SEQ ID NO: 4902041 - DNA, 23 bp, Homo sapiens
gtacataaattgcataaagcata

SEQ ID NO: 4902042 - DNA, 16 bp, Homo sapiens
gtacataactctgtaa

SEQ ID NO: 4902043 - DNA, 18 bp, Homo sapiens
gtacatagttatttattt

SEQ ID NO: 4902044 - DNA, 17 bp, Homo sapiens
gtacatatttattttct

SEQ ID NO: 4902045 - DNA, 11 bp, Homo sapiens
gtacatgagaa

SEQ ID NO: 4902046 - DNA, 10 bp, Homo sapiens
gtacatgtat

SEQ ID NO: 4902047 - DNA, 20 bp, Homo sapiens
gtacatgtgtagcctgtgca

SEQ ID NO: 4902048 - DNA, 15 bp, Homo sapiens
gtacatttaaaattg

SEQ ID NO: 4902049 - DNA, 21 bp, Homo sapiens
gtacatttatgatttaataaa

SEQ ID NO: 4902050 - DNA, 16 bp, Homo sapiens
gtacattttgttgtaa

SEQ ID NO: 4902051 - DNA, 13 bp, Homo sapiens
gtaccaaagtttt

SEQ ID NO: 4902052 - DNA, 21 bp, Homo sapiens
gtaccaggtattattatcttt

SEQ ID NO: 4902053 - DNA, 14 bp, Homo sapiens
gtaccatttgcatg

SEQ ID NO: 4902054 - DNA, 12 bp, Homo sapiens
gtacccactgct

SEQ ID NO: 4902055 - DNA, 13 bp, Homo sapiens
gtacccactgctc

SEQ ID NO: 4902056 - DNA, 16 bp, Homo sapiens
gtacccactgctctgg

SEQ ID NO: 4902057 - DNA, 23 bp, Homo sapiens
gtaccttttgaggagccccagct

SEQ ID NO: 4902058 - DNA, 13 bp, Homo sapiens
gtactaaatttaa

SEQ ID NO: 4902059 - DNA, 17 bp, Homo sapiens
gtactagtgttctgttt

SEQ ID NO: 4902060 - DNA, 15 bp, Homo sapiens
gtactcactgaagcc

SEQ ID NO: 4902061 - DNA, 20 bp, Homo sapiens
gtactcactgaagcctgcgt

SEQ ID NO: 4902062 - DNA, 14 bp, Homo sapiens
gtactctgaaacac

SEQ ID NO: 4902063 - DNA, 23 bp, Homo sapiens
gtactgccccccatgaggaagga

SEQ ID NO: 4902064 - DNA, 12 bp, Homo sapiens
gtactgtaataa

SEQ ID NO: 4902065 - DNA, 13 bp, Homo sapiens
gtactgtactaat

SEQ ID NO: 4902066 - DNA, 20 bp, Homo sapiens
gtactgtttaccatttttca

SEQ ID NO: 4902067 - DNA, 20 bp, Homo sapiens
gtacttagagtttctgtttg

SEQ ID NO: 4902068 - DNA, 14 bp, Homo sapiens
gtacttctccaccc

SEQ ID NO: 4902069 - DNA, 17 bp, Homo sapiens
gtacttctccaccctgc

SEQ ID NO: 4902070 - DNA, 21 bp, Homo sapiens
gtacttgtgaaacacagctgt

SEQ ID NO: 4902071 - DNA, 20 bp, Homo sapiens
gtacttgtggacacagctct

SEQ ID NO: 4902072 - DNA, 19 bp, Homo sapiens
gtacttttgagtgtgtgtg

SEQ ID NO: 4902073 - DNA, 12 bp, Homo sapiens
gtagaaaaacat

SEQ ID NO: 4902074 - DNA, 17 bp, Homo sapiens
gtagaacttactattca

SEQ ID NO: 4902075 - DNA, 18 bp, Homo sapiens
gtagaagcattccttctt

SEQ ID NO: 4902076 - DNA, 18 bp, Homo sapiens
gtagacaatcattgtttt

SEQ ID NO: 4902077 - DNA, 12 bp, Homo sapiens
gtagagacaggg

SEQ ID NO: 4902078 - DNA, 14 bp, Homo sapiens
gtagagccagcttg

SEQ ID NO: 4902079 - DNA, 16 bp, Homo sapiens
gtagagttaagaagct

SEQ ID NO: 4902080 - DNA, 15 bp, Homo sapiens
gtagataaatatttg

SEQ ID NO: 4902081 - DNA, 17 bp, Homo sapiens
gtagatattactttatc

SEQ ID NO: 4902082 - DNA, 14 bp, Homo sapiens
gtagatatttggct

SEQ ID NO: 4902083 - DNA, 16 bp, Homo sapiens
gtagattctgtggaac

SEQ ID NO: 4902084 - DNA, 14 bp, Homo sapiens
gtagccaaaggttc

SEQ ID NO: 4902085 - DNA, 18 bp, Homo sapiens
gtagccccctggcctctg

SEQ ID NO: 4902086 - DNA, 23 bp, Homo sapiens
gtagccccctggcctctgtgcct

SEQ ID NO: 4902087 - DNA, 18 bp, Homo sapiens
gtagcgttttttaaatgt

SEQ ID NO: 4902088 - DNA, 22 bp, Homo sapiens
gtagcgttttttaaatgtatac

SEQ ID NO: 4902089 - DNA, 23 bp, Homo sapiens
gtagctgccacttgaacaaaatc

SEQ ID NO: 4902090 - DNA, 12 bp, Homo sapiens
gtagctgggact

SEQ ID NO: 4902091 - DNA, 17 bp, Homo sapiens
gtagcttaccagaagct

SEQ ID NO: 4902092 - DNA, 17 bp, Homo sapiens
gtagcttacctgacaca

SEQ ID NO: 4902093 - DNA, 18 bp, Homo sapiens
gtagcttacctgacacaa

SEQ ID NO: 4902094 - DNA, 19 bp, Homo sapiens
gtagcttacctgacacaag

SEQ ID NO: 4902095 - DNA, 17 bp, Homo sapiens
gtagctttcccaaataa

SEQ ID NO: 4902096 - DNA, 14 bp, Homo sapiens
gtaggagctgcctt

SEQ ID NO: 4902097 - DNA, 23 bp, Homo sapiens
gtaggagctgccttggctcagac

SEQ ID NO: 4902098 - DNA, 18 bp, Homo sapiens
gtaggccttttaacattt

SEQ ID NO: 4902099 - DNA, 15 bp, Homo sapiens
gtagggaggcagcct

SEQ ID NO: 4902100 - DNA, 16 bp, Homo sapiens
gtagggcgggaggatg

SEQ ID NO: 4902101 - DNA, 22 bp, Homo sapiens
gtagggcgggaggatgttctgg

SEQ ID NO: 4902102 - DNA, 12 bp, Homo sapiens
gtagggctgact

SEQ ID NO: 4902103 - DNA, 15 bp, Homo sapiens
gtagtaattgacatg

SEQ ID NO: 4902104 - DNA, 17 bp, Homo sapiens
gtagtagccctttctgt

SEQ ID NO: 4902105 - DNA, 17 bp, Homo sapiens
gtagtcatttactaaac

SEQ ID NO: 4902106 - DNA, 13 bp, Homo sapiens
gtagtctgctcac

SEQ ID NO: 4902107 - DNA, 12 bp, Homo sapiens
gtagtcttgatg

SEQ ID NO: 4902108 - DNA, 13 bp, Homo sapiens
gtagttaatttat

SEQ ID NO: 4902109 - DNA, 11 bp, Homo sapiens
gtagttaggaa

SEQ ID NO: 4902110 - DNA, 13 bp, Homo sapiens
gtagttaggaaat

SEQ ID NO: 4902111 - DNA, 16 bp, Homo sapiens
gtagttaggaaataaa

SEQ ID NO: 4902112 - DNA, 13 bp, Homo sapiens
gtagttctaagac

SEQ ID NO: 4902113 - DNA, 16 bp, Homo sapiens
gtagttgtctttcctg

SEQ ID NO: 4902114 - DNA, 17 bp, Homo sapiens
gtataaactatcagttt

SEQ ID NO: 4902115 - DNA, 18 bp, Homo sapiens
gtataaagcaactgttat

SEQ ID NO: 4902116 - DNA, 21 bp, Homo sapiens
gtataaagcaactgttatgaa

SEQ ID NO: 4902117 - DNA, 23 bp, Homo sapiens
gtataaagcaactgttatgaaat

SEQ ID NO: 4902118 - DNA, 13 bp, Homo sapiens
gtataaataggag

SEQ ID NO: 4902119 - DNA, 14 bp, Homo sapiens
gtataaatgtatat

SEQ ID NO: 4902120 - DNA, 19 bp, Homo sapiens
gtataaatgtatatacaca

SEQ ID NO: 4902121 - DNA, 18 bp, Homo sapiens
gtataagatcctagatcc

SEQ ID NO: 4902122 - DNA, 22 bp, Homo sapiens
gtataagatcctagatcctaag

SEQ ID NO: 4902123 - DNA, 17 bp, Homo sapiens
gtatacaatatataaaa

SEQ ID NO: 4902124 - DNA, 20 bp, Homo sapiens
gtatactttaaataatttaa

SEQ ID NO: 4902125 - DNA, 12 bp, Homo sapiens
gtatactttagt

SEQ ID NO: 4902126 - DNA, 15 bp, Homo sapiens
gtatagacagtttgt

SEQ ID NO: 4902127 - DNA, 22 bp, Homo sapiens
gtatagacagtttgtaaatgtt

SEQ ID NO: 4902128 - DNA, 15 bp, Homo sapiens
gtatagtgtaaaata

SEQ ID NO: 4902129 - DNA, 12 bp, Homo sapiens
gtatatacacat

SEQ ID NO: 4902130 - DNA, 16 bp, Homo sapiens
gtatatacacatatac

SEQ ID NO: 4902131 - DNA, 12 bp, Homo sapiens
gtatatactttt

SEQ ID NO: 4902132 - DNA, 22 bp, Homo sapiens
gtatatatctgcttcagtggag

SEQ ID NO: 4902133 - DNA, 14 bp, Homo sapiens
gtatatatgtgtat

SEQ ID NO: 4902134 - DNA, 13 bp, Homo sapiens
gtatatgtctcag

SEQ ID NO: 4902135 - DNA, 16 bp, Homo sapiens
gtatatgttgggtgca

SEQ ID NO: 4902136 - DNA, 22 bp, Homo sapiens
gtatattacacatttgtacaga

SEQ ID NO: 4902137 - DNA, 15 bp, Homo sapiens
gtatattatttggca

SEQ ID NO: 4902138 - DNA, 12 bp, Homo sapiens
gtatatttgaaa

SEQ ID NO: 4902139 - DNA, 19 bp, Homo sapiens
gtatatttttttaatttaa

SEQ ID NO: 4902140 - DNA, 22 bp, Homo sapiens
gtatcacattttagtccagaga

SEQ ID NO: 4902141 - DNA, 16 bp, Homo sapiens
gtatcaggtgctgcca

SEQ ID NO: 4902142 - DNA, 20 bp, Homo sapiens
gtatcagtgttttaaattct

SEQ ID NO: 4902143 - DNA, 22 bp, Homo sapiens
gtatcagtgttttaaattctga

SEQ ID NO: 4902144 - DNA, 23 bp, Homo sapiens
gtatcagtgttttaaattctgag

SEQ ID NO: 4902145 - DNA, 24 bp, Homo sapiens
gtatcatctggataggagcctgct

SEQ ID NO: 4902146 - DNA, 14 bp, Homo sapiens
gtatccactttgca

SEQ ID NO: 4902147 - DNA, 20 bp, Homo sapiens
gtatcccccccctgtatagt

SEQ ID NO: 4902148 - DNA, 19 bp, Homo sapiens
gtatcccgagtctgggaca

SEQ ID NO: 4902149 - DNA, 13 bp, Homo sapiens
gtatcccttctca

SEQ ID NO: 4902150 - DNA, 15 bp, Homo sapiens
gtatcgatgttttat

SEQ ID NO: 4902151 - DNA, 16 bp, Homo sapiens
gtatcgtaaccagcca

SEQ ID NO: 4902152 - DNA, 17 bp, Homo sapiens
gtatcgtaaccagccag

SEQ ID NO: 4902153 - DNA, 20 bp, Homo sapiens
gtatctctttcacattgttt

SEQ ID NO: 4902154 - DNA, 14 bp, Homo sapiens
gtatctgagttgcc

SEQ ID NO: 4902155 - DNA, 17 bp, Homo sapiens
gtatctgagttgccaag

SEQ ID NO: 4902156 - DNA, 22 bp, Homo sapiens
gtatctgagttgccaagacaaa

SEQ ID NO: 4902157 - DNA, 19 bp, Homo sapiens
gtatcttccatatttggaa

SEQ ID NO: 4902158 - DNA, 16 bp, Homo sapiens
gtatcttttttcaaaa

SEQ ID NO: 4902159 - DNA, 19 bp, Homo sapiens
gtatgaagagcttgctttg

SEQ ID NO: 4902160 - DNA, 16 bp, Homo sapiens
gtatgacgctgataca

SEQ ID NO: 4902161 - DNA, 17 bp, Homo sapiens
gtatgacgctgatacat

SEQ ID NO: 4902162 - DNA, 19 bp, Homo sapiens
gtatgacgctgatacataa

SEQ ID NO: 4902163 - DNA, 16 bp, Homo sapiens
gtatgatgtgttgtga

SEQ ID NO: 4902164 - DNA, 13 bp, Homo sapiens
gtatggaaataaa

SEQ ID NO: 4902165 - DNA, 21 bp, Homo sapiens
gtatggagcagcctggagacc

SEQ ID NO: 4902166 - DNA, 14 bp, Homo sapiens
gtatggtggctggg

SEQ ID NO: 4902167 - DNA, 14 bp, Homo sapiens
gtatgtaaacagga

SEQ ID NO: 4902168 - DNA, 22 bp, Homo sapiens
gtatgtaatgtgtggtggcctc

SEQ ID NO: 4902169 - DNA, 13 bp, Homo sapiens
gtatgtctccagt

SEQ ID NO: 4902170 - DNA, 11 bp, Homo sapiens
gtatgtgccat

SEQ ID NO: 4902171 - DNA, 13 bp, Homo sapiens
gtatgtgtgtaga

SEQ ID NO: 4902172 - DNA, 18 bp, Homo sapiens
gtatgttgtccaattgtt

SEQ ID NO: 4902173 - DNA, 19 bp, Homo sapiens
gtatgtttaatctgttatg

SEQ ID NO: 4902174 - DNA, 13 bp, Homo sapiens
gtattaaaacatt

SEQ ID NO: 4902175 - DNA, 15 bp, Homo sapiens
gtattaaaacattgg

SEQ ID NO: 4902176 - DNA, 20 bp, Homo sapiens
gtattaaaacattggattat

SEQ ID NO: 4902177 - DNA, 23 bp, Homo sapiens
gtattaaaacattggattatcct

SEQ ID NO: 4902178 - DNA, 14 bp, Homo sapiens
gtattaatactaaa

SEQ ID NO: 4902179 - DNA, 15 bp, Homo sapiens
gtattaatactaaaa

SEQ ID NO: 4902180 - DNA, 16 bp, Homo sapiens
gtattaatcttggata

SEQ ID NO: 4902181 - DNA, 14 bp, Homo sapiens
gtattacttctgct

SEQ ID NO: 4902182 - DNA, 14 bp, Homo sapiens
gtattattgctgtt

SEQ ID NO: 4902183 - DNA, 14 bp, Homo sapiens
gtattgaatattgt

SEQ ID NO: 4902184 - DNA, 23 bp, Homo sapiens
gtattgaatattgtgttcctttt

SEQ ID NO: 4902185 - DNA, 15 bp, Homo sapiens
gtatttaagcaaata

SEQ ID NO: 4902186 - DNA, 19 bp, Homo sapiens
gtatttacgctttgattca

SEQ ID NO: 4902187 - DNA, 12 bp, Homo sapiens
gtatttataata

SEQ ID NO: 4902188 - DNA, 14 bp, Homo sapiens
gtatttatttatgt

SEQ ID NO: 4902189 - DNA, 23 bp, Homo sapiens
gtatttattttgtaattatgatt

SEQ ID NO: 4902190 - DNA, 13 bp, Homo sapiens
gtatttcagtgta

SEQ ID NO: 4902191 - DNA, 16 bp, Homo sapiens
gtatttcatgtggctg

SEQ ID NO: 4902192 - DNA, 16 bp, Homo sapiens
gtatttgttcatgttt

SEQ ID NO: 4902193 - DNA, 22 bp, Homo sapiens
gtatttgttcatgtttggtgca

SEQ ID NO: 4902194 - DNA, 12 bp, Homo sapiens
gtattttgaagt

SEQ ID NO: 4902195 - DNA, 18 bp, Homo sapiens
gtattttgaagtttacat

SEQ ID NO: 4902196 - DNA, 20 bp, Homo sapiens
gtattttgaagtttacattt

SEQ ID NO: 4902197 - DNA, 15 bp, Homo sapiens
gtattttgaatacca

SEQ ID NO: 4902198 - DNA, 14 bp, Homo sapiens
gtatttttataaat

SEQ ID NO: 4902199 - DNA, 13 bp, Homo sapiens
gtatttttatcca

SEQ ID NO: 4902200 - DNA, 19 bp, Homo sapiens
gtatttttcaataataaaa

SEQ ID NO: 4902201 - DNA, 17 bp, Homo sapiens
gtatttttctgttagct

SEQ ID NO: 4902202 - DNA, 16 bp, Homo sapiens
gtcaaaacactgtgga

SEQ ID NO: 4902203 - DNA, 21 bp, Homo sapiens
gtcaaaagttggactaaatgc

SEQ ID NO: 4902204 - DNA, 17 bp, Homo sapiens
gtcaaaattgtttaaaa

SEQ ID NO: 4902205 - DNA, 15 bp, Homo sapiens
gtcaaattatgtatt

SEQ ID NO: 4902206 - DNA, 12 bp, Homo sapiens
gtcaagaagaaa

SEQ ID NO: 4902207 - DNA, 15 bp, Homo sapiens
gtcaagaagaaaaag

SEQ ID NO: 4902208 - DNA, 17 bp, Homo sapiens
gtcaagttcctttgggt

SEQ ID NO: 4902209 - DNA, 15 bp, Homo sapiens
gtcaatcatttctca

SEQ ID NO: 4902210 - DNA, 20 bp, Homo sapiens
gtcaatcccaaaagtcacca

SEQ ID NO: 4902211 - DNA, 14 bp, Homo sapiens
gtcacaaagagttc

SEQ ID NO: 4902212 - DNA, 13 bp, Homo sapiens
gtcacaccagcca

SEQ ID NO: 4902213 - DNA, 18 bp, Homo sapiens
gtcacaggactctgcctc

SEQ ID NO: 4902214 - DNA, 15 bp, Homo sapiens
gtcacaggcaggtcc

SEQ ID NO: 4902215 - DNA, 21 bp, Homo sapiens
gtcacatggcctatgcacata

SEQ ID NO: 4902216 - DNA, 23 bp, Homo sapiens
gtcacatggcctatgcacatatg

SEQ ID NO: 4902217 - DNA, 19 bp, Homo sapiens
gtcacctagcaagctgccg

SEQ ID NO: 4902218 - DNA, 20 bp, Homo sapiens
gtcacctgaagactcattct

SEQ ID NO: 4902219 - DNA, 13 bp, Homo sapiens
gtcaccttccctt

SEQ ID NO: 4902220 - DNA, 20 bp, Homo sapiens
gtcactcattgctgagcctc

SEQ ID NO: 4902221 - DNA, 14 bp, Homo sapiens
gtcactgacacaaa

SEQ ID NO: 4902222 - DNA, 22 bp, Homo sapiens
gtcactgatgtacaattaaaaa

SEQ ID NO: 4902223 - DNA, 16 bp, Homo sapiens
gtcactgccactttgc

SEQ ID NO: 4902224 - DNA, 19 bp, Homo sapiens
gtcactggaccactgggca

SEQ ID NO: 4902225 - DNA, 21 bp, Homo sapiens
gtcactggtagaccaaaataa

SEQ ID NO: 4902226 - DNA, 18 bp, Homo sapiens
gtcagacagaacttgaat

SEQ ID NO: 4902227 - DNA, 12 bp, Homo sapiens
gtcagacataaa

SEQ ID NO: 4902228 - DNA, 13 bp, Homo sapiens
gtcagacataaag

SEQ ID NO: 4902229 - DNA, 17 bp, Homo sapiens
gtcagacataaagccat

SEQ ID NO: 4902230 - DNA, 16 bp, Homo sapiens
gtcagatgagaacaaa

SEQ ID NO: 4902231 - DNA, 15 bp, Homo sapiens
gtcaggaacagaagg

SEQ ID NO: 4902232 - DNA, 16 bp, Homo sapiens
gtcaggaacagaagga

SEQ ID NO: 4902233 - DNA, 11 bp, Homo sapiens
gtcaggccctg

SEQ ID NO: 4902234 - DNA, 12 bp, Homo sapiens
gtcaggccctgg

SEQ ID NO: 4902235 - DNA, 13 bp, Homo sapiens
gtcaggccctgga

SEQ ID NO: 4902236 - DNA, 13 bp, Homo sapiens
gtcaggccctggt

SEQ ID NO: 4902237 - DNA, 22 bp, Homo sapiens
gtcaggcccttattttcaagaa

SEQ ID NO: 4902238 - DNA, 21 bp, Homo sapiens
gtcagggcccagaggctgagt

SEQ ID NO: 4902239 - DNA, 22 bp, Homo sapiens
gtcaggtggggcagcttgaggg

SEQ ID NO: 4902240 - DNA, 13 bp, Homo sapiens
gtcaggtttaaca

SEQ ID NO: 4902241 - DNA, 16 bp, Homo sapiens
gtcagtatccaggctt

SEQ ID NO: 4902242 - DNA, 14 bp, Homo sapiens
gtcatcagccacca

SEQ ID NO: 4902243 - DNA, 20 bp, Homo sapiens
gtcatcatcagggcctgggg

SEQ ID NO: 4902244 - DNA, 22 bp, Homo sapiens
gtcatccttggtctttgtatct

SEQ ID NO: 4902245 - DNA, 23 bp, Homo sapiens
gtcatctttcttttctttgagtc

SEQ ID NO: 4902246 - DNA, 17 bp, Homo sapiens
gtcatgcataaatatgc

SEQ ID NO: 4902247 - DNA, 20 bp, Homo sapiens
gtcatggttacaaactacag

SEQ ID NO: 4902248 - DNA, 18 bp, Homo sapiens
gtcatgtgttccctttgt

SEQ ID NO: 4902249 - DNA, 16 bp, Homo sapiens
gtcatgtttgcagggg

SEQ ID NO: 4902250 - DNA, 14 bp, Homo sapiens
gtcattaatgtgtt

SEQ ID NO: 4902251 - DNA, 16 bp, Homo sapiens
gtcattagactcctcc

SEQ ID NO: 4902252 - DNA, 13 bp, Homo sapiens
gtcatttaaatgt

SEQ ID NO: 4902253 - DNA, 16 bp, Homo sapiens
gtcatttactaaacat

SEQ ID NO: 4902254 - DNA, 21 bp, Homo sapiens
gtcatttcattccattgccta

SEQ ID NO: 4902255 - DNA, 19 bp, Homo sapiens
gtcatttgagcagggctca

SEQ ID NO: 4902256 - DNA, 17 bp, Homo sapiens
gtcatttgttgtgatgt

SEQ ID NO: 4902257 - DNA, 23 bp, Homo sapiens
gtccaagaatccacatttctaaa

SEQ ID NO: 4902258 - DNA, 20 bp, Homo sapiens
gtccaaggtttaaagagtct

SEQ ID NO: 4902259 - DNA, 21 bp, Homo sapiens
gtccaaggtttaaagagtcta

SEQ ID NO: 4902260 - DNA, 14 bp, Homo sapiens
gtccactgtgtata

SEQ ID NO: 4902261 - DNA, 19 bp, Homo sapiens
gtccagcccatctcggagc

SEQ ID NO: 4902262 - DNA, 15 bp, Homo sapiens
gtccaggaacaagct

SEQ ID NO: 4902263 - DNA, 13 bp, Homo sapiens
gtccaggagcctg

SEQ ID NO: 4902264 - DNA, 13 bp, Homo sapiens
gtccagggaagct

SEQ ID NO: 4902265 - DNA, 20 bp, Homo sapiens
gtccagggaagctggccgag

SEQ ID NO: 4902266 - DNA, 17 bp, Homo sapiens
gtccagtgacctgctgg

SEQ ID NO: 4902267 - DNA, 20 bp, Homo sapiens
gtccagtgcaaccacacacc

SEQ ID NO: 4902268 - DNA, 15 bp, Homo sapiens
gtccatcagcccctc

SEQ ID NO: 4902269 - DNA, 21 bp, Homo sapiens
gtccatgcagggggctcctgg

SEQ ID NO: 4902270 - DNA, 23 bp, Homo sapiens
gtccatttatatatgaaaactat

SEQ ID NO: 4902271 - DNA, 13 bp, Homo sapiens
gtccatttgtaaa

SEQ ID NO: 4902272 - DNA, 14 bp, Homo sapiens
gtccatttgtaaaa

SEQ ID NO: 4902273 - DNA, 15 bp, Homo sapiens
gtccatttgtaaaac

SEQ ID NO: 4902274 - DNA, 23 bp, Homo sapiens
gtcccaatgcacatccattccca

SEQ ID NO: 4902275 - DNA, 15 bp, Homo sapiens
gtcccacccccaccc

SEQ ID NO: 4902276 - DNA, 19 bp, Homo sapiens
gtcccacccccacccccag

SEQ ID NO: 4902277 - DNA, 23 bp, Homo sapiens
gtcccacccccacccccagctca

SEQ ID NO: 4902278 - DNA, 17 bp, Homo sapiens
gtcccacccctccctct

SEQ ID NO: 4902279 - DNA, 15 bp, Homo sapiens
gtcccaccttggctg

SEQ ID NO: 4902280 - DNA, 22 bp, Homo sapiens
gtcccacgaatttgctggggaa

SEQ ID NO: 4902281 - DNA, 13 bp, Homo sapiens
gtcccacgtgtct

SEQ ID NO: 4902282 - DNA, 15 bp, Homo sapiens
gtcccactcagtcca

SEQ ID NO: 4902283 - DNA, 12 bp, Homo sapiens
gtcccactgtgc

SEQ ID NO: 4902284 - DNA, 12 bp, Homo sapiens
gtcccaggcaga

SEQ ID NO: 4902285 - DNA, 17 bp, Homo sapiens
gtcccagtctctggcag

SEQ ID NO: 4902286 - DNA, 16 bp, Homo sapiens
gtcccatgcaggccct

SEQ ID NO: 4902287 - DNA, 14 bp, Homo sapiens
gtccccacctggga

SEQ ID NO: 4902288 - DNA, 13 bp, Homo sapiens
gtccccctcagca

SEQ ID NO: 4902289 - DNA, 18 bp, Homo sapiens
gtccccgtggccatccct

SEQ ID NO: 4902290 - DNA, 12 bp, Homo sapiens
gtccctcccacc

SEQ ID NO: 4902291 - DNA, 14 bp, Homo sapiens
gtccctcccacctc

SEQ ID NO: 4902292 - DNA, 18 bp, Homo sapiens
gtccctcccacctctgtg

SEQ ID NO: 4902293 - DNA, 21 bp, Homo sapiens
gtccctcccacctctgtgacc

SEQ ID NO: 4902294 - DNA, 18 bp, Homo sapiens
gtccctgggccagggtct

SEQ ID NO: 4902295 - DNA, 18 bp, Homo sapiens
gtcccttcccctccctgg

SEQ ID NO: 4902296 - DNA, 20 bp, Homo sapiens
gtcccttcccctccctggct

SEQ ID NO: 4902297 - DNA, 16 bp, Homo sapiens
gtcccttgatgcacag

SEQ ID NO: 4902298 - DNA, 17 bp, Homo sapiens
gtcccttgatgcacaga

SEQ ID NO: 4902299 - DNA, 17 bp, Homo sapiens
gtccctttcagagacag

SEQ ID NO: 4902300 - DNA, 15 bp, Homo sapiens
gtcctaaaagcaaaa

SEQ ID NO: 4902301 - DNA, 15 bp, Homo sapiens
gtcctaaggaacctt

SEQ ID NO: 4902302 - DNA, 13 bp, Homo sapiens
gtcctacccaccc

SEQ ID NO: 4902303 - DNA, 15 bp, Homo sapiens
gtcctacccaccctc

SEQ ID NO: 4902304 - DNA, 12 bp, Homo sapiens
gtcctactctgt

SEQ ID NO: 4902305 - DNA, 18 bp, Homo sapiens
gtcctatctatcttccaa

SEQ ID NO: 4902306 - DNA, 17 bp, Homo sapiens
gtcctcacccctgtcct

SEQ ID NO: 4902307 - DNA, 22 bp, Homo sapiens
gtcctcacccctgtcctcactg

SEQ ID NO: 4902308 - DNA, 18 bp, Homo sapiens
gtcctcactgctccctga

SEQ ID NO: 4902309 - DNA, 16 bp, Homo sapiens
gtcctcagggagcagg

SEQ ID NO: 4902310 - DNA, 14 bp, Homo sapiens
gtcctccagaagcc

SEQ ID NO: 4902311 - DNA, 20 bp, Homo sapiens
gtcctccagaagcctctggc

SEQ ID NO: 4902312 - DNA, 22 bp, Homo sapiens
gtcctccatcccaacagccatg

SEQ ID NO: 4902313 - DNA, 17 bp, Homo sapiens
gtcctcccatcccctgg

SEQ ID NO: 4902314 - DNA, 18 bp, Homo sapiens
gtcctcccctcacagcct

SEQ ID NO: 4902315 - DNA, 19 bp, Homo sapiens
gtcctcccctcacagcctc

SEQ ID NO: 4902316 - DNA, 22 bp, Homo sapiens
gtcctcccctcacagcctctga

SEQ ID NO: 4902317 - DNA, 17 bp, Homo sapiens
gtcctgcctcagcctcc

SEQ ID NO: 4902318 - DNA, 15 bp, Homo sapiens
gtcctgcctggccag

SEQ ID NO: 4902319 - DNA, 19 bp, Homo sapiens
gtcctgcctggccaggcag

SEQ ID NO: 4902320 - DNA, 20 bp, Homo sapiens
gtcctgcctggccaggcaga

SEQ ID NO: 4902321 - DNA, 11 bp, Homo sapiens
gtcctgctcca

SEQ ID NO: 4902322 - DNA, 19 bp, Homo sapiens
gtcctggagcagaccaccc

SEQ ID NO: 4902323 - DNA, 17 bp, Homo sapiens
gtcctggatgttgtgtg

SEQ ID NO: 4902324 - DNA, 11 bp, Homo sapiens
gtcctggctcc

SEQ ID NO: 4902325 - DNA, 14 bp, Homo sapiens
gtcctggctcctga

SEQ ID NO: 4902326 - DNA, 19 bp, Homo sapiens
gtcctggctcctgaggggc

SEQ ID NO: 4902327 - DNA, 16 bp, Homo sapiens
gtcctgggagtgagct

SEQ ID NO: 4902328 - DNA, 19 bp, Homo sapiens
gtcctgggagtgagctggt

SEQ ID NO: 4902329 - DNA, 22 bp, Homo sapiens
gtccttcaaaatccttccaaag

SEQ ID NO: 4902330 - DNA, 14 bp, Homo sapiens
gtccttgaaaatat

SEQ ID NO: 4902331 - DNA, 16 bp, Homo sapiens
gtccttgcacccctca

SEQ ID NO: 4902332 - DNA, 18 bp, Homo sapiens
gtcctttccaaggcttct

SEQ ID NO: 4902333 - DNA, 11 bp, Homo sapiens
gtcctttccct

SEQ ID NO: 4902334 - DNA, 15 bp, Homo sapiens
gtccttttgtcttct

SEQ ID NO: 4902335 - DNA, 15 bp, Homo sapiens
gtcgaggggctctca

SEQ ID NO: 4902336 - DNA, 19 bp, Homo sapiens
gtcgaggggctctcagctc

SEQ ID NO: 4902337 - DNA, 14 bp, Homo sapiens
gtcggaacagcaga

SEQ ID NO: 4902338 - DNA, 23 bp, Homo sapiens
gtcgtggcagataatcagcctct

SEQ ID NO: 4902339 - DNA, 13 bp, Homo sapiens
gtctaaatttgaa

SEQ ID NO: 4902340 - DNA, 12 bp, Homo sapiens
gtctaagattct

SEQ ID NO: 4902341 - DNA, 14 bp, Homo sapiens
gtctaagattctag

SEQ ID NO: 4902342 - DNA, 16 bp, Homo sapiens
gtctaagattctagat

SEQ ID NO: 4902343 - DNA, 18 bp, Homo sapiens
gtctaagattctagatca

SEQ ID NO: 4902344 - DNA, 19 bp, Homo sapiens
gtctacactgcaatcatat

SEQ ID NO: 4902345 - DNA, 22 bp, Homo sapiens
gtctacactgcaatcatatgtg

SEQ ID NO: 4902346 - DNA, 22 bp, Homo sapiens
gtctagatgtttattcttctag

SEQ ID NO: 4902347 - DNA, 11 bp, Homo sapiens
gtctagattca

SEQ ID NO: 4902348 - DNA, 15 bp, Homo sapiens
gtctagattcaaagg

SEQ ID NO: 4902349 - DNA, 18 bp, Homo sapiens
gtctagtctctcctgtaa

SEQ ID NO: 4902350 - DNA, 20 bp, Homo sapiens
gtctataatcccagcacttt

SEQ ID NO: 4902351 - DNA, 21 bp, Homo sapiens
gtctataatcccagcactttg

SEQ ID NO: 4902352 - DNA, 10 bp, Homo sapiens
gtctatttaa

SEQ ID NO: 4902353 - DNA, 12 bp, Homo sapiens
gtctatttaagc

SEQ ID NO: 4902354 - DNA, 16 bp, Homo sapiens
gtctatttaagcctca

SEQ ID NO: 4902355 - DNA, 15 bp, Homo sapiens
gtctattttaaaata

SEQ ID NO: 4902356 - DNA, 17 bp, Homo sapiens
gtctcaaaaatacaaaa

SEQ ID NO: 4902357 - DNA, 13 bp, Homo sapiens
gtctcaaacaagg

SEQ ID NO: 4902358 - DNA, 16 bp, Homo sapiens
gtctcaaactcctggg

SEQ ID NO: 4902359 - DNA, 18 bp, Homo sapiens
gtctcactatgttgccca

SEQ ID NO: 4902360 - DNA, 22 bp, Homo sapiens
gtctcactctgtcgcccagtct

SEQ ID NO: 4902361 - DNA, 16 bp, Homo sapiens
gtctcactgttgccca

SEQ ID NO: 4902362 - DNA, 19 bp, Homo sapiens
gtctcactgttgcccaggc

SEQ ID NO: 4902363 - DNA, 18 bp, Homo sapiens
gtctcagacttttgtaca

SEQ ID NO: 4902364 - DNA, 17 bp, Homo sapiens
gtctcaggctggtggga

SEQ ID NO: 4902365 - DNA, 18 bp, Homo sapiens
gtctcaggctggtgggag

SEQ ID NO: 4902366 - DNA, 13 bp, Homo sapiens
gtctcatccccag

SEQ ID NO: 4902367 - DNA, 14 bp, Homo sapiens
gtctcatcctcctg

SEQ ID NO: 4902368 - DNA, 16 bp, Homo sapiens
gtctcattttaatgta

SEQ ID NO: 4902369 - DNA, 19 bp, Homo sapiens
gtctccactgtgcctttgc

SEQ ID NO: 4902370 - DNA, 21 bp, Homo sapiens
gtctccagtatccactttgca

SEQ ID NO: 4902371 - DNA, 20 bp, Homo sapiens
gtctcccgattcccaactga

SEQ ID NO: 4902372 - DNA, 23 bp, Homo sapiens
gtctcctcaatttttgtctcaga

SEQ ID NO: 4902373 - DNA, 16 bp, Homo sapiens
gtctcgctttgttgcc

SEQ ID NO: 4902374 - DNA, 14 bp, Homo sapiens
gtctctaaagcact

SEQ ID NO: 4902375 - DNA, 17 bp, Homo sapiens
gtctctatgccagctca

SEQ ID NO: 4902376 - DNA, 23 bp, Homo sapiens
gtctctatgccagctcagtccca

SEQ ID NO: 4902377 - DNA, 16 bp, Homo sapiens
gtctctatttcatttt

SEQ ID NO: 4902378 - DNA, 15 bp, Homo sapiens
gtctctccctcaggt

SEQ ID NO: 4902379 - DNA, 11 bp, Homo sapiens
gtctctccttt

SEQ ID NO: 4902380 - DNA, 16 bp, Homo sapiens
gtctctcttaaagttg

SEQ ID NO: 4902381 - DNA, 22 bp, Homo sapiens
gtctctgctcgccctcctttct

SEQ ID NO: 4902382 - DNA, 15 bp, Homo sapiens
gtctctgctggccca

SEQ ID NO: 4902383 - DNA, 16 bp, Homo sapiens
gtctctgctggcccag

SEQ ID NO: 4902384 - DNA, 16 bp, Homo sapiens
gtctctggcagttctg

SEQ ID NO: 4902385 - DNA, 21 bp, Homo sapiens
gtctctggcagttctggaatg

SEQ ID NO: 4902386 - DNA, 15 bp, Homo sapiens
gtctcttctccactg

SEQ ID NO: 4902387 - DNA, 16 bp, Homo sapiens
gtctcttctccactgg

SEQ ID NO: 4902388 - DNA, 15 bp, Homo sapiens
gtctcttctcccaga

SEQ ID NO: 4902389 - DNA, 18 bp, Homo sapiens
gtctctttaatgtcacag

SEQ ID NO: 4902390 - DNA, 19 bp, Homo sapiens
gtctctttaatgtcacagg

SEQ ID NO: 4902391 - DNA, 14 bp, Homo sapiens
gtctgaaaatgttg

SEQ ID NO: 4902392 - DNA, 19 bp, Homo sapiens
gtctgaaaatgttgttatg

SEQ ID NO: 4902393 - DNA, 16 bp, Homo sapiens
gtctgaagtcactgca

SEQ ID NO: 4902394 - DNA, 17 bp, Homo sapiens
gtctgaagtcactgcac

SEQ ID NO: 4902395 - DNA, 12 bp, Homo sapiens
gtctgacaggca

SEQ ID NO: 4902396 - DNA, 13 bp, Homo sapiens
gtctgacaggcaa

SEQ ID NO: 4902397 - DNA, 15 bp, Homo sapiens
gtctgacaggcaatg

SEQ ID NO: 4902398 - DNA, 15 bp, Homo sapiens
gtctgacccactgct

SEQ ID NO: 4902399 - DNA, 21 bp, Homo sapiens
gtctgagactcacaggaagga

SEQ ID NO: 4902400 - DNA, 22 bp, Homo sapiens
gtctgagactcacaggaaggag

SEQ ID NO: 4902401 - DNA, 18 bp, Homo sapiens
gtctgaggaatccagacc

SEQ ID NO: 4902402 - DNA, 21 bp, Homo sapiens
gtctgaggaatccagacccgg

SEQ ID NO: 4902403 - DNA, 20 bp, Homo sapiens
gtctgattcccaagctctgc

SEQ ID NO: 4902404 - DNA, 18 bp, Homo sapiens
gtctggactgacagcatg

SEQ ID NO: 4902405 - DNA, 18 bp, Homo sapiens
gtctggagtgggcagagc

SEQ ID NO: 4902406 - DNA, 17 bp, Homo sapiens
gtctgggctaggtagaa

SEQ ID NO: 4902407 - DNA, 16 bp, Homo sapiens
gtctggttttaacaat

SEQ ID NO: 4902408 - DNA, 19 bp, Homo sapiens
gtctgtatttatgtgtgag

SEQ ID NO: 4902409 - DNA, 16 bp, Homo sapiens
gtctgtcgtgatgggg

SEQ ID NO: 4902410 - DNA, 22 bp, Homo sapiens
gtctgtcttcacagctctgtgt

SEQ ID NO: 4902411 - DNA, 13 bp, Homo sapiens
gtctgtgtgaatg

SEQ ID NO: 4902412 - DNA, 16 bp, Homo sapiens
gtctgtgtgaatgtgg

SEQ ID NO: 4902413 - DNA, 20 bp, Homo sapiens
gtctgtgtgatgaactttct

SEQ ID NO: 4902414 - DNA, 18 bp, Homo sapiens
gtctgttctgtttcaagg

SEQ ID NO: 4902415 - DNA, 14 bp, Homo sapiens
gtctgtttaaagtg

SEQ ID NO: 4902416 - DNA, 16 bp, Homo sapiens
gtctgtttaagaaaag

SEQ ID NO: 4902417 - DNA, 20 bp, Homo sapiens
gtctgtttaagaaaagtatt

SEQ ID NO: 4902418 - DNA, 14 bp, Homo sapiens
gtctgtttgtttca

SEQ ID NO: 4902419 - DNA, 18 bp, Homo sapiens
gtctgtttgtttcaagaa

SEQ ID NO: 4902420 - DNA, 13 bp, Homo sapiens
gtcttaattatta

SEQ ID NO: 4902421 - DNA, 21 bp, Homo sapiens
gtcttaattattatttgtgtt

SEQ ID NO: 4902422 - DNA, 17 bp, Homo sapiens
gtcttatatagcagcaa

SEQ ID NO: 4902423 - DNA, 16 bp, Homo sapiens
gtcttcaacatcctgc

SEQ ID NO: 4902424 - DNA, 17 bp, Homo sapiens
gtcttcaacatcctgcc

SEQ ID NO: 4902425 - DNA, 21 bp, Homo sapiens
gtcttcaacatcctgccagcc

SEQ ID NO: 4902426 - DNA, 22 bp, Homo sapiens
gtcttcaacatcctgccagccc

SEQ ID NO: 4902427 - DNA, 16 bp, Homo sapiens
gtcttcacagctctgt

SEQ ID NO: 4902428 - DNA, 19 bp, Homo sapiens
gtcttcagcattccctccc

SEQ ID NO: 4902429 - DNA, 16 bp, Homo sapiens
gtcttccctacctcag

SEQ ID NO: 4902430 - DNA, 17 bp, Homo sapiens
gtcttccgcccctgcct

SEQ ID NO: 4902431 - DNA, 23 bp, Homo sapiens
gtcttccgcccctgcctgccatg

SEQ ID NO: 4902432 - DNA, 23 bp, Homo sapiens
gtcttctaaacttccccatcttc

SEQ ID NO: 4902433 - DNA, 16 bp, Homo sapiens
gtcttctctgtctcag

SEQ ID NO: 4902434 - DNA, 12 bp, Homo sapiens
gtcttgaaagat

SEQ ID NO: 4902435 - DNA, 15 bp, Homo sapiens
gtcttgaatgtcttt

SEQ ID NO: 4902436 - DNA, 18 bp, Homo sapiens
gtcttgatgaccaaagtc

SEQ ID NO: 4902437 - DNA, 15 bp, Homo sapiens
gtcttggacactgta

SEQ ID NO: 4902438 - DNA, 16 bp, Homo sapiens
gtcttgtaatattttg

SEQ ID NO: 4902439 - DNA, 13 bp, Homo sapiens
gtcttgttagaaa

SEQ ID NO: 4902440 - DNA, 22 bp, Homo sapiens
gtcttgttttttttttccactt

SEQ ID NO: 4902441 - DNA, 23 bp, Homo sapiens
gtctttaatttctgtcagaatgc

SEQ ID NO: 4902442 - DNA, 16 bp, Homo sapiens
gtctttcctggcacta

SEQ ID NO: 4902443 - DNA, 16 bp, Homo sapiens
gtctttctccaaagtt

SEQ ID NO: 4902444 - DNA, 22 bp, Homo sapiens
gtctttggggtctacactgcaa

SEQ ID NO: 4902445 - DNA, 15 bp, Homo sapiens
gtctttggttctaag

SEQ ID NO: 4902446 - DNA, 17 bp, Homo sapiens
gtctttggttctaagga

SEQ ID NO: 4902447 - DNA, 11 bp, Homo sapiens
gtctttgtaag

SEQ ID NO: 4902448 - DNA, 12 bp, Homo sapiens
gtctttgtaaga

SEQ ID NO: 4902449 - DNA, 15 bp, Homo sapiens
gtctttgtaagagtg

SEQ ID NO: 4902450 - DNA, 15 bp, Homo sapiens
gtctttgtaagtcag

SEQ ID NO: 4902451 - DNA, 13 bp, Homo sapiens
gtcttttatattt

SEQ ID NO: 4902452 - DNA, 18 bp, Homo sapiens
gtcttttatatttgtatc

SEQ ID NO: 4902453 - DNA, 19 bp, Homo sapiens
gtcttttatatttgtatcg

SEQ ID NO: 4902454 - DNA, 16 bp, Homo sapiens
gtcttttcaggtttgt

SEQ ID NO: 4902455 - DNA, 19 bp, Homo sapiens
gtctttttctgttgtaact

SEQ ID NO: 4902456 - DNA, 15 bp, Homo sapiens
gtgaaacacagctgt

SEQ ID NO: 4902457 - DNA, 14 bp, Homo sapiens
gtgaaacctttttt

SEQ ID NO: 4902458 - DNA, 17 bp, Homo sapiens
gtgaaagctgagaactc

SEQ ID NO: 4902459 - DNA, 21 bp, Homo sapiens
gtgaaagggagctatcaggaa

SEQ ID NO: 4902460 - DNA, 19 bp, Homo sapiens
gtgaaataacaaaatggac

SEQ ID NO: 4902461 - DNA, 19 bp, Homo sapiens
gtgaaatggatactacatc

SEQ ID NO: 4902462 - DNA, 21 bp, Homo sapiens
gtgaaatttattagttaatat

SEQ ID NO: 4902463 - DNA, 19 bp, Homo sapiens
gtgaacaaaagatgctctt

SEQ ID NO: 4902464 - DNA, 19 bp, Homo sapiens
gtgaacaggctgggctgct

SEQ ID NO: 4902465 - DNA, 23 bp, Homo sapiens
gtgaaccaccacacccagcccac

SEQ ID NO: 4902466 - DNA, 12 bp, Homo sapiens
gtgaacttgtag

SEQ ID NO: 4902467 - DNA, 15 bp, Homo sapiens
gtgaacttgtagctg

SEQ ID NO: 4902468 - DNA, 18 bp, Homo sapiens
gtgaaggcttctctgttc

SEQ ID NO: 4902469 - DNA, 19 bp, Homo sapiens
gtgaagtacaataattcat

SEQ ID NO: 4902470 - DNA, 21 bp, Homo sapiens
gtgaagtcatgacctccaggg

SEQ ID NO: 4902471 - DNA, 14 bp, Homo sapiens
gtgaagtttacatt

SEQ ID NO: 4902472 - DNA, 11 bp, Homo sapiens
gtgaatgaaag

SEQ ID NO: 4902473 - DNA, 14 bp, Homo sapiens
gtgaatggattgga

SEQ ID NO: 4902474 - DNA, 21 bp, Homo sapiens
gtgaattaattaaacattgtg

SEQ ID NO: 4902475 - DNA, 18 bp, Homo sapiens
gtgaattcttgaaggaaa

SEQ ID NO: 4902476 - DNA, 20 bp, Homo sapiens
gtgaatttatacctacctgt

SEQ ID NO: 4902477 - DNA, 19 bp, Homo sapiens
gtgaatttcttcactgttg

SEQ ID NO: 4902478 - DNA, 17 bp, Homo sapiens
gtgaatttttttttcct

SEQ ID NO: 4902479 - DNA, 19 bp, Homo sapiens
gtgacaaagatggctcaga

SEQ ID NO: 4902480 - DNA, 14 bp, Homo sapiens
gtgacaagagcctg

SEQ ID NO: 4902481 - DNA, 21 bp, Homo sapiens
gtgacaataatattgttgtat

SEQ ID NO: 4902482 - DNA, 12 bp, Homo sapiens
gtgacacagcag

SEQ ID NO: 4902483 - DNA, 19 bp, Homo sapiens
gtgacacagcagcttcacc

SEQ ID NO: 4902484 - DNA, 22 bp, Homo sapiens
gtgacacagcagcttcaccaga

SEQ ID NO: 4902485 - DNA, 23 bp, Homo sapiens
gtgacagaccacatctttatctg

SEQ ID NO: 4902486 - DNA, 13 bp, Homo sapiens
gtgacagaggcag

SEQ ID NO: 4902487 - DNA, 19 bp, Homo sapiens
gtgacagggccagtggggc

SEQ ID NO: 4902488 - DNA, 19 bp, Homo sapiens
gtgacagtcatcatcaggg

SEQ ID NO: 4902489 - DNA, 16 bp, Homo sapiens
gtgacatgtgaaacct

SEQ ID NO: 4902490 - DNA, 18 bp, Homo sapiens
gtgacatgtgaaaccttt

SEQ ID NO: 4902491 - DNA, 20 bp, Homo sapiens
gtgacattttacattaaatt

SEQ ID NO: 4902492 - DNA, 21 bp, Homo sapiens
gtgacattttacattaaattt

SEQ ID NO: 4902493 - DNA, 23 bp, Homo sapiens
gtgacccttcccaatcagcactg

SEQ ID NO: 4902494 - DNA, 14 bp, Homo sapiens
gtgacggccctcat

SEQ ID NO: 4902495 - DNA, 17 bp, Homo sapiens
gtgactatatagagatg

SEQ ID NO: 4902496 - DNA, 20 bp, Homo sapiens
gtgactatatagagatgttt

SEQ ID NO: 4902497 - DNA, 20 bp, Homo sapiens
gtgactcgagtcacactcaa

SEQ ID NO: 4902498 - DNA, 16 bp, Homo sapiens
gtgactctttttaggg

SEQ ID NO: 4902499 - DNA, 22 bp, Homo sapiens
gtgagaaaaagctcctgtcctc

SEQ ID NO: 4902500 - DNA, 18 bp, Homo sapiens
gtgagactctgtctcaaa

SEQ ID NO: 4902501 - DNA, 14 bp, Homo sapiens
gtgagcacagccta

SEQ ID NO: 4902502 - DNA, 20 bp, Homo sapiens
gtgagcagaagtggagctgg

SEQ ID NO: 4902503 - DNA, 19 bp, Homo sapiens
gtgagcaggaaggcctggg

SEQ ID NO: 4902504 - DNA, 13 bp, Homo sapiens
gtgagccactgca

SEQ ID NO: 4902505 - DNA, 14 bp, Homo sapiens
gtgagccttggctg

SEQ ID NO: 4902506 - DNA, 11 bp, Homo sapiens
gtgaggagctg

SEQ ID NO: 4902507 - DNA, 14 bp, Homo sapiens
gtgaggagctgctg

SEQ ID NO: 4902508 - DNA, 13 bp, Homo sapiens
gtgaggcccctgg

SEQ ID NO: 4902509 - DNA, 15 bp, Homo sapiens
gtgagggtcccatgt

SEQ ID NO: 4902510 - DNA, 13 bp, Homo sapiens
gtgagtaaatatt

SEQ ID NO: 4902511 - DNA, 14 bp, Homo sapiens
gtgagtcatttaaa

SEQ ID NO: 4902512 - DNA, 22 bp, Homo sapiens
gtgagtcatttaaatgtgtaca

SEQ ID NO: 4902513 - DNA, 13 bp, Homo sapiens
gtgagtgagcctg

SEQ ID NO: 4902514 - DNA, 14 bp, Homo sapiens
gtgagtgagcctgg

SEQ ID NO: 4902515 - DNA, 15 bp, Homo sapiens
gtgagtgagcctggc

SEQ ID NO: 4902516 - DNA, 14 bp, Homo sapiens
gtgagtgtgacagg

SEQ ID NO: 4902517 - DNA, 17 bp, Homo sapiens
gtgagtgtgacagggcc

SEQ ID NO: 4902518 - DNA, 20 bp, Homo sapiens
gtgagtgtgacagggccagt

SEQ ID NO: 4902519 - DNA, 16 bp, Homo sapiens
gtgatatcctgaaaaa

SEQ ID NO: 4902520 - DNA, 23 bp, Homo sapiens
gtgatccacccaaccctatctcc

SEQ ID NO: 4902521 - DNA, 15 bp, Homo sapiens
gtgatccacccacct

SEQ ID NO: 4902522 - DNA, 20 bp, Homo sapiens
gtgatccacccacctcagcc

SEQ ID NO: 4902523 - DNA, 22 bp, Homo sapiens
gtgatccacccacctcagcctc

SEQ ID NO: 4902524 - DNA, 14 bp, Homo sapiens
gtgatcctcccacc

SEQ ID NO: 4902525 - DNA, 18 bp, Homo sapiens
gtgatcctcccacctcag

SEQ ID NO: 4902526 - DNA, 20 bp, Homo sapiens
gtgatcctcccacctcagcc

SEQ ID NO: 4902527 - DNA, 22 bp, Homo sapiens
gtgatcttggcttactgcagcc

SEQ ID NO: 4902528 - DNA, 16 bp, Homo sapiens
gtgatgggctttctct

SEQ ID NO: 4902529 - DNA, 14 bp, Homo sapiens
gtgatggttcccct

SEQ ID NO: 4902530 - DNA, 12 bp, Homo sapiens
gtgatgttctaa

SEQ ID NO: 4902531 - DNA, 13 bp, Homo sapiens
gtgatgttctaag

SEQ ID NO: 4902532 - DNA, 15 bp, Homo sapiens
gtgatgtttttatga

SEQ ID NO: 4902533 - DNA, 16 bp, Homo sapiens
gtgattctaatgtctt

SEQ ID NO: 4902534 - DNA, 14 bp, Homo sapiens
gtgattctcctgcc

SEQ ID NO: 4902535 - DNA, 22 bp, Homo sapiens
gtgattctcctgcctcagcctc

SEQ ID NO: 4902536 - DNA, 12 bp, Homo sapiens
gtgattgcagct

SEQ ID NO: 4902537 - DNA, 13 bp, Homo sapiens
gtgattgcagctt

SEQ ID NO: 4902538 - DNA, 22 bp, Homo sapiens
gtgattgcagctttatgttcat

SEQ ID NO: 4902539 - DNA, 23 bp, Homo sapiens
gtgattgtggaatggagattcag

SEQ ID NO: 4902540 - DNA, 19 bp, Homo sapiens
gtgcaaaatatttgactat

SEQ ID NO: 4902541 - DNA, 15 bp, Homo sapiens
gtgcaacagacaagt

SEQ ID NO: 4902542 - DNA, 22 bp, Homo sapiens
gtgcaacccaaggactgaggga

SEQ ID NO: 4902543 - DNA, 14 bp, Homo sapiens
gtgcaacccttacc

SEQ ID NO: 4902544 - DNA, 23 bp, Homo sapiens
gtgcaacccttaccccttagcct

SEQ ID NO: 4902545 - DNA, 20 bp, Homo sapiens
gtgcaatttcaaggttctaa

SEQ ID NO: 4902546 - DNA, 15 bp, Homo sapiens
gtgcacaaatattta

SEQ ID NO: 4902547 - DNA, 12 bp, Homo sapiens
gtgcacacacca

SEQ ID NO: 4902548 - DNA, 23 bp, Homo sapiens
gtgcacacagaaatatatataca

SEQ ID NO: 4902549 - DNA, 12 bp, Homo sapiens
gtgcacagctgt

SEQ ID NO: 4902550 - DNA, 21 bp, Homo sapiens
gtgcacatgcacgtgtgtgca

SEQ ID NO: 4902551 - DNA, 21 bp, Homo sapiens
gtgcacgtggagagctggtgc

SEQ ID NO: 4902552 - DNA, 23 bp, Homo sapiens
gtgcagtggtgcgatctgggttc

SEQ ID NO: 4902553 - DNA, 13 bp, Homo sapiens
gtgcatctcagcc

SEQ ID NO: 4902554 - DNA, 15 bp, Homo sapiens
gtgccaatatgtatt

SEQ ID NO: 4902555 - DNA, 17 bp, Homo sapiens
gtgccaatatgtattgt

SEQ ID NO: 4902556 - DNA, 17 bp, Homo sapiens
gtgccagtcaagaagaa

SEQ ID NO: 4902557 - DNA, 17 bp, Homo sapiens
gtgccatagtcacatgg

SEQ ID NO: 4902558 - DNA, 20 bp, Homo sapiens
gtgcccaagaatagatgctg

SEQ ID NO: 4902559 - DNA, 21 bp, Homo sapiens
gtgcccacaccggggacaggc

SEQ ID NO: 4902560 - DNA, 17 bp, Homo sapiens
gtgcccagaacttccct

SEQ ID NO: 4902561 - DNA, 16 bp, Homo sapiens
gtgccccatgcctgtc

SEQ ID NO: 4902562 - DNA, 21 bp, Homo sapiens
gtgcccctctccttcttagct

SEQ ID NO: 4902563 - DNA, 15 bp, Homo sapiens
gtgccctcgctgctt

SEQ ID NO: 4902564 - DNA, 15 bp, Homo sapiens
gtgccgtgtgagtgt

SEQ ID NO: 4902565 - DNA, 19 bp, Homo sapiens
gtgccgtgtgagtgtgaca

SEQ ID NO: 4902566 - DNA, 21 bp, Homo sapiens
gtgccgtgtgagtgtgacagg

SEQ ID NO: 4902567 - DNA, 17 bp, Homo sapiens
gtgcctttgcaaatcag

SEQ ID NO: 4902568 - DNA, 18 bp, Homo sapiens
gtgccttttatagctatt

SEQ ID NO: 4902569 - DNA, 14 bp, Homo sapiens
gtgcgcctacagga

SEQ ID NO: 4902570 - DNA, 17 bp, Homo sapiens
gtgcgtgtgtagagtta

SEQ ID NO: 4902571 - DNA, 19 bp, Homo sapiens
gtgctcagaataaggcagg

SEQ ID NO: 4902572 - DNA, 20 bp, Homo sapiens
gtgctcagagacctgaagtg

SEQ ID NO: 4902573 - DNA, 13 bp, Homo sapiens
gtgctcatttaag

SEQ ID NO: 4902574 - DNA, 17 bp, Homo sapiens
gtgctctggacaggcat

SEQ ID NO: 4902575 - DNA, 18 bp, Homo sapiens
gtgctctggacaggcatg

SEQ ID NO: 4902576 - DNA, 21 bp, Homo sapiens
gtgctgacatggctctggact

SEQ ID NO: 4902577 - DNA, 14 bp, Homo sapiens
gtgctgagattaca

SEQ ID NO: 4902578 - DNA, 18 bp, Homo sapiens
gtgctgccatccaggttc

SEQ ID NO: 4902579 - DNA, 19 bp, Homo sapiens
gtgctgccatccaggttca

SEQ ID NO: 4902580 - DNA, 16 bp, Homo sapiens
gtgctggaggtgggag

SEQ ID NO: 4902581 - DNA, 20 bp, Homo sapiens
gtgctggatggagcccaggc

SEQ ID NO: 4902582 - DNA, 21 bp, Homo sapiens
gtgctgggattacaagcgtga

SEQ ID NO: 4902583 - DNA, 23 bp, Homo sapiens
gtgctgggggaatgagcccagag

SEQ ID NO: 4902584 - DNA, 13 bp, Homo sapiens
gtgctgtggaagc

SEQ ID NO: 4902585 - DNA, 17 bp, Homo sapiens
gtgcttctccccagaat

SEQ ID NO: 4902586 - DNA, 17 bp, Homo sapiens
gtggaacctctgtctca

SEQ ID NO: 4902587 - DNA, 15 bp, Homo sapiens
gtggaaggcagacag

SEQ ID NO: 4902588 - DNA, 18 bp, Homo sapiens
gtggaatgagtgtgcatg

SEQ ID NO: 4902589 - DNA, 18 bp, Homo sapiens
gtggacacagctcttctc

SEQ ID NO: 4902590 - DNA, 22 bp, Homo sapiens
gtggacacagctcttctccagg

SEQ ID NO: 4902591 - DNA, 17 bp, Homo sapiens
gtggactggcccctggg

SEQ ID NO: 4902592 - DNA, 16 bp, Homo sapiens
gtggacttagaaagca

SEQ ID NO: 4902593 - DNA, 18 bp, Homo sapiens
gtggacttagaaagcagg

SEQ ID NO: 4902594 - DNA, 19 bp, Homo sapiens
gtggacttagaaagcaggg

SEQ ID NO: 4902595 - DNA, 14 bp, Homo sapiens
gtggagagcccggc

SEQ ID NO: 4902596 - DNA, 16 bp, Homo sapiens
gtggagcatgggcctg

SEQ ID NO: 4902597 - DNA, 13 bp, Homo sapiens
gtggaggaaggat

SEQ ID NO: 4902598 - DNA, 15 bp, Homo sapiens
gtggaggcagccagg

SEQ ID NO: 4902599 - DNA, 16 bp, Homo sapiens
gtggatataaaatgtg

SEQ ID NO: 4902600 - DNA, 17 bp, Homo sapiens
gtggatataaaatgtgc

SEQ ID NO: 4902601 - DNA, 19 bp, Homo sapiens
gtggatccaatgttagaga

SEQ ID NO: 4902602 - DNA, 21 bp, Homo sapiens
gtggatgccacagcccagctt

SEQ ID NO: 4902603 - DNA, 18 bp, Homo sapiens
gtggattctgaggccctg

SEQ ID NO: 4902604 - DNA, 15 bp, Homo sapiens
gtggcaaatataaaa

SEQ ID NO: 4902605 - DNA, 17 bp, Homo sapiens
gtggcaagagtgtggag

SEQ ID NO: 4902606 - DNA, 9 bp, Homo sapiens
gtggcagag

SEQ ID NO: 4902607 - DNA, 19 bp, Homo sapiens
gtggcagctgcggtccacc

SEQ ID NO: 4902608 - DNA, 21 bp, Homo sapiens
gtggcagctgcggtccaccca

SEQ ID NO: 4902609 - DNA, 12 bp, Homo sapiens
gtggcagctgct

SEQ ID NO: 4902610 - DNA, 13 bp, Homo sapiens
gtggcagctgctt

SEQ ID NO: 4902611 - DNA, 19 bp, Homo sapiens
gtggcagctgcttttgtct

SEQ ID NO: 4902612 - DNA, 17 bp, Homo sapiens
gtggcagtgggagctgc

SEQ ID NO: 4902613 - DNA, 15 bp, Homo sapiens
gtggcattgaaatga

SEQ ID NO: 4902614 - DNA, 23 bp, Homo sapiens
gtggccagagctgggaggcatgg

SEQ ID NO: 4902615 - DNA, 17 bp, Homo sapiens
gtggccatccctgtgag

SEQ ID NO: 4902616 - DNA, 19 bp, Homo sapiens
gtggccctctcccttaccc

SEQ ID NO: 4902617 - DNA, 21 bp, Homo sapiens
gtggccctgccctctccttcc

SEQ ID NO: 4902618 - DNA, 16 bp, Homo sapiens
gtggccctgtccctcc

SEQ ID NO: 4902619 - DNA, 9 bp, Homo sapiens
gtggcctca

SEQ ID NO: 4902620 - DNA, 12 bp, Homo sapiens
gtggcctcagaa

SEQ ID NO: 4902621 - DNA, 11 bp, Homo sapiens
gtggcctcagc

SEQ ID NO: 4902622 - DNA, 12 bp, Homo sapiens
gtggcctggcca

SEQ ID NO: 4902623 - DNA, 13 bp, Homo sapiens
gtggctccttccc

SEQ ID NO: 4902624 - DNA, 17 bp, Homo sapiens
gtggctgaggaggcctc

SEQ ID NO: 4902625 - DNA, 11 bp, Homo sapiens
gtggctggggg

SEQ ID NO: 4902626 - DNA, 16 bp, Homo sapiens
gtggctgggggcagga

SEQ ID NO: 4902627 - DNA, 18 bp, Homo sapiens
gtggcttcccgctcagcc

SEQ ID NO: 4902628 - DNA, 20 bp, Homo sapiens
gtggcttcccgctcagccct

SEQ ID NO: 4902629 - DNA, 21 bp, Homo sapiens
gtggctttccttgtggcagag

SEQ ID NO: 4902630 - DNA, 22 bp, Homo sapiens
gtgggacccatagatcttctga

SEQ ID NO: 4902631 - DNA, 15 bp, Homo sapiens
gtgggagaaggcagt

SEQ ID NO: 4902632 - DNA, 22 bp, Homo sapiens
gtgggagcaggagattgagaag

SEQ ID NO: 4902633 - DNA, 14 bp, Homo sapiens
gtgggagctgcctg

SEQ ID NO: 4902634 - DNA, 18 bp, Homo sapiens
gtgggagctgcctgttca

SEQ ID NO: 4902635 - DNA, 13 bp, Homo sapiens
gtgggagggagca

SEQ ID NO: 4902636 - DNA, 15 bp, Homo sapiens
gtgggagggagcaga

SEQ ID NO: 4902637 - DNA, 13 bp, Homo sapiens
gtgggaggtcagg

SEQ ID NO: 4902638 - DNA, 14 bp, Homo sapiens
gtgggcttgattct

SEQ ID NO: 4902639 - DNA, 13 bp, Homo sapiens
gtggggacccagg

SEQ ID NO: 4902640 - DNA, 21 bp, Homo sapiens
gtggggacccaggctccgccc

SEQ ID NO: 4902641 - DNA, 13 bp, Homo sapiens
gtggggcttggcg

SEQ ID NO: 4902642 - DNA, 17 bp, Homo sapiens
gtggggcttggcgtgga

SEQ ID NO: 4902643 - DNA, 16 bp, Homo sapiens
gtgggtgacaagagcc

SEQ ID NO: 4902644 - DNA, 23 bp, Homo sapiens
gtgggtgagatgctggagaagag

SEQ ID NO: 4902645 - DNA, 14 bp, Homo sapiens
gtgggtgctcagaa

SEQ ID NO: 4902646 - DNA, 23 bp, Homo sapiens
gtggtaggccttttaacattttg

SEQ ID NO: 4902647 - DNA, 19 bp, Homo sapiens
gtggtctttgtaagagtgt

SEQ ID NO: 4902648 - DNA, 14 bp, Homo sapiens
gtggtgacctctgc

SEQ ID NO: 4902649 - DNA, 16 bp, Homo sapiens
gtggtgccatccccag

SEQ ID NO: 4902650 - DNA, 19 bp, Homo sapiens
gtggtgcgatctgggttca

SEQ ID NO: 4902651 - DNA, 23 bp, Homo sapiens
gtggtggcatacgcctgtagtcc

SEQ ID NO: 4902652 - DNA, 12 bp, Homo sapiens
gtggtgtaattt

SEQ ID NO: 4902653 - DNA, 14 bp, Homo sapiens
gtggtgtgatctta

SEQ ID NO: 4902654 - DNA, 14 bp, Homo sapiens
gtggttatttctca

SEQ ID NO: 4902655 - DNA, 21 bp, Homo sapiens
gtggtttgatggtgacttcct

SEQ ID NO: 4902656 - DNA, 21 bp, Homo sapiens
gtggtttggttcctctctggt

SEQ ID NO: 4902657 - DNA, 22 bp, Homo sapiens
gtgtaaattatgtaatgcaaaa

SEQ ID NO: 4902658 - DNA, 14 bp, Homo sapiens
gtgtaataagacat

SEQ ID NO: 4902659 - DNA, 22 bp, Homo sapiens
gtgtaataagacttagattgtg

SEQ ID NO: 4902660 - DNA, 16 bp, Homo sapiens
gtgtacaatgtacaca

SEQ ID NO: 4902661 - DNA, 20 bp, Homo sapiens
gtgtacaatgtacacactgg

SEQ ID NO: 4902662 - DNA, 18 bp, Homo sapiens
gtgtacatagtgtaatgt

SEQ ID NO: 4902663 - DNA, 15 bp, Homo sapiens
gtgtacttaactatt

SEQ ID NO: 4902664 - DNA, 17 bp, Homo sapiens
gtgtagagttaagaagc

SEQ ID NO: 4902665 - DNA, 18 bp, Homo sapiens
gtgtagagttaagaagct

SEQ ID NO: 4902666 - DNA, 23 bp, Homo sapiens
gtgtagccaggtatggctctgca

SEQ ID NO: 4902667 - DNA, 14 bp, Homo sapiens
gtgtatatatacat

SEQ ID NO: 4902668 - DNA, 16 bp, Homo sapiens
gtgtatatatacatac

SEQ ID NO: 4902669 - DNA, 19 bp, Homo sapiens
gtgtatattatttggcagt

SEQ ID NO: 4902670 - DNA, 19 bp, Homo sapiens
gtgtatggaaataaatgta

SEQ ID NO: 4902671 - DNA, 20 bp, Homo sapiens
gtgtcaagagggtctgagga

SEQ ID NO: 4902672 - DNA, 14 bp, Homo sapiens
gtgtcacctgaaga

SEQ ID NO: 4902673 - DNA, 22 bp, Homo sapiens
gtgtcacctgaagactcattct

SEQ ID NO: 4902674 - DNA, 15 bp, Homo sapiens
gtgtcacttgtgctt

SEQ ID NO: 4902675 - DNA, 16 bp, Homo sapiens
gtgtcagtatccaggc

SEQ ID NO: 4902676 - DNA, 13 bp, Homo sapiens
gtgtcccctccac

SEQ ID NO: 4902677 - DNA, 20 bp, Homo sapiens
gtgtcccctccactgtcaca

SEQ ID NO: 4902678 - DNA, 16 bp, Homo sapiens
gtgtccctgcacttgc

SEQ ID NO: 4902679 - DNA, 14 bp, Homo sapiens
gtgtctaagattct

SEQ ID NO: 4902680 - DNA, 15 bp, Homo sapiens
gtgtctaagattcta

SEQ ID NO: 4902681 - DNA, 23 bp, Homo sapiens
gtgtctcagggtgcagaggtcag

SEQ ID NO: 4902682 - DNA, 13 bp, Homo sapiens
gtgtctgtacacg

SEQ ID NO: 4902683 - DNA, 21 bp, Homo sapiens
gtgtctgtatttcatgtggct

SEQ ID NO: 4902684 - DNA, 14 bp, Homo sapiens
gtgtcttaattatt

SEQ ID NO: 4902685 - DNA, 19 bp, Homo sapiens
gtgtcttaattattatttg

SEQ ID NO: 4902686 - DNA, 13 bp, Homo sapiens
gtgtgaaaatggg

SEQ ID NO: 4902687 - DNA, 21 bp, Homo sapiens
gtgtgaaaggaagctccactg

SEQ ID NO: 4902688 - DNA, 20 bp, Homo sapiens
gtgtgaagtacaataattca

SEQ ID NO: 4902689 - DNA, 14 bp, Homo sapiens
gtgtgaatgaacac

SEQ ID NO: 4902690 - DNA, 11 bp, Homo sapiens
gtgtgaatgtg

SEQ ID NO: 4902691 - DNA, 23 bp, Homo sapiens
gtgtgacagggccagtggggcct

SEQ ID NO: 4902692 - DNA, 16 bp, Homo sapiens
gtgtgaggagctgctg

SEQ ID NO: 4902693 - DNA, 15 bp, Homo sapiens
gtgtgagtgtgacag

SEQ ID NO: 4902694 - DNA, 19 bp, Homo sapiens
gtgtgagtgtgacagggcc

SEQ ID NO: 4902695 - DNA, 16 bp, Homo sapiens
gtgtgcaacagacaag

SEQ ID NO: 4902696 - DNA, 13 bp, Homo sapiens
gtgtgcagtgaag

SEQ ID NO: 4902697 - DNA, 19 bp, Homo sapiens
gtgtgcctcagtatattta

SEQ ID NO: 4902698 - DNA, 18 bp, Homo sapiens
gtgtggatccaatgttag

SEQ ID NO: 4902699 - DNA, 13 bp, Homo sapiens
gtgtggctgagga

SEQ ID NO: 4902700 - DNA, 15 bp, Homo sapiens
gtgtggctgaggagg

SEQ ID NO: 4902701 - DNA, 16 bp, Homo sapiens
gtgtggtggcctcagc

SEQ ID NO: 4902702 - DNA, 17 bp, Homo sapiens
gtgtgtagacaaatatt

SEQ ID NO: 4902703 - DNA, 13 bp, Homo sapiens
gtgtgtagagtta

SEQ ID NO: 4902704 - DNA, 21 bp, Homo sapiens
gtgtgtagagttaagaagctg

SEQ ID NO: 4902705 - DNA, 14 bp, Homo sapiens
gtgtgtatgtgtat

SEQ ID NO: 4902706 - DNA, 15 bp, Homo sapiens
gtgtgtctgctcagt

SEQ ID NO: 4902707 - DNA, 15 bp, Homo sapiens
gtgtgtctgttcact

SEQ ID NO: 4902708 - DNA, 21 bp, Homo sapiens
gtgtgtcttaattattatttg

SEQ ID NO: 4902709 - DNA, 14 bp, Homo sapiens
gtgtgtgaaaggaa

SEQ ID NO: 4902710 - DNA, 11 bp, Homo sapiens
gtgtgtgccct

SEQ ID NO: 4902711 - DNA, 9 bp, Homo sapiens
gtgtgtgtg

SEQ ID NO: 4902712 - DNA, 12 bp, Homo sapiens
gtgtgtgtgtat

SEQ ID NO: 4902713 - DNA, 11 bp, Homo sapiens
gtgtgtgtgtg

SEQ ID NO: 4902714 - DNA, 13 bp, Homo sapiens
gtgtgtgtgtgca

SEQ ID NO: 4902715 - DNA, 16 bp, Homo sapiens
gtgtgtgtgtgtatgt

SEQ ID NO: 4902716 - DNA, 16 bp, Homo sapiens
gtgtgttccaagtttc

SEQ ID NO: 4902717 - DNA, 13 bp, Homo sapiens
gtgtgttgtcttg

SEQ ID NO: 4902718 - DNA, 18 bp, Homo sapiens
gtgtgttgtcttgaaaga

SEQ ID NO: 4902719 - DNA, 17 bp, Homo sapiens
gtgttaacattccaaga

SEQ ID NO: 4902720 - DNA, 15 bp, Homo sapiens
gtgttactgtaattc

SEQ ID NO: 4902721 - DNA, 12 bp, Homo sapiens
gtgttcatacat

SEQ ID NO: 4902722 - DNA, 15 bp, Homo sapiens
gtgttccctttgtct

SEQ ID NO: 4902723 - DNA, 14 bp, Homo sapiens
gtgttcgcttggct

SEQ ID NO: 4902724 - DNA, 13 bp, Homo sapiens
gtgttctaagatg

SEQ ID NO: 4902725 - DNA, 22 bp, Homo sapiens
gtgttctaagatgtgatattct

SEQ ID NO: 4902726 - DNA, 20 bp, Homo sapiens
gtgttgcccaggctggtctc

SEQ ID NO: 4902727 - DNA, 21 bp, Homo sapiens
gtgttgggatactgcagggcc

SEQ ID NO: 4902728 - DNA, 18 bp, Homo sapiens
gtgttgtaattcttcagt

SEQ ID NO: 4902729 - DNA, 15 bp, Homo sapiens
gtgttgtcattgtaa

SEQ ID NO: 4902730 - DNA, 17 bp, Homo sapiens
gtgtttaatttcttcaa

SEQ ID NO: 4902731 - DNA, 13 bp, Homo sapiens
gtgtttatttata

SEQ ID NO: 4902732 - DNA, 15 bp, Homo sapiens
gtgtttggtttacat

SEQ ID NO: 4902733 - DNA, 20 bp, Homo sapiens
gtgtttggtttacatttaaa

SEQ ID NO: 4902734 - DNA, 16 bp, Homo sapiens
gtgttttaagaaatgt

SEQ ID NO: 4902735 - DNA, 13 bp, Homo sapiens
gtgttttaattta

SEQ ID NO: 4902736 - DNA, 14 bp, Homo sapiens
gtgttttaatttaa

SEQ ID NO: 4902737 - DNA, 14 bp, Homo sapiens
gtgtttttctccag

SEQ ID NO: 4902738 - DNA, 23 bp, Homo sapiens
gttaaaactgtacatttaaaatt

SEQ ID NO: 4902739 - DNA, 19 bp, Homo sapiens
gttaaaatgtgaggaagaa

SEQ ID NO: 4902740 - DNA, 12 bp, Homo sapiens
gttaaactgtta

SEQ ID NO: 4902741 - DNA, 20 bp, Homo sapiens
gttaaatactgtgtggaact

SEQ ID NO: 4902742 - DNA, 15 bp, Homo sapiens
gttaaatgaaattgt

SEQ ID NO: 4902743 - DNA, 17 bp, Homo sapiens
gttaaatttgtaagttt

SEQ ID NO: 4902744 - DNA, 23 bp, Homo sapiens
gttaaatttgtaagtttcaggtg

SEQ ID NO: 4902745 - DNA, 17 bp, Homo sapiens
gttaactattgcattta

SEQ ID NO: 4902746 - DNA, 13 bp, Homo sapiens
gttaagaagctgt

SEQ ID NO: 4902747 - DNA, 17 bp, Homo sapiens
gttaagaagctgttgta

SEQ ID NO: 4902748 - DNA, 17 bp, Homo sapiens
gttaagacatgatttcc

SEQ ID NO: 4902749 - DNA, 14 bp, Homo sapiens
gttaagagaaactt

SEQ ID NO: 4902750 - DNA, 16 bp, Homo sapiens
gttaagcattaccact

SEQ ID NO: 4902751 - DNA, 12 bp, Homo sapiens
gttaaggaaact

SEQ ID NO: 4902752 - DNA, 21 bp, Homo sapiens
gttaaggaaactcttatctca

SEQ ID NO: 4902753 - DNA, 19 bp, Homo sapiens
gttaatctctgttatgtac

SEQ ID NO: 4902754 - DNA, 11 bp, Homo sapiens
gttaatgtatt

SEQ ID NO: 4902755 - DNA, 22 bp, Homo sapiens
gttaatgtatttgttcatgttt

SEQ ID NO: 4902756 - DNA, 23 bp, Homo sapiens
gttaatgtatttgttcatgtttg

SEQ ID NO: 4902757 - DNA, 20 bp, Homo sapiens
gttacacattaagtaatcaa

SEQ ID NO: 4902758 - DNA, 13 bp, Homo sapiens
gttaccattcaca

SEQ ID NO: 4902759 - DNA, 16 bp, Homo sapiens
gttaccgcctgtctct

SEQ ID NO: 4902760 - DNA, 16 bp, Homo sapiens
gttacctaaagtattt

SEQ ID NO: 4902761 - DNA, 22 bp, Homo sapiens
gttacctccaacagaactaaat

SEQ ID NO: 4902762 - DNA, 23 bp, Homo sapiens
gttactaattggcctctttaaga

SEQ ID NO: 4902763 - DNA, 20 bp, Homo sapiens
gttactcagggctcctccca

SEQ ID NO: 4902764 - DNA, 11 bp, Homo sapiens
gttactgttct

SEQ ID NO: 4902765 - DNA, 13 bp, Homo sapiens
gttactgttcttg

SEQ ID NO: 4902766 - DNA, 17 bp, Homo sapiens
gttactgttcttgctgc

SEQ ID NO: 4902767 - DNA, 20 bp, Homo sapiens
gttactgttcttgctgctag

SEQ ID NO: 4902768 - DNA, 21 bp, Homo sapiens
gttactgttcttgctgctaga

SEQ ID NO: 4902769 - DNA, 21 bp, Homo sapiens
gttactttatgtttgtctttt

SEQ ID NO: 4902770 - DNA, 22 bp, Homo sapiens
gttagaatataggtctcttctc

SEQ ID NO: 4902771 - DNA, 19 bp, Homo sapiens
gttagaatctattttctat

SEQ ID NO: 4902772 - DNA, 22 bp, Homo sapiens
gttagaatctattttctatgta

SEQ ID NO: 4902773 - DNA, 21 bp, Homo sapiens
gttagagagggaccatgtgtc

SEQ ID NO: 4902774 - DNA, 23 bp, Homo sapiens
gttagagagggaccatgtgtcac

SEQ ID NO: 4902775 - DNA, 14 bp, Homo sapiens
gttagcactgttga

SEQ ID NO: 4902776 - DNA, 16 bp, Homo sapiens
gttaggaaataaaacc

SEQ ID NO: 4902777 - DNA, 18 bp, Homo sapiens
gttaggaaataaaacctt

SEQ ID NO: 4902778 - DNA, 20 bp, Homo sapiens
gttaggagtgggtgacaaga

SEQ ID NO: 4902779 - DNA, 13 bp, Homo sapiens
gttataagactct

SEQ ID NO: 4902780 - DNA, 16 bp, Homo sapiens
gttatataattcactc

SEQ ID NO: 4902781 - DNA, 16 bp, Homo sapiens
gttatatcccctgcta

SEQ ID NO: 4902782 - DNA, 23 bp, Homo sapiens
gttatcaaacttcagctgtactt

SEQ ID NO: 4902783 - DNA, 21 bp, Homo sapiens
gttatcgaaataacaatgtta

SEQ ID NO: 4902784 - DNA, 12 bp, Homo sapiens
gttatctctgtg

SEQ ID NO: 4902785 - DNA, 19 bp, Homo sapiens
gttatcttctcaagttcta

SEQ ID NO: 4902786 - DNA, 21 bp, Homo sapiens
gttatcttctcaagttctaag

SEQ ID NO: 4902787 - DNA, 23 bp, Homo sapiens
gttatcttctcaagttctaagat

SEQ ID NO: 4902788 - DNA, 15 bp, Homo sapiens
gttatgaaataaaga

SEQ ID NO: 4902789 - DNA, 15 bp, Homo sapiens
gttatgactatgtaa

SEQ ID NO: 4902790 - DNA, 22 bp, Homo sapiens
gttatgtaccatatgatctgtt

SEQ ID NO: 4902791 - DNA, 14 bp, Homo sapiens
gttatgtactgtac

SEQ ID NO: 4902792 - DNA, 15 bp, Homo sapiens
gttatgtactgtact

SEQ ID NO: 4902793 - DNA, 19 bp, Homo sapiens
gttatgtactgtactaatt

SEQ ID NO: 4902794 - DNA, 18 bp, Homo sapiens
gttatgtctgtttaagaa

SEQ ID NO: 4902795 - DNA, 18 bp, Homo sapiens
gttatgtgtatgtgccat

SEQ ID NO: 4902796 - DNA, 19 bp, Homo sapiens
gttatgtgtatgtgccatt

SEQ ID NO: 4902797 - DNA, 17 bp, Homo sapiens
gttattgtacagctgtt

SEQ ID NO: 4902798 - DNA, 20 bp, Homo sapiens
gttatttatacaagattgaa

SEQ ID NO: 4902799 - DNA, 19 bp, Homo sapiens
gttatttgttattttcagt

SEQ ID NO: 4902800 - DNA, 17 bp, Homo sapiens
gttattttcagtatttt

SEQ ID NO: 4902801 - DNA, 15 bp, Homo sapiens
gttattttgataaca

SEQ ID NO: 4902802 - DNA, 17 bp, Homo sapiens
gttatttttcaaggaag

SEQ ID NO: 4902803 - DNA, 15 bp, Homo sapiens
gttcaacccacagct

SEQ ID NO: 4902804 - DNA, 16 bp, Homo sapiens
gttcaacccacagcta

SEQ ID NO: 4902805 - DNA, 19 bp, Homo sapiens
gttcaagcgattcttctgc

SEQ ID NO: 4902806 - DNA, 20 bp, Homo sapiens
gttcaataaacttaacttta

SEQ ID NO: 4902807 - DNA, 18 bp, Homo sapiens
gttcaataataaatattt

SEQ ID NO: 4902808 - DNA, 18 bp, Homo sapiens
gttcaatctcccgctgct

SEQ ID NO: 4902809 - DNA, 15 bp, Homo sapiens
gttcaattccctgaa

SEQ ID NO: 4902810 - DNA, 22 bp, Homo sapiens
gttcaatttgttagttcctgta

SEQ ID NO: 4902811 - DNA, 14 bp, Homo sapiens
gttcacaccctgca

SEQ ID NO: 4902812 - DNA, 17 bp, Homo sapiens
gttcacattagaattag

SEQ ID NO: 4902813 - DNA, 19 bp, Homo sapiens
gttcacccatcttatcaag

SEQ ID NO: 4902814 - DNA, 15 bp, Homo sapiens
gttcactaaagcagt

SEQ ID NO: 4902815 - DNA, 20 bp, Homo sapiens
gttcactgaaggtgattcac

SEQ ID NO: 4902816 - DNA, 13 bp, Homo sapiens
gttcagaacaact

SEQ ID NO: 4902817 - DNA, 19 bp, Homo sapiens
gttcagagtccttaaaatg

SEQ ID NO: 4902818 - DNA, 23 bp, Homo sapiens
gttcagcacttgtctcattttaa

SEQ ID NO: 4902819 - DNA, 19 bp, Homo sapiens
gttcagctaagctaggaat

SEQ ID NO: 4902820 - DNA, 13 bp, Homo sapiens
gttcagctccagc

SEQ ID NO: 4902821 - DNA, 16 bp, Homo sapiens
gttcagctccagctca

SEQ ID NO: 4902822 - DNA, 17 bp, Homo sapiens
gttcagctccagctcac

SEQ ID NO: 4902823 - DNA, 17 bp, Homo sapiens
gttcagctgtcctccct

SEQ ID NO: 4902824 - DNA, 19 bp, Homo sapiens
gttcagctgtcctccctcc

SEQ ID NO: 4902825 - DNA, 23 bp, Homo sapiens
gttcagcttgtaaatagctcagg

SEQ ID NO: 4902826 - DNA, 18 bp, Homo sapiens
gttcaggagtcccaagga

SEQ ID NO: 4902827 - DNA, 21 bp, Homo sapiens
gttcaggagtcccaaggaaag

SEQ ID NO: 4902828 - DNA, 15 bp, Homo sapiens
gttcaggggactcag

SEQ ID NO: 4902829 - DNA, 17 bp, Homo sapiens
gttcagggttggcccct

SEQ ID NO: 4902830 - DNA, 21 bp, Homo sapiens
gttcagggttggcccctgccc

SEQ ID NO: 4902831 - DNA, 23 bp, Homo sapiens
gttcagtctgaatgctgccacaa

SEQ ID NO: 4902832 - DNA, 14 bp, Homo sapiens
gttcatacatttga

SEQ ID NO: 4902833 - DNA, 17 bp, Homo sapiens
gttcatcctattgttga

SEQ ID NO: 4902834 - DNA, 18 bp, Homo sapiens
gttcatcctattgttgat

SEQ ID NO: 4902835 - DNA, 12 bp, Homo sapiens
gttcatgagaat

SEQ ID NO: 4902836 - DNA, 15 bp, Homo sapiens
gttcatgtttgcttc

SEQ ID NO: 4902837 - DNA, 20 bp, Homo sapiens
gttcatgtttggtgcataga

SEQ ID NO: 4902838 - DNA, 20 bp, Homo sapiens
gttcattaaagcatgaatgg

SEQ ID NO: 4902839 - DNA, 16 bp, Homo sapiens
gttcattgcactttga

SEQ ID NO: 4902840 - DNA, 18 bp, Homo sapiens
gttcatttgtgtgctcat

SEQ ID NO: 4902841 - DNA, 19 bp, Homo sapiens
gttccaaaagccaatggct

SEQ ID NO: 4902842 - DNA, 16 bp, Homo sapiens
gttccaagtttccaaa

SEQ ID NO: 4902843 - DNA, 17 bp, Homo sapiens
gttccaagtttccaaac

SEQ ID NO: 4902844 - DNA, 18 bp, Homo sapiens
gttccacagttgccacca

SEQ ID NO: 4902845 - DNA, 21 bp, Homo sapiens
gttccagcagatgccacataa

SEQ ID NO: 4902846 - DNA, 23 bp, Homo sapiens
gttccatctcctataatctgtca

SEQ ID NO: 4902847 - DNA, 22 bp, Homo sapiens
gttcccagtcttctgacaaact

SEQ ID NO: 4902848 - DNA, 18 bp, Homo sapiens
gttccccatctgggtcct

SEQ ID NO: 4902849 - DNA, 15 bp, Homo sapiens
gttcccggtcccgag

SEQ ID NO: 4902850 - DNA, 18 bp, Homo sapiens
gttcccgtttctccacct

SEQ ID NO: 4902851 - DNA, 15 bp, Homo sapiens
gttccctctccctgt

SEQ ID NO: 4902852 - DNA, 17 bp, Homo sapiens
gttccctctccctgttg

SEQ ID NO: 4902853 - DNA, 15 bp, Homo sapiens
gttccctctgctcag

SEQ ID NO: 4902854 - DNA, 18 bp, Homo sapiens
gttccctctgctcagcca

SEQ ID NO: 4902855 - DNA, 16 bp, Homo sapiens
gttccctgttcttcct

SEQ ID NO: 4902856 - DNA, 17 bp, Homo sapiens
gttccctgttcttcctc

SEQ ID NO: 4902857 - DNA, 18 bp, Homo sapiens
gttccctgttcttcctcc

SEQ ID NO: 4902858 - DNA, 12 bp, Homo sapiens
gttcccttggcc

SEQ ID NO: 4902859 - DNA, 13 bp, Homo sapiens
gttcccttggcct

SEQ ID NO: 4902860 - DNA, 19 bp, Homo sapiens
gttccctttgtctttcaaa

SEQ ID NO: 4902861 - DNA, 23 bp, Homo sapiens
gttccgcactttccacttcttcc

SEQ ID NO: 4902862 - DNA, 17 bp, Homo sapiens
gttcctaagaagcttct

SEQ ID NO: 4902863 - DNA, 21 bp, Homo sapiens
gttcctaagaagcttctaata

SEQ ID NO: 4902864 - DNA, 17 bp, Homo sapiens
gttcctccccgccttcc

SEQ ID NO: 4902865 - DNA, 17 bp, Homo sapiens
gttcctgacatcacagc

SEQ ID NO: 4902866 - DNA, 19 bp, Homo sapiens
gttcctttgtgtgtactca

SEQ ID NO: 4902867 - DNA, 22 bp, Homo sapiens
gttcgaggactacaaccaattt

SEQ ID NO: 4902868 - DNA, 12 bp, Homo sapiens
gttcgcttggct

SEQ ID NO: 4902869 - DNA, 12 bp, Homo sapiens
gttctaaagctc

SEQ ID NO: 4902870 - DNA, 12 bp, Homo sapiens
gttctaaagttc

SEQ ID NO: 4902871 - DNA, 14 bp, Homo sapiens
gttctaaagttcta

SEQ ID NO: 4902872 - DNA, 15 bp, Homo sapiens
gttctaaagttctaa

SEQ ID NO: 4902873 - DNA, 14 bp, Homo sapiens
gttctaagaaaccc

SEQ ID NO: 4902874 - DNA, 22 bp, Homo sapiens
gttctaagatgtgatattctaa

SEQ ID NO: 4902875 - DNA, 13 bp, Homo sapiens
gttctaagattct

SEQ ID NO: 4902876 - DNA, 14 bp, Homo sapiens
gttctaagattcta

SEQ ID NO: 4902877 - DNA, 15 bp, Homo sapiens
gttctaagattctaa

SEQ ID NO: 4902878 - DNA, 17 bp, Homo sapiens
gttctaagattctaatg

SEQ ID NO: 4902879 - DNA, 21 bp, Homo sapiens
gttctaaggcctaggattcta

SEQ ID NO: 4902880 - DNA, 12 bp, Homo sapiens
gttctaaggctc

SEQ ID NO: 4902881 - DNA, 14 bp, Homo sapiens
gttctaaggctctg

SEQ ID NO: 4902882 - DNA, 17 bp, Homo sapiens
gttctaaggctctgaga

SEQ ID NO: 4902883 - DNA, 19 bp, Homo sapiens
gttctaataatttctaatg

SEQ ID NO: 4902884 - DNA, 17 bp, Homo sapiens
gttctacccgttccaaa

SEQ ID NO: 4902885 - DNA, 22 bp, Homo sapiens
gttctagacatggaggttctaa

SEQ ID NO: 4902886 - DNA, 23 bp, Homo sapiens
gttctaggcactgtagttctaag

SEQ ID NO: 4902887 - DNA, 14 bp, Homo sapiens
gttctatccaaaca

SEQ ID NO: 4902888 - DNA, 23 bp, Homo sapiens
gttctcaatgtgaaaaatgtgtc

SEQ ID NO: 4902889 - DNA, 20 bp, Homo sapiens
gttctccctcccaccttaaa

SEQ ID NO: 4902890 - DNA, 16 bp, Homo sapiens
gttctgcactgaaaag

SEQ ID NO: 4902891 - DNA, 20 bp, Homo sapiens
gttctgcagacacgccttcc

SEQ ID NO: 4902892 - DNA, 15 bp, Homo sapiens
gttctgccagatctt

SEQ ID NO: 4902893 - DNA, 13 bp, Homo sapiens
gttctggccagaa

SEQ ID NO: 4902894 - DNA, 16 bp, Homo sapiens
gttctggccagaatgc

SEQ ID NO: 4902895 - DNA, 23 bp, Homo sapiens
gttctgggacacagttcaattct

SEQ ID NO: 4902896 - DNA, 14 bp, Homo sapiens
gttctgggctcttt

SEQ ID NO: 4902897 - DNA, 18 bp, Homo sapiens
gttctgggctctttcctc

SEQ ID NO: 4902898 - DNA, 18 bp, Homo sapiens
gttctgtttcaaggcact

SEQ ID NO: 4902899 - DNA, 22 bp, Homo sapiens
gttctgtttgttattgttttgt

SEQ ID NO: 4902900 - DNA, 23 bp, Homo sapiens
gttctgtttgttattgttttgtt

SEQ ID NO: 4902901 - DNA, 21 bp, Homo sapiens
gttcttcctccagctgcacca

SEQ ID NO: 4902902 - DNA, 12 bp, Homo sapiens
gttcttgctgct

SEQ ID NO: 4902903 - DNA, 20 bp, Homo sapiens
gttcttgctgctagaacttt

SEQ ID NO: 4902904 - DNA, 15 bp, Homo sapiens
gttctttcttcctct

SEQ ID NO: 4902905 - DNA, 18 bp, Homo sapiens
gttctttcttcctctgct

SEQ ID NO: 4902906 - DNA, 23 bp, Homo sapiens
gttctttgctgcattctgcctct

SEQ ID NO: 4902907 - DNA, 19 bp, Homo sapiens
gttgaaaattattttaaac

SEQ ID NO: 4902908 - DNA, 22 bp, Homo sapiens
gttgaaaattcaaaaagtgttt

SEQ ID NO: 4902909 - DNA, 18 bp, Homo sapiens
gttgaaccaaacctccct

SEQ ID NO: 4902910 - DNA, 16 bp, Homo sapiens
gttgacaactgtgact

SEQ ID NO: 4902911 - DNA, 17 bp, Homo sapiens
gttgacagttctgaaga

SEQ ID NO: 4902912 - DNA, 24 bp, Homo sapiens
gttgacttatagtacatgataaat

SEQ ID NO: 4902913 - DNA, 16 bp, Homo sapiens
gttgagaatcccaaat

SEQ ID NO: 4902914 - DNA, 16 bp, Homo sapiens
gttgaggaactgtaca

SEQ ID NO: 4902915 - DNA, 22 bp, Homo sapiens
gttgatgatctttgcagacagg

SEQ ID NO: 4902916 - DNA, 14 bp, Homo sapiens
gttgatgtatctga

SEQ ID NO: 4902917 - DNA, 21 bp, Homo sapiens
gttgatgtatctgagttgcca

SEQ ID NO: 4902918 - DNA, 20 bp, Homo sapiens
gttgccaaatctggctcctt

SEQ ID NO: 4902919 - DNA, 16 bp, Homo sapiens
gttgccaagacaaatc

SEQ ID NO: 4902920 - DNA, 20 bp, Homo sapiens
gttgccaccacctctgtggc

SEQ ID NO: 4902921 - DNA, 14 bp, Homo sapiens
gttgcccaggcagg

SEQ ID NO: 4902922 - DNA, 23 bp, Homo sapiens
gttgcccaggcaggtcttgaact

SEQ ID NO: 4902923 - DNA, 17 bp, Homo sapiens
gttgcccaggctggcgt

SEQ ID NO: 4902924 - DNA, 18 bp, Homo sapiens
gttgcctaagcattgcct

SEQ ID NO: 4902925 - DNA, 18 bp, Homo sapiens
gttgcctaagtattaaaa

SEQ ID NO: 4902926 - DNA, 19 bp, Homo sapiens
gttgctgtgtttaatttga

SEQ ID NO: 4902927 - DNA, 20 bp, Homo sapiens
gttggaagcttgttttccag

SEQ ID NO: 4902928 - DNA, 13 bp, Homo sapiens
gttggactaaatg

SEQ ID NO: 4902929 - DNA, 23 bp, Homo sapiens
gttggactaaatgcctagttttt

SEQ ID NO: 4902930 - DNA, 16 bp, Homo sapiens
gttggcagtgagtgag

SEQ ID NO: 4902931 - DNA, 23 bp, Homo sapiens
gttggcagtgagtgagcctggct

SEQ ID NO: 4902932 - DNA, 23 bp, Homo sapiens
gttggccaaagccaaagctaggc

SEQ ID NO: 4902933 - DNA, 13 bp, Homo sapiens
gttggccaggctg

SEQ ID NO: 4902934 - DNA, 15 bp, Homo sapiens
gttggccaggctggt

SEQ ID NO: 4902935 - DNA, 17 bp, Homo sapiens
gttggccaggctggtct

SEQ ID NO: 4902936 - DNA, 18 bp, Homo sapiens
gttggccaggctggtcta

SEQ ID NO: 4902937 - DNA, 23 bp, Homo sapiens
gttggctgggggcctcagtgcca

SEQ ID NO: 4902938 - DNA, 12 bp, Homo sapiens
gttgggcatgtg

SEQ ID NO: 4902939 - DNA, 14 bp, Homo sapiens
gttggggtgacagt

SEQ ID NO: 4902940 - DNA, 13 bp, Homo sapiens
gttgggtggatgc

SEQ ID NO: 4902941 - DNA, 23 bp, Homo sapiens
gttggtccagagcggaggctgtg

SEQ ID NO: 4902942 - DNA, 13 bp, Homo sapiens
gttgtaaaaagaa

SEQ ID NO: 4902943 - DNA, 18 bp, Homo sapiens
gttgtacatttatgattt

SEQ ID NO: 4902944 - DNA, 14 bp, Homo sapiens
gttgtataatttcg

SEQ ID NO: 4902945 - DNA, 13 bp, Homo sapiens
gttgtattaacaa

SEQ ID NO: 4902946 - DNA, 20 bp, Homo sapiens
gttgtcattgtaaacaaact

SEQ ID NO: 4902947 - DNA, 22 bp, Homo sapiens
gttgtctgaagtcactgcacag

SEQ ID NO: 4902948 - DNA, 21 bp, Homo sapiens
gttgtgatgtcttttcttggc

SEQ ID NO: 4902949 - DNA, 23 bp, Homo sapiens
gttgttaaaattatgaatctgat

SEQ ID NO: 4902950 - DNA, 15 bp, Homo sapiens
gttgtttctttctag

SEQ ID NO: 4902951 - DNA, 13 bp, Homo sapiens
gtttaaaacagta

SEQ ID NO: 4902952 - DNA, 19 bp, Homo sapiens
gtttaaaacagtatttatt

SEQ ID NO: 4902953 - DNA, 22 bp, Homo sapiens
gtttaacatttgccttgcagaa

SEQ ID NO: 4902954 - DNA, 23 bp, Homo sapiens
gtttaagaaaaaataacacacat

SEQ ID NO: 4902955 - DNA, 12 bp, Homo sapiens
gtttaatattta

SEQ ID NO: 4902956 - DNA, 14 bp, Homo sapiens
gtttaatctgttat

SEQ ID NO: 4902957 - DNA, 15 bp, Homo sapiens
gtttaattgtttgtc

SEQ ID NO: 4902958 - DNA, 16 bp, Homo sapiens
gtttacaagtgtatat

SEQ ID NO: 4902959 - DNA, 13 bp, Homo sapiens
gtttacagaaaaa

SEQ ID NO: 4902960 - DNA, 18 bp, Homo sapiens
gtttacagaaaaatcttg

SEQ ID NO: 4902961 - DNA, 18 bp, Homo sapiens
gtttacaggccctgctcc

SEQ ID NO: 4902962 - DNA, 22 bp, Homo sapiens
gtttacatgtgtagcctatgtt

SEQ ID NO: 4902963 - DNA, 18 bp, Homo sapiens
gtttacatttaaagcatt

SEQ ID NO: 4902964 - DNA, 22 bp, Homo sapiens
gtttacctgaataaatggtagt

SEQ ID NO: 4902965 - DNA, 23 bp, Homo sapiens
gtttactgttttgaaatcaatgc

SEQ ID NO: 4902966 - DNA, 13 bp, Homo sapiens
gtttactttcaaa

SEQ ID NO: 4902967 - DNA, 15 bp, Homo sapiens
gtttagaagctgaga

SEQ ID NO: 4902968 - DNA, 12 bp, Homo sapiens
gtttagaccaag

SEQ ID NO: 4902969 - DNA, 15 bp, Homo sapiens
gtttagaccaaggaa

SEQ ID NO: 4902970 - DNA, 13 bp, Homo sapiens
gtttataaaatat

SEQ ID NO: 4902971 - DNA, 18 bp, Homo sapiens
gtttataaaatataaaca

SEQ ID NO: 4902972 - DNA, 21 bp, Homo sapiens
gtttatattttttcagttgtt

SEQ ID NO: 4902973 - DNA, 18 bp, Homo sapiens
gtttatcagatacatcac

SEQ ID NO: 4902974 - DNA, 21 bp, Homo sapiens
gtttatcagatacatcactgc

SEQ ID NO: 4902975 - DNA, 23 bp, Homo sapiens
gtttatcagatacatcactgctt

SEQ ID NO: 4902976 - DNA, 16 bp, Homo sapiens
gtttatcatgaagcct

SEQ ID NO: 4902977 - DNA, 18 bp, Homo sapiens
gtttatgagatgctggtt

SEQ ID NO: 4902978 - DNA, 13 bp, Homo sapiens
gtttatggcctca

SEQ ID NO: 4902979 - DNA, 14 bp, Homo sapiens
gtttatggcctcag

SEQ ID NO: 4902980 - DNA, 18 bp, Homo sapiens
gtttatggcctcagctgc

SEQ ID NO: 4902981 - DNA, 23 bp, Homo sapiens
gtttatggcctcagctgcctcac

SEQ ID NO: 4902982 - DNA, 18 bp, Homo sapiens
gtttattataaactgtat

SEQ ID NO: 4902983 - DNA, 20 bp, Homo sapiens
gtttattcttctagagttca

SEQ ID NO: 4902984 - DNA, 18 bp, Homo sapiens
gtttatttttcatattgt

SEQ ID NO: 4902985 - DNA, 19 bp, Homo sapiens
gtttcaaagatgctgtgag

SEQ ID NO: 4902986 - DNA, 23 bp, Homo sapiens
gtttcaaccaagtcatgtgcatt

SEQ ID NO: 4902987 - DNA, 19 bp, Homo sapiens
gtttcaaggcactctagat

SEQ ID NO: 4902988 - DNA, 19 bp, Homo sapiens
gtttcaatgtgattctaat

SEQ ID NO: 4902989 - DNA, 21 bp, Homo sapiens
gtttcaatgtgattctaatgt

SEQ ID NO: 4902990 - DNA, 22 bp, Homo sapiens
gtttcacccttaacccaaggag

SEQ ID NO: 4902991 - DNA, 23 bp, Homo sapiens
gtttcagctaagggaagacattt

SEQ ID NO: 4902992 - DNA, 18 bp, Homo sapiens
gtttcatgttttgtgact

SEQ ID NO: 4902993 - DNA, 16 bp, Homo sapiens
gtttcattctcctgcc

SEQ ID NO: 4902994 - DNA, 16 bp, Homo sapiens
gtttccaacctggagt

SEQ ID NO: 4902995 - DNA, 16 bp, Homo sapiens
gtttcgtttctgtata

SEQ ID NO: 4902996 - DNA, 18 bp, Homo sapiens
gtttctaagattctaaag

SEQ ID NO: 4902997 - DNA, 11 bp, Homo sapiens
gtttctaaggt

SEQ ID NO: 4902998 - DNA, 14 bp, Homo sapiens
gtttctcaaatctt

SEQ ID NO: 4902999 - DNA, 14 bp, Homo sapiens
gtttctcagctccc

SEQ ID NO: 4903000 - DNA, 14 bp, Homo sapiens
gtttctcatttgtt

SEQ ID NO: 4903001 - DNA, 19 bp, Homo sapiens
gtttctctctacagtgcca

SEQ ID NO: 4903002 - DNA, 13 bp, Homo sapiens
gtttctgagaaaa

SEQ ID NO: 4903003 - DNA, 22 bp, Homo sapiens
gtttctgaggctttatgataat

SEQ ID NO: 4903004 - DNA, 13 bp, Homo sapiens
gtttctgtctgta

SEQ ID NO: 4903005 - DNA, 13 bp, Homo sapiens
gtttcttagcttt

SEQ ID NO: 4903006 - DNA, 16 bp, Homo sapiens
gtttcttagcttttta

SEQ ID NO: 4903007 - DNA, 20 bp, Homo sapiens
gtttcttctgcgcctcaggc

SEQ ID NO: 4903008 - DNA, 13 bp, Homo sapiens
gtttcttgcttgt

SEQ ID NO: 4903009 - DNA, 18 bp, Homo sapiens
gtttcttgcttgtacctc

SEQ ID NO: 4903010 - DNA, 13 bp, Homo sapiens
gtttcttgtttat

SEQ ID NO: 4903011 - DNA, 18 bp, Homo sapiens
gtttctttctagtggtct

SEQ ID NO: 4903012 - DNA, 23 bp, Homo sapiens
gtttctttctagtggtctttgta

SEQ ID NO: 4903013 - DNA, 17 bp, Homo sapiens
gtttgaaggaaacagtt

SEQ ID NO: 4903014 - DNA, 13 bp, Homo sapiens
gtttgaatatgga

SEQ ID NO: 4903015 - DNA, 14 bp, Homo sapiens
gtttgaatatggac

SEQ ID NO: 4903016 - DNA, 21 bp, Homo sapiens
gtttgacctcacagtgaccct

SEQ ID NO: 4903017 - DNA, 15 bp, Homo sapiens
gtttgagatgctgta

SEQ ID NO: 4903018 - DNA, 15 bp, Homo sapiens
gtttgcaggggtgac

SEQ ID NO: 4903019 - DNA, 14 bp, Homo sapiens
gtttgccatacttt

SEQ ID NO: 4903020 - DNA, 15 bp, Homo sapiens
gtttgccatactttg

SEQ ID NO: 4903021 - DNA, 22 bp, Homo sapiens
gtttgccatactttgtctgaaa

SEQ ID NO: 4903022 - DNA, 16 bp, Homo sapiens
gtttgcctctgcctct

SEQ ID NO: 4903023 - DNA, 18 bp, Homo sapiens
gtttgccttcctttctcc

SEQ ID NO: 4903024 - DNA, 16 bp, Homo sapiens
gtttggatgtaattta

SEQ ID NO: 4903025 - DNA, 14 bp, Homo sapiens
gtttggcttcctcc

SEQ ID NO: 4903026 - DNA, 16 bp, Homo sapiens
gtttggcttcctcctg

SEQ ID NO: 4903027 - DNA, 13 bp, Homo sapiens
gtttggtttacat

SEQ ID NO: 4903028 - DNA, 14 bp, Homo sapiens
gtttggtttacatt

SEQ ID NO: 4903029 - DNA, 20 bp, Homo sapiens
gtttggtttacatttaaagc

SEQ ID NO: 4903030 - DNA, 13 bp, Homo sapiens
gtttgtaaaacta

SEQ ID NO: 4903031 - DNA, 17 bp, Homo sapiens
gtttgtagttgttttaa

SEQ ID NO: 4903032 - DNA, 13 bp, Homo sapiens
gtttgtatgtgtg

SEQ ID NO: 4903033 - DNA, 20 bp, Homo sapiens
gtttgtatgtgtgtagacaa

SEQ ID NO: 4903034 - DNA, 12 bp, Homo sapiens
gtttgtatttgg

SEQ ID NO: 4903035 - DNA, 15 bp, Homo sapiens
gtttgtctattttaa

SEQ ID NO: 4903036 - DNA, 16 bp, Homo sapiens
gtttgtctctcctttt

SEQ ID NO: 4903037 - DNA, 15 bp, Homo sapiens
gtttgtgtgtcttaa

SEQ ID NO: 4903038 - DNA, 15 bp, Homo sapiens
gtttgtgtgttgtct

SEQ ID NO: 4903039 - DNA, 18 bp, Homo sapiens
gtttgtttcaagaacctg

SEQ ID NO: 4903040 - DNA, 14 bp, Homo sapiens
gtttgtttctttgt

SEQ ID NO: 4903041 - DNA, 14 bp, Homo sapiens
gtttgtttgtctgt

SEQ ID NO: 4903042 - DNA, 13 bp, Homo sapiens
gtttgtttttgct

SEQ ID NO: 4903043 - DNA, 16 bp, Homo sapiens
gtttgtttttgcttgt

SEQ ID NO: 4903044 - DNA, 16 bp, Homo sapiens
gttttaagtactacac

SEQ ID NO: 4903045 - DNA, 20 bp, Homo sapiens
gttttaatctgaaattctaa

SEQ ID NO: 4903046 - DNA, 20 bp, Homo sapiens
gttttaattccaatatgatg

SEQ ID NO: 4903047 - DNA, 14 bp, Homo sapiens
gttttactgtgaaa

SEQ ID NO: 4903048 - DNA, 16 bp, Homo sapiens
gttttaggttctaaag

SEQ ID NO: 4903049 - DNA, 17 bp, Homo sapiens
gttttaggttctaaagt

SEQ ID NO: 4903050 - DNA, 12 bp, Homo sapiens
gttttcactctt

SEQ ID NO: 4903051 - DNA, 20 bp, Homo sapiens
gttttcagaacctcttcccc

SEQ ID NO: 4903052 - DNA, 23 bp, Homo sapiens
gttttcatggtgaaaatgtactg

SEQ ID NO: 4903053 - DNA, 22 bp, Homo sapiens
gttttcctctatacatctctcc

SEQ ID NO: 4903054 - DNA, 24 bp, Homo sapiens
gttttcctctatacatctctcccc

SEQ ID NO: 4903055 - DNA, 21 bp, Homo sapiens
gttttctcctcccaggaactg

SEQ ID NO: 4903056 - DNA, 19 bp, Homo sapiens
gttttctcctgcctgtgct

SEQ ID NO: 4903057 - DNA, 19 bp, Homo sapiens
gttttctctcggctcccca

SEQ ID NO: 4903058 - DNA, 18 bp, Homo sapiens
gttttctgtagtcattta

SEQ ID NO: 4903059 - DNA, 23 bp, Homo sapiens
gttttctgtagtcatttactaaa

SEQ ID NO: 4903060 - DNA, 19 bp, Homo sapiens
gttttcttccttgtaaatt

SEQ ID NO: 4903061 - DNA, 17 bp, Homo sapiens
gttttctttctttaaat

SEQ ID NO: 4903062 - DNA, 22 bp, Homo sapiens
gttttgaaaacctaaaagacag

SEQ ID NO: 4903063 - DNA, 15 bp, Homo sapiens
gttttgaaaagctat

SEQ ID NO: 4903064 - DNA, 21 bp, Homo sapiens
gttttgaaaagctattagcca

SEQ ID NO: 4903065 - DNA, 21 bp, Homo sapiens
gttttgaaggcaaaattgcaa

SEQ ID NO: 4903066 - DNA, 16 bp, Homo sapiens
gttttgatatgagtat

SEQ ID NO: 4903067 - DNA, 21 bp, Homo sapiens
gttttgccatgttggccaggc

SEQ ID NO: 4903068 - DNA, 19 bp, Homo sapiens
gttttggatcttgaatgtg

SEQ ID NO: 4903069 - DNA, 22 bp, Homo sapiens
gttttgggggtcaggcagccag

SEQ ID NO: 4903070 - DNA, 17 bp, Homo sapiens
gttttgtacatagattt

SEQ ID NO: 4903071 - DNA, 18 bp, Homo sapiens
gttttgtacatagattta

SEQ ID NO: 4903072 - DNA, 22 bp, Homo sapiens
gttttgtatacaaatatattgt

SEQ ID NO: 4903073 - DNA, 15 bp, Homo sapiens
gttttgtttgtctct

SEQ ID NO: 4903074 - DNA, 15 bp, Homo sapiens
gtttttaaaagtttc

SEQ ID NO: 4903075 - DNA, 18 bp, Homo sapiens
gtttttaaaagtttcaat

SEQ ID NO: 4903076 - DNA, 18 bp, Homo sapiens
gtttttaaatgaggatta

SEQ ID NO: 4903077 - DNA, 18 bp, Homo sapiens
gtttttaatataaagcct

SEQ ID NO: 4903078 - DNA, 21 bp, Homo sapiens
gtttttacctgtcacattgca

SEQ ID NO: 4903079 - DNA, 20 bp, Homo sapiens
gtttttagtaatctgtacat

SEQ ID NO: 4903080 - DNA, 16 bp, Homo sapiens
gtttttattccttgtg

SEQ ID NO: 4903081 - DNA, 14 bp, Homo sapiens
gtttttcctttaaa

SEQ ID NO: 4903082 - DNA, 16 bp, Homo sapiens
gtttttctccagtgct

SEQ ID NO: 4903083 - DNA, 16 bp, Homo sapiens
gtttttctgggtggcc

SEQ ID NO: 4903084 - DNA, 13 bp, Homo sapiens
gttttttcctttg

SEQ ID NO: 4903085 - DNA, 11 bp, Homo sapiens
gtttttttgcc

SEQ ID NO: 4903086 - DNA, 16 bp, Homo sapiens
gtttttttttttaaaa

SEQ ID NO: 4903087 - DNA, 20 bp, Homo sapiens
gttttttttttttttatgtg

SEQ ID NO: 4903088 - DNA, 19 bp, Homo sapiens
taaaaaaaaagatctgttt

SEQ ID NO: 4903089 - DNA, 16 bp, Homo sapiens
taaaaaaaaatgcctt

SEQ ID NO: 4903090 - DNA, 15 bp, Homo sapiens
taaaaaatgaaaata

SEQ ID NO: 4903091 - DNA, 13 bp, Homo sapiens
taaaaaatgaaat

SEQ ID NO: 4903092 - DNA, 18 bp, Homo sapiens
taaaaaattatgacaatg

SEQ ID NO: 4903093 - DNA, 17 bp, Homo sapiens
taaaaacccacaaaaat

SEQ ID NO: 4903094 - DNA, 23 bp, Homo sapiens
taaaaacccacaaaaatgttgaa

SEQ ID NO: 4903095 - DNA, 15 bp, Homo sapiens
taaaaagattagcaa

SEQ ID NO: 4903096 - DNA, 18 bp, Homo sapiens
taaaaaggacatcagcaa

SEQ ID NO: 4903097 - DNA, 17 bp, Homo sapiens
taaaaagtgacacagca

SEQ ID NO: 4903098 - DNA, 12 bp, Homo sapiens
taaaaagtggaa

SEQ ID NO: 4903099 - DNA, 18 bp, Homo sapiens
taaaaagtggaatttctt

SEQ ID NO: 4903100 - DNA, 21 bp, Homo sapiens
taaaaataaatagaaaagtag

SEQ ID NO: 4903101 - DNA, 22 bp, Homo sapiens
taaaaatatatatagtgctata

SEQ ID NO: 4903102 - DNA, 21 bp, Homo sapiens
taaaaatattgtgttgtgaat

SEQ ID NO: 4903103 - DNA, 11 bp, Homo sapiens
taaaacaaaac

SEQ ID NO: 4903104 - DNA, 12 bp, Homo sapiens
taaaacaaaaca

SEQ ID NO: 4903105 - DNA, 17 bp, Homo sapiens
taaaacaaaacaaaaca

SEQ ID NO: 4903106 - DNA, 17 bp, Homo sapiens
taaaacaacagctcgat

SEQ ID NO: 4903107 - DNA, 22 bp, Homo sapiens
taaaacaacagctcgatccaaa

SEQ ID NO: 4903108 - DNA, 23 bp, Homo sapiens
taaaacagctgtctctaacttat

SEQ ID NO: 4903109 - DNA, 13 bp, Homo sapiens
taaaacagtattt

SEQ ID NO: 4903110 - DNA, 20 bp, Homo sapiens
taaaacattatagattttca

SEQ ID NO: 4903111 - DNA, 15 bp, Homo sapiens
taaaacattggatta

SEQ ID NO: 4903112 - DNA, 17 bp, Homo sapiens
taaaacattggattatc

SEQ ID NO: 4903113 - DNA, 19 bp, Homo sapiens
taaaacattggattatcct

SEQ ID NO: 4903114 - DNA, 20 bp, Homo sapiens
taaaacattggattatcctg

SEQ ID NO: 4903115 - DNA, 10 bp, Homo sapiens
taaaaccttt

SEQ ID NO: 4903116 - DNA, 14 bp, Homo sapiens
taaaacctttcaaa

SEQ ID NO: 4903117 - DNA, 21 bp, Homo sapiens
taaaacctttcaaatttcaca

SEQ ID NO: 4903118 - DNA, 22 bp, Homo sapiens
taaaactatattcatttccact

SEQ ID NO: 4903119 - DNA, 13 bp, Homo sapiens
taaaactgctttt

SEQ ID NO: 4903120 - DNA, 13 bp, Homo sapiens
taaaacttcttaa

SEQ ID NO: 4903121 - DNA, 15 bp, Homo sapiens
taaaacttcttaaat

SEQ ID NO: 4903122 - DNA, 19 bp, Homo sapiens
taaaacttcttaaatatct

SEQ ID NO: 4903123 - DNA, 14 bp, Homo sapiens
taaaactttgctgc

SEQ ID NO: 4903124 - DNA, 16 bp, Homo sapiens
taaaactttgctgcca

SEQ ID NO: 4903125 - DNA, 19 bp, Homo sapiens
taaaagaatttttttgtct

SEQ ID NO: 4903126 - DNA, 20 bp, Homo sapiens
taaaagaatttttttgtctt

SEQ ID NO: 4903127 - DNA, 22 bp, Homo sapiens
taaaagatgaagttttatacac

SEQ ID NO: 4903128 - DNA, 13 bp, Homo sapiens
taaaagcaaaata

SEQ ID NO: 4903129 - DNA, 20 bp, Homo sapiens
taaaagcgttggatgtagca

SEQ ID NO: 4903130 - DNA, 21 bp, Homo sapiens
taaaaggaaatctcaccccat

SEQ ID NO: 4903131 - DNA, 18 bp, Homo sapiens
taaaaggatagtattttt

SEQ ID NO: 4903132 - DNA, 23 bp, Homo sapiens
taaaaggatagtatttttatcca

SEQ ID NO: 4903133 - DNA, 19 bp, Homo sapiens
taaaagtgaatgaaagatt

SEQ ID NO: 4903134 - DNA, 23 bp, Homo sapiens
taaaagtgaatgaaagattaaac

SEQ ID NO: 4903135 - DNA, 22 bp, Homo sapiens
taaaagtgggcttgattctgca

SEQ ID NO: 4903136 - DNA, 15 bp, Homo sapiens
taaaagttgtgattc

SEQ ID NO: 4903137 - DNA, 18 bp, Homo sapiens
taaaagtttcaatgtgat

SEQ ID NO: 4903138 - DNA, 14 bp, Homo sapiens
taaaataaacagtt

SEQ ID NO: 4903139 - DNA, 18 bp, Homo sapiens
taaaataatttctctaca

SEQ ID NO: 4903140 - DNA, 16 bp, Homo sapiens
taaaatagagtgtagt

SEQ ID NO: 4903141 - DNA, 18 bp, Homo sapiens
taaaatagcttgtatagt

SEQ ID NO: 4903142 - DNA, 22 bp, Homo sapiens
taaaatattcctgcatttgtga

SEQ ID NO: 4903143 - DNA, 22 bp, Homo sapiens
taaaatcctaagacacaaatgc

SEQ ID NO: 4903144 - DNA, 17 bp, Homo sapiens
taaaatctattctgtgt

SEQ ID NO: 4903145 - DNA, 13 bp, Homo sapiens
taaaatcttatag

SEQ ID NO: 4903146 - DNA, 17 bp, Homo sapiens
taaaatcttatagttct

SEQ ID NO: 4903147 - DNA, 13 bp, Homo sapiens
taaaatcttggaa

SEQ ID NO: 4903148 - DNA, 22 bp, Homo sapiens
taaaatcttggaagtacatgaa

SEQ ID NO: 4903149 - DNA, 15 bp, Homo sapiens
taaaatgactactta

SEQ ID NO: 4903150 - DNA, 16 bp, Homo sapiens
taaaatgattgtaaaa

SEQ ID NO: 4903151 - DNA, 18 bp, Homo sapiens
taaaatgattgtaaaata

SEQ ID NO: 4903152 - DNA, 20 bp, Homo sapiens
taaaatgattgtaaaatagc

SEQ ID NO: 4903153 - DNA, 12 bp, Homo sapiens
taaaatggaatt

SEQ ID NO: 4903154 - DNA, 13 bp, Homo sapiens
taaaatgtatttt

SEQ ID NO: 4903155 - DNA, 17 bp, Homo sapiens
taaaatgtatttttcta

SEQ ID NO: 4903156 - DNA, 13 bp, Homo sapiens
taaaatgtgaagt

SEQ ID NO: 4903157 - DNA, 19 bp, Homo sapiens
taaaatgtgttgaaactgc

SEQ ID NO: 4903158 - DNA, 23 bp, Homo sapiens
taaaattgctatgttactatttt

SEQ ID NO: 4903159 - DNA, 15 bp, Homo sapiens
taaaatttatttcat

SEQ ID NO: 4903160 - DNA, 21 bp, Homo sapiens
taaacaatgctgatttggtga

SEQ ID NO: 4903161 - DNA, 16 bp, Homo sapiens
taaacaattcaagtga

SEQ ID NO: 4903162 - DNA, 18 bp, Homo sapiens
taaacacacagatacaca

SEQ ID NO: 4903163 - DNA, 18 bp, Homo sapiens
taaacacagtcaaaataa

SEQ ID NO: 4903164 - DNA, 16 bp, Homo sapiens
taaacagactgttaat

SEQ ID NO: 4903165 - DNA, 13 bp, Homo sapiens
taaacagcagtgt

SEQ ID NO: 4903166 - DNA, 20 bp, Homo sapiens
taaacagtgagcctgaattt

SEQ ID NO: 4903167 - DNA, 23 bp, Homo sapiens
taaacagtgagcctgaattttgt

SEQ ID NO: 4903168 - DNA, 15 bp, Homo sapiens
taaacataagtgtac

SEQ ID NO: 4903169 - DNA, 15 bp, Homo sapiens
taaacataatgaaaa

SEQ ID NO: 4903170 - DNA, 15 bp, Homo sapiens
taaacatatgatttc

SEQ ID NO: 4903171 - DNA, 18 bp, Homo sapiens
taaacatatgatttcact

SEQ ID NO: 4903172 - DNA, 22 bp, Homo sapiens
taaacatatgatttcactagaa

SEQ ID NO: 4903173 - DNA, 15 bp, Homo sapiens
taaacatcacacaca

SEQ ID NO: 4903174 - DNA, 12 bp, Homo sapiens
taaacatgtgtt

SEQ ID NO: 4903175 - DNA, 17 bp, Homo sapiens
taaacattaaaaatgga

SEQ ID NO: 4903176 - DNA, 17 bp, Homo sapiens
taaacattaaatgtctt

SEQ ID NO: 4903177 - DNA, 14 bp, Homo sapiens
taaacattctttta

SEQ ID NO: 4903178 - DNA, 19 bp, Homo sapiens
taaaccaaaggacattatg

SEQ ID NO: 4903179 - DNA, 21 bp, Homo sapiens
taaaccaaaggacattatgtg

SEQ ID NO: 4903180 - DNA, 22 bp, Homo sapiens
taaaccaccagtgcccaaagtc

SEQ ID NO: 4903181 - DNA, 19 bp, Homo sapiens
taaacctcaaaatgtctaa

SEQ ID NO: 4903182 - DNA, 20 bp, Homo sapiens
taaacctgtctccactgtgc

SEQ ID NO: 4903183 - DNA, 16 bp, Homo sapiens
taaacgcattatcagc

SEQ ID NO: 4903184 - DNA, 21 bp, Homo sapiens
taaacggttcagtttcttctg

SEQ ID NO: 4903185 - DNA, 15 bp, Homo sapiens
taaactactctttga

SEQ ID NO: 4903186 - DNA, 13 bp, Homo sapiens
taaactatcagtt

SEQ ID NO: 4903187 - DNA, 20 bp, Homo sapiens
taaactatcttggtgaattt

SEQ ID NO: 4903188 - DNA, 21 bp, Homo sapiens
taaactatcttggtgaatttt

SEQ ID NO: 4903189 - DNA, 19 bp, Homo sapiens
taaactcaaaacttaacat

SEQ ID NO: 4903190 - DNA, 20 bp, Homo sapiens
taaactcaaaacttaacata

SEQ ID NO: 4903191 - DNA, 11 bp, Homo sapiens
taaactcaggg

SEQ ID NO: 4903192 - DNA, 22 bp, Homo sapiens
taaactctaaacattaatcaat

SEQ ID NO: 4903193 - DNA, 14 bp, Homo sapiens
taaactgactatca

SEQ ID NO: 4903194 - DNA, 17 bp, Homo sapiens
taaactgttagcactgt

SEQ ID NO: 4903195 - DNA, 19 bp, Homo sapiens
taaactgttagcactgttg

SEQ ID NO: 4903196 - DNA, 18 bp, Homo sapiens
taaactgtttcagatttt

SEQ ID NO: 4903197 - DNA, 20 bp, Homo sapiens
taaacttaactttaactgaa

SEQ ID NO: 4903198 - DNA, 15 bp, Homo sapiens
taaacttataaatca

SEQ ID NO: 4903199 - DNA, 16 bp, Homo sapiens
taaacttataaatcat

SEQ ID NO: 4903200 - DNA, 12 bp, Homo sapiens
taaacttcagca

SEQ ID NO: 4903201 - DNA, 13 bp, Homo sapiens
taaacttgtgaat

SEQ ID NO: 4903202 - DNA, 15 bp, Homo sapiens
taaactttttttcaa

SEQ ID NO: 4903203 - DNA, 19 bp, Homo sapiens
taaactttttttcaatgtg

SEQ ID NO: 4903204 - DNA, 13 bp, Homo sapiens
taaagaaacagct

SEQ ID NO: 4903205 - DNA, 15 bp, Homo sapiens
taaagaaacagcttt

SEQ ID NO: 4903206 - DNA, 11 bp, Homo sapiens
taaagaaagtc

SEQ ID NO: 4903207 - DNA, 15 bp, Homo sapiens
taaagaaatgtctta

SEQ ID NO: 4903208 - DNA, 17 bp, Homo sapiens
taaagaaattgcaataa

SEQ ID NO: 4903209 - DNA, 15 bp, Homo sapiens
taaagaaatttacta

SEQ ID NO: 4903210 - DNA, 18 bp, Homo sapiens
taaagaaatttactatat

SEQ ID NO: 4903211 - DNA, 22 bp, Homo sapiens
taaagaaatttactatatatat

SEQ ID NO: 4903212 - DNA, 21 bp, Homo sapiens
taaagacccagggggagaatg

SEQ ID NO: 4903213 - DNA, 23 bp, Homo sapiens
taaagagtctagattcaaaggtt

SEQ ID NO: 4903214 - DNA, 15 bp, Homo sapiens
taaagataatattac

SEQ ID NO: 4903215 - DNA, 17 bp, Homo sapiens
taaagataattgctatt

SEQ ID NO: 4903216 - DNA, 17 bp, Homo sapiens
taaagatatggagaatt

SEQ ID NO: 4903217 - DNA, 21 bp, Homo sapiens
taaagatgcaaggaccaggac

SEQ ID NO: 4903218 - DNA, 18 bp, Homo sapiens
taaagatggagtttctaa

SEQ ID NO: 4903219 - DNA, 13 bp, Homo sapiens
taaagatttgctt

SEQ ID NO: 4903220 - DNA, 20 bp, Homo sapiens
taaagcaactgttatgaaat

SEQ ID NO: 4903221 - DNA, 21 bp, Homo sapiens
taaagcattgctgttatgtct

SEQ ID NO: 4903222 - DNA, 23 bp, Homo sapiens
taaagcattgctgttatgtctgt

SEQ ID NO: 4903223 - DNA, 23 bp, Homo sapiens
taaagctgcctgtagttaggaaa

SEQ ID NO: 4903224 - DNA, 22 bp, Homo sapiens
taaagcttactctgtccattta

SEQ ID NO: 4903225 - DNA, 16 bp, Homo sapiens
taaagcttatccataa

SEQ ID NO: 4903226 - DNA, 16 bp, Homo sapiens
taaaggatgtgattgt

SEQ ID NO: 4903227 - DNA, 22 bp, Homo sapiens
taaaggatgtgattgtggaatg

SEQ ID NO: 4903228 - DNA, 17 bp, Homo sapiens
taaaggatgttggtgtt

SEQ ID NO: 4903229 - DNA, 16 bp, Homo sapiens
taaaggcccagcccct

SEQ ID NO: 4903230 - DNA, 14 bp, Homo sapiens
taaagggcctgcct

SEQ ID NO: 4903231 - DNA, 22 bp, Homo sapiens
taaaggtccacaggtctagact

SEQ ID NO: 4903232 - DNA, 13 bp, Homo sapiens
taaaggtggattt

SEQ ID NO: 4903233 - DNA, 14 bp, Homo sapiens
taaaggtgtattta

SEQ ID NO: 4903234 - DNA, 21 bp, Homo sapiens
taaagtacttgagtgtaatgt

SEQ ID NO: 4903235 - DNA, 13 bp, Homo sapiens
taaagtagaagag

SEQ ID NO: 4903236 - DNA, 19 bp, Homo sapiens
taaagtatagagagaagtt

SEQ ID NO: 4903237 - DNA, 15 bp, Homo sapiens
taaagtatgtaaaca

SEQ ID NO: 4903238 - DNA, 15 bp, Homo sapiens
taaagtgctaaggtt

SEQ ID NO: 4903239 - DNA, 18 bp, Homo sapiens
taaagtgtaagttcacaa

SEQ ID NO: 4903240 - DNA, 17 bp, Homo sapiens
taaagtgttactttttg

SEQ ID NO: 4903241 - DNA, 17 bp, Homo sapiens
taaagtgtttctgttat

SEQ ID NO: 4903242 - DNA, 18 bp, Homo sapiens
taaagtgtttctgttatt

SEQ ID NO: 4903243 - DNA, 16 bp, Homo sapiens
taaagttagaatctat

SEQ ID NO: 4903244 - DNA, 20 bp, Homo sapiens
taaagttagaatctattttc

SEQ ID NO: 4903245 - DNA, 14 bp, Homo sapiens
taaagttctaagat

SEQ ID NO: 4903246 - DNA, 15 bp, Homo sapiens
taaagttctaagatt

SEQ ID NO: 4903247 - DNA, 21 bp, Homo sapiens
taaataaaagaaaaaatatct

SEQ ID NO: 4903248 - DNA, 14 bp, Homo sapiens
taaataaacttttt

SEQ ID NO: 4903249 - DNA, 15 bp, Homo sapiens
taaataaactttttt

SEQ ID NO: 4903250 - DNA, 22 bp, Homo sapiens
taaataaactttttttcaatgt

SEQ ID NO: 4903251 - DNA, 23 bp, Homo sapiens
taaataaactttttttcaatgtg

SEQ ID NO: 4903252 - DNA, 16 bp, Homo sapiens
taaataaatcattaat

SEQ ID NO: 4903253 - DNA, 15 bp, Homo sapiens
taaataagattctaa

SEQ ID NO: 4903254 - DNA, 21 bp, Homo sapiens
taaatacatacggtcaggttt

SEQ ID NO: 4903255 - DNA, 17 bp, Homo sapiens
taaataccagacacgta

SEQ ID NO: 4903256 - DNA, 21 bp, Homo sapiens
taaatactgtgtggaactttt

SEQ ID NO: 4903257 - DNA, 21 bp, Homo sapiens
taaataggagaggatgagagc

SEQ ID NO: 4903258 - DNA, 15 bp, Homo sapiens
taaatataattctgt

SEQ ID NO: 4903259 - DNA, 19 bp, Homo sapiens
taaatataattctgtaaat

SEQ ID NO: 4903260 - DNA, 20 bp, Homo sapiens
taaatatagttcctaagaag

SEQ ID NO: 4903261 - DNA, 11 bp, Homo sapiens
taaatatatat

SEQ ID NO: 4903262 - DNA, 14 bp, Homo sapiens
taaatatcttttat

SEQ ID NO: 4903263 - DNA, 17 bp, Homo sapiens
taaatatcttttatgtt

SEQ ID NO: 4903264 - DNA, 22 bp, Homo sapiens
taaatatcttttatgtttgaat

SEQ ID NO: 4903265 - DNA, 13 bp, Homo sapiens
taaatatgcagtg

SEQ ID NO: 4903266 - DNA, 18 bp, Homo sapiens
taaatattagttaatgga

SEQ ID NO: 4903267 - DNA, 20 bp, Homo sapiens
taaatattgaggctttgtgt

SEQ ID NO: 4903268 - DNA, 22 bp, Homo sapiens
taaatatttggtctctatttca

SEQ ID NO: 4903269 - DNA, 17 bp, Homo sapiens
taaatcctgccatttaa

SEQ ID NO: 4903270 - DNA, 18 bp, Homo sapiens
taaatcctgccatttaaa

SEQ ID NO: 4903271 - DNA, 15 bp, Homo sapiens
taaatctaaatctat

SEQ ID NO: 4903272 - DNA, 19 bp, Homo sapiens
taaatctatttattaatat

SEQ ID NO: 4903273 - DNA, 15 bp, Homo sapiens
taaatgaatattttg

SEQ ID NO: 4903274 - DNA, 21 bp, Homo sapiens
taaatgaatattttgataata

SEQ ID NO: 4903275 - DNA, 14 bp, Homo sapiens
taaatgatctgcct

SEQ ID NO: 4903276 - DNA, 17 bp, Homo sapiens
taaatgattcttagtga

SEQ ID NO: 4903277 - DNA, 21 bp, Homo sapiens
taaatgcaaagttctgtgttt

SEQ ID NO: 4903278 - DNA, 14 bp, Homo sapiens
taaatgcattatag

SEQ ID NO: 4903279 - DNA, 14 bp, Homo sapiens
taaatgcctaataa

SEQ ID NO: 4903280 - DNA, 11 bp, Homo sapiens
taaatggaaat

SEQ ID NO: 4903281 - DNA, 12 bp, Homo sapiens
taaatgtatact

SEQ ID NO: 4903282 - DNA, 13 bp, Homo sapiens
taaatgtatacta

SEQ ID NO: 4903283 - DNA, 13 bp, Homo sapiens
taaatgtatatac

SEQ ID NO: 4903284 - DNA, 13 bp, Homo sapiens
taaatgtctttgt

SEQ ID NO: 4903285 - DNA, 21 bp, Homo sapiens
taaatgtctttgtaagtcagt

SEQ ID NO: 4903286 - DNA, 19 bp, Homo sapiens
taaatgttatgactatgta

SEQ ID NO: 4903287 - DNA, 21 bp, Homo sapiens
taaatgttatgactatgtaaa

SEQ ID NO: 4903288 - DNA, 17 bp, Homo sapiens
taaatgtttgacacaat

SEQ ID NO: 4903289 - DNA, 16 bp, Homo sapiens
taaatgttttataagt

SEQ ID NO: 4903290 - DNA, 17 bp, Homo sapiens
taaatgttttataagtt

SEQ ID NO: 4903291 - DNA, 19 bp, Homo sapiens
taaatgttttataagttca

SEQ ID NO: 4903292 - DNA, 20 bp, Homo sapiens
taaattaaagcctttagtat

SEQ ID NO: 4903293 - DNA, 18 bp, Homo sapiens
taaattcccaacttctct

SEQ ID NO: 4903294 - DNA, 15 bp, Homo sapiens
taaattctgagacat

SEQ ID NO: 4903295 - DNA, 21 bp, Homo sapiens
taaattctttatttctgtcat

SEQ ID NO: 4903296 - DNA, 21 bp, Homo sapiens
taaattgggttcatgatgcag

SEQ ID NO: 4903297 - DNA, 23 bp, Homo sapiens
taaattgtttggcttcctcctga

SEQ ID NO: 4903298 - DNA, 16 bp, Homo sapiens
taaatttaaagatatt

SEQ ID NO: 4903299 - DNA, 21 bp, Homo sapiens
taaatttaaagatattgttca

SEQ ID NO: 4903300 - DNA, 15 bp, Homo sapiens
taaatttaatgctgc

SEQ ID NO: 4903301 - DNA, 16 bp, Homo sapiens
taaatttaatgctgcc

SEQ ID NO: 4903302 - DNA, 21 bp, Homo sapiens
taaatttgatacttatatttt

SEQ ID NO: 4903303 - DNA, 18 bp, Homo sapiens
taaattttaccctttaga

SEQ ID NO: 4903304 - DNA, 16 bp, Homo sapiens
taaattttgagttcta

SEQ ID NO: 4903305 - DNA, 23 bp, Homo sapiens
taacaaaaaaatatatttaatga

SEQ ID NO: 4903306 - DNA, 20 bp, Homo sapiens
taacaaaagatgaaagcagg

SEQ ID NO: 4903307 - DNA, 13 bp, Homo sapiens
taacaaaatggac

SEQ ID NO: 4903308 - DNA, 13 bp, Homo sapiens
taacaacctggcc

SEQ ID NO: 4903309 - DNA, 13 bp, Homo sapiens
taacaagccaccc

SEQ ID NO: 4903310 - DNA, 21 bp, Homo sapiens
taacaagtaccaaagttttat

SEQ ID NO: 4903311 - DNA, 21 bp, Homo sapiens
taacaatgacactagaaaact

SEQ ID NO: 4903312 - DNA, 21 bp, Homo sapiens
taacaatgcagcaaggccctg

SEQ ID NO: 4903313 - DNA, 15 bp, Homo sapiens
taacaatgttaagga

SEQ ID NO: 4903314 - DNA, 16 bp, Homo sapiens
taacaatgttaaggaa

SEQ ID NO: 4903315 - DNA, 15 bp, Homo sapiens
taacaatttccttta

SEQ ID NO: 4903316 - DNA, 15 bp, Homo sapiens
taacacacacagaaa

SEQ ID NO: 4903317 - DNA, 18 bp, Homo sapiens
taacacactttttattag

SEQ ID NO: 4903318 - DNA, 18 bp, Homo sapiens
taacactaaaattttagg

SEQ ID NO: 4903319 - DNA, 20 bp, Homo sapiens
taacagaacagcttcaggtt

SEQ ID NO: 4903320 - DNA, 21 bp, Homo sapiens
taacagtgcagggcaaaatat

SEQ ID NO: 4903321 - DNA, 17 bp, Homo sapiens
taacatatgtacataaa

SEQ ID NO: 4903322 - DNA, 20 bp, Homo sapiens
taacatattctgtatgaact

SEQ ID NO: 4903323 - DNA, 21 bp, Homo sapiens
taacatcactatccatgcacc

SEQ ID NO: 4903324 - DNA, 21 bp, Homo sapiens
taacatgggctcttcactagt

SEQ ID NO: 4903325 - DNA, 22 bp, Homo sapiens
taacattccaagactctagagt

SEQ ID NO: 4903326 - DNA, 11 bp, Homo sapiens
taacatttgcc

SEQ ID NO: 4903327 - DNA, 13 bp, Homo sapiens
taacatttgcctt

SEQ ID NO: 4903328 - DNA, 21 bp, Homo sapiens
taacatttgccttgcagaact

SEQ ID NO: 4903329 - DNA, 21 bp, Homo sapiens
taacattttaaataaaagaaa

SEQ ID NO: 4903330 - DNA, 21 bp, Homo sapiens
taacattttgttcttacacat

SEQ ID NO: 4903331 - DNA, 15 bp, Homo sapiens
taaccaaggaaatat

SEQ ID NO: 4903332 - DNA, 19 bp, Homo sapiens
taaccacgtctgtcttcac

SEQ ID NO: 4903333 - DNA, 20 bp, Homo sapiens
taaccacgtctgtcttcaca

SEQ ID NO: 4903334 - DNA, 20 bp, Homo sapiens
taaccatggagtagaggtac

SEQ ID NO: 4903335 - DNA, 19 bp, Homo sapiens
taacccaggcctgtctgac

SEQ ID NO: 4903336 - DNA, 19 bp, Homo sapiens
taaccgcacatgcacacac

SEQ ID NO: 4903337 - DNA, 20 bp, Homo sapiens
taacctatatgatttatagt

SEQ ID NO: 4903338 - DNA, 17 bp, Homo sapiens
taaccttatcctgcatt

SEQ ID NO: 4903339 - DNA, 15 bp, Homo sapiens
taaccttgaatgctg

SEQ ID NO: 4903340 - DNA, 17 bp, Homo sapiens
taaccttgaatgctgcc

SEQ ID NO: 4903341 - DNA, 23 bp, Homo sapiens
taacgcaataaacgcattatcag

SEQ ID NO: 4903342 - DNA, 17 bp, Homo sapiens
taacgccctatttttgc

SEQ ID NO: 4903343 - DNA, 20 bp, Homo sapiens
taacgccctatttttgcaat

SEQ ID NO: 4903344 - DNA, 22 bp, Homo sapiens
taacggtctgttctgtttcaag

SEQ ID NO: 4903345 - DNA, 23 bp, Homo sapiens
taacggtctgttctgtttcaagg

SEQ ID NO: 4903346 - DNA, 18 bp, Homo sapiens
taacgtttttcctttaaa

SEQ ID NO: 4903347 - DNA, 17 bp, Homo sapiens
taactaaatttgatact

SEQ ID NO: 4903348 - DNA, 12 bp, Homo sapiens
taactacattta

SEQ ID NO: 4903349 - DNA, 20 bp, Homo sapiens
taactacccttaattactta

SEQ ID NO: 4903350 - DNA, 21 bp, Homo sapiens
taactagacacagataataat

SEQ ID NO: 4903351 - DNA, 22 bp, Homo sapiens
taactagacaccaaagttctaa

SEQ ID NO: 4903352 - DNA, 18 bp, Homo sapiens
taactatatttgcttttt

SEQ ID NO: 4903353 - DNA, 16 bp, Homo sapiens
taactattgcatttat

SEQ ID NO: 4903354 - DNA, 21 bp, Homo sapiens
taactattgcatttatatgta

SEQ ID NO: 4903355 - DNA, 15 bp, Homo sapiens
taactcaccagcccc

SEQ ID NO: 4903356 - DNA, 19 bp, Homo sapiens
taactcctgagaaatgtta

SEQ ID NO: 4903357 - DNA, 21 bp, Homo sapiens
taactgatttgcaataaaaat

SEQ ID NO: 4903358 - DNA, 12 bp, Homo sapiens
taactgccttga

SEQ ID NO: 4903359 - DNA, 13 bp, Homo sapiens
taactgtacattt

SEQ ID NO: 4903360 - DNA, 16 bp, Homo sapiens
taactgtgctgaatgc

SEQ ID NO: 4903361 - DNA, 15 bp, Homo sapiens
taactgtttatatgt

SEQ ID NO: 4903362 - DNA, 17 bp, Homo sapiens
taacttatgtagatatt

SEQ ID NO: 4903363 - DNA, 14 bp, Homo sapiens
taacttattgctga

SEQ ID NO: 4903364 - DNA, 16 bp, Homo sapiens
taacttatttagagat

SEQ ID NO: 4903365 - DNA, 21 bp, Homo sapiens
taacttatttatgttaaaaga

SEQ ID NO: 4903366 - DNA, 23 bp, Homo sapiens
taacttcttatggaattgatttg

SEQ ID NO: 4903367 - DNA, 12 bp, Homo sapiens
taacttctttct

SEQ ID NO: 4903368 - DNA, 15 bp, Homo sapiens
taacttgatgcatgt

SEQ ID NO: 4903369 - DNA, 14 bp, Homo sapiens
taactttatgtgta

SEQ ID NO: 4903370 - DNA, 15 bp, Homo sapiens
taactttatgtgtaa

SEQ ID NO: 4903371 - DNA, 21 bp, Homo sapiens
taactttttttcttctacttt

SEQ ID NO: 4903372 - DNA, 14 bp, Homo sapiens
taagaaaagtattt

SEQ ID NO: 4903373 - DNA, 19 bp, Homo sapiens
taagaaaagtattttgaag

SEQ ID NO: 4903374 - DNA, 21 bp, Homo sapiens
taagaaaccctctgtcattcg

SEQ ID NO: 4903375 - DNA, 20 bp, Homo sapiens
taagaaatatgtgagatttt

SEQ ID NO: 4903376 - DNA, 19 bp, Homo sapiens
taagaaatcaaagagagaa

SEQ ID NO: 4903377 - DNA, 14 bp, Homo sapiens
taagaagcaaataa

SEQ ID NO: 4903378 - DNA, 19 bp, Homo sapiens
taagaagctgttgtacatt

SEQ ID NO: 4903379 - DNA, 21 bp, Homo sapiens
taagaagctgttgtacattta

SEQ ID NO: 4903380 - DNA, 20 bp, Homo sapiens
taagaagcttctaataaatt

SEQ ID NO: 4903381 - DNA, 20 bp, Homo sapiens
taagaatcagagtagaaata

SEQ ID NO: 4903382 - DNA, 21 bp, Homo sapiens
taagaatcagagtagaaataa

SEQ ID NO: 4903383 - DNA, 19 bp, Homo sapiens
taagaatgttggtttactt

SEQ ID NO: 4903384 - DNA, 21 bp, Homo sapiens
taagaatgttggtttactttc

SEQ ID NO: 4903385 - DNA, 12 bp, Homo sapiens
taagacataacg

SEQ ID NO: 4903386 - DNA, 16 bp, Homo sapiens
taagacataacgtttt

SEQ ID NO: 4903387 - DNA, 17 bp, Homo sapiens
taagacataacgttttt

SEQ ID NO: 4903388 - DNA, 19 bp, Homo sapiens
taagacatgatttccttga

SEQ ID NO: 4903389 - DNA, 20 bp, Homo sapiens
taagacatgatttccttgaa

SEQ ID NO: 4903390 - DNA, 16 bp, Homo sapiens
taagacctactgttct

SEQ ID NO: 4903391 - DNA, 18 bp, Homo sapiens
taagacctactgttctaa

SEQ ID NO: 4903392 - DNA, 19 bp, Homo sapiens
taagacctactgttctaaa

SEQ ID NO: 4903393 - DNA, 20 bp, Homo sapiens
taagacctactgttctaaag

SEQ ID NO: 4903394 - DNA, 18 bp, Homo sapiens
taagactcaaatgttcta

SEQ ID NO: 4903395 - DNA, 22 bp, Homo sapiens
taagactcaaatgttctaagtt

SEQ ID NO: 4903396 - DNA, 18 bp, Homo sapiens
taagactcattccctaga

SEQ ID NO: 4903397 - DNA, 17 bp, Homo sapiens
taagacttactctaaga

SEQ ID NO: 4903398 - DNA, 15 bp, Homo sapiens
taagacttgtgcatg

SEQ ID NO: 4903399 - DNA, 13 bp, Homo sapiens
taagagaaacttt

SEQ ID NO: 4903400 - DNA, 20 bp, Homo sapiens
taagagaaactttatacatt

SEQ ID NO: 4903401 - DNA, 18 bp, Homo sapiens
taagagaaagaaaatgaa

SEQ ID NO: 4903402 - DNA, 15 bp, Homo sapiens
taagagaaatggcaa

SEQ ID NO: 4903403 - DNA, 20 bp, Homo sapiens
taagagacagaatgtatctg

SEQ ID NO: 4903404 - DNA, 22 bp, Homo sapiens
taagagccatttaggggccact

SEQ ID NO: 4903405 - DNA, 16 bp, Homo sapiens
taagatcttagattct

SEQ ID NO: 4903406 - DNA, 18 bp, Homo sapiens
taagatgtgatattctaa

SEQ ID NO: 4903407 - DNA, 17 bp, Homo sapiens
taagattatagattcta

SEQ ID NO: 4903408 - DNA, 18 bp, Homo sapiens
taagattatagattctaa

SEQ ID NO: 4903409 - DNA, 10 bp, Homo sapiens
taagattcta

SEQ ID NO: 4903410 - DNA, 12 bp, Homo sapiens
taagattctaaa

SEQ ID NO: 4903411 - DNA, 13 bp, Homo sapiens
taagattctagat

SEQ ID NO: 4903412 - DNA, 13 bp, Homo sapiens
taagattctgatt

SEQ ID NO: 4903413 - DNA, 18 bp, Homo sapiens
taagatttttctcaaagt

SEQ ID NO: 4903414 - DNA, 22 bp, Homo sapiens
taagcaaatacttagcaaaaag

SEQ ID NO: 4903415 - DNA, 18 bp, Homo sapiens
taagcactcttaaagcaa

SEQ ID NO: 4903416 - DNA, 13 bp, Homo sapiens
taagcagagaagg

SEQ ID NO: 4903417 - DNA, 22 bp, Homo sapiens
taagcagatggaatgctgtgtt

SEQ ID NO: 4903418 - DNA, 12 bp, Homo sapiens
taagcagtccct

SEQ ID NO: 4903419 - DNA, 20 bp, Homo sapiens
taagcattgaaattatagtt

SEQ ID NO: 4903420 - DNA, 14 bp, Homo sapiens
taagccacttgaaa

SEQ ID NO: 4903421 - DNA, 18 bp, Homo sapiens
taagccagtgttgcctaa

SEQ ID NO: 4903422 - DNA, 16 bp, Homo sapiens
taagcctaaaagtggg

SEQ ID NO: 4903423 - DNA, 17 bp, Homo sapiens
taagcctacctgctctc

SEQ ID NO: 4903424 - DNA, 18 bp, Homo sapiens
taagctgatcctgcggag

SEQ ID NO: 4903425 - DNA, 12 bp, Homo sapiens
taagctgcagct

SEQ ID NO: 4903426 - DNA, 14 bp, Homo sapiens
taagctgcagcttc

SEQ ID NO: 4903427 - DNA, 18 bp, Homo sapiens
taagctgcagcttcctgt

SEQ ID NO: 4903428 - DNA, 17 bp, Homo sapiens
taaggaaaaaaagacaa

SEQ ID NO: 4903429 - DNA, 10 bp, Homo sapiens
taaggaaact

SEQ ID NO: 4903430 - DNA, 15 bp, Homo sapiens
taaggaaactcttat

SEQ ID NO: 4903431 - DNA, 20 bp, Homo sapiens
taaggaaactcttatctcag

SEQ ID NO: 4903432 - DNA, 14 bp, Homo sapiens
taaggctctgagag

SEQ ID NO: 4903433 - DNA, 24 bp, Homo sapiens
taaggctctgagagtctagattct

SEQ ID NO: 4903434 - DNA, 18 bp, Homo sapiens
taagggaagacatttctt

SEQ ID NO: 4903435 - DNA, 19 bp, Homo sapiens
taagggaagacatttcttt

SEQ ID NO: 4903436 - DNA, 18 bp, Homo sapiens
taagggcatgccttgtgc

SEQ ID NO: 4903437 - DNA, 23 bp, Homo sapiens
taaggggtttgccatttgatacc

SEQ ID NO: 4903438 - DNA, 17 bp, Homo sapiens
taagggtcgaaagctct

SEQ ID NO: 4903439 - DNA, 18 bp, Homo sapiens
taagggtgggtgctcaga

SEQ ID NO: 4903440 - DNA, 20 bp, Homo sapiens
taagtaacttcacattaaaa

SEQ ID NO: 4903441 - DNA, 14 bp, Homo sapiens
taagtaatcaataa

SEQ ID NO: 4903442 - DNA, 20 bp, Homo sapiens
taagtaatcaataaagaaaa

SEQ ID NO: 4903443 - DNA, 15 bp, Homo sapiens
taagtaatgtggaag

SEQ ID NO: 4903444 - DNA, 14 bp, Homo sapiens
taagtactgtaata

SEQ ID NO: 4903445 - DNA, 19 bp, Homo sapiens
taagtactgtaataatacc

SEQ ID NO: 4903446 - DNA, 21 bp, Homo sapiens
taagtactgtaataatacctc

SEQ ID NO: 4903447 - DNA, 16 bp, Homo sapiens
taagtactgtttacca

SEQ ID NO: 4903448 - DNA, 13 bp, Homo sapiens
taagtatacagtt

SEQ ID NO: 4903449 - DNA, 17 bp, Homo sapiens
taagtattaaaacattg

SEQ ID NO: 4903450 - DNA, 14 bp, Homo sapiens
taagtatttataat

SEQ ID NO: 4903451 - DNA, 15 bp, Homo sapiens
taagtcctttatgtg

SEQ ID NO: 4903452 - DNA, 20 bp, Homo sapiens
taagtcctttatgtggaaaa

SEQ ID NO: 4903453 - DNA, 13 bp, Homo sapiens
taagtgaatttat

SEQ ID NO: 4903454 - DNA, 14 bp, Homo sapiens
taagtgaatttata

SEQ ID NO: 4903455 - DNA, 15 bp, Homo sapiens
taagtgacatttgta

SEQ ID NO: 4903456 - DNA, 18 bp, Homo sapiens
taagtgcacacagaaata

SEQ ID NO: 4903457 - DNA, 23 bp, Homo sapiens
taagtgcgtgtgtagagttaaga

SEQ ID NO: 4903458 - DNA, 16 bp, Homo sapiens
taagtgctacataaat

SEQ ID NO: 4903459 - DNA, 14 bp, Homo sapiens
taagttcagcactt

SEQ ID NO: 4903460 - DNA, 17 bp, Homo sapiens
taagtttcaggtgacat

SEQ ID NO: 4903461 - DNA, 16 bp, Homo sapiens
taagtttctaagattc

SEQ ID NO: 4903462 - DNA, 15 bp, Homo sapiens
taataaaaaatggaa

SEQ ID NO: 4903463 - DNA, 19 bp, Homo sapiens
taataaaataattctaaag

SEQ ID NO: 4903464 - DNA, 19 bp, Homo sapiens
taataaatatttttgccat

SEQ ID NO: 4903465 - DNA, 20 bp, Homo sapiens
taataactcggattccagcc

SEQ ID NO: 4903466 - DNA, 21 bp, Homo sapiens
taataactgtgaagtttacat

SEQ ID NO: 4903467 - DNA, 19 bp, Homo sapiens
taataagacataacgtttt

SEQ ID NO: 4903468 - DNA, 20 bp, Homo sapiens
taataagacataacgttttt

SEQ ID NO: 4903469 - DNA, 14 bp, Homo sapiens
taataatattgttt

SEQ ID NO: 4903470 - DNA, 21 bp, Homo sapiens
taataatgagctattaaaact

SEQ ID NO: 4903471 - DNA, 18 bp, Homo sapiens
taataatgttaaccaagg

SEQ ID NO: 4903472 - DNA, 17 bp, Homo sapiens
taataattattattaaa

SEQ ID NO: 4903473 - DNA, 15 bp, Homo sapiens
taatacctctgtgtg

SEQ ID NO: 4903474 - DNA, 18 bp, Homo sapiens
taatacctctgtgtgctc

SEQ ID NO: 4903475 - DNA, 14 bp, Homo sapiens
taatactaccttga

SEQ ID NO: 4903476 - DNA, 19 bp, Homo sapiens
taatagcgggttactttca

SEQ ID NO: 4903477 - DNA, 17 bp, Homo sapiens
taatagtttgtctattt

SEQ ID NO: 4903478 - DNA, 19 bp, Homo sapiens
taatagtttgtctatttta

SEQ ID NO: 4903479 - DNA, 19 bp, Homo sapiens
taatataatggaagagaaa

SEQ ID NO: 4903480 - DNA, 20 bp, Homo sapiens
taatataatggaagagaaat

SEQ ID NO: 4903481 - DNA, 18 bp, Homo sapiens
taatatatatgaataaag

SEQ ID NO: 4903482 - DNA, 22 bp, Homo sapiens
taatatatttttatatttagtt

SEQ ID NO: 4903483 - DNA, 23 bp, Homo sapiens
taatatgattttttaaaagaaat

SEQ ID NO: 4903484 - DNA, 10 bp, Homo sapiens
taatatgcat

SEQ ID NO: 4903485 - DNA, 16 bp, Homo sapiens
taatatggcaaaaatg

SEQ ID NO: 4903486 - DNA, 18 bp, Homo sapiens
taatatggcaaaaatggc

SEQ ID NO: 4903487 - DNA, 21 bp, Homo sapiens
taatattgttgtataatttcg

SEQ ID NO: 4903488 - DNA, 16 bp, Homo sapiens
taatatttatatattt

SEQ ID NO: 4903489 - DNA, 21 bp, Homo sapiens
taatatttatgtctatttaag

SEQ ID NO: 4903490 - DNA, 16 bp, Homo sapiens
taatattttgtattat

SEQ ID NO: 4903491 - DNA, 21 bp, Homo sapiens
taatcaaaagggaaaagaaga

SEQ ID NO: 4903492 - DNA, 21 bp, Homo sapiens
taatcaagttgtaacttatat

SEQ ID NO: 4903493 - DNA, 17 bp, Homo sapiens
taatcaatgaatattga

SEQ ID NO: 4903494 - DNA, 19 bp, Homo sapiens
taatcaatgaatattgaag

SEQ ID NO: 4903495 - DNA, 13 bp, Homo sapiens
taatcagcctctt

SEQ ID NO: 4903496 - DNA, 15 bp, Homo sapiens
taatcagcctcttaa

SEQ ID NO: 4903497 - DNA, 16 bp, Homo sapiens
taatcatctataaaga

SEQ ID NO: 4903498 - DNA, 19 bp, Homo sapiens
taatccaggcacagctgag

SEQ ID NO: 4903499 - DNA, 17 bp, Homo sapiens
taatcctttctgccgac

SEQ ID NO: 4903500 - DNA, 20 bp, Homo sapiens
taatcctttctgccgacccc

SEQ ID NO: 4903501 - DNA, 16 bp, Homo sapiens
taatcctttgttttct

SEQ ID NO: 4903502 - DNA, 23 bp, Homo sapiens
taatcctttgttttctgactaat

SEQ ID NO: 4903503 - DNA, 22 bp, Homo sapiens
taatctagaacacaggcaaaat

SEQ ID NO: 4903504 - DNA, 21 bp, Homo sapiens
taatctctgttatgtactgta

SEQ ID NO: 4903505 - DNA, 24 bp, Homo sapiens
taatctctgttatgtactgtacta

SEQ ID NO: 4903506 - DNA, 14 bp, Homo sapiens
taatctgaaattct

SEQ ID NO: 4903507 - DNA, 17 bp, Homo sapiens
taatctggactcctctg

SEQ ID NO: 4903508 - DNA, 23 bp, Homo sapiens
taatctgtacattttgttgtaaa

SEQ ID NO: 4903509 - DNA, 15 bp, Homo sapiens
taatctgtcaaaaca

SEQ ID NO: 4903510 - DNA, 16 bp, Homo sapiens
taatctgtcaaaacac

SEQ ID NO: 4903511 - DNA, 13 bp, Homo sapiens
taatctgttatgt

SEQ ID NO: 4903512 - DNA, 19 bp, Homo sapiens
taatgagctattaaaactc

SEQ ID NO: 4903513 - DNA, 21 bp, Homo sapiens
taatgagctattaaaactcag

SEQ ID NO: 4903514 - DNA, 14 bp, Homo sapiens
taatgataaaacac

SEQ ID NO: 4903515 - DNA, 19 bp, Homo sapiens
taatgataagtaaatgcta

SEQ ID NO: 4903516 - DNA, 22 bp, Homo sapiens
taatgcattaaacctgtctcca

SEQ ID NO: 4903517 - DNA, 19 bp, Homo sapiens
taatgctaatttaaagaga

SEQ ID NO: 4903518 - DNA, 24 bp, Homo sapiens
taatgctgcaaacttaatgttctt

SEQ ID NO: 4903519 - DNA, 20 bp, Homo sapiens
taatgcttagagaatgttct

SEQ ID NO: 4903520 - DNA, 20 bp, Homo sapiens
taatgcttcattcaatattg

SEQ ID NO: 4903521 - DNA, 19 bp, Homo sapiens
taatgctttcacaacattt

SEQ ID NO: 4903522 - DNA, 13 bp, Homo sapiens
taatggaagagaa

SEQ ID NO: 4903523 - DNA, 15 bp, Homo sapiens
taatggattgttaat

SEQ ID NO: 4903524 - DNA, 12 bp, Homo sapiens
taatggcagcag

SEQ ID NO: 4903525 - DNA, 20 bp, Homo sapiens
taatggcagcagaaaacttg

SEQ ID NO: 4903526 - DNA, 15 bp, Homo sapiens
taatggggcggtgag

SEQ ID NO: 4903527 - DNA, 17 bp, Homo sapiens
taatggtctaaaaataa

SEQ ID NO: 4903528 - DNA, 13 bp, Homo sapiens
taatgtaaaatga

SEQ ID NO: 4903529 - DNA, 17 bp, Homo sapiens
taatgtaaaatgttgaa

SEQ ID NO: 4903530 - DNA, 18 bp, Homo sapiens
taatgtaaagatttgctt

SEQ ID NO: 4903531 - DNA, 15 bp, Homo sapiens
taatgtacatctggc

SEQ ID NO: 4903532 - DNA, 20 bp, Homo sapiens
taatgtagcgtgtttacatg

SEQ ID NO: 4903533 - DNA, 22 bp, Homo sapiens
taatgtagcgtgtttacatgtg

SEQ ID NO: 4903534 - DNA, 15 bp, Homo sapiens
taatgtcacaggcag

SEQ ID NO: 4903535 - DNA, 18 bp, Homo sapiens
taatgtccctttcagaga

SEQ ID NO: 4903536 - DNA, 18 bp, Homo sapiens
taatgtgaacttgtagct

SEQ ID NO: 4903537 - DNA, 20 bp, Homo sapiens
taatgtgagtttggtctgga

SEQ ID NO: 4903538 - DNA, 20 bp, Homo sapiens
taatgtgatgatgtaattga

SEQ ID NO: 4903539 - DNA, 21 bp, Homo sapiens
taatgtgatgatgtaattgac

SEQ ID NO: 4903540 - DNA, 19 bp, Homo sapiens
taatgtggaagaaaatggt

SEQ ID NO: 4903541 - DNA, 13 bp, Homo sapiens
taatgtgtgaaaa

SEQ ID NO: 4903542 - DNA, 19 bp, Homo sapiens
taatgtgtggtggcctcag

SEQ ID NO: 4903543 - DNA, 13 bp, Homo sapiens
taatgtgtgtatg

SEQ ID NO: 4903544 - DNA, 14 bp, Homo sapiens
taatgtgtgtatgt

SEQ ID NO: 4903545 - DNA, 13 bp, Homo sapiens
taatgttaaattt

SEQ ID NO: 4903546 - DNA, 20 bp, Homo sapiens
taatgttaaatttgtaagtt

SEQ ID NO: 4903547 - DNA, 23 bp, Homo sapiens
taatgttcttatgcaaaatggaa

SEQ ID NO: 4903548 - DNA, 17 bp, Homo sapiens
taatgtttctatctgat

SEQ ID NO: 4903549 - DNA, 14 bp, Homo sapiens
taattaaattatgg

SEQ ID NO: 4903550 - DNA, 19 bp, Homo sapiens
taattaaattatggtatta

SEQ ID NO: 4903551 - DNA, 13 bp, Homo sapiens
taattacttaaaa

SEQ ID NO: 4903552 - DNA, 17 bp, Homo sapiens
taattaggcaaggctat

SEQ ID NO: 4903553 - DNA, 19 bp, Homo sapiens
taattattaactacattta

SEQ ID NO: 4903554 - DNA, 13 bp, Homo sapiens
taattattattaa

SEQ ID NO: 4903555 - DNA, 14 bp, Homo sapiens
taattattatttgt

SEQ ID NO: 4903556 - DNA, 17 bp, Homo sapiens
taattattatttgtgtt

SEQ ID NO: 4903557 - DNA, 16 bp, Homo sapiens
taattccaatatgatg

SEQ ID NO: 4903558 - DNA, 15 bp, Homo sapiens
taattccacaccttt

SEQ ID NO: 4903559 - DNA, 13 bp, Homo sapiens
taattcctacagc

SEQ ID NO: 4903560 - DNA, 16 bp, Homo sapiens
taattcctacagcact

SEQ ID NO: 4903561 - DNA, 21 bp, Homo sapiens
taattcctacagcactactgg

SEQ ID NO: 4903562 - DNA, 12 bp, Homo sapiens
taattctgtaaa

SEQ ID NO: 4903563 - DNA, 13 bp, Homo sapiens
taattctgtaaat

SEQ ID NO: 4903564 - DNA, 15 bp, Homo sapiens
taattctgtaaatgt

SEQ ID NO: 4903565 - DNA, 19 bp, Homo sapiens
taattcttcagcgtaaaat

SEQ ID NO: 4903566 - DNA, 13 bp, Homo sapiens
taattcttcagtt

SEQ ID NO: 4903567 - DNA, 17 bp, Homo sapiens
taattgacggtttttta

SEQ ID NO: 4903568 - DNA, 12 bp, Homo sapiens
taattgctattt

SEQ ID NO: 4903569 - DNA, 14 bp, Homo sapiens
taattgttgaaatt

SEQ ID NO: 4903570 - DNA, 17 bp, Homo sapiens
taatttaaacacctcct

SEQ ID NO: 4903571 - DNA, 19 bp, Homo sapiens
taatttagggtactaaatt

SEQ ID NO: 4903572 - DNA, 23 bp, Homo sapiens
taatttagggtactaaatttaaa

SEQ ID NO: 4903573 - DNA, 15 bp, Homo sapiens
taatttagttattga

SEQ ID NO: 4903574 - DNA, 20 bp, Homo sapiens
taatttatctaaattaaagc

SEQ ID NO: 4903575 - DNA, 18 bp, Homo sapiens
taatttattattgaaatt

SEQ ID NO: 4903576 - DNA, 17 bp, Homo sapiens
taatttcaaaaatataa

SEQ ID NO: 4903577 - DNA, 19 bp, Homo sapiens
taatttcaaaaatataact

SEQ ID NO: 4903578 - DNA, 17 bp, Homo sapiens
taatttcccttcttgca

SEQ ID NO: 4903579 - DNA, 22 bp, Homo sapiens
taatttctaaagataatattac

SEQ ID NO: 4903580 - DNA, 13 bp, Homo sapiens
taatttctaatgt

SEQ ID NO: 4903581 - DNA, 22 bp, Homo sapiens
taatttgaaaacataatctgca

SEQ ID NO: 4903582 - DNA, 18 bp, Homo sapiens
taatttgaggacaaccat

SEQ ID NO: 4903583 - DNA, 16 bp, Homo sapiens
taatttgattaacaaa

SEQ ID NO: 4903584 - DNA, 12 bp, Homo sapiens
taatttgcatta

SEQ ID NO: 4903585 - DNA, 20 bp, Homo sapiens
taatttgcattaaattcaca

SEQ ID NO: 4903586 - DNA, 22 bp, Homo sapiens
taatttggggaaacctagagaa

SEQ ID NO: 4903587 - DNA, 21 bp, Homo sapiens
taattttctagattttctact

SEQ ID NO: 4903588 - DNA, 18 bp, Homo sapiens
taattttctcaaaagcat

SEQ ID NO: 4903589 - DNA, 16 bp, Homo sapiens
taatttttatatttaa

SEQ ID NO: 4903590 - DNA, 16 bp, Homo sapiens
taattttttgtaatgt

SEQ ID NO: 4903591 - DNA, 22 bp, Homo sapiens
taattttttttttccttttaaa

SEQ ID NO: 4903592 - DNA, 20 bp, Homo sapiens
tacaaacaatctcttaaatt

SEQ ID NO: 4903593 - DNA, 19 bp, Homo sapiens
tacaaactcccacttgtca

SEQ ID NO: 4903594 - DNA, 21 bp, Homo sapiens
tacaaagaggtgtacaggtac

SEQ ID NO: 4903595 - DNA, 23 bp, Homo sapiens
tacaaagcactagagaatgcaca

SEQ ID NO: 4903596 - DNA, 17 bp, Homo sapiens
tacaaatataagatttt

SEQ ID NO: 4903597 - DNA, 15 bp, Homo sapiens
tacaaattaaaaaga

SEQ ID NO: 4903598 - DNA, 13 bp, Homo sapiens
tacaaattataaa

SEQ ID NO: 4903599 - DNA, 22 bp, Homo sapiens
tacaacataatctagtttacag

SEQ ID NO: 4903600 - DNA, 23 bp, Homo sapiens
tacaacataatctagtttacaga

SEQ ID NO: 4903601 - DNA, 15 bp, Homo sapiens
tacaacctccctctt

SEQ ID NO: 4903602 - DNA, 16 bp, Homo sapiens
tacaacctccctcttg

SEQ ID NO: 4903603 - DNA, 20 bp, Homo sapiens
tacaagagcagcctgtggca

SEQ ID NO: 4903604 - DNA, 24 bp, Homo sapiens
tacaagatgaaggagaggcaacat

SEQ ID NO: 4903605 - DNA, 15 bp, Homo sapiens
tacaagattgaaaat

SEQ ID NO: 4903606 - DNA, 18 bp, Homo sapiens
tacaagcgtgagccactg

SEQ ID NO: 4903607 - DNA, 18 bp, Homo sapiens
tacaatcgcaaatcaaaa

SEQ ID NO: 4903608 - DNA, 17 bp, Homo sapiens
tacaatgtgtttttctc

SEQ ID NO: 4903609 - DNA, 18 bp, Homo sapiens
tacaattaaaaaaaaaga

SEQ ID NO: 4903610 - DNA, 22 bp, Homo sapiens
tacaattaatagtttgtctatt

SEQ ID NO: 4903611 - DNA, 14 bp, Homo sapiens
tacacaaaggggat

SEQ ID NO: 4903612 - DNA, 24 bp, Homo sapiens
tacacaaaggggatcataaagtta

SEQ ID NO: 4903613 - DNA, 13 bp, Homo sapiens
tacacacacacac

SEQ ID NO: 4903614 - DNA, 21 bp, Homo sapiens
tacacacacacgcgtgcacac

SEQ ID NO: 4903615 - DNA, 14 bp, Homo sapiens
tacacacacagatg

SEQ ID NO: 4903616 - DNA, 15 bp, Homo sapiens
tacacacacagatgt

SEQ ID NO: 4903617 - DNA, 11 bp, Homo sapiens
tacacagaaac

SEQ ID NO: 4903618 - DNA, 14 bp, Homo sapiens
tacacagaaacact

SEQ ID NO: 4903619 - DNA, 15 bp, Homo sapiens
tacacagctctagac

SEQ ID NO: 4903620 - DNA, 22 bp, Homo sapiens
tacacagtgggaactctgacaa

SEQ ID NO: 4903621 - DNA, 23 bp, Homo sapiens
tacacagtgggaactctgacaag

SEQ ID NO: 4903622 - DNA, 21 bp, Homo sapiens
tacacatatacctataatgtg

SEQ ID NO: 4903623 - DNA, 15 bp, Homo sapiens
tacacattagatttt

SEQ ID NO: 4903624 - DNA, 20 bp, Homo sapiens
tacacatttttaaattgtta

SEQ ID NO: 4903625 - DNA, 23 bp, Homo sapiens
tacacatttttaaattgttagct

SEQ ID NO: 4903626 - DNA, 16 bp, Homo sapiens
tacaccatatactgtt

SEQ ID NO: 4903627 - DNA, 14 bp, Homo sapiens
tacacccaaagagg

SEQ ID NO: 4903628 - DNA, 17 bp, Homo sapiens
tacaccgactagccagg

SEQ ID NO: 4903629 - DNA, 15 bp, Homo sapiens
tacactgacttgaga

SEQ ID NO: 4903630 - DNA, 16 bp, Homo sapiens
tacactgcaatcatat

SEQ ID NO: 4903631 - DNA, 19 bp, Homo sapiens
tacactgcaatcatatgtg

SEQ ID NO: 4903632 - DNA, 20 bp, Homo sapiens
tacactgcaatcatatgtga

SEQ ID NO: 4903633 - DNA, 15 bp, Homo sapiens
tacagacctgctttt

SEQ ID NO: 4903634 - DNA, 20 bp, Homo sapiens
tacagacctgctttttgaaa

SEQ ID NO: 4903635 - DNA, 23 bp, Homo sapiens
tacagacctgctttttgaaatga

SEQ ID NO: 4903636 - DNA, 13 bp, Homo sapiens
tacagagctgtgg

SEQ ID NO: 4903637 - DNA, 15 bp, Homo sapiens
tacagaggaaatctg

SEQ ID NO: 4903638 - DNA, 18 bp, Homo sapiens
tacagaggaaatctgtaa

SEQ ID NO: 4903639 - DNA, 12 bp, Homo sapiens
tacagataacat

SEQ ID NO: 4903640 - DNA, 13 bp, Homo sapiens
tacagatgaaaat

SEQ ID NO: 4903641 - DNA, 14 bp, Homo sapiens
tacagatgcctttt

SEQ ID NO: 4903642 - DNA, 17 bp, Homo sapiens
tacagcactactgggtg

SEQ ID NO: 4903643 - DNA, 18 bp, Homo sapiens
tacagcactactgggtgt

SEQ ID NO: 4903644 - DNA, 22 bp, Homo sapiens
tacagcactactgggtgtcatt

SEQ ID NO: 4903645 - DNA, 16 bp, Homo sapiens
tacagctaatcagcat

SEQ ID NO: 4903646 - DNA, 15 bp, Homo sapiens
tacagctccccaagt

SEQ ID NO: 4903647 - DNA, 20 bp, Homo sapiens
tacagctctggccacaacag

SEQ ID NO: 4903648 - DNA, 20 bp, Homo sapiens
tacagctgggctggggagga

SEQ ID NO: 4903649 - DNA, 20 bp, Homo sapiens
tacagctttacacacacaga

SEQ ID NO: 4903650 - DNA, 13 bp, Homo sapiens
tacaggaagtccc

SEQ ID NO: 4903651 - DNA, 15 bp, Homo sapiens
tacaggagtgagcac

SEQ ID NO: 4903652 - DNA, 20 bp, Homo sapiens
tacaggatttgaactcagat

SEQ ID NO: 4903653 - DNA, 23 bp, Homo sapiens
tacaggatttgaactcagatctg

SEQ ID NO: 4903654 - DNA, 14 bp, Homo sapiens
tacaggccctgctc

SEQ ID NO: 4903655 - DNA, 20 bp, Homo sapiens
tacagggtaactgtgctgaa

SEQ ID NO: 4903656 - DNA, 18 bp, Homo sapiens
tacagtaactttatgtgt

SEQ ID NO: 4903657 - DNA, 20 bp, Homo sapiens
tacagtaactttatgtgtaa

SEQ ID NO: 4903658 - DNA, 15 bp, Homo sapiens
tacagtccttcaaaa

SEQ ID NO: 4903659 - DNA, 19 bp, Homo sapiens
tacagtccttcaaaatcct

SEQ ID NO: 4903660 - DNA, 20 bp, Homo sapiens
tacagttaggcaccagaaga

SEQ ID NO: 4903661 - DNA, 23 bp, Homo sapiens
tacagtttatttttaaagataga

SEQ ID NO: 4903662 - DNA, 14 bp, Homo sapiens
tacataaacaatga

SEQ ID NO: 4903663 - DNA, 13 bp, Homo sapiens
tacataactaaat

SEQ ID NO: 4903664 - DNA, 16 bp, Homo sapiens
tacataactgccttga

SEQ ID NO: 4903665 - DNA, 15 bp, Homo sapiens
tacataagtaattca

SEQ ID NO: 4903666 - DNA, 16 bp, Homo sapiens
tacataagtaattcaa

SEQ ID NO: 4903667 - DNA, 19 bp, Homo sapiens
tacataattttttattcaa

SEQ ID NO: 4903668 - DNA, 14 bp, Homo sapiens
tacatacacttgta

SEQ ID NO: 4903669 - DNA, 13 bp, Homo sapiens
tacatacggtcag

SEQ ID NO: 4903670 - DNA, 15 bp, Homo sapiens
tacatacggtcaggt

SEQ ID NO: 4903671 - DNA, 22 bp, Homo sapiens
tacatagatttatttttcagtt

SEQ ID NO: 4903672 - DNA, 22 bp, Homo sapiens
tacatatatttttaaaaaatga

SEQ ID NO: 4903673 - DNA, 15 bp, Homo sapiens
tacatatcgctgact

SEQ ID NO: 4903674 - DNA, 23 bp, Homo sapiens
tacatatcgctgacttcatggaa

SEQ ID NO: 4903675 - DNA, 13 bp, Homo sapiens
tacatatgtaaac

SEQ ID NO: 4903676 - DNA, 14 bp, Homo sapiens
tacatatgtaaaca

SEQ ID NO: 4903677 - DNA, 17 bp, Homo sapiens
tacatatttattttctt

SEQ ID NO: 4903678 - DNA, 16 bp, Homo sapiens
tacatatttgtggaat

SEQ ID NO: 4903679 - DNA, 17 bp, Homo sapiens
tacatatttgtggaata

SEQ ID NO: 4903680 - DNA, 12 bp, Homo sapiens
tacatcactgct

SEQ ID NO: 4903681 - DNA, 19 bp, Homo sapiens
tacatcactgcttgatgaa

SEQ ID NO: 4903682 - DNA, 23 bp, Homo sapiens
tacatcagttattcattctgtga

SEQ ID NO: 4903683 - DNA, 14 bp, Homo sapiens
tacatcctgggtaa

SEQ ID NO: 4903684 - DNA, 18 bp, Homo sapiens
tacatctattttggattg

SEQ ID NO: 4903685 - DNA, 14 bp, Homo sapiens
tacatctggcttat

SEQ ID NO: 4903686 - DNA, 23 bp, Homo sapiens
tacatctggcttattttaatgtg

SEQ ID NO: 4903687 - DNA, 14 bp, Homo sapiens
tacatcttctgcct

SEQ ID NO: 4903688 - DNA, 13 bp, Homo sapiens
tacatgaaacaga

SEQ ID NO: 4903689 - DNA, 18 bp, Homo sapiens
tacatgagaacaaacaga

SEQ ID NO: 4903690 - DNA, 18 bp, Homo sapiens
tacatgcaaaaagaaatg

SEQ ID NO: 4903691 - DNA, 16 bp, Homo sapiens
tacatgcaatttatta

SEQ ID NO: 4903692 - DNA, 19 bp, Homo sapiens
tacatgcaatttattaaaa

SEQ ID NO: 4903693 - DNA, 18 bp, Homo sapiens
tacatgtgtagcctgtgc

SEQ ID NO: 4903694 - DNA, 19 bp, Homo sapiens
tacatgtgtagcctgtgca

SEQ ID NO: 4903695 - DNA, 16 bp, Homo sapiens
tacatgtgtgtatata

SEQ ID NO: 4903696 - DNA, 21 bp, Homo sapiens
tacatgtgtgtatatatgtgt

SEQ ID NO: 4903697 - DNA, 14 bp, Homo sapiens
tacattagtaaatg

SEQ ID NO: 4903698 - DNA, 22 bp, Homo sapiens
tacattagtaaatgtctttgta

SEQ ID NO: 4903699 - DNA, 15 bp, Homo sapiens
tacattcatttagct

SEQ ID NO: 4903700 - DNA, 19 bp, Homo sapiens
tacattggctggtaacagt

SEQ ID NO: 4903701 - DNA, 17 bp, Homo sapiens
tacattgtaaatagtat

SEQ ID NO: 4903702 - DNA, 23 bp, Homo sapiens
tacattgttgagctattgctgtt

SEQ ID NO: 4903703 - DNA, 15 bp, Homo sapiens
tacatttaaaactta

SEQ ID NO: 4903704 - DNA, 21 bp, Homo sapiens
tacatttaaaattgctatgtt

SEQ ID NO: 4903705 - DNA, 16 bp, Homo sapiens
tacatttataattgca

SEQ ID NO: 4903706 - DNA, 23 bp, Homo sapiens
tacatttatgatttaataaaata

SEQ ID NO: 4903707 - DNA, 23 bp, Homo sapiens
tacatttggagacacaactattt

SEQ ID NO: 4903708 - DNA, 20 bp, Homo sapiens
tacattttgttgtaaaaaga

SEQ ID NO: 4903709 - DNA, 23 bp, Homo sapiens
tacattttgttgtaaaaagaaaa

SEQ ID NO: 4903710 - DNA, 16 bp, Homo sapiens
tacatttttatttatg

SEQ ID NO: 4903711 - DNA, 22 bp, Homo sapiens
tacatttttatttatgaagttt

SEQ ID NO: 4903712 - DNA, 15 bp, Homo sapiens
taccaactttctgta

SEQ ID NO: 4903713 - DNA, 14 bp, Homo sapiens
taccaatgccaaga

SEQ ID NO: 4903714 - DNA, 13 bp, Homo sapiens
taccaatgctgca

SEQ ID NO: 4903715 - DNA, 15 bp, Homo sapiens
taccactaactcctg

SEQ ID NO: 4903716 - DNA, 19 bp, Homo sapiens
taccactaactcctgagaa

SEQ ID NO: 4903717 - DNA, 13 bp, Homo sapiens
taccagaagggaa

SEQ ID NO: 4903718 - DNA, 15 bp, Homo sapiens
taccagactgcaggt

SEQ ID NO: 4903719 - DNA, 21 bp, Homo sapiens
taccagactgcaggttggacc

SEQ ID NO: 4903720 - DNA, 14 bp, Homo sapiens
taccaggatttttt

SEQ ID NO: 4903721 - DNA, 21 bp, Homo sapiens
taccagtctttaaaggcccag

SEQ ID NO: 4903722 - DNA, 16 bp, Homo sapiens
taccatactcatttct

SEQ ID NO: 4903723 - DNA, 14 bp, Homo sapiens
taccatgaacagaa

SEQ ID NO: 4903724 - DNA, 14 bp, Homo sapiens
taccattaaaactg

SEQ ID NO: 4903725 - DNA, 16 bp, Homo sapiens
taccattaaaactgct

SEQ ID NO: 4903726 - DNA, 17 bp, Homo sapiens
taccattaaaactgctt

SEQ ID NO: 4903727 - DNA, 20 bp, Homo sapiens
taccattcagatcactgaat

SEQ ID NO: 4903728 - DNA, 16 bp, Homo sapiens
tacccaaaccctaggt

SEQ ID NO: 4903729 - DNA, 20 bp, Homo sapiens
tacccaaaccctaggttccc

SEQ ID NO: 4903730 - DNA, 13 bp, Homo sapiens
tacccaatttccc

SEQ ID NO: 4903731 - DNA, 22 bp, Homo sapiens
tacccacctagaacactaactc

SEQ ID NO: 4903732 - DNA, 11 bp, Homo sapiens
tacccactgct

SEQ ID NO: 4903733 - DNA, 16 bp, Homo sapiens
tacccagagagtcctg

SEQ ID NO: 4903734 - DNA, 18 bp, Homo sapiens
tacccagcgagccctggt

SEQ ID NO: 4903735 - DNA, 21 bp, Homo sapiens
tacccaggaccaagccacagc

SEQ ID NO: 4903736 - DNA, 13 bp, Homo sapiens
tacccctggctgt

SEQ ID NO: 4903737 - DNA, 17 bp, Homo sapiens
tacccctggctgtactg

SEQ ID NO: 4903738 - DNA, 18 bp, Homo sapiens
tacccctggctgtactgc

SEQ ID NO: 4903739 - DNA, 19 bp, Homo sapiens
taccccttagcctccctga

SEQ ID NO: 4903740 - DNA, 16 bp, Homo sapiens
taccctaatgtcttca

SEQ ID NO: 4903741 - DNA, 19 bp, Homo sapiens
taccctaatgtcttcataa

SEQ ID NO: 4903742 - DNA, 17 bp, Homo sapiens
taccctctcagctccag

SEQ ID NO: 4903743 - DNA, 20 bp, Homo sapiens
taccctctcagctccaggtg

SEQ ID NO: 4903744 - DNA, 12 bp, Homo sapiens
taccctctggag

SEQ ID NO: 4903745 - DNA, 22 bp, Homo sapiens
taccctctggaggggtgtggct

SEQ ID NO: 4903746 - DNA, 15 bp, Homo sapiens
tacccttccctgcac

SEQ ID NO: 4903747 - DNA, 16 bp, Homo sapiens
tacccttccctgcact

SEQ ID NO: 4903748 - DNA, 22 bp, Homo sapiens
taccctttcctcctttatcaca

SEQ ID NO: 4903749 - DNA, 15 bp, Homo sapiens
tacccttttctgggg

SEQ ID NO: 4903750 - DNA, 18 bp, Homo sapiens
taccgagtctcttctcca

SEQ ID NO: 4903751 - DNA, 15 bp, Homo sapiens
taccgcctgtctctt

SEQ ID NO: 4903752 - DNA, 17 bp, Homo sapiens
taccgcctgtctcttta

SEQ ID NO: 4903753 - DNA, 15 bp, Homo sapiens
tacctaacattattt

SEQ ID NO: 4903754 - DNA, 13 bp, Homo sapiens
tacctaagtactg

SEQ ID NO: 4903755 - DNA, 19 bp, Homo sapiens
tacctaagtgacatttgta

SEQ ID NO: 4903756 - DNA, 18 bp, Homo sapiens
tacctataatgtgtgtat

SEQ ID NO: 4903757 - DNA, 21 bp, Homo sapiens
tacctatcccacctccatccc

SEQ ID NO: 4903758 - DNA, 16 bp, Homo sapiens
tacctcaggcagctca

SEQ ID NO: 4903759 - DNA, 14 bp, Homo sapiens
tacctcaggcagga

SEQ ID NO: 4903760 - DNA, 13 bp, Homo sapiens
tacctcatgttta

SEQ ID NO: 4903761 - DNA, 20 bp, Homo sapiens
tacctccaacagaactaaat

SEQ ID NO: 4903762 - DNA, 14 bp, Homo sapiens
tacctcccctgcct

SEQ ID NO: 4903763 - DNA, 13 bp, Homo sapiens
tacctgacacaag

SEQ ID NO: 4903764 - DNA, 20 bp, Homo sapiens
tacctgacctcttgctgtct

SEQ ID NO: 4903765 - DNA, 22 bp, Homo sapiens
tacctgcaggctgagccactct

SEQ ID NO: 4903766 - DNA, 16 bp, Homo sapiens
tacctgccctggaaca

SEQ ID NO: 4903767 - DNA, 14 bp, Homo sapiens
tacctgctctccaa

SEQ ID NO: 4903768 - DNA, 23 bp, Homo sapiens
tacctgctctccaagtctcagtg

SEQ ID NO: 4903769 - DNA, 19 bp, Homo sapiens
tacctgtacactgacttga

SEQ ID NO: 4903770 - DNA, 17 bp, Homo sapiens
tacctgtcacattgcat

SEQ ID NO: 4903771 - DNA, 20 bp, Homo sapiens
tacctgtgcgttactaattg

SEQ ID NO: 4903772 - DNA, 22 bp, Homo sapiens
taccttgaaaataagaatagaa

SEQ ID NO: 4903773 - DNA, 21 bp, Homo sapiens
taccttttgaggagccccagc

SEQ ID NO: 4903774 - DNA, 15 bp, Homo sapiens
tacgaaacacaaacc

SEQ ID NO: 4903775 - DNA, 16 bp, Homo sapiens
tacgaacaaaacacac

SEQ ID NO: 4903776 - DNA, 23 bp, Homo sapiens
tacgatacgctactataaagaga

SEQ ID NO: 4903777 - DNA, 23 bp, Homo sapiens
tacgcactacatgtggtttatag

SEQ ID NO: 4903778 - DNA, 13 bp, Homo sapiens
tacgtttgtatgt

SEQ ID NO: 4903779 - DNA, 14 bp, Homo sapiens
tacgtttgtatgtg

SEQ ID NO: 4903780 - DNA, 20 bp, Homo sapiens
tacgtttgtatgtgtgtaga

SEQ ID NO: 4903781 - DNA, 20 bp, Homo sapiens
tactaagcatagcaaacaga

SEQ ID NO: 4903782 - DNA, 16 bp, Homo sapiens
tactaattccacacct

SEQ ID NO: 4903783 - DNA, 15 bp, Homo sapiens
tactacactgaggag

SEQ ID NO: 4903784 - DNA, 13 bp, Homo sapiens
tactaccttgaaa

SEQ ID NO: 4903785 - DNA, 14 bp, Homo sapiens
tactaccttgaaaa

SEQ ID NO: 4903786 - DNA, 15 bp, Homo sapiens
tactactgaaacaga

SEQ ID NO: 4903787 - DNA, 20 bp, Homo sapiens
tactactgaaacagatttca

SEQ ID NO: 4903788 - DNA, 14 bp, Homo sapiens
tactagaatgctta

SEQ ID NO: 4903789 - DNA, 20 bp, Homo sapiens
tactagcttttcaaacaaga

SEQ ID NO: 4903790 - DNA, 23 bp, Homo sapiens
tactagcttttcaaacaagaatg

SEQ ID NO: 4903791 - DNA, 14 bp, Homo sapiens
tactagtactgtgt

SEQ ID NO: 4903792 - DNA, 21 bp, Homo sapiens
tactagtactgtgtactgtat

SEQ ID NO: 4903793 - DNA, 12 bp, Homo sapiens
tactatagtacc

SEQ ID NO: 4903794 - DNA, 14 bp, Homo sapiens
tactatatttgcta

SEQ ID NO: 4903795 - DNA, 21 bp, Homo sapiens
tactatcatactactgaaaca

SEQ ID NO: 4903796 - DNA, 12 bp, Homo sapiens
tactatttaaag

SEQ ID NO: 4903797 - DNA, 21 bp, Homo sapiens
tactatttaaagcctcctcat

SEQ ID NO: 4903798 - DNA, 21 bp, Homo sapiens
tactcagtttatgttgtacaa

SEQ ID NO: 4903799 - DNA, 15 bp, Homo sapiens
tactcatttctaaaa

SEQ ID NO: 4903800 - DNA, 22 bp, Homo sapiens
tactcatttctaaaagaatatt

SEQ ID NO: 4903801 - DNA, 16 bp, Homo sapiens
tactccctgcagatgc

SEQ ID NO: 4903802 - DNA, 19 bp, Homo sapiens
tactccctgcagatgccac

SEQ ID NO: 4903803 - DNA, 13 bp, Homo sapiens
tactcctcctctt

SEQ ID NO: 4903804 - DNA, 23 bp, Homo sapiens
tactcctcctctttctctcccca

SEQ ID NO: 4903805 - DNA, 11 bp, Homo sapiens
tactcctgact

SEQ ID NO: 4903806 - DNA, 12 bp, Homo sapiens
tactcctgactc

SEQ ID NO: 4903807 - DNA, 13 bp, Homo sapiens
tactcctgactcc

SEQ ID NO: 4903808 - DNA, 13 bp, Homo sapiens
tactctaagatct

SEQ ID NO: 4903809 - DNA, 22 bp, Homo sapiens
tactctaagatcttagattctc

SEQ ID NO: 4903810 - DNA, 14 bp, Homo sapiens
tactctagatgaag

SEQ ID NO: 4903811 - DNA, 20 bp, Homo sapiens
tactctatgccccaaatata

SEQ ID NO: 4903812 - DNA, 17 bp, Homo sapiens
tactcttgttgagttct

SEQ ID NO: 4903813 - DNA, 13 bp, Homo sapiens
tactctttctgta

SEQ ID NO: 4903814 - DNA, 20 bp, Homo sapiens
tactgagaaaagcctctcca

SEQ ID NO: 4903815 - DNA, 23 bp, Homo sapiens
tactgagggaccaactgggccca

SEQ ID NO: 4903816 - DNA, 15 bp, Homo sapiens
tactgcagctttaca

SEQ ID NO: 4903817 - DNA, 19 bp, Homo sapiens
tactgcagctttacatgca

SEQ ID NO: 4903818 - DNA, 16 bp, Homo sapiens
tactgcagggccagga

SEQ ID NO: 4903819 - DNA, 19 bp, Homo sapiens
tactgccatgtactagttt

SEQ ID NO: 4903820 - DNA, 22 bp, Homo sapiens
tactgcccaggcctgcctgttc

SEQ ID NO: 4903821 - DNA, 15 bp, Homo sapiens
tactgggtgtcattt

SEQ ID NO: 4903822 - DNA, 17 bp, Homo sapiens
tactgggtgtcatttca

SEQ ID NO: 4903823 - DNA, 20 bp, Homo sapiens
tactgggtgtcatttcattc

SEQ ID NO: 4903824 - DNA, 18 bp, Homo sapiens
tactggtcttgtggaatt

SEQ ID NO: 4903825 - DNA, 16 bp, Homo sapiens
tactgtaataatacct

SEQ ID NO: 4903826 - DNA, 21 bp, Homo sapiens
tactgtactaattcttacact

SEQ ID NO: 4903827 - DNA, 17 bp, Homo sapiens
tactgtatagacagttt

SEQ ID NO: 4903828 - DNA, 20 bp, Homo sapiens
tactgtctggttttaacaat

SEQ ID NO: 4903829 - DNA, 12 bp, Homo sapiens
tactgtggagga

SEQ ID NO: 4903830 - DNA, 13 bp, Homo sapiens
tactgtgtactgt

SEQ ID NO: 4903831 - DNA, 22 bp, Homo sapiens
tactgtgtgtgtgaatgaacac

SEQ ID NO: 4903832 - DNA, 15 bp, Homo sapiens
tactgttaaccattt

SEQ ID NO: 4903833 - DNA, 18 bp, Homo sapiens
tactgttaaccatttaag

SEQ ID NO: 4903834 - DNA, 13 bp, Homo sapiens
tactgttctaaag

SEQ ID NO: 4903835 - DNA, 14 bp, Homo sapiens
tactgttctaaagc

SEQ ID NO: 4903836 - DNA, 17 bp, Homo sapiens
tactgttctaaagctct

SEQ ID NO: 4903837 - DNA, 18 bp, Homo sapiens
tactgttctaaagctctg

SEQ ID NO: 4903838 - DNA, 17 bp, Homo sapiens
tactgttctgtgtcttt

SEQ ID NO: 4903839 - DNA, 13 bp, Homo sapiens
tactgttcttgct

SEQ ID NO: 4903840 - DNA, 20 bp, Homo sapiens
tactgttcttgctgctagaa

SEQ ID NO: 4903841 - DNA, 19 bp, Homo sapiens
tactgttttatctggcccc

SEQ ID NO: 4903842 - DNA, 13 bp, Homo sapiens
tacttaagagaaa

SEQ ID NO: 4903843 - DNA, 15 bp, Homo sapiens
tacttactaaaatat

SEQ ID NO: 4903844 - DNA, 20 bp, Homo sapiens
tacttagagtttctgtttga

SEQ ID NO: 4903845 - DNA, 14 bp, Homo sapiens
tacttagcatccta

SEQ ID NO: 4903846 - DNA, 20 bp, Homo sapiens
tacttagcatcctaagaaat

SEQ ID NO: 4903847 - DNA, 22 bp, Homo sapiens
tacttagcatcctaagaaatat

SEQ ID NO: 4903848 - DNA, 21 bp, Homo sapiens
tacttatatttccctaaaata

SEQ ID NO: 4903849 - DNA, 22 bp, Homo sapiens
tacttcaggggcacttcattga

SEQ ID NO: 4903850 - DNA, 22 bp, Homo sapiens
tacttccacctcgggcacattt

SEQ ID NO: 4903851 - DNA, 16 bp, Homo sapiens
tacttcctcctcccca

SEQ ID NO: 4903852 - DNA, 23 bp, Homo sapiens
tacttcctgtgacttcagctctg

SEQ ID NO: 4903853 - DNA, 18 bp, Homo sapiens
tacttcgtcttctaattt

SEQ ID NO: 4903854 - DNA, 18 bp, Homo sapiens
tacttctccaccctgctc

SEQ ID NO: 4903855 - DNA, 15 bp, Homo sapiens
tacttctgctacata

SEQ ID NO: 4903856 - DNA, 13 bp, Homo sapiens
tacttggtttgtg

SEQ ID NO: 4903857 - DNA, 14 bp, Homo sapiens
tacttggtttgtgt

SEQ ID NO: 4903858 - DNA, 20 bp, Homo sapiens
tacttgtgaaacacagctgt

SEQ ID NO: 4903859 - DNA, 18 bp, Homo sapiens
tacttgtggacacagctc

SEQ ID NO: 4903860 - DNA, 16 bp, Homo sapiens
tacttgtttctctgtt

SEQ ID NO: 4903861 - DNA, 16 bp, Homo sapiens
tactttaaataattta

SEQ ID NO: 4903862 - DNA, 20 bp, Homo sapiens
tactttatcactttttgaac

SEQ ID NO: 4903863 - DNA, 17 bp, Homo sapiens
tactttcgtacattggc

SEQ ID NO: 4903864 - DNA, 23 bp, Homo sapiens
tactttgatattttcaacgcagc

SEQ ID NO: 4903865 - DNA, 19 bp, Homo sapiens
tactttggtttctgtctgt

SEQ ID NO: 4903866 - DNA, 14 bp, Homo sapiens
tactttgtctgaaa

SEQ ID NO: 4903867 - DNA, 16 bp, Homo sapiens
tactttgtctgaaaaa

SEQ ID NO: 4903868 - DNA, 21 bp, Homo sapiens
tacttttatttgcaacattta

SEQ ID NO: 4903869 - DNA, 14 bp, Homo sapiens
tacttttgagtgtg

SEQ ID NO: 4903870 - DNA, 20 bp, Homo sapiens
tactttttaaaaggtatttt

SEQ ID NO: 4903871 - DNA, 17 bp, Homo sapiens
tactttttcttttgtaa

SEQ ID NO: 4903872 - DNA, 20 bp, Homo sapiens
tagaaaaattcagcaaacca

SEQ ID NO: 4903873 - DNA, 20 bp, Homo sapiens
tagaaaactgaaaatctaat

SEQ ID NO: 4903874 - DNA, 22 bp, Homo sapiens
tagaaaactgaaaatctaatat

SEQ ID NO: 4903875 - DNA, 20 bp, Homo sapiens
tagaaaagctgatcataagt

SEQ ID NO: 4903876 - DNA, 13 bp, Homo sapiens
tagaaacatgaca

SEQ ID NO: 4903877 - DNA, 16 bp, Homo sapiens
tagaaacatgacactg

SEQ ID NO: 4903878 - DNA, 19 bp, Homo sapiens
tagaaacatgacactgacc

SEQ ID NO: 4903879 - DNA, 14 bp, Homo sapiens
tagaaaccttaata

SEQ ID NO: 4903880 - DNA, 14 bp, Homo sapiens
tagaaagcaggggc

SEQ ID NO: 4903881 - DNA, 15 bp, Homo sapiens
tagaacacaggcaaa

SEQ ID NO: 4903882 - DNA, 23 bp, Homo sapiens
tagaactctccatcttattttca

SEQ ID NO: 4903883 - DNA, 13 bp, Homo sapiens
tagaactgggtaa

SEQ ID NO: 4903884 - DNA, 20 bp, Homo sapiens
tagaactgggtaaatgcaaa

SEQ ID NO: 4903885 - DNA, 21 bp, Homo sapiens
tagaacttgcagctgatgttg

SEQ ID NO: 4903886 - DNA, 15 bp, Homo sapiens
tagaacttttttaaa

SEQ ID NO: 4903887 - DNA, 16 bp, Homo sapiens
tagaacttttttaaat

SEQ ID NO: 4903888 - DNA, 19 bp, Homo sapiens
tagaacttttttaaataaa

SEQ ID NO: 4903889 - DNA, 19 bp, Homo sapiens
tagaagagggttttaggta

SEQ ID NO: 4903890 - DNA, 23 bp, Homo sapiens
tagaagcaaattaaacggtaaca

SEQ ID NO: 4903891 - DNA, 23 bp, Homo sapiens
tagaagcattccttctttgataa

SEQ ID NO: 4903892 - DNA, 19 bp, Homo sapiens
tagaagggccagtcctgcc

SEQ ID NO: 4903893 - DNA, 15 bp, Homo sapiens
tagaagtcacacagt

SEQ ID NO: 4903894 - DNA, 23 bp, Homo sapiens
tagaagtgcatttctgaatagaa

SEQ ID NO: 4903895 - DNA, 21 bp, Homo sapiens
tagaatataggtctcttctcc

SEQ ID NO: 4903896 - DNA, 17 bp, Homo sapiens
tagaatctattttctat

SEQ ID NO: 4903897 - DNA, 22 bp, Homo sapiens
tagaatctgcaattcaaaagtt

SEQ ID NO: 4903898 - DNA, 16 bp, Homo sapiens
tagaattatttaaaca

SEQ ID NO: 4903899 - DNA, 21 bp, Homo sapiens
tagaattctgtattggatata

SEQ ID NO: 4903900 - DNA, 19 bp, Homo sapiens
tagacaagatattgtacat

SEQ ID NO: 4903901 - DNA, 14 bp, Homo sapiens
tagacaatatacaa

SEQ ID NO: 4903902 - DNA, 14 bp, Homo sapiens
tagacacatttaag

SEQ ID NO: 4903903 - DNA, 15 bp, Homo sapiens
tagacacatttaagg

SEQ ID NO: 4903904 - DNA, 17 bp, Homo sapiens
tagacacatttaaggat

SEQ ID NO: 4903905 - DNA, 14 bp, Homo sapiens
tagacaccaaagtt

SEQ ID NO: 4903906 - DNA, 17 bp, Homo sapiens
tagacaccaaagttcta

SEQ ID NO: 4903907 - DNA, 13 bp, Homo sapiens
tagacagtttgta

SEQ ID NO: 4903908 - DNA, 13 bp, Homo sapiens
tagacataacaaa

SEQ ID NO: 4903909 - DNA, 18 bp, Homo sapiens
tagacatggaggttctaa

SEQ ID NO: 4903910 - DNA, 23 bp, Homo sapiens
tagacatggaggttctaaggcct

SEQ ID NO: 4903911 - DNA, 13 bp, Homo sapiens
tagaccaaaataa

SEQ ID NO: 4903912 - DNA, 18 bp, Homo sapiens
tagaccaaggaacaaaaa

SEQ ID NO: 4903913 - DNA, 13 bp, Homo sapiens
tagactatataca

SEQ ID NO: 4903914 - DNA, 14 bp, Homo sapiens
tagactatatacat

SEQ ID NO: 4903915 - DNA, 19 bp, Homo sapiens
tagactctgtaacatcact

SEQ ID NO: 4903916 - DNA, 22 bp, Homo sapiens
tagactgacttgtttgtcttcc

SEQ ID NO: 4903917 - DNA, 22 bp, Homo sapiens
tagagaaggacccggaggggcc

SEQ ID NO: 4903918 - DNA, 11 bp, Homo sapiens
tagagacaggg

SEQ ID NO: 4903919 - DNA, 20 bp, Homo sapiens
tagagatatatatacttgtg

SEQ ID NO: 4903920 - DNA, 12 bp, Homo sapiens
tagagatgtttt

SEQ ID NO: 4903921 - DNA, 20 bp, Homo sapiens
tagagatgtttttaaaagtt

SEQ ID NO: 4903922 - DNA, 23 bp, Homo sapiens
tagagatgtttttaaaagtttca

SEQ ID NO: 4903923 - DNA, 21 bp, Homo sapiens
tagagcaaaattgatgtgttt

SEQ ID NO: 4903924 - DNA, 19 bp, Homo sapiens
tagagcattgaattggaga

SEQ ID NO: 4903925 - DNA, 16 bp, Homo sapiens
tagagcctgcctggag

SEQ ID NO: 4903926 - DNA, 17 bp, Homo sapiens
tagaggtatattggaag

SEQ ID NO: 4903927 - DNA, 13 bp, Homo sapiens
tagagtccaaggt

SEQ ID NO: 4903928 - DNA, 14 bp, Homo sapiens
tagagtcctcactc

SEQ ID NO: 4903929 - DNA, 12 bp, Homo sapiens
tagagttaagaa

SEQ ID NO: 4903930 - DNA, 16 bp, Homo sapiens
tagagttaagaagctg

SEQ ID NO: 4903931 - DNA, 17 bp, Homo sapiens
tagagttaagaagctgt

SEQ ID NO: 4903932 - DNA, 19 bp, Homo sapiens
tagagttaagaagctgttg

SEQ ID NO: 4903933 - DNA, 12 bp, Homo sapiens
tagagtttaaca

SEQ ID NO: 4903934 - DNA, 20 bp, Homo sapiens
tagagtttctgtttgattct

SEQ ID NO: 4903935 - DNA, 15 bp, Homo sapiens
tagataaaagctgaa

SEQ ID NO: 4903936 - DNA, 14 bp, Homo sapiens
tagatattacttta

SEQ ID NO: 4903937 - DNA, 17 bp, Homo sapiens
tagatattactttatca

SEQ ID NO: 4903938 - DNA, 22 bp, Homo sapiens
tagatattactttatcactttt

SEQ ID NO: 4903939 - DNA, 12 bp, Homo sapiens
tagatattttca

SEQ ID NO: 4903940 - DNA, 14 bp, Homo sapiens
tagatcagatgctc

SEQ ID NO: 4903941 - DNA, 18 bp, Homo sapiens
tagatcagatgctccaag

SEQ ID NO: 4903942 - DNA, 12 bp, Homo sapiens
tagatcttctga

SEQ ID NO: 4903943 - DNA, 14 bp, Homo sapiens
tagatcttctgaaa

SEQ ID NO: 4903944 - DNA, 21 bp, Homo sapiens
tagatgattaaataagattct

SEQ ID NO: 4903945 - DNA, 23 bp, Homo sapiens
tagatgattaaataagattctaa

SEQ ID NO: 4903946 - DNA, 17 bp, Homo sapiens
tagatgtcttttatagt

SEQ ID NO: 4903947 - DNA, 15 bp, Homo sapiens
tagattaatggcact

SEQ ID NO: 4903948 - DNA, 17 bp, Homo sapiens
tagattcaaaggttcta

SEQ ID NO: 4903949 - DNA, 11 bp, Homo sapiens
tagattctaaa

SEQ ID NO: 4903950 - DNA, 12 bp, Homo sapiens
tagattctaaag

SEQ ID NO: 4903951 - DNA, 17 bp, Homo sapiens
tagattctaaagattct

SEQ ID NO: 4903952 - DNA, 21 bp, Homo sapiens
tagattctctgtgtctaagat

SEQ ID NO: 4903953 - DNA, 14 bp, Homo sapiens
tagatttagtgtaa

SEQ ID NO: 4903954 - DNA, 21 bp, Homo sapiens
tagatttatttttcagttcca

SEQ ID NO: 4903955 - DNA, 13 bp, Homo sapiens
tagatttggaata

SEQ ID NO: 4903956 - DNA, 16 bp, Homo sapiens
tagattttattttact

SEQ ID NO: 4903957 - DNA, 21 bp, Homo sapiens
tagattttctggttctaacat

SEQ ID NO: 4903958 - DNA, 14 bp, Homo sapiens
tagcaaaaagtggg

SEQ ID NO: 4903959 - DNA, 15 bp, Homo sapiens
tagcaaacagaggaa

SEQ ID NO: 4903960 - DNA, 13 bp, Homo sapiens
tagcaacttttgt

SEQ ID NO: 4903961 - DNA, 12 bp, Homo sapiens
tagcaagacaca

SEQ ID NO: 4903962 - DNA, 16 bp, Homo sapiens
tagcaagctggcctct

SEQ ID NO: 4903963 - DNA, 16 bp, Homo sapiens
tagcacagattttaat

SEQ ID NO: 4903964 - DNA, 19 bp, Homo sapiens
tagcacagattttaattgt

SEQ ID NO: 4903965 - DNA, 18 bp, Homo sapiens
tagcacataaactttggg

SEQ ID NO: 4903966 - DNA, 18 bp, Homo sapiens
tagcactgttgatgtatc

SEQ ID NO: 4903967 - DNA, 19 bp, Homo sapiens
tagcactttgaaatacctc

SEQ ID NO: 4903968 - DNA, 18 bp, Homo sapiens
tagcaggccaaggtctga

SEQ ID NO: 4903969 - DNA, 22 bp, Homo sapiens
tagcaggccaaggtctgagcca

SEQ ID NO: 4903970 - DNA, 16 bp, Homo sapiens
tagcagtaaaagatga

SEQ ID NO: 4903971 - DNA, 17 bp, Homo sapiens
tagcagtgtgaagtaca

SEQ ID NO: 4903972 - DNA, 20 bp, Homo sapiens
tagccacatttggaatactt

SEQ ID NO: 4903973 - DNA, 13 bp, Homo sapiens
tagccactcagga

SEQ ID NO: 4903974 - DNA, 14 bp, Homo sapiens
tagccactcaggag

SEQ ID NO: 4903975 - DNA, 20 bp, Homo sapiens
tagccaggatcatggtgtaa

SEQ ID NO: 4903976 - DNA, 17 bp, Homo sapiens
tagccattgatcataaa

SEQ ID NO: 4903977 - DNA, 18 bp, Homo sapiens
tagcccaccctgctgcct

SEQ ID NO: 4903978 - DNA, 18 bp, Homo sapiens
tagcccagcgctctgcct

SEQ ID NO: 4903979 - DNA, 12 bp, Homo sapiens
tagcccaggaga

SEQ ID NO: 4903980 - DNA, 18 bp, Homo sapiens
tagcccaggagagagaaa

SEQ ID NO: 4903981 - DNA, 22 bp, Homo sapiens
tagcccaggagagagaaagcca

SEQ ID NO: 4903982 - DNA, 21 bp, Homo sapiens
tagcccatccctgcctggtca

SEQ ID NO: 4903983 - DNA, 13 bp, Homo sapiens
tagccctttctgt

SEQ ID NO: 4903984 - DNA, 14 bp, Homo sapiens
tagccctttctgtg

SEQ ID NO: 4903985 - DNA, 21 bp, Homo sapiens
tagcctatttacctgcaggct

SEQ ID NO: 4903986 - DNA, 23 bp, Homo sapiens
tagcctgcactttgatgtcatgt

SEQ ID NO: 4903987 - DNA, 20 bp, Homo sapiens
tagcctggagcacctttcct

SEQ ID NO: 4903988 - DNA, 21 bp, Homo sapiens
tagccttagaagtcacacagt

SEQ ID NO: 4903989 - DNA, 18 bp, Homo sapiens
tagcctttggctctggag

SEQ ID NO: 4903990 - DNA, 18 bp, Homo sapiens
tagcgttcccaacaacat

SEQ ID NO: 4903991 - DNA, 17 bp, Homo sapiens
tagcgttttttaaatgt

SEQ ID NO: 4903992 - DNA, 22 bp, Homo sapiens
tagcgttttttaaatgtatact

SEQ ID NO: 4903993 - DNA, 23 bp, Homo sapiens
tagctaacattttaaataaaaga

SEQ ID NO: 4903994 - DNA, 15 bp, Homo sapiens
tagctaagtacacaa

SEQ ID NO: 4903995 - DNA, 19 bp, Homo sapiens
tagctaatgtaataactgt

SEQ ID NO: 4903996 - DNA, 15 bp, Homo sapiens
tagctacaggaagca

SEQ ID NO: 4903997 - DNA, 20 bp, Homo sapiens
tagctacaggaagcacccca

SEQ ID NO: 4903998 - DNA, 14 bp, Homo sapiens
tagctatcagaaga

SEQ ID NO: 4903999 - DNA, 15 bp, Homo sapiens
tagctatcagaagac

SEQ ID NO: 4904000 - DNA, 14 bp, Homo sapiens
tagctattactgtc

SEQ ID NO: 4904001 - DNA, 13 bp, Homo sapiens
tagctctttcctt

SEQ ID NO: 4904002 - DNA, 19 bp, Homo sapiens
tagctcttttttgtttgtt

SEQ ID NO: 4904003 - DNA, 21 bp, Homo sapiens
tagctgatgaacttattctgt

SEQ ID NO: 4904004 - DNA, 23 bp, Homo sapiens
tagctgatgaacttattctgtag

SEQ ID NO: 4904005 - DNA, 21 bp, Homo sapiens
tagctgccacttgaacaaaat

SEQ ID NO: 4904006 - DNA, 18 bp, Homo sapiens
tagctgggactacaggtg

SEQ ID NO: 4904007 - DNA, 15 bp, Homo sapiens
tagctgggattacag

SEQ ID NO: 4904008 - DNA, 10 bp, Homo sapiens
tagctgtggg

SEQ ID NO: 4904009 - DNA, 16 bp, Homo sapiens
tagcttacctgacaca

SEQ ID NO: 4904010 - DNA, 21 bp, Homo sapiens
tagcttctaccatgaacagaa

SEQ ID NO: 4904011 - DNA, 17 bp, Homo sapiens
tagcttgtatagtgtaa

SEQ ID NO: 4904012 - DNA, 19 bp, Homo sapiens
tagcttgtatagtgtaaaa

SEQ ID NO: 4904013 - DNA, 15 bp, Homo sapiens
tagcttgttccctgt

SEQ ID NO: 4904014 - DNA, 20 bp, Homo sapiens
tagctttatatatggacatg

SEQ ID NO: 4904015 - DNA, 21 bp, Homo sapiens
tagctttatatatggacatgg

SEQ ID NO: 4904016 - DNA, 15 bp, Homo sapiens
tagctttattcttca

SEQ ID NO: 4904017 - DNA, 11 bp, Homo sapiens
tagctttgctc

SEQ ID NO: 4904018 - DNA, 15 bp, Homo sapiens
tagctttgctctttg

SEQ ID NO: 4904019 - DNA, 13 bp, Homo sapiens
tagctttgtgttt

SEQ ID NO: 4904020 - DNA, 15 bp, Homo sapiens
tagctttgtgtttgg

SEQ ID NO: 4904021 - DNA, 14 bp, Homo sapiens
tagcttttattgta

SEQ ID NO: 4904022 - DNA, 18 bp, Homo sapiens
tagcttttattgtataaa

SEQ ID NO: 4904023 - DNA, 13 bp, Homo sapiens
tagcttttccctt

SEQ ID NO: 4904024 - DNA, 15 bp, Homo sapiens
tagctttttaaaaca

SEQ ID NO: 4904025 - DNA, 15 bp, Homo sapiens
tagctttttaattgt

SEQ ID NO: 4904026 - DNA, 13 bp, Homo sapiens
taggaaacaagtg

SEQ ID NO: 4904027 - DNA, 16 bp, Homo sapiens
taggaaataaaacctt

SEQ ID NO: 4904028 - DNA, 14 bp, Homo sapiens
taggaacttcagag

SEQ ID NO: 4904029 - DNA, 16 bp, Homo sapiens
taggaacttcagagat

SEQ ID NO: 4904030 - DNA, 18 bp, Homo sapiens
taggaaggtctcattctt

SEQ ID NO: 4904031 - DNA, 18 bp, Homo sapiens
taggaattaagttatctt

SEQ ID NO: 4904032 - DNA, 17 bp, Homo sapiens
taggaattcatcttttg

SEQ ID NO: 4904033 - DNA, 19 bp, Homo sapiens
taggaccactcagccccta

SEQ ID NO: 4904034 - DNA, 21 bp, Homo sapiens
taggaccactcagcccctagg

SEQ ID NO: 4904035 - DNA, 23 bp, Homo sapiens
taggaccatggttaagagtccaa

SEQ ID NO: 4904036 - DNA, 17 bp, Homo sapiens
taggagacttgccagag

SEQ ID NO: 4904037 - DNA, 18 bp, Homo sapiens
taggagaggatgagagcc

SEQ ID NO: 4904038 - DNA, 23 bp, Homo sapiens
taggagcctgctggtcacagcct

SEQ ID NO: 4904039 - DNA, 14 bp, Homo sapiens
taggagctaaggct

SEQ ID NO: 4904040 - DNA, 16 bp, Homo sapiens
taggagctgaggtttc

SEQ ID NO: 4904041 - DNA, 14 bp, Homo sapiens
taggagggagacac

SEQ ID NO: 4904042 - DNA, 20 bp, Homo sapiens
taggatcatttgttggaatg

SEQ ID NO: 4904043 - DNA, 14 bp, Homo sapiens
taggattctaaaat

SEQ ID NO: 4904044 - DNA, 18 bp, Homo sapiens
taggcactcttaaatgat

SEQ ID NO: 4904045 - DNA, 22 bp, Homo sapiens
taggcactgtagttctaagact

SEQ ID NO: 4904046 - DNA, 20 bp, Homo sapiens
taggcatgaagagcaaaaat

SEQ ID NO: 4904047 - DNA, 16 bp, Homo sapiens
taggcattaacacaaa

SEQ ID NO: 4904048 - DNA, 19 bp, Homo sapiens
taggcattaatgtttctat

SEQ ID NO: 4904049 - DNA, 15 bp, Homo sapiens
taggcctggccagat

SEQ ID NO: 4904050 - DNA, 18 bp, Homo sapiens
taggcctggccagatgca

SEQ ID NO: 4904051 - DNA, 14 bp, Homo sapiens
taggctaatgtcaa

SEQ ID NO: 4904052 - DNA, 18 bp, Homo sapiens
tagggacctcagaggttt

SEQ ID NO: 4904053 - DNA, 17 bp, Homo sapiens
tagggaggcagcctcca

SEQ ID NO: 4904054 - DNA, 14 bp, Homo sapiens
tagggatgcctcct

SEQ ID NO: 4904055 - DNA, 18 bp, Homo sapiens
tagggatttattttcaat

SEQ ID NO: 4904056 - DNA, 14 bp, Homo sapiens
tagggccaggcagg

SEQ ID NO: 4904057 - DNA, 15 bp, Homo sapiens
tagggccaggcaggt

SEQ ID NO: 4904058 - DNA, 19 bp, Homo sapiens
tagggctgggcaaggaaaa

SEQ ID NO: 4904059 - DNA, 21 bp, Homo sapiens
tagggctgggcaaggaaaaag

SEQ ID NO: 4904060 - DNA, 22 bp, Homo sapiens
taggggcttataataaaggact

SEQ ID NO: 4904061 - DNA, 23 bp, Homo sapiens
taggggcttataataaaggactg

SEQ ID NO: 4904062 - DNA, 22 bp, Homo sapiens
tagggtacatttataattgcat

SEQ ID NO: 4904063 - DNA, 12 bp, Homo sapiens
tagggtggccct

SEQ ID NO: 4904064 - DNA, 15 bp, Homo sapiens
taggtaaaatgtatt

SEQ ID NO: 4904065 - DNA, 16 bp, Homo sapiens
taggtaaaatgtattt

SEQ ID NO: 4904066 - DNA, 16 bp, Homo sapiens
taggtagaaaaagggt

SEQ ID NO: 4904067 - DNA, 22 bp, Homo sapiens
taggtgatgtttgctcttgttt

SEQ ID NO: 4904068 - DNA, 14 bp, Homo sapiens
taggttcaattccc

SEQ ID NO: 4904069 - DNA, 15 bp, Homo sapiens
taggttctaaagttc

SEQ ID NO: 4904070 - DNA, 17 bp, Homo sapiens
taggttctaaagttcta

SEQ ID NO: 4904071 - DNA, 22 bp, Homo sapiens
taggttctaaagttctaagatt

SEQ ID NO: 4904072 - DNA, 11 bp, Homo sapiens
taggtttcaaa

SEQ ID NO: 4904073 - DNA, 21 bp, Homo sapiens
taggtttttccttatttgctt

SEQ ID NO: 4904074 - DNA, 18 bp, Homo sapiens
tagtaaaatttatttcat

SEQ ID NO: 4904075 - DNA, 16 bp, Homo sapiens
tagtaaatgtctttgt

SEQ ID NO: 4904076 - DNA, 17 bp, Homo sapiens
tagtaaatgtctttgta

SEQ ID NO: 4904077 - DNA, 19 bp, Homo sapiens
tagtaaatgtctttgtaag

SEQ ID NO: 4904078 - DNA, 23 bp, Homo sapiens
tagtaaatgtctttgtaagtcag

SEQ ID NO: 4904079 - DNA, 14 bp, Homo sapiens
tagtaatagagcaa

SEQ ID NO: 4904080 - DNA, 16 bp, Homo sapiens
tagtaatctgtacatt

SEQ ID NO: 4904081 - DNA, 15 bp, Homo sapiens
tagtacaaattataa

SEQ ID NO: 4904082 - DNA, 16 bp, Homo sapiens
tagtacaaattataaa

SEQ ID NO: 4904083 - DNA, 13 bp, Homo sapiens
tagtacactttta

SEQ ID NO: 4904084 - DNA, 15 bp, Homo sapiens
tagtacctgaaaagt

SEQ ID NO: 4904085 - DNA, 13 bp, Homo sapiens
tagtagagacagg

SEQ ID NO: 4904086 - DNA, 15 bp, Homo sapiens
tagtagagacagggt

SEQ ID NO: 4904087 - DNA, 19 bp, Homo sapiens
tagtagcgttttttaaatg

SEQ ID NO: 4904088 - DNA, 14 bp, Homo sapiens
tagtagtttttaca

SEQ ID NO: 4904089 - DNA, 16 bp, Homo sapiens
tagtataaagaaaagt

SEQ ID NO: 4904090 - DNA, 16 bp, Homo sapiens
tagtatcagtgtttta

SEQ ID NO: 4904091 - DNA, 16 bp, Homo sapiens
tagtatggtggctggg

SEQ ID NO: 4904092 - DNA, 12 bp, Homo sapiens
tagtatttgaat

SEQ ID NO: 4904093 - DNA, 21 bp, Homo sapiens
tagtatttgaattaaaacttc

SEQ ID NO: 4904094 - DNA, 18 bp, Homo sapiens
tagtcattccaaatatga

SEQ ID NO: 4904095 - DNA, 19 bp, Homo sapiens
tagtcatttattttaaaaa

SEQ ID NO: 4904096 - DNA, 13 bp, Homo sapiens
tagtccaaaatta

SEQ ID NO: 4904097 - DNA, 16 bp, Homo sapiens
tagtcccttcccctcc

SEQ ID NO: 4904098 - DNA, 23 bp, Homo sapiens
tagtcccttcccctccctggctc

SEQ ID NO: 4904099 - DNA, 12 bp, Homo sapiens
tagtctgctcac

SEQ ID NO: 4904100 - DNA, 22 bp, Homo sapiens
tagtcttctcaaattagaaagt

SEQ ID NO: 4904101 - DNA, 18 bp, Homo sapiens
tagtgatggttcccctgt

SEQ ID NO: 4904102 - DNA, 22 bp, Homo sapiens
tagtgcatccagttaaccaagt

SEQ ID NO: 4904103 - DNA, 22 bp, Homo sapiens
tagtgctatatatataaatatt

SEQ ID NO: 4904104 - DNA, 12 bp, Homo sapiens
tagtgctgggat

SEQ ID NO: 4904105 - DNA, 13 bp, Homo sapiens
tagtggaaaaaca

SEQ ID NO: 4904106 - DNA, 16 bp, Homo sapiens
tagtggtctttgtaag

SEQ ID NO: 4904107 - DNA, 19 bp, Homo sapiens
tagtgtaaaataagaatga

SEQ ID NO: 4904108 - DNA, 20 bp, Homo sapiens
tagtgttttaagaaatgtag

SEQ ID NO: 4904109 - DNA, 13 bp, Homo sapiens
tagttaatggatt

SEQ ID NO: 4904110 - DNA, 19 bp, Homo sapiens
tagttaatggattaaattt

SEQ ID NO: 4904111 - DNA, 14 bp, Homo sapiens
tagttaatttatct

SEQ ID NO: 4904112 - DNA, 16 bp, Homo sapiens
tagttaggaaataaaa

SEQ ID NO: 4904113 - DNA, 23 bp, Homo sapiens
tagttaggaaataaaacctttca

SEQ ID NO: 4904114 - DNA, 20 bp, Homo sapiens
tagttaggatagcatttttg

SEQ ID NO: 4904115 - DNA, 18 bp, Homo sapiens
tagttcaggtaacaggca

SEQ ID NO: 4904116 - DNA, 16 bp, Homo sapiens
tagttccctctgctca

SEQ ID NO: 4904117 - DNA, 13 bp, Homo sapiens
tagttctaagact

SEQ ID NO: 4904118 - DNA, 22 bp, Homo sapiens
tagttgcgtggactctgcacat

SEQ ID NO: 4904119 - DNA, 21 bp, Homo sapiens
tagttgtccatattttcacag

SEQ ID NO: 4904120 - DNA, 16 bp, Homo sapiens
tagtttaaaacacatt

SEQ ID NO: 4904121 - DNA, 13 bp, Homo sapiens
tagtttacagaaa

SEQ ID NO: 4904122 - DNA, 11 bp, Homo sapiens
tagtttcaagc

SEQ ID NO: 4904123 - DNA, 20 bp, Homo sapiens
tagtttgacctcacagtgac

SEQ ID NO: 4904124 - DNA, 11 bp, Homo sapiens
tagtttggatt

SEQ ID NO: 4904125 - DNA, 18 bp, Homo sapiens
tagtttgtataacttctt

SEQ ID NO: 4904126 - DNA, 13 bp, Homo sapiens
tagtttgtttaat

SEQ ID NO: 4904127 - DNA, 14 bp, Homo sapiens
tagttttaaactca

SEQ ID NO: 4904128 - DNA, 16 bp, Homo sapiens
tagttttaaactcatt

SEQ ID NO: 4904129 - DNA, 12 bp, Homo sapiens
tataaaaagcca

SEQ ID NO: 4904130 - DNA, 16 bp, Homo sapiens
tataaaaatatatata

SEQ ID NO: 4904131 - DNA, 19 bp, Homo sapiens
tataaaatagttgtccata

SEQ ID NO: 4904132 - DNA, 12 bp, Homo sapiens
tataaaatgtgc

SEQ ID NO: 4904133 - DNA, 18 bp, Homo sapiens
tataaacaaagattcatg

SEQ ID NO: 4904134 - DNA, 16 bp, Homo sapiens
tataaacattaaatgt

SEQ ID NO: 4904135 - DNA, 15 bp, Homo sapiens
tataaagaatatata

SEQ ID NO: 4904136 - DNA, 15 bp, Homo sapiens
tataaagtatagaga

SEQ ID NO: 4904137 - DNA, 19 bp, Homo sapiens
tataaataggagaggatga

SEQ ID NO: 4904138 - DNA, 21 bp, Homo sapiens
tataaatcatattgatgaaaa

SEQ ID NO: 4904139 - DNA, 18 bp, Homo sapiens
tataaatgtatatacaca

SEQ ID NO: 4904140 - DNA, 19 bp, Homo sapiens
tataaatgtatatacacat

SEQ ID NO: 4904141 - DNA, 23 bp, Homo sapiens
tataaatgtatatacacatatac

SEQ ID NO: 4904142 - DNA, 20 bp, Homo sapiens
tataaccacaaagcacagtt

SEQ ID NO: 4904143 - DNA, 15 bp, Homo sapiens
tataactaacagcat

SEQ ID NO: 4904144 - DNA, 22 bp, Homo sapiens
tataacttaaaaatgtaaatat

SEQ ID NO: 4904145 - DNA, 16 bp, Homo sapiens
tataagagcatgaaat

SEQ ID NO: 4904146 - DNA, 15 bp, Homo sapiens
tataagcaaatttca

SEQ ID NO: 4904147 - DNA, 23 bp, Homo sapiens
tataagcaaatttcaaaagacat

SEQ ID NO: 4904148 - DNA, 15 bp, Homo sapiens
tataagtcacaaaga

SEQ ID NO: 4904149 - DNA, 17 bp, Homo sapiens
tataagttcacaaaatg

SEQ ID NO: 4904150 - DNA, 14 bp, Homo sapiens
tataataaaatgtg

SEQ ID NO: 4904151 - DNA, 20 bp, Homo sapiens
tataataaaatgtgttgaaa

SEQ ID NO: 4904152 - DNA, 14 bp, Homo sapiens
tataataaaggact

SEQ ID NO: 4904153 - DNA, 19 bp, Homo sapiens
tataataaaggactgtaat

SEQ ID NO: 4904154 - DNA, 17 bp, Homo sapiens
tataatactctgttgta

SEQ ID NO: 4904155 - DNA, 14 bp, Homo sapiens
tataatctgtcaaa

SEQ ID NO: 4904156 - DNA, 22 bp, Homo sapiens
tataatctgtcaaaacactgtg

SEQ ID NO: 4904157 - DNA, 14 bp, Homo sapiens
tataatgaaaacat

SEQ ID NO: 4904158 - DNA, 20 bp, Homo sapiens
tataattcactcaagcactg

SEQ ID NO: 4904159 - DNA, 23 bp, Homo sapiens
tataattcactcaagcactgata

SEQ ID NO: 4904160 - DNA, 13 bp, Homo sapiens
tataattctgtaa

SEQ ID NO: 4904161 - DNA, 16 bp, Homo sapiens
tataattctgtaaatg

SEQ ID NO: 4904162 - DNA, 21 bp, Homo sapiens
tataatttcgagatttgtagg

SEQ ID NO: 4904163 - DNA, 14 bp, Homo sapiens
tatacaaaataaga

SEQ ID NO: 4904164 - DNA, 16 bp, Homo sapiens
tatacaacaaaggcaa

SEQ ID NO: 4904165 - DNA, 13 bp, Homo sapiens
tatacaatatata

SEQ ID NO: 4904166 - DNA, 18 bp, Homo sapiens
tatacaatatataaaaat

SEQ ID NO: 4904167 - DNA, 21 bp, Homo sapiens
tatacaccatatactgttctt

SEQ ID NO: 4904168 - DNA, 12 bp, Homo sapiens
tatacagatgaa

SEQ ID NO: 4904169 - DNA, 14 bp, Homo sapiens
tatacagatgaaaa

SEQ ID NO: 4904170 - DNA, 21 bp, Homo sapiens
tatacagatgaaaatttgaga

SEQ ID NO: 4904171 - DNA, 19 bp, Homo sapiens
tatacagtaactttatgtg

SEQ ID NO: 4904172 - DNA, 21 bp, Homo sapiens
tatacagtaactttatgtgta

SEQ ID NO: 4904173 - DNA, 19 bp, Homo sapiens
tatacatacacttgtataa

SEQ ID NO: 4904174 - DNA, 20 bp, Homo sapiens
tatacatacacttgtataaa

SEQ ID NO: 4904175 - DNA, 16 bp, Homo sapiens
tatacatatgtagact

SEQ ID NO: 4904176 - DNA, 16 bp, Homo sapiens
tatacatgtgtgtata

SEQ ID NO: 4904177 - DNA, 22 bp, Homo sapiens
tatacatgtgtgtatatatgtg

SEQ ID NO: 4904178 - DNA, 20 bp, Homo sapiens
tatacattagtaaatgtctt

SEQ ID NO: 4904179 - DNA, 15 bp, Homo sapiens
tatacgaacaaaaca

SEQ ID NO: 4904180 - DNA, 18 bp, Homo sapiens
tatactccagtgtacata

SEQ ID NO: 4904181 - DNA, 18 bp, Homo sapiens
tatactctagatgaagtt

SEQ ID NO: 4904182 - DNA, 16 bp, Homo sapiens
tatactctttctgtat

SEQ ID NO: 4904183 - DNA, 17 bp, Homo sapiens
tatactctttctgtata

SEQ ID NO: 4904184 - DNA, 15 bp, Homo sapiens
tatactgtaatttag

SEQ ID NO: 4904185 - DNA, 14 bp, Homo sapiens
tatacttgaacaaa

SEQ ID NO: 4904186 - DNA, 17 bp, Homo sapiens
tatacttgaacaaaagg

SEQ ID NO: 4904187 - DNA, 15 bp, Homo sapiens
tatagacagtttgta

SEQ ID NO: 4904188 - DNA, 16 bp, Homo sapiens
tatagacagtttgtaa

SEQ ID NO: 4904189 - DNA, 19 bp, Homo sapiens
tatagactgccgtgcatta

SEQ ID NO: 4904190 - DNA, 21 bp, Homo sapiens
tatagaggaccctaacacagt

SEQ ID NO: 4904191 - DNA, 12 bp, Homo sapiens
tatagatgtcta

SEQ ID NO: 4904192 - DNA, 14 bp, Homo sapiens
tatagattctaaag

SEQ ID NO: 4904193 - DNA, 15 bp, Homo sapiens
tatagattctaaaga

SEQ ID NO: 4904194 - DNA, 14 bp, Homo sapiens
tatagcactttgaa

SEQ ID NO: 4904195 - DNA, 21 bp, Homo sapiens
tatagcactttgaaatacctc

SEQ ID NO: 4904196 - DNA, 18 bp, Homo sapiens
tatagcagcaaaaatata

SEQ ID NO: 4904197 - DNA, 21 bp, Homo sapiens
tatagcctatggcagaaaaaa

SEQ ID NO: 4904198 - DNA, 16 bp, Homo sapiens
tatagctacaggaagc

SEQ ID NO: 4904199 - DNA, 14 bp, Homo sapiens
tatagctattactg

SEQ ID NO: 4904200 - DNA, 18 bp, Homo sapiens
tataggagccttaatttt

SEQ ID NO: 4904201 - DNA, 15 bp, Homo sapiens
tataggatcatttgt

SEQ ID NO: 4904202 - DNA, 20 bp, Homo sapiens
tataggtgatgtttgctctt

SEQ ID NO: 4904203 - DNA, 22 bp, Homo sapiens
tataggttgtgcaaattaacag

SEQ ID NO: 4904204 - DNA, 12 bp, Homo sapiens
tatagtacatga

SEQ ID NO: 4904205 - DNA, 13 bp, Homo sapiens
tatagtacatgat

SEQ ID NO: 4904206 - DNA, 21 bp, Homo sapiens
tatagtcatttattttaaaaa

SEQ ID NO: 4904207 - DNA, 18 bp, Homo sapiens
tatagtgtaaaataagaa

SEQ ID NO: 4904208 - DNA, 17 bp, Homo sapiens
tatagttcctaagaagc

SEQ ID NO: 4904209 - DNA, 22 bp, Homo sapiens
tatagttcctaagaagcttcta

SEQ ID NO: 4904210 - DNA, 23 bp, Homo sapiens
tatagttcctaagaagcttctaa

SEQ ID NO: 4904211 - DNA, 13 bp, Homo sapiens
tatagttctagac

SEQ ID NO: 4904212 - DNA, 13 bp, Homo sapiens
tatagttctaggc

SEQ ID NO: 4904213 - DNA, 14 bp, Homo sapiens
tatagttgtcagta

SEQ ID NO: 4904214 - DNA, 21 bp, Homo sapiens
tatagttgtcagtattattct

SEQ ID NO: 4904215 - DNA, 19 bp, Homo sapiens
tatagtttaaaacacattg

SEQ ID NO: 4904216 - DNA, 12 bp, Homo sapiens
tatataaagtat

SEQ ID NO: 4904217 - DNA, 14 bp, Homo sapiens
tatataaagtatag

SEQ ID NO: 4904218 - DNA, 13 bp, Homo sapiens
tatataacagata

SEQ ID NO: 4904219 - DNA, 17 bp, Homo sapiens
tatataacagatacatt

SEQ ID NO: 4904220 - DNA, 18 bp, Homo sapiens
tatataacagatacattt

SEQ ID NO: 4904221 - DNA, 20 bp, Homo sapiens
tatataagagcatgaaattt

SEQ ID NO: 4904222 - DNA, 12 bp, Homo sapiens
tatatacacata

SEQ ID NO: 4904223 - DNA, 13 bp, Homo sapiens
tatatacacatat

SEQ ID NO: 4904224 - DNA, 16 bp, Homo sapiens
tatatacagaggaaat

SEQ ID NO: 4904225 - DNA, 17 bp, Homo sapiens
tatatacagtaacttta

SEQ ID NO: 4904226 - DNA, 23 bp, Homo sapiens
tatatacagtaactttatgtgta

SEQ ID NO: 4904227 - DNA, 14 bp, Homo sapiens
tatatacatatgta

SEQ ID NO: 4904228 - DNA, 16 bp, Homo sapiens
tatatacatatgtaga

SEQ ID NO: 4904229 - DNA, 17 bp, Homo sapiens
tatatacatgtgtgtat

SEQ ID NO: 4904230 - DNA, 18 bp, Homo sapiens
tatatacgcatctataaa

SEQ ID NO: 4904231 - DNA, 17 bp, Homo sapiens
tatatagaaatatatac

SEQ ID NO: 4904232 - DNA, 14 bp, Homo sapiens
tatatagaatgctg

SEQ ID NO: 4904233 - DNA, 19 bp, Homo sapiens
tatatagagatgtttttaa

SEQ ID NO: 4904234 - DNA, 17 bp, Homo sapiens
tatataggttgtgcaaa

SEQ ID NO: 4904235 - DNA, 14 bp, Homo sapiens
tatatagtgctata

SEQ ID NO: 4904236 - DNA, 13 bp, Homo sapiens
tatatatacagta

SEQ ID NO: 4904237 - DNA, 12 bp, Homo sapiens
tatatatacata

SEQ ID NO: 4904238 - DNA, 22 bp, Homo sapiens
tatatatacatacacttgtata

SEQ ID NO: 4904239 - DNA, 14 bp, Homo sapiens
tatatatacatatg

SEQ ID NO: 4904240 - DNA, 15 bp, Homo sapiens
tatatatagaaatat

SEQ ID NO: 4904241 - DNA, 11 bp, Homo sapiens
tatatatataa

SEQ ID NO: 4904242 - DNA, 12 bp, Homo sapiens
tatatatataaa

SEQ ID NO: 4904243 - DNA, 14 bp, Homo sapiens
tatatatatataaa

SEQ ID NO: 4904244 - DNA, 15 bp, Homo sapiens
tatatatatataaag

SEQ ID NO: 4904245 - DNA, 15 bp, Homo sapiens
tatatatatatactt

SEQ ID NO: 4904246 - DNA, 14 bp, Homo sapiens
tatatatatatata

SEQ ID NO: 4904247 - DNA, 15 bp, Homo sapiens
tatatatatatcagt

SEQ ID NO: 4904248 - DNA, 11 bp, Homo sapiens
tatatatatca

SEQ ID NO: 4904249 - DNA, 16 bp, Homo sapiens
tatatatcagtttgat

SEQ ID NO: 4904250 - DNA, 14 bp, Homo sapiens
tatatatgtgtatg

SEQ ID NO: 4904251 - DNA, 20 bp, Homo sapiens
tatatattcttataaaaatg

SEQ ID NO: 4904252 - DNA, 22 bp, Homo sapiens
tatatcaacagatagttgtgtt

SEQ ID NO: 4904253 - DNA, 13 bp, Homo sapiens
tatatcagaaaag

SEQ ID NO: 4904254 - DNA, 18 bp, Homo sapiens
tatatcagaaaagggaag

SEQ ID NO: 4904255 - DNA, 18 bp, Homo sapiens
tatatcatgtaaagaaat

SEQ ID NO: 4904256 - DNA, 22 bp, Homo sapiens
tatatcattggaacaactgata

SEQ ID NO: 4904257 - DNA, 14 bp, Homo sapiens
tatatcccctgcta

SEQ ID NO: 4904258 - DNA, 14 bp, Homo sapiens
tatatcctgtgact

SEQ ID NO: 4904259 - DNA, 15 bp, Homo sapiens
tatatcctgtgactg

SEQ ID NO: 4904260 - DNA, 17 bp, Homo sapiens
tatatcctgtgactgtc

SEQ ID NO: 4904261 - DNA, 16 bp, Homo sapiens
tatatctgaaaactgg

SEQ ID NO: 4904262 - DNA, 19 bp, Homo sapiens
tatatgaaaactatacaac

SEQ ID NO: 4904263 - DNA, 13 bp, Homo sapiens
tatatgatggggg

SEQ ID NO: 4904264 - DNA, 15 bp, Homo sapiens
tatatggacatggca

SEQ ID NO: 4904265 - DNA, 19 bp, Homo sapiens
tatatggatgattcagaaa

SEQ ID NO: 4904266 - DNA, 21 bp, Homo sapiens
tatatgtatatttttttaatt

SEQ ID NO: 4904267 - DNA, 18 bp, Homo sapiens
tatatgtgtatatataca

SEQ ID NO: 4904268 - DNA, 17 bp, Homo sapiens
tatattaatgtacttgt

SEQ ID NO: 4904269 - DNA, 17 bp, Homo sapiens
tatattacacatttgta

SEQ ID NO: 4904270 - DNA, 20 bp, Homo sapiens
tatattacacatttgtacag

SEQ ID NO: 4904271 - DNA, 22 bp, Homo sapiens
tatattataaatatatataaag

SEQ ID NO: 4904272 - DNA, 12 bp, Homo sapiens
tatattcaacca

SEQ ID NO: 4904273 - DNA, 14 bp, Homo sapiens
tatattcatatatt

SEQ ID NO: 4904274 - DNA, 20 bp, Homo sapiens
tatattgaagacaatttgat

SEQ ID NO: 4904275 - DNA, 19 bp, Homo sapiens
tatattgtgtttgtgtatt

SEQ ID NO: 4904276 - DNA, 19 bp, Homo sapiens
tatatttaatgcattaaac

SEQ ID NO: 4904277 - DNA, 14 bp, Homo sapiens
tatatttagtgctg

SEQ ID NO: 4904278 - DNA, 22 bp, Homo sapiens
tatatttatttaaagcattgct

SEQ ID NO: 4904279 - DNA, 13 bp, Homo sapiens
tatatttgtatcg

SEQ ID NO: 4904280 - DNA, 15 bp, Homo sapiens
tatattttaccatac

SEQ ID NO: 4904281 - DNA, 18 bp, Homo sapiens
tatattttcgtatgaaaa

SEQ ID NO: 4904282 - DNA, 21 bp, Homo sapiens
tatatttttataataaacata

SEQ ID NO: 4904283 - DNA, 20 bp, Homo sapiens
tatcaaacagaattttaaag

SEQ ID NO: 4904284 - DNA, 13 bp, Homo sapiens
tatcaactttaat

SEQ ID NO: 4904285 - DNA, 22 bp, Homo sapiens
tatcaaggaagaaatggttcag

SEQ ID NO: 4904286 - DNA, 23 bp, Homo sapiens
tatcacaaccaccgttacaagta

SEQ ID NO: 4904287 - DNA, 13 bp, Homo sapiens
tatcacacttctg

SEQ ID NO: 4904288 - DNA, 14 bp, Homo sapiens
tatcactttttgaa

SEQ ID NO: 4904289 - DNA, 20 bp, Homo sapiens
tatcactttttgaactaaga

SEQ ID NO: 4904290 - DNA, 22 bp, Homo sapiens
tatcactttttgaactaagaaa

SEQ ID NO: 4904291 - DNA, 23 bp, Homo sapiens
tatcagaagaccacaaaaattga

SEQ ID NO: 4904292 - DNA, 19 bp, Homo sapiens
tatcagatacatcactgct

SEQ ID NO: 4904293 - DNA, 20 bp, Homo sapiens
tatcagcacatattttctgt

SEQ ID NO: 4904294 - DNA, 20 bp, Homo sapiens
tatcaggtgctgccatccag

SEQ ID NO: 4904295 - DNA, 19 bp, Homo sapiens
tatcagtgttttaaattct

SEQ ID NO: 4904296 - DNA, 16 bp, Homo sapiens
tatcataaaatcaaaa

SEQ ID NO: 4904297 - DNA, 18 bp, Homo sapiens
tatcatagaaatgtaact

SEQ ID NO: 4904298 - DNA, 13 bp, Homo sapiens
tatcatagttaac

SEQ ID NO: 4904299 - DNA, 16 bp, Homo sapiens
tatcatagttaacata

SEQ ID NO: 4904300 - DNA, 15 bp, Homo sapiens
tatcatattggtatt

SEQ ID NO: 4904301 - DNA, 19 bp, Homo sapiens
tatcatctggataggagcc

SEQ ID NO: 4904302 - DNA, 14 bp, Homo sapiens
tatcatgaagcctg

SEQ ID NO: 4904303 - DNA, 13 bp, Homo sapiens
tatcatgacatgt

SEQ ID NO: 4904304 - DNA, 14 bp, Homo sapiens
tatcatgacatgtt

SEQ ID NO: 4904305 - DNA, 23 bp, Homo sapiens
tatcatgctttaaagtgtaataa

SEQ ID NO: 4904306 - DNA, 16 bp, Homo sapiens
tatcatgtaaagaaat

SEQ ID NO: 4904307 - DNA, 19 bp, Homo sapiens
tatcattgcttcctcctcc

SEQ ID NO: 4904308 - DNA, 20 bp, Homo sapiens
tatcatttattttttacatt

SEQ ID NO: 4904309 - DNA, 17 bp, Homo sapiens
tatccaaatctgaagat

SEQ ID NO: 4904310 - DNA, 20 bp, Homo sapiens
tatccaaatctgaagattgc

SEQ ID NO: 4904311 - DNA, 18 bp, Homo sapiens
tatccagaggacccaact

SEQ ID NO: 4904312 - DNA, 14 bp, Homo sapiens
tatccataaaaaaa

SEQ ID NO: 4904313 - DNA, 17 bp, Homo sapiens
tatccataaaaaaaaat

SEQ ID NO: 4904314 - DNA, 17 bp, Homo sapiens
tatccatattgagtcaa

SEQ ID NO: 4904315 - DNA, 22 bp, Homo sapiens
tatccatattgagtcaaatggt

SEQ ID NO: 4904316 - DNA, 15 bp, Homo sapiens
tatccatgtacttgt

SEQ ID NO: 4904317 - DNA, 16 bp, Homo sapiens
tatcccaatcattgtt

SEQ ID NO: 4904318 - DNA, 16 bp, Homo sapiens
tatcccacatccaact

SEQ ID NO: 4904319 - DNA, 19 bp, Homo sapiens
tatcccccccctgtatagt

SEQ ID NO: 4904320 - DNA, 21 bp, Homo sapiens
tatcccccccctgtatagtta

SEQ ID NO: 4904321 - DNA, 14 bp, Homo sapiens
tatcccctgctacc

SEQ ID NO: 4904322 - DNA, 19 bp, Homo sapiens
tatcccgagtctgggacac

SEQ ID NO: 4904323 - DNA, 12 bp, Homo sapiens
tatcccttccgg

SEQ ID NO: 4904324 - DNA, 15 bp, Homo sapiens
tatcctacaacaaga

SEQ ID NO: 4904325 - DNA, 16 bp, Homo sapiens
tatcctcactgccctc

SEQ ID NO: 4904326 - DNA, 17 bp, Homo sapiens
tatcctgaaatttcaga

SEQ ID NO: 4904327 - DNA, 15 bp, Homo sapiens
tatcctgcattgtta

SEQ ID NO: 4904328 - DNA, 16 bp, Homo sapiens
tatcgaaataacaatg

SEQ ID NO: 4904329 - DNA, 12 bp, Homo sapiens
tatctaaattaa

SEQ ID NO: 4904330 - DNA, 15 bp, Homo sapiens
tatctaatacctctg

SEQ ID NO: 4904331 - DNA, 20 bp, Homo sapiens
tatctaatacctctgtgtgc

SEQ ID NO: 4904332 - DNA, 21 bp, Homo sapiens
tatctaatatatatgaataaa

SEQ ID NO: 4904333 - DNA, 16 bp, Homo sapiens
tatctatatatgtgta

SEQ ID NO: 4904334 - DNA, 14 bp, Homo sapiens
tatctatcttccaa

SEQ ID NO: 4904335 - DNA, 12 bp, Homo sapiens
tatctattaata

SEQ ID NO: 4904336 - DNA, 18 bp, Homo sapiens
tatctattctgagaaaac

SEQ ID NO: 4904337 - DNA, 14 bp, Homo sapiens
tatctcatcaacaa

SEQ ID NO: 4904338 - DNA, 11 bp, Homo sapiens
tatctcctgac

SEQ ID NO: 4904339 - DNA, 17 bp, Homo sapiens
tatctctatttaatatt

SEQ ID NO: 4904340 - DNA, 18 bp, Homo sapiens
tatctctatttaatattt

SEQ ID NO: 4904341 - DNA, 16 bp, Homo sapiens
tatctctgaagcatgt

SEQ ID NO: 4904342 - DNA, 18 bp, Homo sapiens
tatctctgaagcatgttt

SEQ ID NO: 4904343 - DNA, 23 bp, Homo sapiens
tatctctgtgtgcacaaatattt

SEQ ID NO: 4904344 - DNA, 12 bp, Homo sapiens
tatctgaaaact

SEQ ID NO: 4904345 - DNA, 14 bp, Homo sapiens
tatctgaaaactgg

SEQ ID NO: 4904346 - DNA, 16 bp, Homo sapiens
tatctgaaaactggaa

SEQ ID NO: 4904347 - DNA, 18 bp, Homo sapiens
tatctgagttgccaagac

SEQ ID NO: 4904348 - DNA, 20 bp, Homo sapiens
tatctggaggccttccagct

SEQ ID NO: 4904349 - DNA, 19 bp, Homo sapiens
tatctggcctaaaatcttg

SEQ ID NO: 4904350 - DNA, 14 bp, Homo sapiens
tatctgggcctggg

SEQ ID NO: 4904351 - DNA, 23 bp, Homo sapiens
tatctgtcatttgagcagggctc

SEQ ID NO: 4904352 - DNA, 19 bp, Homo sapiens
tatctgtgaaatgctggca

SEQ ID NO: 4904353 - DNA, 23 bp, Homo sapiens
tatcttaaagaaacagctttcaa

SEQ ID NO: 4904354 - DNA, 14 bp, Homo sapiens
tatcttcacatagt

SEQ ID NO: 4904355 - DNA, 18 bp, Homo sapiens
tatcttcagctctttttg

SEQ ID NO: 4904356 - DNA, 14 bp, Homo sapiens
tatcttccatattt

SEQ ID NO: 4904357 - DNA, 17 bp, Homo sapiens
tatcttctcaagttcta

SEQ ID NO: 4904358 - DNA, 16 bp, Homo sapiens
tatcttttatgtttga

SEQ ID NO: 4904359 - DNA, 20 bp, Homo sapiens
tatgaaagatggctgtgcct

SEQ ID NO: 4904360 - DNA, 15 bp, Homo sapiens
tatgaatttaaatat

SEQ ID NO: 4904361 - DNA, 21 bp, Homo sapiens
tatgaatttaaatataattct

SEQ ID NO: 4904362 - DNA, 18 bp, Homo sapiens
tatgactatgtaaactac

SEQ ID NO: 4904363 - DNA, 18 bp, Homo sapiens
tatgactgctccccagcc

SEQ ID NO: 4904364 - DNA, 17 bp, Homo sapiens
tatgagcatcctgagcc

SEQ ID NO: 4904365 - DNA, 15 bp, Homo sapiens
tatgagcttccaagg

SEQ ID NO: 4904366 - DNA, 18 bp, Homo sapiens
tatgagcttgctcattaa

SEQ ID NO: 4904367 - DNA, 17 bp, Homo sapiens
tatgaggaataattatt

SEQ ID NO: 4904368 - DNA, 17 bp, Homo sapiens
tatgaggacttgtgtct

SEQ ID NO: 4904369 - DNA, 15 bp, Homo sapiens
tatgagggaaaatga

SEQ ID NO: 4904370 - DNA, 18 bp, Homo sapiens
tatgagtaactattatta

SEQ ID NO: 4904371 - DNA, 20 bp, Homo sapiens
tatgagtacaaatgccttaa

SEQ ID NO: 4904372 - DNA, 14 bp, Homo sapiens
tatgagtatacaat

SEQ ID NO: 4904373 - DNA, 20 bp, Homo sapiens
tatgagtatacaatatataa

SEQ ID NO: 4904374 - DNA, 16 bp, Homo sapiens
tatgataatagattct

SEQ ID NO: 4904375 - DNA, 17 bp, Homo sapiens
tatgataatagattctc

SEQ ID NO: 4904376 - DNA, 14 bp, Homo sapiens
tatgatcacggctc

SEQ ID NO: 4904377 - DNA, 15 bp, Homo sapiens
tatgatctgttttgt

SEQ ID NO: 4904378 - DNA, 22 bp, Homo sapiens
tatgatcttgagtataagaaat

SEQ ID NO: 4904379 - DNA, 21 bp, Homo sapiens
tatgattgtttctcaaatctt

SEQ ID NO: 4904380 - DNA, 14 bp, Homo sapiens
tatgatttaataaa

SEQ ID NO: 4904381 - DNA, 14 bp, Homo sapiens
tatgatttatagtt

SEQ ID NO: 4904382 - DNA, 15 bp, Homo sapiens
tatgatttatagttt

SEQ ID NO: 4904383 - DNA, 22 bp, Homo sapiens
tatgatttcactagaaaagctg

SEQ ID NO: 4904384 - DNA, 16 bp, Homo sapiens
tatgattttttaaaag

SEQ ID NO: 4904385 - DNA, 17 bp, Homo sapiens
tatgattttttaaaaga

SEQ ID NO: 4904386 - DNA, 21 bp, Homo sapiens
tatgattttttaaaagaaatt

SEQ ID NO: 4904387 - DNA, 14 bp, Homo sapiens
tatgcaaaatggaa

SEQ ID NO: 4904388 - DNA, 19 bp, Homo sapiens
tatgcaccttgtgtctgta

SEQ ID NO: 4904389 - DNA, 22 bp, Homo sapiens
tatgcaccttgtgtctgtacac

SEQ ID NO: 4904390 - DNA, 15 bp, Homo sapiens
tatgcactaaatatg

SEQ ID NO: 4904391 - DNA, 17 bp, Homo sapiens
tatgccagctcagtccc

SEQ ID NO: 4904392 - DNA, 19 bp, Homo sapiens
tatgctctcgcacctttcc

SEQ ID NO: 4904393 - DNA, 17 bp, Homo sapiens
tatggaactctctccac

SEQ ID NO: 4904394 - DNA, 15 bp, Homo sapiens
tatggaatcaattca

SEQ ID NO: 4904395 - DNA, 19 bp, Homo sapiens
tatggaattgatttgcatt

SEQ ID NO: 4904396 - DNA, 18 bp, Homo sapiens
tatggacagggctgtctc

SEQ ID NO: 4904397 - DNA, 17 bp, Homo sapiens
tatggagaattgctgaa

SEQ ID NO: 4904398 - DNA, 19 bp, Homo sapiens
tatggatgattcagaaatt

SEQ ID NO: 4904399 - DNA, 20 bp, Homo sapiens
tatggatgattcagaaattg

SEQ ID NO: 4904400 - DNA, 12 bp, Homo sapiens
tatggcagaaga

SEQ ID NO: 4904401 - DNA, 15 bp, Homo sapiens
tatggcagaagacac

SEQ ID NO: 4904402 - DNA, 23 bp, Homo sapiens
tatggcagaagacaccagagcag

SEQ ID NO: 4904403 - DNA, 22 bp, Homo sapiens
tatggctctgcacccctctgcc

SEQ ID NO: 4904404 - DNA, 16 bp, Homo sapiens
tatgggactcaatgca

SEQ ID NO: 4904405 - DNA, 15 bp, Homo sapiens
tatgggcattgacaa

SEQ ID NO: 4904406 - DNA, 16 bp, Homo sapiens
tatggtgaacccacaa

SEQ ID NO: 4904407 - DNA, 15 bp, Homo sapiens
tatgtaaacaggaga

SEQ ID NO: 4904408 - DNA, 14 bp, Homo sapiens
tatgtaaagtatgt

SEQ ID NO: 4904409 - DNA, 19 bp, Homo sapiens
tatgtaaagtatgtaaaca

SEQ ID NO: 4904410 - DNA, 23 bp, Homo sapiens
tatgtaatgtgtggtggcctcag

SEQ ID NO: 4904411 - DNA, 22 bp, Homo sapiens
tatgtaccatatgatctgtttt

SEQ ID NO: 4904412 - DNA, 19 bp, Homo sapiens
tatgtacgtttgtatgtgt

SEQ ID NO: 4904413 - DNA, 17 bp, Homo sapiens
tatgtactagtactgtg

SEQ ID NO: 4904414 - DNA, 23 bp, Homo sapiens
tatgtactagtactgtgtactgt

SEQ ID NO: 4904415 - DNA, 21 bp, Homo sapiens
tatgtactcctctttacactg

SEQ ID NO: 4904416 - DNA, 14 bp, Homo sapiens
tatgtactgtacta

SEQ ID NO: 4904417 - DNA, 18 bp, Homo sapiens
tatgtagatatttggctt

SEQ ID NO: 4904418 - DNA, 14 bp, Homo sapiens
tatgtagtaattga

SEQ ID NO: 4904419 - DNA, 20 bp, Homo sapiens
tatgtagtaattgacatgtg

SEQ ID NO: 4904420 - DNA, 16 bp, Homo sapiens
tatgtatcagaagaga

SEQ ID NO: 4904421 - DNA, 12 bp, Homo sapiens
tatgtattcttt

SEQ ID NO: 4904422 - DNA, 16 bp, Homo sapiens
tatgtcaagaggctga

SEQ ID NO: 4904423 - DNA, 12 bp, Homo sapiens
tatgtctattta

SEQ ID NO: 4904424 - DNA, 13 bp, Homo sapiens
tatgtctatttaa

SEQ ID NO: 4904425 - DNA, 15 bp, Homo sapiens
tatgtctatttaagc

SEQ ID NO: 4904426 - DNA, 19 bp, Homo sapiens
tatgtctcgctagtgatgt

SEQ ID NO: 4904427 - DNA, 14 bp, Homo sapiens
tatgtctgtttaag

SEQ ID NO: 4904428 - DNA, 20 bp, Homo sapiens
tatgtctgtttaagaaaagt

SEQ ID NO: 4904429 - DNA, 21 bp, Homo sapiens
tatgtgaatcctcttctttat

SEQ ID NO: 4904430 - DNA, 18 bp, Homo sapiens
tatgtgacattttacatt

SEQ ID NO: 4904431 - DNA, 19 bp, Homo sapiens
tatgtgatctgtcttgtaa

SEQ ID NO: 4904432 - DNA, 19 bp, Homo sapiens
tatgtgggttgcctggtga

SEQ ID NO: 4904433 - DNA, 17 bp, Homo sapiens
tatgtgtaaaatgtgaa

SEQ ID NO: 4904434 - DNA, 14 bp, Homo sapiens
tatgtgtaaataca

SEQ ID NO: 4904435 - DNA, 22 bp, Homo sapiens
tatgtgtatatatacatacact

SEQ ID NO: 4904436 - DNA, 21 bp, Homo sapiens
tatgtgtgcatgtgtgtataa

SEQ ID NO: 4904437 - DNA, 17 bp, Homo sapiens
tatgtgttgaaaaccaa

SEQ ID NO: 4904438 - DNA, 16 bp, Homo sapiens
tatgttactattttct

SEQ ID NO: 4904439 - DNA, 18 bp, Homo sapiens
tatgttgaatacttttta

SEQ ID NO: 4904440 - DNA, 13 bp, Homo sapiens
tatgttgcccagg

SEQ ID NO: 4904441 - DNA, 20 bp, Homo sapiens
tatgttgcccaggcaggtct

SEQ ID NO: 4904442 - DNA, 21 bp, Homo sapiens
tatgttgcccaggcaggtctt

SEQ ID NO: 4904443 - DNA, 14 bp, Homo sapiens
tatgttgcctttat

SEQ ID NO: 4904444 - DNA, 19 bp, Homo sapiens
tatgtttaatctgttatgt

SEQ ID NO: 4904445 - DNA, 22 bp, Homo sapiens
tatgtttagatagggctgggca

SEQ ID NO: 4904446 - DNA, 14 bp, Homo sapiens
tatgtttccttgtt

SEQ ID NO: 4904447 - DNA, 14 bp, Homo sapiens
tatgtttgaatatg

SEQ ID NO: 4904448 - DNA, 20 bp, Homo sapiens
tatgtttgtcttttaatgct

SEQ ID NO: 4904449 - DNA, 19 bp, Homo sapiens
tatgttttaagaggcaggg

SEQ ID NO: 4904450 - DNA, 17 bp, Homo sapiens
tatgttttttaaaatat

SEQ ID NO: 4904451 - DNA, 20 bp, Homo sapiens
tattaaaaatatggaacttc

SEQ ID NO: 4904452 - DNA, 22 bp, Homo sapiens
tattaaaaatatggaacttcta

SEQ ID NO: 4904453 - DNA, 12 bp, Homo sapiens
tattaaaacatt

SEQ ID NO: 4904454 - DNA, 17 bp, Homo sapiens
tattaaaacattggatt

SEQ ID NO: 4904455 - DNA, 19 bp, Homo sapiens
tattaaaacattggattat

SEQ ID NO: 4904456 - DNA, 17 bp, Homo sapiens
tattaaaatgattgtaa

SEQ ID NO: 4904457 - DNA, 19 bp, Homo sapiens
tattaaaatgattgtaaaa

SEQ ID NO: 4904458 - DNA, 22 bp, Homo sapiens
tattaaagtgctaaggttctaa

SEQ ID NO: 4904459 - DNA, 24 bp, Homo sapiens
tattaaagtgctaaggttctaagg

SEQ ID NO: 4904460 - DNA, 22 bp, Homo sapiens
tattaaatttgttgacaaaatt

SEQ ID NO: 4904461 - DNA, 23 bp, Homo sapiens
tattaacaacaataacactgtct

SEQ ID NO: 4904462 - DNA, 16 bp, Homo sapiens
tattaactacatttat

SEQ ID NO: 4904463 - DNA, 19 bp, Homo sapiens
tattaattttctacaaata

SEQ ID NO: 4904464 - DNA, 18 bp, Homo sapiens
tattacacatttgtacag

SEQ ID NO: 4904465 - DNA, 22 bp, Homo sapiens
tattacataaaggctaactatg

SEQ ID NO: 4904466 - DNA, 16 bp, Homo sapiens
tattaccagcaagaat

SEQ ID NO: 4904467 - DNA, 22 bp, Homo sapiens
tattaccagtggcgttgttgca

SEQ ID NO: 4904468 - DNA, 22 bp, Homo sapiens
tattaccccctccttcagacac

SEQ ID NO: 4904469 - DNA, 22 bp, Homo sapiens
tattactatgactgctccccag

SEQ ID NO: 4904470 - DNA, 17 bp, Homo sapiens
tattactcctatttttg

SEQ ID NO: 4904471 - DNA, 21 bp, Homo sapiens
tattactgtttatttctgttt

SEQ ID NO: 4904472 - DNA, 14 bp, Homo sapiens
tattacttctgcta

SEQ ID NO: 4904473 - DNA, 13 bp, Homo sapiens
tattagccaggat

SEQ ID NO: 4904474 - DNA, 17 bp, Homo sapiens
tattagccaggatcatg

SEQ ID NO: 4904475 - DNA, 18 bp, Homo sapiens
tattagccaggatcatgg

SEQ ID NO: 4904476 - DNA, 22 bp, Homo sapiens
tattagttccctgtctcttgaa

SEQ ID NO: 4904477 - DNA, 24 bp, Homo sapiens
tattataaaagggggtccgtggaa

SEQ ID NO: 4904478 - DNA, 14 bp, Homo sapiens
tattataaactgta

SEQ ID NO: 4904479 - DNA, 20 bp, Homo sapiens
tattataaatatatataaag

SEQ ID NO: 4904480 - DNA, 17 bp, Homo sapiens
tattataagcattgaaa

SEQ ID NO: 4904481 - DNA, 20 bp, Homo sapiens
tattataagcattgaaatta

SEQ ID NO: 4904482 - DNA, 21 bp, Homo sapiens
tattataagcattgaaattat

SEQ ID NO: 4904483 - DNA, 13 bp, Homo sapiens
tattatatatata

SEQ ID NO: 4904484 - DNA, 19 bp, Homo sapiens
tattatgctttattggaaa

SEQ ID NO: 4904485 - DNA, 19 bp, Homo sapiens
tattattacttatttttga

SEQ ID NO: 4904486 - DNA, 18 bp, Homo sapiens
tattattagaaattagaa

SEQ ID NO: 4904487 - DNA, 12 bp, Homo sapiens
tattattatctt

SEQ ID NO: 4904488 - DNA, 15 bp, Homo sapiens
tattatttataattc

SEQ ID NO: 4904489 - DNA, 12 bp, Homo sapiens
tattatttggca

SEQ ID NO: 4904490 - DNA, 14 bp, Homo sapiens
tattatttggcagt

SEQ ID NO: 4904491 - DNA, 14 bp, Homo sapiens
tattatttgtgttt

SEQ ID NO: 4904492 - DNA, 18 bp, Homo sapiens
tattattttggggtctct

SEQ ID NO: 4904493 - DNA, 21 bp, Homo sapiens
tattattttggggtctctttt

SEQ ID NO: 4904494 - DNA, 23 bp, Homo sapiens
tattcaaaaattatctatagcta

SEQ ID NO: 4904495 - DNA, 22 bp, Homo sapiens
tattcacatcgcttctgtgtat

SEQ ID NO: 4904496 - DNA, 16 bp, Homo sapiens
tattcagcttcatttg

SEQ ID NO: 4904497 - DNA, 19 bp, Homo sapiens
tattcagcttcatttgtgt

SEQ ID NO: 4904498 - DNA, 14 bp, Homo sapiens
tattcatgcttctt

SEQ ID NO: 4904499 - DNA, 12 bp, Homo sapiens
tattcatttagt

SEQ ID NO: 4904500 - DNA, 23 bp, Homo sapiens
tattccagaatgctgtacatcta

SEQ ID NO: 4904501 - DNA, 20 bp, Homo sapiens
tattcccaagcccatgagtc

SEQ ID NO: 4904502 - DNA, 19 bp, Homo sapiens
tattcctgcatttgtgaaa

SEQ ID NO: 4904503 - DNA, 20 bp, Homo sapiens
tattcctgcatttgtgaaat

SEQ ID NO: 4904504 - DNA, 22 bp, Homo sapiens
tattccttgatactaaaagttc

SEQ ID NO: 4904505 - DNA, 21 bp, Homo sapiens
tattcctttgggcctctgctt

SEQ ID NO: 4904506 - DNA, 15 bp, Homo sapiens
tattctaaaaccatt

SEQ ID NO: 4904507 - DNA, 22 bp, Homo sapiens
tattctaagacttactctaaga

SEQ ID NO: 4904508 - DNA, 19 bp, Homo sapiens
tattctagctaatgtaata

SEQ ID NO: 4904509 - DNA, 17 bp, Homo sapiens
tattctatatgaattta

SEQ ID NO: 4904510 - DNA, 14 bp, Homo sapiens
tattctcttttatc

SEQ ID NO: 4904511 - DNA, 15 bp, Homo sapiens
tattctgagaaaaca

SEQ ID NO: 4904512 - DNA, 23 bp, Homo sapiens
tattctgagcatactcaacaaaa

SEQ ID NO: 4904513 - DNA, 21 bp, Homo sapiens
tattctgtgttgcattattca

SEQ ID NO: 4904514 - DNA, 22 bp, Homo sapiens
tattctgtgttgcattattcat

SEQ ID NO: 4904515 - DNA, 22 bp, Homo sapiens
tattcttaagggaacttccaca

SEQ ID NO: 4904516 - DNA, 15 bp, Homo sapiens
tattcttataaaaat

SEQ ID NO: 4904517 - DNA, 15 bp, Homo sapiens
tattcttcatatcct

SEQ ID NO: 4904518 - DNA, 13 bp, Homo sapiens
tattcttctagag

SEQ ID NO: 4904519 - DNA, 20 bp, Homo sapiens
tattgaaattgtacatattt

SEQ ID NO: 4904520 - DNA, 14 bp, Homo sapiens
tattgaagaaacag

SEQ ID NO: 4904521 - DNA, 21 bp, Homo sapiens
tattgaaggaagccaaattta

SEQ ID NO: 4904522 - DNA, 13 bp, Homo sapiens
tattgaatattgt

SEQ ID NO: 4904523 - DNA, 15 bp, Homo sapiens
tattgacatttgtag

SEQ ID NO: 4904524 - DNA, 17 bp, Homo sapiens
tattgacatttgtagtt

SEQ ID NO: 4904525 - DNA, 14 bp, Homo sapiens
tattgagatttctt

SEQ ID NO: 4904526 - DNA, 15 bp, Homo sapiens
tattgaggctttgtg

SEQ ID NO: 4904527 - DNA, 14 bp, Homo sapiens
tattgagtttgtag

SEQ ID NO: 4904528 - DNA, 14 bp, Homo sapiens
tattgatagtactc

SEQ ID NO: 4904529 - DNA, 14 bp, Homo sapiens
tattgatatatatt

SEQ ID NO: 4904530 - DNA, 13 bp, Homo sapiens
tattgatgaaaag

SEQ ID NO: 4904531 - DNA, 14 bp, Homo sapiens
tattgctagtattt

SEQ ID NO: 4904532 - DNA, 16 bp, Homo sapiens
tattgctagtatttga

SEQ ID NO: 4904533 - DNA, 16 bp, Homo sapiens
tattgctgattttaat

SEQ ID NO: 4904534 - DNA, 21 bp, Homo sapiens
tattgcttattgcttagtaaa

SEQ ID NO: 4904535 - DNA, 18 bp, Homo sapiens
tattggtggttctcagca

SEQ ID NO: 4904536 - DNA, 17 bp, Homo sapiens
tattgtaaattttagaa

SEQ ID NO: 4904537 - DNA, 22 bp, Homo sapiens
tattgtacataaaagaattttt

SEQ ID NO: 4904538 - DNA, 13 bp, Homo sapiens
tattgtggtattg

SEQ ID NO: 4904539 - DNA, 23 bp, Homo sapiens
tattgtggtattgaatattgtgt

SEQ ID NO: 4904540 - DNA, 14 bp, Homo sapiens
tattgtgttccttt

SEQ ID NO: 4904541 - DNA, 14 bp, Homo sapiens
tattgtgttgtgaa

SEQ ID NO: 4904542 - DNA, 14 bp, Homo sapiens
tattgttactctta

SEQ ID NO: 4904543 - DNA, 18 bp, Homo sapiens
tattgttactcttacgaa

SEQ ID NO: 4904544 - DNA, 16 bp, Homo sapiens
tattgttcaaacaata

SEQ ID NO: 4904545 - DNA, 14 bp, Homo sapiens
tattgttgtataat

SEQ ID NO: 4904546 - DNA, 15 bp, Homo sapiens
tatttaaactatctt

SEQ ID NO: 4904547 - DNA, 16 bp, Homo sapiens
tatttaaacttataaa

SEQ ID NO: 4904548 - DNA, 21 bp, Homo sapiens
tatttaaacttataaatcata

SEQ ID NO: 4904549 - DNA, 16 bp, Homo sapiens
tatttaaatgggaata

SEQ ID NO: 4904550 - DNA, 15 bp, Homo sapiens
tatttaacaagatct

SEQ ID NO: 4904551 - DNA, 14 bp, Homo sapiens
tatttaagcaaata

SEQ ID NO: 4904552 - DNA, 16 bp, Homo sapiens
tatttaagcaaatact

SEQ ID NO: 4904553 - DNA, 17 bp, Homo sapiens
tatttaataacaattgt

SEQ ID NO: 4904554 - DNA, 14 bp, Homo sapiens
tatttaataacatt

SEQ ID NO: 4904555 - DNA, 17 bp, Homo sapiens
tatttaatgcattaaac

SEQ ID NO: 4904556 - DNA, 17 bp, Homo sapiens
tatttacctgcaggctg

SEQ ID NO: 4904557 - DNA, 15 bp, Homo sapiens
tatttacgctttgat

SEQ ID NO: 4904558 - DNA, 15 bp, Homo sapiens
tatttagttatagtt

SEQ ID NO: 4904559 - DNA, 22 bp, Homo sapiens
tatttataatagcaacttttgt

SEQ ID NO: 4904560 - DNA, 19 bp, Homo sapiens
tatttatacaagattgaaa

SEQ ID NO: 4904561 - DNA, 16 bp, Homo sapiens
tatttatagtcattta

SEQ ID NO: 4904562 - DNA, 17 bp, Homo sapiens
tatttatatgtacatga

SEQ ID NO: 4904563 - DNA, 12 bp, Homo sapiens
tatttatcttta

SEQ ID NO: 4904564 - DNA, 13 bp, Homo sapiens
tatttatgccttg

SEQ ID NO: 4904565 - DNA, 15 bp, Homo sapiens
tatttatgtactttt

SEQ ID NO: 4904566 - DNA, 14 bp, Homo sapiens
tatttatgtgtgag

SEQ ID NO: 4904567 - DNA, 15 bp, Homo sapiens
tatttatgttaaaag

SEQ ID NO: 4904568 - DNA, 13 bp, Homo sapiens
tatttatgtttgc

SEQ ID NO: 4904569 - DNA, 13 bp, Homo sapiens
tatttattaatat

SEQ ID NO: 4904570 - DNA, 17 bp, Homo sapiens
tatttattaatatttaa

SEQ ID NO: 4904571 - DNA, 18 bp, Homo sapiens
tatttattaatatttaac

SEQ ID NO: 4904572 - DNA, 14 bp, Homo sapiens
tatttattactatg

SEQ ID NO: 4904573 - DNA, 21 bp, Homo sapiens
tatttattcagcttcatttgt

SEQ ID NO: 4904574 - DNA, 24 bp, Homo sapiens
tatttattcagcttcatttgtgtc

SEQ ID NO: 4904575 - DNA, 21 bp, Homo sapiens
tatttattgaagaaacagata

SEQ ID NO: 4904576 - DNA, 12 bp, Homo sapiens
tatttatttaaa

SEQ ID NO: 4904577 - DNA, 16 bp, Homo sapiens
tatttatttaaagcat

SEQ ID NO: 4904578 - DNA, 17 bp, Homo sapiens
tatttatttaaagcatt

SEQ ID NO: 4904579 - DNA, 12 bp, Homo sapiens
tatttatttaat

SEQ ID NO: 4904580 - DNA, 21 bp, Homo sapiens
tatttatttaataacaattgt

SEQ ID NO: 4904581 - DNA, 16 bp, Homo sapiens
tatttattttcctaaa

SEQ ID NO: 4904582 - DNA, 21 bp, Homo sapiens
tatttattttcttttgaattg

SEQ ID NO: 4904583 - DNA, 12 bp, Homo sapiens
tatttattttgt

SEQ ID NO: 4904584 - DNA, 19 bp, Homo sapiens
tatttattttgtaattatg

SEQ ID NO: 4904585 - DNA, 16 bp, Homo sapiens
tatttcagattttgat

SEQ ID NO: 4904586 - DNA, 20 bp, Homo sapiens
tatttcagattttgataact

SEQ ID NO: 4904587 - DNA, 21 bp, Homo sapiens
tatttcagtgtagttaattta

SEQ ID NO: 4904588 - DNA, 22 bp, Homo sapiens
tatttcagtgtagttaatttat

SEQ ID NO: 4904589 - DNA, 18 bp, Homo sapiens
tatttcattttttgcatc

SEQ ID NO: 4904590 - DNA, 18 bp, Homo sapiens
tatttccattcaacaaga

SEQ ID NO: 4904591 - DNA, 21 bp, Homo sapiens
tatttcccatttgtgccagag

SEQ ID NO: 4904592 - DNA, 17 bp, Homo sapiens
tatttctagtccaaaat

SEQ ID NO: 4904593 - DNA, 17 bp, Homo sapiens
tatttctgcatatgttg

SEQ ID NO: 4904594 - DNA, 19 bp, Homo sapiens
tatttgaaactgaatgttt

SEQ ID NO: 4904595 - DNA, 14 bp, Homo sapiens
tatttgaattaaaa

SEQ ID NO: 4904596 - DNA, 17 bp, Homo sapiens
tatttgaattaaaactt

SEQ ID NO: 4904597 - DNA, 18 bp, Homo sapiens
tatttgaattaaaacttc

SEQ ID NO: 4904598 - DNA, 23 bp, Homo sapiens
tatttgaattaaaacttcttaaa

SEQ ID NO: 4904599 - DNA, 17 bp, Homo sapiens
tatttgacttgcatgaa

SEQ ID NO: 4904600 - DNA, 19 bp, Homo sapiens
tatttgacttgcatgaaga

SEQ ID NO: 4904601 - DNA, 22 bp, Homo sapiens
tatttgacttgcatgaagagaa

SEQ ID NO: 4904602 - DNA, 19 bp, Homo sapiens
tatttgagagttctaaatt

SEQ ID NO: 4904603 - DNA, 16 bp, Homo sapiens
tatttgcaacatttac

SEQ ID NO: 4904604 - DNA, 16 bp, Homo sapiens
tatttgccatgggctt

SEQ ID NO: 4904605 - DNA, 21 bp, Homo sapiens
tatttgctaatcaaagccagg

SEQ ID NO: 4904606 - DNA, 15 bp, Homo sapiens
tatttgctaattaaa

SEQ ID NO: 4904607 - DNA, 23 bp, Homo sapiens
tatttgctaattaaaaagttaat

SEQ ID NO: 4904608 - DNA, 16 bp, Homo sapiens
tatttggcttaaatat

SEQ ID NO: 4904609 - DNA, 19 bp, Homo sapiens
tatttgtgttttaatttaa

SEQ ID NO: 4904610 - DNA, 18 bp, Homo sapiens
tatttgttattttcagta

SEQ ID NO: 4904611 - DNA, 15 bp, Homo sapiens
tatttgttcatgttt

SEQ ID NO: 4904612 - DNA, 16 bp, Homo sapiens
tatttgttcttcaaga

SEQ ID NO: 4904613 - DNA, 14 bp, Homo sapiens
tatttgttttcatg

SEQ ID NO: 4904614 - DNA, 17 bp, Homo sapiens
tatttgtttttcattca

SEQ ID NO: 4904615 - DNA, 14 bp, Homo sapiens
tattttaaaagcca

SEQ ID NO: 4904616 - DNA, 19 bp, Homo sapiens
tattttaaacaaaatagaa

SEQ ID NO: 4904617 - DNA, 13 bp, Homo sapiens
tattttaatgtga

SEQ ID NO: 4904618 - DNA, 21 bp, Homo sapiens
tattttaatgtgatgatgtaa

SEQ ID NO: 4904619 - DNA, 15 bp, Homo sapiens
tattttacacagaaa

SEQ ID NO: 4904620 - DNA, 12 bp, Homo sapiens
tattttactatt

SEQ ID NO: 4904621 - DNA, 16 bp, Homo sapiens
tattttagaataaatt

SEQ ID NO: 4904622 - DNA, 20 bp, Homo sapiens
tattttatttccatcatgtc

SEQ ID NO: 4904623 - DNA, 14 bp, Homo sapiens
tattttcacaatgt

SEQ ID NO: 4904624 - DNA, 16 bp, Homo sapiens
tattttcacaatgtca

SEQ ID NO: 4904625 - DNA, 21 bp, Homo sapiens
tattttcattacaatggaaac

SEQ ID NO: 4904626 - DNA, 16 bp, Homo sapiens
tattttcgtatgaaaa

SEQ ID NO: 4904627 - DNA, 14 bp, Homo sapiens
tattttctatgtac

SEQ ID NO: 4904628 - DNA, 16 bp, Homo sapiens
tattttctatgtacta

SEQ ID NO: 4904629 - DNA, 17 bp, Homo sapiens
tattttctatgtactag

SEQ ID NO: 4904630 - DNA, 14 bp, Homo sapiens
tattttctgtcaga

SEQ ID NO: 4904631 - DNA, 20 bp, Homo sapiens
tattttctgtcagatgagaa

SEQ ID NO: 4904632 - DNA, 15 bp, Homo sapiens
tattttcttctaagt

SEQ ID NO: 4904633 - DNA, 20 bp, Homo sapiens
tattttgaaaagcttcttaa

SEQ ID NO: 4904634 - DNA, 14 bp, Homo sapiens
tattttgaagttta

SEQ ID NO: 4904635 - DNA, 17 bp, Homo sapiens
tattttgaagtttacat

SEQ ID NO: 4904636 - DNA, 14 bp, Homo sapiens
tattttgataataa

SEQ ID NO: 4904637 - DNA, 18 bp, Homo sapiens
tattttgataataatatt

SEQ ID NO: 4904638 - DNA, 15 bp, Homo sapiens
tattttgatgcagca

SEQ ID NO: 4904639 - DNA, 17 bp, Homo sapiens
tattttgatgcagcatt

SEQ ID NO: 4904640 - DNA, 18 bp, Homo sapiens
tattttggaaagaagaaa

SEQ ID NO: 4904641 - DNA, 23 bp, Homo sapiens
tattttggattgtatattgtgtt

SEQ ID NO: 4904642 - DNA, 15 bp, Homo sapiens
tattttgtatatatc

SEQ ID NO: 4904643 - DNA, 16 bp, Homo sapiens
tattttgtattgtggt

SEQ ID NO: 4904644 - DNA, 13 bp, Homo sapiens
tattttgtgtgac

SEQ ID NO: 4904645 - DNA, 15 bp, Homo sapiens
tattttgtgtgacca

SEQ ID NO: 4904646 - DNA, 22 bp, Homo sapiens
tattttgtgtgaccaactgtgt

SEQ ID NO: 4904647 - DNA, 17 bp, Homo sapiens
tatttttatacaaacct

SEQ ID NO: 4904648 - DNA, 15 bp, Homo sapiens
tatttttcaaggaag

SEQ ID NO: 4904649 - DNA, 14 bp, Homo sapiens
tatttttcatattg

SEQ ID NO: 4904650 - DNA, 15 bp, Homo sapiens
tatttttcatattgt

SEQ ID NO: 4904651 - DNA, 19 bp, Homo sapiens
tatttttcatattgtgcca

SEQ ID NO: 4904652 - DNA, 22 bp, Homo sapiens
tatttttgaaaggcatgttcct

SEQ ID NO: 4904653 - DNA, 14 bp, Homo sapiens
tatttttgtagtga

SEQ ID NO: 4904654 - DNA, 23 bp, Homo sapiens
tatttttgtagtgacctgtttat

SEQ ID NO: 4904655 - DNA, 17 bp, Homo sapiens
tattttttattgttttc

SEQ ID NO: 4904656 - DNA, 18 bp, Homo sapiens
tatttttttaatttaaca

SEQ ID NO: 4904657 - DNA, 17 bp, Homo sapiens
tattttttttaagtatt

SEQ ID NO: 4904658 - DNA, 20 bp, Homo sapiens
tattttttttttttgaaaaa

SEQ ID NO: 4904659 - DNA, 13 bp, Homo sapiens
tcaaaaactgttt

SEQ ID NO: 4904660 - DNA, 22 bp, Homo sapiens
tcaaaaactttggagtcccctc

SEQ ID NO: 4904661 - DNA, 14 bp, Homo sapiens
tcaaaaagtgttta

SEQ ID NO: 4904662 - DNA, 14 bp, Homo sapiens
tcaaaaatacaaaa

SEQ ID NO: 4904663 - DNA, 13 bp, Homo sapiens
tcaaaaatataac

SEQ ID NO: 4904664 - DNA, 16 bp, Homo sapiens
tcaaaaattgaagaga

SEQ ID NO: 4904665 - DNA, 21 bp, Homo sapiens
tcaaaaattgaagagagatat

SEQ ID NO: 4904666 - DNA, 21 bp, Homo sapiens
tcaaaacacatctttcctgtc

SEQ ID NO: 4904667 - DNA, 12 bp, Homo sapiens
tcaaaacactgt

SEQ ID NO: 4904668 - DNA, 13 bp, Homo sapiens
tcaaaacactgtg

SEQ ID NO: 4904669 - DNA, 16 bp, Homo sapiens
tcaaaacactgtggaa

SEQ ID NO: 4904670 - DNA, 16 bp, Homo sapiens
tcaaaactacaaatca

SEQ ID NO: 4904671 - DNA, 18 bp, Homo sapiens
tcaaaagaaaaggcaaaa

SEQ ID NO: 4904672 - DNA, 13 bp, Homo sapiens
tcaaaagacatgt

SEQ ID NO: 4904673 - DNA, 17 bp, Homo sapiens
tcaaaagacatgttgta

SEQ ID NO: 4904674 - DNA, 12 bp, Homo sapiens
tcaaaataaaaa

SEQ ID NO: 4904675 - DNA, 13 bp, Homo sapiens
tcaaaataattct

SEQ ID NO: 4904676 - DNA, 17 bp, Homo sapiens
tcaaaatatttgtacat

SEQ ID NO: 4904677 - DNA, 18 bp, Homo sapiens
tcaaaatatttgtacata

SEQ ID NO: 4904678 - DNA, 19 bp, Homo sapiens
tcaaaatatttgtacatag

SEQ ID NO: 4904679 - DNA, 22 bp, Homo sapiens
tcaaaatgtatatatttagtgc

SEQ ID NO: 4904680 - DNA, 20 bp, Homo sapiens
tcaaaatgttatcttctcaa

SEQ ID NO: 4904681 - DNA, 19 bp, Homo sapiens
tcaaaattgtttaaaaatt

SEQ ID NO: 4904682 - DNA, 15 bp, Homo sapiens
tcaaacaacactggt

SEQ ID NO: 4904683 - DNA, 14 bp, Homo sapiens
tcaaacaagaatgt

SEQ ID NO: 4904684 - DNA, 16 bp, Homo sapiens
tcaaacagaattttaa

SEQ ID NO: 4904685 - DNA, 21 bp, Homo sapiens
tcaaactccaaggttcccttg

SEQ ID NO: 4904686 - DNA, 14 bp, Homo sapiens
tcaaactggggcct

SEQ ID NO: 4904687 - DNA, 18 bp, Homo sapiens
tcaaactgtgaagcattt

SEQ ID NO: 4904688 - DNA, 15 bp, Homo sapiens
tcaaacttactattt

SEQ ID NO: 4904689 - DNA, 16 bp, Homo sapiens
tcaaacttactatttt

SEQ ID NO: 4904690 - DNA, 21 bp, Homo sapiens
tcaaagaaagaaagtttagaa

SEQ ID NO: 4904691 - DNA, 16 bp, Homo sapiens
tcaaagaaatgctgat

SEQ ID NO: 4904692 - DNA, 19 bp, Homo sapiens
tcaaagaaatgctgatgga

SEQ ID NO: 4904693 - DNA, 16 bp, Homo sapiens
tcaaagaaggatggca

SEQ ID NO: 4904694 - DNA, 12 bp, Homo sapiens
tcaaagatgctg

SEQ ID NO: 4904695 - DNA, 15 bp, Homo sapiens
tcaaagccacattat

SEQ ID NO: 4904696 - DNA, 18 bp, Homo sapiens
tcaaagccacattatttc

SEQ ID NO: 4904697 - DNA, 19 bp, Homo sapiens
tcaaagctcacaccaaatt

SEQ ID NO: 4904698 - DNA, 20 bp, Homo sapiens
tcaaaggttctaggtttcaa

SEQ ID NO: 4904699 - DNA, 23 bp, Homo sapiens
tcaaaggttctaggtttcaaaga

SEQ ID NO: 4904700 - DNA, 13 bp, Homo sapiens
tcaaagttttgaa

SEQ ID NO: 4904701 - DNA, 20 bp, Homo sapiens
tcaaagttttgaaaagctat

SEQ ID NO: 4904702 - DNA, 14 bp, Homo sapiens
tcaaataaaaataa

SEQ ID NO: 4904703 - DNA, 23 bp, Homo sapiens
tcaaataaaactagtgacagctt

SEQ ID NO: 4904704 - DNA, 16 bp, Homo sapiens
tcaaatccacccatat

SEQ ID NO: 4904705 - DNA, 19 bp, Homo sapiens
tcaaatccttccaaaaatt

SEQ ID NO: 4904706 - DNA, 21 bp, Homo sapiens
tcaaatccttccaaaaattat

SEQ ID NO: 4904707 - DNA, 23 bp, Homo sapiens
tcaaatcttggcaatattcctta

SEQ ID NO: 4904708 - DNA, 15 bp, Homo sapiens
tcaaatgggtgatat

SEQ ID NO: 4904709 - DNA, 20 bp, Homo sapiens
tcaaatggtaggcatttcct

SEQ ID NO: 4904710 - DNA, 14 bp, Homo sapiens
tcaaatgttctaag

SEQ ID NO: 4904711 - DNA, 20 bp, Homo sapiens
tcaaattggactttcaaaat

SEQ ID NO: 4904712 - DNA, 20 bp, Homo sapiens
tcaaattgtcagcaatttaa

SEQ ID NO: 4904713 - DNA, 16 bp, Homo sapiens
tcaacaaagaaatatt

SEQ ID NO: 4904714 - DNA, 18 bp, Homo sapiens
tcaacaaagaaatattat

SEQ ID NO: 4904715 - DNA, 21 bp, Homo sapiens
tcaacaaagaaatattatttg

SEQ ID NO: 4904716 - DNA, 14 bp, Homo sapiens
tcaacaaagcacag

SEQ ID NO: 4904717 - DNA, 23 bp, Homo sapiens
tcaacaaagcacagtgttaaatg

SEQ ID NO: 4904718 - DNA, 20 bp, Homo sapiens
tcaacaagatttccttgtgc

SEQ ID NO: 4904719 - DNA, 22 bp, Homo sapiens
tcaacaagatttccttgtgcaa

SEQ ID NO: 4904720 - DNA, 23 bp, Homo sapiens
tcaacaggggcgtgaggtcccag

SEQ ID NO: 4904721 - DNA, 17 bp, Homo sapiens
tcaacatcctgccagcc

SEQ ID NO: 4904722 - DNA, 20 bp, Homo sapiens
tcaacatcctgccagcccca

SEQ ID NO: 4904723 - DNA, 15 bp, Homo sapiens
tcaaccattccccat

SEQ ID NO: 4904724 - DNA, 19 bp, Homo sapiens
tcaaccccttcgctcctgt

SEQ ID NO: 4904725 - DNA, 23 bp, Homo sapiens
tcaaccccttcgctcctgtgtct

SEQ ID NO: 4904726 - DNA, 14 bp, Homo sapiens
tcaacctcctgggc

SEQ ID NO: 4904727 - DNA, 15 bp, Homo sapiens
tcaacctcctgtgga

SEQ ID NO: 4904728 - DNA, 17 bp, Homo sapiens
tcaacctcttctggctc

SEQ ID NO: 4904729 - DNA, 19 bp, Homo sapiens
tcaacctcttctggctcaa

SEQ ID NO: 4904730 - DNA, 18 bp, Homo sapiens
tcaacgcagccctgcttt

SEQ ID NO: 4904731 - DNA, 15 bp, Homo sapiens
tcaacgtattgtttc

SEQ ID NO: 4904732 - DNA, 18 bp, Homo sapiens
tcaactccctcctttagt

SEQ ID NO: 4904733 - DNA, 16 bp, Homo sapiens
tcaactcttcgaagcc

SEQ ID NO: 4904734 - DNA, 18 bp, Homo sapiens
tcaactgggctctgtccc

SEQ ID NO: 4904735 - DNA, 12 bp, Homo sapiens
tcaacttaacat

SEQ ID NO: 4904736 - DNA, 19 bp, Homo sapiens
tcaacttgcatccaactcc

SEQ ID NO: 4904737 - DNA, 16 bp, Homo sapiens
tcaagaaaaaataaat

SEQ ID NO: 4904738 - DNA, 18 bp, Homo sapiens
tcaagaaaaaataaatgg

SEQ ID NO: 4904739 - DNA, 22 bp, Homo sapiens
tcaagaaactgaggaattttct

SEQ ID NO: 4904740 - DNA, 14 bp, Homo sapiens
tcaagaagaaaaag

SEQ ID NO: 4904741 - DNA, 19 bp, Homo sapiens
tcaagaggtgggagggccc

SEQ ID NO: 4904742 - DNA, 21 bp, Homo sapiens
tcaagccagcaacacagagca

SEQ ID NO: 4904743 - DNA, 20 bp, Homo sapiens
tcaagccatgtataaatgtg

SEQ ID NO: 4904744 - DNA, 22 bp, Homo sapiens
tcaagccatgtataaatgtgat

SEQ ID NO: 4904745 - DNA, 22 bp, Homo sapiens
tcaaggactctggtttctcatt

SEQ ID NO: 4904746 - DNA, 17 bp, Homo sapiens
tcaaggcttatattcaa

SEQ ID NO: 4904747 - DNA, 18 bp, Homo sapiens
tcaaggcttatattcaac

SEQ ID NO: 4904748 - DNA, 17 bp, Homo sapiens
tcaagggcttactattt

SEQ ID NO: 4904749 - DNA, 20 bp, Homo sapiens
tcaaggttttaggttctaaa

SEQ ID NO: 4904750 - DNA, 23 bp, Homo sapiens
tcaaggttttaggttctaaagtt

SEQ ID NO: 4904751 - DNA, 12 bp, Homo sapiens
tcaagtatttgg

SEQ ID NO: 4904752 - DNA, 20 bp, Homo sapiens
tcaagtattttgtgtttgga

SEQ ID NO: 4904753 - DNA, 17 bp, Homo sapiens
tcaagtgattctcctgc

SEQ ID NO: 4904754 - DNA, 16 bp, Homo sapiens
tcaagttcctttgggt

SEQ ID NO: 4904755 - DNA, 19 bp, Homo sapiens
tcaagttctaagattctaa

SEQ ID NO: 4904756 - DNA, 21 bp, Homo sapiens
tcaagttgtaacttatattga

SEQ ID NO: 4904757 - DNA, 19 bp, Homo sapiens
tcaagttttgggtatgttt

SEQ ID NO: 4904758 - DNA, 12 bp, Homo sapiens
tcaataaatctt

SEQ ID NO: 4904759 - DNA, 22 bp, Homo sapiens
tcaataagaaggtagaatgagt

SEQ ID NO: 4904760 - DNA, 12 bp, Homo sapiens
tcaataataaaa

SEQ ID NO: 4904761 - DNA, 13 bp, Homo sapiens
tcaatatctaata

SEQ ID NO: 4904762 - DNA, 19 bp, Homo sapiens
tcaatatctaatatatatg

SEQ ID NO: 4904763 - DNA, 15 bp, Homo sapiens
tcaatgaagccagct

SEQ ID NO: 4904764 - DNA, 14 bp, Homo sapiens
tcaatgcactgaca

SEQ ID NO: 4904765 - DNA, 18 bp, Homo sapiens
tcaatgcactgacattgt

SEQ ID NO: 4904766 - DNA, 15 bp, Homo sapiens
tcaatgctatttttg

SEQ ID NO: 4904767 - DNA, 17 bp, Homo sapiens
tcaatgggcaatgacag

SEQ ID NO: 4904768 - DNA, 15 bp, Homo sapiens
tcaatgtgattctaa

SEQ ID NO: 4904769 - DNA, 11 bp, Homo sapiens
tcaatgtttga

SEQ ID NO: 4904770 - DNA, 22 bp, Homo sapiens
tcaatgtttgaggagcatgttt

SEQ ID NO: 4904771 - DNA, 12 bp, Homo sapiens
tcaattctcaaa

SEQ ID NO: 4904772 - DNA, 16 bp, Homo sapiens
tcacaaaaatttgaac

SEQ ID NO: 4904773 - DNA, 20 bp, Homo sapiens
tcacaaaaatttgaacactg

SEQ ID NO: 4904774 - DNA, 17 bp, Homo sapiens
tcacaaacttttatact

SEQ ID NO: 4904775 - DNA, 22 bp, Homo sapiens
tcacaaatttcacttatacctg

SEQ ID NO: 4904776 - DNA, 16 bp, Homo sapiens
tcacaacaacctggtc

SEQ ID NO: 4904777 - DNA, 19 bp, Homo sapiens
tcacaaccaccgttacaag

SEQ ID NO: 4904778 - DNA, 13 bp, Homo sapiens
tcacaatacagat

SEQ ID NO: 4904779 - DNA, 14 bp, Homo sapiens
tcacaatacagata

SEQ ID NO: 4904780 - DNA, 22 bp, Homo sapiens
tcacacagtgagtcgaggacag

SEQ ID NO: 4904781 - DNA, 14 bp, Homo sapiens
tcacacatccagac

SEQ ID NO: 4904782 - DNA, 19 bp, Homo sapiens
tcacacatccagacatcat

SEQ ID NO: 4904783 - DNA, 11 bp, Homo sapiens
tcacaccagcc

SEQ ID NO: 4904784 - DNA, 13 bp, Homo sapiens
tcacaccctgcaa

SEQ ID NO: 4904785 - DNA, 17 bp, Homo sapiens
tcacaccctgcaaggcc

SEQ ID NO: 4904786 - DNA, 23 bp, Homo sapiens
tcacaccctgcaaggcccacagg

SEQ ID NO: 4904787 - DNA, 22 bp, Homo sapiens
tcacacctcactctttatagtg

SEQ ID NO: 4904788 - DNA, 16 bp, Homo sapiens
tcacacgaccggggcc

SEQ ID NO: 4904789 - DNA, 21 bp, Homo sapiens
tcacactcagttgtgactaac

SEQ ID NO: 4904790 - DNA, 22 bp, Homo sapiens
tcacacttctgtgagaccccca

SEQ ID NO: 4904791 - DNA, 21 bp, Homo sapiens
tcacagaacccttggagccaa

SEQ ID NO: 4904792 - DNA, 14 bp, Homo sapiens
tcacagcagcctcc

SEQ ID NO: 4904793 - DNA, 19 bp, Homo sapiens
tcacagcctcctctgtctg

SEQ ID NO: 4904794 - DNA, 20 bp, Homo sapiens
tcacagcctcctctgtctgc

SEQ ID NO: 4904795 - DNA, 18 bp, Homo sapiens
tcacagcctctgacccct

SEQ ID NO: 4904796 - DNA, 19 bp, Homo sapiens
tcacagcctctgacccctc

SEQ ID NO: 4904797 - DNA, 16 bp, Homo sapiens
tcacagctcctcccac

SEQ ID NO: 4904798 - DNA, 16 bp, Homo sapiens
tcacaggactctgcct

SEQ ID NO: 4904799 - DNA, 18 bp, Homo sapiens
tcacaggactctgcctcc

SEQ ID NO: 4904800 - DNA, 15 bp, Homo sapiens
tcacaggcaggtcca

SEQ ID NO: 4904801 - DNA, 16 bp, Homo sapiens
tcacagggttgggccc

SEQ ID NO: 4904802 - DNA, 23 bp, Homo sapiens
tcacagggttgggcccagatctg

SEQ ID NO: 4904803 - DNA, 18 bp, Homo sapiens
tcacaggtgtggtgtaat

SEQ ID NO: 4904804 - DNA, 19 bp, Homo sapiens
tcacaggtgtggtgtaatt

SEQ ID NO: 4904805 - DNA, 22 bp, Homo sapiens
tcacaggttggaagagaatcac

SEQ ID NO: 4904806 - DNA, 18 bp, Homo sapiens
tcacagtacagcatgtgc

SEQ ID NO: 4904807 - DNA, 15 bp, Homo sapiens
tcacagtagagccag

SEQ ID NO: 4904808 - DNA, 18 bp, Homo sapiens
tcacagtgacccttccca

SEQ ID NO: 4904809 - DNA, 17 bp, Homo sapiens
tcacagtgttgcccagg

SEQ ID NO: 4904810 - DNA, 13 bp, Homo sapiens
tcacagttgacaa

SEQ ID NO: 4904811 - DNA, 17 bp, Homo sapiens
tcacataaaacctcatt

SEQ ID NO: 4904812 - DNA, 17 bp, Homo sapiens
tcacatagagtgatctt

SEQ ID NO: 4904813 - DNA, 21 bp, Homo sapiens
tcacatagctacccaaaagag

SEQ ID NO: 4904814 - DNA, 16 bp, Homo sapiens
tcacatcagataagac

SEQ ID NO: 4904815 - DNA, 20 bp, Homo sapiens
tcacatgacctgatcactag

SEQ ID NO: 4904816 - DNA, 21 bp, Homo sapiens
tcacatgatctgtttttcacc

SEQ ID NO: 4904817 - DNA, 16 bp, Homo sapiens
tcacatggcctatgca

SEQ ID NO: 4904818 - DNA, 16 bp, Homo sapiens
tcacatggtgccccta

SEQ ID NO: 4904819 - DNA, 21 bp, Homo sapiens
tcacattaaaaaatgaaatat

SEQ ID NO: 4904820 - DNA, 23 bp, Homo sapiens
tcacattgagctgatataaattc

SEQ ID NO: 4904821 - DNA, 12 bp, Homo sapiens
tcacattgcatt

SEQ ID NO: 4904822 - DNA, 15 bp, Homo sapiens
tcacattgcattcta

SEQ ID NO: 4904823 - DNA, 17 bp, Homo sapiens
tcacattgcattctatt

SEQ ID NO: 4904824 - DNA, 21 bp, Homo sapiens
tcacattgcattctattgcct

SEQ ID NO: 4904825 - DNA, 14 bp, Homo sapiens
tcacatttattctg

SEQ ID NO: 4904826 - DNA, 17 bp, Homo sapiens
tcacatttattctgctc

SEQ ID NO: 4904827 - DNA, 15 bp, Homo sapiens
tcaccactccattcc

SEQ ID NO: 4904828 - DNA, 21 bp, Homo sapiens
tcaccagatttgctaatttat

SEQ ID NO: 4904829 - DNA, 13 bp, Homo sapiens
tcaccagcaccaa

SEQ ID NO: 4904830 - DNA, 19 bp, Homo sapiens
tcaccagccccactgccag

SEQ ID NO: 4904831 - DNA, 24 bp, Homo sapiens
tcaccagccccactgccagcagca

SEQ ID NO: 4904832 - DNA, 18 bp, Homo sapiens
tcaccagctgctgctctg

SEQ ID NO: 4904833 - DNA, 19 bp, Homo sapiens
tcaccccatcccacaccct

SEQ ID NO: 4904834 - DNA, 14 bp, Homo sapiens
tcaccccccactca

SEQ ID NO: 4904835 - DNA, 16 bp, Homo sapiens
tcaccccggcaggccc

SEQ ID NO: 4904836 - DNA, 21 bp, Homo sapiens
tcaccccggcaggccctgcag

SEQ ID NO: 4904837 - DNA, 13 bp, Homo sapiens
tcacccctgtcct

SEQ ID NO: 4904838 - DNA, 16 bp, Homo sapiens
tcacccctgtcctcac

SEQ ID NO: 4904839 - DNA, 17 bp, Homo sapiens
tcacccctgtcctcact

SEQ ID NO: 4904840 - DNA, 20 bp, Homo sapiens
tcacccgtacaggcaattcc

SEQ ID NO: 4904841 - DNA, 17 bp, Homo sapiens
tcaccctacctgtgcct

SEQ ID NO: 4904842 - DNA, 14 bp, Homo sapiens
tcaccctccacctc

SEQ ID NO: 4904843 - DNA, 18 bp, Homo sapiens
tcaccctcttcctgtgat

SEQ ID NO: 4904844 - DNA, 17 bp, Homo sapiens
tcacccttaacccaagg

SEQ ID NO: 4904845 - DNA, 18 bp, Homo sapiens
tcacccttaacccaagga

SEQ ID NO: 4904846 - DNA, 19 bp, Homo sapiens
tcacccttaacccaaggag

SEQ ID NO: 4904847 - DNA, 17 bp, Homo sapiens
tcacccttggacaagac

SEQ ID NO: 4904848 - DNA, 17 bp, Homo sapiens
tcacctaagtctctgtg

SEQ ID NO: 4904849 - DNA, 15 bp, Homo sapiens
tcacctagaaattga

SEQ ID NO: 4904850 - DNA, 14 bp, Homo sapiens
tcacctagagccag

SEQ ID NO: 4904851 - DNA, 18 bp, Homo sapiens
tcacctagagccagacca

SEQ ID NO: 4904852 - DNA, 22 bp, Homo sapiens
tcacctcctctaaggttgggca

SEQ ID NO: 4904853 - DNA, 18 bp, Homo sapiens
tcacctctggactggcta

SEQ ID NO: 4904854 - DNA, 19 bp, Homo sapiens
tcacctgaagactcattct

SEQ ID NO: 4904855 - DNA, 19 bp, Homo sapiens
tcacctgagtcaccctacc

SEQ ID NO: 4904856 - DNA, 13 bp, Homo sapiens
tcaccttcccttg

SEQ ID NO: 4904857 - DNA, 20 bp, Homo sapiens
tcaccttgtgtgttccaagt

SEQ ID NO: 4904858 - DNA, 16 bp, Homo sapiens
tcacctttgtgtattt

SEQ ID NO: 4904859 - DNA, 13 bp, Homo sapiens
tcacgacgctgca

SEQ ID NO: 4904860 - DNA, 15 bp, Homo sapiens
tcacgcaacttgaaa

SEQ ID NO: 4904861 - DNA, 13 bp, Homo sapiens
tcacgccactgca

SEQ ID NO: 4904862 - DNA, 20 bp, Homo sapiens
tcacgggcatgggcactccc

SEQ ID NO: 4904863 - DNA, 22 bp, Homo sapiens
tcactagtgaccccttccctgt

SEQ ID NO: 4904864 - DNA, 14 bp, Homo sapiens
tcactatccatgca

SEQ ID NO: 4904865 - DNA, 20 bp, Homo sapiens
tcactatgttgcccaggcag

SEQ ID NO: 4904866 - DNA, 14 bp, Homo sapiens
tcactcaagcactg

SEQ ID NO: 4904867 - DNA, 13 bp, Homo sapiens
tcactcattgctg

SEQ ID NO: 4904868 - DNA, 19 bp, Homo sapiens
tcactcattgctgagcctc

SEQ ID NO: 4904869 - DNA, 20 bp, Homo sapiens
tcactcattgctgagcctct

SEQ ID NO: 4904870 - DNA, 18 bp, Homo sapiens
tcactccccaaggaagag

SEQ ID NO: 4904871 - DNA, 15 bp, Homo sapiens
tcactcctacctggt

SEQ ID NO: 4904872 - DNA, 19 bp, Homo sapiens
tcactctacttagcatgtc

SEQ ID NO: 4904873 - DNA, 20 bp, Homo sapiens
tcactctacttagcatgtcc

SEQ ID NO: 4904874 - DNA, 11 bp, Homo sapiens
tcactctgcca

SEQ ID NO: 4904875 - DNA, 13 bp, Homo sapiens
tcactctgccagg

SEQ ID NO: 4904876 - DNA, 14 bp, Homo sapiens
tcactctgccaggg

SEQ ID NO: 4904877 - DNA, 13 bp, Homo sapiens
tcactctggcctc

SEQ ID NO: 4904878 - DNA, 14 bp, Homo sapiens
tcactctggcctca

SEQ ID NO: 4904879 - DNA, 16 bp, Homo sapiens
tcactctgtcgcccag

SEQ ID NO: 4904880 - DNA, 20 bp, Homo sapiens
tcactcttattgcccacgct

SEQ ID NO: 4904881 - DNA, 15 bp, Homo sapiens
tcactgacacaaagg

SEQ ID NO: 4904882 - DNA, 16 bp, Homo sapiens
tcactgacacaaagga

SEQ ID NO: 4904883 - DNA, 17 bp, Homo sapiens
tcactgacacaaaggaa

SEQ ID NO: 4904884 - DNA, 18 bp, Homo sapiens
tcactgcaacctccgcct

SEQ ID NO: 4904885 - DNA, 20 bp, Homo sapiens
tcactgcacagtgcatctca

SEQ ID NO: 4904886 - DNA, 12 bp, Homo sapiens
tcactgcagcct

SEQ ID NO: 4904887 - DNA, 14 bp, Homo sapiens
tcactgcagcctca

SEQ ID NO: 4904888 - DNA, 15 bp, Homo sapiens
tcactgccacactct

SEQ ID NO: 4904889 - DNA, 16 bp, Homo sapiens
tcactgccactttgca

SEQ ID NO: 4904890 - DNA, 20 bp, Homo sapiens
tcactgccactttgcacatt

SEQ ID NO: 4904891 - DNA, 23 bp, Homo sapiens
tcactgccactttgcacattttg

SEQ ID NO: 4904892 - DNA, 21 bp, Homo sapiens
tcactgctccctgaagccagc

SEQ ID NO: 4904893 - DNA, 24 bp, Homo sapiens
tcactgctccctgaagccagcctt

SEQ ID NO: 4904894 - DNA, 16 bp, Homo sapiens
tcactgctggctgcct

SEQ ID NO: 4904895 - DNA, 22 bp, Homo sapiens
tcactgctggctgccttagaac

SEQ ID NO: 4904896 - DNA, 15 bp, Homo sapiens
tcactgcttgatgaa

SEQ ID NO: 4904897 - DNA, 15 bp, Homo sapiens
tcactggccatccct

SEQ ID NO: 4904898 - DNA, 18 bp, Homo sapiens
tcactggtagaccaaaat

SEQ ID NO: 4904899 - DNA, 14 bp, Homo sapiens
tcactgtataaata

SEQ ID NO: 4904900 - DNA, 16 bp, Homo sapiens
tcactgtataaatagg

SEQ ID NO: 4904901 - DNA, 17 bp, Homo sapiens
tcactgtataaatagga

SEQ ID NO: 4904902 - DNA, 24 bp, Homo sapiens
tcactgtataaataggagaggatg

SEQ ID NO: 4904903 - DNA, 23 bp, Homo sapiens
tcactgtcaatgattattttcat

SEQ ID NO: 4904904 - DNA, 15 bp, Homo sapiens
tcactgtgtacataa

SEQ ID NO: 4904905 - DNA, 22 bp, Homo sapiens
tcactgttagctttttaaaaca

SEQ ID NO: 4904906 - DNA, 23 bp, Homo sapiens
tcactgttagctttttaaaacat

SEQ ID NO: 4904907 - DNA, 18 bp, Homo sapiens
tcactgttgcccaggctg

SEQ ID NO: 4904908 - DNA, 23 bp, Homo sapiens
tcactgttgcccaggctggcgtg

SEQ ID NO: 4904909 - DNA, 18 bp, Homo sapiens
tcacttactattgttgct

SEQ ID NO: 4904910 - DNA, 13 bp, Homo sapiens
tcacttatacctg

SEQ ID NO: 4904911 - DNA, 17 bp, Homo sapiens
tcacttcctacaagagc

SEQ ID NO: 4904912 - DNA, 23 bp, Homo sapiens
tcacttcgcgtgccctcgctgct

SEQ ID NO: 4904913 - DNA, 22 bp, Homo sapiens
tcacttctcttaaacttgtgaa

SEQ ID NO: 4904914 - DNA, 14 bp, Homo sapiens
tcacttgtacaaaa

SEQ ID NO: 4904915 - DNA, 15 bp, Homo sapiens
tcacttgtacaaaat

SEQ ID NO: 4904916 - DNA, 16 bp, Homo sapiens
tcacttgtgctttgct

SEQ ID NO: 4904917 - DNA, 18 bp, Homo sapiens
tcacttgtgctttgctct

SEQ ID NO: 4904918 - DNA, 19 bp, Homo sapiens
tcacttgtgctttgctctt

SEQ ID NO: 4904919 - DNA, 23 bp, Homo sapiens
tcacttgtgctttgctcttgtcc

SEQ ID NO: 4904920 - DNA, 13 bp, Homo sapiens
tcactttgtctaa

SEQ ID NO: 4904921 - DNA, 14 bp, Homo sapiens
tcacttttcagtga

SEQ ID NO: 4904922 - DNA, 21 bp, Homo sapiens
tcacttttgctccgaagctac

SEQ ID NO: 4904923 - DNA, 20 bp, Homo sapiens
tcactttttgaactaagaaa

SEQ ID NO: 4904924 - DNA, 22 bp, Homo sapiens
tcactttttttttttgtttgat

SEQ ID NO: 4904925 - DNA, 18 bp, Homo sapiens
tcagaaaccaaacagttt

SEQ ID NO: 4904926 - DNA, 17 bp, Homo sapiens
tcagaaatttttatcag

SEQ ID NO: 4904927 - DNA, 22 bp, Homo sapiens
tcagaaccatccatagtagtat

SEQ ID NO: 4904928 - DNA, 23 bp, Homo sapiens
tcagaacccagggctctgcccca

SEQ ID NO: 4904929 - DNA, 15 bp, Homo sapiens
tcagaacctcttccc

SEQ ID NO: 4904930 - DNA, 17 bp, Homo sapiens
tcagaacctcttcccca

SEQ ID NO: 4904931 - DNA, 17 bp, Homo sapiens
tcagaagagttgtgcac

SEQ ID NO: 4904932 - DNA, 15 bp, Homo sapiens
tcagaataaggcagg

SEQ ID NO: 4904933 - DNA, 21 bp, Homo sapiens
tcagaataaggcaggcattga

SEQ ID NO: 4904934 - DNA, 16 bp, Homo sapiens
tcagaattatttttaa

SEQ ID NO: 4904935 - DNA, 21 bp, Homo sapiens
tcagaattgatcattttcccc

SEQ ID NO: 4904936 - DNA, 15 bp, Homo sapiens
tcagacaccctcaac

SEQ ID NO: 4904937 - DNA, 17 bp, Homo sapiens
tcagacaccctcaacct

SEQ ID NO: 4904938 - DNA, 15 bp, Homo sapiens
tcagacagaacttga

SEQ ID NO: 4904939 - DNA, 16 bp, Homo sapiens
tcagacataaagccat

SEQ ID NO: 4904940 - DNA, 15 bp, Homo sapiens
tcagacatgttttcc

SEQ ID NO: 4904941 - DNA, 21 bp, Homo sapiens
tcagaccttggatcagatgaa

SEQ ID NO: 4904942 - DNA, 18 bp, Homo sapiens
tcagactctcagcccaga

SEQ ID NO: 4904943 - DNA, 19 bp, Homo sapiens
tcagactctcagcccagaa

SEQ ID NO: 4904944 - DNA, 20 bp, Homo sapiens
tcagactctcagcccagaag

SEQ ID NO: 4904945 - DNA, 16 bp, Homo sapiens
tcagacttttgtacat

SEQ ID NO: 4904946 - DNA, 21 bp, Homo sapiens
tcagagacaaaatatttccca

SEQ ID NO: 4904947 - DNA, 22 bp, Homo sapiens
tcagagagcgagcgctacccac

SEQ ID NO: 4904948 - DNA, 14 bp, Homo sapiens
tcagagcaggacct

SEQ ID NO: 4904949 - DNA, 18 bp, Homo sapiens
tcagagcaggacctccct

SEQ ID NO: 4904950 - DNA, 13 bp, Homo sapiens
tcagagcctgcag

SEQ ID NO: 4904951 - DNA, 14 bp, Homo sapiens
tcagagcctgcagt

SEQ ID NO: 4904952 - DNA, 18 bp, Homo sapiens
tcagaggacctgtattta

SEQ ID NO: 4904953 - DNA, 23 bp, Homo sapiens
tcagaggacctgtatttaagcaa

SEQ ID NO: 4904954 - DNA, 18 bp, Homo sapiens
tcagagggggactgctgc

SEQ ID NO: 4904955 - DNA, 14 bp, Homo sapiens
tcagagtagaaata

SEQ ID NO: 4904956 - DNA, 18 bp, Homo sapiens
tcagagtccttaaaatgt

SEQ ID NO: 4904957 - DNA, 19 bp, Homo sapiens
tcagatcactgaatttata

SEQ ID NO: 4904958 - DNA, 23 bp, Homo sapiens
tcagatcagtgtaccatttgcct

SEQ ID NO: 4904959 - DNA, 19 bp, Homo sapiens
tcagatctttctccttgaa

SEQ ID NO: 4904960 - DNA, 17 bp, Homo sapiens
tcagatgagaacaaagc

SEQ ID NO: 4904961 - DNA, 20 bp, Homo sapiens
tcagatgagaacaaagctgt

SEQ ID NO: 4904962 - DNA, 20 bp, Homo sapiens
tcagatgctccaagattcta

SEQ ID NO: 4904963 - DNA, 21 bp, Homo sapiens
tcagattttgataactgttta

SEQ ID NO: 4904964 - DNA, 19 bp, Homo sapiens
tcagcaatttaactagaca

SEQ ID NO: 4904965 - DNA, 18 bp, Homo sapiens
tcagcacatattttctgt

SEQ ID NO: 4904966 - DNA, 13 bp, Homo sapiens
tcagcaccaccct

SEQ ID NO: 4904967 - DNA, 14 bp, Homo sapiens
tcagcaccacccta

SEQ ID NO: 4904968 - DNA, 13 bp, Homo sapiens
tcagcactgaaaa

SEQ ID NO: 4904969 - DNA, 21 bp, Homo sapiens
tcagcacttgtctcattttaa

SEQ ID NO: 4904970 - DNA, 23 bp, Homo sapiens
tcagcacttgtctcattttaatg

SEQ ID NO: 4904971 - DNA, 21 bp, Homo sapiens
tcagcagccgccttaagctga

SEQ ID NO: 4904972 - DNA, 15 bp, Homo sapiens
tcagccacacccagg

SEQ ID NO: 4904973 - DNA, 23 bp, Homo sapiens
tcagccaccatcctattgcaaag

SEQ ID NO: 4904974 - DNA, 19 bp, Homo sapiens
tcagcccccagcccctccc

SEQ ID NO: 4904975 - DNA, 15 bp, Homo sapiens
tcagccctccctgcc

SEQ ID NO: 4904976 - DNA, 18 bp, Homo sapiens
tcagccctccctgcccct

SEQ ID NO: 4904977 - DNA, 19 bp, Homo sapiens
tcagccctccctgcccctc

SEQ ID NO: 4904978 - DNA, 23 bp, Homo sapiens
tcagccctgaggtgaaagggagc

SEQ ID NO: 4904979 - DNA, 12 bp, Homo sapiens
tcagcctcccaa

SEQ ID NO: 4904980 - DNA, 22 bp, Homo sapiens
tcagcctcccaaagtgctggga

SEQ ID NO: 4904981 - DNA, 21 bp, Homo sapiens
tcagcctcccgagtagctggg

SEQ ID NO: 4904982 - DNA, 12 bp, Homo sapiens
tcagcctgcaca

SEQ ID NO: 4904983 - DNA, 17 bp, Homo sapiens
tcagcggggacagctcc

SEQ ID NO: 4904984 - DNA, 19 bp, Homo sapiens
tcagcggggacagctcctt

SEQ ID NO: 4904985 - DNA, 20 bp, Homo sapiens
tcagcggggacagctccttc

SEQ ID NO: 4904986 - DNA, 21 bp, Homo sapiens
tcagcggggacagctccttct

SEQ ID NO: 4904987 - DNA, 19 bp, Homo sapiens
tcagctaagggaagacatt

SEQ ID NO: 4904988 - DNA, 19 bp, Homo sapiens
tcagctacccactatcctt

SEQ ID NO: 4904989 - DNA, 19 bp, Homo sapiens
tcagctactgatttttgtg

SEQ ID NO: 4904990 - DNA, 18 bp, Homo sapiens
tcagctcagcgccagcct

SEQ ID NO: 4904991 - DNA, 12 bp, Homo sapiens
tcagctccagct

SEQ ID NO: 4904992 - DNA, 21 bp, Homo sapiens
tcagctccagctcaccagccc

SEQ ID NO: 4904993 - DNA, 22 bp, Homo sapiens
tcagctccagctcaccagcccc

SEQ ID NO: 4904994 - DNA, 23 bp, Homo sapiens
tcagctccagctcaccagcccca

SEQ ID NO: 4904995 - DNA, 13 bp, Homo sapiens
tcagctctttttg

SEQ ID NO: 4904996 - DNA, 13 bp, Homo sapiens
tcagctgtcctcc

SEQ ID NO: 4904997 - DNA, 19 bp, Homo sapiens
tcagctgtcctccctccac

SEQ ID NO: 4904998 - DNA, 17 bp, Homo sapiens
tcagcttaaaataaaca

SEQ ID NO: 4904999 - DNA, 18 bp, Homo sapiens
tcagcttaaaataaacag

SEQ ID NO: 4905000 - DNA, 22 bp, Homo sapiens
tcagcttacatccctgagcagg

SEQ ID NO: 4905001 - DNA, 21 bp, Homo sapiens
tcagcttcatttgtgtcaatg

SEQ ID NO: 4905002 - DNA, 20 bp, Homo sapiens
tcagcttgtaaatagctcag

SEQ ID NO: 4905003 - DNA, 22 bp, Homo sapiens
tcagcttgtaaatagctcaggt

SEQ ID NO: 4905004 - DNA, 15 bp, Homo sapiens
tcagctttgagaagc

SEQ ID NO: 4905005 - DNA, 12 bp, Homo sapiens
tcaggaggcgcc

SEQ ID NO: 4905006 - DNA, 23 bp, Homo sapiens
tcaggatatccttatcagagcta

SEQ ID NO: 4905007 - DNA, 15 bp, Homo sapiens
tcaggcactagcctt

SEQ ID NO: 4905008 - DNA, 22 bp, Homo sapiens
tcaggcactagcctttggctct

SEQ ID NO: 4905009 - DNA, 13 bp, Homo sapiens
tcaggcagctcaa

SEQ ID NO: 4905010 - DNA, 13 bp, Homo sapiens
tcaggcaggaagg

SEQ ID NO: 4905011 - DNA, 23 bp, Homo sapiens
tcaggcaggcacctagcaattcc

SEQ ID NO: 4905012 - DNA, 15 bp, Homo sapiens
tcaggccatggctcc

SEQ ID NO: 4905013 - DNA, 11 bp, Homo sapiens
tcaggccctgg

SEQ ID NO: 4905014 - DNA, 20 bp, Homo sapiens
tcaggcgatccacctgtctc

SEQ ID NO: 4905015 - DNA, 21 bp, Homo sapiens
tcaggctcttctcctttcaca

SEQ ID NO: 4905016 - DNA, 12 bp, Homo sapiens
tcaggctgcagc

SEQ ID NO: 4905017 - DNA, 14 bp, Homo sapiens
tcagggacagagcc

SEQ ID NO: 4905018 - DNA, 15 bp, Homo sapiens
tcagggacagagcca

SEQ ID NO: 4905019 - DNA, 15 bp, Homo sapiens
tcagggacaggatga

SEQ ID NO: 4905020 - DNA, 23 bp, Homo sapiens
tcagggagcagggaaggcctgac

SEQ ID NO: 4905021 - DNA, 20 bp, Homo sapiens
tcagggattttttttttaaa

SEQ ID NO: 4905022 - DNA, 14 bp, Homo sapiens
tcagggccatgcct

SEQ ID NO: 4905023 - DNA, 20 bp, Homo sapiens
tcagggcctggggcctgaga

SEQ ID NO: 4905024 - DNA, 22 bp, Homo sapiens
tcagggcctggggcctgagaga

SEQ ID NO: 4905025 - DNA, 15 bp, Homo sapiens
tcagggctcctccca

SEQ ID NO: 4905026 - DNA, 16 bp, Homo sapiens
tcaggggactcagccc

SEQ ID NO: 4905027 - DNA, 12 bp, Homo sapiens
tcaggggccaga

SEQ ID NO: 4905028 - DNA, 14 bp, Homo sapiens
tcaggggccagagg

SEQ ID NO: 4905029 - DNA, 15 bp, Homo sapiens
tcaggggccagagga

SEQ ID NO: 4905030 - DNA, 16 bp, Homo sapiens
tcaggggccagaggaa

SEQ ID NO: 4905031 - DNA, 17 bp, Homo sapiens
tcagggggaagaagcag

SEQ ID NO: 4905032 - DNA, 17 bp, Homo sapiens
tcagggttggcccctgc

SEQ ID NO: 4905033 - DNA, 18 bp, Homo sapiens
tcagggttggcccctgcc

SEQ ID NO: 4905034 - DNA, 16 bp, Homo sapiens
tcaggtaacaggcaga

SEQ ID NO: 4905035 - DNA, 21 bp, Homo sapiens
tcaggtaacaggcagatacag

SEQ ID NO: 4905036 - DNA, 16 bp, Homo sapiens
tcaggtatgttgcctt

SEQ ID NO: 4905037 - DNA, 18 bp, Homo sapiens
tcaggtcacataaaactt

SEQ ID NO: 4905038 - DNA, 23 bp, Homo sapiens
tcaggtcacataaaactttgtat

SEQ ID NO: 4905039 - DNA, 21 bp, Homo sapiens
tcaggtctcccacgtgggaga

SEQ ID NO: 4905040 - DNA, 17 bp, Homo sapiens
tcaggtgaaaatgttca

SEQ ID NO: 4905041 - DNA, 18 bp, Homo sapiens
tcaggtgaaaatgttcat

SEQ ID NO: 4905042 - DNA, 16 bp, Homo sapiens
tcaggtgatccaccca

SEQ ID NO: 4905043 - DNA, 23 bp, Homo sapiens
tcaggtgatccacccacctcagc

SEQ ID NO: 4905044 - DNA, 15 bp, Homo sapiens
tcaggtgctgccatc

SEQ ID NO: 4905045 - DNA, 14 bp, Homo sapiens
tcaggtggggcagc

SEQ ID NO: 4905046 - DNA, 15 bp, Homo sapiens
tcaggtggggcagct

SEQ ID NO: 4905047 - DNA, 16 bp, Homo sapiens
tcaggtggggcagctt

SEQ ID NO: 4905048 - DNA, 20 bp, Homo sapiens
tcaggtggggcagcttgagg

SEQ ID NO: 4905049 - DNA, 23 bp, Homo sapiens
tcaggttatcgaaataacaatgt

SEQ ID NO: 4905050 - DNA, 23 bp, Homo sapiens
tcaggtttaacatttgccttgca

SEQ ID NO: 4905051 - DNA, 13 bp, Homo sapiens
tcagtaatgttat

SEQ ID NO: 4905052 - DNA, 17 bp, Homo sapiens
tcagtaatttgaggaca

SEQ ID NO: 4905053 - DNA, 16 bp, Homo sapiens
tcagtaccctctcagc

SEQ ID NO: 4905054 - DNA, 20 bp, Homo sapiens
tcagtacttgtgaaacacag

SEQ ID NO: 4905055 - DNA, 24 bp, Homo sapiens
tcagtacttgtgaaacacagctgt

SEQ ID NO: 4905056 - DNA, 13 bp, Homo sapiens
tcagtaggctaat

SEQ ID NO: 4905057 - DNA, 18 bp, Homo sapiens
tcagtaggctaatgtcaa

SEQ ID NO: 4905058 - DNA, 16 bp, Homo sapiens
tcagtatgtattcttt

SEQ ID NO: 4905059 - DNA, 23 bp, Homo sapiens
tcagtattaatactaaaatatgt

SEQ ID NO: 4905060 - DNA, 14 bp, Homo sapiens
tcagtatttcagtg

SEQ ID NO: 4905061 - DNA, 23 bp, Homo sapiens
tcagtattttggagaaattattt

SEQ ID NO: 4905062 - DNA, 17 bp, Homo sapiens
tcagtcagaaaacttta

SEQ ID NO: 4905063 - DNA, 23 bp, Homo sapiens
tcagtcagaaaactttaaaaaat

SEQ ID NO: 4905064 - DNA, 17 bp, Homo sapiens
tcagtcctcccctcaca

SEQ ID NO: 4905065 - DNA, 23 bp, Homo sapiens
tcagtcctcccctcacagcctct

SEQ ID NO: 4905066 - DNA, 19 bp, Homo sapiens
tcagtctgattcccaagct

SEQ ID NO: 4905067 - DNA, 19 bp, Homo sapiens
tcagtctggtgggaggacg

SEQ ID NO: 4905068 - DNA, 13 bp, Homo sapiens
tcagtcttgcctt

SEQ ID NO: 4905069 - DNA, 20 bp, Homo sapiens
tcagtcttgccttacacaaa

SEQ ID NO: 4905070 - DNA, 21 bp, Homo sapiens
tcagtctttttctgttgtaac

SEQ ID NO: 4905071 - DNA, 11 bp, Homo sapiens
tcagtggcagc

SEQ ID NO: 4905072 - DNA, 14 bp, Homo sapiens
tcagtggcagctgc

SEQ ID NO: 4905073 - DNA, 19 bp, Homo sapiens
tcagtgtaccatttgcctc

SEQ ID NO: 4905074 - DNA, 15 bp, Homo sapiens
tcagtgtagttaatt

SEQ ID NO: 4905075 - DNA, 18 bp, Homo sapiens
tcagtgtagttaatttat

SEQ ID NO: 4905076 - DNA, 21 bp, Homo sapiens
tcagtgtatggaaataaatgt

SEQ ID NO: 4905077 - DNA, 18 bp, Homo sapiens
tcagtgttttaaattctg

SEQ ID NO: 4905078 - DNA, 19 bp, Homo sapiens
tcagttcccttggcctcag

SEQ ID NO: 4905079 - DNA, 20 bp, Homo sapiens
tcagttcccttggcctcaga

SEQ ID NO: 4905080 - DNA, 22 bp, Homo sapiens
tcagttcccttggcctcagaat

SEQ ID NO: 4905081 - DNA, 16 bp, Homo sapiens
tcagttcctttgtgtg

SEQ ID NO: 4905082 - DNA, 18 bp, Homo sapiens
tcagttggttgtgtcttt

SEQ ID NO: 4905083 - DNA, 19 bp, Homo sapiens
tcagttgtttgtttttgct

SEQ ID NO: 4905084 - DNA, 21 bp, Homo sapiens
tcagtttatgttgtacaatgt

SEQ ID NO: 4905085 - DNA, 22 bp, Homo sapiens
tcagtttcttctgcgcctcagg

SEQ ID NO: 4905086 - DNA, 12 bp, Homo sapiens
tcagtttgatca

SEQ ID NO: 4905087 - DNA, 14 bp, Homo sapiens
tcagtttgtataga

SEQ ID NO: 4905088 - DNA, 18 bp, Homo sapiens
tcagtttgtcctgtagag

SEQ ID NO: 4905089 - DNA, 15 bp, Homo sapiens
tcagtttgtgtgtct

SEQ ID NO: 4905090 - DNA, 16 bp, Homo sapiens
tcagtttgtgtgtctt

SEQ ID NO: 4905091 - DNA, 20 bp, Homo sapiens
tcagttttttgttttacaat

SEQ ID NO: 4905092 - DNA, 19 bp, Homo sapiens
tcataaagttagaatctat

SEQ ID NO: 4905093 - DNA, 20 bp, Homo sapiens
tcataaagttagaatctatt

SEQ ID NO: 4905094 - DNA, 23 bp, Homo sapiens
tcataaagttagaatctattttc

SEQ ID NO: 4905095 - DNA, 20 bp, Homo sapiens
tcataaggcttcaaaatgtt

SEQ ID NO: 4905096 - DNA, 14 bp, Homo sapiens
tcatacctctgacc

SEQ ID NO: 4905097 - DNA, 21 bp, Homo sapiens
tcatactactgaaacagattt

SEQ ID NO: 4905098 - DNA, 14 bp, Homo sapiens
tcatagagatttgt

SEQ ID NO: 4905099 - DNA, 20 bp, Homo sapiens
tcataggttgccaataatac

SEQ ID NO: 4905100 - DNA, 21 bp, Homo sapiens
tcatagtaacttcttatggaa

SEQ ID NO: 4905101 - DNA, 16 bp, Homo sapiens
tcatagtagtttttac

SEQ ID NO: 4905102 - DNA, 13 bp, Homo sapiens
tcatagttaacat

SEQ ID NO: 4905103 - DNA, 19 bp, Homo sapiens
tcatattgaatgtttccaa

SEQ ID NO: 4905104 - DNA, 18 bp, Homo sapiens
tcatattgatgaaaagat

SEQ ID NO: 4905105 - DNA, 18 bp, Homo sapiens
tcatattggaaaaatcac

SEQ ID NO: 4905106 - DNA, 12 bp, Homo sapiens
tcatatttaaag

SEQ ID NO: 4905107 - DNA, 19 bp, Homo sapiens
tcatatttaaagacaggga

SEQ ID NO: 4905108 - DNA, 16 bp, Homo sapiens
tcatcaacaaagaaat

SEQ ID NO: 4905109 - DNA, 13 bp, Homo sapiens
tcatcaacaagat

SEQ ID NO: 4905110 - DNA, 15 bp, Homo sapiens
tcatcaattcccatt

SEQ ID NO: 4905111 - DNA, 15 bp, Homo sapiens
tcatcacagggattt

SEQ ID NO: 4905112 - DNA, 15 bp, Homo sapiens
tcatcagatggaaat

SEQ ID NO: 4905113 - DNA, 22 bp, Homo sapiens
tcatcagatggaaatattttga

SEQ ID NO: 4905114 - DNA, 12 bp, Homo sapiens
tcatcagcattt

SEQ ID NO: 4905115 - DNA, 12 bp, Homo sapiens
tcatcagggcct

SEQ ID NO: 4905116 - DNA, 12 bp, Homo sapiens
tcatcatgcagc

SEQ ID NO: 4905117 - DNA, 13 bp, Homo sapiens
tcatcatgcagct

SEQ ID NO: 4905118 - DNA, 19 bp, Homo sapiens
tcatcatgcagctcaactt

SEQ ID NO: 4905119 - DNA, 17 bp, Homo sapiens
tcatccactgtgccatg

SEQ ID NO: 4905120 - DNA, 20 bp, Homo sapiens
tcatcccattaatcatttcc

SEQ ID NO: 4905121 - DNA, 20 bp, Homo sapiens
tcatccccaggggtcccagc

SEQ ID NO: 4905122 - DNA, 14 bp, Homo sapiens
tcatccccagtccc

SEQ ID NO: 4905123 - DNA, 15 bp, Homo sapiens
tcatcctattgttga

SEQ ID NO: 4905124 - DNA, 11 bp, Homo sapiens
tcatcctcctg

SEQ ID NO: 4905125 - DNA, 12 bp, Homo sapiens
tcatcctcctgg

SEQ ID NO: 4905126 - DNA, 13 bp, Homo sapiens
tcatcctcctgga

SEQ ID NO: 4905127 - DNA, 15 bp, Homo sapiens
tcatcctcctggaac

SEQ ID NO: 4905128 - DNA, 16 bp, Homo sapiens
tcatcctcctggaacc

SEQ ID NO: 4905129 - DNA, 22 bp, Homo sapiens
tcatcctcctggaaccttgctg

SEQ ID NO: 4905130 - DNA, 17 bp, Homo sapiens
tcatcctgccttcatgg

SEQ ID NO: 4905131 - DNA, 17 bp, Homo sapiens
tcatccttggtctttgt

SEQ ID NO: 4905132 - DNA, 20 bp, Homo sapiens
tcatccttggtctttgtatc

SEQ ID NO: 4905133 - DNA, 18 bp, Homo sapiens
tcatcgaaaattcatttc

SEQ ID NO: 4905134 - DNA, 13 bp, Homo sapiens
tcatctataaaga

SEQ ID NO: 4905135 - DNA, 19 bp, Homo sapiens
tcatctattttgatgcagc

SEQ ID NO: 4905136 - DNA, 23 bp, Homo sapiens
tcatctattttgatgcagcattt

SEQ ID NO: 4905137 - DNA, 16 bp, Homo sapiens
tcatctcattcaaacc

SEQ ID NO: 4905138 - DNA, 20 bp, Homo sapiens
tcatctgcacccttcttttc

SEQ ID NO: 4905139 - DNA, 22 bp, Homo sapiens
tcatctggataggagcctgctg

SEQ ID NO: 4905140 - DNA, 15 bp, Homo sapiens
tcatctgtcaagtgg

SEQ ID NO: 4905141 - DNA, 14 bp, Homo sapiens
tcatctgtgtgaaa

SEQ ID NO: 4905142 - DNA, 22 bp, Homo sapiens
tcatcttgtgaaatggccagga

SEQ ID NO: 4905143 - DNA, 11 bp, Homo sapiens
tcatgaagcct

SEQ ID NO: 4905144 - DNA, 13 bp, Homo sapiens
tcatgaagcctgt

SEQ ID NO: 4905145 - DNA, 16 bp, Homo sapiens
tcatgaagcctgtgga

SEQ ID NO: 4905146 - DNA, 21 bp, Homo sapiens
tcatgacatgttatatatttt

SEQ ID NO: 4905147 - DNA, 16 bp, Homo sapiens
tcatgatgcagtctcc

SEQ ID NO: 4905148 - DNA, 17 bp, Homo sapiens
tcatgatgcagtctcct

SEQ ID NO: 4905149 - DNA, 20 bp, Homo sapiens
tcatgatgcagtctcctctt

SEQ ID NO: 4905150 - DNA, 22 bp, Homo sapiens
tcatgatgcagtctcctcttta

SEQ ID NO: 4905151 - DNA, 13 bp, Homo sapiens
tcatgatttataa

SEQ ID NO: 4905152 - DNA, 19 bp, Homo sapiens
tcatgcagctcaactttct

SEQ ID NO: 4905153 - DNA, 12 bp, Homo sapiens
tcatgccagcta

SEQ ID NO: 4905154 - DNA, 18 bp, Homo sapiens
tcatgctctgcaaaagga

SEQ ID NO: 4905155 - DNA, 17 bp, Homo sapiens
tcatgcttcttccttac

SEQ ID NO: 4905156 - DNA, 22 bp, Homo sapiens
tcatgctttaaagtgtaataat

SEQ ID NO: 4905157 - DNA, 23 bp, Homo sapiens
tcatgctttaaagtgtaataata

SEQ ID NO: 4905158 - DNA, 19 bp, Homo sapiens
tcatggaccactgtttctt

SEQ ID NO: 4905159 - DNA, 22 bp, Homo sapiens
tcatggaccactgtttcttgct

SEQ ID NO: 4905160 - DNA, 13 bp, Homo sapiens
tcatggcccctct

SEQ ID NO: 4905161 - DNA, 19 bp, Homo sapiens
tcatggtgaaaatgtactg

SEQ ID NO: 4905162 - DNA, 23 bp, Homo sapiens
tcatggtgggttcaggggactca

SEQ ID NO: 4905163 - DNA, 13 bp, Homo sapiens
tcatggtgtaata

SEQ ID NO: 4905164 - DNA, 19 bp, Homo sapiens
tcatggtgtaataagacat

SEQ ID NO: 4905165 - DNA, 16 bp, Homo sapiens
tcatgtacaagatgaa

SEQ ID NO: 4905166 - DNA, 18 bp, Homo sapiens
tcatgtacaagatgaagg

SEQ ID NO: 4905167 - DNA, 16 bp, Homo sapiens
tcatgtagagaaaagc

SEQ ID NO: 4905168 - DNA, 19 bp, Homo sapiens
tcatgtagagaaaagcaca

SEQ ID NO: 4905169 - DNA, 17 bp, Homo sapiens
tcatgtcaggcctgtgt

SEQ ID NO: 4905170 - DNA, 14 bp, Homo sapiens
tcatgtgttccctt

SEQ ID NO: 4905171 - DNA, 19 bp, Homo sapiens
tcatgttgttaaaattatg

SEQ ID NO: 4905172 - DNA, 14 bp, Homo sapiens
tcatgtttatgaaa

SEQ ID NO: 4905173 - DNA, 15 bp, Homo sapiens
tcatgtttgcttcat

SEQ ID NO: 4905174 - DNA, 20 bp, Homo sapiens
tcatgtttgcttcataaatg

SEQ ID NO: 4905175 - DNA, 15 bp, Homo sapiens
tcatgttttgtgact

SEQ ID NO: 4905176 - DNA, 16 bp, Homo sapiens
tcatgttttgtgacta

SEQ ID NO: 4905177 - DNA, 15 bp, Homo sapiens
tcattaaatggggct

SEQ ID NO: 4905178 - DNA, 13 bp, Homo sapiens
tcattaattctat

SEQ ID NO: 4905179 - DNA, 14 bp, Homo sapiens
tcattactgggcct

SEQ ID NO: 4905180 - DNA, 10 bp, Homo sapiens
tcattagaac

SEQ ID NO: 4905181 - DNA, 13 bp, Homo sapiens
tcattagactcct

SEQ ID NO: 4905182 - DNA, 18 bp, Homo sapiens
tcattagctgtgattttt

SEQ ID NO: 4905183 - DNA, 20 bp, Homo sapiens
tcattatatcattggaacaa

SEQ ID NO: 4905184 - DNA, 20 bp, Homo sapiens
tcattcaatattgacatttg

SEQ ID NO: 4905185 - DNA, 20 bp, Homo sapiens
tcattcatggaccactgttt

SEQ ID NO: 4905186 - DNA, 15 bp, Homo sapiens
tcattccattgccta

SEQ ID NO: 4905187 - DNA, 21 bp, Homo sapiens
tcattccttctttttaaaatg

SEQ ID NO: 4905188 - DNA, 21 bp, Homo sapiens
tcattcgctcccacattctga

SEQ ID NO: 4905189 - DNA, 15 bp, Homo sapiens
tcattcgggatgatt

SEQ ID NO: 4905190 - DNA, 13 bp, Homo sapiens
tcattctcctgcc

SEQ ID NO: 4905191 - DNA, 16 bp, Homo sapiens
tcattctcctgcctgt

SEQ ID NO: 4905192 - DNA, 16 bp, Homo sapiens
tcattctcgtgagtca

SEQ ID NO: 4905193 - DNA, 22 bp, Homo sapiens
tcattctgcattgctagataaa

SEQ ID NO: 4905194 - DNA, 15 bp, Homo sapiens
tcattcttgttttct

SEQ ID NO: 4905195 - DNA, 12 bp, Homo sapiens
tcattgaaatgt

SEQ ID NO: 4905196 - DNA, 14 bp, Homo sapiens
tcattgaaatgtca

SEQ ID NO: 4905197 - DNA, 23 bp, Homo sapiens
tcattgctgagcctctgctcccc

SEQ ID NO: 4905198 - DNA, 21 bp, Homo sapiens
tcattgtaaacaaactcttga

SEQ ID NO: 4905199 - DNA, 15 bp, Homo sapiens
tcattgtatgatgtg

SEQ ID NO: 4905200 - DNA, 17 bp, Homo sapiens
tcattgtatgatgtgtt

SEQ ID NO: 4905201 - DNA, 15 bp, Homo sapiens
tcattgtatgttatt

SEQ ID NO: 4905202 - DNA, 13 bp, Homo sapiens
tcattgtccctct

SEQ ID NO: 4905203 - DNA, 21 bp, Homo sapiens
tcattgtccctcttcactccc

SEQ ID NO: 4905204 - DNA, 22 bp, Homo sapiens
tcattgtctctcacagatgtga

SEQ ID NO: 4905205 - DNA, 15 bp, Homo sapiens
tcattgttatttata

SEQ ID NO: 4905206 - DNA, 15 bp, Homo sapiens
tcatttactaaacat

SEQ ID NO: 4905207 - DNA, 22 bp, Homo sapiens
tcatttagaacttgcagctgat

SEQ ID NO: 4905208 - DNA, 17 bp, Homo sapiens
tcatttagtgagttatt

SEQ ID NO: 4905209 - DNA, 15 bp, Homo sapiens
tcatttcatgctctg

SEQ ID NO: 4905210 - DNA, 13 bp, Homo sapiens
tcatttcattcca

SEQ ID NO: 4905211 - DNA, 15 bp, Homo sapiens
tcatttcattccatt

SEQ ID NO: 4905212 - DNA, 16 bp, Homo sapiens
tcatttcattccattg

SEQ ID NO: 4905213 - DNA, 19 bp, Homo sapiens
tcatttcattgtatgatgt

SEQ ID NO: 4905214 - DNA, 16 bp, Homo sapiens
tcatttcctgtgtctt

SEQ ID NO: 4905215 - DNA, 23 bp, Homo sapiens
tcatttctcactgtgtacataat

SEQ ID NO: 4905216 - DNA, 21 bp, Homo sapiens
tcatttgagcagggctcagcg

SEQ ID NO: 4905217 - DNA, 13 bp, Homo sapiens
tcatttgcttttt

SEQ ID NO: 4905218 - DNA, 16 bp, Homo sapiens
tcatttgtgtgctcat

SEQ ID NO: 4905219 - DNA, 22 bp, Homo sapiens
tcatttgttaaaattatcaata

SEQ ID NO: 4905220 - DNA, 15 bp, Homo sapiens
tcatttgttggaatg

SEQ ID NO: 4905221 - DNA, 12 bp, Homo sapiens
tcatttgttgtg

SEQ ID NO: 4905222 - DNA, 20 bp, Homo sapiens
tcatttgttgtgatgtcttt

SEQ ID NO: 4905223 - DNA, 15 bp, Homo sapiens
tcatttgtttttctc

SEQ ID NO: 4905224 - DNA, 12 bp, Homo sapiens
tcattttaatgt

SEQ ID NO: 4905225 - DNA, 14 bp, Homo sapiens
tcattttctataac

SEQ ID NO: 4905226 - DNA, 15 bp, Homo sapiens
tcattttctataaca

SEQ ID NO: 4905227 - DNA, 16 bp, Homo sapiens
tcattttctataacag

SEQ ID NO: 4905228 - DNA, 19 bp, Homo sapiens
tccaaaaagattttcagaa

SEQ ID NO: 4905229 - DNA, 20 bp, Homo sapiens
tccaaaaagattttcagaaa

SEQ ID NO: 4905230 - DNA, 19 bp, Homo sapiens
tccaaaaagctcctggggc

SEQ ID NO: 4905231 - DNA, 14 bp, Homo sapiens
tccaaaaattatta

SEQ ID NO: 4905232 - DNA, 22 bp, Homo sapiens
tccaaaaattattataagcatt

SEQ ID NO: 4905233 - DNA, 20 bp, Homo sapiens
tccaaaagcaaccacaaacc

SEQ ID NO: 4905234 - DNA, 15 bp, Homo sapiens
tccaaaataatttta

SEQ ID NO: 4905235 - DNA, 12 bp, Homo sapiens
tccaaaattctt

SEQ ID NO: 4905236 - DNA, 19 bp, Homo sapiens
tccaaacatgtatttatgt

SEQ ID NO: 4905237 - DNA, 20 bp, Homo sapiens
tccaaacatgtatttatgta

SEQ ID NO: 4905238 - DNA, 13 bp, Homo sapiens
tccaaagaggctg

SEQ ID NO: 4905239 - DNA, 19 bp, Homo sapiens
tccaaagaggctgcccctc

SEQ ID NO: 4905240 - DNA, 20 bp, Homo sapiens
tccaaagagtagaattgcat

SEQ ID NO: 4905241 - DNA, 21 bp, Homo sapiens
tccaaagctttattaccagtg

SEQ ID NO: 4905242 - DNA, 19 bp, Homo sapiens
tccaaaggaggctggcagg

SEQ ID NO: 4905243 - DNA, 14 bp, Homo sapiens
tccaaaggccccct

SEQ ID NO: 4905244 - DNA, 15 bp, Homo sapiens
tccaaataataaagt

SEQ ID NO: 4905245 - DNA, 16 bp, Homo sapiens
tccaaataataaagtc

SEQ ID NO: 4905246 - DNA, 20 bp, Homo sapiens
tccaaatggcgtctggaagt

SEQ ID NO: 4905247 - DNA, 17 bp, Homo sapiens
tccaaatgtcctccaga

SEQ ID NO: 4905248 - DNA, 19 bp, Homo sapiens
tccaaatgtcctccagaag

SEQ ID NO: 4905249 - DNA, 20 bp, Homo sapiens
tccaaatgtcctccagaagc

SEQ ID NO: 4905250 - DNA, 16 bp, Homo sapiens
tccaacaccacagaca

SEQ ID NO: 4905251 - DNA, 21 bp, Homo sapiens
tccaacaccacagacacacac

SEQ ID NO: 4905252 - DNA, 20 bp, Homo sapiens
tccaacagaactaaatgttc

SEQ ID NO: 4905253 - DNA, 13 bp, Homo sapiens
tccaacagtgagt

SEQ ID NO: 4905254 - DNA, 12 bp, Homo sapiens
tccaactccagc

SEQ ID NO: 4905255 - DNA, 18 bp, Homo sapiens
tccaactgtgttcattag

SEQ ID NO: 4905256 - DNA, 18 bp, Homo sapiens
tccaacttatgtttttaa

SEQ ID NO: 4905257 - DNA, 16 bp, Homo sapiens
tccaagaaagatgaat

SEQ ID NO: 4905258 - DNA, 20 bp, Homo sapiens
tccaagaatccacatttcta

SEQ ID NO: 4905259 - DNA, 23 bp, Homo sapiens
tccaagaatccacatttctaaaa

SEQ ID NO: 4905260 - DNA, 15 bp, Homo sapiens
tccaagagtctaaag

SEQ ID NO: 4905261 - DNA, 17 bp, Homo sapiens
tccaagagtctaaagat

SEQ ID NO: 4905262 - DNA, 14 bp, Homo sapiens
tccaagattctaga

SEQ ID NO: 4905263 - DNA, 15 bp, Homo sapiens
tccaagattctagat

SEQ ID NO: 4905264 - DNA, 14 bp, Homo sapiens
tccaagcctccaca

SEQ ID NO: 4905265 - DNA, 14 bp, Homo sapiens
tccaagctccctgc

SEQ ID NO: 4905266 - DNA, 15 bp, Homo sapiens
tccaagctccctgcc

SEQ ID NO: 4905267 - DNA, 15 bp, Homo sapiens
tccaaggttcccttg

SEQ ID NO: 4905268 - DNA, 13 bp, Homo sapiens
tccaaggtttaaa

SEQ ID NO: 4905269 - DNA, 14 bp, Homo sapiens
tccaaggtttaaag

SEQ ID NO: 4905270 - DNA, 15 bp, Homo sapiens
tccaaggtttaaaga

SEQ ID NO: 4905271 - DNA, 22 bp, Homo sapiens
tccaaggtttaaagagtctaga

SEQ ID NO: 4905272 - DNA, 14 bp, Homo sapiens
tccaagtttccaaa

SEQ ID NO: 4905273 - DNA, 16 bp, Homo sapiens
tccaatatttctgctt

SEQ ID NO: 4905274 - DNA, 19 bp, Homo sapiens
tccaatgtctgctgaggag

SEQ ID NO: 4905275 - DNA, 15 bp, Homo sapiens
tccacaccttttatt

SEQ ID NO: 4905276 - DNA, 17 bp, Homo sapiens
tccacagcgagggcagc

SEQ ID NO: 4905277 - DNA, 14 bp, Homo sapiens
tccacatgctctga

SEQ ID NO: 4905278 - DNA, 15 bp, Homo sapiens
tccacatttctaaaa

SEQ ID NO: 4905279 - DNA, 14 bp, Homo sapiens
tccaccacctccct

SEQ ID NO: 4905280 - DNA, 19 bp, Homo sapiens
tccaccagcatcacctgcc

SEQ ID NO: 4905281 - DNA, 13 bp, Homo sapiens
tccacccacctca

SEQ ID NO: 4905282 - DNA, 17 bp, Homo sapiens
tccacccaggagccccg

SEQ ID NO: 4905283 - DNA, 20 bp, Homo sapiens
tccacccaggagccccgagg

SEQ ID NO: 4905284 - DNA, 14 bp, Homo sapiens
tccaccctgctctc

SEQ ID NO: 4905285 - DNA, 21 bp, Homo sapiens
tccaccctgctctccgaccag

SEQ ID NO: 4905286 - DNA, 15 bp, Homo sapiens
tccaccgctgctcca

SEQ ID NO: 4905287 - DNA, 23 bp, Homo sapiens
tccacctgggcatatccaccacc

SEQ ID NO: 4905288 - DNA, 17 bp, Homo sapiens
tccacctgtctcagcct

SEQ ID NO: 4905289 - DNA, 13 bp, Homo sapiens
tccacctgtgggt

SEQ ID NO: 4905290 - DNA, 15 bp, Homo sapiens
tccaccttcccactt

SEQ ID NO: 4905291 - DNA, 17 bp, Homo sapiens
tccacgcgcttcgactt

SEQ ID NO: 4905292 - DNA, 20 bp, Homo sapiens
tccactctaccctcccaccc

SEQ ID NO: 4905293 - DNA, 23 bp, Homo sapiens
tccactctaccctcccaccccct

SEQ ID NO: 4905294 - DNA, 15 bp, Homo sapiens
tccactgccttcgat

SEQ ID NO: 4905295 - DNA, 22 bp, Homo sapiens
tccactgccttcgatacaccgg

SEQ ID NO: 4905296 - DNA, 19 bp, Homo sapiens
tccactgtcaccctccacc

SEQ ID NO: 4905297 - DNA, 17 bp, Homo sapiens
tccactgtgcctttgca

SEQ ID NO: 4905298 - DNA, 20 bp, Homo sapiens
tccactgtgtatagaagtag

SEQ ID NO: 4905299 - DNA, 23 bp, Homo sapiens
tccagaaatgtctaaatgctgaa

SEQ ID NO: 4905300 - DNA, 20 bp, Homo sapiens
tccagaagaagagaagctgc

SEQ ID NO: 4905301 - DNA, 15 bp, Homo sapiens
tccagaatgctgtac

SEQ ID NO: 4905302 - DNA, 17 bp, Homo sapiens
tccagaatgctgtacat

SEQ ID NO: 4905303 - DNA, 18 bp, Homo sapiens
tccagaatggtctttcta

SEQ ID NO: 4905304 - DNA, 19 bp, Homo sapiens
tccagacatacgaaacaca

SEQ ID NO: 4905305 - DNA, 20 bp, Homo sapiens
tccagacatacgaaacacaa

SEQ ID NO: 4905306 - DNA, 14 bp, Homo sapiens
tccagacccggctg

SEQ ID NO: 4905307 - DNA, 19 bp, Homo sapiens
tccagacccggctgcgtgg

SEQ ID NO: 4905308 - DNA, 14 bp, Homo sapiens
tccagacttccttg

SEQ ID NO: 4905309 - DNA, 15 bp, Homo sapiens
tccagagagtggctc

SEQ ID NO: 4905310 - DNA, 20 bp, Homo sapiens
tccagagcggaggctgtgtg

SEQ ID NO: 4905311 - DNA, 20 bp, Homo sapiens
tccagaggctattattttca

SEQ ID NO: 4905312 - DNA, 20 bp, Homo sapiens
tccagagggttgtgattttg

SEQ ID NO: 4905313 - DNA, 12 bp, Homo sapiens
tccagattttta

SEQ ID NO: 4905314 - DNA, 22 bp, Homo sapiens
tccagcaacacagcctgggccc

SEQ ID NO: 4905315 - DNA, 20 bp, Homo sapiens
tccagcaacttcttctccat

SEQ ID NO: 4905316 - DNA, 17 bp, Homo sapiens
tccagcagaagacaaaa

SEQ ID NO: 4905317 - DNA, 18 bp, Homo sapiens
tccagcccgggagcctag

SEQ ID NO: 4905318 - DNA, 20 bp, Homo sapiens
tccagcccgggagcctagga

SEQ ID NO: 4905319 - DNA, 21 bp, Homo sapiens
tccagcccgggagcctaggac

SEQ ID NO: 4905320 - DNA, 21 bp, Homo sapiens
tccagccgccattgccaccag

SEQ ID NO: 4905321 - DNA, 23 bp, Homo sapiens
tccagccgccattgccaccagga

SEQ ID NO: 4905322 - DNA, 20 bp, Homo sapiens
tccagcctgcccaagcccag

SEQ ID NO: 4905323 - DNA, 12 bp, Homo sapiens
tccagcctgggc

SEQ ID NO: 4905324 - DNA, 19 bp, Homo sapiens
tccagcctgggcagccagg

SEQ ID NO: 4905325 - DNA, 23 bp, Homo sapiens
tccagcctgggcagccaggctgc

SEQ ID NO: 4905326 - DNA, 14 bp, Homo sapiens
tccagctcaccagc

SEQ ID NO: 4905327 - DNA, 16 bp, Homo sapiens
tccagctcaccagccc

SEQ ID NO: 4905328 - DNA, 15 bp, Homo sapiens
tccagctcagaaccc

SEQ ID NO: 4905329 - DNA, 17 bp, Homo sapiens
tccagctcagaacccag

SEQ ID NO: 4905330 - DNA, 13 bp, Homo sapiens
tccagctcctgta

SEQ ID NO: 4905331 - DNA, 14 bp, Homo sapiens
tccagctgcaccag

SEQ ID NO: 4905332 - DNA, 17 bp, Homo sapiens
tccagctgcaccagagc

SEQ ID NO: 4905333 - DNA, 14 bp, Homo sapiens
tccagctgctgtct

SEQ ID NO: 4905334 - DNA, 15 bp, Homo sapiens
tccagctgctgtctt

SEQ ID NO: 4905335 - DNA, 19 bp, Homo sapiens
tccagctttctccccgcta

SEQ ID NO: 4905336 - DNA, 23 bp, Homo sapiens
tccaggagcctggctccgtccag

SEQ ID NO: 4905337 - DNA, 12 bp, Homo sapiens
tccaggcacagg

SEQ ID NO: 4905338 - DNA, 17 bp, Homo sapiens
tccaggcccaactgtga

SEQ ID NO: 4905339 - DNA, 14 bp, Homo sapiens
tccaggcctgcagc

SEQ ID NO: 4905340 - DNA, 19 bp, Homo sapiens
tccaggctagtccggaccc

SEQ ID NO: 4905341 - DNA, 20 bp, Homo sapiens
tccaggctagtccggaccca

SEQ ID NO: 4905342 - DNA, 22 bp, Homo sapiens
tccaggctcctttagcgcccag

SEQ ID NO: 4905343 - DNA, 20 bp, Homo sapiens
tccaggctttgtacagagtg

SEQ ID NO: 4905344 - DNA, 14 bp, Homo sapiens
tccagggaagctgg

SEQ ID NO: 4905345 - DNA, 17 bp, Homo sapiens
tccagggaagctggccg

SEQ ID NO: 4905346 - DNA, 18 bp, Homo sapiens
tccagggaagctggccga

SEQ ID NO: 4905347 - DNA, 23 bp, Homo sapiens
tccagggaagctggccgagggtc

SEQ ID NO: 4905348 - DNA, 14 bp, Homo sapiens
tccagggaatccaa

SEQ ID NO: 4905349 - DNA, 14 bp, Homo sapiens
tccaggggaacctg

SEQ ID NO: 4905350 - DNA, 18 bp, Homo sapiens
tccagggggaaggccaag

SEQ ID NO: 4905351 - DNA, 16 bp, Homo sapiens
tccaggtctcacgggc

SEQ ID NO: 4905352 - DNA, 23 bp, Homo sapiens
tccaggttcaacccacagctact

SEQ ID NO: 4905353 - DNA, 19 bp, Homo sapiens
tccagtaatctaatatggc

SEQ ID NO: 4905354 - DNA, 14 bp, Homo sapiens
tccagtctcttgta

SEQ ID NO: 4905355 - DNA, 16 bp, Homo sapiens
tccagtctcttgtaca

SEQ ID NO: 4905356 - DNA, 22 bp, Homo sapiens
tccagtctcttgtacagcgttt

SEQ ID NO: 4905357 - DNA, 17 bp, Homo sapiens
tccagtgcaaccacaca

SEQ ID NO: 4905358 - DNA, 17 bp, Homo sapiens
tccagtggaggtttgtc

SEQ ID NO: 4905359 - DNA, 23 bp, Homo sapiens
tccataaacagactgttaattat

SEQ ID NO: 4905360 - DNA, 22 bp, Homo sapiens
tccataccagctcgcacccccc

SEQ ID NO: 4905361 - DNA, 15 bp, Homo sapiens
tccatagcaacagga

SEQ ID NO: 4905362 - DNA, 16 bp, Homo sapiens
tccatagcaacaggaa

SEQ ID NO: 4905363 - DNA, 14 bp, Homo sapiens
tccatatcttgcga

SEQ ID NO: 4905364 - DNA, 14 bp, Homo sapiens
tccatatttggaag

SEQ ID NO: 4905365 - DNA, 17 bp, Homo sapiens
tccatatttggaagaaa

SEQ ID NO: 4905366 - DNA, 12 bp, Homo sapiens
tccatattttca

SEQ ID NO: 4905367 - DNA, 23 bp, Homo sapiens
tccatcaccctcttcctgtgatc

SEQ ID NO: 4905368 - DNA, 13 bp, Homo sapiens
tccatcagccagg

SEQ ID NO: 4905369 - DNA, 22 bp, Homo sapiens
tccatccataaatccagttcta

SEQ ID NO: 4905370 - DNA, 19 bp, Homo sapiens
tccatcccaacagccatgc

SEQ ID NO: 4905371 - DNA, 18 bp, Homo sapiens
tccatcccaaccagtgcc

SEQ ID NO: 4905372 - DNA, 14 bp, Homo sapiens
tccatccctacccc

SEQ ID NO: 4905373 - DNA, 18 bp, Homo sapiens
tccatccctaccccctaa

SEQ ID NO: 4905374 - DNA, 12 bp, Homo sapiens
tccatccctcta

SEQ ID NO: 4905375 - DNA, 15 bp, Homo sapiens
tccatccctctaatg

SEQ ID NO: 4905376 - DNA, 14 bp, Homo sapiens
tccatctctgactt

SEQ ID NO: 4905377 - DNA, 13 bp, Homo sapiens
tccatctttacaa

SEQ ID NO: 4905378 - DNA, 14 bp, Homo sapiens
tccatgcaccaaac

SEQ ID NO: 4905379 - DNA, 21 bp, Homo sapiens
tccatgcagggggctcctggg

SEQ ID NO: 4905380 - DNA, 19 bp, Homo sapiens
tccatgcatgacagcctct

SEQ ID NO: 4905381 - DNA, 14 bp, Homo sapiens
tccatgtacttgtt

SEQ ID NO: 4905382 - DNA, 18 bp, Homo sapiens
tccatgtacttgtttgca

SEQ ID NO: 4905383 - DNA, 18 bp, Homo sapiens
tccatgtcctatgtgtga

SEQ ID NO: 4905384 - DNA, 19 bp, Homo sapiens
tccatgtcgcctctgcatt

SEQ ID NO: 4905385 - DNA, 20 bp, Homo sapiens
tccatgtgggctagttgggc

SEQ ID NO: 4905386 - DNA, 18 bp, Homo sapiens
tccatgtggttcttcaaa

SEQ ID NO: 4905387 - DNA, 18 bp, Homo sapiens
tccattgcctagctcttt

SEQ ID NO: 4905388 - DNA, 14 bp, Homo sapiens
tccatttatatatg

SEQ ID NO: 4905389 - DNA, 18 bp, Homo sapiens
tccatttatatatgaaaa

SEQ ID NO: 4905390 - DNA, 21 bp, Homo sapiens
tccatttatatatgaaaacta

SEQ ID NO: 4905391 - DNA, 21 bp, Homo sapiens
tccatttgtaattaaattatg

SEQ ID NO: 4905392 - DNA, 19 bp, Homo sapiens
tccattttcctacaggcag

SEQ ID NO: 4905393 - DNA, 16 bp, Homo sapiens
tcccaacagccatgcc

SEQ ID NO: 4905394 - DNA, 14 bp, Homo sapiens
tcccaaccagtgcc

SEQ ID NO: 4905395 - DNA, 21 bp, Homo sapiens
tcccaacttctcttgctttct

SEQ ID NO: 4905396 - DNA, 13 bp, Homo sapiens
tcccaagaaatgc

SEQ ID NO: 4905397 - DNA, 20 bp, Homo sapiens
tcccaagctatctaaagttt

SEQ ID NO: 4905398 - DNA, 18 bp, Homo sapiens
tcccaaggaaagccccag

SEQ ID NO: 4905399 - DNA, 19 bp, Homo sapiens
tcccaaggagaacaaatat

SEQ ID NO: 4905400 - DNA, 23 bp, Homo sapiens
tcccaagtagctgggattacagg

SEQ ID NO: 4905401 - DNA, 22 bp, Homo sapiens
tcccaagtttccatagcaacag

SEQ ID NO: 4905402 - DNA, 14 bp, Homo sapiens
tcccaatcagcact

SEQ ID NO: 4905403 - DNA, 11 bp, Homo sapiens
tcccacacagg

SEQ ID NO: 4905404 - DNA, 21 bp, Homo sapiens
tcccacaggcccttcctctcc

SEQ ID NO: 4905405 - DNA, 22 bp, Homo sapiens
tcccacatccaactccagcaac

SEQ ID NO: 4905406 - DNA, 15 bp, Homo sapiens
tcccacccacatgtg

SEQ ID NO: 4905407 - DNA, 22 bp, Homo sapiens
tcccacccacatgtgacacata

SEQ ID NO: 4905408 - DNA, 18 bp, Homo sapiens
tcccacccccacccccag

SEQ ID NO: 4905409 - DNA, 20 bp, Homo sapiens
tcccacccccttctctgctc

SEQ ID NO: 4905410 - DNA, 13 bp, Homo sapiens
tcccacccctccc

SEQ ID NO: 4905411 - DNA, 11 bp, Homo sapiens
tcccaccctgt

SEQ ID NO: 4905412 - DNA, 20 bp, Homo sapiens
tcccaccctgtacctcatcc

SEQ ID NO: 4905413 - DNA, 13 bp, Homo sapiens
tcccaccctgttc

SEQ ID NO: 4905414 - DNA, 18 bp, Homo sapiens
tcccacctcagcctcccg

SEQ ID NO: 4905415 - DNA, 15 bp, Homo sapiens
tcccacctccagccc

SEQ ID NO: 4905416 - DNA, 17 bp, Homo sapiens
tcccacctccagcccgg

SEQ ID NO: 4905417 - DNA, 13 bp, Homo sapiens
tcccacctccagt

SEQ ID NO: 4905418 - DNA, 17 bp, Homo sapiens
tcccacctccatcccag

SEQ ID NO: 4905419 - DNA, 18 bp, Homo sapiens
tcccacctccctgcccag

SEQ ID NO: 4905420 - DNA, 18 bp, Homo sapiens
tcccaccttggctgcagg

SEQ ID NO: 4905421 - DNA, 21 bp, Homo sapiens
tcccaccttggctgcagggag

SEQ ID NO: 4905422 - DNA, 15 bp, Homo sapiens
tcccacgtgtcttcc

SEQ ID NO: 4905423 - DNA, 17 bp, Homo sapiens
tcccacgtgtcttccac

SEQ ID NO: 4905424 - DNA, 23 bp, Homo sapiens
tcccactcaccccggcagacgcc

SEQ ID NO: 4905425 - DNA, 14 bp, Homo sapiens
tcccactcagtcca

SEQ ID NO: 4905426 - DNA, 14 bp, Homo sapiens
tcccagaatcccag

SEQ ID NO: 4905427 - DNA, 18 bp, Homo sapiens
tcccagaatcccagccgg

SEQ ID NO: 4905428 - DNA, 17 bp, Homo sapiens
tcccagaggtccagccc

SEQ ID NO: 4905429 - DNA, 15 bp, Homo sapiens
tcccagagtgctggg

SEQ ID NO: 4905430 - DNA, 20 bp, Homo sapiens
tcccagccaccccgggctct

SEQ ID NO: 4905431 - DNA, 19 bp, Homo sapiens
tcccagccggccaatggaa

SEQ ID NO: 4905432 - DNA, 19 bp, Homo sapiens
tcccagcttgtaggagctg

SEQ ID NO: 4905433 - DNA, 19 bp, Homo sapiens
tcccaggacaccacaccca

SEQ ID NO: 4905434 - DNA, 21 bp, Homo sapiens
tcccaggacaccacacccagc

SEQ ID NO: 4905435 - DNA, 15 bp, Homo sapiens
tcccaggagacagtt

SEQ ID NO: 4905436 - DNA, 18 bp, Homo sapiens
tcccaggatgctgggtgg

SEQ ID NO: 4905437 - DNA, 16 bp, Homo sapiens
tcccaggcgccccttc

SEQ ID NO: 4905438 - DNA, 20 bp, Homo sapiens
tcccaggcgccccttccccc

SEQ ID NO: 4905439 - DNA, 22 bp, Homo sapiens
tcccaggggcccaaggcggccc

SEQ ID NO: 4905440 - DNA, 15 bp, Homo sapiens
tcccaggtgttaaca

SEQ ID NO: 4905441 - DNA, 21 bp, Homo sapiens
tcccaggtgttaacattccaa

SEQ ID NO: 4905442 - DNA, 13 bp, Homo sapiens
tcccatcgctgtc

SEQ ID NO: 4905443 - DNA, 23 bp, Homo sapiens
tcccatctaagctgcagcttcct

SEQ ID NO: 4905444 - DNA, 14 bp, Homo sapiens
tcccatgaagcctt

SEQ ID NO: 4905445 - DNA, 17 bp, Homo sapiens
tcccatgaagccttttg

SEQ ID NO: 4905446 - DNA, 16 bp, Homo sapiens
tcccatgagcctcagc

SEQ ID NO: 4905447 - DNA, 18 bp, Homo sapiens
tcccatgagcctcagcat

SEQ ID NO: 4905448 - DNA, 20 bp, Homo sapiens
tcccatgagcctcagcatcc

SEQ ID NO: 4905449 - DNA, 22 bp, Homo sapiens
tcccatgagcctcagcatcctg

SEQ ID NO: 4905450 - DNA, 20 bp, Homo sapiens
tcccatggacactccagtgc

SEQ ID NO: 4905451 - DNA, 21 bp, Homo sapiens
tcccatggacactccagtgcc

SEQ ID NO: 4905452 - DNA, 10 bp, Homo sapiens
tcccatgtgg

SEQ ID NO: 4905453 - DNA, 17 bp, Homo sapiens
tcccatttgtgccagag

SEQ ID NO: 4905454 - DNA, 19 bp, Homo sapiens
tcccatttgtgccagagga

SEQ ID NO: 4905455 - DNA, 23 bp, Homo sapiens
tccccaacagcgacatagcccat

SEQ ID NO: 4905456 - DNA, 23 bp, Homo sapiens
tccccaagtggtttccacatgct

SEQ ID NO: 4905457 - DNA, 14 bp, Homo sapiens
tccccacgccctcc

SEQ ID NO: 4905458 - DNA, 18 bp, Homo sapiens
tccccacgccctcccctc

SEQ ID NO: 4905459 - DNA, 19 bp, Homo sapiens
tccccacgccctcccctcc

SEQ ID NO: 4905460 - DNA, 13 bp, Homo sapiens
tccccagattgca

SEQ ID NO: 4905461 - DNA, 10 bp, Homo sapiens
tccccagccc

SEQ ID NO: 4905462 - DNA, 12 bp, Homo sapiens
tccccagcccag

SEQ ID NO: 4905463 - DNA, 14 bp, Homo sapiens
tccccagcccaggg

SEQ ID NO: 4905464 - DNA, 19 bp, Homo sapiens
tccccagcccctagcccag

SEQ ID NO: 4905465 - DNA, 20 bp, Homo sapiens
tccccagcccctagcccagg

SEQ ID NO: 4905466 - DNA, 13 bp, Homo sapiens
tccccagccctgg

SEQ ID NO: 4905467 - DNA, 18 bp, Homo sapiens
tccccagccctggctctg

SEQ ID NO: 4905468 - DNA, 16 bp, Homo sapiens
tccccagcccttcaca

SEQ ID NO: 4905469 - DNA, 15 bp, Homo sapiens
tccccaggggagttg

SEQ ID NO: 4905470 - DNA, 23 bp, Homo sapiens
tccccaggggtcccagccacccc

SEQ ID NO: 4905471 - DNA, 16 bp, Homo sapiens
tccccagtcccaatgc

SEQ ID NO: 4905472 - DNA, 22 bp, Homo sapiens
tccccagtctctcttaaagttg

SEQ ID NO: 4905473 - DNA, 19 bp, Homo sapiens
tccccatcttctaaaccca

SEQ ID NO: 4905474 - DNA, 21 bp, Homo sapiens
tccccatgccacgttccacag

SEQ ID NO: 4905475 - DNA, 13 bp, Homo sapiens
tccccatggagcc

SEQ ID NO: 4905476 - DNA, 15 bp, Homo sapiens
tccccatggagccag

SEQ ID NO: 4905477 - DNA, 16 bp, Homo sapiens
tccccatggagccagc

SEQ ID NO: 4905478 - DNA, 22 bp, Homo sapiens
tccccattcttcctagttttct

SEQ ID NO: 4905479 - DNA, 17 bp, Homo sapiens
tcccccaacccccaccc

SEQ ID NO: 4905480 - DNA, 14 bp, Homo sapiens
tcccccaacttgag

SEQ ID NO: 4905481 - DNA, 19 bp, Homo sapiens
tcccccaccggtccagctg

SEQ ID NO: 4905482 - DNA, 15 bp, Homo sapiens
tcccccatctcccac

SEQ ID NO: 4905483 - DNA, 16 bp, Homo sapiens
tcccccccctgtatag

SEQ ID NO: 4905484 - DNA, 15 bp, Homo sapiens
tccccctatccttgg

SEQ ID NO: 4905485 - DNA, 12 bp, Homo sapiens
tcccccttgcca

SEQ ID NO: 4905486 - DNA, 14 bp, Homo sapiens
tcccccttttttgt

SEQ ID NO: 4905487 - DNA, 21 bp, Homo sapiens
tcccccttttttgtcccccaa

SEQ ID NO: 4905488 - DNA, 14 bp, Homo sapiens
tccccgcacccccc

SEQ ID NO: 4905489 - DNA, 14 bp, Homo sapiens
tccccggcaccctc

SEQ ID NO: 4905490 - DNA, 18 bp, Homo sapiens
tccccggcaccctctggc

SEQ ID NO: 4905491 - DNA, 20 bp, Homo sapiens
tccccggcaccctctggccg

SEQ ID NO: 4905492 - DNA, 13 bp, Homo sapiens
tccccggctcgag

SEQ ID NO: 4905493 - DNA, 14 bp, Homo sapiens
tccccgttcctgac

SEQ ID NO: 4905494 - DNA, 15 bp, Homo sapiens
tccccgttcctgaca

SEQ ID NO: 4905495 - DNA, 17 bp, Homo sapiens
tccccgttcctgacatc

SEQ ID NO: 4905496 - DNA, 13 bp, Homo sapiens
tcccctcacagcc

SEQ ID NO: 4905497 - DNA, 16 bp, Homo sapiens
tcccctcacagcctct

SEQ ID NO: 4905498 - DNA, 21 bp, Homo sapiens
tcccctcacagcctctgaccc

SEQ ID NO: 4905499 - DNA, 17 bp, Homo sapiens
tcccctcacctcctcta

SEQ ID NO: 4905500 - DNA, 12 bp, Homo sapiens
tcccctccagcc

SEQ ID NO: 4905501 - DNA, 19 bp, Homo sapiens
tcccctccctggctcccat

SEQ ID NO: 4905502 - DNA, 21 bp, Homo sapiens
tcccctccctggctcccatga

SEQ ID NO: 4905503 - DNA, 13 bp, Homo sapiens
tcccctccctgtc

SEQ ID NO: 4905504 - DNA, 14 bp, Homo sapiens
tcccctccttctcc

SEQ ID NO: 4905505 - DNA, 14 bp, Homo sapiens
tcccctctgctgct

SEQ ID NO: 4905506 - DNA, 17 bp, Homo sapiens
tcccctcttcccttcaa

SEQ ID NO: 4905507 - DNA, 12 bp, Homo sapiens
tcccctgagccc

SEQ ID NO: 4905508 - DNA, 24 bp, Homo sapiens
tcccctgccctggtccagggaagc

SEQ ID NO: 4905509 - DNA, 12 bp, Homo sapiens
tcccctgccttg

SEQ ID NO: 4905510 - DNA, 18 bp, Homo sapiens
tcccctgctgcaggggct

SEQ ID NO: 4905511 - DNA, 16 bp, Homo sapiens
tcccctggactgggag

SEQ ID NO: 4905512 - DNA, 15 bp, Homo sapiens
tcccctgttcactct

SEQ ID NO: 4905513 - DNA, 16 bp, Homo sapiens
tccccttcctcactgc

SEQ ID NO: 4905514 - DNA, 13 bp, Homo sapiens
tccccttctctgt

SEQ ID NO: 4905515 - DNA, 15 bp, Homo sapiens
tcccgaatagctggg

SEQ ID NO: 4905516 - DNA, 20 bp, Homo sapiens
tcccgaatagctgggactac

SEQ ID NO: 4905517 - DNA, 15 bp, Homo sapiens
tcccgagtacagtct

SEQ ID NO: 4905518 - DNA, 12 bp, Homo sapiens
tcccgagtctgg

SEQ ID NO: 4905519 - DNA, 16 bp, Homo sapiens
tcccgagtctgggaca

SEQ ID NO: 4905520 - DNA, 21 bp, Homo sapiens
tcccgccccttcccactcacc

SEQ ID NO: 4905521 - DNA, 14 bp, Homo sapiens
tcccgctcagccct

SEQ ID NO: 4905522 - DNA, 15 bp, Homo sapiens
tcccgctgctgctgc

SEQ ID NO: 4905523 - DNA, 15 bp, Homo sapiens
tcccggaggaaatct

SEQ ID NO: 4905524 - DNA, 14 bp, Homo sapiens
tcccggtcccgagt

SEQ ID NO: 4905525 - DNA, 16 bp, Homo sapiens
tccctaagccagcctg

SEQ ID NO: 4905526 - DNA, 20 bp, Homo sapiens
tccctaccccctaagagcca

SEQ ID NO: 4905527 - DNA, 21 bp, Homo sapiens
tccctaccgagtctcttctcc

SEQ ID NO: 4905528 - DNA, 17 bp, Homo sapiens
tccctacctcaggcagg

SEQ ID NO: 4905529 - DNA, 16 bp, Homo sapiens
tccctacttcctgtga

SEQ ID NO: 4905530 - DNA, 22 bp, Homo sapiens
tccctagaaaacaatgcaaaac

SEQ ID NO: 4905531 - DNA, 15 bp, Homo sapiens
tccctagcagtgaac

SEQ ID NO: 4905532 - DNA, 16 bp, Homo sapiens
tccctagccagcactt

SEQ ID NO: 4905533 - DNA, 17 bp, Homo sapiens
tccctagccagcacttg

SEQ ID NO: 4905534 - DNA, 15 bp, Homo sapiens
tccctatgtatttgc

SEQ ID NO: 4905535 - DNA, 15 bp, Homo sapiens
tccctcaccttctga

SEQ ID NO: 4905536 - DNA, 12 bp, Homo sapiens
tccctccccctt

SEQ ID NO: 4905537 - DNA, 14 bp, Homo sapiens
tccctcccctgccc

SEQ ID NO: 4905538 - DNA, 16 bp, Homo sapiens
tccctcccctgccctg

SEQ ID NO: 4905539 - DNA, 17 bp, Homo sapiens
tccctcccctgccctgg

SEQ ID NO: 4905540 - DNA, 19 bp, Homo sapiens
tccctcccctgccctggtc

SEQ ID NO: 4905541 - DNA, 17 bp, Homo sapiens
tccctcctcacctctgg

SEQ ID NO: 4905542 - DNA, 22 bp, Homo sapiens
tccctcctgcccgccacacaga

SEQ ID NO: 4905543 - DNA, 19 bp, Homo sapiens
tccctcgctgcacaaatac

SEQ ID NO: 4905544 - DNA, 14 bp, Homo sapiens
tccctctccctgtc

SEQ ID NO: 4905545 - DNA, 12 bp, Homo sapiens
tccctctctctt

SEQ ID NO: 4905546 - DNA, 18 bp, Homo sapiens
tccctctctcttctgctc

SEQ ID NO: 4905547 - DNA, 21 bp, Homo sapiens
tccctctctcttctgctccac

SEQ ID NO: 4905548 - DNA, 23 bp, Homo sapiens
tccctctctcttctgctccaccc

SEQ ID NO: 4905549 - DNA, 16 bp, Homo sapiens
tccctctgctcagcca

SEQ ID NO: 4905550 - DNA, 16 bp, Homo sapiens
tccctcttgttttgtt

SEQ ID NO: 4905551 - DNA, 20 bp, Homo sapiens
tccctcttgttttgtttgtc

SEQ ID NO: 4905552 - DNA, 23 bp, Homo sapiens
tccctctttggctcccctgtacc

SEQ ID NO: 4905553 - DNA, 10 bp, Homo sapiens
tccctctttt

SEQ ID NO: 4905554 - DNA, 13 bp, Homo sapiens
tccctcttttctt

SEQ ID NO: 4905555 - DNA, 18 bp, Homo sapiens
tccctcttttcttactcc

SEQ ID NO: 4905556 - DNA, 22 bp, Homo sapiens
tccctgaaacacgaaacttgtt

SEQ ID NO: 4905557 - DNA, 12 bp, Homo sapiens
tccctgaagcca

SEQ ID NO: 4905558 - DNA, 15 bp, Homo sapiens
tccctgaagccagcc

SEQ ID NO: 4905559 - DNA, 16 bp, Homo sapiens
tccctgaagccagcct

SEQ ID NO: 4905560 - DNA, 21 bp, Homo sapiens
tccctgaatcccccttgccac

SEQ ID NO: 4905561 - DNA, 20 bp, Homo sapiens
tccctgagagtgtctctgat

SEQ ID NO: 4905562 - DNA, 16 bp, Homo sapiens
tccctgattgacctgc

SEQ ID NO: 4905563 - DNA, 23 bp, Homo sapiens
tccctgattgacctgctccgctg

SEQ ID NO: 4905564 - DNA, 13 bp, Homo sapiens
tccctgcacttgc

SEQ ID NO: 4905565 - DNA, 13 bp, Homo sapiens
tccctgcccaggc

SEQ ID NO: 4905566 - DNA, 16 bp, Homo sapiens
tccctgcccaggccgg

SEQ ID NO: 4905567 - DNA, 19 bp, Homo sapiens
tccctgcccaggccggcca

SEQ ID NO: 4905568 - DNA, 13 bp, Homo sapiens
tccctgccccaaa

SEQ ID NO: 4905569 - DNA, 18 bp, Homo sapiens
tccctgcccctcccttca

SEQ ID NO: 4905570 - DNA, 21 bp, Homo sapiens
tccctgcgcctgtgatgctgg

SEQ ID NO: 4905571 - DNA, 21 bp, Homo sapiens
tccctggagtgtggctgagga

SEQ ID NO: 4905572 - DNA, 22 bp, Homo sapiens
tccctggagtgtggctgaggag

SEQ ID NO: 4905573 - DNA, 14 bp, Homo sapiens
tccctggctcccat

SEQ ID NO: 4905574 - DNA, 18 bp, Homo sapiens
tccctgggccagggtctg

SEQ ID NO: 4905575 - DNA, 12 bp, Homo sapiens
tccctgtgaggg

SEQ ID NO: 4905576 - DNA, 18 bp, Homo sapiens
tccctgttcttcctccag

SEQ ID NO: 4905577 - DNA, 14 bp, Homo sapiens
tccctgtttaatat

SEQ ID NO: 4905578 - DNA, 16 bp, Homo sapiens
tccctgtttaatattt

SEQ ID NO: 4905579 - DNA, 21 bp, Homo sapiens
tcccttcagcccccagcccct

SEQ ID NO: 4905580 - DNA, 20 bp, Homo sapiens
tcccttcagtaccctctcag

SEQ ID NO: 4905581 - DNA, 21 bp, Homo sapiens
tcccttcagtaccctctcagc

SEQ ID NO: 4905582 - DNA, 23 bp, Homo sapiens
tcccttcagtaccctctcagctc

SEQ ID NO: 4905583 - DNA, 14 bp, Homo sapiens
tcccttccactgcc

SEQ ID NO: 4905584 - DNA, 20 bp, Homo sapiens
tcccttccactgcctctgcc

SEQ ID NO: 4905585 - DNA, 22 bp, Homo sapiens
tcccttccactgcctctgcctt

SEQ ID NO: 4905586 - DNA, 17 bp, Homo sapiens
tcccttcccttccactg

SEQ ID NO: 4905587 - DNA, 12 bp, Homo sapiens
tcccttcctctt

SEQ ID NO: 4905588 - DNA, 14 bp, Homo sapiens
tcccttcctcttcg

SEQ ID NO: 4905589 - DNA, 17 bp, Homo sapiens
tcccttcctcttcggcc

SEQ ID NO: 4905590 - DNA, 15 bp, Homo sapiens
tcccttctcacagca

SEQ ID NO: 4905591 - DNA, 16 bp, Homo sapiens
tcccttcttgcatcct

SEQ ID NO: 4905592 - DNA, 23 bp, Homo sapiens
tcccttcttgcatccttcctata

SEQ ID NO: 4905593 - DNA, 16 bp, Homo sapiens
tcccttgatgcacaga

SEQ ID NO: 4905594 - DNA, 17 bp, Homo sapiens
tcccttgccactttgca

SEQ ID NO: 4905595 - DNA, 23 bp, Homo sapiens
tcccttgcttttccctcttttct

SEQ ID NO: 4905596 - DNA, 16 bp, Homo sapiens
tcccttgtggccctct

SEQ ID NO: 4905597 - DNA, 18 bp, Homo sapiens
tccctttccttccatccc

SEQ ID NO: 4905598 - DNA, 19 bp, Homo sapiens
tccctttccttccatccct

SEQ ID NO: 4905599 - DNA, 23 bp, Homo sapiens
tccctttccttccatccctaccc

SEQ ID NO: 4905600 - DNA, 16 bp, Homo sapiens
tccctttccttcctaa

SEQ ID NO: 4905601 - DNA, 21 bp, Homo sapiens
tccgaagtatgagggaaaatg

SEQ ID NO: 4905602 - DNA, 13 bp, Homo sapiens
tccgaccagacac

SEQ ID NO: 4905603 - DNA, 18 bp, Homo sapiens
tccgaccctctgggaacc

SEQ ID NO: 4905604 - DNA, 15 bp, Homo sapiens
tccgatgaattctta

SEQ ID NO: 4905605 - DNA, 20 bp, Homo sapiens
tccgatggatgaatctccca

SEQ ID NO: 4905606 - DNA, 13 bp, Homo sapiens
tccgcccccagcc

SEQ ID NO: 4905607 - DNA, 14 bp, Homo sapiens
tccgcccccagcct

SEQ ID NO: 4905608 - DNA, 16 bp, Homo sapiens
tccgcccctgcctgcc

SEQ ID NO: 4905609 - DNA, 19 bp, Homo sapiens
tccgcccttagtcccccaa

SEQ ID NO: 4905610 - DNA, 13 bp, Homo sapiens
tccgccttttgta

SEQ ID NO: 4905611 - DNA, 12 bp, Homo sapiens
tccgcgaaaata

SEQ ID NO: 4905612 - DNA, 17 bp, Homo sapiens
tccgctctcttcctgcc

SEQ ID NO: 4905613 - DNA, 13 bp, Homo sapiens
tccgctgctcctt

SEQ ID NO: 4905614 - DNA, 18 bp, Homo sapiens
tccgctttctacccagcg

SEQ ID NO: 4905615 - DNA, 21 bp, Homo sapiens
tccgctttctacccagcgagc

SEQ ID NO: 4905616 - DNA, 17 bp, Homo sapiens
tccggtagggaggcagc

SEQ ID NO: 4905617 - DNA, 19 bp, Homo sapiens
tccggtagggaggcagcct

SEQ ID NO: 4905618 - DNA, 19 bp, Homo sapiens
tccggttgcatactggact

SEQ ID NO: 4905619 - DNA, 14 bp, Homo sapiens
tccggtttgccatg

SEQ ID NO: 4905620 - DNA, 21 bp, Homo sapiens
tccgtttattataaactgtat

SEQ ID NO: 4905621 - DNA, 16 bp, Homo sapiens
tcctaaaagcaaaata

SEQ ID NO: 4905622 - DNA, 23 bp, Homo sapiens
tcctaaaagcaaaataaaaacta

SEQ ID NO: 4905623 - DNA, 18 bp, Homo sapiens
tcctaaagagagtatttt

SEQ ID NO: 4905624 - DNA, 18 bp, Homo sapiens
tcctaagaaatatgtgag

SEQ ID NO: 4905625 - DNA, 13 bp, Homo sapiens
tcctaagacacaa

SEQ ID NO: 4905626 - DNA, 19 bp, Homo sapiens
tcctaagagtgctgggcat

SEQ ID NO: 4905627 - DNA, 14 bp, Homo sapiens
tcctaagcctaaaa

SEQ ID NO: 4905628 - DNA, 22 bp, Homo sapiens
tcctaatcagaaatttttatca

SEQ ID NO: 4905629 - DNA, 18 bp, Homo sapiens
tcctacaagagcagcctg

SEQ ID NO: 4905630 - DNA, 21 bp, Homo sapiens
tcctacaagatttagaaaaaa

SEQ ID NO: 4905631 - DNA, 19 bp, Homo sapiens
tcctacaggcagtctctct

SEQ ID NO: 4905632 - DNA, 15 bp, Homo sapiens
tcctacccacacctc

SEQ ID NO: 4905633 - DNA, 13 bp, Homo sapiens
tcctacccttttc

SEQ ID NO: 4905634 - DNA, 23 bp, Homo sapiens
tcctagatcctaagggtcgaaag

SEQ ID NO: 4905635 - DNA, 20 bp, Homo sapiens
tcctaggctccaccccatcc

SEQ ID NO: 4905636 - DNA, 22 bp, Homo sapiens
tcctaggctccaccccatccag

SEQ ID NO: 4905637 - DNA, 17 bp, Homo sapiens
tcctagtttcctctcct

SEQ ID NO: 4905638 - DNA, 21 bp, Homo sapiens
tcctagtttgacctcacagtg

SEQ ID NO: 4905639 - DNA, 13 bp, Homo sapiens
tcctagttttctc

SEQ ID NO: 4905640 - DNA, 20 bp, Homo sapiens
tcctagttttctcctcccag

SEQ ID NO: 4905641 - DNA, 13 bp, Homo sapiens
tcctataacttga

SEQ ID NO: 4905642 - DNA, 20 bp, Homo sapiens
tcctataacttgatgcatgt

SEQ ID NO: 4905643 - DNA, 17 bp, Homo sapiens
tcctataatctgtcaaa

SEQ ID NO: 4905644 - DNA, 14 bp, Homo sapiens
tcctatttgttttc

SEQ ID NO: 4905645 - DNA, 16 bp, Homo sapiens
tcctatttgttttcat

SEQ ID NO: 4905646 - DNA, 13 bp, Homo sapiens
tcctatttttgta

SEQ ID NO: 4905647 - DNA, 17 bp, Homo sapiens
tcctatttttgtaaact

SEQ ID NO: 4905648 - DNA, 12 bp, Homo sapiens
tcctcacatagc

SEQ ID NO: 4905649 - DNA, 13 bp, Homo sapiens
tcctcacccccag

SEQ ID NO: 4905650 - DNA, 16 bp, Homo sapiens
tcctcacccccagctt

SEQ ID NO: 4905651 - DNA, 12 bp, Homo sapiens
tcctcacccctg

SEQ ID NO: 4905652 - DNA, 14 bp, Homo sapiens
tcctcacccctgtc

SEQ ID NO: 4905653 - DNA, 15 bp, Homo sapiens
tcctcacctctggac

SEQ ID NO: 4905654 - DNA, 20 bp, Homo sapiens
tcctcacctctggactggct

SEQ ID NO: 4905655 - DNA, 22 bp, Homo sapiens
tcctcacctctggactggctag

SEQ ID NO: 4905656 - DNA, 23 bp, Homo sapiens
tcctcacctctggactggctaga

SEQ ID NO: 4905657 - DNA, 12 bp, Homo sapiens
tcctcactccca

SEQ ID NO: 4905658 - DNA, 14 bp, Homo sapiens
tcctcactcccagt

SEQ ID NO: 4905659 - DNA, 17 bp, Homo sapiens
tcctcactcccagtcca

SEQ ID NO: 4905660 - DNA, 21 bp, Homo sapiens
tcctcactgctccctgaagcc

SEQ ID NO: 4905661 - DNA, 23 bp, Homo sapiens
tcctcactgctccctgaagccag

SEQ ID NO: 4905662 - DNA, 22 bp, Homo sapiens
tcctcactggccatccctcgtg

SEQ ID NO: 4905663 - DNA, 21 bp, Homo sapiens
tcctcagggagcagggaaggc

SEQ ID NO: 4905664 - DNA, 22 bp, Homo sapiens
tcctcatagtatggtggctggg

SEQ ID NO: 4905665 - DNA, 14 bp, Homo sapiens
tcctcatcccgtgt

SEQ ID NO: 4905666 - DNA, 18 bp, Homo sapiens
tcctccaaaggcccccta

SEQ ID NO: 4905667 - DNA, 16 bp, Homo sapiens
tcctccagaagcctct

SEQ ID NO: 4905668 - DNA, 13 bp, Homo sapiens
tcctccagctgca

SEQ ID NO: 4905669 - DNA, 21 bp, Homo sapiens
tcctccagctgcaccagagca

SEQ ID NO: 4905670 - DNA, 21 bp, Homo sapiens
tcctccagggatgatcaacag

SEQ ID NO: 4905671 - DNA, 14 bp, Homo sapiens
tcctcccacctcag

SEQ ID NO: 4905672 - DNA, 20 bp, Homo sapiens
tcctcccacctcagcctccc

SEQ ID NO: 4905673 - DNA, 22 bp, Homo sapiens
tcctcccagcttgtaggagctg

SEQ ID NO: 4905674 - DNA, 21 bp, Homo sapiens
tcctcccaggcgccccttccc

SEQ ID NO: 4905675 - DNA, 19 bp, Homo sapiens
tcctcccatcccctggact

SEQ ID NO: 4905676 - DNA, 21 bp, Homo sapiens
tcctccccacttgtccgctgg

SEQ ID NO: 4905677 - DNA, 14 bp, Homo sapiens
tcctcccctcacag

SEQ ID NO: 4905678 - DNA, 17 bp, Homo sapiens
tcctcccctcacagcct

SEQ ID NO: 4905679 - DNA, 12 bp, Homo sapiens
tcctccctccac

SEQ ID NO: 4905680 - DNA, 18 bp, Homo sapiens
tcctccctttccttccta

SEQ ID NO: 4905681 - DNA, 23 bp, Homo sapiens
tcctccggttgcatactggactc

SEQ ID NO: 4905682 - DNA, 14 bp, Homo sapiens
tcctccgtccagcc

SEQ ID NO: 4905683 - DNA, 21 bp, Homo sapiens
tcctcctccaaaggcccccta

SEQ ID NO: 4905684 - DNA, 21 bp, Homo sapiens
tcctcctggaaccttgctgtc

SEQ ID NO: 4905685 - DNA, 15 bp, Homo sapiens
tcctcgttcctttct

SEQ ID NO: 4905686 - DNA, 15 bp, Homo sapiens
tcctctagctgtggg

SEQ ID NO: 4905687 - DNA, 17 bp, Homo sapiens
tcctctccactgccttc

SEQ ID NO: 4905688 - DNA, 12 bp, Homo sapiens
tcctctccccag

SEQ ID NO: 4905689 - DNA, 15 bp, Homo sapiens
tcctctccccagcaa

SEQ ID NO: 4905690 - DNA, 12 bp, Homo sapiens
tcctctcctgga

SEQ ID NO: 4905691 - DNA, 14 bp, Homo sapiens
tcctctcctggagg

SEQ ID NO: 4905692 - DNA, 16 bp, Homo sapiens
tcctctcctggaggat

SEQ ID NO: 4905693 - DNA, 19 bp, Homo sapiens
tcctctctccagatgtttc

SEQ ID NO: 4905694 - DNA, 19 bp, Homo sapiens
tcctctgcttgcctggaga

SEQ ID NO: 4905695 - DNA, 17 bp, Homo sapiens
tcctctggggctctagg

SEQ ID NO: 4905696 - DNA, 22 bp, Homo sapiens
tcctctgtccaggcactgctgc

SEQ ID NO: 4905697 - DNA, 21 bp, Homo sapiens
tcctcttcggccctcagatgt

SEQ ID NO: 4905698 - DNA, 15 bp, Homo sapiens
tcctctttaaaacaa

SEQ ID NO: 4905699 - DNA, 18 bp, Homo sapiens
tcctctttaaaacaaaac

SEQ ID NO: 4905700 - DNA, 13 bp, Homo sapiens
tcctctttctctc

SEQ ID NO: 4905701 - DNA, 16 bp, Homo sapiens
tcctctttctctcccc

SEQ ID NO: 4905702 - DNA, 19 bp, Homo sapiens
tcctgaaccgcacagctca

SEQ ID NO: 4905703 - DNA, 13 bp, Homo sapiens
tcctgaagaatta

SEQ ID NO: 4905704 - DNA, 14 bp, Homo sapiens
tcctgacagaaggt

SEQ ID NO: 4905705 - DNA, 15 bp, Homo sapiens
tcctgacagaaggtg

SEQ ID NO: 4905706 - DNA, 21 bp, Homo sapiens
tcctgacatcacagcagcctc

SEQ ID NO: 4905707 - DNA, 16 bp, Homo sapiens
tcctgacctcaggtga

SEQ ID NO: 4905708 - DNA, 18 bp, Homo sapiens
tcctgacgaaactggccc

SEQ ID NO: 4905709 - DNA, 20 bp, Homo sapiens
tcctgacgaaactggccccg

SEQ ID NO: 4905710 - DNA, 21 bp, Homo sapiens
tcctgacgaaactggccccgg

SEQ ID NO: 4905711 - DNA, 22 bp, Homo sapiens
tcctgacgaaactggccccgga

SEQ ID NO: 4905712 - DNA, 20 bp, Homo sapiens
tcctgacgtctgaagcttga

SEQ ID NO: 4905713 - DNA, 22 bp, Homo sapiens
tcctgactcctacctgccctgg

SEQ ID NO: 4905714 - DNA, 16 bp, Homo sapiens
tcctgactctgccccc

SEQ ID NO: 4905715 - DNA, 14 bp, Homo sapiens
tcctgagccccgcc

SEQ ID NO: 4905716 - DNA, 18 bp, Homo sapiens
tcctgagccccgccctct

SEQ ID NO: 4905717 - DNA, 15 bp, Homo sapiens
tcctgagctttatgg

SEQ ID NO: 4905718 - DNA, 17 bp, Homo sapiens
tcctgaggctttggatt

SEQ ID NO: 4905719 - DNA, 18 bp, Homo sapiens
tcctgaggctttggattt

SEQ ID NO: 4905720 - DNA, 17 bp, Homo sapiens
tcctgagggaggacctg

SEQ ID NO: 4905721 - DNA, 21 bp, Homo sapiens
tcctgagggaggacctggggc

SEQ ID NO: 4905722 - DNA, 15 bp, Homo sapiens
tcctgaggggcatct

SEQ ID NO: 4905723 - DNA, 16 bp, Homo sapiens
tcctgaggggcatctg

SEQ ID NO: 4905724 - DNA, 19 bp, Homo sapiens
tcctgaggggcatctgccc

SEQ ID NO: 4905725 - DNA, 22 bp, Homo sapiens
tcctgagggtccccacctggga

SEQ ID NO: 4905726 - DNA, 16 bp, Homo sapiens
tcctgagtggccaggg

SEQ ID NO: 4905727 - DNA, 15 bp, Homo sapiens
tcctgataaagcaca

SEQ ID NO: 4905728 - DNA, 12 bp, Homo sapiens
tcctgcagcatg

SEQ ID NO: 4905729 - DNA, 22 bp, Homo sapiens
tcctgcagcatggtccctgcct

SEQ ID NO: 4905730 - DNA, 11 bp, Homo sapiens
tcctgccaaaa

SEQ ID NO: 4905731 - DNA, 17 bp, Homo sapiens
tcctgccagtgtggaac

SEQ ID NO: 4905732 - DNA, 20 bp, Homo sapiens
tcctgcccactgctgcagta

SEQ ID NO: 4905733 - DNA, 12 bp, Homo sapiens
tcctgcccctct

SEQ ID NO: 4905734 - DNA, 19 bp, Homo sapiens
tcctgcccctctttctctt

SEQ ID NO: 4905735 - DNA, 13 bp, Homo sapiens
tcctgcctcagcc

SEQ ID NO: 4905736 - DNA, 15 bp, Homo sapiens
tcctgcctcagcctc

SEQ ID NO: 4905737 - DNA, 12 bp, Homo sapiens
tcctgcctggcc

SEQ ID NO: 4905738 - DNA, 14 bp, Homo sapiens
tcctgcctggccag

SEQ ID NO: 4905739 - DNA, 16 bp, Homo sapiens
tcctgcctggccaggc

SEQ ID NO: 4905740 - DNA, 14 bp, Homo sapiens
tcctgcctgtgctg

SEQ ID NO: 4905741 - DNA, 12 bp, Homo sapiens
tcctgctccaga

SEQ ID NO: 4905742 - DNA, 14 bp, Homo sapiens
tcctgctccagaat

SEQ ID NO: 4905743 - DNA, 18 bp, Homo sapiens
tcctggaaccttgctgtc

SEQ ID NO: 4905744 - DNA, 21 bp, Homo sapiens
tcctggaaccttgctgtcctg

SEQ ID NO: 4905745 - DNA, 14 bp, Homo sapiens
tcctggcacccggc

SEQ ID NO: 4905746 - DNA, 16 bp, Homo sapiens
tcctggcacccggccc

SEQ ID NO: 4905747 - DNA, 20 bp, Homo sapiens
tcctggcacccggcccctgc

SEQ ID NO: 4905748 - DNA, 11 bp, Homo sapiens
tcctggcagcc

SEQ ID NO: 4905749 - DNA, 14 bp, Homo sapiens
tcctggcagcccag

SEQ ID NO: 4905750 - DNA, 16 bp, Homo sapiens
tcctggctcctgaggg

SEQ ID NO: 4905751 - DNA, 23 bp, Homo sapiens
tcctggctcttgatacccccctc

SEQ ID NO: 4905752 - DNA, 12 bp, Homo sapiens
tcctggctgcgg

SEQ ID NO: 4905753 - DNA, 18 bp, Homo sapiens
tcctgggagtgagctggt

SEQ ID NO: 4905754 - DNA, 21 bp, Homo sapiens
tcctgggggttctttcttcct

SEQ ID NO: 4905755 - DNA, 21 bp, Homo sapiens
tcctgtagaggttttgttgtt

SEQ ID NO: 4905756 - DNA, 16 bp, Homo sapiens
tcctgtagctctccct

SEQ ID NO: 4905757 - DNA, 21 bp, Homo sapiens
tcctgtagttttattttatgt

SEQ ID NO: 4905758 - DNA, 17 bp, Homo sapiens
tcctgtctttaaggaaa

SEQ ID NO: 4905759 - DNA, 16 bp, Homo sapiens
tcctgtcttttcaggt

SEQ ID NO: 4905760 - DNA, 12 bp, Homo sapiens
tcctgtgctggg

SEQ ID NO: 4905761 - DNA, 13 bp, Homo sapiens
tcctgtggggaaa

SEQ ID NO: 4905762 - DNA, 17 bp, Homo sapiens
tcctgtgtactgtgtca

SEQ ID NO: 4905763 - DNA, 23 bp, Homo sapiens
tcctgtgtcttgcaatggcagcc

SEQ ID NO: 4905764 - DNA, 24 bp, Homo sapiens
tcctgtgtcttgcaatggcagcct

SEQ ID NO: 4905765 - DNA, 21 bp, Homo sapiens
tcctgttaatgtatttgttca

SEQ ID NO: 4905766 - DNA, 20 bp, Homo sapiens
tcctgttttataatgaaccc

SEQ ID NO: 4905767 - DNA, 20 bp, Homo sapiens
tcctgtttttctgggtggcc

SEQ ID NO: 4905768 - DNA, 23 bp, Homo sapiens
tccttaaaggcaccatctaatag

SEQ ID NO: 4905769 - DNA, 20 bp, Homo sapiens
tccttcaaaatccttccaaa

SEQ ID NO: 4905770 - DNA, 15 bp, Homo sapiens
tccttccaaagaatt

SEQ ID NO: 4905771 - DNA, 19 bp, Homo sapiens
tccttccaaagaattctta

SEQ ID NO: 4905772 - DNA, 16 bp, Homo sapiens
tccttccatccctacc

SEQ ID NO: 4905773 - DNA, 17 bp, Homo sapiens
tccttccatccctaccc

SEQ ID NO: 4905774 - DNA, 12 bp, Homo sapiens
tccttctccctt

SEQ ID NO: 4905775 - DNA, 20 bp, Homo sapiens
tccttctggcagattcaaat

SEQ ID NO: 4905776 - DNA, 12 bp, Homo sapiens
tccttctggcct

SEQ ID NO: 4905777 - DNA, 12 bp, Homo sapiens
tccttctgtcct

SEQ ID NO: 4905778 - DNA, 13 bp, Homo sapiens
tccttctttgata

SEQ ID NO: 4905779 - DNA, 19 bp, Homo sapiens
tccttgaccttcctctggg

SEQ ID NO: 4905780 - DNA, 14 bp, Homo sapiens
tccttgatcatttt

SEQ ID NO: 4905781 - DNA, 20 bp, Homo sapiens
tccttgcacccctcactctg

SEQ ID NO: 4905782 - DNA, 12 bp, Homo sapiens
tccttggcacca

SEQ ID NO: 4905783 - DNA, 16 bp, Homo sapiens
tccttggcaccaaaga

SEQ ID NO: 4905784 - DNA, 22 bp, Homo sapiens
tccttggcctagcccaccctgc

SEQ ID NO: 4905785 - DNA, 20 bp, Homo sapiens
tccttggcttacctgacctc

SEQ ID NO: 4905786 - DNA, 18 bp, Homo sapiens
tccttggtgcctggcctg

SEQ ID NO: 4905787 - DNA, 13 bp, Homo sapiens
tccttgtcactgg

SEQ ID NO: 4905788 - DNA, 15 bp, Homo sapiens
tccttgtccacccac

SEQ ID NO: 4905789 - DNA, 16 bp, Homo sapiens
tccttgtccacccacc

SEQ ID NO: 4905790 - DNA, 12 bp, Homo sapiens
tccttgtgcaaa

SEQ ID NO: 4905791 - DNA, 13 bp, Homo sapiens
tccttgtggcaga

SEQ ID NO: 4905792 - DNA, 14 bp, Homo sapiens
tccttgtggcagag

SEQ ID NO: 4905793 - DNA, 14 bp, Homo sapiens
tccttgttgttggt

SEQ ID NO: 4905794 - DNA, 20 bp, Homo sapiens
tccttgtttatcagatacat

SEQ ID NO: 4905795 - DNA, 21 bp, Homo sapiens
tccttgtttatcagatacatc

SEQ ID NO: 4905796 - DNA, 22 bp, Homo sapiens
tcctttaaaaaaatttaagtgc

SEQ ID NO: 4905797 - DNA, 21 bp, Homo sapiens
tcctttacaaaagaaatacct

SEQ ID NO: 4905798 - DNA, 15 bp, Homo sapiens
tcctttactttccct

SEQ ID NO: 4905799 - DNA, 22 bp, Homo sapiens
tcctttagcgcccagttgggtg

SEQ ID NO: 4905800 - DNA, 21 bp, Homo sapiens
tcctttatgtggaaaacagaa

SEQ ID NO: 4905801 - DNA, 17 bp, Homo sapiens
tcctttattattatttt

SEQ ID NO: 4905802 - DNA, 19 bp, Homo sapiens
tcctttcacaaccttctgt

SEQ ID NO: 4905803 - DNA, 18 bp, Homo sapiens
tcctttccccagcccagg

SEQ ID NO: 4905804 - DNA, 14 bp, Homo sapiens
tcctttcccttcct

SEQ ID NO: 4905805 - DNA, 15 bp, Homo sapiens
tcctttcccttcctc

SEQ ID NO: 4905806 - DNA, 18 bp, Homo sapiens
tcctttcccttcctcttc

SEQ ID NO: 4905807 - DNA, 13 bp, Homo sapiens
tcctttctccagg

SEQ ID NO: 4905808 - DNA, 17 bp, Homo sapiens
tcctttgcagggcagcc

SEQ ID NO: 4905809 - DNA, 15 bp, Homo sapiens
tcctttgtgtttcta

SEQ ID NO: 4905810 - DNA, 16 bp, Homo sapiens
tcctttgttcttacct

SEQ ID NO: 4905811 - DNA, 19 bp, Homo sapiens
tccttttaaaacacttcca

SEQ ID NO: 4905812 - DNA, 15 bp, Homo sapiens
tccttttcttttgtt

SEQ ID NO: 4905813 - DNA, 22 bp, Homo sapiens
tccttttcttttgttactgttc

SEQ ID NO: 4905814 - DNA, 15 bp, Homo sapiens
tcctttttctgatta

SEQ ID NO: 4905815 - DNA, 21 bp, Homo sapiens
tcgaaaagagtcttccaatta

SEQ ID NO: 4905816 - DNA, 19 bp, Homo sapiens
tcgaaaattcatttcacat

SEQ ID NO: 4905817 - DNA, 13 bp, Homo sapiens
tcgaaacacagaa

SEQ ID NO: 4905818 - DNA, 18 bp, Homo sapiens
tcgaaacacagaaacctt

SEQ ID NO: 4905819 - DNA, 16 bp, Homo sapiens
tcgaaagctctagaat

SEQ ID NO: 4905820 - DNA, 14 bp, Homo sapiens
tcgaaataacaatg

SEQ ID NO: 4905821 - DNA, 16 bp, Homo sapiens
tcgaaataacaatgtt

SEQ ID NO: 4905822 - DNA, 18 bp, Homo sapiens
tcgaaataacaatgttaa

SEQ ID NO: 4905823 - DNA, 18 bp, Homo sapiens
tcgaaccgttttgaagct

SEQ ID NO: 4905824 - DNA, 13 bp, Homo sapiens
tcgaactggctgc

SEQ ID NO: 4905825 - DNA, 18 bp, Homo sapiens
tcgaacttcacaactagg

SEQ ID NO: 4905826 - DNA, 23 bp, Homo sapiens
tcgaagccttgcctaaatttaat

SEQ ID NO: 4905827 - DNA, 12 bp, Homo sapiens
tcgacttttctt

SEQ ID NO: 4905828 - DNA, 22 bp, Homo sapiens
tcgagcagtcctgcctcagcct

SEQ ID NO: 4905829 - DNA, 16 bp, Homo sapiens
tcgaggctgcagtcag

SEQ ID NO: 4905830 - DNA, 20 bp, Homo sapiens
tcgaggctgcagtcagtcat

SEQ ID NO: 4905831 - DNA, 14 bp, Homo sapiens
tcgaggggctctca

SEQ ID NO: 4905832 - DNA, 14 bp, Homo sapiens
tcgatccaaattgt

SEQ ID NO: 4905833 - DNA, 21 bp, Homo sapiens
tcgatccaaattgtgcttctc

SEQ ID NO: 4905834 - DNA, 15 bp, Homo sapiens
tcgatgaaggctgcc

SEQ ID NO: 4905835 - DNA, 17 bp, Homo sapiens
tcgcacccccctgttct

SEQ ID NO: 4905836 - DNA, 18 bp, Homo sapiens
tcgcacctaccatcaggg

SEQ ID NO: 4905837 - DNA, 14 bp, Homo sapiens
tcgccctcctttct

SEQ ID NO: 4905838 - DNA, 16 bp, Homo sapiens
tcgccctcctttctgt

SEQ ID NO: 4905839 - DNA, 18 bp, Homo sapiens
tcgccctcctttctgtgc

SEQ ID NO: 4905840 - DNA, 17 bp, Homo sapiens
tcgcgcccgcccctgca

SEQ ID NO: 4905841 - DNA, 13 bp, Homo sapiens
tcgctcctgtgtc

SEQ ID NO: 4905842 - DNA, 14 bp, Homo sapiens
tcgctcctgtgtct

SEQ ID NO: 4905843 - DNA, 17 bp, Homo sapiens
tcgctgacttcatggaa

SEQ ID NO: 4905844 - DNA, 21 bp, Homo sapiens
tcgctgttaccgcctgtctct

SEQ ID NO: 4905845 - DNA, 17 bp, Homo sapiens
tcgcttcccccatagcc

SEQ ID NO: 4905846 - DNA, 16 bp, Homo sapiens
tcgcttggctccatgc

SEQ ID NO: 4905847 - DNA, 14 bp, Homo sapiens
tcggaacagcagat

SEQ ID NO: 4905848 - DNA, 19 bp, Homo sapiens
tcggaacccaagcttagaa

SEQ ID NO: 4905849 - DNA, 17 bp, Homo sapiens
tcggaaccgctcaccta

SEQ ID NO: 4905850 - DNA, 23 bp, Homo sapiens
tcggactaagcctacctgctctc

SEQ ID NO: 4905851 - DNA, 16 bp, Homo sapiens
tcggagcatcccggag

SEQ ID NO: 4905852 - DNA, 13 bp, Homo sapiens
tcggaggccccac

SEQ ID NO: 4905853 - DNA, 17 bp, Homo sapiens
tcggaggccccactgat

SEQ ID NO: 4905854 - DNA, 18 bp, Homo sapiens
tcggaggccccactgatg

SEQ ID NO: 4905855 - DNA, 19 bp, Homo sapiens
tcggctccccatgtgtcct

SEQ ID NO: 4905856 - DNA, 15 bp, Homo sapiens
tcgggcaccagccag

SEQ ID NO: 4905857 - DNA, 19 bp, Homo sapiens
tcgggcaggggctggaggg

SEQ ID NO: 4905858 - DNA, 19 bp, Homo sapiens
tcggggagaggctgaggac

SEQ ID NO: 4905859 - DNA, 20 bp, Homo sapiens
tcgtaaccagccagatcctc

SEQ ID NO: 4905860 - DNA, 22 bp, Homo sapiens
tcgtagctttcccaaataaact

SEQ ID NO: 4905861 - DNA, 20 bp, Homo sapiens
tcgtatcccgagtctgggac

SEQ ID NO: 4905862 - DNA, 19 bp, Homo sapiens
tcgtgaacatcccctccca

SEQ ID NO: 4905863 - DNA, 14 bp, Homo sapiens
tcgtgagtcattta

SEQ ID NO: 4905864 - DNA, 15 bp, Homo sapiens
tcgtgtaaattatgt

SEQ ID NO: 4905865 - DNA, 19 bp, Homo sapiens
tcgtgtgcaacagacaagt

SEQ ID NO: 4905866 - DNA, 23 bp, Homo sapiens
tcgttagaccgctctcttttctg

SEQ ID NO: 4905867 - DNA, 22 bp, Homo sapiens
tcgttggttatacaagttcttg

SEQ ID NO: 4905868 - DNA, 20 bp, Homo sapiens
tcgttttccaaactgactca

SEQ ID NO: 4905869 - DNA, 18 bp, Homo sapiens
tcgtttttatattaatgt

SEQ ID NO: 4905870 - DNA, 14 bp, Homo sapiens
tctaaaaacaccaa

SEQ ID NO: 4905871 - DNA, 11 bp, Homo sapiens
tctaaaactcc

SEQ ID NO: 4905872 - DNA, 22 bp, Homo sapiens
tctaaaagaatattcagagaat

SEQ ID NO: 4905873 - DNA, 18 bp, Homo sapiens
tctaaaatcttatagttc

SEQ ID NO: 4905874 - DNA, 19 bp, Homo sapiens
tctaaaatcttatagttct

SEQ ID NO: 4905875 - DNA, 20 bp, Homo sapiens
tctaaacaatgctgatttgg

SEQ ID NO: 4905876 - DNA, 16 bp, Homo sapiens
tctaaacccaatccaa

SEQ ID NO: 4905877 - DNA, 18 bp, Homo sapiens
tctaaagataatattact

SEQ ID NO: 4905878 - DNA, 17 bp, Homo sapiens
tctaaaggtccacaggt

SEQ ID NO: 4905879 - DNA, 11 bp, Homo sapiens
tctaaagttct

SEQ ID NO: 4905880 - DNA, 13 bp, Homo sapiens
tctaaagttctaa

SEQ ID NO: 4905881 - DNA, 16 bp, Homo sapiens
tctaaagttctaagat

SEQ ID NO: 4905882 - DNA, 20 bp, Homo sapiens
tctaaagttctaagattctg

SEQ ID NO: 4905883 - DNA, 14 bp, Homo sapiens
tctaaatctattta

SEQ ID NO: 4905884 - DNA, 16 bp, Homo sapiens
tctaaatctatttatt

SEQ ID NO: 4905885 - DNA, 19 bp, Homo sapiens
tctaacactggcatgttca

SEQ ID NO: 4905886 - DNA, 15 bp, Homo sapiens
tctaacctgatggca

SEQ ID NO: 4905887 - DNA, 12 bp, Homo sapiens
tctaaccttgaa

SEQ ID NO: 4905888 - DNA, 17 bp, Homo sapiens
tctaaccttgaatgctg

SEQ ID NO: 4905889 - DNA, 19 bp, Homo sapiens
tctaaccttgaatgctgcc

SEQ ID NO: 4905890 - DNA, 22 bp, Homo sapiens
tctaaccttgaatgctgccagt

SEQ ID NO: 4905891 - DNA, 18 bp, Homo sapiens
tctaagactcaaatgttc

SEQ ID NO: 4905892 - DNA, 19 bp, Homo sapiens
tctaagatcttagattctc

SEQ ID NO: 4905893 - DNA, 13 bp, Homo sapiens
tctaagatgtgat

SEQ ID NO: 4905894 - DNA, 16 bp, Homo sapiens
tctaagattctaatga

SEQ ID NO: 4905895 - DNA, 19 bp, Homo sapiens
tctaagattctagatcaga

SEQ ID NO: 4905896 - DNA, 19 bp, Homo sapiens
tctaagattctgattttag

SEQ ID NO: 4905897 - DNA, 16 bp, Homo sapiens
tctaagcaatttcttg

SEQ ID NO: 4905898 - DNA, 15 bp, Homo sapiens
tctaagctgcagctt

SEQ ID NO: 4905899 - DNA, 20 bp, Homo sapiens
tctaaggatgtcacagggcc

SEQ ID NO: 4905900 - DNA, 19 bp, Homo sapiens
tctaaggcctaggattcta

SEQ ID NO: 4905901 - DNA, 21 bp, Homo sapiens
tctaaggcctaggattctaaa

SEQ ID NO: 4905902 - DNA, 16 bp, Homo sapiens
tctaaggctctgagag

SEQ ID NO: 4905903 - DNA, 20 bp, Homo sapiens
tctaaggtccggtgttctaa

SEQ ID NO: 4905904 - DNA, 17 bp, Homo sapiens
tctaagttataagactc

SEQ ID NO: 4905905 - DNA, 20 bp, Homo sapiens
tctaagtttctaagattcta

SEQ ID NO: 4905906 - DNA, 15 bp, Homo sapiens
tctaataatttctaa

SEQ ID NO: 4905907 - DNA, 16 bp, Homo sapiens
tctaatacctctgtgt

SEQ ID NO: 4905908 - DNA, 15 bp, Homo sapiens
tctaatatatatgaa

SEQ ID NO: 4905909 - DNA, 19 bp, Homo sapiens
tctaatatatatgaataaa

SEQ ID NO: 4905910 - DNA, 17 bp, Homo sapiens
tctaatatcattcacta

SEQ ID NO: 4905911 - DNA, 20 bp, Homo sapiens
tctaatgggtatttaaacaa

SEQ ID NO: 4905912 - DNA, 15 bp, Homo sapiens
tctaatgtcttcatt

SEQ ID NO: 4905913 - DNA, 21 bp, Homo sapiens
tctaattctattaaagtgcta

SEQ ID NO: 4905914 - DNA, 17 bp, Homo sapiens
tctaattgcatctcaaa

SEQ ID NO: 4905915 - DNA, 19 bp, Homo sapiens
tctaatttcaaaaatataa

SEQ ID NO: 4905916 - DNA, 13 bp, Homo sapiens
tctacaaagcact

SEQ ID NO: 4905917 - DNA, 23 bp, Homo sapiens
tctacacagtgggaactctgaca

SEQ ID NO: 4905918 - DNA, 20 bp, Homo sapiens
tctacagctaatcagcattc

SEQ ID NO: 4905919 - DNA, 22 bp, Homo sapiens
tctacataagtaattcaagaaa

SEQ ID NO: 4905920 - DNA, 23 bp, Homo sapiens
tctacatactttcatcctgactc

SEQ ID NO: 4905921 - DNA, 16 bp, Homo sapiens
tctacatcttctgcct

SEQ ID NO: 4905922 - DNA, 14 bp, Homo sapiens
tctacattattgct

SEQ ID NO: 4905923 - DNA, 22 bp, Homo sapiens
tctacccaaaccctaggttccc

SEQ ID NO: 4905924 - DNA, 15 bp, Homo sapiens
tctaccctcccaccc

SEQ ID NO: 4905925 - DNA, 16 bp, Homo sapiens
tctactggtcttgtgg

SEQ ID NO: 4905926 - DNA, 22 bp, Homo sapiens
tctagaaacgagttggtgtctt

SEQ ID NO: 4905927 - DNA, 23 bp, Homo sapiens
tctagaattataagtcacaaaga

SEQ ID NO: 4905928 - DNA, 19 bp, Homo sapiens
tctagaatttatcacactt

SEQ ID NO: 4905929 - DNA, 13 bp, Homo sapiens
tctagacaagata

SEQ ID NO: 4905930 - DNA, 21 bp, Homo sapiens
tctagacaagatattgtacat

SEQ ID NO: 4905931 - DNA, 23 bp, Homo sapiens
tctagacaagatattgtacataa

SEQ ID NO: 4905932 - DNA, 23 bp, Homo sapiens
tctagacaatatacaagccaaag

SEQ ID NO: 4905933 - DNA, 14 bp, Homo sapiens
tctagacactgcca

SEQ ID NO: 4905934 - DNA, 13 bp, Homo sapiens
tctagactttctg

SEQ ID NO: 4905935 - DNA, 16 bp, Homo sapiens
tctagagatatatata

SEQ ID NO: 4905936 - DNA, 20 bp, Homo sapiens
tctagagtccaaggtttaaa

SEQ ID NO: 4905937 - DNA, 14 bp, Homo sapiens
tctagagttcagag

SEQ ID NO: 4905938 - DNA, 16 bp, Homo sapiens
tctagatcagatgctc

SEQ ID NO: 4905939 - DNA, 22 bp, Homo sapiens
tctagatcagatgctccaagat

SEQ ID NO: 4905940 - DNA, 20 bp, Homo sapiens
tctagatgaagttttacatt

SEQ ID NO: 4905941 - DNA, 22 bp, Homo sapiens
tctagatgaagttttacattgt

SEQ ID NO: 4905942 - DNA, 22 bp, Homo sapiens
tctagatgattaaataagattc

SEQ ID NO: 4905943 - DNA, 19 bp, Homo sapiens
tctagattccattggtcca

SEQ ID NO: 4905944 - DNA, 23 bp, Homo sapiens
tctagattccattggtccaagat

SEQ ID NO: 4905945 - DNA, 15 bp, Homo sapiens
tctaggcactgtagt

SEQ ID NO: 4905946 - DNA, 17 bp, Homo sapiens
tctagggttgctggagc

SEQ ID NO: 4905947 - DNA, 20 bp, Homo sapiens
tctaggtaggggcccacttc

SEQ ID NO: 4905948 - DNA, 20 bp, Homo sapiens
tctaggtttcaaagatgctg

SEQ ID NO: 4905949 - DNA, 21 bp, Homo sapiens
tctagtttacagaaaaatctt

SEQ ID NO: 4905950 - DNA, 14 bp, Homo sapiens
tctagtttcttgtg

SEQ ID NO: 4905951 - DNA, 20 bp, Homo sapiens
tctataaagaagaacttgca

SEQ ID NO: 4905952 - DNA, 13 bp, Homo sapiens
tctataaggccat

SEQ ID NO: 4905953 - DNA, 19 bp, Homo sapiens
tctataatcccagcacttt

SEQ ID NO: 4905954 - DNA, 16 bp, Homo sapiens
tctatacatctctccc

SEQ ID NO: 4905955 - DNA, 15 bp, Homo sapiens
tctatatatgtgtat

SEQ ID NO: 4905956 - DNA, 12 bp, Homo sapiens
tctatatgaatt

SEQ ID NO: 4905957 - DNA, 14 bp, Homo sapiens
tctatcaagcccag

SEQ ID NO: 4905958 - DNA, 23 bp, Homo sapiens
tctatcaagtcaatcatttctca

SEQ ID NO: 4905959 - DNA, 15 bp, Homo sapiens
tctatccaaacatgt

SEQ ID NO: 4905960 - DNA, 22 bp, Homo sapiens
tctatccaaacatgtatttatg

SEQ ID NO: 4905961 - DNA, 13 bp, Homo sapiens
tctatctaaatga

SEQ ID NO: 4905962 - DNA, 12 bp, Homo sapiens
tctatctgggcc

SEQ ID NO: 4905963 - DNA, 15 bp, Homo sapiens
tctatctgggcctgg

SEQ ID NO: 4905964 - DNA, 11 bp, Homo sapiens
tctatgatata

SEQ ID NO: 4905965 - DNA, 13 bp, Homo sapiens
tctatgggactca

SEQ ID NO: 4905966 - DNA, 22 bp, Homo sapiens
tctatggttatgaaagaatata

SEQ ID NO: 4905967 - DNA, 18 bp, Homo sapiens
tctatgtactagtactgt

SEQ ID NO: 4905968 - DNA, 23 bp, Homo sapiens
tctattaaatagttatataattc

SEQ ID NO: 4905969 - DNA, 17 bp, Homo sapiens
tctattccttctggcct

SEQ ID NO: 4905970 - DNA, 17 bp, Homo sapiens
tctattctcaaagtttc

SEQ ID NO: 4905971 - DNA, 18 bp, Homo sapiens
tctattctgagaaaacaa

SEQ ID NO: 4905972 - DNA, 12 bp, Homo sapiens
tctattctgtgt

SEQ ID NO: 4905973 - DNA, 18 bp, Homo sapiens
tctattgccttctttgaa

SEQ ID NO: 4905974 - DNA, 21 bp, Homo sapiens
tctattgccttctttgaagaa

SEQ ID NO: 4905975 - DNA, 14 bp, Homo sapiens
tctatttatgcctt

SEQ ID NO: 4905976 - DNA, 14 bp, Homo sapiens
tctatttgacttgt

SEQ ID NO: 4905977 - DNA, 14 bp, Homo sapiens
tctattttagaata

SEQ ID NO: 4905978 - DNA, 14 bp, Homo sapiens
tctattttctatgt

SEQ ID NO: 4905979 - DNA, 13 bp, Homo sapiens
tctattttgatgc

SEQ ID NO: 4905980 - DNA, 20 bp, Homo sapiens
tctattttgatgcagcattt

SEQ ID NO: 4905981 - DNA, 21 bp, Homo sapiens
tctattttgatgcagcatttg

SEQ ID NO: 4905982 - DNA, 23 bp, Homo sapiens
tctattttgatgcagcatttgat

SEQ ID NO: 4905983 - DNA, 15 bp, Homo sapiens
tctattttggattgt

SEQ ID NO: 4905984 - DNA, 16 bp, Homo sapiens
tctcaaaaatacaaaa

SEQ ID NO: 4905985 - DNA, 21 bp, Homo sapiens
tctcaaaactggacagtcact

SEQ ID NO: 4905986 - DNA, 21 bp, Homo sapiens
tctcaaaagcatttatcattc

SEQ ID NO: 4905987 - DNA, 21 bp, Homo sapiens
tctcaaactcttgacctcagg

SEQ ID NO: 4905988 - DNA, 23 bp, Homo sapiens
tctcaaagttttgaaaagctatt

SEQ ID NO: 4905989 - DNA, 19 bp, Homo sapiens
tctcaacaaagcacagtgt

SEQ ID NO: 4905990 - DNA, 17 bp, Homo sapiens
tctcaatgaagccagct

SEQ ID NO: 4905991 - DNA, 12 bp, Homo sapiens
tctcacacacat

SEQ ID NO: 4905992 - DNA, 16 bp, Homo sapiens
tctcacagatgtgact

SEQ ID NO: 4905993 - DNA, 15 bp, Homo sapiens
tctcaccagctgctg

SEQ ID NO: 4905994 - DNA, 22 bp, Homo sapiens
tctcacgggcatgggcactccc

SEQ ID NO: 4905995 - DNA, 13 bp, Homo sapiens
tctcactaaactt

SEQ ID NO: 4905996 - DNA, 21 bp, Homo sapiens
tctcactatgttgcccaggca

SEQ ID NO: 4905997 - DNA, 12 bp, Homo sapiens
tctcactcccca

SEQ ID NO: 4905998 - DNA, 13 bp, Homo sapiens
tctcactccccat

SEQ ID NO: 4905999 - DNA, 13 bp, Homo sapiens
tctcactcctacc

SEQ ID NO: 4906000 - DNA, 17 bp, Homo sapiens
tctcactcctacctggt

SEQ ID NO: 4906001 - DNA, 23 bp, Homo sapiens
tctcactccttttggtgtgttgg

SEQ ID NO: 4906002 - DNA, 12 bp, Homo sapiens
tctcactctgtc

SEQ ID NO: 4906003 - DNA, 17 bp, Homo sapiens
tctcactctgtcgccca

SEQ ID NO: 4906004 - DNA, 17 bp, Homo sapiens
tctcactgtgtacataa

SEQ ID NO: 4906005 - DNA, 14 bp, Homo sapiens
tctcactgttgccc

SEQ ID NO: 4906006 - DNA, 20 bp, Homo sapiens
tctcactgttgcccaggctg

SEQ ID NO: 4906007 - DNA, 21 bp, Homo sapiens
tctcactgttgcccaggctgg

SEQ ID NO: 4906008 - DNA, 17 bp, Homo sapiens
tctcagacttttgtaca

SEQ ID NO: 4906009 - DNA, 20 bp, Homo sapiens
tctcagacttttgtacatct

SEQ ID NO: 4906010 - DNA, 14 bp, Homo sapiens
tctcagcccagaag

SEQ ID NO: 4906011 - DNA, 22 bp, Homo sapiens
tctcagcccagaagaaaattct

SEQ ID NO: 4906012 - DNA, 13 bp, Homo sapiens
tctcagcctccca

SEQ ID NO: 4906013 - DNA, 21 bp, Homo sapiens
tctcagctccaggtggctctg

SEQ ID NO: 4906014 - DNA, 16 bp, Homo sapiens
tctcaggagatttcat

SEQ ID NO: 4906015 - DNA, 23 bp, Homo sapiens
tctcaggatatccttatcagagc

SEQ ID NO: 4906016 - DNA, 16 bp, Homo sapiens
tctcaggatccaagct

SEQ ID NO: 4906017 - DNA, 16 bp, Homo sapiens
tctcagtcatgcataa

SEQ ID NO: 4906018 - DNA, 19 bp, Homo sapiens
tctcagtcatgcataaata

SEQ ID NO: 4906019 - DNA, 18 bp, Homo sapiens
tctcagtgttgagccttt

SEQ ID NO: 4906020 - DNA, 22 bp, Homo sapiens
tctcagtgttgagccttttccc

SEQ ID NO: 4906021 - DNA, 19 bp, Homo sapiens
tctcagtttgtgtgtctta

SEQ ID NO: 4906022 - DNA, 16 bp, Homo sapiens
tctcatccccagtccc

SEQ ID NO: 4906023 - DNA, 17 bp, Homo sapiens
tctcatcctcctggaac

SEQ ID NO: 4906024 - DNA, 15 bp, Homo sapiens
tctcatctgcaccct

SEQ ID NO: 4906025 - DNA, 14 bp, Homo sapiens
tctcatcttgtgaa

SEQ ID NO: 4906026 - DNA, 15 bp, Homo sapiens
tctcatcttgtgaaa

SEQ ID NO: 4906027 - DNA, 18 bp, Homo sapiens
tctcatgtatcatctgga

SEQ ID NO: 4906028 - DNA, 13 bp, Homo sapiens
tctcattcttgtt

SEQ ID NO: 4906029 - DNA, 18 bp, Homo sapiens
tctcatttagaacttgca

SEQ ID NO: 4906030 - DNA, 14 bp, Homo sapiens
tctcatttgtcaca

SEQ ID NO: 4906031 - DNA, 20 bp, Homo sapiens
tctcattttaatgtaaagat

SEQ ID NO: 4906032 - DNA, 17 bp, Homo sapiens
tctccaagtctcagtgg

SEQ ID NO: 4906033 - DNA, 14 bp, Homo sapiens
tctccaccctgctc

SEQ ID NO: 4906034 - DNA, 17 bp, Homo sapiens
tctccaccctgctctcc

SEQ ID NO: 4906035 - DNA, 13 bp, Homo sapiens
tctccactccaga

SEQ ID NO: 4906036 - DNA, 14 bp, Homo sapiens
tctccactgccttc

SEQ ID NO: 4906037 - DNA, 17 bp, Homo sapiens
tctccagctcagaaccc

SEQ ID NO: 4906038 - DNA, 21 bp, Homo sapiens
tctccagctcagaacccaggg

SEQ ID NO: 4906039 - DNA, 17 bp, Homo sapiens
tctccagctgggctctg

SEQ ID NO: 4906040 - DNA, 19 bp, Homo sapiens
tctccagctgggctctgca

SEQ ID NO: 4906041 - DNA, 14 bp, Homo sapiens
tctccaggaccaat

SEQ ID NO: 4906042 - DNA, 11 bp, Homo sapiens
tctccaggctg

SEQ ID NO: 4906043 - DNA, 19 bp, Homo sapiens
tctccaggtctcacgggca

SEQ ID NO: 4906044 - DNA, 21 bp, Homo sapiens
tctccagtgctgtccatgctt

SEQ ID NO: 4906045 - DNA, 22 bp, Homo sapiens
tctcccaagctatctaaagttt

SEQ ID NO: 4906046 - DNA, 18 bp, Homo sapiens
tctcccactccagcgctg

SEQ ID NO: 4906047 - DNA, 18 bp, Homo sapiens
tctcccagaatcccagcc

SEQ ID NO: 4906048 - DNA, 19 bp, Homo sapiens
tctcccagaatcccagccg

SEQ ID NO: 4906049 - DNA, 20 bp, Homo sapiens
tctccccaacccccattctc

SEQ ID NO: 4906050 - DNA, 22 bp, Homo sapiens
tctccccaacccccattctcat

SEQ ID NO: 4906051 - DNA, 22 bp, Homo sapiens
tctccccaaccctaggttccct

SEQ ID NO: 4906052 - DNA, 11 bp, Homo sapiens
tctccccacac

SEQ ID NO: 4906053 - DNA, 14 bp, Homo sapiens
tctccccaccccta

SEQ ID NO: 4906054 - DNA, 14 bp, Homo sapiens
tctcccctgccctg

SEQ ID NO: 4906055 - DNA, 15 bp, Homo sapiens
tctcccctgccctgc

SEQ ID NO: 4906056 - DNA, 14 bp, Homo sapiens
tctcccgctgctgc

SEQ ID NO: 4906057 - DNA, 20 bp, Homo sapiens
tctcccggaggttgggtggg

SEQ ID NO: 4906058 - DNA, 15 bp, Homo sapiens
tctccctgccagagg

SEQ ID NO: 4906059 - DNA, 23 bp, Homo sapiens
tctccgaccagacaccttgacag

SEQ ID NO: 4906060 - DNA, 17 bp, Homo sapiens
tctcctctttaaaacaa

SEQ ID NO: 4906061 - DNA, 20 bp, Homo sapiens
tctcctctttaaaacaaaac

SEQ ID NO: 4906062 - DNA, 20 bp, Homo sapiens
tctcctgcctgtgctgtgac

SEQ ID NO: 4906063 - DNA, 19 bp, Homo sapiens
tctcctgtaagccaaagaa

SEQ ID NO: 4906064 - DNA, 19 bp, Homo sapiens
tctcctgtttattcccatc

SEQ ID NO: 4906065 - DNA, 20 bp, Homo sapiens
tctcctgtttattcccatct

SEQ ID NO: 4906066 - DNA, 14 bp, Homo sapiens
tctcctgtttttct

SEQ ID NO: 4906067 - DNA, 19 bp, Homo sapiens
tctccttcgtatcccgagt

SEQ ID NO: 4906068 - DNA, 13 bp, Homo sapiens
tctccttcttagc

SEQ ID NO: 4906069 - DNA, 22 bp, Homo sapiens
tctccttttcttttgttactgt

SEQ ID NO: 4906070 - DNA, 12 bp, Homo sapiens
tctcgtttttct

SEQ ID NO: 4906071 - DNA, 18 bp, Homo sapiens
tctctaacttattttatt

SEQ ID NO: 4906072 - DNA, 19 bp, Homo sapiens
tctctaattccatccataa

SEQ ID NO: 4906073 - DNA, 14 bp, Homo sapiens
tctctatttaatat

SEQ ID NO: 4906074 - DNA, 15 bp, Homo sapiens
tctctatttaatatt

SEQ ID NO: 4906075 - DNA, 17 bp, Homo sapiens
tctctatttaatattta

SEQ ID NO: 4906076 - DNA, 13 bp, Homo sapiens
tctctcaaatctg

SEQ ID NO: 4906077 - DNA, 15 bp, Homo sapiens
tctctccctgccaga

SEQ ID NO: 4906078 - DNA, 14 bp, Homo sapiens
tctctcctttgctg

SEQ ID NO: 4906079 - DNA, 15 bp, Homo sapiens
tctctctacagtgcc

SEQ ID NO: 4906080 - DNA, 14 bp, Homo sapiens
tctctctgcagctg

SEQ ID NO: 4906081 - DNA, 16 bp, Homo sapiens
tctctctgcagctgcc

SEQ ID NO: 4906082 - DNA, 14 bp, Homo sapiens
tctctcttctgctc

SEQ ID NO: 4906083 - DNA, 13 bp, Homo sapiens
tctctgaagcatg

SEQ ID NO: 4906084 - DNA, 14 bp, Homo sapiens
tctctgaagcatgt

SEQ ID NO: 4906085 - DNA, 16 bp, Homo sapiens
tctctgaagcatgttt

SEQ ID NO: 4906086 - DNA, 14 bp, Homo sapiens
tctctgaggacact

SEQ ID NO: 4906087 - DNA, 17 bp, Homo sapiens
tctctgaggacactaac

SEQ ID NO: 4906088 - DNA, 19 bp, Homo sapiens
tctctgattttcaaagctt

SEQ ID NO: 4906089 - DNA, 15 bp, Homo sapiens
tctctgcagctgccg

SEQ ID NO: 4906090 - DNA, 16 bp, Homo sapiens
tctctgcagctgccgg

SEQ ID NO: 4906091 - DNA, 11 bp, Homo sapiens
tctctgctcca

SEQ ID NO: 4906092 - DNA, 12 bp, Homo sapiens
tctctgctccac

SEQ ID NO: 4906093 - DNA, 22 bp, Homo sapiens
tctctgctcgccctcctttctg

SEQ ID NO: 4906094 - DNA, 12 bp, Homo sapiens
tctctgctggcc

SEQ ID NO: 4906095 - DNA, 15 bp, Homo sapiens
tctctgctggcccag

SEQ ID NO: 4906096 - DNA, 11 bp, Homo sapiens
tctctgctgta

SEQ ID NO: 4906097 - DNA, 22 bp, Homo sapiens
tctctggctgtaaggctctaga

SEQ ID NO: 4906098 - DNA, 23 bp, Homo sapiens
tctctggctgtaaggctctagat

SEQ ID NO: 4906099 - DNA, 16 bp, Homo sapiens
tctctgtataaacatt

SEQ ID NO: 4906100 - DNA, 11 bp, Homo sapiens
tctctgtgctt

SEQ ID NO: 4906101 - DNA, 15 bp, Homo sapiens
tctctgtgtctaaga

SEQ ID NO: 4906102 - DNA, 20 bp, Homo sapiens
tctctgtgtctaagattcta

SEQ ID NO: 4906103 - DNA, 23 bp, Homo sapiens
tctctgtgtctaagattctagat

SEQ ID NO: 4906104 - DNA, 17 bp, Homo sapiens
tctcttcagactctcag

SEQ ID NO: 4906105 - DNA, 14 bp, Homo sapiens
tctcttcatacttt

SEQ ID NO: 4906106 - DNA, 12 bp, Homo sapiens
tctcttcccttt

SEQ ID NO: 4906107 - DNA, 23 bp, Homo sapiens
tctcttccctttccccagcatca

SEQ ID NO: 4906108 - DNA, 11 bp, Homo sapiens
tctcttcctgt

SEQ ID NO: 4906109 - DNA, 13 bp, Homo sapiens
tctcttctccact

SEQ ID NO: 4906110 - DNA, 14 bp, Homo sapiens
tctcttctccactg

SEQ ID NO: 4906111 - DNA, 16 bp, Homo sapiens
tctcttctccactgga

SEQ ID NO: 4906112 - DNA, 14 bp, Homo sapiens
tctcttctcccaga

SEQ ID NO: 4906113 - DNA, 21 bp, Homo sapiens
tctcttctcccagaatcccag

SEQ ID NO: 4906114 - DNA, 13 bp, Homo sapiens
tctcttctgctcc

SEQ ID NO: 4906115 - DNA, 12 bp, Homo sapiens
tctcttcttcat

SEQ ID NO: 4906116 - DNA, 15 bp, Homo sapiens
tctcttcttgtttct

SEQ ID NO: 4906117 - DNA, 18 bp, Homo sapiens
tctcttcttttggcttcc

SEQ ID NO: 4906118 - DNA, 14 bp, Homo sapiens
tctcttgagctggc

SEQ ID NO: 4906119 - DNA, 16 bp, Homo sapiens
tctcttgagctggcct

SEQ ID NO: 4906120 - DNA, 22 bp, Homo sapiens
tctcttgccgaggagccaggca

SEQ ID NO: 4906121 - DNA, 13 bp, Homo sapiens
tctcttgctttct

SEQ ID NO: 4906122 - DNA, 22 bp, Homo sapiens
tctcttgtataagatcctagat

SEQ ID NO: 4906123 - DNA, 21 bp, Homo sapiens
tctctttaatgtcacaggcag

SEQ ID NO: 4906124 - DNA, 19 bp, Homo sapiens
tctctttctctcttccctc

SEQ ID NO: 4906125 - DNA, 20 bp, Homo sapiens
tctctttgtggggcttggcg

SEQ ID NO: 4906126 - DNA, 17 bp, Homo sapiens
tctcttttctcttttta

SEQ ID NO: 4906127 - DNA, 17 bp, Homo sapiens
tctcttttctgtacttc

SEQ ID NO: 4906128 - DNA, 18 bp, Homo sapiens
tctgaaataggaaacaag

SEQ ID NO: 4906129 - DNA, 14 bp, Homo sapiens
tctgaaatctcctt

SEQ ID NO: 4906130 - DNA, 16 bp, Homo sapiens
tctgaacacaggcagc

SEQ ID NO: 4906131 - DNA, 12 bp, Homo sapiens
tctgaagcatgt

SEQ ID NO: 4906132 - DNA, 14 bp, Homo sapiens
tctgaagcatgttt

SEQ ID NO: 4906133 - DNA, 21 bp, Homo sapiens
tctgaagcatgtttcatgttt

SEQ ID NO: 4906134 - DNA, 16 bp, Homo sapiens
tctgaagccctcccag

SEQ ID NO: 4906135 - DNA, 18 bp, Homo sapiens
tctgaagccctcccaggt

SEQ ID NO: 4906136 - DNA, 16 bp, Homo sapiens
tctgaagcctctggga

SEQ ID NO: 4906137 - DNA, 21 bp, Homo sapiens
tctgaaggacattgcggacag

SEQ ID NO: 4906138 - DNA, 17 bp, Homo sapiens
tctgaagtcacatcaca

SEQ ID NO: 4906139 - DNA, 23 bp, Homo sapiens
tctgaagtcacatcacaggacac

SEQ ID NO: 4906140 - DNA, 16 bp, Homo sapiens
tctgaatagaaatggg

SEQ ID NO: 4906141 - DNA, 17 bp, Homo sapiens
tctgacacacagctctg

SEQ ID NO: 4906142 - DNA, 18 bp, Homo sapiens
tctgacacacagctctgt

SEQ ID NO: 4906143 - DNA, 22 bp, Homo sapiens
tctgacattatgtggttttaga

SEQ ID NO: 4906144 - DNA, 17 bp, Homo sapiens
tctgacccctcctcact

SEQ ID NO: 4906145 - DNA, 18 bp, Homo sapiens
tctgacccctcctcactg

SEQ ID NO: 4906146 - DNA, 13 bp, Homo sapiens
tctgactaattag

SEQ ID NO: 4906147 - DNA, 15 bp, Homo sapiens
tctgactaattaggc

SEQ ID NO: 4906148 - DNA, 14 bp, Homo sapiens
tctgagaagaggag

SEQ ID NO: 4906149 - DNA, 13 bp, Homo sapiens
tctgagactcaca

SEQ ID NO: 4906150 - DNA, 15 bp, Homo sapiens
tctgagagtctagat

SEQ ID NO: 4906151 - DNA, 18 bp, Homo sapiens
tctgagagtctagattct

SEQ ID NO: 4906152 - DNA, 22 bp, Homo sapiens
tctgagagtctagattctctgg

SEQ ID NO: 4906153 - DNA, 15 bp, Homo sapiens
tctgagccacagcag

SEQ ID NO: 4906154 - DNA, 20 bp, Homo sapiens
tctgagccacagcagcattt

SEQ ID NO: 4906155 - DNA, 12 bp, Homo sapiens
tctgagcccatg

SEQ ID NO: 4906156 - DNA, 17 bp, Homo sapiens
tctgaggaatccagacc

SEQ ID NO: 4906157 - DNA, 21 bp, Homo sapiens
tctgaggaatccagacccggc

SEQ ID NO: 4906158 - DNA, 22 bp, Homo sapiens
tctgaggaatccagacccggct

SEQ ID NO: 4906159 - DNA, 14 bp, Homo sapiens
tctgatatgggact

SEQ ID NO: 4906160 - DNA, 21 bp, Homo sapiens
tctgatatgggactgagcctg

SEQ ID NO: 4906161 - DNA, 21 bp, Homo sapiens
tctgatcatccactgtgccat

SEQ ID NO: 4906162 - DNA, 19 bp, Homo sapiens
tctgatggaccttctagaa

SEQ ID NO: 4906163 - DNA, 21 bp, Homo sapiens
tctgattagctttgtgtttgg

SEQ ID NO: 4906164 - DNA, 13 bp, Homo sapiens
tctgattggcttg

SEQ ID NO: 4906165 - DNA, 22 bp, Homo sapiens
tctgattggcttgtagaattgt

SEQ ID NO: 4906166 - DNA, 20 bp, Homo sapiens
tctgcaagcacatctgcatt

SEQ ID NO: 4906167 - DNA, 17 bp, Homo sapiens
tctgcaaggtctttggt

SEQ ID NO: 4906168 - DNA, 21 bp, Homo sapiens
tctgcaatgggcactgggatg

SEQ ID NO: 4906169 - DNA, 14 bp, Homo sapiens
tctgcaattcaaaa

SEQ ID NO: 4906170 - DNA, 23 bp, Homo sapiens
tctgcaattcaaaagttccaaga

SEQ ID NO: 4906171 - DNA, 18 bp, Homo sapiens
tctgcaattcccctctgc

SEQ ID NO: 4906172 - DNA, 22 bp, Homo sapiens
tctgcaattcccctctgctgct

SEQ ID NO: 4906173 - DNA, 12 bp, Homo sapiens
tctgcacatgaa

SEQ ID NO: 4906174 - DNA, 16 bp, Homo sapiens
tctgcacatgtcttgt

SEQ ID NO: 4906175 - DNA, 19 bp, Homo sapiens
tctgcacatgtcttgtaca

SEQ ID NO: 4906176 - DNA, 12 bp, Homo sapiens
tctgcactgaaa

SEQ ID NO: 4906177 - DNA, 23 bp, Homo sapiens
tctgcagacacgccttcccctca

SEQ ID NO: 4906178 - DNA, 15 bp, Homo sapiens
tctgcagactgctag

SEQ ID NO: 4906179 - DNA, 14 bp, Homo sapiens
tctgcagctgccgg

SEQ ID NO: 4906180 - DNA, 19 bp, Homo sapiens
tctgcatatgttgaatact

SEQ ID NO: 4906181 - DNA, 21 bp, Homo sapiens
tctgcatatgttgaatacttt

SEQ ID NO: 4906182 - DNA, 18 bp, Homo sapiens
tctgcatctcctgtcttt

SEQ ID NO: 4906183 - DNA, 15 bp, Homo sapiens
tctgccaccagagac

SEQ ID NO: 4906184 - DNA, 20 bp, Homo sapiens
tctgccagaagatcccctca

SEQ ID NO: 4906185 - DNA, 12 bp, Homo sapiens
tctgccagggca

SEQ ID NO: 4906186 - DNA, 13 bp, Homo sapiens
tctgccagggcag

SEQ ID NO: 4906187 - DNA, 18 bp, Homo sapiens
tctgcccaattggaggaa

SEQ ID NO: 4906188 - DNA, 15 bp, Homo sapiens
tctgcccccagccca

SEQ ID NO: 4906189 - DNA, 19 bp, Homo sapiens
tctgcccccagcccaaagg

SEQ ID NO: 4906190 - DNA, 16 bp, Homo sapiens
tctgcccctcccccaa

SEQ ID NO: 4906191 - DNA, 10 bp, Homo sapiens
tctgcccggg

SEQ ID NO: 4906192 - DNA, 23 bp, Homo sapiens
tctgcccgggaaggtcaccagca

SEQ ID NO: 4906193 - DNA, 18 bp, Homo sapiens
tctgccctcattactggg

SEQ ID NO: 4906194 - DNA, 21 bp, Homo sapiens
tctgccctcattactgggcct

SEQ ID NO: 4906195 - DNA, 16 bp, Homo sapiens
tctgcccttcacccca

SEQ ID NO: 4906196 - DNA, 18 bp, Homo sapiens
tctgccgccccctcctga

SEQ ID NO: 4906197 - DNA, 15 bp, Homo sapiens
tctgcctctgacaca

SEQ ID NO: 4906198 - DNA, 19 bp, Homo sapiens
tctgcctgaagtcacacag

SEQ ID NO: 4906199 - DNA, 20 bp, Homo sapiens
tctgcctgaagtcacacagt

SEQ ID NO: 4906200 - DNA, 14 bp, Homo sapiens
tctgcctgcccagg

SEQ ID NO: 4906201 - DNA, 17 bp, Homo sapiens
tctgcctgcccaggccc

SEQ ID NO: 4906202 - DNA, 14 bp, Homo sapiens
tctgcctgtctccc

SEQ ID NO: 4906203 - DNA, 13 bp, Homo sapiens
tctgccttagagg

SEQ ID NO: 4906204 - DNA, 16 bp, Homo sapiens
tctgccttagaggagc

SEQ ID NO: 4906205 - DNA, 10 bp, Homo sapiens
tctgcctttg

SEQ ID NO: 4906206 - DNA, 20 bp, Homo sapiens
tctgcctttgacatttaatt

SEQ ID NO: 4906207 - DNA, 23 bp, Homo sapiens
tctgcctttgacatttaatttag

SEQ ID NO: 4906208 - DNA, 16 bp, Homo sapiens
tctgcggaccccagct

SEQ ID NO: 4906209 - DNA, 22 bp, Homo sapiens
tctgcggaccccagctgtgagc

SEQ ID NO: 4906210 - DNA, 17 bp, Homo sapiens
tctgctcacatatctgt

SEQ ID NO: 4906211 - DNA, 13 bp, Homo sapiens
tctgctcagccaa

SEQ ID NO: 4906212 - DNA, 17 bp, Homo sapiens
tctgctcagccaagctt

SEQ ID NO: 4906213 - DNA, 10 bp, Homo sapiens
tctgctccac

SEQ ID NO: 4906214 - DNA, 18 bp, Homo sapiens
tctgctcctctccccagc

SEQ ID NO: 4906215 - DNA, 13 bp, Homo sapiens
tctgctgaaggaa

SEQ ID NO: 4906216 - DNA, 19 bp, Homo sapiens
tctgctgacagacacaggc

SEQ ID NO: 4906217 - DNA, 17 bp, Homo sapiens
tctgctgcctgcccgca

SEQ ID NO: 4906218 - DNA, 23 bp, Homo sapiens
tctgctgcctgcccgcacagcag

SEQ ID NO: 4906219 - DNA, 18 bp, Homo sapiens
tctgctgctgtccctccc

SEQ ID NO: 4906220 - DNA, 14 bp, Homo sapiens
tctgctggcccagc

SEQ ID NO: 4906221 - DNA, 20 bp, Homo sapiens
tctgctggcccagccaaacc

SEQ ID NO: 4906222 - DNA, 18 bp, Homo sapiens
tctgcttcaataaatctt

SEQ ID NO: 4906223 - DNA, 14 bp, Homo sapiens
tctgcttcagcctc

SEQ ID NO: 4906224 - DNA, 15 bp, Homo sapiens
tctgcttcagcctcc

SEQ ID NO: 4906225 - DNA, 13 bp, Homo sapiens
tctgcttctctca

SEQ ID NO: 4906226 - DNA, 16 bp, Homo sapiens
tctgcttctctcacct

SEQ ID NO: 4906227 - DNA, 18 bp, Homo sapiens
tctgctttaaagggcctg

SEQ ID NO: 4906228 - DNA, 22 bp, Homo sapiens
tctgctttaaagggcctgcctg

SEQ ID NO: 4906229 - DNA, 13 bp, Homo sapiens
tctgcttttatta

SEQ ID NO: 4906230 - DNA, 19 bp, Homo sapiens
tctggaaaagaactgttta

SEQ ID NO: 4906231 - DNA, 20 bp, Homo sapiens
tctggaaacctctacatatt

SEQ ID NO: 4906232 - DNA, 14 bp, Homo sapiens
tctggaatacatga

SEQ ID NO: 4906233 - DNA, 22 bp, Homo sapiens
tctggaatacatgaaatataga

SEQ ID NO: 4906234 - DNA, 21 bp, Homo sapiens
tctggacaggcatgttctctg

SEQ ID NO: 4906235 - DNA, 15 bp, Homo sapiens
tctggactctaaaga

SEQ ID NO: 4906236 - DNA, 17 bp, Homo sapiens
tctggactgacagcatg

SEQ ID NO: 4906237 - DNA, 14 bp, Homo sapiens
tctggactggctag

SEQ ID NO: 4906238 - DNA, 22 bp, Homo sapiens
tctggagacagccccagagcag

SEQ ID NO: 4906239 - DNA, 15 bp, Homo sapiens
tctggagaccaggga

SEQ ID NO: 4906240 - DNA, 20 bp, Homo sapiens
tctggagaccagggagcctt

SEQ ID NO: 4906241 - DNA, 21 bp, Homo sapiens
tctggagccctaaccccttcc

SEQ ID NO: 4906242 - DNA, 19 bp, Homo sapiens
tctggaggccttccagctg

SEQ ID NO: 4906243 - DNA, 23 bp, Homo sapiens
tctggaggccttccagctgctgt

SEQ ID NO: 4906244 - DNA, 18 bp, Homo sapiens
tctggcattagaattatt

SEQ ID NO: 4906245 - DNA, 16 bp, Homo sapiens
tctggcctggcctggc

SEQ ID NO: 4906246 - DNA, 21 bp, Homo sapiens
tctggcctggcctggccctgc

SEQ ID NO: 4906247 - DNA, 23 bp, Homo sapiens
tctggcctggcctggccctgccc

SEQ ID NO: 4906248 - DNA, 17 bp, Homo sapiens
tctggctagaggccagc

SEQ ID NO: 4906249 - DNA, 17 bp, Homo sapiens
tctggctcctttacaaa

SEQ ID NO: 4906250 - DNA, 14 bp, Homo sapiens
tctggctgaaaaag

SEQ ID NO: 4906251 - DNA, 21 bp, Homo sapiens
tctggctgtaaggctctagat

SEQ ID NO: 4906252 - DNA, 15 bp, Homo sapiens
tctgggaacctccca

SEQ ID NO: 4906253 - DNA, 20 bp, Homo sapiens
tctgggaacctcccagaggt

SEQ ID NO: 4906254 - DNA, 18 bp, Homo sapiens
tctgggccccctcctccc

SEQ ID NO: 4906255 - DNA, 12 bp, Homo sapiens
tctgggcctggg

SEQ ID NO: 4906256 - DNA, 13 bp, Homo sapiens
tctgggcctgggc

SEQ ID NO: 4906257 - DNA, 22 bp, Homo sapiens
tctggggaaagacactgcctgg

SEQ ID NO: 4906258 - DNA, 17 bp, Homo sapiens
tctggggcaggctgggc

SEQ ID NO: 4906259 - DNA, 18 bp, Homo sapiens
tctggggcaggctgggcc

SEQ ID NO: 4906260 - DNA, 20 bp, Homo sapiens
tctggggcaggctgggccat

SEQ ID NO: 4906261 - DNA, 21 bp, Homo sapiens
tctggggcaggctgggccatg

SEQ ID NO: 4906262 - DNA, 19 bp, Homo sapiens
tctggggtgctgcctgaat

SEQ ID NO: 4906263 - DNA, 13 bp, Homo sapiens
tctggtcccttgc

SEQ ID NO: 4906264 - DNA, 13 bp, Homo sapiens
tctggtgcctcca

SEQ ID NO: 4906265 - DNA, 13 bp, Homo sapiens
tctggttctgatg

SEQ ID NO: 4906266 - DNA, 15 bp, Homo sapiens
tctggttttaacaat

SEQ ID NO: 4906267 - DNA, 19 bp, Homo sapiens
tctgtaaaaacactgaaaa

SEQ ID NO: 4906268 - DNA, 21 bp, Homo sapiens
tctgtaaataccattgacaca

SEQ ID NO: 4906269 - DNA, 22 bp, Homo sapiens
tctgtaaataccattgacacat

SEQ ID NO: 4906270 - DNA, 22 bp, Homo sapiens
tctgtacattttgttgtaaaaa

SEQ ID NO: 4906271 - DNA, 18 bp, Homo sapiens
tctgtagagccttctgat

SEQ ID NO: 4906272 - DNA, 15 bp, Homo sapiens
tctgtagtcatttac

SEQ ID NO: 4906273 - DNA, 19 bp, Homo sapiens
tctgtagtcatttactaaa

SEQ ID NO: 4906274 - DNA, 15 bp, Homo sapiens
tctgtatatactttt

SEQ ID NO: 4906275 - DNA, 13 bp, Homo sapiens
tctgtatttcatg

SEQ ID NO: 4906276 - DNA, 15 bp, Homo sapiens
tctgtatttcatgtg

SEQ ID NO: 4906277 - DNA, 18 bp, Homo sapiens
tctgtcaaaacactgtgg

SEQ ID NO: 4906278 - DNA, 20 bp, Homo sapiens
tctgtcaaaacactgtggaa

SEQ ID NO: 4906279 - DNA, 13 bp, Homo sapiens
tctgtcaagaaga

SEQ ID NO: 4906280 - DNA, 18 bp, Homo sapiens
tctgtcagaatgctattg

SEQ ID NO: 4906281 - DNA, 18 bp, Homo sapiens
tctgtcagatgagaacaa

SEQ ID NO: 4906282 - DNA, 23 bp, Homo sapiens
tctgtcatttgagcagggctcag

SEQ ID NO: 4906283 - DNA, 13 bp, Homo sapiens
tctgtcatttgtt

SEQ ID NO: 4906284 - DNA, 16 bp, Homo sapiens
tctgtccaaaggaggc

SEQ ID NO: 4906285 - DNA, 19 bp, Homo sapiens
tctgtccaaaggaggctgg

SEQ ID NO: 4906286 - DNA, 24 bp, Homo sapiens
tctgtccaggcactgctgcccagc

SEQ ID NO: 4906287 - DNA, 20 bp, Homo sapiens
tctgtcctactctgtgtcag

SEQ ID NO: 4906288 - DNA, 15 bp, Homo sapiens
tctgtcctgcttctg

SEQ ID NO: 4906289 - DNA, 16 bp, Homo sapiens
tctgtcgcccagtctg

SEQ ID NO: 4906290 - DNA, 17 bp, Homo sapiens
tctgtcgcccagtctgg

SEQ ID NO: 4906291 - DNA, 17 bp, Homo sapiens
tctgtctaaaaaccaga

SEQ ID NO: 4906292 - DNA, 20 bp, Homo sapiens
tctgtctcatcctcctggaa

SEQ ID NO: 4906293 - DNA, 22 bp, Homo sapiens
tctgtctgcccttcaccccagt

SEQ ID NO: 4906294 - DNA, 14 bp, Homo sapiens
tctgtcttcacagc

SEQ ID NO: 4906295 - DNA, 14 bp, Homo sapiens
tctgtgaaacctgt

SEQ ID NO: 4906296 - DNA, 20 bp, Homo sapiens
tctgtgaaatgctggcattt

SEQ ID NO: 4906297 - DNA, 15 bp, Homo sapiens
tctgtgacctcaggc

SEQ ID NO: 4906298 - DNA, 17 bp, Homo sapiens
tctgtgaggaaagcaca

SEQ ID NO: 4906299 - DNA, 14 bp, Homo sapiens
tctgtgatcattta

SEQ ID NO: 4906300 - DNA, 20 bp, Homo sapiens
tctgtgatcttttaaagtgt

SEQ ID NO: 4906301 - DNA, 17 bp, Homo sapiens
tctgtgccccatgcctg

SEQ ID NO: 4906302 - DNA, 14 bp, Homo sapiens
tctgtgctcctcct

SEQ ID NO: 4906303 - DNA, 19 bp, Homo sapiens
tctgtggatgccagggccg

SEQ ID NO: 4906304 - DNA, 14 bp, Homo sapiens
tctgtgtatattat

SEQ ID NO: 4906305 - DNA, 22 bp, Homo sapiens
tctgtgtcaggtggggcagctt

SEQ ID NO: 4906306 - DNA, 15 bp, Homo sapiens
tctgtgtccttccct

SEQ ID NO: 4906307 - DNA, 23 bp, Homo sapiens
tctgtgtctaagattctagatca

SEQ ID NO: 4906308 - DNA, 11 bp, Homo sapiens
tctgtgtcttt

SEQ ID NO: 4906309 - DNA, 13 bp, Homo sapiens
tctgtgtgaatgt

SEQ ID NO: 4906310 - DNA, 20 bp, Homo sapiens
tctgtgtgatgaactttctc

SEQ ID NO: 4906311 - DNA, 22 bp, Homo sapiens
tctgtgttgcattattcattta

SEQ ID NO: 4906312 - DNA, 18 bp, Homo sapiens
tctgtgtttaatttcttc

SEQ ID NO: 4906313 - DNA, 20 bp, Homo sapiens
tctgttaaaatctattctgt

SEQ ID NO: 4906314 - DNA, 20 bp, Homo sapiens
tctgttagctgggtttacat

SEQ ID NO: 4906315 - DNA, 14 bp, Homo sapiens
tctgttatgtactg

SEQ ID NO: 4906316 - DNA, 15 bp, Homo sapiens
tctgttattaacaaa

SEQ ID NO: 4906317 - DNA, 19 bp, Homo sapiens
tctgttcacttttcctccc

SEQ ID NO: 4906318 - DNA, 21 bp, Homo sapiens
tctgttcacttttcctccctc

SEQ ID NO: 4906319 - DNA, 14 bp, Homo sapiens
tctgttcttgctac

SEQ ID NO: 4906320 - DNA, 15 bp, Homo sapiens
tctgttgcaattagg

SEQ ID NO: 4906321 - DNA, 22 bp, Homo sapiens
tctgttgccacccaggtgatgt

SEQ ID NO: 4906322 - DNA, 18 bp, Homo sapiens
tctgttggattccatgct

SEQ ID NO: 4906323 - DNA, 18 bp, Homo sapiens
tctgttggccagtgtgac

SEQ ID NO: 4906324 - DNA, 20 bp, Homo sapiens
tctgttggccagtgtgacaa

SEQ ID NO: 4906325 - DNA, 16 bp, Homo sapiens
tctgttgtaacttatg

SEQ ID NO: 4906326 - DNA, 14 bp, Homo sapiens
tctgttgtgtgtca

SEQ ID NO: 4906327 - DNA, 12 bp, Homo sapiens
tctgtttcaagg

SEQ ID NO: 4906328 - DNA, 16 bp, Homo sapiens
tctgtttgattctttt

SEQ ID NO: 4906329 - DNA, 16 bp, Homo sapiens
tcttaaacttgtgaat

SEQ ID NO: 4906330 - DNA, 16 bp, Homo sapiens
tcttaaagaaacagct

SEQ ID NO: 4906331 - DNA, 23 bp, Homo sapiens
tcttaaagaaacagctttcaagt

SEQ ID NO: 4906332 - DNA, 20 bp, Homo sapiens
tcttaaagctgcctgtagtt

SEQ ID NO: 4906333 - DNA, 21 bp, Homo sapiens
tcttaaagctgcctgtagtta

SEQ ID NO: 4906334 - DNA, 15 bp, Homo sapiens
tcttaaatatctttt

SEQ ID NO: 4906335 - DNA, 15 bp, Homo sapiens
tcttaattaatttga

SEQ ID NO: 4906336 - DNA, 12 bp, Homo sapiens
tcttaattatta

SEQ ID NO: 4906337 - DNA, 23 bp, Homo sapiens
tcttacactgcctgtatacttta

SEQ ID NO: 4906338 - DNA, 21 bp, Homo sapiens
tcttacctgtatgtctccagt

SEQ ID NO: 4906339 - DNA, 21 bp, Homo sapiens
tcttactaatgtaaaatgatt

SEQ ID NO: 4906340 - DNA, 19 bp, Homo sapiens
tcttactcctcctctttct

SEQ ID NO: 4906341 - DNA, 20 bp, Homo sapiens
tcttactcctcctctttctc

SEQ ID NO: 4906342 - DNA, 17 bp, Homo sapiens
tcttacttgagccttta

SEQ ID NO: 4906343 - DNA, 13 bp, Homo sapiens
tcttagaaatgaa

SEQ ID NO: 4906344 - DNA, 14 bp, Homo sapiens
tcttagaaatgaag

SEQ ID NO: 4906345 - DNA, 14 bp, Homo sapiens
tcttagactacatt

SEQ ID NO: 4906346 - DNA, 12 bp, Homo sapiens
tcttagattctc

SEQ ID NO: 4906347 - DNA, 20 bp, Homo sapiens
tcttagctatcattgcttcc

SEQ ID NO: 4906348 - DNA, 18 bp, Homo sapiens
tcttagctgtctgctcag

SEQ ID NO: 4906349 - DNA, 18 bp, Homo sapiens
tcttagctttttaattgt

SEQ ID NO: 4906350 - DNA, 16 bp, Homo sapiens
tcttagtttggattct

SEQ ID NO: 4906351 - DNA, 19 bp, Homo sapiens
tcttataatactctgttgt

SEQ ID NO: 4906352 - DNA, 17 bp, Homo sapiens
tcttatagcactttgaa

SEQ ID NO: 4906353 - DNA, 18 bp, Homo sapiens
tcttatagcactttgaaa

SEQ ID NO: 4906354 - DNA, 17 bp, Homo sapiens
tcttatagttctaggca

SEQ ID NO: 4906355 - DNA, 12 bp, Homo sapiens
tcttatatagca

SEQ ID NO: 4906356 - DNA, 17 bp, Homo sapiens
tcttatgcaaaatggaa

SEQ ID NO: 4906357 - DNA, 17 bp, Homo sapiens
tcttatgcttataatat

SEQ ID NO: 4906358 - DNA, 21 bp, Homo sapiens
tcttatggaattgatttgcat

SEQ ID NO: 4906359 - DNA, 15 bp, Homo sapiens
tcttcaaaaactgtt

SEQ ID NO: 4906360 - DNA, 17 bp, Homo sapiens
tcttcaaaatgtatata

SEQ ID NO: 4906361 - DNA, 20 bp, Homo sapiens
tcttcaaaatgtatatattt

SEQ ID NO: 4906362 - DNA, 13 bp, Homo sapiens
tcttcaaatcctt

SEQ ID NO: 4906363 - DNA, 19 bp, Homo sapiens
tcttcaaatccttccaaaa

SEQ ID NO: 4906364 - DNA, 22 bp, Homo sapiens
tcttcaacataacccacttgtc

SEQ ID NO: 4906365 - DNA, 19 bp, Homo sapiens
tcttcaacatcctgccagc

SEQ ID NO: 4906366 - DNA, 22 bp, Homo sapiens
tcttcaccccggcaggccctgc

SEQ ID NO: 4906367 - DNA, 18 bp, Homo sapiens
tcttcagactctcagccc

SEQ ID NO: 4906368 - DNA, 20 bp, Homo sapiens
tcttcagactctcagcccag

SEQ ID NO: 4906369 - DNA, 14 bp, Homo sapiens
tcttcaggcctccc

SEQ ID NO: 4906370 - DNA, 15 bp, Homo sapiens
tcttcaggcctccct

SEQ ID NO: 4906371 - DNA, 22 bp, Homo sapiens
tcttcagttggttgtgtctttt

SEQ ID NO: 4906372 - DNA, 20 bp, Homo sapiens
tcttcataaagtacttgagt

SEQ ID NO: 4906373 - DNA, 21 bp, Homo sapiens
tcttcatattctaaaaccatt

SEQ ID NO: 4906374 - DNA, 22 bp, Homo sapiens
tcttcatttcattgtatgatgt

SEQ ID NO: 4906375 - DNA, 19 bp, Homo sapiens
tcttccatgtatcttttga

SEQ ID NO: 4906376 - DNA, 17 bp, Homo sapiens
tcttccctttccccagc

SEQ ID NO: 4906377 - DNA, 21 bp, Homo sapiens
tcttcctagttttctcctccc

SEQ ID NO: 4906378 - DNA, 21 bp, Homo sapiens
tcttcctatttgccatgggct

SEQ ID NO: 4906379 - DNA, 13 bp, Homo sapiens
tcttcctccagct

SEQ ID NO: 4906380 - DNA, 15 bp, Homo sapiens
tcttcctccagctgc

SEQ ID NO: 4906381 - DNA, 14 bp, Homo sapiens
tcttcctctgctga

SEQ ID NO: 4906382 - DNA, 11 bp, Homo sapiens
tcttcctgccc

SEQ ID NO: 4906383 - DNA, 13 bp, Homo sapiens
tcttcctttactt

SEQ ID NO: 4906384 - DNA, 16 bp, Homo sapiens
tcttcctttactttcc

SEQ ID NO: 4906385 - DNA, 23 bp, Homo sapiens
tcttcgcgcccgcccctgcagca

SEQ ID NO: 4906386 - DNA, 23 bp, Homo sapiens
tcttcggccctcagatgtccctt

SEQ ID NO: 4906387 - DNA, 14 bp, Homo sapiens
tcttctcaagttct

SEQ ID NO: 4906388 - DNA, 17 bp, Homo sapiens
tcttctcaagttctaag

SEQ ID NO: 4906389 - DNA, 18 bp, Homo sapiens
tcttctcaagttctaaga

SEQ ID NO: 4906390 - DNA, 21 bp, Homo sapiens
tcttctcaagttctaagattc

SEQ ID NO: 4906391 - DNA, 23 bp, Homo sapiens
tcttctccagatttttcggaggc

SEQ ID NO: 4906392 - DNA, 13 bp, Homo sapiens
tcttctccaggct

SEQ ID NO: 4906393 - DNA, 16 bp, Homo sapiens
tcttctcccagaatcc

SEQ ID NO: 4906394 - DNA, 14 bp, Homo sapiens
tcttctgacaaact

SEQ ID NO: 4906395 - DNA, 22 bp, Homo sapiens
tcttctgacaaactgtgtacat

SEQ ID NO: 4906396 - DNA, 17 bp, Homo sapiens
tcttctgcgcctcaggc

SEQ ID NO: 4906397 - DNA, 17 bp, Homo sapiens
tcttctgctccaccctt

SEQ ID NO: 4906398 - DNA, 12 bp, Homo sapiens
tcttctgcttca

SEQ ID NO: 4906399 - DNA, 15 bp, Homo sapiens
tcttctgtacgtctg

SEQ ID NO: 4906400 - DNA, 20 bp, Homo sapiens
tcttctgtacgtctgacagg

SEQ ID NO: 4906401 - DNA, 23 bp, Homo sapiens
tcttctgtacgtctgacaggcaa

SEQ ID NO: 4906402 - DNA, 14 bp, Homo sapiens
tcttcttgtttctc

SEQ ID NO: 4906403 - DNA, 15 bp, Homo sapiens
tcttcttgtttctcc

SEQ ID NO: 4906404 - DNA, 17 bp, Homo sapiens
tcttctttttttgtgat

SEQ ID NO: 4906405 - DNA, 23 bp, Homo sapiens
tcttgaaagattcaggtatgttg

SEQ ID NO: 4906406 - DNA, 21 bp, Homo sapiens
tcttgaaattaagaaggcaaa

SEQ ID NO: 4906407 - DNA, 22 bp, Homo sapiens
tcttgaaattaagaaggcaaaa

SEQ ID NO: 4906408 - DNA, 12 bp, Homo sapiens
tcttgaactcct

SEQ ID NO: 4906409 - DNA, 15 bp, Homo sapiens
tcttgaactcctggc

SEQ ID NO: 4906410 - DNA, 16 bp, Homo sapiens
tcttgaagggcccagg

SEQ ID NO: 4906411 - DNA, 12 bp, Homo sapiens
tcttgaatgtgg

SEQ ID NO: 4906412 - DNA, 12 bp, Homo sapiens
tcttgagctggc

SEQ ID NO: 4906413 - DNA, 14 bp, Homo sapiens
tcttgagctggcct

SEQ ID NO: 4906414 - DNA, 17 bp, Homo sapiens
tcttgagctggcctctc

SEQ ID NO: 4906415 - DNA, 17 bp, Homo sapiens
tcttgatacccccctct

SEQ ID NO: 4906416 - DNA, 21 bp, Homo sapiens
tcttgatacccccctctgtct

SEQ ID NO: 4906417 - DNA, 14 bp, Homo sapiens
tcttgattatccat

SEQ ID NO: 4906418 - DNA, 23 bp, Homo sapiens
tcttgattatccatattgagtca

SEQ ID NO: 4906419 - DNA, 16 bp, Homo sapiens
tcttgcaagcatgctt

SEQ ID NO: 4906420 - DNA, 17 bp, Homo sapiens
tcttgcaatggcagcct

SEQ ID NO: 4906421 - DNA, 18 bp, Homo sapiens
tcttgcaatggcagcctt

SEQ ID NO: 4906422 - DNA, 22 bp, Homo sapiens
tcttgcaatggcagccttggca

SEQ ID NO: 4906423 - DNA, 16 bp, Homo sapiens
tcttgcatccttccta

SEQ ID NO: 4906424 - DNA, 23 bp, Homo sapiens
tcttgcatccttcctataacttg

SEQ ID NO: 4906425 - DNA, 17 bp, Homo sapiens
tcttgccgaggagccag

SEQ ID NO: 4906426 - DNA, 20 bp, Homo sapiens
tcttgcgaatccaagctccc

SEQ ID NO: 4906427 - DNA, 15 bp, Homo sapiens
tcttgctctgctgac

SEQ ID NO: 4906428 - DNA, 10 bp, Homo sapiens
tcttgctgct

SEQ ID NO: 4906429 - DNA, 13 bp, Homo sapiens
tcttgctgctaga

SEQ ID NO: 4906430 - DNA, 13 bp, Homo sapiens
tcttgctgtctct

SEQ ID NO: 4906431 - DNA, 17 bp, Homo sapiens
tcttgctgtctctgctc

SEQ ID NO: 4906432 - DNA, 19 bp, Homo sapiens
tcttgctgtctctgctcgc

SEQ ID NO: 4906433 - DNA, 13 bp, Homo sapiens
tcttgcttgtacc

SEQ ID NO: 4906434 - DNA, 13 bp, Homo sapiens
tcttgctttctat

SEQ ID NO: 4906435 - DNA, 18 bp, Homo sapiens
tcttggaagtacatgaat

SEQ ID NO: 4906436 - DNA, 17 bp, Homo sapiens
tcttggagaccctgcaa

SEQ ID NO: 4906437 - DNA, 17 bp, Homo sapiens
tcttggcaaaagccttg

SEQ ID NO: 4906438 - DNA, 19 bp, Homo sapiens
tcttggcttactgcagcct

SEQ ID NO: 4906439 - DNA, 14 bp, Homo sapiens
tcttggtaagaagc

SEQ ID NO: 4906440 - DNA, 19 bp, Homo sapiens
tcttgtacatgtgtagcct

SEQ ID NO: 4906441 - DNA, 14 bp, Homo sapiens
tcttgtcagacata

SEQ ID NO: 4906442 - DNA, 19 bp, Homo sapiens
tcttgtcagacataaagcc

SEQ ID NO: 4906443 - DNA, 23 bp, Homo sapiens
tcttgtcccacgtgtcttccact

SEQ ID NO: 4906444 - DNA, 17 bp, Homo sapiens
tcttgtcctcagtccat

SEQ ID NO: 4906445 - DNA, 14 bp, Homo sapiens
tcttgtgaaatggc

SEQ ID NO: 4906446 - DNA, 17 bp, Homo sapiens
tcttgtgctagaatact

SEQ ID NO: 4906447 - DNA, 18 bp, Homo sapiens
tcttgtgctagaatactt

SEQ ID NO: 4906448 - DNA, 23 bp, Homo sapiens
tcttgtgctagaatactttttaa

SEQ ID NO: 4906449 - DNA, 21 bp, Homo sapiens
tcttgtgcttttcctatttgt

SEQ ID NO: 4906450 - DNA, 19 bp, Homo sapiens
tcttgtgtgattaacttat

SEQ ID NO: 4906451 - DNA, 13 bp, Homo sapiens
tcttgtttattga

SEQ ID NO: 4906452 - DNA, 13 bp, Homo sapiens
tcttgtttctcca

SEQ ID NO: 4906453 - DNA, 22 bp, Homo sapiens
tcttgtttcttttcacatagct

SEQ ID NO: 4906454 - DNA, 22 bp, Homo sapiens
tcttgttttgtttgtctctcct

SEQ ID NO: 4906455 - DNA, 15 bp, Homo sapiens
tcttgtttttattaa

SEQ ID NO: 4906456 - DNA, 12 bp, Homo sapiens
tctttaaaacaa

SEQ ID NO: 4906457 - DNA, 17 bp, Homo sapiens
tctttaaaagagagaga

SEQ ID NO: 4906458 - DNA, 11 bp, Homo sapiens
tctttaacttt

SEQ ID NO: 4906459 - DNA, 18 bp, Homo sapiens
tctttaagggcatgcctt

SEQ ID NO: 4906460 - DNA, 20 bp, Homo sapiens
tctttaagggcatgccttgt

SEQ ID NO: 4906461 - DNA, 23 bp, Homo sapiens
tctttaatcattttgcctctttt

SEQ ID NO: 4906462 - DNA, 15 bp, Homo sapiens
tctttaatgtcacag

SEQ ID NO: 4906463 - DNA, 16 bp, Homo sapiens
tctttatactgtaatt

SEQ ID NO: 4906464 - DNA, 15 bp, Homo sapiens
tctttatagtgcaca

SEQ ID NO: 4906465 - DNA, 12 bp, Homo sapiens
tctttcaaactc

SEQ ID NO: 4906466 - DNA, 23 bp, Homo sapiens
tctttcacattgtttgctgctat

SEQ ID NO: 4906467 - DNA, 22 bp, Homo sapiens
tctttcagattttttgaaccat

SEQ ID NO: 4906468 - DNA, 23 bp, Homo sapiens
tctttctacaaagcactagagaa

SEQ ID NO: 4906469 - DNA, 16 bp, Homo sapiens
tctttctagtggtctt

SEQ ID NO: 4906470 - DNA, 21 bp, Homo sapiens
tctttctagtggtctttgtaa

SEQ ID NO: 4906471 - DNA, 21 bp, Homo sapiens
tctttctccttgaatatcttt

SEQ ID NO: 4906472 - DNA, 10 bp, Homo sapiens
tctttctctc

SEQ ID NO: 4906473 - DNA, 12 bp, Homo sapiens
tctttctctcag

SEQ ID NO: 4906474 - DNA, 21 bp, Homo sapiens
tctttctctcagccttacatt

SEQ ID NO: 4906475 - DNA, 12 bp, Homo sapiens
tctttctctccc

SEQ ID NO: 4906476 - DNA, 14 bp, Homo sapiens
tctttctctcccca

SEQ ID NO: 4906477 - DNA, 17 bp, Homo sapiens
tctttctctcttccctc

SEQ ID NO: 4906478 - DNA, 18 bp, Homo sapiens
tctttctctcttccctca

SEQ ID NO: 4906479 - DNA, 12 bp, Homo sapiens
tctttctctttc

SEQ ID NO: 4906480 - DNA, 21 bp, Homo sapiens
tctttctgagcacactttagt

SEQ ID NO: 4906481 - DNA, 16 bp, Homo sapiens
tctttcttcctctgct

SEQ ID NO: 4906482 - DNA, 13 bp, Homo sapiens
tctttcttccttt

SEQ ID NO: 4906483 - DNA, 12 bp, Homo sapiens
tctttctttaaa

SEQ ID NO: 4906484 - DNA, 21 bp, Homo sapiens
tctttgaaatagtctgtgtga

SEQ ID NO: 4906485 - DNA, 22 bp, Homo sapiens
tctttgaaatagtctgtgtgaa

SEQ ID NO: 4906486 - DNA, 22 bp, Homo sapiens
tctttgaagaaggtggaccttt

SEQ ID NO: 4906487 - DNA, 16 bp, Homo sapiens
tctttgacactctgca

SEQ ID NO: 4906488 - DNA, 16 bp, Homo sapiens
tctttgataatgttaa

SEQ ID NO: 4906489 - DNA, 17 bp, Homo sapiens
tctttgataatgttaaa

SEQ ID NO: 4906490 - DNA, 20 bp, Homo sapiens
tctttgattctccttttatg

SEQ ID NO: 4906491 - DNA, 22 bp, Homo sapiens
tctttgattctccttttatgtg

SEQ ID NO: 4906492 - DNA, 17 bp, Homo sapiens
tctttgcagacaggcaa

SEQ ID NO: 4906493 - DNA, 14 bp, Homo sapiens
tctttgccttgggc

SEQ ID NO: 4906494 - DNA, 21 bp, Homo sapiens
tctttgccttgggctgctcct

SEQ ID NO: 4906495 - DNA, 18 bp, Homo sapiens
tctttggaaaaatgtttg

SEQ ID NO: 4906496 - DNA, 14 bp, Homo sapiens
tctttggctcccct

SEQ ID NO: 4906497 - DNA, 17 bp, Homo sapiens
tctttggggtctacact

SEQ ID NO: 4906498 - DNA, 14 bp, Homo sapiens
tctttggttctaag

SEQ ID NO: 4906499 - DNA, 13 bp, Homo sapiens
tctttgtaagagt

SEQ ID NO: 4906500 - DNA, 18 bp, Homo sapiens
tctttgtaagagtgtaga

SEQ ID NO: 4906501 - DNA, 19 bp, Homo sapiens
tctttgtaagagtgtagaa

SEQ ID NO: 4906502 - DNA, 24 bp, Homo sapiens
tctttgtaagagtgtagaagcatt

SEQ ID NO: 4906503 - DNA, 20 bp, Homo sapiens
tctttgtcttatctggccct

SEQ ID NO: 4906504 - DNA, 16 bp, Homo sapiens
tctttgtgataattta

SEQ ID NO: 4906505 - DNA, 18 bp, Homo sapiens
tctttgtggggcttggcg

SEQ ID NO: 4906506 - DNA, 13 bp, Homo sapiens
tctttgtgtagct

SEQ ID NO: 4906507 - DNA, 18 bp, Homo sapiens
tctttgtgtagctttgct

SEQ ID NO: 4906508 - DNA, 19 bp, Homo sapiens
tcttttaaaaattcaaatg

SEQ ID NO: 4906509 - DNA, 18 bp, Homo sapiens
tcttttaaagtgttactt

SEQ ID NO: 4906510 - DNA, 23 bp, Homo sapiens
tcttttaaagtgttactttttgt

SEQ ID NO: 4906511 - DNA, 21 bp, Homo sapiens
tcttttatagtggaaaaacac

SEQ ID NO: 4906512 - DNA, 17 bp, Homo sapiens
tcttttatatttgtatc

SEQ ID NO: 4906513 - DNA, 18 bp, Homo sapiens
tcttttatatttgtatcg

SEQ ID NO: 4906514 - DNA, 14 bp, Homo sapiens
tcttttatctgttt

SEQ ID NO: 4906515 - DNA, 15 bp, Homo sapiens
tcttttatctgttta

SEQ ID NO: 4906516 - DNA, 21 bp, Homo sapiens
tcttttatctgtttaaagcat

SEQ ID NO: 4906517 - DNA, 13 bp, Homo sapiens
tcttttatgtttg

SEQ ID NO: 4906518 - DNA, 22 bp, Homo sapiens
tcttttcacatagctgtctaga

SEQ ID NO: 4906519 - DNA, 15 bp, Homo sapiens
tcttttcctgttgta

SEQ ID NO: 4906520 - DNA, 13 bp, Homo sapiens
tcttttctctgtg

SEQ ID NO: 4906521 - DNA, 17 bp, Homo sapiens
tcttttctctgtgcttc

SEQ ID NO: 4906522 - DNA, 13 bp, Homo sapiens
tcttttcttttta

SEQ ID NO: 4906523 - DNA, 15 bp, Homo sapiens
tcttttgaattgttt

SEQ ID NO: 4906524 - DNA, 17 bp, Homo sapiens
tcttttgctactaagtt

SEQ ID NO: 4906525 - DNA, 13 bp, Homo sapiens
tcttttggcttcc

SEQ ID NO: 4906526 - DNA, 14 bp, Homo sapiens
tcttttgtaaatta

SEQ ID NO: 4906527 - DNA, 13 bp, Homo sapiens
tcttttgtaagtg

SEQ ID NO: 4906528 - DNA, 15 bp, Homo sapiens
tcttttgttaaataa

SEQ ID NO: 4906529 - DNA, 22 bp, Homo sapiens
tcttttgttaaataatatggct

SEQ ID NO: 4906530 - DNA, 14 bp, Homo sapiens
tcttttgttactgt

SEQ ID NO: 4906531 - DNA, 16 bp, Homo sapiens
tcttttgttactgttc

SEQ ID NO: 4906532 - DNA, 17 bp, Homo sapiens
tcttttgttactgttct

SEQ ID NO: 4906533 - DNA, 19 bp, Homo sapiens
tcttttgttactgttcttg

SEQ ID NO: 4906534 - DNA, 22 bp, Homo sapiens
tcttttgttactgttcttgctg

SEQ ID NO: 4906535 - DNA, 15 bp, Homo sapiens
tctttttaaaatggt

SEQ ID NO: 4906536 - DNA, 14 bp, Homo sapiens
tctttttaaagctt

SEQ ID NO: 4906537 - DNA, 12 bp, Homo sapiens
tctttttagttt

SEQ ID NO: 4906538 - DNA, 14 bp, Homo sapiens
tctttttatgcatt

SEQ ID NO: 4906539 - DNA, 11 bp, Homo sapiens
tctttttctga

SEQ ID NO: 4906540 - DNA, 14 bp, Homo sapiens
tctttttctgttgt

SEQ ID NO: 4906541 - DNA, 19 bp, Homo sapiens
tcttttttactcattgaaa

SEQ ID NO: 4906542 - DNA, 21 bp, Homo sapiens
tcttttttactcattgaaatg

SEQ ID NO: 4906543 - DNA, 17 bp, Homo sapiens
tctttttttccccccct

SEQ ID NO: 4906544 - DNA, 22 bp, Homo sapiens
tctttttttggtgattcaaatg

SEQ ID NO: 4906545 - DNA, 18 bp, Homo sapiens
tgaaaaccatctggcctg

SEQ ID NO: 4906546 - DNA, 16 bp, Homo sapiens
tgaaaacctacatatt

SEQ ID NO: 4906547 - DNA, 13 bp, Homo sapiens
tgaaaactataca

SEQ ID NO: 4906548 - DNA, 14 bp, Homo sapiens
tgaaaactatacaa

SEQ ID NO: 4906549 - DNA, 13 bp, Homo sapiens
tgaaaactggaat

SEQ ID NO: 4906550 - DNA, 17 bp, Homo sapiens
tgaaaagatttaagcac

SEQ ID NO: 4906551 - DNA, 19 bp, Homo sapiens
tgaaaagggggtgggatgg

SEQ ID NO: 4906552 - DNA, 22 bp, Homo sapiens
tgaaaagtcgttttccaaactg

SEQ ID NO: 4906553 - DNA, 18 bp, Homo sapiens
tgaaaataccatcaggcc

SEQ ID NO: 4906554 - DNA, 19 bp, Homo sapiens
tgaaaatcgtgacaacact

SEQ ID NO: 4906555 - DNA, 17 bp, Homo sapiens
tgaaaatctaatattaa

SEQ ID NO: 4906556 - DNA, 21 bp, Homo sapiens
tgaaaatctaatattaaaaat

SEQ ID NO: 4906557 - DNA, 14 bp, Homo sapiens
tgaaaatcttggag

SEQ ID NO: 4906558 - DNA, 23 bp, Homo sapiens
tgaaaatgaatatctattaatat

SEQ ID NO: 4906559 - DNA, 17 bp, Homo sapiens
tgaaaatgagttgtgaa

SEQ ID NO: 4906560 - DNA, 18 bp, Homo sapiens
tgaaaatgagttgtgaaa

SEQ ID NO: 4906561 - DNA, 21 bp, Homo sapiens
tgaaaatgggttggtgcttct

SEQ ID NO: 4906562 - DNA, 16 bp, Homo sapiens
tgaaaatgtactgaga

SEQ ID NO: 4906563 - DNA, 16 bp, Homo sapiens
tgaaaatgttgttatg

SEQ ID NO: 4906564 - DNA, 15 bp, Homo sapiens
tgaaaattattttaa

SEQ ID NO: 4906565 - DNA, 21 bp, Homo sapiens
tgaaaattcgcccgagctgtt

SEQ ID NO: 4906566 - DNA, 22 bp, Homo sapiens
tgaaaattcgcccgagctgttt

SEQ ID NO: 4906567 - DNA, 22 bp, Homo sapiens
tgaaaattttaaaaatacatat

SEQ ID NO: 4906568 - DNA, 14 bp, Homo sapiens
tgaaacaaagctgc

SEQ ID NO: 4906569 - DNA, 15 bp, Homo sapiens
tgaaacacgaaactt

SEQ ID NO: 4906570 - DNA, 20 bp, Homo sapiens
tgaaacactttgcctcctgt

SEQ ID NO: 4906571 - DNA, 14 bp, Homo sapiens
tgaaacagatttca

SEQ ID NO: 4906572 - DNA, 19 bp, Homo sapiens
tgaaacctagtactgcccc

SEQ ID NO: 4906573 - DNA, 21 bp, Homo sapiens
tgaaaccttttttaagatttt

SEQ ID NO: 4906574 - DNA, 23 bp, Homo sapiens
tgaaaccttttttaagatttttc

SEQ ID NO: 4906575 - DNA, 14 bp, Homo sapiens
tgaaagaatatatt

SEQ ID NO: 4906576 - DNA, 21 bp, Homo sapiens
tgaaagcacaggagacactgt

SEQ ID NO: 4906577 - DNA, 14 bp, Homo sapiens
tgaaagctgagaac

SEQ ID NO: 4906578 - DNA, 22 bp, Homo sapiens
tgaaagctgagaactcctgact

SEQ ID NO: 4906579 - DNA, 18 bp, Homo sapiens
tgaaagggcccagagagg

SEQ ID NO: 4906580 - DNA, 23 bp, Homo sapiens
tgaaagtacatttggagacacaa

SEQ ID NO: 4906581 - DNA, 20 bp, Homo sapiens
tgaaagtagcagtgtgaagt

SEQ ID NO: 4906582 - DNA, 15 bp, Homo sapiens
tgaaagttacccact

SEQ ID NO: 4906583 - DNA, 16 bp, Homo sapiens
tgaaataacaaaatgg

SEQ ID NO: 4906584 - DNA, 17 bp, Homo sapiens
tgaaataacaaaatgga

SEQ ID NO: 4906585 - DNA, 12 bp, Homo sapiens
tgaaataataga

SEQ ID NO: 4906586 - DNA, 13 bp, Homo sapiens
tgaaatagtctgt

SEQ ID NO: 4906587 - DNA, 17 bp, Homo sapiens
tgaaatccttgactgga

SEQ ID NO: 4906588 - DNA, 21 bp, Homo sapiens
tgaaatgaaacaaataatcac

SEQ ID NO: 4906589 - DNA, 15 bp, Homo sapiens
tgaaatgaaatttaa

SEQ ID NO: 4906590 - DNA, 23 bp, Homo sapiens
tgaaatgaaatttaaacattaaa

SEQ ID NO: 4906591 - DNA, 19 bp, Homo sapiens
tgaaatgaggtcagagcct

SEQ ID NO: 4906592 - DNA, 16 bp, Homo sapiens
tgaaatgctggcattt

SEQ ID NO: 4906593 - DNA, 19 bp, Homo sapiens
tgaaatggatactacatct

SEQ ID NO: 4906594 - DNA, 21 bp, Homo sapiens
tgaaatgttagtcattgttat

SEQ ID NO: 4906595 - DNA, 19 bp, Homo sapiens
tgaaattaagaaggcaaaa

SEQ ID NO: 4906596 - DNA, 18 bp, Homo sapiens
tgaaattatagtttcaag

SEQ ID NO: 4906597 - DNA, 19 bp, Homo sapiens
tgaaattccaaagtctcta

SEQ ID NO: 4906598 - DNA, 23 bp, Homo sapiens
tgaaattctaaagagcacttact

SEQ ID NO: 4906599 - DNA, 22 bp, Homo sapiens
tgaaattgataatgctttcaca

SEQ ID NO: 4906600 - DNA, 12 bp, Homo sapiens
tgaaattgtaaa

SEQ ID NO: 4906601 - DNA, 17 bp, Homo sapiens
tgaaattgtacatattt

SEQ ID NO: 4906602 - DNA, 16 bp, Homo sapiens
tgaaatttaaacatta

SEQ ID NO: 4906603 - DNA, 18 bp, Homo sapiens
tgaaatttaaacattaaa

SEQ ID NO: 4906604 - DNA, 20 bp, Homo sapiens
tgaaatttattagttaatat

SEQ ID NO: 4906605 - DNA, 12 bp, Homo sapiens
tgaaatttcaga

SEQ ID NO: 4906606 - DNA, 21 bp, Homo sapiens
tgaaatttctagcctgcactt

SEQ ID NO: 4906607 - DNA, 18 bp, Homo sapiens
tgaaattttctagacttt

SEQ ID NO: 4906608 - DNA, 20 bp, Homo sapiens
tgaaattttgcaaatataaa

SEQ ID NO: 4906609 - DNA, 22 bp, Homo sapiens
tgaaatttttaaaaatacactt

SEQ ID NO: 4906610 - DNA, 18 bp, Homo sapiens
tgaacaaaaaataaaaat

SEQ ID NO: 4906611 - DNA, 13 bp, Homo sapiens
tgaacaaactaaa

SEQ ID NO: 4906612 - DNA, 12 bp, Homo sapiens
tgaacaagaatt

SEQ ID NO: 4906613 - DNA, 19 bp, Homo sapiens
tgaacaagttttaatgtat

SEQ ID NO: 4906614 - DNA, 18 bp, Homo sapiens
tgaacacaaactgtaaat

SEQ ID NO: 4906615 - DNA, 19 bp, Homo sapiens
tgaacacaaactgtaaata

SEQ ID NO: 4906616 - DNA, 13 bp, Homo sapiens
tgaacacaggcag

SEQ ID NO: 4906617 - DNA, 14 bp, Homo sapiens
tgaacacaggcagc

SEQ ID NO: 4906618 - DNA, 22 bp, Homo sapiens
tgaacacgaaagaaatgtacct

SEQ ID NO: 4906619 - DNA, 22 bp, Homo sapiens
tgaaccacatcttgctctgctg

SEQ ID NO: 4906620 - DNA, 20 bp, Homo sapiens
tgaaccaccacacccagccc

SEQ ID NO: 4906621 - DNA, 21 bp, Homo sapiens
tgaaccaccacacccagccca

SEQ ID NO: 4906622 - DNA, 16 bp, Homo sapiens
tgaaccacttcattct

SEQ ID NO: 4906623 - DNA, 21 bp, Homo sapiens
tgaacccttcctgagctttat

SEQ ID NO: 4906624 - DNA, 13 bp, Homo sapiens
tgaacccttgctt

SEQ ID NO: 4906625 - DNA, 14 bp, Homo sapiens
tgaaccgcacagct

SEQ ID NO: 4906626 - DNA, 13 bp, Homo sapiens
tgaacctgtgagt

SEQ ID NO: 4906627 - DNA, 22 bp, Homo sapiens
tgaactaagaaacttttgtaaa

SEQ ID NO: 4906628 - DNA, 21 bp, Homo sapiens
tgaactacgcttgctcatttt

SEQ ID NO: 4906629 - DNA, 20 bp, Homo sapiens
tgaactatttctacacagtg

SEQ ID NO: 4906630 - DNA, 18 bp, Homo sapiens
tgaactcagatctgtctg

SEQ ID NO: 4906631 - DNA, 11 bp, Homo sapiens
tgaactcctgg

SEQ ID NO: 4906632 - DNA, 16 bp, Homo sapiens
tgaacttattctgtag

SEQ ID NO: 4906633 - DNA, 11 bp, Homo sapiens
tgaactttctc

SEQ ID NO: 4906634 - DNA, 14 bp, Homo sapiens
tgaactttggagag

SEQ ID NO: 4906635 - DNA, 13 bp, Homo sapiens
tgaagaacatgtg

SEQ ID NO: 4906636 - DNA, 19 bp, Homo sapiens
tgaagaaggtggacctttt

SEQ ID NO: 4906637 - DNA, 14 bp, Homo sapiens
tgaagaatacagtt

SEQ ID NO: 4906638 - DNA, 15 bp, Homo sapiens
tgaagaatacagtta

SEQ ID NO: 4906639 - DNA, 14 bp, Homo sapiens
tgaagaattaagat

SEQ ID NO: 4906640 - DNA, 23 bp, Homo sapiens
tgaagacaatttgatacataata

SEQ ID NO: 4906641 - DNA, 14 bp, Homo sapiens
tgaagactgaggac

SEQ ID NO: 4906642 - DNA, 15 bp, Homo sapiens
tgaagagagatatat

SEQ ID NO: 4906643 - DNA, 22 bp, Homo sapiens
tgaagagccagaagtgaagagt

SEQ ID NO: 4906644 - DNA, 17 bp, Homo sapiens
tgaagagcttgctttga

SEQ ID NO: 4906645 - DNA, 18 bp, Homo sapiens
tgaagagtcgattatttc

SEQ ID NO: 4906646 - DNA, 16 bp, Homo sapiens
tgaagatgggaacgca

SEQ ID NO: 4906647 - DNA, 13 bp, Homo sapiens
tgaagcaaggaag

SEQ ID NO: 4906648 - DNA, 20 bp, Homo sapiens
tgaagcaaggaagatataca

SEQ ID NO: 4906649 - DNA, 14 bp, Homo sapiens
tgaagcatgtttca

SEQ ID NO: 4906650 - DNA, 21 bp, Homo sapiens
tgaagcattctccccagtgta

SEQ ID NO: 4906651 - DNA, 16 bp, Homo sapiens
tgaagccagccttctt

SEQ ID NO: 4906652 - DNA, 23 bp, Homo sapiens
tgaagccagctcacagtgctgtg

SEQ ID NO: 4906653 - DNA, 16 bp, Homo sapiens
tgaagcccaagtgaaa

SEQ ID NO: 4906654 - DNA, 14 bp, Homo sapiens
tgaagcctctggga

SEQ ID NO: 4906655 - DNA, 22 bp, Homo sapiens
tgaagcctgcgttggtccagag

SEQ ID NO: 4906656 - DNA, 14 bp, Homo sapiens
tgaagctactgtgt

SEQ ID NO: 4906657 - DNA, 13 bp, Homo sapiens
tgaagctgaaaat

SEQ ID NO: 4906658 - DNA, 15 bp, Homo sapiens
tgaagctgaaaatat

SEQ ID NO: 4906659 - DNA, 19 bp, Homo sapiens
tgaaggaacattccttagt

SEQ ID NO: 4906660 - DNA, 22 bp, Homo sapiens
tgaaggaagccaaatttatcaa

SEQ ID NO: 4906661 - DNA, 20 bp, Homo sapiens
tgaaggaataaattgctcct

SEQ ID NO: 4906662 - DNA, 20 bp, Homo sapiens
tgaaggacattgcggacagc

SEQ ID NO: 4906663 - DNA, 22 bp, Homo sapiens
tgaaggagaggcaacatccaaa

SEQ ID NO: 4906664 - DNA, 20 bp, Homo sapiens
tgaaggcttctctgttctac

SEQ ID NO: 4906665 - DNA, 15 bp, Homo sapiens
tgaaggtgacagcag

SEQ ID NO: 4906666 - DNA, 18 bp, Homo sapiens
tgaaggttttaagtggtt

SEQ ID NO: 4906667 - DNA, 15 bp, Homo sapiens
tgaagtagtttgtat

SEQ ID NO: 4906668 - DNA, 15 bp, Homo sapiens
tgaagtcactgcaca

SEQ ID NO: 4906669 - DNA, 16 bp, Homo sapiens
tgaagtcactgcacag

SEQ ID NO: 4906670 - DNA, 12 bp, Homo sapiens
tgaagtcttgta

SEQ ID NO: 4906671 - DNA, 14 bp, Homo sapiens
tgaagttctcctga

SEQ ID NO: 4906672 - DNA, 14 bp, Homo sapiens
tgaagtttaaaaca

SEQ ID NO: 4906673 - DNA, 19 bp, Homo sapiens
tgaagtttaaaacagtatt

SEQ ID NO: 4906674 - DNA, 21 bp, Homo sapiens
tgaagtttaaaacagtattta

SEQ ID NO: 4906675 - DNA, 12 bp, Homo sapiens
tgaagtttacat

SEQ ID NO: 4906676 - DNA, 14 bp, Homo sapiens
tgaagtttacattg

SEQ ID NO: 4906677 - DNA, 17 bp, Homo sapiens
tgaagtttacattttta

SEQ ID NO: 4906678 - DNA, 18 bp, Homo sapiens
tgaagtttgaacttcata

SEQ ID NO: 4906679 - DNA, 20 bp, Homo sapiens
tgaagtttgtagttgtttta

SEQ ID NO: 4906680 - DNA, 16 bp, Homo sapiens
tgaagttttacattgt

SEQ ID NO: 4906681 - DNA, 15 bp, Homo sapiens
tgaataaacttcagc

SEQ ID NO: 4906682 - DNA, 16 bp, Homo sapiens
tgaataaacttcagca

SEQ ID NO: 4906683 - DNA, 15 bp, Homo sapiens
tgaataaagacacct

SEQ ID NO: 4906684 - DNA, 22 bp, Homo sapiens
tgaataccattaaaactgcttt

SEQ ID NO: 4906685 - DNA, 23 bp, Homo sapiens
tgaataccattaaaactgctttt

SEQ ID NO: 4906686 - DNA, 21 bp, Homo sapiens
tgaatagcaatagcatggata

SEQ ID NO: 4906687 - DNA, 14 bp, Homo sapiens
tgaatatctattaa

SEQ ID NO: 4906688 - DNA, 16 bp, Homo sapiens
tgaatatctattaata

SEQ ID NO: 4906689 - DNA, 14 bp, Homo sapiens
tgaatatctttcga

SEQ ID NO: 4906690 - DNA, 19 bp, Homo sapiens
tgaatatggacaagaggta

SEQ ID NO: 4906691 - DNA, 15 bp, Homo sapiens
tgaatattactccta

SEQ ID NO: 4906692 - DNA, 17 bp, Homo sapiens
tgaatattgaagtttca

SEQ ID NO: 4906693 - DNA, 16 bp, Homo sapiens
tgaatattttgataat

SEQ ID NO: 4906694 - DNA, 15 bp, Homo sapiens
tgaatctgattttta

SEQ ID NO: 4906695 - DNA, 14 bp, Homo sapiens
tgaatgagaatcta

SEQ ID NO: 4906696 - DNA, 18 bp, Homo sapiens
tgaatgaggtcccaggca

SEQ ID NO: 4906697 - DNA, 22 bp, Homo sapiens
tgaatgaggtcccaggcagaga

SEQ ID NO: 4906698 - DNA, 14 bp, Homo sapiens
tgaatgatgagcct

SEQ ID NO: 4906699 - DNA, 17 bp, Homo sapiens
tgaatgcctcctgtggg

SEQ ID NO: 4906700 - DNA, 12 bp, Homo sapiens
tgaatgctgcca

SEQ ID NO: 4906701 - DNA, 13 bp, Homo sapiens
tgaatgctgccag

SEQ ID NO: 4906702 - DNA, 15 bp, Homo sapiens
tgaatggattggatt

SEQ ID NO: 4906703 - DNA, 20 bp, Homo sapiens
tgaatggattggattattta

SEQ ID NO: 4906704 - DNA, 21 bp, Homo sapiens
tgaatggattggattatttaa

SEQ ID NO: 4906705 - DNA, 13 bp, Homo sapiens
tgaatggtatgga

SEQ ID NO: 4906706 - DNA, 20 bp, Homo sapiens
tgaatggtatggaactctct

SEQ ID NO: 4906707 - DNA, 19 bp, Homo sapiens
tgaatgtagcagccccggg

SEQ ID NO: 4906708 - DNA, 20 bp, Homo sapiens
tgaatgtatgtaatgtgtgg

SEQ ID NO: 4906709 - DNA, 22 bp, Homo sapiens
tgaatgtatgtaatgtgtggtg

SEQ ID NO: 4906710 - DNA, 19 bp, Homo sapiens
tgaatgtatttatttggga

SEQ ID NO: 4906711 - DNA, 16 bp, Homo sapiens
tgaatgtctaaaattg

SEQ ID NO: 4906712 - DNA, 23 bp, Homo sapiens
tgaatgtcttttgaatattccca

SEQ ID NO: 4906713 - DNA, 18 bp, Homo sapiens
tgaatgtggcttgagaaa

SEQ ID NO: 4906714 - DNA, 16 bp, Homo sapiens
tgaatgtgggcactgg

SEQ ID NO: 4906715 - DNA, 15 bp, Homo sapiens
tgaatgtggtctcag

SEQ ID NO: 4906716 - DNA, 16 bp, Homo sapiens
tgaatgtggtctcagg

SEQ ID NO: 4906717 - DNA, 14 bp, Homo sapiens
tgaatgttaagaat

SEQ ID NO: 4906718 - DNA, 21 bp, Homo sapiens
tgaatgtttccaacctggagt

SEQ ID NO: 4906719 - DNA, 19 bp, Homo sapiens
tgaattgtttttattgttt

SEQ ID NO: 4906720 - DNA, 19 bp, Homo sapiens
tgaatttaaatataattct

SEQ ID NO: 4906721 - DNA, 21 bp, Homo sapiens
tgaatttggcctgcactaatt

SEQ ID NO: 4906722 - DNA, 13 bp, Homo sapiens
tgaatttgtactt

SEQ ID NO: 4906723 - DNA, 23 bp, Homo sapiens
tgaattttaaatctaaatctatt

SEQ ID NO: 4906724 - DNA, 16 bp, Homo sapiens
tgaatttttttttcct

SEQ ID NO: 4906725 - DNA, 19 bp, Homo sapiens
tgaatttttttttcctagc

SEQ ID NO: 4906726 - DNA, 19 bp, Homo sapiens
tgacaaaaagtttccatat

SEQ ID NO: 4906727 - DNA, 14 bp, Homo sapiens
tgacaaagatggct

SEQ ID NO: 4906728 - DNA, 16 bp, Homo sapiens
tgacaaatctgtgtat

SEQ ID NO: 4906729 - DNA, 14 bp, Homo sapiens
tgacaacagaagct

SEQ ID NO: 4906730 - DNA, 13 bp, Homo sapiens
tgacaacctccat

SEQ ID NO: 4906731 - DNA, 20 bp, Homo sapiens
tgacaacctccattctattt

SEQ ID NO: 4906732 - DNA, 13 bp, Homo sapiens
tgacaactgtcta

SEQ ID NO: 4906733 - DNA, 22 bp, Homo sapiens
tgacaagagcctgatctcttcc

SEQ ID NO: 4906734 - DNA, 18 bp, Homo sapiens
tgacaaggattgctactg

SEQ ID NO: 4906735 - DNA, 21 bp, Homo sapiens
tgacaagggctgacctgcctc

SEQ ID NO: 4906736 - DNA, 14 bp, Homo sapiens
tgacacaaaggaag

SEQ ID NO: 4906737 - DNA, 19 bp, Homo sapiens
tgacacaagtggaccttag

SEQ ID NO: 4906738 - DNA, 19 bp, Homo sapiens
tgacacatccgccttttgt

SEQ ID NO: 4906739 - DNA, 14 bp, Homo sapiens
tgacaccaaagcca

SEQ ID NO: 4906740 - DNA, 21 bp, Homo sapiens
tgacacccgtgagcgcctgtg

SEQ ID NO: 4906741 - DNA, 20 bp, Homo sapiens
tgacactatagtttaaaaca

SEQ ID NO: 4906742 - DNA, 11 bp, Homo sapiens
tgacactgacc

SEQ ID NO: 4906743 - DNA, 13 bp, Homo sapiens
tgacagacacagg

SEQ ID NO: 4906744 - DNA, 18 bp, Homo sapiens
tgacagacacaggcccgg

SEQ ID NO: 4906745 - DNA, 17 bp, Homo sapiens
tgacagaccacatcttt

SEQ ID NO: 4906746 - DNA, 15 bp, Homo sapiens
tgacagaggcagccc

SEQ ID NO: 4906747 - DNA, 17 bp, Homo sapiens
tgacagaggcagcccca

SEQ ID NO: 4906748 - DNA, 19 bp, Homo sapiens
tgacagagtgagactctgt

SEQ ID NO: 4906749 - DNA, 22 bp, Homo sapiens
tgacagagtgagactctgtctc

SEQ ID NO: 4906750 - DNA, 12 bp, Homo sapiens
tgacagcctccc

SEQ ID NO: 4906751 - DNA, 22 bp, Homo sapiens
tgacagcctcccacccccatct

SEQ ID NO: 4906752 - DNA, 19 bp, Homo sapiens
tgacaggcaatgctggctg

SEQ ID NO: 4906753 - DNA, 11 bp, Homo sapiens
tgacagggcac

SEQ ID NO: 4906754 - DNA, 16 bp, Homo sapiens
tgacagggcacaccgg

SEQ ID NO: 4906755 - DNA, 20 bp, Homo sapiens
tgacagggcacaccgggcac

SEQ ID NO: 4906756 - DNA, 22 bp, Homo sapiens
tgacagggcacaccgggcactc

SEQ ID NO: 4906757 - DNA, 20 bp, Homo sapiens
tgacagggccagtggggcct

SEQ ID NO: 4906758 - DNA, 23 bp, Homo sapiens
tgacagggccagtggggcctgtg

SEQ ID NO: 4906759 - DNA, 17 bp, Homo sapiens
tgacaggtaaattaaga

SEQ ID NO: 4906760 - DNA, 18 bp, Homo sapiens
tgacagtcatcatcaggg

SEQ ID NO: 4906761 - DNA, 19 bp, Homo sapiens
tgacagtcatcatcagggc

SEQ ID NO: 4906762 - DNA, 23 bp, Homo sapiens
tgacagtcatcatcagggcctgg

SEQ ID NO: 4906763 - DNA, 16 bp, Homo sapiens
tgacagtgttgaaaat

SEQ ID NO: 4906764 - DNA, 17 bp, Homo sapiens
tgacataacagtgcagg

SEQ ID NO: 4906765 - DNA, 14 bp, Homo sapiens
tgacatcacagcag

SEQ ID NO: 4906766 - DNA, 15 bp, Homo sapiens
tgacatcacagcagc

SEQ ID NO: 4906767 - DNA, 16 bp, Homo sapiens
tgacatcacagcagcc

SEQ ID NO: 4906768 - DNA, 16 bp, Homo sapiens
tgacatcacttgtaca

SEQ ID NO: 4906769 - DNA, 18 bp, Homo sapiens
tgacatcacttgtacaaa

SEQ ID NO: 4906770 - DNA, 22 bp, Homo sapiens
tgacatcacttgtacaaaataa

SEQ ID NO: 4906771 - DNA, 22 bp, Homo sapiens
tgacatctcaggggccagagga

SEQ ID NO: 4906772 - DNA, 19 bp, Homo sapiens
tgacatgcactgacccttc

SEQ ID NO: 4906773 - DNA, 12 bp, Homo sapiens
tgacatgtgaaa

SEQ ID NO: 4906774 - DNA, 18 bp, Homo sapiens
tgacattgtagagcttct

SEQ ID NO: 4906775 - DNA, 16 bp, Homo sapiens
tgacatttgtagttgg

SEQ ID NO: 4906776 - DNA, 23 bp, Homo sapiens
tgaccaacaggctgttctgcact

SEQ ID NO: 4906777 - DNA, 12 bp, Homo sapiens
tgaccaactgtg

SEQ ID NO: 4906778 - DNA, 15 bp, Homo sapiens
tgaccaattgtgctg

SEQ ID NO: 4906779 - DNA, 16 bp, Homo sapiens
tgaccaattgtgctgc

SEQ ID NO: 4906780 - DNA, 17 bp, Homo sapiens
tgaccaattgtgctgcc

SEQ ID NO: 4906781 - DNA, 19 bp, Homo sapiens
tgaccaattgtgctgccat

SEQ ID NO: 4906782 - DNA, 23 bp, Homo sapiens
tgaccagcctccatgctgcctcc

SEQ ID NO: 4906783 - DNA, 22 bp, Homo sapiens
tgacccactggttccttcttcc

SEQ ID NO: 4906784 - DNA, 22 bp, Homo sapiens
tgacccccaaccaagtggctcc

SEQ ID NO: 4906785 - DNA, 13 bp, Homo sapiens
tgacccctcctca

SEQ ID NO: 4906786 - DNA, 15 bp, Homo sapiens
tgacccctcctcact

SEQ ID NO: 4906787 - DNA, 22 bp, Homo sapiens
tgacccctcctcactggccatc

SEQ ID NO: 4906788 - DNA, 16 bp, Homo sapiens
tgaccctactcccttg

SEQ ID NO: 4906789 - DNA, 15 bp, Homo sapiens
tgaccctgatgaaaa

SEQ ID NO: 4906790 - DNA, 22 bp, Homo sapiens
tgacccttcccaatcagcactg

SEQ ID NO: 4906791 - DNA, 18 bp, Homo sapiens
tgacctcaggcactagcc

SEQ ID NO: 4906792 - DNA, 20 bp, Homo sapiens
tgacctcaggtgatccaccc

SEQ ID NO: 4906793 - DNA, 21 bp, Homo sapiens
tgacctcaggtgatccaccca

SEQ ID NO: 4906794 - DNA, 13 bp, Homo sapiens
tgacctctgcctg

SEQ ID NO: 4906795 - DNA, 17 bp, Homo sapiens
tgacctctgtcctccct

SEQ ID NO: 4906796 - DNA, 18 bp, Homo sapiens
tgacctcttgctgtctct

SEQ ID NO: 4906797 - DNA, 18 bp, Homo sapiens
tgacctgctccgctgctc

SEQ ID NO: 4906798 - DNA, 11 bp, Homo sapiens
tgaccttcctc

SEQ ID NO: 4906799 - DNA, 17 bp, Homo sapiens
tgaccttcctctggggc

SEQ ID NO: 4906800 - DNA, 19 bp, Homo sapiens
tgaccttcctctggggctc

SEQ ID NO: 4906801 - DNA, 21 bp, Homo sapiens
tgaccttcctctggggctcta

SEQ ID NO: 4906802 - DNA, 23 bp, Homo sapiens
tgaccttcctctggggctctagg

SEQ ID NO: 4906803 - DNA, 16 bp, Homo sapiens
tgaccttccttcctgt

SEQ ID NO: 4906804 - DNA, 14 bp, Homo sapiens
tgaccttctctata

SEQ ID NO: 4906805 - DNA, 17 bp, Homo sapiens
tgaccttttatgtagta

SEQ ID NO: 4906806 - DNA, 21 bp, Homo sapiens
tgacgattccttctctgaaca

SEQ ID NO: 4906807 - DNA, 20 bp, Homo sapiens
tgacggccctcatctatgag

SEQ ID NO: 4906808 - DNA, 15 bp, Homo sapiens
tgacggccctgcaat

SEQ ID NO: 4906809 - DNA, 14 bp, Homo sapiens
tgactaaaatattt

SEQ ID NO: 4906810 - DNA, 18 bp, Homo sapiens
tgactaaattcgtgattt

SEQ ID NO: 4906811 - DNA, 16 bp, Homo sapiens
tgactaaatttgggga

SEQ ID NO: 4906812 - DNA, 20 bp, Homo sapiens
tgactaactagacaccaaag

SEQ ID NO: 4906813 - DNA, 23 bp, Homo sapiens
tgactaattagggtacatttata

SEQ ID NO: 4906814 - DNA, 18 bp, Homo sapiens
tgactagggattcaggct

SEQ ID NO: 4906815 - DNA, 17 bp, Homo sapiens
tgactagtacaaattat

SEQ ID NO: 4906816 - DNA, 20 bp, Homo sapiens
tgactagtacaaattataaa

SEQ ID NO: 4906817 - DNA, 19 bp, Homo sapiens
tgactatatagagatgttt

SEQ ID NO: 4906818 - DNA, 12 bp, Homo sapiens
tgactatgtaaa

SEQ ID NO: 4906819 - DNA, 16 bp, Homo sapiens
tgactcaaatctccag

SEQ ID NO: 4906820 - DNA, 22 bp, Homo sapiens
tgactccacgatcctgccaccc

SEQ ID NO: 4906821 - DNA, 22 bp, Homo sapiens
tgactcccttaaaatagaaata

SEQ ID NO: 4906822 - DNA, 18 bp, Homo sapiens
tgactcctacctgccctg

SEQ ID NO: 4906823 - DNA, 18 bp, Homo sapiens
tgactcgagtcacactca

SEQ ID NO: 4906824 - DNA, 12 bp, Homo sapiens
tgactctaaatt

SEQ ID NO: 4906825 - DNA, 13 bp, Homo sapiens
tgactctgccccc

SEQ ID NO: 4906826 - DNA, 17 bp, Homo sapiens
tgactgtatctgtgtag

SEQ ID NO: 4906827 - DNA, 16 bp, Homo sapiens
tgactgtcactgttcc

SEQ ID NO: 4906828 - DNA, 16 bp, Homo sapiens
tgacttaatgtgatta

SEQ ID NO: 4906829 - DNA, 13 bp, Homo sapiens
tgacttatagtac

SEQ ID NO: 4906830 - DNA, 17 bp, Homo sapiens
tgacttatagtacatga

SEQ ID NO: 4906831 - DNA, 19 bp, Homo sapiens
tgacttatagtacatgata

SEQ ID NO: 4906832 - DNA, 17 bp, Homo sapiens
tgacttcaatgatagta

SEQ ID NO: 4906833 - DNA, 19 bp, Homo sapiens
tgacttcctcgcctctccc

SEQ ID NO: 4906834 - DNA, 21 bp, Homo sapiens
tgacttcctcgcctctcccac

SEQ ID NO: 4906835 - DNA, 16 bp, Homo sapiens
tgacttgcatgaagag

SEQ ID NO: 4906836 - DNA, 19 bp, Homo sapiens
tgacttgcatgaagagaag

SEQ ID NO: 4906837 - DNA, 23 bp, Homo sapiens
tgacttgcatgaagagaagcaat

SEQ ID NO: 4906838 - DNA, 19 bp, Homo sapiens
tgacttggggagatggagt

SEQ ID NO: 4906839 - DNA, 15 bp, Homo sapiens
tgacttgtttgtctt

SEQ ID NO: 4906840 - DNA, 19 bp, Homo sapiens
tgacttgtttgtcttccat

SEQ ID NO: 4906841 - DNA, 18 bp, Homo sapiens
tgactttatatggatgat

SEQ ID NO: 4906842 - DNA, 18 bp, Homo sapiens
tgagaaaaatatatacta

SEQ ID NO: 4906843 - DNA, 15 bp, Homo sapiens
tgagaaatatggaca

SEQ ID NO: 4906844 - DNA, 16 bp, Homo sapiens
tgagaaatttctgtga

SEQ ID NO: 4906845 - DNA, 20 bp, Homo sapiens
tgagaacaaagctgttaaac

SEQ ID NO: 4906846 - DNA, 22 bp, Homo sapiens
tgagaacaaagctgttaaactg

SEQ ID NO: 4906847 - DNA, 13 bp, Homo sapiens
tgagaactcctga

SEQ ID NO: 4906848 - DNA, 15 bp, Homo sapiens
tgagaagaggagccc

SEQ ID NO: 4906849 - DNA, 15 bp, Homo sapiens
tgagaagccttcagc

SEQ ID NO: 4906850 - DNA, 13 bp, Homo sapiens
tgagaagctgctc

SEQ ID NO: 4906851 - DNA, 13 bp, Homo sapiens
tgagaaggagaga

SEQ ID NO: 4906852 - DNA, 14 bp, Homo sapiens
tgagaaggagagaa

SEQ ID NO: 4906853 - DNA, 17 bp, Homo sapiens
tgagaaggcagccacca

SEQ ID NO: 4906854 - DNA, 20 bp, Homo sapiens
tgagaaggcagccaccagcg

SEQ ID NO: 4906855 - DNA, 13 bp, Homo sapiens
tgagaatcccaaa

SEQ ID NO: 4906856 - DNA, 23 bp, Homo sapiens
tgagaatctatatttaacaagat

SEQ ID NO: 4906857 - DNA, 15 bp, Homo sapiens
tgagaatttctaaaa

SEQ ID NO: 4906858 - DNA, 17 bp, Homo sapiens
tgagacacggagcccag

SEQ ID NO: 4906859 - DNA, 21 bp, Homo sapiens
tgagacacggagcccagccct

SEQ ID NO: 4906860 - DNA, 19 bp, Homo sapiens
tgagacagtttcttagctt

SEQ ID NO: 4906861 - DNA, 23 bp, Homo sapiens
tgagacagtttcttagcttttta

SEQ ID NO: 4906862 - DNA, 23 bp, Homo sapiens
tgagacgtttttggaagagtagt

SEQ ID NO: 4906863 - DNA, 17 bp, Homo sapiens
tgagactcacaggaagg

SEQ ID NO: 4906864 - DNA, 22 bp, Homo sapiens
tgagactctagggtccagtgga

SEQ ID NO: 4906865 - DNA, 12 bp, Homo sapiens
tgagactctgtc

SEQ ID NO: 4906866 - DNA, 13 bp, Homo sapiens
tgagactctgtct

SEQ ID NO: 4906867 - DNA, 20 bp, Homo sapiens
tgagactctgtctcaaaaaa

SEQ ID NO: 4906868 - DNA, 19 bp, Homo sapiens
tgagagcccagaggtaaca

SEQ ID NO: 4906869 - DNA, 21 bp, Homo sapiens
tgagaggcgacaggagtattt

SEQ ID NO: 4906870 - DNA, 14 bp, Homo sapiens
tgagaggggaacag

SEQ ID NO: 4906871 - DNA, 18 bp, Homo sapiens
tgagaggggaacagactg

SEQ ID NO: 4906872 - DNA, 19 bp, Homo sapiens
tgagaggggaacagactgg

SEQ ID NO: 4906873 - DNA, 18 bp, Homo sapiens
tgagaggtggcttttgcg

SEQ ID NO: 4906874 - DNA, 21 bp, Homo sapiens
tgagaggtggcttttgcggcc

SEQ ID NO: 4906875 - DNA, 17 bp, Homo sapiens
tgagagtatcaggtctc

SEQ ID NO: 4906876 - DNA, 13 bp, Homo sapiens
tgagagtctagat

SEQ ID NO: 4906877 - DNA, 16 bp, Homo sapiens
tgagagtctagattct

SEQ ID NO: 4906878 - DNA, 19 bp, Homo sapiens
tgagagtctagcactcatt

SEQ ID NO: 4906879 - DNA, 18 bp, Homo sapiens
tgagagttttgtcttgaa

SEQ ID NO: 4906880 - DNA, 21 bp, Homo sapiens
tgagatactttttcttttgta

SEQ ID NO: 4906881 - DNA, 12 bp, Homo sapiens
tgagatcccctg

SEQ ID NO: 4906882 - DNA, 17 bp, Homo sapiens
tgagatggggataaaat

SEQ ID NO: 4906883 - DNA, 12 bp, Homo sapiens
tgagatgtatga

SEQ ID NO: 4906884 - DNA, 19 bp, Homo sapiens
tgagattacagaggaagtt

SEQ ID NO: 4906885 - DNA, 20 bp, Homo sapiens
tgagattcctctgtattgtg

SEQ ID NO: 4906886 - DNA, 23 bp, Homo sapiens
tgagatttaccagggatgtagat

SEQ ID NO: 4906887 - DNA, 16 bp, Homo sapiens
tgagcaaatgtggctc

SEQ ID NO: 4906888 - DNA, 18 bp, Homo sapiens
tgagcaactcttgattat

SEQ ID NO: 4906889 - DNA, 20 bp, Homo sapiens
tgagcacactttagtggccg

SEQ ID NO: 4906890 - DNA, 13 bp, Homo sapiens
tgagcagaaggaa

SEQ ID NO: 4906891 - DNA, 16 bp, Homo sapiens
tgagcaggaaggcctg

SEQ ID NO: 4906892 - DNA, 17 bp, Homo sapiens
tgagcaggaaggcctgg

SEQ ID NO: 4906893 - DNA, 19 bp, Homo sapiens
tgagcaggaaggcctgggt

SEQ ID NO: 4906894 - DNA, 22 bp, Homo sapiens
tgagcagggctcagcggggaca

SEQ ID NO: 4906895 - DNA, 14 bp, Homo sapiens
tgagcatcctgagc

SEQ ID NO: 4906896 - DNA, 16 bp, Homo sapiens
tgagccacagcagcat

SEQ ID NO: 4906897 - DNA, 17 bp, Homo sapiens
tgagccacagcagcatt

SEQ ID NO: 4906898 - DNA, 12 bp, Homo sapiens
tgagccaccacg

SEQ ID NO: 4906899 - DNA, 16 bp, Homo sapiens
tgagccactctcttcc

SEQ ID NO: 4906900 - DNA, 14 bp, Homo sapiens
tgagccactgcacc

SEQ ID NO: 4906901 - DNA, 15 bp, Homo sapiens
tgagcccagagaaca

SEQ ID NO: 4906902 - DNA, 22 bp, Homo sapiens
tgagcccatgttctgcccccag

SEQ ID NO: 4906903 - DNA, 19 bp, Homo sapiens
tgagccccagggtgcccag

SEQ ID NO: 4906904 - DNA, 20 bp, Homo sapiens
tgagccccagggtgcccaga

SEQ ID NO: 4906905 - DNA, 22 bp, Homo sapiens
tgagccccgcagacctccccag

SEQ ID NO: 4906906 - DNA, 23 bp, Homo sapiens
tgagccccgcagacctccccagc

SEQ ID NO: 4906907 - DNA, 19 bp, Homo sapiens
tgagccctactccctgcag

SEQ ID NO: 4906908 - DNA, 20 bp, Homo sapiens
tgagccctactccctgcaga

SEQ ID NO: 4906909 - DNA, 23 bp, Homo sapiens
tgagccctactccctgcagatgc

SEQ ID NO: 4906910 - DNA, 14 bp, Homo sapiens
tgagccgtgaactg

SEQ ID NO: 4906911 - DNA, 17 bp, Homo sapiens
tgagcctcagcatcctg

SEQ ID NO: 4906912 - DNA, 12 bp, Homo sapiens
tgagcctctgct

SEQ ID NO: 4906913 - DNA, 22 bp, Homo sapiens
tgagcctggcccatagaaacat

SEQ ID NO: 4906914 - DNA, 13 bp, Homo sapiens
tgagcctggctct

SEQ ID NO: 4906915 - DNA, 18 bp, Homo sapiens
tgagcctggctcttgtgc

SEQ ID NO: 4906916 - DNA, 20 bp, Homo sapiens
tgagcgcctgtgcacacaca

SEQ ID NO: 4906917 - DNA, 13 bp, Homo sapiens
tgagcgggaggca

SEQ ID NO: 4906918 - DNA, 14 bp, Homo sapiens
tgagcgggaggcag

SEQ ID NO: 4906919 - DNA, 15 bp, Homo sapiens
tgagcgggaggcaga

SEQ ID NO: 4906920 - DNA, 17 bp, Homo sapiens
tgagcgtccagaaatgg

SEQ ID NO: 4906921 - DNA, 18 bp, Homo sapiens
tgagctattaaaactcag

SEQ ID NO: 4906922 - DNA, 21 bp, Homo sapiens
tgagctattaaaactcagcct

SEQ ID NO: 4906923 - DNA, 16 bp, Homo sapiens
tgagctattgctgttc

SEQ ID NO: 4906924 - DNA, 16 bp, Homo sapiens
tgagctgatataaatt

SEQ ID NO: 4906925 - DNA, 22 bp, Homo sapiens
tgagctggggacctggtaccct

SEQ ID NO: 4906926 - DNA, 14 bp, Homo sapiens
tgaggaaagcacac

SEQ ID NO: 4906927 - DNA, 17 bp, Homo sapiens
tgaggaaagcacacagt

SEQ ID NO: 4906928 - DNA, 19 bp, Homo sapiens
tgaggaactgtagatgatg

SEQ ID NO: 4906929 - DNA, 17 bp, Homo sapiens
tgaggaataattattta

SEQ ID NO: 4906930 - DNA, 22 bp, Homo sapiens
tgaggaatccagacccggctgc

SEQ ID NO: 4906931 - DNA, 19 bp, Homo sapiens
tgaggacaaccattccaga

SEQ ID NO: 4906932 - DNA, 21 bp, Homo sapiens
tgaggacactaaccacgctgg

SEQ ID NO: 4906933 - DNA, 21 bp, Homo sapiens
tgaggacatgtttttgttttc

SEQ ID NO: 4906934 - DNA, 15 bp, Homo sapiens
tgaggagcatgtttt

SEQ ID NO: 4906935 - DNA, 15 bp, Homo sapiens
tgaggagccaggccg

SEQ ID NO: 4906936 - DNA, 11 bp, Homo sapiens
tgaggagctgc

SEQ ID NO: 4906937 - DNA, 14 bp, Homo sapiens
tgaggagctgctgg

SEQ ID NO: 4906938 - DNA, 15 bp, Homo sapiens
tgaggagctgctggc

SEQ ID NO: 4906939 - DNA, 17 bp, Homo sapiens
tgaggagctgctggctt

SEQ ID NO: 4906940 - DNA, 22 bp, Homo sapiens
tgaggaggatgtccctgggcca

SEQ ID NO: 4906941 - DNA, 20 bp, Homo sapiens
tgaggattattataaaaggg

SEQ ID NO: 4906942 - DNA, 20 bp, Homo sapiens
tgaggattattgatagtact

SEQ ID NO: 4906943 - DNA, 15 bp, Homo sapiens
tgaggcaagtgtggg

SEQ ID NO: 4906944 - DNA, 21 bp, Homo sapiens
tgaggcaatgtcaggaacaga

SEQ ID NO: 4906945 - DNA, 17 bp, Homo sapiens
tgaggctttgtgttgta

SEQ ID NO: 4906946 - DNA, 21 bp, Homo sapiens
tgagggaaagtgcatatgaaa

SEQ ID NO: 4906947 - DNA, 16 bp, Homo sapiens
tgagggactgcctctg

SEQ ID NO: 4906948 - DNA, 20 bp, Homo sapiens
tgagggaggacctggggcac

SEQ ID NO: 4906949 - DNA, 23 bp, Homo sapiens
tgagggaggacctggggcacagt

SEQ ID NO: 4906950 - DNA, 19 bp, Homo sapiens
tgagggatgggcctggcat

SEQ ID NO: 4906951 - DNA, 21 bp, Homo sapiens
tgagggcccagagcaggaagc

SEQ ID NO: 4906952 - DNA, 20 bp, Homo sapiens
tgaggggtatatctgggctg

SEQ ID NO: 4906953 - DNA, 16 bp, Homo sapiens
tgaggtcagagcctgc

SEQ ID NO: 4906954 - DNA, 17 bp, Homo sapiens
tgaggtcagagcctgca

SEQ ID NO: 4906955 - DNA, 18 bp, Homo sapiens
tgaggtcagagcctgcag

SEQ ID NO: 4906956 - DNA, 15 bp, Homo sapiens
tgaggtcccaggaag

SEQ ID NO: 4906957 - DNA, 13 bp, Homo sapiens
tgaggtcccaggc

SEQ ID NO: 4906958 - DNA, 15 bp, Homo sapiens
tgaggtcccaggcag

SEQ ID NO: 4906959 - DNA, 15 bp, Homo sapiens
tgaggtgaaagggag

SEQ ID NO: 4906960 - DNA, 12 bp, Homo sapiens
tgaggtggtagg

SEQ ID NO: 4906961 - DNA, 12 bp, Homo sapiens
tgaggtgtacca

SEQ ID NO: 4906962 - DNA, 12 bp, Homo sapiens
tgagtaaatatt

SEQ ID NO: 4906963 - DNA, 23 bp, Homo sapiens
tgagtaaatattgaggctttgtg

SEQ ID NO: 4906964 - DNA, 23 bp, Homo sapiens
tgagtacagagtgtggactctgg

SEQ ID NO: 4906965 - DNA, 15 bp, Homo sapiens
tgagtatacaatata

SEQ ID NO: 4906966 - DNA, 18 bp, Homo sapiens
tgagtcagggcccagagg

SEQ ID NO: 4906967 - DNA, 15 bp, Homo sapiens
tgagtccttgaaaat

SEQ ID NO: 4906968 - DNA, 16 bp, Homo sapiens
tgagtccttgaaaata

SEQ ID NO: 4906969 - DNA, 15 bp, Homo sapiens
tgagtcgaggacagg

SEQ ID NO: 4906970 - DNA, 19 bp, Homo sapiens
tgagtcgaggacagggagg

SEQ ID NO: 4906971 - DNA, 15 bp, Homo sapiens
tgagtctagatgttt

SEQ ID NO: 4906972 - DNA, 14 bp, Homo sapiens
tgagtctctggggc

SEQ ID NO: 4906973 - DNA, 15 bp, Homo sapiens
tgagtctgttgtgtg

SEQ ID NO: 4906974 - DNA, 17 bp, Homo sapiens
tgagtctttggttctaa

SEQ ID NO: 4906975 - DNA, 20 bp, Homo sapiens
tgagtctttggttctaagga

SEQ ID NO: 4906976 - DNA, 14 bp, Homo sapiens
tgagtgagcctggc

SEQ ID NO: 4906977 - DNA, 14 bp, Homo sapiens
tgagtggccaggga

SEQ ID NO: 4906978 - DNA, 12 bp, Homo sapiens
tgagtgggagaa

SEQ ID NO: 4906979 - DNA, 21 bp, Homo sapiens
tgagtggggttatctctgtgt

SEQ ID NO: 4906980 - DNA, 15 bp, Homo sapiens
tgagtgtgacagggc

SEQ ID NO: 4906981 - DNA, 15 bp, Homo sapiens
tgagtgtgtgtgtgc

SEQ ID NO: 4906982 - DNA, 14 bp, Homo sapiens
tgagtgtttggggg

SEQ ID NO: 4906983 - DNA, 17 bp, Homo sapiens
tgagttcataccctgtt

SEQ ID NO: 4906984 - DNA, 20 bp, Homo sapiens
tgagttctacataagtaatt

SEQ ID NO: 4906985 - DNA, 16 bp, Homo sapiens
tgagttgattgagaag

SEQ ID NO: 4906986 - DNA, 17 bp, Homo sapiens
tgagttgccaagacaaa

SEQ ID NO: 4906987 - DNA, 14 bp, Homo sapiens
tgagtttaaagcaa

SEQ ID NO: 4906988 - DNA, 22 bp, Homo sapiens
tgagtttgcttatgtaatctca

SEQ ID NO: 4906989 - DNA, 23 bp, Homo sapiens
tgagttttctctttgtggggctt

SEQ ID NO: 4906990 - DNA, 13 bp, Homo sapiens
tgataaagcctca

SEQ ID NO: 4906991 - DNA, 21 bp, Homo sapiens
tgataactgtttatatgtgtt

SEQ ID NO: 4906992 - DNA, 19 bp, Homo sapiens
tgataagttcctttccttt

SEQ ID NO: 4906993 - DNA, 15 bp, Homo sapiens
tgataataaattgaa

SEQ ID NO: 4906994 - DNA, 16 bp, Homo sapiens
tgataataatattgtt

SEQ ID NO: 4906995 - DNA, 14 bp, Homo sapiens
tgataatagattct

SEQ ID NO: 4906996 - DNA, 17 bp, Homo sapiens
tgataatgttaaatttg

SEQ ID NO: 4906997 - DNA, 18 bp, Homo sapiens
tgataatgttaaatttgt

SEQ ID NO: 4906998 - DNA, 22 bp, Homo sapiens
tgataatgttaaatttgtaagt

SEQ ID NO: 4906999 - DNA, 18 bp, Homo sapiens
tgataatttaagagctaa

SEQ ID NO: 4907000 - DNA, 16 bp, Homo sapiens
tgatacaatgaacact

SEQ ID NO: 4907001 - DNA, 14 bp, Homo sapiens
tgatacataactaa

SEQ ID NO: 4907002 - DNA, 15 bp, Homo sapiens
tgatacataactaaa

SEQ ID NO: 4907003 - DNA, 15 bp, Homo sapiens
tgatacccccctctg

SEQ ID NO: 4907004 - DNA, 18 bp, Homo sapiens
tgatacccccctctgtct

SEQ ID NO: 4907005 - DNA, 19 bp, Homo sapiens
tgatacccccctctgtctt

SEQ ID NO: 4907006 - DNA, 16 bp, Homo sapiens
tgatacccctggggaa

SEQ ID NO: 4907007 - DNA, 21 bp, Homo sapiens
tgatactatcatactactgaa

SEQ ID NO: 4907008 - DNA, 16 bp, Homo sapiens
tgatacttatattttc

SEQ ID NO: 4907009 - DNA, 18 bp, Homo sapiens
tgatagacaattgaggta

SEQ ID NO: 4907010 - DNA, 18 bp, Homo sapiens
tgatagctaacattttaa

SEQ ID NO: 4907011 - DNA, 21 bp, Homo sapiens
tgatagctaacattttaaata

SEQ ID NO: 4907012 - DNA, 18 bp, Homo sapiens
tgatagttgattttcaaa

SEQ ID NO: 4907013 - DNA, 14 bp, Homo sapiens
tgatataaattctg

SEQ ID NO: 4907014 - DNA, 12 bp, Homo sapiens
tgatatgagtat

SEQ ID NO: 4907015 - DNA, 18 bp, Homo sapiens
tgatatgagtatacaata

SEQ ID NO: 4907016 - DNA, 15 bp, Homo sapiens
tgatatggcagaaga

SEQ ID NO: 4907017 - DNA, 17 bp, Homo sapiens
tgatattctaagactta

SEQ ID NO: 4907018 - DNA, 19 bp, Homo sapiens
tgatattttacctcttatt

SEQ ID NO: 4907019 - DNA, 19 bp, Homo sapiens
tgatattttcaacgcagcc

SEQ ID NO: 4907020 - DNA, 21 bp, Homo sapiens
tgatattttcaacgcagccct

SEQ ID NO: 4907021 - DNA, 15 bp, Homo sapiens
tgatcaactcttcga

SEQ ID NO: 4907022 - DNA, 20 bp, Homo sapiens
tgatcaattatagtttctga

SEQ ID NO: 4907023 - DNA, 20 bp, Homo sapiens
tgatcataaactgactatca

SEQ ID NO: 4907024 - DNA, 16 bp, Homo sapiens
tgatcatgttgttaaa

SEQ ID NO: 4907025 - DNA, 20 bp, Homo sapiens
tgatcatttattttaagcac

SEQ ID NO: 4907026 - DNA, 23 bp, Homo sapiens
tgatcatttattttaagcactct

SEQ ID NO: 4907027 - DNA, 16 bp, Homo sapiens
tgatccacccaaccct

SEQ ID NO: 4907028 - DNA, 20 bp, Homo sapiens
tgatccacccacctcagcct

SEQ ID NO: 4907029 - DNA, 21 bp, Homo sapiens
tgatccacccacctcagcctc

SEQ ID NO: 4907030 - DNA, 20 bp, Homo sapiens
tgatccccaagtggtgaatg

SEQ ID NO: 4907031 - DNA, 15 bp, Homo sapiens
tgatcctcccacctc

SEQ ID NO: 4907032 - DNA, 16 bp, Homo sapiens
tgatcctcccacctca

SEQ ID NO: 4907033 - DNA, 19 bp, Homo sapiens
tgatcctcccacctcagcc

SEQ ID NO: 4907034 - DNA, 21 bp, Homo sapiens
tgatcctcccacctcagcctc

SEQ ID NO: 4907035 - DNA, 17 bp, Homo sapiens
tgatcgcacaacctgca

SEQ ID NO: 4907036 - DNA, 16 bp, Homo sapiens
tgatctcaaactatga

SEQ ID NO: 4907037 - DNA, 14 bp, Homo sapiens
tgatctcttcctgt

SEQ ID NO: 4907038 - DNA, 21 bp, Homo sapiens
tgatcttggcttactgcagcc

SEQ ID NO: 4907039 - DNA, 18 bp, Homo sapiens
tgatctttgcagacaggc

SEQ ID NO: 4907040 - DNA, 21 bp, Homo sapiens
tgatctttgcagacaggcaag

SEQ ID NO: 4907041 - DNA, 14 bp, Homo sapiens
tgatcttttaaagt

SEQ ID NO: 4907042 - DNA, 17 bp, Homo sapiens
tgatgaacttattctgt

SEQ ID NO: 4907043 - DNA, 23 bp, Homo sapiens
tgatgaactttctcttcatactt

SEQ ID NO: 4907044 - DNA, 15 bp, Homo sapiens
tgatgaagcaaggaa

SEQ ID NO: 4907045 - DNA, 14 bp, Homo sapiens
tgatgaccaaagtc

SEQ ID NO: 4907046 - DNA, 15 bp, Homo sapiens
tgatgagaatttcta

SEQ ID NO: 4907047 - DNA, 16 bp, Homo sapiens
tgatgagaatttctaa

SEQ ID NO: 4907048 - DNA, 23 bp, Homo sapiens
tgatgagaatttctaaaaagatt

SEQ ID NO: 4907049 - DNA, 19 bp, Homo sapiens
tgatgcagcatttgataat

SEQ ID NO: 4907050 - DNA, 21 bp, Homo sapiens
tgatgcatgtggtttggttcc

SEQ ID NO: 4907051 - DNA, 14 bp, Homo sapiens
tgatgccaggacac

SEQ ID NO: 4907052 - DNA, 21 bp, Homo sapiens
tgatgctgagattcttcaggc

SEQ ID NO: 4907053 - DNA, 20 bp, Homo sapiens
tgatggaccttctagaatta

SEQ ID NO: 4907054 - DNA, 15 bp, Homo sapiens
tgatggcaattttgt

SEQ ID NO: 4907055 - DNA, 21 bp, Homo sapiens
tgatgggcaacccccagcctg

SEQ ID NO: 4907056 - DNA, 22 bp, Homo sapiens
tgatgggcaacccccagcctgc

SEQ ID NO: 4907057 - DNA, 22 bp, Homo sapiens
tgatgtaatctctctgcagctg

SEQ ID NO: 4907058 - DNA, 18 bp, Homo sapiens
tgatgtaccatgaaacaa

SEQ ID NO: 4907059 - DNA, 20 bp, Homo sapiens
tgatgtattctagctaatgt

SEQ ID NO: 4907060 - DNA, 17 bp, Homo sapiens
tgatgtcattaatgtgt

SEQ ID NO: 4907061 - DNA, 18 bp, Homo sapiens
tgatgtgtttatttatag

SEQ ID NO: 4907062 - DNA, 14 bp, Homo sapiens
tgatgttctaaggc

SEQ ID NO: 4907063 - DNA, 19 bp, Homo sapiens
tgatgttctaaggctctga

SEQ ID NO: 4907064 - DNA, 20 bp, Homo sapiens
tgatgttctaaggctctgag

SEQ ID NO: 4907065 - DNA, 21 bp, Homo sapiens
tgatgttctaaggctctgaga

SEQ ID NO: 4907066 - DNA, 22 bp, Homo sapiens
tgatgttctaaggctctgagag

SEQ ID NO: 4907067 - DNA, 16 bp, Homo sapiens
tgatgtttgtggcctc

SEQ ID NO: 4907068 - DNA, 17 bp, Homo sapiens
tgatgtttgtggcctca

SEQ ID NO: 4907069 - DNA, 17 bp, Homo sapiens
tgattaaataagattct

SEQ ID NO: 4907070 - DNA, 20 bp, Homo sapiens
tgattaaataagattctaac

SEQ ID NO: 4907071 - DNA, 22 bp, Homo sapiens
tgattaaataagattctaacgg

SEQ ID NO: 4907072 - DNA, 14 bp, Homo sapiens
tgattaacagagag

SEQ ID NO: 4907073 - DNA, 17 bp, Homo sapiens
tgattaagattttacaa

SEQ ID NO: 4907074 - DNA, 11 bp, Homo sapiens
tgattagatga

SEQ ID NO: 4907075 - DNA, 15 bp, Homo sapiens
tgattagctttgtgt

SEQ ID NO: 4907076 - DNA, 18 bp, Homo sapiens
tgattagctttgtgtttg

SEQ ID NO: 4907077 - DNA, 19 bp, Homo sapiens
tgattagctttgtgtttgg

SEQ ID NO: 4907078 - DNA, 16 bp, Homo sapiens
tgattatttattattt

SEQ ID NO: 4907079 - DNA, 11 bp, Homo sapiens
tgattcaaatg

SEQ ID NO: 4907080 - DNA, 24 bp, Homo sapiens
tgattcaccaaaatagtcttctca

SEQ ID NO: 4907081 - DNA, 17 bp, Homo sapiens
tgattcactgcatggct

SEQ ID NO: 4907082 - DNA, 19 bp, Homo sapiens
tgattcatagtaacttctt

SEQ ID NO: 4907083 - DNA, 15 bp, Homo sapiens
tgattcccaagctct

SEQ ID NO: 4907084 - DNA, 19 bp, Homo sapiens
tgattcccaagctctgctc

SEQ ID NO: 4907085 - DNA, 22 bp, Homo sapiens
tgattcccaagctctgctcctc

SEQ ID NO: 4907086 - DNA, 17 bp, Homo sapiens
tgattccttttttcaaa

SEQ ID NO: 4907087 - DNA, 22 bp, Homo sapiens
tgattctatttatatgtacatg

SEQ ID NO: 4907088 - DNA, 15 bp, Homo sapiens
tgattctcctgcctc

SEQ ID NO: 4907089 - DNA, 20 bp, Homo sapiens
tgattctcctgcctcagcct

SEQ ID NO: 4907090 - DNA, 23 bp, Homo sapiens
tgattctttttaaagtgtttctg

SEQ ID NO: 4907091 - DNA, 15 bp, Homo sapiens
tgattgcacattgtt

SEQ ID NO: 4907092 - DNA, 19 bp, Homo sapiens
tgattggaatagcttctgg

SEQ ID NO: 4907093 - DNA, 23 bp, Homo sapiens
tgattggcttgtagaattgttat

SEQ ID NO: 4907094 - DNA, 17 bp, Homo sapiens
tgattggtgcaaccctt

SEQ ID NO: 4907095 - DNA, 15 bp, Homo sapiens
tgatttaaacacaca

SEQ ID NO: 4907096 - DNA, 13 bp, Homo sapiens
tgatttaataaaa

SEQ ID NO: 4907097 - DNA, 15 bp, Homo sapiens
tgatttaataaaata

SEQ ID NO: 4907098 - DNA, 21 bp, Homo sapiens
tgatttaataaaataattcta

SEQ ID NO: 4907099 - DNA, 14 bp, Homo sapiens
tgatttaatatgga

SEQ ID NO: 4907100 - DNA, 20 bp, Homo sapiens
tgatttacagcaagtagata

SEQ ID NO: 4907101 - DNA, 22 bp, Homo sapiens
tgatttatagtttgtacatgca

SEQ ID NO: 4907102 - DNA, 14 bp, Homo sapiens
tgatttccttgaat

SEQ ID NO: 4907103 - DNA, 17 bp, Homo sapiens
tgatttccttgaatgtg

SEQ ID NO: 4907104 - DNA, 20 bp, Homo sapiens
tgatttggtgaccaactgtc

SEQ ID NO: 4907105 - DNA, 18 bp, Homo sapiens
tgatttgtactgaaaaat

SEQ ID NO: 4907106 - DNA, 18 bp, Homo sapiens
tgatttgtagtggaaaca

SEQ ID NO: 4907107 - DNA, 22 bp, Homo sapiens
tgattttaggagctaaggctct

SEQ ID NO: 4907108 - DNA, 19 bp, Homo sapiens
tgattttcaagcagcatct

SEQ ID NO: 4907109 - DNA, 20 bp, Homo sapiens
tgatttttatgatgatgaaa

SEQ ID NO: 4907110 - DNA, 22 bp, Homo sapiens
tgatttttctaaccttgaatgc

SEQ ID NO: 4907111 - DNA, 13 bp, Homo sapiens
tgatttttgtctc

SEQ ID NO: 4907112 - DNA, 15 bp, Homo sapiens
tgcaaaaagaaatga

SEQ ID NO: 4907113 - DNA, 14 bp, Homo sapiens
tgcaaaacctttga

SEQ ID NO: 4907114 - DNA, 22 bp, Homo sapiens
tgcaaaaggttcactaaagcag

SEQ ID NO: 4907115 - DNA, 14 bp, Homo sapiens
tgcaaacagaacag

SEQ ID NO: 4907116 - DNA, 18 bp, Homo sapiens
tgcaaacagaacagggtc

SEQ ID NO: 4907117 - DNA, 23 bp, Homo sapiens
tgcaaagtacaatgtgtttttct

SEQ ID NO: 4907118 - DNA, 19 bp, Homo sapiens
tgcaaagttctgtgtttaa

SEQ ID NO: 4907119 - DNA, 16 bp, Homo sapiens
tgcaaatataaacatc

SEQ ID NO: 4907120 - DNA, 14 bp, Homo sapiens
tgcaaatcttgaaa

SEQ ID NO: 4907121 - DNA, 23 bp, Homo sapiens
tgcaacatttacagtccttcaaa

SEQ ID NO: 4907122 - DNA, 14 bp, Homo sapiens
tgcaaccacacacc

SEQ ID NO: 4907123 - DNA, 16 bp, Homo sapiens
tgcaacccaaggactg

SEQ ID NO: 4907124 - DNA, 14 bp, Homo sapiens
tgcaacctccgcct

SEQ ID NO: 4907125 - DNA, 20 bp, Homo sapiens
tgcaacctccgcctcttggg

SEQ ID NO: 4907126 - DNA, 20 bp, Homo sapiens
tgcaagagtgattgcagctt

SEQ ID NO: 4907127 - DNA, 19 bp, Homo sapiens
tgcaagcaggactttgagg

SEQ ID NO: 4907128 - DNA, 12 bp, Homo sapiens
tgcaaggaagga

SEQ ID NO: 4907129 - DNA, 15 bp, Homo sapiens
tgcaaggaaggaaag

SEQ ID NO: 4907130 - DNA, 15 bp, Homo sapiens
tgcaaggaccaggac

SEQ ID NO: 4907131 - DNA, 17 bp, Homo sapiens
tgcaaggcactgtacta

SEQ ID NO: 4907132 - DNA, 14 bp, Homo sapiens
tgcaaggcccacag

SEQ ID NO: 4907133 - DNA, 16 bp, Homo sapiens
tgcaaggtctttggtt

SEQ ID NO: 4907134 - DNA, 16 bp, Homo sapiens
tgcaataacttctgac

SEQ ID NO: 4907135 - DNA, 14 bp, Homo sapiens
tgcaatatttgaat

SEQ ID NO: 4907136 - DNA, 13 bp, Homo sapiens
tgcaatcatatgt

SEQ ID NO: 4907137 - DNA, 16 bp, Homo sapiens
tgcaatcatatgtgat

SEQ ID NO: 4907138 - DNA, 20 bp, Homo sapiens
tgcaatcatatgtgatctgt

SEQ ID NO: 4907139 - DNA, 22 bp, Homo sapiens
tgcaatcatatgtgatctgtct

SEQ ID NO: 4907140 - DNA, 18 bp, Homo sapiens
tgcaatggctatatggca

SEQ ID NO: 4907141 - DNA, 24 bp, Homo sapiens
tgcaatgtatcccttctcacagca

SEQ ID NO: 4907142 - DNA, 17 bp, Homo sapiens
tgcaattcaaaagttcc

SEQ ID NO: 4907143 - DNA, 19 bp, Homo sapiens
tgcaattcaaaagttccaa

SEQ ID NO: 4907144 - DNA, 13 bp, Homo sapiens
tgcaattcccctc

SEQ ID NO: 4907145 - DNA, 14 bp, Homo sapiens
tgcaatttattaaa

SEQ ID NO: 4907146 - DNA, 15 bp, Homo sapiens
tgcaatttattaaaa

SEQ ID NO: 4907147 - DNA, 20 bp, Homo sapiens
tgcaatttcaaggttctaac

SEQ ID NO: 4907148 - DNA, 14 bp, Homo sapiens
tgcaatttcatatg

SEQ ID NO: 4907149 - DNA, 23 bp, Homo sapiens
tgcacaaaatgaatgaggtctgg

SEQ ID NO: 4907150 - DNA, 17 bp, Homo sapiens
tgcacaaagcccttcca

SEQ ID NO: 4907151 - DNA, 12 bp, Homo sapiens
tgcacaaggatt

SEQ ID NO: 4907152 - DNA, 15 bp, Homo sapiens
tgcacacaccagagc

SEQ ID NO: 4907153 - DNA, 19 bp, Homo sapiens
tgcacacagaaatatatat

SEQ ID NO: 4907154 - DNA, 12 bp, Homo sapiens
tgcacagagaag

SEQ ID NO: 4907155 - DNA, 19 bp, Homo sapiens
tgcacagagaagctgggga

SEQ ID NO: 4907156 - DNA, 11 bp, Homo sapiens
tgcacagctgt

SEQ ID NO: 4907157 - DNA, 12 bp, Homo sapiens
tgcacagctgtc

SEQ ID NO: 4907158 - DNA, 19 bp, Homo sapiens
tgcacagtgcatctcagcc

SEQ ID NO: 4907159 - DNA, 15 bp, Homo sapiens
tgcacatatggactc

SEQ ID NO: 4907160 - DNA, 17 bp, Homo sapiens
tgcacatatggactctg

SEQ ID NO: 4907161 - DNA, 22 bp, Homo sapiens
tgcacatgtcttgtacatgtgt

SEQ ID NO: 4907162 - DNA, 14 bp, Homo sapiens
tgcacattttgatt

SEQ ID NO: 4907163 - DNA, 15 bp, Homo sapiens
tgcacattttgattt

SEQ ID NO: 4907164 - DNA, 23 bp, Homo sapiens
tgcaccagagcaacctctcactc

SEQ ID NO: 4907165 - DNA, 20 bp, Homo sapiens
tgcacccatgggctctgaca

SEQ ID NO: 4907166 - DNA, 22 bp, Homo sapiens
tgcaccctggggcctggacctg

SEQ ID NO: 4907167 - DNA, 13 bp, Homo sapiens
tgcacccttcttt

SEQ ID NO: 4907168 - DNA, 17 bp, Homo sapiens
tgcacccttcttttctc

SEQ ID NO: 4907169 - DNA, 18 bp, Homo sapiens
tgcacccttcttttctca

SEQ ID NO: 4907170 - DNA, 14 bp, Homo sapiens
tgcaccgggccaca

SEQ ID NO: 4907171 - DNA, 17 bp, Homo sapiens
tgcaccgggccacagag

SEQ ID NO: 4907172 - DNA, 19 bp, Homo sapiens
tgcacctagctgtgcaaga

SEQ ID NO: 4907173 - DNA, 19 bp, Homo sapiens
tgcaccttaccaactttct

SEQ ID NO: 4907174 - DNA, 20 bp, Homo sapiens
tgcaccttaccaactttctg

SEQ ID NO: 4907175 - DNA, 15 bp, Homo sapiens
tgcacgacgccctct

SEQ ID NO: 4907176 - DNA, 15 bp, Homo sapiens
tgcacgtgtgtgcac

SEQ ID NO: 4907177 - DNA, 19 bp, Homo sapiens
tgcactaaagccagcctga

SEQ ID NO: 4907178 - DNA, 22 bp, Homo sapiens
tgcactatagcctaggtgacag

SEQ ID NO: 4907179 - DNA, 23 bp, Homo sapiens
tgcactatagcctaggtgacaga

SEQ ID NO: 4907180 - DNA, 12 bp, Homo sapiens
tgcactgaccct

SEQ ID NO: 4907181 - DNA, 20 bp, Homo sapiens
tgcactgacccttccagaca

SEQ ID NO: 4907182 - DNA, 23 bp, Homo sapiens
tgcactgacccttccagacatac

SEQ ID NO: 4907183 - DNA, 16 bp, Homo sapiens
tgcacttaaggcactc

SEQ ID NO: 4907184 - DNA, 23 bp, Homo sapiens
tgcagaactgccattattttctg

SEQ ID NO: 4907185 - DNA, 21 bp, Homo sapiens
tgcagacagaagtctcctcaa

SEQ ID NO: 4907186 - DNA, 12 bp, Homo sapiens
tgcagacaggca

SEQ ID NO: 4907187 - DNA, 22 bp, Homo sapiens
tgcagacaggcaagcacctcct

SEQ ID NO: 4907188 - DNA, 17 bp, Homo sapiens
tgcagactctacagagg

SEQ ID NO: 4907189 - DNA, 19 bp, Homo sapiens
tgcagactctacagaggcc

SEQ ID NO: 4907190 - DNA, 16 bp, Homo sapiens
tgcagagagccatttt

SEQ ID NO: 4907191 - DNA, 21 bp, Homo sapiens
tgcagagagccattttgtgaa

SEQ ID NO: 4907192 - DNA, 23 bp, Homo sapiens
tgcagagcacctttgcacaggat

SEQ ID NO: 4907193 - DNA, 18 bp, Homo sapiens
tgcagcaaggccctgctg

SEQ ID NO: 4907194 - DNA, 17 bp, Homo sapiens
tgcagcacggacaataa

SEQ ID NO: 4907195 - DNA, 20 bp, Homo sapiens
tgcagcaggagtggtgcaga

SEQ ID NO: 4907196 - DNA, 16 bp, Homo sapiens
tgcagcatggtccctg

SEQ ID NO: 4907197 - DNA, 14 bp, Homo sapiens
tgcagcccatgccc

SEQ ID NO: 4907198 - DNA, 19 bp, Homo sapiens
tgcagcctcaacctcctgg

SEQ ID NO: 4907199 - DNA, 12 bp, Homo sapiens
tgcagcgcagct

SEQ ID NO: 4907200 - DNA, 16 bp, Homo sapiens
tgcagctcactaccct

SEQ ID NO: 4907201 - DNA, 13 bp, Homo sapiens
tgcagctggacag

SEQ ID NO: 4907202 - DNA, 15 bp, Homo sapiens
tgcagctggacagag

SEQ ID NO: 4907203 - DNA, 18 bp, Homo sapiens
tgcagctggacagagggg

SEQ ID NO: 4907204 - DNA, 11 bp, Homo sapiens
tgcagcttcct

SEQ ID NO: 4907205 - DNA, 16 bp, Homo sapiens
tgcagcttgggagagc

SEQ ID NO: 4907206 - DNA, 22 bp, Homo sapiens
tgcagcttgggagagcccctgg

SEQ ID NO: 4907207 - DNA, 15 bp, Homo sapiens
tgcagctttacatgc

SEQ ID NO: 4907208 - DNA, 22 bp, Homo sapiens
tgcagctttatgttcatttgtt

SEQ ID NO: 4907209 - DNA, 12 bp, Homo sapiens
tgcaggaatcaa

SEQ ID NO: 4907210 - DNA, 20 bp, Homo sapiens
tgcaggcacttattgtaaat

SEQ ID NO: 4907211 - DNA, 20 bp, Homo sapiens
tgcagggagggcagttttct

SEQ ID NO: 4907212 - DNA, 22 bp, Homo sapiens
tgcagggcaaaatattcactgg

SEQ ID NO: 4907213 - DNA, 14 bp, Homo sapiens
tgcagggcagcccc

SEQ ID NO: 4907214 - DNA, 12 bp, Homo sapiens
tgcagggccagg

SEQ ID NO: 4907215 - DNA, 13 bp, Homo sapiens
tgcagggccagga

SEQ ID NO: 4907216 - DNA, 21 bp, Homo sapiens
tgcaggggctctggagagaaa

SEQ ID NO: 4907217 - DNA, 14 bp, Homo sapiens
tgcaggggtgacgg

SEQ ID NO: 4907218 - DNA, 20 bp, Homo sapiens
tgcaggttggaccccagaga

SEQ ID NO: 4907219 - DNA, 15 bp, Homo sapiens
tgcagtaaatctttt

SEQ ID NO: 4907220 - DNA, 13 bp, Homo sapiens
tgcagtctcctct

SEQ ID NO: 4907221 - DNA, 17 bp, Homo sapiens
tgcagtctcctctttaa

SEQ ID NO: 4907222 - DNA, 17 bp, Homo sapiens
tgcagtgatatggcaga

SEQ ID NO: 4907223 - DNA, 21 bp, Homo sapiens
tgcagtgatatggcagaagac

SEQ ID NO: 4907224 - DNA, 22 bp, Homo sapiens
tgcagtgatatggcagaagaca

SEQ ID NO: 4907225 - DNA, 17 bp, Homo sapiens
tgcagtgttcgcttggc

SEQ ID NO: 4907226 - DNA, 18 bp, Homo sapiens
tgcagttcagcaccaccc

SEQ ID NO: 4907227 - DNA, 19 bp, Homo sapiens
tgcagttcagcaccaccct

SEQ ID NO: 4907228 - DNA, 14 bp, Homo sapiens
tgcagtttttcagg

SEQ ID NO: 4907229 - DNA, 13 bp, Homo sapiens
tgcataaatatgc

SEQ ID NO: 4907230 - DNA, 14 bp, Homo sapiens
tgcatagtgctggg

SEQ ID NO: 4907231 - DNA, 15 bp, Homo sapiens
tgcatatgttgaata

SEQ ID NO: 4907232 - DNA, 17 bp, Homo sapiens
tgcatatgttgaatact

SEQ ID NO: 4907233 - DNA, 20 bp, Homo sapiens
tgcatcagtattaatactaa

SEQ ID NO: 4907234 - DNA, 14 bp, Homo sapiens
tgcatccagaggca

SEQ ID NO: 4907235 - DNA, 19 bp, Homo sapiens
tgcatcccagcacctgcct

SEQ ID NO: 4907236 - DNA, 16 bp, Homo sapiens
tgcatccccttggctg

SEQ ID NO: 4907237 - DNA, 13 bp, Homo sapiens
tgcatccttccta

SEQ ID NO: 4907238 - DNA, 18 bp, Homo sapiens
tgcatcttatagcacttt

SEQ ID NO: 4907239 - DNA, 18 bp, Homo sapiens
tgcatgaagagaagcaat

SEQ ID NO: 4907240 - DNA, 21 bp, Homo sapiens
tgcatgaagagaagcaatttt

SEQ ID NO: 4907241 - DNA, 22 bp, Homo sapiens
tgcatgaagagaagcaattttg

SEQ ID NO: 4907242 - DNA, 15 bp, Homo sapiens
tgcatgacagcctct

SEQ ID NO: 4907243 - DNA, 13 bp, Homo sapiens
tgcatggaggccc

SEQ ID NO: 4907244 - DNA, 16 bp, Homo sapiens
tgcatggctccagaaa

SEQ ID NO: 4907245 - DNA, 13 bp, Homo sapiens
tgcatgtatgtct

SEQ ID NO: 4907246 - DNA, 20 bp, Homo sapiens
tgcatgtcaaacatgagatg

SEQ ID NO: 4907247 - DNA, 11 bp, Homo sapiens
tgcatgtgtgt

SEQ ID NO: 4907248 - DNA, 14 bp, Homo sapiens
tgcatgtgtgtgtg

SEQ ID NO: 4907249 - DNA, 16 bp, Homo sapiens
tgcatgtttgaaatga

SEQ ID NO: 4907250 - DNA, 17 bp, Homo sapiens
tgcattaaattcacaaa

SEQ ID NO: 4907251 - DNA, 19 bp, Homo sapiens
tgcattaaattcacaaact

SEQ ID NO: 4907252 - DNA, 20 bp, Homo sapiens
tgcattaaattcacaaactt

SEQ ID NO: 4907253 - DNA, 21 bp, Homo sapiens
tgcattaaattcacaaacttt

SEQ ID NO: 4907254 - DNA, 14 bp, Homo sapiens
tgcattagcacaga

SEQ ID NO: 4907255 - DNA, 17 bp, Homo sapiens
tgcattagcacagattt

SEQ ID NO: 4907256 - DNA, 19 bp, Homo sapiens
tgcattagcacagatttta

SEQ ID NO: 4907257 - DNA, 23 bp, Homo sapiens
tgcattattcatttagtgagtta

SEQ ID NO: 4907258 - DNA, 15 bp, Homo sapiens
tgcattattctcttt

SEQ ID NO: 4907259 - DNA, 16 bp, Homo sapiens
tgcattcctttgtctt

SEQ ID NO: 4907260 - DNA, 18 bp, Homo sapiens
tgcattcctttgtcttca

SEQ ID NO: 4907261 - DNA, 17 bp, Homo sapiens
tgcattctattgccttc

SEQ ID NO: 4907262 - DNA, 14 bp, Homo sapiens
tgcattgaacacaa

SEQ ID NO: 4907263 - DNA, 13 bp, Homo sapiens
tgcatttatatgt

SEQ ID NO: 4907264 - DNA, 21 bp, Homo sapiens
tgccaaagctagggtggccct

SEQ ID NO: 4907265 - DNA, 14 bp, Homo sapiens
tgccaaagggaaat

SEQ ID NO: 4907266 - DNA, 14 bp, Homo sapiens
tgccaaatctggct

SEQ ID NO: 4907267 - DNA, 18 bp, Homo sapiens
tgccaacaccacagaaat

SEQ ID NO: 4907268 - DNA, 21 bp, Homo sapiens
tgccaacaccacagaaatggg

SEQ ID NO: 4907269 - DNA, 21 bp, Homo sapiens
tgccaagaaaagggctgacat

SEQ ID NO: 4907270 - DNA, 16 bp, Homo sapiens
tgccaagacaaatcaa

SEQ ID NO: 4907271 - DNA, 17 bp, Homo sapiens
tgccaagacaaatcaac

SEQ ID NO: 4907272 - DNA, 19 bp, Homo sapiens
tgccaagacaaatcaacag

SEQ ID NO: 4907273 - DNA, 12 bp, Homo sapiens
tgccaagagagg

SEQ ID NO: 4907274 - DNA, 22 bp, Homo sapiens
tgccaaggccagagtggcctgg

SEQ ID NO: 4907275 - DNA, 18 bp, Homo sapiens
tgccaatattaaatctgc

SEQ ID NO: 4907276 - DNA, 14 bp, Homo sapiens
tgccacaccctccc

SEQ ID NO: 4907277 - DNA, 14 bp, Homo sapiens
tgccacactctcca

SEQ ID NO: 4907278 - DNA, 13 bp, Homo sapiens
tgccacacttcag

SEQ ID NO: 4907279 - DNA, 23 bp, Homo sapiens
tgccacacttcaggctcttctcc

SEQ ID NO: 4907280 - DNA, 12 bp, Homo sapiens
tgccaccaggag

SEQ ID NO: 4907281 - DNA, 13 bp, Homo sapiens
tgccaccaggaga

SEQ ID NO: 4907282 - DNA, 22 bp, Homo sapiens
tgccaccaggagaaccactaca

SEQ ID NO: 4907283 - DNA, 18 bp, Homo sapiens
tgccaccatggccagcca

SEQ ID NO: 4907284 - DNA, 20 bp, Homo sapiens
tgccaccccaccctccctgg

SEQ ID NO: 4907285 - DNA, 21 bp, Homo sapiens
tgccaccccaccctccctgga

SEQ ID NO: 4907286 - DNA, 21 bp, Homo sapiens
tgccacttgaacaaaatctgt

SEQ ID NO: 4907287 - DNA, 22 bp, Homo sapiens
tgccacttgaacaaaatctgtt

SEQ ID NO: 4907288 - DNA, 21 bp, Homo sapiens
tgccactttacccacctagaa

SEQ ID NO: 4907289 - DNA, 22 bp, Homo sapiens
tgccactttacccacctagaac

SEQ ID NO: 4907290 - DNA, 15 bp, Homo sapiens
tgccactttgcacat

SEQ ID NO: 4907291 - DNA, 19 bp, Homo sapiens
tgccactttgcacattttg

SEQ ID NO: 4907292 - DNA, 10 bp, Homo sapiens
tgccagcagc

SEQ ID NO: 4907293 - DNA, 14 bp, Homo sapiens
tgccagcagcagca

SEQ ID NO: 4907294 - DNA, 16 bp, Homo sapiens
tgccagcagcagcagg

SEQ ID NO: 4907295 - DNA, 17 bp, Homo sapiens
tgccagccccacacagc

SEQ ID NO: 4907296 - DNA, 19 bp, Homo sapiens
tgccagctacttcctcctc

SEQ ID NO: 4907297 - DNA, 21 bp, Homo sapiens
tgccaggaacctgtcctaagg

SEQ ID NO: 4907298 - DNA, 11 bp, Homo sapiens
tgccagggagc

SEQ ID NO: 4907299 - DNA, 19 bp, Homo sapiens
tgccagggcagtgctagtg

SEQ ID NO: 4907300 - DNA, 16 bp, Homo sapiens
tgccagggccgaccag

SEQ ID NO: 4907301 - DNA, 17 bp, Homo sapiens
tgccagtcaagaagaaa

SEQ ID NO: 4907302 - DNA, 17 bp, Homo sapiens
tgccatactttgtctga

SEQ ID NO: 4907303 - DNA, 18 bp, Homo sapiens
tgccatactttgtctgaa

SEQ ID NO: 4907304 - DNA, 15 bp, Homo sapiens
tgccatattctgttg

SEQ ID NO: 4907305 - DNA, 20 bp, Homo sapiens
tgccatattctgttggccag

SEQ ID NO: 4907306 - DNA, 15 bp, Homo sapiens
tgccatcctctttct

SEQ ID NO: 4907307 - DNA, 16 bp, Homo sapiens
tgccatctgtgtcctg

SEQ ID NO: 4907308 - DNA, 20 bp, Homo sapiens
tgccatctgtgtcctggtta

SEQ ID NO: 4907309 - DNA, 20 bp, Homo sapiens
tgccatgggcttcactgtat

SEQ ID NO: 4907310 - DNA, 22 bp, Homo sapiens
tgccatgggcttcactgtataa

SEQ ID NO: 4907311 - DNA, 18 bp, Homo sapiens
tgccatgtacctcccctg

SEQ ID NO: 4907312 - DNA, 17 bp, Homo sapiens
tgccatgtgtgctgaac

SEQ ID NO: 4907313 - DNA, 12 bp, Homo sapiens
tgccatgttggc

SEQ ID NO: 4907314 - DNA, 23 bp, Homo sapiens
tgccattatccctgaatccccct

SEQ ID NO: 4907315 - DNA, 19 bp, Homo sapiens
tgccattattttctgtcag

SEQ ID NO: 4907316 - DNA, 12 bp, Homo sapiens
tgccatttattt

SEQ ID NO: 4907317 - DNA, 17 bp, Homo sapiens
tgccatttgatacccct

SEQ ID NO: 4907318 - DNA, 20 bp, Homo sapiens
tgccatttgatacccctggg

SEQ ID NO: 4907319 - DNA, 19 bp, Homo sapiens
tgcccaaagagcacaaaca

SEQ ID NO: 4907320 - DNA, 22 bp, Homo sapiens
tgcccaacctgctctcctcttg

SEQ ID NO: 4907321 - DNA, 23 bp, Homo sapiens
tgcccaagaatagatgctgactg

SEQ ID NO: 4907322 - DNA, 14 bp, Homo sapiens
tgcccaagcccagg

SEQ ID NO: 4907323 - DNA, 21 bp, Homo sapiens
tgcccaagcccaggccaccct

SEQ ID NO: 4907324 - DNA, 20 bp, Homo sapiens
tgcccacaggatcagtctga

SEQ ID NO: 4907325 - DNA, 14 bp, Homo sapiens
tgcccacctgccca

SEQ ID NO: 4907326 - DNA, 17 bp, Homo sapiens
tgcccacctgcccatca

SEQ ID NO: 4907327 - DNA, 12 bp, Homo sapiens
tgcccaggcagg

SEQ ID NO: 4907328 - DNA, 14 bp, Homo sapiens
tgcccaggcaggtc

SEQ ID NO: 4907329 - DNA, 18 bp, Homo sapiens
tgcccaggcccctgccac

SEQ ID NO: 4907330 - DNA, 22 bp, Homo sapiens
tgcccaggccggccagcctcac

SEQ ID NO: 4907331 - DNA, 15 bp, Homo sapiens
tgcccaggcctgcct

SEQ ID NO: 4907332 - DNA, 11 bp, Homo sapiens
tgcccaggctg

SEQ ID NO: 4907333 - DNA, 18 bp, Homo sapiens
tgcccaggctggcgtgca

SEQ ID NO: 4907334 - DNA, 17 bp, Homo sapiens
tgcccaggctggtctca

SEQ ID NO: 4907335 - DNA, 21 bp, Homo sapiens
tgccccaaataacttcagtcc

SEQ ID NO: 4907336 - DNA, 22 bp, Homo sapiens
tgccccaaataacttcagtcct

SEQ ID NO: 4907337 - DNA, 23 bp, Homo sapiens
tgccccaaataacttcagtcctg

SEQ ID NO: 4907338 - DNA, 14 bp, Homo sapiens
tgccccagagctgt

SEQ ID NO: 4907339 - DNA, 15 bp, Homo sapiens
tgccccagagctgtt

SEQ ID NO: 4907340 - DNA, 20 bp, Homo sapiens
tgccccagtcgttagaatat

SEQ ID NO: 4907341 - DNA, 15 bp, Homo sapiens
tgccccatgcctgtc

SEQ ID NO: 4907342 - DNA, 15 bp, Homo sapiens
tgccccccagcctct

SEQ ID NO: 4907343 - DNA, 23 bp, Homo sapiens
tgccccccatgaggaaggaacag

SEQ ID NO: 4907344 - DNA, 14 bp, Homo sapiens
tgcccccggccccc

SEQ ID NO: 4907345 - DNA, 15 bp, Homo sapiens
tgcccccggccccct

SEQ ID NO: 4907346 - DNA, 17 bp, Homo sapiens
tgcccccggccccctgg

SEQ ID NO: 4907347 - DNA, 23 bp, Homo sapiens
tgccccggccacctctgcggacc

SEQ ID NO: 4907348 - DNA, 17 bp, Homo sapiens
tgcccctcccccaaccc

SEQ ID NO: 4907349 - DNA, 14 bp, Homo sapiens
tgcccctctcacca

SEQ ID NO: 4907350 - DNA, 16 bp, Homo sapiens
tgcccctctttctctt

SEQ ID NO: 4907351 - DNA, 20 bp, Homo sapiens
tgcccgcacagcagcctgct

SEQ ID NO: 4907352 - DNA, 21 bp, Homo sapiens
tgcccggagattggacggcct

SEQ ID NO: 4907353 - DNA, 14 bp, Homo sapiens
tgcccggctgcgga

SEQ ID NO: 4907354 - DNA, 19 bp, Homo sapiens
tgcccgggcgcggccagcc

SEQ ID NO: 4907355 - DNA, 14 bp, Homo sapiens
tgcccggtcccacc

SEQ ID NO: 4907356 - DNA, 21 bp, Homo sapiens
tgccctcatggcccctctgac

SEQ ID NO: 4907357 - DNA, 18 bp, Homo sapiens
tgccctcattactgggcc

SEQ ID NO: 4907358 - DNA, 21 bp, Homo sapiens
tgccctctccttccttaccca

SEQ ID NO: 4907359 - DNA, 11 bp, Homo sapiens
tgccctgagaa

SEQ ID NO: 4907360 - DNA, 16 bp, Homo sapiens
tgccctgcccccacga

SEQ ID NO: 4907361 - DNA, 23 bp, Homo sapiens
tgccctggcagggtcatcctgtg

SEQ ID NO: 4907362 - DNA, 12 bp, Homo sapiens
tgccctggtgct

SEQ ID NO: 4907363 - DNA, 14 bp, Homo sapiens
tgccctggtgctgc

SEQ ID NO: 4907364 - DNA, 20 bp, Homo sapiens
tgccctggtgctgccacact

SEQ ID NO: 4907365 - DNA, 22 bp, Homo sapiens
tgccctggtttcactggcccaa

SEQ ID NO: 4907366 - DNA, 14 bp, Homo sapiens
tgccgaggagccag

SEQ ID NO: 4907367 - DNA, 21 bp, Homo sapiens
tgccgatatactctagatgaa

SEQ ID NO: 4907368 - DNA, 19 bp, Homo sapiens
tgccgccccctcctgaacc

SEQ ID NO: 4907369 - DNA, 18 bp, Homo sapiens
tgcctaagcattgcctgg

SEQ ID NO: 4907370 - DNA, 20 bp, Homo sapiens
tgcctaagtattaaaacatt

SEQ ID NO: 4907371 - DNA, 16 bp, Homo sapiens
tgcctagcaagctggc

SEQ ID NO: 4907372 - DNA, 18 bp, Homo sapiens
tgcctagcaagctggcct

SEQ ID NO: 4907373 - DNA, 19 bp, Homo sapiens
tgcctagcaagctggcctc

SEQ ID NO: 4907374 - DNA, 13 bp, Homo sapiens
tgcctagttttta

SEQ ID NO: 4907375 - DNA, 16 bp, Homo sapiens
tgcctagtttttagta

SEQ ID NO: 4907376 - DNA, 13 bp, Homo sapiens
tgcctcagcctcc

SEQ ID NO: 4907377 - DNA, 14 bp, Homo sapiens
tgcctcagcctccc

SEQ ID NO: 4907378 - DNA, 18 bp, Homo sapiens
tgcctcagcctcccgagt

SEQ ID NO: 4907379 - DNA, 21 bp, Homo sapiens
tgcctcagtatatttaaactc

SEQ ID NO: 4907380 - DNA, 19 bp, Homo sapiens
tgcctcctcacccccagct

SEQ ID NO: 4907381 - DNA, 24 bp, Homo sapiens
tgcctcctcacccccagctttgct

SEQ ID NO: 4907382 - DNA, 16 bp, Homo sapiens
tgcctcctcgttcctt

SEQ ID NO: 4907383 - DNA, 20 bp, Homo sapiens
tgcctcctcgttcctttctc

SEQ ID NO: 4907384 - DNA, 13 bp, Homo sapiens
tgcctcctgtggg

SEQ ID NO: 4907385 - DNA, 13 bp, Homo sapiens
tgcctcgaaacac

SEQ ID NO: 4907386 - DNA, 17 bp, Homo sapiens
tgcctcgaaacacagaa

SEQ ID NO: 4907387 - DNA, 19 bp, Homo sapiens
tgcctctcacacacataga

SEQ ID NO: 4907388 - DNA, 14 bp, Homo sapiens
tgcctctgacacac

SEQ ID NO: 4907389 - DNA, 18 bp, Homo sapiens
tgcctctgatatgggact

SEQ ID NO: 4907390 - DNA, 21 bp, Homo sapiens
tgcctctgatatgggactgag

SEQ ID NO: 4907391 - DNA, 12 bp, Homo sapiens
tgcctctgccac

SEQ ID NO: 4907392 - DNA, 13 bp, Homo sapiens
tgcctctgcctct

SEQ ID NO: 4907393 - DNA, 12 bp, Homo sapiens
tgcctctgcctg

SEQ ID NO: 4907394 - DNA, 23 bp, Homo sapiens
tgcctgaccctacttcttttgct

SEQ ID NO: 4907395 - DNA, 14 bp, Homo sapiens
tgcctgcccaggcc

SEQ ID NO: 4907396 - DNA, 17 bp, Homo sapiens
tgcctgcccaggcccct

SEQ ID NO: 4907397 - DNA, 18 bp, Homo sapiens
tgcctgcccaggcccctg

SEQ ID NO: 4907398 - DNA, 20 bp, Homo sapiens
tgcctgcccaggcccctgcc

SEQ ID NO: 4907399 - DNA, 18 bp, Homo sapiens
tgcctgccccaaacaaat

SEQ ID NO: 4907400 - DNA, 18 bp, Homo sapiens
tgcctgcccgcacagcag

SEQ ID NO: 4907401 - DNA, 19 bp, Homo sapiens
tgcctgcccgcacagcagc

SEQ ID NO: 4907402 - DNA, 22 bp, Homo sapiens
tgcctgcccgcacagcagcctg

SEQ ID NO: 4907403 - DNA, 15 bp, Homo sapiens
tgcctggccactgct

SEQ ID NO: 4907404 - DNA, 18 bp, Homo sapiens
tgcctggccactgctccc

SEQ ID NO: 4907405 - DNA, 12 bp, Homo sapiens
tgcctggccagg

SEQ ID NO: 4907406 - DNA, 16 bp, Homo sapiens
tgcctggccaggcaga

SEQ ID NO: 4907407 - DNA, 20 bp, Homo sapiens
tgcctggccaggcagatctg

SEQ ID NO: 4907408 - DNA, 21 bp, Homo sapiens
tgcctggcccctcgcctgtgg

SEQ ID NO: 4907409 - DNA, 17 bp, Homo sapiens
tgcctggcctggcacac

SEQ ID NO: 4907410 - DNA, 14 bp, Homo sapiens
tgcctgggggagtt

SEQ ID NO: 4907411 - DNA, 17 bp, Homo sapiens
tgcctggtgaatggcct

SEQ ID NO: 4907412 - DNA, 18 bp, Homo sapiens
tgcctggtgaatggcctt

SEQ ID NO: 4907413 - DNA, 14 bp, Homo sapiens
tgcctggtggcagc

SEQ ID NO: 4907414 - DNA, 17 bp, Homo sapiens
tgcctggtggcagctgc

SEQ ID NO: 4907415 - DNA, 13 bp, Homo sapiens
tgcctgtaaacat

SEQ ID NO: 4907416 - DNA, 15 bp, Homo sapiens
tgcctgtagcagtga

SEQ ID NO: 4907417 - DNA, 22 bp, Homo sapiens
tgcctgtagttaggaaataaaa

SEQ ID NO: 4907418 - DNA, 19 bp, Homo sapiens
tgcctgtcccacccccacc

SEQ ID NO: 4907419 - DNA, 15 bp, Homo sapiens
tgcctgttcagctcc

SEQ ID NO: 4907420 - DNA, 18 bp, Homo sapiens
tgcctgttcagctccagc

SEQ ID NO: 4907421 - DNA, 15 bp, Homo sapiens
tgccttaaaatggaa

SEQ ID NO: 4907422 - DNA, 14 bp, Homo sapiens
tgccttacacaaag

SEQ ID NO: 4907423 - DNA, 21 bp, Homo sapiens
tgccttagaacctttcttaca

SEQ ID NO: 4907424 - DNA, 16 bp, Homo sapiens
tgccttagaggagccc

SEQ ID NO: 4907425 - DNA, 18 bp, Homo sapiens
tgccttcctttctccagg

SEQ ID NO: 4907426 - DNA, 19 bp, Homo sapiens
tgccttcctttctccagga

SEQ ID NO: 4907427 - DNA, 23 bp, Homo sapiens
tgccttcctttctccaggaccaa

SEQ ID NO: 4907428 - DNA, 19 bp, Homo sapiens
tgccttctgacggccctgc

SEQ ID NO: 4907429 - DNA, 13 bp, Homo sapiens
tgccttctttgaa

SEQ ID NO: 4907430 - DNA, 16 bp, Homo sapiens
tgccttctttgaagaa

SEQ ID NO: 4907431 - DNA, 20 bp, Homo sapiens
tgccttctttgaagaaggtg

SEQ ID NO: 4907432 - DNA, 23 bp, Homo sapiens
tgccttgaacctgtgagtaaata

SEQ ID NO: 4907433 - DNA, 13 bp, Homo sapiens
tgccttggctcag

SEQ ID NO: 4907434 - DNA, 11 bp, Homo sapiens
tgccttgggct

SEQ ID NO: 4907435 - DNA, 19 bp, Homo sapiens
tgccttgggctgctcctca

SEQ ID NO: 4907436 - DNA, 13 bp, Homo sapiens
tgcctttgagaca

SEQ ID NO: 4907437 - DNA, 19 bp, Homo sapiens
tgcctttgagacagtttct

SEQ ID NO: 4907438 - DNA, 13 bp, Homo sapiens
tgccttttatagc

SEQ ID NO: 4907439 - DNA, 19 bp, Homo sapiens
tgcctttttcattttccaa

SEQ ID NO: 4907440 - DNA, 13 bp, Homo sapiens
tgcgatagagtct

SEQ ID NO: 4907441 - DNA, 21 bp, Homo sapiens
tgcgatctgggttcactgcaa

SEQ ID NO: 4907442 - DNA, 16 bp, Homo sapiens
tgcgcaaaatgcagct

SEQ ID NO: 4907443 - DNA, 16 bp, Homo sapiens
tgcgcccttaccttcc

SEQ ID NO: 4907444 - DNA, 23 bp, Homo sapiens
tgcgcgtgcacgtggagagctgg

SEQ ID NO: 4907445 - DNA, 17 bp, Homo sapiens
tgcggacagccacggcc

SEQ ID NO: 4907446 - DNA, 18 bp, Homo sapiens
tgcggacagccacggcca

SEQ ID NO: 4907447 - DNA, 13 bp, Homo sapiens
tgcggaccccagc

SEQ ID NO: 4907448 - DNA, 17 bp, Homo sapiens
tgcggatctcagctttg

SEQ ID NO: 4907449 - DNA, 15 bp, Homo sapiens
tgcggtccacccagg

SEQ ID NO: 4907450 - DNA, 18 bp, Homo sapiens
tgcggtccacccaggagc

SEQ ID NO: 4907451 - DNA, 12 bp, Homo sapiens
tgcgtgaatgta

SEQ ID NO: 4907452 - DNA, 20 bp, Homo sapiens
tgcgtgaatgtatgtaatgt

SEQ ID NO: 4907453 - DNA, 16 bp, Homo sapiens
tgcgtggactctgcac

SEQ ID NO: 4907454 - DNA, 17 bp, Homo sapiens
tgcgtggactctgcaca

SEQ ID NO: 4907455 - DNA, 22 bp, Homo sapiens
tgcgtggactctgcacatgtct

SEQ ID NO: 4907456 - DNA, 13 bp, Homo sapiens
tgcgtgggtcaga

SEQ ID NO: 4907457 - DNA, 16 bp, Homo sapiens
tgcgtgggtcagaaga

SEQ ID NO: 4907458 - DNA, 14 bp, Homo sapiens
tgcgtgtgtagagt

SEQ ID NO: 4907459 - DNA, 16 bp, Homo sapiens
tgcgttctgcaagcat

SEQ ID NO: 4907460 - DNA, 21 bp, Homo sapiens
tgctaaatggtcgcccaggag

SEQ ID NO: 4907461 - DNA, 15 bp, Homo sapiens
tgctaaggttctaag

SEQ ID NO: 4907462 - DNA, 16 bp, Homo sapiens
tgctaatcaaagccag

SEQ ID NO: 4907463 - DNA, 21 bp, Homo sapiens
tgctaatcaaagccagggtct

SEQ ID NO: 4907464 - DNA, 15 bp, Homo sapiens
tgctaattaaaaagt

SEQ ID NO: 4907465 - DNA, 16 bp, Homo sapiens
tgctaatttaaagaga

SEQ ID NO: 4907466 - DNA, 17 bp, Homo sapiens
tgctaatttaaagagac

SEQ ID NO: 4907467 - DNA, 15 bp, Homo sapiens
tgctaattttctcaa

SEQ ID NO: 4907468 - DNA, 17 bp, Homo sapiens
tgctaattttctcaaaa

SEQ ID NO: 4907469 - DNA, 22 bp, Homo sapiens
tgctaattttctcaaaagcatt

SEQ ID NO: 4907470 - DNA, 13 bp, Homo sapiens
tgctactgtacat

SEQ ID NO: 4907471 - DNA, 22 bp, Homo sapiens
tgctactgtctcactgaaacat

SEQ ID NO: 4907472 - DNA, 18 bp, Homo sapiens
tgctactgtctttggaaa

SEQ ID NO: 4907473 - DNA, 17 bp, Homo sapiens
tgctagaacttttttaa

SEQ ID NO: 4907474 - DNA, 20 bp, Homo sapiens
tgctagaacttttttaaata

SEQ ID NO: 4907475 - DNA, 22 bp, Homo sapiens
tgctagaacttttttaaataaa

SEQ ID NO: 4907476 - DNA, 16 bp, Homo sapiens
tgctagaatacttttt

SEQ ID NO: 4907477 - DNA, 18 bp, Homo sapiens
tgctagctatgtgacctt

SEQ ID NO: 4907478 - DNA, 14 bp, Homo sapiens
tgctaggtctcgga

SEQ ID NO: 4907479 - DNA, 16 bp, Homo sapiens
tgctaggttaattcca

SEQ ID NO: 4907480 - DNA, 23 bp, Homo sapiens
tgctaggttaattccaattatat

SEQ ID NO: 4907481 - DNA, 15 bp, Homo sapiens
tgctagtatttgaat

SEQ ID NO: 4907482 - DNA, 17 bp, Homo sapiens
tgctagtatttgaatta

SEQ ID NO: 4907483 - DNA, 18 bp, Homo sapiens
tgctagtatttgaattaa

SEQ ID NO: 4907484 - DNA, 20 bp, Homo sapiens
tgctagtatttgaattaaaa

SEQ ID NO: 4907485 - DNA, 18 bp, Homo sapiens
tgctagtgagctgggcat

SEQ ID NO: 4907486 - DNA, 12 bp, Homo sapiens
tgctatatatat

SEQ ID NO: 4907487 - DNA, 13 bp, Homo sapiens
tgctatgaatgat

SEQ ID NO: 4907488 - DNA, 18 bp, Homo sapiens
tgctatgttactattttc

SEQ ID NO: 4907489 - DNA, 19 bp, Homo sapiens
tgctatttattttcctaaa

SEQ ID NO: 4907490 - DNA, 20 bp, Homo sapiens
tgctatttatttttacaaga

SEQ ID NO: 4907491 - DNA, 16 bp, Homo sapiens
tgctcacatatctgtc

SEQ ID NO: 4907492 - DNA, 18 bp, Homo sapiens
tgctcaggctgcagctgg

SEQ ID NO: 4907493 - DNA, 23 bp, Homo sapiens
tgctcaggctgcagctggacaga

SEQ ID NO: 4907494 - DNA, 23 bp, Homo sapiens
tgctccagcaacacagcctgggc

SEQ ID NO: 4907495 - DNA, 13 bp, Homo sapiens
tgctccaggcctg

SEQ ID NO: 4907496 - DNA, 18 bp, Homo sapiens
tgctccaggcctgcagca

SEQ ID NO: 4907497 - DNA, 16 bp, Homo sapiens
tgctccccagccctgg

SEQ ID NO: 4907498 - DNA, 17 bp, Homo sapiens
tgctccccagccctggc

SEQ ID NO: 4907499 - DNA, 23 bp, Homo sapiens
tgctccccagccctggctctgca

SEQ ID NO: 4907500 - DNA, 17 bp, Homo sapiens
tgctccctcccctgccc

SEQ ID NO: 4907501 - DNA, 19 bp, Homo sapiens
tgctccctcccctgccctg

SEQ ID NO: 4907502 - DNA, 19 bp, Homo sapiens
tgctccctgaagccagcct

SEQ ID NO: 4907503 - DNA, 21 bp, Homo sapiens
tgctccctgaagccagccttc

SEQ ID NO: 4907504 - DNA, 17 bp, Homo sapiens
tgctccctgtgtccacc

SEQ ID NO: 4907505 - DNA, 16 bp, Homo sapiens
tgctcccttcagcccc

SEQ ID NO: 4907506 - DNA, 18 bp, Homo sapiens
tgctccgctgctccttgg

SEQ ID NO: 4907507 - DNA, 17 bp, Homo sapiens
tgctcctctccccagca

SEQ ID NO: 4907508 - DNA, 22 bp, Homo sapiens
tgctcctgccaggccttcagaa

SEQ ID NO: 4907509 - DNA, 12 bp, Homo sapiens
tgctccttggct

SEQ ID NO: 4907510 - DNA, 18 bp, Homo sapiens
tgctctccaagtctcagt

SEQ ID NO: 4907511 - DNA, 19 bp, Homo sapiens
tgctctccaagtctcagtg

SEQ ID NO: 4907512 - DNA, 20 bp, Homo sapiens
tgctctccaagtctcagtgg

SEQ ID NO: 4907513 - DNA, 12 bp, Homo sapiens
tgctctcccctg

SEQ ID NO: 4907514 - DNA, 15 bp, Homo sapiens
tgctctcccctgccc

SEQ ID NO: 4907515 - DNA, 16 bp, Homo sapiens
tgctctcccctgccct

SEQ ID NO: 4907516 - DNA, 16 bp, Homo sapiens
tgctctcctcttgcca

SEQ ID NO: 4907517 - DNA, 18 bp, Homo sapiens
tgctctcctcttgccact

SEQ ID NO: 4907518 - DNA, 17 bp, Homo sapiens
tgctctctcaaattgtc

SEQ ID NO: 4907519 - DNA, 20 bp, Homo sapiens
tgctctgagaagaggagccc

SEQ ID NO: 4907520 - DNA, 22 bp, Homo sapiens
tgctctgctgacagacacaggc

SEQ ID NO: 4907521 - DNA, 14 bp, Homo sapiens
tgctctggacaggc

SEQ ID NO: 4907522 - DNA, 16 bp, Homo sapiens
tgctctggacaggcat

SEQ ID NO: 4907523 - DNA, 17 bp, Homo sapiens
tgctctggacaggcatg

SEQ ID NO: 4907524 - DNA, 20 bp, Homo sapiens
tgctctgtaggagctaccct

SEQ ID NO: 4907525 - DNA, 20 bp, Homo sapiens
tgctcttactacactgagga

SEQ ID NO: 4907526 - DNA, 23 bp, Homo sapiens
tgctcttgtttttattaatttat

SEQ ID NO: 4907527 - DNA, 23 bp, Homo sapiens
tgctctttcccccttccatctct

SEQ ID NO: 4907528 - DNA, 15 bp, Homo sapiens
tgctcttttttactc

SEQ ID NO: 4907529 - DNA, 22 bp, Homo sapiens
tgctgaaaaccatctggcctgg

SEQ ID NO: 4907530 - DNA, 15 bp, Homo sapiens
tgctgaacaaaaaat

SEQ ID NO: 4907531 - DNA, 23 bp, Homo sapiens
tgctgaaggaataaattgctcct

SEQ ID NO: 4907532 - DNA, 21 bp, Homo sapiens
tgctgaagggcattctttccc

SEQ ID NO: 4907533 - DNA, 18 bp, Homo sapiens
tgctgaatatacagcagg

SEQ ID NO: 4907534 - DNA, 16 bp, Homo sapiens
tgctgacagacacagg

SEQ ID NO: 4907535 - DNA, 23 bp, Homo sapiens
tgctgacagacacaggcccggct

SEQ ID NO: 4907536 - DNA, 16 bp, Homo sapiens
tgctgaccaattgtgc

SEQ ID NO: 4907537 - DNA, 23 bp, Homo sapiens
tgctgaccaattgtgctgccatt

SEQ ID NO: 4907538 - DNA, 14 bp, Homo sapiens
tgctgactgtactc

SEQ ID NO: 4907539 - DNA, 16 bp, Homo sapiens
tgctgagattcttcag

SEQ ID NO: 4907540 - DNA, 14 bp, Homo sapiens
tgctgagcctctgc

SEQ ID NO: 4907541 - DNA, 20 bp, Homo sapiens
tgctgagcctctgctcccca

SEQ ID NO: 4907542 - DNA, 17 bp, Homo sapiens
tgctgaggcctccagct

SEQ ID NO: 4907543 - DNA, 19 bp, Homo sapiens
tgctgatttcccctcttcc

SEQ ID NO: 4907544 - DNA, 14 bp, Homo sapiens
tgctgattttaatg

SEQ ID NO: 4907545 - DNA, 14 bp, Homo sapiens
tgctgcactaattg

SEQ ID NO: 4907546 - DNA, 18 bp, Homo sapiens
tgctgcaggggctctgga

SEQ ID NO: 4907547 - DNA, 16 bp, Homo sapiens
tgctgccacacttcag

SEQ ID NO: 4907548 - DNA, 12 bp, Homo sapiens
tgctgccatcca

SEQ ID NO: 4907549 - DNA, 14 bp, Homo sapiens
tgctgccatccagg

SEQ ID NO: 4907550 - DNA, 21 bp, Homo sapiens
tgctgccatccaggttcagct

SEQ ID NO: 4907551 - DNA, 22 bp, Homo sapiens
tgctgccatccaggttcagctt

SEQ ID NO: 4907552 - DNA, 14 bp, Homo sapiens
tgctgcccagcctc

SEQ ID NO: 4907553 - DNA, 21 bp, Homo sapiens
tgctgccttctgacggccctg

SEQ ID NO: 4907554 - DNA, 13 bp, Homo sapiens
tgctgctagaact

SEQ ID NO: 4907555 - DNA, 20 bp, Homo sapiens
tgctgctagaacttttttaa

SEQ ID NO: 4907556 - DNA, 19 bp, Homo sapiens
tgctgctatcctgccaaaa

SEQ ID NO: 4907557 - DNA, 19 bp, Homo sapiens
tgctgctgcctggccactg

SEQ ID NO: 4907558 - DNA, 16 bp, Homo sapiens
tgctgctgctgcgccc

SEQ ID NO: 4907559 - DNA, 17 bp, Homo sapiens
tgctgctgctgcgccct

SEQ ID NO: 4907560 - DNA, 20 bp, Homo sapiens
tgctggacggggactgggga

SEQ ID NO: 4907561 - DNA, 15 bp, Homo sapiens
tgctggactgtcata

SEQ ID NO: 4907562 - DNA, 22 bp, Homo sapiens
tgctggagaagagaggagagga

SEQ ID NO: 4907563 - DNA, 12 bp, Homo sapiens
tgctggagcctg

SEQ ID NO: 4907564 - DNA, 16 bp, Homo sapiens
tgctggaggtgggagc

SEQ ID NO: 4907565 - DNA, 17 bp, Homo sapiens
tgctggaggtgggagca

SEQ ID NO: 4907566 - DNA, 18 bp, Homo sapiens
tgctggatggagcccagg

SEQ ID NO: 4907567 - DNA, 19 bp, Homo sapiens
tgctggatggagcccaggc

SEQ ID NO: 4907568 - DNA, 16 bp, Homo sapiens
tgctggccagcctggg

SEQ ID NO: 4907569 - DNA, 23 bp, Homo sapiens
tgctggccagcctggggcctggc

SEQ ID NO: 4907570 - DNA, 15 bp, Homo sapiens
tgctggctgccttag

SEQ ID NO: 4907571 - DNA, 21 bp, Homo sapiens
tgctggctgccttagaacctt

SEQ ID NO: 4907572 - DNA, 19 bp, Homo sapiens
tgctggctgttggctgggg

SEQ ID NO: 4907573 - DNA, 19 bp, Homo sapiens
tgctgggattacaagcgtg

SEQ ID NO: 4907574 - DNA, 15 bp, Homo sapiens
tgctggggcctcaga

SEQ ID NO: 4907575 - DNA, 17 bp, Homo sapiens
tgctggggcctcagacg

SEQ ID NO: 4907576 - DNA, 22 bp, Homo sapiens
tgctgtcatgaaatcagcaaga

SEQ ID NO: 4907577 - DNA, 17 bp, Homo sapiens
tgctgtccctccccctt

SEQ ID NO: 4907578 - DNA, 14 bp, Homo sapiens
tgctgtcctgatct

SEQ ID NO: 4907579 - DNA, 16 bp, Homo sapiens
tgctgtcctgatctgt

SEQ ID NO: 4907580 - DNA, 19 bp, Homo sapiens
tgctgtctctgctcgccct

SEQ ID NO: 4907581 - DNA, 15 bp, Homo sapiens
tgctgtcttctggac

SEQ ID NO: 4907582 - DNA, 11 bp, Homo sapiens
tgctgtgtgcc

SEQ ID NO: 4907583 - DNA, 20 bp, Homo sapiens
tgctgttactgttaaccatt

SEQ ID NO: 4907584 - DNA, 18 bp, Homo sapiens
tgctgttgcttgaatagc

SEQ ID NO: 4907585 - DNA, 13 bp, Homo sapiens
tgctgtttgacaa

SEQ ID NO: 4907586 - DNA, 18 bp, Homo sapiens
tgcttaaaaggttgcata

SEQ ID NO: 4907587 - DNA, 16 bp, Homo sapiens
tgcttaagttccagca

SEQ ID NO: 4907588 - DNA, 19 bp, Homo sapiens
tgcttaatttctaaagata

SEQ ID NO: 4907589 - DNA, 20 bp, Homo sapiens
tgcttaatttctaaagataa

SEQ ID NO: 4907590 - DNA, 17 bp, Homo sapiens
tgcttattgcttagtaa

SEQ ID NO: 4907591 - DNA, 16 bp, Homo sapiens
tgcttcaattaataaa

SEQ ID NO: 4907592 - DNA, 23 bp, Homo sapiens
tgcttcaattaataaaaaatgga

SEQ ID NO: 4907593 - DNA, 16 bp, Homo sapiens
tgcttcagtggagaat

SEQ ID NO: 4907594 - DNA, 15 bp, Homo sapiens
tgcttcattcaatat

SEQ ID NO: 4907595 - DNA, 20 bp, Homo sapiens
tgcttcccacctccctgccc

SEQ ID NO: 4907596 - DNA, 21 bp, Homo sapiens
tgcttccggtagggaggcagc

SEQ ID NO: 4907597 - DNA, 18 bp, Homo sapiens
tgcttctcatcttgtgaa

SEQ ID NO: 4907598 - DNA, 12 bp, Homo sapiens
tgcttgaatagc

SEQ ID NO: 4907599 - DNA, 13 bp, Homo sapiens
tgcttgagcccag

SEQ ID NO: 4907600 - DNA, 17 bp, Homo sapiens
tgcttgatgaagcaagg

SEQ ID NO: 4907601 - DNA, 19 bp, Homo sapiens
tgcttgctttcttttttaa

SEQ ID NO: 4907602 - DNA, 18 bp, Homo sapiens
tgcttgtacctctggctg

SEQ ID NO: 4907603 - DNA, 15 bp, Homo sapiens
tgcttgtgttaagta

SEQ ID NO: 4907604 - DNA, 19 bp, Homo sapiens
tgcttgttccctctccctg

SEQ ID NO: 4907605 - DNA, 12 bp, Homo sapiens
tgcttgttttat

SEQ ID NO: 4907606 - DNA, 20 bp, Homo sapiens
tgctttaaagggcctgcctg

SEQ ID NO: 4907607 - DNA, 17 bp, Homo sapiens
tgctttaaagtgtaata

SEQ ID NO: 4907608 - DNA, 23 bp, Homo sapiens
tgctttaaagtgtaataatatga

SEQ ID NO: 4907609 - DNA, 15 bp, Homo sapiens
tgctttattccagaa

SEQ ID NO: 4907610 - DNA, 17 bp, Homo sapiens
tgctttattccagaatg

SEQ ID NO: 4907611 - DNA, 20 bp, Homo sapiens
tgctttcttttttaaaatca

SEQ ID NO: 4907612 - DNA, 15 bp, Homo sapiens
tgctttgaagcagtt

SEQ ID NO: 4907613 - DNA, 12 bp, Homo sapiens
tgctttgctctt

SEQ ID NO: 4907614 - DNA, 13 bp, Homo sapiens
tgctttgctcttg

SEQ ID NO: 4907615 - DNA, 14 bp, Homo sapiens
tgctttgggctgcc

SEQ ID NO: 4907616 - DNA, 15 bp, Homo sapiens
tgctttgggctgccc

SEQ ID NO: 4907617 - DNA, 18 bp, Homo sapiens
tgctttgggctgccctgg

SEQ ID NO: 4907618 - DNA, 19 bp, Homo sapiens
tgctttgggctgccctggt

SEQ ID NO: 4907619 - DNA, 20 bp, Homo sapiens
tgctttgggctgccctggtg

SEQ ID NO: 4907620 - DNA, 12 bp, Homo sapiens
tgcttttaatta

SEQ ID NO: 4907621 - DNA, 14 bp, Homo sapiens
tgcttttattttga

SEQ ID NO: 4907622 - DNA, 15 bp, Homo sapiens
tgcttttattttgaa

SEQ ID NO: 4907623 - DNA, 13 bp, Homo sapiens
tgcttttccctct

SEQ ID NO: 4907624 - DNA, 14 bp, Homo sapiens
tgcttttccctctt

SEQ ID NO: 4907625 - DNA, 14 bp, Homo sapiens
tgcttttggtctgt

SEQ ID NO: 4907626 - DNA, 15 bp, Homo sapiens
tgctttttatttctg

SEQ ID NO: 4907627 - DNA, 15 bp, Homo sapiens
tggaaaaatgtttgt

SEQ ID NO: 4907628 - DNA, 15 bp, Homo sapiens
tggaaacctgaaaaa

SEQ ID NO: 4907629 - DNA, 17 bp, Homo sapiens
tggaaatattttgataa

SEQ ID NO: 4907630 - DNA, 18 bp, Homo sapiens
tggaaatcatcgaaaatt

SEQ ID NO: 4907631 - DNA, 20 bp, Homo sapiens
tggaacaaagtgaaggacat

SEQ ID NO: 4907632 - DNA, 18 bp, Homo sapiens
tggaacataaaaaggaca

SEQ ID NO: 4907633 - DNA, 21 bp, Homo sapiens
tggaaccacggagatctcctt

SEQ ID NO: 4907634 - DNA, 21 bp, Homo sapiens
tggaacccagcagttctgtta

SEQ ID NO: 4907635 - DNA, 13 bp, Homo sapiens
tggaacctctgtc

SEQ ID NO: 4907636 - DNA, 14 bp, Homo sapiens
tggaaccttgctgt

SEQ ID NO: 4907637 - DNA, 16 bp, Homo sapiens
tggaaccttgctgtcc

SEQ ID NO: 4907638 - DNA, 22 bp, Homo sapiens
tggaaccttgctgtcctgatct

SEQ ID NO: 4907639 - DNA, 17 bp, Homo sapiens
tggaacgctaatgaaac

SEQ ID NO: 4907640 - DNA, 15 bp, Homo sapiens
tggaactctatctgg

SEQ ID NO: 4907641 - DNA, 20 bp, Homo sapiens
tggaactctatctgggcctg

SEQ ID NO: 4907642 - DNA, 16 bp, Homo sapiens
tggaacttctaatata

SEQ ID NO: 4907643 - DNA, 18 bp, Homo sapiens
tggaagaaaaaaatcttc

SEQ ID NO: 4907644 - DNA, 16 bp, Homo sapiens
tggaagagaaatctca

SEQ ID NO: 4907645 - DNA, 16 bp, Homo sapiens
tggaagcacagcttca

SEQ ID NO: 4907646 - DNA, 16 bp, Homo sapiens
tggaagccctggagac

SEQ ID NO: 4907647 - DNA, 17 bp, Homo sapiens
tggaagctaatttgcat

SEQ ID NO: 4907648 - DNA, 18 bp, Homo sapiens
tggaagctaatttgcatt

SEQ ID NO: 4907649 - DNA, 17 bp, Homo sapiens
tggaagctgccctgccc

SEQ ID NO: 4907650 - DNA, 18 bp, Homo sapiens
tggaagcttgttttccag

SEQ ID NO: 4907651 - DNA, 20 bp, Homo sapiens
tggaagcttgttttccagtc

SEQ ID NO: 4907652 - DNA, 18 bp, Homo sapiens
tggaagggttctggctgc

SEQ ID NO: 4907653 - DNA, 17 bp, Homo sapiens
tggaagggtttgtggct

SEQ ID NO: 4907654 - DNA, 17 bp, Homo sapiens
tggaagtccaatgtggc

SEQ ID NO: 4907655 - DNA, 22 bp, Homo sapiens
tggaataaaaggcttgaagctg

SEQ ID NO: 4907656 - DNA, 15 bp, Homo sapiens
tggaatacatgaaat

SEQ ID NO: 4907657 - DNA, 12 bp, Homo sapiens
tggaatactttt

SEQ ID NO: 4907658 - DNA, 13 bp, Homo sapiens
tggaatacttttt

SEQ ID NO: 4907659 - DNA, 19 bp, Homo sapiens
tggaatgagtgtgcatgga

SEQ ID NO: 4907660 - DNA, 16 bp, Homo sapiens
tggaatgctgtgttaa

SEQ ID NO: 4907661 - DNA, 15 bp, Homo sapiens
tggaatggacatcct

SEQ ID NO: 4907662 - DNA, 12 bp, Homo sapiens
tggaattgattt

SEQ ID NO: 4907663 - DNA, 15 bp, Homo sapiens
tggaattgatttgca

SEQ ID NO: 4907664 - DNA, 17 bp, Homo sapiens
tggaattgggagcttgg

SEQ ID NO: 4907665 - DNA, 18 bp, Homo sapiens
tggacaaactggagtctg

SEQ ID NO: 4907666 - DNA, 17 bp, Homo sapiens
tggacacacaaggtgca

SEQ ID NO: 4907667 - DNA, 15 bp, Homo sapiens
tggacacagctcttc

SEQ ID NO: 4907668 - DNA, 22 bp, Homo sapiens
tggacacagctcttctccaggc

SEQ ID NO: 4907669 - DNA, 15 bp, Homo sapiens
tggacacagggtgac

SEQ ID NO: 4907670 - DNA, 17 bp, Homo sapiens
tggacactccagtgcca

SEQ ID NO: 4907671 - DNA, 14 bp, Homo sapiens
tggacactgtacaa

SEQ ID NO: 4907672 - DNA, 12 bp, Homo sapiens
tggacagagggg

SEQ ID NO: 4907673 - DNA, 13 bp, Homo sapiens
tggacagagggga

SEQ ID NO: 4907674 - DNA, 18 bp, Homo sapiens
tggacagaggggactctg

SEQ ID NO: 4907675 - DNA, 17 bp, Homo sapiens
tggacaggcatgttctc

SEQ ID NO: 4907676 - DNA, 18 bp, Homo sapiens
tggacaggcatgttctct

SEQ ID NO: 4907677 - DNA, 18 bp, Homo sapiens
tggacagttcacaccctg

SEQ ID NO: 4907678 - DNA, 21 bp, Homo sapiens
tggacagttcacaccctgcaa

SEQ ID NO: 4907679 - DNA, 14 bp, Homo sapiens
tggaccactgtttc

SEQ ID NO: 4907680 - DNA, 19 bp, Homo sapiens
tggaccactgtttcttgct

SEQ ID NO: 4907681 - DNA, 20 bp, Homo sapiens
tggaccactgtttcttgctt

SEQ ID NO: 4907682 - DNA, 19 bp, Homo sapiens
tggaccagtggtttccagt

SEQ ID NO: 4907683 - DNA, 16 bp, Homo sapiens
tggacctgcctcctgc

SEQ ID NO: 4907684 - DNA, 17 bp, Homo sapiens
tggacctgcctcctgcc

SEQ ID NO: 4907685 - DNA, 19 bp, Homo sapiens
tggacctgcctcctgcctg

SEQ ID NO: 4907686 - DNA, 16 bp, Homo sapiens
tggacggggactgggg

SEQ ID NO: 4907687 - DNA, 14 bp, Homo sapiens
tggactaaatgcct

SEQ ID NO: 4907688 - DNA, 17 bp, Homo sapiens
tggactcaatccctagg

SEQ ID NO: 4907689 - DNA, 16 bp, Homo sapiens
tggactctaaagacca

SEQ ID NO: 4907690 - DNA, 18 bp, Homo sapiens
tggactctaaagaccaaa

SEQ ID NO: 4907691 - DNA, 13 bp, Homo sapiens
tggactctgcaca

SEQ ID NO: 4907692 - DNA, 15 bp, Homo sapiens
tggactctgcacatg

SEQ ID NO: 4907693 - DNA, 16 bp, Homo sapiens
tggactctgcacatga

SEQ ID NO: 4907694 - DNA, 17 bp, Homo sapiens
tggactctgcacatgaa

SEQ ID NO: 4907695 - DNA, 16 bp, Homo sapiens
tggactctgcatccca

SEQ ID NO: 4907696 - DNA, 18 bp, Homo sapiens
tggactctgcatcccagc

SEQ ID NO: 4907697 - DNA, 22 bp, Homo sapiens
tggactctggtgcctccagagg

SEQ ID NO: 4907698 - DNA, 14 bp, Homo sapiens
tggactggcccctg

SEQ ID NO: 4907699 - DNA, 15 bp, Homo sapiens
tggactggcccctgg

SEQ ID NO: 4907700 - DNA, 13 bp, Homo sapiens
tggactggctaga

SEQ ID NO: 4907701 - DNA, 20 bp, Homo sapiens
tggactggctagagtcctca

SEQ ID NO: 4907702 - DNA, 15 bp, Homo sapiens
tggactgtcatagaa

SEQ ID NO: 4907703 - DNA, 21 bp, Homo sapiens
tggactgtcatagaaattaca

SEQ ID NO: 4907704 - DNA, 12 bp, Homo sapiens
tggactgtggca

SEQ ID NO: 4907705 - DNA, 13 bp, Homo sapiens
tggactgtggcac

SEQ ID NO: 4907706 - DNA, 21 bp, Homo sapiens
tggactgtggcacttgcctgg

SEQ ID NO: 4907707 - DNA, 22 bp, Homo sapiens
tggactgtggcacttgcctggg

SEQ ID NO: 4907708 - DNA, 15 bp, Homo sapiens
tggacttagaaagca

SEQ ID NO: 4907709 - DNA, 16 bp, Homo sapiens
tggacttagaaagcag

SEQ ID NO: 4907710 - DNA, 17 bp, Homo sapiens
tggacttatttcttcaa

SEQ ID NO: 4907711 - DNA, 18 bp, Homo sapiens
tggacttatttcttcaaa

SEQ ID NO: 4907712 - DNA, 23 bp, Homo sapiens
tggactttcaaaattaaatctgt

SEQ ID NO: 4907713 - DNA, 11 bp, Homo sapiens
tggagaaatta

SEQ ID NO: 4907714 - DNA, 14 bp, Homo sapiens
tggagaagagagga

SEQ ID NO: 4907715 - DNA, 17 bp, Homo sapiens
tggagaattgctgaagg

SEQ ID NO: 4907716 - DNA, 12 bp, Homo sapiens
tggagacagccc

SEQ ID NO: 4907717 - DNA, 13 bp, Homo sapiens
tggagacagcccc

SEQ ID NO: 4907718 - DNA, 19 bp, Homo sapiens
tggagaccctgcaaacaga

SEQ ID NO: 4907719 - DNA, 14 bp, Homo sapiens
tggagaccttaccc

SEQ ID NO: 4907720 - DNA, 20 bp, Homo sapiens
tggagacgtggaacctctgt

SEQ ID NO: 4907721 - DNA, 24 bp, Homo sapiens
tggagacgtggaacctctgtctca

SEQ ID NO: 4907722 - DNA, 20 bp, Homo sapiens
tggagactggggggcttgaa

SEQ ID NO: 4907723 - DNA, 19 bp, Homo sapiens
tggagactggtcctgtgtg

SEQ ID NO: 4907724 - DNA, 22 bp, Homo sapiens
tggagagaaacaataaagagat

SEQ ID NO: 4907725 - DNA, 19 bp, Homo sapiens
tggagagctggtgcccgga

SEQ ID NO: 4907726 - DNA, 12 bp, Homo sapiens
tggagaggaaca

SEQ ID NO: 4907727 - DNA, 18 bp, Homo sapiens
tggagcaggactctattt

SEQ ID NO: 4907728 - DNA, 18 bp, Homo sapiens
tggagcaggcggtgggga

SEQ ID NO: 4907729 - DNA, 18 bp, Homo sapiens
tggagcatgggcctggcc

SEQ ID NO: 4907730 - DNA, 16 bp, Homo sapiens
tggagcccaggcggga

SEQ ID NO: 4907731 - DNA, 21 bp, Homo sapiens
tggagcctgagtcagggccca

SEQ ID NO: 4907732 - DNA, 22 bp, Homo sapiens
tggagcctgagtcagggcccag

SEQ ID NO: 4907733 - DNA, 13 bp, Homo sapiens
tggaggaaagcaa

SEQ ID NO: 4907734 - DNA, 13 bp, Homo sapiens
tggaggaaggatt

SEQ ID NO: 4907735 - DNA, 13 bp, Homo sapiens
tggaggattgcta

SEQ ID NO: 4907736 - DNA, 17 bp, Homo sapiens
tggaggcagccagggct

SEQ ID NO: 4907737 - DNA, 21 bp, Homo sapiens
tggaggccctcctgtgctggg

SEQ ID NO: 4907738 - DNA, 18 bp, Homo sapiens
tggaggccttccagctgc

SEQ ID NO: 4907739 - DNA, 20 bp, Homo sapiens
tggaggccttccagctgctg

SEQ ID NO: 4907740 - DNA, 21 bp, Homo sapiens
tggaggccttccagctgctgt

SEQ ID NO: 4907741 - DNA, 19 bp, Homo sapiens
tggaggctgacgtgtgagg

SEQ ID NO: 4907742 - DNA, 13 bp, Homo sapiens
tggaggggtgtgg

SEQ ID NO: 4907743 - DNA, 23 bp, Homo sapiens
tggaggggtgtggctccttccca

SEQ ID NO: 4907744 - DNA, 12 bp, Homo sapiens
tggaggtgggag

SEQ ID NO: 4907745 - DNA, 22 bp, Homo sapiens
tggaggtggggcgaggcaggcc

SEQ ID NO: 4907746 - DNA, 15 bp, Homo sapiens
tggaggttctaaggc

SEQ ID NO: 4907747 - DNA, 16 bp, Homo sapiens
tggaggttctaaggcc

SEQ ID NO: 4907748 - DNA, 16 bp, Homo sapiens
tggagtataatattca

SEQ ID NO: 4907749 - DNA, 21 bp, Homo sapiens
tggagtatgtctgatggatcc

SEQ ID NO: 4907750 - DNA, 14 bp, Homo sapiens
tggagtgggcagag

SEQ ID NO: 4907751 - DNA, 14 bp, Homo sapiens
tggagttcttgtgc

SEQ ID NO: 4907752 - DNA, 16 bp, Homo sapiens
tggagttcttgtgcca

SEQ ID NO: 4907753 - DNA, 21 bp, Homo sapiens
tggagtttttgtttggagagc

SEQ ID NO: 4907754 - DNA, 19 bp, Homo sapiens
tggataaaataatgctgca

SEQ ID NO: 4907755 - DNA, 15 bp, Homo sapiens
tggatactacatctt

SEQ ID NO: 4907756 - DNA, 17 bp, Homo sapiens
tggatagctaataatga

SEQ ID NO: 4907757 - DNA, 18 bp, Homo sapiens
tggatccaatgttagaga

SEQ ID NO: 4907758 - DNA, 17 bp, Homo sapiens
tggatcccctctgtcta

SEQ ID NO: 4907759 - DNA, 23 bp, Homo sapiens
tggatcccctctgtctacaaata

SEQ ID NO: 4907760 - DNA, 15 bp, Homo sapiens
tggatcttgaatgtg

SEQ ID NO: 4907761 - DNA, 16 bp, Homo sapiens
tggatcttgaatgtgg

SEQ ID NO: 4907762 - DNA, 19 bp, Homo sapiens
tggatcttgaatgtggtct

SEQ ID NO: 4907763 - DNA, 14 bp, Homo sapiens
tggatgaaattttc

SEQ ID NO: 4907764 - DNA, 15 bp, Homo sapiens
tggatgaaattttct

SEQ ID NO: 4907765 - DNA, 17 bp, Homo sapiens
tggatgaaattttctag

SEQ ID NO: 4907766 - DNA, 18 bp, Homo sapiens
tggatgaaattttctaga

SEQ ID NO: 4907767 - DNA, 15 bp, Homo sapiens
tggatgatcaatcct

SEQ ID NO: 4907768 - DNA, 20 bp, Homo sapiens
tggatgcaaagtacaatgtg

SEQ ID NO: 4907769 - DNA, 21 bp, Homo sapiens
tggatgccaatattaaatctg

SEQ ID NO: 4907770 - DNA, 14 bp, Homo sapiens
tggatgcctggtgg

SEQ ID NO: 4907771 - DNA, 19 bp, Homo sapiens
tggatgcctggtggcagct

SEQ ID NO: 4907772 - DNA, 15 bp, Homo sapiens
tggattaaatttaat

SEQ ID NO: 4907773 - DNA, 14 bp, Homo sapiens
tggattatcctgag

SEQ ID NO: 4907774 - DNA, 14 bp, Homo sapiens
tggattatttaata

SEQ ID NO: 4907775 - DNA, 17 bp, Homo sapiens
tggattatttaataaca

SEQ ID NO: 4907776 - DNA, 23 bp, Homo sapiens
tggattatttaataacattacct

SEQ ID NO: 4907777 - DNA, 18 bp, Homo sapiens
tggattcccttaaacaaa

SEQ ID NO: 4907778 - DNA, 15 bp, Homo sapiens
tggattggattattt

SEQ ID NO: 4907779 - DNA, 21 bp, Homo sapiens
tggattggattatttaataac

SEQ ID NO: 4907780 - DNA, 17 bp, Homo sapiens
tggattgggggggccaa

SEQ ID NO: 4907781 - DNA, 21 bp, Homo sapiens
tggattgggggggccaaaagg

SEQ ID NO: 4907782 - DNA, 15 bp, Homo sapiens
tggcaaaagccttgt

SEQ ID NO: 4907783 - DNA, 17 bp, Homo sapiens
tggcaaaagccttgtgt

SEQ ID NO: 4907784 - DNA, 19 bp, Homo sapiens
tggcaaaagccttgtgtat

SEQ ID NO: 4907785 - DNA, 12 bp, Homo sapiens
tggcaacagaag

SEQ ID NO: 4907786 - DNA, 21 bp, Homo sapiens
tggcaacagttagctggagct

SEQ ID NO: 4907787 - DNA, 22 bp, Homo sapiens
tggcaaccttgtctctatgcca

SEQ ID NO: 4907788 - DNA, 17 bp, Homo sapiens
tggcaagagtgtggagg

SEQ ID NO: 4907789 - DNA, 19 bp, Homo sapiens
tggcaagagtgtggaggct

SEQ ID NO: 4907790 - DNA, 13 bp, Homo sapiens
tggcaattccaat

SEQ ID NO: 4907791 - DNA, 19 bp, Homo sapiens
tggcaattccaatatttct

SEQ ID NO: 4907792 - DNA, 16 bp, Homo sapiens
tggcacaggccccctt

SEQ ID NO: 4907793 - DNA, 11 bp, Homo sapiens
tggcaccaaag

SEQ ID NO: 4907794 - DNA, 17 bp, Homo sapiens
tggcaccaaagatgcag

SEQ ID NO: 4907795 - DNA, 20 bp, Homo sapiens
tggcaccaaagatgcagccg

SEQ ID NO: 4907796 - DNA, 18 bp, Homo sapiens
tggcaccactgcactcca

SEQ ID NO: 4907797 - DNA, 19 bp, Homo sapiens
tggcaccactgcactccag

SEQ ID NO: 4907798 - DNA, 15 bp, Homo sapiens
tggcacttgcctggg

SEQ ID NO: 4907799 - DNA, 17 bp, Homo sapiens
tggcacttgcctgggtc

SEQ ID NO: 4907800 - DNA, 16 bp, Homo sapiens
tggcactttgaagggg

SEQ ID NO: 4907801 - DNA, 21 bp, Homo sapiens
tggcagaaaaaatgtctgtaa

SEQ ID NO: 4907802 - DNA, 21 bp, Homo sapiens
tggcagaagacaccagagcag

SEQ ID NO: 4907803 - DNA, 23 bp, Homo sapiens
tggcagaagacaccagagcagat

SEQ ID NO: 4907804 - DNA, 12 bp, Homo sapiens
tggcagagagag

SEQ ID NO: 4907805 - DNA, 18 bp, Homo sapiens
tggcagagagagagaaag

SEQ ID NO: 4907806 - DNA, 16 bp, Homo sapiens
tggcagccgtgccttc

SEQ ID NO: 4907807 - DNA, 21 bp, Homo sapiens
tggcagccgtgccttcagctc

SEQ ID NO: 4907808 - DNA, 19 bp, Homo sapiens
tggcagctgcggtccaccc

SEQ ID NO: 4907809 - DNA, 22 bp, Homo sapiens
tggcagggaggtcaggccctgg

SEQ ID NO: 4907810 - DNA, 23 bp, Homo sapiens
tggcagggctggccccagggcac

SEQ ID NO: 4907811 - DNA, 23 bp, Homo sapiens
tggcagtgagtgagcctggctct

SEQ ID NO: 4907812 - DNA, 19 bp, Homo sapiens
tggcagtgggagctgcctg

SEQ ID NO: 4907813 - DNA, 16 bp, Homo sapiens
tggcagtttggtattt

SEQ ID NO: 4907814 - DNA, 23 bp, Homo sapiens
tggcatctttgccttgggctgct

SEQ ID NO: 4907815 - DNA, 19 bp, Homo sapiens
tggcattacagctggagaa

SEQ ID NO: 4907816 - DNA, 17 bp, Homo sapiens
tggcattcttgtacagt

SEQ ID NO: 4907817 - DNA, 22 bp, Homo sapiens
tggccacatttaatatcttcag

SEQ ID NO: 4907818 - DNA, 13 bp, Homo sapiens
tggccactcagct

SEQ ID NO: 4907819 - DNA, 15 bp, Homo sapiens
tggccactcagcttc

SEQ ID NO: 4907820 - DNA, 17 bp, Homo sapiens
tggccactccagacccc

SEQ ID NO: 4907821 - DNA, 16 bp, Homo sapiens
tggccactttaagaga

SEQ ID NO: 4907822 - DNA, 20 bp, Homo sapiens
tggccagagctgggaggcat

SEQ ID NO: 4907823 - DNA, 17 bp, Homo sapiens
tggccagatgcaccagc

SEQ ID NO: 4907824 - DNA, 19 bp, Homo sapiens
tggccagatgcaccagccc

SEQ ID NO: 4907825 - DNA, 20 bp, Homo sapiens
tggccagatgcaccagccct

SEQ ID NO: 4907826 - DNA, 18 bp, Homo sapiens
tggccagcctggggcctg

SEQ ID NO: 4907827 - DNA, 19 bp, Homo sapiens
tggccagcctggggcctgg

SEQ ID NO: 4907828 - DNA, 23 bp, Homo sapiens
tggccagcctggggcctggcagg

SEQ ID NO: 4907829 - DNA, 14 bp, Homo sapiens
tggccaggagctct

SEQ ID NO: 4907830 - DNA, 15 bp, Homo sapiens
tggccaggtggccac

SEQ ID NO: 4907831 - DNA, 23 bp, Homo sapiens
tggccagtgtgacaaggattgct

SEQ ID NO: 4907832 - DNA, 16 bp, Homo sapiens
tggccatccctgtgag

SEQ ID NO: 4907833 - DNA, 14 bp, Homo sapiens
tggccatttgcttt

SEQ ID NO: 4907834 - DNA, 15 bp, Homo sapiens
tggcccagtcctctc

SEQ ID NO: 4907835 - DNA, 19 bp, Homo sapiens
tggcccagtcctctcccaa

SEQ ID NO: 4907836 - DNA, 24 bp, Homo sapiens
tggcccatagaaacatgacactga

SEQ ID NO: 4907837 - DNA, 18 bp, Homo sapiens
tggccccagggcaccctg

SEQ ID NO: 4907838 - DNA, 14 bp, Homo sapiens
tggcccctctgacc

SEQ ID NO: 4907839 - DNA, 16 bp, Homo sapiens
tggcccctgcccggct

SEQ ID NO: 4907840 - DNA, 20 bp, Homo sapiens
tggcccctgcccggctgcgg

SEQ ID NO: 4907841 - DNA, 19 bp, Homo sapiens
tggcccgacagcctggcac

SEQ ID NO: 4907842 - DNA, 18 bp, Homo sapiens
tggccctgccctctcctt

SEQ ID NO: 4907843 - DNA, 14 bp, Homo sapiens
tggccctggctctg

SEQ ID NO: 4907844 - DNA, 13 bp, Homo sapiens
tggccctggggtc

SEQ ID NO: 4907845 - DNA, 19 bp, Homo sapiens
tggccctgtccctcccacc

SEQ ID NO: 4907846 - DNA, 13 bp, Homo sapiens
tggccctttcctt

SEQ ID NO: 4907847 - DNA, 19 bp, Homo sapiens
tggccgagggtcctggctc

SEQ ID NO: 4907848 - DNA, 17 bp, Homo sapiens
tggccgccccctgcccc

SEQ ID NO: 4907849 - DNA, 19 bp, Homo sapiens
tggccgcgtttagaccaag

SEQ ID NO: 4907850 - DNA, 15 bp, Homo sapiens
tggccggctgtgctc

SEQ ID NO: 4907851 - DNA, 14 bp, Homo sapiens
tggccgttatctgg

SEQ ID NO: 4907852 - DNA, 19 bp, Homo sapiens
tggcctagcccaccctgct

SEQ ID NO: 4907853 - DNA, 20 bp, Homo sapiens
tggcctagcccaccctgctg

SEQ ID NO: 4907854 - DNA, 18 bp, Homo sapiens
tggcctcaagtgattctc

SEQ ID NO: 4907855 - DNA, 23 bp, Homo sapiens
tggcctcaagtgattctcctgcc

SEQ ID NO: 4907856 - DNA, 17 bp, Homo sapiens
tggcctcagaattcaca

SEQ ID NO: 4907857 - DNA, 13 bp, Homo sapiens
tggcctcagctgc

SEQ ID NO: 4907858 - DNA, 15 bp, Homo sapiens
tggcctgagagggga

SEQ ID NO: 4907859 - DNA, 15 bp, Homo sapiens
tggcctggacagtat

SEQ ID NO: 4907860 - DNA, 13 bp, Homo sapiens
tggcctggactgt

SEQ ID NO: 4907861 - DNA, 16 bp, Homo sapiens
tggcctggcacacatc

SEQ ID NO: 4907862 - DNA, 18 bp, Homo sapiens
tggcctggcacacatcag

SEQ ID NO: 4907863 - DNA, 14 bp, Homo sapiens
tggcctggccctgc

SEQ ID NO: 4907864 - DNA, 13 bp, Homo sapiens
tggcctggcctgg

SEQ ID NO: 4907865 - DNA, 15 bp, Homo sapiens
tggcctggcctggcc

SEQ ID NO: 4907866 - DNA, 16 bp, Homo sapiens
tggcctggcctggccc

SEQ ID NO: 4907867 - DNA, 17 bp, Homo sapiens
tggcctggcctggccct

SEQ ID NO: 4907868 - DNA, 16 bp, Homo sapiens
tggcctgtctcatccc

SEQ ID NO: 4907869 - DNA, 24 bp, Homo sapiens
tggcctgtctcatccccaggggtc

SEQ ID NO: 4907870 - DNA, 18 bp, Homo sapiens
tggccttgaaaccacctt

SEQ ID NO: 4907871 - DNA, 21 bp, Homo sapiens
tggccttggcttttctagcct

SEQ ID NO: 4907872 - DNA, 14 bp, Homo sapiens
tggcctttcctctc

SEQ ID NO: 4907873 - DNA, 17 bp, Homo sapiens
tggcgctattacaaata

SEQ ID NO: 4907874 - DNA, 14 bp, Homo sapiens
tggcgttgttgcat

SEQ ID NO: 4907875 - DNA, 21 bp, Homo sapiens
tggctaactatatttgctttt

SEQ ID NO: 4907876 - DNA, 16 bp, Homo sapiens
tggctaataaggcttt

SEQ ID NO: 4907877 - DNA, 22 bp, Homo sapiens
tggctagaggccagccccaccc

SEQ ID NO: 4907878 - DNA, 23 bp, Homo sapiens
tggctagaggccagccccaccca

SEQ ID NO: 4907879 - DNA, 16 bp, Homo sapiens
tggctagagtcctcac

SEQ ID NO: 4907880 - DNA, 22 bp, Homo sapiens
tggctattagagatcaacccct

SEQ ID NO: 4907881 - DNA, 22 bp, Homo sapiens
tggctcacagtacagcatgtgc

SEQ ID NO: 4907882 - DNA, 14 bp, Homo sapiens
tggctcaccttccg

SEQ ID NO: 4907883 - DNA, 13 bp, Homo sapiens
tggctcagagggg

SEQ ID NO: 4907884 - DNA, 22 bp, Homo sapiens
tggctcagagggggactgctgc

SEQ ID NO: 4907885 - DNA, 14 bp, Homo sapiens
tggctcagctcggg

SEQ ID NO: 4907886 - DNA, 22 bp, Homo sapiens
tggctcagctcggggagcctta

SEQ ID NO: 4907887 - DNA, 20 bp, Homo sapiens
tggctccagaaatgtctaaa

SEQ ID NO: 4907888 - DNA, 16 bp, Homo sapiens
tggctcccacaggagt

SEQ ID NO: 4907889 - DNA, 20 bp, Homo sapiens
tggctcccacaggcccttcc

SEQ ID NO: 4907890 - DNA, 16 bp, Homo sapiens
tggctcctcccggtgc

SEQ ID NO: 4907891 - DNA, 18 bp, Homo sapiens
tggctcctcccggtgccc

SEQ ID NO: 4907892 - DNA, 21 bp, Homo sapiens
tggctcctgaggggcatctgc

SEQ ID NO: 4907893 - DNA, 17 bp, Homo sapiens
tggctccttcccatcgc

SEQ ID NO: 4907894 - DNA, 16 bp, Homo sapiens
tggctcctttacaaaa

SEQ ID NO: 4907895 - DNA, 15 bp, Homo sapiens
tggctctggactcta

SEQ ID NO: 4907896 - DNA, 13 bp, Homo sapiens
tggctctggagac

SEQ ID NO: 4907897 - DNA, 20 bp, Homo sapiens
tggctcttgatacccccctc

SEQ ID NO: 4907898 - DNA, 22 bp, Homo sapiens
tggctgactaaatttggggaca

SEQ ID NO: 4907899 - DNA, 13 bp, Homo sapiens
tggctgcagggag

SEQ ID NO: 4907900 - DNA, 15 bp, Homo sapiens
tggctgcagggagtc

SEQ ID NO: 4907901 - DNA, 20 bp, Homo sapiens
tggctgccccaacctgctga

SEQ ID NO: 4907902 - DNA, 13 bp, Homo sapiens
tggctggaagggg

SEQ ID NO: 4907903 - DNA, 12 bp, Homo sapiens
tggctgggggcc

SEQ ID NO: 4907904 - DNA, 15 bp, Homo sapiens
tggctgtaaggctct

SEQ ID NO: 4907905 - DNA, 18 bp, Homo sapiens
tggctgtagatcccaaga

SEQ ID NO: 4907906 - DNA, 15 bp, Homo sapiens
tggctgtgaggcccc

SEQ ID NO: 4907907 - DNA, 15 bp, Homo sapiens
tggctgttggctggg

SEQ ID NO: 4907908 - DNA, 18 bp, Homo sapiens
tggctgttggctgggggc

SEQ ID NO: 4907909 - DNA, 18 bp, Homo sapiens
tggcttattttaatgtga

SEQ ID NO: 4907910 - DNA, 21 bp, Homo sapiens
tggcttattttaatgtgatga

SEQ ID NO: 4907911 - DNA, 17 bp, Homo sapiens
tggcttcccatgtcttt

SEQ ID NO: 4907912 - DNA, 16 bp, Homo sapiens
tggcttcccgctcagc

SEQ ID NO: 4907913 - DNA, 13 bp, Homo sapiens
tggcttcctcctg

SEQ ID NO: 4907914 - DNA, 21 bp, Homo sapiens
tggcttctgtgatgagctgat

SEQ ID NO: 4907915 - DNA, 15 bp, Homo sapiens
tggcttgagaaatat

SEQ ID NO: 4907916 - DNA, 14 bp, Homo sapiens
tggcttgtagaatt

SEQ ID NO: 4907917 - DNA, 16 bp, Homo sapiens
tggcttgtagaattgt

SEQ ID NO: 4907918 - DNA, 17 bp, Homo sapiens
tggctttcattattagt

SEQ ID NO: 4907919 - DNA, 21 bp, Homo sapiens
tggctttccttgtggcagagg

SEQ ID NO: 4907920 - DNA, 20 bp, Homo sapiens
tggctttctcccactgagtt

SEQ ID NO: 4907921 - DNA, 15 bp, Homo sapiens
tggcttttcactgct

SEQ ID NO: 4907922 - DNA, 18 bp, Homo sapiens
tggcttttcactgctggc

SEQ ID NO: 4907923 - DNA, 21 bp, Homo sapiens
tggcttttcatgcgtgtgtgt

SEQ ID NO: 4907924 - DNA, 16 bp, Homo sapiens
tgggaaaacactgcca

SEQ ID NO: 4907925 - DNA, 21 bp, Homo sapiens
tgggaaaggaggcatgcctct

SEQ ID NO: 4907926 - DNA, 19 bp, Homo sapiens
tgggaaatgagaaggcagc

SEQ ID NO: 4907927 - DNA, 17 bp, Homo sapiens
tgggaacctcccagagg

SEQ ID NO: 4907928 - DNA, 21 bp, Homo sapiens
tgggaacctcccagaggtcca

SEQ ID NO: 4907929 - DNA, 24 bp, Homo sapiens
tgggaacgcagatgatccatgagt

SEQ ID NO: 4907930 - DNA, 16 bp, Homo sapiens
tgggaactctgacaag

SEQ ID NO: 4907931 - DNA, 15 bp, Homo sapiens
tgggaagctgagggc

SEQ ID NO: 4907932 - DNA, 20 bp, Homo sapiens
tgggaagggtcatagaaagg

SEQ ID NO: 4907933 - DNA, 15 bp, Homo sapiens
tgggaagtgaagact

SEQ ID NO: 4907934 - DNA, 15 bp, Homo sapiens
tgggaataattgctt

SEQ ID NO: 4907935 - DNA, 20 bp, Homo sapiens
tgggacccatagatcttctg

SEQ ID NO: 4907936 - DNA, 18 bp, Homo sapiens
tgggactacaggcaccca

SEQ ID NO: 4907937 - DNA, 15 bp, Homo sapiens
tgggagagcccctgg

SEQ ID NO: 4907938 - DNA, 13 bp, Homo sapiens
tgggagcaggaga

SEQ ID NO: 4907939 - DNA, 14 bp, Homo sapiens
tgggagcagtccat

SEQ ID NO: 4907940 - DNA, 17 bp, Homo sapiens
tgggagcagtccatgca

SEQ ID NO: 4907941 - DNA, 16 bp, Homo sapiens
tgggagccccagggtc

SEQ ID NO: 4907942 - DNA, 15 bp, Homo sapiens
tgggagcctctgggg

SEQ ID NO: 4907943 - DNA, 22 bp, Homo sapiens
tgggagcgtcagggttggtgtg

SEQ ID NO: 4907944 - DNA, 14 bp, Homo sapiens
tgggagctcctctc

SEQ ID NO: 4907945 - DNA, 16 bp, Homo sapiens
tgggagctcctctcct

SEQ ID NO: 4907946 - DNA, 17 bp, Homo sapiens
tgggagctcctctcctg

SEQ ID NO: 4907947 - DNA, 18 bp, Homo sapiens
tgggagctcctctcctgg

SEQ ID NO: 4907948 - DNA, 20 bp, Homo sapiens
tgggagctcctctcctggag

SEQ ID NO: 4907949 - DNA, 21 bp, Homo sapiens
tgggagctcctctcctggagg

SEQ ID NO: 4907950 - DNA, 17 bp, Homo sapiens
tgggagctgcctgttca

SEQ ID NO: 4907951 - DNA, 22 bp, Homo sapiens
tgggagctgcctgttcagctcc

SEQ ID NO: 4907952 - DNA, 18 bp, Homo sapiens
tgggagctggttagaaat

SEQ ID NO: 4907953 - DNA, 17 bp, Homo sapiens
tgggagggagcagacag

SEQ ID NO: 4907954 - DNA, 18 bp, Homo sapiens
tgggagggggagaaaagg

SEQ ID NO: 4907955 - DNA, 16 bp, Homo sapiens
tgggaggtcaggaaac

SEQ ID NO: 4907956 - DNA, 14 bp, Homo sapiens
tgggagtccaggca

SEQ ID NO: 4907957 - DNA, 17 bp, Homo sapiens
tgggagtccaggcacag

SEQ ID NO: 4907958 - DNA, 18 bp, Homo sapiens
tgggagtccaggcacagg

SEQ ID NO: 4907959 - DNA, 19 bp, Homo sapiens
tgggagtccaggcacagga

SEQ ID NO: 4907960 - DNA, 15 bp, Homo sapiens
tgggagtgagctggt

SEQ ID NO: 4907961 - DNA, 23 bp, Homo sapiens
tgggataaagatgcaaggaccag

SEQ ID NO: 4907962 - DNA, 16 bp, Homo sapiens
tgggatactgcagggc

SEQ ID NO: 4907963 - DNA, 16 bp, Homo sapiens
tgggcaacagagcaag

SEQ ID NO: 4907964 - DNA, 16 bp, Homo sapiens
tgggcaacccccagcc

SEQ ID NO: 4907965 - DNA, 17 bp, Homo sapiens
tgggcaacccccagcct

SEQ ID NO: 4907966 - DNA, 21 bp, Homo sapiens
tgggcaacccccagcctgcta

SEQ ID NO: 4907967 - DNA, 14 bp, Homo sapiens
tgggcaaggaaaaa

SEQ ID NO: 4907968 - DNA, 16 bp, Homo sapiens
tgggcacactctgcca

SEQ ID NO: 4907969 - DNA, 16 bp, Homo sapiens
tgggcaccccactgca

SEQ ID NO: 4907970 - DNA, 15 bp, Homo sapiens
tgggcactgggatga

SEQ ID NO: 4907971 - DNA, 16 bp, Homo sapiens
tgggcactgggatgag

SEQ ID NO: 4907972 - DNA, 18 bp, Homo sapiens
tgggcagagcccccagga

SEQ ID NO: 4907973 - DNA, 19 bp, Homo sapiens
tgggcagcaatttaaatgt

SEQ ID NO: 4907974 - DNA, 18 bp, Homo sapiens
tgggcagcatagcaagac

SEQ ID NO: 4907975 - DNA, 20 bp, Homo sapiens
tgggcatggtaccagccctg

SEQ ID NO: 4907976 - DNA, 22 bp, Homo sapiens
tgggcatggtaccagccctggg

SEQ ID NO: 4907977 - DNA, 21 bp, Homo sapiens
tgggccaaatccgctctcttc

SEQ ID NO: 4907978 - DNA, 23 bp, Homo sapiens
tgggccaaatccgctctcttcct

SEQ ID NO: 4907979 - DNA, 17 bp, Homo sapiens
tgggccacccctcctag

SEQ ID NO: 4907980 - DNA, 12 bp, Homo sapiens
tgggccagggct

SEQ ID NO: 4907981 - DNA, 20 bp, Homo sapiens
tgggccagggctgccctgag

SEQ ID NO: 4907982 - DNA, 21 bp, Homo sapiens
tgggccagggctgccctgaga

SEQ ID NO: 4907983 - DNA, 13 bp, Homo sapiens
tgggccagggtct

SEQ ID NO: 4907984 - DNA, 14 bp, Homo sapiens
tgggccagggtctg

SEQ ID NO: 4907985 - DNA, 17 bp, Homo sapiens
tgggccatgtccaaaga

SEQ ID NO: 4907986 - DNA, 23 bp, Homo sapiens
tgggccatgtccaaagaggctgc

SEQ ID NO: 4907987 - DNA, 19 bp, Homo sapiens
tgggccccccagctcaggg

SEQ ID NO: 4907988 - DNA, 14 bp, Homo sapiens
tgggcctcctgtgt

SEQ ID NO: 4907989 - DNA, 12 bp, Homo sapiens
tgggcctggcat

SEQ ID NO: 4907990 - DNA, 19 bp, Homo sapiens
tgggccttagtgggccagg

SEQ ID NO: 4907991 - DNA, 15 bp, Homo sapiens
tgggctatggacaca

SEQ ID NO: 4907992 - DNA, 18 bp, Homo sapiens
tgggctatggacacaggg

SEQ ID NO: 4907993 - DNA, 19 bp, Homo sapiens
tgggctatggacacagggt

SEQ ID NO: 4907994 - DNA, 23 bp, Homo sapiens
tgggctcctggcagaagggagca

SEQ ID NO: 4907995 - DNA, 19 bp, Homo sapiens
tgggctctgacagaaagca

SEQ ID NO: 4907996 - DNA, 20 bp, Homo sapiens
tgggctctgcaattcccctc

SEQ ID NO: 4907997 - DNA, 22 bp, Homo sapiens
tgggctctgcaattcccctctg

SEQ ID NO: 4907998 - DNA, 17 bp, Homo sapiens
tgggctgccctggtgct

SEQ ID NO: 4907999 - DNA, 21 bp, Homo sapiens
tgggctgccctggtgctgcca

SEQ ID NO: 4908000 - DNA, 16 bp, Homo sapiens
tgggctgctcctcatg

SEQ ID NO: 4908001 - DNA, 22 bp, Homo sapiens
tgggctggtattggtggctttc

SEQ ID NO: 4908002 - DNA, 14 bp, Homo sapiens
tgggcttaagaaat

SEQ ID NO: 4908003 - DNA, 23 bp, Homo sapiens
tgggcttcactgtataaatagga

SEQ ID NO: 4908004 - DNA, 15 bp, Homo sapiens
tgggcttcagtggca

SEQ ID NO: 4908005 - DNA, 19 bp, Homo sapiens
tgggcttcagtggcagctg

SEQ ID NO: 4908006 - DNA, 20 bp, Homo sapiens
tgggcttcagtggcagctgc

SEQ ID NO: 4908007 - DNA, 14 bp, Homo sapiens
tggggaaacctaga

SEQ ID NO: 4908008 - DNA, 19 bp, Homo sapiens
tggggaaagacactgcctg

SEQ ID NO: 4908009 - DNA, 21 bp, Homo sapiens
tggggacgctccgctgccgtg

SEQ ID NO: 4908010 - DNA, 15 bp, Homo sapiens
tggggagaggaactc

SEQ ID NO: 4908011 - DNA, 18 bp, Homo sapiens
tggggagcccgtctcagt

SEQ ID NO: 4908012 - DNA, 21 bp, Homo sapiens
tggggagcccgtctcagtgtt

SEQ ID NO: 4908013 - DNA, 16 bp, Homo sapiens
tggggaggtgtcacat

SEQ ID NO: 4908014 - DNA, 16 bp, Homo sapiens
tggggataaaatgact

SEQ ID NO: 4908015 - DNA, 20 bp, Homo sapiens
tggggataaaatgactactt

SEQ ID NO: 4908016 - DNA, 15 bp, Homo sapiens
tggggatgagaaagg

SEQ ID NO: 4908017 - DNA, 15 bp, Homo sapiens
tggggatgtgggagg

SEQ ID NO: 4908018 - DNA, 11 bp, Homo sapiens
tggggcacagt

SEQ ID NO: 4908019 - DNA, 15 bp, Homo sapiens
tggggcacagtccag

SEQ ID NO: 4908020 - DNA, 15 bp, Homo sapiens
tggggcagagcctcc

SEQ ID NO: 4908021 - DNA, 18 bp, Homo sapiens
tggggcaggctgggccat

SEQ ID NO: 4908022 - DNA, 18 bp, Homo sapiens
tggggcctacagctttga

SEQ ID NO: 4908023 - DNA, 14 bp, Homo sapiens
tggggcctccagaa

SEQ ID NO: 4908024 - DNA, 11 bp, Homo sapiens
tggggcctgag

SEQ ID NO: 4908025 - DNA, 14 bp, Homo sapiens
tggggcctgagaga

SEQ ID NO: 4908026 - DNA, 15 bp, Homo sapiens
tggggcctggacctg

SEQ ID NO: 4908027 - DNA, 16 bp, Homo sapiens
tggggcctggacctgc

SEQ ID NO: 4908028 - DNA, 17 bp, Homo sapiens
tggggcctggacctgcc

SEQ ID NO: 4908029 - DNA, 11 bp, Homo sapiens
tggggcctggc

SEQ ID NO: 4908030 - DNA, 12 bp, Homo sapiens
tggggcctgtgg

SEQ ID NO: 4908031 - DNA, 12 bp, Homo sapiens
tggggcttggcg

SEQ ID NO: 4908032 - DNA, 16 bp, Homo sapiens
tgggggccacctgcct

SEQ ID NO: 4908033 - DNA, 18 bp, Homo sapiens
tgggggccacctgcctgc

SEQ ID NO: 4908034 - DNA, 19 bp, Homo sapiens
tgggggccacctgcctgcg

SEQ ID NO: 4908035 - DNA, 18 bp, Homo sapiens
tgggggtcaggcagccag

SEQ ID NO: 4908036 - DNA, 22 bp, Homo sapiens
tgggggttctttcttcctctgc

SEQ ID NO: 4908037 - DNA, 20 bp, Homo sapiens
tggggtacccactgctctgg

SEQ ID NO: 4908038 - DNA, 22 bp, Homo sapiens
tggggtattggacatagatatt

SEQ ID NO: 4908039 - DNA, 23 bp, Homo sapiens
tggggtctcacagtgttgcccag

SEQ ID NO: 4908040 - DNA, 16 bp, Homo sapiens
tggggtgacagtcatc

SEQ ID NO: 4908041 - DNA, 14 bp, Homo sapiens
tggggttgtgttgt

SEQ ID NO: 4908042 - DNA, 20 bp, Homo sapiens
tgggtaaatgcaaagttctg

SEQ ID NO: 4908043 - DNA, 23 bp, Homo sapiens
tgggtaatccaggcacagctgag

SEQ ID NO: 4908044 - DNA, 21 bp, Homo sapiens
tgggtatttgcaatattcctt

SEQ ID NO: 4908045 - DNA, 19 bp, Homo sapiens
tgggtcacacacggaggca

SEQ ID NO: 4908046 - DNA, 22 bp, Homo sapiens
tgggtccccctcagcaagccct

SEQ ID NO: 4908047 - DNA, 20 bp, Homo sapiens
tgggtctcgctttgttgccc

SEQ ID NO: 4908048 - DNA, 14 bp, Homo sapiens
tgggtctgtgcatt

SEQ ID NO: 4908049 - DNA, 22 bp, Homo sapiens
tgggtcttgttttttttttcca

SEQ ID NO: 4908050 - DNA, 18 bp, Homo sapiens
tgggtgagatgctggaga

SEQ ID NO: 4908051 - DNA, 21 bp, Homo sapiens
tgggtgagatgctggagaaga

SEQ ID NO: 4908052 - DNA, 14 bp, Homo sapiens
tgggtggtaccctc

SEQ ID NO: 4908053 - DNA, 19 bp, Homo sapiens
tgggtgtcatttcattcca

SEQ ID NO: 4908054 - DNA, 15 bp, Homo sapiens
tgggttattctggag

SEQ ID NO: 4908055 - DNA, 17 bp, Homo sapiens
tgggttattctggagtt

SEQ ID NO: 4908056 - DNA, 23 bp, Homo sapiens
tgggttcaagcgattcttctgct

SEQ ID NO: 4908057 - DNA, 16 bp, Homo sapiens
tgggttcatgatgcag

SEQ ID NO: 4908058 - DNA, 18 bp, Homo sapiens
tggtaacagttcatgttt

SEQ ID NO: 4908059 - DNA, 15 bp, Homo sapiens
tggtaagagacagaa

SEQ ID NO: 4908060 - DNA, 20 bp, Homo sapiens
tggtaagagacagaatgtat

SEQ ID NO: 4908061 - DNA, 22 bp, Homo sapiens
tggtaatttaagattccagaga

SEQ ID NO: 4908062 - DNA, 15 bp, Homo sapiens
tggtaccagccctgg

SEQ ID NO: 4908063 - DNA, 17 bp, Homo sapiens
tggtactccctctcagg

SEQ ID NO: 4908064 - DNA, 21 bp, Homo sapiens
tggtagcttttcccttctttt

SEQ ID NO: 4908065 - DNA, 21 bp, Homo sapiens
tggtaggccttttaacatttt

SEQ ID NO: 4908066 - DNA, 19 bp, Homo sapiens
tggtattcaggattacatg

SEQ ID NO: 4908067 - DNA, 17 bp, Homo sapiens
tggtcaaaagctggatt

SEQ ID NO: 4908068 - DNA, 15 bp, Homo sapiens
tggtcacagcctcct

SEQ ID NO: 4908069 - DNA, 23 bp, Homo sapiens
tggtcacaggactctgcctcctc

SEQ ID NO: 4908070 - DNA, 15 bp, Homo sapiens
tggtcaggccctggt

SEQ ID NO: 4908071 - DNA, 19 bp, Homo sapiens
tggtcatgtgggtcttcca

SEQ ID NO: 4908072 - DNA, 22 bp, Homo sapiens
tggtcatgtgggtcttccaggg

SEQ ID NO: 4908073 - DNA, 14 bp, Homo sapiens
tggtccatgcaggg

SEQ ID NO: 4908074 - DNA, 22 bp, Homo sapiens
tggtccctccagaaccaccccg

SEQ ID NO: 4908075 - DNA, 17 bp, Homo sapiens
tggtcctaaaagcaaaa

SEQ ID NO: 4908076 - DNA, 12 bp, Homo sapiens
tggtcctgactt

SEQ ID NO: 4908077 - DNA, 14 bp, Homo sapiens
tggtcgcccaggag

SEQ ID NO: 4908078 - DNA, 12 bp, Homo sapiens
tggtctaaaact

SEQ ID NO: 4908079 - DNA, 12 bp, Homo sapiens
tggtctcagaaa

SEQ ID NO: 4908080 - DNA, 12 bp, Homo sapiens
tggtctcaggat

SEQ ID NO: 4908081 - DNA, 13 bp, Homo sapiens
tggtctcaggata

SEQ ID NO: 4908082 - DNA, 17 bp, Homo sapiens
tggtctgacccactgct

SEQ ID NO: 4908083 - DNA, 14 bp, Homo sapiens
tggtctttgtaaga

SEQ ID NO: 4908084 - DNA, 15 bp, Homo sapiens
tggtgaaaatgtact

SEQ ID NO: 4908085 - DNA, 23 bp, Homo sapiens
tggtgaaagctgagaactcctga

SEQ ID NO: 4908086 - DNA, 13 bp, Homo sapiens
tggtgaagagtag

SEQ ID NO: 4908087 - DNA, 17 bp, Homo sapiens
tggtgacctctgcctga

SEQ ID NO: 4908088 - DNA, 15 bp, Homo sapiens
tggtgcagacagaag

SEQ ID NO: 4908089 - DNA, 14 bp, Homo sapiens
tggtgccatcccca

SEQ ID NO: 4908090 - DNA, 24 bp, Homo sapiens
tggtgcctggcctggcacacatca

SEQ ID NO: 4908091 - DNA, 13 bp, Homo sapiens
tggtgctgccaca

SEQ ID NO: 4908092 - DNA, 16 bp, Homo sapiens
tggtgcttaagttcca

SEQ ID NO: 4908093 - DNA, 12 bp, Homo sapiens
tggtggcagctg

SEQ ID NO: 4908094 - DNA, 15 bp, Homo sapiens
tggtggcagctgcgg

SEQ ID NO: 4908095 - DNA, 12 bp, Homo sapiens
tggtggcagtgg

SEQ ID NO: 4908096 - DNA, 13 bp, Homo sapiens
tggtggcctcagc

SEQ ID NO: 4908097 - DNA, 13 bp, Homo sapiens
tggtggctgggtt

SEQ ID NO: 4908098 - DNA, 14 bp, Homo sapiens
tggtggctgtggaa

SEQ ID NO: 4908099 - DNA, 19 bp, Homo sapiens
tggtgggttcaggggactc

SEQ ID NO: 4908100 - DNA, 17 bp, Homo sapiens
tggtgtaataagacata

SEQ ID NO: 4908101 - DNA, 23 bp, Homo sapiens
tggtgtatagaagtttgtccatt

SEQ ID NO: 4908102 - DNA, 18 bp, Homo sapiens
tggtgtcagtatccaggc

SEQ ID NO: 4908103 - DNA, 22 bp, Homo sapiens
tggtgtgatcttaatatatttg

SEQ ID NO: 4908104 - DNA, 21 bp, Homo sapiens
tggtgtgttggacagagaagg

SEQ ID NO: 4908105 - DNA, 13 bp, Homo sapiens
tggttagaaatgc

SEQ ID NO: 4908106 - DNA, 14 bp, Homo sapiens
tggttagaaatgca

SEQ ID NO: 4908107 - DNA, 19 bp, Homo sapiens
tggttatgaaagaatatat

SEQ ID NO: 4908108 - DNA, 13 bp, Homo sapiens
tggttctgatgcc

SEQ ID NO: 4908109 - DNA, 22 bp, Homo sapiens
tggttggtaacacaaattttca

SEQ ID NO: 4908110 - DNA, 15 bp, Homo sapiens
tggttgtgtctgctt

SEQ ID NO: 4908111 - DNA, 20 bp, Homo sapiens
tggtttaaaaatacatgttc

SEQ ID NO: 4908112 - DNA, 15 bp, Homo sapiens
tggtttacaggccct

SEQ ID NO: 4908113 - DNA, 19 bp, Homo sapiens
tggtttacaggccctgctc

SEQ ID NO: 4908114 - DNA, 13 bp, Homo sapiens
tggtttacattta

SEQ ID NO: 4908115 - DNA, 14 bp, Homo sapiens
tggtttacatttaa

SEQ ID NO: 4908116 - DNA, 15 bp, Homo sapiens
tggtttacatttaaa

SEQ ID NO: 4908117 - DNA, 20 bp, Homo sapiens
tggtttacatttaaagcatt

SEQ ID NO: 4908118 - DNA, 21 bp, Homo sapiens
tggtttatagagggccaagac

SEQ ID NO: 4908119 - DNA, 13 bp, Homo sapiens
tggtttatatttt

SEQ ID NO: 4908120 - DNA, 15 bp, Homo sapiens
tggtttctcattctt

SEQ ID NO: 4908121 - DNA, 20 bp, Homo sapiens
tggtttgatggtgacttcct

SEQ ID NO: 4908122 - DNA, 12 bp, Homo sapiens
tggttttaacaa

SEQ ID NO: 4908123 - DNA, 22 bp, Homo sapiens
tggttttttttttttttttggc

SEQ ID NO: 4908124 - DNA, 16 bp, Homo sapiens
tgtaaaacctgtcaat

SEQ ID NO: 4908125 - DNA, 16 bp, Homo sapiens
tgtaaaacgctgtcaa

SEQ ID NO: 4908126 - DNA, 20 bp, Homo sapiens
tgtaaaatgtgaagtgaatg

SEQ ID NO: 4908127 - DNA, 16 bp, Homo sapiens
tgtaaactcaaaactt

SEQ ID NO: 4908128 - DNA, 21 bp, Homo sapiens
tgtaaactcaaaacttaacat

SEQ ID NO: 4908129 - DNA, 15 bp, Homo sapiens
tgtaaactcaaaata

SEQ ID NO: 4908130 - DNA, 22 bp, Homo sapiens
tgtaaactgccatatataacag

SEQ ID NO: 4908131 - DNA, 20 bp, Homo sapiens
tgtaaactggaattaaaagg

SEQ ID NO: 4908132 - DNA, 16 bp, Homo sapiens
tgtaaaggagtcaaaa

SEQ ID NO: 4908133 - DNA, 19 bp, Homo sapiens
tgtaaaggagtcaaaacta

SEQ ID NO: 4908134 - DNA, 13 bp, Homo sapiens
tgtaaatacataa

SEQ ID NO: 4908135 - DNA, 11 bp, Homo sapiens
tgtaaatacca

SEQ ID NO: 4908136 - DNA, 19 bp, Homo sapiens
tgtaaataccaggattttt

SEQ ID NO: 4908137 - DNA, 15 bp, Homo sapiens
tgtaaataccattga

SEQ ID NO: 4908138 - DNA, 15 bp, Homo sapiens
tgtaaatagctcagg

SEQ ID NO: 4908139 - DNA, 14 bp, Homo sapiens
tgtaaatattctat

SEQ ID NO: 4908140 - DNA, 16 bp, Homo sapiens
tgtaaatattctatat

SEQ ID NO: 4908141 - DNA, 16 bp, Homo sapiens
tgtaaatcctgccatt

SEQ ID NO: 4908142 - DNA, 11 bp, Homo sapiens
tgtaaatgtta

SEQ ID NO: 4908143 - DNA, 19 bp, Homo sapiens
tgtaaatgttatttctgca

SEQ ID NO: 4908144 - DNA, 21 bp, Homo sapiens
tgtaaatgttatttctgcaaa

SEQ ID NO: 4908145 - DNA, 21 bp, Homo sapiens
tgtaacacagctgagagactt

SEQ ID NO: 4908146 - DNA, 22 bp, Homo sapiens
tgtaacatcactatccatgcac

SEQ ID NO: 4908147 - DNA, 23 bp, Homo sapiens
tgtaacctgttgctgtgtttaat

SEQ ID NO: 4908148 - DNA, 18 bp, Homo sapiens
tgtaactaggctcagaga

SEQ ID NO: 4908149 - DNA, 17 bp, Homo sapiens
tgtaacttatattgaag

SEQ ID NO: 4908150 - DNA, 18 bp, Homo sapiens
tgtaacttatattgaaga

SEQ ID NO: 4908151 - DNA, 15 bp, Homo sapiens
tgtaacttatgtaga

SEQ ID NO: 4908152 - DNA, 23 bp, Homo sapiens
tgtaacttatgtagatatttggc

SEQ ID NO: 4908153 - DNA, 15 bp, Homo sapiens
tgtaacttttgtaag

SEQ ID NO: 4908154 - DNA, 18 bp, Homo sapiens
tgtaagagtgtagaagca

SEQ ID NO: 4908155 - DNA, 20 bp, Homo sapiens
tgtaagagtgtagaagcatt

SEQ ID NO: 4908156 - DNA, 18 bp, Homo sapiens
tgtaagattatagattct

SEQ ID NO: 4908157 - DNA, 21 bp, Homo sapiens
tgtaagccaaagaaatgaaca

SEQ ID NO: 4908158 - DNA, 22 bp, Homo sapiens
tgtaagccaaagaaatgaacat

SEQ ID NO: 4908159 - DNA, 14 bp, Homo sapiens
tgtaaggctctaga

SEQ ID NO: 4908160 - DNA, 13 bp, Homo sapiens
tgtaagtttcagg

SEQ ID NO: 4908161 - DNA, 19 bp, Homo sapiens
tgtaagtttcaggtgacat

SEQ ID NO: 4908162 - DNA, 14 bp, Homo sapiens
tgtaataagacata

SEQ ID NO: 4908163 - DNA, 16 bp, Homo sapiens
tgtaataatacctcaa

SEQ ID NO: 4908164 - DNA, 23 bp, Homo sapiens
tgtaataatacctcaatgtttga

SEQ ID NO: 4908165 - DNA, 16 bp, Homo sapiens
tgtaatagaaaactga

SEQ ID NO: 4908166 - DNA, 20 bp, Homo sapiens
tgtaatagaaaactgaaaat

SEQ ID NO: 4908167 - DNA, 22 bp, Homo sapiens
tgtaatattttgtattattgct

SEQ ID NO: 4908168 - DNA, 17 bp, Homo sapiens
tgtaatctctctgcagc

SEQ ID NO: 4908169 - DNA, 19 bp, Homo sapiens
tgtaatctctctgcagctg

SEQ ID NO: 4908170 - DNA, 21 bp, Homo sapiens
tgtaatctctctgcagctgcc

SEQ ID NO: 4908171 - DNA, 18 bp, Homo sapiens
tgtaatgaaaatgaatat

SEQ ID NO: 4908172 - DNA, 12 bp, Homo sapiens
tgtaatgctgca

SEQ ID NO: 4908173 - DNA, 13 bp, Homo sapiens
tgtaatgctgcac

SEQ ID NO: 4908174 - DNA, 14 bp, Homo sapiens
tgtaatgctgcact

SEQ ID NO: 4908175 - DNA, 20 bp, Homo sapiens
tgtaatgtgtggtggcctca

SEQ ID NO: 4908176 - DNA, 22 bp, Homo sapiens
tgtaatgtgtggtggcctcagc

SEQ ID NO: 4908177 - DNA, 16 bp, Homo sapiens
tgtaatgtttgttacc

SEQ ID NO: 4908178 - DNA, 18 bp, Homo sapiens
tgtaattaaattatggta

SEQ ID NO: 4908179 - DNA, 15 bp, Homo sapiens
tgtaattatgatttg

SEQ ID NO: 4908180 - DNA, 14 bp, Homo sapiens
tgtaattcttcagt

SEQ ID NO: 4908181 - DNA, 16 bp, Homo sapiens
tgtaattgctttttta

SEQ ID NO: 4908182 - DNA, 13 bp, Homo sapiens
tgtacaaaataaa

SEQ ID NO: 4908183 - DNA, 17 bp, Homo sapiens
tgtacaaaataaacaaa

SEQ ID NO: 4908184 - DNA, 17 bp, Homo sapiens
tgtacacgtgtcctgta

SEQ ID NO: 4908185 - DNA, 17 bp, Homo sapiens
tgtacactgacttgaga

SEQ ID NO: 4908186 - DNA, 21 bp, Homo sapiens
tgtacagaaaagggcggcttc

SEQ ID NO: 4908187 - DNA, 16 bp, Homo sapiens
tgtacaggaactgcat

SEQ ID NO: 4908188 - DNA, 23 bp, Homo sapiens
tgtacataaattgcataaagcat

SEQ ID NO: 4908189 - DNA, 14 bp, Homo sapiens
tgtacatagattta

SEQ ID NO: 4908190 - DNA, 18 bp, Homo sapiens
tgtacatagttatttatt

SEQ ID NO: 4908191 - DNA, 14 bp, Homo sapiens
tgtacatctggcct

SEQ ID NO: 4908192 - DNA, 15 bp, Homo sapiens
tgtacatctggctta

SEQ ID NO: 4908193 - DNA, 21 bp, Homo sapiens
tgtacatctggcttattttaa

SEQ ID NO: 4908194 - DNA, 15 bp, Homo sapiens
tgtacatttaaaatt

SEQ ID NO: 4908195 - DNA, 16 bp, Homo sapiens
tgtacattttgttgta

SEQ ID NO: 4908196 - DNA, 17 bp, Homo sapiens
tgtacattttgttgtaa

SEQ ID NO: 4908197 - DNA, 18 bp, Homo sapiens
tgtaccatatgatctgtt

SEQ ID NO: 4908198 - DNA, 17 bp, Homo sapiens
tgtacctcccctgcctt

SEQ ID NO: 4908199 - DNA, 22 bp, Homo sapiens
tgtacctcccctgccttgctgt

SEQ ID NO: 4908200 - DNA, 17 bp, Homo sapiens
tgtacctctggctgact

SEQ ID NO: 4908201 - DNA, 17 bp, Homo sapiens
tgtacctgttccttaga

SEQ ID NO: 4908202 - DNA, 19 bp, Homo sapiens
tgtacgtttgtatgtgtgt

SEQ ID NO: 4908203 - DNA, 20 bp, Homo sapiens
tgtacgtttgtatgtgtgta

SEQ ID NO: 4908204 - DNA, 18 bp, Homo sapiens
tgtactagtactgtgtac

SEQ ID NO: 4908205 - DNA, 13 bp, Homo sapiens
tgtactagtttta

SEQ ID NO: 4908206 - DNA, 21 bp, Homo sapiens
tgtactatggaaaatcagctg

SEQ ID NO: 4908207 - DNA, 15 bp, Homo sapiens
tgtactgctcaggct

SEQ ID NO: 4908208 - DNA, 21 bp, Homo sapiens
tgtactgtatagacagtttgt

SEQ ID NO: 4908209 - DNA, 15 bp, Homo sapiens
tgtacttaactattc

SEQ ID NO: 4908210 - DNA, 17 bp, Homo sapiens
tgtacttcctgagtggc

SEQ ID NO: 4908211 - DNA, 21 bp, Homo sapiens
tgtacttcgtcttctaatttc

SEQ ID NO: 4908212 - DNA, 18 bp, Homo sapiens
tgtactttgcttgctcat

SEQ ID NO: 4908213 - DNA, 23 bp, Homo sapiens
tgtacttttattttacacagaaa

SEQ ID NO: 4908214 - DNA, 15 bp, Homo sapiens
tgtagaagcattcct

SEQ ID NO: 4908215 - DNA, 17 bp, Homo sapiens
tgtagaatgatttcatg

SEQ ID NO: 4908216 - DNA, 16 bp, Homo sapiens
tgtagaattgttatag

SEQ ID NO: 4908217 - DNA, 15 bp, Homo sapiens
tgtagactatataca

SEQ ID NO: 4908218 - DNA, 19 bp, Homo sapiens
tgtagactatatacatgtg

SEQ ID NO: 4908219 - DNA, 20 bp, Homo sapiens
tgtagactatatacatgtgt

SEQ ID NO: 4908220 - DNA, 21 bp, Homo sapiens
tgtagactatatacatgtgtg

SEQ ID NO: 4908221 - DNA, 23 bp, Homo sapiens
tgtagactatatacatgtgtgta

SEQ ID NO: 4908222 - DNA, 14 bp, Homo sapiens
tgtagagcttctgg

SEQ ID NO: 4908223 - DNA, 16 bp, Homo sapiens
tgtagagttaagaagc

SEQ ID NO: 4908224 - DNA, 15 bp, Homo sapiens
tgtagatatttggct

SEQ ID NO: 4908225 - DNA, 16 bp, Homo sapiens
tgtagatatttggctt

SEQ ID NO: 4908226 - DNA, 22 bp, Homo sapiens
tgtagatcccaagatgactggg

SEQ ID NO: 4908227 - DNA, 23 bp, Homo sapiens
tgtagcagtgagaaaaagctcct

SEQ ID NO: 4908228 - DNA, 15 bp, Homo sapiens
tgtagcatataggtg

SEQ ID NO: 4908229 - DNA, 17 bp, Homo sapiens
tgtagccaggtatggct

SEQ ID NO: 4908230 - DNA, 22 bp, Homo sapiens
tgtagccaggtatggctctgca

SEQ ID NO: 4908231 - DNA, 16 bp, Homo sapiens
tgtagccccctggcct

SEQ ID NO: 4908232 - DNA, 17 bp, Homo sapiens
tgtagccccctggcctc

SEQ ID NO: 4908233 - DNA, 18 bp, Homo sapiens
tgtagccccctggcctct

SEQ ID NO: 4908234 - DNA, 20 bp, Homo sapiens
tgtagccccctggcctctgt

SEQ ID NO: 4908235 - DNA, 23 bp, Homo sapiens
tgtagcctggatattattcttgt

SEQ ID NO: 4908236 - DNA, 20 bp, Homo sapiens
tgtagcgtgtttacatgtgt

SEQ ID NO: 4908237 - DNA, 12 bp, Homo sapiens
tgtagctgtaaa

SEQ ID NO: 4908238 - DNA, 13 bp, Homo sapiens
tgtagctgtaaaa

SEQ ID NO: 4908239 - DNA, 17 bp, Homo sapiens
tgtagctgtaaaacgct

SEQ ID NO: 4908240 - DNA, 12 bp, Homo sapiens
tgtagctttgct

SEQ ID NO: 4908241 - DNA, 19 bp, Homo sapiens
tgtaggaaggtctcattct

SEQ ID NO: 4908242 - DNA, 20 bp, Homo sapiens
tgtaggaaggtctcattctt

SEQ ID NO: 4908243 - DNA, 21 bp, Homo sapiens
tgtaggaaggtctcattcttc

SEQ ID NO: 4908244 - DNA, 13 bp, Homo sapiens
tgtaggagacttg

SEQ ID NO: 4908245 - DNA, 20 bp, Homo sapiens
tgtaggagctacccttttcc

SEQ ID NO: 4908246 - DNA, 16 bp, Homo sapiens
tgtaggtggtatgtga

SEQ ID NO: 4908247 - DNA, 19 bp, Homo sapiens
tgtagtaattgacatgtgc

SEQ ID NO: 4908248 - DNA, 18 bp, Homo sapiens
tgtagtagccctttctgt

SEQ ID NO: 4908249 - DNA, 16 bp, Homo sapiens
tgtagtagcgtttttt

SEQ ID NO: 4908250 - DNA, 22 bp, Homo sapiens
tgtagtagcgttttttaaatgt

SEQ ID NO: 4908251 - DNA, 23 bp, Homo sapiens
tgtagtcctagccactcaggagg

SEQ ID NO: 4908252 - DNA, 14 bp, Homo sapiens
tgtagtgattcaaa

SEQ ID NO: 4908253 - DNA, 14 bp, Homo sapiens
tgtagttaatttat

SEQ ID NO: 4908254 - DNA, 20 bp, Homo sapiens
tgtagttgcgtggactctgc

SEQ ID NO: 4908255 - DNA, 16 bp, Homo sapiens
tgtagtttacagaaaa

SEQ ID NO: 4908256 - DNA, 20 bp, Homo sapiens
tgtataaacattaaatgtct

SEQ ID NO: 4908257 - DNA, 23 bp, Homo sapiens
tgtataaagcaactgttatgaaa

SEQ ID NO: 4908258 - DNA, 21 bp, Homo sapiens
tgtataaatctttcttttgat

SEQ ID NO: 4908259 - DNA, 11 bp, Homo sapiens
tgtataaatgt

SEQ ID NO: 4908260 - DNA, 12 bp, Homo sapiens
tgtataaatgta

SEQ ID NO: 4908261 - DNA, 14 bp, Homo sapiens
tgtataaatgtata

SEQ ID NO: 4908262 - DNA, 21 bp, Homo sapiens
tgtataaatgtatatacacat

SEQ ID NO: 4908263 - DNA, 21 bp, Homo sapiens
tgtataacttcttaaaagttg

SEQ ID NO: 4908264 - DNA, 17 bp, Homo sapiens
tgtataagatcctagat

SEQ ID NO: 4908265 - DNA, 12 bp, Homo sapiens
tgtataatttcg

SEQ ID NO: 4908266 - DNA, 13 bp, Homo sapiens
tgtataatttcga

SEQ ID NO: 4908267 - DNA, 15 bp, Homo sapiens
tgtatacaaatatat

SEQ ID NO: 4908268 - DNA, 16 bp, Homo sapiens
tgtatacaaatatatt

SEQ ID NO: 4908269 - DNA, 15 bp, Homo sapiens
tgtatacatcctggg

SEQ ID NO: 4908270 - DNA, 17 bp, Homo sapiens
tgtatactatagtacca

SEQ ID NO: 4908271 - DNA, 14 bp, Homo sapiens
tgtatactttaaat

SEQ ID NO: 4908272 - DNA, 13 bp, Homo sapiens
tgtatactttagt

SEQ ID NO: 4908273 - DNA, 15 bp, Homo sapiens
tgtatactttagtat

SEQ ID NO: 4908274 - DNA, 21 bp, Homo sapiens
tgtatagacagtttgtaaatg

SEQ ID NO: 4908275 - DNA, 13 bp, Homo sapiens
tgtatatatacat

SEQ ID NO: 4908276 - DNA, 14 bp, Homo sapiens
tgtatatatgtgta

SEQ ID NO: 4908277 - DNA, 18 bp, Homo sapiens
tgtatatcagaaaaggga

SEQ ID NO: 4908278 - DNA, 18 bp, Homo sapiens
tgtatatcctttctaaca

SEQ ID NO: 4908279 - DNA, 23 bp, Homo sapiens
tgtatattacacatttgtacaga

SEQ ID NO: 4908280 - DNA, 13 bp, Homo sapiens
tgtatattatttg

SEQ ID NO: 4908281 - DNA, 24 bp, Homo sapiens
tgtatattatttggcagtttggta

SEQ ID NO: 4908282 - DNA, 19 bp, Homo sapiens
tgtatcagaagagagggga

SEQ ID NO: 4908283 - DNA, 17 bp, Homo sapiens
tgtatcatagaaatgta

SEQ ID NO: 4908284 - DNA, 21 bp, Homo sapiens
tgtatcatctggataggagcc

SEQ ID NO: 4908285 - DNA, 15 bp, Homo sapiens
tgtatcccatgagcc

SEQ ID NO: 4908286 - DNA, 16 bp, Homo sapiens
tgtatcccatgagcct

SEQ ID NO: 4908287 - DNA, 20 bp, Homo sapiens
tgtatcccccccctgtatag

SEQ ID NO: 4908288 - DNA, 21 bp, Homo sapiens
tgtatcccccccctgtatagt

SEQ ID NO: 4908289 - DNA, 19 bp, Homo sapiens
tgtatcgatgttttattat

SEQ ID NO: 4908290 - DNA, 19 bp, Homo sapiens
tgtatcgtaaccagccaga

SEQ ID NO: 4908291 - DNA, 17 bp, Homo sapiens
tgtatctctgaagcatg

SEQ ID NO: 4908292 - DNA, 23 bp, Homo sapiens
tgtatctctgaagcatgtttcat

SEQ ID NO: 4908293 - DNA, 16 bp, Homo sapiens
tgtatctctttcacat

SEQ ID NO: 4908294 - DNA, 19 bp, Homo sapiens
tgtatctgagttgccaaga

SEQ ID NO: 4908295 - DNA, 13 bp, Homo sapiens
tgtatctgtgaag

SEQ ID NO: 4908296 - DNA, 11 bp, Homo sapiens
tgtatctgtgt

SEQ ID NO: 4908297 - DNA, 12 bp, Homo sapiens
tgtatctgtgta

SEQ ID NO: 4908298 - DNA, 13 bp, Homo sapiens
tgtatctgtgtag

SEQ ID NO: 4908299 - DNA, 16 bp, Homo sapiens
tgtatctgtgtagact

SEQ ID NO: 4908300 - DNA, 13 bp, Homo sapiens
tgtatgatgtgtt

SEQ ID NO: 4908301 - DNA, 18 bp, Homo sapiens
tgtatgatgtgttgtgat

SEQ ID NO: 4908302 - DNA, 18 bp, Homo sapiens
tgtatggaaataaatgta

SEQ ID NO: 4908303 - DNA, 13 bp, Homo sapiens
tgtatggggaggc

SEQ ID NO: 4908304 - DNA, 15 bp, Homo sapiens
tgtattaacaaaagt

SEQ ID NO: 4908305 - DNA, 14 bp, Homo sapiens
tgtattattgctgt

SEQ ID NO: 4908306 - DNA, 15 bp, Homo sapiens
tgtattatttataat

SEQ ID NO: 4908307 - DNA, 20 bp, Homo sapiens
tgtattgagatttcttaaat

SEQ ID NO: 4908308 - DNA, 18 bp, Homo sapiens
tgtattggttaaaactgt

SEQ ID NO: 4908309 - DNA, 19 bp, Homo sapiens
tgtattgtaaacatgtgtt

SEQ ID NO: 4908310 - DNA, 20 bp, Homo sapiens
tgtatttaagcaaatactta

SEQ ID NO: 4908311 - DNA, 21 bp, Homo sapiens
tgtatttacgctttgattcat

SEQ ID NO: 4908312 - DNA, 13 bp, Homo sapiens
tgtatttatgtaa

SEQ ID NO: 4908313 - DNA, 16 bp, Homo sapiens
tgtatttatgtgtgag

SEQ ID NO: 4908314 - DNA, 23 bp, Homo sapiens
tgtatttattgaagaaacagata

SEQ ID NO: 4908315 - DNA, 14 bp, Homo sapiens
tgtattttgtgtga

SEQ ID NO: 4908316 - DNA, 15 bp, Homo sapiens
tgtattttgtgtgac

SEQ ID NO: 4908317 - DNA, 19 bp, Homo sapiens
tgtattttgtgtgaccaac

SEQ ID NO: 4908318 - DNA, 19 bp, Homo sapiens
tgtatttttctacattatt

SEQ ID NO: 4908319 - DNA, 14 bp, Homo sapiens
tgtcaaaaaaaaaa

SEQ ID NO: 4908320 - DNA, 15 bp, Homo sapiens
tgtcaaaacactgtg

SEQ ID NO: 4908321 - DNA, 19 bp, Homo sapiens
tgtcaagtgggatctgtca

SEQ ID NO: 4908322 - DNA, 18 bp, Homo sapiens
tgtcaagttcctttgggt

SEQ ID NO: 4908323 - DNA, 13 bp, Homo sapiens
tgtcacacacttt

SEQ ID NO: 4908324 - DNA, 16 bp, Homo sapiens
tgtcacaggcaggtcc

SEQ ID NO: 4908325 - DNA, 21 bp, Homo sapiens
tgtcacaggcaggtccagggt

SEQ ID NO: 4908326 - DNA, 12 bp, Homo sapiens
tgtcacagggcc

SEQ ID NO: 4908327 - DNA, 13 bp, Homo sapiens
tgtcacagggcca

SEQ ID NO: 4908328 - DNA, 15 bp, Homo sapiens
tgtcacatcagataa

SEQ ID NO: 4908329 - DNA, 18 bp, Homo sapiens
tgtcacatggtgccccta

SEQ ID NO: 4908330 - DNA, 20 bp, Homo sapiens
tgtcacatggtgcccctagc

SEQ ID NO: 4908331 - DNA, 16 bp, Homo sapiens
tgtcacattgcattct

SEQ ID NO: 4908332 - DNA, 22 bp, Homo sapiens
tgtcaccctccacctcttcacc

SEQ ID NO: 4908333 - DNA, 15 bp, Homo sapiens
tgtcactcattgctg

SEQ ID NO: 4908334 - DNA, 21 bp, Homo sapiens
tgtcactcattgctgagcctc

SEQ ID NO: 4908335 - DNA, 23 bp, Homo sapiens
tgtcactcattgctgagcctctg

SEQ ID NO: 4908336 - DNA, 18 bp, Homo sapiens
tgtcactgacacaaagga

SEQ ID NO: 4908337 - DNA, 23 bp, Homo sapiens
tgtcactggtagaccaaaataaa

SEQ ID NO: 4908338 - DNA, 17 bp, Homo sapiens
tgtcacttgtgctttgc

SEQ ID NO: 4908339 - DNA, 16 bp, Homo sapiens
tgtcagacataaagcc

SEQ ID NO: 4908340 - DNA, 23 bp, Homo sapiens
tgtcagcgcaggtttagtttact

SEQ ID NO: 4908341 - DNA, 16 bp, Homo sapiens
tgtcaggtggggcagc

SEQ ID NO: 4908342 - DNA, 23 bp, Homo sapiens
tgtcagtatttcagtgtagttaa

SEQ ID NO: 4908343 - DNA, 18 bp, Homo sapiens
tgtcataaacagatgaat

SEQ ID NO: 4908344 - DNA, 15 bp, Homo sapiens
tgtcatagaaattac

SEQ ID NO: 4908345 - DNA, 14 bp, Homo sapiens
tgtcatcagatgga

SEQ ID NO: 4908346 - DNA, 23 bp, Homo sapiens
tgtcatccttggtctttgtatct

SEQ ID NO: 4908347 - DNA, 16 bp, Homo sapiens
tgtcattcaaatgggt

SEQ ID NO: 4908348 - DNA, 21 bp, Homo sapiens
tgtcattcaaatgggtgatat

SEQ ID NO: 4908349 - DNA, 16 bp, Homo sapiens
tgtcatttgagcaggg

SEQ ID NO: 4908350 - DNA, 22 bp, Homo sapiens
tgtcatttgagcagggctcagc

SEQ ID NO: 4908351 - DNA, 18 bp, Homo sapiens
tgtcatttgttgtgatgt

SEQ ID NO: 4908352 - DNA, 17 bp, Homo sapiens
tgtccaaagaggctgcc

SEQ ID NO: 4908353 - DNA, 21 bp, Homo sapiens
tgtccaaagaggctgcccctc

SEQ ID NO: 4908354 - DNA, 21 bp, Homo sapiens
tgtccacccacctatgtgcca

SEQ ID NO: 4908355 - DNA, 21 bp, Homo sapiens
tgtccagagagcaactctgag

SEQ ID NO: 4908356 - DNA, 14 bp, Homo sapiens
tgtccagcctgggc

SEQ ID NO: 4908357 - DNA, 16 bp, Homo sapiens
tgtccatattttcaca

SEQ ID NO: 4908358 - DNA, 20 bp, Homo sapiens
tgtccatttatccacaggaa

SEQ ID NO: 4908359 - DNA, 21 bp, Homo sapiens
tgtccatttatccacaggaaa

SEQ ID NO: 4908360 - DNA, 23 bp, Homo sapiens
tgtcccacccccacccccagctc

SEQ ID NO: 4908361 - DNA, 16 bp, Homo sapiens
tgtcccaggtcctcac

SEQ ID NO: 4908362 - DNA, 17 bp, Homo sapiens
tgtcccaggtcctcact

SEQ ID NO: 4908363 - DNA, 17 bp, Homo sapiens
tgtcccatgcaggccct

SEQ ID NO: 4908364 - DNA, 18 bp, Homo sapiens
tgtcccatggacactcca

SEQ ID NO: 4908365 - DNA, 21 bp, Homo sapiens
tgtccctaccgagtctcttct

SEQ ID NO: 4908366 - DNA, 22 bp, Homo sapiens
tgtccctaccgagtctcttctc

SEQ ID NO: 4908367 - DNA, 17 bp, Homo sapiens
tgtccctcccacctctg

SEQ ID NO: 4908368 - DNA, 14 bp, Homo sapiens
tgtccctccccctt

SEQ ID NO: 4908369 - DNA, 16 bp, Homo sapiens
tgtccctcttcactcc

SEQ ID NO: 4908370 - DNA, 22 bp, Homo sapiens
tgtccctgcacttgcagactct

SEQ ID NO: 4908371 - DNA, 14 bp, Homo sapiens
tgtccctgggccag

SEQ ID NO: 4908372 - DNA, 15 bp, Homo sapiens
tgtccctgggccagg

SEQ ID NO: 4908373 - DNA, 18 bp, Homo sapiens
tgtcccttgatgcacaga

SEQ ID NO: 4908374 - DNA, 15 bp, Homo sapiens
tgtccgctgggtggt

SEQ ID NO: 4908375 - DNA, 22 bp, Homo sapiens
tgtccgctgggtggtaccctct

SEQ ID NO: 4908376 - DNA, 16 bp, Homo sapiens
tgtcctacccaccctc

SEQ ID NO: 4908377 - DNA, 19 bp, Homo sapiens
tgtcctatctatcttccaa

SEQ ID NO: 4908378 - DNA, 14 bp, Homo sapiens
tgtcctatgtgtga

SEQ ID NO: 4908379 - DNA, 19 bp, Homo sapiens
tgtcctcactgctccctga

SEQ ID NO: 4908380 - DNA, 15 bp, Homo sapiens
tgtcctcagcatttc

SEQ ID NO: 4908381 - DNA, 23 bp, Homo sapiens
tgtcctcagggagcagggaaggc

SEQ ID NO: 4908382 - DNA, 16 bp, Homo sapiens
tgtcctccagaagcct

SEQ ID NO: 4908383 - DNA, 18 bp, Homo sapiens
tgtcctccagaagcctct

SEQ ID NO: 4908384 - DNA, 19 bp, Homo sapiens
tgtcctccagaagcctctg

SEQ ID NO: 4908385 - DNA, 17 bp, Homo sapiens
tgtcctcccatcccctg

SEQ ID NO: 4908386 - DNA, 18 bp, Homo sapiens
tgtcctcccatcccctgg

SEQ ID NO: 4908387 - DNA, 19 bp, Homo sapiens
tgtcctcccatcccctgga

SEQ ID NO: 4908388 - DNA, 13 bp, Homo sapiens
tgtcctctcccct

SEQ ID NO: 4908389 - DNA, 23 bp, Homo sapiens
tgtcctgaaaattgtttcaagaa

SEQ ID NO: 4908390 - DNA, 12 bp, Homo sapiens
tgtcctgggagt

SEQ ID NO: 4908391 - DNA, 23 bp, Homo sapiens
tgtcctttcccttcagtaccctc

SEQ ID NO: 4908392 - DNA, 13 bp, Homo sapiens
tgtcgcctctgca

SEQ ID NO: 4908393 - DNA, 15 bp, Homo sapiens
tgtcgggcaccagcc

SEQ ID NO: 4908394 - DNA, 19 bp, Homo sapiens
tgtcgggcaccagccagcg

SEQ ID NO: 4908395 - DNA, 13 bp, Homo sapiens
tgtctaaaaacac

SEQ ID NO: 4908396 - DNA, 16 bp, Homo sapiens
tgtctaaacaatgctg

SEQ ID NO: 4908397 - DNA, 21 bp, Homo sapiens
tgtctaaacaatgctgatttg

SEQ ID NO: 4908398 - DNA, 20 bp, Homo sapiens
tgtctaactcagaattattt

SEQ ID NO: 4908399 - DNA, 14 bp, Homo sapiens
tgtctaagattcta

SEQ ID NO: 4908400 - DNA, 17 bp, Homo sapiens
tgtctaagattctagat

SEQ ID NO: 4908401 - DNA, 18 bp, Homo sapiens
tgtctaagattctagatc

SEQ ID NO: 4908402 - DNA, 18 bp, Homo sapiens
tgtctaattgcatctcaa

SEQ ID NO: 4908403 - DNA, 19 bp, Homo sapiens
tgtctaattgcatctcaaa

SEQ ID NO: 4908404 - DNA, 13 bp, Homo sapiens
tgtctacaaatat

SEQ ID NO: 4908405 - DNA, 22 bp, Homo sapiens
tgtctataatcccagcactttg

SEQ ID NO: 4908406 - DNA, 14 bp, Homo sapiens
tgtctatgggactc

SEQ ID NO: 4908407 - DNA, 15 bp, Homo sapiens
tgtctatgggactca

SEQ ID NO: 4908408 - DNA, 15 bp, Homo sapiens
tgtctattttaaaat

SEQ ID NO: 4908409 - DNA, 16 bp, Homo sapiens
tgtctattttaaaata

SEQ ID NO: 4908410 - DNA, 21 bp, Homo sapiens
tgtctcaaacttcagatggga

SEQ ID NO: 4908411 - DNA, 17 bp, Homo sapiens
tgtctcaagagggcact

SEQ ID NO: 4908412 - DNA, 23 bp, Homo sapiens
tgtctcaagagggcactggtggc

SEQ ID NO: 4908413 - DNA, 13 bp, Homo sapiens
tgtctcagcctcc

SEQ ID NO: 4908414 - DNA, 15 bp, Homo sapiens
tgtctcagcctccca

SEQ ID NO: 4908415 - DNA, 16 bp, Homo sapiens
tgtctcaggtccctgc

SEQ ID NO: 4908416 - DNA, 16 bp, Homo sapiens
tgtctcagttggaaat

SEQ ID NO: 4908417 - DNA, 16 bp, Homo sapiens
tgtctcatccccaggg

SEQ ID NO: 4908418 - DNA, 14 bp, Homo sapiens
tgtctccactgtgc

SEQ ID NO: 4908419 - DNA, 17 bp, Homo sapiens
tgtctcctactcctgac

SEQ ID NO: 4908420 - DNA, 15 bp, Homo sapiens
tgtctctaacttatt

SEQ ID NO: 4908421 - DNA, 13 bp, Homo sapiens
tgtctctcctttt

SEQ ID NO: 4908422 - DNA, 16 bp, Homo sapiens
tgtctctccttttctt

SEQ ID NO: 4908423 - DNA, 20 bp, Homo sapiens
tgtctctccttttcttttgt

SEQ ID NO: 4908424 - DNA, 19 bp, Homo sapiens
tgtctctcttcagactctc

SEQ ID NO: 4908425 - DNA, 15 bp, Homo sapiens
tgtctctgataaaag

SEQ ID NO: 4908426 - DNA, 11 bp, Homo sapiens
tgtctctgctc

SEQ ID NO: 4908427 - DNA, 21 bp, Homo sapiens
tgtctctttaatgtcacaggc

SEQ ID NO: 4908428 - DNA, 22 bp, Homo sapiens
tgtctctttaatgtcacaggca

SEQ ID NO: 4908429 - DNA, 12 bp, Homo sapiens
tgtctgaaaaat

SEQ ID NO: 4908430 - DNA, 18 bp, Homo sapiens
tgtctgaagtcactgcac

SEQ ID NO: 4908431 - DNA, 20 bp, Homo sapiens
tgtctgaagtcactgcacag

SEQ ID NO: 4908432 - DNA, 22 bp, Homo sapiens
tgtctgaatcgagtgagacaaa

SEQ ID NO: 4908433 - DNA, 16 bp, Homo sapiens
tgtctgattggcttgt

SEQ ID NO: 4908434 - DNA, 11 bp, Homo sapiens
tgtctgccctt

SEQ ID NO: 4908435 - DNA, 22 bp, Homo sapiens
tgtctgtatttcatgtggctgt

SEQ ID NO: 4908436 - DNA, 19 bp, Homo sapiens
tgtctgtttgtttcaagaa

SEQ ID NO: 4908437 - DNA, 20 bp, Homo sapiens
tgtctgtttgtttcaagaac

SEQ ID NO: 4908438 - DNA, 19 bp, Homo sapiens
tgtcttaatttttgaaaaa

SEQ ID NO: 4908439 - DNA, 13 bp, Homo sapiens
tgtcttatatata

SEQ ID NO: 4908440 - DNA, 22 bp, Homo sapiens
tgtcttatatatatttctttgt

SEQ ID NO: 4908441 - DNA, 17 bp, Homo sapiens
tgtcttcatttcattgt

SEQ ID NO: 4908442 - DNA, 18 bp, Homo sapiens
tgtcttccattccattgt

SEQ ID NO: 4908443 - DNA, 17 bp, Homo sapiens
tgtcttgaatgtctttt

SEQ ID NO: 4908444 - DNA, 20 bp, Homo sapiens
tgtcttgaatgtcttttgaa

SEQ ID NO: 4908445 - DNA, 17 bp, Homo sapiens
tgtcttgcaatggcagc

SEQ ID NO: 4908446 - DNA, 19 bp, Homo sapiens
tgtcttggacactgtacaa

SEQ ID NO: 4908447 - DNA, 20 bp, Homo sapiens
tgtcttgtacatgtgtagcc

SEQ ID NO: 4908448 - DNA, 22 bp, Homo sapiens
tgtcttgtacatgtgtagcctg

SEQ ID NO: 4908449 - DNA, 15 bp, Homo sapiens
tgtctttaaggaaaa

SEQ ID NO: 4908450 - DNA, 17 bp, Homo sapiens
tgtctttctccaaagtt

SEQ ID NO: 4908451 - DNA, 13 bp, Homo sapiens
tgtctttgtaagt

SEQ ID NO: 4908452 - DNA, 17 bp, Homo sapiens
tgtctttgtaagtcagt

SEQ ID NO: 4908453 - DNA, 20 bp, Homo sapiens
tgtcttttatagtggaaaaa

SEQ ID NO: 4908454 - DNA, 15 bp, Homo sapiens
tgtcttttatatttg

SEQ ID NO: 4908455 - DNA, 22 bp, Homo sapiens
tgtcttttcttggcaaaagcct

SEQ ID NO: 4908456 - DNA, 13 bp, Homo sapiens
tgtcttttgtcat

SEQ ID NO: 4908457 - DNA, 13 bp, Homo sapiens
tgtgaaaatgggt

SEQ ID NO: 4908458 - DNA, 14 bp, Homo sapiens
tgtgaaaatgtgtt

SEQ ID NO: 4908459 - DNA, 14 bp, Homo sapiens
tgtgaaatgctggc

SEQ ID NO: 4908460 - DNA, 16 bp, Homo sapiens
tgtgaaccaccacacc

SEQ ID NO: 4908461 - DNA, 23 bp, Homo sapiens
tgtgaaccaccacacccagccca

SEQ ID NO: 4908462 - DNA, 20 bp, Homo sapiens
tgtgaactagggaagctcag

SEQ ID NO: 4908463 - DNA, 22 bp, Homo sapiens
tgtgaagatgatatactatttt

SEQ ID NO: 4908464 - DNA, 18 bp, Homo sapiens
tgtgaagtgaatgaaaca

SEQ ID NO: 4908465 - DNA, 15 bp, Homo sapiens
tgtgaatgcttctca

SEQ ID NO: 4908466 - DNA, 19 bp, Homo sapiens
tgtgaatggattggattat

SEQ ID NO: 4908467 - DNA, 18 bp, Homo sapiens
tgtgaatgtgggcactgg

SEQ ID NO: 4908468 - DNA, 23 bp, Homo sapiens
tgtgaatttcttcactgttgaaa

SEQ ID NO: 4908469 - DNA, 13 bp, Homo sapiens
tgtgacagggcca

SEQ ID NO: 4908470 - DNA, 15 bp, Homo sapiens
tgtgacagggccagt

SEQ ID NO: 4908471 - DNA, 13 bp, Homo sapiens
tgtgaccaactgt

SEQ ID NO: 4908472 - DNA, 14 bp, Homo sapiens
tgtgaccaactgtg

SEQ ID NO: 4908473 - DNA, 15 bp, Homo sapiens
tgtgaccaactgtgt

SEQ ID NO: 4908474 - DNA, 16 bp, Homo sapiens
tgtgaccaactgtgtt

SEQ ID NO: 4908475 - DNA, 21 bp, Homo sapiens
tgtgacctcaggcactagcct

SEQ ID NO: 4908476 - DNA, 13 bp, Homo sapiens
tgtgaccttctct

SEQ ID NO: 4908477 - DNA, 18 bp, Homo sapiens
tgtgactatatagagatg

SEQ ID NO: 4908478 - DNA, 20 bp, Homo sapiens
tgtgactatatagagatgtt

SEQ ID NO: 4908479 - DNA, 23 bp, Homo sapiens
tgtgactctttttagggccaggc

SEQ ID NO: 4908480 - DNA, 20 bp, Homo sapiens
tgtgactgtacccaaatgga

SEQ ID NO: 4908481 - DNA, 18 bp, Homo sapiens
tgtgacttcagctctgtt

SEQ ID NO: 4908482 - DNA, 16 bp, Homo sapiens
tgtgagacccccacac

SEQ ID NO: 4908483 - DNA, 21 bp, Homo sapiens
tgtgagcccctggtcctgagg

SEQ ID NO: 4908484 - DNA, 22 bp, Homo sapiens
tgtgagcccctggtcctgaggg

SEQ ID NO: 4908485 - DNA, 17 bp, Homo sapiens
tgtgaggagctgctggc

SEQ ID NO: 4908486 - DNA, 13 bp, Homo sapiens
tgtgaggcccctg

SEQ ID NO: 4908487 - DNA, 14 bp, Homo sapiens
tgtgagtaaatatt

SEQ ID NO: 4908488 - DNA, 15 bp, Homo sapiens
tgtgagtcaccaagc

SEQ ID NO: 4908489 - DNA, 17 bp, Homo sapiens
tgtgagtcaccaagccc

SEQ ID NO: 4908490 - DNA, 19 bp, Homo sapiens
tgtgagtcaccaagcccag

SEQ ID NO: 4908491 - DNA, 20 bp, Homo sapiens
tgtgagtctttggttctaag

SEQ ID NO: 4908492 - DNA, 15 bp, Homo sapiens
tgtgagtgtgacagg

SEQ ID NO: 4908493 - DNA, 18 bp, Homo sapiens
tgtgagtgtgacagggcc

SEQ ID NO: 4908494 - DNA, 16 bp, Homo sapiens
tgtgagtttaaagcaa

SEQ ID NO: 4908495 - DNA, 14 bp, Homo sapiens
tgtgatattctaag

SEQ ID NO: 4908496 - DNA, 17 bp, Homo sapiens
tgtgatcacgcctggct

SEQ ID NO: 4908497 - DNA, 18 bp, Homo sapiens
tgtgatcacgcctggcta

SEQ ID NO: 4908498 - DNA, 18 bp, Homo sapiens
tgtgatctgtcttgtaat

SEQ ID NO: 4908499 - DNA, 19 bp, Homo sapiens
tgtgatctgtcttgtaata

SEQ ID NO: 4908500 - DNA, 17 bp, Homo sapiens
tgtgatgatgtaattga

SEQ ID NO: 4908501 - DNA, 16 bp, Homo sapiens
tgtgatgtattctagc

SEQ ID NO: 4908502 - DNA, 17 bp, Homo sapiens
tgtgatgttctaaggct

SEQ ID NO: 4908503 - DNA, 14 bp, Homo sapiens
tgtgattaacttat

SEQ ID NO: 4908504 - DNA, 14 bp, Homo sapiens
tgtgattctaatgt

SEQ ID NO: 4908505 - DNA, 19 bp, Homo sapiens
tgtgcaacgccgtgggctg

SEQ ID NO: 4908506 - DNA, 23 bp, Homo sapiens
tgtgcacgcagattagcaggcca

SEQ ID NO: 4908507 - DNA, 23 bp, Homo sapiens
tgtgcatgtatgtcttggacact

SEQ ID NO: 4908508 - DNA, 14 bp, Homo sapiens
tgtgcatgtgtgta

SEQ ID NO: 4908509 - DNA, 18 bp, Homo sapiens
tgtgcatgtgtgtataag

SEQ ID NO: 4908510 - DNA, 18 bp, Homo sapiens
tgtgccatagagtttaac

SEQ ID NO: 4908511 - DNA, 20 bp, Homo sapiens
tgtgccatagagtttaacac

SEQ ID NO: 4908512 - DNA, 18 bp, Homo sapiens
tgtgccatagtcacatgg

SEQ ID NO: 4908513 - DNA, 14 bp, Homo sapiens
tgtgccccatgcct

SEQ ID NO: 4908514 - DNA, 19 bp, Homo sapiens
tgtgccccatgcctgtcca

SEQ ID NO: 4908515 - DNA, 23 bp, Homo sapiens
tgtgcctggcttctttctctcag

SEQ ID NO: 4908516 - DNA, 13 bp, Homo sapiens
tgtgcctggggga

SEQ ID NO: 4908517 - DNA, 16 bp, Homo sapiens
tgtgccttttatagct

SEQ ID NO: 4908518 - DNA, 21 bp, Homo sapiens
tgtgctactgtctttggaaaa

SEQ ID NO: 4908519 - DNA, 16 bp, Homo sapiens
tgtgctagaatacttt

SEQ ID NO: 4908520 - DNA, 12 bp, Homo sapiens
tgtgctcagaga

SEQ ID NO: 4908521 - DNA, 23 bp, Homo sapiens
tgtgctctgatcatccactgtgc

SEQ ID NO: 4908522 - DNA, 16 bp, Homo sapiens
tgtgctctggacaggc

SEQ ID NO: 4908523 - DNA, 18 bp, Homo sapiens
tgtgctctggacaggcat

SEQ ID NO: 4908524 - DNA, 20 bp, Homo sapiens
tgtgctgatcatttgaggaa

SEQ ID NO: 4908525 - DNA, 20 bp, Homo sapiens
tgtgctggatggagcccagg

SEQ ID NO: 4908526 - DNA, 23 bp, Homo sapiens
tgtgctgggggaatgagcccaga

SEQ ID NO: 4908527 - DNA, 14 bp, Homo sapiens
tgtgctgtggaagc

SEQ ID NO: 4908528 - DNA, 12 bp, Homo sapiens
tgtgcttctccc

SEQ ID NO: 4908529 - DNA, 17 bp, Homo sapiens
tgtgctttgctcttgtc

SEQ ID NO: 4908530 - DNA, 13 bp, Homo sapiens
tgtggaaaacaga

SEQ ID NO: 4908531 - DNA, 16 bp, Homo sapiens
tgtggaacataaaaag

SEQ ID NO: 4908532 - DNA, 19 bp, Homo sapiens
tgtggaacataaaaaggac

SEQ ID NO: 4908533 - DNA, 21 bp, Homo sapiens
tgtggaacccagcagttctgt

SEQ ID NO: 4908534 - DNA, 19 bp, Homo sapiens
tgtggaagaaaatggttta

SEQ ID NO: 4908535 - DNA, 16 bp, Homo sapiens
tgtggaatgagtgtgc

SEQ ID NO: 4908536 - DNA, 18 bp, Homo sapiens
tgtggaatgagtgtgcat

SEQ ID NO: 4908537 - DNA, 15 bp, Homo sapiens
tgtggacacagctct

SEQ ID NO: 4908538 - DNA, 16 bp, Homo sapiens
tgtggagctcagcccc

SEQ ID NO: 4908539 - DNA, 15 bp, Homo sapiens
tgtggaggaaggatt

SEQ ID NO: 4908540 - DNA, 20 bp, Homo sapiens
tgtggaggaaggattgtaaa

SEQ ID NO: 4908541 - DNA, 14 bp, Homo sapiens
tgtggatccaatgt

SEQ ID NO: 4908542 - DNA, 17 bp, Homo sapiens
tgtggatccaatgttag

SEQ ID NO: 4908543 - DNA, 22 bp, Homo sapiens
tgtggattctgaggccctgccc

SEQ ID NO: 4908544 - DNA, 19 bp, Homo sapiens
tgtggcacttgcctgggtc

SEQ ID NO: 4908545 - DNA, 23 bp, Homo sapiens
tgtggcagagagagagaaagaga

SEQ ID NO: 4908546 - DNA, 21 bp, Homo sapiens
tgtggcatctttgccttgggc

SEQ ID NO: 4908547 - DNA, 15 bp, Homo sapiens
tgtggcattgaaatg

SEQ ID NO: 4908548 - DNA, 16 bp, Homo sapiens
tgtggccgaggacttt

SEQ ID NO: 4908549 - DNA, 10 bp, Homo sapiens
tgtggcctca

SEQ ID NO: 4908550 - DNA, 13 bp, Homo sapiens
tgtggctgaggag

SEQ ID NO: 4908551 - DNA, 20 bp, Homo sapiens
tgtggctgtagatcccaaga

SEQ ID NO: 4908552 - DNA, 18 bp, Homo sapiens
tgtggcttttttaaaaaa

SEQ ID NO: 4908553 - DNA, 17 bp, Homo sapiens
tgtgggcactggcccag

SEQ ID NO: 4908554 - DNA, 23 bp, Homo sapiens
tgtgggcactggcccaggttcat

SEQ ID NO: 4908555 - DNA, 21 bp, Homo sapiens
tgtgggcatttcttgcgagcc

SEQ ID NO: 4908556 - DNA, 22 bp, Homo sapiens
tgtgggctagttgggcttcctc

SEQ ID NO: 4908557 - DNA, 17 bp, Homo sapiens
tgtggggacccaggctc

SEQ ID NO: 4908558 - DNA, 14 bp, Homo sapiens
tgtggggggtcctt

SEQ ID NO: 4908559 - DNA, 15 bp, Homo sapiens
tgtgggtgtagccag

SEQ ID NO: 4908560 - DNA, 22 bp, Homo sapiens
tgtggtaggccttttaacattt

SEQ ID NO: 4908561 - DNA, 15 bp, Homo sapiens
tgtggtctcaggata

SEQ ID NO: 4908562 - DNA, 16 bp, Homo sapiens
tgtggtgtgagcttca

SEQ ID NO: 4908563 - DNA, 19 bp, Homo sapiens
tgtggttgacttatgggcc

SEQ ID NO: 4908564 - DNA, 10 bp, Homo sapiens
tgtggtttta

SEQ ID NO: 4908565 - DNA, 21 bp, Homo sapiens
tgtgtaatagaaaactgaaaa

SEQ ID NO: 4908566 - DNA, 13 bp, Homo sapiens
tgtgtaatgaaaa

SEQ ID NO: 4908567 - DNA, 18 bp, Homo sapiens
tgtgtacataactctgta

SEQ ID NO: 4908568 - DNA, 20 bp, Homo sapiens
tgtgtacataactctgtaaa

SEQ ID NO: 4908569 - DNA, 17 bp, Homo sapiens
tgtgtactgtatagaca

SEQ ID NO: 4908570 - DNA, 16 bp, Homo sapiens
tgtgtagagttaagaa

SEQ ID NO: 4908571 - DNA, 23 bp, Homo sapiens
tgtgtagcctgtgcatgtatgtc

SEQ ID NO: 4908572 - DNA, 12 bp, Homo sapiens
tgtgtagggcgg

SEQ ID NO: 4908573 - DNA, 16 bp, Homo sapiens
tgtgtagggcgggagg

SEQ ID NO: 4908574 - DNA, 15 bp, Homo sapiens
tgtgtatatagtttt

SEQ ID NO: 4908575 - DNA, 14 bp, Homo sapiens
tgtgtatatataca

SEQ ID NO: 4908576 - DNA, 15 bp, Homo sapiens
tgtgtatatatacat

SEQ ID NO: 4908577 - DNA, 18 bp, Homo sapiens
tgtgtatatatgtgtata

SEQ ID NO: 4908578 - DNA, 16 bp, Homo sapiens
tgtgtatgtgtattta

SEQ ID NO: 4908579 - DNA, 15 bp, Homo sapiens
tgtgtatttacgctt

SEQ ID NO: 4908580 - DNA, 16 bp, Homo sapiens
tgtgtcacaaagaatt

SEQ ID NO: 4908581 - DNA, 14 bp, Homo sapiens
tgtgtcacttgtgc

SEQ ID NO: 4908582 - DNA, 22 bp, Homo sapiens
tgtgtcacttgtgctttgctct

SEQ ID NO: 4908583 - DNA, 17 bp, Homo sapiens
tgtgtcaggtggggcag

SEQ ID NO: 4908584 - DNA, 16 bp, Homo sapiens
tgtgtccacctgtggg

SEQ ID NO: 4908585 - DNA, 17 bp, Homo sapiens
tgtgtccctcttctctt

SEQ ID NO: 4908586 - DNA, 14 bp, Homo sapiens
tgtgtcctcaggga

SEQ ID NO: 4908587 - DNA, 16 bp, Homo sapiens
tgtgtctaagattcta

SEQ ID NO: 4908588 - DNA, 18 bp, Homo sapiens
tgtgtctaagattctaga

SEQ ID NO: 4908589 - DNA, 19 bp, Homo sapiens
tgtgtctaagattctagat

SEQ ID NO: 4908590 - DNA, 20 bp, Homo sapiens
tgtgtcttgcaatggcagcc

SEQ ID NO: 4908591 - DNA, 10 bp, Homo sapiens
tgtgtctttt

SEQ ID NO: 4908592 - DNA, 12 bp, Homo sapiens
tgtgtgaatgaa

SEQ ID NO: 4908593 - DNA, 18 bp, Homo sapiens
tgtgtgaatgaacactct

SEQ ID NO: 4908594 - DNA, 12 bp, Homo sapiens
tgtgtgaccaac

SEQ ID NO: 4908595 - DNA, 17 bp, Homo sapiens
tgtgtgaccaactgtgt

SEQ ID NO: 4908596 - DNA, 20 bp, Homo sapiens
tgtgtgaccaactgtgttgt

SEQ ID NO: 4908597 - DNA, 17 bp, Homo sapiens
tgtgtgcaaaagcagtg

SEQ ID NO: 4908598 - DNA, 22 bp, Homo sapiens
tgtgtgcaccttaccaactttc

SEQ ID NO: 4908599 - DNA, 23 bp, Homo sapiens
tgtgtgcaccttaccaactttct

SEQ ID NO: 4908600 - DNA, 14 bp, Homo sapiens
tgtgtgcatgtgtg

SEQ ID NO: 4908601 - DNA, 17 bp, Homo sapiens
tgtgtgctcatgtatgt

SEQ ID NO: 4908602 - DNA, 21 bp, Homo sapiens
tgtgtgtactcactgaagcct

SEQ ID NO: 4908603 - DNA, 18 bp, Homo sapiens
tgtgtgtcatgccagtga

SEQ ID NO: 4908604 - DNA, 11 bp, Homo sapiens
tgtgtgtgtat

SEQ ID NO: 4908605 - DNA, 15 bp, Homo sapiens
tgtgtgtgtatgtga

SEQ ID NO: 4908606 - DNA, 14 bp, Homo sapiens
tgtgtgtgtgcatg

SEQ ID NO: 4908607 - DNA, 18 bp, Homo sapiens
tgtgtgttgtcttgaaag

SEQ ID NO: 4908608 - DNA, 16 bp, Homo sapiens
tgtgtgtttgtgctga

SEQ ID NO: 4908609 - DNA, 17 bp, Homo sapiens
tgtgttccaagtttcca

SEQ ID NO: 4908610 - DNA, 18 bp, Homo sapiens
tgtgttccaagtttccaa

SEQ ID NO: 4908611 - DNA, 18 bp, Homo sapiens
tgtgttccctttgtcttt

SEQ ID NO: 4908612 - DNA, 21 bp, Homo sapiens
tgtgttccctttgtctttcaa

SEQ ID NO: 4908613 - DNA, 18 bp, Homo sapiens
tgtgttctcggagtgtgt

SEQ ID NO: 4908614 - DNA, 16 bp, Homo sapiens
tgtgttgaaaaccaaa

SEQ ID NO: 4908615 - DNA, 24 bp, Homo sapiens
tgtgttgcattattcatttagtga

SEQ ID NO: 4908616 - DNA, 15 bp, Homo sapiens
tgtgttgctatcctg

SEQ ID NO: 4908617 - DNA, 19 bp, Homo sapiens
tgtgttgtattaacaaaag

SEQ ID NO: 4908618 - DNA, 13 bp, Homo sapiens
tgtgttgtgatag

SEQ ID NO: 4908619 - DNA, 15 bp, Homo sapiens
tgtgtttatttcact

SEQ ID NO: 4908620 - DNA, 12 bp, Homo sapiens
tgtgttttataa

SEQ ID NO: 4908621 - DNA, 17 bp, Homo sapiens
tgtgttttctctggaat

SEQ ID NO: 4908622 - DNA, 14 bp, Homo sapiens
tgtgtttttattgt

SEQ ID NO: 4908623 - DNA, 19 bp, Homo sapiens
tgtgtttttattgttaact

SEQ ID NO: 4908624 - DNA, 15 bp, Homo sapiens
tgttaaaagattttt

SEQ ID NO: 4908625 - DNA, 14 bp, Homo sapiens
tgttaaaatctatt

SEQ ID NO: 4908626 - DNA, 23 bp, Homo sapiens
tgttaaaattatcaatatctaat

SEQ ID NO: 4908627 - DNA, 19 bp, Homo sapiens
tgttaaactgttagcactg

SEQ ID NO: 4908628 - DNA, 15 bp, Homo sapiens
tgttaaatttgtaag

SEQ ID NO: 4908629 - DNA, 19 bp, Homo sapiens
tgttaaatttgtaagtttc

SEQ ID NO: 4908630 - DNA, 15 bp, Homo sapiens
tgttaaccatttaag

SEQ ID NO: 4908631 - DNA, 14 bp, Homo sapiens
tgttaaggaaactc

SEQ ID NO: 4908632 - DNA, 22 bp, Homo sapiens
tgttaaggaaactcttatctca

SEQ ID NO: 4908633 - DNA, 19 bp, Homo sapiens
tgttaatgatagctactgt

SEQ ID NO: 4908634 - DNA, 18 bp, Homo sapiens
tgttaatgtatttgttca

SEQ ID NO: 4908635 - DNA, 15 bp, Homo sapiens
tgttaccgcctgtct

SEQ ID NO: 4908636 - DNA, 17 bp, Homo sapiens
tgttaccgcctgtctct

SEQ ID NO: 4908637 - DNA, 18 bp, Homo sapiens
tgttacctaaagtatttt

SEQ ID NO: 4908638 - DNA, 14 bp, Homo sapiens
tgttactgttcttg

SEQ ID NO: 4908639 - DNA, 15 bp, Homo sapiens
tgttactgttcttgc

SEQ ID NO: 4908640 - DNA, 18 bp, Homo sapiens
tgttactgttcttgctgc

SEQ ID NO: 4908641 - DNA, 20 bp, Homo sapiens
tgttactgttcttgctgcta

SEQ ID NO: 4908642 - DNA, 22 bp, Homo sapiens
tgttactgttcttgctgctaga

SEQ ID NO: 4908643 - DNA, 17 bp, Homo sapiens
tgttagaaaacaaaatt

SEQ ID NO: 4908644 - DNA, 19 bp, Homo sapiens
tgttagaaaatggacactg

SEQ ID NO: 4908645 - DNA, 17 bp, Homo sapiens
tgttagccccataattt

SEQ ID NO: 4908646 - DNA, 17 bp, Homo sapiens
tgttagttatagatgtc

SEQ ID NO: 4908647 - DNA, 20 bp, Homo sapiens
tgttatatttaatgcattaa

SEQ ID NO: 4908648 - DNA, 14 bp, Homo sapiens
tgttatcagctttc

SEQ ID NO: 4908649 - DNA, 22 bp, Homo sapiens
tgttatcttctcaagttctaag

SEQ ID NO: 4908650 - DNA, 17 bp, Homo sapiens
tgttatgactatgtaaa

SEQ ID NO: 4908651 - DNA, 20 bp, Homo sapiens
tgttatgtactagtgttctg

SEQ ID NO: 4908652 - DNA, 13 bp, Homo sapiens
tgttatgtactgt

SEQ ID NO: 4908653 - DNA, 19 bp, Homo sapiens
tgttattgtgaatgattca

SEQ ID NO: 4908654 - DNA, 17 bp, Homo sapiens
tgttatttagactcatc

SEQ ID NO: 4908655 - DNA, 14 bp, Homo sapiens
tgttattttcagta

SEQ ID NO: 4908656 - DNA, 13 bp, Homo sapiens
tgttcaaacaata

SEQ ID NO: 4908657 - DNA, 19 bp, Homo sapiens
tgttcaaacaatatcatat

SEQ ID NO: 4908658 - DNA, 20 bp, Homo sapiens
tgttcaaacaatatcatatc

SEQ ID NO: 4908659 - DNA, 16 bp, Homo sapiens
tgttcaatgtttaatg

SEQ ID NO: 4908660 - DNA, 18 bp, Homo sapiens
tgttcacgcaacttgaaa

SEQ ID NO: 4908661 - DNA, 14 bp, Homo sapiens
tgttcagctccagc

SEQ ID NO: 4908662 - DNA, 22 bp, Homo sapiens
tgttcagctccagctcaccagc

SEQ ID NO: 4908663 - DNA, 12 bp, Homo sapiens
tgttcatacatt

SEQ ID NO: 4908664 - DNA, 15 bp, Homo sapiens
tgttccaagtttcca

SEQ ID NO: 4908665 - DNA, 18 bp, Homo sapiens
tgttccagtaatctaata

SEQ ID NO: 4908666 - DNA, 20 bp, Homo sapiens
tgttcccatgtagccccctg

SEQ ID NO: 4908667 - DNA, 13 bp, Homo sapiens
tgttccccatctg

SEQ ID NO: 4908668 - DNA, 18 bp, Homo sapiens
tgttccctttgtctttca

SEQ ID NO: 4908669 - DNA, 16 bp, Homo sapiens
tgttctaaagctctga

SEQ ID NO: 4908670 - DNA, 18 bp, Homo sapiens
tgttctaaagctctgaca

SEQ ID NO: 4908671 - DNA, 10 bp, Homo sapiens
tgttctaagg

SEQ ID NO: 4908672 - DNA, 18 bp, Homo sapiens
tgttctaaggctctgaga

SEQ ID NO: 4908673 - DNA, 23 bp, Homo sapiens
tgttctaaggctctgagagtcta

SEQ ID NO: 4908674 - DNA, 14 bp, Homo sapiens
tgttctaagtttct

SEQ ID NO: 4908675 - DNA, 18 bp, Homo sapiens
tgttctacccgttccaaa

SEQ ID NO: 4908676 - DNA, 19 bp, Homo sapiens
tgttctacccgttccaaaa

SEQ ID NO: 4908677 - DNA, 18 bp, Homo sapiens
tgttctcggagtgtgtat

SEQ ID NO: 4908678 - DNA, 15 bp, Homo sapiens
tgttctgcactgaaa

SEQ ID NO: 4908679 - DNA, 16 bp, Homo sapiens
tgttctgcactgaaaa

SEQ ID NO: 4908680 - DNA, 14 bp, Homo sapiens
tgttctgggacaca

SEQ ID NO: 4908681 - DNA, 13 bp, Homo sapiens
tgttctgtgtctt

SEQ ID NO: 4908682 - DNA, 14 bp, Homo sapiens
tgttctgtttgtta

SEQ ID NO: 4908683 - DNA, 14 bp, Homo sapiens
tgttcttgctgcta

SEQ ID NO: 4908684 - DNA, 15 bp, Homo sapiens
tgttcttgctgctag

SEQ ID NO: 4908685 - DNA, 19 bp, Homo sapiens
tgttcttgctgctagaact

SEQ ID NO: 4908686 - DNA, 21 bp, Homo sapiens
tgttcttgctgctagaacttt

SEQ ID NO: 4908687 - DNA, 16 bp, Homo sapiens
tgttctttctggagtc

SEQ ID NO: 4908688 - DNA, 15 bp, Homo sapiens
tgttgaaaaccaaaa

SEQ ID NO: 4908689 - DNA, 17 bp, Homo sapiens
tgttgaaaatgttcaga

SEQ ID NO: 4908690 - DNA, 16 bp, Homo sapiens
tgttgaaattttgcaa

SEQ ID NO: 4908691 - DNA, 21 bp, Homo sapiens
tgttgaaattttgcaaatata

SEQ ID NO: 4908692 - DNA, 18 bp, Homo sapiens
tgttgaagaatacagtta

SEQ ID NO: 4908693 - DNA, 13 bp, Homo sapiens
tgttgaatacttt

SEQ ID NO: 4908694 - DNA, 18 bp, Homo sapiens
tgttgaatactttttaca

SEQ ID NO: 4908695 - DNA, 18 bp, Homo sapiens
tgttgacaactgtgactg

SEQ ID NO: 4908696 - DNA, 16 bp, Homo sapiens
tgttgagccttttccc

SEQ ID NO: 4908697 - DNA, 22 bp, Homo sapiens
tgttgatgtatctgagttgcca

SEQ ID NO: 4908698 - DNA, 18 bp, Homo sapiens
tgttgatttttactgtgt

SEQ ID NO: 4908699 - DNA, 20 bp, Homo sapiens
tgttgatttttactgtgttt

SEQ ID NO: 4908700 - DNA, 22 bp, Homo sapiens
tgttgatttttactgtgtttta

SEQ ID NO: 4908701 - DNA, 14 bp, Homo sapiens
tgttgcatgtttga

SEQ ID NO: 4908702 - DNA, 15 bp, Homo sapiens
tgttgcatgtttgaa

SEQ ID NO: 4908703 - DNA, 16 bp, Homo sapiens
tgttgcattattcatt

SEQ ID NO: 4908704 - DNA, 18 bp, Homo sapiens
tgttgcattattcattta

SEQ ID NO: 4908705 - DNA, 13 bp, Homo sapiens
tgttgcccaggca

SEQ ID NO: 4908706 - DNA, 18 bp, Homo sapiens
tgttgcccaggcaggtct

SEQ ID NO: 4908707 - DNA, 21 bp, Homo sapiens
tgttgccctttctgtaccatt

SEQ ID NO: 4908708 - DNA, 22 bp, Homo sapiens
tgttgcctaagtattaaaacat

SEQ ID NO: 4908709 - DNA, 14 bp, Homo sapiens
tgttgctccctgtg

SEQ ID NO: 4908710 - DNA, 21 bp, Homo sapiens
tgttggcagtgagtgagcctg

SEQ ID NO: 4908711 - DNA, 14 bp, Homo sapiens
tgttggccaggctg

SEQ ID NO: 4908712 - DNA, 23 bp, Homo sapiens
tgttggccaggctggtctaaaac

SEQ ID NO: 4908713 - DNA, 14 bp, Homo sapiens
tgttggctttgttt

SEQ ID NO: 4908714 - DNA, 16 bp, Homo sapiens
tgttggttgttttttc

SEQ ID NO: 4908715 - DNA, 20 bp, Homo sapiens
tgttggttgttttttccttt

SEQ ID NO: 4908716 - DNA, 13 bp, Homo sapiens
tgttgtaaaaaga

SEQ ID NO: 4908717 - DNA, 14 bp, Homo sapiens
tgttgtaaaaagaa

SEQ ID NO: 4908718 - DNA, 22 bp, Homo sapiens
tgttgtaatgctgcacttcctg

SEQ ID NO: 4908719 - DNA, 18 bp, Homo sapiens
tgttgtaattcttcagtt

SEQ ID NO: 4908720 - DNA, 19 bp, Homo sapiens
tgttgtcattgtaaacaaa

SEQ ID NO: 4908721 - DNA, 17 bp, Homo sapiens
tgttgtccttttgtctt

SEQ ID NO: 4908722 - DNA, 13 bp, Homo sapiens
tgttgtgatgtct

SEQ ID NO: 4908723 - DNA, 15 bp, Homo sapiens
tgttgtgtgtgcagg

SEQ ID NO: 4908724 - DNA, 14 bp, Homo sapiens
tgttgttaaaatta

SEQ ID NO: 4908725 - DNA, 14 bp, Homo sapiens
tgttgttatgctat

SEQ ID NO: 4908726 - DNA, 12 bp, Homo sapiens
tgttgtttcttt

SEQ ID NO: 4908727 - DNA, 13 bp, Homo sapiens
tgttgtttctttc

SEQ ID NO: 4908728 - DNA, 15 bp, Homo sapiens
tgttgtttctttcta

SEQ ID NO: 4908729 - DNA, 20 bp, Homo sapiens
tgttgttttgttttaaatac

SEQ ID NO: 4908730 - DNA, 21 bp, Homo sapiens
tgtttaagaaaagtattttga

SEQ ID NO: 4908731 - DNA, 22 bp, Homo sapiens
tgtttaagaaaagtattttgaa

SEQ ID NO: 4908732 - DNA, 18 bp, Homo sapiens
tgtttatcagatacatca

SEQ ID NO: 4908733 - DNA, 23 bp, Homo sapiens
tgtttatcagatacatcactgct

SEQ ID NO: 4908734 - DNA, 13 bp, Homo sapiens
tgtttatgaaaat

SEQ ID NO: 4908735 - DNA, 17 bp, Homo sapiens
tgtttatggccacattt

SEQ ID NO: 4908736 - DNA, 13 bp, Homo sapiens
tgtttatggcctc

SEQ ID NO: 4908737 - DNA, 14 bp, Homo sapiens
tgtttatggcctca

SEQ ID NO: 4908738 - DNA, 14 bp, Homo sapiens
tgtttatttataga

SEQ ID NO: 4908739 - DNA, 14 bp, Homo sapiens
tgtttatttttcat

SEQ ID NO: 4908740 - DNA, 10 bp, Homo sapiens
tgtttcaaga

SEQ ID NO: 4908741 - DNA, 20 bp, Homo sapiens
tgtttcaaggcactctagat

SEQ ID NO: 4908742 - DNA, 21 bp, Homo sapiens
tgtttcagctaagggaagaca

SEQ ID NO: 4908743 - DNA, 22 bp, Homo sapiens
tgtttcagctaagggaagacat

SEQ ID NO: 4908744 - DNA, 23 bp, Homo sapiens
tgtttcagctaagggaagacatt

SEQ ID NO: 4908745 - DNA, 18 bp, Homo sapiens
tgtttccaacctggagta

SEQ ID NO: 4908746 - DNA, 20 bp, Homo sapiens
tgtttccagacttccttgag

SEQ ID NO: 4908747 - DNA, 16 bp, Homo sapiens
tgtttcctcttccaaa

SEQ ID NO: 4908748 - DNA, 23 bp, Homo sapiens
tgtttccttgtttatcagataca

SEQ ID NO: 4908749 - DNA, 19 bp, Homo sapiens
tgtttctgttattaacaaa

SEQ ID NO: 4908750 - DNA, 17 bp, Homo sapiens
tgtttcttcctgttaat

SEQ ID NO: 4908751 - DNA, 13 bp, Homo sapiens
tgtttcttgcttg

SEQ ID NO: 4908752 - DNA, 14 bp, Homo sapiens
tgtttcttgcttgt

SEQ ID NO: 4908753 - DNA, 16 bp, Homo sapiens
tgtttcttgcttgtac

SEQ ID NO: 4908754 - DNA, 15 bp, Homo sapiens
tgtttgaatatggac

SEQ ID NO: 4908755 - DNA, 22 bp, Homo sapiens
tgtttgacaaagttactgattc

SEQ ID NO: 4908756 - DNA, 20 bp, Homo sapiens
tgtttgaggagcatgttttg

SEQ ID NO: 4908757 - DNA, 12 bp, Homo sapiens
tgtttgatgcag

SEQ ID NO: 4908758 - DNA, 16 bp, Homo sapiens
tgtttgcctctgcctc

SEQ ID NO: 4908759 - DNA, 20 bp, Homo sapiens
tgtttggaatgttagaatga

SEQ ID NO: 4908760 - DNA, 17 bp, Homo sapiens
tgtttggatgtaattta

SEQ ID NO: 4908761 - DNA, 19 bp, Homo sapiens
tgtttggatgtaatttagg

SEQ ID NO: 4908762 - DNA, 15 bp, Homo sapiens
tgtttggggatgaga

SEQ ID NO: 4908763 - DNA, 19 bp, Homo sapiens
tgtttggggatgagaaagg

SEQ ID NO: 4908764 - DNA, 18 bp, Homo sapiens
tgtttgggggacgtttct

SEQ ID NO: 4908765 - DNA, 24 bp, Homo sapiens
tgtttgggggacgtttctcatttg

SEQ ID NO: 4908766 - DNA, 14 bp, Homo sapiens
tgtttggtttacat

SEQ ID NO: 4908767 - DNA, 19 bp, Homo sapiens
tgtttgtctgtttgtttca

SEQ ID NO: 4908768 - DNA, 14 bp, Homo sapiens
tgtttgtgtattta

SEQ ID NO: 4908769 - DNA, 15 bp, Homo sapiens
tgtttgtttcaagaa

SEQ ID NO: 4908770 - DNA, 19 bp, Homo sapiens
tgtttgtttcaagaacctg

SEQ ID NO: 4908771 - DNA, 17 bp, Homo sapiens
tgtttgtttcctttgtt

SEQ ID NO: 4908772 - DNA, 21 bp, Homo sapiens
tgttttaaactctcctagtca

SEQ ID NO: 4908773 - DNA, 15 bp, Homo sapiens
tgttttaaattctga

SEQ ID NO: 4908774 - DNA, 15 bp, Homo sapiens
tgttttaagaaatgt

SEQ ID NO: 4908775 - DNA, 16 bp, Homo sapiens
tgttttaagaaatgta

SEQ ID NO: 4908776 - DNA, 16 bp, Homo sapiens
tgttttaagaggcagg

SEQ ID NO: 4908777 - DNA, 22 bp, Homo sapiens
tgttttaagaggcagggtctca

SEQ ID NO: 4908778 - DNA, 15 bp, Homo sapiens
tgttttaatctgaaa

SEQ ID NO: 4908779 - DNA, 15 bp, Homo sapiens
tgttttactgtgaaa

SEQ ID NO: 4908780 - DNA, 15 bp, Homo sapiens
tgttttataagttca

SEQ ID NO: 4908781 - DNA, 18 bp, Homo sapiens
tgttttattttttattgt

SEQ ID NO: 4908782 - DNA, 16 bp, Homo sapiens
tgttttccgtgaaaac

SEQ ID NO: 4908783 - DNA, 16 bp, Homo sapiens
tgttttctgactaatt

SEQ ID NO: 4908784 - DNA, 11 bp, Homo sapiens
tgttttcttct

SEQ ID NO: 4908785 - DNA, 21 bp, Homo sapiens
tgttttctttaaagatgtaat

SEQ ID NO: 4908786 - DNA, 21 bp, Homo sapiens
tgttttctttctttaaatgtt

SEQ ID NO: 4908787 - DNA, 19 bp, Homo sapiens
tgttttgggtagctgccac

SEQ ID NO: 4908788 - DNA, 14 bp, Homo sapiens
tgttttgtatacaa

SEQ ID NO: 4908789 - DNA, 17 bp, Homo sapiens
tgttttgtatacaaata

SEQ ID NO: 4908790 - DNA, 15 bp, Homo sapiens
tgtttttataaaaat

SEQ ID NO: 4908791 - DNA, 21 bp, Homo sapiens
tgtttttatacaaaataagaa

SEQ ID NO: 4908792 - DNA, 12 bp, Homo sapiens
tgtttttctcac

SEQ ID NO: 4908793 - DNA, 12 bp, Homo sapiens
tgtttttctggg

SEQ ID NO: 4908794 - DNA, 15 bp, Homo sapiens
tgtttttgttgtgtg

SEQ ID NO: 4908795 - DNA, 13 bp, Homo sapiens
ttaaaaaaaaaga

SEQ ID NO: 4908796 - DNA, 13 bp, Homo sapiens
ttaaaaaaagaaa

SEQ ID NO: 4908797 - DNA, 12 bp, Homo sapiens
ttaaaaaaatca

SEQ ID NO: 4908798 - DNA, 16 bp, Homo sapiens
ttaaaaaaatttaagt

SEQ ID NO: 4908799 - DNA, 14 bp, Homo sapiens
ttaaaaagaaatct

SEQ ID NO: 4908800 - DNA, 13 bp, Homo sapiens
ttaaaaagattct

SEQ ID NO: 4908801 - DNA, 20 bp, Homo sapiens
ttaaaaagttaatcttcatg

SEQ ID NO: 4908802 - DNA, 17 bp, Homo sapiens
ttaaaaatgtaaatatt

SEQ ID NO: 4908803 - DNA, 20 bp, Homo sapiens
ttaaaaattcttgaaagaat

SEQ ID NO: 4908804 - DNA, 18 bp, Homo sapiens
ttaaaacaaaacaaaaca

SEQ ID NO: 4908805 - DNA, 12 bp, Homo sapiens
ttaaaacagctg

SEQ ID NO: 4908806 - DNA, 20 bp, Homo sapiens
ttaaaacagtatttattttg

SEQ ID NO: 4908807 - DNA, 22 bp, Homo sapiens
ttaaaacagtatttattttgta

SEQ ID NO: 4908808 - DNA, 23 bp, Homo sapiens
ttaaaacagtatttattttgtaa

SEQ ID NO: 4908809 - DNA, 22 bp, Homo sapiens
ttaaaactgcttttttttttcc

SEQ ID NO: 4908810 - DNA, 19 bp, Homo sapiens
ttaaaacttcttaaatatc

SEQ ID NO: 4908811 - DNA, 11 bp, Homo sapiens
ttaaaagagag

SEQ ID NO: 4908812 - DNA, 16 bp, Homo sapiens
ttaaaagtttcaatgt

SEQ ID NO: 4908813 - DNA, 22 bp, Homo sapiens
ttaaaataggggatatttaagg

SEQ ID NO: 4908814 - DNA, 16 bp, Homo sapiens
ttaaaatattcctgca

SEQ ID NO: 4908815 - DNA, 18 bp, Homo sapiens
ttaaaatctattctgtgt

SEQ ID NO: 4908816 - DNA, 19 bp, Homo sapiens
ttaaaatctattctgtgtt

SEQ ID NO: 4908817 - DNA, 21 bp, Homo sapiens
ttaaaatggtgcttaagttcc

SEQ ID NO: 4908818 - DNA, 15 bp, Homo sapiens
ttaaaattgctatgt

SEQ ID NO: 4908819 - DNA, 14 bp, Homo sapiens
ttaaacacaaagtg

SEQ ID NO: 4908820 - DNA, 13 bp, Homo sapiens
ttaaacacctcct

SEQ ID NO: 4908821 - DNA, 11 bp, Homo sapiens
ttaaacagatg

SEQ ID NO: 4908822 - DNA, 22 bp, Homo sapiens
ttaaacagatgatgagaatttc

SEQ ID NO: 4908823 - DNA, 14 bp, Homo sapiens
ttaaacagcagtgt

SEQ ID NO: 4908824 - DNA, 19 bp, Homo sapiens
ttaaacagtatttcattgc

SEQ ID NO: 4908825 - DNA, 18 bp, Homo sapiens
ttaaacagtgagcctgaa

SEQ ID NO: 4908826 - DNA, 23 bp, Homo sapiens
ttaaacagtgagcctgaattttg

SEQ ID NO: 4908827 - DNA, 15 bp, Homo sapiens
ttaaacctgtctcca

SEQ ID NO: 4908828 - DNA, 16 bp, Homo sapiens
ttaaactatcttgtgt

SEQ ID NO: 4908829 - DNA, 13 bp, Homo sapiens
ttaaactcaggga

SEQ ID NO: 4908830 - DNA, 16 bp, Homo sapiens
ttaaactcagggacag

SEQ ID NO: 4908831 - DNA, 22 bp, Homo sapiens
ttaaactcagggacagagccat

SEQ ID NO: 4908832 - DNA, 20 bp, Homo sapiens
ttaaactgttagcactgttg

SEQ ID NO: 4908833 - DNA, 15 bp, Homo sapiens
ttaaacttgtctttt

SEQ ID NO: 4908834 - DNA, 14 bp, Homo sapiens
ttaaagaaacagct

SEQ ID NO: 4908835 - DNA, 12 bp, Homo sapiens
ttaaagagtcta

SEQ ID NO: 4908836 - DNA, 15 bp, Homo sapiens
ttaaagagtctagat

SEQ ID NO: 4908837 - DNA, 23 bp, Homo sapiens
ttaaagagtctagattcaaaggt

SEQ ID NO: 4908838 - DNA, 14 bp, Homo sapiens
ttaaagatattgtt

SEQ ID NO: 4908839 - DNA, 16 bp, Homo sapiens
ttaaagcaaaaaatga

SEQ ID NO: 4908840 - DNA, 14 bp, Homo sapiens
ttaaagcattgctg

SEQ ID NO: 4908841 - DNA, 20 bp, Homo sapiens
ttaaagcattgctgttatgt

SEQ ID NO: 4908842 - DNA, 14 bp, Homo sapiens
ttaaagctgcctgt

SEQ ID NO: 4908843 - DNA, 15 bp, Homo sapiens
ttaaaggaagtcagt

SEQ ID NO: 4908844 - DNA, 18 bp, Homo sapiens
ttaaaggcaccatctaat

SEQ ID NO: 4908845 - DNA, 19 bp, Homo sapiens
ttaaagtgctaaggttcta

SEQ ID NO: 4908846 - DNA, 21 bp, Homo sapiens
ttaaagtgctaaggttctaag

SEQ ID NO: 4908847 - DNA, 17 bp, Homo sapiens
ttaaagtgtaataatat

SEQ ID NO: 4908848 - DNA, 12 bp, Homo sapiens
ttaaataaactt

SEQ ID NO: 4908849 - DNA, 20 bp, Homo sapiens
ttaaataaactttttttcaa

SEQ ID NO: 4908850 - DNA, 14 bp, Homo sapiens
ttaaataagattct

SEQ ID NO: 4908851 - DNA, 15 bp, Homo sapiens
ttaaataagattcta

SEQ ID NO: 4908852 - DNA, 18 bp, Homo sapiens
ttaaataagattctaacg

SEQ ID NO: 4908853 - DNA, 18 bp, Homo sapiens
ttaaataatgcttcagat

SEQ ID NO: 4908854 - DNA, 20 bp, Homo sapiens
ttaaataatgcttcagatat

SEQ ID NO: 4908855 - DNA, 16 bp, Homo sapiens
ttaaataatttaacta

SEQ ID NO: 4908856 - DNA, 21 bp, Homo sapiens
ttaaataatttaactaccctt

SEQ ID NO: 4908857 - DNA, 17 bp, Homo sapiens
ttaaatagatacaaatg

SEQ ID NO: 4908858 - DNA, 13 bp, Homo sapiens
ttaaatataattc

SEQ ID NO: 4908859 - DNA, 17 bp, Homo sapiens
ttaaatataattctgta

SEQ ID NO: 4908860 - DNA, 14 bp, Homo sapiens
ttaaatatagatta

SEQ ID NO: 4908861 - DNA, 17 bp, Homo sapiens
ttaaatatagattagaa

SEQ ID NO: 4908862 - DNA, 17 bp, Homo sapiens
ttaaatatcttttatgt

SEQ ID NO: 4908863 - DNA, 18 bp, Homo sapiens
ttaaatatcttttatgtt

SEQ ID NO: 4908864 - DNA, 20 bp, Homo sapiens
ttaaatatcttttatgtttg

SEQ ID NO: 4908865 - DNA, 21 bp, Homo sapiens
ttaaatgggaatatttataaa

SEQ ID NO: 4908866 - DNA, 16 bp, Homo sapiens
ttaaatgtaaataatc

SEQ ID NO: 4908867 - DNA, 14 bp, Homo sapiens
ttaaatgtatacta

SEQ ID NO: 4908868 - DNA, 20 bp, Homo sapiens
ttaaatgttatgactatgta

SEQ ID NO: 4908869 - DNA, 14 bp, Homo sapiens
ttaaattgggttca

SEQ ID NO: 4908870 - DNA, 22 bp, Homo sapiens
ttaaattgggttcatgatgcag

SEQ ID NO: 4908871 - DNA, 15 bp, Homo sapiens
ttaaatttgtaagtt

SEQ ID NO: 4908872 - DNA, 19 bp, Homo sapiens
ttaaatttgttgacaaaat

SEQ ID NO: 4908873 - DNA, 17 bp, Homo sapiens
ttaaattttttttacat

SEQ ID NO: 4908874 - DNA, 16 bp, Homo sapiens
ttaacaaaagttccct

SEQ ID NO: 4908875 - DNA, 22 bp, Homo sapiens
ttaacaaacatcactctgctgc

SEQ ID NO: 4908876 - DNA, 12 bp, Homo sapiens
ttaacaaatatg

SEQ ID NO: 4908877 - DNA, 22 bp, Homo sapiens
ttaacaacaataacactgtctc

SEQ ID NO: 4908878 - DNA, 17 bp, Homo sapiens
ttaacatagtaagttca

SEQ ID NO: 4908879 - DNA, 20 bp, Homo sapiens
ttaacatagtaagttcagca

SEQ ID NO: 4908880 - DNA, 20 bp, Homo sapiens
ttaacatgggctcttcacta

SEQ ID NO: 4908881 - DNA, 22 bp, Homo sapiens
ttaacatgggctcttcactagt

SEQ ID NO: 4908882 - DNA, 14 bp, Homo sapiens
ttaacattccaaga

SEQ ID NO: 4908883 - DNA, 17 bp, Homo sapiens
ttaacattccaagactc

SEQ ID NO: 4908884 - DNA, 19 bp, Homo sapiens
ttaacattccaagactcta

SEQ ID NO: 4908885 - DNA, 23 bp, Homo sapiens
ttaacatttgccttgcagaactg

SEQ ID NO: 4908886 - DNA, 14 bp, Homo sapiens
ttaaccatttaagt

SEQ ID NO: 4908887 - DNA, 18 bp, Homo sapiens
ttaacccaaggagcacag

SEQ ID NO: 4908888 - DNA, 21 bp, Homo sapiens
ttaagaaaaaataacacacat

SEQ ID NO: 4908889 - DNA, 15 bp, Homo sapiens
ttaagaaatgtagtt

SEQ ID NO: 4908890 - DNA, 21 bp, Homo sapiens
ttaagaaatgtagttgatgta

SEQ ID NO: 4908891 - DNA, 19 bp, Homo sapiens
ttaagaatatgtttccttg

SEQ ID NO: 4908892 - DNA, 20 bp, Homo sapiens
ttaagacctactgttctaaa

SEQ ID NO: 4908893 - DNA, 21 bp, Homo sapiens
ttaagacctactgttctaaag

SEQ ID NO: 4908894 - DNA, 22 bp, Homo sapiens
ttaagacctactgttctaaagc

SEQ ID NO: 4908895 - DNA, 15 bp, Homo sapiens
ttaagagaaacttta

SEQ ID NO: 4908896 - DNA, 19 bp, Homo sapiens
ttaagagaaactttataca

SEQ ID NO: 4908897 - DNA, 20 bp, Homo sapiens
ttaagagaaactttatacat

SEQ ID NO: 4908898 - DNA, 13 bp, Homo sapiens
ttaagagagaaat

SEQ ID NO: 4908899 - DNA, 17 bp, Homo sapiens
ttaagagctaaccagtt

SEQ ID NO: 4908900 - DNA, 13 bp, Homo sapiens
ttaagaggcaggg

SEQ ID NO: 4908901 - DNA, 16 bp, Homo sapiens
ttaagaggcagggtct

SEQ ID NO: 4908902 - DNA, 15 bp, Homo sapiens
ttaagatacaaatta

SEQ ID NO: 4908903 - DNA, 18 bp, Homo sapiens
ttaagattttacaaaaga

SEQ ID NO: 4908904 - DNA, 14 bp, Homo sapiens
ttaagcaaatactt

SEQ ID NO: 4908905 - DNA, 15 bp, Homo sapiens
ttaagcaaatactta

SEQ ID NO: 4908906 - DNA, 15 bp, Homo sapiens
ttaagcactcttaaa

SEQ ID NO: 4908907 - DNA, 19 bp, Homo sapiens
ttaagtgcgtgtgtagagt

SEQ ID NO: 4908908 - DNA, 16 bp, Homo sapiens
ttaagtggtttgatca

SEQ ID NO: 4908909 - DNA, 21 bp, Homo sapiens
ttaataaaaagctttttcctc

SEQ ID NO: 4908910 - DNA, 13 bp, Homo sapiens
ttaataacattac

SEQ ID NO: 4908911 - DNA, 20 bp, Homo sapiens
ttaataacattaccttactg

SEQ ID NO: 4908912 - DNA, 18 bp, Homo sapiens
ttaatagtttgtctattt

SEQ ID NO: 4908913 - DNA, 19 bp, Homo sapiens
ttaatagtttgtctatttt

SEQ ID NO: 4908914 - DNA, 15 bp, Homo sapiens
ttaatatatgtatta

SEQ ID NO: 4908915 - DNA, 12 bp, Homo sapiens
ttaatatttaaa

SEQ ID NO: 4908916 - DNA, 21 bp, Homo sapiens
ttaatatttaaacagcagtgt

SEQ ID NO: 4908917 - DNA, 17 bp, Homo sapiens
ttaatatttaacattat

SEQ ID NO: 4908918 - DNA, 19 bp, Homo sapiens
ttaatcacaaatttcactt

SEQ ID NO: 4908919 - DNA, 15 bp, Homo sapiens
ttaatcatctataaa

SEQ ID NO: 4908920 - DNA, 14 bp, Homo sapiens
ttaatctctgttat

SEQ ID NO: 4908921 - DNA, 22 bp, Homo sapiens
ttaatctctgttatgtactgta

SEQ ID NO: 4908922 - DNA, 23 bp, Homo sapiens
ttaatctctgttatgtactgtac

SEQ ID NO: 4908923 - DNA, 16 bp, Homo sapiens
ttaatctgaaattcta

SEQ ID NO: 4908924 - DNA, 19 bp, Homo sapiens
ttaatctgaaattctaaag

SEQ ID NO: 4908925 - DNA, 19 bp, Homo sapiens
ttaatcttggatagctaat

SEQ ID NO: 4908926 - DNA, 17 bp, Homo sapiens
ttaatgataagtaaatg

SEQ ID NO: 4908927 - DNA, 19 bp, Homo sapiens
ttaatgccattatccctga

SEQ ID NO: 4908928 - DNA, 17 bp, Homo sapiens
ttaatgctgccttttct

SEQ ID NO: 4908929 - DNA, 14 bp, Homo sapiens
ttaatgcttcattc

SEQ ID NO: 4908930 - DNA, 15 bp, Homo sapiens
ttaatgcttcattca

SEQ ID NO: 4908931 - DNA, 18 bp, Homo sapiens
ttaatggacttatttctt

SEQ ID NO: 4908932 - DNA, 20 bp, Homo sapiens
ttaatggacttatttcttca

SEQ ID NO: 4908933 - DNA, 14 bp, Homo sapiens
ttaatggattgtta

SEQ ID NO: 4908934 - DNA, 14 bp, Homo sapiens
ttaatggcactgat

SEQ ID NO: 4908935 - DNA, 22 bp, Homo sapiens
ttaatggtctaaaaataaacca

SEQ ID NO: 4908936 - DNA, 13 bp, Homo sapiens
ttaatgtgatgat

SEQ ID NO: 4908937 - DNA, 20 bp, Homo sapiens
ttaattaatttgattaacaa

SEQ ID NO: 4908938 - DNA, 14 bp, Homo sapiens
ttaattacttaaaa

SEQ ID NO: 4908939 - DNA, 18 bp, Homo sapiens
ttaattattaactacatt

SEQ ID NO: 4908940 - DNA, 21 bp, Homo sapiens
ttaattattatttgtgtttta

SEQ ID NO: 4908941 - DNA, 12 bp, Homo sapiens
ttaattgtcatg

SEQ ID NO: 4908942 - DNA, 13 bp, Homo sapiens
ttaattgttgttt

SEQ ID NO: 4908943 - DNA, 16 bp, Homo sapiens
ttaattgttgtttctt

SEQ ID NO: 4908944 - DNA, 22 bp, Homo sapiens
ttaattgttgtttctttctagt

SEQ ID NO: 4908945 - DNA, 19 bp, Homo sapiens
ttaattgttttgcactttt

SEQ ID NO: 4908946 - DNA, 18 bp, Homo sapiens
ttaatttaaacacctcct

SEQ ID NO: 4908947 - DNA, 16 bp, Homo sapiens
ttaatttaaagcttac

SEQ ID NO: 4908948 - DNA, 19 bp, Homo sapiens
ttaatttattattgaaatt

SEQ ID NO: 4908949 - DNA, 13 bp, Homo sapiens
ttaatttcagtcc

SEQ ID NO: 4908950 - DNA, 17 bp, Homo sapiens
ttaatttcagtcctgta

SEQ ID NO: 4908951 - DNA, 20 bp, Homo sapiens
ttaatttcagtcctgtagtt

SEQ ID NO: 4908952 - DNA, 17 bp, Homo sapiens
ttaatttcttcaaaatg

SEQ ID NO: 4908953 - DNA, 18 bp, Homo sapiens
ttaatttcttcaaaatgt

SEQ ID NO: 4908954 - DNA, 21 bp, Homo sapiens
ttaatttcttcaaaatgtata

SEQ ID NO: 4908955 - DNA, 23 bp, Homo sapiens
ttaatttcttcaaaatgtatata

SEQ ID NO: 4908956 - DNA, 14 bp, Homo sapiens
ttaatttgattaac

SEQ ID NO: 4908957 - DNA, 23 bp, Homo sapiens
ttacaactgcctcgaaacacaga

SEQ ID NO: 4908958 - DNA, 20 bp, Homo sapiens
ttacaagaagtttattctca

SEQ ID NO: 4908959 - DNA, 17 bp, Homo sapiens
ttacaagtatacttata

SEQ ID NO: 4908960 - DNA, 13 bp, Homo sapiens
ttacacagaaaca

SEQ ID NO: 4908961 - DNA, 16 bp, Homo sapiens
ttacacagaaacactg

SEQ ID NO: 4908962 - DNA, 16 bp, Homo sapiens
ttacacatttgtacag

SEQ ID NO: 4908963 - DNA, 20 bp, Homo sapiens
ttacaccctttcttgacaaa

SEQ ID NO: 4908964 - DNA, 19 bp, Homo sapiens
ttacactgcctgtatactt

SEQ ID NO: 4908965 - DNA, 14 bp, Homo sapiens
ttacactgtatttg

SEQ ID NO: 4908966 - DNA, 18 bp, Homo sapiens
ttacagaaaaagacttta

SEQ ID NO: 4908967 - DNA, 16 bp, Homo sapiens
ttacagaggaagttat

SEQ ID NO: 4908968 - DNA, 16 bp, Homo sapiens
ttacagatttaataca

SEQ ID NO: 4908969 - DNA, 15 bp, Homo sapiens
ttacagctttacaca

SEQ ID NO: 4908970 - DNA, 22 bp, Homo sapiens
ttacagctttacacacacagat

SEQ ID NO: 4908971 - DNA, 22 bp, Homo sapiens
ttacagggtaactgtgctgaat

SEQ ID NO: 4908972 - DNA, 17 bp, Homo sapiens
ttacagtccttcaaaat

SEQ ID NO: 4908973 - DNA, 13 bp, Homo sapiens
ttacataactgcc

SEQ ID NO: 4908974 - DNA, 22 bp, Homo sapiens
ttacatgcaatttattaaaatg

SEQ ID NO: 4908975 - DNA, 12 bp, Homo sapiens
ttacattgtaaa

SEQ ID NO: 4908976 - DNA, 15 bp, Homo sapiens
ttacatttttattta

SEQ ID NO: 4908977 - DNA, 17 bp, Homo sapiens
ttacatttttatttatg

SEQ ID NO: 4908978 - DNA, 18 bp, Homo sapiens
ttacatttttatttatga

SEQ ID NO: 4908979 - DNA, 19 bp, Homo sapiens
ttacatttttatttatgaa

SEQ ID NO: 4908980 - DNA, 21 bp, Homo sapiens
ttacattttttgggcagcaat

SEQ ID NO: 4908981 - DNA, 14 bp, Homo sapiens
ttaccaactttctg

SEQ ID NO: 4908982 - DNA, 14 bp, Homo sapiens
ttaccactcaggca

SEQ ID NO: 4908983 - DNA, 17 bp, Homo sapiens
ttaccagaagcttccat

SEQ ID NO: 4908984 - DNA, 21 bp, Homo sapiens
ttaccatttgctactgtacat

SEQ ID NO: 4908985 - DNA, 23 bp, Homo sapiens
ttaccattttggggtacccactg

SEQ ID NO: 4908986 - DNA, 14 bp, Homo sapiens
ttaccatttttcat

SEQ ID NO: 4908987 - DNA, 24 bp, Homo sapiens
ttacccaaaaactaaatctctaat

SEQ ID NO: 4908988 - DNA, 22 bp, Homo sapiens
ttacccacctagaacactaact

SEQ ID NO: 4908989 - DNA, 12 bp, Homo sapiens
ttaccctaatgt

SEQ ID NO: 4908990 - DNA, 13 bp, Homo sapiens
ttacccttccctg

SEQ ID NO: 4908991 - DNA, 17 bp, Homo sapiens
ttacccttccctgcact

SEQ ID NO: 4908992 - DNA, 13 bp, Homo sapiens
ttaccctttagac

SEQ ID NO: 4908993 - DNA, 15 bp, Homo sapiens
ttacctaaagtattt

SEQ ID NO: 4908994 - DNA, 18 bp, Homo sapiens
ttacctaagtgacatttg

SEQ ID NO: 4908995 - DNA, 23 bp, Homo sapiens
ttacctccaacagaactaaatgt

SEQ ID NO: 4908996 - DNA, 12 bp, Homo sapiens
ttacctgacaca

SEQ ID NO: 4908997 - DNA, 17 bp, Homo sapiens
ttacctgacctcttgct

SEQ ID NO: 4908998 - DNA, 11 bp, Homo sapiens
ttacctgtcac

SEQ ID NO: 4908999 - DNA, 18 bp, Homo sapiens
ttacctgtcacattgcat

SEQ ID NO: 4909000 - DNA, 19 bp, Homo sapiens
ttacctgtcacattgcatt

SEQ ID NO: 4909001 - DNA, 22 bp, Homo sapiens
ttacctgtcacattgcattcta

SEQ ID NO: 4909002 - DNA, 22 bp, Homo sapiens
ttacctgttttcgcacctacca

SEQ ID NO: 4909003 - DNA, 21 bp, Homo sapiens
ttactaagcatagcaaacaga

SEQ ID NO: 4909004 - DNA, 17 bp, Homo sapiens
ttactaagccacaagaa

SEQ ID NO: 4909005 - DNA, 20 bp, Homo sapiens
ttactaagccacaagaaatt

SEQ ID NO: 4909006 - DNA, 22 bp, Homo sapiens
ttactatatatatatgcctttt

SEQ ID NO: 4909007 - DNA, 13 bp, Homo sapiens
ttactcagggctc

SEQ ID NO: 4909008 - DNA, 20 bp, Homo sapiens
ttactcagggctcctcccag

SEQ ID NO: 4909009 - DNA, 20 bp, Homo sapiens
ttactcccaagacttcattg

SEQ ID NO: 4909010 - DNA, 22 bp, Homo sapiens
ttactcctatttttgtaaactg

SEQ ID NO: 4909011 - DNA, 18 bp, Homo sapiens
ttactcctcctctttctc

SEQ ID NO: 4909012 - DNA, 14 bp, Homo sapiens
ttactctaagatct

SEQ ID NO: 4909013 - DNA, 13 bp, Homo sapiens
ttactgtacctgt

SEQ ID NO: 4909014 - DNA, 22 bp, Homo sapiens
ttactgtctggttttaacaatt

SEQ ID NO: 4909015 - DNA, 14 bp, Homo sapiens
ttactgtgttttat

SEQ ID NO: 4909016 - DNA, 15 bp, Homo sapiens
ttactgttaaccatt

SEQ ID NO: 4909017 - DNA, 14 bp, Homo sapiens
ttactgttcttgct

SEQ ID NO: 4909018 - DNA, 16 bp, Homo sapiens
ttactgttcttgctgc

SEQ ID NO: 4909019 - DNA, 23 bp, Homo sapiens
ttactgttttgaaatcaatgcaa

SEQ ID NO: 4909020 - DNA, 12 bp, Homo sapiens
ttacttctgcta

SEQ ID NO: 4909021 - DNA, 16 bp, Homo sapiens
ttactttatcactttt

SEQ ID NO: 4909022 - DNA, 17 bp, Homo sapiens
ttacttttaaacagtga

SEQ ID NO: 4909023 - DNA, 21 bp, Homo sapiens
ttacttttatttgcaacattt

SEQ ID NO: 4909024 - DNA, 23 bp, Homo sapiens
ttagaaaaaagtttacaacataa

SEQ ID NO: 4909025 - DNA, 13 bp, Homo sapiens
ttagaaaatgtgt

SEQ ID NO: 4909026 - DNA, 17 bp, Homo sapiens
ttagaaagcaacttatc

SEQ ID NO: 4909027 - DNA, 21 bp, Homo sapiens
ttagaatctattttctatgta

SEQ ID NO: 4909028 - DNA, 23 bp, Homo sapiens
ttagaatctattttctatgtact

SEQ ID NO: 4909029 - DNA, 12 bp, Homo sapiens
ttagaatgaaaa

SEQ ID NO: 4909030 - DNA, 13 bp, Homo sapiens
ttagaattattta

SEQ ID NO: 4909031 - DNA, 11 bp, Homo sapiens
ttagacagagt

SEQ ID NO: 4909032 - DNA, 13 bp, Homo sapiens
ttagacataacaa

SEQ ID NO: 4909033 - DNA, 12 bp, Homo sapiens
ttagaccaagga

SEQ ID NO: 4909034 - DNA, 16 bp, Homo sapiens
ttagaccgctctcttt

SEQ ID NO: 4909035 - DNA, 22 bp, Homo sapiens
ttagaccgctctcttttctgta

SEQ ID NO: 4909036 - DNA, 15 bp, Homo sapiens
ttagacttactatta

SEQ ID NO: 4909037 - DNA, 24 bp, Homo sapiens
ttagataacgcttaaaggaagtca

SEQ ID NO: 4909038 - DNA, 16 bp, Homo sapiens
ttagatgttgccatgt

SEQ ID NO: 4909039 - DNA, 19 bp, Homo sapiens
ttagatgttgccatgtgtt

SEQ ID NO: 4909040 - DNA, 15 bp, Homo sapiens
ttagatgtttcacac

SEQ ID NO: 4909041 - DNA, 19 bp, Homo sapiens
ttagattctctgtgtctaa

SEQ ID NO: 4909042 - DNA, 22 bp, Homo sapiens
ttagattctctgtgtctaagat

SEQ ID NO: 4909043 - DNA, 21 bp, Homo sapiens
ttagattttctggttctaaca

SEQ ID NO: 4909044 - DNA, 18 bp, Homo sapiens
ttagcaaggtcatttctt

SEQ ID NO: 4909045 - DNA, 13 bp, Homo sapiens
ttagcacagattt

SEQ ID NO: 4909046 - DNA, 23 bp, Homo sapiens
ttagcacagattttaattgtcat

SEQ ID NO: 4909047 - DNA, 12 bp, Homo sapiens
ttagcactgttg

SEQ ID NO: 4909048 - DNA, 21 bp, Homo sapiens
ttagcactgttgatgtatctg

SEQ ID NO: 4909049 - DNA, 21 bp, Homo sapiens
ttagcacttgggtgacggcag

SEQ ID NO: 4909050 - DNA, 19 bp, Homo sapiens
ttagcaggccaaggtctga

SEQ ID NO: 4909051 - DNA, 16 bp, Homo sapiens
ttagcagtttgctttg

SEQ ID NO: 4909052 - DNA, 19 bp, Homo sapiens
ttagcatcctaagaaatat

SEQ ID NO: 4909053 - DNA, 23 bp, Homo sapiens
ttagccaggatcatggtgtaata

SEQ ID NO: 4909054 - DNA, 12 bp, Homo sapiens
ttagcctggagc

SEQ ID NO: 4909055 - DNA, 16 bp, Homo sapiens
ttagctccctcccgca

SEQ ID NO: 4909056 - DNA, 15 bp, Homo sapiens
ttagctctattgata

SEQ ID NO: 4909057 - DNA, 13 bp, Homo sapiens
ttagctttgtgtt

SEQ ID NO: 4909058 - DNA, 16 bp, Homo sapiens
ttagctttttaattgt

SEQ ID NO: 4909059 - DNA, 12 bp, Homo sapiens
ttaggaaataaa

SEQ ID NO: 4909060 - DNA, 15 bp, Homo sapiens
ttaggaaataaaacc

SEQ ID NO: 4909061 - DNA, 20 bp, Homo sapiens
ttaggaaataaaacctttca

SEQ ID NO: 4909062 - DNA, 15 bp, Homo sapiens
ttaggagctaaggct

SEQ ID NO: 4909063 - DNA, 16 bp, Homo sapiens
ttaggagctaaggctc

SEQ ID NO: 4909064 - DNA, 17 bp, Homo sapiens
ttaggagctaaggctct

SEQ ID NO: 4909065 - DNA, 22 bp, Homo sapiens
ttaggagtgggtgacaagagcc

SEQ ID NO: 4909066 - DNA, 16 bp, Homo sapiens
ttaggccttcctctct

SEQ ID NO: 4909067 - DNA, 14 bp, Homo sapiens
ttagggatttattt

SEQ ID NO: 4909068 - DNA, 17 bp, Homo sapiens
ttaggtaatttttttca

SEQ ID NO: 4909069 - DNA, 13 bp, Homo sapiens
ttaggtactattc

SEQ ID NO: 4909070 - DNA, 18 bp, Homo sapiens
ttaggtgcaatttcaagg

SEQ ID NO: 4909071 - DNA, 12 bp, Homo sapiens
ttaggttaacat

SEQ ID NO: 4909072 - DNA, 18 bp, Homo sapiens
ttaggttctaaagttcta

SEQ ID NO: 4909073 - DNA, 18 bp, Homo sapiens
ttagtaaatgtctttgta

SEQ ID NO: 4909074 - DNA, 20 bp, Homo sapiens
ttagtaaatgtctttgtaag

SEQ ID NO: 4909075 - DNA, 16 bp, Homo sapiens
ttagtaatctgtacat

SEQ ID NO: 4909076 - DNA, 17 bp, Homo sapiens
ttagtaatctgtacatt

SEQ ID NO: 4909077 - DNA, 19 bp, Homo sapiens
ttagtatttatttatgtac

SEQ ID NO: 4909078 - DNA, 12 bp, Homo sapiens
ttagtctcagtt

SEQ ID NO: 4909079 - DNA, 22 bp, Homo sapiens
ttagtcttagggatttattttc

SEQ ID NO: 4909080 - DNA, 14 bp, Homo sapiens
ttagtgccagaatt

SEQ ID NO: 4909081 - DNA, 15 bp, Homo sapiens
ttagtgtaataagac

SEQ ID NO: 4909082 - DNA, 13 bp, Homo sapiens
ttagttaatggat

SEQ ID NO: 4909083 - DNA, 18 bp, Homo sapiens
ttagttatagtttcagat

SEQ ID NO: 4909084 - DNA, 19 bp, Homo sapiens
ttagttccctgtctcttga

SEQ ID NO: 4909085 - DNA, 22 bp, Homo sapiens
ttagttgcctaagcattgcctg

SEQ ID NO: 4909086 - DNA, 20 bp, Homo sapiens
ttagtttacccggtttcttt

SEQ ID NO: 4909087 - DNA, 14 bp, Homo sapiens
ttagtttggattct

SEQ ID NO: 4909088 - DNA, 20 bp, Homo sapiens
ttataaaaataaatagaaaa

SEQ ID NO: 4909089 - DNA, 18 bp, Homo sapiens
ttataaaatataaacaaa

SEQ ID NO: 4909090 - DNA, 20 bp, Homo sapiens
ttataaaatataaacaaaga

SEQ ID NO: 4909091 - DNA, 17 bp, Homo sapiens
ttataaaattttgcttt

SEQ ID NO: 4909092 - DNA, 18 bp, Homo sapiens
ttataaatataagccttt

SEQ ID NO: 4909093 - DNA, 16 bp, Homo sapiens
ttataaatatatataa

SEQ ID NO: 4909094 - DNA, 18 bp, Homo sapiens
ttataagcattgaaatta

SEQ ID NO: 4909095 - DNA, 15 bp, Homo sapiens
ttataagttcacaaa

SEQ ID NO: 4909096 - DNA, 14 bp, Homo sapiens
ttataatactctgt

SEQ ID NO: 4909097 - DNA, 19 bp, Homo sapiens
ttatacaaaataagaacga

SEQ ID NO: 4909098 - DNA, 21 bp, Homo sapiens
ttatacaaacctaccaaaatg

SEQ ID NO: 4909099 - DNA, 22 bp, Homo sapiens
ttatacagatagagttccatat

SEQ ID NO: 4909100 - DNA, 16 bp, Homo sapiens
ttatacattagtaaat

SEQ ID NO: 4909101 - DNA, 23 bp, Homo sapiens
ttatacattagtaaatgtctttg

SEQ ID NO: 4909102 - DNA, 13 bp, Homo sapiens
ttatagattctaa

SEQ ID NO: 4909103 - DNA, 14 bp, Homo sapiens
ttatagcactttga

SEQ ID NO: 4909104 - DNA, 16 bp, Homo sapiens
ttataggatcatttgt

SEQ ID NO: 4909105 - DNA, 22 bp, Homo sapiens
ttataggtgttggttttggggg

SEQ ID NO: 4909106 - DNA, 22 bp, Homo sapiens
ttatagtcatttattttaaaaa

SEQ ID NO: 4909107 - DNA, 14 bp, Homo sapiens
ttatagtttcaagc

SEQ ID NO: 4909108 - DNA, 13 bp, Homo sapiens
ttatagtttctga

SEQ ID NO: 4909109 - DNA, 15 bp, Homo sapiens
ttatagtttctgagg

SEQ ID NO: 4909110 - DNA, 16 bp, Homo sapiens
ttatagtttgtacatg

SEQ ID NO: 4909111 - DNA, 23 bp, Homo sapiens
ttatataaatgtaaaaataataa

SEQ ID NO: 4909112 - DNA, 14 bp, Homo sapiens
ttatatatggacat

SEQ ID NO: 4909113 - DNA, 17 bp, Homo sapiens
ttatatatggacatggc

SEQ ID NO: 4909114 - DNA, 22 bp, Homo sapiens
ttatatctgtggtcttcaaatt

SEQ ID NO: 4909115 - DNA, 16 bp, Homo sapiens
ttatatgtacatgaga

SEQ ID NO: 4909116 - DNA, 14 bp, Homo sapiens
ttatatgtgttgaa

SEQ ID NO: 4909117 - DNA, 19 bp, Homo sapiens
ttatatgtgttgaaaacca

SEQ ID NO: 4909118 - DNA, 15 bp, Homo sapiens
ttatattcaaccatg

SEQ ID NO: 4909119 - DNA, 16 bp, Homo sapiens
ttatattgaagacaat

SEQ ID NO: 4909120 - DNA, 19 bp, Homo sapiens
ttatatttagttatagttt

SEQ ID NO: 4909121 - DNA, 22 bp, Homo sapiens
ttatatttccctaaaatacatt

SEQ ID NO: 4909122 - DNA, 13 bp, Homo sapiens
ttatatttgtatc

SEQ ID NO: 4909123 - DNA, 15 bp, Homo sapiens
ttatattttcgtatg

SEQ ID NO: 4909124 - DNA, 13 bp, Homo sapiens
ttatcaaagcata

SEQ ID NO: 4909125 - DNA, 17 bp, Homo sapiens
ttatcaaggactctggt

SEQ ID NO: 4909126 - DNA, 15 bp, Homo sapiens
ttatcaatatctaat

SEQ ID NO: 4909127 - DNA, 21 bp, Homo sapiens
ttatcactttttgaactaaga

SEQ ID NO: 4909128 - DNA, 17 bp, Homo sapiens
ttatcagatacatcact

SEQ ID NO: 4909129 - DNA, 20 bp, Homo sapiens
ttatcagatacatcactgct

SEQ ID NO: 4909130 - DNA, 20 bp, Homo sapiens
ttatcagtaagaaaaagaag

SEQ ID NO: 4909131 - DNA, 14 bp, Homo sapiens
ttatccataaaaaa

SEQ ID NO: 4909132 - DNA, 19 bp, Homo sapiens
ttatccatttgtaattaaa

SEQ ID NO: 4909133 - DNA, 15 bp, Homo sapiens
ttatcgaaataacaa

SEQ ID NO: 4909134 - DNA, 19 bp, Homo sapiens
ttatcgaaataacaatgtt

SEQ ID NO: 4909135 - DNA, 20 bp, Homo sapiens
ttatctaatacctctgtgtg

SEQ ID NO: 4909136 - DNA, 20 bp, Homo sapiens
ttatctattctgagaaaaca

SEQ ID NO: 4909137 - DNA, 17 bp, Homo sapiens
ttatctcagtcatgcat

SEQ ID NO: 4909138 - DNA, 14 bp, Homo sapiens
ttatctctatttaa

SEQ ID NO: 4909139 - DNA, 18 bp, Homo sapiens
ttatcttctcaagttcta

SEQ ID NO: 4909140 - DNA, 18 bp, Homo sapiens
ttatgaaaataaatagct

SEQ ID NO: 4909141 - DNA, 15 bp, Homo sapiens
ttatgaaagaatata

SEQ ID NO: 4909142 - DNA, 11 bp, Homo sapiens
ttatgaagttt

SEQ ID NO: 4909143 - DNA, 13 bp, Homo sapiens
ttatgaagtttaa

SEQ ID NO: 4909144 - DNA, 12 bp, Homo sapiens
ttatgaatctga

SEQ ID NO: 4909145 - DNA, 14 bp, Homo sapiens
ttatgaatgaaaaa

SEQ ID NO: 4909146 - DNA, 23 bp, Homo sapiens
ttatgacaatgactgtgctactg

SEQ ID NO: 4909147 - DNA, 14 bp, Homo sapiens
ttatgagcttccaa

SEQ ID NO: 4909148 - DNA, 15 bp, Homo sapiens
ttatgagtaactatt

SEQ ID NO: 4909149 - DNA, 17 bp, Homo sapiens
ttatgataatagattct

SEQ ID NO: 4909150 - DNA, 18 bp, Homo sapiens
ttatgataatagattctc

SEQ ID NO: 4909151 - DNA, 15 bp, Homo sapiens
ttatgatttaataaa

SEQ ID NO: 4909152 - DNA, 18 bp, Homo sapiens
ttatgcaaggaaggaaag

SEQ ID NO: 4909153 - DNA, 19 bp, Homo sapiens
ttatgcactaaatatgaac

SEQ ID NO: 4909154 - DNA, 15 bp, Homo sapiens
ttatgctattaaagt

SEQ ID NO: 4909155 - DNA, 23 bp, Homo sapiens
ttatggaagatagttttctcctt

SEQ ID NO: 4909156 - DNA, 19 bp, Homo sapiens
ttatggaattgatttgcat

SEQ ID NO: 4909157 - DNA, 21 bp, Homo sapiens
ttatggaattgatttgcattg

SEQ ID NO: 4909158 - DNA, 14 bp, Homo sapiens
ttatggagacctct

SEQ ID NO: 4909159 - DNA, 16 bp, Homo sapiens
ttatgtagcacataaa

SEQ ID NO: 4909160 - DNA, 15 bp, Homo sapiens
ttatgtagtaattga

SEQ ID NO: 4909161 - DNA, 16 bp, Homo sapiens
ttatgtagtaattgac

SEQ ID NO: 4909162 - DNA, 16 bp, Homo sapiens
ttatgtggttttagat

SEQ ID NO: 4909163 - DNA, 20 bp, Homo sapiens
ttatgtgtgcatgtgtgtat

SEQ ID NO: 4909164 - DNA, 12 bp, Homo sapiens
ttattacaattt

SEQ ID NO: 4909165 - DNA, 20 bp, Homo sapiens
ttattaccccctccttcaga

SEQ ID NO: 4909166 - DNA, 15 bp, Homo sapiens
ttattatatatataa

SEQ ID NO: 4909167 - DNA, 16 bp, Homo sapiens
ttattattgaaattgt

SEQ ID NO: 4909168 - DNA, 22 bp, Homo sapiens
ttattatttgtgttttaattta

SEQ ID NO: 4909169 - DNA, 20 bp, Homo sapiens
ttattcagcttcatttgtgt

SEQ ID NO: 4909170 - DNA, 17 bp, Homo sapiens
ttattcattagctgtga

SEQ ID NO: 4909171 - DNA, 13 bp, Homo sapiens
ttattcctgtatg

SEQ ID NO: 4909172 - DNA, 19 bp, Homo sapiens
ttattcctgtatgttgtcc

SEQ ID NO: 4909173 - DNA, 13 bp, Homo sapiens
ttattctggagtt

SEQ ID NO: 4909174 - DNA, 20 bp, Homo sapiens
ttattctgtagattctgtgg

SEQ ID NO: 4909175 - DNA, 14 bp, Homo sapiens
ttattcttctagag

SEQ ID NO: 4909176 - DNA, 13 bp, Homo sapiens
ttattgaagaaac

SEQ ID NO: 4909177 - DNA, 22 bp, Homo sapiens
ttattgaaggaagccaaattta

SEQ ID NO: 4909178 - DNA, 19 bp, Homo sapiens
ttattgctagtatttgaat

SEQ ID NO: 4909179 - DNA, 17 bp, Homo sapiens
ttattgctgattttaat

SEQ ID NO: 4909180 - DNA, 15 bp, Homo sapiens
ttattgctgttgctt

SEQ ID NO: 4909181 - DNA, 20 bp, Homo sapiens
ttattgcttattgcttagta

SEQ ID NO: 4909182 - DNA, 10 bp, Homo sapiens
ttatttaata

SEQ ID NO: 4909183 - DNA, 12 bp, Homo sapiens
ttatttaataac

SEQ ID NO: 4909184 - DNA, 15 bp, Homo sapiens
ttatttacagatgaa

SEQ ID NO: 4909185 - DNA, 17 bp, Homo sapiens
ttatttactaattttct

SEQ ID NO: 4909186 - DNA, 21 bp, Homo sapiens
ttatttatatgtactgtttta

SEQ ID NO: 4909187 - DNA, 13 bp, Homo sapiens
ttatttatgtact

SEQ ID NO: 4909188 - DNA, 15 bp, Homo sapiens
ttatttattggagat

SEQ ID NO: 4909189 - DNA, 14 bp, Homo sapiens
ttatttatttaata

SEQ ID NO: 4909190 - DNA, 18 bp, Homo sapiens
ttatttctagtccaaaat

SEQ ID NO: 4909191 - DNA, 11 bp, Homo sapiens
ttatttctgca

SEQ ID NO: 4909192 - DNA, 22 bp, Homo sapiens
ttatttctgcatatgttgaata

SEQ ID NO: 4909193 - DNA, 12 bp, Homo sapiens
ttatttctgtca

SEQ ID NO: 4909194 - DNA, 17 bp, Homo sapiens
ttattttaaaaaatgaa

SEQ ID NO: 4909195 - DNA, 13 bp, Homo sapiens
ttattttaatgtg

SEQ ID NO: 4909196 - DNA, 17 bp, Homo sapiens
ttattttaatgtgatga

SEQ ID NO: 4909197 - DNA, 18 bp, Homo sapiens
ttattttaatgtgatgat

SEQ ID NO: 4909198 - DNA, 17 bp, Homo sapiens
ttattttacacagaaac

SEQ ID NO: 4909199 - DNA, 13 bp, Homo sapiens
ttattttctgtca

SEQ ID NO: 4909200 - DNA, 21 bp, Homo sapiens
ttattttgaaaagcttcttaa

SEQ ID NO: 4909201 - DNA, 15 bp, Homo sapiens
ttattttggggtctc

SEQ ID NO: 4909202 - DNA, 12 bp, Homo sapiens
ttattttgtaat

SEQ ID NO: 4909203 - DNA, 19 bp, Homo sapiens
ttattttgtgctcatttaa

SEQ ID NO: 4909204 - DNA, 14 bp, Homo sapiens
ttatttttcatatt

SEQ ID NO: 4909205 - DNA, 20 bp, Homo sapiens
ttattttttttttttgaaaa

SEQ ID NO: 4909206 - DNA, 20 bp, Homo sapiens
ttcaaaaactgttttgggta

SEQ ID NO: 4909207 - DNA, 14 bp, Homo sapiens
ttcaaaaagtgttt

SEQ ID NO: 4909208 - DNA, 15 bp, Homo sapiens
ttcaaaaatataact

SEQ ID NO: 4909209 - DNA, 12 bp, Homo sapiens
ttcaaaagttcc

SEQ ID NO: 4909210 - DNA, 16 bp, Homo sapiens
ttcaaaagttccaaga

SEQ ID NO: 4909211 - DNA, 13 bp, Homo sapiens
ttcaaaatccttc

SEQ ID NO: 4909212 - DNA, 17 bp, Homo sapiens
ttcaaaatgctttttat

SEQ ID NO: 4909213 - DNA, 21 bp, Homo sapiens
ttcaaactggggcctccagaa

SEQ ID NO: 4909214 - DNA, 13 bp, Homo sapiens
ttcaaactgtgaa

SEQ ID NO: 4909215 - DNA, 19 bp, Homo sapiens
ttcaaacttactattttga

SEQ ID NO: 4909216 - DNA, 12 bp, Homo sapiens
ttcaaagatgct

SEQ ID NO: 4909217 - DNA, 18 bp, Homo sapiens
ttcaaagatgctgtgagt

SEQ ID NO: 4909218 - DNA, 16 bp, Homo sapiens
ttcaaaggttctaggt

SEQ ID NO: 4909219 - DNA, 17 bp, Homo sapiens
ttcaaatccttccaaaa

SEQ ID NO: 4909220 - DNA, 22 bp, Homo sapiens
ttcaaatgatttttacaagttt

SEQ ID NO: 4909221 - DNA, 20 bp, Homo sapiens
ttcaacaaatatcttgtgtt

SEQ ID NO: 4909222 - DNA, 15 bp, Homo sapiens
ttcaacatcctgcca

SEQ ID NO: 4909223 - DNA, 21 bp, Homo sapiens
ttcaacatcctgccagcccca

SEQ ID NO: 4909224 - DNA, 15 bp, Homo sapiens
ttcaaccatggactt

SEQ ID NO: 4909225 - DNA, 19 bp, Homo sapiens
ttcaacgcagccctgcttt

SEQ ID NO: 4909226 - DNA, 17 bp, Homo sapiens
ttcaagaaaaaataaat

SEQ ID NO: 4909227 - DNA, 23 bp, Homo sapiens
ttcaagaaaaaataaatggaaat

SEQ ID NO: 4909228 - DNA, 22 bp, Homo sapiens
ttcaagaaaacaacttcaatat

SEQ ID NO: 4909229 - DNA, 20 bp, Homo sapiens
ttcaagaaactgaggaattt

SEQ ID NO: 4909230 - DNA, 12 bp, Homo sapiens
ttcaagaaataa

SEQ ID NO: 4909231 - DNA, 17 bp, Homo sapiens
ttcaagcacttacagct

SEQ ID NO: 4909232 - DNA, 16 bp, Homo sapiens
ttcaagcagcatcttc

SEQ ID NO: 4909233 - DNA, 14 bp, Homo sapiens
ttcaaggcactcta

SEQ ID NO: 4909234 - DNA, 18 bp, Homo sapiens
ttcaaggtggccaaatta

SEQ ID NO: 4909235 - DNA, 23 bp, Homo sapiens
ttcaagtgcctttctgcagtttt

SEQ ID NO: 4909236 - DNA, 20 bp, Homo sapiens
ttcaagttttgggtatgttt

SEQ ID NO: 4909237 - DNA, 19 bp, Homo sapiens
ttcaataaatctttggaaa

SEQ ID NO: 4909238 - DNA, 19 bp, Homo sapiens
ttcaataaatgtctgttga

SEQ ID NO: 4909239 - DNA, 16 bp, Homo sapiens
ttcaatggttctgaaa

SEQ ID NO: 4909240 - DNA, 15 bp, Homo sapiens
ttcaattttaaagac

SEQ ID NO: 4909241 - DNA, 15 bp, Homo sapiens
ttcacaaaatttcca

SEQ ID NO: 4909242 - DNA, 22 bp, Homo sapiens
ttcacaaacttttatactcttt

SEQ ID NO: 4909243 - DNA, 21 bp, Homo sapiens
ttcacaaccttctgtggctca

SEQ ID NO: 4909244 - DNA, 12 bp, Homo sapiens
ttcacaccctgc

SEQ ID NO: 4909245 - DNA, 14 bp, Homo sapiens
ttcacaccctgcaa

SEQ ID NO: 4909246 - DNA, 18 bp, Homo sapiens
ttcacacgctgttctaat

SEQ ID NO: 4909247 - DNA, 23 bp, Homo sapiens
ttcacaggggttcccttctctca

SEQ ID NO: 4909248 - DNA, 20 bp, Homo sapiens
ttcacagtagagccagcttg

SEQ ID NO: 4909249 - DNA, 18 bp, Homo sapiens
ttcacatagctgtctaga

SEQ ID NO: 4909250 - DNA, 19 bp, Homo sapiens
ttcacattgtttgctgcta

SEQ ID NO: 4909251 - DNA, 20 bp, Homo sapiens
ttcacattgtttgctgctat

SEQ ID NO: 4909252 - DNA, 13 bp, Homo sapiens
ttcaccaaaatta

SEQ ID NO: 4909253 - DNA, 15 bp, Homo sapiens
ttcaccaaaattatc

SEQ ID NO: 4909254 - DNA, 22 bp, Homo sapiens
ttcaccaccaaatgccaagaaa

SEQ ID NO: 4909255 - DNA, 12 bp, Homo sapiens
ttcaccagagca

SEQ ID NO: 4909256 - DNA, 13 bp, Homo sapiens
ttcaccccaccct

SEQ ID NO: 4909257 - DNA, 21 bp, Homo sapiens
ttcaccccagtggccactcag

SEQ ID NO: 4909258 - DNA, 17 bp, Homo sapiens
ttcaccccccactcacc

SEQ ID NO: 4909259 - DNA, 17 bp, Homo sapiens
ttcacctaagtctctgt

SEQ ID NO: 4909260 - DNA, 23 bp, Homo sapiens
ttcactagtgaccccttccctgt

SEQ ID NO: 4909261 - DNA, 14 bp, Homo sapiens
ttcactcaagcact

SEQ ID NO: 4909262 - DNA, 21 bp, Homo sapiens
ttcactctgggcacactctgc

SEQ ID NO: 4909263 - DNA, 19 bp, Homo sapiens
ttcactgaagttctcctga

SEQ ID NO: 4909264 - DNA, 13 bp, Homo sapiens
ttcactggcccaa

SEQ ID NO: 4909265 - DNA, 15 bp, Homo sapiens
ttcactgtagaatga

SEQ ID NO: 4909266 - DNA, 16 bp, Homo sapiens
ttcactgttagctttt

SEQ ID NO: 4909267 - DNA, 21 bp, Homo sapiens
ttcactgttgaaaattatttt

SEQ ID NO: 4909268 - DNA, 20 bp, Homo sapiens
ttcacttcgggctgtgtaaa

SEQ ID NO: 4909269 - DNA, 21 bp, Homo sapiens
ttcacttgatgatacaatgaa

SEQ ID NO: 4909270 - DNA, 21 bp, Homo sapiens
ttcagaaaatattatgtgttt

SEQ ID NO: 4909271 - DNA, 20 bp, Homo sapiens
ttcagaaattggaacagaat

SEQ ID NO: 4909272 - DNA, 16 bp, Homo sapiens
ttcagaaccatccata

SEQ ID NO: 4909273 - DNA, 17 bp, Homo sapiens
ttcagaacctcttcccc

SEQ ID NO: 4909274 - DNA, 18 bp, Homo sapiens
ttcagaacctcttcccca

SEQ ID NO: 4909275 - DNA, 19 bp, Homo sapiens
ttcagaacctcttccccag

SEQ ID NO: 4909276 - DNA, 13 bp, Homo sapiens
ttcagaatattca

SEQ ID NO: 4909277 - DNA, 21 bp, Homo sapiens
ttcagagacagctgatacttc

SEQ ID NO: 4909278 - DNA, 15 bp, Homo sapiens
ttcagatcactgaat

SEQ ID NO: 4909279 - DNA, 21 bp, Homo sapiens
ttcagatgggaggaaagagag

SEQ ID NO: 4909280 - DNA, 21 bp, Homo sapiens
ttcagattcccagagcaaaat

SEQ ID NO: 4909281 - DNA, 22 bp, Homo sapiens
ttcagattttgataactgttta

SEQ ID NO: 4909282 - DNA, 16 bp, Homo sapiens
ttcagcattccctccc

SEQ ID NO: 4909283 - DNA, 13 bp, Homo sapiens
ttcagcccccagc

SEQ ID NO: 4909284 - DNA, 13 bp, Homo sapiens
ttcagctaaggga

SEQ ID NO: 4909285 - DNA, 15 bp, Homo sapiens
ttcagctccagctca

SEQ ID NO: 4909286 - DNA, 19 bp, Homo sapiens
ttcagctgtcctccctcca

SEQ ID NO: 4909287 - DNA, 16 bp, Homo sapiens
ttcagcttaaaataaa

SEQ ID NO: 4909288 - DNA, 19 bp, Homo sapiens
ttcaggaatgtgtggcctg

SEQ ID NO: 4909289 - DNA, 17 bp, Homo sapiens
ttcaggagcgcaagata

SEQ ID NO: 4909290 - DNA, 17 bp, Homo sapiens
ttcaggagtcccaagga

SEQ ID NO: 4909291 - DNA, 16 bp, Homo sapiens
ttcaggctgcttggga

SEQ ID NO: 4909292 - DNA, 21 bp, Homo sapiens
ttcaggcttcctgcaattttc

SEQ ID NO: 4909293 - DNA, 23 bp, Homo sapiens
ttcaggggactcagccctgaggt

SEQ ID NO: 4909294 - DNA, 16 bp, Homo sapiens
ttcagggttggcccct

SEQ ID NO: 4909295 - DNA, 21 bp, Homo sapiens
ttcagggttttctgagggaaa

SEQ ID NO: 4909296 - DNA, 13 bp, Homo sapiens
ttcaggtgacatg

SEQ ID NO: 4909297 - DNA, 19 bp, Homo sapiens
ttcaggtgacatgtgaaac

SEQ ID NO: 4909298 - DNA, 21 bp, Homo sapiens
ttcaggtgacatgtgaaacct

SEQ ID NO: 4909299 - DNA, 20 bp, Homo sapiens
ttcaggttatcgaaataaca

SEQ ID NO: 4909300 - DNA, 21 bp, Homo sapiens
ttcaggttatcgaaataacaa

SEQ ID NO: 4909301 - DNA, 24 bp, Homo sapiens
ttcaggttatcgaaataacaatgt

SEQ ID NO: 4909302 - DNA, 16 bp, Homo sapiens
ttcagtaatgttattt

SEQ ID NO: 4909303 - DNA, 22 bp, Homo sapiens
ttcagtaccctctcagctccag

SEQ ID NO: 4909304 - DNA, 19 bp, Homo sapiens
ttcagtattttggagaaat

SEQ ID NO: 4909305 - DNA, 20 bp, Homo sapiens
ttcagtattttggagaaatt

SEQ ID NO: 4909306 - DNA, 16 bp, Homo sapiens
ttcagtcctgctccag

SEQ ID NO: 4909307 - DNA, 14 bp, Homo sapiens
ttcagtggcagctg

SEQ ID NO: 4909308 - DNA, 24 bp, Homo sapiens
ttcagtgtagttaatttatctaaa

SEQ ID NO: 4909309 - DNA, 19 bp, Homo sapiens
ttcagttggttgtgtcttt

SEQ ID NO: 4909310 - DNA, 20 bp, Homo sapiens
ttcataaagtacttgagtgt

SEQ ID NO: 4909311 - DNA, 15 bp, Homo sapiens
ttcataacctagcct

SEQ ID NO: 4909312 - DNA, 21 bp, Homo sapiens
ttcatacctaagtactgtaat

SEQ ID NO: 4909313 - DNA, 18 bp, Homo sapiens
ttcatagagatttgtcta

SEQ ID NO: 4909314 - DNA, 20 bp, Homo sapiens
ttcatagagatttgtctaat

SEQ ID NO: 4909315 - DNA, 18 bp, Homo sapiens
ttcatatatgaggacttg

SEQ ID NO: 4909316 - DNA, 14 bp, Homo sapiens
ttcatattggaaaa

SEQ ID NO: 4909317 - DNA, 16 bp, Homo sapiens
ttcatattgtgccaat

SEQ ID NO: 4909318 - DNA, 20 bp, Homo sapiens
ttcatccaacttatgttttt

SEQ ID NO: 4909319 - DNA, 18 bp, Homo sapiens
ttcatcgaatctactaat

SEQ ID NO: 4909320 - DNA, 18 bp, Homo sapiens
ttcatctgttgttttgtt

SEQ ID NO: 4909321 - DNA, 13 bp, Homo sapiens
ttcatgatgcagt

SEQ ID NO: 4909322 - DNA, 16 bp, Homo sapiens
ttcatgatgcagtctc

SEQ ID NO: 4909323 - DNA, 21 bp, Homo sapiens
ttcatgccaattagcaattga

SEQ ID NO: 4909324 - DNA, 22 bp, Homo sapiens
ttcatgccaccatggccagcca

SEQ ID NO: 4909325 - DNA, 17 bp, Homo sapiens
ttcatgctatctctgtg

SEQ ID NO: 4909326 - DNA, 15 bp, Homo sapiens
ttcatgctctgcaaa

SEQ ID NO: 4909327 - DNA, 19 bp, Homo sapiens
ttcatggaatggacatcct

SEQ ID NO: 4909328 - DNA, 16 bp, Homo sapiens
ttcatggaccactgtt

SEQ ID NO: 4909329 - DNA, 17 bp, Homo sapiens
ttcatggaccactgttt

SEQ ID NO: 4909330 - DNA, 19 bp, Homo sapiens
ttcatggtgaaaatgtact

SEQ ID NO: 4909331 - DNA, 21 bp, Homo sapiens
ttcatgtacaagatgaaggag

SEQ ID NO: 4909332 - DNA, 14 bp, Homo sapiens
ttcatgtggctgta

SEQ ID NO: 4909333 - DNA, 14 bp, Homo sapiens
ttcatgtttggtgc

SEQ ID NO: 4909334 - DNA, 19 bp, Homo sapiens
ttcatgtttggtgcataga

SEQ ID NO: 4909335 - DNA, 16 bp, Homo sapiens
ttcattaattctataa

SEQ ID NO: 4909336 - DNA, 20 bp, Homo sapiens
ttcattacaatggaaacaat

SEQ ID NO: 4909337 - DNA, 22 bp, Homo sapiens
ttcattattagtactgctcttg

SEQ ID NO: 4909338 - DNA, 15 bp, Homo sapiens
ttcattcaatattga

SEQ ID NO: 4909339 - DNA, 21 bp, Homo sapiens
ttcattcaatattgacatttg

SEQ ID NO: 4909340 - DNA, 17 bp, Homo sapiens
ttcattcacttctctta

SEQ ID NO: 4909341 - DNA, 21 bp, Homo sapiens
ttcattccattgcctagctct

SEQ ID NO: 4909342 - DNA, 12 bp, Homo sapiens
ttcattctcata

SEQ ID NO: 4909343 - DNA, 23 bp, Homo sapiens
ttcattctcataattcctacagc

SEQ ID NO: 4909344 - DNA, 17 bp, Homo sapiens
ttcattctccttgttgt

SEQ ID NO: 4909345 - DNA, 22 bp, Homo sapiens
ttcattgagagttttgtcttga

SEQ ID NO: 4909346 - DNA, 18 bp, Homo sapiens
ttcatttgagaagtaaac

SEQ ID NO: 4909347 - DNA, 21 bp, Homo sapiens
ttccaaaataattttaagaaa

SEQ ID NO: 4909348 - DNA, 13 bp, Homo sapiens
ttccaaaattctt

SEQ ID NO: 4909349 - DNA, 15 bp, Homo sapiens
ttccaaataaaatga

SEQ ID NO: 4909350 - DNA, 17 bp, Homo sapiens
ttccaaatgcaatttga

SEQ ID NO: 4909351 - DNA, 20 bp, Homo sapiens
ttccaacaccacagacacac

SEQ ID NO: 4909352 - DNA, 22 bp, Homo sapiens
ttccaacaccacagacacacac

SEQ ID NO: 4909353 - DNA, 23 bp, Homo sapiens
ttccaacaccacagacacacaca

SEQ ID NO: 4909354 - DNA, 21 bp, Homo sapiens
ttccaagaaagatgaatacat

SEQ ID NO: 4909355 - DNA, 23 bp, Homo sapiens
ttccaagaaagatgaatacattt

SEQ ID NO: 4909356 - DNA, 13 bp, Homo sapiens
ttccaagtaatat

SEQ ID NO: 4909357 - DNA, 16 bp, Homo sapiens
ttccaatatgatgact

SEQ ID NO: 4909358 - DNA, 24 bp, Homo sapiens
ttccaatatttctgctttctttga

SEQ ID NO: 4909359 - DNA, 11 bp, Homo sapiens
ttccacaaaat

SEQ ID NO: 4909360 - DNA, 18 bp, Homo sapiens
ttccacaaaatctgtcca

SEQ ID NO: 4909361 - DNA, 15 bp, Homo sapiens
ttccacaccttttat

SEQ ID NO: 4909362 - DNA, 16 bp, Homo sapiens
ttccacagttgccacc

SEQ ID NO: 4909363 - DNA, 21 bp, Homo sapiens
ttccacagttgccaccacctc

SEQ ID NO: 4909364 - DNA, 13 bp, Homo sapiens
ttccactgcaaaa

SEQ ID NO: 4909365 - DNA, 16 bp, Homo sapiens
ttccactgcctctgcc

SEQ ID NO: 4909366 - DNA, 21 bp, Homo sapiens
ttccagaagaagagaagctgc

SEQ ID NO: 4909367 - DNA, 22 bp, Homo sapiens
ttccagaagaagagaagctgct

SEQ ID NO: 4909368 - DNA, 16 bp, Homo sapiens
ttccagaatgctgtac

SEQ ID NO: 4909369 - DNA, 18 bp, Homo sapiens
ttccagaatgctgtacat

SEQ ID NO: 4909370 - DNA, 21 bp, Homo sapiens
ttccagagagtggctcctccc

SEQ ID NO: 4909371 - DNA, 20 bp, Homo sapiens
ttccagaggctattattttc

SEQ ID NO: 4909372 - DNA, 14 bp, Homo sapiens
ttccagggcaatca

SEQ ID NO: 4909373 - DNA, 17 bp, Homo sapiens
ttccaggggaacctgcc

SEQ ID NO: 4909374 - DNA, 18 bp, Homo sapiens
ttccaggggaacctgcca

SEQ ID NO: 4909375 - DNA, 13 bp, Homo sapiens
ttccatagcaaca

SEQ ID NO: 4909376 - DNA, 15 bp, Homo sapiens
ttccatagcaacagg

SEQ ID NO: 4909377 - DNA, 12 bp, Homo sapiens
ttccatatttgg

SEQ ID NO: 4909378 - DNA, 18 bp, Homo sapiens
ttccatcccaaccagtgc

SEQ ID NO: 4909379 - DNA, 22 bp, Homo sapiens
ttccatctcctataatctgtca

SEQ ID NO: 4909380 - DNA, 23 bp, Homo sapiens
ttccatctcctataatctgtcaa

SEQ ID NO: 4909381 - DNA, 14 bp, Homo sapiens
ttccatctctgact

SEQ ID NO: 4909382 - DNA, 20 bp, Homo sapiens
ttccatgaagtttgaacttc

SEQ ID NO: 4909383 - DNA, 17 bp, Homo sapiens
ttccatgtatcttttga

SEQ ID NO: 4909384 - DNA, 19 bp, Homo sapiens
ttccattggtccaagattc

SEQ ID NO: 4909385 - DNA, 20 bp, Homo sapiens
ttcccaacttctcttgcttt

SEQ ID NO: 4909386 - DNA, 14 bp, Homo sapiens
ttcccaagaaatgc

SEQ ID NO: 4909387 - DNA, 23 bp, Homo sapiens
ttcccaagccttcgggcgtctgt

SEQ ID NO: 4909388 - DNA, 15 bp, Homo sapiens
ttcccaagctctgct

SEQ ID NO: 4909389 - DNA, 16 bp, Homo sapiens
ttcccaagctctgctc

SEQ ID NO: 4909390 - DNA, 23 bp, Homo sapiens
ttcccaatagcaacgtagcttct

SEQ ID NO: 4909391 - DNA, 16 bp, Homo sapiens
ttcccaatcagcactg

SEQ ID NO: 4909392 - DNA, 19 bp, Homo sapiens
ttcccaatcagcactgaaa

SEQ ID NO: 4909393 - DNA, 14 bp, Homo sapiens
ttcccacctccctg

SEQ ID NO: 4909394 - DNA, 18 bp, Homo sapiens
ttcccactttcccacccc

SEQ ID NO: 4909395 - DNA, 23 bp, Homo sapiens
ttcccagagcaaaataattttaa

SEQ ID NO: 4909396 - DNA, 15 bp, Homo sapiens
ttcccatcgctgtca

SEQ ID NO: 4909397 - DNA, 16 bp, Homo sapiens
ttcccatctttactcc

SEQ ID NO: 4909398 - DNA, 17 bp, Homo sapiens
ttccccactgacagcct

SEQ ID NO: 4909399 - DNA, 23 bp, Homo sapiens
ttccccactgacagcctcccacc

SEQ ID NO: 4909400 - DNA, 18 bp, Homo sapiens
ttccccagcatcactccc

SEQ ID NO: 4909401 - DNA, 15 bp, Homo sapiens
ttccccatctgggtc

SEQ ID NO: 4909402 - DNA, 11 bp, Homo sapiens
ttccccatggg

SEQ ID NO: 4909403 - DNA, 14 bp, Homo sapiens
ttcccccactaccg

SEQ ID NO: 4909404 - DNA, 12 bp, Homo sapiens
ttccccccactc

SEQ ID NO: 4909405 - DNA, 19 bp, Homo sapiens
ttccccccactctccccac

SEQ ID NO: 4909406 - DNA, 13 bp, Homo sapiens
ttcccctccctgg

SEQ ID NO: 4909407 - DNA, 17 bp, Homo sapiens
ttcccctccctggctcc

SEQ ID NO: 4909408 - DNA, 18 bp, Homo sapiens
ttcccctccttctccctt

SEQ ID NO: 4909409 - DNA, 14 bp, Homo sapiens
ttcccctctgctgc

SEQ ID NO: 4909410 - DNA, 14 bp, Homo sapiens
ttcccggtcccgag

SEQ ID NO: 4909411 - DNA, 20 bp, Homo sapiens
ttcccggtcccgagtacagt

SEQ ID NO: 4909412 - DNA, 17 bp, Homo sapiens
ttcccgtttctccacct

SEQ ID NO: 4909413 - DNA, 17 bp, Homo sapiens
ttccctacttcctgtga

SEQ ID NO: 4909414 - DNA, 14 bp, Homo sapiens
ttccctctccctgt

SEQ ID NO: 4909415 - DNA, 13 bp, Homo sapiens
ttccctctgctca

SEQ ID NO: 4909416 - DNA, 14 bp, Homo sapiens
ttccctctgctcag

SEQ ID NO: 4909417 - DNA, 20 bp, Homo sapiens
ttccctctttcttataatac

SEQ ID NO: 4909418 - DNA, 16 bp, Homo sapiens
ttccctctttggctcc

SEQ ID NO: 4909419 - DNA, 13 bp, Homo sapiens
ttccctcttttct

SEQ ID NO: 4909420 - DNA, 23 bp, Homo sapiens
ttccctcttttcttactcctcct

SEQ ID NO: 4909421 - DNA, 19 bp, Homo sapiens
ttccctgcatttctgagtt

SEQ ID NO: 4909422 - DNA, 16 bp, Homo sapiens
ttccctgttcttcctc

SEQ ID NO: 4909423 - DNA, 19 bp, Homo sapiens
ttcccttcagtaccctctc

SEQ ID NO: 4909424 - DNA, 22 bp, Homo sapiens
ttcccttcagtaccctctcagc

SEQ ID NO: 4909425 - DNA, 15 bp, Homo sapiens
ttcccttcccttcca

SEQ ID NO: 4909426 - DNA, 17 bp, Homo sapiens
ttcccttcctcttcggc

SEQ ID NO: 4909427 - DNA, 19 bp, Homo sapiens
ttcccttgccactttgcac

SEQ ID NO: 4909428 - DNA, 18 bp, Homo sapiens
ttcccttgcttttccctc

SEQ ID NO: 4909429 - DNA, 20 bp, Homo sapiens
ttcccttgcttttccctctt

SEQ ID NO: 4909430 - DNA, 15 bp, Homo sapiens
ttcccttggcctcag

SEQ ID NO: 4909431 - DNA, 15 bp, Homo sapiens
ttccctttccccagc

SEQ ID NO: 4909432 - DNA, 15 bp, Homo sapiens
ttccctttccttcca

SEQ ID NO: 4909433 - DNA, 17 bp, Homo sapiens
ttccctttgtctttcaa

SEQ ID NO: 4909434 - DNA, 16 bp, Homo sapiens
ttccgaccctctggga

SEQ ID NO: 4909435 - DNA, 17 bp, Homo sapiens
ttccgaccctctgggaa

SEQ ID NO: 4909436 - DNA, 14 bp, Homo sapiens
ttccgcccctgcct

SEQ ID NO: 4909437 - DNA, 16 bp, Homo sapiens
ttcctaagaagcttct

SEQ ID NO: 4909438 - DNA, 15 bp, Homo sapiens
ttcctacagcactac

SEQ ID NO: 4909439 - DNA, 23 bp, Homo sapiens
ttcctacagcactactgggtgtc

SEQ ID NO: 4909440 - DNA, 20 bp, Homo sapiens
ttcctacaggcagtctctct

SEQ ID NO: 4909441 - DNA, 15 bp, Homo sapiens
ttcctagttttctcc

SEQ ID NO: 4909442 - DNA, 17 bp, Homo sapiens
ttcctataacttgatgc

SEQ ID NO: 4909443 - DNA, 19 bp, Homo sapiens
ttcctataacttgatgcat

SEQ ID NO: 4909444 - DNA, 23 bp, Homo sapiens
ttcctcatagtatggtggctggg

SEQ ID NO: 4909445 - DNA, 16 bp, Homo sapiens
ttcctccagctgcacc

SEQ ID NO: 4909446 - DNA, 22 bp, Homo sapiens
ttcctccagctgcaccagagca

SEQ ID NO: 4909447 - DNA, 15 bp, Homo sapiens
ttcctcgcctctccc

SEQ ID NO: 4909448 - DNA, 17 bp, Homo sapiens
ttcctcgcctctcccac

SEQ ID NO: 4909449 - DNA, 17 bp, Homo sapiens
ttcctctatacatctct

SEQ ID NO: 4909450 - DNA, 20 bp, Homo sapiens
ttcctctatacatctctccc

SEQ ID NO: 4909451 - DNA, 19 bp, Homo sapiens
ttcctctcactaaacttta

SEQ ID NO: 4909452 - DNA, 15 bp, Homo sapiens
ttcctctccactgcc

SEQ ID NO: 4909453 - DNA, 16 bp, Homo sapiens
ttcctctccactgcct

SEQ ID NO: 4909454 - DNA, 21 bp, Homo sapiens
ttcctctgtttctccttctga

SEQ ID NO: 4909455 - DNA, 15 bp, Homo sapiens
ttcctgaaatgcagt

SEQ ID NO: 4909456 - DNA, 17 bp, Homo sapiens
ttcctgacatcacagca

SEQ ID NO: 4909457 - DNA, 19 bp, Homo sapiens
ttcctgacatcacagcagc

SEQ ID NO: 4909458 - DNA, 16 bp, Homo sapiens
ttcctgcatttgtgaa

SEQ ID NO: 4909459 - DNA, 20 bp, Homo sapiens
ttcctgcccctctttctctt

SEQ ID NO: 4909460 - DNA, 15 bp, Homo sapiens
ttcctggacactcag

SEQ ID NO: 4909461 - DNA, 17 bp, Homo sapiens
ttcctgtgatccaccca

SEQ ID NO: 4909462 - DNA, 11 bp, Homo sapiens
ttcctgtgtct

SEQ ID NO: 4909463 - DNA, 20 bp, Homo sapiens
ttccttaagtatatcatgta

SEQ ID NO: 4909464 - DNA, 20 bp, Homo sapiens
ttccttatttgcttcattgt

SEQ ID NO: 4909465 - DNA, 15 bp, Homo sapiens
ttccttccactaact

SEQ ID NO: 4909466 - DNA, 11 bp, Homo sapiens
ttccttcctaa

SEQ ID NO: 4909467 - DNA, 13 bp, Homo sapiens
ttccttctgtaaa

SEQ ID NO: 4909468 - DNA, 13 bp, Homo sapiens
ttccttctttgat

SEQ ID NO: 4909469 - DNA, 14 bp, Homo sapiens
ttccttctttgata

SEQ ID NO: 4909470 - DNA, 13 bp, Homo sapiens
ttccttgatcatt

SEQ ID NO: 4909471 - DNA, 14 bp, Homo sapiens
ttccttgatcattt

SEQ ID NO: 4909472 - DNA, 15 bp, Homo sapiens
ttcctttccccagcc

SEQ ID NO: 4909473 - DNA, 17 bp, Homo sapiens
ttcctttccccagccca

SEQ ID NO: 4909474 - DNA, 13 bp, Homo sapiens
ttcctttcccttc

SEQ ID NO: 4909475 - DNA, 14 bp, Homo sapiens
ttcctttcccttcc

SEQ ID NO: 4909476 - DNA, 14 bp, Homo sapiens
ttcctttctccagg

SEQ ID NO: 4909477 - DNA, 15 bp, Homo sapiens
ttcctttctctttct

SEQ ID NO: 4909478 - DNA, 17 bp, Homo sapiens
ttcctttgtcttcaaac

SEQ ID NO: 4909479 - DNA, 20 bp, Homo sapiens
ttcctttgtggttttatgga

SEQ ID NO: 4909480 - DNA, 18 bp, Homo sapiens
ttcctttgtgtttctatt

SEQ ID NO: 4909481 - DNA, 23 bp, Homo sapiens
ttcgcacctaccatcagggacag

SEQ ID NO: 4909482 - DNA, 14 bp, Homo sapiens
ttcgcatggtcaca

SEQ ID NO: 4909483 - DNA, 19 bp, Homo sapiens
ttcgctcctgtgtcttgca

SEQ ID NO: 4909484 - DNA, 19 bp, Homo sapiens
ttcggaggccccactgatg

SEQ ID NO: 4909485 - DNA, 18 bp, Homo sapiens
ttcggctctgggtgggca

SEQ ID NO: 4909486 - DNA, 16 bp, Homo sapiens
ttcgtcttctaatttc

SEQ ID NO: 4909487 - DNA, 17 bp, Homo sapiens
ttcgtgaacatcccctc

SEQ ID NO: 4909488 - DNA, 16 bp, Homo sapiens
ttcgttagaccgctct

SEQ ID NO: 4909489 - DNA, 21 bp, Homo sapiens
ttctaaaatcttatagttcta

SEQ ID NO: 4909490 - DNA, 19 bp, Homo sapiens
ttctaaaatgtgatgttct

SEQ ID NO: 4909491 - DNA, 23 bp, Homo sapiens
ttctaaaatgtgatgttctaagg

SEQ ID NO: 4909492 - DNA, 12 bp, Homo sapiens
ttctaaagattc

SEQ ID NO: 4909493 - DNA, 13 bp, Homo sapiens
ttctaaagattct

SEQ ID NO: 4909494 - DNA, 13 bp, Homo sapiens
ttctaaaggtcca

SEQ ID NO: 4909495 - DNA, 16 bp, Homo sapiens
ttctaaaggtccacag

SEQ ID NO: 4909496 - DNA, 12 bp, Homo sapiens
ttctaaagttct

SEQ ID NO: 4909497 - DNA, 14 bp, Homo sapiens
ttctaaagttctaa

SEQ ID NO: 4909498 - DNA, 20 bp, Homo sapiens
ttctaaagttctaagattct

SEQ ID NO: 4909499 - DNA, 20 bp, Homo sapiens
ttctaagacttactctaaga

SEQ ID NO: 4909500 - DNA, 12 bp, Homo sapiens
ttctaagatgtg

SEQ ID NO: 4909501 - DNA, 19 bp, Homo sapiens
ttctaagatgtgatattct

SEQ ID NO: 4909502 - DNA, 22 bp, Homo sapiens
ttctaagatgtgatattctaag

SEQ ID NO: 4909503 - DNA, 16 bp, Homo sapiens
ttctaagattctaatg

SEQ ID NO: 4909504 - DNA, 17 bp, Homo sapiens
ttctaagattctaatga

SEQ ID NO: 4909505 - DNA, 19 bp, Homo sapiens
ttctaagattctaatgatg

SEQ ID NO: 4909506 - DNA, 13 bp, Homo sapiens
ttctaagattctg

SEQ ID NO: 4909507 - DNA, 19 bp, Homo sapiens
ttctaaggcctaggattct

SEQ ID NO: 4909508 - DNA, 22 bp, Homo sapiens
ttctaaggcctaggattctaaa

SEQ ID NO: 4909509 - DNA, 12 bp, Homo sapiens
ttctaaggctct

SEQ ID NO: 4909510 - DNA, 13 bp, Homo sapiens
ttctaaggctctg

SEQ ID NO: 4909511 - DNA, 20 bp, Homo sapiens
ttctaaggctctgagagtct

SEQ ID NO: 4909512 - DNA, 20 bp, Homo sapiens
ttctaaggtccggtgttcta

SEQ ID NO: 4909513 - DNA, 13 bp, Homo sapiens
ttctaagtttcta

SEQ ID NO: 4909514 - DNA, 16 bp, Homo sapiens
ttctaagtttctaaga

SEQ ID NO: 4909515 - DNA, 18 bp, Homo sapiens
ttctaagtttctaagatt

SEQ ID NO: 4909516 - DNA, 20 bp, Homo sapiens
ttctaagtttctaagattct

SEQ ID NO: 4909517 - DNA, 21 bp, Homo sapiens
ttctaagtttctaagattcta

SEQ ID NO: 4909518 - DNA, 15 bp, Homo sapiens
ttctaataatttcta

SEQ ID NO: 4909519 - DNA, 19 bp, Homo sapiens
ttctaataatttctaatgt

SEQ ID NO: 4909520 - DNA, 13 bp, Homo sapiens
ttctaatatcatt

SEQ ID NO: 4909521 - DNA, 14 bp, Homo sapiens
ttctacaaagcact

SEQ ID NO: 4909522 - DNA, 21 bp, Homo sapiens
ttctacaaagcactagagaat

SEQ ID NO: 4909523 - DNA, 22 bp, Homo sapiens
ttctaccatgaacagaaaacat

SEQ ID NO: 4909524 - DNA, 21 bp, Homo sapiens
ttctagaagtttcccttcctc

SEQ ID NO: 4909525 - DNA, 22 bp, Homo sapiens
ttctagaattataagtcacaaa

SEQ ID NO: 4909526 - DNA, 22 bp, Homo sapiens
ttctagacatggaggttctaag

SEQ ID NO: 4909527 - DNA, 12 bp, Homo sapiens
ttctagcctgca

SEQ ID NO: 4909528 - DNA, 23 bp, Homo sapiens
ttctaggcactgtagttctaaga

SEQ ID NO: 4909529 - DNA, 19 bp, Homo sapiens
ttctaggcatctctgtact

SEQ ID NO: 4909530 - DNA, 21 bp, Homo sapiens
ttctaggtttcaaagatgctg

SEQ ID NO: 4909531 - DNA, 17 bp, Homo sapiens
ttctagtggtctttgta

SEQ ID NO: 4909532 - DNA, 22 bp, Homo sapiens
ttctagtggtctttgtaagagt

SEQ ID NO: 4909533 - DNA, 21 bp, Homo sapiens
ttctataaggccataaaacag

SEQ ID NO: 4909534 - DNA, 23 bp, Homo sapiens
ttctataaggccataaaacaggt

SEQ ID NO: 4909535 - DNA, 14 bp, Homo sapiens
ttctatagttctag

SEQ ID NO: 4909536 - DNA, 16 bp, Homo sapiens
ttctatagttctagac

SEQ ID NO: 4909537 - DNA, 17 bp, Homo sapiens
ttctatagttctagaca

SEQ ID NO: 4909538 - DNA, 20 bp, Homo sapiens
ttctatatgaatttaaatat

SEQ ID NO: 4909539 - DNA, 23 bp, Homo sapiens
ttctatatgaatttaaatataat

SEQ ID NO: 4909540 - DNA, 14 bp, Homo sapiens
ttctatcaagccca

SEQ ID NO: 4909541 - DNA, 17 bp, Homo sapiens
ttctatccaaacatgta

SEQ ID NO: 4909542 - DNA, 13 bp, Homo sapiens
ttctatgtactag

SEQ ID NO: 4909543 - DNA, 12 bp, Homo sapiens
ttctattaaagt

SEQ ID NO: 4909544 - DNA, 22 bp, Homo sapiens
ttctattcaaggtggccaaatt

SEQ ID NO: 4909545 - DNA, 14 bp, Homo sapiens
ttctattccttctg

SEQ ID NO: 4909546 - DNA, 18 bp, Homo sapiens
ttctattccttctggcct

SEQ ID NO: 4909547 - DNA, 17 bp, Homo sapiens
ttctattgacttcaatg

SEQ ID NO: 4909548 - DNA, 23 bp, Homo sapiens
ttctattgacttcaatgatagta

SEQ ID NO: 4909549 - DNA, 12 bp, Homo sapiens
ttctattgcctt

SEQ ID NO: 4909550 - DNA, 18 bp, Homo sapiens
ttctatttatatgtacat

SEQ ID NO: 4909551 - DNA, 19 bp, Homo sapiens
ttctatttatatgtacatg

SEQ ID NO: 4909552 - DNA, 18 bp, Homo sapiens
ttctcaaaagcatttatc

SEQ ID NO: 4909553 - DNA, 12 bp, Homo sapiens
ttctcaaatctt

SEQ ID NO: 4909554 - DNA, 13 bp, Homo sapiens
ttctcaagttcta

SEQ ID NO: 4909555 - DNA, 17 bp, Homo sapiens
ttctcaagttctaagat

SEQ ID NO: 4909556 - DNA, 12 bp, Homo sapiens
ttctcacagcac

SEQ ID NO: 4909557 - DNA, 16 bp, Homo sapiens
ttctcataattcctac

SEQ ID NO: 4909558 - DNA, 14 bp, Homo sapiens
ttctcatctgcacc

SEQ ID NO: 4909559 - DNA, 18 bp, Homo sapiens
ttctcattccaacagtga

SEQ ID NO: 4909560 - DNA, 13 bp, Homo sapiens
ttctcattttctt

SEQ ID NO: 4909561 - DNA, 12 bp, Homo sapiens
ttctccactgga

SEQ ID NO: 4909562 - DNA, 15 bp, Homo sapiens
ttctccagctgggct

SEQ ID NO: 4909563 - DNA, 17 bp, Homo sapiens
ttctcccagaatcccag

SEQ ID NO: 4909564 - DNA, 21 bp, Homo sapiens
ttctcctgcctgtgctgtgac

SEQ ID NO: 4909565 - DNA, 15 bp, Homo sapiens
ttctctccccaaccc

SEQ ID NO: 4909566 - DNA, 18 bp, Homo sapiens
ttctctccctgccagagg

SEQ ID NO: 4909567 - DNA, 17 bp, Homo sapiens
ttctctctacagtgcca

SEQ ID NO: 4909568 - DNA, 18 bp, Homo sapiens
ttctctgaacacaggcag

SEQ ID NO: 4909569 - DNA, 20 bp, Homo sapiens
ttctctgaacacaggcagct

SEQ ID NO: 4909570 - DNA, 20 bp, Homo sapiens
ttctctgaggacactaacca

SEQ ID NO: 4909571 - DNA, 17 bp, Homo sapiens
ttctctgtctcagactt

SEQ ID NO: 4909572 - DNA, 22 bp, Homo sapiens
ttctctgtctcagacttttgta

SEQ ID NO: 4909573 - DNA, 18 bp, Homo sapiens
ttctctgtgtctaagatt

SEQ ID NO: 4909574 - DNA, 22 bp, Homo sapiens
ttctctgtgtctaagattctag

SEQ ID NO: 4909575 - DNA, 14 bp, Homo sapiens
ttctcttgctttct

SEQ ID NO: 4909576 - DNA, 19 bp, Homo sapiens
ttctcttgtataagatcct

SEQ ID NO: 4909577 - DNA, 14 bp, Homo sapiens
ttctctttcttcct

SEQ ID NO: 4909578 - DNA, 22 bp, Homo sapiens
ttctctttgtggggcttggcgt

SEQ ID NO: 4909579 - DNA, 22 bp, Homo sapiens
ttctcttttctagtttgctcat

SEQ ID NO: 4909580 - DNA, 19 bp, Homo sapiens
ttctgacaaaaagtttcca

SEQ ID NO: 4909581 - DNA, 14 bp, Homo sapiens
ttctgacaaactgt

SEQ ID NO: 4909582 - DNA, 14 bp, Homo sapiens
ttctgacggccctg

SEQ ID NO: 4909583 - DNA, 17 bp, Homo sapiens
ttctgacggccctgcaa

SEQ ID NO: 4909584 - DNA, 12 bp, Homo sapiens
ttctgagaaaag

SEQ ID NO: 4909585 - DNA, 19 bp, Homo sapiens
ttctgagtttcattctcct

SEQ ID NO: 4909586 - DNA, 20 bp, Homo sapiens
ttctgagtttcattctcctg

SEQ ID NO: 4909587 - DNA, 23 bp, Homo sapiens
ttctgagtttcattctcctgcct

SEQ ID NO: 4909588 - DNA, 20 bp, Homo sapiens
ttctgattagctttgtgttt

SEQ ID NO: 4909589 - DNA, 17 bp, Homo sapiens
ttctgattttaggagct

SEQ ID NO: 4909590 - DNA, 22 bp, Homo sapiens
ttctgcaagcacatctgcattt

SEQ ID NO: 4909591 - DNA, 12 bp, Homo sapiens
ttctgcactgaa

SEQ ID NO: 4909592 - DNA, 13 bp, Homo sapiens
ttctgcactgaaa

SEQ ID NO: 4909593 - DNA, 18 bp, Homo sapiens
ttctgcagtaaatctttt

SEQ ID NO: 4909594 - DNA, 14 bp, Homo sapiens
ttctgcccccagcc

SEQ ID NO: 4909595 - DNA, 15 bp, Homo sapiens
ttctgcccccagccc

SEQ ID NO: 4909596 - DNA, 22 bp, Homo sapiens
ttctgccgacccctagttccct

SEQ ID NO: 4909597 - DNA, 10 bp, Homo sapiens
ttctgccttt

SEQ ID NO: 4909598 - DNA, 17 bp, Homo sapiens
ttctgctccacccttgg

SEQ ID NO: 4909599 - DNA, 20 bp, Homo sapiens
ttctgctccacccttggcct

SEQ ID NO: 4909600 - DNA, 16 bp, Homo sapiens
ttctgcttcaataaat

SEQ ID NO: 4909601 - DNA, 19 bp, Homo sapiens
ttctgctttctttgattct

SEQ ID NO: 4909602 - DNA, 17 bp, Homo sapiens
ttctggcctttcctctc

SEQ ID NO: 4909603 - DNA, 12 bp, Homo sapiens
ttctgggctctt

SEQ ID NO: 4909604 - DNA, 20 bp, Homo sapiens
ttctggggaaagacactgcc

SEQ ID NO: 4909605 - DNA, 22 bp, Homo sapiens
ttctggggaaagacactgcctg

SEQ ID NO: 4909606 - DNA, 19 bp, Homo sapiens
ttctggggcaggctgggcc

SEQ ID NO: 4909607 - DNA, 21 bp, Homo sapiens
ttctggggcaggctgggccat

SEQ ID NO: 4909608 - DNA, 16 bp, Homo sapiens
ttctgggtcttttgct

SEQ ID NO: 4909609 - DNA, 23 bp, Homo sapiens
ttctgtaaactcaaaacttaaca

SEQ ID NO: 4909610 - DNA, 14 bp, Homo sapiens
ttctgtaaatacca

SEQ ID NO: 4909611 - DNA, 14 bp, Homo sapiens
ttctgtagtcattt

SEQ ID NO: 4909612 - DNA, 22 bp, Homo sapiens
ttctgtagtcatttactaaaca

SEQ ID NO: 4909613 - DNA, 23 bp, Homo sapiens
ttctgtatacaaccctggcatta

SEQ ID NO: 4909614 - DNA, 17 bp, Homo sapiens
ttctgtatatacttttt

SEQ ID NO: 4909615 - DNA, 14 bp, Homo sapiens
ttctgtcaagaaga

SEQ ID NO: 4909616 - DNA, 22 bp, Homo sapiens
ttctgtcagatgagaacaaagc

SEQ ID NO: 4909617 - DNA, 17 bp, Homo sapiens
ttctgtgatcatttatt

SEQ ID NO: 4909618 - DNA, 14 bp, Homo sapiens
ttctgtgtatctct

SEQ ID NO: 4909619 - DNA, 21 bp, Homo sapiens
ttctgtgtatctctttcacat

SEQ ID NO: 4909620 - DNA, 22 bp, Homo sapiens
ttctgtgtctttcacagctcct

SEQ ID NO: 4909621 - DNA, 17 bp, Homo sapiens
ttctgtgtttaatttct

SEQ ID NO: 4909622 - DNA, 21 bp, Homo sapiens
ttctgttggccagtgtgacaa

SEQ ID NO: 4909623 - DNA, 15 bp, Homo sapiens
ttctgtttgattctt

SEQ ID NO: 4909624 - DNA, 15 bp, Homo sapiens
ttcttaaatatcttt

SEQ ID NO: 4909625 - DNA, 17 bp, Homo sapiens
ttcttaaatatctttta

SEQ ID NO: 4909626 - DNA, 18 bp, Homo sapiens
ttcttacactgcctgtat

SEQ ID NO: 4909627 - DNA, 13 bp, Homo sapiens
ttcttataatact

SEQ ID NO: 4909628 - DNA, 18 bp, Homo sapiens
ttcttatgcaaaatggaa

SEQ ID NO: 4909629 - DNA, 22 bp, Homo sapiens
ttcttatggaattgatttgcat

SEQ ID NO: 4909630 - DNA, 14 bp, Homo sapiens
ttcttcaaaatgta

SEQ ID NO: 4909631 - DNA, 22 bp, Homo sapiens
ttcttcagcgtaaaatggtgaa

SEQ ID NO: 4909632 - DNA, 15 bp, Homo sapiens
ttcttcatattctaa

SEQ ID NO: 4909633 - DNA, 12 bp, Homo sapiens
ttcttcctctgc

SEQ ID NO: 4909634 - DNA, 17 bp, Homo sapiens
ttcttcctttactttcc

SEQ ID NO: 4909635 - DNA, 20 bp, Homo sapiens
ttcttctgcttcagcctccc

SEQ ID NO: 4909636 - DNA, 21 bp, Homo sapiens
ttcttgacaaaacctaacttg

SEQ ID NO: 4909637 - DNA, 15 bp, Homo sapiens
ttcttgcaagcatgc

SEQ ID NO: 4909638 - DNA, 18 bp, Homo sapiens
ttcttgcagtcatcagaa

SEQ ID NO: 4909639 - DNA, 22 bp, Homo sapiens
ttcttgctcccttcagccccca

SEQ ID NO: 4909640 - DNA, 19 bp, Homo sapiens
ttcttgctgctagaacttt

SEQ ID NO: 4909641 - DNA, 23 bp, Homo sapiens
ttcttgctgctagaactttttta

SEQ ID NO: 4909642 - DNA, 19 bp, Homo sapiens
ttcttggcaaaagccttgt

SEQ ID NO: 4909643 - DNA, 20 bp, Homo sapiens
ttcttggcaaaagccttgtg

SEQ ID NO: 4909644 - DNA, 13 bp, Homo sapiens
ttcttgtcaaaaa

SEQ ID NO: 4909645 - DNA, 17 bp, Homo sapiens
ttcttgtcagacataaa

SEQ ID NO: 4909646 - DNA, 23 bp, Homo sapiens
ttcttgtctatagttgtcagtat

SEQ ID NO: 4909647 - DNA, 22 bp, Homo sapiens
ttctttaaagaagttgaagttt

SEQ ID NO: 4909648 - DNA, 13 bp, Homo sapiens
ttctttaaagatg

SEQ ID NO: 4909649 - DNA, 20 bp, Homo sapiens
ttctttatatttatccacta

SEQ ID NO: 4909650 - DNA, 13 bp, Homo sapiens
ttctttcccagtg

SEQ ID NO: 4909651 - DNA, 13 bp, Homo sapiens
ttctttctttaaa

SEQ ID NO: 4909652 - DNA, 15 bp, Homo sapiens
ttctttgaatttact

SEQ ID NO: 4909653 - DNA, 17 bp, Homo sapiens
ttctttgataatgttaa

SEQ ID NO: 4909654 - DNA, 12 bp, Homo sapiens
ttctttgtgtag

SEQ ID NO: 4909655 - DNA, 14 bp, Homo sapiens
ttcttttgtaagtg

SEQ ID NO: 4909656 - DNA, 19 bp, Homo sapiens
ttcttttgttactgttctt

SEQ ID NO: 4909657 - DNA, 21 bp, Homo sapiens
ttctttttaagtaatgtggaa

SEQ ID NO: 4909658 - DNA, 13 bp, Homo sapiens
ttctttttacata

SEQ ID NO: 4909659 - DNA, 15 bp, Homo sapiens
ttgaaaaaaacttca

SEQ ID NO: 4909660 - DNA, 15 bp, Homo sapiens
ttgaaaaaagctcat

SEQ ID NO: 4909661 - DNA, 17 bp, Homo sapiens
ttgaaaaaagctcattt

SEQ ID NO: 4909662 - DNA, 20 bp, Homo sapiens
ttgaaaaccaaaatgacatc

SEQ ID NO: 4909663 - DNA, 22 bp, Homo sapiens
ttgaaaaccaaaatgacatctt

SEQ ID NO: 4909664 - DNA, 23 bp, Homo sapiens
ttgaaaaccaaaatgacatcttt

SEQ ID NO: 4909665 - DNA, 12 bp, Homo sapiens
ttgaaaagctat

SEQ ID NO: 4909666 - DNA, 19 bp, Homo sapiens
ttgaaaagcttcttaatta

SEQ ID NO: 4909667 - DNA, 21 bp, Homo sapiens
ttgaaaagcttcttaattaat

SEQ ID NO: 4909668 - DNA, 20 bp, Homo sapiens
ttgaaaattattttaaacaa

SEQ ID NO: 4909669 - DNA, 22 bp, Homo sapiens
ttgaaagattcaggtatgttgc

SEQ ID NO: 4909670 - DNA, 13 bp, Homo sapiens
ttgaaatacctca

SEQ ID NO: 4909671 - DNA, 17 bp, Homo sapiens
ttgaaatacctcatgtt

SEQ ID NO: 4909672 - DNA, 18 bp, Homo sapiens
ttgaaatacctcatgttt

SEQ ID NO: 4909673 - DNA, 13 bp, Homo sapiens
ttgaaatctttta

SEQ ID NO: 4909674 - DNA, 13 bp, Homo sapiens
ttgaaatgaaatt

SEQ ID NO: 4909675 - DNA, 19 bp, Homo sapiens
ttgaaatgaaatttaaaca

SEQ ID NO: 4909676 - DNA, 20 bp, Homo sapiens
ttgaaatgaaatttaaacat

SEQ ID NO: 4909677 - DNA, 20 bp, Homo sapiens
ttgaaattaagaaggcaaaa

SEQ ID NO: 4909678 - DNA, 14 bp, Homo sapiens
ttgaaattatatct

SEQ ID NO: 4909679 - DNA, 17 bp, Homo sapiens
ttgaaattatatctgtg

SEQ ID NO: 4909680 - DNA, 20 bp, Homo sapiens
ttgaaattatgtgacatttt

SEQ ID NO: 4909681 - DNA, 15 bp, Homo sapiens
ttgaaattgtacata

SEQ ID NO: 4909682 - DNA, 19 bp, Homo sapiens
ttgaaattgtgaactcatt

SEQ ID NO: 4909683 - DNA, 20 bp, Homo sapiens
ttgaaattttgcaaatataa

SEQ ID NO: 4909684 - DNA, 18 bp, Homo sapiens
ttgaacacaaactgtaaa

SEQ ID NO: 4909685 - DNA, 14 bp, Homo sapiens
ttgaactaagaaac

SEQ ID NO: 4909686 - DNA, 19 bp, Homo sapiens
ttgaactaagaaacttttg

SEQ ID NO: 4909687 - DNA, 15 bp, Homo sapiens
ttgaactcagatctg

SEQ ID NO: 4909688 - DNA, 18 bp, Homo sapiens
ttgaactgggtacttgtg

SEQ ID NO: 4909689 - DNA, 19 bp, Homo sapiens
ttgaagaaggtggaccttt

SEQ ID NO: 4909690 - DNA, 14 bp, Homo sapiens
ttgaagctgaaaat

SEQ ID NO: 4909691 - DNA, 17 bp, Homo sapiens
ttgaaggaaaatgatac

SEQ ID NO: 4909692 - DNA, 13 bp, Homo sapiens
ttgaaggaaacag

SEQ ID NO: 4909693 - DNA, 20 bp, Homo sapiens
ttgaaggaagccaaatttat

SEQ ID NO: 4909694 - DNA, 12 bp, Homo sapiens
ttgaaggcaaaa

SEQ ID NO: 4909695 - DNA, 17 bp, Homo sapiens
ttgaaggcaaaattgca

SEQ ID NO: 4909696 - DNA, 15 bp, Homo sapiens
ttgaagggcccagga

SEQ ID NO: 4909697 - DNA, 15 bp, Homo sapiens
ttgaagtcaccttgt

SEQ ID NO: 4909698 - DNA, 13 bp, Homo sapiens
ttgaagtcttgta

SEQ ID NO: 4909699 - DNA, 16 bp, Homo sapiens
ttgaagtttacatttt

SEQ ID NO: 4909700 - DNA, 14 bp, Homo sapiens
ttgaataaaagtgc

SEQ ID NO: 4909701 - DNA, 16 bp, Homo sapiens
ttgaataccattaaaa

SEQ ID NO: 4909702 - DNA, 19 bp, Homo sapiens
ttgaataccattaaaactg

SEQ ID NO: 4909703 - DNA, 13 bp, Homo sapiens
ttgaatacttttt

SEQ ID NO: 4909704 - DNA, 15 bp, Homo sapiens
ttgaatatggacaag

SEQ ID NO: 4909705 - DNA, 13 bp, Homo sapiens
ttgaatattactc

SEQ ID NO: 4909706 - DNA, 13 bp, Homo sapiens
ttgaatattgtgt

SEQ ID NO: 4909707 - DNA, 18 bp, Homo sapiens
ttgaatgacaacagaagc

SEQ ID NO: 4909708 - DNA, 20 bp, Homo sapiens
ttgaatgacaacagaagctt

SEQ ID NO: 4909709 - DNA, 16 bp, Homo sapiens
ttgaatgtcttttgaa

SEQ ID NO: 4909710 - DNA, 21 bp, Homo sapiens
ttgaatgtggcttgagaaata

SEQ ID NO: 4909711 - DNA, 23 bp, Homo sapiens
ttgaatgttatttgttattttca

SEQ ID NO: 4909712 - DNA, 15 bp, Homo sapiens
ttgaattttaaatct

SEQ ID NO: 4909713 - DNA, 16 bp, Homo sapiens
ttgaattttaaatcta

SEQ ID NO: 4909714 - DNA, 21 bp, Homo sapiens
ttgacaaaacctaacttgcgc

SEQ ID NO: 4909715 - DNA, 22 bp, Homo sapiens
ttgacaaatctgtgtatattat

SEQ ID NO: 4909716 - DNA, 16 bp, Homo sapiens
ttgacacaattggaat

SEQ ID NO: 4909717 - DNA, 18 bp, Homo sapiens
ttgacacatccgcctttt

SEQ ID NO: 4909718 - DNA, 14 bp, Homo sapiens
ttgacactctgcag

SEQ ID NO: 4909719 - DNA, 18 bp, Homo sapiens
ttgacagttctgaagaat

SEQ ID NO: 4909720 - DNA, 22 bp, Homo sapiens
ttgacatcagttcctttgtgtg

SEQ ID NO: 4909721 - DNA, 22 bp, Homo sapiens
ttgacattaagaatgttggttt

SEQ ID NO: 4909722 - DNA, 17 bp, Homo sapiens
ttgaccatctgctttta

SEQ ID NO: 4909723 - DNA, 18 bp, Homo sapiens
ttgacgagtcaccttcca

SEQ ID NO: 4909724 - DNA, 17 bp, Homo sapiens
ttgacgattccttctct

SEQ ID NO: 4909725 - DNA, 23 bp, Homo sapiens
ttgacggttttttattattgtgg

SEQ ID NO: 4909726 - DNA, 15 bp, Homo sapiens
ttgactcaggattta

SEQ ID NO: 4909727 - DNA, 21 bp, Homo sapiens
ttgactggtttacaggccctg

SEQ ID NO: 4909728 - DNA, 21 bp, Homo sapiens
ttgacttaatgtgattactgc

SEQ ID NO: 4909729 - DNA, 11 bp, Homo sapiens
ttgagaaaaat

SEQ ID NO: 4909730 - DNA, 15 bp, Homo sapiens
ttgagaactttccat

SEQ ID NO: 4909731 - DNA, 16 bp, Homo sapiens
ttgagaagaggacatt

SEQ ID NO: 4909732 - DNA, 23 bp, Homo sapiens
ttgagaagccttcagctccaggg

SEQ ID NO: 4909733 - DNA, 14 bp, Homo sapiens
ttgagaaggagaga

SEQ ID NO: 4909734 - DNA, 17 bp, Homo sapiens
ttgagaaggagagaaag

SEQ ID NO: 4909735 - DNA, 11 bp, Homo sapiens
ttgagacagag

SEQ ID NO: 4909736 - DNA, 13 bp, Homo sapiens
ttgagacagtttc

SEQ ID NO: 4909737 - DNA, 19 bp, Homo sapiens
ttgagacagtttcttagct

SEQ ID NO: 4909738 - DNA, 14 bp, Homo sapiens
ttgagactagtttt

SEQ ID NO: 4909739 - DNA, 21 bp, Homo sapiens
ttgagatgctgtaggtggtat

SEQ ID NO: 4909740 - DNA, 18 bp, Homo sapiens
ttgagatggggataaaat

SEQ ID NO: 4909741 - DNA, 13 bp, Homo sapiens
ttgagatgtatga

SEQ ID NO: 4909742 - DNA, 15 bp, Homo sapiens
ttgagattgccccag

SEQ ID NO: 4909743 - DNA, 17 bp, Homo sapiens
ttgagattgccccaggt

SEQ ID NO: 4909744 - DNA, 16 bp, Homo sapiens
ttgagcagggctcagc

SEQ ID NO: 4909745 - DNA, 20 bp, Homo sapiens
ttgagcgtgaatctgtatct

SEQ ID NO: 4909746 - DNA, 15 bp, Homo sapiens
ttgagctattgctgt

SEQ ID NO: 4909747 - DNA, 12 bp, Homo sapiens
ttgagctggcct

SEQ ID NO: 4909748 - DNA, 16 bp, Homo sapiens
ttgaggagcatgtttt

SEQ ID NO: 4909749 - DNA, 16 bp, Homo sapiens
ttgaggagccccagct

SEQ ID NO: 4909750 - DNA, 13 bp, Homo sapiens
ttgaggccaggag

SEQ ID NO: 4909751 - DNA, 21 bp, Homo sapiens
ttgagggacgctttgtctgtc

SEQ ID NO: 4909752 - DNA, 16 bp, Homo sapiens
ttgagggttgggctgg

SEQ ID NO: 4909753 - DNA, 21 bp, Homo sapiens
ttgaggtagaccaggatttct

SEQ ID NO: 4909754 - DNA, 16 bp, Homo sapiens
ttgagtagatattact

SEQ ID NO: 4909755 - DNA, 12 bp, Homo sapiens
ttgagtgtgtgt

SEQ ID NO: 4909756 - DNA, 20 bp, Homo sapiens
ttgagtttgtaggtaaaatg

SEQ ID NO: 4909757 - DNA, 17 bp, Homo sapiens
ttgataataaattgaaa

SEQ ID NO: 4909758 - DNA, 15 bp, Homo sapiens
ttgataatgctttca

SEQ ID NO: 4909759 - DNA, 15 bp, Homo sapiens
ttgataatgttaaat

SEQ ID NO: 4909760 - DNA, 20 bp, Homo sapiens
ttgataatgttaaatttgta

SEQ ID NO: 4909761 - DNA, 21 bp, Homo sapiens
ttgataatgttaaatttgtaa

SEQ ID NO: 4909762 - DNA, 13 bp, Homo sapiens
ttgatacataata

SEQ ID NO: 4909763 - DNA, 15 bp, Homo sapiens
ttgatacccccctct

SEQ ID NO: 4909764 - DNA, 15 bp, Homo sapiens
ttgatactctttcta

SEQ ID NO: 4909765 - DNA, 16 bp, Homo sapiens
ttgatacttatatttt

SEQ ID NO: 4909766 - DNA, 18 bp, Homo sapiens
ttgatcattttcccccca

SEQ ID NO: 4909767 - DNA, 19 bp, Homo sapiens
ttgatcattttccccccac

SEQ ID NO: 4909768 - DNA, 18 bp, Homo sapiens
ttgatgaagcaaggaaga

SEQ ID NO: 4909769 - DNA, 21 bp, Homo sapiens
ttgatgaagcaaggaagatat

SEQ ID NO: 4909770 - DNA, 11 bp, Homo sapiens
ttgatgcatgt

SEQ ID NO: 4909771 - DNA, 13 bp, Homo sapiens
ttgatgtatctga

SEQ ID NO: 4909772 - DNA, 14 bp, Homo sapiens
ttgatgtgacaata

SEQ ID NO: 4909773 - DNA, 14 bp, Homo sapiens
ttgatgttacagat

SEQ ID NO: 4909774 - DNA, 15 bp, Homo sapiens
ttgatgtttgtggcc

SEQ ID NO: 4909775 - DNA, 17 bp, Homo sapiens
ttgatgtttgtggcctc

SEQ ID NO: 4909776 - DNA, 18 bp, Homo sapiens
ttgattaagattttacaa

SEQ ID NO: 4909777 - DNA, 20 bp, Homo sapiens
ttgattaagattttacaaaa

SEQ ID NO: 4909778 - DNA, 14 bp, Homo sapiens
ttgattcagcctgt

SEQ ID NO: 4909779 - DNA, 19 bp, Homo sapiens
ttgattcatagtaacttct

SEQ ID NO: 4909780 - DNA, 12 bp, Homo sapiens
ttgattctgcag

SEQ ID NO: 4909781 - DNA, 19 bp, Homo sapiens
ttgattgactgcccattca

SEQ ID NO: 4909782 - DNA, 18 bp, Homo sapiens
ttgatttaaacacacaga

SEQ ID NO: 4909783 - DNA, 22 bp, Homo sapiens
ttgatttacagcaagtagataa

SEQ ID NO: 4909784 - DNA, 15 bp, Homo sapiens
ttgatttgcattgaa

SEQ ID NO: 4909785 - DNA, 19 bp, Homo sapiens
ttgatttgcattgaacaca

SEQ ID NO: 4909786 - DNA, 16 bp, Homo sapiens
ttgatttttactgtgt

SEQ ID NO: 4909787 - DNA, 12 bp, Homo sapiens
ttgcaaatcttg

SEQ ID NO: 4909788 - DNA, 16 bp, Homo sapiens
ttgcaaatcttgaaat

SEQ ID NO: 4909789 - DNA, 17 bp, Homo sapiens
ttgcaacaggctgggct

SEQ ID NO: 4909790 - DNA, 15 bp, Homo sapiens
ttgcaataccaagta

SEQ ID NO: 4909791 - DNA, 17 bp, Homo sapiens
ttgcacctacctcacag

SEQ ID NO: 4909792 - DNA, 17 bp, Homo sapiens
ttgcacgacgccctctc

SEQ ID NO: 4909793 - DNA, 19 bp, Homo sapiens
ttgcacgacgccctctccc

SEQ ID NO: 4909794 - DNA, 21 bp, Homo sapiens
ttgcagctttatgttcatttg

SEQ ID NO: 4909795 - DNA, 12 bp, Homo sapiens
ttgcagggcagc

SEQ ID NO: 4909796 - DNA, 13 bp, Homo sapiens
ttgcagggcagcc

SEQ ID NO: 4909797 - DNA, 21 bp, Homo sapiens
ttgcagggcagccccacaact

SEQ ID NO: 4909798 - DNA, 19 bp, Homo sapiens
ttgcaggtggaactcagtc

SEQ ID NO: 4909799 - DNA, 16 bp, Homo sapiens
ttgcagttcagcacca

SEQ ID NO: 4909800 - DNA, 14 bp, Homo sapiens
ttgcataaagcata

SEQ ID NO: 4909801 - DNA, 16 bp, Homo sapiens
ttgcatatgagccgtg

SEQ ID NO: 4909802 - DNA, 15 bp, Homo sapiens
ttgcatcagtattaa

SEQ ID NO: 4909803 - DNA, 23 bp, Homo sapiens
ttgcatcagtattaatactaaaa

SEQ ID NO: 4909804 - DNA, 18 bp, Homo sapiens
ttgcatctcaaaattatt

SEQ ID NO: 4909805 - DNA, 14 bp, Homo sapiens
ttgcatctgaaata

SEQ ID NO: 4909806 - DNA, 18 bp, Homo sapiens
ttgcatgaagagaagcaa

SEQ ID NO: 4909807 - DNA, 19 bp, Homo sapiens
ttgcatggctccagaaatg

SEQ ID NO: 4909808 - DNA, 20 bp, Homo sapiens
ttgcatggctccagaaatgt

SEQ ID NO: 4909809 - DNA, 13 bp, Homo sapiens
ttgcatgtttgaa

SEQ ID NO: 4909810 - DNA, 13 bp, Homo sapiens
ttgcattaaattc

SEQ ID NO: 4909811 - DNA, 20 bp, Homo sapiens
ttgcattaaattcacaaact

SEQ ID NO: 4909812 - DNA, 16 bp, Homo sapiens
ttgcattattcattta

SEQ ID NO: 4909813 - DNA, 17 bp, Homo sapiens
ttgcattcctttgtctt

SEQ ID NO: 4909814 - DNA, 18 bp, Homo sapiens
ttgcattctattgccttc

SEQ ID NO: 4909815 - DNA, 18 bp, Homo sapiens
ttgcattgaacacaaact

SEQ ID NO: 4909816 - DNA, 15 bp, Homo sapiens
ttgcatttatatgta

SEQ ID NO: 4909817 - DNA, 12 bp, Homo sapiens
ttgccaagacaa

SEQ ID NO: 4909818 - DNA, 15 bp, Homo sapiens
ttgccaagacaaatc

SEQ ID NO: 4909819 - DNA, 18 bp, Homo sapiens
ttgccaccacctctgtgg

SEQ ID NO: 4909820 - DNA, 15 bp, Homo sapiens
ttgccaccaggagaa

SEQ ID NO: 4909821 - DNA, 16 bp, Homo sapiens
ttgccaccaggagaac

SEQ ID NO: 4909822 - DNA, 12 bp, Homo sapiens
ttgccaccccac

SEQ ID NO: 4909823 - DNA, 19 bp, Homo sapiens
ttgccaccccaccctccct

SEQ ID NO: 4909824 - DNA, 21 bp, Homo sapiens
ttgccaccccaccctccctgg

SEQ ID NO: 4909825 - DNA, 21 bp, Homo sapiens
ttgccatcctaaaagccaccc

SEQ ID NO: 4909826 - DNA, 22 bp, Homo sapiens
ttgccatgggcttcactgtata

SEQ ID NO: 4909827 - DNA, 14 bp, Homo sapiens
ttgccatgtgtttt

SEQ ID NO: 4909828 - DNA, 20 bp, Homo sapiens
ttgccatgttggccaggctg

SEQ ID NO: 4909829 - DNA, 16 bp, Homo sapiens
ttgcccaggcaggtct

SEQ ID NO: 4909830 - DNA, 11 bp, Homo sapiens
ttgcccaggct

SEQ ID NO: 4909831 - DNA, 20 bp, Homo sapiens
ttgccctttctgtaccattt

SEQ ID NO: 4909832 - DNA, 20 bp, Homo sapiens
ttgcctaagcattgcctggc

SEQ ID NO: 4909833 - DNA, 14 bp, Homo sapiens
ttgcctaagtatta

SEQ ID NO: 4909834 - DNA, 21 bp, Homo sapiens
ttgcctcctgtgtactgtgtc

SEQ ID NO: 4909835 - DNA, 16 bp, Homo sapiens
ttgccttaaagaaagt

SEQ ID NO: 4909836 - DNA, 17 bp, Homo sapiens
ttgccttctttgaagaa

SEQ ID NO: 4909837 - DNA, 22 bp, Homo sapiens
ttgcctttttcattttccaata

SEQ ID NO: 4909838 - DNA, 17 bp, Homo sapiens
ttgctaattttctcaaa

SEQ ID NO: 4909839 - DNA, 21 bp, Homo sapiens
ttgctaccctgagttcatcca

SEQ ID NO: 4909840 - DNA, 23 bp, Homo sapiens
ttgctagcagtaaaagatgaagt

SEQ ID NO: 4909841 - DNA, 23 bp, Homo sapiens
ttgctatctggaggccttccagc

SEQ ID NO: 4909842 - DNA, 15 bp, Homo sapiens
ttgctcccttcagcc

SEQ ID NO: 4909843 - DNA, 17 bp, Homo sapiens
ttgctcccttcagcccc

SEQ ID NO: 4909844 - DNA, 22 bp, Homo sapiens
ttgctcgggtcccttcacctcc

SEQ ID NO: 4909845 - DNA, 16 bp, Homo sapiens
ttgctctatctctcaa

SEQ ID NO: 4909846 - DNA, 21 bp, Homo sapiens
ttgctctcccctgccctgctg

SEQ ID NO: 4909847 - DNA, 19 bp, Homo sapiens
ttgctgattttaatggatt

SEQ ID NO: 4909848 - DNA, 16 bp, Homo sapiens
ttgctgctagaacttt

SEQ ID NO: 4909849 - DNA, 23 bp, Homo sapiens
ttgctgctagaacttttttaaat

SEQ ID NO: 4909850 - DNA, 21 bp, Homo sapiens
ttgctggacggggactgggga

SEQ ID NO: 4909851 - DNA, 23 bp, Homo sapiens
ttgctggactgtcatagaaatta

SEQ ID NO: 4909852 - DNA, 16 bp, Homo sapiens
ttgctgtcctgatctg

SEQ ID NO: 4909853 - DNA, 15 bp, Homo sapiens
ttgctgtctctgctc

SEQ ID NO: 4909854 - DNA, 16 bp, Homo sapiens
ttgctgtctctgctcg

SEQ ID NO: 4909855 - DNA, 14 bp, Homo sapiens
ttgctgttgcttga

SEQ ID NO: 4909856 - DNA, 13 bp, Homo sapiens
ttgctgttttgat

SEQ ID NO: 4909857 - DNA, 13 bp, Homo sapiens
ttgcttatttaat

SEQ ID NO: 4909858 - DNA, 16 bp, Homo sapiens
ttgcttatttaataaa

SEQ ID NO: 4909859 - DNA, 17 bp, Homo sapiens
ttgcttcataaatgaag

SEQ ID NO: 4909860 - DNA, 14 bp, Homo sapiens
ttgcttgagcccag

SEQ ID NO: 4909861 - DNA, 17 bp, Homo sapiens
ttgcttgagcccaggag

SEQ ID NO: 4909862 - DNA, 15 bp, Homo sapiens
ttgcttgtacctctg

SEQ ID NO: 4909863 - DNA, 21 bp, Homo sapiens
ttgcttgttatattaagcaga

SEQ ID NO: 4909864 - DNA, 15 bp, Homo sapiens
ttgctttcttttctc

SEQ ID NO: 4909865 - DNA, 14 bp, Homo sapiens
ttgctttgaagcag

SEQ ID NO: 4909866 - DNA, 19 bp, Homo sapiens
ttgctttgatttacagcaa

SEQ ID NO: 4909867 - DNA, 12 bp, Homo sapiens
ttgcttttaatt

SEQ ID NO: 4909868 - DNA, 17 bp, Homo sapiens
ttgcttttattttgaaa

SEQ ID NO: 4909869 - DNA, 21 bp, Homo sapiens
ttgcttttccctcttttctta

SEQ ID NO: 4909870 - DNA, 19 bp, Homo sapiens
ttgctttttcacagtcact

SEQ ID NO: 4909871 - DNA, 15 bp, Homo sapiens
ttgcttttttaaata

SEQ ID NO: 4909872 - DNA, 24 bp, Homo sapiens
ttggaaatcctagtttcctctcct

SEQ ID NO: 4909873 - DNA, 19 bp, Homo sapiens
ttggaagaaaaaaatcttc

SEQ ID NO: 4909874 - DNA, 13 bp, Homo sapiens
ttggaagagaaag

SEQ ID NO: 4909875 - DNA, 13 bp, Homo sapiens
ttggaagagaatc

SEQ ID NO: 4909876 - DNA, 15 bp, Homo sapiens
ttggaagattcagct

SEQ ID NO: 4909877 - DNA, 15 bp, Homo sapiens
ttggaagtacatgaa

SEQ ID NO: 4909878 - DNA, 15 bp, Homo sapiens
ttggaattgtcttta

SEQ ID NO: 4909879 - DNA, 13 bp, Homo sapiens
ttggaatttacca

SEQ ID NO: 4909880 - DNA, 17 bp, Homo sapiens
ttggacatagatatttt

SEQ ID NO: 4909881 - DNA, 23 bp, Homo sapiens
ttggacatagatattttcacaat

SEQ ID NO: 4909882 - DNA, 14 bp, Homo sapiens
ttggaccccagaga

SEQ ID NO: 4909883 - DNA, 13 bp, Homo sapiens
ttggacggcctga

SEQ ID NO: 4909884 - DNA, 14 bp, Homo sapiens
ttggagaaattatt

SEQ ID NO: 4909885 - DNA, 15 bp, Homo sapiens
ttggagaaattattt

SEQ ID NO: 4909886 - DNA, 18 bp, Homo sapiens
ttggagacacaactattt

SEQ ID NO: 4909887 - DNA, 22 bp, Homo sapiens
ttggagaccctgcaaacagaac

SEQ ID NO: 4909888 - DNA, 15 bp, Homo sapiens
ttggagagacacagc

SEQ ID NO: 4909889 - DNA, 17 bp, Homo sapiens
ttggatcttgaatgtgg

SEQ ID NO: 4909890 - DNA, 15 bp, Homo sapiens
ttggattatcctgag

SEQ ID NO: 4909891 - DNA, 14 bp, Homo sapiens
ttggattatttaat

SEQ ID NO: 4909892 - DNA, 19 bp, Homo sapiens
ttggattatttaataacat

SEQ ID NO: 4909893 - DNA, 21 bp, Homo sapiens
ttggattatttaataacatta

SEQ ID NO: 4909894 - DNA, 14 bp, Homo sapiens
ttggattgtatatt

SEQ ID NO: 4909895 - DNA, 17 bp, Homo sapiens
ttggcaaaagccttgtg

SEQ ID NO: 4909896 - DNA, 20 bp, Homo sapiens
ttggcaaaagccttgtgtat

SEQ ID NO: 4909897 - DNA, 23 bp, Homo sapiens
ttggcagtgagtgagcctggctc

SEQ ID NO: 4909898 - DNA, 14 bp, Homo sapiens
ttggcagtttggta

SEQ ID NO: 4909899 - DNA, 14 bp, Homo sapiens
ttggcatggcttta

SEQ ID NO: 4909900 - DNA, 14 bp, Homo sapiens
ttggccaggctggt

SEQ ID NO: 4909901 - DNA, 22 bp, Homo sapiens
ttggctaggacccctccatgtg

SEQ ID NO: 4909902 - DNA, 17 bp, Homo sapiens
ttggctcaataaagatt

SEQ ID NO: 4909903 - DNA, 13 bp, Homo sapiens
ttggctcaatcct

SEQ ID NO: 4909904 - DNA, 14 bp, Homo sapiens
ttggctcaatcctc

SEQ ID NO: 4909905 - DNA, 21 bp, Homo sapiens
ttggctggatgaaattttcta

SEQ ID NO: 4909906 - DNA, 22 bp, Homo sapiens
ttgggaaccaagctattccttt

SEQ ID NO: 4909907 - DNA, 19 bp, Homo sapiens
ttgggaatatccatgtact

SEQ ID NO: 4909908 - DNA, 15 bp, Homo sapiens
ttgggagagcccctg

SEQ ID NO: 4909909 - DNA, 16 bp, Homo sapiens
ttgggagagcccctgg

SEQ ID NO: 4909910 - DNA, 19 bp, Homo sapiens
ttgggagggaaaagggaag

SEQ ID NO: 4909911 - DNA, 18 bp, Homo sapiens
ttgggagtccaggcacag

SEQ ID NO: 4909912 - DNA, 16 bp, Homo sapiens
ttgggatactgcaggg

SEQ ID NO: 4909913 - DNA, 19 bp, Homo sapiens
ttgggcagcaatttaaatg

SEQ ID NO: 4909914 - DNA, 22 bp, Homo sapiens
ttgggccaaatccgctctcttc

SEQ ID NO: 4909915 - DNA, 23 bp, Homo sapiens
ttggggccaccaaagctgcccac

SEQ ID NO: 4909916 - DNA, 19 bp, Homo sapiens
ttgggggacgtttctcatt

SEQ ID NO: 4909917 - DNA, 22 bp, Homo sapiens
ttgggggtcaggcagccagtga

SEQ ID NO: 4909918 - DNA, 14 bp, Homo sapiens
ttggggtctgaccc

SEQ ID NO: 4909919 - DNA, 21 bp, Homo sapiens
ttggggtgtctttttttggtg

SEQ ID NO: 4909920 - DNA, 19 bp, Homo sapiens
ttgggtcacccctccagga

SEQ ID NO: 4909921 - DNA, 16 bp, Homo sapiens
ttgggtggatgcctgg

SEQ ID NO: 4909922 - DNA, 19 bp, Homo sapiens
ttggtaacacaaattttca

SEQ ID NO: 4909923 - DNA, 13 bp, Homo sapiens
ttggtagattaaa

SEQ ID NO: 4909924 - DNA, 18 bp, Homo sapiens
ttggtagattaaatatag

SEQ ID NO: 4909925 - DNA, 15 bp, Homo sapiens
ttggtccaagattcc

SEQ ID NO: 4909926 - DNA, 14 bp, Homo sapiens
ttggtctttgtatc

SEQ ID NO: 4909927 - DNA, 15 bp, Homo sapiens
ttggtgcatagaact

SEQ ID NO: 4909928 - DNA, 16 bp, Homo sapiens
ttggtgcatagaactg

SEQ ID NO: 4909929 - DNA, 20 bp, Homo sapiens
ttggtgcctggcctggcaca

SEQ ID NO: 4909930 - DNA, 19 bp, Homo sapiens
ttggtgtgttggacagaga

SEQ ID NO: 4909931 - DNA, 15 bp, Homo sapiens
ttggttaaaactgta

SEQ ID NO: 4909932 - DNA, 15 bp, Homo sapiens
ttggttcctctctgg

SEQ ID NO: 4909933 - DNA, 13 bp, Homo sapiens
ttggttctaagga

SEQ ID NO: 4909934 - DNA, 21 bp, Homo sapiens
ttggtttacatttaaagcatt

SEQ ID NO: 4909935 - DNA, 13 bp, Homo sapiens
ttggtttactttc

SEQ ID NO: 4909936 - DNA, 16 bp, Homo sapiens
ttggtttactttcaaa

SEQ ID NO: 4909937 - DNA, 22 bp, Homo sapiens
ttgtaaaaattaaaagttatgg

SEQ ID NO: 4909938 - DNA, 20 bp, Homo sapiens
ttgtaaaacctgtcaatgat

SEQ ID NO: 4909939 - DNA, 16 bp, Homo sapiens
ttgtaaacaaactctt

SEQ ID NO: 4909940 - DNA, 14 bp, Homo sapiens
ttgtaaacatgtgt

SEQ ID NO: 4909941 - DNA, 15 bp, Homo sapiens
ttgtaaacatgtgtt

SEQ ID NO: 4909942 - DNA, 20 bp, Homo sapiens
ttgtaaagaaatttactata

SEQ ID NO: 4909943 - DNA, 21 bp, Homo sapiens
ttgtaaattaaacataaaaca

SEQ ID NO: 4909944 - DNA, 18 bp, Homo sapiens
ttgtaacttatattgaag

SEQ ID NO: 4909945 - DNA, 17 bp, Homo sapiens
ttgtaacttatgtagat

SEQ ID NO: 4909946 - DNA, 19 bp, Homo sapiens
ttgtaagagtgtagaagca

SEQ ID NO: 4909947 - DNA, 21 bp, Homo sapiens
ttgtaagagtgtagaagcatt

SEQ ID NO: 4909948 - DNA, 21 bp, Homo sapiens
ttgtaagtgctacataaattg

SEQ ID NO: 4909949 - DNA, 14 bp, Homo sapiens
ttgtaatattttta

SEQ ID NO: 4909950 - DNA, 17 bp, Homo sapiens
ttgtaatgtgtgaaaaa

SEQ ID NO: 4909951 - DNA, 16 bp, Homo sapiens
ttgtaattcttcagtt

SEQ ID NO: 4909952 - DNA, 11 bp, Homo sapiens
ttgtacataaa

SEQ ID NO: 4909953 - DNA, 16 bp, Homo sapiens
ttgtagaattgttata

SEQ ID NO: 4909954 - DNA, 19 bp, Homo sapiens
ttgtagcagattgtttcct

SEQ ID NO: 4909955 - DNA, 22 bp, Homo sapiens
ttgtagcagattgtttcctctt

SEQ ID NO: 4909956 - DNA, 19 bp, Homo sapiens
ttgtaggggtcaaagaaat

SEQ ID NO: 4909957 - DNA, 15 bp, Homo sapiens
ttgtaggtaaaatgt

SEQ ID NO: 4909958 - DNA, 13 bp, Homo sapiens
ttgtagtttacct

SEQ ID NO: 4909959 - DNA, 12 bp, Homo sapiens
ttgtataatttc

SEQ ID NO: 4909960 - DNA, 14 bp, Homo sapiens
ttgtataatttcga

SEQ ID NO: 4909961 - DNA, 19 bp, Homo sapiens
ttgtatacatcctgggtaa

SEQ ID NO: 4909962 - DNA, 15 bp, Homo sapiens
ttgtatactttaaat

SEQ ID NO: 4909963 - DNA, 19 bp, Homo sapiens
ttgtatactttaaataatt

SEQ ID NO: 4909964 - DNA, 14 bp, Homo sapiens
ttgtatagtgtaaa

SEQ ID NO: 4909965 - DNA, 20 bp, Homo sapiens
ttgtatattacacatttgta

SEQ ID NO: 4909966 - DNA, 21 bp, Homo sapiens
ttgtatctctgaagcatgttt

SEQ ID NO: 4909967 - DNA, 22 bp, Homo sapiens
ttgtatgaaagatggctgtgcc

SEQ ID NO: 4909968 - DNA, 13 bp, Homo sapiens
ttgtatgatgtgt

SEQ ID NO: 4909969 - DNA, 14 bp, Homo sapiens
ttgtatgatgtgtt

SEQ ID NO: 4909970 - DNA, 16 bp, Homo sapiens
ttgtatgatgtgttgt

SEQ ID NO: 4909971 - DNA, 18 bp, Homo sapiens
ttgtatgatgtgttgtga

SEQ ID NO: 4909972 - DNA, 15 bp, Homo sapiens
ttgtatgcaatggat

SEQ ID NO: 4909973 - DNA, 13 bp, Homo sapiens
ttgtattacagat

SEQ ID NO: 4909974 - DNA, 14 bp, Homo sapiens
ttgtattacagatg

SEQ ID NO: 4909975 - DNA, 19 bp, Homo sapiens
ttgtattattgctgttgct

SEQ ID NO: 4909976 - DNA, 22 bp, Homo sapiens
ttgtattattgctgttgcttga

SEQ ID NO: 4909977 - DNA, 17 bp, Homo sapiens
ttgtcacacactttggc

SEQ ID NO: 4909978 - DNA, 16 bp, Homo sapiens
ttgtcactgacacaaa

SEQ ID NO: 4909979 - DNA, 13 bp, Homo sapiens
ttgtcagacataa

SEQ ID NO: 4909980 - DNA, 16 bp, Homo sapiens
ttgtcagacataaagc

SEQ ID NO: 4909981 - DNA, 21 bp, Homo sapiens
ttgtcatatcagcacatattt

SEQ ID NO: 4909982 - DNA, 23 bp, Homo sapiens
ttgtcatatcagcacatattttc

SEQ ID NO: 4909983 - DNA, 12 bp, Homo sapiens
ttgtcatggtta

SEQ ID NO: 4909984 - DNA, 18 bp, Homo sapiens
ttgtcatggttacaaact

SEQ ID NO: 4909985 - DNA, 22 bp, Homo sapiens
ttgtcattgtaaacaaactctt

SEQ ID NO: 4909986 - DNA, 22 bp, Homo sapiens
ttgtccaattgttgacagttct

SEQ ID NO: 4909987 - DNA, 16 bp, Homo sapiens
ttgtccatattttcac

SEQ ID NO: 4909988 - DNA, 15 bp, Homo sapiens
ttgtccatttgtaaa

SEQ ID NO: 4909989 - DNA, 17 bp, Homo sapiens
ttgtcctcagtccattt

SEQ ID NO: 4909990 - DNA, 16 bp, Homo sapiens
ttgtccttttgtcttc

SEQ ID NO: 4909991 - DNA, 16 bp, Homo sapiens
ttgtctattttaaaat

SEQ ID NO: 4909992 - DNA, 15 bp, Homo sapiens
ttgtctcagttggaa

SEQ ID NO: 4909993 - DNA, 18 bp, Homo sapiens
ttgtctcattttaatgta

SEQ ID NO: 4909994 - DNA, 19 bp, Homo sapiens
ttgtctctatgccagctca

SEQ ID NO: 4909995 - DNA, 16 bp, Homo sapiens
ttgtctctccttttct

SEQ ID NO: 4909996 - DNA, 19 bp, Homo sapiens
ttgtcttttaatgcttcat

SEQ ID NO: 4909997 - DNA, 13 bp, Homo sapiens
ttgtgaactcatt

SEQ ID NO: 4909998 - DNA, 22 bp, Homo sapiens
ttgtgaatgattcatgttatat

SEQ ID NO: 4909999 - DNA, 15 bp, Homo sapiens
ttgtgaatgcttctc

SEQ ID NO: 4910000 - DNA, 14 bp, Homo sapiens
ttgtgaatggattg

SEQ ID NO: 4910001 - DNA, 15 bp, Homo sapiens
ttgtgactatataga

SEQ ID NO: 4910002 - DNA, 18 bp, Homo sapiens
ttgtgagccaccacgtcc

SEQ ID NO: 4910003 - DNA, 13 bp, Homo sapiens
ttgtgataattta

SEQ ID NO: 4910004 - DNA, 14 bp, Homo sapiens
ttgtgctgatgaga

SEQ ID NO: 4910005 - DNA, 12 bp, Homo sapiens
ttgtgctgccat

SEQ ID NO: 4910006 - DNA, 18 bp, Homo sapiens
ttgtgctggatggagccc

SEQ ID NO: 4910007 - DNA, 16 bp, Homo sapiens
ttgtgcttcacagtag

SEQ ID NO: 4910008 - DNA, 12 bp, Homo sapiens
ttgtgcttctcc

SEQ ID NO: 4910009 - DNA, 14 bp, Homo sapiens
ttgtgcttctcccc

SEQ ID NO: 4910010 - DNA, 17 bp, Homo sapiens
ttgtgcttctccccaga

SEQ ID NO: 4910011 - DNA, 14 bp, Homo sapiens
ttgtgcttttcctg

SEQ ID NO: 4910012 - DNA, 21 bp, Homo sapiens
ttgtggaaaatgaaaattagg

SEQ ID NO: 4910013 - DNA, 21 bp, Homo sapiens
ttgtggaattgggagcttggg

SEQ ID NO: 4910014 - DNA, 18 bp, Homo sapiens
ttgtggatataaaatgtg

SEQ ID NO: 4910015 - DNA, 11 bp, Homo sapiens
ttgtggcagag

SEQ ID NO: 4910016 - DNA, 13 bp, Homo sapiens
ttgtggcctcaga

SEQ ID NO: 4910017 - DNA, 18 bp, Homo sapiens
ttgtgggcataaactgtt

SEQ ID NO: 4910018 - DNA, 20 bp, Homo sapiens
ttgtggggacccaggctccg

SEQ ID NO: 4910019 - DNA, 22 bp, Homo sapiens
ttgtggtaggccttttaacatt

SEQ ID NO: 4910020 - DNA, 16 bp, Homo sapiens
ttgtggttttatggag

SEQ ID NO: 4910021 - DNA, 15 bp, Homo sapiens
ttgtgtatatttgta

SEQ ID NO: 4910022 - DNA, 16 bp, Homo sapiens
ttgtgtatatttgtat

SEQ ID NO: 4910023 - DNA, 19 bp, Homo sapiens
ttgtgtatttacgctttga

SEQ ID NO: 4910024 - DNA, 21 bp, Homo sapiens
ttgtgtcaatgggcaatgaca

SEQ ID NO: 4910025 - DNA, 17 bp, Homo sapiens
ttgtgtgaccaactgtg

SEQ ID NO: 4910026 - DNA, 18 bp, Homo sapiens
ttgtgtgaccaactgtgt

SEQ ID NO: 4910027 - DNA, 19 bp, Homo sapiens
ttgtgtgaccaactgtgtt

SEQ ID NO: 4910028 - DNA, 23 bp, Homo sapiens
ttgtgtgaccaactgtgttgtat

SEQ ID NO: 4910029 - DNA, 13 bp, Homo sapiens
ttgtgttcacctt

SEQ ID NO: 4910030 - DNA, 16 bp, Homo sapiens
ttgtgttcctttttat

SEQ ID NO: 4910031 - DNA, 12 bp, Homo sapiens
ttgtgttgacat

SEQ ID NO: 4910032 - DNA, 13 bp, Homo sapiens
ttgtgttgacatt

SEQ ID NO: 4910033 - DNA, 13 bp, Homo sapiens
ttgtgttgtaatt

SEQ ID NO: 4910034 - DNA, 19 bp, Homo sapiens
ttgtgtttggtttacattt

SEQ ID NO: 4910035 - DNA, 18 bp, Homo sapiens
ttgttactgttcttgctg

SEQ ID NO: 4910036 - DNA, 22 bp, Homo sapiens
ttgttactgttcttgctgctag

SEQ ID NO: 4910037 - DNA, 24 bp, Homo sapiens
ttgttactgttcttgctgctagaa

SEQ ID NO: 4910038 - DNA, 22 bp, Homo sapiens
ttgttagaaaacaaaattttat

SEQ ID NO: 4910039 - DNA, 13 bp, Homo sapiens
ttgttatcagtaa

SEQ ID NO: 4910040 - DNA, 14 bp, Homo sapiens
ttgttatgctatta

SEQ ID NO: 4910041 - DNA, 11 bp, Homo sapiens
ttgttattgtg

SEQ ID NO: 4910042 - DNA, 12 bp, Homo sapiens
ttgttattgtga

SEQ ID NO: 4910043 - DNA, 14 bp, Homo sapiens
ttgttcaaacaata

SEQ ID NO: 4910044 - DNA, 17 bp, Homo sapiens
ttgttcaaacaatatca

SEQ ID NO: 4910045 - DNA, 13 bp, Homo sapiens
ttgttcatgtttg

SEQ ID NO: 4910046 - DNA, 12 bp, Homo sapiens
ttgttccagctc

SEQ ID NO: 4910047 - DNA, 18 bp, Homo sapiens
ttgttgaaattttgcaaa

SEQ ID NO: 4910048 - DNA, 16 bp, Homo sapiens
ttgttgacaaaatttt

SEQ ID NO: 4910049 - DNA, 18 bp, Homo sapiens
ttgttgagctattgctgt

SEQ ID NO: 4910050 - DNA, 14 bp, Homo sapiens
ttgttgcaaaggtc

SEQ ID NO: 4910051 - DNA, 13 bp, Homo sapiens
ttgttgtaaaaag

SEQ ID NO: 4910052 - DNA, 16 bp, Homo sapiens
ttgttgtaaaaagaaa

SEQ ID NO: 4910053 - DNA, 20 bp, Homo sapiens
ttgtttaatgtgaacttgta

SEQ ID NO: 4910054 - DNA, 19 bp, Homo sapiens
ttgtttatcagatacatca

SEQ ID NO: 4910055 - DNA, 21 bp, Homo sapiens
ttgtttatcagatacatcact

SEQ ID NO: 4910056 - DNA, 13 bp, Homo sapiens
ttgtttattgagt

SEQ ID NO: 4910057 - DNA, 16 bp, Homo sapiens
ttgtttcctcttccaa

SEQ ID NO: 4910058 - DNA, 17 bp, Homo sapiens
ttgtttctctgttgtaa

SEQ ID NO: 4910059 - DNA, 17 bp, Homo sapiens
ttgtttcttgtttattg

SEQ ID NO: 4910060 - DNA, 18 bp, Homo sapiens
ttgtttggatgtaattta

SEQ ID NO: 4910061 - DNA, 14 bp, Homo sapiens
ttgtttggcttcct

SEQ ID NO: 4910062 - DNA, 15 bp, Homo sapiens
ttgtttgtctgtttg

SEQ ID NO: 4910063 - DNA, 12 bp, Homo sapiens
ttgtttgtttct

SEQ ID NO: 4910064 - DNA, 13 bp, Homo sapiens
ttgtttgtttctt

SEQ ID NO: 4910065 - DNA, 14 bp, Homo sapiens
ttgttttaatctga

SEQ ID NO: 4910066 - DNA, 14 bp, Homo sapiens
ttgttttgcacttt

SEQ ID NO: 4910067 - DNA, 18 bp, Homo sapiens
ttgttttttttttccact

SEQ ID NO: 4910068 - DNA, 15 bp, Homo sapiens
tttaaaaaaagaaaa

SEQ ID NO: 4910069 - DNA, 16 bp, Homo sapiens
tttaaaaaaatttaag

SEQ ID NO: 4910070 - DNA, 17 bp, Homo sapiens
tttaaaaaaatttaagt

SEQ ID NO: 4910071 - DNA, 19 bp, Homo sapiens
tttaaaaacatagaaaaat

SEQ ID NO: 4910072 - DNA, 17 bp, Homo sapiens
tttaaaaagaaatctgg

SEQ ID NO: 4910073 - DNA, 17 bp, Homo sapiens
tttaaaaatacacttgt

SEQ ID NO: 4910074 - DNA, 13 bp, Homo sapiens
tttaaaacacatg

SEQ ID NO: 4910075 - DNA, 19 bp, Homo sapiens
tttaaaaggtattttgaat

SEQ ID NO: 4910076 - DNA, 17 bp, Homo sapiens
tttaaaagtttcaatgt

SEQ ID NO: 4910077 - DNA, 15 bp, Homo sapiens
tttaaacaaacattg

SEQ ID NO: 4910078 - DNA, 18 bp, Homo sapiens
tttaaacaaacattgtgt

SEQ ID NO: 4910079 - DNA, 12 bp, Homo sapiens
tttaaacaaatt

SEQ ID NO: 4910080 - DNA, 14 bp, Homo sapiens
tttaaacacctcct

SEQ ID NO: 4910081 - DNA, 13 bp, Homo sapiens
tttaaacagcagt

SEQ ID NO: 4910082 - DNA, 15 bp, Homo sapiens
tttaaagagtctaga

SEQ ID NO: 4910083 - DNA, 20 bp, Homo sapiens
tttaaagcattgctgttatg

SEQ ID NO: 4910084 - DNA, 16 bp, Homo sapiens
tttaaagcttactctg

SEQ ID NO: 4910085 - DNA, 18 bp, Homo sapiens
tttaaagcttactctgtc

SEQ ID NO: 4910086 - DNA, 23 bp, Homo sapiens
tttaaaggcccagcccctagaaa

SEQ ID NO: 4910087 - DNA, 19 bp, Homo sapiens
tttaaagtgtttctgttat

SEQ ID NO: 4910088 - DNA, 20 bp, Homo sapiens
tttaaagtgtttctgttatt

SEQ ID NO: 4910089 - DNA, 23 bp, Homo sapiens
tttaaataaaagaaaaaatatct

SEQ ID NO: 4910090 - DNA, 20 bp, Homo sapiens
tttaaataaactttttttca

SEQ ID NO: 4910091 - DNA, 22 bp, Homo sapiens
tttaaataaactttttttcaat

SEQ ID NO: 4910092 - DNA, 21 bp, Homo sapiens
tttaaataatttaactaccct

SEQ ID NO: 4910093 - DNA, 18 bp, Homo sapiens
tttaaatataattctgta

SEQ ID NO: 4910094 - DNA, 15 bp, Homo sapiens
tttaaatgtatacta

SEQ ID NO: 4910095 - DNA, 23 bp, Homo sapiens
tttaaatgtgtacaatgtacaca

SEQ ID NO: 4910096 - DNA, 12 bp, Homo sapiens
tttaaattctga

SEQ ID NO: 4910097 - DNA, 23 bp, Homo sapiens
tttaacaatttcctttatattta

SEQ ID NO: 4910098 - DNA, 23 bp, Homo sapiens
tttaacatgaacacccttagaaa

SEQ ID NO: 4910099 - DNA, 13 bp, Homo sapiens
tttaacatttgcc

SEQ ID NO: 4910100 - DNA, 14 bp, Homo sapiens
tttaactaccctta

SEQ ID NO: 4910101 - DNA, 14 bp, Homo sapiens
tttaacttctttct

SEQ ID NO: 4910102 - DNA, 19 bp, Homo sapiens
tttaactttttttcttcta

SEQ ID NO: 4910103 - DNA, 22 bp, Homo sapiens
tttaagaaaaaataacacacat

SEQ ID NO: 4910104 - DNA, 23 bp, Homo sapiens
tttaagaaaagtattttgaagtt

SEQ ID NO: 4910105 - DNA, 22 bp, Homo sapiens
tttaagacagtcccatcaaaac

SEQ ID NO: 4910106 - DNA, 21 bp, Homo sapiens
tttaagagagaaatctgaaaa

SEQ ID NO: 4910107 - DNA, 12 bp, Homo sapiens
tttaagattttt

SEQ ID NO: 4910108 - DNA, 20 bp, Homo sapiens
tttaagcactcttaaagcaa

SEQ ID NO: 4910109 - DNA, 12 bp, Homo sapiens
tttaaggaaaca

SEQ ID NO: 4910110 - DNA, 18 bp, Homo sapiens
tttaagggcatgccttgt

SEQ ID NO: 4910111 - DNA, 20 bp, Homo sapiens
tttaagggcatgccttgtgc

SEQ ID NO: 4910112 - DNA, 16 bp, Homo sapiens
tttaagtaatgtggaa

SEQ ID NO: 4910113 - DNA, 23 bp, Homo sapiens
tttaagtaatgtggaagaaaatg

SEQ ID NO: 4910114 - DNA, 20 bp, Homo sapiens
tttaagtactacacattttt

SEQ ID NO: 4910115 - DNA, 20 bp, Homo sapiens
tttaagtcagtatggtctaa

SEQ ID NO: 4910116 - DNA, 20 bp, Homo sapiens
tttaagtgcgtgtgtagagt

SEQ ID NO: 4910117 - DNA, 20 bp, Homo sapiens
tttaataaactactctttga

SEQ ID NO: 4910118 - DNA, 21 bp, Homo sapiens
tttaataaactactctttgat

SEQ ID NO: 4910119 - DNA, 17 bp, Homo sapiens
tttaatacagtttattt

SEQ ID NO: 4910120 - DNA, 19 bp, Homo sapiens
tttaatagctatggaatca

SEQ ID NO: 4910121 - DNA, 17 bp, Homo sapiens
tttaatagtcattccaa

SEQ ID NO: 4910122 - DNA, 12 bp, Homo sapiens
tttaatatttaa

SEQ ID NO: 4910123 - DNA, 13 bp, Homo sapiens
tttaatatttaaa

SEQ ID NO: 4910124 - DNA, 18 bp, Homo sapiens
tttaatctgttatgtact

SEQ ID NO: 4910125 - DNA, 21 bp, Homo sapiens
tttaatgcattaaacctgtct

SEQ ID NO: 4910126 - DNA, 17 bp, Homo sapiens
tttaatgcttcattcaa

SEQ ID NO: 4910127 - DNA, 21 bp, Homo sapiens
tttaatggattgttaatttca

SEQ ID NO: 4910128 - DNA, 23 bp, Homo sapiens
tttaatggattgttaatttcagt

SEQ ID NO: 4910129 - DNA, 15 bp, Homo sapiens
tttaatgtaaagatt

SEQ ID NO: 4910130 - DNA, 16 bp, Homo sapiens
tttaatgtaaagattt

SEQ ID NO: 4910131 - DNA, 16 bp, Homo sapiens
tttaatgtgaacttgt

SEQ ID NO: 4910132 - DNA, 13 bp, Homo sapiens
tttaattaaataa

SEQ ID NO: 4910133 - DNA, 11 bp, Homo sapiens
tttaattatta

SEQ ID NO: 4910134 - DNA, 12 bp, Homo sapiens
tttaattgtcat

SEQ ID NO: 4910135 - DNA, 13 bp, Homo sapiens
tttaattgtcatg

SEQ ID NO: 4910136 - DNA, 16 bp, Homo sapiens
tttaattgttgtttct

SEQ ID NO: 4910137 - DNA, 23 bp, Homo sapiens
tttaattgttgtttctttctagt

SEQ ID NO: 4910138 - DNA, 13 bp, Homo sapiens
tttaatttcttca

SEQ ID NO: 4910139 - DNA, 21 bp, Homo sapiens
tttacaaaagaaataccttga

SEQ ID NO: 4910140 - DNA, 19 bp, Homo sapiens
tttacaagaagtttattct

SEQ ID NO: 4910141 - DNA, 21 bp, Homo sapiens
tttacaagtgtatatcagaaa

SEQ ID NO: 4910142 - DNA, 12 bp, Homo sapiens
tttacacagaaa

SEQ ID NO: 4910143 - DNA, 15 bp, Homo sapiens
tttacacagaaacac

SEQ ID NO: 4910144 - DNA, 20 bp, Homo sapiens
tttacacagaaacactgcct

SEQ ID NO: 4910145 - DNA, 16 bp, Homo sapiens
tttacagaaaaatctt

SEQ ID NO: 4910146 - DNA, 17 bp, Homo sapiens
tttacagaaaaatcttg

SEQ ID NO: 4910147 - DNA, 17 bp, Homo sapiens
tttacagatgaatgtat

SEQ ID NO: 4910148 - DNA, 13 bp, Homo sapiens
tttacagctgcct

SEQ ID NO: 4910149 - DNA, 15 bp, Homo sapiens
tttacagctgcctgc

SEQ ID NO: 4910150 - DNA, 16 bp, Homo sapiens
tttacagtccttcaaa

SEQ ID NO: 4910151 - DNA, 14 bp, Homo sapiens
tttacataactgcc

SEQ ID NO: 4910152 - DNA, 10 bp, Homo sapiens
tttacattta

SEQ ID NO: 4910153 - DNA, 16 bp, Homo sapiens
tttacatttaaagcat

SEQ ID NO: 4910154 - DNA, 13 bp, Homo sapiens
tttacatttttat

SEQ ID NO: 4910155 - DNA, 19 bp, Homo sapiens
tttaccagttaattactca

SEQ ID NO: 4910156 - DNA, 15 bp, Homo sapiens
tttaccatacattta

SEQ ID NO: 4910157 - DNA, 15 bp, Homo sapiens
tttacccatgaagat

SEQ ID NO: 4910158 - DNA, 21 bp, Homo sapiens
tttacctgtcacattgcattc

SEQ ID NO: 4910159 - DNA, 13 bp, Homo sapiens
tttacgctttgat

SEQ ID NO: 4910160 - DNA, 17 bp, Homo sapiens
tttactaccaatgccaa

SEQ ID NO: 4910161 - DNA, 14 bp, Homo sapiens
tttactatatatat

SEQ ID NO: 4910162 - DNA, 15 bp, Homo sapiens
tttactatatatata

SEQ ID NO: 4910163 - DNA, 17 bp, Homo sapiens
tttactcattgaaatgt

SEQ ID NO: 4910164 - DNA, 19 bp, Homo sapiens
tttactcattgaaatgtca

SEQ ID NO: 4910165 - DNA, 22 bp, Homo sapiens
tttactcattgaaatgtcacgt

SEQ ID NO: 4910166 - DNA, 22 bp, Homo sapiens
tttactgttttgaaatcaatgc

SEQ ID NO: 4910167 - DNA, 20 bp, Homo sapiens
tttactttcccttgcttttc

SEQ ID NO: 4910168 - DNA, 15 bp, Homo sapiens
tttagaagtgcattt

SEQ ID NO: 4910169 - DNA, 16 bp, Homo sapiens
tttagacagtctcact

SEQ ID NO: 4910170 - DNA, 11 bp, Homo sapiens
tttagaccaag

SEQ ID NO: 4910171 - DNA, 18 bp, Homo sapiens
tttagaccaaggaacaaa

SEQ ID NO: 4910172 - DNA, 22 bp, Homo sapiens
tttagactcatcaatcaaataa

SEQ ID NO: 4910173 - DNA, 15 bp, Homo sapiens
tttagactgtagcct

SEQ ID NO: 4910174 - DNA, 13 bp, Homo sapiens
tttaggaaaatca

SEQ ID NO: 4910175 - DNA, 13 bp, Homo sapiens
tttaggaagtgtt

SEQ ID NO: 4910176 - DNA, 20 bp, Homo sapiens
tttagggtactaaatttaaa

SEQ ID NO: 4910177 - DNA, 17 bp, Homo sapiens
tttaggtactattctga

SEQ ID NO: 4910178 - DNA, 21 bp, Homo sapiens
tttaggtgaattaattaaaca

SEQ ID NO: 4910179 - DNA, 22 bp, Homo sapiens
tttaggtttttgtttgtttcct

SEQ ID NO: 4910180 - DNA, 21 bp, Homo sapiens
tttagtattcattctgcattg

SEQ ID NO: 4910181 - DNA, 14 bp, Homo sapiens
tttagttatagttt

SEQ ID NO: 4910182 - DNA, 17 bp, Homo sapiens
tttataaaatataaaca

SEQ ID NO: 4910183 - DNA, 14 bp, Homo sapiens
tttataaaattaga

SEQ ID NO: 4910184 - DNA, 16 bp, Homo sapiens
tttataaaattagaaa

SEQ ID NO: 4910185 - DNA, 24 bp, Homo sapiens
tttataaagtacccatctagtact

SEQ ID NO: 4910186 - DNA, 22 bp, Homo sapiens
tttataaatataagccttttat

SEQ ID NO: 4910187 - DNA, 16 bp, Homo sapiens
tttataagcaaatttc

SEQ ID NO: 4910188 - DNA, 18 bp, Homo sapiens
tttataagttcacaaaat

SEQ ID NO: 4910189 - DNA, 18 bp, Homo sapiens
tttataatagcaactttt

SEQ ID NO: 4910190 - DNA, 16 bp, Homo sapiens
tttatacaatatcatc

SEQ ID NO: 4910191 - DNA, 21 bp, Homo sapiens
tttatacattagtaaatgtct

SEQ ID NO: 4910192 - DNA, 10 bp, Homo sapiens
tttatacctc

SEQ ID NO: 4910193 - DNA, 16 bp, Homo sapiens
tttataggtgagaaaa

SEQ ID NO: 4910194 - DNA, 15 bp, Homo sapiens
tttatagtgcacaaa

SEQ ID NO: 4910195 - DNA, 15 bp, Homo sapiens
tttatatatacagta

SEQ ID NO: 4910196 - DNA, 14 bp, Homo sapiens
tttatatatgaaaa

SEQ ID NO: 4910197 - DNA, 16 bp, Homo sapiens
tttatatatgaaaact

SEQ ID NO: 4910198 - DNA, 17 bp, Homo sapiens
tttatatatgaaaacta

SEQ ID NO: 4910199 - DNA, 13 bp, Homo sapiens
tttatatatttat

SEQ ID NO: 4910200 - DNA, 13 bp, Homo sapiens
tttatatgtacat

SEQ ID NO: 4910201 - DNA, 17 bp, Homo sapiens
tttatatgtacatgaga

SEQ ID NO: 4910202 - DNA, 12 bp, Homo sapiens
tttatattttta

SEQ ID NO: 4910203 - DNA, 17 bp, Homo sapiens
tttatcacacttctgtg

SEQ ID NO: 4910204 - DNA, 13 bp, Homo sapiens
tttatcacttttt

SEQ ID NO: 4910205 - DNA, 19 bp, Homo sapiens
tttatcactttttgaacta

SEQ ID NO: 4910206 - DNA, 20 bp, Homo sapiens
tttatcactttttgaactaa

SEQ ID NO: 4910207 - DNA, 21 bp, Homo sapiens
tttatcagatacatcactgct

SEQ ID NO: 4910208 - DNA, 22 bp, Homo sapiens
tttatcagtttccagtctcaaa

SEQ ID NO: 4910209 - DNA, 16 bp, Homo sapiens
tttatccatttgtaat

SEQ ID NO: 4910210 - DNA, 13 bp, Homo sapiens
tttatctctattt

SEQ ID NO: 4910211 - DNA, 14 bp, Homo sapiens
tttatctctattta

SEQ ID NO: 4910212 - DNA, 17 bp, Homo sapiens
tttatctggccccaggt

SEQ ID NO: 4910213 - DNA, 13 bp, Homo sapiens
tttatctgttctt

SEQ ID NO: 4910214 - DNA, 23 bp, Homo sapiens
tttatgaagtttaaaacagtatt

SEQ ID NO: 4910215 - DNA, 20 bp, Homo sapiens
tttatgagtaactattatta

SEQ ID NO: 4910216 - DNA, 18 bp, Homo sapiens
tttatgataatagattct

SEQ ID NO: 4910217 - DNA, 22 bp, Homo sapiens
tttatggcctcagctgcctcac

SEQ ID NO: 4910218 - DNA, 22 bp, Homo sapiens
tttatgtaatgaagtaaagcca

SEQ ID NO: 4910219 - DNA, 19 bp, Homo sapiens
tttatgtagtaattgacat

SEQ ID NO: 4910220 - DNA, 15 bp, Homo sapiens
tttatgttaaaagat

SEQ ID NO: 4910221 - DNA, 17 bp, Homo sapiens
tttatgttcatttgttt

SEQ ID NO: 4910222 - DNA, 14 bp, Homo sapiens
tttatgtttagata

SEQ ID NO: 4910223 - DNA, 12 bp, Homo sapiens
tttatgtttgaa

SEQ ID NO: 4910224 - DNA, 14 bp, Homo sapiens
tttatgtttgaata

SEQ ID NO: 4910225 - DNA, 19 bp, Homo sapiens
tttattaaataaaatcaat

SEQ ID NO: 4910226 - DNA, 21 bp, Homo sapiens
tttattaaatttgttgacaaa

SEQ ID NO: 4910227 - DNA, 17 bp, Homo sapiens
tttattaccccctcctt

SEQ ID NO: 4910228 - DNA, 23 bp, Homo sapiens
tttattaccccctccttcagaca

SEQ ID NO: 4910229 - DNA, 14 bp, Homo sapiens
tttattataaactg

SEQ ID NO: 4910230 - DNA, 19 bp, Homo sapiens
tttattcagcttcatttgt

SEQ ID NO: 4910231 - DNA, 18 bp, Homo sapiens
tttattccagaatgctgt

SEQ ID NO: 4910232 - DNA, 23 bp, Homo sapiens
tttattccagaatgctgtacatc

SEQ ID NO: 4910233 - DNA, 16 bp, Homo sapiens
tttattcctgtatgtt

SEQ ID NO: 4910234 - DNA, 23 bp, Homo sapiens
tttattgctagtatttgaattaa

SEQ ID NO: 4910235 - DNA, 19 bp, Homo sapiens
tttatttatatgtactgtt

SEQ ID NO: 4910236 - DNA, 14 bp, Homo sapiens
tttatttatgaagt

SEQ ID NO: 4910237 - DNA, 13 bp, Homo sapiens
tttatttatttat

SEQ ID NO: 4910238 - DNA, 11 bp, Homo sapiens
tttatttcact

SEQ ID NO: 4910239 - DNA, 16 bp, Homo sapiens
tttatttctgcatatg

SEQ ID NO: 4910240 - DNA, 18 bp, Homo sapiens
tttattttacacagaaac

SEQ ID NO: 4910241 - DNA, 14 bp, Homo sapiens
tttattttactatt

SEQ ID NO: 4910242 - DNA, 15 bp, Homo sapiens
tttattttcctaaag

SEQ ID NO: 4910243 - DNA, 17 bp, Homo sapiens
tttatttttcatattgt

SEQ ID NO: 4910244 - DNA, 21 bp, Homo sapiens
tttcaaaaatataacttaaaa

SEQ ID NO: 4910245 - DNA, 19 bp, Homo sapiens
tttcaaaatccaaaaagaa

SEQ ID NO: 4910246 - DNA, 17 bp, Homo sapiens
tttcaaagctttttcca

SEQ ID NO: 4910247 - DNA, 20 bp, Homo sapiens
tttcaaattggactttcaaa

SEQ ID NO: 4910248 - DNA, 20 bp, Homo sapiens
tttcaacgcagccctgcttt

SEQ ID NO: 4910249 - DNA, 18 bp, Homo sapiens
tttcaagaaaaaataaat

SEQ ID NO: 4910250 - DNA, 19 bp, Homo sapiens
tttcaagaaactgaggaat

SEQ ID NO: 4910251 - DNA, 20 bp, Homo sapiens
tttcaaggaaggttcatgta

SEQ ID NO: 4910252 - DNA, 13 bp, Homo sapiens
tttcaaggttcta

SEQ ID NO: 4910253 - DNA, 23 bp, Homo sapiens
tttcaagtgcctttctgcagttt

SEQ ID NO: 4910254 - DNA, 22 bp, Homo sapiens
tttcacaaccttctgtggctca

SEQ ID NO: 4910255 - DNA, 20 bp, Homo sapiens
tttcacaccggaaggttttt

SEQ ID NO: 4910256 - DNA, 13 bp, Homo sapiens
tttcacagctcct

SEQ ID NO: 4910257 - DNA, 16 bp, Homo sapiens
tttcacatagctgtct

SEQ ID NO: 4910258 - DNA, 18 bp, Homo sapiens
tttcacatagctgtctag

SEQ ID NO: 4910259 - DNA, 20 bp, Homo sapiens
tttcacattaatggtctaaa

SEQ ID NO: 4910260 - DNA, 19 bp, Homo sapiens
tttcacattgtttgctgct

SEQ ID NO: 4910261 - DNA, 17 bp, Homo sapiens
tttcaccagatttgcta

SEQ ID NO: 4910262 - DNA, 14 bp, Homo sapiens
tttcacttatacct

SEQ ID NO: 4910263 - DNA, 18 bp, Homo sapiens
tttcagaacctcttcccc

SEQ ID NO: 4910264 - DNA, 12 bp, Homo sapiens
tttcagagattt

SEQ ID NO: 4910265 - DNA, 15 bp, Homo sapiens
tttcagattttgata

SEQ ID NO: 4910266 - DNA, 16 bp, Homo sapiens
tttcagctatcagtag

SEQ ID NO: 4910267 - DNA, 13 bp, Homo sapiens
tttcagcttaaaa

SEQ ID NO: 4910268 - DNA, 16 bp, Homo sapiens
tttcaggaccttttga

SEQ ID NO: 4910269 - DNA, 22 bp, Homo sapiens
tttcaggcaggcacctagcaat

SEQ ID NO: 4910270 - DNA, 15 bp, Homo sapiens
tttcaggtgacatgt

SEQ ID NO: 4910271 - DNA, 22 bp, Homo sapiens
tttcaggtgacatgtgaaacct

SEQ ID NO: 4910272 - DNA, 19 bp, Homo sapiens
tttcagtgtagttaattta

SEQ ID NO: 4910273 - DNA, 12 bp, Homo sapiens
tttcagttccaa

SEQ ID NO: 4910274 - DNA, 13 bp, Homo sapiens
tttcagttccaag

SEQ ID NO: 4910275 - DNA, 18 bp, Homo sapiens
tttcataacttattgctg

SEQ ID NO: 4910276 - DNA, 20 bp, Homo sapiens
tttcataacttattgctgat

SEQ ID NO: 4910277 - DNA, 15 bp, Homo sapiens
tttcatattgtgcca

SEQ ID NO: 4910278 - DNA, 16 bp, Homo sapiens
tttcatcattgtttct

SEQ ID NO: 4910279 - DNA, 16 bp, Homo sapiens
tttcatgctatctctg

SEQ ID NO: 4910280 - DNA, 17 bp, Homo sapiens
tttcatgctctgcaaaa

SEQ ID NO: 4910281 - DNA, 17 bp, Homo sapiens
tttcatgtggctgtaga

SEQ ID NO: 4910282 - DNA, 17 bp, Homo sapiens
tttcattgtatgatgtg

SEQ ID NO: 4910283 - DNA, 14 bp, Homo sapiens
tttcattttccaat

SEQ ID NO: 4910284 - DNA, 16 bp, Homo sapiens
tttccaaactgactca

SEQ ID NO: 4910285 - DNA, 18 bp, Homo sapiens
tttccaacaccacagaca

SEQ ID NO: 4910286 - DNA, 21 bp, Homo sapiens
tttccaacaccacagacacac

SEQ ID NO: 4910287 - DNA, 21 bp, Homo sapiens
tttccaagtaatataatggaa

SEQ ID NO: 4910288 - DNA, 18 bp, Homo sapiens
tttccacttgttctcagg

SEQ ID NO: 4910289 - DNA, 19 bp, Homo sapiens
tttccagacttccttgaga

SEQ ID NO: 4910290 - DNA, 19 bp, Homo sapiens
tttccagaggctattattt

SEQ ID NO: 4910291 - DNA, 16 bp, Homo sapiens
tttccagcagaagaca

SEQ ID NO: 4910292 - DNA, 16 bp, Homo sapiens
tttccagctttctccc

SEQ ID NO: 4910293 - DNA, 18 bp, Homo sapiens
tttccagtctcttgtaca

SEQ ID NO: 4910294 - DNA, 12 bp, Homo sapiens
tttccatatgtt

SEQ ID NO: 4910295 - DNA, 16 bp, Homo sapiens
tttcccaggttctgtt

SEQ ID NO: 4910296 - DNA, 19 bp, Homo sapiens
tttccccagcatcactccc

SEQ ID NO: 4910297 - DNA, 19 bp, Homo sapiens
tttccccccactctcccca

SEQ ID NO: 4910298 - DNA, 19 bp, Homo sapiens
tttcccttcagtaccctct

SEQ ID NO: 4910299 - DNA, 16 bp, Homo sapiens
tttcccttcccttcca

SEQ ID NO: 4910300 - DNA, 19 bp, Homo sapiens
tttcccttgcttttccctc

SEQ ID NO: 4910301 - DNA, 13 bp, Homo sapiens
tttcctaacaaaa

SEQ ID NO: 4910302 - DNA, 23 bp, Homo sapiens
tttcctaacaaaagatgaaagca

SEQ ID NO: 4910303 - DNA, 18 bp, Homo sapiens
tttcctctatacatctct

SEQ ID NO: 4910304 - DNA, 23 bp, Homo sapiens
tttcctgacagaaggactcaggt

SEQ ID NO: 4910305 - DNA, 20 bp, Homo sapiens
tttcctgagaccacagagag

SEQ ID NO: 4910306 - DNA, 21 bp, Homo sapiens
tttcctgataaagcacagctg

SEQ ID NO: 4910307 - DNA, 12 bp, Homo sapiens
tttcctgtgtct

SEQ ID NO: 4910308 - DNA, 15 bp, Homo sapiens
tttccttccatccct

SEQ ID NO: 4910309 - DNA, 15 bp, Homo sapiens
tttccttgtgcaaaa

SEQ ID NO: 4910310 - DNA, 22 bp, Homo sapiens
tttcctttaaaaaaatttaagt

SEQ ID NO: 4910311 - DNA, 19 bp, Homo sapiens
tttcctttatatttagtga

SEQ ID NO: 4910312 - DNA, 17 bp, Homo sapiens
tttcctttttctgatta

SEQ ID NO: 4910313 - DNA, 13 bp, Homo sapiens
tttcgataaacaa

SEQ ID NO: 4910314 - DNA, 21 bp, Homo sapiens
tttctaacaaaaaaatatatt

SEQ ID NO: 4910315 - DNA, 14 bp, Homo sapiens
tttctaaccttgaa

SEQ ID NO: 4910316 - DNA, 20 bp, Homo sapiens
tttctaaccttgaatgctgc

SEQ ID NO: 4910317 - DNA, 13 bp, Homo sapiens
tttctaagattct

SEQ ID NO: 4910318 - DNA, 15 bp, Homo sapiens
tttctaatgtgtgaa

SEQ ID NO: 4910319 - DNA, 23 bp, Homo sapiens
tttctacaaagcactagagaatg

SEQ ID NO: 4910320 - DNA, 15 bp, Homo sapiens
tttctacattattgc

SEQ ID NO: 4910321 - DNA, 20 bp, Homo sapiens
tttctacattattgcttatt

SEQ ID NO: 4910322 - DNA, 15 bp, Homo sapiens
tttctacccagcgag

SEQ ID NO: 4910323 - DNA, 23 bp, Homo sapiens
tttctagaagtttcccttcctcc

SEQ ID NO: 4910324 - DNA, 16 bp, Homo sapiens
tttctagactttctgt

SEQ ID NO: 4910325 - DNA, 20 bp, Homo sapiens
tttctagtacacttttatga

SEQ ID NO: 4910326 - DNA, 14 bp, Homo sapiens
tttctagtggtctt

SEQ ID NO: 4910327 - DNA, 17 bp, Homo sapiens
tttctagtggtctttgt

SEQ ID NO: 4910328 - DNA, 19 bp, Homo sapiens
tttctagtggtctttgtaa

SEQ ID NO: 4910329 - DNA, 21 bp, Homo sapiens
tttctagtggtctttgtaaga

SEQ ID NO: 4910330 - DNA, 15 bp, Homo sapiens
tttctataacagata

SEQ ID NO: 4910331 - DNA, 13 bp, Homo sapiens
tttctatgtacta

SEQ ID NO: 4910332 - DNA, 22 bp, Homo sapiens
tttctatgtactagtactgtgt

SEQ ID NO: 4910333 - DNA, 23 bp, Homo sapiens
tttctatgtactagtactgtgta

SEQ ID NO: 4910334 - DNA, 14 bp, Homo sapiens
tttctattccttct

SEQ ID NO: 4910335 - DNA, 18 bp, Homo sapiens
tttctattccttctggcc

SEQ ID NO: 4910336 - DNA, 16 bp, Homo sapiens
tttctatttgacttgt

SEQ ID NO: 4910337 - DNA, 13 bp, Homo sapiens
tttctcaaaagca

SEQ ID NO: 4910338 - DNA, 14 bp, Homo sapiens
tttctcaaaagcat

SEQ ID NO: 4910339 - DNA, 16 bp, Homo sapiens
tttctcaaaagcattt

SEQ ID NO: 4910340 - DNA, 16 bp, Homo sapiens
tttctcaaagttttga

SEQ ID NO: 4910341 - DNA, 22 bp, Homo sapiens
tttctcaaagttttgaaaagct

SEQ ID NO: 4910342 - DNA, 22 bp, Homo sapiens
tttctcaacaaagcacagtgtt

SEQ ID NO: 4910343 - DNA, 20 bp, Homo sapiens
tttctcatttgtttttctca

SEQ ID NO: 4910344 - DNA, 21 bp, Homo sapiens
tttctccagctcagaacccag

SEQ ID NO: 4910345 - DNA, 12 bp, Homo sapiens
tttctccagctg

SEQ ID NO: 4910346 - DNA, 19 bp, Homo sapiens
tttctctcagccttacatt

SEQ ID NO: 4910347 - DNA, 21 bp, Homo sapiens
tttctctcagccttacatttg

SEQ ID NO: 4910348 - DNA, 20 bp, Homo sapiens
tttctctccagcctgacttg

SEQ ID NO: 4910349 - DNA, 18 bp, Homo sapiens
tttctcttgagctggcct

SEQ ID NO: 4910350 - DNA, 13 bp, Homo sapiens
tttctctttctct

SEQ ID NO: 4910351 - DNA, 20 bp, Homo sapiens
tttctgaaagttacccactg

SEQ ID NO: 4910352 - DNA, 15 bp, Homo sapiens
tttctgaatagaaat

SEQ ID NO: 4910353 - DNA, 15 bp, Homo sapiens
tttctgagaaaagaa

SEQ ID NO: 4910354 - DNA, 17 bp, Homo sapiens
tttctgaggctttatga

SEQ ID NO: 4910355 - DNA, 17 bp, Homo sapiens
tttctgattagctttgt

SEQ ID NO: 4910356 - DNA, 18 bp, Homo sapiens
tttctgattagctttgtg

SEQ ID NO: 4910357 - DNA, 19 bp, Homo sapiens
tttctgattagctttgtgt

SEQ ID NO: 4910358 - DNA, 13 bp, Homo sapiens
tttctgcatatgt

SEQ ID NO: 4910359 - DNA, 17 bp, Homo sapiens
tttctgcatatgttgaa

SEQ ID NO: 4910360 - DNA, 22 bp, Homo sapiens
tttctgcatgaatatcatacaa

SEQ ID NO: 4910361 - DNA, 22 bp, Homo sapiens
tttctgctttctttgattctcc

SEQ ID NO: 4910362 - DNA, 21 bp, Homo sapiens
tttctggccaaaagcagtaaa

SEQ ID NO: 4910363 - DNA, 21 bp, Homo sapiens
tttctggggaaagacactgcc

SEQ ID NO: 4910364 - DNA, 15 bp, Homo sapiens
tttctgggtcctgaa

SEQ ID NO: 4910365 - DNA, 19 bp, Homo sapiens
tttctgtagtcatttacta

SEQ ID NO: 4910366 - DNA, 24 bp, Homo sapiens
tttctgtagtcatttactaaacat

SEQ ID NO: 4910367 - DNA, 14 bp, Homo sapiens
tttctgtcagaatg

SEQ ID NO: 4910368 - DNA, 15 bp, Homo sapiens
tttctgtcagaatgc

SEQ ID NO: 4910369 - DNA, 13 bp, Homo sapiens
tttctgtcattca

SEQ ID NO: 4910370 - DNA, 11 bp, Homo sapiens
tttctgtgtgc

SEQ ID NO: 4910371 - DNA, 22 bp, Homo sapiens
tttctgtgtgcaccttaccaac

SEQ ID NO: 4910372 - DNA, 15 bp, Homo sapiens
tttctgttgtaactt

SEQ ID NO: 4910373 - DNA, 19 bp, Homo sapiens
tttctgttgtaacttatgt

SEQ ID NO: 4910374 - DNA, 23 bp, Homo sapiens
tttctgttgtaacttatgtagat

SEQ ID NO: 4910375 - DNA, 15 bp, Homo sapiens
tttcttactcctcct

SEQ ID NO: 4910376 - DNA, 17 bp, Homo sapiens
tttcttactcctcctct

SEQ ID NO: 4910377 - DNA, 16 bp, Homo sapiens
tttcttagctttttaa

SEQ ID NO: 4910378 - DNA, 19 bp, Homo sapiens
tttcttagctttttaattg

SEQ ID NO: 4910379 - DNA, 16 bp, Homo sapiens
tttcttagtgcctgtg

SEQ ID NO: 4910380 - DNA, 14 bp, Homo sapiens
tttcttattgcgct

SEQ ID NO: 4910381 - DNA, 13 bp, Homo sapiens
tttcttcatccaa

SEQ ID NO: 4910382 - DNA, 18 bp, Homo sapiens
tttcttcctgttaatgta

SEQ ID NO: 4910383 - DNA, 15 bp, Homo sapiens
tttcttcctttactt

SEQ ID NO: 4910384 - DNA, 13 bp, Homo sapiens
tttcttctacttt

SEQ ID NO: 4910385 - DNA, 19 bp, Homo sapiens
tttcttgctcccttcagcc

SEQ ID NO: 4910386 - DNA, 19 bp, Homo sapiens
tttcttggcaaaagccttg

SEQ ID NO: 4910387 - DNA, 13 bp, Homo sapiens
tttctttctagtg

SEQ ID NO: 4910388 - DNA, 16 bp, Homo sapiens
tttcttttgaattgtt

SEQ ID NO: 4910389 - DNA, 22 bp, Homo sapiens
tttctttttaagtaatgtggaa

SEQ ID NO: 4910390 - DNA, 12 bp, Homo sapiens
tttctttttaca

SEQ ID NO: 4910391 - DNA, 13 bp, Homo sapiens
tttctttttacat

SEQ ID NO: 4910392 - DNA, 14 bp, Homo sapiens
tttctttttacata

SEQ ID NO: 4910393 - DNA, 17 bp, Homo sapiens
tttcttttttaaaatca

SEQ ID NO: 4910394 - DNA, 21 bp, Homo sapiens
tttgaaaaaagctcatttcat

SEQ ID NO: 4910395 - DNA, 15 bp, Homo sapiens
tttgaaaagctatta

SEQ ID NO: 4910396 - DNA, 23 bp, Homo sapiens
tttgaaaagcttcttaattaatt

SEQ ID NO: 4910397 - DNA, 15 bp, Homo sapiens
tttgaaacctgctct

SEQ ID NO: 4910398 - DNA, 22 bp, Homo sapiens
tttgaaagggatcatcatgcag

SEQ ID NO: 4910399 - DNA, 19 bp, Homo sapiens
tttgaaatagtctgtgtga

SEQ ID NO: 4910400 - DNA, 13 bp, Homo sapiens
tttgaaatgaaat

SEQ ID NO: 4910401 - DNA, 14 bp, Homo sapiens
tttgaaatgaaatt

SEQ ID NO: 4910402 - DNA, 15 bp, Homo sapiens
tttgaaatgaaattt

SEQ ID NO: 4910403 - DNA, 20 bp, Homo sapiens
tttgaaatgaggtctgttta

SEQ ID NO: 4910404 - DNA, 15 bp, Homo sapiens
tttgaaattatgtga

SEQ ID NO: 4910405 - DNA, 22 bp, Homo sapiens
tttgaaattatgtgacatttta

SEQ ID NO: 4910406 - DNA, 22 bp, Homo sapiens
tttgaactggcaattgtctatt

SEQ ID NO: 4910407 - DNA, 18 bp, Homo sapiens
tttgaagaacatgtgaga

SEQ ID NO: 4910408 - DNA, 16 bp, Homo sapiens
tttgaagcagttgtgt

SEQ ID NO: 4910409 - DNA, 16 bp, Homo sapiens
tttgaagctactgtgt

SEQ ID NO: 4910410 - DNA, 14 bp, Homo sapiens
tttgaagtcttgta

SEQ ID NO: 4910411 - DNA, 16 bp, Homo sapiens
tttgaagtcttgtata

SEQ ID NO: 4910412 - DNA, 22 bp, Homo sapiens
tttgaataccattaaaactgct

SEQ ID NO: 4910413 - DNA, 17 bp, Homo sapiens
tttgaattttaaatcta

SEQ ID NO: 4910414 - DNA, 19 bp, Homo sapiens
tttgactagatgatggatg

SEQ ID NO: 4910415 - DNA, 21 bp, Homo sapiens
tttgactagggattcaggctg

SEQ ID NO: 4910416 - DNA, 19 bp, Homo sapiens
tttgactgaagatgcagct

SEQ ID NO: 4910417 - DNA, 17 bp, Homo sapiens
tttgacttgcatgaaga

SEQ ID NO: 4910418 - DNA, 13 bp, Homo sapiens
tttgagagttcta

SEQ ID NO: 4910419 - DNA, 16 bp, Homo sapiens
tttgaggagcatgttt

SEQ ID NO: 4910420 - DNA, 21 bp, Homo sapiens
tttgagggactgcctctgcca

SEQ ID NO: 4910421 - DNA, 15 bp, Homo sapiens
tttgaggtaaagata

SEQ ID NO: 4910422 - DNA, 21 bp, Homo sapiens
tttgagtagatattactttat

SEQ ID NO: 4910423 - DNA, 18 bp, Homo sapiens
tttgagtgtgtgtgtgca

SEQ ID NO: 4910424 - DNA, 13 bp, Homo sapiens
tttgagttctaca

SEQ ID NO: 4910425 - DNA, 22 bp, Homo sapiens
tttgataactgtttatatgtgt

SEQ ID NO: 4910426 - DNA, 14 bp, Homo sapiens
tttgataatgataa

SEQ ID NO: 4910427 - DNA, 17 bp, Homo sapiens
tttgataatgttaaatt

SEQ ID NO: 4910428 - DNA, 14 bp, Homo sapiens
tttgatacataata

SEQ ID NO: 4910429 - DNA, 23 bp, Homo sapiens
tttgatacataataaaaaattat

SEQ ID NO: 4910430 - DNA, 14 bp, Homo sapiens
tttgatacttatat

SEQ ID NO: 4910431 - DNA, 15 bp, Homo sapiens
tttgatacttatatt

SEQ ID NO: 4910432 - DNA, 17 bp, Homo sapiens
tttgatacttatatttt

SEQ ID NO: 4910433 - DNA, 18 bp, Homo sapiens
tttgatacttatattttc

SEQ ID NO: 4910434 - DNA, 15 bp, Homo sapiens
tttgatatgagtata

SEQ ID NO: 4910435 - DNA, 18 bp, Homo sapiens
tttgatatgagtatacaa

SEQ ID NO: 4910436 - DNA, 14 bp, Homo sapiens
tttgatccaagctg

SEQ ID NO: 4910437 - DNA, 15 bp, Homo sapiens
tttgatccaagctgg

SEQ ID NO: 4910438 - DNA, 16 bp, Homo sapiens
tttgatgcagcatttg

SEQ ID NO: 4910439 - DNA, 15 bp, Homo sapiens
tttgatgtcatgtgt

SEQ ID NO: 4910440 - DNA, 16 bp, Homo sapiens
tttgattaacaaatat

SEQ ID NO: 4910441 - DNA, 18 bp, Homo sapiens
tttgcaataaaaatgata

SEQ ID NO: 4910442 - DNA, 18 bp, Homo sapiens
tttgcacattttgatttt

SEQ ID NO: 4910443 - DNA, 19 bp, Homo sapiens
tttgcacgacgccctctcc

SEQ ID NO: 4910444 - DNA, 20 bp, Homo sapiens
tttgcacgacgccctctccc

SEQ ID NO: 4910445 - DNA, 19 bp, Homo sapiens
tttgcactaaatcagagac

SEQ ID NO: 4910446 - DNA, 14 bp, Homo sapiens
tttgcagacaggca

SEQ ID NO: 4910447 - DNA, 22 bp, Homo sapiens
tttgcatctgaaataggaaaca

SEQ ID NO: 4910448 - DNA, 22 bp, Homo sapiens
tttgcatggctccagaaatgtc

SEQ ID NO: 4910449 - DNA, 21 bp, Homo sapiens
tttgcattaaattcacaaact

SEQ ID NO: 4910450 - DNA, 22 bp, Homo sapiens
tttgcattaaattcacaaactt

SEQ ID NO: 4910451 - DNA, 18 bp, Homo sapiens
tttgccactaattttagt

SEQ ID NO: 4910452 - DNA, 22 bp, Homo sapiens
tttgccactaattttagtattc

SEQ ID NO: 4910453 - DNA, 14 bp, Homo sapiens
tttgccatgggctt

SEQ ID NO: 4910454 - DNA, 20 bp, Homo sapiens
tttgccatgggcttcactgt

SEQ ID NO: 4910455 - DNA, 12 bp, Homo sapiens
tttgccatttga

SEQ ID NO: 4910456 - DNA, 19 bp, Homo sapiens
tttgccctggtttcactgg

SEQ ID NO: 4910457 - DNA, 20 bp, Homo sapiens
tttgcctcttttctctgtgc

SEQ ID NO: 4910458 - DNA, 18 bp, Homo sapiens
tttgcctggttttgtctt

SEQ ID NO: 4910459 - DNA, 21 bp, Homo sapiens
tttgccttgggctgctcctca

SEQ ID NO: 4910460 - DNA, 12 bp, Homo sapiens
tttgcctttaaa

SEQ ID NO: 4910461 - DNA, 19 bp, Homo sapiens
tttgctaattaaaaagtta

SEQ ID NO: 4910462 - DNA, 19 bp, Homo sapiens
tttgctagactctagacaa

SEQ ID NO: 4910463 - DNA, 15 bp, Homo sapiens
tttgctagcagtaaa

SEQ ID NO: 4910464 - DNA, 17 bp, Homo sapiens
tttgctcttgtttttat

SEQ ID NO: 4910465 - DNA, 13 bp, Homo sapiens
tttgcttcataaa

SEQ ID NO: 4910466 - DNA, 17 bp, Homo sapiens
tttgcttgttatattaa

SEQ ID NO: 4910467 - DNA, 14 bp, Homo sapiens
tttgctttttgcta

SEQ ID NO: 4910468 - DNA, 17 bp, Homo sapiens
tttgggaaccaagctat

SEQ ID NO: 4910469 - DNA, 20 bp, Homo sapiens
tttgggaagtgaagactgga

SEQ ID NO: 4910470 - DNA, 14 bp, Homo sapiens
tttgggcctctgct

SEQ ID NO: 4910471 - DNA, 14 bp, Homo sapiens
tttgggctgccctg

SEQ ID NO: 4910472 - DNA, 18 bp, Homo sapiens
tttggggaaacctagaga

SEQ ID NO: 4910473 - DNA, 18 bp, Homo sapiens
tttgggggacgtttctca

SEQ ID NO: 4910474 - DNA, 22 bp, Homo sapiens
tttgggtatgtttaatctgtta

SEQ ID NO: 4910475 - DNA, 21 bp, Homo sapiens
tttggtctggactgacagcat

SEQ ID NO: 4910476 - DNA, 16 bp, Homo sapiens
tttggtgcatagaact

SEQ ID NO: 4910477 - DNA, 16 bp, Homo sapiens
tttggttcctctctgg

SEQ ID NO: 4910478 - DNA, 22 bp, Homo sapiens
tttgtaaactcaaaatatttgt

SEQ ID NO: 4910479 - DNA, 16 bp, Homo sapiens
tttgtaaactggaatt

SEQ ID NO: 4910480 - DNA, 13 bp, Homo sapiens
tttgtaaagaaat

SEQ ID NO: 4910481 - DNA, 21 bp, Homo sapiens
tttgtaaagaaatttactata

SEQ ID NO: 4910482 - DNA, 22 bp, Homo sapiens
tttgtaaagaaatttactatat

SEQ ID NO: 4910483 - DNA, 14 bp, Homo sapiens
tttgtaaatgttat

SEQ ID NO: 4910484 - DNA, 19 bp, Homo sapiens
tttgtaaatgttatttctg

SEQ ID NO: 4910485 - DNA, 21 bp, Homo sapiens
tttgtaagagtgtagaagcat

SEQ ID NO: 4910486 - DNA, 22 bp, Homo sapiens
tttgtaagtcagtgttgagatg

SEQ ID NO: 4910487 - DNA, 14 bp, Homo sapiens
tttgtaagtttcag

SEQ ID NO: 4910488 - DNA, 21 bp, Homo sapiens
tttgtaagtttcaggtgacat

SEQ ID NO: 4910489 - DNA, 18 bp, Homo sapiens
tttgtaatgtgtgaaaaa

SEQ ID NO: 4910490 - DNA, 16 bp, Homo sapiens
tttgtacatagattta

SEQ ID NO: 4910491 - DNA, 12 bp, Homo sapiens
tttgtacatctg

SEQ ID NO: 4910492 - DNA, 20 bp, Homo sapiens
tttgtaggtaaaatgtattt

SEQ ID NO: 4910493 - DNA, 16 bp, Homo sapiens
tttgtagtgaaataat

SEQ ID NO: 4910494 - DNA, 14 bp, Homo sapiens
tttgtatacaaata

SEQ ID NO: 4910495 - DNA, 19 bp, Homo sapiens
tttgtatattacacatttg

SEQ ID NO: 4910496 - DNA, 21 bp, Homo sapiens
tttgtatattacacatttgta

SEQ ID NO: 4910497 - DNA, 21 bp, Homo sapiens
tttgtatctctgaagcatgtt

SEQ ID NO: 4910498 - DNA, 22 bp, Homo sapiens
tttgtatcttccatatttggaa

SEQ ID NO: 4910499 - DNA, 16 bp, Homo sapiens
tttgtatgcactttgt

SEQ ID NO: 4910500 - DNA, 16 bp, Homo sapiens
tttgtattttgtgtga

SEQ ID NO: 4910501 - DNA, 16 bp, Homo sapiens
tttgtccatttgtaaa

SEQ ID NO: 4910502 - DNA, 16 bp, Homo sapiens
tttgtcccccaacttg

SEQ ID NO: 4910503 - DNA, 17 bp, Homo sapiens
tttgtcccccaacttga

SEQ ID NO: 4910504 - DNA, 18 bp, Homo sapiens
tttgtctattttaaaata

SEQ ID NO: 4910505 - DNA, 22 bp, Homo sapiens
tttgtctctccttttcttttgt

SEQ ID NO: 4910506 - DNA, 13 bp, Homo sapiens
tttgtctgtcgtg

SEQ ID NO: 4910507 - DNA, 19 bp, Homo sapiens
tttgtcttatatatatttc

SEQ ID NO: 4910508 - DNA, 22 bp, Homo sapiens
tttgtgaaatgatggtgaaagt

SEQ ID NO: 4910509 - DNA, 20 bp, Homo sapiens
tttgtgactatatagagatg

SEQ ID NO: 4910510 - DNA, 23 bp, Homo sapiens
tttgtgactatatagagatgttt

SEQ ID NO: 4910511 - DNA, 13 bp, Homo sapiens
tttgtgccagagg

SEQ ID NO: 4910512 - DNA, 20 bp, Homo sapiens
tttgtgcctggcttctttct

SEQ ID NO: 4910513 - DNA, 21 bp, Homo sapiens
tttgtgctcatttaagtttca

SEQ ID NO: 4910514 - DNA, 17 bp, Homo sapiens
tttgtggcaccttttct

SEQ ID NO: 4910515 - DNA, 14 bp, Homo sapiens
tttgtggcctcaga

SEQ ID NO: 4910516 - DNA, 22 bp, Homo sapiens
tttgtggtacgacctttagatt

SEQ ID NO: 4910517 - DNA, 16 bp, Homo sapiens
tttgtgtaatgaaaat

SEQ ID NO: 4910518 - DNA, 14 bp, Homo sapiens
tttgtgttgtaatt

SEQ ID NO: 4910519 - DNA, 22 bp, Homo sapiens
tttgtgttgtaattcttcagtt

SEQ ID NO: 4910520 - DNA, 20 bp, Homo sapiens
tttgtgttgttggaaaaagt

SEQ ID NO: 4910521 - DNA, 13 bp, Homo sapiens
tttgttaaataat

SEQ ID NO: 4910522 - DNA, 12 bp, Homo sapiens
tttgttactgtt

SEQ ID NO: 4910523 - DNA, 15 bp, Homo sapiens
tttgttactgttctt

SEQ ID NO: 4910524 - DNA, 15 bp, Homo sapiens
tttgttagatagctg

SEQ ID NO: 4910525 - DNA, 15 bp, Homo sapiens
tttgttagttcctgt

SEQ ID NO: 4910526 - DNA, 12 bp, Homo sapiens
tttgttattttg

SEQ ID NO: 4910527 - DNA, 19 bp, Homo sapiens
tttgttcactgaaggtgat

SEQ ID NO: 4910528 - DNA, 19 bp, Homo sapiens
tttgttcatcctattgttg

SEQ ID NO: 4910529 - DNA, 14 bp, Homo sapiens
tttgttcatgtttg

SEQ ID NO: 4910530 - DNA, 15 bp, Homo sapiens
tttgttcttacacat

SEQ ID NO: 4910531 - DNA, 15 bp, Homo sapiens
tttgttgtaaaaaga

SEQ ID NO: 4910532 - DNA, 14 bp, Homo sapiens
tttgtttcctttgt

SEQ ID NO: 4910533 - DNA, 13 bp, Homo sapiens
tttgtttgatgca

SEQ ID NO: 4910534 - DNA, 12 bp, Homo sapiens
tttgtttgtctc

SEQ ID NO: 4910535 - DNA, 18 bp, Homo sapiens
tttgttttacaatgtcat

SEQ ID NO: 4910536 - DNA, 16 bp, Homo sapiens
tttgtttttgcttgtt

SEQ ID NO: 4910537 - DNA, 22 bp, Homo sapiens
tttgtttttttccaactgtgtt

SEQ ID NO: 4910538 - DNA, 13 bp, Homo sapiens
ttttaaaaaaaga

SEQ ID NO: 4910539 - DNA, 15 bp, Homo sapiens
ttttaaaaaaagaaa

SEQ ID NO: 4910540 - DNA, 18 bp, Homo sapiens
ttttaaaaaaagaaaatg

SEQ ID NO: 4910541 - DNA, 16 bp, Homo sapiens
ttttaaaacacttcca

SEQ ID NO: 4910542 - DNA, 22 bp, Homo sapiens
ttttaaaacacttccataatct

SEQ ID NO: 4910543 - DNA, 19 bp, Homo sapiens
ttttaaaagtttcaatgtg

SEQ ID NO: 4910544 - DNA, 16 bp, Homo sapiens
ttttaaaatcaactta

SEQ ID NO: 4910545 - DNA, 13 bp, Homo sapiens
ttttaaacaaaca

SEQ ID NO: 4910546 - DNA, 19 bp, Homo sapiens
ttttaaacagtgagcctga

SEQ ID NO: 4910547 - DNA, 15 bp, Homo sapiens
ttttaaagatctgta

SEQ ID NO: 4910548 - DNA, 18 bp, Homo sapiens
ttttaaaggtggattttg

SEQ ID NO: 4910549 - DNA, 20 bp, Homo sapiens
ttttaaattctgagacatgt

SEQ ID NO: 4910550 - DNA, 24 bp, Homo sapiens
ttttaaattctgagacatgtgtca

SEQ ID NO: 4910551 - DNA, 13 bp, Homo sapiens
ttttaagaaatgt

SEQ ID NO: 4910552 - DNA, 14 bp, Homo sapiens
ttttaagaaatgta

SEQ ID NO: 4910553 - DNA, 15 bp, Homo sapiens
ttttaagaggcaggg

SEQ ID NO: 4910554 - DNA, 19 bp, Homo sapiens
ttttaagatttttctcaaa

SEQ ID NO: 4910555 - DNA, 21 bp, Homo sapiens
ttttaagatttttctcaaagt

SEQ ID NO: 4910556 - DNA, 21 bp, Homo sapiens
ttttaagcactcttaaagcaa

SEQ ID NO: 4910557 - DNA, 12 bp, Homo sapiens
ttttaaggaaac

SEQ ID NO: 4910558 - DNA, 20 bp, Homo sapiens
ttttaagggtttgtggaaaa

SEQ ID NO: 4910559 - DNA, 19 bp, Homo sapiens
ttttaataaactactcttt

SEQ ID NO: 4910560 - DNA, 16 bp, Homo sapiens
ttttaatgcagttgct

SEQ ID NO: 4910561 - DNA, 17 bp, Homo sapiens
ttttaatggattgttaa

SEQ ID NO: 4910562 - DNA, 15 bp, Homo sapiens
ttttaattgtcatgg

SEQ ID NO: 4910563 - DNA, 15 bp, Homo sapiens
ttttaatttaaagct

SEQ ID NO: 4910564 - DNA, 17 bp, Homo sapiens
ttttaatttaacatgaa

SEQ ID NO: 4910565 - DNA, 17 bp, Homo sapiens
ttttacacagaaacact

SEQ ID NO: 4910566 - DNA, 22 bp, Homo sapiens
ttttacacagaaacactgcctt

SEQ ID NO: 4910567 - DNA, 20 bp, Homo sapiens
ttttacctgtcacattgcat

SEQ ID NO: 4910568 - DNA, 23 bp, Homo sapiens
ttttacctgtcacattgcattct

SEQ ID NO: 4910569 - DNA, 20 bp, Homo sapiens
ttttactcattgaaatgtca

SEQ ID NO: 4910570 - DNA, 21 bp, Homo sapiens
ttttagacagtctcactttgt

SEQ ID NO: 4910571 - DNA, 19 bp, Homo sapiens
ttttagatgagattgtttt

SEQ ID NO: 4910572 - DNA, 22 bp, Homo sapiens
ttttagattttctggttctaac

SEQ ID NO: 4910573 - DNA, 21 bp, Homo sapiens
ttttagctgatgaacttattc

SEQ ID NO: 4910574 - DNA, 22 bp, Homo sapiens
ttttagctggtggcaataaata

SEQ ID NO: 4910575 - DNA, 17 bp, Homo sapiens
ttttaggcactcttaaa

SEQ ID NO: 4910576 - DNA, 15 bp, Homo sapiens
ttttaggtagaaaaa

SEQ ID NO: 4910577 - DNA, 23 bp, Homo sapiens
ttttaggtcaagggcttactatt

SEQ ID NO: 4910578 - DNA, 15 bp, Homo sapiens
ttttaggttctaaag

SEQ ID NO: 4910579 - DNA, 15 bp, Homo sapiens
ttttagtaatctgta

SEQ ID NO: 4910580 - DNA, 15 bp, Homo sapiens
ttttagtagagacag

SEQ ID NO: 4910581 - DNA, 20 bp, Homo sapiens
ttttataaatataagccttt

SEQ ID NO: 4910582 - DNA, 19 bp, Homo sapiens
ttttatactctttctgtat

SEQ ID NO: 4910583 - DNA, 14 bp, Homo sapiens
ttttatagtggaaa

SEQ ID NO: 4910584 - DNA, 17 bp, Homo sapiens
ttttatattaatgtact

SEQ ID NO: 4910585 - DNA, 15 bp, Homo sapiens
ttttatcatgacatg

SEQ ID NO: 4910586 - DNA, 19 bp, Homo sapiens
ttttatcatgacatgttat

SEQ ID NO: 4910587 - DNA, 13 bp, Homo sapiens
ttttatgctcttt

SEQ ID NO: 4910588 - DNA, 24 bp, Homo sapiens
ttttatgctcttttttactcattg

SEQ ID NO: 4910589 - DNA, 19 bp, Homo sapiens
ttttatggagacctctcct

SEQ ID NO: 4910590 - DNA, 19 bp, Homo sapiens
ttttatgtagtaattgaca

SEQ ID NO: 4910591 - DNA, 15 bp, Homo sapiens
ttttatgtttagata

SEQ ID NO: 4910592 - DNA, 14 bp, Homo sapiens
ttttatgtttgaat

SEQ ID NO: 4910593 - DNA, 15 bp, Homo sapiens
ttttatgtttgaata

SEQ ID NO: 4910594 - DNA, 16 bp, Homo sapiens
ttttatgtttgaatat

SEQ ID NO: 4910595 - DNA, 15 bp, Homo sapiens
ttttattattgtggt

SEQ ID NO: 4910596 - DNA, 22 bp, Homo sapiens
ttttattattgtggtaggcctt

SEQ ID NO: 4910597 - DNA, 17 bp, Homo sapiens
ttttattatttctatta

SEQ ID NO: 4910598 - DNA, 15 bp, Homo sapiens
ttttattcctgtatg

SEQ ID NO: 4910599 - DNA, 12 bp, Homo sapiens
ttttattgctag

SEQ ID NO: 4910600 - DNA, 17 bp, Homo sapiens
ttttattgctagtattt

SEQ ID NO: 4910601 - DNA, 21 bp, Homo sapiens
ttttattgctagtatttgaat

SEQ ID NO: 4910602 - DNA, 12 bp, Homo sapiens
ttttattgtttt

SEQ ID NO: 4910603 - DNA, 14 bp, Homo sapiens
ttttattgttttca

SEQ ID NO: 4910604 - DNA, 15 bp, Homo sapiens
ttttattttactatt

SEQ ID NO: 4910605 - DNA, 16 bp, Homo sapiens
ttttattttatgttta

SEQ ID NO: 4910606 - DNA, 12 bp, Homo sapiens
ttttattttgaa

SEQ ID NO: 4910607 - DNA, 15 bp, Homo sapiens
ttttcaagcagcatc

SEQ ID NO: 4910608 - DNA, 22 bp, Homo sapiens
ttttcaagcagcatcttctggt

SEQ ID NO: 4910609 - DNA, 13 bp, Homo sapiens
ttttcaaggaagg

SEQ ID NO: 4910610 - DNA, 13 bp, Homo sapiens
ttttcaccccacc

SEQ ID NO: 4910611 - DNA, 20 bp, Homo sapiens
ttttcaccccacccttcccc

SEQ ID NO: 4910612 - DNA, 22 bp, Homo sapiens
ttttcagaaaatattatgtgtt

SEQ ID NO: 4910613 - DNA, 23 bp, Homo sapiens
ttttcagaaaatattatgtgttt

SEQ ID NO: 4910614 - DNA, 22 bp, Homo sapiens
ttttcagagatttatataaatg

SEQ ID NO: 4910615 - DNA, 17 bp, Homo sapiens
ttttcaggagcgcaaga

SEQ ID NO: 4910616 - DNA, 22 bp, Homo sapiens
ttttcaggagcgcaagatagat

SEQ ID NO: 4910617 - DNA, 16 bp, Homo sapiens
ttttcagttccaagaa

SEQ ID NO: 4910618 - DNA, 16 bp, Homo sapiens
ttttcatattgtgcca

SEQ ID NO: 4910619 - DNA, 15 bp, Homo sapiens
ttttcatctgttgtt

SEQ ID NO: 4910620 - DNA, 21 bp, Homo sapiens
ttttcatggtgaaaatgtact

SEQ ID NO: 4910621 - DNA, 13 bp, Homo sapiens
ttttcattttcca

SEQ ID NO: 4910622 - DNA, 15 bp, Homo sapiens
ttttcattttccaat

SEQ ID NO: 4910623 - DNA, 13 bp, Homo sapiens
ttttccagcaagt

SEQ ID NO: 4910624 - DNA, 20 bp, Homo sapiens
ttttccagggcaatcaatgt

SEQ ID NO: 4910625 - DNA, 15 bp, Homo sapiens
ttttccagtctcttg

SEQ ID NO: 4910626 - DNA, 18 bp, Homo sapiens
ttttccagtctcttgtac

SEQ ID NO: 4910627 - DNA, 17 bp, Homo sapiens
ttttcctacaggcagtc

SEQ ID NO: 4910628 - DNA, 17 bp, Homo sapiens
ttttcctagccctctca

SEQ ID NO: 4910629 - DNA, 13 bp, Homo sapiens
ttttcctccctca

SEQ ID NO: 4910630 - DNA, 21 bp, Homo sapiens
ttttcggaggccccactgatg

SEQ ID NO: 4910631 - DNA, 14 bp, Homo sapiens
ttttctaaccttga

SEQ ID NO: 4910632 - DNA, 14 bp, Homo sapiens
ttttctatgtacta

SEQ ID NO: 4910633 - DNA, 17 bp, Homo sapiens
ttttctcactccttttg

SEQ ID NO: 4910634 - DNA, 13 bp, Homo sapiens
ttttctccagctc

SEQ ID NO: 4910635 - DNA, 14 bp, Homo sapiens
ttttctcctcccag

SEQ ID NO: 4910636 - DNA, 21 bp, Homo sapiens
ttttctcttagaacattgtat

SEQ ID NO: 4910637 - DNA, 17 bp, Homo sapiens
ttttctggttctaacat

SEQ ID NO: 4910638 - DNA, 11 bp, Homo sapiens
ttttctgtact

SEQ ID NO: 4910639 - DNA, 11 bp, Homo sapiens
ttttcttcctt

SEQ ID NO: 4910640 - DNA, 21 bp, Homo sapiens
ttttcttggcaaaagccttgt

SEQ ID NO: 4910641 - DNA, 15 bp, Homo sapiens
ttttctttaaagatg

SEQ ID NO: 4910642 - DNA, 17 bp, Homo sapiens
ttttctttgaatgcttt

SEQ ID NO: 4910643 - DNA, 14 bp, Homo sapiens
ttttcttttgttac

SEQ ID NO: 4910644 - DNA, 17 bp, Homo sapiens
ttttcttttgttactgt

SEQ ID NO: 4910645 - DNA, 15 bp, Homo sapiens
ttttctttttacata

SEQ ID NO: 4910646 - DNA, 12 bp, Homo sapiens
ttttgaaatgaa

SEQ ID NO: 4910647 - DNA, 22 bp, Homo sapiens
ttttgaaatgaaatttaaacat

SEQ ID NO: 4910648 - DNA, 20 bp, Homo sapiens
ttttgaaattatgtgacatt

SEQ ID NO: 4910649 - DNA, 13 bp, Homo sapiens
ttttgaaggcaaa

SEQ ID NO: 4910650 - DNA, 19 bp, Homo sapiens
ttttgaagtagtttgtata

SEQ ID NO: 4910651 - DNA, 11 bp, Homo sapiens
ttttgaagttt

SEQ ID NO: 4910652 - DNA, 18 bp, Homo sapiens
ttttgaagtttacatttt

SEQ ID NO: 4910653 - DNA, 23 bp, Homo sapiens
ttttgacagtgttgaaaatgttc

SEQ ID NO: 4910654 - DNA, 24 bp, Homo sapiens
ttttgacagtgttgaaaatgttca

SEQ ID NO: 4910655 - DNA, 17 bp, Homo sapiens
ttttgagacagaatctc

SEQ ID NO: 4910656 - DNA, 15 bp, Homo sapiens
ttttgaggagcccca

SEQ ID NO: 4910657 - DNA, 18 bp, Homo sapiens
ttttgagtagatattact

SEQ ID NO: 4910658 - DNA, 19 bp, Homo sapiens
ttttgagtagatattactt

SEQ ID NO: 4910659 - DNA, 14 bp, Homo sapiens
ttttgagtgtgtgt

SEQ ID NO: 4910660 - DNA, 18 bp, Homo sapiens
ttttgataataaattgaa

SEQ ID NO: 4910661 - DNA, 15 bp, Homo sapiens
ttttgatgcagcatt

SEQ ID NO: 4910662 - DNA, 17 bp, Homo sapiens
ttttgatgcagcatttg

SEQ ID NO: 4910663 - DNA, 19 bp, Homo sapiens
ttttgcaaatataaacatc

SEQ ID NO: 4910664 - DNA, 20 bp, Homo sapiens
ttttgcaaatataaacatct

SEQ ID NO: 4910665 - DNA, 21 bp, Homo sapiens
ttttgcagcccagacaaatgt

SEQ ID NO: 4910666 - DNA, 20 bp, Homo sapiens
ttttgccatacatcagttat

SEQ ID NO: 4910667 - DNA, 23 bp, Homo sapiens
ttttgcttgttatattaagcaga

SEQ ID NO: 4910668 - DNA, 19 bp, Homo sapiens
ttttggggttgtgttgtca

SEQ ID NO: 4910669 - DNA, 17 bp, Homo sapiens
ttttggtagattaaata

SEQ ID NO: 4910670 - DNA, 17 bp, Homo sapiens
ttttggtgattcaaatg

SEQ ID NO: 4910671 - DNA, 21 bp, Homo sapiens
ttttgtaaacgacaagaataa

SEQ ID NO: 4910672 - DNA, 19 bp, Homo sapiens
ttttgtaaagaaatttact

SEQ ID NO: 4910673 - DNA, 21 bp, Homo sapiens
ttttgtatacaaatatattgt

SEQ ID NO: 4910674 - DNA, 20 bp, Homo sapiens
ttttgtcccccaacttgaga

SEQ ID NO: 4910675 - DNA, 21 bp, Homo sapiens
ttttgtgatgtcccaacttgt

SEQ ID NO: 4910676 - DNA, 19 bp, Homo sapiens
ttttgtgatttagaactgt

SEQ ID NO: 4910677 - DNA, 21 bp, Homo sapiens
ttttgtgcaaaagcttcaaat

SEQ ID NO: 4910678 - DNA, 22 bp, Homo sapiens
ttttgtgcatttgtaaatgctg

SEQ ID NO: 4910679 - DNA, 17 bp, Homo sapiens
ttttgtgtaatgaaaat

SEQ ID NO: 4910680 - DNA, 15 bp, Homo sapiens
ttttgttaactgatt

SEQ ID NO: 4910681 - DNA, 14 bp, Homo sapiens
ttttgttactgttc

SEQ ID NO: 4910682 - DNA, 19 bp, Homo sapiens
ttttgttactgttcttgct

SEQ ID NO: 4910683 - DNA, 18 bp, Homo sapiens
ttttgttatcagtcaata

SEQ ID NO: 4910684 - DNA, 22 bp, Homo sapiens
ttttgttcttacacatacagtt

SEQ ID NO: 4910685 - DNA, 15 bp, Homo sapiens
ttttgttgtaaaaag

SEQ ID NO: 4910686 - DNA, 14 bp, Homo sapiens
ttttgtttgatgca

SEQ ID NO: 4910687 - DNA, 20 bp, Homo sapiens
ttttgtttgatgcaggcact

SEQ ID NO: 4910688 - DNA, 14 bp, Homo sapiens
ttttgtttgtttct

SEQ ID NO: 4910689 - DNA, 21 bp, Homo sapiens
ttttgtttgtttctttgtgtt

SEQ ID NO: 4910690 - DNA, 17 bp, Homo sapiens
tttttaaaaaaagaaaa

SEQ ID NO: 4910691 - DNA, 19 bp, Homo sapiens
tttttaaaagtttcaatgt

SEQ ID NO: 4910692 - DNA, 17 bp, Homo sapiens
tttttaaaatatttatt

SEQ ID NO: 4910693 - DNA, 14 bp, Homo sapiens
tttttaaaatggtg

SEQ ID NO: 4910694 - DNA, 13 bp, Homo sapiens
tttttaaataaac

SEQ ID NO: 4910695 - DNA, 23 bp, Homo sapiens
tttttaaatgtatactatagtac

SEQ ID NO: 4910696 - DNA, 13 bp, Homo sapiens
tttttaagatttt

SEQ ID NO: 4910697 - DNA, 16 bp, Homo sapiens
tttttaatctagacaa

SEQ ID NO: 4910698 - DNA, 10 bp, Homo sapiens
tttttaatgg

SEQ ID NO: 4910699 - DNA, 21 bp, Homo sapiens
tttttaatttattattgaaat

SEQ ID NO: 4910700 - DNA, 18 bp, Homo sapiens
tttttacaagttttaaat

SEQ ID NO: 4910701 - DNA, 12 bp, Homo sapiens
tttttacatttt

SEQ ID NO: 4910702 - DNA, 15 bp, Homo sapiens
tttttacctgtcaca

SEQ ID NO: 4910703 - DNA, 21 bp, Homo sapiens
tttttacctgtcacattgcat

SEQ ID NO: 4910704 - DNA, 23 bp, Homo sapiens
tttttactcattgaaatgtcacg

SEQ ID NO: 4910705 - DNA, 13 bp, Homo sapiens
tttttactgtgtt

SEQ ID NO: 4910706 - DNA, 15 bp, Homo sapiens
tttttagtaatctgt

SEQ ID NO: 4910707 - DNA, 20 bp, Homo sapiens
tttttagtaatctgtacatt

SEQ ID NO: 4910708 - DNA, 23 bp, Homo sapiens
tttttagtatttatttatgtact

SEQ ID NO: 4910709 - DNA, 15 bp, Homo sapiens
tttttatattaatgt

SEQ ID NO: 4910710 - DNA, 15 bp, Homo sapiens
tttttatatttagtt

SEQ ID NO: 4910711 - DNA, 20 bp, Homo sapiens
tttttatgaggcaacctgat

SEQ ID NO: 4910712 - DNA, 14 bp, Homo sapiens
tttttcagttccaa

SEQ ID NO: 4910713 - DNA, 17 bp, Homo sapiens
tttttcagttccaagaa

SEQ ID NO: 4910714 - DNA, 14 bp, Homo sapiens
tttttcattttcca

SEQ ID NO: 4910715 - DNA, 16 bp, Homo sapiens
tttttcattttccaat

SEQ ID NO: 4910716 - DNA, 13 bp, Homo sapiens
tttttccatcttt

SEQ ID NO: 4910717 - DNA, 23 bp, Homo sapiens
tttttcctaacaaaagatgaaag

SEQ ID NO: 4910718 - DNA, 16 bp, Homo sapiens
tttttcctttttctga

SEQ ID NO: 4910719 - DNA, 17 bp, Homo sapiens
tttttcctttttctgat

SEQ ID NO: 4910720 - DNA, 11 bp, Homo sapiens
tttttctgatt

SEQ ID NO: 4910721 - DNA, 17 bp, Homo sapiens
tttttgaaaaaagctca

SEQ ID NO: 4910722 - DNA, 15 bp, Homo sapiens
tttttgaagtcttgt

SEQ ID NO: 4910723 - DNA, 19 bp, Homo sapiens
tttttgaagtcttgtataa

SEQ ID NO: 4910724 - DNA, 16 bp, Homo sapiens
tttttgactcccagat

SEQ ID NO: 4910725 - DNA, 15 bp, Homo sapiens
tttttgataaagcct

SEQ ID NO: 4910726 - DNA, 20 bp, Homo sapiens
tttttgggcagcaatttaaa

SEQ ID NO: 4910727 - DNA, 23 bp, Homo sapiens
tttttgggcagcaatttaaatgt

SEQ ID NO: 4910728 - DNA, 15 bp, Homo sapiens
tttttgtaaactgga

SEQ ID NO: 4910729 - DNA, 20 bp, Homo sapiens
tttttgtagtgacctgttta

SEQ ID NO: 4910730 - DNA, 18 bp, Homo sapiens
ttttttaaaaaaagaaaa

SEQ ID NO: 4910731 - DNA, 11 bp, Homo sapiens
ttttttaagat

SEQ ID NO: 4910732 - DNA, 12 bp, Homo sapiens
ttttttaagatt

SEQ ID NO: 4910733 - DNA, 13 bp, Homo sapiens
ttttttacagatt

SEQ ID NO: 4910734 - DNA, 13 bp, Homo sapiens
ttttttccatctt

SEQ ID NO: 4910735 - DNA, 13 bp, Homo sapiens
tttttttcaatgt

SEQ ID NO: 4910736 - DNA, 13 bp, Homo sapiens
tttttttttaaac

SEQ ID NO: 4910737 - DNA, 21 bp, Homo sapiens
cagcccctcccccatctccca

SEQ ID NO: 4910738 - DNA, 13 bp, Homo sapiens
cagcccctgcaca

SEQ ID NO: 4910739 - DNA, 14 bp, Homo sapiens
cagcccgggagcct

SEQ ID NO: 4910740 - DNA, 15 bp, Homo sapiens
cagcccgggagccta

SEQ ID NO: 4910741 - DNA, 19 bp, Homo sapiens
cagcccgggagcctaggac

SEQ ID NO: 4910742 - DNA, 21 bp, Homo sapiens
cagccctagagcctgcctgga

SEQ ID NO: 4910743 - DNA, 13 bp, Homo sapiens
cagccctccctgc

SEQ ID NO: 4910744 - DNA, 15 bp, Homo sapiens
cagccctccctgccc

SEQ ID NO: 4910745 - DNA, 16 bp, Homo sapiens
cagccctccctgcccc

SEQ ID NO: 4910746 - DNA, 18 bp, Homo sapiens
cagccctccctgcccctc

SEQ ID NO: 4910747 - DNA, 22 bp, Homo sapiens
cagccctccctgcccctccctt

SEQ ID NO: 4910748 - DNA, 22 bp, Homo sapiens
cagccctgaggtgaaagggagc

SEQ ID NO: 4910749 - DNA, 21 bp, Homo sapiens
cagccctgctttgggctgccc

SEQ ID NO: 4910750 - DNA, 22 bp, Homo sapiens
cagccctgctttgggctgccct

SEQ ID NO: 4910751 - DNA, 12 bp, Homo sapiens
cagccctggctc

SEQ ID NO: 4910752 - DNA, 16 bp, Homo sapiens
cagccctggctctgca

SEQ ID NO: 4910753 - DNA, 18 bp, Homo sapiens
cagccgccatcagcccaa

SEQ ID NO: 4910754 - DNA, 17 bp, Homo sapiens
cagccgccattgccacc

SEQ ID NO: 4910755 - DNA, 19 bp, Homo sapiens
cagccgccattgccaccag

SEQ ID NO: 4910756 - DNA, 21 bp, Homo sapiens
cagccgccattgccaccagga

SEQ ID NO: 4910757 - DNA, 22 bp, Homo sapiens
cagccgccattgccaccaggag

SEQ ID NO: 4910758 - DNA, 18 bp, Homo sapiens
cagccgccttccttgacc

SEQ ID NO: 4910759 - DNA, 22 bp, Homo sapiens
cagccgccttccttgaccttcc

SEQ ID NO: 4910760 - DNA, 23 bp, Homo sapiens
cagccgccttccttgaccttcct

SEQ ID NO: 4910761 - DNA, 20 bp, Homo sapiens
cagccggcgtggcaaatata

SEQ ID NO: 4910762 - DNA, 16 bp, Homo sapiens
cagcctcacccttgcg

SEQ ID NO: 4910763 - DNA, 14 bp, Homo sapiens
cagcctccatgctg

SEQ ID NO: 4910764 - DNA, 21 bp, Homo sapiens
cagcctcccaaagtgctgaga

SEQ ID NO: 4910765 - DNA, 19 bp, Homo sapiens
cagcctcccaaagtgctgg

SEQ ID NO: 4910766 - DNA, 14 bp, Homo sapiens
cagcctcccacccc

SEQ ID NO: 4910767 - DNA, 19 bp, Homo sapiens
cagcctcccacccccatct

SEQ ID NO: 4910768 - DNA, 22 bp, Homo sapiens
cagcctcccgaatagctgggac

SEQ ID NO: 4910769 - DNA, 23 bp, Homo sapiens
cagcctcccgaatagctgggact

SEQ ID NO: 4910770 - DNA, 19 bp, Homo sapiens
cagcctcccgagtagctgg

SEQ ID NO: 4910771 - DNA, 22 bp, Homo sapiens
cagcctcccgagtagctgggac

SEQ ID NO: 4910772 - DNA, 12 bp, Homo sapiens
cagcctcctctg

SEQ ID NO: 4910773 - DNA, 14 bp, Homo sapiens
cagcctctgacccc

SEQ ID NO: 4910774 - DNA, 17 bp, Homo sapiens
cagcctctgacccctcc

SEQ ID NO: 4910775 - DNA, 13 bp, Homo sapiens
cagcctctggcat

SEQ ID NO: 4910776 - DNA, 15 bp, Homo sapiens
cagcctcttaaagct

SEQ ID NO: 4910777 - DNA, 18 bp, Homo sapiens
cagcctcttggccccaga

SEQ ID NO: 4910778 - DNA, 22 bp, Homo sapiens
cagcctgaccttccttcctgtt

SEQ ID NO: 4910779 - DNA, 16 bp, Homo sapiens
cagcctgagcaactct

SEQ ID NO: 4910780 - DNA, 14 bp, Homo sapiens
cagcctgcacagtg

SEQ ID NO: 4910781 - DNA, 20 bp, Homo sapiens
cagcctgggcagcatagcaa

SEQ ID NO: 4910782 - DNA, 17 bp, Homo sapiens
cagcctgggcagccagg

SEQ ID NO: 4910783 - DNA, 19 bp, Homo sapiens
cagcctggtccatgcaggg

SEQ ID NO: 4910784 - DNA, 19 bp, Homo sapiens
cagcctgtcccatggacac

SEQ ID NO: 4910785 - DNA, 21 bp, Homo sapiens
cagcctgtggcatctttgcct

SEQ ID NO: 4910786 - DNA, 17 bp, Homo sapiens
cagcctttgcctccccg

SEQ ID NO: 4910787 - DNA, 19 bp, Homo sapiens
cagcgaagtagcttgctcc

SEQ ID NO: 4910788 - DNA, 19 bp, Homo sapiens
cagcgacatagcccatccc

SEQ ID NO: 4910789 - DNA, 18 bp, Homo sapiens
cagggaggtcaggccctg

SEQ ID NO: 4910790 - DNA, 20 bp, Homo sapiens
cagggaggtcaggccctgga

SEQ ID NO: 4910791 - DNA, 20 bp, Homo sapiens
cagggcaaatgacatgcact

SEQ ID NO: 4910792 - DNA, 21 bp, Homo sapiens
cagggcaaatgacatgcactg

SEQ ID NO: 4910793 - DNA, 23 bp, Homo sapiens
cagggcaaatgacatgcactgac

SEQ ID NO: 4910794 - DNA, 15 bp, Homo sapiens
cagggcacaccgggc

SEQ ID NO: 4910795 - DNA, 17 bp, Homo sapiens
cagggcacaccgggcac

SEQ ID NO: 4910796 - DNA, 21 bp, Homo sapiens
cagggcacaccgggcactcag

SEQ ID NO: 4910797 - DNA, 12 bp, Homo sapiens
cagggcagcccc

SEQ ID NO: 4910798 - DNA, 18 bp, Homo sapiens
cagggcatgccccggcca

SEQ ID NO: 4910799 - DNA, 22 bp, Homo sapiens
cagggccaacttgagggcccag

SEQ ID NO: 4910800 - DNA, 12 bp, Homo sapiens
cagggccaggac

SEQ ID NO: 4910801 - DNA, 15 bp, Homo sapiens
cagggccaggactga

SEQ ID NO: 4910802 - DNA, 15 bp, Homo sapiens
cagggccagtggggc

SEQ ID NO: 4910803 - DNA, 13 bp, Homo sapiens
cagggcccagagg

SEQ ID NO: 4910804 - DNA, 16 bp, Homo sapiens
cagggcccagaggctg

SEQ ID NO: 4910805 - DNA, 17 bp, Homo sapiens
cagggcccagaggctga

SEQ ID NO: 4910806 - DNA, 14 bp, Homo sapiens
cagggccgaggagg

SEQ ID NO: 4910807 - DNA, 14 bp, Homo sapiens
cagggcctggggcc

SEQ ID NO: 4910808 - DNA, 20 bp, Homo sapiens
cagggcctggggcctgagag

SEQ ID NO: 4910809 - DNA, 20 bp, Homo sapiens
cagggctcagcggggacagc

SEQ ID NO: 4910810 - DNA, 21 bp, Homo sapiens
cagggctcagcggggacagct

SEQ ID NO: 4910811 - DNA, 13 bp, Homo sapiens
cagggctcctccc

SEQ ID NO: 4910812 - DNA, 15 bp, Homo sapiens
cagggctcctcccag

SEQ ID NO: 4910813 - DNA, 16 bp, Homo sapiens
cagggctcctcccagc

SEQ ID NO: 4910814 - DNA, 19 bp, Homo sapiens
cagggctcctcccagcttg

SEQ ID NO: 4910815 - DNA, 20 bp, Homo sapiens
cagggctcctcccagcttgt

SEQ ID NO: 4910816 - DNA, 17 bp, Homo sapiens
cagggctctgccccagt

SEQ ID NO: 4910817 - DNA, 22 bp, Homo sapiens
cagggctgccctgagaagctgc

SEQ ID NO: 4910818 - DNA, 23 bp, Homo sapiens
cagggctgccctgagaagctgct

SEQ ID NO: 4910819 - DNA, 19 bp, Homo sapiens
cagggctggccccagggca

SEQ ID NO: 4910820 - DNA, 20 bp, Homo sapiens
cagggctggccccagggcac

SEQ ID NO: 4910821 - DNA, 23 bp, Homo sapiens
cagggctggccccagggcaccct

SEQ ID NO: 4910822 - DNA, 19 bp, Homo sapiens
cagggcttacctgtacact

SEQ ID NO: 4910823 - DNA, 17 bp, Homo sapiens
caggggactcagccctg

SEQ ID NO: 4910824 - DNA, 23 bp, Homo sapiens
caggggactcagccctgaggtga

SEQ ID NO: 4910825 - DNA, 16 bp, Homo sapiens
caggggaggtgatagc

SEQ ID NO: 4910826 - DNA, 22 bp, Homo sapiens
caggggcccaaggcggcccctc

SEQ ID NO: 4910827 - DNA, 15 bp, Homo sapiens
caggggctctggaga

SEQ ID NO: 4910828 - DNA, 21 bp, Homo sapiens
cagggggaagaagcagagaga

SEQ ID NO: 4910829 - DNA, 17 bp, Homo sapiens
cagggggcatgaccaga

SEQ ID NO: 4910830 - DNA, 21 bp, Homo sapiens
cagggtaactgtgctgaatgc

SEQ ID NO: 4910831 - DNA, 15 bp, Homo sapiens
cagggtctcactctg

SEQ ID NO: 4910832 - DNA, 17 bp, Homo sapiens
cagggtctcactctgtc

SEQ ID NO: 4910833 - DNA, 21 bp, Homo sapiens
cagggtctcactctgtcgccc

SEQ ID NO: 4910834 - DNA, 23 bp, Homo sapiens
cagggtctcactctgtcgcccag

SEQ ID NO: 4910835 - DNA, 16 bp, Homo sapiens
cagggtctctccctca

SEQ ID NO: 4910836 - DNA, 20 bp, Homo sapiens
cagggtctctccctcaggtg

SEQ ID NO: 4910837 - DNA, 23 bp, Homo sapiens
cagggtctgtgtgaatgtgggca

SEQ ID NO: 4910838 - DNA, 17 bp, Homo sapiens
cagggtcttccctacct

SEQ ID NO: 4910839 - DNA, 22 bp, Homo sapiens
cagggtgcccagaacttccctg

SEQ ID NO: 4910840 - DNA, 20 bp, Homo sapiens
cagggtgtgagcgccacatc

SEQ ID NO: 4910841 - DNA, 23 bp, Homo sapiens
cagggttctccctcccaccttaa

SEQ ID NO: 4910842 - DNA, 15 bp, Homo sapiens
cagggttggcccctg

SEQ ID NO: 4910843 - DNA, 21 bp, Homo sapiens
cagggttggcccctgcccggc

SEQ ID NO: 4910844 - DNA, 13 bp, Homo sapiens
cagggttgggccc

SEQ ID NO: 4910845 - DNA, 15 bp, Homo sapiens
cagggttggtgtgct

SEQ ID NO: 4910846 - DNA, 18 bp, Homo sapiens
cagggttggtgtgctgag

SEQ ID NO: 4910847 - DNA, 16 bp, Homo sapiens
cagggttttgccatgt

SEQ ID NO: 4910848 - DNA, 19 bp, Homo sapiens
cagggtttttacctgtcac

SEQ ID NO: 4910849 - DNA, 15 bp, Homo sapiens
caggtaacaggcaga

SEQ ID NO: 4910850 - DNA, 16 bp, Homo sapiens
caggtaacaggcagat

SEQ ID NO: 4910851 - DNA, 18 bp, Homo sapiens
caggtattattatcttta

SEQ ID NO: 4910852 - DNA, 22 bp, Homo sapiens
gttaagagaaactttatacatt

SEQ ID NO: 4910853 - DNA, 18 bp, Homo sapiens
gttaagcattaccactca

SEQ ID NO: 4910854 - DNA, 21 bp, Homo sapiens
gttaagcattaccactcaggc

SEQ ID NO: 4910855 - DNA, 16 bp, Homo sapiens
gttaaggaaactctta

SEQ ID NO: 4910856 - DNA, 22 bp, Homo sapiens
gttaaggaccgtggccctgccc

SEQ ID NO: 4910857 - DNA, 21 bp, Homo sapiens
gttaatatatcccagaaatta

SEQ ID NO: 4910858 - DNA, 18 bp, Homo sapiens
gttaatctctgttatgta

SEQ ID NO: 4910859 - DNA, 22 bp, Homo sapiens
gttaatctctgttatgtactgt

SEQ ID NO: 4910860 - DNA, 17 bp, Homo sapiens
gttaatttatctaaatt

SEQ ID NO: 4910861 - DNA, 21 bp, Homo sapiens
gttaatttatctaaattaaag

SEQ ID NO: 4910862 - DNA, 13 bp, Homo sapiens
gttacaagtatac

SEQ ID NO: 4910863 - DNA, 21 bp, Homo sapiens
gttaccatatttatccatttg

SEQ ID NO: 4910864 - DNA, 23 bp, Homo sapiens
gttaccattttggggtacccact

SEQ ID NO: 4910865 - DNA, 23 bp, Homo sapiens
gttacctccaacagaactaaatg

SEQ ID NO: 4910866 - DNA, 12 bp, Homo sapiens
gttactattttc

SEQ ID NO: 4910867 - DNA, 22 bp, Homo sapiens
gttactcagggctcctcccagc

SEQ ID NO: 4910868 - DNA, 10 bp, Homo sapiens
gttactgttc

SEQ ID NO: 4910869 - DNA, 15 bp, Homo sapiens
gttactgttcttgct

SEQ ID NO: 4910870 - DNA, 17 bp, Homo sapiens
gttagaatctattttct

SEQ ID NO: 4910871 - DNA, 22 bp, Homo sapiens
gttagaccgctctcttttctgt

SEQ ID NO: 4910872 - DNA, 23 bp, Homo sapiens
gttagaccgctctcttttctgta

SEQ ID NO: 4910873 - DNA, 23 bp, Homo sapiens
gttagactgacttgtttgtcttc

SEQ ID NO: 4910874 - DNA, 22 bp, Homo sapiens
gttagagagggaccatgtgtca

SEQ ID NO: 4910875 - DNA, 16 bp, Homo sapiens
gttagcactgttgatg

SEQ ID NO: 4910876 - DNA, 19 bp, Homo sapiens
gttagctttttaaaacatt

SEQ ID NO: 4910877 - DNA, 14 bp, Homo sapiens
gttaggaaataaaa

SEQ ID NO: 4910878 - DNA, 21 bp, Homo sapiens
gttaggtagagggagttgtca

SEQ ID NO: 4910879 - DNA, 17 bp, Homo sapiens
gttagttatagatgtct

SEQ ID NO: 4910880 - DNA, 16 bp, Homo sapiens
gttagtttctttggga

SEQ ID NO: 4910881 - DNA, 14 bp, Homo sapiens
gttatatcaacaga

SEQ ID NO: 4910882 - DNA, 17 bp, Homo sapiens
gttatatcccctgctac

SEQ ID NO: 4910883 - DNA, 17 bp, Homo sapiens
gttatatttaatgcatt

SEQ ID NO: 4910884 - DNA, 15 bp, Homo sapiens
gttatcgaaataaca

SEQ ID NO: 4910885 - DNA, 13 bp, Homo sapiens
gttatctctgtgt

SEQ ID NO: 4910886 - DNA, 17 bp, Homo sapiens
gttatgaaagaatatat

SEQ ID NO: 4910887 - DNA, 18 bp, Homo sapiens
gttatgaaagaatatatt

SEQ ID NO: 4910888 - DNA, 20 bp, Homo sapiens
gttatgaaagaatatattta

SEQ ID NO: 4910889 - DNA, 17 bp, Homo sapiens
gttatgtactagtgttc

SEQ ID NO: 4910890 - DNA, 13 bp, Homo sapiens
gttatgtactgta

SEQ ID NO: 4910891 - DNA, 17 bp, Homo sapiens
gttatgtactgtactaa

SEQ ID NO: 4910892 - DNA, 15 bp, Homo sapiens
gttatgtctgtttaa

SEQ ID NO: 4910893 - DNA, 20 bp, Homo sapiens
gttatgtgtatgtgccattt

SEQ ID NO: 4910894 - DNA, 18 bp, Homo sapiens
gttattccttgatcattt

SEQ ID NO: 4910895 - DNA, 14 bp, Homo sapiens
gttattgtgaatga

SEQ ID NO: 4910896 - DNA, 12 bp, Homo sapiens
gttatttagact

SEQ ID NO: 4910897 - DNA, 16 bp, Homo sapiens
gttatttgcacactgc

SEQ ID NO: 4910898 - DNA, 18 bp, Homo sapiens
gttatttgttattttcag

SEQ ID NO: 4910899 - DNA, 14 bp, Homo sapiens
gttattttcagtat

SEQ ID NO: 4910900 - DNA, 15 bp, Homo sapiens
gttattttcttctaa

SEQ ID NO: 4910901 - DNA, 18 bp, Homo sapiens
gttatttttcaaggaagg

SEQ ID NO: 4910902 - DNA, 15 bp, Homo sapiens
gttcaacttccagaa

SEQ ID NO: 4910903 - DNA, 15 bp, Homo sapiens
gttcacaccctgcaa

SEQ ID NO: 4910904 - DNA, 17 bp, Homo sapiens
gttcacaccctgcaagg

SEQ ID NO: 4910905 - DNA, 16 bp, Homo sapiens
gttcacattagaatta

SEQ ID NO: 4910906 - DNA, 15 bp, Homo sapiens
gttcacgcaacttga

SEQ ID NO: 4910907 - DNA, 17 bp, Homo sapiens
gttcagcaccaccctag

SEQ ID NO: 4910908 - DNA, 15 bp, Homo sapiens
gttcagctccagctc

SEQ ID NO: 4910909 - DNA, 18 bp, Homo sapiens
gttcagctgtcctccctc

SEQ ID NO: 4910910 - DNA, 22 bp, Homo sapiens
gttcagggttggcccctgcccg

SEQ ID NO: 4910911 - DNA, 17 bp, Homo sapiens
gttcaggtaacaggcag

SEQ ID NO: 4910912 - DNA, 16 bp, Homo sapiens
gttcatacctaagtac

SEQ ID NO: 4910913 - DNA, 20 bp, Homo sapiens
gttcatacctaagtactgta

SEQ ID NO: 4910914 - DNA, 21 bp, Homo sapiens
gttcatacctaagtactgtaa

SEQ ID NO: 4910915 - DNA, 23 bp, Homo sapiens
gttcatgatgcagtctcctcttt

SEQ ID NO: 4910916 - DNA, 19 bp, Homo sapiens
gttcatgtagagaaaagca

SEQ ID NO: 4910917 - DNA, 10 bp, Homo sapiens
gttcatgttt

SEQ ID NO: 4910918 - DNA, 16 bp, Homo sapiens
gttcatttgtgtgctc

SEQ ID NO: 4910919 - DNA, 14 bp, Homo sapiens
gttccaagagtcta

SEQ ID NO: 4910920 - DNA, 18 bp, Homo sapiens
gttccaagagtctaaaga

SEQ ID NO: 4910921 - DNA, 16 bp, Homo sapiens
gttccaatcctggctc

SEQ ID NO: 4910922 - DNA, 16 bp, Homo sapiens
gttccacgtgttttat

SEQ ID NO: 4910923 - DNA, 22 bp, Homo sapiens
gttccatctcctataatctgtc

SEQ ID NO: 4910924 - DNA, 16 bp, Homo sapiens
gttccatgggatacaa

SEQ ID NO: 4910925 - DNA, 17 bp, Homo sapiens
gttcccatgtagccccc

SEQ ID NO: 4910926 - DNA, 18 bp, Homo sapiens
gttcccatgtagccccct

SEQ ID NO: 4910927 - DNA, 17 bp, Homo sapiens
gttcccctgttcactct

SEQ ID NO: 4910928 - DNA, 14 bp, Homo sapiens
gttcccgtttctcc

SEQ ID NO: 4910929 - DNA, 16 bp, Homo sapiens
gttccctgaaacacga

SEQ ID NO: 4910930 - DNA, 16 bp, Homo sapiens
gttccctgtcttgtcc

SEQ ID NO: 4910931 - DNA, 16 bp, Homo sapiens
gttcccttggcctcag

SEQ ID NO: 4910932 - DNA, 19 bp, Homo sapiens
gttcccttggcctcagaat

SEQ ID NO: 4910933 - DNA, 19 bp, Homo sapiens
gttccctttccttccatcc

SEQ ID NO: 4910934 - DNA, 22 bp, Homo sapiens
gttccctttccttccatcccta

SEQ ID NO: 4910935 - DNA, 16 bp, Homo sapiens
gttccctttgtctttc

SEQ ID NO: 4910936 - DNA, 14 bp, Homo sapiens
gttccgcactttcc

SEQ ID NO: 4910937 - DNA, 18 bp, Homo sapiens
gttcctaagaagcttcta

SEQ ID NO: 4910938 - DNA, 12 bp, Homo sapiens
gttcctctctgg

SEQ ID NO: 4910939 - DNA, 21 bp, Homo sapiens
gttcctgacatcacagcagcc

SEQ ID NO: 4910940 - DNA, 18 bp, Homo sapiens
gttcctttgtgtgtactc

SEQ ID NO: 4910941 - DNA, 14 bp, Homo sapiens
gttcctttttatga

SEQ ID NO: 4910942 - DNA, 19 bp, Homo sapiens
gttcgcttggctccatgct

SEQ ID NO: 4910943 - DNA, 14 bp, Homo sapiens
gttcggctctgggt

SEQ ID NO: 4910944 - DNA, 13 bp, Homo sapiens
gttcgtagctttc

SEQ ID NO: 4910945 - DNA, 16 bp, Homo sapiens
gttctaaagttctaag

SEQ ID NO: 4910946 - DNA, 17 bp, Homo sapiens
gttctaaagttctaaga

SEQ ID NO: 4910947 - DNA, 19 bp, Homo sapiens
gttctaaagttctaagatt

SEQ ID NO: 4910948 - DNA, 21 bp, Homo sapiens
gttctaaagttctaagattct

SEQ ID NO: 4910949 - DNA, 20 bp, Homo sapiens
gttctaagactcaaatgttc

SEQ ID NO: 4910950 - DNA, 20 bp, Homo sapiens
gttctaagattctaatgatg

SEQ ID NO: 4910951 - DNA, 11 bp, Homo sapiens
gttctaaggct

SEQ ID NO: 4910952 - DNA, 14 bp, Homo sapiens
gttctaagtttcta

SEQ ID NO: 4910953 - DNA, 15 bp, Homo sapiens
gttctaagtttctaa

SEQ ID NO: 4910954 - DNA, 18 bp, Homo sapiens
gttctaagtttctaagat

SEQ ID NO: 4910955 - DNA, 22 bp, Homo sapiens
gttctaagtttctaagattcta

SEQ ID NO: 4910956 - DNA, 17 bp, Homo sapiens
gttctaataatttctaa

SEQ ID NO: 4910957 - DNA, 19 bp, Homo sapiens
gttctacggatcatcaaca

SEQ ID NO: 4910958 - DNA, 22 bp, Homo sapiens
gttctaggcactgtagttctaa

SEQ ID NO: 4910959 - DNA, 14 bp, Homo sapiens
gttctaggtttcaa

SEQ ID NO: 4910960 - DNA, 12 bp, Homo sapiens
gttctatccaaa

SEQ ID NO: 4910961 - DNA, 21 bp, Homo sapiens
gttctatccaaacatgtattt

SEQ ID NO: 4910962 - DNA, 14 bp, Homo sapiens
taaagtttgcttag

SEQ ID NO: 4910963 - DNA, 21 bp, Homo sapiens
taaataaaacttaaatctcac

SEQ ID NO: 4910964 - DNA, 22 bp, Homo sapiens
taaataaacctcaaaatgtcta

SEQ ID NO: 4910965 - DNA, 11 bp, Homo sapiens
taaataaactt

SEQ ID NO: 4910966 - DNA, 20 bp, Homo sapiens
taaataaactttttttcaat

SEQ ID NO: 4910967 - DNA, 13 bp, Homo sapiens
taaataagattct

SEQ ID NO: 4910968 - DNA, 14 bp, Homo sapiens
taaataatttaact

SEQ ID NO: 4910969 - DNA, 17 bp, Homo sapiens
taaataatttaactacc

SEQ ID NO: 4910970 - DNA, 12 bp, Homo sapiens
taaataccagga

SEQ ID NO: 4910971 - DNA, 12 bp, Homo sapiens
taaataccattg

SEQ ID NO: 4910972 - DNA, 17 bp, Homo sapiens
taaataccattgacaca

SEQ ID NO: 4910973 - DNA, 14 bp, Homo sapiens
taaatataagcctt

SEQ ID NO: 4910974 - DNA, 18 bp, Homo sapiens
taaatataattctgtaaa

SEQ ID NO: 4910975 - DNA, 17 bp, Homo sapiens
taaatatagattagaaa

SEQ ID NO: 4910976 - DNA, 20 bp, Homo sapiens
taaatatagattagaaaaat

SEQ ID NO: 4910977 - DNA, 15 bp, Homo sapiens
taaatatagttccta

SEQ ID NO: 4910978 - DNA, 14 bp, Homo sapiens
taaatatatataaa

SEQ ID NO: 4910979 - DNA, 22 bp, Homo sapiens
taaatatcaatcaagccatgta

SEQ ID NO: 4910980 - DNA, 20 bp, Homo sapiens
taaatatcttttatgtttga

SEQ ID NO: 4910981 - DNA, 21 bp, Homo sapiens
taaatatcttttatgtttgaa

SEQ ID NO: 4910982 - DNA, 22 bp, Homo sapiens
taaatatgaaccctttgtttct

SEQ ID NO: 4910983 - DNA, 19 bp, Homo sapiens
taaatattagttaatggat

SEQ ID NO: 4910984 - DNA, 20 bp, Homo sapiens
taaatattagttaatggatt

SEQ ID NO: 4910985 - DNA, 19 bp, Homo sapiens
taaatattctatatgaatt

SEQ ID NO: 4910986 - DNA, 20 bp, Homo sapiens
taaatcatattgatgaaaag

SEQ ID NO: 4910987 - DNA, 14 bp, Homo sapiens
taaatctaaatcta

SEQ ID NO: 4910988 - DNA, 14 bp, Homo sapiens
taaatcttttacaa

SEQ ID NO: 4910989 - DNA, 18 bp, Homo sapiens
taaatgaaaatcgtgaca

SEQ ID NO: 4910990 - DNA, 15 bp, Homo sapiens
taaatgaaattgtaa

SEQ ID NO: 4910991 - DNA, 16 bp, Homo sapiens
taaatgaaattgtaaa

SEQ ID NO: 4910992 - DNA, 16 bp, Homo sapiens
taaatgaagcagcttt

SEQ ID NO: 4910993 - DNA, 17 bp, Homo sapiens
taaatgaagcagcttta

SEQ ID NO: 4910994 - DNA, 22 bp, Homo sapiens
taaatgaagcagctttaaacaa

SEQ ID NO: 4910995 - DNA, 14 bp, Homo sapiens
taaatgaatatttt

SEQ ID NO: 4910996 - DNA, 19 bp, Homo sapiens
taaatgcaaagttctgtgt

SEQ ID NO: 4910997 - DNA, 14 bp, Homo sapiens
taaatgcctagttt

SEQ ID NO: 4910998 - DNA, 17 bp, Homo sapiens
taaatgcctagttttta

SEQ ID NO: 4910999 - DNA, 20 bp, Homo sapiens
taaatgcctagtttttagta

SEQ ID NO: 4911000 - DNA, 17 bp, Homo sapiens
taaatgtatactatagt

SEQ ID NO: 4911001 - DNA, 20 bp, Homo sapiens
taaatgtatactatagtacc

SEQ ID NO: 4911002 - DNA, 17 bp, Homo sapiens
taaatgtatatacacat

SEQ ID NO: 4911003 - DNA, 22 bp, Homo sapiens
taaatgtctctttaatgtcaca

SEQ ID NO: 4911004 - DNA, 12 bp, Homo sapiens
taaatgtctgtt

SEQ ID NO: 4911005 - DNA, 14 bp, Homo sapiens
taaatgtctttgta

SEQ ID NO: 4911006 - DNA, 15 bp, Homo sapiens
taaatgtctttgtaa

SEQ ID NO: 4911007 - DNA, 16 bp, Homo sapiens
taaatgtctttgtaag

SEQ ID NO: 4911008 - DNA, 22 bp, Homo sapiens
taaatgtctttgtaagtcagtg

SEQ ID NO: 4911009 - DNA, 20 bp, Homo sapiens
taaatgttatgactatgtaa

SEQ ID NO: 4911010 - DNA, 23 bp, Homo sapiens
taaatgttatgactatgtaaact

SEQ ID NO: 4911011 - DNA, 21 bp, Homo sapiens
taaatgttatttctgcaaaca

SEQ ID NO: 4911012 - DNA, 13 bp, Homo sapiens
taaatgttctatg

SEQ ID NO: 4911013 - DNA, 22 bp, Homo sapiens
taaatgttctatggttatgaaa

SEQ ID NO: 4911014 - DNA, 19 bp, Homo sapiens
taaattaaagcctttagta

SEQ ID NO: 4911015 - DNA, 12 bp, Homo sapiens
taaattaagaca

SEQ ID NO: 4911016 - DNA, 13 bp, Homo sapiens
taaattaagacat

SEQ ID NO: 4911017 - DNA, 15 bp, Homo sapiens
taaattaagacatgc

SEQ ID NO: 4911018 - DNA, 23 bp, Homo sapiens
taaattaggaggctcaacaataa

SEQ ID NO: 4911019 - DNA, 18 bp, Homo sapiens
taaattatgtaatgcaaa

SEQ ID NO: 4911020 - DNA, 16 bp, Homo sapiens
taaattcacaaacttt

SEQ ID NO: 4911021 - DNA, 18 bp, Homo sapiens
taaattcacaaactttta

SEQ ID NO: 4911022 - DNA, 19 bp, Homo sapiens
taaattctgagacatgtgt

SEQ ID NO: 4911023 - DNA, 14 bp, Homo sapiens
taaatttaaagata

SEQ ID NO: 4911024 - DNA, 22 bp, Homo sapiens
taaatttaaagatattgttcaa

SEQ ID NO: 4911025 - DNA, 14 bp, Homo sapiens
taaatttaatgctg

SEQ ID NO: 4911026 - DNA, 16 bp, Homo sapiens
taaatttgatacttat

SEQ ID NO: 4911027 - DNA, 14 bp, Homo sapiens
taaatttgctagca

SEQ ID NO: 4911028 - DNA, 12 bp, Homo sapiens
taaatttgtaag

SEQ ID NO: 4911029 - DNA, 23 bp, Homo sapiens
taaatttgtaagtttcaggtgac

SEQ ID NO: 4911030 - DNA, 20 bp, Homo sapiens
taaattttgtctttaactca

SEQ ID NO: 4911031 - DNA, 18 bp, Homo sapiens
taacaaaagatgaaagca

SEQ ID NO: 4911032 - DNA, 11 bp, Homo sapiens
taacaaaatgg

SEQ ID NO: 4911033 - DNA, 12 bp, Homo sapiens
taacaaaatgga

SEQ ID NO: 4911034 - DNA, 15 bp, Homo sapiens
taacaagaaaatcaa

SEQ ID NO: 4911035 - DNA, 12 bp, Homo sapiens
taacaatgttaa

SEQ ID NO: 4911036 - DNA, 19 bp, Homo sapiens
taacaatgttaaggaaact

SEQ ID NO: 4911037 - DNA, 23 bp, Homo sapiens
taacaatgttaaggaaactctta

SEQ ID NO: 4911038 - DNA, 23 bp, Homo sapiens
taacacaagtcctgtgaatttct

SEQ ID NO: 4911039 - DNA, 23 bp, Homo sapiens
taacacccttccttctgtaaata

SEQ ID NO: 4911040 - DNA, 24 bp, Homo sapiens
taacacccttccttctgtaaatac

SEQ ID NO: 4911041 - DNA, 12 bp, Homo sapiens
taacagaacagc

SEQ ID NO: 4911042 - DNA, 19 bp, Homo sapiens
taacagaacagcttcaggt

SEQ ID NO: 4911043 - DNA, 21 bp, Homo sapiens
taacagaacagcttcaggtta

SEQ ID NO: 4911044 - DNA, 22 bp, Homo sapiens
taacagaacagcttcaggttat

SEQ ID NO: 4911045 - DNA, 13 bp, Homo sapiens
taacagatacatt

SEQ ID NO: 4911046 - DNA, 20 bp, Homo sapiens
taacaggcatttgttcactg

SEQ ID NO: 4911047 - DNA, 14 bp, Homo sapiens
taacaggtattttg

SEQ ID NO: 4911048 - DNA, 20 bp, Homo sapiens
taacaggtattttgtttctt

SEQ ID NO: 4911049 - DNA, 21 bp, Homo sapiens
taacagtcctaactggtatag

SEQ ID NO: 4911050 - DNA, 14 bp, Homo sapiens
taacagttcatgtt

SEQ ID NO: 4911051 - DNA, 20 bp, Homo sapiens
taacatatgtacataaattg

SEQ ID NO: 4911052 - DNA, 11 bp, Homo sapiens
taacatgggct

SEQ ID NO: 4911053 - DNA, 18 bp, Homo sapiens
taacatgggctcttcact

SEQ ID NO: 4911054 - DNA, 13 bp, Homo sapiens
taacattacctta

SEQ ID NO: 4911055 - DNA, 14 bp, Homo sapiens
taacattatttata

SEQ ID NO: 4911056 - DNA, 12 bp, Homo sapiens
taacattccaag

SEQ ID NO: 4911057 - DNA, 14 bp, Homo sapiens
taacattttgttct

SEQ ID NO: 4911058 - DNA, 15 bp, Homo sapiens
taacattttgttctt

SEQ ID NO: 4911059 - DNA, 22 bp, Homo sapiens
taacattttgttcttacacata

SEQ ID NO: 4911060 - DNA, 20 bp, Homo sapiens
taaccaaggaaatatatttt

SEQ ID NO: 4911061 - DNA, 15 bp, Homo sapiens
taaccagctgtaaca

SEQ ID NO: 4911062 - DNA, 14 bp, Homo sapiens
taaccatttgcact

SEQ ID NO: 4911063 - DNA, 12 bp, Homo sapiens
taacccaaggag

SEQ ID NO: 4911064 - DNA, 14 bp, Homo sapiens
taacccacttgtca

SEQ ID NO: 4911065 - DNA, 14 bp, Homo sapiens
taaccctacaccca

SEQ ID NO: 4911066 - DNA, 22 bp, Homo sapiens
taacctgactggttaacagcag

SEQ ID NO: 4911067 - DNA, 22 bp, Homo sapiens
taaccttgaatgctgccagtgt

SEQ ID NO: 4911068 - DNA, 19 bp, Homo sapiens
taacgtttttcctttaaaa

SEQ ID NO: 4911069 - DNA, 20 bp, Homo sapiens
taacgtttttcctttaaaaa

SEQ ID NO: 4911070 - DNA, 16 bp, Homo sapiens
taactaaatttgatac

SEQ ID NO: 4911071 - DNA, 20 bp, Homo sapiens
taactaaatttgatacttat

SEQ ID NO: 4911072 - DNA, 12 bp, Homo sapiens
aaaagacatgtt

SEQ ID NO: 4911073 - DNA, 17 bp, Homo sapiens
aaaagagaagaagaaaa

SEQ ID NO: 4911074 - DNA, 18 bp, Homo sapiens
aaaagagaagaagaaaaa

SEQ ID NO: 4911075 - DNA, 15 bp, Homo sapiens
aaaagaggagcactt

SEQ ID NO: 4911076 - DNA, 13 bp, Homo sapiens
aaaagattagcaa

SEQ ID NO: 4911077 - DNA, 13 bp, Homo sapiens
aaaagatttaagc

SEQ ID NO: 4911078 - DNA, 13 bp, Homo sapiens
aaaagcaaaataa

SEQ ID NO: 4911079 - DNA, 11 bp, Homo sapiens
aaaagcacctc

SEQ ID NO: 4911080 - DNA, 19 bp, Homo sapiens
aaaagcctgcaatttcata

SEQ ID NO: 4911081 - DNA, 17 bp, Homo sapiens
aaaagccttgtgtatat

SEQ ID NO: 4911082 - DNA, 18 bp, Homo sapiens
aaaagccttgtgtatatt

SEQ ID NO: 4911083 - DNA, 23 bp, Homo sapiens
aaaagctgatcataagtgaattt

SEQ ID NO: 4911084 - DNA, 13 bp, Homo sapiens
aaaagcttcttaa

SEQ ID NO: 4911085 - DNA, 20 bp, Homo sapiens
aaaagcttcttaattaattt

SEQ ID NO: 4911086 - DNA, 11 bp, Homo sapiens
aaaagctttat

SEQ ID NO: 4911087 - DNA, 18 bp, Homo sapiens
aaaagctttatgattttc

SEQ ID NO: 4911088 - DNA, 20 bp, Homo sapiens
aaaagctttatgattttcat

SEQ ID NO: 4911089 - DNA, 23 bp, Homo sapiens
aaaaggaaaagaaaaaaaaaaga

SEQ ID NO: 4911090 - DNA, 17 bp, Homo sapiens
aaaaggacatcagcaaa

SEQ ID NO: 4911091 - DNA, 17 bp, Homo sapiens
aaaaggatagtattttt

SEQ ID NO: 4911092 - DNA, 16 bp, Homo sapiens
aaaaggcaaatgtgta

SEQ ID NO: 4911093 - DNA, 14 bp, Homo sapiens
aaaaggcttgaagc

SEQ ID NO: 4911094 - DNA, 18 bp, Homo sapiens
aaaagggaagtagtcctt

SEQ ID NO: 4911095 - DNA, 12 bp, Homo sapiens
aaaagggtcaga

SEQ ID NO: 4911096 - DNA, 19 bp, Homo sapiens
aaaaggttcactaaagcag

SEQ ID NO: 4911097 - DNA, 12 bp, Homo sapiens
aaaagtaacttg

SEQ ID NO: 4911098 - DNA, 20 bp, Homo sapiens
aaaagtaggtttacattcat

SEQ ID NO: 4911099 - DNA, 15 bp, Homo sapiens
aaaagtattttgaag

SEQ ID NO: 4911100 - DNA, 15 bp, Homo sapiens
aaaagtcgttttcca

SEQ ID NO: 4911101 - DNA, 20 bp, Homo sapiens
aaaagtgaatgaaagattaa

SEQ ID NO: 4911102 - DNA, 13 bp, Homo sapiens
aaaagtgacacag

SEQ ID NO: 4911103 - DNA, 17 bp, Homo sapiens
aaaagtgggcttgattc

SEQ ID NO: 4911104 - DNA, 14 bp, Homo sapiens
aaaagtggggcaga

SEQ ID NO: 4911105 - DNA, 18 bp, Homo sapiens
aaaagtggggcagagcct

SEQ ID NO: 4911106 - DNA, 21 bp, Homo sapiens
aaaagtgtttatttttcatat

SEQ ID NO: 4911107 - DNA, 13 bp, Homo sapiens
aaaagttccaaga

SEQ ID NO: 4911108 - DNA, 17 bp, Homo sapiens
aaaagttccctgaaaca

SEQ ID NO: 4911109 - DNA, 13 bp, Homo sapiens
aaaagtttacaac

SEQ ID NO: 4911110 - DNA, 13 bp, Homo sapiens
aaaagtttcaatg

SEQ ID NO: 4911111 - DNA, 18 bp, Homo sapiens
aaaagtttcaatgtgatt

SEQ ID NO: 4911112 - DNA, 16 bp, Homo sapiens
aaaataaaaactattc

SEQ ID NO: 4911113 - DNA, 22 bp, Homo sapiens
aaaataaaaagtgacacagcag

SEQ ID NO: 4911114 - DNA, 13 bp, Homo sapiens
aaaataaaaatgg

SEQ ID NO: 4911115 - DNA, 12 bp, Homo sapiens
aaaataaagaca

SEQ ID NO: 4911116 - DNA, 20 bp, Homo sapiens
aaaataaagacaaccatatt

SEQ ID NO: 4911117 - DNA, 20 bp, Homo sapiens
aaaataaatagcttaaaatt

SEQ ID NO: 4911118 - DNA, 16 bp, Homo sapiens
aaaataacttcaagca

SEQ ID NO: 4911119 - DNA, 16 bp, Homo sapiens
aaaataagaatagaaa

SEQ ID NO: 4911120 - DNA, 22 bp, Homo sapiens
aaaataataatttttatattta

SEQ ID NO: 4911121 - DNA, 20 bp, Homo sapiens
aaaataattttaaacaaagg

SEQ ID NO: 4911122 - DNA, 18 bp, Homo sapiens
aaaatacatttaaaactt

SEQ ID NO: 4911123 - DNA, 15 bp, Homo sapiens
aaaatagcaatgcct

SEQ ID NO: 4911124 - DNA, 19 bp, Homo sapiens
aaaatagcttgtatagtgt

SEQ ID NO: 4911125 - DNA, 13 bp, Homo sapiens
aaaatataaaata

SEQ ID NO: 4911126 - DNA, 15 bp, Homo sapiens
aaaatataaacaaag

SEQ ID NO: 4911127 - DNA, 20 bp, Homo sapiens
aaaatatatatagtgctata

SEQ ID NO: 4911128 - DNA, 14 bp, Homo sapiens
aaaatatatttaat

SEQ ID NO: 4911129 - DNA, 15 bp, Homo sapiens
aaaatattcctgcat

SEQ ID NO: 4911130 - DNA, 11 bp, Homo sapiens
aaaatatttat

SEQ ID NO: 4911131 - DNA, 23 bp, Homo sapiens
aaaatatttattaaataaaatca

SEQ ID NO: 4911132 - DNA, 15 bp, Homo sapiens
aaaatatttgtacat

SEQ ID NO: 4911133 - DNA, 14 bp, Homo sapiens
aaaatcacaaaaat

SEQ ID NO: 4911134 - DNA, 14 bp, Homo sapiens
aaaatcatctattt

SEQ ID NO: 4911135 - DNA, 15 bp, Homo sapiens
aaaatcatctatttt

SEQ ID NO: 4911136 - DNA, 20 bp, Homo sapiens
aaaatccttgcttatgacat

SEQ ID NO: 4911137 - DNA, 15 bp, Homo sapiens
aaaatctaatattaa

SEQ ID NO: 4911138 - DNA, 23 bp, Homo sapiens
aaaatctaatattaaaaatatgg

SEQ ID NO: 4911139 - DNA, 12 bp, Homo sapiens
aaaatctgtcca

SEQ ID NO: 4911140 - DNA, 20 bp, Homo sapiens
aaaatcttggagaccctgca

SEQ ID NO: 4911141 - DNA, 18 bp, Homo sapiens
aaaatcttgtgctagaat

SEQ ID NO: 4911142 - DNA, 19 bp, Homo sapiens
aaaatcttgtgctagaata

SEQ ID NO: 4911143 - DNA, 15 bp, Homo sapiens
aaaatgaaatatttt

SEQ ID NO: 4911144 - DNA, 22 bp, Homo sapiens
aaaatgaatatctattaatata

SEQ ID NO: 4911145 - DNA, 15 bp, Homo sapiens
aaaatgacatctttt

SEQ ID NO: 4911146 - DNA, 14 bp, Homo sapiens
aaaatgactactta

SEQ ID NO: 4911147 - DNA, 16 bp, Homo sapiens
aaaatgaggacatgtt

SEQ ID NO: 4911148 - DNA, 12 bp, Homo sapiens
aaaatgcctttg

SEQ ID NO: 4911149 - DNA, 14 bp, Homo sapiens
aaaatggaactgtg

SEQ ID NO: 4911150 - DNA, 22 bp, Homo sapiens
aaaatggatattattagaaatt

SEQ ID NO: 4911151 - DNA, 22 bp, Homo sapiens
aaaatggtttattttgtattgt

SEQ ID NO: 4911152 - DNA, 19 bp, Homo sapiens
aaaatgtaaaggagtcaaa

SEQ ID NO: 4911153 - DNA, 11 bp, Homo sapiens
aaaatgtaaat

SEQ ID NO: 4911154 - DNA, 20 bp, Homo sapiens
aaactgttttgggtagctgc

SEQ ID NO: 4911155 - DNA, 17 bp, Homo sapiens
aaacttaacatatttac

SEQ ID NO: 4911156 - DNA, 20 bp, Homo sapiens
aaacttacctaagtgacatt

SEQ ID NO: 4911157 - DNA, 17 bp, Homo sapiens
aaacttcattctcgtga

SEQ ID NO: 4911158 - DNA, 20 bp, Homo sapiens
aaacttcttaaatatctttt

SEQ ID NO: 4911159 - DNA, 17 bp, Homo sapiens
aaacttcttgtcagaca

SEQ ID NO: 4911160 - DNA, 23 bp, Homo sapiens
aaacttcttgtcagacataaagc

SEQ ID NO: 4911161 - DNA, 14 bp, Homo sapiens
aaacttgaaaatat

SEQ ID NO: 4911162 - DNA, 19 bp, Homo sapiens
aaacttgactccatttcat

SEQ ID NO: 4911163 - DNA, 16 bp, Homo sapiens
aaacttgctgagctgt

SEQ ID NO: 4911164 - DNA, 15 bp, Homo sapiens
aaacttgtgaatgct

SEQ ID NO: 4911165 - DNA, 19 bp, Homo sapiens
aaacttgttattgtgaatg

SEQ ID NO: 4911166 - DNA, 22 bp, Homo sapiens
aaactttaaaaaatatttatta

SEQ ID NO: 4911167 - DNA, 13 bp, Homo sapiens
aaactttatacat

SEQ ID NO: 4911168 - DNA, 16 bp, Homo sapiens
aaactttatacattag

SEQ ID NO: 4911169 - DNA, 24 bp, Homo sapiens
aaacttttgtaaagaaatttacta

SEQ ID NO: 4911170 - DNA, 17 bp, Homo sapiens
aaactttttttcaatgt

SEQ ID NO: 4911171 - DNA, 12 bp, Homo sapiens
aaagaaaatttt

SEQ ID NO: 4911172 - DNA, 15 bp, Homo sapiens
aaagaaacagctttc

SEQ ID NO: 4911173 - DNA, 16 bp, Homo sapiens
aaagaaatgactaatt

SEQ ID NO: 4911174 - DNA, 17 bp, Homo sapiens
aaagaaatgtcttaatt

SEQ ID NO: 4911175 - DNA, 22 bp, Homo sapiens
aaagaaccaaaagttttcctga

SEQ ID NO: 4911176 - DNA, 12 bp, Homo sapiens
aaagaacttact

SEQ ID NO: 4911177 - DNA, 9 bp, Homo sapiens
aaagaagaa

SEQ ID NO: 4911178 - DNA, 16 bp, Homo sapiens
aaagaagaaagactct

SEQ ID NO: 4911179 - DNA, 17 bp, Homo sapiens
aaagaagaacttgcatg

SEQ ID NO: 4911180 - DNA, 10 bp, Homo sapiens
aaagaagaag

SEQ ID NO: 4911181 - DNA, 21 bp, Homo sapiens
aaagaagaagaagaagaaaag

SEQ ID NO: 4911182 - DNA, 11 bp, Homo sapiens
aaagaagaccg

SEQ ID NO: 4911183 - DNA, 17 bp, Homo sapiens
aaagaatatatttattt

SEQ ID NO: 4911184 - DNA, 14 bp, Homo sapiens
aaagacaagaaaat

SEQ ID NO: 4911185 - DNA, 17 bp, Homo sapiens
aaagacaccatttatct

SEQ ID NO: 4911186 - DNA, 17 bp, Homo sapiens
aaattgtgcttctcccc

SEQ ID NO: 4911187 - DNA, 13 bp, Homo sapiens
aaatttaaacatt

SEQ ID NO: 4911188 - DNA, 13 bp, Homo sapiens
aaatttaaagata

SEQ ID NO: 4911189 - DNA, 15 bp, Homo sapiens
aaatttaaagatatt

SEQ ID NO: 4911190 - DNA, 21 bp, Homo sapiens
aaatttaagtgcgtgtgtaga

SEQ ID NO: 4911191 - DNA, 13 bp, Homo sapiens
aaatttaatgctg

SEQ ID NO: 4911192 - DNA, 12 bp, Homo sapiens
aaatttaattct

SEQ ID NO: 4911193 - DNA, 12 bp, Homo sapiens
aaatttactata

SEQ ID NO: 4911194 - DNA, 16 bp, Homo sapiens
aaatttactttacaca

SEQ ID NO: 4911195 - DNA, 20 bp, Homo sapiens
aaatttatttaatgtgagtt

SEQ ID NO: 4911196 - DNA, 16 bp, Homo sapiens
aaatttcaaaagacat

SEQ ID NO: 4911197 - DNA, 21 bp, Homo sapiens
aaatttcaaaagacatgttgt

SEQ ID NO: 4911198 - DNA, 14 bp, Homo sapiens
aaatttgagactat

SEQ ID NO: 4911199 - DNA, 13 bp, Homo sapiens
aaatttgatactt

SEQ ID NO: 4911200 - DNA, 12 bp, Homo sapiens
aaatttgtaagt

SEQ ID NO: 4911201 - DNA, 13 bp, Homo sapiens
aaatttgtaagtt

SEQ ID NO: 4911202 - DNA, 14 bp, Homo sapiens
aaatttgtaagttt

SEQ ID NO: 4911203 - DNA, 20 bp, Homo sapiens
aaatttgtaagtttcaggtg

SEQ ID NO: 4911204 - DNA, 18 bp, Homo sapiens
aaatttgtgggttttttt

SEQ ID NO: 4911205 - DNA, 16 bp, Homo sapiens
aaattttattttgtgc

SEQ ID NO: 4911206 - DNA, 20 bp, Homo sapiens
aaattttctagactttctgt

SEQ ID NO: 4911207 - DNA, 12 bp, Homo sapiens
aaattttgcaaa

SEQ ID NO: 4911208 - DNA, 14 bp, Homo sapiens
aaattttgcaaata

SEQ ID NO: 4911209 - DNA, 18 bp, Homo sapiens
aaattttttttacatttt

SEQ ID NO: 4911210 - DNA, 17 bp, Homo sapiens
aaattttttttttaata

SEQ ID NO: 4911211 - DNA, 12 bp, Homo sapiens
aacaaaacaaaa

SEQ ID NO: 4911212 - DNA, 16 bp, Homo sapiens
aacaaaacaaaactat

SEQ ID NO: 4911213 - DNA, 9 bp, Homo sapiens
aacaaaact

SEQ ID NO: 4911214 - DNA, 14 bp, Homo sapiens
aacaaaactatact

SEQ ID NO: 4911215 - DNA, 17 bp, Homo sapiens
aacaaaactatacttga

SEQ ID NO: 4911216 - DNA, 13 bp, Homo sapiens
aacaaaagatgaa

SEQ ID NO: 4911217 - DNA, 12 bp, Homo sapiens
aacaaaagggtc

SEQ ID NO: 4911218 - DNA, 12 bp, Homo sapiens
aacaaaatagaa

SEQ ID NO: 4911219 - DNA, 19 bp, Homo sapiens
aacaaaatttgtttgaaat

SEQ ID NO: 4911220 - DNA, 16 bp, Homo sapiens
aacaaacaccttctta

SEQ ID NO: 4911221 - DNA, 19 bp, Homo sapiens
aacaaacaccttcttatta

SEQ ID NO: 4911222 - DNA, 20 bp, Homo sapiens
aacaaacattgtgttgacat

SEQ ID NO: 4911223 - DNA, 22 bp, Homo sapiens
aacaaacttttcaaggcttata

SEQ ID NO: 4911224 - DNA, 18 bp, Homo sapiens
aactgcaataacttctga

SEQ ID NO: 4911225 - DNA, 19 bp, Homo sapiens
aactgcaataacttctgac

SEQ ID NO: 4911226 - DNA, 14 bp, Homo sapiens
aactggaataagaa

SEQ ID NO: 4911227 - DNA, 15 bp, Homo sapiens
aactggaataagaag

SEQ ID NO: 4911228 - DNA, 21 bp, Homo sapiens
aactggaataagaagcaaata

SEQ ID NO: 4911229 - DNA, 14 bp, Homo sapiens
aactggaattaaaa

SEQ ID NO: 4911230 - DNA, 20 bp, Homo sapiens
aactggaattaaaaggatag

SEQ ID NO: 4911231 - DNA, 14 bp, Homo sapiens
aactggagtctgga

SEQ ID NO: 4911232 - DNA, 17 bp, Homo sapiens
aactgtaacgttttctt

SEQ ID NO: 4911233 - DNA, 18 bp, Homo sapiens
aactgtacatttaaaatt

SEQ ID NO: 4911234 - DNA, 20 bp, Homo sapiens
aactgtagataaagtggttt

SEQ ID NO: 4911235 - DNA, 14 bp, Homo sapiens
aactgtccagagag

SEQ ID NO: 4911236 - DNA, 19 bp, Homo sapiens
aactgtctttaaaagagag

SEQ ID NO: 4911237 - DNA, 19 bp, Homo sapiens
aactgtgaagtttacattg

SEQ ID NO: 4911238 - DNA, 15 bp, Homo sapiens
aactgtgttgtatta

SEQ ID NO: 4911239 - DNA, 17 bp, Homo sapiens
aactgtgttgtattaac

SEQ ID NO: 4911240 - DNA, 18 bp, Homo sapiens
aactgtgttgtattaaca

SEQ ID NO: 4911241 - DNA, 23 bp, Homo sapiens
aactgtgttgtattaacaaaagt

SEQ ID NO: 4911242 - DNA, 13 bp, Homo sapiens
aactgtttatatg

SEQ ID NO: 4911243 - DNA, 17 bp, Homo sapiens
aacttaaaaatgtaaat

SEQ ID NO: 4911244 - DNA, 18 bp, Homo sapiens
aacttaaaaatgtaaata

SEQ ID NO: 4911245 - DNA, 19 bp, Homo sapiens
aacttagtgtaatatacca

SEQ ID NO: 4911246 - DNA, 14 bp, Homo sapiens
aacttataaatcat

SEQ ID NO: 4911247 - DNA, 19 bp, Homo sapiens
aacttatcctaaaacaaat

SEQ ID NO: 4911248 - DNA, 17 bp, Homo sapiens
aacttatgtagatattt

SEQ ID NO: 4911249 - DNA, 16 bp, Homo sapiens
aacttcacaactaggc

SEQ ID NO: 4911250 - DNA, 12 bp, Homo sapiens
aacttcagcacc

SEQ ID NO: 4911251 - DNA, 21 bp, Homo sapiens
aacttcaggataataaagtgt

SEQ ID NO: 4911252 - DNA, 14 bp, Homo sapiens
aacttcatgtaact

SEQ ID NO: 4911253 - DNA, 12 bp, Homo sapiens
aacttcattctc

SEQ ID NO: 4911254 - DNA, 19 bp, Homo sapiens
aacttccaggtgttactgt

SEQ ID NO: 4911255 - DNA, 22 bp, Homo sapiens
aacttccaggtgttactgtaat

SEQ ID NO: 4911256 - DNA, 17 bp, Homo sapiens
aacttccccatcttcta

SEQ ID NO: 4911257 - DNA, 18 bp, Homo sapiens
aacttccccatcttctaa

SEQ ID NO: 4911258 - DNA, 11 bp, Homo sapiens
aacttccctga

SEQ ID NO: 4911259 - DNA, 16 bp, Homo sapiens
aacttctaatatattt

SEQ ID NO: 4911260 - DNA, 19 bp, Homo sapiens
aacttctcttgctttctat

SEQ ID NO: 4911261 - DNA, 15 bp, Homo sapiens
aacttcttaaatatc

SEQ ID NO: 4911262 - DNA, 17 bp, Homo sapiens
aacttcttaaatatctt

SEQ ID NO: 4911263 - DNA, 17 bp, Homo sapiens
aacttcttatggaattg

SEQ ID NO: 4911264 - DNA, 19 bp, Homo sapiens
aacttcttatggaattgat

SEQ ID NO: 4911265 - DNA, 18 bp, Homo sapiens
aacttcttgtcagacata

SEQ ID NO: 4911266 - DNA, 22 bp, Homo sapiens
aacttctttctatttgacttgt

SEQ ID NO: 4911267 - DNA, 15 bp, Homo sapiens
aacttctttgaattt

SEQ ID NO: 4911268 - DNA, 16 bp, Homo sapiens
aacttgactccatttc

SEQ ID NO: 4911269 - DNA, 22 bp, Homo sapiens
aacttgagatgtatgaaggctt

SEQ ID NO: 4911270 - DNA, 15 bp, Homo sapiens
aacttgatgcatgtg

SEQ ID NO: 4911271 - DNA, 15 bp, Homo sapiens
aacttgcatggagca

SEQ ID NO: 4911272 - DNA, 13 bp, Homo sapiens
aacttgtagctgt

SEQ ID NO: 4911273 - DNA, 23 bp, Homo sapiens
aacttgtagctgtaaaacgctgt

SEQ ID NO: 4911274 - DNA, 20 bp, Homo sapiens
aacttgtttgctgtgaacaa

SEQ ID NO: 4911275 - DNA, 15 bp, Homo sapiens
aactttaaaaaatat

SEQ ID NO: 4911276 - DNA, 17 bp, Homo sapiens
aactttaaaaaatattt

SEQ ID NO: 4911277 - DNA, 20 bp, Homo sapiens
aactttaattctctttcaaa

SEQ ID NO: 4911278 - DNA, 21 bp, Homo sapiens
aactttagaagtgcatttctg

SEQ ID NO: 4911279 - DNA, 22 bp, Homo sapiens
aactttagaagtgcatttctga

SEQ ID NO: 4911280 - DNA, 23 bp, Homo sapiens
aactttcccaggttctgtttatg

SEQ ID NO: 4911281 - DNA, 18 bp, Homo sapiens
aactttggagtcccctca

SEQ ID NO: 4911282 - DNA, 14 bp, Homo sapiens
aacttttatctatt

SEQ ID NO: 4911283 - DNA, 15 bp, Homo sapiens
aacttttgtaaagaa

SEQ ID NO: 4911284 - DNA, 18 bp, Homo sapiens
aacttttgtaaagaaatt

SEQ ID NO: 4911285 - DNA, 15 bp, Homo sapiens
aacttttttaaataa

SEQ ID NO: 4911286 - DNA, 19 bp, Homo sapiens
aacttttttaaataaactt

SEQ ID NO: 4911287 - DNA, 14 bp, Homo sapiens
aagaaaacaacttc

SEQ ID NO: 4911288 - DNA, 15 bp, Homo sapiens
aagaaaagagaagaa

SEQ ID NO: 4911289 - DNA, 13 bp, Homo sapiens
aagaaaagtattt

SEQ ID NO: 4911290 - DNA, 14 bp, Homo sapiens
aagaaaagtatttt

SEQ ID NO: 4911291 - DNA, 15 bp, Homo sapiens
aagaaaagtattttg

SEQ ID NO: 4911292 - DNA, 16 bp, Homo sapiens
aagaaaagtattttga

SEQ ID NO: 4911293 - DNA, 13 bp, Homo sapiens
aagataattgcta

SEQ ID NO: 4911294 - DNA, 19 bp, Homo sapiens
aagataattgttgaaattt

SEQ ID NO: 4911295 - DNA, 16 bp, Homo sapiens
aagatagatcctttta

SEQ ID NO: 4911296 - DNA, 13 bp, Homo sapiens
aagatatggagaa

SEQ ID NO: 4911297 - DNA, 15 bp, Homo sapiens
aagatatggagaatt

SEQ ID NO: 4911298 - DNA, 14 bp, Homo sapiens
aagatattgttcaa

SEQ ID NO: 4911299 - DNA, 15 bp, Homo sapiens
aagatcaaaataaaa

SEQ ID NO: 4911300 - DNA, 16 bp, Homo sapiens
aagatcccctcaggac

SEQ ID NO: 4911301 - DNA, 16 bp, Homo sapiens
aagatctataaagcga

SEQ ID NO: 4911302 - DNA, 23 bp, Homo sapiens
aagatctgcagggggtgtgtctg

SEQ ID NO: 4911303 - DNA, 21 bp, Homo sapiens
aagatctgttttgaaggcaaa

SEQ ID NO: 4911304 - DNA, 22 bp, Homo sapiens
aagatctgttttgaaggcaaaa

SEQ ID NO: 4911305 - DNA, 13 bp, Homo sapiens
aagatcttagatt

SEQ ID NO: 4911306 - DNA, 15 bp, Homo sapiens
aagatcttagattct

SEQ ID NO: 4911307 - DNA, 17 bp, Homo sapiens
aagatcttagattctct

SEQ ID NO: 4911308 - DNA, 23 bp, Homo sapiens
aagatgaaggagaggcaacatcc

SEQ ID NO: 4911309 - DNA, 20 bp, Homo sapiens
aagatgagattggcatggct

SEQ ID NO: 4911310 - DNA, 15 bp, Homo sapiens
aagatgatcagacct

SEQ ID NO: 4911311 - DNA, 23 bp, Homo sapiens
aagatgctccagcaacacagcct

SEQ ID NO: 4911312 - DNA, 14 bp, Homo sapiens
aagatggagtttct

SEQ ID NO: 4911313 - DNA, 21 bp, Homo sapiens
aagatggctcagagggggact

SEQ ID NO: 4911314 - DNA, 16 bp, Homo sapiens
aagatggctgtgcctc

SEQ ID NO: 4911315 - DNA, 23 bp, Homo sapiens
aagatggctgtgcctctgcctgt

SEQ ID NO: 4911316 - DNA, 21 bp, Homo sapiens
aagatgggaacgcagatgatc

SEQ ID NO: 4911317 - DNA, 17 bp, Homo sapiens
aagatgtacctggtgga

SEQ ID NO: 4911318 - DNA, 14 bp, Homo sapiens
aagatgtgatattc

SEQ ID NO: 4911319 - DNA, 21 bp, Homo sapiens
aagatgtgatattctaagact

SEQ ID NO: 4911320 - DNA, 17 bp, Homo sapiens
aagattaaacagatgat

SEQ ID NO: 4911321 - DNA, 11 bp, Homo sapiens
aagattagaag

SEQ ID NO: 4911322 - DNA, 17 bp, Homo sapiens
aagattatagattctaa

SEQ ID NO: 4911323 - DNA, 20 bp, Homo sapiens
aagattatagattctaaaga

SEQ ID NO: 4911324 - DNA, 12 bp, Homo sapiens
aagattctagat

SEQ ID NO: 4911325 - DNA, 14 bp, Homo sapiens
aagattctagatga

SEQ ID NO: 4911326 - DNA, 17 bp, Homo sapiens
aagattctatagttcta

SEQ ID NO: 4911327 - DNA, 20 bp, Homo sapiens
aagattcttctgtgtttata

SEQ ID NO: 4911328 - DNA, 21 bp, Homo sapiens
aagattgtaattaaaatgata

SEQ ID NO: 4911329 - DNA, 16 bp, Homo sapiens
aagatttccttgtgca

SEQ ID NO: 4911330 - DNA, 23 bp, Homo sapiens
aagattttctgggcctaaaggat

SEQ ID NO: 4911331 - DNA, 14 bp, Homo sapiens
aagatttttctcaa

SEQ ID NO: 4911332 - DNA, 11 bp, Homo sapiens
aagcaaaagaa

SEQ ID NO: 4911333 - DNA, 15 bp, Homo sapiens
aagcaaaagaaaaag

SEQ ID NO: 4911334 - DNA, 15 bp, Homo sapiens
aagcaaaataaaaac

SEQ ID NO: 4911335 - DNA, 16 bp, Homo sapiens
aagcaaaataaaaact

SEQ ID NO: 4911336 - DNA, 13 bp, Homo sapiens
aagcaaaatatta

SEQ ID NO: 4911337 - DNA, 20 bp, Homo sapiens
tcagctctctgtataaacat

SEQ ID NO: 4911338 - DNA, 22 bp, Homo sapiens
tcagctgaatgcctcctgtggg

SEQ ID NO: 4911339 - DNA, 23 bp, Homo sapiens
tcagctgaatgcctcctgtgggg

SEQ ID NO: 4911340 - DNA, 17 bp, Homo sapiens
tcagctgtcctccctcc

SEQ ID NO: 4911341 - DNA, 18 bp, Homo sapiens
tcagcttcatttgtgtca

SEQ ID NO: 4911342 - DNA, 15 bp, Homo sapiens
tcagcttcctaccca

SEQ ID NO: 4911343 - DNA, 19 bp, Homo sapiens
tcagcttcctacccacacc

SEQ ID NO: 4911344 - DNA, 23 bp, Homo sapiens
tcagcttcctacccacacctctg

SEQ ID NO: 4911345 - DNA, 15 bp, Homo sapiens
tcagctttcagggcc

SEQ ID NO: 4911346 - DNA, 16 bp, Homo sapiens
tcaggaacagaaggat

SEQ ID NO: 4911347 - DNA, 14 bp, Homo sapiens
tcaggaccttttga

SEQ ID NO: 4911348 - DNA, 19 bp, Homo sapiens
tcaggagtcccaaggaaag

SEQ ID NO: 4911349 - DNA, 15 bp, Homo sapiens
tctgttgtaagaata

SEQ ID NO: 4911350 - DNA, 17 bp, Homo sapiens
tctgttgtactatggaa

SEQ ID NO: 4911351 - DNA, 13 bp, Homo sapiens
tctgtttaaagtg

SEQ ID NO: 4911352 - DNA, 14 bp, Homo sapiens
tctgtttaagaaaa

SEQ ID NO: 4911353 - DNA, 19 bp, Homo sapiens
tctgtttaagaaaagtatt

SEQ ID NO: 4911354 - DNA, 20 bp, Homo sapiens
tctgtttaagaaaagtattt

SEQ ID NO: 4911355 - DNA, 23 bp, Homo sapiens
tctgtttatggccacatttaata

SEQ ID NO: 4911356 - DNA, 23 bp, Homo sapiens
tctgtttcaaggcactctagatt

SEQ ID NO: 4911357 - DNA, 17 bp, Homo sapiens
tctgttttgaaggcaaa

SEQ ID NO: 4911358 - DNA, 14 bp, Homo sapiens
tctgtttttctttt

SEQ ID NO: 4911359 - DNA, 23 bp, Homo sapiens
tcttaaaagttgtgattccagat

SEQ ID NO: 4911360 - DNA, 15 bp, Homo sapiens
tcttaaacttgtgaa

SEQ ID NO: 4911361 - DNA, 22 bp, Homo sapiens
tcttaaagaaacagctttcaag

SEQ ID NO: 4911362 - DNA, 23 bp, Homo sapiens
tcttaaagctgcctgtagttagg

SEQ ID NO: 4911363 - DNA, 22 bp, Homo sapiens
tcttaaataatgcttcagatat

SEQ ID NO: 4911364 - DNA, 13 bp, Homo sapiens
tcttaaatatctt

SEQ ID NO: 4911365 - DNA, 17 bp, Homo sapiens
tcttaaatatcttttat

SEQ ID NO: 4911366 - DNA, 14 bp, Homo sapiens
tcttaattaatttg

SEQ ID NO: 4911367 - DNA, 23 bp, Homo sapiens
tcttaattaatttgattaacaaa

SEQ ID NO: 4911368 - DNA, 22 bp, Homo sapiens
tcttacactgcctgtatacttt

SEQ ID NO: 4911369 - DNA, 15 bp, Homo sapiens
tcttacccaatttcc

SEQ ID NO: 4911370 - DNA, 22 bp, Homo sapiens
tcttaccctgtacatatgtaaa

SEQ ID NO: 4911371 - DNA, 23 bp, Homo sapiens
tcttacctgtatgtctccagtat

SEQ ID NO: 4911372 - DNA, 14 bp, Homo sapiens
tcttactaatgtaa

SEQ ID NO: 4911373 - DNA, 16 bp, Homo sapiens
tcttactaatgtaaaa

SEQ ID NO: 4911374 - DNA, 15 bp, Homo sapiens
tcttactcctcctct

SEQ ID NO: 4911375 - DNA, 18 bp, Homo sapiens
tcttactgtacctgttcc

SEQ ID NO: 4911376 - DNA, 23 bp, Homo sapiens
tcttactttcctttccccagccc

SEQ ID NO: 4911377 - DNA, 22 bp, Homo sapiens
tcttagcatagcttattattga

SEQ ID NO: 4911378 - DNA, 15 bp, Homo sapiens
tcttagctgtctgct

SEQ ID NO: 4911379 - DNA, 23 bp, Homo sapiens
tcttagctgtctgctcagacaga

SEQ ID NO: 4911380 - DNA, 16 bp, Homo sapiens
tcttagctttttaatt

SEQ ID NO: 4911381 - DNA, 17 bp, Homo sapiens
tcttagctttttaattg

SEQ ID NO: 4911382 - DNA, 21 bp, Homo sapiens
tcttagtttggattcttatgt

SEQ ID NO: 4911383 - DNA, 14 bp, Homo sapiens
tcttatacacattg

SEQ ID NO: 4911384 - DNA, 16 bp, Homo sapiens
tcttatagcactttga

SEQ ID NO: 4911385 - DNA, 20 bp, Homo sapiens
tcttatatatatttctttgt

SEQ ID NO: 4911386 - DNA, 23 bp, Homo sapiens
tcttatcaaggactctggtttct

SEQ ID NO: 4911387 - DNA, 20 bp, Homo sapiens
tcttatctcagtcatgcata

SEQ ID NO: 4911388 - DNA, 14 bp, Homo sapiens
tcttatgcaatttc

SEQ ID NO: 4911389 - DNA, 17 bp, Homo sapiens
tcttatggaattgattt

SEQ ID NO: 4911390 - DNA, 15 bp, Homo sapiens
tcttattatatatat

SEQ ID NO: 4911391 - DNA, 22 bp, Homo sapiens
tcttattgcaaaatagcatttg

SEQ ID NO: 4911392 - DNA, 18 bp, Homo sapiens
tcttattgcccacgctgg

SEQ ID NO: 4911393 - DNA, 16 bp, Homo sapiens
tcttcaaaaactgttt

SEQ ID NO: 4911394 - DNA, 14 bp, Homo sapiens
tcttcaaactgtga

SEQ ID NO: 4911395 - DNA, 21 bp, Homo sapiens
tcttcaacatcctgccagccc

SEQ ID NO: 4911396 - DNA, 22 bp, Homo sapiens
tcttcaacatcctgccagcccc

SEQ ID NO: 4911397 - DNA, 16 bp, Homo sapiens
tcttcaactgaccagc

SEQ ID NO: 4911398 - DNA, 15 bp, Homo sapiens
tcttcaccccggcag

SEQ ID NO: 4911399 - DNA, 20 bp, Homo sapiens
tcttcaccccggcaggccct

SEQ ID NO: 4911400 - DNA, 19 bp, Homo sapiens
tcttcacctaagtctctgt

SEQ ID NO: 4911401 - DNA, 22 bp, Homo sapiens
tcttcagactctcagcccagaa

SEQ ID NO: 4911402 - DNA, 19 bp, Homo sapiens
tcttcagcattccctccca

SEQ ID NO: 4911403 - DNA, 19 bp, Homo sapiens
tcttcagcgtaaaatggtg

SEQ ID NO: 4911404 - DNA, 16 bp, Homo sapiens
tcttcagtcagaaaac

SEQ ID NO: 4911405 - DNA, 22 bp, Homo sapiens
tcttcagtcagaaaactttaaa

SEQ ID NO: 4911406 - DNA, 22 bp, Homo sapiens
tcttcatactttttttcacagt

SEQ ID NO: 4911407 - DNA, 24 bp, Homo sapiens
tcttcatttcattgtatgatgtgt

SEQ ID NO: 4911408 - DNA, 14 bp, Homo sapiens
tcttccagggggaa

SEQ ID NO: 4911409 - DNA, 19 bp, Homo sapiens
tcttccctttccccagcat

SEQ ID NO: 4911410 - DNA, 15 bp, Homo sapiens
tcttccgcccctgcc

SEQ ID NO: 4911411 - DNA, 21 bp, Homo sapiens
tcttccgcccctgcctgccat

SEQ ID NO: 4911412 - DNA, 23 bp, Homo sapiens
tcttccgcccctgcctgccatgt

SEQ ID NO: 4911413 - DNA, 21 bp, Homo sapiens
tcttcctcacagtcccactgt

SEQ ID NO: 4911414 - DNA, 11 bp, Homo sapiens
tcttcctctgc

SEQ ID NO: 4911415 - DNA, 12 bp, Homo sapiens
tcttcctctgct

SEQ ID NO: 4911416 - DNA, 23 bp, Homo sapiens
tttttgaaaggcatgttcctctg

SEQ ID NO: 4911417 - DNA, 11 bp, Homo sapiens
tttttgaaatg

SEQ ID NO: 4911418 - DNA, 15 bp, Homo sapiens
tttttgaaatgaaat

SEQ ID NO: 4911419 - DNA, 17 bp, Homo sapiens
tttttgaaatgaaattt

SEQ ID NO: 4911420 - DNA, 21 bp, Homo sapiens
tttttgaaccatccacttaca

SEQ ID NO: 4911421 - DNA, 19 bp, Homo sapiens
tttttgaactaagaaactt

SEQ ID NO: 4911422 - DNA, 21 bp, Homo sapiens
tttttgggcagcaatttaaat

SEQ ID NO: 4911423 - DNA, 19 bp, Homo sapiens
tttttggtgattcaaatgg

SEQ ID NO: 4911424 - DNA, 19 bp, Homo sapiens
tttttgtagagccagggtc

SEQ ID NO: 4911425 - DNA, 12 bp, Homo sapiens
tttttgtcatca

SEQ ID NO: 4911426 - DNA, 20 bp, Homo sapiens
tttttgtgaaaatgtcaaag

SEQ ID NO: 4911427 - DNA, 20 bp, Homo sapiens
tttttgtttctgagaaaaga

SEQ ID NO: 4911428 - DNA, 13 bp, Homo sapiens
tttttgtttgatg

SEQ ID NO: 4911429 - DNA, 13 bp, Homo sapiens
ttttttaaaagaa

SEQ ID NO: 4911430 - DNA, 13 bp, Homo sapiens
ttttttcaatgtg

SEQ ID NO: 4911431 - DNA, 10 bp, Homo sapiens
ttttttgaag

SEQ ID NO: 4911432 - DNA, 13 bp, Homo sapiens
ttttttgtttgtt

SEQ ID NO: 4911433 - DNA, 12 bp, Homo sapiens
tttttttcaatg

SEQ ID NO: 4911434 - DNA, 14 bp, Homo sapiens
tttttttcaatgtg

SEQ ID NO: 4911435 - DNA, 10 bp, Homo sapiens
tttttttcca

SEQ ID NO: 4911436 - DNA, 12 bp, Homo sapiens
tttttttccatt

SEQ ID NO: 4911437 - DNA, 13 bp, Homo sapiens
tttttttcctttt

SEQ ID NO: 4911438 - DNA, 17 bp, Homo sapiens
tttgtatcttaaatttg

SEQ ID NO: 4911439 - DNA, 14 bp, Homo sapiens
tttgtattattgct

SEQ ID NO: 4911440 - DNA, 13 bp, Homo sapiens
tttgtattcaaaa

SEQ ID NO: 4911441 - DNA, 23 bp, Homo sapiens
tttgtattttgtgtgaccaactg

SEQ ID NO: 4911442 - DNA, 12 bp, Homo sapiens
tttgtcccaggt

SEQ ID NO: 4911443 - DNA, 18 bp, Homo sapiens
tttgtcccccaacttgag

SEQ ID NO: 4911444 - DNA, 21 bp, Homo sapiens
tttgtcgggcaccagccagcg

SEQ ID NO: 4911445 - DNA, 21 bp, Homo sapiens
tttgtctgtttgtttcaagaa

SEQ ID NO: 4911446 - DNA, 14 bp, Homo sapiens
tttgtcttatatat

SEQ ID NO: 4911447 - DNA, 20 bp, Homo sapiens
tttgtcttatatatatttct

SEQ ID NO: 4911448 - DNA, 23 bp, Homo sapiens
tttgtgaatggattggattattt

SEQ ID NO: 4911449 - DNA, 17 bp, Homo sapiens
tttgtgatttagaactg

SEQ ID NO: 4911450 - DNA, 14 bp, Homo sapiens
tttgtgctcattta

SEQ ID NO: 4911451 - DNA, 20 bp, Homo sapiens
tttgtgtgaccaactgtgtt

SEQ ID NO: 4911452 - DNA, 21 bp, Homo sapiens
tttgtgtgaccaactgtgttg

SEQ ID NO: 4911453 - DNA, 19 bp, Homo sapiens
tttgtgtgttgtcttgaaa

SEQ ID NO: 4911454 - DNA, 21 bp, Homo sapiens
tttgtgttgttggaaaaagtc

SEQ ID NO: 4911455 - DNA, 17 bp, Homo sapiens
tttgtgtttggtttaca

SEQ ID NO: 4911456 - DNA, 21 bp, Homo sapiens
tttgtgtttggtttacattta

SEQ ID NO: 4911457 - DNA, 16 bp, Homo sapiens
tttgttactgttcttg

SEQ ID NO: 4911458 - DNA, 18 bp, Homo sapiens
tttgttactgttcttgct

SEQ ID NO: 4911459 - DNA, 19 bp, Homo sapiens
tttgttactgttcttgctg

SEQ ID NO: 4911460 - DNA, 20 bp, Homo sapiens
tttgttactgttcttgctgc

SEQ ID NO: 4911461 - DNA, 21 bp, Homo sapiens
tttgttagatagctgcatgtg

SEQ ID NO: 4911462 - DNA, 16 bp, Homo sapiens
tttgttattgttttgt

SEQ ID NO: 4911463 - DNA, 17 bp, Homo sapiens
tttgttcaagttttggg

SEQ ID NO: 4911464 - DNA, 20 bp, Homo sapiens
tttgttcgcatggtcacaca

SEQ ID NO: 4911465 - DNA, 14 bp, Homo sapiens
tttgttcttacaca

SEQ ID NO: 4911466 - DNA, 14 bp, Homo sapiens
tttgttgctgtttt

SEQ ID NO: 4911467 - DNA, 15 bp, Homo sapiens
tttgttgtgtgtgca

SEQ ID NO: 4911468 - DNA, 17 bp, Homo sapiens
tttgtttctgagaaaag

SEQ ID NO: 4911469 - DNA, 21 bp, Homo sapiens
tttgtttggatgtaatttagg

SEQ ID NO: 4911470 - DNA, 12 bp, Homo sapiens
tttgtttgtctg

SEQ ID NO: 4911471 - DNA, 14 bp, Homo sapiens
tttgtttttcattc

SEQ ID NO: 4911472 - DNA, 14 bp, Homo sapiens
tttgtttttctcac

SEQ ID NO: 4911473 - DNA, 13 bp, Homo sapiens
tttgtttttgctt

SEQ ID NO: 4911474 - DNA, 16 bp, Homo sapiens
tttgtttttttccaac

SEQ ID NO: 4911475 - DNA, 15 bp, Homo sapiens
tttgtttttttgcca

SEQ ID NO: 4911476 - DNA, 14 bp, Homo sapiens
ttttaaaaatacat

SEQ ID NO: 4911477 - DNA, 23 bp, Homo sapiens
ttttaaaaatgtcctgcctttta

SEQ ID NO: 4911478 - DNA, 13 bp, Homo sapiens
ttttaaaacacat

SEQ ID NO: 4911479 - DNA, 13 bp, Homo sapiens
ttttaaaagaaat

SEQ ID NO: 4911480 - DNA, 13 bp, Homo sapiens
ttttaaaagtttc

SEQ ID NO: 4911481 - DNA, 15 bp, Homo sapiens
ttttaaaagtttcaa

SEQ ID NO: 4911482 - DNA, 18 bp, Homo sapiens
ttttaaaagtttcaatgt

SEQ ID NO: 4911483 - DNA, 13 bp, Homo sapiens
ttttaaacagtga

SEQ ID NO: 4911484 - DNA, 20 bp, Homo sapiens
ttttaaagatctgtaagtaa

SEQ ID NO: 4911485 - DNA, 16 bp, Homo sapiens
ttttaaaggctttttg

SEQ ID NO: 4911486 - DNA, 16 bp, Homo sapiens
ttttaaaggtggattt

SEQ ID NO: 4911487 - DNA, 18 bp, Homo sapiens
ttttaaagtgtttcagct

SEQ ID NO: 4911488 - DNA, 13 bp, Homo sapiens
ttttaaataaact

SEQ ID NO: 4911489 - DNA, 22 bp, Homo sapiens
ttttaaataaactttttttcaa

SEQ ID NO: 4911490 - DNA, 14 bp, Homo sapiens
ttttaaatctaaat

SEQ ID NO: 4911491 - DNA, 19 bp, Homo sapiens
ttttaaatgcataaatgca

SEQ ID NO: 4911492 - DNA, 12 bp, Homo sapiens
ttttaaattgtt

SEQ ID NO: 4911493 - DNA, 14 bp, Homo sapiens
ttttaacattttgt

SEQ ID NO: 4911494 - DNA, 11 bp, Homo sapiens
ttttaagaaat

SEQ ID NO: 4911495 - DNA, 16 bp, Homo sapiens
ttttaagaaatgtagt

SEQ ID NO: 4911496 - DNA, 23 bp, Homo sapiens
ttttaagggtttgtggaaaatga

SEQ ID NO: 4911497 - DNA, 14 bp, Homo sapiens
ttttaagtaatgtg

SEQ ID NO: 4911498 - DNA, 15 bp, Homo sapiens
ttttaagtaatgtgg

SEQ ID NO: 4911499 - DNA, 15 bp, Homo sapiens
ttttaagtatttagg

SEQ ID NO: 4911500 - DNA, 15 bp, Homo sapiens
ttttaataaactact

SEQ ID NO: 4911501 - DNA, 21 bp, Homo sapiens
ttttaataaactactctttga

SEQ ID NO: 4911502 - DNA, 21 bp, Homo sapiens
ttttaatagtcattccaaata

SEQ ID NO: 4911503 - DNA, 17 bp, Homo sapiens
ttttaatggcagcagaa

SEQ ID NO: 4911504 - DNA, 18 bp, Homo sapiens
ttttaatgtgatgatgta

SEQ ID NO: 4911505 - DNA, 19 bp, Homo sapiens
ttttaattccaatatgatg

SEQ ID NO: 4911506 - DNA, 22 bp, Homo sapiens
ttttaattccaatatgatgact

SEQ ID NO: 4911507 - DNA, 12 bp, Homo sapiens
ttttaattgtca

SEQ ID NO: 4911508 - DNA, 19 bp, Homo sapiens
ttttacaaaaaagaaaaga

SEQ ID NO: 4911509 - DNA, 17 bp, Homo sapiens
ttttacaagaagtttat

SEQ ID NO: 4911510 - DNA, 15 bp, Homo sapiens
ttttacacagaaaca

SEQ ID NO: 4911511 - DNA, 18 bp, Homo sapiens
ttttacataactgccttg

SEQ ID NO: 4911512 - DNA, 19 bp, Homo sapiens
ttttacctgtcacattgca

SEQ ID NO: 4911513 - DNA, 22 bp, Homo sapiens
ttttactaccaatgccaagata

SEQ ID NO: 4911514 - DNA, 17 bp, Homo sapiens
ttttactcattgaaatg

SEQ ID NO: 4911515 - DNA, 17 bp, Homo sapiens
ttttagagactatggag

SEQ ID NO: 4911516 - DNA, 20 bp, Homo sapiens
ttttaggaaaatcactttgt

SEQ ID NO: 4911517 - DNA, 15 bp, Homo sapiens
ttttaggcactctta

SEQ ID NO: 4911518 - DNA, 18 bp, Homo sapiens
ttttaggttctaaagttc

SEQ ID NO: 4911519 - DNA, 23 bp, Homo sapiens
ttttaggttctaaagttctaaga

SEQ ID NO: 4911520 - DNA, 19 bp, Homo sapiens
ttttagtaatctgtacatt

SEQ ID NO: 4911521 - DNA, 13 bp, Homo sapiens
ttttagtccaaat

SEQ ID NO: 4911522 - DNA, 17 bp, Homo sapiens
ttttataaaattttgct

SEQ ID NO: 4911523 - DNA, 14 bp, Homo sapiens
ttttatacaaacct

SEQ ID NO: 4911524 - DNA, 15 bp, Homo sapiens
ttttatagtggaaaa

SEQ ID NO: 4911525 - DNA, 17 bp, Homo sapiens
ttttatatttgtatcga

SEQ ID NO: 4911526 - DNA, 14 bp, Homo sapiens
ttttatctgtttaa

SEQ ID NO: 4911527 - DNA, 18 bp, Homo sapiens
ttttatgagcttccaagg

SEQ ID NO: 4911528 - DNA, 15 bp, Homo sapiens
ttttatgatatccct

SEQ ID NO: 4911529 - DNA, 15 bp, Homo sapiens
ttttatgatgatgaa

SEQ ID NO: 4911530 - DNA, 14 bp, Homo sapiens
ttttattattgtgg

SEQ ID NO: 4911531 - DNA, 15 bp, Homo sapiens
ttttattatttctat

SEQ ID NO: 4911532 - DNA, 18 bp, Homo sapiens
ttttattcctgtatgttg

SEQ ID NO: 4911533 - DNA, 19 bp, Homo sapiens
ttttattgctagtatttga

SEQ ID NO: 4911534 - DNA, 14 bp, Homo sapiens
ttttatttatatgt

SEQ ID NO: 4911535 - DNA, 11 bp, Homo sapiens
ttttattttac

SEQ ID NO: 4911536 - DNA, 18 bp, Homo sapiens
ttttatttttagacagag

SEQ ID NO: 4911537 - DNA, 20 bp, Homo sapiens
ttttcaaaatccaaaaagaa

SEQ ID NO: 4911538 - DNA, 17 bp, Homo sapiens
ttttcaacgcagccctg

SEQ ID NO: 4911539 - DNA, 18 bp, Homo sapiens
ttttcaaggcttatattc

SEQ ID NO: 4911540 - DNA, 20 bp, Homo sapiens
ttttcacaatgtcagtattt

SEQ ID NO: 4911541 - DNA, 19 bp, Homo sapiens
ttttcactgctggctgcct

SEQ ID NO: 4911542 - DNA, 20 bp, Homo sapiens
ttttcactgctggctgcctt

SEQ ID NO: 4911543 - DNA, 16 bp, Homo sapiens
ttttcagaaaatatta

SEQ ID NO: 4911544 - DNA, 18 bp, Homo sapiens
ttttcagaacctcttccc

SEQ ID NO: 4911545 - DNA, 22 bp, Homo sapiens
ttttcagaacctcttccccaga

SEQ ID NO: 4911546 - DNA, 16 bp, Homo sapiens
ttttcagtattttgga

SEQ ID NO: 4911547 - DNA, 13 bp, Homo sapiens
ttttcataactta

SEQ ID NO: 4911548 - DNA, 15 bp, Homo sapiens
ttttcataacttatt

SEQ ID NO: 4911549 - DNA, 18 bp, Homo sapiens
ttttcatacttttacctt

SEQ ID NO: 4911550 - DNA, 16 bp, Homo sapiens
tcttttatatttgtat

SEQ ID NO: 4911551 - DNA, 16 bp, Homo sapiens
tcttttatgtttgaat

SEQ ID NO: 4911552 - DNA, 15 bp, Homo sapiens
tcttttctcatgtgt

SEQ ID NO: 4911553 - DNA, 16 bp, Homo sapiens
tcttttctctttttag

SEQ ID NO: 4911554 - DNA, 15 bp, Homo sapiens
tcttttcttggcaaa

SEQ ID NO: 4911555 - DNA, 22 bp, Homo sapiens
tcttttcttggcaaaagccttg

SEQ ID NO: 4911556 - DNA, 17 bp, Homo sapiens
tcttttctttttacata

SEQ ID NO: 4911557 - DNA, 10 bp, Homo sapiens
tcttttgtaa

SEQ ID NO: 4911558 - DNA, 11 bp, Homo sapiens
tcttttgtaag

SEQ ID NO: 4911559 - DNA, 12 bp, Homo sapiens
tcttttgttact

SEQ ID NO: 4911560 - DNA, 13 bp, Homo sapiens
tcttttgttactg

SEQ ID NO: 4911561 - DNA, 21 bp, Homo sapiens
tcttttgttactgttcttgct

SEQ ID NO: 4911562 - DNA, 23 bp, Homo sapiens
tcttttgttactgttcttgctgc

SEQ ID NO: 4911563 - DNA, 20 bp, Homo sapiens
tcttttgttcgcatggtcac

SEQ ID NO: 4911564 - DNA, 19 bp, Homo sapiens
tctttttaagtaatgtgga

SEQ ID NO: 4911565 - DNA, 20 bp, Homo sapiens
tctttttacataactgcctt

SEQ ID NO: 4911566 - DNA, 15 bp, Homo sapiens
tctttttctgttgta

SEQ ID NO: 4911567 - DNA, 16 bp, Homo sapiens
tctttttctgttgtaa

SEQ ID NO: 4911568 - DNA, 17 bp, Homo sapiens
tctttttctgttgtaac

SEQ ID NO: 4911569 - DNA, 15 bp, Homo sapiens
tcttttttaaaatca

SEQ ID NO: 4911570 - DNA, 14 bp, Homo sapiens
tcttttttactcat

SEQ ID NO: 4911571 - DNA, 15 bp, Homo sapiens
tcttttttactcatt

SEQ ID NO: 4911572 - DNA, 20 bp, Homo sapiens
tcttttttactcattgaaat

SEQ ID NO: 4911573 - DNA, 16 bp, Homo sapiens
tctttttttgtgatgt

SEQ ID NO: 4911574 - DNA, 16 bp, Homo sapiens
tgaaaaaaagtttaca

SEQ ID NO: 4911575 - DNA, 12 bp, Homo sapiens
tgaaaaaagctc

SEQ ID NO: 4911576 - DNA, 14 bp, Homo sapiens
tgaaaaaagctcat

SEQ ID NO: 4911577 - DNA, 17 bp, Homo sapiens
tgaaaaacaacaacaca

SEQ ID NO: 4911578 - DNA, 21 bp, Homo sapiens
tgaaaaccaaaatgacatctt

SEQ ID NO: 4911579 - DNA, 21 bp, Homo sapiens
tgaaaaccatctggcctggcc

SEQ ID NO: 4911580 - DNA, 18 bp, Homo sapiens
tgaaaacctaaaagacag

SEQ ID NO: 4911581 - DNA, 20 bp, Homo sapiens
tgaaaacggagctgaacaat

SEQ ID NO: 4911582 - DNA, 19 bp, Homo sapiens
tgaaaactcattacttttc

SEQ ID NO: 4911583 - DNA, 12 bp, Homo sapiens
tgaaaactggaa

SEQ ID NO: 4911584 - DNA, 14 bp, Homo sapiens
tgaaaactggaata

SEQ ID NO: 4911585 - DNA, 23 bp, Homo sapiens
tgaaaactggaataagaagcaaa

SEQ ID NO: 4911586 - DNA, 20 bp, Homo sapiens
tttgagggactgcctctgcc

SEQ ID NO: 4911587 - DNA, 20 bp, Homo sapiens
tttgagtagatattacttta

SEQ ID NO: 4911588 - DNA, 15 bp, Homo sapiens
tttgataactgttta

SEQ ID NO: 4911589 - DNA, 14 bp, Homo sapiens
tttgataatgttaa

SEQ ID NO: 4911590 - DNA, 15 bp, Homo sapiens
tttgatacataataa

SEQ ID NO: 4911591 - DNA, 17 bp, Homo sapiens
tttgatacccctgggga

SEQ ID NO: 4911592 - DNA, 13 bp, Homo sapiens
tttgatacttata

SEQ ID NO: 4911593 - DNA, 19 bp, Homo sapiens
tttgatatgagtatacaat

SEQ ID NO: 4911594 - DNA, 15 bp, Homo sapiens
tttgatgctgtttga

SEQ ID NO: 4911595 - DNA, 15 bp, Homo sapiens
tttgattcatagtaa

SEQ ID NO: 4911596 - DNA, 20 bp, Homo sapiens
tttgattcatagtaacttct

SEQ ID NO: 4911597 - DNA, 17 bp, Homo sapiens
tttgatttacagcaagt

SEQ ID NO: 4911598 - DNA, 18 bp, Homo sapiens
tttgatttccaagtaata

SEQ ID NO: 4911599 - DNA, 20 bp, Homo sapiens
tttgatttccaagtaatata

SEQ ID NO: 4911600 - DNA, 17 bp, Homo sapiens
tttgcacgacgccctct

SEQ ID NO: 4911601 - DNA, 21 bp, Homo sapiens
tttgcacgacgccctctcccc

SEQ ID NO: 4911602 - DNA, 20 bp, Homo sapiens
tttgcactaaatcagagaca

SEQ ID NO: 4911603 - DNA, 21 bp, Homo sapiens
tttgcacttgtgattatttat

SEQ ID NO: 4911604 - DNA, 21 bp, Homo sapiens
tttgccactaattttagtatt

SEQ ID NO: 4911605 - DNA, 13 bp, Homo sapiens
tttgccatacatc

SEQ ID NO: 4911606 - DNA, 18 bp, Homo sapiens
tttgccatgttggccagg

SEQ ID NO: 4911607 - DNA, 14 bp, Homo sapiens
tttgccatttgata

SEQ ID NO: 4911608 - DNA, 21 bp, Homo sapiens
tttgcctcctgtgtactgtgt

SEQ ID NO: 4911609 - DNA, 19 bp, Homo sapiens
tttgcctgcctggtgtgcc

SEQ ID NO: 4911610 - DNA, 22 bp, Homo sapiens
tttgccttcctttctccaggac

SEQ ID NO: 4911611 - DNA, 14 bp, Homo sapiens
tttgccttgcagaa

SEQ ID NO: 4911612 - DNA, 16 bp, Homo sapiens
tttgccttgcagaact

SEQ ID NO: 4911613 - DNA, 23 bp, Homo sapiens
tttgctcttgtttttattaattt

SEQ ID NO: 4911614 - DNA, 21 bp, Homo sapiens
tttgctgatttcccctcttcc

SEQ ID NO: 4911615 - DNA, 14 bp, Homo sapiens
tttgctgtgaacaa

SEQ ID NO: 4911616 - DNA, 12 bp, Homo sapiens
tttgcttagaaa

SEQ ID NO: 4911617 - DNA, 20 bp, Homo sapiens
tttgcttcattgtactacct

SEQ ID NO: 4911618 - DNA, 11 bp, Homo sapiens
tttggaatgtg

SEQ ID NO: 4911619 - DNA, 20 bp, Homo sapiens
tttggaccaatagcccacag

SEQ ID NO: 4911620 - DNA, 15 bp, Homo sapiens
tttggactttgtata
